United States Patent 11,421,016 (CANCER NEOEPITOPES) - sequence listing, part 8

SEQ ID NO: 323669 - protein, 9 aa, Homo Sapiens
DDTDRLVPD

SEQ ID NO: 323670 - protein, 9 aa, Homo Sapiens
SPEVESGPQ

SEQ ID NO: 323671 - protein, 9 aa, Homo Sapiens
QQDTLTWNN

SEQ ID NO: 323672 - protein, 9 aa, Homo Sapiens
SANSAQSNA

SEQ ID NO: 323673 - protein, 9 aa, Homo Sapiens
LLSDITCCT

SEQ ID NO: 323674 - protein, 9 aa, Homo Sapiens
LVVSKELCM

SEQ ID NO: 323675 - protein, 9 aa, Homo Sapiens
IYVYIKRKT

SEQ ID NO: 323676 - protein, 9 aa, Homo Sapiens
VSPSTLPSH

SEQ ID NO: 323677 - protein, 9 aa, Homo Sapiens
QEGEGCLGK

SEQ ID NO: 323678 - protein, 9 aa, Homo Sapiens
GYMYCGSCA

SEQ ID NO: 323679 - protein, 9 aa, Homo Sapiens
CCKSLGRFP

SEQ ID NO: 323680 - protein, 9 aa, Homo Sapiens
RGLLHPPQL

SEQ ID NO: 323681 - protein, 9 aa, Homo Sapiens
TFISGPQYQ

SEQ ID NO: 323682 - protein, 9 aa, Homo Sapiens
EEGFTPPED

SEQ ID NO: 323683 - protein, 9 aa, Homo Sapiens
LDHKFNLMY

SEQ ID NO: 323684 - protein, 9 aa, Homo Sapiens
FYKLVDPEQ

SEQ ID NO: 323685 - protein, 9 aa, Homo Sapiens
PPMRPVQPV

SEQ ID NO: 323686 - protein, 9 aa, Homo Sapiens
PYARKEPSL

SEQ ID NO: 323687 - protein, 9 aa, Homo Sapiens
HAAVGVLVS

SEQ ID NO: 323688 - protein, 9 aa, Homo Sapiens
WRKEDGERS

SEQ ID NO: 323689 - protein, 9 aa, Homo Sapiens
NLSPTLRYT

SEQ ID NO: 323690 - protein, 9 aa, Homo Sapiens
AVAMQGRYG

SEQ ID NO: 323691 - protein, 9 aa, Homo Sapiens
YCMGNVLSS

SEQ ID NO: 323692 - protein, 9 aa, Homo Sapiens
AHGRTGTGT

SEQ ID NO: 323693 - protein, 9 aa, Homo Sapiens
VYQDQNKYK

SEQ ID NO: 323694 - protein, 9 aa, Homo Sapiens
KSCAVKNEG

SEQ ID NO: 323695 - protein, 9 aa, Homo Sapiens
RGEAPCTVT

SEQ ID NO: 323696 - protein, 9 aa, Homo Sapiens
FTPRVIGTS

SEQ ID NO: 323697 - protein, 9 aa, Homo Sapiens
TLGQPLPDM

SEQ ID NO: 323698 - protein, 9 aa, Homo Sapiens
ACGANSYEM

SEQ ID NO: 323699 - protein, 9 aa, Homo Sapiens
LSTVQLTAR

SEQ ID NO: 323700 - protein, 9 aa, Homo Sapiens
ELLYHTDFF

SEQ ID NO: 323701 - protein, 9 aa, Homo Sapiens
RGEQSDCPV

SEQ ID NO: 323702 - protein, 9 aa, Homo Sapiens
TITEFQTTI

SEQ ID NO: 323703 - protein, 9 aa, Homo Sapiens
GSRASPDNL

SEQ ID NO: 323704 - protein, 9 aa, Homo Sapiens
RFWRKRAEF

SEQ ID NO: 323705 - protein, 9 aa, Homo Sapiens
REESSRMEI

SEQ ID NO: 323706 - protein, 9 aa, Homo Sapiens
VLAPILLDN

SEQ ID NO: 323707 - protein, 9 aa, Homo Sapiens
KKKEKQKKM

SEQ ID NO: 323708 - protein, 9 aa, Homo Sapiens
STTCELYLE

SEQ ID NO: 323709 - protein, 9 aa, Homo Sapiens
RCFLFTVTL

SEQ ID NO: 323710 - protein, 9 aa, Homo Sapiens
GNVATGDLI

SEQ ID NO: 323711 - protein, 9 aa, Homo Sapiens
RWKPLQTVR

SEQ ID NO: 323712 - protein, 9 aa, Homo Sapiens
ILTPSEAPN

SEQ ID NO: 323713 - protein, 9 aa, Homo Sapiens
VHFQASEDT

SEQ ID NO: 323714 - protein, 9 aa, Homo Sapiens
MDLPPNKDV

SEQ ID NO: 323715 - protein, 9 aa, Homo Sapiens
FNHFDWDHS

SEQ ID NO: 323716 - protein, 9 aa, Homo Sapiens
IRYIDNQAV

SEQ ID NO: 323717 - protein, 9 aa, Homo Sapiens
ANSQVKKTK

SEQ ID NO: 323718 - protein, 9 aa, Homo Sapiens
LVFAVSWMS

SEQ ID NO: 323719 - protein, 9 aa, Homo Sapiens
TQMGNQQEP

SEQ ID NO: 323720 - protein, 9 aa, Homo Sapiens
ILCRSVSMV

SEQ ID NO: 323721 - protein, 9 aa, Homo Sapiens
HTSMRGLKR

SEQ ID NO: 323722 - protein, 9 aa, Homo Sapiens
KCLNNRFTS

SEQ ID NO: 323723 - protein, 9 aa, Homo Sapiens
EQSKGRIQR

SEQ ID NO: 323724 - protein, 9 aa, Homo Sapiens
KIQAVIDVG

SEQ ID NO: 323725 - protein, 9 aa, Homo Sapiens
LHCMDILFT

SEQ ID NO: 323726 - protein, 9 aa, Homo Sapiens
LTPTGVIVF

SEQ ID NO: 323727 - protein, 9 aa, Homo Sapiens
RHDDTRVHT

SEQ ID NO: 323728 - protein, 9 aa, Homo Sapiens
EQLLALCIT

SEQ ID NO: 323729 - protein, 9 aa, Homo Sapiens
TITGIYIAL

SEQ ID NO: 323730 - protein, 9 aa, Homo Sapiens
NKASILQKR

SEQ ID NO: 323731 - protein, 9 aa, Homo Sapiens
TLWAKPPSE

SEQ ID NO: 323732 - protein, 9 aa, Homo Sapiens
ENTGSTLEW

SEQ ID NO: 323733 - protein, 9 aa, Homo Sapiens
CGGRERRDR

SEQ ID NO: 323734 - protein, 9 aa, Homo Sapiens
ATVNMDGTT

SEQ ID NO: 323735 - protein, 9 aa, Homo Sapiens
EQIPHGCIL

SEQ ID NO: 323736 - protein, 9 aa, Homo Sapiens
VIVFEGDTK

SEQ ID NO: 323737 - protein, 9 aa, Homo Sapiens
FLVTGLMFL

SEQ ID NO: 323738 - protein, 9 aa, Homo Sapiens
CMSLRPSER

SEQ ID NO: 323739 - protein, 9 aa, Homo Sapiens
EEQALSNLG

SEQ ID NO: 323740 - protein, 9 aa, Homo Sapiens
HRSPMPGSL

SEQ ID NO: 323741 - protein, 9 aa, Homo Sapiens
LLDNFSTPT

SEQ ID NO: 323742 - protein, 9 aa, Homo Sapiens
KTIDDLEEC

SEQ ID NO: 323743 - protein, 9 aa, Homo Sapiens
PLSSNLRWL

SEQ ID NO: 323744 - protein, 9 aa, Homo Sapiens
AGADEDFQV

SEQ ID NO: 323745 - protein, 9 aa, Homo Sapiens
TVKNDTIKY

SEQ ID NO: 323746 - protein, 9 aa, Homo Sapiens
HCEESGRHV

SEQ ID NO: 323747 - protein, 9 aa, Homo Sapiens
DIDALKQSL

SEQ ID NO: 323748 - protein, 9 aa, Homo Sapiens
APRLDRKKC

SEQ ID NO: 323749 - protein, 9 aa, Homo Sapiens
GCVGDSPIP

SEQ ID NO: 323750 - protein, 9 aa, Homo Sapiens
LVFVTKPNS

SEQ ID NO: 323751 - protein, 9 aa, Homo Sapiens
FLRTDRGTV

SEQ ID NO: 323752 - protein, 9 aa, Homo Sapiens
TLQAERSWV

SEQ ID NO: 323753 - protein, 9 aa, Homo Sapiens
HEEGSQLAS

SEQ ID NO: 323754 - protein, 9 aa, Homo Sapiens
PPLSTTVTL

SEQ ID NO: 323755 - protein, 9 aa, Homo Sapiens
HKVEMLKPH

SEQ ID NO: 323756 - protein, 9 aa, Homo Sapiens
VDTDAADAA

SEQ ID NO: 323757 - protein, 9 aa, Homo Sapiens
HYELSSIQV

SEQ ID NO: 323758 - protein, 9 aa, Homo Sapiens
RAGAKSRSK

SEQ ID NO: 323759 - protein, 9 aa, Homo Sapiens
ACCGGRVSL

SEQ ID NO: 323760 - protein, 9 aa, Homo Sapiens
EIHLVMIQL

SEQ ID NO: 323761 - protein, 9 aa, Homo Sapiens
DLDLSDPMW

SEQ ID NO: 323762 - protein, 9 aa, Homo Sapiens
GGSSPIPLP

SEQ ID NO: 323763 - protein, 9 aa, Homo Sapiens
NSPLGDLLQ

SEQ ID NO: 323764 - protein, 9 aa, Homo Sapiens
PEFGGAMGL

SEQ ID NO: 323765 - protein, 9 aa, Homo Sapiens
LQIQHWLFK

SEQ ID NO: 323766 - protein, 9 aa, Homo Sapiens
KCSLYGKKL

SEQ ID NO: 323767 - protein, 9 aa, Homo Sapiens
RVCYYQSLQ

SEQ ID NO: 323768 - protein, 9 aa, Homo Sapiens
VHCMHLHEK

SEQ ID NO: 323769 - protein, 9 aa, Homo Sapiens
PEGATNMGT

SEQ ID NO: 323770 - protein, 9 aa, Homo Sapiens
GWVGPNGCI

SEQ ID NO: 323771 - protein, 9 aa, Homo Sapiens
MFSGLQGAI

SEQ ID NO: 323772 - protein, 9 aa, Homo Sapiens
RPRRGPLPR

SEQ ID NO: 323773 - protein, 9 aa, Homo Sapiens
GMDKRVTRF

SEQ ID NO: 323774 - protein, 9 aa, Homo Sapiens
NYCGVHASE

SEQ ID NO: 323775 - protein, 9 aa, Homo Sapiens
YWPLRGKCE

SEQ ID NO: 323776 - protein, 9 aa, Homo Sapiens
FMTSPTDAD

SEQ ID NO: 323777 - protein, 9 aa, Homo Sapiens
ETDITQGVP

SEQ ID NO: 323778 - protein, 9 aa, Homo Sapiens
SSAAASPRP

SEQ ID NO: 323779 - protein, 9 aa, Homo Sapiens
KSKLEEVLN

SEQ ID NO: 323780 - protein, 9 aa, Homo Sapiens
EWNLSTVGR

SEQ ID NO: 323781 - protein, 9 aa, Homo Sapiens
SSRAVMGVM

SEQ ID NO: 323782 - protein, 9 aa, Homo Sapiens
DAESASRRP

SEQ ID NO: 323783 - protein, 9 aa, Homo Sapiens
KAPGKPAPV

SEQ ID NO: 323784 - protein, 9 aa, Homo Sapiens
FLCLYLLGR

SEQ ID NO: 323785 - protein, 9 aa, Homo Sapiens
ITAVAMQGR

SEQ ID NO: 323786 - protein, 9 aa, Homo Sapiens
SGAPPRARP

SEQ ID NO: 323787 - protein, 9 aa, Homo Sapiens
LIPRQLHRT

SEQ ID NO: 323788 - protein, 9 aa, Homo Sapiens
AQILMCHCL

SEQ ID NO: 323789 - protein, 9 aa, Homo Sapiens
LGSALSALM

SEQ ID NO: 323790 - protein, 9 aa, Homo Sapiens
TETNTERVK

SEQ ID NO: 323791 - protein, 9 aa, Homo Sapiens
QVKKTKMVL

SEQ ID NO: 323792 - protein, 9 aa, Homo Sapiens
RYVVICHPL

SEQ ID NO: 323793 - protein, 9 aa, Homo Sapiens
GQRATENHQ

SEQ ID NO: 323794 - protein, 9 aa, Homo Sapiens
VLIAAIIAI

SEQ ID NO: 323795 - protein, 9 aa, Homo Sapiens
VLTITGIYI

SEQ ID NO: 323796 - protein, 9 aa, Homo Sapiens
TLKALVKTW

SEQ ID NO: 323797 - protein, 9 aa, Homo Sapiens
RCLGKSKGQ

SEQ ID NO: 323798 - protein, 9 aa, Homo Sapiens
DVPQGLHGQ

SEQ ID NO: 323799 - protein, 9 aa, Homo Sapiens
QSPRRCLQR

SEQ ID NO: 323800 - protein, 9 aa, Homo Sapiens
QQVVKRLAG

SEQ ID NO: 323801 - protein, 9 aa, Homo Sapiens
APSATREPD

SEQ ID NO: 323802 - protein, 9 aa, Homo Sapiens
DQKKFEDVN

SEQ ID NO: 323803 - protein, 9 aa, Homo Sapiens
QLIIMLFKN

SEQ ID NO: 323804 - protein, 9 aa, Homo Sapiens
EVLLLTSMA

SEQ ID NO: 323805 - protein, 9 aa, Homo Sapiens
YTSTAEESE

SEQ ID NO: 323806 - protein, 9 aa, Homo Sapiens
ATGPTDIRF

SEQ ID NO: 323807 - protein, 9 aa, Homo Sapiens
TTYIQRGLH

SEQ ID NO: 323808 - protein, 9 aa, Homo Sapiens
MARHTKGPK

SEQ ID NO: 323809 - protein, 9 aa, Homo Sapiens
LHVNLDMGK

SEQ ID NO: 323810 - protein, 9 aa, Homo Sapiens
DGCGKDFSH

SEQ ID NO: 323811 - protein, 9 aa, Homo Sapiens
VQCSHDVVI

SEQ ID NO: 323812 - protein, 9 aa, Homo Sapiens
CLPGVIAAI

SEQ ID NO: 323813 - protein, 9 aa, Homo Sapiens
DSFREQITS

SEQ ID NO: 323814 - protein, 9 aa, Homo Sapiens
HERWSQFPV

SEQ ID NO: 323815 - protein, 9 aa, Homo Sapiens
LFPDENKNT

SEQ ID NO: 323816 - protein, 9 aa, Homo Sapiens
TLGHALPSS

SEQ ID NO: 323817 - protein, 9 aa, Homo Sapiens
MELRFNTLT

SEQ ID NO: 323818 - protein, 9 aa, Homo Sapiens
LPRRPRPAC

SEQ ID NO: 323819 - protein, 9 aa, Homo Sapiens
KSKEQMAFV

SEQ ID NO: 323820 - protein, 9 aa, Homo Sapiens
SGTYSHREQ

SEQ ID NO: 323821 - protein, 9 aa, Homo Sapiens
WKRKHMDRM

SEQ ID NO: 323822 - protein, 9 aa, Homo Sapiens
VKLVKKSFE

SEQ ID NO: 323823 - protein, 9 aa, Homo Sapiens
LTPPTNMPT

SEQ ID NO: 323824 - protein, 9 aa, Homo Sapiens
HTLQTSQDT

SEQ ID NO: 323825 - protein, 9 aa, Homo Sapiens
RPLHQHSPN

SEQ ID NO: 323826 - protein, 9 aa, Homo Sapiens
TARIHRLRR

SEQ ID NO: 323827 - protein, 9 aa, Homo Sapiens
GLTLSDMYP

SEQ ID NO: 323828 - protein, 9 aa, Homo Sapiens
WDLELSEEG

SEQ ID NO: 323829 - protein, 9 aa, Homo Sapiens
EHSKPPLKD

SEQ ID NO: 323830 - protein, 9 aa, Homo Sapiens
SSLGSTFLR

SEQ ID NO: 323831 - protein, 9 aa, Homo Sapiens
SSQAVSNVI

SEQ ID NO: 323832 - protein, 9 aa, Homo Sapiens
CGIHLNRLH

SEQ ID NO: 323833 - protein, 9 aa, Homo Sapiens
FMWYKDSRT

SEQ ID NO: 323834 - protein, 9 aa, Homo Sapiens
CFLFTVTLE

SEQ ID NO: 323835 - protein, 9 aa, Homo Sapiens
QVQHLSHAT

SEQ ID NO: 323836 - protein, 9 aa, Homo Sapiens
GFATLEMES

SEQ ID NO: 323837 - protein, 9 aa, Homo Sapiens
PARSGTTQI

SEQ ID NO: 323838 - protein, 9 aa, Homo Sapiens
RYKWNGHWW

SEQ ID NO: 323839 - protein, 9 aa, Homo Sapiens
LEMESGELV

SEQ ID NO: 323840 - protein, 9 aa, Homo Sapiens
PRRPRPACH

SEQ ID NO: 323841 - protein, 9 aa, Homo Sapiens
LLITQNSTP

SEQ ID NO: 323842 - protein, 9 aa, Homo Sapiens
MSISCPNAV

SEQ ID NO: 323843 - protein, 9 aa, Homo Sapiens
FTKVITKQE

SEQ ID NO: 323844 - protein, 9 aa, Homo Sapiens
PENTGSTLE

SEQ ID NO: 323845 - protein, 9 aa, Homo Sapiens
TVLDANGPP

SEQ ID NO: 323846 - protein, 9 aa, Homo Sapiens
AMQGRYGSS

SEQ ID NO: 323847 - protein, 9 aa, Homo Sapiens
VLVDTGCPI

SEQ ID NO: 323848 - protein, 9 aa, Homo Sapiens
LWRRHREQE

SEQ ID NO: 323849 - protein, 9 aa, Homo Sapiens
HYMRNNVCV

SEQ ID NO: 323850 - protein, 9 aa, Homo Sapiens
VDGEGHTGQ

SEQ ID NO: 323851 - protein, 9 aa, Homo Sapiens
LDRNSLCVN

SEQ ID NO: 323852 - protein, 9 aa, Homo Sapiens
QVNQTFEEL

SEQ ID NO: 323853 - protein, 9 aa, Homo Sapiens
PLDHHVHAR

SEQ ID NO: 323854 - protein, 9 aa, Homo Sapiens
HTGEKSCAV

SEQ ID NO: 323855 - protein, 9 aa, Homo Sapiens
ALHFDETES

SEQ ID NO: 323856 - protein, 9 aa, Homo Sapiens
NLRSLNLRS

SEQ ID NO: 323857 - protein, 9 aa, Homo Sapiens
QALCGLALL

SEQ ID NO: 323858 - protein, 9 aa, Homo Sapiens
PLAGQQPGS

SEQ ID NO: 323859 - protein, 9 aa, Homo Sapiens
SIIISMVSS

SEQ ID NO: 323860 - protein, 9 aa, Homo Sapiens
YNGWGQGEL

SEQ ID NO: 323861 - protein, 9 aa, Homo Sapiens
LQASIDTAI

SEQ ID NO: 323862 - protein, 9 aa, Homo Sapiens
EKHYGKVPY

SEQ ID NO: 323863 - protein, 9 aa, Homo Sapiens
TDEEGGEGG

SEQ ID NO: 323864 - protein, 9 aa, Homo Sapiens
RTTIWLLES

SEQ ID NO: 323865 - protein, 9 aa, Homo Sapiens
SKLMRLPSG

SEQ ID NO: 323866 - protein, 9 aa, Homo Sapiens
LKAGRRAAC

SEQ ID NO: 323867 - protein, 9 aa, Homo Sapiens
LEVADHLFS

SEQ ID NO: 323868 - protein, 9 aa, Homo Sapiens
EMPEEKDLW

SEQ ID NO: 323869 - protein, 9 aa, Homo Sapiens
IATTLIQRR

SEQ ID NO: 323870 - protein, 9 aa, Homo Sapiens
PKPGLVGHQ

SEQ ID NO: 323871 - protein, 9 aa, Homo Sapiens
VSGNMELIP

SEQ ID NO: 323872 - protein, 9 aa, Homo Sapiens
ESDQPNIYI

SEQ ID NO: 323873 - protein, 9 aa, Homo Sapiens
FTARGGLKG

SEQ ID NO: 323874 - protein, 9 aa, Homo Sapiens
CFMTSGIQA

SEQ ID NO: 323875 - protein, 9 aa, Homo Sapiens
LPLCSPRSE

SEQ ID NO: 323876 - protein, 9 aa, Homo Sapiens
SCVSVWSSR

SEQ ID NO: 323877 - protein, 9 aa, Homo Sapiens
YRYGMGKPE

SEQ ID NO: 323878 - protein, 9 aa, Homo Sapiens
LFSVLHERW

SEQ ID NO: 323879 - protein, 9 aa, Homo Sapiens
GVSPSTLPS

SEQ ID NO: 323880 - protein, 9 aa, Homo Sapiens
AWEKPPHPT

SEQ ID NO: 323881 - protein, 9 aa, Homo Sapiens
DKIQAVIDV

SEQ ID NO: 323882 - protein, 9 aa, Homo Sapiens
RTKFCACCG

SEQ ID NO: 323883 - protein, 9 aa, Homo Sapiens
EYFFDRNHP

SEQ ID NO: 323884 - protein, 9 aa, Homo Sapiens
ESPWQVMAS

SEQ ID NO: 323885 - protein, 9 aa, Homo Sapiens
SLGPRPIPV

SEQ ID NO: 323886 - protein, 9 aa, Homo Sapiens
PAMESVYGY

SEQ ID NO: 323887 - protein, 9 aa, Homo Sapiens
MSHQFTCKS

SEQ ID NO: 323888 - protein, 9 aa, Homo Sapiens
SRAKIQTVK

SEQ ID NO: 323889 - protein, 9 aa, Homo Sapiens
PFRLTEKMV

SEQ ID NO: 323890 - protein, 9 aa, Homo Sapiens
IYFIASVVV

SEQ ID NO: 323891 - protein, 9 aa, Homo Sapiens
RDLKTKNLL

SEQ ID NO: 323892 - protein, 9 aa, Homo Sapiens
PPCKNGGHY

SEQ ID NO: 323893 - protein, 9 aa, Homo Sapiens
SMAQVVLSR

SEQ ID NO: 323894 - protein, 9 aa, Homo Sapiens
SASLSGSSL

SEQ ID NO: 323895 - protein, 9 aa, Homo Sapiens
ATGPPVSTE

SEQ ID NO: 323896 - protein, 9 aa, Homo Sapiens
QRRGIYPTS

SEQ ID NO: 323897 - protein, 9 aa, Homo Sapiens
NTSGNYSGK

SEQ ID NO: 323898 - protein, 9 aa, Homo Sapiens
ESQEKIENV

SEQ ID NO: 323899 - protein, 9 aa, Homo Sapiens
RACGANSYE

SEQ ID NO: 323900 - protein, 9 aa, Homo Sapiens
TAPMWCCSR

SEQ ID NO: 323901 - protein, 9 aa, Homo Sapiens
VKKYEYKKP

SEQ ID NO: 323902 - protein, 9 aa, Homo Sapiens
KEALGLYQW

SEQ ID NO: 323903 - protein, 9 aa, Homo Sapiens
RWAAASKLG

SEQ ID NO: 323904 - protein, 9 aa, Homo Sapiens
GPLPYHRHP

SEQ ID NO: 323905 - protein, 9 aa, Homo Sapiens
VWRVVFIAF

SEQ ID NO: 323906 - protein, 9 aa, Homo Sapiens
SKSPTSPMT

SEQ ID NO: 323907 - protein, 9 aa, Homo Sapiens
GHLHMVNPD

SEQ ID NO: 323908 - protein, 9 aa, Homo Sapiens
GEDGKPFRK

SEQ ID NO: 323909 - protein, 9 aa, Homo Sapiens
HGEQNRTSV

SEQ ID NO: 323910 - protein, 9 aa, Homo Sapiens
ASEHGRPNA

SEQ ID NO: 323911 - protein, 9 aa, Homo Sapiens
KIVALDFFT

SEQ ID NO: 323912 - protein, 9 aa, Homo Sapiens
SWLQDSCKQ

SEQ ID NO: 323913 - protein, 9 aa, Homo Sapiens
WDGVACMRF

SEQ ID NO: 323914 - protein, 9 aa, Homo Sapiens
ITGWMDDVI

SEQ ID NO: 323915 - protein, 9 aa, Homo Sapiens
VVIFLHGLG

SEQ ID NO: 323916 - protein, 9 aa, Homo Sapiens
LLTYGVGVL

SEQ ID NO: 323917 - protein, 9 aa, Homo Sapiens
TGPQLITIH

SEQ ID NO: 323918 - protein, 9 aa, Homo Sapiens
ATPTQLPRR

SEQ ID NO: 323919 - protein, 9 aa, Homo Sapiens
QNLIQVIEP

SEQ ID NO: 323920 - protein, 9 aa, Homo Sapiens
HLSHMGNLR

SEQ ID NO: 323921 - protein, 9 aa, Homo Sapiens
GVVSNLVAI

SEQ ID NO: 323922 - protein, 9 aa, Homo Sapiens
GKAFSLASS

SEQ ID NO: 323923 - protein, 9 aa, Homo Sapiens
ADHICLENC

SEQ ID NO: 323924 - protein, 9 aa, Homo Sapiens
FAAVPRGCC

SEQ ID NO: 323925 - protein, 9 aa, Homo Sapiens
VQYLRSVQL

SEQ ID NO: 323926 - protein, 9 aa, Homo Sapiens
CLQRSSWHT

SEQ ID NO: 323927 - protein, 9 aa, Homo Sapiens
YIYERLTWT

SEQ ID NO: 323928 - protein, 9 aa, Homo Sapiens
ALDSLNTSW

SEQ ID NO: 323929 - protein, 9 aa, Homo Sapiens
GKNLELQFV

SEQ ID NO: 323930 - protein, 9 aa, Homo Sapiens
DALLSFAHT

SEQ ID NO: 323931 - protein, 9 aa, Homo Sapiens
EGCLGKCSA

SEQ ID NO: 323932 - protein, 9 aa, Homo Sapiens
LSASLSGSS

SEQ ID NO: 323933 - protein, 9 aa, Homo Sapiens
LFPQNSNVV

SEQ ID NO: 323934 - protein, 9 aa, Homo Sapiens
GGQKLLMRK

SEQ ID NO: 323935 - protein, 9 aa, Homo Sapiens
HVCGIHLNR

SEQ ID NO: 323936 - protein, 9 aa, Homo Sapiens
PGPGPLQAD

SEQ ID NO: 323937 - protein, 9 aa, Homo Sapiens
DQQKPVVCT

SEQ ID NO: 323938 - protein, 9 aa, Homo Sapiens
TEDDPLLRD

SEQ ID NO: 323939 - protein, 9 aa, Homo Sapiens
NQIEEGERP

SEQ ID NO: 323940 - protein, 9 aa, Homo Sapiens
LLLNDAVTV

SEQ ID NO: 323941 - protein, 9 aa, Homo Sapiens
EQGAEAQAA

SEQ ID NO: 323942 - protein, 9 aa, Homo Sapiens
VSLAYDHVR

SEQ ID NO: 323943 - protein, 9 aa, Homo Sapiens
DDGQKSVYV

SEQ ID NO: 323944 - protein, 9 aa, Homo Sapiens
ENDSRSTKG

SEQ ID NO: 323945 - protein, 9 aa, Homo Sapiens
RKNIDLTVI

SEQ ID NO: 323946 - protein, 9 aa, Homo Sapiens
VIINLATQP

SEQ ID NO: 323947 - protein, 9 aa, Homo Sapiens
KSAPILKWA

SEQ ID NO: 323948 - protein, 9 aa, Homo Sapiens
ILQKRLSEK

SEQ ID NO: 323949 - protein, 9 aa, Homo Sapiens
HLHMVNPDW

SEQ ID NO: 323950 - protein, 9 aa, Homo Sapiens
NNYEKFKNN

SEQ ID NO: 323951 - protein, 9 aa, Homo Sapiens
HCSPTNPTS

SEQ ID NO: 323952 - protein, 9 aa, Homo Sapiens
LVQEETLAR

SEQ ID NO: 323953 - protein, 9 aa, Homo Sapiens
RFKLSLVGL

SEQ ID NO: 323954 - protein, 9 aa, Homo Sapiens
ISSPHQKQR

SEQ ID NO: 323955 - protein, 9 aa, Homo Sapiens
ILLTIFTLS

SEQ ID NO: 323956 - protein, 9 aa, Homo Sapiens
LPGSLYVTS

SEQ ID NO: 323957 - protein, 9 aa, Homo Sapiens
QYFGGVSSL

SEQ ID NO: 323958 - protein, 9 aa, Homo Sapiens
AAKHKKNRS

SEQ ID NO: 323959 - protein, 9 aa, Homo Sapiens
LFCQATGPT

SEQ ID NO: 323960 - protein, 9 aa, Homo Sapiens
NFLKTTLFL

SEQ ID NO: 323961 - protein, 9 aa, Homo Sapiens
VISPERRCC

SEQ ID NO: 323962 - protein, 9 aa, Homo Sapiens
TEYSIQMME

SEQ ID NO: 323963 - protein, 9 aa, Homo Sapiens
ASPDNLSPQ

SEQ ID NO: 323964 - protein, 9 aa, Homo Sapiens
PTLRYTFYL

SEQ ID NO: 323965 - protein, 9 aa, Homo Sapiens
LRMVANYEP

SEQ ID NO: 323966 - protein, 9 aa, Homo Sapiens
ANLPGPSMR

SEQ ID NO: 323967 - protein, 9 aa, Homo Sapiens
VKKEAKKSP

SEQ ID NO: 323968 - protein, 9 aa, Homo Sapiens
GDLSGLSPR

SEQ ID NO: 323969 - protein, 9 aa, Homo Sapiens
GITVMLLFF

SEQ ID NO: 323970 - protein, 9 aa, Homo Sapiens
DILQLLLDF

SEQ ID NO: 323971 - protein, 9 aa, Homo Sapiens
VTPDRVDFR

SEQ ID NO: 323972 - protein, 9 aa, Homo Sapiens
LEEHLECTC

SEQ ID NO: 323973 - protein, 9 aa, Homo Sapiens
WTHLPNIKV

SEQ ID NO: 323974 - protein, 9 aa, Homo Sapiens
AEKRLPYLT

SEQ ID NO: 323975 - protein, 9 aa, Homo Sapiens
DHKFNLMYA

SEQ ID NO: 323976 - protein, 9 aa, Homo Sapiens
VDPEQDMSL

SEQ ID NO: 323977 - protein, 9 aa, Homo Sapiens
VSSELLSIA

SEQ ID NO: 323978 - protein, 9 aa, Homo Sapiens
HIVECRDDG

SEQ ID NO: 323979 - protein, 9 aa, Homo Sapiens
QSEGADTTV

SEQ ID NO: 323980 - protein, 9 aa, Homo Sapiens
LYYHYYLHT

SEQ ID NO: 323981 - protein, 9 aa, Homo Sapiens
LHSQRLHWE

SEQ ID NO: 323982 - protein, 9 aa, Homo Sapiens
CCGRASRDP

SEQ ID NO: 323983 - protein, 9 aa, Homo Sapiens
HPQRLHHHL

SEQ ID NO: 323984 - protein, 9 aa, Homo Sapiens
LNSTFGATN

SEQ ID NO: 323985 - protein, 9 aa, Homo Sapiens
LPAVPPQPQ

SEQ ID NO: 323986 - protein, 9 aa, Homo Sapiens
QGEPTEPEI

SEQ ID NO: 323987 - protein, 9 aa, Homo Sapiens
SGELSIEEA

SEQ ID NO: 323988 - protein, 9 aa, Homo Sapiens
ESVYGYFHR

SEQ ID NO: 323989 - protein, 9 aa, Homo Sapiens
KSLGAIMIP

SEQ ID NO: 323990 - protein, 9 aa, Homo Sapiens
EPWRAGFQW

SEQ ID NO: 323991 - protein, 9 aa, Homo Sapiens
ASAPPSGHG

SEQ ID NO: 323992 - protein, 9 aa, Homo Sapiens
VITRKPGVY

SEQ ID NO: 323993 - protein, 9 aa, Homo Sapiens
TTISIDVIV

SEQ ID NO: 323994 - protein, 9 aa, Homo Sapiens
LDIFMRFGR

SEQ ID NO: 323995 - protein, 9 aa, Homo Sapiens
VLTNMCFRP

SEQ ID NO: 323996 - protein, 9 aa, Homo Sapiens
KKNRSPGSD

SEQ ID NO: 323997 - protein, 9 aa, Homo Sapiens
TSPVEEFYT

SEQ ID NO: 323998 - protein, 9 aa, Homo Sapiens
LNMVHKFYR

SEQ ID NO: 323999 - protein, 9 aa, Homo Sapiens
FDQALLWHI

SEQ ID NO: 324000 - protein, 9 aa, Homo Sapiens
PYPEECDCH

SEQ ID NO: 324001 - protein, 9 aa, Homo Sapiens
GAFRLVFQQ

SEQ ID NO: 324002 - protein, 9 aa, Homo Sapiens
GPCRQRTVM

SEQ ID NO: 324003 - protein, 9 aa, Homo Sapiens
TVASASLEV

SEQ ID NO: 324004 - protein, 9 aa, Homo Sapiens
KLISVEMDI

SEQ ID NO: 324005 - protein, 9 aa, Homo Sapiens
KEDMTRLLR

SEQ ID NO: 324006 - protein, 9 aa, Homo Sapiens
RRAPPESCV

SEQ ID NO: 324007 - protein, 9 aa, Homo Sapiens
RHNNRRLQV

SEQ ID NO: 324008 - protein, 9 aa, Homo Sapiens
TAFQGSASA

SEQ ID NO: 324009 - protein, 9 aa, Homo Sapiens
IRRDSIGVW

SEQ ID NO: 324010 - protein, 9 aa, Homo Sapiens
PGDKFSPHY

SEQ ID NO: 324011 - protein, 9 aa, Homo Sapiens
PWVRRHRQA

SEQ ID NO: 324012 - protein, 9 aa, Homo Sapiens
VKMLSGLSP

SEQ ID NO: 324013 - protein, 9 aa, Homo Sapiens
PEEEKLLGA

SEQ ID NO: 324014 - protein, 9 aa, Homo Sapiens
NSMYIHKAA

SEQ ID NO: 324015 - protein, 9 aa, Homo Sapiens
GIRMVIIRQ

SEQ ID NO: 324016 - protein, 9 aa, Homo Sapiens
IQHYIGQDG

SEQ ID NO: 324017 - protein, 9 aa, Homo Sapiens
HEEPSAEDS

SEQ ID NO: 324018 - protein, 9 aa, Homo Sapiens
TSPSAVFAT

SEQ ID NO: 324019 - protein, 9 aa, Homo Sapiens
RSVSMVILY

SEQ ID NO: 324020 - protein, 9 aa, Homo Sapiens
LRTMLRRCA

SEQ ID NO: 324021 - protein, 9 aa, Homo Sapiens
GEEQALSNL

SEQ ID NO: 324022 - protein, 9 aa, Homo Sapiens
DMVKQGYVK

SEQ ID NO: 324023 - protein, 9 aa, Homo Sapiens
PGTEAYIPQ

SEQ ID NO: 324024 - protein, 9 aa, Homo Sapiens
HSLRRPDVL

SEQ ID NO: 324025 - protein, 9 aa, Homo Sapiens
LPRSWFAHG

SEQ ID NO: 324026 - protein, 9 aa, Homo Sapiens
GRDGPGRGW

SEQ ID NO: 324027 - protein, 9 aa, Homo Sapiens
TDSQADFLK

SEQ ID NO: 324028 - protein, 9 aa, Homo Sapiens
PAHHAAANG

SEQ ID NO: 324029 - protein, 9 aa, Homo Sapiens
VHRGEAPCT

SEQ ID NO: 324030 - protein, 9 aa, Homo Sapiens
TLAVYSHVT

SEQ ID NO: 324031 - protein, 9 aa, Homo Sapiens
EKERRPCWS

SEQ ID NO: 324032 - protein, 9 aa, Homo Sapiens
FGFSPGGGI

SEQ ID NO: 324033 - protein, 9 aa, Homo Sapiens
VAKGAIMRS

SEQ ID NO: 324034 - protein, 9 aa, Homo Sapiens
LLHFGCPVG

SEQ ID NO: 324035 - protein, 9 aa, Homo Sapiens
AMSGTQSLH

SEQ ID NO: 324036 - protein, 9 aa, Homo Sapiens
GHYDGNLQC

SEQ ID NO: 324037 - protein, 9 aa, Homo Sapiens
PDILQLLLD

SEQ ID NO: 324038 - protein, 9 aa, Homo Sapiens
SCRLAGMGL

SEQ ID NO: 324039 - protein, 9 aa, Homo Sapiens
FWEKSHLTQ

SEQ ID NO: 324040 - protein, 9 aa, Homo Sapiens
WLSTIKMVQ

SEQ ID NO: 324041 - protein, 9 aa, Homo Sapiens
GHVGTVIGS

SEQ ID NO: 324042 - protein, 9 aa, Homo Sapiens
RDGPGRGWA

SEQ ID NO: 324043 - protein, 9 aa, Homo Sapiens
RTADHCAFH

SEQ ID NO: 324044 - protein, 9 aa, Homo Sapiens
PSFIGMEST

SEQ ID NO: 324045 - protein, 9 aa, Homo Sapiens
HYEFGSLRE

SEQ ID NO: 324046 - protein, 9 aa, Homo Sapiens
KVQWILRLI

SEQ ID NO: 324047 - protein, 9 aa, Homo Sapiens
KVRRITNEG

SEQ ID NO: 324048 - protein, 9 aa, Homo Sapiens
AANQQVTYH

SEQ ID NO: 324049 - protein, 9 aa, Homo Sapiens
YKDMLDIFM

SEQ ID NO: 324050 - protein, 9 aa, Homo Sapiens
QGMSSRRRR

SEQ ID NO: 324051 - protein, 9 aa, Homo Sapiens
LKSEWELDK

SEQ ID NO: 324052 - protein, 9 aa, Homo Sapiens
YFADMERHH

SEQ ID NO: 324053 - protein, 9 aa, Homo Sapiens
PMRSLGEPW

SEQ ID NO: 324054 - protein, 9 aa, Homo Sapiens
QEPNNGISS

SEQ ID NO: 324055 - protein, 9 aa, Homo Sapiens
LWLLFSDVV

SEQ ID NO: 324056 - protein, 9 aa, Homo Sapiens
DWFWWRQGF

SEQ ID NO: 324057 - protein, 9 aa, Homo Sapiens
DFIRLGSCF

SEQ ID NO: 324058 - protein, 9 aa, Homo Sapiens
HSLYLKDEN

SEQ ID NO: 324059 - protein, 9 aa, Homo Sapiens
PEEEVRMAA

SEQ ID NO: 324060 - protein, 9 aa, Homo Sapiens
FKVVKKKAY

SEQ ID NO: 324061 - protein, 9 aa, Homo Sapiens
MSIMISVFI

SEQ ID NO: 324062 - protein, 9 aa, Homo Sapiens
CQILAVTIS

SEQ ID NO: 324063 - protein, 9 aa, Homo Sapiens
LLKELARFQ

SEQ ID NO: 324064 - protein, 9 aa, Homo Sapiens
SLRGELESQ

SEQ ID NO: 324065 - protein, 9 aa, Homo Sapiens
LHERWSQFP

SEQ ID NO: 324066 - protein, 9 aa, Homo Sapiens
PELPEEMLM

SEQ ID NO: 324067 - protein, 9 aa, Homo Sapiens
SLGAIMIPP

SEQ ID NO: 324068 - protein, 9 aa, Homo Sapiens
LHGQRAHLF

SEQ ID NO: 324069 - protein, 9 aa, Homo Sapiens
KKDDIQEED

SEQ ID NO: 324070 - protein, 9 aa, Homo Sapiens
SPSCRQRLE

SEQ ID NO: 324071 - protein, 9 aa, Homo Sapiens
FGCKSYPML

SEQ ID NO: 324072 - protein, 9 aa, Homo Sapiens
FGELLLNDA

SEQ ID NO: 324073 - protein, 9 aa, Homo Sapiens
VKNRQTVAS

SEQ ID NO: 324074 - protein, 9 aa, Homo Sapiens
TPPCTPNIV

SEQ ID NO: 324075 - protein, 9 aa, Homo Sapiens
CDPKTLVGL

SEQ ID NO: 324076 - protein, 9 aa, Homo Sapiens
PSLYWQLCW

SEQ ID NO: 324077 - protein, 9 aa, Homo Sapiens
NVGFKEAVK

SEQ ID NO: 324078 - protein, 9 aa, Homo Sapiens
KLVKKSFET

SEQ ID NO: 324079 - protein, 9 aa, Homo Sapiens
ITSSTISHH

SEQ ID NO: 324080 - protein, 9 aa, Homo Sapiens
TSDLRYKET

SEQ ID NO: 324081 - protein, 9 aa, Homo Sapiens
LDVMFASSS

SEQ ID NO: 324082 - protein, 9 aa, Homo Sapiens
TVATLEKVI

SEQ ID NO: 324083 - protein, 9 aa, Homo Sapiens
DRPCASLRC

SEQ ID NO: 324084 - protein, 9 aa, Homo Sapiens
RSSWKSEHS

SEQ ID NO: 324085 - protein, 9 aa, Homo Sapiens
KCFPFQGTI

SEQ ID NO: 324086 - protein, 9 aa, Homo Sapiens
WGTERIGRH

SEQ ID NO: 324087 - protein, 9 aa, Homo Sapiens
VGVYLPCLQ

SEQ ID NO: 324088 - protein, 9 aa, Homo Sapiens
WLNKHSIQN

SEQ ID NO: 324089 - protein, 9 aa, Homo Sapiens
RLQSPSKKE

SEQ ID NO: 324090 - protein, 9 aa, Homo Sapiens
ECEKAFGIG

SEQ ID NO: 324091 - protein, 9 aa, Homo Sapiens
FCKFSSRSD

SEQ ID NO: 324092 - protein, 9 aa, Homo Sapiens
KRRQRDQGR

SEQ ID NO: 324093 - protein, 9 aa, Homo Sapiens
SVVEGGLWA

SEQ ID NO: 324094 - protein, 9 aa, Homo Sapiens
AALILDQLR

SEQ ID NO: 324095 - protein, 9 aa, Homo Sapiens
LACPGACSS

SEQ ID NO: 324096 - protein, 9 aa, Homo Sapiens
DQDHAAFLL

SEQ ID NO: 324097 - protein, 9 aa, Homo Sapiens
SWGQDPCVI

SEQ ID NO: 324098 - protein, 9 aa, Homo Sapiens
IYNANIDNA

SEQ ID NO: 324099 - protein, 9 aa, Homo Sapiens
GMQGSHQLL

SEQ ID NO: 324100 - protein, 9 aa, Homo Sapiens
ESKLDSLET

SEQ ID NO: 324101 - protein, 9 aa, Homo Sapiens
DAHANEEID

SEQ ID NO: 324102 - protein, 9 aa, Homo Sapiens
QRQPHRSFF

SEQ ID NO: 324103 - protein, 9 aa, Homo Sapiens
ECGHLHMVN

SEQ ID NO: 324104 - protein, 9 aa, Homo Sapiens
LELLLWSSQ

SEQ ID NO: 324105 - protein, 9 aa, Homo Sapiens
AIKYASRSW

SEQ ID NO: 324106 - protein, 9 aa, Homo Sapiens
ACEREELPK

SEQ ID NO: 324107 - protein, 9 aa, Homo Sapiens
SSRPPTGLG

SEQ ID NO: 324108 - protein, 9 aa, Homo Sapiens
ISVVPTQPR

SEQ ID NO: 324109 - protein, 9 aa, Homo Sapiens
VNEYVCRVL

SEQ ID NO: 324110 - protein, 9 aa, Homo Sapiens
GCEWHFARS

SEQ ID NO: 324111 - protein, 9 aa, Homo Sapiens
RHGRWRGHA

SEQ ID NO: 324112 - protein, 9 aa, Homo Sapiens
RDFLLAKVN

SEQ ID NO: 324113 - protein, 9 aa, Homo Sapiens
IDNAGIYKC

SEQ ID NO: 324114 - protein, 9 aa, Homo Sapiens
TRSITDNIS

SEQ ID NO: 324115 - protein, 9 aa, Homo Sapiens
LVLRHLLFL

SEQ ID NO: 324116 - protein, 9 aa, Homo Sapiens
PEGNPGPKC

SEQ ID NO: 324117 - protein, 9 aa, Homo Sapiens
IHHDLKPSN

SEQ ID NO: 324118 - protein, 9 aa, Homo Sapiens
KFIHTKLQK

SEQ ID NO: 324119 - protein, 9 aa, Homo Sapiens
EKSCAVKNE

SEQ ID NO: 324120 - protein, 9 aa, Homo Sapiens
LKATTSSSA

SEQ ID NO: 324121 - protein, 9 aa, Homo Sapiens
HCPCAVPYR

SEQ ID NO: 324122 - protein, 9 aa, Homo Sapiens
SCTVRPDAS

SEQ ID NO: 324123 - protein, 9 aa, Homo Sapiens
RAGARPHRR

SEQ ID NO: 324124 - protein, 9 aa, Homo Sapiens
EMCVNYNGQ

SEQ ID NO: 324125 - protein, 9 aa, Homo Sapiens
LSLDLYKGR

SEQ ID NO: 324126 - protein, 9 aa, Homo Sapiens
SSWLQDSCK

SEQ ID NO: 324127 - protein, 9 aa, Homo Sapiens
QLVDWHQIQ

SEQ ID NO: 324128 - protein, 9 aa, Homo Sapiens
HMWPASSSW

SEQ ID NO: 324129 - protein, 9 aa, Homo Sapiens
FTSFINKVR

SEQ ID NO: 324130 - protein, 9 aa, Homo Sapiens
HPATFTAHT

SEQ ID NO: 324131 - protein, 9 aa, Homo Sapiens
KAPGQFGHP

SEQ ID NO: 324132 - protein, 9 aa, Homo Sapiens
GNLRSLNLR

SEQ ID NO: 324133 - protein, 9 aa, Homo Sapiens
QSDCPVIVS

SEQ ID NO: 324134 - protein, 9 aa, Homo Sapiens
ICFLLKVRV

SEQ ID NO: 324135 - protein, 9 aa, Homo Sapiens
TPSRHETSL

SEQ ID NO: 324136 - protein, 9 aa, Homo Sapiens
IDTAIIQLK

SEQ ID NO: 324137 - protein, 9 aa, Homo Sapiens
RRPPPRATG

SEQ ID NO: 324138 - protein, 9 aa, Homo Sapiens
VLFTRSITD

SEQ ID NO: 324139 - protein, 9 aa, Homo Sapiens
RQRQAMERP

SEQ ID NO: 324140 - protein, 9 aa, Homo Sapiens
AKEDMTRLL

SEQ ID NO: 324141 - protein, 9 aa, Homo Sapiens
EGDRVAGRL

SEQ ID NO: 324142 - protein, 9 aa, Homo Sapiens
VIVLAAGYG

SEQ ID NO: 324143 - protein, 9 aa, Homo Sapiens
DIFHDLMDC

SEQ ID NO: 324144 - protein, 9 aa, Homo Sapiens
WQKDEEDKA

SEQ ID NO: 324145 - protein, 9 aa, Homo Sapiens
FPYPEECDC

SEQ ID NO: 324146 - protein, 9 aa, Homo Sapiens
LDTLQETQE

SEQ ID NO: 324147 - protein, 9 aa, Homo Sapiens
RQRTVMETI

SEQ ID NO: 324148 - protein, 9 aa, Homo Sapiens
VSDPIIFQM

SEQ ID NO: 324149 - protein, 9 aa, Homo Sapiens
GLYDETIRH

SEQ ID NO: 324150 - protein, 9 aa, Homo Sapiens
AKVQWILRL

SEQ ID NO: 324151 - protein, 9 aa, Homo Sapiens
CVLWKKGLS

SEQ ID NO: 324152 - protein, 9 aa, Homo Sapiens
SQVAIDLHE

SEQ ID NO: 324153 - protein, 9 aa, Homo Sapiens
YMPLIHSRM

SEQ ID NO: 324154 - protein, 9 aa, Homo Sapiens
IHMDSRPFA

SEQ ID NO: 324155 - protein, 9 aa, Homo Sapiens
VDVLCRTAS

SEQ ID NO: 324156 - protein, 9 aa, Homo Sapiens
HLASRCSPP

SEQ ID NO: 324157 - protein, 9 aa, Homo Sapiens
ADEDFQVTL

SEQ ID NO: 324158 - protein, 9 aa, Homo Sapiens
WAPWNTHHA

SEQ ID NO: 324159 - protein, 9 aa, Homo Sapiens
ERLHARMEE

SEQ ID NO: 324160 - protein, 9 aa, Homo Sapiens
SPRGRTDKE

SEQ ID NO: 324161 - protein, 9 aa, Homo Sapiens
PVPARGSCS

SEQ ID NO: 324162 - protein, 9 aa, Homo Sapiens
RCTFRNFLD

SEQ ID NO: 324163 - protein, 9 aa, Homo Sapiens
RQGGLVYLL

SEQ ID NO: 324164 - protein, 9 aa, Homo Sapiens
LYGPFLPGN

SEQ ID NO: 324165 - protein, 9 aa, Homo Sapiens
CLQLGHLKD

SEQ ID NO: 324166 - protein, 9 aa, Homo Sapiens
QVIEPFSRV

SEQ ID NO: 324167 - protein, 9 aa, Homo Sapiens
FYPSPSPPA

SEQ ID NO: 324168 - protein, 9 aa, Homo Sapiens
KGSGAGSRP

SEQ ID NO: 324169 - protein, 9 aa, Homo Sapiens
MGICRCLSE

SEQ ID NO: 324170 - protein, 9 aa, Homo Sapiens
FQGHYDGNL

SEQ ID NO: 324171 - protein, 9 aa, Homo Sapiens
TLRICFLLK

SEQ ID NO: 324172 - protein, 9 aa, Homo Sapiens
TLPCRPYKV

SEQ ID NO: 324173 - protein, 9 aa, Homo Sapiens
AWGRAEPPE

SEQ ID NO: 324174 - protein, 9 aa, Homo Sapiens
RATALRWNT

SEQ ID NO: 324175 - protein, 9 aa, Homo Sapiens
QSIKDKCSC

SEQ ID NO: 324176 - protein, 9 aa, Homo Sapiens
IVRTVPVAT

SEQ ID NO: 324177 - protein, 9 aa, Homo Sapiens
RAGFQWGES

SEQ ID NO: 324178 - protein, 9 aa, Homo Sapiens
SSYSLDEPS

SEQ ID NO: 324179 - protein, 9 aa, Homo Sapiens
QITGWMDDV

SEQ ID NO: 324180 - protein, 9 aa, Homo Sapiens
TRHKKMEKE

SEQ ID NO: 324181 - protein, 9 aa, Homo Sapiens
TQLRLEEAL

SEQ ID NO: 324182 - protein, 9 aa, Homo Sapiens
EGNPGPKCA

SEQ ID NO: 324183 - protein, 9 aa, Homo Sapiens
NVESFKQTN

SEQ ID NO: 324184 - protein, 9 aa, Homo Sapiens
ENMRMGNLP

SEQ ID NO: 324185 - protein, 9 aa, Homo Sapiens
TLVSVRVFY

SEQ ID NO: 324186 - protein, 9 aa, Homo Sapiens
IQMLNNPEK

SEQ ID NO: 324187 - protein, 9 aa, Homo Sapiens
AHENNRVLF

SEQ ID NO: 324188 - protein, 9 aa, Homo Sapiens
CRTASIMGL

SEQ ID NO: 324189 - protein, 9 aa, Homo Sapiens
GRHMKRQDQ

SEQ ID NO: 324190 - protein, 9 aa, Homo Sapiens
EGVCNISNQ

SEQ ID NO: 324191 - protein, 9 aa, Homo Sapiens
MQDLDLSDP

SEQ ID NO: 324192 - protein, 9 aa, Homo Sapiens
THGNSSIIA

SEQ ID NO: 324193 - protein, 9 aa, Homo Sapiens
PDYKCQPRR

SEQ ID NO: 324194 - protein, 9 aa, Homo Sapiens
NAARTTIWL

SEQ ID NO: 324195 - protein, 9 aa, Homo Sapiens
VENEEAEGN

SEQ ID NO: 324196 - protein, 9 aa, Homo Sapiens
RNAYKCMSQ

SEQ ID NO: 324197 - protein, 9 aa, Homo Sapiens
QGAPMLAPE

SEQ ID NO: 324198 - protein, 9 aa, Homo Sapiens
LDIKAPEQG

SEQ ID NO: 324199 - protein, 9 aa, Homo Sapiens
PDSANSAQS

SEQ ID NO: 324200 - protein, 9 aa, Homo Sapiens
FNSPGYPEI

SEQ ID NO: 324201 - protein, 9 aa, Homo Sapiens
TVDSIMPLH

SEQ ID NO: 324202 - protein, 9 aa, Homo Sapiens
RPACHEHGP

SEQ ID NO: 324203 - protein, 9 aa, Homo Sapiens
GKTSMLVKY

SEQ ID NO: 324204 - protein, 9 aa, Homo Sapiens
RETDITQGV

SEQ ID NO: 324205 - protein, 9 aa, Homo Sapiens
PLGSWQEQL

SEQ ID NO: 324206 - protein, 9 aa, Homo Sapiens
PNGCITNFD

SEQ ID NO: 324207 - protein, 9 aa, Homo Sapiens
LLAVIVAVI

SEQ ID NO: 324208 - protein, 9 aa, Homo Sapiens
LYHTDFFPG

SEQ ID NO: 324209 - protein, 9 aa, Homo Sapiens
KYRYGMGKP

SEQ ID NO: 324210 - protein, 9 aa, Homo Sapiens
AAIQKKLVI

SEQ ID NO: 324211 - protein, 9 aa, Homo Sapiens
FAKGQSVAP

SEQ ID NO: 324212 - protein, 9 aa, Homo Sapiens
AVTEIVETW

SEQ ID NO: 324213 - protein, 9 aa, Homo Sapiens
WWRKALRRN

SEQ ID NO: 324214 - protein, 9 aa, Homo Sapiens
RGCLTYYAK

SEQ ID NO: 324215 - protein, 9 aa, Homo Sapiens
VTVLDANGP

SEQ ID NO: 324216 - protein, 9 aa, Homo Sapiens
GIHLNRLHS

SEQ ID NO: 324217 - protein, 9 aa, Homo Sapiens
IDDLEECLY

SEQ ID NO: 324218 - protein, 9 aa, Homo Sapiens
DCPCMVVSC

SEQ ID NO: 324219 - protein, 9 aa, Homo Sapiens
HCQERFEAG

SEQ ID NO: 324220 - protein, 9 aa, Homo Sapiens
PTPRPRRLQ

SEQ ID NO: 324221 - protein, 9 aa, Homo Sapiens
EGLGFRSKY

SEQ ID NO: 324222 - protein, 9 aa, Homo Sapiens
PMAHVLIGN

SEQ ID NO: 324223 - protein, 9 aa, Homo Sapiens
KPCASKVAT

SEQ ID NO: 324224 - protein, 9 aa, Homo Sapiens
YHVLFLRTD

SEQ ID NO: 324225 - protein, 9 aa, Homo Sapiens
STLEWDNYD

SEQ ID NO: 324226 - protein, 9 aa, Homo Sapiens
MSLRPSERP

SEQ ID NO: 324227 - protein, 9 aa, Homo Sapiens
ALFRCAKAH

SEQ ID NO: 324228 - protein, 9 aa, Homo Sapiens
PPQPQRPHD

SEQ ID NO: 324229 - protein, 9 aa, Homo Sapiens
QPPPHMCCE

SEQ ID NO: 324230 - protein, 9 aa, Homo Sapiens
GMNVAPGDR

SEQ ID NO: 324231 - protein, 9 aa, Homo Sapiens
VSEKVGGAK

SEQ ID NO: 324232 - protein, 9 aa, Homo Sapiens
SGASSSCRQ

SEQ ID NO: 324233 - protein, 9 aa, Homo Sapiens
SCLKECSCM

SEQ ID NO: 324234 - protein, 9 aa, Homo Sapiens
NTVMVALAS

SEQ ID NO: 324235 - protein, 9 aa, Homo Sapiens
EKEPALAPP

SEQ ID NO: 324236 - protein, 9 aa, Homo Sapiens
PVGLASFVE

SEQ ID NO: 324237 - protein, 9 aa, Homo Sapiens
MAPRKEGTG

SEQ ID NO: 324238 - protein, 9 aa, Homo Sapiens
DIYSCYIYW

SEQ ID NO: 324239 - protein, 9 aa, Homo Sapiens
HEFKEWFSN

SEQ ID NO: 324240 - protein, 9 aa, Homo Sapiens
ESGRHVLVY

SEQ ID NO: 324241 - protein, 9 aa, Homo Sapiens
ADAQVLHVD

SEQ ID NO: 324242 - protein, 9 aa, Homo Sapiens
PPDLLQLYQ

SEQ ID NO: 324243 - protein, 9 aa, Homo Sapiens
LCHCCDLIG

SEQ ID NO: 324244 - protein, 9 aa, Homo Sapiens
ITLLALVCL

SEQ ID NO: 324245 - protein, 9 aa, Homo Sapiens
QAVSTKGER

SEQ ID NO: 324246 - protein, 9 aa, Homo Sapiens
KCDVCEKGF

SEQ ID NO: 324247 - protein, 9 aa, Homo Sapiens
MPTKGRFPI

SEQ ID NO: 324248 - protein, 9 aa, Homo Sapiens
DHCAFHNLL

SEQ ID NO: 324249 - protein, 9 aa, Homo Sapiens
VGTASGLCS

SEQ ID NO: 324250 - protein, 9 aa, Homo Sapiens
SMKSEELNL

SEQ ID NO: 324251 - protein, 9 aa, Homo Sapiens
VYLDIKAPE

SEQ ID NO: 324252 - protein, 9 aa, Homo Sapiens
YHYYLHTSE

SEQ ID NO: 324253 - protein, 9 aa, Homo Sapiens
RAHCPANGA

SEQ ID NO: 324254 - protein, 9 aa, Homo Sapiens
RARQLQRDR

SEQ ID NO: 324255 - protein, 9 aa, Homo Sapiens
RTPPCTPNI

SEQ ID NO: 324256 - protein, 9 aa, Homo Sapiens
LKTTLFLYS

SEQ ID NO: 324257 - protein, 9 aa, Homo Sapiens
FNQMTVEYV

SEQ ID NO: 324258 - protein, 9 aa, Homo Sapiens
RIYVYIKRK

SEQ ID NO: 324259 - protein, 9 aa, Homo Sapiens
SQLKKIFWG

SEQ ID NO: 324260 - protein, 9 aa, Homo Sapiens
QHQHQHQQQ

SEQ ID NO: 324261 - protein, 9 aa, Homo Sapiens
TFYLSCKEL

SEQ ID NO: 324262 - protein, 9 aa, Homo Sapiens
TLEDAKRLC

SEQ ID NO: 324263 - protein, 9 aa, Homo Sapiens
FIEWMVGGS

SEQ ID NO: 324264 - protein, 9 aa, Homo Sapiens
EGDGNWTNY

SEQ ID NO: 324265 - protein, 9 aa, Homo Sapiens
ITDHLQIQH

SEQ ID NO: 324266 - protein, 9 aa, Homo Sapiens
FDSDEPWML

SEQ ID NO: 324267 - protein, 9 aa, Homo Sapiens
GDHITHCWQ

SEQ ID NO: 324268 - protein, 9 aa, Homo Sapiens
SDPFAKLIV

SEQ ID NO: 324269 - protein, 9 aa, Homo Sapiens
KYRHMCRHK

SEQ ID NO: 324270 - protein, 9 aa, Homo Sapiens
ELRRTCSPH

SEQ ID NO: 324271 - protein, 9 aa, Homo Sapiens
PRSSSHCSC

SEQ ID NO: 324272 - protein, 9 aa, Homo Sapiens
MLEANEWAT

SEQ ID NO: 324273 - protein, 9 aa, Homo Sapiens
SKADWHGLC

SEQ ID NO: 324274 - protein, 9 aa, Homo Sapiens
LEIHLVMIQ

SEQ ID NO: 324275 - protein, 9 aa, Homo Sapiens
SCICHVCGI

SEQ ID NO: 324276 - protein, 9 aa, Homo Sapiens
CDGCGKDFS

SEQ ID NO: 324277 - protein, 9 aa, Homo Sapiens
ALASLLLWG

SEQ ID NO: 324278 - protein, 9 aa, Homo Sapiens
HEHGPRSSW

SEQ ID NO: 324279 - protein, 9 aa, Homo Sapiens
PAGLPLAMA

SEQ ID NO: 324280 - protein, 9 aa, Homo Sapiens
LLWSSQREE

SEQ ID NO: 324281 - protein, 9 aa, Homo Sapiens
LSATVPHHE

SEQ ID NO: 324282 - protein, 9 aa, Homo Sapiens
HSTSPVEEF

SEQ ID NO: 324283 - protein, 9 aa, Homo Sapiens
PQRQICVGD

SEQ ID NO: 324284 - protein, 9 aa, Homo Sapiens
SKPPGMALP

SEQ ID NO: 324285 - protein, 9 aa, Homo Sapiens
RRVSLKPPA

SEQ ID NO: 324286 - protein, 9 aa, Homo Sapiens
IMTNGLCIW

SEQ ID NO: 324287 - protein, 9 aa, Homo Sapiens
TEAYIPQRY

SEQ ID NO: 324288 - protein, 9 aa, Homo Sapiens
WVQYTFQNG

SEQ ID NO: 324289 - protein, 9 aa, Homo Sapiens
VFDLVIVAE

SEQ ID NO: 324290 - protein, 9 aa, Homo Sapiens
AQAMDTALA

SEQ ID NO: 324291 - protein, 9 aa, Homo Sapiens
AHDPQWYPS

SEQ ID NO: 324292 - protein, 9 aa, Homo Sapiens
ELKLSMREA

SEQ ID NO: 324293 - protein, 9 aa, Homo Sapiens
DQLAEEQAQ

SEQ ID NO: 324294 - protein, 9 aa, Homo Sapiens
LQHPQRLHH

SEQ ID NO: 324295 - protein, 9 aa, Homo Sapiens
KQASLLGDS

SEQ ID NO: 324296 - protein, 9 aa, Homo Sapiens
RSADGRRFW

SEQ ID NO: 324297 - protein, 9 aa, Homo Sapiens
MEPKVDDKN

SEQ ID NO: 324298 - protein, 9 aa, Homo Sapiens
ELLSIAAQT

SEQ ID NO: 324299 - protein, 9 aa, Homo Sapiens
SLFQGIEFH

SEQ ID NO: 324300 - protein, 9 aa, Homo Sapiens
VYIKRKTNV

SEQ ID NO: 324301 - protein, 9 aa, Homo Sapiens
VGLASFVEV

SEQ ID NO: 324302 - protein, 9 aa, Homo Sapiens
YIQHRVHSS

SEQ ID NO: 324303 - protein, 9 aa, Homo Sapiens
STPEGTTPP

SEQ ID NO: 324304 - protein, 9 aa, Homo Sapiens
YHTDFFPGL

SEQ ID NO: 324305 - protein, 9 aa, Homo Sapiens
IWNERDEYI

SEQ ID NO: 324306 - protein, 9 aa, Homo Sapiens
QAFRSRRKE

SEQ ID NO: 324307 - protein, 9 aa, Homo Sapiens
FASVHSISA

SEQ ID NO: 324308 - protein, 9 aa, Homo Sapiens
TGKLYPTEI

SEQ ID NO: 324309 - protein, 9 aa, Homo Sapiens
IDVGVCRRL

SEQ ID NO: 324310 - protein, 9 aa, Homo Sapiens
DGSAFYQGS

SEQ ID NO: 324311 - protein, 9 aa, Homo Sapiens
RCTLATLIG

SEQ ID NO: 324312 - protein, 9 aa, Homo Sapiens
MLHRLGILS

SEQ ID NO: 324313 - protein, 9 aa, Homo Sapiens
PPKKLKQEV

SEQ ID NO: 324314 - protein, 9 aa, Homo Sapiens
TLKATTSSS

SEQ ID NO: 324315 - protein, 9 aa, Homo Sapiens
PWMDTAPVV

SEQ ID NO: 324316 - protein, 9 aa, Homo Sapiens
QASEGKHPS

SEQ ID NO: 324317 - protein, 9 aa, Homo Sapiens
RDYNVTLPS

SEQ ID NO: 324318 - protein, 9 aa, Homo Sapiens
FPGFPPHVP

SEQ ID NO: 324319 - protein, 9 aa, Homo Sapiens
VLLMLFGGI

SEQ ID NO: 324320 - protein, 9 aa, Homo Sapiens
APRKEGTGS

SEQ ID NO: 324321 - protein, 9 aa, Homo Sapiens
PLCSPRSEV

SEQ ID NO: 324322 - protein, 9 aa, Homo Sapiens
THNSHLPAA

SEQ ID NO: 324323 - protein, 9 aa, Homo Sapiens
AEKAGIICY

SEQ ID NO: 324324 - protein, 9 aa, Homo Sapiens
VARVEHEET

SEQ ID NO: 324325 - protein, 9 aa, Homo Sapiens
GSCFRFSGR

SEQ ID NO: 324326 - protein, 9 aa, Homo Sapiens
HKRLEDLWR

SEQ ID NO: 324327 - protein, 9 aa, Homo Sapiens
GPFANITHG

SEQ ID NO: 324328 - protein, 9 aa, Homo Sapiens
DRRPGPSRA

SEQ ID NO: 324329 - protein, 9 aa, Homo Sapiens
CLAGVAVLI

SEQ ID NO: 324330 - protein, 9 aa, Homo Sapiens
TRLRPMSML

SEQ ID NO: 324331 - protein, 9 aa, Homo Sapiens
EQNRTSVQS

SEQ ID NO: 324332 - protein, 9 aa, Homo Sapiens
EELCKGGDP

SEQ ID NO: 324333 - protein, 9 aa, Homo Sapiens
QKSLGAIMI

SEQ ID NO: 324334 - protein, 9 aa, Homo Sapiens
IRRDAPAGC

SEQ ID NO: 324335 - protein, 9 aa, Homo Sapiens
AAEIKKWMG

SEQ ID NO: 324336 - protein, 9 aa, Homo Sapiens
GGFLGQRGR

SEQ ID NO: 324337 - protein, 9 aa, Homo Sapiens
SEPAAQALD

SEQ ID NO: 324338 - protein, 9 aa, Homo Sapiens
SSQLIIMLF

SEQ ID NO: 324339 - protein, 9 aa, Homo Sapiens
ISLTFTEIP

SEQ ID NO: 324340 - protein, 9 aa, Homo Sapiens
NVHSRVPMM

SEQ ID NO: 324341 - protein, 9 aa, Homo Sapiens
PKVKDRTHD

SEQ ID NO: 324342 - protein, 9 aa, Homo Sapiens
TGAQRSFTC

SEQ ID NO: 324343 - protein, 9 aa, Homo Sapiens
VNSPEEHSL

SEQ ID NO: 324344 - protein, 9 aa, Homo Sapiens
LRLCHLLVG

SEQ ID NO: 324345 - protein, 9 aa, Homo Sapiens
GKLGEHEKV

SEQ ID NO: 324346 - protein, 9 aa, Homo Sapiens
DLTVIISDL

SEQ ID NO: 324347 - protein, 9 aa, Homo Sapiens
DMYPHEAWS

SEQ ID NO: 324348 - protein, 9 aa, Homo Sapiens
PFDKRLHFS

SEQ ID NO: 324349 - protein, 9 aa, Homo Sapiens
QGCHCQERF

SEQ ID NO: 324350 - protein, 9 aa, Homo Sapiens
TIEAGVPWH

SEQ ID NO: 324351 - protein, 9 aa, Homo Sapiens
LPGDVRTWV

SEQ ID NO: 324352 - protein, 9 aa, Homo Sapiens
TSTQYTAAV

SEQ ID NO: 324353 - protein, 9 aa, Homo Sapiens
NNGISSDPT

SEQ ID NO: 324354 - protein, 9 aa, Homo Sapiens
ATAAALRRW

SEQ ID NO: 324355 - protein, 9 aa, Homo Sapiens
IAAFGQKQW

SEQ ID NO: 324356 - protein, 9 aa, Homo Sapiens
TPAPSPDTS

SEQ ID NO: 324357 - protein, 9 aa, Homo Sapiens
RAHIEKAYA

SEQ ID NO: 324358 - protein, 9 aa, Homo Sapiens
QVVMANSDG

SEQ ID NO: 324359 - protein, 9 aa, Homo Sapiens
LETTGAISY

SEQ ID NO: 324360 - protein, 9 aa, Homo Sapiens
AKNYGMTHM

SEQ ID NO: 324361 - protein, 9 aa, Homo Sapiens
MLFGGIPKT

SEQ ID NO: 324362 - protein, 9 aa, Homo Sapiens
KWLLLQRLY

SEQ ID NO: 324363 - protein, 9 aa, Homo Sapiens
QELEECLAR

SEQ ID NO: 324364 - protein, 9 aa, Homo Sapiens
NTQMGNQQE

SEQ ID NO: 324365 - protein, 9 aa, Homo Sapiens
ATEIMAVLF

SEQ ID NO: 324366 - protein, 9 aa, Homo Sapiens
FTHPLLSKW

SEQ ID NO: 324367 - protein, 9 aa, Homo Sapiens
LRSLAFPAP

SEQ ID NO: 324368 - protein, 9 aa, Homo Sapiens
PTSCCSATE

SEQ ID NO: 324369 - protein, 9 aa, Homo Sapiens
KLNQRLSHP

SEQ ID NO: 324370 - protein, 9 aa, Homo Sapiens
LEAQRVAME

SEQ ID NO: 324371 - protein, 9 aa, Homo Sapiens
LTNFLVRCS

SEQ ID NO: 324372 - protein, 9 aa, Homo Sapiens
PPVLTLSLV

SEQ ID NO: 324373 - protein, 9 aa, Homo Sapiens
VGGAKGTKL

SEQ ID NO: 324374 - protein, 9 aa, Homo Sapiens
QAKEDMTRL

SEQ ID NO: 324375 - protein, 9 aa, Homo Sapiens
LVDPEQDMS

SEQ ID NO: 324376 - protein, 9 aa, Homo Sapiens
NNERTQLLS

SEQ ID NO: 324377 - protein, 9 aa, Homo Sapiens
VASASLEVY

SEQ ID NO: 324378 - protein, 9 aa, Homo Sapiens
RKKRRMCSM

SEQ ID NO: 324379 - protein, 9 aa, Homo Sapiens
PAVAVGQYP

SEQ ID NO: 324380 - protein, 9 aa, Homo Sapiens
LQSPSKKEL

SEQ ID NO: 324381 - protein, 9 aa, Homo Sapiens
GPEFGGAMG

SEQ ID NO: 324382 - protein, 9 aa, Homo Sapiens
FKAARIDIE

SEQ ID NO: 324383 - protein, 9 aa, Homo Sapiens
DQPFDKRLH

SEQ ID NO: 324384 - protein, 9 aa, Homo Sapiens
NPGYCMSLT

SEQ ID NO: 324385 - protein, 9 aa, Homo Sapiens
ESCVSQGKS

SEQ ID NO: 324386 - protein, 9 aa, Homo Sapiens
PLGPVTSPD

SEQ ID NO: 324387 - protein, 9 aa, Homo Sapiens
KHGSSKPTN

SEQ ID NO: 324388 - protein, 9 aa, Homo Sapiens
WLLSDGPAG

SEQ ID NO: 324389 - protein, 9 aa, Homo Sapiens
DQALLWHIV

SEQ ID NO: 324390 - protein, 9 aa, Homo Sapiens
GYVIFAISL

SEQ ID NO: 324391 - protein, 9 aa, Homo Sapiens
DRNHPSFDA

SEQ ID NO: 324392 - protein, 9 aa, Homo Sapiens
RTGYHPTGH

SEQ ID NO: 324393 - protein, 9 aa, Homo Sapiens
FNTLTKCPH

SEQ ID NO: 324394 - protein, 9 aa, Homo Sapiens
WHQPYQLKT

SEQ ID NO: 324395 - protein, 9 aa, Homo Sapiens
KELSNLTDE

SEQ ID NO: 324396 - protein, 9 aa, Homo Sapiens
GPIDWSGDV

SEQ ID NO: 324397 - protein, 9 aa, Homo Sapiens
DKALDCYSK

SEQ ID NO: 324398 - protein, 9 aa, Homo Sapiens
TSLAWLNRV

SEQ ID NO: 324399 - protein, 9 aa, Homo Sapiens
VVYGDVPDD

SEQ ID NO: 324400 - protein, 9 aa, Homo Sapiens
NGHFWMFHR

SEQ ID NO: 324401 - protein, 9 aa, Homo Sapiens
DTRVHTDIQ

SEQ ID NO: 324402 - protein, 9 aa, Homo Sapiens
TAVGGMKDV

SEQ ID NO: 324403 - protein, 9 aa, Homo Sapiens
MVNGSTGPL

SEQ ID NO: 324404 - protein, 9 aa, Homo Sapiens
CKTCGKAFR

SEQ ID NO: 324405 - protein, 9 aa, Homo Sapiens
QLTARIHRL

SEQ ID NO: 324406 - protein, 9 aa, Homo Sapiens
SMSSQASTG

SEQ ID NO: 324407 - protein, 9 aa, Homo Sapiens
YATEEGFTP

SEQ ID NO: 324408 - protein, 9 aa, Homo Sapiens
EGKWSLELP

SEQ ID NO: 324409 - protein, 9 aa, Homo Sapiens
ELEQQIWNE

SEQ ID NO: 324410 - protein, 9 aa, Homo Sapiens
KCQGYVIFA

SEQ ID NO: 324411 - protein, 9 aa, Homo Sapiens
NKIVHFTGS

SEQ ID NO: 324412 - protein, 9 aa, Homo Sapiens
HVRNLTIRA

SEQ ID NO: 324413 - protein, 9 aa, Homo Sapiens
KLQCQIHAK

SEQ ID NO: 324414 - protein, 9 aa, Homo Sapiens
MNCLHERAH

SEQ ID NO: 324415 - protein, 9 aa, Homo Sapiens
LFLFTFLFL

SEQ ID NO: 324416 - protein, 9 aa, Homo Sapiens
GFISGLGKW

SEQ ID NO: 324417 - protein, 9 aa, Homo Sapiens
ATDAKAREA

SEQ ID NO: 324418 - protein, 9 aa, Homo Sapiens
WDSKKLPGL

SEQ ID NO: 324419 - protein, 9 aa, Homo Sapiens
GDAKVVVLG

SEQ ID NO: 324420 - protein, 9 aa, Homo Sapiens
RRMCSMVGN

SEQ ID NO: 324421 - protein, 9 aa, Homo Sapiens
PGMFNLPGS

SEQ ID NO: 324422 - protein, 9 aa, Homo Sapiens
LFTGKLYPT

SEQ ID NO: 324423 - protein, 9 aa, Homo Sapiens
AEEMQVRLA

SEQ ID NO: 324424 - protein, 9 aa, Homo Sapiens
LRYQLQHGV

SEQ ID NO: 324425 - protein, 9 aa, Homo Sapiens
RNFLVSGWH

SEQ ID NO: 324426 - protein, 9 aa, Homo Sapiens
WMLGNANHD

SEQ ID NO: 324427 - protein, 9 aa, Homo Sapiens
VFIPEEEVR

SEQ ID NO: 324428 - protein, 9 aa, Homo Sapiens
TQNSTPILY

SEQ ID NO: 324429 - protein, 9 aa, Homo Sapiens
VQYFLIDAL

SEQ ID NO: 324430 - protein, 9 aa, Homo Sapiens
KLVNEYVCR

SEQ ID NO: 324431 - protein, 9 aa, Homo Sapiens
YWTDRATHR

SEQ ID NO: 324432 - protein, 9 aa, Homo Sapiens
LGPVTSPDP

SEQ ID NO: 324433 - protein, 9 aa, Homo Sapiens
GTLVGVYLP

SEQ ID NO: 324434 - protein, 9 aa, Homo Sapiens
DQPNIYIRE

SEQ ID NO: 324435 - protein, 9 aa, Homo Sapiens
MIQLLQHFE

SEQ ID NO: 324436 - protein, 9 aa, Homo Sapiens
LNCVDGSQD

SEQ ID NO: 324437 - protein, 9 aa, Homo Sapiens
CQGYVIFAI

SEQ ID NO: 324438 - protein, 9 aa, Homo Sapiens
RVRGAQVTD

SEQ ID NO: 324439 - protein, 9 aa, Homo Sapiens
RLREEEVDT

SEQ ID NO: 324440 - protein, 9 aa, Homo Sapiens
LPAPPPWRH

SEQ ID NO: 324441 - protein, 9 aa, Homo Sapiens
VGFLFGSLG

SEQ ID NO: 324442 - protein, 9 aa, Homo Sapiens
QLVRTGSAE

SEQ ID NO: 324443 - protein, 9 aa, Homo Sapiens
LLLVVPEDV

SEQ ID NO: 324444 - protein, 9 aa, Homo Sapiens
RYQIIHTGA

SEQ ID NO: 324445 - protein, 9 aa, Homo Sapiens
VPCTILAPN

SEQ ID NO: 324446 - protein, 9 aa, Homo Sapiens
TISIDVIVY

SEQ ID NO: 324447 - protein, 9 aa, Homo Sapiens
LLRDLLICS

SEQ ID NO: 324448 - protein, 9 aa, Homo Sapiens
YNHIRPGQL

SEQ ID NO: 324449 - protein, 9 aa, Homo Sapiens
YPAWVRVSN

SEQ ID NO: 324450 - protein, 9 aa, Homo Sapiens
GITYMLFFI

SEQ ID NO: 324451 - protein, 9 aa, Homo Sapiens
FWLLSDITC

SEQ ID NO: 324452 - protein, 9 aa, Homo Sapiens
VWDFLKLYQ

SEQ ID NO: 324453 - protein, 9 aa, Homo Sapiens
CHRTKEEGD

SEQ ID NO: 324454 - protein, 9 aa, Homo Sapiens
VAFCDTQST

SEQ ID NO: 324455 - protein, 9 aa, Homo Sapiens
KYDFTTYIQ

SEQ ID NO: 324456 - protein, 9 aa, Homo Sapiens
LHFGCPVGS

SEQ ID NO: 324457 - protein, 9 aa, Homo Sapiens
EDFDQALLW

SEQ ID NO: 324458 - protein, 9 aa, Homo Sapiens
ALSRWANLP

SEQ ID NO: 324459 - protein, 9 aa, Homo Sapiens
IDTKLEKPQ

SEQ ID NO: 324460 - protein, 9 aa, Homo Sapiens
PELLYHTDF

SEQ ID NO: 324461 - protein, 9 aa, Homo Sapiens
DLCGKIVAL

SEQ ID NO: 324462 - protein, 9 aa, Homo Sapiens
TPRCTLDFA

SEQ ID NO: 324463 - protein, 9 aa, Homo Sapiens
ISSHSDMTT

SEQ ID NO: 324464 - protein, 9 aa, Homo Sapiens
RPLQRVRHT

SEQ ID NO: 324465 - protein, 9 aa, Homo Sapiens
EVEPQFSLP

SEQ ID NO: 324466 - protein, 9 aa, Homo Sapiens
CGLALLHHS

SEQ ID NO: 324467 - protein, 9 aa, Homo Sapiens
GSWAAGYGV

SEQ ID NO: 324468 - protein, 9 aa, Homo Sapiens
PQPAPHLAW

SEQ ID NO: 324469 - protein, 9 aa, Homo Sapiens
QVTYHISGV

SEQ ID NO: 324470 - protein, 9 aa, Homo Sapiens
GGSPSRSAA

SEQ ID NO: 324471 - protein, 9 aa, Homo Sapiens
LNLNCILIL

SEQ ID NO: 324472 - protein, 9 aa, Homo Sapiens
ATGKTTKIP

SEQ ID NO: 324473 - protein, 9 aa, Homo Sapiens
SPLVSGSHL

SEQ ID NO: 324474 - protein, 9 aa, Homo Sapiens
YSSYFGIFL

SEQ ID NO: 324475 - protein, 9 aa, Homo Sapiens
FSLATPLCA

SEQ ID NO: 324476 - protein, 9 aa, Homo Sapiens
LFTHCSGAS

SEQ ID NO: 324477 - protein, 9 aa, Homo Sapiens
KQKKMKAYE

SEQ ID NO: 324478 - protein, 9 aa, Homo Sapiens
SGTKPKTMA

SEQ ID NO: 324479 - protein, 9 aa, Homo Sapiens
KQWPSRFFM

SEQ ID NO: 324480 - protein, 9 aa, Homo Sapiens
WPSSSQHGY

SEQ ID NO: 324481 - protein, 9 aa, Homo Sapiens
GWQWKPQLG

SEQ ID NO: 324482 - protein, 9 aa, Homo Sapiens
ALTPPTNMP

SEQ ID NO: 324483 - protein, 9 aa, Homo Sapiens
IWKRSAWRK

SEQ ID NO: 324484 - protein, 9 aa, Homo Sapiens
RTGLAFCPG

SEQ ID NO: 324485 - protein, 9 aa, Homo Sapiens
HSRMRLDPV

SEQ ID NO: 324486 - protein, 9 aa, Homo Sapiens
GLSGCLAED

SEQ ID NO: 324487 - protein, 9 aa, Homo Sapiens
ESQLVLVRD

SEQ ID NO: 324488 - protein, 9 aa, Homo Sapiens
RYGMGKPEV

SEQ ID NO: 324489 - protein, 9 aa, Homo Sapiens
ALSSAAASP

SEQ ID NO: 324490 - protein, 9 aa, Homo Sapiens
YGVHTCEGC

SEQ ID NO: 324491 - protein, 9 aa, Homo Sapiens
NTKKNWVST

SEQ ID NO: 324492 - protein, 9 aa, Homo Sapiens
WAQRGGGGS

SEQ ID NO: 324493 - protein, 9 aa, Homo Sapiens
HLAWEFMIK

SEQ ID NO: 324494 - protein, 9 aa, Homo Sapiens
DAVLAWSDS

SEQ ID NO: 324495 - protein, 9 aa, Homo Sapiens
AADAQVLHV

SEQ ID NO: 324496 - protein, 9 aa, Homo Sapiens
CVAELVKTY

SEQ ID NO: 324497 - protein, 9 aa, Homo Sapiens
SLELPVCAP

SEQ ID NO: 324498 - protein, 9 aa, Homo Sapiens
GENGFRCIC

SEQ ID NO: 324499 - protein, 9 aa, Homo Sapiens
SQQKAMNTC

SEQ ID NO: 324500 - protein, 9 aa, Homo Sapiens
SPGWQQPAL

SEQ ID NO: 324501 - protein, 9 aa, Homo Sapiens
WEFMIKTRR

SEQ ID NO: 324502 - protein, 9 aa, Homo Sapiens
PVRASSLNS

SEQ ID NO: 324503 - protein, 9 aa, Homo Sapiens
AVRRQRQAM

SEQ ID NO: 324504 - protein, 9 aa, Homo Sapiens
KPYKCDGCG

SEQ ID NO: 324505 - protein, 9 aa, Homo Sapiens
PTSPGASEH

SEQ ID NO: 324506 - protein, 9 aa, Homo Sapiens
QDLVMHARG

SEQ ID NO: 324507 - protein, 9 aa, Homo Sapiens
IVCGMNQVL

SEQ ID NO: 324508 - protein, 9 aa, Homo Sapiens
SGWVGPNGC

SEQ ID NO: 324509 - protein, 9 aa, Homo Sapiens
LNYCGVHAS

SEQ ID NO: 324510 - protein, 9 aa, Homo Sapiens
PDGPPSPMG

SEQ ID NO: 324511 - protein, 9 aa, Homo Sapiens
RQRAEDDCE

SEQ ID NO: 324512 - protein, 9 aa, Homo Sapiens
KEAVKDSVW

SEQ ID NO: 324513 - protein, 9 aa, Homo Sapiens
VICDALLIT

SEQ ID NO: 324514 - protein, 9 aa, Homo Sapiens
MWHQPYQLK

SEQ ID NO: 324515 - protein, 9 aa, Homo Sapiens
ELSIEEAQD

SEQ ID NO: 324516 - protein, 9 aa, Homo Sapiens
NTKHAIRSL

SEQ ID NO: 324517 - protein, 9 aa, Homo Sapiens
LRAVEAELE

SEQ ID NO: 324518 - protein, 9 aa, Homo Sapiens
QSIELKVIQ

SEQ ID NO: 324519 - protein, 9 aa, Homo Sapiens
AAPKNRCTI

SEQ ID NO: 324520 - protein, 9 aa, Homo Sapiens
DWRKPTTIS

SEQ ID NO: 324521 - protein, 9 aa, Homo Sapiens
QNSNVVNFA

SEQ ID NO: 324522 - protein, 9 aa, Homo Sapiens
PGVKTHSEV

SEQ ID NO: 324523 - protein, 9 aa, Homo Sapiens
TIHKAHLLS

SEQ ID NO: 324524 - protein, 9 aa, Homo Sapiens
LQKLSKKDV

SEQ ID NO: 324525 - protein, 9 aa, Homo Sapiens
DSLGEAVDT

SEQ ID NO: 324526 - protein, 9 aa, Homo Sapiens
WLTWVLLPS

SEQ ID NO: 324527 - protein, 9 aa, Homo Sapiens
TSWRVLISG

SEQ ID NO: 324528 - protein, 9 aa, Homo Sapiens
AIAIYKVLQ

SEQ ID NO: 324529 - protein, 9 aa, Homo Sapiens
SLVQEGTAQ

SEQ ID NO: 324530 - protein, 9 aa, Homo Sapiens
CPVCGHVYP

SEQ ID NO: 324531 - protein, 9 aa, Homo Sapiens
KKNWVSTSK

SEQ ID NO: 324532 - protein, 9 aa, Homo Sapiens
VNEVNVDIK

SEQ ID NO: 324533 - protein, 9 aa, Homo Sapiens
ELVQHICAA

SEQ ID NO: 324534 - protein, 9 aa, Homo Sapiens
EAPSMGTLV

SEQ ID NO: 324535 - protein, 9 aa, Homo Sapiens
HPTSCCSAT

SEQ ID NO: 324536 - protein, 9 aa, Homo Sapiens
PNVPSCCLL

SEQ ID NO: 324537 - protein, 9 aa, Homo Sapiens
VGLVLRHLL

SEQ ID NO: 324538 - protein, 9 aa, Homo Sapiens
NTLVQMADG

SEQ ID NO: 324539 - protein, 9 aa, Homo Sapiens
VPVTVALLR

SEQ ID NO: 324540 - protein, 9 aa, Homo Sapiens
PSISPPKTP

SEQ ID NO: 324541 - protein, 9 aa, Homo Sapiens
QLGGEVGDD

SEQ ID NO: 324542 - protein, 9 aa, Homo Sapiens
EATNVVTFD

SEQ ID NO: 324543 - protein, 9 aa, Homo Sapiens
PFLCELSIK

SEQ ID NO: 324544 - protein, 9 aa, Homo Sapiens
HIHASYSIF

SEQ ID NO: 324545 - protein, 9 aa, Homo Sapiens
EVVNEILED

SEQ ID NO: 324546 - protein, 9 aa, Homo Sapiens
PLQTVRLME

SEQ ID NO: 324547 - protein, 9 aa, Homo Sapiens
PSTWMFQSP

SEQ ID NO: 324548 - protein, 9 aa, Homo Sapiens
VGAPGGAPS

SEQ ID NO: 324549 - protein, 9 aa, Homo Sapiens
PHRSFFESF

SEQ ID NO: 324550 - protein, 9 aa, Homo Sapiens
IGISCLAGV

SEQ ID NO: 324551 - protein, 9 aa, Homo Sapiens
LCLSWKGHV

SEQ ID NO: 324552 - protein, 9 aa, Homo Sapiens
WGQDPCVIT

SEQ ID NO: 324553 - protein, 9 aa, Homo Sapiens
QEGTRTGAE

SEQ ID NO: 324554 - protein, 9 aa, Homo Sapiens
RHRFMSVYE

SEQ ID NO: 324555 - protein, 9 aa, Homo Sapiens
EVLMDIFAK

SEQ ID NO: 324556 - protein, 9 aa, Homo Sapiens
YELSSIQVD

SEQ ID NO: 324557 - protein, 9 aa, Homo Sapiens
QIQEIVVET

SEQ ID NO: 324558 - protein, 9 aa, Homo Sapiens
SRRLSVLNA

SEQ ID NO: 324559 - protein, 9 aa, Homo Sapiens
ALVRWGKYG

SEQ ID NO: 324560 - protein, 9 aa, Homo Sapiens
LKHVGPGKP

SEQ ID NO: 324561 - protein, 9 aa, Homo Sapiens
CACCGGRVS

SEQ ID NO: 324562 - protein, 9 aa, Homo Sapiens
PWRAGFQWG

SEQ ID NO: 324563 - protein, 9 aa, Homo Sapiens
LEMWWNKRK

SEQ ID NO: 324564 - protein, 9 aa, Homo Sapiens
KCEAMLEML

SEQ ID NO: 324565 - protein, 9 aa, Homo Sapiens
TRKEMAPVQ

SEQ ID NO: 324566 - protein, 9 aa, Homo Sapiens
LRRPPPRAT

SEQ ID NO: 324567 - protein, 9 aa, Homo Sapiens
VNIVKVDVT

SEQ ID NO: 324568 - protein, 9 aa, Homo Sapiens
AGYREEIVQ

SEQ ID NO: 324569 - protein, 9 aa, Homo Sapiens
LRWSYNELG

SEQ ID NO: 324570 - protein, 9 aa, Homo Sapiens
GIREELEVL

SEQ ID NO: 324571 - protein, 9 aa, Homo Sapiens
TTLYEALAA

SEQ ID NO: 324572 - protein, 9 aa, Homo Sapiens
GHPVVVPHG

SEQ ID NO: 324573 - protein, 9 aa, Homo Sapiens
HYLHLNSSI

SEQ ID NO: 324574 - protein, 9 aa, Homo Sapiens
VRAADPDLG

SEQ ID NO: 324575 - protein, 9 aa, Homo Sapiens
LGTLESQWG

SEQ ID NO: 324576 - protein, 9 aa, Homo Sapiens
SPDLLTLGH

SEQ ID NO: 324577 - protein, 9 aa, Homo Sapiens
SATVPHHEP

SEQ ID NO: 324578 - protein, 9 aa, Homo Sapiens
VFLKCENMQ

SEQ ID NO: 324579 - protein, 9 aa, Homo Sapiens
SQACAEQCN

SEQ ID NO: 324580 - protein, 9 aa, Homo Sapiens
NRAQKARLA

SEQ ID NO: 324581 - protein, 9 aa, Homo Sapiens
RSLSSCSKN

SEQ ID NO: 324582 - protein, 9 aa, Homo Sapiens
YKWNGHWWE

SEQ ID NO: 324583 - protein, 9 aa, Homo Sapiens
FLPGNLQYC

SEQ ID NO: 324584 - protein, 9 aa, Homo Sapiens
LRQRGSDIF

SEQ ID NO: 324585 - protein, 9 aa, Homo Sapiens
LKEDRESRF

SEQ ID NO: 324586 - protein, 9 aa, Homo Sapiens
RVQNILINE

SEQ ID NO: 324587 - protein, 9 aa, Homo Sapiens
ENSCTEMEG

SEQ ID NO: 324588 - protein, 9 aa, Homo Sapiens
RQVALCDQD

SEQ ID NO: 324589 - protein, 9 aa, Homo Sapiens
FGIFLLAVF

SEQ ID NO: 324590 - protein, 9 aa, Homo Sapiens
PLVPSSSLS

SEQ ID NO: 324591 - protein, 9 aa, Homo Sapiens
TSDGMNVAP

SEQ ID NO: 324592 - protein, 9 aa, Homo Sapiens
WSSQREEGD

SEQ ID NO: 324593 - protein, 9 aa, Homo Sapiens
KIAIKLWLH

SEQ ID NO: 324594 - protein, 9 aa, Homo Sapiens
CTLDFAPQT

SEQ ID NO: 324595 - protein, 9 aa, Homo Sapiens
QALLWHIVK

SEQ ID NO: 324596 - protein, 9 aa, Homo Sapiens
WNTSDLRYK

SEQ ID NO: 324597 - protein, 9 aa, Homo Sapiens
YNSLLLRYQ

SEQ ID NO: 324598 - protein, 9 aa, Homo Sapiens
SWAALSNSG

SEQ ID NO: 324599 - protein, 9 aa, Homo Sapiens
MRRTLRICF

SEQ ID NO: 324600 - protein, 9 aa, Homo Sapiens
VDGPKSTRP

SEQ ID NO: 324601 - protein, 9 aa, Homo Sapiens
VFQGHKKEA

SEQ ID NO: 324602 - protein, 9 aa, Homo Sapiens
RMRLDPVLF

SEQ ID NO: 324603 - protein, 9 aa, Homo Sapiens
IFTGECVMK

SEQ ID NO: 324604 - protein, 9 aa, Homo Sapiens
FRLYAARKL

SEQ ID NO: 324605 - protein, 9 aa, Homo Sapiens
GAISYTVEL

SEQ ID NO: 324606 - protein, 9 aa, Homo Sapiens
WEKIYAICS

SEQ ID NO: 324607 - protein, 9 aa, Homo Sapiens
KDKDGQLVR

SEQ ID NO: 324608 - protein, 9 aa, Homo Sapiens
NHMIKSSHP

SEQ ID NO: 324609 - protein, 9 aa, Homo Sapiens
DEHTLWKRG

SEQ ID NO: 324610 - protein, 9 aa, Homo Sapiens
EDSDSSPSC

SEQ ID NO: 324611 - protein, 9 aa, Homo Sapiens
PDWFWWRQG

SEQ ID NO: 324612 - protein, 9 aa, Homo Sapiens
VLLPLLLCT

SEQ ID NO: 324613 - protein, 9 aa, Homo Sapiens
DSEILSDAC

SEQ ID NO: 324614 - protein, 9 aa, Homo Sapiens
DNELCICAR

SEQ ID NO: 324615 - protein, 9 aa, Homo Sapiens
NAGLKMLVT

SEQ ID NO: 324616 - protein, 9 aa, Homo Sapiens
RQKIVIIAK

SEQ ID NO: 324617 - protein, 9 aa, Homo Sapiens
RSAWRKTTW

SEQ ID NO: 324618 - protein, 9 aa, Homo Sapiens
DGQLVRTGS

SEQ ID NO: 324619 - protein, 9 aa, Homo Sapiens
VKEILLWKG

SEQ ID NO: 324620 - protein, 9 aa, Homo Sapiens
KACITHWWE

SEQ ID NO: 324621 - protein, 9 aa, Homo Sapiens
EVYRWDSKK

SEQ ID NO: 324622 - protein, 9 aa, Homo Sapiens
ISSPFAAAI

SEQ ID NO: 324623 - protein, 9 aa, Homo Sapiens
PWHSCRLAG

SEQ ID NO: 324624 - protein, 9 aa, Homo Sapiens
DRATHRVMR

SEQ ID NO: 324625 - protein, 9 aa, Homo Sapiens
QDQIAELQV

SEQ ID NO: 324626 - protein, 9 aa, Homo Sapiens
EGGCASGTW

SEQ ID NO: 324627 - protein, 9 aa, Homo Sapiens
GPSPRGRTD

SEQ ID NO: 324628 - protein, 9 aa, Homo Sapiens
RMVIIRQHE

SEQ ID NO: 324629 - protein, 9 aa, Homo Sapiens
GGSGLSCHQ

SEQ ID NO: 324630 - protein, 9 aa, Homo Sapiens
KKCTVNREE

SEQ ID NO: 324631 - protein, 9 aa, Homo Sapiens
NKIVKNRQT

SEQ ID NO: 324632 - protein, 9 aa, Homo Sapiens
QIVCVFQGL

SEQ ID NO: 324633 - protein, 9 aa, Homo Sapiens
HFLVMLRII

SEQ ID NO: 324634 - protein, 9 aa, Homo Sapiens
IYTGLFLFT

SEQ ID NO: 324635 - protein, 9 aa, Homo Sapiens
LQINFYCPG

SEQ ID NO: 324636 - protein, 9 aa, Homo Sapiens
SHWTYEYTW

SEQ ID NO: 324637 - protein, 9 aa, Homo Sapiens
LTISGLFPG

SEQ ID NO: 324638 - protein, 9 aa, Homo Sapiens
SMEWRPAEE

SEQ ID NO: 324639 - protein, 9 aa, Homo Sapiens
PMCPPPPPP

SEQ ID NO: 324640 - protein, 9 aa, Homo Sapiens
TSSCRGARA

SEQ ID NO: 324641 - protein, 9 aa, Homo Sapiens
DVGVCRRLV

SEQ ID NO: 324642 - protein, 9 aa, Homo Sapiens
PIPSSSPTP

SEQ ID NO: 324643 - protein, 9 aa, Homo Sapiens
QGHMGIVLN

SEQ ID NO: 324644 - protein, 9 aa, Homo Sapiens
ITADVAHFE

SEQ ID NO: 324645 - protein, 9 aa, Homo Sapiens
RIYKWVPVM

SEQ ID NO: 324646 - protein, 9 aa, Homo Sapiens
EAKGQSVGE

SEQ ID NO: 324647 - protein, 9 aa, Homo Sapiens
WLFDLHGEN

SEQ ID NO: 324648 - protein, 9 aa, Homo Sapiens
RMVANYEPE

SEQ ID NO: 324649 - protein, 9 aa, Homo Sapiens
SVYGYFHRS

SEQ ID NO: 324650 - protein, 9 aa, Homo Sapiens
HEKVLHILV

SEQ ID NO: 324651 - protein, 9 aa, Homo Sapiens
KCPVWINAD

SEQ ID NO: 324652 - protein, 9 aa, Homo Sapiens
LRCSDAWRD

SEQ ID NO: 324653 - protein, 9 aa, Homo Sapiens
GKEFTAGAD

SEQ ID NO: 324654 - protein, 9 aa, Homo Sapiens
RLAVHEDGL

SEQ ID NO: 324655 - protein, 9 aa, Homo Sapiens
PLARTRTLT

SEQ ID NO: 324656 - protein, 9 aa, Homo Sapiens
LSFHKVEML

SEQ ID NO: 324657 - protein, 9 aa, Homo Sapiens
GQPYNSAVY

SEQ ID NO: 324658 - protein, 9 aa, Homo Sapiens
TSCCSATEI

SEQ ID NO: 324659 - protein, 9 aa, Homo Sapiens
VLGHSVQCW

SEQ ID NO: 324660 - protein, 9 aa, Homo Sapiens
KSITMLRNK

SEQ ID NO: 324661 - protein, 9 aa, Homo Sapiens
KLKNKASIL

SEQ ID NO: 324662 - protein, 9 aa, Homo Sapiens
APPKAKMPA

SEQ ID NO: 324663 - protein, 9 aa, Homo Sapiens
DKAEAWGII

SEQ ID NO: 324664 - protein, 9 aa, Homo Sapiens
GDWFVCLEK

SEQ ID NO: 324665 - protein, 9 aa, Homo Sapiens
LGHSVQCWM

SEQ ID NO: 324666 - protein, 9 aa, Homo Sapiens
IEENPGKFL

SEQ ID NO: 324667 - protein, 9 aa, Homo Sapiens
REWLGRAIF

SEQ ID NO: 324668 - protein, 9 aa, Homo Sapiens
VVTNQIEEG

SEQ ID NO: 324669 - protein, 9 aa, Homo Sapiens
QAEAAEHSR

SEQ ID NO: 324670 - protein, 9 aa, Homo Sapiens
QHFYCGSSF

SEQ ID NO: 324671 - protein, 9 aa, Homo Sapiens
GFFQGPPRL

SEQ ID NO: 324672 - protein, 9 aa, Homo Sapiens
LYVVRSVCQ

SEQ ID NO: 324673 - protein, 9 aa, Homo Sapiens
KLMRLPSGK

SEQ ID NO: 324674 - protein, 9 aa, Homo Sapiens
MEHILVHLE

SEQ ID NO: 324675 - protein, 9 aa, Homo Sapiens
FLFTVTLEQ

SEQ ID NO: 324676 - protein, 9 aa, Homo Sapiens
RWCMSLRPS

SEQ ID NO: 324677 - protein, 9 aa, Homo Sapiens
SRRKEALGL

SEQ ID NO: 324678 - protein, 9 aa, Homo Sapiens
IFMRFGRTV

SEQ ID NO: 324679 - protein, 9 aa, Homo Sapiens
GKPKADMTG

SEQ ID NO: 324680 - protein, 9 aa, Homo Sapiens
DSKSITTLK

SEQ ID NO: 324681 - protein, 9 aa, Homo Sapiens
PPCTPNIVT

SEQ ID NO: 324682 - protein, 9 aa, Homo Sapiens
CGEGFVNTY

SEQ ID NO: 324683 - protein, 9 aa, Homo Sapiens
PLRWCACPR

SEQ ID NO: 324684 - protein, 9 aa, Homo Sapiens
IQVIEPFSR

SEQ ID NO: 324685 - protein, 9 aa, Homo Sapiens
RSSRQTGAK

SEQ ID NO: 324686 - protein, 9 aa, Homo Sapiens
TAVAMQGRY

SEQ ID NO: 324687 - protein, 9 aa, Homo Sapiens
QLPTSFTLV

SEQ ID NO: 324688 - protein, 9 aa, Homo Sapiens
TFLFLLVCF

SEQ ID NO: 324689 - protein, 9 aa, Homo Sapiens
PHPTCTKDW

SEQ ID NO: 324690 - protein, 9 aa, Homo Sapiens
VRDVWPYIV

SEQ ID NO: 324691 - protein, 9 aa, Homo Sapiens
WMAAPKNRC

SEQ ID NO: 324692 - protein, 9 aa, Homo Sapiens
VAAVLDPLG

SEQ ID NO: 324693 - protein, 9 aa, Homo Sapiens
YTVELEAIA

SEQ ID NO: 324694 - protein, 9 aa, Homo Sapiens
AFYQGSVYP

SEQ ID NO: 324695 - protein, 9 aa, Homo Sapiens
LCENDSRST

SEQ ID NO: 324696 - protein, 9 aa, Homo Sapiens
TVMETIAVG

SEQ ID NO: 324697 - protein, 9 aa, Homo Sapiens
EPPLTPRCT

SEQ ID NO: 324698 - protein, 9 aa, Homo Sapiens
RRQRQAMER

SEQ ID NO: 324699 - protein, 9 aa, Homo Sapiens
ISIDVIVYA

SEQ ID NO: 324700 - protein, 9 aa, Homo Sapiens
RCGRDPEMG

SEQ ID NO: 324701 - protein, 9 aa, Homo Sapiens
IGGNPEPSF

SEQ ID NO: 324702 - protein, 9 aa, Homo Sapiens
LGFFLPFVA

SEQ ID NO: 324703 - protein, 9 aa, Homo Sapiens
KNVARGCLT

SEQ ID NO: 324704 - protein, 9 aa, Homo Sapiens
RPEQKIKDI

SEQ ID NO: 324705 - protein, 9 aa, Homo Sapiens
TMEVPVRAS

SEQ ID NO: 324706 - protein, 9 aa, Homo Sapiens
WSDSAQIVA

SEQ ID NO: 324707 - protein, 9 aa, Homo Sapiens
MAAIQKKLV

SEQ ID NO: 324708 - protein, 9 aa, Homo Sapiens
EDVTVPLVD

SEQ ID NO: 324709 - protein, 9 aa, Homo Sapiens
GPRAGARPH

SEQ ID NO: 324710 - protein, 9 aa, Homo Sapiens
KEHDLSISS

SEQ ID NO: 324711 - protein, 9 aa, Homo Sapiens
GDIIVLWRK

SEQ ID NO: 324712 - protein, 9 aa, Homo Sapiens
QPVVQHRSS

SEQ ID NO: 324713 - protein, 9 aa, Homo Sapiens
HSILKKSVP

SEQ ID NO: 324714 - protein, 9 aa, Homo Sapiens
KKYEYKKPE

SEQ ID NO: 324715 - protein, 9 aa, Homo Sapiens
AQAELLKHQ

SEQ ID NO: 324716 - protein, 9 aa, Homo Sapiens
HQGAPMLAP

SEQ ID NO: 324717 - protein, 9 aa, Homo Sapiens
YWHVYLEGL

SEQ ID NO: 324718 - protein, 9 aa, Homo Sapiens
IALNMVHKF

SEQ ID NO: 324719 - protein, 9 aa, Homo Sapiens
CSRSQLKKI

SEQ ID NO: 324720 - protein, 9 aa, Homo Sapiens
TTIWLLESL

SEQ ID NO: 324721 - protein, 9 aa, Homo Sapiens
CTIEVNRCR

SEQ ID NO: 324722 - protein, 9 aa, Homo Sapiens
TPRPRRLQS

SEQ ID NO: 324723 - protein, 9 aa, Homo Sapiens
AARSQLPWP

SEQ ID NO: 324724 - protein, 9 aa, Homo Sapiens
GAERETAVV

SEQ ID NO: 324725 - protein, 9 aa, Homo Sapiens
KKLVKISEI

SEQ ID NO: 324726 - protein, 9 aa, Homo Sapiens
SGASSRPPT

SEQ ID NO: 324727 - protein, 9 aa, Homo Sapiens
IHRGMDSTR

SEQ ID NO: 324728 - protein, 9 aa, Homo Sapiens
LVWYAPVPC

SEQ ID NO: 324729 - protein, 9 aa, Homo Sapiens
NMRMGNLPA

SEQ ID NO: 324730 - protein, 9 aa, Homo Sapiens
KIQTVKMTF

SEQ ID NO: 324731 - protein, 9 aa, Homo Sapiens
ILCHCCDLI

SEQ ID NO: 324732 - protein, 9 aa, Homo Sapiens
YQFSHPGPQ

SEQ ID NO: 324733 - protein, 9 aa, Homo Sapiens
HMGNLRSLN

SEQ ID NO: 324734 - protein, 9 aa, Homo Sapiens
DHPDYKCQP

SEQ ID NO: 324735 - protein, 9 aa, Homo Sapiens
LCACVCVCV

SEQ ID NO: 324736 - protein, 9 aa, Homo Sapiens
NIRMMQVQE

SEQ ID NO: 324737 - protein, 9 aa, Homo Sapiens
FIAGVVIHM

SEQ ID NO: 324738 - protein, 9 aa, Homo Sapiens
MCFRPMQMA

SEQ ID NO: 324739 - protein, 9 aa, Homo Sapiens
AWHKVFINP

SEQ ID NO: 324740 - protein, 9 aa, Homo Sapiens
DWVVFEPDL

SEQ ID NO: 324741 - protein, 9 aa, Homo Sapiens
PTEEEWEFT

SEQ ID NO: 324742 - protein, 9 aa, Homo Sapiens
EECDCHPQV

SEQ ID NO: 324743 - protein, 9 aa, Homo Sapiens
ENGFRCICP

SEQ ID NO: 324744 - protein, 9 aa, Homo Sapiens
QPAGVSPST

SEQ ID NO: 324745 - protein, 9 aa, Homo Sapiens
EHGPRSSWP

SEQ ID NO: 324746 - protein, 9 aa, Homo Sapiens
QMARVQNHH

SEQ ID NO: 324747 - protein, 9 aa, Homo Sapiens
LLAKVNNAE

SEQ ID NO: 324748 - protein, 9 aa, Homo Sapiens
RCARDPDNN

SEQ ID NO: 324749 - protein, 9 aa, Homo Sapiens
ASVTMQPTE

SEQ ID NO: 324750 - protein, 9 aa, Homo Sapiens
TPLAFASST

SEQ ID NO: 324751 - protein, 9 aa, Homo Sapiens
MQPCIDLIE

SEQ ID NO: 324752 - protein, 9 aa, Homo Sapiens
LVVVGAGDV

SEQ ID NO: 324753 - protein, 9 aa, Homo Sapiens
KNYGMTHMD

SEQ ID NO: 324754 - protein, 9 aa, Homo Sapiens
LDWVVFEPD

SEQ ID NO: 324755 - protein, 9 aa, Homo Sapiens
TYIQRGLHR

SEQ ID NO: 324756 - protein, 9 aa, Homo Sapiens
LFANLYLLM

SEQ ID NO: 324757 - protein, 9 aa, Homo Sapiens
FENIGKKRI

SEQ ID NO: 324758 - protein, 9 aa, Homo Sapiens
PWQMLACCM

SEQ ID NO: 324759 - protein, 9 aa, Homo Sapiens
ARHTKGPKF

SEQ ID NO: 324760 - protein, 9 aa, Homo Sapiens
PPAHPADAE

SEQ ID NO: 324761 - protein, 9 aa, Homo Sapiens
GWPFGSTKD

SEQ ID NO: 324762 - protein, 9 aa, Homo Sapiens
KFYVHSEAT

SEQ ID NO: 324763 - protein, 9 aa, Homo Sapiens
RVHSINLKE

SEQ ID NO: 324764 - protein, 9 aa, Homo Sapiens
YDLETGKYV

SEQ ID NO: 324765 - protein, 9 aa, Homo Sapiens
FTTYIQRGL

SEQ ID NO: 324766 - protein, 9 aa, Homo Sapiens
PDIRSHPRS

SEQ ID NO: 324767 - protein, 9 aa, Homo Sapiens
TQSTQEIHE

SEQ ID NO: 324768 - protein, 9 aa, Homo Sapiens
ELLLWSSQR

SEQ ID NO: 324769 - protein, 9 aa, Homo Sapiens
GNMELIPKE

SEQ ID NO: 324770 - protein, 9 aa, Homo Sapiens
FKQTNVYSM

SEQ ID NO: 324771 - protein, 9 aa, Homo Sapiens
GHWWEPSGK

SEQ ID NO: 324772 - protein, 9 aa, Homo Sapiens
LVSLPTLAV

SEQ ID NO: 324773 - protein, 9 aa, Homo Sapiens
PSVDTRHKK

SEQ ID NO: 324774 - protein, 9 aa, Homo Sapiens
MRFQPSAKR

SEQ ID NO: 324775 - protein, 9 aa, Homo Sapiens
WGVAVLCTE

SEQ ID NO: 324776 - protein, 9 aa, Homo Sapiens
NRRLQVESE

SEQ ID NO: 324777 - protein, 9 aa, Homo Sapiens
LTVMSSCSR

SEQ ID NO: 324778 - protein, 9 aa, Homo Sapiens
FATAMQILG

SEQ ID NO: 324779 - protein, 9 aa, Homo Sapiens
NADRLGSSK

SEQ ID NO: 324780 - protein, 9 aa, Homo Sapiens
HKRWQRSSC

SEQ ID NO: 324781 - protein, 9 aa, Homo Sapiens
SSCRGARAP

SEQ ID NO: 324782 - protein, 9 aa, Homo Sapiens
GHSGPELQQ

SEQ ID NO: 324783 - protein, 9 aa, Homo Sapiens
HMTPEQIVW

SEQ ID NO: 324784 - protein, 9 aa, Homo Sapiens
DAAYSQCAT

SEQ ID NO: 324785 - protein, 9 aa, Homo Sapiens
RGKSRWRKE

SEQ ID NO: 324786 - protein, 9 aa, Homo Sapiens
RHLADGKKA

SEQ ID NO: 324787 - protein, 9 aa, Homo Sapiens
CTFRNFLDK

SEQ ID NO: 324788 - protein, 9 aa, Homo Sapiens
DRDAHANGW

SEQ ID NO: 324789 - protein, 9 aa, Homo Sapiens
ATPLCAGEE

SEQ ID NO: 324790 - protein, 9 aa, Homo Sapiens
SKLDAAPRS

SEQ ID NO: 324791 - protein, 9 aa, Homo Sapiens
PVTHTWEKI

SEQ ID NO: 324792 - protein, 9 aa, Homo Sapiens
SKAKDDQTP

SEQ ID NO: 324793 - protein, 9 aa, Homo Sapiens
RTGTGTGGR

SEQ ID NO: 324794 - protein, 9 aa, Homo Sapiens
NVPIMLSAS

SEQ ID NO: 324795 - protein, 9 aa, Homo Sapiens
RRFNLYEDC

SEQ ID NO: 324796 - protein, 9 aa, Homo Sapiens
ADLKLLGSS

SEQ ID NO: 324797 - protein, 9 aa, Homo Sapiens
LSLKHRSPM

SEQ ID NO: 324798 - protein, 9 aa, Homo Sapiens
PSPQIAWQK

SEQ ID NO: 324799 - protein, 9 aa, Homo Sapiens
EGACEREEL

SEQ ID NO: 324800 - protein, 9 aa, Homo Sapiens
GFPMWGRGG

SEQ ID NO: 324801 - protein, 9 aa, Homo Sapiens
RQEDQHRLL

SEQ ID NO: 324802 - protein, 9 aa, Homo Sapiens
AGSRPWIKN

SEQ ID NO: 324803 - protein, 9 aa, Homo Sapiens
YFGIFLLAV

SEQ ID NO: 324804 - protein, 9 aa, Homo Sapiens
QKDPRNAGL

SEQ ID NO: 324805 - protein, 9 aa, Homo Sapiens
PLGDLLQGV

SEQ ID NO: 324806 - protein, 9 aa, Homo Sapiens
SGSESDQPN

SEQ ID NO: 324807 - protein, 9 aa, Homo Sapiens
PASSLAHHV

SEQ ID NO: 324808 - protein, 9 aa, Homo Sapiens
LWKKGLSLS

SEQ ID NO: 324809 - protein, 9 aa, Homo Sapiens
HRVAQADLK

SEQ ID NO: 324810 - protein, 9 aa, Homo Sapiens
GRWRGHAES

SEQ ID NO: 324811 - protein, 9 aa, Homo Sapiens
RKQEEAWLT

SEQ ID NO: 324812 - protein, 9 aa, Homo Sapiens
AEPMGRLVQ

SEQ ID NO: 324813 - protein, 9 aa, Homo Sapiens
QRLQGLLEM

SEQ ID NO: 324814 - protein, 9 aa, Homo Sapiens
VTSQDPGVP

SEQ ID NO: 324815 - protein, 9 aa, Homo Sapiens
ECINFCKFS

SEQ ID NO: 324816 - protein, 9 aa, Homo Sapiens
RHRQAEMGT

SEQ ID NO: 324817 - protein, 9 aa, Homo Sapiens
HETSLGLLT

SEQ ID NO: 324818 - protein, 9 aa, Homo Sapiens
GAPVPWSQP

SEQ ID NO: 324819 - protein, 9 aa, Homo Sapiens
YVTLLVESL

SEQ ID NO: 324820 - protein, 9 aa, Homo Sapiens
ICLENCVLK

SEQ ID NO: 324821 - protein, 9 aa, Homo Sapiens
EVRDVWPYI

SEQ ID NO: 324822 - protein, 9 aa, Homo Sapiens
IRSHPRSLE

SEQ ID NO: 324823 - protein, 9 aa, Homo Sapiens
NALLEQQVC

SEQ ID NO: 324824 - protein, 9 aa, Homo Sapiens
WDNGRQVTY

SEQ ID NO: 324825 - protein, 9 aa, Homo Sapiens
TSREEVVIS

SEQ ID NO: 324826 - protein, 9 aa, Homo Sapiens
PSITLGNVF

SEQ ID NO: 324827 - protein, 9 aa, Homo Sapiens
EENPYKCDE

SEQ ID NO: 324828 - protein, 9 aa, Homo Sapiens
IAPEVIFHQ

SEQ ID NO: 324829 - protein, 9 aa, Homo Sapiens
NSLGETAEC

SEQ ID NO: 324830 - protein, 9 aa, Homo Sapiens
RVTASSGIM

SEQ ID NO: 324831 - protein, 9 aa, Homo Sapiens
ILTVLLAVI

SEQ ID NO: 324832 - protein, 9 aa, Homo Sapiens
VESDEMCPC

SEQ ID NO: 324833 - protein, 9 aa, Homo Sapiens
CSSCGEGFV

SEQ ID NO: 324834 - protein, 9 aa, Homo Sapiens
SPEDIVTVQ

SEQ ID NO: 324835 - protein, 9 aa, Homo Sapiens
GFSNRAQKA

SEQ ID NO: 324836 - protein, 9 aa, Homo Sapiens
TCSNVRCRR

SEQ ID NO: 324837 - protein, 9 aa, Homo Sapiens
ASGNVATGD

SEQ ID NO: 324838 - protein, 9 aa, Homo Sapiens
YTYLQINFY

SEQ ID NO: 324839 - protein, 9 aa, Homo Sapiens
QKLVCIVSM

SEQ ID NO: 324840 - protein, 9 aa, Homo Sapiens
DGYAYFMRG

SEQ ID NO: 324841 - protein, 9 aa, Homo Sapiens
CHVCGIHLN

SEQ ID NO: 324842 - protein, 9 aa, Homo Sapiens
FASSTSPTD

SEQ ID NO: 324843 - protein, 9 aa, Homo Sapiens
HGEAHMSPL

SEQ ID NO: 324844 - protein, 9 aa, Homo Sapiens
LQRELERLH

SEQ ID NO: 324845 - protein, 9 aa, Homo Sapiens
AIFTGECVM

SEQ ID NO: 324846 - protein, 9 aa, Homo Sapiens
FTAMDAYVK

SEQ ID NO: 324847 - protein, 9 aa, Homo Sapiens
FSWGKNGKD

SEQ ID NO: 324848 - protein, 9 aa, Homo Sapiens
EPPPGTEAY

SEQ ID NO: 324849 - protein, 9 aa, Homo Sapiens
MKDAVIHTL

SEQ ID NO: 324850 - protein, 9 aa, Homo Sapiens
AGCKVGLIA

SEQ ID NO: 324851 - protein, 9 aa, Homo Sapiens
YDVLDKRCG

SEQ ID NO: 324852 - protein, 9 aa, Homo Sapiens
LWLLFRLMF

SEQ ID NO: 324853 - protein, 9 aa, Homo Sapiens
MFHRQAVYD

SEQ ID NO: 324854 - protein, 9 aa, Homo Sapiens
EQLADGNLR

SEQ ID NO: 324855 - protein, 9 aa, Homo Sapiens
VGQKTRDVK

SEQ ID NO: 324856 - protein, 9 aa, Homo Sapiens
ELWNSLGPR

SEQ ID NO: 324857 - protein, 9 aa, Homo Sapiens
VICHPLRHA

SEQ ID NO: 324858 - protein, 9 aa, Homo Sapiens
EKISAEAVV

SEQ ID NO: 324859 - protein, 9 aa, Homo Sapiens
YEKSLRKYF

SEQ ID NO: 324860 - protein, 9 aa, Homo Sapiens
LAQAQQNQT

SEQ ID NO: 324861 - protein, 9 aa, Homo Sapiens
KNKLYVAMV

SEQ ID NO: 324862 - protein, 9 aa, Homo Sapiens
GACVTLVSV

SEQ ID NO: 324863 - protein, 9 aa, Homo Sapiens
SNEKKNTLA

SEQ ID NO: 324864 - protein, 9 aa, Homo Sapiens
KAGIICYAI

SEQ ID NO: 324865 - protein, 9 aa, Homo Sapiens
TADVAHFEL

SEQ ID NO: 324866 - protein, 9 aa, Homo Sapiens
QQWESREWK

SEQ ID NO: 324867 - protein, 9 aa, Homo Sapiens
ISIMILGRV

SEQ ID NO: 324868 - protein, 9 aa, Homo Sapiens
GFIAGVVIH

SEQ ID NO: 324869 - protein, 9 aa, Homo Sapiens
LYTVELEAI

SEQ ID NO: 324870 - protein, 9 aa, Homo Sapiens
LASHTLPVC

SEQ ID NO: 324871 - protein, 9 aa, Homo Sapiens
PKISRGYEP

SEQ ID NO: 324872 - protein, 9 aa, Homo Sapiens
KCLEVVSMY

SEQ ID NO: 324873 - protein, 9 aa, Homo Sapiens
GGPGPHGPK

SEQ ID NO: 324874 - protein, 9 aa, Homo Sapiens
NSAVYSLEE

SEQ ID NO: 324875 - protein, 9 aa, Homo Sapiens
TLRPRCINM

SEQ ID NO: 324876 - protein, 9 aa, Homo Sapiens
RRHLATHVE

SEQ ID NO: 324877 - protein, 9 aa, Homo Sapiens
APPPWRHGA

SEQ ID NO: 324878 - protein, 9 aa, Homo Sapiens
KKSKEVSQQ

SEQ ID NO: 324879 - protein, 9 aa, Homo Sapiens
GTLESQWGV

SEQ ID NO: 324880 - protein, 9 aa, Homo Sapiens
AWDNTANFL

SEQ ID NO: 324881 - protein, 9 aa, Homo Sapiens
SFTCTQSEW

SEQ ID NO: 324882 - protein, 9 aa, Homo Sapiens
MAEGTGDTT

SEQ ID NO: 324883 - protein, 9 aa, Homo Sapiens
DFDQALLWH

SEQ ID NO: 324884 - protein, 9 aa, Homo Sapiens
PIPLAYVET

SEQ ID NO: 324885 - protein, 9 aa, Homo Sapiens
IHGCVGDSP

SEQ ID NO: 324886 - protein, 9 aa, Homo Sapiens
KHLRTHQVS

SEQ ID NO: 324887 - protein, 9 aa, Homo Sapiens
IPKTDLLMI

SEQ ID NO: 324888 - protein, 9 aa, Homo Sapiens
ALCDIEMSK

SEQ ID NO: 324889 - protein, 9 aa, Homo Sapiens
MVWPGVGAP

SEQ ID NO: 324890 - protein, 9 aa, Homo Sapiens
AQNTQMGNQ

SEQ ID NO: 324891 - protein, 9 aa, Homo Sapiens
LVIVAEYFD

SEQ ID NO: 324892 - protein, 9 aa, Homo Sapiens
SVLNASYGP

SEQ ID NO: 324893 - protein, 9 aa, Homo Sapiens
EMTAEKEPF

SEQ ID NO: 324894 - protein, 9 aa, Homo Sapiens
CGRASRDPW

SEQ ID NO: 324895 - protein, 9 aa, Homo Sapiens
LKLSMREAQ

SEQ ID NO: 324896 - protein, 9 aa, Homo Sapiens
GPKPKWLLL

SEQ ID NO: 324897 - protein, 9 aa, Homo Sapiens
VAVLIHDEN

SEQ ID NO: 324898 - protein, 9 aa, Homo Sapiens
EMAPVQLPV

SEQ ID NO: 324899 - protein, 9 aa, Homo Sapiens
KHKKNRSPG

SEQ ID NO: 324900 - protein, 9 aa, Homo Sapiens
CTERPFPCH

SEQ ID NO: 324901 - protein, 9 aa, Homo Sapiens
PLRVTSQDP

SEQ ID NO: 324902 - protein, 9 aa, Homo Sapiens
IEHGEQNRT

SEQ ID NO: 324903 - protein, 9 aa, Homo Sapiens
VKKTKMVLR

SEQ ID NO: 324904 - protein, 9 aa, Homo Sapiens
GWPCPAVPL

SEQ ID NO: 324905 - protein, 9 aa, Homo Sapiens
RGIYPTSTQ

SEQ ID NO: 324906 - protein, 9 aa, Homo Sapiens
IAPHAGYMY

SEQ ID NO: 324907 - protein, 9 aa, Homo Sapiens
PGKPKADMT

SEQ ID NO: 324908 - protein, 9 aa, Homo Sapiens
KDDIQEEDK

SEQ ID NO: 324909 - protein, 9 aa, Homo Sapiens
ANFCQILAV

SEQ ID NO: 324910 - protein, 9 aa, Homo Sapiens
IVALDFFTY

SEQ ID NO: 324911 - protein, 9 aa, Homo Sapiens
QTNVYSMAL

SEQ ID NO: 324912 - protein, 9 aa, Homo Sapiens
KAVRRGRCG

SEQ ID NO: 324913 - protein, 9 aa, Homo Sapiens
GGLVYLLWD

SEQ ID NO: 324914 - protein, 9 aa, Homo Sapiens
MIPKPPKPP

SEQ ID NO: 324915 - protein, 9 aa, Homo Sapiens
LPIIEIHIV

SEQ ID NO: 324916 - protein, 9 aa, Homo Sapiens
MAAPKNRCT

SEQ ID NO: 324917 - protein, 9 aa, Homo Sapiens
VSLQLLISC

SEQ ID NO: 324918 - protein, 9 aa, Homo Sapiens
HGQRAHLFG

SEQ ID NO: 324919 - protein, 9 aa, Homo Sapiens
LQKSTDSRC

SEQ ID NO: 324920 - protein, 9 aa, Homo Sapiens
CSKNQSEAG

SEQ ID NO: 324921 - protein, 9 aa, Homo Sapiens
ARTTIWLLE

SEQ ID NO: 324922 - protein, 9 aa, Homo Sapiens
FTCTQSEWH

SEQ ID NO: 324923 - protein, 9 aa, Homo Sapiens
RATAPMWCC

SEQ ID NO: 324924 - protein, 9 aa, Homo Sapiens
VQEGTAQIW

SEQ ID NO: 324925 - protein, 9 aa, Homo Sapiens
LANFCQILA

SEQ ID NO: 324926 - protein, 9 aa, Homo Sapiens
ADIAESHVN

SEQ ID NO: 324927 - protein, 9 aa, Homo Sapiens
AGRLVLSSL

SEQ ID NO: 324928 - protein, 9 aa, Homo Sapiens
IVFEGDTKI

SEQ ID NO: 324929 - protein, 9 aa, Homo Sapiens
LAGMGLQLL

SEQ ID NO: 324930 - protein, 9 aa, Homo Sapiens
AVSVLVSGQ

SEQ ID NO: 324931 - protein, 9 aa, Homo Sapiens
YFGLFSYCM

SEQ ID NO: 324932 - protein, 9 aa, Homo Sapiens
KENTLVQMA

SEQ ID NO: 324933 - protein, 9 aa, Homo Sapiens
HLKPKNHPL

SEQ ID NO: 324934 - protein, 9 aa, Homo Sapiens
GAKGGPGPH

SEQ ID NO: 324935 - protein, 9 aa, Homo Sapiens
GTYSHREQS

SEQ ID NO: 324936 - protein, 9 aa, Homo Sapiens
CRQRLEEAK

SEQ ID NO: 324937 - protein, 9 aa, Homo Sapiens
DDTPMVRWA

SEQ ID NO: 324938 - protein, 9 aa, Homo Sapiens
LPVCLLRPS

SEQ ID NO: 324939 - protein, 9 aa, Homo Sapiens
ISINFWYGL

SEQ ID NO: 324940 - protein, 9 aa, Homo Sapiens
GGNPEPSFM

SEQ ID NO: 324941 - protein, 9 aa, Homo Sapiens
LPSITLGNV

SEQ ID NO: 324942 - protein, 9 aa, Homo Sapiens
KSKEVSQQL

SEQ ID NO: 324943 - protein, 9 aa, Homo Sapiens
VYEQRIEPP

SEQ ID NO: 324944 - protein, 9 aa, Homo Sapiens
QPEMLQDLR

SEQ ID NO: 324945 - protein, 9 aa, Homo Sapiens
ALSALMPGG

SEQ ID NO: 324946 - protein, 9 aa, Homo Sapiens
QHRSPKCLA

SEQ ID NO: 324947 - protein, 9 aa, Homo Sapiens
VPGGAVAQQ

SEQ ID NO: 324948 - protein, 9 aa, Homo Sapiens
LFDVLRSVI

SEQ ID NO: 324949 - protein, 9 aa, Homo Sapiens
CILASGSVQ

SEQ ID NO: 324950 - protein, 9 aa, Homo Sapiens
FVNSPEEHS

SEQ ID NO: 324951 - protein, 9 aa, Homo Sapiens
NYGMTHMDP

SEQ ID NO: 324952 - protein, 9 aa, Homo Sapiens
VLKVARVEH

SEQ ID NO: 324953 - protein, 9 aa, Homo Sapiens
RYSINIGQL

SEQ ID NO: 324954 - protein, 9 aa, Homo Sapiens
NPKDTTPAP

SEQ ID NO: 324955 - protein, 9 aa, Homo Sapiens
WRKRAEFDI

SEQ ID NO: 324956 - protein, 9 aa, Homo Sapiens
EKPPHPTCT

SEQ ID NO: 324957 - protein, 9 aa, Homo Sapiens
MGQVGEKQS

SEQ ID NO: 324958 - protein, 9 aa, Homo Sapiens
HQDFLVETC

SEQ ID NO: 324959 - protein, 9 aa, Homo Sapiens
AELEYQRRQ

SEQ ID NO: 324960 - protein, 9 aa, Homo Sapiens
AGVRAADPD

SEQ ID NO: 324961 - protein, 9 aa, Homo Sapiens
CERLLASSP

SEQ ID NO: 324962 - protein, 9 aa, Homo Sapiens
YCRTKFCAC

SEQ ID NO: 324963 - protein, 9 aa, Homo Sapiens
LPASSLAHH

SEQ ID NO: 324964 - protein, 9 aa, Homo Sapiens
QHWLFKMDS

SEQ ID NO: 324965 - protein, 9 aa, Homo Sapiens
FLLHFGCPV

SEQ ID NO: 324966 - protein, 9 aa, Homo Sapiens
VEQIPHGCI

SEQ ID NO: 324967 - protein, 9 aa, Homo Sapiens
FAGAEVLLL

SEQ ID NO: 324968 - protein, 9 aa, Homo Sapiens
HVRVEALQS

SEQ ID NO: 324969 - protein, 9 aa, Homo Sapiens
SALSALMPG

SEQ ID NO: 324970 - protein, 9 aa, Homo Sapiens
QANFNKTEL

SEQ ID NO: 324971 - protein, 9 aa, Homo Sapiens
KKLLSQEPN

SEQ ID NO: 324972 - protein, 9 aa, Homo Sapiens
VAGLETMYT

SEQ ID NO: 324973 - protein, 9 aa, Homo Sapiens
DVRTWVKSQ

SEQ ID NO: 324974 - protein, 9 aa, Homo Sapiens
PCMVVSCPH

SEQ ID NO: 324975 - protein, 9 aa, Homo Sapiens
EREVIINLA

SEQ ID NO: 324976 - protein, 9 aa, Homo Sapiens
PHDGASRSA

SEQ ID NO: 324977 - protein, 9 aa, Homo Sapiens
ISTFLDMLH

SEQ ID NO: 324978 - protein, 9 aa, Homo Sapiens
QHTDDKFFK

SEQ ID NO: 324979 - protein, 9 aa, Homo Sapiens
RPRCINMTD

SEQ ID NO: 324980 - protein, 9 aa, Homo Sapiens
GKDRYCSNI

SEQ ID NO: 324981 - protein, 9 aa, Homo Sapiens
LGLTPTGVI

SEQ ID NO: 324982 - protein, 9 aa, Homo Sapiens
VRPSGGRPG

SEQ ID NO: 324983 - protein, 9 aa, Homo Sapiens
YNGQHPNGW

SEQ ID NO: 324984 - protein, 9 aa, Homo Sapiens
CHLPWIYQA

SEQ ID NO: 324985 - protein, 9 aa, Homo Sapiens
VAPPVALPS

SEQ ID NO: 324986 - protein, 9 aa, Homo Sapiens
MGVMKPGVW

SEQ ID NO: 324987 - protein, 9 aa, Homo Sapiens
GRSHSHRRQ

SEQ ID NO: 324988 - protein, 9 aa, Homo Sapiens
KQNSKLQPE

SEQ ID NO: 324989 - protein, 9 aa, Homo Sapiens
LLLRYQIIH

SEQ ID NO: 324990 - protein, 9 aa, Homo Sapiens
PPSSWLQDS

SEQ ID NO: 324991 - protein, 9 aa, Homo Sapiens
EARIWQKDE

SEQ ID NO: 324992 - protein, 9 aa, Homo Sapiens
GHQGAPMLA

SEQ ID NO: 324993 - protein, 9 aa, Homo Sapiens
CCVVAGMNH

SEQ ID NO: 324994 - protein, 9 aa, Homo Sapiens
KLFSYNLPL

SEQ ID NO: 324995 - protein, 9 aa, Homo Sapiens
EEAGATTEA

SEQ ID NO: 324996 - protein, 9 aa, Homo Sapiens
ICYAIGVGH

SEQ ID NO: 324997 - protein, 9 aa, Homo Sapiens
YSMPWHSCR

SEQ ID NO: 324998 - protein, 9 aa, Homo Sapiens
QKKMKAYEP

SEQ ID NO: 324999 - protein, 9 aa, Homo Sapiens
PLLRDVWLE

SEQ ID NO: 325000 - protein, 9 aa, Homo Sapiens
PDLELLLWS

SEQ ID NO: 325001 - protein, 9 aa, Homo Sapiens
PLGPARTGL

SEQ ID NO: 325002 - protein, 9 aa, Homo Sapiens
YIFTSILGH

SEQ ID NO: 325003 - protein, 9 aa, Homo Sapiens
CCSVELDLN

SEQ ID NO: 325004 - protein, 9 aa, Homo Sapiens
EALEVLSAQ

SEQ ID NO: 325005 - protein, 9 aa, Homo Sapiens
NEEAEGNEI

SEQ ID NO: 325006 - protein, 9 aa, Homo Sapiens
LHGFLVRQK

SEQ ID NO: 325007 - protein, 9 aa, Homo Sapiens
NEVNVDIKD

SEQ ID NO: 325008 - protein, 9 aa, Homo Sapiens
QIQRLVAEH

SEQ ID NO: 325009 - protein, 9 aa, Homo Sapiens
QAELLKHQE

SEQ ID NO: 325010 - protein, 9 aa, Homo Sapiens
FPWLVGQGM

SEQ ID NO: 325011 - protein, 9 aa, Homo Sapiens
AWILQDVLG

SEQ ID NO: 325012 - protein, 9 aa, Homo Sapiens
ALHVTALPR

SEQ ID NO: 325013 - protein, 9 aa, Homo Sapiens
QPAPHLAWE

SEQ ID NO: 325014 - protein, 9 aa, Homo Sapiens
PPGMALPTV

SEQ ID NO: 325015 - protein, 9 aa, Homo Sapiens
DPARGSCGE

SEQ ID NO: 325016 - protein, 9 aa, Homo Sapiens
SPTLRYTFY

SEQ ID NO: 325017 - protein, 9 aa, Homo Sapiens
IKALDFMWH

SEQ ID NO: 325018 - protein, 9 aa, Homo Sapiens
SILQKRLSE

SEQ ID NO: 325019 - protein, 9 aa, Homo Sapiens
DGPRELMLQ

SEQ ID NO: 325020 - protein, 9 aa, Homo Sapiens
PVEEFYTRH

SEQ ID NO: 325021 - protein, 9 aa, Homo Sapiens
WLLQEENRT

SEQ ID NO: 325022 - protein, 9 aa, Homo Sapiens
HGVVVLAKS

SEQ ID NO: 325023 - protein, 9 aa, Homo Sapiens
ASSWHGQRG

SEQ ID NO: 325024 - protein, 9 aa, Homo Sapiens
EGIQTQNRK

SEQ ID NO: 325025 - protein, 9 aa, Homo Sapiens
DSQAKVQWI

SEQ ID NO: 325026 - protein, 9 aa, Homo Sapiens
PWHMHLEMH

SEQ ID NO: 325027 - protein, 9 aa, Homo Sapiens
LVVGNPDLQ

SEQ ID NO: 325028 - protein, 9 aa, Homo Sapiens
WVVGNSIVE

SEQ ID NO: 325029 - protein, 9 aa, Homo Sapiens
LHFKDKFRF

SEQ ID NO: 325030 - protein, 9 aa, Homo Sapiens
HAYIQHRVH

SEQ ID NO: 325031 - protein, 9 aa, Homo Sapiens
EEALSLDWS

SEQ ID NO: 325032 - protein, 9 aa, Homo Sapiens
LWYGTRRKP

SEQ ID NO: 325033 - protein, 9 aa, Homo Sapiens
KRPPFYHLS

SEQ ID NO: 325034 - protein, 9 aa, Homo Sapiens
GFRSKYSFI

SEQ ID NO: 325035 - protein, 9 aa, Homo Sapiens
VVVDISGRF

SEQ ID NO: 325036 - protein, 9 aa, Homo Sapiens
PAHDPQWYP

SEQ ID NO: 325037 - protein, 9 aa, Homo Sapiens
VCAWDSTYR

SEQ ID NO: 325038 - protein, 9 aa, Homo Sapiens
ALRWSSVET

SEQ ID NO: 325039 - protein, 9 aa, Homo Sapiens
TWVLHQDPH

SEQ ID NO: 325040 - protein, 9 aa, Homo Sapiens
GKDEKSGPC

SEQ ID NO: 325041 - protein, 9 aa, Homo Sapiens
AKHLHLSLN

SEQ ID NO: 325042 - protein, 9 aa, Homo Sapiens
SGSFFAWDN

SEQ ID NO: 325043 - protein, 9 aa, Homo Sapiens
SQANFNKTE

SEQ ID NO: 325044 - protein, 9 aa, Homo Sapiens
RTASIMGLC

SEQ ID NO: 325045 - protein, 9 aa, Homo Sapiens
CHSPGCPRL

SEQ ID NO: 325046 - protein, 9 aa, Homo Sapiens
DKFRFYDEY

SEQ ID NO: 325047 - protein, 9 aa, Homo Sapiens
GWWSFGVLL

SEQ ID NO: 325048 - protein, 9 aa, Homo Sapiens
GQRQPHRSF

SEQ ID NO: 325049 - protein, 9 aa, Homo Sapiens
TCGKAFRQR

SEQ ID NO: 325050 - protein, 9 aa, Homo Sapiens
HTQKDRVGG

SEQ ID NO: 325051 - protein, 9 aa, Homo Sapiens
NGWVQYTFQ

SEQ ID NO: 325052 - protein, 9 aa, Homo Sapiens
ELETTGAIS

SEQ ID NO: 325053 - protein, 9 aa, Homo Sapiens
GVLTSSGDA

SEQ ID NO: 325054 - protein, 9 aa, Homo Sapiens
EPVDYMVRN

SEQ ID NO: 325055 - protein, 9 aa, Homo Sapiens
CLFASGGPF

SEQ ID NO: 325056 - protein, 9 aa, Homo Sapiens
IKVRRSLLT

SEQ ID NO: 325057 - protein, 9 aa, Homo Sapiens
GVSSLTPDQ

SEQ ID NO: 325058 - protein, 9 aa, Homo Sapiens
SIMAKEGLL

SEQ ID NO: 325059 - protein, 9 aa, Homo Sapiens
CLCTQVLED

SEQ ID NO: 325060 - protein, 9 aa, Homo Sapiens
HICLENCVL

SEQ ID NO: 325061 - protein, 9 aa, Homo Sapiens
HTEELVATG

SEQ ID NO: 325062 - protein, 9 aa, Homo Sapiens
WRKALRRNP

SEQ ID NO: 325063 - protein, 9 aa, Homo Sapiens
PPPKKLKQE

SEQ ID NO: 325064 - protein, 9 aa, Homo Sapiens
NEIADQVSW

SEQ ID NO: 325065 - protein, 9 aa, Homo Sapiens
HGENPTLFV

SEQ ID NO: 325066 - protein, 9 aa, Homo Sapiens
HTNCTLIIS

SEQ ID NO: 325067 - protein, 9 aa, Homo Sapiens
TGIYIALLV

SEQ ID NO: 325068 - protein, 9 aa, Homo Sapiens
MADAVVTFL

SEQ ID NO: 325069 - protein, 9 aa, Homo Sapiens
KPLSSNLRW

SEQ ID NO: 325070 - protein, 9 aa, Homo Sapiens
QGLVFLSLV

SEQ ID NO: 325071 - protein, 9 aa, Homo Sapiens
CAWYRGTAP

SEQ ID NO: 325072 - protein, 9 aa, Homo Sapiens
KAKHLHLSL

SEQ ID NO: 325073 - protein, 9 aa, Homo Sapiens
GWVQYTFQN

SEQ ID NO: 325074 - protein, 9 aa, Homo Sapiens
PRATALRWN

SEQ ID NO: 325075 - protein, 9 aa, Homo Sapiens
SRCDGHVEV

SEQ ID NO: 325076 - protein, 9 aa, Homo Sapiens
RRRRRSKKE

SEQ ID NO: 325077 - protein, 9 aa, Homo Sapiens
RPMCPPPPP

SEQ ID NO: 325078 - protein, 9 aa, Homo Sapiens
PQWKLDPLL

SEQ ID NO: 325079 - protein, 9 aa, Homo Sapiens
DWSSTIASD

SEQ ID NO: 325080 - protein, 9 aa, Homo Sapiens
SVDGPKSTR

SEQ ID NO: 325081 - protein, 9 aa, Homo Sapiens
SNLVAIVVL

SEQ ID NO: 325082 - protein, 9 aa, Homo Sapiens
TPMAQFSAQ

SEQ ID NO: 325083 - protein, 9 aa, Homo Sapiens
LVMIQLLQH

SEQ ID NO: 325084 - protein, 9 aa, Homo Sapiens
ELGGPPPKK

SEQ ID NO: 325085 - protein, 9 aa, Homo Sapiens
YLLRLASMP

SEQ ID NO: 325086 - protein, 9 aa, Homo Sapiens
AMDTALAHL

SEQ ID NO: 325087 - protein, 9 aa, Homo Sapiens
KDHIQQFDD

SEQ ID NO: 325088 - protein, 9 aa, Homo Sapiens
ARGCLTYYA

SEQ ID NO: 325089 - protein, 9 aa, Homo Sapiens
ENTYKSCRR

SEQ ID NO: 325090 - protein, 9 aa, Homo Sapiens
TAQPGWPFG

SEQ ID NO: 325091 - protein, 9 aa, Homo Sapiens
LESQWGVQG

SEQ ID NO: 325092 - protein, 9 aa, Homo Sapiens
RQDPTSYAP

SEQ ID NO: 325093 - protein, 9 aa, Homo Sapiens
NASPDGLIL

SEQ ID NO: 325094 - protein, 9 aa, Homo Sapiens
EVAGGTQPV

SEQ ID NO: 325095 - protein, 9 aa, Homo Sapiens
QLGHLKDQD

SEQ ID NO: 325096 - protein, 9 aa, Homo Sapiens
LLRAVTEIV

SEQ ID NO: 325097 - protein, 9 aa, Homo Sapiens
FNPSILHYQ

SEQ ID NO: 325098 - protein, 9 aa, Homo Sapiens
PRDRGRILA

SEQ ID NO: 325099 - protein, 9 aa, Homo Sapiens
ETFALSAQL

SEQ ID NO: 325100 - protein, 9 aa, Homo Sapiens
AVAWAMTNY

SEQ ID NO: 325101 - protein, 9 aa, Homo Sapiens
HMKRQDQIQ

SEQ ID NO: 325102 - protein, 9 aa, Homo Sapiens
QTTSTQYTA

SEQ ID NO: 325103 - protein, 9 aa, Homo Sapiens
RQQWLLGLW

SEQ ID NO: 325104 - protein, 9 aa, Homo Sapiens
TGLGPAPYS

SEQ ID NO: 325105 - protein, 9 aa, Homo Sapiens
WPVVWGKLD

SEQ ID NO: 325106 - protein, 9 aa, Homo Sapiens
RHLATHVEP

SEQ ID NO: 325107 - protein, 9 aa, Homo Sapiens
SPRTTTPTS

SEQ ID NO: 325108 - protein, 9 aa, Homo Sapiens
WPLRKWSSL

SEQ ID NO: 325109 - protein, 9 aa, Homo Sapiens
QEATPPAHH

SEQ ID NO: 325110 - protein, 9 aa, Homo Sapiens
SRGKSRWRK

SEQ ID NO: 325111 - protein, 9 aa, Homo Sapiens
AALSNSGQG

SEQ ID NO: 325112 - protein, 9 aa, Homo Sapiens
SEGDAKVVV

SEQ ID NO: 325113 - protein, 9 aa, Homo Sapiens
QAGTQIPIE

SEQ ID NO: 325114 - protein, 9 aa, Homo Sapiens
GLVVIVPAQ

SEQ ID NO: 325115 - protein, 9 aa, Homo Sapiens
FCQATGPTD

SEQ ID NO: 325116 - protein, 9 aa, Homo Sapiens
IVCDYDVYA

SEQ ID NO: 325117 - protein, 9 aa, Homo Sapiens
CLQTALLVV

SEQ ID NO: 325118 - protein, 9 aa, Homo Sapiens
QEYTSDGMN

SEQ ID NO: 325119 - protein, 9 aa, Homo Sapiens
QDWGRSLDV

SEQ ID NO: 325120 - protein, 9 aa, Homo Sapiens
IMGSQQQKV

SEQ ID NO: 325121 - protein, 9 aa, Homo Sapiens
GESMLVVQL

SEQ ID NO: 325122 - protein, 9 aa, Homo Sapiens
LCRTASIMG

SEQ ID NO: 325123 - protein, 9 aa, Homo Sapiens
TDCPCMVVS

SEQ ID NO: 325124 - protein, 9 aa, Homo Sapiens
LTTQHRSPK

SEQ ID NO: 325125 - protein, 9 aa, Homo Sapiens
QWCAVQGQV

SEQ ID NO: 325126 - protein, 9 aa, Homo Sapiens
SHISSSNEV

SEQ ID NO: 325127 - protein, 9 aa, Homo Sapiens
VVCDFWLLS

SEQ ID NO: 325128 - protein, 9 aa, Homo Sapiens
LLALQHPQR

SEQ ID NO: 325129 - protein, 9 aa, Homo Sapiens
RATENHQGT

SEQ ID NO: 325130 - protein, 9 aa, Homo Sapiens
LAKNYGMTH

SEQ ID NO: 325131 - protein, 9 aa, Homo Sapiens
VLWRKVDEQ

SEQ ID NO: 325132 - protein, 9 aa, Homo Sapiens
KLEEVLNLA

SEQ ID NO: 325133 - protein, 9 aa, Homo Sapiens
KTTLLTLSK

SEQ ID NO: 325134 - protein, 9 aa, Homo Sapiens
QKKFEDVNS

SEQ ID NO: 325135 - protein, 9 aa, Homo Sapiens
SYRPDGNGF

SEQ ID NO: 325136 - protein, 9 aa, Homo Sapiens
EAAVAAAGP

SEQ ID NO: 325137 - protein, 9 aa, Homo Sapiens
LLEMLLGYT

SEQ ID NO: 325138 - protein, 9 aa, Homo Sapiens
RWSSVETVC

SEQ ID NO: 325139 - protein, 9 aa, Homo Sapiens
KPPIKVTSW

SEQ ID NO: 325140 - protein, 9 aa, Homo Sapiens
EHRNFLVSG

SEQ ID NO: 325141 - protein, 9 aa, Homo Sapiens
FVCLEKTLL

SEQ ID NO: 325142 - protein, 9 aa, Homo Sapiens
MINENAKRR

SEQ ID NO: 325143 - protein, 9 aa, Homo Sapiens
RETAVVIFL

SEQ ID NO: 325144 - protein, 9 aa, Homo Sapiens
HKEASLQKD

SEQ ID NO: 325145 - protein, 9 aa, Homo Sapiens
KQSPMLQRN

SEQ ID NO: 325146 - protein, 9 aa, Homo Sapiens
RLQADHICL

SEQ ID NO: 325147 - protein, 9 aa, Homo Sapiens
SSQTPGHSL

SEQ ID NO: 325148 - protein, 9 aa, Homo Sapiens
VGWGDVPII

SEQ ID NO: 325149 - protein, 9 aa, Homo Sapiens
LGPSICVFL

SEQ ID NO: 325150 - protein, 9 aa, Homo Sapiens
VCWTPYHMF

SEQ ID NO: 325151 - protein, 9 aa, Homo Sapiens
YSLHLASRC

SEQ ID NO: 325152 - protein, 9 aa, Homo Sapiens
VLDANGPPI

SEQ ID NO: 325153 - protein, 9 aa, Homo Sapiens
PAAPSLMRP

SEQ ID NO: 325154 - protein, 9 aa, Homo Sapiens
EDPRSFYEW

SEQ ID NO: 325155 - protein, 9 aa, Homo Sapiens
CLKECSCMK

SEQ ID NO: 325156 - protein, 9 aa, Homo Sapiens
KKLHKLFSY

SEQ ID NO: 325157 - protein, 9 aa, Homo Sapiens
LRQWLPLQV

SEQ ID NO: 325158 - protein, 9 aa, Homo Sapiens
MTAEKEPFL

SEQ ID NO: 325159 - protein, 9 aa, Homo Sapiens
GWHCFMTSG

SEQ ID NO: 325160 - protein, 9 aa, Homo Sapiens
PRPLHALAT

SEQ ID NO: 325161 - protein, 9 aa, Homo Sapiens
DSQADFLKM

SEQ ID NO: 325162 - protein, 9 aa, Homo Sapiens
SEATLDING

SEQ ID NO: 325163 - protein, 9 aa, Homo Sapiens
DSILEEEVE

SEQ ID NO: 325164 - protein, 9 aa, Homo Sapiens
WVGPNGCIT

SEQ ID NO: 325165 - protein, 9 aa, Homo Sapiens
SPLKGRLVI

SEQ ID NO: 325166 - protein, 9 aa, Homo Sapiens
ILADLIITD

SEQ ID NO: 325167 - protein, 9 aa, Homo Sapiens
MCQYLREEE

SEQ ID NO: 325168 - protein, 9 aa, Homo Sapiens
HLLVGALWA

SEQ ID NO: 325169 - protein, 9 aa, Homo Sapiens
FDRNHPSFD

SEQ ID NO: 325170 - protein, 9 aa, Homo Sapiens
FRSRRKEAL

SEQ ID NO: 325171 - protein, 9 aa, Homo Sapiens
DNQRELSRI

SEQ ID NO: 325172 - protein, 9 aa, Homo Sapiens
IQHWLFKMD

SEQ ID NO: 325173 - protein, 9 aa, Homo Sapiens
GPTDIRFVW

SEQ ID NO: 325174 - protein, 9 aa, Homo Sapiens
QASRRELAH

SEQ ID NO: 325175 - protein, 9 aa, Homo Sapiens
DVVWTDVFQ

SEQ ID NO: 325176 - protein, 9 aa, Homo Sapiens
GPSRAHCPA

SEQ ID NO: 325177 - protein, 9 aa, Homo Sapiens
ELQVFQGHK

SEQ ID NO: 325178 - protein, 9 aa, Homo Sapiens
YKCGKSFRL

SEQ ID NO: 325179 - protein, 9 aa, Homo Sapiens
LVLSSLPVL

SEQ ID NO: 325180 - protein, 9 aa, Homo Sapiens
GLWARKLEE

SEQ ID NO: 325181 - protein, 9 aa, Homo Sapiens
DKHALKQFE

SEQ ID NO: 325182 - protein, 9 aa, Homo Sapiens
TVTLEQARH

SEQ ID NO: 325183 - protein, 9 aa, Homo Sapiens
RTRNPNGND

SEQ ID NO: 325184 - protein, 9 aa, Homo Sapiens
LACVLWKKG

SEQ ID NO: 325185 - protein, 9 aa, Homo Sapiens
NRVLFHAAK

SEQ ID NO: 325186 - protein, 9 aa, Homo Sapiens
VVMANSDGS

SEQ ID NO: 325187 - protein, 9 aa, Homo Sapiens
ILGAVRRQR

SEQ ID NO: 325188 - protein, 9 aa, Homo Sapiens
DTAIIQLKT

SEQ ID NO: 325189 - protein, 9 aa, Homo Sapiens
AEEERRGGE

SEQ ID NO: 325190 - protein, 9 aa, Homo Sapiens
LAASEAATT

SEQ ID NO: 325191 - protein, 9 aa, Homo Sapiens
KFYRPLNIQ

SEQ ID NO: 325192 - protein, 9 aa, Homo Sapiens
YNKTDVATP

SEQ ID NO: 325193 - protein, 9 aa, Homo Sapiens
NKVSKLQCQ

SEQ ID NO: 325194 - protein, 9 aa, Homo Sapiens
KSPGMQGSH

SEQ ID NO: 325195 - protein, 9 aa, Homo Sapiens
FKNFMLNQN

SEQ ID NO: 325196 - protein, 9 aa, Homo Sapiens
YPAETFCFP

SEQ ID NO: 325197 - protein, 9 aa, Homo Sapiens
KEYLMWAHF

SEQ ID NO: 325198 - protein, 9 aa, Homo Sapiens
VHRRKKRRM

SEQ ID NO: 325199 - protein, 9 aa, Homo Sapiens
LGGHTVWRV

SEQ ID NO: 325200 - protein, 9 aa, Homo Sapiens
EWQFHFAGI

SEQ ID NO: 325201 - protein, 9 aa, Homo Sapiens
GLVAFVKVA

SEQ ID NO: 325202 - protein, 9 aa, Homo Sapiens
DLRQWLPLQ

SEQ ID NO: 325203 - protein, 9 aa, Homo Sapiens
AQSIQDNIH

SEQ ID NO: 325204 - protein, 9 aa, Homo Sapiens
HHRDHQQSR

SEQ ID NO: 325205 - protein, 9 aa, Homo Sapiens
LCDLLERPG

SEQ ID NO: 325206 - protein, 9 aa, Homo Sapiens
MKSEELNLR

SEQ ID NO: 325207 - protein, 9 aa, Homo Sapiens
WDNTANFLH

SEQ ID NO: 325208 - protein, 9 aa, Homo Sapiens
KKKNKEEER

SEQ ID NO: 325209 - protein, 9 aa, Homo Sapiens
YTSDGMNVA

SEQ ID NO: 325210 - protein, 9 aa, Homo Sapiens
VIAIKQFSR

SEQ ID NO: 325211 - protein, 9 aa, Homo Sapiens
TSQLASSLS

SEQ ID NO: 325212 - protein, 9 aa, Homo Sapiens
FRSWGHVGT

SEQ ID NO: 325213 - protein, 9 aa, Homo Sapiens
ECLGPLRWC

SEQ ID NO: 325214 - protein, 9 aa, Homo Sapiens
LEAPKRFRD

SEQ ID NO: 325215 - protein, 9 aa, Homo Sapiens
AATSPSAVF

SEQ ID NO: 325216 - protein, 9 aa, Homo Sapiens
QPRLLLSSS

SEQ ID NO: 325217 - protein, 9 aa, Homo Sapiens
ERKSKLEEV

SEQ ID NO: 325218 - protein, 9 aa, Homo Sapiens
DSLCCGRAS

SEQ ID NO: 325219 - protein, 9 aa, Homo Sapiens
RPPTGLGPA

SEQ ID NO: 325220 - protein, 9 aa, Homo Sapiens
QGVVYGDVP

SEQ ID NO: 325221 - protein, 9 aa, Homo Sapiens
PPGLSFHKV

SEQ ID NO: 325222 - protein, 9 aa, Homo Sapiens
ALWHLALLA

SEQ ID NO: 325223 - protein, 9 aa, Homo Sapiens
SSSRLRSLH

SEQ ID NO: 325224 - protein, 9 aa, Homo Sapiens
HTFTTVEVS

SEQ ID NO: 325225 - protein, 9 aa, Homo Sapiens
AEEPWQMLA

SEQ ID NO: 325226 - protein, 9 aa, Homo Sapiens
GLCVPIMTV

SEQ ID NO: 325227 - protein, 9 aa, Homo Sapiens
YSIQMMEPD

SEQ ID NO: 325228 - protein, 9 aa, Homo Sapiens
YSIFQKLNV

SEQ ID NO: 325229 - protein, 9 aa, Homo Sapiens
NFRINLPIP

SEQ ID NO: 325230 - protein, 9 aa, Homo Sapiens
YVQIVEAIL

SEQ ID NO: 325231 - protein, 9 aa, Homo Sapiens
TATQQNNWP

SEQ ID NO: 325232 - protein, 9 aa, Homo Sapiens
ALRRWLDLG

SEQ ID NO: 325233 - protein, 9 aa, Homo Sapiens
KTFYDLETG

SEQ ID NO: 325234 - protein, 9 aa, Homo Sapiens
GKNVARGCL

SEQ ID NO: 325235 - protein, 9 aa, Homo Sapiens
APLIICHMI

SEQ ID NO: 325236 - protein, 9 aa, Homo Sapiens
SGLSCHQGI

SEQ ID NO: 325237 - protein, 9 aa, Homo Sapiens
RRPGPSRAH

SEQ ID NO: 325238 - protein, 9 aa, Homo Sapiens
LLASSPPRL

SEQ ID NO: 325239 - protein, 9 aa, Homo Sapiens
GLSFHKVEM

SEQ ID NO: 325240 - protein, 9 aa, Homo Sapiens
DPVAISDVA

SEQ ID NO: 325241 - protein, 9 aa, Homo Sapiens
QVTCLCTQV

SEQ ID NO: 325242 - protein, 9 aa, Homo Sapiens
GSGLYDETI

SEQ ID NO: 325243 - protein, 9 aa, Homo Sapiens
NGKEEQEQD

SEQ ID NO: 325244 - protein, 9 aa, Homo Sapiens
DEDFQVTLP

SEQ ID NO: 325245 - protein, 9 aa, Homo Sapiens
LEAPGHRPR

SEQ ID NO: 325246 - protein, 9 aa, Homo Sapiens
FRLVFQQGL

SEQ ID NO: 325247 - protein, 9 aa, Homo Sapiens
DWFVCLEKT

SEQ ID NO: 325248 - protein, 9 aa, Homo Sapiens
GYGSENGEE

SEQ ID NO: 325249 - protein, 9 aa, Homo Sapiens
KKMKSQMGQ

SEQ ID NO: 325250 - protein, 9 aa, Homo Sapiens
YVKALFRCA

SEQ ID NO: 325251 - protein, 9 aa, Homo Sapiens
PHQQDPHLT

SEQ ID NO: 325252 - protein, 9 aa, Homo Sapiens
SNSWNMVDM

SEQ ID NO: 325253 - protein, 9 aa, Homo Sapiens
TNHCKRAVE

SEQ ID NO: 325254 - protein, 9 aa, Homo Sapiens
SSCDVKLVK

SEQ ID NO: 325255 - protein, 9 aa, Homo Sapiens
SSLHSAHQG

SEQ ID NO: 325256 - protein, 9 aa, Homo Sapiens
QWVVGNSIV

SEQ ID NO: 325257 - protein, 9 aa, Homo Sapiens
VHCPCAVPY

SEQ ID NO: 325258 - protein, 9 aa, Homo Sapiens
STQPEPQHF

SEQ ID NO: 325259 - protein, 9 aa, Homo Sapiens
TVHCMHLHE

SEQ ID NO: 325260 - protein, 9 aa, Homo Sapiens
RSWGHVGTV

SEQ ID NO: 325261 - protein, 9 aa, Homo Sapiens
LEGLGFRSK

SEQ ID NO: 325262 - protein, 9 aa, Homo Sapiens
GSAFYQGSV

SEQ ID NO: 325263 - protein, 9 aa, Homo Sapiens
RPQSPQRLL

SEQ ID NO: 325264 - protein, 9 aa, Homo Sapiens
LQRKQEEAW

SEQ ID NO: 325265 - protein, 9 aa, Homo Sapiens
VVVGAGDVG

SEQ ID NO: 325266 - protein, 9 aa, Homo Sapiens
DDCEKLERQ

SEQ ID NO: 325267 - protein, 9 aa, Homo Sapiens
RDVWLEEEQ

SEQ ID NO: 325268 - protein, 9 aa, Homo Sapiens
ALLEQQVCA

SEQ ID NO: 325269 - protein, 9 aa, Homo Sapiens
QIVCGMNQV

SEQ ID NO: 325270 - protein, 9 aa, Homo Sapiens
RESRFLASK

SEQ ID NO: 325271 - protein, 9 aa, Homo Sapiens
YIRTGYHPT

SEQ ID NO: 325272 - protein, 9 aa, Homo Sapiens
RVAGRLVLS

SEQ ID NO: 325273 - protein, 9 aa, Homo Sapiens
LHACLQLGH

SEQ ID NO: 325274 - protein, 9 aa, Homo Sapiens
VVAASEGDA

SEQ ID NO: 325275 - protein, 9 aa, Homo Sapiens
VALDFFTYC

SEQ ID NO: 325276 - protein, 9 aa, Homo Sapiens
KFQQIVCGM

SEQ ID NO: 325277 - protein, 9 aa, Homo Sapiens
MRPFLAEAP

SEQ ID NO: 325278 - protein, 9 aa, Homo Sapiens
LRRASSKAT

SEQ ID NO: 325279 - protein, 9 aa, Homo Sapiens
REVIINLAT

SEQ ID NO: 325280 - protein, 9 aa, Homo Sapiens
IMILGRVIM

SEQ ID NO: 325281 - protein, 9 aa, Homo Sapiens
NVKISATWA

SEQ ID NO: 325282 - protein, 9 aa, Homo Sapiens
RSPVPPSEH

SEQ ID NO: 325283 - protein, 9 aa, Homo Sapiens
RSPMPGSLP

SEQ ID NO: 325284 - protein, 9 aa, Homo Sapiens
TWQKGECIL

SEQ ID NO: 325285 - protein, 9 aa, Homo Sapiens
IQTVKMTFV

SEQ ID NO: 325286 - protein, 9 aa, Homo Sapiens
WKPDSARVC

SEQ ID NO: 325287 - protein, 9 aa, Homo Sapiens
PHRRIQPVP

SEQ ID NO: 325288 - protein, 9 aa, Homo Sapiens
KLDAAPRSL

SEQ ID NO: 325289 - protein, 9 aa, Homo Sapiens
PLEVGLVLR

SEQ ID NO: 325290 - protein, 9 aa, Homo Sapiens
ESQWEKLRG

SEQ ID NO: 325291 - protein, 9 aa, Homo Sapiens
SIMPLHAAS

SEQ ID NO: 325292 - protein, 9 aa, Homo Sapiens
ASRHGTHGG

SEQ ID NO: 325293 - protein, 9 aa, Homo Sapiens
FLLAKVNNA

SEQ ID NO: 325294 - protein, 9 aa, Homo Sapiens
ASGSPSTWM

SEQ ID NO: 325295 - protein, 9 aa, Homo Sapiens
EMAGSAQGR

SEQ ID NO: 325296 - protein, 9 aa, Homo Sapiens
REEIVQYLR

SEQ ID NO: 325297 - protein, 9 aa, Homo Sapiens
AEGSGVGGK

SEQ ID NO: 325298 - protein, 9 aa, Homo Sapiens
RGPLRVTSQ

SEQ ID NO: 325299 - protein, 9 aa, Homo Sapiens
MAQVTHPLV

SEQ ID NO: 325300 - protein, 9 aa, Homo Sapiens
NGGATNQGR

SEQ ID NO: 325301 - protein, 9 aa, Homo Sapiens
NLELQFVSS

SEQ ID NO: 325302 - protein, 9 aa, Homo Sapiens
GPQWHIDLQ

SEQ ID NO: 325303 - protein, 9 aa, Homo Sapiens
GWMVSSRSS

SEQ ID NO: 325304 - protein, 9 aa, Homo Sapiens
TDVATPFGG

SEQ ID NO: 325305 - protein, 9 aa, Homo Sapiens
LLERYAKWK

SEQ ID NO: 325306 - protein, 9 aa, Homo Sapiens
SFTLVPGGA

SEQ ID NO: 325307 - protein, 9 aa, Homo Sapiens
QDGAQVESK

SEQ ID NO: 325308 - protein, 9 aa, Homo Sapiens
AAAGPPGGP

SEQ ID NO: 325309 - protein, 9 aa, Homo Sapiens
TSPTDADYE

SEQ ID NO: 325310 - protein, 9 aa, Homo Sapiens
TKLEKPQEQ

SEQ ID NO: 325311 - protein, 9 aa, Homo Sapiens
TSIKGMYTL

SEQ ID NO: 325312 - protein, 9 aa, Homo Sapiens
YVCRVLELL

SEQ ID NO: 325313 - protein, 9 aa, Homo Sapiens
IKYFKKIML

SEQ ID NO: 325314 - protein, 9 aa, Homo Sapiens
LNNRFTSFI

SEQ ID NO: 325315 - protein, 9 aa, Homo Sapiens
HGEIARLTI

SEQ ID NO: 325316 - protein, 9 aa, Homo Sapiens
SILHYQQAL

SEQ ID NO: 325317 - protein, 9 aa, Homo Sapiens
QEEKMHNQE

SEQ ID NO: 325318 - protein, 9 aa, Homo Sapiens
FREQITSEA

SEQ ID NO: 325319 - protein, 9 aa, Homo Sapiens
HPDIRSHPR

SEQ ID NO: 325320 - protein, 9 aa, Homo Sapiens
GWAPRGRVA

SEQ ID NO: 325321 - protein, 9 aa, Homo Sapiens
ISGLFPGVS

SEQ ID NO: 325322 - protein, 9 aa, Homo Sapiens
KWMGPGAAS

SEQ ID NO: 325323 - protein, 9 aa, Homo Sapiens
IKELGPMLP

SEQ ID NO: 325324 - protein, 9 aa, Homo Sapiens
VAAAGPPGG

SEQ ID NO: 325325 - protein, 9 aa, Homo Sapiens
TEAQESGIR

SEQ ID NO: 325326 - protein, 9 aa, Homo Sapiens
PDGSHASSN

SEQ ID NO: 325327 - protein, 9 aa, Homo Sapiens
ASPGWQQPA

SEQ ID NO: 325328 - protein, 9 aa, Homo Sapiens
NFLVRCSPV

SEQ ID NO: 325329 - protein, 9 aa, Homo Sapiens
QCQAWARAA

SEQ ID NO: 325330 - protein, 9 aa, Homo Sapiens
LAYLHMEIV

SEQ ID NO: 325331 - protein, 9 aa, Homo Sapiens
FCKMDYFSQ

SEQ ID NO: 325332 - protein, 9 aa, Homo Sapiens
QVSLHLKPK

SEQ ID NO: 325333 - protein, 9 aa, Homo Sapiens
SKGISKKEV

SEQ ID NO: 325334 - protein, 9 aa, Homo Sapiens
VRASSLNSS

SEQ ID NO: 325335 - protein, 9 aa, Homo Sapiens
NMVHKFYRG

SEQ ID NO: 325336 - protein, 9 aa, Homo Sapiens
MISAEYPKM

SEQ ID NO: 325337 - protein, 9 aa, Homo Sapiens
LWHIIKFHC

SEQ ID NO: 325338 - protein, 9 aa, Homo Sapiens
LDKSESQEK

SEQ ID NO: 325339 - protein, 9 aa, Homo Sapiens
WNLSTVGRV

SEQ ID NO: 325340 - protein, 9 aa, Homo Sapiens
LVLKQAVCK

SEQ ID NO: 325341 - protein, 9 aa, Homo Sapiens
RGKNVARGC

SEQ ID NO: 325342 - protein, 9 aa, Homo Sapiens
SGFTGSHCK

SEQ ID NO: 325343 - protein, 9 aa, Homo Sapiens
ATAPMWCCS

SEQ ID NO: 325344 - protein, 9 aa, Homo Sapiens
KDRQPLRSG

SEQ ID NO: 325345 - protein, 9 aa, Homo Sapiens
ASPDGLILW

SEQ ID NO: 325346 - protein, 9 aa, Homo Sapiens
ILLLAGKSL

SEQ ID NO: 325347 - protein, 9 aa, Homo Sapiens
MQVQSRETL

SEQ ID NO: 325348 - protein, 9 aa, Homo Sapiens
PVLFTRSIT

SEQ ID NO: 325349 - protein, 9 aa, Homo Sapiens
ALEMSSILC

SEQ ID NO: 325350 - protein, 9 aa, Homo Sapiens
CPNAVVGRC

SEQ ID NO: 325351 - protein, 9 aa, Homo Sapiens
HFDSDEPWM

SEQ ID NO: 325352 - protein, 9 aa, Homo Sapiens
MAAEIKKWM

SEQ ID NO: 325353 - protein, 9 aa, Homo Sapiens
QNRTSVQSV

SEQ ID NO: 325354 - protein, 9 aa, Homo Sapiens
AFSLASSLR

SEQ ID NO: 325355 - protein, 9 aa, Homo Sapiens
SDMYPHEAW

SEQ ID NO: 325356 - protein, 9 aa, Homo Sapiens
VHSISAEGT

SEQ ID NO: 325357 - protein, 9 aa, Homo Sapiens
TEEGFTPPE

SEQ ID NO: 325358 - protein, 9 aa, Homo Sapiens
TPLCAGEEG

SEQ ID NO: 325359 - protein, 9 aa, Homo Sapiens
EMAVNEPLK

SEQ ID NO: 325360 - protein, 9 aa, Homo Sapiens
RVPLHRLKP

SEQ ID NO: 325361 - protein, 9 aa, Homo Sapiens
GNPEPSFMW

SEQ ID NO: 325362 - protein, 9 aa, Homo Sapiens
AAEGSGVGG

SEQ ID NO: 325363 - protein, 9 aa, Homo Sapiens
SDTDIFPDS

SEQ ID NO: 325364 - protein, 9 aa, Homo Sapiens
LIPKAPKKT

SEQ ID NO: 325365 - protein, 9 aa, Homo Sapiens
GIICYAIGV

SEQ ID NO: 325366 - protein, 9 aa, Homo Sapiens
QNTQMGNQQ

SEQ ID NO: 325367 - protein, 9 aa, Homo Sapiens
NDLMKKYEK

SEQ ID NO: 325368 - protein, 9 aa, Homo Sapiens
KTDLLMIAL

SEQ ID NO: 325369 - protein, 9 aa, Homo Sapiens
IEEAQDPFL

SEQ ID NO: 325370 - protein, 9 aa, Homo Sapiens
PSPRGRTDK

SEQ ID NO: 325371 - protein, 9 aa, Homo Sapiens
YKLVDPEQD

SEQ ID NO: 325372 - protein, 9 aa, Homo Sapiens
VQPVVQHRS

SEQ ID NO: 325373 - protein, 9 aa, Homo Sapiens
GFRCICPPG

SEQ ID NO: 325374 - protein, 9 aa, Homo Sapiens
FYDEHTLWK

SEQ ID NO: 325375 - protein, 9 aa, Homo Sapiens
LPRVNRCTL

SEQ ID NO: 325376 - protein, 9 aa, Homo Sapiens
SRLGSRMFW

SEQ ID NO: 325377 - protein, 9 aa, Homo Sapiens
VGLSVVMGS

SEQ ID NO: 325378 - protein, 9 aa, Homo Sapiens
LFTIEAGVP

SEQ ID NO: 325379 - protein, 9 aa, Homo Sapiens
AECLIQSHP

SEQ ID NO: 325380 - protein, 9 aa, Homo Sapiens
VTNQIEEGE

SEQ ID NO: 325381 - protein, 9 aa, Homo Sapiens
CRQRTVMET

SEQ ID NO: 325382 - protein, 9 aa, Homo Sapiens
TSLRYSINI

SEQ ID NO: 325383 - protein, 9 aa, Homo Sapiens
FVINENAPV

SEQ ID NO: 325384 - protein, 9 aa, Homo Sapiens
GMGKPEVGR

SEQ ID NO: 325385 - protein, 9 aa, Homo Sapiens
ESFKQTNVY

SEQ ID NO: 325386 - protein, 9 aa, Homo Sapiens
VPIMLSASP

SEQ ID NO: 325387 - protein, 9 aa, Homo Sapiens
TLDRNSLCV

SEQ ID NO: 325388 - protein, 9 aa, Homo Sapiens
LGIAVYHCS

SEQ ID NO: 325389 - protein, 9 aa, Homo Sapiens
DPFPYPEEC

SEQ ID NO: 325390 - protein, 9 aa, Homo Sapiens
SLFESIATA

SEQ ID NO: 325391 - protein, 9 aa, Homo Sapiens
KSSNGWQWK

SEQ ID NO: 325392 - protein, 9 aa, Homo Sapiens
GHLCLPRSA

SEQ ID NO: 325393 - protein, 9 aa, Homo Sapiens
ALLHFLVML

SEQ ID NO: 325394 - protein, 9 aa, Homo Sapiens
VSNVIQQLL

SEQ ID NO: 325395 - protein, 9 aa, Homo Sapiens
GDFYPSPSP

SEQ ID NO: 325396 - protein, 9 aa, Homo Sapiens
RGYEPKQFK

SEQ ID NO: 325397 - protein, 9 aa, Homo Sapiens
SPAHDPQWY

SEQ ID NO: 325398 - protein, 9 aa, Homo Sapiens
HKKMEKEPA

SEQ ID NO: 325399 - protein, 9 aa, Homo Sapiens
WLVGQGMSS

SEQ ID NO: 325400 - protein, 9 aa, Homo Sapiens
DSDFRMVLQ

SEQ ID NO: 325401 - protein, 9 aa, Homo Sapiens
LKYTFSVGW

SEQ ID NO: 325402 - protein, 9 aa, Homo Sapiens
SNLRWLLEA

SEQ ID NO: 325403 - protein, 9 aa, Homo Sapiens
ATGHPSPQI

SEQ ID NO: 325404 - protein, 9 aa, Homo Sapiens
AMAEDSDPF

SEQ ID NO: 325405 - protein, 9 aa, Homo Sapiens
TLTGTPGTT

SEQ ID NO: 325406 - protein, 9 aa, Homo Sapiens
MAKKHQDFL

SEQ ID NO: 325407 - protein, 9 aa, Homo Sapiens
HAIRSLIQR

SEQ ID NO: 325408 - protein, 9 aa, Homo Sapiens
QGHKKEATA

SEQ ID NO: 325409 - protein, 9 aa, Homo Sapiens
SEPEKRPPF

SEQ ID NO: 325410 - protein, 9 aa, Homo Sapiens
HARGVLKDR

SEQ ID NO: 325411 - protein, 9 aa, Homo Sapiens
EQRLCAPDL

SEQ ID NO: 325412 - protein, 9 aa, Homo Sapiens
ESITRTSWA

SEQ ID NO: 325413 - protein, 9 aa, Homo Sapiens
LIAAIIAII

SEQ ID NO: 325414 - protein, 9 aa, Homo Sapiens
QGAIAFALA

SEQ ID NO: 325415 - protein, 9 aa, Homo Sapiens
ISAEGTVVS

SEQ ID NO: 325416 - protein, 9 aa, Homo Sapiens
EVGDDGDSR

SEQ ID NO: 325417 - protein, 9 aa, Homo Sapiens
LDQAHPASQ

SEQ ID NO: 325418 - protein, 9 aa, Homo Sapiens
ITKQEPGEA

SEQ ID NO: 325419 - protein, 9 aa, Homo Sapiens
DGQRATENH

SEQ ID NO: 325420 - protein, 9 aa, Homo Sapiens
EWQPIGRLL

SEQ ID NO: 325421 - protein, 9 aa, Homo Sapiens
MAPVQLPVS

SEQ ID NO: 325422 - protein, 9 aa, Homo Sapiens
VSGRLDSDT

SEQ ID NO: 325423 - protein, 9 aa, Homo Sapiens
PSLCVAELV

SEQ ID NO: 325424 - protein, 9 aa, Homo Sapiens
GYRPCPLIK

SEQ ID NO: 325425 - protein, 9 aa, Homo Sapiens
LDSVFDLVI

SEQ ID NO: 325426 - protein, 9 aa, Homo Sapiens
DEMCPCWFQ

SEQ ID NO: 325427 - protein, 9 aa, Homo Sapiens
AVMTYMKHF

SEQ ID NO: 325428 - protein, 9 aa, Homo Sapiens
YYNGHTKCK

SEQ ID NO: 325429 - protein, 9 aa, Homo Sapiens
ESTGIHETT

SEQ ID NO: 325430 - protein, 9 aa, Homo Sapiens
AERETAVVI

SEQ ID NO: 325431 - protein, 9 aa, Homo Sapiens
KISATWAQR

SEQ ID NO: 325432 - protein, 9 aa, Homo Sapiens
MDSVGSIPA

SEQ ID NO: 325433 - protein, 9 aa, Homo Sapiens
FSYRPDGNG

SEQ ID NO: 325434 - protein, 9 aa, Homo Sapiens
TLLALQHPQ

SEQ ID NO: 325435 - protein, 9 aa, Homo Sapiens
SPSGNLKQP

SEQ ID NO: 325436 - protein, 9 aa, Homo Sapiens
RAEDDCEKL

SEQ ID NO: 325437 - protein, 9 aa, Homo Sapiens
VQIEGSSGA

SEQ ID NO: 325438 - protein, 9 aa, Homo Sapiens
NFVWITIIK

SEQ ID NO: 325439 - protein, 9 aa, Homo Sapiens
SPTNPTSVQ

SEQ ID NO: 325440 - protein, 9 aa, Homo Sapiens
CELYLEDSP

SEQ ID NO: 325441 - protein, 9 aa, Homo Sapiens
VPGPGPLQA

SEQ ID NO: 325442 - protein, 9 aa, Homo Sapiens
CTSSQSIGQ

SEQ ID NO: 325443 - protein, 9 aa, Homo Sapiens
LERYAKWKG

SEQ ID NO: 325444 - protein, 9 aa, Homo Sapiens
QQTGRIFGG

SEQ ID NO: 325445 - protein, 9 aa, Homo Sapiens
SWKLILAQK

SEQ ID NO: 325446 - protein, 9 aa, Homo Sapiens
CLYSQLERN

SEQ ID NO: 325447 - protein, 9 aa, Homo Sapiens
IIAMETFGA

SEQ ID NO: 325448 - protein, 9 aa, Homo Sapiens
SFPCPVCGH

SEQ ID NO: 325449 - protein, 9 aa, Homo Sapiens
DHLQIQHWL

SEQ ID NO: 325450 - protein, 9 aa, Homo Sapiens
MLKCCGNGV

SEQ ID NO: 325451 - protein, 9 aa, Homo Sapiens
VEVKDKGEW

SEQ ID NO: 325452 - protein, 9 aa, Homo Sapiens
DDLMTCSNV

SEQ ID NO: 325453 - protein, 9 aa, Homo Sapiens
VTLEQARHN

SEQ ID NO: 325454 - protein, 9 aa, Homo Sapiens
KDIFHDLMD

SEQ ID NO: 325455 - protein, 9 aa, Homo Sapiens
NIADGKEIH

SEQ ID NO: 325456 - protein, 9 aa, Homo Sapiens
LLEQQVCAL

SEQ ID NO: 325457 - protein, 9 aa, Homo Sapiens
TCATTSLNP

SEQ ID NO: 325458 - protein, 9 aa, Homo Sapiens
SDGMNVAPG

SEQ ID NO: 325459 - protein, 9 aa, Homo Sapiens
VSLPTLAVY

SEQ ID NO: 325460 - protein, 9 aa, Homo Sapiens
TAISFHQVD

SEQ ID NO: 325461 - protein, 9 aa, Homo Sapiens
LPEEMLMER

SEQ ID NO: 325462 - protein, 9 aa, Homo Sapiens
FRLTEKMVF

SEQ ID NO: 325463 - protein, 9 aa, Homo Sapiens
ALHQAKEDM

SEQ ID NO: 325464 - protein, 9 aa, Homo Sapiens
LQADLHAQR

SEQ ID NO: 325465 - protein, 9 aa, Homo Sapiens
KSLLCHLPW

SEQ ID NO: 325466 - protein, 9 aa, Homo Sapiens
TVALKHVGP

SEQ ID NO: 325467 - protein, 9 aa, Homo Sapiens
CYTVPCTIL

SEQ ID NO: 325468 - protein, 9 aa, Homo Sapiens
HLCLPRSAA

SEQ ID NO: 325469 - protein, 9 aa, Homo Sapiens
VSWPSRLGS

SEQ ID NO: 325470 - protein, 9 aa, Homo Sapiens
EMEILAADC

SEQ ID NO: 325471 - protein, 9 aa, Homo Sapiens
LNKLLDPIW

SEQ ID NO: 325472 - protein, 9 aa, Homo Sapiens
GNVERNIAD

SEQ ID NO: 325473 - protein, 9 aa, Homo Sapiens
WARAALAMV

SEQ ID NO: 325474 - protein, 9 aa, Homo Sapiens
QPQWKLDPL

SEQ ID NO: 325475 - protein, 9 aa, Homo Sapiens
NHHLMLEAN

SEQ ID NO: 325476 - protein, 9 aa, Homo Sapiens
FGATNLTGL

SEQ ID NO: 325477 - protein, 9 aa, Homo Sapiens
PGDVRTWVK

SEQ ID NO: 325478 - protein, 9 aa, Homo Sapiens
SSIRSIVPA

SEQ ID NO: 325479 - protein, 9 aa, Homo Sapiens
PPTGLGPAP

SEQ ID NO: 325480 - protein, 9 aa, Homo Sapiens
PRRLQSPSK

SEQ ID NO: 325481 - protein, 9 aa, Homo Sapiens
EARPPSEDA

SEQ ID NO: 325482 - protein, 9 aa, Homo Sapiens
ELKVIQHYI

SEQ ID NO: 325483 - protein, 9 aa, Homo Sapiens
FEEWMEEES

SEQ ID NO: 325484 - protein, 9 aa, Homo Sapiens
DTYSGAPPR

SEQ ID NO: 325485 - protein, 9 aa, Homo Sapiens
HLDPCDVHL

SEQ ID NO: 325486 - protein, 9 aa, Homo Sapiens
CRQHMAMKS

SEQ ID NO: 325487 - protein, 9 aa, Homo Sapiens
HKVFINPLV

SEQ ID NO: 325488 - protein, 9 aa, Homo Sapiens
AICRNREMV

SEQ ID NO: 325489 - protein, 9 aa, Homo Sapiens
MVKRGDKKG

SEQ ID NO: 325490 - protein, 9 aa, Homo Sapiens
EILDFDYPQ

SEQ ID NO: 325491 - protein, 9 aa, Homo Sapiens
LVVDSIMDV

SEQ ID NO: 325492 - protein, 9 aa, Homo Sapiens
TFDRQELQC

SEQ ID NO: 325493 - protein, 9 aa, Homo Sapiens
NMCFRPMQM

SEQ ID NO: 325494 - protein, 9 aa, Homo Sapiens
PSPSPPAAG

SEQ ID NO: 325495 - protein, 9 aa, Homo Sapiens
APGQFGHPV

SEQ ID NO: 325496 - protein, 9 aa, Homo Sapiens
FASGGPFGP

SEQ ID NO: 325497 - protein, 9 aa, Homo Sapiens
NEGGESMLV

SEQ ID NO: 325498 - protein, 9 aa, Homo Sapiens
WIHMDSRPF

SEQ ID NO: 325499 - protein, 9 aa, Homo Sapiens
TCVDVHISY

SEQ ID NO: 325500 - protein, 9 aa, Homo Sapiens
AEHGPAFCG

SEQ ID NO: 325501 - protein, 9 aa, Homo Sapiens
TKKNWVSTS

SEQ ID NO: 325502 - protein, 9 aa, Homo Sapiens
WRKPTTISI

SEQ ID NO: 325503 - protein, 9 aa, Homo Sapiens
GFDFVINEN

SEQ ID NO: 325504 - protein, 9 aa, Homo Sapiens
DPEQDMSLR

SEQ ID NO: 325505 - protein, 9 aa, Homo Sapiens
QGIEFHYVY

SEQ ID NO: 325506 - protein, 9 aa, Homo Sapiens
TVQLTARIH

SEQ ID NO: 325507 - protein, 9 aa, Homo Sapiens
KLEHKEIQP

SEQ ID NO: 325508 - protein, 9 aa, Homo Sapiens
KFEDVNSWP

SEQ ID NO: 325509 - protein, 9 aa, Homo Sapiens
LIITDSKLY

SEQ ID NO: 325510 - protein, 9 aa, Homo Sapiens
TSTSIIISM

SEQ ID NO: 325511 - protein, 9 aa, Homo Sapiens
MGSKAAGAA

SEQ ID NO: 325512 - protein, 9 aa, Homo Sapiens
GGMKDVVWT

SEQ ID NO: 325513 - protein, 9 aa, Homo Sapiens
YWLNEDKVA

SEQ ID NO: 325514 - protein, 9 aa, Homo Sapiens
RLWYGTRRK

SEQ ID NO: 325515 - protein, 9 aa, Homo Sapiens
QIFGCKSYP

SEQ ID NO: 325516 - protein, 9 aa, Homo Sapiens
KPSPWLTIF

SEQ ID NO: 325517 - protein, 9 aa, Homo Sapiens
WRDLELAIG

SEQ ID NO: 325518 - protein, 9 aa, Homo Sapiens
KLVCIVSMD

SEQ ID NO: 325519 - protein, 9 aa, Homo Sapiens
SVVLHHHWI

SEQ ID NO: 325520 - protein, 9 aa, Homo Sapiens
KPDMHKQRG

SEQ ID NO: 325521 - protein, 9 aa, Homo Sapiens
GPKSTRPGA

SEQ ID NO: 325522 - protein, 9 aa, Homo Sapiens
NEFSWGKNG

SEQ ID NO: 325523 - protein, 9 aa, Homo Sapiens
YSTMVSPAV

SEQ ID NO: 325524 - protein, 9 aa, Homo Sapiens
ATQLVGGRE

SEQ ID NO: 325525 - protein, 9 aa, Homo Sapiens
SESWEPHVP

SEQ ID NO: 325526 - protein, 9 aa, Homo Sapiens
PPSGHGCSF

SEQ ID NO: 325527 - protein, 9 aa, Homo Sapiens
LHFEVFCVA

SEQ ID NO: 325528 - protein, 9 aa, Homo Sapiens
KINQFFVAI

SEQ ID NO: 325529 - protein, 9 aa, Homo Sapiens
AGDVAAVLD

SEQ ID NO: 325530 - protein, 9 aa, Homo Sapiens
EYSIQMMEP

SEQ ID NO: 325531 - protein, 9 aa, Homo Sapiens
FNQVVMANS

SEQ ID NO: 325532 - protein, 9 aa, Homo Sapiens
VLEKLNEHT

SEQ ID NO: 325533 - protein, 9 aa, Homo Sapiens
PKRFRDEPY

SEQ ID NO: 325534 - protein, 9 aa, Homo Sapiens
FFLPFVAMA

SEQ ID NO: 325535 - protein, 9 aa, Homo Sapiens
YQCFACNKF

SEQ ID NO: 325536 - protein, 9 aa, Homo Sapiens
PDNLSPQPE

SEQ ID NO: 325537 - protein, 9 aa, Homo Sapiens
KLGPQVSSQ

SEQ ID NO: 325538 - protein, 9 aa, Homo Sapiens
GLSCHQGIP

SEQ ID NO: 325539 - protein, 9 aa, Homo Sapiens
AVFEMLEGN

SEQ ID NO: 325540 - protein, 9 aa, Homo Sapiens
RALGGILAS

SEQ ID NO: 325541 - protein, 9 aa, Homo Sapiens
WVPVMEPKV

SEQ ID NO: 325542 - protein, 9 aa, Homo Sapiens
AHLEHLLQA

SEQ ID NO: 325543 - protein, 9 aa, Homo Sapiens
HFARSDELT

SEQ ID NO: 325544 - protein, 9 aa, Homo Sapiens
TGKKPFKCY

SEQ ID NO: 325545 - protein, 9 aa, Homo Sapiens
GEPWRAGFQ

SEQ ID NO: 325546 - protein, 9 aa, Homo Sapiens
PDLLQLYQD

SEQ ID NO: 325547 - protein, 9 aa, Homo Sapiens
TAECLIQSH

SEQ ID NO: 325548 - protein, 9 aa, Homo Sapiens
NCLHERAHI

SEQ ID NO: 325549 - protein, 9 aa, Homo Sapiens
LEGFRRFNL

SEQ ID NO: 325550 - protein, 9 aa, Homo Sapiens
SSESTVSRQ

SEQ ID NO: 325551 - protein, 9 aa, Homo Sapiens
HSDLHAYIQ

SEQ ID NO: 325552 - protein, 9 aa, Homo Sapiens
LWNSLGPRP

SEQ ID NO: 325553 - protein, 9 aa, Homo Sapiens
EWMVGGSVA

SEQ ID NO: 325554 - protein, 9 aa, Homo Sapiens
DMIDTKLEK

SEQ ID NO: 325555 - protein, 9 aa, Homo Sapiens
CITQFQVDM

SEQ ID NO: 325556 - protein, 9 aa, Homo Sapiens
TNVYSMALV

SEQ ID NO: 325557 - protein, 9 aa, Homo Sapiens
SIGSTNASS

SEQ ID NO: 325558 - protein, 9 aa, Homo Sapiens
KKCSLYGKK

SEQ ID NO: 325559 - protein, 9 aa, Homo Sapiens
RHTLLHNAC

SEQ ID NO: 325560 - protein, 9 aa, Homo Sapiens
TRGTGWPLA

SEQ ID NO: 325561 - protein, 9 aa, Homo Sapiens
DSADFRHSF

SEQ ID NO: 325562 - protein, 9 aa, Homo Sapiens
STHNSHLPA

SEQ ID NO: 325563 - protein, 9 aa, Homo Sapiens
LYQDFGNHQ

SEQ ID NO: 325564 - protein, 9 aa, Homo Sapiens
NVLIKELGP

SEQ ID NO: 325565 - protein, 9 aa, Homo Sapiens
RYHSVTGLV

SEQ ID NO: 325566 - protein, 9 aa, Homo Sapiens
GWVEVKDKG

SEQ ID NO: 325567 - protein, 9 aa, Homo Sapiens
YARQKIVII

SEQ ID NO: 325568 - protein, 9 aa, Homo Sapiens
PKKLKQEVG

SEQ ID NO: 325569 - protein, 9 aa, Homo Sapiens
ILLGRLGSN

SEQ ID NO: 325570 - protein, 9 aa, Homo Sapiens
KKKLISVEM

SEQ ID NO: 325571 - protein, 9 aa, Homo Sapiens
KVKDRTHDV

SEQ ID NO: 325572 - protein, 9 aa, Homo Sapiens
SSSHCSCGD

SEQ ID NO: 325573 - protein, 9 aa, Homo Sapiens
GSVGCSCSM

SEQ ID NO: 325574 - protein, 9 aa, Homo Sapiens
GGIRMVIIR

SEQ ID NO: 325575 - protein, 9 aa, Homo Sapiens
LWGEHTLTE

SEQ ID NO: 325576 - protein, 9 aa, Homo Sapiens
QTTLMLCEN

SEQ ID NO: 325577 - protein, 9 aa, Homo Sapiens
AKIQTVKMT

SEQ ID NO: 325578 - protein, 9 aa, Homo Sapiens
RDAPAGCKV

SEQ ID NO: 325579 - protein, 9 aa, Homo Sapiens
ITVSFLQKN

SEQ ID NO: 325580 - protein, 9 aa, Homo Sapiens
YRDYQQVVK

SEQ ID NO: 325581 - protein, 9 aa, Homo Sapiens
TGSCVQFLH

SEQ ID NO: 325582 - protein, 9 aa, Homo Sapiens
FTAHTAPAY

SEQ ID NO: 325583 - protein, 9 aa, Homo Sapiens
NKHSIQNRI

SEQ ID NO: 325584 - protein, 9 aa, Homo Sapiens
PPDILQLLL

SEQ ID NO: 325585 - protein, 9 aa, Homo Sapiens
QHFLSPETF

SEQ ID NO: 325586 - protein, 9 aa, Homo Sapiens
IAELQVQID

SEQ ID NO: 325587 - protein, 9 aa, Homo Sapiens
KSPWHMHLE

SEQ ID NO: 325588 - protein, 9 aa, Homo Sapiens
EATATDAKA

SEQ ID NO: 325589 - protein, 9 aa, Homo Sapiens
MVAGSTTLH

SEQ ID NO: 325590 - protein, 9 aa, Homo Sapiens
CINMTDTGI

SEQ ID NO: 325591 - protein, 9 aa, Homo Sapiens
QIHFLVCAW

SEQ ID NO: 325592 - protein, 9 aa, Homo Sapiens
TAKISSPHQ

SEQ ID NO: 325593 - protein, 9 aa, Homo Sapiens
DFSYSLHLA

SEQ ID NO: 325594 - protein, 9 aa, Homo Sapiens
PLPAQIQEI

SEQ ID NO: 325595 - protein, 9 aa, Homo Sapiens
IPELLRWVL

SEQ ID NO: 325596 - protein, 9 aa, Homo Sapiens
DKEACEVCG

SEQ ID NO: 325597 - protein, 9 aa, Homo Sapiens
GEPKHYLHL

SEQ ID NO: 325598 - protein, 9 aa, Homo Sapiens
PHCLGQLGL

SEQ ID NO: 325599 - protein, 9 aa, Homo Sapiens
KGYVQIVEA

SEQ ID NO: 325600 - protein, 9 aa, Homo Sapiens
KMALSTGDV

SEQ ID NO: 325601 - protein, 9 aa, Homo Sapiens
EGSTGIICL

SEQ ID NO: 325602 - protein, 9 aa, Homo Sapiens
SSSPTPLSS

SEQ ID NO: 325603 - protein, 9 aa, Homo Sapiens
MESTGIHET

SEQ ID NO: 325604 - protein, 9 aa, Homo Sapiens
GPPPKKLKQ

SEQ ID NO: 325605 - protein, 9 aa, Homo Sapiens
PKAPFSDTL

SEQ ID NO: 325606 - protein, 9 aa, Homo Sapiens
SVYVVSSNH

SEQ ID NO: 325607 - protein, 9 aa, Homo Sapiens
ANSAQSNAV

SEQ ID NO: 325608 - protein, 9 aa, Homo Sapiens
TQPEPQHFQ

SEQ ID NO: 325609 - protein, 9 aa, Homo Sapiens
PPGDKFSPH

SEQ ID NO: 325610 - protein, 9 aa, Homo Sapiens
RVQSTQSQF

SEQ ID NO: 325611 - protein, 9 aa, Homo Sapiens
LEPQPPPHM

SEQ ID NO: 325612 - protein, 9 aa, Homo Sapiens
HTVEFNQVV

SEQ ID NO: 325613 - protein, 9 aa, Homo Sapiens
HAVRTPPCT

SEQ ID NO: 325614 - protein, 9 aa, Homo Sapiens
LEWLQVQTI

SEQ ID NO: 325615 - protein, 9 aa, Homo Sapiens
FTSREEVVI

SEQ ID NO: 325616 - protein, 9 aa, Homo Sapiens
DYHSLCEWQ

SEQ ID NO: 325617 - protein, 9 aa, Homo Sapiens
NNVWDFLKL

SEQ ID NO: 325618 - protein, 9 aa, Homo Sapiens
RPLGQRQPH

SEQ ID NO: 325619 - protein, 9 aa, Homo Sapiens
GELSIEEAQ

SEQ ID NO: 325620 - protein, 9 aa, Homo Sapiens
PSRAFACHE

SEQ ID NO: 325621 - protein, 9 aa, Homo Sapiens
FPSWEMAVN

SEQ ID NO: 325622 - protein, 9 aa, Homo Sapiens
SGITVMLLF

SEQ ID NO: 325623 - protein, 9 aa, Homo Sapiens
DLLERPGPA

SEQ ID NO: 325624 - protein, 9 aa, Homo Sapiens
KNNYEKFKN

SEQ ID NO: 325625 - protein, 9 aa, Homo Sapiens
QDMSLRLNE

SEQ ID NO: 325626 - protein, 9 aa, Homo Sapiens
KKMTLKALV

SEQ ID NO: 325627 - protein, 9 aa, Homo Sapiens
QLQRDREAM

SEQ ID NO: 325628 - protein, 9 aa, Homo Sapiens
TIKQVPVES

SEQ ID NO: 325629 - protein, 9 aa, Homo Sapiens
QMTHVRPGS

SEQ ID NO: 325630 - protein, 9 aa, Homo Sapiens
VTVDSIMPL

SEQ ID NO: 325631 - protein, 9 aa, Homo Sapiens
SALKCHGLG

SEQ ID NO: 325632 - protein, 9 aa, Homo Sapiens
AFRSRRKEA

SEQ ID NO: 325633 - protein, 9 aa, Homo Sapiens
DACKLCSCH

SEQ ID NO: 325634 - protein, 9 aa, Homo Sapiens
CDPRDLKRC

SEQ ID NO: 325635 - protein, 9 aa, Homo Sapiens
AVMGVMKPG

SEQ ID NO: 325636 - protein, 9 aa, Homo Sapiens
CVNGFTHWI

SEQ ID NO: 325637 - protein, 9 aa, Homo Sapiens
NKGDIIVLW

SEQ ID NO: 325638 - protein, 9 aa, Homo Sapiens
GACEREELP

SEQ ID NO: 325639 - protein, 9 aa, Homo Sapiens
EELVATGKT

SEQ ID NO: 325640 - protein, 9 aa, Homo Sapiens
CVRACGANS

SEQ ID NO: 325641 - protein, 9 aa, Homo Sapiens
NSPGYPEIY

SEQ ID NO: 325642 - protein, 9 aa, Homo Sapiens
EDDPLLRDV

SEQ ID NO: 325643 - protein, 9 aa, Homo Sapiens
LVCLPGVIA

SEQ ID NO: 325644 - protein, 9 aa, Homo Sapiens
HRNAYKCMS

SEQ ID NO: 325645 - protein, 9 aa, Homo Sapiens
VDSFREQIT

SEQ ID NO: 325646 - protein, 9 aa, Homo Sapiens
SGLAYLHME

SEQ ID NO: 325647 - protein, 9 aa, Homo Sapiens
IDQDHAAFL

SEQ ID NO: 325648 - protein, 9 aa, Homo Sapiens
TNFLVRCSP

SEQ ID NO: 325649 - protein, 9 aa, Homo Sapiens
SGKCVMDSV

SEQ ID NO: 325650 - protein, 9 aa, Homo Sapiens
RSDSLCCGR

SEQ ID NO: 325651 - protein, 9 aa, Homo Sapiens
KGQTHPRID

SEQ ID NO: 325652 - protein, 9 aa, Homo Sapiens
PRDLKRCNR

SEQ ID NO: 325653 - protein, 9 aa, Homo Sapiens
KAARIDIEI

SEQ ID NO: 325654 - protein, 9 aa, Homo Sapiens
WSYNELGLL

SEQ ID NO: 325655 - protein, 9 aa, Homo Sapiens
RTKEEGDRE

SEQ ID NO: 325656 - protein, 9 aa, Homo Sapiens
FKNKLYVAM

SEQ ID NO: 325657 - protein, 9 aa, Homo Sapiens
YGHTSTVHC

SEQ ID NO: 325658 - protein, 9 aa, Homo Sapiens
RPRRKGPQW

SEQ ID NO: 325659 - protein, 9 aa, Homo Sapiens
APPESCVSQ

SEQ ID NO: 325660 - protein, 9 aa, Homo Sapiens
EQRTVTLGV

SEQ ID NO: 325661 - protein, 9 aa, Homo Sapiens
VLQILVVIS

SEQ ID NO: 325662 - protein, 9 aa, Homo Sapiens
LDKRCGRDP

SEQ ID NO: 325663 - protein, 9 aa, Homo Sapiens
RVPLHTQKD

SEQ ID NO: 325664 - protein, 9 aa, Homo Sapiens
PRENSMRSC

SEQ ID NO: 325665 - protein, 9 aa, Homo Sapiens
IMGGAVFEM

SEQ ID NO: 325666 - protein, 9 aa, Homo Sapiens
PCIEENPGK

SEQ ID NO: 325667 - protein, 9 aa, Homo Sapiens
GQKQWPSRF

SEQ ID NO: 325668 - protein, 9 aa, Homo Sapiens
IKYASRSWK

SEQ ID NO: 325669 - protein, 9 aa, Homo Sapiens
YSCTFIQTT

SEQ ID NO: 325670 - protein, 9 aa, Homo Sapiens
AGVAKGAIM

SEQ ID NO: 325671 - protein, 9 aa, Homo Sapiens
PHQKQRLKK

SEQ ID NO: 325672 - protein, 9 aa, Homo Sapiens
KLPKLNQRL

SEQ ID NO: 325673 - protein, 9 aa, Homo Sapiens
QTQAGTQIP

SEQ ID NO: 325674 - protein, 9 aa, Homo Sapiens
NPQKKTVCI

SEQ ID NO: 325675 - protein, 9 aa, Homo Sapiens
RKVPKYQDA

SEQ ID NO: 325676 - protein, 9 aa, Homo Sapiens
RNKIVHFTG

SEQ ID NO: 325677 - protein, 9 aa, Homo Sapiens
SETRKWMGT

SEQ ID NO: 325678 - protein, 9 aa, Homo Sapiens
ESSTLLHHR

SEQ ID NO: 325679 - protein, 9 aa, Homo Sapiens
NGFRCICPP

SEQ ID NO: 325680 - protein, 9 aa, Homo Sapiens
QCAMADPYV

SEQ ID NO: 325681 - protein, 9 aa, Homo Sapiens
FMSVYEQRI

SEQ ID NO: 325682 - protein, 9 aa, Homo Sapiens
AVIDVGVCR

SEQ ID NO: 325683 - protein, 9 aa, Homo Sapiens
ADQVSWEYG

SEQ ID NO: 325684 - protein, 9 aa, Homo Sapiens
NHRYKWNGH

SEQ ID NO: 325685 - protein, 9 aa, Homo Sapiens
HSNVHSRVP

SEQ ID NO: 325686 - protein, 9 aa, Homo Sapiens
LGEIFMLKC

SEQ ID NO: 325687 - protein, 9 aa, Homo Sapiens
AGYGLISFK

SEQ ID NO: 325688 - protein, 9 aa, Homo Sapiens
LASMPDLRR

SEQ ID NO: 325689 - protein, 9 aa, Homo Sapiens
NGLCIWLLI

SEQ ID NO: 325690 - protein, 9 aa, Homo Sapiens
RRGRCGKKG

SEQ ID NO: 325691 - protein, 9 aa, Homo Sapiens
RRGIYPTST

SEQ ID NO: 325692 - protein, 9 aa, Homo Sapiens
NSADCVSED

SEQ ID NO: 325693 - protein, 9 aa, Homo Sapiens
CGKKGAATK

SEQ ID NO: 325694 - protein, 9 aa, Homo Sapiens
PKDTTPAPP

SEQ ID NO: 325695 - protein, 9 aa, Homo Sapiens
CTCATTSLN

SEQ ID NO: 325696 - protein, 9 aa, Homo Sapiens
GLPAMALGF

SEQ ID NO: 325697 - protein, 9 aa, Homo Sapiens
CAKAHEKLD

SEQ ID NO: 325698 - protein, 9 aa, Homo Sapiens
AWRDLELAI

SEQ ID NO: 325699 - protein, 9 aa, Homo Sapiens
SHHEFKEWF

SEQ ID NO: 325700 - protein, 9 aa, Homo Sapiens
IQRLVAEHP

SEQ ID NO: 325701 - protein, 9 aa, Homo Sapiens
QCSHDVVIC

SEQ ID NO: 325702 - protein, 9 aa, Homo Sapiens
PGSCPSQHQ

SEQ ID NO: 325703 - protein, 9 aa, Homo Sapiens
GKTGLRLWK

SEQ ID NO: 325704 - protein, 9 aa, Homo Sapiens
PDPRPNGAG

SEQ ID NO: 325705 - protein, 9 aa, Homo Sapiens
DLHAYIQHR

SEQ ID NO: 325706 - protein, 9 aa, Homo Sapiens
IDWEKLEHK

SEQ ID NO: 325707 - protein, 9 aa, Homo Sapiens
HTVWRVVFI

SEQ ID NO: 325708 - protein, 9 aa, Homo Sapiens
NGQDAYASS

SEQ ID NO: 325709 - protein, 9 aa, Homo Sapiens
CDTQSTQEI

SEQ ID NO: 325710 - protein, 9 aa, Homo Sapiens
PMRKHLSAP

SEQ ID NO: 325711 - protein, 9 aa, Homo Sapiens
SFHSNVHSR

SEQ ID NO: 325712 - protein, 9 aa, Homo Sapiens
IVQCAMADP

SEQ ID NO: 325713 - protein, 9 aa, Homo Sapiens
RPHVRVEAL

SEQ ID NO: 325714 - protein, 9 aa, Homo Sapiens
LSWHQKIHT

SEQ ID NO: 325715 - protein, 9 aa, Homo Sapiens
HRRLHLPQQ

SEQ ID NO: 325716 - protein, 9 aa, Homo Sapiens
GRGEQSDCP

SEQ ID NO: 325717 - protein, 9 aa, Homo Sapiens
SCPVTHTWE

SEQ ID NO: 325718 - protein, 9 aa, Homo Sapiens
QTFEELTLL

SEQ ID NO: 325719 - protein, 9 aa, Homo Sapiens
SAPPSGHGC

SEQ ID NO: 325720 - protein, 9 aa, Homo Sapiens
PPVALPSDG

SEQ ID NO: 325721 - protein, 9 aa, Homo Sapiens
RRAKETKGG

SEQ ID NO: 325722 - protein, 9 aa, Homo Sapiens
LPYLTAKIS

SEQ ID NO: 325723 - protein, 9 aa, Homo Sapiens
ARDALVELS

SEQ ID NO: 325724 - protein, 9 aa, Homo Sapiens
RSQLPWPAS

SEQ ID NO: 325725 - protein, 9 aa, Homo Sapiens
VDTGCPIPG

SEQ ID NO: 325726 - protein, 9 aa, Homo Sapiens
IPDSYIPDC

SEQ ID NO: 325727 - protein, 9 aa, Homo Sapiens
TARGGLKGQ

SEQ ID NO: 325728 - protein, 9 aa, Homo Sapiens
SGPELQQTG

SEQ ID NO: 325729 - protein, 9 aa, Homo Sapiens
RQIISAVHY

SEQ ID NO: 325730 - protein, 9 aa, Homo Sapiens
HNQEEKIRE

SEQ ID NO: 325731 - protein, 9 aa, Homo Sapiens
IKFHCASKA

SEQ ID NO: 325732 - protein, 9 aa, Homo Sapiens
TQPRLLLSS

SEQ ID NO: 325733 - protein, 9 aa, Homo Sapiens
SSTSFMVSW

SEQ ID NO: 325734 - protein, 9 aa, Homo Sapiens
LAVAWDLEL

SEQ ID NO: 325735 - protein, 9 aa, Homo Sapiens
AWIKKLPFL

SEQ ID NO: 325736 - protein, 9 aa, Homo Sapiens
STKRSPQQP

SEQ ID NO: 325737 - protein, 9 aa, Homo Sapiens
LVGQGMSSR

SEQ ID NO: 325738 - protein, 9 aa, Homo Sapiens
ICSQPRENS

SEQ ID NO: 325739 - protein, 9 aa, Homo Sapiens
SGTTQISVR

SEQ ID NO: 325740 - protein, 9 aa, Homo Sapiens
THSTASHSS

SEQ ID NO: 325741 - protein, 9 aa, Homo Sapiens
RWQRSSCSS

SEQ ID NO: 325742 - protein, 9 aa, Homo Sapiens
EGEGCLGKC

SEQ ID NO: 325743 - protein, 9 aa, Homo Sapiens
PGDLSGLSP

SEQ ID NO: 325744 - protein, 9 aa, Homo Sapiens
GVAVLIILL

SEQ ID NO: 325745 - protein, 9 aa, Homo Sapiens
PGACVTLVS

SEQ ID NO: 325746 - protein, 9 aa, Homo Sapiens
LLLLIPRQL

SEQ ID NO: 325747 - protein, 9 aa, Homo Sapiens
GIGSELTRH

SEQ ID NO: 325748 - protein, 9 aa, Homo Sapiens
TDPVSAPCV

SEQ ID NO: 325749 - protein, 9 aa, Homo Sapiens
KWLVGTVTK

SEQ ID NO: 325750 - protein, 9 aa, Homo Sapiens
PDSPTTLYH

SEQ ID NO: 325751 - protein, 9 aa, Homo Sapiens
EPWMLGNAN

SEQ ID NO: 325752 - protein, 9 aa, Homo Sapiens
ALDFFTYCC

SEQ ID NO: 325753 - protein, 9 aa, Homo Sapiens
TIFTLSMAY

SEQ ID NO: 325754 - protein, 9 aa, Homo Sapiens
TEPRCCSGL

SEQ ID NO: 325755 - protein, 9 aa, Homo Sapiens
MERHHILFR

SEQ ID NO: 325756 - protein, 9 aa, Homo Sapiens
PFSDTLRPY

SEQ ID NO: 325757 - protein, 9 aa, Homo Sapiens
RTDRGTVQK

SEQ ID NO: 325758 - protein, 9 aa, Homo Sapiens
SPGSAAWGR

SEQ ID NO: 325759 - protein, 9 aa, Homo Sapiens
ARSGTTQIS

SEQ ID NO: 325760 - protein, 9 aa, Homo Sapiens
VLEPLQEHR

SEQ ID NO: 325761 - protein, 9 aa, Homo Sapiens
PPQLFAAVP

SEQ ID NO: 325762 - protein, 9 aa, Homo Sapiens
NFLRTWGRA

SEQ ID NO: 325763 - protein, 9 aa, Homo Sapiens
SWQEQLARA

SEQ ID NO: 325764 - protein, 9 aa, Homo Sapiens
LARDAALIL

SEQ ID NO: 325765 - protein, 9 aa, Homo Sapiens
SIPMFLCLY

SEQ ID NO: 325766 - protein, 9 aa, Homo Sapiens
ETLRKGGHC

SEQ ID NO: 325767 - protein, 9 aa, Homo Sapiens
WLVGTVTKP

SEQ ID NO: 325768 - protein, 9 aa, Homo Sapiens
AASEAATTI

SEQ ID NO: 325769 - protein, 9 aa, Homo Sapiens
VTDSQADFL

SEQ ID NO: 325770 - protein, 9 aa, Homo Sapiens
GTGGRQGSH

SEQ ID NO: 325771 - protein, 9 aa, Homo Sapiens
PLFEELMTT

SEQ ID NO: 325772 - protein, 9 aa, Homo Sapiens
LVAPPVALP

SEQ ID NO: 325773 - protein, 9 aa, Homo Sapiens
FRRAKETKG

SEQ ID NO: 325774 - protein, 9 aa, Homo Sapiens
GTTLYEALA

SEQ ID NO: 325775 - protein, 9 aa, Homo Sapiens
NINTVATLE

SEQ ID NO: 325776 - protein, 9 aa, Homo Sapiens
VQFLHGEAC

SEQ ID NO: 325777 - protein, 9 aa, Homo Sapiens
CIHRLIEVD

SEQ ID NO: 325778 - protein, 9 aa, Homo Sapiens
LDLSDPMWP

SEQ ID NO: 325779 - protein, 9 aa, Homo Sapiens
EKQGLALDG

SEQ ID NO: 325780 - protein, 9 aa, Homo Sapiens
VLYLKKKQE

SEQ ID NO: 325781 - protein, 9 aa, Homo Sapiens
LQCQIHAKD

SEQ ID NO: 325782 - protein, 9 aa, Homo Sapiens
VLQSTPTPM

SEQ ID NO: 325783 - protein, 9 aa, Homo Sapiens
ATIIRHTSM

SEQ ID NO: 325784 - protein, 9 aa, Homo Sapiens
TSWWTFRCP

SEQ ID NO: 325785 - protein, 9 aa, Homo Sapiens
LEIIHKCEP

SEQ ID NO: 325786 - protein, 9 aa, Homo Sapiens
HQGLPGRLP

SEQ ID NO: 325787 - protein, 9 aa, Homo Sapiens
LSIPMFLCL

SEQ ID NO: 325788 - protein, 9 aa, Homo Sapiens
LRLASMPDL

SEQ ID NO: 325789 - protein, 9 aa, Homo Sapiens
WHCFMTSGI

SEQ ID NO: 325790 - protein, 9 aa, Homo Sapiens
ASEAATTIS

SEQ ID NO: 325791 - protein, 9 aa, Homo Sapiens
SAVFNPSIL

SEQ ID NO: 325792 - protein, 9 aa, Homo Sapiens
LPFVAMACC

SEQ ID NO: 325793 - protein, 9 aa, Homo Sapiens
KLTRERMMG

SEQ ID NO: 325794 - protein, 9 aa, Homo Sapiens
PCVITRKPG

SEQ ID NO: 325795 - protein, 9 aa, Homo Sapiens
CEKGFRYSS

SEQ ID NO: 325796 - protein, 9 aa, Homo Sapiens
NTYKSCRRS

SEQ ID NO: 325797 - protein, 9 aa, Homo Sapiens
WARKLEELI

SEQ ID NO: 325798 - protein, 9 aa, Homo Sapiens
IDAYSPAWC

SEQ ID NO: 325799 - protein, 9 aa, Homo Sapiens
RVVFIAFLT

SEQ ID NO: 325800 - protein, 9 aa, Homo Sapiens
LVTDGLPAM

SEQ ID NO: 325801 - protein, 9 aa, Homo Sapiens
SNTDHLDSM

SEQ ID NO: 325802 - protein, 9 aa, Homo Sapiens
GCSLNCVDG

SEQ ID NO: 325803 - protein, 9 aa, Homo Sapiens
ALLKENWLL

SEQ ID NO: 325804 - protein, 9 aa, Homo Sapiens
SGNVATGDL

SEQ ID NO: 325805 - protein, 9 aa, Homo Sapiens
NIALCPDRA

SEQ ID NO: 325806 - protein, 9 aa, Homo Sapiens
IYKWVPVME

SEQ ID NO: 325807 - protein, 9 aa, Homo Sapiens
VNSRGYPTL

SEQ ID NO: 325808 - protein, 9 aa, Homo Sapiens
RITNEGQIL

SEQ ID NO: 325809 - protein, 9 aa, Homo Sapiens
QEKIENVQS

SEQ ID NO: 325810 - protein, 9 aa, Homo Sapiens
GHMGIVLNS

SEQ ID NO: 325811 - protein, 9 aa, Homo Sapiens
LLLSSVHPP

SEQ ID NO: 325812 - protein, 9 aa, Homo Sapiens
LGNVQITVV

SEQ ID NO: 325813 - protein, 9 aa, Homo Sapiens
VCVFQGLTP

SEQ ID NO: 325814 - protein, 9 aa, Homo Sapiens
KLVDPEQDM

SEQ ID NO: 325815 - protein, 9 aa, Homo Sapiens
QLCWKLVSP

SEQ ID NO: 325816 - protein, 9 aa, Homo Sapiens
GGPPPKKLK

SEQ ID NO: 325817 - protein, 9 aa, Homo Sapiens
IKSQNLLVL

SEQ ID NO: 325818 - protein, 9 aa, Homo Sapiens
RKLTVMSSC

SEQ ID NO: 325819 - protein, 9 aa, Homo Sapiens
MFLCLYLLG

SEQ ID NO: 325820 - protein, 9 aa, Homo Sapiens
VPKDSFEGL

SEQ ID NO: 325821 - protein, 9 aa, Homo Sapiens
LQEHRICVC

SEQ ID NO: 325822 - protein, 9 aa, Homo Sapiens
VRRITNEGQ

SEQ ID NO: 325823 - protein, 9 aa, Homo Sapiens
DAPHSLRSN

SEQ ID NO: 325824 - protein, 9 aa, Homo Sapiens
PANGAGWPC

SEQ ID NO: 325825 - protein, 9 aa, Homo Sapiens
YPEIYPPNV

SEQ ID NO: 325826 - protein, 9 aa, Homo Sapiens
CSGASSSCR

SEQ ID NO: 325827 - protein, 9 aa, Homo Sapiens
QAWARAALA

SEQ ID NO: 325828 - protein, 9 aa, Homo Sapiens
IGRHMKRQD

SEQ ID NO: 325829 - protein, 9 aa, Homo Sapiens
SRGYEPKQF

SEQ ID NO: 325830 - protein, 9 aa, Homo Sapiens
ARNEGGESM

SEQ ID NO: 325831 - protein, 9 aa, Homo Sapiens
ESREWKKIT

SEQ ID NO: 325832 - protein, 9 aa, Homo Sapiens
EGSFLVCFI

SEQ ID NO: 325833 - protein, 9 aa, Homo Sapiens
AAGPPGGPQ

SEQ ID NO: 325834 - protein, 9 aa, Homo Sapiens
ATRSGGDLV

SEQ ID NO: 325835 - protein, 9 aa, Homo Sapiens
LQGVLDVPA

SEQ ID NO: 325836 - protein, 9 aa, Homo Sapiens
IFRSWGHVG

SEQ ID NO: 325837 - protein, 9 aa, Homo Sapiens
QDECQYRRP

SEQ ID NO: 325838 - protein, 9 aa, Homo Sapiens
DGLQSSCHI

SEQ ID NO: 325839 - protein, 9 aa, Homo Sapiens
KHQEELERK

SEQ ID NO: 325840 - protein, 9 aa, Homo Sapiens
NNFQGHYDG

SEQ ID NO: 325841 - protein, 9 aa, Homo Sapiens
VARAGFLDT

SEQ ID NO: 325842 - protein, 9 aa, Homo Sapiens
IVLAAGYGL

SEQ ID NO: 325843 - protein, 9 aa, Homo Sapiens
MFLCATEWL

SEQ ID NO: 325844 - protein, 9 aa, Homo Sapiens
HHEFKEWFS

SEQ ID NO: 325845 - protein, 9 aa, Homo Sapiens
LCERLLASS

SEQ ID NO: 325846 - protein, 9 aa, Homo Sapiens
GLETMYTGG

SEQ ID NO: 325847 - protein, 9 aa, Homo Sapiens
VNPNMKSKA

SEQ ID NO: 325848 - protein, 9 aa, Homo Sapiens
ALGGILASI

SEQ ID NO: 325849 - protein, 9 aa, Homo Sapiens
EAEARSSPG

SEQ ID NO: 325850 - protein, 9 aa, Homo Sapiens
DGFLRQRGS

SEQ ID NO: 325851 - protein, 9 aa, Homo Sapiens
DGSHASSNS

SEQ ID NO: 325852 - protein, 9 aa, Homo Sapiens
RSPGSDPFP

SEQ ID NO: 325853 - protein, 9 aa, Homo Sapiens
SFREQITSE

SEQ ID NO: 325854 - protein, 9 aa, Homo Sapiens
YTFSVGWWS

SEQ ID NO: 325855 - protein, 9 aa, Homo Sapiens
GWRTGLAFC

SEQ ID NO: 325856 - protein, 9 aa, Homo Sapiens
WDHSGTLGP

SEQ ID NO: 325857 - protein, 9 aa, Homo Sapiens
LRTYQTQGL

SEQ ID NO: 325858 - protein, 9 aa, Homo Sapiens
QTSTIPEEL

SEQ ID NO: 325859 - protein, 9 aa, Homo Sapiens
APRSLEFLR

SEQ ID NO: 325860 - protein, 9 aa, Homo Sapiens
AGFQWGESP

SEQ ID NO: 325861 - protein, 9 aa, Homo Sapiens
GITGSSCTQ

SEQ ID NO: 325862 - protein, 9 aa, Homo Sapiens
HLRIGIHTG

SEQ ID NO: 325863 - protein, 9 aa, Homo Sapiens
NPEPSFMWY

SEQ ID NO: 325864 - protein, 9 aa, Homo Sapiens
MLGNANHDG

SEQ ID NO: 325865 - protein, 9 aa, Homo Sapiens
SGLQGAIAF

SEQ ID NO: 325866 - protein, 9 aa, Homo Sapiens
CNKFGTALS

SEQ ID NO: 325867 - protein, 9 aa, Homo Sapiens
IAPATPAPG

SEQ ID NO: 325868 - protein, 9 aa, Homo Sapiens
IFAISLGST

SEQ ID NO: 325869 - protein, 9 aa, Homo Sapiens
ETHSHFLAQ

SEQ ID NO: 325870 - protein, 9 aa, Homo Sapiens
FSVLHERWS

SEQ ID NO: 325871 - protein, 9 aa, Homo Sapiens
VKDKGEWDF

SEQ ID NO: 325872 - protein, 9 aa, Homo Sapiens
SQFIYVFTT

SEQ ID NO: 325873 - protein, 9 aa, Homo Sapiens
KKEAKKSPK

SEQ ID NO: 325874 - protein, 9 aa, Homo Sapiens
DEEKIPKTD

SEQ ID NO: 325875 - protein, 9 aa, Homo Sapiens
EVLNLATEF

SEQ ID NO: 325876 - protein, 9 aa, Homo Sapiens
RERRDRRPG

SEQ ID NO: 325877 - protein, 9 aa, Homo Sapiens
HCAAASGMK

SEQ ID NO: 325878 - protein, 9 aa, Homo Sapiens
WIASPAHDP

SEQ ID NO: 325879 - protein, 9 aa, Homo Sapiens
TKDKDGQLV

SEQ ID NO: 325880 - protein, 9 aa, Homo Sapiens
LKECSCMKG

SEQ ID NO: 325881 - protein, 9 aa, Homo Sapiens
PEETFISGP

SEQ ID NO: 325882 - protein, 9 aa, Homo Sapiens
KNLELQFVS

SEQ ID NO: 325883 - protein, 9 aa, Homo Sapiens
WAAASKLGE

SEQ ID NO: 325884 - protein, 9 aa, Homo Sapiens
FEGSFLVCF

SEQ ID NO: 325885 - protein, 9 aa, Homo Sapiens
SIVEKVQVQ

SEQ ID NO: 325886 - protein, 9 aa, Homo Sapiens
YKDHIQQFD

SEQ ID NO: 325887 - protein, 9 aa, Homo Sapiens
FCDTQSTQE

SEQ ID NO: 325888 - protein, 9 aa, Homo Sapiens
GLKYTFSVG

SEQ ID NO: 325889 - protein, 9 aa, Homo Sapiens
AIQKKLVIV

SEQ ID NO: 325890 - protein, 9 aa, Homo Sapiens
EPHVPEASS

SEQ ID NO: 325891 - protein, 9 aa, Homo Sapiens
FPLFTHCSG

SEQ ID NO: 325892 - protein, 9 aa, Homo Sapiens
LDHNKVIEL

SEQ ID NO: 325893 - protein, 9 aa, Homo Sapiens
QEAPGMALA

SEQ ID NO: 325894 - protein, 9 aa, Homo Sapiens
KGQSVAPYN

SEQ ID NO: 325895 - protein, 9 aa, Homo Sapiens
VCVLVSDIL

SEQ ID NO: 325896 - protein, 9 aa, Homo Sapiens
KRGSKIIVG

SEQ ID NO: 325897 - protein, 9 aa, Homo Sapiens
ADAPHGVVW

SEQ ID NO: 325898 - protein, 9 aa, Homo Sapiens
LVMFGCGSM

SEQ ID NO: 325899 - protein, 9 aa, Homo Sapiens
KLTGVMKDG

SEQ ID NO: 325900 - protein, 9 aa, Homo Sapiens
YKSCRRSYH

SEQ ID NO: 325901 - protein, 9 aa, Homo Sapiens
FDLHGENPT

SEQ ID NO: 325902 - protein, 9 aa, Homo Sapiens
PIIFQMTLI

SEQ ID NO: 325903 - protein, 9 aa, Homo Sapiens
HLKDGIRHG

SEQ ID NO: 325904 - protein, 9 aa, Homo Sapiens
WALKVKQAM

SEQ ID NO: 325905 - protein, 9 aa, Homo Sapiens
YNSAVYSLE

SEQ ID NO: 325906 - protein, 9 aa, Homo Sapiens
VVTFLQLAD

SEQ ID NO: 325907 - protein, 9 aa, Homo Sapiens
KMTLKALVK

SEQ ID NO: 325908 - protein, 9 aa, Homo Sapiens
ISCLAGVAV

SEQ ID NO: 325909 - protein, 9 aa, Homo Sapiens
QQKAMNTCG

SEQ ID NO: 325910 - protein, 9 aa, Homo Sapiens
SMLVVQLEV

SEQ ID NO: 325911 - protein, 9 aa, Homo Sapiens
SLDGSVDKR

SEQ ID NO: 325912 - protein, 9 aa, Homo Sapiens
RHIGNKTEC

SEQ ID NO: 325913 - protein, 9 aa, Homo Sapiens
PLPDMVQDL

SEQ ID NO: 325914 - protein, 9 aa, Homo Sapiens
PEEFGFGFG

SEQ ID NO: 325915 - protein, 9 aa, Homo Sapiens
SVMVKVVII

SEQ ID NO: 325916 - protein, 9 aa, Homo Sapiens
GIAVYHCSA

SEQ ID NO: 325917 - protein, 9 aa, Homo Sapiens
ALLITQNST

SEQ ID NO: 325918 - protein, 9 aa, Homo Sapiens
FFQGPPRLP

SEQ ID NO: 325919 - protein, 9 aa, Homo Sapiens
ITDSADFRH

SEQ ID NO: 325920 - protein, 9 aa, Homo Sapiens
DFTTYIQRG

SEQ ID NO: 325921 - protein, 9 aa, Homo Sapiens
VPLPPWSTS

SEQ ID NO: 325922 - protein, 9 aa, Homo Sapiens
SAQGEPTEP

SEQ ID NO: 325923 - protein, 9 aa, Homo Sapiens
AVSNVIQQL

SEQ ID NO: 325924 - protein, 9 aa, Homo Sapiens
RQQSSCQPA

SEQ ID NO: 325925 - protein, 9 aa, Homo Sapiens
EDLNHIQNK

SEQ ID NO: 325926 - protein, 9 aa, Homo Sapiens
PSEAPNLKS

SEQ ID NO: 325927 - protein, 9 aa, Homo Sapiens
APPKAPIHV

SEQ ID NO: 325928 - protein, 9 aa, Homo Sapiens
TGLMFLCSM

SEQ ID NO: 325929 - protein, 9 aa, Homo Sapiens
SREDMIDTK

SEQ ID NO: 325930 - protein, 9 aa, Homo Sapiens
CTSQIKEAR

SEQ ID NO: 325931 - protein, 9 aa, Homo Sapiens
KYASRSWKL

SEQ ID NO: 325932 - protein, 9 aa, Homo Sapiens
CRLAGMGLQ

SEQ ID NO: 325933 - protein, 9 aa, Homo Sapiens
SGLSPMEGT

SEQ ID NO: 325934 - protein, 9 aa, Homo Sapiens
FQISTFLDM

SEQ ID NO: 325935 - protein, 9 aa, Homo Sapiens
LHHSHLQQI

SEQ ID NO: 325936 - protein, 9 aa, Homo Sapiens
QQPVPYVVP

SEQ ID NO: 325937 - protein, 9 aa, Homo Sapiens
GQLLNRLAD

SEQ ID NO: 325938 - protein, 9 aa, Homo Sapiens
RCSDAWRDL

SEQ ID NO: 325939 - protein, 9 aa, Homo Sapiens
FRAEKERRP

SEQ ID NO: 325940 - protein, 9 aa, Homo Sapiens
AITWQKGEC

SEQ ID NO: 325941 - protein, 9 aa, Homo Sapiens
EILLWKGVQ

SEQ ID NO: 325942 - protein, 9 aa, Homo Sapiens
QQHQHQHQQ

SEQ ID NO: 325943 - protein, 9 aa, Homo Sapiens
KRHTLLHNA

SEQ ID NO: 325944 - protein, 9 aa, Homo Sapiens
VYWTDRATH

SEQ ID NO: 325945 - protein, 9 aa, Homo Sapiens
SLGTLESQW

SEQ ID NO: 325946 - protein, 9 aa, Homo Sapiens
DSPTTLYHF

SEQ ID NO: 325947 - protein, 9 aa, Homo Sapiens
QSPVSPIRS

SEQ ID NO: 325948 - protein, 9 aa, Homo Sapiens
LRIYVYIKR

SEQ ID NO: 325949 - protein, 9 aa, Homo Sapiens
IQADSFIQD

SEQ ID NO: 325950 - protein, 9 aa, Homo Sapiens
SLLLWGLLP

SEQ ID NO: 325951 - protein, 9 aa, Homo Sapiens
ADDPQPSRG

SEQ ID NO: 325952 - protein, 9 aa, Homo Sapiens
PWIYQAFLM

SEQ ID NO: 325953 - protein, 9 aa, Homo Sapiens
HVRPGSTMP

SEQ ID NO: 325954 - protein, 9 aa, Homo Sapiens
RFRDEPYFK

SEQ ID NO: 325955 - protein, 9 aa, Homo Sapiens
FRRFNLYED

SEQ ID NO: 325956 - protein, 9 aa, Homo Sapiens
GSWASLPKV

SEQ ID NO: 325957 - protein, 9 aa, Homo Sapiens
QQQHQHQHQ

SEQ ID NO: 325958 - protein, 9 aa, Homo Sapiens
SNIHGHTES

SEQ ID NO: 325959 - protein, 9 aa, Homo Sapiens
LMADAVVTF

SEQ ID NO: 325960 - protein, 9 aa, Homo Sapiens
TIWRQQWLL

SEQ ID NO: 325961 - protein, 9 aa, Homo Sapiens
SPTSPMTPN

SEQ ID NO: 325962 - protein, 9 aa, Homo Sapiens
SQLPWPAST

SEQ ID NO: 325963 - protein, 9 aa, Homo Sapiens
SEQSCQMSK

SEQ ID NO: 325964 - protein, 9 aa, Homo Sapiens
GGLEHLAVR

SEQ ID NO: 325965 - protein, 9 aa, Homo Sapiens
TVALLRAER

SEQ ID NO: 325966 - protein, 9 aa, Homo Sapiens
VGHQGAPML

SEQ ID NO: 325967 - protein, 9 aa, Homo Sapiens
VKDSVWDCV

SEQ ID NO: 325968 - protein, 9 aa, Homo Sapiens
KKISSIRSI

SEQ ID NO: 325969 - protein, 9 aa, Homo Sapiens
SYNHIRPGQ

SEQ ID NO: 325970 - protein, 9 aa, Homo Sapiens
LFLRTDRGT

SEQ ID NO: 325971 - protein, 9 aa, Homo Sapiens
EAAEHSRLR

SEQ ID NO: 325972 - protein, 9 aa, Homo Sapiens
DKYLGHAVL

SEQ ID NO: 325973 - protein, 9 aa, Homo Sapiens
PFTHEACPV

SEQ ID NO: 325974 - protein, 9 aa, Homo Sapiens
GTATQQNNW

SEQ ID NO: 325975 - protein, 9 aa, Homo Sapiens
QPPDRSAPS

SEQ ID NO: 325976 - protein, 9 aa, Homo Sapiens
ILVHLETDS

SEQ ID NO: 325977 - protein, 9 aa, Homo Sapiens
HREPPPGTE

SEQ ID NO: 325978 - protein, 9 aa, Homo Sapiens
LWKGVQLLL

SEQ ID NO: 325979 - protein, 9 aa, Homo Sapiens
EIADQVSWE

SEQ ID NO: 325980 - protein, 9 aa, Homo Sapiens
RARYEEIAQ

SEQ ID NO: 325981 - protein, 9 aa, Homo Sapiens
ELEIHLVMI

SEQ ID NO: 325982 - protein, 9 aa, Homo Sapiens
QFGHPVVVP

SEQ ID NO: 325983 - protein, 9 aa, Homo Sapiens
ELERLHAAL

SEQ ID NO: 325984 - protein, 9 aa, Homo Sapiens
LLTLGHALP

SEQ ID NO: 325985 - protein, 9 aa, Homo Sapiens
QREAECVEA

SEQ ID NO: 325986 - protein, 9 aa, Homo Sapiens
FAHTNCTLI

SEQ ID NO: 325987 - protein, 9 aa, Homo Sapiens
VLLRYQFSH

SEQ ID NO: 325988 - protein, 9 aa, Homo Sapiens
ASETRKWMG

SEQ ID NO: 325989 - protein, 9 aa, Homo Sapiens
YEQLLALCI

SEQ ID NO: 325990 - protein, 9 aa, Homo Sapiens
GLWVESVPG

SEQ ID NO: 325991 - protein, 9 aa, Homo Sapiens
LADGNLRFV

SEQ ID NO: 325992 - protein, 9 aa, Homo Sapiens
IRHTSMRGL

SEQ ID NO: 325993 - protein, 9 aa, Homo Sapiens
SLNCVDGSQ

SEQ ID NO: 325994 - protein, 9 aa, Homo Sapiens
PKSTRPGAG

SEQ ID NO: 325995 - protein, 9 aa, Homo Sapiens
FFYDEHTLW

SEQ ID NO: 325996 - protein, 9 aa, Homo Sapiens
LTIFTLSMA

SEQ ID NO: 325997 - protein, 9 aa, Homo Sapiens
QEPVLFTRS

SEQ ID NO: 325998 - protein, 9 aa, Homo Sapiens
EAGEANKSI

SEQ ID NO: 325999 - protein, 9 aa, Homo Sapiens
SVTLHLFSI

SEQ ID NO: 326000 - protein, 9 aa, Homo Sapiens
IGPSSHFRV

SEQ ID NO: 326001 - protein, 9 aa, Homo Sapiens
STVSRQGGA

SEQ ID NO: 326002 - protein, 9 aa, Homo Sapiens
GDLVLVGLG

SEQ ID NO: 326003 - protein, 9 aa, Homo Sapiens
TKPKTMAIQ

SEQ ID NO: 326004 - protein, 9 aa, Homo Sapiens
SGLYDETIR

SEQ ID NO: 326005 - protein, 9 aa, Homo Sapiens
LGLVRVPLH

SEQ ID NO: 326006 - protein, 9 aa, Homo Sapiens
LSPMAHVLI

SEQ ID NO: 326007 - protein, 9 aa, Homo Sapiens
FTAHLYYFQ

SEQ ID NO: 326008 - protein, 9 aa, Homo Sapiens
LPPSSWLQD

SEQ ID NO: 326009 - protein, 9 aa, Homo Sapiens
VRDLHSIVE

SEQ ID NO: 326010 - protein, 9 aa, Homo Sapiens
HIIIPSYVS

SEQ ID NO: 326011 - protein, 9 aa, Homo Sapiens
FPFWMGLSQ

SEQ ID NO: 326012 - protein, 9 aa, Homo Sapiens
KLCERLLAS

SEQ ID NO: 326013 - protein, 9 aa, Homo Sapiens
MFSIWELTI

SEQ ID NO: 326014 - protein, 9 aa, Homo Sapiens
KCSCCYGPL

SEQ ID NO: 326015 - protein, 9 aa, Homo Sapiens
LGAIMIPPI

SEQ ID NO: 326016 - protein, 9 aa, Homo Sapiens
AQGSCSPRT

SEQ ID NO: 326017 - protein, 9 aa, Homo Sapiens
NLTLVLTII

SEQ ID NO: 326018 - protein, 9 aa, Homo Sapiens
ANPGGSDSM

SEQ ID NO: 326019 - protein, 9 aa, Homo Sapiens
TLQREAECV

SEQ ID NO: 326020 - protein, 9 aa, Homo Sapiens
SESDQPNIY

SEQ ID NO: 326021 - protein, 9 aa, Homo Sapiens
RPAHCYRYC

SEQ ID NO: 326022 - protein, 9 aa, Homo Sapiens
SEHGRPNAE

SEQ ID NO: 326023 - protein, 9 aa, Homo Sapiens
EIGTCKETK

SEQ ID NO: 326024 - protein, 9 aa, Homo Sapiens
MFASSSKCG

SEQ ID NO: 326025 - protein, 9 aa, Homo Sapiens
LSNLTDEEG

SEQ ID NO: 326026 - protein, 9 aa, Homo Sapiens
TLESQWGVQ

SEQ ID NO: 326027 - protein, 9 aa, Homo Sapiens
VTCLCTQVL

SEQ ID NO: 326028 - protein, 9 aa, Homo Sapiens
VEEFYTRHV

SEQ ID NO: 326029 - protein, 9 aa, Homo Sapiens
PSQVPLIIQ

SEQ ID NO: 326030 - protein, 9 aa, Homo Sapiens
AAAEDGPPV

SEQ ID NO: 326031 - protein, 9 aa, Homo Sapiens
LTRWKPLQT

SEQ ID NO: 326032 - protein, 9 aa, Homo Sapiens
GDNLQKSTD

SEQ ID NO: 326033 - protein, 9 aa, Homo Sapiens
LYAEAEEMQ

SEQ ID NO: 326034 - protein, 9 aa, Homo Sapiens
CYRLHLEGY

SEQ ID NO: 326035 - protein, 9 aa, Homo Sapiens
SLFPQNSNV

SEQ ID NO: 326036 - protein, 9 aa, Homo Sapiens
DYKCQPRRR

SEQ ID NO: 326037 - protein, 9 aa, Homo Sapiens
HLARDVMKE

SEQ ID NO: 326038 - protein, 9 aa, Homo Sapiens
RPLGSWQEQ

SEQ ID NO: 326039 - protein, 9 aa, Homo Sapiens
SHHHRHHRC

SEQ ID NO: 326040 - protein, 9 aa, Homo Sapiens
SDAWRDLEL

SEQ ID NO: 326041 - protein, 9 aa, Homo Sapiens
GTPSRHETS

SEQ ID NO: 326042 - protein, 9 aa, Homo Sapiens
GTRRKPYNL

SEQ ID NO: 326043 - protein, 9 aa, Homo Sapiens
TYPAWVRVS

SEQ ID NO: 326044 - protein, 9 aa, Homo Sapiens
ISPERRCCS

SEQ ID NO: 326045 - protein, 9 aa, Homo Sapiens
LTPRCTLDF

SEQ ID NO: 326046 - protein, 9 aa, Homo Sapiens
PNAEGDASS

SEQ ID NO: 326047 - protein, 9 aa, Homo Sapiens
KVLKVARVE

SEQ ID NO: 326048 - protein, 9 aa, Homo Sapiens
KAKPSPWLT

SEQ ID NO: 326049 - protein, 9 aa, Homo Sapiens
RHVRHHTGK

SEQ ID NO: 326050 - protein, 9 aa, Homo Sapiens
VWSSRCSDR

SEQ ID NO: 326051 - protein, 9 aa, Homo Sapiens
IKRLWTHLP

SEQ ID NO: 326052 - protein, 9 aa, Homo Sapiens
NGAGWPCPA

SEQ ID NO: 326053 - protein, 9 aa, Homo Sapiens
ILVSLPTLA

SEQ ID NO: 326054 - protein, 9 aa, Homo Sapiens
QQQQRPQSP

SEQ ID NO: 326055 - protein, 9 aa, Homo Sapiens
DVEAHQSWR

SEQ ID NO: 326056 - protein, 9 aa, Homo Sapiens
TSVQSVAIV

SEQ ID NO: 326057 - protein, 9 aa, Homo Sapiens
VGVLVSLPQ

SEQ ID NO: 326058 - protein, 9 aa, Homo Sapiens
MVCCAPSVA

SEQ ID NO: 326059 - protein, 9 aa, Homo Sapiens
IQTTSTQYT

SEQ ID NO: 326060 - protein, 9 aa, Homo Sapiens
KEEEARRIA

SEQ ID NO: 326061 - protein, 9 aa, Homo Sapiens
GPPVFGEGP

SEQ ID NO: 326062 - protein, 9 aa, Homo Sapiens
KRLEDLWRR

SEQ ID NO: 326063 - protein, 9 aa, Homo Sapiens
RSWKLILAQ

SEQ ID NO: 326064 - protein, 9 aa, Homo Sapiens
GGLWARKLE

SEQ ID NO: 326065 - protein, 9 aa, Homo Sapiens
NHYGGHLCL

SEQ ID NO: 326066 - protein, 9 aa, Homo Sapiens
VEVEVYRWD

SEQ ID NO: 326067 - protein, 9 aa, Homo Sapiens
GAKSRSKRK

SEQ ID NO: 326068 - protein, 9 aa, Homo Sapiens
SDEPWMLGN

SEQ ID NO: 326069 - protein, 9 aa, Homo Sapiens
FPCPVCGHV

SEQ ID NO: 326070 - protein, 9 aa, Homo Sapiens
LASIYFGAL

SEQ ID NO: 326071 - protein, 9 aa, Homo Sapiens
FKEKELDRN

SEQ ID NO: 326072 - protein, 9 aa, Homo Sapiens
NQRLSHPGH

SEQ ID NO: 326073 - protein, 9 aa, Homo Sapiens
YGQVLKFGA

SEQ ID NO: 326074 - protein, 9 aa, Homo Sapiens
RHSFPMNGT

SEQ ID NO: 326075 - protein, 9 aa, Homo Sapiens
MRLANGGAT

SEQ ID NO: 326076 - protein, 9 aa, Homo Sapiens
CTFIQTTST

SEQ ID NO: 326077 - protein, 9 aa, Homo Sapiens
AGTGKTSML

SEQ ID NO: 326078 - protein, 9 aa, Homo Sapiens
EKKISSIRS

SEQ ID NO: 326079 - protein, 9 aa, Homo Sapiens
SKFLFLVSL

SEQ ID NO: 326080 - protein, 9 aa, Homo Sapiens
GSLYVTSQG

SEQ ID NO: 326081 - protein, 9 aa, Homo Sapiens
FSYNLPLEL

SEQ ID NO: 326082 - protein, 9 aa, Homo Sapiens
KIGPSSHFR

SEQ ID NO: 326083 - protein, 9 aa, Homo Sapiens
NNEITSSTI

SEQ ID NO: 326084 - protein, 9 aa, Homo Sapiens
LVGVYLPCL

SEQ ID NO: 326085 - protein, 9 aa, Homo Sapiens
LCGKIVALD

SEQ ID NO: 326086 - protein, 9 aa, Homo Sapiens
ERPEWIHMD

SEQ ID NO: 326087 - protein, 9 aa, Homo Sapiens
AVLIHDEND

SEQ ID NO: 326088 - protein, 9 aa, Homo Sapiens
GKQNSKLQP

SEQ ID NO: 326089 - protein, 9 aa, Homo Sapiens
PERRCCSVE

SEQ ID NO: 326090 - protein, 9 aa, Homo Sapiens
SPMPGSLPD

SEQ ID NO: 326091 - protein, 9 aa, Homo Sapiens
GECILASGS

SEQ ID NO: 326092 - protein, 9 aa, Homo Sapiens
AESSENSCT

SEQ ID NO: 326093 - protein, 9 aa, Homo Sapiens
IIMLFKNFM

SEQ ID NO: 326094 - protein, 9 aa, Homo Sapiens
SDTHQCRRL

SEQ ID NO: 326095 - protein, 9 aa, Homo Sapiens
IGRLYGPFL

SEQ ID NO: 326096 - protein, 9 aa, Homo Sapiens
PMSHVRLWA

SEQ ID NO: 326097 - protein, 9 aa, Homo Sapiens
WRVLISGTP

SEQ ID NO: 326098 - protein, 9 aa, Homo Sapiens
TVTLGVDVN

SEQ ID NO: 326099 - protein, 9 aa, Homo Sapiens
CSPTNPTSV

SEQ ID NO: 326100 - protein, 9 aa, Homo Sapiens
TLSKTRNIL

SEQ ID NO: 326101 - protein, 9 aa, Homo Sapiens
RRPAHCYRY

SEQ ID NO: 326102 - protein, 9 aa, Homo Sapiens
IIHKCEPSK

SEQ ID NO: 326103 - protein, 9 aa, Homo Sapiens
PAPPPWRHG

SEQ ID NO: 326104 - protein, 9 aa, Homo Sapiens
GDVNSRGYP

SEQ ID NO: 326105 - protein, 9 aa, Homo Sapiens
VFINPLVFF

SEQ ID NO: 326106 - protein, 9 aa, Homo Sapiens
IAVPLRAGV

SEQ ID NO: 326107 - protein, 9 aa, Homo Sapiens
STYYNWWRK

SEQ ID NO: 326108 - protein, 9 aa, Homo Sapiens
QDVSLHSQR

SEQ ID NO: 326109 - protein, 9 aa, Homo Sapiens
SLGETAECL

SEQ ID NO: 326110 - protein, 9 aa, Homo Sapiens
VLNLATEFQ

SEQ ID NO: 326111 - protein, 9 aa, Homo Sapiens
HTCEGCKGF

SEQ ID NO: 326112 - protein, 9 aa, Homo Sapiens
KPDSARVCY

SEQ ID NO: 326113 - protein, 9 aa, Homo Sapiens
QHELQHPII

SEQ ID NO: 326114 - protein, 9 aa, Homo Sapiens
IVHRDLKTK

SEQ ID NO: 326115 - protein, 9 aa, Homo Sapiens
NCAGICACT

SEQ ID NO: 326116 - protein, 9 aa, Homo Sapiens
TKFQQIVCG

SEQ ID NO: 326117 - protein, 9 aa, Homo Sapiens
GLGKWLVGT

SEQ ID NO: 326118 - protein, 9 aa, Homo Sapiens
GESPWQVMA

SEQ ID NO: 326119 - protein, 9 aa, Homo Sapiens
CQYRRPAKL

SEQ ID NO: 326120 - protein, 9 aa, Homo Sapiens
NMKSKACEK

SEQ ID NO: 326121 - protein, 9 aa, Homo Sapiens
QFRHLADGK

SEQ ID NO: 326122 - protein, 9 aa, Homo Sapiens
GRCGKKGAA

SEQ ID NO: 326123 - protein, 9 aa, Homo Sapiens
RQWLPLQVR

SEQ ID NO: 326124 - protein, 9 aa, Homo Sapiens
PEGLAQSKL

SEQ ID NO: 326125 - protein, 9 aa, Homo Sapiens
NLPGSLYVT

SEQ ID NO: 326126 - protein, 9 aa, Homo Sapiens
EAKKSPKGK

SEQ ID NO: 326127 - protein, 9 aa, Homo Sapiens
FLFFCQKSI

SEQ ID NO: 326128 - protein, 9 aa, Homo Sapiens
MQGRRYHSV

SEQ ID NO: 326129 - protein, 9 aa, Homo Sapiens
VLFHNLPSI

SEQ ID NO: 326130 - protein, 9 aa, Homo Sapiens
SRIKTSQAN

SEQ ID NO: 326131 - protein, 9 aa, Homo Sapiens
FLGGWQEVV

SEQ ID NO: 326132 - protein, 9 aa, Homo Sapiens
SVSWSFQSE

SEQ ID NO: 326133 - protein, 9 aa, Homo Sapiens
AQVYFEEAL

SEQ ID NO: 326134 - protein, 9 aa, Homo Sapiens
QVFSQMTHV

SEQ ID NO: 326135 - protein, 9 aa, Homo Sapiens
TLKVGKQQI

SEQ ID NO: 326136 - protein, 9 aa, Homo Sapiens
VMFLCATEW

SEQ ID NO: 326137 - protein, 9 aa, Homo Sapiens
LKKSVPSVA

SEQ ID NO: 326138 - protein, 9 aa, Homo Sapiens
PSRGDDLGA

SEQ ID NO: 326139 - protein, 9 aa, Homo Sapiens
SWWTFRCPG

SEQ ID NO: 326140 - protein, 9 aa, Homo Sapiens
ITGIVILSM

SEQ ID NO: 326141 - protein, 9 aa, Homo Sapiens
PEEKDLWSS

SEQ ID NO: 326142 - protein, 9 aa, Homo Sapiens
GWKPTMKWS

SEQ ID NO: 326143 - protein, 9 aa, Homo Sapiens
LVCFLFFCQ

SEQ ID NO: 326144 - protein, 9 aa, Homo Sapiens
SVCGQDIFI

SEQ ID NO: 326145 - protein, 9 aa, Homo Sapiens
CQMSKLRLL

SEQ ID NO: 326146 - protein, 9 aa, Homo Sapiens
NANIDNAGI

SEQ ID NO: 326147 - protein, 9 aa, Homo Sapiens
KSPTSPMTP

SEQ ID NO: 326148 - protein, 9 aa, Homo Sapiens
LPRGPPAHP

SEQ ID NO: 326149 - protein, 9 aa, Homo Sapiens
ALQPHCLGQ

SEQ ID NO: 326150 - protein, 9 aa, Homo Sapiens
TTSSCRGAR

SEQ ID NO: 326151 - protein, 9 aa, Homo Sapiens
DMKDFWPLR

SEQ ID NO: 326152 - protein, 9 aa, Homo Sapiens
ADFRHSFPM

SEQ ID NO: 326153 - protein, 9 aa, Homo Sapiens
AGRKRHTLL

SEQ ID NO: 326154 - protein, 9 aa, Homo Sapiens
ESLKLMSAS

SEQ ID NO: 326155 - protein, 9 aa, Homo Sapiens
TQNRKMSNK

SEQ ID NO: 326156 - protein, 9 aa, Homo Sapiens
LDSLETAAK

SEQ ID NO: 326157 - protein, 9 aa, Homo Sapiens
GGYYQITGW

SEQ ID NO: 326158 - protein, 9 aa, Homo Sapiens
HAGQTINDQ

SEQ ID NO: 326159 - protein, 9 aa, Homo Sapiens
LEQLADGNL

SEQ ID NO: 326160 - protein, 9 aa, Homo Sapiens
ASDYNQALG

SEQ ID NO: 326161 - protein, 9 aa, Homo Sapiens
DWSLLSSLV

SEQ ID NO: 326162 - protein, 9 aa, Homo Sapiens
SGAERETAV

SEQ ID NO: 326163 - protein, 9 aa, Homo Sapiens
SWMSLHLFH

SEQ ID NO: 326164 - protein, 9 aa, Homo Sapiens
SSSRHHHRH

SEQ ID NO: 326165 - protein, 9 aa, Homo Sapiens
EDVEKRNEA

SEQ ID NO: 326166 - protein, 9 aa, Homo Sapiens
YYSSYFGIF

SEQ ID NO: 326167 - protein, 9 aa, Homo Sapiens
FDVDTPPAW

SEQ ID NO: 326168 - protein, 9 aa, Homo Sapiens
RRLSVLNAS

SEQ ID NO: 326169 - protein, 9 aa, Homo Sapiens
EGPEATNVV

SEQ ID NO: 326170 - protein, 9 aa, Homo Sapiens
FFRQIISAV

SEQ ID NO: 326171 - protein, 9 aa, Homo Sapiens
PEIYPPNVE

SEQ ID NO: 326172 - protein, 9 aa, Homo Sapiens
VEIGTCKET

SEQ ID NO: 326173 - protein, 9 aa, Homo Sapiens
IKRRQRAED

SEQ ID NO: 326174 - protein, 9 aa, Homo Sapiens
AGVSPSTLP

SEQ ID NO: 326175 - protein, 9 aa, Homo Sapiens
MWWNKRKGS

SEQ ID NO: 326176 - protein, 9 aa, Homo Sapiens
STIKMVQYR

SEQ ID NO: 326177 - protein, 9 aa, Homo Sapiens
VTEDKSSSN

SEQ ID NO: 326178 - protein, 9 aa, Homo Sapiens
PTFSYRPDG

SEQ ID NO: 326179 - protein, 9 aa, Homo Sapiens
TTVDDWLST

SEQ ID NO: 326180 - protein, 9 aa, Homo Sapiens
CVMFLCATE

SEQ ID NO: 326181 - protein, 9 aa, Homo Sapiens
FEMLEGNTI

SEQ ID NO: 326182 - protein, 9 aa, Homo Sapiens
IRRRPHVRV

SEQ ID NO: 326183 - protein, 9 aa, Homo Sapiens
KEISSLWNE

SEQ ID NO: 326184 - protein, 9 aa, Homo Sapiens
LMGLSDSEE

SEQ ID NO: 326185 - protein, 9 aa, Homo Sapiens
VTLHLFSID

SEQ ID NO: 326186 - protein, 9 aa, Homo Sapiens
PQQQGHMGI

SEQ ID NO: 326187 - protein, 9 aa, Homo Sapiens
SGLCSNKKK

SEQ ID NO: 326188 - protein, 9 aa, Homo Sapiens
ETAECLIQS

SEQ ID NO: 326189 - protein, 9 aa, Homo Sapiens
QPFDKRLHF

SEQ ID NO: 326190 - protein, 9 aa, Homo Sapiens
NKNDGLKSK

SEQ ID NO: 326191 - protein, 9 aa, Homo Sapiens
PDRAVDGNW

SEQ ID NO: 326192 - protein, 9 aa, Homo Sapiens
FLRDYNVTL

SEQ ID NO: 326193 - protein, 9 aa, Homo Sapiens
QCQIHAKDN

SEQ ID NO: 326194 - protein, 9 aa, Homo Sapiens
GNWTNYNTF

SEQ ID NO: 326195 - protein, 9 aa, Homo Sapiens
SLDMQPKKV

SEQ ID NO: 326196 - protein, 9 aa, Homo Sapiens
QCFFQQDTL

SEQ ID NO: 326197 - protein, 9 aa, Homo Sapiens
PHEVRDFAI

SEQ ID NO: 326198 - protein, 9 aa, Homo Sapiens
EFFPMSHVR

SEQ ID NO: 326199 - protein, 9 aa, Homo Sapiens
YVSWFDYNC

SEQ ID NO: 326200 - protein, 9 aa, Homo Sapiens
GGAPVPWSQ

SEQ ID NO: 326201 - protein, 9 aa, Homo Sapiens
DPFTHEACP

SEQ ID NO: 326202 - protein, 9 aa, Homo Sapiens
TISGLFPGV

SEQ ID NO: 326203 - protein, 9 aa, Homo Sapiens
SDAPEEICD

SEQ ID NO: 326204 - protein, 9 aa, Homo Sapiens
TEHLARDVM

SEQ ID NO: 326205 - protein, 9 aa, Homo Sapiens
VEKRNEALE

SEQ ID NO: 326206 - protein, 9 aa, Homo Sapiens
AFSAMRVRG

SEQ ID NO: 326207 - protein, 9 aa, Homo Sapiens
TKCPHCKKI

SEQ ID NO: 326208 - protein, 9 aa, Homo Sapiens
KEVIEQEAP

SEQ ID NO: 326209 - protein, 9 aa, Homo Sapiens
SWEYGGEGT

SEQ ID NO: 326210 - protein, 9 aa, Homo Sapiens
TLFREQSKG

SEQ ID NO: 326211 - protein, 9 aa, Homo Sapiens
PCASKVATK

SEQ ID NO: 326212 - protein, 9 aa, Homo Sapiens
QWESREWKK

SEQ ID NO: 326213 - protein, 9 aa, Homo Sapiens
ELEAIAIYK

SEQ ID NO: 326214 - protein, 9 aa, Homo Sapiens
NPQLARRPH

SEQ ID NO: 326215 - protein, 9 aa, Homo Sapiens
RGRHWGTPW

SEQ ID NO: 326216 - protein, 9 aa, Homo Sapiens
CCSRIMHMQ

SEQ ID NO: 326217 - protein, 9 aa, Homo Sapiens
NSGTKPKTM

SEQ ID NO: 326218 - protein, 9 aa, Homo Sapiens
LSISSDSTH

SEQ ID NO: 326219 - protein, 9 aa, Homo Sapiens
TLSSYSLDE

SEQ ID NO: 326220 - protein, 9 aa, Homo Sapiens
AEIKKWMGP

SEQ ID NO: 326221 - protein, 9 aa, Homo Sapiens
ESSESPSGN

SEQ ID NO: 326222 - protein, 9 aa, Homo Sapiens
WHWREADRP

SEQ ID NO: 326223 - protein, 9 aa, Homo Sapiens
KNLLLDGNM

SEQ ID NO: 326224 - protein, 9 aa, Homo Sapiens
PCAPLPPPP

SEQ ID NO: 326225 - protein, 9 aa, Homo Sapiens
KFRPGPQWC

SEQ ID NO: 326226 - protein, 9 aa, Homo Sapiens
QWLPLQVRS

SEQ ID NO: 326227 - protein, 9 aa, Homo Sapiens
PTHQDALQK

SEQ ID NO: 326228 - protein, 9 aa, Homo Sapiens
AEPEAAGWG

SEQ ID NO: 326229 - protein, 9 aa, Homo Sapiens
CVLVDTGCP

SEQ ID NO: 326230 - protein, 9 aa, Homo Sapiens
MCKESVNRQ

SEQ ID NO: 326231 - protein, 9 aa, Homo Sapiens
NKLYVAMVG

SEQ ID NO: 326232 - protein, 9 aa, Homo Sapiens
SWPNESPRN

SEQ ID NO: 326233 - protein, 9 aa, Homo Sapiens
WQWKPQLGF

SEQ ID NO: 326234 - protein, 9 aa, Homo Sapiens
RAAHRCCNK

SEQ ID NO: 326235 - protein, 9 aa, Homo Sapiens
DSSLQVENE

SEQ ID NO: 326236 - protein, 9 aa, Homo Sapiens
WRVVFIAFL

SEQ ID NO: 326237 - protein, 9 aa, Homo Sapiens
LLIAFGAAI

SEQ ID NO: 326238 - protein, 9 aa, Homo Sapiens
GEIRVPLHR

SEQ ID NO: 326239 - protein, 9 aa, Homo Sapiens
EEEEAEEER

SEQ ID NO: 326240 - protein, 9 aa, Homo Sapiens
QRASDYNQA

SEQ ID NO: 326241 - protein, 9 aa, Homo Sapiens
LRTHQVSLH

SEQ ID NO: 326242 - protein, 9 aa, Homo Sapiens
LQCNVISSS

SEQ ID NO: 326243 - protein, 9 aa, Homo Sapiens
IRGLNASTC

SEQ ID NO: 326244 - protein, 9 aa, Homo Sapiens
LFSNVPIML

SEQ ID NO: 326245 - protein, 9 aa, Homo Sapiens
DYQQVVKRL

SEQ ID NO: 326246 - protein, 9 aa, Homo Sapiens
KDKGEWDFY

SEQ ID NO: 326247 - protein, 9 aa, Homo Sapiens
EALSLDWSS

SEQ ID NO: 326248 - protein, 9 aa, Homo Sapiens
EDVPLDHHV

SEQ ID NO: 326249 - protein, 9 aa, Homo Sapiens
DWTKAVFSL

SEQ ID NO: 326250 - protein, 9 aa, Homo Sapiens
DLRDDSCLR

SEQ ID NO: 326251 - protein, 9 aa, Homo Sapiens
PGLPNASSN

SEQ ID NO: 326252 - protein, 9 aa, Homo Sapiens
VDNELCICA

SEQ ID NO: 326253 - protein, 9 aa, Homo Sapiens
DMHKQRGKA

SEQ ID NO: 326254 - protein, 9 aa, Homo Sapiens
MCRHKKPEA

SEQ ID NO: 326255 - protein, 9 aa, Homo Sapiens
ARLVSLQLL

SEQ ID NO: 326256 - protein, 9 aa, Homo Sapiens
TLMLCENDS

SEQ ID NO: 326257 - protein, 9 aa, Homo Sapiens
KCEAALRGE

SEQ ID NO: 326258 - protein, 9 aa, Homo Sapiens
GCKVGLIAA

SEQ ID NO: 326259 - protein, 9 aa, Homo Sapiens
QVQSNPDPV

SEQ ID NO: 326260 - protein, 9 aa, Homo Sapiens
HSMEWRPAE

SEQ ID NO: 326261 - protein, 9 aa, Homo Sapiens
PCPLIKYCW

SEQ ID NO: 326262 - protein, 9 aa, Homo Sapiens
IFALPHFIS

SEQ ID NO: 326263 - protein, 9 aa, Homo Sapiens
SADEFANET

SEQ ID NO: 326264 - protein, 9 aa, Homo Sapiens
AQRSFTCTQ

SEQ ID NO: 326265 - protein, 9 aa, Homo Sapiens
EIYPPNVEC

SEQ ID NO: 326266 - protein, 9 aa, Homo Sapiens
IQEEDKGNV

SEQ ID NO: 326267 - protein, 9 aa, Homo Sapiens
LEPLQEHRI

SEQ ID NO: 326268 - protein, 9 aa, Homo Sapiens
PHSLRSNLP

SEQ ID NO: 326269 - protein, 9 aa, Homo Sapiens
HIGNKTECA

SEQ ID NO: 326270 - protein, 9 aa, Homo Sapiens
HPPQLHLLS

SEQ ID NO: 326271 - protein, 9 aa, Homo Sapiens
WRLWYGTRR

SEQ ID NO: 326272 - protein, 9 aa, Homo Sapiens
KSKASQQKA

SEQ ID NO: 326273 - protein, 9 aa, Homo Sapiens
PRRRWAPWN

SEQ ID NO: 326274 - protein, 9 aa, Homo Sapiens
ICACTNNGT

SEQ ID NO: 326275 - protein, 9 aa, Homo Sapiens
CILVMGNII

SEQ ID NO: 326276 - protein, 9 aa, Homo Sapiens
DAPEEICDA

SEQ ID NO: 326277 - protein, 9 aa, Homo Sapiens
ALVCLPGVI

SEQ ID NO: 326278 - protein, 9 aa, Homo Sapiens
KDPGRLPGR

SEQ ID NO: 326279 - protein, 9 aa, Homo Sapiens
KSLDGSVDK

SEQ ID NO: 326280 - protein, 9 aa, Homo Sapiens
ETLSTVQLT

SEQ ID NO: 326281 - protein, 9 aa, Homo Sapiens
TYHLAVVLG

SEQ ID NO: 326282 - protein, 9 aa, Homo Sapiens
GSKAAGAAR

SEQ ID NO: 326283 - protein, 9 aa, Homo Sapiens
DRQELQCNV

SEQ ID NO: 326284 - protein, 9 aa, Homo Sapiens
CSCSMVVSG

SEQ ID NO: 326285 - protein, 9 aa, Homo Sapiens
WGRALVNTA

SEQ ID NO: 326286 - protein, 9 aa, Homo Sapiens
EEARPPSED

SEQ ID NO: 326287 - protein, 9 aa, Homo Sapiens
GHREPPPGT

SEQ ID NO: 326288 - protein, 9 aa, Homo Sapiens
LILLTIFTL

SEQ ID NO: 326289 - protein, 9 aa, Homo Sapiens
ISPNGNDTS

SEQ ID NO: 326290 - protein, 9 aa, Homo Sapiens
DLYKGRVAL

SEQ ID NO: 326291 - protein, 9 aa, Homo Sapiens
ACVLCNKDP

SEQ ID NO: 326292 - protein, 9 aa, Homo Sapiens
AFPLFTHCS

SEQ ID NO: 326293 - protein, 9 aa, Homo Sapiens
LKKAYFQMR

SEQ ID NO: 326294 - protein, 9 aa, Homo Sapiens
TLLFLLGTT

SEQ ID NO: 326295 - protein, 9 aa, Homo Sapiens
VFLKAGRRA

SEQ ID NO: 326296 - protein, 9 aa, Homo Sapiens
DQDVSLHSQ

SEQ ID NO: 326297 - protein, 9 aa, Homo Sapiens
QGLSGCLAE

SEQ ID NO: 326298 - protein, 9 aa, Homo Sapiens
DKYDFTTYI

SEQ ID NO: 326299 - protein, 9 aa, Homo Sapiens
GIYPTSTQL

SEQ ID NO: 326300 - protein, 9 aa, Homo Sapiens
FDRYVVICH

SEQ ID NO: 326301 - protein, 9 aa, Homo Sapiens
QLFVIDNGT

SEQ ID NO: 326302 - protein, 9 aa, Homo Sapiens
PAGRQSRTF

SEQ ID NO: 326303 - protein, 9 aa, Homo Sapiens
IPSSSPTPL

SEQ ID NO: 326304 - protein, 9 aa, Homo Sapiens
YSINIGQLN

SEQ ID NO: 326305 - protein, 9 aa, Homo Sapiens
GCITNFDNF

SEQ ID NO: 326306 - protein, 9 aa, Homo Sapiens
HWIASPAHD

SEQ ID NO: 326307 - protein, 9 aa, Homo Sapiens
AATSLQILQ

SEQ ID NO: 326308 - protein, 9 aa, Homo Sapiens
CDVKLVKKS

SEQ ID NO: 326309 - protein, 9 aa, Homo Sapiens
AKWKGLPPP

SEQ ID NO: 326310 - protein, 9 aa, Homo Sapiens
HEQRRSLEW

SEQ ID NO: 326311 - protein, 9 aa, Homo Sapiens
IIDAHANEE

SEQ ID NO: 326312 - protein, 9 aa, Homo Sapiens
ATQQNNWPP

SEQ ID NO: 326313 - protein, 9 aa, Homo Sapiens
IIAIIALSP

SEQ ID NO: 326314 - protein, 9 aa, Homo Sapiens
MMSVHRGEA

SEQ ID NO: 326315 - protein, 9 aa, Homo Sapiens
TLSTVQLTA

SEQ ID NO: 326316 - protein, 9 aa, Homo Sapiens
SSWPVGQPQ

SEQ ID NO: 326317 - protein, 9 aa, Homo Sapiens
LTRERMMGE

SEQ ID NO: 326318 - protein, 9 aa, Homo Sapiens
NGTDDWRIA

SEQ ID NO: 326319 - protein, 9 aa, Homo Sapiens
WPSRFFMTP

SEQ ID NO: 326320 - protein, 9 aa, Homo Sapiens
ICRCLSEWL

SEQ ID NO: 326321 - protein, 9 aa, Homo Sapiens
QVGWKPTMK

SEQ ID NO: 326322 - protein, 9 aa, Homo Sapiens
QAKVQWILR

SEQ ID NO: 326323 - protein, 9 aa, Homo Sapiens
AQLDIDKDG

SEQ ID NO: 326324 - protein, 9 aa, Homo Sapiens
RIPNSDQKD

SEQ ID NO: 326325 - protein, 9 aa, Homo Sapiens
EKCEAALRG

SEQ ID NO: 326326 - protein, 9 aa, Homo Sapiens
QAASEDVDK

SEQ ID NO: 326327 - protein, 9 aa, Homo Sapiens
CLEVVSMYY

SEQ ID NO: 326328 - protein, 9 aa, Homo Sapiens
GIFLLAVFR

SEQ ID NO: 326329 - protein, 9 aa, Homo Sapiens
TERAKKRCT

SEQ ID NO: 326330 - protein, 9 aa, Homo Sapiens
RLCAPDLEY

SEQ ID NO: 326331 - protein, 9 aa, Homo Sapiens
KFRFYDEYC

SEQ ID NO: 326332 - protein, 9 aa, Homo Sapiens
KVAVLIHDE

SEQ ID NO: 326333 - protein, 9 aa, Homo Sapiens
TDAKAREAA

SEQ ID NO: 326334 - protein, 9 aa, Homo Sapiens
NLYLLMPPM

SEQ ID NO: 326335 - protein, 9 aa, Homo Sapiens
TWMFQSPRR

SEQ ID NO: 326336 - protein, 9 aa, Homo Sapiens
WFSADEQFF

SEQ ID NO: 326337 - protein, 9 aa, Homo Sapiens
IPLLLLLPP

SEQ ID NO: 326338 - protein, 9 aa, Homo Sapiens
RGRPRKLTV

SEQ ID NO: 326339 - protein, 9 aa, Homo Sapiens
ETKPCASKV

SEQ ID NO: 326340 - protein, 9 aa, Homo Sapiens
MYVYKVLKQ

SEQ ID NO: 326341 - protein, 9 aa, Homo Sapiens
FIGMESTGI

SEQ ID NO: 326342 - protein, 9 aa, Homo Sapiens
MVFPLADVS

SEQ ID NO: 326343 - protein, 9 aa, Homo Sapiens
HLRTHQVSL

SEQ ID NO: 326344 - protein, 9 aa, Homo Sapiens
LLQGVLDVP

SEQ ID NO: 326345 - protein, 9 aa, Homo Sapiens
LLCHLPWIY

SEQ ID NO: 326346 - protein, 9 aa, Homo Sapiens
PTAEDVTVP

SEQ ID NO: 326347 - protein, 9 aa, Homo Sapiens
QFIYVFTTH

SEQ ID NO: 326348 - protein, 9 aa, Homo Sapiens
GALTLLFLL

SEQ ID NO: 326349 - protein, 9 aa, Homo Sapiens
VRRFCCFGN

SEQ ID NO: 326350 - protein, 9 aa, Homo Sapiens
QLQHGVVVL

SEQ ID NO: 326351 - protein, 9 aa, Homo Sapiens
SPRDRGRIL

SEQ ID NO: 326352 - protein, 9 aa, Homo Sapiens
QLPWPASTC

SEQ ID NO: 326353 - protein, 9 aa, Homo Sapiens
DDWLSTIKM

SEQ ID NO: 326354 - protein, 9 aa, Homo Sapiens
KCEGDKVRL

SEQ ID NO: 326355 - protein, 9 aa, Homo Sapiens
IFTYLIGQE

SEQ ID NO: 326356 - protein, 9 aa, Homo Sapiens
CAARSQLPW

SEQ ID NO: 326357 - protein, 9 aa, Homo Sapiens
TTWLEGSCV

SEQ ID NO: 326358 - protein, 9 aa, Homo Sapiens
QLRLEEALS

SEQ ID NO: 326359 - protein, 9 aa, Homo Sapiens
VDSAAECYR

SEQ ID NO: 326360 - protein, 9 aa, Homo Sapiens
EEDDDDDDK

SEQ ID NO: 326361 - protein, 9 aa, Homo Sapiens
LVRCSPVKN

SEQ ID NO: 326362 - protein, 9 aa, Homo Sapiens
DAALILDQL

SEQ ID NO: 326363 - protein, 9 aa, Homo Sapiens
EEKIPKTDL

SEQ ID NO: 326364 - protein, 9 aa, Homo Sapiens
HHLMLEANE

SEQ ID NO: 326365 - protein, 9 aa, Homo Sapiens
QLPALRPLQ

SEQ ID NO: 326366 - protein, 9 aa, Homo Sapiens
TPLHLTTQH

SEQ ID NO: 326367 - protein, 9 aa, Homo Sapiens
GYGVWNTAI

SEQ ID NO: 326368 - protein, 9 aa, Homo Sapiens
QKVLLCCEA

SEQ ID NO: 326369 - protein, 9 aa, Homo Sapiens
HGGQLIVPI

SEQ ID NO: 326370 - protein, 9 aa, Homo Sapiens
TTQSSGSWA

SEQ ID NO: 326371 - protein, 9 aa, Homo Sapiens
LREEEVDTD

SEQ ID NO: 326372 - protein, 9 aa, Homo Sapiens
NLNCILILL

SEQ ID NO: 326373 - protein, 9 aa, Homo Sapiens
DLIITDSKL

SEQ ID NO: 326374 - protein, 9 aa, Homo Sapiens
EAWLTLAGL

SEQ ID NO: 326375 - protein, 9 aa, Homo Sapiens
DFYPSPSPP

SEQ ID NO: 326376 - protein, 9 aa, Homo Sapiens
WSSVETVCG

SEQ ID NO: 326377 - protein, 9 aa, Homo Sapiens
NTKAPGKPA

SEQ ID NO: 326378 - protein, 9 aa, Homo Sapiens
AAFGQKQWP

SEQ ID NO: 326379 - protein, 9 aa, Homo Sapiens
KCLEENNGM

SEQ ID NO: 326380 - protein, 9 aa, Homo Sapiens
QGKDQYYLR

SEQ ID NO: 326381 - protein, 9 aa, Homo Sapiens
MAEDSDPFA

SEQ ID NO: 326382 - protein, 9 aa, Homo Sapiens
CINFCKFSS

SEQ ID NO: 326383 - protein, 9 aa, Homo Sapiens
GMESTGIHE

SEQ ID NO: 326384 - protein, 9 aa, Homo Sapiens
GDKKGKDRY

SEQ ID NO: 326385 - protein, 9 aa, Homo Sapiens
KASPGWQQP

SEQ ID NO: 326386 - protein, 9 aa, Homo Sapiens
SKLVNEYVC

SEQ ID NO: 326387 - protein, 9 aa, Homo Sapiens
VSEHPCIEE

SEQ ID NO: 326388 - protein, 9 aa, Homo Sapiens
NLYEDCKDA

SEQ ID NO: 326389 - protein, 9 aa, Homo Sapiens
ELSRISREL

SEQ ID NO: 326390 - protein, 9 aa, Homo Sapiens
KALDFMWHQ

SEQ ID NO: 326391 - protein, 9 aa, Homo Sapiens
HIEKAYAQQ

SEQ ID NO: 326392 - protein, 9 aa, Homo Sapiens
AAQILMCHC

SEQ ID NO: 326393 - protein, 9 aa, Homo Sapiens
TRRKPYNLD

SEQ ID NO: 326394 - protein, 9 aa, Homo Sapiens
APSLMRPFL

SEQ ID NO: 326395 - protein, 9 aa, Homo Sapiens
ILCVDDQCH

SEQ ID NO: 326396 - protein, 9 aa, Homo Sapiens
IEFHYVYSH

SEQ ID NO: 326397 - protein, 9 aa, Homo Sapiens
AWDGVACMR

SEQ ID NO: 326398 - protein, 9 aa, Homo Sapiens
SYFGIFLLA

SEQ ID NO: 326399 - protein, 9 aa, Homo Sapiens
IVKNRQTVA

SEQ ID NO: 326400 - protein, 9 aa, Homo Sapiens
TGRHWLTWV

SEQ ID NO: 326401 - protein, 9 aa, Homo Sapiens
APKSPWHMH

SEQ ID NO: 326402 - protein, 9 aa, Homo Sapiens
AGAKSRSKR

SEQ ID NO: 326403 - protein, 9 aa, Homo Sapiens
DENKNTAFQ

SEQ ID NO: 326404 - protein, 9 aa, Homo Sapiens
KRKLRELTQ

SEQ ID NO: 326405 - protein, 9 aa, Homo Sapiens
HGCILVMGN

SEQ ID NO: 326406 - protein, 9 aa, Homo Sapiens
KRHLKCPVW

SEQ ID NO: 326407 - protein, 9 aa, Homo Sapiens
MWRRGHEPQ

SEQ ID NO: 326408 - protein, 9 aa, Homo Sapiens
QKARLAEPQ

SEQ ID NO: 326409 - protein, 9 aa, Homo Sapiens
YYHYYLHTS

SEQ ID NO: 326410 - protein, 9 aa, Homo Sapiens
RIMNTFNVM

SEQ ID NO: 326411 - protein, 9 aa, Homo Sapiens
RTLTGTPGT

SEQ ID NO: 326412 - protein, 9 aa, Homo Sapiens
LKGKVIPPP

SEQ ID NO: 326413 - protein, 9 aa, Homo Sapiens
SVLHERWSQ

SEQ ID NO: 326414 - protein, 9 aa, Homo Sapiens
TYLIGQEAA

SEQ ID NO: 326415 - protein, 9 aa, Homo Sapiens
HYYLHTSET

SEQ ID NO: 326416 - protein, 9 aa, Homo Sapiens
PVESDEMCP

SEQ ID NO: 326417 - protein, 9 aa, Homo Sapiens
CAGEEGSHS

SEQ ID NO: 326418 - protein, 9 aa, Homo Sapiens
NGPPIFTLN

SEQ ID NO: 326419 - protein, 9 aa, Homo Sapiens
AAKYHMASL

SEQ ID NO: 326420 - protein, 9 aa, Homo Sapiens
QFFVAIFTG

SEQ ID NO: 326421 - protein, 9 aa, Homo Sapiens
PVLTLSLVL

SEQ ID NO: 326422 - protein, 9 aa, Homo Sapiens
GSSKPTNGT

SEQ ID NO: 326423 - protein, 9 aa, Homo Sapiens
PEAAGWGSQ

SEQ ID NO: 326424 - protein, 9 aa, Homo Sapiens
EIHIVECRD

SEQ ID NO: 326425 - protein, 9 aa, Homo Sapiens
TGERKLTGV

SEQ ID NO: 326426 - protein, 9 aa, Homo Sapiens
HFKDKFRFY

SEQ ID NO: 326427 - protein, 9 aa, Homo Sapiens
FHNLLLVRP

SEQ ID NO: 326428 - protein, 9 aa, Homo Sapiens
HISGVGIDQ

SEQ ID NO: 326429 - protein, 9 aa, Homo Sapiens
GHMNVLELI

SEQ ID NO: 326430 - protein, 9 aa, Homo Sapiens
LRNKIVHFT

SEQ ID NO: 326431 - protein, 9 aa, Homo Sapiens
SSGDAQGMN

SEQ ID NO: 326432 - protein, 9 aa, Homo Sapiens
LQGLSGCLA

SEQ ID NO: 326433 - protein, 9 aa, Homo Sapiens
SGSWASLPK

SEQ ID NO: 326434 - protein, 9 aa, Homo Sapiens
GDQTTMITA

SEQ ID NO: 326435 - protein, 9 aa, Homo Sapiens
LDKEACEVC

SEQ ID NO: 326436 - protein, 9 aa, Homo Sapiens
MEQAIPLTR

SEQ ID NO: 326437 - protein, 9 aa, Homo Sapiens
DQEDAFAVN

SEQ ID NO: 326438 - protein, 9 aa, Homo Sapiens
ENSVLEVIA

SEQ ID NO: 326439 - protein, 9 aa, Homo Sapiens
VFRGMSISC

SEQ ID NO: 326440 - protein, 9 aa, Homo Sapiens
PHLAWEFMI

SEQ ID NO: 326441 - protein, 9 aa, Homo Sapiens
QSDTDIFPD

SEQ ID NO: 326442 - protein, 9 aa, Homo Sapiens
DASRNGIRL

SEQ ID NO: 326443 - protein, 9 aa, Homo Sapiens
WSLLSSLVS

SEQ ID NO: 326444 - protein, 9 aa, Homo Sapiens
SPMAHVLIG

SEQ ID NO: 326445 - protein, 9 aa, Homo Sapiens
PVLRSLAFP

SEQ ID NO: 326446 - protein, 9 aa, Homo Sapiens
PETFALSAQ

SEQ ID NO: 326447 - protein, 9 aa, Homo Sapiens
LVFLSLVLH

SEQ ID NO: 326448 - protein, 9 aa, Homo Sapiens
CFIAMLEMW

SEQ ID NO: 326449 - protein, 9 aa, Homo Sapiens
PHHEPPFHL

SEQ ID NO: 326450 - protein, 9 aa, Homo Sapiens
RLIHMSIMI

SEQ ID NO: 326451 - protein, 9 aa, Homo Sapiens
FPTVSVAPS

SEQ ID NO: 326452 - protein, 9 aa, Homo Sapiens
TTVTLTVAV

SEQ ID NO: 326453 - protein, 9 aa, Homo Sapiens
QLQEVQGQA

SEQ ID NO: 326454 - protein, 9 aa, Homo Sapiens
MMMFSGLQG

SEQ ID NO: 326455 - protein, 9 aa, Homo Sapiens
EAPGHRPRQ

SEQ ID NO: 326456 - protein, 9 aa, Homo Sapiens
LNDTAQFNQ

SEQ ID NO: 326457 - protein, 9 aa, Homo Sapiens
WLLEAGSLK

SEQ ID NO: 326458 - protein, 9 aa, Homo Sapiens
PLVPTGGCK

SEQ ID NO: 326459 - protein, 9 aa, Homo Sapiens
DAARGLKGH

SEQ ID NO: 326460 - protein, 9 aa, Homo Sapiens
CTLATLIGH

SEQ ID NO: 326461 - protein, 9 aa, Homo Sapiens
FQSPRRCLQ

SEQ ID NO: 326462 - protein, 9 aa, Homo Sapiens
WEKSHLTQH

SEQ ID NO: 326463 - protein, 9 aa, Homo Sapiens
GTTPPPPAA

SEQ ID NO: 326464 - protein, 9 aa, Homo Sapiens
LVFLKAGRR

SEQ ID NO: 326465 - protein, 9 aa, Homo Sapiens
KNRSSGPLS

SEQ ID NO: 326466 - protein, 9 aa, Homo Sapiens
AFGQKQWPS

SEQ ID NO: 326467 - protein, 9 aa, Homo Sapiens
QTNHCKRAV

SEQ ID NO: 326468 - protein, 9 aa, Homo Sapiens
KAKMPAKKT

SEQ ID NO: 326469 - protein, 9 aa, Homo Sapiens
RQPHRSFFE

SEQ ID NO: 326470 - protein, 9 aa, Homo Sapiens
KLWLHIEDI

SEQ ID NO: 326471 - protein, 9 aa, Homo Sapiens
HSPNFLQGL

SEQ ID NO: 326472 - protein, 9 aa, Homo Sapiens
MHARGVLKD

SEQ ID NO: 326473 - protein, 9 aa, Homo Sapiens
SLVSGNMEL

SEQ ID NO: 326474 - protein, 9 aa, Homo Sapiens
RPDVPQGLH

SEQ ID NO: 326475 - protein, 9 aa, Homo Sapiens
SDSMPSRTH

SEQ ID NO: 326476 - protein, 9 aa, Homo Sapiens
LDGSPIWKR

SEQ ID NO: 326477 - protein, 9 aa, Homo Sapiens
KIVPHVGKN

SEQ ID NO: 326478 - protein, 9 aa, Homo Sapiens
ADLIITDSK

SEQ ID NO: 326479 - protein, 9 aa, Homo Sapiens
DLHSIVEDY

SEQ ID NO: 326480 - protein, 9 aa, Homo Sapiens
TKGRFPIRR

SEQ ID NO: 326481 - protein, 9 aa, Homo Sapiens
QATGPTDIR

SEQ ID NO: 326482 - protein, 9 aa, Homo Sapiens
LQYPQTQLR

SEQ ID NO: 326483 - protein, 9 aa, Homo Sapiens
PKQFKNDLK

SEQ ID NO: 326484 - protein, 9 aa, Homo Sapiens
EGFTPPEDD

SEQ ID NO: 326485 - protein, 9 aa, Homo Sapiens
LKVARVEHE

SEQ ID NO: 326486 - protein, 9 aa, Homo Sapiens
SPWQVMASL

SEQ ID NO: 326487 - protein, 9 aa, Homo Sapiens
VLLNIDGID

SEQ ID NO: 326488 - protein, 9 aa, Homo Sapiens
VWDSKKHTG

SEQ ID NO: 326489 - protein, 9 aa, Homo Sapiens
YSPEDIVTV

SEQ ID NO: 326490 - protein, 9 aa, Homo Sapiens
RASFNHFDW

SEQ ID NO: 326491 - protein, 9 aa, Homo Sapiens
ELQAWHAGQ

SEQ ID NO: 326492 - protein, 9 aa, Homo Sapiens
QLHRTPRRR

SEQ ID NO: 326493 - protein, 9 aa, Homo Sapiens
HVEVSLDGV

SEQ ID NO: 326494 - protein, 9 aa, Homo Sapiens
WIKKLPFLC

SEQ ID NO: 326495 - protein, 9 aa, Homo Sapiens
GQRPMRKHL

SEQ ID NO: 326496 - protein, 9 aa, Homo Sapiens
APFSDTLRP

SEQ ID NO: 326497 - protein, 9 aa, Homo Sapiens
ELLTEHQLD

SEQ ID NO: 326498 - protein, 9 aa, Homo Sapiens
QHQGLPGRL

SEQ ID NO: 326499 - protein, 9 aa, Homo Sapiens
YLMWAHFGL

SEQ ID NO: 326500 - protein, 9 aa, Homo Sapiens
RKLTGVMKD

SEQ ID NO: 326501 - protein, 9 aa, Homo Sapiens
CSNVRCRRT

SEQ ID NO: 326502 - protein, 9 aa, Homo Sapiens
MYGQVLKFG

SEQ ID NO: 326503 - protein, 9 aa, Homo Sapiens
GGDLVLVGL

SEQ ID NO: 326504 - protein, 9 aa, Homo Sapiens
CVDDQCHGL

SEQ ID NO: 326505 - protein, 9 aa, Homo Sapiens
RCTLDFAPQ

SEQ ID NO: 326506 - protein, 9 aa, Homo Sapiens
SRRCSRDRA

SEQ ID NO: 326507 - protein, 9 aa, Homo Sapiens
NQADNCPRI

SEQ ID NO: 326508 - protein, 9 aa, Homo Sapiens
APPVALPSD

SEQ ID NO: 326509 - protein, 9 aa, Homo Sapiens
GLPGRLPPP

SEQ ID NO: 326510 - protein, 9 aa, Homo Sapiens
LIRYIDNQA

SEQ ID NO: 326511 - protein, 9 aa, Homo Sapiens
KRRMCSMVG

SEQ ID NO: 326512 - protein, 9 aa, Homo Sapiens
QGPAGLPLA

SEQ ID NO: 326513 - protein, 9 aa, Homo Sapiens
NSQMIREEL

SEQ ID NO: 326514 - protein, 9 aa, Homo Sapiens
SPLKPPWMD

SEQ ID NO: 326515 - protein, 9 aa, Homo Sapiens
SSLSSFMTS

SEQ ID NO: 326516 - protein, 9 aa, Homo Sapiens
CPDMKHFCK

SEQ ID NO: 326517 - protein, 9 aa, Homo Sapiens
HQFTCKSGA

SEQ ID NO: 326518 - protein, 9 aa, Homo Sapiens
EENNGMDKR

SEQ ID NO: 326519 - protein, 9 aa, Homo Sapiens
LQEYTSDGM

SEQ ID NO: 326520 - protein, 9 aa, Homo Sapiens
EGGTCEVRA

SEQ ID NO: 326521 - protein, 9 aa, Homo Sapiens
TSMLVKYAE

SEQ ID NO: 326522 - protein, 9 aa, Homo Sapiens
AADGSLDMQ

SEQ ID NO: 326523 - protein, 9 aa, Homo Sapiens
AAFVLAIFC

SEQ ID NO: 326524 - protein, 9 aa, Homo Sapiens
IICHMIDKR

SEQ ID NO: 326525 - protein, 9 aa, Homo Sapiens
VPHHEPPFH

SEQ ID NO: 326526 - protein, 9 aa, Homo Sapiens
TCASCLKEF

SEQ ID NO: 326527 - protein, 9 aa, Homo Sapiens
NGMDKRVTR

SEQ ID NO: 326528 - protein, 9 aa, Homo Sapiens
EELLKKCSL

SEQ ID NO: 326529 - protein, 9 aa, Homo Sapiens
HRTPRRRWA

SEQ ID NO: 326530 - protein, 9 aa, Homo Sapiens
IYKSRRLSV

SEQ ID NO: 326531 - protein, 9 aa, Homo Sapiens
GSPIWKRSA

SEQ ID NO: 326532 - protein, 9 aa, Homo Sapiens
GILASIYFG

SEQ ID NO: 326533 - protein, 9 aa, Homo Sapiens
LGQRQPHRS

SEQ ID NO: 326534 - protein, 9 aa, Homo Sapiens
VSMYYTLPR

SEQ ID NO: 326535 - protein, 9 aa, Homo Sapiens
CILKHATAT

SEQ ID NO: 326536 - protein, 9 aa, Homo Sapiens
DPIWEKFNT

SEQ ID NO: 326537 - protein, 9 aa, Homo Sapiens
LKQAVCKPL

SEQ ID NO: 326538 - protein, 9 aa, Homo Sapiens
YGMGKPEVG

SEQ ID NO: 326539 - protein, 9 aa, Homo Sapiens
WNERDEYIT

SEQ ID NO: 326540 - protein, 9 aa, Homo Sapiens
WRHGALPTS

SEQ ID NO: 326541 - protein, 9 aa, Homo Sapiens
LLRYQFSHP

SEQ ID NO: 326542 - protein, 9 aa, Homo Sapiens
VRLAVQKGT

SEQ ID NO: 326543 - protein, 9 aa, Homo Sapiens
SIMKSCWHW

SEQ ID NO: 326544 - protein, 9 aa, Homo Sapiens
HDVVICPDA

SEQ ID NO: 326545 - protein, 9 aa, Homo Sapiens
FKGDKALDC

SEQ ID NO: 326546 - protein, 9 aa, Homo Sapiens
QFPCQSSTH

SEQ ID NO: 326547 - protein, 9 aa, Homo Sapiens
EDAKRLCVM

SEQ ID NO: 326548 - protein, 9 aa, Homo Sapiens
ILEAPKRFR

SEQ ID NO: 326549 - protein, 9 aa, Homo Sapiens
LYWQLCWKL

SEQ ID NO: 326550 - protein, 9 aa, Homo Sapiens
FQSWPNPKD

SEQ ID NO: 326551 - protein, 9 aa, Homo Sapiens
NSMRSCRSV

SEQ ID NO: 326552 - protein, 9 aa, Homo Sapiens
PYHMFSIWE

SEQ ID NO: 326553 - protein, 9 aa, Homo Sapiens
VAFPLVVGN

SEQ ID NO: 326554 - protein, 9 aa, Homo Sapiens
GYWLNEDKV

SEQ ID NO: 326555 - protein, 9 aa, Homo Sapiens
CLARQKEVL

SEQ ID NO: 326556 - protein, 9 aa, Homo Sapiens
YIKRKTNVL

SEQ ID NO: 326557 - protein, 9 aa, Homo Sapiens
IKRFKLSLV

SEQ ID NO: 326558 - protein, 9 aa, Homo Sapiens
PTPMAQFSA

SEQ ID NO: 326559 - protein, 9 aa, Homo Sapiens
DVPIIAMET

SEQ ID NO: 326560 - protein, 9 aa, Homo Sapiens
SNGWQWKPQ

SEQ ID NO: 326561 - protein, 9 aa, Homo Sapiens
YLLMPPMLN

SEQ ID NO: 326562 - protein, 9 aa, Homo Sapiens
EGDKVRLAV

SEQ ID NO: 326563 - protein, 9 aa, Homo Sapiens
MIPPIPKAR

SEQ ID NO: 326564 - protein, 9 aa, Homo Sapiens
LGHALPSSL

SEQ ID NO: 326565 - protein, 9 aa, Homo Sapiens
KWKGLPPPL

SEQ ID NO: 326566 - protein, 9 aa, Homo Sapiens
DLKLLGSSD

SEQ ID NO: 326567 - protein, 9 aa, Homo Sapiens
DELETTGAI

SEQ ID NO: 326568 - protein, 9 aa, Homo Sapiens
QQQQHQHQH

SEQ ID NO: 326569 - protein, 9 aa, Homo Sapiens
LSLTMLENV

SEQ ID NO: 326570 - protein, 9 aa, Homo Sapiens
ESSENSCTE

SEQ ID NO: 326571 - protein, 9 aa, Homo Sapiens
AWGIILETV

SEQ ID NO: 326572 - protein, 9 aa, Homo Sapiens
FFIPTMHLS

SEQ ID NO: 326573 - protein, 9 aa, Homo Sapiens
TKQSPMLQR

SEQ ID NO: 326574 - protein, 9 aa, Homo Sapiens
SCRSCPALS

SEQ ID NO: 326575 - protein, 9 aa, Homo Sapiens
EHPKPDVAT

SEQ ID NO: 326576 - protein, 9 aa, Homo Sapiens
AQVQVSSSV

SEQ ID NO: 326577 - protein, 9 aa, Homo Sapiens
FRHSFPMNG

SEQ ID NO: 326578 - protein, 9 aa, Homo Sapiens
CLPYGRLTY

SEQ ID NO: 326579 - protein, 9 aa, Homo Sapiens
VEAELEYQR

SEQ ID NO: 326580 - protein, 9 aa, Homo Sapiens
SISSHSDMT

SEQ ID NO: 326581 - protein, 9 aa, Homo Sapiens
FTVSVTLHL

SEQ ID NO: 326582 - protein, 9 aa, Homo Sapiens
IHMSIMISV

SEQ ID NO: 326583 - protein, 9 aa, Homo Sapiens
FDVLRSVIF

SEQ ID NO: 326584 - protein, 9 aa, Homo Sapiens
TAKPEVSLV

SEQ ID NO: 326585 - protein, 9 aa, Homo Sapiens
SSHPLRVFA

SEQ ID NO: 326586 - protein, 9 aa, Homo Sapiens
SCCYGPLEC

SEQ ID NO: 326587 - protein, 9 aa, Homo Sapiens
STMPVNTNR

SEQ ID NO: 326588 - protein, 9 aa, Homo Sapiens
DHAAFLLST

SEQ ID NO: 326589 - protein, 9 aa, Homo Sapiens
QKQWPSRFF

SEQ ID NO: 326590 - protein, 9 aa, Homo Sapiens
APEVIFHQG

SEQ ID NO: 326591 - protein, 9 aa, Homo Sapiens
DHFASVHSI

SEQ ID NO: 326592 - protein, 9 aa, Homo Sapiens
RLTEKMVFP

SEQ ID NO: 326593 - protein, 9 aa, Homo Sapiens
EAPDGSHAS

SEQ ID NO: 326594 - protein, 9 aa, Homo Sapiens
SKPTNGTKV

SEQ ID NO: 326595 - protein, 9 aa, Homo Sapiens
HHHRHHRCP

SEQ ID NO: 326596 - protein, 9 aa, Homo Sapiens
PQKLVCIVS

SEQ ID NO: 326597 - protein, 9 aa, Homo Sapiens
MSDIHISQF

SEQ ID NO: 326598 - protein, 9 aa, Homo Sapiens
VQELEECLA

SEQ ID NO: 326599 - protein, 9 aa, Homo Sapiens
FNKKENTLV

SEQ ID NO: 326600 - protein, 9 aa, Homo Sapiens
NLNKEWQFH

SEQ ID NO: 326601 - protein, 9 aa, Homo Sapiens
EKVGGAKGT

SEQ ID NO: 326602 - protein, 9 aa, Homo Sapiens
TLVWYAPVP

SEQ ID NO: 326603 - protein, 9 aa, Homo Sapiens
EGSGVGGKR

SEQ ID NO: 326604 - protein, 9 aa, Homo Sapiens
IQSIKDKCS

SEQ ID NO: 326605 - protein, 9 aa, Homo Sapiens
FLKDLKDRQ

SEQ ID NO: 326606 - protein, 9 aa, Homo Sapiens
LEGDNLQKS

SEQ ID NO: 326607 - protein, 9 aa, Homo Sapiens
FSGYIETLQ

SEQ ID NO: 326608 - protein, 9 aa, Homo Sapiens
QSSTHNSHL

SEQ ID NO: 326609 - protein, 9 aa, Homo Sapiens
SMGTLVGVY

SEQ ID NO: 326610 - protein, 9 aa, Homo Sapiens
VVGNPDLQI

SEQ ID NO: 326611 - protein, 9 aa, Homo Sapiens
KVVKKKAYG

SEQ ID NO: 326612 - protein, 9 aa, Homo Sapiens
PWLTIFDEE

SEQ ID NO: 326613 - protein, 9 aa, Homo Sapiens
LVQGQGPER

SEQ ID NO: 326614 - protein, 9 aa, Homo Sapiens
YFVTTSAHG

SEQ ID NO: 326615 - protein, 9 aa, Homo Sapiens
RDWRKPTTI

SEQ ID NO: 326616 - protein, 9 aa, Homo Sapiens
SNVPIMLSA

SEQ ID NO: 326617 - protein, 9 aa, Homo Sapiens
KDIRLSTSL

SEQ ID NO: 326618 - protein, 9 aa, Homo Sapiens
LHVTALPRG

SEQ ID NO: 326619 - protein, 9 aa, Homo Sapiens
PLNGALHFD

SEQ ID NO: 326620 - protein, 9 aa, Homo Sapiens
RSWFAHGHP

SEQ ID NO: 326621 - protein, 9 aa, Homo Sapiens
SDFIRLGSC

SEQ ID NO: 326622 - protein, 9 aa, Homo Sapiens
SCYIYWTCE

SEQ ID NO: 326623 - protein, 9 aa, Homo Sapiens
CHEEGSQLA

SEQ ID NO: 326624 - protein, 9 aa, Homo Sapiens
ATREPDPAR

SEQ ID NO: 326625 - protein, 9 aa, Homo Sapiens
HHILFRYAG

SEQ ID NO: 326626 - protein, 9 aa, Homo Sapiens
PQLITIHKA

SEQ ID NO: 326627 - protein, 9 aa, Homo Sapiens
ETRKWMGTQ

SEQ ID NO: 326628 - protein, 9 aa, Homo Sapiens
APIVQCAMA

SEQ ID NO: 326629 - protein, 9 aa, Homo Sapiens
WHVYLEGLT

SEQ ID NO: 326630 - protein, 9 aa, Homo Sapiens
KYRVAKALH

SEQ ID NO: 326631 - protein, 9 aa, Homo Sapiens
VMEPKVDDK

SEQ ID NO: 326632 - protein, 9 aa, Homo Sapiens
AWDNGRQVT

SEQ ID NO: 326633 - protein, 9 aa, Homo Sapiens
LLTLSKTRN

SEQ ID NO: 326634 - protein, 9 aa, Homo Sapiens
NLMAAEVVV

SEQ ID NO: 326635 - protein, 9 aa, Homo Sapiens
NHFDWDHSG

SEQ ID NO: 326636 - protein, 9 aa, Homo Sapiens
RLLLSSSGD

SEQ ID NO: 326637 - protein, 9 aa, Homo Sapiens
KPWAQLPDC

SEQ ID NO: 326638 - protein, 9 aa, Homo Sapiens
YGYFHRSHN

SEQ ID NO: 326639 - protein, 9 aa, Homo Sapiens
EDGPPVFGE

SEQ ID NO: 326640 - protein, 9 aa, Homo Sapiens
QQVCALEKA

SEQ ID NO: 326641 - protein, 9 aa, Homo Sapiens
EAGVPWHDL

SEQ ID NO: 326642 - protein, 9 aa, Homo Sapiens
RLYGPFLPG

SEQ ID NO: 326643 - protein, 9 aa, Homo Sapiens
SSGIMIPKP

SEQ ID NO: 326644 - protein, 9 aa, Homo Sapiens
RKSPAMEQA

SEQ ID NO: 326645 - protein, 9 aa, Homo Sapiens
AVVTFLQLA

SEQ ID NO: 326646 - protein, 9 aa, Homo Sapiens
RPRPACHEH

SEQ ID NO: 326647 - protein, 9 aa, Homo Sapiens
CENPYYDSR

SEQ ID NO: 326648 - protein, 9 aa, Homo Sapiens
ITIGVILCR

SEQ ID NO: 326649 - protein, 9 aa, Homo Sapiens
NVYSMALVL

SEQ ID NO: 326650 - protein, 9 aa, Homo Sapiens
AAQFQGGGL

SEQ ID NO: 326651 - protein, 9 aa, Homo Sapiens
MKSQMGQVG

SEQ ID NO: 326652 - protein, 9 aa, Homo Sapiens
YPTLVQALP

SEQ ID NO: 326653 - protein, 9 aa, Homo Sapiens
PQFPCQSST

SEQ ID NO: 326654 - protein, 9 aa, Homo Sapiens
FIHTKLQKS

SEQ ID NO: 326655 - protein, 9 aa, Homo Sapiens
PLFTHCSGA

SEQ ID NO: 326656 - protein, 9 aa, Homo Sapiens
PRRCLQRSS

SEQ ID NO: 326657 - protein, 9 aa, Homo Sapiens
GSKIIVGDA

SEQ ID NO: 326658 - protein, 9 aa, Homo Sapiens
AMGLCFYLG

SEQ ID NO: 326659 - protein, 9 aa, Homo Sapiens
RVEHEETLS

SEQ ID NO: 326660 - protein, 9 aa, Homo Sapiens
NNDIASFLR

SEQ ID NO: 326661 - protein, 9 aa, Homo Sapiens
FLIDALQPH

SEQ ID NO: 326662 - protein, 9 aa, Homo Sapiens
QRTVTLGVD

SEQ ID NO: 326663 - protein, 9 aa, Homo Sapiens
TMITAILQS

SEQ ID NO: 326664 - protein, 9 aa, Homo Sapiens
NKNKEQRLC

SEQ ID NO: 326665 - protein, 9 aa, Homo Sapiens
AAMVNGSTG

SEQ ID NO: 326666 - protein, 9 aa, Homo Sapiens
AFTKVITKQ

SEQ ID NO: 326667 - protein, 9 aa, Homo Sapiens
ASLLLWGLL

SEQ ID NO: 326668 - protein, 9 aa, Homo Sapiens
IHTKLQKSS

SEQ ID NO: 326669 - protein, 9 aa, Homo Sapiens
VKNDTIKYF

SEQ ID NO: 326670 - protein, 9 aa, Homo Sapiens
GEYQCFACN

SEQ ID NO: 326671 - protein, 9 aa, Homo Sapiens
DMLHRLGIL

SEQ ID NO: 326672 - protein, 9 aa, Homo Sapiens
MAVGGQLGK

SEQ ID NO: 326673 - protein, 9 aa, Homo Sapiens
GRGWAPRGR

SEQ ID NO: 326674 - protein, 9 aa, Homo Sapiens
EGDYTYLQI

SEQ ID NO: 326675 - protein, 9 aa, Homo Sapiens
SPVPPSEHH

SEQ ID NO: 326676 - protein, 9 aa, Homo Sapiens
KMPAKKTRP

SEQ ID NO: 326677 - protein, 9 aa, Homo Sapiens
GCSFPPPVL

SEQ ID NO: 326678 - protein, 9 aa, Homo Sapiens
GPLRWCACP

SEQ ID NO: 326679 - protein, 9 aa, Homo Sapiens
IMDRTEHLA

SEQ ID NO: 326680 - protein, 9 aa, Homo Sapiens
RDRLLDTLQ

SEQ ID NO: 326681 - protein, 9 aa, Homo Sapiens
GASGNVATG

SEQ ID NO: 326682 - protein, 9 aa, Homo Sapiens
GQLEQLLLQ

SEQ ID NO: 326683 - protein, 9 aa, Homo Sapiens
DLVSSCRSC

SEQ ID NO: 326684 - protein, 9 aa, Homo Sapiens
KMSIPLLLL

SEQ ID NO: 326685 - protein, 9 aa, Homo Sapiens
LGKSKGQTH

SEQ ID NO: 326686 - protein, 9 aa, Homo Sapiens
GDLDVMFAS

SEQ ID NO: 326687 - protein, 9 aa, Homo Sapiens
DEEGGEGGV

SEQ ID NO: 326688 - protein, 9 aa, Homo Sapiens
IMDVIFLVD

SEQ ID NO: 326689 - protein, 9 aa, Homo Sapiens
TGSTLEWDN

SEQ ID NO: 326690 - protein, 9 aa, Homo Sapiens
NLFPTVSVA

SEQ ID NO: 326691 - protein, 9 aa, Homo Sapiens
TTLFLYSWD

SEQ ID NO: 326692 - protein, 9 aa, Homo Sapiens
AEPDVDACI

SEQ ID NO: 326693 - protein, 9 aa, Homo Sapiens
PTLAVYSHV

SEQ ID NO: 326694 - protein, 9 aa, Homo Sapiens
TVSVAPSAD

SEQ ID NO: 326695 - protein, 9 aa, Homo Sapiens
CDWSLLSSL

SEQ ID NO: 326696 - protein, 9 aa, Homo Sapiens
NELCICARD

SEQ ID NO: 326697 - protein, 9 aa, Homo Sapiens
HYPDITTGD

SEQ ID NO: 326698 - protein, 9 aa, Homo Sapiens
FYLLRTVHC

SEQ ID NO: 326699 - protein, 9 aa, Homo Sapiens
ILLWKGVQL

SEQ ID NO: 326700 - protein, 9 aa, Homo Sapiens
RPHDGASRS

SEQ ID NO: 326701 - protein, 9 aa, Homo Sapiens
KKEKQKKMK

SEQ ID NO: 326702 - protein, 9 aa, Homo Sapiens
YTYSTMVSP

SEQ ID NO: 326703 - protein, 9 aa, Homo Sapiens
PEILNTSGN

SEQ ID NO: 326704 - protein, 9 aa, Homo Sapiens
QTQNRKMSN

SEQ ID NO: 326705 - protein, 9 aa, Homo Sapiens
SQKHLRTHQ

SEQ ID NO: 326706 - protein, 9 aa, Homo Sapiens
MLFKNFMLN

SEQ ID NO: 326707 - protein, 9 aa, Homo Sapiens
WLEGDNLQK

SEQ ID NO: 326708 - protein, 9 aa, Homo Sapiens
APHAGYMYC

SEQ ID NO: 326709 - protein, 9 aa, Homo Sapiens
STFLRLAVH

SEQ ID NO: 326710 - protein, 9 aa, Homo Sapiens
ASGSFFAWD

SEQ ID NO: 326711 - protein, 9 aa, Homo Sapiens
VSSCRSCPA

SEQ ID NO: 326712 - protein, 9 aa, Homo Sapiens
PEGGTCEVR

SEQ ID NO: 326713 - protein, 9 aa, Homo Sapiens
QPLPDMVQD

SEQ ID NO: 326714 - protein, 9 aa, Homo Sapiens
QIVSTTCEL

SEQ ID NO: 326715 - protein, 9 aa, Homo Sapiens
TYHISGVGI

SEQ ID NO: 326716 - protein, 9 aa, Homo Sapiens
SLYLKDENS

SEQ ID NO: 326717 - protein, 9 aa, Homo Sapiens
SKNIRMMQV

SEQ ID NO: 326718 - protein, 9 aa, Homo Sapiens
RAYVRDLHS

SEQ ID NO: 326719 - protein, 9 aa, Homo Sapiens
CAVKNEGKY

SEQ ID NO: 326720 - protein, 9 aa, Homo Sapiens
LYAARKLTR

SEQ ID NO: 326721 - protein, 9 aa, Homo Sapiens
LRKINCSNN

SEQ ID NO: 326722 - protein, 9 aa, Homo Sapiens
WGKYGALTK

SEQ ID NO: 326723 - protein, 9 aa, Homo Sapiens
EKLFVTVCW

SEQ ID NO: 326724 - protein, 9 aa, Homo Sapiens
LSVFSQHFY

SEQ ID NO: 326725 - protein, 9 aa, Homo Sapiens
AVPPQPQRP

SEQ ID NO: 326726 - protein, 9 aa, Homo Sapiens
KGECILASG

SEQ ID NO: 326727 - protein, 9 aa, Homo Sapiens
PSPWLTIFD

SEQ ID NO: 326728 - protein, 9 aa, Homo Sapiens
LIHMSIMIS

SEQ ID NO: 326729 - protein, 9 aa, Homo Sapiens
IKCHRTKEE

SEQ ID NO: 326730 - protein, 9 aa, Homo Sapiens
ARGLKGHII

SEQ ID NO: 326731 - protein, 9 aa, Homo Sapiens
RVISDLDWV

SEQ ID NO: 326732 - protein, 9 aa, Homo Sapiens
EIHFKTCYQ

SEQ ID NO: 326733 - protein, 9 aa, Homo Sapiens
GRPGGFLGQ

SEQ ID NO: 326734 - protein, 9 aa, Homo Sapiens
TTTGKTNQK

SEQ ID NO: 326735 - protein, 9 aa, Homo Sapiens
VCCAPSVAN

SEQ ID NO: 326736 - protein, 9 aa, Homo Sapiens
AWISKPPGM

SEQ ID NO: 326737 - protein, 9 aa, Homo Sapiens
IAIKQFSRG

SEQ ID NO: 326738 - protein, 9 aa, Homo Sapiens
RRDYHSLRR

SEQ ID NO: 326739 - protein, 9 aa, Homo Sapiens
LLGAETSAA

SEQ ID NO: 326740 - protein, 9 aa, Homo Sapiens
VVGNERSSV

SEQ ID NO: 326741 - protein, 9 aa, Homo Sapiens
SQWPIQMVK

SEQ ID NO: 326742 - protein, 9 aa, Homo Sapiens
SCGEGFVNT

SEQ ID NO: 326743 - protein, 9 aa, Homo Sapiens
CLLDKGLDP

SEQ ID NO: 326744 - protein, 9 aa, Homo Sapiens
LMWAHFGLP

SEQ ID NO: 326745 - protein, 9 aa, Homo Sapiens
VVPTQPRLL

SEQ ID NO: 326746 - protein, 9 aa, Homo Sapiens
LSGITVMLL

SEQ ID NO: 326747 - protein, 9 aa, Homo Sapiens
QALLKENWL

SEQ ID NO: 326748 - protein, 9 aa, Homo Sapiens
CSPRTTTPT

SEQ ID NO: 326749 - protein, 9 aa, Homo Sapiens
TPTQLPRRP

SEQ ID NO: 326750 - protein, 9 aa, Homo Sapiens
QLLPVGLAS

SEQ ID NO: 326751 - protein, 9 aa, Homo Sapiens
ENVKRHLKC

SEQ ID NO: 326752 - protein, 9 aa, Homo Sapiens
LWLHIEDIK

SEQ ID NO: 326753 - protein, 9 aa, Homo Sapiens
RTGERKLTG

SEQ ID NO: 326754 - protein, 9 aa, Homo Sapiens
KQPAGVSPS

SEQ ID NO: 326755 - protein, 9 aa, Homo Sapiens
ASFNHFDWD

SEQ ID NO: 326756 - protein, 9 aa, Homo Sapiens
LNNFQGHYD

SEQ ID NO: 326757 - protein, 9 aa, Homo Sapiens
EAELWGEHT

SEQ ID NO: 326758 - protein, 9 aa, Homo Sapiens
HMMMFSGLQ

SEQ ID NO: 326759 - protein, 9 aa, Homo Sapiens
PPAAGSRTW

SEQ ID NO: 326760 - protein, 9 aa, Homo Sapiens
ERAAEDKPW

SEQ ID NO: 326761 - protein, 9 aa, Homo Sapiens
RRQRAEDDC

SEQ ID NO: 326762 - protein, 9 aa, Homo Sapiens
SLEWARTED

SEQ ID NO: 326763 - protein, 9 aa, Homo Sapiens
TGEGLDGSF

SEQ ID NO: 326764 - protein, 9 aa, Homo Sapiens
AMAEHGPAF

SEQ ID NO: 326765 - protein, 9 aa, Homo Sapiens
TLAAQKNKV

SEQ ID NO: 326766 - protein, 9 aa, Homo Sapiens
VEITAVAMQ

SEQ ID NO: 326767 - protein, 9 aa, Homo Sapiens
DSDSSPSCR

SEQ ID NO: 326768 - protein, 9 aa, Homo Sapiens
RGDVLLNID

SEQ ID NO: 326769 - protein, 9 aa, Homo Sapiens
FHVDSAAEC

SEQ ID NO: 326770 - protein, 9 aa, Homo Sapiens
LKLMSASGF

SEQ ID NO: 326771 - protein, 9 aa, Homo Sapiens
RETAQNTQM

SEQ ID NO: 326772 - protein, 9 aa, Homo Sapiens
MSLHLFHVV

SEQ ID NO: 326773 - protein, 9 aa, Homo Sapiens
QRTVMETIA

SEQ ID NO: 326774 - protein, 9 aa, Homo Sapiens
TDAADAAAA

SEQ ID NO: 326775 - protein, 9 aa, Homo Sapiens
SGGSGLSCH

SEQ ID NO: 326776 - protein, 9 aa, Homo Sapiens
GPHGPKGEP

SEQ ID NO: 326777 - protein, 9 aa, Homo Sapiens
LVGHQGAPM

SEQ ID NO: 326778 - protein, 9 aa, Homo Sapiens
MESGELVPT

SEQ ID NO: 326779 - protein, 9 aa, Homo Sapiens
NIGQLNGPN

SEQ ID NO: 326780 - protein, 9 aa, Homo Sapiens
CTRLHGNIL

SEQ ID NO: 326781 - protein, 9 aa, Homo Sapiens
SFFFMYMVA

SEQ ID NO: 326782 - protein, 9 aa, Homo Sapiens
PQEQLHLRI

SEQ ID NO: 326783 - protein, 9 aa, Homo Sapiens
IMNNRELLG

SEQ ID NO: 326784 - protein, 9 aa, Homo Sapiens
CHHGGQLIV

SEQ ID NO: 326785 - protein, 9 aa, Homo Sapiens
IALHMTTTG

SEQ ID NO: 326786 - protein, 9 aa, Homo Sapiens
HPSENLGQV

SEQ ID NO: 326787 - protein, 9 aa, Homo Sapiens
ARQKIVIIA

SEQ ID NO: 326788 - protein, 9 aa, Homo Sapiens
SSLLRVPVL

SEQ ID NO: 326789 - protein, 9 aa, Homo Sapiens
TNTVMDQKK

SEQ ID NO: 326790 - protein, 9 aa, Homo Sapiens
ERWSQFPVL

SEQ ID NO: 326791 - protein, 9 aa, Homo Sapiens
QVTHPLVHI

SEQ ID NO: 326792 - protein, 9 aa, Homo Sapiens
MTAQPGWPF

SEQ ID NO: 326793 - protein, 9 aa, Homo Sapiens
EANEWATIE

SEQ ID NO: 326794 - protein, 9 aa, Homo Sapiens
KDTSMKDMH

SEQ ID NO: 326795 - protein, 9 aa, Homo Sapiens
SCLPYGRLT

SEQ ID NO: 326796 - protein, 9 aa, Homo Sapiens
SLPPRRGSL

SEQ ID NO: 326797 - protein, 9 aa, Homo Sapiens
NFWYGLCVP

SEQ ID NO: 326798 - protein, 9 aa, Homo Sapiens
PRVIGTSVA

SEQ ID NO: 326799 - protein, 9 aa, Homo Sapiens
IQMMEPDNL

SEQ ID NO: 326800 - protein, 9 aa, Homo Sapiens
QDSEILSDA

SEQ ID NO: 326801 - protein, 9 aa, Homo Sapiens
AYLIHRGMD

SEQ ID NO: 326802 - protein, 9 aa, Homo Sapiens
GNLRFVVEP

SEQ ID NO: 326803 - protein, 9 aa, Homo Sapiens
VASRHGTHG

SEQ ID NO: 326804 - protein, 9 aa, Homo Sapiens
MHRNAYKCM

SEQ ID NO: 326805 - protein, 9 aa, Homo Sapiens
LTLLFLLGT

SEQ ID NO: 326806 - protein, 9 aa, Homo Sapiens
PQNSNVVNF

SEQ ID NO: 326807 - protein, 9 aa, Homo Sapiens
PSYVSWFDY

SEQ ID NO: 326808 - protein, 9 aa, Homo Sapiens
ICAAVCTRA

SEQ ID NO: 326809 - protein, 9 aa, Homo Sapiens
VLTIIVFIF

SEQ ID NO: 326810 - protein, 9 aa, Homo Sapiens
KALVKTWTQ

SEQ ID NO: 326811 - protein, 9 aa, Homo Sapiens
WYDGIREEL

SEQ ID NO: 326812 - protein, 9 aa, Homo Sapiens
PNSGVGAEV

SEQ ID NO: 326813 - protein, 9 aa, Homo Sapiens
ISVEMDIVV

SEQ ID NO: 326814 - protein, 9 aa, Homo Sapiens
HHGPSMPTL

SEQ ID NO: 326815 - protein, 9 aa, Homo Sapiens
LYGHTSTVH

SEQ ID NO: 326816 - protein, 9 aa, Homo Sapiens
MGIVLNSDW

SEQ ID NO: 326817 - protein, 9 aa, Homo Sapiens
MLLSDTHQC

SEQ ID NO: 326818 - protein, 9 aa, Homo Sapiens
KVSDPIIFQ

SEQ ID NO: 326819 - protein, 9 aa, Homo Sapiens
FMVSWPSRL

SEQ ID NO: 326820 - protein, 9 aa, Homo Sapiens
EGLTTNAGL

SEQ ID NO: 326821 - protein, 9 aa, Homo Sapiens
DLMTCSNVR

SEQ ID NO: 326822 - protein, 9 aa, Homo Sapiens
CRIRGSVGC

SEQ ID NO: 326823 - protein, 9 aa, Homo Sapiens
RELCITQFQ

SEQ ID NO: 326824 - protein, 9 aa, Homo Sapiens
DTYPAWVRV

SEQ ID NO: 326825 - protein, 9 aa, Homo Sapiens
EPPCTRLHG

SEQ ID NO: 326826 - protein, 9 aa, Homo Sapiens
DTLTWNNEI

SEQ ID NO: 326827 - protein, 9 aa, Homo Sapiens
QMGQSKQSP

SEQ ID NO: 326828 - protein, 9 aa, Homo Sapiens
VGGSVAHLL

SEQ ID NO: 326829 - protein, 9 aa, Homo Sapiens
EKVLHILVH

SEQ ID NO: 326830 - protein, 9 aa, Homo Sapiens
GEIIINFVW

SEQ ID NO: 326831 - protein, 9 aa, Homo Sapiens
TKVITKQEP

SEQ ID NO: 326832 - protein, 9 aa, Homo Sapiens
TNEGQILEQ

SEQ ID NO: 326833 - protein, 9 aa, Homo Sapiens
TKDSFSKRQ

SEQ ID NO: 326834 - protein, 9 aa, Homo Sapiens
LVLDQRASD

SEQ ID NO: 326835 - protein, 9 aa, Homo Sapiens
CPVWINADI

SEQ ID NO: 326836 - protein, 9 aa, Homo Sapiens
VPSLVSGNM

SEQ ID NO: 326837 - protein, 9 aa, Homo Sapiens
LRSCSFTKH

SEQ ID NO: 326838 - protein, 9 aa, Homo Sapiens
CPPPPPPAK

SEQ ID NO: 326839 - protein, 9 aa, Homo Sapiens
SENTYKSCR

SEQ ID NO: 326840 - protein, 9 aa, Homo Sapiens
RGLRAVEAE

SEQ ID NO: 326841 - protein, 9 aa, Homo Sapiens
SSRMEIRNE

SEQ ID NO: 326842 - protein, 9 aa, Homo Sapiens
IGEIRVPLH

SEQ ID NO: 326843 - protein, 9 aa, Homo Sapiens
SCFRFSGRT

SEQ ID NO: 326844 - protein, 9 aa, Homo Sapiens
GRLDSDTKE

SEQ ID NO: 326845 - protein, 9 aa, Homo Sapiens
PQVFSQMTH

SEQ ID NO: 326846 - protein, 9 aa, Homo Sapiens
PRGPPAHPA

SEQ ID NO: 326847 - protein, 9 aa, Homo Sapiens
VRTPPCTPN

SEQ ID NO: 326848 - protein, 9 aa, Homo Sapiens
LLRTVHCPC

SEQ ID NO: 326849 - protein, 9 aa, Homo Sapiens
FSHPGPQSV

SEQ ID NO: 326850 - protein, 9 aa, Homo Sapiens
GHSPPPSSG

SEQ ID NO: 326851 - protein, 9 aa, Homo Sapiens
HHDLKPSNL

SEQ ID NO: 326852 - protein, 9 aa, Homo Sapiens
KVARVEHEE

SEQ ID NO: 326853 - protein, 9 aa, Homo Sapiens
GSRMFWYSM

SEQ ID NO: 326854 - protein, 9 aa, Homo Sapiens
SCPALSPLG

SEQ ID NO: 326855 - protein, 9 aa, Homo Sapiens
SVHSISAEG

SEQ ID NO: 326856 - protein, 9 aa, Homo Sapiens
LLRAERVLL

SEQ ID NO: 326857 - protein, 9 aa, Homo Sapiens
RWVLEGMKG

SEQ ID NO: 326858 - protein, 9 aa, Homo Sapiens
HLSLNEEGQ

SEQ ID NO: 326859 - protein, 9 aa, Homo Sapiens
APTCVDVHI

SEQ ID NO: 326860 - protein, 9 aa, Homo Sapiens
QVRLAAKKQ

SEQ ID NO: 326861 - protein, 9 aa, Homo Sapiens
VEVKMLSGL

SEQ ID NO: 326862 - protein, 9 aa, Homo Sapiens
SSLTPDQYL

SEQ ID NO: 326863 - protein, 9 aa, Homo Sapiens
HPVVVPHGK

SEQ ID NO: 326864 - protein, 9 aa, Homo Sapiens
KGAQLGGTR

SEQ ID NO: 326865 - protein, 9 aa, Homo Sapiens
LPCRPYKVL

SEQ ID NO: 326866 - protein, 9 aa, Homo Sapiens
RRLQVESES

SEQ ID NO: 326867 - protein, 9 aa, Homo Sapiens
AGQLPALRP

SEQ ID NO: 326868 - protein, 9 aa, Homo Sapiens
AHGLRDPLV

SEQ ID NO: 326869 - protein, 9 aa, Homo Sapiens
LNKHSIQNR

SEQ ID NO: 326870 - protein, 9 aa, Homo Sapiens
GHSLGSALS

SEQ ID NO: 326871 - protein, 9 aa, Homo Sapiens
VAGRLVLSS

SEQ ID NO: 326872 - protein, 9 aa, Homo Sapiens
KPFRKGPGK

SEQ ID NO: 326873 - protein, 9 aa, Homo Sapiens
EPDCCDDER

SEQ ID NO: 326874 - protein, 9 aa, Homo Sapiens
LIHDENDNS

SEQ ID NO: 326875 - protein, 9 aa, Homo Sapiens
MQILGGLEH

SEQ ID NO: 326876 - protein, 9 aa, Homo Sapiens
KHPSENLGQ

SEQ ID NO: 326877 - protein, 9 aa, Homo Sapiens
RLWKVDQGL

SEQ ID NO: 326878 - protein, 9 aa, Homo Sapiens
HLKCPVWIN

SEQ ID NO: 326879 - protein, 9 aa, Homo Sapiens
RDFLLHFGC

SEQ ID NO: 326880 - protein, 9 aa, Homo Sapiens
GLKSKEQMA

SEQ ID NO: 326881 - protein, 9 aa, Homo Sapiens
IQDNIHLYA

SEQ ID NO: 326882 - protein, 9 aa, Homo Sapiens
QSIQDNIHL

SEQ ID NO: 326883 - protein, 9 aa, Homo Sapiens
NGESMAGPT

SEQ ID NO: 326884 - protein, 9 aa, Homo Sapiens
LTVLLAVIV

SEQ ID NO: 326885 - protein, 9 aa, Homo Sapiens
SDVELVQHI

SEQ ID NO: 326886 - protein, 9 aa, Homo Sapiens
DRCECLGPL

SEQ ID NO: 326887 - protein, 9 aa, Homo Sapiens
GCPIPGTST

SEQ ID NO: 326888 - protein, 9 aa, Homo Sapiens
TTLIQRRFR

SEQ ID NO: 326889 - protein, 9 aa, Homo Sapiens
GIKRLWTHL

SEQ ID NO: 326890 - protein, 9 aa, Homo Sapiens
ATLSSYSLD

SEQ ID NO: 326891 - protein, 9 aa, Homo Sapiens
SEILSDACW

SEQ ID NO: 326892 - protein, 9 aa, Homo Sapiens
ALRPLQHEQ

SEQ ID NO: 326893 - protein, 9 aa, Homo Sapiens
FLVRCSPVK

SEQ ID NO: 326894 - protein, 9 aa, Homo Sapiens
LTNVLFLVT

SEQ ID NO: 326895 - protein, 9 aa, Homo Sapiens
HKVLRTLQQ

SEQ ID NO: 326896 - protein, 9 aa, Homo Sapiens
TSKRGSKII

SEQ ID NO: 326897 - protein, 9 aa, Homo Sapiens
RNIADGKEI

SEQ ID NO: 326898 - protein, 9 aa, Homo Sapiens
TISRAKIQT

SEQ ID NO: 326899 - protein, 9 aa, Homo Sapiens
KRSPQQPVP

SEQ ID NO: 326900 - protein, 9 aa, Homo Sapiens
PLKPPWMDT

SEQ ID NO: 326901 - protein, 9 aa, Homo Sapiens
TLFPDENKN

SEQ ID NO: 326902 - protein, 9 aa, Homo Sapiens
EEAELWGEH

SEQ ID NO: 326903 - protein, 9 aa, Homo Sapiens
LQLGHLKDQ

SEQ ID NO: 326904 - protein, 9 aa, Homo Sapiens
TTKDKDGQL

SEQ ID NO: 326905 - protein, 9 aa, Homo Sapiens
NFCKFSSRS

SEQ ID NO: 326906 - protein, 9 aa, Homo Sapiens
VPTRETDIT

SEQ ID NO: 326907 - protein, 9 aa, Homo Sapiens
GVVWDSKKH

SEQ ID NO: 326908 - protein, 9 aa, Homo Sapiens
TDLLTLTPG

SEQ ID NO: 326909 - protein, 9 aa, Homo Sapiens
SEKVGGAKG

SEQ ID NO: 326910 - protein, 9 aa, Homo Sapiens
PAGEMVPAF

SEQ ID NO: 326911 - protein, 9 aa, Homo Sapiens
SLLQEGEGC

SEQ ID NO: 326912 - protein, 9 aa, Homo Sapiens
RVLGHSVQC

SEQ ID NO: 326913 - protein, 9 aa, Homo Sapiens
LAADCGMKL

SEQ ID NO: 326914 - protein, 9 aa, Homo Sapiens
VRRSLLTYG

SEQ ID NO: 326915 - protein, 9 aa, Homo Sapiens
RRLKLSQAQ

SEQ ID NO: 326916 - protein, 9 aa, Homo Sapiens
GHLGFSLWN

SEQ ID NO: 326917 - protein, 9 aa, Homo Sapiens
FTMTCQVER

SEQ ID NO: 326918 - protein, 9 aa, Homo Sapiens
HSLRSNLPT

SEQ ID NO: 326919 - protein, 9 aa, Homo Sapiens
LGDQTTMIT

SEQ ID NO: 326920 - protein, 9 aa, Homo Sapiens
LFYLLRTVH

SEQ ID NO: 326921 - protein, 9 aa, Homo Sapiens
GLQSSCHIL

SEQ ID NO: 326922 - protein, 9 aa, Homo Sapiens
LGNLTLVLT

SEQ ID NO: 326923 - protein, 9 aa, Homo Sapiens
LGSTFLRLA

SEQ ID NO: 326924 - protein, 9 aa, Homo Sapiens
TKAPGKPAP

SEQ ID NO: 326925 - protein, 9 aa, Homo Sapiens
IALCPDRAV

SEQ ID NO: 326926 - protein, 9 aa, Homo Sapiens
VWAVTQNGK

SEQ ID NO: 326927 - protein, 9 aa, Homo Sapiens
MSMIVPGMN

SEQ ID NO: 326928 - protein, 9 aa, Homo Sapiens
RPDSANSAQ

SEQ ID NO: 326929 - protein, 9 aa, Homo Sapiens
QGSCSPRTT

SEQ ID NO: 326930 - protein, 9 aa, Homo Sapiens
DKISPNGND

SEQ ID NO: 326931 - protein, 9 aa, Homo Sapiens
MRPVQPVVQ

SEQ ID NO: 326932 - protein, 9 aa, Homo Sapiens
PMDINNYPM

SEQ ID NO: 326933 - protein, 9 aa, Homo Sapiens
LCIWLLILS

SEQ ID NO: 326934 - protein, 9 aa, Homo Sapiens
DMLDIFMRF

SEQ ID NO: 326935 - protein, 9 aa, Homo Sapiens
RSLEWARTE

SEQ ID NO: 326936 - protein, 9 aa, Homo Sapiens
CRVGRSHSH

SEQ ID NO: 326937 - protein, 9 aa, Homo Sapiens
EPKHYLHLN

SEQ ID NO: 326938 - protein, 9 aa, Homo Sapiens
PIWEKFNTP

SEQ ID NO: 326939 - protein, 9 aa, Homo Sapiens
VKISATWAQ

SEQ ID NO: 326940 - protein, 9 aa, Homo Sapiens
FYGGHLGFS

SEQ ID NO: 326941 - protein, 9 aa, Homo Sapiens
CSPRSEVMY

SEQ ID NO: 326942 - protein, 9 aa, Homo Sapiens
SAQLDIDKD

SEQ ID NO: 326943 - protein, 9 aa, Homo Sapiens
HECGEKPDM

SEQ ID NO: 326944 - protein, 9 aa, Homo Sapiens
LLDTLQETQ

SEQ ID NO: 326945 - protein, 9 aa, Homo Sapiens
IMAKEGLLK

SEQ ID NO: 326946 - protein, 9 aa, Homo Sapiens
ECIHRLIEV

SEQ ID NO: 326947 - protein, 9 aa, Homo Sapiens
MKKEGIQTQ

SEQ ID NO: 326948 - protein, 9 aa, Homo Sapiens
RTSVMVKVV

SEQ ID NO: 326949 - protein, 9 aa, Homo Sapiens
SDGKVSPGM

SEQ ID NO: 326950 - protein, 9 aa, Homo Sapiens
GRRGPGGQL

SEQ ID NO: 326951 - protein, 9 aa, Homo Sapiens
PPIKVTSWW

SEQ ID NO: 326952 - protein, 9 aa, Homo Sapiens
KVSPGMLSI

SEQ ID NO: 326953 - protein, 9 aa, Homo Sapiens
LCATEWLTL

SEQ ID NO: 326954 - protein, 9 aa, Homo Sapiens
FQFTVTPDR

SEQ ID NO: 326955 - protein, 9 aa, Homo Sapiens
LAVQKGTST

SEQ ID NO: 326956 - protein, 9 aa, Homo Sapiens
DLMKKYEKS

SEQ ID NO: 326957 - protein, 9 aa, Homo Sapiens
YLSLTTELF

SEQ ID NO: 326958 - protein, 9 aa, Homo Sapiens
GLRGLLHPP

SEQ ID NO: 326959 - protein, 9 aa, Homo Sapiens
NQMTVEYVY

SEQ ID NO: 326960 - protein, 9 aa, Homo Sapiens
YLGPPIAAA

SEQ ID NO: 326961 - protein, 9 aa, Homo Sapiens
NIDKHWLNS

SEQ ID NO: 326962 - protein, 9 aa, Homo Sapiens
KNTAFQGSA

SEQ ID NO: 326963 - protein, 9 aa, Homo Sapiens
MPALSRWAN

SEQ ID NO: 326964 - protein, 9 aa, Homo Sapiens
ACAEQCNIM

SEQ ID NO: 326965 - protein, 9 aa, Homo Sapiens
DVLGIAFCL

SEQ ID NO: 326966 - protein, 9 aa, Homo Sapiens
DCGLGTQEG

SEQ ID NO: 326967 - protein, 9 aa, Homo Sapiens
SMYYTLPRK

SEQ ID NO: 326968 - protein, 9 aa, Homo Sapiens
LKCPVWINA

SEQ ID NO: 326969 - protein, 9 aa, Homo Sapiens
TLSQLCSEI

SEQ ID NO: 326970 - protein, 9 aa, Homo Sapiens
ALTLLSARL

SEQ ID NO: 326971 - protein, 9 aa, Homo Sapiens
QLGGTRGTG

SEQ ID NO: 326972 - protein, 9 aa, Homo Sapiens
AVRRGRCGK

SEQ ID NO: 326973 - protein, 9 aa, Homo Sapiens
YFFDRNHPS

SEQ ID NO: 326974 - protein, 9 aa, Homo Sapiens
GWQQPALAT

SEQ ID NO: 326975 - protein, 9 aa, Homo Sapiens
RAFPLFTHC

SEQ ID NO: 326976 - protein, 9 aa, Homo Sapiens
KAAQMARVQ

SEQ ID NO: 326977 - protein, 9 aa, Homo Sapiens
QHQDSEILS

SEQ ID NO: 326978 - protein, 9 aa, Homo Sapiens
IGLSLPPRR

SEQ ID NO: 326979 - protein, 9 aa, Homo Sapiens
LLDEILDFD

SEQ ID NO: 326980 - protein, 9 aa, Homo Sapiens
DVAAVLDPL

SEQ ID NO: 326981 - protein, 9 aa, Homo Sapiens
VGPNGCITN

SEQ ID NO: 326982 - protein, 9 aa, Homo Sapiens
PDMKHFCKS

SEQ ID NO: 326983 - protein, 9 aa, Homo Sapiens
YDETIRHFS

SEQ ID NO: 326984 - protein, 9 aa, Homo Sapiens
DVDTPPAWP

SEQ ID NO: 326985 - protein, 9 aa, Homo Sapiens
FKDKFRFYD

SEQ ID NO: 326986 - protein, 9 aa, Homo Sapiens
IVSTTCELY

SEQ ID NO: 326987 - protein, 9 aa, Homo Sapiens
QKPVVCTCS

SEQ ID NO: 326988 - protein, 9 aa, Homo Sapiens
LLALVCLPG

SEQ ID NO: 326989 - protein, 9 aa, Homo Sapiens
QGPCAPLPP

SEQ ID NO: 326990 - protein, 9 aa, Homo Sapiens
LASSLRRHE

SEQ ID NO: 326991 - protein, 9 aa, Homo Sapiens
RGVRPSDWP

SEQ ID NO: 326992 - protein, 9 aa, Homo Sapiens
EQEAPDGSH

SEQ ID NO: 326993 - protein, 9 aa, Homo Sapiens
KLTVMSSCS

SEQ ID NO: 326994 - protein, 9 aa, Homo Sapiens
AGARPHRRI

SEQ ID NO: 326995 - protein, 9 aa, Homo Sapiens
LAYDHVRKT

SEQ ID NO: 326996 - protein, 9 aa, Homo Sapiens
SQVWDVGMC

SEQ ID NO: 326997 - protein, 9 aa, Homo Sapiens
VTYHISGVG

SEQ ID NO: 326998 - protein, 9 aa, Homo Sapiens
MTHVRPGST

SEQ ID NO: 326999 - protein, 9 aa, Homo Sapiens
ARQAEAAEH

SEQ ID NO: 327000 - protein, 9 aa, Homo Sapiens
TKILKTIKS

SEQ ID NO: 327001 - protein, 9 aa, Homo Sapiens
KISSPHQKQ

SEQ ID NO: 327002 - protein, 9 aa, Homo Sapiens
DAAPRSLEF

SEQ ID NO: 327003 - protein, 9 aa, Homo Sapiens
GVHASERLA

SEQ ID NO: 327004 - protein, 9 aa, Homo Sapiens
YHRHPVLRA

SEQ ID NO: 327005 - protein, 9 aa, Homo Sapiens
SSNDMNSPT

SEQ ID NO: 327006 - protein, 9 aa, Homo Sapiens
MEAEARSSP

SEQ ID NO: 327007 - protein, 9 aa, Homo Sapiens
VKAAMVNGS

SEQ ID NO: 327008 - protein, 9 aa, Homo Sapiens
PLSSQTPGH

SEQ ID NO: 327009 - protein, 9 aa, Homo Sapiens
CAFHNLLLV

SEQ ID NO: 327010 - protein, 9 aa, Homo Sapiens
MDQKKFEDV

SEQ ID NO: 327011 - protein, 9 aa, Homo Sapiens
NSEPEKRPP

SEQ ID NO: 327012 - protein, 9 aa, Homo Sapiens
GKAVRRGRC

SEQ ID NO: 327013 - protein, 9 aa, Homo Sapiens
LLLGPSICV

SEQ ID NO: 327014 - protein, 9 aa, Homo Sapiens
SITTLKGKV

SEQ ID NO: 327015 - protein, 9 aa, Homo Sapiens
VMSSCSRRS

SEQ ID NO: 327016 - protein, 9 aa, Homo Sapiens
GGAPGTKRK

SEQ ID NO: 327017 - protein, 9 aa, Homo Sapiens
PWHDLGSRQ

SEQ ID NO: 327018 - protein, 9 aa, Homo Sapiens
DPIIFQMTL

SEQ ID NO: 327019 - protein, 9 aa, Homo Sapiens
GRCLFASGG

SEQ ID NO: 327020 - protein, 9 aa, Homo Sapiens
RTSWAPSVA

SEQ ID NO: 327021 - protein, 9 aa, Homo Sapiens
DEKCEAALR

SEQ ID NO: 327022 - protein, 9 aa, Homo Sapiens
RSALHVTAL

SEQ ID NO: 327023 - protein, 9 aa, Homo Sapiens
APKNRCTIE

SEQ ID NO: 327024 - protein, 9 aa, Homo Sapiens
DLCRQHMAM

SEQ ID NO: 327025 - protein, 9 aa, Homo Sapiens
PIGMPLSSQ

SEQ ID NO: 327026 - protein, 9 aa, Homo Sapiens
SSSNTNKSA

SEQ ID NO: 327027 - protein, 9 aa, Homo Sapiens
APTFSYRPD

SEQ ID NO: 327028 - protein, 9 aa, Homo Sapiens
VVFLWDLGS

SEQ ID NO: 327029 - protein, 9 aa, Homo Sapiens
RRRSKKERR

SEQ ID NO: 327030 - protein, 9 aa, Homo Sapiens
GEHEKVLHI

SEQ ID NO: 327031 - protein, 9 aa, Homo Sapiens
ESDEMCPCW

SEQ ID NO: 327032 - protein, 9 aa, Homo Sapiens
GKPFRKGPG

SEQ ID NO: 327033 - protein, 9 aa, Homo Sapiens
AARPNRRAT

SEQ ID NO: 327034 - protein, 9 aa, Homo Sapiens
AVVIFLHGL

SEQ ID NO: 327035 - protein, 9 aa, Homo Sapiens
LATPLCAGE

SEQ ID NO: 327036 - protein, 9 aa, Homo Sapiens
LPLPRSWFA

SEQ ID NO: 327037 - protein, 9 aa, Homo Sapiens
GPGKPKADM

SEQ ID NO: 327038 - protein, 9 aa, Homo Sapiens
LHTQKDRVG

SEQ ID NO: 327039 - protein, 9 aa, Homo Sapiens
SSQLSMSSQ

SEQ ID NO: 327040 - protein, 9 aa, Homo Sapiens
KYWDSWFRG

SEQ ID NO: 327041 - protein, 9 aa, Homo Sapiens
LLHLSHMGN

SEQ ID NO: 327042 - protein, 9 aa, Homo Sapiens
KFEALAARD

SEQ ID NO: 327043 - protein, 9 aa, Homo Sapiens
VTTSAHGGR

SEQ ID NO: 327044 - protein, 9 aa, Homo Sapiens
MVSLAYDHV

SEQ ID NO: 327045 - protein, 9 aa, Homo Sapiens
YPADASRNG

SEQ ID NO: 327046 - protein, 9 aa, Homo Sapiens
FTFPKAPFS

SEQ ID NO: 327047 - protein, 9 aa, Homo Sapiens
FVLVNLEVT

SEQ ID NO: 327048 - protein, 9 aa, Homo Sapiens
RRYHSVTGL

SEQ ID NO: 327049 - protein, 9 aa, Homo Sapiens
HAKPESSES

SEQ ID NO: 327050 - protein, 9 aa, Homo Sapiens
ILCCAICRN

SEQ ID NO: 327051 - protein, 9 aa, Homo Sapiens
PLWEWVLQC

SEQ ID NO: 327052 - protein, 9 aa, Homo Sapiens
IARQGGLVY

SEQ ID NO: 327053 - protein, 9 aa, Homo Sapiens
RMEIRNESR

SEQ ID NO: 327054 - protein, 9 aa, Homo Sapiens
RQLQRDREA

SEQ ID NO: 327055 - protein, 9 aa, Homo Sapiens
AVLAWSDSA

SEQ ID NO: 327056 - protein, 9 aa, Homo Sapiens
AISLGSTRK

SEQ ID NO: 327057 - protein, 9 aa, Homo Sapiens
PPPWRHGAL

SEQ ID NO: 327058 - protein, 9 aa, Homo Sapiens
CGANSYEME

SEQ ID NO: 327059 - protein, 9 aa, Homo Sapiens
LELQFVSSL

SEQ ID NO: 327060 - protein, 9 aa, Homo Sapiens
QSKQSPLEE

SEQ ID NO: 327061 - protein, 9 aa, Homo Sapiens
TLSLVLDCG

SEQ ID NO: 327062 - protein, 9 aa, Homo Sapiens
TAMQILGGL

SEQ ID NO: 327063 - protein, 9 aa, Homo Sapiens
SSWHTGRCR

SEQ ID NO: 327064 - protein, 9 aa, Homo Sapiens
MSVAASQGN

SEQ ID NO: 327065 - protein, 9 aa, Homo Sapiens
SGPLSLQEI

SEQ ID NO: 327066 - protein, 9 aa, Homo Sapiens
EDVDKGPKE

SEQ ID NO: 327067 - protein, 9 aa, Homo Sapiens
LCVAELVKT

SEQ ID NO: 327068 - protein, 9 aa, Homo Sapiens
SCTEMEGRS

SEQ ID NO: 327069 - protein, 9 aa, Homo Sapiens
TITGIVILS

SEQ ID NO: 327070 - protein, 9 aa, Homo Sapiens
PLQVRSPVF

SEQ ID NO: 327071 - protein, 9 aa, Homo Sapiens
SADGRRFWQ

SEQ ID NO: 327072 - protein, 9 aa, Homo Sapiens
KEVSQQLQD

SEQ ID NO: 327073 - protein, 9 aa, Homo Sapiens
KASILQKRL

SEQ ID NO: 327074 - protein, 9 aa, Homo Sapiens
ILQLLLDFS

SEQ ID NO: 327075 - protein, 9 aa, Homo Sapiens
PCTLVWYAP

SEQ ID NO: 327076 - protein, 9 aa, Homo Sapiens
TCSYPRWHS

SEQ ID NO: 327077 - protein, 9 aa, Homo Sapiens
LAMDTYSGA

SEQ ID NO: 327078 - protein, 9 aa, Homo Sapiens
FPPHVPPGT

SEQ ID NO: 327079 - protein, 9 aa, Homo Sapiens
GNLTLVLTI

SEQ ID NO: 327080 - protein, 9 aa, Homo Sapiens
LLDAWRFWR

SEQ ID NO: 327081 - protein, 9 aa, Homo Sapiens
MDIFAKVLE

SEQ ID NO: 327082 - protein, 9 aa, Homo Sapiens
LEAIAIYKV

SEQ ID NO: 327083 - protein, 9 aa, Homo Sapiens
LLPGEAAPS

SEQ ID NO: 327084 - protein, 9 aa, Homo Sapiens
DGAQVESKA

SEQ ID NO: 327085 - protein, 9 aa, Homo Sapiens
CHCSSITKN

SEQ ID NO: 327086 - protein, 9 aa, Homo Sapiens
FISRHFYMA

SEQ ID NO: 327087 - protein, 9 aa, Homo Sapiens
FHQGYGKPV

SEQ ID NO: 327088 - protein, 9 aa, Homo Sapiens
RRGGARPGG

SEQ ID NO: 327089 - protein, 9 aa, Homo Sapiens
WKVSDPIIF

SEQ ID NO: 327090 - protein, 9 aa, Homo Sapiens
SGDVPVSCS

SEQ ID NO: 327091 - protein, 9 aa, Homo Sapiens
FWRKRAEFD

SEQ ID NO: 327092 - protein, 9 aa, Homo Sapiens
PPQLHLLSR

SEQ ID NO: 327093 - protein, 9 aa, Homo Sapiens
ADGRRFWQA

SEQ ID NO: 327094 - protein, 9 aa, Homo Sapiens
LWAKPPSEA

SEQ ID NO: 327095 - protein, 9 aa, Homo Sapiens
EKSHLTQHQ

SEQ ID NO: 327096 - protein, 9 aa, Homo Sapiens
RSCPALSPL

SEQ ID NO: 327097 - protein, 9 aa, Homo Sapiens
MDYFSQFGT

SEQ ID NO: 327098 - protein, 9 aa, Homo Sapiens
SSPHQKQRL

SEQ ID NO: 327099 - protein, 9 aa, Homo Sapiens
GVIVFEGDT

SEQ ID NO: 327100 - protein, 9 aa, Homo Sapiens
MLACCMEVA

SEQ ID NO: 327101 - protein, 9 aa, Homo Sapiens
SHQFTCKSG

SEQ ID NO: 327102 - protein, 9 aa, Homo Sapiens
ARAPQKKVR

SEQ ID NO: 327103 - protein, 9 aa, Homo Sapiens
APMWCCSRI

SEQ ID NO: 327104 - protein, 9 aa, Homo Sapiens
SFIALNMVH

SEQ ID NO: 327105 - protein, 9 aa, Homo Sapiens
QLEQLLLQP

SEQ ID NO: 327106 - protein, 9 aa, Homo Sapiens
RDHQQSRAN

SEQ ID NO: 327107 - protein, 9 aa, Homo Sapiens
SLYHSMEWR

SEQ ID NO: 327108 - protein, 9 aa, Homo Sapiens
SHREQSQII

SEQ ID NO: 327109 - protein, 9 aa, Homo Sapiens
KQGLALDGK

SEQ ID NO: 327110 - protein, 9 aa, Homo Sapiens
LRDLLICSH

SEQ ID NO: 327111 - protein, 9 aa, Homo Sapiens
SLAYDHVRK

SEQ ID NO: 327112 - protein, 9 aa, Homo Sapiens
MDGTTLYEA

SEQ ID NO: 327113 - protein, 9 aa, Homo Sapiens
SVVPTQPRL

SEQ ID NO: 327114 - protein, 9 aa, Homo Sapiens
GALLRELCI

SEQ ID NO: 327115 - protein, 9 aa, Homo Sapiens
PQFYPLRPL

SEQ ID NO: 327116 - protein, 9 aa, Homo Sapiens
RLWLLFSDV

SEQ ID NO: 327117 - protein, 9 aa, Homo Sapiens
WVLSQLDAS

SEQ ID NO: 327118 - protein, 9 aa, Homo Sapiens
PMWGRGGFD

SEQ ID NO: 327119 - protein, 9 aa, Homo Sapiens
EARSSPGGR

SEQ ID NO: 327120 - protein, 9 aa, Homo Sapiens
IFFYIKSPL

SEQ ID NO: 327121 - protein, 9 aa, Homo Sapiens
SVPCGVGQK

SEQ ID NO: 327122 - protein, 9 aa, Homo Sapiens
NYSGKAADV

SEQ ID NO: 327123 - protein, 9 aa, Homo Sapiens
ILAVAWDLE

SEQ ID NO: 327124 - protein, 9 aa, Homo Sapiens
LLLQPERPG

SEQ ID NO: 327125 - protein, 9 aa, Homo Sapiens
MQPKKVRKV

SEQ ID NO: 327126 - protein, 9 aa, Homo Sapiens
YKCQPRRRK

SEQ ID NO: 327127 - protein, 9 aa, Homo Sapiens
GRLPGRPAH

SEQ ID NO: 327128 - protein, 9 aa, Homo Sapiens
AIMRSLRVL

SEQ ID NO: 327129 - protein, 9 aa, Homo Sapiens
DAGVAKGAI

SEQ ID NO: 327130 - protein, 9 aa, Homo Sapiens
TPEQIVWLK

SEQ ID NO: 327131 - protein, 9 aa, Homo Sapiens
SWGHVGTVI

SEQ ID NO: 327132 - protein, 9 aa, Homo Sapiens
LKDLKDRQP

SEQ ID NO: 327133 - protein, 9 aa, Homo Sapiens
PSWEMAVNE

SEQ ID NO: 327134 - protein, 9 aa, Homo Sapiens
ESEDSYNGW

SEQ ID NO: 327135 - protein, 9 aa, Homo Sapiens
ENIGKKRIL

SEQ ID NO: 327136 - protein, 9 aa, Homo Sapiens
PDSARVCYY

SEQ ID NO: 327137 - protein, 9 aa, Homo Sapiens
KVDSFREQI

SEQ ID NO: 327138 - protein, 9 aa, Homo Sapiens
AALSHKLCR

SEQ ID NO: 327139 - protein, 9 aa, Homo Sapiens
EEEAEEERR

SEQ ID NO: 327140 - protein, 9 aa, Homo Sapiens
NLYSYFRSS

SEQ ID NO: 327141 - protein, 9 aa, Homo Sapiens
HPADAESAS

SEQ ID NO: 327142 - protein, 9 aa, Homo Sapiens
ETVCGYGSQ

SEQ ID NO: 327143 - protein, 9 aa, Homo Sapiens
LQCFGKKTS

SEQ ID NO: 327144 - protein, 9 aa, Homo Sapiens
FLRTWGRAL

SEQ ID NO: 327145 - protein, 9 aa, Homo Sapiens
AMVNGSTGP

SEQ ID NO: 327146 - protein, 9 aa, Homo Sapiens
AQTGLSLHD

SEQ ID NO: 327147 - protein, 9 aa, Homo Sapiens
ANGVKPDIM

SEQ ID NO: 327148 - protein, 9 aa, Homo Sapiens
KLHTEVIQL

SEQ ID NO: 327149 - protein, 9 aa, Homo Sapiens
EARLRHKVQ

SEQ ID NO: 327150 - protein, 9 aa, Homo Sapiens
RDRRPGPSR

SEQ ID NO: 327151 - protein, 9 aa, Homo Sapiens
VTVPLDLFK

SEQ ID NO: 327152 - protein, 9 aa, Homo Sapiens
EGPSVDTRH

SEQ ID NO: 327153 - protein, 9 aa, Homo Sapiens
WMGTQFGQW

SEQ ID NO: 327154 - protein, 9 aa, Homo Sapiens
PQYFGGVSS

SEQ ID NO: 327155 - protein, 9 aa, Homo Sapiens
EPQGVVYGD

SEQ ID NO: 327156 - protein, 9 aa, Homo Sapiens
LHLRIGIHT

SEQ ID NO: 327157 - protein, 9 aa, Homo Sapiens
PPAQPPGLP

SEQ ID NO: 327158 - protein, 9 aa, Homo Sapiens
SGPKVDIKA

SEQ ID NO: 327159 - protein, 9 aa, Homo Sapiens
TRTGERKLT

SEQ ID NO: 327160 - protein, 9 aa, Homo Sapiens
RNRNSQMIR

SEQ ID NO: 327161 - protein, 9 aa, Homo Sapiens
AVSTKGERF

SEQ ID NO: 327162 - protein, 9 aa, Homo Sapiens
GAFQDSILE

SEQ ID NO: 327163 - protein, 9 aa, Homo Sapiens
AYLSPLGPV

SEQ ID NO: 327164 - protein, 9 aa, Homo Sapiens
ASYEEILLE

SEQ ID NO: 327165 - protein, 9 aa, Homo Sapiens
VCFLFFCQK

SEQ ID NO: 327166 - protein, 9 aa, Homo Sapiens
TGKTSMLVK

SEQ ID NO: 327167 - protein, 9 aa, Homo Sapiens
GGGSSDAKE

SEQ ID NO: 327168 - protein, 9 aa, Homo Sapiens
TLVQMADGN

SEQ ID NO: 327169 - protein, 9 aa, Homo Sapiens
PDPARGSCG

SEQ ID NO: 327170 - protein, 9 aa, Homo Sapiens
TWGELLVLD

SEQ ID NO: 327171 - protein, 9 aa, Homo Sapiens
SSSCRQQSS

SEQ ID NO: 327172 - protein, 9 aa, Homo Sapiens
WIFISFFFM

SEQ ID NO: 327173 - protein, 9 aa, Homo Sapiens
QGKAKHLHL

SEQ ID NO: 327174 - protein, 9 aa, Homo Sapiens
AMDTYSGAP

SEQ ID NO: 327175 - protein, 9 aa, Homo Sapiens
EMQVRLAAK

SEQ ID NO: 327176 - protein, 9 aa, Homo Sapiens
ECTCATTSL

SEQ ID NO: 327177 - protein, 9 aa, Homo Sapiens
GSDSMPSRT

SEQ ID NO: 327178 - protein, 9 aa, Homo Sapiens
YGRLTYHLA

SEQ ID NO: 327179 - protein, 9 aa, Homo Sapiens
VVSMYYTLP

SEQ ID NO: 327180 - protein, 9 aa, Homo Sapiens
DRLGSSKVE

SEQ ID NO: 327181 - protein, 9 aa, Homo Sapiens
GVCNISNQL

SEQ ID NO: 327182 - protein, 9 aa, Homo Sapiens
GFTGSHCKK

SEQ ID NO: 327183 - protein, 9 aa, Homo Sapiens
SAQIVCVFQ

SEQ ID NO: 327184 - protein, 9 aa, Homo Sapiens
QRSDSLCCG

SEQ ID NO: 327185 - protein, 9 aa, Homo Sapiens
FYVHSEATL

SEQ ID NO: 327186 - protein, 9 aa, Homo Sapiens
DFMWHQPYQ

SEQ ID NO: 327187 - protein, 9 aa, Homo Sapiens
LLSIPMFLC

SEQ ID NO: 327188 - protein, 9 aa, Homo Sapiens
TLVGVYLPC

SEQ ID NO: 327189 - protein, 9 aa, Homo Sapiens
TKLQKSSRG

SEQ ID NO: 327190 - protein, 9 aa, Homo Sapiens
GRVVFLWDL

SEQ ID NO: 327191 - protein, 9 aa, Homo Sapiens
VINENAPVT

SEQ ID NO: 327192 - protein, 9 aa, Homo Sapiens
LPAQIQEIV

SEQ ID NO: 327193 - protein, 9 aa, Homo Sapiens
YSHREQSQI

SEQ ID NO: 327194 - protein, 9 aa, Homo Sapiens
VAPLIICHM

SEQ ID NO: 327195 - protein, 9 aa, Homo Sapiens
WHATPTQLP

SEQ ID NO: 327196 - protein, 9 aa, Homo Sapiens
IEVYLDIKA

SEQ ID NO: 327197 - protein, 9 aa, Homo Sapiens
WLLILSYVG

SEQ ID NO: 327198 - protein, 9 aa, Homo Sapiens
SADFRHSFP

SEQ ID NO: 327199 - protein, 9 aa, Homo Sapiens
RHMCRHKKP

SEQ ID NO: 327200 - protein, 9 aa, Homo Sapiens
LAEEQAQII

SEQ ID NO: 327201 - protein, 9 aa, Homo Sapiens
RNQLLPGVK

SEQ ID NO: 327202 - protein, 9 aa, Homo Sapiens
HRLKPSQKK

SEQ ID NO: 327203 - protein, 9 aa, Homo Sapiens
CSPVKNEED

SEQ ID NO: 327204 - protein, 9 aa, Homo Sapiens
EVGLVLRHL

SEQ ID NO: 327205 - protein, 9 aa, Homo Sapiens
HAVLMQAYR

SEQ ID NO: 327206 - protein, 9 aa, Homo Sapiens
TAPPKQEFL

SEQ ID NO: 327207 - protein, 9 aa, Homo Sapiens
ATEEGFTPP

SEQ ID NO: 327208 - protein, 9 aa, Homo Sapiens
LTLVLTIIV

SEQ ID NO: 327209 - protein, 9 aa, Homo Sapiens
MPRHRFMSV

SEQ ID NO: 327210 - protein, 9 aa, Homo Sapiens
WLQVQTIQC

SEQ ID NO: 327211 - protein, 9 aa, Homo Sapiens
CIFTQFWII

SEQ ID NO: 327212 - protein, 9 aa, Homo Sapiens
MSKLRLLLL

SEQ ID NO: 327213 - protein, 9 aa, Homo Sapiens
VPRGCCTSL

SEQ ID NO: 327214 - protein, 9 aa, Homo Sapiens
KDHPDYKCQ

SEQ ID NO: 327215 - protein, 9 aa, Homo Sapiens
SVKAAMVNG

SEQ ID NO: 327216 - protein, 9 aa, Homo Sapiens
RALLDIDAL

SEQ ID NO: 327217 - protein, 9 aa, Homo Sapiens
RLHGFLVRQ

SEQ ID NO: 327218 - protein, 9 aa, Homo Sapiens
VGAALREWL

SEQ ID NO: 327219 - protein, 9 aa, Homo Sapiens
LHSIVEDYL

SEQ ID NO: 327220 - protein, 9 aa, Homo Sapiens
LDGNGQDAY

SEQ ID NO: 327221 - protein, 9 aa, Homo Sapiens
SEDVPLDHH

SEQ ID NO: 327222 - protein, 9 aa, Homo Sapiens
YRVQSTQSQ

SEQ ID NO: 327223 - protein, 9 aa, Homo Sapiens
DGQKSVYVV

SEQ ID NO: 327224 - protein, 9 aa, Homo Sapiens
EHLECTCAT

SEQ ID NO: 327225 - protein, 9 aa, Homo Sapiens
IKHWIFISF

SEQ ID NO: 327226 - protein, 9 aa, Homo Sapiens
LEPVDYMVR

SEQ ID NO: 327227 - protein, 9 aa, Homo Sapiens
KTWTQFRNY

SEQ ID NO: 327228 - protein, 9 aa, Homo Sapiens
LSVVMGSKA

SEQ ID NO: 327229 - protein, 9 aa, Homo Sapiens
SRKESYSMY

SEQ ID NO: 327230 - protein, 9 aa, Homo Sapiens
TQLVGGREQ

SEQ ID NO: 327231 - protein, 9 aa, Homo Sapiens
MDTALAHLE

SEQ ID NO: 327232 - protein, 9 aa, Homo Sapiens
AISFHQVDF

SEQ ID NO: 327233 - protein, 9 aa, Homo Sapiens
FTFLFLLVC

SEQ ID NO: 327234 - protein, 9 aa, Homo Sapiens
CRSVSMVIL

SEQ ID NO: 327235 - protein, 9 aa, Homo Sapiens
RQSSLLRHQ

SEQ ID NO: 327236 - protein, 9 aa, Homo Sapiens
VRKALQSPV

SEQ ID NO: 327237 - protein, 9 aa, Homo Sapiens
ARQGGLVYL

SEQ ID NO: 327238 - protein, 9 aa, Homo Sapiens
AMSLLQDWG

SEQ ID NO: 327239 - protein, 9 aa, Homo Sapiens
IMWRRGHEP

SEQ ID NO: 327240 - protein, 9 aa, Homo Sapiens
PGSPGSAAW

SEQ ID NO: 327241 - protein, 9 aa, Homo Sapiens
KGLSLSYGP

SEQ ID NO: 327242 - protein, 9 aa, Homo Sapiens
LYGKKLVKI

SEQ ID NO: 327243 - protein, 9 aa, Homo Sapiens
DRPLQVEKN

SEQ ID NO: 327244 - protein, 9 aa, Homo Sapiens
WLPSNIYTG

SEQ ID NO: 327245 - protein, 9 aa, Homo Sapiens
ARPGTCAAR

SEQ ID NO: 327246 - protein, 9 aa, Homo Sapiens
RLHVRDINE

SEQ ID NO: 327247 - protein, 9 aa, Homo Sapiens
PKKTLLKCW

SEQ ID NO: 327248 - protein, 9 aa, Homo Sapiens
GVGQKTRDV

SEQ ID NO: 327249 - protein, 9 aa, Homo Sapiens
CFGNFIWLP

SEQ ID NO: 327250 - protein, 9 aa, Homo Sapiens
GRRFWQACD

SEQ ID NO: 327251 - protein, 9 aa, Homo Sapiens
EQCQAWARA

SEQ ID NO: 327252 - protein, 9 aa, Homo Sapiens
PPRLPAVPP

SEQ ID NO: 327253 - protein, 9 aa, Homo Sapiens
QEIHFKTCY

SEQ ID NO: 327254 - protein, 9 aa, Homo Sapiens
TGPCRQRTV

SEQ ID NO: 327255 - protein, 9 aa, Homo Sapiens
GPAGHLTLR

SEQ ID NO: 327256 - protein, 9 aa, Homo Sapiens
FTRLSMTTI

SEQ ID NO: 327257 - protein, 9 aa, Homo Sapiens
SPDLELLLW

SEQ ID NO: 327258 - protein, 9 aa, Homo Sapiens
TKQEPGEAP

SEQ ID NO: 327259 - protein, 9 aa, Homo Sapiens
GHAESPGVP

SEQ ID NO: 327260 - protein, 9 aa, Homo Sapiens
RIRGSVGCS

SEQ ID NO: 327261 - protein, 9 aa, Homo Sapiens
KLDKDPLLS

SEQ ID NO: 327262 - protein, 9 aa, Homo Sapiens
ERAKKRCTS

SEQ ID NO: 327263 - protein, 9 aa, Homo Sapiens
RTEHLARDV

SEQ ID NO: 327264 - protein, 9 aa, Homo Sapiens
SRSKRKKQK

SEQ ID NO: 327265 - protein, 9 aa, Homo Sapiens
SKLSWHQKI

SEQ ID NO: 327266 - protein, 9 aa, Homo Sapiens
VLQEWLCLA

SEQ ID NO: 327267 - protein, 9 aa, Homo Sapiens
YGMVSLAYD

SEQ ID NO: 327268 - protein, 9 aa, Homo Sapiens
TRAGIKRLW

SEQ ID NO: 327269 - protein, 9 aa, Homo Sapiens
IDKISPNGN

SEQ ID NO: 327270 - protein, 9 aa, Homo Sapiens
RCWTCSRSQ

SEQ ID NO: 327271 - protein, 9 aa, Homo Sapiens
SDMTTSSLH

SEQ ID NO: 327272 - protein, 9 aa, Homo Sapiens
SCTQRTLHV

SEQ ID NO: 327273 - protein, 9 aa, Homo Sapiens
HVYPMQKRL

SEQ ID NO: 327274 - protein, 9 aa, Homo Sapiens
LTNMCFRPM

SEQ ID NO: 327275 - protein, 9 aa, Homo Sapiens
SPQRFANTM

SEQ ID NO: 327276 - protein, 9 aa, Homo Sapiens
YIPDCLPAK

SEQ ID NO: 327277 - protein, 9 aa, Homo Sapiens
EETRKEMAP

SEQ ID NO: 327278 - protein, 9 aa, Homo Sapiens
HMSPLFEKG

SEQ ID NO: 327279 - protein, 9 aa, Homo Sapiens
VYQQARKKH

SEQ ID NO: 327280 - protein, 9 aa, Homo Sapiens
EHILVHLET

SEQ ID NO: 327281 - protein, 9 aa, Homo Sapiens
WTEYSIQMM

SEQ ID NO: 327282 - protein, 9 aa, Homo Sapiens
GVDVNNRTD

SEQ ID NO: 327283 - protein, 9 aa, Homo Sapiens
KDMYGQVLK

SEQ ID NO: 327284 - protein, 9 aa, Homo Sapiens
DGLILWTRF

SEQ ID NO: 327285 - protein, 9 aa, Homo Sapiens
MTAKPEVSL

SEQ ID NO: 327286 - protein, 9 aa, Homo Sapiens
WTEEAGATT

SEQ ID NO: 327287 - protein, 9 aa, Homo Sapiens
WKLILAQKL

SEQ ID NO: 327288 - protein, 9 aa, Homo Sapiens
TGRPLHQHS

SEQ ID NO: 327289 - protein, 9 aa, Homo Sapiens
DECQYRRPA

SEQ ID NO: 327290 - protein, 9 aa, Homo Sapiens
HIATTLIQR

SEQ ID NO: 327291 - protein, 9 aa, Homo Sapiens
LHHRRSHQG

SEQ ID NO: 327292 - protein, 9 aa, Homo Sapiens
CGTYFSTQD

SEQ ID NO: 327293 - protein, 9 aa, Homo Sapiens
TQGKDQYYL

SEQ ID NO: 327294 - protein, 9 aa, Homo Sapiens
SKLDSLETA

SEQ ID NO: 327295 - protein, 9 aa, Homo Sapiens
REDVEKRNE

SEQ ID NO: 327296 - protein, 9 aa, Homo Sapiens
QGYVIFAIS

SEQ ID NO: 327297 - protein, 9 aa, Homo Sapiens
DCHPQVCDT

SEQ ID NO: 327298 - protein, 9 aa, Homo Sapiens
ADASRNGIR

SEQ ID NO: 327299 - protein, 9 aa, Homo Sapiens
STSLAWLNR

SEQ ID NO: 327300 - protein, 9 aa, Homo Sapiens
RQHMAMKSL

SEQ ID NO: 327301 - protein, 9 aa, Homo Sapiens
EATKEVIEQ

SEQ ID NO: 327302 - protein, 9 aa, Homo Sapiens
DCVTMDNLQ

SEQ ID NO: 327303 - protein, 9 aa, Homo Sapiens
PAHCYRYCK

SEQ ID NO: 327304 - protein, 9 aa, Homo Sapiens
GLGTQEGTR

SEQ ID NO: 327305 - protein, 9 aa, Homo Sapiens
RNHPSFDAI

SEQ ID NO: 327306 - protein, 9 aa, Homo Sapiens
KDLKDRQPL

SEQ ID NO: 327307 - protein, 9 aa, Homo Sapiens
SGAGQLPAL

SEQ ID NO: 327308 - protein, 9 aa, Homo Sapiens
CKLCSCHPV

SEQ ID NO: 327309 - protein, 9 aa, Homo Sapiens
KINCSNNKI

SEQ ID NO: 327310 - protein, 9 aa, Homo Sapiens
TIRHFSTML

SEQ ID NO: 327311 - protein, 9 aa, Homo Sapiens
HPTCTKDWE

SEQ ID NO: 327312 - protein, 9 aa, Homo Sapiens
GSSDAKEVM

SEQ ID NO: 327313 - protein, 9 aa, Homo Sapiens
LEGSCVSVW

SEQ ID NO: 327314 - protein, 9 aa, Homo Sapiens
APACSSTSF

SEQ ID NO: 327315 - protein, 9 aa, Homo Sapiens
PSRRCSRDR

SEQ ID NO: 327316 - protein, 9 aa, Homo Sapiens
PQIHFLVCA

SEQ ID NO: 327317 - protein, 9 aa, Homo Sapiens
SDIKCHRTK

SEQ ID NO: 327318 - protein, 9 aa, Homo Sapiens
GMMLLSDTH

SEQ ID NO: 327319 - protein, 9 aa, Homo Sapiens
SGHGCSFPP

SEQ ID NO: 327320 - protein, 9 aa, Homo Sapiens
LFTQLLAQS

SEQ ID NO: 327321 - protein, 9 aa, Homo Sapiens
SFMTSPTDA

SEQ ID NO: 327322 - protein, 9 aa, Homo Sapiens
ELPEEMLME

SEQ ID NO: 327323 - protein, 9 aa, Homo Sapiens
NQAVSTKGE

SEQ ID NO: 327324 - protein, 9 aa, Homo Sapiens
GSTQPEPQH

SEQ ID NO: 327325 - protein, 9 aa, Homo Sapiens
ICLSHDSAA

SEQ ID NO: 327326 - protein, 9 aa, Homo Sapiens
WMGLSQRNP

SEQ ID NO: 327327 - protein, 9 aa, Homo Sapiens
LLYIYERLT

SEQ ID NO: 327328 - protein, 9 aa, Homo Sapiens
ILPGDVRTW

SEQ ID NO: 327329 - protein, 9 aa, Homo Sapiens
SPPCRSLGC

SEQ ID NO: 327330 - protein, 9 aa, Homo Sapiens
SAWRKTTWL

SEQ ID NO: 327331 - protein, 9 aa, Homo Sapiens
IFQKLNVPM

SEQ ID NO: 327332 - protein, 9 aa, Homo Sapiens
SQLIIMLFK

SEQ ID NO: 327333 - protein, 9 aa, Homo Sapiens
IPKAPKKTL

SEQ ID NO: 327334 - protein, 9 aa, Homo Sapiens
NPNMKSKAC

SEQ ID NO: 327335 - protein, 9 aa, Homo Sapiens
QPVPYVVPL

SEQ ID NO: 327336 - protein, 9 aa, Homo Sapiens
WTTLAPGKT

SEQ ID NO: 327337 - protein, 9 aa, Homo Sapiens
SKELCMYDE

SEQ ID NO: 327338 - protein, 9 aa, Homo Sapiens
GARAPQKKV

SEQ ID NO: 327339 - protein, 9 aa, Homo Sapiens
EEEYYTITE

SEQ ID NO: 327340 - protein, 9 aa, Homo Sapiens
DDEDSRHSS

SEQ ID NO: 327341 - protein, 9 aa, Homo Sapiens
LRAGVRAAD

SEQ ID NO: 327342 - protein, 9 aa, Homo Sapiens
IGEGSTGII

SEQ ID NO: 327343 - protein, 9 aa, Homo Sapiens
PQVGLSQAN

SEQ ID NO: 327344 - protein, 9 aa, Homo Sapiens
ESKAKDDQT

SEQ ID NO: 327345 - protein, 9 aa, Homo Sapiens
LVNFLRTWG

SEQ ID NO: 327346 - protein, 9 aa, Homo Sapiens
TLAPGKTQF

SEQ ID NO: 327347 - protein, 9 aa, Homo Sapiens
GGQLRLMLP

SEQ ID NO: 327348 - protein, 9 aa, Homo Sapiens
ALSGAVQQR

SEQ ID NO: 327349 - protein, 9 aa, Homo Sapiens
SHKYSLINH

SEQ ID NO: 327350 - protein, 9 aa, Homo Sapiens
MRMAIWKWH

SEQ ID NO: 327351 - protein, 9 aa, Homo Sapiens
SAAASPRPM

SEQ ID NO: 327352 - protein, 9 aa, Homo Sapiens
PESSESPSG

SEQ ID NO: 327353 - protein, 9 aa, Homo Sapiens
DHQQSRANG

SEQ ID NO: 327354 - protein, 9 aa, Homo Sapiens
MAPRLRPMC

SEQ ID NO: 327355 - protein, 9 aa, Homo Sapiens
CAAASGMKA

SEQ ID NO: 327356 - protein, 9 aa, Homo Sapiens
TFTARVLGG

SEQ ID NO: 327357 - protein, 9 aa, Homo Sapiens
LHGEACPKA

SEQ ID NO: 327358 - protein, 9 aa, Homo Sapiens
GLRAVEAEL

SEQ ID NO: 327359 - protein, 9 aa, Homo Sapiens
PTGETIYFI

SEQ ID NO: 327360 - protein, 9 aa, Homo Sapiens
GRPVGFPMW

SEQ ID NO: 327361 - protein, 9 aa, Homo Sapiens
SGSPSTWMF

SEQ ID NO: 327362 - protein, 9 aa, Homo Sapiens
LNTSWRVLI

SEQ ID NO: 327363 - protein, 9 aa, Homo Sapiens
PLHTQKDRV

SEQ ID NO: 327364 - protein, 9 aa, Homo Sapiens
LTLGHALPS

SEQ ID NO: 327365 - protein, 9 aa, Homo Sapiens
GDVPVSCSL

SEQ ID NO: 327366 - protein, 9 aa, Homo Sapiens
IRMVIIRQH

SEQ ID NO: 327367 - protein, 9 aa, Homo Sapiens
TGAISYTVE

SEQ ID NO: 327368 - protein, 9 aa, Homo Sapiens
EATLDINGV

SEQ ID NO: 327369 - protein, 9 aa, Homo Sapiens
KWPVVWGKL

SEQ ID NO: 327370 - protein, 9 aa, Homo Sapiens
RRHRQAEMG

SEQ ID NO: 327371 - protein, 9 aa, Homo Sapiens
TALPRGPPA

SEQ ID NO: 327372 - protein, 9 aa, Homo Sapiens
TCTKDWEAV

SEQ ID NO: 327373 - protein, 9 aa, Homo Sapiens
LQSPVSPIR

SEQ ID NO: 327374 - protein, 9 aa, Homo Sapiens
NSESWEPHV

SEQ ID NO: 327375 - protein, 9 aa, Homo Sapiens
AAVGVLVSL

SEQ ID NO: 327376 - protein, 9 aa, Homo Sapiens
AHGGRVTCH

SEQ ID NO: 327377 - protein, 9 aa, Homo Sapiens
VRSISLTFT

SEQ ID NO: 327378 - protein, 9 aa, Homo Sapiens
SLDMKDFWP

SEQ ID NO: 327379 - protein, 9 aa, Homo Sapiens
SNVIQQLLE

SEQ ID NO: 327380 - protein, 9 aa, Homo Sapiens
PEELGGPPP

SEQ ID NO: 327381 - protein, 9 aa, Homo Sapiens
TCEVRAAHR

SEQ ID NO: 327382 - protein, 9 aa, Homo Sapiens
SSTLLHHRR

SEQ ID NO: 327383 - protein, 9 aa, Homo Sapiens
AGVAVLIIL

SEQ ID NO: 327384 - protein, 9 aa, Homo Sapiens
IVHFQASED

SEQ ID NO: 327385 - protein, 9 aa, Homo Sapiens
GERIEKSGA

SEQ ID NO: 327386 - protein, 9 aa, Homo Sapiens
WPYIVGAVV

SEQ ID NO: 327387 - protein, 9 aa, Homo Sapiens
SLDWSSTIA

SEQ ID NO: 327388 - protein, 9 aa, Homo Sapiens
RGPPAHPAD

SEQ ID NO: 327389 - protein, 9 aa, Homo Sapiens
RFIYQPPDR

SEQ ID NO: 327390 - protein, 9 aa, Homo Sapiens
QAPACSSTS

SEQ ID NO: 327391 - protein, 9 aa, Homo Sapiens
SMAEGTGDT

SEQ ID NO: 327392 - protein, 9 aa, Homo Sapiens
DKGEWDFYW

SEQ ID NO: 327393 - protein, 9 aa, Homo Sapiens
RPVGFPMWG

SEQ ID NO: 327394 - protein, 9 aa, Homo Sapiens
TPQSPVSLV

SEQ ID NO: 327395 - protein, 9 aa, Homo Sapiens
AGFFQGPPR

SEQ ID NO: 327396 - protein, 9 aa, Homo Sapiens
PAAQALDTQ

SEQ ID NO: 327397 - protein, 9 aa, Homo Sapiens
EPVLFTRSI

SEQ ID NO: 327398 - protein, 9 aa, Homo Sapiens
WGERLHARM

SEQ ID NO: 327399 - protein, 9 aa, Homo Sapiens
SGNMELIPK

SEQ ID NO: 327400 - protein, 9 aa, Homo Sapiens
PKCAQGFIG

SEQ ID NO: 327401 - protein, 9 aa, Homo Sapiens
ENNRVLFHA

SEQ ID NO: 327402 - protein, 9 aa, Homo Sapiens
DGEGHTGQK

SEQ ID NO: 327403 - protein, 9 aa, Homo Sapiens
NTFNVMPSP

SEQ ID NO: 327404 - protein, 9 aa, Homo Sapiens
GVKPDIMHH

SEQ ID NO: 327405 - protein, 9 aa, Homo Sapiens
PYGRLTYHL

SEQ ID NO: 327406 - protein, 9 aa, Homo Sapiens
SESTVSRQG

SEQ ID NO: 327407 - protein, 9 aa, Homo Sapiens
RYVSAQPPA

SEQ ID NO: 327408 - protein, 9 aa, Homo Sapiens
QRPMRKHLS

SEQ ID NO: 327409 - protein, 9 aa, Homo Sapiens
EAEPEAAGW

SEQ ID NO: 327410 - protein, 9 aa, Homo Sapiens
MISVFICIF

SEQ ID NO: 327411 - protein, 9 aa, Homo Sapiens
DHICLENCV

SEQ ID NO: 327412 - protein, 9 aa, Homo Sapiens
YDYYSSYFG

SEQ ID NO: 327413 - protein, 9 aa, Homo Sapiens
IDLLEPVDY

SEQ ID NO: 327414 - protein, 9 aa, Homo Sapiens
EEVKKEAKK

SEQ ID NO: 327415 - protein, 9 aa, Homo Sapiens
ALRFDPMAF

SEQ ID NO: 327416 - protein, 9 aa, Homo Sapiens
TVELEAIAI

SEQ ID NO: 327417 - protein, 9 aa, Homo Sapiens
KTSGSKMAL

SEQ ID NO: 327418 - protein, 9 aa, Homo Sapiens
WQDECQYRR

SEQ ID NO: 327419 - protein, 9 aa, Homo Sapiens
DVEKRNEAL

SEQ ID NO: 327420 - protein, 9 aa, Homo Sapiens
SASPEVESG

SEQ ID NO: 327421 - protein, 9 aa, Homo Sapiens
ANGGATNQG

SEQ ID NO: 327422 - protein, 9 aa, Homo Sapiens
CSFGHFPGP

SEQ ID NO: 327423 - protein, 9 aa, Homo Sapiens
ERVLAPILL

SEQ ID NO: 327424 - protein, 9 aa, Homo Sapiens
AGGTQPVAG

SEQ ID NO: 327425 - protein, 9 aa, Homo Sapiens
YQGSVYPSQ

SEQ ID NO: 327426 - protein, 9 aa, Homo Sapiens
QLFAAVPRG

SEQ ID NO: 327427 - protein, 9 aa, Homo Sapiens
HLVMIQLLQ

SEQ ID NO: 327428 - protein, 9 aa, Homo Sapiens
PNPKDTTPA

SEQ ID NO: 327429 - protein, 9 aa, Homo Sapiens
VEPQFSLPV

SEQ ID NO: 327430 - protein, 9 aa, Homo Sapiens
WMGPGAASG

SEQ ID NO: 327431 - protein, 9 aa, Homo Sapiens
LCDQDNLSV

SEQ ID NO: 327432 - protein, 9 aa, Homo Sapiens
WWTFRCPGC

SEQ ID NO: 327433 - protein, 9 aa, Homo Sapiens
AWGERLHAR

SEQ ID NO: 327434 - protein, 9 aa, Homo Sapiens
ISSDSTHVT

SEQ ID NO: 327435 - protein, 9 aa, Homo Sapiens
IPLTRWKPL

SEQ ID NO: 327436 - protein, 9 aa, Homo Sapiens
LNNLRVHSI

SEQ ID NO: 327437 - protein, 9 aa, Homo Sapiens
SLILEAPKR

SEQ ID NO: 327438 - protein, 9 aa, Homo Sapiens
KKSVPSVAV

SEQ ID NO: 327439 - protein, 9 aa, Homo Sapiens
AHCYRYCKN

SEQ ID NO: 327440 - protein, 9 aa, Homo Sapiens
LCTARLVSL

SEQ ID NO: 327441 - protein, 9 aa, Homo Sapiens
TAHTAPAYY

SEQ ID NO: 327442 - protein, 9 aa, Homo Sapiens
TTLLTLSKT

SEQ ID NO: 327443 - protein, 9 aa, Homo Sapiens
DLGLGCSQL

SEQ ID NO: 327444 - protein, 9 aa, Homo Sapiens
SPAVSVLVS

SEQ ID NO: 327445 - protein, 9 aa, Homo Sapiens
GAEEPWQML

SEQ ID NO: 327446 - protein, 9 aa, Homo Sapiens
WPTRKAQTG

SEQ ID NO: 327447 - protein, 9 aa, Homo Sapiens
LHCTERPFP

SEQ ID NO: 327448 - protein, 9 aa, Homo Sapiens
THNTKHAIR

SEQ ID NO: 327449 - protein, 9 aa, Homo Sapiens
RVDFRLSRE

SEQ ID NO: 327450 - protein, 9 aa, Homo Sapiens
KTIGGVYQQ

SEQ ID NO: 327451 - protein, 9 aa, Homo Sapiens
GQLGLVVIV

SEQ ID NO: 327452 - protein, 9 aa, Homo Sapiens
LTVIISDLR

SEQ ID NO: 327453 - protein, 9 aa, Homo Sapiens
SGNELKSEW

SEQ ID NO: 327454 - protein, 9 aa, Homo Sapiens
YHISGVGID

SEQ ID NO: 327455 - protein, 9 aa, Homo Sapiens
QQWLLGLWQ

SEQ ID NO: 327456 - protein, 9 aa, Homo Sapiens
DYEKTSGSK

SEQ ID NO: 327457 - protein, 9 aa, Homo Sapiens
RKEALGLYQ

SEQ ID NO: 327458 - protein, 9 aa, Homo Sapiens
QCNIMRLVD

SEQ ID NO: 327459 - protein, 9 aa, Homo Sapiens
CLTYYAKPH

SEQ ID NO: 327460 - protein, 9 aa, Homo Sapiens
LSQAQVYFE

SEQ ID NO: 327461 - protein, 9 aa, Homo Sapiens
MTTTGKTNQ

SEQ ID NO: 327462 - protein, 9 aa, Homo Sapiens
IGGFATLEM

SEQ ID NO: 327463 - protein, 9 aa, Homo Sapiens
AALRRWLDL

SEQ ID NO: 327464 - protein, 9 aa, Homo Sapiens
SDLHAYIQH

SEQ ID NO: 327465 - protein, 9 aa, Homo Sapiens
RDSSLQVEN

SEQ ID NO: 327466 - protein, 9 aa, Homo Sapiens
LHFSVRQTE

SEQ ID NO: 327467 - protein, 9 aa, Homo Sapiens
GSSLSSFMT

SEQ ID NO: 327468 - protein, 9 aa, Homo Sapiens
MLLDASPQY

SEQ ID NO: 327469 - protein, 9 aa, Homo Sapiens
GARPGGRTR

SEQ ID NO: 327470 - protein, 9 aa, Homo Sapiens
KQAVCKPLE

SEQ ID NO: 327471 - protein, 9 aa, Homo Sapiens
VEVYRWDSK

SEQ ID NO: 327472 - protein, 9 aa, Homo Sapiens
KLLMRKADS

SEQ ID NO: 327473 - protein, 9 aa, Homo Sapiens
PNPVVYYLH

SEQ ID NO: 327474 - protein, 9 aa, Homo Sapiens
CWTCSRSQL

SEQ ID NO: 327475 - protein, 9 aa, Homo Sapiens
MDINNYPMA

SEQ ID NO: 327476 - protein, 9 aa, Homo Sapiens
ETAAKSKNC

SEQ ID NO: 327477 - protein, 9 aa, Homo Sapiens
LIIMLFKNF

SEQ ID NO: 327478 - protein, 9 aa, Homo Sapiens
IDNGTDDWR

SEQ ID NO: 327479 - protein, 9 aa, Homo Sapiens
QRIRRDSIG

SEQ ID NO: 327480 - protein, 9 aa, Homo Sapiens
WLPLQVRSP

SEQ ID NO: 327481 - protein, 9 aa, Homo Sapiens
ANTMGLVVE

SEQ ID NO: 327482 - protein, 9 aa, Homo Sapiens
VLLCCEASD

SEQ ID NO: 327483 - protein, 9 aa, Homo Sapiens
HGHSPPPSS

SEQ ID NO: 327484 - protein, 9 aa, Homo Sapiens
PLVSGSHLD

SEQ ID NO: 327485 - protein, 9 aa, Homo Sapiens
DLLRTSVMV

SEQ ID NO: 327486 - protein, 9 aa, Homo Sapiens
EAEGNEIYE

SEQ ID NO: 327487 - protein, 9 aa, Homo Sapiens
PLLLLLPPS

SEQ ID NO: 327488 - protein, 9 aa, Homo Sapiens
RVIGTSVAR

SEQ ID NO: 327489 - protein, 9 aa, Homo Sapiens
QSCLKECSC

SEQ ID NO: 327490 - protein, 9 aa, Homo Sapiens
KQRLKKAYF

SEQ ID NO: 327491 - protein, 9 aa, Homo Sapiens
VISWRMPGD

SEQ ID NO: 327492 - protein, 9 aa, Homo Sapiens
GQHHLPVWA

SEQ ID NO: 327493 - protein, 9 aa, Homo Sapiens
LQHEQRVLL

SEQ ID NO: 327494 - protein, 9 aa, Homo Sapiens
SKLRLLLLG

SEQ ID NO: 327495 - protein, 9 aa, Homo Sapiens
AEDGPPVFG

SEQ ID NO: 327496 - protein, 9 aa, Homo Sapiens
GPGPHGPKG

SEQ ID NO: 327497 - protein, 9 aa, Homo Sapiens
GKAKHLHLS

SEQ ID NO: 327498 - protein, 9 aa, Homo Sapiens
EKLPKLNQR

SEQ ID NO: 327499 - protein, 9 aa, Homo Sapiens
ATLEMESGE

SEQ ID NO: 327500 - protein, 9 aa, Homo Sapiens
NEYVCRVLE

SEQ ID NO: 327501 - protein, 9 aa, Homo Sapiens
GKDPVQCSH

SEQ ID NO: 327502 - protein, 9 aa, Homo Sapiens
KILKTIKSQ

SEQ ID NO: 327503 - protein, 9 aa, Homo Sapiens
PPRRGSLPD

SEQ ID NO: 327504 - protein, 9 aa, Homo Sapiens
EGGSSPIPL

SEQ ID NO: 327505 - protein, 9 aa, Homo Sapiens
LLVCFLFFC

SEQ ID NO: 327506 - protein, 9 aa, Homo Sapiens
SRAHCPANG

SEQ ID NO: 327507 - protein, 9 aa, Homo Sapiens
DVPVSCSLS

SEQ ID NO: 327508 - protein, 9 aa, Homo Sapiens
TDRLVPDQE

SEQ ID NO: 327509 - protein, 9 aa, Homo Sapiens
DTDAADAAA

SEQ ID NO: 327510 - protein, 9 aa, Homo Sapiens
YTVPCTILA

SEQ ID NO: 327511 - protein, 9 aa, Homo Sapiens
VSMSKNNYE

SEQ ID NO: 327512 - protein, 9 aa, Homo Sapiens
GWGDVPIIA

SEQ ID NO: 327513 - protein, 9 aa, Homo Sapiens
QVSWEYGGE

SEQ ID NO: 327514 - protein, 9 aa, Homo Sapiens
GIPARSGTT

SEQ ID NO: 327515 - protein, 9 aa, Homo Sapiens
YPKMCQYLR

SEQ ID NO: 327516 - protein, 9 aa, Homo Sapiens
NSTFGATNL

SEQ ID NO: 327517 - protein, 9 aa, Homo Sapiens
PDMVQDLES

SEQ ID NO: 327518 - protein, 9 aa, Homo Sapiens
VGLARSEES

SEQ ID NO: 327519 - protein, 9 aa, Homo Sapiens
ISCPNAVVG

SEQ ID NO: 327520 - protein, 9 aa, Homo Sapiens
LVMHARGVL

SEQ ID NO: 327521 - protein, 9 aa, Homo Sapiens
KKAYGSQKH

SEQ ID NO: 327522 - protein, 9 aa, Homo Sapiens
QECGHLHMV

SEQ ID NO: 327523 - protein, 9 aa, Homo Sapiens
MHISRFTRL

SEQ ID NO: 327524 - protein, 9 aa, Homo Sapiens
PLKGRLVIS

SEQ ID NO: 327525 - protein, 9 aa, Homo Sapiens
WPPRAGLGG

SEQ ID NO: 327526 - protein, 9 aa, Homo Sapiens
QTIQCEKAK

SEQ ID NO: 327527 - protein, 9 aa, Homo Sapiens
MMFSGLQGA

SEQ ID NO: 327528 - protein, 9 aa, Homo Sapiens
KSGAFRLVF

SEQ ID NO: 327529 - protein, 9 aa, Homo Sapiens
SWLFDLHGE

SEQ ID NO: 327530 - protein, 9 aa, Homo Sapiens
TTISHQAIQ

SEQ ID NO: 327531 - protein, 9 aa, Homo Sapiens
HVNKLRAKS

SEQ ID NO: 327532 - protein, 9 aa, Homo Sapiens
PMSVAASQG

SEQ ID NO: 327533 - protein, 9 aa, Homo Sapiens
GDRVAGRLV

SEQ ID NO: 327534 - protein, 9 aa, Homo Sapiens
WWRQGFAVL

SEQ ID NO: 327535 - protein, 9 aa, Homo Sapiens
MTRLLRDYQ

SEQ ID NO: 327536 - protein, 9 aa, Homo Sapiens
KYGALTKDS

SEQ ID NO: 327537 - protein, 9 aa, Homo Sapiens
QPMPNPVVY

SEQ ID NO: 327538 - protein, 9 aa, Homo Sapiens
VKMVVCRNV

SEQ ID NO: 327539 - protein, 9 aa, Homo Sapiens
LCHLPWIYQ

SEQ ID NO: 327540 - protein, 9 aa, Homo Sapiens
LRYQFSHPG

SEQ ID NO: 327541 - protein, 9 aa, Homo Sapiens
RRFCCFGNF

SEQ ID NO: 327542 - protein, 9 aa, Homo Sapiens
HILVHLETD

SEQ ID NO: 327543 - protein, 9 aa, Homo Sapiens
ARLTISGLF

SEQ ID NO: 327544 - protein, 9 aa, Homo Sapiens
GHFWMFHRQ

SEQ ID NO: 327545 - protein, 9 aa, Homo Sapiens
RHKVNPNMK

SEQ ID NO: 327546 - protein, 9 aa, Homo Sapiens
EEWEFTARG

SEQ ID NO: 327547 - protein, 9 aa, Homo Sapiens
RSSWHTGRC

SEQ ID NO: 327548 - protein, 9 aa, Homo Sapiens
ATGFSPPVN

SEQ ID NO: 327549 - protein, 9 aa, Homo Sapiens
SSIQVDTFR

SEQ ID NO: 327550 - protein, 9 aa, Homo Sapiens
APRQDVWEW

SEQ ID NO: 327551 - protein, 9 aa, Homo Sapiens
NRQVALCDQ

SEQ ID NO: 327552 - protein, 9 aa, Homo Sapiens
DSIMDVIFL

SEQ ID NO: 327553 - protein, 9 aa, Homo Sapiens
VAWAADAQV

SEQ ID NO: 327554 - protein, 9 aa, Homo Sapiens
GTCKETKDV

SEQ ID NO: 327555 - protein, 9 aa, Homo Sapiens
LGEHEKVLH

SEQ ID NO: 327556 - protein, 9 aa, Homo Sapiens
RRKKRRMCS

SEQ ID NO: 327557 - protein, 9 aa, Homo Sapiens
AGAYLIHRG

SEQ ID NO: 327558 - protein, 9 aa, Homo Sapiens
LCICARDKE

SEQ ID NO: 327559 - protein, 9 aa, Homo Sapiens
HLHNAASKL

SEQ ID NO: 327560 - protein, 9 aa, Homo Sapiens
CCDDERYWP

SEQ ID NO: 327561 - protein, 9 aa, Homo Sapiens
VFRQNSHLV

SEQ ID NO: 327562 - protein, 9 aa, Homo Sapiens
KAELAKKNR

SEQ ID NO: 327563 - protein, 9 aa, Homo Sapiens
LFSYCMGNV

SEQ ID NO: 327564 - protein, 9 aa, Homo Sapiens
SPRRCLQRS

SEQ ID NO: 327565 - protein, 9 aa, Homo Sapiens
WVLHQDPHE

SEQ ID NO: 327566 - protein, 9 aa, Homo Sapiens
HMCRHKKPE

SEQ ID NO: 327567 - protein, 9 aa, Homo Sapiens
CCEASDKSQ

SEQ ID NO: 327568 - protein, 9 aa, Homo Sapiens
RAGIKRLWT

SEQ ID NO: 327569 - protein, 9 aa, Homo Sapiens
HWLTWVLLP

SEQ ID NO: 327570 - protein, 9 aa, Homo Sapiens
IAIYKVLQS

SEQ ID NO: 327571 - protein, 9 aa, Homo Sapiens
TCELYLEDS

SEQ ID NO: 327572 - protein, 9 aa, Homo Sapiens
TEIMAVLFF

SEQ ID NO: 327573 - protein, 9 aa, Homo Sapiens
ETKKKDDIQ

SEQ ID NO: 327574 - protein, 9 aa, Homo Sapiens
MARVQNHHT

SEQ ID NO: 327575 - protein, 9 aa, Homo Sapiens
KKQEPPCTR

SEQ ID NO: 327576 - protein, 9 aa, Homo Sapiens
RDSIGVWNY

SEQ ID NO: 327577 - protein, 9 aa, Homo Sapiens
VAIFTGECV

SEQ ID NO: 327578 - protein, 9 aa, Homo Sapiens
LSMIDLLEP

SEQ ID NO: 327579 - protein, 9 aa, Homo Sapiens
TDDWRIAMT

SEQ ID NO: 327580 - protein, 9 aa, Homo Sapiens
RFCCFGNFI

SEQ ID NO: 327581 - protein, 9 aa, Homo Sapiens
NVQGCHCQE

SEQ ID NO: 327582 - protein, 9 aa, Homo Sapiens
QRLKKAYFQ

SEQ ID NO: 327583 - protein, 9 aa, Homo Sapiens
LLVVPEDVE

SEQ ID NO: 327584 - protein, 9 aa, Homo Sapiens
INENAPVTE

SEQ ID NO: 327585 - protein, 9 aa, Homo Sapiens
FMLKCCGNG

SEQ ID NO: 327586 - protein, 9 aa, Homo Sapiens
KSVYVVSSN

SEQ ID NO: 327587 - protein, 9 aa, Homo Sapiens
AVGEQEGAC

SEQ ID NO: 327588 - protein, 9 aa, Homo Sapiens
YFKAARIDI

SEQ ID NO: 327589 - protein, 9 aa, Homo Sapiens
APGTKRKRP

SEQ ID NO: 327590 - protein, 9 aa, Homo Sapiens
PRSSWPVGQ

SEQ ID NO: 327591 - protein, 9 aa, Homo Sapiens
SPSPPAAGS

SEQ ID NO: 327592 - protein, 9 aa, Homo Sapiens
EMNVAAKYH

SEQ ID NO: 327593 - protein, 9 aa, Homo Sapiens
CMYDEKAHE

SEQ ID NO: 327594 - protein, 9 aa, Homo Sapiens
HITHCWQDL

SEQ ID NO: 327595 - protein, 9 aa, Homo Sapiens
ISRHFYMAK

SEQ ID NO: 327596 - protein, 9 aa, Homo Sapiens
NSNVVNFAS

SEQ ID NO: 327597 - protein, 9 aa, Homo Sapiens
RPPPMRPVQ

SEQ ID NO: 327598 - protein, 9 aa, Homo Sapiens
SCCVPTRLR

SEQ ID NO: 327599 - protein, 9 aa, Homo Sapiens
CSQLQLFPL

SEQ ID NO: 327600 - protein, 9 aa, Homo Sapiens
MRGLKRQSD

SEQ ID NO: 327601 - protein, 9 aa, Homo Sapiens
LETGKYVKV

SEQ ID NO: 327602 - protein, 9 aa, Homo Sapiens
PKTLVGLAR

SEQ ID NO: 327603 - protein, 9 aa, Homo Sapiens
HTLLHNACA

SEQ ID NO: 327604 - protein, 9 aa, Homo Sapiens
GGSGGSGLS

SEQ ID NO: 327605 - protein, 9 aa, Homo Sapiens
IDFSFCLTG

SEQ ID NO: 327606 - protein, 9 aa, Homo Sapiens
VHSRVPMMN

SEQ ID NO: 327607 - protein, 9 aa, Homo Sapiens
HGQPPLSTT

SEQ ID NO: 327608 - protein, 9 aa, Homo Sapiens
LNGESMAGP

SEQ ID NO: 327609 - protein, 9 aa, Homo Sapiens
FRNRNSQMI

SEQ ID NO: 327610 - protein, 9 aa, Homo Sapiens
DVLRSVIFF

SEQ ID NO: 327611 - protein, 9 aa, Homo Sapiens
LQDQQKPVV

SEQ ID NO: 327612 - protein, 9 aa, Homo Sapiens
ESLTISSPF

SEQ ID NO: 327613 - protein, 9 aa, Homo Sapiens
PRPLQRVRH

SEQ ID NO: 327614 - protein, 9 aa, Homo Sapiens
DLETGKYVK

SEQ ID NO: 327615 - protein, 9 aa, Homo Sapiens
WGPEREVII

SEQ ID NO: 327616 - protein, 9 aa, Homo Sapiens
QDQQKPVVC

SEQ ID NO: 327617 - protein, 9 aa, Homo Sapiens
HPLRVFAAV

SEQ ID NO: 327618 - protein, 9 aa, Homo Sapiens
DIIVLWRKV

SEQ ID NO: 327619 - protein, 9 aa, Homo Sapiens
GQHPNGWYI

SEQ ID NO: 327620 - protein, 9 aa, Homo Sapiens
KIHGCVGDS

SEQ ID NO: 327621 - protein, 9 aa, Homo Sapiens
LGLGDRRVQ

SEQ ID NO: 327622 - protein, 9 aa, Homo Sapiens
FQGSASAPP

SEQ ID NO: 327623 - protein, 9 aa, Homo Sapiens
HKVNPNMKS

SEQ ID NO: 327624 - protein, 9 aa, Homo Sapiens
DTHQCRRLY

SEQ ID NO: 327625 - protein, 9 aa, Homo Sapiens
PPTNMPTPT

SEQ ID NO: 327626 - protein, 9 aa, Homo Sapiens
PWLPMRSLG

SEQ ID NO: 327627 - protein, 9 aa, Homo Sapiens
QRQAMERPP

SEQ ID NO: 327628 - protein, 9 aa, Homo Sapiens
NWTNYNTFG

SEQ ID NO: 327629 - protein, 9 aa, Homo Sapiens
VTFLQLADQ

SEQ ID NO: 327630 - protein, 9 aa, Homo Sapiens
KSEHSKPPL

SEQ ID NO: 327631 - protein, 9 aa, Homo Sapiens
DVPLDHHVH

SEQ ID NO: 327632 - protein, 9 aa, Homo Sapiens
IQNRIVHSP

SEQ ID NO: 327633 - protein, 9 aa, Homo Sapiens
PFFTHPLLS

SEQ ID NO: 327634 - protein, 9 aa, Homo Sapiens
PPESCVSQG

SEQ ID NO: 327635 - protein, 9 aa, Homo Sapiens
GAPPRARPG

SEQ ID NO: 327636 - protein, 9 aa, Homo Sapiens
SQPNPATAD

SEQ ID NO: 327637 - protein, 9 aa, Homo Sapiens
PSSARPWGP

SEQ ID NO: 327638 - protein, 9 aa, Homo Sapiens
IPKTTGEGT

SEQ ID NO: 327639 - protein, 9 aa, Homo Sapiens
IPGTVVQTS

SEQ ID NO: 327640 - protein, 9 aa, Homo Sapiens
ITKQSPMLQ

SEQ ID NO: 327641 - protein, 9 aa, Homo Sapiens
DRGLKSKEQ

SEQ ID NO: 327642 - protein, 9 aa, Homo Sapiens
VKGFSNRAQ

SEQ ID NO: 327643 - protein, 9 aa, Homo Sapiens
STSPTDVSS

SEQ ID NO: 327644 - protein, 9 aa, Homo Sapiens
DFLKMRLSK

SEQ ID NO: 327645 - protein, 9 aa, Homo Sapiens
GVAKGAIMR

SEQ ID NO: 327646 - protein, 9 aa, Homo Sapiens
LCVDDQCHG

SEQ ID NO: 327647 - protein, 9 aa, Homo Sapiens
GKSRWRKED

SEQ ID NO: 327648 - protein, 9 aa, Homo Sapiens
GMGLQLLRL

SEQ ID NO: 327649 - protein, 9 aa, Homo Sapiens
IAAIIAIIA

SEQ ID NO: 327650 - protein, 9 aa, Homo Sapiens
LSWKGHVPK

SEQ ID NO: 327651 - protein, 9 aa, Homo Sapiens
MAAEVVVPR

SEQ ID NO: 327652 - protein, 9 aa, Homo Sapiens
EILSDACWA

SEQ ID NO: 327653 - protein, 9 aa, Homo Sapiens
LTHSMKSEE

SEQ ID NO: 327654 - protein, 9 aa, Homo Sapiens
HNKVIELPR

SEQ ID NO: 327655 - protein, 9 aa, Homo Sapiens
HPLEVGLVL

SEQ ID NO: 327656 - protein, 9 aa, Homo Sapiens
KLDPLLLLI

SEQ ID NO: 327657 - protein, 9 aa, Homo Sapiens
RLDRKKCTV

SEQ ID NO: 327658 - protein, 9 aa, Homo Sapiens
LFVIDNGTD

SEQ ID NO: 327659 - protein, 9 aa, Homo Sapiens
LVLQILVVI

SEQ ID NO: 327660 - protein, 9 aa, Homo Sapiens
SQPRENSMR

SEQ ID NO: 327661 - protein, 9 aa, Homo Sapiens
LHAYIQHRV

SEQ ID NO: 327662 - protein, 9 aa, Homo Sapiens
KPPWMDTAP

SEQ ID NO: 327663 - protein, 9 aa, Homo Sapiens
CACTNNGTC

SEQ ID NO: 327664 - protein, 9 aa, Homo Sapiens
LNIQIVLVG

SEQ ID NO: 327665 - protein, 9 aa, Homo Sapiens
LWRKVDEQW

SEQ ID NO: 327666 - protein, 9 aa, Homo Sapiens
IIVFGELLL

SEQ ID NO: 327667 - protein, 9 aa, Homo Sapiens
KFPFFTHPL

SEQ ID NO: 327668 - protein, 9 aa, Homo Sapiens
TGPSLFESI

SEQ ID NO: 327669 - protein, 9 aa, Homo Sapiens
QDQVLEVEP

SEQ ID NO: 327670 - protein, 9 aa, Homo Sapiens
GKWSLELPV

SEQ ID NO: 327671 - protein, 9 aa, Homo Sapiens
VVNEILEDI

SEQ ID NO: 327672 - protein, 9 aa, Homo Sapiens
LDMLHRLGI

SEQ ID NO: 327673 - protein, 9 aa, Homo Sapiens
THCSGASRR

SEQ ID NO: 327674 - protein, 9 aa, Homo Sapiens
TFAGAEVLL

SEQ ID NO: 327675 - protein, 9 aa, Homo Sapiens
VGGQLGKEA

SEQ ID NO: 327676 - protein, 9 aa, Homo Sapiens
GIQAPACSS

SEQ ID NO: 327677 - protein, 9 aa, Homo Sapiens
CVFQGLTPT

SEQ ID NO: 327678 - protein, 9 aa, Homo Sapiens
TTVLQEWLC

SEQ ID NO: 327679 - protein, 9 aa, Homo Sapiens
LDPLRKSPA

SEQ ID NO: 327680 - protein, 9 aa, Homo Sapiens
TGLRLWKVD

SEQ ID NO: 327681 - protein, 9 aa, Homo Sapiens
FLARWGPSP

SEQ ID NO: 327682 - protein, 9 aa, Homo Sapiens
VEMDIVVDH

SEQ ID NO: 327683 - protein, 9 aa, Homo Sapiens
ARLRHKVQD

SEQ ID NO: 327684 - protein, 9 aa, Homo Sapiens
WDGDHITHC

SEQ ID NO: 327685 - protein, 9 aa, Homo Sapiens
IIVLWRKVD

SEQ ID NO: 327686 - protein, 9 aa, Homo Sapiens
IHSDLHAYI

SEQ ID NO: 327687 - protein, 9 aa, Homo Sapiens
VQEAVSRVK

SEQ ID NO: 327688 - protein, 9 aa, Homo Sapiens
ARCESKADW

SEQ ID NO: 327689 - protein, 9 aa, Homo Sapiens
RRLQSPSKK

SEQ ID NO: 327690 - protein, 9 aa, Homo Sapiens
LGLQKKLHT

SEQ ID NO: 327691 - protein, 9 aa, Homo Sapiens
KNKASILQK

SEQ ID NO: 327692 - protein, 9 aa, Homo Sapiens
MTAISFHQV

SEQ ID NO: 327693 - protein, 9 aa, Homo Sapiens
HEDLNHIQN

SEQ ID NO: 327694 - protein, 9 aa, Homo Sapiens
LPTLAVYSH

SEQ ID NO: 327695 - protein, 9 aa, Homo Sapiens
KMQGRRYHS

SEQ ID NO: 327696 - protein, 9 aa, Homo Sapiens
LGQPYNSAV

SEQ ID NO: 327697 - protein, 9 aa, Homo Sapiens
KCIFTQFWI

SEQ ID NO: 327698 - protein, 9 aa, Homo Sapiens
EVVAASEGD

SEQ ID NO: 327699 - protein, 9 aa, Homo Sapiens
HSDMTTSSL

SEQ ID NO: 327700 - protein, 9 aa, Homo Sapiens
ACNKFGTAL

SEQ ID NO: 327701 - protein, 9 aa, Homo Sapiens
QLITIHKAH

SEQ ID NO: 327702 - protein, 9 aa, Homo Sapiens
RKSHHHRHH

SEQ ID NO: 327703 - protein, 9 aa, Homo Sapiens
YVVICHPLR

SEQ ID NO: 327704 - protein, 9 aa, Homo Sapiens
TASGLCSNK

SEQ ID NO: 327705 - protein, 9 aa, Homo Sapiens
PTTLYHFNA

SEQ ID NO: 327706 - protein, 9 aa, Homo Sapiens
KEKELDRNP

SEQ ID NO: 327707 - protein, 9 aa, Homo Sapiens
RIEKSGAFR

SEQ ID NO: 327708 - protein, 9 aa, Homo Sapiens
TDSADFRHS

SEQ ID NO: 327709 - protein, 9 aa, Homo Sapiens
SPNVPSCCL

SEQ ID NO: 327710 - protein, 9 aa, Homo Sapiens
TKAVFSLDR

SEQ ID NO: 327711 - protein, 9 aa, Homo Sapiens
QTGLSLHDR

SEQ ID NO: 327712 - protein, 9 aa, Homo Sapiens
YQDFGNHQV

SEQ ID NO: 327713 - protein, 9 aa, Homo Sapiens
GWQEVVAAS

SEQ ID NO: 327714 - protein, 9 aa, Homo Sapiens
QKNLESGMN

SEQ ID NO: 327715 - protein, 9 aa, Homo Sapiens
GGLALSAFL

SEQ ID NO: 327716 - protein, 9 aa, Homo Sapiens
EQEAPGMAL

SEQ ID NO: 327717 - protein, 9 aa, Homo Sapiens
SMAGPTHQD

SEQ ID NO: 327718 - protein, 9 aa, Homo Sapiens
WSSNEDSHI

SEQ ID NO: 327719 - protein, 9 aa, Homo Sapiens
GHCNSLLGP

SEQ ID NO: 327720 - protein, 9 aa, Homo Sapiens
KSTRPGAGP

SEQ ID NO: 327721 - protein, 9 aa, Homo Sapiens
PATFTAHTA

SEQ ID NO: 327722 - protein, 9 aa, Homo Sapiens
PSMPTLIAP

SEQ ID NO: 327723 - protein, 9 aa, Homo Sapiens
PVFSRDDSK

SEQ ID NO: 327724 - protein, 9 aa, Homo Sapiens
SCYLDWIHG

SEQ ID NO: 327725 - protein, 9 aa, Homo Sapiens
DLLMIALGV

SEQ ID NO: 327726 - protein, 9 aa, Homo Sapiens
PSQHQGLPG

SEQ ID NO: 327727 - protein, 9 aa, Homo Sapiens
ADEFANETQ

SEQ ID NO: 327728 - protein, 9 aa, Homo Sapiens
LAPILLDNF

SEQ ID NO: 327729 - protein, 9 aa, Homo Sapiens
NYKIGPSSH

SEQ ID NO: 327730 - protein, 9 aa, Homo Sapiens
ESQWPIQMV

SEQ ID NO: 327731 - protein, 9 aa, Homo Sapiens
ALLCGTYFS

SEQ ID NO: 327732 - protein, 9 aa, Homo Sapiens
MYYTLPRKP

SEQ ID NO: 327733 - protein, 9 aa, Homo Sapiens
KLAVQMDKP

SEQ ID NO: 327734 - protein, 9 aa, Homo Sapiens
TEKMVFPLA

SEQ ID NO: 327735 - protein, 9 aa, Homo Sapiens
VTGLMFLCS

SEQ ID NO: 327736 - protein, 9 aa, Homo Sapiens
QPVAGAQEP

SEQ ID NO: 327737 - protein, 9 aa, Homo Sapiens
IGMESTGIH

SEQ ID NO: 327738 - protein, 9 aa, Homo Sapiens
NRSPGSDPF

SEQ ID NO: 327739 - protein, 9 aa, Homo Sapiens
LNQRLSHPG

SEQ ID NO: 327740 - protein, 9 aa, Homo Sapiens
LHIEDIKKL

SEQ ID NO: 327741 - protein, 9 aa, Homo Sapiens
GPFGPVKLT

SEQ ID NO: 327742 - protein, 9 aa, Homo Sapiens
AFQGSASAP

SEQ ID NO: 327743 - protein, 9 aa, Homo Sapiens
GKKPFKCYK

SEQ ID NO: 327744 - protein, 9 aa, Homo Sapiens
QKGECILAS

SEQ ID NO: 327745 - protein, 9 aa, Homo Sapiens
GWMDDVINI

SEQ ID NO: 327746 - protein, 9 aa, Homo Sapiens
EQEQDLLEK

SEQ ID NO: 327747 - protein, 9 aa, Homo Sapiens
GGGGSPSRS

SEQ ID NO: 327748 - protein, 9 aa, Homo Sapiens
KAYGSQKHL

SEQ ID NO: 327749 - protein, 9 aa, Homo Sapiens
GVPWHDLGS

SEQ ID NO: 327750 - protein, 9 aa, Homo Sapiens
GRKRHTLLH

SEQ ID NO: 327751 - protein, 9 aa, Homo Sapiens
TYSGAPPRA

SEQ ID NO: 327752 - protein, 9 aa, Homo Sapiens
VPDFILMGL

SEQ ID NO: 327753 - protein, 9 aa, Homo Sapiens
QPHCLGQLG

SEQ ID NO: 327754 - protein, 9 aa, Homo Sapiens
SRSWKLILA

SEQ ID NO: 327755 - protein, 9 aa, Homo Sapiens
NELKSEWEL

SEQ ID NO: 327756 - protein, 9 aa, Homo Sapiens
CMSLTSSTG

SEQ ID NO: 327757 - protein, 9 aa, Homo Sapiens
LEVVSMYYT

SEQ ID NO: 327758 - protein, 9 aa, Homo Sapiens
PWMLGNANH

SEQ ID NO: 327759 - protein, 9 aa, Homo Sapiens
DGVVQHELQ

SEQ ID NO: 327760 - protein, 9 aa, Homo Sapiens
EDSYNGWGQ

SEQ ID NO: 327761 - protein, 9 aa, Homo Sapiens
VMVALASVS

SEQ ID NO: 327762 - protein, 9 aa, Homo Sapiens
THSHFLAQL

SEQ ID NO: 327763 - protein, 9 aa, Homo Sapiens
VAIDLHEAV

SEQ ID NO: 327764 - protein, 9 aa, Homo Sapiens
GQLPALRPL

SEQ ID NO: 327765 - protein, 9 aa, Homo Sapiens
DCLPAKSPD

SEQ ID NO: 327766 - protein, 9 aa, Homo Sapiens
AYGSQKHLR

SEQ ID NO: 327767 - protein, 9 aa, Homo Sapiens
AVPLRAGVR

SEQ ID NO: 327768 - protein, 9 aa, Homo Sapiens
EKAGIICYA

SEQ ID NO: 327769 - protein, 9 aa, Homo Sapiens
KDRTHDVTE

SEQ ID NO: 327770 - protein, 9 aa, Homo Sapiens
PLHLTTQHR

SEQ ID NO: 327771 - protein, 9 aa, Homo Sapiens
VALCDIEMS

SEQ ID NO: 327772 - protein, 9 aa, Homo Sapiens
ISFFFMYMV

SEQ ID NO: 327773 - protein, 9 aa, Homo Sapiens
KKRVVKKTT

SEQ ID NO: 327774 - protein, 9 aa, Homo Sapiens
VFRVLIPQI

SEQ ID NO: 327775 - protein, 9 aa, Homo Sapiens
AWRFWRKRA

SEQ ID NO: 327776 - protein, 9 aa, Homo Sapiens
LTAKISSPH

SEQ ID NO: 327777 - protein, 9 aa, Homo Sapiens
GVHPATFTA

SEQ ID NO: 327778 - protein, 9 aa, Homo Sapiens
HKVQDARDQ

SEQ ID NO: 327779 - protein, 9 aa, Homo Sapiens
HDENVQGCH

SEQ ID NO: 327780 - protein, 9 aa, Homo Sapiens
IFGCKSYPM

SEQ ID NO: 327781 - protein, 9 aa, Homo Sapiens
AQAWGERLH

SEQ ID NO: 327782 - protein, 9 aa, Homo Sapiens
EGLAQSKLM

SEQ ID NO: 327783 - protein, 9 aa, Homo Sapiens
QDQNKYKEA

SEQ ID NO: 327784 - protein, 9 aa, Homo Sapiens
GEPACVLCN

SEQ ID NO: 327785 - protein, 9 aa, Homo Sapiens
AGPPGGPQV

SEQ ID NO: 327786 - protein, 9 aa, Homo Sapiens
KGPKFYFEN

SEQ ID NO: 327787 - protein, 9 aa, Homo Sapiens
VGWTETNTE

SEQ ID NO: 327788 - protein, 9 aa, Homo Sapiens
PCRCFLFTV

SEQ ID NO: 327789 - protein, 9 aa, Homo Sapiens
ILKLLGKPN

SEQ ID NO: 327790 - protein, 9 aa, Homo Sapiens
KKKAYGSQK

SEQ ID NO: 327791 - protein, 9 aa, Homo Sapiens
VMGSKAAGA

SEQ ID NO: 327792 - protein, 9 aa, Homo Sapiens
DCCDDERYW

SEQ ID NO: 327793 - protein, 9 aa, Homo Sapiens
AIMIPPIPK

SEQ ID NO: 327794 - protein, 9 aa, Homo Sapiens
VYRWDSKKL

SEQ ID NO: 327795 - protein, 9 aa, Homo Sapiens
LQFVSSLRR

SEQ ID NO: 327796 - protein, 9 aa, Homo Sapiens
NSKSPTSPM

SEQ ID NO: 327797 - protein, 9 aa, Homo Sapiens
SGIMIPKPP

SEQ ID NO: 327798 - protein, 9 aa, Homo Sapiens
DIDKDGIGD

SEQ ID NO: 327799 - protein, 9 aa, Homo Sapiens
PQLARRPHQ

SEQ ID NO: 327800 - protein, 9 aa, Homo Sapiens
NTSDLRYKE

SEQ ID NO: 327801 - protein, 9 aa, Homo Sapiens
VFQQGLVFL

SEQ ID NO: 327802 - protein, 9 aa, Homo Sapiens
SISPPKTPV

SEQ ID NO: 327803 - protein, 9 aa, Homo Sapiens
GIEFHYVYS

SEQ ID NO: 327804 - protein, 9 aa, Homo Sapiens
LPKGEPKHY

SEQ ID NO: 327805 - protein, 9 aa, Homo Sapiens
RNFSRQSSL

SEQ ID NO: 327806 - protein, 9 aa, Homo Sapiens
RSREDMIDT

SEQ ID NO: 327807 - protein, 9 aa, Homo Sapiens
ETFCFPASP

SEQ ID NO: 327808 - protein, 9 aa, Homo Sapiens
RSTYYNWWR

SEQ ID NO: 327809 - protein, 9 aa, Homo Sapiens
ADAARGLKG

SEQ ID NO: 327810 - protein, 9 aa, Homo Sapiens
YTGLFLFTF

SEQ ID NO: 327811 - protein, 9 aa, Homo Sapiens
KKAPPKAKM

SEQ ID NO: 327812 - protein, 9 aa, Homo Sapiens
EQSCQMSKL

SEQ ID NO: 327813 - protein, 9 aa, Homo Sapiens
SQDQVLEVE

SEQ ID NO: 327814 - protein, 9 aa, Homo Sapiens
TTSSLHFAS

SEQ ID NO: 327815 - protein, 9 aa, Homo Sapiens
LSHKLCRKL

SEQ ID NO: 327816 - protein, 9 aa, Homo Sapiens
SISFNRVLG

SEQ ID NO: 327817 - protein, 9 aa, Homo Sapiens
GCLTYYAKP

SEQ ID NO: 327818 - protein, 9 aa, Homo Sapiens
RNQSERGPH

SEQ ID NO: 327819 - protein, 9 aa, Homo Sapiens
LAAGYGLIS

SEQ ID NO: 327820 - protein, 9 aa, Homo Sapiens
PAPWLPMRS

SEQ ID NO: 327821 - protein, 9 aa, Homo Sapiens
PQALEDVKM

SEQ ID NO: 327822 - protein, 9 aa, Homo Sapiens
RSAACGGRE

SEQ ID NO: 327823 - protein, 9 aa, Homo Sapiens
GPLQADLHA

SEQ ID NO: 327824 - protein, 9 aa, Homo Sapiens
RAEMQMPWS

SEQ ID NO: 327825 - protein, 9 aa, Homo Sapiens
DFVINENAP

SEQ ID NO: 327826 - protein, 9 aa, Homo Sapiens
GQEAAFADN

SEQ ID NO: 327827 - protein, 9 aa, Homo Sapiens
FTVTLEQAR

SEQ ID NO: 327828 - protein, 9 aa, Homo Sapiens
CVTLVSVRV

SEQ ID NO: 327829 - protein, 9 aa, Homo Sapiens
KFYSHKYSL

SEQ ID NO: 327830 - protein, 9 aa, Homo Sapiens
FINPGEDDL

SEQ ID NO: 327831 - protein, 9 aa, Homo Sapiens
LLLIPRQLH

SEQ ID NO: 327832 - protein, 9 aa, Homo Sapiens
VVDISGRFM

SEQ ID NO: 327833 - protein, 9 aa, Homo Sapiens
NPERFLCEN

SEQ ID NO: 327834 - protein, 9 aa, Homo Sapiens
EMLNNVWDF

SEQ ID NO: 327835 - protein, 9 aa, Homo Sapiens
PCTILAPNE

SEQ ID NO: 327836 - protein, 9 aa, Homo Sapiens
TEEAGATTE

SEQ ID NO: 327837 - protein, 9 aa, Homo Sapiens
SKRKKQKKN

SEQ ID NO: 327838 - protein, 9 aa, Homo Sapiens
IPDCLPAKS

SEQ ID NO: 327839 - protein, 9 aa, Homo Sapiens
TRLPLCSPR

SEQ ID NO: 327840 - protein, 9 aa, Homo Sapiens
DSMPSRTHS

SEQ ID NO: 327841 - protein, 9 aa, Homo Sapiens
IFGVVSNLV

SEQ ID NO: 327842 - protein, 9 aa, Homo Sapiens
HGLVQPGAV

SEQ ID NO: 327843 - protein, 9 aa, Homo Sapiens
ARVCYYQSL

SEQ ID NO: 327844 - protein, 9 aa, Homo Sapiens
VACLLDKGL

SEQ ID NO: 327845 - protein, 9 aa, Homo Sapiens
RRDSIGVWN

SEQ ID NO: 327846 - protein, 9 aa, Homo Sapiens
NGQHPNGWY

SEQ ID NO: 327847 - protein, 9 aa, Homo Sapiens
QEFHSNTDH

SEQ ID NO: 327848 - protein, 9 aa, Homo Sapiens
EYVCRVLEL

SEQ ID NO: 327849 - protein, 9 aa, Homo Sapiens
GDWFTAMDA

SEQ ID NO: 327850 - protein, 9 aa, Homo Sapiens
PDRIMNTFN

SEQ ID NO: 327851 - protein, 9 aa, Homo Sapiens
IQIVSTTCE

SEQ ID NO: 327852 - protein, 9 aa, Homo Sapiens
MVVSCPHKC

SEQ ID NO: 327853 - protein, 9 aa, Homo Sapiens
QSKLMRLPS

SEQ ID NO: 327854 - protein, 9 aa, Homo Sapiens
KGKKRRRRR

SEQ ID NO: 327855 - protein, 9 aa, Homo Sapiens
TKSALKCHG

SEQ ID NO: 327856 - protein, 9 aa, Homo Sapiens
METEVVNEI

SEQ ID NO: 327857 - protein, 9 aa, Homo Sapiens
YLLPTGETI

SEQ ID NO: 327858 - protein, 9 aa, Homo Sapiens
IQIVLVGVE

SEQ ID NO: 327859 - protein, 9 aa, Homo Sapiens
PNINTVATL

SEQ ID NO: 327860 - protein, 9 aa, Homo Sapiens
SCDVKLVKK

SEQ ID NO: 327861 - protein, 9 aa, Homo Sapiens
PVPYVVPLS

SEQ ID NO: 327862 - protein, 9 aa, Homo Sapiens
HSIQNRIVH

SEQ ID NO: 327863 - protein, 9 aa, Homo Sapiens
DEHQGEGTT

SEQ ID NO: 327864 - protein, 9 aa, Homo Sapiens
LHALATGFS

SEQ ID NO: 327865 - protein, 9 aa, Homo Sapiens
IALRYQLQH

SEQ ID NO: 327866 - protein, 9 aa, Homo Sapiens
RPSQRRPHR

SEQ ID NO: 327867 - protein, 9 aa, Homo Sapiens
PPGLPNASS

SEQ ID NO: 327868 - protein, 9 aa, Homo Sapiens
TVQIEGSSG

SEQ ID NO: 327869 - protein, 9 aa, Homo Sapiens
PALAPPEPP

SEQ ID NO: 327870 - protein, 9 aa, Homo Sapiens
GSKMALSTG

SEQ ID NO: 327871 - protein, 9 aa, Homo Sapiens
DWPPRAGLG

SEQ ID NO: 327872 - protein, 9 aa, Homo Sapiens
SKNNYEKFK

SEQ ID NO: 327873 - protein, 9 aa, Homo Sapiens
QQIVCGMNQ

SEQ ID NO: 327874 - protein, 9 aa, Homo Sapiens
PRSWFAHGH

SEQ ID NO: 327875 - protein, 9 aa, Homo Sapiens
QIAELQVQI

SEQ ID NO: 327876 - protein, 9 aa, Homo Sapiens
HGPSMPTLI

SEQ ID NO: 327877 - protein, 9 aa, Homo Sapiens
IEWMVGGSV

SEQ ID NO: 327878 - protein, 9 aa, Homo Sapiens
FATLEMESG

SEQ ID NO: 327879 - protein, 9 aa, Homo Sapiens
TSMRGLKRQ

SEQ ID NO: 327880 - protein, 9 aa, Homo Sapiens
APILLDNFS

SEQ ID NO: 327881 - protein, 9 aa, Homo Sapiens
PAMEQAVQT

SEQ ID NO: 327882 - protein, 9 aa, Homo Sapiens
LMLQAMADG

SEQ ID NO: 327883 - protein, 9 aa, Homo Sapiens
PFQGTINQH

SEQ ID NO: 327884 - protein, 9 aa, Homo Sapiens
NQQVTYHIS

SEQ ID NO: 327885 - protein, 9 aa, Homo Sapiens
LRKSPAMEQ

SEQ ID NO: 327886 - protein, 9 aa, Homo Sapiens
LGAFTKVIT

SEQ ID NO: 327887 - protein, 9 aa, Homo Sapiens
QQLANFCQI

SEQ ID NO: 327888 - protein, 9 aa, Homo Sapiens
ITKNSYNDA

SEQ ID NO: 327889 - protein, 9 aa, Homo Sapiens
ENMQPSGSF

SEQ ID NO: 327890 - protein, 9 aa, Homo Sapiens
PEECDCHPQ

SEQ ID NO: 327891 - protein, 9 aa, Homo Sapiens
KRCNRPCVW

SEQ ID NO: 327892 - protein, 9 aa, Homo Sapiens
NLREVLKKI

SEQ ID NO: 327893 - protein, 9 aa, Homo Sapiens
CLGKSKGQT

SEQ ID NO: 327894 - protein, 9 aa, Homo Sapiens
HANGVKPDI

SEQ ID NO: 327895 - protein, 9 aa, Homo Sapiens
VADHLFSSF

SEQ ID NO: 327896 - protein, 9 aa, Homo Sapiens
MDSRPFASL

SEQ ID NO: 327897 - protein, 9 aa, Homo Sapiens
FLFLVSLPL

SEQ ID NO: 327898 - protein, 9 aa, Homo Sapiens
CNISNQLSI

SEQ ID NO: 327899 - protein, 9 aa, Homo Sapiens
GLPLAMAQV

SEQ ID NO: 327900 - protein, 9 aa, Homo Sapiens
HVPEASSEP

SEQ ID NO: 327901 - protein, 9 aa, Homo Sapiens
ATEWLTLGL

SEQ ID NO: 327902 - protein, 9 aa, Homo Sapiens
PAVSVLVSG

SEQ ID NO: 327903 - protein, 9 aa, Homo Sapiens
NRQTVASIK

SEQ ID NO: 327904 - protein, 9 aa, Homo Sapiens
KLQKKKNKE

SEQ ID NO: 327905 - protein, 9 aa, Homo Sapiens
QHPQRLHHH

SEQ ID NO: 327906 - protein, 9 aa, Homo Sapiens
HLCACVCVC

SEQ ID NO: 327907 - protein, 9 aa, Homo Sapiens
HRGEAPCTV

SEQ ID NO: 327908 - protein, 9 aa, Homo Sapiens
AEAEEMQVR

SEQ ID NO: 327909 - protein, 9 aa, Homo Sapiens
CLPRVNRCT

SEQ ID NO: 327910 - protein, 9 aa, Homo Sapiens
RHGTHGGLV

SEQ ID NO: 327911 - protein, 9 aa, Homo Sapiens
FSSLVPGYW

SEQ ID NO: 327912 - protein, 9 aa, Homo Sapiens
YSHKYSLIN

SEQ ID NO: 327913 - protein, 9 aa, Homo Sapiens
ILWAPADIN

SEQ ID NO: 327914 - protein, 9 aa, Homo Sapiens
LKNKASILQ

SEQ ID NO: 327915 - protein, 9 aa, Homo Sapiens
RKTMRVSDH

SEQ ID NO: 327916 - protein, 9 aa, Homo Sapiens
DVKMVVCRN

SEQ ID NO: 327917 - protein, 9 aa, Homo Sapiens
AGMGLQLLR

SEQ ID NO: 327918 - protein, 9 aa, Homo Sapiens
LPYHRHPVL

SEQ ID NO: 327919 - protein, 9 aa, Homo Sapiens
LVFQQGLVF

SEQ ID NO: 327920 - protein, 9 aa, Homo Sapiens
HHHRHRRLH

SEQ ID NO: 327921 - protein, 9 aa, Homo Sapiens
MLFFINPGE

SEQ ID NO: 327922 - protein, 9 aa, Homo Sapiens
GGYIIKRFK

SEQ ID NO: 327923 - protein, 9 aa, Homo Sapiens
RLAGMGLQL

SEQ ID NO: 327924 - protein, 9 aa, Homo Sapiens
PIVQCAMAD

SEQ ID NO: 327925 - protein, 9 aa, Homo Sapiens
TGLFLFTFL

SEQ ID NO: 327926 - protein, 9 aa, Homo Sapiens
LHLASRCSP

SEQ ID NO: 327927 - protein, 9 aa, Homo Sapiens
SASSSQLSM

SEQ ID NO: 327928 - protein, 9 aa, Homo Sapiens
KCAQGFIGS

SEQ ID NO: 327929 - protein, 9 aa, Homo Sapiens
LRYQIIHTG

SEQ ID NO: 327930 - protein, 9 aa, Homo Sapiens
TDEDMETEV

SEQ ID NO: 327931 - protein, 9 aa, Homo Sapiens
ALSLDWSST

SEQ ID NO: 327932 - protein, 9 aa, Homo Sapiens
SIMDVIFLV

SEQ ID NO: 327933 - protein, 9 aa, Homo Sapiens
YAKWKGLPP

SEQ ID NO: 327934 - protein, 9 aa, Homo Sapiens
GDKALDCYS

SEQ ID NO: 327935 - protein, 9 aa, Homo Sapiens
SLNLGFKHI

SEQ ID NO: 327936 - protein, 9 aa, Homo Sapiens
VWPGVGAPG

SEQ ID NO: 327937 - protein, 9 aa, Homo Sapiens
APIHVRNLT

SEQ ID NO: 327938 - protein, 9 aa, Homo Sapiens
RRKWPVVWG

SEQ ID NO: 327939 - protein, 9 aa, Homo Sapiens
LKSKEQMAF

SEQ ID NO: 327940 - protein, 9 aa, Homo Sapiens
QRAEDDCEK

SEQ ID NO: 327941 - protein, 9 aa, Homo Sapiens
LFRCAKAHE

SEQ ID NO: 327942 - protein, 9 aa, Homo Sapiens
MEWRPAEEP

SEQ ID NO: 327943 - protein, 9 aa, Homo Sapiens
NQKNLESGM

SEQ ID NO: 327944 - protein, 9 aa, Homo Sapiens
IRMQDLDLS

SEQ ID NO: 327945 - protein, 9 aa, Homo Sapiens
SSCTQRTLH

SEQ ID NO: 327946 - protein, 9 aa, Homo Sapiens
MPHVFQSHH

SEQ ID NO: 327947 - protein, 9 aa, Homo Sapiens
AGEGLLTLW

SEQ ID NO: 327948 - protein, 9 aa, Homo Sapiens
LESWLFDLH

SEQ ID NO: 327949 - protein, 9 aa, Homo Sapiens
ACKKLQKKK

SEQ ID NO: 327950 - protein, 9 aa, Homo Sapiens
PNGAGACCR

SEQ ID NO: 327951 - protein, 9 aa, Homo Sapiens
RRRRSKKER

SEQ ID NO: 327952 - protein, 9 aa, Homo Sapiens
VETVCGYGS

SEQ ID NO: 327953 - protein, 9 aa, Homo Sapiens
LSPLKPPWM

SEQ ID NO: 327954 - protein, 9 aa, Homo Sapiens
DLEECLYSQ

SEQ ID NO: 327955 - protein, 9 aa, Homo Sapiens
AATTISHQA

SEQ ID NO: 327956 - protein, 9 aa, Homo Sapiens
PPQGLWVES

SEQ ID NO: 327957 - protein, 9 aa, Homo Sapiens
KCMSQIQAF

SEQ ID NO: 327958 - protein, 9 aa, Homo Sapiens
GQTHPRIDP

SEQ ID NO: 327959 - protein, 9 aa, Homo Sapiens
KTRDVKCVS

SEQ ID NO: 327960 - protein, 9 aa, Homo Sapiens
QGRRYHSVT

SEQ ID NO: 327961 - protein, 9 aa, Homo Sapiens
IDFGLDMQP

SEQ ID NO: 327962 - protein, 9 aa, Homo Sapiens
LLESCTVRP

SEQ ID NO: 327963 - protein, 9 aa, Homo Sapiens
PEVESGPQG

SEQ ID NO: 327964 - protein, 9 aa, Homo Sapiens
SLRAEPDVD

SEQ ID NO: 327965 - protein, 9 aa, Homo Sapiens
LQDWGRSLD

SEQ ID NO: 327966 - protein, 9 aa, Homo Sapiens
AGIHYPDIT

SEQ ID NO: 327967 - protein, 9 aa, Homo Sapiens
ASSGIMIPK

SEQ ID NO: 327968 - protein, 9 aa, Homo Sapiens
NLFIEWMVG

SEQ ID NO: 327969 - protein, 9 aa, Homo Sapiens
ITTGDGKPL

SEQ ID NO: 327970 - protein, 9 aa, Homo Sapiens
FMRFGRTVR

SEQ ID NO: 327971 - protein, 9 aa, Homo Sapiens
KSVPSVAVI

SEQ ID NO: 327972 - protein, 9 aa, Homo Sapiens
KPPIAPATP

SEQ ID NO: 327973 - protein, 9 aa, Homo Sapiens
RHTKGPKFY

SEQ ID NO: 327974 - protein, 9 aa, Homo Sapiens
QMTVEYVYE

SEQ ID NO: 327975 - protein, 9 aa, Homo Sapiens
RSGGDLVLV

SEQ ID NO: 327976 - protein, 9 aa, Homo Sapiens
DLVLVGLGS

SEQ ID NO: 327977 - protein, 9 aa, Homo Sapiens
AAAEPMGRL

SEQ ID NO: 327978 - protein, 9 aa, Homo Sapiens
EKRNEALEE

SEQ ID NO: 327979 - protein, 9 aa, Homo Sapiens
EAELEYQRR

SEQ ID NO: 327980 - protein, 9 aa, Homo Sapiens
LGLVVIVPA

SEQ ID NO: 327981 - protein, 9 aa, Homo Sapiens
SWEMAVNEP

SEQ ID NO: 327982 - protein, 9 aa, Homo Sapiens
KWMGTQFGQ

SEQ ID NO: 327983 - protein, 9 aa, Homo Sapiens
GYALLHFLV

SEQ ID NO: 327984 - protein, 9 aa, Homo Sapiens
GQHVQKLYT

SEQ ID NO: 327985 - protein, 9 aa, Homo Sapiens
KKWMGPGAA

SEQ ID NO: 327986 - protein, 9 aa, Homo Sapiens
MAMKSLFNR

SEQ ID NO: 327987 - protein, 9 aa, Homo Sapiens
GRTGTGTGG

SEQ ID NO: 327988 - protein, 9 aa, Homo Sapiens
TTSAHGGRV

SEQ ID NO: 327989 - protein, 9 aa, Homo Sapiens
VERNIADGK

SEQ ID NO: 327990 - protein, 9 aa, Homo Sapiens
SQAQVYFEE

SEQ ID NO: 327991 - protein, 9 aa, Homo Sapiens
LCGLALLHH

SEQ ID NO: 327992 - protein, 9 aa, Homo Sapiens
RSLLTYGVG

SEQ ID NO: 327993 - protein, 9 aa, Homo Sapiens
YKSRRLSVL

SEQ ID NO: 327994 - protein, 9 aa, Homo Sapiens
VWNTAIQSA

SEQ ID NO: 327995 - protein, 9 aa, Homo Sapiens
DVVTDLASH

SEQ ID NO: 327996 - protein, 9 aa, Homo Sapiens
RFMSVYEQR

SEQ ID NO: 327997 - protein, 9 aa, Homo Sapiens
VVLHHHWIL

SEQ ID NO: 327998 - protein, 9 aa, Homo Sapiens
LSPLNGALH

SEQ ID NO: 327999 - protein, 9 aa, Homo Sapiens
GPTHQDALQ

SEQ ID NO: 328000 - protein, 9 aa, Homo Sapiens
KHIGDEGAG

SEQ ID NO: 328001 - protein, 9 aa, Homo Sapiens
MLEVADHLF

SEQ ID NO: 328002 - protein, 9 aa, Homo Sapiens
FLVVLCCVV

SEQ ID NO: 328003 - protein, 9 aa, Homo Sapiens
HWWEPSGKA

SEQ ID NO: 328004 - protein, 9 aa, Homo Sapiens
GAAGRATQL

SEQ ID NO: 328005 - protein, 9 aa, Homo Sapiens
ACSSTSFMV

SEQ ID NO: 328006 - protein, 9 aa, Homo Sapiens
VVICHPLRH

SEQ ID NO: 328007 - protein, 9 aa, Homo Sapiens
EDKVAIKTI

SEQ ID NO: 328008 - protein, 9 aa, Homo Sapiens
MTCSNVRCR

SEQ ID NO: 328009 - protein, 9 aa, Homo Sapiens
CAICRNREM

SEQ ID NO: 328010 - protein, 9 aa, Homo Sapiens
YQLQHGVVV

SEQ ID NO: 328011 - protein, 9 aa, Homo Sapiens
YNLFIEWMV

SEQ ID NO: 328012 - protein, 9 aa, Homo Sapiens
GKKPYECYK

SEQ ID NO: 328013 - protein, 9 aa, Homo Sapiens
DSCLRSLDI

SEQ ID NO: 328014 - protein, 9 aa, Homo Sapiens
AWSDSAQIV

SEQ ID NO: 328015 - protein, 9 aa, Homo Sapiens
DTSMKDMHK

SEQ ID NO: 328016 - protein, 9 aa, Homo Sapiens
SSSLSPDHY

SEQ ID NO: 328017 - protein, 9 aa, Homo Sapiens
PERFLCENP

SEQ ID NO: 328018 - protein, 9 aa, Homo Sapiens
KMTAQPGWP

SEQ ID NO: 328019 - protein, 9 aa, Homo Sapiens
AQRVAMEFA

SEQ ID NO: 328020 - protein, 9 aa, Homo Sapiens
ENVQGCHCQ

SEQ ID NO: 328021 - protein, 9 aa, Homo Sapiens
YVHSEATLD

SEQ ID NO: 328022 - protein, 9 aa, Homo Sapiens
ANLTQGKDQ

SEQ ID NO: 328023 - protein, 9 aa, Homo Sapiens
SLGSALSAL

SEQ ID NO: 328024 - protein, 9 aa, Homo Sapiens
LQGLLEMLL

SEQ ID NO: 328025 - protein, 9 aa, Homo Sapiens
FLTILPGDV

SEQ ID NO: 328026 - protein, 9 aa, Homo Sapiens
ASRSALHVT

SEQ ID NO: 328027 - protein, 9 aa, Homo Sapiens
RCCSGLGAG

SEQ ID NO: 328028 - protein, 9 aa, Homo Sapiens
LEANEWATI

SEQ ID NO: 328029 - protein, 9 aa, Homo Sapiens
GQYPLVGPG

SEQ ID NO: 328030 - protein, 9 aa, Homo Sapiens
ALQSPVSPI

SEQ ID NO: 328031 - protein, 9 aa, Homo Sapiens
GVMKPGVWW

SEQ ID NO: 328032 - protein, 9 aa, Homo Sapiens
LLNNLRVHS

SEQ ID NO: 328033 - protein, 9 aa, Homo Sapiens
RDAASKLKE

SEQ ID NO: 328034 - protein, 9 aa, Homo Sapiens
QWHIDLQPW

SEQ ID NO: 328035 - protein, 9 aa, Homo Sapiens
DLLTLGHAL

SEQ ID NO: 328036 - protein, 9 aa, Homo Sapiens
LGKLRMVAN

SEQ ID NO: 328037 - protein, 9 aa, Homo Sapiens
QGFAVLAGP

SEQ ID NO: 328038 - protein, 9 aa, Homo Sapiens
TILAPNECL

SEQ ID NO: 328039 - protein, 9 aa, Homo Sapiens
TLHSTSPVE

SEQ ID NO: 328040 - protein, 9 aa, Homo Sapiens
QKSVYVVSS

SEQ ID NO: 328041 - protein, 9 aa, Homo Sapiens
KMLSGLSPM

SEQ ID NO: 328042 - protein, 9 aa, Homo Sapiens
ANGPPIFTL

SEQ ID NO: 328043 - protein, 9 aa, Homo Sapiens
PDMYECLHV

SEQ ID NO: 328044 - protein, 9 aa, Homo Sapiens
FTLVPGGAV

SEQ ID NO: 328045 - protein, 9 aa, Homo Sapiens
TLEMESGEL

SEQ ID NO: 328046 - protein, 9 aa, Homo Sapiens
SCHILWAPA

SEQ ID NO: 328047 - protein, 9 aa, Homo Sapiens
KPGLVGHQG

SEQ ID NO: 328048 - protein, 9 aa, Homo Sapiens
PVCLLRPSD

SEQ ID NO: 328049 - protein, 9 aa, Homo Sapiens
ACIDKISPN

SEQ ID NO: 328050 - protein, 9 aa, Homo Sapiens
ERIEKSGAF

SEQ ID NO: 328051 - protein, 9 aa, Homo Sapiens
LCGTYFSTQ

SEQ ID NO: 328052 - protein, 9 aa, Homo Sapiens
TLVGLARSE

SEQ ID NO: 328053 - protein, 9 aa, Homo Sapiens
EDMIDTKLE

SEQ ID NO: 328054 - protein, 9 aa, Homo Sapiens
IDWSGDVPV

SEQ ID NO: 328055 - protein, 9 aa, Homo Sapiens
SSKLGPQVS

SEQ ID NO: 328056 - protein, 9 aa, Homo Sapiens
LLLCTAQPD

SEQ ID NO: 328057 - protein, 9 aa, Homo Sapiens
SWHQKIHTG

SEQ ID NO: 328058 - protein, 9 aa, Homo Sapiens
HCASKANKK

SEQ ID NO: 328059 - protein, 9 aa, Homo Sapiens
LSTIKMVQY

SEQ ID NO: 328060 - protein, 9 aa, Homo Sapiens
CLGPLRWCA

SEQ ID NO: 328061 - protein, 9 aa, Homo Sapiens
FIYVFTTHL

SEQ ID NO: 328062 - protein, 9 aa, Homo Sapiens
PQIARVCKG

SEQ ID NO: 328063 - protein, 9 aa, Homo Sapiens
QLYYHYYLH

SEQ ID NO: 328064 - protein, 9 aa, Homo Sapiens
AEMFAKGQS

SEQ ID NO: 328065 - protein, 9 aa, Homo Sapiens
VTVALLRAE

SEQ ID NO: 328066 - protein, 9 aa, Homo Sapiens
SQIKEARRW

SEQ ID NO: 328067 - protein, 9 aa, Homo Sapiens
SYPRWHSTT

SEQ ID NO: 328068 - protein, 9 aa, Homo Sapiens
ETAQNTQMG

SEQ ID NO: 328069 - protein, 9 aa, Homo Sapiens
TTPFSVFDI

SEQ ID NO: 328070 - protein, 9 aa, Homo Sapiens
PGQFGHPVV

SEQ ID NO: 328071 - protein, 9 aa, Homo Sapiens
LSARLPPGL

SEQ ID NO: 328072 - protein, 9 aa, Homo Sapiens
QKLSKKDVT

SEQ ID NO: 328073 - protein, 9 aa, Homo Sapiens
FIQTTSTQY

SEQ ID NO: 328074 - protein, 9 aa, Homo Sapiens
NLLTNVLFL

SEQ ID NO: 328075 - protein, 9 aa, Homo Sapiens
DKGLKKMTL

SEQ ID NO: 328076 - protein, 9 aa, Homo Sapiens
GPLTSPAVS

SEQ ID NO: 328077 - protein, 9 aa, Homo Sapiens
MKDMHKVLR

SEQ ID NO: 328078 - protein, 9 aa, Homo Sapiens
NRVAATFPG

SEQ ID NO: 328079 - protein, 9 aa, Homo Sapiens
ELGPMLPGN

SEQ ID NO: 328080 - protein, 9 aa, Homo Sapiens
EIAQSSKAE

SEQ ID NO: 328081 - protein, 9 aa, Homo Sapiens
EEMQVRLAA

SEQ ID NO: 328082 - protein, 9 aa, Homo Sapiens
HKEIQPPYK

SEQ ID NO: 328083 - protein, 9 aa, Homo Sapiens
FKSKFLFLV

SEQ ID NO: 328084 - protein, 9 aa, Homo Sapiens
PISLHVNLD

SEQ ID NO: 328085 - protein, 9 aa, Homo Sapiens
WPVGQPQWK

SEQ ID NO: 328086 - protein, 9 aa, Homo Sapiens
LQKKKNKEE

SEQ ID NO: 328087 - protein, 9 aa, Homo Sapiens
RDVWPYIVG

SEQ ID NO: 328088 - protein, 9 aa, Homo Sapiens
VLLLLPLPR

SEQ ID NO: 328089 - protein, 9 aa, Homo Sapiens
HTDDKFFKI

SEQ ID NO: 328090 - protein, 9 aa, Homo Sapiens
ESQWAPTCV

SEQ ID NO: 328091 - protein, 9 aa, Homo Sapiens
AHDLSKSPG

SEQ ID NO: 328092 - protein, 9 aa, Homo Sapiens
WAQLPDCAP

SEQ ID NO: 328093 - protein, 9 aa, Homo Sapiens
IEKSGAFRL

SEQ ID NO: 328094 - protein, 9 aa, Homo Sapiens
AKVNNAENA

SEQ ID NO: 328095 - protein, 9 aa, Homo Sapiens
TIFTAHLYY

SEQ ID NO: 328096 - protein, 9 aa, Homo Sapiens
CRRSYHSSL

SEQ ID NO: 328097 - protein, 9 aa, Homo Sapiens
TVVGNERSS

SEQ ID NO: 328098 - protein, 9 aa, Homo Sapiens
EFTMTCQVE

SEQ ID NO: 328099 - protein, 9 aa, Homo Sapiens
ERLAQAMDT

SEQ ID NO: 328100 - protein, 9 aa, Homo Sapiens
GLALSAFLV

SEQ ID NO: 328101 - protein, 9 aa, Homo Sapiens
EPADRPCAS

SEQ ID NO: 328102 - protein, 9 aa, Homo Sapiens
CPLIKYCWL

SEQ ID NO: 328103 - protein, 9 aa, Homo Sapiens
SPPHKRWQR

SEQ ID NO: 328104 - protein, 9 aa, Homo Sapiens
NPFKVVKKK

SEQ ID NO: 328105 - protein, 9 aa, Homo Sapiens
SHRRQGLAP

SEQ ID NO: 328106 - protein, 9 aa, Homo Sapiens
YATRSGGDL

SEQ ID NO: 328107 - protein, 9 aa, Homo Sapiens
VKSLYHSME

SEQ ID NO: 328108 - protein, 9 aa, Homo Sapiens
FPPGLSFHK

SEQ ID NO: 328109 - protein, 9 aa, Homo Sapiens
VSVQYFLID

SEQ ID NO: 328110 - protein, 9 aa, Homo Sapiens
ASTCYLFRM

SEQ ID NO: 328111 - protein, 9 aa, Homo Sapiens
GPRSSWPVG

SEQ ID NO: 328112 - protein, 9 aa, Homo Sapiens
PDCCDDERY

SEQ ID NO: 328113 - protein, 9 aa, Homo Sapiens
KTRNILNPF

SEQ ID NO: 328114 - protein, 9 aa, Homo Sapiens
PSRSAACGG

SEQ ID NO: 328115 - protein, 9 aa, Homo Sapiens
LHPDIRSHP

SEQ ID NO: 328116 - protein, 9 aa, Homo Sapiens
PDVPQGLHG

SEQ ID NO: 328117 - protein, 9 aa, Homo Sapiens
VPEDVEAHQ

SEQ ID NO: 328118 - protein, 9 aa, Homo Sapiens
RSKRKKQKK

SEQ ID NO: 328119 - protein, 9 aa, Homo Sapiens
TVRLMEAPP

SEQ ID NO: 328120 - protein, 9 aa, Homo Sapiens
FARTRNPNG

SEQ ID NO: 328121 - protein, 9 aa, Homo Sapiens
ADLHAQRSE

SEQ ID NO: 328122 - protein, 9 aa, Homo Sapiens
WQRSSCSSS

SEQ ID NO: 328123 - protein, 9 aa, Homo Sapiens
CLSWKGHVP

SEQ ID NO: 328124 - protein, 9 aa, Homo Sapiens
AHHVLPTTS

SEQ ID NO: 328125 - protein, 9 aa, Homo Sapiens
LDKDPLLSY

SEQ ID NO: 328126 - protein, 9 aa, Homo Sapiens
DGPKSTRPG

SEQ ID NO: 328127 - protein, 9 aa, Homo Sapiens
FTYLIGQEA

SEQ ID NO: 328128 - protein, 9 aa, Homo Sapiens
LRFNTLTKC

SEQ ID NO: 328129 - protein, 9 aa, Homo Sapiens
HLQEAVWQH

SEQ ID NO: 328130 - protein, 9 aa, Homo Sapiens
EVRMAALES

SEQ ID NO: 328131 - protein, 9 aa, Homo Sapiens
VEKHYGKVP

SEQ ID NO: 328132 - protein, 9 aa, Homo Sapiens
QKIKDISNK

SEQ ID NO: 328133 - protein, 9 aa, Homo Sapiens
VLHILVHEL

SEQ ID NO: 328134 - protein, 9 aa, Homo Sapiens
GSGLSCHQG

SEQ ID NO: 328135 - protein, 9 aa, Homo Sapiens
CEGTRVASI

SEQ ID NO: 328136 - protein, 9 aa, Homo Sapiens
WLLSDITCC

SEQ ID NO: 328137 - protein, 9 aa, Homo Sapiens
GAEAQAAEE

SEQ ID NO: 328138 - protein, 9 aa, Homo Sapiens
DNCPRIPNS

SEQ ID NO: 328139 - protein, 9 aa, Homo Sapiens
NGGHYMRNN

SEQ ID NO: 328140 - protein, 9 aa, Homo Sapiens
RIDIEIYLK

SEQ ID NO: 328141 - protein, 9 aa, Homo Sapiens
IIAQVQVSS

SEQ ID NO: 328142 - protein, 9 aa, Homo Sapiens
IPQIARVCK

SEQ ID NO: 328143 - protein, 9 aa, Homo Sapiens
MIDLLEPVD

SEQ ID NO: 328144 - protein, 9 aa, Homo Sapiens
TNASSVPNT

SEQ ID NO: 328145 - protein, 9 aa, Homo Sapiens
EPKQFKNDL

SEQ ID NO: 328146 - protein, 9 aa, Homo Sapiens
LDTYPAWVR

SEQ ID NO: 328147 - protein, 9 aa, Homo Sapiens
DYHSLRRPD

SEQ ID NO: 328148 - protein, 9 aa, Homo Sapiens
ALEVLSAQG

SEQ ID NO: 328149 - protein, 9 aa, Homo Sapiens
GPRKMSMIV

SEQ ID NO: 328150 - protein, 9 aa, Homo Sapiens
KDQYYLRVT

SEQ ID NO: 328151 - protein, 9 aa, Homo Sapiens
LTYHLAVVL

SEQ ID NO: 328152 - protein, 9 aa, Homo Sapiens
AKVVVLGET

SEQ ID NO: 328153 - protein, 9 aa, Homo Sapiens
TQRTLHVPS

SEQ ID NO: 328154 - protein, 9 aa, Homo Sapiens
ARYEEIAQS

SEQ ID NO: 328155 - protein, 9 aa, Homo Sapiens
KRLWRVACT

SEQ ID NO: 328156 - protein, 9 aa, Homo Sapiens
PKHYLHLNS

SEQ ID NO: 328157 - protein, 9 aa, Homo Sapiens
RLVISWRMP

SEQ ID NO: 328158 - protein, 9 aa, Homo Sapiens
NTVATLEKV

SEQ ID NO: 328159 - protein, 9 aa, Homo Sapiens
GAILVSLPT

SEQ ID NO: 328160 - protein, 9 aa, Homo Sapiens
YFQMRRTLR

SEQ ID NO: 328161 - protein, 9 aa, Homo Sapiens
TDEQRARQL

SEQ ID NO: 328162 - protein, 9 aa, Homo Sapiens
LRAEPDVDA

SEQ ID NO: 328163 - protein, 9 aa, Homo Sapiens
AAASPRPMA

SEQ ID NO: 328164 - protein, 9 aa, Homo Sapiens
EQAASEDVD

SEQ ID NO: 328165 - protein, 9 aa, Homo Sapiens
MYTGGNGFS

SEQ ID NO: 328166 - protein, 9 aa, Homo Sapiens
LLKVAQTRL

SEQ ID NO: 328167 - protein, 9 aa, Homo Sapiens
SWEPHVPEA

SEQ ID NO: 328168 - protein, 9 aa, Homo Sapiens
LVGLARSEE

SEQ ID NO: 328169 - protein, 9 aa, Homo Sapiens
KKVLKVARV

SEQ ID NO: 328170 - protein, 9 aa, Homo Sapiens
DAAIRNYDI

SEQ ID NO: 328171 - protein, 9 aa, Homo Sapiens
ELLRWVLEG

SEQ ID NO: 328172 - protein, 9 aa, Homo Sapiens
RALRFDPMA

SEQ ID NO: 328173 - protein, 9 aa, Homo Sapiens
ARAALAMVD

SEQ ID NO: 328174 - protein, 9 aa, Homo Sapiens
WVVFEPDLL

SEQ ID NO: 328175 - protein, 9 aa, Homo Sapiens
ENPYKCDEC

SEQ ID NO: 328176 - protein, 9 aa, Homo Sapiens
AFLARWGPS

SEQ ID NO: 328177 - protein, 9 aa, Homo Sapiens
GETAECLIQ

SEQ ID NO: 328178 - protein, 9 aa, Homo Sapiens
GVPPDILQL

SEQ ID NO: 328179 - protein, 9 aa, Homo Sapiens
FCLTGEGLD

SEQ ID NO: 328180 - protein, 9 aa, Homo Sapiens
SSKYVFENI

SEQ ID NO: 328181 - protein, 9 aa, Homo Sapiens
EFTARGGLK

SEQ ID NO: 328182 - protein, 9 aa, Homo Sapiens
ITVVGNERS

SEQ ID NO: 328183 - protein, 9 aa, Homo Sapiens
VWPYIVGAV

SEQ ID NO: 328184 - protein, 9 aa, Homo Sapiens
YPARPDSAN

SEQ ID NO: 328185 - protein, 9 aa, Homo Sapiens
TQEGTRTGA

SEQ ID NO: 328186 - protein, 9 aa, Homo Sapiens
VNELQNLMA

SEQ ID NO: 328187 - protein, 9 aa, Homo Sapiens
LHRLKPSQK

SEQ ID NO: 328188 - protein, 9 aa, Homo Sapiens
PDLGQPYNS

SEQ ID NO: 328189 - protein, 9 aa, Homo Sapiens
NVVTFDADD

SEQ ID NO: 328190 - protein, 9 aa, Homo Sapiens
VYHCSASTR

SEQ ID NO: 328191 - protein, 9 aa, Homo Sapiens
LETIWRQQW

SEQ ID NO: 328192 - protein, 9 aa, Homo Sapiens
SDDVALCDI

SEQ ID NO: 328193 - protein, 9 aa, Homo Sapiens
ARIWQKDEE

SEQ ID NO: 328194 - protein, 9 aa, Homo Sapiens
LGSSKVEQV

SEQ ID NO: 328195 - protein, 9 aa, Homo Sapiens
EPACVLCNK

SEQ ID NO: 328196 - protein, 9 aa, Homo Sapiens
ELEECLARQ

SEQ ID NO: 328197 - protein, 9 aa, Homo Sapiens
FANITHGNS

SEQ ID NO: 328198 - protein, 9 aa, Homo Sapiens
GGSGTYSHR

SEQ ID NO: 328199 - protein, 9 aa, Homo Sapiens
IHSRMRLDP

SEQ ID NO: 328200 - protein, 9 aa, Homo Sapiens
WLNNFQGHY

SEQ ID NO: 328201 - protein, 9 aa, Homo Sapiens
WMVGGSVAH

SEQ ID NO: 328202 - protein, 9 aa, Homo Sapiens
SRYNLVQGQ

SEQ ID NO: 328203 - protein, 9 aa, Homo Sapiens
PASTVEKHY

SEQ ID NO: 328204 - protein, 9 aa, Homo Sapiens
PAMSGTQSL

SEQ ID NO: 328205 - protein, 9 aa, Homo Sapiens
VMVKVVIIP

SEQ ID NO: 328206 - protein, 9 aa, Homo Sapiens
DSSPSCRQR

SEQ ID NO: 328207 - protein, 9 aa, Homo Sapiens
NLPTSSDSK

SEQ ID NO: 328208 - protein, 9 aa, Homo Sapiens
RPPSEDASN

SEQ ID NO: 328209 - protein, 9 aa, Homo Sapiens
GCGSMAQVV

SEQ ID NO: 328210 - protein, 9 aa, Homo Sapiens
CNFCLLGSN

SEQ ID NO: 328211 - protein, 9 aa, Homo Sapiens
PLHQHSPNF

SEQ ID NO: 328212 - protein, 9 aa, Homo Sapiens
ALGGTATQQ

SEQ ID NO: 328213 - protein, 9 aa, Homo Sapiens
GDLIYMLNG

SEQ ID NO: 328214 - protein, 9 aa, Homo Sapiens
ATATTGQGK

SEQ ID NO: 328215 - protein, 9 aa, Homo Sapiens
GMSISCPNA

SEQ ID NO: 328216 - protein, 9 aa, Homo Sapiens
PLSLQEIHF

SEQ ID NO: 328217 - protein, 9 aa, Homo Sapiens
LQREAECVE

SEQ ID NO: 328218 - protein, 9 aa, Homo Sapiens
VSAPCVPPL

SEQ ID NO: 328219 - protein, 9 aa, Homo Sapiens
LKKKQEPPC

SEQ ID NO: 328220 - protein, 9 aa, Homo Sapiens
ESIATAPTS

SEQ ID NO: 328221 - protein, 9 aa, Homo Sapiens
RNHMIKSSH

SEQ ID NO: 328222 - protein, 9 aa, Homo Sapiens
PTGVIVFEG

SEQ ID NO: 328223 - protein, 9 aa, Homo Sapiens
LDAWRFWRK

SEQ ID NO: 328224 - protein, 9 aa, Homo Sapiens
GKKYRVAKA

SEQ ID NO: 328225 - protein, 9 aa, Homo Sapiens
ILPFYVTLL

SEQ ID NO: 328226 - protein, 9 aa, Homo Sapiens
RQGFAVLAG

SEQ ID NO: 328227 - protein, 9 aa, Homo Sapiens
LYLKDENST

SEQ ID NO: 328228 - protein, 9 aa, Homo Sapiens
VRVPLHTQK

SEQ ID NO: 328229 - protein, 9 aa, Homo Sapiens
MDVIFLVDI

SEQ ID NO: 328230 - protein, 9 aa, Homo Sapiens
RLMLPSSAR

SEQ ID NO: 328231 - protein, 9 aa, Homo Sapiens
IVFGELLLN

SEQ ID NO: 328232 - protein, 9 aa, Homo Sapiens
APECINFCK

SEQ ID NO: 328233 - protein, 9 aa, Homo Sapiens
MCPPPPPPA

SEQ ID NO: 328234 - protein, 9 aa, Homo Sapiens
GLQGAIAFA

SEQ ID NO: 328235 - protein, 9 aa, Homo Sapiens
SWKGHVPKS

SEQ ID NO: 328236 - protein, 9 aa, Homo Sapiens
ISSIRSIVP

SEQ ID NO: 328237 - protein, 9 aa, Homo Sapiens
FCDSCHVWP

SEQ ID NO: 328238 - protein, 9 aa, Homo Sapiens
LQVQTIQCE

SEQ ID NO: 328239 - protein, 9 aa, Homo Sapiens
SGKKPYECY

SEQ ID NO: 328240 - protein, 9 aa, Homo Sapiens
PAFFGSLTQ

SEQ ID NO: 328241 - protein, 9 aa, Homo Sapiens
QEEARPPSE

SEQ ID NO: 328242 - protein, 9 aa, Homo Sapiens
YRGTAPPKQ

SEQ ID NO: 328243 - protein, 9 aa, Homo Sapiens
SIAAQTLLS

SEQ ID NO: 328244 - protein, 9 aa, Homo Sapiens
AKPSPWLTI

SEQ ID NO: 328245 - protein, 9 aa, Homo Sapiens
LSSCSKNQS

SEQ ID NO: 328246 - protein, 9 aa, Homo Sapiens
YLHLNSSIP

SEQ ID NO: 328247 - protein, 9 aa, Homo Sapiens
WHQKIHTGE

SEQ ID NO: 328248 - protein, 9 aa, Homo Sapiens
FLVRRFCCF

SEQ ID NO: 328249 - protein, 9 aa, Homo Sapiens
LGGWQEVVA

SEQ ID NO: 328250 - protein, 9 aa, Homo Sapiens
DKFSPHYEF

SEQ ID NO: 328251 - protein, 9 aa, Homo Sapiens
CEGDKVRLA

SEQ ID NO: 328252 - protein, 9 aa, Homo Sapiens
HMHLEMHCL

SEQ ID NO: 328253 - protein, 9 aa, Homo Sapiens
PDITTGDGK

SEQ ID NO: 328254 - protein, 9 aa, Homo Sapiens
QIVEAILSH

SEQ ID NO: 328255 - protein, 9 aa, Homo Sapiens
LIQVIEPFS

SEQ ID NO: 328256 - protein, 9 aa, Homo Sapiens
FQTQAGTQI

SEQ ID NO: 328257 - protein, 9 aa, Homo Sapiens
NSQVKKTKM

SEQ ID NO: 328258 - protein, 9 aa, Homo Sapiens
VFQSHHEFK

SEQ ID NO: 328259 - protein, 9 aa, Homo Sapiens
MLLKVRRVS

SEQ ID NO: 328260 - protein, 9 aa, Homo Sapiens
HRQAEMGTQ

SEQ ID NO: 328261 - protein, 9 aa, Homo Sapiens
QQQGHMGIV

SEQ ID NO: 328262 - protein, 9 aa, Homo Sapiens
TAHLYYFQY

SEQ ID NO: 328263 - protein, 9 aa, Homo Sapiens
CTPNIVTTV

SEQ ID NO: 328264 - protein, 9 aa, Homo Sapiens
GYAYFMRGR

SEQ ID NO: 328265 - protein, 9 aa, Homo Sapiens
SVASRHGTH

SEQ ID NO: 328266 - protein, 9 aa, Homo Sapiens
GIICLAREK

SEQ ID NO: 328267 - protein, 9 aa, Homo Sapiens
KLSQAQVYF

SEQ ID NO: 328268 - protein, 9 aa, Homo Sapiens
LKRCNRPCV

SEQ ID NO: 328269 - protein, 9 aa, Homo Sapiens
KDFWPLRKW

SEQ ID NO: 328270 - protein, 9 aa, Homo Sapiens
AVAVGQYPL

SEQ ID NO: 328271 - protein, 9 aa, Homo Sapiens
NNLRVHSIN

SEQ ID NO: 328272 - protein, 9 aa, Homo Sapiens
KVPIAIWAG

SEQ ID NO: 328273 - protein, 9 aa, Homo Sapiens
CSHDVVICP

SEQ ID NO: 328274 - protein, 9 aa, Homo Sapiens
ARSQLPWPA

SEQ ID NO: 328275 - protein, 9 aa, Homo Sapiens
PQPSRGDDL

SEQ ID NO: 328276 - protein, 9 aa, Homo Sapiens
MGLSQRNPS

SEQ ID NO: 328277 - protein, 9 aa, Homo Sapiens
LKKMKSQMG

SEQ ID NO: 328278 - protein, 9 aa, Homo Sapiens
RETLLHQLY

SEQ ID NO: 328279 - protein, 9 aa, Homo Sapiens
NNPERFLCE

SEQ ID NO: 328280 - protein, 9 aa, Homo Sapiens
PPTCEEACC

SEQ ID NO: 328281 - protein, 9 aa, Homo Sapiens
PWNLILLTI

SEQ ID NO: 328282 - protein, 9 aa, Homo Sapiens
TNVLFLVTW

SEQ ID NO: 328283 - protein, 9 aa, Homo Sapiens
MKDFWPLRK

SEQ ID NO: 328284 - protein, 9 aa, Homo Sapiens
LAHQGAQVD

SEQ ID NO: 328285 - protein, 9 aa, Homo Sapiens
AKKNRSSGP

SEQ ID NO: 328286 - protein, 9 aa, Homo Sapiens
IIGQQQLQV

SEQ ID NO: 328287 - protein, 9 aa, Homo Sapiens
LHSAHQGRD

SEQ ID NO: 328288 - protein, 9 aa, Homo Sapiens
SSPTPLSSP

SEQ ID NO: 328289 - protein, 9 aa, Homo Sapiens
AYSPAWCSG

SEQ ID NO: 328290 - protein, 9 aa, Homo Sapiens
MQPTEFKIK

SEQ ID NO: 328291 - protein, 9 aa, Homo Sapiens
MTNQSDTDI

SEQ ID NO: 328292 - protein, 9 aa, Homo Sapiens
QEAVWQHVA

SEQ ID NO: 328293 - protein, 9 aa, Homo Sapiens
RGLNASTCY

SEQ ID NO: 328294 - protein, 9 aa, Homo Sapiens
QFPGFPPHV

SEQ ID NO: 328295 - protein, 9 aa, Homo Sapiens
EDMTRLLRD

SEQ ID NO: 328296 - protein, 9 aa, Homo Sapiens
GGHLGFSLW

SEQ ID NO: 328297 - protein, 9 aa, Homo Sapiens
HFKTCYQIY

SEQ ID NO: 328298 - protein, 9 aa, Homo Sapiens
EGFRRFNLY

SEQ ID NO: 328299 - protein, 9 aa, Homo Sapiens
VFSRDDSKF

SEQ ID NO: 328300 - protein, 9 aa, Homo Sapiens
KLGDQTTMI

SEQ ID NO: 328301 - protein, 9 aa, Homo Sapiens
LMKKYEKSL

SEQ ID NO: 328302 - protein, 9 aa, Homo Sapiens
TAKEEEARR

SEQ ID NO: 328303 - protein, 9 aa, Homo Sapiens
GPGGQLRLM

SEQ ID NO: 328304 - protein, 9 aa, Homo Sapiens
ATHRVMRAN

SEQ ID NO: 328305 - protein, 9 aa, Homo Sapiens
TSVARYNFA

SEQ ID NO: 328306 - protein, 9 aa, Homo Sapiens
GDRRVQNIL

SEQ ID NO: 328307 - protein, 9 aa, Homo Sapiens
KKFEDVNSW

SEQ ID NO: 328308 - protein, 9 aa, Homo Sapiens
GFVNTYGLK

SEQ ID NO: 328309 - protein, 9 aa, Homo Sapiens
YNDLGLGCS

SEQ ID NO: 328310 - protein, 9 aa, Homo Sapiens
DPKIYCQFD

SEQ ID NO: 328311 - protein, 9 aa, Homo Sapiens
QSVVLHHHW

SEQ ID NO: 328312 - protein, 9 aa, Homo Sapiens
CVNYNGQHP

SEQ ID NO: 328313 - protein, 9 aa, Homo Sapiens
LSVLNASYG

SEQ ID NO: 328314 - protein, 9 aa, Homo Sapiens
SKLEEVLNL

SEQ ID NO: 328315 - protein, 9 aa, Homo Sapiens
KWALKVKQA

SEQ ID NO: 328316 - protein, 9 aa, Homo Sapiens
CIVSMDKAK

SEQ ID NO: 328317 - protein, 9 aa, Homo Sapiens
IHRLIEVDK

SEQ ID NO: 328318 - protein, 9 aa, Homo Sapiens
QSSKAEAEA

SEQ ID NO: 328319 - protein, 9 aa, Homo Sapiens
AVIHDVARA

SEQ ID NO: 328320 - protein, 9 aa, Homo Sapiens
LHTSETSYL

SEQ ID NO: 328321 - protein, 9 aa, Homo Sapiens
NLILLTIFT

SEQ ID NO: 328322 - protein, 9 aa, Homo Sapiens
IWLPSNIYT

SEQ ID NO: 328323 - protein, 9 aa, Homo Sapiens
TLKGKVIPP

SEQ ID NO: 328324 - protein, 9 aa, Homo Sapiens
PIDWSGDVP

SEQ ID NO: 328325 - protein, 9 aa, Homo Sapiens
FSRDDSKFF

SEQ ID NO: 328326 - protein, 9 aa, Homo Sapiens
ATTEAQESG

SEQ ID NO: 328327 - protein, 9 aa, Homo Sapiens
GDRKLTAKE

SEQ ID NO: 328328 - protein, 9 aa, Homo Sapiens
KEASLQKDP

SEQ ID NO: 328329 - protein, 9 aa, Homo Sapiens
QGAEAQAAE

SEQ ID NO: 328330 - protein, 9 aa, Homo Sapiens
PKTDLLMIA

SEQ ID NO: 328331 - protein, 9 aa, Homo Sapiens
IKAPEQGSH

SEQ ID NO: 328332 - protein, 9 aa, Homo Sapiens
SEIQMLNNP

SEQ ID NO: 328333 - protein, 9 aa, Homo Sapiens
RRCCSVELD

SEQ ID NO: 328334 - protein, 9 aa, Homo Sapiens
EHQGEGTTP

SEQ ID NO: 328335 - protein, 9 aa, Homo Sapiens
SPEEHSLSR

SEQ ID NO: 328336 - protein, 9 aa, Homo Sapiens
NKEWQFHFA

SEQ ID NO: 328337 - protein, 9 aa, Homo Sapiens
RRCARDPDN

SEQ ID NO: 328338 - protein, 9 aa, Homo Sapiens
NEITSSTIS

SEQ ID NO: 328339 - protein, 9 aa, Homo Sapiens
EAWGIILET

SEQ ID NO: 328340 - protein, 9 aa, Homo Sapiens
SPWHMHLEM

SEQ ID NO: 328341 - protein, 9 aa, Homo Sapiens
AFQTQAGTQ

SEQ ID NO: 328342 - protein, 9 aa, Homo Sapiens
NLRWLLEAG

SEQ ID NO: 328343 - protein, 9 aa, Homo Sapiens
NERDEYITK

SEQ ID NO: 328344 - protein, 9 aa, Homo Sapiens
PKMCQYLRE

SEQ ID NO: 328345 - protein, 9 aa, Homo Sapiens
VPWHDLGSR

SEQ ID NO: 328346 - protein, 9 aa, Homo Sapiens
ASMPDLRRF

SEQ ID NO: 328347 - protein, 9 aa, Homo Sapiens
LKVDSFREQ

SEQ ID NO: 328348 - protein, 9 aa, Homo Sapiens
TVMDQKKFE

SEQ ID NO: 328349 - protein, 9 aa, Homo Sapiens
RRKGPQWHI

SEQ ID NO: 328350 - protein, 9 aa, Homo Sapiens
LAWEFMIKT

SEQ ID NO: 328351 - protein, 9 aa, Homo Sapiens
ASVLNLNCI

SEQ ID NO: 328352 - protein, 9 aa, Homo Sapiens
EKSGAFRLV

SEQ ID NO: 328353 - protein, 9 aa, Homo Sapiens
APCTVTSAS

SEQ ID NO: 328354 - protein, 9 aa, Homo Sapiens
TWLLSDGPA

SEQ ID NO: 328355 - protein, 9 aa, Homo Sapiens
VSGWHCFMT

SEQ ID NO: 328356 - protein, 9 aa, Homo Sapiens
SVEMDIVVD

SEQ ID NO: 328357 - protein, 9 aa, Homo Sapiens
HTWEKIYAI

SEQ ID NO: 328358 - protein, 9 aa, Homo Sapiens
ELQCNVISS

SEQ ID NO: 328359 - protein, 9 aa, Homo Sapiens
KILGAVRRQ

SEQ ID NO: 328360 - protein, 9 aa, Homo Sapiens
ADMERHHIL

SEQ ID NO: 328361 - protein, 9 aa, Homo Sapiens
FMTFAGAEV

SEQ ID NO: 328362 - protein, 9 aa, Homo Sapiens
ALNMVHKFY

SEQ ID NO: 328363 - protein, 9 aa, Homo Sapiens
SSLVPGYWH

SEQ ID NO: 328364 - protein, 9 aa, Homo Sapiens
PDGLILWTR

SEQ ID NO: 328365 - protein, 9 aa, Homo Sapiens
TGIVILSMI

SEQ ID NO: 328366 - protein, 9 aa, Homo Sapiens
MTTSSLHFA

SEQ ID NO: 328367 - protein, 9 aa, Homo Sapiens
SPATLKVGK

SEQ ID NO: 328368 - protein, 9 aa, Homo Sapiens
PHVPPGTPM

SEQ ID NO: 328369 - protein, 9 aa, Homo Sapiens
KMCQYLREE

SEQ ID NO: 328370 - protein, 9 aa, Homo Sapiens
EYTCEAGAS

SEQ ID NO: 328371 - protein, 9 aa, Homo Sapiens
MAIWKWHRG

SEQ ID NO: 328372 - protein, 9 aa, Homo Sapiens
SIQVDTFRA

SEQ ID NO: 328373 - protein, 9 aa, Homo Sapiens
YVSAQPPAG

SEQ ID NO: 328374 - protein, 9 aa, Homo Sapiens
PSWWGFLVT

SEQ ID NO: 328375 - protein, 9 aa, Homo Sapiens
LHGVPPDIL

SEQ ID NO: 328376 - protein, 9 aa, Homo Sapiens
PCKNGGHYM

SEQ ID NO: 328377 - protein, 9 aa, Homo Sapiens
PSLVSGNME

SEQ ID NO: 328378 - protein, 9 aa, Homo Sapiens
CRQQSSCQP

SEQ ID NO: 328379 - protein, 9 aa, Homo Sapiens
EHHGVRPHG

SEQ ID NO: 328380 - protein, 9 aa, Homo Sapiens
DCVSEDDTT

SEQ ID NO: 328381 - protein, 9 aa, Homo Sapiens
MAGPTHQDA

SEQ ID NO: 328382 - protein, 9 aa, Homo Sapiens
LPGDLSGLS

SEQ ID NO: 328383 - protein, 9 aa, Homo Sapiens
TNSPATLKV

SEQ ID NO: 328384 - protein, 9 aa, Homo Sapiens
PQKKVRSIS

SEQ ID NO: 328385 - protein, 9 aa, Homo Sapiens
ALLLSSVHP

SEQ ID NO: 328386 - protein, 9 aa, Homo Sapiens
HRWQQFRHL

SEQ ID NO: 328387 - protein, 9 aa, Homo Sapiens
CEREELPKE

SEQ ID NO: 328388 - protein, 9 aa, Homo Sapiens
LCLACRSDA

SEQ ID NO: 328389 - protein, 9 aa, Homo Sapiens
LLLPLPRSW

SEQ ID NO: 328390 - protein, 9 aa, Homo Sapiens
LPPSWAALS

SEQ ID NO: 328391 - protein, 9 aa, Homo Sapiens
IREELEVLV

SEQ ID NO: 328392 - protein, 9 aa, Homo Sapiens
VLIHDENDN

SEQ ID NO: 328393 - protein, 9 aa, Homo Sapiens
HLMLEANEW

SEQ ID NO: 328394 - protein, 9 aa, Homo Sapiens
SADCVSEDD

SEQ ID NO: 328395 - protein, 9 aa, Homo Sapiens
TNVPDFILM

SEQ ID NO: 328396 - protein, 9 aa, Homo Sapiens
IKRKTNVLS

SEQ ID NO: 328397 - protein, 9 aa, Homo Sapiens
LHTEVIQLE

SEQ ID NO: 328398 - protein, 9 aa, Homo Sapiens
LDRKKCTVN

SEQ ID NO: 328399 - protein, 9 aa, Homo Sapiens
REWKKITDS

SEQ ID NO: 328400 - protein, 9 aa, Homo Sapiens
LFAAVPRGC

SEQ ID NO: 328401 - protein, 9 aa, Homo Sapiens
RLASMPDLR

SEQ ID NO: 328402 - protein, 9 aa, Homo Sapiens
LVPSSSLSP

SEQ ID NO: 328403 - protein, 9 aa, Homo Sapiens
DSRHSSRRR

SEQ ID NO: 328404 - protein, 9 aa, Homo Sapiens
NKTDVATPF

SEQ ID NO: 328405 - protein, 9 aa, Homo Sapiens
SVTGLVVMD

SEQ ID NO: 328406 - protein, 9 aa, Homo Sapiens
PTGLGPAPY

SEQ ID NO: 328407 - protein, 9 aa, Homo Sapiens
AHQGRDCRC

SEQ ID NO: 328408 - protein, 9 aa, Homo Sapiens
THPWRQVCD

SEQ ID NO: 328409 - protein, 9 aa, Homo Sapiens
AKEGLLKVA

SEQ ID NO: 328410 - protein, 9 aa, Homo Sapiens
ILLELVSSS

SEQ ID NO: 328411 - protein, 9 aa, Homo Sapiens
SYVSWFDYN

SEQ ID NO: 328412 - protein, 9 aa, Homo Sapiens
MREAQEQAY

SEQ ID NO: 328413 - protein, 9 aa, Homo Sapiens
RWSQFPVLH

SEQ ID NO: 328414 - protein, 9 aa, Homo Sapiens
FTKDPGRLP

SEQ ID NO: 328415 - protein, 9 aa, Homo Sapiens
HGSSKPTNG

SEQ ID NO: 328416 - protein, 9 aa, Homo Sapiens
TLYEALAAI

SEQ ID NO: 328417 - protein, 9 aa, Homo Sapiens
LVNEYVCRV

SEQ ID NO: 328418 - protein, 9 aa, Homo Sapiens
KRRQRAEDD

SEQ ID NO: 328419 - protein, 9 aa, Homo Sapiens
STWMFQSPR

SEQ ID NO: 328420 - protein, 9 aa, Homo Sapiens
TSQIKEARR

SEQ ID NO: 328421 - protein, 9 aa, Homo Sapiens
RSRPRKSHH

SEQ ID NO: 328422 - protein, 9 aa, Homo Sapiens
MAKEGLLKV

SEQ ID NO: 328423 - protein, 9 aa, Homo Sapiens
PTNGTKVVS

SEQ ID NO: 328424 - protein, 9 aa, Homo Sapiens
SSRHHHRHR

SEQ ID NO: 328425 - protein, 9 aa, Homo Sapiens
QADHICLEN

SEQ ID NO: 328426 - protein, 9 aa, Homo Sapiens
ELQFVSSLR

SEQ ID NO: 328427 - protein, 9 aa, Homo Sapiens
PPHKRWQRS

SEQ ID NO: 328428 - protein, 9 aa, Homo Sapiens
YTLDRNSLC

SEQ ID NO: 328429 - protein, 9 aa, Homo Sapiens
CYKDHIQQF

SEQ ID NO: 328430 - protein, 9 aa, Homo Sapiens
YVDKYRHMC

SEQ ID NO: 328431 - protein, 9 aa, Homo Sapiens
SYSLHLASR

SEQ ID NO: 328432 - protein, 9 aa, Homo Sapiens
CGKIVALDF

SEQ ID NO: 328433 - protein, 9 aa, Homo Sapiens
LPGVKTHSE

SEQ ID NO: 328434 - protein, 9 aa, Homo Sapiens
LAWSDSAQI

SEQ ID NO: 328435 - protein, 9 aa, Homo Sapiens
LCKGGDPKY

SEQ ID NO: 328436 - protein, 9 aa, Homo Sapiens
HDSAATSLQ

SEQ ID NO: 328437 - protein, 9 aa, Homo Sapiens
LMAAEVVVP

SEQ ID NO: 328438 - protein, 9 aa, Homo Sapiens
EKQKKMKAY

SEQ ID NO: 328439 - protein, 9 aa, Homo Sapiens
SAASGLAYL

SEQ ID NO: 328440 - protein, 9 aa, Homo Sapiens
LAARDALVE

SEQ ID NO: 328441 - protein, 9 aa, Homo Sapiens
WRTGLAFCP

SEQ ID NO: 328442 - protein, 9 aa, Homo Sapiens
WVLEGMKGL

SEQ ID NO: 328443 - protein, 9 aa, Homo Sapiens
SSWHGQRGA

SEQ ID NO: 328444 - protein, 9 aa, Homo Sapiens
DHMTPEQIV

SEQ ID NO: 328445 - protein, 9 aa, Homo Sapiens
TLDFAPQTL

SEQ ID NO: 328446 - protein, 9 aa, Homo Sapiens
AAPPKAPIH

SEQ ID NO: 328447 - protein, 9 aa, Homo Sapiens
KSKGQTHPR

SEQ ID NO: 328448 - protein, 9 aa, Homo Sapiens
LSPPHKRWQ

SEQ ID NO: 328449 - protein, 9 aa, Homo Sapiens
LIAFGAAIF

SEQ ID NO: 328450 - protein, 9 aa, Homo Sapiens
EMKQMTRWF

SEQ ID NO: 328451 - protein, 9 aa, Homo Sapiens
SIQNRIVHS

SEQ ID NO: 328452 - protein, 9 aa, Homo Sapiens
CYDEFFPMS

SEQ ID NO: 328453 - protein, 9 aa, Homo Sapiens
SPVSLVQEG

SEQ ID NO: 328454 - protein, 9 aa, Homo Sapiens
GEIARLTIS

SEQ ID NO: 328455 - protein, 9 aa, Homo Sapiens
SMLVKYAEK

SEQ ID NO: 328456 - protein, 9 aa, Homo Sapiens
NPSILHYQQ

SEQ ID NO: 328457 - protein, 9 aa, Homo Sapiens
ARRWKDSWK

SEQ ID NO: 328458 - protein, 9 aa, Homo Sapiens
LWVESVPGY

SEQ ID NO: 328459 - protein, 9 aa, Homo Sapiens
GPEGATNMG

SEQ ID NO: 328460 - protein, 9 aa, Homo Sapiens
LPPMSVAAS

SEQ ID NO: 328461 - protein, 9 aa, Homo Sapiens
DGIDLTNLS

SEQ ID NO: 328462 - protein, 9 aa, Homo Sapiens
DKPWAQLPD

SEQ ID NO: 328463 - protein, 9 aa, Homo Sapiens
HENNRVLFH

SEQ ID NO: 328464 - protein, 9 aa, Homo Sapiens
DNIHLYAEA

SEQ ID NO: 328465 - protein, 9 aa, Homo Sapiens
PGGSDSMPS

SEQ ID NO: 328466 - protein, 9 aa, Homo Sapiens
FTTVEVSAT

SEQ ID NO: 328467 - protein, 9 aa, Homo Sapiens
LPALRPLQH

SEQ ID NO: 328468 - protein, 9 aa, Homo Sapiens
QIVWLKLQQ

SEQ ID NO: 328469 - protein, 9 aa, Homo Sapiens
PLDKSESQE

SEQ ID NO: 328470 - protein, 9 aa, Homo Sapiens
GQAGDGERA

SEQ ID NO: 328471 - protein, 9 aa, Homo Sapiens
GGRERRDRR

SEQ ID NO: 328472 - protein, 9 aa, Homo Sapiens
DNLQKSTDS

SEQ ID NO: 328473 - protein, 9 aa, Homo Sapiens
ASLSGSSLY

SEQ ID NO: 328474 - protein, 9 aa, Homo Sapiens
GPSRRCSRD

SEQ ID NO: 328475 - protein, 9 aa, Homo Sapiens
LIYKSRRLS

SEQ ID NO: 328476 - protein, 9 aa, Homo Sapiens
PRELMLQAM

SEQ ID NO: 328477 - protein, 9 aa, Homo Sapiens
STSPVEEFY

SEQ ID NO: 328478 - protein, 9 aa, Homo Sapiens
VCLEKTLLH

SEQ ID NO: 328479 - protein, 9 aa, Homo Sapiens
SMRSCRSVP

SEQ ID NO: 328480 - protein, 9 aa, Homo Sapiens
KDSSSTESD

SEQ ID NO: 328481 - protein, 9 aa, Homo Sapiens
TNMPTPTTD

SEQ ID NO: 328482 - protein, 9 aa, Homo Sapiens
LTGTPGTTP

SEQ ID NO: 328483 - protein, 9 aa, Homo Sapiens
VLVLIAAII

SEQ ID NO: 328484 - protein, 9 aa, Homo Sapiens
IIIPSYVSW

SEQ ID NO: 328485 - protein, 9 aa, Homo Sapiens
MHLEMHCLV

SEQ ID NO: 328486 - protein, 9 aa, Homo Sapiens
EELQVFQGH

SEQ ID NO: 328487 - protein, 9 aa, Homo Sapiens
PLPYHRHPV

SEQ ID NO: 328488 - protein, 9 aa, Homo Sapiens
VLEETRKEM

SEQ ID NO: 328489 - protein, 9 aa, Homo Sapiens
LLQEGEGCL

SEQ ID NO: 328490 - protein, 9 aa, Homo Sapiens
LHQAKEDMT

SEQ ID NO: 328491 - protein, 9 aa, Homo Sapiens
ERSWVLSQL

SEQ ID NO: 328492 - protein, 9 aa, Homo Sapiens
SIMILGRVI

SEQ ID NO: 328493 - protein, 9 aa, Homo Sapiens
QEVKEILLW

SEQ ID NO: 328494 - protein, 9 aa, Homo Sapiens
VCEVDNELC

SEQ ID NO: 328495 - protein, 9 aa, Homo Sapiens
DVATPFGGF

SEQ ID NO: 328496 - protein, 9 aa, Homo Sapiens
LQAWHAGQT

SEQ ID NO: 328497 - protein, 9 aa, Homo Sapiens
GDSNIHGHT

SEQ ID NO: 328498 - protein, 9 aa, Homo Sapiens
ASEPAAQAL

SEQ ID NO: 328499 - protein, 9 aa, Homo Sapiens
VSTTCELYL

SEQ ID NO: 328500 - protein, 9 aa, Homo Sapiens
HCSCGDGKE

SEQ ID NO: 328501 - protein, 9 aa, Homo Sapiens
YVVRSVCQD

SEQ ID NO: 328502 - protein, 9 aa, Homo Sapiens
VLSTNSPAT

SEQ ID NO: 328503 - protein, 9 aa, Homo Sapiens
SRAVMGVMK

SEQ ID NO: 328504 - protein, 9 aa, Homo Sapiens
GASSSCRQQ

SEQ ID NO: 328505 - protein, 9 aa, Homo Sapiens
AADCGMKLY

SEQ ID NO: 328506 - protein, 9 aa, Homo Sapiens
WQFHFAGIR

SEQ ID NO: 328507 - protein, 9 aa, Homo Sapiens
CCPLPAQIQ

SEQ ID NO: 328508 - protein, 9 aa, Homo Sapiens
VLWLLFRLM

SEQ ID NO: 328509 - protein, 9 aa, Homo Sapiens
LPARDKHAL

SEQ ID NO: 328510 - protein, 9 aa, Homo Sapiens
AESHVNKLR

SEQ ID NO: 328511 - protein, 9 aa, Homo Sapiens
EREKEISSL

SEQ ID NO: 328512 - protein, 9 aa, Homo Sapiens
LLYHTDFFP

SEQ ID NO: 328513 - protein, 9 aa, Homo Sapiens
PVSPIRSPV

SEQ ID NO: 328514 - protein, 9 aa, Homo Sapiens
MPLSSQTPG

SEQ ID NO: 328515 - protein, 9 aa, Homo Sapiens
SSYRESQER

SEQ ID NO: 328516 - protein, 9 aa, Homo Sapiens
ASPEVESGP

SEQ ID NO: 328517 - protein, 9 aa, Homo Sapiens
DKVACLLDK

SEQ ID NO: 328518 - protein, 9 aa, Homo Sapiens
ECCKVFRQN

SEQ ID NO: 328519 - protein, 9 aa, Homo Sapiens
SQEKIENVQ

SEQ ID NO: 328520 - protein, 9 aa, Homo Sapiens
WFWWRQGFA

SEQ ID NO: 328521 - protein, 9 aa, Homo Sapiens
LEECLARQK

SEQ ID NO: 328522 - protein, 9 aa, Homo Sapiens
VPRQDRPVC

SEQ ID NO: 328523 - protein, 9 aa, Homo Sapiens
AKHGEPACV

SEQ ID NO: 328524 - protein, 9 aa, Homo Sapiens
DHQQLEAVY

SEQ ID NO: 328525 - protein, 9 aa, Homo Sapiens
SKIIVGDAT

SEQ ID NO: 328526 - protein, 9 aa, Homo Sapiens
VPSLCVAEL

SEQ ID NO: 328527 - protein, 9 aa, Homo Sapiens
MWGRGGFDR

SEQ ID NO: 328528 - protein, 9 aa, Homo Sapiens
PLAMAQVTH

SEQ ID NO: 328529 - protein, 9 aa, Homo Sapiens
DVWEWPHSE

SEQ ID NO: 328530 - protein, 9 aa, Homo Sapiens
RLCECVGGD

SEQ ID NO: 328531 - protein, 9 aa, Homo Sapiens
TGLLPGEAA

SEQ ID NO: 328532 - protein, 9 aa, Homo Sapiens
ELSNLTDEE

SEQ ID NO: 328533 - protein, 9 aa, Homo Sapiens
YWQLCWKLV

SEQ ID NO: 328534 - protein, 9 aa, Homo Sapiens
TLVLTIIVF

SEQ ID NO: 328535 - protein, 9 aa, Homo Sapiens
GMLSIGSAL

SEQ ID NO: 328536 - protein, 9 aa, Homo Sapiens
PLPPSSWLQ

SEQ ID NO: 328537 - protein, 9 aa, Homo Sapiens
FTHCSGASR

SEQ ID NO: 328538 - protein, 9 aa, Homo Sapiens
IAIKLWLHI

SEQ ID NO: 328539 - protein, 9 aa, Homo Sapiens
DPMAFVKAK

SEQ ID NO: 328540 - protein, 9 aa, Homo Sapiens
HLTTQHRSP

SEQ ID NO: 328541 - protein, 9 aa, Homo Sapiens
ICVYLFTGK

SEQ ID NO: 328542 - protein, 9 aa, Homo Sapiens
ASSKLGPQV

SEQ ID NO: 328543 - protein, 9 aa, Homo Sapiens
ARWKPGWRT

SEQ ID NO: 328544 - protein, 9 aa, Homo Sapiens
FLRTYQTQG

SEQ ID NO: 328545 - protein, 9 aa, Homo Sapiens
AEYPKMCQY

SEQ ID NO: 328546 - protein, 9 aa, Homo Sapiens
DFVNQRTRK

SEQ ID NO: 328547 - protein, 9 aa, Homo Sapiens
RDALVELSG

SEQ ID NO: 328548 - protein, 9 aa, Homo Sapiens
ATNMGTPMM

SEQ ID NO: 328549 - protein, 9 aa, Homo Sapiens
LLRDVWLEE

SEQ ID NO: 328550 - protein, 9 aa, Homo Sapiens
NPEDVPPEI

SEQ ID NO: 328551 - protein, 9 aa, Homo Sapiens
KFHMWPASS

SEQ ID NO: 328552 - protein, 9 aa, Homo Sapiens
ILAHQGAQV

SEQ ID NO: 328553 - protein, 9 aa, Homo Sapiens
QMTRWFSAD

SEQ ID NO: 328554 - protein, 9 aa, Homo Sapiens
SSKVEQVQL

SEQ ID NO: 328555 - protein, 9 aa, Homo Sapiens
SSLTSISTF

SEQ ID NO: 328556 - protein, 9 aa, Homo Sapiens
LMDCVTMDN

SEQ ID NO: 328557 - protein, 9 aa, Homo Sapiens
YFSQFGTKC

SEQ ID NO: 328558 - protein, 9 aa, Homo Sapiens
INHYGGHLC

SEQ ID NO: 328559 - protein, 9 aa, Homo Sapiens
AEQCNIMRL

SEQ ID NO: 328560 - protein, 9 aa, Homo Sapiens
CMSQIQAFL

SEQ ID NO: 328561 - protein, 9 aa, Homo Sapiens
KEPSLLVLL

SEQ ID NO: 328562 - protein, 9 aa, Homo Sapiens
KLGEHEKVL

SEQ ID NO: 328563 - protein, 9 aa, Homo Sapiens
SISAEGTVV

SEQ ID NO: 328564 - protein, 9 aa, Homo Sapiens
GKCEAMLEM

SEQ ID NO: 328565 - protein, 9 aa, Homo Sapiens
CSSHGRCVD

SEQ ID NO: 328566 - protein, 9 aa, Homo Sapiens
RHILLLAGK

SEQ ID NO: 328567 - protein, 9 aa, Homo Sapiens
VDWHQIQAD

SEQ ID NO: 328568 - protein, 9 aa, Homo Sapiens
RVAMEFAFR

SEQ ID NO: 328569 - protein, 9 aa, Homo Sapiens
QCEQGFPVP

SEQ ID NO: 328570 - protein, 9 aa, Homo Sapiens
AKKHQDFLV

SEQ ID NO: 328571 - protein, 9 aa, Homo Sapiens
DCLQTALLV

SEQ ID NO: 328572 - protein, 9 aa, Homo Sapiens
DAHANGWVQ

SEQ ID NO: 328573 - protein, 9 aa, Homo Sapiens
INLDGNGQD

SEQ ID NO: 328574 - protein, 9 aa, Homo Sapiens
VLQASIDTA

SEQ ID NO: 328575 - protein, 9 aa, Homo Sapiens
VAGGTQPVA

SEQ ID NO: 328576 - protein, 9 aa, Homo Sapiens
ACSSHGRCV

SEQ ID NO: 328577 - protein, 9 aa, Homo Sapiens
ETLLHQLYS

SEQ ID NO: 328578 - protein, 9 aa, Homo Sapiens
YNANIDNAG

SEQ ID NO: 328579 - protein, 9 aa, Homo Sapiens
EEEVRMAAL

SEQ ID NO: 328580 - protein, 9 aa, Homo Sapiens
ELCITQFQV

SEQ ID NO: 328581 - protein, 9 aa, Homo Sapiens
PLHCAAASG

SEQ ID NO: 328582 - protein, 9 aa, Homo Sapiens
PGWVEVKDK

SEQ ID NO: 328583 - protein, 9 aa, Homo Sapiens
SHPGPQSVP

SEQ ID NO: 328584 - protein, 9 aa, Homo Sapiens
LGASIPCHS

SEQ ID NO: 328585 - protein, 9 aa, Homo Sapiens
EMWWNKRKG

SEQ ID NO: 328586 - protein, 9 aa, Homo Sapiens
EDVQDMSPV

SEQ ID NO: 328587 - protein, 9 aa, Homo Sapiens
DLMDCVTMD

SEQ ID NO: 328588 - protein, 9 aa, Homo Sapiens
PAGCKVGLI

SEQ ID NO: 328589 - protein, 9 aa, Homo Sapiens
GGKVRRITN

SEQ ID NO: 328590 - protein, 9 aa, Homo Sapiens
FWMFHRQAV

SEQ ID NO: 328591 - protein, 9 aa, Homo Sapiens
ETRKEMAPV

SEQ ID NO: 328592 - protein, 9 aa, Homo Sapiens
SQLSMSSQA

SEQ ID NO: 328593 - protein, 9 aa, Homo Sapiens
PFRKGPGKQ

SEQ ID NO: 328594 - protein, 9 aa, Homo Sapiens
QHSPNFLQG

SEQ ID NO: 328595 - protein, 9 aa, Homo Sapiens
HLKDQDKAA

SEQ ID NO: 328596 - protein, 9 aa, Homo Sapiens
RRCWTCSRS

SEQ ID NO: 328597 - protein, 9 aa, Homo Sapiens
TVNELQNLM

SEQ ID NO: 328598 - protein, 9 aa, Homo Sapiens
EQEGACERE

SEQ ID NO: 328599 - protein, 9 aa, Homo Sapiens
DRKLTAKEE

SEQ ID NO: 328600 - protein, 9 aa, Homo Sapiens
SDSVDGPKS

SEQ ID NO: 328601 - protein, 9 aa, Homo Sapiens
KKLPFLCEL

SEQ ID NO: 328602 - protein, 9 aa, Homo Sapiens
QRSSWHTGR

SEQ ID NO: 328603 - protein, 9 aa, Homo Sapiens
DHITHCWQD

SEQ ID NO: 328604 - protein, 9 aa, Homo Sapiens
CFLFFCQKS

SEQ ID NO: 328605 - protein, 9 aa, Homo Sapiens
RRWLDLGSC

SEQ ID NO: 328606 - protein, 9 aa, Homo Sapiens
AGICACTNN

SEQ ID NO: 328607 - protein, 9 aa, Homo Sapiens
HFYCGSSFY

SEQ ID NO: 328608 - protein, 9 aa, Homo Sapiens
RELSRISRE

SEQ ID NO: 328609 - protein, 9 aa, Homo Sapiens
LLSARLPPG

SEQ ID NO: 328610 - protein, 9 aa, Homo Sapiens
RGMDSTRHS

SEQ ID NO: 328611 - protein, 9 aa, Homo Sapiens
ERNIADGKE

SEQ ID NO: 328612 - protein, 9 aa, Homo Sapiens
APEQGSHFS

SEQ ID NO: 328613 - protein, 9 aa, Homo Sapiens
RIGRHMKRQ

SEQ ID NO: 328614 - protein, 9 aa, Homo Sapiens
RLPYLTAKI

SEQ ID NO: 328615 - protein, 9 aa, Homo Sapiens
RTLRICFLL

SEQ ID NO: 328616 - protein, 9 aa, Homo Sapiens
TDITQGVPR

SEQ ID NO: 328617 - protein, 9 aa, Homo Sapiens
PCTRLHGNI

SEQ ID NO: 328618 - protein, 9 aa, Homo Sapiens
FCKACITHW

SEQ ID NO: 328619 - protein, 9 aa, Homo Sapiens
TTGKTNQKL

SEQ ID NO: 328620 - protein, 9 aa, Homo Sapiens
DQVSWEYGG

SEQ ID NO: 328621 - protein, 9 aa, Homo Sapiens
CPANGAGWP

SEQ ID NO: 328622 - protein, 9 aa, Homo Sapiens
DFCDSCHVW

SEQ ID NO: 328623 - protein, 9 aa, Homo Sapiens
LHFLVMLRI

SEQ ID NO: 328624 - protein, 9 aa, Homo Sapiens
CAWDGVACM

SEQ ID NO: 328625 - protein, 9 aa, Homo Sapiens
DGNLRFVVE

SEQ ID NO: 328626 - protein, 9 aa, Homo Sapiens
QRKQEEAWL

SEQ ID NO: 328627 - protein, 9 aa, Homo Sapiens
IPHGCILVM

SEQ ID NO: 328628 - protein, 9 aa, Homo Sapiens
EEEEEENGG

SEQ ID NO: 328629 - protein, 9 aa, Homo Sapiens
NGAGACCRF

SEQ ID NO: 328630 - protein, 9 aa, Homo Sapiens
LTFITLDFV

SEQ ID NO: 328631 - protein, 9 aa, Homo Sapiens
AGTQIPIER

SEQ ID NO: 328632 - protein, 9 aa, Homo Sapiens
DIELAVSLC

SEQ ID NO: 328633 - protein, 9 aa, Homo Sapiens
LSTVGRVTP

SEQ ID NO: 328634 - protein, 9 aa, Homo Sapiens
KSLYHSMEW

SEQ ID NO: 328635 - protein, 9 aa, Homo Sapiens
KGPRKMSMI

SEQ ID NO: 328636 - protein, 9 aa, Homo Sapiens
PQGLWVESV

SEQ ID NO: 328637 - protein, 9 aa, Homo Sapiens
WRFWRKRAE

SEQ ID NO: 328638 - protein, 9 aa, Homo Sapiens
ESMAGPTHQ

SEQ ID NO: 328639 - protein, 9 aa, Homo Sapiens
WLNEDKVAI

SEQ ID NO: 328640 - protein, 9 aa, Homo Sapiens
FGFGFSPGG

SEQ ID NO: 328641 - protein, 9 aa, Homo Sapiens
QVAIDLHEA

SEQ ID NO: 328642 - protein, 9 aa, Homo Sapiens
VFSQHFYCG

SEQ ID NO: 328643 - protein, 9 aa, Homo Sapiens
AFDRYVVIC

SEQ ID NO: 328644 - protein, 9 aa, Homo Sapiens
LEMSSILCH

SEQ ID NO: 328645 - protein, 9 aa, Homo Sapiens
QADAPHGVV

SEQ ID NO: 328646 - protein, 9 aa, Homo Sapiens
GSSKVEQVQ

SEQ ID NO: 328647 - protein, 9 aa, Homo Sapiens
RWGKYGALT

SEQ ID NO: 328648 - protein, 9 aa, Homo Sapiens
SHPLRVFAA

SEQ ID NO: 328649 - protein, 9 aa, Homo Sapiens
QGLALDGKL

SEQ ID NO: 328650 - protein, 9 aa, Homo Sapiens
AQSSKAEAE

SEQ ID NO: 328651 - protein, 9 aa, Homo Sapiens
EQQQQQQRP

SEQ ID NO: 328652 - protein, 9 aa, Homo Sapiens
RDYHSLCEW

SEQ ID NO: 328653 - protein, 9 aa, Homo Sapiens
LLTLWAKPP

SEQ ID NO: 328654 - protein, 9 aa, Homo Sapiens
AEEQAQIIW

SEQ ID NO: 328655 - protein, 9 aa, Homo Sapiens
SEHRNFLVS

SEQ ID NO: 328656 - protein, 9 aa, Homo Sapiens
FLVSGWHCF

SEQ ID NO: 328657 - protein, 9 aa, Homo Sapiens
DMERHHILF

SEQ ID NO: 328658 - protein, 9 aa, Homo Sapiens
AQCLNSFLR

SEQ ID NO: 328659 - protein, 9 aa, Homo Sapiens
KQSPLEESS

SEQ ID NO: 328660 - protein, 9 aa, Homo Sapiens
DSFSKRQED

SEQ ID NO: 328661 - protein, 9 aa, Homo Sapiens
ICRRNFSRQ

SEQ ID NO: 328662 - protein, 9 aa, Homo Sapiens
KCTVNREEL

SEQ ID NO: 328663 - protein, 9 aa, Homo Sapiens
FAISLGSTR

SEQ ID NO: 328664 - protein, 9 aa, Homo Sapiens
HMVNPDWLW

SEQ ID NO: 328665 - protein, 9 aa, Homo Sapiens
SRHFYMAKG

SEQ ID NO: 328666 - protein, 9 aa, Homo Sapiens
RPCASLRCP

SEQ ID NO: 328667 - protein, 9 aa, Homo Sapiens
GTINQHLRK

SEQ ID NO: 328668 - protein, 9 aa, Homo Sapiens
ASEDVDKGP

SEQ ID NO: 328669 - protein, 9 aa, Homo Sapiens
LAGVAVLII

SEQ ID NO: 328670 - protein, 9 aa, Homo Sapiens
ELCMYDEKA

SEQ ID NO: 328671 - protein, 9 aa, Homo Sapiens
PSCCLLLEL

SEQ ID NO: 328672 - protein, 9 aa, Homo Sapiens
DENVQGCHC

SEQ ID NO: 328673 - protein, 9 aa, Homo Sapiens
IITDSKLYI

SEQ ID NO: 328674 - protein, 9 aa, Homo Sapiens
LSPLGPVTS

SEQ ID NO: 328675 - protein, 9 aa, Homo Sapiens
YYTITEFQT

SEQ ID NO: 328676 - protein, 9 aa, Homo Sapiens
PHQHTDDKF

SEQ ID NO: 328677 - protein, 9 aa, Homo Sapiens
AQDLVMHAR

SEQ ID NO: 328678 - protein, 9 aa, Homo Sapiens
WAKPPSEAE

SEQ ID NO: 328679 - protein, 9 aa, Homo Sapiens
TLTKCPHCK

SEQ ID NO: 328680 - protein, 9 aa, Homo Sapiens
APTFSSLTS

SEQ ID NO: 328681 - protein, 9 aa, Homo Sapiens
LSIAAQTLL

SEQ ID NO: 328682 - protein, 9 aa, Homo Sapiens
STFLDMLHR

SEQ ID NO: 328683 - protein, 9 aa, Homo Sapiens
MCSMVGNGD

SEQ ID NO: 328684 - protein, 9 aa, Homo Sapiens
MLCHHGGQL

SEQ ID NO: 328685 - protein, 9 aa, Homo Sapiens
KHTTPFSVF

SEQ ID NO: 328686 - protein, 9 aa, Homo Sapiens
SINIGQLNG

SEQ ID NO: 328687 - protein, 9 aa, Homo Sapiens
FHRQAVYDI

SEQ ID NO: 328688 - protein, 9 aa, Homo Sapiens
RWLLEAGSL

SEQ ID NO: 328689 - protein, 9 aa, Homo Sapiens
ERKLTGVMK

SEQ ID NO: 328690 - protein, 9 aa, Homo Sapiens
FCQASEGKH

SEQ ID NO: 328691 - protein, 9 aa, Homo Sapiens
ICHVCGIHL

SEQ ID NO: 328692 - protein, 9 aa, Homo Sapiens
PSFMWYKDS

SEQ ID NO: 328693 - protein, 9 aa, Homo Sapiens
RAPQKKVRS

SEQ ID NO: 328694 - protein, 9 aa, Homo Sapiens
WLEGSCVSV

SEQ ID NO: 328695 - protein, 9 aa, Homo Sapiens
ARDKHALKQ

SEQ ID NO: 328696 - protein, 9 aa, Homo Sapiens
LEEVLNLAT

SEQ ID NO: 328697 - protein, 9 aa, Homo Sapiens
LTLWAKPPS

SEQ ID NO: 328698 - protein, 9 aa, Homo Sapiens
WTNYNTFGS

SEQ ID NO: 328699 - protein, 9 aa, Homo Sapiens
SPAGILCVD

SEQ ID NO: 328700 - protein, 9 aa, Homo Sapiens
QALEDVKMV

SEQ ID NO: 328701 - protein, 9 aa, Homo Sapiens
LPTGETIYF

SEQ ID NO: 328702 - protein, 9 aa, Homo Sapiens
RKEFTMTCQ

SEQ ID NO: 328703 - protein, 9 aa, Homo Sapiens
SQSDIKCHR

SEQ ID NO: 328704 - protein, 9 aa, Homo Sapiens
LDPLGLQEV

SEQ ID NO: 328705 - protein, 9 aa, Homo Sapiens
TSYAPDAKP

SEQ ID NO: 328706 - protein, 9 aa, Homo Sapiens
VLQGLSGCL

SEQ ID NO: 328707 - protein, 9 aa, Homo Sapiens
GRILAHQGA

SEQ ID NO: 328708 - protein, 9 aa, Homo Sapiens
CRLCECVGG

SEQ ID NO: 328709 - protein, 9 aa, Homo Sapiens
GIKHWIFIS

SEQ ID NO: 328710 - protein, 9 aa, Homo Sapiens
IGMPLSSQT

SEQ ID NO: 328711 - protein, 9 aa, Homo Sapiens
IQCEKAKGG

SEQ ID NO: 328712 - protein, 9 aa, Homo Sapiens
HGWMVSSRS

SEQ ID NO: 328713 - protein, 9 aa, Homo Sapiens
TLTCQLNGS

SEQ ID NO: 328714 - protein, 9 aa, Homo Sapiens
LLGPSICVF

SEQ ID NO: 328715 - protein, 9 aa, Homo Sapiens
PYNSAVYSL

SEQ ID NO: 328716 - protein, 9 aa, Homo Sapiens
KHALKQFEE

SEQ ID NO: 328717 - protein, 9 aa, Homo Sapiens
HEMLNNVWD

SEQ ID NO: 328718 - protein, 9 aa, Homo Sapiens
KIYCQFDFK

SEQ ID NO: 328719 - protein, 9 aa, Homo Sapiens
GLSPRLRLL

SEQ ID NO: 328720 - protein, 9 aa, Homo Sapiens
VFNNQLFTQ

SEQ ID NO: 328721 - protein, 9 aa, Homo Sapiens
RELMLQAMA

SEQ ID NO: 328722 - protein, 9 aa, Homo Sapiens
LCLYQLVKK

SEQ ID NO: 328723 - protein, 9 aa, Homo Sapiens
MTPLHLTTQ

SEQ ID NO: 328724 - protein, 9 aa, Homo Sapiens
TISHQAIQI

SEQ ID NO: 328725 - protein, 9 aa, Homo Sapiens
HQEELERKA

SEQ ID NO: 328726 - protein, 9 aa, Homo Sapiens
RASDYNQAL

SEQ ID NO: 328727 - protein, 9 aa, Homo Sapiens
RSLGEPWRA

SEQ ID NO: 328728 - protein, 9 aa, Homo Sapiens
ISRAKIQTV

SEQ ID NO: 328729 - protein, 9 aa, Homo Sapiens
YVVSSNHSA

SEQ ID NO: 328730 - protein, 9 aa, Homo Sapiens
HVPKSEKEK

SEQ ID NO: 328731 - protein, 9 aa, Homo Sapiens
WMSLHLFHV

SEQ ID NO: 328732 - protein, 9 aa, Homo Sapiens
LASVSQSQL

SEQ ID NO: 328733 - protein, 9 aa, Homo Sapiens
PEREVIINL

SEQ ID NO: 328734 - protein, 9 aa, Homo Sapiens
LSPRLRLLA

SEQ ID NO: 328735 - protein, 9 aa, Homo Sapiens
EESQWPIQM

SEQ ID NO: 328736 - protein, 9 aa, Homo Sapiens
GYQPEHIDP

SEQ ID NO: 328737 - protein, 9 aa, Homo Sapiens
QHGVVVLAK

SEQ ID NO: 328738 - protein, 9 aa, Homo Sapiens
MDKRVTRFV

SEQ ID NO: 328739 - protein, 9 aa, Homo Sapiens
LKDRQPLRS

SEQ ID NO: 328740 - protein, 9 aa, Homo Sapiens
TFIQTTSTQ

SEQ ID NO: 328741 - protein, 9 aa, Homo Sapiens
GPKCAQGFI

SEQ ID NO: 328742 - protein, 9 aa, Homo Sapiens
GEAPCTVTS

SEQ ID NO: 328743 - protein, 9 aa, Homo Sapiens
WAGDWFVCL

SEQ ID NO: 328744 - protein, 9 aa, Homo Sapiens
FVAMACCYT

SEQ ID NO: 328745 - protein, 9 aa, Homo Sapiens
EIVQYLRSV

SEQ ID NO: 328746 - protein, 9 aa, Homo Sapiens
GNPGPKCAQ

SEQ ID NO: 328747 - protein, 9 aa, Homo Sapiens
WQQPALATA

SEQ ID NO: 328748 - protein, 9 aa, Homo Sapiens
WPSGELSIE

SEQ ID NO: 328749 - protein, 9 aa, Homo Sapiens
NFLTTVTVP

SEQ ID NO: 328750 - protein, 9 aa, Homo Sapiens
EAEEMQVRL

SEQ ID NO: 328751 - protein, 9 aa, Homo Sapiens
AMQILGGLE

SEQ ID NO: 328752 - protein, 9 aa, Homo Sapiens
GLAYLHMEI

SEQ ID NO: 328753 - protein, 9 aa, Homo Sapiens
KLQKSSRGF

SEQ ID NO: 328754 - protein, 9 aa, Homo Sapiens
NIYTGLFLF

SEQ ID NO: 328755 - protein, 9 aa, Homo Sapiens
NILNPFKVV

SEQ ID NO: 328756 - protein, 9 aa, Homo Sapiens
GLLKVAQTR

SEQ ID NO: 328757 - protein, 9 aa, Homo Sapiens
ALALTLLSA

SEQ ID NO: 328758 - protein, 9 aa, Homo Sapiens
GILCVDDQC

SEQ ID NO: 328759 - protein, 9 aa, Homo Sapiens
DPRRDYHSL

SEQ ID NO: 328760 - protein, 9 aa, Homo Sapiens
IIAPHAGYM

SEQ ID NO: 328761 - protein, 9 aa, Homo Sapiens
PLRKSPAME

SEQ ID NO: 328762 - protein, 9 aa, Homo Sapiens
EKDLWSSNE

SEQ ID NO: 328763 - protein, 9 aa, Homo Sapiens
INFCKFSSR

SEQ ID NO: 328764 - protein, 9 aa, Homo Sapiens
DPPQGLWVE

SEQ ID NO: 328765 - protein, 9 aa, Homo Sapiens
YHMFSIWEL

SEQ ID NO: 328766 - protein, 9 aa, Homo Sapiens
RRKEALGLY

SEQ ID NO: 328767 - protein, 9 aa, Homo Sapiens
TMGLVVERR

SEQ ID NO: 328768 - protein, 9 aa, Homo Sapiens
SPTTLYHFN

SEQ ID NO: 328769 - protein, 9 aa, Homo Sapiens
SDEMCPCWF

SEQ ID NO: 328770 - protein, 9 aa, Homo Sapiens
HTEVIQLED

SEQ ID NO: 328771 - protein, 9 aa, Homo Sapiens
VAWDLELSE

SEQ ID NO: 328772 - protein, 9 aa, Homo Sapiens
KYTFSVGWW

SEQ ID NO: 328773 - protein, 9 aa, Homo Sapiens
KQFETTAVN

SEQ ID NO: 328774 - protein, 9 aa, Homo Sapiens
LDKSVCVLV

SEQ ID NO: 328775 - protein, 9 aa, Homo Sapiens
KYIFTSILG

SEQ ID NO: 328776 - protein, 9 aa, Homo Sapiens
STSIIISMV

SEQ ID NO: 328777 - protein, 9 aa, Homo Sapiens
GYVQIVEAI

SEQ ID NO: 328778 - protein, 9 aa, Homo Sapiens
IDIEIYLKL

SEQ ID NO: 328779 - protein, 9 aa, Homo Sapiens
ELLQFYTST

SEQ ID NO: 328780 - protein, 9 aa, Homo Sapiens
HTRSVGRDS

SEQ ID NO: 328781 - protein, 9 aa, Homo Sapiens
LTEKMVFPL

SEQ ID NO: 328782 - protein, 9 aa, Homo Sapiens
ERGQLLNRL

SEQ ID NO: 328783 - protein, 9 aa, Homo Sapiens
CLTPAQALR

SEQ ID NO: 328784 - protein, 9 aa, Homo Sapiens
IEWNLSTVG

SEQ ID NO: 328785 - protein, 9 aa, Homo Sapiens
LLNIDGIDL

SEQ ID NO: 328786 - protein, 9 aa, Homo Sapiens
VRGAQVTDI

SEQ ID NO: 328787 - protein, 9 aa, Homo Sapiens
VMDSVGSIP

SEQ ID NO: 328788 - protein, 9 aa, Homo Sapiens
IDIYSCYIY

SEQ ID NO: 328789 - protein, 9 aa, Homo Sapiens
ALPRGPPAH

SEQ ID NO: 328790 - protein, 9 aa, Homo Sapiens
LTPSEAPNL

SEQ ID NO: 328791 - protein, 9 aa, Homo Sapiens
PPSQFIYVF

SEQ ID NO: 328792 - protein, 9 aa, Homo Sapiens
LLHFLVMLR

SEQ ID NO: 328793 - protein, 9 aa, Homo Sapiens
LVAFVKVAE

SEQ ID NO: 328794 - protein, 9 aa, Homo Sapiens
NGHTKCKTT

SEQ ID NO: 328795 - protein, 9 aa, Homo Sapiens
HSLGSALSA

SEQ ID NO: 328796 - protein, 9 aa, Homo Sapiens
VAAKYHMAS

SEQ ID NO: 328797 - protein, 9 aa, Homo Sapiens
PSATREPDP

SEQ ID NO: 328798 - protein, 9 aa, Homo Sapiens
EGDASSWHG

SEQ ID NO: 328799 - protein, 9 aa, Homo Sapiens
GLDVPSLCV

SEQ ID NO: 328800 - protein, 9 aa, Homo Sapiens
IAAQTLLSS

SEQ ID NO: 328801 - protein, 9 aa, Homo Sapiens
QSPLEESSC

SEQ ID NO: 328802 - protein, 9 aa, Homo Sapiens
PPCTLVWYA

SEQ ID NO: 328803 - protein, 9 aa, Homo Sapiens
SPGASEHGR

SEQ ID NO: 328804 - protein, 9 aa, Homo Sapiens
RCSRDRALE

SEQ ID NO: 328805 - protein, 9 aa, Homo Sapiens
SVTMQPTEF

SEQ ID NO: 328806 - protein, 9 aa, Homo Sapiens
IPLAYVETL

SEQ ID NO: 328807 - protein, 9 aa, Homo Sapiens
CKMDYFSQF

SEQ ID NO: 328808 - protein, 9 aa, Homo Sapiens
LEKTLLHDM

SEQ ID NO: 328809 - protein, 9 aa, Homo Sapiens
VKKKAYGSQ

SEQ ID NO: 328810 - protein, 9 aa, Homo Sapiens
ILEEEVELV

SEQ ID NO: 328811 - protein, 9 aa, Homo Sapiens
REEEEAEEE

SEQ ID NO: 328812 - protein, 9 aa, Homo Sapiens
NRFTSFINK

SEQ ID NO: 328813 - protein, 9 aa, Homo Sapiens
CCFGNFIWL

SEQ ID NO: 328814 - protein, 9 aa, Homo Sapiens
SGPQGCATE

SEQ ID NO: 328815 - protein, 9 aa, Homo Sapiens
GSYDPQRQI

SEQ ID NO: 328816 - protein, 9 aa, Homo Sapiens
AKALHRGLV

SEQ ID NO: 328817 - protein, 9 aa, Homo Sapiens
SILCHCCDL

SEQ ID NO: 328818 - protein, 9 aa, Homo Sapiens
SCSKNQSEA

SEQ ID NO: 328819 - protein, 9 aa, Homo Sapiens
DPLRKSPAM

SEQ ID NO: 328820 - protein, 9 aa, Homo Sapiens
IMKENMRMG

SEQ ID NO: 328821 - protein, 9 aa, Homo Sapiens
SYEEILLEL

SEQ ID NO: 328822 - protein, 9 aa, Homo Sapiens
TQLPRRPRP

SEQ ID NO: 328823 - protein, 9 aa, Homo Sapiens
VMFASSSKC

SEQ ID NO: 328824 - protein, 9 aa, Homo Sapiens
RVALRDIHL

SEQ ID NO: 328825 - protein, 9 aa, Homo Sapiens
FHSRAEEGG

SEQ ID NO: 328826 - protein, 9 aa, Homo Sapiens
FEDVNSWPN

SEQ ID NO: 328827 - protein, 9 aa, Homo Sapiens
LSQEPNNGI

SEQ ID NO: 328828 - protein, 9 aa, Homo Sapiens
RVFFFIPTM

SEQ ID NO: 328829 - protein, 9 aa, Homo Sapiens
LKCHGLGAV

SEQ ID NO: 328830 - protein, 9 aa, Homo Sapiens
DPLGLQEVA

SEQ ID NO: 328831 - protein, 9 aa, Homo Sapiens
HTGRCRPRR

SEQ ID NO: 328832 - protein, 9 aa, Homo Sapiens
VYLFTGKLY

SEQ ID NO: 328833 - protein, 9 aa, Homo Sapiens
LFPTVSVAP

SEQ ID NO: 328834 - protein, 9 aa, Homo Sapiens
STLQAERSW

SEQ ID NO: 328835 - protein, 9 aa, Homo Sapiens
WYSMPWHSC

SEQ ID NO: 328836 - protein, 9 aa, Homo Sapiens
DGSPIWKRS

SEQ ID NO: 328837 - protein, 9 aa, Homo Sapiens
TPMVRWAAA

SEQ ID NO: 328838 - protein, 9 aa, Homo Sapiens
TIYNANIDN

SEQ ID NO: 328839 - protein, 9 aa, Homo Sapiens
QDFGNHQVT

SEQ ID NO: 328840 - protein, 9 aa, Homo Sapiens
GEYTCEAGA

SEQ ID NO: 328841 - protein, 9 aa, Homo Sapiens
LHSAQDAAQ

SEQ ID NO: 328842 - protein, 9 aa, Homo Sapiens
SLNTSWRVL

SEQ ID NO: 328843 - protein, 9 aa, Homo Sapiens
RSRRKEALG

SEQ ID NO: 328844 - protein, 9 aa, Homo Sapiens
EVKMLSGLS

SEQ ID NO: 328845 - protein, 9 aa, Homo Sapiens
MKDVVWTDV

SEQ ID NO: 328846 - protein, 9 aa, Homo Sapiens
ASLLGDSNI

SEQ ID NO: 328847 - protein, 9 aa, Homo Sapiens
TRKWMGTQF

SEQ ID NO: 328848 - protein, 9 aa, Homo Sapiens
RVNRCTLAT

SEQ ID NO: 328849 - protein, 9 aa, Homo Sapiens
ELVATGKTT

SEQ ID NO: 328850 - protein, 9 aa, Homo Sapiens
PGGQLRLML

SEQ ID NO: 328851 - protein, 9 aa, Homo Sapiens
GILTCLLLP

SEQ ID NO: 328852 - protein, 9 aa, Homo Sapiens
LSCHQGIPG

SEQ ID NO: 328853 - protein, 9 aa, Homo Sapiens
LTILPGDVR

SEQ ID NO: 328854 - protein, 9 aa, Homo Sapiens
IATGPPVST

SEQ ID NO: 328855 - protein, 9 aa, Homo Sapiens
MVDMDLPPN

SEQ ID NO: 328856 - protein, 9 aa, Homo Sapiens
TPYHMFSIW

SEQ ID NO: 328857 - protein, 9 aa, Homo Sapiens
LGTQEGTRT

SEQ ID NO: 328858 - protein, 9 aa, Homo Sapiens
QGGGLALSA

SEQ ID NO: 328859 - protein, 9 aa, Homo Sapiens
EILLELVSS

SEQ ID NO: 328860 - protein, 9 aa, Homo Sapiens
VCNISNQLS

SEQ ID NO: 328861 - protein, 9 aa, Homo Sapiens
ACPGACSSH

SEQ ID NO: 328862 - protein, 9 aa, Homo Sapiens
IGSTNASSV

SEQ ID NO: 328863 - protein, 9 aa, Homo Sapiens
PWSTSLAWL

SEQ ID NO: 328864 - protein, 9 aa, Homo Sapiens
FSFIALNMV

SEQ ID NO: 328865 - protein, 9 aa, Homo Sapiens
GVACMRFQP

SEQ ID NO: 328866 - protein, 9 aa, Homo Sapiens
AGATTEAQE

SEQ ID NO: 328867 - protein, 9 aa, Homo Sapiens
NRITADVAH

SEQ ID NO: 328868 - protein, 9 aa, Homo Sapiens
SHSHRRQGL

SEQ ID NO: 328869 - protein, 9 aa, Homo Sapiens
LILEAPKRF

SEQ ID NO: 328870 - protein, 9 aa, Homo Sapiens
QQQQQRPQS

SEQ ID NO: 328871 - protein, 9 aa, Homo Sapiens
GTSVARYNF

SEQ ID NO: 328872 - protein, 9 aa, Homo Sapiens
IGQEAAFAD

SEQ ID NO: 328873 - protein, 9 aa, Homo Sapiens
GKDQYYLRV

SEQ ID NO: 328874 - protein, 9 aa, Homo Sapiens
CVDVHISYL

SEQ ID NO: 328875 - protein, 9 aa, Homo Sapiens
REPPPGTEA

SEQ ID NO: 328876 - protein, 9 aa, Homo Sapiens
VHTAENCQS

SEQ ID NO: 328877 - protein, 9 aa, Homo Sapiens
SLYWQLCWK

SEQ ID NO: 328878 - protein, 9 aa, Homo Sapiens
LGPPIAAAF

SEQ ID NO: 328879 - protein, 9 aa, Homo Sapiens
SVAPYNTTQ

SEQ ID NO: 328880 - protein, 9 aa, Homo Sapiens
IQVDTFRAN

SEQ ID NO: 328881 - protein, 9 aa, Homo Sapiens
LGHAVLMQA

SEQ ID NO: 328882 - protein, 9 aa, Homo Sapiens
WTDRATHRV

SEQ ID NO: 328883 - protein, 9 aa, Homo Sapiens
FCKDGGGEE

SEQ ID NO: 328884 - protein, 9 aa, Homo Sapiens
LHMVNPDWL

SEQ ID NO: 328885 - protein, 9 aa, Homo Sapiens
EQLLLQPER

SEQ ID NO: 328886 - protein, 9 aa, Homo Sapiens
LCRSVSMVI

SEQ ID NO: 328887 - protein, 9 aa, Homo Sapiens
ATDLLTLTP

SEQ ID NO: 328888 - protein, 9 aa, Homo Sapiens
KLMAQVNQT

SEQ ID NO: 328889 - protein, 9 aa, Homo Sapiens
RIAEAKGQS

SEQ ID NO: 328890 - protein, 9 aa, Homo Sapiens
VKALFRCAK

SEQ ID NO: 328891 - protein, 9 aa, Homo Sapiens
ATVTVPLDL

SEQ ID NO: 328892 - protein, 9 aa, Homo Sapiens
FAVIHDVAR

SEQ ID NO: 328893 - protein, 9 aa, Homo Sapiens
VHSEATLDI

SEQ ID NO: 328894 - protein, 9 aa, Homo Sapiens
CSGASRRLE

SEQ ID NO: 328895 - protein, 9 aa, Homo Sapiens
FIYQPPDRS

SEQ ID NO: 328896 - protein, 9 aa, Homo Sapiens
EVSATVRQF

SEQ ID NO: 328897 - protein, 9 aa, Homo Sapiens
FSQMTHVRP

SEQ ID NO: 328898 - protein, 9 aa, Homo Sapiens
LRRKWPVVW

SEQ ID NO: 328899 - protein, 9 aa, Homo Sapiens
ALDGSPIWK

SEQ ID NO: 328900 - protein, 9 aa, Homo Sapiens
SVETVCGYG

SEQ ID NO: 328901 - protein, 9 aa, Homo Sapiens
VIKVRRSLL

SEQ ID NO: 328902 - protein, 9 aa, Homo Sapiens
RLGASIPCH

SEQ ID NO: 328903 - protein, 9 aa, Homo Sapiens
LLRLASMPD

SEQ ID NO: 328904 - protein, 9 aa, Homo Sapiens
FYRPLNIQI

SEQ ID NO: 328905 - protein, 9 aa, Homo Sapiens
ARKLTRERM

SEQ ID NO: 328906 - protein, 9 aa, Homo Sapiens
VLQEYTSDG

SEQ ID NO: 328907 - protein, 9 aa, Homo Sapiens
PLRGKCEAM

SEQ ID NO: 328908 - protein, 9 aa, Homo Sapiens
TVSVTLHLF

SEQ ID NO: 328909 - protein, 9 aa, Homo Sapiens
NQEEKIREQ

SEQ ID NO: 328910 - protein, 9 aa, Homo Sapiens
LDAAPRSLE

SEQ ID NO: 328911 - protein, 9 aa, Homo Sapiens
VDTPPAWPS

SEQ ID NO: 328912 - protein, 9 aa, Homo Sapiens
LLPVGLASF

SEQ ID NO: 328913 - protein, 9 aa, Homo Sapiens
LYTCASCLK

SEQ ID NO: 328914 - protein, 9 aa, Homo Sapiens
LAQAMDTAL

SEQ ID NO: 328915 - protein, 9 aa, Homo Sapiens
VTLTCQLNG

SEQ ID NO: 328916 - protein, 9 aa, Homo Sapiens
GIMIPKPPK

SEQ ID NO: 328917 - protein, 9 aa, Homo Sapiens
EKKNTLAAQ

SEQ ID NO: 328918 - protein, 9 aa, Homo Sapiens
FWWRQGFAV

SEQ ID NO: 328919 - protein, 9 aa, Homo Sapiens
QTINDQDFF

SEQ ID NO: 328920 - protein, 9 aa, Homo Sapiens
IDGIDLTNL

SEQ ID NO: 328921 - protein, 9 aa, Homo Sapiens
TVGRVTPKE

SEQ ID NO: 328922 - protein, 9 aa, Homo Sapiens
GQQPGSCPS

SEQ ID NO: 328923 - protein, 9 aa, Homo Sapiens
NDGDMRLAN

SEQ ID NO: 328924 - protein, 9 aa, Homo Sapiens
DLGQPYNSA

SEQ ID NO: 328925 - protein, 9 aa, Homo Sapiens
FDGQRATEN

SEQ ID NO: 328926 - protein, 9 aa, Homo Sapiens
AKEEELCKG

SEQ ID NO: 328927 - protein, 9 aa, Homo Sapiens
VGDDGDSRD

SEQ ID NO: 328928 - protein, 9 aa, Homo Sapiens
ALAPPEPPH

SEQ ID NO: 328929 - protein, 9 aa, Homo Sapiens
NLTIFTAHL

SEQ ID NO: 328930 - protein, 9 aa, Homo Sapiens
SMIVPGMNM

SEQ ID NO: 328931 - protein, 9 aa, Homo Sapiens
EDGKPFRKG

SEQ ID NO: 328932 - protein, 9 aa, Homo Sapiens
LQEIHFKTC

SEQ ID NO: 328933 - protein, 9 aa, Homo Sapiens
PDLLTLGHA

SEQ ID NO: 328934 - protein, 9 aa, Homo Sapiens
RQPQVGLSQ

SEQ ID NO: 328935 - protein, 9 aa, Homo Sapiens
PLCAGEEGS

SEQ ID NO: 328936 - protein, 9 aa, Homo Sapiens
SPHQKQRLK

SEQ ID NO: 328937 - protein, 9 aa, Homo Sapiens
AQQNQTQTH

SEQ ID NO: 328938 - protein, 9 aa, Homo Sapiens
SIFQKLNVP

SEQ ID NO: 328939 - protein, 9 aa, Homo Sapiens
TTFQSWPNP

SEQ ID NO: 328940 - protein, 9 aa, Homo Sapiens
LLECIHRLI

SEQ ID NO: 328941 - protein, 9 aa, Homo Sapiens
WAMTNYIHV

SEQ ID NO: 328942 - protein, 9 aa, Homo Sapiens
EVPVRASSL

SEQ ID NO: 328943 - protein, 9 aa, Homo Sapiens
LWEWVLQCF

SEQ ID NO: 328944 - protein, 9 aa, Homo Sapiens
SLMRPFLAE

SEQ ID NO: 328945 - protein, 9 aa, Homo Sapiens
AKKSPKGKG

SEQ ID NO: 328946 - protein, 9 aa, Homo Sapiens
SNFLKTTLF

SEQ ID NO: 328947 - protein, 9 aa, Homo Sapiens
INCSNNKIT

SEQ ID NO: 328948 - protein, 9 aa, Homo Sapiens
NEKKNTLAA

SEQ ID NO: 328949 - protein, 9 aa, Homo Sapiens
EHTLWKRGL

SEQ ID NO: 328950 - protein, 9 aa, Homo Sapiens
GIQTQNRKM

SEQ ID NO: 328951 - protein, 9 aa, Homo Sapiens
EEARLRHKV

SEQ ID NO: 328952 - protein, 9 aa, Homo Sapiens
KNRCTIEVN

SEQ ID NO: 328953 - protein, 9 aa, Homo Sapiens
IVGAVTVAS

SEQ ID NO: 328954 - protein, 9 aa, Homo Sapiens
YEWGVAVLC

SEQ ID NO: 328955 - protein, 9 aa, Homo Sapiens
LGADRGLKS

SEQ ID NO: 328956 - protein, 9 aa, Homo Sapiens
QKSIIDAHA

SEQ ID NO: 328957 - protein, 9 aa, Homo Sapiens
SHSDMTTSS

SEQ ID NO: 328958 - protein, 9 aa, Homo Sapiens
AEDKPWAQL

SEQ ID NO: 328959 - protein, 9 aa, Homo Sapiens
VGPGKPKAD

SEQ ID NO: 328960 - protein, 9 aa, Homo Sapiens
TLQTSQDTV

SEQ ID NO: 328961 - protein, 9 aa, Homo Sapiens
ARVQNHHTW

SEQ ID NO: 328962 - protein, 9 aa, Homo Sapiens
NKVIELPRG

SEQ ID NO: 328963 - protein, 9 aa, Homo Sapiens
LCELSIKDY

SEQ ID NO: 328964 - protein, 9 aa, Homo Sapiens
TLLALVCLP

SEQ ID NO: 328965 - protein, 9 aa, Homo Sapiens
WAVTQNGKH

SEQ ID NO: 328966 - protein, 9 aa, Homo Sapiens
VVQHELQHP

SEQ ID NO: 328967 - protein, 9 aa, Homo Sapiens
PARGSCSQA

SEQ ID NO: 328968 - protein, 9 aa, Homo Sapiens
EAAGWGSQA

SEQ ID NO: 328969 - protein, 9 aa, Homo Sapiens
IDNQAVSTK

SEQ ID NO: 328970 - protein, 9 aa, Homo Sapiens
DSVGSIPAL

SEQ ID NO: 328971 - protein, 9 aa, Homo Sapiens
AQAQQNQTQ

SEQ ID NO: 328972 - protein, 9 aa, Homo Sapiens
KDMLDIFMR

SEQ ID NO: 328973 - protein, 9 aa, Homo Sapiens
VHLPIIEIH

SEQ ID NO: 328974 - protein, 9 aa, Homo Sapiens
SGLGKWLVG

SEQ ID NO: 328975 - protein, 9 aa, Homo Sapiens
PALLCGTYF

SEQ ID NO: 328976 - protein, 9 aa, Homo Sapiens
TLGPAVRPM

SEQ ID NO: 328977 - protein, 9 aa, Homo Sapiens
AIPLTRWKP

SEQ ID NO: 328978 - protein, 9 aa, Homo Sapiens
NASSVPNTD

SEQ ID NO: 328979 - protein, 9 aa, Homo Sapiens
QLLALCITD

SEQ ID NO: 328980 - protein, 9 aa, Homo Sapiens
KDPLLSYNV

SEQ ID NO: 328981 - protein, 9 aa, Homo Sapiens
LLPLLLCTA

SEQ ID NO: 328982 - protein, 9 aa, Homo Sapiens
NKHLRGGGG

SEQ ID NO: 328983 - protein, 9 aa, Homo Sapiens
LGEPWRAGF

SEQ ID NO: 328984 - protein, 9 aa, Homo Sapiens
IAKHGEPAC

SEQ ID NO: 328985 - protein, 9 aa, Homo Sapiens
RQLHRTPRR

SEQ ID NO: 328986 - protein, 9 aa, Homo Sapiens
GLFLFTFLF

SEQ ID NO: 328987 - protein, 9 aa, Homo Sapiens
RFGKHLSPM

SEQ ID NO: 328988 - protein, 9 aa, Homo Sapiens
PPVFGEGPP

SEQ ID NO: 328989 - protein, 9 aa, Homo Sapiens
SCIDTCENS

SEQ ID NO: 328990 - protein, 9 aa, Homo Sapiens
LRNSADCVS

SEQ ID NO: 328991 - protein, 9 aa, Homo Sapiens
GGPLPYHRH

SEQ ID NO: 328992 - protein, 9 aa, Homo Sapiens
DGNWTNYNT

SEQ ID NO: 328993 - protein, 9 aa, Homo Sapiens
HAAFLLSTM

SEQ ID NO: 328994 - protein, 9 aa, Homo Sapiens
LYILDWRGM

SEQ ID NO: 328995 - protein, 9 aa, Homo Sapiens
VKTWTQFRN

SEQ ID NO: 328996 - protein, 9 aa, Homo Sapiens
FCQKSIIDA

SEQ ID NO: 328997 - protein, 9 aa, Homo Sapiens
MTRWFSADE

SEQ ID NO: 328998 - protein, 9 aa, Homo Sapiens
HHEPPFHLD

SEQ ID NO: 328999 - protein, 9 aa, Homo Sapiens
NDLGLGCSQ

SEQ ID NO: 329000 - protein, 9 aa, Homo Sapiens
TSTVHCMHL

SEQ ID NO: 329001 - protein, 9 aa, Homo Sapiens
CFPFQGTIN

SEQ ID NO: 329002 - protein, 9 aa, Homo Sapiens
IMSDIHISQ

SEQ ID NO: 329003 - protein, 9 aa, Homo Sapiens
CPALSPLGD

SEQ ID NO: 329004 - protein, 9 aa, Homo Sapiens
NQVTVDSIM

SEQ ID NO: 329005 - protein, 9 aa, Homo Sapiens
GATNMGTPM

SEQ ID NO: 329006 - protein, 9 aa, Homo Sapiens
FNLMYAKRA

SEQ ID NO: 329007 - protein, 9 aa, Homo Sapiens
WCSGKRTAQ

SEQ ID NO: 329008 - protein, 9 aa, Homo Sapiens
WTETNTERV

SEQ ID NO: 329009 - protein, 9 aa, Homo Sapiens
WLLLQRLYS

SEQ ID NO: 329010 - protein, 9 aa, Homo Sapiens
ADGVGPLLT

SEQ ID NO: 329011 - protein, 9 aa, Homo Sapiens
LLSDTHQCR

SEQ ID NO: 329012 - protein, 9 aa, Homo Sapiens
MYIHKAATR

SEQ ID NO: 329013 - protein, 9 aa, Homo Sapiens
CGQRPMRKH

SEQ ID NO: 329014 - protein, 9 aa, Homo Sapiens
IVIIAKAFG

SEQ ID NO: 329015 - protein, 9 aa, Homo Sapiens
DRKLCERLL

SEQ ID NO: 329016 - protein, 9 aa, Homo Sapiens
RIVCDYDVY

SEQ ID NO: 329017 - protein, 9 aa, Homo Sapiens
VMDQKKFED

SEQ ID NO: 329018 - protein, 9 aa, Homo Sapiens
ANGWVQYTF

SEQ ID NO: 329019 - protein, 9 aa, Homo Sapiens
YCGVHASER

SEQ ID NO: 329020 - protein, 9 aa, Homo Sapiens
KLCRTRGEE

SEQ ID NO: 329021 - protein, 9 aa, Homo Sapiens
DPQPSRGDD

SEQ ID NO: 329022 - protein, 9 aa, Homo Sapiens
ISWGQDPCV

SEQ ID NO: 329023 - protein, 9 aa, Homo Sapiens
EGTTPPPPA

SEQ ID NO: 329024 - protein, 9 aa, Homo Sapiens
PTVSVAPSA

SEQ ID NO: 329025 - protein, 9 aa, Homo Sapiens
RLPAVPPQP

SEQ ID NO: 329026 - protein, 9 aa, Homo Sapiens
SFFAWDNTA

SEQ ID NO: 329027 - protein, 9 aa, Homo Sapiens
LVPFDEIMG

SEQ ID NO: 329028 - protein, 9 aa, Homo Sapiens
GSCAWYRGT

SEQ ID NO: 329029 - protein, 9 aa, Homo Sapiens
VTTKDKDGQ

SEQ ID NO: 329030 - protein, 9 aa, Homo Sapiens
MLEMWWNKR

SEQ ID NO: 329031 - protein, 9 aa, Homo Sapiens
PILKWALKV

SEQ ID NO: 329032 - protein, 9 aa, Homo Sapiens
SLLQDWGRS

SEQ ID NO: 329033 - protein, 9 aa, Homo Sapiens
FPDENKNTA

SEQ ID NO: 329034 - protein, 9 aa, Homo Sapiens
CLHVANEVT

SEQ ID NO: 329035 - protein, 9 aa, Homo Sapiens
FGCGSMAQV

SEQ ID NO: 329036 - protein, 9 aa, Homo Sapiens
RASSKATDL

SEQ ID NO: 329037 - protein, 9 aa, Homo Sapiens
HIIKFHCAS

SEQ ID NO: 329038 - protein, 9 aa, Homo Sapiens
INPLVFFTI

SEQ ID NO: 329039 - protein, 9 aa, Homo Sapiens
LYKGRVALR

SEQ ID NO: 329040 - protein, 9 aa, Homo Sapiens
QADLHAQRS

SEQ ID NO: 329041 - protein, 9 aa, Homo Sapiens
CRHKKPEAG

SEQ ID NO: 329042 - protein, 9 aa, Homo Sapiens
EQGFPVPAR

SEQ ID NO: 329043 - protein, 9 aa, Homo Sapiens
NHCKRAVES

SEQ ID NO: 329044 - protein, 9 aa, Homo Sapiens
PKNRCTIEV

SEQ ID NO: 329045 - protein, 9 aa, Homo Sapiens
VRTVPVATT

SEQ ID NO: 329046 - protein, 9 aa, Homo Sapiens
QILMCHCLA

SEQ ID NO: 329047 - protein, 9 aa, Homo Sapiens
YDEFFPMSH

SEQ ID NO: 329048 - protein, 9 aa, Homo Sapiens
SVVMGSKAA

SEQ ID NO: 329049 - protein, 9 aa, Homo Sapiens
DTIKYFKKI

SEQ ID NO: 329050 - protein, 9 aa, Homo Sapiens
GGAMAEHGP

SEQ ID NO: 329051 - protein, 9 aa, Homo Sapiens
LLLPPSLPL

SEQ ID NO: 329052 - protein, 9 aa, Homo Sapiens
VEMRRGRVV

SEQ ID NO: 329053 - protein, 9 aa, Homo Sapiens
LHLQEAVWQ

SEQ ID NO: 329054 - protein, 9 aa, Homo Sapiens
QEGACEREE

SEQ ID NO: 329055 - protein, 9 aa, Homo Sapiens
VSVTLHLFS

SEQ ID NO: 329056 - protein, 9 aa, Homo Sapiens
CIWLLILSY

SEQ ID NO: 329057 - protein, 9 aa, Homo Sapiens
CGSMAQVVL

SEQ ID NO: 329058 - protein, 9 aa, Homo Sapiens
ENTLVQMAD

SEQ ID NO: 329059 - protein, 9 aa, Homo Sapiens
HIEDIKKLK

SEQ ID NO: 329060 - protein, 9 aa, Homo Sapiens
SLESPSSST

SEQ ID NO: 329061 - protein, 9 aa, Homo Sapiens
GRVALRDIH

SEQ ID NO: 329062 - protein, 9 aa, Homo Sapiens
LIRWCMSLR

SEQ ID NO: 329063 - protein, 9 aa, Homo Sapiens
MASNFNDMV

SEQ ID NO: 329064 - protein, 9 aa, Homo Sapiens
YMAKGNPIH

SEQ ID NO: 329065 - protein, 9 aa, Homo Sapiens
SQLVLVRDI

SEQ ID NO: 329066 - protein, 9 aa, Homo Sapiens
ELARFQDRM

SEQ ID NO: 329067 - protein, 9 aa, Homo Sapiens
PRGCCTSLT

SEQ ID NO: 329068 - protein, 9 aa, Homo Sapiens
AAEPMGRLV

SEQ ID NO: 329069 - protein, 9 aa, Homo Sapiens
PCQGPCAPL

SEQ ID NO: 329070 - protein, 9 aa, Homo Sapiens
SEGKHPSEN

SEQ ID NO: 329071 - protein, 9 aa, Homo Sapiens
NHIIIPSYV

SEQ ID NO: 329072 - protein, 9 aa, Homo Sapiens
QDFLVETCE

SEQ ID NO: 329073 - protein, 9 aa, Homo Sapiens
PFLPGNLQY

SEQ ID NO: 329074 - protein, 9 aa, Homo Sapiens
CHMIDKRSP

SEQ ID NO: 329075 - protein, 9 aa, Homo Sapiens
IEIHIVECR

SEQ ID NO: 329076 - protein, 9 aa, Homo Sapiens
QRRSLEWAR

SEQ ID NO: 329077 - protein, 9 aa, Homo Sapiens
CSATEIMAV

SEQ ID NO: 329078 - protein, 9 aa, Homo Sapiens
APHSLRSNL

SEQ ID NO: 329079 - protein, 9 aa, Homo Sapiens
GWGPEREVI

SEQ ID NO: 329080 - protein, 9 aa, Homo Sapiens
RLPELLTEH

SEQ ID NO: 329081 - protein, 9 aa, Homo Sapiens
KEWQFHFAG

SEQ ID NO: 329082 - protein, 9 aa, Homo Sapiens
YEYTWGELL

SEQ ID NO: 329083 - protein, 9 aa, Homo Sapiens
LLGRLGSNP

SEQ ID NO: 329084 - protein, 9 aa, Homo Sapiens
HGLRDPLVP

SEQ ID NO: 329085 - protein, 9 aa, Homo Sapiens
PLTESQLVL

SEQ ID NO: 329086 - protein, 9 aa, Homo Sapiens
CSCMKGGTD

SEQ ID NO: 329087 - protein, 9 aa, Homo Sapiens
GEEEEEENG

SEQ ID NO: 329088 - protein, 9 aa, Homo Sapiens
VPPQPQRPH

SEQ ID NO: 329089 - protein, 9 aa, Homo Sapiens
ESHVNKLRA

SEQ ID NO: 329090 - protein, 9 aa, Homo Sapiens
NDGLKSKQA

SEQ ID NO: 329091 - protein, 9 aa, Homo Sapiens
FQGHKKEAT

SEQ ID NO: 329092 - protein, 9 aa, Homo Sapiens
RKKCTVNRE

SEQ ID NO: 329093 - protein, 9 aa, Homo Sapiens
HCSGASRRL

SEQ ID NO: 329094 - protein, 9 aa, Homo Sapiens
VQGCHCQER

SEQ ID NO: 329095 - protein, 9 aa, Homo Sapiens
YVCVHLCAC

SEQ ID NO: 329096 - protein, 9 aa, Homo Sapiens
STAEEMAGS

SEQ ID NO: 329097 - protein, 9 aa, Homo Sapiens
RSSPGGRVL

SEQ ID NO: 329098 - protein, 9 aa, Homo Sapiens
SQSIELKVI

SEQ ID NO: 329099 - protein, 9 aa, Homo Sapiens
LRDPLVPTG

SEQ ID NO: 329100 - protein, 9 aa, Homo Sapiens
LSGAVQQRE

SEQ ID NO: 329101 - protein, 9 aa, Homo Sapiens
KLELLECIH

SEQ ID NO: 329102 - protein, 9 aa, Homo Sapiens
TEKYWDSWF

SEQ ID NO: 329103 - protein, 9 aa, Homo Sapiens
APAPWLPMR

SEQ ID NO: 329104 - protein, 9 aa, Homo Sapiens
IGSGLYDET

SEQ ID NO: 329105 - protein, 9 aa, Homo Sapiens
LSLPPRRGS

SEQ ID NO: 329106 - protein, 9 aa, Homo Sapiens
MPLHAASLQ

SEQ ID NO: 329107 - protein, 9 aa, Homo Sapiens
ADMTGAQRS

SEQ ID NO: 329108 - protein, 9 aa, Homo Sapiens
VPLGPARTG

SEQ ID NO: 329109 - protein, 9 aa, Homo Sapiens
MILCCAICR

SEQ ID NO: 329110 - protein, 9 aa, Homo Sapiens
ATLDINGVT

SEQ ID NO: 329111 - protein, 9 aa, Homo Sapiens
RHFYMAKGN

SEQ ID NO: 329112 - protein, 9 aa, Homo Sapiens
SPQYPAIGV

SEQ ID NO: 329113 - protein, 9 aa, Homo Sapiens
REKEISSLW

SEQ ID NO: 329114 - protein, 9 aa, Homo Sapiens
RPRRLQSPS

SEQ ID NO: 329115 - protein, 9 aa, Homo Sapiens
YLHMEIVGT

SEQ ID NO: 329116 - protein, 9 aa, Homo Sapiens
TRTMEVPVR

SEQ ID NO: 329117 - protein, 9 aa, Homo Sapiens
DIKAPDVSL

SEQ ID NO: 329118 - protein, 9 aa, Homo Sapiens
SWGKNGKDL

SEQ ID NO: 329119 - protein, 9 aa, Homo Sapiens
GEMVPAFFG

SEQ ID NO: 329120 - protein, 9 aa, Homo Sapiens
YIALLVVGI

SEQ ID NO: 329121 - protein, 9 aa, Homo Sapiens
MTSPTDADY

SEQ ID NO: 329122 - protein, 9 aa, Homo Sapiens
ATASQLFTS

SEQ ID NO: 329123 - protein, 9 aa, Homo Sapiens
ASVNLFPTV

SEQ ID NO: 329124 - protein, 9 aa, Homo Sapiens
FLCELSIKD

SEQ ID NO: 329125 - protein, 9 aa, Homo Sapiens
ASVWKRKHM

SEQ ID NO: 329126 - protein, 9 aa, Homo Sapiens
GYHCDWSLL

SEQ ID NO: 329127 - protein, 9 aa, Homo Sapiens
VILCRSVSM

SEQ ID NO: 329128 - protein, 9 aa, Homo Sapiens
VQGPAGLPL

SEQ ID NO: 329129 - protein, 9 aa, Homo Sapiens
SRDDSKFFM

SEQ ID NO: 329130 - protein, 9 aa, Homo Sapiens
PAPAPWLPM

SEQ ID NO: 329131 - protein, 9 aa, Homo Sapiens
PLTRWKPLQ

SEQ ID NO: 329132 - protein, 9 aa, Homo Sapiens
IFMLKCCGN

SEQ ID NO: 329133 - protein, 9 aa, Homo Sapiens
HSMKSEELN

SEQ ID NO: 329134 - protein, 9 aa, Homo Sapiens
SALLHPDIR

SEQ ID NO: 329135 - protein, 9 aa, Homo Sapiens
YHPTGHEWR

SEQ ID NO: 329136 - protein, 9 aa, Homo Sapiens
LQADHICLE

SEQ ID NO: 329137 - protein, 9 aa, Homo Sapiens
MSLLQDWGR

SEQ ID NO: 329138 - protein, 9 aa, Homo Sapiens
TLRYTFYLS

SEQ ID NO: 329139 - protein, 9 aa, Homo Sapiens
TVLLAVIVA

SEQ ID NO: 329140 - protein, 9 aa, Homo Sapiens
QWILRLISG

SEQ ID NO: 329141 - protein, 9 aa, Homo Sapiens
SGQVVTIKQ

SEQ ID NO: 329142 - protein, 9 aa, Homo Sapiens
RGRVVFLWD

SEQ ID NO: 329143 - protein, 9 aa, Homo Sapiens
PHLSVLQMD

SEQ ID NO: 329144 - protein, 9 aa, Homo Sapiens
VEKVQVQVT

SEQ ID NO: 329145 - protein, 9 aa, Homo Sapiens
PLQEHRICV

SEQ ID NO: 329146 - protein, 9 aa, Homo Sapiens
CLLRPSDDV

SEQ ID NO: 329147 - protein, 9 aa, Homo Sapiens
AVRPMPWQR

SEQ ID NO: 329148 - protein, 9 aa, Homo Sapiens
VFEMLEGNT

SEQ ID NO: 329149 - protein, 9 aa, Homo Sapiens
GEGHTGQKF

SEQ ID NO: 329150 - protein, 9 aa, Homo Sapiens
SRHETSLGL

SEQ ID NO: 329151 - protein, 9 aa, Homo Sapiens
KVSSQNRTC

SEQ ID NO: 329152 - protein, 9 aa, Homo Sapiens
TGEEQALSN

SEQ ID NO: 329153 - protein, 9 aa, Homo Sapiens
QLKEDRESR

SEQ ID NO: 329154 - protein, 9 aa, Homo Sapiens
LRTVHCPCA

SEQ ID NO: 329155 - protein, 9 aa, Homo Sapiens
VLFLRTDRG

SEQ ID NO: 329156 - protein, 9 aa, Homo Sapiens
HDLSISSDS

SEQ ID NO: 329157 - protein, 9 aa, Homo Sapiens
KCQPRRRKS

SEQ ID NO: 329158 - protein, 9 aa, Homo Sapiens
WLDLGSCLD

SEQ ID NO: 329159 - protein, 9 aa, Homo Sapiens
SPPAAGSRT

SEQ ID NO: 329160 - protein, 9 aa, Homo Sapiens
KRVVKKTTL

SEQ ID NO: 329161 - protein, 9 aa, Homo Sapiens
AKKRCTSSQ

SEQ ID NO: 329162 - protein, 9 aa, Homo Sapiens
TGDLIYMLN

SEQ ID NO: 329163 - protein, 9 aa, Homo Sapiens
DPLVPTGGC

SEQ ID NO: 329164 - protein, 9 aa, Homo Sapiens
SPEVRDVWP

SEQ ID NO: 329165 - protein, 9 aa, Homo Sapiens
QITKNSYND

SEQ ID NO: 329166 - protein, 9 aa, Homo Sapiens
RTHQVSLHL

SEQ ID NO: 329167 - protein, 9 aa, Homo Sapiens
PPAVAVGQY

SEQ ID NO: 329168 - protein, 9 aa, Homo Sapiens
CECVGGDLR

SEQ ID NO: 329169 - protein, 9 aa, Homo Sapiens
VTVKNDTIK

SEQ ID NO: 329170 - protein, 9 aa, Homo Sapiens
TNMCFRPMQ

SEQ ID NO: 329171 - protein, 9 aa, Homo Sapiens
VTMQPTEFK

SEQ ID NO: 329172 - protein, 9 aa, Homo Sapiens
PDFILMGLS

SEQ ID NO: 329173 - protein, 9 aa, Homo Sapiens
FSESSTLLH

SEQ ID NO: 329174 - protein, 9 aa, Homo Sapiens
HLECTCATT

SEQ ID NO: 329175 - protein, 9 aa, Homo Sapiens
DANGPPIFT

SEQ ID NO: 329176 - protein, 9 aa, Homo Sapiens
IAPWRTPEF

SEQ ID NO: 329177 - protein, 9 aa, Homo Sapiens
NQSERGPHC

SEQ ID NO: 329178 - protein, 9 aa, Homo Sapiens
FAWDNTANF

SEQ ID NO: 329179 - protein, 9 aa, Homo Sapiens
CNSLLGPAH

SEQ ID NO: 329180 - protein, 9 aa, Homo Sapiens
GFLVTGLMF

SEQ ID NO: 329181 - protein, 9 aa, Homo Sapiens
WGELLVLDL

SEQ ID NO: 329182 - protein, 9 aa, Homo Sapiens
CCLLLELLD

SEQ ID NO: 329183 - protein, 9 aa, Homo Sapiens
RTVTLGVDV

SEQ ID NO: 329184 - protein, 9 aa, Homo Sapiens
VGEQEGACE

SEQ ID NO: 329185 - protein, 9 aa, Homo Sapiens
DIFMRFGRT

SEQ ID NO: 329186 - protein, 9 aa, Homo Sapiens
GTGKTSMLV

SEQ ID NO: 329187 - protein, 9 aa, Homo Sapiens
ACQLARHIL

SEQ ID NO: 329188 - protein, 9 aa, Homo Sapiens
CEGHNGYYN

SEQ ID NO: 329189 - protein, 9 aa, Homo Sapiens
QQFRHLADG

SEQ ID NO: 329190 - protein, 9 aa, Homo Sapiens
FLLIQIFGC

SEQ ID NO: 329191 - protein, 9 aa, Homo Sapiens
PGKPAPVPP

SEQ ID NO: 329192 - protein, 9 aa, Homo Sapiens
HPVLRAEFT

SEQ ID NO: 329193 - protein, 9 aa, Homo Sapiens
LRNRITADV

SEQ ID NO: 329194 - protein, 9 aa, Homo Sapiens
TLLTLSKTR

SEQ ID NO: 329195 - protein, 9 aa, Homo Sapiens
SRLRSLHTI

SEQ ID NO: 329196 - protein, 9 aa, Homo Sapiens
LKTIKSQNL

SEQ ID NO: 329197 - protein, 9 aa, Homo Sapiens
RATQLVGGR

SEQ ID NO: 329198 - protein, 9 aa, Homo Sapiens
RAQGSCSPR

SEQ ID NO: 329199 - protein, 9 aa, Homo Sapiens
YWDSWFRGL

SEQ ID NO: 329200 - protein, 9 aa, Homo Sapiens
PQGPLVPSS

SEQ ID NO: 329201 - protein, 9 aa, Homo Sapiens
LKIKLAVQM

SEQ ID NO: 329202 - protein, 9 aa, Homo Sapiens
RKINCSNNK

SEQ ID NO: 329203 - protein, 9 aa, Homo Sapiens
IIKFHCASK

SEQ ID NO: 329204 - protein, 9 aa, Homo Sapiens
GHTEELVAT

SEQ ID NO: 329205 - protein, 9 aa, Homo Sapiens
DSYNGWGQG

SEQ ID NO: 329206 - protein, 9 aa, Homo Sapiens
PELLTEHQL

SEQ ID NO: 329207 - protein, 9 aa, Homo Sapiens
MFQSPRRCL

SEQ ID NO: 329208 - protein, 9 aa, Homo Sapiens
DYFSQFGTK

SEQ ID NO: 329209 - protein, 9 aa, Homo Sapiens
YDPQRQICV

SEQ ID NO: 329210 - protein, 9 aa, Homo Sapiens
ALCGLALLH

SEQ ID NO: 329211 - protein, 9 aa, Homo Sapiens
RPRKLTVMS

SEQ ID NO: 329212 - protein, 9 aa, Homo Sapiens
KIVIIAKAF

SEQ ID NO: 329213 - protein, 9 aa, Homo Sapiens
VNMDGTTLY

SEQ ID NO: 329214 - protein, 9 aa, Homo Sapiens
DPSACLTPA

SEQ ID NO: 329215 - protein, 9 aa, Homo Sapiens
ILWTRFCKE

SEQ ID NO: 329216 - protein, 9 aa, Homo Sapiens
LFDLHGENP

SEQ ID NO: 329217 - protein, 9 aa, Homo Sapiens
DEILDFDYP

SEQ ID NO: 329218 - protein, 9 aa, Homo Sapiens
EEACCKSLG

SEQ ID NO: 329219 - protein, 9 aa, Homo Sapiens
SARPWGPDG

SEQ ID NO: 329220 - protein, 9 aa, Homo Sapiens
ITIHKAHLL

SEQ ID NO: 329221 - protein, 9 aa, Homo Sapiens
AFHNLLLVR

SEQ ID NO: 329222 - protein, 9 aa, Homo Sapiens
KALDCYSKK

SEQ ID NO: 329223 - protein, 9 aa, Homo Sapiens
AVEKEPALA

SEQ ID NO: 329224 - protein, 9 aa, Homo Sapiens
VNLFPTVSV

SEQ ID NO: 329225 - protein, 9 aa, Homo Sapiens
LASYEEILL

SEQ ID NO: 329226 - protein, 9 aa, Homo Sapiens
HHRRSHQGE

SEQ ID NO: 329227 - protein, 9 aa, Homo Sapiens
QTQLRLEEA

SEQ ID NO: 329228 - protein, 9 aa, Homo Sapiens
FRKFPFFTH

SEQ ID NO: 329229 - protein, 9 aa, Homo Sapiens
GELLLNDAV

SEQ ID NO: 329230 - protein, 9 aa, Homo Sapiens
SSRSSRQTG

SEQ ID NO: 329231 - protein, 9 aa, Homo Sapiens
NLRFVVEPV

SEQ ID NO: 329232 - protein, 9 aa, Homo Sapiens
RVHTDIQND

SEQ ID NO: 329233 - protein, 9 aa, Homo Sapiens
NQLLPGVKT

SEQ ID NO: 329234 - protein, 9 aa, Homo Sapiens
SLDRSYALA

SEQ ID NO: 329235 - protein, 9 aa, Homo Sapiens
DRPVCEGTR

SEQ ID NO: 329236 - protein, 9 aa, Homo Sapiens
TFPKAPFSD

SEQ ID NO: 329237 - protein, 9 aa, Homo Sapiens
SSLDMKDFW

SEQ ID NO: 329238 - protein, 9 aa, Homo Sapiens
AMESVYGYF

SEQ ID NO: 329239 - protein, 9 aa, Homo Sapiens
YRHMCRHKK

SEQ ID NO: 329240 - protein, 9 aa, Homo Sapiens
IDAHANEEI

SEQ ID NO: 329241 - protein, 9 aa, Homo Sapiens
SLGSTFLRL

SEQ ID NO: 329242 - protein, 9 aa, Homo Sapiens
QPRENSMRS

SEQ ID NO: 329243 - protein, 9 aa, Homo Sapiens
FPKAPFSDT

SEQ ID NO: 329244 - protein, 9 aa, Homo Sapiens
DVKLVKKSF

SEQ ID NO: 329245 - protein, 9 aa, Homo Sapiens
VWLKLQQEF

SEQ ID NO: 329246 - protein, 9 aa, Homo Sapiens
QNCCPLPAQ

SEQ ID NO: 329247 - protein, 9 aa, Homo Sapiens
IKCLNNRFT

SEQ ID NO: 329248 - protein, 9 aa, Homo Sapiens
RVEIKESVC

SEQ ID NO: 329249 - protein, 9 aa, Homo Sapiens
TPPPPAAPA

SEQ ID NO: 329250 - protein, 9 aa, Homo Sapiens
EKIPKTDLL

SEQ ID NO: 329251 - protein, 9 aa, Homo Sapiens
DSIGVWNYI

SEQ ID NO: 329252 - protein, 9 aa, Homo Sapiens
PSSSPTPLS

SEQ ID NO: 329253 - protein, 9 aa, Homo Sapiens
YLLRTVHCP

SEQ ID NO: 329254 - protein, 9 aa, Homo Sapiens
GLVYLLWDG

SEQ ID NO: 329255 - protein, 9 aa, Homo Sapiens
VNLTIFTAH

SEQ ID NO: 329256 - protein, 9 aa, Homo Sapiens
AQVNQTFEE

SEQ ID NO: 329257 - protein, 9 aa, Homo Sapiens
KELARFQDR

SEQ ID NO: 329258 - protein, 9 aa, Homo Sapiens
WVRVSNITD

SEQ ID NO: 329259 - protein, 9 aa, Homo Sapiens
HPCIEENPG

SEQ ID NO: 329260 - protein, 9 aa, Homo Sapiens
NFIWLPSNI

SEQ ID NO: 329261 - protein, 9 aa, Homo Sapiens
NLTDEEGGE

SEQ ID NO: 329262 - protein, 9 aa, Homo Sapiens
MSGTQSLHP

SEQ ID NO: 329263 - protein, 9 aa, Homo Sapiens
TLITETPDQ

SEQ ID NO: 329264 - protein, 9 aa, Homo Sapiens
LAVQMDKPQ

SEQ ID NO: 329265 - protein, 9 aa, Homo Sapiens
TKHAIRSLI

SEQ ID NO: 329266 - protein, 9 aa, Homo Sapiens
KLYVAMVGD

SEQ ID NO: 329267 - protein, 9 aa, Homo Sapiens
LDLYKGRVA

SEQ ID NO: 329268 - protein, 9 aa, Homo Sapiens
IMIPKPPKP

SEQ ID NO: 329269 - protein, 9 aa, Homo Sapiens
STVGRVTPK

SEQ ID NO: 329270 - protein, 9 aa, Homo Sapiens
FGEIIINFV

SEQ ID NO: 329271 - protein, 9 aa, Homo Sapiens
VLHERWSQF

SEQ ID NO: 329272 - protein, 9 aa, Homo Sapiens
NLVNFLRTW

SEQ ID NO: 329273 - protein, 9 aa, Homo Sapiens
SSCRSCPAL

SEQ ID NO: 329274 - protein, 9 aa, Homo Sapiens
CPCMVVSCP

SEQ ID NO: 329275 - protein, 9 aa, Homo Sapiens
KKYEKSLRK

SEQ ID NO: 329276 - protein, 9 aa, Homo Sapiens
TVVQTSTIP

SEQ ID NO: 329277 - protein, 9 aa, Homo Sapiens
DDPLLRDVW

SEQ ID NO: 329278 - protein, 9 aa, Homo Sapiens
SDHQQLEAV

SEQ ID NO: 329279 - protein, 9 aa, Homo Sapiens
SYCMGNVLS

SEQ ID NO: 329280 - protein, 9 aa, Homo Sapiens
LALCITDPE

SEQ ID NO: 329281 - protein, 9 aa, Homo Sapiens
ESPSSSTGS

SEQ ID NO: 329282 - protein, 9 aa, Homo Sapiens
RCTIEVNRC

SEQ ID NO: 329283 - protein, 9 aa, Homo Sapiens
NLRVHSINL

SEQ ID NO: 329284 - protein, 9 aa, Homo Sapiens
MSPVFVGTP

SEQ ID NO: 329285 - protein, 9 aa, Homo Sapiens
QLFTQLLAQ

SEQ ID NO: 329286 - protein, 9 aa, Homo Sapiens
KRFRDEPYF

SEQ ID NO: 329287 - protein, 9 aa, Homo Sapiens
EEEVDTDAA

SEQ ID NO: 329288 - protein, 9 aa, Homo Sapiens
IRRLVFLKA

SEQ ID NO: 329289 - protein, 9 aa, Homo Sapiens
LEVLSAQGE

SEQ ID NO: 329290 - protein, 9 aa, Homo Sapiens
AKGAIMRSL

SEQ ID NO: 329291 - protein, 9 aa, Homo Sapiens
YECYKCGKS

SEQ ID NO: 329292 - protein, 9 aa, Homo Sapiens
GVRPSDWPP

SEQ ID NO: 329293 - protein, 9 aa, Homo Sapiens
DFRHSFPMN

SEQ ID NO: 329294 - protein, 9 aa, Homo Sapiens
TTAKDSSST

SEQ ID NO: 329295 - protein, 9 aa, Homo Sapiens
YRVAKALHR

SEQ ID NO: 329296 - protein, 9 aa, Homo Sapiens
VPRSVGVGH

SEQ ID NO: 329297 - protein, 9 aa, Homo Sapiens
GYPEIYPPN

SEQ ID NO: 329298 - protein, 9 aa, Homo Sapiens
TNGTKVVSH

SEQ ID NO: 329299 - protein, 9 aa, Homo Sapiens
TKLYWLDEK

SEQ ID NO: 329300 - protein, 9 aa, Homo Sapiens
QQQRPQSPQ

SEQ ID NO: 329301 - protein, 9 aa, Homo Sapiens
MDTYSGAPP

SEQ ID NO: 329302 - protein, 9 aa, Homo Sapiens
GTITGIVIL

SEQ ID NO: 329303 - protein, 9 aa, Homo Sapiens
STGIICLAR

SEQ ID NO: 329304 - protein, 9 aa, Homo Sapiens
SNVHSRVPM

SEQ ID NO: 329305 - protein, 9 aa, Homo Sapiens
FLVLDQRAS

SEQ ID NO: 329306 - protein, 9 aa, Homo Sapiens
AASVASRHG

SEQ ID NO: 329307 - protein, 9 aa, Homo Sapiens
DMRLANGGA

SEQ ID NO: 329308 - protein, 9 aa, Homo Sapiens
KSITTLKGK

SEQ ID NO: 329309 - protein, 9 aa, Homo Sapiens
EEGGSSPIP

SEQ ID NO: 329310 - protein, 9 aa, Homo Sapiens
RLTYHRFGN

SEQ ID NO: 329311 - protein, 9 aa, Homo Sapiens
WNLILLTIF

SEQ ID NO: 329312 - protein, 9 aa, Homo Sapiens
RVTLPMDIN

SEQ ID NO: 329313 - protein, 9 aa, Homo Sapiens
FLFTFLFLL

SEQ ID NO: 329314 - protein, 9 aa, Homo Sapiens
AARDALVEL

SEQ ID NO: 329315 - protein, 9 aa, Homo Sapiens
RAEKERRPC

SEQ ID NO: 329316 - protein, 9 aa, Homo Sapiens
LDSLNTSWR

SEQ ID NO: 329317 - protein, 9 aa, Homo Sapiens
EFLVVLCCV

SEQ ID NO: 329318 - protein, 9 aa, Homo Sapiens
HCMHLHEKR

SEQ ID NO: 329319 - protein, 9 aa, Homo Sapiens
GGFATLEME

SEQ ID NO: 329320 - protein, 9 aa, Homo Sapiens
CDLSKFDLH

SEQ ID NO: 329321 - protein, 9 aa, Homo Sapiens
HSGPELQQT

SEQ ID NO: 329322 - protein, 9 aa, Homo Sapiens
LGPRPIPVI

SEQ ID NO: 329323 - protein, 9 aa, Homo Sapiens
LQARLHGFL

SEQ ID NO: 329324 - protein, 9 aa, Homo Sapiens
EDDDDDDKG

SEQ ID NO: 329325 - protein, 9 aa, Homo Sapiens
KNKEQRLCA

SEQ ID NO: 329326 - protein, 9 aa, Homo Sapiens
SITLGNVFV

SEQ ID NO: 329327 - protein, 9 aa, Homo Sapiens
ALQHPQRLH

SEQ ID NO: 329328 - protein, 9 aa, Homo Sapiens
SLGEPWRAG

SEQ ID NO: 329329 - protein, 9 aa, Homo Sapiens
INFWYGLCV

SEQ ID NO: 329330 - protein, 9 aa, Homo Sapiens
INPGEDDLS

SEQ ID NO: 329331 - protein, 9 aa, Homo Sapiens
NPYKCDECG

SEQ ID NO: 329332 - protein, 9 aa, Homo Sapiens
RPPPRATGV

SEQ ID NO: 329333 - protein, 9 aa, Homo Sapiens
AIYIRRRPH

SEQ ID NO: 329334 - protein, 9 aa, Homo Sapiens
SIQDNIHLY

SEQ ID NO: 329335 - protein, 9 aa, Homo Sapiens
PRQLHRTPR

SEQ ID NO: 329336 - protein, 9 aa, Homo Sapiens
MAFQTQAGT

SEQ ID NO: 329337 - protein, 9 aa, Homo Sapiens
AQMARVQNH

SEQ ID NO: 329338 - protein, 9 aa, Homo Sapiens
LLWHIVKEF

SEQ ID NO: 329339 - protein, 9 aa, Homo Sapiens
LKHQEELER

SEQ ID NO: 329340 - protein, 9 aa, Homo Sapiens
TVTVPLDLF

SEQ ID NO: 329341 - protein, 9 aa, Homo Sapiens
AKRAYWNTS

SEQ ID NO: 329342 - protein, 9 aa, Homo Sapiens
QLVVSKELC

SEQ ID NO: 329343 - protein, 9 aa, Homo Sapiens
ENIPGTVVQ

SEQ ID NO: 329344 - protein, 9 aa, Homo Sapiens
PAQIQEIVV

SEQ ID NO: 329345 - protein, 9 aa, Homo Sapiens
RDLLICSHL

SEQ ID NO: 329346 - protein, 9 aa, Homo Sapiens
AMLEMWWNK

SEQ ID NO: 329347 - protein, 9 aa, Homo Sapiens
DMTRLLRDY

SEQ ID NO: 329348 - protein, 9 aa, Homo Sapiens
LDCYSKKKY

SEQ ID NO: 329349 - protein, 9 aa, Homo Sapiens
RATHRVMRA

SEQ ID NO: 329350 - protein, 9 aa, Homo Sapiens
SKSPGMQGS

SEQ ID NO: 329351 - protein, 9 aa, Homo Sapiens
PNIYIREYS

SEQ ID NO: 329352 - protein, 9 aa, Homo Sapiens
MYPHEAWSF

SEQ ID NO: 329353 - protein, 9 aa, Homo Sapiens
PVGQPQWKL

SEQ ID NO: 329354 - protein, 9 aa, Homo Sapiens
VSLVQEGTA

SEQ ID NO: 329355 - protein, 9 aa, Homo Sapiens
RPQEQLHLR

SEQ ID NO: 329356 - protein, 9 aa, Homo Sapiens
SLDAVLAWS

SEQ ID NO: 329357 - protein, 9 aa, Homo Sapiens
EEVRMAALE

SEQ ID NO: 329358 - protein, 9 aa, Homo Sapiens
RAKRAYWNT

SEQ ID NO: 329359 - protein, 9 aa, Homo Sapiens
LRRCARDPD

SEQ ID NO: 329360 - protein, 9 aa, Homo Sapiens
CIYQLLRSC

SEQ ID NO: 329361 - protein, 9 aa, Homo Sapiens
ESVCGQDIF

SEQ ID NO: 329362 - protein, 9 aa, Homo Sapiens
MDIVVDHYK

SEQ ID NO: 329363 - protein, 9 aa, Homo Sapiens
TPFSVFDIL

SEQ ID NO: 329364 - protein, 9 aa, Homo Sapiens
LRHKVQDAR

SEQ ID NO: 329365 - protein, 9 aa, Homo Sapiens
QALSNLGLP

SEQ ID NO: 329366 - protein, 9 aa, Homo Sapiens
MGSQQQKVK

SEQ ID NO: 329367 - protein, 9 aa, Homo Sapiens
PVCGHVYPM

SEQ ID NO: 329368 - protein, 9 aa, Homo Sapiens
RFLCENPYY

SEQ ID NO: 329369 - protein, 9 aa, Homo Sapiens
SKISVLEPL

SEQ ID NO: 329370 - protein, 9 aa, Homo Sapiens
ALASVSQSQ

SEQ ID NO: 329371 - protein, 9 aa, Homo Sapiens
KKSFETDTN

SEQ ID NO: 329372 - protein, 9 aa, Homo Sapiens
SRSQLKKIF

SEQ ID NO: 329373 - protein, 9 aa, Homo Sapiens
KALAPLLLV

SEQ ID NO: 329374 - protein, 9 aa, Homo Sapiens
PAWPSSSQH

SEQ ID NO: 329375 - protein, 9 aa, Homo Sapiens
EEILLELVS

SEQ ID NO: 329376 - protein, 9 aa, Homo Sapiens
RGHAESPGV

SEQ ID NO: 329377 - protein, 9 aa, Homo Sapiens
EQQVCALEK

SEQ ID NO: 329378 - protein, 9 aa, Homo Sapiens
LANGGATNQ

SEQ ID NO: 329379 - protein, 9 aa, Homo Sapiens
QQGLVFLSL

SEQ ID NO: 329380 - protein, 9 aa, Homo Sapiens
TSQVWDVGM

SEQ ID NO: 329381 - protein, 9 aa, Homo Sapiens
AAAFVLAIF

SEQ ID NO: 329382 - protein, 9 aa, Homo Sapiens
VQDGAQVES

SEQ ID NO: 329383 - protein, 9 aa, Homo Sapiens
KDMHKVLRT

SEQ ID NO: 329384 - protein, 9 aa, Homo Sapiens
HYGKVPYPP

SEQ ID NO: 329385 - protein, 9 aa, Homo Sapiens
DGDHITHCW

SEQ ID NO: 329386 - protein, 9 aa, Homo Sapiens
EAVWQHVAQ

SEQ ID NO: 329387 - protein, 9 aa, Homo Sapiens
PQGRNLLII

SEQ ID NO: 329388 - protein, 9 aa, Homo Sapiens
ILNTSGNYS

SEQ ID NO: 329389 - protein, 9 aa, Homo Sapiens
HVRHHTGKK

SEQ ID NO: 329390 - protein, 9 aa, Homo Sapiens
VNTYGLKKH

SEQ ID NO: 329391 - protein, 9 aa, Homo Sapiens
VTDLLKELA

SEQ ID NO: 329392 - protein, 9 aa, Homo Sapiens
WMFHRQAVY

SEQ ID NO: 329393 - protein, 9 aa, Homo Sapiens
RLGSSKVEQ

SEQ ID NO: 329394 - protein, 9 aa, Homo Sapiens
SGSHLDPCD

SEQ ID NO: 329395 - protein, 9 aa, Homo Sapiens
TLYHFNASL

SEQ ID NO: 329396 - protein, 9 aa, Homo Sapiens
SVDKRKLRE

SEQ ID NO: 329397 - protein, 9 aa, Homo Sapiens
DSARVCYYQ

SEQ ID NO: 329398 - protein, 9 aa, Homo Sapiens
SCLRSLDIR

SEQ ID NO: 329399 - protein, 9 aa, Homo Sapiens
QWGESPWQV

SEQ ID NO: 329400 - protein, 9 aa, Homo Sapiens
HFWMFHRQA

SEQ ID NO: 329401 - protein, 9 aa, Homo Sapiens
DPLLLLIPR

SEQ ID NO: 329402 - protein, 9 aa, Homo Sapiens
KEPALAPPE

SEQ ID NO: 329403 - protein, 9 aa, Homo Sapiens
WAAGYGVWN

SEQ ID NO: 329404 - protein, 9 aa, Homo Sapiens
SAEYPKMCQ

SEQ ID NO: 329405 - protein, 9 aa, Homo Sapiens
NGTKVVSHP

SEQ ID NO: 329406 - protein, 9 aa, Homo Sapiens
GASSRPPTG

SEQ ID NO: 329407 - protein, 9 aa, Homo Sapiens
RGQLLNRLA

SEQ ID NO: 329408 - protein, 9 aa, Homo Sapiens
AASTAEEMA

SEQ ID NO: 329409 - protein, 9 aa, Homo Sapiens
DGLHEDLNH

SEQ ID NO: 329410 - protein, 9 aa, Homo Sapiens
ENGEEDFAA

SEQ ID NO: 329411 - protein, 9 aa, Homo Sapiens
KSEWELDKI

SEQ ID NO: 329412 - protein, 9 aa, Homo Sapiens
GRSRGAGST

SEQ ID NO: 329413 - protein, 9 aa, Homo Sapiens
TTLAQAQQN

SEQ ID NO: 329414 - protein, 9 aa, Homo Sapiens
TPAMESVYG

SEQ ID NO: 329415 - protein, 9 aa, Homo Sapiens
CGLGTQEGT

SEQ ID NO: 329416 - protein, 9 aa, Homo Sapiens
CMVKIILTD

SEQ ID NO: 329417 - protein, 9 aa, Homo Sapiens
LIHRGMDST

SEQ ID NO: 329418 - protein, 9 aa, Homo Sapiens
GADRGLKSK

SEQ ID NO: 329419 - protein, 9 aa, Homo Sapiens
LHVANEVTL

SEQ ID NO: 329420 - protein, 9 aa, Homo Sapiens
KWNKDDRPL

SEQ ID NO: 329421 - protein, 9 aa, Homo Sapiens
EMCPCWFQL

SEQ ID NO: 329422 - protein, 9 aa, Homo Sapiens
VCQDNESET

SEQ ID NO: 329423 - protein, 9 aa, Homo Sapiens
AKYHMASLY

SEQ ID NO: 329424 - protein, 9 aa, Homo Sapiens
LPVWAVTQN

SEQ ID NO: 329425 - protein, 9 aa, Homo Sapiens
PRPIPVIFK

SEQ ID NO: 329426 - protein, 9 aa, Homo Sapiens
SSGPLSLQE

SEQ ID NO: 329427 - protein, 9 aa, Homo Sapiens
QRSSCSSSG

SEQ ID NO: 329428 - protein, 9 aa, Homo Sapiens
FQGKAKHLH

SEQ ID NO: 329429 - protein, 9 aa, Homo Sapiens
CEVDNELCI

SEQ ID NO: 329430 - protein, 9 aa, Homo Sapiens
HQLDLGTLN

SEQ ID NO: 329431 - protein, 9 aa, Homo Sapiens
YDVGARVHT

SEQ ID NO: 329432 - protein, 9 aa, Homo Sapiens
FLVTWRGVE

SEQ ID NO: 329433 - protein, 9 aa, Homo Sapiens
EANKSIQDH

SEQ ID NO: 329434 - protein, 9 aa, Homo Sapiens
LFTSREEVV

SEQ ID NO: 329435 - protein, 9 aa, Homo Sapiens
AQIQEIVVE

SEQ ID NO: 329436 - protein, 9 aa, Homo Sapiens
HGEPACVLC

SEQ ID NO: 329437 - protein, 9 aa, Homo Sapiens
HARMEEMGS

SEQ ID NO: 329438 - protein, 9 aa, Homo Sapiens
PLQLPPMSV

SEQ ID NO: 329439 - protein, 9 aa, Homo Sapiens
FGIGSELTR

SEQ ID NO: 329440 - protein, 9 aa, Homo Sapiens
LHCAAASGM

SEQ ID NO: 329441 - protein, 9 aa, Homo Sapiens
FGQKQWPSR

SEQ ID NO: 329442 - protein, 9 aa, Homo Sapiens
AQECGHLHM

SEQ ID NO: 329443 - protein, 9 aa, Homo Sapiens
PRSLEFLRT

SEQ ID NO: 329444 - protein, 9 aa, Homo Sapiens
YILGLGDRR

SEQ ID NO: 329445 - protein, 9 aa, Homo Sapiens
HLDTYPAWV

SEQ ID NO: 329446 - protein, 9 aa, Homo Sapiens
FQDSILEEE

SEQ ID NO: 329447 - protein, 9 aa, Homo Sapiens
MVANYEPEE

SEQ ID NO: 329448 - protein, 9 aa, Homo Sapiens
INTVATLEK

SEQ ID NO: 329449 - protein, 9 aa, Homo Sapiens
ASRRELAHL

SEQ ID NO: 329450 - protein, 9 aa, Homo Sapiens
GSLDMQPKK

SEQ ID NO: 329451 - protein, 9 aa, Homo Sapiens
VYLLWDGGL

SEQ ID NO: 329452 - protein, 9 aa, Homo Sapiens
DPGRLPGRP

SEQ ID NO: 329453 - protein, 9 aa, Homo Sapiens
FQAFRSRRK

SEQ ID NO: 329454 - protein, 9 aa, Homo Sapiens
KFLFLVSLP

SEQ ID NO: 329455 - protein, 9 aa, Homo Sapiens
PKAPKKTLL

SEQ ID NO: 329456 - protein, 9 aa, Homo Sapiens
NEYFFDRNH

SEQ ID NO: 329457 - protein, 9 aa, Homo Sapiens
ASSTSPTDV

SEQ ID NO: 329458 - protein, 9 aa, Homo Sapiens
QSRETLLHQ

SEQ ID NO: 329459 - protein, 9 aa, Homo Sapiens
PPPRPLQRV

SEQ ID NO: 329460 - protein, 9 aa, Homo Sapiens
EVFCVALRP

SEQ ID NO: 329461 - protein, 9 aa, Homo Sapiens
IAVLYLKKK

SEQ ID NO: 329462 - protein, 9 aa, Homo Sapiens
YRWDSKKLP

SEQ ID NO: 329463 - protein, 9 aa, Homo Sapiens
KVLHILVHE

SEQ ID NO: 329464 - protein, 9 aa, Homo Sapiens
KSCRRSYHS

SEQ ID NO: 329465 - protein, 9 aa, Homo Sapiens
HVFQSHHEF

SEQ ID NO: 329466 - protein, 9 aa, Homo Sapiens
GFTPPEDDE

SEQ ID NO: 329467 - protein, 9 aa, Homo Sapiens
ARCRDAASK

SEQ ID NO: 329468 - protein, 9 aa, Homo Sapiens
QACAEQCNI

SEQ ID NO: 329469 - protein, 9 aa, Homo Sapiens
CTEMEGRSS

SEQ ID NO: 329470 - protein, 9 aa, Homo Sapiens
ENWLLQEEN

SEQ ID NO: 329471 - protein, 9 aa, Homo Sapiens
LEDAKRLCV

SEQ ID NO: 329472 - protein, 9 aa, Homo Sapiens
GSPSTWMFQ

SEQ ID NO: 329473 - protein, 9 aa, Homo Sapiens
AFYGAKPPI

SEQ ID NO: 329474 - protein, 9 aa, Homo Sapiens
EGAYGMVSL

SEQ ID NO: 329475 - protein, 9 aa, Homo Sapiens
LRPDESLTI

SEQ ID NO: 329476 - protein, 9 aa, Homo Sapiens
QGLPGRLPP

SEQ ID NO: 329477 - protein, 9 aa, Homo Sapiens
TTVEVSATV

SEQ ID NO: 329478 - protein, 9 aa, Homo Sapiens
ARERLHVRD

SEQ ID NO: 329479 - protein, 9 aa, Homo Sapiens
TCEAGASGS

SEQ ID NO: 329480 - protein, 9 aa, Homo Sapiens
KADMTGAQR

SEQ ID NO: 329481 - protein, 9 aa, Homo Sapiens
GELESQWEK

SEQ ID NO: 329482 - protein, 9 aa, Homo Sapiens
SCLAGVAVL

SEQ ID NO: 329483 - protein, 9 aa, Homo Sapiens
QCFACNKFG

SEQ ID NO: 329484 - protein, 9 aa, Homo Sapiens
DAASKLKEL

SEQ ID NO: 329485 - protein, 9 aa, Homo Sapiens
AFACHEEGS

SEQ ID NO: 329486 - protein, 9 aa, Homo Sapiens
RGDKKGKDR

SEQ ID NO: 329487 - protein, 9 aa, Homo Sapiens
GQRIRRDSI

SEQ ID NO: 329488 - protein, 9 aa, Homo Sapiens
CPSETEKDI

SEQ ID NO: 329489 - protein, 9 aa, Homo Sapiens
VISDLDWVV

SEQ ID NO: 329490 - protein, 9 aa, Homo Sapiens
KVAEALIER

SEQ ID NO: 329491 - protein, 9 aa, Homo Sapiens
SKATDLLTL

SEQ ID NO: 329492 - protein, 9 aa, Homo Sapiens
NGHWWEPSG

SEQ ID NO: 329493 - protein, 9 aa, Homo Sapiens
SRDRALEPG

SEQ ID NO: 329494 - protein, 9 aa, Homo Sapiens
KIKTFYDLE

SEQ ID NO: 329495 - protein, 9 aa, Homo Sapiens
QAWGERLHA

SEQ ID NO: 329496 - protein, 9 aa, Homo Sapiens
ILGGLEHLA

SEQ ID NO: 329497 - protein, 9 aa, Homo Sapiens
PIAPATPAP

SEQ ID NO: 329498 - protein, 9 aa, Homo Sapiens
KFCACCGGR

SEQ ID NO: 329499 - protein, 9 aa, Homo Sapiens
PSILHYQQA

SEQ ID NO: 329500 - protein, 9 aa, Homo Sapiens
CPDRAVDGN

SEQ ID NO: 329501 - protein, 9 aa, Homo Sapiens
TGIHETTYN

SEQ ID NO: 329502 - protein, 9 aa, Homo Sapiens
TLLHNACAN

SEQ ID NO: 329503 - protein, 9 aa, Homo Sapiens
PVIMKNSMY

SEQ ID NO: 329504 - protein, 9 aa, Homo Sapiens
PSVAGLETM

SEQ ID NO: 329505 - protein, 9 aa, Homo Sapiens
ETIWRQQWL

SEQ ID NO: 329506 - protein, 9 aa, Homo Sapiens
SKLQCQIHA

SEQ ID NO: 329507 - protein, 9 aa, Homo Sapiens
ILAADCGMK

SEQ ID NO: 329508 - protein, 9 aa, Homo Sapiens
FFFIPTMHL

SEQ ID NO: 329509 - protein, 9 aa, Homo Sapiens
IPSYVSWFD

SEQ ID NO: 329510 - protein, 9 aa, Homo Sapiens
FGAAIFALP

SEQ ID NO: 329511 - protein, 9 aa, Homo Sapiens
CAMADPYVV

SEQ ID NO: 329512 - protein, 9 aa, Homo Sapiens
DHLFSSFGQ

SEQ ID NO: 329513 - protein, 9 aa, Homo Sapiens
QQSRANGVP

SEQ ID NO: 329514 - protein, 9 aa, Homo Sapiens
RLVQEETLA

SEQ ID NO: 329515 - protein, 9 aa, Homo Sapiens
VGFKEAVKD

SEQ ID NO: 329516 - protein, 9 aa, Homo Sapiens
SKNQSEAGT

SEQ ID NO: 329517 - protein, 9 aa, Homo Sapiens
QILGGLEHL

SEQ ID NO: 329518 - protein, 9 aa, Homo Sapiens
PKYQDAAYS

SEQ ID NO: 329519 - protein, 9 aa, Homo Sapiens
SFLRTYQTQ

SEQ ID NO: 329520 - protein, 9 aa, Homo Sapiens
HPDYKCQPR

SEQ ID NO: 329521 - protein, 9 aa, Homo Sapiens
LDFDYPQNS

SEQ ID NO: 329522 - protein, 9 aa, Homo Sapiens
MFNLPGSLY

SEQ ID NO: 329523 - protein, 9 aa, Homo Sapiens
ETAVVIFLH

SEQ ID NO: 329524 - protein, 9 aa, Homo Sapiens
LATGFSPPV

SEQ ID NO: 329525 - protein, 9 aa, Homo Sapiens
DTDIFPDSK

SEQ ID NO: 329526 - protein, 9 aa, Homo Sapiens
KVACLLDKG

SEQ ID NO: 329527 - protein, 9 aa, Homo Sapiens
PEGEPPAMS

SEQ ID NO: 329528 - protein, 9 aa, Homo Sapiens
GSTNASSVP

SEQ ID NO: 329529 - protein, 9 aa, Homo Sapiens
VSAQPPAGR

SEQ ID NO: 329530 - protein, 9 aa, Homo Sapiens
MAGSAQGRA

SEQ ID NO: 329531 - protein, 9 aa, Homo Sapiens
KAPIHVRNL

SEQ ID NO: 329532 - protein, 9 aa, Homo Sapiens
TPEFYNRFK

SEQ ID NO: 329533 - protein, 9 aa, Homo Sapiens
ASNFNDMVK

SEQ ID NO: 329534 - protein, 9 aa, Homo Sapiens
QLARHILLL

SEQ ID NO: 329535 - protein, 9 aa, Homo Sapiens
CKGGDPKYA

SEQ ID NO: 329536 - protein, 9 aa, Homo Sapiens
DWGRSLDVD

SEQ ID NO: 329537 - protein, 9 aa, Homo Sapiens
GMPLSSQTP

SEQ ID NO: 329538 - protein, 9 aa, Homo Sapiens
VRPSDWPPR

SEQ ID NO: 329539 - protein, 9 aa, Homo Sapiens
GPNGCITNF

SEQ ID NO: 329540 - protein, 9 aa, Homo Sapiens
AMGPEGATN

SEQ ID NO: 329541 - protein, 9 aa, Homo Sapiens
LFSYNLPLE

SEQ ID NO: 329542 - protein, 9 aa, Homo Sapiens
YYNWWRKAL

SEQ ID NO: 329543 - protein, 9 aa, Homo Sapiens
HTLWKRGLL

SEQ ID NO: 329544 - protein, 9 aa, Homo Sapiens
HCDWSLLSS

SEQ ID NO: 329545 - protein, 9 aa, Homo Sapiens
LKKMTLKAL

SEQ ID NO: 329546 - protein, 9 aa, Homo Sapiens
CPCWFQLDQ

SEQ ID NO: 329547 - protein, 9 aa, Homo Sapiens
LIMSDIHIS

SEQ ID NO: 329548 - protein, 9 aa, Homo Sapiens
YTCASCLKE

SEQ ID NO: 329549 - protein, 9 aa, Homo Sapiens
ANKSIQDHL

SEQ ID NO: 329550 - protein, 9 aa, Homo Sapiens
VPIIAMETF

SEQ ID NO: 329551 - protein, 9 aa, Homo Sapiens
VDVHISYLP

SEQ ID NO: 329552 - protein, 9 aa, Homo Sapiens
TPTAEDVTV

SEQ ID NO: 329553 - protein, 9 aa, Homo Sapiens
LGGPPPKKL

SEQ ID NO: 329554 - protein, 9 aa, Homo Sapiens
LYWLDEKWD

SEQ ID NO: 329555 - protein, 9 aa, Homo Sapiens
GNFIWLPSN

SEQ ID NO: 329556 - protein, 9 aa, Homo Sapiens
SACPSETEK

SEQ ID NO: 329557 - protein, 9 aa, Homo Sapiens
RAKIQTVKM

SEQ ID NO: 329558 - protein, 9 aa, Homo Sapiens
LCCAICRNR

SEQ ID NO: 329559 - protein, 9 aa, Homo Sapiens
TDKVACLLD

SEQ ID NO: 329560 - protein, 9 aa, Homo Sapiens
VQWILRLIS

SEQ ID NO: 329561 - protein, 9 aa, Homo Sapiens
GKEYLMWAH

SEQ ID NO: 329562 - protein, 9 aa, Homo Sapiens
KSQMGQVGE

SEQ ID NO: 329563 - protein, 9 aa, Homo Sapiens
YDIELAVSL

SEQ ID NO: 329564 - protein, 9 aa, Homo Sapiens
CGKFYSHKY

SEQ ID NO: 329565 - protein, 9 aa, Homo Sapiens
RRGRLIDFK

SEQ ID NO: 329566 - protein, 9 aa, Homo Sapiens
CITDPETGL

SEQ ID NO: 329567 - protein, 9 aa, Homo Sapiens
QCLNSFLRD

SEQ ID NO: 329568 - protein, 9 aa, Homo Sapiens
NVIQQLLEL

SEQ ID NO: 329569 - protein, 9 aa, Homo Sapiens
ALKHVGPGK

SEQ ID NO: 329570 - protein, 9 aa, Homo Sapiens
GPFLPGNLQ

SEQ ID NO: 329571 - protein, 9 aa, Homo Sapiens
PMFLCLYLL

SEQ ID NO: 329572 - protein, 9 aa, Homo Sapiens
FPMSHVRLW

SEQ ID NO: 329573 - protein, 9 aa, Homo Sapiens
QINFYCPGS

SEQ ID NO: 329574 - protein, 9 aa, Homo Sapiens
IAESHVNKL

SEQ ID NO: 329575 - protein, 9 aa, Homo Sapiens
SAQDAAQIL

SEQ ID NO: 329576 - protein, 9 aa, Homo Sapiens
LAASTAEEM

SEQ ID NO: 329577 - protein, 9 aa, Homo Sapiens
PPSWAALSN

SEQ ID NO: 329578 - protein, 9 aa, Homo Sapiens
LLSQEPNNG

SEQ ID NO: 329579 - protein, 9 aa, Homo Sapiens
ASSVETKPC

SEQ ID NO: 329580 - protein, 9 aa, Homo Sapiens
TCGPDPKIY

SEQ ID NO: 329581 - protein, 9 aa, Homo Sapiens
KSTDSRCYG

SEQ ID NO: 329582 - protein, 9 aa, Homo Sapiens
AAGYGVWNT

SEQ ID NO: 329583 - protein, 9 aa, Homo Sapiens
VLSGETQEQ

SEQ ID NO: 329584 - protein, 9 aa, Homo Sapiens
VPSVAVIGA

SEQ ID NO: 329585 - protein, 9 aa, Homo Sapiens
RERPPSQVP

SEQ ID NO: 329586 - protein, 9 aa, Homo Sapiens
PVWAVTQNG

SEQ ID NO: 329587 - protein, 9 aa, Homo Sapiens
DMHKVLRTL

SEQ ID NO: 329588 - protein, 9 aa, Homo Sapiens
PHKRWQRSS

SEQ ID NO: 329589 - protein, 9 aa, Homo Sapiens
RLTYHLAVV

SEQ ID NO: 329590 - protein, 9 aa, Homo Sapiens
WPNPKDTTP

SEQ ID NO: 329591 - protein, 9 aa, Homo Sapiens
VSLHSQRLH

SEQ ID NO: 329592 - protein, 9 aa, Homo Sapiens
HLYYFQYPC

SEQ ID NO: 329593 - protein, 9 aa, Homo Sapiens
VLVRDIRRR

SEQ ID NO: 329594 - protein, 9 aa, Homo Sapiens
YLRIYVYIK

SEQ ID NO: 329595 - protein, 9 aa, Homo Sapiens
SKQADSVEQ

SEQ ID NO: 329596 - protein, 9 aa, Homo Sapiens
PTSFTLVPG

SEQ ID NO: 329597 - protein, 9 aa, Homo Sapiens
HDPRATALR

SEQ ID NO: 329598 - protein, 9 aa, Homo Sapiens
DDLEECLYS

SEQ ID NO: 329599 - protein, 9 aa, Homo Sapiens
YLLERYAKW

SEQ ID NO: 329600 - protein, 9 aa, Homo Sapiens
LRVPVLRSL

SEQ ID NO: 329601 - protein, 9 aa, Homo Sapiens
GAALREWLG

SEQ ID NO: 329602 - protein, 9 aa, Homo Sapiens
MFWYSMPWH

SEQ ID NO: 329603 - protein, 9 aa, Homo Sapiens
TWLEGSCVS

SEQ ID NO: 329604 - protein, 9 aa, Homo Sapiens
PSPIGMPLS

SEQ ID NO: 329605 - protein, 9 aa, Homo Sapiens
AFVLAIFCK

SEQ ID NO: 329606 - protein, 9 aa, Homo Sapiens
PMLEAPGHR

SEQ ID NO: 329607 - protein, 9 aa, Homo Sapiens
SGAFRLVFQ

SEQ ID NO: 329608 - protein, 9 aa, Homo Sapiens
TGRCRPRRG

SEQ ID NO: 329609 - protein, 9 aa, Homo Sapiens
SAHGRTGTG

SEQ ID NO: 329610 - protein, 9 aa, Homo Sapiens
KECEKAFGI

SEQ ID NO: 329611 - protein, 9 aa, Homo Sapiens
PTRKAQTGL

SEQ ID NO: 329612 - protein, 9 aa, Homo Sapiens
KLNEHTARW

SEQ ID NO: 329613 - protein, 9 aa, Homo Sapiens
WEMAVNEPL

SEQ ID NO: 329614 - protein, 9 aa, Homo Sapiens
SQWGVQGSA

SEQ ID NO: 329615 - protein, 9 aa, Homo Sapiens
GYEPKQFKN

SEQ ID NO: 329616 - protein, 9 aa, Homo Sapiens
RPLNIQIVL

SEQ ID NO: 329617 - protein, 9 aa, Homo Sapiens
AARGLKGHI

SEQ ID NO: 329618 - protein, 9 aa, Homo Sapiens
SVAGLETMY

SEQ ID NO: 329619 - protein, 9 aa, Homo Sapiens
AVGVLVSLP

SEQ ID NO: 329620 - protein, 9 aa, Homo Sapiens
MWCCSRIMH

SEQ ID NO: 329621 - protein, 9 aa, Homo Sapiens
NDTTMVCCA

SEQ ID NO: 329622 - protein, 9 aa, Homo Sapiens
DPVTLYGSS

SEQ ID NO: 329623 - protein, 9 aa, Homo Sapiens
VSWFDYNCI

SEQ ID NO: 329624 - protein, 9 aa, Homo Sapiens
SQMIREELG

SEQ ID NO: 329625 - protein, 9 aa, Homo Sapiens
HFYMAKGNP

SEQ ID NO: 329626 - protein, 9 aa, Homo Sapiens
MTNGLCIWL

SEQ ID NO: 329627 - protein, 9 aa, Homo Sapiens
ATGDLIYML

SEQ ID NO: 329628 - protein, 9 aa, Homo Sapiens
ARLDHKFNL

SEQ ID NO: 329629 - protein, 9 aa, Homo Sapiens
GFTLRWSYN

SEQ ID NO: 329630 - protein, 9 aa, Homo Sapiens
EQAQIIWEC

SEQ ID NO: 329631 - protein, 9 aa, Homo Sapiens
AVIKVRRSL

SEQ ID NO: 329632 - protein, 9 aa, Homo Sapiens
RMQLMSCIA

SEQ ID NO: 329633 - protein, 9 aa, Homo Sapiens
MPTLIAPED

SEQ ID NO: 329634 - protein, 9 aa, Homo Sapiens
LDANGPPIF

SEQ ID NO: 329635 - protein, 9 aa, Homo Sapiens
LARHILLLA

SEQ ID NO: 329636 - protein, 9 aa, Homo Sapiens
HTDFFPGLG

SEQ ID NO: 329637 - protein, 9 aa, Homo Sapiens
RYAKWKGLP

SEQ ID NO: 329638 - protein, 9 aa, Homo Sapiens
SEREKEISS

SEQ ID NO: 329639 - protein, 9 aa, Homo Sapiens
LKGCLLCTY

SEQ ID NO: 329640 - protein, 9 aa, Homo Sapiens
KECSCMKGG

SEQ ID NO: 329641 - protein, 9 aa, Homo Sapiens
PEQIVWLKL

SEQ ID NO: 329642 - protein, 9 aa, Homo Sapiens
RYRDYQQVV

SEQ ID NO: 329643 - protein, 9 aa, Homo Sapiens
PLPPWSTSL

SEQ ID NO: 329644 - protein, 9 aa, Homo Sapiens
ARPNRRATA

SEQ ID NO: 329645 - protein, 9 aa, Homo Sapiens
SWPVGQPQW

SEQ ID NO: 329646 - protein, 9 aa, Homo Sapiens
FRFYDEYCS

SEQ ID NO: 329647 - protein, 9 aa, Homo Sapiens
EWEFTARGG

SEQ ID NO: 329648 - protein, 9 aa, Homo Sapiens
GIILETVAT

SEQ ID NO: 329649 - protein, 9 aa, Homo Sapiens
RFLDNKVML

SEQ ID NO: 329650 - protein, 9 aa, Homo Sapiens
HDVTEKVTQ

SEQ ID NO: 329651 - protein, 9 aa, Homo Sapiens
GIPKTTGEG

SEQ ID NO: 329652 - protein, 9 aa, Homo Sapiens
LPQFYPLRP

SEQ ID NO: 329653 - protein, 9 aa, Homo Sapiens
HGPRSSWPV

SEQ ID NO: 329654 - protein, 9 aa, Homo Sapiens
STSFMVSWP

SEQ ID NO: 329655 - protein, 9 aa, Homo Sapiens
LVHADDEKC

SEQ ID NO: 329656 - protein, 9 aa, Homo Sapiens
QERILYQFS

SEQ ID NO: 329657 - protein, 9 aa, Homo Sapiens
IKTFYDLET

SEQ ID NO: 329658 - protein, 9 aa, Homo Sapiens
RSLSQVAID

SEQ ID NO: 329659 - protein, 9 aa, Homo Sapiens
GTQIPIERL

SEQ ID NO: 329660 - protein, 9 aa, Homo Sapiens
TGIICLARE

SEQ ID NO: 329661 - protein, 9 aa, Homo Sapiens
QEVQGQAGD

SEQ ID NO: 329662 - protein, 9 aa, Homo Sapiens
VIVAEYFDE

SEQ ID NO: 329663 - protein, 9 aa, Homo Sapiens
GGGRVAFCM

SEQ ID NO: 329664 - protein, 9 aa, Homo Sapiens
RLVSLQLLI

SEQ ID NO: 329665 - protein, 9 aa, Homo Sapiens
QDSILEEEV

SEQ ID NO: 329666 - protein, 9 aa, Homo Sapiens
PAPVPPPKP

SEQ ID NO: 329667 - protein, 9 aa, Homo Sapiens
VYTKVSCYL

SEQ ID NO: 329668 - protein, 9 aa, Homo Sapiens
QLQARLHGF

SEQ ID NO: 329669 - protein, 9 aa, Homo Sapiens
APPQGRNLL

SEQ ID NO: 329670 - protein, 9 aa, Homo Sapiens
LVRRFCCFG

SEQ ID NO: 329671 - protein, 9 aa, Homo Sapiens
PWPTRKAQT

SEQ ID NO: 329672 - protein, 9 aa, Homo Sapiens
WHMHLEMHC

SEQ ID NO: 329673 - protein, 9 aa, Homo Sapiens
KESGQVVTI

SEQ ID NO: 329674 - protein, 9 aa, Homo Sapiens
LGYHCDWSL

SEQ ID NO: 329675 - protein, 9 aa, Homo Sapiens
EVLSAQGEP

SEQ ID NO: 329676 - protein, 9 aa, Homo Sapiens
MHSAQVIHH

SEQ ID NO: 329677 - protein, 9 aa, Homo Sapiens
DFWPLRKWS

SEQ ID NO: 329678 - protein, 9 aa, Homo Sapiens
YPDITTGDG

SEQ ID NO: 329679 - protein, 9 aa, Homo Sapiens
FKKSKEVSQ

SEQ ID NO: 329680 - protein, 9 aa, Homo Sapiens
DAVIHTLQT

SEQ ID NO: 329681 - protein, 9 aa, Homo Sapiens
QKIVIIAKA

SEQ ID NO: 329682 - protein, 9 aa, Homo Sapiens
RLCHLLVGA

SEQ ID NO: 329683 - protein, 9 aa, Homo Sapiens
QLGLVVIVP

SEQ ID NO: 329684 - protein, 9 aa, Homo Sapiens
VPLRAGVRA

SEQ ID NO: 329685 - protein, 9 aa, Homo Sapiens
WKGLPPPLF

SEQ ID NO: 329686 - protein, 9 aa, Homo Sapiens
DALLITQNS

SEQ ID NO: 329687 - protein, 9 aa, Homo Sapiens
KSALKCHGL

SEQ ID NO: 329688 - protein, 9 aa, Homo Sapiens
VNFLTTVTV

SEQ ID NO: 329689 - protein, 9 aa, Homo Sapiens
VFCVALRPR

SEQ ID NO: 329690 - protein, 9 aa, Homo Sapiens
PVTVALLRA

SEQ ID NO: 329691 - protein, 9 aa, Homo Sapiens
EKLEHKEIQ

SEQ ID NO: 329692 - protein, 9 aa, Homo Sapiens
MIVPGMNMV

SEQ ID NO: 329693 - protein, 9 aa, Homo Sapiens
HHGVRPHGE

SEQ ID NO: 329694 - protein, 9 aa, Homo Sapiens
MVRWAAASK

SEQ ID NO: 329695 - protein, 9 aa, Homo Sapiens
LQKDPRNAG

SEQ ID NO: 329696 - protein, 9 aa, Homo Sapiens
HMDSRPFAS

SEQ ID NO: 329697 - protein, 9 aa, Homo Sapiens
LILTVLLAV

SEQ ID NO: 329698 - protein, 9 aa, Homo Sapiens
YAPECINFC

SEQ ID NO: 329699 - protein, 9 aa, Homo Sapiens
IYIALLVVG

SEQ ID NO: 329700 - protein, 9 aa, Homo Sapiens
PQGVVYGDV

SEQ ID NO: 329701 - protein, 9 aa, Homo Sapiens
AGLKMLVTI

SEQ ID NO: 329702 - protein, 9 aa, Homo Sapiens
RLLDTLQET

SEQ ID NO: 329703 - protein, 9 aa, Homo Sapiens
TWRPLGSWQ

SEQ ID NO: 329704 - protein, 9 aa, Homo Sapiens
KYEKSLRKY

SEQ ID NO: 329705 - protein, 9 aa, Homo Sapiens
ELWRWHATP

SEQ ID NO: 329706 - protein, 9 aa, Homo Sapiens
EGGESMLVV

SEQ ID NO: 329707 - protein, 9 aa, Homo Sapiens
VEPGQEQAE

SEQ ID NO: 329708 - protein, 9 aa, Homo Sapiens
AHCPANGAG

SEQ ID NO: 329709 - protein, 9 aa, Homo Sapiens
PGRQPQVGL

SEQ ID NO: 329710 - protein, 9 aa, Homo Sapiens
SSTSPTDVS

SEQ ID NO: 329711 - protein, 9 aa, Homo Sapiens
EDDDEDSRH

SEQ ID NO: 329712 - protein, 9 aa, Homo Sapiens
DFLLHFGCP

SEQ ID NO: 329713 - protein, 9 aa, Homo Sapiens
ARCLAMTAI

SEQ ID NO: 329714 - protein, 9 aa, Homo Sapiens
PSCRQRLEE

SEQ ID NO: 329715 - protein, 9 aa, Homo Sapiens
SDFRMVLQK

SEQ ID NO: 329716 - protein, 9 aa, Homo Sapiens
CSHLQDLKD

SEQ ID NO: 329717 - protein, 9 aa, Homo Sapiens
PTNMPTPTT

SEQ ID NO: 329718 - protein, 9 aa, Homo Sapiens
MPVNTNRWL

SEQ ID NO: 329719 - protein, 9 aa, Homo Sapiens
TRHFFRQII

SEQ ID NO: 329720 - protein, 9 aa, Homo Sapiens
VFGELLLND

SEQ ID NO: 329721 - protein, 9 aa, Homo Sapiens
PNRRATATT

SEQ ID NO: 329722 - protein, 9 aa, Homo Sapiens
RLHFSVRQT

SEQ ID NO: 329723 - protein, 9 aa, Homo Sapiens
SVLEPLQEH

SEQ ID NO: 329724 - protein, 9 aa, Homo Sapiens
HFSPNVPSC

SEQ ID NO: 329725 - protein, 9 aa, Homo Sapiens
GIPELLRWV

SEQ ID NO: 329726 - protein, 9 aa, Homo Sapiens
TVWRVVFIA

SEQ ID NO: 329727 - protein, 9 aa, Homo Sapiens
SIELKVIQH

SEQ ID NO: 329728 - protein, 9 aa, Homo Sapiens
AGIKRLWTH

SEQ ID NO: 329729 - protein, 9 aa, Homo Sapiens
LILWTRFCK

SEQ ID NO: 329730 - protein, 9 aa, Homo Sapiens
EIMGSQQQK

SEQ ID NO: 329731 - protein, 9 aa, Homo Sapiens
LSRWANLPG

SEQ ID NO: 329732 - protein, 9 aa, Homo Sapiens
IADGKEIHS

SEQ ID NO: 329733 - protein, 9 aa, Homo Sapiens
VATPFGGFK

SEQ ID NO: 329734 - protein, 9 aa, Homo Sapiens
SQAVSNVIQ

SEQ ID NO: 329735 - protein, 9 aa, Homo Sapiens
NPVVYYLHH

SEQ ID NO: 329736 - protein, 9 aa, Homo Sapiens
ANEWATIEG

SEQ ID NO: 329737 - protein, 9 aa, Homo Sapiens
CHVWPPGDE

SEQ ID NO: 329738 - protein, 9 aa, Homo Sapiens
WHIIKFHCA

SEQ ID NO: 329739 - protein, 9 aa, Homo Sapiens
SDLDWVVFE

SEQ ID NO: 329740 - protein, 9 aa, Homo Sapiens
WPCPAVPLG

SEQ ID NO: 329741 - protein, 9 aa, Homo Sapiens
QKQRLKKAY

SEQ ID NO: 329742 - protein, 9 aa, Homo Sapiens
CKKLQKKKN

SEQ ID NO: 329743 - protein, 9 aa, Homo Sapiens
KTMRVSDHQ

SEQ ID NO: 329744 - protein, 9 aa, Homo Sapiens
HLPIIEIHI

SEQ ID NO: 329745 - protein, 9 aa, Homo Sapiens
LLLLLPPSL

SEQ ID NO: 329746 - protein, 9 aa, Homo Sapiens
GKLRMVANY

SEQ ID NO: 329747 - protein, 9 aa, Homo Sapiens
PKNHPLGSG

SEQ ID NO: 329748 - protein, 9 aa, Homo Sapiens
QEWLCLACR

SEQ ID NO: 329749 - protein, 9 aa, Homo Sapiens
PPCRSLGCK

SEQ ID NO: 329750 - protein, 9 aa, Homo Sapiens
QDRPVCEGT

SEQ ID NO: 329751 - protein, 9 aa, Homo Sapiens
VRRQRQAME

SEQ ID NO: 329752 - protein, 9 aa, Homo Sapiens
NVKRHLKCP

SEQ ID NO: 329753 - protein, 9 aa, Homo Sapiens
LSAQGEPTE

SEQ ID NO: 329754 - protein, 9 aa, Homo Sapiens
HSVTGLVVM

SEQ ID NO: 329755 - protein, 9 aa, Homo Sapiens
DFWLLSDIT

SEQ ID NO: 329756 - protein, 9 aa, Homo Sapiens
PRCTLDFAP

SEQ ID NO: 329757 - protein, 9 aa, Homo Sapiens
FQGTINQHL

SEQ ID NO: 329758 - protein, 9 aa, Homo Sapiens
SSESPSGNL

SEQ ID NO: 329759 - protein, 9 aa, Homo Sapiens
LRSLHTIAV

SEQ ID NO: 329760 - protein, 9 aa, Homo Sapiens
DENSTKILK

SEQ ID NO: 329761 - protein, 9 aa, Homo Sapiens
HGEACPKAG

SEQ ID NO: 329762 - protein, 9 aa, Homo Sapiens
KDGGGEEEE

SEQ ID NO: 329763 - protein, 9 aa, Homo Sapiens
CITNFDNFA

SEQ ID NO: 329764 - protein, 9 aa, Homo Sapiens
LPGRQPQVG

SEQ ID NO: 329765 - protein, 9 aa, Homo Sapiens
MPDLRRFAR

SEQ ID NO: 329766 - protein, 9 aa, Homo Sapiens
ALVYQDQNK

SEQ ID NO: 329767 - protein, 9 aa, Homo Sapiens
HSLTHSMKS

SEQ ID NO: 329768 - protein, 9 aa, Homo Sapiens
WGRAEPPEE

SEQ ID NO: 329769 - protein, 9 aa, Homo Sapiens
TPPEDDEIE

SEQ ID NO: 329770 - protein, 9 aa, Homo Sapiens
DKDPLLSYN

SEQ ID NO: 329771 - protein, 9 aa, Homo Sapiens
FPQNSNVVN

SEQ ID NO: 329772 - protein, 9 aa, Homo Sapiens
YLIGQEAAF

SEQ ID NO: 329773 - protein, 9 aa, Homo Sapiens
GHAVLMQAY

SEQ ID NO: 329774 - protein, 9 aa, Homo Sapiens
PSLLVLLPD

SEQ ID NO: 329775 - protein, 9 aa, Homo Sapiens
ANNARERLH

SEQ ID NO: 329776 - protein, 9 aa, Homo Sapiens
ELLKKCSLY

SEQ ID NO: 329777 - protein, 9 aa, Homo Sapiens
DEIMGSQQQ

SEQ ID NO: 329778 - protein, 9 aa, Homo Sapiens
TMHDPRATA

SEQ ID NO: 329779 - protein, 9 aa, Homo Sapiens
PSNGPALLC

SEQ ID NO: 329780 - protein, 9 aa, Homo Sapiens
QEEDKGNVK

SEQ ID NO: 329781 - protein, 9 aa, Homo Sapiens
TLIAPEDSP

SEQ ID NO: 329782 - protein, 9 aa, Homo Sapiens
VKCLEVVSM

SEQ ID NO: 329783 - protein, 9 aa, Homo Sapiens
AIIAIIALS

SEQ ID NO: 329784 - protein, 9 aa, Homo Sapiens
VVSSNHSAA

SEQ ID NO: 329785 - protein, 9 aa, Homo Sapiens
TKNSYNDAL

SEQ ID NO: 329786 - protein, 9 aa, Homo Sapiens
ICVFLVRRF

SEQ ID NO: 329787 - protein, 9 aa, Homo Sapiens
VHLCACVCV

SEQ ID NO: 329788 - protein, 9 aa, Homo Sapiens
SACLTPAQA

SEQ ID NO: 329789 - protein, 9 aa, Homo Sapiens
RDFAILVQS

SEQ ID NO: 329790 - protein, 9 aa, Homo Sapiens
ATALRWNTT

SEQ ID NO: 329791 - protein, 9 aa, Homo Sapiens
WNSLGPRPI

SEQ ID NO: 329792 - protein, 9 aa, Homo Sapiens
LSDMYPHEA

SEQ ID NO: 329793 - protein, 9 aa, Homo Sapiens
CDSCHVWPP

SEQ ID NO: 329794 - protein, 9 aa, Homo Sapiens
KVRSISLTF

SEQ ID NO: 329795 - protein, 9 aa, Homo Sapiens
LPMDINNYP

SEQ ID NO: 329796 - protein, 9 aa, Homo Sapiens
CVSVWSSRC

SEQ ID NO: 329797 - protein, 9 aa, Homo Sapiens
LECIHRLIE

SEQ ID NO: 329798 - protein, 9 aa, Homo Sapiens
PACHEHGPR

SEQ ID NO: 329799 - protein, 9 aa, Homo Sapiens
QDVLGIAFC

SEQ ID NO: 329800 - protein, 9 aa, Homo Sapiens
GQLKEDRES

SEQ ID NO: 329801 - protein, 9 aa, Homo Sapiens
KMKAYEPKL

SEQ ID NO: 329802 - protein, 9 aa, Homo Sapiens
DIMHHISTP

SEQ ID NO: 329803 - protein, 9 aa, Homo Sapiens
MRKHLSAPE

SEQ ID NO: 329804 - protein, 9 aa, Homo Sapiens
SITLLALVC

SEQ ID NO: 329805 - protein, 9 aa, Homo Sapiens
WPLAGQQPG

SEQ ID NO: 329806 - protein, 9 aa, Homo Sapiens
SPQQPVPYV

SEQ ID NO: 329807 - protein, 9 aa, Homo Sapiens
YHSLRRPDV

SEQ ID NO: 329808 - protein, 9 aa, Homo Sapiens
SGFHYGVHT

SEQ ID NO: 329809 - protein, 9 aa, Homo Sapiens
RMDASERGQ

SEQ ID NO: 329810 - protein, 9 aa, Homo Sapiens
RCNRPCVWS

SEQ ID NO: 329811 - protein, 9 aa, Homo Sapiens
YGDVPDDTE

SEQ ID NO: 329812 - protein, 9 aa, Homo Sapiens
LHEDLNHIQ

SEQ ID NO: 329813 - protein, 9 aa, Homo Sapiens
DWSGDVPVS

SEQ ID NO: 329814 - protein, 9 aa, Homo Sapiens
EPMGRLVQE

SEQ ID NO: 329815 - protein, 9 aa, Homo Sapiens
GESMAGPTH

SEQ ID NO: 329816 - protein, 9 aa, Homo Sapiens
TGCPIPGTS

SEQ ID NO: 329817 - protein, 9 aa, Homo Sapiens
CSFTKHKVS

SEQ ID NO: 329818 - protein, 9 aa, Homo Sapiens
GPPAHPADA

SEQ ID NO: 329819 - protein, 9 aa, Homo Sapiens
TIVRTVPVA

SEQ ID NO: 329820 - protein, 9 aa, Homo Sapiens
EEEKLLGAE

SEQ ID NO: 329821 - protein, 9 aa, Homo Sapiens
CACVCVCVR

SEQ ID NO: 329822 - protein, 9 aa, Homo Sapiens
TIKMVQYRD

SEQ ID NO: 329823 - protein, 9 aa, Homo Sapiens
MKAYEPKLT

SEQ ID NO: 329824 - protein, 9 aa, Homo Sapiens
KVNPNMKSK

SEQ ID NO: 329825 - protein, 9 aa, Homo Sapiens
MTHMDPYCR

SEQ ID NO: 329826 - protein, 9 aa, Homo Sapiens
QLDIDKDGI

SEQ ID NO: 329827 - protein, 9 aa, Homo Sapiens
PDCLPAKSP

SEQ ID NO: 329828 - protein, 9 aa, Homo Sapiens
FLDKEACEV

SEQ ID NO: 329829 - protein, 9 aa, Homo Sapiens
SLEKLFVTV

SEQ ID NO: 329830 - protein, 9 aa, Homo Sapiens
MHNQEEKIR

SEQ ID NO: 329831 - protein, 9 aa, Homo Sapiens
AYPARPDSA

SEQ ID NO: 329832 - protein, 9 aa, Homo Sapiens
SRNGIRLDG

SEQ ID NO: 329833 - protein, 9 aa, Homo Sapiens
DETIRHFST

SEQ ID NO: 329834 - protein, 9 aa, Homo Sapiens
CFFQQDTLT

SEQ ID NO: 329835 - protein, 9 aa, Homo Sapiens
LPVGLASFV

SEQ ID NO: 329836 - protein, 9 aa, Homo Sapiens
TPDWFWWRQ

SEQ ID NO: 329837 - protein, 9 aa, Homo Sapiens
LVPGGAVAQ

SEQ ID NO: 329838 - protein, 9 aa, Homo Sapiens
LRYSINIGQ

SEQ ID NO: 329839 - protein, 9 aa, Homo Sapiens
CCVPTRLRP

SEQ ID NO: 329840 - protein, 9 aa, Homo Sapiens
AAQALDTQP

SEQ ID NO: 329841 - protein, 9 aa, Homo Sapiens
LTGVMKDGV

SEQ ID NO: 329842 - protein, 9 aa, Homo Sapiens
QDAYASSCN

SEQ ID NO: 329843 - protein, 9 aa, Homo Sapiens
RAVEAELEY

SEQ ID NO: 329844 - protein, 9 aa, Homo Sapiens
AGVVIHMRS

SEQ ID NO: 329845 - protein, 9 aa, Homo Sapiens
GQKSVYVVS

SEQ ID NO: 329846 - protein, 9 aa, Homo Sapiens
QDAAYSQCA

SEQ ID NO: 329847 - protein, 9 aa, Homo Sapiens
PLLLLIPRQ

SEQ ID NO: 329848 - protein, 9 aa, Homo Sapiens
TMLRRCARD

SEQ ID NO: 329849 - protein, 9 aa, Homo Sapiens
YNGHTKCKT

SEQ ID NO: 329850 - protein, 9 aa, Homo Sapiens
GVYQQARKK

SEQ ID NO: 329851 - protein, 9 aa, Homo Sapiens
CIRMQDLDL

SEQ ID NO: 329852 - protein, 9 aa, Homo Sapiens
NQLFTQLLA

SEQ ID NO: 329853 - protein, 9 aa, Homo Sapiens
LGFTLRWSY

SEQ ID NO: 329854 - protein, 9 aa, Homo Sapiens
HHAAVGVLV

SEQ ID NO: 329855 - protein, 9 aa, Homo Sapiens
RQPDSPTTL

SEQ ID NO: 329856 - protein, 9 aa, Homo Sapiens
VLDPLGLQE

SEQ ID NO: 329857 - protein, 9 aa, Homo Sapiens
MAAEGSGVG

SEQ ID NO: 329858 - protein, 9 aa, Homo Sapiens
KNRQTVASI

SEQ ID NO: 329859 - protein, 9 aa, Homo Sapiens
EAPCTVTSA

SEQ ID NO: 329860 - protein, 9 aa, Homo Sapiens
RINLPIPLA

SEQ ID NO: 329861 - protein, 9 aa, Homo Sapiens
LNDPHPLLH

SEQ ID NO: 329862 - protein, 9 aa, Homo Sapiens
WLVLWLLFR

SEQ ID NO: 329863 - protein, 9 aa, Homo Sapiens
IMNTFNVMP

SEQ ID NO: 329864 - protein, 9 aa, Homo Sapiens
LWKRGLLVA

SEQ ID NO: 329865 - protein, 9 aa, Homo Sapiens
NEALEEEVK

SEQ ID NO: 329866 - protein, 9 aa, Homo Sapiens
IKVTSWWTF

SEQ ID NO: 329867 - protein, 9 aa, Homo Sapiens
WNNRQVALC

SEQ ID NO: 329868 - protein, 9 aa, Homo Sapiens
TSLFQGIEF

SEQ ID NO: 329869 - protein, 9 aa, Homo Sapiens
PGYCMSLTS

SEQ ID NO: 329870 - protein, 9 aa, Homo Sapiens
SFCLTGEGL

SEQ ID NO: 329871 - protein, 9 aa, Homo Sapiens
KLYPTEIRQ

SEQ ID NO: 329872 - protein, 9 aa, Homo Sapiens
WTCSRSQLK

SEQ ID NO: 329873 - protein, 9 aa, Homo Sapiens
RNILNPFKV

SEQ ID NO: 329874 - protein, 9 aa, Homo Sapiens
MTSGIQAPA

SEQ ID NO: 329875 - protein, 9 aa, Homo Sapiens
PNNGISSDP

SEQ ID NO: 329876 - protein, 9 aa, Homo Sapiens
SQCHCSSIT

SEQ ID NO: 329877 - protein, 9 aa, Homo Sapiens
AVYHCSAST

SEQ ID NO: 329878 - protein, 9 aa, Homo Sapiens
KKGLSLSYG

SEQ ID NO: 329879 - protein, 9 aa, Homo Sapiens
EARRWKDSW

SEQ ID NO: 329880 - protein, 9 aa, Homo Sapiens
EEIVQYLRS

SEQ ID NO: 329881 - protein, 9 aa, Homo Sapiens
FCQILAVTI

SEQ ID NO: 329882 - protein, 9 aa, Homo Sapiens
PCGPPPTMV

SEQ ID NO: 329883 - protein, 9 aa, Homo Sapiens
FACNKFGTA

SEQ ID NO: 329884 - protein, 9 aa, Homo Sapiens
WVESVPGYP

SEQ ID NO: 329885 - protein, 9 aa, Homo Sapiens
ESGPQGCAT

SEQ ID NO: 329886 - protein, 9 aa, Homo Sapiens
LQKKLHTEV

SEQ ID NO: 329887 - protein, 9 aa, Homo Sapiens
EGCEWHFAR

SEQ ID NO: 329888 - protein, 9 aa, Homo Sapiens
KCCGNGVVE

SEQ ID NO: 329889 - protein, 9 aa, Homo Sapiens
YEYRWQDEC

SEQ ID NO: 329890 - protein, 9 aa, Homo Sapiens
MVNPDWLWS

SEQ ID NO: 329891 - protein, 9 aa, Homo Sapiens
GLVRVPLHT

SEQ ID NO: 329892 - protein, 9 aa, Homo Sapiens
QFGTKCARC

SEQ ID NO: 329893 - protein, 9 aa, Homo Sapiens
HLGFSLWNF

SEQ ID NO: 329894 - protein, 9 aa, Homo Sapiens
KATTSSSAQ

SEQ ID NO: 329895 - protein, 9 aa, Homo Sapiens
SGLSPRLRL

SEQ ID NO: 329896 - protein, 9 aa, Homo Sapiens
IILETVATA

SEQ ID NO: 329897 - protein, 9 aa, Homo Sapiens
PLIICHMID

SEQ ID NO: 329898 - protein, 9 aa, Homo Sapiens
RIMKENMRM

SEQ ID NO: 329899 - protein, 9 aa, Homo Sapiens
GERLHARME

SEQ ID NO: 329900 - protein, 9 aa, Homo Sapiens
VLLAVIVAV

SEQ ID NO: 329901 - protein, 9 aa, Homo Sapiens
SNDMNSPTD

SEQ ID NO: 329902 - protein, 9 aa, Homo Sapiens
AHANEEIDT

SEQ ID NO: 329903 - protein, 9 aa, Homo Sapiens
RVAKALHRG

SEQ ID NO: 329904 - protein, 9 aa, Homo Sapiens
RERHCSPTN

SEQ ID NO: 329905 - protein, 9 aa, Homo Sapiens
LDGSVDKRK

SEQ ID NO: 329906 - protein, 9 aa, Homo Sapiens
PRCCSGLGA

SEQ ID NO: 329907 - protein, 9 aa, Homo Sapiens
LRRFIYQPP

SEQ ID NO: 329908 - protein, 9 aa, Homo Sapiens
DAKAREAAL

SEQ ID NO: 329909 - protein, 9 aa, Homo Sapiens
GCLAEDVQR

SEQ ID NO: 329910 - protein, 9 aa, Homo Sapiens
CEAMLEMLL

SEQ ID NO: 329911 - protein, 9 aa, Homo Sapiens
GRAGSPHGS

SEQ ID NO: 329912 - protein, 9 aa, Homo Sapiens
PFYVTLLVE

SEQ ID NO: 329913 - protein, 9 aa, Homo Sapiens
AQFNQMTVE

SEQ ID NO: 329914 - protein, 9 aa, Homo Sapiens
DADGYAYFM

SEQ ID NO: 329915 - protein, 9 aa, Homo Sapiens
SLRRPPPRA

SEQ ID NO: 329916 - protein, 9 aa, Homo Sapiens
VGAGDVGKS

SEQ ID NO: 329917 - protein, 9 aa, Homo Sapiens
LSDGPAGRE

SEQ ID NO: 329918 - protein, 9 aa, Homo Sapiens
NKLLDPIWE

SEQ ID NO: 329919 - protein, 9 aa, Homo Sapiens
LRICFLLKV

SEQ ID NO: 329920 - protein, 9 aa, Homo Sapiens
EILAVAWDL

SEQ ID NO: 329921 - protein, 9 aa, Homo Sapiens
NDTAQFNQM

SEQ ID NO: 329922 - protein, 9 aa, Homo Sapiens
LDPIWEKFN

SEQ ID NO: 329923 - protein, 9 aa, Homo Sapiens
ANYEPEEEE

SEQ ID NO: 329924 - protein, 9 aa, Homo Sapiens
VATGDLIYM

SEQ ID NO: 329925 - protein, 9 aa, Homo Sapiens
CEAGASGSP

SEQ ID NO: 329926 - protein, 9 aa, Homo Sapiens
NSQRKHLHN

SEQ ID NO: 329927 - protein, 9 aa, Homo Sapiens
LCHHGGQLI

SEQ ID NO: 329928 - protein, 9 aa, Homo Sapiens
SKLGPQVSS

SEQ ID NO: 329929 - protein, 9 aa, Homo Sapiens
GFQWGESPW

SEQ ID NO: 329930 - protein, 9 aa, Homo Sapiens
GTTPCTSSI

SEQ ID NO: 329931 - protein, 9 aa, Homo Sapiens
LCMYDEKAH

SEQ ID NO: 329932 - protein, 9 aa, Homo Sapiens
HHTGKKPFK

SEQ ID NO: 329933 - protein, 9 aa, Homo Sapiens
YAWDNGRQV

SEQ ID NO: 329934 - protein, 9 aa, Homo Sapiens
MRSLGEPWR

SEQ ID NO: 329935 - protein, 9 aa, Homo Sapiens
QIKEARRWK

SEQ ID NO: 329936 - protein, 9 aa, Homo Sapiens
NGNGTKFSQ

SEQ ID NO: 329937 - protein, 9 aa, Homo Sapiens
SSVETKPCA

SEQ ID NO: 329938 - protein, 9 aa, Homo Sapiens
SLVLDCGYC

SEQ ID NO: 329939 - protein, 9 aa, Homo Sapiens
AFCMVKIIL

SEQ ID NO: 329940 - protein, 9 aa, Homo Sapiens
MPWQRVDRD

SEQ ID NO: 329941 - protein, 9 aa, Homo Sapiens
MVLQKLSKK

SEQ ID NO: 329942 - protein, 9 aa, Homo Sapiens
AEAVVVDIS

SEQ ID NO: 329943 - protein, 9 aa, Homo Sapiens
DRLLDTLQE

SEQ ID NO: 329944 - protein, 9 aa, Homo Sapiens
RTSVQSVAI

SEQ ID NO: 329945 - protein, 9 aa, Homo Sapiens
RDNHGWHGG

SEQ ID NO: 329946 - protein, 9 aa, Homo Sapiens
KRRRRRSKK

SEQ ID NO: 329947 - protein, 9 aa, Homo Sapiens
PHVFQSHHE

SEQ ID NO: 329948 - protein, 9 aa, Homo Sapiens
YGLCVPIMT

SEQ ID NO: 329949 - protein, 9 aa, Homo Sapiens
GEANKSIQD

SEQ ID NO: 329950 - protein, 9 aa, Homo Sapiens
ITNEGQILE

SEQ ID NO: 329951 - protein, 9 aa, Homo Sapiens
RVQELEECL

SEQ ID NO: 329952 - protein, 9 aa, Homo Sapiens
YREEIVQYL

SEQ ID NO: 329953 - protein, 9 aa, Homo Sapiens
SKYSFIPDP

SEQ ID NO: 329954 - protein, 9 aa, Homo Sapiens
SIQMMEPDN

SEQ ID NO: 329955 - protein, 9 aa, Homo Sapiens
QISTFLDML

SEQ ID NO: 329956 - protein, 9 aa, Homo Sapiens
RMCSMVGNG

SEQ ID NO: 329957 - protein, 9 aa, Homo Sapiens
DNKVMLSFG

SEQ ID NO: 329958 - protein, 9 aa, Homo Sapiens
KAEAWGIIL

SEQ ID NO: 329959 - protein, 9 aa, Homo Sapiens
QNSKLQPEM

SEQ ID NO: 329960 - protein, 9 aa, Homo Sapiens
VSAITLWQF

SEQ ID NO: 329961 - protein, 9 aa, Homo Sapiens
QVFVLEYLR

SEQ ID NO: 329962 - protein, 9 aa, Homo Sapiens
SYSLDEPSH

SEQ ID NO: 329963 - protein, 9 aa, Homo Sapiens
LVDWHQIQA

SEQ ID NO: 329964 - protein, 9 aa, Homo Sapiens
THMDPYCRL

SEQ ID NO: 329965 - protein, 9 aa, Homo Sapiens
RTMEVPVRA

SEQ ID NO: 329966 - protein, 9 aa, Homo Sapiens
DGNGQDAYA

SEQ ID NO: 329967 - protein, 9 aa, Homo Sapiens
KLLDPIWEK

SEQ ID NO: 329968 - protein, 9 aa, Homo Sapiens
YDEHTLWKR

SEQ ID NO: 329969 - protein, 9 aa, Homo Sapiens
MDRTEHLAR

SEQ ID NO: 329970 - protein, 9 aa, Homo Sapiens
EPTLLALQH

SEQ ID NO: 329971 - protein, 9 aa, Homo Sapiens
IKKLHKLFS

SEQ ID NO: 329972 - protein, 9 aa, Homo Sapiens
KIGLSLPPR

SEQ ID NO: 329973 - protein, 9 aa, Homo Sapiens
KHVDWLYNR

SEQ ID NO: 329974 - protein, 9 aa, Homo Sapiens
MRVRGAQVT

SEQ ID NO: 329975 - protein, 9 aa, Homo Sapiens
FEKLCRTRG

SEQ ID NO: 329976 - protein, 9 aa, Homo Sapiens
PIKVTSWWT

SEQ ID NO: 329977 - protein, 9 aa, Homo Sapiens
KDKCSCCYG

SEQ ID NO: 329978 - protein, 9 aa, Homo Sapiens
ICLAREKHS

SEQ ID NO: 329979 - protein, 9 aa, Homo Sapiens
YKCNECCKV

SEQ ID NO: 329980 - protein, 9 aa, Homo Sapiens
KWVPVMEPK

SEQ ID NO: 329981 - protein, 9 aa, Homo Sapiens
LHHHWILPF

SEQ ID NO: 329982 - protein, 9 aa, Homo Sapiens
VATGKTTKI

SEQ ID NO: 329983 - protein, 9 aa, Homo Sapiens
AIDFSFCLT

SEQ ID NO: 329984 - protein, 9 aa, Homo Sapiens
GGSSDAKEV

SEQ ID NO: 329985 - protein, 9 aa, Homo Sapiens
ARQEFEEWM

SEQ ID NO: 329986 - protein, 9 aa, Homo Sapiens
SDIHISQFC

SEQ ID NO: 329987 - protein, 9 aa, Homo Sapiens
RTMLRRCAR

SEQ ID NO: 329988 - protein, 9 aa, Homo Sapiens
HQGRDCRCG

SEQ ID NO: 329989 - protein, 9 aa, Homo Sapiens
YPPTTAKDS

SEQ ID NO: 329990 - protein, 9 aa, Homo Sapiens
DVSLHSQRL

SEQ ID NO: 329991 - protein, 9 aa, Homo Sapiens
SKVEQVQLV

SEQ ID NO: 329992 - protein, 9 aa, Homo Sapiens
HWIFISFFF

SEQ ID NO: 329993 - protein, 9 aa, Homo Sapiens
SRSSRQTGA

SEQ ID NO: 329994 - protein, 9 aa, Homo Sapiens
SRAFACHEE

SEQ ID NO: 329995 - protein, 9 aa, Homo Sapiens
VGPLLTKGK

SEQ ID NO: 329996 - protein, 9 aa, Homo Sapiens
VLGIAFCLN

SEQ ID NO: 329997 - protein, 9 aa, Homo Sapiens
SYSMYVYKV

SEQ ID NO: 329998 - protein, 9 aa, Homo Sapiens
GLKSKQADS

SEQ ID NO: 329999 - protein, 9 aa, Homo Sapiens
ERPGPAGHL

SEQ ID NO: 330000 - protein, 9 aa, Homo Sapiens
GKVRRITNE

SEQ ID NO: 330001 - protein, 9 aa, Homo Sapiens
ILHLQEAVW

SEQ ID NO: 330002 - protein, 9 aa, Homo Sapiens
AELLKHQEE

SEQ ID NO: 330003 - protein, 9 aa, Homo Sapiens
KFTKDPGRL

SEQ ID NO: 330004 - protein, 9 aa, Homo Sapiens
QLHLRIGIH

SEQ ID NO: 330005 - protein, 9 aa, Homo Sapiens
LSPMEGTNQ

SEQ ID NO: 330006 - protein, 9 aa, Homo Sapiens
WDVGMCKES

SEQ ID NO: 330007 - protein, 9 aa, Homo Sapiens
YLFTGKLYP

SEQ ID NO: 330008 - protein, 9 aa, Homo Sapiens
NSYEMEEDG

SEQ ID NO: 330009 - protein, 9 aa, Homo Sapiens
SKDSKAKKN

SEQ ID NO: 330010 - protein, 9 aa, Homo Sapiens
LRFDPMAFV

SEQ ID NO: 330011 - protein, 9 aa, Homo Sapiens
YKCDGCGKD

SEQ ID NO: 330012 - protein, 9 aa, Homo Sapiens
GSESDQPNI

SEQ ID NO: 330013 - protein, 9 aa, Homo Sapiens
PGTPSRHET

SEQ ID NO: 330014 - protein, 9 aa, Homo Sapiens
AWEFMIKTR

SEQ ID NO: 330015 - protein, 9 aa, Homo Sapiens
LPELLTEHQ

SEQ ID NO: 330016 - protein, 9 aa, Homo Sapiens
AYIQHRVHS

SEQ ID NO: 330017 - protein, 9 aa, Homo Sapiens
NPDPVAISD

SEQ ID NO: 330018 - protein, 9 aa, Homo Sapiens
AASVWKRKH

SEQ ID NO: 330019 - protein, 9 aa, Homo Sapiens
NDCILKHAT

SEQ ID NO: 330020 - protein, 9 aa, Homo Sapiens
SLRCPECSV

SEQ ID NO: 330021 - protein, 9 aa, Homo Sapiens
QFNQMTVEY

SEQ ID NO: 330022 - protein, 9 aa, Homo Sapiens
SLHLKPKNH

SEQ ID NO: 330023 - protein, 9 aa, Homo Sapiens
PGRGWAPRG

SEQ ID NO: 330024 - protein, 9 aa, Homo Sapiens
ELILELRPA

SEQ ID NO: 330025 - protein, 9 aa, Homo Sapiens
FVSMSKNNY

SEQ ID NO: 330026 - protein, 9 aa, Homo Sapiens
EQRVLLPLL

SEQ ID NO: 330027 - protein, 9 aa, Homo Sapiens
LANNREKQG

SEQ ID NO: 330028 - protein, 9 aa, Homo Sapiens
AEKERRPCW

SEQ ID NO: 330029 - protein, 9 aa, Homo Sapiens
DEPDCCDDE

SEQ ID NO: 330030 - protein, 9 aa, Homo Sapiens
VCLPGVIAA

SEQ ID NO: 330031 - protein, 9 aa, Homo Sapiens
LLCGTYFST

SEQ ID NO: 330032 - protein, 9 aa, Homo Sapiens
RFWQACDMV

SEQ ID NO: 330033 - protein, 9 aa, Homo Sapiens
LGMMLLSDT

SEQ ID NO: 330034 - protein, 9 aa, Homo Sapiens
PPIAAAFVL

SEQ ID NO: 330035 - protein, 9 aa, Homo Sapiens
RSVGVGHVV

SEQ ID NO: 330036 - protein, 9 aa, Homo Sapiens
RCLAMTAIS

SEQ ID NO: 330037 - protein, 9 aa, Homo Sapiens
WLQDSCKQG

SEQ ID NO: 330038 - protein, 9 aa, Homo Sapiens
KYHMASLYV

SEQ ID NO: 330039 - protein, 9 aa, Homo Sapiens
PSIFGVVSN

SEQ ID NO: 330040 - protein, 9 aa, Homo Sapiens
AAQMARVQN

SEQ ID NO: 330041 - protein, 9 aa, Homo Sapiens
PWLVGQGMS

SEQ ID NO: 330042 - protein, 9 aa, Homo Sapiens
GRDSSLQVE

SEQ ID NO: 330043 - protein, 9 aa, Homo Sapiens
TGPTDIRFV

SEQ ID NO: 330044 - protein, 9 aa, Homo Sapiens
MQTLSASLS

SEQ ID NO: 330045 - protein, 9 aa, Homo Sapiens
TEFQTTIPD

SEQ ID NO: 330046 - protein, 9 aa, Homo Sapiens
IDLTVIISD

SEQ ID NO: 330047 - protein, 9 aa, Homo Sapiens
ACLTPAQAL

SEQ ID NO: 330048 - protein, 9 aa, Homo Sapiens
RRGRVVFLW

SEQ ID NO: 330049 - protein, 9 aa, Homo Sapiens
APEPEGKDE

SEQ ID NO: 330050 - protein, 9 aa, Homo Sapiens
IFRRAKETK

SEQ ID NO: 330051 - protein, 9 aa, Homo Sapiens
ELLECIHRL

SEQ ID NO: 330052 - protein, 9 aa, Homo Sapiens
LAMAQVTHP

SEQ ID NO: 330053 - protein, 9 aa, Homo Sapiens
VSATVRQFT

SEQ ID NO: 330054 - protein, 9 aa, Homo Sapiens
GSPWVRRHR

SEQ ID NO: 330055 - protein, 9 aa, Homo Sapiens
LQAERSWVL

SEQ ID NO: 330056 - protein, 9 aa, Homo Sapiens
DTPPAWPSS

SEQ ID NO: 330057 - protein, 9 aa, Homo Sapiens
RKSKLEEVL

SEQ ID NO: 330058 - protein, 9 aa, Homo Sapiens
MGAEEPWQM

SEQ ID NO: 330059 - protein, 9 aa, Homo Sapiens
SRNVEIGTC

SEQ ID NO: 330060 - protein, 9 aa, Homo Sapiens
RSCARGALT

SEQ ID NO: 330061 - protein, 9 aa, Homo Sapiens
GRPRKLTVM

SEQ ID NO: 330062 - protein, 9 aa, Homo Sapiens
LRGSDPVTL

SEQ ID NO: 330063 - protein, 9 aa, Homo Sapiens
AAVQINLSL

SEQ ID NO: 330064 - protein, 9 aa, Homo Sapiens
KDFSYSLHL

SEQ ID NO: 330065 - protein, 9 aa, Homo Sapiens
MKQPAGVSP

SEQ ID NO: 330066 - protein, 9 aa, Homo Sapiens
KHMDRMMVE

SEQ ID NO: 330067 - protein, 9 aa, Homo Sapiens
ELSSIQVDT

SEQ ID NO: 330068 - protein, 9 aa, Homo Sapiens
MDASERGQL

SEQ ID NO: 330069 - protein, 9 aa, Homo Sapiens
GMKDVVWTD

SEQ ID NO: 330070 - protein, 9 aa, Homo Sapiens
IGTSLFQGI

SEQ ID NO: 330071 - protein, 9 aa, Homo Sapiens
GAIMRSLRV

SEQ ID NO: 330072 - protein, 9 aa, Homo Sapiens
NYLSLTTEL

SEQ ID NO: 330073 - protein, 9 aa, Homo Sapiens
EHSLSRMVT

SEQ ID NO: 330074 - protein, 9 aa, Homo Sapiens
MRFGRTVRA

SEQ ID NO: 330075 - protein, 9 aa, Homo Sapiens
RTHTGEKSC

SEQ ID NO: 330076 - protein, 9 aa, Homo Sapiens
TDRATHRVM

SEQ ID NO: 330077 - protein, 9 aa, Homo Sapiens
PHGCILVMG

SEQ ID NO: 330078 - protein, 9 aa, Homo Sapiens
CEWHFARSD

SEQ ID NO: 330079 - protein, 9 aa, Homo Sapiens
PGMALPTVS

SEQ ID NO: 330080 - protein, 9 aa, Homo Sapiens
LGYWLNEDK

SEQ ID NO: 330081 - protein, 9 aa, Homo Sapiens
GHPSPQIAW

SEQ ID NO: 330082 - protein, 9 aa, Homo Sapiens
TERIGRHMK

SEQ ID NO: 330083 - protein, 9 aa, Homo Sapiens
GDVRTWVKS

SEQ ID NO: 330084 - protein, 9 aa, Homo Sapiens
LPAMALGFN

SEQ ID NO: 330085 - protein, 9 aa, Homo Sapiens
PWQVMASLT

SEQ ID NO: 330086 - protein, 9 aa, Homo Sapiens
QEILAVAWD

SEQ ID NO: 330087 - protein, 9 aa, Homo Sapiens
SLLRVPVLR

SEQ ID NO: 330088 - protein, 9 aa, Homo Sapiens
GAGSTQPEP

SEQ ID NO: 330089 - protein, 9 aa, Homo Sapiens
PDQEDAFAV

SEQ ID NO: 330090 - protein, 9 aa, Homo Sapiens
SRGAGSTQP

SEQ ID NO: 330091 - protein, 9 aa, Homo Sapiens
PPLKPSISP

SEQ ID NO: 330092 - protein, 9 aa, Homo Sapiens
AHKEASLQK

SEQ ID NO: 330093 - protein, 9 aa, Homo Sapiens
GASRSALHV

SEQ ID NO: 330094 - protein, 9 aa, Homo Sapiens
AWHAGQTIN

SEQ ID NO: 330095 - protein, 9 aa, Homo Sapiens
TQIPIERLA

SEQ ID NO: 330096 - protein, 9 aa, Homo Sapiens
TTNAGLKML

SEQ ID NO: 330097 - protein, 9 aa, Homo Sapiens
EMINENAKR

SEQ ID NO: 330098 - protein, 9 aa, Homo Sapiens
EGLLKVAQT

SEQ ID NO: 330099 - protein, 9 aa, Homo Sapiens
PSDWPPRAG

SEQ ID NO: 330100 - protein, 9 aa, Homo Sapiens
TSSTISHHG

SEQ ID NO: 330101 - protein, 9 aa, Homo Sapiens
SDVVTDLAS

SEQ ID NO: 330102 - protein, 9 aa, Homo Sapiens
KIKLAVQMD

SEQ ID NO: 330103 - protein, 9 aa, Homo Sapiens
SLCVAELVK

SEQ ID NO: 330104 - protein, 9 aa, Homo Sapiens
LWARKLEEL

SEQ ID NO: 330105 - protein, 9 aa, Homo Sapiens
GMCKESVNR

SEQ ID NO: 330106 - protein, 9 aa, Homo Sapiens
VLHHHWILP

SEQ ID NO: 330107 - protein, 9 aa, Homo Sapiens
QLADGNLRF

SEQ ID NO: 330108 - protein, 9 aa, Homo Sapiens
QEQERILYQ

SEQ ID NO: 330109 - protein, 9 aa, Homo Sapiens
MGNQQEPSP

SEQ ID NO: 330110 - protein, 9 aa, Homo Sapiens
SQRRPHRPP

SEQ ID NO: 330111 - protein, 9 aa, Homo Sapiens
FLRLAVHED

SEQ ID NO: 330112 - protein, 9 aa, Homo Sapiens
RTQLLSRDI

SEQ ID NO: 330113 - protein, 9 aa, Homo Sapiens
VCKPLEAVL

SEQ ID NO: 330114 - protein, 9 aa, Homo Sapiens
LGPARTGLL

SEQ ID NO: 330115 - protein, 9 aa, Homo Sapiens
FVNTYGLKK

SEQ ID NO: 330116 - protein, 9 aa, Homo Sapiens
EMDIVVDHY

SEQ ID NO: 330117 - protein, 9 aa, Homo Sapiens
SSNLRWLLE

SEQ ID NO: 330118 - protein, 9 aa, Homo Sapiens
MLPSSARPW

SEQ ID NO: 330119 - protein, 9 aa, Homo Sapiens
LLRWVLEGM

SEQ ID NO: 330120 - protein, 9 aa, Homo Sapiens
CRSCPALSP

SEQ ID NO: 330121 - protein, 9 aa, Homo Sapiens
STAVMTYMK

SEQ ID NO: 330122 - protein, 9 aa, Homo Sapiens
GVHTCEGCK

SEQ ID NO: 330123 - protein, 9 aa, Homo Sapiens
GKGRGVIAI

SEQ ID NO: 330124 - protein, 9 aa, Homo Sapiens
PEQKIKDIS

SEQ ID NO: 330125 - protein, 9 aa, Homo Sapiens
RPGPSRAHC

SEQ ID NO: 330126 - protein, 9 aa, Homo Sapiens
KCNECCKVF

SEQ ID NO: 330127 - protein, 9 aa, Homo Sapiens
QLLPGVKTH

SEQ ID NO: 330128 - protein, 9 aa, Homo Sapiens
NSPEEHSLS

SEQ ID NO: 330129 - protein, 9 aa, Homo Sapiens
ASGLAYLHM

SEQ ID NO: 330130 - protein, 9 aa, Homo Sapiens
SLDLYKGRV

SEQ ID NO: 330131 - protein, 9 aa, Homo Sapiens
VFAVSWMSL

SEQ ID NO: 330132 - protein, 9 aa, Homo Sapiens
IFNSPGYPE

SEQ ID NO: 330133 - protein, 9 aa, Homo Sapiens
IHTLQTSQD

SEQ ID NO: 330134 - protein, 9 aa, Homo Sapiens
NYNGQHPNG

SEQ ID NO: 330135 - protein, 9 aa, Homo Sapiens
RHCSPTNPT

SEQ ID NO: 330136 - protein, 9 aa, Homo Sapiens
NRCTIEVNR

SEQ ID NO: 330137 - protein, 9 aa, Homo Sapiens
TGAKSEHRN

SEQ ID NO: 330138 - protein, 9 aa, Homo Sapiens
TMAIQGISE

SEQ ID NO: 330139 - protein, 9 aa, Homo Sapiens
SVLVLIAAI

SEQ ID NO: 330140 - protein, 9 aa, Homo Sapiens
GDKFSPHYE

SEQ ID NO: 330141 - protein, 9 aa, Homo Sapiens
NASTCYLFR

SEQ ID NO: 330142 - protein, 9 aa, Homo Sapiens
RPCPLIKYC

SEQ ID NO: 330143 - protein, 9 aa, Homo Sapiens
KGDKALDCY

SEQ ID NO: 330144 - protein, 9 aa, Homo Sapiens
NCAVREKLT

SEQ ID NO: 330145 - protein, 9 aa, Homo Sapiens
AGIASSIME

SEQ ID NO: 330146 - protein, 9 aa, Homo Sapiens
QDYGKNGQV

SEQ ID NO: 330147 - protein, 9 aa, Homo Sapiens
AGLKENTLI

SEQ ID NO: 330148 - protein, 9 aa, Homo Sapiens
QAACYAASV

SEQ ID NO: 330149 - protein, 9 aa, Homo Sapiens
KEMKNKVDT

SEQ ID NO: 330150 - protein, 9 aa, Homo Sapiens
IDIDVGFNK

SEQ ID NO: 330151 - protein, 9 aa, Homo Sapiens
KPRSLQPPS

SEQ ID NO: 330152 - protein, 9 aa, Homo Sapiens
NTTFCFDLF

SEQ ID NO: 330153 - protein, 9 aa, Homo Sapiens
NLKSCSEVG

SEQ ID NO: 330154 - protein, 9 aa, Homo Sapiens
PDPGVSLVC

SEQ ID NO: 330155 - protein, 9 aa, Homo Sapiens
NVRFEHQFK

SEQ ID NO: 330156 - protein, 9 aa, Homo Sapiens
KNATEDVST

SEQ ID NO: 330157 - protein, 9 aa, Homo Sapiens
CTYLQIHEI

SEQ ID NO: 330158 - protein, 9 aa, Homo Sapiens
LKEIYPDKR

SEQ ID NO: 330159 - protein, 9 aa, Homo Sapiens
ERAQYTLRV

SEQ ID NO: 330160 - protein, 9 aa, Homo Sapiens
RYKIDSLIG

SEQ ID NO: 330161 - protein, 9 aa, Homo Sapiens
KFPFQNNNK

SEQ ID NO: 330162 - protein, 9 aa, Homo Sapiens
SHHYHRKEN

SEQ ID NO: 330163 - protein, 9 aa, Homo Sapiens
SDQGVAGYD

SEQ ID NO: 330164 - protein, 9 aa, Homo Sapiens
IKIKEENIF

SEQ ID NO: 330165 - protein, 9 aa, Homo Sapiens
LYKLLGRKS

SEQ ID NO: 330166 - protein, 9 aa, Homo Sapiens
LPVTAASSV

SEQ ID NO: 330167 - protein, 9 aa, Homo Sapiens
ICYSTPLMY

SEQ ID NO: 330168 - protein, 9 aa, Homo Sapiens
SPSSAEDTG

SEQ ID NO: 330169 - protein, 9 aa, Homo Sapiens
DDTYDKDKK

SEQ ID NO: 330170 - protein, 9 aa, Homo Sapiens
DIYKLVMET

SEQ ID NO: 330171 - protein, 9 aa, Homo Sapiens
NISYSDKEL

SEQ ID NO: 330172 - protein, 9 aa, Homo Sapiens
KILFENPDQ

SEQ ID NO: 330173 - protein, 9 aa, Homo Sapiens
PHNKYRFLS

SEQ ID NO: 330174 - protein, 9 aa, Homo Sapiens
IFDISIAQR

SEQ ID NO: 330175 - protein, 9 aa, Homo Sapiens
SEFREQQPP

SEQ ID NO: 330176 - protein, 9 aa, Homo Sapiens
NTLKGQGEK

SEQ ID NO: 330177 - protein, 9 aa, Homo Sapiens
KAGLPQSIN

SEQ ID NO: 330178 - protein, 9 aa, Homo Sapiens
RFFSAVGLV

SEQ ID NO: 330179 - protein, 9 aa, Homo Sapiens
PAWIPELNL

SEQ ID NO: 330180 - protein, 9 aa, Homo Sapiens
KERTFKRFT

SEQ ID NO: 330181 - protein, 9 aa, Homo Sapiens
VISSLEYGT

SEQ ID NO: 330182 - protein, 9 aa, Homo Sapiens
SNLSSLQPP

SEQ ID NO: 330183 - protein, 9 aa, Homo Sapiens
IIVMCNLCI

SEQ ID NO: 330184 - protein, 9 aa, Homo Sapiens
LVFVGIYST

SEQ ID NO: 330185 - protein, 9 aa, Homo Sapiens
RCSSSLCDH

SEQ ID NO: 330186 - protein, 9 aa, Homo Sapiens
DLGFKMLAV

SEQ ID NO: 330187 - protein, 9 aa, Homo Sapiens
THLNAQFLW

SEQ ID NO: 330188 - protein, 9 aa, Homo Sapiens
NSYYSWYHN

SEQ ID NO: 330189 - protein, 9 aa, Homo Sapiens
QHQERAEQL

SEQ ID NO: 330190 - protein, 9 aa, Homo Sapiens
QISMKLPQL

SEQ ID NO: 330191 - protein, 9 aa, Homo Sapiens
CNRNFVYCN

SEQ ID NO: 330192 - protein, 9 aa, Homo Sapiens
DTTADYTTK

SEQ ID NO: 330193 - protein, 9 aa, Homo Sapiens
EDFEGKQGR

SEQ ID NO: 330194 - protein, 9 aa, Homo Sapiens
FSQSSQGEE

SEQ ID NO: 330195 - protein, 9 aa, Homo Sapiens
KILPWYPQV

SEQ ID NO: 330196 - protein, 9 aa, Homo Sapiens
ASWPAPFKM

SEQ ID NO: 330197 - protein, 9 aa, Homo Sapiens
NHLFCESQR

SEQ ID NO: 330198 - protein, 9 aa, Homo Sapiens
KKGGLDGVD

SEQ ID NO: 330199 - protein, 9 aa, Homo Sapiens
HFTTDSWEH

SEQ ID NO: 330200 - protein, 9 aa, Homo Sapiens
TWDLDFGGN

SEQ ID NO: 330201 - protein, 9 aa, Homo Sapiens
YYWDASACV

SEQ ID NO: 330202 - protein, 9 aa, Homo Sapiens
GVKCEACPD

SEQ ID NO: 330203 - protein, 9 aa, Homo Sapiens
AGTESELSL

SEQ ID NO: 330204 - protein, 9 aa, Homo Sapiens
ISMKLPQLI

SEQ ID NO: 330205 - protein, 9 aa, Homo Sapiens
QITHEIEKN

SEQ ID NO: 330206 - protein, 9 aa, Homo Sapiens
EKDRWLKKK

SEQ ID NO: 330207 - protein, 9 aa, Homo Sapiens
QLEEVKQAS

SEQ ID NO: 330208 - protein, 9 aa, Homo Sapiens
EERCLRKAL

SEQ ID NO: 330209 - protein, 9 aa, Homo Sapiens
EIITGVNSS

SEQ ID NO: 330210 - protein, 9 aa, Homo Sapiens
TAPLPWHIQ

SEQ ID NO: 330211 - protein, 9 aa, Homo Sapiens
RKQTPKHQN

SEQ ID NO: 330212 - protein, 9 aa, Homo Sapiens
FGNQCGKPK

SEQ ID NO: 330213 - protein, 9 aa, Homo Sapiens
DTQVLSWRT

SEQ ID NO: 330214 - protein, 9 aa, Homo Sapiens
HQGSLVLYR

SEQ ID NO: 330215 - protein, 9 aa, Homo Sapiens
GGDQVSCIF

SEQ ID NO: 330216 - protein, 9 aa, Homo Sapiens
MKNKVDTIV

SEQ ID NO: 330217 - protein, 9 aa, Homo Sapiens
TSPPRRSLG

SEQ ID NO: 330218 - protein, 9 aa, Homo Sapiens
VRHAKKIKY

SEQ ID NO: 330219 - protein, 9 aa, Homo Sapiens
ETVDVVQER

SEQ ID NO: 330220 - protein, 9 aa, Homo Sapiens
EDVNSESEG

SEQ ID NO: 330221 - protein, 9 aa, Homo Sapiens
DDQAKGPLR

SEQ ID NO: 330222 - protein, 9 aa, Homo Sapiens
WNFVFEDFV

SEQ ID NO: 330223 - protein, 9 aa, Homo Sapiens
NKGLELDII

SEQ ID NO: 330224 - protein, 9 aa, Homo Sapiens
SYYSWYHNY

SEQ ID NO: 330225 - protein, 9 aa, Homo Sapiens
VVQTACMSA

SEQ ID NO: 330226 - protein, 9 aa, Homo Sapiens
PVVNPYDMP

SEQ ID NO: 330227 - protein, 9 aa, Homo Sapiens
MTFGKVKSG

SEQ ID NO: 330228 - protein, 9 aa, Homo Sapiens
NSFWLGHLL

SEQ ID NO: 330229 - protein, 9 aa, Homo Sapiens
PNTAWGGEG

SEQ ID NO: 330230 - protein, 9 aa, Homo Sapiens
KKGDTRLPL

SEQ ID NO: 330231 - protein, 9 aa, Homo Sapiens
KTMIYFVGC

SEQ ID NO: 330232 - protein, 9 aa, Homo Sapiens
EEEDVNSES

SEQ ID NO: 330233 - protein, 9 aa, Homo Sapiens
ERFLLLFWC

SEQ ID NO: 330234 - protein, 9 aa, Homo Sapiens
AKVGKLKDD

SEQ ID NO: 330235 - protein, 9 aa, Homo Sapiens
TEKKDNAAA

SEQ ID NO: 330236 - protein, 9 aa, Homo Sapiens
GVASYIESI

SEQ ID NO: 330237 - protein, 9 aa, Homo Sapiens
GSGGGEPPT

SEQ ID NO: 330238 - protein, 9 aa, Homo Sapiens
RGRRDGEAD

SEQ ID NO: 330239 - protein, 9 aa, Homo Sapiens
SGKQVDGKG

SEQ ID NO: 330240 - protein, 9 aa, Homo Sapiens
ICQLCGFRQ

SEQ ID NO: 330241 - protein, 9 aa, Homo Sapiens
AYERYICVV

SEQ ID NO: 330242 - protein, 9 aa, Homo Sapiens
VVCVRPENT

SEQ ID NO: 330243 - protein, 9 aa, Homo Sapiens
QTDCTHTGL

SEQ ID NO: 330244 - protein, 9 aa, Homo Sapiens
RKVNDGKWC

SEQ ID NO: 330245 - protein, 9 aa, Homo Sapiens
QQEMLSRLS

SEQ ID NO: 330246 - protein, 9 aa, Homo Sapiens
EDSDLIFKR

SEQ ID NO: 330247 - protein, 9 aa, Homo Sapiens
EILQRLEKI

SEQ ID NO: 330248 - protein, 9 aa, Homo Sapiens
WEKNEHGFQ

SEQ ID NO: 330249 - protein, 9 aa, Homo Sapiens
YVSEYRFVS

SEQ ID NO: 330250 - protein, 9 aa, Homo Sapiens
IKGVGWLTE

SEQ ID NO: 330251 - protein, 9 aa, Homo Sapiens
HSRRQPHVV

SEQ ID NO: 330252 - protein, 9 aa, Homo Sapiens
IWELSSIKH

SEQ ID NO: 330253 - protein, 9 aa, Homo Sapiens
TLARKMAIG

SEQ ID NO: 330254 - protein, 9 aa, Homo Sapiens
KKQRFYQLL

SEQ ID NO: 330255 - protein, 9 aa, Homo Sapiens
DLTQVMTLQ

SEQ ID NO: 330256 - protein, 9 aa, Homo Sapiens
ETKELWDTF

SEQ ID NO: 330257 - protein, 9 aa, Homo Sapiens
TECLRHPWL

SEQ ID NO: 330258 - protein, 9 aa, Homo Sapiens
TELYVQNEN

SEQ ID NO: 330259 - protein, 9 aa, Homo Sapiens
RVDNIKVLT

SEQ ID NO: 330260 - protein, 9 aa, Homo Sapiens
SLLNHTTRW

SEQ ID NO: 330261 - protein, 9 aa, Homo Sapiens
RLQSYSAGE

SEQ ID NO: 330262 - protein, 9 aa, Homo Sapiens
EFWLVDLLP

SEQ ID NO: 330263 - protein, 9 aa, Homo Sapiens
IIDGNESEF

SEQ ID NO: 330264 - protein, 9 aa, Homo Sapiens
RQQDTRSPT

SEQ ID NO: 330265 - protein, 9 aa, Homo Sapiens
APDPFQPLC

SEQ ID NO: 330266 - protein, 9 aa, Homo Sapiens
KKHLFGLQI

SEQ ID NO: 330267 - protein, 9 aa, Homo Sapiens
IFRVVGNLV

SEQ ID NO: 330268 - protein, 9 aa, Homo Sapiens
FRSLQTSPK

SEQ ID NO: 330269 - protein, 9 aa, Homo Sapiens
GTQIQPLPA

SEQ ID NO: 330270 - protein, 9 aa, Homo Sapiens
DSNHSIATL

SEQ ID NO: 330271 - protein, 9 aa, Homo Sapiens
IFNRSLMAC

SEQ ID NO: 330272 - protein, 9 aa, Homo Sapiens
IEFLMKDGD

SEQ ID NO: 330273 - protein, 9 aa, Homo Sapiens
PDYSPFSSF

SEQ ID NO: 330274 - protein, 9 aa, Homo Sapiens
WFNLQARKH

SEQ ID NO: 330275 - protein, 9 aa, Homo Sapiens
CIERNEQKM

SEQ ID NO: 330276 - protein, 9 aa, Homo Sapiens
SMSQPRDLG

SEQ ID NO: 330277 - protein, 9 aa, Homo Sapiens
DAFVHHIDN

SEQ ID NO: 330278 - protein, 9 aa, Homo Sapiens
NKLSTIHGK

SEQ ID NO: 330279 - protein, 9 aa, Homo Sapiens
MTGWNPVWL

SEQ ID NO: 330280 - protein, 9 aa, Homo Sapiens
GAMAATYST

SEQ ID NO: 330281 - protein, 9 aa, Homo Sapiens
EEADTGSLY

SEQ ID NO: 330282 - protein, 9 aa, Homo Sapiens
YTCRLLDIT

SEQ ID NO: 330283 - protein, 9 aa, Homo Sapiens
LCVCTCAHV

SEQ ID NO: 330284 - protein, 9 aa, Homo Sapiens
DGKMLRCTK

SEQ ID NO: 330285 - protein, 9 aa, Homo Sapiens
VYDYQEDGL

SEQ ID NO: 330286 - protein, 9 aa, Homo Sapiens
YASVTVNTY

SEQ ID NO: 330287 - protein, 9 aa, Homo Sapiens
EHNSNEEDK

SEQ ID NO: 330288 - protein, 9 aa, Homo Sapiens
ITYEGGNAL

SEQ ID NO: 330289 - protein, 9 aa, Homo Sapiens
KTNVKGDEL

SEQ ID NO: 330290 - protein, 9 aa, Homo Sapiens
KEKNENLET

SEQ ID NO: 330291 - protein, 9 aa, Homo Sapiens
VARVIVATW

SEQ ID NO: 330292 - protein, 9 aa, Homo Sapiens
VIEKLSKSG

SEQ ID NO: 330293 - protein, 9 aa, Homo Sapiens
GGTKVYKSL

SEQ ID NO: 330294 - protein, 9 aa, Homo Sapiens
KRPRLLVNT

SEQ ID NO: 330295 - protein, 9 aa, Homo Sapiens
SCLLTKNKI

SEQ ID NO: 330296 - protein, 9 aa, Homo Sapiens
TDTRVQTMN

SEQ ID NO: 330297 - protein, 9 aa, Homo Sapiens
ITHTGEKPF

SEQ ID NO: 330298 - protein, 9 aa, Homo Sapiens
ITHTGEKPC

SEQ ID NO: 330299 - protein, 9 aa, Homo Sapiens
GHKALSIIV

SEQ ID NO: 330300 - protein, 9 aa, Homo Sapiens
RKKQGRKKH

SEQ ID NO: 330301 - protein, 9 aa, Homo Sapiens
AYQQLPAKW

SEQ ID NO: 330302 - protein, 9 aa, Homo Sapiens
KCEECDKVL

SEQ ID NO: 330303 - protein, 9 aa, Homo Sapiens
CHCPPAPPP

SEQ ID NO: 330304 - protein, 9 aa, Homo Sapiens
DKIPWLSET

SEQ ID NO: 330305 - protein, 9 aa, Homo Sapiens
AEIAKLFPG

SEQ ID NO: 330306 - protein, 9 aa, Homo Sapiens
WYQQYVKDR

SEQ ID NO: 330307 - protein, 9 aa, Homo Sapiens
RYVCKFVLM

SEQ ID NO: 330308 - protein, 9 aa, Homo Sapiens
RQACKKHKL

SEQ ID NO: 330309 - protein, 9 aa, Homo Sapiens
LLMYPYGYT

SEQ ID NO: 330310 - protein, 9 aa, Homo Sapiens
GTCRGDKFQ

SEQ ID NO: 330311 - protein, 9 aa, Homo Sapiens
PEHHKINKD

SEQ ID NO: 330312 - protein, 9 aa, Homo Sapiens
LFQQSECRE

SEQ ID NO: 330313 - protein, 9 aa, Homo Sapiens
LMHFSSKEV

SEQ ID NO: 330314 - protein, 9 aa, Homo Sapiens
MGYDHYVAI

SEQ ID NO: 330315 - protein, 9 aa, Homo Sapiens
LAKHPKYQE

SEQ ID NO: 330316 - protein, 9 aa, Homo Sapiens
AKGSPKRHH

SEQ ID NO: 330317 - protein, 9 aa, Homo Sapiens
CENQDLISS

SEQ ID NO: 330318 - protein, 9 aa, Homo Sapiens
KSNPEERYD

SEQ ID NO: 330319 - protein, 9 aa, Homo Sapiens
KQELEQQRR

SEQ ID NO: 330320 - protein, 9 aa, Homo Sapiens
VRATCSGFL

SEQ ID NO: 330321 - protein, 9 aa, Homo Sapiens
ELSIFEFNQ

SEQ ID NO: 330322 - protein, 9 aa, Homo Sapiens
ENTLGCQNN

SEQ ID NO: 330323 - protein, 9 aa, Homo Sapiens
SQRGKSGFN

SEQ ID NO: 330324 - protein, 9 aa, Homo Sapiens
GYLLGQSLA

SEQ ID NO: 330325 - protein, 9 aa, Homo Sapiens
PWKFPSSLA

SEQ ID NO: 330326 - protein, 9 aa, Homo Sapiens
VDKDLDLFS

SEQ ID NO: 330327 - protein, 9 aa, Homo Sapiens
EIINRQLIE

SEQ ID NO: 330328 - protein, 9 aa, Homo Sapiens
WMANEGFDP

SEQ ID NO: 330329 - protein, 9 aa, Homo Sapiens
FARWPSLRL

SEQ ID NO: 330330 - protein, 9 aa, Homo Sapiens
VSPPRCLIA

SEQ ID NO: 330331 - protein, 9 aa, Homo Sapiens
SRGVVVAVT

SEQ ID NO: 330332 - protein, 9 aa, Homo Sapiens
NTFLASHRK

SEQ ID NO: 330333 - protein, 9 aa, Homo Sapiens
LIQQISSGE

SEQ ID NO: 330334 - protein, 9 aa, Homo Sapiens
ENLTPQQNS

SEQ ID NO: 330335 - protein, 9 aa, Homo Sapiens
LSRRKQVVV

SEQ ID NO: 330336 - protein, 9 aa, Homo Sapiens
KQPRLLKAL

SEQ ID NO: 330337 - protein, 9 aa, Homo Sapiens
QELMAQYWK

SEQ ID NO: 330338 - protein, 9 aa, Homo Sapiens
HKYCQVAPL

SEQ ID NO: 330339 - protein, 9 aa, Homo Sapiens
FLTPGLCLT

SEQ ID NO: 330340 - protein, 9 aa, Homo Sapiens
SQSKACDTK

SEQ ID NO: 330341 - protein, 9 aa, Homo Sapiens
LGGAIDIPM

SEQ ID NO: 330342 - protein, 9 aa, Homo Sapiens
EDLKAKLCS

SEQ ID NO: 330343 - protein, 9 aa, Homo Sapiens
YSTPLMYFE

SEQ ID NO: 330344 - protein, 9 aa, Homo Sapiens
TACKNQVCN

SEQ ID NO: 330345 - protein, 9 aa, Homo Sapiens
NLVNDFYCD

SEQ ID NO: 330346 - protein, 9 aa, Homo Sapiens
EGAPYPQTR

SEQ ID NO: 330347 - protein, 9 aa, Homo Sapiens
DERVPCPVT

SEQ ID NO: 330348 - protein, 9 aa, Homo Sapiens
FDHIRLVVT

SEQ ID NO: 330349 - protein, 9 aa, Homo Sapiens
EVPERGHMD

SEQ ID NO: 330350 - protein, 9 aa, Homo Sapiens
DNDKLGHGD

SEQ ID NO: 330351 - protein, 9 aa, Homo Sapiens
ECLMRLTKL

SEQ ID NO: 330352 - protein, 9 aa, Homo Sapiens
NFIKKRLYK

SEQ ID NO: 330353 - protein, 9 aa, Homo Sapiens
SLSSVAICT

SEQ ID NO: 330354 - protein, 9 aa, Homo Sapiens
AAEQLLAAQ

SEQ ID NO: 330355 - protein, 9 aa, Homo Sapiens
WWSATVVYD

SEQ ID NO: 330356 - protein, 9 aa, Homo Sapiens
VVKINSRKT

SEQ ID NO: 330357 - protein, 9 aa, Homo Sapiens
IGDKRRIVV

SEQ ID NO: 330358 - protein, 9 aa, Homo Sapiens
ESCVKWLIM

SEQ ID NO: 330359 - protein, 9 aa, Homo Sapiens
DDTHFVSSL

SEQ ID NO: 330360 - protein, 9 aa, Homo Sapiens
YLKWWSATV

SEQ ID NO: 330361 - protein, 9 aa, Homo Sapiens
GEIIWSHLE

SEQ ID NO: 330362 - protein, 9 aa, Homo Sapiens
FIPDNEEGL

SEQ ID NO: 330363 - protein, 9 aa, Homo Sapiens
PPPLPEKKS

SEQ ID NO: 330364 - protein, 9 aa, Homo Sapiens
YAYANSHSL

SEQ ID NO: 330365 - protein, 9 aa, Homo Sapiens
DATKDAKEI

SEQ ID NO: 330366 - protein, 9 aa, Homo Sapiens
TGCVKCQTL

SEQ ID NO: 330367 - protein, 9 aa, Homo Sapiens
ELSSIKHSL

SEQ ID NO: 330368 - protein, 9 aa, Homo Sapiens
GKIKFFKCL

SEQ ID NO: 330369 - protein, 9 aa, Homo Sapiens
NHLLTYLPR

SEQ ID NO: 330370 - protein, 9 aa, Homo Sapiens
VVLRLKAEG

SEQ ID NO: 330371 - protein, 9 aa, Homo Sapiens
NLDVDIQLS

SEQ ID NO: 330372 - protein, 9 aa, Homo Sapiens
KKKTRKDLN

SEQ ID NO: 330373 - protein, 9 aa, Homo Sapiens
LRDSHSEHE

SEQ ID NO: 330374 - protein, 9 aa, Homo Sapiens
KHRLDRINE

SEQ ID NO: 330375 - protein, 9 aa, Homo Sapiens
EINQTEEER

SEQ ID NO: 330376 - protein, 9 aa, Homo Sapiens
ESPLSLKRP

SEQ ID NO: 330377 - protein, 9 aa, Homo Sapiens
YVCCGTVGS

SEQ ID NO: 330378 - protein, 9 aa, Homo Sapiens
HPDTCPEVG

SEQ ID NO: 330379 - protein, 9 aa, Homo Sapiens
IPSCILMAV

SEQ ID NO: 330380 - protein, 9 aa, Homo Sapiens
SAFQQIGER

SEQ ID NO: 330381 - protein, 9 aa, Homo Sapiens
KDRWLKKKH

SEQ ID NO: 330382 - protein, 9 aa, Homo Sapiens
NKTCSVRDK

SEQ ID NO: 330383 - protein, 9 aa, Homo Sapiens
CPALQNKVQ

SEQ ID NO: 330384 - protein, 9 aa, Homo Sapiens
AISESELSA

SEQ ID NO: 330385 - protein, 9 aa, Homo Sapiens
EHEKHKKSF

SEQ ID NO: 330386 - protein, 9 aa, Homo Sapiens
KINLPPGIR

SEQ ID NO: 330387 - protein, 9 aa, Homo Sapiens
RGYLLGQSL

SEQ ID NO: 330388 - protein, 9 aa, Homo Sapiens
LVSPRNSQS

SEQ ID NO: 330389 - protein, 9 aa, Homo Sapiens
KTKDLKHNK

SEQ ID NO: 330390 - protein, 9 aa, Homo Sapiens
RYFSDKQKI

SEQ ID NO: 330391 - protein, 9 aa, Homo Sapiens
KKHVISKEA

SEQ ID NO: 330392 - protein, 9 aa, Homo Sapiens
LFLACPATA

SEQ ID NO: 330393 - protein, 9 aa, Homo Sapiens
QIETKTKDK

SEQ ID NO: 330394 - protein, 9 aa, Homo Sapiens
RSAGTSSQP

SEQ ID NO: 330395 - protein, 9 aa, Homo Sapiens
ILDGLHEDL

SEQ ID NO: 330396 - protein, 9 aa, Homo Sapiens
DHDDSAMNT

SEQ ID NO: 330397 - protein, 9 aa, Homo Sapiens
GSAKVPVGV

SEQ ID NO: 330398 - protein, 9 aa, Homo Sapiens
NPLPAGPNN

SEQ ID NO: 330399 - protein, 9 aa, Homo Sapiens
GSHLMSLLE

SEQ ID NO: 330400 - protein, 9 aa, Homo Sapiens
LTQHQIFHT

SEQ ID NO: 330401 - protein, 9 aa, Homo Sapiens
QSPDESHRM

SEQ ID NO: 330402 - protein, 9 aa, Homo Sapiens
TQVLSWRTN

SEQ ID NO: 330403 - protein, 9 aa, Homo Sapiens
KKFCSNFCE

SEQ ID NO: 330404 - protein, 9 aa, Homo Sapiens
TPVNTNQHK

SEQ ID NO: 330405 - protein, 9 aa, Homo Sapiens
AVQNIQNVL

SEQ ID NO: 330406 - protein, 9 aa, Homo Sapiens
KYPEMVSCI

SEQ ID NO: 330407 - protein, 9 aa, Homo Sapiens
DNMMTCYLF

SEQ ID NO: 330408 - protein, 9 aa, Homo Sapiens
SYKAWFIRQ

SEQ ID NO: 330409 - protein, 9 aa, Homo Sapiens
VINTDMFQT

SEQ ID NO: 330410 - protein, 9 aa, Homo Sapiens
TFFSQTPII

SEQ ID NO: 330411 - protein, 9 aa, Homo Sapiens
HNYGHLELI

SEQ ID NO: 330412 - protein, 9 aa, Homo Sapiens
AYRQIDDDK

SEQ ID NO: 330413 - protein, 9 aa, Homo Sapiens
REKSQVQTL

SEQ ID NO: 330414 - protein, 9 aa, Homo Sapiens
VIVWMRTAA

SEQ ID NO: 330415 - protein, 9 aa, Homo Sapiens
HPACANEIA

SEQ ID NO: 330416 - protein, 9 aa, Homo Sapiens
YLIQDMKAY

SEQ ID NO: 330417 - protein, 9 aa, Homo Sapiens
LPTASLTPT

SEQ ID NO: 330418 - protein, 9 aa, Homo Sapiens
VTELYVQNE

SEQ ID NO: 330419 - protein, 9 aa, Homo Sapiens
DGLVLQIDC

SEQ ID NO: 330420 - protein, 9 aa, Homo Sapiens
KAFFSPSLL

SEQ ID NO: 330421 - protein, 9 aa, Homo Sapiens
KFAKHITNA

SEQ ID NO: 330422 - protein, 9 aa, Homo Sapiens
ETEEEPPQQ

SEQ ID NO: 330423 - protein, 9 aa, Homo Sapiens
SSLTLHMRN

SEQ ID NO: 330424 - protein, 9 aa, Homo Sapiens
TVKNRRNFA

SEQ ID NO: 330425 - protein, 9 aa, Homo Sapiens
HTHVISVAK

SEQ ID NO: 330426 - protein, 9 aa, Homo Sapiens
PFMGGNDNE

SEQ ID NO: 330427 - protein, 9 aa, Homo Sapiens
TMKALQKKS

SEQ ID NO: 330428 - protein, 9 aa, Homo Sapiens
NQPKAMTSI

SEQ ID NO: 330429 - protein, 9 aa, Homo Sapiens
IIHMISHTG

SEQ ID NO: 330430 - protein, 9 aa, Homo Sapiens
VVLWLLGCH

SEQ ID NO: 330431 - protein, 9 aa, Homo Sapiens
AASEQPLAI

SEQ ID NO: 330432 - protein, 9 aa, Homo Sapiens
NTKETLKIV

SEQ ID NO: 330433 - protein, 9 aa, Homo Sapiens
TAKVNCLSF

SEQ ID NO: 330434 - protein, 9 aa, Homo Sapiens
HNNERQGLV

SEQ ID NO: 330435 - protein, 9 aa, Homo Sapiens
FSLFVTIGD

SEQ ID NO: 330436 - protein, 9 aa, Homo Sapiens
DRARRSPQK

SEQ ID NO: 330437 - protein, 9 aa, Homo Sapiens
ELLVCTVCI

SEQ ID NO: 330438 - protein, 9 aa, Homo Sapiens
HHPQPYRWS

SEQ ID NO: 330439 - protein, 9 aa, Homo Sapiens
GTCSGFEPP

SEQ ID NO: 330440 - protein, 9 aa, Homo Sapiens
RKEACLLYK

SEQ ID NO: 330441 - protein, 9 aa, Homo Sapiens
FHEQSNKCV

SEQ ID NO: 330442 - protein, 9 aa, Homo Sapiens
LALDMDRIK

SEQ ID NO: 330443 - protein, 9 aa, Homo Sapiens
LAIALPVPV

SEQ ID NO: 330444 - protein, 9 aa, Homo Sapiens
YGVLYKTLM

SEQ ID NO: 330445 - protein, 9 aa, Homo Sapiens
FGGGDNDKL

SEQ ID NO: 330446 - protein, 9 aa, Homo Sapiens
TMEVLQQSS

SEQ ID NO: 330447 - protein, 9 aa, Homo Sapiens
ISQISMKLP

SEQ ID NO: 330448 - protein, 9 aa, Homo Sapiens
TSGVDCNHK

SEQ ID NO: 330449 - protein, 9 aa, Homo Sapiens
AEECRVHKL

SEQ ID NO: 330450 - protein, 9 aa, Homo Sapiens
HNINVYIHD

SEQ ID NO: 330451 - protein, 9 aa, Homo Sapiens
NNELSHLLE

SEQ ID NO: 330452 - protein, 9 aa, Homo Sapiens
KIQQPLKNP

SEQ ID NO: 330453 - protein, 9 aa, Homo Sapiens
VKFTTQKSV

SEQ ID NO: 330454 - protein, 9 aa, Homo Sapiens
CFEKRNKIE

SEQ ID NO: 330455 - protein, 9 aa, Homo Sapiens
VTHLEVLQA

SEQ ID NO: 330456 - protein, 9 aa, Homo Sapiens
FEYHNIWVY

SEQ ID NO: 330457 - protein, 9 aa, Homo Sapiens
CQPEIRMWQ

SEQ ID NO: 330458 - protein, 9 aa, Homo Sapiens
DTYDKDKKS

SEQ ID NO: 330459 - protein, 9 aa, Homo Sapiens
CLKKCSETW

SEQ ID NO: 330460 - protein, 9 aa, Homo Sapiens
LHLKQFGNI

SEQ ID NO: 330461 - protein, 9 aa, Homo Sapiens
LLCMYQNAT

SEQ ID NO: 330462 - protein, 9 aa, Homo Sapiens
PRRSPPVAF

SEQ ID NO: 330463 - protein, 9 aa, Homo Sapiens
ICDGALIAK

SEQ ID NO: 330464 - protein, 9 aa, Homo Sapiens
FIYMCPVRA

SEQ ID NO: 330465 - protein, 9 aa, Homo Sapiens
GRKEIMFPD

SEQ ID NO: 330466 - protein, 9 aa, Homo Sapiens
NLTSSIMQK

SEQ ID NO: 330467 - protein, 9 aa, Homo Sapiens
AEFASRHKS

SEQ ID NO: 330468 - protein, 9 aa, Homo Sapiens
SAQAEIGTS

SEQ ID NO: 330469 - protein, 9 aa, Homo Sapiens
KVRDKDYGQ

SEQ ID NO: 330470 - protein, 9 aa, Homo Sapiens
QRVAKLRDK

SEQ ID NO: 330471 - protein, 9 aa, Homo Sapiens
PIQMIVLTH

SEQ ID NO: 330472 - protein, 9 aa, Homo Sapiens
LNNPIVKVR

SEQ ID NO: 330473 - protein, 9 aa, Homo Sapiens
QEHFGGAMV

SEQ ID NO: 330474 - protein, 9 aa, Homo Sapiens
SPEIGERVH

SEQ ID NO: 330475 - protein, 9 aa, Homo Sapiens
EHVKEISEL

SEQ ID NO: 330476 - protein, 9 aa, Homo Sapiens
ENNKLTCSH

SEQ ID NO: 330477 - protein, 9 aa, Homo Sapiens
LLNCFLAPE

SEQ ID NO: 330478 - protein, 9 aa, Homo Sapiens
MYQNATGES

SEQ ID NO: 330479 - protein, 9 aa, Homo Sapiens
GRHNAIKCG

SEQ ID NO: 330480 - protein, 9 aa, Homo Sapiens
RTEVAKNNL

SEQ ID NO: 330481 - protein, 9 aa, Homo Sapiens
PLCFLSTLI

SEQ ID NO: 330482 - protein, 9 aa, Homo Sapiens
QVFSLFVHN

SEQ ID NO: 330483 - protein, 9 aa, Homo Sapiens
KKNRNVDQS

SEQ ID NO: 330484 - protein, 9 aa, Homo Sapiens
DLKAYYAFR

SEQ ID NO: 330485 - protein, 9 aa, Homo Sapiens
GLASVEQHI

SEQ ID NO: 330486 - protein, 9 aa, Homo Sapiens
ESTRQQDTR

SEQ ID NO: 330487 - protein, 9 aa, Homo Sapiens
LEEVKQASI

SEQ ID NO: 330488 - protein, 9 aa, Homo Sapiens
YVLLQNAYR

SEQ ID NO: 330489 - protein, 9 aa, Homo Sapiens
VIRQLLLDC

SEQ ID NO: 330490 - protein, 9 aa, Homo Sapiens
EATNYSKPQ

SEQ ID NO: 330491 - protein, 9 aa, Homo Sapiens
NLLVPSLTN

SEQ ID NO: 330492 - protein, 9 aa, Homo Sapiens
KRAAAKESE

SEQ ID NO: 330493 - protein, 9 aa, Homo Sapiens
REKLTDECY

SEQ ID NO: 330494 - protein, 9 aa, Homo Sapiens
DSGTYGCTS

SEQ ID NO: 330495 - protein, 9 aa, Homo Sapiens
EKEAHKSTP

SEQ ID NO: 330496 - protein, 9 aa, Homo Sapiens
ASKAQRRRL

SEQ ID NO: 330497 - protein, 9 aa, Homo Sapiens
LSEHSEMKL

SEQ ID NO: 330498 - protein, 9 aa, Homo Sapiens
EAQNRGFFK

SEQ ID NO: 330499 - protein, 9 aa, Homo Sapiens
LYLNPFCPP

SEQ ID NO: 330500 - protein, 9 aa, Homo Sapiens
RSAEKTKTY

SEQ ID NO: 330501 - protein, 9 aa, Homo Sapiens
CGQCGKSFC

SEQ ID NO: 330502 - protein, 9 aa, Homo Sapiens
RITMQEKSR

SEQ ID NO: 330503 - protein, 9 aa, Homo Sapiens
KVTAKTKAG

SEQ ID NO: 330504 - protein, 9 aa, Homo Sapiens
PLPAGPNNT

SEQ ID NO: 330505 - protein, 9 aa, Homo Sapiens
KRAESQIRG

SEQ ID NO: 330506 - protein, 9 aa, Homo Sapiens
QLGPPKHCP

SEQ ID NO: 330507 - protein, 9 aa, Homo Sapiens
MAVLKLACV

SEQ ID NO: 330508 - protein, 9 aa, Homo Sapiens
IPHIFCNVT

SEQ ID NO: 330509 - protein, 9 aa, Homo Sapiens
PLSDEVTES

SEQ ID NO: 330510 - protein, 9 aa, Homo Sapiens
AKRDKLTEL

SEQ ID NO: 330511 - protein, 9 aa, Homo Sapiens
WTSSCTNQN

SEQ ID NO: 330512 - protein, 9 aa, Homo Sapiens
DRNRPSFNG

SEQ ID NO: 330513 - protein, 9 aa, Homo Sapiens
AIYIDAQTE

SEQ ID NO: 330514 - protein, 9 aa, Homo Sapiens
LPSKWSKDY

SEQ ID NO: 330515 - protein, 9 aa, Homo Sapiens
ATEAADYII

SEQ ID NO: 330516 - protein, 9 aa, Homo Sapiens
KIKVLKLIK

SEQ ID NO: 330517 - protein, 9 aa, Homo Sapiens
QKASCRCKS

SEQ ID NO: 330518 - protein, 9 aa, Homo Sapiens
ALHHGRLCF

SEQ ID NO: 330519 - protein, 9 aa, Homo Sapiens
LAALSFTPA

SEQ ID NO: 330520 - protein, 9 aa, Homo Sapiens
VGIVSWGSN

SEQ ID NO: 330521 - protein, 9 aa, Homo Sapiens
NKDTFLGPV

SEQ ID NO: 330522 - protein, 9 aa, Homo Sapiens
SGCMQKVSY

SEQ ID NO: 330523 - protein, 9 aa, Homo Sapiens
QSNLIQHQI

SEQ ID NO: 330524 - protein, 9 aa, Homo Sapiens
LHVHCVFNA

SEQ ID NO: 330525 - protein, 9 aa, Homo Sapiens
CIVAQRRGQ

SEQ ID NO: 330526 - protein, 9 aa, Homo Sapiens
KKTPVERDS

SEQ ID NO: 330527 - protein, 9 aa, Homo Sapiens
KKRIYEAKE

SEQ ID NO: 330528 - protein, 9 aa, Homo Sapiens
SISFQINNT

SEQ ID NO: 330529 - protein, 9 aa, Homo Sapiens
VDLVCCPEC

SEQ ID NO: 330530 - protein, 9 aa, Homo Sapiens
LISNLWDSG

SEQ ID NO: 330531 - protein, 9 aa, Homo Sapiens
TAVYCCHCR

SEQ ID NO: 330532 - protein, 9 aa, Homo Sapiens
RPGGATSSH

SEQ ID NO: 330533 - protein, 9 aa, Homo Sapiens
SNLENINFK

SEQ ID NO: 330534 - protein, 9 aa, Homo Sapiens
VMAGNNENY

SEQ ID NO: 330535 - protein, 9 aa, Homo Sapiens
KKKWSTQGE

SEQ ID NO: 330536 - protein, 9 aa, Homo Sapiens
RQRLLLISG

SEQ ID NO: 330537 - protein, 9 aa, Homo Sapiens
ENKCIHTSS

SEQ ID NO: 330538 - protein, 9 aa, Homo Sapiens
ICRFEPLTL

SEQ ID NO: 330539 - protein, 9 aa, Homo Sapiens
CIYFNGVSL

SEQ ID NO: 330540 - protein, 9 aa, Homo Sapiens
TIIQKTKQQ

SEQ ID NO: 330541 - protein, 9 aa, Homo Sapiens
QTAIIVPHR

SEQ ID NO: 330542 - protein, 9 aa, Homo Sapiens
ERLDLQNNL

SEQ ID NO: 330543 - protein, 9 aa, Homo Sapiens
VGKKYGDSP

SEQ ID NO: 330544 - protein, 9 aa, Homo Sapiens
DTYWPFQGT

SEQ ID NO: 330545 - protein, 9 aa, Homo Sapiens
QNPRSQLRQ

SEQ ID NO: 330546 - protein, 9 aa, Homo Sapiens
QTEVSRLKR

SEQ ID NO: 330547 - protein, 9 aa, Homo Sapiens
IEVECIKAE

SEQ ID NO: 330548 - protein, 9 aa, Homo Sapiens
YSIEEDGSQ

SEQ ID NO: 330549 - protein, 9 aa, Homo Sapiens
KDEHILWFL

SEQ ID NO: 330550 - protein, 9 aa, Homo Sapiens
IAFLATDIN

SEQ ID NO: 330551 - protein, 9 aa, Homo Sapiens
LYKIKWGMS

SEQ ID NO: 330552 - protein, 9 aa, Homo Sapiens
WVTKTEKTA

SEQ ID NO: 330553 - protein, 9 aa, Homo Sapiens
RKEDLDAID

SEQ ID NO: 330554 - protein, 9 aa, Homo Sapiens
NYTVRKQSE

SEQ ID NO: 330555 - protein, 9 aa, Homo Sapiens
TQLVQDDQA

SEQ ID NO: 330556 - protein, 9 aa, Homo Sapiens
KDIWENGMK

SEQ ID NO: 330557 - protein, 9 aa, Homo Sapiens
TFSAMKKVE

SEQ ID NO: 330558 - protein, 9 aa, Homo Sapiens
KMGRVMLGE

SEQ ID NO: 330559 - protein, 9 aa, Homo Sapiens
FRREYKRII

SEQ ID NO: 330560 - protein, 9 aa, Homo Sapiens
VFSDDDSDL

SEQ ID NO: 330561 - protein, 9 aa, Homo Sapiens
GSLCEITTT

SEQ ID NO: 330562 - protein, 9 aa, Homo Sapiens
FEVKIFPPE

SEQ ID NO: 330563 - protein, 9 aa, Homo Sapiens
NEISHHLGK

SEQ ID NO: 330564 - protein, 9 aa, Homo Sapiens
GRFKCSNSV

SEQ ID NO: 330565 - protein, 9 aa, Homo Sapiens
GNDQIDSMD

SEQ ID NO: 330566 - protein, 9 aa, Homo Sapiens
HKLAKSYGI

SEQ ID NO: 330567 - protein, 9 aa, Homo Sapiens
EVLNVVKEL

SEQ ID NO: 330568 - protein, 9 aa, Homo Sapiens
GQPSPSAQI

SEQ ID NO: 330569 - protein, 9 aa, Homo Sapiens
DQTTKAPTS

SEQ ID NO: 330570 - protein, 9 aa, Homo Sapiens
GADHDVPKH

SEQ ID NO: 330571 - protein, 9 aa, Homo Sapiens
VVLKTLRKP

SEQ ID NO: 330572 - protein, 9 aa, Homo Sapiens
RLPRSPCLG

SEQ ID NO: 330573 - protein, 9 aa, Homo Sapiens
VCSLLSAQQ

SEQ ID NO: 330574 - protein, 9 aa, Homo Sapiens
LYIFSRDGV

SEQ ID NO: 330575 - protein, 9 aa, Homo Sapiens
EFNQIELEV

SEQ ID NO: 330576 - protein, 9 aa, Homo Sapiens
HQDTLHTMY

SEQ ID NO: 330577 - protein, 9 aa, Homo Sapiens
RKVARVQPK

SEQ ID NO: 330578 - protein, 9 aa, Homo Sapiens
FSGCCFSRP

SEQ ID NO: 330579 - protein, 9 aa, Homo Sapiens
RKEFIKTCV

SEQ ID NO: 330580 - protein, 9 aa, Homo Sapiens
SGVKLTHQA

SEQ ID NO: 330581 - protein, 9 aa, Homo Sapiens
LERVEEAAV

SEQ ID NO: 330582 - protein, 9 aa, Homo Sapiens
NPAARKFKP

SEQ ID NO: 330583 - protein, 9 aa, Homo Sapiens
PFSALLITT

SEQ ID NO: 330584 - protein, 9 aa, Homo Sapiens
LYFDNTCVV

SEQ ID NO: 330585 - protein, 9 aa, Homo Sapiens
ATGNNSCPS

SEQ ID NO: 330586 - protein, 9 aa, Homo Sapiens
GCADLIQRI

SEQ ID NO: 330587 - protein, 9 aa, Homo Sapiens
LSNGVAIHS

SEQ ID NO: 330588 - protein, 9 aa, Homo Sapiens
IGLALLNNE

SEQ ID NO: 330589 - protein, 9 aa, Homo Sapiens
SESEASENK

SEQ ID NO: 330590 - protein, 9 aa, Homo Sapiens
SRWTRLVGI

SEQ ID NO: 330591 - protein, 9 aa, Homo Sapiens
KYTVIYLYT

SEQ ID NO: 330592 - protein, 9 aa, Homo Sapiens
NLGVTVDLY

SEQ ID NO: 330593 - protein, 9 aa, Homo Sapiens
SMDDNYFVN

SEQ ID NO: 330594 - protein, 9 aa, Homo Sapiens
FTQIIAEAE

SEQ ID NO: 330595 - protein, 9 aa, Homo Sapiens
VIAEQLAQL

SEQ ID NO: 330596 - protein, 9 aa, Homo Sapiens
SKAEMSHAP

SEQ ID NO: 330597 - protein, 9 aa, Homo Sapiens
LSNLVVLDA

SEQ ID NO: 330598 - protein, 9 aa, Homo Sapiens
LSMTFDGQL

SEQ ID NO: 330599 - protein, 9 aa, Homo Sapiens
VKWLEVCCV

SEQ ID NO: 330600 - protein, 9 aa, Homo Sapiens
NVEKESKQL

SEQ ID NO: 330601 - protein, 9 aa, Homo Sapiens
PDIYRGCEA

SEQ ID NO: 330602 - protein, 9 aa, Homo Sapiens
QEMLSRLSL

SEQ ID NO: 330603 - protein, 9 aa, Homo Sapiens
YLKCISCGS

SEQ ID NO: 330604 - protein, 9 aa, Homo Sapiens
DYEHSRRGC

SEQ ID NO: 330605 - protein, 9 aa, Homo Sapiens
NVTGNSIRS

SEQ ID NO: 330606 - protein, 9 aa, Homo Sapiens
PPVVNPYDM

SEQ ID NO: 330607 - protein, 9 aa, Homo Sapiens
EIKVIFIPS

SEQ ID NO: 330608 - protein, 9 aa, Homo Sapiens
CELCHKPQR

SEQ ID NO: 330609 - protein, 9 aa, Homo Sapiens
KCVIATSTK

SEQ ID NO: 330610 - protein, 9 aa, Homo Sapiens
LYPLFMEGV

SEQ ID NO: 330611 - protein, 9 aa, Homo Sapiens
LCQLTKTSR

SEQ ID NO: 330612 - protein, 9 aa, Homo Sapiens
QLMDRLSND

SEQ ID NO: 330613 - protein, 9 aa, Homo Sapiens
LSDSERISI

SEQ ID NO: 330614 - protein, 9 aa, Homo Sapiens
AFPGLTSTH

SEQ ID NO: 330615 - protein, 9 aa, Homo Sapiens
SQILAPGET

SEQ ID NO: 330616 - protein, 9 aa, Homo Sapiens
SMHIYQPRF

SEQ ID NO: 330617 - protein, 9 aa, Homo Sapiens
SKAVKNLAS

SEQ ID NO: 330618 - protein, 9 aa, Homo Sapiens
CSYYHMKKC

SEQ ID NO: 330619 - protein, 9 aa, Homo Sapiens
SIKAKPLKS

SEQ ID NO: 330620 - protein, 9 aa, Homo Sapiens
IGPRQGGGM

SEQ ID NO: 330621 - protein, 9 aa, Homo Sapiens
AFQAWQKAQ

SEQ ID NO: 330622 - protein, 9 aa, Homo Sapiens
HTPHSGDNS

SEQ ID NO: 330623 - protein, 9 aa, Homo Sapiens
PNTSQMHWT

SEQ ID NO: 330624 - protein, 9 aa, Homo Sapiens
YSPAHNREK

SEQ ID NO: 330625 - protein, 9 aa, Homo Sapiens
GADTQVLSW

SEQ ID NO: 330626 - protein, 9 aa, Homo Sapiens
YITKQIRLR

SEQ ID NO: 330627 - protein, 9 aa, Homo Sapiens
AFHKGVPNP

SEQ ID NO: 330628 - protein, 9 aa, Homo Sapiens
ERENALLKY

SEQ ID NO: 330629 - protein, 9 aa, Homo Sapiens
VKRSQGRIS

SEQ ID NO: 330630 - protein, 9 aa, Homo Sapiens
FPLHLQPSQ

SEQ ID NO: 330631 - protein, 9 aa, Homo Sapiens
PNSSGWGGG

SEQ ID NO: 330632 - protein, 9 aa, Homo Sapiens
GYTLMDLLK

SEQ ID NO: 330633 - protein, 9 aa, Homo Sapiens
FQGYNRLAW

SEQ ID NO: 330634 - protein, 9 aa, Homo Sapiens
GVCVCPFPG

SEQ ID NO: 330635 - protein, 9 aa, Homo Sapiens
QLHYFRNRH

SEQ ID NO: 330636 - protein, 9 aa, Homo Sapiens
WLVYLWVSL

SEQ ID NO: 330637 - protein, 9 aa, Homo Sapiens
SDLMAQPPQ

SEQ ID NO: 330638 - protein, 9 aa, Homo Sapiens
NLTRRGLYL

SEQ ID NO: 330639 - protein, 9 aa, Homo Sapiens
SDWTLLLSS

SEQ ID NO: 330640 - protein, 9 aa, Homo Sapiens
SVNKFAKHI

SEQ ID NO: 330641 - protein, 9 aa, Homo Sapiens
ARRSPQKLP

SEQ ID NO: 330642 - protein, 9 aa, Homo Sapiens
HHLGSRHQA

SEQ ID NO: 330643 - protein, 9 aa, Homo Sapiens
CQSPDESHR

SEQ ID NO: 330644 - protein, 9 aa, Homo Sapiens
CRLTGSTPM

SEQ ID NO: 330645 - protein, 9 aa, Homo Sapiens
NQLKEEVWL

SEQ ID NO: 330646 - protein, 9 aa, Homo Sapiens
ERCFTSGQC

SEQ ID NO: 330647 - protein, 9 aa, Homo Sapiens
AAIADKLDL

SEQ ID NO: 330648 - protein, 9 aa, Homo Sapiens
MSKLGKLFK

SEQ ID NO: 330649 - protein, 9 aa, Homo Sapiens
QNSQLDPDS

SEQ ID NO: 330650 - protein, 9 aa, Homo Sapiens
LSAQGDSLQ

SEQ ID NO: 330651 - protein, 9 aa, Homo Sapiens
ACARCAHPL

SEQ ID NO: 330652 - protein, 9 aa, Homo Sapiens
GKSAFSGIP

SEQ ID NO: 330653 - protein, 9 aa, Homo Sapiens
LWLRGLRKY

SEQ ID NO: 330654 - protein, 9 aa, Homo Sapiens
RFKNKLPVP

SEQ ID NO: 330655 - protein, 9 aa, Homo Sapiens
KWSKDYWIA

SEQ ID NO: 330656 - protein, 9 aa, Homo Sapiens
AMLDMLLQH

SEQ ID NO: 330657 - protein, 9 aa, Homo Sapiens
RWLCSLIRM

SEQ ID NO: 330658 - protein, 9 aa, Homo Sapiens
ATTPAKKTV

SEQ ID NO: 330659 - protein, 9 aa, Homo Sapiens
QFAVLDPEH

SEQ ID NO: 330660 - protein, 9 aa, Homo Sapiens
AIAGVLAIA

SEQ ID NO: 330661 - protein, 9 aa, Homo Sapiens
ATVSVSTSN

SEQ ID NO: 330662 - protein, 9 aa, Homo Sapiens
YQIEDKMEV

SEQ ID NO: 330663 - protein, 9 aa, Homo Sapiens
ASGTPWYPI

SEQ ID NO: 330664 - protein, 9 aa, Homo Sapiens
NSSELNTAC

SEQ ID NO: 330665 - protein, 9 aa, Homo Sapiens
VLSWRTNFD

SEQ ID NO: 330666 - protein, 9 aa, Homo Sapiens
QERAEQLSQ

SEQ ID NO: 330667 - protein, 9 aa, Homo Sapiens
ESQEDSDTP

SEQ ID NO: 330668 - protein, 9 aa, Homo Sapiens
YMALHWACY

SEQ ID NO: 330669 - protein, 9 aa, Homo Sapiens
LADSFFIVE

SEQ ID NO: 330670 - protein, 9 aa, Homo Sapiens
GYFITPCVC

SEQ ID NO: 330671 - protein, 9 aa, Homo Sapiens
TPFILAAIV

SEQ ID NO: 330672 - protein, 9 aa, Homo Sapiens
SEQILKVAS

SEQ ID NO: 330673 - protein, 9 aa, Homo Sapiens
KINQIILVV

SEQ ID NO: 330674 - protein, 9 aa, Homo Sapiens
YQDNNGNVI

SEQ ID NO: 330675 - protein, 9 aa, Homo Sapiens
SSQGEEELD

SEQ ID NO: 330676 - protein, 9 aa, Homo Sapiens
LNRHETIHT

SEQ ID NO: 330677 - protein, 9 aa, Homo Sapiens
KMQELNNKI

SEQ ID NO: 330678 - protein, 9 aa, Homo Sapiens
PNLEIGTHD

SEQ ID NO: 330679 - protein, 9 aa, Homo Sapiens
LSIAQQNKQ

SEQ ID NO: 330680 - protein, 9 aa, Homo Sapiens
TPLMYFELP

SEQ ID NO: 330681 - protein, 9 aa, Homo Sapiens
HRKTTLEMS

SEQ ID NO: 330682 - protein, 9 aa, Homo Sapiens
LMPDFFPVR

SEQ ID NO: 330683 - protein, 9 aa, Homo Sapiens
EEELQTMDQ

SEQ ID NO: 330684 - protein, 9 aa, Homo Sapiens
CTPRHKIIK

SEQ ID NO: 330685 - protein, 9 aa, Homo Sapiens
RKQCYWPFS

SEQ ID NO: 330686 - protein, 9 aa, Homo Sapiens
FPISHICLW

SEQ ID NO: 330687 - protein, 9 aa, Homo Sapiens
IFETLIKYT

SEQ ID NO: 330688 - protein, 9 aa, Homo Sapiens
FKRNLFQHQ

SEQ ID NO: 330689 - protein, 9 aa, Homo Sapiens
VLKVLTNKT

SEQ ID NO: 330690 - protein, 9 aa, Homo Sapiens
ESMLPDKVE

SEQ ID NO: 330691 - protein, 9 aa, Homo Sapiens
SSSLSSPSV

SEQ ID NO: 330692 - protein, 9 aa, Homo Sapiens
KYGDLNPML

SEQ ID NO: 330693 - protein, 9 aa, Homo Sapiens
HLPKEALKM

SEQ ID NO: 330694 - protein, 9 aa, Homo Sapiens
VAMVINRLF

SEQ ID NO: 330695 - protein, 9 aa, Homo Sapiens
FVITTPDVY

SEQ ID NO: 330696 - protein, 9 aa, Homo Sapiens
IYGLLVALA

SEQ ID NO: 330697 - protein, 9 aa, Homo Sapiens
LYMCHKCKN

SEQ ID NO: 330698 - protein, 9 aa, Homo Sapiens
EYDAYCTDL

SEQ ID NO: 330699 - protein, 9 aa, Homo Sapiens
EKYCANHFA

SEQ ID NO: 330700 - protein, 9 aa, Homo Sapiens
HSVILLACQ

SEQ ID NO: 330701 - protein, 9 aa, Homo Sapiens
IIAQGDLAD

SEQ ID NO: 330702 - protein, 9 aa, Homo Sapiens
SWFWDGQLL

SEQ ID NO: 330703 - protein, 9 aa, Homo Sapiens
WFHNQRHML

SEQ ID NO: 330704 - protein, 9 aa, Homo Sapiens
QQAFGKLLK

SEQ ID NO: 330705 - protein, 9 aa, Homo Sapiens
NEIFQCQVN

SEQ ID NO: 330706 - protein, 9 aa, Homo Sapiens
KLLFKKNIL

SEQ ID NO: 330707 - protein, 9 aa, Homo Sapiens
HIGVLRHTG

SEQ ID NO: 330708 - protein, 9 aa, Homo Sapiens
WQVAEQVLQ

SEQ ID NO: 330709 - protein, 9 aa, Homo Sapiens
FITVSGYLS

SEQ ID NO: 330710 - protein, 9 aa, Homo Sapiens
ESNSESADN

SEQ ID NO: 330711 - protein, 9 aa, Homo Sapiens
VKITGEIVL

SEQ ID NO: 330712 - protein, 9 aa, Homo Sapiens
EQIINQLTA

SEQ ID NO: 330713 - protein, 9 aa, Homo Sapiens
EALHYCHDN

SEQ ID NO: 330714 - protein, 9 aa, Homo Sapiens
EYVKAGKRS

SEQ ID NO: 330715 - protein, 9 aa, Homo Sapiens
RECQLVCGA

SEQ ID NO: 330716 - protein, 9 aa, Homo Sapiens
NDILSNALK

SEQ ID NO: 330717 - protein, 9 aa, Homo Sapiens
MLHLHGTDI

SEQ ID NO: 330718 - protein, 9 aa, Homo Sapiens
ASQSKACDT

SEQ ID NO: 330719 - protein, 9 aa, Homo Sapiens
KKGATEKTP

SEQ ID NO: 330720 - protein, 9 aa, Homo Sapiens
RRMWNYTVR

SEQ ID NO: 330721 - protein, 9 aa, Homo Sapiens
IDVMDQLSY

SEQ ID NO: 330722 - protein, 9 aa, Homo Sapiens
GATVINEDK

SEQ ID NO: 330723 - protein, 9 aa, Homo Sapiens
SLGAQQQKQ

SEQ ID NO: 330724 - protein, 9 aa, Homo Sapiens
NWLLERGHT

SEQ ID NO: 330725 - protein, 9 aa, Homo Sapiens
VDTKQAHKL

SEQ ID NO: 330726 - protein, 9 aa, Homo Sapiens
FLPRIPKVQ

SEQ ID NO: 330727 - protein, 9 aa, Homo Sapiens
RFVLKDAEK

SEQ ID NO: 330728 - protein, 9 aa, Homo Sapiens
TYTFRGFWS

SEQ ID NO: 330729 - protein, 9 aa, Homo Sapiens
QINLIDLAG

SEQ ID NO: 330730 - protein, 9 aa, Homo Sapiens
NHSLYLGRK

SEQ ID NO: 330731 - protein, 9 aa, Homo Sapiens
IIYDDGKMV

SEQ ID NO: 330732 - protein, 9 aa, Homo Sapiens
PRSLQPPSR

SEQ ID NO: 330733 - protein, 9 aa, Homo Sapiens
TLFVRKNNS

SEQ ID NO: 330734 - protein, 9 aa, Homo Sapiens
VCPFPGAVT

SEQ ID NO: 330735 - protein, 9 aa, Homo Sapiens
RAIQTGKEL

SEQ ID NO: 330736 - protein, 9 aa, Homo Sapiens
DNEARKGNK

SEQ ID NO: 330737 - protein, 9 aa, Homo Sapiens
VFINTIPNI

SEQ ID NO: 330738 - protein, 9 aa, Homo Sapiens
VDNATVCAG

SEQ ID NO: 330739 - protein, 9 aa, Homo Sapiens
TVNTTDLDE

SEQ ID NO: 330740 - protein, 9 aa, Homo Sapiens
VLLVTGIAT

SEQ ID NO: 330741 - protein, 9 aa, Homo Sapiens
FLGETPPSV

SEQ ID NO: 330742 - protein, 9 aa, Homo Sapiens
HPPGNWKKP

SEQ ID NO: 330743 - protein, 9 aa, Homo Sapiens
KETQLICQQ

SEQ ID NO: 330744 - protein, 9 aa, Homo Sapiens
YGLRDSHSE

SEQ ID NO: 330745 - protein, 9 aa, Homo Sapiens
AASVALVNT

SEQ ID NO: 330746 - protein, 9 aa, Homo Sapiens
CDSRLFTDV

SEQ ID NO: 330747 - protein, 9 aa, Homo Sapiens
EKRNTTTEE

SEQ ID NO: 330748 - protein, 9 aa, Homo Sapiens
GTSSDKVQE

SEQ ID NO: 330749 - protein, 9 aa, Homo Sapiens
EHLLKALHK

SEQ ID NO: 330750 - protein, 9 aa, Homo Sapiens
SMERGDLVP

SEQ ID NO: 330751 - protein, 9 aa, Homo Sapiens
CQPKVMCLK

SEQ ID NO: 330752 - protein, 9 aa, Homo Sapiens
FQTFSKAEA

SEQ ID NO: 330753 - protein, 9 aa, Homo Sapiens
PIKSIPSYA

SEQ ID NO: 330754 - protein, 9 aa, Homo Sapiens
WSKDIQTCK

SEQ ID NO: 330755 - protein, 9 aa, Homo Sapiens
CVLLASEGA

SEQ ID NO: 330756 - protein, 9 aa, Homo Sapiens
QNSNSYLSA

SEQ ID NO: 330757 - protein, 9 aa, Homo Sapiens
EKNVVFAID

SEQ ID NO: 330758 - protein, 9 aa, Homo Sapiens
TICEKVVNI

SEQ ID NO: 330759 - protein, 9 aa, Homo Sapiens
QLSLKRLPC

SEQ ID NO: 330760 - protein, 9 aa, Homo Sapiens
ACLKEEWMN

SEQ ID NO: 330761 - protein, 9 aa, Homo Sapiens
SSELDNHPM

SEQ ID NO: 330762 - protein, 9 aa, Homo Sapiens
VIEEGDADK

SEQ ID NO: 330763 - protein, 9 aa, Homo Sapiens
VSAASVALV

SEQ ID NO: 330764 - protein, 9 aa, Homo Sapiens
NKMALTSFM

SEQ ID NO: 330765 - protein, 9 aa, Homo Sapiens
KTRVFVVVI

SEQ ID NO: 330766 - protein, 9 aa, Homo Sapiens
KDLPFEPSN

SEQ ID NO: 330767 - protein, 9 aa, Homo Sapiens
HCQKNLSLH

SEQ ID NO: 330768 - protein, 9 aa, Homo Sapiens
PSKSPVPIA

SEQ ID NO: 330769 - protein, 9 aa, Homo Sapiens
EKDNRKLHM

SEQ ID NO: 330770 - protein, 9 aa, Homo Sapiens
ELYLNPFCP

SEQ ID NO: 330771 - protein, 9 aa, Homo Sapiens
ELPPLPPKF

SEQ ID NO: 330772 - protein, 9 aa, Homo Sapiens
GDKLQTDQA

SEQ ID NO: 330773 - protein, 9 aa, Homo Sapiens
NNAKTSSNG

SEQ ID NO: 330774 - protein, 9 aa, Homo Sapiens
SKTVPTANR

SEQ ID NO: 330775 - protein, 9 aa, Homo Sapiens
DKLDVPDDI

SEQ ID NO: 330776 - protein, 9 aa, Homo Sapiens
DTPNTTGPP

SEQ ID NO: 330777 - protein, 9 aa, Homo Sapiens
NLEALRYLN

SEQ ID NO: 330778 - protein, 9 aa, Homo Sapiens
LGSLIQIAQ

SEQ ID NO: 330779 - protein, 9 aa, Homo Sapiens
ECMSKYTVV

SEQ ID NO: 330780 - protein, 9 aa, Homo Sapiens
AIEAKEKKF

SEQ ID NO: 330781 - protein, 9 aa, Homo Sapiens
IWCPQDTGG

SEQ ID NO: 330782 - protein, 9 aa, Homo Sapiens
FTAWITELM

SEQ ID NO: 330783 - protein, 9 aa, Homo Sapiens
AGPLQAITV

SEQ ID NO: 330784 - protein, 9 aa, Homo Sapiens
EGHAIQNPN

SEQ ID NO: 330785 - protein, 9 aa, Homo Sapiens
SDFQCGPTS

SEQ ID NO: 330786 - protein, 9 aa, Homo Sapiens
VAGKRAEPM

SEQ ID NO: 330787 - protein, 9 aa, Homo Sapiens
NLTPDIYLS

SEQ ID NO: 330788 - protein, 9 aa, Homo Sapiens
ATKDKRTER

SEQ ID NO: 330789 - protein, 9 aa, Homo Sapiens
AQVHQRSSE

SEQ ID NO: 330790 - protein, 9 aa, Homo Sapiens
FKRIQSQTV

SEQ ID NO: 330791 - protein, 9 aa, Homo Sapiens
SVVAEGGSA

SEQ ID NO: 330792 - protein, 9 aa, Homo Sapiens
KSKFKRRPR

SEQ ID NO: 330793 - protein, 9 aa, Homo Sapiens
TLGEEDLSI

SEQ ID NO: 330794 - protein, 9 aa, Homo Sapiens
RTKLSFNIQ

SEQ ID NO: 330795 - protein, 9 aa, Homo Sapiens
RPANQYKDP

SEQ ID NO: 330796 - protein, 9 aa, Homo Sapiens
HHPDSPLLC

SEQ ID NO: 330797 - protein, 9 aa, Homo Sapiens
HLKQNDSII

SEQ ID NO: 330798 - protein, 9 aa, Homo Sapiens
VCYTSAKDG

SEQ ID NO: 330799 - protein, 9 aa, Homo Sapiens
EIATQFQLE

SEQ ID NO: 330800 - protein, 9 aa, Homo Sapiens
CSVFIIHMI

SEQ ID NO: 330801 - protein, 9 aa, Homo Sapiens
TLSQGTAVT

SEQ ID NO: 330802 - protein, 9 aa, Homo Sapiens
SVFLVWKFA

SEQ ID NO: 330803 - protein, 9 aa, Homo Sapiens
KIECDNKGD

SEQ ID NO: 330804 - protein, 9 aa, Homo Sapiens
RQKEEKQQE

SEQ ID NO: 330805 - protein, 9 aa, Homo Sapiens
EYAFNRKDK

SEQ ID NO: 330806 - protein, 9 aa, Homo Sapiens
DDAARCSMI

SEQ ID NO: 330807 - protein, 9 aa, Homo Sapiens
AKQAQRWAQ

SEQ ID NO: 330808 - protein, 9 aa, Homo Sapiens
RSNVSFYIV

SEQ ID NO: 330809 - protein, 9 aa, Homo Sapiens
DFNVTLRLQ

SEQ ID NO: 330810 - protein, 9 aa, Homo Sapiens
NTGEKPYKC

SEQ ID NO: 330811 - protein, 9 aa, Homo Sapiens
MEHIQEIQT

SEQ ID NO: 330812 - protein, 9 aa, Homo Sapiens
DEQHREEMQ

SEQ ID NO: 330813 - protein, 9 aa, Homo Sapiens
WAKLLSIVA

SEQ ID NO: 330814 - protein, 9 aa, Homo Sapiens
DTGSNDAHT

SEQ ID NO: 330815 - protein, 9 aa, Homo Sapiens
KEDQFSALD

SEQ ID NO: 330816 - protein, 9 aa, Homo Sapiens
CRGDKFQCG

SEQ ID NO: 330817 - protein, 9 aa, Homo Sapiens
ARINNFMME

SEQ ID NO: 330818 - protein, 9 aa, Homo Sapiens
FILCLISFL

SEQ ID NO: 330819 - protein, 9 aa, Homo Sapiens
RSLQPPSRQ

SEQ ID NO: 330820 - protein, 9 aa, Homo Sapiens
QGAVVAVTG

SEQ ID NO: 330821 - protein, 9 aa, Homo Sapiens
EKLLCMYQN

SEQ ID NO: 330822 - protein, 9 aa, Homo Sapiens
YYRQMDSED

SEQ ID NO: 330823 - protein, 9 aa, Homo Sapiens
ETLKECVQL

SEQ ID NO: 330824 - protein, 9 aa, Homo Sapiens
FLQQHYAIY

SEQ ID NO: 330825 - protein, 9 aa, Homo Sapiens
DPFINELVI

SEQ ID NO: 330826 - protein, 9 aa, Homo Sapiens
GMKPHKAFP

SEQ ID NO: 330827 - protein, 9 aa, Homo Sapiens
GQTHTISLP

SEQ ID NO: 330828 - protein, 9 aa, Homo Sapiens
PTTTKKTTL

SEQ ID NO: 330829 - protein, 9 aa, Homo Sapiens
NFKSDIWPL

SEQ ID NO: 330830 - protein, 9 aa, Homo Sapiens
GGTCRNLVN

SEQ ID NO: 330831 - protein, 9 aa, Homo Sapiens
ASQPEAAFL

SEQ ID NO: 330832 - protein, 9 aa, Homo Sapiens
YIGVKPEFS

SEQ ID NO: 330833 - protein, 9 aa, Homo Sapiens
SYSDKELTI

SEQ ID NO: 330834 - protein, 9 aa, Homo Sapiens
ESSLSVKEV

SEQ ID NO: 330835 - protein, 9 aa, Homo Sapiens
WGRLHSHCP

SEQ ID NO: 330836 - protein, 9 aa, Homo Sapiens
YKRNFEESK

SEQ ID NO: 330837 - protein, 9 aa, Homo Sapiens
EEEEEDVNS

SEQ ID NO: 330838 - protein, 9 aa, Homo Sapiens
LLLFFLLHI

SEQ ID NO: 330839 - protein, 9 aa, Homo Sapiens
KLLVSATGH

SEQ ID NO: 330840 - protein, 9 aa, Homo Sapiens
SSTIQNLKE

SEQ ID NO: 330841 - protein, 9 aa, Homo Sapiens
IRDPVSEPL

SEQ ID NO: 330842 - protein, 9 aa, Homo Sapiens
NSDRPERSK

SEQ ID NO: 330843 - protein, 9 aa, Homo Sapiens
GLHRSLPAV

SEQ ID NO: 330844 - protein, 9 aa, Homo Sapiens
HDNSFMKML

SEQ ID NO: 330845 - protein, 9 aa, Homo Sapiens
YPPSGSPKE

SEQ ID NO: 330846 - protein, 9 aa, Homo Sapiens
RAHRQINAS

SEQ ID NO: 330847 - protein, 9 aa, Homo Sapiens
LSGNCDQRF

SEQ ID NO: 330848 - protein, 9 aa, Homo Sapiens
QIEEMENER

SEQ ID NO: 330849 - protein, 9 aa, Homo Sapiens
KRCSALLSD

SEQ ID NO: 330850 - protein, 9 aa, Homo Sapiens
YSAEVGTLW

SEQ ID NO: 330851 - protein, 9 aa, Homo Sapiens
IIKLMIIPD

SEQ ID NO: 330852 - protein, 9 aa, Homo Sapiens
VAGLLPKKL

SEQ ID NO: 330853 - protein, 9 aa, Homo Sapiens
CCEEKTVGR

SEQ ID NO: 330854 - protein, 9 aa, Homo Sapiens
SNINNGLVK

SEQ ID NO: 330855 - protein, 9 aa, Homo Sapiens
VTECKEYQF

SEQ ID NO: 330856 - protein, 9 aa, Homo Sapiens
GINTLKEVV

SEQ ID NO: 330857 - protein, 9 aa, Homo Sapiens
SSKSYSYFP

SEQ ID NO: 330858 - protein, 9 aa, Homo Sapiens
LRVRTSIKD

SEQ ID NO: 330859 - protein, 9 aa, Homo Sapiens
RPMYFVLGH

SEQ ID NO: 330860 - protein, 9 aa, Homo Sapiens
WWDSNFLGG

SEQ ID NO: 330861 - protein, 9 aa, Homo Sapiens
ANITANLIA

SEQ ID NO: 330862 - protein, 9 aa, Homo Sapiens
AVVHHLGHN

SEQ ID NO: 330863 - protein, 9 aa, Homo Sapiens
IWTRGVEDI

SEQ ID NO: 330864 - protein, 9 aa, Homo Sapiens
FSEILNRFQ

SEQ ID NO: 330865 - protein, 9 aa, Homo Sapiens
AMTSILDHL

SEQ ID NO: 330866 - protein, 9 aa, Homo Sapiens
HCKWFNVCM

SEQ ID NO: 330867 - protein, 9 aa, Homo Sapiens
QTTSIVTHR

SEQ ID NO: 330868 - protein, 9 aa, Homo Sapiens
PRPASACAR

SEQ ID NO: 330869 - protein, 9 aa, Homo Sapiens
LDVSLKFSK

SEQ ID NO: 330870 - protein, 9 aa, Homo Sapiens
DSELDIPVP

SEQ ID NO: 330871 - protein, 9 aa, Homo Sapiens
IDTLELQSD

SEQ ID NO: 330872 - protein, 9 aa, Homo Sapiens
TRRLNGQAF

SEQ ID NO: 330873 - protein, 9 aa, Homo Sapiens
LNTRSSQNG

SEQ ID NO: 330874 - protein, 9 aa, Homo Sapiens
HTYVLGQNS

SEQ ID NO: 330875 - protein, 9 aa, Homo Sapiens
ILLGFSNYS

SEQ ID NO: 330876 - protein, 9 aa, Homo Sapiens
PVISSLEYG

SEQ ID NO: 330877 - protein, 9 aa, Homo Sapiens
KSLDKDISE

SEQ ID NO: 330878 - protein, 9 aa, Homo Sapiens
QIFNEFCDS

SEQ ID NO: 330879 - protein, 9 aa, Homo Sapiens
RTSPTPRDF

SEQ ID NO: 330880 - protein, 9 aa, Homo Sapiens
VFVLVPLRG

SEQ ID NO: 330881 - protein, 9 aa, Homo Sapiens
SDKDMDINE

SEQ ID NO: 330882 - protein, 9 aa, Homo Sapiens
ESIWKKAVQ

SEQ ID NO: 330883 - protein, 9 aa, Homo Sapiens
SNTLKGQGE

SEQ ID NO: 330884 - protein, 9 aa, Homo Sapiens
CIECGKLFR

SEQ ID NO: 330885 - protein, 9 aa, Homo Sapiens
VQRILIAKL

SEQ ID NO: 330886 - protein, 9 aa, Homo Sapiens
LQMEAQCIC

SEQ ID NO: 330887 - protein, 9 aa, Homo Sapiens
GDESGGENE

SEQ ID NO: 330888 - protein, 9 aa, Homo Sapiens
GGHTPHSGD

SEQ ID NO: 330889 - protein, 9 aa, Homo Sapiens
IILKKFPHL

SEQ ID NO: 330890 - protein, 9 aa, Homo Sapiens
EEVDERQRA

SEQ ID NO: 330891 - protein, 9 aa, Homo Sapiens
REGHQWDKI

SEQ ID NO: 330892 - protein, 9 aa, Homo Sapiens
LEASFSSSE

SEQ ID NO: 330893 - protein, 9 aa, Homo Sapiens
DRRRAATCL

SEQ ID NO: 330894 - protein, 9 aa, Homo Sapiens
HSAAVSCGL

SEQ ID NO: 330895 - protein, 9 aa, Homo Sapiens
PKKGRRKGQ

SEQ ID NO: 330896 - protein, 9 aa, Homo Sapiens
SLYADNLPG

SEQ ID NO: 330897 - protein, 9 aa, Homo Sapiens
GTVIVAGYP

SEQ ID NO: 330898 - protein, 9 aa, Homo Sapiens
ARGEKYLAY

SEQ ID NO: 330899 - protein, 9 aa, Homo Sapiens
HCGEKSSKA

SEQ ID NO: 330900 - protein, 9 aa, Homo Sapiens
LKTDALLGK

SEQ ID NO: 330901 - protein, 9 aa, Homo Sapiens
RGGNQAGGS

SEQ ID NO: 330902 - protein, 9 aa, Homo Sapiens
QEENNEDHT

SEQ ID NO: 330903 - protein, 9 aa, Homo Sapiens
LEPTQDAFQ

SEQ ID NO: 330904 - protein, 9 aa, Homo Sapiens
QDSATHRNG

SEQ ID NO: 330905 - protein, 9 aa, Homo Sapiens
YVTFLRYFS

SEQ ID NO: 330906 - protein, 9 aa, Homo Sapiens
GGTQIQPLP

SEQ ID NO: 330907 - protein, 9 aa, Homo Sapiens
ALTDLMTKA

SEQ ID NO: 330908 - protein, 9 aa, Homo Sapiens
VAVEASTDS

SEQ ID NO: 330909 - protein, 9 aa, Homo Sapiens
IQTGKELFF

SEQ ID NO: 330910 - protein, 9 aa, Homo Sapiens
ANLQVINEE

SEQ ID NO: 330911 - protein, 9 aa, Homo Sapiens
LPQHTFCVI

SEQ ID NO: 330912 - protein, 9 aa, Homo Sapiens
YDIKLSEWK

SEQ ID NO: 330913 - protein, 9 aa, Homo Sapiens
ADKENMKKP

SEQ ID NO: 330914 - protein, 9 aa, Homo Sapiens
KELGMASFG

SEQ ID NO: 330915 - protein, 9 aa, Homo Sapiens
CGPSVEPGS

SEQ ID NO: 330916 - protein, 9 aa, Homo Sapiens
KSFREKSVV

SEQ ID NO: 330917 - protein, 9 aa, Homo Sapiens
RIGYPNEWY

SEQ ID NO: 330918 - protein, 9 aa, Homo Sapiens
KVHKGTCYW

SEQ ID NO: 330919 - protein, 9 aa, Homo Sapiens
SALFLHLHN

SEQ ID NO: 330920 - protein, 9 aa, Homo Sapiens
TTRWLTQAA

SEQ ID NO: 330921 - protein, 9 aa, Homo Sapiens
PDGRKEIMF

SEQ ID NO: 330922 - protein, 9 aa, Homo Sapiens
RTKKRIYEA

SEQ ID NO: 330923 - protein, 9 aa, Homo Sapiens
IYPPSGSPK

SEQ ID NO: 330924 - protein, 9 aa, Homo Sapiens
TRSAGTSSQ

SEQ ID NO: 330925 - protein, 9 aa, Homo Sapiens
RTALCGAAH

SEQ ID NO: 330926 - protein, 9 aa, Homo Sapiens
TADCRYRPS

SEQ ID NO: 330927 - protein, 9 aa, Homo Sapiens
TPRDFPKGL

SEQ ID NO: 330928 - protein, 9 aa, Homo Sapiens
NFQSVGSSL

SEQ ID NO: 330929 - protein, 9 aa, Homo Sapiens
YGCTSTSNM

SEQ ID NO: 330930 - protein, 9 aa, Homo Sapiens
TVFGSSGNL

SEQ ID NO: 330931 - protein, 9 aa, Homo Sapiens
KIARNGDAS

SEQ ID NO: 330932 - protein, 9 aa, Homo Sapiens
IFFGRQMGG

SEQ ID NO: 330933 - protein, 9 aa, Homo Sapiens
KPAFDCPMN

SEQ ID NO: 330934 - protein, 9 aa, Homo Sapiens
QVHRHMNSL

SEQ ID NO: 330935 - protein, 9 aa, Homo Sapiens
KMTRKKLNK

SEQ ID NO: 330936 - protein, 9 aa, Homo Sapiens
TAKTKAGAT

SEQ ID NO: 330937 - protein, 9 aa, Homo Sapiens
TVSKCKREY

SEQ ID NO: 330938 - protein, 9 aa, Homo Sapiens
LQDMHKTKK

SEQ ID NO: 330939 - protein, 9 aa, Homo Sapiens
CELYVFIIP

SEQ ID NO: 330940 - protein, 9 aa, Homo Sapiens
KRIQSQTVG

SEQ ID NO: 330941 - protein, 9 aa, Homo Sapiens
CIECVKTFC

SEQ ID NO: 330942 - protein, 9 aa, Homo Sapiens
IVNLIHSTH

SEQ ID NO: 330943 - protein, 9 aa, Homo Sapiens
EDQFSALDL

SEQ ID NO: 330944 - protein, 9 aa, Homo Sapiens
NMEAALGSL

SEQ ID NO: 330945 - protein, 9 aa, Homo Sapiens
KCIEMKKLL

SEQ ID NO: 330946 - protein, 9 aa, Homo Sapiens
RSKQEGIIY

SEQ ID NO: 330947 - protein, 9 aa, Homo Sapiens
IIRGKRRAK

SEQ ID NO: 330948 - protein, 9 aa, Homo Sapiens
NLMGWLHSK

SEQ ID NO: 330949 - protein, 9 aa, Homo Sapiens
DPELKNLFN

SEQ ID NO: 330950 - protein, 9 aa, Homo Sapiens
VFLHQCILW

SEQ ID NO: 330951 - protein, 9 aa, Homo Sapiens
KVEKRTSAK

SEQ ID NO: 330952 - protein, 9 aa, Homo Sapiens
LQPEVDTYW

SEQ ID NO: 330953 - protein, 9 aa, Homo Sapiens
NKRAAAKES

SEQ ID NO: 330954 - protein, 9 aa, Homo Sapiens
WTNRNGEEM

SEQ ID NO: 330955 - protein, 9 aa, Homo Sapiens
LLPGGLECH

SEQ ID NO: 330956 - protein, 9 aa, Homo Sapiens
VPLLYDFRW

SEQ ID NO: 330957 - protein, 9 aa, Homo Sapiens
PYEAAHMFF

SEQ ID NO: 330958 - protein, 9 aa, Homo Sapiens
DCFQMRIHK

SEQ ID NO: 330959 - protein, 9 aa, Homo Sapiens
AKVDALDGK

SEQ ID NO: 330960 - protein, 9 aa, Homo Sapiens
DNLTRRGLY

SEQ ID NO: 330961 - protein, 9 aa, Homo Sapiens
EYRFVSDQK

SEQ ID NO: 330962 - protein, 9 aa, Homo Sapiens
WSQVFSLFV

SEQ ID NO: 330963 - protein, 9 aa, Homo Sapiens
FCWHQIRTD

SEQ ID NO: 330964 - protein, 9 aa, Homo Sapiens
MFIADTHEK

SEQ ID NO: 330965 - protein, 9 aa, Homo Sapiens
GFKLTSVEK

SEQ ID NO: 330966 - protein, 9 aa, Homo Sapiens
VLNHFFCGI

SEQ ID NO: 330967 - protein, 9 aa, Homo Sapiens
LPFYPASVY

SEQ ID NO: 330968 - protein, 9 aa, Homo Sapiens
TFIVPQQWV

SEQ ID NO: 330969 - protein, 9 aa, Homo Sapiens
YQTFFDPKS

SEQ ID NO: 330970 - protein, 9 aa, Homo Sapiens
EICIHKLHY

SEQ ID NO: 330971 - protein, 9 aa, Homo Sapiens
DFKMPPPSP

SEQ ID NO: 330972 - protein, 9 aa, Homo Sapiens
PKPRSLQPP

SEQ ID NO: 330973 - protein, 9 aa, Homo Sapiens
KMLYVCCGT

SEQ ID NO: 330974 - protein, 9 aa, Homo Sapiens
LQAEIHQLK

SEQ ID NO: 330975 - protein, 9 aa, Homo Sapiens
LPIYPAIYI

SEQ ID NO: 330976 - protein, 9 aa, Homo Sapiens
CNNTAYQEV

SEQ ID NO: 330977 - protein, 9 aa, Homo Sapiens
ILRAVVIAF

SEQ ID NO: 330978 - protein, 9 aa, Homo Sapiens
GVAWVSSLR

SEQ ID NO: 330979 - protein, 9 aa, Homo Sapiens
KLLPLHRGY

SEQ ID NO: 330980 - protein, 9 aa, Homo Sapiens
KELEEQQKL

SEQ ID NO: 330981 - protein, 9 aa, Homo Sapiens
ECIRGTVGP

SEQ ID NO: 330982 - protein, 9 aa, Homo Sapiens
PFTETLKGT

SEQ ID NO: 330983 - protein, 9 aa, Homo Sapiens
EVRYEVNCL

SEQ ID NO: 330984 - protein, 9 aa, Homo Sapiens
EYFSAVPPT

SEQ ID NO: 330985 - protein, 9 aa, Homo Sapiens
CIIKVQDIN

SEQ ID NO: 330986 - protein, 9 aa, Homo Sapiens
QIKIYSKIA

SEQ ID NO: 330987 - protein, 9 aa, Homo Sapiens
QKNNLKDLQ

SEQ ID NO: 330988 - protein, 9 aa, Homo Sapiens
MELYKLLGR

SEQ ID NO: 330989 - protein, 9 aa, Homo Sapiens
FMVLEHYNM

SEQ ID NO: 330990 - protein, 9 aa, Homo Sapiens
ALKMSVAPG

SEQ ID NO: 330991 - protein, 9 aa, Homo Sapiens
GGTLVQAEA

SEQ ID NO: 330992 - protein, 9 aa, Homo Sapiens
TEDNKLCHE

SEQ ID NO: 330993 - protein, 9 aa, Homo Sapiens
RFQESLNQN

SEQ ID NO: 330994 - protein, 9 aa, Homo Sapiens
CALKFPNCQ

SEQ ID NO: 330995 - protein, 9 aa, Homo Sapiens
QLFLSQTAQ

SEQ ID NO: 330996 - protein, 9 aa, Homo Sapiens
DALALSVTL

SEQ ID NO: 330997 - protein, 9 aa, Homo Sapiens
VYTGGYNGL

SEQ ID NO: 330998 - protein, 9 aa, Homo Sapiens
SDDDSDLDF

SEQ ID NO: 330999 - protein, 9 aa, Homo Sapiens
ELSNWYTEA

SEQ ID NO: 331000 - protein, 9 aa, Homo Sapiens
ANKIALEAS

SEQ ID NO: 331001 - protein, 9 aa, Homo Sapiens
RLHSHCPRH

SEQ ID NO: 331002 - protein, 9 aa, Homo Sapiens
KEKKESIFV

SEQ ID NO: 331003 - protein, 9 aa, Homo Sapiens
KNRMWRNTR

SEQ ID NO: 331004 - protein, 9 aa, Homo Sapiens
DLRENGEVT

SEQ ID NO: 331005 - protein, 9 aa, Homo Sapiens
VDVCFLNRR

SEQ ID NO: 331006 - protein, 9 aa, Homo Sapiens
NETSFKQTL

SEQ ID NO: 331007 - protein, 9 aa, Homo Sapiens
LRRFMYTTL

SEQ ID NO: 331008 - protein, 9 aa, Homo Sapiens
KQGRKKHAA

SEQ ID NO: 331009 - protein, 9 aa, Homo Sapiens
AILDLTHNT

SEQ ID NO: 331010 - protein, 9 aa, Homo Sapiens
RLEYLVKKH

SEQ ID NO: 331011 - protein, 9 aa, Homo Sapiens
KRNHTQNKC

SEQ ID NO: 331012 - protein, 9 aa, Homo Sapiens
ITLFPLSFL

SEQ ID NO: 331013 - protein, 9 aa, Homo Sapiens
QNYNKILAI

SEQ ID NO: 331014 - protein, 9 aa, Homo Sapiens
AHRVALAEA

SEQ ID NO: 331015 - protein, 9 aa, Homo Sapiens
LAPRHILVK

SEQ ID NO: 331016 - protein, 9 aa, Homo Sapiens
YSKITTRDA

SEQ ID NO: 331017 - protein, 9 aa, Homo Sapiens
CVYKGKPLE

SEQ ID NO: 331018 - protein, 9 aa, Homo Sapiens
DDKEKPVKQ

SEQ ID NO: 331019 - protein, 9 aa, Homo Sapiens
RRCMTISIC

SEQ ID NO: 331020 - protein, 9 aa, Homo Sapiens
PESLPFCQP

SEQ ID NO: 331021 - protein, 9 aa, Homo Sapiens
VFSLAAVNP

SEQ ID NO: 331022 - protein, 9 aa, Homo Sapiens
PVNVRFCLK

SEQ ID NO: 331023 - protein, 9 aa, Homo Sapiens
SNITVCMPS

SEQ ID NO: 331024 - protein, 9 aa, Homo Sapiens
LGIDTQLLN

SEQ ID NO: 331025 - protein, 9 aa, Homo Sapiens
EAAEERHKS

SEQ ID NO: 331026 - protein, 9 aa, Homo Sapiens
IEVLKSEPY

SEQ ID NO: 331027 - protein, 9 aa, Homo Sapiens
NVFITKTCP

SEQ ID NO: 331028 - protein, 9 aa, Homo Sapiens
SIMWEGRDR

SEQ ID NO: 331029 - protein, 9 aa, Homo Sapiens
GTESELSLP

SEQ ID NO: 331030 - protein, 9 aa, Homo Sapiens
SQPVISSLE

SEQ ID NO: 331031 - protein, 9 aa, Homo Sapiens
SQASLGFKL

SEQ ID NO: 331032 - protein, 9 aa, Homo Sapiens
DEAAFFNTA

SEQ ID NO: 331033 - protein, 9 aa, Homo Sapiens
SSFSLRDSL

SEQ ID NO: 331034 - protein, 9 aa, Homo Sapiens
QNDSIIVDI

SEQ ID NO: 331035 - protein, 9 aa, Homo Sapiens
RPFPVLEHE

SEQ ID NO: 331036 - protein, 9 aa, Homo Sapiens
DIYITSFGP

SEQ ID NO: 331037 - protein, 9 aa, Homo Sapiens
VQKQSESSF

SEQ ID NO: 331038 - protein, 9 aa, Homo Sapiens
RVSEDVYHS

SEQ ID NO: 331039 - protein, 9 aa, Homo Sapiens
ENIIIVIFP

SEQ ID NO: 331040 - protein, 9 aa, Homo Sapiens
NLFNLDRFC

SEQ ID NO: 331041 - protein, 9 aa, Homo Sapiens
VTAVYCCHC

SEQ ID NO: 331042 - protein, 9 aa, Homo Sapiens
YSWYHNYGH

SEQ ID NO: 331043 - protein, 9 aa, Homo Sapiens
IQHQRVHTA

SEQ ID NO: 331044 - protein, 9 aa, Homo Sapiens
NVGKLSFVT

SEQ ID NO: 331045 - protein, 9 aa, Homo Sapiens
VLPVVKVLS

SEQ ID NO: 331046 - protein, 9 aa, Homo Sapiens
ITVSGYLSA

SEQ ID NO: 331047 - protein, 9 aa, Homo Sapiens
EAGVEVIVI

SEQ ID NO: 331048 - protein, 9 aa, Homo Sapiens
NKILAISLV

SEQ ID NO: 331049 - protein, 9 aa, Homo Sapiens
FTEREASKI

SEQ ID NO: 331050 - protein, 9 aa, Homo Sapiens
NLTPQQNSS

SEQ ID NO: 331051 - protein, 9 aa, Homo Sapiens
LQQLVNKTI

SEQ ID NO: 331052 - protein, 9 aa, Homo Sapiens
LKDHVSELE

SEQ ID NO: 331053 - protein, 9 aa, Homo Sapiens
SMLYQDNNG

SEQ ID NO: 331054 - protein, 9 aa, Homo Sapiens
RVLKEGDEK

SEQ ID NO: 331055 - protein, 9 aa, Homo Sapiens
KDSDGLCLL

SEQ ID NO: 331056 - protein, 9 aa, Homo Sapiens
VSAHALNVQ

SEQ ID NO: 331057 - protein, 9 aa, Homo Sapiens
CSHPQLCVC

SEQ ID NO: 331058 - protein, 9 aa, Homo Sapiens
ILEMALIPE

SEQ ID NO: 331059 - protein, 9 aa, Homo Sapiens
KLTEEDYKL

SEQ ID NO: 331060 - protein, 9 aa, Homo Sapiens
CCEQCEMPR

SEQ ID NO: 331061 - protein, 9 aa, Homo Sapiens
LHSHCPRHC

SEQ ID NO: 331062 - protein, 9 aa, Homo Sapiens
EPPSWRKIC

SEQ ID NO: 331063 - protein, 9 aa, Homo Sapiens
SSGKYTGAN

SEQ ID NO: 331064 - protein, 9 aa, Homo Sapiens
GELEKKAER

SEQ ID NO: 331065 - protein, 9 aa, Homo Sapiens
ACNRISHLK

SEQ ID NO: 331066 - protein, 9 aa, Homo Sapiens
LTCETVIVA

SEQ ID NO: 331067 - protein, 9 aa, Homo Sapiens
NCVCNAGFH

SEQ ID NO: 331068 - protein, 9 aa, Homo Sapiens
FRLRQGSRF

SEQ ID NO: 331069 - protein, 9 aa, Homo Sapiens
DSSGGEEED

SEQ ID NO: 331070 - protein, 9 aa, Homo Sapiens
INTLKEVVS

SEQ ID NO: 331071 - protein, 9 aa, Homo Sapiens
GTSWSPPAM

SEQ ID NO: 331072 - protein, 9 aa, Homo Sapiens
AEILFKKLI

SEQ ID NO: 331073 - protein, 9 aa, Homo Sapiens
KNKVDTIVN

SEQ ID NO: 331074 - protein, 9 aa, Homo Sapiens
QGSPEKARL

SEQ ID NO: 331075 - protein, 9 aa, Homo Sapiens
IVYCSFGNH

SEQ ID NO: 331076 - protein, 9 aa, Homo Sapiens
IISDEANSN

SEQ ID NO: 331077 - protein, 9 aa, Homo Sapiens
QRILQRITH

SEQ ID NO: 331078 - protein, 9 aa, Homo Sapiens
TPEICKYKK

SEQ ID NO: 331079 - protein, 9 aa, Homo Sapiens
QCIYGRKPF

SEQ ID NO: 331080 - protein, 9 aa, Homo Sapiens
APGVDTSPP

SEQ ID NO: 331081 - protein, 9 aa, Homo Sapiens
PLLEKTSNS

SEQ ID NO: 331082 - protein, 9 aa, Homo Sapiens
NTSKFTLER

SEQ ID NO: 331083 - protein, 9 aa, Homo Sapiens
IVEEVTQNA

SEQ ID NO: 331084 - protein, 9 aa, Homo Sapiens
RKETFLLML

SEQ ID NO: 331085 - protein, 9 aa, Homo Sapiens
KLAKYYRQM

SEQ ID NO: 331086 - protein, 9 aa, Homo Sapiens
CHKKDCPDE

SEQ ID NO: 331087 - protein, 9 aa, Homo Sapiens
IYVDGASNR

SEQ ID NO: 331088 - protein, 9 aa, Homo Sapiens
EKEKNENLE

SEQ ID NO: 331089 - protein, 9 aa, Homo Sapiens
FLEATNIKT

SEQ ID NO: 331090 - protein, 9 aa, Homo Sapiens
IKNDNNTFT

SEQ ID NO: 331091 - protein, 9 aa, Homo Sapiens
LFFLLHIWC

SEQ ID NO: 331092 - protein, 9 aa, Homo Sapiens
SFKMSTVHK

SEQ ID NO: 331093 - protein, 9 aa, Homo Sapiens
QILWGNNHF

SEQ ID NO: 331094 - protein, 9 aa, Homo Sapiens
NINGESRST

SEQ ID NO: 331095 - protein, 9 aa, Homo Sapiens
HLMLISVSV

SEQ ID NO: 331096 - protein, 9 aa, Homo Sapiens
AEIASCRDR

SEQ ID NO: 331097 - protein, 9 aa, Homo Sapiens
RLQAELGAL

SEQ ID NO: 331098 - protein, 9 aa, Homo Sapiens
CIRGTVGPK

SEQ ID NO: 331099 - protein, 9 aa, Homo Sapiens
TLALHPLTE

SEQ ID NO: 331100 - protein, 9 aa, Homo Sapiens
PLEDIKARP

SEQ ID NO: 331101 - protein, 9 aa, Homo Sapiens
ARAKEIGQI

SEQ ID NO: 331102 - protein, 9 aa, Homo Sapiens
VTLASGLVL

SEQ ID NO: 331103 - protein, 9 aa, Homo Sapiens
NRDANKLST

SEQ ID NO: 331104 - protein, 9 aa, Homo Sapiens
GKREPFAET

SEQ ID NO: 331105 - protein, 9 aa, Homo Sapiens
VVFYQMAKC

SEQ ID NO: 331106 - protein, 9 aa, Homo Sapiens
NIVYLTNLL

SEQ ID NO: 331107 - protein, 9 aa, Homo Sapiens
IIFGTDIVR

SEQ ID NO: 331108 - protein, 9 aa, Homo Sapiens
VISVQHNKD

SEQ ID NO: 331109 - protein, 9 aa, Homo Sapiens
TKLQHFLDT

SEQ ID NO: 331110 - protein, 9 aa, Homo Sapiens
GKRKVTDSI

SEQ ID NO: 331111 - protein, 9 aa, Homo Sapiens
LAQLDDNVD

SEQ ID NO: 331112 - protein, 9 aa, Homo Sapiens
TVIHKGPIS

SEQ ID NO: 331113 - protein, 9 aa, Homo Sapiens
KVVQTACMS

SEQ ID NO: 331114 - protein, 9 aa, Homo Sapiens
GFQMNQLQG

SEQ ID NO: 331115 - protein, 9 aa, Homo Sapiens
KVAVCEATG

SEQ ID NO: 331116 - protein, 9 aa, Homo Sapiens
CPPAPPPTQ

SEQ ID NO: 331117 - protein, 9 aa, Homo Sapiens
FNLCPEVIL

SEQ ID NO: 331118 - protein, 9 aa, Homo Sapiens
RCFTSGQCQ

SEQ ID NO: 331119 - protein, 9 aa, Homo Sapiens
ETVFEAFLN

SEQ ID NO: 331120 - protein, 9 aa, Homo Sapiens
HCSHNGTDP

SEQ ID NO: 331121 - protein, 9 aa, Homo Sapiens
LEQPERICQ

SEQ ID NO: 331122 - protein, 9 aa, Homo Sapiens
LRQHHSDLY

SEQ ID NO: 331123 - protein, 9 aa, Homo Sapiens
YPKGYVQDL

SEQ ID NO: 331124 - protein, 9 aa, Homo Sapiens
LEHYVGAVM

SEQ ID NO: 331125 - protein, 9 aa, Homo Sapiens
ADNFYAISY

SEQ ID NO: 331126 - protein, 9 aa, Homo Sapiens
EKKRQKRNN

SEQ ID NO: 331127 - protein, 9 aa, Homo Sapiens
LEVITLWFQ

SEQ ID NO: 331128 - protein, 9 aa, Homo Sapiens
GRRIHKETS

SEQ ID NO: 331129 - protein, 9 aa, Homo Sapiens
EELPFKEGK

SEQ ID NO: 331130 - protein, 9 aa, Homo Sapiens
CGNSFRGKS

SEQ ID NO: 331131 - protein, 9 aa, Homo Sapiens
NLIDCGQKK

SEQ ID NO: 331132 - protein, 9 aa, Homo Sapiens
VFESMLPDK

SEQ ID NO: 331133 - protein, 9 aa, Homo Sapiens
GDSQGLFNL

SEQ ID NO: 331134 - protein, 9 aa, Homo Sapiens
LIFRYLHNR

SEQ ID NO: 331135 - protein, 9 aa, Homo Sapiens
STPKITKST

SEQ ID NO: 331136 - protein, 9 aa, Homo Sapiens
AISKKVEEE

SEQ ID NO: 331137 - protein, 9 aa, Homo Sapiens
VEQYLLEKS

SEQ ID NO: 331138 - protein, 9 aa, Homo Sapiens
KLVMETREG

SEQ ID NO: 331139 - protein, 9 aa, Homo Sapiens
NGASTVQEE

SEQ ID NO: 331140 - protein, 9 aa, Homo Sapiens
EALTPLIKA

SEQ ID NO: 331141 - protein, 9 aa, Homo Sapiens
FKTLIKGLQ

SEQ ID NO: 331142 - protein, 9 aa, Homo Sapiens
DECKIILRK

SEQ ID NO: 331143 - protein, 9 aa, Homo Sapiens
FLRIRVVFQ

SEQ ID NO: 331144 - protein, 9 aa, Homo Sapiens
VSQWSRSAS

SEQ ID NO: 331145 - protein, 9 aa, Homo Sapiens
FQTWFEQSP

SEQ ID NO: 331146 - protein, 9 aa, Homo Sapiens
KVFHELFGG

SEQ ID NO: 331147 - protein, 9 aa, Homo Sapiens
EAINCLHAA

SEQ ID NO: 331148 - protein, 9 aa, Homo Sapiens
VKLKYRKVQ

SEQ ID NO: 331149 - protein, 9 aa, Homo Sapiens
QDHQLSFKH

SEQ ID NO: 331150 - protein, 9 aa, Homo Sapiens
DQKQEVWEA

SEQ ID NO: 331151 - protein, 9 aa, Homo Sapiens
KIKKGGLDG

SEQ ID NO: 331152 - protein, 9 aa, Homo Sapiens
YTEGNASQA

SEQ ID NO: 331153 - protein, 9 aa, Homo Sapiens
VPWKFPSSL

SEQ ID NO: 331154 - protein, 9 aa, Homo Sapiens
YQPQDLLGL

SEQ ID NO: 331155 - protein, 9 aa, Homo Sapiens
RKHKYFKKH

SEQ ID NO: 331156 - protein, 9 aa, Homo Sapiens
TVEILLKIT

SEQ ID NO: 331157 - protein, 9 aa, Homo Sapiens
EVLQNELQT

SEQ ID NO: 331158 - protein, 9 aa, Homo Sapiens
TSCIIRLLL

SEQ ID NO: 331159 - protein, 9 aa, Homo Sapiens
SVLVKMYKA

SEQ ID NO: 331160 - protein, 9 aa, Homo Sapiens
TPWASTFPP

SEQ ID NO: 331161 - protein, 9 aa, Homo Sapiens
ECTMIDPTS

SEQ ID NO: 331162 - protein, 9 aa, Homo Sapiens
GVYVLHFDN

SEQ ID NO: 331163 - protein, 9 aa, Homo Sapiens
YVACGGLNN

SEQ ID NO: 331164 - protein, 9 aa, Homo Sapiens
TSYFHTTPN

SEQ ID NO: 331165 - protein, 9 aa, Homo Sapiens
EGLEDNWNW

SEQ ID NO: 331166 - protein, 9 aa, Homo Sapiens
DRKKVQQYT

SEQ ID NO: 331167 - protein, 9 aa, Homo Sapiens
MDFTDIIKL

SEQ ID NO: 331168 - protein, 9 aa, Homo Sapiens
LKFLLDVSL

SEQ ID NO: 331169 - protein, 9 aa, Homo Sapiens
GDQILWGNN

SEQ ID NO: 331170 - protein, 9 aa, Homo Sapiens
PRCSHCQKN

SEQ ID NO: 331171 - protein, 9 aa, Homo Sapiens
QQGPQHYPM

SEQ ID NO: 331172 - protein, 9 aa, Homo Sapiens
YEFKKDLSK

SEQ ID NO: 331173 - protein, 9 aa, Homo Sapiens
WFIGLVTLL

SEQ ID NO: 331174 - protein, 9 aa, Homo Sapiens
ELNEKQRME

SEQ ID NO: 331175 - protein, 9 aa, Homo Sapiens
GPMFKLLPG

SEQ ID NO: 331176 - protein, 9 aa, Homo Sapiens
QSKIFADRP

SEQ ID NO: 331177 - protein, 9 aa, Homo Sapiens
SVISDGPAA

SEQ ID NO: 331178 - protein, 9 aa, Homo Sapiens
AHVYLEQIH

SEQ ID NO: 331179 - protein, 9 aa, Homo Sapiens
LCHNNITSI

SEQ ID NO: 331180 - protein, 9 aa, Homo Sapiens
IDINDHGPV

SEQ ID NO: 331181 - protein, 9 aa, Homo Sapiens
TTLEMSSSM

SEQ ID NO: 331182 - protein, 9 aa, Homo Sapiens
LDLKSTREA

SEQ ID NO: 331183 - protein, 9 aa, Homo Sapiens
ISAPPEAYW

SEQ ID NO: 331184 - protein, 9 aa, Homo Sapiens
PDDAARCSM

SEQ ID NO: 331185 - protein, 9 aa, Homo Sapiens
HSSEFLPPI

SEQ ID NO: 331186 - protein, 9 aa, Homo Sapiens
IWCSNKKNA

SEQ ID NO: 331187 - protein, 9 aa, Homo Sapiens
EREAESGGL

SEQ ID NO: 331188 - protein, 9 aa, Homo Sapiens
AIQTGKELF

SEQ ID NO: 331189 - protein, 9 aa, Homo Sapiens
QSREETQNA

SEQ ID NO: 331190 - protein, 9 aa, Homo Sapiens
MFLTLLHFD

SEQ ID NO: 331191 - protein, 9 aa, Homo Sapiens
QQLVEQVEQ

SEQ ID NO: 331192 - protein, 9 aa, Homo Sapiens
LQRSSTPIE

SEQ ID NO: 331193 - protein, 9 aa, Homo Sapiens
RDGAKGDPG

SEQ ID NO: 331194 - protein, 9 aa, Homo Sapiens
LEYTCRLLD

SEQ ID NO: 331195 - protein, 9 aa, Homo Sapiens
KQRVSNVLI

SEQ ID NO: 331196 - protein, 9 aa, Homo Sapiens
CHPDRITTI

SEQ ID NO: 331197 - protein, 9 aa, Homo Sapiens
PATDVGKIN

SEQ ID NO: 331198 - protein, 9 aa, Homo Sapiens
IELIYAALT

SEQ ID NO: 331199 - protein, 9 aa, Homo Sapiens
ALPSCLLSL

SEQ ID NO: 331200 - protein, 9 aa, Homo Sapiens
LSAQSPRCR

SEQ ID NO: 331201 - protein, 9 aa, Homo Sapiens
HNSNTGIRS

SEQ ID NO: 331202 - protein, 9 aa, Homo Sapiens
VTNKHFSDS

SEQ ID NO: 331203 - protein, 9 aa, Homo Sapiens
PCHCPPAPP

SEQ ID NO: 331204 - protein, 9 aa, Homo Sapiens
APPEAYWNR

SEQ ID NO: 331205 - protein, 9 aa, Homo Sapiens
EAHREGFSY

SEQ ID NO: 331206 - protein, 9 aa, Homo Sapiens
HNHLLTYLP

SEQ ID NO: 331207 - protein, 9 aa, Homo Sapiens
QFRSLQTSP

SEQ ID NO: 331208 - protein, 9 aa, Homo Sapiens
PGVSLVCKK

SEQ ID NO: 331209 - protein, 9 aa, Homo Sapiens
HSQMDTYTS

SEQ ID NO: 331210 - protein, 9 aa, Homo Sapiens
STLFQQSEC

SEQ ID NO: 331211 - protein, 9 aa, Homo Sapiens
AFRELITQL

SEQ ID NO: 331212 - protein, 9 aa, Homo Sapiens
YSLKCNLDK

SEQ ID NO: 331213 - protein, 9 aa, Homo Sapiens
LAKWMVHGY

SEQ ID NO: 331214 - protein, 9 aa, Homo Sapiens
NAYTFRDPN

SEQ ID NO: 331215 - protein, 9 aa, Homo Sapiens
VVSTPIPIC

SEQ ID NO: 331216 - protein, 9 aa, Homo Sapiens
VFFTKTEWK

SEQ ID NO: 331217 - protein, 9 aa, Homo Sapiens
IKAEIASCR

SEQ ID NO: 331218 - protein, 9 aa, Homo Sapiens
TKKTTLLLH

SEQ ID NO: 331219 - protein, 9 aa, Homo Sapiens
DGKPFDLHI

SEQ ID NO: 331220 - protein, 9 aa, Homo Sapiens
RIDGLVLQI

SEQ ID NO: 331221 - protein, 9 aa, Homo Sapiens
NSVALLCKL

SEQ ID NO: 331222 - protein, 9 aa, Homo Sapiens
MRDLHKSSF

SEQ ID NO: 331223 - protein, 9 aa, Homo Sapiens
QQKVWMANE

SEQ ID NO: 331224 - protein, 9 aa, Homo Sapiens
VYYKQLVLH

SEQ ID NO: 331225 - protein, 9 aa, Homo Sapiens
RMNYYPYLA

SEQ ID NO: 331226 - protein, 9 aa, Homo Sapiens
KLSVTFIEA

SEQ ID NO: 331227 - protein, 9 aa, Homo Sapiens
RIIEEAENG

SEQ ID NO: 331228 - protein, 9 aa, Homo Sapiens
GKRYCINLA

SEQ ID NO: 331229 - protein, 9 aa, Homo Sapiens
ADHDVPKHK

SEQ ID NO: 331230 - protein, 9 aa, Homo Sapiens
VIHTILLGY

SEQ ID NO: 331231 - protein, 9 aa, Homo Sapiens
QKDFMRPFE

SEQ ID NO: 331232 - protein, 9 aa, Homo Sapiens
DLQNYQYTL

SEQ ID NO: 331233 - protein, 9 aa, Homo Sapiens
VGYWPLWDL

SEQ ID NO: 331234 - protein, 9 aa, Homo Sapiens
IHLGDDFNR

SEQ ID NO: 331235 - protein, 9 aa, Homo Sapiens
NINDYSLRD

SEQ ID NO: 331236 - protein, 9 aa, Homo Sapiens
EGMSLGIDT

SEQ ID NO: 331237 - protein, 9 aa, Homo Sapiens
PGYIRSHYN

SEQ ID NO: 331238 - protein, 9 aa, Homo Sapiens
CTMYWYIFV

SEQ ID NO: 331239 - protein, 9 aa, Homo Sapiens
QTKMIWFNS

SEQ ID NO: 331240 - protein, 9 aa, Homo Sapiens
DPDEGIKYL

SEQ ID NO: 331241 - protein, 9 aa, Homo Sapiens
VRPSEYINL

SEQ ID NO: 331242 - protein, 9 aa, Homo Sapiens
RICGFLILL

SEQ ID NO: 331243 - protein, 9 aa, Homo Sapiens
TNTTRFVLK

SEQ ID NO: 331244 - protein, 9 aa, Homo Sapiens
AENTARCEW

SEQ ID NO: 331245 - protein, 9 aa, Homo Sapiens
PPPKTEDHG

SEQ ID NO: 331246 - protein, 9 aa, Homo Sapiens
RKSKYKIAS

SEQ ID NO: 331247 - protein, 9 aa, Homo Sapiens
INYYVQMCK

SEQ ID NO: 331248 - protein, 9 aa, Homo Sapiens
ASVIGYLTS

SEQ ID NO: 331249 - protein, 9 aa, Homo Sapiens
LKHTIEALM

SEQ ID NO: 331250 - protein, 9 aa, Homo Sapiens
KLDKKDLFG

SEQ ID NO: 331251 - protein, 9 aa, Homo Sapiens
DTLHTMYFA

SEQ ID NO: 331252 - protein, 9 aa, Homo Sapiens
KDMDISAMP

SEQ ID NO: 331253 - protein, 9 aa, Homo Sapiens
FLNSYSTSS

SEQ ID NO: 331254 - protein, 9 aa, Homo Sapiens
KNYQTLTSI

SEQ ID NO: 331255 - protein, 9 aa, Homo Sapiens
ETLSQIQNS

SEQ ID NO: 331256 - protein, 9 aa, Homo Sapiens
SFIMYATIQ

SEQ ID NO: 331257 - protein, 9 aa, Homo Sapiens
PSAGQFFTS

SEQ ID NO: 331258 - protein, 9 aa, Homo Sapiens
SSNGSAKVP

SEQ ID NO: 331259 - protein, 9 aa, Homo Sapiens
CMTISICIN

SEQ ID NO: 331260 - protein, 9 aa, Homo Sapiens
EWYSSLFVF

SEQ ID NO: 331261 - protein, 9 aa, Homo Sapiens
IQIIVPLNN

SEQ ID NO: 331262 - protein, 9 aa, Homo Sapiens
PPKSEKCSS

SEQ ID NO: 331263 - protein, 9 aa, Homo Sapiens
AQAEIGTSS

SEQ ID NO: 331264 - protein, 9 aa, Homo Sapiens
ENYWDSESP

SEQ ID NO: 331265 - protein, 9 aa, Homo Sapiens
SPELPKPTP

SEQ ID NO: 331266 - protein, 9 aa, Homo Sapiens
YCTDLEELN

SEQ ID NO: 331267 - protein, 9 aa, Homo Sapiens
SGTSDQIRF

SEQ ID NO: 331268 - protein, 9 aa, Homo Sapiens
KLKYIKTYL

SEQ ID NO: 331269 - protein, 9 aa, Homo Sapiens
RNLFQHQVI

SEQ ID NO: 331270 - protein, 9 aa, Homo Sapiens
KIWLWLRGL

SEQ ID NO: 331271 - protein, 9 aa, Homo Sapiens
AYCTDLEEL

SEQ ID NO: 331272 - protein, 9 aa, Homo Sapiens
HPALICCEQ

SEQ ID NO: 331273 - protein, 9 aa, Homo Sapiens
TQASNIYSG

SEQ ID NO: 331274 - protein, 9 aa, Homo Sapiens
FRISFSTTS

SEQ ID NO: 331275 - protein, 9 aa, Homo Sapiens
KFDKILYNK

SEQ ID NO: 331276 - protein, 9 aa, Homo Sapiens
ENLEHSPEV

SEQ ID NO: 331277 - protein, 9 aa, Homo Sapiens
EEPQTLVTE

SEQ ID NO: 331278 - protein, 9 aa, Homo Sapiens
DRPFKCKDC

SEQ ID NO: 331279 - protein, 9 aa, Homo Sapiens
QIDLNKENK

SEQ ID NO: 331280 - protein, 9 aa, Homo Sapiens
NRALYFTCD

SEQ ID NO: 331281 - protein, 9 aa, Homo Sapiens
AVIRFLREH

SEQ ID NO: 331282 - protein, 9 aa, Homo Sapiens
LQSLVIEKL

SEQ ID NO: 331283 - protein, 9 aa, Homo Sapiens
CMMNESSID

SEQ ID NO: 331284 - protein, 9 aa, Homo Sapiens
DATTRHHLG

SEQ ID NO: 331285 - protein, 9 aa, Homo Sapiens
TARTMCQDS

SEQ ID NO: 331286 - protein, 9 aa, Homo Sapiens
HSFLLTIMG

SEQ ID NO: 331287 - protein, 9 aa, Homo Sapiens
LWSEVEAER

SEQ ID NO: 331288 - protein, 9 aa, Homo Sapiens
KCIKLWLQY

SEQ ID NO: 331289 - protein, 9 aa, Homo Sapiens
EIFQCQVNL

SEQ ID NO: 331290 - protein, 9 aa, Homo Sapiens
AKRLYKSNK

SEQ ID NO: 331291 - protein, 9 aa, Homo Sapiens
ESITQGPPV

SEQ ID NO: 331292 - protein, 9 aa, Homo Sapiens
WVTPPVSNG

SEQ ID NO: 331293 - protein, 9 aa, Homo Sapiens
NSTRDLETF

SEQ ID NO: 331294 - protein, 9 aa, Homo Sapiens
TGRGKPPLS

SEQ ID NO: 331295 - protein, 9 aa, Homo Sapiens
LRGKSAFSG

SEQ ID NO: 331296 - protein, 9 aa, Homo Sapiens
RTDDLKWSC

SEQ ID NO: 331297 - protein, 9 aa, Homo Sapiens
SILTYSQIG

SEQ ID NO: 331298 - protein, 9 aa, Homo Sapiens
KITQQQKVV

SEQ ID NO: 331299 - protein, 9 aa, Homo Sapiens
KPRAKQKTH

SEQ ID NO: 331300 - protein, 9 aa, Homo Sapiens
YYQKSSVSS

SEQ ID NO: 331301 - protein, 9 aa, Homo Sapiens
RTEELKEAK

SEQ ID NO: 331302 - protein, 9 aa, Homo Sapiens
QHFTNRLDM

SEQ ID NO: 331303 - protein, 9 aa, Homo Sapiens
KFTLTEQTL

SEQ ID NO: 331304 - protein, 9 aa, Homo Sapiens
VDLQNYQYT

SEQ ID NO: 331305 - protein, 9 aa, Homo Sapiens
LQKKAQEVL

SEQ ID NO: 331306 - protein, 9 aa, Homo Sapiens
DAVTGVAIA

SEQ ID NO: 331307 - protein, 9 aa, Homo Sapiens
MSDPGVSYC

SEQ ID NO: 331308 - protein, 9 aa, Homo Sapiens
NLPVSVEET

SEQ ID NO: 331309 - protein, 9 aa, Homo Sapiens
WTVPIAGGP

SEQ ID NO: 331310 - protein, 9 aa, Homo Sapiens
DIGTLNGIF

SEQ ID NO: 331311 - protein, 9 aa, Homo Sapiens
AFRSAKYIQ

SEQ ID NO: 331312 - protein, 9 aa, Homo Sapiens
DLILCNNTA

SEQ ID NO: 331313 - protein, 9 aa, Homo Sapiens
DDGLIQIEL

SEQ ID NO: 331314 - protein, 9 aa, Homo Sapiens
WSASDLSDG

SEQ ID NO: 331315 - protein, 9 aa, Homo Sapiens
KGTHCSQNA

SEQ ID NO: 331316 - protein, 9 aa, Homo Sapiens
ETFYSDSSE

SEQ ID NO: 331317 - protein, 9 aa, Homo Sapiens
HRTLKTDAL

SEQ ID NO: 331318 - protein, 9 aa, Homo Sapiens
TLEHLLKAL

SEQ ID NO: 331319 - protein, 9 aa, Homo Sapiens
ELTSNNSAL

SEQ ID NO: 331320 - protein, 9 aa, Homo Sapiens
EGMDVEEGK

SEQ ID NO: 331321 - protein, 9 aa, Homo Sapiens
DHLGNTNVD

SEQ ID NO: 331322 - protein, 9 aa, Homo Sapiens
CYIQIKEYV

SEQ ID NO: 331323 - protein, 9 aa, Homo Sapiens
IKTFYRFKD

SEQ ID NO: 331324 - protein, 9 aa, Homo Sapiens
CSENCLSAQ

SEQ ID NO: 331325 - protein, 9 aa, Homo Sapiens
TLLSSVICC

SEQ ID NO: 331326 - protein, 9 aa, Homo Sapiens
SPGIMLQNP

SEQ ID NO: 331327 - protein, 9 aa, Homo Sapiens
DNLISRELR

SEQ ID NO: 331328 - protein, 9 aa, Homo Sapiens
NVLNHFFCG

SEQ ID NO: 331329 - protein, 9 aa, Homo Sapiens
RSVAVTKEC

SEQ ID NO: 331330 - protein, 9 aa, Homo Sapiens
EPSQCLEID

SEQ ID NO: 331331 - protein, 9 aa, Homo Sapiens
EAQCICLSL

SEQ ID NO: 331332 - protein, 9 aa, Homo Sapiens
PHELYWHLK

SEQ ID NO: 331333 - protein, 9 aa, Homo Sapiens
YLPQPYRMI

SEQ ID NO: 331334 - protein, 9 aa, Homo Sapiens
VDYYPDITY

SEQ ID NO: 331335 - protein, 9 aa, Homo Sapiens
CVVHARVIN

SEQ ID NO: 331336 - protein, 9 aa, Homo Sapiens
IFYSKITTR

SEQ ID NO: 331337 - protein, 9 aa, Homo Sapiens
LTIKPLDKK

SEQ ID NO: 331338 - protein, 9 aa, Homo Sapiens
SSGLTVHRQ

SEQ ID NO: 331339 - protein, 9 aa, Homo Sapiens
NTEEKFQAV

SEQ ID NO: 331340 - protein, 9 aa, Homo Sapiens
CISCDCNRA

SEQ ID NO: 331341 - protein, 9 aa, Homo Sapiens
KTKQQQYAD

SEQ ID NO: 331342 - protein, 9 aa, Homo Sapiens
HMQHRSFII

SEQ ID NO: 331343 - protein, 9 aa, Homo Sapiens
QQNLHNCVN

SEQ ID NO: 331344 - protein, 9 aa, Homo Sapiens
FFNTASTGK

SEQ ID NO: 331345 - protein, 9 aa, Homo Sapiens
SYENERPNS

SEQ ID NO: 331346 - protein, 9 aa, Homo Sapiens
GVRILRAVV

SEQ ID NO: 331347 - protein, 9 aa, Homo Sapiens
PSWKFPDCM

SEQ ID NO: 331348 - protein, 9 aa, Homo Sapiens
IPEKRATAT

SEQ ID NO: 331349 - protein, 9 aa, Homo Sapiens
TKDLLVNQT

SEQ ID NO: 331350 - protein, 9 aa, Homo Sapiens
NCICVDCKG

SEQ ID NO: 331351 - protein, 9 aa, Homo Sapiens
NLEQVHRHM

SEQ ID NO: 331352 - protein, 9 aa, Homo Sapiens
ETIHTGKKP

SEQ ID NO: 331353 - protein, 9 aa, Homo Sapiens
RQGKSMSQP

SEQ ID NO: 331354 - protein, 9 aa, Homo Sapiens
DKELTIKPL

SEQ ID NO: 331355 - protein, 9 aa, Homo Sapiens
DSIINKWLS

SEQ ID NO: 331356 - protein, 9 aa, Homo Sapiens
KRINAGEKP

SEQ ID NO: 331357 - protein, 9 aa, Homo Sapiens
SKEVVTHMW

SEQ ID NO: 331358 - protein, 9 aa, Homo Sapiens
FQDDQEFEL

SEQ ID NO: 331359 - protein, 9 aa, Homo Sapiens
PRTVLKPHK

SEQ ID NO: 331360 - protein, 9 aa, Homo Sapiens
TVTVSHHPQ

SEQ ID NO: 331361 - protein, 9 aa, Homo Sapiens
QTLGIKGYQ

SEQ ID NO: 331362 - protein, 9 aa, Homo Sapiens
KAVPVNCAL

SEQ ID NO: 331363 - protein, 9 aa, Homo Sapiens
YTLDAFGTA

SEQ ID NO: 331364 - protein, 9 aa, Homo Sapiens
RWIWDALRP

SEQ ID NO: 331365 - protein, 9 aa, Homo Sapiens
GQSFGYGQH

SEQ ID NO: 331366 - protein, 9 aa, Homo Sapiens
VIGYLTSRP

SEQ ID NO: 331367 - protein, 9 aa, Homo Sapiens
QTPNEECLL

SEQ ID NO: 331368 - protein, 9 aa, Homo Sapiens
MLSGDRVRL

SEQ ID NO: 331369 - protein, 9 aa, Homo Sapiens
DIACIRKTL

SEQ ID NO: 331370 - protein, 9 aa, Homo Sapiens
PICDPTVHW

SEQ ID NO: 331371 - protein, 9 aa, Homo Sapiens
VCCEEKTVG

SEQ ID NO: 331372 - protein, 9 aa, Homo Sapiens
RTQNHGHNV

SEQ ID NO: 331373 - protein, 9 aa, Homo Sapiens
YTLNSIALH

SEQ ID NO: 331374 - protein, 9 aa, Homo Sapiens
ESLSRSIKG

SEQ ID NO: 331375 - protein, 9 aa, Homo Sapiens
VQNIQNVLV

SEQ ID NO: 331376 - protein, 9 aa, Homo Sapiens
FLKSREHSS

SEQ ID NO: 331377 - protein, 9 aa, Homo Sapiens
RIIIVGTLQ

SEQ ID NO: 331378 - protein, 9 aa, Homo Sapiens
IHKGPISMT

SEQ ID NO: 331379 - protein, 9 aa, Homo Sapiens
KDMWIVEEL

SEQ ID NO: 331380 - protein, 9 aa, Homo Sapiens
KHEQNTDCG

SEQ ID NO: 331381 - protein, 9 aa, Homo Sapiens
SYWRIMSVK

SEQ ID NO: 331382 - protein, 9 aa, Homo Sapiens
LSSPSVEHF

SEQ ID NO: 331383 - protein, 9 aa, Homo Sapiens
LANNAKTSS

SEQ ID NO: 331384 - protein, 9 aa, Homo Sapiens
MHNSNTGIR

SEQ ID NO: 331385 - protein, 9 aa, Homo Sapiens
HLSSSKENA

SEQ ID NO: 331386 - protein, 9 aa, Homo Sapiens
FYTPVQEFN

SEQ ID NO: 331387 - protein, 9 aa, Homo Sapiens
LEVCCVCPM

SEQ ID NO: 331388 - protein, 9 aa, Homo Sapiens
LIGLWEVGK

SEQ ID NO: 331389 - protein, 9 aa, Homo Sapiens
KQWSNLSSL

SEQ ID NO: 331390 - protein, 9 aa, Homo Sapiens
LISWLDEEE

SEQ ID NO: 331391 - protein, 9 aa, Homo Sapiens
WLSKSSATL

SEQ ID NO: 331392 - protein, 9 aa, Homo Sapiens
YPLCPKDVV

SEQ ID NO: 331393 - protein, 9 aa, Homo Sapiens
LAWIVVVLQ

SEQ ID NO: 331394 - protein, 9 aa, Homo Sapiens
YLPSPHPVR

SEQ ID NO: 331395 - protein, 9 aa, Homo Sapiens
VDCNHKRKG

SEQ ID NO: 331396 - protein, 9 aa, Homo Sapiens
RSNYALTIL

SEQ ID NO: 331397 - protein, 9 aa, Homo Sapiens
HPDEAAFFN

SEQ ID NO: 331398 - protein, 9 aa, Homo Sapiens
VNWSNIRQL

SEQ ID NO: 331399 - protein, 9 aa, Homo Sapiens
IPGEFEKII

SEQ ID NO: 331400 - protein, 9 aa, Homo Sapiens
LEPESECII

SEQ ID NO: 331401 - protein, 9 aa, Homo Sapiens
NMELYKLLG

SEQ ID NO: 331402 - protein, 9 aa, Homo Sapiens
KMKLCGTKD

SEQ ID NO: 331403 - protein, 9 aa, Homo Sapiens
FPGLHKIEA

SEQ ID NO: 331404 - protein, 9 aa, Homo Sapiens
ESEVSVLAL

SEQ ID NO: 331405 - protein, 9 aa, Homo Sapiens
NLRLILQQS

SEQ ID NO: 331406 - protein, 9 aa, Homo Sapiens
HNCGHHKDA

SEQ ID NO: 331407 - protein, 9 aa, Homo Sapiens
YLQAVKESV

SEQ ID NO: 331408 - protein, 9 aa, Homo Sapiens
VLLTKIHLS

SEQ ID NO: 331409 - protein, 9 aa, Homo Sapiens
SAGIGYGCN

SEQ ID NO: 331410 - protein, 9 aa, Homo Sapiens
ITANLIAFL

SEQ ID NO: 331411 - protein, 9 aa, Homo Sapiens
YYKVNNLGV

SEQ ID NO: 331412 - protein, 9 aa, Homo Sapiens
CGALVDVKC

SEQ ID NO: 331413 - protein, 9 aa, Homo Sapiens
RPHQSRLLT

SEQ ID NO: 331414 - protein, 9 aa, Homo Sapiens
DHGTPAPFT

SEQ ID NO: 331415 - protein, 9 aa, Homo Sapiens
VFIIHMISH

SEQ ID NO: 331416 - protein, 9 aa, Homo Sapiens
GTQGKKTEE

SEQ ID NO: 331417 - protein, 9 aa, Homo Sapiens
GRTCQAWSF

SEQ ID NO: 331418 - protein, 9 aa, Homo Sapiens
LKENDEREL

SEQ ID NO: 331419 - protein, 9 aa, Homo Sapiens
SKLLFKKNI

SEQ ID NO: 331420 - protein, 9 aa, Homo Sapiens
YFGGAVAYT

SEQ ID NO: 331421 - protein, 9 aa, Homo Sapiens
NEARKGNKE

SEQ ID NO: 331422 - protein, 9 aa, Homo Sapiens
MQNDLFNKE

SEQ ID NO: 331423 - protein, 9 aa, Homo Sapiens
LVMSVITSY

SEQ ID NO: 331424 - protein, 9 aa, Homo Sapiens
VSVSTSNII

SEQ ID NO: 331425 - protein, 9 aa, Homo Sapiens
NLYASVLLL

SEQ ID NO: 331426 - protein, 9 aa, Homo Sapiens
TPTFFSQTP

SEQ ID NO: 331427 - protein, 9 aa, Homo Sapiens
RELITQLEL

SEQ ID NO: 331428 - protein, 9 aa, Homo Sapiens
TPPKSEKCS

SEQ ID NO: 331429 - protein, 9 aa, Homo Sapiens
WLDEEEELS

SEQ ID NO: 331430 - protein, 9 aa, Homo Sapiens
SSSFQRHMV

SEQ ID NO: 331431 - protein, 9 aa, Homo Sapiens
EIKHEMDSF

SEQ ID NO: 331432 - protein, 9 aa, Homo Sapiens
CKKHKLYVS

SEQ ID NO: 331433 - protein, 9 aa, Homo Sapiens
ISEAVFLVP

SEQ ID NO: 331434 - protein, 9 aa, Homo Sapiens
SIISHECTR

SEQ ID NO: 331435 - protein, 9 aa, Homo Sapiens
EDPDEGIKY

SEQ ID NO: 331436 - protein, 9 aa, Homo Sapiens
PPTSPPERA

SEQ ID NO: 331437 - protein, 9 aa, Homo Sapiens
KYVAMVINR

SEQ ID NO: 331438 - protein, 9 aa, Homo Sapiens
GDRPFKCKD

SEQ ID NO: 331439 - protein, 9 aa, Homo Sapiens
REMYSLGSN

SEQ ID NO: 331440 - protein, 9 aa, Homo Sapiens
YLQIHEIIH

SEQ ID NO: 331441 - protein, 9 aa, Homo Sapiens
CVCILMSIV

SEQ ID NO: 331442 - protein, 9 aa, Homo Sapiens
FPIRRDNGS

SEQ ID NO: 331443 - protein, 9 aa, Homo Sapiens
YYFLGFLFL

SEQ ID NO: 331444 - protein, 9 aa, Homo Sapiens
QTWFEQSPI

SEQ ID NO: 331445 - protein, 9 aa, Homo Sapiens
LEALRYLNV

SEQ ID NO: 331446 - protein, 9 aa, Homo Sapiens
LQISANSNP

SEQ ID NO: 331447 - protein, 9 aa, Homo Sapiens
SLISLEEEE

SEQ ID NO: 331448 - protein, 9 aa, Homo Sapiens
ALFCKVHGF

SEQ ID NO: 331449 - protein, 9 aa, Homo Sapiens
GPPSMAGHS

SEQ ID NO: 331450 - protein, 9 aa, Homo Sapiens
CLLPLLLPS

SEQ ID NO: 331451 - protein, 9 aa, Homo Sapiens
PALQNKVQA

SEQ ID NO: 331452 - protein, 9 aa, Homo Sapiens
QFRRTEQFC

SEQ ID NO: 331453 - protein, 9 aa, Homo Sapiens
EWVQSICQL

SEQ ID NO: 331454 - protein, 9 aa, Homo Sapiens
HGYTEALGV

SEQ ID NO: 331455 - protein, 9 aa, Homo Sapiens
YWLRNDSNF

SEQ ID NO: 331456 - protein, 9 aa, Homo Sapiens
WKKFCSNFC

SEQ ID NO: 331457 - protein, 9 aa, Homo Sapiens
QINQVAHDQ

SEQ ID NO: 331458 - protein, 9 aa, Homo Sapiens
VRALPADKM

SEQ ID NO: 331459 - protein, 9 aa, Homo Sapiens
MVGPILEMA

SEQ ID NO: 331460 - protein, 9 aa, Homo Sapiens
SGLTVHRQT

SEQ ID NO: 331461 - protein, 9 aa, Homo Sapiens
EKCLPVYYK

SEQ ID NO: 331462 - protein, 9 aa, Homo Sapiens
RNAGATQSN

SEQ ID NO: 331463 - protein, 9 aa, Homo Sapiens
LLLTLIDIN

SEQ ID NO: 331464 - protein, 9 aa, Homo Sapiens
DPTLNYGLV

SEQ ID NO: 331465 - protein, 9 aa, Homo Sapiens
ENSVGDILS

SEQ ID NO: 331466 - protein, 9 aa, Homo Sapiens
EPKTPVNTN

SEQ ID NO: 331467 - protein, 9 aa, Homo Sapiens
ENARSCIQA

SEQ ID NO: 331468 - protein, 9 aa, Homo Sapiens
DNFFLLRGN

SEQ ID NO: 331469 - protein, 9 aa, Homo Sapiens
LGNIVTWVS

SEQ ID NO: 331470 - protein, 9 aa, Homo Sapiens
SGQVVLEMD

SEQ ID NO: 331471 - protein, 9 aa, Homo Sapiens
DPSHSPYKK

SEQ ID NO: 331472 - protein, 9 aa, Homo Sapiens
DPSHSERFC

SEQ ID NO: 331473 - protein, 9 aa, Homo Sapiens
NHGYMALHW

SEQ ID NO: 331474 - protein, 9 aa, Homo Sapiens
SAESVCSLL

SEQ ID NO: 331475 - protein, 9 aa, Homo Sapiens
SMLFITLMS

SEQ ID NO: 331476 - protein, 9 aa, Homo Sapiens
KVKGDVDVY

SEQ ID NO: 331477 - protein, 9 aa, Homo Sapiens
AQVRIEVVG

SEQ ID NO: 331478 - protein, 9 aa, Homo Sapiens
GGLADLFGQ

SEQ ID NO: 331479 - protein, 9 aa, Homo Sapiens
HLLGNIVTW

SEQ ID NO: 331480 - protein, 9 aa, Homo Sapiens
PEASREDYG

SEQ ID NO: 331481 - protein, 9 aa, Homo Sapiens
AVPKYAKYI

SEQ ID NO: 331482 - protein, 9 aa, Homo Sapiens
LLKYLSSND

SEQ ID NO: 331483 - protein, 9 aa, Homo Sapiens
CVNWSNIRQ

SEQ ID NO: 331484 - protein, 9 aa, Homo Sapiens
LVRTGLTQI

SEQ ID NO: 331485 - protein, 9 aa, Homo Sapiens
QKFIKADYY

SEQ ID NO: 331486 - protein, 9 aa, Homo Sapiens
PSSPEELDK

SEQ ID NO: 331487 - protein, 9 aa, Homo Sapiens
SAESEEYNQ

SEQ ID NO: 331488 - protein, 9 aa, Homo Sapiens
AHSDYICCI

SEQ ID NO: 331489 - protein, 9 aa, Homo Sapiens
NVGLFDQHC

SEQ ID NO: 331490 - protein, 9 aa, Homo Sapiens
NCLHAAIDI

SEQ ID NO: 331491 - protein, 9 aa, Homo Sapiens
PIKSKEVVT

SEQ ID NO: 331492 - protein, 9 aa, Homo Sapiens
GQFSVQMFR

SEQ ID NO: 331493 - protein, 9 aa, Homo Sapiens
TKVPTMCVN

SEQ ID NO: 331494 - protein, 9 aa, Homo Sapiens
LNNKINMQQ

SEQ ID NO: 331495 - protein, 9 aa, Homo Sapiens
TGSYEDRVK

SEQ ID NO: 331496 - protein, 9 aa, Homo Sapiens
KITSLACKI

SEQ ID NO: 331497 - protein, 9 aa, Homo Sapiens
GNNENYSAE

SEQ ID NO: 331498 - protein, 9 aa, Homo Sapiens
LNCFLAPEI

SEQ ID NO: 331499 - protein, 9 aa, Homo Sapiens
RGCSYDSSM

SEQ ID NO: 331500 - protein, 9 aa, Homo Sapiens
CPVSLGAQQ

SEQ ID NO: 331501 - protein, 9 aa, Homo Sapiens
SFEKHRKEK

SEQ ID NO: 331502 - protein, 9 aa, Homo Sapiens
LETAVLLAR

SEQ ID NO: 331503 - protein, 9 aa, Homo Sapiens
KEYQSGWGT

SEQ ID NO: 331504 - protein, 9 aa, Homo Sapiens
VGATLVLMW

SEQ ID NO: 331505 - protein, 9 aa, Homo Sapiens
DYDSNMLSF

SEQ ID NO: 331506 - protein, 9 aa, Homo Sapiens
RRIVQSMID

SEQ ID NO: 331507 - protein, 9 aa, Homo Sapiens
SKPQGKVQY

SEQ ID NO: 331508 - protein, 9 aa, Homo Sapiens
VSVAQQLLN

SEQ ID NO: 331509 - protein, 9 aa, Homo Sapiens
HRQIHTGER

SEQ ID NO: 331510 - protein, 9 aa, Homo Sapiens
DVQNSTRSD

SEQ ID NO: 331511 - protein, 9 aa, Homo Sapiens
QYIQGYKII

SEQ ID NO: 331512 - protein, 9 aa, Homo Sapiens
ECVERLTAR

SEQ ID NO: 331513 - protein, 9 aa, Homo Sapiens
FYCGVGLLT

SEQ ID NO: 331514 - protein, 9 aa, Homo Sapiens
RLILHAAKH

SEQ ID NO: 331515 - protein, 9 aa, Homo Sapiens
RDDIDGINT

SEQ ID NO: 331516 - protein, 9 aa, Homo Sapiens
SELRALSMV

SEQ ID NO: 331517 - protein, 9 aa, Homo Sapiens
YEFKFPFQN

SEQ ID NO: 331518 - protein, 9 aa, Homo Sapiens
TSFMKGRTV

SEQ ID NO: 331519 - protein, 9 aa, Homo Sapiens
LEELQHHCQ

SEQ ID NO: 331520 - protein, 9 aa, Homo Sapiens
SIHDNKFFG

SEQ ID NO: 331521 - protein, 9 aa, Homo Sapiens
AVGFEACYV

SEQ ID NO: 331522 - protein, 9 aa, Homo Sapiens
NATEASGIS

SEQ ID NO: 331523 - protein, 9 aa, Homo Sapiens
RQKILKPKD

SEQ ID NO: 331524 - protein, 9 aa, Homo Sapiens
ILVGPPLKG

SEQ ID NO: 331525 - protein, 9 aa, Homo Sapiens
CPVVTVNHI

SEQ ID NO: 331526 - protein, 9 aa, Homo Sapiens
PPLETVLAN

SEQ ID NO: 331527 - protein, 9 aa, Homo Sapiens
HLTTLFDVL

SEQ ID NO: 331528 - protein, 9 aa, Homo Sapiens
SNGVAIHSL

SEQ ID NO: 331529 - protein, 9 aa, Homo Sapiens
NIKKGVSWN

SEQ ID NO: 331530 - protein, 9 aa, Homo Sapiens
WGDSQPANR

SEQ ID NO: 331531 - protein, 9 aa, Homo Sapiens
KYPDFHDDY

SEQ ID NO: 331532 - protein, 9 aa, Homo Sapiens
NPQQGQGRH

SEQ ID NO: 331533 - protein, 9 aa, Homo Sapiens
RRFFLRIRV

SEQ ID NO: 331534 - protein, 9 aa, Homo Sapiens
RRAKQAQRW

SEQ ID NO: 331535 - protein, 9 aa, Homo Sapiens
LVLQIDCGS

SEQ ID NO: 331536 - protein, 9 aa, Homo Sapiens
VGIQKIIGE

SEQ ID NO: 331537 - protein, 9 aa, Homo Sapiens
NPDYGMFTY

SEQ ID NO: 331538 - protein, 9 aa, Homo Sapiens
SEDVVYYAF

SEQ ID NO: 331539 - protein, 9 aa, Homo Sapiens
MVLEHYNMT

SEQ ID NO: 331540 - protein, 9 aa, Homo Sapiens
CTICEKVVN

SEQ ID NO: 331541 - protein, 9 aa, Homo Sapiens
RQGVYKNFR

SEQ ID NO: 331542 - protein, 9 aa, Homo Sapiens
RHSEKSQIE

SEQ ID NO: 331543 - protein, 9 aa, Homo Sapiens
FQMPVSSQQ

SEQ ID NO: 331544 - protein, 9 aa, Homo Sapiens
IFSYFFYKR

SEQ ID NO: 331545 - protein, 9 aa, Homo Sapiens
FNTSKFTLE

SEQ ID NO: 331546 - protein, 9 aa, Homo Sapiens
DLTFLRICS

SEQ ID NO: 331547 - protein, 9 aa, Homo Sapiens
CEGCGKAFV

SEQ ID NO: 331548 - protein, 9 aa, Homo Sapiens
PGEDVKGDD

SEQ ID NO: 331549 - protein, 9 aa, Homo Sapiens
EKIAFPIPN

SEQ ID NO: 331550 - protein, 9 aa, Homo Sapiens
DDKDSFNNS

SEQ ID NO: 331551 - protein, 9 aa, Homo Sapiens
NKVWMAEQK

SEQ ID NO: 331552 - protein, 9 aa, Homo Sapiens
RVTQQHNTM

SEQ ID NO: 331553 - protein, 9 aa, Homo Sapiens
IHDNAKFQK

SEQ ID NO: 331554 - protein, 9 aa, Homo Sapiens
RGKREGQGS

SEQ ID NO: 331555 - protein, 9 aa, Homo Sapiens
RQLEEVDER

SEQ ID NO: 331556 - protein, 9 aa, Homo Sapiens
QSRLLTILC

SEQ ID NO: 331557 - protein, 9 aa, Homo Sapiens
PLPPKFSNQ

SEQ ID NO: 331558 - protein, 9 aa, Homo Sapiens
PRIKSRDLP

SEQ ID NO: 331559 - protein, 9 aa, Homo Sapiens
RKGVEVKES

SEQ ID NO: 331560 - protein, 9 aa, Homo Sapiens
KGGRRRKQS

SEQ ID NO: 331561 - protein, 9 aa, Homo Sapiens
QPSLPGTTN

SEQ ID NO: 331562 - protein, 9 aa, Homo Sapiens
APTDINSSK

SEQ ID NO: 331563 - protein, 9 aa, Homo Sapiens
SLLLQIPQS

SEQ ID NO: 331564 - protein, 9 aa, Homo Sapiens
LLNVDTKST

SEQ ID NO: 331565 - protein, 9 aa, Homo Sapiens
RGPNAQAAI

SEQ ID NO: 331566 - protein, 9 aa, Homo Sapiens
GDVDVYLPK

SEQ ID NO: 331567 - protein, 9 aa, Homo Sapiens
HIDNINKAF

SEQ ID NO: 331568 - protein, 9 aa, Homo Sapiens
QEDCLELLL

SEQ ID NO: 331569 - protein, 9 aa, Homo Sapiens
EQWLQKIKA

SEQ ID NO: 331570 - protein, 9 aa, Homo Sapiens
VSVLQAETL

SEQ ID NO: 331571 - protein, 9 aa, Homo Sapiens
KFFCDVSSD

SEQ ID NO: 331572 - protein, 9 aa, Homo Sapiens
SVAVEASTD

SEQ ID NO: 331573 - protein, 9 aa, Homo Sapiens
DQGPKNIEQ

SEQ ID NO: 331574 - protein, 9 aa, Homo Sapiens
ITMGSTEAC

SEQ ID NO: 331575 - protein, 9 aa, Homo Sapiens
CGKAFSKSL

SEQ ID NO: 331576 - protein, 9 aa, Homo Sapiens
REGFSYRTG

SEQ ID NO: 331577 - protein, 9 aa, Homo Sapiens
IHQIIHTGE

SEQ ID NO: 331578 - protein, 9 aa, Homo Sapiens
NLTKRRHAE

SEQ ID NO: 331579 - protein, 9 aa, Homo Sapiens
ARIMLSLSQ

SEQ ID NO: 331580 - protein, 9 aa, Homo Sapiens
KDLQNGMII

SEQ ID NO: 331581 - protein, 9 aa, Homo Sapiens
SFGGFDLMN

SEQ ID NO: 331582 - protein, 9 aa, Homo Sapiens
AVSKDNAEL

SEQ ID NO: 331583 - protein, 9 aa, Homo Sapiens
SECIRGTVG

SEQ ID NO: 331584 - protein, 9 aa, Homo Sapiens
LSVPDLRRF

SEQ ID NO: 331585 - protein, 9 aa, Homo Sapiens
GADDLSAVH

SEQ ID NO: 331586 - protein, 9 aa, Homo Sapiens
VLLPEGAGR

SEQ ID NO: 331587 - protein, 9 aa, Homo Sapiens
VNKTIIILD

SEQ ID NO: 331588 - protein, 9 aa, Homo Sapiens
MMEEQKTKV

SEQ ID NO: 331589 - protein, 9 aa, Homo Sapiens
FMTATQHFT

SEQ ID NO: 331590 - protein, 9 aa, Homo Sapiens
LPTVRSTQI

SEQ ID NO: 331591 - protein, 9 aa, Homo Sapiens
FQIHHDVNE

SEQ ID NO: 331592 - protein, 9 aa, Homo Sapiens
INSYEMQNA

SEQ ID NO: 331593 - protein, 9 aa, Homo Sapiens
TFLKTEFSE

SEQ ID NO: 331594 - protein, 9 aa, Homo Sapiens
LGRQPSRIK

SEQ ID NO: 331595 - protein, 9 aa, Homo Sapiens
ANTIKNTVC

SEQ ID NO: 331596 - protein, 9 aa, Homo Sapiens
QLIEYGNKS

SEQ ID NO: 331597 - protein, 9 aa, Homo Sapiens
EEHRQILQE

SEQ ID NO: 331598 - protein, 9 aa, Homo Sapiens
IFGTDIVRQ

SEQ ID NO: 331599 - protein, 9 aa, Homo Sapiens
DRYKIDSLI

SEQ ID NO: 331600 - protein, 9 aa, Homo Sapiens
NVACSLPGV

SEQ ID NO: 331601 - protein, 9 aa, Homo Sapiens
DEKICQAFY

SEQ ID NO: 331602 - protein, 9 aa, Homo Sapiens
QKVNRPYLC

SEQ ID NO: 331603 - protein, 9 aa, Homo Sapiens
GPPSTQLHF

SEQ ID NO: 331604 - protein, 9 aa, Homo Sapiens
QEKKITALE

SEQ ID NO: 331605 - protein, 9 aa, Homo Sapiens
RTHQKCVIA

SEQ ID NO: 331606 - protein, 9 aa, Homo Sapiens
TSSSEIIRG

SEQ ID NO: 331607 - protein, 9 aa, Homo Sapiens
EGGLCTVLD

SEQ ID NO: 331608 - protein, 9 aa, Homo Sapiens
SDTLEHLLK

SEQ ID NO: 331609 - protein, 9 aa, Homo Sapiens
PLGQINEAV

SEQ ID NO: 331610 - protein, 9 aa, Homo Sapiens
KTVNNSSLI

SEQ ID NO: 331611 - protein, 9 aa, Homo Sapiens
RLAWIVVVL

SEQ ID NO: 331612 - protein, 9 aa, Homo Sapiens
VSLVCKELR

SEQ ID NO: 331613 - protein, 9 aa, Homo Sapiens
MWEGRDRVV

SEQ ID NO: 331614 - protein, 9 aa, Homo Sapiens
FDEFNQIEL

SEQ ID NO: 331615 - protein, 9 aa, Homo Sapiens
DASVKAYIF

SEQ ID NO: 331616 - protein, 9 aa, Homo Sapiens
FMGGNDNET

SEQ ID NO: 331617 - protein, 9 aa, Homo Sapiens
NPHISDDPS

SEQ ID NO: 331618 - protein, 9 aa, Homo Sapiens
LKEKSIWEI

SEQ ID NO: 331619 - protein, 9 aa, Homo Sapiens
DSSSSSLFP

SEQ ID NO: 331620 - protein, 9 aa, Homo Sapiens
SFGKTKSGY

SEQ ID NO: 331621 - protein, 9 aa, Homo Sapiens
GQRVEQEVE

SEQ ID NO: 331622 - protein, 9 aa, Homo Sapiens
IDRYVVCYT

SEQ ID NO: 331623 - protein, 9 aa, Homo Sapiens
YTYFYLFKK

SEQ ID NO: 331624 - protein, 9 aa, Homo Sapiens
TEDREMRNK

SEQ ID NO: 331625 - protein, 9 aa, Homo Sapiens
IVVFFVFVL

SEQ ID NO: 331626 - protein, 9 aa, Homo Sapiens
CVGSAYQAF

SEQ ID NO: 331627 - protein, 9 aa, Homo Sapiens
WWNRVCGHS

SEQ ID NO: 331628 - protein, 9 aa, Homo Sapiens
LKNIKLFDK

SEQ ID NO: 331629 - protein, 9 aa, Homo Sapiens
FQQWQVAEQ

SEQ ID NO: 331630 - protein, 9 aa, Homo Sapiens
LFPDIYRGC

SEQ ID NO: 331631 - protein, 9 aa, Homo Sapiens
QTGLDQYQH

SEQ ID NO: 331632 - protein, 9 aa, Homo Sapiens
SRCLFTKSK

SEQ ID NO: 331633 - protein, 9 aa, Homo Sapiens
IKVLKLIKG

SEQ ID NO: 331634 - protein, 9 aa, Homo Sapiens
TVTMTKCDV

SEQ ID NO: 331635 - protein, 9 aa, Homo Sapiens
CVSVAQQLL

SEQ ID NO: 331636 - protein, 9 aa, Homo Sapiens
SQCPTGWRG

SEQ ID NO: 331637 - protein, 9 aa, Homo Sapiens
VSYSNINNG

SEQ ID NO: 331638 - protein, 9 aa, Homo Sapiens
EFKFPFQNN

SEQ ID NO: 331639 - protein, 9 aa, Homo Sapiens
LTFELSIFE

SEQ ID NO: 331640 - protein, 9 aa, Homo Sapiens
GRRDGEADA

SEQ ID NO: 331641 - protein, 9 aa, Homo Sapiens
QPSAGQFFT

SEQ ID NO: 331642 - protein, 9 aa, Homo Sapiens
EEAENGLVH

SEQ ID NO: 331643 - protein, 9 aa, Homo Sapiens
RITSQINLI

SEQ ID NO: 331644 - protein, 9 aa, Homo Sapiens
SVYHSPGHN

SEQ ID NO: 331645 - protein, 9 aa, Homo Sapiens
ECLQYGHDT

SEQ ID NO: 331646 - protein, 9 aa, Homo Sapiens
LPHTSSGSS

SEQ ID NO: 331647 - protein, 9 aa, Homo Sapiens
TTNDATGPD

SEQ ID NO: 331648 - protein, 9 aa, Homo Sapiens
KHRKTTLEM

SEQ ID NO: 331649 - protein, 9 aa, Homo Sapiens
VYYGCLHLV

SEQ ID NO: 331650 - protein, 9 aa, Homo Sapiens
DHLIQILET

SEQ ID NO: 331651 - protein, 9 aa, Homo Sapiens
IREQNQYDL

SEQ ID NO: 331652 - protein, 9 aa, Homo Sapiens
IPAWTFYSG

SEQ ID NO: 331653 - protein, 9 aa, Homo Sapiens
MWNYTVRKQ

SEQ ID NO: 331654 - protein, 9 aa, Homo Sapiens
LKTLQEDSP

SEQ ID NO: 331655 - protein, 9 aa, Homo Sapiens
FFGPDLITV

SEQ ID NO: 331656 - protein, 9 aa, Homo Sapiens
KRDKLTELM

SEQ ID NO: 331657 - protein, 9 aa, Homo Sapiens
CVQPMKGDP

SEQ ID NO: 331658 - protein, 9 aa, Homo Sapiens
PTSYKSKFK

SEQ ID NO: 331659 - protein, 9 aa, Homo Sapiens
CINANNIND

SEQ ID NO: 331660 - protein, 9 aa, Homo Sapiens
HYAIYDSGD

SEQ ID NO: 331661 - protein, 9 aa, Homo Sapiens
VDCPPKRKD

SEQ ID NO: 331662 - protein, 9 aa, Homo Sapiens
GLAISKGFW

SEQ ID NO: 331663 - protein, 9 aa, Homo Sapiens
WKYTINNVS

SEQ ID NO: 331664 - protein, 9 aa, Homo Sapiens
KNGGWNAPI

SEQ ID NO: 331665 - protein, 9 aa, Homo Sapiens
KLALYIYEY

SEQ ID NO: 331666 - protein, 9 aa, Homo Sapiens
QKVHKKKME

SEQ ID NO: 331667 - protein, 9 aa, Homo Sapiens
QAIDKKPSI

SEQ ID NO: 331668 - protein, 9 aa, Homo Sapiens
KVPARLTLQ

SEQ ID NO: 331669 - protein, 9 aa, Homo Sapiens
AADGKTTHH

SEQ ID NO: 331670 - protein, 9 aa, Homo Sapiens
TTPDVYKSP

SEQ ID NO: 331671 - protein, 9 aa, Homo Sapiens
EFRCEPSSQ

SEQ ID NO: 331672 - protein, 9 aa, Homo Sapiens
ALHLAVSKD

SEQ ID NO: 331673 - protein, 9 aa, Homo Sapiens
HFTGNKVGF

SEQ ID NO: 331674 - protein, 9 aa, Homo Sapiens
SEKTKKDKA

SEQ ID NO: 331675 - protein, 9 aa, Homo Sapiens
AFKASDSVI

SEQ ID NO: 331676 - protein, 9 aa, Homo Sapiens
CFVCGIFFS

SEQ ID NO: 331677 - protein, 9 aa, Homo Sapiens
PLETVLANF

SEQ ID NO: 331678 - protein, 9 aa, Homo Sapiens
YSTLNSSKP

SEQ ID NO: 331679 - protein, 9 aa, Homo Sapiens
IFPGLHKIE

SEQ ID NO: 331680 - protein, 9 aa, Homo Sapiens
MQHNRHSLQ

SEQ ID NO: 331681 - protein, 9 aa, Homo Sapiens
PCPQRALIG

SEQ ID NO: 331682 - protein, 9 aa, Homo Sapiens
EIWELIGIS

SEQ ID NO: 331683 - protein, 9 aa, Homo Sapiens
EINQRFKNK

SEQ ID NO: 331684 - protein, 9 aa, Homo Sapiens
QSYEAPRGD

SEQ ID NO: 331685 - protein, 9 aa, Homo Sapiens
QNHYRVYNL

SEQ ID NO: 331686 - protein, 9 aa, Homo Sapiens
RVFSNKLLD

SEQ ID NO: 331687 - protein, 9 aa, Homo Sapiens
NGCMHTLHI

SEQ ID NO: 331688 - protein, 9 aa, Homo Sapiens
KLAMAELND

SEQ ID NO: 331689 - protein, 9 aa, Homo Sapiens
SRRTLNNSR

SEQ ID NO: 331690 - protein, 9 aa, Homo Sapiens
QINILREKQ

SEQ ID NO: 331691 - protein, 9 aa, Homo Sapiens
YLDIPGDKE

SEQ ID NO: 331692 - protein, 9 aa, Homo Sapiens
LPFTKGEIL

SEQ ID NO: 331693 - protein, 9 aa, Homo Sapiens
INCGKAFSD

SEQ ID NO: 331694 - protein, 9 aa, Homo Sapiens
MLYFLLYNY

SEQ ID NO: 331695 - protein, 9 aa, Homo Sapiens
FRLTHPGVI

SEQ ID NO: 331696 - protein, 9 aa, Homo Sapiens
GVLTIVTLM

SEQ ID NO: 331697 - protein, 9 aa, Homo Sapiens
KKMKLCGTK

SEQ ID NO: 331698 - protein, 9 aa, Homo Sapiens
LEQFTCIPY

SEQ ID NO: 331699 - protein, 9 aa, Homo Sapiens
ATDTEDPTL

SEQ ID NO: 331700 - protein, 9 aa, Homo Sapiens
AMSCSENCL

SEQ ID NO: 331701 - protein, 9 aa, Homo Sapiens
LFGQRANTI

SEQ ID NO: 331702 - protein, 9 aa, Homo Sapiens
SYAINLPVS

SEQ ID NO: 331703 - protein, 9 aa, Homo Sapiens
QLKDHVSEL

SEQ ID NO: 331704 - protein, 9 aa, Homo Sapiens
QPHKKYKLT

SEQ ID NO: 331705 - protein, 9 aa, Homo Sapiens
TTLMILLSQ

SEQ ID NO: 331706 - protein, 9 aa, Homo Sapiens
KNCPACHLR

SEQ ID NO: 331707 - protein, 9 aa, Homo Sapiens
EVEISMTST

SEQ ID NO: 331708 - protein, 9 aa, Homo Sapiens
SPGSTPQIS

SEQ ID NO: 331709 - protein, 9 aa, Homo Sapiens
AAPVTKNNG

SEQ ID NO: 331710 - protein, 9 aa, Homo Sapiens
TPEGIQLQC

SEQ ID NO: 331711 - protein, 9 aa, Homo Sapiens
RLRTLPEVH

SEQ ID NO: 331712 - protein, 9 aa, Homo Sapiens
LLSIFQSYP

SEQ ID NO: 331713 - protein, 9 aa, Homo Sapiens
NTPGGFRCK

SEQ ID NO: 331714 - protein, 9 aa, Homo Sapiens
SAEGRTKAY

SEQ ID NO: 331715 - protein, 9 aa, Homo Sapiens
NKGSMQNKK

SEQ ID NO: 331716 - protein, 9 aa, Homo Sapiens
TLWCDYYGC

SEQ ID NO: 331717 - protein, 9 aa, Homo Sapiens
GLPPMHMGQ

SEQ ID NO: 331718 - protein, 9 aa, Homo Sapiens
HQEQLSSLA

SEQ ID NO: 331719 - protein, 9 aa, Homo Sapiens
DGAEHGLPG

SEQ ID NO: 331720 - protein, 9 aa, Homo Sapiens
TLASGLVLA

SEQ ID NO: 331721 - protein, 9 aa, Homo Sapiens
GTYGCTSTS

SEQ ID NO: 331722 - protein, 9 aa, Homo Sapiens
CMAPISLFA

SEQ ID NO: 331723 - protein, 9 aa, Homo Sapiens
FSNKLLDKA

SEQ ID NO: 331724 - protein, 9 aa, Homo Sapiens
TQFVCINIL

SEQ ID NO: 331725 - protein, 9 aa, Homo Sapiens
QHQDKVLYL

SEQ ID NO: 331726 - protein, 9 aa, Homo Sapiens
QSKACDTKV

SEQ ID NO: 331727 - protein, 9 aa, Homo Sapiens
EGIDDFVQL

SEQ ID NO: 331728 - protein, 9 aa, Homo Sapiens
EPKVKELVR

SEQ ID NO: 331729 - protein, 9 aa, Homo Sapiens
RAAAKESEE

SEQ ID NO: 331730 - protein, 9 aa, Homo Sapiens
WFLQQSAQA

SEQ ID NO: 331731 - protein, 9 aa, Homo Sapiens
KTFQGHDAP

SEQ ID NO: 331732 - protein, 9 aa, Homo Sapiens
GSMQNKKPG

SEQ ID NO: 331733 - protein, 9 aa, Homo Sapiens
ITIKCRITW

SEQ ID NO: 331734 - protein, 9 aa, Homo Sapiens
WTLLSSVIC

SEQ ID NO: 331735 - protein, 9 aa, Homo Sapiens
NLTVRKLKL

SEQ ID NO: 331736 - protein, 9 aa, Homo Sapiens
CKGNEYSLW

SEQ ID NO: 331737 - protein, 9 aa, Homo Sapiens
AQYSADIIF

SEQ ID NO: 331738 - protein, 9 aa, Homo Sapiens
DVCFNTAGT

SEQ ID NO: 331739 - protein, 9 aa, Homo Sapiens
AQEFVQRLE

SEQ ID NO: 331740 - protein, 9 aa, Homo Sapiens
NLVPVAAAK

SEQ ID NO: 331741 - protein, 9 aa, Homo Sapiens
SREQPCGKR

SEQ ID NO: 331742 - protein, 9 aa, Homo Sapiens
RAHAASMFL

SEQ ID NO: 331743 - protein, 9 aa, Homo Sapiens
NSYLTKLEE

SEQ ID NO: 331744 - protein, 9 aa, Homo Sapiens
DDIQYDLFL

SEQ ID NO: 331745 - protein, 9 aa, Homo Sapiens
DGLACYWLG

SEQ ID NO: 331746 - protein, 9 aa, Homo Sapiens
SFILASTPS

SEQ ID NO: 331747 - protein, 9 aa, Homo Sapiens
PQTAPAGYL

SEQ ID NO: 331748 - protein, 9 aa, Homo Sapiens
KSHKLAVEY

SEQ ID NO: 331749 - protein, 9 aa, Homo Sapiens
LMKEGTSTF

SEQ ID NO: 331750 - protein, 9 aa, Homo Sapiens
QKWKERTAS

SEQ ID NO: 331751 - protein, 9 aa, Homo Sapiens
GEADATASS

SEQ ID NO: 331752 - protein, 9 aa, Homo Sapiens
QKGPLTLKG

SEQ ID NO: 331753 - protein, 9 aa, Homo Sapiens
KYSFHHRIF

SEQ ID NO: 331754 - protein, 9 aa, Homo Sapiens
QQREEELKE

SEQ ID NO: 331755 - protein, 9 aa, Homo Sapiens
YVDLTNEAT

SEQ ID NO: 331756 - protein, 9 aa, Homo Sapiens
FCFASLFHV

SEQ ID NO: 331757 - protein, 9 aa, Homo Sapiens
GFYVEQLWV

SEQ ID NO: 331758 - protein, 9 aa, Homo Sapiens
RICQRTHFV

SEQ ID NO: 331759 - protein, 9 aa, Homo Sapiens
DIEQVPRQP

SEQ ID NO: 331760 - protein, 9 aa, Homo Sapiens
ICCPVCSQE

SEQ ID NO: 331761 - protein, 9 aa, Homo Sapiens
SYYSGEHLT

SEQ ID NO: 331762 - protein, 9 aa, Homo Sapiens
LLEPHNKYR

SEQ ID NO: 331763 - protein, 9 aa, Homo Sapiens
CFLSTLISQ

SEQ ID NO: 331764 - protein, 9 aa, Homo Sapiens
REHLGLNVA

SEQ ID NO: 331765 - protein, 9 aa, Homo Sapiens
AAEIVTNIF

SEQ ID NO: 331766 - protein, 9 aa, Homo Sapiens
LIRMLVVGT

SEQ ID NO: 331767 - protein, 9 aa, Homo Sapiens
PLQMDVREK

SEQ ID NO: 331768 - protein, 9 aa, Homo Sapiens
KDAGVICSA

SEQ ID NO: 331769 - protein, 9 aa, Homo Sapiens
LPHELYWHL

SEQ ID NO: 331770 - protein, 9 aa, Homo Sapiens
GIVHRDLKS

SEQ ID NO: 331771 - protein, 9 aa, Homo Sapiens
VDQKNNLKD

SEQ ID NO: 331772 - protein, 9 aa, Homo Sapiens
DPGFYSPLG

SEQ ID NO: 331773 - protein, 9 aa, Homo Sapiens
VGPEEQELS

SEQ ID NO: 331774 - protein, 9 aa, Homo Sapiens
DEEEELSTL

SEQ ID NO: 331775 - protein, 9 aa, Homo Sapiens
YRQIDDDKG

SEQ ID NO: 331776 - protein, 9 aa, Homo Sapiens
LTPATFNEL

SEQ ID NO: 331777 - protein, 9 aa, Homo Sapiens
INLLLDRIR

SEQ ID NO: 331778 - protein, 9 aa, Homo Sapiens
YGIDLGKIV

SEQ ID NO: 331779 - protein, 9 aa, Homo Sapiens
DSDDKEKPV

SEQ ID NO: 331780 - protein, 9 aa, Homo Sapiens
QEKSRWTEE

SEQ ID NO: 331781 - protein, 9 aa, Homo Sapiens
EHTYVLGQN

SEQ ID NO: 331782 - protein, 9 aa, Homo Sapiens
RYLNLAENS

SEQ ID NO: 331783 - protein, 9 aa, Homo Sapiens
LYYLMSAVQ

SEQ ID NO: 331784 - protein, 9 aa, Homo Sapiens
TAISDVEAK

SEQ ID NO: 331785 - protein, 9 aa, Homo Sapiens
GMSYPISVL

SEQ ID NO: 331786 - protein, 9 aa, Homo Sapiens
LTLTHTCNP

SEQ ID NO: 331787 - protein, 9 aa, Homo Sapiens
MINLDYSVG

SEQ ID NO: 331788 - protein, 9 aa, Homo Sapiens
LDLSEFLNL

SEQ ID NO: 331789 - protein, 9 aa, Homo Sapiens
SGNTSQRGK

SEQ ID NO: 331790 - protein, 9 aa, Homo Sapiens
LPRLSIQKY

SEQ ID NO: 331791 - protein, 9 aa, Homo Sapiens
RVEQEVEDR

SEQ ID NO: 331792 - protein, 9 aa, Homo Sapiens
VIFTLTSVV

SEQ ID NO: 331793 - protein, 9 aa, Homo Sapiens
EDPTLNYGL

SEQ ID NO: 331794 - protein, 9 aa, Homo Sapiens
RPAQHRLSE

SEQ ID NO: 331795 - protein, 9 aa, Homo Sapiens
ILHAAKHQD

SEQ ID NO: 331796 - protein, 9 aa, Homo Sapiens
RITLFWTVI

SEQ ID NO: 331797 - protein, 9 aa, Homo Sapiens
KRTKKKTRK

SEQ ID NO: 331798 - protein, 9 aa, Homo Sapiens
MAIGHREQQ

SEQ ID NO: 331799 - protein, 9 aa, Homo Sapiens
FQFSQALAI

SEQ ID NO: 331800 - protein, 9 aa, Homo Sapiens
GHSKCSSVY

SEQ ID NO: 331801 - protein, 9 aa, Homo Sapiens
WNPVWLYEQ

SEQ ID NO: 331802 - protein, 9 aa, Homo Sapiens
RPGFATMPL

SEQ ID NO: 331803 - protein, 9 aa, Homo Sapiens
NDIDKALTV

SEQ ID NO: 331804 - protein, 9 aa, Homo Sapiens
AAYHPFSRL

SEQ ID NO: 331805 - protein, 9 aa, Homo Sapiens
AGNQADLSK

SEQ ID NO: 331806 - protein, 9 aa, Homo Sapiens
KVHIKFTEG

SEQ ID NO: 331807 - protein, 9 aa, Homo Sapiens
SKECLQTES

SEQ ID NO: 331808 - protein, 9 aa, Homo Sapiens
GINQPLLSL

SEQ ID NO: 331809 - protein, 9 aa, Homo Sapiens
QGAFHKGVP

SEQ ID NO: 331810 - protein, 9 aa, Homo Sapiens
TLLLCGTEL

SEQ ID NO: 331811 - protein, 9 aa, Homo Sapiens
GNHLAQSKN

SEQ ID NO: 331812 - protein, 9 aa, Homo Sapiens
KCEACPDPE

SEQ ID NO: 331813 - protein, 9 aa, Homo Sapiens
KYEFKKDLS

SEQ ID NO: 331814 - protein, 9 aa, Homo Sapiens
VLMFYKEKP

SEQ ID NO: 331815 - protein, 9 aa, Homo Sapiens
WITELMQVL

SEQ ID NO: 331816 - protein, 9 aa, Homo Sapiens
IDVNEISHH

SEQ ID NO: 331817 - protein, 9 aa, Homo Sapiens
DLITVTKEN

SEQ ID NO: 331818 - protein, 9 aa, Homo Sapiens
YSNINNGLV

SEQ ID NO: 331819 - protein, 9 aa, Homo Sapiens
YQLTQHQIF

SEQ ID NO: 331820 - protein, 9 aa, Homo Sapiens
GSSNYSASA

SEQ ID NO: 331821 - protein, 9 aa, Homo Sapiens
AHHDIVQFL

SEQ ID NO: 331822 - protein, 9 aa, Homo Sapiens
AAECIRFIL

SEQ ID NO: 331823 - protein, 9 aa, Homo Sapiens
TVVGELFRL

SEQ ID NO: 331824 - protein, 9 aa, Homo Sapiens
INNNPDLLP

SEQ ID NO: 331825 - protein, 9 aa, Homo Sapiens
TLTHTCNPP

SEQ ID NO: 331826 - protein, 9 aa, Homo Sapiens
VSRSIGLLF

SEQ ID NO: 331827 - protein, 9 aa, Homo Sapiens
CIRYKKPMK

SEQ ID NO: 331828 - protein, 9 aa, Homo Sapiens
QVIEDIEEM

SEQ ID NO: 331829 - protein, 9 aa, Homo Sapiens
LPEKKSKHM

SEQ ID NO: 331830 - protein, 9 aa, Homo Sapiens
RIYDFNNDD

SEQ ID NO: 331831 - protein, 9 aa, Homo Sapiens
YITALDLYI

SEQ ID NO: 331832 - protein, 9 aa, Homo Sapiens
TNVKGDELD

SEQ ID NO: 331833 - protein, 9 aa, Homo Sapiens
SLEDKTKRE

SEQ ID NO: 331834 - protein, 9 aa, Homo Sapiens
GWMKLDKNK

SEQ ID NO: 331835 - protein, 9 aa, Homo Sapiens
FLHHQNCYG

SEQ ID NO: 331836 - protein, 9 aa, Homo Sapiens
HIIGFDTGD

SEQ ID NO: 331837 - protein, 9 aa, Homo Sapiens
LLLIRQIFN

SEQ ID NO: 331838 - protein, 9 aa, Homo Sapiens
EAGLEECLV

SEQ ID NO: 331839 - protein, 9 aa, Homo Sapiens
QKDWCCQSN

SEQ ID NO: 331840 - protein, 9 aa, Homo Sapiens
GFLPDWNKA

SEQ ID NO: 331841 - protein, 9 aa, Homo Sapiens
YKDAIVIFC

SEQ ID NO: 331842 - protein, 9 aa, Homo Sapiens
FKYVHYYLT

SEQ ID NO: 331843 - protein, 9 aa, Homo Sapiens
PGLRGFPFH

SEQ ID NO: 331844 - protein, 9 aa, Homo Sapiens
PKQFLPTMS

SEQ ID NO: 331845 - protein, 9 aa, Homo Sapiens
FVFESMLPD

SEQ ID NO: 331846 - protein, 9 aa, Homo Sapiens
IIYIPVNVT

SEQ ID NO: 331847 - protein, 9 aa, Homo Sapiens
KDRQKSYTS

SEQ ID NO: 331848 - protein, 9 aa, Homo Sapiens
GTSLQDSGH

SEQ ID NO: 331849 - protein, 9 aa, Homo Sapiens
GLRSCGGCD

SEQ ID NO: 331850 - protein, 9 aa, Homo Sapiens
RWTRLVGIN

SEQ ID NO: 331851 - protein, 9 aa, Homo Sapiens
TSDNLKLVH

SEQ ID NO: 331852 - protein, 9 aa, Homo Sapiens
HFSTENASK

SEQ ID NO: 331853 - protein, 9 aa, Homo Sapiens
CPDELYAIM

SEQ ID NO: 331854 - protein, 9 aa, Homo Sapiens
KIRVTVTLF

SEQ ID NO: 331855 - protein, 9 aa, Homo Sapiens
VNCALYICD

SEQ ID NO: 331856 - protein, 9 aa, Homo Sapiens
QELWKYTIN

SEQ ID NO: 331857 - protein, 9 aa, Homo Sapiens
YTITCVALA

SEQ ID NO: 331858 - protein, 9 aa, Homo Sapiens
ERLGLHQDS

SEQ ID NO: 331859 - protein, 9 aa, Homo Sapiens
CALNKHSLE

SEQ ID NO: 331860 - protein, 9 aa, Homo Sapiens
LLIQISLLV

SEQ ID NO: 331861 - protein, 9 aa, Homo Sapiens
NSIDSVLEK

SEQ ID NO: 331862 - protein, 9 aa, Homo Sapiens
LGTAIKDLL

SEQ ID NO: 331863 - protein, 9 aa, Homo Sapiens
TENKSFKCK

SEQ ID NO: 331864 - protein, 9 aa, Homo Sapiens
AAFLGPEMT

SEQ ID NO: 331865 - protein, 9 aa, Homo Sapiens
AVVLTSYHS

SEQ ID NO: 331866 - protein, 9 aa, Homo Sapiens
QQQISNNTV

SEQ ID NO: 331867 - protein, 9 aa, Homo Sapiens
GAPRPGIKS

SEQ ID NO: 331868 - protein, 9 aa, Homo Sapiens
TLREVTVNV

SEQ ID NO: 331869 - protein, 9 aa, Homo Sapiens
LQLLGPPGR

SEQ ID NO: 331870 - protein, 9 aa, Homo Sapiens
LKDYFQKVI

SEQ ID NO: 331871 - protein, 9 aa, Homo Sapiens
LLTKIHLSP

SEQ ID NO: 331872 - protein, 9 aa, Homo Sapiens
FQCQVNLIF

SEQ ID NO: 331873 - protein, 9 aa, Homo Sapiens
PDESPKLTS

SEQ ID NO: 331874 - protein, 9 aa, Homo Sapiens
LKDKKVELF

SEQ ID NO: 331875 - protein, 9 aa, Homo Sapiens
YKAWFIRQE

SEQ ID NO: 331876 - protein, 9 aa, Homo Sapiens
VYHIDLVKT

SEQ ID NO: 331877 - protein, 9 aa, Homo Sapiens
DLFAFSFGP

SEQ ID NO: 331878 - protein, 9 aa, Homo Sapiens
FCGMKNTQQ

SEQ ID NO: 331879 - protein, 9 aa, Homo Sapiens
TPEYNIKMK

SEQ ID NO: 331880 - protein, 9 aa, Homo Sapiens
QGKKSCHTG

SEQ ID NO: 331881 - protein, 9 aa, Homo Sapiens
YGVINTDMF

SEQ ID NO: 331882 - protein, 9 aa, Homo Sapiens
LWSGAMTPD

SEQ ID NO: 331883 - protein, 9 aa, Homo Sapiens
QQYVKDRSP

SEQ ID NO: 331884 - protein, 9 aa, Homo Sapiens
HQPYEAAHM

SEQ ID NO: 331885 - protein, 9 aa, Homo Sapiens
VEEPRTATS

SEQ ID NO: 331886 - protein, 9 aa, Homo Sapiens
YGCDNPWAG

SEQ ID NO: 331887 - protein, 9 aa, Homo Sapiens
NERPNSSHL

SEQ ID NO: 331888 - protein, 9 aa, Homo Sapiens
SAITATQCR

SEQ ID NO: 331889 - protein, 9 aa, Homo Sapiens
LIRQIFNPD

SEQ ID NO: 331890 - protein, 9 aa, Homo Sapiens
EQANNILVR

SEQ ID NO: 331891 - protein, 9 aa, Homo Sapiens
ADAEEEIKI

SEQ ID NO: 331892 - protein, 9 aa, Homo Sapiens
MNYFSAALN

SEQ ID NO: 331893 - protein, 9 aa, Homo Sapiens
FYMFAGINS

SEQ ID NO: 331894 - protein, 9 aa, Homo Sapiens
HLRWADNPC

SEQ ID NO: 331895 - protein, 9 aa, Homo Sapiens
FILRVVLRL

SEQ ID NO: 331896 - protein, 9 aa, Homo Sapiens
AGSIMWEGR

SEQ ID NO: 331897 - protein, 9 aa, Homo Sapiens
CQVSEEEQR

SEQ ID NO: 331898 - protein, 9 aa, Homo Sapiens
DYIINNHLP

SEQ ID NO: 331899 - protein, 9 aa, Homo Sapiens
RKLSTKKKA

SEQ ID NO: 331900 - protein, 9 aa, Homo Sapiens
PGGLQPLLF

SEQ ID NO: 331901 - protein, 9 aa, Homo Sapiens
QDLTQVMTL

SEQ ID NO: 331902 - protein, 9 aa, Homo Sapiens
YIYCQIIDQ

SEQ ID NO: 331903 - protein, 9 aa, Homo Sapiens
EIGAIAQAH

SEQ ID NO: 331904 - protein, 9 aa, Homo Sapiens
FRSAESVCS

SEQ ID NO: 331905 - protein, 9 aa, Homo Sapiens
LDLYIAICF

SEQ ID NO: 331906 - protein, 9 aa, Homo Sapiens
AANLALLAD

SEQ ID NO: 331907 - protein, 9 aa, Homo Sapiens
KKDKKINKI

SEQ ID NO: 331908 - protein, 9 aa, Homo Sapiens
DCEPPDSRC

SEQ ID NO: 331909 - protein, 9 aa, Homo Sapiens
CTRKFHFFV

SEQ ID NO: 331910 - protein, 9 aa, Homo Sapiens
AVHGLPLKI

SEQ ID NO: 331911 - protein, 9 aa, Homo Sapiens
KSFCHSSSF

SEQ ID NO: 331912 - protein, 9 aa, Homo Sapiens
TVLLPSKWS

SEQ ID NO: 331913 - protein, 9 aa, Homo Sapiens
RDPKTLLLD

SEQ ID NO: 331914 - protein, 9 aa, Homo Sapiens
KTYPECLQY

SEQ ID NO: 331915 - protein, 9 aa, Homo Sapiens
RAMRAAQSL

SEQ ID NO: 331916 - protein, 9 aa, Homo Sapiens
KIRTGEKPY

SEQ ID NO: 331917 - protein, 9 aa, Homo Sapiens
EKDIMPDPK

SEQ ID NO: 331918 - protein, 9 aa, Homo Sapiens
GKHAHFKTR

SEQ ID NO: 331919 - protein, 9 aa, Homo Sapiens
SPLSLLQLA

SEQ ID NO: 331920 - protein, 9 aa, Homo Sapiens
HFGWEADLR

SEQ ID NO: 331921 - protein, 9 aa, Homo Sapiens
GTPRMNLSL

SEQ ID NO: 331922 - protein, 9 aa, Homo Sapiens
KNASLRTTS

SEQ ID NO: 331923 - protein, 9 aa, Homo Sapiens
CGEKSSKAK

SEQ ID NO: 331924 - protein, 9 aa, Homo Sapiens
SQANLSDLK

SEQ ID NO: 331925 - protein, 9 aa, Homo Sapiens
LLTVKHNQN

SEQ ID NO: 331926 - protein, 9 aa, Homo Sapiens
QTMDQALKS

SEQ ID NO: 331927 - protein, 9 aa, Homo Sapiens
KILETFQLD

SEQ ID NO: 331928 - protein, 9 aa, Homo Sapiens
DSQGLFNLA

SEQ ID NO: 331929 - protein, 9 aa, Homo Sapiens
ACPSVCRCN

SEQ ID NO: 331930 - protein, 9 aa, Homo Sapiens
KITKSTQTQ

SEQ ID NO: 331931 - protein, 9 aa, Homo Sapiens
RIPFIRPAN

SEQ ID NO: 331932 - protein, 9 aa, Homo Sapiens
TKTYEYERE

SEQ ID NO: 331933 - protein, 9 aa, Homo Sapiens
KQTEYWDNV

SEQ ID NO: 331934 - protein, 9 aa, Homo Sapiens
EVLRELRVE

SEQ ID NO: 331935 - protein, 9 aa, Homo Sapiens
KHRNEAELS

SEQ ID NO: 331936 - protein, 9 aa, Homo Sapiens
TVDTKQAHK

SEQ ID NO: 331937 - protein, 9 aa, Homo Sapiens
RFQKAVDDL

SEQ ID NO: 331938 - protein, 9 aa, Homo Sapiens
CGACKPECN

SEQ ID NO: 331939 - protein, 9 aa, Homo Sapiens
ETKDGFMCL

SEQ ID NO: 331940 - protein, 9 aa, Homo Sapiens
SHRTLKASL

SEQ ID NO: 331941 - protein, 9 aa, Homo Sapiens
SLGETWDNL

SEQ ID NO: 331942 - protein, 9 aa, Homo Sapiens
TLFSVGGWN

SEQ ID NO: 331943 - protein, 9 aa, Homo Sapiens
TEVAKNNLN

SEQ ID NO: 331944 - protein, 9 aa, Homo Sapiens
GSESESWSV

SEQ ID NO: 331945 - protein, 9 aa, Homo Sapiens
DLHEAGGEY

SEQ ID NO: 331946 - protein, 9 aa, Homo Sapiens
DWNKAGEWS

SEQ ID NO: 331947 - protein, 9 aa, Homo Sapiens
MEILFKAWL

SEQ ID NO: 331948 - protein, 9 aa, Homo Sapiens
GVSHLHINH

SEQ ID NO: 331949 - protein, 9 aa, Homo Sapiens
DENIQNSDD

SEQ ID NO: 331950 - protein, 9 aa, Homo Sapiens
NAVVGAGYP

SEQ ID NO: 331951 - protein, 9 aa, Homo Sapiens
VKKCLNGVG

SEQ ID NO: 331952 - protein, 9 aa, Homo Sapiens
LLTLPRTKD

SEQ ID NO: 331953 - protein, 9 aa, Homo Sapiens
NKLPLGLTF

SEQ ID NO: 331954 - protein, 9 aa, Homo Sapiens
REETQNAAW

SEQ ID NO: 331955 - protein, 9 aa, Homo Sapiens
LYPVLVSGI

SEQ ID NO: 331956 - protein, 9 aa, Homo Sapiens
KHGAEDRTH

SEQ ID NO: 331957 - protein, 9 aa, Homo Sapiens
SKDGLLQQL

SEQ ID NO: 331958 - protein, 9 aa, Homo Sapiens
QAEMKIFPI

SEQ ID NO: 331959 - protein, 9 aa, Homo Sapiens
SLIRMLVVG

SEQ ID NO: 331960 - protein, 9 aa, Homo Sapiens
SFNCVCNAG

SEQ ID NO: 331961 - protein, 9 aa, Homo Sapiens
LDSNKKLAC

SEQ ID NO: 331962 - protein, 9 aa, Homo Sapiens
TPPTAALDL

SEQ ID NO: 331963 - protein, 9 aa, Homo Sapiens
DYYPDITYI

SEQ ID NO: 331964 - protein, 9 aa, Homo Sapiens
VRGKQHGSS

SEQ ID NO: 331965 - protein, 9 aa, Homo Sapiens
LLVLVVLLT

SEQ ID NO: 331966 - protein, 9 aa, Homo Sapiens
VTVTLFLFL

SEQ ID NO: 331967 - protein, 9 aa, Homo Sapiens
LLNVFVFLL

SEQ ID NO: 331968 - protein, 9 aa, Homo Sapiens
GNTIRVTFH

SEQ ID NO: 331969 - protein, 9 aa, Homo Sapiens
ATFNELVTQ

SEQ ID NO: 331970 - protein, 9 aa, Homo Sapiens
KDSYLRNGW

SEQ ID NO: 331971 - protein, 9 aa, Homo Sapiens
CIRKTLALD

SEQ ID NO: 331972 - protein, 9 aa, Homo Sapiens
PEESQRQRL

SEQ ID NO: 331973 - protein, 9 aa, Homo Sapiens
ETGGYMLEW

SEQ ID NO: 331974 - protein, 9 aa, Homo Sapiens
TWLVCWTIF

SEQ ID NO: 331975 - protein, 9 aa, Homo Sapiens
VLQGSSVLQ

SEQ ID NO: 331976 - protein, 9 aa, Homo Sapiens
NKMKREEKL

SEQ ID NO: 331977 - protein, 9 aa, Homo Sapiens
AEKIQQQNQ

SEQ ID NO: 331978 - protein, 9 aa, Homo Sapiens
FKIHYASVT

SEQ ID NO: 331979 - protein, 9 aa, Homo Sapiens
GVYLSAHWC

SEQ ID NO: 331980 - protein, 9 aa, Homo Sapiens
APWTLIPEF

SEQ ID NO: 331981 - protein, 9 aa, Homo Sapiens
AIFSNAYTF

SEQ ID NO: 331982 - protein, 9 aa, Homo Sapiens
PEAQNRGFF

SEQ ID NO: 331983 - protein, 9 aa, Homo Sapiens
TPEPLVLVS

SEQ ID NO: 331984 - protein, 9 aa, Homo Sapiens
HSRRGCSYD

SEQ ID NO: 331985 - protein, 9 aa, Homo Sapiens
NGKGEKRAS

SEQ ID NO: 331986 - protein, 9 aa, Homo Sapiens
FQWPFSALL

SEQ ID NO: 331987 - protein, 9 aa, Homo Sapiens
QDSFLHDNS

SEQ ID NO: 331988 - protein, 9 aa, Homo Sapiens
VSTLSPNPT

SEQ ID NO: 331989 - protein, 9 aa, Homo Sapiens
LDEGTSVLV

SEQ ID NO: 331990 - protein, 9 aa, Homo Sapiens
AFILDGLHE

SEQ ID NO: 331991 - protein, 9 aa, Homo Sapiens
RRSHQQECD

SEQ ID NO: 331992 - protein, 9 aa, Homo Sapiens
SQLFENGDV

SEQ ID NO: 331993 - protein, 9 aa, Homo Sapiens
AKWHLGIQS

SEQ ID NO: 331994 - protein, 9 aa, Homo Sapiens
TKRNKFHFN

SEQ ID NO: 331995 - protein, 9 aa, Homo Sapiens
PCELYVFII

SEQ ID NO: 331996 - protein, 9 aa, Homo Sapiens
PMHNLKIRP

SEQ ID NO: 331997 - protein, 9 aa, Homo Sapiens
DSPAPASSI

SEQ ID NO: 331998 - protein, 9 aa, Homo Sapiens
VGVIFYQCI

SEQ ID NO: 331999 - protein, 9 aa, Homo Sapiens
AANQLLIVA

SEQ ID NO: 332000 - protein, 9 aa, Homo Sapiens
CLLGRSIEL

SEQ ID NO: 332001 - protein, 9 aa, Homo Sapiens
SSSHGKRKD

SEQ ID NO: 332002 - protein, 9 aa, Homo Sapiens
KALTSKINL

SEQ ID NO: 332003 - protein, 9 aa, Homo Sapiens
ASVLLLTCL

SEQ ID NO: 332004 - protein, 9 aa, Homo Sapiens
WDIENNPTV

SEQ ID NO: 332005 - protein, 9 aa, Homo Sapiens
QGPCHPTLQ

SEQ ID NO: 332006 - protein, 9 aa, Homo Sapiens
VASEAGEHE

SEQ ID NO: 332007 - protein, 9 aa, Homo Sapiens
RCALNKSRK

SEQ ID NO: 332008 - protein, 9 aa, Homo Sapiens
VQSMIDQSN

SEQ ID NO: 332009 - protein, 9 aa, Homo Sapiens
IGVLRHTGN

SEQ ID NO: 332010 - protein, 9 aa, Homo Sapiens
QGYFRDYCN

SEQ ID NO: 332011 - protein, 9 aa, Homo Sapiens
ARKLLPVLN

SEQ ID NO: 332012 - protein, 9 aa, Homo Sapiens
ITSPEYLNL

SEQ ID NO: 332013 - protein, 9 aa, Homo Sapiens
ISFFLEATN

SEQ ID NO: 332014 - protein, 9 aa, Homo Sapiens
VYLSAHWCP

SEQ ID NO: 332015 - protein, 9 aa, Homo Sapiens
ENHLKQNDS

SEQ ID NO: 332016 - protein, 9 aa, Homo Sapiens
GTEKKNYAK

SEQ ID NO: 332017 - protein, 9 aa, Homo Sapiens
VLPIEHQKF

SEQ ID NO: 332018 - protein, 9 aa, Homo Sapiens
QQNLFGGKC

SEQ ID NO: 332019 - protein, 9 aa, Homo Sapiens
GLGLISIFC

SEQ ID NO: 332020 - protein, 9 aa, Homo Sapiens
EAAFFNTAS

SEQ ID NO: 332021 - protein, 9 aa, Homo Sapiens
ELMAQYWKR

SEQ ID NO: 332022 - protein, 9 aa, Homo Sapiens
EDHSPISQK

SEQ ID NO: 332023 - protein, 9 aa, Homo Sapiens
CKSGYTGQH

SEQ ID NO: 332024 - protein, 9 aa, Homo Sapiens
KLIKVLSPK

SEQ ID NO: 332025 - protein, 9 aa, Homo Sapiens
FDGQLVKKI

SEQ ID NO: 332026 - protein, 9 aa, Homo Sapiens
TKNIQFTHA

SEQ ID NO: 332027 - protein, 9 aa, Homo Sapiens
LCLPGSSYS

SEQ ID NO: 332028 - protein, 9 aa, Homo Sapiens
LALKLKESV

SEQ ID NO: 332029 - protein, 9 aa, Homo Sapiens
VHISHDKQD

SEQ ID NO: 332030 - protein, 9 aa, Homo Sapiens
WKSSGFLNL

SEQ ID NO: 332031 - protein, 9 aa, Homo Sapiens
VQYLKWWSA

SEQ ID NO: 332032 - protein, 9 aa, Homo Sapiens
RGHKRARKI

SEQ ID NO: 332033 - protein, 9 aa, Homo Sapiens
KNKDIENLR

SEQ ID NO: 332034 - protein, 9 aa, Homo Sapiens
DELNHSLRQ

SEQ ID NO: 332035 - protein, 9 aa, Homo Sapiens
ISYTLFVRK

SEQ ID NO: 332036 - protein, 9 aa, Homo Sapiens
TRSQLSVFK

SEQ ID NO: 332037 - protein, 9 aa, Homo Sapiens
VLEGQTHTI

SEQ ID NO: 332038 - protein, 9 aa, Homo Sapiens
AGKTDQKEF

SEQ ID NO: 332039 - protein, 9 aa, Homo Sapiens
GLSFETTGE

SEQ ID NO: 332040 - protein, 9 aa, Homo Sapiens
GKRFPQAFF

SEQ ID NO: 332041 - protein, 9 aa, Homo Sapiens
YRVVEAKTA

SEQ ID NO: 332042 - protein, 9 aa, Homo Sapiens
TEKQKEEHQ

SEQ ID NO: 332043 - protein, 9 aa, Homo Sapiens
QIGLALLNN

SEQ ID NO: 332044 - protein, 9 aa, Homo Sapiens
DFRASQFRS

SEQ ID NO: 332045 - protein, 9 aa, Homo Sapiens
QKYILTIKA

SEQ ID NO: 332046 - protein, 9 aa, Homo Sapiens
QRHRHERTQ

SEQ ID NO: 332047 - protein, 9 aa, Homo Sapiens
SKGIKGGTK

SEQ ID NO: 332048 - protein, 9 aa, Homo Sapiens
HTKIDKLRT

SEQ ID NO: 332049 - protein, 9 aa, Homo Sapiens
LAILEQRFD

SEQ ID NO: 332050 - protein, 9 aa, Homo Sapiens
FNQTTNEDI

SEQ ID NO: 332051 - protein, 9 aa, Homo Sapiens
SPEKARLSS

SEQ ID NO: 332052 - protein, 9 aa, Homo Sapiens
EMNTALRDR

SEQ ID NO: 332053 - protein, 9 aa, Homo Sapiens
CGHISVQFD

SEQ ID NO: 332054 - protein, 9 aa, Homo Sapiens
DVKNVSART

SEQ ID NO: 332055 - protein, 9 aa, Homo Sapiens
PKDEHILWF

SEQ ID NO: 332056 - protein, 9 aa, Homo Sapiens
AQNLTKYST

SEQ ID NO: 332057 - protein, 9 aa, Homo Sapiens
IKQTKDCPQ

SEQ ID NO: 332058 - protein, 9 aa, Homo Sapiens
RAHHKNVRI

SEQ ID NO: 332059 - protein, 9 aa, Homo Sapiens
QRKKEFWNP

SEQ ID NO: 332060 - protein, 9 aa, Homo Sapiens
AAMWHEQEG

SEQ ID NO: 332061 - protein, 9 aa, Homo Sapiens
ENGLVHQTQ

SEQ ID NO: 332062 - protein, 9 aa, Homo Sapiens
RYLKCISCG

SEQ ID NO: 332063 - protein, 9 aa, Homo Sapiens
FFKGLFGGS

SEQ ID NO: 332064 - protein, 9 aa, Homo Sapiens
PPLFNTSKF

SEQ ID NO: 332065 - protein, 9 aa, Homo Sapiens
KHIKHSHHD

SEQ ID NO: 332066 - protein, 9 aa, Homo Sapiens
LYKSSKALS

SEQ ID NO: 332067 - protein, 9 aa, Homo Sapiens
DNTDVALAC

SEQ ID NO: 332068 - protein, 9 aa, Homo Sapiens
DKGVIQQGA

SEQ ID NO: 332069 - protein, 9 aa, Homo Sapiens
DPGQFIDQA

SEQ ID NO: 332070 - protein, 9 aa, Homo Sapiens
AKGTPDKVF

SEQ ID NO: 332071 - protein, 9 aa, Homo Sapiens
TPPSVELET

SEQ ID NO: 332072 - protein, 9 aa, Homo Sapiens
NELSHLLEE

SEQ ID NO: 332073 - protein, 9 aa, Homo Sapiens
AQLISELQR

SEQ ID NO: 332074 - protein, 9 aa, Homo Sapiens
DRLLVFFFL

SEQ ID NO: 332075 - protein, 9 aa, Homo Sapiens
CTMIDPTSK

SEQ ID NO: 332076 - protein, 9 aa, Homo Sapiens
YITLLNKLD

SEQ ID NO: 332077 - protein, 9 aa, Homo Sapiens
GHLRIHQHM

SEQ ID NO: 332078 - protein, 9 aa, Homo Sapiens
ALCQNAREM

SEQ ID NO: 332079 - protein, 9 aa, Homo Sapiens
DLSVIRQLL

SEQ ID NO: 332080 - protein, 9 aa, Homo Sapiens
TMLQERRCL

SEQ ID NO: 332081 - protein, 9 aa, Homo Sapiens
TKHTIQFVD

SEQ ID NO: 332082 - protein, 9 aa, Homo Sapiens
EKASFFPPV

SEQ ID NO: 332083 - protein, 9 aa, Homo Sapiens
DGALENKRA

SEQ ID NO: 332084 - protein, 9 aa, Homo Sapiens
IVAWAIGGE

SEQ ID NO: 332085 - protein, 9 aa, Homo Sapiens
FKTWDLDFG

SEQ ID NO: 332086 - protein, 9 aa, Homo Sapiens
VMASSHFVD

SEQ ID NO: 332087 - protein, 9 aa, Homo Sapiens
ETLEFGSEY

SEQ ID NO: 332088 - protein, 9 aa, Homo Sapiens
PLSVHISHD

SEQ ID NO: 332089 - protein, 9 aa, Homo Sapiens
PGLVAGKRA

SEQ ID NO: 332090 - protein, 9 aa, Homo Sapiens
NHLQRWNQL

SEQ ID NO: 332091 - protein, 9 aa, Homo Sapiens
KHNVLTLKE

SEQ ID NO: 332092 - protein, 9 aa, Homo Sapiens
CVVFINKKT

SEQ ID NO: 332093 - protein, 9 aa, Homo Sapiens
FPITSIEQV

SEQ ID NO: 332094 - protein, 9 aa, Homo Sapiens
AAKREKQLA

SEQ ID NO: 332095 - protein, 9 aa, Homo Sapiens
APSPASSLG

SEQ ID NO: 332096 - protein, 9 aa, Homo Sapiens
TNKLRDRIA

SEQ ID NO: 332097 - protein, 9 aa, Homo Sapiens
DTKGNVFVW

SEQ ID NO: 332098 - protein, 9 aa, Homo Sapiens
NIKDYFEKV

SEQ ID NO: 332099 - protein, 9 aa, Homo Sapiens
ALPGNPVLA

SEQ ID NO: 332100 - protein, 9 aa, Homo Sapiens
DSDIISDEA

SEQ ID NO: 332101 - protein, 9 aa, Homo Sapiens
EEDKLDVPD

SEQ ID NO: 332102 - protein, 9 aa, Homo Sapiens
PFFICGPSV

SEQ ID NO: 332103 - protein, 9 aa, Homo Sapiens
PGASQSCIL

SEQ ID NO: 332104 - protein, 9 aa, Homo Sapiens
RICCKSYVR

SEQ ID NO: 332105 - protein, 9 aa, Homo Sapiens
DIQEKNNMK

SEQ ID NO: 332106 - protein, 9 aa, Homo Sapiens
NRALNRTNH

SEQ ID NO: 332107 - protein, 9 aa, Homo Sapiens
AQENMAYVA

SEQ ID NO: 332108 - protein, 9 aa, Homo Sapiens
MAILLQCNT

SEQ ID NO: 332109 - protein, 9 aa, Homo Sapiens
LYTQNIKVS

SEQ ID NO: 332110 - protein, 9 aa, Homo Sapiens
DEIGQIELV

SEQ ID NO: 332111 - protein, 9 aa, Homo Sapiens
AAEKEQKLL

SEQ ID NO: 332112 - protein, 9 aa, Homo Sapiens
MLRCTKRGW

SEQ ID NO: 332113 - protein, 9 aa, Homo Sapiens
VPIQTPARK

SEQ ID NO: 332114 - protein, 9 aa, Homo Sapiens
LKEQHSKIY

SEQ ID NO: 332115 - protein, 9 aa, Homo Sapiens
VDPDEELDY

SEQ ID NO: 332116 - protein, 9 aa, Homo Sapiens
VACQRSSKR

SEQ ID NO: 332117 - protein, 9 aa, Homo Sapiens
DLARIYIQR

SEQ ID NO: 332118 - protein, 9 aa, Homo Sapiens
QEFRKQIHN

SEQ ID NO: 332119 - protein, 9 aa, Homo Sapiens
QNTGEIVIR

SEQ ID NO: 332120 - protein, 9 aa, Homo Sapiens
SFWVIFFCL

SEQ ID NO: 332121 - protein, 9 aa, Homo Sapiens
DVYHSHVAG

SEQ ID NO: 332122 - protein, 9 aa, Homo Sapiens
NCQCLTTVI

SEQ ID NO: 332123 - protein, 9 aa, Homo Sapiens
MPYASKGLH

SEQ ID NO: 332124 - protein, 9 aa, Homo Sapiens
EKLNSHHNK

SEQ ID NO: 332125 - protein, 9 aa, Homo Sapiens
RIWKERMRK

SEQ ID NO: 332126 - protein, 9 aa, Homo Sapiens
YYITFSPDS

SEQ ID NO: 332127 - protein, 9 aa, Homo Sapiens
TLVCGSAEF

SEQ ID NO: 332128 - protein, 9 aa, Homo Sapiens
GIQRSLFTT

SEQ ID NO: 332129 - protein, 9 aa, Homo Sapiens
TLQIDSSRI

SEQ ID NO: 332130 - protein, 9 aa, Homo Sapiens
FPQFPDTLS

SEQ ID NO: 332131 - protein, 9 aa, Homo Sapiens
GAPDPFQPL

SEQ ID NO: 332132 - protein, 9 aa, Homo Sapiens
THSFLLTIM

SEQ ID NO: 332133 - protein, 9 aa, Homo Sapiens
LEKLIEKGV

SEQ ID NO: 332134 - protein, 9 aa, Homo Sapiens
AQSDGWERA

SEQ ID NO: 332135 - protein, 9 aa, Homo Sapiens
SLVCKKHML

SEQ ID NO: 332136 - protein, 9 aa, Homo Sapiens
IKRRQCQPE

SEQ ID NO: 332137 - protein, 9 aa, Homo Sapiens
QNELQTEVS

SEQ ID NO: 332138 - protein, 9 aa, Homo Sapiens
VERIDGLVL

SEQ ID NO: 332139 - protein, 9 aa, Homo Sapiens
FDCWFQIFN

SEQ ID NO: 332140 - protein, 9 aa, Homo Sapiens
TSDMVLKIK

SEQ ID NO: 332141 - protein, 9 aa, Homo Sapiens
SLIPAWTFY

SEQ ID NO: 332142 - protein, 9 aa, Homo Sapiens
GYLCPSGLK

SEQ ID NO: 332143 - protein, 9 aa, Homo Sapiens
KDKKSKKSK

SEQ ID NO: 332144 - protein, 9 aa, Homo Sapiens
LDLHLSMFL

SEQ ID NO: 332145 - protein, 9 aa, Homo Sapiens
QSYPESAQS

SEQ ID NO: 332146 - protein, 9 aa, Homo Sapiens
RVFVVVITD

SEQ ID NO: 332147 - protein, 9 aa, Homo Sapiens
CKIQQLTNI

SEQ ID NO: 332148 - protein, 9 aa, Homo Sapiens
DYLEFSPGK

SEQ ID NO: 332149 - protein, 9 aa, Homo Sapiens
YGFVKLFTN

SEQ ID NO: 332150 - protein, 9 aa, Homo Sapiens
HEVSAHALN

SEQ ID NO: 332151 - protein, 9 aa, Homo Sapiens
KFSNQFESI

SEQ ID NO: 332152 - protein, 9 aa, Homo Sapiens
ASPKNKESV

SEQ ID NO: 332153 - protein, 9 aa, Homo Sapiens
TPATFNELV

SEQ ID NO: 332154 - protein, 9 aa, Homo Sapiens
LRPTMQTLM

SEQ ID NO: 332155 - protein, 9 aa, Homo Sapiens
QLAGEDADI

SEQ ID NO: 332156 - protein, 9 aa, Homo Sapiens
CIKAESAEA

SEQ ID NO: 332157 - protein, 9 aa, Homo Sapiens
EFELVLWNW

SEQ ID NO: 332158 - protein, 9 aa, Homo Sapiens
QNKTLVEEL

SEQ ID NO: 332159 - protein, 9 aa, Homo Sapiens
AEGEHKSGV

SEQ ID NO: 332160 - protein, 9 aa, Homo Sapiens
MHYLICVEP

SEQ ID NO: 332161 - protein, 9 aa, Homo Sapiens
QVEQLCQAI

SEQ ID NO: 332162 - protein, 9 aa, Homo Sapiens
IFSNAYTFR

SEQ ID NO: 332163 - protein, 9 aa, Homo Sapiens
LLEKTSNST

SEQ ID NO: 332164 - protein, 9 aa, Homo Sapiens
LSQHKIIYT

SEQ ID NO: 332165 - protein, 9 aa, Homo Sapiens
NVSLNQEYL

SEQ ID NO: 332166 - protein, 9 aa, Homo Sapiens
IGAVAKVIA

SEQ ID NO: 332167 - protein, 9 aa, Homo Sapiens
KVARVQPKF

SEQ ID NO: 332168 - protein, 9 aa, Homo Sapiens
AYGVIHFQG

SEQ ID NO: 332169 - protein, 9 aa, Homo Sapiens
VNKKDLPIC

SEQ ID NO: 332170 - protein, 9 aa, Homo Sapiens
HEKGTSRKH

SEQ ID NO: 332171 - protein, 9 aa, Homo Sapiens
EYSLWDCPA

SEQ ID NO: 332172 - protein, 9 aa, Homo Sapiens
RKRECQLVC

SEQ ID NO: 332173 - protein, 9 aa, Homo Sapiens
PPSVELETI

SEQ ID NO: 332174 - protein, 9 aa, Homo Sapiens
GGATSSHRT

SEQ ID NO: 332175 - protein, 9 aa, Homo Sapiens
DWSKDIQTC

SEQ ID NO: 332176 - protein, 9 aa, Homo Sapiens
RFMYTTLFT

SEQ ID NO: 332177 - protein, 9 aa, Homo Sapiens
HKRIITGEK

SEQ ID NO: 332178 - protein, 9 aa, Homo Sapiens
CCIIYVTEA

SEQ ID NO: 332179 - protein, 9 aa, Homo Sapiens
KALEEARNI

SEQ ID NO: 332180 - protein, 9 aa, Homo Sapiens
DVVYYAFKI

SEQ ID NO: 332181 - protein, 9 aa, Homo Sapiens
LTKMNKMSF

SEQ ID NO: 332182 - protein, 9 aa, Homo Sapiens
INTDGSFNC

SEQ ID NO: 332183 - protein, 9 aa, Homo Sapiens
LPPGTNILI

SEQ ID NO: 332184 - protein, 9 aa, Homo Sapiens
TFKRFTPRK

SEQ ID NO: 332185 - protein, 9 aa, Homo Sapiens
NMPFQDDQE

SEQ ID NO: 332186 - protein, 9 aa, Homo Sapiens
KKQGRKKHA

SEQ ID NO: 332187 - protein, 9 aa, Homo Sapiens
LGQTELILI

SEQ ID NO: 332188 - protein, 9 aa, Homo Sapiens
DPPGRCISC

SEQ ID NO: 332189 - protein, 9 aa, Homo Sapiens
NHCETKCVK

SEQ ID NO: 332190 - protein, 9 aa, Homo Sapiens
HCNSCPFIC

SEQ ID NO: 332191 - protein, 9 aa, Homo Sapiens
LLDIKRYLN

SEQ ID NO: 332192 - protein, 9 aa, Homo Sapiens
KRFTKVEDI

SEQ ID NO: 332193 - protein, 9 aa, Homo Sapiens
HHTQLSFVF

SEQ ID NO: 332194 - protein, 9 aa, Homo Sapiens
KDRINHCGI

SEQ ID NO: 332195 - protein, 9 aa, Homo Sapiens
MFFLYTDLF

SEQ ID NO: 332196 - protein, 9 aa, Homo Sapiens
RNKIREQNQ

SEQ ID NO: 332197 - protein, 9 aa, Homo Sapiens
HPGASIQET

SEQ ID NO: 332198 - protein, 9 aa, Homo Sapiens
SRLAILPAS

SEQ ID NO: 332199 - protein, 9 aa, Homo Sapiens
SQNKSLATL

SEQ ID NO: 332200 - protein, 9 aa, Homo Sapiens
VTHYKNMIQ

SEQ ID NO: 332201 - protein, 9 aa, Homo Sapiens
SEESYNIND

SEQ ID NO: 332202 - protein, 9 aa, Homo Sapiens
KMLYQDKLF

SEQ ID NO: 332203 - protein, 9 aa, Homo Sapiens
REKNHPRVY

SEQ ID NO: 332204 - protein, 9 aa, Homo Sapiens
RWPSLRLHR

SEQ ID NO: 332205 - protein, 9 aa, Homo Sapiens
YQLATKIKE

SEQ ID NO: 332206 - protein, 9 aa, Homo Sapiens
YKGEKGKCG

SEQ ID NO: 332207 - protein, 9 aa, Homo Sapiens
SLCQCPPGL

SEQ ID NO: 332208 - protein, 9 aa, Homo Sapiens
MKSFLSELG

SEQ ID NO: 332209 - protein, 9 aa, Homo Sapiens
LVFVINGSK

SEQ ID NO: 332210 - protein, 9 aa, Homo Sapiens
YLCNAINVY

SEQ ID NO: 332211 - protein, 9 aa, Homo Sapiens
LKLTYTLLN

SEQ ID NO: 332212 - protein, 9 aa, Homo Sapiens
LDIPRFQMS

SEQ ID NO: 332213 - protein, 9 aa, Homo Sapiens
TGEFCQSKI

SEQ ID NO: 332214 - protein, 9 aa, Homo Sapiens
NLEIGTHDK

SEQ ID NO: 332215 - protein, 9 aa, Homo Sapiens
NALNVLMAM

SEQ ID NO: 332216 - protein, 9 aa, Homo Sapiens
DEKQLAELH

SEQ ID NO: 332217 - protein, 9 aa, Homo Sapiens
KEEHRQILQ

SEQ ID NO: 332218 - protein, 9 aa, Homo Sapiens
ANNCTKLKS

SEQ ID NO: 332219 - protein, 9 aa, Homo Sapiens
QHYSFIGMC

SEQ ID NO: 332220 - protein, 9 aa, Homo Sapiens
AKVPVGVQM

SEQ ID NO: 332221 - protein, 9 aa, Homo Sapiens
IWNYNKSWI

SEQ ID NO: 332222 - protein, 9 aa, Homo Sapiens
CFSEYIPTP

SEQ ID NO: 332223 - protein, 9 aa, Homo Sapiens
RCYFLLRAS

SEQ ID NO: 332224 - protein, 9 aa, Homo Sapiens
IYECSKCGN

SEQ ID NO: 332225 - protein, 9 aa, Homo Sapiens
IKNATEDVS

SEQ ID NO: 332226 - protein, 9 aa, Homo Sapiens
YAKYIAQVL

SEQ ID NO: 332227 - protein, 9 aa, Homo Sapiens
QVSSLVLYL

SEQ ID NO: 332228 - protein, 9 aa, Homo Sapiens
MGRPAQHRL

SEQ ID NO: 332229 - protein, 9 aa, Homo Sapiens
SALESHKII

SEQ ID NO: 332230 - protein, 9 aa, Homo Sapiens
TYSLEEERI

SEQ ID NO: 332231 - protein, 9 aa, Homo Sapiens
KPIQSPAMS

SEQ ID NO: 332232 - protein, 9 aa, Homo Sapiens
HLAKHPKYQ

SEQ ID NO: 332233 - protein, 9 aa, Homo Sapiens
YEVNCLGIY

SEQ ID NO: 332234 - protein, 9 aa, Homo Sapiens
QCEHCARFL

SEQ ID NO: 332235 - protein, 9 aa, Homo Sapiens
LKTRNLDPE

SEQ ID NO: 332236 - protein, 9 aa, Homo Sapiens
TQHSSLVML

SEQ ID NO: 332237 - protein, 9 aa, Homo Sapiens
PTSVGLLQN

SEQ ID NO: 332238 - protein, 9 aa, Homo Sapiens
KCDNMMTCY

SEQ ID NO: 332239 - protein, 9 aa, Homo Sapiens
YQCIYGRKP

SEQ ID NO: 332240 - protein, 9 aa, Homo Sapiens
YAGHVGSVH

SEQ ID NO: 332241 - protein, 9 aa, Homo Sapiens
CGEDCLNCL

SEQ ID NO: 332242 - protein, 9 aa, Homo Sapiens
QNIHTGEKT

SEQ ID NO: 332243 - protein, 9 aa, Homo Sapiens
DDKSKTQFV

SEQ ID NO: 332244 - protein, 9 aa, Homo Sapiens
ILEENLQRS

SEQ ID NO: 332245 - protein, 9 aa, Homo Sapiens
RKQVVVAAL

SEQ ID NO: 332246 - protein, 9 aa, Homo Sapiens
LLLLSVCAW

SEQ ID NO: 332247 - protein, 9 aa, Homo Sapiens
LSLNDDLLA

SEQ ID NO: 332248 - protein, 9 aa, Homo Sapiens
INEGASNPC

SEQ ID NO: 332249 - protein, 9 aa, Homo Sapiens
PLLFQNPVY

SEQ ID NO: 332250 - protein, 9 aa, Homo Sapiens
GSLCALSTN

SEQ ID NO: 332251 - protein, 9 aa, Homo Sapiens
IANHPFMFI

SEQ ID NO: 332252 - protein, 9 aa, Homo Sapiens
TEGNASQAR

SEQ ID NO: 332253 - protein, 9 aa, Homo Sapiens
SMKLPQLIL

SEQ ID NO: 332254 - protein, 9 aa, Homo Sapiens
LPKPTPLTP

SEQ ID NO: 332255 - protein, 9 aa, Homo Sapiens
TVTPNTAWG

SEQ ID NO: 332256 - protein, 9 aa, Homo Sapiens
EDVYHSHVA

SEQ ID NO: 332257 - protein, 9 aa, Homo Sapiens
NKWLSKSSA

SEQ ID NO: 332258 - protein, 9 aa, Homo Sapiens
ERWECTMYW

SEQ ID NO: 332259 - protein, 9 aa, Homo Sapiens
ICINTLDSY

SEQ ID NO: 332260 - protein, 9 aa, Homo Sapiens
AHLDGTCVE

SEQ ID NO: 332261 - protein, 9 aa, Homo Sapiens
CGIFFSILG

SEQ ID NO: 332262 - protein, 9 aa, Homo Sapiens
EVQIVEEVT

SEQ ID NO: 332263 - protein, 9 aa, Homo Sapiens
LTLGEIITG

SEQ ID NO: 332264 - protein, 9 aa, Homo Sapiens
FRCEPSSQM

SEQ ID NO: 332265 - protein, 9 aa, Homo Sapiens
PASSISQVT

SEQ ID NO: 332266 - protein, 9 aa, Homo Sapiens
YERYICVVH

SEQ ID NO: 332267 - protein, 9 aa, Homo Sapiens
SQGEEELDV

SEQ ID NO: 332268 - protein, 9 aa, Homo Sapiens
QRGKSGFNS

SEQ ID NO: 332269 - protein, 9 aa, Homo Sapiens
QLKKEEQQP

SEQ ID NO: 332270 - protein, 9 aa, Homo Sapiens
LPLGRELSV

SEQ ID NO: 332271 - protein, 9 aa, Homo Sapiens
LMTKAEVTE

SEQ ID NO: 332272 - protein, 9 aa, Homo Sapiens
ALHYMLLAS

SEQ ID NO: 332273 - protein, 9 aa, Homo Sapiens
YENERPNSS

SEQ ID NO: 332274 - protein, 9 aa, Homo Sapiens
VLANFSSGP

SEQ ID NO: 332275 - protein, 9 aa, Homo Sapiens
HRFYGNNSS

SEQ ID NO: 332276 - protein, 9 aa, Homo Sapiens
DFTQLTDEV

SEQ ID NO: 332277 - protein, 9 aa, Homo Sapiens
EVTATDADN

SEQ ID NO: 332278 - protein, 9 aa, Homo Sapiens
LAVGVGNAV

SEQ ID NO: 332279 - protein, 9 aa, Homo Sapiens
SSYENERPN

SEQ ID NO: 332280 - protein, 9 aa, Homo Sapiens
ETAVLLARI

SEQ ID NO: 332281 - protein, 9 aa, Homo Sapiens
ASSISQVTA

SEQ ID NO: 332282 - protein, 9 aa, Homo Sapiens
YQCSRFQES

SEQ ID NO: 332283 - protein, 9 aa, Homo Sapiens
YSSLFVFPV

SEQ ID NO: 332284 - protein, 9 aa, Homo Sapiens
AKHQIIHTG

SEQ ID NO: 332285 - protein, 9 aa, Homo Sapiens
QNNLISSID

SEQ ID NO: 332286 - protein, 9 aa, Homo Sapiens
LNFQNKGKS

SEQ ID NO: 332287 - protein, 9 aa, Homo Sapiens
SFPMADSSP

SEQ ID NO: 332288 - protein, 9 aa, Homo Sapiens
MLKSEEVLS

SEQ ID NO: 332289 - protein, 9 aa, Homo Sapiens
VINRLFLWI

SEQ ID NO: 332290 - protein, 9 aa, Homo Sapiens
AEGGSAVSA

SEQ ID NO: 332291 - protein, 9 aa, Homo Sapiens
AKERRAGVN

SEQ ID NO: 332292 - protein, 9 aa, Homo Sapiens
SVGAGHFWS

SEQ ID NO: 332293 - protein, 9 aa, Homo Sapiens
AYTVHPSSG

SEQ ID NO: 332294 - protein, 9 aa, Homo Sapiens
TWYSSNGSA

SEQ ID NO: 332295 - protein, 9 aa, Homo Sapiens
TLYQKEIKP

SEQ ID NO: 332296 - protein, 9 aa, Homo Sapiens
QTVMTMMLP

SEQ ID NO: 332297 - protein, 9 aa, Homo Sapiens
LMGPYHPDT

SEQ ID NO: 332298 - protein, 9 aa, Homo Sapiens
AKGNVTAQI

SEQ ID NO: 332299 - protein, 9 aa, Homo Sapiens
QIHHDVNEL

SEQ ID NO: 332300 - protein, 9 aa, Homo Sapiens
SRLTVHRKI

SEQ ID NO: 332301 - protein, 9 aa, Homo Sapiens
GELNEKQRM

SEQ ID NO: 332302 - protein, 9 aa, Homo Sapiens
DVPRRSPPV

SEQ ID NO: 332303 - protein, 9 aa, Homo Sapiens
SIKNKRALR

SEQ ID NO: 332304 - protein, 9 aa, Homo Sapiens
GGGSLNLIS

SEQ ID NO: 332305 - protein, 9 aa, Homo Sapiens
TTRFVLKDA

SEQ ID NO: 332306 - protein, 9 aa, Homo Sapiens
KECSHVLVG

SEQ ID NO: 332307 - protein, 9 aa, Homo Sapiens
MYPIEDFEA

SEQ ID NO: 332308 - protein, 9 aa, Homo Sapiens
VFSAQAEIG

SEQ ID NO: 332309 - protein, 9 aa, Homo Sapiens
ANAREWTRM

SEQ ID NO: 332310 - protein, 9 aa, Homo Sapiens
RGKRTKKKT

SEQ ID NO: 332311 - protein, 9 aa, Homo Sapiens
FSTLTGLPW

SEQ ID NO: 332312 - protein, 9 aa, Homo Sapiens
SHTRERRYK

SEQ ID NO: 332313 - protein, 9 aa, Homo Sapiens
NIESKFALR

SEQ ID NO: 332314 - protein, 9 aa, Homo Sapiens
EDASIHQLE

SEQ ID NO: 332315 - protein, 9 aa, Homo Sapiens
QLQCEHCAR

SEQ ID NO: 332316 - protein, 9 aa, Homo Sapiens
LLMAVINGC

SEQ ID NO: 332317 - protein, 9 aa, Homo Sapiens
IMNLIGMML

SEQ ID NO: 332318 - protein, 9 aa, Homo Sapiens
IFWRKEDLD

SEQ ID NO: 332319 - protein, 9 aa, Homo Sapiens
GLFDQHCRL

SEQ ID NO: 332320 - protein, 9 aa, Homo Sapiens
VLVGVVCLF

SEQ ID NO: 332321 - protein, 9 aa, Homo Sapiens
NTVSPRASA

SEQ ID NO: 332322 - protein, 9 aa, Homo Sapiens
NDIVSMEIL

SEQ ID NO: 332323 - protein, 9 aa, Homo Sapiens
MYTRANSCI

SEQ ID NO: 332324 - protein, 9 aa, Homo Sapiens
VYQASYFGA

SEQ ID NO: 332325 - protein, 9 aa, Homo Sapiens
WTFIDFDMD

SEQ ID NO: 332326 - protein, 9 aa, Homo Sapiens
KYLAYHEWK

SEQ ID NO: 332327 - protein, 9 aa, Homo Sapiens
KLHTPMYLF

SEQ ID NO: 332328 - protein, 9 aa, Homo Sapiens
LLSLVALDG

SEQ ID NO: 332329 - protein, 9 aa, Homo Sapiens
DLIKYLPKG

SEQ ID NO: 332330 - protein, 9 aa, Homo Sapiens
GKRHRKKLI

SEQ ID NO: 332331 - protein, 9 aa, Homo Sapiens
FSLDLCRII

SEQ ID NO: 332332 - protein, 9 aa, Homo Sapiens
LTKNIQFTH

SEQ ID NO: 332333 - protein, 9 aa, Homo Sapiens
PEGAGRFHS

SEQ ID NO: 332334 - protein, 9 aa, Homo Sapiens
YRYVAQASL

SEQ ID NO: 332335 - protein, 9 aa, Homo Sapiens
QCKVAVCEA

SEQ ID NO: 332336 - protein, 9 aa, Homo Sapiens
MLKQLSTAN

SEQ ID NO: 332337 - protein, 9 aa, Homo Sapiens
QLKEEVWLQ

SEQ ID NO: 332338 - protein, 9 aa, Homo Sapiens
LFNTSKFTL

SEQ ID NO: 332339 - protein, 9 aa, Homo Sapiens
SPEQNNRTP

SEQ ID NO: 332340 - protein, 9 aa, Homo Sapiens
DVGFNKGLD

SEQ ID NO: 332341 - protein, 9 aa, Homo Sapiens
PSSEDPGFY

SEQ ID NO: 332342 - protein, 9 aa, Homo Sapiens
SPPSNVACS

SEQ ID NO: 332343 - protein, 9 aa, Homo Sapiens
TNYLSAHDN

SEQ ID NO: 332344 - protein, 9 aa, Homo Sapiens
NDHPEITYW

SEQ ID NO: 332345 - protein, 9 aa, Homo Sapiens
FYRCVVQNR

SEQ ID NO: 332346 - protein, 9 aa, Homo Sapiens
EAGGEYFAM

SEQ ID NO: 332347 - protein, 9 aa, Homo Sapiens
NTDCGGGYV

SEQ ID NO: 332348 - protein, 9 aa, Homo Sapiens
PSLDFNGNE

SEQ ID NO: 332349 - protein, 9 aa, Homo Sapiens
DSSQQKTFQ

SEQ ID NO: 332350 - protein, 9 aa, Homo Sapiens
HQHQERAEQ

SEQ ID NO: 332351 - protein, 9 aa, Homo Sapiens
RFIVITDFR

SEQ ID NO: 332352 - protein, 9 aa, Homo Sapiens
NLKINSSYF

SEQ ID NO: 332353 - protein, 9 aa, Homo Sapiens
AQNRGFFKG

SEQ ID NO: 332354 - protein, 9 aa, Homo Sapiens
TEAPEQVVP

SEQ ID NO: 332355 - protein, 9 aa, Homo Sapiens
QQWVTGAIC

SEQ ID NO: 332356 - protein, 9 aa, Homo Sapiens
INHQMWLLF

SEQ ID NO: 332357 - protein, 9 aa, Homo Sapiens
KDSVIPTPN

SEQ ID NO: 332358 - protein, 9 aa, Homo Sapiens
APPDLLDRQ

SEQ ID NO: 332359 - protein, 9 aa, Homo Sapiens
ENIQNSDDE

SEQ ID NO: 332360 - protein, 9 aa, Homo Sapiens
GVAIATILF

SEQ ID NO: 332361 - protein, 9 aa, Homo Sapiens
NKYKEEHRQ

SEQ ID NO: 332362 - protein, 9 aa, Homo Sapiens
FPVNKCSAF

SEQ ID NO: 332363 - protein, 9 aa, Homo Sapiens
IHAELLPIF

SEQ ID NO: 332364 - protein, 9 aa, Homo Sapiens
PCGRWANIL

SEQ ID NO: 332365 - protein, 9 aa, Homo Sapiens
SPLVYLQAV

SEQ ID NO: 332366 - protein, 9 aa, Homo Sapiens
KWMDRYKID

SEQ ID NO: 332367 - protein, 9 aa, Homo Sapiens
QCIKWKGLL

SEQ ID NO: 332368 - protein, 9 aa, Homo Sapiens
HDQDIMLLC

SEQ ID NO: 332369 - protein, 9 aa, Homo Sapiens
GSNLTRHQI

SEQ ID NO: 332370 - protein, 9 aa, Homo Sapiens
GICSFADAQ

SEQ ID NO: 332371 - protein, 9 aa, Homo Sapiens
QLPKYLYAA

SEQ ID NO: 332372 - protein, 9 aa, Homo Sapiens
GHGSTYCWH

SEQ ID NO: 332373 - protein, 9 aa, Homo Sapiens
TIQSDIPAP

SEQ ID NO: 332374 - protein, 9 aa, Homo Sapiens
RATCSGFLY

SEQ ID NO: 332375 - protein, 9 aa, Homo Sapiens
SIGMVKVNT

SEQ ID NO: 332376 - protein, 9 aa, Homo Sapiens
ELQLRVQQL

SEQ ID NO: 332377 - protein, 9 aa, Homo Sapiens
SARTKLEPE

SEQ ID NO: 332378 - protein, 9 aa, Homo Sapiens
QQNVYCMAK

SEQ ID NO: 332379 - protein, 9 aa, Homo Sapiens
VWRTEVAKN

SEQ ID NO: 332380 - protein, 9 aa, Homo Sapiens
QEKQNTAYL

SEQ ID NO: 332381 - protein, 9 aa, Homo Sapiens
YRDALLLQI

SEQ ID NO: 332382 - protein, 9 aa, Homo Sapiens
ESLGWSNEK

SEQ ID NO: 332383 - protein, 9 aa, Homo Sapiens
LVSSSYENE

SEQ ID NO: 332384 - protein, 9 aa, Homo Sapiens
TYHHHLYDI

SEQ ID NO: 332385 - protein, 9 aa, Homo Sapiens
ELHAKLQAL

SEQ ID NO: 332386 - protein, 9 aa, Homo Sapiens
LLVMALDRY

SEQ ID NO: 332387 - protein, 9 aa, Homo Sapiens
HAVMGRALS

SEQ ID NO: 332388 - protein, 9 aa, Homo Sapiens
VPTMCVNWS

SEQ ID NO: 332389 - protein, 9 aa, Homo Sapiens
KAQWPAWQS

SEQ ID NO: 332390 - protein, 9 aa, Homo Sapiens
STNDSSAAW

SEQ ID NO: 332391 - protein, 9 aa, Homo Sapiens
KKTVGDILR

SEQ ID NO: 332392 - protein, 9 aa, Homo Sapiens
IAQQNKQIF

SEQ ID NO: 332393 - protein, 9 aa, Homo Sapiens
YSTVIALKM

SEQ ID NO: 332394 - protein, 9 aa, Homo Sapiens
CLALQHAGR

SEQ ID NO: 332395 - protein, 9 aa, Homo Sapiens
ASYIESILL

SEQ ID NO: 332396 - protein, 9 aa, Homo Sapiens
IYFSGCLAQ

SEQ ID NO: 332397 - protein, 9 aa, Homo Sapiens
KNKMKREEK

SEQ ID NO: 332398 - protein, 9 aa, Homo Sapiens
YAPPKEKGL

SEQ ID NO: 332399 - protein, 9 aa, Homo Sapiens
DNPWAGGVF

SEQ ID NO: 332400 - protein, 9 aa, Homo Sapiens
GDEKLDLNE

SEQ ID NO: 332401 - protein, 9 aa, Homo Sapiens
VLVSPRNSQ

SEQ ID NO: 332402 - protein, 9 aa, Homo Sapiens
TLESGGASV

SEQ ID NO: 332403 - protein, 9 aa, Homo Sapiens
EYVWLAINY

SEQ ID NO: 332404 - protein, 9 aa, Homo Sapiens
TSLQDSGHN

SEQ ID NO: 332405 - protein, 9 aa, Homo Sapiens
MFIMKHNPT

SEQ ID NO: 332406 - protein, 9 aa, Homo Sapiens
PRSPCLGHR

SEQ ID NO: 332407 - protein, 9 aa, Homo Sapiens
PDTELGYTK

SEQ ID NO: 332408 - protein, 9 aa, Homo Sapiens
DPKTLLLDE

SEQ ID NO: 332409 - protein, 9 aa, Homo Sapiens
HFIEECSFV

SEQ ID NO: 332410 - protein, 9 aa, Homo Sapiens
FITKTCPNH

SEQ ID NO: 332411 - protein, 9 aa, Homo Sapiens
VEILLKITT

SEQ ID NO: 332412 - protein, 9 aa, Homo Sapiens
LEQRFDPPI

SEQ ID NO: 332413 - protein, 9 aa, Homo Sapiens
WKSVTKNWT

SEQ ID NO: 332414 - protein, 9 aa, Homo Sapiens
ELFDHIVEK

SEQ ID NO: 332415 - protein, 9 aa, Homo Sapiens
RISYHAMRK

SEQ ID NO: 332416 - protein, 9 aa, Homo Sapiens
SKGLHLETE

SEQ ID NO: 332417 - protein, 9 aa, Homo Sapiens
QEQDLQLEE

SEQ ID NO: 332418 - protein, 9 aa, Homo Sapiens
GKVTAKTKA

SEQ ID NO: 332419 - protein, 9 aa, Homo Sapiens
GLSASGTPW

SEQ ID NO: 332420 - protein, 9 aa, Homo Sapiens
AYEEAQKHL

SEQ ID NO: 332421 - protein, 9 aa, Homo Sapiens
LQRVTRAAA

SEQ ID NO: 332422 - protein, 9 aa, Homo Sapiens
TKTCPNHYT

SEQ ID NO: 332423 - protein, 9 aa, Homo Sapiens
FTGEEKIFA

SEQ ID NO: 332424 - protein, 9 aa, Homo Sapiens
LPFYHSAVL

SEQ ID NO: 332425 - protein, 9 aa, Homo Sapiens
LRKTFSQSS

SEQ ID NO: 332426 - protein, 9 aa, Homo Sapiens
ASQGAGFRG

SEQ ID NO: 332427 - protein, 9 aa, Homo Sapiens
YRTALCGAA

SEQ ID NO: 332428 - protein, 9 aa, Homo Sapiens
KADLAWIKG

SEQ ID NO: 332429 - protein, 9 aa, Homo Sapiens
RCCLRKLLS

SEQ ID NO: 332430 - protein, 9 aa, Homo Sapiens
PAQENMAYV

SEQ ID NO: 332431 - protein, 9 aa, Homo Sapiens
KSAVVMGRG

SEQ ID NO: 332432 - protein, 9 aa, Homo Sapiens
AHAASMFLT

SEQ ID NO: 332433 - protein, 9 aa, Homo Sapiens
GRGRGCRGP

SEQ ID NO: 332434 - protein, 9 aa, Homo Sapiens
GPPPVASTL

SEQ ID NO: 332435 - protein, 9 aa, Homo Sapiens
ITQPLKKLE

SEQ ID NO: 332436 - protein, 9 aa, Homo Sapiens
AVTGVAIAT

SEQ ID NO: 332437 - protein, 9 aa, Homo Sapiens
YSSNGSAKV

SEQ ID NO: 332438 - protein, 9 aa, Homo Sapiens
LVVTVNTTD

SEQ ID NO: 332439 - protein, 9 aa, Homo Sapiens
IINEIYFTT

SEQ ID NO: 332440 - protein, 9 aa, Homo Sapiens
VQDWYYKAA

SEQ ID NO: 332441 - protein, 9 aa, Homo Sapiens
YNKSWIHSF

SEQ ID NO: 332442 - protein, 9 aa, Homo Sapiens
LPAMSRLLR

SEQ ID NO: 332443 - protein, 9 aa, Homo Sapiens
CINTDGSFN

SEQ ID NO: 332444 - protein, 9 aa, Homo Sapiens
SKPLKKFVE

SEQ ID NO: 332445 - protein, 9 aa, Homo Sapiens
VSVFFTKTE

SEQ ID NO: 332446 - protein, 9 aa, Homo Sapiens
EVTQNAEEQ

SEQ ID NO: 332447 - protein, 9 aa, Homo Sapiens
VLFGANTNR

SEQ ID NO: 332448 - protein, 9 aa, Homo Sapiens
IGTYLIQDM

SEQ ID NO: 332449 - protein, 9 aa, Homo Sapiens
GFNTSWERV

SEQ ID NO: 332450 - protein, 9 aa, Homo Sapiens
ALKKHVISK

SEQ ID NO: 332451 - protein, 9 aa, Homo Sapiens
PNSSSLSSP

SEQ ID NO: 332452 - protein, 9 aa, Homo Sapiens
FHSLNNATK

SEQ ID NO: 332453 - protein, 9 aa, Homo Sapiens
VWVCINILG

SEQ ID NO: 332454 - protein, 9 aa, Homo Sapiens
VFESLLSDP

SEQ ID NO: 332455 - protein, 9 aa, Homo Sapiens
IVIDKAQNF

SEQ ID NO: 332456 - protein, 9 aa, Homo Sapiens
EQFLRVMTW

SEQ ID NO: 332457 - protein, 9 aa, Homo Sapiens
LHYDVVMKL

SEQ ID NO: 332458 - protein, 9 aa, Homo Sapiens
VAWGVGLAS

SEQ ID NO: 332459 - protein, 9 aa, Homo Sapiens
ETNGGTQIQ

SEQ ID NO: 332460 - protein, 9 aa, Homo Sapiens
GAEHGLPGT

SEQ ID NO: 332461 - protein, 9 aa, Homo Sapiens
EAYICVFSQ

SEQ ID NO: 332462 - protein, 9 aa, Homo Sapiens
DQGWQNNDR

SEQ ID NO: 332463 - protein, 9 aa, Homo Sapiens
LLFFLLHIW

SEQ ID NO: 332464 - protein, 9 aa, Homo Sapiens
MARGEKYLA

SEQ ID NO: 332465 - protein, 9 aa, Homo Sapiens
VDILGKKFG

SEQ ID NO: 332466 - protein, 9 aa, Homo Sapiens
AAEDYGVIN

SEQ ID NO: 332467 - protein, 9 aa, Homo Sapiens
GEDTGGIYP

SEQ ID NO: 332468 - protein, 9 aa, Homo Sapiens
IKSKEVVTH

SEQ ID NO: 332469 - protein, 9 aa, Homo Sapiens
DVRTTDICV

SEQ ID NO: 332470 - protein, 9 aa, Homo Sapiens
MNGMNRQIN

SEQ ID NO: 332471 - protein, 9 aa, Homo Sapiens
RELARTLQT

SEQ ID NO: 332472 - protein, 9 aa, Homo Sapiens
TGNNSCPST

SEQ ID NO: 332473 - protein, 9 aa, Homo Sapiens
AIGHREQQR

SEQ ID NO: 332474 - protein, 9 aa, Homo Sapiens
FSFKRNLFQ

SEQ ID NO: 332475 - protein, 9 aa, Homo Sapiens
LHIDVVSEN

SEQ ID NO: 332476 - protein, 9 aa, Homo Sapiens
SNVMPFNIY

SEQ ID NO: 332477 - protein, 9 aa, Homo Sapiens
PGTTNGSLS

SEQ ID NO: 332478 - protein, 9 aa, Homo Sapiens
SVSTSNIIP

SEQ ID NO: 332479 - protein, 9 aa, Homo Sapiens
NGKKEEASQ

SEQ ID NO: 332480 - protein, 9 aa, Homo Sapiens
GDILSKKGC

SEQ ID NO: 332481 - protein, 9 aa, Homo Sapiens
EKIAAIADK

SEQ ID NO: 332482 - protein, 9 aa, Homo Sapiens
RSDSELDIP

SEQ ID NO: 332483 - protein, 9 aa, Homo Sapiens
ILLAICRMH

SEQ ID NO: 332484 - protein, 9 aa, Homo Sapiens
DKAFYHPRL

SEQ ID NO: 332485 - protein, 9 aa, Homo Sapiens
PASTQLNLI

SEQ ID NO: 332486 - protein, 9 aa, Homo Sapiens
NSESADNGW

SEQ ID NO: 332487 - protein, 9 aa, Homo Sapiens
WLDEKKVDG

SEQ ID NO: 332488 - protein, 9 aa, Homo Sapiens
TNINEGASN

SEQ ID NO: 332489 - protein, 9 aa, Homo Sapiens
KSEEVLSCR

SEQ ID NO: 332490 - protein, 9 aa, Homo Sapiens
LIDKGNAFN

SEQ ID NO: 332491 - protein, 9 aa, Homo Sapiens
IKKLHQEKM

SEQ ID NO: 332492 - protein, 9 aa, Homo Sapiens
IQEIQTLRK

SEQ ID NO: 332493 - protein, 9 aa, Homo Sapiens
SGKIKLITS

SEQ ID NO: 332494 - protein, 9 aa, Homo Sapiens
SHLKSEAKE

SEQ ID NO: 332495 - protein, 9 aa, Homo Sapiens
THNCGHHKD

SEQ ID NO: 332496 - protein, 9 aa, Homo Sapiens
LVLAFLDTH

SEQ ID NO: 332497 - protein, 9 aa, Homo Sapiens
VESTLFQQS

SEQ ID NO: 332498 - protein, 9 aa, Homo Sapiens
IIRINFCLS

SEQ ID NO: 332499 - protein, 9 aa, Homo Sapiens
NLDEGVNGE

SEQ ID NO: 332500 - protein, 9 aa, Homo Sapiens
KLSEWKMVS

SEQ ID NO: 332501 - protein, 9 aa, Homo Sapiens
IRIQTNASD

SEQ ID NO: 332502 - protein, 9 aa, Homo Sapiens
PAGVFTMDT

SEQ ID NO: 332503 - protein, 9 aa, Homo Sapiens
TQKAKVGKL

SEQ ID NO: 332504 - protein, 9 aa, Homo Sapiens
ELFTSLIDQ

SEQ ID NO: 332505 - protein, 9 aa, Homo Sapiens
DVFISPESP

SEQ ID NO: 332506 - protein, 9 aa, Homo Sapiens
AGEDADISA

SEQ ID NO: 332507 - protein, 9 aa, Homo Sapiens
FFFSFSFFY

SEQ ID NO: 332508 - protein, 9 aa, Homo Sapiens
YLVSSAKTK

SEQ ID NO: 332509 - protein, 9 aa, Homo Sapiens
KLLDKAFSI

SEQ ID NO: 332510 - protein, 9 aa, Homo Sapiens
PPLPEKKSK

SEQ ID NO: 332511 - protein, 9 aa, Homo Sapiens
IPRPFSVCY

SEQ ID NO: 332512 - protein, 9 aa, Homo Sapiens
RVVFKLMDV

SEQ ID NO: 332513 - protein, 9 aa, Homo Sapiens
SYFSSWDDS

SEQ ID NO: 332514 - protein, 9 aa, Homo Sapiens
LTLSTPPTA

SEQ ID NO: 332515 - protein, 9 aa, Homo Sapiens
RKEIFKTLI

SEQ ID NO: 332516 - protein, 9 aa, Homo Sapiens
EHEQHKTVV

SEQ ID NO: 332517 - protein, 9 aa, Homo Sapiens
TKKYREKSL

SEQ ID NO: 332518 - protein, 9 aa, Homo Sapiens
YWPFQGTMG

SEQ ID NO: 332519 - protein, 9 aa, Homo Sapiens
QIYPVVCAP

SEQ ID NO: 332520 - protein, 9 aa, Homo Sapiens
DPSDLHSRN

SEQ ID NO: 332521 - protein, 9 aa, Homo Sapiens
NWFKWFIGL

SEQ ID NO: 332522 - protein, 9 aa, Homo Sapiens
SCRFADNDI

SEQ ID NO: 332523 - protein, 9 aa, Homo Sapiens
NPKEPDISL

SEQ ID NO: 332524 - protein, 9 aa, Homo Sapiens
RSSAQHLDV

SEQ ID NO: 332525 - protein, 9 aa, Homo Sapiens
LENGKEVIF

SEQ ID NO: 332526 - protein, 9 aa, Homo Sapiens
DKVLYLLSQ

SEQ ID NO: 332527 - protein, 9 aa, Homo Sapiens
EKYKENSVL

SEQ ID NO: 332528 - protein, 9 aa, Homo Sapiens
GKYGDLNPM

SEQ ID NO: 332529 - protein, 9 aa, Homo Sapiens
ARKICSDLT

SEQ ID NO: 332530 - protein, 9 aa, Homo Sapiens
LGPPGRRYY

SEQ ID NO: 332531 - protein, 9 aa, Homo Sapiens
AKLNTLILC

SEQ ID NO: 332532 - protein, 9 aa, Homo Sapiens
YLSQTVGIQ

SEQ ID NO: 332533 - protein, 9 aa, Homo Sapiens
MKALQKKSV

SEQ ID NO: 332534 - protein, 9 aa, Homo Sapiens
CRITWDKKG

SEQ ID NO: 332535 - protein, 9 aa, Homo Sapiens
AGEHEKHKK

SEQ ID NO: 332536 - protein, 9 aa, Homo Sapiens
LHKSSFSLS

SEQ ID NO: 332537 - protein, 9 aa, Homo Sapiens
FIMYATIQT

SEQ ID NO: 332538 - protein, 9 aa, Homo Sapiens
KVPTMCVNW

SEQ ID NO: 332539 - protein, 9 aa, Homo Sapiens
IIKNDNNTF

SEQ ID NO: 332540 - protein, 9 aa, Homo Sapiens
NIQNSDDEE

SEQ ID NO: 332541 - protein, 9 aa, Homo Sapiens
AFVHHIDNV

SEQ ID NO: 332542 - protein, 9 aa, Homo Sapiens
KHAHFKTRK

SEQ ID NO: 332543 - protein, 9 aa, Homo Sapiens
KHEMDSFNG

SEQ ID NO: 332544 - protein, 9 aa, Homo Sapiens
GGCDTEIKN

SEQ ID NO: 332545 - protein, 9 aa, Homo Sapiens
NPRGSKDIN

SEQ ID NO: 332546 - protein, 9 aa, Homo Sapiens
KLSKDVTYS

SEQ ID NO: 332547 - protein, 9 aa, Homo Sapiens
GAVWGVKCE

SEQ ID NO: 332548 - protein, 9 aa, Homo Sapiens
NTPGHNYSN

SEQ ID NO: 332549 - protein, 9 aa, Homo Sapiens
HQLEGTDLD

SEQ ID NO: 332550 - protein, 9 aa, Homo Sapiens
QTLQSENLN

SEQ ID NO: 332551 - protein, 9 aa, Homo Sapiens
CAIAGVLAI

SEQ ID NO: 332552 - protein, 9 aa, Homo Sapiens
ALVKESGKR

SEQ ID NO: 332553 - protein, 9 aa, Homo Sapiens
DKYRDCYDS

SEQ ID NO: 332554 - protein, 9 aa, Homo Sapiens
LKMKPGRPQ

SEQ ID NO: 332555 - protein, 9 aa, Homo Sapiens
DELPARILC

SEQ ID NO: 332556 - protein, 9 aa, Homo Sapiens
PDSPLLCKT

SEQ ID NO: 332557 - protein, 9 aa, Homo Sapiens
GKPVNNALD

SEQ ID NO: 332558 - protein, 9 aa, Homo Sapiens
KISAPPEAY

SEQ ID NO: 332559 - protein, 9 aa, Homo Sapiens
IQQQNQYER

SEQ ID NO: 332560 - protein, 9 aa, Homo Sapiens
FYECINTTN

SEQ ID NO: 332561 - protein, 9 aa, Homo Sapiens
TKKRIYEAK

SEQ ID NO: 332562 - protein, 9 aa, Homo Sapiens
VENCAVREK

SEQ ID NO: 332563 - protein, 9 aa, Homo Sapiens
NSFRGKSHL

SEQ ID NO: 332564 - protein, 9 aa, Homo Sapiens
LGSYYSGEH

SEQ ID NO: 332565 - protein, 9 aa, Homo Sapiens
SQRILQRIT

SEQ ID NO: 332566 - protein, 9 aa, Homo Sapiens
ALHIGISFV

SEQ ID NO: 332567 - protein, 9 aa, Homo Sapiens
DSLISLEEE

SEQ ID NO: 332568 - protein, 9 aa, Homo Sapiens
SQAKTQINS

SEQ ID NO: 332569 - protein, 9 aa, Homo Sapiens
NCFLAPEIL

SEQ ID NO: 332570 - protein, 9 aa, Homo Sapiens
LVRTRRYVC

SEQ ID NO: 332571 - protein, 9 aa, Homo Sapiens
IDDKDSFNN

SEQ ID NO: 332572 - protein, 9 aa, Homo Sapiens
KPPKITGSS

SEQ ID NO: 332573 - protein, 9 aa, Homo Sapiens
LQVKKIMQS

SEQ ID NO: 332574 - protein, 9 aa, Homo Sapiens
RMWRNTRSK

SEQ ID NO: 332575 - protein, 9 aa, Homo Sapiens
CQIIDQRDY

SEQ ID NO: 332576 - protein, 9 aa, Homo Sapiens
NKTTVVYLK

SEQ ID NO: 332577 - protein, 9 aa, Homo Sapiens
LLENLVMSD

SEQ ID NO: 332578 - protein, 9 aa, Homo Sapiens
VIIFPYLYE

SEQ ID NO: 332579 - protein, 9 aa, Homo Sapiens
LAAGELCLG

SEQ ID NO: 332580 - protein, 9 aa, Homo Sapiens
QNLSTPPLR

SEQ ID NO: 332581 - protein, 9 aa, Homo Sapiens
WAYARTIHV

SEQ ID NO: 332582 - protein, 9 aa, Homo Sapiens
RKNCPACHL

SEQ ID NO: 332583 - protein, 9 aa, Homo Sapiens
FDEMTFGKV

SEQ ID NO: 332584 - protein, 9 aa, Homo Sapiens
NAGVAFVVI

SEQ ID NO: 332585 - protein, 9 aa, Homo Sapiens
VTPDNGPSG

SEQ ID NO: 332586 - protein, 9 aa, Homo Sapiens
MSQTMIRGM

SEQ ID NO: 332587 - protein, 9 aa, Homo Sapiens
PEVDTYWPF

SEQ ID NO: 332588 - protein, 9 aa, Homo Sapiens
NGNVWVCIN

SEQ ID NO: 332589 - protein, 9 aa, Homo Sapiens
KKYLAATFP

SEQ ID NO: 332590 - protein, 9 aa, Homo Sapiens
TSSSETSVH

SEQ ID NO: 332591 - protein, 9 aa, Homo Sapiens
SPESQEDSD

SEQ ID NO: 332592 - protein, 9 aa, Homo Sapiens
DKLFQWLGK

SEQ ID NO: 332593 - protein, 9 aa, Homo Sapiens
AQANVYVTE

SEQ ID NO: 332594 - protein, 9 aa, Homo Sapiens
LALHPLTEL

SEQ ID NO: 332595 - protein, 9 aa, Homo Sapiens
GKFHYKFFC

SEQ ID NO: 332596 - protein, 9 aa, Homo Sapiens
IESVELRGK

SEQ ID NO: 332597 - protein, 9 aa, Homo Sapiens
ILHRDLRSS

SEQ ID NO: 332598 - protein, 9 aa, Homo Sapiens
ADYIINNHL

SEQ ID NO: 332599 - protein, 9 aa, Homo Sapiens
LDVRRQIPI

SEQ ID NO: 332600 - protein, 9 aa, Homo Sapiens
LGIIFGVSW

SEQ ID NO: 332601 - protein, 9 aa, Homo Sapiens
TSCSDKNIS

SEQ ID NO: 332602 - protein, 9 aa, Homo Sapiens
HEITHTGEK

SEQ ID NO: 332603 - protein, 9 aa, Homo Sapiens
VLTTAKTSV

SEQ ID NO: 332604 - protein, 9 aa, Homo Sapiens
LFITAAWSI

SEQ ID NO: 332605 - protein, 9 aa, Homo Sapiens
KDKKINKIP

SEQ ID NO: 332606 - protein, 9 aa, Homo Sapiens
TSFKAHISV

SEQ ID NO: 332607 - protein, 9 aa, Homo Sapiens
QHQRVHTAV

SEQ ID NO: 332608 - protein, 9 aa, Homo Sapiens
PQTLVTELS

SEQ ID NO: 332609 - protein, 9 aa, Homo Sapiens
HGIATSVAA

SEQ ID NO: 332610 - protein, 9 aa, Homo Sapiens
HLHRATVFA

SEQ ID NO: 332611 - protein, 9 aa, Homo Sapiens
VELETIFKC

SEQ ID NO: 332612 - protein, 9 aa, Homo Sapiens
IEEAENGLV

SEQ ID NO: 332613 - protein, 9 aa, Homo Sapiens
LPGAPDPFQ

SEQ ID NO: 332614 - protein, 9 aa, Homo Sapiens
NYSELQGQL

SEQ ID NO: 332615 - protein, 9 aa, Homo Sapiens
TWECVQPMK

SEQ ID NO: 332616 - protein, 9 aa, Homo Sapiens
GIEVLKSEP

SEQ ID NO: 332617 - protein, 9 aa, Homo Sapiens
VPILHRDLR

SEQ ID NO: 332618 - protein, 9 aa, Homo Sapiens
LNRHYHLNC

SEQ ID NO: 332619 - protein, 9 aa, Homo Sapiens
VELRGKSAF

SEQ ID NO: 332620 - protein, 9 aa, Homo Sapiens
NINVYIHDN

SEQ ID NO: 332621 - protein, 9 aa, Homo Sapiens
CQLVCGACK

SEQ ID NO: 332622 - protein, 9 aa, Homo Sapiens
IAQAHAENG

SEQ ID NO: 332623 - protein, 9 aa, Homo Sapiens
FWDGQLLPS

SEQ ID NO: 332624 - protein, 9 aa, Homo Sapiens
YTTLFTLEG

SEQ ID NO: 332625 - protein, 9 aa, Homo Sapiens
ENGGEILNK

SEQ ID NO: 332626 - protein, 9 aa, Homo Sapiens
WIHSFRGVK

SEQ ID NO: 332627 - protein, 9 aa, Homo Sapiens
LLSKLEELE

SEQ ID NO: 332628 - protein, 9 aa, Homo Sapiens
KEGCYFHVL

SEQ ID NO: 332629 - protein, 9 aa, Homo Sapiens
ASAPGALGT

SEQ ID NO: 332630 - protein, 9 aa, Homo Sapiens
ERTRAERTN

SEQ ID NO: 332631 - protein, 9 aa, Homo Sapiens
GCQLFITCS

SEQ ID NO: 332632 - protein, 9 aa, Homo Sapiens
YLICVEPFT

SEQ ID NO: 332633 - protein, 9 aa, Homo Sapiens
LLELSKLCG

SEQ ID NO: 332634 - protein, 9 aa, Homo Sapiens
CGRHAKAPT

SEQ ID NO: 332635 - protein, 9 aa, Homo Sapiens
VLRSRLHLP

SEQ ID NO: 332636 - protein, 9 aa, Homo Sapiens
DIATFLDTV

SEQ ID NO: 332637 - protein, 9 aa, Homo Sapiens
FVVSWLPLH

SEQ ID NO: 332638 - protein, 9 aa, Homo Sapiens
EKVFHELFG

SEQ ID NO: 332639 - protein, 9 aa, Homo Sapiens
VSSSSLDAS

SEQ ID NO: 332640 - protein, 9 aa, Homo Sapiens
ASFERLLWQ

SEQ ID NO: 332641 - protein, 9 aa, Homo Sapiens
SSSFQYHGR

SEQ ID NO: 332642 - protein, 9 aa, Homo Sapiens
ALGNGASTV

SEQ ID NO: 332643 - protein, 9 aa, Homo Sapiens
NFPSTMIKL

SEQ ID NO: 332644 - protein, 9 aa, Homo Sapiens
NNENYSAEL

SEQ ID NO: 332645 - protein, 9 aa, Homo Sapiens
STVTKINGA

SEQ ID NO: 332646 - protein, 9 aa, Homo Sapiens
HTPRASNEA

SEQ ID NO: 332647 - protein, 9 aa, Homo Sapiens
QHVNNNLQV

SEQ ID NO: 332648 - protein, 9 aa, Homo Sapiens
SAAFEMVPQ

SEQ ID NO: 332649 - protein, 9 aa, Homo Sapiens
ICIDWFYTI

SEQ ID NO: 332650 - protein, 9 aa, Homo Sapiens
NVEIQRGHL

SEQ ID NO: 332651 - protein, 9 aa, Homo Sapiens
QKLSWIAKL

SEQ ID NO: 332652 - protein, 9 aa, Homo Sapiens
LKSEEKDMD

SEQ ID NO: 332653 - protein, 9 aa, Homo Sapiens
AGQFFTSLD

SEQ ID NO: 332654 - protein, 9 aa, Homo Sapiens
EIVQLFSGL

SEQ ID NO: 332655 - protein, 9 aa, Homo Sapiens
QCGKAFARW

SEQ ID NO: 332656 - protein, 9 aa, Homo Sapiens
KLYAYANSH

SEQ ID NO: 332657 - protein, 9 aa, Homo Sapiens
HVCCISVDR

SEQ ID NO: 332658 - protein, 9 aa, Homo Sapiens
LFKDDFILE

SEQ ID NO: 332659 - protein, 9 aa, Homo Sapiens
EGDEKLDLN

SEQ ID NO: 332660 - protein, 9 aa, Homo Sapiens
QLNLITQQL

SEQ ID NO: 332661 - protein, 9 aa, Homo Sapiens
TDMTKNLKE

SEQ ID NO: 332662 - protein, 9 aa, Homo Sapiens
LGEAQRSLH

SEQ ID NO: 332663 - protein, 9 aa, Homo Sapiens
ENIASAMII

SEQ ID NO: 332664 - protein, 9 aa, Homo Sapiens
TTENINNTF

SEQ ID NO: 332665 - protein, 9 aa, Homo Sapiens
LNNATKAGE

SEQ ID NO: 332666 - protein, 9 aa, Homo Sapiens
NMKAKRCAT

SEQ ID NO: 332667 - protein, 9 aa, Homo Sapiens
AEAEQQRQE

SEQ ID NO: 332668 - protein, 9 aa, Homo Sapiens
WDDGKGALN

SEQ ID NO: 332669 - protein, 9 aa, Homo Sapiens
ENMVLRSKA

SEQ ID NO: 332670 - protein, 9 aa, Homo Sapiens
ANLLSPVAF

SEQ ID NO: 332671 - protein, 9 aa, Homo Sapiens
SISTNQTAE

SEQ ID NO: 332672 - protein, 9 aa, Homo Sapiens
TRAMSIKIL

SEQ ID NO: 332673 - protein, 9 aa, Homo Sapiens
GQIPVTCQI

SEQ ID NO: 332674 - protein, 9 aa, Homo Sapiens
FRISPQSRG

SEQ ID NO: 332675 - protein, 9 aa, Homo Sapiens
TASSPSYKF

SEQ ID NO: 332676 - protein, 9 aa, Homo Sapiens
QNRFASSKE

SEQ ID NO: 332677 - protein, 9 aa, Homo Sapiens
PSAQQLRDI

SEQ ID NO: 332678 - protein, 9 aa, Homo Sapiens
AFDELLLKP

SEQ ID NO: 332679 - protein, 9 aa, Homo Sapiens
CKTDLRTGL

SEQ ID NO: 332680 - protein, 9 aa, Homo Sapiens
SINSDIWSY

SEQ ID NO: 332681 - protein, 9 aa, Homo Sapiens
IQLSLKRLP

SEQ ID NO: 332682 - protein, 9 aa, Homo Sapiens
VQTREYRYV

SEQ ID NO: 332683 - protein, 9 aa, Homo Sapiens
GGRGKREGQ

SEQ ID NO: 332684 - protein, 9 aa, Homo Sapiens
GLDSDSESK

SEQ ID NO: 332685 - protein, 9 aa, Homo Sapiens
KGYQTVVAL

SEQ ID NO: 332686 - protein, 9 aa, Homo Sapiens
YSELQGQLF

SEQ ID NO: 332687 - protein, 9 aa, Homo Sapiens
GTNTFFWQA

SEQ ID NO: 332688 - protein, 9 aa, Homo Sapiens
GGEPPTSPP

SEQ ID NO: 332689 - protein, 9 aa, Homo Sapiens
ELSGWDKYF

SEQ ID NO: 332690 - protein, 9 aa, Homo Sapiens
IMYGKFSIN

SEQ ID NO: 332691 - protein, 9 aa, Homo Sapiens
DAPAMTMTA

SEQ ID NO: 332692 - protein, 9 aa, Homo Sapiens
YQASYFGAY

SEQ ID NO: 332693 - protein, 9 aa, Homo Sapiens
TVHAINLDE

SEQ ID NO: 332694 - protein, 9 aa, Homo Sapiens
RILALEANM

SEQ ID NO: 332695 - protein, 9 aa, Homo Sapiens
KVNQFKNVI

SEQ ID NO: 332696 - protein, 9 aa, Homo Sapiens
VHICLECEK

SEQ ID NO: 332697 - protein, 9 aa, Homo Sapiens
QCSVEIQIT

SEQ ID NO: 332698 - protein, 9 aa, Homo Sapiens
LPDFRNKLQ

SEQ ID NO: 332699 - protein, 9 aa, Homo Sapiens
RNSTECRSL

SEQ ID NO: 332700 - protein, 9 aa, Homo Sapiens
TLPFYHSAV

SEQ ID NO: 332701 - protein, 9 aa, Homo Sapiens
SILVTISFV

SEQ ID NO: 332702 - protein, 9 aa, Homo Sapiens
ELFGGNNPF

SEQ ID NO: 332703 - protein, 9 aa, Homo Sapiens
QSGDFTTSS

SEQ ID NO: 332704 - protein, 9 aa, Homo Sapiens
NTEQLPPSE

SEQ ID NO: 332705 - protein, 9 aa, Homo Sapiens
LRVLFITAA

SEQ ID NO: 332706 - protein, 9 aa, Homo Sapiens
GWWLARVWM

SEQ ID NO: 332707 - protein, 9 aa, Homo Sapiens
ATIPPPLPP

SEQ ID NO: 332708 - protein, 9 aa, Homo Sapiens
PWGTLSRSQ

SEQ ID NO: 332709 - protein, 9 aa, Homo Sapiens
QQKERKNRM

SEQ ID NO: 332710 - protein, 9 aa, Homo Sapiens
SATHRNGDP

SEQ ID NO: 332711 - protein, 9 aa, Homo Sapiens
SHFSLSPNL

SEQ ID NO: 332712 - protein, 9 aa, Homo Sapiens
RALSMVADD

SEQ ID NO: 332713 - protein, 9 aa, Homo Sapiens
VEEIEACTA

SEQ ID NO: 332714 - protein, 9 aa, Homo Sapiens
AGVLGFNTS

SEQ ID NO: 332715 - protein, 9 aa, Homo Sapiens
KRSGKLLNK

SEQ ID NO: 332716 - protein, 9 aa, Homo Sapiens
STFTYHKIT

SEQ ID NO: 332717 - protein, 9 aa, Homo Sapiens
MVVALFKTW

SEQ ID NO: 332718 - protein, 9 aa, Homo Sapiens
CVWISFYEI

SEQ ID NO: 332719 - protein, 9 aa, Homo Sapiens
QDLSLMTNC

SEQ ID NO: 332720 - protein, 9 aa, Homo Sapiens
VVRIMNLIG

SEQ ID NO: 332721 - protein, 9 aa, Homo Sapiens
ESPQMDFNS

SEQ ID NO: 332722 - protein, 9 aa, Homo Sapiens
KIICTGEKP

SEQ ID NO: 332723 - protein, 9 aa, Homo Sapiens
AIPGKKSAV

SEQ ID NO: 332724 - protein, 9 aa, Homo Sapiens
QHSQCQDCR

SEQ ID NO: 332725 - protein, 9 aa, Homo Sapiens
DMNGFPVNK

SEQ ID NO: 332726 - protein, 9 aa, Homo Sapiens
PASSLGERL

SEQ ID NO: 332727 - protein, 9 aa, Homo Sapiens
EDVTDEHGK

SEQ ID NO: 332728 - protein, 9 aa, Homo Sapiens
QVQEVLSPI

SEQ ID NO: 332729 - protein, 9 aa, Homo Sapiens
RLLFLFSWM

SEQ ID NO: 332730 - protein, 9 aa, Homo Sapiens
KIQQLTNIH

SEQ ID NO: 332731 - protein, 9 aa, Homo Sapiens
WPEQNIKDY

SEQ ID NO: 332732 - protein, 9 aa, Homo Sapiens
ANGLCKNGG

SEQ ID NO: 332733 - protein, 9 aa, Homo Sapiens
TIHVYPNFR

SEQ ID NO: 332734 - protein, 9 aa, Homo Sapiens
NKRQGWRTF

SEQ ID NO: 332735 - protein, 9 aa, Homo Sapiens
GLLCQSQLT

SEQ ID NO: 332736 - protein, 9 aa, Homo Sapiens
FWSQHTTEV

SEQ ID NO: 332737 - protein, 9 aa, Homo Sapiens
RRGQVTGKT

SEQ ID NO: 332738 - protein, 9 aa, Homo Sapiens
CMVGLCLIS

SEQ ID NO: 332739 - protein, 9 aa, Homo Sapiens
LWKLMKNIF

SEQ ID NO: 332740 - protein, 9 aa, Homo Sapiens
NQTEEERTK

SEQ ID NO: 332741 - protein, 9 aa, Homo Sapiens
STEECQKDW

SEQ ID NO: 332742 - protein, 9 aa, Homo Sapiens
LFTKSKTDY

SEQ ID NO: 332743 - protein, 9 aa, Homo Sapiens
KEMQTIMTS

SEQ ID NO: 332744 - protein, 9 aa, Homo Sapiens
VITGVDSAM

SEQ ID NO: 332745 - protein, 9 aa, Homo Sapiens
ALKMLVNFI

SEQ ID NO: 332746 - protein, 9 aa, Homo Sapiens
NNILVRVTR

SEQ ID NO: 332747 - protein, 9 aa, Homo Sapiens
IFKKSKSPS

SEQ ID NO: 332748 - protein, 9 aa, Homo Sapiens
CLNGVGICK

SEQ ID NO: 332749 - protein, 9 aa, Homo Sapiens
EEENQATKD

SEQ ID NO: 332750 - protein, 9 aa, Homo Sapiens
DIIVWHTVL

SEQ ID NO: 332751 - protein, 9 aa, Homo Sapiens
HIRKFTQER

SEQ ID NO: 332752 - protein, 9 aa, Homo Sapiens
EQRFDPPII

SEQ ID NO: 332753 - protein, 9 aa, Homo Sapiens
TGVDSAMNH

SEQ ID NO: 332754 - protein, 9 aa, Homo Sapiens
VDRAIASRQ

SEQ ID NO: 332755 - protein, 9 aa, Homo Sapiens
IMVQEERCL

SEQ ID NO: 332756 - protein, 9 aa, Homo Sapiens
RHQWWNRVC

SEQ ID NO: 332757 - protein, 9 aa, Homo Sapiens
RAIQITYYF

SEQ ID NO: 332758 - protein, 9 aa, Homo Sapiens
RCNRNFVYC

SEQ ID NO: 332759 - protein, 9 aa, Homo Sapiens
LANEHIQKA

SEQ ID NO: 332760 - protein, 9 aa, Homo Sapiens
KINGAVLIK

SEQ ID NO: 332761 - protein, 9 aa, Homo Sapiens
SSGGHTPHS

SEQ ID NO: 332762 - protein, 9 aa, Homo Sapiens
EFNYLHNQN

SEQ ID NO: 332763 - protein, 9 aa, Homo Sapiens
LTQSASKQG

SEQ ID NO: 332764 - protein, 9 aa, Homo Sapiens
LSDQNKQVL

SEQ ID NO: 332765 - protein, 9 aa, Homo Sapiens
ISDLEMDVA

SEQ ID NO: 332766 - protein, 9 aa, Homo Sapiens
LLYLQEQGI

SEQ ID NO: 332767 - protein, 9 aa, Homo Sapiens
DSNMLSFYD

SEQ ID NO: 332768 - protein, 9 aa, Homo Sapiens
CWTIFSLLK

SEQ ID NO: 332769 - protein, 9 aa, Homo Sapiens
TTADYTTKK

SEQ ID NO: 332770 - protein, 9 aa, Homo Sapiens
YKADLAWIK

SEQ ID NO: 332771 - protein, 9 aa, Homo Sapiens
RSKYLPSPH

SEQ ID NO: 332772 - protein, 9 aa, Homo Sapiens
EDMRKAGHK

SEQ ID NO: 332773 - protein, 9 aa, Homo Sapiens
MPEIRMVLF

SEQ ID NO: 332774 - protein, 9 aa, Homo Sapiens
EVLQINDTI

SEQ ID NO: 332775 - protein, 9 aa, Homo Sapiens
PTGWRGRPR

SEQ ID NO: 332776 - protein, 9 aa, Homo Sapiens
NEIKHEMDS

SEQ ID NO: 332777 - protein, 9 aa, Homo Sapiens
GQKFVFSLA

SEQ ID NO: 332778 - protein, 9 aa, Homo Sapiens
QLVCMMNES

SEQ ID NO: 332779 - protein, 9 aa, Homo Sapiens
NVPQVNGEH

SEQ ID NO: 332780 - protein, 9 aa, Homo Sapiens
DNIFQSMYY

SEQ ID NO: 332781 - protein, 9 aa, Homo Sapiens
GTPDKVFTV

SEQ ID NO: 332782 - protein, 9 aa, Homo Sapiens
LPITCCLVK

SEQ ID NO: 332783 - protein, 9 aa, Homo Sapiens
IVSEPGNNV

SEQ ID NO: 332784 - protein, 9 aa, Homo Sapiens
IITGEKPYR

SEQ ID NO: 332785 - protein, 9 aa, Homo Sapiens
PAYPDIALP

SEQ ID NO: 332786 - protein, 9 aa, Homo Sapiens
GKTVGTAVV

SEQ ID NO: 332787 - protein, 9 aa, Homo Sapiens
RVVYQIYAK

SEQ ID NO: 332788 - protein, 9 aa, Homo Sapiens
GPDIFLGFL

SEQ ID NO: 332789 - protein, 9 aa, Homo Sapiens
ICSFADAQG

SEQ ID NO: 332790 - protein, 9 aa, Homo Sapiens
IRSERSIIR

SEQ ID NO: 332791 - protein, 9 aa, Homo Sapiens
LTQHQNIHT

SEQ ID NO: 332792 - protein, 9 aa, Homo Sapiens
QNVKGTKSS

SEQ ID NO: 332793 - protein, 9 aa, Homo Sapiens
LQQGKSIYF

SEQ ID NO: 332794 - protein, 9 aa, Homo Sapiens
AMGYDHYVA

SEQ ID NO: 332795 - protein, 9 aa, Homo Sapiens
LGHLLDKLQ

SEQ ID NO: 332796 - protein, 9 aa, Homo Sapiens
IQFLIYPAL

SEQ ID NO: 332797 - protein, 9 aa, Homo Sapiens
EKFWKISAP

SEQ ID NO: 332798 - protein, 9 aa, Homo Sapiens
LTRFLKLLG

SEQ ID NO: 332799 - protein, 9 aa, Homo Sapiens
DLQQKYIGV

SEQ ID NO: 332800 - protein, 9 aa, Homo Sapiens
GVDLDKFRD

SEQ ID NO: 332801 - protein, 9 aa, Homo Sapiens
AFWKGYKQW

SEQ ID NO: 332802 - protein, 9 aa, Homo Sapiens
QPSRIKPMD

SEQ ID NO: 332803 - protein, 9 aa, Homo Sapiens
FITAAGCEY

SEQ ID NO: 332804 - protein, 9 aa, Homo Sapiens
VRLINSMSK

SEQ ID NO: 332805 - protein, 9 aa, Homo Sapiens
VKLCNFGFA

SEQ ID NO: 332806 - protein, 9 aa, Homo Sapiens
IRNIFYLFL

SEQ ID NO: 332807 - protein, 9 aa, Homo Sapiens
QDRDISTQH

SEQ ID NO: 332808 - protein, 9 aa, Homo Sapiens
SSAQHLDVT

SEQ ID NO: 332809 - protein, 9 aa, Homo Sapiens
SLYLIHEIT

SEQ ID NO: 332810 - protein, 9 aa, Homo Sapiens
PISNADFSV

SEQ ID NO: 332811 - protein, 9 aa, Homo Sapiens
RRKQSGRGQ

SEQ ID NO: 332812 - protein, 9 aa, Homo Sapiens
SVPNQPLKQ

SEQ ID NO: 332813 - protein, 9 aa, Homo Sapiens
AEGNTTDQA

SEQ ID NO: 332814 - protein, 9 aa, Homo Sapiens
INKCNFIKK

SEQ ID NO: 332815 - protein, 9 aa, Homo Sapiens
ISNADFSVP

SEQ ID NO: 332816 - protein, 9 aa, Homo Sapiens
RHIQKVHKK

SEQ ID NO: 332817 - protein, 9 aa, Homo Sapiens
ILKSNKRQG

SEQ ID NO: 332818 - protein, 9 aa, Homo Sapiens
KVEQETWCE

SEQ ID NO: 332819 - protein, 9 aa, Homo Sapiens
FLINGYTLM

SEQ ID NO: 332820 - protein, 9 aa, Homo Sapiens
QHLRVNTQE

SEQ ID NO: 332821 - protein, 9 aa, Homo Sapiens
LTSKINLHQ

SEQ ID NO: 332822 - protein, 9 aa, Homo Sapiens
TCRNLVNDF

SEQ ID NO: 332823 - protein, 9 aa, Homo Sapiens
KTKHIAGKI

SEQ ID NO: 332824 - protein, 9 aa, Homo Sapiens
FHVCCISVD

SEQ ID NO: 332825 - protein, 9 aa, Homo Sapiens
IPRFQMSDD

SEQ ID NO: 332826 - protein, 9 aa, Homo Sapiens
SNTSKLFSE

SEQ ID NO: 332827 - protein, 9 aa, Homo Sapiens
TCVALAIYY

SEQ ID NO: 332828 - protein, 9 aa, Homo Sapiens
KDSASNIPT

SEQ ID NO: 332829 - protein, 9 aa, Homo Sapiens
GKHHILRCM

SEQ ID NO: 332830 - protein, 9 aa, Homo Sapiens
FSAQAEIGT

SEQ ID NO: 332831 - protein, 9 aa, Homo Sapiens
SQGLFNLAL

SEQ ID NO: 332832 - protein, 9 aa, Homo Sapiens
MRIEHEHKL

SEQ ID NO: 332833 - protein, 9 aa, Homo Sapiens
KIKDMAMMT

SEQ ID NO: 332834 - protein, 9 aa, Homo Sapiens
TQCWDIKDS

SEQ ID NO: 332835 - protein, 9 aa, Homo Sapiens
KNKESVEKA

SEQ ID NO: 332836 - protein, 9 aa, Homo Sapiens
LQPDAGGVF

SEQ ID NO: 332837 - protein, 9 aa, Homo Sapiens
MFAKLKDKL

SEQ ID NO: 332838 - protein, 9 aa, Homo Sapiens
RWAQQTPVQ

SEQ ID NO: 332839 - protein, 9 aa, Homo Sapiens
YTGGYNGLN

SEQ ID NO: 332840 - protein, 9 aa, Homo Sapiens
PGLHKIEAE

SEQ ID NO: 332841 - protein, 9 aa, Homo Sapiens
SDICAAETG

SEQ ID NO: 332842 - protein, 9 aa, Homo Sapiens
DKRKKRRGK

SEQ ID NO: 332843 - protein, 9 aa, Homo Sapiens
YGLSQNTYQ

SEQ ID NO: 332844 - protein, 9 aa, Homo Sapiens
KALRVHATL

SEQ ID NO: 332845 - protein, 9 aa, Homo Sapiens
LKKLEINVF

SEQ ID NO: 332846 - protein, 9 aa, Homo Sapiens
SENNKLTCS

SEQ ID NO: 332847 - protein, 9 aa, Homo Sapiens
EEAQSDMHY

SEQ ID NO: 332848 - protein, 9 aa, Homo Sapiens
QNVTFVFDA

SEQ ID NO: 332849 - protein, 9 aa, Homo Sapiens
QRFDHIFYM

SEQ ID NO: 332850 - protein, 9 aa, Homo Sapiens
IQQQISNNT

SEQ ID NO: 332851 - protein, 9 aa, Homo Sapiens
EKTMIYFVG

SEQ ID NO: 332852 - protein, 9 aa, Homo Sapiens
KAHRLPEIQ

SEQ ID NO: 332853 - protein, 9 aa, Homo Sapiens
LPICGSSGE

SEQ ID NO: 332854 - protein, 9 aa, Homo Sapiens
LPFVTTNNK

SEQ ID NO: 332855 - protein, 9 aa, Homo Sapiens
DEEMKKICQ

SEQ ID NO: 332856 - protein, 9 aa, Homo Sapiens
IHQSKNKWK

SEQ ID NO: 332857 - protein, 9 aa, Homo Sapiens
TQVSSLVLY

SEQ ID NO: 332858 - protein, 9 aa, Homo Sapiens
ANLNIKYKR

SEQ ID NO: 332859 - protein, 9 aa, Homo Sapiens
EINIPRCSC

SEQ ID NO: 332860 - protein, 9 aa, Homo Sapiens
TLLLDEATS

SEQ ID NO: 332861 - protein, 9 aa, Homo Sapiens
ELNLMPDFF

SEQ ID NO: 332862 - protein, 9 aa, Homo Sapiens
DLALQPGDW

SEQ ID NO: 332863 - protein, 9 aa, Homo Sapiens
YQQYVKDRS

SEQ ID NO: 332864 - protein, 9 aa, Homo Sapiens
SHGKRKDNK

SEQ ID NO: 332865 - protein, 9 aa, Homo Sapiens
YLAKWMVHG

SEQ ID NO: 332866 - protein, 9 aa, Homo Sapiens
AAGCEYLAS

SEQ ID NO: 332867 - protein, 9 aa, Homo Sapiens
YLGLALDMD

SEQ ID NO: 332868 - protein, 9 aa, Homo Sapiens
DINNNPPVF

SEQ ID NO: 332869 - protein, 9 aa, Homo Sapiens
QKERLMNYF

SEQ ID NO: 332870 - protein, 9 aa, Homo Sapiens
SGKSYYKVN

SEQ ID NO: 332871 - protein, 9 aa, Homo Sapiens
ERINLLEDD

SEQ ID NO: 332872 - protein, 9 aa, Homo Sapiens
FYEKPAFDC

SEQ ID NO: 332873 - protein, 9 aa, Homo Sapiens
QDLISSKLK

SEQ ID NO: 332874 - protein, 9 aa, Homo Sapiens
IYDDGKMVE

SEQ ID NO: 332875 - protein, 9 aa, Homo Sapiens
FPPVEKPDL

SEQ ID NO: 332876 - protein, 9 aa, Homo Sapiens
EEDKKANLQ

SEQ ID NO: 332877 - protein, 9 aa, Homo Sapiens
MSNLRSLEE

SEQ ID NO: 332878 - protein, 9 aa, Homo Sapiens
VMVTVKIIS

SEQ ID NO: 332879 - protein, 9 aa, Homo Sapiens
QRFKNKLPV

SEQ ID NO: 332880 - protein, 9 aa, Homo Sapiens
ELKNLFNMC

SEQ ID NO: 332881 - protein, 9 aa, Homo Sapiens
MHVAEVAVS

SEQ ID NO: 332882 - protein, 9 aa, Homo Sapiens
RITIEDFNK

SEQ ID NO: 332883 - protein, 9 aa, Homo Sapiens
NIASAMIIW

SEQ ID NO: 332884 - protein, 9 aa, Homo Sapiens
RDRLQINRF

SEQ ID NO: 332885 - protein, 9 aa, Homo Sapiens
GDPDVECQA

SEQ ID NO: 332886 - protein, 9 aa, Homo Sapiens
AKNERRYSL

SEQ ID NO: 332887 - protein, 9 aa, Homo Sapiens
YWPLWDLGV

SEQ ID NO: 332888 - protein, 9 aa, Homo Sapiens
SLDHSETRL

SEQ ID NO: 332889 - protein, 9 aa, Homo Sapiens
QQISSGEYR

SEQ ID NO: 332890 - protein, 9 aa, Homo Sapiens
RPKPERNIL

SEQ ID NO: 332891 - protein, 9 aa, Homo Sapiens
ITIEDFNKF

SEQ ID NO: 332892 - protein, 9 aa, Homo Sapiens
TTYQRDYSL

SEQ ID NO: 332893 - protein, 9 aa, Homo Sapiens
IIWHRPALV

SEQ ID NO: 332894 - protein, 9 aa, Homo Sapiens
ESDKENGIF

SEQ ID NO: 332895 - protein, 9 aa, Homo Sapiens
TQNIKVSRL

SEQ ID NO: 332896 - protein, 9 aa, Homo Sapiens
TEELNALKS

SEQ ID NO: 332897 - protein, 9 aa, Homo Sapiens
WVVEFGSLE

SEQ ID NO: 332898 - protein, 9 aa, Homo Sapiens
SRVASPKNK

SEQ ID NO: 332899 - protein, 9 aa, Homo Sapiens
HYDVVMKLW

SEQ ID NO: 332900 - protein, 9 aa, Homo Sapiens
GKYLAKWMV

SEQ ID NO: 332901 - protein, 9 aa, Homo Sapiens
LEKDILSLY

SEQ ID NO: 332902 - protein, 9 aa, Homo Sapiens
QNCGTEKKN

SEQ ID NO: 332903 - protein, 9 aa, Homo Sapiens
TVSISVVSG

SEQ ID NO: 332904 - protein, 9 aa, Homo Sapiens
RSHHYHRKE

SEQ ID NO: 332905 - protein, 9 aa, Homo Sapiens
SAKERRSLL

SEQ ID NO: 332906 - protein, 9 aa, Homo Sapiens
ELITQLELD

SEQ ID NO: 332907 - protein, 9 aa, Homo Sapiens
YPQTRWYKD

SEQ ID NO: 332908 - protein, 9 aa, Homo Sapiens
WAVFRLTHP

SEQ ID NO: 332909 - protein, 9 aa, Homo Sapiens
QENMAYVAV

SEQ ID NO: 332910 - protein, 9 aa, Homo Sapiens
WQNNDRVQV

SEQ ID NO: 332911 - protein, 9 aa, Homo Sapiens
SPVEFFRPD

SEQ ID NO: 332912 - protein, 9 aa, Homo Sapiens
QGVSHLHIN

SEQ ID NO: 332913 - protein, 9 aa, Homo Sapiens
QKMEYFSAV

SEQ ID NO: 332914 - protein, 9 aa, Homo Sapiens
RVYLLNDDL

SEQ ID NO: 332915 - protein, 9 aa, Homo Sapiens
CVVCVSQLA

SEQ ID NO: 332916 - protein, 9 aa, Homo Sapiens
ANNNLLALP

SEQ ID NO: 332917 - protein, 9 aa, Homo Sapiens
PFQDDQEFE

SEQ ID NO: 332918 - protein, 9 aa, Homo Sapiens
DIEITNSSG

SEQ ID NO: 332919 - protein, 9 aa, Homo Sapiens
NLISNLWDS

SEQ ID NO: 332920 - protein, 9 aa, Homo Sapiens
VVYYAFKIS

SEQ ID NO: 332921 - protein, 9 aa, Homo Sapiens
RYSLSHDFN

SEQ ID NO: 332922 - protein, 9 aa, Homo Sapiens
WVYDEEATD

SEQ ID NO: 332923 - protein, 9 aa, Homo Sapiens
SFPQEVAEQ

SEQ ID NO: 332924 - protein, 9 aa, Homo Sapiens
GIPSILKYA

SEQ ID NO: 332925 - protein, 9 aa, Homo Sapiens
TTDICVGPE

SEQ ID NO: 332926 - protein, 9 aa, Homo Sapiens
THTCNPPWA

SEQ ID NO: 332927 - protein, 9 aa, Homo Sapiens
LQQEMLSRL

SEQ ID NO: 332928 - protein, 9 aa, Homo Sapiens
TKNVNLNTG

SEQ ID NO: 332929 - protein, 9 aa, Homo Sapiens
EGSPGPPGP

SEQ ID NO: 332930 - protein, 9 aa, Homo Sapiens
LQKKSVLLT

SEQ ID NO: 332931 - protein, 9 aa, Homo Sapiens
EEIVRSSIQ

SEQ ID NO: 332932 - protein, 9 aa, Homo Sapiens
TLGVVRLHI

SEQ ID NO: 332933 - protein, 9 aa, Homo Sapiens
IEACTAGCD

SEQ ID NO: 332934 - protein, 9 aa, Homo Sapiens
IHHILKANA

SEQ ID NO: 332935 - protein, 9 aa, Homo Sapiens
DRLHVDFAQ

SEQ ID NO: 332936 - protein, 9 aa, Homo Sapiens
GKNALKDAK

SEQ ID NO: 332937 - protein, 9 aa, Homo Sapiens
LEYFMKNSD

SEQ ID NO: 332938 - protein, 9 aa, Homo Sapiens
YSILESFIH

SEQ ID NO: 332939 - protein, 9 aa, Homo Sapiens
ECSKCGNSF

SEQ ID NO: 332940 - protein, 9 aa, Homo Sapiens
ISNKGAKTL

SEQ ID NO: 332941 - protein, 9 aa, Homo Sapiens
DVSTRWQKQ

SEQ ID NO: 332942 - protein, 9 aa, Homo Sapiens
IGKNGKIHD

SEQ ID NO: 332943 - protein, 9 aa, Homo Sapiens
QIHSAAVSC

SEQ ID NO: 332944 - protein, 9 aa, Homo Sapiens
KDSSAAWNE

SEQ ID NO: 332945 - protein, 9 aa, Homo Sapiens
IGEKFYRQS

SEQ ID NO: 332946 - protein, 9 aa, Homo Sapiens
DSLVTANTT

SEQ ID NO: 332947 - protein, 9 aa, Homo Sapiens
HRLANKAVQ

SEQ ID NO: 332948 - protein, 9 aa, Homo Sapiens
TNVDIQMVK

SEQ ID NO: 332949 - protein, 9 aa, Homo Sapiens
IKTCVGLPF

SEQ ID NO: 332950 - protein, 9 aa, Homo Sapiens
SVGGKIIES

SEQ ID NO: 332951 - protein, 9 aa, Homo Sapiens
IKIEGNRLT

SEQ ID NO: 332952 - protein, 9 aa, Homo Sapiens
VVMCRHPLV

SEQ ID NO: 332953 - protein, 9 aa, Homo Sapiens
PDIALPLNS

SEQ ID NO: 332954 - protein, 9 aa, Homo Sapiens
PKTTLTLKE

SEQ ID NO: 332955 - protein, 9 aa, Homo Sapiens
YVKKGDTRL

SEQ ID NO: 332956 - protein, 9 aa, Homo Sapiens
IRVPFFICG

SEQ ID NO: 332957 - protein, 9 aa, Homo Sapiens
DYEFKTCLL

SEQ ID NO: 332958 - protein, 9 aa, Homo Sapiens
NKHYANIGK

SEQ ID NO: 332959 - protein, 9 aa, Homo Sapiens
DFSELKQPR

SEQ ID NO: 332960 - protein, 9 aa, Homo Sapiens
DNSCTNKLR

SEQ ID NO: 332961 - protein, 9 aa, Homo Sapiens
LHMVDGGGR

SEQ ID NO: 332962 - protein, 9 aa, Homo Sapiens
YKFSGCCFS

SEQ ID NO: 332963 - protein, 9 aa, Homo Sapiens
VNGATVINE

SEQ ID NO: 332964 - protein, 9 aa, Homo Sapiens
FANLLSPVA

SEQ ID NO: 332965 - protein, 9 aa, Homo Sapiens
AADWSKDIQ

SEQ ID NO: 332966 - protein, 9 aa, Homo Sapiens
GNSFRGKSH

SEQ ID NO: 332967 - protein, 9 aa, Homo Sapiens
NASENKEIV

SEQ ID NO: 332968 - protein, 9 aa, Homo Sapiens
ASAGIGYGC

SEQ ID NO: 332969 - protein, 9 aa, Homo Sapiens
GYMINLDYS

SEQ ID NO: 332970 - protein, 9 aa, Homo Sapiens
TYLLQNISS

SEQ ID NO: 332971 - protein, 9 aa, Homo Sapiens
VVNHFQKAN

SEQ ID NO: 332972 - protein, 9 aa, Homo Sapiens
AIQRTEELK

SEQ ID NO: 332973 - protein, 9 aa, Homo Sapiens
YLVKKHTVE

SEQ ID NO: 332974 - protein, 9 aa, Homo Sapiens
MYDAVTNKH

SEQ ID NO: 332975 - protein, 9 aa, Homo Sapiens
MADKENMKK

SEQ ID NO: 332976 - protein, 9 aa, Homo Sapiens
EISRIKTLQ

SEQ ID NO: 332977 - protein, 9 aa, Homo Sapiens
QEILQRLEK

SEQ ID NO: 332978 - protein, 9 aa, Homo Sapiens
NQNGQKVRP

SEQ ID NO: 332979 - protein, 9 aa, Homo Sapiens
DFLASQEFD

SEQ ID NO: 332980 - protein, 9 aa, Homo Sapiens
RFQMPVSSQ

SEQ ID NO: 332981 - protein, 9 aa, Homo Sapiens
MIKQGLIQN

SEQ ID NO: 332982 - protein, 9 aa, Homo Sapiens
PPFGDAFQS

SEQ ID NO: 332983 - protein, 9 aa, Homo Sapiens
INFIVEPTF

SEQ ID NO: 332984 - protein, 9 aa, Homo Sapiens
FSPKQQYKP

SEQ ID NO: 332985 - protein, 9 aa, Homo Sapiens
FAKHQIIHT

SEQ ID NO: 332986 - protein, 9 aa, Homo Sapiens
SRRRFWKIN

SEQ ID NO: 332987 - protein, 9 aa, Homo Sapiens
LGFLFLAAR

SEQ ID NO: 332988 - protein, 9 aa, Homo Sapiens
LPLLLPSGS

SEQ ID NO: 332989 - protein, 9 aa, Homo Sapiens
KVMVTLGEE

SEQ ID NO: 332990 - protein, 9 aa, Homo Sapiens
NLGWAPLHL

SEQ ID NO: 332991 - protein, 9 aa, Homo Sapiens
GGNQRLLSD

SEQ ID NO: 332992 - protein, 9 aa, Homo Sapiens
LTHPGVITR

SEQ ID NO: 332993 - protein, 9 aa, Homo Sapiens
EYKRIILAL

SEQ ID NO: 332994 - protein, 9 aa, Homo Sapiens
GNTTENINN

SEQ ID NO: 332995 - protein, 9 aa, Homo Sapiens
IAASVNANF

SEQ ID NO: 332996 - protein, 9 aa, Homo Sapiens
IETVHGFVS

SEQ ID NO: 332997 - protein, 9 aa, Homo Sapiens
VHIHNEISW

SEQ ID NO: 332998 - protein, 9 aa, Homo Sapiens
QIEQIKQLS

SEQ ID NO: 332999 - protein, 9 aa, Homo Sapiens
KVKELVRIL

SEQ ID NO: 333000 - protein, 9 aa, Homo Sapiens
RKDELNHSL

SEQ ID NO: 333001 - protein, 9 aa, Homo Sapiens
KTKNNLKKF

SEQ ID NO: 333002 - protein, 9 aa, Homo Sapiens
TLYQGGNQR

SEQ ID NO: 333003 - protein, 9 aa, Homo Sapiens
WASYTGQED

SEQ ID NO: 333004 - protein, 9 aa, Homo Sapiens
VEIQITLNQ

SEQ ID NO: 333005 - protein, 9 aa, Homo Sapiens
KFLEEIAKA

SEQ ID NO: 333006 - protein, 9 aa, Homo Sapiens
SDKELTIKP

SEQ ID NO: 333007 - protein, 9 aa, Homo Sapiens
KIVDFLNPL

SEQ ID NO: 333008 - protein, 9 aa, Homo Sapiens
KTIKTSSGK

SEQ ID NO: 333009 - protein, 9 aa, Homo Sapiens
FEMVPQTAP

SEQ ID NO: 333010 - protein, 9 aa, Homo Sapiens
EEVIQEKLL

SEQ ID NO: 333011 - protein, 9 aa, Homo Sapiens
VNRQISVAA

SEQ ID NO: 333012 - protein, 9 aa, Homo Sapiens
QFQLELIKT

SEQ ID NO: 333013 - protein, 9 aa, Homo Sapiens
KSEESYNIN

SEQ ID NO: 333014 - protein, 9 aa, Homo Sapiens
APPPTQGLE

SEQ ID NO: 333015 - protein, 9 aa, Homo Sapiens
VSQDCYTRI

SEQ ID NO: 333016 - protein, 9 aa, Homo Sapiens
MKFQGAFHK

SEQ ID NO: 333017 - protein, 9 aa, Homo Sapiens
PLAVRACVI

SEQ ID NO: 333018 - protein, 9 aa, Homo Sapiens
AQQLRDIFN

SEQ ID NO: 333019 - protein, 9 aa, Homo Sapiens
PNTTGPPSA

SEQ ID NO: 333020 - protein, 9 aa, Homo Sapiens
SYQEEAAMA

SEQ ID NO: 333021 - protein, 9 aa, Homo Sapiens
AVCEKVFDV

SEQ ID NO: 333022 - protein, 9 aa, Homo Sapiens
AEQLRAHLD

SEQ ID NO: 333023 - protein, 9 aa, Homo Sapiens
SNKALKKIC

SEQ ID NO: 333024 - protein, 9 aa, Homo Sapiens
QVAGLLPKK

SEQ ID NO: 333025 - protein, 9 aa, Homo Sapiens
SNPKNMENL

SEQ ID NO: 333026 - protein, 9 aa, Homo Sapiens
TLMILLSQI

SEQ ID NO: 333027 - protein, 9 aa, Homo Sapiens
VFLLLKDNY

SEQ ID NO: 333028 - protein, 9 aa, Homo Sapiens
PFQRVREEE

SEQ ID NO: 333029 - protein, 9 aa, Homo Sapiens
SLVCKELRS

SEQ ID NO: 333030 - protein, 9 aa, Homo Sapiens
PNQEKYSSS

SEQ ID NO: 333031 - protein, 9 aa, Homo Sapiens
GKDGPKYCS

SEQ ID NO: 333032 - protein, 9 aa, Homo Sapiens
HMRNHTGEK

SEQ ID NO: 333033 - protein, 9 aa, Homo Sapiens
SSVRIYDWR

SEQ ID NO: 333034 - protein, 9 aa, Homo Sapiens
CDGLGTGDG

SEQ ID NO: 333035 - protein, 9 aa, Homo Sapiens
MKHFGWEAD

SEQ ID NO: 333036 - protein, 9 aa, Homo Sapiens
DKWLLQKKA

SEQ ID NO: 333037 - protein, 9 aa, Homo Sapiens
ELLSTVNSL

SEQ ID NO: 333038 - protein, 9 aa, Homo Sapiens
MICHTTNLT

SEQ ID NO: 333039 - protein, 9 aa, Homo Sapiens
KCIERNEQK

SEQ ID NO: 333040 - protein, 9 aa, Homo Sapiens
DVRRQIPIK

SEQ ID NO: 333041 - protein, 9 aa, Homo Sapiens
DLVMEIGDQ

SEQ ID NO: 333042 - protein, 9 aa, Homo Sapiens
MCRHPLVYV

SEQ ID NO: 333043 - protein, 9 aa, Homo Sapiens
TEKTMIYFV

SEQ ID NO: 333044 - protein, 9 aa, Homo Sapiens
ITEISRDLD

SEQ ID NO: 333045 - protein, 9 aa, Homo Sapiens
DMDLQACID

SEQ ID NO: 333046 - protein, 9 aa, Homo Sapiens
SWWSFTSST

SEQ ID NO: 333047 - protein, 9 aa, Homo Sapiens
FVGIYSTIW

SEQ ID NO: 333048 - protein, 9 aa, Homo Sapiens
VRLAAKYLD

SEQ ID NO: 333049 - protein, 9 aa, Homo Sapiens
KIKLKIQFL

SEQ ID NO: 333050 - protein, 9 aa, Homo Sapiens
LSRSAQLTG

SEQ ID NO: 333051 - protein, 9 aa, Homo Sapiens
CLSFGHSKC

SEQ ID NO: 333052 - protein, 9 aa, Homo Sapiens
KYTITCVAL

SEQ ID NO: 333053 - protein, 9 aa, Homo Sapiens
MFVHPEWRR

SEQ ID NO: 333054 - protein, 9 aa, Homo Sapiens
RSSSRSHVR

SEQ ID NO: 333055 - protein, 9 aa, Homo Sapiens
NFMQELMAQ

SEQ ID NO: 333056 - protein, 9 aa, Homo Sapiens
KEEEENNEK

SEQ ID NO: 333057 - protein, 9 aa, Homo Sapiens
GKPDSSPIT

SEQ ID NO: 333058 - protein, 9 aa, Homo Sapiens
VETEKEKRK

SEQ ID NO: 333059 - protein, 9 aa, Homo Sapiens
NTTDQAGFS

SEQ ID NO: 333060 - protein, 9 aa, Homo Sapiens
QIDSMDSNV

SEQ ID NO: 333061 - protein, 9 aa, Homo Sapiens
GPEMANMVP

SEQ ID NO: 333062 - protein, 9 aa, Homo Sapiens
YMYLLPYTK

SEQ ID NO: 333063 - protein, 9 aa, Homo Sapiens
QRGTMGETA

SEQ ID NO: 333064 - protein, 9 aa, Homo Sapiens
ATIKTKHTI

SEQ ID NO: 333065 - protein, 9 aa, Homo Sapiens
NRLQSLSRN

SEQ ID NO: 333066 - protein, 9 aa, Homo Sapiens
SDDEEDASS

SEQ ID NO: 333067 - protein, 9 aa, Homo Sapiens
QHRLVVLFG

SEQ ID NO: 333068 - protein, 9 aa, Homo Sapiens
HKSSMKKLM

SEQ ID NO: 333069 - protein, 9 aa, Homo Sapiens
VQLRDGDRY

SEQ ID NO: 333070 - protein, 9 aa, Homo Sapiens
WKFCVEHHT

SEQ ID NO: 333071 - protein, 9 aa, Homo Sapiens
LIAKLIMFR

SEQ ID NO: 333072 - protein, 9 aa, Homo Sapiens
LHPLTELTG

SEQ ID NO: 333073 - protein, 9 aa, Homo Sapiens
GRSSCCSQT

SEQ ID NO: 333074 - protein, 9 aa, Homo Sapiens
DFGSSCFKY

SEQ ID NO: 333075 - protein, 9 aa, Homo Sapiens
GAGRFHSTA

SEQ ID NO: 333076 - protein, 9 aa, Homo Sapiens
QIIDQRDYS

SEQ ID NO: 333077 - protein, 9 aa, Homo Sapiens
RCPSEIVIG

SEQ ID NO: 333078 - protein, 9 aa, Homo Sapiens
PLVEKFSPP

SEQ ID NO: 333079 - protein, 9 aa, Homo Sapiens
GRTARAGHS

SEQ ID NO: 333080 - protein, 9 aa, Homo Sapiens
WSTKSETNH

SEQ ID NO: 333081 - protein, 9 aa, Homo Sapiens
VCEKVFDVI

SEQ ID NO: 333082 - protein, 9 aa, Homo Sapiens
DKAEFDDKH

SEQ ID NO: 333083 - protein, 9 aa, Homo Sapiens
TQQQKVVSV

SEQ ID NO: 333084 - protein, 9 aa, Homo Sapiens
YECIECVKT

SEQ ID NO: 333085 - protein, 9 aa, Homo Sapiens
SGRIALVVE

SEQ ID NO: 333086 - protein, 9 aa, Homo Sapiens
TSVGLLQNK

SEQ ID NO: 333087 - protein, 9 aa, Homo Sapiens
LSTFEESVS

SEQ ID NO: 333088 - protein, 9 aa, Homo Sapiens
LNVDTKSTR

SEQ ID NO: 333089 - protein, 9 aa, Homo Sapiens
DNDTSSDPL

SEQ ID NO: 333090 - protein, 9 aa, Homo Sapiens
GLSEEVTFQ

SEQ ID NO: 333091 - protein, 9 aa, Homo Sapiens
PISGHKHIK

SEQ ID NO: 333092 - protein, 9 aa, Homo Sapiens
GSNDAHTKK

SEQ ID NO: 333093 - protein, 9 aa, Homo Sapiens
VNTQETLYQ

SEQ ID NO: 333094 - protein, 9 aa, Homo Sapiens
QQGKSIYFS

SEQ ID NO: 333095 - protein, 9 aa, Homo Sapiens
PTTATGNNS

SEQ ID NO: 333096 - protein, 9 aa, Homo Sapiens
KTYECSGCG

SEQ ID NO: 333097 - protein, 9 aa, Homo Sapiens
QKIVDFLNP

SEQ ID NO: 333098 - protein, 9 aa, Homo Sapiens
NVEVKDINN

SEQ ID NO: 333099 - protein, 9 aa, Homo Sapiens
TNGNTLWRT

SEQ ID NO: 333100 - protein, 9 aa, Homo Sapiens
FEKLWLSLQ

SEQ ID NO: 333101 - protein, 9 aa, Homo Sapiens
PCVSGTVHT

SEQ ID NO: 333102 - protein, 9 aa, Homo Sapiens
RWANILEKD

SEQ ID NO: 333103 - protein, 9 aa, Homo Sapiens
ATEENKSLK

SEQ ID NO: 333104 - protein, 9 aa, Homo Sapiens
CHNGGTCRN

SEQ ID NO: 333105 - protein, 9 aa, Homo Sapiens
AEQFLRVMT

SEQ ID NO: 333106 - protein, 9 aa, Homo Sapiens
EHLQNELRE

SEQ ID NO: 333107 - protein, 9 aa, Homo Sapiens
AGQSQSCVT

SEQ ID NO: 333108 - protein, 9 aa, Homo Sapiens
HAQTVVICV

SEQ ID NO: 333109 - protein, 9 aa, Homo Sapiens
KFIIANVRV

SEQ ID NO: 333110 - protein, 9 aa, Homo Sapiens
LLGQSLAET

SEQ ID NO: 333111 - protein, 9 aa, Homo Sapiens
FFLEATNIK

SEQ ID NO: 333112 - protein, 9 aa, Homo Sapiens
APLLNDILK

SEQ ID NO: 333113 - protein, 9 aa, Homo Sapiens
GQGILELLW

SEQ ID NO: 333114 - protein, 9 aa, Homo Sapiens
SHFAQDIWP

SEQ ID NO: 333115 - protein, 9 aa, Homo Sapiens
KSNKRQGWR

SEQ ID NO: 333116 - protein, 9 aa, Homo Sapiens
GHSKCLLLV

SEQ ID NO: 333117 - protein, 9 aa, Homo Sapiens
TNVQFSDDK

SEQ ID NO: 333118 - protein, 9 aa, Homo Sapiens
RYSPGWDVK

SEQ ID NO: 333119 - protein, 9 aa, Homo Sapiens
IVAIFCVHW

SEQ ID NO: 333120 - protein, 9 aa, Homo Sapiens
LALSVTLPT

SEQ ID NO: 333121 - protein, 9 aa, Homo Sapiens
KLFFSGSAK

SEQ ID NO: 333122 - protein, 9 aa, Homo Sapiens
ELGWLCPQA

SEQ ID NO: 333123 - protein, 9 aa, Homo Sapiens
NSCPFICSR

SEQ ID NO: 333124 - protein, 9 aa, Homo Sapiens
MASSHFVDL

SEQ ID NO: 333125 - protein, 9 aa, Homo Sapiens
DLVGAPRFF

SEQ ID NO: 333126 - protein, 9 aa, Homo Sapiens
LINYYVQMC

SEQ ID NO: 333127 - protein, 9 aa, Homo Sapiens
LTVTLSVNV

SEQ ID NO: 333128 - protein, 9 aa, Homo Sapiens
HQRGTMGET

SEQ ID NO: 333129 - protein, 9 aa, Homo Sapiens
GERRKFGVS

SEQ ID NO: 333130 - protein, 9 aa, Homo Sapiens
YLEFSPGKE

SEQ ID NO: 333131 - protein, 9 aa, Homo Sapiens
KVLQGSSVL

SEQ ID NO: 333132 - protein, 9 aa, Homo Sapiens
EAAHMFFEG

SEQ ID NO: 333133 - protein, 9 aa, Homo Sapiens
LSACLISLL

SEQ ID NO: 333134 - protein, 9 aa, Homo Sapiens
SIVTHRAQE

SEQ ID NO: 333135 - protein, 9 aa, Homo Sapiens
KLCFFQEEM

SEQ ID NO: 333136 - protein, 9 aa, Homo Sapiens
IPLEKLEKQ

SEQ ID NO: 333137 - protein, 9 aa, Homo Sapiens
YTGLAIHIQ

SEQ ID NO: 333138 - protein, 9 aa, Homo Sapiens
IFQNIQEME

SEQ ID NO: 333139 - protein, 9 aa, Homo Sapiens
DEEINQTEE

SEQ ID NO: 333140 - protein, 9 aa, Homo Sapiens
TIQHCPLYK

SEQ ID NO: 333141 - protein, 9 aa, Homo Sapiens
VFLVHKISG

SEQ ID NO: 333142 - protein, 9 aa, Homo Sapiens
QVTGKTVGT

SEQ ID NO: 333143 - protein, 9 aa, Homo Sapiens
LCLPEDIWT

SEQ ID NO: 333144 - protein, 9 aa, Homo Sapiens
ISVPTNDLN

SEQ ID NO: 333145 - protein, 9 aa, Homo Sapiens
CEITTTLSF

SEQ ID NO: 333146 - protein, 9 aa, Homo Sapiens
EQLLAAQNP

SEQ ID NO: 333147 - protein, 9 aa, Homo Sapiens
PITQCWDIK

SEQ ID NO: 333148 - protein, 9 aa, Homo Sapiens
AALTQAICT

SEQ ID NO: 333149 - protein, 9 aa, Homo Sapiens
RDAGAPVYL

SEQ ID NO: 333150 - protein, 9 aa, Homo Sapiens
SRSHVRTRG

SEQ ID NO: 333151 - protein, 9 aa, Homo Sapiens
LCNKIDVVK

SEQ ID NO: 333152 - protein, 9 aa, Homo Sapiens
EQPERICQR

SEQ ID NO: 333153 - protein, 9 aa, Homo Sapiens
AKGPLRVGA

SEQ ID NO: 333154 - protein, 9 aa, Homo Sapiens
PKRHHKQLK

SEQ ID NO: 333155 - protein, 9 aa, Homo Sapiens
CNLDKERMT

SEQ ID NO: 333156 - protein, 9 aa, Homo Sapiens
QSQLTSNRQ

SEQ ID NO: 333157 - protein, 9 aa, Homo Sapiens
LSITVRHAK

SEQ ID NO: 333158 - protein, 9 aa, Homo Sapiens
LAKGSPKRH

SEQ ID NO: 333159 - protein, 9 aa, Homo Sapiens
YPNEWYLNR

SEQ ID NO: 333160 - protein, 9 aa, Homo Sapiens
DSVVHLINY

SEQ ID NO: 333161 - protein, 9 aa, Homo Sapiens
AERAEAEQQ

SEQ ID NO: 333162 - protein, 9 aa, Homo Sapiens
FICGPSVEP

SEQ ID NO: 333163 - protein, 9 aa, Homo Sapiens
LEKTSNSTG

SEQ ID NO: 333164 - protein, 9 aa, Homo Sapiens
CFRVRKMIN

SEQ ID NO: 333165 - protein, 9 aa, Homo Sapiens
EYEKRVLAI

SEQ ID NO: 333166 - protein, 9 aa, Homo Sapiens
HLSMFLPTL

SEQ ID NO: 333167 - protein, 9 aa, Homo Sapiens
EIRNIFYLF

SEQ ID NO: 333168 - protein, 9 aa, Homo Sapiens
EAMLDMLLQ

SEQ ID NO: 333169 - protein, 9 aa, Homo Sapiens
GLTPTKKIQ

SEQ ID NO: 333170 - protein, 9 aa, Homo Sapiens
CSEDCCKKV

SEQ ID NO: 333171 - protein, 9 aa, Homo Sapiens
VEQLLKKGY

SEQ ID NO: 333172 - protein, 9 aa, Homo Sapiens
YLAIVHATH

SEQ ID NO: 333173 - protein, 9 aa, Homo Sapiens
FDCIYFNGV

SEQ ID NO: 333174 - protein, 9 aa, Homo Sapiens
SEDITPLPG

SEQ ID NO: 333175 - protein, 9 aa, Homo Sapiens
IKQVVNLSP

SEQ ID NO: 333176 - protein, 9 aa, Homo Sapiens
CLQTESPES

SEQ ID NO: 333177 - protein, 9 aa, Homo Sapiens
TGQEDCLEL

SEQ ID NO: 333178 - protein, 9 aa, Homo Sapiens
WVVENLEHS

SEQ ID NO: 333179 - protein, 9 aa, Homo Sapiens
FKQTLEPTL

SEQ ID NO: 333180 - protein, 9 aa, Homo Sapiens
STEKTMIYF

SEQ ID NO: 333181 - protein, 9 aa, Homo Sapiens
FEPSNKLYV

SEQ ID NO: 333182 - protein, 9 aa, Homo Sapiens
LHNRSRIQV

SEQ ID NO: 333183 - protein, 9 aa, Homo Sapiens
KASAFLHME

SEQ ID NO: 333184 - protein, 9 aa, Homo Sapiens
ALIKDIWEN

SEQ ID NO: 333185 - protein, 9 aa, Homo Sapiens
AIFEKPRLS

SEQ ID NO: 333186 - protein, 9 aa, Homo Sapiens
TLLLHPDSS

SEQ ID NO: 333187 - protein, 9 aa, Homo Sapiens
HGLGNRVLV

SEQ ID NO: 333188 - protein, 9 aa, Homo Sapiens
KYFVTFEVK

SEQ ID NO: 333189 - protein, 9 aa, Homo Sapiens
SDKRTFLRQ

SEQ ID NO: 333190 - protein, 9 aa, Homo Sapiens
IHQLKKEEQ

SEQ ID NO: 333191 - protein, 9 aa, Homo Sapiens
ADCHGKSQG

SEQ ID NO: 333192 - protein, 9 aa, Homo Sapiens
CFHKHGTSF

SEQ ID NO: 333193 - protein, 9 aa, Homo Sapiens
EHERLLERE

SEQ ID NO: 333194 - protein, 9 aa, Homo Sapiens
EVKHICGEY

SEQ ID NO: 333195 - protein, 9 aa, Homo Sapiens
LASHRKLGM

SEQ ID NO: 333196 - protein, 9 aa, Homo Sapiens
KIVDDPKTL

SEQ ID NO: 333197 - protein, 9 aa, Homo Sapiens
CLFVHFLNG

SEQ ID NO: 333198 - protein, 9 aa, Homo Sapiens
AERLGLHQD

SEQ ID NO: 333199 - protein, 9 aa, Homo Sapiens
SSGRFHKRK

SEQ ID NO: 333200 - protein, 9 aa, Homo Sapiens
NVRPSEYIN

SEQ ID NO: 333201 - protein, 9 aa, Homo Sapiens
GPCHPTLQF

SEQ ID NO: 333202 - protein, 9 aa, Homo Sapiens
SEDSPIRFL

SEQ ID NO: 333203 - protein, 9 aa, Homo Sapiens
NAAQPQCPV

SEQ ID NO: 333204 - protein, 9 aa, Homo Sapiens
EGNHLAQSK

SEQ ID NO: 333205 - protein, 9 aa, Homo Sapiens
PGSAATVSV

SEQ ID NO: 333206 - protein, 9 aa, Homo Sapiens
IQNGPYRQL

SEQ ID NO: 333207 - protein, 9 aa, Homo Sapiens
LGYNRLQSL

SEQ ID NO: 333208 - protein, 9 aa, Homo Sapiens
QKSMQGKKS

SEQ ID NO: 333209 - protein, 9 aa, Homo Sapiens
GPPKHCPVV

SEQ ID NO: 333210 - protein, 9 aa, Homo Sapiens
HLPLSECIR

SEQ ID NO: 333211 - protein, 9 aa, Homo Sapiens
SLCTLGVVR

SEQ ID NO: 333212 - protein, 9 aa, Homo Sapiens
FLMKDGDKN

SEQ ID NO: 333213 - protein, 9 aa, Homo Sapiens
GREHLGLNV

SEQ ID NO: 333214 - protein, 9 aa, Homo Sapiens
YYIVSVCCE

SEQ ID NO: 333215 - protein, 9 aa, Homo Sapiens
AQPATKDKF

SEQ ID NO: 333216 - protein, 9 aa, Homo Sapiens
LYQDKLFQW

SEQ ID NO: 333217 - protein, 9 aa, Homo Sapiens
EEHKKFENL

SEQ ID NO: 333218 - protein, 9 aa, Homo Sapiens
RILQDKENL

SEQ ID NO: 333219 - protein, 9 aa, Homo Sapiens
KAFARWPSL

SEQ ID NO: 333220 - protein, 9 aa, Homo Sapiens
SPQKRSYSS

SEQ ID NO: 333221 - protein, 9 aa, Homo Sapiens
SDQSDDENI

SEQ ID NO: 333222 - protein, 9 aa, Homo Sapiens
LQDPPLYPP

SEQ ID NO: 333223 - protein, 9 aa, Homo Sapiens
HSIATLAIT

SEQ ID NO: 333224 - protein, 9 aa, Homo Sapiens
GSTPQISLS

SEQ ID NO: 333225 - protein, 9 aa, Homo Sapiens
DMHKTKKKK

SEQ ID NO: 333226 - protein, 9 aa, Homo Sapiens
LSTEKTMIY

SEQ ID NO: 333227 - protein, 9 aa, Homo Sapiens
RKNYQTLTS

SEQ ID NO: 333228 - protein, 9 aa, Homo Sapiens
GYTSKWTNN

SEQ ID NO: 333229 - protein, 9 aa, Homo Sapiens
KVASLQVPR

SEQ ID NO: 333230 - protein, 9 aa, Homo Sapiens
LSSLFQRPP

SEQ ID NO: 333231 - protein, 9 aa, Homo Sapiens
TDSALKPAF

SEQ ID NO: 333232 - protein, 9 aa, Homo Sapiens
CDGALIAKD

SEQ ID NO: 333233 - protein, 9 aa, Homo Sapiens
VLMGPYHPD

SEQ ID NO: 333234 - protein, 9 aa, Homo Sapiens
LAGGWQTLQ

SEQ ID NO: 333235 - protein, 9 aa, Homo Sapiens
ASCNEPLET

SEQ ID NO: 333236 - protein, 9 aa, Homo Sapiens
DKRKEFIKT

SEQ ID NO: 333237 - protein, 9 aa, Homo Sapiens
KLVVVGAGD

SEQ ID NO: 333238 - protein, 9 aa, Homo Sapiens
NSCPSTETE

SEQ ID NO: 333239 - protein, 9 aa, Homo Sapiens
KAVTFDLSG

SEQ ID NO: 333240 - protein, 9 aa, Homo Sapiens
SELNKWSCE

SEQ ID NO: 333241 - protein, 9 aa, Homo Sapiens
GVSLMDRPL

SEQ ID NO: 333242 - protein, 9 aa, Homo Sapiens
RNSKSKLLQ

SEQ ID NO: 333243 - protein, 9 aa, Homo Sapiens
DKLMDLRNE

SEQ ID NO: 333244 - protein, 9 aa, Homo Sapiens
CHSFQIHEI

SEQ ID NO: 333245 - protein, 9 aa, Homo Sapiens
ALVNTSKNG

SEQ ID NO: 333246 - protein, 9 aa, Homo Sapiens
LGSHLMSLL

SEQ ID NO: 333247 - protein, 9 aa, Homo Sapiens
RQIDDDKGR

SEQ ID NO: 333248 - protein, 9 aa, Homo Sapiens
VTKNNGPGS

SEQ ID NO: 333249 - protein, 9 aa, Homo Sapiens
KYSTLKHEG

SEQ ID NO: 333250 - protein, 9 aa, Homo Sapiens
ERLLYVTCL

SEQ ID NO: 333251 - protein, 9 aa, Homo Sapiens
ELYWHLKRH

SEQ ID NO: 333252 - protein, 9 aa, Homo Sapiens
QDLQQKYIG

SEQ ID NO: 333253 - protein, 9 aa, Homo Sapiens
HLRKYNEVL

SEQ ID NO: 333254 - protein, 9 aa, Homo Sapiens
SNIQGVPQT

SEQ ID NO: 333255 - protein, 9 aa, Homo Sapiens
KHLITGFNT

SEQ ID NO: 333256 - protein, 9 aa, Homo Sapiens
GSPEILWKR

SEQ ID NO: 333257 - protein, 9 aa, Homo Sapiens
GTGRLFFKF

SEQ ID NO: 333258 - protein, 9 aa, Homo Sapiens
SSCTNQNAI

SEQ ID NO: 333259 - protein, 9 aa, Homo Sapiens
VQKQLWDVA

SEQ ID NO: 333260 - protein, 9 aa, Homo Sapiens
KDTPYEAVH

SEQ ID NO: 333261 - protein, 9 aa, Homo Sapiens
TNLVKNQLC

SEQ ID NO: 333262 - protein, 9 aa, Homo Sapiens
LMCDVHSIT

SEQ ID NO: 333263 - protein, 9 aa, Homo Sapiens
QIKFYEENG

SEQ ID NO: 333264 - protein, 9 aa, Homo Sapiens
YSPSAYTQE

SEQ ID NO: 333265 - protein, 9 aa, Homo Sapiens
TAATLKHTI

SEQ ID NO: 333266 - protein, 9 aa, Homo Sapiens
SQGRISVKW

SEQ ID NO: 333267 - protein, 9 aa, Homo Sapiens
QIQEQQNVL

SEQ ID NO: 333268 - protein, 9 aa, Homo Sapiens
IILGVSGHL

SEQ ID NO: 333269 - protein, 9 aa, Homo Sapiens
SSKPDMDKS

SEQ ID NO: 333270 - protein, 9 aa, Homo Sapiens
NIYMFKNNN

SEQ ID NO: 333271 - protein, 9 aa, Homo Sapiens
NNKLTCSHG

SEQ ID NO: 333272 - protein, 9 aa, Homo Sapiens
EQNRSSLLE

SEQ ID NO: 333273 - protein, 9 aa, Homo Sapiens
VLCLFFNHG

SEQ ID NO: 333274 - protein, 9 aa, Homo Sapiens
RLPKFADWA

SEQ ID NO: 333275 - protein, 9 aa, Homo Sapiens
HLSRHITSH

SEQ ID NO: 333276 - protein, 9 aa, Homo Sapiens
SSASESQII

SEQ ID NO: 333277 - protein, 9 aa, Homo Sapiens
GNTPITVWG

SEQ ID NO: 333278 - protein, 9 aa, Homo Sapiens
NLDNLTRRG

SEQ ID NO: 333279 - protein, 9 aa, Homo Sapiens
SPSNHVPNN

SEQ ID NO: 333280 - protein, 9 aa, Homo Sapiens
NRMWRNTRS

SEQ ID NO: 333281 - protein, 9 aa, Homo Sapiens
GKMGDEEAP

SEQ ID NO: 333282 - protein, 9 aa, Homo Sapiens
VVCLFLACP

SEQ ID NO: 333283 - protein, 9 aa, Homo Sapiens
YSFLHHQNC

SEQ ID NO: 333284 - protein, 9 aa, Homo Sapiens
FNTASTGKT

SEQ ID NO: 333285 - protein, 9 aa, Homo Sapiens
WFLRARDFN

SEQ ID NO: 333286 - protein, 9 aa, Homo Sapiens
WDKARKEKN

SEQ ID NO: 333287 - protein, 9 aa, Homo Sapiens
YLHNRSRIQ

SEQ ID NO: 333288 - protein, 9 aa, Homo Sapiens
CSHGNYLFH

SEQ ID NO: 333289 - protein, 9 aa, Homo Sapiens
EAAVLQGSR

SEQ ID NO: 333290 - protein, 9 aa, Homo Sapiens
WGLQQEMLS

SEQ ID NO: 333291 - protein, 9 aa, Homo Sapiens
AIDVSSSMF

SEQ ID NO: 333292 - protein, 9 aa, Homo Sapiens
IAKLIMFRG

SEQ ID NO: 333293 - protein, 9 aa, Homo Sapiens
KNIKLFFSG

SEQ ID NO: 333294 - protein, 9 aa, Homo Sapiens
KQSIWIQTK

SEQ ID NO: 333295 - protein, 9 aa, Homo Sapiens
FLGCFGVDQ

SEQ ID NO: 333296 - protein, 9 aa, Homo Sapiens
EEIKELQVA

SEQ ID NO: 333297 - protein, 9 aa, Homo Sapiens
HKETSLIEV

SEQ ID NO: 333298 - protein, 9 aa, Homo Sapiens
AHLQVKTTN

SEQ ID NO: 333299 - protein, 9 aa, Homo Sapiens
TLKRFTKVE

SEQ ID NO: 333300 - protein, 9 aa, Homo Sapiens
LQYKNNQIE

SEQ ID NO: 333301 - protein, 9 aa, Homo Sapiens
IANHWIIHN

SEQ ID NO: 333302 - protein, 9 aa, Homo Sapiens
VSSLSLCDS

SEQ ID NO: 333303 - protein, 9 aa, Homo Sapiens
DTSPPRRSL

SEQ ID NO: 333304 - protein, 9 aa, Homo Sapiens
TLKGQAVQK

SEQ ID NO: 333305 - protein, 9 aa, Homo Sapiens
GNYSKPLKK

SEQ ID NO: 333306 - protein, 9 aa, Homo Sapiens
GLDHLIQIL

SEQ ID NO: 333307 - protein, 9 aa, Homo Sapiens
KRGRAVPVL

SEQ ID NO: 333308 - protein, 9 aa, Homo Sapiens
SQWDVLSGN

SEQ ID NO: 333309 - protein, 9 aa, Homo Sapiens
RASASLTSQ

SEQ ID NO: 333310 - protein, 9 aa, Homo Sapiens
DPDEELDYL

SEQ ID NO: 333311 - protein, 9 aa, Homo Sapiens
VAGNLNVTW

SEQ ID NO: 333312 - protein, 9 aa, Homo Sapiens
VYKRIVPAC

SEQ ID NO: 333313 - protein, 9 aa, Homo Sapiens
EGDLPLADK

SEQ ID NO: 333314 - protein, 9 aa, Homo Sapiens
LFCEDHDES

SEQ ID NO: 333315 - protein, 9 aa, Homo Sapiens
VLSRKLSTK

SEQ ID NO: 333316 - protein, 9 aa, Homo Sapiens
FPFHTPLKK

SEQ ID NO: 333317 - protein, 9 aa, Homo Sapiens
ATVNSPAIY

SEQ ID NO: 333318 - protein, 9 aa, Homo Sapiens
LIHHQIIHT

SEQ ID NO: 333319 - protein, 9 aa, Homo Sapiens
CTGTKTGKK

SEQ ID NO: 333320 - protein, 9 aa, Homo Sapiens
FIIFWSFKI

SEQ ID NO: 333321 - protein, 9 aa, Homo Sapiens
TGMMSSFRS

SEQ ID NO: 333322 - protein, 9 aa, Homo Sapiens
PGGLECHLK

SEQ ID NO: 333323 - protein, 9 aa, Homo Sapiens
DAGYIYCQI

SEQ ID NO: 333324 - protein, 9 aa, Homo Sapiens
AFKGLVSLE

SEQ ID NO: 333325 - protein, 9 aa, Homo Sapiens
RLGLHQDSA

SEQ ID NO: 333326 - protein, 9 aa, Homo Sapiens
QITYYFQTY

SEQ ID NO: 333327 - protein, 9 aa, Homo Sapiens
LLIYRDRLQ

SEQ ID NO: 333328 - protein, 9 aa, Homo Sapiens
NATLLSANT

SEQ ID NO: 333329 - protein, 9 aa, Homo Sapiens
TALRDRLLV

SEQ ID NO: 333330 - protein, 9 aa, Homo Sapiens
FPSTMIKLP

SEQ ID NO: 333331 - protein, 9 aa, Homo Sapiens
EHIDNINKA

SEQ ID NO: 333332 - protein, 9 aa, Homo Sapiens
AIFWRKEDL

SEQ ID NO: 333333 - protein, 9 aa, Homo Sapiens
RYNLFCEWH

SEQ ID NO: 333334 - protein, 9 aa, Homo Sapiens
SLSFYPACV

SEQ ID NO: 333335 - protein, 9 aa, Homo Sapiens
LSAVHNHTY

SEQ ID NO: 333336 - protein, 9 aa, Homo Sapiens
RTYNALNVL

SEQ ID NO: 333337 - protein, 9 aa, Homo Sapiens
GFRCKCWVG

SEQ ID NO: 333338 - protein, 9 aa, Homo Sapiens
DCWFQIFNM

SEQ ID NO: 333339 - protein, 9 aa, Homo Sapiens
QLEGTDLDC

SEQ ID NO: 333340 - protein, 9 aa, Homo Sapiens
GAKTLARSL

SEQ ID NO: 333341 - protein, 9 aa, Homo Sapiens
PEPPRQFFV

SEQ ID NO: 333342 - protein, 9 aa, Homo Sapiens
LAIHIQNHT

SEQ ID NO: 333343 - protein, 9 aa, Homo Sapiens
DRKASAFLH

SEQ ID NO: 333344 - protein, 9 aa, Homo Sapiens
KNLSEIETV

SEQ ID NO: 333345 - protein, 9 aa, Homo Sapiens
QRVSNVLIF

SEQ ID NO: 333346 - protein, 9 aa, Homo Sapiens
VVITLWLVY

SEQ ID NO: 333347 - protein, 9 aa, Homo Sapiens
KFTHSIPHS

SEQ ID NO: 333348 - protein, 9 aa, Homo Sapiens
GFAFSIFKS

SEQ ID NO: 333349 - protein, 9 aa, Homo Sapiens
YVTCLQNWE

SEQ ID NO: 333350 - protein, 9 aa, Homo Sapiens
VKEISELFY

SEQ ID NO: 333351 - protein, 9 aa, Homo Sapiens
THCLAYSNS

SEQ ID NO: 333352 - protein, 9 aa, Homo Sapiens
YPSPGSNLG

SEQ ID NO: 333353 - protein, 9 aa, Homo Sapiens
DLLIQISLL

SEQ ID NO: 333354 - protein, 9 aa, Homo Sapiens
NQCGKPKGP

SEQ ID NO: 333355 - protein, 9 aa, Homo Sapiens
EWAVFRLTH

SEQ ID NO: 333356 - protein, 9 aa, Homo Sapiens
ENINFKMAA

SEQ ID NO: 333357 - protein, 9 aa, Homo Sapiens
VLLSICIDW

SEQ ID NO: 333358 - protein, 9 aa, Homo Sapiens
LRSRLHLPE

SEQ ID NO: 333359 - protein, 9 aa, Homo Sapiens
NNDGDGFVT

SEQ ID NO: 333360 - protein, 9 aa, Homo Sapiens
DAGGVFLSH

SEQ ID NO: 333361 - protein, 9 aa, Homo Sapiens
PRGFKFNTD

SEQ ID NO: 333362 - protein, 9 aa, Homo Sapiens
LEKEAHKST

SEQ ID NO: 333363 - protein, 9 aa, Homo Sapiens
ESIFVVSGD

SEQ ID NO: 333364 - protein, 9 aa, Homo Sapiens
KSCSEVGEI

SEQ ID NO: 333365 - protein, 9 aa, Homo Sapiens
KKDVMASSH

SEQ ID NO: 333366 - protein, 9 aa, Homo Sapiens
ILALYIPGL

SEQ ID NO: 333367 - protein, 9 aa, Homo Sapiens
QEVTRSLKY

SEQ ID NO: 333368 - protein, 9 aa, Homo Sapiens
QSSKESAAL

SEQ ID NO: 333369 - protein, 9 aa, Homo Sapiens
LVLAFCYWA

SEQ ID NO: 333370 - protein, 9 aa, Homo Sapiens
ELEGTNVEE

SEQ ID NO: 333371 - protein, 9 aa, Homo Sapiens
KITMEPNPH

SEQ ID NO: 333372 - protein, 9 aa, Homo Sapiens
SQAEMKIFP

SEQ ID NO: 333373 - protein, 9 aa, Homo Sapiens
TIFPLVTTK

SEQ ID NO: 333374 - protein, 9 aa, Homo Sapiens
NCTMRHSGT

SEQ ID NO: 333375 - protein, 9 aa, Homo Sapiens
GTCHHTQLS

SEQ ID NO: 333376 - protein, 9 aa, Homo Sapiens
RVGDCLVEP

SEQ ID NO: 333377 - protein, 9 aa, Homo Sapiens
YDHYGREGL

SEQ ID NO: 333378 - protein, 9 aa, Homo Sapiens
LLKLLARAS

SEQ ID NO: 333379 - protein, 9 aa, Homo Sapiens
TYSRSRYLK

SEQ ID NO: 333380 - protein, 9 aa, Homo Sapiens
SIWIQTKPS

SEQ ID NO: 333381 - protein, 9 aa, Homo Sapiens
YKGGYVIKA

SEQ ID NO: 333382 - protein, 9 aa, Homo Sapiens
FPFQDNIFQ

SEQ ID NO: 333383 - protein, 9 aa, Homo Sapiens
SPNLLKMIC

SEQ ID NO: 333384 - protein, 9 aa, Homo Sapiens
DNPCVSGTV

SEQ ID NO: 333385 - protein, 9 aa, Homo Sapiens
LGKTNVKGD

SEQ ID NO: 333386 - protein, 9 aa, Homo Sapiens
KLSMNNNII

SEQ ID NO: 333387 - protein, 9 aa, Homo Sapiens
ELIPAVITC

SEQ ID NO: 333388 - protein, 9 aa, Homo Sapiens
RVHTLVLGL

SEQ ID NO: 333389 - protein, 9 aa, Homo Sapiens
VCIVAQRRG

SEQ ID NO: 333390 - protein, 9 aa, Homo Sapiens
LIGKNGKIH

SEQ ID NO: 333391 - protein, 9 aa, Homo Sapiens
TVGDILRVL

SEQ ID NO: 333392 - protein, 9 aa, Homo Sapiens
NTPITVWGT

SEQ ID NO: 333393 - protein, 9 aa, Homo Sapiens
IQQISSGEY

SEQ ID NO: 333394 - protein, 9 aa, Homo Sapiens
LQRQLALKV

SEQ ID NO: 333395 - protein, 9 aa, Homo Sapiens
KIQGLPNES

SEQ ID NO: 333396 - protein, 9 aa, Homo Sapiens
ALDLDPCLL

SEQ ID NO: 333397 - protein, 9 aa, Homo Sapiens
YVAFGAPIG

SEQ ID NO: 333398 - protein, 9 aa, Homo Sapiens
LTHNTYQHF

SEQ ID NO: 333399 - protein, 9 aa, Homo Sapiens
GNKDNTFSF

SEQ ID NO: 333400 - protein, 9 aa, Homo Sapiens
FKWFIGLVT

SEQ ID NO: 333401 - protein, 9 aa, Homo Sapiens
QTEEPTVAS

SEQ ID NO: 333402 - protein, 9 aa, Homo Sapiens
MAVRPGPLQ

SEQ ID NO: 333403 - protein, 9 aa, Homo Sapiens
PTKRNKFHF

SEQ ID NO: 333404 - protein, 9 aa, Homo Sapiens
ASFLFRITT

SEQ ID NO: 333405 - protein, 9 aa, Homo Sapiens
VEATGVSWI

SEQ ID NO: 333406 - protein, 9 aa, Homo Sapiens
GIVYLPTSV

SEQ ID NO: 333407 - protein, 9 aa, Homo Sapiens
MNTLRRCIE

SEQ ID NO: 333408 - protein, 9 aa, Homo Sapiens
IRINFCLSI

SEQ ID NO: 333409 - protein, 9 aa, Homo Sapiens
YNLFCEWHL

SEQ ID NO: 333410 - protein, 9 aa, Homo Sapiens
ICFWDIRSE

SEQ ID NO: 333411 - protein, 9 aa, Homo Sapiens
VDAHTAKVN

SEQ ID NO: 333412 - protein, 9 aa, Homo Sapiens
VWEAGEAGL

SEQ ID NO: 333413 - protein, 9 aa, Homo Sapiens
KSKTQFVCI

SEQ ID NO: 333414 - protein, 9 aa, Homo Sapiens
TSSDLMAQP

SEQ ID NO: 333415 - protein, 9 aa, Homo Sapiens
DYGGINTLK

SEQ ID NO: 333416 - protein, 9 aa, Homo Sapiens
RAPRASKAQ

SEQ ID NO: 333417 - protein, 9 aa, Homo Sapiens
YKKLHNLTN

SEQ ID NO: 333418 - protein, 9 aa, Homo Sapiens
QRSQPPGKK

SEQ ID NO: 333419 - protein, 9 aa, Homo Sapiens
LPAEDMPLH

SEQ ID NO: 333420 - protein, 9 aa, Homo Sapiens
DLIRQIECL

SEQ ID NO: 333421 - protein, 9 aa, Homo Sapiens
LHAKLQALW

SEQ ID NO: 333422 - protein, 9 aa, Homo Sapiens
EPLVEKFSP

SEQ ID NO: 333423 - protein, 9 aa, Homo Sapiens
MNQLQGKKS

SEQ ID NO: 333424 - protein, 9 aa, Homo Sapiens
RRPEHHKIN

SEQ ID NO: 333425 - protein, 9 aa, Homo Sapiens
HTIEALMDR

SEQ ID NO: 333426 - protein, 9 aa, Homo Sapiens
TQDAFQGQE

SEQ ID NO: 333427 - protein, 9 aa, Homo Sapiens
PDNGPSGVH

SEQ ID NO: 333428 - protein, 9 aa, Homo Sapiens
ETWCETGIS

SEQ ID NO: 333429 - protein, 9 aa, Homo Sapiens
TFYATSYCT

SEQ ID NO: 333430 - protein, 9 aa, Homo Sapiens
YTTKKYREK

SEQ ID NO: 333431 - protein, 9 aa, Homo Sapiens
INFKVKTVF

SEQ ID NO: 333432 - protein, 9 aa, Homo Sapiens
LKAKEQHFL

SEQ ID NO: 333433 - protein, 9 aa, Homo Sapiens
QKLGNAPAE

SEQ ID NO: 333434 - protein, 9 aa, Homo Sapiens
TTNIYIFNL

SEQ ID NO: 333435 - protein, 9 aa, Homo Sapiens
KHNFAITFF

SEQ ID NO: 333436 - protein, 9 aa, Homo Sapiens
MNTVCPEQG

SEQ ID NO: 333437 - protein, 9 aa, Homo Sapiens
EEINQTEEE

SEQ ID NO: 333438 - protein, 9 aa, Homo Sapiens
KQEGIIYVD

SEQ ID NO: 333439 - protein, 9 aa, Homo Sapiens
DWNLVMYDG

SEQ ID NO: 333440 - protein, 9 aa, Homo Sapiens
YDVVMKLWH

SEQ ID NO: 333441 - protein, 9 aa, Homo Sapiens
ANISELQTS

SEQ ID NO: 333442 - protein, 9 aa, Homo Sapiens
ALLCKCIKL

SEQ ID NO: 333443 - protein, 9 aa, Homo Sapiens
SRCPSEIVI

SEQ ID NO: 333444 - protein, 9 aa, Homo Sapiens
CWSVLKRVV

SEQ ID NO: 333445 - protein, 9 aa, Homo Sapiens
VAPPGGRTN

SEQ ID NO: 333446 - protein, 9 aa, Homo Sapiens
ESKGIKGGT

SEQ ID NO: 333447 - protein, 9 aa, Homo Sapiens
RINNDGDGF

SEQ ID NO: 333448 - protein, 9 aa, Homo Sapiens
IKLSEWKMV

SEQ ID NO: 333449 - protein, 9 aa, Homo Sapiens
VVICVGCST

SEQ ID NO: 333450 - protein, 9 aa, Homo Sapiens
EIKMRIKTT

SEQ ID NO: 333451 - protein, 9 aa, Homo Sapiens
NTTGPPSAL

SEQ ID NO: 333452 - protein, 9 aa, Homo Sapiens
SPFVEQLLK

SEQ ID NO: 333453 - protein, 9 aa, Homo Sapiens
KYAAGVHNP

SEQ ID NO: 333454 - protein, 9 aa, Homo Sapiens
MYLFLTNLS

SEQ ID NO: 333455 - protein, 9 aa, Homo Sapiens
IVFKRISKI

SEQ ID NO: 333456 - protein, 9 aa, Homo Sapiens
DERDAGITE

SEQ ID NO: 333457 - protein, 9 aa, Homo Sapiens
SNLVVLDAA

SEQ ID NO: 333458 - protein, 9 aa, Homo Sapiens
FCQSKIDYC

SEQ ID NO: 333459 - protein, 9 aa, Homo Sapiens
GDKPYQCKQ

SEQ ID NO: 333460 - protein, 9 aa, Homo Sapiens
YYKNASENK

SEQ ID NO: 333461 - protein, 9 aa, Homo Sapiens
GLLAPLLND

SEQ ID NO: 333462 - protein, 9 aa, Homo Sapiens
DAVTNKHFS

SEQ ID NO: 333463 - protein, 9 aa, Homo Sapiens
ILNRKKDVM

SEQ ID NO: 333464 - protein, 9 aa, Homo Sapiens
YQFSLYPLF

SEQ ID NO: 333465 - protein, 9 aa, Homo Sapiens
TAYVSNEGC

SEQ ID NO: 333466 - protein, 9 aa, Homo Sapiens
LLWSATILS

SEQ ID NO: 333467 - protein, 9 aa, Homo Sapiens
PYKCDACNL

SEQ ID NO: 333468 - protein, 9 aa, Homo Sapiens
QILQESIDV

SEQ ID NO: 333469 - protein, 9 aa, Homo Sapiens
LLVNQTIEK

SEQ ID NO: 333470 - protein, 9 aa, Homo Sapiens
ICQQHQSWL

SEQ ID NO: 333471 - protein, 9 aa, Homo Sapiens
EAAFLGPEM

SEQ ID NO: 333472 - protein, 9 aa, Homo Sapiens
KTSVKPSVS

SEQ ID NO: 333473 - protein, 9 aa, Homo Sapiens
GQSFCWKSP

SEQ ID NO: 333474 - protein, 9 aa, Homo Sapiens
YVLYFDCWF

SEQ ID NO: 333475 - protein, 9 aa, Homo Sapiens
LTILQFTRN

SEQ ID NO: 333476 - protein, 9 aa, Homo Sapiens
NVYIHDNAK

SEQ ID NO: 333477 - protein, 9 aa, Homo Sapiens
FSKSLNLTN

SEQ ID NO: 333478 - protein, 9 aa, Homo Sapiens
TIMGYDRYV

SEQ ID NO: 333479 - protein, 9 aa, Homo Sapiens
ACPILHQQT

SEQ ID NO: 333480 - protein, 9 aa, Homo Sapiens
KIFSFRSSF

SEQ ID NO: 333481 - protein, 9 aa, Homo Sapiens
SLHGLTPFH

SEQ ID NO: 333482 - protein, 9 aa, Homo Sapiens
SENLKSCSE

SEQ ID NO: 333483 - protein, 9 aa, Homo Sapiens
DIPRFQMSD

SEQ ID NO: 333484 - protein, 9 aa, Homo Sapiens
VLNFQPQVI

SEQ ID NO: 333485 - protein, 9 aa, Homo Sapiens
WDTFHELGT

SEQ ID NO: 333486 - protein, 9 aa, Homo Sapiens
CFGESTTGF

SEQ ID NO: 333487 - protein, 9 aa, Homo Sapiens
VMAKKEEDG

SEQ ID NO: 333488 - protein, 9 aa, Homo Sapiens
KLLPVLNPS

SEQ ID NO: 333489 - protein, 9 aa, Homo Sapiens
FTTDSWEHI

SEQ ID NO: 333490 - protein, 9 aa, Homo Sapiens
SFPIRRDNG

SEQ ID NO: 333491 - protein, 9 aa, Homo Sapiens
GGLSASGTP

SEQ ID NO: 333492 - protein, 9 aa, Homo Sapiens
KTEKTATHF

SEQ ID NO: 333493 - protein, 9 aa, Homo Sapiens
PTFFSQTPI

SEQ ID NO: 333494 - protein, 9 aa, Homo Sapiens
IAFPIPNSP

SEQ ID NO: 333495 - protein, 9 aa, Homo Sapiens
QGLEWKLSA

SEQ ID NO: 333496 - protein, 9 aa, Homo Sapiens
AIRYTWPCS

SEQ ID NO: 333497 - protein, 9 aa, Homo Sapiens
RAVGFEACY

SEQ ID NO: 333498 - protein, 9 aa, Homo Sapiens
YLFLTNLSI

SEQ ID NO: 333499 - protein, 9 aa, Homo Sapiens
QDANLTKRR

SEQ ID NO: 333500 - protein, 9 aa, Homo Sapiens
FLLLKDNYN

SEQ ID NO: 333501 - protein, 9 aa, Homo Sapiens
VARKHRKTT

SEQ ID NO: 333502 - protein, 9 aa, Homo Sapiens
RHETIHTGK

SEQ ID NO: 333503 - protein, 9 aa, Homo Sapiens
ISKKVEEES

SEQ ID NO: 333504 - protein, 9 aa, Homo Sapiens
GEEEVKEEE

SEQ ID NO: 333505 - protein, 9 aa, Homo Sapiens
HISVQFDPF

SEQ ID NO: 333506 - protein, 9 aa, Homo Sapiens
MASVTRVVF

SEQ ID NO: 333507 - protein, 9 aa, Homo Sapiens
PTMENILQA

SEQ ID NO: 333508 - protein, 9 aa, Homo Sapiens
NIDNLGVTV

SEQ ID NO: 333509 - protein, 9 aa, Homo Sapiens
DLVEYGADH

SEQ ID NO: 333510 - protein, 9 aa, Homo Sapiens
EKIWLWLRG

SEQ ID NO: 333511 - protein, 9 aa, Homo Sapiens
HRLDRINEY

SEQ ID NO: 333512 - protein, 9 aa, Homo Sapiens
GQINEAVND

SEQ ID NO: 333513 - protein, 9 aa, Homo Sapiens
ALICCEQCE

SEQ ID NO: 333514 - protein, 9 aa, Homo Sapiens
DMLHRFYGN

SEQ ID NO: 333515 - protein, 9 aa, Homo Sapiens
LSEVGFPDI

SEQ ID NO: 333516 - protein, 9 aa, Homo Sapiens
DIYRGCEAF

SEQ ID NO: 333517 - protein, 9 aa, Homo Sapiens
SWKRCYFLL

SEQ ID NO: 333518 - protein, 9 aa, Homo Sapiens
LVLHMVDGG

SEQ ID NO: 333519 - protein, 9 aa, Homo Sapiens
PERGHMDVA

SEQ ID NO: 333520 - protein, 9 aa, Homo Sapiens
KNVPSVWQS

SEQ ID NO: 333521 - protein, 9 aa, Homo Sapiens
RPTMQTLMC

SEQ ID NO: 333522 - protein, 9 aa, Homo Sapiens
GAGGTKAPW

SEQ ID NO: 333523 - protein, 9 aa, Homo Sapiens
VLGGDNVTG

SEQ ID NO: 333524 - protein, 9 aa, Homo Sapiens
WDLDFGGNG

SEQ ID NO: 333525 - protein, 9 aa, Homo Sapiens
EKTKTYEYE

SEQ ID NO: 333526 - protein, 9 aa, Homo Sapiens
LLGSLTADK

SEQ ID NO: 333527 - protein, 9 aa, Homo Sapiens
MEQDERGPN

SEQ ID NO: 333528 - protein, 9 aa, Homo Sapiens
QIHFGDNIK

SEQ ID NO: 333529 - protein, 9 aa, Homo Sapiens
FLSELGVTF

SEQ ID NO: 333530 - protein, 9 aa, Homo Sapiens
YTVHPSSGP

SEQ ID NO: 333531 - protein, 9 aa, Homo Sapiens
AHREGFSYR

SEQ ID NO: 333532 - protein, 9 aa, Homo Sapiens
LTELWFHNQ

SEQ ID NO: 333533 - protein, 9 aa, Homo Sapiens
KKAKIILKK

SEQ ID NO: 333534 - protein, 9 aa, Homo Sapiens
NTSYFHTTP

SEQ ID NO: 333535 - protein, 9 aa, Homo Sapiens
SSQSINFQS

SEQ ID NO: 333536 - protein, 9 aa, Homo Sapiens
VFKRISKII

SEQ ID NO: 333537 - protein, 9 aa, Homo Sapiens
LGICSFADA

SEQ ID NO: 333538 - protein, 9 aa, Homo Sapiens
GNNSSYVHG

SEQ ID NO: 333539 - protein, 9 aa, Homo Sapiens
SPDILCSSK

SEQ ID NO: 333540 - protein, 9 aa, Homo Sapiens
QNLHNCVNI

SEQ ID NO: 333541 - protein, 9 aa, Homo Sapiens
LVAHKHYTI

SEQ ID NO: 333542 - protein, 9 aa, Homo Sapiens
EKKVDGLIE

SEQ ID NO: 333543 - protein, 9 aa, Homo Sapiens
THTGLGGYW

SEQ ID NO: 333544 - protein, 9 aa, Homo Sapiens
FIIHMISHT

SEQ ID NO: 333545 - protein, 9 aa, Homo Sapiens
YLICYQRKH

SEQ ID NO: 333546 - protein, 9 aa, Homo Sapiens
WHGGWDWSQ

SEQ ID NO: 333547 - protein, 9 aa, Homo Sapiens
EEGLWQAMQ

SEQ ID NO: 333548 - protein, 9 aa, Homo Sapiens
REEHKKFEN

SEQ ID NO: 333549 - protein, 9 aa, Homo Sapiens
GPRCSHCQK

SEQ ID NO: 333550 - protein, 9 aa, Homo Sapiens
ADSSSSSLF

SEQ ID NO: 333551 - protein, 9 aa, Homo Sapiens
PSNKLYVVK

SEQ ID NO: 333552 - protein, 9 aa, Homo Sapiens
LVATSKKNV

SEQ ID NO: 333553 - protein, 9 aa, Homo Sapiens
REVTVTPNT

SEQ ID NO: 333554 - protein, 9 aa, Homo Sapiens
FKEVPERGH

SEQ ID NO: 333555 - protein, 9 aa, Homo Sapiens
NGHRDLEIE

SEQ ID NO: 333556 - protein, 9 aa, Homo Sapiens
HSRLRFNWR

SEQ ID NO: 333557 - protein, 9 aa, Homo Sapiens
IDVVKRKLK

SEQ ID NO: 333558 - protein, 9 aa, Homo Sapiens
APKIFKRIQ

SEQ ID NO: 333559 - protein, 9 aa, Homo Sapiens
IMLNIMEEY

SEQ ID NO: 333560 - protein, 9 aa, Homo Sapiens
LPSRRTLNN

SEQ ID NO: 333561 - protein, 9 aa, Homo Sapiens
EVLKSEPYE

SEQ ID NO: 333562 - protein, 9 aa, Homo Sapiens
IAYIYAQSL

SEQ ID NO: 333563 - protein, 9 aa, Homo Sapiens
YLHKASLKR

SEQ ID NO: 333564 - protein, 9 aa, Homo Sapiens
HSTHIHIMP

SEQ ID NO: 333565 - protein, 9 aa, Homo Sapiens
KIAFPIPNS

SEQ ID NO: 333566 - protein, 9 aa, Homo Sapiens
IISHTLYDL

SEQ ID NO: 333567 - protein, 9 aa, Homo Sapiens
LRKLLSKLE

SEQ ID NO: 333568 - protein, 9 aa, Homo Sapiens
IFWLIFSIV

SEQ ID NO: 333569 - protein, 9 aa, Homo Sapiens
VSCSSVVLK

SEQ ID NO: 333570 - protein, 9 aa, Homo Sapiens
TPLGYIPYG

SEQ ID NO: 333571 - protein, 9 aa, Homo Sapiens
PHPTYLQQA

SEQ ID NO: 333572 - protein, 9 aa, Homo Sapiens
LCHVDASFF

SEQ ID NO: 333573 - protein, 9 aa, Homo Sapiens
LKENLDKKK

SEQ ID NO: 333574 - protein, 9 aa, Homo Sapiens
PKYQEQCRQ

SEQ ID NO: 333575 - protein, 9 aa, Homo Sapiens
IRLCFWKLY

SEQ ID NO: 333576 - protein, 9 aa, Homo Sapiens
VTKTITTPT

SEQ ID NO: 333577 - protein, 9 aa, Homo Sapiens
YNLTVRKLK

SEQ ID NO: 333578 - protein, 9 aa, Homo Sapiens
FFIPDNEEG

SEQ ID NO: 333579 - protein, 9 aa, Homo Sapiens
SFYSEDVVY

SEQ ID NO: 333580 - protein, 9 aa, Homo Sapiens
LEKKKKRLR

SEQ ID NO: 333581 - protein, 9 aa, Homo Sapiens
ERPHNYFCK

SEQ ID NO: 333582 - protein, 9 aa, Homo Sapiens
DSGHNRTVG

SEQ ID NO: 333583 - protein, 9 aa, Homo Sapiens
AQAGKQWSN

SEQ ID NO: 333584 - protein, 9 aa, Homo Sapiens
GLLTTFMHA

SEQ ID NO: 333585 - protein, 9 aa, Homo Sapiens
ISSQPVISS

SEQ ID NO: 333586 - protein, 9 aa, Homo Sapiens
LTKGISRQS

SEQ ID NO: 333587 - protein, 9 aa, Homo Sapiens
EDQGKKEGD

SEQ ID NO: 333588 - protein, 9 aa, Homo Sapiens
EGIVVAVSQ

SEQ ID NO: 333589 - protein, 9 aa, Homo Sapiens
TGNNVQQYH

SEQ ID NO: 333590 - protein, 9 aa, Homo Sapiens
PRPGIKSSP

SEQ ID NO: 333591 - protein, 9 aa, Homo Sapiens
GNYHRFLGR

SEQ ID NO: 333592 - protein, 9 aa, Homo Sapiens
GQLDLSEFL

SEQ ID NO: 333593 - protein, 9 aa, Homo Sapiens
TRLRVLNIS

SEQ ID NO: 333594 - protein, 9 aa, Homo Sapiens
SLPFVTTNN

SEQ ID NO: 333595 - protein, 9 aa, Homo Sapiens
QGEQGDNGD

SEQ ID NO: 333596 - protein, 9 aa, Homo Sapiens
TFVFDAVTD

SEQ ID NO: 333597 - protein, 9 aa, Homo Sapiens
YCQVAPLTH

SEQ ID NO: 333598 - protein, 9 aa, Homo Sapiens
VTVNTTDLD

SEQ ID NO: 333599 - protein, 9 aa, Homo Sapiens
AIQNPNAQQ

SEQ ID NO: 333600 - protein, 9 aa, Homo Sapiens
NLEKNKMKR

SEQ ID NO: 333601 - protein, 9 aa, Homo Sapiens
HTYLISFNQ

SEQ ID NO: 333602 - protein, 9 aa, Homo Sapiens
KGFTHRNVY

SEQ ID NO: 333603 - protein, 9 aa, Homo Sapiens
IRGEQVNIP

SEQ ID NO: 333604 - protein, 9 aa, Homo Sapiens
LVNCFENVL

SEQ ID NO: 333605 - protein, 9 aa, Homo Sapiens
PISNLTTTA

SEQ ID NO: 333606 - protein, 9 aa, Homo Sapiens
SPSAAKVTL

SEQ ID NO: 333607 - protein, 9 aa, Homo Sapiens
KKRKIKRLK

SEQ ID NO: 333608 - protein, 9 aa, Homo Sapiens
SKNKDIENL

SEQ ID NO: 333609 - protein, 9 aa, Homo Sapiens
SYCTREEIQ

SEQ ID NO: 333610 - protein, 9 aa, Homo Sapiens
SLPGTTNGS

SEQ ID NO: 333611 - protein, 9 aa, Homo Sapiens
KPAESKNNT

SEQ ID NO: 333612 - protein, 9 aa, Homo Sapiens
CEVPKVGCS

SEQ ID NO: 333613 - protein, 9 aa, Homo Sapiens
DTKQAHKLA

SEQ ID NO: 333614 - protein, 9 aa, Homo Sapiens
EVKQASIQH

SEQ ID NO: 333615 - protein, 9 aa, Homo Sapiens
VKINSRKTV

SEQ ID NO: 333616 - protein, 9 aa, Homo Sapiens
AKNNLNPSW

SEQ ID NO: 333617 - protein, 9 aa, Homo Sapiens
ELGMASFGA

SEQ ID NO: 333618 - protein, 9 aa, Homo Sapiens
TCNPPWAES

SEQ ID NO: 333619 - protein, 9 aa, Homo Sapiens
TMGETALHI

SEQ ID NO: 333620 - protein, 9 aa, Homo Sapiens
NSSGWGGGT

SEQ ID NO: 333621 - protein, 9 aa, Homo Sapiens
KEDDANRKT

SEQ ID NO: 333622 - protein, 9 aa, Homo Sapiens
GEIYTVGAK

SEQ ID NO: 333623 - protein, 9 aa, Homo Sapiens
GAIGLHIAL

SEQ ID NO: 333624 - protein, 9 aa, Homo Sapiens
EVEGGDKLQ

SEQ ID NO: 333625 - protein, 9 aa, Homo Sapiens
FHADKEMEG

SEQ ID NO: 333626 - protein, 9 aa, Homo Sapiens
VAAAKGRPR

SEQ ID NO: 333627 - protein, 9 aa, Homo Sapiens
QNSTENNCA

SEQ ID NO: 333628 - protein, 9 aa, Homo Sapiens
LRVLATNVY

SEQ ID NO: 333629 - protein, 9 aa, Homo Sapiens
ALLSKCLCG

SEQ ID NO: 333630 - protein, 9 aa, Homo Sapiens
PSEPRPSLS

SEQ ID NO: 333631 - protein, 9 aa, Homo Sapiens
FDNATEASG

SEQ ID NO: 333632 - protein, 9 aa, Homo Sapiens
LQDVKNVSA

SEQ ID NO: 333633 - protein, 9 aa, Homo Sapiens
VQSLRTASD

SEQ ID NO: 333634 - protein, 9 aa, Homo Sapiens
VITTPDVYK

SEQ ID NO: 333635 - protein, 9 aa, Homo Sapiens
CFTSGQCQV

SEQ ID NO: 333636 - protein, 9 aa, Homo Sapiens
KTLIKGLQR

SEQ ID NO: 333637 - protein, 9 aa, Homo Sapiens
LKDEFTQII

SEQ ID NO: 333638 - protein, 9 aa, Homo Sapiens
GGDKLQTDQ

SEQ ID NO: 333639 - protein, 9 aa, Homo Sapiens
ADNLPGNVG

SEQ ID NO: 333640 - protein, 9 aa, Homo Sapiens
GSSTTLTKY

SEQ ID NO: 333641 - protein, 9 aa, Homo Sapiens
GSKNTCFEW

SEQ ID NO: 333642 - protein, 9 aa, Homo Sapiens
ADAKSAAHS

SEQ ID NO: 333643 - protein, 9 aa, Homo Sapiens
GGLSFETTG

SEQ ID NO: 333644 - protein, 9 aa, Homo Sapiens
QKSSVSSVS

SEQ ID NO: 333645 - protein, 9 aa, Homo Sapiens
LEKESDKEN

SEQ ID NO: 333646 - protein, 9 aa, Homo Sapiens
LDRYHRIIK

SEQ ID NO: 333647 - protein, 9 aa, Homo Sapiens
TELRDKIAR

SEQ ID NO: 333648 - protein, 9 aa, Homo Sapiens
NKQITASLF

SEQ ID NO: 333649 - protein, 9 aa, Homo Sapiens
LQVKSVISD

SEQ ID NO: 333650 - protein, 9 aa, Homo Sapiens
FLLLFWCLH

SEQ ID NO: 333651 - protein, 9 aa, Homo Sapiens
GMISREAAN

SEQ ID NO: 333652 - protein, 9 aa, Homo Sapiens
SSCRNYNNQ

SEQ ID NO: 333653 - protein, 9 aa, Homo Sapiens
VLLDIKRYL

SEQ ID NO: 333654 - protein, 9 aa, Homo Sapiens
FKELQGLAD

SEQ ID NO: 333655 - protein, 9 aa, Homo Sapiens
SSMTKCSCM

SEQ ID NO: 333656 - protein, 9 aa, Homo Sapiens
WFNVCMGFG

SEQ ID NO: 333657 - protein, 9 aa, Homo Sapiens
FEIVVVGYN

SEQ ID NO: 333658 - protein, 9 aa, Homo Sapiens
LGRNHTHVI

SEQ ID NO: 333659 - protein, 9 aa, Homo Sapiens
KCWVGYEPG

SEQ ID NO: 333660 - protein, 9 aa, Homo Sapiens
ESILGRNHT

SEQ ID NO: 333661 - protein, 9 aa, Homo Sapiens
RNQYYQKSS

SEQ ID NO: 333662 - protein, 9 aa, Homo Sapiens
QAKTQINSQ

SEQ ID NO: 333663 - protein, 9 aa, Homo Sapiens
VKETYMLYI

SEQ ID NO: 333664 - protein, 9 aa, Homo Sapiens
DFANNETKR

SEQ ID NO: 333665 - protein, 9 aa, Homo Sapiens
PLTELTGFT

SEQ ID NO: 333666 - protein, 9 aa, Homo Sapiens
LDNYRNLIS

SEQ ID NO: 333667 - protein, 9 aa, Homo Sapiens
CTRRPAFPV

SEQ ID NO: 333668 - protein, 9 aa, Homo Sapiens
PGLCQSPLL

SEQ ID NO: 333669 - protein, 9 aa, Homo Sapiens
TSERSTSLT

SEQ ID NO: 333670 - protein, 9 aa, Homo Sapiens
ITVALLTEK

SEQ ID NO: 333671 - protein, 9 aa, Homo Sapiens
KERCFTSGQ

SEQ ID NO: 333672 - protein, 9 aa, Homo Sapiens
WLSETSLVN

SEQ ID NO: 333673 - protein, 9 aa, Homo Sapiens
QKLAETSFL

SEQ ID NO: 333674 - protein, 9 aa, Homo Sapiens
SVWQSARRK

SEQ ID NO: 333675 - protein, 9 aa, Homo Sapiens
LCPKDVKYN

SEQ ID NO: 333676 - protein, 9 aa, Homo Sapiens
KYLFDYSPP

SEQ ID NO: 333677 - protein, 9 aa, Homo Sapiens
HLGDDFNRE

SEQ ID NO: 333678 - protein, 9 aa, Homo Sapiens
IHHSGRTGR

SEQ ID NO: 333679 - protein, 9 aa, Homo Sapiens
QNAHAMRWA

SEQ ID NO: 333680 - protein, 9 aa, Homo Sapiens
ERENLCFDL

SEQ ID NO: 333681 - protein, 9 aa, Homo Sapiens
FEWWCFHKH

SEQ ID NO: 333682 - protein, 9 aa, Homo Sapiens
LKALCETKC

SEQ ID NO: 333683 - protein, 9 aa, Homo Sapiens
VDQCLACLK

SEQ ID NO: 333684 - protein, 9 aa, Homo Sapiens
SELKQPRSC

SEQ ID NO: 333685 - protein, 9 aa, Homo Sapiens
ELALRRNKE

SEQ ID NO: 333686 - protein, 9 aa, Homo Sapiens
RSKNKDIEN

SEQ ID NO: 333687 - protein, 9 aa, Homo Sapiens
AVCNPLWYP

SEQ ID NO: 333688 - protein, 9 aa, Homo Sapiens
LFILLCNVI

SEQ ID NO: 333689 - protein, 9 aa, Homo Sapiens
ILQKHGKNV

SEQ ID NO: 333690 - protein, 9 aa, Homo Sapiens
MDQLSYSIL

SEQ ID NO: 333691 - protein, 9 aa, Homo Sapiens
IRNSEKVYL

SEQ ID NO: 333692 - protein, 9 aa, Homo Sapiens
LQRVAHYES

SEQ ID NO: 333693 - protein, 9 aa, Homo Sapiens
HEVQCFGDI

SEQ ID NO: 333694 - protein, 9 aa, Homo Sapiens
FNTDELNFP

SEQ ID NO: 333695 - protein, 9 aa, Homo Sapiens
PWSISSCDT

SEQ ID NO: 333696 - protein, 9 aa, Homo Sapiens
TKDKRTERS

SEQ ID NO: 333697 - protein, 9 aa, Homo Sapiens
KTSSGKIKR

SEQ ID NO: 333698 - protein, 9 aa, Homo Sapiens
SPYAQVHIA

SEQ ID NO: 333699 - protein, 9 aa, Homo Sapiens
KNNMKALAG

SEQ ID NO: 333700 - protein, 9 aa, Homo Sapiens
RETLLQCED

SEQ ID NO: 333701 - protein, 9 aa, Homo Sapiens
NHTGEKPYH

SEQ ID NO: 333702 - protein, 9 aa, Homo Sapiens
YNIKMKIAW

SEQ ID NO: 333703 - protein, 9 aa, Homo Sapiens
EMVPQTAPA

SEQ ID NO: 333704 - protein, 9 aa, Homo Sapiens
MTNSLFFCP

SEQ ID NO: 333705 - protein, 9 aa, Homo Sapiens
DVGQTQAAQ

SEQ ID NO: 333706 - protein, 9 aa, Homo Sapiens
ISVQFDPFN

SEQ ID NO: 333707 - protein, 9 aa, Homo Sapiens
NVFPITSIE

SEQ ID NO: 333708 - protein, 9 aa, Homo Sapiens
GGQKFVFSL

SEQ ID NO: 333709 - protein, 9 aa, Homo Sapiens
EEWKIIRTL

SEQ ID NO: 333710 - protein, 9 aa, Homo Sapiens
SSELFKPYY

SEQ ID NO: 333711 - protein, 9 aa, Homo Sapiens
SSIWGEKCE

SEQ ID NO: 333712 - protein, 9 aa, Homo Sapiens
FCFGESTTG

SEQ ID NO: 333713 - protein, 9 aa, Homo Sapiens
SEYGVLYKT

SEQ ID NO: 333714 - protein, 9 aa, Homo Sapiens
QNTAYLSKV

SEQ ID NO: 333715 - protein, 9 aa, Homo Sapiens
PGAVKLSRR

SEQ ID NO: 333716 - protein, 9 aa, Homo Sapiens
PIRRDNGSW

SEQ ID NO: 333717 - protein, 9 aa, Homo Sapiens
TCSGFEPPS

SEQ ID NO: 333718 - protein, 9 aa, Homo Sapiens
TVHPSSGPH

SEQ ID NO: 333719 - protein, 9 aa, Homo Sapiens
PRQTPICDP

SEQ ID NO: 333720 - protein, 9 aa, Homo Sapiens
WLLERGHTD

SEQ ID NO: 333721 - protein, 9 aa, Homo Sapiens
LACMCAGLH

SEQ ID NO: 333722 - protein, 9 aa, Homo Sapiens
SKENWKRSQ

SEQ ID NO: 333723 - protein, 9 aa, Homo Sapiens
GFVCLLPLL

SEQ ID NO: 333724 - protein, 9 aa, Homo Sapiens
RSGQSFGYG

SEQ ID NO: 333725 - protein, 9 aa, Homo Sapiens
GATAVYHID

SEQ ID NO: 333726 - protein, 9 aa, Homo Sapiens
LNTDKIKRL

SEQ ID NO: 333727 - protein, 9 aa, Homo Sapiens
EHKRLENVQ

SEQ ID NO: 333728 - protein, 9 aa, Homo Sapiens
KNVCVSLVF

SEQ ID NO: 333729 - protein, 9 aa, Homo Sapiens
VFLVPVSRR

SEQ ID NO: 333730 - protein, 9 aa, Homo Sapiens
SLGSCQALE

SEQ ID NO: 333731 - protein, 9 aa, Homo Sapiens
WGYQLTQHQ

SEQ ID NO: 333732 - protein, 9 aa, Homo Sapiens
DQDSFLHDN

SEQ ID NO: 333733 - protein, 9 aa, Homo Sapiens
KQLFQFLQA

SEQ ID NO: 333734 - protein, 9 aa, Homo Sapiens
LHRSLPAVA

SEQ ID NO: 333735 - protein, 9 aa, Homo Sapiens
GWPACHILH

SEQ ID NO: 333736 - protein, 9 aa, Homo Sapiens
PAKCRSRTK

SEQ ID NO: 333737 - protein, 9 aa, Homo Sapiens
NIIRTRAEL

SEQ ID NO: 333738 - protein, 9 aa, Homo Sapiens
TYWLRNDSN

SEQ ID NO: 333739 - protein, 9 aa, Homo Sapiens
NIKTSKNNI

SEQ ID NO: 333740 - protein, 9 aa, Homo Sapiens
VNGDVQNST

SEQ ID NO: 333741 - protein, 9 aa, Homo Sapiens
AVNWLLERG

SEQ ID NO: 333742 - protein, 9 aa, Homo Sapiens
LYTLVIPIQ

SEQ ID NO: 333743 - protein, 9 aa, Homo Sapiens
VGRMGVFIT

SEQ ID NO: 333744 - protein, 9 aa, Homo Sapiens
EQKDKDSIH

SEQ ID NO: 333745 - protein, 9 aa, Homo Sapiens
KKAATTPAK

SEQ ID NO: 333746 - protein, 9 aa, Homo Sapiens
QGDLADSFF

SEQ ID NO: 333747 - protein, 9 aa, Homo Sapiens
EDSPIRFLV

SEQ ID NO: 333748 - protein, 9 aa, Homo Sapiens
TCYWIAETK

SEQ ID NO: 333749 - protein, 9 aa, Homo Sapiens
ESSKLGMPG

SEQ ID NO: 333750 - protein, 9 aa, Homo Sapiens
SCKNLWKFC

SEQ ID NO: 333751 - protein, 9 aa, Homo Sapiens
RYFKDFHST

SEQ ID NO: 333752 - protein, 9 aa, Homo Sapiens
LRSLEEEKY

SEQ ID NO: 333753 - protein, 9 aa, Homo Sapiens
SSRSHVRTR

SEQ ID NO: 333754 - protein, 9 aa, Homo Sapiens
EDGNTVKLL

SEQ ID NO: 333755 - protein, 9 aa, Homo Sapiens
FHTPLKKNQ

SEQ ID NO: 333756 - protein, 9 aa, Homo Sapiens
SYTGQEDCL

SEQ ID NO: 333757 - protein, 9 aa, Homo Sapiens
KLSFVTQPS

SEQ ID NO: 333758 - protein, 9 aa, Homo Sapiens
KLAELQPPL

SEQ ID NO: 333759 - protein, 9 aa, Homo Sapiens
DKRFAQPRQ

SEQ ID NO: 333760 - protein, 9 aa, Homo Sapiens
DIMLLCLAR

SEQ ID NO: 333761 - protein, 9 aa, Homo Sapiens
LSLMNSTDQ

SEQ ID NO: 333762 - protein, 9 aa, Homo Sapiens
GSFIFAENT

SEQ ID NO: 333763 - protein, 9 aa, Homo Sapiens
LKPKEQILF

SEQ ID NO: 333764 - protein, 9 aa, Homo Sapiens
MDLKNLQLD

SEQ ID NO: 333765 - protein, 9 aa, Homo Sapiens
MQGTIMGIF

SEQ ID NO: 333766 - protein, 9 aa, Homo Sapiens
FAQPATKDK

SEQ ID NO: 333767 - protein, 9 aa, Homo Sapiens
VYQWYLDLC

SEQ ID NO: 333768 - protein, 9 aa, Homo Sapiens
GLSFYQQIK

SEQ ID NO: 333769 - protein, 9 aa, Homo Sapiens
GSAESEEYN

SEQ ID NO: 333770 - protein, 9 aa, Homo Sapiens
ELSRDSRSS

SEQ ID NO: 333771 - protein, 9 aa, Homo Sapiens
KLRDKIMAL

SEQ ID NO: 333772 - protein, 9 aa, Homo Sapiens
SFHLFEDSL

SEQ ID NO: 333773 - protein, 9 aa, Homo Sapiens
VVSVSELLA

SEQ ID NO: 333774 - protein, 9 aa, Homo Sapiens
DINSSKTVL

SEQ ID NO: 333775 - protein, 9 aa, Homo Sapiens
HEIIHTGER

SEQ ID NO: 333776 - protein, 9 aa, Homo Sapiens
VYHFCDVKD

SEQ ID NO: 333777 - protein, 9 aa, Homo Sapiens
SVHLTLHQH

SEQ ID NO: 333778 - protein, 9 aa, Homo Sapiens
HTGDKPYQC

SEQ ID NO: 333779 - protein, 9 aa, Homo Sapiens
NINNGLVKL

SEQ ID NO: 333780 - protein, 9 aa, Homo Sapiens
CVCPFPGAV

SEQ ID NO: 333781 - protein, 9 aa, Homo Sapiens
YLEQIHNRV

SEQ ID NO: 333782 - protein, 9 aa, Homo Sapiens
YNKIAIPNE

SEQ ID NO: 333783 - protein, 9 aa, Homo Sapiens
ALHPLTELT

SEQ ID NO: 333784 - protein, 9 aa, Homo Sapiens
QIDLRCPLS

SEQ ID NO: 333785 - protein, 9 aa, Homo Sapiens
EGLWQAMQE

SEQ ID NO: 333786 - protein, 9 aa, Homo Sapiens
PQCKRSYHF

SEQ ID NO: 333787 - protein, 9 aa, Homo Sapiens
SLRAWVAAM

SEQ ID NO: 333788 - protein, 9 aa, Homo Sapiens
DSQKDDMMA

SEQ ID NO: 333789 - protein, 9 aa, Homo Sapiens
HPSHQPPVS

SEQ ID NO: 333790 - protein, 9 aa, Homo Sapiens
EKMSKDCSW

SEQ ID NO: 333791 - protein, 9 aa, Homo Sapiens
QKLWADTTC

SEQ ID NO: 333792 - protein, 9 aa, Homo Sapiens
QLDNVFRQL

SEQ ID NO: 333793 - protein, 9 aa, Homo Sapiens
RVKMYPIED

SEQ ID NO: 333794 - protein, 9 aa, Homo Sapiens
GGVDVFSLL

SEQ ID NO: 333795 - protein, 9 aa, Homo Sapiens
LPPVCYKII

SEQ ID NO: 333796 - protein, 9 aa, Homo Sapiens
AILEQRFDP

SEQ ID NO: 333797 - protein, 9 aa, Homo Sapiens
IRDSLISLE

SEQ ID NO: 333798 - protein, 9 aa, Homo Sapiens
DIWTRGVED

SEQ ID NO: 333799 - protein, 9 aa, Homo Sapiens
SLLERLDLQ

SEQ ID NO: 333800 - protein, 9 aa, Homo Sapiens
METMRMLKS

SEQ ID NO: 333801 - protein, 9 aa, Homo Sapiens
DSMMKLKGA

SEQ ID NO: 333802 - protein, 9 aa, Homo Sapiens
ENALLKYLS

SEQ ID NO: 333803 - protein, 9 aa, Homo Sapiens
SSDLTRHRQ

SEQ ID NO: 333804 - protein, 9 aa, Homo Sapiens
GNNILDHCL

SEQ ID NO: 333805 - protein, 9 aa, Homo Sapiens
SRRQPHVVS

SEQ ID NO: 333806 - protein, 9 aa, Homo Sapiens
QVEFDNATE

SEQ ID NO: 333807 - protein, 9 aa, Homo Sapiens
DSVLVLQAY

SEQ ID NO: 333808 - protein, 9 aa, Homo Sapiens
GIIEDNWQL

SEQ ID NO: 333809 - protein, 9 aa, Homo Sapiens
LCRFGSVPH

SEQ ID NO: 333810 - protein, 9 aa, Homo Sapiens
GYIPYGKEV

SEQ ID NO: 333811 - protein, 9 aa, Homo Sapiens
QYLGNQPLP

SEQ ID NO: 333812 - protein, 9 aa, Homo Sapiens
NPKNMENLL

SEQ ID NO: 333813 - protein, 9 aa, Homo Sapiens
PPNRQTCVF

SEQ ID NO: 333814 - protein, 9 aa, Homo Sapiens
ETIIIVHSL

SEQ ID NO: 333815 - protein, 9 aa, Homo Sapiens
ARLLLGRVG

SEQ ID NO: 333816 - protein, 9 aa, Homo Sapiens
CHMRRNAFS

SEQ ID NO: 333817 - protein, 9 aa, Homo Sapiens
IATILFFFP

SEQ ID NO: 333818 - protein, 9 aa, Homo Sapiens
LELGEAQRS

SEQ ID NO: 333819 - protein, 9 aa, Homo Sapiens
KDDTYDKDK

SEQ ID NO: 333820 - protein, 9 aa, Homo Sapiens
STVGINFKV

SEQ ID NO: 333821 - protein, 9 aa, Homo Sapiens
KRASSPFQR

SEQ ID NO: 333822 - protein, 9 aa, Homo Sapiens
NVDYYPDIT

SEQ ID NO: 333823 - protein, 9 aa, Homo Sapiens
ADLFGQMPG

SEQ ID NO: 333824 - protein, 9 aa, Homo Sapiens
VTGNSIRSY

SEQ ID NO: 333825 - protein, 9 aa, Homo Sapiens
RIALGNGAS

SEQ ID NO: 333826 - protein, 9 aa, Homo Sapiens
ISEDSPIRF

SEQ ID NO: 333827 - protein, 9 aa, Homo Sapiens
VAPQCKRSY

SEQ ID NO: 333828 - protein, 9 aa, Homo Sapiens
AYELFTSLI

SEQ ID NO: 333829 - protein, 9 aa, Homo Sapiens
ILPWYPQVL

SEQ ID NO: 333830 - protein, 9 aa, Homo Sapiens
AGNKDNTFS

SEQ ID NO: 333831 - protein, 9 aa, Homo Sapiens
YLSSNDQLS

SEQ ID NO: 333832 - protein, 9 aa, Homo Sapiens
EGSHVGVYL

SEQ ID NO: 333833 - protein, 9 aa, Homo Sapiens
RWSRFTRVL

SEQ ID NO: 333834 - protein, 9 aa, Homo Sapiens
ERNPDELRF

SEQ ID NO: 333835 - protein, 9 aa, Homo Sapiens
GKNGKIHDH

SEQ ID NO: 333836 - protein, 9 aa, Homo Sapiens
KDLPICGSS

SEQ ID NO: 333837 - protein, 9 aa, Homo Sapiens
HNVLTLKEE

SEQ ID NO: 333838 - protein, 9 aa, Homo Sapiens
AAKGRPRLN

SEQ ID NO: 333839 - protein, 9 aa, Homo Sapiens
HLHGTDIQV

SEQ ID NO: 333840 - protein, 9 aa, Homo Sapiens
PRLLVNTER

SEQ ID NO: 333841 - protein, 9 aa, Homo Sapiens
WNTLYQKEI

SEQ ID NO: 333842 - protein, 9 aa, Homo Sapiens
NSYLSACLI

SEQ ID NO: 333843 - protein, 9 aa, Homo Sapiens
LFFKFYHLL

SEQ ID NO: 333844 - protein, 9 aa, Homo Sapiens
LMYPYGYTT

SEQ ID NO: 333845 - protein, 9 aa, Homo Sapiens
IPQSYNVTL

SEQ ID NO: 333846 - protein, 9 aa, Homo Sapiens
VAWAIGGEG

SEQ ID NO: 333847 - protein, 9 aa, Homo Sapiens
QCYWPFSMD

SEQ ID NO: 333848 - protein, 9 aa, Homo Sapiens
FWPVGITAF

SEQ ID NO: 333849 - protein, 9 aa, Homo Sapiens
LSENEASDD

SEQ ID NO: 333850 - protein, 9 aa, Homo Sapiens
AEKDRWLKK

SEQ ID NO: 333851 - protein, 9 aa, Homo Sapiens
EQLLGGPDI

SEQ ID NO: 333852 - protein, 9 aa, Homo Sapiens
IEKIWLWLR

SEQ ID NO: 333853 - protein, 9 aa, Homo Sapiens
ASPLWTSFL

SEQ ID NO: 333854 - protein, 9 aa, Homo Sapiens
RQGSRFTWR

SEQ ID NO: 333855 - protein, 9 aa, Homo Sapiens
RVVGNLVAI

SEQ ID NO: 333856 - protein, 9 aa, Homo Sapiens
NGVQICFVN

SEQ ID NO: 333857 - protein, 9 aa, Homo Sapiens
SGHNRTVGP

SEQ ID NO: 333858 - protein, 9 aa, Homo Sapiens
VQTTLKSAT

SEQ ID NO: 333859 - protein, 9 aa, Homo Sapiens
FKEGKIIKV

SEQ ID NO: 333860 - protein, 9 aa, Homo Sapiens
AIFCVHWRR

SEQ ID NO: 333861 - protein, 9 aa, Homo Sapiens
KYKENSVLS

SEQ ID NO: 333862 - protein, 9 aa, Homo Sapiens
VRMNYYPYL

SEQ ID NO: 333863 - protein, 9 aa, Homo Sapiens
VPDEEAIEM

SEQ ID NO: 333864 - protein, 9 aa, Homo Sapiens
KTSKPQGKV

SEQ ID NO: 333865 - protein, 9 aa, Homo Sapiens
THVTQVTES

SEQ ID NO: 333866 - protein, 9 aa, Homo Sapiens
WHEQYLLNV

SEQ ID NO: 333867 - protein, 9 aa, Homo Sapiens
TTDSWEHIH

SEQ ID NO: 333868 - protein, 9 aa, Homo Sapiens
AKEAWDNHR

SEQ ID NO: 333869 - protein, 9 aa, Homo Sapiens
FRQRAHLIQ

SEQ ID NO: 333870 - protein, 9 aa, Homo Sapiens
VKKIMQSIK

SEQ ID NO: 333871 - protein, 9 aa, Homo Sapiens
ELDSVGGKI

SEQ ID NO: 333872 - protein, 9 aa, Homo Sapiens
IYDFDSIMH

SEQ ID NO: 333873 - protein, 9 aa, Homo Sapiens
LQTAGFSEK

SEQ ID NO: 333874 - protein, 9 aa, Homo Sapiens
FNQIELEVL

SEQ ID NO: 333875 - protein, 9 aa, Homo Sapiens
DGNVMRKFH

SEQ ID NO: 333876 - protein, 9 aa, Homo Sapiens
CLQNWEAMG

SEQ ID NO: 333877 - protein, 9 aa, Homo Sapiens
FNNGLDLGE

SEQ ID NO: 333878 - protein, 9 aa, Homo Sapiens
SSVVFGMRK

SEQ ID NO: 333879 - protein, 9 aa, Homo Sapiens
KALQKKSVL

SEQ ID NO: 333880 - protein, 9 aa, Homo Sapiens
RESLNRHYH

SEQ ID NO: 333881 - protein, 9 aa, Homo Sapiens
QNCQKIIKI

SEQ ID NO: 333882 - protein, 9 aa, Homo Sapiens
LCYLPGHSK

SEQ ID NO: 333883 - protein, 9 aa, Homo Sapiens
VAFAINLIL

SEQ ID NO: 333884 - protein, 9 aa, Homo Sapiens
LFSLDLCRI

SEQ ID NO: 333885 - protein, 9 aa, Homo Sapiens
LHRDLRSSN

SEQ ID NO: 333886 - protein, 9 aa, Homo Sapiens
RTGLTQIPT

SEQ ID NO: 333887 - protein, 9 aa, Homo Sapiens
DCVTECKEY

SEQ ID NO: 333888 - protein, 9 aa, Homo Sapiens
SNVACSLPG

SEQ ID NO: 333889 - protein, 9 aa, Homo Sapiens
CLDEQQHAQ

SEQ ID NO: 333890 - protein, 9 aa, Homo Sapiens
LSTFYENWS

SEQ ID NO: 333891 - protein, 9 aa, Homo Sapiens
TLKGQGEKI

SEQ ID NO: 333892 - protein, 9 aa, Homo Sapiens
KQGLIQNMV

SEQ ID NO: 333893 - protein, 9 aa, Homo Sapiens
VLYLGSIST

SEQ ID NO: 333894 - protein, 9 aa, Homo Sapiens
FMSSFQSYE

SEQ ID NO: 333895 - protein, 9 aa, Homo Sapiens
IHFQGGSHS

SEQ ID NO: 333896 - protein, 9 aa, Homo Sapiens
VCYDPYTQR

SEQ ID NO: 333897 - protein, 9 aa, Homo Sapiens
HQRIHTGET

SEQ ID NO: 333898 - protein, 9 aa, Homo Sapiens
ITTPDVYKS

SEQ ID NO: 333899 - protein, 9 aa, Homo Sapiens
VSAPGLVLT

SEQ ID NO: 333900 - protein, 9 aa, Homo Sapiens
QDYEKYKEN

SEQ ID NO: 333901 - protein, 9 aa, Homo Sapiens
LKIVEQINC

SEQ ID NO: 333902 - protein, 9 aa, Homo Sapiens
SIIDGNESE

SEQ ID NO: 333903 - protein, 9 aa, Homo Sapiens
KKTNSKRPD

SEQ ID NO: 333904 - protein, 9 aa, Homo Sapiens
LGVLLDYDS

SEQ ID NO: 333905 - protein, 9 aa, Homo Sapiens
IKLKIQFLI

SEQ ID NO: 333906 - protein, 9 aa, Homo Sapiens
KMKVDLSLK

SEQ ID NO: 333907 - protein, 9 aa, Homo Sapiens
LSSGRFHKR

SEQ ID NO: 333908 - protein, 9 aa, Homo Sapiens
FCTKLYQQL

SEQ ID NO: 333909 - protein, 9 aa, Homo Sapiens
VAGSAEMAA

SEQ ID NO: 333910 - protein, 9 aa, Homo Sapiens
TKLVKLKYR

SEQ ID NO: 333911 - protein, 9 aa, Homo Sapiens
RILIAKLIM

SEQ ID NO: 333912 - protein, 9 aa, Homo Sapiens
KIWDPAHRV

SEQ ID NO: 333913 - protein, 9 aa, Homo Sapiens
FISPESPTN

SEQ ID NO: 333914 - protein, 9 aa, Homo Sapiens
SKIYEMRMM

SEQ ID NO: 333915 - protein, 9 aa, Homo Sapiens
RTSAKKLLQ

SEQ ID NO: 333916 - protein, 9 aa, Homo Sapiens
FKAPQYAMA

SEQ ID NO: 333917 - protein, 9 aa, Homo Sapiens
SNLISKVPR

SEQ ID NO: 333918 - protein, 9 aa, Homo Sapiens
DKFQCGDGT

SEQ ID NO: 333919 - protein, 9 aa, Homo Sapiens
SQTAIIVPH

SEQ ID NO: 333920 - protein, 9 aa, Homo Sapiens
KQIHNLEDR

SEQ ID NO: 333921 - protein, 9 aa, Homo Sapiens
IPPLETVLA

SEQ ID NO: 333922 - protein, 9 aa, Homo Sapiens
IISMILCVP

SEQ ID NO: 333923 - protein, 9 aa, Homo Sapiens
LSFGKTKSG

SEQ ID NO: 333924 - protein, 9 aa, Homo Sapiens
REVTVNVLS

SEQ ID NO: 333925 - protein, 9 aa, Homo Sapiens
IWLARKICS

SEQ ID NO: 333926 - protein, 9 aa, Homo Sapiens
GTRAKLAYF

SEQ ID NO: 333927 - protein, 9 aa, Homo Sapiens
VVLGGDNVT

SEQ ID NO: 333928 - protein, 9 aa, Homo Sapiens
KGDESKDAT

SEQ ID NO: 333929 - protein, 9 aa, Homo Sapiens
LDSYRCECR

SEQ ID NO: 333930 - protein, 9 aa, Homo Sapiens
MNLMGWLHS

SEQ ID NO: 333931 - protein, 9 aa, Homo Sapiens
KYIKTYLQA

SEQ ID NO: 333932 - protein, 9 aa, Homo Sapiens
HGKREPFAE

SEQ ID NO: 333933 - protein, 9 aa, Homo Sapiens
TNDIDKALT

SEQ ID NO: 333934 - protein, 9 aa, Homo Sapiens
SAEVGTLWY

SEQ ID NO: 333935 - protein, 9 aa, Homo Sapiens
IYPMHNLKI

SEQ ID NO: 333936 - protein, 9 aa, Homo Sapiens
ELPFRKNKM

SEQ ID NO: 333937 - protein, 9 aa, Homo Sapiens
GKVDARSDQ

SEQ ID NO: 333938 - protein, 9 aa, Homo Sapiens
GGLQPLLFQ

SEQ ID NO: 333939 - protein, 9 aa, Homo Sapiens
TFREGHQWD

SEQ ID NO: 333940 - protein, 9 aa, Homo Sapiens
EDIKARPDM

SEQ ID NO: 333941 - protein, 9 aa, Homo Sapiens
PFKSNHPQG

SEQ ID NO: 333942 - protein, 9 aa, Homo Sapiens
QNDISLILN

SEQ ID NO: 333943 - protein, 9 aa, Homo Sapiens
GKFQPPRKA

SEQ ID NO: 333944 - protein, 9 aa, Homo Sapiens
ALRGHTKPQ

SEQ ID NO: 333945 - protein, 9 aa, Homo Sapiens
CFGDIVPLG

SEQ ID NO: 333946 - protein, 9 aa, Homo Sapiens
SAAKRLKLA

SEQ ID NO: 333947 - protein, 9 aa, Homo Sapiens
KEPDISLHV

SEQ ID NO: 333948 - protein, 9 aa, Homo Sapiens
KMLAVGVGN

SEQ ID NO: 333949 - protein, 9 aa, Homo Sapiens
ANQESNISG

SEQ ID NO: 333950 - protein, 9 aa, Homo Sapiens
MICQQHQSW

SEQ ID NO: 333951 - protein, 9 aa, Homo Sapiens
DLDAIDWNE

SEQ ID NO: 333952 - protein, 9 aa, Homo Sapiens
DSTQQYRSN

SEQ ID NO: 333953 - protein, 9 aa, Homo Sapiens
ERTNNWSLI

SEQ ID NO: 333954 - protein, 9 aa, Homo Sapiens
ATYVLASLL

SEQ ID NO: 333955 - protein, 9 aa, Homo Sapiens
DWKVHKGTC

SEQ ID NO: 333956 - protein, 9 aa, Homo Sapiens
RPEPEPPRQ

SEQ ID NO: 333957 - protein, 9 aa, Homo Sapiens
DLMAQPPQT

SEQ ID NO: 333958 - protein, 9 aa, Homo Sapiens
QQELIEKQQ

SEQ ID NO: 333959 - protein, 9 aa, Homo Sapiens
CLFIYVKPK

SEQ ID NO: 333960 - protein, 9 aa, Homo Sapiens
IGFDTGDAV

SEQ ID NO: 333961 - protein, 9 aa, Homo Sapiens
IISHECTRR

SEQ ID NO: 333962 - protein, 9 aa, Homo Sapiens
DVESYIHHS

SEQ ID NO: 333963 - protein, 9 aa, Homo Sapiens
DKVWFLEQQ

SEQ ID NO: 333964 - protein, 9 aa, Homo Sapiens
SRSRYLKCI

SEQ ID NO: 333965 - protein, 9 aa, Homo Sapiens
LFKTWDLDF

SEQ ID NO: 333966 - protein, 9 aa, Homo Sapiens
QQLTNIHRQ

SEQ ID NO: 333967 - protein, 9 aa, Homo Sapiens
KFHFFVAIQ

SEQ ID NO: 333968 - protein, 9 aa, Homo Sapiens
PSVWQSARR

SEQ ID NO: 333969 - protein, 9 aa, Homo Sapiens
VFWVLGTLF

SEQ ID NO: 333970 - protein, 9 aa, Homo Sapiens
KPDSSPITK

SEQ ID NO: 333971 - protein, 9 aa, Homo Sapiens
KFTQERNRT

SEQ ID NO: 333972 - protein, 9 aa, Homo Sapiens
DVNRQISVA

SEQ ID NO: 333973 - protein, 9 aa, Homo Sapiens
KEFNYLHNQ

SEQ ID NO: 333974 - protein, 9 aa, Homo Sapiens
IGSPEILWK

SEQ ID NO: 333975 - protein, 9 aa, Homo Sapiens
LEWVCLGNG

SEQ ID NO: 333976 - protein, 9 aa, Homo Sapiens
QQNKFGEEI

SEQ ID NO: 333977 - protein, 9 aa, Homo Sapiens
SICLICSLS

SEQ ID NO: 333978 - protein, 9 aa, Homo Sapiens
NLCFDLYDV

SEQ ID NO: 333979 - protein, 9 aa, Homo Sapiens
AHLNLQDHQ

SEQ ID NO: 333980 - protein, 9 aa, Homo Sapiens
HKGWSQIMF

SEQ ID NO: 333981 - protein, 9 aa, Homo Sapiens
GFYGLSCQG

SEQ ID NO: 333982 - protein, 9 aa, Homo Sapiens
LSSLTNLPL

SEQ ID NO: 333983 - protein, 9 aa, Homo Sapiens
HPFSDRMPS

SEQ ID NO: 333984 - protein, 9 aa, Homo Sapiens
EKQLAELHT

SEQ ID NO: 333985 - protein, 9 aa, Homo Sapiens
AASAAGVYV

SEQ ID NO: 333986 - protein, 9 aa, Homo Sapiens
GKDITMLEE

SEQ ID NO: 333987 - protein, 9 aa, Homo Sapiens
DNGTNYTFI

SEQ ID NO: 333988 - protein, 9 aa, Homo Sapiens
TRAKRDKLT

SEQ ID NO: 333989 - protein, 9 aa, Homo Sapiens
LLHMKALSH

SEQ ID NO: 333990 - protein, 9 aa, Homo Sapiens
LNTATVKEK

SEQ ID NO: 333991 - protein, 9 aa, Homo Sapiens
VHNHTYQML

SEQ ID NO: 333992 - protein, 9 aa, Homo Sapiens
KTNEIMLAL

SEQ ID NO: 333993 - protein, 9 aa, Homo Sapiens
KNLSEVGFP

SEQ ID NO: 333994 - protein, 9 aa, Homo Sapiens
ENLGIADCI

SEQ ID NO: 333995 - protein, 9 aa, Homo Sapiens
RGKQHGSSR

SEQ ID NO: 333996 - protein, 9 aa, Homo Sapiens
LLQIPSCLY

SEQ ID NO: 333997 - protein, 9 aa, Homo Sapiens
PWNTRAKRD

SEQ ID NO: 333998 - protein, 9 aa, Homo Sapiens
LIRLCFWKL

SEQ ID NO: 333999 - protein, 9 aa, Homo Sapiens
EFIKTCVGL

SEQ ID NO: 334000 - protein, 9 aa, Homo Sapiens
KTVGTAVVH

SEQ ID NO: 334001 - protein, 9 aa, Homo Sapiens
GLALGLLQT

SEQ ID NO: 334002 - protein, 9 aa, Homo Sapiens
KFTKELHAK

SEQ ID NO: 334003 - protein, 9 aa, Homo Sapiens
TDKIKRLEL

SEQ ID NO: 334004 - protein, 9 aa, Homo Sapiens
RKNEKEKKG

SEQ ID NO: 334005 - protein, 9 aa, Homo Sapiens
LTHTCNPPW

SEQ ID NO: 334006 - protein, 9 aa, Homo Sapiens
YFKESPLNH

SEQ ID NO: 334007 - protein, 9 aa, Homo Sapiens
QNQVAHVKA

SEQ ID NO: 334008 - protein, 9 aa, Homo Sapiens
RVVFGELPS

SEQ ID NO: 334009 - protein, 9 aa, Homo Sapiens
DGLRNAGAT

SEQ ID NO: 334010 - protein, 9 aa, Homo Sapiens
GLGSPVIKS

SEQ ID NO: 334011 - protein, 9 aa, Homo Sapiens
SMFKLSGPF

SEQ ID NO: 334012 - protein, 9 aa, Homo Sapiens
SIDDLKNPR

SEQ ID NO: 334013 - protein, 9 aa, Homo Sapiens
GKSDSDEEE

SEQ ID NO: 334014 - protein, 9 aa, Homo Sapiens
SNKRQGWRT

SEQ ID NO: 334015 - protein, 9 aa, Homo Sapiens
HAGVAWVSS

SEQ ID NO: 334016 - protein, 9 aa, Homo Sapiens
EDIEEMMQN

SEQ ID NO: 334017 - protein, 9 aa, Homo Sapiens
GANSGIGFK

SEQ ID NO: 334018 - protein, 9 aa, Homo Sapiens
DTWVTPCSL

SEQ ID NO: 334019 - protein, 9 aa, Homo Sapiens
LNIKYKRPI

SEQ ID NO: 334020 - protein, 9 aa, Homo Sapiens
QICRGNVYL

SEQ ID NO: 334021 - protein, 9 aa, Homo Sapiens
DLEAYICVF

SEQ ID NO: 334022 - protein, 9 aa, Homo Sapiens
RDQKEEGNG

SEQ ID NO: 334023 - protein, 9 aa, Homo Sapiens
QSEYCIRKI

SEQ ID NO: 334024 - protein, 9 aa, Homo Sapiens
LLQEKELQK

SEQ ID NO: 334025 - protein, 9 aa, Homo Sapiens
PKYWCQGYF

SEQ ID NO: 334026 - protein, 9 aa, Homo Sapiens
TLIKYTIDV

SEQ ID NO: 334027 - protein, 9 aa, Homo Sapiens
SNGTDRTTE

SEQ ID NO: 334028 - protein, 9 aa, Homo Sapiens
SPRQMAVCE

SEQ ID NO: 334029 - protein, 9 aa, Homo Sapiens
MGNLALGQK

SEQ ID NO: 334030 - protein, 9 aa, Homo Sapiens
LNAGDVVMV

SEQ ID NO: 334031 - protein, 9 aa, Homo Sapiens
IEEDGSQTF

SEQ ID NO: 334032 - protein, 9 aa, Homo Sapiens
TGPIPLHQH

SEQ ID NO: 334033 - protein, 9 aa, Homo Sapiens
IQKVHKKKM

SEQ ID NO: 334034 - protein, 9 aa, Homo Sapiens
KNIKLFDKL

SEQ ID NO: 334035 - protein, 9 aa, Homo Sapiens
FNSKPHSPG

SEQ ID NO: 334036 - protein, 9 aa, Homo Sapiens
DLTRHRQIH

SEQ ID NO: 334037 - protein, 9 aa, Homo Sapiens
FQAWQKAQS

SEQ ID NO: 334038 - protein, 9 aa, Homo Sapiens
EADAKSAAH

SEQ ID NO: 334039 - protein, 9 aa, Homo Sapiens
KNYYKNASE

SEQ ID NO: 334040 - protein, 9 aa, Homo Sapiens
LPLLWGQSF

SEQ ID NO: 334041 - protein, 9 aa, Homo Sapiens
KYNIGIIED

SEQ ID NO: 334042 - protein, 9 aa, Homo Sapiens
KAERLGLHQ

SEQ ID NO: 334043 - protein, 9 aa, Homo Sapiens
PLSLETRVD

SEQ ID NO: 334044 - protein, 9 aa, Homo Sapiens
AEFDDKHLI

SEQ ID NO: 334045 - protein, 9 aa, Homo Sapiens
PSSLQKHVK

SEQ ID NO: 334046 - protein, 9 aa, Homo Sapiens
LKTLFSVGG

SEQ ID NO: 334047 - protein, 9 aa, Homo Sapiens
WQINLKTNI

SEQ ID NO: 334048 - protein, 9 aa, Homo Sapiens
IPVVRRPDQ

SEQ ID NO: 334049 - protein, 9 aa, Homo Sapiens
RRLPTQADR

SEQ ID NO: 334050 - protein, 9 aa, Homo Sapiens
DILIDPIQV

SEQ ID NO: 334051 - protein, 9 aa, Homo Sapiens
IMWTTVHPG

SEQ ID NO: 334052 - protein, 9 aa, Homo Sapiens
QSSSAKQKI

SEQ ID NO: 334053 - protein, 9 aa, Homo Sapiens
WLKEIYPDK

SEQ ID NO: 334054 - protein, 9 aa, Homo Sapiens
GASMDDNYF

SEQ ID NO: 334055 - protein, 9 aa, Homo Sapiens
YPQEVSTTV

SEQ ID NO: 334056 - protein, 9 aa, Homo Sapiens
INASRDQVV

SEQ ID NO: 334057 - protein, 9 aa, Homo Sapiens
GKELFFDYR

SEQ ID NO: 334058 - protein, 9 aa, Homo Sapiens
MMIAKQRLG

SEQ ID NO: 334059 - protein, 9 aa, Homo Sapiens
NCIQKTLNE

SEQ ID NO: 334060 - protein, 9 aa, Homo Sapiens
KGQVKNEVL

SEQ ID NO: 334061 - protein, 9 aa, Homo Sapiens
PDEAAFFNT

SEQ ID NO: 334062 - protein, 9 aa, Homo Sapiens
KAGLAPFVY

SEQ ID NO: 334063 - protein, 9 aa, Homo Sapiens
RQALVEFGD

SEQ ID NO: 334064 - protein, 9 aa, Homo Sapiens
SCLFIYVKP

SEQ ID NO: 334065 - protein, 9 aa, Homo Sapiens
PPTAALDLQ

SEQ ID NO: 334066 - protein, 9 aa, Homo Sapiens
CEDMSHTDV

SEQ ID NO: 334067 - protein, 9 aa, Homo Sapiens
RSAKYIQIH

SEQ ID NO: 334068 - protein, 9 aa, Homo Sapiens
LSQVKLGIH

SEQ ID NO: 334069 - protein, 9 aa, Homo Sapiens
REAMLDMLL

SEQ ID NO: 334070 - protein, 9 aa, Homo Sapiens
MQSIKGWRP

SEQ ID NO: 334071 - protein, 9 aa, Homo Sapiens
VAKAAQEFV

SEQ ID NO: 334072 - protein, 9 aa, Homo Sapiens
MEGTISWTD

SEQ ID NO: 334073 - protein, 9 aa, Homo Sapiens
AYKCPVIHG

SEQ ID NO: 334074 - protein, 9 aa, Homo Sapiens
YVKTARNPP

SEQ ID NO: 334075 - protein, 9 aa, Homo Sapiens
TFGKVKSGI

SEQ ID NO: 334076 - protein, 9 aa, Homo Sapiens
DLKKFLKSK

SEQ ID NO: 334077 - protein, 9 aa, Homo Sapiens
DDKHLITGF

SEQ ID NO: 334078 - protein, 9 aa, Homo Sapiens
KGCNLFIYH

SEQ ID NO: 334079 - protein, 9 aa, Homo Sapiens
ASVALVNTS

SEQ ID NO: 334080 - protein, 9 aa, Homo Sapiens
PPAQLEGLN

SEQ ID NO: 334081 - protein, 9 aa, Homo Sapiens
CKMSIYFRS

SEQ ID NO: 334082 - protein, 9 aa, Homo Sapiens
QDNIFQSMY

SEQ ID NO: 334083 - protein, 9 aa, Homo Sapiens
NIFISWFPF

SEQ ID NO: 334084 - protein, 9 aa, Homo Sapiens
PGHNYSNHS

SEQ ID NO: 334085 - protein, 9 aa, Homo Sapiens
KLTHLCLAN

SEQ ID NO: 334086 - protein, 9 aa, Homo Sapiens
SRAEAKQMK

SEQ ID NO: 334087 - protein, 9 aa, Homo Sapiens
PQAKLAHLA

SEQ ID NO: 334088 - protein, 9 aa, Homo Sapiens
KWFIGLVTL

SEQ ID NO: 334089 - protein, 9 aa, Homo Sapiens
QPINTHQTN

SEQ ID NO: 334090 - protein, 9 aa, Homo Sapiens
HKSTPEISE

SEQ ID NO: 334091 - protein, 9 aa, Homo Sapiens
QCNLTTSSA

SEQ ID NO: 334092 - protein, 9 aa, Homo Sapiens
DTIFPLVTT

SEQ ID NO: 334093 - protein, 9 aa, Homo Sapiens
NNNIINTQQ

SEQ ID NO: 334094 - protein, 9 aa, Homo Sapiens
KECLVHQSK

SEQ ID NO: 334095 - protein, 9 aa, Homo Sapiens
FTLDKVHII

SEQ ID NO: 334096 - protein, 9 aa, Homo Sapiens
PCCQPTCGR

SEQ ID NO: 334097 - protein, 9 aa, Homo Sapiens
AQNKEKYTV

SEQ ID NO: 334098 - protein, 9 aa, Homo Sapiens
ELSKLCGSL

SEQ ID NO: 334099 - protein, 9 aa, Homo Sapiens
NQLQEDLQS

SEQ ID NO: 334100 - protein, 9 aa, Homo Sapiens
VNKQEENNE

SEQ ID NO: 334101 - protein, 9 aa, Homo Sapiens
TCIPYRVVE

SEQ ID NO: 334102 - protein, 9 aa, Homo Sapiens
AHTAKVNCL

SEQ ID NO: 334103 - protein, 9 aa, Homo Sapiens
MNLESDNED

SEQ ID NO: 334104 - protein, 9 aa, Homo Sapiens
KTLDLKSTR

SEQ ID NO: 334105 - protein, 9 aa, Homo Sapiens
DCGPGLLCQ

SEQ ID NO: 334106 - protein, 9 aa, Homo Sapiens
HHGIATSVA

SEQ ID NO: 334107 - protein, 9 aa, Homo Sapiens
KEGTEASAL

SEQ ID NO: 334108 - protein, 9 aa, Homo Sapiens
DVVYPEIFP

SEQ ID NO: 334109 - protein, 9 aa, Homo Sapiens
KIVECTFTK

SEQ ID NO: 334110 - protein, 9 aa, Homo Sapiens
VEKAKAMSS

SEQ ID NO: 334111 - protein, 9 aa, Homo Sapiens
FIRIQTNAS

SEQ ID NO: 334112 - protein, 9 aa, Homo Sapiens
TEDHGTPAP

SEQ ID NO: 334113 - protein, 9 aa, Homo Sapiens
IHTILLGYL

SEQ ID NO: 334114 - protein, 9 aa, Homo Sapiens
SSCLTQHQI

SEQ ID NO: 334115 - protein, 9 aa, Homo Sapiens
IDNFKTRTR

SEQ ID NO: 334116 - protein, 9 aa, Homo Sapiens
VSLQYKNNQ

SEQ ID NO: 334117 - protein, 9 aa, Homo Sapiens
ESQIKATVM

SEQ ID NO: 334118 - protein, 9 aa, Homo Sapiens
MGGNNPFLG

SEQ ID NO: 334119 - protein, 9 aa, Homo Sapiens
IQNEGIKSL

SEQ ID NO: 334120 - protein, 9 aa, Homo Sapiens
AKIKVLKLI

SEQ ID NO: 334121 - protein, 9 aa, Homo Sapiens
EPNRMPSRS

SEQ ID NO: 334122 - protein, 9 aa, Homo Sapiens
QDAHLLMTN

SEQ ID NO: 334123 - protein, 9 aa, Homo Sapiens
SAMNHHLQE

SEQ ID NO: 334124 - protein, 9 aa, Homo Sapiens
SPTTATGNN

SEQ ID NO: 334125 - protein, 9 aa, Homo Sapiens
VRFMSLPPN

SEQ ID NO: 334126 - protein, 9 aa, Homo Sapiens
TTATGNNSC

SEQ ID NO: 334127 - protein, 9 aa, Homo Sapiens
AFQNFMQEL

SEQ ID NO: 334128 - protein, 9 aa, Homo Sapiens
LFVSDLFKT

SEQ ID NO: 334129 - protein, 9 aa, Homo Sapiens
SQPEAAFLG

SEQ ID NO: 334130 - protein, 9 aa, Homo Sapiens
GTAVTHGDH

SEQ ID NO: 334131 - protein, 9 aa, Homo Sapiens
EDVSTGEPL

SEQ ID NO: 334132 - protein, 9 aa, Homo Sapiens
IYKLVMETR

SEQ ID NO: 334133 - protein, 9 aa, Homo Sapiens
NVALSSCHV

SEQ ID NO: 334134 - protein, 9 aa, Homo Sapiens
KICFWDIRS

SEQ ID NO: 334135 - protein, 9 aa, Homo Sapiens
EPENYSKKD

SEQ ID NO: 334136 - protein, 9 aa, Homo Sapiens
VIYLYTARD

SEQ ID NO: 334137 - protein, 9 aa, Homo Sapiens
LQLFLSQTA

SEQ ID NO: 334138 - protein, 9 aa, Homo Sapiens
NQNKCIEMK

SEQ ID NO: 334139 - protein, 9 aa, Homo Sapiens
AGHVGSVHS

SEQ ID NO: 334140 - protein, 9 aa, Homo Sapiens
AAELRDAEL

SEQ ID NO: 334141 - protein, 9 aa, Homo Sapiens
EVNSLGEIY

SEQ ID NO: 334142 - protein, 9 aa, Homo Sapiens
QKHVKTVHG

SEQ ID NO: 334143 - protein, 9 aa, Homo Sapiens
HEIWEEFLM

SEQ ID NO: 334144 - protein, 9 aa, Homo Sapiens
NDNNTFTVK

SEQ ID NO: 334145 - protein, 9 aa, Homo Sapiens
LITVTKENE

SEQ ID NO: 334146 - protein, 9 aa, Homo Sapiens
DHPEITYWL

SEQ ID NO: 334147 - protein, 9 aa, Homo Sapiens
LSLLWSEVE

SEQ ID NO: 334148 - protein, 9 aa, Homo Sapiens
QSENLNLRK

SEQ ID NO: 334149 - protein, 9 aa, Homo Sapiens
ETAFSAFQQ

SEQ ID NO: 334150 - protein, 9 aa, Homo Sapiens
MPILVEKLP

SEQ ID NO: 334151 - protein, 9 aa, Homo Sapiens
KDVKYNVLY

SEQ ID NO: 334152 - protein, 9 aa, Homo Sapiens
WLARVWMMK

SEQ ID NO: 334153 - protein, 9 aa, Homo Sapiens
ISPKNKKPK

SEQ ID NO: 334154 - protein, 9 aa, Homo Sapiens
PLGYIPYGK

SEQ ID NO: 334155 - protein, 9 aa, Homo Sapiens
IPNHRNAVI

SEQ ID NO: 334156 - protein, 9 aa, Homo Sapiens
QNGSSMKPQ

SEQ ID NO: 334157 - protein, 9 aa, Homo Sapiens
RFKCSNSVT

SEQ ID NO: 334158 - protein, 9 aa, Homo Sapiens
KKTSRKQQK

SEQ ID NO: 334159 - protein, 9 aa, Homo Sapiens
LWGAVGHRP

SEQ ID NO: 334160 - protein, 9 aa, Homo Sapiens
LSFMLDNLQ

SEQ ID NO: 334161 - protein, 9 aa, Homo Sapiens
ELHRQVRIL

SEQ ID NO: 334162 - protein, 9 aa, Homo Sapiens
WPTMENILQ

SEQ ID NO: 334163 - protein, 9 aa, Homo Sapiens
RRSLDWGAP

SEQ ID NO: 334164 - protein, 9 aa, Homo Sapiens
IKDIWENGM

SEQ ID NO: 334165 - protein, 9 aa, Homo Sapiens
TDLMTKAEV

SEQ ID NO: 334166 - protein, 9 aa, Homo Sapiens
AQVQTGNIR

SEQ ID NO: 334167 - protein, 9 aa, Homo Sapiens
CLGHRRTSS

SEQ ID NO: 334168 - protein, 9 aa, Homo Sapiens
YLLNDDLKP

SEQ ID NO: 334169 - protein, 9 aa, Homo Sapiens
CRLYKHLDM

SEQ ID NO: 334170 - protein, 9 aa, Homo Sapiens
FCVHWRRET

SEQ ID NO: 334171 - protein, 9 aa, Homo Sapiens
DAGITEKVV

SEQ ID NO: 334172 - protein, 9 aa, Homo Sapiens
NCKPDNGKE

SEQ ID NO: 334173 - protein, 9 aa, Homo Sapiens
RRGAELVTE

SEQ ID NO: 334174 - protein, 9 aa, Homo Sapiens
DISEAFTST

SEQ ID NO: 334175 - protein, 9 aa, Homo Sapiens
EKPVLLSKF

SEQ ID NO: 334176 - protein, 9 aa, Homo Sapiens
ERDAGITEK

SEQ ID NO: 334177 - protein, 9 aa, Homo Sapiens
VHKGTCYWI

SEQ ID NO: 334178 - protein, 9 aa, Homo Sapiens
VTMTKCDVT

SEQ ID NO: 334179 - protein, 9 aa, Homo Sapiens
FGDKYRDCY

SEQ ID NO: 334180 - protein, 9 aa, Homo Sapiens
KIDSLIGKG

SEQ ID NO: 334181 - protein, 9 aa, Homo Sapiens
WLAINYRLH

SEQ ID NO: 334182 - protein, 9 aa, Homo Sapiens
LCLPGSSNY

SEQ ID NO: 334183 - protein, 9 aa, Homo Sapiens
QLHLWAFKM

SEQ ID NO: 334184 - protein, 9 aa, Homo Sapiens
VMSDKSIFY

SEQ ID NO: 334185 - protein, 9 aa, Homo Sapiens
WACFDEFNQ

SEQ ID NO: 334186 - protein, 9 aa, Homo Sapiens
LLYDFRWMT

SEQ ID NO: 334187 - protein, 9 aa, Homo Sapiens
SEVPGQTQL

SEQ ID NO: 334188 - protein, 9 aa, Homo Sapiens
RNLKTRNLD

SEQ ID NO: 334189 - protein, 9 aa, Homo Sapiens
TVNLTVIWC

SEQ ID NO: 334190 - protein, 9 aa, Homo Sapiens
ELQSDMYIL

SEQ ID NO: 334191 - protein, 9 aa, Homo Sapiens
KASLKRCCN

SEQ ID NO: 334192 - protein, 9 aa, Homo Sapiens
WQLQQLVNK

SEQ ID NO: 334193 - protein, 9 aa, Homo Sapiens
DQIRFTVNR

SEQ ID NO: 334194 - protein, 9 aa, Homo Sapiens
AYLIEHQRL

SEQ ID NO: 334195 - protein, 9 aa, Homo Sapiens
CKVFGAHKY

SEQ ID NO: 334196 - protein, 9 aa, Homo Sapiens
LGTRAKLAY

SEQ ID NO: 334197 - protein, 9 aa, Homo Sapiens
LSEVVKFDR

SEQ ID NO: 334198 - protein, 9 aa, Homo Sapiens
LIPEFLAEH

SEQ ID NO: 334199 - protein, 9 aa, Homo Sapiens
FYDQDNSSL

SEQ ID NO: 334200 - protein, 9 aa, Homo Sapiens
FWVGSKNTC

SEQ ID NO: 334201 - protein, 9 aa, Homo Sapiens
KTGCSKTPK

SEQ ID NO: 334202 - protein, 9 aa, Homo Sapiens
AMAGKTDQK

SEQ ID NO: 334203 - protein, 9 aa, Homo Sapiens
RQKTSKPQG

SEQ ID NO: 334204 - protein, 9 aa, Homo Sapiens
MKKDKKINK

SEQ ID NO: 334205 - protein, 9 aa, Homo Sapiens
DTEEQKDKD

SEQ ID NO: 334206 - protein, 9 aa, Homo Sapiens
PSIFRVVGN

SEQ ID NO: 334207 - protein, 9 aa, Homo Sapiens
SPISHLPSP

SEQ ID NO: 334208 - protein, 9 aa, Homo Sapiens
EQINCKQDW

SEQ ID NO: 334209 - protein, 9 aa, Homo Sapiens
IIVHSLLTG

SEQ ID NO: 334210 - protein, 9 aa, Homo Sapiens
LTPMLNPLM

SEQ ID NO: 334211 - protein, 9 aa, Homo Sapiens
TPDKVFTVS

SEQ ID NO: 334212 - protein, 9 aa, Homo Sapiens
GKKTYPECL

SEQ ID NO: 334213 - protein, 9 aa, Homo Sapiens
DGDNKYGAG

SEQ ID NO: 334214 - protein, 9 aa, Homo Sapiens
ADLAWIKGV

SEQ ID NO: 334215 - protein, 9 aa, Homo Sapiens
TATRNEILV

SEQ ID NO: 334216 - protein, 9 aa, Homo Sapiens
SYSLVETQK

SEQ ID NO: 334217 - protein, 9 aa, Homo Sapiens
GELYRQNRF

SEQ ID NO: 334218 - protein, 9 aa, Homo Sapiens
KEEGNGYDT

SEQ ID NO: 334219 - protein, 9 aa, Homo Sapiens
QRYSLSHDF

SEQ ID NO: 334220 - protein, 9 aa, Homo Sapiens
KDTTLQELE

SEQ ID NO: 334221 - protein, 9 aa, Homo Sapiens
LQMDVREKQ

SEQ ID NO: 334222 - protein, 9 aa, Homo Sapiens
SWKFPDCMA

SEQ ID NO: 334223 - protein, 9 aa, Homo Sapiens
ASATESSFI

SEQ ID NO: 334224 - protein, 9 aa, Homo Sapiens
TADLFAFSF

SEQ ID NO: 334225 - protein, 9 aa, Homo Sapiens
RPEEIKELQ

SEQ ID NO: 334226 - protein, 9 aa, Homo Sapiens
NNNPPVFSL

SEQ ID NO: 334227 - protein, 9 aa, Homo Sapiens
LSNVGWAIS

SEQ ID NO: 334228 - protein, 9 aa, Homo Sapiens
MSYPISVLV

SEQ ID NO: 334229 - protein, 9 aa, Homo Sapiens
LLHQIIHKG

SEQ ID NO: 334230 - protein, 9 aa, Homo Sapiens
RWAEIAKLF

SEQ ID NO: 334231 - protein, 9 aa, Homo Sapiens
LLAELNLMP

SEQ ID NO: 334232 - protein, 9 aa, Homo Sapiens
RDSMERGDL

SEQ ID NO: 334233 - protein, 9 aa, Homo Sapiens
EKRHGRFKC

SEQ ID NO: 334234 - protein, 9 aa, Homo Sapiens
DLSASEQDN

SEQ ID NO: 334235 - protein, 9 aa, Homo Sapiens
RINHCGIAS

SEQ ID NO: 334236 - protein, 9 aa, Homo Sapiens
FPAPSEKSN

SEQ ID NO: 334237 - protein, 9 aa, Homo Sapiens
KERQKRGWD

SEQ ID NO: 334238 - protein, 9 aa, Homo Sapiens
KSMQGKKSS

SEQ ID NO: 334239 - protein, 9 aa, Homo Sapiens
ICKERNQYG

SEQ ID NO: 334240 - protein, 9 aa, Homo Sapiens
KIQQQNQYE

SEQ ID NO: 334241 - protein, 9 aa, Homo Sapiens
YAWAVQNIQ

SEQ ID NO: 334242 - protein, 9 aa, Homo Sapiens
DVTRAGFLN

SEQ ID NO: 334243 - protein, 9 aa, Homo Sapiens
VTLQIDSSR

SEQ ID NO: 334244 - protein, 9 aa, Homo Sapiens
NPCVSGTVH

SEQ ID NO: 334245 - protein, 9 aa, Homo Sapiens
ISIAQRKDL

SEQ ID NO: 334246 - protein, 9 aa, Homo Sapiens
PNDDIQYDL

SEQ ID NO: 334247 - protein, 9 aa, Homo Sapiens
KNIQFTHAN

SEQ ID NO: 334248 - protein, 9 aa, Homo Sapiens
EGQGSLRGA

SEQ ID NO: 334249 - protein, 9 aa, Homo Sapiens
NGIQRSLFT

SEQ ID NO: 334250 - protein, 9 aa, Homo Sapiens
LTHLCLANN

SEQ ID NO: 334251 - protein, 9 aa, Homo Sapiens
ENLKNHDNS

SEQ ID NO: 334252 - protein, 9 aa, Homo Sapiens
NNHSLYLGR

SEQ ID NO: 334253 - protein, 9 aa, Homo Sapiens
SGNDTTENG

SEQ ID NO: 334254 - protein, 9 aa, Homo Sapiens
RKKDVMASS

SEQ ID NO: 334255 - protein, 9 aa, Homo Sapiens
TESSFILAS

SEQ ID NO: 334256 - protein, 9 aa, Homo Sapiens
ILGRTSLKI

SEQ ID NO: 334257 - protein, 9 aa, Homo Sapiens
TYFYLFKKL

SEQ ID NO: 334258 - protein, 9 aa, Homo Sapiens
IKSIFAFVL

SEQ ID NO: 334259 - protein, 9 aa, Homo Sapiens
IPFIRPANQ

SEQ ID NO: 334260 - protein, 9 aa, Homo Sapiens
VHNLFVLRG

SEQ ID NO: 334261 - protein, 9 aa, Homo Sapiens
RLEHLHIDV

SEQ ID NO: 334262 - protein, 9 aa, Homo Sapiens
NKCAIFEKP

SEQ ID NO: 334263 - protein, 9 aa, Homo Sapiens
VCKKFMERN

SEQ ID NO: 334264 - protein, 9 aa, Homo Sapiens
PQDDIATEA

SEQ ID NO: 334265 - protein, 9 aa, Homo Sapiens
VLGAYVEQY

SEQ ID NO: 334266 - protein, 9 aa, Homo Sapiens
ATESSFILA

SEQ ID NO: 334267 - protein, 9 aa, Homo Sapiens
KHLKMAEED

SEQ ID NO: 334268 - protein, 9 aa, Homo Sapiens
VILRINRTA

SEQ ID NO: 334269 - protein, 9 aa, Homo Sapiens
QKEFVRKKT

SEQ ID NO: 334270 - protein, 9 aa, Homo Sapiens
PPCTQCIKW

SEQ ID NO: 334271 - protein, 9 aa, Homo Sapiens
INTTNGSRF

SEQ ID NO: 334272 - protein, 9 aa, Homo Sapiens
ERICQRTHF

SEQ ID NO: 334273 - protein, 9 aa, Homo Sapiens
FERWECTMY

SEQ ID NO: 334274 - protein, 9 aa, Homo Sapiens
LNTLILCHN

SEQ ID NO: 334275 - protein, 9 aa, Homo Sapiens
PASKSNINK

SEQ ID NO: 334276 - protein, 9 aa, Homo Sapiens
PLRGLPPMH

SEQ ID NO: 334277 - protein, 9 aa, Homo Sapiens
VKKAGLAPF

SEQ ID NO: 334278 - protein, 9 aa, Homo Sapiens
KPDMDKSHF

SEQ ID NO: 334279 - protein, 9 aa, Homo Sapiens
FYQVRACLA

SEQ ID NO: 334280 - protein, 9 aa, Homo Sapiens
TMTKCDVTG

SEQ ID NO: 334281 - protein, 9 aa, Homo Sapiens
PSCLLSLCQ

SEQ ID NO: 334282 - protein, 9 aa, Homo Sapiens
KINQGTLTI

SEQ ID NO: 334283 - protein, 9 aa, Homo Sapiens
LKYFSSSKR

SEQ ID NO: 334284 - protein, 9 aa, Homo Sapiens
GLKGNEGSP

SEQ ID NO: 334285 - protein, 9 aa, Homo Sapiens
EHVRKIIQD

SEQ ID NO: 334286 - protein, 9 aa, Homo Sapiens
QLAELHTKT

SEQ ID NO: 334287 - protein, 9 aa, Homo Sapiens
NKSRKFNLM

SEQ ID NO: 334288 - protein, 9 aa, Homo Sapiens
VACYGSCLV

SEQ ID NO: 334289 - protein, 9 aa, Homo Sapiens
QNGPYRQLF

SEQ ID NO: 334290 - protein, 9 aa, Homo Sapiens
GRRKGQQAA

SEQ ID NO: 334291 - protein, 9 aa, Homo Sapiens
KFIILITDG

SEQ ID NO: 334292 - protein, 9 aa, Homo Sapiens
RRITIEDFN

SEQ ID NO: 334293 - protein, 9 aa, Homo Sapiens
EDEEWKIIR

SEQ ID NO: 334294 - protein, 9 aa, Homo Sapiens
LKINSSYFL

SEQ ID NO: 334295 - protein, 9 aa, Homo Sapiens
PLQRLSSLI

SEQ ID NO: 334296 - protein, 9 aa, Homo Sapiens
LVPVDGILY

SEQ ID NO: 334297 - protein, 9 aa, Homo Sapiens
LHSRNNMLL

SEQ ID NO: 334298 - protein, 9 aa, Homo Sapiens
YDKIKDMAM

SEQ ID NO: 334299 - protein, 9 aa, Homo Sapiens
EKARLSSSP

SEQ ID NO: 334300 - protein, 9 aa, Homo Sapiens
RIRYNDMFE

SEQ ID NO: 334301 - protein, 9 aa, Homo Sapiens
EYFLALKKH

SEQ ID NO: 334302 - protein, 9 aa, Homo Sapiens
HQERAEQLS

SEQ ID NO: 334303 - protein, 9 aa, Homo Sapiens
QVFVFESML

SEQ ID NO: 334304 - protein, 9 aa, Homo Sapiens
KAERLVKYR

SEQ ID NO: 334305 - protein, 9 aa, Homo Sapiens
SRITMQEKS

SEQ ID NO: 334306 - protein, 9 aa, Homo Sapiens
QVKSEKLKY

SEQ ID NO: 334307 - protein, 9 aa, Homo Sapiens
LEINLDDDD

SEQ ID NO: 334308 - protein, 9 aa, Homo Sapiens
SLQDPPLYP

SEQ ID NO: 334309 - protein, 9 aa, Homo Sapiens
QDNAELETT

SEQ ID NO: 334310 - protein, 9 aa, Homo Sapiens
MTNHLYAAI

SEQ ID NO: 334311 - protein, 9 aa, Homo Sapiens
GIVSWGSNT

SEQ ID NO: 334312 - protein, 9 aa, Homo Sapiens
GLNWENIQN

SEQ ID NO: 334313 - protein, 9 aa, Homo Sapiens
RHRLSLLED

SEQ ID NO: 334314 - protein, 9 aa, Homo Sapiens
ISNITVCMP

SEQ ID NO: 334315 - protein, 9 aa, Homo Sapiens
PRLYFDNTC

SEQ ID NO: 334316 - protein, 9 aa, Homo Sapiens
HDKMNEISL

SEQ ID NO: 334317 - protein, 9 aa, Homo Sapiens
YKENSVLSY

SEQ ID NO: 334318 - protein, 9 aa, Homo Sapiens
ELDIMFTLD

SEQ ID NO: 334319 - protein, 9 aa, Homo Sapiens
LPKNKGSMQ

SEQ ID NO: 334320 - protein, 9 aa, Homo Sapiens
VVEICACPP

SEQ ID NO: 334321 - protein, 9 aa, Homo Sapiens
EYLEKQCLK

SEQ ID NO: 334322 - protein, 9 aa, Homo Sapiens
ETFCIDNKA

SEQ ID NO: 334323 - protein, 9 aa, Homo Sapiens
ILALWNPRH

SEQ ID NO: 334324 - protein, 9 aa, Homo Sapiens
YNSTVKESQ

SEQ ID NO: 334325 - protein, 9 aa, Homo Sapiens
TYQRDYSLP

SEQ ID NO: 334326 - protein, 9 aa, Homo Sapiens
FPAARHLYW

SEQ ID NO: 334327 - protein, 9 aa, Homo Sapiens
TAFCLAQKH

SEQ ID NO: 334328 - protein, 9 aa, Homo Sapiens
DEIYSICSR

SEQ ID NO: 334329 - protein, 9 aa, Homo Sapiens
PQRALIGLW

SEQ ID NO: 334330 - protein, 9 aa, Homo Sapiens
HPDIFPGLH

SEQ ID NO: 334331 - protein, 9 aa, Homo Sapiens
ALSDKDMDI

SEQ ID NO: 334332 - protein, 9 aa, Homo Sapiens
LEEENMVLR

SEQ ID NO: 334333 - protein, 9 aa, Homo Sapiens
NFNPEHCSH

SEQ ID NO: 334334 - protein, 9 aa, Homo Sapiens
DFLMFNCSV

SEQ ID NO: 334335 - protein, 9 aa, Homo Sapiens
QASYFGAYD

SEQ ID NO: 334336 - protein, 9 aa, Homo Sapiens
SPPLLLLSV

SEQ ID NO: 334337 - protein, 9 aa, Homo Sapiens
LLQCNTEDA

SEQ ID NO: 334338 - protein, 9 aa, Homo Sapiens
SFLVAQVQK

SEQ ID NO: 334339 - protein, 9 aa, Homo Sapiens
SFVIGIDLW

SEQ ID NO: 334340 - protein, 9 aa, Homo Sapiens
ARRQQYPSP

SEQ ID NO: 334341 - protein, 9 aa, Homo Sapiens
QTISKGLFV

SEQ ID NO: 334342 - protein, 9 aa, Homo Sapiens
GLKENDERE

SEQ ID NO: 334343 - protein, 9 aa, Homo Sapiens
QTKLEFALE

SEQ ID NO: 334344 - protein, 9 aa, Homo Sapiens
VKQGKYQNK

SEQ ID NO: 334345 - protein, 9 aa, Homo Sapiens
NPIQDGLRN

SEQ ID NO: 334346 - protein, 9 aa, Homo Sapiens
EGLNWENIQ

SEQ ID NO: 334347 - protein, 9 aa, Homo Sapiens
NKVNSEGKF

SEQ ID NO: 334348 - protein, 9 aa, Homo Sapiens
ILVAHKHYT

SEQ ID NO: 334349 - protein, 9 aa, Homo Sapiens
HCPVVTVNH

SEQ ID NO: 334350 - protein, 9 aa, Homo Sapiens
INGEKLLIW

SEQ ID NO: 334351 - protein, 9 aa, Homo Sapiens
KSPDLKTLQ

SEQ ID NO: 334352 - protein, 9 aa, Homo Sapiens
TIQDQAKHM

SEQ ID NO: 334353 - protein, 9 aa, Homo Sapiens
NVEEEKNKR

SEQ ID NO: 334354 - protein, 9 aa, Homo Sapiens
LSVFKVVPG

SEQ ID NO: 334355 - protein, 9 aa, Homo Sapiens
VVLLTVAAA

SEQ ID NO: 334356 - protein, 9 aa, Homo Sapiens
TAFCLAQKV

SEQ ID NO: 334357 - protein, 9 aa, Homo Sapiens
FNIYMFKNN

SEQ ID NO: 334358 - protein, 9 aa, Homo Sapiens
YNERDEITH

SEQ ID NO: 334359 - protein, 9 aa, Homo Sapiens
VTVTPNTAW

SEQ ID NO: 334360 - protein, 9 aa, Homo Sapiens
QNIVLNRPS

SEQ ID NO: 334361 - protein, 9 aa, Homo Sapiens
KRKDELNHS

SEQ ID NO: 334362 - protein, 9 aa, Homo Sapiens
IESLGWSNE

SEQ ID NO: 334363 - protein, 9 aa, Homo Sapiens
NTTRAMSIK

SEQ ID NO: 334364 - protein, 9 aa, Homo Sapiens
ECKIILRKL

SEQ ID NO: 334365 - protein, 9 aa, Homo Sapiens
GNNPFLGIA

SEQ ID NO: 334366 - protein, 9 aa, Homo Sapiens
EVCIVAQRR

SEQ ID NO: 334367 - protein, 9 aa, Homo Sapiens
RSKIGWVWN

SEQ ID NO: 334368 - protein, 9 aa, Homo Sapiens
GSMENLASY

SEQ ID NO: 334369 - protein, 9 aa, Homo Sapiens
SSQPVISSL

SEQ ID NO: 334370 - protein, 9 aa, Homo Sapiens
EFCQSKIDY

SEQ ID NO: 334371 - protein, 9 aa, Homo Sapiens
HVGGIIRTC

SEQ ID NO: 334372 - protein, 9 aa, Homo Sapiens
NSNTGIRSS

SEQ ID NO: 334373 - protein, 9 aa, Homo Sapiens
YELFTSLID

SEQ ID NO: 334374 - protein, 9 aa, Homo Sapiens
PDENEVQTL

SEQ ID NO: 334375 - protein, 9 aa, Homo Sapiens
KTTLTLKEM

SEQ ID NO: 334376 - protein, 9 aa, Homo Sapiens
QKYIGVKPE

SEQ ID NO: 334377 - protein, 9 aa, Homo Sapiens
RPGPLQLLG

SEQ ID NO: 334378 - protein, 9 aa, Homo Sapiens
FQVHEKIHT

SEQ ID NO: 334379 - protein, 9 aa, Homo Sapiens
RRMDTEEQK

SEQ ID NO: 334380 - protein, 9 aa, Homo Sapiens
SPIHSLETL

SEQ ID NO: 334381 - protein, 9 aa, Homo Sapiens
ETITGKVKS

SEQ ID NO: 334382 - protein, 9 aa, Homo Sapiens
KRFNLCPEV

SEQ ID NO: 334383 - protein, 9 aa, Homo Sapiens
QRDLIRQIE

SEQ ID NO: 334384 - protein, 9 aa, Homo Sapiens
ISWMGGNNP

SEQ ID NO: 334385 - protein, 9 aa, Homo Sapiens
ITHIGEKPY

SEQ ID NO: 334386 - protein, 9 aa, Homo Sapiens
QDIWPEQGI

SEQ ID NO: 334387 - protein, 9 aa, Homo Sapiens
SFVEKLNSH

SEQ ID NO: 334388 - protein, 9 aa, Homo Sapiens
YIAQRKLKK

SEQ ID NO: 334389 - protein, 9 aa, Homo Sapiens
EVKDINNNP

SEQ ID NO: 334390 - protein, 9 aa, Homo Sapiens
FCEDHDESI

SEQ ID NO: 334391 - protein, 9 aa, Homo Sapiens
KNNYNRGDI

SEQ ID NO: 334392 - protein, 9 aa, Homo Sapiens
TIFSLLKAG

SEQ ID NO: 334393 - protein, 9 aa, Homo Sapiens
LEFSLFYDQ

SEQ ID NO: 334394 - protein, 9 aa, Homo Sapiens
NTLKEVVSR

SEQ ID NO: 334395 - protein, 9 aa, Homo Sapiens
RHGQVPSSF

SEQ ID NO: 334396 - protein, 9 aa, Homo Sapiens
LEEAAKREK

SEQ ID NO: 334397 - protein, 9 aa, Homo Sapiens
IYRDRLQIN

SEQ ID NO: 334398 - protein, 9 aa, Homo Sapiens
KIDKLRTLD

SEQ ID NO: 334399 - protein, 9 aa, Homo Sapiens
DKLFNEINK

SEQ ID NO: 334400 - protein, 9 aa, Homo Sapiens
CKDTWSGCI

SEQ ID NO: 334401 - protein, 9 aa, Homo Sapiens
CQQAITSTL

SEQ ID NO: 334402 - protein, 9 aa, Homo Sapiens
ATVINEDKW

SEQ ID NO: 334403 - protein, 9 aa, Homo Sapiens
DQGKKEGDT

SEQ ID NO: 334404 - protein, 9 aa, Homo Sapiens
KLPKVKCLH

SEQ ID NO: 334405 - protein, 9 aa, Homo Sapiens
VGKARKESE

SEQ ID NO: 334406 - protein, 9 aa, Homo Sapiens
QGNLVYQIA

SEQ ID NO: 334407 - protein, 9 aa, Homo Sapiens
LVVEICACP

SEQ ID NO: 334408 - protein, 9 aa, Homo Sapiens
EQKLSQAKT

SEQ ID NO: 334409 - protein, 9 aa, Homo Sapiens
KHSTLKATI

SEQ ID NO: 334410 - protein, 9 aa, Homo Sapiens
ETSLRNSKS

SEQ ID NO: 334411 - protein, 9 aa, Homo Sapiens
PKNGGWNAP

SEQ ID NO: 334412 - protein, 9 aa, Homo Sapiens
PWTLIPEFL

SEQ ID NO: 334413 - protein, 9 aa, Homo Sapiens
TSPLQENHN

SEQ ID NO: 334414 - protein, 9 aa, Homo Sapiens
KIIQNEGIK

SEQ ID NO: 334415 - protein, 9 aa, Homo Sapiens
QVADKNDDD

SEQ ID NO: 334416 - protein, 9 aa, Homo Sapiens
GCDNPWAGG

SEQ ID NO: 334417 - protein, 9 aa, Homo Sapiens
DQKDLLGYL

SEQ ID NO: 334418 - protein, 9 aa, Homo Sapiens
VITCIVSRQ

SEQ ID NO: 334419 - protein, 9 aa, Homo Sapiens
AKERRSLLR

SEQ ID NO: 334420 - protein, 9 aa, Homo Sapiens
CAAIFHEHT

SEQ ID NO: 334421 - protein, 9 aa, Homo Sapiens
DYLLENLEK

SEQ ID NO: 334422 - protein, 9 aa, Homo Sapiens
DLSIAQQNK

SEQ ID NO: 334423 - protein, 9 aa, Homo Sapiens
LSAPPCTQC

SEQ ID NO: 334424 - protein, 9 aa, Homo Sapiens
GEYRRSLDW

SEQ ID NO: 334425 - protein, 9 aa, Homo Sapiens
GVMHYLICV

SEQ ID NO: 334426 - protein, 9 aa, Homo Sapiens
QMFIHFIEE

SEQ ID NO: 334427 - protein, 9 aa, Homo Sapiens
ADKKSSCFI

SEQ ID NO: 334428 - protein, 9 aa, Homo Sapiens
TLHQHTHTG

SEQ ID NO: 334429 - protein, 9 aa, Homo Sapiens
EKDSDGLCL

SEQ ID NO: 334430 - protein, 9 aa, Homo Sapiens
YNGGEPKHS

SEQ ID NO: 334431 - protein, 9 aa, Homo Sapiens
VLNISYNVL

SEQ ID NO: 334432 - protein, 9 aa, Homo Sapiens
VYLEQIHNR

SEQ ID NO: 334433 - protein, 9 aa, Homo Sapiens
KDNPHLIIM

SEQ ID NO: 334434 - protein, 9 aa, Homo Sapiens
MEVSIDDLK

SEQ ID NO: 334435 - protein, 9 aa, Homo Sapiens
LSRKSHLER

SEQ ID NO: 334436 - protein, 9 aa, Homo Sapiens
AGAVIIGGV

SEQ ID NO: 334437 - protein, 9 aa, Homo Sapiens
GEGSKTWDC

SEQ ID NO: 334438 - protein, 9 aa, Homo Sapiens
SPLWTSFLE

SEQ ID NO: 334439 - protein, 9 aa, Homo Sapiens
MYQPQDLLG

SEQ ID NO: 334440 - protein, 9 aa, Homo Sapiens
FGGAVAYTI

SEQ ID NO: 334441 - protein, 9 aa, Homo Sapiens
KRIKKRKGG

SEQ ID NO: 334442 - protein, 9 aa, Homo Sapiens
APQLLINLC

SEQ ID NO: 334443 - protein, 9 aa, Homo Sapiens
LIYVFQDFL

SEQ ID NO: 334444 - protein, 9 aa, Homo Sapiens
KMICHTTNL

SEQ ID NO: 334445 - protein, 9 aa, Homo Sapiens
SNDNGTNYT

SEQ ID NO: 334446 - protein, 9 aa, Homo Sapiens
IPLCEKISK

SEQ ID NO: 334447 - protein, 9 aa, Homo Sapiens
DVYLPKVEG

SEQ ID NO: 334448 - protein, 9 aa, Homo Sapiens
ELNTACRKH

SEQ ID NO: 334449 - protein, 9 aa, Homo Sapiens
PGALLKTGG

SEQ ID NO: 334450 - protein, 9 aa, Homo Sapiens
QWDKIPLSG

SEQ ID NO: 334451 - protein, 9 aa, Homo Sapiens
TREEHKKFE

SEQ ID NO: 334452 - protein, 9 aa, Homo Sapiens
QKENIPLKL

SEQ ID NO: 334453 - protein, 9 aa, Homo Sapiens
QITASLFKK

SEQ ID NO: 334454 - protein, 9 aa, Homo Sapiens
TLQSENLNL

SEQ ID NO: 334455 - protein, 9 aa, Homo Sapiens
SSYLILRNH

SEQ ID NO: 334456 - protein, 9 aa, Homo Sapiens
PKISWFNNG

SEQ ID NO: 334457 - protein, 9 aa, Homo Sapiens
HSQCQDCRD

SEQ ID NO: 334458 - protein, 9 aa, Homo Sapiens
EGRTQNHGH

SEQ ID NO: 334459 - protein, 9 aa, Homo Sapiens
QMDVREKQG

SEQ ID NO: 334460 - protein, 9 aa, Homo Sapiens
EQIIAQGDL

SEQ ID NO: 334461 - protein, 9 aa, Homo Sapiens
LGQQFRGRT

SEQ ID NO: 334462 - protein, 9 aa, Homo Sapiens
ALNTDKIKR

SEQ ID NO: 334463 - protein, 9 aa, Homo Sapiens
GSQTFDIIT

SEQ ID NO: 334464 - protein, 9 aa, Homo Sapiens
EQALKERMI

SEQ ID NO: 334465 - protein, 9 aa, Homo Sapiens
SLFVTIGDM

SEQ ID NO: 334466 - protein, 9 aa, Homo Sapiens
LHFLQQHYA

SEQ ID NO: 334467 - protein, 9 aa, Homo Sapiens
EKPKTKIYK

SEQ ID NO: 334468 - protein, 9 aa, Homo Sapiens
SLKIPKRPL

SEQ ID NO: 334469 - protein, 9 aa, Homo Sapiens
PLLYDFRWM

SEQ ID NO: 334470 - protein, 9 aa, Homo Sapiens
IGMVKVNTV

SEQ ID NO: 334471 - protein, 9 aa, Homo Sapiens
EINAAQPQC

SEQ ID NO: 334472 - protein, 9 aa, Homo Sapiens
NSDGQLDLS

SEQ ID NO: 334473 - protein, 9 aa, Homo Sapiens
IKHEMDSFN

SEQ ID NO: 334474 - protein, 9 aa, Homo Sapiens
YAAGVHNPQ

SEQ ID NO: 334475 - protein, 9 aa, Homo Sapiens
KEEEEEENV

SEQ ID NO: 334476 - protein, 9 aa, Homo Sapiens
FLNKLIKVL

SEQ ID NO: 334477 - protein, 9 aa, Homo Sapiens
LVRVTRANS

SEQ ID NO: 334478 - protein, 9 aa, Homo Sapiens
HRLPEIQQP

SEQ ID NO: 334479 - protein, 9 aa, Homo Sapiens
ITAFCLAQK

SEQ ID NO: 334480 - protein, 9 aa, Homo Sapiens
SESPLSLKR

SEQ ID NO: 334481 - protein, 9 aa, Homo Sapiens
PDITYIFTF

SEQ ID NO: 334482 - protein, 9 aa, Homo Sapiens
NSWLPPLSP

SEQ ID NO: 334483 - protein, 9 aa, Homo Sapiens
SILSTHKII

SEQ ID NO: 334484 - protein, 9 aa, Homo Sapiens
QTHTGEKPH

SEQ ID NO: 334485 - protein, 9 aa, Homo Sapiens
KEQKLLKQK

SEQ ID NO: 334486 - protein, 9 aa, Homo Sapiens
ISLWLQGLR

SEQ ID NO: 334487 - protein, 9 aa, Homo Sapiens
TQLNLITQQ

SEQ ID NO: 334488 - protein, 9 aa, Homo Sapiens
GQTTSIVTH

SEQ ID NO: 334489 - protein, 9 aa, Homo Sapiens
TELILILMC

SEQ ID NO: 334490 - protein, 9 aa, Homo Sapiens
LTSSSETSV

SEQ ID NO: 334491 - protein, 9 aa, Homo Sapiens
PAMSRLLRS

SEQ ID NO: 334492 - protein, 9 aa, Homo Sapiens
SEIETVHGF

SEQ ID NO: 334493 - protein, 9 aa, Homo Sapiens
ETREGLNMN

SEQ ID NO: 334494 - protein, 9 aa, Homo Sapiens
EGEGLRYFS

SEQ ID NO: 334495 - protein, 9 aa, Homo Sapiens
QTVVICVGC

SEQ ID NO: 334496 - protein, 9 aa, Homo Sapiens
FNRNLKTQA

SEQ ID NO: 334497 - protein, 9 aa, Homo Sapiens
LKGQAVQKQ

SEQ ID NO: 334498 - protein, 9 aa, Homo Sapiens
GERLMERYA

SEQ ID NO: 334499 - protein, 9 aa, Homo Sapiens
AQVILQWKP

SEQ ID NO: 334500 - protein, 9 aa, Homo Sapiens
DAARCSMID

SEQ ID NO: 334501 - protein, 9 aa, Homo Sapiens
EGGASIDLS

SEQ ID NO: 334502 - protein, 9 aa, Homo Sapiens
LNDDLLAQE

SEQ ID NO: 334503 - protein, 9 aa, Homo Sapiens
TETTADCRY

SEQ ID NO: 334504 - protein, 9 aa, Homo Sapiens
VSPSLDKGA

SEQ ID NO: 334505 - protein, 9 aa, Homo Sapiens
ICEDMSHTD

SEQ ID NO: 334506 - protein, 9 aa, Homo Sapiens
SMDSNVKKY

SEQ ID NO: 334507 - protein, 9 aa, Homo Sapiens
ADTEIRLGA

SEQ ID NO: 334508 - protein, 9 aa, Homo Sapiens
ISYNVLEWF

SEQ ID NO: 334509 - protein, 9 aa, Homo Sapiens
CYWPFSMDC

SEQ ID NO: 334510 - protein, 9 aa, Homo Sapiens
AAAVPKYAK

SEQ ID NO: 334511 - protein, 9 aa, Homo Sapiens
KFFGGVSGL

SEQ ID NO: 334512 - protein, 9 aa, Homo Sapiens
GNLEALRYL

SEQ ID NO: 334513 - protein, 9 aa, Homo Sapiens
PLSLLQLAS

SEQ ID NO: 334514 - protein, 9 aa, Homo Sapiens
FGWNFVFED

SEQ ID NO: 334515 - protein, 9 aa, Homo Sapiens
WDNLTILAV

SEQ ID NO: 334516 - protein, 9 aa, Homo Sapiens
YYSDTKGNV

SEQ ID NO: 334517 - protein, 9 aa, Homo Sapiens
DEEDASSKV

SEQ ID NO: 334518 - protein, 9 aa, Homo Sapiens
LEALHYCHD

SEQ ID NO: 334519 - protein, 9 aa, Homo Sapiens
ELYVFIIPF

SEQ ID NO: 334520 - protein, 9 aa, Homo Sapiens
ETFKQQKVW

SEQ ID NO: 334521 - protein, 9 aa, Homo Sapiens
IYEAKEELK

SEQ ID NO: 334522 - protein, 9 aa, Homo Sapiens
DFVYKRIVP

SEQ ID NO: 334523 - protein, 9 aa, Homo Sapiens
MKDAQDIQE

SEQ ID NO: 334524 - protein, 9 aa, Homo Sapiens
AGMLSGIFT

SEQ ID NO: 334525 - protein, 9 aa, Homo Sapiens
NKPLNAFML

SEQ ID NO: 334526 - protein, 9 aa, Homo Sapiens
KGSPKRHHK

SEQ ID NO: 334527 - protein, 9 aa, Homo Sapiens
RSGMLEMLL

SEQ ID NO: 334528 - protein, 9 aa, Homo Sapiens
MTKCSCMLT

SEQ ID NO: 334529 - protein, 9 aa, Homo Sapiens
DELHRQVRI

SEQ ID NO: 334530 - protein, 9 aa, Homo Sapiens
LVDTECCLL

SEQ ID NO: 334531 - protein, 9 aa, Homo Sapiens
VSWGSNTCS

SEQ ID NO: 334532 - protein, 9 aa, Homo Sapiens
ATRKKIIAY

SEQ ID NO: 334533 - protein, 9 aa, Homo Sapiens
HVSSLSLCD

SEQ ID NO: 334534 - protein, 9 aa, Homo Sapiens
WDCDQDKHS

SEQ ID NO: 334535 - protein, 9 aa, Homo Sapiens
DQIDSMDSN

SEQ ID NO: 334536 - protein, 9 aa, Homo Sapiens
DYEKYKENS

SEQ ID NO: 334537 - protein, 9 aa, Homo Sapiens
GVEVIVIIS

SEQ ID NO: 334538 - protein, 9 aa, Homo Sapiens
TAQANVYVT

SEQ ID NO: 334539 - protein, 9 aa, Homo Sapiens
HFLEMKLSK

SEQ ID NO: 334540 - protein, 9 aa, Homo Sapiens
INELVIFIF

SEQ ID NO: 334541 - protein, 9 aa, Homo Sapiens
DSDLSPPQR

SEQ ID NO: 334542 - protein, 9 aa, Homo Sapiens
NFKSFVEKL

SEQ ID NO: 334543 - protein, 9 aa, Homo Sapiens
QRLHSGSAS

SEQ ID NO: 334544 - protein, 9 aa, Homo Sapiens
PVYLYEFRH

SEQ ID NO: 334545 - protein, 9 aa, Homo Sapiens
FKQQKVWMA

SEQ ID NO: 334546 - protein, 9 aa, Homo Sapiens
AKVIATTVT

SEQ ID NO: 334547 - protein, 9 aa, Homo Sapiens
VPELVDFRQ

SEQ ID NO: 334548 - protein, 9 aa, Homo Sapiens
HERLLERER

SEQ ID NO: 334549 - protein, 9 aa, Homo Sapiens
SKTPKNRYR

SEQ ID NO: 334550 - protein, 9 aa, Homo Sapiens
RCANGLCKN

SEQ ID NO: 334551 - protein, 9 aa, Homo Sapiens
HRITSQINL

SEQ ID NO: 334552 - protein, 9 aa, Homo Sapiens
SRRSSSWCI

SEQ ID NO: 334553 - protein, 9 aa, Homo Sapiens
AQVIQSAKE

SEQ ID NO: 334554 - protein, 9 aa, Homo Sapiens
DLSEVVKFD

SEQ ID NO: 334555 - protein, 9 aa, Homo Sapiens
NGVAAFHTF

SEQ ID NO: 334556 - protein, 9 aa, Homo Sapiens
VFKLGLQNG

SEQ ID NO: 334557 - protein, 9 aa, Homo Sapiens
LSNVSKQTE

SEQ ID NO: 334558 - protein, 9 aa, Homo Sapiens
PEEDVTHLE

SEQ ID NO: 334559 - protein, 9 aa, Homo Sapiens
NIFKQYSHS

SEQ ID NO: 334560 - protein, 9 aa, Homo Sapiens
NEIYFTTKV

SEQ ID NO: 334561 - protein, 9 aa, Homo Sapiens
DGLEKYFYS

SEQ ID NO: 334562 - protein, 9 aa, Homo Sapiens
IWSHLELLR

SEQ ID NO: 334563 - protein, 9 aa, Homo Sapiens
TPPVLTTAK

SEQ ID NO: 334564 - protein, 9 aa, Homo Sapiens
GVWSEPSQC

SEQ ID NO: 334565 - protein, 9 aa, Homo Sapiens
AIKLAELQP

SEQ ID NO: 334566 - protein, 9 aa, Homo Sapiens
QVQSLRTAS

SEQ ID NO: 334567 - protein, 9 aa, Homo Sapiens
KDYFQKVIL

SEQ ID NO: 334568 - protein, 9 aa, Homo Sapiens
SMTRLYYWD

SEQ ID NO: 334569 - protein, 9 aa, Homo Sapiens
FINTSSLCK

SEQ ID NO: 334570 - protein, 9 aa, Homo Sapiens
AFLATDINL

SEQ ID NO: 334571 - protein, 9 aa, Homo Sapiens
AVQTTLKSA

SEQ ID NO: 334572 - protein, 9 aa, Homo Sapiens
EDSSGGEEE

SEQ ID NO: 334573 - protein, 9 aa, Homo Sapiens
EEASQNLST

SEQ ID NO: 334574 - protein, 9 aa, Homo Sapiens
ENVQPDNVI

SEQ ID NO: 334575 - protein, 9 aa, Homo Sapiens
EGWCKALPT

SEQ ID NO: 334576 - protein, 9 aa, Homo Sapiens
FDECQFDIS

SEQ ID NO: 334577 - protein, 9 aa, Homo Sapiens
GEVNSLGEI

SEQ ID NO: 334578 - protein, 9 aa, Homo Sapiens
LPPIKVMVT

SEQ ID NO: 334579 - protein, 9 aa, Homo Sapiens
TYLQIHEII

SEQ ID NO: 334580 - protein, 9 aa, Homo Sapiens
RAKIKVLKL

SEQ ID NO: 334581 - protein, 9 aa, Homo Sapiens
DSQPANRTG

SEQ ID NO: 334582 - protein, 9 aa, Homo Sapiens
HLRVNTQET

SEQ ID NO: 334583 - protein, 9 aa, Homo Sapiens
PFQNNNKWQ

SEQ ID NO: 334584 - protein, 9 aa, Homo Sapiens
HSLYLGRKE

SEQ ID NO: 334585 - protein, 9 aa, Homo Sapiens
EIIAAFDEL

SEQ ID NO: 334586 - protein, 9 aa, Homo Sapiens
NVSFYIVTL

SEQ ID NO: 334587 - protein, 9 aa, Homo Sapiens
FIMVQEERC

SEQ ID NO: 334588 - protein, 9 aa, Homo Sapiens
KQNLEKNKM

SEQ ID NO: 334589 - protein, 9 aa, Homo Sapiens
NKQEENNED

SEQ ID NO: 334590 - protein, 9 aa, Homo Sapiens
FAAGMLSGI

SEQ ID NO: 334591 - protein, 9 aa, Homo Sapiens
FIVITDFRK

SEQ ID NO: 334592 - protein, 9 aa, Homo Sapiens
VGLSSLFQR

SEQ ID NO: 334593 - protein, 9 aa, Homo Sapiens
PIRFLVVKV

SEQ ID NO: 334594 - protein, 9 aa, Homo Sapiens
LSFLIKRLP

SEQ ID NO: 334595 - protein, 9 aa, Homo Sapiens
THLCLANNP

SEQ ID NO: 334596 - protein, 9 aa, Homo Sapiens
GFDLMNRSL

SEQ ID NO: 334597 - protein, 9 aa, Homo Sapiens
LPKVKCLHN

SEQ ID NO: 334598 - protein, 9 aa, Homo Sapiens
KSSMKKLMA

SEQ ID NO: 334599 - protein, 9 aa, Homo Sapiens
FHQHQERAE

SEQ ID NO: 334600 - protein, 9 aa, Homo Sapiens
PGTSWSPPA

SEQ ID NO: 334601 - protein, 9 aa, Homo Sapiens
KKERCFTSG

SEQ ID NO: 334602 - protein, 9 aa, Homo Sapiens
NAIQVDQSG

SEQ ID NO: 334603 - protein, 9 aa, Homo Sapiens
KRLAPRHIL

SEQ ID NO: 334604 - protein, 9 aa, Homo Sapiens
ARPNIRKFI

SEQ ID NO: 334605 - protein, 9 aa, Homo Sapiens
VFAGLVDTE

SEQ ID NO: 334606 - protein, 9 aa, Homo Sapiens
KLSLCKMSD

SEQ ID NO: 334607 - protein, 9 aa, Homo Sapiens
VPQVNGEHT

SEQ ID NO: 334608 - protein, 9 aa, Homo Sapiens
GLLMLLYVI

SEQ ID NO: 334609 - protein, 9 aa, Homo Sapiens
QERRQEEHE

SEQ ID NO: 334610 - protein, 9 aa, Homo Sapiens
PKHCPVVTV

SEQ ID NO: 334611 - protein, 9 aa, Homo Sapiens
EIQTLRKRL

SEQ ID NO: 334612 - protein, 9 aa, Homo Sapiens
NPLWYPLLM

SEQ ID NO: 334613 - protein, 9 aa, Homo Sapiens
CPEQGKKTE

SEQ ID NO: 334614 - protein, 9 aa, Homo Sapiens
IEIINLAKK

SEQ ID NO: 334615 - protein, 9 aa, Homo Sapiens
EASLGIPHL

SEQ ID NO: 334616 - protein, 9 aa, Homo Sapiens
EGLNVVKMG

SEQ ID NO: 334617 - protein, 9 aa, Homo Sapiens
YINDDGLIQ

SEQ ID NO: 334618 - protein, 9 aa, Homo Sapiens
ENVSMKAPP

SEQ ID NO: 334619 - protein, 9 aa, Homo Sapiens
MLTWLVFVG

SEQ ID NO: 334620 - protein, 9 aa, Homo Sapiens
DRIHTPRAS

SEQ ID NO: 334621 - protein, 9 aa, Homo Sapiens
GPQWKKFCS

SEQ ID NO: 334622 - protein, 9 aa, Homo Sapiens
EEQQKLGNA

SEQ ID NO: 334623 - protein, 9 aa, Homo Sapiens
LMNYFSAAL

SEQ ID NO: 334624 - protein, 9 aa, Homo Sapiens
KLSQTCVMW

SEQ ID NO: 334625 - protein, 9 aa, Homo Sapiens
GGKPDSSPI

SEQ ID NO: 334626 - protein, 9 aa, Homo Sapiens
NTSQGKLLP

SEQ ID NO: 334627 - protein, 9 aa, Homo Sapiens
KLFTNAWCW

SEQ ID NO: 334628 - protein, 9 aa, Homo Sapiens
TGVNSSDPV

SEQ ID NO: 334629 - protein, 9 aa, Homo Sapiens
CSNLEGAYM

SEQ ID NO: 334630 - protein, 9 aa, Homo Sapiens
LHPGHILVQ

SEQ ID NO: 334631 - protein, 9 aa, Homo Sapiens
ENKITGIIT

SEQ ID NO: 334632 - protein, 9 aa, Homo Sapiens
GIIAILQSY

SEQ ID NO: 334633 - protein, 9 aa, Homo Sapiens
CESNANPPV

SEQ ID NO: 334634 - protein, 9 aa, Homo Sapiens
SKCLCGAAC

SEQ ID NO: 334635 - protein, 9 aa, Homo Sapiens
RDFVDFVLC

SEQ ID NO: 334636 - protein, 9 aa, Homo Sapiens
SLQLSTEGL

SEQ ID NO: 334637 - protein, 9 aa, Homo Sapiens
NLEHSPEVE

SEQ ID NO: 334638 - protein, 9 aa, Homo Sapiens
STYCWHSFE

SEQ ID NO: 334639 - protein, 9 aa, Homo Sapiens
KYTVLGRLA

SEQ ID NO: 334640 - protein, 9 aa, Homo Sapiens
ATDDYFHHK

SEQ ID NO: 334641 - protein, 9 aa, Homo Sapiens
IYRPSGANH

SEQ ID NO: 334642 - protein, 9 aa, Homo Sapiens
EKLEKQMTS

SEQ ID NO: 334643 - protein, 9 aa, Homo Sapiens
SLSHLKSEA

SEQ ID NO: 334644 - protein, 9 aa, Homo Sapiens
GSPKENTST

SEQ ID NO: 334645 - protein, 9 aa, Homo Sapiens
EGGKGPCGE

SEQ ID NO: 334646 - protein, 9 aa, Homo Sapiens
GFMCLTDQS

SEQ ID NO: 334647 - protein, 9 aa, Homo Sapiens
RFCLKGMEE

SEQ ID NO: 334648 - protein, 9 aa, Homo Sapiens
RIEIGYTYF

SEQ ID NO: 334649 - protein, 9 aa, Homo Sapiens
RRDGEADAT

SEQ ID NO: 334650 - protein, 9 aa, Homo Sapiens
IAQGDLADS

SEQ ID NO: 334651 - protein, 9 aa, Homo Sapiens
SKTQFVCIN

SEQ ID NO: 334652 - protein, 9 aa, Homo Sapiens
DPKTLKTLT

SEQ ID NO: 334653 - protein, 9 aa, Homo Sapiens
LMILLSQIE

SEQ ID NO: 334654 - protein, 9 aa, Homo Sapiens
YAAGFSQHG

SEQ ID NO: 334655 - protein, 9 aa, Homo Sapiens
VKGDVDVYL

SEQ ID NO: 334656 - protein, 9 aa, Homo Sapiens
VIPIQYYVR

SEQ ID NO: 334657 - protein, 9 aa, Homo Sapiens
VRRPDQKDL

SEQ ID NO: 334658 - protein, 9 aa, Homo Sapiens
NDQNPGFQF

SEQ ID NO: 334659 - protein, 9 aa, Homo Sapiens
EGAQFDLYK

SEQ ID NO: 334660 - protein, 9 aa, Homo Sapiens
HLQSLVIEK

SEQ ID NO: 334661 - protein, 9 aa, Homo Sapiens
YCGSQSINH

SEQ ID NO: 334662 - protein, 9 aa, Homo Sapiens
KSVDFKMPP

SEQ ID NO: 334663 - protein, 9 aa, Homo Sapiens
CDPTVHWLF

SEQ ID NO: 334664 - protein, 9 aa, Homo Sapiens
QTELLTLPR

SEQ ID NO: 334665 - protein, 9 aa, Homo Sapiens
YNNLTVVPH

SEQ ID NO: 334666 - protein, 9 aa, Homo Sapiens
KIKQAIKSL

SEQ ID NO: 334667 - protein, 9 aa, Homo Sapiens
CGNITVYET

SEQ ID NO: 334668 - protein, 9 aa, Homo Sapiens
LDEEAFADT

SEQ ID NO: 334669 - protein, 9 aa, Homo Sapiens
KNHDNSLSQ

SEQ ID NO: 334670 - protein, 9 aa, Homo Sapiens
IIFGRLEIN

SEQ ID NO: 334671 - protein, 9 aa, Homo Sapiens
YFVGCFAQM

SEQ ID NO: 334672 - protein, 9 aa, Homo Sapiens
QENSLDHSE

SEQ ID NO: 334673 - protein, 9 aa, Homo Sapiens
DCNSSPEHN

SEQ ID NO: 334674 - protein, 9 aa, Homo Sapiens
NTCTACKNQ

SEQ ID NO: 334675 - protein, 9 aa, Homo Sapiens
LVCWTIFSL

SEQ ID NO: 334676 - protein, 9 aa, Homo Sapiens
TQADRRTSG

SEQ ID NO: 334677 - protein, 9 aa, Homo Sapiens
SLKIKQVVN

SEQ ID NO: 334678 - protein, 9 aa, Homo Sapiens
LEDIKARPD

SEQ ID NO: 334679 - protein, 9 aa, Homo Sapiens
LRICSKKNE

SEQ ID NO: 334680 - protein, 9 aa, Homo Sapiens
INLPPGIRN

SEQ ID NO: 334681 - protein, 9 aa, Homo Sapiens
SLNVRAAPS

SEQ ID NO: 334682 - protein, 9 aa, Homo Sapiens
PSNPAFWWT

SEQ ID NO: 334683 - protein, 9 aa, Homo Sapiens
SPSYKFILN

SEQ ID NO: 334684 - protein, 9 aa, Homo Sapiens
RQSVREASF

SEQ ID NO: 334685 - protein, 9 aa, Homo Sapiens
FDCINCGKA

SEQ ID NO: 334686 - protein, 9 aa, Homo Sapiens
SHLMSLLEK

SEQ ID NO: 334687 - protein, 9 aa, Homo Sapiens
YKYAAGVHN

SEQ ID NO: 334688 - protein, 9 aa, Homo Sapiens
TGLQPINTH

SEQ ID NO: 334689 - protein, 9 aa, Homo Sapiens
PFHFFSLHF

SEQ ID NO: 334690 - protein, 9 aa, Homo Sapiens
QNPQMRYTL

SEQ ID NO: 334691 - protein, 9 aa, Homo Sapiens
NKLLDKAFS

SEQ ID NO: 334692 - protein, 9 aa, Homo Sapiens
VQIRSVTCA

SEQ ID NO: 334693 - protein, 9 aa, Homo Sapiens
DPRIKSRDL

SEQ ID NO: 334694 - protein, 9 aa, Homo Sapiens
EQQRYSLSH

SEQ ID NO: 334695 - protein, 9 aa, Homo Sapiens
GLSCQGPCT

SEQ ID NO: 334696 - protein, 9 aa, Homo Sapiens
SRGTPTQMF

SEQ ID NO: 334697 - protein, 9 aa, Homo Sapiens
SGFPIEDHK

SEQ ID NO: 334698 - protein, 9 aa, Homo Sapiens
PESQEDSDT

SEQ ID NO: 334699 - protein, 9 aa, Homo Sapiens
DTPKRALKM

SEQ ID NO: 334700 - protein, 9 aa, Homo Sapiens
RSRSRNIDR

SEQ ID NO: 334701 - protein, 9 aa, Homo Sapiens
HGMSYPISV

SEQ ID NO: 334702 - protein, 9 aa, Homo Sapiens
ILQDMHKTK

SEQ ID NO: 334703 - protein, 9 aa, Homo Sapiens
DKKINKIPI

SEQ ID NO: 334704 - protein, 9 aa, Homo Sapiens
SIFDISIAQ

SEQ ID NO: 334705 - protein, 9 aa, Homo Sapiens
RRQNPQMRY

SEQ ID NO: 334706 - protein, 9 aa, Homo Sapiens
LLDSPYAQV

SEQ ID NO: 334707 - protein, 9 aa, Homo Sapiens
MHWTPYRAM

SEQ ID NO: 334708 - protein, 9 aa, Homo Sapiens
EEGCYCICE

SEQ ID NO: 334709 - protein, 9 aa, Homo Sapiens
SGECQSTVS

SEQ ID NO: 334710 - protein, 9 aa, Homo Sapiens
RDHGPQSFI

SEQ ID NO: 334711 - protein, 9 aa, Homo Sapiens
IWPEQGIED

SEQ ID NO: 334712 - protein, 9 aa, Homo Sapiens
ATNYSKPQP

SEQ ID NO: 334713 - protein, 9 aa, Homo Sapiens
KYKLTGNFS

SEQ ID NO: 334714 - protein, 9 aa, Homo Sapiens
QANVYVTEN

SEQ ID NO: 334715 - protein, 9 aa, Homo Sapiens
PWNVTGNSI

SEQ ID NO: 334716 - protein, 9 aa, Homo Sapiens
ATTIIIISM

SEQ ID NO: 334717 - protein, 9 aa, Homo Sapiens
AVTEILGLV

SEQ ID NO: 334718 - protein, 9 aa, Homo Sapiens
LGLQNGKEY

SEQ ID NO: 334719 - protein, 9 aa, Homo Sapiens
HLQRLQSYS

SEQ ID NO: 334720 - protein, 9 aa, Homo Sapiens
SHAQTVVIC

SEQ ID NO: 334721 - protein, 9 aa, Homo Sapiens
NLCIRYTIM

SEQ ID NO: 334722 - protein, 9 aa, Homo Sapiens
AHLLMTNCI

SEQ ID NO: 334723 - protein, 9 aa, Homo Sapiens
TNVQLQAFD

SEQ ID NO: 334724 - protein, 9 aa, Homo Sapiens
SVFKVVPGT

SEQ ID NO: 334725 - protein, 9 aa, Homo Sapiens
GGNNPFLGI

SEQ ID NO: 334726 - protein, 9 aa, Homo Sapiens
TTYQCSRFQ

SEQ ID NO: 334727 - protein, 9 aa, Homo Sapiens
QTSFKAHIS

SEQ ID NO: 334728 - protein, 9 aa, Homo Sapiens
DFVLCDQRA

SEQ ID NO: 334729 - protein, 9 aa, Homo Sapiens
ETLLKEKGE

SEQ ID NO: 334730 - protein, 9 aa, Homo Sapiens
WSSWDYGIN

SEQ ID NO: 334731 - protein, 9 aa, Homo Sapiens
KECLQTESP

SEQ ID NO: 334732 - protein, 9 aa, Homo Sapiens
EHQKFGKAF

SEQ ID NO: 334733 - protein, 9 aa, Homo Sapiens
HLYAAILGY

SEQ ID NO: 334734 - protein, 9 aa, Homo Sapiens
IAQLVACQR

SEQ ID NO: 334735 - protein, 9 aa, Homo Sapiens
SHVRTRGTL

SEQ ID NO: 334736 - protein, 9 aa, Homo Sapiens
QIKDLRDLL

SEQ ID NO: 334737 - protein, 9 aa, Homo Sapiens
YTPVTNLTS

SEQ ID NO: 334738 - protein, 9 aa, Homo Sapiens
TDLPVKRQT

SEQ ID NO: 334739 - protein, 9 aa, Homo Sapiens
ECKVYTGGY

SEQ ID NO: 334740 - protein, 9 aa, Homo Sapiens
WNTRAKRDK

SEQ ID NO: 334741 - protein, 9 aa, Homo Sapiens
PVFSDDDSD

SEQ ID NO: 334742 - protein, 9 aa, Homo Sapiens
EHGKREPFA

SEQ ID NO: 334743 - protein, 9 aa, Homo Sapiens
AERTNNWSL

SEQ ID NO: 334744 - protein, 9 aa, Homo Sapiens
DQPPTVMFS

SEQ ID NO: 334745 - protein, 9 aa, Homo Sapiens
KSLEDKTKR

SEQ ID NO: 334746 - protein, 9 aa, Homo Sapiens
VLHFDNTYS

SEQ ID NO: 334747 - protein, 9 aa, Homo Sapiens
QYVTFLRYF

SEQ ID NO: 334748 - protein, 9 aa, Homo Sapiens
FLINFSYLL

SEQ ID NO: 334749 - protein, 9 aa, Homo Sapiens
SLCEITTTL

SEQ ID NO: 334750 - protein, 9 aa, Homo Sapiens
ASQEKKITA

SEQ ID NO: 334751 - protein, 9 aa, Homo Sapiens
QCGKSFCQS

SEQ ID NO: 334752 - protein, 9 aa, Homo Sapiens
CKFVHFLFY

SEQ ID NO: 334753 - protein, 9 aa, Homo Sapiens
AATFPSACG

SEQ ID NO: 334754 - protein, 9 aa, Homo Sapiens
KQKELGMAS

SEQ ID NO: 334755 - protein, 9 aa, Homo Sapiens
VNDGKWCHV

SEQ ID NO: 334756 - protein, 9 aa, Homo Sapiens
KPKPRSLQP

SEQ ID NO: 334757 - protein, 9 aa, Homo Sapiens
KLASDDFRN

SEQ ID NO: 334758 - protein, 9 aa, Homo Sapiens
HDDSAMNTL

SEQ ID NO: 334759 - protein, 9 aa, Homo Sapiens
CKSTPKITK

SEQ ID NO: 334760 - protein, 9 aa, Homo Sapiens
EKLYICMKC

SEQ ID NO: 334761 - protein, 9 aa, Homo Sapiens
CQSTVSISV

SEQ ID NO: 334762 - protein, 9 aa, Homo Sapiens
EIANHKGPP

SEQ ID NO: 334763 - protein, 9 aa, Homo Sapiens
AVVAKEAWD

SEQ ID NO: 334764 - protein, 9 aa, Homo Sapiens
GEQVNIPLS

SEQ ID NO: 334765 - protein, 9 aa, Homo Sapiens
LYRSRKKHL

SEQ ID NO: 334766 - protein, 9 aa, Homo Sapiens
GFMEQLCTY

SEQ ID NO: 334767 - protein, 9 aa, Homo Sapiens
ERDEKIFLL

SEQ ID NO: 334768 - protein, 9 aa, Homo Sapiens
AKLLSIVAE

SEQ ID NO: 334769 - protein, 9 aa, Homo Sapiens
NLESDNEDG

SEQ ID NO: 334770 - protein, 9 aa, Homo Sapiens
DFCQNITTR

SEQ ID NO: 334771 - protein, 9 aa, Homo Sapiens
YICVVHARV

SEQ ID NO: 334772 - protein, 9 aa, Homo Sapiens
MSPKCDGLG

SEQ ID NO: 334773 - protein, 9 aa, Homo Sapiens
KNNHKALKA

SEQ ID NO: 334774 - protein, 9 aa, Homo Sapiens
LREDKRPEG

SEQ ID NO: 334775 - protein, 9 aa, Homo Sapiens
FPNLGNTWY

SEQ ID NO: 334776 - protein, 9 aa, Homo Sapiens
RHIRNSSAR

SEQ ID NO: 334777 - protein, 9 aa, Homo Sapiens
VKKVKKAGD

SEQ ID NO: 334778 - protein, 9 aa, Homo Sapiens
AVSSSSLDA

SEQ ID NO: 334779 - protein, 9 aa, Homo Sapiens
KRAEPMESC

SEQ ID NO: 334780 - protein, 9 aa, Homo Sapiens
PDNLISREL

SEQ ID NO: 334781 - protein, 9 aa, Homo Sapiens
YDSLCTLGV

SEQ ID NO: 334782 - protein, 9 aa, Homo Sapiens
EMSHAPQSQ

SEQ ID NO: 334783 - protein, 9 aa, Homo Sapiens
EKMILSTHR

SEQ ID NO: 334784 - protein, 9 aa, Homo Sapiens
KRKDNKIRI

SEQ ID NO: 334785 - protein, 9 aa, Homo Sapiens
AVFLVPVSR

SEQ ID NO: 334786 - protein, 9 aa, Homo Sapiens
VIMTIVFDL

SEQ ID NO: 334787 - protein, 9 aa, Homo Sapiens
QLALKVIVT

SEQ ID NO: 334788 - protein, 9 aa, Homo Sapiens
GAAPIFIKL

SEQ ID NO: 334789 - protein, 9 aa, Homo Sapiens
NKRDEHPAK

SEQ ID NO: 334790 - protein, 9 aa, Homo Sapiens
DSPRGIFVV

SEQ ID NO: 334791 - protein, 9 aa, Homo Sapiens
QTRWYKDGA

SEQ ID NO: 334792 - protein, 9 aa, Homo Sapiens
DKLLGESAL

SEQ ID NO: 334793 - protein, 9 aa, Homo Sapiens
IINLAKKDL

SEQ ID NO: 334794 - protein, 9 aa, Homo Sapiens
KQTLEPTLS

SEQ ID NO: 334795 - protein, 9 aa, Homo Sapiens
IGQIELVQK

SEQ ID NO: 334796 - protein, 9 aa, Homo Sapiens
KVDARSDQT

SEQ ID NO: 334797 - protein, 9 aa, Homo Sapiens
QIGGRVKTL

SEQ ID NO: 334798 - protein, 9 aa, Homo Sapiens
SPKCQQLAN

SEQ ID NO: 334799 - protein, 9 aa, Homo Sapiens
WVIFFCLFV

SEQ ID NO: 334800 - protein, 9 aa, Homo Sapiens
TKTEKTATH

SEQ ID NO: 334801 - protein, 9 aa, Homo Sapiens
LLGRVGDCL

SEQ ID NO: 334802 - protein, 9 aa, Homo Sapiens
HKKDCPDEI

SEQ ID NO: 334803 - protein, 9 aa, Homo Sapiens
FVEKLNSHH

SEQ ID NO: 334804 - protein, 9 aa, Homo Sapiens
FSWWSFTSS

SEQ ID NO: 334805 - protein, 9 aa, Homo Sapiens
LPDWNKAGE

SEQ ID NO: 334806 - protein, 9 aa, Homo Sapiens
SSTDKKDSD

SEQ ID NO: 334807 - protein, 9 aa, Homo Sapiens
QTEYWDNVP

SEQ ID NO: 334808 - protein, 9 aa, Homo Sapiens
VTGPRNCKD

SEQ ID NO: 334809 - protein, 9 aa, Homo Sapiens
KQPRSCLFE

SEQ ID NO: 334810 - protein, 9 aa, Homo Sapiens
CRAIVYCSF

SEQ ID NO: 334811 - protein, 9 aa, Homo Sapiens
ADDNDDPPV

SEQ ID NO: 334812 - protein, 9 aa, Homo Sapiens
NTELLSITE

SEQ ID NO: 334813 - protein, 9 aa, Homo Sapiens
GCTSTSNMG

SEQ ID NO: 334814 - protein, 9 aa, Homo Sapiens
QIIVPLNNR

SEQ ID NO: 334815 - protein, 9 aa, Homo Sapiens
CINMTDTGI

SEQ ID NO: 334816 - protein, 9 aa, Homo Sapiens
TGLAIHIQN

SEQ ID NO: 334817 - protein, 9 aa, Homo Sapiens
NSGMLPNTV

SEQ ID NO: 334818 - protein, 9 aa, Homo Sapiens
KAEMSHAPQ

SEQ ID NO: 334819 - protein, 9 aa, Homo Sapiens
RVNALANNI

SEQ ID NO: 334820 - protein, 9 aa, Homo Sapiens
NSNSYLSAC

SEQ ID NO: 334821 - protein, 9 aa, Homo Sapiens
IINKWLSKS

SEQ ID NO: 334822 - protein, 9 aa, Homo Sapiens
PEVFDSLHF

SEQ ID NO: 334823 - protein, 9 aa, Homo Sapiens
KCTQDLSLM

SEQ ID NO: 334824 - protein, 9 aa, Homo Sapiens
LYHTFSAMK

SEQ ID NO: 334825 - protein, 9 aa, Homo Sapiens
LADDLAKQT

SEQ ID NO: 334826 - protein, 9 aa, Homo Sapiens
SKLVIDLGE

SEQ ID NO: 334827 - protein, 9 aa, Homo Sapiens
QLHKVREMM

SEQ ID NO: 334828 - protein, 9 aa, Homo Sapiens
LQIPQSYNV

SEQ ID NO: 334829 - protein, 9 aa, Homo Sapiens
RLKLATLLL

SEQ ID NO: 334830 - protein, 9 aa, Homo Sapiens
LAETSFLSN

SEQ ID NO: 334831 - protein, 9 aa, Homo Sapiens
QIFNPDYGM

SEQ ID NO: 334832 - protein, 9 aa, Homo Sapiens
CVKALRSWR

SEQ ID NO: 334833 - protein, 9 aa, Homo Sapiens
DLLNCFLAP

SEQ ID NO: 334834 - protein, 9 aa, Homo Sapiens
GNPVLAVVT

SEQ ID NO: 334835 - protein, 9 aa, Homo Sapiens
SVSPENNKE

SEQ ID NO: 334836 - protein, 9 aa, Homo Sapiens
EIVLSFPAG

SEQ ID NO: 334837 - protein, 9 aa, Homo Sapiens
AFPIPNSPL

SEQ ID NO: 334838 - protein, 9 aa, Homo Sapiens
NEINNVNES

SEQ ID NO: 334839 - protein, 9 aa, Homo Sapiens
TRANSCIIL

SEQ ID NO: 334840 - protein, 9 aa, Homo Sapiens
EPAQENMAY

SEQ ID NO: 334841 - protein, 9 aa, Homo Sapiens
RKFWDLEAD

SEQ ID NO: 334842 - protein, 9 aa, Homo Sapiens
RASSPSQST

SEQ ID NO: 334843 - protein, 9 aa, Homo Sapiens
YGNNSSYVH

SEQ ID NO: 334844 - protein, 9 aa, Homo Sapiens
VYLKNTTES

SEQ ID NO: 334845 - protein, 9 aa, Homo Sapiens
VHLDIEITN

SEQ ID NO: 334846 - protein, 9 aa, Homo Sapiens
PQFRLIRLC

SEQ ID NO: 334847 - protein, 9 aa, Homo Sapiens
VRKVFINTI

SEQ ID NO: 334848 - protein, 9 aa, Homo Sapiens
LDSSQGNLV

SEQ ID NO: 334849 - protein, 9 aa, Homo Sapiens
AKWMVHGYP

SEQ ID NO: 334850 - protein, 9 aa, Homo Sapiens
TITISDTNE

SEQ ID NO: 334851 - protein, 9 aa, Homo Sapiens
AGGLAMGID

SEQ ID NO: 334852 - protein, 9 aa, Homo Sapiens
KSATAIAVS

SEQ ID NO: 334853 - protein, 9 aa, Homo Sapiens
MAPISLFAI

SEQ ID NO: 334854 - protein, 9 aa, Homo Sapiens
TKNKIRSLI

SEQ ID NO: 334855 - protein, 9 aa, Homo Sapiens
LQSFDDIAC

SEQ ID NO: 334856 - protein, 9 aa, Homo Sapiens
EDNVRFEHQ

SEQ ID NO: 334857 - protein, 9 aa, Homo Sapiens
DLYGNCTMR

SEQ ID NO: 334858 - protein, 9 aa, Homo Sapiens
RRKFILASV

SEQ ID NO: 334859 - protein, 9 aa, Homo Sapiens
WLQGLRMCT

SEQ ID NO: 334860 - protein, 9 aa, Homo Sapiens
SLERLHLQS

SEQ ID NO: 334861 - protein, 9 aa, Homo Sapiens
KNGTYFQIH

SEQ ID NO: 334862 - protein, 9 aa, Homo Sapiens
KAAKGYTQF

SEQ ID NO: 334863 - protein, 9 aa, Homo Sapiens
MNVPYCGSQ

SEQ ID NO: 334864 - protein, 9 aa, Homo Sapiens
NLTTHKRTH

SEQ ID NO: 334865 - protein, 9 aa, Homo Sapiens
FIVAIFCVH

SEQ ID NO: 334866 - protein, 9 aa, Homo Sapiens
ERGNYLTRQ

SEQ ID NO: 334867 - protein, 9 aa, Homo Sapiens
GSVLQRVTR

SEQ ID NO: 334868 - protein, 9 aa, Homo Sapiens
NNQASEQNW

SEQ ID NO: 334869 - protein, 9 aa, Homo Sapiens
RVLAIVEQS

SEQ ID NO: 334870 - protein, 9 aa, Homo Sapiens
WHGDQILWG

SEQ ID NO: 334871 - protein, 9 aa, Homo Sapiens
ASLTPTFFS

SEQ ID NO: 334872 - protein, 9 aa, Homo Sapiens
VPRGEIIWS

SEQ ID NO: 334873 - protein, 9 aa, Homo Sapiens
TVLPPSLDH

SEQ ID NO: 334874 - protein, 9 aa, Homo Sapiens
RGHKSSMKK

SEQ ID NO: 334875 - protein, 9 aa, Homo Sapiens
AQKEMQTIM

SEQ ID NO: 334876 - protein, 9 aa, Homo Sapiens
YRGCEAFLR

SEQ ID NO: 334877 - protein, 9 aa, Homo Sapiens
TYVDLTNEA

SEQ ID NO: 334878 - protein, 9 aa, Homo Sapiens
SQGNLVYQI

SEQ ID NO: 334879 - protein, 9 aa, Homo Sapiens
NKFWHHFMF

SEQ ID NO: 334880 - protein, 9 aa, Homo Sapiens
PFVTTNNKE

SEQ ID NO: 334881 - protein, 9 aa, Homo Sapiens
GERFLLLFW

SEQ ID NO: 334882 - protein, 9 aa, Homo Sapiens
QSCILEPCP

SEQ ID NO: 334883 - protein, 9 aa, Homo Sapiens
GSLIQIAQA

SEQ ID NO: 334884 - protein, 9 aa, Homo Sapiens
VELRSSYFS

SEQ ID NO: 334885 - protein, 9 aa, Homo Sapiens
LDQFVQLRD

SEQ ID NO: 334886 - protein, 9 aa, Homo Sapiens
LLLTCLSID

SEQ ID NO: 334887 - protein, 9 aa, Homo Sapiens
FPIEDHKTS

SEQ ID NO: 334888 - protein, 9 aa, Homo Sapiens
KQCYWPFSM

SEQ ID NO: 334889 - protein, 9 aa, Homo Sapiens
LKDEKETLL

SEQ ID NO: 334890 - protein, 9 aa, Homo Sapiens
CCVVITPEI

SEQ ID NO: 334891 - protein, 9 aa, Homo Sapiens
SQVFSLFVH

SEQ ID NO: 334892 - protein, 9 aa, Homo Sapiens
AAEERHKSH

SEQ ID NO: 334893 - protein, 9 aa, Homo Sapiens
DYSPIRFCA

SEQ ID NO: 334894 - protein, 9 aa, Homo Sapiens
LLFVSYFHC

SEQ ID NO: 334895 - protein, 9 aa, Homo Sapiens
AKHPKYQEQ

SEQ ID NO: 334896 - protein, 9 aa, Homo Sapiens
GAFHKGVPN

SEQ ID NO: 334897 - protein, 9 aa, Homo Sapiens
WMKLDKNKR

SEQ ID NO: 334898 - protein, 9 aa, Homo Sapiens
HGDQILWGN

SEQ ID NO: 334899 - protein, 9 aa, Homo Sapiens
WCILGSKQS

SEQ ID NO: 334900 - protein, 9 aa, Homo Sapiens
VANITANLI

SEQ ID NO: 334901 - protein, 9 aa, Homo Sapiens
KIMFPDIIA

SEQ ID NO: 334902 - protein, 9 aa, Homo Sapiens
TKQFLKEIN

SEQ ID NO: 334903 - protein, 9 aa, Homo Sapiens
VRFNISTDQ

SEQ ID NO: 334904 - protein, 9 aa, Homo Sapiens
STDSSKTDK

SEQ ID NO: 334905 - protein, 9 aa, Homo Sapiens
QMDFNSKPH

SEQ ID NO: 334906 - protein, 9 aa, Homo Sapiens
KKITALEKA

SEQ ID NO: 334907 - protein, 9 aa, Homo Sapiens
TKDGFMCLT

SEQ ID NO: 334908 - protein, 9 aa, Homo Sapiens
LATPRLTLS

SEQ ID NO: 334909 - protein, 9 aa, Homo Sapiens
NLIGAQLVD

SEQ ID NO: 334910 - protein, 9 aa, Homo Sapiens
GSDPRIKSR

SEQ ID NO: 334911 - protein, 9 aa, Homo Sapiens
ISGSIINEL

SEQ ID NO: 334912 - protein, 9 aa, Homo Sapiens
ITHEIEKNH

SEQ ID NO: 334913 - protein, 9 aa, Homo Sapiens
KEARRSSFE

SEQ ID NO: 334914 - protein, 9 aa, Homo Sapiens
LVCKELRSR

SEQ ID NO: 334915 - protein, 9 aa, Homo Sapiens
AHAEVIKLQ

SEQ ID NO: 334916 - protein, 9 aa, Homo Sapiens
FWEFSMESS

SEQ ID NO: 334917 - protein, 9 aa, Homo Sapiens
GYTGEFCQS

SEQ ID NO: 334918 - protein, 9 aa, Homo Sapiens
LIDKNKQFR

SEQ ID NO: 334919 - protein, 9 aa, Homo Sapiens
KTLQADFNK

SEQ ID NO: 334920 - protein, 9 aa, Homo Sapiens
ISQVTASTS

SEQ ID NO: 334921 - protein, 9 aa, Homo Sapiens
TVCPEQGKK

SEQ ID NO: 334922 - protein, 9 aa, Homo Sapiens
QVRILQDKE

SEQ ID NO: 334923 - protein, 9 aa, Homo Sapiens
LLAILEQRF

SEQ ID NO: 334924 - protein, 9 aa, Homo Sapiens
PISQKEFVR

SEQ ID NO: 334925 - protein, 9 aa, Homo Sapiens
KSGQIFCTA

SEQ ID NO: 334926 - protein, 9 aa, Homo Sapiens
GWRGRPRGR

SEQ ID NO: 334927 - protein, 9 aa, Homo Sapiens
APYNKINQI

SEQ ID NO: 334928 - protein, 9 aa, Homo Sapiens
LPARILCGI

SEQ ID NO: 334929 - protein, 9 aa, Homo Sapiens
ANTTFCFDL

SEQ ID NO: 334930 - protein, 9 aa, Homo Sapiens
HLTLHQHTH

SEQ ID NO: 334931 - protein, 9 aa, Homo Sapiens
ELEEGCYCI

SEQ ID NO: 334932 - protein, 9 aa, Homo Sapiens
IKEENIFCD

SEQ ID NO: 334933 - protein, 9 aa, Homo Sapiens
TLRVQALDR

SEQ ID NO: 334934 - protein, 9 aa, Homo Sapiens
HLLRDTLIK

SEQ ID NO: 334935 - protein, 9 aa, Homo Sapiens
TQMFIHFIE

SEQ ID NO: 334936 - protein, 9 aa, Homo Sapiens
DLWSGAMTP

SEQ ID NO: 334937 - protein, 9 aa, Homo Sapiens
IAKRKEVIF

SEQ ID NO: 334938 - protein, 9 aa, Homo Sapiens
GRWLCSLIR

SEQ ID NO: 334939 - protein, 9 aa, Homo Sapiens
VMSVITSYT

SEQ ID NO: 334940 - protein, 9 aa, Homo Sapiens
KNIKRRTYN

SEQ ID NO: 334941 - protein, 9 aa, Homo Sapiens
VGINLVRCH

SEQ ID NO: 334942 - protein, 9 aa, Homo Sapiens
LKEEVWLQY

SEQ ID NO: 334943 - protein, 9 aa, Homo Sapiens
RVGYWPLWD

SEQ ID NO: 334944 - protein, 9 aa, Homo Sapiens
ASESQIISC

SEQ ID NO: 334945 - protein, 9 aa, Homo Sapiens
KISKIYEMR

SEQ ID NO: 334946 - protein, 9 aa, Homo Sapiens
MKNIQFPLM

SEQ ID NO: 334947 - protein, 9 aa, Homo Sapiens
SRFFYYFRG

SEQ ID NO: 334948 - protein, 9 aa, Homo Sapiens
ERVPCPVTT

SEQ ID NO: 334949 - protein, 9 aa, Homo Sapiens
DNWNWDTWD

SEQ ID NO: 334950 - protein, 9 aa, Homo Sapiens
LQFAYIDNF

SEQ ID NO: 334951 - protein, 9 aa, Homo Sapiens
VLIKLYSRS

SEQ ID NO: 334952 - protein, 9 aa, Homo Sapiens
KEGQGGAKN

SEQ ID NO: 334953 - protein, 9 aa, Homo Sapiens
REGGDESGG

SEQ ID NO: 334954 - protein, 9 aa, Homo Sapiens
KQVEQCLKC

SEQ ID NO: 334955 - protein, 9 aa, Homo Sapiens
VRYERFVKG

SEQ ID NO: 334956 - protein, 9 aa, Homo Sapiens
TEFTLKRFT

SEQ ID NO: 334957 - protein, 9 aa, Homo Sapiens
ELQHHCQVS

SEQ ID NO: 334958 - protein, 9 aa, Homo Sapiens
QLLAELNLM

SEQ ID NO: 334959 - protein, 9 aa, Homo Sapiens
SLMNSTDQE

SEQ ID NO: 334960 - protein, 9 aa, Homo Sapiens
DNHRLRNDS

SEQ ID NO: 334961 - protein, 9 aa, Homo Sapiens
AATLKHTIE

SEQ ID NO: 334962 - protein, 9 aa, Homo Sapiens
SCRLYKHLD

SEQ ID NO: 334963 - protein, 9 aa, Homo Sapiens
GAIDIPMDP

SEQ ID NO: 334964 - protein, 9 aa, Homo Sapiens
FLVPVSRRP

SEQ ID NO: 334965 - protein, 9 aa, Homo Sapiens
VRDVVSSLC

SEQ ID NO: 334966 - protein, 9 aa, Homo Sapiens
NYHRFLGRH

SEQ ID NO: 334967 - protein, 9 aa, Homo Sapiens
SIDSLKENL

SEQ ID NO: 334968 - protein, 9 aa, Homo Sapiens
NVLTLKEEE

SEQ ID NO: 334969 - protein, 9 aa, Homo Sapiens
PFILKPSVK

SEQ ID NO: 334970 - protein, 9 aa, Homo Sapiens
ILHLKQFGN

SEQ ID NO: 334971 - protein, 9 aa, Homo Sapiens
HTGEKPYVG

SEQ ID NO: 334972 - protein, 9 aa, Homo Sapiens
INQVAHDQA

SEQ ID NO: 334973 - protein, 9 aa, Homo Sapiens
DQTVIHKGP

SEQ ID NO: 334974 - protein, 9 aa, Homo Sapiens
LLKKMQFLW

SEQ ID NO: 334975 - protein, 9 aa, Homo Sapiens
LCTVLDQPI

SEQ ID NO: 334976 - protein, 9 aa, Homo Sapiens
KYLAEEDDI

SEQ ID NO: 334977 - protein, 9 aa, Homo Sapiens
ALNRTNHPP

SEQ ID NO: 334978 - protein, 9 aa, Homo Sapiens
CIDCGKSFC

SEQ ID NO: 334979 - protein, 9 aa, Homo Sapiens
IFKELTRDF

SEQ ID NO: 334980 - protein, 9 aa, Homo Sapiens
FIDEIYSIC

SEQ ID NO: 334981 - protein, 9 aa, Homo Sapiens
VTQPSNTCE

SEQ ID NO: 334982 - protein, 9 aa, Homo Sapiens
IFSFRSSFR

SEQ ID NO: 334983 - protein, 9 aa, Homo Sapiens
AVLEKHVEL

SEQ ID NO: 334984 - protein, 9 aa, Homo Sapiens
DMFAKLKDK

SEQ ID NO: 334985 - protein, 9 aa, Homo Sapiens
KSIARVFTV

SEQ ID NO: 334986 - protein, 9 aa, Homo Sapiens
MLAVGVGNA

SEQ ID NO: 334987 - protein, 9 aa, Homo Sapiens
LDFNGNEDI

SEQ ID NO: 334988 - protein, 9 aa, Homo Sapiens
LKKQRFYQL

SEQ ID NO: 334989 - protein, 9 aa, Homo Sapiens
ENQATKDKR

SEQ ID NO: 334990 - protein, 9 aa, Homo Sapiens
ASQNLSTPP

SEQ ID NO: 334991 - protein, 9 aa, Homo Sapiens
QERCKEAER

SEQ ID NO: 334992 - protein, 9 aa, Homo Sapiens
ITPLPGLPG

SEQ ID NO: 334993 - protein, 9 aa, Homo Sapiens
NDTAPSELS

SEQ ID NO: 334994 - protein, 9 aa, Homo Sapiens
LSFSRYPKG

SEQ ID NO: 334995 - protein, 9 aa, Homo Sapiens
LKKFLKSKG

SEQ ID NO: 334996 - protein, 9 aa, Homo Sapiens
MRNHTGEKP

SEQ ID NO: 334997 - protein, 9 aa, Homo Sapiens
FQENSLDHS

SEQ ID NO: 334998 - protein, 9 aa, Homo Sapiens
LLSQIEERK

SEQ ID NO: 334999 - protein, 9 aa, Homo Sapiens
LHYFRNRHP

SEQ ID NO: 335000 - protein, 9 aa, Homo Sapiens
QAKIQDYHI

SEQ ID NO: 335001 - protein, 9 aa, Homo Sapiens
QGHDAPVLS

SEQ ID NO: 335002 - protein, 9 aa, Homo Sapiens
IQHLPLSEC

SEQ ID NO: 335003 - protein, 9 aa, Homo Sapiens
IAAFLQPIQ

SEQ ID NO: 335004 - protein, 9 aa, Homo Sapiens
ECKEYQFRC

SEQ ID NO: 335005 - protein, 9 aa, Homo Sapiens
KKATVNSPA

SEQ ID NO: 335006 - protein, 9 aa, Homo Sapiens
LLLGRVGDC

SEQ ID NO: 335007 - protein, 9 aa, Homo Sapiens
EPQTLVTEL

SEQ ID NO: 335008 - protein, 9 aa, Homo Sapiens
DNGSWEVIE

SEQ ID NO: 335009 - protein, 9 aa, Homo Sapiens
THPNSFWLG

SEQ ID NO: 335010 - protein, 9 aa, Homo Sapiens
GWHPHEPIT

SEQ ID NO: 335011 - protein, 9 aa, Homo Sapiens
KDDEENYWD

SEQ ID NO: 335012 - protein, 9 aa, Homo Sapiens
QHNKDITLE

SEQ ID NO: 335013 - protein, 9 aa, Homo Sapiens
DESICLICS

SEQ ID NO: 335014 - protein, 9 aa, Homo Sapiens
MFTRKFVFQ

SEQ ID NO: 335015 - protein, 9 aa, Homo Sapiens
EALSNKALK

SEQ ID NO: 335016 - protein, 9 aa, Homo Sapiens
HHILKANAQ

SEQ ID NO: 335017 - protein, 9 aa, Homo Sapiens
NDLLRKGVE

SEQ ID NO: 335018 - protein, 9 aa, Homo Sapiens
PVSEYKIQG

SEQ ID NO: 335019 - protein, 9 aa, Homo Sapiens
YCCHCRNIV

SEQ ID NO: 335020 - protein, 9 aa, Homo Sapiens
LKKMQFLWE

SEQ ID NO: 335021 - protein, 9 aa, Homo Sapiens
ALRDRLLVF

SEQ ID NO: 335022 - protein, 9 aa, Homo Sapiens
IIGFDTGDA

SEQ ID NO: 335023 - protein, 9 aa, Homo Sapiens
NTVLPPSLD

SEQ ID NO: 335024 - protein, 9 aa, Homo Sapiens
KDEINIPRC

SEQ ID NO: 335025 - protein, 9 aa, Homo Sapiens
ANNILVRVT

SEQ ID NO: 335026 - protein, 9 aa, Homo Sapiens
GSYTEGNAS

SEQ ID NO: 335027 - protein, 9 aa, Homo Sapiens
TAFSAFQQI

SEQ ID NO: 335028 - protein, 9 aa, Homo Sapiens
VPQQWVTGA

SEQ ID NO: 335029 - protein, 9 aa, Homo Sapiens
HLCLANNPI

SEQ ID NO: 335030 - protein, 9 aa, Homo Sapiens
CGETGPAGR

SEQ ID NO: 335031 - protein, 9 aa, Homo Sapiens
CSPATPAEV

SEQ ID NO: 335032 - protein, 9 aa, Homo Sapiens
HNLLLLQTA

SEQ ID NO: 335033 - protein, 9 aa, Homo Sapiens
NCKQDWSDH

SEQ ID NO: 335034 - protein, 9 aa, Homo Sapiens
NAGATQSNI

SEQ ID NO: 335035 - protein, 9 aa, Homo Sapiens
DIKARPDMQ

SEQ ID NO: 335036 - protein, 9 aa, Homo Sapiens
REHSSHKLY

SEQ ID NO: 335037 - protein, 9 aa, Homo Sapiens
ELIVDVNKP

SEQ ID NO: 335038 - protein, 9 aa, Homo Sapiens
LDNVFRQLD

SEQ ID NO: 335039 - protein, 9 aa, Homo Sapiens
PTVRSTQIV

SEQ ID NO: 335040 - protein, 9 aa, Homo Sapiens
FRKQIHNLE

SEQ ID NO: 335041 - protein, 9 aa, Homo Sapiens
AAIVGSVKL

SEQ ID NO: 335042 - protein, 9 aa, Homo Sapiens
IKYLVEITL

SEQ ID NO: 335043 - protein, 9 aa, Homo Sapiens
HIIVVSIIF

SEQ ID NO: 335044 - protein, 9 aa, Homo Sapiens
TKKFTLTEQ

SEQ ID NO: 335045 - protein, 9 aa, Homo Sapiens
SEISRIKTL

SEQ ID NO: 335046 - protein, 9 aa, Homo Sapiens
YQEALAKGN

SEQ ID NO: 335047 - protein, 9 aa, Homo Sapiens
VVDSRLKKT

SEQ ID NO: 335048 - protein, 9 aa, Homo Sapiens
NSEGKFDKD

SEQ ID NO: 335049 - protein, 9 aa, Homo Sapiens
TLKRFNLCP

SEQ ID NO: 335050 - protein, 9 aa, Homo Sapiens
TTSLPVTAA

SEQ ID NO: 335051 - protein, 9 aa, Homo Sapiens
LSMNLESDN

SEQ ID NO: 335052 - protein, 9 aa, Homo Sapiens
EKLALYIYE

SEQ ID NO: 335053 - protein, 9 aa, Homo Sapiens
NPNLKTLFS

SEQ ID NO: 335054 - protein, 9 aa, Homo Sapiens
PRTRKEIFK

SEQ ID NO: 335055 - protein, 9 aa, Homo Sapiens
EVAEQFLRV

SEQ ID NO: 335056 - protein, 9 aa, Homo Sapiens
KMSVAPGLA

SEQ ID NO: 335057 - protein, 9 aa, Homo Sapiens
SVELRGKSA

SEQ ID NO: 335058 - protein, 9 aa, Homo Sapiens
NQLLIVAEG

SEQ ID NO: 335059 - protein, 9 aa, Homo Sapiens
GLQIRVPPV

SEQ ID NO: 335060 - protein, 9 aa, Homo Sapiens
DGKSEQSDL

SEQ ID NO: 335061 - protein, 9 aa, Homo Sapiens
EDIWTRGVE

SEQ ID NO: 335062 - protein, 9 aa, Homo Sapiens
MTVGPHQRP

SEQ ID NO: 335063 - protein, 9 aa, Homo Sapiens
ENKLLPLHR

SEQ ID NO: 335064 - protein, 9 aa, Homo Sapiens
TVKHNQNHV

SEQ ID NO: 335065 - protein, 9 aa, Homo Sapiens
LSVFCDCEI

SEQ ID NO: 335066 - protein, 9 aa, Homo Sapiens
GSVHSIKFH

SEQ ID NO: 335067 - protein, 9 aa, Homo Sapiens
RQKRNNRRK

SEQ ID NO: 335068 - protein, 9 aa, Homo Sapiens
VSLSNTAVY

SEQ ID NO: 335069 - protein, 9 aa, Homo Sapiens
KLFQWLGKA

SEQ ID NO: 335070 - protein, 9 aa, Homo Sapiens
FTQPEYRAS

SEQ ID NO: 335071 - protein, 9 aa, Homo Sapiens
PWASTFPPH

SEQ ID NO: 335072 - protein, 9 aa, Homo Sapiens
VLNRPSSIQ

SEQ ID NO: 335073 - protein, 9 aa, Homo Sapiens
LLGVLPYFW

SEQ ID NO: 335074 - protein, 9 aa, Homo Sapiens
LTSCIIRLL

SEQ ID NO: 335075 - protein, 9 aa, Homo Sapiens
CYDSDRYRD

SEQ ID NO: 335076 - protein, 9 aa, Homo Sapiens
RGFPFHTPL

SEQ ID NO: 335077 - protein, 9 aa, Homo Sapiens
KNLPVQPVT

SEQ ID NO: 335078 - protein, 9 aa, Homo Sapiens
CLLLASKQL

SEQ ID NO: 335079 - protein, 9 aa, Homo Sapiens
SVQFDPFNF

SEQ ID NO: 335080 - protein, 9 aa, Homo Sapiens
RTLNNSRLV

SEQ ID NO: 335081 - protein, 9 aa, Homo Sapiens
VLFTGILYV

SEQ ID NO: 335082 - protein, 9 aa, Homo Sapiens
SIRKDLIQH

SEQ ID NO: 335083 - protein, 9 aa, Homo Sapiens
TIILSFPTK

SEQ ID NO: 335084 - protein, 9 aa, Homo Sapiens
ELSRSGMLE

SEQ ID NO: 335085 - protein, 9 aa, Homo Sapiens
SSCFKYQKL

SEQ ID NO: 335086 - protein, 9 aa, Homo Sapiens
MKALSHLST

SEQ ID NO: 335087 - protein, 9 aa, Homo Sapiens
QRINENVLG

SEQ ID NO: 335088 - protein, 9 aa, Homo Sapiens
GWRKCCLYL

SEQ ID NO: 335089 - protein, 9 aa, Homo Sapiens
ILGLIIVQR

SEQ ID NO: 335090 - protein, 9 aa, Homo Sapiens
ECALKFPNC

SEQ ID NO: 335091 - protein, 9 aa, Homo Sapiens
NKPLSCVVF

SEQ ID NO: 335092 - protein, 9 aa, Homo Sapiens
GKHQGSLVL

SEQ ID NO: 335093 - protein, 9 aa, Homo Sapiens
EQSFEILTE

SEQ ID NO: 335094 - protein, 9 aa, Homo Sapiens
GNLKPQAKL

SEQ ID NO: 335095 - protein, 9 aa, Homo Sapiens
LSLKRPKTA

SEQ ID NO: 335096 - protein, 9 aa, Homo Sapiens
IRFLVVKVS

SEQ ID NO: 335097 - protein, 9 aa, Homo Sapiens
SLPRVSLSN

SEQ ID NO: 335098 - protein, 9 aa, Homo Sapiens
FNGILYYYQ

SEQ ID NO: 335099 - protein, 9 aa, Homo Sapiens
DLLDKFCTK

SEQ ID NO: 335100 - protein, 9 aa, Homo Sapiens
TQPEYRASV

SEQ ID NO: 335101 - protein, 9 aa, Homo Sapiens
WYHNYGHLE

SEQ ID NO: 335102 - protein, 9 aa, Homo Sapiens
PGFRISFST

SEQ ID NO: 335103 - protein, 9 aa, Homo Sapiens
NLIQQISSG

SEQ ID NO: 335104 - protein, 9 aa, Homo Sapiens
NLRSLEEEK

SEQ ID NO: 335105 - protein, 9 aa, Homo Sapiens
SEYINLDIK

SEQ ID NO: 335106 - protein, 9 aa, Homo Sapiens
DHKNLIQQI

SEQ ID NO: 335107 - protein, 9 aa, Homo Sapiens
LTKRRHAEL

SEQ ID NO: 335108 - protein, 9 aa, Homo Sapiens
KQCLKMLET

SEQ ID NO: 335109 - protein, 9 aa, Homo Sapiens
CVKNGIQRS

SEQ ID NO: 335110 - protein, 9 aa, Homo Sapiens
KPLEKETFQ

SEQ ID NO: 335111 - protein, 9 aa, Homo Sapiens
KLWLQYTQK

SEQ ID NO: 335112 - protein, 9 aa, Homo Sapiens
YHFYLSFEN

SEQ ID NO: 335113 - protein, 9 aa, Homo Sapiens
IHILQKHGK

SEQ ID NO: 335114 - protein, 9 aa, Homo Sapiens
CSEVGEIDA

SEQ ID NO: 335115 - protein, 9 aa, Homo Sapiens
KALYDICSR

SEQ ID NO: 335116 - protein, 9 aa, Homo Sapiens
GSIINELIG

SEQ ID NO: 335117 - protein, 9 aa, Homo Sapiens
ELWFHNQRH

SEQ ID NO: 335118 - protein, 9 aa, Homo Sapiens
ERPRYLDIP

SEQ ID NO: 335119 - protein, 9 aa, Homo Sapiens
LRWLKRDSY

SEQ ID NO: 335120 - protein, 9 aa, Homo Sapiens
IQRTLRNFI

SEQ ID NO: 335121 - protein, 9 aa, Homo Sapiens
GKERKQTPK

SEQ ID NO: 335122 - protein, 9 aa, Homo Sapiens
LIMFRGEVR

SEQ ID NO: 335123 - protein, 9 aa, Homo Sapiens
TQFQLELIK

SEQ ID NO: 335124 - protein, 9 aa, Homo Sapiens
SVEIQITLN

SEQ ID NO: 335125 - protein, 9 aa, Homo Sapiens
TVAQYHFYL

SEQ ID NO: 335126 - protein, 9 aa, Homo Sapiens
HLALIIIIL

SEQ ID NO: 335127 - protein, 9 aa, Homo Sapiens
GKYLEQQCN

SEQ ID NO: 335128 - protein, 9 aa, Homo Sapiens
EDNWDNDNV

SEQ ID NO: 335129 - protein, 9 aa, Homo Sapiens
DFNKSVDFK

SEQ ID NO: 335130 - protein, 9 aa, Homo Sapiens
PRALVLKAV

SEQ ID NO: 335131 - protein, 9 aa, Homo Sapiens
PNEWYLNRL

SEQ ID NO: 335132 - protein, 9 aa, Homo Sapiens
WHFSQGFPV

SEQ ID NO: 335133 - protein, 9 aa, Homo Sapiens
KHLCVWISF

SEQ ID NO: 335134 - protein, 9 aa, Homo Sapiens
LDKAFSISQ

SEQ ID NO: 335135 - protein, 9 aa, Homo Sapiens
EYIDIGTLN

SEQ ID NO: 335136 - protein, 9 aa, Homo Sapiens
WQAMQEWQH

SEQ ID NO: 335137 - protein, 9 aa, Homo Sapiens
RTHSKEVNI

SEQ ID NO: 335138 - protein, 9 aa, Homo Sapiens
TQMICQQHQ

SEQ ID NO: 335139 - protein, 9 aa, Homo Sapiens
VDVVDQCLA

SEQ ID NO: 335140 - protein, 9 aa, Homo Sapiens
VAETVLALE

SEQ ID NO: 335141 - protein, 9 aa, Homo Sapiens
EDNWQLSQF

SEQ ID NO: 335142 - protein, 9 aa, Homo Sapiens
FLKSKGYDF

SEQ ID NO: 335143 - protein, 9 aa, Homo Sapiens
ELNAGDVVM

SEQ ID NO: 335144 - protein, 9 aa, Homo Sapiens
GIICFLLIA

SEQ ID NO: 335145 - protein, 9 aa, Homo Sapiens
TITCVALAI

SEQ ID NO: 335146 - protein, 9 aa, Homo Sapiens
IQRINENVL

SEQ ID NO: 335147 - protein, 9 aa, Homo Sapiens
TTRDAVKLH

SEQ ID NO: 335148 - protein, 9 aa, Homo Sapiens
ELERLRSKN

SEQ ID NO: 335149 - protein, 9 aa, Homo Sapiens
DRTTELSEL

SEQ ID NO: 335150 - protein, 9 aa, Homo Sapiens
GDPEESQRQ

SEQ ID NO: 335151 - protein, 9 aa, Homo Sapiens
IEGAPYPQT

SEQ ID NO: 335152 - protein, 9 aa, Homo Sapiens
DTLLYQKHN

SEQ ID NO: 335153 - protein, 9 aa, Homo Sapiens
LLIWMSKRY

SEQ ID NO: 335154 - protein, 9 aa, Homo Sapiens
ELTEMQNDL

SEQ ID NO: 335155 - protein, 9 aa, Homo Sapiens
DCLRWLKRD

SEQ ID NO: 335156 - protein, 9 aa, Homo Sapiens
CQRTHFVIS

SEQ ID NO: 335157 - protein, 9 aa, Homo Sapiens
KFQGAFHKG

SEQ ID NO: 335158 - protein, 9 aa, Homo Sapiens
GGRGHPRGQ

SEQ ID NO: 335159 - protein, 9 aa, Homo Sapiens
EKIWDPAHR

SEQ ID NO: 335160 - protein, 9 aa, Homo Sapiens
KSSGVKLTH

SEQ ID NO: 335161 - protein, 9 aa, Homo Sapiens
CLISFLLLL

SEQ ID NO: 335162 - protein, 9 aa, Homo Sapiens
SPAAECIRF

SEQ ID NO: 335163 - protein, 9 aa, Homo Sapiens
FPQEVAEQF

SEQ ID NO: 335164 - protein, 9 aa, Homo Sapiens
QSLRHSPKR

SEQ ID NO: 335165 - protein, 9 aa, Homo Sapiens
TFWSNDNGT

SEQ ID NO: 335166 - protein, 9 aa, Homo Sapiens
QNDAPVPYK

SEQ ID NO: 335167 - protein, 9 aa, Homo Sapiens
RMCSRPKSN

SEQ ID NO: 335168 - protein, 9 aa, Homo Sapiens
AGHNIDTCC

SEQ ID NO: 335169 - protein, 9 aa, Homo Sapiens
QQQKVVSVS

SEQ ID NO: 335170 - protein, 9 aa, Homo Sapiens
HVTGSKTTN

SEQ ID NO: 335171 - protein, 9 aa, Homo Sapiens
NPPLQRLSS

SEQ ID NO: 335172 - protein, 9 aa, Homo Sapiens
SWGSNTCST

SEQ ID NO: 335173 - protein, 9 aa, Homo Sapiens
ELFWGLRSY

SEQ ID NO: 335174 - protein, 9 aa, Homo Sapiens
TYSTLNSSK

SEQ ID NO: 335175 - protein, 9 aa, Homo Sapiens
SLQPPSRQA

SEQ ID NO: 335176 - protein, 9 aa, Homo Sapiens
FQLLLTEVN

SEQ ID NO: 335177 - protein, 9 aa, Homo Sapiens
LNRPSSIQK

SEQ ID NO: 335178 - protein, 9 aa, Homo Sapiens
ATKTIKPSV

SEQ ID NO: 335179 - protein, 9 aa, Homo Sapiens
NLSEVGFPD

SEQ ID NO: 335180 - protein, 9 aa, Homo Sapiens
HHKNVRITA

SEQ ID NO: 335181 - protein, 9 aa, Homo Sapiens
DKEEVEEDG

SEQ ID NO: 335182 - protein, 9 aa, Homo Sapiens
YQGPTKMTT

SEQ ID NO: 335183 - protein, 9 aa, Homo Sapiens
QGFLKSREH

SEQ ID NO: 335184 - protein, 9 aa, Homo Sapiens
LKNAMRATV

SEQ ID NO: 335185 - protein, 9 aa, Homo Sapiens
TYSQIGGRV

SEQ ID NO: 335186 - protein, 9 aa, Homo Sapiens
CRFGSVPHG

SEQ ID NO: 335187 - protein, 9 aa, Homo Sapiens
LKLNAFKAS

SEQ ID NO: 335188 - protein, 9 aa, Homo Sapiens
SFHQHQERA

SEQ ID NO: 335189 - protein, 9 aa, Homo Sapiens
LQPGYIRSH

SEQ ID NO: 335190 - protein, 9 aa, Homo Sapiens
IHSKDGLLQ

SEQ ID NO: 335191 - protein, 9 aa, Homo Sapiens
IPEDNFLAA

SEQ ID NO: 335192 - protein, 9 aa, Homo Sapiens
EFDNATEAS

SEQ ID NO: 335193 - protein, 9 aa, Homo Sapiens
YFSSSKRMN

SEQ ID NO: 335194 - protein, 9 aa, Homo Sapiens
HSEHERQYL

SEQ ID NO: 335195 - protein, 9 aa, Homo Sapiens
RSDRRGAEL

SEQ ID NO: 335196 - protein, 9 aa, Homo Sapiens
VQALDRRTG

SEQ ID NO: 335197 - protein, 9 aa, Homo Sapiens
FVFSLAAVN

SEQ ID NO: 335198 - protein, 9 aa, Homo Sapiens
MKLDEGTSV

SEQ ID NO: 335199 - protein, 9 aa, Homo Sapiens
TWDKKGMDR

SEQ ID NO: 335200 - protein, 9 aa, Homo Sapiens
QKCELCHKP

SEQ ID NO: 335201 - protein, 9 aa, Homo Sapiens
EGLSEEVTF

SEQ ID NO: 335202 - protein, 9 aa, Homo Sapiens
VWGVKCEAC

SEQ ID NO: 335203 - protein, 9 aa, Homo Sapiens
LVRILRTVP

SEQ ID NO: 335204 - protein, 9 aa, Homo Sapiens
DKHLMSSIL

SEQ ID NO: 335205 - protein, 9 aa, Homo Sapiens
RRSSSWCIL

SEQ ID NO: 335206 - protein, 9 aa, Homo Sapiens
PLPAAPVTG

SEQ ID NO: 335207 - protein, 9 aa, Homo Sapiens
PVLAVVTCN

SEQ ID NO: 335208 - protein, 9 aa, Homo Sapiens
KNNQIENYK

SEQ ID NO: 335209 - protein, 9 aa, Homo Sapiens
DQTGEVIFK

SEQ ID NO: 335210 - protein, 9 aa, Homo Sapiens
KGTFPHHGI

SEQ ID NO: 335211 - protein, 9 aa, Homo Sapiens
QKQLWDVAH

SEQ ID NO: 335212 - protein, 9 aa, Homo Sapiens
HINKPLNAF

SEQ ID NO: 335213 - protein, 9 aa, Homo Sapiens
WKERTASGI

SEQ ID NO: 335214 - protein, 9 aa, Homo Sapiens
ELALGQYHQ

SEQ ID NO: 335215 - protein, 9 aa, Homo Sapiens
FWVIFFCLF

SEQ ID NO: 335216 - protein, 9 aa, Homo Sapiens
LSTEGLITL

SEQ ID NO: 335217 - protein, 9 aa, Homo Sapiens
WVTGAICVN

SEQ ID NO: 335218 - protein, 9 aa, Homo Sapiens
PDSRCPSEI

SEQ ID NO: 335219 - protein, 9 aa, Homo Sapiens
HQNRVFHDF

SEQ ID NO: 335220 - protein, 9 aa, Homo Sapiens
KQSGRGQRI

SEQ ID NO: 335221 - protein, 9 aa, Homo Sapiens
YSADIIFLI

SEQ ID NO: 335222 - protein, 9 aa, Homo Sapiens
DNNGNVILR

SEQ ID NO: 335223 - protein, 9 aa, Homo Sapiens
SCGGCDTEI

SEQ ID NO: 335224 - protein, 9 aa, Homo Sapiens
FEFLEKEAT

SEQ ID NO: 335225 - protein, 9 aa, Homo Sapiens
KFVHFLFYW

SEQ ID NO: 335226 - protein, 9 aa, Homo Sapiens
SLQVSPSLD

SEQ ID NO: 335227 - protein, 9 aa, Homo Sapiens
FCERGKFQP

SEQ ID NO: 335228 - protein, 9 aa, Homo Sapiens
NFPQFPDTL

SEQ ID NO: 335229 - protein, 9 aa, Homo Sapiens
FGSSGNLAN

SEQ ID NO: 335230 - protein, 9 aa, Homo Sapiens
VPTIQSDIP

SEQ ID NO: 335231 - protein, 9 aa, Homo Sapiens
GKLSQTCVM

SEQ ID NO: 335232 - protein, 9 aa, Homo Sapiens
NLVYQIAMV

SEQ ID NO: 335233 - protein, 9 aa, Homo Sapiens
HKKFENLNS

SEQ ID NO: 335234 - protein, 9 aa, Homo Sapiens
SGQLHKVRE

SEQ ID NO: 335235 - protein, 9 aa, Homo Sapiens
SAGQFFTSL

SEQ ID NO: 335236 - protein, 9 aa, Homo Sapiens
PPVASTLSR

SEQ ID NO: 335237 - protein, 9 aa, Homo Sapiens
NQTIEKVSF

SEQ ID NO: 335238 - protein, 9 aa, Homo Sapiens
VREKQGQQM

SEQ ID NO: 335239 - protein, 9 aa, Homo Sapiens
CDKAEFFSF

SEQ ID NO: 335240 - protein, 9 aa, Homo Sapiens
EKNHPRVYQ

SEQ ID NO: 335241 - protein, 9 aa, Homo Sapiens
LATNNSKWV

SEQ ID NO: 335242 - protein, 9 aa, Homo Sapiens
RIGLAEEIC

SEQ ID NO: 335243 - protein, 9 aa, Homo Sapiens
WLKKKHQLL

SEQ ID NO: 335244 - protein, 9 aa, Homo Sapiens
DNAWWVGYE

SEQ ID NO: 335245 - protein, 9 aa, Homo Sapiens
NIPRCSCSL

SEQ ID NO: 335246 - protein, 9 aa, Homo Sapiens
DGAYTVHPS

SEQ ID NO: 335247 - protein, 9 aa, Homo Sapiens
YYVREFVLR

SEQ ID NO: 335248 - protein, 8 aa, Homo Sapiens
NSHFRFVL

SEQ ID NO: 335249 - protein, 9 aa, Homo Sapiens
GRVECGKAF

SEQ ID NO: 335250 - protein, 9 aa, Homo Sapiens
NFEIKNVPF

SEQ ID NO: 335251 - protein, 9 aa, Homo Sapiens
EAIFSNAYT

SEQ ID NO: 335252 - protein, 9 aa, Homo Sapiens
RADEALNTD

SEQ ID NO: 335253 - protein, 9 aa, Homo Sapiens
KTDIFQDVK

SEQ ID NO: 335254 - protein, 9 aa, Homo Sapiens
EVVGINDNA

SEQ ID NO: 335255 - protein, 9 aa, Homo Sapiens
TDALLGKAT

SEQ ID NO: 335256 - protein, 9 aa, Homo Sapiens
GPDLITVTK

SEQ ID NO: 335257 - protein, 9 aa, Homo Sapiens
KPKKKNNIS

SEQ ID NO: 335258 - protein, 9 aa, Homo Sapiens
TQILGKKPW

SEQ ID NO: 335259 - protein, 9 aa, Homo Sapiens
GNQADLSKD

SEQ ID NO: 335260 - protein, 9 aa, Homo Sapiens
IVECTFTKM

SEQ ID NO: 335261 - protein, 9 aa, Homo Sapiens
GKDLEVEQA

SEQ ID NO: 335262 - protein, 9 aa, Homo Sapiens
PQEATNYSK

SEQ ID NO: 335263 - protein, 9 aa, Homo Sapiens
VEKKPEAAA

SEQ ID NO: 335264 - protein, 9 aa, Homo Sapiens
DWFYTIVYP

SEQ ID NO: 335265 - protein, 9 aa, Homo Sapiens
EQNSTENNC

SEQ ID NO: 335266 - protein, 9 aa, Homo Sapiens
AGYVPIQTP

SEQ ID NO: 335267 - protein, 9 aa, Homo Sapiens
IQIHGRTHT

SEQ ID NO: 335268 - protein, 9 aa, Homo Sapiens
LIFKKGSRN

SEQ ID NO: 335269 - protein, 9 aa, Homo Sapiens
EGEVGEDGD

SEQ ID NO: 335270 - protein, 9 aa, Homo Sapiens
RPGEYRRSL

SEQ ID NO: 335271 - protein, 9 aa, Homo Sapiens
EYLNISFNI

SEQ ID NO: 335272 - protein, 9 aa, Homo Sapiens
SYFICHRDL

SEQ ID NO: 335273 - protein, 9 aa, Homo Sapiens
TEACVDYMG

SEQ ID NO: 335274 - protein, 9 aa, Homo Sapiens
MILLHIRKF

SEQ ID NO: 335275 - protein, 9 aa, Homo Sapiens
PTKSPDYLE

SEQ ID NO: 335276 - protein, 9 aa, Homo Sapiens
YAINLPVSV

SEQ ID NO: 335277 - protein, 9 aa, Homo Sapiens
AIATIKTKH

SEQ ID NO: 335278 - protein, 9 aa, Homo Sapiens
NGTSVYYIT

SEQ ID NO: 335279 - protein, 9 aa, Homo Sapiens
FFYYFRGVE

SEQ ID NO: 335280 - protein, 9 aa, Homo Sapiens
IVIFCGYKI

SEQ ID NO: 335281 - protein, 9 aa, Homo Sapiens
SDAEQRGKN

SEQ ID NO: 335282 - protein, 9 aa, Homo Sapiens
LKGQGEKIA

SEQ ID NO: 335283 - protein, 9 aa, Homo Sapiens
CQNAREMTL

SEQ ID NO: 335284 - protein, 9 aa, Homo Sapiens
CYSLKCNLD

SEQ ID NO: 335285 - protein, 9 aa, Homo Sapiens
LSDWIFTLY

SEQ ID NO: 335286 - protein, 9 aa, Homo Sapiens
LHIGISFVK

SEQ ID NO: 335287 - protein, 9 aa, Homo Sapiens
EIHQLKKEE

SEQ ID NO: 335288 - protein, 9 aa, Homo Sapiens
AGASCVVPE

SEQ ID NO: 335289 - protein, 9 aa, Homo Sapiens
QVKTTNVQL

SEQ ID NO: 335290 - protein, 9 aa, Homo Sapiens
MKINTCDLL

SEQ ID NO: 335291 - protein, 9 aa, Homo Sapiens
ELTKMNKMS

SEQ ID NO: 335292 - protein, 9 aa, Homo Sapiens
KNNSPALHI

SEQ ID NO: 335293 - protein, 9 aa, Homo Sapiens
ADNKTCSVR

SEQ ID NO: 335294 - protein, 9 aa, Homo Sapiens
SLKLTYTLL

SEQ ID NO: 335295 - protein, 9 aa, Homo Sapiens
EATNIKTSK

SEQ ID NO: 335296 - protein, 9 aa, Homo Sapiens
KACNRISHL

SEQ ID NO: 335297 - protein, 9 aa, Homo Sapiens
LDSQSDKHT

SEQ ID NO: 335298 - protein, 9 aa, Homo Sapiens
PLGCLLYEM

SEQ ID NO: 335299 - protein, 9 aa, Homo Sapiens
QKILKPKDV

SEQ ID NO: 335300 - protein, 9 aa, Homo Sapiens
YNLTILIYV

SEQ ID NO: 335301 - protein, 9 aa, Homo Sapiens
LHVIHHILK

SEQ ID NO: 335302 - protein, 9 aa, Homo Sapiens
KQKWKERTA

SEQ ID NO: 335303 - protein, 9 aa, Homo Sapiens
CQDCRDSLS

SEQ ID NO: 335304 - protein, 9 aa, Homo Sapiens
HKVREMMNQ

SEQ ID NO: 335305 - protein, 9 aa, Homo Sapiens
GQIFCTASL

SEQ ID NO: 335306 - protein, 9 aa, Homo Sapiens
SIAVVHHLG

SEQ ID NO: 335307 - protein, 9 aa, Homo Sapiens
KCDGLGTGD

SEQ ID NO: 335308 - protein, 9 aa, Homo Sapiens
TLVIPIQYY

SEQ ID NO: 335309 - protein, 9 aa, Homo Sapiens
YLLDSNGHL

SEQ ID NO: 335310 - protein, 9 aa, Homo Sapiens
NRVTGIYKL

SEQ ID NO: 335311 - protein, 9 aa, Homo Sapiens
SFKRNLFQH

SEQ ID NO: 335312 - protein, 9 aa, Homo Sapiens
CPGASQSCI

SEQ ID NO: 335313 - protein, 9 aa, Homo Sapiens
QEGIIYVDG

SEQ ID NO: 335314 - protein, 9 aa, Homo Sapiens
GEKYLAYHE

SEQ ID NO: 335315 - protein, 9 aa, Homo Sapiens
TIKTKHTIQ

SEQ ID NO: 335316 - protein, 9 aa, Homo Sapiens
HNKLKECLK

SEQ ID NO: 335317 - protein, 9 aa, Homo Sapiens
LAKCKSDGA

SEQ ID NO: 335318 - protein, 9 aa, Homo Sapiens
DWNTLYQKE

SEQ ID NO: 335319 - protein, 9 aa, Homo Sapiens
RNLQIANNS

SEQ ID NO: 335320 - protein, 9 aa, Homo Sapiens
GLFNLALLI

SEQ ID NO: 335321 - protein, 9 aa, Homo Sapiens
VLLPLIIFH

SEQ ID NO: 335322 - protein, 9 aa, Homo Sapiens
WKLSASLVL

SEQ ID NO: 335323 - protein, 9 aa, Homo Sapiens
VQACKERQK

SEQ ID NO: 335324 - protein, 9 aa, Homo Sapiens
LWFHNQRHM

SEQ ID NO: 335325 - protein, 9 aa, Homo Sapiens
EQALNKILS

SEQ ID NO: 335326 - protein, 9 aa, Homo Sapiens
WYPQVLNLG

SEQ ID NO: 335327 - protein, 9 aa, Homo Sapiens
GKLFKGGGS

SEQ ID NO: 335328 - protein, 9 aa, Homo Sapiens
QANDELSKS

SEQ ID NO: 335329 - protein, 9 aa, Homo Sapiens
FRNPKEPDI

SEQ ID NO: 335330 - protein, 9 aa, Homo Sapiens
WDQTIIFNE

SEQ ID NO: 335331 - protein, 9 aa, Homo Sapiens
AVAYTIGLI

SEQ ID NO: 335332 - protein, 9 aa, Homo Sapiens
VQNNKLPDY

SEQ ID NO: 335333 - protein, 9 aa, Homo Sapiens
LHINHLYIK

SEQ ID NO: 335334 - protein, 9 aa, Homo Sapiens
RRKQVVVAA

SEQ ID NO: 335335 - protein, 9 aa, Homo Sapiens
GYRYVAVSR

SEQ ID NO: 335336 - protein, 9 aa, Homo Sapiens
TYKDAIVIF

SEQ ID NO: 335337 - protein, 9 aa, Homo Sapiens
SPCLGHRRT

SEQ ID NO: 335338 - protein, 9 aa, Homo Sapiens
GATLVLMWL

SEQ ID NO: 335339 - protein, 9 aa, Homo Sapiens
VIEDIEEMM

SEQ ID NO: 335340 - protein, 9 aa, Homo Sapiens
SIEKEHVKE

SEQ ID NO: 335341 - protein, 9 aa, Homo Sapiens
ASVKAYIFK

SEQ ID NO: 335342 - protein, 9 aa, Homo Sapiens
ELGYTKQLF

SEQ ID NO: 335343 - protein, 9 aa, Homo Sapiens
LFCKVHGFY

SEQ ID NO: 335344 - protein, 9 aa, Homo Sapiens
KNSVSLMNR

SEQ ID NO: 335345 - protein, 9 aa, Homo Sapiens
INLAALSFT

SEQ ID NO: 335346 - protein, 9 aa, Homo Sapiens
GSRCLFTKS

SEQ ID NO: 335347 - protein, 9 aa, Homo Sapiens
EHQNRVFHD

SEQ ID NO: 335348 - protein, 9 aa, Homo Sapiens
KEKKRKKHF

SEQ ID NO: 335349 - protein, 9 aa, Homo Sapiens
RKDEWAEVD

SEQ ID NO: 335350 - protein, 9 aa, Homo Sapiens
ILGKKFGIG

SEQ ID NO: 335351 - protein, 9 aa, Homo Sapiens
DGPGTCLKS

SEQ ID NO: 335352 - protein, 9 aa, Homo Sapiens
VNKQQRQLI

SEQ ID NO: 335353 - protein, 9 aa, Homo Sapiens
EEMQKERRR

SEQ ID NO: 335354 - protein, 9 aa, Homo Sapiens
TTRAMSIKI

SEQ ID NO: 335355 - protein, 9 aa, Homo Sapiens
AWWVGYEFF

SEQ ID NO: 335356 - protein, 9 aa, Homo Sapiens
VVLEMDMGL

SEQ ID NO: 335357 - protein, 9 aa, Homo Sapiens
RRPLAVRAC

SEQ ID NO: 335358 - protein, 9 aa, Homo Sapiens
PRTLETDDG

SEQ ID NO: 335359 - protein, 9 aa, Homo Sapiens
AHDQAVVLQ

SEQ ID NO: 335360 - protein, 9 aa, Homo Sapiens
IKAITDRYG

SEQ ID NO: 335361 - protein, 9 aa, Homo Sapiens
CYVTITNCS

SEQ ID NO: 335362 - protein, 9 aa, Homo Sapiens
VYFVIAYIY

SEQ ID NO: 335363 - protein, 9 aa, Homo Sapiens
NESITQGPP

SEQ ID NO: 335364 - protein, 9 aa, Homo Sapiens
TSFYQCSYL

SEQ ID NO: 335365 - protein, 9 aa, Homo Sapiens
KSFVEKLNS

SEQ ID NO: 335366 - protein, 9 aa, Homo Sapiens
QAFNTELQP

SEQ ID NO: 335367 - protein, 9 aa, Homo Sapiens
VSTTVQKVM

SEQ ID NO: 335368 - protein, 9 aa, Homo Sapiens
CPILHQQTS

SEQ ID NO: 335369 - protein, 9 aa, Homo Sapiens
NRRNFASKW

SEQ ID NO: 335370 - protein, 9 aa, Homo Sapiens
VTTKGENHP

SEQ ID NO: 335371 - protein, 9 aa, Homo Sapiens
REITDVDNL

SEQ ID NO: 335372 - protein, 9 aa, Homo Sapiens
YLLENLEKI

SEQ ID NO: 335373 - protein, 9 aa, Homo Sapiens
WSATVVYDD

SEQ ID NO: 335374 - protein, 9 aa, Homo Sapiens
KQFLPTMSP

SEQ ID NO: 335375 - protein, 9 aa, Homo Sapiens
CFTAQDTVA

SEQ ID NO: 335376 - protein, 9 aa, Homo Sapiens
TIDERTISK

SEQ ID NO: 335377 - protein, 9 aa, Homo Sapiens
LQNELQTEV

SEQ ID NO: 335378 - protein, 9 aa, Homo Sapiens
NKNKNVTNR

SEQ ID NO: 335379 - protein, 9 aa, Homo Sapiens
DPLQPPPLP

SEQ ID NO: 335380 - protein, 9 aa, Homo Sapiens
VWMMKGDFY

SEQ ID NO: 335381 - protein, 9 aa, Homo Sapiens
AEHKRLENV

SEQ ID NO: 335382 - protein, 9 aa, Homo Sapiens
QFKTMEFAH

SEQ ID NO: 335383 - protein, 9 aa, Homo Sapiens
QENHNNQGT

SEQ ID NO: 335384 - protein, 9 aa, Homo Sapiens
EFHLLRDTL

SEQ ID NO: 335385 - protein, 9 aa, Homo Sapiens
KDISLFILL

SEQ ID NO: 335386 - protein, 9 aa, Homo Sapiens
GSTLIQHQQ

SEQ ID NO: 335387 - protein, 9 aa, Homo Sapiens
GFDKNEIQN

SEQ ID NO: 335388 - protein, 9 aa, Homo Sapiens
SGHKHIKHS

SEQ ID NO: 335389 - protein, 9 aa, Homo Sapiens
SLAQAHEEA

SEQ ID NO: 335390 - protein, 9 aa, Homo Sapiens
HSKCLLLVL

SEQ ID NO: 335391 - protein, 9 aa, Homo Sapiens
LRSWRINMV

SEQ ID NO: 335392 - protein, 9 aa, Homo Sapiens
LSWDLQFPC

SEQ ID NO: 335393 - protein, 9 aa, Homo Sapiens
PLGQHEVCF

SEQ ID NO: 335394 - protein, 9 aa, Homo Sapiens
WGSNTCSTS

SEQ ID NO: 335395 - protein, 9 aa, Homo Sapiens
PQYLGNQPL

SEQ ID NO: 335396 - protein, 9 aa, Homo Sapiens
SVHDQDYGK

SEQ ID NO: 335397 - protein, 9 aa, Homo Sapiens
LSVVAEGGS

SEQ ID NO: 335398 - protein, 9 aa, Homo Sapiens
NKEVTRTFM

SEQ ID NO: 335399 - protein, 9 aa, Homo Sapiens
SRPPTLHPG

SEQ ID NO: 335400 - protein, 9 aa, Homo Sapiens
DMFREVDKI

SEQ ID NO: 335401 - protein, 9 aa, Homo Sapiens
PGIMLQNPR

SEQ ID NO: 335402 - protein, 9 aa, Homo Sapiens
DKRPEGPGA

SEQ ID NO: 335403 - protein, 9 aa, Homo Sapiens
MIAKQRLGD

SEQ ID NO: 335404 - protein, 9 aa, Homo Sapiens
SVFNNDAAE

SEQ ID NO: 335405 - protein, 9 aa, Homo Sapiens
ICCIAVHPT

SEQ ID NO: 335406 - protein, 9 aa, Homo Sapiens
SSALTMLQE

SEQ ID NO: 335407 - protein, 9 aa, Homo Sapiens
GPILEMALI

SEQ ID NO: 335408 - protein, 9 aa, Homo Sapiens
PVGKARKES

SEQ ID NO: 335409 - protein, 9 aa, Homo Sapiens
KYLLDQLKD

SEQ ID NO: 335410 - protein, 9 aa, Homo Sapiens
IFRYLHNRS

SEQ ID NO: 335411 - protein, 9 aa, Homo Sapiens
TVDQKNNLK

SEQ ID NO: 335412 - protein, 9 aa, Homo Sapiens
LVMNHPACA

SEQ ID NO: 335413 - protein, 9 aa, Homo Sapiens
RLQSLSRNA

SEQ ID NO: 335414 - protein, 9 aa, Homo Sapiens
LWDIENNPT

SEQ ID NO: 335415 - protein, 9 aa, Homo Sapiens
EKNKVKESV

SEQ ID NO: 335416 - protein, 9 aa, Homo Sapiens
LNSMMTVGP

SEQ ID NO: 335417 - protein, 9 aa, Homo Sapiens
LGNCKPDNG

SEQ ID NO: 335418 - protein, 9 aa, Homo Sapiens
LLAPGVDTS

SEQ ID NO: 335419 - protein, 9 aa, Homo Sapiens
KESIFVVSG

SEQ ID NO: 335420 - protein, 9 aa, Homo Sapiens
QKDDMMARR

SEQ ID NO: 335421 - protein, 9 aa, Homo Sapiens
KNKKPKERK

SEQ ID NO: 335422 - protein, 9 aa, Homo Sapiens
VDGILYAAR

SEQ ID NO: 335423 - protein, 9 aa, Homo Sapiens
PLEKLEKQM

SEQ ID NO: 335424 - protein, 9 aa, Homo Sapiens
VNSVFTFFS

SEQ ID NO: 335425 - protein, 9 aa, Homo Sapiens
IATSIVLYF

SEQ ID NO: 335426 - protein, 9 aa, Homo Sapiens
GVGICKKKC

SEQ ID NO: 335427 - protein, 9 aa, Homo Sapiens
LDLKKSDVS

SEQ ID NO: 335428 - protein, 9 aa, Homo Sapiens
CGKGTHCSQ

SEQ ID NO: 335429 - protein, 9 aa, Homo Sapiens
QNATQRIQE

SEQ ID NO: 335430 - protein, 9 aa, Homo Sapiens
SIWGEKCEM

SEQ ID NO: 335431 - protein, 9 aa, Homo Sapiens
VCFNTAGTQ

SEQ ID NO: 335432 - protein, 9 aa, Homo Sapiens
QKSSGVKLT

SEQ ID NO: 335433 - protein, 9 aa, Homo Sapiens
SGVDCNHKR

SEQ ID NO: 335434 - protein, 9 aa, Homo Sapiens
LNKLIKVLS

SEQ ID NO: 335435 - protein, 9 aa, Homo Sapiens
RIHKETSLI

SEQ ID NO: 335436 - protein, 9 aa, Homo Sapiens
HNKYRFLSN

SEQ ID NO: 335437 - protein, 9 aa, Homo Sapiens
TLNSIALHI

SEQ ID NO: 335438 - protein, 9 aa, Homo Sapiens
FEHSELLCK

SEQ ID NO: 335439 - protein, 9 aa, Homo Sapiens
TFGSTEDKH

SEQ ID NO: 335440 - protein, 9 aa, Homo Sapiens
FDADKKDIA

SEQ ID NO: 335441 - protein, 9 aa, Homo Sapiens
RFIESSTKP

SEQ ID NO: 335442 - protein, 9 aa, Homo Sapiens
MDFNSKPHS

SEQ ID NO: 335443 - protein, 9 aa, Homo Sapiens
RPSEYINLD

SEQ ID NO: 335444 - protein, 9 aa, Homo Sapiens
EEKPFVCSE

SEQ ID NO: 335445 - protein, 9 aa, Homo Sapiens
EQHRQQHFE

SEQ ID NO: 335446 - protein, 9 aa, Homo Sapiens
PVKRPRLLV

SEQ ID NO: 335447 - protein, 9 aa, Homo Sapiens
SLTSCIIRL

SEQ ID NO: 335448 - protein, 9 aa, Homo Sapiens
ADDLSAVHN

SEQ ID NO: 335449 - protein, 9 aa, Homo Sapiens
ELTIKPLDK

SEQ ID NO: 335450 - protein, 9 aa, Homo Sapiens
KAAFRELIT

SEQ ID NO: 335451 - protein, 9 aa, Homo Sapiens
NYLQDQSHA

SEQ ID NO: 335452 - protein, 9 aa, Homo Sapiens
EKDMWIVEE

SEQ ID NO: 335453 - protein, 9 aa, Homo Sapiens
KKLLQEYCM

SEQ ID NO: 335454 - protein, 9 aa, Homo Sapiens
NLGNTWYMN

SEQ ID NO: 335455 - protein, 9 aa, Homo Sapiens
DSDRLHVDF

SEQ ID NO: 335456 - protein, 9 aa, Homo Sapiens
LIKYLPKGT

SEQ ID NO: 335457 - protein, 9 aa, Homo Sapiens
TGCETVDVV

SEQ ID NO: 335458 - protein, 9 aa, Homo Sapiens
STECRSLRV

SEQ ID NO: 335459 - protein, 9 aa, Homo Sapiens
QISNNTVSP

SEQ ID NO: 335460 - protein, 9 aa, Homo Sapiens
NNALDLKFD

SEQ ID NO: 335461 - protein, 9 aa, Homo Sapiens
QMAILLQCN

SEQ ID NO: 335462 - protein, 9 aa, Homo Sapiens
PPYLIFCIQ

SEQ ID NO: 335463 - protein, 9 aa, Homo Sapiens
PKENTSTAT

SEQ ID NO: 335464 - protein, 9 aa, Homo Sapiens
TLEFGSEYG

SEQ ID NO: 335465 - protein, 9 aa, Homo Sapiens
TCHHTQLSF

SEQ ID NO: 335466 - protein, 9 aa, Homo Sapiens
NTCVVPERL

SEQ ID NO: 335467 - protein, 9 aa, Homo Sapiens
AHKLAKSYG

SEQ ID NO: 335468 - protein, 9 aa, Homo Sapiens
HCVSVLQAE

SEQ ID NO: 335469 - protein, 9 aa, Homo Sapiens
SIVGLFLGI

SEQ ID NO: 335470 - protein, 9 aa, Homo Sapiens
PNFNTCTAC

SEQ ID NO: 335471 - protein, 9 aa, Homo Sapiens
FDSHFSLSP

SEQ ID NO: 335472 - protein, 9 aa, Homo Sapiens
PVEPTYTSL

SEQ ID NO: 335473 - protein, 9 aa, Homo Sapiens
GKNSCPVSL

SEQ ID NO: 335474 - protein, 9 aa, Homo Sapiens
AADYIINNH

SEQ ID NO: 335475 - protein, 9 aa, Homo Sapiens
YWDSESPCE

SEQ ID NO: 335476 - protein, 9 aa, Homo Sapiens
KEYCLLDSS

SEQ ID NO: 335477 - protein, 9 aa, Homo Sapiens
ESQRQRLLL

SEQ ID NO: 335478 - protein, 9 aa, Homo Sapiens
TEQNSTENN

SEQ ID NO: 335479 - protein, 9 aa, Homo Sapiens
PDKQPGSPS

SEQ ID NO: 335480 - protein, 9 aa, Homo Sapiens
GHHKDAGVI

SEQ ID NO: 335481 - protein, 9 aa, Homo Sapiens
TSQGKLLPA

SEQ ID NO: 335482 - protein, 9 aa, Homo Sapiens
LKIKQTKDC

SEQ ID NO: 335483 - protein, 9 aa, Homo Sapiens
KNRKLTKTN

SEQ ID NO: 335484 - protein, 9 aa, Homo Sapiens
VLQPDAGGV

SEQ ID NO: 335485 - protein, 9 aa, Homo Sapiens
VALVNTSKN

SEQ ID NO: 335486 - protein, 9 aa, Homo Sapiens
QYPALAPWP

SEQ ID NO: 335487 - protein, 9 aa, Homo Sapiens
FSLCPSAID

SEQ ID NO: 335488 - protein, 9 aa, Homo Sapiens
PAWQSLNVR

SEQ ID NO: 335489 - protein, 9 aa, Homo Sapiens
YDTSIDSLK

SEQ ID NO: 335490 - protein, 9 aa, Homo Sapiens
QGLIQNMVA

SEQ ID NO: 335491 - protein, 9 aa, Homo Sapiens
QLLQNQIVT

SEQ ID NO: 335492 - protein, 9 aa, Homo Sapiens
TKFFGGVSG

SEQ ID NO: 335493 - protein, 9 aa, Homo Sapiens
TYTLLNKLG

SEQ ID NO: 335494 - protein, 9 aa, Homo Sapiens
YSNLMLQHE

SEQ ID NO: 335495 - protein, 9 aa, Homo Sapiens
SNINKVWMA

SEQ ID NO: 335496 - protein, 9 aa, Homo Sapiens
ISREAANQL

SEQ ID NO: 335497 - protein, 9 aa, Homo Sapiens
CFQMRIHKR

SEQ ID NO: 335498 - protein, 9 aa, Homo Sapiens
TLPEEDVTH

SEQ ID NO: 335499 - protein, 9 aa, Homo Sapiens
KTSPLDNSD

SEQ ID NO: 335500 - protein, 9 aa, Homo Sapiens
WVMSLVQLI

SEQ ID NO: 335501 - protein, 9 aa, Homo Sapiens
CLCELPALV

SEQ ID NO: 335502 - protein, 9 aa, Homo Sapiens
QTGKELFFD

SEQ ID NO: 335503 - protein, 9 aa, Homo Sapiens
RQTPICDPT

SEQ ID NO: 335504 - protein, 9 aa, Homo Sapiens
LRWHKLMMS

SEQ ID NO: 335505 - protein, 9 aa, Homo Sapiens
RAPMDEADA

SEQ ID NO: 335506 - protein, 9 aa, Homo Sapiens
ACLLYKIKW

SEQ ID NO: 335507 - protein, 9 aa, Homo Sapiens
LEAAEERHK

SEQ ID NO: 335508 - protein, 9 aa, Homo Sapiens
QDPPLYPPV

SEQ ID NO: 335509 - protein, 9 aa, Homo Sapiens
RFDPPIIIF

SEQ ID NO: 335510 - protein, 9 aa, Homo Sapiens
KCISCGSSD

SEQ ID NO: 335511 - protein, 9 aa, Homo Sapiens
KLNRRICPT

SEQ ID NO: 335512 - protein, 9 aa, Homo Sapiens
LVDVKCLNF

SEQ ID NO: 335513 - protein, 9 aa, Homo Sapiens
TAQNSQLDP

SEQ ID NO: 335514 - protein, 9 aa, Homo Sapiens
HIQKRLIQR

SEQ ID NO: 335515 - protein, 9 aa, Homo Sapiens
KESEPLAKP

SEQ ID NO: 335516 - protein, 9 aa, Homo Sapiens
TQHWRIHTG

SEQ ID NO: 335517 - protein, 9 aa, Homo Sapiens
GAVKLSRRH

SEQ ID NO: 335518 - protein, 9 aa, Homo Sapiens
QLGYSYAIN

SEQ ID NO: 335519 - protein, 9 aa, Homo Sapiens
NKLRDRIAS

SEQ ID NO: 335520 - protein, 9 aa, Homo Sapiens
CVASTELDA

SEQ ID NO: 335521 - protein, 9 aa, Homo Sapiens
ASAMIIWIN

SEQ ID NO: 335522 - protein, 9 aa, Homo Sapiens
PGIKSSPHD

SEQ ID NO: 335523 - protein, 9 aa, Homo Sapiens
LMLYFLLYN

SEQ ID NO: 335524 - protein, 9 aa, Homo Sapiens
KQNTAYLSK

SEQ ID NO: 335525 - protein, 9 aa, Homo Sapiens
EKPYVGKEC

SEQ ID NO: 335526 - protein, 9 aa, Homo Sapiens
VERMLGNAA

SEQ ID NO: 335527 - protein, 9 aa, Homo Sapiens
SKEHTDTFH

SEQ ID NO: 335528 - protein, 9 aa, Homo Sapiens
EWWCFHKHG

SEQ ID NO: 335529 - protein, 9 aa, Homo Sapiens
VFWVGSKNT

SEQ ID NO: 335530 - protein, 9 aa, Homo Sapiens
GQFGEVWRG

SEQ ID NO: 335531 - protein, 9 aa, Homo Sapiens
SLVICGTQG

SEQ ID NO: 335532 - protein, 9 aa, Homo Sapiens
ICGALVDVK

SEQ ID NO: 335533 - protein, 9 aa, Homo Sapiens
QQRYSLSHD

SEQ ID NO: 335534 - protein, 9 aa, Homo Sapiens
LWQAMQEWQ

SEQ ID NO: 335535 - protein, 9 aa, Homo Sapiens
SKLKYHPEM

SEQ ID NO: 335536 - protein, 9 aa, Homo Sapiens
IDLRCPLSR

SEQ ID NO: 335537 - protein, 9 aa, Homo Sapiens
KVTGLAQVI

SEQ ID NO: 335538 - protein, 9 aa, Homo Sapiens
NDQIDSMDS

SEQ ID NO: 335539 - protein, 9 aa, Homo Sapiens
ILWKLMKNI

SEQ ID NO: 335540 - protein, 9 aa, Homo Sapiens
GPKHLYGLS

SEQ ID NO: 335541 - protein, 9 aa, Homo Sapiens
LCGKGFTHR

SEQ ID NO: 335542 - protein, 9 aa, Homo Sapiens
LTILIYVFQ

SEQ ID NO: 335543 - protein, 9 aa, Homo Sapiens
SYSPASASQ

SEQ ID NO: 335544 - protein, 9 aa, Homo Sapiens
AAFFNTAST

SEQ ID NO: 335545 - protein, 9 aa, Homo Sapiens
PWGRLHSHC

SEQ ID NO: 335546 - protein, 9 aa, Homo Sapiens
NVLISSKTE

SEQ ID NO: 335547 - protein, 9 aa, Homo Sapiens
YREITDVDN

SEQ ID NO: 335548 - protein, 9 aa, Homo Sapiens
STLSRADRE

SEQ ID NO: 335549 - protein, 9 aa, Homo Sapiens
NSVQSGKSD

SEQ ID NO: 335550 - protein, 9 aa, Homo Sapiens
AAFHIFQAI

SEQ ID NO: 335551 - protein, 9 aa, Homo Sapiens
YDDFFEQTI

SEQ ID NO: 335552 - protein, 9 aa, Homo Sapiens
PPTIRRTFW

SEQ ID NO: 335553 - protein, 9 aa, Homo Sapiens
QRSLHRVPL

SEQ ID NO: 335554 - protein, 9 aa, Homo Sapiens
CGGLNNICS

SEQ ID NO: 335555 - protein, 9 aa, Homo Sapiens
TCHIGVLRH

SEQ ID NO: 335556 - protein, 9 aa, Homo Sapiens
HSGRTGRAG

SEQ ID NO: 335557 - protein, 9 aa, Homo Sapiens
TAVLLARIN

SEQ ID NO: 335558 - protein, 9 aa, Homo Sapiens
GKFIQIHFG

SEQ ID NO: 335559 - protein, 9 aa, Homo Sapiens
NVFVWLLNG

SEQ ID NO: 335560 - protein, 9 aa, Homo Sapiens
SKMNENIIR

SEQ ID NO: 335561 - protein, 9 aa, Homo Sapiens
GDILRVLAT

SEQ ID NO: 335562 - protein, 9 aa, Homo Sapiens
GELFRLVSE

SEQ ID NO: 335563 - protein, 9 aa, Homo Sapiens
YIPYGKEVS

SEQ ID NO: 335564 - protein, 9 aa, Homo Sapiens
CEKVVNIPS

SEQ ID NO: 335565 - protein, 9 aa, Homo Sapiens
ITMAKQKQT

SEQ ID NO: 335566 - protein, 9 aa, Homo Sapiens
NFEESKGRG

SEQ ID NO: 335567 - protein, 9 aa, Homo Sapiens
VCPEQGKKT

SEQ ID NO: 335568 - protein, 9 aa, Homo Sapiens
SIVGVNLFA

SEQ ID NO: 335569 - protein, 9 aa, Homo Sapiens
TKMIWFNSV

SEQ ID NO: 335570 - protein, 9 aa, Homo Sapiens
TKQQQYADL

SEQ ID NO: 335571 - protein, 9 aa, Homo Sapiens
ADYTLESGG

SEQ ID NO: 335572 - protein, 9 aa, Homo Sapiens
KDVKDVSIL

SEQ ID NO: 335573 - protein, 9 aa, Homo Sapiens
RVLNISYNV

SEQ ID NO: 335574 - protein, 9 aa, Homo Sapiens
QDPESLPFC

SEQ ID NO: 335575 - protein, 9 aa, Homo Sapiens
AGNLEYFMK

SEQ ID NO: 335576 - protein, 9 aa, Homo Sapiens
IMRLCFNHF

SEQ ID NO: 335577 - protein, 9 aa, Homo Sapiens
HGMKPHKAF

SEQ ID NO: 335578 - protein, 9 aa, Homo Sapiens
MQELNNKIN

SEQ ID NO: 335579 - protein, 9 aa, Homo Sapiens
KFSGCCFSR

SEQ ID NO: 335580 - protein, 9 aa, Homo Sapiens
LNVVKELEL

SEQ ID NO: 335581 - protein, 9 aa, Homo Sapiens
VNVSSKECL

SEQ ID NO: 335582 - protein, 9 aa, Homo Sapiens
VHQITHTGE

SEQ ID NO: 335583 - protein, 9 aa, Homo Sapiens
MLMHFSSKE

SEQ ID NO: 335584 - protein, 9 aa, Homo Sapiens
KIMKSIGEA

SEQ ID NO: 335585 - protein, 9 aa, Homo Sapiens
IINNFIIFW

SEQ ID NO: 335586 - protein, 9 aa, Homo Sapiens
RDPVSEPLV

SEQ ID NO: 335587 - protein, 9 aa, Homo Sapiens
YSNTSKLFS

SEQ ID NO: 335588 - protein, 9 aa, Homo Sapiens
AFSKSLNLT

SEQ ID NO: 335589 - protein, 9 aa, Homo Sapiens
DLKKSDVST

SEQ ID NO: 335590 - protein, 9 aa, Homo Sapiens
LMERYAPVA

SEQ ID NO: 335591 - protein, 9 aa, Homo Sapiens
SDPEHRRVL

SEQ ID NO: 335592 - protein, 9 aa, Homo Sapiens
DPLGGLADL

SEQ ID NO: 335593 - protein, 9 aa, Homo Sapiens
MEQQHQDKV

SEQ ID NO: 335594 - protein, 9 aa, Homo Sapiens
PHLQWKRPP

SEQ ID NO: 335595 - protein, 9 aa, Homo Sapiens
NNSALEYQL

SEQ ID NO: 335596 - protein, 9 aa, Homo Sapiens
LLAPLLNDI

SEQ ID NO: 335597 - protein, 9 aa, Homo Sapiens
HKSDCNSSP

SEQ ID NO: 335598 - protein, 9 aa, Homo Sapiens
DMWIVEELF

SEQ ID NO: 335599 - protein, 9 aa, Homo Sapiens
KSHYTAFSV

SEQ ID NO: 335600 - protein, 9 aa, Homo Sapiens
SKPDMDKSH

SEQ ID NO: 335601 - protein, 9 aa, Homo Sapiens
LGCPAPRAE

SEQ ID NO: 335602 - protein, 9 aa, Homo Sapiens
EMANMVPSV

SEQ ID NO: 335603 - protein, 9 aa, Homo Sapiens
QRFYQLLDS

SEQ ID NO: 335604 - protein, 9 aa, Homo Sapiens
RPGNLVYHF

SEQ ID NO: 335605 - protein, 9 aa, Homo Sapiens
AITHFFCNV

SEQ ID NO: 335606 - protein, 9 aa, Homo Sapiens
NEHGFQKGG

SEQ ID NO: 335607 - protein, 9 aa, Homo Sapiens
LILLAICRM

SEQ ID NO: 335608 - protein, 9 aa, Homo Sapiens
GKCLVNVGQ

SEQ ID NO: 335609 - protein, 9 aa, Homo Sapiens
EAAKREKQL

SEQ ID NO: 335610 - protein, 9 aa, Homo Sapiens
PTSPPERAV

SEQ ID NO: 335611 - protein, 9 aa, Homo Sapiens
TLKGVAELG

SEQ ID NO: 335612 - protein, 9 aa, Homo Sapiens
LEMLSGDRV

SEQ ID NO: 335613 - protein, 9 aa, Homo Sapiens
NDDPPVFPH

SEQ ID NO: 335614 - protein, 9 aa, Homo Sapiens
LHGLTPFHY

SEQ ID NO: 335615 - protein, 9 aa, Homo Sapiens
KVTSMFKLS

SEQ ID NO: 335616 - protein, 9 aa, Homo Sapiens
ARLSSSPQH

SEQ ID NO: 335617 - protein, 9 aa, Homo Sapiens
QHLPLSECI

SEQ ID NO: 335618 - protein, 9 aa, Homo Sapiens
KTPTCVPVS

SEQ ID NO: 335619 - protein, 9 aa, Homo Sapiens
AWVMSLVQL

SEQ ID NO: 335620 - protein, 9 aa, Homo Sapiens
RMEQQHQDK

SEQ ID NO: 335621 - protein, 9 aa, Homo Sapiens
ALESHKIIH

SEQ ID NO: 335622 - protein, 9 aa, Homo Sapiens
YLANNCTKL

SEQ ID NO: 335623 - protein, 9 aa, Homo Sapiens
SNKLYVVKQ

SEQ ID NO: 335624 - protein, 9 aa, Homo Sapiens
EYNQVLDSV

SEQ ID NO: 335625 - protein, 9 aa, Homo Sapiens
EKCFTFVLA

SEQ ID NO: 335626 - protein, 9 aa, Homo Sapiens
VSSSVLTGT

SEQ ID NO: 335627 - protein, 9 aa, Homo Sapiens
KNTQQCPGL

SEQ ID NO: 335628 - protein, 9 aa, Homo Sapiens
HSHVAGQML

SEQ ID NO: 335629 - protein, 9 aa, Homo Sapiens
CKKERCFTS

SEQ ID NO: 335630 - protein, 9 aa, Homo Sapiens
TQMVVHDIR

SEQ ID NO: 335631 - protein, 9 aa, Homo Sapiens
NEGSPGPPG

SEQ ID NO: 335632 - protein, 9 aa, Homo Sapiens
HNKDTFLGP

SEQ ID NO: 335633 - protein, 9 aa, Homo Sapiens
ECNECGRYF

SEQ ID NO: 335634 - protein, 9 aa, Homo Sapiens
ILEQRFDPP

SEQ ID NO: 335635 - protein, 9 aa, Homo Sapiens
RRADQGPKN

SEQ ID NO: 335636 - protein, 9 aa, Homo Sapiens
SHLMLISVS

SEQ ID NO: 335637 - protein, 9 aa, Homo Sapiens
QGYNRLAWI

SEQ ID NO: 335638 - protein, 9 aa, Homo Sapiens
RFHADKEME

SEQ ID NO: 335639 - protein, 9 aa, Homo Sapiens
QTELILILM

SEQ ID NO: 335640 - protein, 9 aa, Homo Sapiens
AKLMKNIQF

SEQ ID NO: 335641 - protein, 9 aa, Homo Sapiens
RKRRNLKTR

SEQ ID NO: 335642 - protein, 9 aa, Homo Sapiens
LFCGPKALS

SEQ ID NO: 335643 - protein, 9 aa, Homo Sapiens
VLEHYNMTS

SEQ ID NO: 335644 - protein, 9 aa, Homo Sapiens
LQGYHFTTD

SEQ ID NO: 335645 - protein, 9 aa, Homo Sapiens
LNGQAFPLP

SEQ ID NO: 335646 - protein, 9 aa, Homo Sapiens
KHYTIDVII

SEQ ID NO: 335647 - protein, 9 aa, Homo Sapiens
GEKPYVGKE

SEQ ID NO: 335648 - protein, 9 aa, Homo Sapiens
KSIFAFVLI

SEQ ID NO: 335649 - protein, 9 aa, Homo Sapiens
LTAREYALK

SEQ ID NO: 335650 - protein, 9 aa, Homo Sapiens
CQLMFFIGS

SEQ ID NO: 335651 - protein, 9 aa, Homo Sapiens
EHRRVLAQL

SEQ ID NO: 335652 - protein, 9 aa, Homo Sapiens
LGETFYSDS

SEQ ID NO: 335653 - protein, 9 aa, Homo Sapiens
RVKQGKYQN

SEQ ID NO: 335654 - protein, 9 aa, Homo Sapiens
ASDLSDGDA

SEQ ID NO: 335655 - protein, 9 aa, Homo Sapiens
ENEWKRMCS

SEQ ID NO: 335656 - protein, 9 aa, Homo Sapiens
INNTFIKTL

SEQ ID NO: 335657 - protein, 9 aa, Homo Sapiens
SIINKWLSK

SEQ ID NO: 335658 - protein, 9 aa, Homo Sapiens
LNHNPYPSS

SEQ ID NO: 335659 - protein, 9 aa, Homo Sapiens
DDSDLDFDI

SEQ ID NO: 335660 - protein, 9 aa, Homo Sapiens
DMKCDNMMT

SEQ ID NO: 335661 - protein, 9 aa, Homo Sapiens
GKKNGKLWS

SEQ ID NO: 335662 - protein, 9 aa, Homo Sapiens
HSGEKPYGR

SEQ ID NO: 335663 - protein, 9 aa, Homo Sapiens
VCTCAHVGA

SEQ ID NO: 335664 - protein, 9 aa, Homo Sapiens
NLKEEHLKK

SEQ ID NO: 335665 - protein, 9 aa, Homo Sapiens
VTNESITQG

SEQ ID NO: 335666 - protein, 9 aa, Homo Sapiens
GIDNCSVMA

SEQ ID NO: 335667 - protein, 9 aa, Homo Sapiens
MNRSLHVGS

SEQ ID NO: 335668 - protein, 9 aa, Homo Sapiens
MLLASEVEE

SEQ ID NO: 335669 - protein, 9 aa, Homo Sapiens
VWKSVTKNW

SEQ ID NO: 335670 - protein, 9 aa, Homo Sapiens
YLNISFNIL

SEQ ID NO: 335671 - protein, 9 aa, Homo Sapiens
CQIRYERDN

SEQ ID NO: 335672 - protein, 9 aa, Homo Sapiens
PNFICQNTL

SEQ ID NO: 335673 - protein, 9 aa, Homo Sapiens
TSHVSSLSL

SEQ ID NO: 335674 - protein, 9 aa, Homo Sapiens
WLVHEEQKI

SEQ ID NO: 335675 - protein, 9 aa, Homo Sapiens
MFPDQTVKN

SEQ ID NO: 335676 - protein, 9 aa, Homo Sapiens
DNLDSQSDK

SEQ ID NO: 335677 - protein, 9 aa, Homo Sapiens
AIDIPMDPS

SEQ ID NO: 335678 - protein, 9 aa, Homo Sapiens
TQGYLCPSG

SEQ ID NO: 335679 - protein, 9 aa, Homo Sapiens
KVIVTLSET

SEQ ID NO: 335680 - protein, 9 aa, Homo Sapiens
RIMDDDNNQ

SEQ ID NO: 335681 - protein, 9 aa, Homo Sapiens
LFDRKWLQY

SEQ ID NO: 335682 - protein, 9 aa, Homo Sapiens
EDNFLAAQA

SEQ ID NO: 335683 - protein, 9 aa, Homo Sapiens
AGVNKDYEE

SEQ ID NO: 335684 - protein, 9 aa, Homo Sapiens
RKVRMNYYP

SEQ ID NO: 335685 - protein, 9 aa, Homo Sapiens
NVFESFVVL

SEQ ID NO: 335686 - protein, 9 aa, Homo Sapiens
AARQGVYKN

SEQ ID NO: 335687 - protein, 9 aa, Homo Sapiens
ALEMMSQTM

SEQ ID NO: 335688 - protein, 9 aa, Homo Sapiens
PNLKYTITC

SEQ ID NO: 335689 - protein, 9 aa, Homo Sapiens
PRLPKFADW

SEQ ID NO: 335690 - protein, 9 aa, Homo Sapiens
DSERISIPP

SEQ ID NO: 335691 - protein, 9 aa, Homo Sapiens
FSIFKSDIP

SEQ ID NO: 335692 - protein, 9 aa, Homo Sapiens
PVVKVLSSG

SEQ ID NO: 335693 - protein, 9 aa, Homo Sapiens
STGSYEDRV

SEQ ID NO: 335694 - protein, 9 aa, Homo Sapiens
ELDNHPMNE

SEQ ID NO: 335695 - protein, 9 aa, Homo Sapiens
CWGYQLTQH

SEQ ID NO: 335696 - protein, 9 aa, Homo Sapiens
YMINLDYSV

SEQ ID NO: 335697 - protein, 9 aa, Homo Sapiens
AYFSFLPQS

SEQ ID NO: 335698 - protein, 9 aa, Homo Sapiens
QNSSVFIKP

SEQ ID NO: 335699 - protein, 9 aa, Homo Sapiens
DDIVVVALD

SEQ ID NO: 335700 - protein, 9 aa, Homo Sapiens
KPAEGNTTD

SEQ ID NO: 335701 - protein, 9 aa, Homo Sapiens
QFNVVMCRH

SEQ ID NO: 335702 - protein, 9 aa, Homo Sapiens
PAWLPEDKV

SEQ ID NO: 335703 - protein, 9 aa, Homo Sapiens
LYIYEYLLH

SEQ ID NO: 335704 - protein, 9 aa, Homo Sapiens
NTRSNVSFY

SEQ ID NO: 335705 - protein, 9 aa, Homo Sapiens
VNKCSAFQF

SEQ ID NO: 335706 - protein, 9 aa, Homo Sapiens
HVTSPALRG

SEQ ID NO: 335707 - protein, 9 aa, Homo Sapiens
NWNWDTWDG

SEQ ID NO: 335708 - protein, 9 aa, Homo Sapiens
IGTHDKMNE

SEQ ID NO: 335709 - protein, 9 aa, Homo Sapiens
EHSRRGCSY

SEQ ID NO: 335710 - protein, 9 aa, Homo Sapiens
KYVNIFINL

SEQ ID NO: 335711 - protein, 9 aa, Homo Sapiens
SLLVMALDR

SEQ ID NO: 335712 - protein, 9 aa, Homo Sapiens
RQFFVDQWE

SEQ ID NO: 335713 - protein, 9 aa, Homo Sapiens
SNTEEKFQA

SEQ ID NO: 335714 - protein, 9 aa, Homo Sapiens
CLAGNQADL

SEQ ID NO: 335715 - protein, 9 aa, Homo Sapiens
ALTEQLQKL

SEQ ID NO: 335716 - protein, 9 aa, Homo Sapiens
PPIQNSNTE

SEQ ID NO: 335717 - protein, 9 aa, Homo Sapiens
YFPVFSLLS

SEQ ID NO: 335718 - protein, 9 aa, Homo Sapiens
GQHEVCFVP

SEQ ID NO: 335719 - protein, 9 aa, Homo Sapiens
KEAEEDSSG

SEQ ID NO: 335720 - protein, 9 aa, Homo Sapiens
EGEHQYKLF

SEQ ID NO: 335721 - protein, 9 aa, Homo Sapiens
NPNIAKNER

SEQ ID NO: 335722 - protein, 9 aa, Homo Sapiens
YLSHILEQI

SEQ ID NO: 335723 - protein, 9 aa, Homo Sapiens
NNLGVCGSR

SEQ ID NO: 335724 - protein, 9 aa, Homo Sapiens
ESSVVFGMR

SEQ ID NO: 335725 - protein, 9 aa, Homo Sapiens
TLISQKVPE

SEQ ID NO: 335726 - protein, 9 aa, Homo Sapiens
RAFAESHNQ

SEQ ID NO: 335727 - protein, 9 aa, Homo Sapiens
NFTRWRYGV

SEQ ID NO: 335728 - protein, 9 aa, Homo Sapiens
AKQKIPPPV

SEQ ID NO: 335729 - protein, 9 aa, Homo Sapiens
GLEWKLSAS

SEQ ID NO: 335730 - protein, 9 aa, Homo Sapiens
GMGRPAQHR

SEQ ID NO: 335731 - protein, 9 aa, Homo Sapiens
QHRSFIIQN

SEQ ID NO: 335732 - protein, 9 aa, Homo Sapiens
LMFVFNLFI

SEQ ID NO: 335733 - protein, 9 aa, Homo Sapiens
VLLTAPWEL

SEQ ID NO: 335734 - protein, 9 aa, Homo Sapiens
LSSPDILCS

SEQ ID NO: 335735 - protein, 9 aa, Homo Sapiens
GLSTLMELS

SEQ ID NO: 335736 - protein, 9 aa, Homo Sapiens
NHPKYWCQG

SEQ ID NO: 335737 - protein, 9 aa, Homo Sapiens
DHIVEKGFY

SEQ ID NO: 335738 - protein, 9 aa, Homo Sapiens
GIAASVNAN

SEQ ID NO: 335739 - protein, 9 aa, Homo Sapiens
SVILLACQI

SEQ ID NO: 335740 - protein, 9 aa, Homo Sapiens
EERFIESST

SEQ ID NO: 335741 - protein, 9 aa, Homo Sapiens
EACVDYMGS

SEQ ID NO: 335742 - protein, 9 aa, Homo Sapiens
KQNDSIIVD

SEQ ID NO: 335743 - protein, 9 aa, Homo Sapiens
QIHHIKNVY

SEQ ID NO: 335744 - protein, 9 aa, Homo Sapiens
YSDKELTIK

SEQ ID NO: 335745 - protein, 9 aa, Homo Sapiens
DMDISAMPR

SEQ ID NO: 335746 - protein, 9 aa, Homo Sapiens
FPGVLECCL

SEQ ID NO: 335747 - protein, 9 aa, Homo Sapiens
KLERVEEAA

SEQ ID NO: 335748 - protein, 9 aa, Homo Sapiens
SLCDSNVIH

SEQ ID NO: 335749 - protein, 9 aa, Homo Sapiens
RAPKGAWGP

SEQ ID NO: 335750 - protein, 9 aa, Homo Sapiens
ELELTKMNK

SEQ ID NO: 335751 - protein, 9 aa, Homo Sapiens
CLHFSPFHF

SEQ ID NO: 335752 - protein, 9 aa, Homo Sapiens
KMKEQEYWK

SEQ ID NO: 335753 - protein, 9 aa, Homo Sapiens
VTCQIEEME

SEQ ID NO: 335754 - protein, 9 aa, Homo Sapiens
DGFTDPSHS

SEQ ID NO: 335755 - protein, 9 aa, Homo Sapiens
ILSFPTKSP

SEQ ID NO: 335756 - protein, 9 aa, Homo Sapiens
IHEVQCFGD

SEQ ID NO: 335757 - protein, 9 aa, Homo Sapiens
LASQPPVVN

SEQ ID NO: 335758 - protein, 9 aa, Homo Sapiens
NVLFGMRIC

SEQ ID NO: 335759 - protein, 9 aa, Homo Sapiens
FSALDLDPC

SEQ ID NO: 335760 - protein, 9 aa, Homo Sapiens
SVKVMLKNI

SEQ ID NO: 335761 - protein, 9 aa, Homo Sapiens
SLLSDPGPG

SEQ ID NO: 335762 - protein, 9 aa, Homo Sapiens
PASVYPRHF

SEQ ID NO: 335763 - protein, 9 aa, Homo Sapiens
TVNNSSLIS

SEQ ID NO: 335764 - protein, 9 aa, Homo Sapiens
KLKDKLFNE

SEQ ID NO: 335765 - protein, 9 aa, Homo Sapiens
VVLLTELKT

SEQ ID NO: 335766 - protein, 9 aa, Homo Sapiens
TEELKEAKK

SEQ ID NO: 335767 - protein, 9 aa, Homo Sapiens
KNLEIYKGS

SEQ ID NO: 335768 - protein, 9 aa, Homo Sapiens
PHDFDECQF

SEQ ID NO: 335769 - protein, 9 aa, Homo Sapiens
NGESSQGQF

SEQ ID NO: 335770 - protein, 9 aa, Homo Sapiens
VSILQVKVL

SEQ ID NO: 335771 - protein, 9 aa, Homo Sapiens
NPIVKVRYE

SEQ ID NO: 335772 - protein, 9 aa, Homo Sapiens
EEETTLGSH

SEQ ID NO: 335773 - protein, 9 aa, Homo Sapiens
DIRNYPYPQ

SEQ ID NO: 335774 - protein, 9 aa, Homo Sapiens
KNTCTIDGL

SEQ ID NO: 335775 - protein, 9 aa, Homo Sapiens
PLMYTLRNE

SEQ ID NO: 335776 - protein, 9 aa, Homo Sapiens
HYLLNESNC

SEQ ID NO: 335777 - protein, 9 aa, Homo Sapiens
GSCVQACGA

SEQ ID NO: 335778 - protein, 9 aa, Homo Sapiens
IQVVQGDIG

SEQ ID NO: 335779 - protein, 9 aa, Homo Sapiens
MKLCGTKDL

SEQ ID NO: 335780 - protein, 9 aa, Homo Sapiens
NNHTYRIDD

SEQ ID NO: 335781 - protein, 9 aa, Homo Sapiens
ENKPTVSVF

SEQ ID NO: 335782 - protein, 9 aa, Homo Sapiens
MLSMLMHFS

SEQ ID NO: 335783 - protein, 9 aa, Homo Sapiens
VLDQFVQLR

SEQ ID NO: 335784 - protein, 9 aa, Homo Sapiens
MSLGCCVVI

SEQ ID NO: 335785 - protein, 9 aa, Homo Sapiens
CYKIITLKT

SEQ ID NO: 335786 - protein, 9 aa, Homo Sapiens
IGQLEGILC

SEQ ID NO: 335787 - protein, 9 aa, Homo Sapiens
VYLCDQERQ

SEQ ID NO: 335788 - protein, 9 aa, Homo Sapiens
VLSLQNNLD

SEQ ID NO: 335789 - protein, 9 aa, Homo Sapiens
VTPNTAWGG

SEQ ID NO: 335790 - protein, 9 aa, Homo Sapiens
ECNIKKGVS

SEQ ID NO: 335791 - protein, 9 aa, Homo Sapiens
CLHTAVYHE

SEQ ID NO: 335792 - protein, 9 aa, Homo Sapiens
TNSCISPLS

SEQ ID NO: 335793 - protein, 9 aa, Homo Sapiens
DDLLAQEAQ

SEQ ID NO: 335794 - protein, 9 aa, Homo Sapiens
MPPRKQRRQ

SEQ ID NO: 335795 - protein, 9 aa, Homo Sapiens
SEPLVEKFS

SEQ ID NO: 335796 - protein, 9 aa, Homo Sapiens
ADRIHIFSY

SEQ ID NO: 335797 - protein, 9 aa, Homo Sapiens
CSDLTALTE

SEQ ID NO: 335798 - protein, 9 aa, Homo Sapiens
MRLEQENED

SEQ ID NO: 335799 - protein, 9 aa, Homo Sapiens
SMFLPTLLH

SEQ ID NO: 335800 - protein, 9 aa, Homo Sapiens
EQQRRLEWE

SEQ ID NO: 335801 - protein, 9 aa, Homo Sapiens
IFWSFKIVL

SEQ ID NO: 335802 - protein, 9 aa, Homo Sapiens
TISWFWDGQ

SEQ ID NO: 335803 - protein, 9 aa, Homo Sapiens
TEGRTQNHG

SEQ ID NO: 335804 - protein, 9 aa, Homo Sapiens
GCIRYKKPM

SEQ ID NO: 335805 - protein, 9 aa, Homo Sapiens
CRRVVCNIK

SEQ ID NO: 335806 - protein, 9 aa, Homo Sapiens
LSRTKEHTY

SEQ ID NO: 335807 - protein, 9 aa, Homo Sapiens
PEITYWLRN

SEQ ID NO: 335808 - protein, 9 aa, Homo Sapiens
LPGEWLPAE

SEQ ID NO: 335809 - protein, 9 aa, Homo Sapiens
KYQEQCRQE

SEQ ID NO: 335810 - protein, 9 aa, Homo Sapiens
EECGNTFNR

SEQ ID NO: 335811 - protein, 9 aa, Homo Sapiens
VMNHPACAN

SEQ ID NO: 335812 - protein, 9 aa, Homo Sapiens
EKQSIWIQT

SEQ ID NO: 335813 - protein, 9 aa, Homo Sapiens
VFVAEPKKS

SEQ ID NO: 335814 - protein, 9 aa, Homo Sapiens
QIHNRVALG

SEQ ID NO: 335815 - protein, 9 aa, Homo Sapiens
HIFSYFFYK

SEQ ID NO: 335816 - protein, 9 aa, Homo Sapiens
SEKLLKEDK

SEQ ID NO: 335817 - protein, 9 aa, Homo Sapiens
QNVEIQRGH

SEQ ID NO: 335818 - protein, 9 aa, Homo Sapiens
GHMDVAEPY

SEQ ID NO: 335819 - protein, 9 aa, Homo Sapiens
KQRRQPSQK

SEQ ID NO: 335820 - protein, 9 aa, Homo Sapiens
LKPKKKNNI

SEQ ID NO: 335821 - protein, 9 aa, Homo Sapiens
QGYKIIYRP

SEQ ID NO: 335822 - protein, 9 aa, Homo Sapiens
ITVRDDIDG

SEQ ID NO: 335823 - protein, 9 aa, Homo Sapiens
IFKKGSRNN

SEQ ID NO: 335824 - protein, 9 aa, Homo Sapiens
WIVVKINSR

SEQ ID NO: 335825 - protein, 9 aa, Homo Sapiens
CDHERTHTG

SEQ ID NO: 335826 - protein, 9 aa, Homo Sapiens
FPIRAAFMV

SEQ ID NO: 335827 - protein, 9 aa, Homo Sapiens
PVLTFELSI

SEQ ID NO: 335828 - protein, 9 aa, Homo Sapiens
AEEDDIIVW

SEQ ID NO: 335829 - protein, 9 aa, Homo Sapiens
SLYDPSPWV

SEQ ID NO: 335830 - protein, 9 aa, Homo Sapiens
WDDMAHLPF

SEQ ID NO: 335831 - protein, 9 aa, Homo Sapiens
DETEYKVPA

SEQ ID NO: 335832 - protein, 9 aa, Homo Sapiens
FCYVKTARN

SEQ ID NO: 335833 - protein, 9 aa, Homo Sapiens
KAVKNLASP

SEQ ID NO: 335834 - protein, 9 aa, Homo Sapiens
TIILWKLMK

SEQ ID NO: 335835 - protein, 9 aa, Homo Sapiens
VPRQPTYVQ

SEQ ID NO: 335836 - protein, 9 aa, Homo Sapiens
ELALRALRE

SEQ ID NO: 335837 - protein, 9 aa, Homo Sapiens
IIYRPSGAN

SEQ ID NO: 335838 - protein, 9 aa, Homo Sapiens
PEKTAAATK

SEQ ID NO: 335839 - protein, 9 aa, Homo Sapiens
EDNKLCHEQ

SEQ ID NO: 335840 - protein, 9 aa, Homo Sapiens
ETNGGADKK

SEQ ID NO: 335841 - protein, 9 aa, Homo Sapiens
LLERIGYPN

SEQ ID NO: 335842 - protein, 9 aa, Homo Sapiens
KIILMLTNK

SEQ ID NO: 335843 - protein, 9 aa, Homo Sapiens
YSDSSEMFL

SEQ ID NO: 335844 - protein, 9 aa, Homo Sapiens
KFTLIVTDA

SEQ ID NO: 335845 - protein, 9 aa, Homo Sapiens
MGRVMLGET

SEQ ID NO: 335846 - protein, 9 aa, Homo Sapiens
FNWRGLVAM

SEQ ID NO: 335847 - protein, 9 aa, Homo Sapiens
DFLMLYFLL

SEQ ID NO: 335848 - protein, 9 aa, Homo Sapiens
IREARQKEE

SEQ ID NO: 335849 - protein, 9 aa, Homo Sapiens
QYLLDSNGH

SEQ ID NO: 335850 - protein, 9 aa, Homo Sapiens
EIEHLQNEL

SEQ ID NO: 335851 - protein, 9 aa, Homo Sapiens
RDVRDYFMS

SEQ ID NO: 335852 - protein, 9 aa, Homo Sapiens
LRCCDNDMK

SEQ ID NO: 335853 - protein, 9 aa, Homo Sapiens
RTLLETLQT

SEQ ID NO: 335854 - protein, 9 aa, Homo Sapiens
IARNGDASS

SEQ ID NO: 335855 - protein, 9 aa, Homo Sapiens
YTCKSNWHG

SEQ ID NO: 335856 - protein, 9 aa, Homo Sapiens
IIFWSFKIV

SEQ ID NO: 335857 - protein, 9 aa, Homo Sapiens
SSQQKTFQG

SEQ ID NO: 335858 - protein, 9 aa, Homo Sapiens
ATISWFWDG

SEQ ID NO: 335859 - protein, 9 aa, Homo Sapiens
RREGFDKNE

SEQ ID NO: 335860 - protein, 9 aa, Homo Sapiens
ATILFFFPS

SEQ ID NO: 335861 - protein, 9 aa, Homo Sapiens
NNETKRNQL

SEQ ID NO: 335862 - protein, 9 aa, Homo Sapiens
EHRQILQES

SEQ ID NO: 335863 - protein, 9 aa, Homo Sapiens
VVFGELPSG

SEQ ID NO: 335864 - protein, 9 aa, Homo Sapiens
DLHLSMFLP

SEQ ID NO: 335865 - protein, 9 aa, Homo Sapiens
RNILEENLQ

SEQ ID NO: 335866 - protein, 9 aa, Homo Sapiens
KEALKMSVA

SEQ ID NO: 335867 - protein, 9 aa, Homo Sapiens
DADNDVNTY

SEQ ID NO: 335868 - protein, 9 aa, Homo Sapiens
VEQLWVVEF

SEQ ID NO: 335869 - protein, 9 aa, Homo Sapiens
EELKEAKKK

SEQ ID NO: 335870 - protein, 9 aa, Homo Sapiens
ICSDLTALT

SEQ ID NO: 335871 - protein, 9 aa, Homo Sapiens
LKEEERFIE

SEQ ID NO: 335872 - protein, 9 aa, Homo Sapiens
SSEEEESLV

SEQ ID NO: 335873 - protein, 9 aa, Homo Sapiens
HVYYLGMTL

SEQ ID NO: 335874 - protein, 9 aa, Homo Sapiens
IDKVWFLEQ

SEQ ID NO: 335875 - protein, 9 aa, Homo Sapiens
NQNKTLVEE

SEQ ID NO: 335876 - protein, 9 aa, Homo Sapiens
DKNDDDPKF

SEQ ID NO: 335877 - protein, 9 aa, Homo Sapiens
KRHHKQLKI

SEQ ID NO: 335878 - protein, 9 aa, Homo Sapiens
DEEESIWKK

SEQ ID NO: 335879 - protein, 9 aa, Homo Sapiens
THHNYYFIN

SEQ ID NO: 335880 - protein, 9 aa, Homo Sapiens
KQIVTAVYC

SEQ ID NO: 335881 - protein, 9 aa, Homo Sapiens
VCKELRSRI

SEQ ID NO: 335882 - protein, 9 aa, Homo Sapiens
KITSMETAL

SEQ ID NO: 335883 - protein, 9 aa, Homo Sapiens
ILVATLQGS

SEQ ID NO: 335884 - protein, 9 aa, Homo Sapiens
KSEEKDMDI

SEQ ID NO: 335885 - protein, 9 aa, Homo Sapiens
MSISNITVC

SEQ ID NO: 335886 - protein, 9 aa, Homo Sapiens
RFNISTDQR

SEQ ID NO: 335887 - protein, 9 aa, Homo Sapiens
NLIFRYLHN

SEQ ID NO: 335888 - protein, 9 aa, Homo Sapiens
YLSAHWCPP

SEQ ID NO: 335889 - protein, 9 aa, Homo Sapiens
AATCLLLAS

SEQ ID NO: 335890 - protein, 9 aa, Homo Sapiens
KKIRTGEKP

SEQ ID NO: 335891 - protein, 9 aa, Homo Sapiens
PHCMESSKL

SEQ ID NO: 335892 - protein, 9 aa, Homo Sapiens
QLHKSDCNS

SEQ ID NO: 335893 - protein, 9 aa, Homo Sapiens
TRYKKLHNL

SEQ ID NO: 335894 - protein, 9 aa, Homo Sapiens
IHKHCVYYF

SEQ ID NO: 335895 - protein, 9 aa, Homo Sapiens
LLCKLFLDS

SEQ ID NO: 335896 - protein, 9 aa, Homo Sapiens
EDEHFLEMK

SEQ ID NO: 335897 - protein, 9 aa, Homo Sapiens
VTGSKTTND

SEQ ID NO: 335898 - protein, 9 aa, Homo Sapiens
TRDKLNYSI

SEQ ID NO: 335899 - protein, 9 aa, Homo Sapiens
FQLFQEAVP

SEQ ID NO: 335900 - protein, 9 aa, Homo Sapiens
KKYKLTGNF

SEQ ID NO: 335901 - protein, 9 aa, Homo Sapiens
SPLLCKTSK

SEQ ID NO: 335902 - protein, 9 aa, Homo Sapiens
GLNNFLHQL

SEQ ID NO: 335903 - protein, 9 aa, Homo Sapiens
KCFTFVLAV

SEQ ID NO: 335904 - protein, 9 aa, Homo Sapiens
YGKVLLAKC

SEQ ID NO: 335905 - protein, 9 aa, Homo Sapiens
RVVRHHKGG

SEQ ID NO: 335906 - protein, 9 aa, Homo Sapiens
MYIIEMPLL

SEQ ID NO: 335907 - protein, 9 aa, Homo Sapiens
VRKNNSPAL

SEQ ID NO: 335908 - protein, 9 aa, Homo Sapiens
LGDQGWQNN

SEQ ID NO: 335909 - protein, 9 aa, Homo Sapiens
LGYLAMVIE

SEQ ID NO: 335910 - protein, 9 aa, Homo Sapiens
CTGEKPYKC

SEQ ID NO: 335911 - protein, 9 aa, Homo Sapiens
VPTANRSGR

SEQ ID NO: 335912 - protein, 9 aa, Homo Sapiens
QEPHDKHRL

SEQ ID NO: 335913 - protein, 9 aa, Homo Sapiens
IIIFGTDIV

SEQ ID NO: 335914 - protein, 9 aa, Homo Sapiens
NGTDRTTEL

SEQ ID NO: 335915 - protein, 9 aa, Homo Sapiens
FHKRKHKHK

SEQ ID NO: 335916 - protein, 9 aa, Homo Sapiens
SVFACPILH

SEQ ID NO: 335917 - protein, 9 aa, Homo Sapiens
DTITQEDIE

SEQ ID NO: 335918 - protein, 9 aa, Homo Sapiens
NQDLISSKL

SEQ ID NO: 335919 - protein, 9 aa, Homo Sapiens
MTREEHKKF

SEQ ID NO: 335920 - protein, 9 aa, Homo Sapiens
LTNLLELEH

SEQ ID NO: 335921 - protein, 9 aa, Homo Sapiens
CVVCSTPQS

SEQ ID NO: 335922 - protein, 9 aa, Homo Sapiens
SLSDKSVKV

SEQ ID NO: 335923 - protein, 9 aa, Homo Sapiens
IIHNEERSY

SEQ ID NO: 335924 - protein, 9 aa, Homo Sapiens
GATEVEISM

SEQ ID NO: 335925 - protein, 9 aa, Homo Sapiens
LALGQKLWA

SEQ ID NO: 335926 - protein, 9 aa, Homo Sapiens
LLFQNPVYH

SEQ ID NO: 335927 - protein, 9 aa, Homo Sapiens
EKKNYAKRI

SEQ ID NO: 335928 - protein, 9 aa, Homo Sapiens
RKITKNLSE

SEQ ID NO: 335929 - protein, 9 aa, Homo Sapiens
YSFHHRIFF

SEQ ID NO: 335930 - protein, 9 aa, Homo Sapiens
KDSISHETA

SEQ ID NO: 335931 - protein, 9 aa, Homo Sapiens
DKSMFQLVV

SEQ ID NO: 335932 - protein, 9 aa, Homo Sapiens
DKEPVPWKF

SEQ ID NO: 335933 - protein, 9 aa, Homo Sapiens
ELVRILRTV

SEQ ID NO: 335934 - protein, 9 aa, Homo Sapiens
VCILMSIVC

SEQ ID NO: 335935 - protein, 9 aa, Homo Sapiens
YGGLGYGCA

SEQ ID NO: 335936 - protein, 9 aa, Homo Sapiens
LKNIISPLW

SEQ ID NO: 335937 - protein, 9 aa, Homo Sapiens
GMMSSFRSV

SEQ ID NO: 335938 - protein, 9 aa, Homo Sapiens
LKLACVDTH

SEQ ID NO: 335939 - protein, 9 aa, Homo Sapiens
PEQCCTKFK

SEQ ID NO: 335940 - protein, 9 aa, Homo Sapiens
DEEEEEEAA

SEQ ID NO: 335941 - protein, 9 aa, Homo Sapiens
FAVFQWPFS

SEQ ID NO: 335942 - protein, 9 aa, Homo Sapiens
SAAEQLLAA

SEQ ID NO: 335943 - protein, 9 aa, Homo Sapiens
YNHPHQFCS

SEQ ID NO: 335944 - protein, 9 aa, Homo Sapiens
VVKMGRVML

SEQ ID NO: 335945 - protein, 9 aa, Homo Sapiens
RSAILVTDT

SEQ ID NO: 335946 - protein, 9 aa, Homo Sapiens
EVIVIISHT

SEQ ID NO: 335947 - protein, 9 aa, Homo Sapiens
VTFLRYFSD

SEQ ID NO: 335948 - protein, 9 aa, Homo Sapiens
IEDIEEMMQ

SEQ ID NO: 335949 - protein, 9 aa, Homo Sapiens
DAYKITVAL

SEQ ID NO: 335950 - protein, 9 aa, Homo Sapiens
ICQAFYFAL

SEQ ID NO: 335951 - protein, 9 aa, Homo Sapiens
LLNTHVTQV

SEQ ID NO: 335952 - protein, 9 aa, Homo Sapiens
CCTKFKSLQ

SEQ ID NO: 335953 - protein, 9 aa, Homo Sapiens
PEDHSPISQ

SEQ ID NO: 335954 - protein, 9 aa, Homo Sapiens
KHSLERYLH

SEQ ID NO: 335955 - protein, 9 aa, Homo Sapiens
NENIIIVIF

SEQ ID NO: 335956 - protein, 9 aa, Homo Sapiens
EQILFINLC

SEQ ID NO: 335957 - protein, 9 aa, Homo Sapiens
RVSLVCKEL

SEQ ID NO: 335958 - protein, 9 aa, Homo Sapiens
MKDVKCHIT

SEQ ID NO: 335959 - protein, 9 aa, Homo Sapiens
RRPTMAKVV

SEQ ID NO: 335960 - protein, 9 aa, Homo Sapiens
ALKVIVTLS

SEQ ID NO: 335961 - protein, 9 aa, Homo Sapiens
LNQHLRVNT

SEQ ID NO: 335962 - protein, 9 aa, Homo Sapiens
STICRFEPL

SEQ ID NO: 335963 - protein, 9 aa, Homo Sapiens
GRTHSKEVN

SEQ ID NO: 335964 - protein, 9 aa, Homo Sapiens
ACVIHFMET

SEQ ID NO: 335965 - protein, 9 aa, Homo Sapiens
NNFLPHFGK

SEQ ID NO: 335966 - protein, 9 aa, Homo Sapiens
APIEDRRRA

SEQ ID NO: 335967 - protein, 9 aa, Homo Sapiens
EELLHMKAL

SEQ ID NO: 335968 - protein, 9 aa, Homo Sapiens
DLLVNQTIE

SEQ ID NO: 335969 - protein, 9 aa, Homo Sapiens
HMVDGGGRH

SEQ ID NO: 335970 - protein, 9 aa, Homo Sapiens
GSAAEQLLA

SEQ ID NO: 335971 - protein, 9 aa, Homo Sapiens
EEFLMSFTP

SEQ ID NO: 335972 - protein, 9 aa, Homo Sapiens
QKAHRLPEI

SEQ ID NO: 335973 - protein, 9 aa, Homo Sapiens
NDAHTKKAV

SEQ ID NO: 335974 - protein, 9 aa, Homo Sapiens
IPGKKSAVV

SEQ ID NO: 335975 - protein, 9 aa, Homo Sapiens
NSNTEEKFQ

SEQ ID NO: 335976 - protein, 9 aa, Homo Sapiens
NGFINEDVI

SEQ ID NO: 335977 - protein, 9 aa, Homo Sapiens
QNIQEMEER

SEQ ID NO: 335978 - protein, 9 aa, Homo Sapiens
CPQRALIGL

SEQ ID NO: 335979 - protein, 9 aa, Homo Sapiens
SCIILKIVD

SEQ ID NO: 335980 - protein, 9 aa, Homo Sapiens
KECAAIFHE

SEQ ID NO: 335981 - protein, 9 aa, Homo Sapiens
EKEIKECAA

SEQ ID NO: 335982 - protein, 9 aa, Homo Sapiens
RERDMQMGG

SEQ ID NO: 335983 - protein, 9 aa, Homo Sapiens
AQGDTWVTP

SEQ ID NO: 335984 - protein, 9 aa, Homo Sapiens
SVYYGCLHL

SEQ ID NO: 335985 - protein, 9 aa, Homo Sapiens
EDADISAFE

SEQ ID NO: 335986 - protein, 9 aa, Homo Sapiens
REWYSSLFV

SEQ ID NO: 335987 - protein, 9 aa, Homo Sapiens
VKCLHNNER

SEQ ID NO: 335988 - protein, 9 aa, Homo Sapiens
LRGYLLGQS

SEQ ID NO: 335989 - protein, 9 aa, Homo Sapiens
PEGIDDFVQ

SEQ ID NO: 335990 - protein, 9 aa, Homo Sapiens
AFCYWAKLC

SEQ ID NO: 335991 - protein, 9 aa, Homo Sapiens
VIHEVQCFG

SEQ ID NO: 335992 - protein, 9 aa, Homo Sapiens
EAFLNSYST

SEQ ID NO: 335993 - protein, 9 aa, Homo Sapiens
FLAARLPLD

SEQ ID NO: 335994 - protein, 9 aa, Homo Sapiens
SVVLKTLRK

SEQ ID NO: 335995 - protein, 9 aa, Homo Sapiens
LVDLQNYQY

SEQ ID NO: 335996 - protein, 9 aa, Homo Sapiens
LAAIAPSIT

SEQ ID NO: 335997 - protein, 9 aa, Homo Sapiens
LVMETREGL

SEQ ID NO: 335998 - protein, 9 aa, Homo Sapiens
YVEQYLLEK

SEQ ID NO: 335999 - protein, 9 aa, Homo Sapiens
VCFGEGSLL

SEQ ID NO: 336000 - protein, 9 aa, Homo Sapiens
ADFSVPVEI

SEQ ID NO: 336001 - protein, 9 aa, Homo Sapiens
GGGDNDKLG

SEQ ID NO: 336002 - protein, 9 aa, Homo Sapiens
DSEVNVNDA

SEQ ID NO: 336003 - protein, 9 aa, Homo Sapiens
NAMLKNICE

SEQ ID NO: 336004 - protein, 9 aa, Homo Sapiens
LAFCYWAKL

SEQ ID NO: 336005 - protein, 9 aa, Homo Sapiens
WNPSIYEKL

SEQ ID NO: 336006 - protein, 9 aa, Homo Sapiens
LQPGDWIML

SEQ ID NO: 336007 - protein, 9 aa, Homo Sapiens
CEWAVFRLT

SEQ ID NO: 336008 - protein, 9 aa, Homo Sapiens
LENLVMSDK

SEQ ID NO: 336009 - protein, 9 aa, Homo Sapiens
CRDRLENTI

SEQ ID NO: 336010 - protein, 9 aa, Homo Sapiens
SHLKKKLDN

SEQ ID NO: 336011 - protein, 9 aa, Homo Sapiens
VRIEVVGIN

SEQ ID NO: 336012 - protein, 9 aa, Homo Sapiens
FSVGGWNFG

SEQ ID NO: 336013 - protein, 9 aa, Homo Sapiens
EKIMWTTVH

SEQ ID NO: 336014 - protein, 9 aa, Homo Sapiens
QALVEFGDV

SEQ ID NO: 336015 - protein, 9 aa, Homo Sapiens
LFVLDVVIN

SEQ ID NO: 336016 - protein, 9 aa, Homo Sapiens
AWDNHRLRN

SEQ ID NO: 336017 - protein, 9 aa, Homo Sapiens
FTVKHEQNT

SEQ ID NO: 336018 - protein, 9 aa, Homo Sapiens
DITEGINEA

SEQ ID NO: 336019 - protein, 9 aa, Homo Sapiens
PAVVLTSYH

SEQ ID NO: 336020 - protein, 9 aa, Homo Sapiens
DWRMLGTRA

SEQ ID NO: 336021 - protein, 9 aa, Homo Sapiens
WMGGNNPFL

SEQ ID NO: 336022 - protein, 9 aa, Homo Sapiens
ELFLGMHPE

SEQ ID NO: 336023 - protein, 9 aa, Homo Sapiens
EQLQCEHCA

SEQ ID NO: 336024 - protein, 9 aa, Homo Sapiens
KHCVYYFKS

SEQ ID NO: 336025 - protein, 9 aa, Homo Sapiens
RPSLSGKLH

SEQ ID NO: 336026 - protein, 9 aa, Homo Sapiens
GYSGTSDQI

SEQ ID NO: 336027 - protein, 9 aa, Homo Sapiens
STLTGLPWS

SEQ ID NO: 336028 - protein, 9 aa, Homo Sapiens
LSFPTKSPT

SEQ ID NO: 336029 - protein, 9 aa, Homo Sapiens
LTLKGVAEL

SEQ ID NO: 336030 - protein, 9 aa, Homo Sapiens
IFKQYSHSE

SEQ ID NO: 336031 - protein, 9 aa, Homo Sapiens
AKQMKVAKN

SEQ ID NO: 336032 - protein, 9 aa, Homo Sapiens
VKNVSARTD

SEQ ID NO: 336033 - protein, 9 aa, Homo Sapiens
TSILDHLNW

SEQ ID NO: 336034 - protein, 9 aa, Homo Sapiens
EVKCKGNEY

SEQ ID NO: 336035 - protein, 9 aa, Homo Sapiens
KELIEDDSE

SEQ ID NO: 336036 - protein, 9 aa, Homo Sapiens
MFIHFIEEC

SEQ ID NO: 336037 - protein, 9 aa, Homo Sapiens
AQNSQLDPD

SEQ ID NO: 336038 - protein, 9 aa, Homo Sapiens
AKEMKQITE

SEQ ID NO: 336039 - protein, 9 aa, Homo Sapiens
FLHDNSLHQ

SEQ ID NO: 336040 - protein, 9 aa, Homo Sapiens
LCTPEGIQL

SEQ ID NO: 336041 - protein, 9 aa, Homo Sapiens
EKKKPHINK

SEQ ID NO: 336042 - protein, 9 aa, Homo Sapiens
ERLMERYAP

SEQ ID NO: 336043 - protein, 9 aa, Homo Sapiens
DELYAIMKM

SEQ ID NO: 336044 - protein, 9 aa, Homo Sapiens
FDYSPIRFC

SEQ ID NO: 336045 - protein, 9 aa, Homo Sapiens
DDEGAPQIS

SEQ ID NO: 336046 - protein, 9 aa, Homo Sapiens
KMILSTHRN

SEQ ID NO: 336047 - protein, 9 aa, Homo Sapiens
FRFPLHLQP

SEQ ID NO: 336048 - protein, 9 aa, Homo Sapiens
YTLRVQALD

SEQ ID NO: 336049 - protein, 9 aa, Homo Sapiens
TQLEENEEC

SEQ ID NO: 336050 - protein, 9 aa, Homo Sapiens
DHNCSENKP

SEQ ID NO: 336051 - protein, 9 aa, Homo Sapiens
SILGRNHTH

SEQ ID NO: 336052 - protein, 9 aa, Homo Sapiens
KTKAGATVT

SEQ ID NO: 336053 - protein, 9 aa, Homo Sapiens
QFQLFQEAV

SEQ ID NO: 336054 - protein, 9 aa, Homo Sapiens
LQLASPSGL

SEQ ID NO: 336055 - protein, 9 aa, Homo Sapiens
CLPEINNWL

SEQ ID NO: 336056 - protein, 9 aa, Homo Sapiens
LFFRICPIF

SEQ ID NO: 336057 - protein, 9 aa, Homo Sapiens
GHIAHLNLQ

SEQ ID NO: 336058 - protein, 9 aa, Homo Sapiens
FNCSVPSYL

SEQ ID NO: 336059 - protein, 9 aa, Homo Sapiens
EWYNVDFQR

SEQ ID NO: 336060 - protein, 9 aa, Homo Sapiens
AIVGSVKLL

SEQ ID NO: 336061 - protein, 9 aa, Homo Sapiens
KPHKVCASG

SEQ ID NO: 336062 - protein, 9 aa, Homo Sapiens
EEGDVPRRS

SEQ ID NO: 336063 - protein, 9 aa, Homo Sapiens
SPKCDGLGT

SEQ ID NO: 336064 - protein, 9 aa, Homo Sapiens
SFLLTIMGY

SEQ ID NO: 336065 - protein, 9 aa, Homo Sapiens
NLEIYKGSC

SEQ ID NO: 336066 - protein, 9 aa, Homo Sapiens
SLVIEKLSK

SEQ ID NO: 336067 - protein, 9 aa, Homo Sapiens
KTTRSGTLF

SEQ ID NO: 336068 - protein, 9 aa, Homo Sapiens
TCQQQISDS

SEQ ID NO: 336069 - protein, 9 aa, Homo Sapiens
VHHIDNVFD

SEQ ID NO: 336070 - protein, 9 aa, Homo Sapiens
SLHGCLAAI

SEQ ID NO: 336071 - protein, 9 aa, Homo Sapiens
VTKRTNGKG

SEQ ID NO: 336072 - protein, 9 aa, Homo Sapiens
VTITISDTN

SEQ ID NO: 336073 - protein, 9 aa, Homo Sapiens
IVASEAGEH

SEQ ID NO: 336074 - protein, 9 aa, Homo Sapiens
GERVHTLVL

SEQ ID NO: 336075 - protein, 9 aa, Homo Sapiens
IYSLIDKNK

SEQ ID NO: 336076 - protein, 9 aa, Homo Sapiens
EVDTYWPFQ

SEQ ID NO: 336077 - protein, 9 aa, Homo Sapiens
LNLISNLWD

SEQ ID NO: 336078 - protein, 9 aa, Homo Sapiens
KGHFHRVVR

SEQ ID NO: 336079 - protein, 9 aa, Homo Sapiens
SMEAPKIFK

SEQ ID NO: 336080 - protein, 9 aa, Homo Sapiens
VNCLGIYEQ

SEQ ID NO: 336081 - protein, 9 aa, Homo Sapiens
TVLLTAPWE

SEQ ID NO: 336082 - protein, 9 aa, Homo Sapiens
IRHTENKSF

SEQ ID NO: 336083 - protein, 9 aa, Homo Sapiens
IKCRITWDK

SEQ ID NO: 336084 - protein, 9 aa, Homo Sapiens
AAERLRTLP

SEQ ID NO: 336085 - protein, 9 aa, Homo Sapiens
TTLGSHLMS

SEQ ID NO: 336086 - protein, 9 aa, Homo Sapiens
SNQFISHQQ

SEQ ID NO: 336087 - protein, 9 aa, Homo Sapiens
AVIALHHGR

SEQ ID NO: 336088 - protein, 9 aa, Homo Sapiens
TIDGLLMLL

SEQ ID NO: 336089 - protein, 9 aa, Homo Sapiens
ESSNGTDRT

SEQ ID NO: 336090 - protein, 9 aa, Homo Sapiens
LKLDNLVYY

SEQ ID NO: 336091 - protein, 9 aa, Homo Sapiens
MHSPPSNVA

SEQ ID NO: 336092 - protein, 9 aa, Homo Sapiens
QHCPLYKSS

SEQ ID NO: 336093 - protein, 9 aa, Homo Sapiens
PQKSSLTQM

SEQ ID NO: 336094 - protein, 9 aa, Homo Sapiens
FKTRKLAGP

SEQ ID NO: 336095 - protein, 9 aa, Homo Sapiens
TRKKIIAYI

SEQ ID NO: 336096 - protein, 9 aa, Homo Sapiens
ITKQIRLRY

SEQ ID NO: 336097 - protein, 9 aa, Homo Sapiens
ETQNAAWRK

SEQ ID NO: 336098 - protein, 9 aa, Homo Sapiens
FYSEDVVYY

SEQ ID NO: 336099 - protein, 9 aa, Homo Sapiens
PNLKTLFSV

SEQ ID NO: 336100 - protein, 9 aa, Homo Sapiens
NNVLTLEQI

SEQ ID NO: 336101 - protein, 9 aa, Homo Sapiens
YDVFRSNNF

SEQ ID NO: 336102 - protein, 9 aa, Homo Sapiens
LLVLAFLDT

SEQ ID NO: 336103 - protein, 9 aa, Homo Sapiens
CRFADNDIG

SEQ ID NO: 336104 - protein, 9 aa, Homo Sapiens
WPKQGLKDY

SEQ ID NO: 336105 - protein, 9 aa, Homo Sapiens
GFKMLAVGV

SEQ ID NO: 336106 - protein, 9 aa, Homo Sapiens
SSSEDITPL

SEQ ID NO: 336107 - protein, 9 aa, Homo Sapiens
KNLIQQISS

SEQ ID NO: 336108 - protein, 9 aa, Homo Sapiens
EADLRNPQL

SEQ ID NO: 336109 - protein, 9 aa, Homo Sapiens
IQTKPSDII

SEQ ID NO: 336110 - protein, 9 aa, Homo Sapiens
NHVPNNLFF

SEQ ID NO: 336111 - protein, 9 aa, Homo Sapiens
YVKAGKRSP

SEQ ID NO: 336112 - protein, 9 aa, Homo Sapiens
HQCILWFLQ

SEQ ID NO: 336113 - protein, 9 aa, Homo Sapiens
QENSQAFNP

SEQ ID NO: 336114 - protein, 9 aa, Homo Sapiens
PCGWPACHI

SEQ ID NO: 336115 - protein, 9 aa, Homo Sapiens
FKCRFSLSV

SEQ ID NO: 336116 - protein, 9 aa, Homo Sapiens
CIRFILGEE

SEQ ID NO: 336117 - protein, 9 aa, Homo Sapiens
TSPEYLNLP

SEQ ID NO: 336118 - protein, 9 aa, Homo Sapiens
MLACLHFSP

SEQ ID NO: 336119 - protein, 9 aa, Homo Sapiens
TGERPRYLD

SEQ ID NO: 336120 - protein, 9 aa, Homo Sapiens
PHINKPLNA

SEQ ID NO: 336121 - protein, 9 aa, Homo Sapiens
RLLTILCEE

SEQ ID NO: 336122 - protein, 9 aa, Homo Sapiens
LKRSSKSLN

SEQ ID NO: 336123 - protein, 9 aa, Homo Sapiens
SKKVEEESK

SEQ ID NO: 336124 - protein, 9 aa, Homo Sapiens
VIETGAAPI

SEQ ID NO: 336125 - protein, 9 aa, Homo Sapiens
STVFGSSGN

SEQ ID NO: 336126 - protein, 9 aa, Homo Sapiens
PRLPRSPCL

SEQ ID NO: 336127 - protein, 9 aa, Homo Sapiens
QHLQRLQSY

SEQ ID NO: 336128 - protein, 9 aa, Homo Sapiens
KIMWTTVHP

SEQ ID NO: 336129 - protein, 9 aa, Homo Sapiens
PLWYPLLMN

SEQ ID NO: 336130 - protein, 9 aa, Homo Sapiens
RVCGHSSGP

SEQ ID NO: 336131 - protein, 9 aa, Homo Sapiens
PNKAIPGKK

SEQ ID NO: 336132 - protein, 9 aa, Homo Sapiens
QKIVTERSV

SEQ ID NO: 336133 - protein, 9 aa, Homo Sapiens
QENLTPQQN

SEQ ID NO: 336134 - protein, 9 aa, Homo Sapiens
ITDVPIEIQ

SEQ ID NO: 336135 - protein, 9 aa, Homo Sapiens
VSFYIVTLN

SEQ ID NO: 336136 - protein, 9 aa, Homo Sapiens
VNEISHHLG

SEQ ID NO: 336137 - protein, 9 aa, Homo Sapiens
LKWWSATVV

SEQ ID NO: 336138 - protein, 9 aa, Homo Sapiens
SPDGLACYW

SEQ ID NO: 336139 - protein, 9 aa, Homo Sapiens
ERFIESSTK

SEQ ID NO: 336140 - protein, 9 aa, Homo Sapiens
TTTEENGEK

SEQ ID NO: 336141 - protein, 9 aa, Homo Sapiens
LPLRQHHSD

SEQ ID NO: 336142 - protein, 9 aa, Homo Sapiens
PARNAKLQY

SEQ ID NO: 336143 - protein, 9 aa, Homo Sapiens
LTPLIKAGL

SEQ ID NO: 336144 - protein, 9 aa, Homo Sapiens
IYSIYPMHN

SEQ ID NO: 336145 - protein, 9 aa, Homo Sapiens
YADNLPGNV

SEQ ID NO: 336146 - protein, 9 aa, Homo Sapiens
ELIGISEDQ

SEQ ID NO: 336147 - protein, 9 aa, Homo Sapiens
VGAGYPVQW

SEQ ID NO: 336148 - protein, 9 aa, Homo Sapiens
DTEDPTLNY

SEQ ID NO: 336149 - protein, 9 aa, Homo Sapiens
QKEKHHVNM

SEQ ID NO: 336150 - protein, 9 aa, Homo Sapiens
LCELKEVAK

SEQ ID NO: 336151 - protein, 9 aa, Homo Sapiens
SYKSKFKRR

SEQ ID NO: 336152 - protein, 9 aa, Homo Sapiens
ITKSTQTQD

SEQ ID NO: 336153 - protein, 9 aa, Homo Sapiens
EGEEEVKEE

SEQ ID NO: 336154 - protein, 9 aa, Homo Sapiens
SAATCLLLA

SEQ ID NO: 336155 - protein, 9 aa, Homo Sapiens
LQVKTTNVQ

SEQ ID NO: 336156 - protein, 9 aa, Homo Sapiens
FIIISYARI

SEQ ID NO: 336157 - protein, 9 aa, Homo Sapiens
LSTPPTAAL

SEQ ID NO: 336158 - protein, 9 aa, Homo Sapiens
LEGGLKQFY

SEQ ID NO: 336159 - protein, 9 aa, Homo Sapiens
SEKLKYLFD

SEQ ID NO: 336160 - protein, 9 aa, Homo Sapiens
AIASRQEAV

SEQ ID NO: 336161 - protein, 9 aa, Homo Sapiens
PIILVGPPL

SEQ ID NO: 336162 - protein, 9 aa, Homo Sapiens
LQIRVPPVP

SEQ ID NO: 336163 - protein, 9 aa, Homo Sapiens
FRKNKMKEQ

SEQ ID NO: 336164 - protein, 9 aa, Homo Sapiens
GPNAQAAIS

SEQ ID NO: 336165 - protein, 9 aa, Homo Sapiens
ASDQSEFRE

SEQ ID NO: 336166 - protein, 9 aa, Homo Sapiens
TGDKPFQCN

SEQ ID NO: 336167 - protein, 9 aa, Homo Sapiens
IYNAGVAFV

SEQ ID NO: 336168 - protein, 9 aa, Homo Sapiens
KHVTVARPH

SEQ ID NO: 336169 - protein, 9 aa, Homo Sapiens
ERKKAKIIL

SEQ ID NO: 336170 - protein, 9 aa, Homo Sapiens
HFSPKQQYK

SEQ ID NO: 336171 - protein, 9 aa, Homo Sapiens
WDFRNKTDL

SEQ ID NO: 336172 - protein, 9 aa, Homo Sapiens
SELQLRVQQ

SEQ ID NO: 336173 - protein, 9 aa, Homo Sapiens
FLGPEMTVL

SEQ ID NO: 336174 - protein, 9 aa, Homo Sapiens
QEPEKALHI

SEQ ID NO: 336175 - protein, 9 aa, Homo Sapiens
KVRKGKKRN

SEQ ID NO: 336176 - protein, 9 aa, Homo Sapiens
NKIAIPNEE

SEQ ID NO: 336177 - protein, 9 aa, Homo Sapiens
DCYDSDRYR

SEQ ID NO: 336178 - protein, 9 aa, Homo Sapiens
SKLFSEENS

SEQ ID NO: 336179 - protein, 9 aa, Homo Sapiens
QNAREMTLQ

SEQ ID NO: 336180 - protein, 9 aa, Homo Sapiens
AKPNLLSML

SEQ ID NO: 336181 - protein, 9 aa, Homo Sapiens
AKQQRKKME

SEQ ID NO: 336182 - protein, 9 aa, Homo Sapiens
DIDKALTVS

SEQ ID NO: 336183 - protein, 9 aa, Homo Sapiens
FADFVYKRI

SEQ ID NO: 336184 - protein, 9 aa, Homo Sapiens
VTLGEEDLS

SEQ ID NO: 336185 - protein, 9 aa, Homo Sapiens
SQIRGTERP

SEQ ID NO: 336186 - protein, 9 aa, Homo Sapiens
EGATEVEIS

SEQ ID NO: 336187 - protein, 9 aa, Homo Sapiens
INNELSHLL

SEQ ID NO: 336188 - protein, 9 aa, Homo Sapiens
LAPGETITG

SEQ ID NO: 336189 - protein, 9 aa, Homo Sapiens
QGYHFTTDS

SEQ ID NO: 336190 - protein, 9 aa, Homo Sapiens
IQSSFASCL

SEQ ID NO: 336191 - protein, 9 aa, Homo Sapiens
EETTLGSHL

SEQ ID NO: 336192 - protein, 9 aa, Homo Sapiens
VHSGTRIQQ

SEQ ID NO: 336193 - protein, 9 aa, Homo Sapiens
SLTPATFNE

SEQ ID NO: 336194 - protein, 9 aa, Homo Sapiens
YTFEKNFSR

SEQ ID NO: 336195 - protein, 9 aa, Homo Sapiens
LITITLGTK

SEQ ID NO: 336196 - protein, 9 aa, Homo Sapiens
QQQLPKQFL

SEQ ID NO: 336197 - protein, 9 aa, Homo Sapiens
EFTLKRFTK

SEQ ID NO: 336198 - protein, 9 aa, Homo Sapiens
LQTMDQALK

SEQ ID NO: 336199 - protein, 9 aa, Homo Sapiens
LANNCTKLK

SEQ ID NO: 336200 - protein, 9 aa, Homo Sapiens
ATDVGKINL

SEQ ID NO: 336201 - protein, 9 aa, Homo Sapiens
EKEELKNMK

SEQ ID NO: 336202 - protein, 9 aa, Homo Sapiens
FDWKAYIQD

SEQ ID NO: 336203 - protein, 9 aa, Homo Sapiens
NIVTWVSGS

SEQ ID NO: 336204 - protein, 9 aa, Homo Sapiens
SMKPQADVA

SEQ ID NO: 336205 - protein, 9 aa, Homo Sapiens
ELFRLVSER

SEQ ID NO: 336206 - protein, 9 aa, Homo Sapiens
SGADGGTLV

SEQ ID NO: 336207 - protein, 9 aa, Homo Sapiens
ESSQGQFSV

SEQ ID NO: 336208 - protein, 9 aa, Homo Sapiens
MCLTDQSYI

SEQ ID NO: 336209 - protein, 9 aa, Homo Sapiens
VLKEGDEKL

SEQ ID NO: 336210 - protein, 9 aa, Homo Sapiens
CICCPVGTY

SEQ ID NO: 336211 - protein, 9 aa, Homo Sapiens
PEEIKELQV

SEQ ID NO: 336212 - protein, 9 aa, Homo Sapiens
LTTHKRTHT

SEQ ID NO: 336213 - protein, 9 aa, Homo Sapiens
RGQVYSKLK

SEQ ID NO: 336214 - protein, 9 aa, Homo Sapiens
PTGYIRFKK

SEQ ID NO: 336215 - protein, 9 aa, Homo Sapiens
NAKPNLLSM

SEQ ID NO: 336216 - protein, 9 aa, Homo Sapiens
IFQCQVNLI

SEQ ID NO: 336217 - protein, 9 aa, Homo Sapiens
TYHKITHTG

SEQ ID NO: 336218 - protein, 9 aa, Homo Sapiens
EIAKLFPGR

SEQ ID NO: 336219 - protein, 9 aa, Homo Sapiens
SSEDPGFYS

SEQ ID NO: 336220 - protein, 9 aa, Homo Sapiens
LEIGTHDKM

SEQ ID NO: 336221 - protein, 9 aa, Homo Sapiens
KNSCPVSLG

SEQ ID NO: 336222 - protein, 9 aa, Homo Sapiens
GTSSDLMAQ

SEQ ID NO: 336223 - protein, 9 aa, Homo Sapiens
GNVFVWLLN

SEQ ID NO: 336224 - protein, 9 aa, Homo Sapiens
DTLEHLLKA

SEQ ID NO: 336225 - protein, 9 aa, Homo Sapiens
EVTLKNKTS

SEQ ID NO: 336226 - protein, 9 aa, Homo Sapiens
EINLLSVAY

SEQ ID NO: 336227 - protein, 9 aa, Homo Sapiens
EAQGDTWVT

SEQ ID NO: 336228 - protein, 9 aa, Homo Sapiens
EIEYLEKQC

SEQ ID NO: 336229 - protein, 9 aa, Homo Sapiens
KIIYRPSGA

SEQ ID NO: 336230 - protein, 9 aa, Homo Sapiens
SLGPSIFRV

SEQ ID NO: 336231 - protein, 9 aa, Homo Sapiens
TFFFIIISY

SEQ ID NO: 336232 - protein, 9 aa, Homo Sapiens
KMDLDHNCS

SEQ ID NO: 336233 - protein, 9 aa, Homo Sapiens
FLALKKHVI

SEQ ID NO: 336234 - protein, 9 aa, Homo Sapiens
FHLFEDSLE

SEQ ID NO: 336235 - protein, 9 aa, Homo Sapiens
ALLNTHVTQ

SEQ ID NO: 336236 - protein, 9 aa, Homo Sapiens
VDIQLSLKR

SEQ ID NO: 336237 - protein, 9 aa, Homo Sapiens
VLQAETLVT

SEQ ID NO: 336238 - protein, 9 aa, Homo Sapiens
EDPGFYSPL

SEQ ID NO: 336239 - protein, 9 aa, Homo Sapiens
LQGLVSPSG

SEQ ID NO: 336240 - protein, 9 aa, Homo Sapiens
LDKCNDIIN

SEQ ID NO: 336241 - protein, 9 aa, Homo Sapiens
IQIGILIGI

SEQ ID NO: 336242 - protein, 9 aa, Homo Sapiens
FIKRTSAQV

SEQ ID NO: 336243 - protein, 9 aa, Homo Sapiens
TPEAGIHQG

SEQ ID NO: 336244 - protein, 9 aa, Homo Sapiens
VCVRPENTK

SEQ ID NO: 336245 - protein, 9 aa, Homo Sapiens
HRPMYFVLG

SEQ ID NO: 336246 - protein, 9 aa, Homo Sapiens
IASGWHPHE

SEQ ID NO: 336247 - protein, 9 aa, Homo Sapiens
IRQEHFGGA

SEQ ID NO: 336248 - protein, 9 aa, Homo Sapiens
VIFIPSSPG

SEQ ID NO: 336249 - protein, 9 aa, Homo Sapiens
DAMLHFSLF

SEQ ID NO: 336250 - protein, 9 aa, Homo Sapiens
QTSCYCPNN

SEQ ID NO: 336251 - protein, 9 aa, Homo Sapiens
LNPSGDYYY

SEQ ID NO: 336252 - protein, 9 aa, Homo Sapiens
RYKKLHNLT

SEQ ID NO: 336253 - protein, 9 aa, Homo Sapiens
TQRMQHNRH

SEQ ID NO: 336254 - protein, 9 aa, Homo Sapiens
LCMYQNATG

SEQ ID NO: 336255 - protein, 9 aa, Homo Sapiens
STPQISLSP

SEQ ID NO: 336256 - protein, 9 aa, Homo Sapiens
FFCFFFFFL

SEQ ID NO: 336257 - protein, 9 aa, Homo Sapiens
QSRRRFWKI

SEQ ID NO: 336258 - protein, 9 aa, Homo Sapiens
KTPEYNIKM

SEQ ID NO: 336259 - protein, 9 aa, Homo Sapiens
HLNRHETIH

SEQ ID NO: 336260 - protein, 9 aa, Homo Sapiens
ALQHRLVVL

SEQ ID NO: 336261 - protein, 9 aa, Homo Sapiens
AQSQIGFIN

SEQ ID NO: 336262 - protein, 9 aa, Homo Sapiens
QGDNGDPGP

SEQ ID NO: 336263 - protein, 9 aa, Homo Sapiens
NKIALEASF

SEQ ID NO: 336264 - protein, 9 aa, Homo Sapiens
MQHRSFIIQ

SEQ ID NO: 336265 - protein, 9 aa, Homo Sapiens
WAFRGPKNG

SEQ ID NO: 336266 - protein, 9 aa, Homo Sapiens
SYEMQNAVN

SEQ ID NO: 336267 - protein, 9 aa, Homo Sapiens
NGEHTERHA

SEQ ID NO: 336268 - protein, 9 aa, Homo Sapiens
QARRAHRQI

SEQ ID NO: 336269 - protein, 9 aa, Homo Sapiens
FSSKYPDFH

SEQ ID NO: 336270 - protein, 9 aa, Homo Sapiens
AENETSFKQ

SEQ ID NO: 336271 - protein, 9 aa, Homo Sapiens
PSREGGDES

SEQ ID NO: 336272 - protein, 9 aa, Homo Sapiens
KRKVTDSIS

SEQ ID NO: 336273 - protein, 9 aa, Homo Sapiens
LYYSDTKGN

SEQ ID NO: 336274 - protein, 9 aa, Homo Sapiens
ACKIHDGMF

SEQ ID NO: 336275 - protein, 9 aa, Homo Sapiens
MKNFKCRFS

SEQ ID NO: 336276 - protein, 9 aa, Homo Sapiens
YLAFQDLQN

SEQ ID NO: 336277 - protein, 9 aa, Homo Sapiens
FALPGNPVL

SEQ ID NO: 336278 - protein, 9 aa, Homo Sapiens
KQRLSLKAE

SEQ ID NO: 336279 - protein, 9 aa, Homo Sapiens
EAQKHLKMA

SEQ ID NO: 336280 - protein, 9 aa, Homo Sapiens
TDKEHNSNE

SEQ ID NO: 336281 - protein, 9 aa, Homo Sapiens
LKDFDGTQA

SEQ ID NO: 336282 - protein, 9 aa, Homo Sapiens
EDNWNWDTW

SEQ ID NO: 336283 - protein, 9 aa, Homo Sapiens
YLHNQNGSE

SEQ ID NO: 336284 - protein, 9 aa, Homo Sapiens
VSLVCKKHM

SEQ ID NO: 336285 - protein, 9 aa, Homo Sapiens
LSLDMLKQL

SEQ ID NO: 336286 - protein, 9 aa, Homo Sapiens
TDLRTGLST

SEQ ID NO: 336287 - protein, 9 aa, Homo Sapiens
WGTLSRSQS

SEQ ID NO: 336288 - protein, 9 aa, Homo Sapiens
RSHTRERRY

SEQ ID NO: 336289 - protein, 9 aa, Homo Sapiens
RGQVREVCK

SEQ ID NO: 336290 - protein, 9 aa, Homo Sapiens
LFITCSKCD

SEQ ID NO: 336291 - protein, 9 aa, Homo Sapiens
TKFKAPQYA

SEQ ID NO: 336292 - protein, 9 aa, Homo Sapiens
LVNQTIEKV

SEQ ID NO: 336293 - protein, 9 aa, Homo Sapiens
KHFGWEADL

SEQ ID NO: 336294 - protein, 9 aa, Homo Sapiens
FVIAYIYAQ

SEQ ID NO: 336295 - protein, 9 aa, Homo Sapiens
CSLGDTQHR

SEQ ID NO: 336296 - protein, 9 aa, Homo Sapiens
PWLSETSLV

SEQ ID NO: 336297 - protein, 9 aa, Homo Sapiens
AEDRTHNII

SEQ ID NO: 336298 - protein, 9 aa, Homo Sapiens
YTFRGFWST

SEQ ID NO: 336299 - protein, 9 aa, Homo Sapiens
LTDLMTKAE

SEQ ID NO: 336300 - protein, 9 aa, Homo Sapiens
ASKESKPKQ

SEQ ID NO: 336301 - protein, 9 aa, Homo Sapiens
ISEEDKLDV

SEQ ID NO: 336302 - protein, 9 aa, Homo Sapiens
IEHEHKLSP

SEQ ID NO: 336303 - protein, 9 aa, Homo Sapiens
PQPQGQETE

SEQ ID NO: 336304 - protein, 9 aa, Homo Sapiens
PIHSLETLL

SEQ ID NO: 336305 - protein, 9 aa, Homo Sapiens
MDLDHNCSE

SEQ ID NO: 336306 - protein, 9 aa, Homo Sapiens
VCRDRLENT

SEQ ID NO: 336307 - protein, 9 aa, Homo Sapiens
FYPASVYPR

SEQ ID NO: 336308 - protein, 9 aa, Homo Sapiens
FQQIGERLG

SEQ ID NO: 336309 - protein, 9 aa, Homo Sapiens
QATKQFLKE

SEQ ID NO: 336310 - protein, 9 aa, Homo Sapiens
DTHTVIIFP

SEQ ID NO: 336311 - protein, 9 aa, Homo Sapiens
ADQKLSVTF

SEQ ID NO: 336312 - protein, 9 aa, Homo Sapiens
KISEEDKLD

SEQ ID NO: 336313 - protein, 9 aa, Homo Sapiens
CVKTFCWST

SEQ ID NO: 336314 - protein, 9 aa, Homo Sapiens
NRHSLQDPS

SEQ ID NO: 336315 - protein, 9 aa, Homo Sapiens
NCFENVLIS

SEQ ID NO: 336316 - protein, 9 aa, Homo Sapiens
LFNVTVTMT

SEQ ID NO: 336317 - protein, 9 aa, Homo Sapiens
HYILYLTDI

SEQ ID NO: 336318 - protein, 9 aa, Homo Sapiens
TAADGKTTH

SEQ ID NO: 336319 - protein, 9 aa, Homo Sapiens
NTVSKCKRE

SEQ ID NO: 336320 - protein, 9 aa, Homo Sapiens
ILSPLGQIN

SEQ ID NO: 336321 - protein, 9 aa, Homo Sapiens
DEFIKAITD

SEQ ID NO: 336322 - protein, 9 aa, Homo Sapiens
SQNSRDAIA

SEQ ID NO: 336323 - protein, 9 aa, Homo Sapiens
TMDTDDPQI

SEQ ID NO: 336324 - protein, 9 aa, Homo Sapiens
HPKYWCQGY

SEQ ID NO: 336325 - protein, 9 aa, Homo Sapiens
LSQTAQRSA

SEQ ID NO: 336326 - protein, 9 aa, Homo Sapiens
PSENNKLTC

SEQ ID NO: 336327 - protein, 9 aa, Homo Sapiens
MDINEEELT

SEQ ID NO: 336328 - protein, 9 aa, Homo Sapiens
KNWTSYMRH

SEQ ID NO: 336329 - protein, 9 aa, Homo Sapiens
VTVSPEQNN

SEQ ID NO: 336330 - protein, 9 aa, Homo Sapiens
KRECQLVCG

SEQ ID NO: 336331 - protein, 9 aa, Homo Sapiens
LDCNGFDSH

SEQ ID NO: 336332 - protein, 9 aa, Homo Sapiens
FQTHPSATL

SEQ ID NO: 336333 - protein, 9 aa, Homo Sapiens
LVVQTVGSR

SEQ ID NO: 336334 - protein, 9 aa, Homo Sapiens
LTVHRQTHT

SEQ ID NO: 336335 - protein, 9 aa, Homo Sapiens
VEQETWCET

SEQ ID NO: 336336 - protein, 9 aa, Homo Sapiens
KVWMANEGF

SEQ ID NO: 336337 - protein, 9 aa, Homo Sapiens
EKSNEETDS

SEQ ID NO: 336338 - protein, 9 aa, Homo Sapiens
RGALVGLSS

SEQ ID NO: 336339 - protein, 9 aa, Homo Sapiens
KVLEGMSLG

SEQ ID NO: 336340 - protein, 9 aa, Homo Sapiens
LNHNSGWGP

SEQ ID NO: 336341 - protein, 9 aa, Homo Sapiens
MFASRRKQC

SEQ ID NO: 336342 - protein, 9 aa, Homo Sapiens
EAKQLFARL

SEQ ID NO: 336343 - protein, 9 aa, Homo Sapiens
KEVTELYVQ

SEQ ID NO: 336344 - protein, 9 aa, Homo Sapiens
FIDKVWFLE

SEQ ID NO: 336345 - protein, 9 aa, Homo Sapiens
AMRKAAIVI

SEQ ID NO: 336346 - protein, 9 aa, Homo Sapiens
APEQVVPIQ

SEQ ID NO: 336347 - protein, 9 aa, Homo Sapiens
TEGPTDALA

SEQ ID NO: 336348 - protein, 9 aa, Homo Sapiens
VERCGKILF

SEQ ID NO: 336349 - protein, 9 aa, Homo Sapiens
MFSKQTIEL

SEQ ID NO: 336350 - protein, 9 aa, Homo Sapiens
DEEWKIIRT

SEQ ID NO: 336351 - protein, 9 aa, Homo Sapiens
TNTAERGNY

SEQ ID NO: 336352 - protein, 9 aa, Homo Sapiens
HATLKPEQS

SEQ ID NO: 336353 - protein, 9 aa, Homo Sapiens
LSVKEVPCL

SEQ ID NO: 336354 - protein, 9 aa, Homo Sapiens
CQAIEELYY

SEQ ID NO: 336355 - protein, 9 aa, Homo Sapiens
QIIAQGDLA

SEQ ID NO: 336356 - protein, 9 aa, Homo Sapiens
NELFLGMHP

SEQ ID NO: 336357 - protein, 9 aa, Homo Sapiens
IYFTTKVPQ

SEQ ID NO: 336358 - protein, 9 aa, Homo Sapiens
DSRTSPTPR

SEQ ID NO: 336359 - protein, 9 aa, Homo Sapiens
EDASSKVEK

SEQ ID NO: 336360 - protein, 9 aa, Homo Sapiens
CRDSLSEDL

SEQ ID NO: 336361 - protein, 9 aa, Homo Sapiens
ILALEANMT

SEQ ID NO: 336362 - protein, 9 aa, Homo Sapiens
LCVWISFYE

SEQ ID NO: 336363 - protein, 9 aa, Homo Sapiens
VTGKTVGTA

SEQ ID NO: 336364 - protein, 9 aa, Homo Sapiens
TYCWHSFEN

SEQ ID NO: 336365 - protein, 9 aa, Homo Sapiens
DKDNAHYAV

SEQ ID NO: 336366 - protein, 9 aa, Homo Sapiens
GITAIKLAE

SEQ ID NO: 336367 - protein, 9 aa, Homo Sapiens
PEAEELEST

SEQ ID NO: 336368 - protein, 9 aa, Homo Sapiens
SVVIQHQRA

SEQ ID NO: 336369 - protein, 9 aa, Homo Sapiens
LKCNLDKER

SEQ ID NO: 336370 - protein, 9 aa, Homo Sapiens
PRAVKVYAI

SEQ ID NO: 336371 - protein, 9 aa, Homo Sapiens
IINTGEKLY

SEQ ID NO: 336372 - protein, 9 aa, Homo Sapiens
LNAFKASDS

SEQ ID NO: 336373 - protein, 9 aa, Homo Sapiens
TPLKHVTVA

SEQ ID NO: 336374 - protein, 9 aa, Homo Sapiens
IVLNTLFMV

SEQ ID NO: 336375 - protein, 9 aa, Homo Sapiens
KITGEIVLS

SEQ ID NO: 336376 - protein, 9 aa, Homo Sapiens
LGNRVLVMS

SEQ ID NO: 336377 - protein, 9 aa, Homo Sapiens
TGTPLGYIP

SEQ ID NO: 336378 - protein, 9 aa, Homo Sapiens
QSILAKQQN

SEQ ID NO: 336379 - protein, 9 aa, Homo Sapiens
IYSICSRRG

SEQ ID NO: 336380 - protein, 9 aa, Homo Sapiens
HQWRQRRKL

SEQ ID NO: 336381 - protein, 9 aa, Homo Sapiens
SSVNKFAKH

SEQ ID NO: 336382 - protein, 9 aa, Homo Sapiens
QRDKLERAT

SEQ ID NO: 336383 - protein, 9 aa, Homo Sapiens
GRFLPASTQ

SEQ ID NO: 336384 - protein, 9 aa, Homo Sapiens
VQCASCNEP

SEQ ID NO: 336385 - protein, 9 aa, Homo Sapiens
IYQKAFNLI

SEQ ID NO: 336386 - protein, 9 aa, Homo Sapiens
YMFAGINSL

SEQ ID NO: 336387 - protein, 9 aa, Homo Sapiens
QIQFNVVMC

SEQ ID NO: 336388 - protein, 9 aa, Homo Sapiens
KANLQVINE

SEQ ID NO: 336389 - protein, 9 aa, Homo Sapiens
ETLKGQAVQ

SEQ ID NO: 336390 - protein, 9 aa, Homo Sapiens
HVGKKYGDS

SEQ ID NO: 336391 - protein, 9 aa, Homo Sapiens
ATQVGVICC

SEQ ID NO: 336392 - protein, 9 aa, Homo Sapiens
ETPEAGIHQ

SEQ ID NO: 336393 - protein, 9 aa, Homo Sapiens
NSTENNCAK

SEQ ID NO: 336394 - protein, 9 aa, Homo Sapiens
DDACTRKFH

SEQ ID NO: 336395 - protein, 9 aa, Homo Sapiens
SNNPPLQRL

SEQ ID NO: 336396 - protein, 9 aa, Homo Sapiens
YSTVQRVTL

SEQ ID NO: 336397 - protein, 9 aa, Homo Sapiens
KIKLITSEE

SEQ ID NO: 336398 - protein, 9 aa, Homo Sapiens
IPPKYLCNA

SEQ ID NO: 336399 - protein, 9 aa, Homo Sapiens
TDVPIEIQN

SEQ ID NO: 336400 - protein, 9 aa, Homo Sapiens
SDKADLGEL

SEQ ID NO: 336401 - protein, 9 aa, Homo Sapiens
DVKLLWLPA

SEQ ID NO: 336402 - protein, 9 aa, Homo Sapiens
DKDNDTSSD

SEQ ID NO: 336403 - protein, 9 aa, Homo Sapiens
THTGDKPYQ

SEQ ID NO: 336404 - protein, 9 aa, Homo Sapiens
ISLFILLCN

SEQ ID NO: 336405 - protein, 9 aa, Homo Sapiens
SCSEVGEID

SEQ ID NO: 336406 - protein, 9 aa, Homo Sapiens
LLQDVKNVS

SEQ ID NO: 336407 - protein, 9 aa, Homo Sapiens
DRSFLNLLH

SEQ ID NO: 336408 - protein, 9 aa, Homo Sapiens
RAKLAYFSF

SEQ ID NO: 336409 - protein, 9 aa, Homo Sapiens
NTSEGLPDN

SEQ ID NO: 336410 - protein, 9 aa, Homo Sapiens
YENWSFVMD

SEQ ID NO: 336411 - protein, 9 aa, Homo Sapiens
KGVCVCPFP

SEQ ID NO: 336412 - protein, 9 aa, Homo Sapiens
LSGQTTSIV

SEQ ID NO: 336413 - protein, 9 aa, Homo Sapiens
NARSCIQAY

SEQ ID NO: 336414 - protein, 9 aa, Homo Sapiens
CSKCGKSFS

SEQ ID NO: 336415 - protein, 9 aa, Homo Sapiens
ETVIVAWAI

SEQ ID NO: 336416 - protein, 9 aa, Homo Sapiens
ARNAKLQYP

SEQ ID NO: 336417 - protein, 9 aa, Homo Sapiens
PIEDHKTSP

SEQ ID NO: 336418 - protein, 9 aa, Homo Sapiens
INKNKNVTN

SEQ ID NO: 336419 - protein, 9 aa, Homo Sapiens
IATRKKIIA

SEQ ID NO: 336420 - protein, 9 aa, Homo Sapiens
GTSTFANLD

SEQ ID NO: 336421 - protein, 9 aa, Homo Sapiens
RKMAIGHRE

SEQ ID NO: 336422 - protein, 9 aa, Homo Sapiens
ISSATGCWR

SEQ ID NO: 336423 - protein, 9 aa, Homo Sapiens
DGESSLSVK

SEQ ID NO: 336424 - protein, 9 aa, Homo Sapiens
FYKINKNKF

SEQ ID NO: 336425 - protein, 9 aa, Homo Sapiens
FNLFIFLGG

SEQ ID NO: 336426 - protein, 9 aa, Homo Sapiens
KCLPVYYKQ

SEQ ID NO: 336427 - protein, 9 aa, Homo Sapiens
RDKKQVAGL

SEQ ID NO: 336428 - protein, 9 aa, Homo Sapiens
QKEIKPPFK

SEQ ID NO: 336429 - protein, 9 aa, Homo Sapiens
QKRLIQRRW

SEQ ID NO: 336430 - protein, 9 aa, Homo Sapiens
DAHLVLKRF

SEQ ID NO: 336431 - protein, 9 aa, Homo Sapiens
PPQEATNYS

SEQ ID NO: 336432 - protein, 9 aa, Homo Sapiens
CAFPGLTST

SEQ ID NO: 336433 - protein, 9 aa, Homo Sapiens
GSGGKLSQT

SEQ ID NO: 336434 - protein, 9 aa, Homo Sapiens
PCKVTADKL

SEQ ID NO: 336435 - protein, 9 aa, Homo Sapiens
SFSQSAYLI

SEQ ID NO: 336436 - protein, 9 aa, Homo Sapiens
LVYLWVSLL

SEQ ID NO: 336437 - protein, 9 aa, Homo Sapiens
IDNKALYDI

SEQ ID NO: 336438 - protein, 9 aa, Homo Sapiens
TSPFKREEL

SEQ ID NO: 336439 - protein, 9 aa, Homo Sapiens
NSTECRSLR

SEQ ID NO: 336440 - protein, 9 aa, Homo Sapiens
LECHLKIKT

SEQ ID NO: 336441 - protein, 9 aa, Homo Sapiens
DLGAGNLEY

SEQ ID NO: 336442 - protein, 9 aa, Homo Sapiens
FIIGAVAKV

SEQ ID NO: 336443 - protein, 9 aa, Homo Sapiens
AESLSRSIK

SEQ ID NO: 336444 - protein, 9 aa, Homo Sapiens
VGINDNAPE

SEQ ID NO: 336445 - protein, 9 aa, Homo Sapiens
IRAMRAAQS

SEQ ID NO: 336446 - protein, 9 aa, Homo Sapiens
VKLVCGNIT

SEQ ID NO: 336447 - protein, 9 aa, Homo Sapiens
KRRNLKTRN

SEQ ID NO: 336448 - protein, 9 aa, Homo Sapiens
ICQVIRKYN

SEQ ID NO: 336449 - protein, 9 aa, Homo Sapiens
IVQSMIDQS

SEQ ID NO: 336450 - protein, 9 aa, Homo Sapiens
CIKWKGLLL

SEQ ID NO: 336451 - protein, 9 aa, Homo Sapiens
TVAAGLDRK

SEQ ID NO: 336452 - protein, 9 aa, Homo Sapiens
KNLFNMCGI

SEQ ID NO: 336453 - protein, 9 aa, Homo Sapiens
ILILMCFIL

SEQ ID NO: 336454 - protein, 9 aa, Homo Sapiens
LALYTGMMS

SEQ ID NO: 336455 - protein, 9 aa, Homo Sapiens
LICCEQCEM

SEQ ID NO: 336456 - protein, 9 aa, Homo Sapiens
KMINLMRSG

SEQ ID NO: 336457 - protein, 9 aa, Homo Sapiens
TLLKEKGEN

SEQ ID NO: 336458 - protein, 9 aa, Homo Sapiens
SSGWGGGTP

SEQ ID NO: 336459 - protein, 9 aa, Homo Sapiens
SSSIRTHEK

SEQ ID NO: 336460 - protein, 9 aa, Homo Sapiens
LIFSIVGVN

SEQ ID NO: 336461 - protein, 9 aa, Homo Sapiens
VFVGVSQVM

SEQ ID NO: 336462 - protein, 9 aa, Homo Sapiens
KDLRENGEV

SEQ ID NO: 336463 - protein, 9 aa, Homo Sapiens
TQMFPHHSI

SEQ ID NO: 336464 - protein, 9 aa, Homo Sapiens
PLQWVVENL

SEQ ID NO: 336465 - protein, 9 aa, Homo Sapiens
VMTMMLPFC

SEQ ID NO: 336466 - protein, 9 aa, Homo Sapiens
ILPCCARFQ

SEQ ID NO: 336467 - protein, 9 aa, Homo Sapiens
PKFADWAQE

SEQ ID NO: 336468 - protein, 9 aa, Homo Sapiens
VRVYLLNDD

SEQ ID NO: 336469 - protein, 9 aa, Homo Sapiens
GKSFSQSAY

SEQ ID NO: 336470 - protein, 9 aa, Homo Sapiens
PPSKPPNEE

SEQ ID NO: 336471 - protein, 9 aa, Homo Sapiens
EHHKINKDL

SEQ ID NO: 336472 - protein, 9 aa, Homo Sapiens
QGILELLWT

SEQ ID NO: 336473 - protein, 9 aa, Homo Sapiens
NVTFVFDAV

SEQ ID NO: 336474 - protein, 9 aa, Homo Sapiens
WMLLVAKRR

SEQ ID NO: 336475 - protein, 9 aa, Homo Sapiens
NKCVQAARK

SEQ ID NO: 336476 - protein, 9 aa, Homo Sapiens
CQFCKESFT

SEQ ID NO: 336477 - protein, 9 aa, Homo Sapiens
SIMENTYTR

SEQ ID NO: 336478 - protein, 9 aa, Homo Sapiens
PYFSWTGAA

SEQ ID NO: 336479 - protein, 9 aa, Homo Sapiens
LPSSAMIKY

SEQ ID NO: 336480 - protein, 9 aa, Homo Sapiens
ESFTGPIPL

SEQ ID NO: 336481 - protein, 9 aa, Homo Sapiens
LISRELRAR

SEQ ID NO: 336482 - protein, 9 aa, Homo Sapiens
KELWDTFHE

SEQ ID NO: 336483 - protein, 9 aa, Homo Sapiens
KWNELNAGD

SEQ ID NO: 336484 - protein, 9 aa, Homo Sapiens
AHGLGNRVL

SEQ ID NO: 336485 - protein, 9 aa, Homo Sapiens
SGRWVHLDI

SEQ ID NO: 336486 - protein, 9 aa, Homo Sapiens
QNAYREVSR

SEQ ID NO: 336487 - protein, 9 aa, Homo Sapiens
QLMANPEAL

SEQ ID NO: 336488 - protein, 9 aa, Homo Sapiens
KLPPHLQWK

SEQ ID NO: 336489 - protein, 9 aa, Homo Sapiens
AGAPVYLYE

SEQ ID NO: 336490 - protein, 9 aa, Homo Sapiens
NCPACHLRK

SEQ ID NO: 336491 - protein, 9 aa, Homo Sapiens
INGAVLIKV

SEQ ID NO: 336492 - protein, 9 aa, Homo Sapiens
LAATVTVLF

SEQ ID NO: 336493 - protein, 9 aa, Homo Sapiens
RGELNEKQR

SEQ ID NO: 336494 - protein, 9 aa, Homo Sapiens
CPNHYTLVT

SEQ ID NO: 336495 - protein, 9 aa, Homo Sapiens
LSAHDNDAN

SEQ ID NO: 336496 - protein, 9 aa, Homo Sapiens
CVRPENTKE

SEQ ID NO: 336497 - protein, 9 aa, Homo Sapiens
IFSVFNNDA

SEQ ID NO: 336498 - protein, 9 aa, Homo Sapiens
SCILEPCPG

SEQ ID NO: 336499 - protein, 9 aa, Homo Sapiens
VVADHHFYR

SEQ ID NO: 336500 - protein, 9 aa, Homo Sapiens
DNKYGAGEH

SEQ ID NO: 336501 - protein, 9 aa, Homo Sapiens
RHHKGGKAH

SEQ ID NO: 336502 - protein, 9 aa, Homo Sapiens
MKIETSLRN

SEQ ID NO: 336503 - protein, 9 aa, Homo Sapiens
KESFTGPIP

SEQ ID NO: 336504 - protein, 9 aa, Homo Sapiens
NHPACANEI

SEQ ID NO: 336505 - protein, 9 aa, Homo Sapiens
EGGLKQFYF

SEQ ID NO: 336506 - protein, 9 aa, Homo Sapiens
SWPAPFKMP

SEQ ID NO: 336507 - protein, 9 aa, Homo Sapiens
SWFNNGLDL

SEQ ID NO: 336508 - protein, 9 aa, Homo Sapiens
QQIHHIKNV

SEQ ID NO: 336509 - protein, 9 aa, Homo Sapiens
SGNCDQRFR

SEQ ID NO: 336510 - protein, 9 aa, Homo Sapiens
IQAKIQDYH

SEQ ID NO: 336511 - protein, 9 aa, Homo Sapiens
VTDTEKGSE

SEQ ID NO: 336512 - protein, 9 aa, Homo Sapiens
VCQYDKIHQ

SEQ ID NO: 336513 - protein, 9 aa, Homo Sapiens
HWYQQYVKD

SEQ ID NO: 336514 - protein, 9 aa, Homo Sapiens
QHQIFHTGE

SEQ ID NO: 336515 - protein, 9 aa, Homo Sapiens
SQPASRPPA

SEQ ID NO: 336516 - protein, 9 aa, Homo Sapiens
GSVKLWSLN

SEQ ID NO: 336517 - protein, 9 aa, Homo Sapiens
NSDPILDTA

SEQ ID NO: 336518 - protein, 9 aa, Homo Sapiens
QMGGGGAMN

SEQ ID NO: 336519 - protein, 9 aa, Homo Sapiens
ISTDQRDKL

SEQ ID NO: 336520 - protein, 9 aa, Homo Sapiens
TSLCFSEYI

SEQ ID NO: 336521 - protein, 9 aa, Homo Sapiens
YDNSRVRLQ

SEQ ID NO: 336522 - protein, 9 aa, Homo Sapiens
QFSLYPLFM

SEQ ID NO: 336523 - protein, 9 aa, Homo Sapiens
RLPTQADRR

SEQ ID NO: 336524 - protein, 9 aa, Homo Sapiens
IVLFVSDLF

SEQ ID NO: 336525 - protein, 9 aa, Homo Sapiens
QHSKIYMVH

SEQ ID NO: 336526 - protein, 9 aa, Homo Sapiens
THSIPHSSP

SEQ ID NO: 336527 - protein, 9 aa, Homo Sapiens
SLHFSTENA

SEQ ID NO: 336528 - protein, 9 aa, Homo Sapiens
SEAVFLVPV

SEQ ID NO: 336529 - protein, 9 aa, Homo Sapiens
RLEGDLPLA

SEQ ID NO: 336530 - protein, 9 aa, Homo Sapiens
ELVLWNWES

SEQ ID NO: 336531 - protein, 9 aa, Homo Sapiens
TVGAKVTFS

SEQ ID NO: 336532 - protein, 9 aa, Homo Sapiens
PHNLPSSLE

SEQ ID NO: 336533 - protein, 9 aa, Homo Sapiens
AELVTEEKF

SEQ ID NO: 336534 - protein, 9 aa, Homo Sapiens
HIKNRKLTK

SEQ ID NO: 336535 - protein, 9 aa, Homo Sapiens
GDFEIVVVG

SEQ ID NO: 336536 - protein, 9 aa, Homo Sapiens
KQNVLQSEK

SEQ ID NO: 336537 - protein, 9 aa, Homo Sapiens
EGKKGQFID

SEQ ID NO: 336538 - protein, 9 aa, Homo Sapiens
CFWPVGITA

SEQ ID NO: 336539 - protein, 9 aa, Homo Sapiens
FTSSSALQS

SEQ ID NO: 336540 - protein, 9 aa, Homo Sapiens
DGPISPKNK

SEQ ID NO: 336541 - protein, 9 aa, Homo Sapiens
VKEQMYKLA

SEQ ID NO: 336542 - protein, 9 aa, Homo Sapiens
IFIPSSPGV

SEQ ID NO: 336543 - protein, 9 aa, Homo Sapiens
KAGATVTVK

SEQ ID NO: 336544 - protein, 9 aa, Homo Sapiens
LKQRVSNVL

SEQ ID NO: 336545 - protein, 9 aa, Homo Sapiens
LCLPEINNW

SEQ ID NO: 336546 - protein, 9 aa, Homo Sapiens
AWVSSSVLT

SEQ ID NO: 336547 - protein, 9 aa, Homo Sapiens
HQKFGKAFA

SEQ ID NO: 336548 - protein, 9 aa, Homo Sapiens
DKVPADIQI

SEQ ID NO: 336549 - protein, 9 aa, Homo Sapiens
LKLLARAST

SEQ ID NO: 336550 - protein, 9 aa, Homo Sapiens
CYCPNNSIF

SEQ ID NO: 336551 - protein, 9 aa, Homo Sapiens
ANNVFPPPS

SEQ ID NO: 336552 - protein, 9 aa, Homo Sapiens
IKYLPKGTF

SEQ ID NO: 336553 - protein, 9 aa, Homo Sapiens
EFCDSRLFT

SEQ ID NO: 336554 - protein, 9 aa, Homo Sapiens
YWCQGYFRD

SEQ ID NO: 336555 - protein, 9 aa, Homo Sapiens
SLTSQSPTD

SEQ ID NO: 336556 - protein, 9 aa, Homo Sapiens
ACYGSCLVA

SEQ ID NO: 336557 - protein, 9 aa, Homo Sapiens
IPGNDQIDS

SEQ ID NO: 336558 - protein, 9 aa, Homo Sapiens
ESADNGWDS

SEQ ID NO: 336559 - protein, 9 aa, Homo Sapiens
GRWANILEK

SEQ ID NO: 336560 - protein, 9 aa, Homo Sapiens
GSCSHPQLC

SEQ ID NO: 336561 - protein, 9 aa, Homo Sapiens
LLGFSNYSE

SEQ ID NO: 336562 - protein, 9 aa, Homo Sapiens
SQDGPQTSN

SEQ ID NO: 336563 - protein, 9 aa, Homo Sapiens
AVKDYIQTQ

SEQ ID NO: 336564 - protein, 9 aa, Homo Sapiens
GLCLLGGRR

SEQ ID NO: 336565 - protein, 9 aa, Homo Sapiens
ITVWGTHLD

SEQ ID NO: 336566 - protein, 9 aa, Homo Sapiens
EYRRSLDWG

SEQ ID NO: 336567 - protein, 9 aa, Homo Sapiens
CVAHVCQHN

SEQ ID NO: 336568 - protein, 9 aa, Homo Sapiens
ITIYIAGNQ

SEQ ID NO: 336569 - protein, 9 aa, Homo Sapiens
RRDFINIES

SEQ ID NO: 336570 - protein, 9 aa, Homo Sapiens
DSSQGNLVY

SEQ ID NO: 336571 - protein, 9 aa, Homo Sapiens
QIVTAVYCC

SEQ ID NO: 336572 - protein, 9 aa, Homo Sapiens
MDQHIEFFW

SEQ ID NO: 336573 - protein, 9 aa, Homo Sapiens
VSVVKKAGL

SEQ ID NO: 336574 - protein, 9 aa, Homo Sapiens
EELDGSLGS

SEQ ID NO: 336575 - protein, 9 aa, Homo Sapiens
RLNNLLTDV

SEQ ID NO: 336576 - protein, 9 aa, Homo Sapiens
ADLSASEQD

SEQ ID NO: 336577 - protein, 9 aa, Homo Sapiens
VLKPHKVCA

SEQ ID NO: 336578 - protein, 9 aa, Homo Sapiens
ELNLVEHGP

SEQ ID NO: 336579 - protein, 9 aa, Homo Sapiens
TYQCSRFQE

SEQ ID NO: 336580 - protein, 9 aa, Homo Sapiens
YLKNTTESF

SEQ ID NO: 336581 - protein, 9 aa, Homo Sapiens
QFLIYQIIR

SEQ ID NO: 336582 - protein, 9 aa, Homo Sapiens
YPGLCQSPL

SEQ ID NO: 336583 - protein, 9 aa, Homo Sapiens
AIIYIPVNV

SEQ ID NO: 336584 - protein, 9 aa, Homo Sapiens
QEKYSSSNE

SEQ ID NO: 336585 - protein, 9 aa, Homo Sapiens
LRGFPFHTP

SEQ ID NO: 336586 - protein, 9 aa, Homo Sapiens
TTKKYREKS

SEQ ID NO: 336587 - protein, 9 aa, Homo Sapiens
VINGSKSLG

SEQ ID NO: 336588 - protein, 9 aa, Homo Sapiens
LEMKLSKDV

SEQ ID NO: 336589 - protein, 9 aa, Homo Sapiens
DKCSDQGVA

SEQ ID NO: 336590 - protein, 9 aa, Homo Sapiens
MIQEQDLQL

SEQ ID NO: 336591 - protein, 9 aa, Homo Sapiens
RCFHHCNPG

SEQ ID NO: 336592 - protein, 9 aa, Homo Sapiens
KITALEKAI

SEQ ID NO: 336593 - protein, 9 aa, Homo Sapiens
LHGCLAAIA

SEQ ID NO: 336594 - protein, 9 aa, Homo Sapiens
KRATATECL

SEQ ID NO: 336595 - protein, 9 aa, Homo Sapiens
SSFQRHMVM

SEQ ID NO: 336596 - protein, 9 aa, Homo Sapiens
VRKCVAHVC

SEQ ID NO: 336597 - protein, 9 aa, Homo Sapiens
TCTIDGLLM

SEQ ID NO: 336598 - protein, 9 aa, Homo Sapiens
GERCKSHYT

SEQ ID NO: 336599 - protein, 9 aa, Homo Sapiens
FICEDMSHT

SEQ ID NO: 336600 - protein, 9 aa, Homo Sapiens
LCTPRHKII

SEQ ID NO: 336601 - protein, 9 aa, Homo Sapiens
HEILEKSGQ

SEQ ID NO: 336602 - protein, 9 aa, Homo Sapiens
IGIIAILQS

SEQ ID NO: 336603 - protein, 9 aa, Homo Sapiens
LTTFLFSLS

SEQ ID NO: 336604 - protein, 9 aa, Homo Sapiens
QRESLNRHY

SEQ ID NO: 336605 - protein, 9 aa, Homo Sapiens
SGLSPFMGG

SEQ ID NO: 336606 - protein, 9 aa, Homo Sapiens
QTQLLERQI

SEQ ID NO: 336607 - protein, 9 aa, Homo Sapiens
LHFHFFHIQ

SEQ ID NO: 336608 - protein, 9 aa, Homo Sapiens
VEVYLQKEA

SEQ ID NO: 336609 - protein, 9 aa, Homo Sapiens
VEQCLKCLK

SEQ ID NO: 336610 - protein, 9 aa, Homo Sapiens
FYGLLFTSD

SEQ ID NO: 336611 - protein, 9 aa, Homo Sapiens
TFEKNFSRG

SEQ ID NO: 336612 - protein, 9 aa, Homo Sapiens
QNRMGALLQ

SEQ ID NO: 336613 - protein, 9 aa, Homo Sapiens
NICEVLDLE

SEQ ID NO: 336614 - protein, 9 aa, Homo Sapiens
QAEIGTSSD

SEQ ID NO: 336615 - protein, 9 aa, Homo Sapiens
LQKHGKNVP

SEQ ID NO: 336616 - protein, 9 aa, Homo Sapiens
EWDDMAHLP

SEQ ID NO: 336617 - protein, 9 aa, Homo Sapiens
LFKPYYGEG

SEQ ID NO: 336618 - protein, 9 aa, Homo Sapiens
NKKDKETIY

SEQ ID NO: 336619 - protein, 9 aa, Homo Sapiens
DSSVRIYDW

SEQ ID NO: 336620 - protein, 9 aa, Homo Sapiens
LLDVPPGEY

SEQ ID NO: 336621 - protein, 9 aa, Homo Sapiens
PHLTTLFDV

SEQ ID NO: 336622 - protein, 9 aa, Homo Sapiens
SPEELEAGT

SEQ ID NO: 336623 - protein, 9 aa, Homo Sapiens
SLSSPSVEH

SEQ ID NO: 336624 - protein, 9 aa, Homo Sapiens
AKPPKITGS

SEQ ID NO: 336625 - protein, 9 aa, Homo Sapiens
CIEMKKLLK

SEQ ID NO: 336626 - protein, 9 aa, Homo Sapiens
EGGSDKADL

SEQ ID NO: 336627 - protein, 9 aa, Homo Sapiens
LPWYPQVLN

SEQ ID NO: 336628 - protein, 9 aa, Homo Sapiens
DPDKRKEFI

SEQ ID NO: 336629 - protein, 9 aa, Homo Sapiens
NIPLSVYNY

SEQ ID NO: 336630 - protein, 9 aa, Homo Sapiens
QKHYFMLWH

SEQ ID NO: 336631 - protein, 9 aa, Homo Sapiens
CEKISKIYE

SEQ ID NO: 336632 - protein, 9 aa, Homo Sapiens
QEERCLRKA

SEQ ID NO: 336633 - protein, 9 aa, Homo Sapiens
LVTNESITQ

SEQ ID NO: 336634 - protein, 9 aa, Homo Sapiens
FHKYFPDAI

SEQ ID NO: 336635 - protein, 9 aa, Homo Sapiens
SVRLYLVVS

SEQ ID NO: 336636 - protein, 9 aa, Homo Sapiens
LRIPPKYLC

SEQ ID NO: 336637 - protein, 9 aa, Homo Sapiens
KTCGHISVQ

SEQ ID NO: 336638 - protein, 9 aa, Homo Sapiens
FASFIDKVW

SEQ ID NO: 336639 - protein, 9 aa, Homo Sapiens
ACIRKTLAL

SEQ ID NO: 336640 - protein, 9 aa, Homo Sapiens
DFRNKTDLQ

SEQ ID NO: 336641 - protein, 9 aa, Homo Sapiens
DNIKLKLSN

SEQ ID NO: 336642 - protein, 9 aa, Homo Sapiens
NLMDYSHQS

SEQ ID NO: 336643 - protein, 9 aa, Homo Sapiens
YRQSVREAS

SEQ ID NO: 336644 - protein, 9 aa, Homo Sapiens
IGRGFSSKY

SEQ ID NO: 336645 - protein, 9 aa, Homo Sapiens
ACGRIRYND

SEQ ID NO: 336646 - protein, 9 aa, Homo Sapiens
GESPQMDFN

SEQ ID NO: 336647 - protein, 9 aa, Homo Sapiens
SPFMGGNDN

SEQ ID NO: 336648 - protein, 9 aa, Homo Sapiens
YQWIDRIHT

SEQ ID NO: 336649 - protein, 9 aa, Homo Sapiens
LLIRQIFNP

SEQ ID NO: 336650 - protein, 9 aa, Homo Sapiens
QAHAENGDL

SEQ ID NO: 336651 - protein, 9 aa, Homo Sapiens
EGIPKEADI

SEQ ID NO: 336652 - protein, 9 aa, Homo Sapiens
CIQRFTKNN

SEQ ID NO: 336653 - protein, 9 aa, Homo Sapiens
KTLARSLLV

SEQ ID NO: 336654 - protein, 9 aa, Homo Sapiens
CRLLDITTA

SEQ ID NO: 336655 - protein, 9 aa, Homo Sapiens
LHNCKKITD

SEQ ID NO: 336656 - protein, 9 aa, Homo Sapiens
PGLLCQSQL

SEQ ID NO: 336657 - protein, 9 aa, Homo Sapiens
RKDHKKADA

SEQ ID NO: 336658 - protein, 9 aa, Homo Sapiens
QRSSEVSKD

SEQ ID NO: 336659 - protein, 9 aa, Homo Sapiens
WIVEELFGC

SEQ ID NO: 336660 - protein, 9 aa, Homo Sapiens
PGHILVQGA

SEQ ID NO: 336661 - protein, 9 aa, Homo Sapiens
LCFNHFATE

SEQ ID NO: 336662 - protein, 9 aa, Homo Sapiens
ENELFLGMH

SEQ ID NO: 336663 - protein, 9 aa, Homo Sapiens
EEFWLVDLL

SEQ ID NO: 336664 - protein, 9 aa, Homo Sapiens
DYGSPDLSE

SEQ ID NO: 336665 - protein, 9 aa, Homo Sapiens
VTNLTSSIM

SEQ ID NO: 336666 - protein, 9 aa, Homo Sapiens
KGWSQIMFR

SEQ ID NO: 336667 - protein, 9 aa, Homo Sapiens
DVSRSIGLL

SEQ ID NO: 336668 - protein, 9 aa, Homo Sapiens
QRISRVEEL

SEQ ID NO: 336669 - protein, 9 aa, Homo Sapiens
RIIMNPRIC

SEQ ID NO: 336670 - protein, 9 aa, Homo Sapiens
LIVQTPSTL

SEQ ID NO: 336671 - protein, 9 aa, Homo Sapiens
TFYENWSFV

SEQ ID NO: 336672 - protein, 9 aa, Homo Sapiens
KGVEVKESK

SEQ ID NO: 336673 - protein, 9 aa, Homo Sapiens
KDMNGFPVN

SEQ ID NO: 336674 - protein, 9 aa, Homo Sapiens
EFALELGYS

SEQ ID NO: 336675 - protein, 9 aa, Homo Sapiens
NWHGGWDWS

SEQ ID NO: 336676 - protein, 9 aa, Homo Sapiens
SQVIHNADN

SEQ ID NO: 336677 - protein, 9 aa, Homo Sapiens
FTLVCGSAE

SEQ ID NO: 336678 - protein, 9 aa, Homo Sapiens
SSIGVLFCG

SEQ ID NO: 336679 - protein, 9 aa, Homo Sapiens
IAPSITSSE

SEQ ID NO: 336680 - protein, 9 aa, Homo Sapiens
NKMKNFKCR

SEQ ID NO: 336681 - protein, 9 aa, Homo Sapiens
LLDNTDVAL

SEQ ID NO: 336682 - protein, 9 aa, Homo Sapiens
GNTNVDIQM

SEQ ID NO: 336683 - protein, 9 aa, Homo Sapiens
IGLLTTFMH

SEQ ID NO: 336684 - protein, 9 aa, Homo Sapiens
PYDTFNLHL

SEQ ID NO: 336685 - protein, 9 aa, Homo Sapiens
KERTASGIT

SEQ ID NO: 336686 - protein, 9 aa, Homo Sapiens
QTTNTTRFV

SEQ ID NO: 336687 - protein, 9 aa, Homo Sapiens
QNRGSCSHP

SEQ ID NO: 336688 - protein, 9 aa, Homo Sapiens
VVHICLECE

SEQ ID NO: 336689 - protein, 9 aa, Homo Sapiens
EFDDKHLIT

SEQ ID NO: 336690 - protein, 9 aa, Homo Sapiens
YSPRQMAVC

SEQ ID NO: 336691 - protein, 9 aa, Homo Sapiens
LHYPIHMRK

SEQ ID NO: 336692 - protein, 9 aa, Homo Sapiens
NTNQHKREI

SEQ ID NO: 336693 - protein, 9 aa, Homo Sapiens
EQGKKTEEF

SEQ ID NO: 336694 - protein, 9 aa, Homo Sapiens
LSLVSAPGL

SEQ ID NO: 336695 - protein, 9 aa, Homo Sapiens
CINILGGQY

SEQ ID NO: 336696 - protein, 9 aa, Homo Sapiens
TVDRAIASR

SEQ ID NO: 336697 - protein, 9 aa, Homo Sapiens
RGRKITKNL

SEQ ID NO: 336698 - protein, 9 aa, Homo Sapiens
GKTNLVTIS

SEQ ID NO: 336699 - protein, 9 aa, Homo Sapiens
NYPEAEGLN

SEQ ID NO: 336700 - protein, 9 aa, Homo Sapiens
RMSGECQST

SEQ ID NO: 336701 - protein, 9 aa, Homo Sapiens
VGENGSVLQ

SEQ ID NO: 336702 - protein, 9 aa, Homo Sapiens
ASSKVEKAY

SEQ ID NO: 336703 - protein, 9 aa, Homo Sapiens
GEDCLNCLL

SEQ ID NO: 336704 - protein, 9 aa, Homo Sapiens
LLCVCIMMN

SEQ ID NO: 336705 - protein, 9 aa, Homo Sapiens
QIKEYVHIH

SEQ ID NO: 336706 - protein, 9 aa, Homo Sapiens
AERLRTLPE

SEQ ID NO: 336707 - protein, 9 aa, Homo Sapiens
RNPADPQCI

SEQ ID NO: 336708 - protein, 9 aa, Homo Sapiens
PIKAFSDKR

SEQ ID NO: 336709 - protein, 9 aa, Homo Sapiens
QNFMQELMA

SEQ ID NO: 336710 - protein, 9 aa, Homo Sapiens
GISRQSANV

SEQ ID NO: 336711 - protein, 9 aa, Homo Sapiens
YVEEPRTAT

SEQ ID NO: 336712 - protein, 9 aa, Homo Sapiens
TELIGRSHH

SEQ ID NO: 336713 - protein, 9 aa, Homo Sapiens
LVHQSKIFA

SEQ ID NO: 336714 - protein, 9 aa, Homo Sapiens
LDKGAKADT

SEQ ID NO: 336715 - protein, 9 aa, Homo Sapiens
LEEVDERQR

SEQ ID NO: 336716 - protein, 9 aa, Homo Sapiens
NYQTLTSIL

SEQ ID NO: 336717 - protein, 9 aa, Homo Sapiens
SQSCVTGPR

SEQ ID NO: 336718 - protein, 9 aa, Homo Sapiens
IDNINKAFS

SEQ ID NO: 336719 - protein, 9 aa, Homo Sapiens
NHLDECNIK

SEQ ID NO: 336720 - protein, 9 aa, Homo Sapiens
SMFQLVVQT

SEQ ID NO: 336721 - protein, 9 aa, Homo Sapiens
ALGQKLWAD

SEQ ID NO: 336722 - protein, 9 aa, Homo Sapiens
QRIQEIVQN

SEQ ID NO: 336723 - protein, 9 aa, Homo Sapiens
QLTQSASKQ

SEQ ID NO: 336724 - protein, 9 aa, Homo Sapiens
AVPVLPNIG

SEQ ID NO: 336725 - protein, 9 aa, Homo Sapiens
SIKGGIEGG

SEQ ID NO: 336726 - protein, 9 aa, Homo Sapiens
GEKLLIWMS

SEQ ID NO: 336727 - protein, 9 aa, Homo Sapiens
SFLFRITTH

SEQ ID NO: 336728 - protein, 9 aa, Homo Sapiens
VVLLQDVKN

SEQ ID NO: 336729 - protein, 9 aa, Homo Sapiens
NGSAKVPVG

SEQ ID NO: 336730 - protein, 9 aa, Homo Sapiens
DPAHRVALA

SEQ ID NO: 336731 - protein, 9 aa, Homo Sapiens
YPKIIERAG

SEQ ID NO: 336732 - protein, 9 aa, Homo Sapiens
SDDVKEQMY

SEQ ID NO: 336733 - protein, 9 aa, Homo Sapiens
FLIDTHNLL

SEQ ID NO: 336734 - protein, 9 aa, Homo Sapiens
IQYDLFLSC

SEQ ID NO: 336735 - protein, 9 aa, Homo Sapiens
PDQKDLLGY

SEQ ID NO: 336736 - protein, 9 aa, Homo Sapiens
SDTPQKSSL

SEQ ID NO: 336737 - protein, 9 aa, Homo Sapiens
NLNIKYKRP

SEQ ID NO: 336738 - protein, 9 aa, Homo Sapiens
FHTYLISFN

SEQ ID NO: 336739 - protein, 9 aa, Homo Sapiens
VNVRFCLKG

SEQ ID NO: 336740 - protein, 9 aa, Homo Sapiens
VAPSESEKL

SEQ ID NO: 336741 - protein, 9 aa, Homo Sapiens
FSELKQPRS

SEQ ID NO: 336742 - protein, 9 aa, Homo Sapiens
NVQLQAFDF

SEQ ID NO: 336743 - protein, 9 aa, Homo Sapiens
NQVRFMSLP

SEQ ID NO: 336744 - protein, 9 aa, Homo Sapiens
TPSISTNQT

SEQ ID NO: 336745 - protein, 9 aa, Homo Sapiens
NLNVTWRGK

SEQ ID NO: 336746 - protein, 9 aa, Homo Sapiens
HQRIHTGGK

SEQ ID NO: 336747 - protein, 9 aa, Homo Sapiens
QMKIQRAHH

SEQ ID NO: 336748 - protein, 9 aa, Homo Sapiens
DQDNQRVQA

SEQ ID NO: 336749 - protein, 9 aa, Homo Sapiens
KREAMLDML

SEQ ID NO: 336750 - protein, 9 aa, Homo Sapiens
HACSECGKG

SEQ ID NO: 336751 - protein, 9 aa, Homo Sapiens
ESFDADKKD

SEQ ID NO: 336752 - protein, 9 aa, Homo Sapiens
TVRHAKKIK

SEQ ID NO: 336753 - protein, 9 aa, Homo Sapiens
VLDQNVHEK

SEQ ID NO: 336754 - protein, 9 aa, Homo Sapiens
HVFKLGLQN

SEQ ID NO: 336755 - protein, 9 aa, Homo Sapiens
LMKNIQFPL

SEQ ID NO: 336756 - protein, 9 aa, Homo Sapiens
RSTSLTTVL

SEQ ID NO: 336757 - protein, 9 aa, Homo Sapiens
KDFNRRIQN

SEQ ID NO: 336758 - protein, 9 aa, Homo Sapiens
STSLTTVLI

SEQ ID NO: 336759 - protein, 9 aa, Homo Sapiens
LDNLTRRGL

SEQ ID NO: 336760 - protein, 9 aa, Homo Sapiens
VSLTETALI

SEQ ID NO: 336761 - protein, 9 aa, Homo Sapiens
TELLTLPRT

SEQ ID NO: 336762 - protein, 9 aa, Homo Sapiens
TNSLFFCPV

SEQ ID NO: 336763 - protein, 9 aa, Homo Sapiens
SLDLCRIIW

SEQ ID NO: 336764 - protein, 9 aa, Homo Sapiens
GISFGLAVT

SEQ ID NO: 336765 - protein, 9 aa, Homo Sapiens
YINLDIKYK

SEQ ID NO: 336766 - protein, 9 aa, Homo Sapiens
SLSFYSEDV

SEQ ID NO: 336767 - protein, 9 aa, Homo Sapiens
YVTEVEANR

SEQ ID NO: 336768 - protein, 9 aa, Homo Sapiens
VFEYHNIWV

SEQ ID NO: 336769 - protein, 9 aa, Homo Sapiens
MSVITSYTL

SEQ ID NO: 336770 - protein, 9 aa, Homo Sapiens
FQNGYMINL

SEQ ID NO: 336771 - protein, 9 aa, Homo Sapiens
GFATMPLVT

SEQ ID NO: 336772 - protein, 9 aa, Homo Sapiens
KSAFSGIPN

SEQ ID NO: 336773 - protein, 9 aa, Homo Sapiens
RRFEVSSYL

SEQ ID NO: 336774 - protein, 9 aa, Homo Sapiens
GTSLNREMY

SEQ ID NO: 336775 - protein, 9 aa, Homo Sapiens
TSLMQIDGN

SEQ ID NO: 336776 - protein, 9 aa, Homo Sapiens
INNKQVTLP

SEQ ID NO: 336777 - protein, 9 aa, Homo Sapiens
CANEIALSL

SEQ ID NO: 336778 - protein, 9 aa, Homo Sapiens
NSTRSDLYE

SEQ ID NO: 336779 - protein, 9 aa, Homo Sapiens
TRAQLANNA

SEQ ID NO: 336780 - protein, 9 aa, Homo Sapiens
TVDAPVTPS

SEQ ID NO: 336781 - protein, 9 aa, Homo Sapiens
ILYCEVPKV

SEQ ID NO: 336782 - protein, 9 aa, Homo Sapiens
QKLVSFDQE

SEQ ID NO: 336783 - protein, 9 aa, Homo Sapiens
VAVKKTSGG

SEQ ID NO: 336784 - protein, 9 aa, Homo Sapiens
FYMGNTAVG

SEQ ID NO: 336785 - protein, 9 aa, Homo Sapiens
ARKESEPLA

SEQ ID NO: 336786 - protein, 9 aa, Homo Sapiens
VSKDNAELI

SEQ ID NO: 336787 - protein, 9 aa, Homo Sapiens
TGEEKIFAF

SEQ ID NO: 336788 - protein, 9 aa, Homo Sapiens
QNIKINEMV

SEQ ID NO: 336789 - protein, 9 aa, Homo Sapiens
ERLLWQICR

SEQ ID NO: 336790 - protein, 9 aa, Homo Sapiens
TMEELSLRN

SEQ ID NO: 336791 - protein, 9 aa, Homo Sapiens
LGGQKFVFS

SEQ ID NO: 336792 - protein, 9 aa, Homo Sapiens
CQNRGSCSH

SEQ ID NO: 336793 - protein, 9 aa, Homo Sapiens
PAGCEPRSQ

SEQ ID NO: 336794 - protein, 9 aa, Homo Sapiens
MNFKSFVEK

SEQ ID NO: 336795 - protein, 9 aa, Homo Sapiens
VHKLIKEMD

SEQ ID NO: 336796 - protein, 9 aa, Homo Sapiens
LIYAALTSS

SEQ ID NO: 336797 - protein, 9 aa, Homo Sapiens
NPVWLYEQL

SEQ ID NO: 336798 - protein, 9 aa, Homo Sapiens
TREQKPFKV

SEQ ID NO: 336799 - protein, 9 aa, Homo Sapiens
NYREITDVD

SEQ ID NO: 336800 - protein, 9 aa, Homo Sapiens
AGLLPKKLP

SEQ ID NO: 336801 - protein, 9 aa, Homo Sapiens
ICCPVGTYQ

SEQ ID NO: 336802 - protein, 9 aa, Homo Sapiens
SQNGSLKTW

SEQ ID NO: 336803 - protein, 9 aa, Homo Sapiens
IPGDNSIFV

SEQ ID NO: 336804 - protein, 9 aa, Homo Sapiens
QHIKNRKLT

SEQ ID NO: 336805 - protein, 9 aa, Homo Sapiens
IECRQAFIQ

SEQ ID NO: 336806 - protein, 9 aa, Homo Sapiens
NKLPVPIPI

SEQ ID NO: 336807 - protein, 9 aa, Homo Sapiens
KSNWHGGWD

SEQ ID NO: 336808 - protein, 9 aa, Homo Sapiens
EKNKPFYTL

SEQ ID NO: 336809 - protein, 9 aa, Homo Sapiens
LICYQRKHD

SEQ ID NO: 336810 - protein, 9 aa, Homo Sapiens
CICLSLVYS

SEQ ID NO: 336811 - protein, 9 aa, Homo Sapiens
FKMLAVGVG

SEQ ID NO: 336812 - protein, 9 aa, Homo Sapiens
ERILALEAN

SEQ ID NO: 336813 - protein, 9 aa, Homo Sapiens
ALRVHATLT

SEQ ID NO: 336814 - protein, 9 aa, Homo Sapiens
TGGYMLEWV

SEQ ID NO: 336815 - protein, 9 aa, Homo Sapiens
RCLHTAVYH

SEQ ID NO: 336816 - protein, 9 aa, Homo Sapiens
KYVHYYLTS

SEQ ID NO: 336817 - protein, 9 aa, Homo Sapiens
ALTMLQERR

SEQ ID NO: 336818 - protein, 9 aa, Homo Sapiens
LLYVTCLQN

SEQ ID NO: 336819 - protein, 9 aa, Homo Sapiens
KKADAEEEI

SEQ ID NO: 336820 - protein, 9 aa, Homo Sapiens
SSFQSYEAP

SEQ ID NO: 336821 - protein, 9 aa, Homo Sapiens
SEKSCMNVN

SEQ ID NO: 336822 - protein, 9 aa, Homo Sapiens
RIYDVFRSN

SEQ ID NO: 336823 - protein, 9 aa, Homo Sapiens
CWSCGASLH

SEQ ID NO: 336824 - protein, 9 aa, Homo Sapiens
WSFMTPHSH

SEQ ID NO: 336825 - protein, 9 aa, Homo Sapiens
LEKLEKQMT

SEQ ID NO: 336826 - protein, 9 aa, Homo Sapiens
CTHTGLGGY

SEQ ID NO: 336827 - protein, 9 aa, Homo Sapiens
EETQNAAWR

SEQ ID NO: 336828 - protein, 9 aa, Homo Sapiens
KGPCGETGP

SEQ ID NO: 336829 - protein, 9 aa, Homo Sapiens
QNHLQRWNQ

SEQ ID NO: 336830 - protein, 9 aa, Homo Sapiens
YIRSHYNLG

SEQ ID NO: 336831 - protein, 9 aa, Homo Sapiens
NLTTHKILH

SEQ ID NO: 336832 - protein, 9 aa, Homo Sapiens
EKQKEEHQF

SEQ ID NO: 336833 - protein, 9 aa, Homo Sapiens
SSSWCILGS

SEQ ID NO: 336834 - protein, 9 aa, Homo Sapiens
ERVAGSAEM

SEQ ID NO: 336835 - protein, 9 aa, Homo Sapiens
NKKFIIANV

SEQ ID NO: 336836 - protein, 9 aa, Homo Sapiens
PRMNLSLNL

SEQ ID NO: 336837 - protein, 9 aa, Homo Sapiens
ISTNQTAET

SEQ ID NO: 336838 - protein, 9 aa, Homo Sapiens
YNGDLVEYG

SEQ ID NO: 336839 - protein, 9 aa, Homo Sapiens
HTCSPREWS

SEQ ID NO: 336840 - protein, 9 aa, Homo Sapiens
QNITTRLLL

SEQ ID NO: 336841 - protein, 9 aa, Homo Sapiens
GDSPRGIFV

SEQ ID NO: 336842 - protein, 9 aa, Homo Sapiens
TTLTVHQIT

SEQ ID NO: 336843 - protein, 9 aa, Homo Sapiens
LKDLEVITL

SEQ ID NO: 336844 - protein, 9 aa, Homo Sapiens
LLKMICHTT

SEQ ID NO: 336845 - protein, 9 aa, Homo Sapiens
DHFSIDQNT

SEQ ID NO: 336846 - protein, 9 aa, Homo Sapiens
YECCECGKT

SEQ ID NO: 336847 - protein, 9 aa, Homo Sapiens
VKMYPIEDF

SEQ ID NO: 336848 - protein, 9 aa, Homo Sapiens
AQVMRNGDS

SEQ ID NO: 336849 - protein, 9 aa, Homo Sapiens
KNEVGSAHA

SEQ ID NO: 336850 - protein, 9 aa, Homo Sapiens
GSFNCVCNA

SEQ ID NO: 336851 - protein, 9 aa, Homo Sapiens
DNTTFQLQV

SEQ ID NO: 336852 - protein, 9 aa, Homo Sapiens
MLNPLMYTL

SEQ ID NO: 336853 - protein, 9 aa, Homo Sapiens
FAKLKDKLF

SEQ ID NO: 336854 - protein, 9 aa, Homo Sapiens
PGALIKDIW

SEQ ID NO: 336855 - protein, 9 aa, Homo Sapiens
DAHTKKAVS

SEQ ID NO: 336856 - protein, 9 aa, Homo Sapiens
HKEDQGKKE

SEQ ID NO: 336857 - protein, 9 aa, Homo Sapiens
FSRSSSRSH

SEQ ID NO: 336858 - protein, 9 aa, Homo Sapiens
RHSVCDDIE

SEQ ID NO: 336859 - protein, 9 aa, Homo Sapiens
GILYVDPVG

SEQ ID NO: 336860 - protein, 9 aa, Homo Sapiens
KSNINKVWM

SEQ ID NO: 336861 - protein, 9 aa, Homo Sapiens
EKVVNIPSS

SEQ ID NO: 336862 - protein, 9 aa, Homo Sapiens
PLKKLEINV

SEQ ID NO: 336863 - protein, 9 aa, Homo Sapiens
QAKEDAQAE

SEQ ID NO: 336864 - protein, 9 aa, Homo Sapiens
KLHNLTNLL

SEQ ID NO: 336865 - protein, 9 aa, Homo Sapiens
QNPFDVFIS

SEQ ID NO: 336866 - protein, 9 aa, Homo Sapiens
TASGITNQM

SEQ ID NO: 336867 - protein, 9 aa, Homo Sapiens
WKGELYRQN

SEQ ID NO: 336868 - protein, 9 aa, Homo Sapiens
KVNSEGKFD

SEQ ID NO: 336869 - protein, 9 aa, Homo Sapiens
GFPVNKCSA

SEQ ID NO: 336870 - protein, 9 aa, Homo Sapiens
LEVQIVEEV

SEQ ID NO: 336871 - protein, 9 aa, Homo Sapiens
TQRIQEIVQ

SEQ ID NO: 336872 - protein, 9 aa, Homo Sapiens
TYDKDKKSK

SEQ ID NO: 336873 - protein, 9 aa, Homo Sapiens
LGQKLWADT

SEQ ID NO: 336874 - protein, 9 aa, Homo Sapiens
LLCQSQLTS

SEQ ID NO: 336875 - protein, 9 aa, Homo Sapiens
TLFEIVVQL

SEQ ID NO: 336876 - protein, 9 aa, Homo Sapiens
PSPTKLQDQ

SEQ ID NO: 336877 - protein, 9 aa, Homo Sapiens
HPEITYWLR

SEQ ID NO: 336878 - protein, 9 aa, Homo Sapiens
YQKAFNLIE

SEQ ID NO: 336879 - protein, 9 aa, Homo Sapiens
VERNIQIIV

SEQ ID NO: 336880 - protein, 9 aa, Homo Sapiens
KLNEDSDLI

SEQ ID NO: 336881 - protein, 9 aa, Homo Sapiens
LLLQIPSCL

SEQ ID NO: 336882 - protein, 9 aa, Homo Sapiens
ISQKVPEKS

SEQ ID NO: 336883 - protein, 9 aa, Homo Sapiens
NGDPGPMGP

SEQ ID NO: 336884 - protein, 9 aa, Homo Sapiens
MLTKDLQNG

SEQ ID NO: 336885 - protein, 9 aa, Homo Sapiens
LFGLQIRVP

SEQ ID NO: 336886 - protein, 9 aa, Homo Sapiens
EEENNEKRQ

SEQ ID NO: 336887 - protein, 9 aa, Homo Sapiens
TFLRYFSDK

SEQ ID NO: 336888 - protein, 9 aa, Homo Sapiens
QLVKRLEYL

SEQ ID NO: 336889 - protein, 9 aa, Homo Sapiens
WLGHLLDKL

SEQ ID NO: 336890 - protein, 9 aa, Homo Sapiens
VCCGTVGSR

SEQ ID NO: 336891 - protein, 9 aa, Homo Sapiens
KYDKIKDMA

SEQ ID NO: 336892 - protein, 9 aa, Homo Sapiens
KECGKIFSF

SEQ ID NO: 336893 - protein, 9 aa, Homo Sapiens
ACTDDEDDN

SEQ ID NO: 336894 - protein, 9 aa, Homo Sapiens
NTWKDHVAA

SEQ ID NO: 336895 - protein, 9 aa, Homo Sapiens
ISRLSGKQV

SEQ ID NO: 336896 - protein, 9 aa, Homo Sapiens
AFDCPMNQM

SEQ ID NO: 336897 - protein, 9 aa, Homo Sapiens
NSESVYYGC

SEQ ID NO: 336898 - protein, 9 aa, Homo Sapiens
ITCVALAIY

SEQ ID NO: 336899 - protein, 9 aa, Homo Sapiens
HICGEYQIE

SEQ ID NO: 336900 - protein, 9 aa, Homo Sapiens
GGYTDPLTF

SEQ ID NO: 336901 - protein, 9 aa, Homo Sapiens
TLRLQAELG

SEQ ID NO: 336902 - protein, 9 aa, Homo Sapiens
KTGDAYKCP

SEQ ID NO: 336903 - protein, 9 aa, Homo Sapiens
APIFIKLLN

SEQ ID NO: 336904 - protein, 9 aa, Homo Sapiens
RPCVDIQEK

SEQ ID NO: 336905 - protein, 9 aa, Homo Sapiens
IVITRYNNH

SEQ ID NO: 336906 - protein, 9 aa, Homo Sapiens
TCVPVSIGR

SEQ ID NO: 336907 - protein, 9 aa, Homo Sapiens
EVGNTIRVT

SEQ ID NO: 336908 - protein, 9 aa, Homo Sapiens
CYFHVLLAP

SEQ ID NO: 336909 - protein, 9 aa, Homo Sapiens
ASLRTTSST

SEQ ID NO: 336910 - protein, 9 aa, Homo Sapiens
IPKEADIEI

SEQ ID NO: 336911 - protein, 9 aa, Homo Sapiens
IKARPDMQL

SEQ ID NO: 336912 - protein, 9 aa, Homo Sapiens
DVGKVVNSD

SEQ ID NO: 336913 - protein, 9 aa, Homo Sapiens
EKGKCGIDG

SEQ ID NO: 336914 - protein, 9 aa, Homo Sapiens
DNIKVLTAD

SEQ ID NO: 336915 - protein, 9 aa, Homo Sapiens
CIECRQAFI

SEQ ID NO: 336916 - protein, 9 aa, Homo Sapiens
LMNRSLHVG

SEQ ID NO: 336917 - protein, 9 aa, Homo Sapiens
KLNTLILCH

SEQ ID NO: 336918 - protein, 9 aa, Homo Sapiens
RSPQKLPTS

SEQ ID NO: 336919 - protein, 9 aa, Homo Sapiens
EYKVPARLT

SEQ ID NO: 336920 - protein, 9 aa, Homo Sapiens
YYAFRIYDF

SEQ ID NO: 336921 - protein, 9 aa, Homo Sapiens
SLLTETMEV

SEQ ID NO: 336922 - protein, 9 aa, Homo Sapiens
EPGNNVTLT

SEQ ID NO: 336923 - protein, 9 aa, Homo Sapiens
TLFPLSFLI

SEQ ID NO: 336924 - protein, 9 aa, Homo Sapiens
WTEKQKEEH

SEQ ID NO: 336925 - protein, 9 aa, Homo Sapiens
NCLPNFICQ

SEQ ID NO: 336926 - protein, 9 aa, Homo Sapiens
ELKSLDKDI

SEQ ID NO: 336927 - protein, 9 aa, Homo Sapiens
ITYIFTFLL

SEQ ID NO: 336928 - protein, 9 aa, Homo Sapiens
IKTYLQAVG

SEQ ID NO: 336929 - protein, 9 aa, Homo Sapiens
LPEGIDDFV

SEQ ID NO: 336930 - protein, 9 aa, Homo Sapiens
GKFSINSDI

SEQ ID NO: 336931 - protein, 9 aa, Homo Sapiens
CGKIFSFRS

SEQ ID NO: 336932 - protein, 9 aa, Homo Sapiens
PEAAFLGPE

SEQ ID NO: 336933 - protein, 9 aa, Homo Sapiens
CTDDEDDND

SEQ ID NO: 336934 - protein, 9 aa, Homo Sapiens
GVLSGKIKL

SEQ ID NO: 336935 - protein, 9 aa, Homo Sapiens
PDMALCQNA

SEQ ID NO: 336936 - protein, 9 aa, Homo Sapiens
ELLAAAGRR

SEQ ID NO: 336937 - protein, 9 aa, Homo Sapiens
PCSFPMADS

SEQ ID NO: 336938 - protein, 9 aa, Homo Sapiens
ELKEAKKKL

SEQ ID NO: 336939 - protein, 9 aa, Homo Sapiens
TLNSSKPTP

SEQ ID NO: 336940 - protein, 9 aa, Homo Sapiens
FEFFIPDNE

SEQ ID NO: 336941 - protein, 9 aa, Homo Sapiens
LVYLQAVKE

SEQ ID NO: 336942 - protein, 9 aa, Homo Sapiens
GCVKNGIQR

SEQ ID NO: 336943 - protein, 9 aa, Homo Sapiens
VRSTQIVEE

SEQ ID NO: 336944 - protein, 9 aa, Homo Sapiens
SPRRGEIGL

SEQ ID NO: 336945 - protein, 9 aa, Homo Sapiens
LETSLKIPK

SEQ ID NO: 336946 - protein, 9 aa, Homo Sapiens
YTGSLCEIT

SEQ ID NO: 336947 - protein, 9 aa, Homo Sapiens
VGQTQAAQA

SEQ ID NO: 336948 - protein, 9 aa, Homo Sapiens
ERCIKFVPN

SEQ ID NO: 336949 - protein, 9 aa, Homo Sapiens
VNGKEMKNK

SEQ ID NO: 336950 - protein, 9 aa, Homo Sapiens
ENWSFVMDE

SEQ ID NO: 336951 - protein, 9 aa, Homo Sapiens
SVLQRVTRA

SEQ ID NO: 336952 - protein, 9 aa, Homo Sapiens
DSSRREQMT

SEQ ID NO: 336953 - protein, 9 aa, Homo Sapiens
QKLNDSSSR

SEQ ID NO: 336954 - protein, 9 aa, Homo Sapiens
EHLRKYNEV

SEQ ID NO: 336955 - protein, 9 aa, Homo Sapiens
MKVDLSLKD

SEQ ID NO: 336956 - protein, 9 aa, Homo Sapiens
LLFWCLHFV

SEQ ID NO: 336957 - protein, 9 aa, Homo Sapiens
CRNLVNDFY

SEQ ID NO: 336958 - protein, 9 aa, Homo Sapiens
VQDDQAKGP

SEQ ID NO: 336959 - protein, 9 aa, Homo Sapiens
PKVMCLKDY

SEQ ID NO: 336960 - protein, 9 aa, Homo Sapiens
TLKNIISPL

SEQ ID NO: 336961 - protein, 9 aa, Homo Sapiens
FGQRANTIK

SEQ ID NO: 336962 - protein, 9 aa, Homo Sapiens
MKTKDLKHN

SEQ ID NO: 336963 - protein, 9 aa, Homo Sapiens
MERNPDELR

SEQ ID NO: 336964 - protein, 9 aa, Homo Sapiens
DEQDYHARK

SEQ ID NO: 336965 - protein, 9 aa, Homo Sapiens
NFLLFSLSL

SEQ ID NO: 336966 - protein, 9 aa, Homo Sapiens
LLPLIIFHA

SEQ ID NO: 336967 - protein, 9 aa, Homo Sapiens
FSKQTIELK

SEQ ID NO: 336968 - protein, 9 aa, Homo Sapiens
DKDSFNNSP

SEQ ID NO: 336969 - protein, 9 aa, Homo Sapiens
SRKLSTKKK

SEQ ID NO: 336970 - protein, 9 aa, Homo Sapiens
TVLSGQTTS

SEQ ID NO: 336971 - protein, 9 aa, Homo Sapiens
RLMNYFSAA

SEQ ID NO: 336972 - protein, 9 aa, Homo Sapiens
KHLYGLSQN

SEQ ID NO: 336973 - protein, 9 aa, Homo Sapiens
LKDTTLQEL

SEQ ID NO: 336974 - protein, 9 aa, Homo Sapiens
KSKCNLLLS

SEQ ID NO: 336975 - protein, 9 aa, Homo Sapiens
THKRIITGE

SEQ ID NO: 336976 - protein, 9 aa, Homo Sapiens
KSFCQSSNL

SEQ ID NO: 336977 - protein, 9 aa, Homo Sapiens
ENTARCEWN

SEQ ID NO: 336978 - protein, 9 aa, Homo Sapiens
PKDVVYPEI

SEQ ID NO: 336979 - protein, 9 aa, Homo Sapiens
LAYERYICV

SEQ ID NO: 336980 - protein, 9 aa, Homo Sapiens
HLPGKVVQT

SEQ ID NO: 336981 - protein, 9 aa, Homo Sapiens
MADTDVQLM

SEQ ID NO: 336982 - protein, 9 aa, Homo Sapiens
HFSLFVTIG

SEQ ID NO: 336983 - protein, 9 aa, Homo Sapiens
KELEGTNVE

SEQ ID NO: 336984 - protein, 9 aa, Homo Sapiens
PHQFCSPGS

SEQ ID NO: 336985 - protein, 9 aa, Homo Sapiens
SQNAYMLVY

SEQ ID NO: 336986 - protein, 9 aa, Homo Sapiens
RKIHSGEKP

SEQ ID NO: 336987 - protein, 9 aa, Homo Sapiens
PSELSNWYT

SEQ ID NO: 336988 - protein, 9 aa, Homo Sapiens
SPEGEGLRY

SEQ ID NO: 336989 - protein, 9 aa, Homo Sapiens
INEIFQCQV

SEQ ID NO: 336990 - protein, 9 aa, Homo Sapiens
GGLDGVDIY

SEQ ID NO: 336991 - protein, 9 aa, Homo Sapiens
LKSSKNASL

SEQ ID NO: 336992 - protein, 9 aa, Homo Sapiens
IHLLGNIVT

SEQ ID NO: 336993 - protein, 9 aa, Homo Sapiens
GKIKRTVTR

SEQ ID NO: 336994 - protein, 9 aa, Homo Sapiens
DLYHLLKHI

SEQ ID NO: 336995 - protein, 9 aa, Homo Sapiens
SCLLSLCQC

SEQ ID NO: 336996 - protein, 9 aa, Homo Sapiens
AGGEYFAMD

SEQ ID NO: 336997 - protein, 9 aa, Homo Sapiens
PADRFKTKH

SEQ ID NO: 336998 - protein, 9 aa, Homo Sapiens
LTWLVFVGI

SEQ ID NO: 336999 - protein, 9 aa, Homo Sapiens
LWLSLQDQV

SEQ ID NO: 337000 - protein, 9 aa, Homo Sapiens
IEQIKQLSD

SEQ ID NO: 337001 - protein, 9 aa, Homo Sapiens
TKMTTEELN

SEQ ID NO: 337002 - protein, 9 aa, Homo Sapiens
WEAGEAGLE

SEQ ID NO: 337003 - protein, 9 aa, Homo Sapiens
VSSLCRHRM

SEQ ID NO: 337004 - protein, 9 aa, Homo Sapiens
QKSSLTQME

SEQ ID NO: 337005 - protein, 9 aa, Homo Sapiens
EALKYLTMQ

SEQ ID NO: 337006 - protein, 9 aa, Homo Sapiens
HLDGTCVEW

SEQ ID NO: 337007 - protein, 9 aa, Homo Sapiens
NGFPVNKCS

SEQ ID NO: 337008 - protein, 9 aa, Homo Sapiens
PFDVFISPE

SEQ ID NO: 337009 - protein, 9 aa, Homo Sapiens
TRLVQTAQN

SEQ ID NO: 337010 - protein, 9 aa, Homo Sapiens
EQLLKKGYE

SEQ ID NO: 337011 - protein, 9 aa, Homo Sapiens
RDTLPDFRN

SEQ ID NO: 337012 - protein, 9 aa, Homo Sapiens
CKKITDKLS

SEQ ID NO: 337013 - protein, 9 aa, Homo Sapiens
LLSFGKTKS

SEQ ID NO: 337014 - protein, 9 aa, Homo Sapiens
VSFEDVSVF

SEQ ID NO: 337015 - protein, 9 aa, Homo Sapiens
HLLENSLMD

SEQ ID NO: 337016 - protein, 9 aa, Homo Sapiens
KVEVAKKTK

SEQ ID NO: 337017 - protein, 9 aa, Homo Sapiens
ENQDLISSK

SEQ ID NO: 337018 - protein, 9 aa, Homo Sapiens
VCVVVVFVV

SEQ ID NO: 337019 - protein, 9 aa, Homo Sapiens
DLPICGSSG

SEQ ID NO: 337020 - protein, 9 aa, Homo Sapiens
YPVVCAPSS

SEQ ID NO: 337021 - protein, 9 aa, Homo Sapiens
TKCVKPLGL

SEQ ID NO: 337022 - protein, 9 aa, Homo Sapiens
ICKMNKHVL

SEQ ID NO: 337023 - protein, 9 aa, Homo Sapiens
DSSPITKHG

SEQ ID NO: 337024 - protein, 9 aa, Homo Sapiens
GDNKLLRMM

SEQ ID NO: 337025 - protein, 9 aa, Homo Sapiens
SAPPEAYWN

SEQ ID NO: 337026 - protein, 9 aa, Homo Sapiens
GYNRLQSLS

SEQ ID NO: 337027 - protein, 9 aa, Homo Sapiens
RIEYDAYCT

SEQ ID NO: 337028 - protein, 9 aa, Homo Sapiens
RTCQAWSFM

SEQ ID NO: 337029 - protein, 9 aa, Homo Sapiens
IYLYTARDQ

SEQ ID NO: 337030 - protein, 9 aa, Homo Sapiens
STTSERSTS

SEQ ID NO: 337031 - protein, 9 aa, Homo Sapiens
DGLIQIELT

SEQ ID NO: 337032 - protein, 9 aa, Homo Sapiens
STVNSLAAV

SEQ ID NO: 337033 - protein, 9 aa, Homo Sapiens
GPHDVHTCS

SEQ ID NO: 337034 - protein, 9 aa, Homo Sapiens
FMYTTLFTL

SEQ ID NO: 337035 - protein, 9 aa, Homo Sapiens
ALVGLSSLF

SEQ ID NO: 337036 - protein, 9 aa, Homo Sapiens
WKFAYAHKY

SEQ ID NO: 337037 - protein, 9 aa, Homo Sapiens
EEQKDKDSI

SEQ ID NO: 337038 - protein, 9 aa, Homo Sapiens
GEGAQFDLY

SEQ ID NO: 337039 - protein, 9 aa, Homo Sapiens
MFNCSVPSY

SEQ ID NO: 337040 - protein, 9 aa, Homo Sapiens
SFFTWGNNI

SEQ ID NO: 337041 - protein, 9 aa, Homo Sapiens
LLNDGQFRR

SEQ ID NO: 337042 - protein, 9 aa, Homo Sapiens
PCTQCIKWK

SEQ ID NO: 337043 - protein, 9 aa, Homo Sapiens
TVEFLVELH

SEQ ID NO: 337044 - protein, 9 aa, Homo Sapiens
VMLNEVKRA

SEQ ID NO: 337045 - protein, 9 aa, Homo Sapiens
NSDVLVRTG

SEQ ID NO: 337046 - protein, 9 aa, Homo Sapiens
GDDNPKESS

SEQ ID NO: 337047 - protein, 9 aa, Homo Sapiens
EKDILSLYE

SEQ ID NO: 337048 - protein, 9 aa, Homo Sapiens
LDWIKANTE

SEQ ID NO: 337049 - protein, 9 aa, Homo Sapiens
NKFFGDPIE

SEQ ID NO: 337050 - protein, 9 aa, Homo Sapiens
GKGYDNEDN

SEQ ID NO: 337051 - protein, 9 aa, Homo Sapiens
EAQKEMQTI

SEQ ID NO: 337052 - protein, 9 aa, Homo Sapiens
SKSYSYFPI

SEQ ID NO: 337053 - protein, 9 aa, Homo Sapiens
QFLVQLDDY

SEQ ID NO: 337054 - protein, 9 aa, Homo Sapiens
IMKTPEVPF

SEQ ID NO: 337055 - protein, 9 aa, Homo Sapiens
ARVKQGKYQ

SEQ ID NO: 337056 - protein, 9 aa, Homo Sapiens
YGLKENDER

SEQ ID NO: 337057 - protein, 9 aa, Homo Sapiens
EAFADTEIR

SEQ ID NO: 337058 - protein, 9 aa, Homo Sapiens
QGLFNLALL

SEQ ID NO: 337059 - protein, 9 aa, Homo Sapiens
INNGLVKLI

SEQ ID NO: 337060 - protein, 9 aa, Homo Sapiens
ALVEFGDVL

SEQ ID NO: 337061 - protein, 9 aa, Homo Sapiens
PWYPQVLNL

SEQ ID NO: 337062 - protein, 9 aa, Homo Sapiens
SSITNHKII

SEQ ID NO: 337063 - protein, 9 aa, Homo Sapiens
FYRDALLLQ

SEQ ID NO: 337064 - protein, 9 aa, Homo Sapiens
KPGRPQIKK

SEQ ID NO: 337065 - protein, 9 aa, Homo Sapiens
RFQENSLDH

SEQ ID NO: 337066 - protein, 9 aa, Homo Sapiens
DDNLLKNIK

SEQ ID NO: 337067 - protein, 9 aa, Homo Sapiens
RQIECLPTS

SEQ ID NO: 337068 - protein, 9 aa, Homo Sapiens
IFSRFFYYF

SEQ ID NO: 337069 - protein, 9 aa, Homo Sapiens
YQKEIKPPF

SEQ ID NO: 337070 - protein, 9 aa, Homo Sapiens
QDTLHTMYF

SEQ ID NO: 337071 - protein, 9 aa, Homo Sapiens
GEAASKESK

SEQ ID NO: 337072 - protein, 9 aa, Homo Sapiens
VYCCHCRNI

SEQ ID NO: 337073 - protein, 9 aa, Homo Sapiens
IKAWPFPGV

SEQ ID NO: 337074 - protein, 9 aa, Homo Sapiens
MELLVCTVC

SEQ ID NO: 337075 - protein, 9 aa, Homo Sapiens
GWERYTKVA

SEQ ID NO: 337076 - protein, 9 aa, Homo Sapiens
NLALGQKLW

SEQ ID NO: 337077 - protein, 9 aa, Homo Sapiens
LPSALFLHL

SEQ ID NO: 337078 - protein, 9 aa, Homo Sapiens
QDEQDYHAR

SEQ ID NO: 337079 - protein, 9 aa, Homo Sapiens
LLVIQLGCF

SEQ ID NO: 337080 - protein, 9 aa, Homo Sapiens
KERKQTPKH

SEQ ID NO: 337081 - protein, 9 aa, Homo Sapiens
TRGCRFCYV

SEQ ID NO: 337082 - protein, 9 aa, Homo Sapiens
NFNQTLRLL

SEQ ID NO: 337083 - protein, 9 aa, Homo Sapiens
SACVGSAYQ

SEQ ID NO: 337084 - protein, 9 aa, Homo Sapiens
AGNLNVTWR

SEQ ID NO: 337085 - protein, 9 aa, Homo Sapiens
ISHKMLDQC

SEQ ID NO: 337086 - protein, 9 aa, Homo Sapiens
KHQGSLVLY

SEQ ID NO: 337087 - protein, 9 aa, Homo Sapiens
NVSKQTEYW

SEQ ID NO: 337088 - protein, 9 aa, Homo Sapiens
HREEMQKER

SEQ ID NO: 337089 - protein, 9 aa, Homo Sapiens
SEMKLDEGT

SEQ ID NO: 337090 - protein, 9 aa, Homo Sapiens
TDQRDKLER

SEQ ID NO: 337091 - protein, 9 aa, Homo Sapiens
ISLSFVISG

SEQ ID NO: 337092 - protein, 9 aa, Homo Sapiens
MRLELQISA

SEQ ID NO: 337093 - protein, 9 aa, Homo Sapiens
FLTTFQMTG

SEQ ID NO: 337094 - protein, 9 aa, Homo Sapiens
GKKFGIGLP

SEQ ID NO: 337095 - protein, 9 aa, Homo Sapiens
IVFWVLGTL

SEQ ID NO: 337096 - protein, 9 aa, Homo Sapiens
LCKTSKKVA

SEQ ID NO: 337097 - protein, 9 aa, Homo Sapiens
DRAKERRAG

SEQ ID NO: 337098 - protein, 9 aa, Homo Sapiens
FRVRKMINV

SEQ ID NO: 337099 - protein, 9 aa, Homo Sapiens
HRATVFANG

SEQ ID NO: 337100 - protein, 9 aa, Homo Sapiens
WMDRYKIDS

SEQ ID NO: 337101 - protein, 9 aa, Homo Sapiens
DSNGHLPKA

SEQ ID NO: 337102 - protein, 9 aa, Homo Sapiens
ISWFWDGQL

SEQ ID NO: 337103 - protein, 9 aa, Homo Sapiens
QFGGKRLME

SEQ ID NO: 337104 - protein, 9 aa, Homo Sapiens
LYVNQNGQK

SEQ ID NO: 337105 - protein, 9 aa, Homo Sapiens
FSRLAILPA

SEQ ID NO: 337106 - protein, 9 aa, Homo Sapiens
DDSQKDDMM

SEQ ID NO: 337107 - protein, 9 aa, Homo Sapiens
PAARHLYWD

SEQ ID NO: 337108 - protein, 9 aa, Homo Sapiens
QITLNQLGT

SEQ ID NO: 337109 - protein, 9 aa, Homo Sapiens
MSCPGRGHG

SEQ ID NO: 337110 - protein, 9 aa, Homo Sapiens
RVLVMSYSA

SEQ ID NO: 337111 - protein, 9 aa, Homo Sapiens
IRTHEKIHT

SEQ ID NO: 337112 - protein, 9 aa, Homo Sapiens
EKETLLKEK

SEQ ID NO: 337113 - protein, 9 aa, Homo Sapiens
GGKIIESPM

SEQ ID NO: 337114 - protein, 9 aa, Homo Sapiens
QRQGAVVAV

SEQ ID NO: 337115 - protein, 9 aa, Homo Sapiens
MLPFLRIGL

SEQ ID NO: 337116 - protein, 9 aa, Homo Sapiens
RIVQSMIDQ

SEQ ID NO: 337117 - protein, 9 aa, Homo Sapiens
RLRWSRFTR

SEQ ID NO: 337118 - protein, 9 aa, Homo Sapiens
DANKLSTIH

SEQ ID NO: 337119 - protein, 9 aa, Homo Sapiens
CLPNFICQN

SEQ ID NO: 337120 - protein, 9 aa, Homo Sapiens
CYDPYTQRI

SEQ ID NO: 337121 - protein, 9 aa, Homo Sapiens
AVDILGKKF

SEQ ID NO: 337122 - protein, 9 aa, Homo Sapiens
EKEATEKFI

SEQ ID NO: 337123 - protein, 9 aa, Homo Sapiens
DAQAEIEQY

SEQ ID NO: 337124 - protein, 9 aa, Homo Sapiens
KINKNKFFK

SEQ ID NO: 337125 - protein, 9 aa, Homo Sapiens
GYDTRSEAS

SEQ ID NO: 337126 - protein, 9 aa, Homo Sapiens
QCVQCASCN

SEQ ID NO: 337127 - protein, 9 aa, Homo Sapiens
TIIIVHSLL

SEQ ID NO: 337128 - protein, 9 aa, Homo Sapiens
ASACARCAH

SEQ ID NO: 337129 - protein, 9 aa, Homo Sapiens
KMSIYFRSR

SEQ ID NO: 337130 - protein, 9 aa, Homo Sapiens
SLQTSPKIG

SEQ ID NO: 337131 - protein, 9 aa, Homo Sapiens
KVMVTVKII

SEQ ID NO: 337132 - protein, 9 aa, Homo Sapiens
FALQAEIHQ

SEQ ID NO: 337133 - protein, 9 aa, Homo Sapiens
RVAGSAEMA

SEQ ID NO: 337134 - protein, 9 aa, Homo Sapiens
SSCDTFLNV

SEQ ID NO: 337135 - protein, 9 aa, Homo Sapiens
PSTMIKLPG

SEQ ID NO: 337136 - protein, 9 aa, Homo Sapiens
RNKEYCLLD

SEQ ID NO: 337137 - protein, 9 aa, Homo Sapiens
NWQIKYLNL

SEQ ID NO: 337138 - protein, 9 aa, Homo Sapiens
HILQKHGKN

SEQ ID NO: 337139 - protein, 9 aa, Homo Sapiens
LPASRFQMP

SEQ ID NO: 337140 - protein, 9 aa, Homo Sapiens
NSSVFIKPE

SEQ ID NO: 337141 - protein, 9 aa, Homo Sapiens
DSRLKKTEF

SEQ ID NO: 337142 - protein, 9 aa, Homo Sapiens
VFVGIYSTI

SEQ ID NO: 337143 - protein, 9 aa, Homo Sapiens
VQQVVHICL

SEQ ID NO: 337144 - protein, 9 aa, Homo Sapiens
RLSLLWSEV

SEQ ID NO: 337145 - protein, 9 aa, Homo Sapiens
CGTQGAEEV

SEQ ID NO: 337146 - protein, 9 aa, Homo Sapiens
ASRRSHQQE

SEQ ID NO: 337147 - protein, 9 aa, Homo Sapiens
AGVAWVSSL

SEQ ID NO: 337148 - protein, 9 aa, Homo Sapiens
RDVVSSLCR

SEQ ID NO: 337149 - protein, 9 aa, Homo Sapiens
QHLDVTVGD

SEQ ID NO: 337150 - protein, 9 aa, Homo Sapiens
RRTLHKPDR

SEQ ID NO: 337151 - protein, 9 aa, Homo Sapiens
GVQICFVNP

SEQ ID NO: 337152 - protein, 9 aa, Homo Sapiens
TDTEDPTLN

SEQ ID NO: 337153 - protein, 9 aa, Homo Sapiens
PPIKAFSDK

SEQ ID NO: 337154 - protein, 9 aa, Homo Sapiens
CVKWLIMSF

SEQ ID NO: 337155 - protein, 9 aa, Homo Sapiens
KEGGASIDL

SEQ ID NO: 337156 - protein, 9 aa, Homo Sapiens
LDLCRIIWR

SEQ ID NO: 337157 - protein, 9 aa, Homo Sapiens
VEVIQTLCL

SEQ ID NO: 337158 - protein, 9 aa, Homo Sapiens
GHPFYRGNK

SEQ ID NO: 337159 - protein, 9 aa, Homo Sapiens
QEFDFNKVF

SEQ ID NO: 337160 - protein, 9 aa, Homo Sapiens
SCQGPCTCD

SEQ ID NO: 337161 - protein, 9 aa, Homo Sapiens
QWVTGAICV

SEQ ID NO: 337162 - protein, 9 aa, Homo Sapiens
GLAMGIDNC

SEQ ID NO: 337163 - protein, 9 aa, Homo Sapiens
FSWMLLVAK

SEQ ID NO: 337164 - protein, 9 aa, Homo Sapiens
CSFGGFDLM

SEQ ID NO: 337165 - protein, 9 aa, Homo Sapiens
CEPRSQTAI

SEQ ID NO: 337166 - protein, 9 aa, Homo Sapiens
LEENFEKLW

SEQ ID NO: 337167 - protein, 9 aa, Homo Sapiens
EEAFADTEI

SEQ ID NO: 337168 - protein, 9 aa, Homo Sapiens
RPGDNTTFQ

SEQ ID NO: 337169 - protein, 9 aa, Homo Sapiens
TSERGKVKH

SEQ ID NO: 337170 - protein, 9 aa, Homo Sapiens
TYFQVHEKI

SEQ ID NO: 337171 - protein, 9 aa, Homo Sapiens
SVQSGKSDS

SEQ ID NO: 337172 - protein, 9 aa, Homo Sapiens
GVNKAQDNT

SEQ ID NO: 337173 - protein, 9 aa, Homo Sapiens
TESVYAALT

SEQ ID NO: 337174 - protein, 9 aa, Homo Sapiens
LLKRSGKLL

SEQ ID NO: 337175 - protein, 9 aa, Homo Sapiens
QIIHKGGKP

SEQ ID NO: 337176 - protein, 9 aa, Homo Sapiens
REARQKEEK

SEQ ID NO: 337177 - protein, 9 aa, Homo Sapiens
VDLTNEATT

SEQ ID NO: 337178 - protein, 9 aa, Homo Sapiens
EVCSAFLAA

SEQ ID NO: 337179 - protein, 9 aa, Homo Sapiens
KRKIKRLKP

SEQ ID NO: 337180 - protein, 9 aa, Homo Sapiens
MSIYFRSRT

SEQ ID NO: 337181 - protein, 9 aa, Homo Sapiens
ASTLSRADR

SEQ ID NO: 337182 - protein, 9 aa, Homo Sapiens
YLLGAGRQS

SEQ ID NO: 337183 - protein, 9 aa, Homo Sapiens
SPKENTSTA

SEQ ID NO: 337184 - protein, 9 aa, Homo Sapiens
SGKYGDLNP

SEQ ID NO: 337185 - protein, 9 aa, Homo Sapiens
QKDKDSIHG

SEQ ID NO: 337186 - protein, 9 aa, Homo Sapiens
ENQARRQQH

SEQ ID NO: 337187 - protein, 9 aa, Homo Sapiens
GQFIDQARA

SEQ ID NO: 337188 - protein, 9 aa, Homo Sapiens
AGVEVIVII

SEQ ID NO: 337189 - protein, 9 aa, Homo Sapiens
LIYSFLTLS

SEQ ID NO: 337190 - protein, 9 aa, Homo Sapiens
IEIGYTYFY

SEQ ID NO: 337191 - protein, 9 aa, Homo Sapiens
NATLPFVPG

SEQ ID NO: 337192 - protein, 9 aa, Homo Sapiens
GTASSPSYK

SEQ ID NO: 337193 - protein, 9 aa, Homo Sapiens
AFSDERVPC

SEQ ID NO: 337194 - protein, 9 aa, Homo Sapiens
KEADIEIIP

SEQ ID NO: 337195 - protein, 9 aa, Homo Sapiens
SSILSTHKI

SEQ ID NO: 337196 - protein, 9 aa, Homo Sapiens
VKGMGGAMY

SEQ ID NO: 337197 - protein, 9 aa, Homo Sapiens
EHQYKLFVD

SEQ ID NO: 337198 - protein, 9 aa, Homo Sapiens
DNKGDGSCD

SEQ ID NO: 337199 - protein, 9 aa, Homo Sapiens
APPKEKGLA

SEQ ID NO: 337200 - protein, 9 aa, Homo Sapiens
SVAEDPLVQ

SEQ ID NO: 337201 - protein, 9 aa, Homo Sapiens
KSLSLVLGK

SEQ ID NO: 337202 - protein, 9 aa, Homo Sapiens
ECIRFILGE

SEQ ID NO: 337203 - protein, 9 aa, Homo Sapiens
QTLFEIVVQ

SEQ ID NO: 337204 - protein, 9 aa, Homo Sapiens
ESVSSSDRI

SEQ ID NO: 337205 - protein, 9 aa, Homo Sapiens
ISFTIDVNK

SEQ ID NO: 337206 - protein, 9 aa, Homo Sapiens
TMRHSGTSA

SEQ ID NO: 337207 - protein, 9 aa, Homo Sapiens
SASLSSGRF

SEQ ID NO: 337208 - protein, 9 aa, Homo Sapiens
VSCGGGVQI

SEQ ID NO: 337209 - protein, 9 aa, Homo Sapiens
FTGILYVDP

SEQ ID NO: 337210 - protein, 9 aa, Homo Sapiens
RANSCIILK

SEQ ID NO: 337211 - protein, 9 aa, Homo Sapiens
SPEYLNLPR

SEQ ID NO: 337212 - protein, 9 aa, Homo Sapiens
TEVLYVNQN

SEQ ID NO: 337213 - protein, 9 aa, Homo Sapiens
EGSTKPIQS

SEQ ID NO: 337214 - protein, 9 aa, Homo Sapiens
EGTDVGQTQ

SEQ ID NO: 337215 - protein, 9 aa, Homo Sapiens
PDTLSYLYK

SEQ ID NO: 337216 - protein, 9 aa, Homo Sapiens
KSYDIIVEG

SEQ ID NO: 337217 - protein, 9 aa, Homo Sapiens
KARPDMQLE

SEQ ID NO: 337218 - protein, 9 aa, Homo Sapiens
VDGFTDPSH

SEQ ID NO: 337219 - protein, 9 aa, Homo Sapiens
DNTFSFSFS

SEQ ID NO: 337220 - protein, 9 aa, Homo Sapiens
GCSYDSSME

SEQ ID NO: 337221 - protein, 9 aa, Homo Sapiens
NYNKILAIS

SEQ ID NO: 337222 - protein, 9 aa, Homo Sapiens
DEINIPRCS

SEQ ID NO: 337223 - protein, 9 aa, Homo Sapiens
QWQVAEQVL

SEQ ID NO: 337224 - protein, 9 aa, Homo Sapiens
FPDTLSYLY

SEQ ID NO: 337225 - protein, 9 aa, Homo Sapiens
LLAADVLYR

SEQ ID NO: 337226 - protein, 9 aa, Homo Sapiens
SLSWDLQFP

SEQ ID NO: 337227 - protein, 9 aa, Homo Sapiens
QIRTDENGL

SEQ ID NO: 337228 - protein, 9 aa, Homo Sapiens
TRVVYQIYA

SEQ ID NO: 337229 - protein, 9 aa, Homo Sapiens
GRRGGRGHP

SEQ ID NO: 337230 - protein, 9 aa, Homo Sapiens
ISSVLIPPQ

SEQ ID NO: 337231 - protein, 9 aa, Homo Sapiens
FPYLYESYS

SEQ ID NO: 337232 - protein, 9 aa, Homo Sapiens
HRQINASRD

SEQ ID NO: 337233 - protein, 9 aa, Homo Sapiens
QKIPREPIP

SEQ ID NO: 337234 - protein, 9 aa, Homo Sapiens
IWPLGCLLY

SEQ ID NO: 337235 - protein, 9 aa, Homo Sapiens
PRSQTAIIV

SEQ ID NO: 337236 - protein, 9 aa, Homo Sapiens
GKGLRHLSM

SEQ ID NO: 337237 - protein, 9 aa, Homo Sapiens
GGTKAPWGT

SEQ ID NO: 337238 - protein, 9 aa, Homo Sapiens
KIPREPIPG

SEQ ID NO: 337239 - protein, 9 aa, Homo Sapiens
NDSSAAWDE

SEQ ID NO: 337240 - protein, 9 aa, Homo Sapiens
KGLRHLSMK

SEQ ID NO: 337241 - protein, 9 aa, Homo Sapiens
TFTVNADLS

SEQ ID NO: 337242 - protein, 9 aa, Homo Sapiens
NAVDNLDSQ

SEQ ID NO: 337243 - protein, 9 aa, Homo Sapiens
LKEDDANRK

SEQ ID NO: 337244 - protein, 9 aa, Homo Sapiens
ILDHCLCEL

SEQ ID NO: 337245 - protein, 9 aa, Homo Sapiens
YEKNKPFYT

SEQ ID NO: 337246 - protein, 9 aa, Homo Sapiens
ALLKYLSSN

SEQ ID NO: 337247 - protein, 9 aa, Homo Sapiens
ELAYEGKCI

SEQ ID NO: 337248 - protein, 9 aa, Homo Sapiens
VANTSYFHT

SEQ ID NO: 337249 - protein, 9 aa, Homo Sapiens
VLVLQAYIF

SEQ ID NO: 337250 - protein, 9 aa, Homo Sapiens
EANRDANKL

SEQ ID NO: 337251 - protein, 9 aa, Homo Sapiens
ILDLTHNTY

SEQ ID NO: 337252 - protein, 9 aa, Homo Sapiens
AQLIELIEK

SEQ ID NO: 337253 - protein, 9 aa, Homo Sapiens
LSVHDQDYG

SEQ ID NO: 337254 - protein, 9 aa, Homo Sapiens
FPALVLAPV

SEQ ID NO: 337255 - protein, 9 aa, Homo Sapiens
EYELFWGLR

SEQ ID NO: 337256 - protein, 9 aa, Homo Sapiens
GMKQKQKPA

SEQ ID NO: 337257 - protein, 9 aa, Homo Sapiens
AYVSNEGCI

SEQ ID NO: 337258 - protein, 9 aa, Homo Sapiens
KHIIGFDTG

SEQ ID NO: 337259 - protein, 9 aa, Homo Sapiens
KTKTYEYER

SEQ ID NO: 337260 - protein, 9 aa, Homo Sapiens
PTPNSDVFT

SEQ ID NO: 337261 - protein, 9 aa, Homo Sapiens
QEEAAMALK

SEQ ID NO: 337262 - protein, 9 aa, Homo Sapiens
DFIIQNLKI

SEQ ID NO: 337263 - protein, 9 aa, Homo Sapiens
DNEIKHEMD

SEQ ID NO: 337264 - protein, 9 aa, Homo Sapiens
AFEECPPPY

SEQ ID NO: 337265 - protein, 9 aa, Homo Sapiens
NCSVPSYLK

SEQ ID NO: 337266 - protein, 9 aa, Homo Sapiens
EFKTCLLED

SEQ ID NO: 337267 - protein, 9 aa, Homo Sapiens
KKNLPVQPV

SEQ ID NO: 337268 - protein, 9 aa, Homo Sapiens
TSSPNTSQM

SEQ ID NO: 337269 - protein, 9 aa, Homo Sapiens
QSQSKPYDI

SEQ ID NO: 337270 - protein, 9 aa, Homo Sapiens
GVAVKGQGV

SEQ ID NO: 337271 - protein, 9 aa, Homo Sapiens
ENKRAAAKE

SEQ ID NO: 337272 - protein, 9 aa, Homo Sapiens
ERSTILCQL

SEQ ID NO: 337273 - protein, 9 aa, Homo Sapiens
LTHNCGHHK

SEQ ID NO: 337274 - protein, 9 aa, Homo Sapiens
QKQTSFKAH

SEQ ID NO: 337275 - protein, 9 aa, Homo Sapiens
QEEHERLLE

SEQ ID NO: 337276 - protein, 9 aa, Homo Sapiens
PYRYNLFCE

SEQ ID NO: 337277 - protein, 9 aa, Homo Sapiens
TVSHHPQPY

SEQ ID NO: 337278 - protein, 9 aa, Homo Sapiens
TLLNKLDEA

SEQ ID NO: 337279 - protein, 9 aa, Homo Sapiens
LGKYLEQQC

SEQ ID NO: 337280 - protein, 9 aa, Homo Sapiens
SKNITQVYK

SEQ ID NO: 337281 - protein, 9 aa, Homo Sapiens
QLHVHCVFN

SEQ ID NO: 337282 - protein, 9 aa, Homo Sapiens
NKWSCESIC

SEQ ID NO: 337283 - protein, 9 aa, Homo Sapiens
CIELIYAAL

SEQ ID NO: 337284 - protein, 9 aa, Homo Sapiens
AQDIQEASK

SEQ ID NO: 337285 - protein, 9 aa, Homo Sapiens
LDLQNLIDC

SEQ ID NO: 337286 - protein, 9 aa, Homo Sapiens
WQEKEIKRA

SEQ ID NO: 337287 - protein, 9 aa, Homo Sapiens
PGTNILIYG

SEQ ID NO: 337288 - protein, 9 aa, Homo Sapiens
EEEEGLEDN

SEQ ID NO: 337289 - protein, 9 aa, Homo Sapiens
RSGTLFERL

SEQ ID NO: 337290 - protein, 9 aa, Homo Sapiens
VFFGPDLIT

SEQ ID NO: 337291 - protein, 9 aa, Homo Sapiens
LMLTNKCQE

SEQ ID NO: 337292 - protein, 9 aa, Homo Sapiens
NYFSAALNN

SEQ ID NO: 337293 - protein, 9 aa, Homo Sapiens
IIIVGTLQR

SEQ ID NO: 337294 - protein, 9 aa, Homo Sapiens
SGGHSDSAK

SEQ ID NO: 337295 - protein, 9 aa, Homo Sapiens
PGGFRCKCW

SEQ ID NO: 337296 - protein, 9 aa, Homo Sapiens
VATPGTNMP

SEQ ID NO: 337297 - protein, 9 aa, Homo Sapiens
LAANNVFPP

SEQ ID NO: 337298 - protein, 9 aa, Homo Sapiens
LYIPGLFSF

SEQ ID NO: 337299 - protein, 9 aa, Homo Sapiens
DIVSMEILF

SEQ ID NO: 337300 - protein, 9 aa, Homo Sapiens
MEVNFTKNR

SEQ ID NO: 337301 - protein, 9 aa, Homo Sapiens
SATLTCESN

SEQ ID NO: 337302 - protein, 9 aa, Homo Sapiens
ICHTTNLTL

SEQ ID NO: 337303 - protein, 9 aa, Homo Sapiens
GIADCIRIE

SEQ ID NO: 337304 - protein, 9 aa, Homo Sapiens
SVFTFFSSF

SEQ ID NO: 337305 - protein, 9 aa, Homo Sapiens
NSKGKKAIQ

SEQ ID NO: 337306 - protein, 9 aa, Homo Sapiens
KNLFCFGES

SEQ ID NO: 337307 - protein, 9 aa, Homo Sapiens
PSFNGILYY

SEQ ID NO: 337308 - protein, 9 aa, Homo Sapiens
FFLIDKGNA

SEQ ID NO: 337309 - protein, 9 aa, Homo Sapiens
LIQDINNNP

SEQ ID NO: 337310 - protein, 9 aa, Homo Sapiens
ESLVRCVDG

SEQ ID NO: 337311 - protein, 9 aa, Homo Sapiens
RDSWKSSGF

SEQ ID NO: 337312 - protein, 9 aa, Homo Sapiens
VGPILEMAL

SEQ ID NO: 337313 - protein, 9 aa, Homo Sapiens
CNGFDSHFS

SEQ ID NO: 337314 - protein, 9 aa, Homo Sapiens
QGQFSVQMF

SEQ ID NO: 337315 - protein, 9 aa, Homo Sapiens
RTAGEDTGG

SEQ ID NO: 337316 - protein, 9 aa, Homo Sapiens
DADISAFEL

SEQ ID NO: 337317 - protein, 9 aa, Homo Sapiens
APPPACPSK

SEQ ID NO: 337318 - protein, 9 aa, Homo Sapiens
IIYVTEADL

SEQ ID NO: 337319 - protein, 9 aa, Homo Sapiens
EEPRTATSG

SEQ ID NO: 337320 - protein, 9 aa, Homo Sapiens
IPHSSPCRV

SEQ ID NO: 337321 - protein, 9 aa, Homo Sapiens
NQNAISSSY

SEQ ID NO: 337322 - protein, 9 aa, Homo Sapiens
IPLINISEF

SEQ ID NO: 337323 - protein, 9 aa, Homo Sapiens
SLECQNLQL

SEQ ID NO: 337324 - protein, 9 aa, Homo Sapiens
MKLPQLILV

SEQ ID NO: 337325 - protein, 9 aa, Homo Sapiens
IASAMIIWI

SEQ ID NO: 337326 - protein, 9 aa, Homo Sapiens
NLFQHQVIH

SEQ ID NO: 337327 - protein, 9 aa, Homo Sapiens
HEQNTDCGG

SEQ ID NO: 337328 - protein, 9 aa, Homo Sapiens
TYLICYQRK

SEQ ID NO: 337329 - protein, 9 aa, Homo Sapiens
QNAYMLVYR

SEQ ID NO: 337330 - protein, 9 aa, Homo Sapiens
NTQENKHYA

SEQ ID NO: 337331 - protein, 9 aa, Homo Sapiens
THYKNMIQE

SEQ ID NO: 337332 - protein, 9 aa, Homo Sapiens
IVSINHQMW

SEQ ID NO: 337333 - protein, 9 aa, Homo Sapiens
RIAQLVACQ

SEQ ID NO: 337334 - protein, 9 aa, Homo Sapiens
NMRAKGTPD

SEQ ID NO: 337335 - protein, 9 aa, Homo Sapiens
QQRQEELEM

SEQ ID NO: 337336 - protein, 9 aa, Homo Sapiens
DASVKFSEC

SEQ ID NO: 337337 - protein, 9 aa, Homo Sapiens
YLNVRRNHL

SEQ ID NO: 337338 - protein, 9 aa, Homo Sapiens
DEIEHLQNE

SEQ ID NO: 337339 - protein, 9 aa, Homo Sapiens
DPEESQRQR

SEQ ID NO: 337340 - protein, 9 aa, Homo Sapiens
VLVRTGLTQ

SEQ ID NO: 337341 - protein, 9 aa, Homo Sapiens
VNLGVASYI

SEQ ID NO: 337342 - protein, 9 aa, Homo Sapiens
TSKINLHQH

SEQ ID NO: 337343 - protein, 9 aa, Homo Sapiens
LMHTKIDKL

SEQ ID NO: 337344 - protein, 9 aa, Homo Sapiens
VTVVGELFR

SEQ ID NO: 337345 - protein, 9 aa, Homo Sapiens
KLWSLNSDE

SEQ ID NO: 337346 - protein, 9 aa, Homo Sapiens
VTRLRELAR

SEQ ID NO: 337347 - protein, 9 aa, Homo Sapiens
TQQYVRADV

SEQ ID NO: 337348 - protein, 9 aa, Homo Sapiens
KCHITARLD

SEQ ID NO: 337349 - protein, 9 aa, Homo Sapiens
EKISKIYEM

SEQ ID NO: 337350 - protein, 9 aa, Homo Sapiens
EYLNLLFRI

SEQ ID NO: 337351 - protein, 9 aa, Homo Sapiens
DYFHHKSDN

SEQ ID NO: 337352 - protein, 9 aa, Homo Sapiens
SNFLSNSCW

SEQ ID NO: 337353 - protein, 9 aa, Homo Sapiens
GYIRFKKFL

SEQ ID NO: 337354 - protein, 9 aa, Homo Sapiens
SLETRVDLC

SEQ ID NO: 337355 - protein, 9 aa, Homo Sapiens
KGMGGAMYL

SEQ ID NO: 337356 - protein, 9 aa, Homo Sapiens
SDSKKKELC

SEQ ID NO: 337357 - protein, 9 aa, Homo Sapiens
NNKRDEHPA

SEQ ID NO: 337358 - protein, 9 aa, Homo Sapiens
DGKKSWKRC

SEQ ID NO: 337359 - protein, 9 aa, Homo Sapiens
KKFMERNPD

SEQ ID NO: 337360 - protein, 9 aa, Homo Sapiens
STEDKHLMS

SEQ ID NO: 337361 - protein, 9 aa, Homo Sapiens
CGPGLLCQS

SEQ ID NO: 337362 - protein, 9 aa, Homo Sapiens
QTVVALDKV

SEQ ID NO: 337363 - protein, 9 aa, Homo Sapiens
RLQRVIDRW

SEQ ID NO: 337364 - protein, 9 aa, Homo Sapiens
WSNEKDKRD

SEQ ID NO: 337365 - protein, 9 aa, Homo Sapiens
LISFLLLLF

SEQ ID NO: 337366 - protein, 9 aa, Homo Sapiens
DESGGENET

SEQ ID NO: 337367 - protein, 9 aa, Homo Sapiens
TKKKTRKDL

SEQ ID NO: 337368 - protein, 9 aa, Homo Sapiens
CNRISHLKV

SEQ ID NO: 337369 - protein, 9 aa, Homo Sapiens
KRMCSRPKS

SEQ ID NO: 337370 - protein, 9 aa, Homo Sapiens
KVNDGKWCH

SEQ ID NO: 337371 - protein, 9 aa, Homo Sapiens
SLNDDLLAQ

SEQ ID NO: 337372 - protein, 9 aa, Homo Sapiens
SAAVSCGLN

SEQ ID NO: 337373 - protein, 9 aa, Homo Sapiens
MHKTKKKKT

SEQ ID NO: 337374 - protein, 9 aa, Homo Sapiens
ASAVVRIMN

SEQ ID NO: 337375 - protein, 9 aa, Homo Sapiens
NEQALNKIL

SEQ ID NO: 337376 - protein, 9 aa, Homo Sapiens
YCTFPALVL

SEQ ID NO: 337377 - protein, 9 aa, Homo Sapiens
PKHKKFPAS

SEQ ID NO: 337378 - protein, 9 aa, Homo Sapiens
SNTAVYYCL

SEQ ID NO: 337379 - protein, 9 aa, Homo Sapiens
QADRRTSGQ

SEQ ID NO: 337380 - protein, 9 aa, Homo Sapiens
KATVNSPAI

SEQ ID NO: 337381 - protein, 9 aa, Homo Sapiens
FYPACVLLS

SEQ ID NO: 337382 - protein, 9 aa, Homo Sapiens
SQVQTLHKV

SEQ ID NO: 337383 - protein, 9 aa, Homo Sapiens
DVDIQLSLK

SEQ ID NO: 337384 - protein, 9 aa, Homo Sapiens
NQTLDFKEF

SEQ ID NO: 337385 - protein, 9 aa, Homo Sapiens
HILEQITSS

SEQ ID NO: 337386 - protein, 9 aa, Homo Sapiens
YQSGWGTQV

SEQ ID NO: 337387 - protein, 9 aa, Homo Sapiens
FPSPADIKE

SEQ ID NO: 337388 - protein, 9 aa, Homo Sapiens
RRRKQSGRG

SEQ ID NO: 337389 - protein, 9 aa, Homo Sapiens
FDWTPATST

SEQ ID NO: 337390 - protein, 9 aa, Homo Sapiens
LSSEQIHLG

SEQ ID NO: 337391 - protein, 9 aa, Homo Sapiens
AWFIRQEHF

SEQ ID NO: 337392 - protein, 9 aa, Homo Sapiens
DYLHFSPKQ

SEQ ID NO: 337393 - protein, 9 aa, Homo Sapiens
IDLVTNESI

SEQ ID NO: 337394 - protein, 9 aa, Homo Sapiens
YTDVYPKII

SEQ ID NO: 337395 - protein, 9 aa, Homo Sapiens
IGTSSDKVQ

SEQ ID NO: 337396 - protein, 9 aa, Homo Sapiens
VSPVEFFRP

SEQ ID NO: 337397 - protein, 9 aa, Homo Sapiens
VKVSAPSGI

SEQ ID NO: 337398 - protein, 9 aa, Homo Sapiens
GFYRCVVQN

SEQ ID NO: 337399 - protein, 9 aa, Homo Sapiens
ISYSDKELT

SEQ ID NO: 337400 - protein, 9 aa, Homo Sapiens
FLWSLWDTF

SEQ ID NO: 337401 - protein, 9 aa, Homo Sapiens
DAVLSKSKC

SEQ ID NO: 337402 - protein, 9 aa, Homo Sapiens
KSDQSDDEN

SEQ ID NO: 337403 - protein, 9 aa, Homo Sapiens
KPSRKKQGR

SEQ ID NO: 337404 - protein, 9 aa, Homo Sapiens
ENFLLFSLS

SEQ ID NO: 337405 - protein, 9 aa, Homo Sapiens
NLTQHWRIH

SEQ ID NO: 337406 - protein, 9 aa, Homo Sapiens
YAVRLSVAE

SEQ ID NO: 337407 - protein, 9 aa, Homo Sapiens
IRNMFDLVM

SEQ ID NO: 337408 - protein, 9 aa, Homo Sapiens
LEKELVHAR

SEQ ID NO: 337409 - protein, 9 aa, Homo Sapiens
ISSLEYGTE

SEQ ID NO: 337410 - protein, 9 aa, Homo Sapiens
ANSGIGFKT

SEQ ID NO: 337411 - protein, 9 aa, Homo Sapiens
STELDAVES

SEQ ID NO: 337412 - protein, 9 aa, Homo Sapiens
LLPGKTNLV

SEQ ID NO: 337413 - protein, 9 aa, Homo Sapiens
LNLLHLVHA

SEQ ID NO: 337414 - protein, 9 aa, Homo Sapiens
KAVRDVCFN

SEQ ID NO: 337415 - protein, 9 aa, Homo Sapiens
LIQHFNIHT

SEQ ID NO: 337416 - protein, 9 aa, Homo Sapiens
NNILDHCLC

SEQ ID NO: 337417 - protein, 9 aa, Homo Sapiens
VNKSSYSKK

SEQ ID NO: 337418 - protein, 9 aa, Homo Sapiens
FASLFHVCC

SEQ ID NO: 337419 - protein, 9 aa, Homo Sapiens
PDLIVSINH

SEQ ID NO: 337420 - protein, 9 aa, Homo Sapiens
IENTNGQLM

SEQ ID NO: 337421 - protein, 9 aa, Homo Sapiens
KALSIIVDE

SEQ ID NO: 337422 - protein, 9 aa, Homo Sapiens
YFQELLQKH

SEQ ID NO: 337423 - protein, 9 aa, Homo Sapiens
RNAMLKNIC

SEQ ID NO: 337424 - protein, 9 aa, Homo Sapiens
YSSIVLKPH

SEQ ID NO: 337425 - protein, 9 aa, Homo Sapiens
LACYWLGEK

SEQ ID NO: 337426 - protein, 9 aa, Homo Sapiens
YESSVVFGM

SEQ ID NO: 337427 - protein, 9 aa, Homo Sapiens
LPGTTNGSL

SEQ ID NO: 337428 - protein, 9 aa, Homo Sapiens
LYRQNRFAS

SEQ ID NO: 337429 - protein, 9 aa, Homo Sapiens
DLVFVINGS

SEQ ID NO: 337430 - protein, 9 aa, Homo Sapiens
IVHNLFVLR

SEQ ID NO: 337431 - protein, 9 aa, Homo Sapiens
WKLTEEDYK

SEQ ID NO: 337432 - protein, 9 aa, Homo Sapiens
ADEYYLYAK

SEQ ID NO: 337433 - protein, 9 aa, Homo Sapiens
HDEIFYTLS

SEQ ID NO: 337434 - protein, 9 aa, Homo Sapiens
ARIEYDAYC

SEQ ID NO: 337435 - protein, 9 aa, Homo Sapiens
SVFFGPDLI

SEQ ID NO: 337436 - protein, 9 aa, Homo Sapiens
SDISLDKQY

SEQ ID NO: 337437 - protein, 9 aa, Homo Sapiens
EAANQLLIV

SEQ ID NO: 337438 - protein, 9 aa, Homo Sapiens
FYSNLMLQH

SEQ ID NO: 337439 - protein, 9 aa, Homo Sapiens
SSLVLYLGS

SEQ ID NO: 337440 - protein, 9 aa, Homo Sapiens
IIWSHLELL

SEQ ID NO: 337441 - protein, 9 aa, Homo Sapiens
KLLCMYQNA

SEQ ID NO: 337442 - protein, 9 aa, Homo Sapiens
KVVPGTDQV

SEQ ID NO: 337443 - protein, 9 aa, Homo Sapiens
EDGDKRKKR

SEQ ID NO: 337444 - protein, 9 aa, Homo Sapiens
SAEMAALTQ

SEQ ID NO: 337445 - protein, 9 aa, Homo Sapiens
DEKKVDGLI

SEQ ID NO: 337446 - protein, 9 aa, Homo Sapiens
QHKWFEVAF

SEQ ID NO: 337447 - protein, 9 aa, Homo Sapiens
ERQDAHLLM

SEQ ID NO: 337448 - protein, 9 aa, Homo Sapiens
KHNQNHVVS

SEQ ID NO: 337449 - protein, 9 aa, Homo Sapiens
SFVVLGGDN

SEQ ID NO: 337450 - protein, 9 aa, Homo Sapiens
KPFKVQYML

SEQ ID NO: 337451 - protein, 9 aa, Homo Sapiens
AMWHEQEGR

SEQ ID NO: 337452 - protein, 9 aa, Homo Sapiens
TYLQQAQSQ

SEQ ID NO: 337453 - protein, 9 aa, Homo Sapiens
TLWFQSTVS

SEQ ID NO: 337454 - protein, 9 aa, Homo Sapiens
LPKNGGWNA

SEQ ID NO: 337455 - protein, 9 aa, Homo Sapiens
IPTPNSDVF

SEQ ID NO: 337456 - protein, 9 aa, Homo Sapiens
SDQTGEVIF

SEQ ID NO: 337457 - protein, 9 aa, Homo Sapiens
FLQPIQDVQ

SEQ ID NO: 337458 - protein, 9 aa, Homo Sapiens
SPSHKTTRS

SEQ ID NO: 337459 - protein, 9 aa, Homo Sapiens
TRKFTHSIP

SEQ ID NO: 337460 - protein, 9 aa, Homo Sapiens
YCLRHKRSL

SEQ ID NO: 337461 - protein, 9 aa, Homo Sapiens
WGAEALTPL

SEQ ID NO: 337462 - protein, 9 aa, Homo Sapiens
VEPTYTSLT

SEQ ID NO: 337463 - protein, 9 aa, Homo Sapiens
SEGGDQVSC

SEQ ID NO: 337464 - protein, 9 aa, Homo Sapiens
QNSDLLKLW

SEQ ID NO: 337465 - protein, 9 aa, Homo Sapiens
FLEMKLSKD

SEQ ID NO: 337466 - protein, 9 aa, Homo Sapiens
RITTIKHWI

SEQ ID NO: 337467 - protein, 9 aa, Homo Sapiens
EPGTETSQA

SEQ ID NO: 337468 - protein, 9 aa, Homo Sapiens
SYNINDYSL

SEQ ID NO: 337469 - protein, 9 aa, Homo Sapiens
IIWINEILP

SEQ ID NO: 337470 - protein, 9 aa, Homo Sapiens
VLLQNAYRE

SEQ ID NO: 337471 - protein, 9 aa, Homo Sapiens
TAMQRGDAG

SEQ ID NO: 337472 - protein, 9 aa, Homo Sapiens
YFLLYNYDL

SEQ ID NO: 337473 - protein, 9 aa, Homo Sapiens
QNSYLTIHH

SEQ ID NO: 337474 - protein, 9 aa, Homo Sapiens
MKLNSLSEL

SEQ ID NO: 337475 - protein, 9 aa, Homo Sapiens
GNVTAQIAL

SEQ ID NO: 337476 - protein, 9 aa, Homo Sapiens
LHVGGIIRT

SEQ ID NO: 337477 - protein, 9 aa, Homo Sapiens
SPADIKETM

SEQ ID NO: 337478 - protein, 9 aa, Homo Sapiens
IIEEAENGL

SEQ ID NO: 337479 - protein, 9 aa, Homo Sapiens
WQICRGNVY

SEQ ID NO: 337480 - protein, 9 aa, Homo Sapiens
LLPLHRGYI

SEQ ID NO: 337481 - protein, 9 aa, Homo Sapiens
QEETIQRIN

SEQ ID NO: 337482 - protein, 9 aa, Homo Sapiens
RICPIFVFD

SEQ ID NO: 337483 - protein, 9 aa, Homo Sapiens
SQQTLDTPN

SEQ ID NO: 337484 - protein, 9 aa, Homo Sapiens
IDGRNRELA

SEQ ID NO: 337485 - protein, 9 aa, Homo Sapiens
WKFPSSLAF

SEQ ID NO: 337486 - protein, 9 aa, Homo Sapiens
DPDEEALQR

SEQ ID NO: 337487 - protein, 9 aa, Homo Sapiens
TQIVEEADV

SEQ ID NO: 337488 - protein, 9 aa, Homo Sapiens
NCLGIYEQE

SEQ ID NO: 337489 - protein, 9 aa, Homo Sapiens
MWIVEELFG

SEQ ID NO: 337490 - protein, 9 aa, Homo Sapiens
DDDNNQTLD

SEQ ID NO: 337491 - protein, 9 aa, Homo Sapiens
VTVNVLSRK

SEQ ID NO: 337492 - protein, 9 aa, Homo Sapiens
PMFKLLPGE

SEQ ID NO: 337493 - protein, 9 aa, Homo Sapiens
RVHTGDKPY

SEQ ID NO: 337494 - protein, 9 aa, Homo Sapiens
LQPIQDVQR

SEQ ID NO: 337495 - protein, 9 aa, Homo Sapiens
LRVHATLTN

SEQ ID NO: 337496 - protein, 9 aa, Homo Sapiens
VQHNKDITL

SEQ ID NO: 337497 - protein, 9 aa, Homo Sapiens
LTIMGYDRY

SEQ ID NO: 337498 - protein, 9 aa, Homo Sapiens
ISFSFKGIQ

SEQ ID NO: 337499 - protein, 9 aa, Homo Sapiens
MILLSQIEE

SEQ ID NO: 337500 - protein, 9 aa, Homo Sapiens
SIRPIPEDN

SEQ ID NO: 337501 - protein, 9 aa, Homo Sapiens
SWIHSFRGV

SEQ ID NO: 337502 - protein, 9 aa, Homo Sapiens
SLGEIYDFD

SEQ ID NO: 337503 - protein, 9 aa, Homo Sapiens
ARIVTNYLS

SEQ ID NO: 337504 - protein, 9 aa, Homo Sapiens
GKQHGSSRK

SEQ ID NO: 337505 - protein, 9 aa, Homo Sapiens
CLACLKEEW

SEQ ID NO: 337506 - protein, 9 aa, Homo Sapiens
SHRGSSSPQ

SEQ ID NO: 337507 - protein, 9 aa, Homo Sapiens
YKIKWGMSR

SEQ ID NO: 337508 - protein, 9 aa, Homo Sapiens
MEKNVVFAI

SEQ ID NO: 337509 - protein, 9 aa, Homo Sapiens
DNKTCSVRD

SEQ ID NO: 337510 - protein, 9 aa, Homo Sapiens
SIINNSQLF

SEQ ID NO: 337511 - protein, 9 aa, Homo Sapiens
TIRQKIVDF

SEQ ID NO: 337512 - protein, 9 aa, Homo Sapiens
SILAKQQNK

SEQ ID NO: 337513 - protein, 9 aa, Homo Sapiens
SVGTIVGIY

SEQ ID NO: 337514 - protein, 9 aa, Homo Sapiens
NELNAGDVV

SEQ ID NO: 337515 - protein, 9 aa, Homo Sapiens
FNMCGISEA

SEQ ID NO: 337516 - protein, 9 aa, Homo Sapiens
CSALLSDCV

SEQ ID NO: 337517 - protein, 9 aa, Homo Sapiens
SKHAVIALH

SEQ ID NO: 337518 - protein, 9 aa, Homo Sapiens
ENIQIILET

SEQ ID NO: 337519 - protein, 9 aa, Homo Sapiens
STGEARTEE

SEQ ID NO: 337520 - protein, 9 aa, Homo Sapiens
FNCVCNAGF

SEQ ID NO: 337521 - protein, 9 aa, Homo Sapiens
YWDCIHCTQ

SEQ ID NO: 337522 - protein, 9 aa, Homo Sapiens
PSTFTYHKI

SEQ ID NO: 337523 - protein, 9 aa, Homo Sapiens
IKLWLQYTQ

SEQ ID NO: 337524 - protein, 9 aa, Homo Sapiens
NSSSVNKFA

SEQ ID NO: 337525 - protein, 9 aa, Homo Sapiens
NHNNQGTVN

SEQ ID NO: 337526 - protein, 9 aa, Homo Sapiens
PQKRSYSSS

SEQ ID NO: 337527 - protein, 9 aa, Homo Sapiens
QACKKHKLY

SEQ ID NO: 337528 - protein, 9 aa, Homo Sapiens
LSCQGPCTC

SEQ ID NO: 337529 - protein, 9 aa, Homo Sapiens
ALQAEIHQL

SEQ ID NO: 337530 - protein, 9 aa, Homo Sapiens
CILMAVLAV

SEQ ID NO: 337531 - protein, 9 aa, Homo Sapiens
LVILVATLQ

SEQ ID NO: 337532 - protein, 9 aa, Homo Sapiens
ERRLPTQAD

SEQ ID NO: 337533 - protein, 9 aa, Homo Sapiens
NISFNILDK

SEQ ID NO: 337534 - protein, 9 aa, Homo Sapiens
HTENKSFKC

SEQ ID NO: 337535 - protein, 9 aa, Homo Sapiens
PWVTKTEKT

SEQ ID NO: 337536 - protein, 9 aa, Homo Sapiens
TEHRIPKAD

SEQ ID NO: 337537 - protein, 9 aa, Homo Sapiens
LALLADDII

SEQ ID NO: 337538 - protein, 9 aa, Homo Sapiens
QTREYRYVA

SEQ ID NO: 337539 - protein, 9 aa, Homo Sapiens
GCYFHVLLA

SEQ ID NO: 337540 - protein, 9 aa, Homo Sapiens
VVLSQNSRD

SEQ ID NO: 337541 - protein, 9 aa, Homo Sapiens
YIGFYSSML

SEQ ID NO: 337542 - protein, 9 aa, Homo Sapiens
YQESKMNEN

SEQ ID NO: 337543 - protein, 9 aa, Homo Sapiens
DDIACIRKT

SEQ ID NO: 337544 - protein, 9 aa, Homo Sapiens
FQNKGKSRS

SEQ ID NO: 337545 - protein, 9 aa, Homo Sapiens
EPLKRLEKL

SEQ ID NO: 337546 - protein, 9 aa, Homo Sapiens
MFDLVMEIG

SEQ ID NO: 337547 - protein, 9 aa, Homo Sapiens
TYYYRQRHR

SEQ ID NO: 337548 - protein, 9 aa, Homo Sapiens
LTCIASGWH

SEQ ID NO: 337549 - protein, 9 aa, Homo Sapiens
KLTCSHGNY

SEQ ID NO: 337550 - protein, 9 aa, Homo Sapiens
ISLTSQSPT

SEQ ID NO: 337551 - protein, 9 aa, Homo Sapiens
EDDIVVVAL

SEQ ID NO: 337552 - protein, 9 aa, Homo Sapiens
EAGKFMITF

SEQ ID NO: 337553 - protein, 9 aa, Homo Sapiens
PGGRTNITS

SEQ ID NO: 337554 - protein, 9 aa, Homo Sapiens
HPSNCLGIC

SEQ ID NO: 337555 - protein, 9 aa, Homo Sapiens
GASNPCLNQ

SEQ ID NO: 337556 - protein, 9 aa, Homo Sapiens
LALLMFALS

SEQ ID NO: 337557 - protein, 9 aa, Homo Sapiens
ALISDLEMD

SEQ ID NO: 337558 - protein, 9 aa, Homo Sapiens
SPGHNVLGT

SEQ ID NO: 337559 - protein, 9 aa, Homo Sapiens
MDTWLVCWT

SEQ ID NO: 337560 - protein, 9 aa, Homo Sapiens
GQRSNYALT

SEQ ID NO: 337561 - protein, 9 aa, Homo Sapiens
IIEMPLLEA

SEQ ID NO: 337562 - protein, 9 aa, Homo Sapiens
LALYIPGLF

SEQ ID NO: 337563 - protein, 9 aa, Homo Sapiens
PRERDMQMG

SEQ ID NO: 337564 - protein, 9 aa, Homo Sapiens
LMAQYWKRN

SEQ ID NO: 337565 - protein, 9 aa, Homo Sapiens
LDKDISEAF

SEQ ID NO: 337566 - protein, 9 aa, Homo Sapiens
VNLIHSTHI

SEQ ID NO: 337567 - protein, 9 aa, Homo Sapiens
KEEDYQNRY

SEQ ID NO: 337568 - protein, 9 aa, Homo Sapiens
EDIKELFLG

SEQ ID NO: 337569 - protein, 9 aa, Homo Sapiens
DTNEAAALL

SEQ ID NO: 337570 - protein, 9 aa, Homo Sapiens
SFQYHGRTH

SEQ ID NO: 337571 - protein, 9 aa, Homo Sapiens
RKFILASVL

SEQ ID NO: 337572 - protein, 9 aa, Homo Sapiens
KSSDYLRVA

SEQ ID NO: 337573 - protein, 9 aa, Homo Sapiens
IPKADAPLT

SEQ ID NO: 337574 - protein, 9 aa, Homo Sapiens
ISVKWMAIE

SEQ ID NO: 337575 - protein, 9 aa, Homo Sapiens
SPGVVSTPI

SEQ ID NO: 337576 - protein, 9 aa, Homo Sapiens
LDKKHQNHY

SEQ ID NO: 337577 - protein, 9 aa, Homo Sapiens
TSIVTHRAQ

SEQ ID NO: 337578 - protein, 9 aa, Homo Sapiens
NRGDIPSEA

SEQ ID NO: 337579 - protein, 9 aa, Homo Sapiens
LVEELKALK

SEQ ID NO: 337580 - protein, 9 aa, Homo Sapiens
QVIFIATAN

SEQ ID NO: 337581 - protein, 9 aa, Homo Sapiens
KDHLWHIQG

SEQ ID NO: 337582 - protein, 9 aa, Homo Sapiens
NVEKAISKK

SEQ ID NO: 337583 - protein, 9 aa, Homo Sapiens
LEMDVADDD

SEQ ID NO: 337584 - protein, 9 aa, Homo Sapiens
GDWIMLVDD

SEQ ID NO: 337585 - protein, 9 aa, Homo Sapiens
WLCSLIRML

SEQ ID NO: 337586 - protein, 9 aa, Homo Sapiens
TAPSELSNW

SEQ ID NO: 337587 - protein, 9 aa, Homo Sapiens
TEDNKGLEL

SEQ ID NO: 337588 - protein, 9 aa, Homo Sapiens
SWSVKVKIK

SEQ ID NO: 337589 - protein, 9 aa, Homo Sapiens
LHMQHRSFI

SEQ ID NO: 337590 - protein, 9 aa, Homo Sapiens
CRVHKLIKE

SEQ ID NO: 337591 - protein, 9 aa, Homo Sapiens
QGRKKHAAE

SEQ ID NO: 337592 - protein, 9 aa, Homo Sapiens
AFLLCVCIM

SEQ ID NO: 337593 - protein, 9 aa, Homo Sapiens
FRPDNLISR

SEQ ID NO: 337594 - protein, 9 aa, Homo Sapiens
FLGFLFLAA

SEQ ID NO: 337595 - protein, 9 aa, Homo Sapiens
TCETVIVAW

SEQ ID NO: 337596 - protein, 9 aa, Homo Sapiens
FVLKDAEKI

SEQ ID NO: 337597 - protein, 9 aa, Homo Sapiens
SSSCLIHEI

SEQ ID NO: 337598 - protein, 9 aa, Homo Sapiens
VFHELFGGN

SEQ ID NO: 337599 - protein, 9 aa, Homo Sapiens
NQEKYSSSN

SEQ ID NO: 337600 - protein, 9 aa, Homo Sapiens
YSAKNTSKL

SEQ ID NO: 337601 - protein, 9 aa, Homo Sapiens
GNNVQQYHR

SEQ ID NO: 337602 - protein, 9 aa, Homo Sapiens
SCHPFSDRM

SEQ ID NO: 337603 - protein, 9 aa, Homo Sapiens
IDLVFVING

SEQ ID NO: 337604 - protein, 9 aa, Homo Sapiens
HTDMTKNLK

SEQ ID NO: 337605 - protein, 9 aa, Homo Sapiens
PYDTITQED

SEQ ID NO: 337606 - protein, 9 aa, Homo Sapiens
QVLKKRHTK

SEQ ID NO: 337607 - protein, 9 aa, Homo Sapiens
VEISMTSTR

SEQ ID NO: 337608 - protein, 9 aa, Homo Sapiens
TKIHLSPGK

SEQ ID NO: 337609 - protein, 9 aa, Homo Sapiens
TLDSYRCEC

SEQ ID NO: 337610 - protein, 9 aa, Homo Sapiens
QELSRSGML

SEQ ID NO: 337611 - protein, 9 aa, Homo Sapiens
RLCFWKLYI

SEQ ID NO: 337612 - protein, 9 aa, Homo Sapiens
QTIIFNEVE

SEQ ID NO: 337613 - protein, 9 aa, Homo Sapiens
SPSTDSALK

SEQ ID NO: 337614 - protein, 9 aa, Homo Sapiens
IFNPDYGMF

SEQ ID NO: 337615 - protein, 9 aa, Homo Sapiens
YFTSSSPSS

SEQ ID NO: 337616 - protein, 9 aa, Homo Sapiens
TDAIEAKEK

SEQ ID NO: 337617 - protein, 9 aa, Homo Sapiens
INLAKKDLE

SEQ ID NO: 337618 - protein, 9 aa, Homo Sapiens
KDITMLEEI

SEQ ID NO: 337619 - protein, 9 aa, Homo Sapiens
YIQEEIPNH

SEQ ID NO: 337620 - protein, 9 aa, Homo Sapiens
SEMVNDATE

SEQ ID NO: 337621 - protein, 9 aa, Homo Sapiens
FSSKQQCIA

SEQ ID NO: 337622 - protein, 9 aa, Homo Sapiens
EVKEEEEEE

SEQ ID NO: 337623 - protein, 9 aa, Homo Sapiens
AWQSLNVRA

SEQ ID NO: 337624 - protein, 9 aa, Homo Sapiens
TISVGIVLI

SEQ ID NO: 337625 - protein, 9 aa, Homo Sapiens
DLSLKDKKV

SEQ ID NO: 337626 - protein, 9 aa, Homo Sapiens
SSSIGVLFC

SEQ ID NO: 337627 - protein, 9 aa, Homo Sapiens
VEYLANNCT

SEQ ID NO: 337628 - protein, 9 aa, Homo Sapiens
PANISGCMQ

SEQ ID NO: 337629 - protein, 9 aa, Homo Sapiens
HEVCFVPKS

SEQ ID NO: 337630 - protein, 9 aa, Homo Sapiens
HPTVKNRRN

SEQ ID NO: 337631 - protein, 9 aa, Homo Sapiens
VIFCGYKIS

SEQ ID NO: 337632 - protein, 9 aa, Homo Sapiens
SEMASAQLK

SEQ ID NO: 337633 - protein, 9 aa, Homo Sapiens
QKLCFFQEE

SEQ ID NO: 337634 - protein, 9 aa, Homo Sapiens
KSEAKEPLK

SEQ ID NO: 337635 - protein, 9 aa, Homo Sapiens
KKKINLKDK

SEQ ID NO: 337636 - protein, 9 aa, Homo Sapiens
EKPHACSEC

SEQ ID NO: 337637 - protein, 9 aa, Homo Sapiens
LSEKCTLEG

SEQ ID NO: 337638 - protein, 9 aa, Homo Sapiens
QHSSLVMLN

SEQ ID NO: 337639 - protein, 9 aa, Homo Sapiens
EGYFQELLQ

SEQ ID NO: 337640 - protein, 9 aa, Homo Sapiens
VITRYNNHT

SEQ ID NO: 337641 - protein, 9 aa, Homo Sapiens
SLCFSEYIP

SEQ ID NO: 337642 - protein, 9 aa, Homo Sapiens
ILLHIRKFT

SEQ ID NO: 337643 - protein, 9 aa, Homo Sapiens
WIVTGLQPI

SEQ ID NO: 337644 - protein, 9 aa, Homo Sapiens
VIMAELATN

SEQ ID NO: 337645 - protein, 9 aa, Homo Sapiens
EDSDDKEKP

SEQ ID NO: 337646 - protein, 9 aa, Homo Sapiens
NEDLAHELV

SEQ ID NO: 337647 - protein, 9 aa, Homo Sapiens
SRCFHHCNP

SEQ ID NO: 337648 - protein, 9 aa, Homo Sapiens
SPNTSQMHW

SEQ ID NO: 337649 - protein, 9 aa, Homo Sapiens
PGMLQQRRP

SEQ ID NO: 337650 - protein, 9 aa, Homo Sapiens
YSPIRFCAR

SEQ ID NO: 337651 - protein, 9 aa, Homo Sapiens
CYGSCLVAS

SEQ ID NO: 337652 - protein, 9 aa, Homo Sapiens
DLCRIIWRK

SEQ ID NO: 337653 - protein, 9 aa, Homo Sapiens
VPARLTLQI

SEQ ID NO: 337654 - protein, 9 aa, Homo Sapiens
ICGPSVEPG

SEQ ID NO: 337655 - protein, 9 aa, Homo Sapiens
GFSNYSELQ

SEQ ID NO: 337656 - protein, 9 aa, Homo Sapiens
SVGCYCFRQ

SEQ ID NO: 337657 - protein, 9 aa, Homo Sapiens
HWHFSQGFP

SEQ ID NO: 337658 - protein, 9 aa, Homo Sapiens
YWKVEVAKK

SEQ ID NO: 337659 - protein, 9 aa, Homo Sapiens
RVSQIICSV

SEQ ID NO: 337660 - protein, 9 aa, Homo Sapiens
AAIDKMTNK

SEQ ID NO: 337661 - protein, 9 aa, Homo Sapiens
WCLYHKGHP

SEQ ID NO: 337662 - protein, 9 aa, Homo Sapiens
FVKLFTNAW

SEQ ID NO: 337663 - protein, 9 aa, Homo Sapiens
FPTFFQTHP

SEQ ID NO: 337664 - protein, 9 aa, Homo Sapiens
SYLHKASLK

SEQ ID NO: 337665 - protein, 9 aa, Homo Sapiens
EQIKFYEEN

SEQ ID NO: 337666 - protein, 9 aa, Homo Sapiens
QHCRLTGST

SEQ ID NO: 337667 - protein, 9 aa, Homo Sapiens
KNNISHDTF

SEQ ID NO: 337668 - protein, 9 aa, Homo Sapiens
SGFQMNQLQ

SEQ ID NO: 337669 - protein, 9 aa, Homo Sapiens
QPRLLKALK

SEQ ID NO: 337670 - protein, 9 aa, Homo Sapiens
ATILSIVGL

SEQ ID NO: 337671 - protein, 9 aa, Homo Sapiens
CCKKVQDWY

SEQ ID NO: 337672 - protein, 9 aa, Homo Sapiens
VPQDLTMEE

SEQ ID NO: 337673 - protein, 9 aa, Homo Sapiens
CRQAGIWVI

SEQ ID NO: 337674 - protein, 9 aa, Homo Sapiens
QRVVLQLKD

SEQ ID NO: 337675 - protein, 9 aa, Homo Sapiens
IMAELATNN

SEQ ID NO: 337676 - protein, 9 aa, Homo Sapiens
LMAQPPQTP

SEQ ID NO: 337677 - protein, 9 aa, Homo Sapiens
KKLEINVFK

SEQ ID NO: 337678 - protein, 9 aa, Homo Sapiens
LSQAKTQIN

SEQ ID NO: 337679 - protein, 9 aa, Homo Sapiens
TTEELNALK

SEQ ID NO: 337680 - protein, 9 aa, Homo Sapiens
VIATTVTYP

SEQ ID NO: 337681 - protein, 9 aa, Homo Sapiens
HRLSLLEDS

SEQ ID NO: 337682 - protein, 9 aa, Homo Sapiens
EVTTQNVLK

SEQ ID NO: 337683 - protein, 9 aa, Homo Sapiens
VLYKYTLDA

SEQ ID NO: 337684 - protein, 9 aa, Homo Sapiens
EAQSLRHSP

SEQ ID NO: 337685 - protein, 9 aa, Homo Sapiens
KAWGDVNRQ

SEQ ID NO: 337686 - protein, 9 aa, Homo Sapiens
CLTTFLFSL

SEQ ID NO: 337687 - protein, 9 aa, Homo Sapiens
ILVRVTRAN

SEQ ID NO: 337688 - protein, 9 aa, Homo Sapiens
DKLQTDQAE

SEQ ID NO: 337689 - protein, 9 aa, Homo Sapiens
RGNKDTPYE

SEQ ID NO: 337690 - protein, 9 aa, Homo Sapiens
DVNKQQRQL

SEQ ID NO: 337691 - protein, 9 aa, Homo Sapiens
MRVRWEIQQ

SEQ ID NO: 337692 - protein, 9 aa, Homo Sapiens
RDISTQHLQ

SEQ ID NO: 337693 - protein, 9 aa, Homo Sapiens
KDLIQHFNI

SEQ ID NO: 337694 - protein, 9 aa, Homo Sapiens
LGFNTSWER

SEQ ID NO: 337695 - protein, 9 aa, Homo Sapiens
PLEPESECI

SEQ ID NO: 337696 - protein, 9 aa, Homo Sapiens
PQTRWYKDG

SEQ ID NO: 337697 - protein, 9 aa, Homo Sapiens
LWFLQQSAQ

SEQ ID NO: 337698 - protein, 9 aa, Homo Sapiens
GDADKWVKA

SEQ ID NO: 337699 - protein, 9 aa, Homo Sapiens
STQLNLITQ

SEQ ID NO: 337700 - protein, 9 aa, Homo Sapiens
PAEQVCTIV

SEQ ID NO: 337701 - protein, 9 aa, Homo Sapiens
LQLSTEGLI

SEQ ID NO: 337702 - protein, 9 aa, Homo Sapiens
KAYEEAQKH

SEQ ID NO: 337703 - protein, 9 aa, Homo Sapiens
PARIVTNYL

SEQ ID NO: 337704 - protein, 9 aa, Homo Sapiens
PQQNSSVFI

SEQ ID NO: 337705 - protein, 9 aa, Homo Sapiens
THSGIAASV

SEQ ID NO: 337706 - protein, 9 aa, Homo Sapiens
KMINVYKPD

SEQ ID NO: 337707 - protein, 9 aa, Homo Sapiens
THGPPSMAG

SEQ ID NO: 337708 - protein, 9 aa, Homo Sapiens
CECGKTFSH

SEQ ID NO: 337709 - protein, 9 aa, Homo Sapiens
QKSYTSDLQ

SEQ ID NO: 337710 - protein, 9 aa, Homo Sapiens
VRACVIHFM

SEQ ID NO: 337711 - protein, 9 aa, Homo Sapiens
TASLVPGCS

SEQ ID NO: 337712 - protein, 9 aa, Homo Sapiens
LMYFELPDS

SEQ ID NO: 337713 - protein, 9 aa, Homo Sapiens
QFIDQARAL

SEQ ID NO: 337714 - protein, 9 aa, Homo Sapiens
RIENSFKYL

SEQ ID NO: 337715 - protein, 9 aa, Homo Sapiens
VEFITVSGY

SEQ ID NO: 337716 - protein, 9 aa, Homo Sapiens
EEGLEDNWN

SEQ ID NO: 337717 - protein, 9 aa, Homo Sapiens
LKNSDVLVR

SEQ ID NO: 337718 - protein, 9 aa, Homo Sapiens
LPFVRKSER

SEQ ID NO: 337719 - protein, 9 aa, Homo Sapiens
ANGERRKFG

SEQ ID NO: 337720 - protein, 9 aa, Homo Sapiens
SLIQIAQAE

SEQ ID NO: 337721 - protein, 9 aa, Homo Sapiens
INLLEDDSD

SEQ ID NO: 337722 - protein, 9 aa, Homo Sapiens
GDNKYGAGE

SEQ ID NO: 337723 - protein, 9 aa, Homo Sapiens
HTSSNLSRQ

SEQ ID NO: 337724 - protein, 9 aa, Homo Sapiens
MHTLHISST

SEQ ID NO: 337725 - protein, 9 aa, Homo Sapiens
KKDFLQETV

SEQ ID NO: 337726 - protein, 9 aa, Homo Sapiens
HQRVHTAVR

SEQ ID NO: 337727 - protein, 9 aa, Homo Sapiens
LYKSNKLFG

SEQ ID NO: 337728 - protein, 9 aa, Homo Sapiens
HLAVSKDNA

SEQ ID NO: 337729 - protein, 9 aa, Homo Sapiens
TSSLCKHEK

SEQ ID NO: 337730 - protein, 9 aa, Homo Sapiens
QQWSEKRPH

SEQ ID NO: 337731 - protein, 9 aa, Homo Sapiens
SLLSVSPVE

SEQ ID NO: 337732 - protein, 9 aa, Homo Sapiens
RREQMTDMA

SEQ ID NO: 337733 - protein, 9 aa, Homo Sapiens
VYEKYCANH

SEQ ID NO: 337734 - protein, 9 aa, Homo Sapiens
HCRRVVCNI

SEQ ID NO: 337735 - protein, 9 aa, Homo Sapiens
KCSVSGCNI

SEQ ID NO: 337736 - protein, 9 aa, Homo Sapiens
LSDVTGNKI

SEQ ID NO: 337737 - protein, 9 aa, Homo Sapiens
LPAGPNNTF

SEQ ID NO: 337738 - protein, 9 aa, Homo Sapiens
MASAQLKRF

SEQ ID NO: 337739 - protein, 9 aa, Homo Sapiens
IIGAVAKVI

SEQ ID NO: 337740 - protein, 9 aa, Homo Sapiens
RSSCCSQTC

SEQ ID NO: 337741 - protein, 9 aa, Homo Sapiens
KNLASPLIG

SEQ ID NO: 337742 - protein, 9 aa, Homo Sapiens
GAELKDRKA

SEQ ID NO: 337743 - protein, 9 aa, Homo Sapiens
HLKKKLDNE

SEQ ID NO: 337744 - protein, 9 aa, Homo Sapiens
DILKSNKRQ

SEQ ID NO: 337745 - protein, 9 aa, Homo Sapiens
RTLKTDALL

SEQ ID NO: 337746 - protein, 9 aa, Homo Sapiens
CKNSESVYY

SEQ ID NO: 337747 - protein, 9 aa, Homo Sapiens
ENNHSLYLG

SEQ ID NO: 337748 - protein, 9 aa, Homo Sapiens
LEYLVKKHT

SEQ ID NO: 337749 - protein, 9 aa, Homo Sapiens
IDEKSQKKN

SEQ ID NO: 337750 - protein, 9 aa, Homo Sapiens
SKGKKAIQR

SEQ ID NO: 337751 - protein, 9 aa, Homo Sapiens
ADREKRAAK

SEQ ID NO: 337752 - protein, 9 aa, Homo Sapiens
LQGEDIAFL

SEQ ID NO: 337753 - protein, 9 aa, Homo Sapiens
SSLLNLSLM

SEQ ID NO: 337754 - protein, 9 aa, Homo Sapiens
QQTGCVKCQ

SEQ ID NO: 337755 - protein, 9 aa, Homo Sapiens
KSIPSYAFN

SEQ ID NO: 337756 - protein, 9 aa, Homo Sapiens
FNLIEHYFG

SEQ ID NO: 337757 - protein, 9 aa, Homo Sapiens
EQVQKGPLT

SEQ ID NO: 337758 - protein, 9 aa, Homo Sapiens
VKVRYERFV

SEQ ID NO: 337759 - protein, 9 aa, Homo Sapiens
SRSLKLTYT

SEQ ID NO: 337760 - protein, 9 aa, Homo Sapiens
EKSQIEDEE

SEQ ID NO: 337761 - protein, 9 aa, Homo Sapiens
RVAKLRDKI

SEQ ID NO: 337762 - protein, 9 aa, Homo Sapiens
KDNAHYAVQ

SEQ ID NO: 337763 - protein, 9 aa, Homo Sapiens
LPGGLECHL

SEQ ID NO: 337764 - protein, 9 aa, Homo Sapiens
KEGGLCTVL

SEQ ID NO: 337765 - protein, 9 aa, Homo Sapiens
KCKNKQKST

SEQ ID NO: 337766 - protein, 9 aa, Homo Sapiens
ECRQAFIQK

SEQ ID NO: 337767 - protein, 9 aa, Homo Sapiens
PGFYSPLGM

SEQ ID NO: 337768 - protein, 9 aa, Homo Sapiens
EKYIEIDAL

SEQ ID NO: 337769 - protein, 9 aa, Homo Sapiens
LVPVAAAKG

SEQ ID NO: 337770 - protein, 9 aa, Homo Sapiens
SVKSERINL

SEQ ID NO: 337771 - protein, 9 aa, Homo Sapiens
LRPGTARTM

SEQ ID NO: 337772 - protein, 9 aa, Homo Sapiens
ELYRQNRFA

SEQ ID NO: 337773 - protein, 9 aa, Homo Sapiens
AAGMLSGIF

SEQ ID NO: 337774 - protein, 9 aa, Homo Sapiens
VAKFRFLNK

SEQ ID NO: 337775 - protein, 9 aa, Homo Sapiens
DKHSDSAQK

SEQ ID NO: 337776 - protein, 9 aa, Homo Sapiens
NKKPKERKQ

SEQ ID NO: 337777 - protein, 9 aa, Homo Sapiens
PCKGTLRLD

SEQ ID NO: 337778 - protein, 9 aa, Homo Sapiens
MTSERGKVK

SEQ ID NO: 337779 - protein, 9 aa, Homo Sapiens
TVSEVSVPP

SEQ ID NO: 337780 - protein, 9 aa, Homo Sapiens
DAFGTARRS

SEQ ID NO: 337781 - protein, 9 aa, Homo Sapiens
EIKELQVAF

SEQ ID NO: 337782 - protein, 9 aa, Homo Sapiens
KQITASLFK

SEQ ID NO: 337783 - protein, 9 aa, Homo Sapiens
RSGSIKRSR

SEQ ID NO: 337784 - protein, 9 aa, Homo Sapiens
AESVCSLLS

SEQ ID NO: 337785 - protein, 9 aa, Homo Sapiens
IQLYLSQTV

SEQ ID NO: 337786 - protein, 9 aa, Homo Sapiens
HPGHILVQG

SEQ ID NO: 337787 - protein, 9 aa, Homo Sapiens
LVMALDRYV

SEQ ID NO: 337788 - protein, 9 aa, Homo Sapiens
KRRGCASAP

SEQ ID NO: 337789 - protein, 9 aa, Homo Sapiens
TISLVICGT

SEQ ID NO: 337790 - protein, 9 aa, Homo Sapiens
DSSFAKHQI

SEQ ID NO: 337791 - protein, 9 aa, Homo Sapiens
CVDTHINEV

SEQ ID NO: 337792 - protein, 9 aa, Homo Sapiens
WVHLDIEIT

SEQ ID NO: 337793 - protein, 9 aa, Homo Sapiens
HKVCASGKR

SEQ ID NO: 337794 - protein, 9 aa, Homo Sapiens
VIATEKKAN

SEQ ID NO: 337795 - protein, 9 aa, Homo Sapiens
TMENILQAT

SEQ ID NO: 337796 - protein, 9 aa, Homo Sapiens
QWDDGKGAL

SEQ ID NO: 337797 - protein, 9 aa, Homo Sapiens
DFMLSFSRY

SEQ ID NO: 337798 - protein, 9 aa, Homo Sapiens
EVQTLFGLH

SEQ ID NO: 337799 - protein, 9 aa, Homo Sapiens
CVTGPRNCK

SEQ ID NO: 337800 - protein, 9 aa, Homo Sapiens
SPTELTEMQ

SEQ ID NO: 337801 - protein, 9 aa, Homo Sapiens
KTTTNIYIF

SEQ ID NO: 337802 - protein, 9 aa, Homo Sapiens
ILRLAQENK

SEQ ID NO: 337803 - protein, 9 aa, Homo Sapiens
QAQSLKTED

SEQ ID NO: 337804 - protein, 9 aa, Homo Sapiens
DAVESRAQL

SEQ ID NO: 337805 - protein, 9 aa, Homo Sapiens
RYNNHTYRI

SEQ ID NO: 337806 - protein, 9 aa, Homo Sapiens
STYFQVHEK

SEQ ID NO: 337807 - protein, 9 aa, Homo Sapiens
PPSGMIEAF

SEQ ID NO: 337808 - protein, 9 aa, Homo Sapiens
PIQSPAMSG

SEQ ID NO: 337809 - protein, 9 aa, Homo Sapiens
QSSFASCLR

SEQ ID NO: 337810 - protein, 9 aa, Homo Sapiens
AYGFVKLFT

SEQ ID NO: 337811 - protein, 9 aa, Homo Sapiens
VPNQPLKQQ

SEQ ID NO: 337812 - protein, 9 aa, Homo Sapiens
HFQGGSHSY

SEQ ID NO: 337813 - protein, 9 aa, Homo Sapiens
IKAFSDKRT

SEQ ID NO: 337814 - protein, 9 aa, Homo Sapiens
LCAIAGVLA

SEQ ID NO: 337815 - protein, 9 aa, Homo Sapiens
DLTHFVRFV

SEQ ID NO: 337816 - protein, 9 aa, Homo Sapiens
CPFICSRLS

SEQ ID NO: 337817 - protein, 9 aa, Homo Sapiens
YEDKSNGFV

SEQ ID NO: 337818 - protein, 9 aa, Homo Sapiens
EDKLLGESA

SEQ ID NO: 337819 - protein, 9 aa, Homo Sapiens
PVEKKPEAA

SEQ ID NO: 337820 - protein, 9 aa, Homo Sapiens
FRGFWSTKS

SEQ ID NO: 337821 - protein, 9 aa, Homo Sapiens
GEGATEVEI

SEQ ID NO: 337822 - protein, 9 aa, Homo Sapiens
RHRKKLILA

SEQ ID NO: 337823 - protein, 9 aa, Homo Sapiens
SLTKHIQQA

SEQ ID NO: 337824 - protein, 9 aa, Homo Sapiens
EGLKLANEH

SEQ ID NO: 337825 - protein, 9 aa, Homo Sapiens
IAGFKIFEY

SEQ ID NO: 337826 - protein, 9 aa, Homo Sapiens
NANNINDIT

SEQ ID NO: 337827 - protein, 9 aa, Homo Sapiens
GTNVEEEKN

SEQ ID NO: 337828 - protein, 9 aa, Homo Sapiens
EIAPDDYEI

SEQ ID NO: 337829 - protein, 9 aa, Homo Sapiens
HTFSAMKKV

SEQ ID NO: 337830 - protein, 9 aa, Homo Sapiens
SGIICFLLI

SEQ ID NO: 337831 - protein, 9 aa, Homo Sapiens
VTDANEAPQ

SEQ ID NO: 337832 - protein, 9 aa, Homo Sapiens
QYSHSETPL

SEQ ID NO: 337833 - protein, 9 aa, Homo Sapiens
LLSELFTNQ

SEQ ID NO: 337834 - protein, 9 aa, Homo Sapiens
FHELFGGNN

SEQ ID NO: 337835 - protein, 9 aa, Homo Sapiens
SFNQTTNED

SEQ ID NO: 337836 - protein, 9 aa, Homo Sapiens
YSPFSSFIS

SEQ ID NO: 337837 - protein, 9 aa, Homo Sapiens
AVKQRLSLK

SEQ ID NO: 337838 - protein, 9 aa, Homo Sapiens
PECLQYGHD

SEQ ID NO: 337839 - protein, 9 aa, Homo Sapiens
DKLGHGDTN

SEQ ID NO: 337840 - protein, 9 aa, Homo Sapiens
GEKPFDCIN

SEQ ID NO: 337841 - protein, 9 aa, Homo Sapiens
IVSWGSNTC

SEQ ID NO: 337842 - protein, 9 aa, Homo Sapiens
MTVESANNS

SEQ ID NO: 337843 - protein, 9 aa, Homo Sapiens
VNIFINLPR

SEQ ID NO: 337844 - protein, 9 aa, Homo Sapiens
NRNLKTQAE

SEQ ID NO: 337845 - protein, 9 aa, Homo Sapiens
DSDSESKLV

SEQ ID NO: 337846 - protein, 9 aa, Homo Sapiens
QYYQKSSVS

SEQ ID NO: 337847 - protein, 9 aa, Homo Sapiens
ILRINRTAT

SEQ ID NO: 337848 - protein, 9 aa, Homo Sapiens
ICSKKNEIM

SEQ ID NO: 337849 - protein, 9 aa, Homo Sapiens
YDTFNLHLL

SEQ ID NO: 337850 - protein, 9 aa, Homo Sapiens
IAEQLAQLA

SEQ ID NO: 337851 - protein, 9 aa, Homo Sapiens
DTSIDSLKE

SEQ ID NO: 337852 - protein, 9 aa, Homo Sapiens
ARRKLREFM

SEQ ID NO: 337853 - protein, 9 aa, Homo Sapiens
VSTSNIIPP

SEQ ID NO: 337854 - protein, 9 aa, Homo Sapiens
NEVLRELRV

SEQ ID NO: 337855 - protein, 9 aa, Homo Sapiens
QIAASKTID

SEQ ID NO: 337856 - protein, 9 aa, Homo Sapiens
PEAYFPYFT

SEQ ID NO: 337857 - protein, 9 aa, Homo Sapiens
KWFEELQKE

SEQ ID NO: 337858 - protein, 9 aa, Homo Sapiens
CGPQAYQQL

SEQ ID NO: 337859 - protein, 9 aa, Homo Sapiens
NHVVSQKIL

SEQ ID NO: 337860 - protein, 9 aa, Homo Sapiens
PRFFSAVGL

SEQ ID NO: 337861 - protein, 9 aa, Homo Sapiens
KTANKIALE

SEQ ID NO: 337862 - protein, 9 aa, Homo Sapiens
QGRILANTF

SEQ ID NO: 337863 - protein, 9 aa, Homo Sapiens
TRWRYGVSI

SEQ ID NO: 337864 - protein, 9 aa, Homo Sapiens
VKFHDLTEQ

SEQ ID NO: 337865 - protein, 9 aa, Homo Sapiens
TLNYGLVVD

SEQ ID NO: 337866 - protein, 9 aa, Homo Sapiens
MKETERHSV

SEQ ID NO: 337867 - protein, 9 aa, Homo Sapiens
SSGVKLTHQ

SEQ ID NO: 337868 - protein, 9 aa, Homo Sapiens
VFPEVLLTK

SEQ ID NO: 337869 - protein, 9 aa, Homo Sapiens
VCGHSSGPM

SEQ ID NO: 337870 - protein, 9 aa, Homo Sapiens
KYTVVFYQM

SEQ ID NO: 337871 - protein, 9 aa, Homo Sapiens
SAISDVTPD

SEQ ID NO: 337872 - protein, 9 aa, Homo Sapiens
WWTNRNGEE

SEQ ID NO: 337873 - protein, 9 aa, Homo Sapiens
DVSILQVKV

SEQ ID NO: 337874 - protein, 9 aa, Homo Sapiens
LEMDMGLRE

SEQ ID NO: 337875 - protein, 9 aa, Homo Sapiens
HTPMYLFLT

SEQ ID NO: 337876 - protein, 9 aa, Homo Sapiens
NVDMPNTSE

SEQ ID NO: 337877 - protein, 9 aa, Homo Sapiens
AVHNHTYQM

SEQ ID NO: 337878 - protein, 9 aa, Homo Sapiens
SGHLALIII

SEQ ID NO: 337879 - protein, 9 aa, Homo Sapiens
SSQNGSLKT

SEQ ID NO: 337880 - protein, 9 aa, Homo Sapiens
FSAGLWDIE

SEQ ID NO: 337881 - protein, 9 aa, Homo Sapiens
RFQPELSVP

SEQ ID NO: 337882 - protein, 9 aa, Homo Sapiens
VLISSKTEK

SEQ ID NO: 337883 - protein, 9 aa, Homo Sapiens
EDYKLAMAE

SEQ ID NO: 337884 - protein, 9 aa, Homo Sapiens
QKVEATGVS

SEQ ID NO: 337885 - protein, 9 aa, Homo Sapiens
QSLKTEDLL

SEQ ID NO: 337886 - protein, 9 aa, Homo Sapiens
TLQTAGFSE

SEQ ID NO: 337887 - protein, 9 aa, Homo Sapiens
VKDEKICQA

SEQ ID NO: 337888 - protein, 9 aa, Homo Sapiens
LLVPSLTNL

SEQ ID NO: 337889 - protein, 9 aa, Homo Sapiens
HHILQDMHK

SEQ ID NO: 337890 - protein, 9 aa, Homo Sapiens
DQDYGKNGQ

SEQ ID NO: 337891 - protein, 9 aa, Homo Sapiens
DDDSDLDFD

SEQ ID NO: 337892 - protein, 9 aa, Homo Sapiens
GWAPLHLAC

SEQ ID NO: 337893 - protein, 9 aa, Homo Sapiens
QCTQKAAKG

SEQ ID NO: 337894 - protein, 9 aa, Homo Sapiens
LFDQHCRLT

SEQ ID NO: 337895 - protein, 9 aa, Homo Sapiens
LLHIWCSNK

SEQ ID NO: 337896 - protein, 9 aa, Homo Sapiens
SGKSDSDEE

SEQ ID NO: 337897 - protein, 9 aa, Homo Sapiens
ADNDIGLTL

SEQ ID NO: 337898 - protein, 9 aa, Homo Sapiens
RIPPKYLCN

SEQ ID NO: 337899 - protein, 9 aa, Homo Sapiens
NNTFIKTLQ

SEQ ID NO: 337900 - protein, 9 aa, Homo Sapiens
PHQSRLLTI

SEQ ID NO: 337901 - protein, 9 aa, Homo Sapiens
RCICCPVGT

SEQ ID NO: 337902 - protein, 9 aa, Homo Sapiens
DPIQVVQGD

SEQ ID NO: 337903 - protein, 9 aa, Homo Sapiens
LSVTFIEAQ

SEQ ID NO: 337904 - protein, 9 aa, Homo Sapiens
GGAGKYLAK

SEQ ID NO: 337905 - protein, 9 aa, Homo Sapiens
KRYCINLAA

SEQ ID NO: 337906 - protein, 9 aa, Homo Sapiens
HTPLKKNQN

SEQ ID NO: 337907 - protein, 9 aa, Homo Sapiens
VDNIKVLTA

SEQ ID NO: 337908 - protein, 9 aa, Homo Sapiens
DEQELQKIR

SEQ ID NO: 337909 - protein, 9 aa, Homo Sapiens
ELGKTSFFT

SEQ ID NO: 337910 - protein, 9 aa, Homo Sapiens
TLKIFANLL

SEQ ID NO: 337911 - protein, 9 aa, Homo Sapiens
GGLITVLCL

SEQ ID NO: 337912 - protein, 9 aa, Homo Sapiens
TVLANFSSG

SEQ ID NO: 337913 - protein, 9 aa, Homo Sapiens
IVQLFSGLE

SEQ ID NO: 337914 - protein, 9 aa, Homo Sapiens
EILNRFQKA

SEQ ID NO: 337915 - protein, 9 aa, Homo Sapiens
LIQILETKE

SEQ ID NO: 337916 - protein, 9 aa, Homo Sapiens
LGVSGHLAL

SEQ ID NO: 337917 - protein, 9 aa, Homo Sapiens
LEQKLSQAK

SEQ ID NO: 337918 - protein, 9 aa, Homo Sapiens
KVTLQIDSS

SEQ ID NO: 337919 - protein, 9 aa, Homo Sapiens
NSQLFENGD

SEQ ID NO: 337920 - protein, 9 aa, Homo Sapiens
ICGVPTIQS

SEQ ID NO: 337921 - protein, 9 aa, Homo Sapiens
FLPDWNKAG

SEQ ID NO: 337922 - protein, 9 aa, Homo Sapiens
VVGAGDVGK

SEQ ID NO: 337923 - protein, 9 aa, Homo Sapiens
IDDGSRCLF

SEQ ID NO: 337924 - protein, 9 aa, Homo Sapiens
CLGIYEQEP

SEQ ID NO: 337925 - protein, 9 aa, Homo Sapiens
EEDKEEVEE

SEQ ID NO: 337926 - protein, 9 aa, Homo Sapiens
DVKDVSILQ

SEQ ID NO: 337927 - protein, 9 aa, Homo Sapiens
KKIMQSIKG

SEQ ID NO: 337928 - protein, 9 aa, Homo Sapiens
KDAIVIFCG

SEQ ID NO: 337929 - protein, 9 aa, Homo Sapiens
SAKNTSKLL

SEQ ID NO: 337930 - protein, 9 aa, Homo Sapiens
KCVAHVCQH

SEQ ID NO: 337931 - protein, 9 aa, Homo Sapiens
KFILASVLA

SEQ ID NO: 337932 - protein, 9 aa, Homo Sapiens
GKLSFVTQP

SEQ ID NO: 337933 - protein, 9 aa, Homo Sapiens
QDDQEFELS

SEQ ID NO: 337934 - protein, 9 aa, Homo Sapiens
EPHNGKFRE

SEQ ID NO: 337935 - protein, 9 aa, Homo Sapiens
DAKSAAHSS

SEQ ID NO: 337936 - protein, 9 aa, Homo Sapiens
VLLLTCLSI

SEQ ID NO: 337937 - protein, 9 aa, Homo Sapiens
AFPISHICL

SEQ ID NO: 337938 - protein, 9 aa, Homo Sapiens
SVSCGGGVQ

SEQ ID NO: 337939 - protein, 9 aa, Homo Sapiens
DKKANLQVI

SEQ ID NO: 337940 - protein, 9 aa, Homo Sapiens
NDDDPKFMQ

SEQ ID NO: 337941 - protein, 9 aa, Homo Sapiens
QNLEKNKMK

SEQ ID NO: 337942 - protein, 9 aa, Homo Sapiens
KWLKEAEED

SEQ ID NO: 337943 - protein, 9 aa, Homo Sapiens
FKTKHIAGK

SEQ ID NO: 337944 - protein, 9 aa, Homo Sapiens
KKPHINKPL

SEQ ID NO: 337945 - protein, 9 aa, Homo Sapiens
RVKANAREW

SEQ ID NO: 337946 - protein, 9 aa, Homo Sapiens
EIETVHGFV

SEQ ID NO: 337947 - protein, 9 aa, Homo Sapiens
LEHLLKALH

SEQ ID NO: 337948 - protein, 9 aa, Homo Sapiens
ATSSHRTLK

SEQ ID NO: 337949 - protein, 9 aa, Homo Sapiens
SQMHVYYLG

SEQ ID NO: 337950 - protein, 9 aa, Homo Sapiens
ENSYLTKLE

SEQ ID NO: 337951 - protein, 9 aa, Homo Sapiens
LAAIVGSVK

SEQ ID NO: 337952 - protein, 9 aa, Homo Sapiens
VSSALTMLQ

SEQ ID NO: 337953 - protein, 9 aa, Homo Sapiens
ALALSVTLP

SEQ ID NO: 337954 - protein, 9 aa, Homo Sapiens
TSTSNMGSY

SEQ ID NO: 337955 - protein, 9 aa, Homo Sapiens
ASIFFIERH

SEQ ID NO: 337956 - protein, 9 aa, Homo Sapiens
RRQKTRVFV

SEQ ID NO: 337957 - protein, 9 aa, Homo Sapiens
FLVELHKFY

SEQ ID NO: 337958 - protein, 9 aa, Homo Sapiens
KPHINKPLN

SEQ ID NO: 337959 - protein, 9 aa, Homo Sapiens
TGNSIRSYC

SEQ ID NO: 337960 - protein, 9 aa, Homo Sapiens
LSTALSEKC

SEQ ID NO: 337961 - protein, 9 aa, Homo Sapiens
KFPNCQCLT

SEQ ID NO: 337962 - protein, 9 aa, Homo Sapiens
DILGKKFGI

SEQ ID NO: 337963 - protein, 9 aa, Homo Sapiens
IVVVGYNGP

SEQ ID NO: 337964 - protein, 9 aa, Homo Sapiens
NSQAFNPDN

SEQ ID NO: 337965 - protein, 9 aa, Homo Sapiens
ELLAFILDG

SEQ ID NO: 337966 - protein, 9 aa, Homo Sapiens
RLEKIAEDP

SEQ ID NO: 337967 - protein, 9 aa, Homo Sapiens
YKLSLCKMS

SEQ ID NO: 337968 - protein, 9 aa, Homo Sapiens
LGDTQHREK

SEQ ID NO: 337969 - protein, 9 aa, Homo Sapiens
TIGKEFINL

SEQ ID NO: 337970 - protein, 9 aa, Homo Sapiens
FYTLQEVKI

SEQ ID NO: 337971 - protein, 9 aa, Homo Sapiens
FDLCLVNSS

SEQ ID NO: 337972 - protein, 9 aa, Homo Sapiens
HNTRSNVSF

SEQ ID NO: 337973 - protein, 9 aa, Homo Sapiens
FGDVLGACN

SEQ ID NO: 337974 - protein, 9 aa, Homo Sapiens
IKIYSKIAK

SEQ ID NO: 337975 - protein, 9 aa, Homo Sapiens
CNSSPEHNL

SEQ ID NO: 337976 - protein, 9 aa, Homo Sapiens
NLFSTNDSS

SEQ ID NO: 337977 - protein, 9 aa, Homo Sapiens
IVYLTNLLE

SEQ ID NO: 337978 - protein, 9 aa, Homo Sapiens
ALLQHNGSF

SEQ ID NO: 337979 - protein, 9 aa, Homo Sapiens
TKDKLTPLH

SEQ ID NO: 337980 - protein, 9 aa, Homo Sapiens
VKTTNVQLQ

SEQ ID NO: 337981 - protein, 9 aa, Homo Sapiens
KLFKGGGSS

SEQ ID NO: 337982 - protein, 9 aa, Homo Sapiens
EVAKNNLNP

SEQ ID NO: 337983 - protein, 9 aa, Homo Sapiens
DQRDKLERA

SEQ ID NO: 337984 - protein, 9 aa, Homo Sapiens
MRIKTTSED

SEQ ID NO: 337985 - protein, 9 aa, Homo Sapiens
RTPLKHVTV

SEQ ID NO: 337986 - protein, 9 aa, Homo Sapiens
GGFDLMNRS

SEQ ID NO: 337987 - protein, 9 aa, Homo Sapiens
TVNAYTLNS

SEQ ID NO: 337988 - protein, 9 aa, Homo Sapiens
CHMESKTGH

SEQ ID NO: 337989 - protein, 9 aa, Homo Sapiens
DKVTQEAGK

SEQ ID NO: 337990 - protein, 9 aa, Homo Sapiens
AISLWLQGL

SEQ ID NO: 337991 - protein, 9 aa, Homo Sapiens
QIILVVDPV

SEQ ID NO: 337992 - protein, 9 aa, Homo Sapiens
QEVSTTVQK

SEQ ID NO: 337993 - protein, 9 aa, Homo Sapiens
WRKGKLLVS

SEQ ID NO: 337994 - protein, 9 aa, Homo Sapiens
YLASALISN

SEQ ID NO: 337995 - protein, 9 aa, Homo Sapiens
GWNFVFEDF

SEQ ID NO: 337996 - protein, 9 aa, Homo Sapiens
IIKLFNEMA

SEQ ID NO: 337997 - protein, 9 aa, Homo Sapiens
TRLQEVCSA

SEQ ID NO: 337998 - protein, 9 aa, Homo Sapiens
TMYWYIFVF

SEQ ID NO: 337999 - protein, 9 aa, Homo Sapiens
ISLFAISAS

SEQ ID NO: 338000 - protein, 9 aa, Homo Sapiens
WICKERNQY

SEQ ID NO: 338001 - protein, 9 aa, Homo Sapiens
WLEADCHGK

SEQ ID NO: 338002 - protein, 9 aa, Homo Sapiens
LLNESNCAE

SEQ ID NO: 338003 - protein, 9 aa, Homo Sapiens
ILINDAYKI

SEQ ID NO: 338004 - protein, 9 aa, Homo Sapiens
HIYQPRFHV

SEQ ID NO: 338005 - protein, 9 aa, Homo Sapiens
AVGATAVYH

SEQ ID NO: 338006 - protein, 9 aa, Homo Sapiens
IVCLEPDDV

SEQ ID NO: 338007 - protein, 9 aa, Homo Sapiens
DAPVTPSDK

SEQ ID NO: 338008 - protein, 9 aa, Homo Sapiens
IQNEKGEIE

SEQ ID NO: 338009 - protein, 9 aa, Homo Sapiens
APNSSSLSS

SEQ ID NO: 338010 - protein, 9 aa, Homo Sapiens
QTVGIQKII

SEQ ID NO: 338011 - protein, 9 aa, Homo Sapiens
DLFGQMPGS

SEQ ID NO: 338012 - protein, 9 aa, Homo Sapiens
LLPKKLPNS

SEQ ID NO: 338013 - protein, 9 aa, Homo Sapiens
RLFSLQLLS

SEQ ID NO: 338014 - protein, 9 aa, Homo Sapiens
CSPGSLLHG

SEQ ID NO: 338015 - protein, 9 aa, Homo Sapiens
IDEIYSICS

SEQ ID NO: 338016 - protein, 9 aa, Homo Sapiens
TLHMRNHTG

SEQ ID NO: 338017 - protein, 9 aa, Homo Sapiens
FIDFDMDLQ

SEQ ID NO: 338018 - protein, 9 aa, Homo Sapiens
GQAFPLPRH

SEQ ID NO: 338019 - protein, 9 aa, Homo Sapiens
RCVVQNRMG

SEQ ID NO: 338020 - protein, 9 aa, Homo Sapiens
QALNKILSN

SEQ ID NO: 338021 - protein, 9 aa, Homo Sapiens
QIDIDVGFN

SEQ ID NO: 338022 - protein, 9 aa, Homo Sapiens
AKFFELSDL

SEQ ID NO: 338023 - protein, 9 aa, Homo Sapiens
PHISDDPSI

SEQ ID NO: 338024 - protein, 9 aa, Homo Sapiens
GQKLWADTT

SEQ ID NO: 338025 - protein, 9 aa, Homo Sapiens
SVCCEEKTV

SEQ ID NO: 338026 - protein, 9 aa, Homo Sapiens
DLQNDAPVP

SEQ ID NO: 338027 - protein, 9 aa, Homo Sapiens
IQYGNEKQR

SEQ ID NO: 338028 - protein, 9 aa, Homo Sapiens
GEKKYLAAT

SEQ ID NO: 338029 - protein, 9 aa, Homo Sapiens
FKIIQNEGI

SEQ ID NO: 338030 - protein, 9 aa, Homo Sapiens
EETNGGTQI

SEQ ID NO: 338031 - protein, 9 aa, Homo Sapiens
QHKTVVLLT

SEQ ID NO: 338032 - protein, 9 aa, Homo Sapiens
VRLGNCKPD

SEQ ID NO: 338033 - protein, 9 aa, Homo Sapiens
LSRHITSHN

SEQ ID NO: 338034 - protein, 9 aa, Homo Sapiens
DSMDSNVKK

SEQ ID NO: 338035 - protein, 9 aa, Homo Sapiens
NKQKWKERT

SEQ ID NO: 338036 - protein, 9 aa, Homo Sapiens
HQIRTDENG

SEQ ID NO: 338037 - protein, 9 aa, Homo Sapiens
QKTSKPQGK

SEQ ID NO: 338038 - protein, 9 aa, Homo Sapiens
IIEVASGKY

SEQ ID NO: 338039 - protein, 9 aa, Homo Sapiens
ASILEKESD

SEQ ID NO: 338040 - protein, 9 aa, Homo Sapiens
NKFAKHITN

SEQ ID NO: 338041 - protein, 9 aa, Homo Sapiens
QLEGLKCIE

SEQ ID NO: 338042 - protein, 9 aa, Homo Sapiens
IAPDDYEII

SEQ ID NO: 338043 - protein, 9 aa, Homo Sapiens
YLSNRCCII

SEQ ID NO: 338044 - protein, 9 aa, Homo Sapiens
ENHKFTKEL

SEQ ID NO: 338045 - protein, 9 aa, Homo Sapiens
LAEFASRHK

SEQ ID NO: 338046 - protein, 9 aa, Homo Sapiens
YRDCYDSDR

SEQ ID NO: 338047 - protein, 9 aa, Homo Sapiens
MVEVYLQKE

SEQ ID NO: 338048 - protein, 9 aa, Homo Sapiens
AAAKGRPRL

SEQ ID NO: 338049 - protein, 9 aa, Homo Sapiens
TEDLEAYIC

SEQ ID NO: 338050 - protein, 9 aa, Homo Sapiens
HLVDAHTAK

SEQ ID NO: 338051 - protein, 9 aa, Homo Sapiens
QLAQLAQGI

SEQ ID NO: 338052 - protein, 9 aa, Homo Sapiens
GADKKSSCF

SEQ ID NO: 338053 - protein, 9 aa, Homo Sapiens
LLGRKSGGV

SEQ ID NO: 338054 - protein, 9 aa, Homo Sapiens
IKHIVAEGE

SEQ ID NO: 338055 - protein, 9 aa, Homo Sapiens
SDYNSSELN

SEQ ID NO: 338056 - protein, 9 aa, Homo Sapiens
REDYGSPDL

SEQ ID NO: 338057 - protein, 9 aa, Homo Sapiens
PKAMTSILD

SEQ ID NO: 338058 - protein, 9 aa, Homo Sapiens
HNSGWGPIL

SEQ ID NO: 338059 - protein, 9 aa, Homo Sapiens
SNAYTFRDP

SEQ ID NO: 338060 - protein, 9 aa, Homo Sapiens
ETDLPVKRQ

SEQ ID NO: 338061 - protein, 9 aa, Homo Sapiens
EGDFANNET

SEQ ID NO: 338062 - protein, 9 aa, Homo Sapiens
AYTIGLIMG

SEQ ID NO: 338063 - protein, 9 aa, Homo Sapiens
EESKSYDII

SEQ ID NO: 338064 - protein, 9 aa, Homo Sapiens
DKPYQCKQC

SEQ ID NO: 338065 - protein, 9 aa, Homo Sapiens
GTPTQMFPH

SEQ ID NO: 338066 - protein, 9 aa, Homo Sapiens
CINTLDSYR

SEQ ID NO: 338067 - protein, 9 aa, Homo Sapiens
APRPGIKSS

SEQ ID NO: 338068 - protein, 9 aa, Homo Sapiens
RWECTMYWY

SEQ ID NO: 338069 - protein, 9 aa, Homo Sapiens
KAFSKSLNL

SEQ ID NO: 338070 - protein, 9 aa, Homo Sapiens
KEDAQAEIE

SEQ ID NO: 338071 - protein, 9 aa, Homo Sapiens
IVEQINCKQ

SEQ ID NO: 338072 - protein, 9 aa, Homo Sapiens
WSLGITAIK

SEQ ID NO: 338073 - protein, 9 aa, Homo Sapiens
FGSYTFEKN

SEQ ID NO: 338074 - protein, 9 aa, Homo Sapiens
RIMRLCFNH

SEQ ID NO: 338075 - protein, 9 aa, Homo Sapiens
RFLNKLIKV

SEQ ID NO: 338076 - protein, 9 aa, Homo Sapiens
WYVKKCLNG

SEQ ID NO: 338077 - protein, 9 aa, Homo Sapiens
WKGYKQWKE

SEQ ID NO: 338078 - protein, 9 aa, Homo Sapiens
SANNSVLGP

SEQ ID NO: 338079 - protein, 9 aa, Homo Sapiens
HAFLPRIPK

SEQ ID NO: 338080 - protein, 9 aa, Homo Sapiens
ASKSNINKV

SEQ ID NO: 338081 - protein, 9 aa, Homo Sapiens
GPKNIEQIH

SEQ ID NO: 338082 - protein, 9 aa, Homo Sapiens
RVTVTLFLF

SEQ ID NO: 338083 - protein, 9 aa, Homo Sapiens
RILKPKEQI

SEQ ID NO: 338084 - protein, 9 aa, Homo Sapiens
GEDSISFQI

SEQ ID NO: 338085 - protein, 9 aa, Homo Sapiens
INFSYLLSK

SEQ ID NO: 338086 - protein, 9 aa, Homo Sapiens
LEGQTHTIS

SEQ ID NO: 338087 - protein, 9 aa, Homo Sapiens
KTMEFAHYI

SEQ ID NO: 338088 - protein, 9 aa, Homo Sapiens
QGDTWVTPC

SEQ ID NO: 338089 - protein, 9 aa, Homo Sapiens
NPSGDYYYW

SEQ ID NO: 338090 - protein, 9 aa, Homo Sapiens
NLFVLRGTN

SEQ ID NO: 338091 - protein, 9 aa, Homo Sapiens
RFQMSDDID

SEQ ID NO: 338092 - protein, 9 aa, Homo Sapiens
NTEDNKGLE

SEQ ID NO: 338093 - protein, 9 aa, Homo Sapiens
DIALPLNSD

SEQ ID NO: 338094 - protein, 9 aa, Homo Sapiens
AIQREDFLR

SEQ ID NO: 338095 - protein, 9 aa, Homo Sapiens
PELCSKTKA

SEQ ID NO: 338096 - protein, 9 aa, Homo Sapiens
DGRKEIMFP

SEQ ID NO: 338097 - protein, 9 aa, Homo Sapiens
IQQLTNIHR

SEQ ID NO: 338098 - protein, 9 aa, Homo Sapiens
MAELATNNS

SEQ ID NO: 338099 - protein, 9 aa, Homo Sapiens
YPISVLVKM

SEQ ID NO: 338100 - protein, 9 aa, Homo Sapiens
FHKDSYLRN

SEQ ID NO: 338101 - protein, 9 aa, Homo Sapiens
CTQKAAKGY

SEQ ID NO: 338102 - protein, 9 aa, Homo Sapiens
IKAVPVNCA

SEQ ID NO: 338103 - protein, 9 aa, Homo Sapiens
TFQLHVHCV

SEQ ID NO: 338104 - protein, 9 aa, Homo Sapiens
NLMPDFFPV

SEQ ID NO: 338105 - protein, 9 aa, Homo Sapiens
RIEQERCKE

SEQ ID NO: 338106 - protein, 9 aa, Homo Sapiens
FDLHIYVCL

SEQ ID NO: 338107 - protein, 9 aa, Homo Sapiens
KKPWVTKTE

SEQ ID NO: 338108 - protein, 9 aa, Homo Sapiens
KGLSNLEIG

SEQ ID NO: 338109 - protein, 9 aa, Homo Sapiens
YGLDFVKKK

SEQ ID NO: 338110 - protein, 9 aa, Homo Sapiens
DLKNPRVGP

SEQ ID NO: 338111 - protein, 9 aa, Homo Sapiens
YTIDVLNQI

SEQ ID NO: 338112 - protein, 9 aa, Homo Sapiens
VLLEQKLSQ

SEQ ID NO: 338113 - protein, 9 aa, Homo Sapiens
SMTFDGQLV

SEQ ID NO: 338114 - protein, 9 aa, Homo Sapiens
HRHMNSLMD

SEQ ID NO: 338115 - protein, 9 aa, Homo Sapiens
SSGLSLVSA

SEQ ID NO: 338116 - protein, 9 aa, Homo Sapiens
AALAQDTVD

SEQ ID NO: 338117 - protein, 9 aa, Homo Sapiens
QQDAYELFT

SEQ ID NO: 338118 - protein, 9 aa, Homo Sapiens
SAQNLTKYS

SEQ ID NO: 338119 - protein, 9 aa, Homo Sapiens
SGMDSLSSE

SEQ ID NO: 338120 - protein, 9 aa, Homo Sapiens
EEPVISGKH

SEQ ID NO: 338121 - protein, 9 aa, Homo Sapiens
AELEDSDDK

SEQ ID NO: 338122 - protein, 9 aa, Homo Sapiens
VGPGKALPI

SEQ ID NO: 338123 - protein, 9 aa, Homo Sapiens
YTDLFLSLV

SEQ ID NO: 338124 - protein, 9 aa, Homo Sapiens
ENIIRTRAE

SEQ ID NO: 338125 - protein, 9 aa, Homo Sapiens
LRGHTKPQD

SEQ ID NO: 338126 - protein, 9 aa, Homo Sapiens
PLYPPVQVI

SEQ ID NO: 338127 - protein, 9 aa, Homo Sapiens
PCHPTVKNR

SEQ ID NO: 338128 - protein, 9 aa, Homo Sapiens
DSAMNTLRN

SEQ ID NO: 338129 - protein, 9 aa, Homo Sapiens
KEAKKKLAQ

SEQ ID NO: 338130 - protein, 9 aa, Homo Sapiens
PEYELFWGL

SEQ ID NO: 338131 - protein, 9 aa, Homo Sapiens
KKRKGGAMA

SEQ ID NO: 338132 - protein, 9 aa, Homo Sapiens
LPTIILSFP

SEQ ID NO: 338133 - protein, 9 aa, Homo Sapiens
PGFATMPLV

SEQ ID NO: 338134 - protein, 9 aa, Homo Sapiens
QFSDDKDGV

SEQ ID NO: 338135 - protein, 9 aa, Homo Sapiens
NENYSAELR

SEQ ID NO: 338136 - protein, 9 aa, Homo Sapiens
SVQENSQAF

SEQ ID NO: 338137 - protein, 9 aa, Homo Sapiens
QVVQGDIGE

SEQ ID NO: 338138 - protein, 9 aa, Homo Sapiens
DSYRCECRE

SEQ ID NO: 338139 - protein, 9 aa, Homo Sapiens
AFQLLLTEV

SEQ ID NO: 338140 - protein, 9 aa, Homo Sapiens
RLRFNWRGL

SEQ ID NO: 338141 - protein, 9 aa, Homo Sapiens
VGELFRLVS

SEQ ID NO: 338142 - protein, 9 aa, Homo Sapiens
IEWTFIDFD

SEQ ID NO: 338143 - protein, 9 aa, Homo Sapiens
QGPQHYPMA

SEQ ID NO: 338144 - protein, 9 aa, Homo Sapiens
WAIIYIPVN

SEQ ID NO: 338145 - protein, 9 aa, Homo Sapiens
CSTLMTVFL

SEQ ID NO: 338146 - protein, 9 aa, Homo Sapiens
KTWDCFQMR

SEQ ID NO: 338147 - protein, 9 aa, Homo Sapiens
EPQQDGGGG

SEQ ID NO: 338148 - protein, 9 aa, Homo Sapiens
LIPTSYKSK

SEQ ID NO: 338149 - protein, 9 aa, Homo Sapiens
FLRICSKKN

SEQ ID NO: 338150 - protein, 9 aa, Homo Sapiens
LGSPSCLSV

SEQ ID NO: 338151 - protein, 9 aa, Homo Sapiens
KFPDCMACD

SEQ ID NO: 338152 - protein, 9 aa, Homo Sapiens
FEKNFSRGL

SEQ ID NO: 338153 - protein, 9 aa, Homo Sapiens
ANAEKVTQK

SEQ ID NO: 338154 - protein, 9 aa, Homo Sapiens
LIQISLLVE

SEQ ID NO: 338155 - protein, 9 aa, Homo Sapiens
YGLLFTSDN

SEQ ID NO: 338156 - protein, 9 aa, Homo Sapiens
GKKYGDSPR

SEQ ID NO: 338157 - protein, 9 aa, Homo Sapiens
CQIEEMENE

SEQ ID NO: 338158 - protein, 9 aa, Homo Sapiens
TEQLPPSEG

SEQ ID NO: 338159 - protein, 9 aa, Homo Sapiens
YPIHMRKRV

SEQ ID NO: 338160 - protein, 9 aa, Homo Sapiens
SLGRQPSRI

SEQ ID NO: 338161 - protein, 9 aa, Homo Sapiens
SCIKIGSTV

SEQ ID NO: 338162 - protein, 9 aa, Homo Sapiens
TKNRKDKNQ

SEQ ID NO: 338163 - protein, 9 aa, Homo Sapiens
RLSLLEDSY

SEQ ID NO: 338164 - protein, 9 aa, Homo Sapiens
QLGVNKAQD

SEQ ID NO: 338165 - protein, 9 aa, Homo Sapiens
RHYHLNCGC

SEQ ID NO: 338166 - protein, 9 aa, Homo Sapiens
IDRWKALKA

SEQ ID NO: 338167 - protein, 9 aa, Homo Sapiens
LTLHMRNHT

SEQ ID NO: 338168 - protein, 9 aa, Homo Sapiens
LKGNEGSPG

SEQ ID NO: 338169 - protein, 9 aa, Homo Sapiens
AKNIQSIYT

SEQ ID NO: 338170 - protein, 9 aa, Homo Sapiens
GSPLGRLSA

SEQ ID NO: 338171 - protein, 9 aa, Homo Sapiens
GRDGAKGDP

SEQ ID NO: 338172 - protein, 9 aa, Homo Sapiens
WVCLGNGKG

SEQ ID NO: 338173 - protein, 9 aa, Homo Sapiens
RKYNEVLQI

SEQ ID NO: 338174 - protein, 9 aa, Homo Sapiens
NRSRPPHLH

SEQ ID NO: 338175 - protein, 9 aa, Homo Sapiens
CETKCVKPL

SEQ ID NO: 338176 - protein, 9 aa, Homo Sapiens
QAADVAIKH

SEQ ID NO: 338177 - protein, 9 aa, Homo Sapiens
KKINLKDKS

SEQ ID NO: 338178 - protein, 9 aa, Homo Sapiens
IPDNEEGLK

SEQ ID NO: 338179 - protein, 9 aa, Homo Sapiens
MKIFPIRAA

SEQ ID NO: 338180 - protein, 9 aa, Homo Sapiens
HTQNKCNQC

SEQ ID NO: 338181 - protein, 9 aa, Homo Sapiens
RKLREFMQL

SEQ ID NO: 338182 - protein, 9 aa, Homo Sapiens
SQVKYKRNF

SEQ ID NO: 338183 - protein, 9 aa, Homo Sapiens
LYLGSISTL

SEQ ID NO: 338184 - protein, 9 aa, Homo Sapiens
SVLPHTSSG

SEQ ID NO: 338185 - protein, 9 aa, Homo Sapiens
NDELPARIL

SEQ ID NO: 338186 - protein, 9 aa, Homo Sapiens
LKGLEKKEK

SEQ ID NO: 338187 - protein, 9 aa, Homo Sapiens
CNINEKQIS

SEQ ID NO: 338188 - protein, 9 aa, Homo Sapiens
KAPVPYFGP

SEQ ID NO: 338189 - protein, 9 aa, Homo Sapiens
NNRTPLVMV

SEQ ID NO: 338190 - protein, 9 aa, Homo Sapiens
AFQDLQNDA

SEQ ID NO: 338191 - protein, 9 aa, Homo Sapiens
LTGEDWNLV

SEQ ID NO: 338192 - protein, 9 aa, Homo Sapiens
FKVQYMLVV

SEQ ID NO: 338193 - protein, 9 aa, Homo Sapiens
SIEEDGSQT

SEQ ID NO: 338194 - protein, 9 aa, Homo Sapiens
VQGIIVYQA

SEQ ID NO: 338195 - protein, 9 aa, Homo Sapiens
ISEKTKCLN

SEQ ID NO: 338196 - protein, 9 aa, Homo Sapiens
SCVQACGAD

SEQ ID NO: 338197 - protein, 9 aa, Homo Sapiens
PLHYPIHMR

SEQ ID NO: 338198 - protein, 9 aa, Homo Sapiens
LGKKIKQAI

SEQ ID NO: 338199 - protein, 9 aa, Homo Sapiens
PDFRNKLQG

SEQ ID NO: 338200 - protein, 9 aa, Homo Sapiens
EEMKKICQV

SEQ ID NO: 338201 - protein, 9 aa, Homo Sapiens
GMLSGIFTT

SEQ ID NO: 338202 - protein, 9 aa, Homo Sapiens
SHILEQITS

SEQ ID NO: 338203 - protein, 9 aa, Homo Sapiens
LHFLLPGKT

SEQ ID NO: 338204 - protein, 9 aa, Homo Sapiens
SLSELAPIT

SEQ ID NO: 338205 - protein, 9 aa, Homo Sapiens
PKLTSSSET

SEQ ID NO: 338206 - protein, 9 aa, Homo Sapiens
QIEDEEEEE

SEQ ID NO: 338207 - protein, 9 aa, Homo Sapiens
NGSKSLGEE

SEQ ID NO: 338208 - protein, 9 aa, Homo Sapiens
SPRCRHARD

SEQ ID NO: 338209 - protein, 9 aa, Homo Sapiens
KIFPPEDKK

SEQ ID NO: 338210 - protein, 9 aa, Homo Sapiens
ALIASGVSI

SEQ ID NO: 338211 - protein, 9 aa, Homo Sapiens
VLDCHKKDC

SEQ ID NO: 338212 - protein, 9 aa, Homo Sapiens
VAIFCVHWR

SEQ ID NO: 338213 - protein, 9 aa, Homo Sapiens
MKVVVCVRP

SEQ ID NO: 338214 - protein, 9 aa, Homo Sapiens
ADSVPLKVT

SEQ ID NO: 338215 - protein, 9 aa, Homo Sapiens
DLGYNRLQS

SEQ ID NO: 338216 - protein, 9 aa, Homo Sapiens
IPESLPPSC

SEQ ID NO: 338217 - protein, 9 aa, Homo Sapiens
PLPWHIQIG

SEQ ID NO: 338218 - protein, 9 aa, Homo Sapiens
EQLSSLAQA

SEQ ID NO: 338219 - protein, 9 aa, Homo Sapiens
SCCRRKPFT

SEQ ID NO: 338220 - protein, 9 aa, Homo Sapiens
EITTTLSFE

SEQ ID NO: 338221 - protein, 9 aa, Homo Sapiens
LSVIRQLLL

SEQ ID NO: 338222 - protein, 9 aa, Homo Sapiens
ANQLLIVAE

SEQ ID NO: 338223 - protein, 9 aa, Homo Sapiens
VIIHKHCVY

SEQ ID NO: 338224 - protein, 9 aa, Homo Sapiens
VWLAINYRL

SEQ ID NO: 338225 - protein, 9 aa, Homo Sapiens
WLVEGNLSR

SEQ ID NO: 338226 - protein, 9 aa, Homo Sapiens
MQFLWEKAC

SEQ ID NO: 338227 - protein, 9 aa, Homo Sapiens
NEDGGEAEK

SEQ ID NO: 338228 - protein, 9 aa, Homo Sapiens
QQLRDIFNM

SEQ ID NO: 338229 - protein, 9 aa, Homo Sapiens
QYVKDRSPR

SEQ ID NO: 338230 - protein, 9 aa, Homo Sapiens
SRYLKCISC

SEQ ID NO: 338231 - protein, 9 aa, Homo Sapiens
EHKKFENLN

SEQ ID NO: 338232 - protein, 9 aa, Homo Sapiens
KCCLYLFVL

SEQ ID NO: 338233 - protein, 9 aa, Homo Sapiens
QRADEALNT

SEQ ID NO: 338234 - protein, 9 aa, Homo Sapiens
DLPFEPSNK

SEQ ID NO: 338235 - protein, 9 aa, Homo Sapiens
SKEVNILRF

SEQ ID NO: 338236 - protein, 9 aa, Homo Sapiens
AAALFDRKW

SEQ ID NO: 338237 - protein, 9 aa, Homo Sapiens
RSCGGCDTE

SEQ ID NO: 338238 - protein, 9 aa, Homo Sapiens
YHMKKCSVS

SEQ ID NO: 338239 - protein, 9 aa, Homo Sapiens
PHKLGKQQQ

SEQ ID NO: 338240 - protein, 9 aa, Homo Sapiens
KQMKETERH

SEQ ID NO: 338241 - protein, 9 aa, Homo Sapiens
QKMQELNNK

SEQ ID NO: 338242 - protein, 9 aa, Homo Sapiens
WSRSLKLTY

SEQ ID NO: 338243 - protein, 9 aa, Homo Sapiens
CNPLWYPLL

SEQ ID NO: 338244 - protein, 9 aa, Homo Sapiens
VFSKYGNTL

SEQ ID NO: 338245 - protein, 9 aa, Homo Sapiens
SRIIREKYI

SEQ ID NO: 338246 - protein, 9 aa, Homo Sapiens
GQIIRNGAA

SEQ ID NO: 338247 - protein, 9 aa, Homo Sapiens
YFDDIHRKR

SEQ ID NO: 338248 - protein, 9 aa, Homo Sapiens
KDQLCLALQ

SEQ ID NO: 338249 - protein, 9 aa, Homo Sapiens
IARRQAFNT

SEQ ID NO: 338250 - protein, 9 aa, Homo Sapiens
IVERNIQII

SEQ ID NO: 338251 - protein, 9 aa, Homo Sapiens
GNNSCPSTE

SEQ ID NO: 338252 - protein, 9 aa, Homo Sapiens
SRRKAERLV

SEQ ID NO: 338253 - protein, 9 aa, Homo Sapiens
WGSMENLAS

SEQ ID NO: 338254 - protein, 9 aa, Homo Sapiens
TPVERDSIH

SEQ ID NO: 338255 - protein, 9 aa, Homo Sapiens
TTAKTSVKP

SEQ ID NO: 338256 - protein, 9 aa, Homo Sapiens
GLSPFMGGN

SEQ ID NO: 338257 - protein, 9 aa, Homo Sapiens
TPQQNSSVF

SEQ ID NO: 338258 - protein, 9 aa, Homo Sapiens
HSTAERKLL

SEQ ID NO: 338259 - protein, 9 aa, Homo Sapiens
FLKLYAYAN

SEQ ID NO: 338260 - protein, 9 aa, Homo Sapiens
QIINQLTAM

SEQ ID NO: 338261 - protein, 9 aa, Homo Sapiens
GFQFSQALA

SEQ ID NO: 338262 - protein, 9 aa, Homo Sapiens
GLSLGGTAL

SEQ ID NO: 338263 - protein, 9 aa, Homo Sapiens
YGCLHLVSD

SEQ ID NO: 338264 - protein, 9 aa, Homo Sapiens
FTLKIFANL

SEQ ID NO: 338265 - protein, 9 aa, Homo Sapiens
TILLGYLAM

SEQ ID NO: 338266 - protein, 9 aa, Homo Sapiens
VIATPRIIE

SEQ ID NO: 338267 - protein, 9 aa, Homo Sapiens
KYLVEITLK

SEQ ID NO: 338268 - protein, 9 aa, Homo Sapiens
LQARKHKYF

SEQ ID NO: 338269 - protein, 9 aa, Homo Sapiens
SKLCGSLPF

SEQ ID NO: 338270 - protein, 9 aa, Homo Sapiens
AGGKQRSYT

SEQ ID NO: 338271 - protein, 9 aa, Homo Sapiens
SFPPNSSGW

SEQ ID NO: 338272 - protein, 9 aa, Homo Sapiens
KCGIDGVDG

SEQ ID NO: 338273 - protein, 9 aa, Homo Sapiens
HCETKCVKP

SEQ ID NO: 338274 - protein, 9 aa, Homo Sapiens
VTYHHHLYD

SEQ ID NO: 338275 - protein, 9 aa, Homo Sapiens
VMGRALSMT

SEQ ID NO: 338276 - protein, 9 aa, Homo Sapiens
ESLPFCQPV

SEQ ID NO: 338277 - protein, 9 aa, Homo Sapiens
LAVTEILGL

SEQ ID NO: 338278 - protein, 9 aa, Homo Sapiens
MDQYHFCYN

SEQ ID NO: 338279 - protein, 9 aa, Homo Sapiens
REKLRRNCT

SEQ ID NO: 338280 - protein, 9 aa, Homo Sapiens
SALKNNHKA

SEQ ID NO: 338281 - protein, 9 aa, Homo Sapiens
VFKVNKSSY

SEQ ID NO: 338282 - protein, 9 aa, Homo Sapiens
EVQCFGDIV

SEQ ID NO: 338283 - protein, 9 aa, Homo Sapiens
LNLSLMNST

SEQ ID NO: 338284 - protein, 9 aa, Homo Sapiens
LNSECAHRE

SEQ ID NO: 338285 - protein, 9 aa, Homo Sapiens
CPHEVLLCS

SEQ ID NO: 338286 - protein, 9 aa, Homo Sapiens
IMNLLVDLQ

SEQ ID NO: 338287 - protein, 9 aa, Homo Sapiens
FQYHGRTHT

SEQ ID NO: 338288 - protein, 9 aa, Homo Sapiens
HHIDNVFDS

SEQ ID NO: 338289 - protein, 9 aa, Homo Sapiens
RGHKQQNVY

SEQ ID NO: 338290 - protein, 9 aa, Homo Sapiens
KKMQFLWEK

SEQ ID NO: 338291 - protein, 9 aa, Homo Sapiens
SGTRIQQAF

SEQ ID NO: 338292 - protein, 9 aa, Homo Sapiens
WSEPSQCLE

SEQ ID NO: 338293 - protein, 9 aa, Homo Sapiens
RKKDVLLQN

SEQ ID NO: 338294 - protein, 9 aa, Homo Sapiens
VGPHQRPHI

SEQ ID NO: 338295 - protein, 9 aa, Homo Sapiens
GFKIHYASV

SEQ ID NO: 338296 - protein, 9 aa, Homo Sapiens
RPGPRCSHC

SEQ ID NO: 338297 - protein, 9 aa, Homo Sapiens
ASIDLSASS

SEQ ID NO: 338298 - protein, 9 aa, Homo Sapiens
KAVSSSSLD

SEQ ID NO: 338299 - protein, 9 aa, Homo Sapiens
SVFFTKTEW

SEQ ID NO: 338300 - protein, 9 aa, Homo Sapiens
FKIFEYNSL

SEQ ID NO: 338301 - protein, 9 aa, Homo Sapiens
ILQRLEKIA

SEQ ID NO: 338302 - protein, 9 aa, Homo Sapiens
ISWTDWGNT

SEQ ID NO: 338303 - protein, 9 aa, Homo Sapiens
REQANNILV

SEQ ID NO: 338304 - protein, 9 aa, Homo Sapiens
HFDKKICFW

SEQ ID NO: 338305 - protein, 9 aa, Homo Sapiens
SKCKREYFI

SEQ ID NO: 338306 - protein, 9 aa, Homo Sapiens
CAHREARGQ

SEQ ID NO: 338307 - protein, 9 aa, Homo Sapiens
GCASAPGAL

SEQ ID NO: 338308 - protein, 9 aa, Homo Sapiens
ILDEGHAIQ

SEQ ID NO: 338309 - protein, 9 aa, Homo Sapiens
SVAQVIQSA

SEQ ID NO: 338310 - protein, 9 aa, Homo Sapiens
DTPQKSSLT

SEQ ID NO: 338311 - protein, 9 aa, Homo Sapiens
PKTLLLDEA

SEQ ID NO: 338312 - protein, 9 aa, Homo Sapiens
SPAHNREKN

SEQ ID NO: 338313 - protein, 9 aa, Homo Sapiens
VKLFTNAWC

SEQ ID NO: 338314 - protein, 9 aa, Homo Sapiens
FMTPHSHSR

SEQ ID NO: 338315 - protein, 9 aa, Homo Sapiens
CLPGSSYSP

SEQ ID NO: 338316 - protein, 9 aa, Homo Sapiens
AGFGGLGYG

SEQ ID NO: 338317 - protein, 9 aa, Homo Sapiens
DICYSTPLM

SEQ ID NO: 338318 - protein, 9 aa, Homo Sapiens
PFNKFQFER

SEQ ID NO: 338319 - protein, 9 aa, Homo Sapiens
DGRNRELAI

SEQ ID NO: 338320 - protein, 9 aa, Homo Sapiens
VWFLEQQNQ

SEQ ID NO: 338321 - protein, 9 aa, Homo Sapiens
FCMVGLCLI

SEQ ID NO: 338322 - protein, 9 aa, Homo Sapiens
AVTKECSHV

SEQ ID NO: 338323 - protein, 9 aa, Homo Sapiens
DSPYAQVHI

SEQ ID NO: 338324 - protein, 9 aa, Homo Sapiens
DLVTNESIT

SEQ ID NO: 338325 - protein, 9 aa, Homo Sapiens
EDGKPFDLH

SEQ ID NO: 338326 - protein, 9 aa, Homo Sapiens
AACGRIRYN

SEQ ID NO: 338327 - protein, 9 aa, Homo Sapiens
CKVENGVGV

SEQ ID NO: 338328 - protein, 9 aa, Homo Sapiens
KHFFLYEEF

SEQ ID NO: 338329 - protein, 9 aa, Homo Sapiens
NQEYLNLLF

SEQ ID NO: 338330 - protein, 9 aa, Homo Sapiens
KYQGLEWKL

SEQ ID NO: 338331 - protein, 9 aa, Homo Sapiens
DQFVQLRDG

SEQ ID NO: 338332 - protein, 9 aa, Homo Sapiens
KCGICMVNM

SEQ ID NO: 338333 - protein, 9 aa, Homo Sapiens
SSSLLPHAG

SEQ ID NO: 338334 - protein, 9 aa, Homo Sapiens
RRGVAVKGQ

SEQ ID NO: 338335 - protein, 9 aa, Homo Sapiens
GILLKRSSK

SEQ ID NO: 338336 - protein, 9 aa, Homo Sapiens
YKRIILALW

SEQ ID NO: 338337 - protein, 9 aa, Homo Sapiens
QNAVNDAGF

SEQ ID NO: 338338 - protein, 9 aa, Homo Sapiens
EIYFTTKVP

SEQ ID NO: 338339 - protein, 9 aa, Homo Sapiens
SRRITNNCV

SEQ ID NO: 338340 - protein, 9 aa, Homo Sapiens
CSRCGKAYR

SEQ ID NO: 338341 - protein, 9 aa, Homo Sapiens
HQKCVIATS

SEQ ID NO: 338342 - protein, 9 aa, Homo Sapiens
WAEIAKLFP

SEQ ID NO: 338343 - protein, 9 aa, Homo Sapiens
REYLNISFN

SEQ ID NO: 338344 - protein, 9 aa, Homo Sapiens
LIVDVNKPI

SEQ ID NO: 338345 - protein, 9 aa, Homo Sapiens
VSSLVLYLG

SEQ ID NO: 338346 - protein, 9 aa, Homo Sapiens
QQAASGHCR

SEQ ID NO: 338347 - protein, 9 aa, Homo Sapiens
EQPCGKRFP

SEQ ID NO: 338348 - protein, 9 aa, Homo Sapiens
PDIYLSDWI

SEQ ID NO: 338349 - protein, 9 aa, Homo Sapiens
TYNDESQIK

SEQ ID NO: 338350 - protein, 9 aa, Homo Sapiens
GYNRLAWIV

SEQ ID NO: 338351 - protein, 9 aa, Homo Sapiens
VCVSLVFSF

SEQ ID NO: 338352 - protein, 9 aa, Homo Sapiens
MPVPYRRVE

SEQ ID NO: 338353 - protein, 9 aa, Homo Sapiens
EVTVNVLSR

SEQ ID NO: 338354 - protein, 9 aa, Homo Sapiens
AQLEGLNNF

SEQ ID NO: 338355 - protein, 9 aa, Homo Sapiens
DAIEAKEKK

SEQ ID NO: 338356 - protein, 9 aa, Homo Sapiens
NEECTMIDP

SEQ ID NO: 338357 - protein, 9 aa, Homo Sapiens
TVFEFDWKA

SEQ ID NO: 338358 - protein, 9 aa, Homo Sapiens
KDVKCHITA

SEQ ID NO: 338359 - protein, 9 aa, Homo Sapiens
TDPLTFYAT

SEQ ID NO: 338360 - protein, 9 aa, Homo Sapiens
NNLDATVTA

SEQ ID NO: 338361 - protein, 9 aa, Homo Sapiens
PVAVKKTSG

SEQ ID NO: 338362 - protein, 9 aa, Homo Sapiens
QSPTDILIS

SEQ ID NO: 338363 - protein, 9 aa, Homo Sapiens
LTTTASESI

SEQ ID NO: 338364 - protein, 9 aa, Homo Sapiens
KLCGSLPFS

SEQ ID NO: 338365 - protein, 9 aa, Homo Sapiens
WCPQDTGGG

SEQ ID NO: 338366 - protein, 9 aa, Homo Sapiens
YFRFHADKE

SEQ ID NO: 338367 - protein, 9 aa, Homo Sapiens
ICENQDLIS

SEQ ID NO: 338368 - protein, 9 aa, Homo Sapiens
ERHKSHEAE

SEQ ID NO: 338369 - protein, 9 aa, Homo Sapiens
DVLSGNCDQ

SEQ ID NO: 338370 - protein, 9 aa, Homo Sapiens
SCNEPLETT

SEQ ID NO: 338371 - protein, 9 aa, Homo Sapiens
RELRPEEIK

SEQ ID NO: 338372 - protein, 9 aa, Homo Sapiens
LSELAPITW

SEQ ID NO: 338373 - protein, 9 aa, Homo Sapiens
KQIHSAAVS

SEQ ID NO: 338374 - protein, 9 aa, Homo Sapiens
NYLSAHDND

SEQ ID NO: 338375 - protein, 9 aa, Homo Sapiens
HVLNFQNKG

SEQ ID NO: 338376 - protein, 9 aa, Homo Sapiens
QQLANNNLL

SEQ ID NO: 338377 - protein, 9 aa, Homo Sapiens
STTLTKYFT

SEQ ID NO: 338378 - protein, 9 aa, Homo Sapiens
SASSELFKP

SEQ ID NO: 338379 - protein, 9 aa, Homo Sapiens
SSFILASTP

SEQ ID NO: 338380 - protein, 9 aa, Homo Sapiens
EKNIKLFFS

SEQ ID NO: 338381 - protein, 9 aa, Homo Sapiens
GEIYDFDSI

SEQ ID NO: 338382 - protein, 9 aa, Homo Sapiens
WGDPDVECQ

SEQ ID NO: 338383 - protein, 9 aa, Homo Sapiens
SKEEQNRSS

SEQ ID NO: 338384 - protein, 9 aa, Homo Sapiens
IPGLFSFLT

SEQ ID NO: 338385 - protein, 9 aa, Homo Sapiens
FHLVAHQRT

SEQ ID NO: 338386 - protein, 9 aa, Homo Sapiens
DSESKLVID

SEQ ID NO: 338387 - protein, 9 aa, Homo Sapiens
ACPSKSPVP

SEQ ID NO: 338388 - protein, 9 aa, Homo Sapiens
AKTLARSLL

SEQ ID NO: 338389 - protein, 9 aa, Homo Sapiens
NIINNFIIF

SEQ ID NO: 338390 - protein, 9 aa, Homo Sapiens
SQINLIDLA

SEQ ID NO: 338391 - protein, 9 aa, Homo Sapiens
KNERRYSLS

SEQ ID NO: 338392 - protein, 9 aa, Homo Sapiens
MCVNWSNIR

SEQ ID NO: 338393 - protein, 9 aa, Homo Sapiens
VILALYIPG

SEQ ID NO: 338394 - protein, 9 aa, Homo Sapiens
QMKVAKNAQ

SEQ ID NO: 338395 - protein, 9 aa, Homo Sapiens
SVGDILSKK

SEQ ID NO: 338396 - protein, 9 aa, Homo Sapiens
DTIRERYFK

SEQ ID NO: 338397 - protein, 9 aa, Homo Sapiens
RALVLKAVS

SEQ ID NO: 338398 - protein, 9 aa, Homo Sapiens
QKELGMASF

SEQ ID NO: 338399 - protein, 9 aa, Homo Sapiens
IRNSSARTK

SEQ ID NO: 338400 - protein, 9 aa, Homo Sapiens
SVILLLSMG

SEQ ID NO: 338401 - protein, 9 aa, Homo Sapiens
QHAAELRDA

SEQ ID NO: 338402 - protein, 9 aa, Homo Sapiens
QRLEKIAED

SEQ ID NO: 338403 - protein, 9 aa, Homo Sapiens
SEWKMVSPM

SEQ ID NO: 338404 - protein, 9 aa, Homo Sapiens
EGCGKAFVW

SEQ ID NO: 338405 - protein, 9 aa, Homo Sapiens
SVVKKAGLA

SEQ ID NO: 338406 - protein, 9 aa, Homo Sapiens
ACGEDCLNC

SEQ ID NO: 338407 - protein, 9 aa, Homo Sapiens
CDTEIKNGQ

SEQ ID NO: 338408 - protein, 9 aa, Homo Sapiens
QSFGYGQHG

SEQ ID NO: 338409 - protein, 9 aa, Homo Sapiens
ESLCHVDAS

SEQ ID NO: 338410 - protein, 9 aa, Homo Sapiens
SLSKNITQV

SEQ ID NO: 338411 - protein, 9 aa, Homo Sapiens
VGWAISFVT

SEQ ID NO: 338412 - protein, 9 aa, Homo Sapiens
KSTPKITKS

SEQ ID NO: 338413 - protein, 9 aa, Homo Sapiens
LNVVKMGRV

SEQ ID NO: 338414 - protein, 9 aa, Homo Sapiens
QGVPQTIQD

SEQ ID NO: 338415 - protein, 9 aa, Homo Sapiens
NHPNHLFCE

SEQ ID NO: 338416 - protein, 9 aa, Homo Sapiens
QGIFKELTR

SEQ ID NO: 338417 - protein, 9 aa, Homo Sapiens
CYVKTARNP

SEQ ID NO: 338418 - protein, 9 aa, Homo Sapiens
AIALPVPVI

SEQ ID NO: 338419 - protein, 9 aa, Homo Sapiens
FILASVLAL

SEQ ID NO: 338420 - protein, 9 aa, Homo Sapiens
IFLLGEEVA

SEQ ID NO: 338421 - protein, 9 aa, Homo Sapiens
LQLNPAARK

SEQ ID NO: 338422 - protein, 9 aa, Homo Sapiens
TFSQNSYLT

SEQ ID NO: 338423 - protein, 9 aa, Homo Sapiens
TSNSTGEAR

SEQ ID NO: 338424 - protein, 9 aa, Homo Sapiens
EMQNDLFNK

SEQ ID NO: 338425 - protein, 9 aa, Homo Sapiens
DVVDQCLAC

SEQ ID NO: 338426 - protein, 9 aa, Homo Sapiens
IVLFLSVAL

SEQ ID NO: 338427 - protein, 9 aa, Homo Sapiens
NICYNVLDQ

SEQ ID NO: 338428 - protein, 9 aa, Homo Sapiens
IKCYLYPDL

SEQ ID NO: 338429 - protein, 9 aa, Homo Sapiens
EVSAHALNV

SEQ ID NO: 338430 - protein, 9 aa, Homo Sapiens
SFCHSSSFR

SEQ ID NO: 338431 - protein, 9 aa, Homo Sapiens
GGINVTTTV

SEQ ID NO: 338432 - protein, 9 aa, Homo Sapiens
DDDPKFMQD

SEQ ID NO: 338433 - protein, 9 aa, Homo Sapiens
QMTGSTLKK

SEQ ID NO: 338434 - protein, 9 aa, Homo Sapiens
KKNNISHDT

SEQ ID NO: 338435 - protein, 9 aa, Homo Sapiens
PPDSRCPSE

SEQ ID NO: 338436 - protein, 9 aa, Homo Sapiens
KEEASQNLS

SEQ ID NO: 338437 - protein, 9 aa, Homo Sapiens
EIPNHRNAV

SEQ ID NO: 338438 - protein, 9 aa, Homo Sapiens
HYMLLASEV

SEQ ID NO: 338439 - protein, 9 aa, Homo Sapiens
PAAECIRFI

SEQ ID NO: 338440 - protein, 9 aa, Homo Sapiens
EQKKTKNNL

SEQ ID NO: 338441 - protein, 9 aa, Homo Sapiens
LTSLLQTVM

SEQ ID NO: 338442 - protein, 9 aa, Homo Sapiens
QGEDIAFLA

SEQ ID NO: 338443 - protein, 9 aa, Homo Sapiens
KNVPKYQCP

SEQ ID NO: 338444 - protein, 9 aa, Homo Sapiens
KDDGKMLRC

SEQ ID NO: 338445 - protein, 9 aa, Homo Sapiens
TIPEEAQSD

SEQ ID NO: 338446 - protein, 9 aa, Homo Sapiens
QSPAMSGGI

SEQ ID NO: 338447 - protein, 9 aa, Homo Sapiens
IILMLTNKC

SEQ ID NO: 338448 - protein, 9 aa, Homo Sapiens
KLDVPDDIS

SEQ ID NO: 338449 - protein, 9 aa, Homo Sapiens
VNDATEQRT

SEQ ID NO: 338450 - protein, 9 aa, Homo Sapiens
NLPVQPVTK

SEQ ID NO: 338451 - protein, 9 aa, Homo Sapiens
MKEWSRRKA

SEQ ID NO: 338452 - protein, 9 aa, Homo Sapiens
CYCFRQTNC

SEQ ID NO: 338453 - protein, 9 aa, Homo Sapiens
FQLHVHCVF

SEQ ID NO: 338454 - protein, 9 aa, Homo Sapiens
KEINKWTVQ

SEQ ID NO: 338455 - protein, 9 aa, Homo Sapiens
KEEREAESG

SEQ ID NO: 338456 - protein, 9 aa, Homo Sapiens
IQTCKILNA

SEQ ID NO: 338457 - protein, 9 aa, Homo Sapiens
SINFQSVGS

SEQ ID NO: 338458 - protein, 9 aa, Homo Sapiens
AVAKVIATT

SEQ ID NO: 338459 - protein, 9 aa, Homo Sapiens
CLLQHERIH

SEQ ID NO: 338460 - protein, 9 aa, Homo Sapiens
HLGNTNVDI

SEQ ID NO: 338461 - protein, 9 aa, Homo Sapiens
LHFSLFVTI

SEQ ID NO: 338462 - protein, 9 aa, Homo Sapiens
QCIPSNPSH

SEQ ID NO: 338463 - protein, 9 aa, Homo Sapiens
DPFSFHLFE

SEQ ID NO: 338464 - protein, 9 aa, Homo Sapiens
QPEYRASVW

SEQ ID NO: 338465 - protein, 9 aa, Homo Sapiens
VSAQNKEKY

SEQ ID NO: 338466 - protein, 9 aa, Homo Sapiens
PGPEMANMV

SEQ ID NO: 338467 - protein, 9 aa, Homo Sapiens
KEGGKGPCG

SEQ ID NO: 338468 - protein, 9 aa, Homo Sapiens
SEAGEHEKH

SEQ ID NO: 338469 - protein, 9 aa, Homo Sapiens
VRRQIPIKL

SEQ ID NO: 338470 - protein, 9 aa, Homo Sapiens
HNYSNHSKR

SEQ ID NO: 338471 - protein, 9 aa, Homo Sapiens
FAICFVCGI

SEQ ID NO: 338472 - protein, 9 aa, Homo Sapiens
EASNFTRWR

SEQ ID NO: 338473 - protein, 9 aa, Homo Sapiens
FVVSVVKKA

SEQ ID NO: 338474 - protein, 9 aa, Homo Sapiens
GIHEYNFEI

SEQ ID NO: 338475 - protein, 9 aa, Homo Sapiens
MQELMAQYW

SEQ ID NO: 338476 - protein, 9 aa, Homo Sapiens
AENTTRAMS

SEQ ID NO: 338477 - protein, 9 aa, Homo Sapiens
RVCRHNKDT

SEQ ID NO: 338478 - protein, 9 aa, Homo Sapiens
IRMVLFGAN

SEQ ID NO: 338479 - protein, 9 aa, Homo Sapiens
LASPSGLCV

SEQ ID NO: 338480 - protein, 9 aa, Homo Sapiens
CFFDSRSKY

SEQ ID NO: 338481 - protein, 9 aa, Homo Sapiens
KRRTYNALN

SEQ ID NO: 338482 - protein, 9 aa, Homo Sapiens
NTQHSSLVM

SEQ ID NO: 338483 - protein, 9 aa, Homo Sapiens
SECIIKVQD

SEQ ID NO: 338484 - protein, 9 aa, Homo Sapiens
IKENIQIIL

SEQ ID NO: 338485 - protein, 9 aa, Homo Sapiens
KCDKCGKGY

SEQ ID NO: 338486 - protein, 9 aa, Homo Sapiens
SAEDTGKLA

SEQ ID NO: 338487 - protein, 9 aa, Homo Sapiens
IIDQRDYSN

SEQ ID NO: 338488 - protein, 9 aa, Homo Sapiens
SKNASLRTT

SEQ ID NO: 338489 - protein, 9 aa, Homo Sapiens
GALVDVKCL

SEQ ID NO: 338490 - protein, 9 aa, Homo Sapiens
EEDGSQTFD

SEQ ID NO: 338491 - protein, 9 aa, Homo Sapiens
SPSPLVYLQ

SEQ ID NO: 338492 - protein, 9 aa, Homo Sapiens
LPASTQLNL

SEQ ID NO: 338493 - protein, 9 aa, Homo Sapiens
PIPGEFEKI

SEQ ID NO: 338494 - protein, 9 aa, Homo Sapiens
KQKDDEENY

SEQ ID NO: 338495 - protein, 9 aa, Homo Sapiens
EWSRRKAER

SEQ ID NO: 338496 - protein, 9 aa, Homo Sapiens
HSKDGLLQQ

SEQ ID NO: 338497 - protein, 9 aa, Homo Sapiens
VLRISSATG

SEQ ID NO: 338498 - protein, 9 aa, Homo Sapiens
RDRLLVFFF

SEQ ID NO: 338499 - protein, 9 aa, Homo Sapiens
ENVQNNTRV

SEQ ID NO: 338500 - protein, 9 aa, Homo Sapiens
HIAHLNLQD

SEQ ID NO: 338501 - protein, 9 aa, Homo Sapiens
AGLQVFVTL

SEQ ID NO: 338502 - protein, 9 aa, Homo Sapiens
DYSPFSSFI

SEQ ID NO: 338503 - protein, 9 aa, Homo Sapiens
YTVRKQSES

SEQ ID NO: 338504 - protein, 9 aa, Homo Sapiens
HKIICTGEK

SEQ ID NO: 338505 - protein, 9 aa, Homo Sapiens
HLSVVAEGG

SEQ ID NO: 338506 - protein, 9 aa, Homo Sapiens
ICCEQCEMP

SEQ ID NO: 338507 - protein, 9 aa, Homo Sapiens
NFYNETYDY

SEQ ID NO: 338508 - protein, 9 aa, Homo Sapiens
RKKLEQHIQ

SEQ ID NO: 338509 - protein, 9 aa, Homo Sapiens
GRTKAYLTC

SEQ ID NO: 338510 - protein, 9 aa, Homo Sapiens
LVLAPVPTH

SEQ ID NO: 338511 - protein, 9 aa, Homo Sapiens
RWAYARTIH

SEQ ID NO: 338512 - protein, 9 aa, Homo Sapiens
SLKDVKDVS

SEQ ID NO: 338513 - protein, 9 aa, Homo Sapiens
TRAGFLNRE

SEQ ID NO: 338514 - protein, 9 aa, Homo Sapiens
DTFLNVFQS

SEQ ID NO: 338515 - protein, 9 aa, Homo Sapiens
EEDVTHLEV

SEQ ID NO: 338516 - protein, 9 aa, Homo Sapiens
DKRRIVVPP

SEQ ID NO: 338517 - protein, 9 aa, Homo Sapiens
QIHTGERPF

SEQ ID NO: 338518 - protein, 9 aa, Homo Sapiens
GCDTEIKNG

SEQ ID NO: 338519 - protein, 9 aa, Homo Sapiens
IFGRLEINL

SEQ ID NO: 338520 - protein, 9 aa, Homo Sapiens
IDVNKQQRQ

SEQ ID NO: 338521 - protein, 9 aa, Homo Sapiens
WKVHKGTCY

SEQ ID NO: 338522 - protein, 9 aa, Homo Sapiens
WVAAMWHEQ

SEQ ID NO: 338523 - protein, 9 aa, Homo Sapiens
CYQRKHDYV

SEQ ID NO: 338524 - protein, 9 aa, Homo Sapiens
DPQGVIRHC

SEQ ID NO: 338525 - protein, 9 aa, Homo Sapiens
EQIANFQEK

SEQ ID NO: 338526 - protein, 9 aa, Homo Sapiens
DTDDPQIKQ

SEQ ID NO: 338527 - protein, 9 aa, Homo Sapiens
LAKTIKNET

SEQ ID NO: 338528 - protein, 9 aa, Homo Sapiens
PSVIHYILY

SEQ ID NO: 338529 - protein, 9 aa, Homo Sapiens
HQNCYGSEQ

SEQ ID NO: 338530 - protein, 9 aa, Homo Sapiens
LHNLTNLLI

SEQ ID NO: 338531 - protein, 9 aa, Homo Sapiens
LRDIFNMAR

SEQ ID NO: 338532 - protein, 9 aa, Homo Sapiens
DLQSREETQ

SEQ ID NO: 338533 - protein, 9 aa, Homo Sapiens
IRSHYNLGI

SEQ ID NO: 338534 - protein, 9 aa, Homo Sapiens
LRENGEVTC

SEQ ID NO: 338535 - protein, 9 aa, Homo Sapiens
QSQDLAPSP

SEQ ID NO: 338536 - protein, 9 aa, Homo Sapiens
LKLIKGSNI

SEQ ID NO: 338537 - protein, 9 aa, Homo Sapiens
PARKEKNKV

SEQ ID NO: 338538 - protein, 9 aa, Homo Sapiens
FDRNRPSFN

SEQ ID NO: 338539 - protein, 9 aa, Homo Sapiens
LFQLNYLSG

SEQ ID NO: 338540 - protein, 9 aa, Homo Sapiens
PAKKKMKLC

SEQ ID NO: 338541 - protein, 9 aa, Homo Sapiens
QASTEGCKE

SEQ ID NO: 338542 - protein, 9 aa, Homo Sapiens
DYLPQPYRM

SEQ ID NO: 338543 - protein, 9 aa, Homo Sapiens
EWKLSASLV

SEQ ID NO: 338544 - protein, 9 aa, Homo Sapiens
VQLVGLIQS

SEQ ID NO: 338545 - protein, 9 aa, Homo Sapiens
RNEEEKILE

SEQ ID NO: 338546 - protein, 9 aa, Homo Sapiens
MMSQTMIRG

SEQ ID NO: 338547 - protein, 9 aa, Homo Sapiens
SGKSAQIPP

SEQ ID NO: 338548 - protein, 9 aa, Homo Sapiens
MGNTAVGKI

SEQ ID NO: 338549 - protein, 9 aa, Homo Sapiens
ACQPKVMCL

SEQ ID NO: 338550 - protein, 9 aa, Homo Sapiens
NTGEASNFT

SEQ ID NO: 338551 - protein, 9 aa, Homo Sapiens
TAQYSADII

SEQ ID NO: 338552 - protein, 9 aa, Homo Sapiens
PLKDPFLSN

SEQ ID NO: 338553 - protein, 9 aa, Homo Sapiens
CTMKLNSLS

SEQ ID NO: 338554 - protein, 9 aa, Homo Sapiens
PFSSIWGEK

SEQ ID NO: 338555 - protein, 9 aa, Homo Sapiens
ALDRINNNP

SEQ ID NO: 338556 - protein, 9 aa, Homo Sapiens
HFVRFVLMF

SEQ ID NO: 338557 - protein, 9 aa, Homo Sapiens
STVKESQND

SEQ ID NO: 338558 - protein, 9 aa, Homo Sapiens
LRLAQENKV

SEQ ID NO: 338559 - protein, 9 aa, Homo Sapiens
TLLETLQTA

SEQ ID NO: 338560 - protein, 9 aa, Homo Sapiens
APVTPSDKG

SEQ ID NO: 338561 - protein, 9 aa, Homo Sapiens
EIGTHDKMN

SEQ ID NO: 338562 - protein, 9 aa, Homo Sapiens
DVFSLLVMA

SEQ ID NO: 338563 - protein, 9 aa, Homo Sapiens
DSRWCSQVK

SEQ ID NO: 338564 - protein, 9 aa, Homo Sapiens
GTMGETALH

SEQ ID NO: 338565 - protein, 9 aa, Homo Sapiens
NLDKERMTT

SEQ ID NO: 338566 - protein, 9 aa, Homo Sapiens
CVDYMGSSI

SEQ ID NO: 338567 - protein, 9 aa, Homo Sapiens
RCISCDCNR

SEQ ID NO: 338568 - protein, 9 aa, Homo Sapiens
KLSVPQDLT

SEQ ID NO: 338569 - protein, 9 aa, Homo Sapiens
APDDYEIIN

SEQ ID NO: 338570 - protein, 9 aa, Homo Sapiens
MQIEQIKQL

SEQ ID NO: 338571 - protein, 9 aa, Homo Sapiens
SELFKPYYG

SEQ ID NO: 338572 - protein, 9 aa, Homo Sapiens
SNLRSLEEE

SEQ ID NO: 338573 - protein, 9 aa, Homo Sapiens
DSSAAWNET

SEQ ID NO: 338574 - protein, 9 aa, Homo Sapiens
CKLCGKGFT

SEQ ID NO: 338575 - protein, 9 aa, Homo Sapiens
PNYLQDQSH

SEQ ID NO: 338576 - protein, 9 aa, Homo Sapiens
VNQLKEEVW

SEQ ID NO: 338577 - protein, 9 aa, Homo Sapiens
KDHLEGQKH

SEQ ID NO: 338578 - protein, 9 aa, Homo Sapiens
LKIPKRPLF

SEQ ID NO: 338579 - protein, 9 aa, Homo Sapiens
GSYSLVETQ

SEQ ID NO: 338580 - protein, 9 aa, Homo Sapiens
GTFFRFPLH

SEQ ID NO: 338581 - protein, 9 aa, Homo Sapiens
CSCMLTSPP

SEQ ID NO: 338582 - protein, 9 aa, Homo Sapiens
DSIMLVVEL

SEQ ID NO: 338583 - protein, 9 aa, Homo Sapiens
DTGGIYPSV

SEQ ID NO: 338584 - protein, 9 aa, Homo Sapiens
KLLSKLEEL

SEQ ID NO: 338585 - protein, 9 aa, Homo Sapiens
ERIENSFKY

SEQ ID NO: 338586 - protein, 9 aa, Homo Sapiens
LQRLQSYSA

SEQ ID NO: 338587 - protein, 9 aa, Homo Sapiens
PHMLFDHIR

SEQ ID NO: 338588 - protein, 9 aa, Homo Sapiens
IHVYPNFRP

SEQ ID NO: 338589 - protein, 9 aa, Homo Sapiens
ISPAAECIR

SEQ ID NO: 338590 - protein, 9 aa, Homo Sapiens
VESYIHHSG

SEQ ID NO: 338591 - protein, 9 aa, Homo Sapiens
EMKLSKDVT

SEQ ID NO: 338592 - protein, 9 aa, Homo Sapiens
GVDVFSLLV

SEQ ID NO: 338593 - protein, 9 aa, Homo Sapiens
ALDGDSQGL

SEQ ID NO: 338594 - protein, 9 aa, Homo Sapiens
QGVYKNFRR

SEQ ID NO: 338595 - protein, 9 aa, Homo Sapiens
LPEFHLLRD

SEQ ID NO: 338596 - protein, 9 aa, Homo Sapiens
VAEEEEDKE

SEQ ID NO: 338597 - protein, 9 aa, Homo Sapiens
DSQELLAFI

SEQ ID NO: 338598 - protein, 9 aa, Homo Sapiens
PLGRLSAGS

SEQ ID NO: 338599 - protein, 9 aa, Homo Sapiens
RVHATLTNT

SEQ ID NO: 338600 - protein, 9 aa, Homo Sapiens
RDIFNMARD

SEQ ID NO: 338601 - protein, 9 aa, Homo Sapiens
MRKNPLAVS

SEQ ID NO: 338602 - protein, 9 aa, Homo Sapiens
MTISICINS

SEQ ID NO: 338603 - protein, 9 aa, Homo Sapiens
RSSKSLNKE

SEQ ID NO: 338604 - protein, 9 aa, Homo Sapiens
VSKSVRLYL

SEQ ID NO: 338605 - protein, 9 aa, Homo Sapiens
RDLIRQIEC

SEQ ID NO: 338606 - protein, 9 aa, Homo Sapiens
LEKPVLLSK

SEQ ID NO: 338607 - protein, 9 aa, Homo Sapiens
INSMSKQAI

SEQ ID NO: 338608 - protein, 9 aa, Homo Sapiens
KAEFDDKHL

SEQ ID NO: 338609 - protein, 9 aa, Homo Sapiens
KTLGIIFGV

SEQ ID NO: 338610 - protein, 9 aa, Homo Sapiens
HKKADAEEE

SEQ ID NO: 338611 - protein, 9 aa, Homo Sapiens
FPFQNNNKW

SEQ ID NO: 338612 - protein, 9 aa, Homo Sapiens
LDAIDWNEA

SEQ ID NO: 338613 - protein, 9 aa, Homo Sapiens
LVLHFLQQH

SEQ ID NO: 338614 - protein, 9 aa, Homo Sapiens
IAEPEWVMQ

SEQ ID NO: 338615 - protein, 9 aa, Homo Sapiens
GLLSANSKN

SEQ ID NO: 338616 - protein, 9 aa, Homo Sapiens
PRKAFRGAM

SEQ ID NO: 338617 - protein, 9 aa, Homo Sapiens
KLMKNIQFP

SEQ ID NO: 338618 - protein, 9 aa, Homo Sapiens
DGKLCLMWC

SEQ ID NO: 338619 - protein, 9 aa, Homo Sapiens
INEDVIVWM

SEQ ID NO: 338620 - protein, 9 aa, Homo Sapiens
PQWKKFCSN

SEQ ID NO: 338621 - protein, 9 aa, Homo Sapiens
YLYTARDQD

SEQ ID NO: 338622 - protein, 9 aa, Homo Sapiens
ENILQATKS

SEQ ID NO: 338623 - protein, 9 aa, Homo Sapiens
PQKLPTSLK

SEQ ID NO: 338624 - protein, 9 aa, Homo Sapiens
RSIIRINFC

SEQ ID NO: 338625 - protein, 9 aa, Homo Sapiens
QYQHVPVEI

SEQ ID NO: 338626 - protein, 9 aa, Homo Sapiens
LLIPPLETV

SEQ ID NO: 338627 - protein, 9 aa, Homo Sapiens
DKIPLSGSN

SEQ ID NO: 338628 - protein, 9 aa, Homo Sapiens
HTEFTLKRF

SEQ ID NO: 338629 - protein, 9 aa, Homo Sapiens
EVFDSLHFS

SEQ ID NO: 338630 - protein, 9 aa, Homo Sapiens
SKHMLAYMQ

SEQ ID NO: 338631 - protein, 9 aa, Homo Sapiens
QRSCRAIVY

SEQ ID NO: 338632 - protein, 9 aa, Homo Sapiens
CLVNVGQFN

SEQ ID NO: 338633 - protein, 9 aa, Homo Sapiens
KKCLNGVGI

SEQ ID NO: 338634 - protein, 9 aa, Homo Sapiens
IFPIRAAFM

SEQ ID NO: 338635 - protein, 9 aa, Homo Sapiens
NLQVINEEN

SEQ ID NO: 338636 - protein, 9 aa, Homo Sapiens
SLGDTQHRE

SEQ ID NO: 338637 - protein, 9 aa, Homo Sapiens
LKCGICMVN

SEQ ID NO: 338638 - protein, 9 aa, Homo Sapiens
YKINKNKFF

SEQ ID NO: 338639 - protein, 9 aa, Homo Sapiens
RLTHPGVIT

SEQ ID NO: 338640 - protein, 9 aa, Homo Sapiens
PPAGYVPIQ

SEQ ID NO: 338641 - protein, 9 aa, Homo Sapiens
PSEVPGQTQ

SEQ ID NO: 338642 - protein, 9 aa, Homo Sapiens
IQMIVLTHF

SEQ ID NO: 338643 - protein, 9 aa, Homo Sapiens
GKTDQKEFV

SEQ ID NO: 338644 - protein, 9 aa, Homo Sapiens
ELQRVAHYE

SEQ ID NO: 338645 - protein, 9 aa, Homo Sapiens
TRIQQAFGK

SEQ ID NO: 338646 - protein, 9 aa, Homo Sapiens
QNSNTEEKF

SEQ ID NO: 338647 - protein, 9 aa, Homo Sapiens
TDFSELKQP

SEQ ID NO: 338648 - protein, 9 aa, Homo Sapiens
QDLQNDAPV

SEQ ID NO: 338649 - protein, 9 aa, Homo Sapiens
PKATEENKS

SEQ ID NO: 338650 - protein, 9 aa, Homo Sapiens
RVSLSNTAV

SEQ ID NO: 338651 - protein, 9 aa, Homo Sapiens
GDNTTFQLQ

SEQ ID NO: 338652 - protein, 9 aa, Homo Sapiens
GIRQGKSMS

SEQ ID NO: 338653 - protein, 9 aa, Homo Sapiens
SHKEDQGKK

SEQ ID NO: 338654 - protein, 9 aa, Homo Sapiens
QLVPVDGIL

SEQ ID NO: 338655 - protein, 9 aa, Homo Sapiens
FHRIVTYHH

SEQ ID NO: 338656 - protein, 9 aa, Homo Sapiens
VVSVVKKAG

SEQ ID NO: 338657 - protein, 9 aa, Homo Sapiens
VIQSAKEQI

SEQ ID NO: 338658 - protein, 9 aa, Homo Sapiens
GCKTDLRTG

SEQ ID NO: 338659 - protein, 9 aa, Homo Sapiens
FNMELYKLL

SEQ ID NO: 338660 - protein, 9 aa, Homo Sapiens
GRGKPPLSS

SEQ ID NO: 338661 - protein, 9 aa, Homo Sapiens
FLEKEATEK

SEQ ID NO: 338662 - protein, 9 aa, Homo Sapiens
QSGGKPDSS

SEQ ID NO: 338663 - protein, 9 aa, Homo Sapiens
LKTLRKPAT

SEQ ID NO: 338664 - protein, 9 aa, Homo Sapiens
LVVADHHFY

SEQ ID NO: 338665 - protein, 9 aa, Homo Sapiens
QCWDIKDSI

SEQ ID NO: 338666 - protein, 9 aa, Homo Sapiens
RFEVSSYLI

SEQ ID NO: 338667 - protein, 9 aa, Homo Sapiens
WKAYIQDSR

SEQ ID NO: 338668 - protein, 9 aa, Homo Sapiens
YFTKHNVTA

SEQ ID NO: 338669 - protein, 9 aa, Homo Sapiens
KVEATGVSW

SEQ ID NO: 338670 - protein, 9 aa, Homo Sapiens
SKGTFPHHG

SEQ ID NO: 338671 - protein, 9 aa, Homo Sapiens
FLWEKACEN

SEQ ID NO: 338672 - protein, 9 aa, Homo Sapiens
VYLPKVEGD

SEQ ID NO: 338673 - protein, 9 aa, Homo Sapiens
GNSIRSYCE

SEQ ID NO: 338674 - protein, 9 aa, Homo Sapiens
IGVLFCGPK

SEQ ID NO: 338675 - protein, 9 aa, Homo Sapiens
GNLANVEQW

SEQ ID NO: 338676 - protein, 9 aa, Homo Sapiens
EHSQMDTYT

SEQ ID NO: 338677 - protein, 9 aa, Homo Sapiens
DNSIFVTKI

SEQ ID NO: 338678 - protein, 9 aa, Homo Sapiens
ITEKKDNAA

SEQ ID NO: 338679 - protein, 9 aa, Homo Sapiens
LINEILNIR

SEQ ID NO: 338680 - protein, 9 aa, Homo Sapiens
NKVGFFKPI

SEQ ID NO: 338681 - protein, 9 aa, Homo Sapiens
GWLCPQAEV

SEQ ID NO: 338682 - protein, 9 aa, Homo Sapiens
YMCHKCKNK

SEQ ID NO: 338683 - protein, 9 aa, Homo Sapiens
LHLLDNTDV

SEQ ID NO: 338684 - protein, 9 aa, Homo Sapiens
IYLIPRYVR

SEQ ID NO: 338685 - protein, 9 aa, Homo Sapiens
FKTCLLEDT

SEQ ID NO: 338686 - protein, 9 aa, Homo Sapiens
IATTIIIIS

SEQ ID NO: 338687 - protein, 9 aa, Homo Sapiens
ANEVFYTPV

SEQ ID NO: 338688 - protein, 9 aa, Homo Sapiens
LGSVLSPEL

SEQ ID NO: 338689 - protein, 9 aa, Homo Sapiens
LSPVFSSWQ

SEQ ID NO: 338690 - protein, 9 aa, Homo Sapiens
LLNLSLMNS

SEQ ID NO: 338691 - protein, 9 aa, Homo Sapiens
CKELRSRIQ

SEQ ID NO: 338692 - protein, 9 aa, Homo Sapiens
KEKFWKISA

SEQ ID NO: 338693 - protein, 9 aa, Homo Sapiens
PQRTIILWK

SEQ ID NO: 338694 - protein, 9 aa, Homo Sapiens
VGSKNTCFE

SEQ ID NO: 338695 - protein, 9 aa, Homo Sapiens
NGSVLQRVT

SEQ ID NO: 338696 - protein, 9 aa, Homo Sapiens
KCYPQENVI

SEQ ID NO: 338697 - protein, 9 aa, Homo Sapiens
IKECAAIFH

SEQ ID NO: 338698 - protein, 9 aa, Homo Sapiens
KYLAATFPS

SEQ ID NO: 338699 - protein, 9 aa, Homo Sapiens
HPFMFIMKH

SEQ ID NO: 338700 - protein, 9 aa, Homo Sapiens
KLTSSSETS

SEQ ID NO: 338701 - protein, 9 aa, Homo Sapiens
DNPHKLGKQ

SEQ ID NO: 338702 - protein, 9 aa, Homo Sapiens
CGQAYPVYQ

SEQ ID NO: 338703 - protein, 9 aa, Homo Sapiens
PDIFKKSKS

SEQ ID NO: 338704 - protein, 9 aa, Homo Sapiens
SYSGTSQKI

SEQ ID NO: 338705 - protein, 9 aa, Homo Sapiens
IQNMVAWFE

SEQ ID NO: 338706 - protein, 9 aa, Homo Sapiens
AGHSGKAIT

SEQ ID NO: 338707 - protein, 9 aa, Homo Sapiens
DYKLAMAEL

SEQ ID NO: 338708 - protein, 9 aa, Homo Sapiens
NWLDEKKVD

SEQ ID NO: 338709 - protein, 9 aa, Homo Sapiens
ALDGKIKFF

SEQ ID NO: 338710 - protein, 9 aa, Homo Sapiens
QSEKEIVVL

SEQ ID NO: 338711 - protein, 9 aa, Homo Sapiens
GARLLLGRV

SEQ ID NO: 338712 - protein, 9 aa, Homo Sapiens
QAQRWAQQT

SEQ ID NO: 338713 - protein, 9 aa, Homo Sapiens
RFPTFFQTH

SEQ ID NO: 338714 - protein, 9 aa, Homo Sapiens
HSKIEALLG

SEQ ID NO: 338715 - protein, 9 aa, Homo Sapiens
PPEISLTSQ

SEQ ID NO: 338716 - protein, 9 aa, Homo Sapiens
FTHLPGKVV

SEQ ID NO: 338717 - protein, 9 aa, Homo Sapiens
RRQIPIKLI

SEQ ID NO: 338718 - protein, 9 aa, Homo Sapiens
KPPRAPRAS

SEQ ID NO: 338719 - protein, 9 aa, Homo Sapiens
LKRLSDVTG

SEQ ID NO: 338720 - protein, 9 aa, Homo Sapiens
FIIDTLELQ

SEQ ID NO: 338721 - protein, 9 aa, Homo Sapiens
SVSLMNRGC

SEQ ID NO: 338722 - protein, 9 aa, Homo Sapiens
VVKECVERL

SEQ ID NO: 338723 - protein, 9 aa, Homo Sapiens
FHLLRDTLI

SEQ ID NO: 338724 - protein, 9 aa, Homo Sapiens
EDIVERNIQ

SEQ ID NO: 338725 - protein, 9 aa, Homo Sapiens
ATSIVLYFQ

SEQ ID NO: 338726 - protein, 9 aa, Homo Sapiens
CESICLVLY

SEQ ID NO: 338727 - protein, 9 aa, Homo Sapiens
KPKISWFNN

SEQ ID NO: 338728 - protein, 9 aa, Homo Sapiens
NRCCIIYVT

SEQ ID NO: 338729 - protein, 9 aa, Homo Sapiens
PRAPKGAWG

SEQ ID NO: 338730 - protein, 9 aa, Homo Sapiens
NGQGPKYVN

SEQ ID NO: 338731 - protein, 9 aa, Homo Sapiens
GARVKQGKY

SEQ ID NO: 338732 - protein, 9 aa, Homo Sapiens
EESYWRIMS

SEQ ID NO: 338733 - protein, 9 aa, Homo Sapiens
AGTSSQPAS

SEQ ID NO: 338734 - protein, 9 aa, Homo Sapiens
QEQCPVAVK

SEQ ID NO: 338735 - protein, 9 aa, Homo Sapiens
EGGDQVSCI

SEQ ID NO: 338736 - protein, 9 aa, Homo Sapiens
NSKPHSPGL

SEQ ID NO: 338737 - protein, 9 aa, Homo Sapiens
NNTFLQDQS

SEQ ID NO: 338738 - protein, 9 aa, Homo Sapiens
RLNWQIKYL

SEQ ID NO: 338739 - protein, 9 aa, Homo Sapiens
SSSRSHVRT

SEQ ID NO: 338740 - protein, 9 aa, Homo Sapiens
KNEIQNAEQ

SEQ ID NO: 338741 - protein, 9 aa, Homo Sapiens
ASREDYGSP

SEQ ID NO: 338742 - protein, 9 aa, Homo Sapiens
LTRHRQIHT

SEQ ID NO: 338743 - protein, 9 aa, Homo Sapiens
SNLGWAPLH

SEQ ID NO: 338744 - protein, 9 aa, Homo Sapiens
GGSAVSATS

SEQ ID NO: 338745 - protein, 9 aa, Homo Sapiens
ICPIFVFDG

SEQ ID NO: 338746 - protein, 9 aa, Homo Sapiens
ENFEKLWLS

SEQ ID NO: 338747 - protein, 9 aa, Homo Sapiens
KSLQELCHM

SEQ ID NO: 338748 - protein, 9 aa, Homo Sapiens
SKDATKDAK

SEQ ID NO: 338749 - protein, 9 aa, Homo Sapiens
SCVQHQKLH

SEQ ID NO: 338750 - protein, 9 aa, Homo Sapiens
CQQQNTELL

SEQ ID NO: 338751 - protein, 9 aa, Homo Sapiens
KARKDEWAE

SEQ ID NO: 338752 - protein, 9 aa, Homo Sapiens
KSDIWPLGC

SEQ ID NO: 338753 - protein, 9 aa, Homo Sapiens
TLTALKTPT

SEQ ID NO: 338754 - protein, 9 aa, Homo Sapiens
EAADQKRCS

SEQ ID NO: 338755 - protein, 9 aa, Homo Sapiens
LNTACRKHE

SEQ ID NO: 338756 - protein, 9 aa, Homo Sapiens
LDVTVGDLT

SEQ ID NO: 338757 - protein, 9 aa, Homo Sapiens
KTLVEELKA

SEQ ID NO: 338758 - protein, 9 aa, Homo Sapiens
LTQAICTGT

SEQ ID NO: 338759 - protein, 9 aa, Homo Sapiens
LRTLPEVHY

SEQ ID NO: 338760 - protein, 9 aa, Homo Sapiens
NGDLVEYGA

SEQ ID NO: 338761 - protein, 9 aa, Homo Sapiens
TTADCRYRP

SEQ ID NO: 338762 - protein, 9 aa, Homo Sapiens
GRIALVVEI

SEQ ID NO: 338763 - protein, 9 aa, Homo Sapiens
SQTMIRGMM

SEQ ID NO: 338764 - protein, 9 aa, Homo Sapiens
VLAFLDTHA

SEQ ID NO: 338765 - protein, 9 aa, Homo Sapiens
ECGRYFAHI

SEQ ID NO: 338766 - protein, 9 aa, Homo Sapiens
EFSSALKNN

SEQ ID NO: 338767 - protein, 9 aa, Homo Sapiens
NSSPEHNLT

SEQ ID NO: 338768 - protein, 9 aa, Homo Sapiens
ASSELFKPY

SEQ ID NO: 338769 - protein, 9 aa, Homo Sapiens
EASRPPTLH

SEQ ID NO: 338770 - protein, 9 aa, Homo Sapiens
LAKQQNKFG

SEQ ID NO: 338771 - protein, 9 aa, Homo Sapiens
PLIKAGLTF

SEQ ID NO: 338772 - protein, 9 aa, Homo Sapiens
LPEAIFSNA

SEQ ID NO: 338773 - protein, 9 aa, Homo Sapiens
MTKTQMFIH

SEQ ID NO: 338774 - protein, 9 aa, Homo Sapiens
NPKLKIILS

SEQ ID NO: 338775 - protein, 9 aa, Homo Sapiens
AAFRELITQ

SEQ ID NO: 338776 - protein, 9 aa, Homo Sapiens
PYDPNFYNE

SEQ ID NO: 338777 - protein, 9 aa, Homo Sapiens
NDGKWCHVD

SEQ ID NO: 338778 - protein, 9 aa, Homo Sapiens
INDAYKITV

SEQ ID NO: 338779 - protein, 9 aa, Homo Sapiens
YHMMNKFIG

SEQ ID NO: 338780 - protein, 9 aa, Homo Sapiens
FARLLFNDP

SEQ ID NO: 338781 - protein, 9 aa, Homo Sapiens
RGCASAPGA

SEQ ID NO: 338782 - protein, 9 aa, Homo Sapiens
KSERINLLE

SEQ ID NO: 338783 - protein, 9 aa, Homo Sapiens
SDWIFTLYS

SEQ ID NO: 338784 - protein, 9 aa, Homo Sapiens
FQSYPESAQ

SEQ ID NO: 338785 - protein, 9 aa, Homo Sapiens
DVQTDCTHT

SEQ ID NO: 338786 - protein, 9 aa, Homo Sapiens
AKTSVKPSV

SEQ ID NO: 338787 - protein, 9 aa, Homo Sapiens
NGLCKNGGT

SEQ ID NO: 338788 - protein, 9 aa, Homo Sapiens
AGHKALSII

SEQ ID NO: 338789 - protein, 9 aa, Homo Sapiens
YLYYLMSAV

SEQ ID NO: 338790 - protein, 9 aa, Homo Sapiens
IIAYDNSRV

SEQ ID NO: 338791 - protein, 9 aa, Homo Sapiens
DTFHELGTE

SEQ ID NO: 338792 - protein, 9 aa, Homo Sapiens
EQVKQKSMQ

SEQ ID NO: 338793 - protein, 9 aa, Homo Sapiens
HWIIHNEER

SEQ ID NO: 338794 - protein, 9 aa, Homo Sapiens
DIAGFKIFE

SEQ ID NO: 338795 - protein, 9 aa, Homo Sapiens
RQIHTGERP

SEQ ID NO: 338796 - protein, 9 aa, Homo Sapiens
ATKAGEGSW

SEQ ID NO: 338797 - protein, 9 aa, Homo Sapiens
KKKHTKQNE

SEQ ID NO: 338798 - protein, 9 aa, Homo Sapiens
HYYGLRDSH

SEQ ID NO: 338799 - protein, 9 aa, Homo Sapiens
DFCHSYFIC

SEQ ID NO: 338800 - protein, 9 aa, Homo Sapiens
RASQFRSLQ

SEQ ID NO: 338801 - protein, 9 aa, Homo Sapiens
QVLMGPYHP

SEQ ID NO: 338802 - protein, 9 aa, Homo Sapiens
RRSLLRKWY

SEQ ID NO: 338803 - protein, 9 aa, Homo Sapiens
QSWGSMENL

SEQ ID NO: 338804 - protein, 9 aa, Homo Sapiens
SSHGKRKDN

SEQ ID NO: 338805 - protein, 9 aa, Homo Sapiens
KQFYFPLSS

SEQ ID NO: 338806 - protein, 9 aa, Homo Sapiens
LALSSFNSC

SEQ ID NO: 338807 - protein, 9 aa, Homo Sapiens
FAIDVSSSM

SEQ ID NO: 338808 - protein, 9 aa, Homo Sapiens
LENQNKTLV

SEQ ID NO: 338809 - protein, 9 aa, Homo Sapiens
QAFHGLAGG

SEQ ID NO: 338810 - protein, 9 aa, Homo Sapiens
PLLLPSGSK

SEQ ID NO: 338811 - protein, 9 aa, Homo Sapiens
APVPYFGPV

SEQ ID NO: 338812 - protein, 9 aa, Homo Sapiens
EQMYKLAKK

SEQ ID NO: 338813 - protein, 9 aa, Homo Sapiens
HQGNEIGGK

SEQ ID NO: 338814 - protein, 9 aa, Homo Sapiens
GNLSQVKLG

SEQ ID NO: 338815 - protein, 9 aa, Homo Sapiens
IKYLNLFYS

SEQ ID NO: 338816 - protein, 9 aa, Homo Sapiens
DNEDGGEAE

SEQ ID NO: 338817 - protein, 9 aa, Homo Sapiens
ICTGTKTGK

SEQ ID NO: 338818 - protein, 9 aa, Homo Sapiens
HLNLQDHQL

SEQ ID NO: 338819 - protein, 9 aa, Homo Sapiens
KGFWGTVGY

SEQ ID NO: 338820 - protein, 9 aa, Homo Sapiens
QAEIHQLKK

SEQ ID NO: 338821 - protein, 9 aa, Homo Sapiens
GTNILIYGN

SEQ ID NO: 338822 - protein, 9 aa, Homo Sapiens
ERIWKERMR

SEQ ID NO: 338823 - protein, 9 aa, Homo Sapiens
LARKMAIGH

SEQ ID NO: 338824 - protein, 9 aa, Homo Sapiens
YLAPNSSSL

SEQ ID NO: 338825 - protein, 9 aa, Homo Sapiens
CIPYRVVEA

SEQ ID NO: 338826 - protein, 9 aa, Homo Sapiens
ESFVVLGGD

SEQ ID NO: 338827 - protein, 9 aa, Homo Sapiens
PELKNLFNM

SEQ ID NO: 338828 - protein, 9 aa, Homo Sapiens
QKLSQAKTQ

SEQ ID NO: 338829 - protein, 9 aa, Homo Sapiens
PQGVIRHCV

SEQ ID NO: 338830 - protein, 9 aa, Homo Sapiens
EIEGNHLAQ

SEQ ID NO: 338831 - protein, 9 aa, Homo Sapiens
SFEDVSVFF

SEQ ID NO: 338832 - protein, 9 aa, Homo Sapiens
EQILKVASL

SEQ ID NO: 338833 - protein, 9 aa, Homo Sapiens
LGTERFLEL

SEQ ID NO: 338834 - protein, 9 aa, Homo Sapiens
SRFGKFIQI

SEQ ID NO: 338835 - protein, 9 aa, Homo Sapiens
WSRFTRVLL

SEQ ID NO: 338836 - protein, 9 aa, Homo Sapiens
FNGNEDIPT

SEQ ID NO: 338837 - protein, 9 aa, Homo Sapiens
HKAFPVLGI

SEQ ID NO: 338838 - protein, 9 aa, Homo Sapiens
ILQQSQAYF

SEQ ID NO: 338839 - protein, 9 aa, Homo Sapiens
YLSAHDNDA

SEQ ID NO: 338840 - protein, 9 aa, Homo Sapiens
DSLATPRLT

SEQ ID NO: 338841 - protein, 9 aa, Homo Sapiens
IQDRDISTQ

SEQ ID NO: 338842 - protein, 9 aa, Homo Sapiens
VDKIDEIRR

SEQ ID NO: 338843 - protein, 9 aa, Homo Sapiens
LDEEMKKIC

SEQ ID NO: 338844 - protein, 9 aa, Homo Sapiens
DPTRLIVVF

SEQ ID NO: 338845 - protein, 9 aa, Homo Sapiens
TTHKRTHTA

SEQ ID NO: 338846 - protein, 9 aa, Homo Sapiens
DISEEDIQT

SEQ ID NO: 338847 - protein, 9 aa, Homo Sapiens
HQDKVLYLL

SEQ ID NO: 338848 - protein, 9 aa, Homo Sapiens
IVFTWTKHG

SEQ ID NO: 338849 - protein, 9 aa, Homo Sapiens
KIFPIRAAF

SEQ ID NO: 338850 - protein, 9 aa, Homo Sapiens
KKKHLFGLQ

SEQ ID NO: 338851 - protein, 9 aa, Homo Sapiens
LPGNPVLAV

SEQ ID NO: 338852 - protein, 9 aa, Homo Sapiens
QPGKERKQT

SEQ ID NO: 338853 - protein, 9 aa, Homo Sapiens
KAYIQDSRY

SEQ ID NO: 338854 - protein, 9 aa, Homo Sapiens
LHFSPFHFF

SEQ ID NO: 338855 - protein, 9 aa, Homo Sapiens
CGKRFPQAF

SEQ ID NO: 338856 - protein, 9 aa, Homo Sapiens
CVERLTARE

SEQ ID NO: 338857 - protein, 9 aa, Homo Sapiens
EEPKVKELV

SEQ ID NO: 338858 - protein, 9 aa, Homo Sapiens
ENGLGSPVI

SEQ ID NO: 338859 - protein, 9 aa, Homo Sapiens
DSIINNSQL

SEQ ID NO: 338860 - protein, 9 aa, Homo Sapiens
LVIADAFVH

SEQ ID NO: 338861 - protein, 9 aa, Homo Sapiens
NVYHCGLCL

SEQ ID NO: 338862 - protein, 9 aa, Homo Sapiens
TNSDGQLDL

SEQ ID NO: 338863 - protein, 9 aa, Homo Sapiens
FMEQLCTYQ

SEQ ID NO: 338864 - protein, 9 aa, Homo Sapiens
YSNVRGKQH

SEQ ID NO: 338865 - protein, 9 aa, Homo Sapiens
GPEKVLDQP

SEQ ID NO: 338866 - protein, 9 aa, Homo Sapiens
FVSTVGINF

SEQ ID NO: 338867 - protein, 9 aa, Homo Sapiens
QMIVLTHFP

SEQ ID NO: 338868 - protein, 9 aa, Homo Sapiens
MTLQGLVSP

SEQ ID NO: 338869 - protein, 9 aa, Homo Sapiens
GLKTANGKG

SEQ ID NO: 338870 - protein, 9 aa, Homo Sapiens
RPERRGVAV

SEQ ID NO: 338871 - protein, 9 aa, Homo Sapiens
LVQYLKWWS

SEQ ID NO: 338872 - protein, 9 aa, Homo Sapiens
SSIMENTYT

SEQ ID NO: 338873 - protein, 9 aa, Homo Sapiens
ISSCDTFLN

SEQ ID NO: 338874 - protein, 9 aa, Homo Sapiens
VPRLPKFAD

SEQ ID NO: 338875 - protein, 9 aa, Homo Sapiens
WAISFVTKN

SEQ ID NO: 338876 - protein, 9 aa, Homo Sapiens
CLIENTNGQ

SEQ ID NO: 338877 - protein, 9 aa, Homo Sapiens
CQNITTRLL

SEQ ID NO: 338878 - protein, 9 aa, Homo Sapiens
QLRDIFNMA

SEQ ID NO: 338879 - protein, 9 aa, Homo Sapiens
NWVRKVFIN

SEQ ID NO: 338880 - protein, 9 aa, Homo Sapiens
QGLPLRQHH

SEQ ID NO: 338881 - protein, 9 aa, Homo Sapiens
FFIWVDLIK

SEQ ID NO: 338882 - protein, 9 aa, Homo Sapiens
SVCAWGLLP

SEQ ID NO: 338883 - protein, 9 aa, Homo Sapiens
KRKEFIKTC

SEQ ID NO: 338884 - protein, 9 aa, Homo Sapiens
TSGKWYWKV

SEQ ID NO: 338885 - protein, 9 aa, Homo Sapiens
VRRHIQKVH

SEQ ID NO: 338886 - protein, 9 aa, Homo Sapiens
TFMHANKSI

SEQ ID NO: 338887 - protein, 9 aa, Homo Sapiens
AGCEPRSQT

SEQ ID NO: 338888 - protein, 9 aa, Homo Sapiens
NLKYTITCV

SEQ ID NO: 338889 - protein, 9 aa, Homo Sapiens
ILHTKEKPS

SEQ ID NO: 338890 - protein, 9 aa, Homo Sapiens
LLLECGKDG

SEQ ID NO: 338891 - protein, 9 aa, Homo Sapiens
VVSSLCRHR

SEQ ID NO: 338892 - protein, 9 aa, Homo Sapiens
MYQVGLMEM

SEQ ID NO: 338893 - protein, 9 aa, Homo Sapiens
VGSMFIADT

SEQ ID NO: 338894 - protein, 9 aa, Homo Sapiens
LVYHFCDVK

SEQ ID NO: 338895 - protein, 9 aa, Homo Sapiens
ISVQHNKDI

SEQ ID NO: 338896 - protein, 9 aa, Homo Sapiens
FFEQTILCN

SEQ ID NO: 338897 - protein, 9 aa, Homo Sapiens
DDEEDASSK

SEQ ID NO: 338898 - protein, 9 aa, Homo Sapiens
SHLTIHQII

SEQ ID NO: 338899 - protein, 9 aa, Homo Sapiens
HNAIKCGWL

SEQ ID NO: 338900 - protein, 9 aa, Homo Sapiens
KDLRDLLIQ

SEQ ID NO: 338901 - protein, 9 aa, Homo Sapiens
ACYWLGEKL

SEQ ID NO: 338902 - protein, 9 aa, Homo Sapiens
MVNDATEQR

SEQ ID NO: 338903 - protein, 9 aa, Homo Sapiens
DLIIHIGAI

SEQ ID NO: 338904 - protein, 9 aa, Homo Sapiens
LTNEATTDS

SEQ ID NO: 338905 - protein, 9 aa, Homo Sapiens
SVIATPRII

SEQ ID NO: 338906 - protein, 9 aa, Homo Sapiens
SSEDITPLP

SEQ ID NO: 338907 - protein, 9 aa, Homo Sapiens
CIDYQTFFD

SEQ ID NO: 338908 - protein, 9 aa, Homo Sapiens
NGGEPKHSR

SEQ ID NO: 338909 - protein, 9 aa, Homo Sapiens
DPQCIPSNP

SEQ ID NO: 338910 - protein, 9 aa, Homo Sapiens
AASMFLTLL

SEQ ID NO: 338911 - protein, 9 aa, Homo Sapiens
DEPILKFLL

SEQ ID NO: 338912 - protein, 9 aa, Homo Sapiens
DVQVQIKIY

SEQ ID NO: 338913 - protein, 9 aa, Homo Sapiens
SQVIYLFAT

SEQ ID NO: 338914 - protein, 9 aa, Homo Sapiens
YSLDVELIN

SEQ ID NO: 338915 - protein, 9 aa, Homo Sapiens
FGKFIQIHF

SEQ ID NO: 338916 - protein, 9 aa, Homo Sapiens
SACARCAHP

SEQ ID NO: 338917 - protein, 9 aa, Homo Sapiens
NMIQEQDLQ

SEQ ID NO: 338918 - protein, 9 aa, Homo Sapiens
NVALEYLEG

SEQ ID NO: 338919 - protein, 9 aa, Homo Sapiens
LIQQQISNN

SEQ ID NO: 338920 - protein, 9 aa, Homo Sapiens
RSPCLGHRR

SEQ ID NO: 338921 - protein, 9 aa, Homo Sapiens
FNLHLLENS

SEQ ID NO: 338922 - protein, 9 aa, Homo Sapiens
CRDRLSRLK

SEQ ID NO: 338923 - protein, 9 aa, Homo Sapiens
SSLNSTNSG

SEQ ID NO: 338924 - protein, 9 aa, Homo Sapiens
PVASTLSRA

SEQ ID NO: 338925 - protein, 9 aa, Homo Sapiens
GFTAWITEL

SEQ ID NO: 338926 - protein, 9 aa, Homo Sapiens
LSLLDLIRP

SEQ ID NO: 338927 - protein, 9 aa, Homo Sapiens
MLSFMLDNL

SEQ ID NO: 338928 - protein, 9 aa, Homo Sapiens
CRCKSGYTG

SEQ ID NO: 338929 - protein, 9 aa, Homo Sapiens
KFDKDRDSI

SEQ ID NO: 338930 - protein, 9 aa, Homo Sapiens
PTPRDFPKG

SEQ ID NO: 338931 - protein, 9 aa, Homo Sapiens
IQIILETRA

SEQ ID NO: 338932 - protein, 9 aa, Homo Sapiens
AVFRLTHPG

SEQ ID NO: 338933 - protein, 9 aa, Homo Sapiens
SHYTAFSVG

SEQ ID NO: 338934 - protein, 9 aa, Homo Sapiens
FDISIAQRK

SEQ ID NO: 338935 - protein, 9 aa, Homo Sapiens
SDIWPLGCL

SEQ ID NO: 338936 - protein, 9 aa, Homo Sapiens
WSEKKKAHY

SEQ ID NO: 338937 - protein, 9 aa, Homo Sapiens
YSGEHLTAA

SEQ ID NO: 338938 - protein, 9 aa, Homo Sapiens
CAPSSFFIG

SEQ ID NO: 338939 - protein, 9 aa, Homo Sapiens
HIVEKGFYT

SEQ ID NO: 338940 - protein, 9 aa, Homo Sapiens
RIMVEVYLQ

SEQ ID NO: 338941 - protein, 9 aa, Homo Sapiens
TRPSVQENS

SEQ ID NO: 338942 - protein, 9 aa, Homo Sapiens
CSPGVVSTP

SEQ ID NO: 338943 - protein, 9 aa, Homo Sapiens
QYHKNLLKY

SEQ ID NO: 338944 - protein, 9 aa, Homo Sapiens
GDVGKSALT

SEQ ID NO: 338945 - protein, 9 aa, Homo Sapiens
ADKNDDDPK

SEQ ID NO: 338946 - protein, 9 aa, Homo Sapiens
VVARDKPMH

SEQ ID NO: 338947 - protein, 9 aa, Homo Sapiens
LAKYYRQMD

SEQ ID NO: 338948 - protein, 9 aa, Homo Sapiens
NNNLLALPR

SEQ ID NO: 338949 - protein, 9 aa, Homo Sapiens
SCQQQNTEL

SEQ ID NO: 338950 - protein, 9 aa, Homo Sapiens
SLRERTRVV

SEQ ID NO: 338951 - protein, 9 aa, Homo Sapiens
RCVRADEYY

SEQ ID NO: 338952 - protein, 9 aa, Homo Sapiens
LQHNGSFAN

SEQ ID NO: 338953 - protein, 9 aa, Homo Sapiens
AATVSVSTS

SEQ ID NO: 338954 - protein, 9 aa, Homo Sapiens
LGWSNEKDK

SEQ ID NO: 338955 - protein, 9 aa, Homo Sapiens
EGGSAVSAT

SEQ ID NO: 338956 - protein, 9 aa, Homo Sapiens
LKNNHKALK

SEQ ID NO: 338957 - protein, 9 aa, Homo Sapiens
SYPGFRISF

SEQ ID NO: 338958 - protein, 9 aa, Homo Sapiens
LSLLTETME

SEQ ID NO: 338959 - protein, 9 aa, Homo Sapiens
KVVITLWLV

SEQ ID NO: 338960 - protein, 9 aa, Homo Sapiens
YINAKPNLL

SEQ ID NO: 338961 - protein, 9 aa, Homo Sapiens
YNVALEYLE

SEQ ID NO: 338962 - protein, 9 aa, Homo Sapiens
LLENSLMDM

SEQ ID NO: 338963 - protein, 9 aa, Homo Sapiens
VLLTLRPRC

SEQ ID NO: 338964 - protein, 9 aa, Homo Sapiens
DASLQDPPL

SEQ ID NO: 338965 - protein, 9 aa, Homo Sapiens
RDEKTQMIC

SEQ ID NO: 338966 - protein, 9 aa, Homo Sapiens
TLILCHNNI

SEQ ID NO: 338967 - protein, 9 aa, Homo Sapiens
HKHYTIDVI

SEQ ID NO: 338968 - protein, 9 aa, Homo Sapiens
YHSPGHNVL

SEQ ID NO: 338969 - protein, 9 aa, Homo Sapiens
VPPGEYKGG

SEQ ID NO: 338970 - protein, 9 aa, Homo Sapiens
SFIDKVWFL

SEQ ID NO: 338971 - protein, 9 aa, Homo Sapiens
QQLARRCFK

SEQ ID NO: 338972 - protein, 9 aa, Homo Sapiens
ILLKRSSKS

SEQ ID NO: 338973 - protein, 9 aa, Homo Sapiens
QGNPTKKTN

SEQ ID NO: 338974 - protein, 9 aa, Homo Sapiens
MLFITLMSV

SEQ ID NO: 338975 - protein, 9 aa, Homo Sapiens
FTQLTDEVL

SEQ ID NO: 338976 - protein, 9 aa, Homo Sapiens
SVLRQKILK

SEQ ID NO: 338977 - protein, 9 aa, Homo Sapiens
ILYNKFNHY

SEQ ID NO: 338978 - protein, 9 aa, Homo Sapiens
RAVPVLPNI

SEQ ID NO: 338979 - protein, 9 aa, Homo Sapiens
FNVVMCRHP

SEQ ID NO: 338980 - protein, 9 aa, Homo Sapiens
TERHSVCDD

SEQ ID NO: 338981 - protein, 9 aa, Homo Sapiens
LSAKKTPVE

SEQ ID NO: 338982 - protein, 9 aa, Homo Sapiens
TSVYHSPGH

SEQ ID NO: 338983 - protein, 9 aa, Homo Sapiens
STTVQKVME

SEQ ID NO: 338984 - protein, 9 aa, Homo Sapiens
HPFSRLAIL

SEQ ID NO: 338985 - protein, 9 aa, Homo Sapiens
GASWPAPFK

SEQ ID NO: 338986 - protein, 9 aa, Homo Sapiens
NHIRDTLPD

SEQ ID NO: 338987 - protein, 9 aa, Homo Sapiens
HGRFKCSNS

SEQ ID NO: 338988 - protein, 9 aa, Homo Sapiens
SEDASIHQL

SEQ ID NO: 338989 - protein, 9 aa, Homo Sapiens
DFLCDYTQI

SEQ ID NO: 338990 - protein, 9 aa, Homo Sapiens
DRHCVSVLQ

SEQ ID NO: 338991 - protein, 9 aa, Homo Sapiens
HIVSEPGNN

SEQ ID NO: 338992 - protein, 9 aa, Homo Sapiens
QKAKVGKLK

SEQ ID NO: 338993 - protein, 9 aa, Homo Sapiens
DEMTFGKVK

SEQ ID NO: 338994 - protein, 9 aa, Homo Sapiens
PALLQHNGS

SEQ ID NO: 338995 - protein, 9 aa, Homo Sapiens
SLAVHGLPL

SEQ ID NO: 338996 - protein, 9 aa, Homo Sapiens
YEKPAFDCP

SEQ ID NO: 338997 - protein, 9 aa, Homo Sapiens
IKKRKGGAM

SEQ ID NO: 338998 - protein, 9 aa, Homo Sapiens
DILEVLRHP

SEQ ID NO: 338999 - protein, 9 aa, Homo Sapiens
ADYTTKKYR

SEQ ID NO: 339000 - protein, 9 aa, Homo Sapiens
LSANSKNKE

SEQ ID NO: 339001 - protein, 9 aa, Homo Sapiens
DSRSKYLPS

SEQ ID NO: 339002 - protein, 9 aa, Homo Sapiens
AEKTKTYEY

SEQ ID NO: 339003 - protein, 9 aa, Homo Sapiens
SPFWLPEPV

SEQ ID NO: 339004 - protein, 9 aa, Homo Sapiens
KLRTLDSVS

SEQ ID NO: 339005 - protein, 9 aa, Homo Sapiens
VQPVLPFYC

SEQ ID NO: 339006 - protein, 9 aa, Homo Sapiens
ATLQGSAPR

SEQ ID NO: 339007 - protein, 9 aa, Homo Sapiens
PIYPAIYID

SEQ ID NO: 339008 - protein, 9 aa, Homo Sapiens
CTGIEGEDS

SEQ ID NO: 339009 - protein, 9 aa, Homo Sapiens
ITEKRKRQA

SEQ ID NO: 339010 - protein, 9 aa, Homo Sapiens
VIKLQIEGE

SEQ ID NO: 339011 - protein, 9 aa, Homo Sapiens
TLGIKGYQT

SEQ ID NO: 339012 - protein, 9 aa, Homo Sapiens
NTFSFSFSN

SEQ ID NO: 339013 - protein, 9 aa, Homo Sapiens
QPKVMCLKD

SEQ ID NO: 339014 - protein, 9 aa, Homo Sapiens
LQWVVENLE

SEQ ID NO: 339015 - protein, 9 aa, Homo Sapiens
GICMVNMKS

SEQ ID NO: 339016 - protein, 9 aa, Homo Sapiens
FPSWKFPDC

SEQ ID NO: 339017 - protein, 9 aa, Homo Sapiens
GVQIRSVTC

SEQ ID NO: 339018 - protein, 9 aa, Homo Sapiens
LFELLKNAM

SEQ ID NO: 339019 - protein, 9 aa, Homo Sapiens
ADNGWDSGS

SEQ ID NO: 339020 - protein, 9 aa, Homo Sapiens
TPTFFSQVA

SEQ ID NO: 339021 - protein, 9 aa, Homo Sapiens
PNAQAAISQ

SEQ ID NO: 339022 - protein, 9 aa, Homo Sapiens
IKFRVLDCH

SEQ ID NO: 339023 - protein, 9 aa, Homo Sapiens
ISNLTTTAS

SEQ ID NO: 339024 - protein, 9 aa, Homo Sapiens
LAWIKGVGW

SEQ ID NO: 339025 - protein, 9 aa, Homo Sapiens
EFNAHHPFL

SEQ ID NO: 339026 - protein, 9 aa, Homo Sapiens
FPLVTTKGE

SEQ ID NO: 339027 - protein, 9 aa, Homo Sapiens
TSFHQHQER

SEQ ID NO: 339028 - protein, 9 aa, Homo Sapiens
NSDIWSYGV

SEQ ID NO: 339029 - protein, 9 aa, Homo Sapiens
KTDALLGKA

SEQ ID NO: 339030 - protein, 9 aa, Homo Sapiens
FPYFTKHNV

SEQ ID NO: 339031 - protein, 9 aa, Homo Sapiens
VKNLASPLI

SEQ ID NO: 339032 - protein, 9 aa, Homo Sapiens
QPVDIGTYL

SEQ ID NO: 339033 - protein, 9 aa, Homo Sapiens
DAGQSQSCV

SEQ ID NO: 339034 - protein, 9 aa, Homo Sapiens
AFAINLILL

SEQ ID NO: 339035 - protein, 9 aa, Homo Sapiens
LKCLKNMNL

SEQ ID NO: 339036 - protein, 9 aa, Homo Sapiens
DNHGYMALH

SEQ ID NO: 339037 - protein, 9 aa, Homo Sapiens
KTHDKDLRE

SEQ ID NO: 339038 - protein, 9 aa, Homo Sapiens
IFVVSGDTF

SEQ ID NO: 339039 - protein, 9 aa, Homo Sapiens
QATAQANVY

SEQ ID NO: 339040 - protein, 9 aa, Homo Sapiens
AINQKVSCH

SEQ ID NO: 339041 - protein, 9 aa, Homo Sapiens
AGLWDIENN

SEQ ID NO: 339042 - protein, 9 aa, Homo Sapiens
YSPGWDVKL

SEQ ID NO: 339043 - protein, 9 aa, Homo Sapiens
DVVQERVDV

SEQ ID NO: 339044 - protein, 9 aa, Homo Sapiens
YLGNQPLPP

SEQ ID NO: 339045 - protein, 9 aa, Homo Sapiens
IFTLTSVVV

SEQ ID NO: 339046 - protein, 9 aa, Homo Sapiens
TFCFDLFQE

SEQ ID NO: 339047 - protein, 9 aa, Homo Sapiens
VEGGSDKAD

SEQ ID NO: 339048 - protein, 9 aa, Homo Sapiens
LCPKDVVYP

SEQ ID NO: 339049 - protein, 9 aa, Homo Sapiens
LLFTATRNE

SEQ ID NO: 339050 - protein, 9 aa, Homo Sapiens
LPEDIWTRG

SEQ ID NO: 339051 - protein, 9 aa, Homo Sapiens
SQQKTFQGH

SEQ ID NO: 339052 - protein, 9 aa, Homo Sapiens
NQESNISGP

SEQ ID NO: 339053 - protein, 9 aa, Homo Sapiens
KPRTVLKPH

SEQ ID NO: 339054 - protein, 9 aa, Homo Sapiens
QDCRDSLSE

SEQ ID NO: 339055 - protein, 9 aa, Homo Sapiens
SQIEERKAI

SEQ ID NO: 339056 - protein, 9 aa, Homo Sapiens
CVHLCVCTC

SEQ ID NO: 339057 - protein, 9 aa, Homo Sapiens
VTKQAFNIT

SEQ ID NO: 339058 - protein, 9 aa, Homo Sapiens
SLNRHYHLN

SEQ ID NO: 339059 - protein, 9 aa, Homo Sapiens
PDEELDYLP

SEQ ID NO: 339060 - protein, 9 aa, Homo Sapiens
VASLSWDLQ

SEQ ID NO: 339061 - protein, 9 aa, Homo Sapiens
KNMENLLDN

SEQ ID NO: 339062 - protein, 9 aa, Homo Sapiens
TFHFRIQRT

SEQ ID NO: 339063 - protein, 9 aa, Homo Sapiens
VGLFDQHCR

SEQ ID NO: 339064 - protein, 9 aa, Homo Sapiens
TGSGRIALV

SEQ ID NO: 339065 - protein, 9 aa, Homo Sapiens
WWVRNMNTL

SEQ ID NO: 339066 - protein, 9 aa, Homo Sapiens
HAHFKTRKL

SEQ ID NO: 339067 - protein, 9 aa, Homo Sapiens
NTSSLCKHE

SEQ ID NO: 339068 - protein, 9 aa, Homo Sapiens
DRLENTIIL

SEQ ID NO: 339069 - protein, 9 aa, Homo Sapiens
SQKKNRNVD

SEQ ID NO: 339070 - protein, 9 aa, Homo Sapiens
VFFVSRKRQ

SEQ ID NO: 339071 - protein, 9 aa, Homo Sapiens
FTNQKENIP

SEQ ID NO: 339072 - protein, 9 aa, Homo Sapiens
FTWQGLLTA

SEQ ID NO: 339073 - protein, 9 aa, Homo Sapiens
TITQEDIEG

SEQ ID NO: 339074 - protein, 9 aa, Homo Sapiens
LLYKIKWGM

SEQ ID NO: 339075 - protein, 9 aa, Homo Sapiens
EYVHIHNEI

SEQ ID NO: 339076 - protein, 9 aa, Homo Sapiens
VITDFRKDS

SEQ ID NO: 339077 - protein, 9 aa, Homo Sapiens
SFVISGFTE

SEQ ID NO: 339078 - protein, 9 aa, Homo Sapiens
EDDKSKTQF

SEQ ID NO: 339079 - protein, 9 aa, Homo Sapiens
HKKRREKDG

SEQ ID NO: 339080 - protein, 9 aa, Homo Sapiens
WLPEPVPSG

SEQ ID NO: 339081 - protein, 9 aa, Homo Sapiens
NIFEESYWR

SEQ ID NO: 339082 - protein, 9 aa, Homo Sapiens
RALSMTLKH

SEQ ID NO: 339083 - protein, 9 aa, Homo Sapiens
AMSSPRILK

SEQ ID NO: 339084 - protein, 9 aa, Homo Sapiens
PPKYLCNAI

SEQ ID NO: 339085 - protein, 9 aa, Homo Sapiens
FLLPGKTNL

SEQ ID NO: 339086 - protein, 9 aa, Homo Sapiens
HLNAQFLWS

SEQ ID NO: 339087 - protein, 9 aa, Homo Sapiens
KVFGAHKYC

SEQ ID NO: 339088 - protein, 9 aa, Homo Sapiens
HSDAVLSKS

SEQ ID NO: 339089 - protein, 9 aa, Homo Sapiens
LILHAAKHQ

SEQ ID NO: 339090 - protein, 9 aa, Homo Sapiens
RKGKLLVSA

SEQ ID NO: 339091 - protein, 9 aa, Homo Sapiens
LEHQTQVLK

SEQ ID NO: 339092 - protein, 9 aa, Homo Sapiens
KAPWGTLSR

SEQ ID NO: 339093 - protein, 9 aa, Homo Sapiens
GPYHPDTCP

SEQ ID NO: 339094 - protein, 9 aa, Homo Sapiens
GSSKPDMDK

SEQ ID NO: 339095 - protein, 9 aa, Homo Sapiens
SLGIPHLSS

SEQ ID NO: 339096 - protein, 9 aa, Homo Sapiens
KKPEAAAKY

SEQ ID NO: 339097 - protein, 9 aa, Homo Sapiens
NINKAFSKE

SEQ ID NO: 339098 - protein, 9 aa, Homo Sapiens
LIVSINHQM

SEQ ID NO: 339099 - protein, 9 aa, Homo Sapiens
MPHHVEPLK

SEQ ID NO: 339100 - protein, 9 aa, Homo Sapiens
FSPNENIII

SEQ ID NO: 339101 - protein, 9 aa, Homo Sapiens
DYSHQSGDF

SEQ ID NO: 339102 - protein, 9 aa, Homo Sapiens
NTRVPRLPK

SEQ ID NO: 339103 - protein, 9 aa, Homo Sapiens
DGKIKFFKC

SEQ ID NO: 339104 - protein, 9 aa, Homo Sapiens
ISGFTEISE

SEQ ID NO: 339105 - protein, 9 aa, Homo Sapiens
VNVVFDVSQ

SEQ ID NO: 339106 - protein, 9 aa, Homo Sapiens
YTGEFCQSK

SEQ ID NO: 339107 - protein, 9 aa, Homo Sapiens
LMAQAVGRD

SEQ ID NO: 339108 - protein, 9 aa, Homo Sapiens
GEMLHKKRR

SEQ ID NO: 339109 - protein, 9 aa, Homo Sapiens
LYLVVSPAS

SEQ ID NO: 339110 - protein, 9 aa, Homo Sapiens
DTAKEMKQI

SEQ ID NO: 339111 - protein, 9 aa, Homo Sapiens
KIFANLLSP

SEQ ID NO: 339112 - protein, 9 aa, Homo Sapiens
HIFYMGNTA

SEQ ID NO: 339113 - protein, 9 aa, Homo Sapiens
FLSVHDQDY

SEQ ID NO: 339114 - protein, 9 aa, Homo Sapiens
TVCAGASCV

SEQ ID NO: 339115 - protein, 9 aa, Homo Sapiens
RNNMLLATK

SEQ ID NO: 339116 - protein, 9 aa, Homo Sapiens
EFVLRFPDC

SEQ ID NO: 339117 - protein, 9 aa, Homo Sapiens
CDNDMKRKK

SEQ ID NO: 339118 - protein, 9 aa, Homo Sapiens
QDAEKCVSV

SEQ ID NO: 339119 - protein, 9 aa, Homo Sapiens
VAGAVIIGG

SEQ ID NO: 339120 - protein, 9 aa, Homo Sapiens
EQLPDLGCP

SEQ ID NO: 339121 - protein, 9 aa, Homo Sapiens
QLTQHQIFH

SEQ ID NO: 339122 - protein, 9 aa, Homo Sapiens
HKVANTSYF

SEQ ID NO: 339123 - protein, 9 aa, Homo Sapiens
EENIASAMI

SEQ ID NO: 339124 - protein, 9 aa, Homo Sapiens
ELEELQHHC

SEQ ID NO: 339125 - protein, 9 aa, Homo Sapiens
ITSQINLID

SEQ ID NO: 339126 - protein, 9 aa, Homo Sapiens
FRSHKEDQG

SEQ ID NO: 339127 - protein, 9 aa, Homo Sapiens
KQKSMQGKK

SEQ ID NO: 339128 - protein, 9 aa, Homo Sapiens
VSVSKDNST

SEQ ID NO: 339129 - protein, 9 aa, Homo Sapiens
DALLLQIPS

SEQ ID NO: 339130 - protein, 9 aa, Homo Sapiens
ISDVEAKET

SEQ ID NO: 339131 - protein, 9 aa, Homo Sapiens
IKIQQPLKN

SEQ ID NO: 339132 - protein, 9 aa, Homo Sapiens
TATDADNDV

SEQ ID NO: 339133 - protein, 9 aa, Homo Sapiens
PTLNYGLVV

SEQ ID NO: 339134 - protein, 9 aa, Homo Sapiens
RRLHMQHRS

SEQ ID NO: 339135 - protein, 9 aa, Homo Sapiens
KCLDEQQHA

SEQ ID NO: 339136 - protein, 9 aa, Homo Sapiens
GKQVDGKGQ

SEQ ID NO: 339137 - protein, 9 aa, Homo Sapiens
EEKDFDLVD

SEQ ID NO: 339138 - protein, 9 aa, Homo Sapiens
HDEDPLQPP

SEQ ID NO: 339139 - protein, 9 aa, Homo Sapiens
QSIWIQTKP

SEQ ID NO: 339140 - protein, 9 aa, Homo Sapiens
LHMKALSHL

SEQ ID NO: 339141 - protein, 9 aa, Homo Sapiens
CLSGKHQGS

SEQ ID NO: 339142 - protein, 9 aa, Homo Sapiens
LHQWRQRRK

SEQ ID NO: 339143 - protein, 9 aa, Homo Sapiens
KYFSHHSNR

SEQ ID NO: 339144 - protein, 9 aa, Homo Sapiens
ILNSMHIYQ

SEQ ID NO: 339145 - protein, 9 aa, Homo Sapiens
LLSMLLTDP

SEQ ID NO: 339146 - protein, 9 aa, Homo Sapiens
FMERNPDEL

SEQ ID NO: 339147 - protein, 9 aa, Homo Sapiens
SSAEDTGKL

SEQ ID NO: 339148 - protein, 9 aa, Homo Sapiens
NGIIKSLIL

SEQ ID NO: 339149 - protein, 9 aa, Homo Sapiens
TTVVTPFLT

SEQ ID NO: 339150 - protein, 9 aa, Homo Sapiens
NQADLSKDS

SEQ ID NO: 339151 - protein, 9 aa, Homo Sapiens
NPNYLQDQS

SEQ ID NO: 339152 - protein, 9 aa, Homo Sapiens
IVAEGEHKS

SEQ ID NO: 339153 - protein, 9 aa, Homo Sapiens
GDVNRQISV

SEQ ID NO: 339154 - protein, 9 aa, Homo Sapiens
SLSNVSKQT

SEQ ID NO: 339155 - protein, 9 aa, Homo Sapiens
VRLEHLHID

SEQ ID NO: 339156 - protein, 9 aa, Homo Sapiens
APLHLACYF

SEQ ID NO: 339157 - protein, 9 aa, Homo Sapiens
QLAVDVCFL

SEQ ID NO: 339158 - protein, 9 aa, Homo Sapiens
FIRQEHFGG

SEQ ID NO: 339159 - protein, 9 aa, Homo Sapiens
IGDLKIMFP

SEQ ID NO: 339160 - protein, 9 aa, Homo Sapiens
KRYLNLAEN

SEQ ID NO: 339161 - protein, 9 aa, Homo Sapiens
GIKLIYNAG

SEQ ID NO: 339162 - protein, 9 aa, Homo Sapiens
EELLKKMQF

SEQ ID NO: 339163 - protein, 9 aa, Homo Sapiens
HNCKKITDK

SEQ ID NO: 339164 - protein, 9 aa, Homo Sapiens
CIYGRKPFG

SEQ ID NO: 339165 - protein, 9 aa, Homo Sapiens
QHYAIYDSG

SEQ ID NO: 339166 - protein, 9 aa, Homo Sapiens
MLYIARAVM

SEQ ID NO: 339167 - protein, 9 aa, Homo Sapiens
QGKHFFLYE

SEQ ID NO: 339168 - protein, 9 aa, Homo Sapiens
EQELQKIRK

SEQ ID NO: 339169 - protein, 9 aa, Homo Sapiens
ITVLCLFFN

SEQ ID NO: 339170 - protein, 9 aa, Homo Sapiens
DLHIYVCLN

SEQ ID NO: 339171 - protein, 9 aa, Homo Sapiens
SRYPKGYVQ

SEQ ID NO: 339172 - protein, 9 aa, Homo Sapiens
SRSIGLLFV

SEQ ID NO: 339173 - protein, 9 aa, Homo Sapiens
CNEPLETTC

SEQ ID NO: 339174 - protein, 9 aa, Homo Sapiens
TADQVIEDI

SEQ ID NO: 339175 - protein, 9 aa, Homo Sapiens
AKKKMKLCG

SEQ ID NO: 339176 - protein, 9 aa, Homo Sapiens
SQCQDCRDS

SEQ ID NO: 339177 - protein, 9 aa, Homo Sapiens
NKFNHYDTA

SEQ ID NO: 339178 - protein, 9 aa, Homo Sapiens
GNEGSPGPP

SEQ ID NO: 339179 - protein, 9 aa, Homo Sapiens
PPARKEKNK

SEQ ID NO: 339180 - protein, 9 aa, Homo Sapiens
IPAGVFTMD

SEQ ID NO: 339181 - protein, 9 aa, Homo Sapiens
YKEEHRQIL

SEQ ID NO: 339182 - protein, 9 aa, Homo Sapiens
KYLCNAINV

SEQ ID NO: 339183 - protein, 9 aa, Homo Sapiens
WHRPALVKV

SEQ ID NO: 339184 - protein, 9 aa, Homo Sapiens
DRCVVCVSQ

SEQ ID NO: 339185 - protein, 9 aa, Homo Sapiens
NNTQHSSLV

SEQ ID NO: 339186 - protein, 9 aa, Homo Sapiens
MDDDNNQTL

SEQ ID NO: 339187 - protein, 9 aa, Homo Sapiens
KAIQREDFL

SEQ ID NO: 339188 - protein, 9 aa, Homo Sapiens
TDTEKGSEK

SEQ ID NO: 339189 - protein, 9 aa, Homo Sapiens
TKIDKLRTL

SEQ ID NO: 339190 - protein, 9 aa, Homo Sapiens
GLKCIERNE

SEQ ID NO: 339191 - protein, 9 aa, Homo Sapiens
PKHLYGLSQ

SEQ ID NO: 339192 - protein, 9 aa, Homo Sapiens
GKALTSKIN

SEQ ID NO: 339193 - protein, 9 aa, Homo Sapiens
YQCMAKNEV

SEQ ID NO: 339194 - protein, 9 aa, Homo Sapiens
LHHMLFELL

SEQ ID NO: 339195 - protein, 9 aa, Homo Sapiens
SNRIVHQRV

SEQ ID NO: 339196 - protein, 9 aa, Homo Sapiens
ALKEGQGGA

SEQ ID NO: 339197 - protein, 9 aa, Homo Sapiens
RFYGNNSSY

SEQ ID NO: 339198 - protein, 9 aa, Homo Sapiens
KLTQGSVAF

SEQ ID NO: 339199 - protein, 9 aa, Homo Sapiens
AKQLFARLL

SEQ ID NO: 339200 - protein, 9 aa, Homo Sapiens
TVDLVCCPE

SEQ ID NO: 339201 - protein, 9 aa, Homo Sapiens
CGGCDTEIK

SEQ ID NO: 339202 - protein, 9 aa, Homo Sapiens
LAKHNVLTL

SEQ ID NO: 339203 - protein, 9 aa, Homo Sapiens
PELEQLPDL

SEQ ID NO: 339204 - protein, 9 aa, Homo Sapiens
RTLHKPDRL

SEQ ID NO: 339205 - protein, 9 aa, Homo Sapiens
DCAVVNHFQ

SEQ ID NO: 339206 - protein, 9 aa, Homo Sapiens
SFGYGQHGS

SEQ ID NO: 339207 - protein, 9 aa, Homo Sapiens
KTKDLLVNQ

SEQ ID NO: 339208 - protein, 9 aa, Homo Sapiens
LRMRMYSLK

SEQ ID NO: 339209 - protein, 9 aa, Homo Sapiens
SVAVTKECS

SEQ ID NO: 339210 - protein, 9 aa, Homo Sapiens
TSPSSAEDT

SEQ ID NO: 339211 - protein, 9 aa, Homo Sapiens
ETYNDESQI

SEQ ID NO: 339212 - protein, 9 aa, Homo Sapiens
RFMSLPPNC

SEQ ID NO: 339213 - protein, 9 aa, Homo Sapiens
EKFLRDFTD

SEQ ID NO: 339214 - protein, 9 aa, Homo Sapiens
VLKRLSDVT

SEQ ID NO: 339215 - protein, 9 aa, Homo Sapiens
SHCQKNLSL

SEQ ID NO: 339216 - protein, 9 aa, Homo Sapiens
YSLSHDFNG

SEQ ID NO: 339217 - protein, 9 aa, Homo Sapiens
EQQNVLKVL

SEQ ID NO: 339218 - protein, 9 aa, Homo Sapiens
AVRLSVAED

SEQ ID NO: 339219 - protein, 9 aa, Homo Sapiens
FQRGLRHVL

SEQ ID NO: 339220 - protein, 9 aa, Homo Sapiens
ASMLSFMLD

SEQ ID NO: 339221 - protein, 9 aa, Homo Sapiens
EMDVADDDA

SEQ ID NO: 339222 - protein, 9 aa, Homo Sapiens
IYSGQVQQP

SEQ ID NO: 339223 - protein, 9 aa, Homo Sapiens
WQDEQDYHA

SEQ ID NO: 339224 - protein, 9 aa, Homo Sapiens
NHPALICCE

SEQ ID NO: 339225 - protein, 9 aa, Homo Sapiens
DKLRTLDSV

SEQ ID NO: 339226 - protein, 9 aa, Homo Sapiens
QTFWCLYHK

SEQ ID NO: 339227 - protein, 9 aa, Homo Sapiens
EMVSCIKIG

SEQ ID NO: 339228 - protein, 9 aa, Homo Sapiens
IAQRKLKKH

SEQ ID NO: 339229 - protein, 9 aa, Homo Sapiens
PSVMNLDNL

SEQ ID NO: 339230 - protein, 9 aa, Homo Sapiens
SIYPMHNLK

SEQ ID NO: 339231 - protein, 9 aa, Homo Sapiens
NANPPVSHY

SEQ ID NO: 339232 - protein, 9 aa, Homo Sapiens
WIIHNEERS

SEQ ID NO: 339233 - protein, 9 aa, Homo Sapiens
IFPYLYESY

SEQ ID NO: 339234 - protein, 9 aa, Homo Sapiens
ERSNISAYD

SEQ ID NO: 339235 - protein, 9 aa, Homo Sapiens
LVLKRFPRA

SEQ ID NO: 339236 - protein, 9 aa, Homo Sapiens
KTICDGALI

SEQ ID NO: 339237 - protein, 9 aa, Homo Sapiens
LSKHLQSLV

SEQ ID NO: 339238 - protein, 9 aa, Homo Sapiens
TCIDYQTFF

SEQ ID NO: 339239 - protein, 9 aa, Homo Sapiens
FRFLNKLIK

SEQ ID NO: 339240 - protein, 9 aa, Homo Sapiens
PSPLVYLQA

SEQ ID NO: 339241 - protein, 9 aa, Homo Sapiens
SMQIEQIKQ

SEQ ID NO: 339242 - protein, 9 aa, Homo Sapiens
AITSTLRED

SEQ ID NO: 339243 - protein, 9 aa, Homo Sapiens
KLLERIGYP

SEQ ID NO: 339244 - protein, 9 aa, Homo Sapiens
GAKGDPGPP

SEQ ID NO: 339245 - protein, 9 aa, Homo Sapiens
MTNCMEHAL

SEQ ID NO: 339246 - protein, 9 aa, Homo Sapiens
KTKIYKYWL

SEQ ID NO: 339247 - protein, 9 aa, Homo Sapiens
SLNLTNHQR

SEQ ID NO: 339248 - protein, 9 aa, Homo Sapiens
EFGDVLGAC

SEQ ID NO: 339249 - protein, 9 aa, Homo Sapiens
VRTDIYITS

SEQ ID NO: 339250 - protein, 9 aa, Homo Sapiens
DHGNTLHKG

SEQ ID NO: 339251 - protein, 9 aa, Homo Sapiens
GVSLVCKKH

SEQ ID NO: 339252 - protein, 9 aa, Homo Sapiens
FKYLLDQLK

SEQ ID NO: 339253 - protein, 9 aa, Homo Sapiens
AHRIRQQNE

SEQ ID NO: 339254 - protein, 9 aa, Homo Sapiens
GVLFCGPKA

SEQ ID NO: 339255 - protein, 9 aa, Homo Sapiens
VHRDLKSDN

SEQ ID NO: 339256 - protein, 9 aa, Homo Sapiens
SFERLLWQI

SEQ ID NO: 339257 - protein, 9 aa, Homo Sapiens
QLLNVDTKS

SEQ ID NO: 339258 - protein, 9 aa, Homo Sapiens
NSGERPFEC

SEQ ID NO: 339259 - protein, 9 aa, Homo Sapiens
YHPFSRLAI

SEQ ID NO: 339260 - protein, 9 aa, Homo Sapiens
QILETKELN

SEQ ID NO: 339261 - protein, 9 aa, Homo Sapiens
GETWDNLTI

SEQ ID NO: 339262 - protein, 9 aa, Homo Sapiens
TVDDFKTQG

SEQ ID NO: 339263 - protein, 9 aa, Homo Sapiens
QTTKAPTSP

SEQ ID NO: 339264 - protein, 9 aa, Homo Sapiens
GWVTPPVSN

SEQ ID NO: 339265 - protein, 9 aa, Homo Sapiens
LAELNLMPD

SEQ ID NO: 339266 - protein, 9 aa, Homo Sapiens
KFIQIHFGA

SEQ ID NO: 339267 - protein, 9 aa, Homo Sapiens
RGVVVAVTG

SEQ ID NO: 339268 - protein, 9 aa, Homo Sapiens
RQLALKVIV

SEQ ID NO: 339269 - protein, 9 aa, Homo Sapiens
QATMKALQK

SEQ ID NO: 339270 - protein, 9 aa, Homo Sapiens
KVTQEAGKF

SEQ ID NO: 339271 - protein, 9 aa, Homo Sapiens
IGIIEDNWQ

SEQ ID NO: 339272 - protein, 9 aa, Homo Sapiens
GGLIYSFLT

SEQ ID NO: 339273 - protein, 9 aa, Homo Sapiens
LTSQVIHNA

SEQ ID NO: 339274 - protein, 9 aa, Homo Sapiens
EYRASVWEN

SEQ ID NO: 339275 - protein, 9 aa, Homo Sapiens
IFFCLFVHF

SEQ ID NO: 339276 - protein, 9 aa, Homo Sapiens
RRQEEHERL

SEQ ID NO: 339277 - protein, 9 aa, Homo Sapiens
KLRLKEPQQ

SEQ ID NO: 339278 - protein, 9 aa, Homo Sapiens
QDVQRESEG

SEQ ID NO: 339279 - protein, 9 aa, Homo Sapiens
WDGQLLPSS

SEQ ID NO: 339280 - protein, 9 aa, Homo Sapiens
LYHLLKHIV

SEQ ID NO: 339281 - protein, 9 aa, Homo Sapiens
VIEYNSTRD

SEQ ID NO: 339282 - protein, 9 aa, Homo Sapiens
EFMQLLLRE

SEQ ID NO: 339283 - protein, 9 aa, Homo Sapiens
GFWGTVGYR

SEQ ID NO: 339284 - protein, 9 aa, Homo Sapiens
ESLAVHGLP

SEQ ID NO: 339285 - protein, 9 aa, Homo Sapiens
LCALSTNLL

SEQ ID NO: 339286 - protein, 9 aa, Homo Sapiens
QQELSRSGM

SEQ ID NO: 339287 - protein, 9 aa, Homo Sapiens
VGKINLPPG

SEQ ID NO: 339288 - protein, 9 aa, Homo Sapiens
ANLALLADD

SEQ ID NO: 339289 - protein, 9 aa, Homo Sapiens
NIQFTHANK

SEQ ID NO: 339290 - protein, 9 aa, Homo Sapiens
YWIVVKINS

SEQ ID NO: 339291 - protein, 9 aa, Homo Sapiens
EELEAGTES

SEQ ID NO: 339292 - protein, 9 aa, Homo Sapiens
MALTSFMKG

SEQ ID NO: 339293 - protein, 9 aa, Homo Sapiens
ANNSYNDAL

SEQ ID NO: 339294 - protein, 9 aa, Homo Sapiens
DHCLCELPA

SEQ ID NO: 339295 - protein, 9 aa, Homo Sapiens
SRVLPIEHQ

SEQ ID NO: 339296 - protein, 9 aa, Homo Sapiens
YSGTSQKIT

SEQ ID NO: 339297 - protein, 9 aa, Homo Sapiens
VLSQNSRDA

SEQ ID NO: 339298 - protein, 9 aa, Homo Sapiens
SYIHHSGRT

SEQ ID NO: 339299 - protein, 9 aa, Homo Sapiens
LITVLCLFF

SEQ ID NO: 339300 - protein, 9 aa, Homo Sapiens
KNKTSDDEA

SEQ ID NO: 339301 - protein, 9 aa, Homo Sapiens
IKILHLKQF

SEQ ID NO: 339302 - protein, 9 aa, Homo Sapiens
SCFKYQKLY

SEQ ID NO: 339303 - protein, 9 aa, Homo Sapiens
PGNNVTLTC

SEQ ID NO: 339304 - protein, 9 aa, Homo Sapiens
KLKLFFSKL

SEQ ID NO: 339305 - protein, 9 aa, Homo Sapiens
VKVMLKNIK

SEQ ID NO: 339306 - protein, 9 aa, Homo Sapiens
AFHKDSYLR

SEQ ID NO: 339307 - protein, 9 aa, Homo Sapiens
LFWCLHFVN

SEQ ID NO: 339308 - protein, 9 aa, Homo Sapiens
QELNNKINM

SEQ ID NO: 339309 - protein, 9 aa, Homo Sapiens
NILEKDKRT

SEQ ID NO: 339310 - protein, 9 aa, Homo Sapiens
TTHKRIITG

SEQ ID NO: 339311 - protein, 9 aa, Homo Sapiens
PGSSNYSAS

SEQ ID NO: 339312 - protein, 9 aa, Homo Sapiens
YTAFSVGRK

SEQ ID NO: 339313 - protein, 9 aa, Homo Sapiens
KAENTTRAM

SEQ ID NO: 339314 - protein, 9 aa, Homo Sapiens
ILCNNTAYQ

SEQ ID NO: 339315 - protein, 9 aa, Homo Sapiens
PPAENLSAP

SEQ ID NO: 339316 - protein, 9 aa, Homo Sapiens
LGKTSFFTW

SEQ ID NO: 339317 - protein, 9 aa, Homo Sapiens
EECQKDWCC

SEQ ID NO: 339318 - protein, 9 aa, Homo Sapiens
VPFVQTREY

SEQ ID NO: 339319 - protein, 9 aa, Homo Sapiens
HSPYKKKKN

SEQ ID NO: 339320 - protein, 9 aa, Homo Sapiens
SHAPSSNFL

SEQ ID NO: 339321 - protein, 9 aa, Homo Sapiens
SALTMLQER

SEQ ID NO: 339322 - protein, 9 aa, Homo Sapiens
GTYFQIHIN

SEQ ID NO: 339323 - protein, 9 aa, Homo Sapiens
YSASASQVA

SEQ ID NO: 339324 - protein, 9 aa, Homo Sapiens
NMFDLIDVY

SEQ ID NO: 339325 - protein, 9 aa, Homo Sapiens
FLASHRKLG

SEQ ID NO: 339326 - protein, 9 aa, Homo Sapiens
EERIWKERM

SEQ ID NO: 339327 - protein, 9 aa, Homo Sapiens
ETLAIVCWS

SEQ ID NO: 339328 - protein, 9 aa, Homo Sapiens
DESKDATKD

SEQ ID NO: 339329 - protein, 9 aa, Homo Sapiens
LDLFSEGSL

SEQ ID NO: 339330 - protein, 9 aa, Homo Sapiens
SLMQIDGNV

SEQ ID NO: 339331 - protein, 9 aa, Homo Sapiens
SKLIRDSME

SEQ ID NO: 339332 - protein, 9 aa, Homo Sapiens
ARELFPDIY

SEQ ID NO: 339333 - protein, 9 aa, Homo Sapiens
GMVKVNTVD

SEQ ID NO: 339334 - protein, 9 aa, Homo Sapiens
LKAVSSSSL

SEQ ID NO: 339335 - protein, 9 aa, Homo Sapiens
EKESDKENG

SEQ ID NO: 339336 - protein, 9 aa, Homo Sapiens
SKFKRRPRE

SEQ ID NO: 339337 - protein, 9 aa, Homo Sapiens
EIYGLDFVK

SEQ ID NO: 339338 - protein, 9 aa, Homo Sapiens
AWGPRESQD

SEQ ID NO: 339339 - protein, 9 aa, Homo Sapiens
DIPGDKEYC

SEQ ID NO: 339340 - protein, 9 aa, Homo Sapiens
DNGDPGPMG

SEQ ID NO: 339341 - protein, 9 aa, Homo Sapiens
HREKLRRNC

SEQ ID NO: 339342 - protein, 9 aa, Homo Sapiens
ESANNSVLG

SEQ ID NO: 339343 - protein, 9 aa, Homo Sapiens
DEGAPQISL

SEQ ID NO: 339344 - protein, 9 aa, Homo Sapiens
GQAQSLKTE

SEQ ID NO: 339345 - protein, 9 aa, Homo Sapiens
TATECLRHP

SEQ ID NO: 339346 - protein, 9 aa, Homo Sapiens
PLFMEGVGK

SEQ ID NO: 339347 - protein, 9 aa, Homo Sapiens
KIREQNQYD

SEQ ID NO: 339348 - protein, 9 aa, Homo Sapiens
YIDAQTESN

SEQ ID NO: 339349 - protein, 9 aa, Homo Sapiens
DFNSKPHSP

SEQ ID NO: 339350 - protein, 9 aa, Homo Sapiens
EHKRINAGE

SEQ ID NO: 339351 - protein, 9 aa, Homo Sapiens
GYEFFADVW

SEQ ID NO: 339352 - protein, 9 aa, Homo Sapiens
DFPAARHLY

SEQ ID NO: 339353 - protein, 9 aa, Homo Sapiens
KVNNLGVCG

SEQ ID NO: 339354 - protein, 9 aa, Homo Sapiens
YKVPARLTL

SEQ ID NO: 339355 - protein, 9 aa, Homo Sapiens
QQYPSPGSN

SEQ ID NO: 339356 - protein, 9 aa, Homo Sapiens
TGEKPHACS

SEQ ID NO: 339357 - protein, 9 aa, Homo Sapiens
GKRSPRRGE

SEQ ID NO: 339358 - protein, 9 aa, Homo Sapiens
ILYQFSRCF

SEQ ID NO: 339359 - protein, 9 aa, Homo Sapiens
TRTNVQFSD

SEQ ID NO: 339360 - protein, 9 aa, Homo Sapiens
DHRITSQIN

SEQ ID NO: 339361 - protein, 9 aa, Homo Sapiens
SSLHQKLCF

SEQ ID NO: 339362 - protein, 9 aa, Homo Sapiens
VKLLWLPAS

SEQ ID NO: 339363 - protein, 9 aa, Homo Sapiens
CRLSTFYEN

SEQ ID NO: 339364 - protein, 9 aa, Homo Sapiens
EALQRSSTP

SEQ ID NO: 339365 - protein, 9 aa, Homo Sapiens
FFLSEHQIT

SEQ ID NO: 339366 - protein, 9 aa, Homo Sapiens
EQSDLEEFQ

SEQ ID NO: 339367 - protein, 9 aa, Homo Sapiens
PSSSIGVLF

SEQ ID NO: 339368 - protein, 9 aa, Homo Sapiens
LNRSKIGWV

SEQ ID NO: 339369 - protein, 9 aa, Homo Sapiens
LFLMFCMVG

SEQ ID NO: 339370 - protein, 9 aa, Homo Sapiens
VKLSRRHPI

SEQ ID NO: 339371 - protein, 9 aa, Homo Sapiens
ELVLHQSVE

SEQ ID NO: 339372 - protein, 9 aa, Homo Sapiens
YKSKFKRRP

SEQ ID NO: 339373 - protein, 9 aa, Homo Sapiens
LYVCCGTVG

SEQ ID NO: 339374 - protein, 9 aa, Homo Sapiens
PSWRKICKS

SEQ ID NO: 339375 - protein, 9 aa, Homo Sapiens
YLDLCRFGS

SEQ ID NO: 339376 - protein, 9 aa, Homo Sapiens
YLGFEHSEL

SEQ ID NO: 339377 - protein, 9 aa, Homo Sapiens
STSADSLAT

SEQ ID NO: 339378 - protein, 9 aa, Homo Sapiens
IRRMWNYTV

SEQ ID NO: 339379 - protein, 9 aa, Homo Sapiens
LINKCNFIK

SEQ ID NO: 339380 - protein, 9 aa, Homo Sapiens
TKHKIICTG

SEQ ID NO: 339381 - protein, 9 aa, Homo Sapiens
EEPPQQPPE

SEQ ID NO: 339382 - protein, 9 aa, Homo Sapiens
GRNHTHVIS

SEQ ID NO: 339383 - protein, 9 aa, Homo Sapiens
DLFLSLVAV

SEQ ID NO: 339384 - protein, 9 aa, Homo Sapiens
EAASKESKP

SEQ ID NO: 339385 - protein, 9 aa, Homo Sapiens
CDACNLQFA

SEQ ID NO: 339386 - protein, 9 aa, Homo Sapiens
ENEDLAHEL

SEQ ID NO: 339387 - protein, 9 aa, Homo Sapiens
HLLLECGKD

SEQ ID NO: 339388 - protein, 9 aa, Homo Sapiens
KPNLLSMLL

SEQ ID NO: 339389 - protein, 9 aa, Homo Sapiens
DSRDVLAGL

SEQ ID NO: 339390 - protein, 9 aa, Homo Sapiens
GEKFYRQSV

SEQ ID NO: 339391 - protein, 9 aa, Homo Sapiens
WVGSKNTCF

SEQ ID NO: 339392 - protein, 9 aa, Homo Sapiens
LTELTGFTE

SEQ ID NO: 339393 - protein, 9 aa, Homo Sapiens
SIGVLFCGP

SEQ ID NO: 339394 - protein, 9 aa, Homo Sapiens
AEIHQLKKE

SEQ ID NO: 339395 - protein, 9 aa, Homo Sapiens
SEFLPPIRG

SEQ ID NO: 339396 - protein, 9 aa, Homo Sapiens
LQHERIHTG

SEQ ID NO: 339397 - protein, 9 aa, Homo Sapiens
EKRVLAIVE

SEQ ID NO: 339398 - protein, 9 aa, Homo Sapiens
DLFRLFRTN

SEQ ID NO: 339399 - protein, 9 aa, Homo Sapiens
KEAVTALIA

SEQ ID NO: 339400 - protein, 9 aa, Homo Sapiens
ISIIDGNES

SEQ ID NO: 339401 - protein, 9 aa, Homo Sapiens
FKNKLPVPI

SEQ ID NO: 339402 - protein, 9 aa, Homo Sapiens
DNHPMNEEG

SEQ ID NO: 339403 - protein, 9 aa, Homo Sapiens
NMPQYLGNQ

SEQ ID NO: 339404 - protein, 9 aa, Homo Sapiens
NLEHVKINQ

SEQ ID NO: 339405 - protein, 9 aa, Homo Sapiens
KAGSIMWEG

SEQ ID NO: 339406 - protein, 9 aa, Homo Sapiens
SLSVKEVPC

SEQ ID NO: 339407 - protein, 9 aa, Homo Sapiens
LGIYEQEPL

SEQ ID NO: 339408 - protein, 9 aa, Homo Sapiens
RAPSPTKLQ

SEQ ID NO: 339409 - protein, 9 aa, Homo Sapiens
ADIQILAIK

SEQ ID NO: 339410 - protein, 9 aa, Homo Sapiens
WDNNDTTII

SEQ ID NO: 339411 - protein, 9 aa, Homo Sapiens
TRQQDTRSP

SEQ ID NO: 339412 - protein, 9 aa, Homo Sapiens
NETSNSIDS

SEQ ID NO: 339413 - protein, 9 aa, Homo Sapiens
KTTLTVHQI

SEQ ID NO: 339414 - protein, 9 aa, Homo Sapiens
QNTDCGGGY

SEQ ID NO: 339415 - protein, 9 aa, Homo Sapiens
IILSIGGYL

SEQ ID NO: 339416 - protein, 9 aa, Homo Sapiens
MDVREKQGQ

SEQ ID NO: 339417 - protein, 9 aa, Homo Sapiens
KLDKNKRTP

SEQ ID NO: 339418 - protein, 9 aa, Homo Sapiens
KLQDQTGSG

SEQ ID NO: 339419 - protein, 9 aa, Homo Sapiens
QQSSKESAA

SEQ ID NO: 339420 - protein, 9 aa, Homo Sapiens
EVFESLLSD

SEQ ID NO: 339421 - protein, 9 aa, Homo Sapiens
PSRRDRSKN

SEQ ID NO: 339422 - protein, 9 aa, Homo Sapiens
QQERLQAIT

SEQ ID NO: 339423 - protein, 9 aa, Homo Sapiens
NISEKTKCL

SEQ ID NO: 339424 - protein, 9 aa, Homo Sapiens
RSSSWCILG

SEQ ID NO: 339425 - protein, 9 aa, Homo Sapiens
PLGGQKFVF

SEQ ID NO: 339426 - protein, 9 aa, Homo Sapiens
LFLNSYNGH

SEQ ID NO: 339427 - protein, 9 aa, Homo Sapiens
ATFLDTVKE

SEQ ID NO: 339428 - protein, 9 aa, Homo Sapiens
EKKKKRLRV

SEQ ID NO: 339429 - protein, 9 aa, Homo Sapiens
SMQNKKPGF

SEQ ID NO: 339430 - protein, 9 aa, Homo Sapiens
STTKSAAKR

SEQ ID NO: 339431 - protein, 9 aa, Homo Sapiens
DRDANQESN

SEQ ID NO: 339432 - protein, 9 aa, Homo Sapiens
FPEVLLTKI

SEQ ID NO: 339433 - protein, 9 aa, Homo Sapiens
IKHFIIYLI

SEQ ID NO: 339434 - protein, 9 aa, Homo Sapiens
PARILCGIV

SEQ ID NO: 339435 - protein, 9 aa, Homo Sapiens
LDVPPGEYK

SEQ ID NO: 339436 - protein, 9 aa, Homo Sapiens
KCRFSLSVP

SEQ ID NO: 339437 - protein, 9 aa, Homo Sapiens
GLIEKNIKL

SEQ ID NO: 339438 - protein, 9 aa, Homo Sapiens
NEVEIYGEP

SEQ ID NO: 339439 - protein, 9 aa, Homo Sapiens
NSKSKLLQT

SEQ ID NO: 339440 - protein, 9 aa, Homo Sapiens
FFLRIRVVF

SEQ ID NO: 339441 - protein, 9 aa, Homo Sapiens
GMKRKDELN

SEQ ID NO: 339442 - protein, 9 aa, Homo Sapiens
IEHLQNELR

SEQ ID NO: 339443 - protein, 9 aa, Homo Sapiens
AQRKLKKHF

SEQ ID NO: 339444 - protein, 9 aa, Homo Sapiens
RFAQPATKD

SEQ ID NO: 339445 - protein, 9 aa, Homo Sapiens
TSDDVKEQM

SEQ ID NO: 339446 - protein, 9 aa, Homo Sapiens
ADGGTLVQA

SEQ ID NO: 339447 - protein, 9 aa, Homo Sapiens
EDRGPDDQE

SEQ ID NO: 339448 - protein, 9 aa, Homo Sapiens
IATFLDTVK

SEQ ID NO: 339449 - protein, 9 aa, Homo Sapiens
KESKQLKIS

SEQ ID NO: 339450 - protein, 9 aa, Homo Sapiens
TWDCDQDKH

SEQ ID NO: 339451 - protein, 9 aa, Homo Sapiens
DKENMKKPA

SEQ ID NO: 339452 - protein, 9 aa, Homo Sapiens
PPKTEDHGT

SEQ ID NO: 339453 - protein, 9 aa, Homo Sapiens
GDKRKKRRG

SEQ ID NO: 339454 - protein, 9 aa, Homo Sapiens
TADNHGYMA

SEQ ID NO: 339455 - protein, 9 aa, Homo Sapiens
SESQIISCR

SEQ ID NO: 339456 - protein, 9 aa, Homo Sapiens
LFDSEKIMW

SEQ ID NO: 339457 - protein, 9 aa, Homo Sapiens
SDSDLSPPQ

SEQ ID NO: 339458 - protein, 9 aa, Homo Sapiens
YKQLVLHPR

SEQ ID NO: 339459 - protein, 9 aa, Homo Sapiens
ACVDYMGSS

SEQ ID NO: 339460 - protein, 9 aa, Homo Sapiens
TMEVEGGDK

SEQ ID NO: 339461 - protein, 9 aa, Homo Sapiens
VHRHMNSLM

SEQ ID NO: 339462 - protein, 9 aa, Homo Sapiens
AQSLRHSPK

SEQ ID NO: 339463 - protein, 9 aa, Homo Sapiens
NLANVEQWR

SEQ ID NO: 339464 - protein, 9 aa, Homo Sapiens
IFGTVIVAG

SEQ ID NO: 339465 - protein, 9 aa, Homo Sapiens
HLLKALHKI

SEQ ID NO: 339466 - protein, 9 aa, Homo Sapiens
RSMQGTIMG

SEQ ID NO: 339467 - protein, 9 aa, Homo Sapiens
PKPKISWFN

SEQ ID NO: 339468 - protein, 9 aa, Homo Sapiens
GVQTELLTL

SEQ ID NO: 339469 - protein, 9 aa, Homo Sapiens
QHDVQELNQ

SEQ ID NO: 339470 - protein, 9 aa, Homo Sapiens
CVRADEYYL

SEQ ID NO: 339471 - protein, 9 aa, Homo Sapiens
ITISDTNEA

SEQ ID NO: 339472 - protein, 9 aa, Homo Sapiens
NILEENLQR

SEQ ID NO: 339473 - protein, 9 aa, Homo Sapiens
KTDLQLHVK

SEQ ID NO: 339474 - protein, 9 aa, Homo Sapiens
TVIYLYTAR

SEQ ID NO: 339475 - protein, 9 aa, Homo Sapiens
SRTSPTPRD

SEQ ID NO: 339476 - protein, 9 aa, Homo Sapiens
DHHFYRYMG

SEQ ID NO: 339477 - protein, 9 aa, Homo Sapiens
FMYTIRNKE

SEQ ID NO: 339478 - protein, 9 aa, Homo Sapiens
RQTCVFFEA

SEQ ID NO: 339479 - protein, 9 aa, Homo Sapiens
LHNCIQKTL

SEQ ID NO: 339480 - protein, 9 aa, Homo Sapiens
KIKQVVNLS

SEQ ID NO: 339481 - protein, 9 aa, Homo Sapiens
EVGTLWYRP

SEQ ID NO: 339482 - protein, 9 aa, Homo Sapiens
VDVVQERVD

SEQ ID NO: 339483 - protein, 9 aa, Homo Sapiens
VGKDLPAMS

SEQ ID NO: 339484 - protein, 9 aa, Homo Sapiens
IQEKLLLKT

SEQ ID NO: 339485 - protein, 9 aa, Homo Sapiens
TVNADLSAS

SEQ ID NO: 339486 - protein, 9 aa, Homo Sapiens
FRWMTARRR

SEQ ID NO: 339487 - protein, 9 aa, Homo Sapiens
TTKKTTLLL

SEQ ID NO: 339488 - protein, 9 aa, Homo Sapiens
MGMYFVSSG

SEQ ID NO: 339489 - protein, 9 aa, Homo Sapiens
NDVVDFFHK

SEQ ID NO: 339490 - protein, 9 aa, Homo Sapiens
LHQHTHTGE

SEQ ID NO: 339491 - protein, 9 aa, Homo Sapiens
QIIAEPEWV

SEQ ID NO: 339492 - protein, 9 aa, Homo Sapiens
VNSGERPFE

SEQ ID NO: 339493 - protein, 9 aa, Homo Sapiens
ALDTLLYQK

SEQ ID NO: 339494 - protein, 9 aa, Homo Sapiens
TPNLAANNV

SEQ ID NO: 339495 - protein, 9 aa, Homo Sapiens
DNDMKRKKV

SEQ ID NO: 339496 - protein, 9 aa, Homo Sapiens
FGDNIKLKL

SEQ ID NO: 339497 - protein, 9 aa, Homo Sapiens
PSSAMIKYL

SEQ ID NO: 339498 - protein, 9 aa, Homo Sapiens
LYEVVHRIL

SEQ ID NO: 339499 - protein, 9 aa, Homo Sapiens
LKNNYNRGD

SEQ ID NO: 339500 - protein, 9 aa, Homo Sapiens
RASKAQRRR

SEQ ID NO: 339501 - protein, 9 aa, Homo Sapiens
ASGWHPHEP

SEQ ID NO: 339502 - protein, 9 aa, Homo Sapiens
EGNASQARV

SEQ ID NO: 339503 - protein, 9 aa, Homo Sapiens
AARKFKPDV

SEQ ID NO: 339504 - protein, 9 aa, Homo Sapiens
KSLEEAAKR

SEQ ID NO: 339505 - protein, 9 aa, Homo Sapiens
ELQPFNRNL

SEQ ID NO: 339506 - protein, 9 aa, Homo Sapiens
SRSIKGGIE

SEQ ID NO: 339507 - protein, 9 aa, Homo Sapiens
NNKQVTLPA

SEQ ID NO: 339508 - protein, 9 aa, Homo Sapiens
FKASDSVIS

SEQ ID NO: 339509 - protein, 9 aa, Homo Sapiens
ITCCLVKAG

SEQ ID NO: 339510 - protein, 9 aa, Homo Sapiens
CQSQLTSNR

SEQ ID NO: 339511 - protein, 9 aa, Homo Sapiens
PERRGVAVK

SEQ ID NO: 339512 - protein, 9 aa, Homo Sapiens
SDLEEFQEA

SEQ ID NO: 339513 - protein, 9 aa, Homo Sapiens
NRWDNNDTT

SEQ ID NO: 339514 - protein, 9 aa, Homo Sapiens
NCLSAQGDS

SEQ ID NO: 339515 - protein, 9 aa, Homo Sapiens
IEVVGINDN

SEQ ID NO: 339516 - protein, 9 aa, Homo Sapiens
REKLALYIY

SEQ ID NO: 339517 - protein, 9 aa, Homo Sapiens
ITDVDNLRM

SEQ ID NO: 339518 - protein, 9 aa, Homo Sapiens
KHIAGKIIP

SEQ ID NO: 339519 - protein, 9 aa, Homo Sapiens
CQAFYFALR

SEQ ID NO: 339520 - protein, 9 aa, Homo Sapiens
AGVHNPQQH

SEQ ID NO: 339521 - protein, 9 aa, Homo Sapiens
WGPRESQDL

SEQ ID NO: 339522 - protein, 9 aa, Homo Sapiens
LSFMYRWLK

SEQ ID NO: 339523 - protein, 9 aa, Homo Sapiens
GEQLLNVDT

SEQ ID NO: 339524 - protein, 9 aa, Homo Sapiens
EPRSQTAII

SEQ ID NO: 339525 - protein, 9 aa, Homo Sapiens
EIQKNRWDN

SEQ ID NO: 339526 - protein, 9 aa, Homo Sapiens
VDLIKYLPK

SEQ ID NO: 339527 - protein, 9 aa, Homo Sapiens
PVMAKKEED

SEQ ID NO: 339528 - protein, 9 aa, Homo Sapiens
REKYIEIDA

SEQ ID NO: 339529 - protein, 9 aa, Homo Sapiens
EDRTHNIIM

SEQ ID NO: 339530 - protein, 9 aa, Homo Sapiens
SHVARVIVA

SEQ ID NO: 339531 - protein, 9 aa, Homo Sapiens
CGFTTISVG

SEQ ID NO: 339532 - protein, 9 aa, Homo Sapiens
EEDSSGGEE

SEQ ID NO: 339533 - protein, 9 aa, Homo Sapiens
QIHINKYKM

SEQ ID NO: 339534 - protein, 9 aa, Homo Sapiens
NNICSIYNL

SEQ ID NO: 339535 - protein, 9 aa, Homo Sapiens
DLGCPAPRA

SEQ ID NO: 339536 - protein, 9 aa, Homo Sapiens
ILFVITTPD

SEQ ID NO: 339537 - protein, 9 aa, Homo Sapiens
PLEKEEASH

SEQ ID NO: 339538 - protein, 9 aa, Homo Sapiens
VGAKVTFSC

SEQ ID NO: 339539 - protein, 9 aa, Homo Sapiens
IFQTWFEQS

SEQ ID NO: 339540 - protein, 9 aa, Homo Sapiens
LGVKNKLCV

SEQ ID NO: 339541 - protein, 9 aa, Homo Sapiens
MRAAQSLGE

SEQ ID NO: 339542 - protein, 9 aa, Homo Sapiens
CGPTSTSID

SEQ ID NO: 339543 - protein, 9 aa, Homo Sapiens
VDSAMNHHL

SEQ ID NO: 339544 - protein, 9 aa, Homo Sapiens
YFLALKKHV

SEQ ID NO: 339545 - protein, 9 aa, Homo Sapiens
TIKNETDVF

SEQ ID NO: 339546 - protein, 9 aa, Homo Sapiens
KHPKYQEQC

SEQ ID NO: 339547 - protein, 9 aa, Homo Sapiens
GFYCGVGLL

SEQ ID NO: 339548 - protein, 9 aa, Homo Sapiens
DGVDIYSLV

SEQ ID NO: 339549 - protein, 9 aa, Homo Sapiens
RAIASRQEA

SEQ ID NO: 339550 - protein, 9 aa, Homo Sapiens
VVRRPDQKD

SEQ ID NO: 339551 - protein, 9 aa, Homo Sapiens
GKLCLMWCI

SEQ ID NO: 339552 - protein, 9 aa, Homo Sapiens
CNWDFRNKT

SEQ ID NO: 339553 - protein, 9 aa, Homo Sapiens
RQKIVDFLN

SEQ ID NO: 339554 - protein, 9 aa, Homo Sapiens
SLKSSKNAS

SEQ ID NO: 339555 - protein, 9 aa, Homo Sapiens
GTHDKMNEI

SEQ ID NO: 339556 - protein, 9 aa, Homo Sapiens
NWKRSQHES

SEQ ID NO: 339557 - protein, 9 aa, Homo Sapiens
KCRITWDKK

SEQ ID NO: 339558 - protein, 9 aa, Homo Sapiens
DKHIIGFDT

SEQ ID NO: 339559 - protein, 9 aa, Homo Sapiens
YRKVQEHEK

SEQ ID NO: 339560 - protein, 9 aa, Homo Sapiens
VPVILMGCS

SEQ ID NO: 339561 - protein, 9 aa, Homo Sapiens
ADCIRIELR

SEQ ID NO: 339562 - protein, 9 aa, Homo Sapiens
LSLCDSNVI

SEQ ID NO: 339563 - protein, 9 aa, Homo Sapiens
REGPKGCNL

SEQ ID NO: 339564 - protein, 9 aa, Homo Sapiens
KENDERELS

SEQ ID NO: 339565 - protein, 9 aa, Homo Sapiens
RETQEYNQI

SEQ ID NO: 339566 - protein, 9 aa, Homo Sapiens
VHQRSSEVS

SEQ ID NO: 339567 - protein, 9 aa, Homo Sapiens
PVCYKIITL

SEQ ID NO: 339568 - protein, 9 aa, Homo Sapiens
ITLGTKTES

SEQ ID NO: 339569 - protein, 9 aa, Homo Sapiens
GSAEMAALT

SEQ ID NO: 339570 - protein, 9 aa, Homo Sapiens
ISVLVKMYK

SEQ ID NO: 339571 - protein, 9 aa, Homo Sapiens
CLLMIECSS

SEQ ID NO: 339572 - protein, 9 aa, Homo Sapiens
AFNLIEHYF

SEQ ID NO: 339573 - protein, 9 aa, Homo Sapiens
FFSAVGLVT

SEQ ID NO: 339574 - protein, 9 aa, Homo Sapiens
GDAYKCPVI

SEQ ID NO: 339575 - protein, 9 aa, Homo Sapiens
FRIYDFNND

SEQ ID NO: 339576 - protein, 9 aa, Homo Sapiens
CSSVVLKTL

SEQ ID NO: 339577 - protein, 9 aa, Homo Sapiens
SVALLCKLF

SEQ ID NO: 339578 - protein, 9 aa, Homo Sapiens
HFTNRLDMS

SEQ ID NO: 339579 - protein, 9 aa, Homo Sapiens
LPNQKGSTK

SEQ ID NO: 339580 - protein, 9 aa, Homo Sapiens
WLKEAEEDS

SEQ ID NO: 339581 - protein, 9 aa, Homo Sapiens
ITDDSRWCS

SEQ ID NO: 339582 - protein, 9 aa, Homo Sapiens
ERLRTLPEV

SEQ ID NO: 339583 - protein, 9 aa, Homo Sapiens
DLSGMDSLS

SEQ ID NO: 339584 - protein, 9 aa, Homo Sapiens
SLTPTFFSQ

SEQ ID NO: 339585 - protein, 9 aa, Homo Sapiens
GPYPALLQH

SEQ ID NO: 339586 - protein, 9 aa, Homo Sapiens
VEIYRWIWD

SEQ ID NO: 339587 - protein, 9 aa, Homo Sapiens
LRCPLSRNI

SEQ ID NO: 339588 - protein, 9 aa, Homo Sapiens
KWLQYLEKL

SEQ ID NO: 339589 - protein, 9 aa, Homo Sapiens
TNQNAISSS

SEQ ID NO: 339590 - protein, 9 aa, Homo Sapiens
ERSFHFKYV

SEQ ID NO: 339591 - protein, 9 aa, Homo Sapiens
MQEKSRWTE

SEQ ID NO: 339592 - protein, 9 aa, Homo Sapiens
SNKKLACGA

SEQ ID NO: 339593 - protein, 9 aa, Homo Sapiens
EIIWSHLEL

SEQ ID NO: 339594 - protein, 9 aa, Homo Sapiens
FRPDGLPKT

SEQ ID NO: 339595 - protein, 9 aa, Homo Sapiens
KDHKKADAE

SEQ ID NO: 339596 - protein, 9 aa, Homo Sapiens
TNHLYAAIL

SEQ ID NO: 339597 - protein, 9 aa, Homo Sapiens
LNEIIAAFD

SEQ ID NO: 339598 - protein, 9 aa, Homo Sapiens
LYAIMKMCW

SEQ ID NO: 339599 - protein, 9 aa, Homo Sapiens
CTAGCDKAF

SEQ ID NO: 339600 - protein, 9 aa, Homo Sapiens
ITATGRGKP

SEQ ID NO: 339601 - protein, 9 aa, Homo Sapiens
LCQKVEATG

SEQ ID NO: 339602 - protein, 9 aa, Homo Sapiens
TKPIQSPAM

SEQ ID NO: 339603 - protein, 9 aa, Homo Sapiens
YHSAVLLIG

SEQ ID NO: 339604 - protein, 9 aa, Homo Sapiens
VWSEPSQCL

SEQ ID NO: 339605 - protein, 9 aa, Homo Sapiens
CFENVLISS

SEQ ID NO: 339606 - protein, 9 aa, Homo Sapiens
DPPVFPHSS

SEQ ID NO: 339607 - protein, 9 aa, Homo Sapiens
KVVNIPSSF

SEQ ID NO: 339608 - protein, 9 aa, Homo Sapiens
QERLQAITE

SEQ ID NO: 339609 - protein, 9 aa, Homo Sapiens
LVACQRSSK

SEQ ID NO: 339610 - protein, 9 aa, Homo Sapiens
RAAQSLGER

SEQ ID NO: 339611 - protein, 9 aa, Homo Sapiens
SMIDQSNRA

SEQ ID NO: 339612 - protein, 9 aa, Homo Sapiens
QKIILMLTN

SEQ ID NO: 339613 - protein, 9 aa, Homo Sapiens
WELSSIKHS

SEQ ID NO: 339614 - protein, 9 aa, Homo Sapiens
IDQARALIR

SEQ ID NO: 339615 - protein, 9 aa, Homo Sapiens
FMLWHPKLI

SEQ ID NO: 339616 - protein, 9 aa, Homo Sapiens
SKSYDIIVE

SEQ ID NO: 339617 - protein, 9 aa, Homo Sapiens
RHAKKIKYF

SEQ ID NO: 339618 - protein, 9 aa, Homo Sapiens
RKQLEMLSG

SEQ ID NO: 339619 - protein, 9 aa, Homo Sapiens
QSVKVRVYL

SEQ ID NO: 339620 - protein, 9 aa, Homo Sapiens
IQDHGDMTN

SEQ ID NO: 339621 - protein, 9 aa, Homo Sapiens
TEEKPYDTI

SEQ ID NO: 339622 - protein, 9 aa, Homo Sapiens
LHLLENSLM

SEQ ID NO: 339623 - protein, 9 aa, Homo Sapiens
HIQNHTGEK

SEQ ID NO: 339624 - protein, 9 aa, Homo Sapiens
EVPGQTQLL

SEQ ID NO: 339625 - protein, 9 aa, Homo Sapiens
GNCKPDNGK

SEQ ID NO: 339626 - protein, 9 aa, Homo Sapiens
SANSKNKEK

SEQ ID NO: 339627 - protein, 9 aa, Homo Sapiens
KLCSTVAND

SEQ ID NO: 339628 - protein, 9 aa, Homo Sapiens
NSQGERLME

SEQ ID NO: 339629 - protein, 9 aa, Homo Sapiens
PLKREKNIL

SEQ ID NO: 339630 - protein, 9 aa, Homo Sapiens
RPFKCKDCG

SEQ ID NO: 339631 - protein, 9 aa, Homo Sapiens
LTALKTPTC

SEQ ID NO: 339632 - protein, 9 aa, Homo Sapiens
LRWADNPCV

SEQ ID NO: 339633 - protein, 9 aa, Homo Sapiens
HVRTRGTLE

SEQ ID NO: 339634 - protein, 9 aa, Homo Sapiens
NKEYCLLDS

SEQ ID NO: 339635 - protein, 9 aa, Homo Sapiens
QWIDRIHTP

SEQ ID NO: 339636 - protein, 9 aa, Homo Sapiens
GGLCTVLDQ

SEQ ID NO: 339637 - protein, 9 aa, Homo Sapiens
VEEVTQNAE

SEQ ID NO: 339638 - protein, 9 aa, Homo Sapiens
LFGQMPGSG

SEQ ID NO: 339639 - protein, 9 aa, Homo Sapiens
DCSNLEGAY

SEQ ID NO: 339640 - protein, 9 aa, Homo Sapiens
QKSPDLKTL

SEQ ID NO: 339641 - protein, 9 aa, Homo Sapiens
ECCECGKTF

SEQ ID NO: 339642 - protein, 9 aa, Homo Sapiens
VILQWKPNP

SEQ ID NO: 339643 - protein, 9 aa, Homo Sapiens
VQNRMGALL

SEQ ID NO: 339644 - protein, 9 aa, Homo Sapiens
DFRWMTARR

SEQ ID NO: 339645 - protein, 9 aa, Homo Sapiens
PVALDKHII

SEQ ID NO: 339646 - protein, 9 aa, Homo Sapiens
EKLKYIKTY

SEQ ID NO: 339647 - protein, 9 aa, Homo Sapiens
ARSLLSLVA

SEQ ID NO: 339648 - protein, 9 aa, Homo Sapiens
AADQKRCSA

SEQ ID NO: 339649 - protein, 9 aa, Homo Sapiens
ARQGVYKNF

SEQ ID NO: 339650 - protein, 9 aa, Homo Sapiens
PPVLTTAKT

SEQ ID NO: 339651 - protein, 9 aa, Homo Sapiens
AGKRSPRRG

SEQ ID NO: 339652 - protein, 9 aa, Homo Sapiens
CLFFNHGEA

SEQ ID NO: 339653 - protein, 9 aa, Homo Sapiens
DLAKWKDRQ

SEQ ID NO: 339654 - protein, 9 aa, Homo Sapiens
SSSAKQKIP

SEQ ID NO: 339655 - protein, 9 aa, Homo Sapiens
SLPVTAASS

SEQ ID NO: 339656 - protein, 9 aa, Homo Sapiens
TILSIVGLF

SEQ ID NO: 339657 - protein, 9 aa, Homo Sapiens
MNKLGHNKL

SEQ ID NO: 339658 - protein, 9 aa, Homo Sapiens
LSKNITQVY

SEQ ID NO: 339659 - protein, 9 aa, Homo Sapiens
RVSNVLIFS

SEQ ID NO: 339660 - protein, 9 aa, Homo Sapiens
KQFGAQVHQ

SEQ ID NO: 339661 - protein, 9 aa, Homo Sapiens
NQIQKELER

SEQ ID NO: 339662 - protein, 9 aa, Homo Sapiens
QLSYSILES

SEQ ID NO: 339663 - protein, 9 aa, Homo Sapiens
SNKCVQAAR

SEQ ID NO: 339664 - protein, 9 aa, Homo Sapiens
STMETEEEP

SEQ ID NO: 339665 - protein, 9 aa, Homo Sapiens
LIKVRDKDY

SEQ ID NO: 339666 - protein, 9 aa, Homo Sapiens
KSEKCSSKK

SEQ ID NO: 339667 - protein, 9 aa, Homo Sapiens
PALVLAPVP

SEQ ID NO: 339668 - protein, 9 aa, Homo Sapiens
PAQLEGLNN

SEQ ID NO: 339669 - protein, 9 aa, Homo Sapiens
ASDDEEDAS

SEQ ID NO: 339670 - protein, 9 aa, Homo Sapiens
IIHAGEKPF

SEQ ID NO: 339671 - protein, 9 aa, Homo Sapiens
GRELSVSDD

SEQ ID NO: 339672 - protein, 9 aa, Homo Sapiens
TLFQQSECR

SEQ ID NO: 339673 - protein, 9 aa, Homo Sapiens
GAMDLKNLQ

SEQ ID NO: 339674 - protein, 9 aa, Homo Sapiens
KKAYEKSKE

SEQ ID NO: 339675 - protein, 9 aa, Homo Sapiens
LKNKTSDDE

SEQ ID NO: 339676 - protein, 9 aa, Homo Sapiens
QENEDLAHE

SEQ ID NO: 339677 - protein, 9 aa, Homo Sapiens
VHRQTHTGE

SEQ ID NO: 339678 - protein, 9 aa, Homo Sapiens
GIYKLSLCK

SEQ ID NO: 339679 - protein, 9 aa, Homo Sapiens
YGGINTLKE

SEQ ID NO: 339680 - protein, 9 aa, Homo Sapiens
DKSKTQFVC

SEQ ID NO: 339681 - protein, 9 aa, Homo Sapiens
IVAGYPPDT

SEQ ID NO: 339682 - protein, 9 aa, Homo Sapiens
DPESLPFCQ

SEQ ID NO: 339683 - protein, 9 aa, Homo Sapiens
KELTRDFLP

SEQ ID NO: 339684 - protein, 9 aa, Homo Sapiens
ILTGEDWNL

SEQ ID NO: 339685 - protein, 9 aa, Homo Sapiens
ILEQITSSN

SEQ ID NO: 339686 - protein, 9 aa, Homo Sapiens
APAMTMTAS

SEQ ID NO: 339687 - protein, 9 aa, Homo Sapiens
NLEIGMYAL

SEQ ID NO: 339688 - protein, 9 aa, Homo Sapiens
IVLDQFVQL

SEQ ID NO: 339689 - protein, 9 aa, Homo Sapiens
KCLHNNERQ

SEQ ID NO: 339690 - protein, 9 aa, Homo Sapiens
LISFNQTTN

SEQ ID NO: 339691 - protein, 9 aa, Homo Sapiens
RKEEDYQNR

SEQ ID NO: 339692 - protein, 9 aa, Homo Sapiens
SIMDVLSAD

SEQ ID NO: 339693 - protein, 9 aa, Homo Sapiens
HLYWDDLKR

SEQ ID NO: 339694 - protein, 9 aa, Homo Sapiens
GSLFHEQSN

SEQ ID NO: 339695 - protein, 9 aa, Homo Sapiens
ETFLLMLQS

SEQ ID NO: 339696 - protein, 9 aa, Homo Sapiens
HFYLSFENS

SEQ ID NO: 339697 - protein, 9 aa, Homo Sapiens
KAISKKVEE

SEQ ID NO: 339698 - protein, 9 aa, Homo Sapiens
PTCVPVSIG

SEQ ID NO: 339699 - protein, 9 aa, Homo Sapiens
ASRRKQCYW

SEQ ID NO: 339700 - protein, 9 aa, Homo Sapiens
LAPGVDTSP

SEQ ID NO: 339701 - protein, 9 aa, Homo Sapiens
HHDIVQFLV

SEQ ID NO: 339702 - protein, 9 aa, Homo Sapiens
TDIMAELES

SEQ ID NO: 339703 - protein, 9 aa, Homo Sapiens
SLISPLQRI

SEQ ID NO: 339704 - protein, 9 aa, Homo Sapiens
DECLMRLTK

SEQ ID NO: 339705 - protein, 9 aa, Homo Sapiens
EHIQEIQTL

SEQ ID NO: 339706 - protein, 9 aa, Homo Sapiens
ITLAVLRIS

SEQ ID NO: 339707 - protein, 9 aa, Homo Sapiens
RTVDLCQKV

SEQ ID NO: 339708 - protein, 9 aa, Homo Sapiens
TRVFVVVIT

SEQ ID NO: 339709 - protein, 9 aa, Homo Sapiens
GICGQAYPV

SEQ ID NO: 339710 - protein, 9 aa, Homo Sapiens
CNFGFARTL

SEQ ID NO: 339711 - protein, 9 aa, Homo Sapiens
DDTLSYTVR

SEQ ID NO: 339712 - protein, 9 aa, Homo Sapiens
KQQCIATAD

SEQ ID NO: 339713 - protein, 9 aa, Homo Sapiens
DRAIASRQE

SEQ ID NO: 339714 - protein, 9 aa, Homo Sapiens
AHTKKAVSR

SEQ ID NO: 339715 - protein, 9 aa, Homo Sapiens
SVPVEIDGT

SEQ ID NO: 339716 - protein, 9 aa, Homo Sapiens
GFNTVTTCV

SEQ ID NO: 339717 - protein, 9 aa, Homo Sapiens
KEAWDNHRL

SEQ ID NO: 339718 - protein, 9 aa, Homo Sapiens
NKALKKICV

SEQ ID NO: 339719 - protein, 9 aa, Homo Sapiens
AKEIGQIIR

SEQ ID NO: 339720 - protein, 9 aa, Homo Sapiens
MYLLPYTKF

SEQ ID NO: 339721 - protein, 9 aa, Homo Sapiens
PMVEIPPTD

SEQ ID NO: 339722 - protein, 9 aa, Homo Sapiens
RISIPPSPL

SEQ ID NO: 339723 - protein, 9 aa, Homo Sapiens
YHQNGCISI

SEQ ID NO: 339724 - protein, 9 aa, Homo Sapiens
LRDSLWNRM

SEQ ID NO: 339725 - protein, 9 aa, Homo Sapiens
TRHSEKSQI

SEQ ID NO: 339726 - protein, 9 aa, Homo Sapiens
VLLPSKWSK

SEQ ID NO: 339727 - protein, 9 aa, Homo Sapiens
SQGQFSVQM

SEQ ID NO: 339728 - protein, 9 aa, Homo Sapiens
DSANADLII

SEQ ID NO: 339729 - protein, 9 aa, Homo Sapiens
INHCGIASA

SEQ ID NO: 339730 - protein, 9 aa, Homo Sapiens
IIIVIFPIF

SEQ ID NO: 339731 - protein, 9 aa, Homo Sapiens
SKSPSWYKY

SEQ ID NO: 339732 - protein, 9 aa, Homo Sapiens
WEFSMESSN

SEQ ID NO: 339733 - protein, 9 aa, Homo Sapiens
VAPSVIHYI

SEQ ID NO: 339734 - protein, 9 aa, Homo Sapiens
RKSCQQQNT

SEQ ID NO: 339735 - protein, 9 aa, Homo Sapiens
FHFKYVHYY

SEQ ID NO: 339736 - protein, 9 aa, Homo Sapiens
TKKDKAFYH

SEQ ID NO: 339737 - protein, 9 aa, Homo Sapiens
QGPTKMTTE

SEQ ID NO: 339738 - protein, 9 aa, Homo Sapiens
PATSTDITV

SEQ ID NO: 339739 - protein, 9 aa, Homo Sapiens
LCSTVANDV

SEQ ID NO: 339740 - protein, 9 aa, Homo Sapiens
IGAVWGVKC

SEQ ID NO: 339741 - protein, 9 aa, Homo Sapiens
LGEIYDFDS

SEQ ID NO: 339742 - protein, 9 aa, Homo Sapiens
LTVEEINLL

SEQ ID NO: 339743 - protein, 9 aa, Homo Sapiens
ESESWSVKV

SEQ ID NO: 339744 - protein, 9 aa, Homo Sapiens
FMCLTDQSY

SEQ ID NO: 339745 - protein, 9 aa, Homo Sapiens
RPHNYFCKC

SEQ ID NO: 339746 - protein, 9 aa, Homo Sapiens
TQHFTNRLD

SEQ ID NO: 339747 - protein, 9 aa, Homo Sapiens
ILEALHYCH

SEQ ID NO: 339748 - protein, 9 aa, Homo Sapiens
PISLFAISA

SEQ ID NO: 339749 - protein, 9 aa, Homo Sapiens
FVGVSQVMA

SEQ ID NO: 339750 - protein, 9 aa, Homo Sapiens
KCIQAKIQD

SEQ ID NO: 339751 - protein, 9 aa, Homo Sapiens
QYNKIAIPN

SEQ ID NO: 339752 - protein, 9 aa, Homo Sapiens
AKYFPVFSL

SEQ ID NO: 339753 - protein, 9 aa, Homo Sapiens
SPENNKEGG

SEQ ID NO: 339754 - protein, 9 aa, Homo Sapiens
IIANVRVQN

SEQ ID NO: 339755 - protein, 9 aa, Homo Sapiens
DCCKKVQDW

SEQ ID NO: 339756 - protein, 9 aa, Homo Sapiens
HSPPSNVAC

SEQ ID NO: 339757 - protein, 9 aa, Homo Sapiens
PRGSKDINK

SEQ ID NO: 339758 - protein, 9 aa, Homo Sapiens
SHICLWVLQ

SEQ ID NO: 339759 - protein, 9 aa, Homo Sapiens
EESIWKKAV

SEQ ID NO: 339760 - protein, 9 aa, Homo Sapiens
VLVKMYKAK

SEQ ID NO: 339761 - protein, 9 aa, Homo Sapiens
KGDVDVYLP

SEQ ID NO: 339762 - protein, 9 aa, Homo Sapiens
RDFPFQDNI

SEQ ID NO: 339763 - protein, 9 aa, Homo Sapiens
AKHQDSGAL

SEQ ID NO: 339764 - protein, 9 aa, Homo Sapiens
FHCNSCPFI

SEQ ID NO: 339765 - protein, 9 aa, Homo Sapiens
ENEECTMID

SEQ ID NO: 339766 - protein, 9 aa, Homo Sapiens
GHGMKQKQK

SEQ ID NO: 339767 - protein, 9 aa, Homo Sapiens
KVLDQVLYQ

SEQ ID NO: 339768 - protein, 9 aa, Homo Sapiens
GRGHKQQNV

SEQ ID NO: 339769 - protein, 9 aa, Homo Sapiens
DLEEFQEAI

SEQ ID NO: 339770 - protein, 9 aa, Homo Sapiens
LDMDRIKKD

SEQ ID NO: 339771 - protein, 9 aa, Homo Sapiens
EWTFIDFDM

SEQ ID NO: 339772 - protein, 9 aa, Homo Sapiens
TPDVYKSPL

SEQ ID NO: 339773 - protein, 9 aa, Homo Sapiens
SCGLDYCPY

SEQ ID NO: 339774 - protein, 9 aa, Homo Sapiens
LAICRMHSA

SEQ ID NO: 339775 - protein, 9 aa, Homo Sapiens
NATQRIQEI

SEQ ID NO: 339776 - protein, 9 aa, Homo Sapiens
IMYTRANSC

SEQ ID NO: 339777 - protein, 9 aa, Homo Sapiens
DGLQLAVDV

SEQ ID NO: 339778 - protein, 9 aa, Homo Sapiens
RKGKKRNEH

SEQ ID NO: 339779 - protein, 9 aa, Homo Sapiens
QHGSSRKSS

SEQ ID NO: 339780 - protein, 9 aa, Homo Sapiens
RILRAVVIA

SEQ ID NO: 339781 - protein, 9 aa, Homo Sapiens
PKTLKTLTF

SEQ ID NO: 339782 - protein, 9 aa, Homo Sapiens
FESLLSDPG

SEQ ID NO: 339783 - protein, 9 aa, Homo Sapiens
DDSITIYIA

SEQ ID NO: 339784 - protein, 9 aa, Homo Sapiens
RFEPLTLSH

SEQ ID NO: 339785 - protein, 9 aa, Homo Sapiens
DLMNRSLHV

SEQ ID NO: 339786 - protein, 9 aa, Homo Sapiens
SPMEKDIMP

SEQ ID NO: 339787 - protein, 9 aa, Homo Sapiens
KNVYAFNLF

SEQ ID NO: 339788 - protein, 9 aa, Homo Sapiens
LMGWLHSKI

SEQ ID NO: 339789 - protein, 9 aa, Homo Sapiens
GCPCKGTLR

SEQ ID NO: 339790 - protein, 9 aa, Homo Sapiens
NPVLAVVTC

SEQ ID NO: 339791 - protein, 9 aa, Homo Sapiens
ASCRDRLSR

SEQ ID NO: 339792 - protein, 9 aa, Homo Sapiens
ATKQFLKEI

SEQ ID NO: 339793 - protein, 9 aa, Homo Sapiens
CPNNSIFCS

SEQ ID NO: 339794 - protein, 9 aa, Homo Sapiens
QAKLAHLAG

SEQ ID NO: 339795 - protein, 9 aa, Homo Sapiens
AKQELEQQR

SEQ ID NO: 339796 - protein, 9 aa, Homo Sapiens
NPDYVKKGD

SEQ ID NO: 339797 - protein, 9 aa, Homo Sapiens
HPMEGTISW

SEQ ID NO: 339798 - protein, 9 aa, Homo Sapiens
SFVTQPSNT

SEQ ID NO: 339799 - protein, 9 aa, Homo Sapiens
LDHGNTLHK

SEQ ID NO: 339800 - protein, 9 aa, Homo Sapiens
DALRMRMYS

SEQ ID NO: 339801 - protein, 9 aa, Homo Sapiens
SKACDTKVL

SEQ ID NO: 339802 - protein, 9 aa, Homo Sapiens
YQWYLDLCR

SEQ ID NO: 339803 - protein, 9 aa, Homo Sapiens
SHVSSLSLC

SEQ ID NO: 339804 - protein, 9 aa, Homo Sapiens
DKVFTVSNI

SEQ ID NO: 339805 - protein, 9 aa, Homo Sapiens
ILGVVATPG

SEQ ID NO: 339806 - protein, 9 aa, Homo Sapiens
PEERYDTPK

SEQ ID NO: 339807 - protein, 9 aa, Homo Sapiens
PQTLFEIVV

SEQ ID NO: 339808 - protein, 9 aa, Homo Sapiens
IDGLVLQID

SEQ ID NO: 339809 - protein, 9 aa, Homo Sapiens
SKDNSTASE

SEQ ID NO: 339810 - protein, 9 aa, Homo Sapiens
TGIIYPHNK

SEQ ID NO: 339811 - protein, 9 aa, Homo Sapiens
DGNTVKLLT

SEQ ID NO: 339812 - protein, 9 aa, Homo Sapiens
KSVPDVVQN

SEQ ID NO: 339813 - protein, 9 aa, Homo Sapiens
DLEYSPSAY

SEQ ID NO: 339814 - protein, 9 aa, Homo Sapiens
CSHCQKNLS

SEQ ID NO: 339815 - protein, 9 aa, Homo Sapiens
RSPPVAFTE

SEQ ID NO: 339816 - protein, 9 aa, Homo Sapiens
SRIKPMDDH

SEQ ID NO: 339817 - protein, 9 aa, Homo Sapiens
PADPQCIPS

SEQ ID NO: 339818 - protein, 9 aa, Homo Sapiens
NVQPDNVIE

SEQ ID NO: 339819 - protein, 9 aa, Homo Sapiens
PKVKCLHNN

SEQ ID NO: 339820 - protein, 9 aa, Homo Sapiens
PVVRRPDQK

SEQ ID NO: 339821 - protein, 9 aa, Homo Sapiens
NATEDVSTG

SEQ ID NO: 339822 - protein, 9 aa, Homo Sapiens
DNAHYAVQA

SEQ ID NO: 339823 - protein, 9 aa, Homo Sapiens
EDLPFTKGE

SEQ ID NO: 339824 - protein, 9 aa, Homo Sapiens
ALEEARNIF

SEQ ID NO: 339825 - protein, 9 aa, Homo Sapiens
PIQDGLRNA

SEQ ID NO: 339826 - protein, 9 aa, Homo Sapiens
AGFTAWITE

SEQ ID NO: 339827 - protein, 9 aa, Homo Sapiens
CEYLASALI

SEQ ID NO: 339828 - protein, 9 aa, Homo Sapiens
KPVNNALDL

SEQ ID NO: 339829 - protein, 9 aa, Homo Sapiens
VDQGIFKEL

SEQ ID NO: 339830 - protein, 9 aa, Homo Sapiens
GTLVQAEAS

SEQ ID NO: 339831 - protein, 9 aa, Homo Sapiens
PNRMPSRSL

SEQ ID NO: 339832 - protein, 9 aa, Homo Sapiens
DVMASSHFV

SEQ ID NO: 339833 - protein, 9 aa, Homo Sapiens
PAAPVTGHT

SEQ ID NO: 339834 - protein, 9 aa, Homo Sapiens
IAKNERRYS

SEQ ID NO: 339835 - protein, 9 aa, Homo Sapiens
RIPKVQSNG

SEQ ID NO: 339836 - protein, 9 aa, Homo Sapiens
GKTFSQNSY

SEQ ID NO: 339837 - protein, 9 aa, Homo Sapiens
MRGTADLFA

SEQ ID NO: 339838 - protein, 9 aa, Homo Sapiens
LMDYSHQSG

SEQ ID NO: 339839 - protein, 9 aa, Homo Sapiens
ESFALHSSE

SEQ ID NO: 339840 - protein, 9 aa, Homo Sapiens
VVQERVDVQ

SEQ ID NO: 339841 - protein, 9 aa, Homo Sapiens
ATRLVQTAQ

SEQ ID NO: 339842 - protein, 9 aa, Homo Sapiens
NSRVRLQTI

SEQ ID NO: 339843 - protein, 9 aa, Homo Sapiens
ELPKPTPLT

SEQ ID NO: 339844 - protein, 9 aa, Homo Sapiens
FLQVKSVIS

SEQ ID NO: 339845 - protein, 9 aa, Homo Sapiens
QLEENEECT

SEQ ID NO: 339846 - protein, 9 aa, Homo Sapiens
IEYNSTRDL

SEQ ID NO: 339847 - protein, 9 aa, Homo Sapiens
KQQREEELK

SEQ ID NO: 339848 - protein, 9 aa, Homo Sapiens
EHLNHNPYP

SEQ ID NO: 339849 - protein, 9 aa, Homo Sapiens
VCCISVDRY

SEQ ID NO: 339850 - protein, 9 aa, Homo Sapiens
IYLFATYVL

SEQ ID NO: 339851 - protein, 9 aa, Homo Sapiens
CPKDVVYPE

SEQ ID NO: 339852 - protein, 9 aa, Homo Sapiens
GPRESQDLL

SEQ ID NO: 339853 - protein, 9 aa, Homo Sapiens
GAVAGARSK

SEQ ID NO: 339854 - protein, 9 aa, Homo Sapiens
MKPFKSNHP

SEQ ID NO: 339855 - protein, 9 aa, Homo Sapiens
SLKEEERFI

SEQ ID NO: 339856 - protein, 9 aa, Homo Sapiens
YNRLAWIVV

SEQ ID NO: 339857 - protein, 9 aa, Homo Sapiens
SQSINFQSV

SEQ ID NO: 339858 - protein, 9 aa, Homo Sapiens
DGNESEFEE

SEQ ID NO: 339859 - protein, 9 aa, Homo Sapiens
CKWFNVCMG

SEQ ID NO: 339860 - protein, 9 aa, Homo Sapiens
EKELQKEKK

SEQ ID NO: 339861 - protein, 9 aa, Homo Sapiens
NNIVLLPDP

SEQ ID NO: 339862 - protein, 9 aa, Homo Sapiens
MQLFQTFWC

SEQ ID NO: 339863 - protein, 9 aa, Homo Sapiens
EGGLAISKG

SEQ ID NO: 339864 - protein, 9 aa, Homo Sapiens
ELWQRLNNL

SEQ ID NO: 339865 - protein, 9 aa, Homo Sapiens
FKLARQTYP

SEQ ID NO: 339866 - protein, 9 aa, Homo Sapiens
GYGCNINEK

SEQ ID NO: 339867 - protein, 9 aa, Homo Sapiens
EKEEASHIE

SEQ ID NO: 339868 - protein, 9 aa, Homo Sapiens
SNLTTHKIL

SEQ ID NO: 339869 - protein, 9 aa, Homo Sapiens
GNTSQRGKS

SEQ ID NO: 339870 - protein, 9 aa, Homo Sapiens
SVKAYIFKE

SEQ ID NO: 339871 - protein, 9 aa, Homo Sapiens
NWSNIRQLL

SEQ ID NO: 339872 - protein, 9 aa, Homo Sapiens
YPEAEGLNS

SEQ ID NO: 339873 - protein, 9 aa, Homo Sapiens
EGILCELKE

SEQ ID NO: 339874 - protein, 9 aa, Homo Sapiens
KTLIEMYTT

SEQ ID NO: 339875 - protein, 9 aa, Homo Sapiens
KWLIMSFSG

SEQ ID NO: 339876 - protein, 9 aa, Homo Sapiens
TLSRADREK

SEQ ID NO: 339877 - protein, 9 aa, Homo Sapiens
TCTACKNQV

SEQ ID NO: 339878 - protein, 9 aa, Homo Sapiens
QYDLKTAGP

SEQ ID NO: 339879 - protein, 9 aa, Homo Sapiens
LPEGAGRFH

SEQ ID NO: 339880 - protein, 9 aa, Homo Sapiens
KGPLTKGIS

SEQ ID NO: 339881 - protein, 9 aa, Homo Sapiens
YLLFKDDFI

SEQ ID NO: 339882 - protein, 9 aa, Homo Sapiens
VWQSARRKR

SEQ ID NO: 339883 - protein, 9 aa, Homo Sapiens
NTNGQLMAN

SEQ ID NO: 339884 - protein, 9 aa, Homo Sapiens
TSQVIHNAD

SEQ ID NO: 339885 - protein, 9 aa, Homo Sapiens
TCVPWNLHE

SEQ ID NO: 339886 - protein, 9 aa, Homo Sapiens
EFVQRLELG

SEQ ID NO: 339887 - protein, 9 aa, Homo Sapiens
LRHTKMKTT

SEQ ID NO: 339888 - protein, 9 aa, Homo Sapiens
TVFLLLKDN

SEQ ID NO: 339889 - protein, 9 aa, Homo Sapiens
EIYSICSRR

SEQ ID NO: 339890 - protein, 9 aa, Homo Sapiens
LSFVTQPSN

SEQ ID NO: 339891 - protein, 9 aa, Homo Sapiens
LYFLLYNYD

SEQ ID NO: 339892 - protein, 9 aa, Homo Sapiens
LGLHQDSAT

SEQ ID NO: 339893 - protein, 9 aa, Homo Sapiens
LFQTFWCLY

SEQ ID NO: 339894 - protein, 9 aa, Homo Sapiens
LSEHQITHI

SEQ ID NO: 339895 - protein, 9 aa, Homo Sapiens
NIKLFDKLA

SEQ ID NO: 339896 - protein, 9 aa, Homo Sapiens
MKKPAESKN

SEQ ID NO: 339897 - protein, 9 aa, Homo Sapiens
ATLKPEQSF

SEQ ID NO: 339898 - protein, 9 aa, Homo Sapiens
LSLKRLPCD

SEQ ID NO: 339899 - protein, 9 aa, Homo Sapiens
NLQLLPGIT

SEQ ID NO: 339900 - protein, 9 aa, Homo Sapiens
RLIYHQQTH

SEQ ID NO: 339901 - protein, 9 aa, Homo Sapiens
MSVAPGLAD

SEQ ID NO: 339902 - protein, 9 aa, Homo Sapiens
HRTLKASLP

SEQ ID NO: 339903 - protein, 9 aa, Homo Sapiens
ELDAVESRA

SEQ ID NO: 339904 - protein, 9 aa, Homo Sapiens
FFICGPSVE

SEQ ID NO: 339905 - protein, 9 aa, Homo Sapiens
APSPTKLQD

SEQ ID NO: 339906 - protein, 9 aa, Homo Sapiens
YYPYLADRH

SEQ ID NO: 339907 - protein, 9 aa, Homo Sapiens
AGSAEMAAL

SEQ ID NO: 339908 - protein, 9 aa, Homo Sapiens
LHFSPKQQY

SEQ ID NO: 339909 - protein, 9 aa, Homo Sapiens
KEEAQLIEL

SEQ ID NO: 339910 - protein, 9 aa, Homo Sapiens
PHTEFTLKR

SEQ ID NO: 339911 - protein, 9 aa, Homo Sapiens
DPAYPDIAL

SEQ ID NO: 339912 - protein, 9 aa, Homo Sapiens
YDAYCTDLE

SEQ ID NO: 339913 - protein, 9 aa, Homo Sapiens
SVTSRPKPE

SEQ ID NO: 339914 - protein, 9 aa, Homo Sapiens
ASPHSKAIS

SEQ ID NO: 339915 - protein, 9 aa, Homo Sapiens
PVILMGCSR

SEQ ID NO: 339916 - protein, 9 aa, Homo Sapiens
AREKLALYI

SEQ ID NO: 339917 - protein, 9 aa, Homo Sapiens
NLNLRKQAT

SEQ ID NO: 339918 - protein, 9 aa, Homo Sapiens
FMANTFLAS

SEQ ID NO: 339919 - protein, 9 aa, Homo Sapiens
VDSRLKKTE

SEQ ID NO: 339920 - protein, 9 aa, Homo Sapiens
QGKSIYFSG

SEQ ID NO: 339921 - protein, 9 aa, Homo Sapiens
KNICEVLDL

SEQ ID NO: 339922 - protein, 9 aa, Homo Sapiens
YSKKDKGKA

SEQ ID NO: 339923 - protein, 9 aa, Homo Sapiens
PAFWWTNRN

SEQ ID NO: 339924 - protein, 9 aa, Homo Sapiens
CELELQVQS

SEQ ID NO: 339925 - protein, 9 aa, Homo Sapiens
RILVLEKVN

SEQ ID NO: 339926 - protein, 9 aa, Homo Sapiens
INDITEGIN

SEQ ID NO: 339927 - protein, 9 aa, Homo Sapiens
SRLKKTEFK

SEQ ID NO: 339928 - protein, 9 aa, Homo Sapiens
LKQQNLHNC

SEQ ID NO: 339929 - protein, 9 aa, Homo Sapiens
GYTKQLFQF

SEQ ID NO: 339930 - protein, 9 aa, Homo Sapiens
EKPCSSNTL

SEQ ID NO: 339931 - protein, 9 aa, Homo Sapiens
NITQVYKVC

SEQ ID NO: 339932 - protein, 9 aa, Homo Sapiens
KIAEDPGTC

SEQ ID NO: 339933 - protein, 9 aa, Homo Sapiens
QNFLQNVKG

SEQ ID NO: 339934 - protein, 9 aa, Homo Sapiens
CIAIPKKKI

SEQ ID NO: 339935 - protein, 9 aa, Homo Sapiens
PSALALCCM

SEQ ID NO: 339936 - protein, 9 aa, Homo Sapiens
IYQPRFHVV

SEQ ID NO: 339937 - protein, 9 aa, Homo Sapiens
LARIYIQRT

SEQ ID NO: 339938 - protein, 9 aa, Homo Sapiens
GHPRGQPPV

SEQ ID NO: 339939 - protein, 9 aa, Homo Sapiens
AINLESQYL

SEQ ID NO: 339940 - protein, 9 aa, Homo Sapiens
HVRLEHLHI

SEQ ID NO: 339941 - protein, 9 aa, Homo Sapiens
PLPLKLENY

SEQ ID NO: 339942 - protein, 9 aa, Homo Sapiens
SAPGLVLTC

SEQ ID NO: 339943 - protein, 9 aa, Homo Sapiens
LAIVEQSWN

SEQ ID NO: 339944 - protein, 9 aa, Homo Sapiens
DKIHQSKNK

SEQ ID NO: 339945 - protein, 9 aa, Homo Sapiens
LQELCHMES

SEQ ID NO: 339946 - protein, 9 aa, Homo Sapiens
FHSRLRFNW

SEQ ID NO: 339947 - protein, 9 aa, Homo Sapiens
VFTVINQTQ

SEQ ID NO: 339948 - protein, 9 aa, Homo Sapiens
RGPLGQHEV

SEQ ID NO: 339949 - protein, 9 aa, Homo Sapiens
RSLDEEKEK

SEQ ID NO: 339950 - protein, 9 aa, Homo Sapiens
ISEEDIQTV

SEQ ID NO: 339951 - protein, 9 aa, Homo Sapiens
AEGRTKAYL

SEQ ID NO: 339952 - protein, 9 aa, Homo Sapiens
FWKINYKGE

SEQ ID NO: 339953 - protein, 9 aa, Homo Sapiens
CFWKLYIQR

SEQ ID NO: 339954 - protein, 9 aa, Homo Sapiens
TKNNLKKFL

SEQ ID NO: 339955 - protein, 9 aa, Homo Sapiens
GYFQELLQK

SEQ ID NO: 339956 - protein, 9 aa, Homo Sapiens
PEEAQSDMH

SEQ ID NO: 339957 - protein, 9 aa, Homo Sapiens
GVSLECQNL

SEQ ID NO: 339958 - protein, 9 aa, Homo Sapiens
ISKEEREAE

SEQ ID NO: 339959 - protein, 9 aa, Homo Sapiens
RPEDDILHQ

SEQ ID NO: 339960 - protein, 9 aa, Homo Sapiens
QVQTGNIRE

SEQ ID NO: 339961 - protein, 9 aa, Homo Sapiens
FRGLSLNDD

SEQ ID NO: 339962 - protein, 9 aa, Homo Sapiens
PPGGRTNIT

SEQ ID NO: 339963 - protein, 9 aa, Homo Sapiens
HQITHIGEK

SEQ ID NO: 339964 - protein, 9 aa, Homo Sapiens
VSQASLGFK

SEQ ID NO: 339965 - protein, 9 aa, Homo Sapiens
ITLWLVYLW

SEQ ID NO: 339966 - protein, 9 aa, Homo Sapiens
LDFDEMTFG

SEQ ID NO: 339967 - protein, 9 aa, Homo Sapiens
TAFDWICKE

SEQ ID NO: 339968 - protein, 9 aa, Homo Sapiens
NVVMCRHPL

SEQ ID NO: 339969 - protein, 9 aa, Homo Sapiens
HETIHTGKK

SEQ ID NO: 339970 - protein, 9 aa, Homo Sapiens
AISKGFWGT

SEQ ID NO: 339971 - protein, 9 aa, Homo Sapiens
QIRVPPVPP

SEQ ID NO: 339972 - protein, 9 aa, Homo Sapiens
GKKAATTPA

SEQ ID NO: 339973 - protein, 9 aa, Homo Sapiens
QVHEKIHTG

SEQ ID NO: 339974 - protein, 9 aa, Homo Sapiens
EDDSEVNVN

SEQ ID NO: 339975 - protein, 9 aa, Homo Sapiens
PAENLSAPE

SEQ ID NO: 339976 - protein, 9 aa, Homo Sapiens
TSFQQLSSL

SEQ ID NO: 339977 - protein, 9 aa, Homo Sapiens
QWKEYMHRR

SEQ ID NO: 339978 - protein, 9 aa, Homo Sapiens
KDIMPDPKL

SEQ ID NO: 339979 - protein, 9 aa, Homo Sapiens
EWGLWWQSQ

SEQ ID NO: 339980 - protein, 9 aa, Homo Sapiens
IPEGIQIDL

SEQ ID NO: 339981 - protein, 9 aa, Homo Sapiens
LLVNVVFDV

SEQ ID NO: 339982 - protein, 9 aa, Homo Sapiens
TWVTPCSLI

SEQ ID NO: 339983 - protein, 9 aa, Homo Sapiens
PQENVIRQN

SEQ ID NO: 339984 - protein, 9 aa, Homo Sapiens
KEKGLALGL

SEQ ID NO: 339985 - protein, 9 aa, Homo Sapiens
PATFNELVT

SEQ ID NO: 339986 - protein, 9 aa, Homo Sapiens
KHIVAEGEH

SEQ ID NO: 339987 - protein, 9 aa, Homo Sapiens
YFDNTCVVP

SEQ ID NO: 339988 - protein, 9 aa, Homo Sapiens
QKILDKCND

SEQ ID NO: 339989 - protein, 9 aa, Homo Sapiens
LNDTELICY

SEQ ID NO: 339990 - protein, 9 aa, Homo Sapiens
HLNHNPYPS

SEQ ID NO: 339991 - protein, 9 aa, Homo Sapiens
EAHSDYICC

SEQ ID NO: 339992 - protein, 9 aa, Homo Sapiens
CYNVLDQNV

SEQ ID NO: 339993 - protein, 9 aa, Homo Sapiens
EFDKFLEEI

SEQ ID NO: 339994 - protein, 9 aa, Homo Sapiens
ASGQTVDDF

SEQ ID NO: 339995 - protein, 9 aa, Homo Sapiens
YLYAKNENT

SEQ ID NO: 339996 - protein, 9 aa, Homo Sapiens
QPIQDVQRE

SEQ ID NO: 339997 - protein, 9 aa, Homo Sapiens
KRSPRRGEI

SEQ ID NO: 339998 - protein, 9 aa, Homo Sapiens
LQEPHDKHR

SEQ ID NO: 339999 - protein, 9 aa, Homo Sapiens
VSGGELFDH

SEQ ID NO: 340000 - protein, 9 aa, Homo Sapiens
LRIRVVFQI

SEQ ID NO: 340001 - protein, 9 aa, Homo Sapiens
ARASTKKKS

SEQ ID NO: 340002 - protein, 9 aa, Homo Sapiens
STEACVDYM

SEQ ID NO: 340003 - protein, 9 aa, Homo Sapiens
LRRTHQKCV

SEQ ID NO: 340004 - protein, 9 aa, Homo Sapiens
RIGLADYTL

SEQ ID NO: 340005 - protein, 9 aa, Homo Sapiens
GLIYSFLTL

SEQ ID NO: 340006 - protein, 9 aa, Homo Sapiens
ISIPPSPLT

SEQ ID NO: 340007 - protein, 9 aa, Homo Sapiens
SMLSFMLDN

SEQ ID NO: 340008 - protein, 9 aa, Homo Sapiens
YPTKRNKFH

SEQ ID NO: 340009 - protein, 9 aa, Homo Sapiens
GGRRRKQSG

SEQ ID NO: 340010 - protein, 9 aa, Homo Sapiens
LHMRNHTGE

SEQ ID NO: 340011 - protein, 9 aa, Homo Sapiens
VIALKMLVN

SEQ ID NO: 340012 - protein, 9 aa, Homo Sapiens
CRFEPLTLS

SEQ ID NO: 340013 - protein, 9 aa, Homo Sapiens
YTEALGVKN

SEQ ID NO: 340014 - protein, 9 aa, Homo Sapiens
KETLAIVCW

SEQ ID NO: 340015 - protein, 9 aa, Homo Sapiens
SPSLSFYPA

SEQ ID NO: 340016 - protein, 9 aa, Homo Sapiens
AALFDRKWL

SEQ ID NO: 340017 - protein, 9 aa, Homo Sapiens
SGFEPPSWR

SEQ ID NO: 340018 - protein, 9 aa, Homo Sapiens
QQSECREVL

SEQ ID NO: 340019 - protein, 9 aa, Homo Sapiens
CPIFVFDGD

SEQ ID NO: 340020 - protein, 9 aa, Homo Sapiens
PNTVLPPSL

SEQ ID NO: 340021 - protein, 9 aa, Homo Sapiens
IKLNRRICP

SEQ ID NO: 340022 - protein, 9 aa, Homo Sapiens
FRITTHCLA

SEQ ID NO: 340023 - protein, 9 aa, Homo Sapiens
GKIIKVYGD

SEQ ID NO: 340024 - protein, 9 aa, Homo Sapiens
LDMLKQLST

SEQ ID NO: 340025 - protein, 9 aa, Homo Sapiens
AMQHAAELR

SEQ ID NO: 340026 - protein, 9 aa, Homo Sapiens
IFFNVLLPL

SEQ ID NO: 340027 - protein, 9 aa, Homo Sapiens
TTFDGQHYS

SEQ ID NO: 340028 - protein, 9 aa, Homo Sapiens
QCGELIIEG

SEQ ID NO: 340029 - protein, 9 aa, Homo Sapiens
RRICPTKDV

SEQ ID NO: 340030 - protein, 9 aa, Homo Sapiens
DQPVDIGTY

SEQ ID NO: 340031 - protein, 9 aa, Homo Sapiens
QLLKKGYEV

SEQ ID NO: 340032 - protein, 9 aa, Homo Sapiens
NKFGEEIAR

SEQ ID NO: 340033 - protein, 9 aa, Homo Sapiens
NKCIHTSST

SEQ ID NO: 340034 - protein, 9 aa, Homo Sapiens
LCFFQEEMV

SEQ ID NO: 340035 - protein, 9 aa, Homo Sapiens
PCGETGPAG

SEQ ID NO: 340036 - protein, 9 aa, Homo Sapiens
KEWSRRKAE

SEQ ID NO: 340037 - protein, 9 aa, Homo Sapiens
ADQVIEDIE

SEQ ID NO: 340038 - protein, 9 aa, Homo Sapiens
PYRVVEAKT

SEQ ID NO: 340039 - protein, 9 aa, Homo Sapiens
FSIRKDLIQ

SEQ ID NO: 340040 - protein, 9 aa, Homo Sapiens
HDNKFFGDP

SEQ ID NO: 340041 - protein, 9 aa, Homo Sapiens
AVPVNCALY

SEQ ID NO: 340042 - protein, 9 aa, Homo Sapiens
SPDKQPGSP

SEQ ID NO: 340043 - protein, 9 aa, Homo Sapiens
CNQLFVLDV

SEQ ID NO: 340044 - protein, 9 aa, Homo Sapiens
VAGYDISMS

SEQ ID NO: 340045 - protein, 9 aa, Homo Sapiens
KLFRSHKED

SEQ ID NO: 340046 - protein, 9 aa, Homo Sapiens
DRINNDGDG

SEQ ID NO: 340047 - protein, 9 aa, Homo Sapiens
LVCCPECDP

SEQ ID NO: 340048 - protein, 9 aa, Homo Sapiens
IDKKKDFLQ

SEQ ID NO: 340049 - protein, 9 aa, Homo Sapiens
SAASAAGVY

SEQ ID NO: 340050 - protein, 9 aa, Homo Sapiens
KLFVDGQWV

SEQ ID NO: 340051 - protein, 9 aa, Homo Sapiens
KLEAAEERH

SEQ ID NO: 340052 - protein, 9 aa, Homo Sapiens
LGSYTEGNA

SEQ ID NO: 340053 - protein, 9 aa, Homo Sapiens
ASSCSYLHK

SEQ ID NO: 340054 - protein, 9 aa, Homo Sapiens
NTTRFVLKD

SEQ ID NO: 340055 - protein, 9 aa, Homo Sapiens
SSQGNLVYQ

SEQ ID NO: 340056 - protein, 9 aa, Homo Sapiens
GWGTQVFVT

SEQ ID NO: 340057 - protein, 9 aa, Homo Sapiens
VGEGEEEVK

SEQ ID NO: 340058 - protein, 9 aa, Homo Sapiens
SQFRSLQTS

SEQ ID NO: 340059 - protein, 9 aa, Homo Sapiens
KTAFLGPKD

SEQ ID NO: 340060 - protein, 9 aa, Homo Sapiens
PGPQWKKFC

SEQ ID NO: 340061 - protein, 9 aa, Homo Sapiens
PFILAAIVG

SEQ ID NO: 340062 - protein, 9 aa, Homo Sapiens
SRKKQGRKK

SEQ ID NO: 340063 - protein, 9 aa, Homo Sapiens
GCMHTLHIS

SEQ ID NO: 340064 - protein, 9 aa, Homo Sapiens
HGFQKGGEH

SEQ ID NO: 340065 - protein, 9 aa, Homo Sapiens
NNWLNAAIE

SEQ ID NO: 340066 - protein, 9 aa, Homo Sapiens
IAAIADKLD

SEQ ID NO: 340067 - protein, 9 aa, Homo Sapiens
IGLWEVGKG

SEQ ID NO: 340068 - protein, 9 aa, Homo Sapiens
ARFQCGELI

SEQ ID NO: 340069 - protein, 9 aa, Homo Sapiens
SLKENLDKK

SEQ ID NO: 340070 - protein, 9 aa, Homo Sapiens
KNITQVYKV

SEQ ID NO: 340071 - protein, 9 aa, Homo Sapiens
ILVAVFQYG

SEQ ID NO: 340072 - protein, 9 aa, Homo Sapiens
SPTPRDFPK

SEQ ID NO: 340073 - protein, 9 aa, Homo Sapiens
NRSSLLEEN

SEQ ID NO: 340074 - protein, 9 aa, Homo Sapiens
CILMSIVCY

SEQ ID NO: 340075 - protein, 9 aa, Homo Sapiens
HSEALKYLT

SEQ ID NO: 340076 - protein, 9 aa, Homo Sapiens
KIILRKLEL

SEQ ID NO: 340077 - protein, 9 aa, Homo Sapiens
ENAYISALN

SEQ ID NO: 340078 - protein, 9 aa, Homo Sapiens
VTCLQNWEA

SEQ ID NO: 340079 - protein, 9 aa, Homo Sapiens
AIMKHFGWE

SEQ ID NO: 340080 - protein, 9 aa, Homo Sapiens
KFVFSLAAV

SEQ ID NO: 340081 - protein, 9 aa, Homo Sapiens
RIKKRKGGA

SEQ ID NO: 340082 - protein, 9 aa, Homo Sapiens
KCELCHKPQ

SEQ ID NO: 340083 - protein, 9 aa, Homo Sapiens
ESRSGQSFG

SEQ ID NO: 340084 - protein, 9 aa, Homo Sapiens
FNITIMILI

SEQ ID NO: 340085 - protein, 9 aa, Homo Sapiens
LSLGGAIDI

SEQ ID NO: 340086 - protein, 9 aa, Homo Sapiens
ESVEEKQPR

SEQ ID NO: 340087 - protein, 9 aa, Homo Sapiens
TKNRMWRNT

SEQ ID NO: 340088 - protein, 9 aa, Homo Sapiens
DFRNKYQTE

SEQ ID NO: 340089 - protein, 9 aa, Homo Sapiens
KPPQTQKEL

SEQ ID NO: 340090 - protein, 9 aa, Homo Sapiens
HHHLYDIHV

SEQ ID NO: 340091 - protein, 9 aa, Homo Sapiens
GDRIEIGYT

SEQ ID NO: 340092 - protein, 9 aa, Homo Sapiens
EKPAFDCPM

SEQ ID NO: 340093 - protein, 9 aa, Homo Sapiens
DNKFFGDPI

SEQ ID NO: 340094 - protein, 9 aa, Homo Sapiens
RKAGHKALS

SEQ ID NO: 340095 - protein, 9 aa, Homo Sapiens
QGEMLHKKR

SEQ ID NO: 340096 - protein, 9 aa, Homo Sapiens
MCLLPASRF

SEQ ID NO: 340097 - protein, 9 aa, Homo Sapiens
LEEPQTLVT

SEQ ID NO: 340098 - protein, 9 aa, Homo Sapiens
SGMIEAFTK

SEQ ID NO: 340099 - protein, 9 aa, Homo Sapiens
LHNLTLLTL

SEQ ID NO: 340100 - protein, 9 aa, Homo Sapiens
FFYFFFSFS

SEQ ID NO: 340101 - protein, 9 aa, Homo Sapiens
GFFIWVDLI

SEQ ID NO: 340102 - protein, 9 aa, Homo Sapiens
LTHICRADI

SEQ ID NO: 340103 - protein, 9 aa, Homo Sapiens
NKLYVVKQE

SEQ ID NO: 340104 - protein, 9 aa, Homo Sapiens
LVLKRLSDV

SEQ ID NO: 340105 - protein, 9 aa, Homo Sapiens
HMDVAEPYK

SEQ ID NO: 340106 - protein, 9 aa, Homo Sapiens
FGVRIYYVL

SEQ ID NO: 340107 - protein, 9 aa, Homo Sapiens
YDTITQEDI

SEQ ID NO: 340108 - protein, 9 aa, Homo Sapiens
VASLQVPRP

SEQ ID NO: 340109 - protein, 9 aa, Homo Sapiens
PGTETSQAN

SEQ ID NO: 340110 - protein, 9 aa, Homo Sapiens
SEGIKCYLY

SEQ ID NO: 340111 - protein, 9 aa, Homo Sapiens
QLIVQTPST

SEQ ID NO: 340112 - protein, 9 aa, Homo Sapiens
VAAGLDRKK

SEQ ID NO: 340113 - protein, 9 aa, Homo Sapiens
DMDRIKKDQ

SEQ ID NO: 340114 - protein, 9 aa, Homo Sapiens
FTRKFVFQP

SEQ ID NO: 340115 - protein, 9 aa, Homo Sapiens
QDPDEEALQ

SEQ ID NO: 340116 - protein, 9 aa, Homo Sapiens
TIQTESIRW

SEQ ID NO: 340117 - protein, 9 aa, Homo Sapiens
NIQEMEERR

SEQ ID NO: 340118 - protein, 9 aa, Homo Sapiens
TFFSQVACS

SEQ ID NO: 340119 - protein, 9 aa, Homo Sapiens
LAQLAQGIS

SEQ ID NO: 340120 - protein, 9 aa, Homo Sapiens
IVVQLLNFF

SEQ ID NO: 340121 - protein, 9 aa, Homo Sapiens
VDNLDSQSD

SEQ ID NO: 340122 - protein, 9 aa, Homo Sapiens
SKEEREAES

SEQ ID NO: 340123 - protein, 9 aa, Homo Sapiens
SIDFLASQE

SEQ ID NO: 340124 - protein, 9 aa, Homo Sapiens
TKQLFQFLQ

SEQ ID NO: 340125 - protein, 9 aa, Homo Sapiens
HQSRLLTIL

SEQ ID NO: 340126 - protein, 9 aa, Homo Sapiens
DCEGDISLD

SEQ ID NO: 340127 - protein, 9 aa, Homo Sapiens
GKKAIQRED

SEQ ID NO: 340128 - protein, 9 aa, Homo Sapiens
GLIQNMVAW

SEQ ID NO: 340129 - protein, 9 aa, Homo Sapiens
SITNHKIIY

SEQ ID NO: 340130 - protein, 9 aa, Homo Sapiens
KPISNADFS

SEQ ID NO: 340131 - protein, 9 aa, Homo Sapiens
NSYLTIHHR

SEQ ID NO: 340132 - protein, 9 aa, Homo Sapiens
LGYIPYGKE

SEQ ID NO: 340133 - protein, 9 aa, Homo Sapiens
KKNYAKRIE

SEQ ID NO: 340134 - protein, 9 aa, Homo Sapiens
CLQYGHDTF

SEQ ID NO: 340135 - protein, 9 aa, Homo Sapiens
EYFMKNSDN

SEQ ID NO: 340136 - protein, 9 aa, Homo Sapiens
KTKCLNELK

SEQ ID NO: 340137 - protein, 9 aa, Homo Sapiens
GYQKTGDAY

SEQ ID NO: 340138 - protein, 9 aa, Homo Sapiens
LLQQLKENQ

SEQ ID NO: 340139 - protein, 9 aa, Homo Sapiens
FAFLLCVCI

SEQ ID NO: 340140 - protein, 9 aa, Homo Sapiens
VMCRHPLVY

SEQ ID NO: 340141 - protein, 9 aa, Homo Sapiens
RGTPTQMFP

SEQ ID NO: 340142 - protein, 9 aa, Homo Sapiens
LENINFKMA

SEQ ID NO: 340143 - protein, 9 aa, Homo Sapiens
ERHHLSRHI

SEQ ID NO: 340144 - protein, 9 aa, Homo Sapiens
DSLDKFRIN

SEQ ID NO: 340145 - protein, 9 aa, Homo Sapiens
AVCEATGRQ

SEQ ID NO: 340146 - protein, 9 aa, Homo Sapiens
WQRLNNLLT

SEQ ID NO: 340147 - protein, 9 aa, Homo Sapiens
EESLCHVDA

SEQ ID NO: 340148 - protein, 9 aa, Homo Sapiens
AYSRHNAEI

SEQ ID NO: 340149 - protein, 9 aa, Homo Sapiens
KYQFSLYPL

SEQ ID NO: 340150 - protein, 9 aa, Homo Sapiens
TVVPHNLPS

SEQ ID NO: 340151 - protein, 9 aa, Homo Sapiens
FVSSGLLIR

SEQ ID NO: 340152 - protein, 9 aa, Homo Sapiens
DGSRCLFTK

SEQ ID NO: 340153 - protein, 9 aa, Homo Sapiens
DCHGKSQGA

SEQ ID NO: 340154 - protein, 9 aa, Homo Sapiens
FSDDDSDLD

SEQ ID NO: 340155 - protein, 9 aa, Homo Sapiens
NFILSIGGI

SEQ ID NO: 340156 - protein, 9 aa, Homo Sapiens
KLATLLLCG

SEQ ID NO: 340157 - protein, 9 aa, Homo Sapiens
QIIRGLKYI

SEQ ID NO: 340158 - protein, 9 aa, Homo Sapiens
KLFLMFCMV

SEQ ID NO: 340159 - protein, 9 aa, Homo Sapiens
SEIIRGKRR

SEQ ID NO: 340160 - protein, 9 aa, Homo Sapiens
NVSSSHGKR

SEQ ID NO: 340161 - protein, 9 aa, Homo Sapiens
HIKNVYAFN

SEQ ID NO: 340162 - protein, 9 aa, Homo Sapiens
RHKSFMETA

SEQ ID NO: 340163 - protein, 9 aa, Homo Sapiens
KSDCNSSPE

SEQ ID NO: 340164 - protein, 9 aa, Homo Sapiens
TKSGYFLSI

SEQ ID NO: 340165 - protein, 9 aa, Homo Sapiens
TILQFTRNG

SEQ ID NO: 340166 - protein, 9 aa, Homo Sapiens
QVRGFLPDW

SEQ ID NO: 340167 - protein, 9 aa, Homo Sapiens
SWRINMVQT

SEQ ID NO: 340168 - protein, 9 aa, Homo Sapiens
SGGYTDPLT

SEQ ID NO: 340169 - protein, 9 aa, Homo Sapiens
VPKHKKFPA

SEQ ID NO: 340170 - protein, 9 aa, Homo Sapiens
LPPKRKEDK

SEQ ID NO: 340171 - protein, 9 aa, Homo Sapiens
EGRTKAYLT

SEQ ID NO: 340172 - protein, 9 aa, Homo Sapiens
VARDKPMHD

SEQ ID NO: 340173 - protein, 9 aa, Homo Sapiens
AKQQNKFGE

SEQ ID NO: 340174 - protein, 9 aa, Homo Sapiens
PIIDGRNRE

SEQ ID NO: 340175 - protein, 9 aa, Homo Sapiens
VAQVQKLND

SEQ ID NO: 340176 - protein, 9 aa, Homo Sapiens
MLQQRRPWE

SEQ ID NO: 340177 - protein, 9 aa, Homo Sapiens
RRSAHLIQH

SEQ ID NO: 340178 - protein, 9 aa, Homo Sapiens
RIKTLQADF

SEQ ID NO: 340179 - protein, 9 aa, Homo Sapiens
GEDADISAF

SEQ ID NO: 340180 - protein, 9 aa, Homo Sapiens
TYLLGAGRQ

SEQ ID NO: 340181 - protein, 9 aa, Homo Sapiens
LQESIGKGQ

SEQ ID NO: 340182 - protein, 9 aa, Homo Sapiens
QIIRNGAAR

SEQ ID NO: 340183 - protein, 9 aa, Homo Sapiens
ALKKICVKN

SEQ ID NO: 340184 - protein, 9 aa, Homo Sapiens
ALKSEEKDM

SEQ ID NO: 340185 - protein, 9 aa, Homo Sapiens
IFIDEIYSI

SEQ ID NO: 340186 - protein, 9 aa, Homo Sapiens
LCLGSWSLT

SEQ ID NO: 340187 - protein, 9 aa, Homo Sapiens
IWENGMKVG

SEQ ID NO: 340188 - protein, 9 aa, Homo Sapiens
SEKFHLVAH

SEQ ID NO: 340189 - protein, 9 aa, Homo Sapiens
NFIVEPTFS

SEQ ID NO: 340190 - protein, 9 aa, Homo Sapiens
IDTCCHVSI

SEQ ID NO: 340191 - protein, 9 aa, Homo Sapiens
GQALEPTQD

SEQ ID NO: 340192 - protein, 9 aa, Homo Sapiens
HSGDRPFKC

SEQ ID NO: 340193 - protein, 9 aa, Homo Sapiens
AAKHQDSGA

SEQ ID NO: 340194 - protein, 9 aa, Homo Sapiens
LHTKEKPSK

SEQ ID NO: 340195 - protein, 9 aa, Homo Sapiens
QLANNAKTS

SEQ ID NO: 340196 - protein, 9 aa, Homo Sapiens
EDDNDLLSS

SEQ ID NO: 340197 - protein, 9 aa, Homo Sapiens
LSTNLLGSI

SEQ ID NO: 340198 - protein, 9 aa, Homo Sapiens
DLVQYLKWW

SEQ ID NO: 340199 - protein, 9 aa, Homo Sapiens
ECNNSPLKR

SEQ ID NO: 340200 - protein, 9 aa, Homo Sapiens
NRIMRLCFN

SEQ ID NO: 340201 - protein, 9 aa, Homo Sapiens
HTLHISSTN

SEQ ID NO: 340202 - protein, 9 aa, Homo Sapiens
TSKPQGKVQ

SEQ ID NO: 340203 - protein, 9 aa, Homo Sapiens
PEGERVYFD

SEQ ID NO: 340204 - protein, 9 aa, Homo Sapiens
EEIAKAAEM

SEQ ID NO: 340205 - protein, 9 aa, Homo Sapiens
FREVDKIDE

SEQ ID NO: 340206 - protein, 9 aa, Homo Sapiens
QDMHKTKKK

SEQ ID NO: 340207 - protein, 9 aa, Homo Sapiens
VRKNLFCFG

SEQ ID NO: 340208 - protein, 9 aa, Homo Sapiens
IHTLTYLLQ

SEQ ID NO: 340209 - protein, 9 aa, Homo Sapiens
KVQQELSRS

SEQ ID NO: 340210 - protein, 9 aa, Homo Sapiens
LSRKLSTKK

SEQ ID NO: 340211 - protein, 9 aa, Homo Sapiens
NSCTNKLRD

SEQ ID NO: 340212 - protein, 9 aa, Homo Sapiens
NQPHKKYKL

SEQ ID NO: 340213 - protein, 9 aa, Homo Sapiens
SEASENKCI

SEQ ID NO: 340214 - protein, 9 aa, Homo Sapiens
PNELIMPDS

SEQ ID NO: 340215 - protein, 9 aa, Homo Sapiens
KIPWLSETS

SEQ ID NO: 340216 - protein, 9 aa, Homo Sapiens
HEQHKTVVL

SEQ ID NO: 340217 - protein, 9 aa, Homo Sapiens
RVEELALRA

SEQ ID NO: 340218 - protein, 9 aa, Homo Sapiens
WTSLNFNQT

SEQ ID NO: 340219 - protein, 9 aa, Homo Sapiens
FFCLFVHFL

SEQ ID NO: 340220 - protein, 9 aa, Homo Sapiens
RTFKRFTPR

SEQ ID NO: 340221 - protein, 9 aa, Homo Sapiens
ITYWLRNDS

SEQ ID NO: 340222 - protein, 9 aa, Homo Sapiens
KKSEESYNI

SEQ ID NO: 340223 - protein, 9 aa, Homo Sapiens
AIKHRNEAE

SEQ ID NO: 340224 - protein, 9 aa, Homo Sapiens
TTNGSRFPA

SEQ ID NO: 340225 - protein, 9 aa, Homo Sapiens
NKDTPYEAV

SEQ ID NO: 340226 - protein, 9 aa, Homo Sapiens
AYIYAQSLW

SEQ ID NO: 340227 - protein, 9 aa, Homo Sapiens
STKSSDYLR

SEQ ID NO: 340228 - protein, 9 aa, Homo Sapiens
SALALCCMQ

SEQ ID NO: 340229 - protein, 9 aa, Homo Sapiens
AAGKGYDNE

SEQ ID NO: 340230 - protein, 9 aa, Homo Sapiens
GSGQVVLEM

SEQ ID NO: 340231 - protein, 9 aa, Homo Sapiens
HLAPLQMDV

SEQ ID NO: 340232 - protein, 9 aa, Homo Sapiens
ENELVLHQS

SEQ ID NO: 340233 - protein, 9 aa, Homo Sapiens
NMRLEQENE

SEQ ID NO: 340234 - protein, 9 aa, Homo Sapiens
EVAVSVILL

SEQ ID NO: 340235 - protein, 9 aa, Homo Sapiens
MLHKKRREK

SEQ ID NO: 340236 - protein, 9 aa, Homo Sapiens
HFYRYMGRG

SEQ ID NO: 340237 - protein, 9 aa, Homo Sapiens
EMRNKKEEY

SEQ ID NO: 340238 - protein, 9 aa, Homo Sapiens
TLIEMYTTQ

SEQ ID NO: 340239 - protein, 9 aa, Homo Sapiens
YKNFRRELE

SEQ ID NO: 340240 - protein, 9 aa, Homo Sapiens
LLDITTAAV

SEQ ID NO: 340241 - protein, 9 aa, Homo Sapiens
MLQNPRSQL

SEQ ID NO: 340242 - protein, 9 aa, Homo Sapiens
GNIFKQYSH

SEQ ID NO: 340243 - protein, 9 aa, Homo Sapiens
MLALSSFNS

SEQ ID NO: 340244 - protein, 9 aa, Homo Sapiens
PPNSSGWGG

SEQ ID NO: 340245 - protein, 9 aa, Homo Sapiens
LVANNRLFS

SEQ ID NO: 340246 - protein, 9 aa, Homo Sapiens
NSTNQNKCI

SEQ ID NO: 340247 - protein, 9 aa, Homo Sapiens
KVIATTVTY

SEQ ID NO: 340248 - protein, 9 aa, Homo Sapiens
FTRCLAPLV

SEQ ID NO: 340249 - protein, 9 aa, Homo Sapiens
DKPMHDEIF

SEQ ID NO: 340250 - protein, 9 aa, Homo Sapiens
SALDLDPCL

SEQ ID NO: 340251 - protein, 9 aa, Homo Sapiens
LFIYVKPKQ

SEQ ID NO: 340252 - protein, 9 aa, Homo Sapiens
ETTGESLRS

SEQ ID NO: 340253 - protein, 9 aa, Homo Sapiens
PGRRNSQTE

SEQ ID NO: 340254 - protein, 9 aa, Homo Sapiens
LCLQLGVNK

SEQ ID NO: 340255 - protein, 9 aa, Homo Sapiens
EHSHRDKHP

SEQ ID NO: 340256 - protein, 9 aa, Homo Sapiens
PKNKESVEK

SEQ ID NO: 340257 - protein, 9 aa, Homo Sapiens
HSKTYLICY

SEQ ID NO: 340258 - protein, 9 aa, Homo Sapiens
DPILDTASL

SEQ ID NO: 340259 - protein, 9 aa, Homo Sapiens
QFRMRVRWE

SEQ ID NO: 340260 - protein, 9 aa, Homo Sapiens
KEAAEKEQK

SEQ ID NO: 340261 - protein, 9 aa, Homo Sapiens
EYKYCLRHK

SEQ ID NO: 340262 - protein, 9 aa, Homo Sapiens
MRSVLRQKI

SEQ ID NO: 340263 - protein, 9 aa, Homo Sapiens
SQDCYTRIW

SEQ ID NO: 340264 - protein, 9 aa, Homo Sapiens
DFVDFVLCD

SEQ ID NO: 340265 - protein, 9 aa, Homo Sapiens
SLATPRLTL

SEQ ID NO: 340266 - protein, 9 aa, Homo Sapiens
NTLHKGWSQ

SEQ ID NO: 340267 - protein, 9 aa, Homo Sapiens
RIKLLFFRK

SEQ ID NO: 340268 - protein, 9 aa, Homo Sapiens
TKGENHPSP

SEQ ID NO: 340269 - protein, 9 aa, Homo Sapiens
CLAKGSPKR

SEQ ID NO: 340270 - protein, 9 aa, Homo Sapiens
LLKRHEKSH

SEQ ID NO: 340271 - protein, 9 aa, Homo Sapiens
TVVICVGCS

SEQ ID NO: 340272 - protein, 9 aa, Homo Sapiens
ERDEIGQIE

SEQ ID NO: 340273 - protein, 9 aa, Homo Sapiens
RLVQTAQNS

SEQ ID NO: 340274 - protein, 9 aa, Homo Sapiens
PFVPEEMME

SEQ ID NO: 340275 - protein, 9 aa, Homo Sapiens
VACCIVLFV

SEQ ID NO: 340276 - protein, 9 aa, Homo Sapiens
KQVSGEIRN

SEQ ID NO: 340277 - protein, 9 aa, Homo Sapiens
LQPGNIYPT

SEQ ID NO: 340278 - protein, 9 aa, Homo Sapiens
ADSNSKDND

SEQ ID NO: 340279 - protein, 9 aa, Homo Sapiens
NLGIADCIR

SEQ ID NO: 340280 - protein, 9 aa, Homo Sapiens
LHQLIEYGN

SEQ ID NO: 340281 - protein, 9 aa, Homo Sapiens
VQTVGSRRE

SEQ ID NO: 340282 - protein, 9 aa, Homo Sapiens
HTLTQQRHL

SEQ ID NO: 340283 - protein, 9 aa, Homo Sapiens
VAVCEATGR

SEQ ID NO: 340284 - protein, 9 aa, Homo Sapiens
ERLRSKNKD

SEQ ID NO: 340285 - protein, 9 aa, Homo Sapiens
LLGCHMRRN

SEQ ID NO: 340286 - protein, 9 aa, Homo Sapiens
VHNPQQHRN

SEQ ID NO: 340287 - protein, 9 aa, Homo Sapiens
RNYNNQASE

SEQ ID NO: 340288 - protein, 9 aa, Homo Sapiens
GVAIHSLAH

SEQ ID NO: 340289 - protein, 9 aa, Homo Sapiens
RMLKSEEVL

SEQ ID NO: 340290 - protein, 9 aa, Homo Sapiens
ELLTLPRTK

SEQ ID NO: 340291 - protein, 9 aa, Homo Sapiens
SELQGQLFV

SEQ ID NO: 340292 - protein, 9 aa, Homo Sapiens
ALDKHIIGF

SEQ ID NO: 340293 - protein, 9 aa, Homo Sapiens
YVIMTIVFD

SEQ ID NO: 340294 - protein, 9 aa, Homo Sapiens
ARKDEWAEV

SEQ ID NO: 340295 - protein, 9 aa, Homo Sapiens
YCPNNSIFC

SEQ ID NO: 340296 - protein, 9 aa, Homo Sapiens
QLRVQQLVE

SEQ ID NO: 340297 - protein, 9 aa, Homo Sapiens
TIFSVFNND

SEQ ID NO: 340298 - protein, 9 aa, Homo Sapiens
QNQYERKGE

SEQ ID NO: 340299 - protein, 9 aa, Homo Sapiens
QFGEVWRGK

SEQ ID NO: 340300 - protein, 9 aa, Homo Sapiens
QVCTIVKKD

SEQ ID NO: 340301 - protein, 9 aa, Homo Sapiens
VGIYRKKST

SEQ ID NO: 340302 - protein, 9 aa, Homo Sapiens
MTKAEVTEN

SEQ ID NO: 340303 - protein, 9 aa, Homo Sapiens
VIILGVSGH

SEQ ID NO: 340304 - protein, 9 aa, Homo Sapiens
VKMGRVMLG

SEQ ID NO: 340305 - protein, 9 aa, Homo Sapiens
HKIEAEIVR

SEQ ID NO: 340306 - protein, 9 aa, Homo Sapiens
QARALIREQ

SEQ ID NO: 340307 - protein, 9 aa, Homo Sapiens
FCKVHGFYP

SEQ ID NO: 340308 - protein, 9 aa, Homo Sapiens
DFDMDLQAC

SEQ ID NO: 340309 - protein, 9 aa, Homo Sapiens
LNWQIKYLN

SEQ ID NO: 340310 - protein, 9 aa, Homo Sapiens
SEISNPKNM

SEQ ID NO: 340311 - protein, 9 aa, Homo Sapiens
PSMAGHSSC

SEQ ID NO: 340312 - protein, 9 aa, Homo Sapiens
ETLRLFPIV

SEQ ID NO: 340313 - protein, 9 aa, Homo Sapiens
LDHCLCELP

SEQ ID NO: 340314 - protein, 9 aa, Homo Sapiens
FLCDYTQIN

SEQ ID NO: 340315 - protein, 9 aa, Homo Sapiens
TKAEVTENT

SEQ ID NO: 340316 - protein, 9 aa, Homo Sapiens
HLRVLFITA

SEQ ID NO: 340317 - protein, 9 aa, Homo Sapiens
IDHPAHAEV

SEQ ID NO: 340318 - protein, 9 aa, Homo Sapiens
ILASVLALQ

SEQ ID NO: 340319 - protein, 9 aa, Homo Sapiens
KDILSLYEV

SEQ ID NO: 340320 - protein, 9 aa, Homo Sapiens
SKSNINKVW

SEQ ID NO: 340321 - protein, 9 aa, Homo Sapiens
STLISQKVP

SEQ ID NO: 340322 - protein, 9 aa, Homo Sapiens
KNEKEKKGK

SEQ ID NO: 340323 - protein, 9 aa, Homo Sapiens
CSMIDDTYQ

SEQ ID NO: 340324 - protein, 9 aa, Homo Sapiens
TDPSHSERF

SEQ ID NO: 340325 - protein, 9 aa, Homo Sapiens
VQVADKNDD

SEQ ID NO: 340326 - protein, 9 aa, Homo Sapiens
FAFVLIVEF

SEQ ID NO: 340327 - protein, 9 aa, Homo Sapiens
CPPPYFSWT

SEQ ID NO: 340328 - protein, 9 aa, Homo Sapiens
TVFEAFLNS

SEQ ID NO: 340329 - protein, 9 aa, Homo Sapiens
CKERQKRGW

SEQ ID NO: 340330 - protein, 9 aa, Homo Sapiens
SCAFPGLTS

SEQ ID NO: 340331 - protein, 9 aa, Homo Sapiens
GLIIVQRLL

SEQ ID NO: 340332 - protein, 9 aa, Homo Sapiens
LTHFVRFVL

SEQ ID NO: 340333 - protein, 9 aa, Homo Sapiens
TVFLRVRTS

SEQ ID NO: 340334 - protein, 9 aa, Homo Sapiens
VMKLWHCLL

SEQ ID NO: 340335 - protein, 9 aa, Homo Sapiens
EGCQRQGAV

SEQ ID NO: 340336 - protein, 9 aa, Homo Sapiens
LIQSLFLDK

SEQ ID NO: 340337 - protein, 9 aa, Homo Sapiens
RTTYQCSRF

SEQ ID NO: 340338 - protein, 9 aa, Homo Sapiens
TVLFLYTAE

SEQ ID NO: 340339 - protein, 9 aa, Homo Sapiens
QDAYELFTS

SEQ ID NO: 340340 - protein, 9 aa, Homo Sapiens
KKICQVIRK

SEQ ID NO: 340341 - protein, 9 aa, Homo Sapiens
SCNWDFRNK

SEQ ID NO: 340342 - protein, 9 aa, Homo Sapiens
QLNPAARKF

SEQ ID NO: 340343 - protein, 9 aa, Homo Sapiens
SVSKDNSTA

SEQ ID NO: 340344 - protein, 9 aa, Homo Sapiens
WTAGTSSDL

SEQ ID NO: 340345 - protein, 9 aa, Homo Sapiens
TLNNSRLVS

SEQ ID NO: 340346 - protein, 9 aa, Homo Sapiens
CLAMLEKNY

SEQ ID NO: 340347 - protein, 9 aa, Homo Sapiens
LDIAGFKIF

SEQ ID NO: 340348 - protein, 9 aa, Homo Sapiens
ISGHKHIKH

SEQ ID NO: 340349 - protein, 9 aa, Homo Sapiens
NKLGHNKLK

SEQ ID NO: 340350 - protein, 9 aa, Homo Sapiens
IVTNIFISW

SEQ ID NO: 340351 - protein, 9 aa, Homo Sapiens
TDSSKTDKK

SEQ ID NO: 340352 - protein, 9 aa, Homo Sapiens
GGASIDLSA

SEQ ID NO: 340353 - protein, 9 aa, Homo Sapiens
EIYDFDSIM

SEQ ID NO: 340354 - protein, 9 aa, Homo Sapiens
VLEKVNNLV

SEQ ID NO: 340355 - protein, 9 aa, Homo Sapiens
RQHHSDLYS

SEQ ID NO: 340356 - protein, 9 aa, Homo Sapiens
RLSGKQVDG

SEQ ID NO: 340357 - protein, 9 aa, Homo Sapiens
ILAPGETIT

SEQ ID NO: 340358 - protein, 9 aa, Homo Sapiens
QIKNATEDV

SEQ ID NO: 340359 - protein, 9 aa, Homo Sapiens
KKTYPECLQ

SEQ ID NO: 340360 - protein, 9 aa, Homo Sapiens
DIKETMTPG

SEQ ID NO: 340361 - protein, 9 aa, Homo Sapiens
TSTAPQLLI

SEQ ID NO: 340362 - protein, 9 aa, Homo Sapiens
EEVTQNAEE

SEQ ID NO: 340363 - protein, 9 aa, Homo Sapiens
MDEKIAFPI

SEQ ID NO: 340364 - protein, 9 aa, Homo Sapiens
VVPAWVSSS

SEQ ID NO: 340365 - protein, 9 aa, Homo Sapiens
HNREKNHPR

SEQ ID NO: 340366 - protein, 9 aa, Homo Sapiens
QELQKIRKY

SEQ ID NO: 340367 - protein, 9 aa, Homo Sapiens
YGCNINEKQ

SEQ ID NO: 340368 - protein, 9 aa, Homo Sapiens
RLAPRHILV

SEQ ID NO: 340369 - protein, 9 aa, Homo Sapiens
TILCEEMGA

SEQ ID NO: 340370 - protein, 9 aa, Homo Sapiens
DDGALQPGT

SEQ ID NO: 340371 - protein, 9 aa, Homo Sapiens
DFEIVVVGY

SEQ ID NO: 340372 - protein, 9 aa, Homo Sapiens
EIPIKSKEV

SEQ ID NO: 340373 - protein, 9 aa, Homo Sapiens
SKSKCNLLL

SEQ ID NO: 340374 - protein, 9 aa, Homo Sapiens
RKEIMFPDQ

SEQ ID NO: 340375 - protein, 9 aa, Homo Sapiens
EKKGKDHKS

SEQ ID NO: 340376 - protein, 9 aa, Homo Sapiens
YLFATYVLA

SEQ ID NO: 340377 - protein, 9 aa, Homo Sapiens
LCLTTFLFS

SEQ ID NO: 340378 - protein, 9 aa, Homo Sapiens
LQLKDHVSE

SEQ ID NO: 340379 - protein, 9 aa, Homo Sapiens
AQLLAELNL

SEQ ID NO: 340380 - protein, 9 aa, Homo Sapiens
EKDMDISAM

SEQ ID NO: 340381 - protein, 9 aa, Homo Sapiens
LPPHLQWKR

SEQ ID NO: 340382 - protein, 9 aa, Homo Sapiens
VTQNAEEQP

SEQ ID NO: 340383 - protein, 9 aa, Homo Sapiens
SFPTKSPTK

SEQ ID NO: 340384 - protein, 9 aa, Homo Sapiens
NETHFTGNK

SEQ ID NO: 340385 - protein, 9 aa, Homo Sapiens
SEKSNEETD

SEQ ID NO: 340386 - protein, 9 aa, Homo Sapiens
AIVYCSFGN

SEQ ID NO: 340387 - protein, 9 aa, Homo Sapiens
SCRNSNSNP

SEQ ID NO: 340388 - protein, 9 aa, Homo Sapiens
TLAIVCWSV

SEQ ID NO: 340389 - protein, 9 aa, Homo Sapiens
HQSGDFTTS

SEQ ID NO: 340390 - protein, 9 aa, Homo Sapiens
AIVRDPKTL

SEQ ID NO: 340391 - protein, 9 aa, Homo Sapiens
SSKENWKRS

SEQ ID NO: 340392 - protein, 9 aa, Homo Sapiens
RIIREKYIE

SEQ ID NO: 340393 - protein, 9 aa, Homo Sapiens
GELMPRKAI

SEQ ID NO: 340394 - protein, 9 aa, Homo Sapiens
RTATFVKWS

SEQ ID NO: 340395 - protein, 9 aa, Homo Sapiens
IIISMILCV

SEQ ID NO: 340396 - protein, 9 aa, Homo Sapiens
SHIVSEPGN

SEQ ID NO: 340397 - protein, 9 aa, Homo Sapiens
SKAISESEL

SEQ ID NO: 340398 - protein, 9 aa, Homo Sapiens
RLSNDSIML

SEQ ID NO: 340399 - protein, 9 aa, Homo Sapiens
KENKKIWDK

SEQ ID NO: 340400 - protein, 9 aa, Homo Sapiens
FAYIDNFKT

SEQ ID NO: 340401 - protein, 9 aa, Homo Sapiens
NALANNIVL

SEQ ID NO: 340402 - protein, 9 aa, Homo Sapiens
LPDLGCPAP

SEQ ID NO: 340403 - protein, 9 aa, Homo Sapiens
YFLLVLAFL

SEQ ID NO: 340404 - protein, 9 aa, Homo Sapiens
SSTTLTKYF

SEQ ID NO: 340405 - protein, 9 aa, Homo Sapiens
PSIEFNAHH

SEQ ID NO: 340406 - protein, 9 aa, Homo Sapiens
CNNSPLKRE

SEQ ID NO: 340407 - protein, 9 aa, Homo Sapiens
PPEYELFWG

SEQ ID NO: 340408 - protein, 9 aa, Homo Sapiens
TEEERTKQI

SEQ ID NO: 340409 - protein, 9 aa, Homo Sapiens
SGTFRLRQG

SEQ ID NO: 340410 - protein, 9 aa, Homo Sapiens
DRIGLADYT

SEQ ID NO: 340411 - protein, 9 aa, Homo Sapiens
LVNVVFDVS

SEQ ID NO: 340412 - protein, 9 aa, Homo Sapiens
KKDKGKAKL

SEQ ID NO: 340413 - protein, 9 aa, Homo Sapiens
DAEDLPFTK

SEQ ID NO: 340414 - protein, 9 aa, Homo Sapiens
QHIDVDSVL

SEQ ID NO: 340415 - protein, 9 aa, Homo Sapiens
RDCPHEVLL

SEQ ID NO: 340416 - protein, 9 aa, Homo Sapiens
WSSGTAAAK

SEQ ID NO: 340417 - protein, 9 aa, Homo Sapiens
ANVRVQNCA

SEQ ID NO: 340418 - protein, 9 aa, Homo Sapiens
KHAVQTTLK

SEQ ID NO: 340419 - protein, 9 aa, Homo Sapiens
FCDSRLFTD

SEQ ID NO: 340420 - protein, 9 aa, Homo Sapiens
SLNHPNHLF

SEQ ID NO: 340421 - protein, 9 aa, Homo Sapiens
LVVLDAAGG

SEQ ID NO: 340422 - protein, 9 aa, Homo Sapiens
KPKQSTEKP

SEQ ID NO: 340423 - protein, 9 aa, Homo Sapiens
NVPSVWQSA

SEQ ID NO: 340424 - protein, 9 aa, Homo Sapiens
TKHGVPLDL

SEQ ID NO: 340425 - protein, 9 aa, Homo Sapiens
AVFQWPFSA

SEQ ID NO: 340426 - protein, 9 aa, Homo Sapiens
KDAHLVLKR

SEQ ID NO: 340427 - protein, 9 aa, Homo Sapiens
AKNEVGSAH

SEQ ID NO: 340428 - protein, 9 aa, Homo Sapiens
EGIQLQCFM

SEQ ID NO: 340429 - protein, 9 aa, Homo Sapiens
LASQEFDFN

SEQ ID NO: 340430 - protein, 9 aa, Homo Sapiens
SSIVLKPHN

SEQ ID NO: 340431 - protein, 9 aa, Homo Sapiens
RDQEGRPEQ

SEQ ID NO: 340432 - protein, 9 aa, Homo Sapiens
MLDNYRNLI

SEQ ID NO: 340433 - protein, 9 aa, Homo Sapiens
SGNLANVEQ

SEQ ID NO: 340434 - protein, 9 aa, Homo Sapiens
LLMTVESAN

SEQ ID NO: 340435 - protein, 9 aa, Homo Sapiens
TLPRTKDTL

SEQ ID NO: 340436 - protein, 9 aa, Homo Sapiens
VNKCGAQHV

SEQ ID NO: 340437 - protein, 9 aa, Homo Sapiens
FVIIHKHCV

SEQ ID NO: 340438 - protein, 9 aa, Homo Sapiens
PKDVKYNVL

SEQ ID NO: 340439 - protein, 9 aa, Homo Sapiens
DKKDSDRLH

SEQ ID NO: 340440 - protein, 9 aa, Homo Sapiens
LSRSIKGGI

SEQ ID NO: 340441 - protein, 9 aa, Homo Sapiens
LQTVMTMML

SEQ ID NO: 340442 - protein, 9 aa, Homo Sapiens
HIQKVHKKK

SEQ ID NO: 340443 - protein, 9 aa, Homo Sapiens
QLSTEGLIT

SEQ ID NO: 340444 - protein, 9 aa, Homo Sapiens
GKKSWKRCY

SEQ ID NO: 340445 - protein, 9 aa, Homo Sapiens
FKDNPHLII

SEQ ID NO: 340446 - protein, 9 aa, Homo Sapiens
FFENVDMPN

SEQ ID NO: 340447 - protein, 9 aa, Homo Sapiens
DEHILWFLR

SEQ ID NO: 340448 - protein, 9 aa, Homo Sapiens
MCISPEELQ

SEQ ID NO: 340449 - protein, 9 aa, Homo Sapiens
GCAGFGGLG

SEQ ID NO: 340450 - protein, 9 aa, Homo Sapiens
KTLKTLTFK

SEQ ID NO: 340451 - protein, 9 aa, Homo Sapiens
NKLLRMMIA

SEQ ID NO: 340452 - protein, 9 aa, Homo Sapiens
HDIRNYPYP

SEQ ID NO: 340453 - protein, 9 aa, Homo Sapiens
HLKMAEEDR

SEQ ID NO: 340454 - protein, 9 aa, Homo Sapiens
WRNTRSKVS

SEQ ID NO: 340455 - protein, 9 aa, Homo Sapiens
TQGSVAFED

SEQ ID NO: 340456 - protein, 9 aa, Homo Sapiens
KYKRNFEES

SEQ ID NO: 340457 - protein, 9 aa, Homo Sapiens
SKQQCIATA

SEQ ID NO: 340458 - protein, 9 aa, Homo Sapiens
VYHSHVAGQ

SEQ ID NO: 340459 - protein, 9 aa, Homo Sapiens
KFKAPQYAM

SEQ ID NO: 340460 - protein, 9 aa, Homo Sapiens
IFNEVEIYG

SEQ ID NO: 340461 - protein, 9 aa, Homo Sapiens
EEDDIIVWH

SEQ ID NO: 340462 - protein, 9 aa, Homo Sapiens
LYYWDASAC

SEQ ID NO: 340463 - protein, 9 aa, Homo Sapiens
KKFTLTEQT

SEQ ID NO: 340464 - protein, 9 aa, Homo Sapiens
MWSASDLSD

SEQ ID NO: 340465 - protein, 9 aa, Homo Sapiens
LKNCNLVGN

SEQ ID NO: 340466 - protein, 9 aa, Homo Sapiens
IKTSSGKIK

SEQ ID NO: 340467 - protein, 9 aa, Homo Sapiens
YSQIGGRVK

SEQ ID NO: 340468 - protein, 9 aa, Homo Sapiens
PPVCYKIIT

SEQ ID NO: 340469 - protein, 9 aa, Homo Sapiens
FLSLIPAWT

SEQ ID NO: 340470 - protein, 9 aa, Homo Sapiens
TRERRYKCK

SEQ ID NO: 340471 - protein, 9 aa, Homo Sapiens
VLDQPPTVM

SEQ ID NO: 340472 - protein, 9 aa, Homo Sapiens
FFGVQWVCP

SEQ ID NO: 340473 - protein, 9 aa, Homo Sapiens
CETKCSRQE

SEQ ID NO: 340474 - protein, 9 aa, Homo Sapiens
TKHIQQAHC

SEQ ID NO: 340475 - protein, 9 aa, Homo Sapiens
PLSCVVFIN

SEQ ID NO: 340476 - protein, 9 aa, Homo Sapiens
GVYLPLLWG

SEQ ID NO: 340477 - protein, 9 aa, Homo Sapiens
EEVFKVNKS

SEQ ID NO: 340478 - protein, 9 aa, Homo Sapiens
CMCAGLHRS

SEQ ID NO: 340479 - protein, 9 aa, Homo Sapiens
CKGGSRTGY

SEQ ID NO: 340480 - protein, 9 aa, Homo Sapiens
YTIGLIMGG

SEQ ID NO: 340481 - protein, 9 aa, Homo Sapiens
QNGSELDLL

SEQ ID NO: 340482 - protein, 9 aa, Homo Sapiens
PSLSFYPAC

SEQ ID NO: 340483 - protein, 9 aa, Homo Sapiens
GLDFVKKKC

SEQ ID NO: 340484 - protein, 9 aa, Homo Sapiens
SYSGRGRGC

SEQ ID NO: 340485 - protein, 9 aa, Homo Sapiens
GFYSPLGMP

SEQ ID NO: 340486 - protein, 9 aa, Homo Sapiens
KAEVTENTE

SEQ ID NO: 340487 - protein, 9 aa, Homo Sapiens
DECQFDISV

SEQ ID NO: 340488 - protein, 9 aa, Homo Sapiens
KVLTADIVI

SEQ ID NO: 340489 - protein, 9 aa, Homo Sapiens
NMVPSVTNN

SEQ ID NO: 340490 - protein, 9 aa, Homo Sapiens
LKDRKASAF

SEQ ID NO: 340491 - protein, 9 aa, Homo Sapiens
SFMTPHSHS

SEQ ID NO: 340492 - protein, 9 aa, Homo Sapiens
TDMKLSMNN

SEQ ID NO: 340493 - protein, 9 aa, Homo Sapiens
NNVTLTCQP

SEQ ID NO: 340494 - protein, 9 aa, Homo Sapiens
ETLQTAGFS

SEQ ID NO: 340495 - protein, 9 aa, Homo Sapiens
PLVTTKGEN

SEQ ID NO: 340496 - protein, 9 aa, Homo Sapiens
DINNNPPTF

SEQ ID NO: 340497 - protein, 9 aa, Homo Sapiens
DQLVKRLEY

SEQ ID NO: 340498 - protein, 9 aa, Homo Sapiens
KNKIRSLIY

SEQ ID NO: 340499 - protein, 9 aa, Homo Sapiens
LSAVDILGK

SEQ ID NO: 340500 - protein, 9 aa, Homo Sapiens
CLVHQSKIF

SEQ ID NO: 340501 - protein, 9 aa, Homo Sapiens
GTQAEKDRW

SEQ ID NO: 340502 - protein, 9 aa, Homo Sapiens
PQADVAFHF

SEQ ID NO: 340503 - protein, 9 aa, Homo Sapiens
NIKINEMVA

SEQ ID NO: 340504 - protein, 9 aa, Homo Sapiens
IQNHLDECN

SEQ ID NO: 340505 - protein, 9 aa, Homo Sapiens
ENGESSQGQ

SEQ ID NO: 340506 - protein, 9 aa, Homo Sapiens
DQYQHVPVE

SEQ ID NO: 340507 - protein, 9 aa, Homo Sapiens
LKYLEYLLM

SEQ ID NO: 340508 - protein, 9 aa, Homo Sapiens
GKEVIFAFE

SEQ ID NO: 340509 - protein, 9 aa, Homo Sapiens
DCHKKDCPD

SEQ ID NO: 340510 - protein, 9 aa, Homo Sapiens
GRPAQHRLS

SEQ ID NO: 340511 - protein, 9 aa, Homo Sapiens
DWIMLVDDS

SEQ ID NO: 340512 - protein, 9 aa, Homo Sapiens
INNVSPHAQ

SEQ ID NO: 340513 - protein, 9 aa, Homo Sapiens
HSSSFQRHM

SEQ ID NO: 340514 - protein, 9 aa, Homo Sapiens
MAGELMPRK

SEQ ID NO: 340515 - protein, 9 aa, Homo Sapiens
GQRKLDDSQ

SEQ ID NO: 340516 - protein, 9 aa, Homo Sapiens
LRNKEVTRT

SEQ ID NO: 340517 - protein, 9 aa, Homo Sapiens
HVDRVLGLH

SEQ ID NO: 340518 - protein, 9 aa, Homo Sapiens
RHTENKSFK

SEQ ID NO: 340519 - protein, 9 aa, Homo Sapiens
AMVINRLFL

SEQ ID NO: 340520 - protein, 9 aa, Homo Sapiens
PSTEAPEQV

SEQ ID NO: 340521 - protein, 9 aa, Homo Sapiens
KYYRQMDSE

SEQ ID NO: 340522 - protein, 9 aa, Homo Sapiens
QEYLNLLFR

SEQ ID NO: 340523 - protein, 9 aa, Homo Sapiens
KNFRRELEM

SEQ ID NO: 340524 - protein, 9 aa, Homo Sapiens
KQTIELKKM

SEQ ID NO: 340525 - protein, 9 aa, Homo Sapiens
ELQISANSN

SEQ ID NO: 340526 - protein, 9 aa, Homo Sapiens
DLSPPQRSQ

SEQ ID NO: 340527 - protein, 9 aa, Homo Sapiens
LVGVVCLFL

SEQ ID NO: 340528 - protein, 9 aa, Homo Sapiens
QGGGMPEKL

SEQ ID NO: 340529 - protein, 9 aa, Homo Sapiens
KTLLLDEAT

SEQ ID NO: 340530 - protein, 9 aa, Homo Sapiens
ECMKTTWQI

SEQ ID NO: 340531 - protein, 9 aa, Homo Sapiens
NTRSKVSGS

SEQ ID NO: 340532 - protein, 9 aa, Homo Sapiens
FLYFLVMSV

SEQ ID NO: 340533 - protein, 9 aa, Homo Sapiens
NLSNLVVLD

SEQ ID NO: 340534 - protein, 9 aa, Homo Sapiens
CLDLEYSPS

SEQ ID NO: 340535 - protein, 9 aa, Homo Sapiens
IGQIIRNGA

SEQ ID NO: 340536 - protein, 9 aa, Homo Sapiens
ARKMAIGHR

SEQ ID NO: 340537 - protein, 9 aa, Homo Sapiens
GLKQFYFPL

SEQ ID NO: 340538 - protein, 9 aa, Homo Sapiens
IVITDFRKD

SEQ ID NO: 340539 - protein, 9 aa, Homo Sapiens
ATCSGFLYC

SEQ ID NO: 340540 - protein, 9 aa, Homo Sapiens
TRFVLKDAE

SEQ ID NO: 340541 - protein, 9 aa, Homo Sapiens
TRTFMKILG

SEQ ID NO: 340542 - protein, 9 aa, Homo Sapiens
LEAGTESEL

SEQ ID NO: 340543 - protein, 9 aa, Homo Sapiens
RRYSLSFQS

SEQ ID NO: 340544 - protein, 9 aa, Homo Sapiens
KFAYAHKYL

SEQ ID NO: 340545 - protein, 9 aa, Homo Sapiens
TPGVLRDSR

SEQ ID NO: 340546 - protein, 9 aa, Homo Sapiens
YPASVYPRH

SEQ ID NO: 340547 - protein, 9 aa, Homo Sapiens
DNTCVVPER

SEQ ID NO: 340548 - protein, 9 aa, Homo Sapiens
VNVENTLLG

SEQ ID NO: 340549 - protein, 9 aa, Homo Sapiens
GEAGLEECL

SEQ ID NO: 340550 - protein, 9 aa, Homo Sapiens
DVENCAVRE

SEQ ID NO: 340551 - protein, 9 aa, Homo Sapiens
LHKPDRLDR

SEQ ID NO: 340552 - protein, 9 aa, Homo Sapiens
LLCKCIKLW

SEQ ID NO: 340553 - protein, 9 aa, Homo Sapiens
ALCPKDVKY

SEQ ID NO: 340554 - protein, 9 aa, Homo Sapiens
KIIYTRENS

SEQ ID NO: 340555 - protein, 9 aa, Homo Sapiens
DKGKAKLGK

SEQ ID NO: 340556 - protein, 9 aa, Homo Sapiens
HATLTNTLM

SEQ ID NO: 340557 - protein, 9 aa, Homo Sapiens
EKLLIWMSK

SEQ ID NO: 340558 - protein, 9 aa, Homo Sapiens
DRINHCGIA

SEQ ID NO: 340559 - protein, 9 aa, Homo Sapiens
AKSHKLAVE

SEQ ID NO: 340560 - protein, 9 aa, Homo Sapiens
NKEKYTVLG

SEQ ID NO: 340561 - protein, 9 aa, Homo Sapiens
YYSWYHNYG

SEQ ID NO: 340562 - protein, 9 aa, Homo Sapiens
WEKEELKNM

SEQ ID NO: 340563 - protein, 9 aa, Homo Sapiens
PNGVQICFV

SEQ ID NO: 340564 - protein, 9 aa, Homo Sapiens
ELIEDDSEV

SEQ ID NO: 340565 - protein, 9 aa, Homo Sapiens
KLSASLVLL

SEQ ID NO: 340566 - protein, 9 aa, Homo Sapiens
ETVCMAAIK

SEQ ID NO: 340567 - protein, 9 aa, Homo Sapiens
NKCNFIKKR

SEQ ID NO: 340568 - protein, 9 aa, Homo Sapiens
CPPKRKDKS

SEQ ID NO: 340569 - protein, 9 aa, Homo Sapiens
NGENVYHCG

SEQ ID NO: 340570 - protein, 9 aa, Homo Sapiens
KPFDCINCG

SEQ ID NO: 340571 - protein, 9 aa, Homo Sapiens
EYLVKKHTV

SEQ ID NO: 340572 - protein, 9 aa, Homo Sapiens
CWDIKDSIS

SEQ ID NO: 340573 - protein, 9 aa, Homo Sapiens
FEITFCSKN

SEQ ID NO: 340574 - protein, 9 aa, Homo Sapiens
EVYGVRLAA

SEQ ID NO: 340575 - protein, 9 aa, Homo Sapiens
ADIEIIPEI

SEQ ID NO: 340576 - protein, 9 aa, Homo Sapiens
VPQCKVAVC

SEQ ID NO: 340577 - protein, 9 aa, Homo Sapiens
DITMLEEIK

SEQ ID NO: 340578 - protein, 9 aa, Homo Sapiens
IIRTLLSPA

SEQ ID NO: 340579 - protein, 9 aa, Homo Sapiens
FVFLEHQTQ

SEQ ID NO: 340580 - protein, 9 aa, Homo Sapiens
IRIEQERCK

SEQ ID NO: 340581 - protein, 9 aa, Homo Sapiens
ITAQYSADI

SEQ ID NO: 340582 - protein, 9 aa, Homo Sapiens
KVLSSGKYT

SEQ ID NO: 340583 - protein, 9 aa, Homo Sapiens
TLDTPNTTG

SEQ ID NO: 340584 - protein, 9 aa, Homo Sapiens
ITQCWDIKD

SEQ ID NO: 340585 - protein, 9 aa, Homo Sapiens
VLVSGIICF

SEQ ID NO: 340586 - protein, 9 aa, Homo Sapiens
VTFDLSGMD

SEQ ID NO: 340587 - protein, 9 aa, Homo Sapiens
SCPFICSRL

SEQ ID NO: 340588 - protein, 9 aa, Homo Sapiens
FEIVVQLLN

SEQ ID NO: 340589 - protein, 9 aa, Homo Sapiens
GYKGEKGKC

SEQ ID NO: 340590 - protein, 9 aa, Homo Sapiens
SLKRPKTAE

SEQ ID NO: 340591 - protein, 9 aa, Homo Sapiens
YRFKDTAYC

SEQ ID NO: 340592 - protein, 9 aa, Homo Sapiens
AWGDVNRQI

SEQ ID NO: 340593 - protein, 9 aa, Homo Sapiens
HKLYVSFRD

SEQ ID NO: 340594 - protein, 9 aa, Homo Sapiens
LPLADKGMT

SEQ ID NO: 340595 - protein, 9 aa, Homo Sapiens
VCIGDKRRI

SEQ ID NO: 340596 - protein, 9 aa, Homo Sapiens
NRSKIGWVW

SEQ ID NO: 340597 - protein, 9 aa, Homo Sapiens
YQEDGLVLL

SEQ ID NO: 340598 - protein, 9 aa, Homo Sapiens
SKSNLGWAP

SEQ ID NO: 340599 - protein, 9 aa, Homo Sapiens
SLLPHAGVA

SEQ ID NO: 340600 - protein, 9 aa, Homo Sapiens
IMTIVFDLS

SEQ ID NO: 340601 - protein, 9 aa, Homo Sapiens
LLCLPEDIW

SEQ ID NO: 340602 - protein, 9 aa, Homo Sapiens
KADAEEEIK

SEQ ID NO: 340603 - protein, 9 aa, Homo Sapiens
WDPAHRVAL

SEQ ID NO: 340604 - protein, 9 aa, Homo Sapiens
VLNQALIPR

SEQ ID NO: 340605 - protein, 9 aa, Homo Sapiens
IDELITKWQ

SEQ ID NO: 340606 - protein, 9 aa, Homo Sapiens
LCPQAEVDR

SEQ ID NO: 340607 - protein, 9 aa, Homo Sapiens
GEIVLSFPA

SEQ ID NO: 340608 - protein, 9 aa, Homo Sapiens
ARNQYYQKS

SEQ ID NO: 340609 - protein, 9 aa, Homo Sapiens
AEEEEDKEE

SEQ ID NO: 340610 - protein, 9 aa, Homo Sapiens
RYFRVPELV

SEQ ID NO: 340611 - protein, 9 aa, Homo Sapiens
VNQNGQKVR

SEQ ID NO: 340612 - protein, 9 aa, Homo Sapiens
GFRISFSTT

SEQ ID NO: 340613 - protein, 9 aa, Homo Sapiens
SIDQNTGEI

SEQ ID NO: 340614 - protein, 9 aa, Homo Sapiens
PPSNVACSL

SEQ ID NO: 340615 - protein, 9 aa, Homo Sapiens
SESADNGWD

SEQ ID NO: 340616 - protein, 9 aa, Homo Sapiens
AIEVECIKA

SEQ ID NO: 340617 - protein, 9 aa, Homo Sapiens
LYDFRWMTA

SEQ ID NO: 340618 - protein, 9 aa, Homo Sapiens
NELVLHQSV

SEQ ID NO: 340619 - protein, 9 aa, Homo Sapiens
ILNKTRSFH

SEQ ID NO: 340620 - protein, 9 aa, Homo Sapiens
VTPGKKAAT

SEQ ID NO: 340621 - protein, 9 aa, Homo Sapiens
WLSLQDQVD

SEQ ID NO: 340622 - protein, 9 aa, Homo Sapiens
MNLSLNLGG

SEQ ID NO: 340623 - protein, 9 aa, Homo Sapiens
YAIMKMCWK

SEQ ID NO: 340624 - protein, 9 aa, Homo Sapiens
HHNYYFINY

SEQ ID NO: 340625 - protein, 9 aa, Homo Sapiens
LDNTDVALA

SEQ ID NO: 340626 - protein, 9 aa, Homo Sapiens
SQEPIKTFY

SEQ ID NO: 340627 - protein, 9 aa, Homo Sapiens
RDYFMSCPG

SEQ ID NO: 340628 - protein, 9 aa, Homo Sapiens
STLIMWRRD

SEQ ID NO: 340629 - protein, 9 aa, Homo Sapiens
KEIVVLIKL

SEQ ID NO: 340630 - protein, 9 aa, Homo Sapiens
DEYIDIGTL

SEQ ID NO: 340631 - protein, 9 aa, Homo Sapiens
WHWHFSQGF

SEQ ID NO: 340632 - protein, 9 aa, Homo Sapiens
QNLFGGKCL

SEQ ID NO: 340633 - protein, 9 aa, Homo Sapiens
ACQRSSKRK

SEQ ID NO: 340634 - protein, 9 aa, Homo Sapiens
GATSSHRTL

SEQ ID NO: 340635 - protein, 9 aa, Homo Sapiens
LKLKESVKE

SEQ ID NO: 340636 - protein, 9 aa, Homo Sapiens
PVIWAEVGN

SEQ ID NO: 340637 - protein, 9 aa, Homo Sapiens
ITDMKLSMN

SEQ ID NO: 340638 - protein, 9 aa, Homo Sapiens
LAIVHATHT

SEQ ID NO: 340639 - protein, 9 aa, Homo Sapiens
PDVECQACD

SEQ ID NO: 340640 - protein, 9 aa, Homo Sapiens
GTVEFLVEL

SEQ ID NO: 340641 - protein, 9 aa, Homo Sapiens
TPNEECLLL

SEQ ID NO: 340642 - protein, 9 aa, Homo Sapiens
NKENKITGI

SEQ ID NO: 340643 - protein, 9 aa, Homo Sapiens
LAPLVPEDL

SEQ ID NO: 340644 - protein, 9 aa, Homo Sapiens
CQKDWCCQS

SEQ ID NO: 340645 - protein, 9 aa, Homo Sapiens
VRTGLTQIP

SEQ ID NO: 340646 - protein, 9 aa, Homo Sapiens
ENGKEVIFA

SEQ ID NO: 340647 - protein, 9 aa, Homo Sapiens
IYAALTSSS

SEQ ID NO: 340648 - protein, 9 aa, Homo Sapiens
SNNSALEYQ

SEQ ID NO: 340649 - protein, 9 aa, Homo Sapiens
FRVPELVDF

SEQ ID NO: 340650 - protein, 9 aa, Homo Sapiens
RAESLSRSI

SEQ ID NO: 340651 - protein, 9 aa, Homo Sapiens
MNKMALTSF

SEQ ID NO: 340652 - protein, 9 aa, Homo Sapiens
KDYIQTQII

SEQ ID NO: 340653 - protein, 9 aa, Homo Sapiens
VGKECGKAF

SEQ ID NO: 340654 - protein, 9 aa, Homo Sapiens
ITITLGTKT

SEQ ID NO: 340655 - protein, 9 aa, Homo Sapiens
ESQNIKINE

SEQ ID NO: 340656 - protein, 9 aa, Homo Sapiens
YNHKTPEYN

SEQ ID NO: 340657 - protein, 9 aa, Homo Sapiens
DIQLSLKRL

SEQ ID NO: 340658 - protein, 9 aa, Homo Sapiens
NRRFEVSSY

SEQ ID NO: 340659 - protein, 9 aa, Homo Sapiens
DELSGWDKY

SEQ ID NO: 340660 - protein, 9 aa, Homo Sapiens
ANLYIFSRD

SEQ ID NO: 340661 - protein, 9 aa, Homo Sapiens
IIRTCQKFL

SEQ ID NO: 340662 - protein, 9 aa, Homo Sapiens
DPLGGQKFV

SEQ ID NO: 340663 - protein, 9 aa, Homo Sapiens
SPRNSQSGF

SEQ ID NO: 340664 - protein, 9 aa, Homo Sapiens
LSWIAKLEA

SEQ ID NO: 340665 - protein, 9 aa, Homo Sapiens
IPHLSSSKE

SEQ ID NO: 340666 - protein, 9 aa, Homo Sapiens
RGHPRGQPP

SEQ ID NO: 340667 - protein, 9 aa, Homo Sapiens
ETPPSVELE

SEQ ID NO: 340668 - protein, 9 aa, Homo Sapiens
VAILMLASK

SEQ ID NO: 340669 - protein, 9 aa, Homo Sapiens
NYDLTLWCD

SEQ ID NO: 340670 - protein, 9 aa, Homo Sapiens
SKPPNEEHR

SEQ ID NO: 340671 - protein, 9 aa, Homo Sapiens
ATSTDITVQ

SEQ ID NO: 340672 - protein, 9 aa, Homo Sapiens
HELIPAVIT

SEQ ID NO: 340673 - protein, 9 aa, Homo Sapiens
TSRKQQKER

SEQ ID NO: 340674 - protein, 9 aa, Homo Sapiens
NTAWGGEGS

SEQ ID NO: 340675 - protein, 9 aa, Homo Sapiens
IICTGEKPY

SEQ ID NO: 340676 - protein, 9 aa, Homo Sapiens
SKTTNDATG

SEQ ID NO: 340677 - protein, 9 aa, Homo Sapiens
AAAAGGKQR

SEQ ID NO: 340678 - protein, 9 aa, Homo Sapiens
ELLHMKALS

SEQ ID NO: 340679 - protein, 9 aa, Homo Sapiens
THRCICCPV

SEQ ID NO: 340680 - protein, 9 aa, Homo Sapiens
TKEEIVQLF

SEQ ID NO: 340681 - protein, 9 aa, Homo Sapiens
PVSTLSPNP

SEQ ID NO: 340682 - protein, 9 aa, Homo Sapiens
PTVDLVCCP

SEQ ID NO: 340683 - protein, 9 aa, Homo Sapiens
YYGLRDSHS

SEQ ID NO: 340684 - protein, 9 aa, Homo Sapiens
SQTVGIQKI

SEQ ID NO: 340685 - protein, 9 aa, Homo Sapiens
KLMKNIFCH

SEQ ID NO: 340686 - protein, 9 aa, Homo Sapiens
QRQACKKHK

SEQ ID NO: 340687 - protein, 9 aa, Homo Sapiens
TLKATIPPP

SEQ ID NO: 340688 - protein, 9 aa, Homo Sapiens
ESLLSDPGP

SEQ ID NO: 340689 - protein, 9 aa, Homo Sapiens
LNNICSIYN

SEQ ID NO: 340690 - protein, 9 aa, Homo Sapiens
GVSHKARGE

SEQ ID NO: 340691 - protein, 9 aa, Homo Sapiens
LGLKGNEGS

SEQ ID NO: 340692 - protein, 9 aa, Homo Sapiens
VIRFFIKGK

SEQ ID NO: 340693 - protein, 9 aa, Homo Sapiens
GTKVYKSLI

SEQ ID NO: 340694 - protein, 9 aa, Homo Sapiens
CMESSKLGM

SEQ ID NO: 340695 - protein, 9 aa, Homo Sapiens
MYKLAKKGL

SEQ ID NO: 340696 - protein, 9 aa, Homo Sapiens
AIATILFFF

SEQ ID NO: 340697 - protein, 9 aa, Homo Sapiens
IFQDVKWSD

SEQ ID NO: 340698 - protein, 9 aa, Homo Sapiens
VKGTKSSQP

SEQ ID NO: 340699 - protein, 9 aa, Homo Sapiens
SGQTVDDFK

SEQ ID NO: 340700 - protein, 9 aa, Homo Sapiens
WEDNWDNDN

SEQ ID NO: 340701 - protein, 9 aa, Homo Sapiens
ETKTKDKLT

SEQ ID NO: 340702 - protein, 9 aa, Homo Sapiens
VVDFFHKYF

SEQ ID NO: 340703 - protein, 9 aa, Homo Sapiens
YLEKQCLKM

SEQ ID NO: 340704 - protein, 9 aa, Homo Sapiens
QPIVHNLFV

SEQ ID NO: 340705 - protein, 9 aa, Homo Sapiens
LEQDNAELE

SEQ ID NO: 340706 - protein, 9 aa, Homo Sapiens
AIINEIYFT

SEQ ID NO: 340707 - protein, 9 aa, Homo Sapiens
YKVVITLWL

SEQ ID NO: 340708 - protein, 9 aa, Homo Sapiens
GTFSIAVVH

SEQ ID NO: 340709 - protein, 9 aa, Homo Sapiens
LSHLLEEIK

SEQ ID NO: 340710 - protein, 9 aa, Homo Sapiens
GSEWGLWWQ

SEQ ID NO: 340711 - protein, 9 aa, Homo Sapiens
THEKIHTGE

SEQ ID NO: 340712 - protein, 9 aa, Homo Sapiens
SLTADKDEE

SEQ ID NO: 340713 - protein, 9 aa, Homo Sapiens
RISPQSRGT

SEQ ID NO: 340714 - protein, 9 aa, Homo Sapiens
KAHHDIVQF

SEQ ID NO: 340715 - protein, 9 aa, Homo Sapiens
ALEASFSSS

SEQ ID NO: 340716 - protein, 9 aa, Homo Sapiens
WALALAYRQ

SEQ ID NO: 340717 - protein, 9 aa, Homo Sapiens
SDRINSGAT

SEQ ID NO: 340718 - protein, 9 aa, Homo Sapiens
KLEQKSPDL

SEQ ID NO: 340719 - protein, 9 aa, Homo Sapiens
LKQLSTAND

SEQ ID NO: 340720 - protein, 9 aa, Homo Sapiens
LSQTPADGR

SEQ ID NO: 340721 - protein, 9 aa, Homo Sapiens
MNLIGMMLL

SEQ ID NO: 340722 - protein, 9 aa, Homo Sapiens
IGSLDVKKV

SEQ ID NO: 340723 - protein, 9 aa, Homo Sapiens
HPHQFCSPG

SEQ ID NO: 340724 - protein, 9 aa, Homo Sapiens
PLCEKISKI

SEQ ID NO: 340725 - protein, 9 aa, Homo Sapiens
RVRKMINVY

SEQ ID NO: 340726 - protein, 9 aa, Homo Sapiens
GLDVRKTAF

SEQ ID NO: 340727 - protein, 9 aa, Homo Sapiens
GYMLEWVCL

SEQ ID NO: 340728 - protein, 9 aa, Homo Sapiens
KSQVSKHQI

SEQ ID NO: 340729 - protein, 9 aa, Homo Sapiens
APFSSIWGE

SEQ ID NO: 340730 - protein, 9 aa, Homo Sapiens
MLEKDILSL

SEQ ID NO: 340731 - protein, 9 aa, Homo Sapiens
LTLRPRCIN

SEQ ID NO: 340732 - protein, 9 aa, Homo Sapiens
TFSVSSALT

SEQ ID NO: 340733 - protein, 9 aa, Homo Sapiens
GRNRELAIL

SEQ ID NO: 340734 - protein, 9 aa, Homo Sapiens
INHLYIKQQ

SEQ ID NO: 340735 - protein, 9 aa, Homo Sapiens
ISVKVMLKN

SEQ ID NO: 340736 - protein, 9 aa, Homo Sapiens
TEGLITLTY

SEQ ID NO: 340737 - protein, 9 aa, Homo Sapiens
KYQKLYTYI

SEQ ID NO: 340738 - protein, 9 aa, Homo Sapiens
TDNPHISDD

SEQ ID NO: 340739 - protein, 9 aa, Homo Sapiens
VASELLIRC

SEQ ID NO: 340740 - protein, 9 aa, Homo Sapiens
TGWRGRPRG

SEQ ID NO: 340741 - protein, 9 aa, Homo Sapiens
HLVLKRFPR

SEQ ID NO: 340742 - protein, 9 aa, Homo Sapiens
SIRTHEKIH

SEQ ID NO: 340743 - protein, 9 aa, Homo Sapiens
LQTEGRTQN

SEQ ID NO: 340744 - protein, 9 aa, Homo Sapiens
FFKIIQNEG

SEQ ID NO: 340745 - protein, 9 aa, Homo Sapiens
RQNFLQNVK

SEQ ID NO: 340746 - protein, 9 aa, Homo Sapiens
DLEVEQALK

SEQ ID NO: 340747 - protein, 9 aa, Homo Sapiens
VVHHLGHNL

SEQ ID NO: 340748 - protein, 9 aa, Homo Sapiens
FVIGIDLWS

SEQ ID NO: 340749 - protein, 9 aa, Homo Sapiens
QPQCPVGLN

SEQ ID NO: 340750 - protein, 9 aa, Homo Sapiens
CIKIGSTVE

SEQ ID NO: 340751 - protein, 9 aa, Homo Sapiens
GYIRSHYNL

SEQ ID NO: 340752 - protein, 9 aa, Homo Sapiens
RLDLQNNLI

SEQ ID NO: 340753 - protein, 9 aa, Homo Sapiens
TSFLESLKK

SEQ ID NO: 340754 - protein, 9 aa, Homo Sapiens
LCTYQEGKE

SEQ ID NO: 340755 - protein, 9 aa, Homo Sapiens
IWKKAVQFG

SEQ ID NO: 340756 - protein, 9 aa, Homo Sapiens
VSVGTIVGI

SEQ ID NO: 340757 - protein, 9 aa, Homo Sapiens
NSFKYLLDQ

SEQ ID NO: 340758 - protein, 9 aa, Homo Sapiens
VTVKIISKK

SEQ ID NO: 340759 - protein, 9 aa, Homo Sapiens
VLDVLEGQT

SEQ ID NO: 340760 - protein, 9 aa, Homo Sapiens
SAMIKYLSQ

SEQ ID NO: 340761 - protein, 9 aa, Homo Sapiens
RPIILVGPP

SEQ ID NO: 340762 - protein, 9 aa, Homo Sapiens
DKFRINILS

SEQ ID NO: 340763 - protein, 9 aa, Homo Sapiens
KTDQKEFVR

SEQ ID NO: 340764 - protein, 9 aa, Homo Sapiens
KSCRLYKHL

SEQ ID NO: 340765 - protein, 9 aa, Homo Sapiens
RINENVLGA

SEQ ID NO: 340766 - protein, 9 aa, Homo Sapiens
DITYIFTFL

SEQ ID NO: 340767 - protein, 9 aa, Homo Sapiens
NVIFYSKIT

SEQ ID NO: 340768 - protein, 9 aa, Homo Sapiens
LLDVSLKFS

SEQ ID NO: 340769 - protein, 9 aa, Homo Sapiens
QLSVFKVVP

SEQ ID NO: 340770 - protein, 9 aa, Homo Sapiens
QHQNIHTGE

SEQ ID NO: 340771 - protein, 9 aa, Homo Sapiens
ESQNDISLI

SEQ ID NO: 340772 - protein, 9 aa, Homo Sapiens
HNYFCKCGD

SEQ ID NO: 340773 - protein, 9 aa, Homo Sapiens
LCLFFNHGE

SEQ ID NO: 340774 - protein, 9 aa, Homo Sapiens
LSANTSQGK

SEQ ID NO: 340775 - protein, 9 aa, Homo Sapiens
GDYWIVVKI

SEQ ID NO: 340776 - protein, 9 aa, Homo Sapiens
TNTCTTCQI

SEQ ID NO: 340777 - protein, 9 aa, Homo Sapiens
QEKELQKEK

SEQ ID NO: 340778 - protein, 9 aa, Homo Sapiens
HKILHTKEK

SEQ ID NO: 340779 - protein, 9 aa, Homo Sapiens
AHWTKLQHF

SEQ ID NO: 340780 - protein, 9 aa, Homo Sapiens
WVRKVFINT

SEQ ID NO: 340781 - protein, 9 aa, Homo Sapiens
GVLLDYDSN

SEQ ID NO: 340782 - protein, 9 aa, Homo Sapiens
RACLAMLEK

SEQ ID NO: 340783 - protein, 9 aa, Homo Sapiens
HGSAAEQLL

SEQ ID NO: 340784 - protein, 9 aa, Homo Sapiens
ILLAVNWLL

SEQ ID NO: 340785 - protein, 9 aa, Homo Sapiens
NGSSMKPQA

SEQ ID NO: 340786 - protein, 9 aa, Homo Sapiens
RCCAKFFEL

SEQ ID NO: 340787 - protein, 9 aa, Homo Sapiens
NGYDTRSEA

SEQ ID NO: 340788 - protein, 9 aa, Homo Sapiens
CGKGFTHRN

SEQ ID NO: 340789 - protein, 9 aa, Homo Sapiens
CKVTADKLM

SEQ ID NO: 340790 - protein, 9 aa, Homo Sapiens
LSEEVTFQI

SEQ ID NO: 340791 - protein, 9 aa, Homo Sapiens
KTAAATKTI

SEQ ID NO: 340792 - protein, 9 aa, Homo Sapiens
HQNGCISIW

SEQ ID NO: 340793 - protein, 9 aa, Homo Sapiens
VLRSKACHI

SEQ ID NO: 340794 - protein, 9 aa, Homo Sapiens
SIFRVVGNL

SEQ ID NO: 340795 - protein, 9 aa, Homo Sapiens
KSVFFGPDL

SEQ ID NO: 340796 - protein, 9 aa, Homo Sapiens
LIRQIECLP

SEQ ID NO: 340797 - protein, 9 aa, Homo Sapiens
KEEHQFFEI

SEQ ID NO: 340798 - protein, 9 aa, Homo Sapiens
YYFRGVEVT

SEQ ID NO: 340799 - protein, 9 aa, Homo Sapiens
SSQGQFSVQ

SEQ ID NO: 340800 - protein, 9 aa, Homo Sapiens
FAGLVDTEC

SEQ ID NO: 340801 - protein, 9 aa, Homo Sapiens
KNIQFPLMT

SEQ ID NO: 340802 - protein, 9 aa, Homo Sapiens
QNVLQSEKE

SEQ ID NO: 340803 - protein, 9 aa, Homo Sapiens
RRDHGPQSF

SEQ ID NO: 340804 - protein, 9 aa, Homo Sapiens
SPKQQYKPD

SEQ ID NO: 340805 - protein, 9 aa, Homo Sapiens
LEKMSKDCS

SEQ ID NO: 340806 - protein, 9 aa, Homo Sapiens
EQVCTIVKK

SEQ ID NO: 340807 - protein, 9 aa, Homo Sapiens
VGKLSFVTQ

SEQ ID NO: 340808 - protein, 9 aa, Homo Sapiens
KMAKDRINH

SEQ ID NO: 340809 - protein, 9 aa, Homo Sapiens
QPPEKRRIT

SEQ ID NO: 340810 - protein, 9 aa, Homo Sapiens
HTDVCQGSL

SEQ ID NO: 340811 - protein, 9 aa, Homo Sapiens
DMLLQHQIC

SEQ ID NO: 340812 - protein, 9 aa, Homo Sapiens
KCLNELKLS

SEQ ID NO: 340813 - protein, 9 aa, Homo Sapiens
AMRWAFRGP

SEQ ID NO: 340814 - protein, 9 aa, Homo Sapiens
HDGGVYRCT

SEQ ID NO: 340815 - protein, 9 aa, Homo Sapiens
QQLSSLTNL

SEQ ID NO: 340816 - protein, 9 aa, Homo Sapiens
ATSKKNVCV

SEQ ID NO: 340817 - protein, 9 aa, Homo Sapiens
IQSPAMSGG

SEQ ID NO: 340818 - protein, 9 aa, Homo Sapiens
KENWKRSQH

SEQ ID NO: 340819 - protein, 9 aa, Homo Sapiens
ASASLTSQV

SEQ ID NO: 340820 - protein, 9 aa, Homo Sapiens
PENYSKKDK

SEQ ID NO: 340821 - protein, 9 aa, Homo Sapiens
EEVCLDLEY

SEQ ID NO: 340822 - protein, 9 aa, Homo Sapiens
SQTAQRSAL

SEQ ID NO: 340823 - protein, 9 aa, Homo Sapiens
SSGKIKRTV

SEQ ID NO: 340824 - protein, 9 aa, Homo Sapiens
MDDNYFVNY

SEQ ID NO: 340825 - protein, 9 aa, Homo Sapiens
STRDKLNYS

SEQ ID NO: 340826 - protein, 9 aa, Homo Sapiens
RFCWHQIRT

SEQ ID NO: 340827 - protein, 9 aa, Homo Sapiens
LQPINTHQT

SEQ ID NO: 340828 - protein, 9 aa, Homo Sapiens
KKCSVSGCN

SEQ ID NO: 340829 - protein, 9 aa, Homo Sapiens
PEVISNTKE

SEQ ID NO: 340830 - protein, 9 aa, Homo Sapiens
LEDSDDKEK

SEQ ID NO: 340831 - protein, 9 aa, Homo Sapiens
IQQPLKNPS

SEQ ID NO: 340832 - protein, 9 aa, Homo Sapiens
LSPVEEFVP

SEQ ID NO: 340833 - protein, 9 aa, Homo Sapiens
YGADHMAQL

SEQ ID NO: 340834 - protein, 9 aa, Homo Sapiens
FAKWFEELQ

SEQ ID NO: 340835 - protein, 9 aa, Homo Sapiens
EFLPPIRGH

SEQ ID NO: 340836 - protein, 9 aa, Homo Sapiens
QPASRPPAS

SEQ ID NO: 340837 - protein, 9 aa, Homo Sapiens
GPGTCLKSL

SEQ ID NO: 340838 - protein, 9 aa, Homo Sapiens
KSSKAKEVT

SEQ ID NO: 340839 - protein, 9 aa, Homo Sapiens
ILDKCNDII

SEQ ID NO: 340840 - protein, 9 aa, Homo Sapiens
SLWLQGLRM

SEQ ID NO: 340841 - protein, 9 aa, Homo Sapiens
AANNVFPPP

SEQ ID NO: 340842 - protein, 9 aa, Homo Sapiens
LWSLWDTFK

SEQ ID NO: 340843 - protein, 9 aa, Homo Sapiens
SCSENCLSA

SEQ ID NO: 340844 - protein, 9 aa, Homo Sapiens
GVTVDLYIL

SEQ ID NO: 340845 - protein, 9 aa, Homo Sapiens
VLWNWESSI

SEQ ID NO: 340846 - protein, 9 aa, Homo Sapiens
KKRQKRNNR

SEQ ID NO: 340847 - protein, 9 aa, Homo Sapiens
KIDVVKRKL

SEQ ID NO: 340848 - protein, 9 aa, Homo Sapiens
VVKVLSSGK

SEQ ID NO: 340849 - protein, 9 aa, Homo Sapiens
YIYAQSLWQ

SEQ ID NO: 340850 - protein, 9 aa, Homo Sapiens
EEGPKHLYG

SEQ ID NO: 340851 - protein, 9 aa, Homo Sapiens
VHDIRNYPY

SEQ ID NO: 340852 - protein, 9 aa, Homo Sapiens
KTFSQSSQG

SEQ ID NO: 340853 - protein, 9 aa, Homo Sapiens
DRVKRLSVS

SEQ ID NO: 340854 - protein, 9 aa, Homo Sapiens
KLKECLKTA

SEQ ID NO: 340855 - protein, 9 aa, Homo Sapiens
VERLTAREY

SEQ ID NO: 340856 - protein, 9 aa, Homo Sapiens
VINEDKWKP

SEQ ID NO: 340857 - protein, 9 aa, Homo Sapiens
HIKHSHHDK

SEQ ID NO: 340858 - protein, 9 aa, Homo Sapiens
GWNPVWLYE

SEQ ID NO: 340859 - protein, 9 aa, Homo Sapiens
HTAKVNCLS

SEQ ID NO: 340860 - protein, 9 aa, Homo Sapiens
EKFYRQSVR

SEQ ID NO: 340861 - protein, 9 aa, Homo Sapiens
SLKDEFTQI

SEQ ID NO: 340862 - protein, 9 aa, Homo Sapiens
VYIHDNAKF

SEQ ID NO: 340863 - protein, 9 aa, Homo Sapiens
TYECSGCGK

SEQ ID NO: 340864 - protein, 9 aa, Homo Sapiens
TQSASKQGL

SEQ ID NO: 340865 - protein, 9 aa, Homo Sapiens
QYNAVVGAG

SEQ ID NO: 340866 - protein, 9 aa, Homo Sapiens
ALRSWRINM

SEQ ID NO: 340867 - protein, 9 aa, Homo Sapiens
MKEGTSTFA

SEQ ID NO: 340868 - protein, 9 aa, Homo Sapiens
QQREGPKGC

SEQ ID NO: 340869 - protein, 9 aa, Homo Sapiens
KKELIEDDS

SEQ ID NO: 340870 - protein, 9 aa, Homo Sapiens
HFLFYWNLY

SEQ ID NO: 340871 - protein, 9 aa, Homo Sapiens
FSRYPKGYV

SEQ ID NO: 340872 - protein, 9 aa, Homo Sapiens
PYNLTILIY

SEQ ID NO: 340873 - protein, 9 aa, Homo Sapiens
NEHKIIHAG

SEQ ID NO: 340874 - protein, 9 aa, Homo Sapiens
SCRCKSGYT

SEQ ID NO: 340875 - protein, 9 aa, Homo Sapiens
HSMQIEQIK

SEQ ID NO: 340876 - protein, 9 aa, Homo Sapiens
PQSDTPEIC

SEQ ID NO: 340877 - protein, 9 aa, Homo Sapiens
LSGIFTTGI

SEQ ID NO: 340878 - protein, 9 aa, Homo Sapiens
YGGRGKREG

SEQ ID NO: 340879 - protein, 9 aa, Homo Sapiens
VCRHNKDTF

SEQ ID NO: 340880 - protein, 9 aa, Homo Sapiens
TKQKVMVTV

SEQ ID NO: 340881 - protein, 9 aa, Homo Sapiens
PLLCKTSKK

SEQ ID NO: 340882 - protein, 9 aa, Homo Sapiens
AASVIGYLT

SEQ ID NO: 340883 - protein, 9 aa, Homo Sapiens
MEQEREGLS

SEQ ID NO: 340884 - protein, 9 aa, Homo Sapiens
QNNRTPLVM

SEQ ID NO: 340885 - protein, 9 aa, Homo Sapiens
VLMWLKRGL

SEQ ID NO: 340886 - protein, 9 aa, Homo Sapiens
EIEFLMKDG

SEQ ID NO: 340887 - protein, 9 aa, Homo Sapiens
AYIFKELQK

SEQ ID NO: 340888 - protein, 9 aa, Homo Sapiens
VSLTPATFN

SEQ ID NO: 340889 - protein, 9 aa, Homo Sapiens
NNSRLVSKK

SEQ ID NO: 340890 - protein, 9 aa, Homo Sapiens
LFGMRICQN

SEQ ID NO: 340891 - protein, 9 aa, Homo Sapiens
PEELDKLQC

SEQ ID NO: 340892 - protein, 9 aa, Homo Sapiens
GEHVLNFQN

SEQ ID NO: 340893 - protein, 9 aa, Homo Sapiens
NVYKPDWCE

SEQ ID NO: 340894 - protein, 9 aa, Homo Sapiens
VTSPALRGH

SEQ ID NO: 340895 - protein, 9 aa, Homo Sapiens
LKECVQLVC

SEQ ID NO: 340896 - protein, 9 aa, Homo Sapiens
GADHMAQLQ

SEQ ID NO: 340897 - protein, 9 aa, Homo Sapiens
KSVRLYLVV

SEQ ID NO: 340898 - protein, 9 aa, Homo Sapiens
PPGRCISCD

SEQ ID NO: 340899 - protein, 9 aa, Homo Sapiens
EEERIWKER

SEQ ID NO: 340900 - protein, 9 aa, Homo Sapiens
LEKSGQIFC

SEQ ID NO: 340901 - protein, 9 aa, Homo Sapiens
GTPSISTNQ

SEQ ID NO: 340902 - protein, 9 aa, Homo Sapiens
PTKGIHEYN

SEQ ID NO: 340903 - protein, 9 aa, Homo Sapiens
YPDNFFLLR

SEQ ID NO: 340904 - protein, 9 aa, Homo Sapiens
SSIQKLNCL

SEQ ID NO: 340905 - protein, 9 aa, Homo Sapiens
MLFELLKNA

SEQ ID NO: 340906 - protein, 9 aa, Homo Sapiens
RIATTIIII

SEQ ID NO: 340907 - protein, 9 aa, Homo Sapiens
EHGFQKGGE

SEQ ID NO: 340908 - protein, 9 aa, Homo Sapiens
AGRFHSTAK

SEQ ID NO: 340909 - protein, 9 aa, Homo Sapiens
RIRVVFQIS

SEQ ID NO: 340910 - protein, 9 aa, Homo Sapiens
ENAELESHI

SEQ ID NO: 340911 - protein, 9 aa, Homo Sapiens
SHLIIHTGE

SEQ ID NO: 340912 - protein, 9 aa, Homo Sapiens
LSHLKSEAK

SEQ ID NO: 340913 - protein, 9 aa, Homo Sapiens
SPDIFKKSK

SEQ ID NO: 340914 - protein, 9 aa, Homo Sapiens
PAFDCPMNQ

SEQ ID NO: 340915 - protein, 9 aa, Homo Sapiens
SDQNKQVLE

SEQ ID NO: 340916 - protein, 9 aa, Homo Sapiens
YHRIIKIEG

SEQ ID NO: 340917 - protein, 9 aa, Homo Sapiens
DAPSPASSL

SEQ ID NO: 340918 - protein, 9 aa, Homo Sapiens
IKTLQADFN

SEQ ID NO: 340919 - protein, 9 aa, Homo Sapiens
LYLQEQGIH

SEQ ID NO: 340920 - protein, 9 aa, Homo Sapiens
RDKLTELMF

SEQ ID NO: 340921 - protein, 9 aa, Homo Sapiens
LPKFADWAQ

SEQ ID NO: 340922 - protein, 9 aa, Homo Sapiens
SDMQWKVRQ

SEQ ID NO: 340923 - protein, 9 aa, Homo Sapiens
DLHPGHILV

SEQ ID NO: 340924 - protein, 9 aa, Homo Sapiens
VSLMNRGCE

SEQ ID NO: 340925 - protein, 9 aa, Homo Sapiens
FWWTNRNGE

SEQ ID NO: 340926 - protein, 9 aa, Homo Sapiens
VRWEIQQNS

SEQ ID NO: 340927 - protein, 9 aa, Homo Sapiens
HFCDVKDET

SEQ ID NO: 340928 - protein, 9 aa, Homo Sapiens
GGLGYGCAG

SEQ ID NO: 340929 - protein, 9 aa, Homo Sapiens
LSIFEFNQS

SEQ ID NO: 340930 - protein, 9 aa, Homo Sapiens
YHQQTHTGE

SEQ ID NO: 340931 - protein, 9 aa, Homo Sapiens
GRDTNRPLE

SEQ ID NO: 340932 - protein, 9 aa, Homo Sapiens
GEDWNLVMY

SEQ ID NO: 340933 - protein, 9 aa, Homo Sapiens
AKKTKKGAT

SEQ ID NO: 340934 - protein, 9 aa, Homo Sapiens
DLIVSINHQ

SEQ ID NO: 340935 - protein, 9 aa, Homo Sapiens
NLVLHMVDG

SEQ ID NO: 340936 - protein, 9 aa, Homo Sapiens
ARRSSFEKH

SEQ ID NO: 340937 - protein, 9 aa, Homo Sapiens
PDNFFLLRG

SEQ ID NO: 340938 - protein, 9 aa, Homo Sapiens
KRHRKKLIL

SEQ ID NO: 340939 - protein, 9 aa, Homo Sapiens
RYEAACHRL

SEQ ID NO: 340940 - protein, 9 aa, Homo Sapiens
FLNSYNGHR

SEQ ID NO: 340941 - protein, 9 aa, Homo Sapiens
FKESPLNHN

SEQ ID NO: 340942 - protein, 9 aa, Homo Sapiens
IFCGYKISR

SEQ ID NO: 340943 - protein, 9 aa, Homo Sapiens
ALKFPNCQC

SEQ ID NO: 340944 - protein, 9 aa, Homo Sapiens
NVHLVSHLI

SEQ ID NO: 340945 - protein, 9 aa, Homo Sapiens
VSYCTREEI

SEQ ID NO: 340946 - protein, 9 aa, Homo Sapiens
LMRSGVFTD

SEQ ID NO: 340947 - protein, 9 aa, Homo Sapiens
DIKDSISHE

SEQ ID NO: 340948 - protein, 9 aa, Homo Sapiens
CGISPILKL

SEQ ID NO: 340949 - protein, 9 aa, Homo Sapiens
VLFVSDLFK

SEQ ID NO: 340950 - protein, 9 aa, Homo Sapiens
AEVAVSVIL

SEQ ID NO: 340951 - protein, 9 aa, Homo Sapiens
GKAFNLFSS

SEQ ID NO: 340952 - protein, 9 aa, Homo Sapiens
QNIQNVLVD

SEQ ID NO: 340953 - protein, 9 aa, Homo Sapiens
TDALALSVT

SEQ ID NO: 340954 - protein, 9 aa, Homo Sapiens
LQRSDKELE

SEQ ID NO: 340955 - protein, 9 aa, Homo Sapiens
IFRNPKEPD

SEQ ID NO: 340956 - protein, 9 aa, Homo Sapiens
QKVWMANEG

SEQ ID NO: 340957 - protein, 9 aa, Homo Sapiens
LPGHSKCSS

SEQ ID NO: 340958 - protein, 9 aa, Homo Sapiens
PAVTSSSEI

SEQ ID NO: 340959 - protein, 9 aa, Homo Sapiens
SSFSWWSFT

SEQ ID NO: 340960 - protein, 9 aa, Homo Sapiens
HRQQHFEKR

SEQ ID NO: 340961 - protein, 9 aa, Homo Sapiens
SRNNMLLAT

SEQ ID NO: 340962 - protein, 9 aa, Homo Sapiens
LDATEKDLS

SEQ ID NO: 340963 - protein, 9 aa, Homo Sapiens
KGAWGPRES

SEQ ID NO: 340964 - protein, 9 aa, Homo Sapiens
GAEALTPLI

SEQ ID NO: 340965 - protein, 9 aa, Homo Sapiens
RQAFNTELQ

SEQ ID NO: 340966 - protein, 9 aa, Homo Sapiens
VTLFLFLLS

SEQ ID NO: 340967 - protein, 9 aa, Homo Sapiens
RILNRSKIG

SEQ ID NO: 340968 - protein, 9 aa, Homo Sapiens
DLMTKAEVT

SEQ ID NO: 340969 - protein, 9 aa, Homo Sapiens
SRFQMPVSS

SEQ ID NO: 340970 - protein, 9 aa, Homo Sapiens
NCDKTGCSK

SEQ ID NO: 340971 - protein, 9 aa, Homo Sapiens
FEEIATQFQ

SEQ ID NO: 340972 - protein, 9 aa, Homo Sapiens
QEYITVVKK

SEQ ID NO: 340973 - protein, 9 aa, Homo Sapiens
KYCQVAPLT

SEQ ID NO: 340974 - protein, 9 aa, Homo Sapiens
NYLSGDITI

SEQ ID NO: 340975 - protein, 9 aa, Homo Sapiens
QHMHTGERP

SEQ ID NO: 340976 - protein, 9 aa, Homo Sapiens
HAPFSSIWG

SEQ ID NO: 340977 - protein, 9 aa, Homo Sapiens
TQAICTGTK

SEQ ID NO: 340978 - protein, 9 aa, Homo Sapiens
LENKRAAAK

SEQ ID NO: 340979 - protein, 9 aa, Homo Sapiens
CMGFGFISM

SEQ ID NO: 340980 - protein, 9 aa, Homo Sapiens
ALGFAFHKD

SEQ ID NO: 340981 - protein, 9 aa, Homo Sapiens
ANHWIIHNE

SEQ ID NO: 340982 - protein, 9 aa, Homo Sapiens
QDIFNRSLM

SEQ ID NO: 340983 - protein, 9 aa, Homo Sapiens
WAGGVFLVA

SEQ ID NO: 340984 - protein, 9 aa, Homo Sapiens
HKIIYTREN

SEQ ID NO: 340985 - protein, 9 aa, Homo Sapiens
LQENHNNQG

SEQ ID NO: 340986 - protein, 9 aa, Homo Sapiens
MNLMTSAVP

SEQ ID NO: 340987 - protein, 9 aa, Homo Sapiens
QLNTRSSQN

SEQ ID NO: 340988 - protein, 9 aa, Homo Sapiens
LLENGKEVI

SEQ ID NO: 340989 - protein, 9 aa, Homo Sapiens
IKHSHHDKH

SEQ ID NO: 340990 - protein, 9 aa, Homo Sapiens
GIQLQCFMK

SEQ ID NO: 340991 - protein, 9 aa, Homo Sapiens
QFQDVTRAG

SEQ ID NO: 340992 - protein, 9 aa, Homo Sapiens
AQMKIQRAH

SEQ ID NO: 340993 - protein, 9 aa, Homo Sapiens
IVDVNKPII

SEQ ID NO: 340994 - protein, 9 aa, Homo Sapiens
MWKGELYRQ

SEQ ID NO: 340995 - protein, 9 aa, Homo Sapiens
IDVSYSNIN

SEQ ID NO: 340996 - protein, 9 aa, Homo Sapiens
AKGGRRRKQ

SEQ ID NO: 340997 - protein, 9 aa, Homo Sapiens
WQGLLTAHG

SEQ ID NO: 340998 - protein, 9 aa, Homo Sapiens
SQIGGRVKT

SEQ ID NO: 340999 - protein, 9 aa, Homo Sapiens
CSSSLCDHE

SEQ ID NO: 341000 - protein, 9 aa, Homo Sapiens
ECIIKVQDI

SEQ ID NO: 341001 - protein, 9 aa, Homo Sapiens
IIQRKKEFW

SEQ ID NO: 341002 - protein, 9 aa, Homo Sapiens
RYPKGYVQD

SEQ ID NO: 341003 - protein, 9 aa, Homo Sapiens
PFYCSPATP

SEQ ID NO: 341004 - protein, 9 aa, Homo Sapiens
MINVYKPDW

SEQ ID NO: 341005 - protein, 9 aa, Homo Sapiens
PQTYKDHLE

SEQ ID NO: 341006 - protein, 9 aa, Homo Sapiens
QLFITCSKC

SEQ ID NO: 341007 - protein, 9 aa, Homo Sapiens
ELPARILCG

SEQ ID NO: 341008 - protein, 9 aa, Homo Sapiens
GVIQQGAGA

SEQ ID NO: 341009 - protein, 9 aa, Homo Sapiens
LKVESPARV

SEQ ID NO: 341010 - protein, 9 aa, Homo Sapiens
TALFCKVHG

SEQ ID NO: 341011 - protein, 9 aa, Homo Sapiens
KIHQSKNKW

SEQ ID NO: 341012 - protein, 9 aa, Homo Sapiens
QWSNLSSLQ

SEQ ID NO: 341013 - protein, 9 aa, Homo Sapiens
VKKATVNSP

SEQ ID NO: 341014 - protein, 9 aa, Homo Sapiens
LPEGIPSIL

SEQ ID NO: 341015 - protein, 9 aa, Homo Sapiens
RRQQYPSPG

SEQ ID NO: 341016 - protein, 9 aa, Homo Sapiens
MQVITSPSK

SEQ ID NO: 341017 - protein, 9 aa, Homo Sapiens
KTSDMVLKI

SEQ ID NO: 341018 - protein, 9 aa, Homo Sapiens
PWYKETTYQ

SEQ ID NO: 341019 - protein, 9 aa, Homo Sapiens
NELQTEVSR

SEQ ID NO: 341020 - protein, 9 aa, Homo Sapiens
SIFEFNQSL

SEQ ID NO: 341021 - protein, 9 aa, Homo Sapiens
LQLLASDLQ

SEQ ID NO: 341022 - protein, 9 aa, Homo Sapiens
MANMVPSVT

SEQ ID NO: 341023 - protein, 9 aa, Homo Sapiens
SKLNEDSDL

SEQ ID NO: 341024 - protein, 9 aa, Homo Sapiens
LQSEKETRN

SEQ ID NO: 341025 - protein, 9 aa, Homo Sapiens
RCVVCVSQL

SEQ ID NO: 341026 - protein, 9 aa, Homo Sapiens
WLRNNPIKS

SEQ ID NO: 341027 - protein, 9 aa, Homo Sapiens
YKKKKNNLG

SEQ ID NO: 341028 - protein, 9 aa, Homo Sapiens
LKVLDQVLY

SEQ ID NO: 341029 - protein, 9 aa, Homo Sapiens
DEEKEKNEN

SEQ ID NO: 341030 - protein, 9 aa, Homo Sapiens
SSPSYKFIL

SEQ ID NO: 341031 - protein, 9 aa, Homo Sapiens
FNKGLDRIF

SEQ ID NO: 341032 - protein, 9 aa, Homo Sapiens
QRVPRGEII

SEQ ID NO: 341033 - protein, 9 aa, Homo Sapiens
RTSLKIWNV

SEQ ID NO: 341034 - protein, 9 aa, Homo Sapiens
NQNKPLSCV

SEQ ID NO: 341035 - protein, 9 aa, Homo Sapiens
LSKLEELEE

SEQ ID NO: 341036 - protein, 9 aa, Homo Sapiens
KKTTLLLHP

SEQ ID NO: 341037 - protein, 9 aa, Homo Sapiens
ISDSKKKEL

SEQ ID NO: 341038 - protein, 9 aa, Homo Sapiens
FAESHNQID

SEQ ID NO: 341039 - protein, 9 aa, Homo Sapiens
YKSRAEAKQ

SEQ ID NO: 341040 - protein, 9 aa, Homo Sapiens
LTEQLQKLV

SEQ ID NO: 341041 - protein, 9 aa, Homo Sapiens
GKMLRCTKR

SEQ ID NO: 341042 - protein, 9 aa, Homo Sapiens
ITASLFKKS

SEQ ID NO: 341043 - protein, 9 aa, Homo Sapiens
ELFLGLALM

SEQ ID NO: 341044 - protein, 9 aa, Homo Sapiens
NSIRSYCEK

SEQ ID NO: 341045 - protein, 9 aa, Homo Sapiens
WQSARRKRK

SEQ ID NO: 341046 - protein, 9 aa, Homo Sapiens
IKEYVHIHN

SEQ ID NO: 341047 - protein, 9 aa, Homo Sapiens
GNIIAYDNS

SEQ ID NO: 341048 - protein, 9 aa, Homo Sapiens
EHISTSINF

SEQ ID NO: 341049 - protein, 9 aa, Homo Sapiens
VGLCLISFL

SEQ ID NO: 341050 - protein, 9 aa, Homo Sapiens
TCSGFLYCS

SEQ ID NO: 341051 - protein, 9 aa, Homo Sapiens
TTLFTLEGR

SEQ ID NO: 341052 - protein, 9 aa, Homo Sapiens
MSKYTVVFY

SEQ ID NO: 341053 - protein, 9 aa, Homo Sapiens
GEIITGVNS

SEQ ID NO: 341054 - protein, 9 aa, Homo Sapiens
NDITEGINE

SEQ ID NO: 341055 - protein, 9 aa, Homo Sapiens
TFSQSSQGE

SEQ ID NO: 341056 - protein, 9 aa, Homo Sapiens
NNSSLISPL

SEQ ID NO: 341057 - protein, 9 aa, Homo Sapiens
QAITVTALL

SEQ ID NO: 341058 - protein, 9 aa, Homo Sapiens
KEEERFIES

SEQ ID NO: 341059 - protein, 9 aa, Homo Sapiens
SVDGPGTCL

SEQ ID NO: 341060 - protein, 9 aa, Homo Sapiens
EIYDHYGRE

SEQ ID NO: 341061 - protein, 9 aa, Homo Sapiens
SGKRKVTDS

SEQ ID NO: 341062 - protein, 9 aa, Homo Sapiens
RILYQFSRC

SEQ ID NO: 341063 - protein, 9 aa, Homo Sapiens
DKFLEEIAK

SEQ ID NO: 341064 - protein, 9 aa, Homo Sapiens
SEKIAAIAD

SEQ ID NO: 341065 - protein, 9 aa, Homo Sapiens
IEDLKVNQF

SEQ ID NO: 341066 - protein, 9 aa, Homo Sapiens
LLAEFASRH

SEQ ID NO: 341067 - protein, 9 aa, Homo Sapiens
FCQNITTRL

SEQ ID NO: 341068 - protein, 9 aa, Homo Sapiens
LCLVNSSLE

SEQ ID NO: 341069 - protein, 9 aa, Homo Sapiens
IFEESYWRI

SEQ ID NO: 341070 - protein, 9 aa, Homo Sapiens
HNCIQKTLN

SEQ ID NO: 341071 - protein, 9 aa, Homo Sapiens
VFYQMAKCD

SEQ ID NO: 341072 - protein, 9 aa, Homo Sapiens
KLTHQAAIV

SEQ ID NO: 341073 - protein, 9 aa, Homo Sapiens
KALVTKRTN

SEQ ID NO: 341074 - protein, 9 aa, Homo Sapiens
FTSSTASWA

SEQ ID NO: 341075 - protein, 9 aa, Homo Sapiens
NDNVEDDFS

SEQ ID NO: 341076 - protein, 9 aa, Homo Sapiens
YGLLVALAM

SEQ ID NO: 341077 - protein, 9 aa, Homo Sapiens
ARYEAACHR

SEQ ID NO: 341078 - protein, 9 aa, Homo Sapiens
WHPHEPITI

SEQ ID NO: 341079 - protein, 9 aa, Homo Sapiens
TAVIHEVQC

SEQ ID NO: 341080 - protein, 9 aa, Homo Sapiens
MAQLEKMSK

SEQ ID NO: 341081 - protein, 9 aa, Homo Sapiens
EKRRITIED

SEQ ID NO: 341082 - protein, 9 aa, Homo Sapiens
KEEVEEDGP

SEQ ID NO: 341083 - protein, 9 aa, Homo Sapiens
MNMPQYLGN

SEQ ID NO: 341084 - protein, 9 aa, Homo Sapiens
LAKWKDRQK

SEQ ID NO: 341085 - protein, 9 aa, Homo Sapiens
ADSDIISDE

SEQ ID NO: 341086 - protein, 9 aa, Homo Sapiens
KDFMRPFEH

SEQ ID NO: 341087 - protein, 9 aa, Homo Sapiens
WKKAVQFGT

SEQ ID NO: 341088 - protein, 9 aa, Homo Sapiens
IMPDPKLLE

SEQ ID NO: 341089 - protein, 9 aa, Homo Sapiens
NGNVILRHY

SEQ ID NO: 341090 - protein, 9 aa, Homo Sapiens
RAHLDGTCV

SEQ ID NO: 341091 - protein, 9 aa, Homo Sapiens
AAGGKQRSY

SEQ ID NO: 341092 - protein, 9 aa, Homo Sapiens
GFLKSREHS

SEQ ID NO: 341093 - protein, 9 aa, Homo Sapiens
DDENIQNSD

SEQ ID NO: 341094 - protein, 9 aa, Homo Sapiens
IMWRRDHGP

SEQ ID NO: 341095 - protein, 9 aa, Homo Sapiens
ERDPFSFHL

SEQ ID NO: 341096 - protein, 9 aa, Homo Sapiens
EQITSSNVI

SEQ ID NO: 341097 - protein, 9 aa, Homo Sapiens
KLKIILSIG

SEQ ID NO: 341098 - protein, 9 aa, Homo Sapiens
KIAIPNEES

SEQ ID NO: 341099 - protein, 9 aa, Homo Sapiens
HQRSSEVSK

SEQ ID NO: 341100 - protein, 9 aa, Homo Sapiens
KTENGLTPT

SEQ ID NO: 341101 - protein, 9 aa, Homo Sapiens
VCCPECDPR

SEQ ID NO: 341102 - protein, 9 aa, Homo Sapiens
WYPLLMNRR

SEQ ID NO: 341103 - protein, 9 aa, Homo Sapiens
EVTRTFMKI

SEQ ID NO: 341104 - protein, 9 aa, Homo Sapiens
HPQETLKEC

SEQ ID NO: 341105 - protein, 9 aa, Homo Sapiens
LRTPEQCCT

SEQ ID NO: 341106 - protein, 9 aa, Homo Sapiens
RKFKPDVKS

SEQ ID NO: 341107 - protein, 9 aa, Homo Sapiens
SAEKTKTYE

SEQ ID NO: 341108 - protein, 9 aa, Homo Sapiens
NAELESHIQ

SEQ ID NO: 341109 - protein, 9 aa, Homo Sapiens
EVDKIDEIR

SEQ ID NO: 341110 - protein, 9 aa, Homo Sapiens
VLQINDTIR

SEQ ID NO: 341111 - protein, 9 aa, Homo Sapiens
GLLVALAMA

SEQ ID NO: 341112 - protein, 9 aa, Homo Sapiens
MAASEQPLA

SEQ ID NO: 341113 - protein, 9 aa, Homo Sapiens
VNKFAKHIT

SEQ ID NO: 341114 - protein, 9 aa, Homo Sapiens
QESIGKGQF

SEQ ID NO: 341115 - protein, 9 aa, Homo Sapiens
PTMCVNWSN

SEQ ID NO: 341116 - protein, 9 aa, Homo Sapiens
GVYKNFRRE

SEQ ID NO: 341117 - protein, 9 aa, Homo Sapiens
RLKQAKEDA

SEQ ID NO: 341118 - protein, 9 aa, Homo Sapiens
YVSNEGCIR

SEQ ID NO: 341119 - protein, 9 aa, Homo Sapiens
LCNNTAYQE

SEQ ID NO: 341120 - protein, 9 aa, Homo Sapiens
QKKSVLLTG

SEQ ID NO: 341121 - protein, 9 aa, Homo Sapiens
TDDTYYYRQ

SEQ ID NO: 341122 - protein, 9 aa, Homo Sapiens
VVPHNLPSS

SEQ ID NO: 341123 - protein, 9 aa, Homo Sapiens
NLLSMLLTD

SEQ ID NO: 341124 - protein, 9 aa, Homo Sapiens
ATVTVLFLY

SEQ ID NO: 341125 - protein, 9 aa, Homo Sapiens
IQLQCFMKY

SEQ ID NO: 341126 - protein, 9 aa, Homo Sapiens
WGYSGTSDQ

SEQ ID NO: 341127 - protein, 9 aa, Homo Sapiens
HSKEVNILR

SEQ ID NO: 341128 - protein, 9 aa, Homo Sapiens
HECTRRPAF

SEQ ID NO: 341129 - protein, 9 aa, Homo Sapiens
LTVSNTQTV

SEQ ID NO: 341130 - protein, 9 aa, Homo Sapiens
SEPGNNVTL

SEQ ID NO: 341131 - protein, 9 aa, Homo Sapiens
INRTATFVK

SEQ ID NO: 341132 - protein, 9 aa, Homo Sapiens
LVIEKLSKS

SEQ ID NO: 341133 - protein, 9 aa, Homo Sapiens
YNVFESFVV

SEQ ID NO: 341134 - protein, 9 aa, Homo Sapiens
LRDRLLVFF

SEQ ID NO: 341135 - protein, 9 aa, Homo Sapiens
TEDKHLMSS

SEQ ID NO: 341136 - protein, 9 aa, Homo Sapiens
ILCELKEVA

SEQ ID NO: 341137 - protein, 9 aa, Homo Sapiens
VAVTKECSH

SEQ ID NO: 341138 - protein, 9 aa, Homo Sapiens
TEGSVEVIQ

SEQ ID NO: 341139 - protein, 9 aa, Homo Sapiens
FRRSAHLIQ

SEQ ID NO: 341140 - protein, 9 aa, Homo Sapiens
ALSHSSSFQ

SEQ ID NO: 341141 - protein, 9 aa, Homo Sapiens
SSLPEFELV

SEQ ID NO: 341142 - protein, 9 aa, Homo Sapiens
WRINMVQTE

SEQ ID NO: 341143 - protein, 9 aa, Homo Sapiens
RLFFKFYHL

SEQ ID NO: 341144 - protein, 9 aa, Homo Sapiens
FPYVLLQNA

SEQ ID NO: 341145 - protein, 9 aa, Homo Sapiens
LVPLRGLPP

SEQ ID NO: 341146 - protein, 9 aa, Homo Sapiens
SKHSTLKAT

SEQ ID NO: 341147 - protein, 9 aa, Homo Sapiens
YCGVGLLTR

SEQ ID NO: 341148 - protein, 9 aa, Homo Sapiens
QFIDELITK

SEQ ID NO: 341149 - protein, 9 aa, Homo Sapiens
VASPKNKES

SEQ ID NO: 341150 - protein, 9 aa, Homo Sapiens
EPDMKCDNM

SEQ ID NO: 341151 - protein, 9 aa, Homo Sapiens
VYHCGLCLQ

SEQ ID NO: 341152 - protein, 9 aa, Homo Sapiens
LTQHWRIHT

SEQ ID NO: 341153 - protein, 9 aa, Homo Sapiens
TEILGLVFS

SEQ ID NO: 341154 - protein, 9 aa, Homo Sapiens
LFRLFRTNT

SEQ ID NO: 341155 - protein, 9 aa, Homo Sapiens
TLDLKSTRE

SEQ ID NO: 341156 - protein, 9 aa, Homo Sapiens
AKNGTYFQI

SEQ ID NO: 341157 - protein, 9 aa, Homo Sapiens
RTVTVSHHP

SEQ ID NO: 341158 - protein, 9 aa, Homo Sapiens
VMETREGLN

SEQ ID NO: 341159 - protein, 9 aa, Homo Sapiens
AMTMTASLL

SEQ ID NO: 341160 - protein, 9 aa, Homo Sapiens
RYTKVAKRG

SEQ ID NO: 341161 - protein, 9 aa, Homo Sapiens
SVLQAETLV

SEQ ID NO: 341162 - protein, 9 aa, Homo Sapiens
GQFFTSLDP

SEQ ID NO: 341163 - protein, 9 aa, Homo Sapiens
FRGAMDLKN

SEQ ID NO: 341164 - protein, 9 aa, Homo Sapiens
GRQPSRIKP

SEQ ID NO: 341165 - protein, 9 aa, Homo Sapiens
TTRLLLKSS

SEQ ID NO: 341166 - protein, 9 aa, Homo Sapiens
LSIQKYILT

SEQ ID NO: 341167 - protein, 9 aa, Homo Sapiens
RSIGLLFVS

SEQ ID NO: 341168 - protein, 9 aa, Homo Sapiens
NFQPQVICL

SEQ ID NO: 341169 - protein, 9 aa, Homo Sapiens
EKKANQLSS

SEQ ID NO: 341170 - protein, 9 aa, Homo Sapiens
VTKINGAVL

SEQ ID NO: 341171 - protein, 9 aa, Homo Sapiens
CGMKNTQQC

SEQ ID NO: 341172 - protein, 9 aa, Homo Sapiens
ELATNNSKW

SEQ ID NO: 341173 - protein, 9 aa, Homo Sapiens
FPSSPFTET

SEQ ID NO: 341174 - protein, 9 aa, Homo Sapiens
DRKWLQYLE

SEQ ID NO: 341175 - protein, 9 aa, Homo Sapiens
RDANQESNI

SEQ ID NO: 341176 - protein, 9 aa, Homo Sapiens
FICSRLSSI

SEQ ID NO: 341177 - protein, 9 aa, Homo Sapiens
QEREGLSEE

SEQ ID NO: 341178 - protein, 9 aa, Homo Sapiens
EAEQLRAHL

SEQ ID NO: 341179 - protein, 9 aa, Homo Sapiens
IDHFSIDQN

SEQ ID NO: 341180 - protein, 9 aa, Homo Sapiens
ATDTQNVTF

SEQ ID NO: 341181 - protein, 9 aa, Homo Sapiens
KNIKTRLGR

SEQ ID NO: 341182 - protein, 9 aa, Homo Sapiens
QGLRMCTPL

SEQ ID NO: 341183 - protein, 9 aa, Homo Sapiens
VKETLAIVC

SEQ ID NO: 341184 - protein, 9 aa, Homo Sapiens
QPGNIYPTS

SEQ ID NO: 341185 - protein, 9 aa, Homo Sapiens
QASLGFKLT

SEQ ID NO: 341186 - protein, 9 aa, Homo Sapiens
WRMLGTRAT

SEQ ID NO: 341187 - protein, 9 aa, Homo Sapiens
GMAQEDSRH

SEQ ID NO: 341188 - protein, 9 aa, Homo Sapiens
GHNRTVGPN

SEQ ID NO: 341189 - protein, 9 aa, Homo Sapiens
STQMVVHDI

SEQ ID NO: 341190 - protein, 9 aa, Homo Sapiens
VLKLACVDT

SEQ ID NO: 341191 - protein, 9 aa, Homo Sapiens
IIRGLKYIH

SEQ ID NO: 341192 - protein, 9 aa, Homo Sapiens
CKGTLRLDT

SEQ ID NO: 341193 - protein, 9 aa, Homo Sapiens
WTVIFTLTS

SEQ ID NO: 341194 - protein, 9 aa, Homo Sapiens
EQCCTKFKS

SEQ ID NO: 341195 - protein, 9 aa, Homo Sapiens
EYITVVKKL

SEQ ID NO: 341196 - protein, 9 aa, Homo Sapiens
LLKHIVCLE

SEQ ID NO: 341197 - protein, 9 aa, Homo Sapiens
CHSDTLEHL

SEQ ID NO: 341198 - protein, 9 aa, Homo Sapiens
TGSNDAHTK

SEQ ID NO: 341199 - protein, 9 aa, Homo Sapiens
QDVKNVSAR

SEQ ID NO: 341200 - protein, 9 aa, Homo Sapiens
IESILLYTL

SEQ ID NO: 341201 - protein, 9 aa, Homo Sapiens
QVLNLGQAL

SEQ ID NO: 341202 - protein, 9 aa, Homo Sapiens
EEELSRDSR

SEQ ID NO: 341203 - protein, 9 aa, Homo Sapiens
CTACKNQVC

SEQ ID NO: 341204 - protein, 9 aa, Homo Sapiens
RLILQQSQA

SEQ ID NO: 341205 - protein, 9 aa, Homo Sapiens
ALGSLIQIA

SEQ ID NO: 341206 - protein, 9 aa, Homo Sapiens
SVEDLKAKL

SEQ ID NO: 341207 - protein, 9 aa, Homo Sapiens
SEPSQCLEI

SEQ ID NO: 341208 - protein, 9 aa, Homo Sapiens
AAKAEAITS

SEQ ID NO: 341209 - protein, 9 aa, Homo Sapiens
VVLLDSNKK

SEQ ID NO: 341210 - protein, 9 aa, Homo Sapiens
LIQRITEIS

SEQ ID NO: 341211 - protein, 9 aa, Homo Sapiens
PEWQSWGSM

SEQ ID NO: 341212 - protein, 9 aa, Homo Sapiens
IFEWWCFHK

SEQ ID NO: 341213 - protein, 9 aa, Homo Sapiens
CKQIYQSSS

SEQ ID NO: 341214 - protein, 9 aa, Homo Sapiens
QPEIRMWQT

SEQ ID NO: 341215 - protein, 9 aa, Homo Sapiens
QNTELLSIT

SEQ ID NO: 341216 - protein, 9 aa, Homo Sapiens
SDGAISVPN

SEQ ID NO: 341217 - protein, 9 aa, Homo Sapiens
KKSDVSTRW

SEQ ID NO: 341218 - protein, 9 aa, Homo Sapiens
KPLGLENGN

SEQ ID NO: 341219 - protein, 9 aa, Homo Sapiens
IKRRTYNAL

SEQ ID NO: 341220 - protein, 9 aa, Homo Sapiens
CEKPFLGHC

SEQ ID NO: 341221 - protein, 9 aa, Homo Sapiens
VFLRVRTSI

SEQ ID NO: 341222 - protein, 9 aa, Homo Sapiens
EVLYVNQNG

SEQ ID NO: 341223 - protein, 9 aa, Homo Sapiens
QTIQDQAKH

SEQ ID NO: 341224 - protein, 9 aa, Homo Sapiens
KTRKDLNRG

SEQ ID NO: 341225 - protein, 9 aa, Homo Sapiens
RRITNNCVN

SEQ ID NO: 341226 - protein, 9 aa, Homo Sapiens
CLLSLCQCP

SEQ ID NO: 341227 - protein, 9 aa, Homo Sapiens
FTKHNVTAV

SEQ ID NO: 341228 - protein, 9 aa, Homo Sapiens
EEEEDVNSE

SEQ ID NO: 341229 - protein, 9 aa, Homo Sapiens
MNTLRNKMG

SEQ ID NO: 341230 - protein, 9 aa, Homo Sapiens
TLTEQTLPV

SEQ ID NO: 341231 - protein, 9 aa, Homo Sapiens
LPCPQRALI

SEQ ID NO: 341232 - protein, 9 aa, Homo Sapiens
ALWSSGTAA

SEQ ID NO: 341233 - protein, 9 aa, Homo Sapiens
GSLLALSFL

SEQ ID NO: 341234 - protein, 9 aa, Homo Sapiens
TKNPKLKII

SEQ ID NO: 341235 - protein, 9 aa, Homo Sapiens
KEDQGKKEG

SEQ ID NO: 341236 - protein, 9 aa, Homo Sapiens
NKEGGNDNQ

SEQ ID NO: 341237 - protein, 9 aa, Homo Sapiens
KRTHTAEKF

SEQ ID NO: 341238 - protein, 9 aa, Homo Sapiens
SGGHTPHSG

SEQ ID NO: 341239 - protein, 9 aa, Homo Sapiens
CYSTPLMYF

SEQ ID NO: 341240 - protein, 9 aa, Homo Sapiens
MRTKCIELI

SEQ ID NO: 341241 - protein, 9 aa, Homo Sapiens
KESQNDISL

SEQ ID NO: 341242 - protein, 9 aa, Homo Sapiens
TKKTNSKRP

SEQ ID NO: 341243 - protein, 9 aa, Homo Sapiens
LPEINNWLN

SEQ ID NO: 341244 - protein, 9 aa, Homo Sapiens
ENKKIWDKA

SEQ ID NO: 341245 - protein, 9 aa, Homo Sapiens
AAQSLGERT

SEQ ID NO: 341246 - protein, 9 aa, Homo Sapiens
EVTESVYAA

SEQ ID NO: 341247 - protein, 9 aa, Homo Sapiens
NAKLQYPAL

SEQ ID NO: 341248 - protein, 9 aa, Homo Sapiens
MWAKLLSIV

SEQ ID NO: 341249 - protein, 9 aa, Homo Sapiens
DLIQRITEI

SEQ ID NO: 341250 - protein, 9 aa, Homo Sapiens
VVFGMRKAL

SEQ ID NO: 341251 - protein, 9 aa, Homo Sapiens
LFKGGGSSK

SEQ ID NO: 341252 - protein, 9 aa, Homo Sapiens
LGMPGVSLT

SEQ ID NO: 341253 - protein, 9 aa, Homo Sapiens
RQAFIQKTH

SEQ ID NO: 341254 - protein, 9 aa, Homo Sapiens
EHFLEMKLS

SEQ ID NO: 341255 - protein, 9 aa, Homo Sapiens
STQIVEEAD

SEQ ID NO: 341256 - protein, 9 aa, Homo Sapiens
KTPVERDSI

SEQ ID NO: 341257 - protein, 9 aa, Homo Sapiens
RATATECLR

SEQ ID NO: 341258 - protein, 9 aa, Homo Sapiens
KTQQYVRAD

SEQ ID NO: 341259 - protein, 9 aa, Homo Sapiens
QCSYLTRHK

SEQ ID NO: 341260 - protein, 9 aa, Homo Sapiens
TSINFNIIK

SEQ ID NO: 341261 - protein, 9 aa, Homo Sapiens
QKEEHQFFE

SEQ ID NO: 341262 - protein, 9 aa, Homo Sapiens
GIQIEFINE

SEQ ID NO: 341263 - protein, 9 aa, Homo Sapiens
IPAVITCIV

SEQ ID NO: 341264 - protein, 9 aa, Homo Sapiens
WDVLSGNCD

SEQ ID NO: 341265 - protein, 9 aa, Homo Sapiens
LQNLIDCGQ

SEQ ID NO: 341266 - protein, 9 aa, Homo Sapiens
RDECKIILR

SEQ ID NO: 341267 - protein, 9 aa, Homo Sapiens
YIPGLFSFL

SEQ ID NO: 341268 - protein, 9 aa, Homo Sapiens
KEHNSNEED

SEQ ID NO: 341269 - protein, 9 aa, Homo Sapiens
ELARTLQTS

SEQ ID NO: 341270 - protein, 9 aa, Homo Sapiens
MMKRLLMTK

SEQ ID NO: 341271 - protein, 9 aa, Homo Sapiens
QFCLGHTGT

SEQ ID NO: 341272 - protein, 9 aa, Homo Sapiens
LSLMTNCME

SEQ ID NO: 341273 - protein, 9 aa, Homo Sapiens
LNHTTRWLT

SEQ ID NO: 341274 - protein, 9 aa, Homo Sapiens
SDPILDTAS

SEQ ID NO: 341275 - protein, 9 aa, Homo Sapiens
ELELQVQSL

SEQ ID NO: 341276 - protein, 9 aa, Homo Sapiens
LWDFREFEV

SEQ ID NO: 341277 - protein, 9 aa, Homo Sapiens
LDGSLGSCQ

SEQ ID NO: 341278 - protein, 9 aa, Homo Sapiens
ESAALQPFF

SEQ ID NO: 341279 - protein, 9 aa, Homo Sapiens
LLLSSPDIL

SEQ ID NO: 341280 - protein, 9 aa, Homo Sapiens
GIATSIVLY

SEQ ID NO: 341281 - protein, 9 aa, Homo Sapiens
RTHTAEKFY

SEQ ID NO: 341282 - protein, 9 aa, Homo Sapiens
ERHPSRWPA

SEQ ID NO: 341283 - protein, 9 aa, Homo Sapiens
RILANTFIT

SEQ ID NO: 341284 - protein, 9 aa, Homo Sapiens
PLEPGVFVG

SEQ ID NO: 341285 - protein, 9 aa, Homo Sapiens
FIQIHFGAT

SEQ ID NO: 341286 - protein, 9 aa, Homo Sapiens
SPLQENHNN

SEQ ID NO: 341287 - protein, 9 aa, Homo Sapiens
DIFLGFLKA

SEQ ID NO: 341288 - protein, 9 aa, Homo Sapiens
AKYIQIHGR

SEQ ID NO: 341289 - protein, 9 aa, Homo Sapiens
HIQEWYEFQ

SEQ ID NO: 341290 - protein, 9 aa, Homo Sapiens
HIFQAIDKK

SEQ ID NO: 341291 - protein, 9 aa, Homo Sapiens
MMNKFIGSF

SEQ ID NO: 341292 - protein, 9 aa, Homo Sapiens
LLDKFCTKL

SEQ ID NO: 341293 - protein, 9 aa, Homo Sapiens
VIKSIRVDV

SEQ ID NO: 341294 - protein, 9 aa, Homo Sapiens
CGKILFENP

SEQ ID NO: 341295 - protein, 9 aa, Homo Sapiens
KDLGFKMLA

SEQ ID NO: 341296 - protein, 9 aa, Homo Sapiens
VRGFLPDWN

SEQ ID NO: 341297 - protein, 9 aa, Homo Sapiens
IILVGPPLK

SEQ ID NO: 341298 - protein, 9 aa, Homo Sapiens
QLEQDNAEL

SEQ ID NO: 341299 - protein, 9 aa, Homo Sapiens
HDQDYGKNG

SEQ ID NO: 341300 - protein, 9 aa, Homo Sapiens
FALELGYSE

SEQ ID NO: 341301 - protein, 9 aa, Homo Sapiens
IQIMKTPEV

SEQ ID NO: 341302 - protein, 9 aa, Homo Sapiens
TLKVLDQVL

SEQ ID NO: 341303 - protein, 9 aa, Homo Sapiens
SNSLWLEEF

SEQ ID NO: 341304 - protein, 9 aa, Homo Sapiens
WKFPDCMAC

SEQ ID NO: 341305 - protein, 9 aa, Homo Sapiens
SEGNTEQLP

SEQ ID NO: 341306 - protein, 9 aa, Homo Sapiens
CNLTTSSAN

SEQ ID NO: 341307 - protein, 9 aa, Homo Sapiens
VEANRIDVE

SEQ ID NO: 341308 - protein, 9 aa, Homo Sapiens
RGTADLFAF

SEQ ID NO: 341309 - protein, 9 aa, Homo Sapiens
EEMMEEQKT

SEQ ID NO: 341310 - protein, 9 aa, Homo Sapiens
SVKVRVYLL

SEQ ID NO: 341311 - protein, 9 aa, Homo Sapiens
PGHNVLGTE

SEQ ID NO: 341312 - protein, 9 aa, Homo Sapiens
LQEKELQKE

SEQ ID NO: 341313 - protein, 9 aa, Homo Sapiens
QQHTSSLRA

SEQ ID NO: 341314 - protein, 9 aa, Homo Sapiens
TRKFHFFVA

SEQ ID NO: 341315 - protein, 9 aa, Homo Sapiens
AEVIKLQIE

SEQ ID NO: 341316 - protein, 9 aa, Homo Sapiens
THIHIMPSL

SEQ ID NO: 341317 - protein, 9 aa, Homo Sapiens
ATEVEISMT

SEQ ID NO: 341318 - protein, 9 aa, Homo Sapiens
TAGCDKAFT

SEQ ID NO: 341319 - protein, 9 aa, Homo Sapiens
VIHKGPISM

SEQ ID NO: 341320 - protein, 9 aa, Homo Sapiens
KKQLRKKQE

SEQ ID NO: 341321 - protein, 9 aa, Homo Sapiens
QHHLGSPSC

SEQ ID NO: 341322 - protein, 9 aa, Homo Sapiens
EHTDTFHFR

SEQ ID NO: 341323 - protein, 9 aa, Homo Sapiens
ASTRDKLNY

SEQ ID NO: 341324 - protein, 9 aa, Homo Sapiens
KGQLIFYAH

SEQ ID NO: 341325 - protein, 9 aa, Homo Sapiens
DVVMKLWHC

SEQ ID NO: 341326 - protein, 9 aa, Homo Sapiens
ICQSNSATP

SEQ ID NO: 341327 - protein, 9 aa, Homo Sapiens
SSNSPRTLE

SEQ ID NO: 341328 - protein, 9 aa, Homo Sapiens
AHSDAVLSK

SEQ ID NO: 341329 - protein, 9 aa, Homo Sapiens
GASPHSKAI

SEQ ID NO: 341330 - protein, 9 aa, Homo Sapiens
RMKFQGAFH

SEQ ID NO: 341331 - protein, 9 aa, Homo Sapiens
INANNINDI

SEQ ID NO: 341332 - protein, 9 aa, Homo Sapiens
HKRINAGEK

SEQ ID NO: 341333 - protein, 9 aa, Homo Sapiens
LFTSLIDQM

SEQ ID NO: 341334 - protein, 9 aa, Homo Sapiens
RDCYDSDRY

SEQ ID NO: 341335 - protein, 9 aa, Homo Sapiens
NRKKDVMAS

SEQ ID NO: 341336 - protein, 9 aa, Homo Sapiens
PKEIEWDDM

SEQ ID NO: 341337 - protein, 9 aa, Homo Sapiens
TPMLNPLMY

SEQ ID NO: 341338 - protein, 9 aa, Homo Sapiens
RVLFITAAW

SEQ ID NO: 341339 - protein, 9 aa, Homo Sapiens
TVARPHLLS

SEQ ID NO: 341340 - protein, 9 aa, Homo Sapiens
DDFASFQHK

SEQ ID NO: 341341 - protein, 9 aa, Homo Sapiens
GMNMGRIND

SEQ ID NO: 341342 - protein, 9 aa, Homo Sapiens
SPDLKTLQE

SEQ ID NO: 341343 - protein, 9 aa, Homo Sapiens
DWRKGKLLV

SEQ ID NO: 341344 - protein, 9 aa, Homo Sapiens
VFGAHKYCQ

SEQ ID NO: 341345 - protein, 9 aa, Homo Sapiens
LLIPLEKLE

SEQ ID NO: 341346 - protein, 9 aa, Homo Sapiens
LASSNGYAN

SEQ ID NO: 341347 - protein, 9 aa, Homo Sapiens
SLSGKLHNT

SEQ ID NO: 341348 - protein, 9 aa, Homo Sapiens
HLKDEKETL

SEQ ID NO: 341349 - protein, 9 aa, Homo Sapiens
PSKHQGNEI

SEQ ID NO: 341350 - protein, 9 aa, Homo Sapiens
DHIFYMGNT

SEQ ID NO: 341351 - protein, 9 aa, Homo Sapiens
SMLTWLVFV

SEQ ID NO: 341352 - protein, 9 aa, Homo Sapiens
KAFKWYGSC

SEQ ID NO: 341353 - protein, 9 aa, Homo Sapiens
RKTAFECMY

SEQ ID NO: 341354 - protein, 9 aa, Homo Sapiens
FGMRICQNS

SEQ ID NO: 341355 - protein, 9 aa, Homo Sapiens
ALKNNHKAL

SEQ ID NO: 341356 - protein, 9 aa, Homo Sapiens
LSFYPACVL

SEQ ID NO: 341357 - protein, 9 aa, Homo Sapiens
CASAPGALG

SEQ ID NO: 341358 - protein, 9 aa, Homo Sapiens
DQGIFKELT

SEQ ID NO: 341359 - protein, 9 aa, Homo Sapiens
NSLGEIYDF

SEQ ID NO: 341360 - protein, 9 aa, Homo Sapiens
SLSRSIKGG

SEQ ID NO: 341361 - protein, 9 aa, Homo Sapiens
DQFCLGHTG

SEQ ID NO: 341362 - protein, 9 aa, Homo Sapiens
CQHNQLLPN

SEQ ID NO: 341363 - protein, 9 aa, Homo Sapiens
DKCGKGYNS

SEQ ID NO: 341364 - protein, 9 aa, Homo Sapiens
ITAAGCEYL

SEQ ID NO: 341365 - protein, 9 aa, Homo Sapiens
IHSTHIHIM

SEQ ID NO: 341366 - protein, 9 aa, Homo Sapiens
DATDDYFHH

SEQ ID NO: 341367 - protein, 9 aa, Homo Sapiens
LLEKKKKRL

SEQ ID NO: 341368 - protein, 9 aa, Homo Sapiens
NQLTQSASK

SEQ ID NO: 341369 - protein, 9 aa, Homo Sapiens
SKCGKSFSF

SEQ ID NO: 341370 - protein, 9 aa, Homo Sapiens
DGFMCLTDQ

SEQ ID NO: 341371 - protein, 9 aa, Homo Sapiens
YWDTFYKIN

SEQ ID NO: 341372 - protein, 9 aa, Homo Sapiens
REHEQHKTV

SEQ ID NO: 341373 - protein, 9 aa, Homo Sapiens
EHLLFVRRQ

SEQ ID NO: 341374 - protein, 9 aa, Homo Sapiens
NYSIQYVLE

SEQ ID NO: 341375 - protein, 9 aa, Homo Sapiens
YLMFVFNLF

SEQ ID NO: 341376 - protein, 9 aa, Homo Sapiens
IILALWNPR

SEQ ID NO: 341377 - protein, 9 aa, Homo Sapiens
YVAVSRGVV

SEQ ID NO: 341378 - protein, 9 aa, Homo Sapiens
TFRQSDTPQ

SEQ ID NO: 341379 - protein, 9 aa, Homo Sapiens
KYQLATKIK

SEQ ID NO: 341380 - protein, 9 aa, Homo Sapiens
TLSVNVTMF

SEQ ID NO: 341381 - protein, 9 aa, Homo Sapiens
DMIIAKEEI

SEQ ID NO: 341382 - protein, 9 aa, Homo Sapiens
RPNIRKFII

SEQ ID NO: 341383 - protein, 9 aa, Homo Sapiens
FQGAFHKGV

SEQ ID NO: 341384 - protein, 9 aa, Homo Sapiens
TFFDPKSNP

SEQ ID NO: 341385 - protein, 9 aa, Homo Sapiens
GCGKLFRDM

SEQ ID NO: 341386 - protein, 9 aa, Homo Sapiens
CADLIQRIT

SEQ ID NO: 341387 - protein, 9 aa, Homo Sapiens
FWLIFSIVG

SEQ ID NO: 341388 - protein, 9 aa, Homo Sapiens
EYYLYAKNE

SEQ ID NO: 341389 - protein, 9 aa, Homo Sapiens
RAEAQYLLD

SEQ ID NO: 341390 - protein, 9 aa, Homo Sapiens
VVNSDRPER

SEQ ID NO: 341391 - protein, 9 aa, Homo Sapiens
RCKSHYTAF

SEQ ID NO: 341392 - protein, 9 aa, Homo Sapiens
KETLLKEKG

SEQ ID NO: 341393 - protein, 9 aa, Homo Sapiens
LTETMEVLQ

SEQ ID NO: 341394 - protein, 9 aa, Homo Sapiens
DTHFVSSLS

SEQ ID NO: 341395 - protein, 9 aa, Homo Sapiens
KVNTVDKYQ

SEQ ID NO: 341396 - protein, 9 aa, Homo Sapiens
ILWKRLSVS

SEQ ID NO: 341397 - protein, 9 aa, Homo Sapiens
RNSQTEEPT

SEQ ID NO: 341398 - protein, 9 aa, Homo Sapiens
LVMEIGDQW

SEQ ID NO: 341399 - protein, 9 aa, Homo Sapiens
KGAVAGARS

SEQ ID NO: 341400 - protein, 9 aa, Homo Sapiens
YNNHTYRID

SEQ ID NO: 341401 - protein, 9 aa, Homo Sapiens
TLLYQKHNK

SEQ ID NO: 341402 - protein, 9 aa, Homo Sapiens
CSSKKKKSY

SEQ ID NO: 341403 - protein, 9 aa, Homo Sapiens
DEEIEFLMK

SEQ ID NO: 341404 - protein, 9 aa, Homo Sapiens
NKSVDFKMP

SEQ ID NO: 341405 - protein, 9 aa, Homo Sapiens
NRAAGKGYD

SEQ ID NO: 341406 - protein, 9 aa, Homo Sapiens
YQTLTSILT

SEQ ID NO: 341407 - protein, 9 aa, Homo Sapiens
NQYDLKTAG

SEQ ID NO: 341408 - protein, 9 aa, Homo Sapiens
KLEINVFKV

SEQ ID NO: 341409 - protein, 9 aa, Homo Sapiens
VEKRTSAKK

SEQ ID NO: 341410 - protein, 9 aa, Homo Sapiens
RNLTVSNTQ

SEQ ID NO: 341411 - protein, 9 aa, Homo Sapiens
GEAQRSLHR

SEQ ID NO: 341412 - protein, 9 aa, Homo Sapiens
PDEEALQRS

SEQ ID NO: 341413 - protein, 9 aa, Homo Sapiens
KLTGNFSSV

SEQ ID NO: 341414 - protein, 9 aa, Homo Sapiens
HAKMRQEHQ

SEQ ID NO: 341415 - protein, 9 aa, Homo Sapiens
YSDTKGNVF

SEQ ID NO: 341416 - protein, 9 aa, Homo Sapiens
DINEEELTG

SEQ ID NO: 341417 - protein, 9 aa, Homo Sapiens
DRKTICDGA

SEQ ID NO: 341418 - protein, 9 aa, Homo Sapiens
DIGTYLIQD

SEQ ID NO: 341419 - protein, 9 aa, Homo Sapiens
SRAPSPTKL

SEQ ID NO: 341420 - protein, 9 aa, Homo Sapiens
GGVQDDMII

SEQ ID NO: 341421 - protein, 9 aa, Homo Sapiens
PEQSFEILT

SEQ ID NO: 341422 - protein, 9 aa, Homo Sapiens
NSLLNYLTS

SEQ ID NO: 341423 - protein, 9 aa, Homo Sapiens
THNLLLLQT

SEQ ID NO: 341424 - protein, 9 aa, Homo Sapiens
MPSRSLRRT

SEQ ID NO: 341425 - protein, 9 aa, Homo Sapiens
LKYLSSNDQ

SEQ ID NO: 341426 - protein, 9 aa, Homo Sapiens
FELVLWNWE

SEQ ID NO: 341427 - protein, 9 aa, Homo Sapiens
VACCNQLFV

SEQ ID NO: 341428 - protein, 9 aa, Homo Sapiens
SLSVNSVFT

SEQ ID NO: 341429 - protein, 9 aa, Homo Sapiens
ATLTNTLMV

SEQ ID NO: 341430 - protein, 9 aa, Homo Sapiens
QCSRFQESL

SEQ ID NO: 341431 - protein, 9 aa, Homo Sapiens
VSCIKIGST

SEQ ID NO: 341432 - protein, 9 aa, Homo Sapiens
NTDELNFPT

SEQ ID NO: 341433 - protein, 9 aa, Homo Sapiens
ISFVMKFFN

SEQ ID NO: 341434 - protein, 9 aa, Homo Sapiens
YFMSCPGRG

SEQ ID NO: 341435 - protein, 9 aa, Homo Sapiens
GHKRARKIT

SEQ ID NO: 341436 - protein, 9 aa, Homo Sapiens
NTDVALACA

SEQ ID NO: 341437 - protein, 9 aa, Homo Sapiens
FLMFCMVGL

SEQ ID NO: 341438 - protein, 9 aa, Homo Sapiens
NPTKKTNSK

SEQ ID NO: 341439 - protein, 9 aa, Homo Sapiens
IWGEKCEMK

SEQ ID NO: 341440 - protein, 9 aa, Homo Sapiens
ENLNLRKQA

SEQ ID NO: 341441 - protein, 9 aa, Homo Sapiens
NPSKHQGNE

SEQ ID NO: 341442 - protein, 9 aa, Homo Sapiens
EDYEFKTCL

SEQ ID NO: 341443 - protein, 9 aa, Homo Sapiens
WLRCALNKH

SEQ ID NO: 341444 - protein, 9 aa, Homo Sapiens
FINLLLDRI

SEQ ID NO: 341445 - protein, 9 aa, Homo Sapiens
LNKENKITG

SEQ ID NO: 341446 - protein, 9 aa, Homo Sapiens
QEDYEFKTC

SEQ ID NO: 341447 - protein, 9 aa, Homo Sapiens
KKIWDKARK

SEQ ID NO: 341448 - protein, 9 aa, Homo Sapiens
DVVSSLCRH

SEQ ID NO: 341449 - protein, 9 aa, Homo Sapiens
REGQGSLRG

SEQ ID NO: 341450 - protein, 9 aa, Homo Sapiens
YVHYYLTSA

SEQ ID NO: 341451 - protein, 9 aa, Homo Sapiens
RIKPMDDHL

SEQ ID NO: 341452 - protein, 9 aa, Homo Sapiens
CFNHFATEC

SEQ ID NO: 341453 - protein, 9 aa, Homo Sapiens
LQCNTEDAY

SEQ ID NO: 341454 - protein, 9 aa, Homo Sapiens
LAVHGLPLK

SEQ ID NO: 341455 - protein, 9 aa, Homo Sapiens
LTEQNSTEN

SEQ ID NO: 341456 - protein, 9 aa, Homo Sapiens
GDFANNETK

SEQ ID NO: 341457 - protein, 9 aa, Homo Sapiens
GVEVKESKL

SEQ ID NO: 341458 - protein, 9 aa, Homo Sapiens
RQTKMIWFN

SEQ ID NO: 341459 - protein, 9 aa, Homo Sapiens
HPHEPITIG

SEQ ID NO: 341460 - protein, 9 aa, Homo Sapiens
CQLCGFRQE

SEQ ID NO: 341461 - protein, 9 aa, Homo Sapiens
GAHKYCQVA

SEQ ID NO: 341462 - protein, 9 aa, Homo Sapiens
DRRTSGQID

SEQ ID NO: 341463 - protein, 9 aa, Homo Sapiens
GYKIIYRPS

SEQ ID NO: 341464 - protein, 9 aa, Homo Sapiens
PDKVFTVSN

SEQ ID NO: 341465 - protein, 9 aa, Homo Sapiens
CEPSSQMIE

SEQ ID NO: 341466 - protein, 9 aa, Homo Sapiens
YFVTFEVKI

SEQ ID NO: 341467 - protein, 9 aa, Homo Sapiens
DVMVAGGTN

SEQ ID NO: 341468 - protein, 9 aa, Homo Sapiens
CFHGSSTIQ

SEQ ID NO: 341469 - protein, 9 aa, Homo Sapiens
SKQTIELKK

SEQ ID NO: 341470 - protein, 9 aa, Homo Sapiens
FCNVTPLLK

SEQ ID NO: 341471 - protein, 9 aa, Homo Sapiens
MLPEFHLLR

SEQ ID NO: 341472 - protein, 9 aa, Homo Sapiens
SIARVFTVI

SEQ ID NO: 341473 - protein, 9 aa, Homo Sapiens
SILKYAEAG

SEQ ID NO: 341474 - protein, 9 aa, Homo Sapiens
AENLSAPEA

SEQ ID NO: 341475 - protein, 9 aa, Homo Sapiens
PSLLKRHEK

SEQ ID NO: 341476 - protein, 9 aa, Homo Sapiens
IKSLILPGI

SEQ ID NO: 341477 - protein, 9 aa, Homo Sapiens
GSTVFLRVR

SEQ ID NO: 341478 - protein, 9 aa, Homo Sapiens
FSVSSALTM

SEQ ID NO: 341479 - protein, 9 aa, Homo Sapiens
CTKEEIVQL

SEQ ID NO: 341480 - protein, 9 aa, Homo Sapiens
IIDGICGQA

SEQ ID NO: 341481 - protein, 9 aa, Homo Sapiens
YVNIFINLP

SEQ ID NO: 341482 - protein, 9 aa, Homo Sapiens
HSAVLLIGI

SEQ ID NO: 341483 - protein, 9 aa, Homo Sapiens
ICVEPFTTL

SEQ ID NO: 341484 - protein, 9 aa, Homo Sapiens
EAFPQNDDE

SEQ ID NO: 341485 - protein, 9 aa, Homo Sapiens
FLVMSVITS

SEQ ID NO: 341486 - protein, 9 aa, Homo Sapiens
SEVNVNDAR

SEQ ID NO: 341487 - protein, 9 aa, Homo Sapiens
REWTRMHGL

SEQ ID NO: 341488 - protein, 9 aa, Homo Sapiens
TQSFCIIFP

SEQ ID NO: 341489 - protein, 9 aa, Homo Sapiens
SSVLIPPQN

SEQ ID NO: 341490 - protein, 9 aa, Homo Sapiens
KKGSRNNTD

SEQ ID NO: 341491 - protein, 9 aa, Homo Sapiens
WFWDGQLLP

SEQ ID NO: 341492 - protein, 9 aa, Homo Sapiens
LRLKEPQQD

SEQ ID NO: 341493 - protein, 9 aa, Homo Sapiens
AATKTIKPS

SEQ ID NO: 341494 - protein, 9 aa, Homo Sapiens
SSPSLSFYP

SEQ ID NO: 341495 - protein, 9 aa, Homo Sapiens
AKLFPGRTD

SEQ ID NO: 341496 - protein, 9 aa, Homo Sapiens
AKKTPVERD

SEQ ID NO: 341497 - protein, 9 aa, Homo Sapiens
QTHPSATLH

SEQ ID NO: 341498 - protein, 9 aa, Homo Sapiens
EFQIHHDVN

SEQ ID NO: 341499 - protein, 9 aa, Homo Sapiens
WGTQVFVTE

SEQ ID NO: 341500 - protein, 9 aa, Homo Sapiens
ITEQQRYSL

SEQ ID NO: 341501 - protein, 9 aa, Homo Sapiens
LFENGDVPS

SEQ ID NO: 341502 - protein, 9 aa, Homo Sapiens
SIKAWPFPG

SEQ ID NO: 341503 - protein, 9 aa, Homo Sapiens
HILHVSREK

SEQ ID NO: 341504 - protein, 9 aa, Homo Sapiens
KIHDGMFRK

SEQ ID NO: 341505 - protein, 9 aa, Homo Sapiens
SGTYGCTST

SEQ ID NO: 341506 - protein, 9 aa, Homo Sapiens
DTAFDWICK

SEQ ID NO: 341507 - protein, 9 aa, Homo Sapiens
KVYTGGYNG

SEQ ID NO: 341508 - protein, 9 aa, Homo Sapiens
GKKPWVTKT

SEQ ID NO: 341509 - protein, 9 aa, Homo Sapiens
QHHSDLYSH

SEQ ID NO: 341510 - protein, 9 aa, Homo Sapiens
DLSRDECKI

SEQ ID NO: 341511 - protein, 9 aa, Homo Sapiens
KKKRDSWKS

SEQ ID NO: 341512 - protein, 9 aa, Homo Sapiens
GVFTMDTDD

SEQ ID NO: 341513 - protein, 9 aa, Homo Sapiens
PTLQFGGKR

SEQ ID NO: 341514 - protein, 9 aa, Homo Sapiens
CSKNITILE

SEQ ID NO: 341515 - protein, 9 aa, Homo Sapiens
LQPPSRQAE

SEQ ID NO: 341516 - protein, 9 aa, Homo Sapiens
VKSERINLL

SEQ ID NO: 341517 - protein, 9 aa, Homo Sapiens
QQLLIPLEK

SEQ ID NO: 341518 - protein, 9 aa, Homo Sapiens
PGAPDPFQP

SEQ ID NO: 341519 - protein, 9 aa, Homo Sapiens
FRGLSEEKT

SEQ ID NO: 341520 - protein, 9 aa, Homo Sapiens
IKHLRVLFI

SEQ ID NO: 341521 - protein, 9 aa, Homo Sapiens
LRIKGKRHR

SEQ ID NO: 341522 - protein, 9 aa, Homo Sapiens
MFTGEEKIF

SEQ ID NO: 341523 - protein, 9 aa, Homo Sapiens
NVVKFTTQK

SEQ ID NO: 341524 - protein, 9 aa, Homo Sapiens
DNEDNYSNI

SEQ ID NO: 341525 - protein, 9 aa, Homo Sapiens
SVYYITFSP

SEQ ID NO: 341526 - protein, 9 aa, Homo Sapiens
LTAMGYDHY

SEQ ID NO: 341527 - protein, 9 aa, Homo Sapiens
AFQSHTFSE

SEQ ID NO: 341528 - protein, 9 aa, Homo Sapiens
RGAIGLHIA

SEQ ID NO: 341529 - protein, 9 aa, Homo Sapiens
VANNRLFSS

SEQ ID NO: 341530 - protein, 9 aa, Homo Sapiens
PTDPKLREL

SEQ ID NO: 341531 - protein, 9 aa, Homo Sapiens
HMDCLRWLK

SEQ ID NO: 341532 - protein, 9 aa, Homo Sapiens
VQRLELGDV

SEQ ID NO: 341533 - protein, 9 aa, Homo Sapiens
QAITEKRKR

SEQ ID NO: 341534 - protein, 9 aa, Homo Sapiens
NNGFKIHYA

SEQ ID NO: 341535 - protein, 9 aa, Homo Sapiens
LRDSRDVLA

SEQ ID NO: 341536 - protein, 9 aa, Homo Sapiens
QTEEERTKQ

SEQ ID NO: 341537 - protein, 9 aa, Homo Sapiens
FELSIFEFN

SEQ ID NO: 341538 - protein, 9 aa, Homo Sapiens
PLHLQPSQL

SEQ ID NO: 341539 - protein, 9 aa, Homo Sapiens
ALNKHSLER

SEQ ID NO: 341540 - protein, 9 aa, Homo Sapiens
SSEEDKKAN

SEQ ID NO: 341541 - protein, 9 aa, Homo Sapiens
IETNGGADK

SEQ ID NO: 341542 - protein, 9 aa, Homo Sapiens
NNKINMQQT

SEQ ID NO: 341543 - protein, 9 aa, Homo Sapiens
DIMFTLDKV

SEQ ID NO: 341544 - protein, 9 aa, Homo Sapiens
GFDSHFSLS

SEQ ID NO: 341545 - protein, 9 aa, Homo Sapiens
LKYEPGAVK

SEQ ID NO: 341546 - protein, 9 aa, Homo Sapiens
DKLTPLHCA

SEQ ID NO: 341547 - protein, 9 aa, Homo Sapiens
ANILEKDKR

SEQ ID NO: 341548 - protein, 9 aa, Homo Sapiens
LLFGQRANT

SEQ ID NO: 341549 - protein, 9 aa, Homo Sapiens
VEQINCKQD

SEQ ID NO: 341550 - protein, 9 aa, Homo Sapiens
AKPFNKFQF

SEQ ID NO: 341551 - protein, 9 aa, Homo Sapiens
PPKITGSSP

SEQ ID NO: 341552 - protein, 9 aa, Homo Sapiens
NKKIWDKAR

SEQ ID NO: 341553 - protein, 9 aa, Homo Sapiens
IQQAFGKLL

SEQ ID NO: 341554 - protein, 9 aa, Homo Sapiens
CQYNAVVGA

SEQ ID NO: 341555 - protein, 9 aa, Homo Sapiens
GVLDIAGFK

SEQ ID NO: 341556 - protein, 9 aa, Homo Sapiens
FFVSLTETA

SEQ ID NO: 341557 - protein, 9 aa, Homo Sapiens
EHQITHIGE

SEQ ID NO: 341558 - protein, 9 aa, Homo Sapiens
NKYGAGEHG

SEQ ID NO: 341559 - protein, 9 aa, Homo Sapiens
LVTEEKFTI

SEQ ID NO: 341560 - protein, 9 aa, Homo Sapiens
ACLHFSPFH

SEQ ID NO: 341561 - protein, 9 aa, Homo Sapiens
SSNTLKGQG

SEQ ID NO: 341562 - protein, 9 aa, Homo Sapiens
HRDLRSSNI

SEQ ID NO: 341563 - protein, 9 aa, Homo Sapiens
EEIEFLMKD

SEQ ID NO: 341564 - protein, 9 aa, Homo Sapiens
LLPLLLPSG

SEQ ID NO: 341565 - protein, 9 aa, Homo Sapiens
DKDTKNVNL

SEQ ID NO: 341566 - protein, 9 aa, Homo Sapiens
HSTTKSAAK

SEQ ID NO: 341567 - protein, 9 aa, Homo Sapiens
NQGLDHLIQ

SEQ ID NO: 341568 - protein, 9 aa, Homo Sapiens
PRQGGGMPE

SEQ ID NO: 341569 - protein, 9 aa, Homo Sapiens
AGEDTGGIY

SEQ ID NO: 341570 - protein, 9 aa, Homo Sapiens
QKKEKELVT

SEQ ID NO: 341571 - protein, 9 aa, Homo Sapiens
GEVLQNELQ

SEQ ID NO: 341572 - protein, 9 aa, Homo Sapiens
DKEHNSNEE

SEQ ID NO: 341573 - protein, 9 aa, Homo Sapiens
SVYITLLNK

SEQ ID NO: 341574 - protein, 9 aa, Homo Sapiens
LVSGIICFL

SEQ ID NO: 341575 - protein, 9 aa, Homo Sapiens
TMGSTEACV

SEQ ID NO: 341576 - protein, 9 aa, Homo Sapiens
SWTSSCTNQ

SEQ ID NO: 341577 - protein, 9 aa, Homo Sapiens
VEAEKDMWI

SEQ ID NO: 341578 - protein, 9 aa, Homo Sapiens
GNEYSLWDC

SEQ ID NO: 341579 - protein, 9 aa, Homo Sapiens
RMESPIDLA

SEQ ID NO: 341580 - protein, 9 aa, Homo Sapiens
PPSWRKICK

SEQ ID NO: 341581 - protein, 9 aa, Homo Sapiens
NLFNMCGIS

SEQ ID NO: 341582 - protein, 9 aa, Homo Sapiens
VAKLDGTQH

SEQ ID NO: 341583 - protein, 9 aa, Homo Sapiens
IQNLKERFH

SEQ ID NO: 341584 - protein, 9 aa, Homo Sapiens
SDKKDSASN

SEQ ID NO: 341585 - protein, 9 aa, Homo Sapiens
APEASREDY

SEQ ID NO: 341586 - protein, 9 aa, Homo Sapiens
TLIDINDHG

SEQ ID NO: 341587 - protein, 9 aa, Homo Sapiens
EQEREGLSE

SEQ ID NO: 341588 - protein, 9 aa, Homo Sapiens
PYFWEFSME

SEQ ID NO: 341589 - protein, 9 aa, Homo Sapiens
TQLWHGDQI

SEQ ID NO: 341590 - protein, 9 aa, Homo Sapiens
KCTLEGELH

SEQ ID NO: 341591 - protein, 9 aa, Homo Sapiens
NILDHCLCE

SEQ ID NO: 341592 - protein, 9 aa, Homo Sapiens
EVTRLRELA

SEQ ID NO: 341593 - protein, 9 aa, Homo Sapiens
MLDNLQKTV

SEQ ID NO: 341594 - protein, 9 aa, Homo Sapiens
EITFCSKNI

SEQ ID NO: 341595 - protein, 9 aa, Homo Sapiens
TITATGRGK

SEQ ID NO: 341596 - protein, 9 aa, Homo Sapiens
YYETVCMAA

SEQ ID NO: 341597 - protein, 9 aa, Homo Sapiens
SDQEGYFQE

SEQ ID NO: 341598 - protein, 9 aa, Homo Sapiens
ELCLGKEGT

SEQ ID NO: 341599 - protein, 9 aa, Homo Sapiens
QLDLSEFLN

SEQ ID NO: 341600 - protein, 9 aa, Homo Sapiens
QLNITAMQR

SEQ ID NO: 341601 - protein, 9 aa, Homo Sapiens
LASGECKCK

SEQ ID NO: 341602 - protein, 9 aa, Homo Sapiens
IAALAQDTV

SEQ ID NO: 341603 - protein, 9 aa, Homo Sapiens
WSRRKAERL

SEQ ID NO: 341604 - protein, 9 aa, Homo Sapiens
NNGEFWFSL

SEQ ID NO: 341605 - protein, 9 aa, Homo Sapiens
PLVYLQAVK

SEQ ID NO: 341606 - protein, 9 aa, Homo Sapiens
SVSSSEDIT

SEQ ID NO: 341607 - protein, 9 aa, Homo Sapiens
IKGYQTVVA

SEQ ID NO: 341608 - protein, 9 aa, Homo Sapiens
SFMLDNLQK

SEQ ID NO: 341609 - protein, 9 aa, Homo Sapiens
RCKEAERIA

SEQ ID NO: 341610 - protein, 9 aa, Homo Sapiens
TTELSELED

SEQ ID NO: 341611 - protein, 9 aa, Homo Sapiens
RDFTDNPCL

SEQ ID NO: 341612 - protein, 9 aa, Homo Sapiens
VLAFCYWAK

SEQ ID NO: 341613 - protein, 9 aa, Homo Sapiens
GRLEINLDD

SEQ ID NO: 341614 - protein, 9 aa, Homo Sapiens
CETVDVVQE

SEQ ID NO: 341615 - protein, 9 aa, Homo Sapiens
CAAETGGIA

SEQ ID NO: 341616 - protein, 9 aa, Homo Sapiens
ELFTNQKEN

SEQ ID NO: 341617 - protein, 9 aa, Homo Sapiens
LGETWDNLT

SEQ ID NO: 341618 - protein, 9 aa, Homo Sapiens
DLIFKRGPP

SEQ ID NO: 341619 - protein, 9 aa, Homo Sapiens
RHNAIKCGW

SEQ ID NO: 341620 - protein, 9 aa, Homo Sapiens
VPYFGPVFT

SEQ ID NO: 341621 - protein, 9 aa, Homo Sapiens
RLRQGSRFT

SEQ ID NO: 341622 - protein, 9 aa, Homo Sapiens
KPQADVAFH

SEQ ID NO: 341623 - protein, 9 aa, Homo Sapiens
PAPFKMPSS

SEQ ID NO: 341624 - protein, 9 aa, Homo Sapiens
TEENKSLKR

SEQ ID NO: 341625 - protein, 9 aa, Homo Sapiens
NSGSGLLPP

SEQ ID NO: 341626 - protein, 9 aa, Homo Sapiens
ICKFVHFLF

SEQ ID NO: 341627 - protein, 9 aa, Homo Sapiens
SSVVLKTLR

SEQ ID NO: 341628 - protein, 9 aa, Homo Sapiens
LPWAIIYIP

SEQ ID NO: 341629 - protein, 9 aa, Homo Sapiens
AEKDMWIVE

SEQ ID NO: 341630 - protein, 9 aa, Homo Sapiens
IFNEFCDSR

SEQ ID NO: 341631 - protein, 9 aa, Homo Sapiens
NGSWEVIEG

SEQ ID NO: 341632 - protein, 9 aa, Homo Sapiens
SVSSELDNH

SEQ ID NO: 341633 - protein, 9 aa, Homo Sapiens
PGEWLPAED

SEQ ID NO: 341634 - protein, 9 aa, Homo Sapiens
QQDTRSPTS

SEQ ID NO: 341635 - protein, 9 aa, Homo Sapiens
KGGLDGVDI

SEQ ID NO: 341636 - protein, 9 aa, Homo Sapiens
PMTQINQVA

SEQ ID NO: 341637 - protein, 9 aa, Homo Sapiens
EYTDVYPKI

SEQ ID NO: 341638 - protein, 9 aa, Homo Sapiens
DERQRASEI

SEQ ID NO: 341639 - protein, 9 aa, Homo Sapiens
ALLNNEMMK

SEQ ID NO: 341640 - protein, 9 aa, Homo Sapiens
FVHHIDNVF

SEQ ID NO: 341641 - protein, 9 aa, Homo Sapiens
RSRNIDRYY

SEQ ID NO: 341642 - protein, 9 aa, Homo Sapiens
FTTISVGIV

SEQ ID NO: 341643 - protein, 9 aa, Homo Sapiens
SNRVTGIYK

SEQ ID NO: 341644 - protein, 9 aa, Homo Sapiens
LLLHPDSSR

SEQ ID NO: 341645 - protein, 9 aa, Homo Sapiens
VADDNDDPP

SEQ ID NO: 341646 - protein, 9 aa, Homo Sapiens
GRMEESQNK

SEQ ID NO: 341647 - protein, 9 aa, Homo Sapiens
FEAHSDYIC

SEQ ID NO: 341648 - protein, 9 aa, Homo Sapiens
RQLEQDNAE

SEQ ID NO: 341649 - protein, 9 aa, Homo Sapiens
DKKSKKSKF

SEQ ID NO: 341650 - protein, 9 aa, Homo Sapiens
ETQLICQQK

SEQ ID NO: 341651 - protein, 9 aa, Homo Sapiens
VLEMLASFK

SEQ ID NO: 341652 - protein, 9 aa, Homo Sapiens
EEIKVIFIP

SEQ ID NO: 341653 - protein, 9 aa, Homo Sapiens
ELEQLPDLG

SEQ ID NO: 341654 - protein, 9 aa, Homo Sapiens
SNYALTILQ

SEQ ID NO: 341655 - protein, 9 aa, Homo Sapiens
TTVVYLKNT

SEQ ID NO: 341656 - protein, 9 aa, Homo Sapiens
EHIQKAGGL

SEQ ID NO: 341657 - protein, 9 aa, Homo Sapiens
KHSRTAYTR

SEQ ID NO: 341658 - protein, 9 aa, Homo Sapiens
RVTGIYKLS

SEQ ID NO: 341659 - protein, 9 aa, Homo Sapiens
SQSSQGEEE

SEQ ID NO: 341660 - protein, 9 aa, Homo Sapiens
LIFGLTVTL

SEQ ID NO: 341661 - protein, 9 aa, Homo Sapiens
GKGFTHRNV

SEQ ID NO: 341662 - protein, 9 aa, Homo Sapiens
PHIFCNVTP

SEQ ID NO: 341663 - protein, 9 aa, Homo Sapiens
NSYEDKSNG

SEQ ID NO: 341664 - protein, 9 aa, Homo Sapiens
SRLRFNWRG

SEQ ID NO: 341665 - protein, 9 aa, Homo Sapiens
ASVDGPGTC

SEQ ID NO: 341666 - protein, 9 aa, Homo Sapiens
TVIIFPYLY

SEQ ID NO: 341667 - protein, 9 aa, Homo Sapiens
ILIFGLTVT

SEQ ID NO: 341668 - protein, 9 aa, Homo Sapiens
HHGRLCFML

SEQ ID NO: 341669 - protein, 9 aa, Homo Sapiens
LPQLILVNM

SEQ ID NO: 341670 - protein, 9 aa, Homo Sapiens
IKVMVTLGE

SEQ ID NO: 341671 - protein, 9 aa, Homo Sapiens
HCLSGKHQG

SEQ ID NO: 341672 - protein, 9 aa, Homo Sapiens
AVFTNDIDK

SEQ ID NO: 341673 - protein, 9 aa, Homo Sapiens
SLWVEFITV

SEQ ID NO: 341674 - protein, 9 aa, Homo Sapiens
IARVFTVIN

SEQ ID NO: 341675 - protein, 9 aa, Homo Sapiens
IATEKKANQ

SEQ ID NO: 341676 - protein, 9 aa, Homo Sapiens
DVLEGQTHT

SEQ ID NO: 341677 - protein, 9 aa, Homo Sapiens
PKKKNNISH

SEQ ID NO: 341678 - protein, 9 aa, Homo Sapiens
PVGGGESLQ

SEQ ID NO: 341679 - protein, 9 aa, Homo Sapiens
TGHGRGHKS

SEQ ID NO: 341680 - protein, 9 aa, Homo Sapiens
GGEYFAMDE

SEQ ID NO: 341681 - protein, 9 aa, Homo Sapiens
RGCRGPNYT

SEQ ID NO: 341682 - protein, 9 aa, Homo Sapiens
CRAVGFEAC

SEQ ID NO: 341683 - protein, 9 aa, Homo Sapiens
SEQPLAISR

SEQ ID NO: 341684 - protein, 9 aa, Homo Sapiens
CDQRAIDLL

SEQ ID NO: 341685 - protein, 9 aa, Homo Sapiens
RRDRSKNKL

SEQ ID NO: 341686 - protein, 9 aa, Homo Sapiens
AMAARVEPP

SEQ ID NO: 341687 - protein, 9 aa, Homo Sapiens
IWEITVESL

SEQ ID NO: 341688 - protein, 9 aa, Homo Sapiens
IIDGRNREL

SEQ ID NO: 341689 - protein, 9 aa, Homo Sapiens
AFNLFSSIT

SEQ ID NO: 341690 - protein, 9 aa, Homo Sapiens
VKGKDITML

SEQ ID NO: 341691 - protein, 9 aa, Homo Sapiens
QPGYIRSHY

SEQ ID NO: 341692 - protein, 9 aa, Homo Sapiens
SYYKVNNLG

SEQ ID NO: 341693 - protein, 9 aa, Homo Sapiens
ESVYYGCLH

SEQ ID NO: 341694 - protein, 9 aa, Homo Sapiens
PFVQTREYR

SEQ ID NO: 341695 - protein, 9 aa, Homo Sapiens
KLLAILEQR

SEQ ID NO: 341696 - protein, 9 aa, Homo Sapiens
VQLDNVFRQ

SEQ ID NO: 341697 - protein, 9 aa, Homo Sapiens
KMIWFNSVA

SEQ ID NO: 341698 - protein, 9 aa, Homo Sapiens
KKAYELSVF

SEQ ID NO: 341699 - protein, 9 aa, Homo Sapiens
YFRNRHPGA

SEQ ID NO: 341700 - protein, 9 aa, Homo Sapiens
LVSAPGLVL

SEQ ID NO: 341701 - protein, 9 aa, Homo Sapiens
SIRHFCKMS

SEQ ID NO: 341702 - protein, 9 aa, Homo Sapiens
TMIKLPGFI

SEQ ID NO: 341703 - protein, 9 aa, Homo Sapiens
QELEQQRRL

SEQ ID NO: 341704 - protein, 9 aa, Homo Sapiens
RESVEEKQP

SEQ ID NO: 341705 - protein, 9 aa, Homo Sapiens
WKIIRTLLS

SEQ ID NO: 341706 - protein, 9 aa, Homo Sapiens
ASAAGVYVA

SEQ ID NO: 341707 - protein, 9 aa, Homo Sapiens
DTRVQTMNE

SEQ ID NO: 341708 - protein, 9 aa, Homo Sapiens
LTVRKLKLF

SEQ ID NO: 341709 - protein, 9 aa, Homo Sapiens
CGKDGPKYC

SEQ ID NO: 341710 - protein, 9 aa, Homo Sapiens
LQNKVQALS

SEQ ID NO: 341711 - protein, 9 aa, Homo Sapiens
QYLGLALDM

SEQ ID NO: 341712 - protein, 9 aa, Homo Sapiens
LMIIPDPEK

SEQ ID NO: 341713 - protein, 9 aa, Homo Sapiens
APSALALCC

SEQ ID NO: 341714 - protein, 9 aa, Homo Sapiens
KKDIAESTL

SEQ ID NO: 341715 - protein, 9 aa, Homo Sapiens
AESQIRGTE

SEQ ID NO: 341716 - protein, 9 aa, Homo Sapiens
KKKNNISHD

SEQ ID NO: 341717 - protein, 9 aa, Homo Sapiens
CSVSGCNIT

SEQ ID NO: 341718 - protein, 9 aa, Homo Sapiens
QLEGILCEL

SEQ ID NO: 341719 - protein, 9 aa, Homo Sapiens
LVQLIVQTP

SEQ ID NO: 341720 - protein, 9 aa, Homo Sapiens
RGPDDQESH

SEQ ID NO: 341721 - protein, 9 aa, Homo Sapiens
SGECKCKDT

SEQ ID NO: 341722 - protein, 9 aa, Homo Sapiens
VKVKDEKIC

SEQ ID NO: 341723 - protein, 9 aa, Homo Sapiens
IKGGTKVYK

SEQ ID NO: 341724 - protein, 9 aa, Homo Sapiens
NYLHNQNGS

SEQ ID NO: 341725 - protein, 9 aa, Homo Sapiens
DNVRFEHQF

SEQ ID NO: 341726 - protein, 9 aa, Homo Sapiens
HILWFLRAR

SEQ ID NO: 341727 - protein, 9 aa, Homo Sapiens
LYGNCTMRH

SEQ ID NO: 341728 - protein, 9 aa, Homo Sapiens
IFANLLSPV

SEQ ID NO: 341729 - protein, 9 aa, Homo Sapiens
TALDLYIAI

SEQ ID NO: 341730 - protein, 9 aa, Homo Sapiens
GEVGEDGDK

SEQ ID NO: 341731 - protein, 9 aa, Homo Sapiens
LTVHAINLD

SEQ ID NO: 341732 - protein, 9 aa, Homo Sapiens
FVLRFPDCR

SEQ ID NO: 341733 - protein, 9 aa, Homo Sapiens
SSISWMGGN

SEQ ID NO: 341734 - protein, 9 aa, Homo Sapiens
QFSRCFHHC

SEQ ID NO: 341735 - protein, 9 aa, Homo Sapiens
LFPGRTDNS

SEQ ID NO: 341736 - protein, 9 aa, Homo Sapiens
NRQTCVFFE

SEQ ID NO: 341737 - protein, 9 aa, Homo Sapiens
CELKEVAKE

SEQ ID NO: 341738 - protein, 9 aa, Homo Sapiens
ANKLDKKDL

SEQ ID NO: 341739 - protein, 9 aa, Homo Sapiens
ASPPLLLLS

SEQ ID NO: 341740 - protein, 9 aa, Homo Sapiens
AVIKEGGLC

SEQ ID NO: 341741 - protein, 9 aa, Homo Sapiens
CVVQNRMGA

SEQ ID NO: 341742 - protein, 9 aa, Homo Sapiens
QTGCVKCQT

SEQ ID NO: 341743 - protein, 9 aa, Homo Sapiens
TAERIKLLF

SEQ ID NO: 341744 - protein, 9 aa, Homo Sapiens
PQCIPSNPS

SEQ ID NO: 341745 - protein, 9 aa, Homo Sapiens
KHCPVVTVN

SEQ ID NO: 341746 - protein, 9 aa, Homo Sapiens
DKDEEGVTL

SEQ ID NO: 341747 - protein, 9 aa, Homo Sapiens
SHKTTRSGT

SEQ ID NO: 341748 - protein, 9 aa, Homo Sapiens
GLIQSSFAS

SEQ ID NO: 341749 - protein, 9 aa, Homo Sapiens
ECTMYWYIF

SEQ ID NO: 341750 - protein, 9 aa, Homo Sapiens
AISENLKSC

SEQ ID NO: 341751 - protein, 9 aa, Homo Sapiens
LGLTYHVHN

SEQ ID NO: 341752 - protein, 9 aa, Homo Sapiens
MSIMDVLSA

SEQ ID NO: 341753 - protein, 9 aa, Homo Sapiens
LRTKKRIYE

SEQ ID NO: 341754 - protein, 9 aa, Homo Sapiens
DLEADSNSK

SEQ ID NO: 341755 - protein, 9 aa, Homo Sapiens
DTKSTRFFC

SEQ ID NO: 341756 - protein, 9 aa, Homo Sapiens
HDRMKDVKC

SEQ ID NO: 341757 - protein, 9 aa, Homo Sapiens
YDSNMLSFY

SEQ ID NO: 341758 - protein, 9 aa, Homo Sapiens
WRKCCLYLF

SEQ ID NO: 341759 - protein, 9 aa, Homo Sapiens
IKFKDNPHL

SEQ ID NO: 341760 - protein, 9 aa, Homo Sapiens
INSSYFLGL

SEQ ID NO: 341761 - protein, 9 aa, Homo Sapiens
QLLPPCELY

SEQ ID NO: 341762 - protein, 9 aa, Homo Sapiens
HHSGRTGRA

SEQ ID NO: 341763 - protein, 9 aa, Homo Sapiens
YEAAHMFFE

SEQ ID NO: 341764 - protein, 9 aa, Homo Sapiens
GSEKLLKED

SEQ ID NO: 341765 - protein, 9 aa, Homo Sapiens
MEARRQQYP

SEQ ID NO: 341766 - protein, 9 aa, Homo Sapiens
DCGQKKFSC

SEQ ID NO: 341767 - protein, 9 aa, Homo Sapiens
SMLMHFSSK

SEQ ID NO: 341768 - protein, 9 aa, Homo Sapiens
LLVCTVCIK

SEQ ID NO: 341769 - protein, 9 aa, Homo Sapiens
SQCLEIDEC

SEQ ID NO: 341770 - protein, 9 aa, Homo Sapiens
KITTFGAFL

SEQ ID NO: 341771 - protein, 9 aa, Homo Sapiens
LEQVHRHMN

SEQ ID NO: 341772 - protein, 9 aa, Homo Sapiens
NKKDLPICG

SEQ ID NO: 341773 - protein, 9 aa, Homo Sapiens
TDEEIANHK

SEQ ID NO: 341774 - protein, 9 aa, Homo Sapiens
FKGLFGGSG

SEQ ID NO: 341775 - protein, 9 aa, Homo Sapiens
NILIYGNIS

SEQ ID NO: 341776 - protein, 9 aa, Homo Sapiens
REKCFTFVL

SEQ ID NO: 341777 - protein, 9 aa, Homo Sapiens
YPIEDFEAS

SEQ ID NO: 341778 - protein, 9 aa, Homo Sapiens
SGGGEPPTS

SEQ ID NO: 341779 - protein, 9 aa, Homo Sapiens
RRTEQFCKS

SEQ ID NO: 341780 - protein, 9 aa, Homo Sapiens
PELPKPTPL

SEQ ID NO: 341781 - protein, 9 aa, Homo Sapiens
RCEPSSQMI

SEQ ID NO: 341782 - protein, 9 aa, Homo Sapiens
GLITLTYKG

SEQ ID NO: 341783 - protein, 9 aa, Homo Sapiens
CTVCIKFSR

SEQ ID NO: 341784 - protein, 9 aa, Homo Sapiens
YNFPQFPDT

SEQ ID NO: 341785 - protein, 9 aa, Homo Sapiens
ALQKKSVLL

SEQ ID NO: 341786 - protein, 9 aa, Homo Sapiens
CRSLRVKRT

SEQ ID NO: 341787 - protein, 9 aa, Homo Sapiens
YFLVMSVIT

SEQ ID NO: 341788 - protein, 9 aa, Homo Sapiens
IQDGLRNAG

SEQ ID NO: 341789 - protein, 9 aa, Homo Sapiens
LSMKVCEKV

SEQ ID NO: 341790 - protein, 9 aa, Homo Sapiens
WKRMCSRPK

SEQ ID NO: 341791 - protein, 9 aa, Homo Sapiens
YGVRLAAKY

SEQ ID NO: 341792 - protein, 9 aa, Homo Sapiens
CGKLFRHSS

SEQ ID NO: 341793 - protein, 9 aa, Homo Sapiens
GRKKHAAEV

SEQ ID NO: 341794 - protein, 9 aa, Homo Sapiens
PLSFLIKRL

SEQ ID NO: 341795 - protein, 9 aa, Homo Sapiens
TLNGIFVLG

SEQ ID NO: 341796 - protein, 9 aa, Homo Sapiens
PPEKRRITI

SEQ ID NO: 341797 - protein, 9 aa, Homo Sapiens
LNHPKTQQY

SEQ ID NO: 341798 - protein, 9 aa, Homo Sapiens
CTDLEELNL

SEQ ID NO: 341799 - protein, 9 aa, Homo Sapiens
LFVPLQSIQ

SEQ ID NO: 341800 - protein, 9 aa, Homo Sapiens
HEAEQLRAH

SEQ ID NO: 341801 - protein, 9 aa, Homo Sapiens
YIVSVCCEE

SEQ ID NO: 341802 - protein, 9 aa, Homo Sapiens
RFKKFLPVM

SEQ ID NO: 341803 - protein, 9 aa, Homo Sapiens
HKTNEIMLA

SEQ ID NO: 341804 - protein, 9 aa, Homo Sapiens
QDRAHRIRQ

SEQ ID NO: 341805 - protein, 9 aa, Homo Sapiens
QAICTGTKT

SEQ ID NO: 341806 - protein, 9 aa, Homo Sapiens
SAQNKEKYT

SEQ ID NO: 341807 - protein, 9 aa, Homo Sapiens
VNTTDLDEG

SEQ ID NO: 341808 - protein, 9 aa, Homo Sapiens
MWCIGDFRP

SEQ ID NO: 341809 - protein, 9 aa, Homo Sapiens
ITKNLSEVG

SEQ ID NO: 341810 - protein, 9 aa, Homo Sapiens
DTHNLLLLQ

SEQ ID NO: 341811 - protein, 9 aa, Homo Sapiens
HSPISQKEF

SEQ ID NO: 341812 - protein, 9 aa, Homo Sapiens
GTISWTDWG

SEQ ID NO: 341813 - protein, 9 aa, Homo Sapiens
IGAIAQAHA

SEQ ID NO: 341814 - protein, 9 aa, Homo Sapiens
YICENQDLI

SEQ ID NO: 341815 - protein, 9 aa, Homo Sapiens
KYGAGEHGL

SEQ ID NO: 341816 - protein, 9 aa, Homo Sapiens
STGKKNGKL

SEQ ID NO: 341817 - protein, 9 aa, Homo Sapiens
LISSKTEKV

SEQ ID NO: 341818 - protein, 9 aa, Homo Sapiens
INRLFLWIF

SEQ ID NO: 341819 - protein, 9 aa, Homo Sapiens
GHNKLKECL

SEQ ID NO: 341820 - protein, 9 aa, Homo Sapiens
DGLDVRKTA

SEQ ID NO: 341821 - protein, 9 aa, Homo Sapiens
TAAAVPKYA

SEQ ID NO: 341822 - protein, 9 aa, Homo Sapiens
RDDGALQPG

SEQ ID NO: 341823 - protein, 9 aa, Homo Sapiens
WPFSALLIT

SEQ ID NO: 341824 - protein, 9 aa, Homo Sapiens
QTESIRWLI

SEQ ID NO: 341825 - protein, 9 aa, Homo Sapiens
QNGYMINLD

SEQ ID NO: 341826 - protein, 9 aa, Homo Sapiens
NVKGDELDA

SEQ ID NO: 341827 - protein, 9 aa, Homo Sapiens
AQLEKMSKD

SEQ ID NO: 341828 - protein, 9 aa, Homo Sapiens
RLTAREYAL

SEQ ID NO: 341829 - protein, 9 aa, Homo Sapiens
VQLLNFFSG

SEQ ID NO: 341830 - protein, 9 aa, Homo Sapiens
SEPRPSLSG

SEQ ID NO: 341831 - protein, 9 aa, Homo Sapiens
AFVSTVGIN

SEQ ID NO: 341832 - protein, 9 aa, Homo Sapiens
SATILSIVG

SEQ ID NO: 341833 - protein, 9 aa, Homo Sapiens
IKLMIIPDP

SEQ ID NO: 341834 - protein, 9 aa, Homo Sapiens
QLMFFIGSF

SEQ ID NO: 341835 - protein, 9 aa, Homo Sapiens
LDNLVYYNR

SEQ ID NO: 341836 - protein, 9 aa, Homo Sapiens
LSSVICCLC

SEQ ID NO: 341837 - protein, 9 aa, Homo Sapiens
PKTPVNTNQ

SEQ ID NO: 341838 - protein, 9 aa, Homo Sapiens
DDSAMNTLR

SEQ ID NO: 341839 - protein, 9 aa, Homo Sapiens
NIKILHLKQ

SEQ ID NO: 341840 - protein, 9 aa, Homo Sapiens
GLHIALAIS

SEQ ID NO: 341841 - protein, 9 aa, Homo Sapiens
GNKSGKKAG

SEQ ID NO: 341842 - protein, 9 aa, Homo Sapiens
ASCRCKSGY

SEQ ID NO: 341843 - protein, 9 aa, Homo Sapiens
DHLWHIQGC

SEQ ID NO: 341844 - protein, 9 aa, Homo Sapiens
LKPEQSFEI

SEQ ID NO: 341845 - protein, 9 aa, Homo Sapiens
YFSAVPPTK

SEQ ID NO: 341846 - protein, 9 aa, Homo Sapiens
AVLRISSAT

SEQ ID NO: 341847 - protein, 9 aa, Homo Sapiens
KDNSTASEV

SEQ ID NO: 341848 - protein, 9 aa, Homo Sapiens
LCKHEKNHS

SEQ ID NO: 341849 - protein, 9 aa, Homo Sapiens
STDFSELKQ

SEQ ID NO: 341850 - protein, 9 aa, Homo Sapiens
ISTNNGKRC

SEQ ID NO: 341851 - protein, 9 aa, Homo Sapiens
FITLFPLSF

SEQ ID NO: 341852 - protein, 9 aa, Homo Sapiens
RWHKLMMSV

SEQ ID NO: 341853 - protein, 9 aa, Homo Sapiens
KGSEKLLKE

SEQ ID NO: 341854 - protein, 9 aa, Homo Sapiens
FITPCVCIL

SEQ ID NO: 341855 - protein, 9 aa, Homo Sapiens
GKIRVTVTL

SEQ ID NO: 341856 - protein, 9 aa, Homo Sapiens
EKVNNLVKE

SEQ ID NO: 341857 - protein, 9 aa, Homo Sapiens
KASNSTQTG

SEQ ID NO: 341858 - protein, 9 aa, Homo Sapiens
GLEDNWNWD

SEQ ID NO: 341859 - protein, 9 aa, Homo Sapiens
RILVANNRL

SEQ ID NO: 341860 - protein, 9 aa, Homo Sapiens
PYCGSQSIN

SEQ ID NO: 341861 - protein, 9 aa, Homo Sapiens
QLVGLIQSS

SEQ ID NO: 341862 - protein, 9 aa, Homo Sapiens
ELQGLADFI

SEQ ID NO: 341863 - protein, 9 aa, Homo Sapiens
WEEFLMSFT

SEQ ID NO: 341864 - protein, 9 aa, Homo Sapiens
VEKLNSHHN

SEQ ID NO: 341865 - protein, 9 aa, Homo Sapiens
IDCGKSFCH

SEQ ID NO: 341866 - protein, 9 aa, Homo Sapiens
GQVFRPDNL

SEQ ID NO: 341867 - protein, 9 aa, Homo Sapiens
VQRVTLASG

SEQ ID NO: 341868 - protein, 9 aa, Homo Sapiens
KNLKEEHLK

SEQ ID NO: 341869 - protein, 9 aa, Homo Sapiens
EVSAKERRS

SEQ ID NO: 341870 - protein, 9 aa, Homo Sapiens
VKALRSWRI

SEQ ID NO: 341871 - protein, 9 aa, Homo Sapiens
DLDKFRDIL

SEQ ID NO: 341872 - protein, 9 aa, Homo Sapiens
IIREKYIEI

SEQ ID NO: 341873 - protein, 9 aa, Homo Sapiens
PGYTGEFCQ

SEQ ID NO: 341874 - protein, 9 aa, Homo Sapiens
KKSKHMLAY

SEQ ID NO: 341875 - protein, 9 aa, Homo Sapiens
AMLKNICEV

SEQ ID NO: 341876 - protein, 9 aa, Homo Sapiens
ECQNLQLLP

SEQ ID NO: 341877 - protein, 9 aa, Homo Sapiens
TTPAKKTVT

SEQ ID NO: 341878 - protein, 9 aa, Homo Sapiens
VKEVPCLEG

SEQ ID NO: 341879 - protein, 9 aa, Homo Sapiens
LGITAIKLA

SEQ ID NO: 341880 - protein, 9 aa, Homo Sapiens
SAVHNHTYQ

SEQ ID NO: 341881 - protein, 9 aa, Homo Sapiens
RMYVAETVL

SEQ ID NO: 341882 - protein, 9 aa, Homo Sapiens
SFTDAPAMT

SEQ ID NO: 341883 - protein, 9 aa, Homo Sapiens
DKEKPVKQD

SEQ ID NO: 341884 - protein, 9 aa, Homo Sapiens
IGGGWLVHE

SEQ ID NO: 341885 - protein, 9 aa, Homo Sapiens
GYIYCQIID

SEQ ID NO: 341886 - protein, 9 aa, Homo Sapiens
ALLLQIPSC

SEQ ID NO: 341887 - protein, 9 aa, Homo Sapiens
VRRQNPQMR

SEQ ID NO: 341888 - protein, 9 aa, Homo Sapiens
NRVLVMSYS

SEQ ID NO: 341889 - protein, 9 aa, Homo Sapiens
PGNDQIDSM

SEQ ID NO: 341890 - protein, 9 aa, Homo Sapiens
PTLREDKRP

SEQ ID NO: 341891 - protein, 9 aa, Homo Sapiens
NESSIDYIS

SEQ ID NO: 341892 - protein, 9 aa, Homo Sapiens
EFRKQIHNL

SEQ ID NO: 341893 - protein, 9 aa, Homo Sapiens
IMLALSSFN

SEQ ID NO: 341894 - protein, 9 aa, Homo Sapiens
TIIFNEVEI

SEQ ID NO: 341895 - protein, 9 aa, Homo Sapiens
RNNRRKNKC

SEQ ID NO: 341896 - protein, 9 aa, Homo Sapiens
DAARQGVYK

SEQ ID NO: 341897 - protein, 9 aa, Homo Sapiens
RGEKYLAYH

SEQ ID NO: 341898 - protein, 9 aa, Homo Sapiens
IVTGLQPIN

SEQ ID NO: 341899 - protein, 9 aa, Homo Sapiens
EAAKQELEQ

SEQ ID NO: 341900 - protein, 9 aa, Homo Sapiens
NKVEARKNY

SEQ ID NO: 341901 - protein, 9 aa, Homo Sapiens
AATVTVLFL

SEQ ID NO: 341902 - protein, 9 aa, Homo Sapiens
LTEMQNDLF

SEQ ID NO: 341903 - protein, 9 aa, Homo Sapiens
GPLGQHEVC

SEQ ID NO: 341904 - protein, 9 aa, Homo Sapiens
IAILQSYRF

SEQ ID NO: 341905 - protein, 9 aa, Homo Sapiens
KGVARLYRS

SEQ ID NO: 341906 - protein, 9 aa, Homo Sapiens
PRIATTIII

SEQ ID NO: 341907 - protein, 9 aa, Homo Sapiens
RLINSMSKQ

SEQ ID NO: 341908 - protein, 9 aa, Homo Sapiens
VGGIIRTCQ

SEQ ID NO: 341909 - protein, 9 aa, Homo Sapiens
IDKGNAFNQ

SEQ ID NO: 341910 - protein, 9 aa, Homo Sapiens
VMDQLSYSI

SEQ ID NO: 341911 - protein, 9 aa, Homo Sapiens
TPQKSSLTQ

SEQ ID NO: 341912 - protein, 9 aa, Homo Sapiens
NNSPLKREK

SEQ ID NO: 341913 - protein, 9 aa, Homo Sapiens
IYFNGVSLM

SEQ ID NO: 341914 - protein, 9 aa, Homo Sapiens
LHAAIDIYT

SEQ ID NO: 341915 - protein, 9 aa, Homo Sapiens
FTTQKSVPD

SEQ ID NO: 341916 - protein, 9 aa, Homo Sapiens
QLCQAIEEL

SEQ ID NO: 341917 - protein, 9 aa, Homo Sapiens
TKDSSAAWN

SEQ ID NO: 341918 - protein, 9 aa, Homo Sapiens
TVLRIPPKY

SEQ ID NO: 341919 - protein, 9 aa, Homo Sapiens
PQQGQGRHN

SEQ ID NO: 341920 - protein, 9 aa, Homo Sapiens
AVITCIVSR

SEQ ID NO: 341921 - protein, 9 aa, Homo Sapiens
RQRHRHERT

SEQ ID NO: 341922 - protein, 9 aa, Homo Sapiens
GNTFNRCSH

SEQ ID NO: 341923 - protein, 9 aa, Homo Sapiens
DETFCIDNK

SEQ ID NO: 341924 - protein, 9 aa, Homo Sapiens
YGRKSKYKI

SEQ ID NO: 341925 - protein, 9 aa, Homo Sapiens
VQQELSRSG

SEQ ID NO: 341926 - protein, 9 aa, Homo Sapiens
MKLSKDVTY

SEQ ID NO: 341927 - protein, 9 aa, Homo Sapiens
GFDHKNLIQ

SEQ ID NO: 341928 - protein, 9 aa, Homo Sapiens
NTSQRGKSG

SEQ ID NO: 341929 - protein, 9 aa, Homo Sapiens
REDKRPEGP

SEQ ID NO: 341930 - protein, 9 aa, Homo Sapiens
ILDTASLVP

SEQ ID NO: 341931 - protein, 9 aa, Homo Sapiens
VLLDYDSNM

SEQ ID NO: 341932 - protein, 9 aa, Homo Sapiens
HEHKLSPGV

SEQ ID NO: 341933 - protein, 9 aa, Homo Sapiens
PFRKNKMKE

SEQ ID NO: 341934 - protein, 9 aa, Homo Sapiens
AGVGRMGVF

SEQ ID NO: 341935 - protein, 9 aa, Homo Sapiens
RLYKSNKLF

SEQ ID NO: 341936 - protein, 9 aa, Homo Sapiens
HIPNIFQNI

SEQ ID NO: 341937 - protein, 9 aa, Homo Sapiens
TCLLLASKQ

SEQ ID NO: 341938 - protein, 9 aa, Homo Sapiens
MALKVEDPF

SEQ ID NO: 341939 - protein, 9 aa, Homo Sapiens
QSPFVPEEM

SEQ ID NO: 341940 - protein, 9 aa, Homo Sapiens
QKKAQEVLL

SEQ ID NO: 341941 - protein, 9 aa, Homo Sapiens
KREKNILEY

SEQ ID NO: 341942 - protein, 9 aa, Homo Sapiens
KILETSLKI

SEQ ID NO: 341943 - protein, 9 aa, Homo Sapiens
IIVVSIIFI

SEQ ID NO: 341944 - protein, 9 aa, Homo Sapiens
KQEENNEDH

SEQ ID NO: 341945 - protein, 9 aa, Homo Sapiens
FNVCMGFGF

SEQ ID NO: 341946 - protein, 9 aa, Homo Sapiens
EWVCLGNGK

SEQ ID NO: 341947 - protein, 9 aa, Homo Sapiens
INNDGDGFV

SEQ ID NO: 341948 - protein, 9 aa, Homo Sapiens
NKLPDYSPF

SEQ ID NO: 341949 - protein, 9 aa, Homo Sapiens
PANGTSVYY

SEQ ID NO: 341950 - protein, 9 aa, Homo Sapiens
EIINLAKKD

SEQ ID NO: 341951 - protein, 9 aa, Homo Sapiens
ISFSTTSAS

SEQ ID NO: 341952 - protein, 9 aa, Homo Sapiens
VYYITFSPD

SEQ ID NO: 341953 - protein, 9 aa, Homo Sapiens
DWQLQQLVN

SEQ ID NO: 341954 - protein, 9 aa, Homo Sapiens
VDFLNPLTA

SEQ ID NO: 341955 - protein, 9 aa, Homo Sapiens
PACANEIAL

SEQ ID NO: 341956 - protein, 9 aa, Homo Sapiens
KELTIKPLD

SEQ ID NO: 341957 - protein, 9 aa, Homo Sapiens
IQRITEISR

SEQ ID NO: 341958 - protein, 9 aa, Homo Sapiens
LAISKGFWG

SEQ ID NO: 341959 - protein, 9 aa, Homo Sapiens
NKAFSKENM

SEQ ID NO: 341960 - protein, 9 aa, Homo Sapiens
FQQSECREV

SEQ ID NO: 341961 - protein, 9 aa, Homo Sapiens
TFPHHGIAT

SEQ ID NO: 341962 - protein, 9 aa, Homo Sapiens
RSSFEKHRK

SEQ ID NO: 341963 - protein, 9 aa, Homo Sapiens
DIFNMARDQ

SEQ ID NO: 341964 - protein, 9 aa, Homo Sapiens
RIKSRDLPE

SEQ ID NO: 341965 - protein, 9 aa, Homo Sapiens
VAEDPLVQS

SEQ ID NO: 341966 - protein, 9 aa, Homo Sapiens
HVVSQWSRS

SEQ ID NO: 341967 - protein, 9 aa, Homo Sapiens
PTIQSDIPA

SEQ ID NO: 341968 - protein, 9 aa, Homo Sapiens
AVREKLTDE

SEQ ID NO: 341969 - protein, 9 aa, Homo Sapiens
SPHPTYLQQ

SEQ ID NO: 341970 - protein, 9 aa, Homo Sapiens
IQAYFYDLH

SEQ ID NO: 341971 - protein, 9 aa, Homo Sapiens
EKCVSVAQQ

SEQ ID NO: 341972 - protein, 9 aa, Homo Sapiens
PYFGPVFTE

SEQ ID NO: 341973 - protein, 9 aa, Homo Sapiens
SLGITAIKL

SEQ ID NO: 341974 - protein, 9 aa, Homo Sapiens
TNGQLMANP

SEQ ID NO: 341975 - protein, 9 aa, Homo Sapiens
SKKKLTPFT

SEQ ID NO: 341976 - protein, 9 aa, Homo Sapiens
SPSQSTQLD

SEQ ID NO: 341977 - protein, 9 aa, Homo Sapiens
WKVRQTLAF

SEQ ID NO: 341978 - protein, 9 aa, Homo Sapiens
NDILKASLA

SEQ ID NO: 341979 - protein, 9 aa, Homo Sapiens
NVTLRLQAE

SEQ ID NO: 341980 - protein, 9 aa, Homo Sapiens
LKENTLILL

SEQ ID NO: 341981 - protein, 9 aa, Homo Sapiens
RRYVCKFVL

SEQ ID NO: 341982 - protein, 9 aa, Homo Sapiens
NRTATFVKW

SEQ ID NO: 341983 - protein, 9 aa, Homo Sapiens
EELALRALR

SEQ ID NO: 341984 - protein, 9 aa, Homo Sapiens
IPEFLAEHR

SEQ ID NO: 341985 - protein, 9 aa, Homo Sapiens
PESECIIKV

SEQ ID NO: 341986 - protein, 9 aa, Homo Sapiens
KEMEGTSSK

SEQ ID NO: 341987 - protein, 9 aa, Homo Sapiens
YKIQGLPNE

SEQ ID NO: 341988 - protein, 9 aa, Homo Sapiens
ATDIGFGNQ

SEQ ID NO: 341989 - protein, 9 aa, Homo Sapiens
LITLTYKGP

SEQ ID NO: 341990 - protein, 9 aa, Homo Sapiens
DCIRIELRS

SEQ ID NO: 341991 - protein, 9 aa, Homo Sapiens
PTDIMAELE

SEQ ID NO: 341992 - protein, 9 aa, Homo Sapiens
ETTADCRYR

SEQ ID NO: 341993 - protein, 9 aa, Homo Sapiens
LYIARAVML

SEQ ID NO: 341994 - protein, 9 aa, Homo Sapiens
RSHQQECDE

SEQ ID NO: 341995 - protein, 9 aa, Homo Sapiens
LKKICVKNV

SEQ ID NO: 341996 - protein, 9 aa, Homo Sapiens
AHHLSEPEI

SEQ ID NO: 341997 - protein, 9 aa, Homo Sapiens
THFVRFVLM

SEQ ID NO: 341998 - protein, 9 aa, Homo Sapiens
LCDYTQINV

SEQ ID NO: 341999 - protein, 9 aa, Homo Sapiens
EECPPPYFS

SEQ ID NO: 342000 - protein, 9 aa, Homo Sapiens
SYFLLHQII

SEQ ID NO: 342001 - protein, 9 aa, Homo Sapiens
NLVYHFCDV

SEQ ID NO: 342002 - protein, 9 aa, Homo Sapiens
EEASHIEEL

SEQ ID NO: 342003 - protein, 9 aa, Homo Sapiens
QPLKNPSVP

SEQ ID NO: 342004 - protein, 9 aa, Homo Sapiens
HPTLPYRYN

SEQ ID NO: 342005 - protein, 9 aa, Homo Sapiens
PLSQARSLL

SEQ ID NO: 342006 - protein, 9 aa, Homo Sapiens
SESESWSVK

SEQ ID NO: 342007 - protein, 9 aa, Homo Sapiens
SFNGILYYY

SEQ ID NO: 342008 - protein, 9 aa, Homo Sapiens
VQKGPLTLK

SEQ ID NO: 342009 - protein, 9 aa, Homo Sapiens
ILTKHKIIC

SEQ ID NO: 342010 - protein, 9 aa, Homo Sapiens
KFCVEHHTF

SEQ ID NO: 342011 - protein, 9 aa, Homo Sapiens
AAGVHNPQQ

SEQ ID NO: 342012 - protein, 9 aa, Homo Sapiens
AQGVSHLHI

SEQ ID NO: 342013 - protein, 9 aa, Homo Sapiens
MNRGCEGFS

SEQ ID NO: 342014 - protein, 9 aa, Homo Sapiens
QHNTRSNVS

SEQ ID NO: 342015 - protein, 9 aa, Homo Sapiens
TVVFYQMAK

SEQ ID NO: 342016 - protein, 9 aa, Homo Sapiens
AICTILVPV

SEQ ID NO: 342017 - protein, 9 aa, Homo Sapiens
YHARKVQMD

SEQ ID NO: 342018 - protein, 9 aa, Homo Sapiens
TVTLSVNVT

SEQ ID NO: 342019 - protein, 9 aa, Homo Sapiens
LFCAYAYPY

SEQ ID NO: 342020 - protein, 9 aa, Homo Sapiens
CAKFFELSD

SEQ ID NO: 342021 - protein, 9 aa, Homo Sapiens
EAPPNRQTC

SEQ ID NO: 342022 - protein, 9 aa, Homo Sapiens
TSLNREMYS

SEQ ID NO: 342023 - protein, 9 aa, Homo Sapiens
AIIWHRPAL

SEQ ID NO: 342024 - protein, 9 aa, Homo Sapiens
LHQKAHRLP

SEQ ID NO: 342025 - protein, 9 aa, Homo Sapiens
HGVPLDLQD

SEQ ID NO: 342026 - protein, 9 aa, Homo Sapiens
EARKNYQTL

SEQ ID NO: 342027 - protein, 9 aa, Homo Sapiens
NVQNNTRVI

SEQ ID NO: 342028 - protein, 9 aa, Homo Sapiens
HLAQSKNRS

SEQ ID NO: 342029 - protein, 9 aa, Homo Sapiens
LISSQPVIS

SEQ ID NO: 342030 - protein, 9 aa, Homo Sapiens
DRRGAELVT

SEQ ID NO: 342031 - protein, 9 aa, Homo Sapiens
PFNIYMFKN

SEQ ID NO: 342032 - protein, 9 aa, Homo Sapiens
REVSAKERR

SEQ ID NO: 342033 - protein, 9 aa, Homo Sapiens
IEQQASIML

SEQ ID NO: 342034 - protein, 9 aa, Homo Sapiens
NTCSTSSPG

SEQ ID NO: 342035 - protein, 9 aa, Homo Sapiens
LISDLEMDV

SEQ ID NO: 342036 - protein, 9 aa, Homo Sapiens
VQMDKGVIQ

SEQ ID NO: 342037 - protein, 9 aa, Homo Sapiens
KYGNTLSVK

SEQ ID NO: 342038 - protein, 9 aa, Homo Sapiens
QPPTVMFSS

SEQ ID NO: 342039 - protein, 9 aa, Homo Sapiens
LVWKFAYAH

SEQ ID NO: 342040 - protein, 9 aa, Homo Sapiens
IQRTEELKE

SEQ ID NO: 342041 - protein, 9 aa, Homo Sapiens
HKPDRLDRL

SEQ ID NO: 342042 - protein, 9 aa, Homo Sapiens
MQEWQHTSN

SEQ ID NO: 342043 - protein, 9 aa, Homo Sapiens
FFQGYNRLA

SEQ ID NO: 342044 - protein, 9 aa, Homo Sapiens
LPLSECIRG

SEQ ID NO: 342045 - protein, 9 aa, Homo Sapiens
GVLGFNTSW

SEQ ID NO: 342046 - protein, 9 aa, Homo Sapiens
SSLCRHRMH

SEQ ID NO: 342047 - protein, 9 aa, Homo Sapiens
YSASSELFK

SEQ ID NO: 342048 - protein, 9 aa, Homo Sapiens
EHDHRITSQ

SEQ ID NO: 342049 - protein, 9 aa, Homo Sapiens
MLQHEERET

SEQ ID NO: 342050 - protein, 9 aa, Homo Sapiens
RLEQENEDL

SEQ ID NO: 342051 - protein, 9 aa, Homo Sapiens
VALAMALMG

SEQ ID NO: 342052 - protein, 9 aa, Homo Sapiens
YLSKVNASR

SEQ ID NO: 342053 - protein, 9 aa, Homo Sapiens
KIKEENIFC

SEQ ID NO: 342054 - protein, 9 aa, Homo Sapiens
CKCWVGYEP

SEQ ID NO: 342055 - protein, 9 aa, Homo Sapiens
TLKTDALLG

SEQ ID NO: 342056 - protein, 9 aa, Homo Sapiens
NGCQLFITC

SEQ ID NO: 342057 - protein, 9 aa, Homo Sapiens
GSMFIADTH

SEQ ID NO: 342058 - protein, 9 aa, Homo Sapiens
HKDSYLRNG

SEQ ID NO: 342059 - protein, 9 aa, Homo Sapiens
NDVNTYNAA

SEQ ID NO: 342060 - protein, 9 aa, Homo Sapiens
EDLAHELVT

SEQ ID NO: 342061 - protein, 9 aa, Homo Sapiens
KADAPLTTS

SEQ ID NO: 342062 - protein, 9 aa, Homo Sapiens
YFYSFYVCT

SEQ ID NO: 342063 - protein, 9 aa, Homo Sapiens
NCKKITDKL

SEQ ID NO: 342064 - protein, 9 aa, Homo Sapiens
VAYTIGLIM

SEQ ID NO: 342065 - protein, 9 aa, Homo Sapiens
EYNSTRDLE

SEQ ID NO: 342066 - protein, 9 aa, Homo Sapiens
VHTDEEIAN

SEQ ID NO: 342067 - protein, 9 aa, Homo Sapiens
SIFVVSGDT

SEQ ID NO: 342068 - protein, 9 aa, Homo Sapiens
NGEKLLIWM

SEQ ID NO: 342069 - protein, 9 aa, Homo Sapiens
KIVDRINND

SEQ ID NO: 342070 - protein, 9 aa, Homo Sapiens
KIKHLRVLF

SEQ ID NO: 342071 - protein, 9 aa, Homo Sapiens
IINQLTAMS

SEQ ID NO: 342072 - protein, 9 aa, Homo Sapiens
FLLFSLSLS

SEQ ID NO: 342073 - protein, 9 aa, Homo Sapiens
GLRHLSMKV

SEQ ID NO: 342074 - protein, 9 aa, Homo Sapiens
DMELLVCTV

SEQ ID NO: 342075 - protein, 9 aa, Homo Sapiens
VKLTHQAAI

SEQ ID NO: 342076 - protein, 9 aa, Homo Sapiens
KNKVKESVS

SEQ ID NO: 342077 - protein, 9 aa, Homo Sapiens
VIVIISHTL

SEQ ID NO: 342078 - protein, 9 aa, Homo Sapiens
SPVRKNLFC

SEQ ID NO: 342079 - protein, 9 aa, Homo Sapiens
WTNNYSMVL

SEQ ID NO: 342080 - protein, 9 aa, Homo Sapiens
ASENKEIVK

SEQ ID NO: 342081 - protein, 9 aa, Homo Sapiens
LMLISVSVL

SEQ ID NO: 342082 - protein, 9 aa, Homo Sapiens
IKEGGLCTV

SEQ ID NO: 342083 - protein, 9 aa, Homo Sapiens
DHIRLVVTK

SEQ ID NO: 342084 - protein, 9 aa, Homo Sapiens
YIQTQIISK

SEQ ID NO: 342085 - protein, 9 aa, Homo Sapiens
MMTVGPHQR

SEQ ID NO: 342086 - protein, 9 aa, Homo Sapiens
VGPYGIQSE

SEQ ID NO: 342087 - protein, 9 aa, Homo Sapiens
TPLIKAGLT

SEQ ID NO: 342088 - protein, 9 aa, Homo Sapiens
DSDEDLGTA

SEQ ID NO: 342089 - protein, 9 aa, Homo Sapiens
CRRKRRNLK

SEQ ID NO: 342090 - protein, 9 aa, Homo Sapiens
NNATKAGEG

SEQ ID NO: 342091 - protein, 9 aa, Homo Sapiens
RRPDQKDLL

SEQ ID NO: 342092 - protein, 9 aa, Homo Sapiens
LERKKAKII

SEQ ID NO: 342093 - protein, 9 aa, Homo Sapiens
ITRYNNHTY

SEQ ID NO: 342094 - protein, 9 aa, Homo Sapiens
WNLKEEAQL

SEQ ID NO: 342095 - protein, 9 aa, Homo Sapiens
PNLLSMLLT

SEQ ID NO: 342096 - protein, 9 aa, Homo Sapiens
QHREEMQKE

SEQ ID NO: 342097 - protein, 9 aa, Homo Sapiens
AHLIQHHKL

SEQ ID NO: 342098 - protein, 9 aa, Homo Sapiens
LDRKTICDG

SEQ ID NO: 342099 - protein, 9 aa, Homo Sapiens
QSTICRFEP

SEQ ID NO: 342100 - protein, 9 aa, Homo Sapiens
HPNHLFCES

SEQ ID NO: 342101 - protein, 9 aa, Homo Sapiens
QVNIPLSVY

SEQ ID NO: 342102 - protein, 9 aa, Homo Sapiens
SGTTHKRII

SEQ ID NO: 342103 - protein, 9 aa, Homo Sapiens
RIMNLIGMM

SEQ ID NO: 342104 - protein, 9 aa, Homo Sapiens
TLHPGLRAA

SEQ ID NO: 342105 - protein, 9 aa, Homo Sapiens
GCDTCMADT

SEQ ID NO: 342106 - protein, 9 aa, Homo Sapiens
PIKVMVTLG

SEQ ID NO: 342107 - protein, 9 aa, Homo Sapiens
KFLKSKGYD

SEQ ID NO: 342108 - protein, 9 aa, Homo Sapiens
EEQVKQKSM

SEQ ID NO: 342109 - protein, 9 aa, Homo Sapiens
IIVIFPIFA

SEQ ID NO: 342110 - protein, 9 aa, Homo Sapiens
RNGDPEESQ

SEQ ID NO: 342111 - protein, 9 aa, Homo Sapiens
KRSRYFQSP

SEQ ID NO: 342112 - protein, 9 aa, Homo Sapiens
FYCSPATPA

SEQ ID NO: 342113 - protein, 9 aa, Homo Sapiens
WKLMKNIFC

SEQ ID NO: 342114 - protein, 9 aa, Homo Sapiens
GGEILNKTR

SEQ ID NO: 342115 - protein, 9 aa, Homo Sapiens
GVFEYHNIW

SEQ ID NO: 342116 - protein, 9 aa, Homo Sapiens
TDIGFGNQC

SEQ ID NO: 342117 - protein, 9 aa, Homo Sapiens
WLKNCNLVG

SEQ ID NO: 342118 - protein, 9 aa, Homo Sapiens
RVRTSIKDA

SEQ ID NO: 342119 - protein, 9 aa, Homo Sapiens
PTANRSGRS

SEQ ID NO: 342120 - protein, 9 aa, Homo Sapiens
NCVKALRSW

SEQ ID NO: 342121 - protein, 9 aa, Homo Sapiens
DELPPLPPK

SEQ ID NO: 342122 - protein, 9 aa, Homo Sapiens
IEHQKFGKA

SEQ ID NO: 342123 - protein, 9 aa, Homo Sapiens
GSSTIQNLK

SEQ ID NO: 342124 - protein, 9 aa, Homo Sapiens
YLCDQERQS

SEQ ID NO: 342125 - protein, 9 aa, Homo Sapiens
DTWLVCWTI

SEQ ID NO: 342126 - protein, 9 aa, Homo Sapiens
ADRFKTKHI

SEQ ID NO: 342127 - protein, 9 aa, Homo Sapiens
WPFPGVLEC

SEQ ID NO: 342128 - protein, 9 aa, Homo Sapiens
KASCRCKSG

SEQ ID NO: 342129 - protein, 9 aa, Homo Sapiens
CLTQHQITH

SEQ ID NO: 342130 - protein, 9 aa, Homo Sapiens
QATTVSLCL

SEQ ID NO: 342131 - protein, 9 aa, Homo Sapiens
LCFSEYIPT

SEQ ID NO: 342132 - protein, 9 aa, Homo Sapiens
PWAIIYIPV

SEQ ID NO: 342133 - protein, 9 aa, Homo Sapiens
QWPFSALLI

SEQ ID NO: 342134 - protein, 9 aa, Homo Sapiens
TQHQIFHTG

SEQ ID NO: 342135 - protein, 9 aa, Homo Sapiens
PSVELETIF

SEQ ID NO: 342136 - protein, 9 aa, Homo Sapiens
KVYLCDQER

SEQ ID NO: 342137 - protein, 9 aa, Homo Sapiens
LFTLEGRPR

SEQ ID NO: 342138 - protein, 9 aa, Homo Sapiens
VKQRLSLKA

SEQ ID NO: 342139 - protein, 9 aa, Homo Sapiens
VSATGHSDR

SEQ ID NO: 342140 - protein, 9 aa, Homo Sapiens
IFCVHWRRE

SEQ ID NO: 342141 - protein, 9 aa, Homo Sapiens
PFKIIYDDG

SEQ ID NO: 342142 - protein, 9 aa, Homo Sapiens
LKQIHSAAV

SEQ ID NO: 342143 - protein, 9 aa, Homo Sapiens
SDSQSGSPH

SEQ ID NO: 342144 - protein, 9 aa, Homo Sapiens
LEQQRRLEW

SEQ ID NO: 342145 - protein, 9 aa, Homo Sapiens
AVFQYGHFS

SEQ ID NO: 342146 - protein, 9 aa, Homo Sapiens
CTKFKSLQL

SEQ ID NO: 342147 - protein, 9 aa, Homo Sapiens
KTIRQKIVD

SEQ ID NO: 342148 - protein, 9 aa, Homo Sapiens
KWHLGIQSQ

SEQ ID NO: 342149 - protein, 9 aa, Homo Sapiens
FGTVIVAGY

SEQ ID NO: 342150 - protein, 9 aa, Homo Sapiens
CATDTQNVT

SEQ ID NO: 342151 - protein, 9 aa, Homo Sapiens
TLILVAVFQ

SEQ ID NO: 342152 - protein, 9 aa, Homo Sapiens
NVAPSVIHY

SEQ ID NO: 342153 - protein, 9 aa, Homo Sapiens
GHISVQFDP

SEQ ID NO: 342154 - protein, 9 aa, Homo Sapiens
RKEKIWDPA

SEQ ID NO: 342155 - protein, 9 aa, Homo Sapiens
FPIPNSPLA

SEQ ID NO: 342156 - protein, 9 aa, Homo Sapiens
HPHRLTGNN

SEQ ID NO: 342157 - protein, 9 aa, Homo Sapiens
GVIRHCVVC

SEQ ID NO: 342158 - protein, 9 aa, Homo Sapiens
EKDFDLVDK

SEQ ID NO: 342159 - protein, 9 aa, Homo Sapiens
EILFKKLIL

SEQ ID NO: 342160 - protein, 9 aa, Homo Sapiens
PHHVEPLKR

SEQ ID NO: 342161 - protein, 9 aa, Homo Sapiens
LVPTVAQYH

SEQ ID NO: 342162 - protein, 9 aa, Homo Sapiens
HFFCGISPI

SEQ ID NO: 342163 - protein, 9 aa, Homo Sapiens
QEYNQIQKE

SEQ ID NO: 342164 - protein, 9 aa, Homo Sapiens
PDISLHVPP

SEQ ID NO: 342165 - protein, 9 aa, Homo Sapiens
QYSADIIFL

SEQ ID NO: 342166 - protein, 9 aa, Homo Sapiens
QDIMLLCLA

SEQ ID NO: 342167 - protein, 9 aa, Homo Sapiens
GKMSRITMQ

SEQ ID NO: 342168 - protein, 9 aa, Homo Sapiens
KINSSYFLG

SEQ ID NO: 342169 - protein, 9 aa, Homo Sapiens
PTQMFPHHS

SEQ ID NO: 342170 - protein, 9 aa, Homo Sapiens
GNLNVTWRG

SEQ ID NO: 342171 - protein, 9 aa, Homo Sapiens
CQFDISVND

SEQ ID NO: 342172 - protein, 9 aa, Homo Sapiens
LSVNSVFTF

SEQ ID NO: 342173 - protein, 9 aa, Homo Sapiens
GQGPKYVNI

SEQ ID NO: 342174 - protein, 9 aa, Homo Sapiens
LEENLQRSD

SEQ ID NO: 342175 - protein, 9 aa, Homo Sapiens
QEDSRHGQV

SEQ ID NO: 342176 - protein, 9 aa, Homo Sapiens
YLTNLLELE

SEQ ID NO: 342177 - protein, 9 aa, Homo Sapiens
ALSEMASAQ

SEQ ID NO: 342178 - protein, 9 aa, Homo Sapiens
KPDLSEVVK

SEQ ID NO: 342179 - protein, 9 aa, Homo Sapiens
KRARKITSM

SEQ ID NO: 342180 - protein, 9 aa, Homo Sapiens
ENDLLRKGV

SEQ ID NO: 342181 - protein, 9 aa, Homo Sapiens
YKCDACNLQ

SEQ ID NO: 342182 - protein, 9 aa, Homo Sapiens
SFHFKYVHY

SEQ ID NO: 342183 - protein, 9 aa, Homo Sapiens
RGLPPMHMG

SEQ ID NO: 342184 - protein, 9 aa, Homo Sapiens
VEEGKMGDE

SEQ ID NO: 342185 - protein, 9 aa, Homo Sapiens
VLGHLSFLE

SEQ ID NO: 342186 - protein, 9 aa, Homo Sapiens
KPKTKIYKY

SEQ ID NO: 342187 - protein, 9 aa, Homo Sapiens
SPEELDKLQ

SEQ ID NO: 342188 - protein, 9 aa, Homo Sapiens
EAESGGLRP

SEQ ID NO: 342189 - protein, 9 aa, Homo Sapiens
PFLGHCHYE

SEQ ID NO: 342190 - protein, 9 aa, Homo Sapiens
GRMGVFITL

SEQ ID NO: 342191 - protein, 9 aa, Homo Sapiens
WQSQDLAPS

SEQ ID NO: 342192 - protein, 9 aa, Homo Sapiens
FLLLLFSLV

SEQ ID NO: 342193 - protein, 9 aa, Homo Sapiens
YVREFVLRF

SEQ ID NO: 342194 - protein, 9 aa, Homo Sapiens
VSRKRQILI

SEQ ID NO: 342195 - protein, 9 aa, Homo Sapiens
FSSQSINFQ

SEQ ID NO: 342196 - protein, 9 aa, Homo Sapiens
DKMTNKMQK

SEQ ID NO: 342197 - protein, 9 aa, Homo Sapiens
GIEDMLERH

SEQ ID NO: 342198 - protein, 9 aa, Homo Sapiens
KLKEQEFRK

SEQ ID NO: 342199 - protein, 9 aa, Homo Sapiens
ITGIIYPHN

SEQ ID NO: 342200 - protein, 9 aa, Homo Sapiens
DISAFELQT

SEQ ID NO: 342201 - protein, 9 aa, Homo Sapiens
KPDENEVQT

SEQ ID NO: 342202 - protein, 9 aa, Homo Sapiens
FLHQCILWF

SEQ ID NO: 342203 - protein, 9 aa, Homo Sapiens
DYQAESLAV

SEQ ID NO: 342204 - protein, 9 aa, Homo Sapiens
KSLNLTNHQ

SEQ ID NO: 342205 - protein, 9 aa, Homo Sapiens
PEQNNRTPL

SEQ ID NO: 342206 - protein, 9 aa, Homo Sapiens
TFQGHDAPV

SEQ ID NO: 342207 - protein, 9 aa, Homo Sapiens
KDITAQYSA

SEQ ID NO: 342208 - protein, 9 aa, Homo Sapiens
FSRFFYYFR

SEQ ID NO: 342209 - protein, 9 aa, Homo Sapiens
SFMFVHPEW

SEQ ID NO: 342210 - protein, 9 aa, Homo Sapiens
EKEARRSSF

SEQ ID NO: 342211 - protein, 9 aa, Homo Sapiens
LQGLADFIA

SEQ ID NO: 342212 - protein, 9 aa, Homo Sapiens
NQGNVFPIT

SEQ ID NO: 342213 - protein, 9 aa, Homo Sapiens
LHHQNCYGS

SEQ ID NO: 342214 - protein, 9 aa, Homo Sapiens
FKTMEFAHY

SEQ ID NO: 342215 - protein, 9 aa, Homo Sapiens
QLCGFRQEE

SEQ ID NO: 342216 - protein, 9 aa, Homo Sapiens
SFGGGDNDK

SEQ ID NO: 342217 - protein, 9 aa, Homo Sapiens
HHILRCMGN

SEQ ID NO: 342218 - protein, 9 aa, Homo Sapiens
ASVYPRHFG

SEQ ID NO: 342219 - protein, 9 aa, Homo Sapiens
DANEAPQFS

SEQ ID NO: 342220 - protein, 9 aa, Homo Sapiens
LPTLARKMA

SEQ ID NO: 342221 - protein, 9 aa, Homo Sapiens
TSRPKPERN

SEQ ID NO: 342222 - protein, 9 aa, Homo Sapiens
LYFLVMSVI

SEQ ID NO: 342223 - protein, 9 aa, Homo Sapiens
CPMVEIPPT

SEQ ID NO: 342224 - protein, 9 aa, Homo Sapiens
CKNLWKFCV

SEQ ID NO: 342225 - protein, 9 aa, Homo Sapiens
IDERTISKK

SEQ ID NO: 342226 - protein, 9 aa, Homo Sapiens
PMDEADAKS

SEQ ID NO: 342227 - protein, 9 aa, Homo Sapiens
RDVGKVVNS

SEQ ID NO: 342228 - protein, 9 aa, Homo Sapiens
NSSARTKLE

SEQ ID NO: 342229 - protein, 9 aa, Homo Sapiens
QINASRDQV

SEQ ID NO: 342230 - protein, 9 aa, Homo Sapiens
ATEDVSTGE

SEQ ID NO: 342231 - protein, 9 aa, Homo Sapiens
NSATPKMLV

SEQ ID NO: 342232 - protein, 9 aa, Homo Sapiens
DSLSKNITQ

SEQ ID NO: 342233 - protein, 9 aa, Homo Sapiens
TEKFIYDHL

SEQ ID NO: 342234 - protein, 9 aa, Homo Sapiens
HMLFDHIRL

SEQ ID NO: 342235 - protein, 9 aa, Homo Sapiens
RTKEHTYVL

SEQ ID NO: 342236 - protein, 9 aa, Homo Sapiens
AYQAFHGLA

SEQ ID NO: 342237 - protein, 9 aa, Homo Sapiens
YDAVTNKHF

SEQ ID NO: 342238 - protein, 9 aa, Homo Sapiens
QKRDDGALQ

SEQ ID NO: 342239 - protein, 9 aa, Homo Sapiens
PRFQMSDDI

SEQ ID NO: 342240 - protein, 9 aa, Homo Sapiens
FIDQARALI

SEQ ID NO: 342241 - protein, 9 aa, Homo Sapiens
ERYDTPKRA

SEQ ID NO: 342242 - protein, 9 aa, Homo Sapiens
LSGKIKLIT

SEQ ID NO: 342243 - protein, 9 aa, Homo Sapiens
FSFLRGYLL

SEQ ID NO: 342244 - protein, 9 aa, Homo Sapiens
QIRSVTCAK

SEQ ID NO: 342245 - protein, 9 aa, Homo Sapiens
IMLQNPRSQ

SEQ ID NO: 342246 - protein, 9 aa, Homo Sapiens
EAETIIQKT

SEQ ID NO: 342247 - protein, 9 aa, Homo Sapiens
WTPATSTDI

SEQ ID NO: 342248 - protein, 9 aa, Homo Sapiens
QSVREASFV

SEQ ID NO: 342249 - protein, 9 aa, Homo Sapiens
CGAACGVTC

SEQ ID NO: 342250 - protein, 9 aa, Homo Sapiens
CFGVDQFCL

SEQ ID NO: 342251 - protein, 9 aa, Homo Sapiens
TLSQIQNSI

SEQ ID NO: 342252 - protein, 9 aa, Homo Sapiens
LVNTERSEE

SEQ ID NO: 342253 - protein, 9 aa, Homo Sapiens
THEKISVQT

SEQ ID NO: 342254 - protein, 9 aa, Homo Sapiens
AEILSPLGQ

SEQ ID NO: 342255 - protein, 9 aa, Homo Sapiens
IQILETKEL

SEQ ID NO: 342256 - protein, 9 aa, Homo Sapiens
FIIEVASGK

SEQ ID NO: 342257 - protein, 9 aa, Homo Sapiens
HNLPSSLEY

SEQ ID NO: 342258 - protein, 9 aa, Homo Sapiens
CVLLPEGAG

SEQ ID NO: 342259 - protein, 9 aa, Homo Sapiens
ESETAFSAF

SEQ ID NO: 342260 - protein, 9 aa, Homo Sapiens
PELYLNPFC

SEQ ID NO: 342261 - protein, 9 aa, Homo Sapiens
SSLSLCDSN

SEQ ID NO: 342262 - protein, 9 aa, Homo Sapiens
DWFAKWFEE

SEQ ID NO: 342263 - protein, 9 aa, Homo Sapiens
ELPFKEGKI

SEQ ID NO: 342264 - protein, 9 aa, Homo Sapiens
PQETLKECV

SEQ ID NO: 342265 - protein, 9 aa, Homo Sapiens
QFYFPLSSE

SEQ ID NO: 342266 - protein, 9 aa, Homo Sapiens
QILEALHYC

SEQ ID NO: 342267 - protein, 9 aa, Homo Sapiens
VDVLSRKLS

SEQ ID NO: 342268 - protein, 9 aa, Homo Sapiens
QRGLRHVLA

SEQ ID NO: 342269 - protein, 9 aa, Homo Sapiens
TGDKPYQCK

SEQ ID NO: 342270 - protein, 9 aa, Homo Sapiens
AGKRAEPME

SEQ ID NO: 342271 - protein, 9 aa, Homo Sapiens
LMVHQITHT

SEQ ID NO: 342272 - protein, 9 aa, Homo Sapiens
NSGIGFKTA

SEQ ID NO: 342273 - protein, 9 aa, Homo Sapiens
NIFCDNIKG

SEQ ID NO: 342274 - protein, 9 aa, Homo Sapiens
GDKRRIVVP

SEQ ID NO: 342275 - protein, 9 aa, Homo Sapiens
QRMQHNRHS

SEQ ID NO: 342276 - protein, 9 aa, Homo Sapiens
WVGYEFFAD

SEQ ID NO: 342277 - protein, 9 aa, Homo Sapiens
IDFLMLYFL

SEQ ID NO: 342278 - protein, 9 aa, Homo Sapiens
RKEEELSRD

SEQ ID NO: 342279 - protein, 9 aa, Homo Sapiens
ESYIHHSGR

SEQ ID NO: 342280 - protein, 9 aa, Homo Sapiens
RFFIKGKDN

SEQ ID NO: 342281 - protein, 9 aa, Homo Sapiens
TMQEKSRWT

SEQ ID NO: 342282 - protein, 9 aa, Homo Sapiens
YSLVETQKS

SEQ ID NO: 342283 - protein, 9 aa, Homo Sapiens
GVLAIALPV

SEQ ID NO: 342284 - protein, 9 aa, Homo Sapiens
AKDLGFKML

SEQ ID NO: 342285 - protein, 9 aa, Homo Sapiens
AHMFFEGLR

SEQ ID NO: 342286 - protein, 9 aa, Homo Sapiens
IYSFLTLSS

SEQ ID NO: 342287 - protein, 9 aa, Homo Sapiens
SKEIHNTPL

SEQ ID NO: 342288 - protein, 9 aa, Homo Sapiens
TTHKILHTK

SEQ ID NO: 342289 - protein, 9 aa, Homo Sapiens
CLARPAKLS

SEQ ID NO: 342290 - protein, 9 aa, Homo Sapiens
LRDIEQVPR

SEQ ID NO: 342291 - protein, 9 aa, Homo Sapiens
GPGLLCQSQ

SEQ ID NO: 342292 - protein, 9 aa, Homo Sapiens
RYNDMFEML

SEQ ID NO: 342293 - protein, 9 aa, Homo Sapiens
QLFQTFWCL

SEQ ID NO: 342294 - protein, 9 aa, Homo Sapiens
IKRADHPHM

SEQ ID NO: 342295 - protein, 9 aa, Homo Sapiens
NQLQGKKSC

SEQ ID NO: 342296 - protein, 9 aa, Homo Sapiens
CFWDIRSES

SEQ ID NO: 342297 - protein, 9 aa, Homo Sapiens
NRYRSDPNL

SEQ ID NO: 342298 - protein, 9 aa, Homo Sapiens
LDDSITIYI

SEQ ID NO: 342299 - protein, 9 aa, Homo Sapiens
EKNLSEIET

SEQ ID NO: 342300 - protein, 9 aa, Homo Sapiens
VAEQFLRVM

SEQ ID NO: 342301 - protein, 9 aa, Homo Sapiens
VIQTLCLGG

SEQ ID NO: 342302 - protein, 9 aa, Homo Sapiens
EEGIPKEAD

SEQ ID NO: 342303 - protein, 9 aa, Homo Sapiens
TYYFQTYGS

SEQ ID NO: 342304 - protein, 9 aa, Homo Sapiens
KRQILISGS

SEQ ID NO: 342305 - protein, 9 aa, Homo Sapiens
SLRQKTSKP

SEQ ID NO: 342306 - protein, 9 aa, Homo Sapiens
SMNNNIINT

SEQ ID NO: 342307 - protein, 9 aa, Homo Sapiens
EKVTQKIVT

SEQ ID NO: 342308 - protein, 9 aa, Homo Sapiens
AELNLMPDF

SEQ ID NO: 342309 - protein, 9 aa, Homo Sapiens
EDCFQERNN

SEQ ID NO: 342310 - protein, 9 aa, Homo Sapiens
NHPPGNWKK

SEQ ID NO: 342311 - protein, 9 aa, Homo Sapiens
KSYYKVNNL

SEQ ID NO: 342312 - protein, 9 aa, Homo Sapiens
DRQAFKGLV

SEQ ID NO: 342313 - protein, 9 aa, Homo Sapiens
LLARNQYYQ

SEQ ID NO: 342314 - protein, 9 aa, Homo Sapiens
HHKINKDLF

SEQ ID NO: 342315 - protein, 9 aa, Homo Sapiens
HAAIDIYTD

SEQ ID NO: 342316 - protein, 9 aa, Homo Sapiens
DIQTCKILN

SEQ ID NO: 342317 - protein, 9 aa, Homo Sapiens
ELSAQLHLW

SEQ ID NO: 342318 - protein, 9 aa, Homo Sapiens
NITEIPLIN

SEQ ID NO: 342319 - protein, 9 aa, Homo Sapiens
GLDVRRQIP

SEQ ID NO: 342320 - protein, 9 aa, Homo Sapiens
GSPVIKSIR

SEQ ID NO: 342321 - protein, 9 aa, Homo Sapiens
LLAICRMHS

SEQ ID NO: 342322 - protein, 9 aa, Homo Sapiens
FDTAFDWIC

SEQ ID NO: 342323 - protein, 9 aa, Homo Sapiens
VTGPQIHDG

SEQ ID NO: 342324 - protein, 9 aa, Homo Sapiens
KELHAKLQA

SEQ ID NO: 342325 - protein, 9 aa, Homo Sapiens
PSLSGKLHN

SEQ ID NO: 342326 - protein, 9 aa, Homo Sapiens
AGVLAIALP

SEQ ID NO: 342327 - protein, 9 aa, Homo Sapiens
VLAVVTCNL

SEQ ID NO: 342328 - protein, 9 aa, Homo Sapiens
SSATGCWRA

SEQ ID NO: 342329 - protein, 9 aa, Homo Sapiens
LLLATLFST

SEQ ID NO: 342330 - protein, 9 aa, Homo Sapiens
AESGGLRPN

SEQ ID NO: 342331 - protein, 9 aa, Homo Sapiens
ILHQWRQRR

SEQ ID NO: 342332 - protein, 9 aa, Homo Sapiens
EQHSKIYMV

SEQ ID NO: 342333 - protein, 9 aa, Homo Sapiens
KSEKDKKEN

SEQ ID NO: 342334 - protein, 9 aa, Homo Sapiens
VSCHPFSDR

SEQ ID NO: 342335 - protein, 9 aa, Homo Sapiens
IIAILQSYR

SEQ ID NO: 342336 - protein, 9 aa, Homo Sapiens
VGVYLSAHW

SEQ ID NO: 342337 - protein, 9 aa, Homo Sapiens
MHFSSKEVF

SEQ ID NO: 342338 - protein, 9 aa, Homo Sapiens
KRDDGALQP

SEQ ID NO: 342339 - protein, 9 aa, Homo Sapiens
ILVEKLPFV

SEQ ID NO: 342340 - protein, 9 aa, Homo Sapiens
GLPWAIIYI

SEQ ID NO: 342341 - protein, 9 aa, Homo Sapiens
QVKKIMQSI

SEQ ID NO: 342342 - protein, 9 aa, Homo Sapiens
GVHGIQIEF

SEQ ID NO: 342343 - protein, 9 aa, Homo Sapiens
YPMAFPSTQ

SEQ ID NO: 342344 - protein, 9 aa, Homo Sapiens
SLDSDEDLG

SEQ ID NO: 342345 - protein, 9 aa, Homo Sapiens
HKRARKITS

SEQ ID NO: 342346 - protein, 9 aa, Homo Sapiens
ADLIIHIGA

SEQ ID NO: 342347 - protein, 9 aa, Homo Sapiens
KKIIAYIPG

SEQ ID NO: 342348 - protein, 9 aa, Homo Sapiens
LEPHNGKFR

SEQ ID NO: 342349 - protein, 9 aa, Homo Sapiens
LELQISANS

SEQ ID NO: 342350 - protein, 9 aa, Homo Sapiens
QHRLSEALK

SEQ ID NO: 342351 - protein, 9 aa, Homo Sapiens
ANLSDLKAS

SEQ ID NO: 342352 - protein, 9 aa, Homo Sapiens
SFSRYPKGY

SEQ ID NO: 342353 - protein, 9 aa, Homo Sapiens
YFQVHEKIH

SEQ ID NO: 342354 - protein, 9 aa, Homo Sapiens
KVGCSNWKR

SEQ ID NO: 342355 - protein, 9 aa, Homo Sapiens
QILAIKSTT

SEQ ID NO: 342356 - protein, 9 aa, Homo Sapiens
NKVDTIVNF

SEQ ID NO: 342357 - protein, 9 aa, Homo Sapiens
QCFGDIVPL

SEQ ID NO: 342358 - protein, 9 aa, Homo Sapiens
WASTFPPHQ

SEQ ID NO: 342359 - protein, 9 aa, Homo Sapiens
KGLALGLLQ

SEQ ID NO: 342360 - protein, 9 aa, Homo Sapiens
EPTVIDEIQ

SEQ ID NO: 342361 - protein, 9 aa, Homo Sapiens
ILSNTTVVT

SEQ ID NO: 342362 - protein, 9 aa, Homo Sapiens
LSVSDDSSL

SEQ ID NO: 342363 - protein, 9 aa, Homo Sapiens
KIAAIADKL

SEQ ID NO: 342364 - protein, 9 aa, Homo Sapiens
QLNYLSGDI

SEQ ID NO: 342365 - protein, 9 aa, Homo Sapiens
TRVSQIICS

SEQ ID NO: 342366 - protein, 9 aa, Homo Sapiens
RMKDVKCHI

SEQ ID NO: 342367 - protein, 9 aa, Homo Sapiens
LDGTQHRVL

SEQ ID NO: 342368 - protein, 9 aa, Homo Sapiens
HSRETLLQC

SEQ ID NO: 342369 - protein, 9 aa, Homo Sapiens
ELNQILFSA

SEQ ID NO: 342370 - protein, 9 aa, Homo Sapiens
SMTKCSCML

SEQ ID NO: 342371 - protein, 9 aa, Homo Sapiens
ILLACQIRY

SEQ ID NO: 342372 - protein, 9 aa, Homo Sapiens
VSLECQNLQ

SEQ ID NO: 342373 - protein, 9 aa, Homo Sapiens
DAYKCPVIH

SEQ ID NO: 342374 - protein, 9 aa, Homo Sapiens
TGVLTIVTL

SEQ ID NO: 342375 - protein, 9 aa, Homo Sapiens
HDIVQFLVQ

SEQ ID NO: 342376 - protein, 9 aa, Homo Sapiens
PIQDVQRES

SEQ ID NO: 342377 - protein, 9 aa, Homo Sapiens
ASTDSSKTD

SEQ ID NO: 342378 - protein, 9 aa, Homo Sapiens
ECGTSFYQC

SEQ ID NO: 342379 - protein, 9 aa, Homo Sapiens
PGTCLKSLG

SEQ ID NO: 342380 - protein, 9 aa, Homo Sapiens
AAFEMVPQT

SEQ ID NO: 342381 - protein, 9 aa, Homo Sapiens
NSNMFDLID

SEQ ID NO: 342382 - protein, 9 aa, Homo Sapiens
FCIQRFTKN

SEQ ID NO: 342383 - protein, 9 aa, Homo Sapiens
KPWVTKTEK

SEQ ID NO: 342384 - protein, 9 aa, Homo Sapiens
LIQNMVAWF

SEQ ID NO: 342385 - protein, 9 aa, Homo Sapiens
EMKNKVDTI

SEQ ID NO: 342386 - protein, 9 aa, Homo Sapiens
DDPKFMQDV

SEQ ID NO: 342387 - protein, 9 aa, Homo Sapiens
GQLHKVREM

SEQ ID NO: 342388 - protein, 9 aa, Homo Sapiens
PNENIIIVI

SEQ ID NO: 342389 - protein, 9 aa, Homo Sapiens
ERDEQELQK

SEQ ID NO: 342390 - protein, 9 aa, Homo Sapiens
VDFKMPPPS

SEQ ID NO: 342391 - protein, 9 aa, Homo Sapiens
LAKCLDEQQ

SEQ ID NO: 342392 - protein, 9 aa, Homo Sapiens
GSRNNTDKN

SEQ ID NO: 342393 - protein, 9 aa, Homo Sapiens
LRDKIARNG

SEQ ID NO: 342394 - protein, 9 aa, Homo Sapiens
ELFQRGLRH

SEQ ID NO: 342395 - protein, 9 aa, Homo Sapiens
NGYQKTGDA

SEQ ID NO: 342396 - protein, 9 aa, Homo Sapiens
KNVGKLSFV

SEQ ID NO: 342397 - protein, 9 aa, Homo Sapiens
GGVQIRSVT

SEQ ID NO: 342398 - protein, 9 aa, Homo Sapiens
IQGYKIIYR

SEQ ID NO: 342399 - protein, 9 aa, Homo Sapiens
LFTSDNLKL

SEQ ID NO: 342400 - protein, 9 aa, Homo Sapiens
IEEGDADKW

SEQ ID NO: 342401 - protein, 9 aa, Homo Sapiens
GLWDIENNP

SEQ ID NO: 342402 - protein, 9 aa, Homo Sapiens
SRPPEYELF

SEQ ID NO: 342403 - protein, 9 aa, Homo Sapiens
KQQGEMLHK

SEQ ID NO: 342404 - protein, 9 aa, Homo Sapiens
IQKLSWIAK

SEQ ID NO: 342405 - protein, 9 aa, Homo Sapiens
SSLGERLEP

SEQ ID NO: 342406 - protein, 9 aa, Homo Sapiens
QEKKRQKRN

SEQ ID NO: 342407 - protein, 9 aa, Homo Sapiens
EYHNIWVYD

SEQ ID NO: 342408 - protein, 9 aa, Homo Sapiens
LHLSMFLPT

SEQ ID NO: 342409 - protein, 9 aa, Homo Sapiens
KEINQRFKN

SEQ ID NO: 342410 - protein, 9 aa, Homo Sapiens
VTFEVKIFP

SEQ ID NO: 342411 - protein, 9 aa, Homo Sapiens
DLAWIKGVG

SEQ ID NO: 342412 - protein, 9 aa, Homo Sapiens
RGKSAFSGI

SEQ ID NO: 342413 - protein, 9 aa, Homo Sapiens
HPSSSIGVL

SEQ ID NO: 342414 - protein, 9 aa, Homo Sapiens
YKQWKEYMH

SEQ ID NO: 342415 - protein, 9 aa, Homo Sapiens
LQAEVYGVR

SEQ ID NO: 342416 - protein, 9 aa, Homo Sapiens
LQATHSGIA

SEQ ID NO: 342417 - protein, 9 aa, Homo Sapiens
LEADCHGKS

SEQ ID NO: 342418 - protein, 9 aa, Homo Sapiens
SGGKLSQTC

SEQ ID NO: 342419 - protein, 9 aa, Homo Sapiens
WVRNMNTLR

SEQ ID NO: 342420 - protein, 9 aa, Homo Sapiens
QRAHHKNVR

SEQ ID NO: 342421 - protein, 9 aa, Homo Sapiens
IAIPNEESV

SEQ ID NO: 342422 - protein, 9 aa, Homo Sapiens
PVTPSDKGM

SEQ ID NO: 342423 - protein, 9 aa, Homo Sapiens
TANKIALEA

SEQ ID NO: 342424 - protein, 9 aa, Homo Sapiens
EKQPRLLKA

SEQ ID NO: 342425 - protein, 9 aa, Homo Sapiens
MNKMKNFKC

SEQ ID NO: 342426 - protein, 9 aa, Homo Sapiens
TLELQSDMY

SEQ ID NO: 342427 - protein, 9 aa, Homo Sapiens
TERFLELAP

SEQ ID NO: 342428 - protein, 9 aa, Homo Sapiens
NDRSTGKKN

SEQ ID NO: 342429 - protein, 9 aa, Homo Sapiens
QLAHHLSEP

SEQ ID NO: 342430 - protein, 9 aa, Homo Sapiens
LQNVKGTKS

SEQ ID NO: 342431 - protein, 9 aa, Homo Sapiens
LDAFGTARR

SEQ ID NO: 342432 - protein, 9 aa, Homo Sapiens
DFMRPFEHI

SEQ ID NO: 342433 - protein, 9 aa, Homo Sapiens
PLSPVFSSW

SEQ ID NO: 342434 - protein, 9 aa, Homo Sapiens
KQLSTANDE

SEQ ID NO: 342435 - protein, 9 aa, Homo Sapiens
CDKCGKGYN

SEQ ID NO: 342436 - protein, 9 aa, Homo Sapiens
ANTELVGPA

SEQ ID NO: 342437 - protein, 9 aa, Homo Sapiens
RARRSPQKL

SEQ ID NO: 342438 - protein, 9 aa, Homo Sapiens
FLPASTQLN

SEQ ID NO: 342439 - protein, 9 aa, Homo Sapiens
RQRVDNIKV

SEQ ID NO: 342440 - protein, 9 aa, Homo Sapiens
EKNENLETE

SEQ ID NO: 342441 - protein, 9 aa, Homo Sapiens
AYECSRCGK

SEQ ID NO: 342442 - protein, 9 aa, Homo Sapiens
KSNGFVCPI

SEQ ID NO: 342443 - protein, 9 aa, Homo Sapiens
PPPVASTLS

SEQ ID NO: 342444 - protein, 9 aa, Homo Sapiens
NYVLNQALI

SEQ ID NO: 342445 - protein, 9 aa, Homo Sapiens
VLAVSSIQW

SEQ ID NO: 342446 - protein, 9 aa, Homo Sapiens
TLKDTTLQE

SEQ ID NO: 342447 - protein, 9 aa, Homo Sapiens
EEIPIKSKE

SEQ ID NO: 342448 - protein, 9 aa, Homo Sapiens
MESPIDLAD

SEQ ID NO: 342449 - protein, 9 aa, Homo Sapiens
VHAINLDEG

SEQ ID NO: 342450 - protein, 9 aa, Homo Sapiens
LRDFTDNPC

SEQ ID NO: 342451 - protein, 9 aa, Homo Sapiens
MLKNICEVL

SEQ ID NO: 342452 - protein, 9 aa, Homo Sapiens
GIFETLIKY

SEQ ID NO: 342453 - protein, 9 aa, Homo Sapiens
CSGCGKLFR

SEQ ID NO: 342454 - protein, 9 aa, Homo Sapiens
EEEDKEEVE

SEQ ID NO: 342455 - protein, 9 aa, Homo Sapiens
TLFWTVIFT

SEQ ID NO: 342456 - protein, 9 aa, Homo Sapiens
VIDKAQNFR

SEQ ID NO: 342457 - protein, 9 aa, Homo Sapiens
VFRSNNFLP

SEQ ID NO: 342458 - protein, 9 aa, Homo Sapiens
WYKHNFAIT

SEQ ID NO: 342459 - protein, 9 aa, Homo Sapiens
KLHLSNGVA

SEQ ID NO: 342460 - protein, 9 aa, Homo Sapiens
LRLRWSRFT

SEQ ID NO: 342461 - protein, 9 aa, Homo Sapiens
MAHLPFLTM

SEQ ID NO: 342462 - protein, 9 aa, Homo Sapiens
PESLPPSCR

SEQ ID NO: 342463 - protein, 9 aa, Homo Sapiens
FSKAEAPEL

SEQ ID NO: 342464 - protein, 9 aa, Homo Sapiens
SWYHNYGHL

SEQ ID NO: 342465 - protein, 9 aa, Homo Sapiens
TTDAIEAKE

SEQ ID NO: 342466 - protein, 9 aa, Homo Sapiens
MYFVSSGLL

SEQ ID NO: 342467 - protein, 9 aa, Homo Sapiens
APMDEADAK

SEQ ID NO: 342468 - protein, 9 aa, Homo Sapiens
RCMTISICI

SEQ ID NO: 342469 - protein, 9 aa, Homo Sapiens
AHLARHRNI

SEQ ID NO: 342470 - protein, 9 aa, Homo Sapiens
LLPSKWSKD

SEQ ID NO: 342471 - protein, 9 aa, Homo Sapiens
GVVTVAGNL

SEQ ID NO: 342472 - protein, 9 aa, Homo Sapiens
SSAAWNETL

SEQ ID NO: 342473 - protein, 9 aa, Homo Sapiens
LNREMYSLG

SEQ ID NO: 342474 - protein, 9 aa, Homo Sapiens
FSYLYYLMS

SEQ ID NO: 342475 - protein, 9 aa, Homo Sapiens
TAWGGEGSL

SEQ ID NO: 342476 - protein, 9 aa, Homo Sapiens
QENKVDFIL

SEQ ID NO: 342477 - protein, 9 aa, Homo Sapiens
MIIAKEEIF

SEQ ID NO: 342478 - protein, 9 aa, Homo Sapiens
HVYCLHVIH

SEQ ID NO: 342479 - protein, 9 aa, Homo Sapiens
VNRPFPVLE

SEQ ID NO: 342480 - protein, 9 aa, Homo Sapiens
SSTGSYEDR

SEQ ID NO: 342481 - protein, 9 aa, Homo Sapiens
TVQLVGLIQ

SEQ ID NO: 342482 - protein, 9 aa, Homo Sapiens
DTKNVNLNT

SEQ ID NO: 342483 - protein, 9 aa, Homo Sapiens
LLTAMGYDH

SEQ ID NO: 342484 - protein, 9 aa, Homo Sapiens
TVSGYLSAR

SEQ ID NO: 342485 - protein, 9 aa, Homo Sapiens
GEQGDNGDP

SEQ ID NO: 342486 - protein, 9 aa, Homo Sapiens
TYFKISHKM

SEQ ID NO: 342487 - protein, 9 aa, Homo Sapiens
KQKTHEKGT

SEQ ID NO: 342488 - protein, 9 aa, Homo Sapiens
IANNSYNDA

SEQ ID NO: 342489 - protein, 9 aa, Homo Sapiens
PTFFQTHPS

SEQ ID NO: 342490 - protein, 9 aa, Homo Sapiens
ALRRNKEYC

SEQ ID NO: 342491 - protein, 9 aa, Homo Sapiens
IDKAWQNYN

SEQ ID NO: 342492 - protein, 9 aa, Homo Sapiens
GKKSAVVMG

SEQ ID NO: 342493 - protein, 9 aa, Homo Sapiens
AVKGQGVSV

SEQ ID NO: 342494 - protein, 9 aa, Homo Sapiens
FFLLHIWCS

SEQ ID NO: 342495 - protein, 9 aa, Homo Sapiens
VKEEEEEEN

SEQ ID NO: 342496 - protein, 9 aa, Homo Sapiens
QELNQILFS

SEQ ID NO: 342497 - protein, 9 aa, Homo Sapiens
CGRCCAKFF

SEQ ID NO: 342498 - protein, 9 aa, Homo Sapiens
ENKSFKCKK

SEQ ID NO: 342499 - protein, 9 aa, Homo Sapiens
ITALDLYIA

SEQ ID NO: 342500 - protein, 9 aa, Homo Sapiens
FINISIIDG

SEQ ID NO: 342501 - protein, 9 aa, Homo Sapiens
EASTDSSKT

SEQ ID NO: 342502 - protein, 9 aa, Homo Sapiens
MINLMRSGV

SEQ ID NO: 342503 - protein, 9 aa, Homo Sapiens
GIQSQSKPY

SEQ ID NO: 342504 - protein, 9 aa, Homo Sapiens
GSPSCLSVG

SEQ ID NO: 342505 - protein, 9 aa, Homo Sapiens
NSVGDILSK

SEQ ID NO: 342506 - protein, 9 aa, Homo Sapiens
EKSVVIQHQ

SEQ ID NO: 342507 - protein, 9 aa, Homo Sapiens
EADGTQGKK

SEQ ID NO: 342508 - protein, 9 aa, Homo Sapiens
LDVLEGQTH

SEQ ID NO: 342509 - protein, 9 aa, Homo Sapiens
GPKGCNLFI

SEQ ID NO: 342510 - protein, 9 aa, Homo Sapiens
AILLQCNTE

SEQ ID NO: 342511 - protein, 9 aa, Homo Sapiens
EQHKTVVLL

SEQ ID NO: 342512 - protein, 9 aa, Homo Sapiens
IADTHEKIS

SEQ ID NO: 342513 - protein, 9 aa, Homo Sapiens
PGEVKGKDI

SEQ ID NO: 342514 - protein, 9 aa, Homo Sapiens
GKARKESEP

SEQ ID NO: 342515 - protein, 9 aa, Homo Sapiens
ATECLRHPW

SEQ ID NO: 342516 - protein, 9 aa, Homo Sapiens
VFSNKLLDK

SEQ ID NO: 342517 - protein, 9 aa, Homo Sapiens
PEINNWLNA

SEQ ID NO: 342518 - protein, 9 aa, Homo Sapiens
RQINASRDQ

SEQ ID NO: 342519 - protein, 9 aa, Homo Sapiens
MRTKLSFNI

SEQ ID NO: 342520 - protein, 9 aa, Homo Sapiens
DCNHKRKGS

SEQ ID NO: 342521 - protein, 9 aa, Homo Sapiens
FYSDSSEMF

SEQ ID NO: 342522 - protein, 9 aa, Homo Sapiens
TITLGTKTE

SEQ ID NO: 342523 - protein, 9 aa, Homo Sapiens
WKRSQHESG

SEQ ID NO: 342524 - protein, 9 aa, Homo Sapiens
QAEKDRWLK

SEQ ID NO: 342525 - protein, 9 aa, Homo Sapiens
FGFSEGNTE

SEQ ID NO: 342526 - protein, 9 aa, Homo Sapiens
RVLQLFLSQ

SEQ ID NO: 342527 - protein, 9 aa, Homo Sapiens
RAGFLNRES

SEQ ID NO: 342528 - protein, 9 aa, Homo Sapiens
NSGFMEQLC

SEQ ID NO: 342529 - protein, 9 aa, Homo Sapiens
VNVAPSVIH

SEQ ID NO: 342530 - protein, 9 aa, Homo Sapiens
SNYSELQGQ

SEQ ID NO: 342531 - protein, 9 aa, Homo Sapiens
IDGICGQAY

SEQ ID NO: 342532 - protein, 9 aa, Homo Sapiens
VQCFGDIVP

SEQ ID NO: 342533 - protein, 9 aa, Homo Sapiens
QANLSDLKA

SEQ ID NO: 342534 - protein, 9 aa, Homo Sapiens
CSSNTLKGQ

SEQ ID NO: 342535 - protein, 9 aa, Homo Sapiens
FNTELQPVK

SEQ ID NO: 342536 - protein, 9 aa, Homo Sapiens
AFEMVPQTA

SEQ ID NO: 342537 - protein, 9 aa, Homo Sapiens
VEVFESLLS

SEQ ID NO: 342538 - protein, 9 aa, Homo Sapiens
TRVLLTRSC

SEQ ID NO: 342539 - protein, 9 aa, Homo Sapiens
ATSCSDKNI

SEQ ID NO: 342540 - protein, 9 aa, Homo Sapiens
VSSYLILRN

SEQ ID NO: 342541 - protein, 9 aa, Homo Sapiens
QLLCQQAIT

SEQ ID NO: 342542 - protein, 9 aa, Homo Sapiens
HKSSFSLSG

SEQ ID NO: 342543 - protein, 9 aa, Homo Sapiens
REEMQKERR

SEQ ID NO: 342544 - protein, 9 aa, Homo Sapiens
RDEITHNDI

SEQ ID NO: 342545 - protein, 9 aa, Homo Sapiens
PTSNQVRFM

SEQ ID NO: 342546 - protein, 9 aa, Homo Sapiens
LQAITVTAL

SEQ ID NO: 342547 - protein, 9 aa, Homo Sapiens
GQTELILIL

SEQ ID NO: 342548 - protein, 9 aa, Homo Sapiens
AIKEYQSGW

SEQ ID NO: 342549 - protein, 9 aa, Homo Sapiens
HPQLCVCRS

SEQ ID NO: 342550 - protein, 9 aa, Homo Sapiens
KVQYMLVVH

SEQ ID NO: 342551 - protein, 9 aa, Homo Sapiens
CLHVIHHIL

SEQ ID NO: 342552 - protein, 9 aa, Homo Sapiens
YPTSKLVSR

SEQ ID NO: 342553 - protein, 9 aa, Homo Sapiens
TANGKGEKR

SEQ ID NO: 342554 - protein, 9 aa, Homo Sapiens
QGNIFKQYS

SEQ ID NO: 342555 - protein, 9 aa, Homo Sapiens
NTAYQEVFK

SEQ ID NO: 342556 - protein, 9 aa, Homo Sapiens
ASKGLSNLE

SEQ ID NO: 342557 - protein, 9 aa, Homo Sapiens
FYENWSFVM

SEQ ID NO: 342558 - protein, 9 aa, Homo Sapiens
PDLKTLQED

SEQ ID NO: 342559 - protein, 9 aa, Homo Sapiens
WTRGVEDIP

SEQ ID NO: 342560 - protein, 9 aa, Homo Sapiens
KQGKYQNKA

SEQ ID NO: 342561 - protein, 9 aa, Homo Sapiens
VPIEIQNCQ

SEQ ID NO: 342562 - protein, 9 aa, Homo Sapiens
TPHDFDECQ

SEQ ID NO: 342563 - protein, 9 aa, Homo Sapiens
SQHLRQKLI

SEQ ID NO: 342564 - protein, 9 aa, Homo Sapiens
YDCQSPDES

SEQ ID NO: 342565 - protein, 9 aa, Homo Sapiens
PKCQQLANN

SEQ ID NO: 342566 - protein, 9 aa, Homo Sapiens
DMQFAFSYL

SEQ ID NO: 342567 - protein, 9 aa, Homo Sapiens
IPLGSYYSG

SEQ ID NO: 342568 - protein, 9 aa, Homo Sapiens
LASEGAQVM

SEQ ID NO: 342569 - protein, 9 aa, Homo Sapiens
HQIIHKGGK

SEQ ID NO: 342570 - protein, 9 aa, Homo Sapiens
AWIPELNLV

SEQ ID NO: 342571 - protein, 9 aa, Homo Sapiens
SEAGVYVLH

SEQ ID NO: 342572 - protein, 9 aa, Homo Sapiens
TWDCFQMRI

SEQ ID NO: 342573 - protein, 9 aa, Homo Sapiens
QCLACLKEE

SEQ ID NO: 342574 - protein, 9 aa, Homo Sapiens
SFFKGYGRI

SEQ ID NO: 342575 - protein, 9 aa, Homo Sapiens
GECQSTVSI

SEQ ID NO: 342576 - protein, 9 aa, Homo Sapiens
TVITGVDSA

SEQ ID NO: 342577 - protein, 9 aa, Homo Sapiens
TDDLKWSCL

SEQ ID NO: 342578 - protein, 9 aa, Homo Sapiens
NLTETPEAG

SEQ ID NO: 342579 - protein, 9 aa, Homo Sapiens
LCQSQLTSN

SEQ ID NO: 342580 - protein, 9 aa, Homo Sapiens
EEHSHRDKH

SEQ ID NO: 342581 - protein, 9 aa, Homo Sapiens
GLPQSINTD

SEQ ID NO: 342582 - protein, 9 aa, Homo Sapiens
KKLHQEKMI

SEQ ID NO: 342583 - protein, 9 aa, Homo Sapiens
GSIKRSRYF

SEQ ID NO: 342584 - protein, 9 aa, Homo Sapiens
IPDPEKPVR

SEQ ID NO: 342585 - protein, 9 aa, Homo Sapiens
VESFFKGYG

SEQ ID NO: 342586 - protein, 9 aa, Homo Sapiens
AKKEEDGTL

SEQ ID NO: 342587 - protein, 9 aa, Homo Sapiens
LDFLMFNCS

SEQ ID NO: 342588 - protein, 9 aa, Homo Sapiens
LHIALAISA

SEQ ID NO: 342589 - protein, 9 aa, Homo Sapiens
GGKRAESQI

SEQ ID NO: 342590 - protein, 9 aa, Homo Sapiens
KVHGFYPPE

SEQ ID NO: 342591 - protein, 9 aa, Homo Sapiens
NVTVTMTKC

SEQ ID NO: 342592 - protein, 9 aa, Homo Sapiens
DECNNSPLK

SEQ ID NO: 342593 - protein, 9 aa, Homo Sapiens
SKGLSNLEI

SEQ ID NO: 342594 - protein, 9 aa, Homo Sapiens
IANHKGPPV

SEQ ID NO: 342595 - protein, 9 aa, Homo Sapiens
ASEGIKCYL

SEQ ID NO: 342596 - protein, 9 aa, Homo Sapiens
IWMSKRYKE

SEQ ID NO: 342597 - protein, 9 aa, Homo Sapiens
APYPQTRWY

SEQ ID NO: 342598 - protein, 9 aa, Homo Sapiens
DNGPSGVHS

SEQ ID NO: 342599 - protein, 9 aa, Homo Sapiens
ETLIKYTID

SEQ ID NO: 342600 - protein, 9 aa, Homo Sapiens
QVTNMRTKL

SEQ ID NO: 342601 - protein, 9 aa, Homo Sapiens
FGDILKSNK

SEQ ID NO: 342602 - protein, 9 aa, Homo Sapiens
DHDVPKHKK

SEQ ID NO: 342603 - protein, 9 aa, Homo Sapiens
GFKIFEYNS

SEQ ID NO: 342604 - protein, 9 aa, Homo Sapiens
SSSLMVHQI

SEQ ID NO: 342605 - protein, 9 aa, Homo Sapiens
GIPHLSSSK

SEQ ID NO: 342606 - protein, 9 aa, Homo Sapiens
MHWASYTGQ

SEQ ID NO: 342607 - protein, 9 aa, Homo Sapiens
AVESRAQLL

SEQ ID NO: 342608 - protein, 9 aa, Homo Sapiens
LFGGKCLVN

SEQ ID NO: 342609 - protein, 9 aa, Homo Sapiens
LRNLYTQNI

SEQ ID NO: 342610 - protein, 9 aa, Homo Sapiens
NRPFPVLEH

SEQ ID NO: 342611 - protein, 9 aa, Homo Sapiens
CQNLQLLPG

SEQ ID NO: 342612 - protein, 9 aa, Homo Sapiens
QIMKTPEVP

SEQ ID NO: 342613 - protein, 9 aa, Homo Sapiens
ASGECKCKD

SEQ ID NO: 342614 - protein, 9 aa, Homo Sapiens
SISQVTAST

SEQ ID NO: 342615 - protein, 9 aa, Homo Sapiens
QVFRPDNLI

SEQ ID NO: 342616 - protein, 9 aa, Homo Sapiens
GDSVKASNS

SEQ ID NO: 342617 - protein, 9 aa, Homo Sapiens
VALLSKCLC

SEQ ID NO: 342618 - protein, 9 aa, Homo Sapiens
LRVWHDKDN

SEQ ID NO: 342619 - protein, 9 aa, Homo Sapiens
LNKCAIFEK

SEQ ID NO: 342620 - protein, 9 aa, Homo Sapiens
GDLPLADKG

SEQ ID NO: 342621 - protein, 9 aa, Homo Sapiens
NIQNLEAPY

SEQ ID NO: 342622 - protein, 9 aa, Homo Sapiens
EHVLNFQNK

SEQ ID NO: 342623 - protein, 9 aa, Homo Sapiens
YCKVENGVG

SEQ ID NO: 342624 - protein, 9 aa, Homo Sapiens
EKQRMELEQ

SEQ ID NO: 342625 - protein, 9 aa, Homo Sapiens
TSLPVTAAS

SEQ ID NO: 342626 - protein, 9 aa, Homo Sapiens
PDRCVVCVS

SEQ ID NO: 342627 - protein, 9 aa, Homo Sapiens
ANTFLASHR

SEQ ID NO: 342628 - protein, 9 aa, Homo Sapiens
TIKCRITWD

SEQ ID NO: 342629 - protein, 9 aa, Homo Sapiens
RRFMYTTLF

SEQ ID NO: 342630 - protein, 9 aa, Homo Sapiens
FILAAIVGS

SEQ ID NO: 342631 - protein, 9 aa, Homo Sapiens
IELRIPKDN

SEQ ID NO: 342632 - protein, 9 aa, Homo Sapiens
KIVTERSVS

SEQ ID NO: 342633 - protein, 9 aa, Homo Sapiens
NNCAKFTLV

SEQ ID NO: 342634 - protein, 9 aa, Homo Sapiens
GAVIIGGVT

SEQ ID NO: 342635 - protein, 9 aa, Homo Sapiens
VSEKTKKDK

SEQ ID NO: 342636 - protein, 9 aa, Homo Sapiens
ENWKRSQHE

SEQ ID NO: 342637 - protein, 9 aa, Homo Sapiens
LQQSQAYFK

SEQ ID NO: 342638 - protein, 9 aa, Homo Sapiens
ELIGRSHHY

SEQ ID NO: 342639 - protein, 9 aa, Homo Sapiens
VYLKEEEEN

SEQ ID NO: 342640 - protein, 9 aa, Homo Sapiens
HLFGLQIRV

SEQ ID NO: 342641 - protein, 9 aa, Homo Sapiens
SVDFKMPPP

SEQ ID NO: 342642 - protein, 9 aa, Homo Sapiens
RCFKRTKEQ

SEQ ID NO: 342643 - protein, 9 aa, Homo Sapiens
KLNYSIQYV

SEQ ID NO: 342644 - protein, 9 aa, Homo Sapiens
TLIMWRRDH

SEQ ID NO: 342645 - protein, 9 aa, Homo Sapiens
MDRIKKDQE

SEQ ID NO: 342646 - protein, 9 aa, Homo Sapiens
QPDAGGVFL

SEQ ID NO: 342647 - protein, 9 aa, Homo Sapiens
KQGRILANT

SEQ ID NO: 342648 - protein, 9 aa, Homo Sapiens
CKALPTCGS

SEQ ID NO: 342649 - protein, 9 aa, Homo Sapiens
RTRAERTNN

SEQ ID NO: 342650 - protein, 9 aa, Homo Sapiens
PPISNLTTT

SEQ ID NO: 342651 - protein, 9 aa, Homo Sapiens
LYLSQTVGI

SEQ ID NO: 342652 - protein, 9 aa, Homo Sapiens
PKTLGIIFG

SEQ ID NO: 342653 - protein, 9 aa, Homo Sapiens
TFYRFKDTA

SEQ ID NO: 342654 - protein, 9 aa, Homo Sapiens
AGRAEILGR

SEQ ID NO: 342655 - protein, 9 aa, Homo Sapiens
RDKLNYSIQ

SEQ ID NO: 342656 - protein, 9 aa, Homo Sapiens
AEMKIFPIR

SEQ ID NO: 342657 - protein, 9 aa, Homo Sapiens
LRTQIAASK

SEQ ID NO: 342658 - protein, 9 aa, Homo Sapiens
MPQYLGNQP

SEQ ID NO: 342659 - protein, 9 aa, Homo Sapiens
FDSVVHLIN

SEQ ID NO: 342660 - protein, 9 aa, Homo Sapiens
REQKPFKVQ

SEQ ID NO: 342661 - protein, 9 aa, Homo Sapiens
WHPKLIKLL

SEQ ID NO: 342662 - protein, 9 aa, Homo Sapiens
VVKRKLKMW

SEQ ID NO: 342663 - protein, 9 aa, Homo Sapiens
ISEDQRLQR

SEQ ID NO: 342664 - protein, 9 aa, Homo Sapiens
GKHFFLYEE

SEQ ID NO: 342665 - protein, 9 aa, Homo Sapiens
FNTSWERVS

SEQ ID NO: 342666 - protein, 9 aa, Homo Sapiens
DGENVSMKA

SEQ ID NO: 342667 - protein, 9 aa, Homo Sapiens
DRYVVCYTS

SEQ ID NO: 342668 - protein, 9 aa, Homo Sapiens
EGGDKLQTD

SEQ ID NO: 342669 - protein, 9 aa, Homo Sapiens
FVLSQAKDK

SEQ ID NO: 342670 - protein, 9 aa, Homo Sapiens
SRFTRVLLT

SEQ ID NO: 342671 - protein, 9 aa, Homo Sapiens
KRRQCQPEI

SEQ ID NO: 342672 - protein, 9 aa, Homo Sapiens
TVTVLFLYT

SEQ ID NO: 342673 - protein, 9 aa, Homo Sapiens
DIGLTLASG

SEQ ID NO: 342674 - protein, 9 aa, Homo Sapiens
HQQIHTSES

SEQ ID NO: 342675 - protein, 9 aa, Homo Sapiens
EEAKQLFAR

SEQ ID NO: 342676 - protein, 9 aa, Homo Sapiens
HCVYYFKSS

SEQ ID NO: 342677 - protein, 9 aa, Homo Sapiens
GPLQAITVT

SEQ ID NO: 342678 - protein, 9 aa, Homo Sapiens
AAAGGKQRS

SEQ ID NO: 342679 - protein, 9 aa, Homo Sapiens
LSFGHSKCL

SEQ ID NO: 342680 - protein, 9 aa, Homo Sapiens
RKFTHSIPH

SEQ ID NO: 342681 - protein, 9 aa, Homo Sapiens
ALEPTQDAF

SEQ ID NO: 342682 - protein, 9 aa, Homo Sapiens
KKKPHINKP

SEQ ID NO: 342683 - protein, 9 aa, Homo Sapiens
VIEGLEDDI

SEQ ID NO: 342684 - protein, 9 aa, Homo Sapiens
EGIEVLKSE

SEQ ID NO: 342685 - protein, 9 aa, Homo Sapiens
QIVEEVTQN

SEQ ID NO: 342686 - protein, 9 aa, Homo Sapiens
IMLLCLARP

SEQ ID NO: 342687 - protein, 9 aa, Homo Sapiens
WVQSICQLC

SEQ ID NO: 342688 - protein, 9 aa, Homo Sapiens
IYMVHRNKS

SEQ ID NO: 342689 - protein, 9 aa, Homo Sapiens
YEIINRQLI

SEQ ID NO: 342690 - protein, 9 aa, Homo Sapiens
RTWDCVLVS

SEQ ID NO: 342691 - protein, 9 aa, Homo Sapiens
ITAKSHKLA

SEQ ID NO: 342692 - protein, 9 aa, Homo Sapiens
ETQEYNQIQ

SEQ ID NO: 342693 - protein, 9 aa, Homo Sapiens
ELLWTVPIA

SEQ ID NO: 342694 - protein, 9 aa, Homo Sapiens
FWQAHTLTV

SEQ ID NO: 342695 - protein, 9 aa, Homo Sapiens
PLDFDEMTF

SEQ ID NO: 342696 - protein, 9 aa, Homo Sapiens
IFKTLIKGL

SEQ ID NO: 342697 - protein, 9 aa, Homo Sapiens
KLVIDLGED

SEQ ID NO: 342698 - protein, 9 aa, Homo Sapiens
DGLLMLLYV

SEQ ID NO: 342699 - protein, 9 aa, Homo Sapiens
PFYTLQEVK

SEQ ID NO: 342700 - protein, 9 aa, Homo Sapiens
KAPPDLLDR

SEQ ID NO: 342701 - protein, 9 aa, Homo Sapiens
NYRTALCGA

SEQ ID NO: 342702 - protein, 9 aa, Homo Sapiens
ICINSRELL

SEQ ID NO: 342703 - protein, 9 aa, Homo Sapiens
SYTFILRVV

SEQ ID NO: 342704 - protein, 9 aa, Homo Sapiens
CVKCQTLSG

SEQ ID NO: 342705 - protein, 9 aa, Homo Sapiens
FKLTQGSVA

SEQ ID NO: 342706 - protein, 9 aa, Homo Sapiens
VSSSDRINS

SEQ ID NO: 342707 - protein, 9 aa, Homo Sapiens
GNSVTSRPK

SEQ ID NO: 342708 - protein, 9 aa, Homo Sapiens
CCGTVGSRM

SEQ ID NO: 342709 - protein, 9 aa, Homo Sapiens
RLYLVVSPA

SEQ ID NO: 342710 - protein, 9 aa, Homo Sapiens
SDKSIFYFS

SEQ ID NO: 342711 - protein, 9 aa, Homo Sapiens
WDKKGMDRG

SEQ ID NO: 342712 - protein, 9 aa, Homo Sapiens
KQRLHSGSA

SEQ ID NO: 342713 - protein, 9 aa, Homo Sapiens
QEVLLSASL

SEQ ID NO: 342714 - protein, 9 aa, Homo Sapiens
VSPEQNNRT

SEQ ID NO: 342715 - protein, 9 aa, Homo Sapiens
KELQVAFQE

SEQ ID NO: 342716 - protein, 9 aa, Homo Sapiens
WLTCLLQHE

SEQ ID NO: 342717 - protein, 9 aa, Homo Sapiens
RIEHEHKLS

SEQ ID NO: 342718 - protein, 9 aa, Homo Sapiens
EKQAGVLGF

SEQ ID NO: 342719 - protein, 9 aa, Homo Sapiens
YICIECRQA

SEQ ID NO: 342720 - protein, 9 aa, Homo Sapiens
TVIDEIQNG

SEQ ID NO: 342721 - protein, 9 aa, Homo Sapiens
LKIGLLSAN

SEQ ID NO: 342722 - protein, 9 aa, Homo Sapiens
KKHKLYVSF

SEQ ID NO: 342723 - protein, 9 aa, Homo Sapiens
AQLAQGISQ

SEQ ID NO: 342724 - protein, 9 aa, Homo Sapiens
IMFPDQTVK

SEQ ID NO: 342725 - protein, 9 aa, Homo Sapiens
LCGAACGVT

SEQ ID NO: 342726 - protein, 9 aa, Homo Sapiens
EDDILHQWR

SEQ ID NO: 342727 - protein, 9 aa, Homo Sapiens
MLPIYPAIY

SEQ ID NO: 342728 - protein, 9 aa, Homo Sapiens
PSYKFILND

SEQ ID NO: 342729 - protein, 9 aa, Homo Sapiens
FLTLSTPPT

SEQ ID NO: 342730 - protein, 9 aa, Homo Sapiens
DEYKYCLRH

SEQ ID NO: 342731 - protein, 9 aa, Homo Sapiens
LSDSQSGSP

SEQ ID NO: 342732 - protein, 9 aa, Homo Sapiens
DIFQDVKWS

SEQ ID NO: 342733 - protein, 9 aa, Homo Sapiens
EATTDSTTS

SEQ ID NO: 342734 - protein, 9 aa, Homo Sapiens
LQNAHAMRW

SEQ ID NO: 342735 - protein, 9 aa, Homo Sapiens
LQRWNQLQE

SEQ ID NO: 342736 - protein, 9 aa, Homo Sapiens
HKHIKHSHH

SEQ ID NO: 342737 - protein, 9 aa, Homo Sapiens
RMDTEEQKD

SEQ ID NO: 342738 - protein, 9 aa, Homo Sapiens
CHYERKGLA

SEQ ID NO: 342739 - protein, 9 aa, Homo Sapiens
LVIPIQYYV

SEQ ID NO: 342740 - protein, 9 aa, Homo Sapiens
TNNSKWVEV

SEQ ID NO: 342741 - protein, 9 aa, Homo Sapiens
KDATDDYFH

SEQ ID NO: 342742 - protein, 9 aa, Homo Sapiens
GAYVEQYLL

SEQ ID NO: 342743 - protein, 9 aa, Homo Sapiens
SSLRQKTSK

SEQ ID NO: 342744 - protein, 9 aa, Homo Sapiens
GKYQNKARR

SEQ ID NO: 342745 - protein, 9 aa, Homo Sapiens
SPSLDKGAK

SEQ ID NO: 342746 - protein, 9 aa, Homo Sapiens
MTVFLLLKD

SEQ ID NO: 342747 - protein, 9 aa, Homo Sapiens
LFTGILYVD

SEQ ID NO: 342748 - protein, 9 aa, Homo Sapiens
KKDVLLQNQ

SEQ ID NO: 342749 - protein, 9 aa, Homo Sapiens
SGKKRKIKR

SEQ ID NO: 342750 - protein, 9 aa, Homo Sapiens
KEISELFYD

SEQ ID NO: 342751 - protein, 9 aa, Homo Sapiens
RQSRRRFWK

SEQ ID NO: 342752 - protein, 9 aa, Homo Sapiens
QKQSESSFI

SEQ ID NO: 342753 - protein, 9 aa, Homo Sapiens
EADIEIIPE

SEQ ID NO: 342754 - protein, 9 aa, Homo Sapiens
WLQYEKLHQ

SEQ ID NO: 342755 - protein, 9 aa, Homo Sapiens
HAASMFLTL

SEQ ID NO: 342756 - protein, 9 aa, Homo Sapiens
RRKNCPACH

SEQ ID NO: 342757 - protein, 9 aa, Homo Sapiens
LEKNKMKRE

SEQ ID NO: 342758 - protein, 9 aa, Homo Sapiens
AKALEEARN

SEQ ID NO: 342759 - protein, 9 aa, Homo Sapiens
LNRHKMTHT

SEQ ID NO: 342760 - protein, 9 aa, Homo Sapiens
EEKKKPHIN

SEQ ID NO: 342761 - protein, 9 aa, Homo Sapiens
RDVGPYGIQ

SEQ ID NO: 342762 - protein, 9 aa, Homo Sapiens
LKSNKRQGW

SEQ ID NO: 342763 - protein, 9 aa, Homo Sapiens
KEQHSKIYM

SEQ ID NO: 342764 - protein, 9 aa, Homo Sapiens
GPLTKGISR

SEQ ID NO: 342765 - protein, 9 aa, Homo Sapiens
HKTSPLDNS

SEQ ID NO: 342766 - protein, 9 aa, Homo Sapiens
VFEFDWKAY

SEQ ID NO: 342767 - protein, 9 aa, Homo Sapiens
ASNIYSGQV

SEQ ID NO: 342768 - protein, 9 aa, Homo Sapiens
GGKVTAKTK

SEQ ID NO: 342769 - protein, 9 aa, Homo Sapiens
KHPSHQPPV

SEQ ID NO: 342770 - protein, 9 aa, Homo Sapiens
SSLLPHAGV

SEQ ID NO: 342771 - protein, 9 aa, Homo Sapiens
HLQWKRPPE

SEQ ID NO: 342772 - protein, 9 aa, Homo Sapiens
ELQKIRKYF

SEQ ID NO: 342773 - protein, 9 aa, Homo Sapiens
QSINHFFCE

SEQ ID NO: 342774 - protein, 9 aa, Homo Sapiens
INKAFSKEN

SEQ ID NO: 342775 - protein, 9 aa, Homo Sapiens
LSRVCRHNK

SEQ ID NO: 342776 - protein, 9 aa, Homo Sapiens
HIWCSNKKN

SEQ ID NO: 342777 - protein, 9 aa, Homo Sapiens
INKIPIDNY

SEQ ID NO: 342778 - protein, 9 aa, Homo Sapiens
KLDLNEDNC

SEQ ID NO: 342779 - protein, 9 aa, Homo Sapiens
LGTFSIAVV

SEQ ID NO: 342780 - protein, 9 aa, Homo Sapiens
VSLGAQQQK

SEQ ID NO: 342781 - protein, 9 aa, Homo Sapiens
KKGVCVCPF

SEQ ID NO: 342782 - protein, 9 aa, Homo Sapiens
LGKKPWVTK

SEQ ID NO: 342783 - protein, 9 aa, Homo Sapiens
FSNAYTFRD

SEQ ID NO: 342784 - protein, 9 aa, Homo Sapiens
QKIRKYFSF

SEQ ID NO: 342785 - protein, 9 aa, Homo Sapiens
VHGLPLKIK

SEQ ID NO: 342786 - protein, 9 aa, Homo Sapiens
RNMNTLRRC

SEQ ID NO: 342787 - protein, 9 aa, Homo Sapiens
CGSQSINHF

SEQ ID NO: 342788 - protein, 9 aa, Homo Sapiens
KNIFSRFFY

SEQ ID NO: 342789 - protein, 9 aa, Homo Sapiens
FQIHEITHT

SEQ ID NO: 342790 - protein, 9 aa, Homo Sapiens
GIVVAVSQD

SEQ ID NO: 342791 - protein, 9 aa, Homo Sapiens
KKESIFVVS

SEQ ID NO: 342792 - protein, 9 aa, Homo Sapiens
DWCCQSNCK

SEQ ID NO: 342793 - protein, 9 aa, Homo Sapiens
FSLDWIKAN

SEQ ID NO: 342794 - protein, 9 aa, Homo Sapiens
VCWSVLKRV

SEQ ID NO: 342795 - protein, 9 aa, Homo Sapiens
GVGLASVEQ

SEQ ID NO: 342796 - protein, 9 aa, Homo Sapiens
GCFTAQDTV

SEQ ID NO: 342797 - protein, 9 aa, Homo Sapiens
GMSLGIDTQ

SEQ ID NO: 342798 - protein, 9 aa, Homo Sapiens
LVILRINRT

SEQ ID NO: 342799 - protein, 9 aa, Homo Sapiens
MLHRFYGNN

SEQ ID NO: 342800 - protein, 9 aa, Homo Sapiens
ISHLPSPSP

SEQ ID NO: 342801 - protein, 9 aa, Homo Sapiens
RYELIVDVN

SEQ ID NO: 342802 - protein, 9 aa, Homo Sapiens
GKKIKQAIK

SEQ ID NO: 342803 - protein, 9 aa, Homo Sapiens
MLTNKCQEQ

SEQ ID NO: 342804 - protein, 9 aa, Homo Sapiens
IGKEFINLL

SEQ ID NO: 342805 - protein, 9 aa, Homo Sapiens
LMVERCGKI

SEQ ID NO: 342806 - protein, 9 aa, Homo Sapiens
VNWLLERGH

SEQ ID NO: 342807 - protein, 9 aa, Homo Sapiens
KEPVPWKFP

SEQ ID NO: 342808 - protein, 9 aa, Homo Sapiens
LNRKKDVMA

SEQ ID NO: 342809 - protein, 9 aa, Homo Sapiens
LPPSCRNSN

SEQ ID NO: 342810 - protein, 9 aa, Homo Sapiens
RGDKFQCGD

SEQ ID NO: 342811 - protein, 9 aa, Homo Sapiens
IFNLFSTND

SEQ ID NO: 342812 - protein, 9 aa, Homo Sapiens
ASALKGLEK

SEQ ID NO: 342813 - protein, 9 aa, Homo Sapiens
MGGNDNETL

SEQ ID NO: 342814 - protein, 9 aa, Homo Sapiens
EENMVLRSK

SEQ ID NO: 342815 - protein, 9 aa, Homo Sapiens
GPPSKPPNE

SEQ ID NO: 342816 - protein, 9 aa, Homo Sapiens
LLMKEGTST

SEQ ID NO: 342817 - protein, 9 aa, Homo Sapiens
TLFTLEGRP

SEQ ID NO: 342818 - protein, 9 aa, Homo Sapiens
HTYRIDDVD

SEQ ID NO: 342819 - protein, 8 aa, Homo Sapiens
NDHQEKLE

SEQ ID NO: 342820 - protein, 9 aa, Homo Sapiens
GTPGVLRDS

SEQ ID NO: 342821 - protein, 9 aa, Homo Sapiens
QVMTLQGLV

SEQ ID NO: 342822 - protein, 9 aa, Homo Sapiens
KILHLKQFG

SEQ ID NO: 342823 - protein, 9 aa, Homo Sapiens
DQKNNLKDL

SEQ ID NO: 342824 - protein, 9 aa, Homo Sapiens
KTDLRTGLS

SEQ ID NO: 342825 - protein, 9 aa, Homo Sapiens
EQFTCIPYR

SEQ ID NO: 342826 - protein, 9 aa, Homo Sapiens
PTFFSQVAC

SEQ ID NO: 342827 - protein, 9 aa, Homo Sapiens
VDVNKPIIA

SEQ ID NO: 342828 - protein, 9 aa, Homo Sapiens
VKSVISDGP

SEQ ID NO: 342829 - protein, 9 aa, Homo Sapiens
GIGWWVRNM

SEQ ID NO: 342830 - protein, 9 aa, Homo Sapiens
LEGILCELK

SEQ ID NO: 342831 - protein, 9 aa, Homo Sapiens
PGVDTSPPR

SEQ ID NO: 342832 - protein, 9 aa, Homo Sapiens
GLVLLTCDA

SEQ ID NO: 342833 - protein, 9 aa, Homo Sapiens
RGFYVEQLW

SEQ ID NO: 342834 - protein, 9 aa, Homo Sapiens
LSQTCVMWD

SEQ ID NO: 342835 - protein, 9 aa, Homo Sapiens
KNSESVYYG

SEQ ID NO: 342836 - protein, 9 aa, Homo Sapiens
QTLLKEIAK

SEQ ID NO: 342837 - protein, 9 aa, Homo Sapiens
SYIESILLY

SEQ ID NO: 342838 - protein, 9 aa, Homo Sapiens
CLKNMNLEG

SEQ ID NO: 342839 - protein, 9 aa, Homo Sapiens
PSPADIKET

SEQ ID NO: 342840 - protein, 9 aa, Homo Sapiens
WCFHKHGTS

SEQ ID NO: 342841 - protein, 9 aa, Homo Sapiens
LLTTFMHAN

SEQ ID NO: 342842 - protein, 9 aa, Homo Sapiens
VDAPVTPSD

SEQ ID NO: 342843 - protein, 9 aa, Homo Sapiens
SQGTAVTHG

SEQ ID NO: 342844 - protein, 9 aa, Homo Sapiens
IVMRLERVC

SEQ ID NO: 342845 - protein, 9 aa, Homo Sapiens
GLTSTHSKF

SEQ ID NO: 342846 - protein, 9 aa, Homo Sapiens
KCYLYPDLS

SEQ ID NO: 342847 - protein, 9 aa, Homo Sapiens
HHVEPLKRL

SEQ ID NO: 342848 - protein, 9 aa, Homo Sapiens
IVHATHTLT

SEQ ID NO: 342849 - protein, 9 aa, Homo Sapiens
NMNLMGWLH

SEQ ID NO: 342850 - protein, 9 aa, Homo Sapiens
RQVRILQDK

SEQ ID NO: 342851 - protein, 9 aa, Homo Sapiens
CCPVCSQEC

SEQ ID NO: 342852 - protein, 9 aa, Homo Sapiens
LAGNQADLS

SEQ ID NO: 342853 - protein, 9 aa, Homo Sapiens
GETMSLGCC

SEQ ID NO: 342854 - protein, 9 aa, Homo Sapiens
SRVEELALR

SEQ ID NO: 342855 - protein, 9 aa, Homo Sapiens
SLQYKNNQI

SEQ ID NO: 342856 - protein, 9 aa, Homo Sapiens
IKRTSAQVQ

SEQ ID NO: 342857 - protein, 9 aa, Homo Sapiens
CYNVALEYL

SEQ ID NO: 342858 - protein, 9 aa, Homo Sapiens
LAFILDGLH

SEQ ID NO: 342859 - protein, 9 aa, Homo Sapiens
PIQYYVRWR

SEQ ID NO: 342860 - protein, 9 aa, Homo Sapiens
ATIDRYVVC

SEQ ID NO: 342861 - protein, 9 aa, Homo Sapiens
CVAPQCKRS

SEQ ID NO: 342862 - protein, 9 aa, Homo Sapiens
ACHILHVSR

SEQ ID NO: 342863 - protein, 9 aa, Homo Sapiens
SMEILFKAW

SEQ ID NO: 342864 - protein, 9 aa, Homo Sapiens
GDQVSCIFA

SEQ ID NO: 342865 - protein, 9 aa, Homo Sapiens
CHGKSQGAA

SEQ ID NO: 342866 - protein, 9 aa, Homo Sapiens
LDIPGDKEY

SEQ ID NO: 342867 - protein, 9 aa, Homo Sapiens
PAIYIDAQT

SEQ ID NO: 342868 - protein, 9 aa, Homo Sapiens
LVQTAQNSQ

SEQ ID NO: 342869 - protein, 9 aa, Homo Sapiens
CFPLHYPIH

SEQ ID NO: 342870 - protein, 9 aa, Homo Sapiens
YQWLEADCH

SEQ ID NO: 342871 - protein, 9 aa, Homo Sapiens
GNNVTLTCQ

SEQ ID NO: 342872 - protein, 9 aa, Homo Sapiens
NKLKECLKT

SEQ ID NO: 342873 - protein, 9 aa, Homo Sapiens
FNVLLPLII

SEQ ID NO: 342874 - protein, 9 aa, Homo Sapiens
SRRGCSYDS

SEQ ID NO: 342875 - protein, 9 aa, Homo Sapiens
DIKLSEWKM

SEQ ID NO: 342876 - protein, 9 aa, Homo Sapiens
KYSSSNEKQ

SEQ ID NO: 342877 - protein, 9 aa, Homo Sapiens
KQCSYISTN

SEQ ID NO: 342878 - protein, 9 aa, Homo Sapiens
ISDTNEAAA

SEQ ID NO: 342879 - protein, 9 aa, Homo Sapiens
RKQSGRGQR

SEQ ID NO: 342880 - protein, 9 aa, Homo Sapiens
HQFFEIQSK

SEQ ID NO: 342881 - protein, 9 aa, Homo Sapiens
PGQFIDQAR

SEQ ID NO: 342882 - protein, 9 aa, Homo Sapiens
SEYPELCSK

SEQ ID NO: 342883 - protein, 9 aa, Homo Sapiens
TITGKVKSD

SEQ ID NO: 342884 - protein, 9 aa, Homo Sapiens
QKAQSDGWE

SEQ ID NO: 342885 - protein, 9 aa, Homo Sapiens
MQMGGGGAM

SEQ ID NO: 342886 - protein, 9 aa, Homo Sapiens
SAAKAEAIT

SEQ ID NO: 342887 - protein, 9 aa, Homo Sapiens
VLVMSYSAK

SEQ ID NO: 342888 - protein, 9 aa, Homo Sapiens
AYLSKVNAS

SEQ ID NO: 342889 - protein, 9 aa, Homo Sapiens
LNSKAVKNL

SEQ ID NO: 342890 - protein, 9 aa, Homo Sapiens
LPAAPVTGH

SEQ ID NO: 342891 - protein, 9 aa, Homo Sapiens
FGSEYGVLY

SEQ ID NO: 342892 - protein, 9 aa, Homo Sapiens
YLNLPRRSH

SEQ ID NO: 342893 - protein, 9 aa, Homo Sapiens
VTASPLWTS

SEQ ID NO: 342894 - protein, 9 aa, Homo Sapiens
DYTTKKYRE

SEQ ID NO: 342895 - protein, 9 aa, Homo Sapiens
VQFLIYQII

SEQ ID NO: 342896 - protein, 9 aa, Homo Sapiens
PVHLTQERN

SEQ ID NO: 342897 - protein, 9 aa, Homo Sapiens
LTQVSSLVL

SEQ ID NO: 342898 - protein, 9 aa, Homo Sapiens
LFQEAVPPN

SEQ ID NO: 342899 - protein, 9 aa, Homo Sapiens
SLDRKTICD

SEQ ID NO: 342900 - protein, 9 aa, Homo Sapiens
HNRHSLQDP

SEQ ID NO: 342901 - protein, 9 aa, Homo Sapiens
EAVTALIAS

SEQ ID NO: 342902 - protein, 9 aa, Homo Sapiens
VGKLKDDDF

SEQ ID NO: 342903 - protein, 9 aa, Homo Sapiens
ICQQKKEKE

SEQ ID NO: 342904 - protein, 9 aa, Homo Sapiens
YYNRDWYKH

SEQ ID NO: 342905 - protein, 9 aa, Homo Sapiens
LTSNNSALE

SEQ ID NO: 342906 - protein, 9 aa, Homo Sapiens
ANTSYFHTT

SEQ ID NO: 342907 - protein, 9 aa, Homo Sapiens
VHYYLTSAI

SEQ ID NO: 342908 - protein, 9 aa, Homo Sapiens
TFDGQLVKK

SEQ ID NO: 342909 - protein, 9 aa, Homo Sapiens
LEEELQTMD

SEQ ID NO: 342910 - protein, 9 aa, Homo Sapiens
ALKGLEKKE

SEQ ID NO: 342911 - protein, 9 aa, Homo Sapiens
LRVNTQETL

SEQ ID NO: 342912 - protein, 9 aa, Homo Sapiens
ESGKRKVTD

SEQ ID NO: 342913 - protein, 9 aa, Homo Sapiens
PTVNAYTLN

SEQ ID NO: 342914 - protein, 9 aa, Homo Sapiens
PIQTPARKL

SEQ ID NO: 342915 - protein, 9 aa, Homo Sapiens
KFRDILLRH

SEQ ID NO: 342916 - protein, 9 aa, Homo Sapiens
KRRITIEDF

SEQ ID NO: 342917 - protein, 9 aa, Homo Sapiens
EQIKQLSDF

SEQ ID NO: 342918 - protein, 9 aa, Homo Sapiens
AFSRSTYFQ

SEQ ID NO: 342919 - protein, 9 aa, Homo Sapiens
QRVHTAVRP

SEQ ID NO: 342920 - protein, 9 aa, Homo Sapiens
RMELEQNVV

SEQ ID NO: 342921 - protein, 9 aa, Homo Sapiens
LNNSRLVSK

SEQ ID NO: 342922 - protein, 9 aa, Homo Sapiens
QDVTRAGFL

SEQ ID NO: 342923 - protein, 9 aa, Homo Sapiens
APFKMPSSV

SEQ ID NO: 342924 - protein, 9 aa, Homo Sapiens
KKYREKSLY

SEQ ID NO: 342925 - protein, 9 aa, Homo Sapiens
MKRLLMTKL

SEQ ID NO: 342926 - protein, 9 aa, Homo Sapiens
LCLSFGHSK

SEQ ID NO: 342927 - protein, 9 aa, Homo Sapiens
WYSSLFVFP

SEQ ID NO: 342928 - protein, 9 aa, Homo Sapiens
RAVKVYAIN

SEQ ID NO: 342929 - protein, 9 aa, Homo Sapiens
LEGDLPLAD

SEQ ID NO: 342930 - protein, 9 aa, Homo Sapiens
SDLPPGTNI

SEQ ID NO: 342931 - protein, 9 aa, Homo Sapiens
KEGTSTFAN

SEQ ID NO: 342932 - protein, 9 aa, Homo Sapiens
GQQRDLIRQ

SEQ ID NO: 342933 - protein, 9 aa, Homo Sapiens
EKGPMFKLL

SEQ ID NO: 342934 - protein, 9 aa, Homo Sapiens
FVLMFYKEK

SEQ ID NO: 342935 - protein, 9 aa, Homo Sapiens
KAEIASCRD

SEQ ID NO: 342936 - protein, 9 aa, Homo Sapiens
VEEILEICI

SEQ ID NO: 342937 - protein, 9 aa, Homo Sapiens
YGLKTANGK

SEQ ID NO: 342938 - protein, 9 aa, Homo Sapiens
TPVLEAFPQ

SEQ ID NO: 342939 - protein, 9 aa, Homo Sapiens
KRNFEESKG

SEQ ID NO: 342940 - protein, 9 aa, Homo Sapiens
MTNKMQKTL

SEQ ID NO: 342941 - protein, 9 aa, Homo Sapiens
EITHNDIAL

SEQ ID NO: 342942 - protein, 9 aa, Homo Sapiens
CKQDWSDHA

SEQ ID NO: 342943 - protein, 9 aa, Homo Sapiens
CKVHQRGTM

SEQ ID NO: 342944 - protein, 9 aa, Homo Sapiens
GNEKQRKQA

SEQ ID NO: 342945 - protein, 9 aa, Homo Sapiens
LSLLEKKKK

SEQ ID NO: 342946 - protein, 9 aa, Homo Sapiens
RPEHHKINK

SEQ ID NO: 342947 - protein, 9 aa, Homo Sapiens
DSLKENLDK

SEQ ID NO: 342948 - protein, 9 aa, Homo Sapiens
SVALAKPFN

SEQ ID NO: 342949 - protein, 9 aa, Homo Sapiens
DCINCGKAF

SEQ ID NO: 342950 - protein, 9 aa, Homo Sapiens
CGVGLLTRF

SEQ ID NO: 342951 - protein, 9 aa, Homo Sapiens
ISRIKTLQA

SEQ ID NO: 342952 - protein, 9 aa, Homo Sapiens
YNKFNHYDT

SEQ ID NO: 342953 - protein, 9 aa, Homo Sapiens
EQCSIKAKP

SEQ ID NO: 342954 - protein, 9 aa, Homo Sapiens
FCWGYQLTQ

SEQ ID NO: 342955 - protein, 9 aa, Homo Sapiens
LGKKFGIGL

SEQ ID NO: 342956 - protein, 9 aa, Homo Sapiens
RPALADNFY

SEQ ID NO: 342957 - protein, 9 aa, Homo Sapiens
AKVNCLSFN

SEQ ID NO: 342958 - protein, 9 aa, Homo Sapiens
PALPSCLLS

SEQ ID NO: 342959 - protein, 9 aa, Homo Sapiens
NDTTENGLP

SEQ ID NO: 342960 - protein, 9 aa, Homo Sapiens
AINLDEGVN

SEQ ID NO: 342961 - protein, 9 aa, Homo Sapiens
KAFYHPRLI

SEQ ID NO: 342962 - protein, 9 aa, Homo Sapiens
EKGQVKNEV

SEQ ID NO: 342963 - protein, 9 aa, Homo Sapiens
DKCQLMFFI

SEQ ID NO: 342964 - protein, 9 aa, Homo Sapiens
LQQAQSQYP

SEQ ID NO: 342965 - protein, 9 aa, Homo Sapiens
TSAQVQTGN

SEQ ID NO: 342966 - protein, 9 aa, Homo Sapiens
GFRCSSSLC

SEQ ID NO: 342967 - protein, 9 aa, Homo Sapiens
SHSERFCLG

SEQ ID NO: 342968 - protein, 9 aa, Homo Sapiens
RLSSSPQHL

SEQ ID NO: 342969 - protein, 9 aa, Homo Sapiens
DLSASSSLR

SEQ ID NO: 342970 - protein, 9 aa, Homo Sapiens
AGKGYDNED

SEQ ID NO: 342971 - protein, 9 aa, Homo Sapiens
ELWKYTINN

SEQ ID NO: 342972 - protein, 9 aa, Homo Sapiens
ENVYHCGLC

SEQ ID NO: 342973 - protein, 9 aa, Homo Sapiens
YNGHRDLEI

SEQ ID NO: 342974 - protein, 9 aa, Homo Sapiens
LYLIHEITH

SEQ ID NO: 342975 - protein, 9 aa, Homo Sapiens
EGCIRYKKP

SEQ ID NO: 342976 - protein, 9 aa, Homo Sapiens
YLVEITLKK

SEQ ID NO: 342977 - protein, 9 aa, Homo Sapiens
LALAYRQID

SEQ ID NO: 342978 - protein, 9 aa, Homo Sapiens
TPKITKSTQ

SEQ ID NO: 342979 - protein, 9 aa, Homo Sapiens
TQINQVAHD

SEQ ID NO: 342980 - protein, 9 aa, Homo Sapiens
VQTAQNSQL

SEQ ID NO: 342981 - protein, 9 aa, Homo Sapiens
SRVTYLLGA

SEQ ID NO: 342982 - protein, 9 aa, Homo Sapiens
QYLKWWSAT

SEQ ID NO: 342983 - protein, 9 aa, Homo Sapiens
CLNELKLSV

SEQ ID NO: 342984 - protein, 9 aa, Homo Sapiens
LHRSPHRES

SEQ ID NO: 342985 - protein, 9 aa, Homo Sapiens
EAPRSMQGT

SEQ ID NO: 342986 - protein, 9 aa, Homo Sapiens
SPEILWKRL

SEQ ID NO: 342987 - protein, 9 aa, Homo Sapiens
EWKIIRTLL

SEQ ID NO: 342988 - protein, 9 aa, Homo Sapiens
GRHAKAPTD

SEQ ID NO: 342989 - protein, 9 aa, Homo Sapiens
KGMEESGSE

SEQ ID NO: 342990 - protein, 9 aa, Homo Sapiens
KKKKWSTQG

SEQ ID NO: 342991 - protein, 9 aa, Homo Sapiens
QSYSAGEAS

SEQ ID NO: 342992 - protein, 9 aa, Homo Sapiens
CHMLAVMAY

SEQ ID NO: 342993 - protein, 9 aa, Homo Sapiens
SVMCISPEE

SEQ ID NO: 342994 - protein, 9 aa, Homo Sapiens
GAVGHRPVW

SEQ ID NO: 342995 - protein, 9 aa, Homo Sapiens
LDHSETRLL

SEQ ID NO: 342996 - protein, 9 aa, Homo Sapiens
SKINLHQHQ

SEQ ID NO: 342997 - protein, 9 aa, Homo Sapiens
HLINYYVQM

SEQ ID NO: 342998 - protein, 9 aa, Homo Sapiens
RALYFTCDN

SEQ ID NO: 342999 - protein, 9 aa, Homo Sapiens
QHKIIYTRE

SEQ ID NO: 343000 - protein, 9 aa, Homo Sapiens
LSIFQSYPE

SEQ ID NO: 343001 - protein, 9 aa, Homo Sapiens
LERLRSKNK

SEQ ID NO: 343002 - protein, 9 aa, Homo Sapiens
DWYKHNFAI

SEQ ID NO: 343003 - protein, 9 aa, Homo Sapiens
EETIQRINE

SEQ ID NO: 343004 - protein, 9 aa, Homo Sapiens
QLDGDNKYG

SEQ ID NO: 343005 - protein, 9 aa, Homo Sapiens
LPRTKDTLS

SEQ ID NO: 343006 - protein, 9 aa, Homo Sapiens
VSSSGNDTT

SEQ ID NO: 343007 - protein, 9 aa, Homo Sapiens
FRKETFLLM

SEQ ID NO: 343008 - protein, 9 aa, Homo Sapiens
IYEYLLHVG

SEQ ID NO: 343009 - protein, 9 aa, Homo Sapiens
EGTISWTDW

SEQ ID NO: 343010 - protein, 9 aa, Homo Sapiens
NGKIHDHAI

SEQ ID NO: 343011 - protein, 9 aa, Homo Sapiens
LYDPSPWVK

SEQ ID NO: 343012 - protein, 9 aa, Homo Sapiens
VMVTLGEED

SEQ ID NO: 343013 - protein, 9 aa, Homo Sapiens
MNVSLNQEY

SEQ ID NO: 343014 - protein, 9 aa, Homo Sapiens
QCKECGKAC

SEQ ID NO: 343015 - protein, 9 aa, Homo Sapiens
EAQLIELIE

SEQ ID NO: 343016 - protein, 9 aa, Homo Sapiens
AVSRGVVVA

SEQ ID NO: 343017 - protein, 9 aa, Homo Sapiens
ATLFSTLTG

SEQ ID NO: 343018 - protein, 9 aa, Homo Sapiens
TRLNWQIKY

SEQ ID NO: 343019 - protein, 9 aa, Homo Sapiens
QEIQTLRKR

SEQ ID NO: 343020 - protein, 9 aa, Homo Sapiens
EYINLDIKY

SEQ ID NO: 343021 - protein, 9 aa, Homo Sapiens
ICYVTITNC

SEQ ID NO: 343022 - protein, 9 aa, Homo Sapiens
SQSCILEPC

SEQ ID NO: 343023 - protein, 9 aa, Homo Sapiens
IENSFKYLL

SEQ ID NO: 343024 - protein, 9 aa, Homo Sapiens
QNQLRNQLG

SEQ ID NO: 343025 - protein, 9 aa, Homo Sapiens
VLFGMRICQ

SEQ ID NO: 343026 - protein, 9 aa, Homo Sapiens
WAVQNIQNV

SEQ ID NO: 343027 - protein, 9 aa, Homo Sapiens
AGGTNSCIS

SEQ ID NO: 343028 - protein, 9 aa, Homo Sapiens
LVCTVCIKF

SEQ ID NO: 343029 - protein, 9 aa, Homo Sapiens
LWTSFLESL

SEQ ID NO: 343030 - protein, 9 aa, Homo Sapiens
KTFYRFKDT

SEQ ID NO: 343031 - protein, 9 aa, Homo Sapiens
HSHRDKHPV

SEQ ID NO: 343032 - protein, 9 aa, Homo Sapiens
TPNTTGPPS

SEQ ID NO: 343033 - protein, 9 aa, Homo Sapiens
NTALRDRLL

SEQ ID NO: 343034 - protein, 9 aa, Homo Sapiens
PRPSLSGKL

SEQ ID NO: 343035 - protein, 9 aa, Homo Sapiens
DPEHRRVLA

SEQ ID NO: 343036 - protein, 9 aa, Homo Sapiens
SSLERTFRE

SEQ ID NO: 343037 - protein, 9 aa, Homo Sapiens
ESHNQIDLM

SEQ ID NO: 343038 - protein, 9 aa, Homo Sapiens
EEIPNHRNA

SEQ ID NO: 343039 - protein, 9 aa, Homo Sapiens
RKMINVYKP

SEQ ID NO: 343040 - protein, 9 aa, Homo Sapiens
MQFAFSYLY

SEQ ID NO: 343041 - protein, 9 aa, Homo Sapiens
AAGLKENTL

SEQ ID NO: 343042 - protein, 9 aa, Homo Sapiens
FGWEADLRN

SEQ ID NO: 343043 - protein, 9 aa, Homo Sapiens
QRAHLIQHH

SEQ ID NO: 343044 - protein, 9 aa, Homo Sapiens
ELGAQPDAT

SEQ ID NO: 343045 - protein, 9 aa, Homo Sapiens
IHDNKFFGD

SEQ ID NO: 343046 - protein, 9 aa, Homo Sapiens
TVVYLKNTT

SEQ ID NO: 343047 - protein, 9 aa, Homo Sapiens
QRTIILWKL

SEQ ID NO: 343048 - protein, 9 aa, Homo Sapiens
HKKYKLTGN

SEQ ID NO: 343049 - protein, 9 aa, Homo Sapiens
RVECGKAFS

SEQ ID NO: 343050 - protein, 9 aa, Homo Sapiens
LYQWLEADC

SEQ ID NO: 343051 - protein, 9 aa, Homo Sapiens
ESEASENKC

SEQ ID NO: 343052 - protein, 9 aa, Homo Sapiens
SRTKEHTYV

SEQ ID NO: 343053 - protein, 9 aa, Homo Sapiens
SVGLLQNKH

SEQ ID NO: 343054 - protein, 9 aa, Homo Sapiens
VEASTDSSK

SEQ ID NO: 343055 - protein, 9 aa, Homo Sapiens
VTGLQPINT

SEQ ID NO: 343056 - protein, 9 aa, Homo Sapiens
FATQVGVIC

SEQ ID NO: 343057 - protein, 9 aa, Homo Sapiens
VFNLFIFLG

SEQ ID NO: 343058 - protein, 9 aa, Homo Sapiens
NTWPVAILM

SEQ ID NO: 343059 - protein, 9 aa, Homo Sapiens
HADLHPGHI

SEQ ID NO: 343060 - protein, 9 aa, Homo Sapiens
KEIMFPDQT

SEQ ID NO: 343061 - protein, 9 aa, Homo Sapiens
TREYRYVAQ

SEQ ID NO: 343062 - protein, 9 aa, Homo Sapiens
PKEPDISLH

SEQ ID NO: 343063 - protein, 9 aa, Homo Sapiens
WPVGITAFC

SEQ ID NO: 343064 - protein, 9 aa, Homo Sapiens
EYGNKSGKK

SEQ ID NO: 343065 - protein, 9 aa, Homo Sapiens
LKEEEENNE

SEQ ID NO: 343066 - protein, 9 aa, Homo Sapiens
PSQTHKERS

SEQ ID NO: 343067 - protein, 9 aa, Homo Sapiens
AVVGAGYPV

SEQ ID NO: 343068 - protein, 9 aa, Homo Sapiens
ERLLFLFSW

SEQ ID NO: 343069 - protein, 9 aa, Homo Sapiens
QNKQVLEHE

SEQ ID NO: 343070 - protein, 9 aa, Homo Sapiens
IIGGVTRLT

SEQ ID NO: 343071 - protein, 9 aa, Homo Sapiens
PLNHNSGWG

SEQ ID NO: 343072 - protein, 9 aa, Homo Sapiens
YPVMAKKEE

SEQ ID NO: 343073 - protein, 9 aa, Homo Sapiens
DLSEFLNLI

SEQ ID NO: 343074 - protein, 9 aa, Homo Sapiens
WELIGISED

SEQ ID NO: 343075 - protein, 9 aa, Homo Sapiens
QTYKDHLEG

SEQ ID NO: 343076 - protein, 9 aa, Homo Sapiens
KLIQSLFLD

SEQ ID NO: 343077 - protein, 9 aa, Homo Sapiens
PEEMMEEQK

SEQ ID NO: 343078 - protein, 9 aa, Homo Sapiens
FMQELMAQY

SEQ ID NO: 343079 - protein, 9 aa, Homo Sapiens
EPPHLANLY

SEQ ID NO: 343080 - protein, 9 aa, Homo Sapiens
LSAQLHLWA

SEQ ID NO: 343081 - protein, 9 aa, Homo Sapiens
HKLMMSVAG

SEQ ID NO: 343082 - protein, 9 aa, Homo Sapiens
QQCIATADY

SEQ ID NO: 343083 - protein, 9 aa, Homo Sapiens
ERFQENSLD

SEQ ID NO: 343084 - protein, 9 aa, Homo Sapiens
MRSKQEGII

SEQ ID NO: 343085 - protein, 9 aa, Homo Sapiens
DIWENGMKV

SEQ ID NO: 343086 - protein, 9 aa, Homo Sapiens
SSKQQCIAT

SEQ ID NO: 343087 - protein, 9 aa, Homo Sapiens
VQDDMIIAK

SEQ ID NO: 343088 - protein, 9 aa, Homo Sapiens
TPDNGPSGV

SEQ ID NO: 343089 - protein, 9 aa, Homo Sapiens
GDNDKLGHG

SEQ ID NO: 343090 - protein, 9 aa, Homo Sapiens
DTLREVTVN

SEQ ID NO: 343091 - protein, 9 aa, Homo Sapiens
RRGRRDGEA

SEQ ID NO: 343092 - protein, 9 aa, Homo Sapiens
LSKSLSLVL

SEQ ID NO: 343093 - protein, 9 aa, Homo Sapiens
GLALLNNEM

SEQ ID NO: 343094 - protein, 9 aa, Homo Sapiens
KLSGPFRQQ

SEQ ID NO: 343095 - protein, 9 aa, Homo Sapiens
ELSVFCDCE

SEQ ID NO: 343096 - protein, 9 aa, Homo Sapiens
QDINLDIPR

SEQ ID NO: 343097 - protein, 9 aa, Homo Sapiens
ITATQCRLD

SEQ ID NO: 343098 - protein, 9 aa, Homo Sapiens
RDIVEGGSD

SEQ ID NO: 343099 - protein, 9 aa, Homo Sapiens
SRPALADNF

SEQ ID NO: 343100 - protein, 9 aa, Homo Sapiens
RPRYLDIPG

SEQ ID NO: 343101 - protein, 9 aa, Homo Sapiens
QKERRRIQE

SEQ ID NO: 343102 - protein, 9 aa, Homo Sapiens
VPQTAPAGY

SEQ ID NO: 343103 - protein, 9 aa, Homo Sapiens
SKDASVKAY

SEQ ID NO: 343104 - protein, 9 aa, Homo Sapiens
GKKTEEFFS

SEQ ID NO: 343105 - protein, 9 aa, Homo Sapiens
NNCTKLKSL

SEQ ID NO: 343106 - protein, 9 aa, Homo Sapiens
HNRTVGPNP

SEQ ID NO: 343107 - protein, 9 aa, Homo Sapiens
STLMTVFLL

SEQ ID NO: 343108 - protein, 9 aa, Homo Sapiens
LSSLQYHKN

SEQ ID NO: 343109 - protein, 9 aa, Homo Sapiens
PRASSPSQS

SEQ ID NO: 343110 - protein, 9 aa, Homo Sapiens
LVQRESLNR

SEQ ID NO: 343111 - protein, 9 aa, Homo Sapiens
LLPASRFQM

SEQ ID NO: 343112 - protein, 9 aa, Homo Sapiens
VFLSHESPK

SEQ ID NO: 343113 - protein, 9 aa, Homo Sapiens
LCFWKLYIQ

SEQ ID NO: 343114 - protein, 9 aa, Homo Sapiens
TAAGCEYLA

SEQ ID NO: 343115 - protein, 9 aa, Homo Sapiens
HIQEIQTLR

SEQ ID NO: 343116 - protein, 9 aa, Homo Sapiens
LLELEHIEV

SEQ ID NO: 343117 - protein, 9 aa, Homo Sapiens
ENNHPLLTR

SEQ ID NO: 343118 - protein, 9 aa, Homo Sapiens
RGRAVPVLP

SEQ ID NO: 343119 - protein, 9 aa, Homo Sapiens
VYYLGMTLY

SEQ ID NO: 343120 - protein, 9 aa, Homo Sapiens
VPSVWQSAR

SEQ ID NO: 343121 - protein, 9 aa, Homo Sapiens
LEIEGNHLA

SEQ ID NO: 343122 - protein, 9 aa, Homo Sapiens
EGIKCYLYP

SEQ ID NO: 343123 - protein, 9 aa, Homo Sapiens
VTQEAGKFM

SEQ ID NO: 343124 - protein, 9 aa, Homo Sapiens
HIQKAGGLK

SEQ ID NO: 343125 - protein, 9 aa, Homo Sapiens
GNDTTENGL

SEQ ID NO: 343126 - protein, 9 aa, Homo Sapiens
CLVNSSLER

SEQ ID NO: 343127 - protein, 9 aa, Homo Sapiens
VSLNQEYLN

SEQ ID NO: 343128 - protein, 9 aa, Homo Sapiens
SVGISVPTN

SEQ ID NO: 343129 - protein, 9 aa, Homo Sapiens
ATMPLVTSM

SEQ ID NO: 343130 - protein, 9 aa, Homo Sapiens
KVMCLKDYV

SEQ ID NO: 343131 - protein, 9 aa, Homo Sapiens
FFKLARQTY

SEQ ID NO: 343132 - protein, 9 aa, Homo Sapiens
PRGEIIWSH

SEQ ID NO: 343133 - protein, 9 aa, Homo Sapiens
GHNVLGTES

SEQ ID NO: 343134 - protein, 9 aa, Homo Sapiens
SISSCDTFL

SEQ ID NO: 343135 - protein, 9 aa, Homo Sapiens
HATEEIKVI

SEQ ID NO: 343136 - protein, 9 aa, Homo Sapiens
YCYAVRLSV

SEQ ID NO: 343137 - protein, 9 aa, Homo Sapiens
FIIANVRVQ

SEQ ID NO: 343138 - protein, 9 aa, Homo Sapiens
TLDTAKEMK

SEQ ID NO: 343139 - protein, 9 aa, Homo Sapiens
HRIPKADAP

SEQ ID NO: 343140 - protein, 9 aa, Homo Sapiens
SNQVRFMSL

SEQ ID NO: 343141 - protein, 9 aa, Homo Sapiens
EQDYHARKV

SEQ ID NO: 343142 - protein, 9 aa, Homo Sapiens
HDFDECQFD

SEQ ID NO: 343143 - protein, 9 aa, Homo Sapiens
EQIHLGDDF

SEQ ID NO: 343144 - protein, 9 aa, Homo Sapiens
HDNSLSQSG

SEQ ID NO: 343145 - protein, 9 aa, Homo Sapiens
EIHNTPLDM

SEQ ID NO: 343146 - protein, 9 aa, Homo Sapiens
YGDSPRGIF

SEQ ID NO: 343147 - protein, 9 aa, Homo Sapiens
STKKKAIST

SEQ ID NO: 343148 - protein, 9 aa, Homo Sapiens
ETSFLSNVT

SEQ ID NO: 343149 - protein, 9 aa, Homo Sapiens
DEAQSLRHS

SEQ ID NO: 343150 - protein, 9 aa, Homo Sapiens
KTKKFTLTE

SEQ ID NO: 343151 - protein, 9 aa, Homo Sapiens
KYIGVKPEF

SEQ ID NO: 343152 - protein, 9 aa, Homo Sapiens
IDEFIKAIT

SEQ ID NO: 343153 - protein, 9 aa, Homo Sapiens
HFHRVVRHH

SEQ ID NO: 343154 - protein, 9 aa, Homo Sapiens
RFADNDIGL

SEQ ID NO: 343155 - protein, 9 aa, Homo Sapiens
GCLAAIAPS

SEQ ID NO: 343156 - protein, 9 aa, Homo Sapiens
MQHAAELRD

SEQ ID NO: 343157 - protein, 9 aa, Homo Sapiens
PGRCISCDC

SEQ ID NO: 343158 - protein, 9 aa, Homo Sapiens
GKDFNRRIQ

SEQ ID NO: 343159 - protein, 9 aa, Homo Sapiens
MGRINDILS

SEQ ID NO: 343160 - protein, 9 aa, Homo Sapiens
LVQDDQAKG

SEQ ID NO: 343161 - protein, 9 aa, Homo Sapiens
RTNHPPGNW

SEQ ID NO: 343162 - protein, 9 aa, Homo Sapiens
MILQNATQR

SEQ ID NO: 343163 - protein, 9 aa, Homo Sapiens
QHNGSFANF

SEQ ID NO: 343164 - protein, 9 aa, Homo Sapiens
NPTVDLVCC

SEQ ID NO: 343165 - protein, 9 aa, Homo Sapiens
KGDELDAML

SEQ ID NO: 343166 - protein, 9 aa, Homo Sapiens
FYHSAVLLI

SEQ ID NO: 343167 - protein, 9 aa, Homo Sapiens
LQRLSSLIQ

SEQ ID NO: 343168 - protein, 9 aa, Homo Sapiens
NHDNSLSQS

SEQ ID NO: 343169 - protein, 9 aa, Homo Sapiens
VVLTSYHST

SEQ ID NO: 343170 - protein, 9 aa, Homo Sapiens
LTCESNANP

SEQ ID NO: 343171 - protein, 9 aa, Homo Sapiens
IKEPVSDIL

SEQ ID NO: 343172 - protein, 9 aa, Homo Sapiens
TEIPLINIS

SEQ ID NO: 343173 - protein, 9 aa, Homo Sapiens
TELGYTKQL

SEQ ID NO: 343174 - protein, 9 aa, Homo Sapiens
DEKKKRDSW

SEQ ID NO: 343175 - protein, 9 aa, Homo Sapiens
LCVFPDRCV

SEQ ID NO: 343176 - protein, 9 aa, Homo Sapiens
LCKNGGTCV

SEQ ID NO: 343177 - protein, 9 aa, Homo Sapiens
ARQKEEKQQ

SEQ ID NO: 343178 - protein, 9 aa, Homo Sapiens
VIDRWKALK

SEQ ID NO: 343179 - protein, 9 aa, Homo Sapiens
SNPNQEKYS

SEQ ID NO: 343180 - protein, 9 aa, Homo Sapiens
RLGNCKPDN

SEQ ID NO: 343181 - protein, 9 aa, Homo Sapiens
AFHIFQAID

SEQ ID NO: 343182 - protein, 9 aa, Homo Sapiens
KMRQEHQNR

SEQ ID NO: 343183 - protein, 9 aa, Homo Sapiens
LVWRTEVAK

SEQ ID NO: 343184 - protein, 9 aa, Homo Sapiens
VNTNQHKRE

SEQ ID NO: 343185 - protein, 9 aa, Homo Sapiens
TFELSIFEF

SEQ ID NO: 343186 - protein, 9 aa, Homo Sapiens
KYNVLYFAQ

SEQ ID NO: 343187 - protein, 9 aa, Homo Sapiens
RKEKDNRKL

SEQ ID NO: 343188 - protein, 9 aa, Homo Sapiens
HTTSLPVTA

SEQ ID NO: 343189 - protein, 9 aa, Homo Sapiens
QINEAVNDL

SEQ ID NO: 343190 - protein, 9 aa, Homo Sapiens
DPPFGDAFQ

SEQ ID NO: 343191 - protein, 9 aa, Homo Sapiens
GLEKYFYSF

SEQ ID NO: 343192 - protein, 9 aa, Homo Sapiens
RPENQARRQ

SEQ ID NO: 343193 - protein, 9 aa, Homo Sapiens
FLHLHNLTL

SEQ ID NO: 343194 - protein, 9 aa, Homo Sapiens
GKESTRQQD

SEQ ID NO: 343195 - protein, 9 aa, Homo Sapiens
QQKYIGVKP

SEQ ID NO: 343196 - protein, 9 aa, Homo Sapiens
KIGLLSANS

SEQ ID NO: 343197 - protein, 9 aa, Homo Sapiens
KDFDLVDKI

SEQ ID NO: 343198 - protein, 9 aa, Homo Sapiens
AYEKSKEIH

SEQ ID NO: 343199 - protein, 9 aa, Homo Sapiens
SQAMQEYIT

SEQ ID NO: 343200 - protein, 9 aa, Homo Sapiens
SEEFWLVDL

SEQ ID NO: 343201 - protein, 9 aa, Homo Sapiens
YANISELQT

SEQ ID NO: 343202 - protein, 9 aa, Homo Sapiens
QALEPTQDA

SEQ ID NO: 343203 - protein, 9 aa, Homo Sapiens
EKVYLCDQE

SEQ ID NO: 343204 - protein, 9 aa, Homo Sapiens
TSKLLFKKN

SEQ ID NO: 343205 - protein, 9 aa, Homo Sapiens
VNIPSSFQI

SEQ ID NO: 343206 - protein, 9 aa, Homo Sapiens
IYRWIWDAL

SEQ ID NO: 343207 - protein, 9 aa, Homo Sapiens
RNAPWTLIP

SEQ ID NO: 343208 - protein, 9 aa, Homo Sapiens
ILQWKPNPD

SEQ ID NO: 343209 - protein, 9 aa, Homo Sapiens
SFCQSSNLH

SEQ ID NO: 343210 - protein, 9 aa, Homo Sapiens
SFYIVTLNN

SEQ ID NO: 343211 - protein, 9 aa, Homo Sapiens
QLSSLAQAH

SEQ ID NO: 343212 - protein, 9 aa, Homo Sapiens
GTSGVDCNH

SEQ ID NO: 343213 - protein, 9 aa, Homo Sapiens
AFDLSQVIF

SEQ ID NO: 343214 - protein, 9 aa, Homo Sapiens
DFTDIIKLF

SEQ ID NO: 343215 - protein, 9 aa, Homo Sapiens
VKRPRLLVN

SEQ ID NO: 343216 - protein, 9 aa, Homo Sapiens
HVIHHILKA

SEQ ID NO: 343217 - protein, 9 aa, Homo Sapiens
VVQNRMGAL

SEQ ID NO: 343218 - protein, 9 aa, Homo Sapiens
WLRNDSNFA

SEQ ID NO: 343219 - protein, 9 aa, Homo Sapiens
KTSNSTGEA

SEQ ID NO: 343220 - protein, 9 aa, Homo Sapiens
TLKHTIEAL

SEQ ID NO: 343221 - protein, 9 aa, Homo Sapiens
SAILVTDTR

SEQ ID NO: 343222 - protein, 9 aa, Homo Sapiens
FVLGHLSFL

SEQ ID NO: 343223 - protein, 9 aa, Homo Sapiens
LGPPPVAST

SEQ ID NO: 343224 - protein, 9 aa, Homo Sapiens
VSKDNSTAS

SEQ ID NO: 343225 - protein, 9 aa, Homo Sapiens
LWLQGLRMC

SEQ ID NO: 343226 - protein, 9 aa, Homo Sapiens
PPTLHPGLR

SEQ ID NO: 343227 - protein, 9 aa, Homo Sapiens
EECRVHKLI

SEQ ID NO: 343228 - protein, 9 aa, Homo Sapiens
ERGKFQPPR

SEQ ID NO: 343229 - protein, 9 aa, Homo Sapiens
YMDVGVSHK

SEQ ID NO: 343230 - protein, 9 aa, Homo Sapiens
EERENLCFD

SEQ ID NO: 343231 - protein, 9 aa, Homo Sapiens
QLWHGDQIL

SEQ ID NO: 343232 - protein, 9 aa, Homo Sapiens
KLLSSLQYH

SEQ ID NO: 343233 - protein, 9 aa, Homo Sapiens
VSLCLGSWS

SEQ ID NO: 343234 - protein, 9 aa, Homo Sapiens
DKDKKSKKS

SEQ ID NO: 343235 - protein, 9 aa, Homo Sapiens
ILLKITTFG

SEQ ID NO: 343236 - protein, 9 aa, Homo Sapiens
KESGKRKVT

SEQ ID NO: 343237 - protein, 9 aa, Homo Sapiens
AFKELQGLA

SEQ ID NO: 343238 - protein, 9 aa, Homo Sapiens
EDKTDIFQD

SEQ ID NO: 343239 - protein, 9 aa, Homo Sapiens
CPCKGTLRL

SEQ ID NO: 343240 - protein, 9 aa, Homo Sapiens
MPFNIYMFK

SEQ ID NO: 343241 - protein, 9 aa, Homo Sapiens
SVPDLRRFI

SEQ ID NO: 343242 - protein, 9 aa, Homo Sapiens
FVMKFFNWL

SEQ ID NO: 343243 - protein, 9 aa, Homo Sapiens
TSSGKIKRT

SEQ ID NO: 343244 - protein, 9 aa, Homo Sapiens
CMQKVSYFH

SEQ ID NO: 343245 - protein, 9 aa, Homo Sapiens
FNTCTACKN

SEQ ID NO: 343246 - protein, 9 aa, Homo Sapiens
FKKFLPVMT

SEQ ID NO: 343247 - protein, 9 aa, Homo Sapiens
IHMRKRVCA

SEQ ID NO: 343248 - protein, 9 aa, Homo Sapiens
WPAPFKMPS

SEQ ID NO: 343249 - protein, 9 aa, Homo Sapiens
ILHVSREKL

SEQ ID NO: 343250 - protein, 9 aa, Homo Sapiens
AMQEWQHTS

SEQ ID NO: 343251 - protein, 9 aa, Homo Sapiens
LLDDSITIY

SEQ ID NO: 343252 - protein, 9 aa, Homo Sapiens
DFPFQDNIF

SEQ ID NO: 343253 - protein, 9 aa, Homo Sapiens
GEYFAMDED

SEQ ID NO: 343254 - protein, 9 aa, Homo Sapiens
GKNVPSVWQ

SEQ ID NO: 343255 - protein, 9 aa, Homo Sapiens
KDEAQSLRH

SEQ ID NO: 343256 - protein, 9 aa, Homo Sapiens
ATFPSACGK

SEQ ID NO: 343257 - protein, 9 aa, Homo Sapiens
EDSISFQIN

SEQ ID NO: 343258 - protein, 9 aa, Homo Sapiens
TSFLSNVTS

SEQ ID NO: 343259 - protein, 9 aa, Homo Sapiens
SKPLEDIKA

SEQ ID NO: 343260 - protein, 9 aa, Homo Sapiens
KCAIFEKPR

SEQ ID NO: 343261 - protein, 9 aa, Homo Sapiens
SESKLVIDL

SEQ ID NO: 343262 - protein, 9 aa, Homo Sapiens
SCDCNRAGT

SEQ ID NO: 343263 - protein, 9 aa, Homo Sapiens
CTFPALVLA

SEQ ID NO: 343264 - protein, 9 aa, Homo Sapiens
RRKPFTLVC

SEQ ID NO: 343265 - protein, 9 aa, Homo Sapiens
GAQHVNNNL

SEQ ID NO: 343266 - protein, 9 aa, Homo Sapiens
KNKRALRRF

SEQ ID NO: 343267 - protein, 9 aa, Homo Sapiens
EPPDSRCPS

SEQ ID NO: 343268 - protein, 9 aa, Homo Sapiens
TIRRTFWIN

SEQ ID NO: 343269 - protein, 9 aa, Homo Sapiens
VTANTTFCF

SEQ ID NO: 343270 - protein, 9 aa, Homo Sapiens
ISYHAMRKA

SEQ ID NO: 343271 - protein, 9 aa, Homo Sapiens
KPFLGHCHY

SEQ ID NO: 343272 - protein, 9 aa, Homo Sapiens
QICFVNPAG

SEQ ID NO: 343273 - protein, 9 aa, Homo Sapiens
QLGCFTAQD

SEQ ID NO: 343274 - protein, 9 aa, Homo Sapiens
SLLSLVALD

SEQ ID NO: 343275 - protein, 9 aa, Homo Sapiens
ELWDTFHEL

SEQ ID NO: 343276 - protein, 9 aa, Homo Sapiens
AEELESTVP

SEQ ID NO: 343277 - protein, 9 aa, Homo Sapiens
ALDMDRIKK

SEQ ID NO: 343278 - protein, 9 aa, Homo Sapiens
YYCKVENGV

SEQ ID NO: 343279 - protein, 9 aa, Homo Sapiens
ADHHFYRYM

SEQ ID NO: 343280 - protein, 9 aa, Homo Sapiens
CPFHSLNNA

SEQ ID NO: 343281 - protein, 9 aa, Homo Sapiens
WLWLRGLRK

SEQ ID NO: 343282 - protein, 9 aa, Homo Sapiens
YSPASASQV

SEQ ID NO: 343283 - protein, 9 aa, Homo Sapiens
SKLEELEEL

SEQ ID NO: 343284 - protein, 9 aa, Homo Sapiens
MNLDNLTRR

SEQ ID NO: 343285 - protein, 9 aa, Homo Sapiens
FNYLAKHNV

SEQ ID NO: 343286 - protein, 9 aa, Homo Sapiens
EDQDNQRVQ

SEQ ID NO: 343287 - protein, 9 aa, Homo Sapiens
AAMALKVEG

SEQ ID NO: 343288 - protein, 9 aa, Homo Sapiens
EGQIPVTCQ

SEQ ID NO: 343289 - protein, 9 aa, Homo Sapiens
KMSRITMQE

SEQ ID NO: 343290 - protein, 9 aa, Homo Sapiens
FLRTPEQCC

SEQ ID NO: 343291 - protein, 9 aa, Homo Sapiens
FLTESSLTK

SEQ ID NO: 343292 - protein, 9 aa, Homo Sapiens
SKFSLLSVS

SEQ ID NO: 343293 - protein, 9 aa, Homo Sapiens
KFLVSVSKD

SEQ ID NO: 343294 - protein, 9 aa, Homo Sapiens
VTQQHNTMF

SEQ ID NO: 343295 - protein, 9 aa, Homo Sapiens
SQSTQLDNP

SEQ ID NO: 343296 - protein, 9 aa, Homo Sapiens
LYHLAKHPK

SEQ ID NO: 343297 - protein, 9 aa, Homo Sapiens
KVTQKIVTE

SEQ ID NO: 343298 - protein, 9 aa, Homo Sapiens
NTIRVTFHN

SEQ ID NO: 343299 - protein, 9 aa, Homo Sapiens
KQDEEINQT

SEQ ID NO: 343300 - protein, 9 aa, Homo Sapiens
ARLYRSRKK

SEQ ID NO: 343301 - protein, 9 aa, Homo Sapiens
VPLRGLPPM

SEQ ID NO: 343302 - protein, 9 aa, Homo Sapiens
VHKISGHDT

SEQ ID NO: 343303 - protein, 9 aa, Homo Sapiens
IRYTWPCSF

SEQ ID NO: 343304 - protein, 9 aa, Homo Sapiens
CKNKQKSTK

SEQ ID NO: 343305 - protein, 9 aa, Homo Sapiens
QTERSNISA

SEQ ID NO: 343306 - protein, 9 aa, Homo Sapiens
QREGPKGCN

SEQ ID NO: 343307 - protein, 9 aa, Homo Sapiens
KKTSGGGRP

SEQ ID NO: 343308 - protein, 9 aa, Homo Sapiens
RAKERRAGV

SEQ ID NO: 343309 - protein, 9 aa, Homo Sapiens
LPYRYNLFC

SEQ ID NO: 343310 - protein, 9 aa, Homo Sapiens
FIKHFIIYL

SEQ ID NO: 343311 - protein, 9 aa, Homo Sapiens
PVAAAKGRP

SEQ ID NO: 343312 - protein, 9 aa, Homo Sapiens
IVKKDAFWR

SEQ ID NO: 343313 - protein, 9 aa, Homo Sapiens
ICILVAHKH

SEQ ID NO: 343314 - protein, 9 aa, Homo Sapiens
FPVLEHEAR

SEQ ID NO: 343315 - protein, 9 aa, Homo Sapiens
WQTRSHVAR

SEQ ID NO: 343316 - protein, 9 aa, Homo Sapiens
SCLTQHQIT

SEQ ID NO: 343317 - protein, 9 aa, Homo Sapiens
LPNTVLPPS

SEQ ID NO: 343318 - protein, 9 aa, Homo Sapiens
FSHAPSSNF

SEQ ID NO: 343319 - protein, 9 aa, Homo Sapiens
EFWNPSIYE

SEQ ID NO: 343320 - protein, 9 aa, Homo Sapiens
KVMLKNIKT

SEQ ID NO: 343321 - protein, 9 aa, Homo Sapiens
TAYGFVKLF

SEQ ID NO: 343322 - protein, 9 aa, Homo Sapiens
LTPDIYLSD

SEQ ID NO: 343323 - protein, 9 aa, Homo Sapiens
HQTQVLKKR

SEQ ID NO: 343324 - protein, 9 aa, Homo Sapiens
KYLSQEFGM

SEQ ID NO: 343325 - protein, 9 aa, Homo Sapiens
VLQSEKETR

SEQ ID NO: 343326 - protein, 9 aa, Homo Sapiens
GSSVLQVSV

SEQ ID NO: 343327 - protein, 9 aa, Homo Sapiens
VFREELGAQ

SEQ ID NO: 343328 - protein, 9 aa, Homo Sapiens
VSRVASPKN

SEQ ID NO: 343329 - protein, 9 aa, Homo Sapiens
AEKCVSVAQ

SEQ ID NO: 343330 - protein, 9 aa, Homo Sapiens
VKSSKENWK

SEQ ID NO: 343331 - protein, 9 aa, Homo Sapiens
KEGKIIKVY

SEQ ID NO: 343332 - protein, 9 aa, Homo Sapiens
EKESKQLKI

SEQ ID NO: 343333 - protein, 9 aa, Homo Sapiens
IQRGHLRDD

SEQ ID NO: 343334 - protein, 9 aa, Homo Sapiens
ETLPEEDVT

SEQ ID NO: 343335 - protein, 9 aa, Homo Sapiens
SAYDGEYAQ

SEQ ID NO: 343336 - protein, 9 aa, Homo Sapiens
DDNPKESSP

SEQ ID NO: 343337 - protein, 9 aa, Homo Sapiens
STLSVIATP

SEQ ID NO: 343338 - protein, 9 aa, Homo Sapiens
CANGLCKNG

SEQ ID NO: 343339 - protein, 9 aa, Homo Sapiens
TRSLKYFSS

SEQ ID NO: 343340 - protein, 9 aa, Homo Sapiens
QNCYGSEQE

SEQ ID NO: 343341 - protein, 9 aa, Homo Sapiens
GDKPFQCNE

SEQ ID NO: 343342 - protein, 9 aa, Homo Sapiens
LEKQCLKML

SEQ ID NO: 343343 - protein, 9 aa, Homo Sapiens
GCQRQGAVV

SEQ ID NO: 343344 - protein, 9 aa, Homo Sapiens
PAGYVPIQT

SEQ ID NO: 343345 - protein, 9 aa, Homo Sapiens
KERLMNYFS

SEQ ID NO: 343346 - protein, 9 aa, Homo Sapiens
RGLSLNDDL

SEQ ID NO: 343347 - protein, 9 aa, Homo Sapiens
REFVLRFPD

SEQ ID NO: 343348 - protein, 9 aa, Homo Sapiens
VKYKRNFEE

SEQ ID NO: 343349 - protein, 9 aa, Homo Sapiens
QHFEKRRKP

SEQ ID NO: 343350 - protein, 9 aa, Homo Sapiens
SAKNGTYFQ

SEQ ID NO: 343351 - protein, 9 aa, Homo Sapiens
GHLRDDIKE

SEQ ID NO: 343352 - protein, 9 aa, Homo Sapiens
GHLALIIII

SEQ ID NO: 343353 - protein, 9 aa, Homo Sapiens
YKSFEFFIP

SEQ ID NO: 343354 - protein, 9 aa, Homo Sapiens
SGVLAGGWQ

SEQ ID NO: 343355 - protein, 9 aa, Homo Sapiens
AASSVSTGH

SEQ ID NO: 343356 - protein, 9 aa, Homo Sapiens
QLGLHQKAH

SEQ ID NO: 343357 - protein, 9 aa, Homo Sapiens
LYVTCLQNW

SEQ ID NO: 343358 - protein, 9 aa, Homo Sapiens
IGFKAENSY

SEQ ID NO: 343359 - protein, 9 aa, Homo Sapiens
EEIEACTAG

SEQ ID NO: 343360 - protein, 9 aa, Homo Sapiens
TVLDKCQLM

SEQ ID NO: 343361 - protein, 9 aa, Homo Sapiens
LGAQQQKQL

SEQ ID NO: 343362 - protein, 9 aa, Homo Sapiens
SDRRGAELV

SEQ ID NO: 343363 - protein, 9 aa, Homo Sapiens
FFMTATQHF

SEQ ID NO: 343364 - protein, 9 aa, Homo Sapiens
QHQIIHSGE

SEQ ID NO: 343365 - protein, 9 aa, Homo Sapiens
TANLIAFLA

SEQ ID NO: 343366 - protein, 9 aa, Homo Sapiens
RWAFRGPKN

SEQ ID NO: 343367 - protein, 9 aa, Homo Sapiens
SENKCIHTS

SEQ ID NO: 343368 - protein, 9 aa, Homo Sapiens
LIPRYVRDL

SEQ ID NO: 343369 - protein, 9 aa, Homo Sapiens
ALLPGEWLP

SEQ ID NO: 343370 - protein, 9 aa, Homo Sapiens
TISWTDWGN

SEQ ID NO: 343371 - protein, 9 aa, Homo Sapiens
HNCSENKPP

SEQ ID NO: 343372 - protein, 9 aa, Homo Sapiens
HKILCKLSL

SEQ ID NO: 343373 - protein, 9 aa, Homo Sapiens
LWQICRGNV

SEQ ID NO: 343374 - protein, 9 aa, Homo Sapiens
FSFHLFEDS

SEQ ID NO: 343375 - protein, 9 aa, Homo Sapiens
KAISESELS

SEQ ID NO: 343376 - protein, 9 aa, Homo Sapiens
EGGDESGGE

SEQ ID NO: 343377 - protein, 9 aa, Homo Sapiens
FVNGKEMKN

SEQ ID NO: 343378 - protein, 9 aa, Homo Sapiens
LATLFSTLT

SEQ ID NO: 343379 - protein, 9 aa, Homo Sapiens
EERYDTPKR

SEQ ID NO: 343380 - protein, 9 aa, Homo Sapiens
TDLLNCFLA

SEQ ID NO: 343381 - protein, 9 aa, Homo Sapiens
IKLKLSNIA

SEQ ID NO: 343382 - protein, 9 aa, Homo Sapiens
DDSRWCSQV

SEQ ID NO: 343383 - protein, 9 aa, Homo Sapiens
DHGPQSFIH

SEQ ID NO: 343384 - protein, 9 aa, Homo Sapiens
LVKLKYRKV

SEQ ID NO: 343385 - protein, 9 aa, Homo Sapiens
WCSQVKLGS

SEQ ID NO: 343386 - protein, 9 aa, Homo Sapiens
CHPTVKNRR

SEQ ID NO: 343387 - protein, 9 aa, Homo Sapiens
PSKWSKDYW

SEQ ID NO: 343388 - protein, 9 aa, Homo Sapiens
AERIKLLFF

SEQ ID NO: 343389 - protein, 9 aa, Homo Sapiens
LECGKDGPK

SEQ ID NO: 343390 - protein, 9 aa, Homo Sapiens
CCAKFFELS

SEQ ID NO: 343391 - protein, 9 aa, Homo Sapiens
YSKLKYHPE

SEQ ID NO: 343392 - protein, 9 aa, Homo Sapiens
DILHQWRQR

SEQ ID NO: 343393 - protein, 9 aa, Homo Sapiens
LSLETRVDL

SEQ ID NO: 343394 - protein, 9 aa, Homo Sapiens
VSELDIMFT

SEQ ID NO: 343395 - protein, 9 aa, Homo Sapiens
GLLQQLKEN

SEQ ID NO: 343396 - protein, 9 aa, Homo Sapiens
LTTFMHANK

SEQ ID NO: 343397 - protein, 9 aa, Homo Sapiens
TQVLGKKIK

SEQ ID NO: 343398 - protein, 9 aa, Homo Sapiens
ESPKLTSSS

SEQ ID NO: 343399 - protein, 9 aa, Homo Sapiens
SLLNLSLMN

SEQ ID NO: 343400 - protein, 9 aa, Homo Sapiens
FSLQLLSET

SEQ ID NO: 343401 - protein, 9 aa, Homo Sapiens
AICTGTKTG

SEQ ID NO: 343402 - protein, 9 aa, Homo Sapiens
WPSLRLHRK

SEQ ID NO: 343403 - protein, 9 aa, Homo Sapiens
TEAADYIIN

SEQ ID NO: 343404 - protein, 9 aa, Homo Sapiens
YFLKLYAYA

SEQ ID NO: 343405 - protein, 9 aa, Homo Sapiens
KDRSPRANL

SEQ ID NO: 343406 - protein, 9 aa, Homo Sapiens
LPGTSWSPP

SEQ ID NO: 343407 - protein, 9 aa, Homo Sapiens
ARRQAFNTE

SEQ ID NO: 343408 - protein, 9 aa, Homo Sapiens
SSTQMVVHD

SEQ ID NO: 343409 - protein, 9 aa, Homo Sapiens
DGDKRKKRR

SEQ ID NO: 343410 - protein, 9 aa, Homo Sapiens
KPYSPISNI

SEQ ID NO: 343411 - protein, 9 aa, Homo Sapiens
PEFELVLWN

SEQ ID NO: 343412 - protein, 9 aa, Homo Sapiens
LPVVKVLSS

SEQ ID NO: 343413 - protein, 9 aa, Homo Sapiens
ANSKNKEKL

SEQ ID NO: 343414 - protein, 9 aa, Homo Sapiens
YSLEEERIW

SEQ ID NO: 343415 - protein, 9 aa, Homo Sapiens
KLDFLMFNC

SEQ ID NO: 343416 - protein, 9 aa, Homo Sapiens
IHNRVALGV

SEQ ID NO: 343417 - protein, 9 aa, Homo Sapiens
KTLMRKNPL

SEQ ID NO: 343418 - protein, 9 aa, Homo Sapiens
DLNKENKIT

SEQ ID NO: 343419 - protein, 9 aa, Homo Sapiens
LLWSEVEAE

SEQ ID NO: 343420 - protein, 9 aa, Homo Sapiens
NETDVFWKS

SEQ ID NO: 343421 - protein, 9 aa, Homo Sapiens
VEIYGLDFV

SEQ ID NO: 343422 - protein, 9 aa, Homo Sapiens
AATTPAKKT

SEQ ID NO: 343423 - protein, 9 aa, Homo Sapiens
ITQSFCIIF

SEQ ID NO: 343424 - protein, 9 aa, Homo Sapiens
VLCLQLGVN

SEQ ID NO: 343425 - protein, 9 aa, Homo Sapiens
QIVEEADVD

SEQ ID NO: 343426 - protein, 9 aa, Homo Sapiens
GSVKSERIN

SEQ ID NO: 343427 - protein, 9 aa, Homo Sapiens
REIYDHYGR

SEQ ID NO: 343428 - protein, 9 aa, Homo Sapiens
LLARINNFM

SEQ ID NO: 343429 - protein, 9 aa, Homo Sapiens
LLTIMGYDR

SEQ ID NO: 343430 - protein, 9 aa, Homo Sapiens
SCSYLHKAS

SEQ ID NO: 343431 - protein, 9 aa, Homo Sapiens
HKALSIIVD

SEQ ID NO: 343432 - protein, 9 aa, Homo Sapiens
TCDNVLWAG

SEQ ID NO: 343433 - protein, 9 aa, Homo Sapiens
EPESECIIK

SEQ ID NO: 343434 - protein, 9 aa, Homo Sapiens
WNRVCGHSS

SEQ ID NO: 343435 - protein, 9 aa, Homo Sapiens
LASAVVRIM

SEQ ID NO: 343436 - protein, 9 aa, Homo Sapiens
FCHSSSFRR

SEQ ID NO: 343437 - protein, 9 aa, Homo Sapiens
DGAKGDPGP

SEQ ID NO: 343438 - protein, 9 aa, Homo Sapiens
GRERTQAST

SEQ ID NO: 343439 - protein, 9 aa, Homo Sapiens
HVCGRCCAK

SEQ ID NO: 343440 - protein, 9 aa, Homo Sapiens
STDQRDKLE

SEQ ID NO: 343441 - protein, 9 aa, Homo Sapiens
RMEESQNKS

SEQ ID NO: 343442 - protein, 9 aa, Homo Sapiens
RPCPGASQS

SEQ ID NO: 343443 - protein, 9 aa, Homo Sapiens
LLFLFSWML

SEQ ID NO: 343444 - protein, 9 aa, Homo Sapiens
LNLQDHQLS

SEQ ID NO: 343445 - protein, 9 aa, Homo Sapiens
DLKHNKLPL

SEQ ID NO: 343446 - protein, 9 aa, Homo Sapiens
VPKVGCSNW

SEQ ID NO: 343447 - protein, 9 aa, Homo Sapiens
SRDSRSSSE

SEQ ID NO: 343448 - protein, 9 aa, Homo Sapiens
VLKLIKGSN

SEQ ID NO: 343449 - protein, 9 aa, Homo Sapiens
CGSLPFSPC

SEQ ID NO: 343450 - protein, 9 aa, Homo Sapiens
LRDLLIQIS

SEQ ID NO: 343451 - protein, 9 aa, Homo Sapiens
ACTRKFHFF

SEQ ID NO: 343452 - protein, 9 aa, Homo Sapiens
DVTPDNGPS

SEQ ID NO: 343453 - protein, 9 aa, Homo Sapiens
AVNLRPGDN

SEQ ID NO: 343454 - protein, 9 aa, Homo Sapiens
TSDKKDSAS

SEQ ID NO: 343455 - protein, 9 aa, Homo Sapiens
QFRALWSSG

SEQ ID NO: 343456 - protein, 9 aa, Homo Sapiens
CQKVEATGV

SEQ ID NO: 343457 - protein, 9 aa, Homo Sapiens
VEAPPNRQT

SEQ ID NO: 343458 - protein, 9 aa, Homo Sapiens
VQTDCTHTG

SEQ ID NO: 343459 - protein, 9 aa, Homo Sapiens
EIGSQDGPQ

SEQ ID NO: 343460 - protein, 9 aa, Homo Sapiens
KMKTTTNIY

SEQ ID NO: 343461 - protein, 9 aa, Homo Sapiens
AIVCWSVLK

SEQ ID NO: 343462 - protein, 9 aa, Homo Sapiens
KQIYQSSSD

SEQ ID NO: 343463 - protein, 9 aa, Homo Sapiens
FGHSKCLLL

SEQ ID NO: 343464 - protein, 9 aa, Homo Sapiens
CLRPACGRV

SEQ ID NO: 343465 - protein, 9 aa, Homo Sapiens
LEVRPTCFE

SEQ ID NO: 343466 - protein, 9 aa, Homo Sapiens
YFEKVTLRR

SEQ ID NO: 343467 - protein, 9 aa, Homo Sapiens
FWLPEPVPS

SEQ ID NO: 343468 - protein, 9 aa, Homo Sapiens
ALSTNLLGS

SEQ ID NO: 343469 - protein, 9 aa, Homo Sapiens
DSKKKELCR

SEQ ID NO: 343470 - protein, 9 aa, Homo Sapiens
FYAHPEWEQ

SEQ ID NO: 343471 - protein, 9 aa, Homo Sapiens
AEKEVTELY

SEQ ID NO: 343472 - protein, 9 aa, Homo Sapiens
WLQKKRRIQ

SEQ ID NO: 343473 - protein, 9 aa, Homo Sapiens
DCPPKRKDK

SEQ ID NO: 343474 - protein, 9 aa, Homo Sapiens
AENARSCIQ

SEQ ID NO: 343475 - protein, 9 aa, Homo Sapiens
TRSILTYSQ

SEQ ID NO: 343476 - protein, 9 aa, Homo Sapiens
YEMQNAVND

SEQ ID NO: 343477 - protein, 9 aa, Homo Sapiens
GDCSNLEGA

SEQ ID NO: 343478 - protein, 9 aa, Homo Sapiens
ADVAIKHRN

SEQ ID NO: 343479 - protein, 9 aa, Homo Sapiens
EYQWIDRIH

SEQ ID NO: 343480 - protein, 9 aa, Homo Sapiens
VSDDSSLSD

SEQ ID NO: 343481 - protein, 9 aa, Homo Sapiens
IDALTEQLQ

SEQ ID NO: 343482 - protein, 9 aa, Homo Sapiens
GGADTQVLS

SEQ ID NO: 343483 - protein, 9 aa, Homo Sapiens
KDTWSGCIM

SEQ ID NO: 343484 - protein, 9 aa, Homo Sapiens
KKGKDHKSN

SEQ ID NO: 343485 - protein, 9 aa, Homo Sapiens
SISELSAQL

SEQ ID NO: 343486 - protein, 9 aa, Homo Sapiens
PNNSIFCSP

SEQ ID NO: 343487 - protein, 9 aa, Homo Sapiens
SFNCSSSFQ

SEQ ID NO: 343488 - protein, 9 aa, Homo Sapiens
ISAYDGEYA

SEQ ID NO: 343489 - protein, 9 aa, Homo Sapiens
VDERQRASE

SEQ ID NO: 343490 - protein, 9 aa, Homo Sapiens
HRRVLAQLD

SEQ ID NO: 343491 - protein, 9 aa, Homo Sapiens
LELQSDMYI

SEQ ID NO: 343492 - protein, 9 aa, Homo Sapiens
GQTQAAQAL

SEQ ID NO: 343493 - protein, 9 aa, Homo Sapiens
KYENGEFSF

SEQ ID NO: 343494 - protein, 9 aa, Homo Sapiens
TRVVFGELP

SEQ ID NO: 343495 - protein, 9 aa, Homo Sapiens
EDKRPEGPG

SEQ ID NO: 343496 - protein, 9 aa, Homo Sapiens
HIIIIFGTD

SEQ ID NO: 343497 - protein, 9 aa, Homo Sapiens
FQNFMQELM

SEQ ID NO: 343498 - protein, 9 aa, Homo Sapiens
LVAEEEEDK

SEQ ID NO: 343499 - protein, 9 aa, Homo Sapiens
GVLRHTGNG

SEQ ID NO: 343500 - protein, 9 aa, Homo Sapiens
GSLYDPSPW

SEQ ID NO: 343501 - protein, 9 aa, Homo Sapiens
AFWWTNRNG

SEQ ID NO: 343502 - protein, 9 aa, Homo Sapiens
YEKYCANHF

SEQ ID NO: 343503 - protein, 9 aa, Homo Sapiens
ARKFKPDVK

SEQ ID NO: 343504 - protein, 9 aa, Homo Sapiens
KITDDSRWC

SEQ ID NO: 343505 - protein, 9 aa, Homo Sapiens
LMEHIQEIQ

SEQ ID NO: 343506 - protein, 9 aa, Homo Sapiens
SHTDVCQGS

SEQ ID NO: 343507 - protein, 9 aa, Homo Sapiens
ESQWDDGKG

SEQ ID NO: 343508 - protein, 9 aa, Homo Sapiens
KWWSATVVY

SEQ ID NO: 343509 - protein, 9 aa, Homo Sapiens
TLELGWLCP

SEQ ID NO: 343510 - protein, 9 aa, Homo Sapiens
STSNMGSYK

SEQ ID NO: 343511 - protein, 9 aa, Homo Sapiens
SAQVEQLCQ

SEQ ID NO: 343512 - protein, 9 aa, Homo Sapiens
QGAGFRGLS

SEQ ID NO: 343513 - protein, 9 aa, Homo Sapiens
QQTPSQTHK

SEQ ID NO: 343514 - protein, 9 aa, Homo Sapiens
NKMEEIVRS

SEQ ID NO: 343515 - protein, 9 aa, Homo Sapiens
LLLFWCLHF

SEQ ID NO: 343516 - protein, 9 aa, Homo Sapiens
HSFQIHEIT

SEQ ID NO: 343517 - protein, 9 aa, Homo Sapiens
NAFKASDSV

SEQ ID NO: 343518 - protein, 9 aa, Homo Sapiens
FCKESFTGP

SEQ ID NO: 343519 - protein, 9 aa, Homo Sapiens
TRHHLGSRH

SEQ ID NO: 343520 - protein, 9 aa, Homo Sapiens
LIKDIWENG

SEQ ID NO: 343521 - protein, 9 aa, Homo Sapiens
GLISIFCFA

SEQ ID NO: 343522 - protein, 9 aa, Homo Sapiens
KMALTSFMK

SEQ ID NO: 343523 - protein, 9 aa, Homo Sapiens
DAEEEIKIP

SEQ ID NO: 343524 - protein, 9 aa, Homo Sapiens
DGKTTHHNY

SEQ ID NO: 343525 - protein, 9 aa, Homo Sapiens
IQFEEVIQE

SEQ ID NO: 343526 - protein, 9 aa, Homo Sapiens
TMRMLKSEE

SEQ ID NO: 343527 - protein, 9 aa, Homo Sapiens
WGDVNRQIS

SEQ ID NO: 343528 - protein, 9 aa, Homo Sapiens
KLLKQKLQE

SEQ ID NO: 343529 - protein, 9 aa, Homo Sapiens
QGNVFPITS

SEQ ID NO: 343530 - protein, 9 aa, Homo Sapiens
LLQNQVAHV

SEQ ID NO: 343531 - protein, 9 aa, Homo Sapiens
VQIVEEVTQ

SEQ ID NO: 343532 - protein, 9 aa, Homo Sapiens
MDRLSNDSI

SEQ ID NO: 343533 - protein, 9 aa, Homo Sapiens
ELQTEGRTQ

SEQ ID NO: 343534 - protein, 9 aa, Homo Sapiens
DLADDLAKQ

SEQ ID NO: 343535 - protein, 9 aa, Homo Sapiens
QNAISSSYS

SEQ ID NO: 343536 - protein, 9 aa, Homo Sapiens
ALHSSEFLP

SEQ ID NO: 343537 - protein, 9 aa, Homo Sapiens
TISFVMKFF

SEQ ID NO: 343538 - protein, 9 aa, Homo Sapiens
ALSTFEESV

SEQ ID NO: 343539 - protein, 9 aa, Homo Sapiens
HHIKNVYAF

SEQ ID NO: 343540 - protein, 9 aa, Homo Sapiens
CHILHVSRE

SEQ ID NO: 343541 - protein, 9 aa, Homo Sapiens
FSAFQQIGE

SEQ ID NO: 343542 - protein, 9 aa, Homo Sapiens
IKDSISHET

SEQ ID NO: 343543 - protein, 9 aa, Homo Sapiens
KDLPAMSRL

SEQ ID NO: 343544 - protein, 9 aa, Homo Sapiens
FQKDFMRPF

SEQ ID NO: 343545 - protein, 9 aa, Homo Sapiens
FTATRNEIL

SEQ ID NO: 343546 - protein, 9 aa, Homo Sapiens
KAKAEAIQI

SEQ ID NO: 343547 - protein, 9 aa, Homo Sapiens
YILTIKANT

SEQ ID NO: 343548 - protein, 9 aa, Homo Sapiens
DGGTLVQAE

SEQ ID NO: 343549 - protein, 9 aa, Homo Sapiens
AFHTFLKTE

SEQ ID NO: 343550 - protein, 9 aa, Homo Sapiens
TAGTSSDLM

SEQ ID NO: 343551 - protein, 9 aa, Homo Sapiens
DNSRVRLQT

SEQ ID NO: 343552 - protein, 9 aa, Homo Sapiens
PRAKQKTHE

SEQ ID NO: 343553 - protein, 9 aa, Homo Sapiens
CVEPFTTLH

SEQ ID NO: 343554 - protein, 9 aa, Homo Sapiens
KGLELDIIP

SEQ ID NO: 343555 - protein, 9 aa, Homo Sapiens
DVDSVLVLQ

SEQ ID NO: 343556 - protein, 9 aa, Homo Sapiens
FWTVIFTLT

SEQ ID NO: 343557 - protein, 9 aa, Homo Sapiens
LFWGVLLAA

SEQ ID NO: 343558 - protein, 9 aa, Homo Sapiens
PTYLQQAQS

SEQ ID NO: 343559 - protein, 9 aa, Homo Sapiens
CNECGRYFA

SEQ ID NO: 343560 - protein, 9 aa, Homo Sapiens
KCKDTWSGC

SEQ ID NO: 343561 - protein, 9 aa, Homo Sapiens
SSKYPDFHD

SEQ ID NO: 343562 - protein, 9 aa, Homo Sapiens
FSFENVKVF

SEQ ID NO: 343563 - protein, 9 aa, Homo Sapiens
LLITITLGT

SEQ ID NO: 343564 - protein, 9 aa, Homo Sapiens
ELRPEEIKE

SEQ ID NO: 343565 - protein, 9 aa, Homo Sapiens
IQREYLNIS

SEQ ID NO: 343566 - protein, 9 aa, Homo Sapiens
AWNETLLDK

SEQ ID NO: 343567 - protein, 9 aa, Homo Sapiens
GGDNDKLGH

SEQ ID NO: 343568 - protein, 9 aa, Homo Sapiens
RASDQSEFR

SEQ ID NO: 343569 - protein, 9 aa, Homo Sapiens
FPDRCVVCV

SEQ ID NO: 343570 - protein, 9 aa, Homo Sapiens
KTVVLLTEL

SEQ ID NO: 343571 - protein, 9 aa, Homo Sapiens
TLLLTLIDI

SEQ ID NO: 343572 - protein, 9 aa, Homo Sapiens
IEIQNCQKI

SEQ ID NO: 343573 - protein, 9 aa, Homo Sapiens
SRRDRSKNK

SEQ ID NO: 343574 - protein, 9 aa, Homo Sapiens
SPALRGHTK

SEQ ID NO: 343575 - protein, 9 aa, Homo Sapiens
LESSQNSDL

SEQ ID NO: 343576 - protein, 9 aa, Homo Sapiens
KSFLSELGV

SEQ ID NO: 343577 - protein, 9 aa, Homo Sapiens
KRQKRNNRR

SEQ ID NO: 343578 - protein, 9 aa, Homo Sapiens
EVNINGESR

SEQ ID NO: 343579 - protein, 9 aa, Homo Sapiens
ICEITWECV

SEQ ID NO: 343580 - protein, 9 aa, Homo Sapiens
EQLVPVDGI

SEQ ID NO: 343581 - protein, 9 aa, Homo Sapiens
AFSDKRTSQ

SEQ ID NO: 343582 - protein, 9 aa, Homo Sapiens
KQVERMLGN

SEQ ID NO: 343583 - protein, 9 aa, Homo Sapiens
ALNKSRKFN

SEQ ID NO: 343584 - protein, 9 aa, Homo Sapiens
DGEWYNVDF

SEQ ID NO: 343585 - protein, 9 aa, Homo Sapiens
IPKDNEARK

SEQ ID NO: 343586 - protein, 9 aa, Homo Sapiens
VKRLEYLVK

SEQ ID NO: 343587 - protein, 9 aa, Homo Sapiens
TCSHGNYLF

SEQ ID NO: 343588 - protein, 9 aa, Homo Sapiens
SFTGPIPLH

SEQ ID NO: 343589 - protein, 9 aa, Homo Sapiens
WCLHFVNNS

SEQ ID NO: 343590 - protein, 9 aa, Homo Sapiens
RCSALLSDC

SEQ ID NO: 343591 - protein, 9 aa, Homo Sapiens
LYQKEIKPP

SEQ ID NO: 343592 - protein, 9 aa, Homo Sapiens
KNKQKSTKK

SEQ ID NO: 343593 - protein, 9 aa, Homo Sapiens
DKSNGFVCP

SEQ ID NO: 343594 - protein, 9 aa, Homo Sapiens
LSNTAVYYC

SEQ ID NO: 343595 - protein, 9 aa, Homo Sapiens
EEIATQFQL

SEQ ID NO: 343596 - protein, 9 aa, Homo Sapiens
TRLQRVIDR

SEQ ID NO: 343597 - protein, 9 aa, Homo Sapiens
WEVGVHGIQ

SEQ ID NO: 343598 - protein, 9 aa, Homo Sapiens
SMFTGEEKI

SEQ ID NO: 343599 - protein, 9 aa, Homo Sapiens
VQTLHKVKR

SEQ ID NO: 343600 - protein, 9 aa, Homo Sapiens
NTLILLDVS

SEQ ID NO: 343601 - protein, 9 aa, Homo Sapiens
LVNSSLERT

SEQ ID NO: 343602 - protein, 9 aa, Homo Sapiens
EDEIEHLQN

SEQ ID NO: 343603 - protein, 9 aa, Homo Sapiens
THTGEKLFK

SEQ ID NO: 343604 - protein, 9 aa, Homo Sapiens
NVVKELELA

SEQ ID NO: 343605 - protein, 9 aa, Homo Sapiens
GPQHYPMAF

SEQ ID NO: 343606 - protein, 9 aa, Homo Sapiens
LRRFFLRIR

SEQ ID NO: 343607 - protein, 9 aa, Homo Sapiens
FLLFDSEKI

SEQ ID NO: 343608 - protein, 9 aa, Homo Sapiens
QSFEILTEQ

SEQ ID NO: 343609 - protein, 9 aa, Homo Sapiens
KYFYSFYVC

SEQ ID NO: 343610 - protein, 9 aa, Homo Sapiens
AKFRFLNKL

SEQ ID NO: 343611 - protein, 9 aa, Homo Sapiens
HPSDFQCGP

SEQ ID NO: 343612 - protein, 9 aa, Homo Sapiens
SLIHHQIIH

SEQ ID NO: 343613 - protein, 9 aa, Homo Sapiens
NISGCMQKV

SEQ ID NO: 343614 - protein, 9 aa, Homo Sapiens
VGFEACYVW

SEQ ID NO: 343615 - protein, 9 aa, Homo Sapiens
QLFARLLFN

SEQ ID NO: 343616 - protein, 9 aa, Homo Sapiens
NSYSTSSKK

SEQ ID NO: 343617 - protein, 9 aa, Homo Sapiens
LFNMCGISE

SEQ ID NO: 343618 - protein, 9 aa, Homo Sapiens
RSNISAYDG

SEQ ID NO: 343619 - protein, 9 aa, Homo Sapiens
SKENDLSVI

SEQ ID NO: 343620 - protein, 9 aa, Homo Sapiens
LDCHKKDCP

SEQ ID NO: 343621 - protein, 9 aa, Homo Sapiens
PGFQFSQAL

SEQ ID NO: 343622 - protein, 9 aa, Homo Sapiens
AENSYLTKL

SEQ ID NO: 343623 - protein, 9 aa, Homo Sapiens
GNIYPTSKL

SEQ ID NO: 343624 - protein, 9 aa, Homo Sapiens
FFSFSFFYF

SEQ ID NO: 343625 - protein, 9 aa, Homo Sapiens
PHNYFCKCG

SEQ ID NO: 343626 - protein, 9 aa, Homo Sapiens
PFHTPLKKN

SEQ ID NO: 343627 - protein, 9 aa, Homo Sapiens
VRFLDKKHQ

SEQ ID NO: 343628 - protein, 9 aa, Homo Sapiens
KSCMNVNNV

SEQ ID NO: 343629 - protein, 9 aa, Homo Sapiens
TDKKDSDRL

SEQ ID NO: 343630 - protein, 9 aa, Homo Sapiens
ELHNCIQKT

SEQ ID NO: 343631 - protein, 9 aa, Homo Sapiens
EDKKANLQV

SEQ ID NO: 343632 - protein, 9 aa, Homo Sapiens
TRRYVCKFV

SEQ ID NO: 343633 - protein, 9 aa, Homo Sapiens
LKAREKSQV

SEQ ID NO: 343634 - protein, 9 aa, Homo Sapiens
SSSGNDTTE

SEQ ID NO: 343635 - protein, 9 aa, Homo Sapiens
KRDEHPAKC

SEQ ID NO: 343636 - protein, 9 aa, Homo Sapiens
ENEEVFKVN

SEQ ID NO: 343637 - protein, 9 aa, Homo Sapiens
SRTVTVSHH

SEQ ID NO: 343638 - protein, 9 aa, Homo Sapiens
HKLSPGVFE

SEQ ID NO: 343639 - protein, 9 aa, Homo Sapiens
RPSFNGILY

SEQ ID NO: 343640 - protein, 9 aa, Homo Sapiens
LCLEVRPTC

SEQ ID NO: 343641 - protein, 9 aa, Homo Sapiens
CALSTNLLG

SEQ ID NO: 343642 - protein, 9 aa, Homo Sapiens
HRGAIGLHI

SEQ ID NO: 343643 - protein, 9 aa, Homo Sapiens
VHQRGTMGE

SEQ ID NO: 343644 - protein, 9 aa, Homo Sapiens
LAVEYNIFE

SEQ ID NO: 343645 - protein, 9 aa, Homo Sapiens
HLQNELRET

SEQ ID NO: 343646 - protein, 9 aa, Homo Sapiens
FQRVREEEI

SEQ ID NO: 343647 - protein, 9 aa, Homo Sapiens
VLLASEGAQ

SEQ ID NO: 343648 - protein, 9 aa, Homo Sapiens
LSLLQLASP

SEQ ID NO: 343649 - protein, 9 aa, Homo Sapiens
LTVIWCPQD

SEQ ID NO: 343650 - protein, 9 aa, Homo Sapiens
LGLHQKAHR

SEQ ID NO: 343651 - protein, 9 aa, Homo Sapiens
CGPPSGMIE

SEQ ID NO: 343652 - protein, 9 aa, Homo Sapiens
APLVPEDLR

SEQ ID NO: 343653 - protein, 9 aa, Homo Sapiens
GLWGIEDML

SEQ ID NO: 343654 - protein, 9 aa, Homo Sapiens
ELKDRKASA

SEQ ID NO: 343655 - protein, 9 aa, Homo Sapiens
KGEKGKCGI

SEQ ID NO: 343656 - protein, 9 aa, Homo Sapiens
DVEEGKMGD

SEQ ID NO: 343657 - protein, 9 aa, Homo Sapiens
LGVASYIES

SEQ ID NO: 343658 - protein, 9 aa, Homo Sapiens
QKHLKMAEE

SEQ ID NO: 343659 - protein, 9 aa, Homo Sapiens
SSQKMEYFS

SEQ ID NO: 343660 - protein, 9 aa, Homo Sapiens
APSEKSNEE

SEQ ID NO: 343661 - protein, 9 aa, Homo Sapiens
WLARKICSD

SEQ ID NO: 343662 - protein, 9 aa, Homo Sapiens
TYTSLTALS

SEQ ID NO: 343663 - protein, 9 aa, Homo Sapiens
IDDFVQLSR

SEQ ID NO: 343664 - protein, 9 aa, Homo Sapiens
STQHLQIEK

SEQ ID NO: 343665 - protein, 9 aa, Homo Sapiens
LLKQRVSNV

SEQ ID NO: 343666 - protein, 9 aa, Homo Sapiens
QQIHTSEST

SEQ ID NO: 343667 - protein, 9 aa, Homo Sapiens
VNTERSEET

SEQ ID NO: 343668 - protein, 9 aa, Homo Sapiens
LRNQLGQQF

SEQ ID NO: 343669 - protein, 9 aa, Homo Sapiens
NWENIQNLE

SEQ ID NO: 343670 - protein, 9 aa, Homo Sapiens
EENQATKDK

SEQ ID NO: 343671 - protein, 9 aa, Homo Sapiens
LAYFSFLPQ

SEQ ID NO: 343672 - protein, 9 aa, Homo Sapiens
VDGVSEEFW

SEQ ID NO: 343673 - protein, 9 aa, Homo Sapiens
GKWCHVDFQ

SEQ ID NO: 343674 - protein, 9 aa, Homo Sapiens
NGFKIHYAS

SEQ ID NO: 343675 - protein, 9 aa, Homo Sapiens
ILNRFQKAV

SEQ ID NO: 343676 - protein, 9 aa, Homo Sapiens
AEKEQKLLK

SEQ ID NO: 343677 - protein, 9 aa, Homo Sapiens
RSWRINMVQ

SEQ ID NO: 343678 - protein, 9 aa, Homo Sapiens
AQENKVDFI

SEQ ID NO: 343679 - protein, 9 aa, Homo Sapiens
PTEGPTDAL

SEQ ID NO: 343680 - protein, 9 aa, Homo Sapiens
IIAEPEWVM

SEQ ID NO: 343681 - protein, 9 aa, Homo Sapiens
SYITALDLY

SEQ ID NO: 343682 - protein, 9 aa, Homo Sapiens
GWEADLRNP

SEQ ID NO: 343683 - protein, 9 aa, Homo Sapiens
KMSTVHKIL

SEQ ID NO: 343684 - protein, 9 aa, Homo Sapiens
EQKLLKQKL

SEQ ID NO: 343685 - protein, 9 aa, Homo Sapiens
ESVSPENNK

SEQ ID NO: 343686 - protein, 9 aa, Homo Sapiens
TLSPQPQGQ

SEQ ID NO: 343687 - protein, 9 aa, Homo Sapiens
EQQHQDKVL

SEQ ID NO: 343688 - protein, 9 aa, Homo Sapiens
HSERFCLGL

SEQ ID NO: 343689 - protein, 9 aa, Homo Sapiens
PLVLVSPPR

SEQ ID NO: 343690 - protein, 9 aa, Homo Sapiens
LVALAMALM

SEQ ID NO: 343691 - protein, 9 aa, Homo Sapiens
LSEMASAQL

SEQ ID NO: 343692 - protein, 9 aa, Homo Sapiens
KSYSYFPIP

SEQ ID NO: 343693 - protein, 9 aa, Homo Sapiens
SSDISLDKQ

SEQ ID NO: 343694 - protein, 9 aa, Homo Sapiens
TNGGADKKS

SEQ ID NO: 343695 - protein, 9 aa, Homo Sapiens
CRHPLVYVV

SEQ ID NO: 343696 - protein, 9 aa, Homo Sapiens
IKYPDNFFL

SEQ ID NO: 343697 - protein, 9 aa, Homo Sapiens
LTIHQIIHT

SEQ ID NO: 343698 - protein, 9 aa, Homo Sapiens
QSSQEYDGN

SEQ ID NO: 343699 - protein, 9 aa, Homo Sapiens
GINVTTTVS

SEQ ID NO: 343700 - protein, 9 aa, Homo Sapiens
VYCSFGNHS

SEQ ID NO: 343701 - protein, 9 aa, Homo Sapiens
IVGYLLFKD

SEQ ID NO: 343702 - protein, 9 aa, Homo Sapiens
KHIQQAHCS

SEQ ID NO: 343703 - protein, 9 aa, Homo Sapiens
GRYYCKVEN

SEQ ID NO: 343704 - protein, 9 aa, Homo Sapiens
KVSCHPFSD

SEQ ID NO: 343705 - protein, 9 aa, Homo Sapiens
WWQSQDLAP

SEQ ID NO: 343706 - protein, 9 aa, Homo Sapiens
DGKWCHVDF

SEQ ID NO: 343707 - protein, 9 aa, Homo Sapiens
KSTPEISER

SEQ ID NO: 343708 - protein, 9 aa, Homo Sapiens
QCASCNEPL

SEQ ID NO: 343709 - protein, 9 aa, Homo Sapiens
ICSHFAQDI

SEQ ID NO: 343710 - protein, 9 aa, Homo Sapiens
AWEELDGSL

SEQ ID NO: 343711 - protein, 9 aa, Homo Sapiens
APTSPFKRE

SEQ ID NO: 343712 - protein, 9 aa, Homo Sapiens
HNPQQHRNA

SEQ ID NO: 343713 - protein, 9 aa, Homo Sapiens
LKRDSYLPV

SEQ ID NO: 343714 - protein, 9 aa, Homo Sapiens
QKEKKRKKH

SEQ ID NO: 343715 - protein, 9 aa, Homo Sapiens
SCRAIVYCS

SEQ ID NO: 343716 - protein, 9 aa, Homo Sapiens
DNLVLHMVD

SEQ ID NO: 343717 - protein, 9 aa, Homo Sapiens
SGEKPYGRV

SEQ ID NO: 343718 - protein, 9 aa, Homo Sapiens
IIESPMHPY

SEQ ID NO: 343719 - protein, 9 aa, Homo Sapiens
IKLLFFRKT

SEQ ID NO: 343720 - protein, 9 aa, Homo Sapiens
LKQMKETER

SEQ ID NO: 343721 - protein, 9 aa, Homo Sapiens
LEQENEDLA

SEQ ID NO: 343722 - protein, 9 aa, Homo Sapiens
AIQREYLNI

SEQ ID NO: 343723 - protein, 9 aa, Homo Sapiens
SEHQITHIG

SEQ ID NO: 343724 - protein, 9 aa, Homo Sapiens
IVDKMHNSN

SEQ ID NO: 343725 - protein, 9 aa, Homo Sapiens
STVDQKNNL

SEQ ID NO: 343726 - protein, 9 aa, Homo Sapiens
WKYVAMVIN

SEQ ID NO: 343727 - protein, 9 aa, Homo Sapiens
HQKAHRLPE

SEQ ID NO: 343728 - protein, 9 aa, Homo Sapiens
SCYCPNNSI

SEQ ID NO: 343729 - protein, 9 aa, Homo Sapiens
PVLEAFPQN

SEQ ID NO: 343730 - protein, 9 aa, Homo Sapiens
YGIQSEYCI

SEQ ID NO: 343731 - protein, 9 aa, Homo Sapiens
IDSVLEKDP

SEQ ID NO: 343732 - protein, 9 aa, Homo Sapiens
VAVKGQGVS

SEQ ID NO: 343733 - protein, 9 aa, Homo Sapiens
QEQGIHAEL

SEQ ID NO: 343734 - protein, 9 aa, Homo Sapiens
LCGAAHRSL

SEQ ID NO: 343735 - protein, 9 aa, Homo Sapiens
EVSIDDLKN

SEQ ID NO: 343736 - protein, 9 aa, Homo Sapiens
LLFTSDNLK

SEQ ID NO: 343737 - protein, 9 aa, Homo Sapiens
SFGHSKCLL

SEQ ID NO: 343738 - protein, 9 aa, Homo Sapiens
GTDRTTELS

SEQ ID NO: 343739 - protein, 9 aa, Homo Sapiens
KQFRALWSS

SEQ ID NO: 343740 - protein, 9 aa, Homo Sapiens
HDVQELNQI

SEQ ID NO: 343741 - protein, 9 aa, Homo Sapiens
PSLISWLDE

SEQ ID NO: 343742 - protein, 9 aa, Homo Sapiens
ATATECLRH

SEQ ID NO: 343743 - protein, 9 aa, Homo Sapiens
TKRELLESY

SEQ ID NO: 343744 - protein, 9 aa, Homo Sapiens
LAATFPSAC

SEQ ID NO: 343745 - protein, 9 aa, Homo Sapiens
NNHPLLTRF

SEQ ID NO: 343746 - protein, 9 aa, Homo Sapiens
NVRGKQHGS

SEQ ID NO: 343747 - protein, 9 aa, Homo Sapiens
VLQRVTRAA

SEQ ID NO: 343748 - protein, 9 aa, Homo Sapiens
YTFIVPQQW

SEQ ID NO: 343749 - protein, 9 aa, Homo Sapiens
KEEASHIEE

SEQ ID NO: 343750 - protein, 9 aa, Homo Sapiens
ADQGPKNIE

SEQ ID NO: 343751 - protein, 9 aa, Homo Sapiens
GTQHRVLFE

SEQ ID NO: 343752 - protein, 9 aa, Homo Sapiens
TMAKVVNLG

SEQ ID NO: 343753 - protein, 9 aa, Homo Sapiens
LRPVHLTQE

SEQ ID NO: 343754 - protein, 9 aa, Homo Sapiens
GASIDLSAS

SEQ ID NO: 343755 - protein, 9 aa, Homo Sapiens
PCVCILMSI

SEQ ID NO: 343756 - protein, 9 aa, Homo Sapiens
PKEADIEII

SEQ ID NO: 343757 - protein, 9 aa, Homo Sapiens
RGSSSPQKR

SEQ ID NO: 343758 - protein, 9 aa, Homo Sapiens
ANADLIIHI

SEQ ID NO: 343759 - protein, 9 aa, Homo Sapiens
SKLNERCIK

SEQ ID NO: 343760 - protein, 9 aa, Homo Sapiens
QLLIPLEKL

SEQ ID NO: 343761 - protein, 9 aa, Homo Sapiens
KEQILFINL

SEQ ID NO: 343762 - protein, 9 aa, Homo Sapiens
ERSIIRINF

SEQ ID NO: 343763 - protein, 9 aa, Homo Sapiens
IIFGVSWFL

SEQ ID NO: 343764 - protein, 9 aa, Homo Sapiens
LGMASFGAS

SEQ ID NO: 343765 - protein, 9 aa, Homo Sapiens
WDCFQMRIH

SEQ ID NO: 343766 - protein, 9 aa, Homo Sapiens
LSELQLRVQ

SEQ ID NO: 343767 - protein, 9 aa, Homo Sapiens
IIQDHGDMT

SEQ ID NO: 343768 - protein, 9 aa, Homo Sapiens
FSLYLIHEI

SEQ ID NO: 343769 - protein, 9 aa, Homo Sapiens
EKYTVLGRL

SEQ ID NO: 343770 - protein, 9 aa, Homo Sapiens
WNELGKTSF

SEQ ID NO: 343771 - protein, 9 aa, Homo Sapiens
INDDGLIQI

SEQ ID NO: 343772 - protein, 9 aa, Homo Sapiens
PLKKQRFYQ

SEQ ID NO: 343773 - protein, 9 aa, Homo Sapiens
KAISTLFDN

SEQ ID NO: 343774 - protein, 9 aa, Homo Sapiens
KVLLKEKSI

SEQ ID NO: 343775 - protein, 9 aa, Homo Sapiens
STDSALKPA

SEQ ID NO: 343776 - protein, 9 aa, Homo Sapiens
AGTSSDLMA

SEQ ID NO: 343777 - protein, 9 aa, Homo Sapiens
CSSSFQYHG

SEQ ID NO: 343778 - protein, 9 aa, Homo Sapiens
RFWKINYKG

SEQ ID NO: 343779 - protein, 9 aa, Homo Sapiens
SCVTGPRNC

SEQ ID NO: 343780 - protein, 9 aa, Homo Sapiens
SSSLNSTNS

SEQ ID NO: 343781 - protein, 9 aa, Homo Sapiens
YEFKTCLLE

SEQ ID NO: 343782 - protein, 9 aa, Homo Sapiens
QIANNSYND

SEQ ID NO: 343783 - protein, 9 aa, Homo Sapiens
PEPKTPVNT

SEQ ID NO: 343784 - protein, 9 aa, Homo Sapiens
LKFPNCQCL

SEQ ID NO: 343785 - protein, 9 aa, Homo Sapiens
RFRAHAASM

SEQ ID NO: 343786 - protein, 9 aa, Homo Sapiens
DQCLACLKE

SEQ ID NO: 343787 - protein, 9 aa, Homo Sapiens
KAKWHLGIQ

SEQ ID NO: 343788 - protein, 9 aa, Homo Sapiens
FVVVITDGR

SEQ ID NO: 343789 - protein, 9 aa, Homo Sapiens
LVKWLEVCC

SEQ ID NO: 343790 - protein, 9 aa, Homo Sapiens
QKVKVKKAT

SEQ ID NO: 343791 - protein, 9 aa, Homo Sapiens
FESFVVLGG

SEQ ID NO: 343792 - protein, 9 aa, Homo Sapiens
LHSTICKMN

SEQ ID NO: 343793 - protein, 9 aa, Homo Sapiens
QLLDDSITI

SEQ ID NO: 343794 - protein, 9 aa, Homo Sapiens
TVESTVDQK

SEQ ID NO: 343795 - protein, 9 aa, Homo Sapiens
KPLEPESEC

SEQ ID NO: 343796 - protein, 9 aa, Homo Sapiens
LQQKYIGVK

SEQ ID NO: 343797 - protein, 9 aa, Homo Sapiens
EYNIKMKIA

SEQ ID NO: 343798 - protein, 9 aa, Homo Sapiens
GSAYQAFHG

SEQ ID NO: 343799 - protein, 9 aa, Homo Sapiens
QPVLPFYCS

SEQ ID NO: 343800 - protein, 9 aa, Homo Sapiens
DGSLGSCQA

SEQ ID NO: 343801 - protein, 9 aa, Homo Sapiens
KKWSTQGEE

SEQ ID NO: 343802 - protein, 9 aa, Homo Sapiens
SHSPYKKKK

SEQ ID NO: 343803 - protein, 9 aa, Homo Sapiens
STNQTAETI

SEQ ID NO: 343804 - protein, 9 aa, Homo Sapiens
RSTILCQLT

SEQ ID NO: 343805 - protein, 9 aa, Homo Sapiens
SSFEKHRKE

SEQ ID NO: 343806 - protein, 9 aa, Homo Sapiens
VFRLTHPGV

SEQ ID NO: 343807 - protein, 9 aa, Homo Sapiens
LEHSPEVED

SEQ ID NO: 343808 - protein, 9 aa, Homo Sapiens
DSRHGQVPS

SEQ ID NO: 343809 - protein, 9 aa, Homo Sapiens
CKLLFFRIC

SEQ ID NO: 343810 - protein, 9 aa, Homo Sapiens
NEKDKRDPL

SEQ ID NO: 343811 - protein, 9 aa, Homo Sapiens
LKKSLEEAA

SEQ ID NO: 343812 - protein, 9 aa, Homo Sapiens
SHQSGDFTT

SEQ ID NO: 343813 - protein, 9 aa, Homo Sapiens
RIWNYNKSW

SEQ ID NO: 343814 - protein, 9 aa, Homo Sapiens
ILTYSQIGG

SEQ ID NO: 343815 - protein, 9 aa, Homo Sapiens
KGHRVLINN

SEQ ID NO: 343816 - protein, 9 aa, Homo Sapiens
KIIKVYGDK

SEQ ID NO: 343817 - protein, 9 aa, Homo Sapiens
PQCKQIYQS

SEQ ID NO: 343818 - protein, 9 aa, Homo Sapiens
FLLFCAYAY

SEQ ID NO: 343819 - protein, 9 aa, Homo Sapiens
RLWGLQQEM

SEQ ID NO: 343820 - protein, 9 aa, Homo Sapiens
IVHRDLKSD

SEQ ID NO: 343821 - protein, 9 aa, Homo Sapiens
YDNEDNYSN

SEQ ID NO: 343822 - protein, 9 aa, Homo Sapiens
GLAIHIQNH

SEQ ID NO: 343823 - protein, 9 aa, Homo Sapiens
DIFNRSLMA

SEQ ID NO: 343824 - protein, 9 aa, Homo Sapiens
ETSLVNKPL

SEQ ID NO: 343825 - protein, 9 aa, Homo Sapiens
IVDFLNPLT

SEQ ID NO: 343826 - protein, 9 aa, Homo Sapiens
RIVTNYLSA

SEQ ID NO: 343827 - protein, 9 aa, Homo Sapiens
KFGVSQERN

SEQ ID NO: 343828 - protein, 9 aa, Homo Sapiens
EQYLLNVFV

SEQ ID NO: 343829 - protein, 9 aa, Homo Sapiens
LHLHGTDIQ

SEQ ID NO: 343830 - protein, 9 aa, Homo Sapiens
KSDVSTRWQ

SEQ ID NO: 343831 - protein, 9 aa, Homo Sapiens
DTNYREITD

SEQ ID NO: 343832 - protein, 9 aa, Homo Sapiens
DHYGREGLT

SEQ ID NO: 343833 - protein, 9 aa, Homo Sapiens
ENEVQTLFG

SEQ ID NO: 343834 - protein, 9 aa, Homo Sapiens
KCSDQGVAG

SEQ ID NO: 343835 - protein, 9 aa, Homo Sapiens
YQNKARRSR

SEQ ID NO: 343836 - protein, 9 aa, Homo Sapiens
ECKIQQLTN

SEQ ID NO: 343837 - protein, 9 aa, Homo Sapiens
EMPLLEAPL

SEQ ID NO: 343838 - protein, 9 aa, Homo Sapiens
SNSPRTLET

SEQ ID NO: 343839 - protein, 9 aa, Homo Sapiens
LLYQKHNKQ

SEQ ID NO: 343840 - protein, 9 aa, Homo Sapiens
EQNNRTPLV

SEQ ID NO: 343841 - protein, 9 aa, Homo Sapiens
LSNWYTEAL

SEQ ID NO: 343842 - protein, 9 aa, Homo Sapiens
EGLKQQNLH

SEQ ID NO: 343843 - protein, 9 aa, Homo Sapiens
LMMSVAGRV

SEQ ID NO: 343844 - protein, 9 aa, Homo Sapiens
ALIPEAELR

SEQ ID NO: 343845 - protein, 9 aa, Homo Sapiens
EGIPSILKY

SEQ ID NO: 343846 - protein, 9 aa, Homo Sapiens
PTVAQYHFY

SEQ ID NO: 343847 - protein, 9 aa, Homo Sapiens
ATADNHGYM

SEQ ID NO: 343848 - protein, 9 aa, Homo Sapiens
TKPSADQKL

SEQ ID NO: 343849 - protein, 9 aa, Homo Sapiens
NTVCPEQGK

SEQ ID NO: 343850 - protein, 9 aa, Homo Sapiens
WYLDLCRFG

SEQ ID NO: 343851 - protein, 9 aa, Homo Sapiens
KVKVKKATV

SEQ ID NO: 343852 - protein, 9 aa, Homo Sapiens
KKLEQHIQK

SEQ ID NO: 343853 - protein, 9 aa, Homo Sapiens
SQKDDMMAR

SEQ ID NO: 343854 - protein, 9 aa, Homo Sapiens
ECAHREARG

SEQ ID NO: 343855 - protein, 9 aa, Homo Sapiens
KEYTDVYPK

SEQ ID NO: 343856 - protein, 9 aa, Homo Sapiens
ICSYSKIVS

SEQ ID NO: 343857 - protein, 9 aa, Homo Sapiens
REQMTDMAK

SEQ ID NO: 343858 - protein, 9 aa, Homo Sapiens
VKKGDTRLP

SEQ ID NO: 343859 - protein, 9 aa, Homo Sapiens
VTEEKPYDT

SEQ ID NO: 343860 - protein, 9 aa, Homo Sapiens
KHIVCLEPD

SEQ ID NO: 343861 - protein, 9 aa, Homo Sapiens
GDLKIMFPD

SEQ ID NO: 343862 - protein, 9 aa, Homo Sapiens
LVDKIQTEV

SEQ ID NO: 343863 - protein, 9 aa, Homo Sapiens
EEANKFWHH

SEQ ID NO: 343864 - protein, 9 aa, Homo Sapiens
SDSVISMTE

SEQ ID NO: 343865 - protein, 9 aa, Homo Sapiens
DKARKDEWA

SEQ ID NO: 343866 - protein, 9 aa, Homo Sapiens
RVQPKFLQT

SEQ ID NO: 343867 - protein, 9 aa, Homo Sapiens
CLAVKDYIQ

SEQ ID NO: 343868 - protein, 9 aa, Homo Sapiens
LIHEITHTG

SEQ ID NO: 343869 - protein, 9 aa, Homo Sapiens
SLNSDEPVA

SEQ ID NO: 343870 - protein, 9 aa, Homo Sapiens
GNESEFEEP

SEQ ID NO: 343871 - protein, 9 aa, Homo Sapiens
YTDPSSLQK

SEQ ID NO: 343872 - protein, 9 aa, Homo Sapiens
SLDKDISEA

SEQ ID NO: 343873 - protein, 9 aa, Homo Sapiens
QNQIVTDPD

SEQ ID NO: 343874 - protein, 9 aa, Homo Sapiens
SKCLLLVLM

SEQ ID NO: 343875 - protein, 9 aa, Homo Sapiens
NECGKVFHH

SEQ ID NO: 343876 - protein, 9 aa, Homo Sapiens
RYVAVSRGV

SEQ ID NO: 343877 - protein, 9 aa, Homo Sapiens
LHRATVFAN

SEQ ID NO: 343878 - protein, 9 aa, Homo Sapiens
KHKYFKKHE

SEQ ID NO: 343879 - protein, 9 aa, Homo Sapiens
NYRIMVEVY

SEQ ID NO: 343880 - protein, 9 aa, Homo Sapiens
FDVLEMLAS

SEQ ID NO: 343881 - protein, 9 aa, Homo Sapiens
EDTGKLAVD

SEQ ID NO: 343882 - protein, 9 aa, Homo Sapiens
LSDQEGYFQ

SEQ ID NO: 343883 - protein, 9 aa, Homo Sapiens
SDQKEELEE

SEQ ID NO: 343884 - protein, 9 aa, Homo Sapiens
VRNAPWTLI

SEQ ID NO: 343885 - protein, 9 aa, Homo Sapiens
DKTGCSKTP

SEQ ID NO: 343886 - protein, 9 aa, Homo Sapiens
CLVASELLI

SEQ ID NO: 343887 - protein, 9 aa, Homo Sapiens
KFHDLTEQI

SEQ ID NO: 343888 - protein, 9 aa, Homo Sapiens
QEKMILSTH

SEQ ID NO: 343889 - protein, 9 aa, Homo Sapiens
HAINLDEGV

SEQ ID NO: 343890 - protein, 9 aa, Homo Sapiens
WELDCEGDI

SEQ ID NO: 343891 - protein, 9 aa, Homo Sapiens
SDTPEICKY

SEQ ID NO: 343892 - protein, 9 aa, Homo Sapiens
LRLFPIVMR

SEQ ID NO: 343893 - protein, 9 aa, Homo Sapiens
KVRYERFVK

SEQ ID NO: 343894 - protein, 9 aa, Homo Sapiens
NKKLACGAV

SEQ ID NO: 343895 - protein, 9 aa, Homo Sapiens
HSIPHSSPC

SEQ ID NO: 343896 - protein, 9 aa, Homo Sapiens
KSDNSCTNK

SEQ ID NO: 343897 - protein, 9 aa, Homo Sapiens
REQNQYDLK

SEQ ID NO: 343898 - protein, 9 aa, Homo Sapiens
QIKAEIASC

SEQ ID NO: 343899 - protein, 9 aa, Homo Sapiens
YFRLVLNFQ

SEQ ID NO: 343900 - protein, 9 aa, Homo Sapiens
PKIRHTENK

SEQ ID NO: 343901 - protein, 9 aa, Homo Sapiens
SSRVWWDSN

SEQ ID NO: 343902 - protein, 9 aa, Homo Sapiens
FIESSTKPV

SEQ ID NO: 343903 - protein, 9 aa, Homo Sapiens
DSNSKDNDK

SEQ ID NO: 343904 - protein, 9 aa, Homo Sapiens
DTGKLAVDT

SEQ ID NO: 343905 - protein, 9 aa, Homo Sapiens
SRSGQSFGY

SEQ ID NO: 343906 - protein, 9 aa, Homo Sapiens
FDHIFYMGN

SEQ ID NO: 343907 - protein, 9 aa, Homo Sapiens
DVLSRKLST

SEQ ID NO: 343908 - protein, 9 aa, Homo Sapiens
GVAAFHTFL

SEQ ID NO: 343909 - protein, 9 aa, Homo Sapiens
TENNCAKFT

SEQ ID NO: 343910 - protein, 9 aa, Homo Sapiens
SFSSSVNVE

SEQ ID NO: 343911 - protein, 9 aa, Homo Sapiens
PELSVPDLR

SEQ ID NO: 343912 - protein, 9 aa, Homo Sapiens
GPDTIRERY

SEQ ID NO: 343913 - protein, 9 aa, Homo Sapiens
KLSFNIQAL

SEQ ID NO: 343914 - protein, 9 aa, Homo Sapiens
HAAKHQDSG

SEQ ID NO: 343915 - protein, 9 aa, Homo Sapiens
FDMDLQACI

SEQ ID NO: 343916 - protein, 9 aa, Homo Sapiens
LGLALMSQG

SEQ ID NO: 343917 - protein, 9 aa, Homo Sapiens
DLKTLQEDS

SEQ ID NO: 343918 - protein, 9 aa, Homo Sapiens
MYRWLKNCN

SEQ ID NO: 343919 - protein, 9 aa, Homo Sapiens
TLEEPQTLV

SEQ ID NO: 343920 - protein, 9 aa, Homo Sapiens
KRIYEAKEE

SEQ ID NO: 343921 - protein, 9 aa, Homo Sapiens
SLYPLFMEG

SEQ ID NO: 343922 - protein, 9 aa, Homo Sapiens
DHGVEYLAN

SEQ ID NO: 343923 - protein, 9 aa, Homo Sapiens
NGNYHRFLG

SEQ ID NO: 343924 - protein, 9 aa, Homo Sapiens
LQAITEKRK

SEQ ID NO: 343925 - protein, 9 aa, Homo Sapiens
VLIPPQNPG

SEQ ID NO: 343926 - protein, 9 aa, Homo Sapiens
FSLYPLFME

SEQ ID NO: 343927 - protein, 9 aa, Homo Sapiens
PFFLLITIT

SEQ ID NO: 343928 - protein, 9 aa, Homo Sapiens
SVEEKQPRL

SEQ ID NO: 343929 - protein, 9 aa, Homo Sapiens
LFRHSSVLF

SEQ ID NO: 343930 - protein, 9 aa, Homo Sapiens
RLMERYAPV

SEQ ID NO: 343931 - protein, 9 aa, Homo Sapiens
TLTVHQITH

SEQ ID NO: 343932 - protein, 9 aa, Homo Sapiens
RYYCKVENG

SEQ ID NO: 343933 - protein, 9 aa, Homo Sapiens
LIPAWTFYS

SEQ ID NO: 343934 - protein, 9 aa, Homo Sapiens
TDMAKIKLS

SEQ ID NO: 343935 - protein, 9 aa, Homo Sapiens
PLSLKRPKT

SEQ ID NO: 343936 - protein, 9 aa, Homo Sapiens
YALTILQFT

SEQ ID NO: 343937 - protein, 9 aa, Homo Sapiens
CFNFPSTMI

SEQ ID NO: 343938 - protein, 9 aa, Homo Sapiens
DMQWKVRQT

SEQ ID NO: 343939 - protein, 9 aa, Homo Sapiens
WHIQIGILI

SEQ ID NO: 343940 - protein, 9 aa, Homo Sapiens
SKIYMVHRN

SEQ ID NO: 343941 - protein, 9 aa, Homo Sapiens
RSRRITNNC

SEQ ID NO: 343942 - protein, 9 aa, Homo Sapiens
LSELFTNQK

SEQ ID NO: 343943 - protein, 9 aa, Homo Sapiens
NTFIKTLQG

SEQ ID NO: 343944 - protein, 9 aa, Homo Sapiens
DQKEFVRKK

SEQ ID NO: 343945 - protein, 9 aa, Homo Sapiens
HSRNNMLLA

SEQ ID NO: 343946 - protein, 9 aa, Homo Sapiens
KFLIDTHNL

SEQ ID NO: 343947 - protein, 9 aa, Homo Sapiens
CEECGNTFN

SEQ ID NO: 343948 - protein, 9 aa, Homo Sapiens
RVTYLLGAG

SEQ ID NO: 343949 - protein, 9 aa, Homo Sapiens
FLLKQRVSN

SEQ ID NO: 343950 - protein, 9 aa, Homo Sapiens
ITQILGKKP

SEQ ID NO: 343951 - protein, 9 aa, Homo Sapiens
NEDSDLIFK

SEQ ID NO: 343952 - protein, 9 aa, Homo Sapiens
SRIIIVGTL

SEQ ID NO: 343953 - protein, 9 aa, Homo Sapiens
ITVVKKLDP

SEQ ID NO: 343954 - protein, 9 aa, Homo Sapiens
GRILANTFI

SEQ ID NO: 343955 - protein, 9 aa, Homo Sapiens
PNQPLKQQI

SEQ ID NO: 343956 - protein, 9 aa, Homo Sapiens
WMTARRRVN

SEQ ID NO: 343957 - protein, 9 aa, Homo Sapiens
IDDLKNPRV

SEQ ID NO: 343958 - protein, 9 aa, Homo Sapiens
HNKLPLGLT

SEQ ID NO: 343959 - protein, 9 aa, Homo Sapiens
ELEQQRRLE

SEQ ID NO: 343960 - protein, 9 aa, Homo Sapiens
EENNEDHTP

SEQ ID NO: 343961 - protein, 9 aa, Homo Sapiens
AKCLDEQQH

SEQ ID NO: 343962 - protein, 9 aa, Homo Sapiens
IGSQDGPQT

SEQ ID NO: 343963 - protein, 9 aa, Homo Sapiens
EIYPDKRFA

SEQ ID NO: 343964 - protein, 9 aa, Homo Sapiens
CCAISLWLQ

SEQ ID NO: 343965 - protein, 9 aa, Homo Sapiens
PEDIWTRGV

SEQ ID NO: 343966 - protein, 9 aa, Homo Sapiens
SRKVNDGKW

SEQ ID NO: 343967 - protein, 9 aa, Homo Sapiens
ECIECGKLF

SEQ ID NO: 343968 - protein, 9 aa, Homo Sapiens
RTLPEVHYH

SEQ ID NO: 343969 - protein, 9 aa, Homo Sapiens
SFKGIQFSK

SEQ ID NO: 343970 - protein, 9 aa, Homo Sapiens
CCVCPMCNK

SEQ ID NO: 343971 - protein, 9 aa, Homo Sapiens
FINIESKFA

SEQ ID NO: 343972 - protein, 9 aa, Homo Sapiens
YLFDYSPPL

SEQ ID NO: 343973 - protein, 9 aa, Homo Sapiens
KLCYLPGHS

SEQ ID NO: 343974 - protein, 9 aa, Homo Sapiens
ADGTQGKKT

SEQ ID NO: 343975 - protein, 9 aa, Homo Sapiens
MTMMLPFCG

SEQ ID NO: 343976 - protein, 9 aa, Homo Sapiens
NNGKRCPNA

SEQ ID NO: 343977 - protein, 9 aa, Homo Sapiens
HVYLEQIHN

SEQ ID NO: 343978 - protein, 9 aa, Homo Sapiens
RLNGQAFPL

SEQ ID NO: 343979 - protein, 9 aa, Homo Sapiens
AQYTLRVQA

SEQ ID NO: 343980 - protein, 9 aa, Homo Sapiens
DSALKPAFG

SEQ ID NO: 343981 - protein, 9 aa, Homo Sapiens
LNKLDEAVQ

SEQ ID NO: 343982 - protein, 9 aa, Homo Sapiens
QGRRIHKET

SEQ ID NO: 343983 - protein, 9 aa, Homo Sapiens
HRKIHSGEK

SEQ ID NO: 343984 - protein, 9 aa, Homo Sapiens
HGCLAAIAP

SEQ ID NO: 343985 - protein, 9 aa, Homo Sapiens
DIQYDLFLS

SEQ ID NO: 343986 - protein, 9 aa, Homo Sapiens
PLRQHHSDL

SEQ ID NO: 343987 - protein, 9 aa, Homo Sapiens
LSYTVRIAA

SEQ ID NO: 343988 - protein, 9 aa, Homo Sapiens
PPKFSNQFE

SEQ ID NO: 343989 - protein, 9 aa, Homo Sapiens
NYSASASQV

SEQ ID NO: 343990 - protein, 9 aa, Homo Sapiens
LRLQAELGA

SEQ ID NO: 343991 - protein, 9 aa, Homo Sapiens
VALSDKDMD

SEQ ID NO: 343992 - protein, 9 aa, Homo Sapiens
KLNAFKASD

SEQ ID NO: 343993 - protein, 9 aa, Homo Sapiens
KRKEDKLLG

SEQ ID NO: 343994 - protein, 9 aa, Homo Sapiens
EEESLVRCV

SEQ ID NO: 343995 - protein, 9 aa, Homo Sapiens
VICCLCAID

SEQ ID NO: 343996 - protein, 9 aa, Homo Sapiens
ASRPPTLHP

SEQ ID NO: 343997 - protein, 9 aa, Homo Sapiens
SWMGGNNPF

SEQ ID NO: 343998 - protein, 9 aa, Homo Sapiens
HVKEISELF

SEQ ID NO: 343999 - protein, 9 aa, Homo Sapiens
EVIGFKAEN

SEQ ID NO: 344000 - protein, 9 aa, Homo Sapiens
PRLSIQKYI

SEQ ID NO: 344001 - protein, 9 aa, Homo Sapiens
LCSKTKALA

SEQ ID NO: 344002 - protein, 9 aa, Homo Sapiens
LEPPIAALA

SEQ ID NO: 344003 - protein, 9 aa, Homo Sapiens
LGPAPGSPD

SEQ ID NO: 344004 - protein, 9 aa, Homo Sapiens
ESVELRGKS

SEQ ID NO: 344005 - protein, 9 aa, Homo Sapiens
LKFENELVL

SEQ ID NO: 344006 - protein, 9 aa, Homo Sapiens
TKLEFALEL

SEQ ID NO: 344007 - protein, 9 aa, Homo Sapiens
IFTNTCTTC

SEQ ID NO: 344008 - protein, 9 aa, Homo Sapiens
CILGSKQSE

SEQ ID NO: 344009 - protein, 9 aa, Homo Sapiens
KFPTKIPRG

SEQ ID NO: 344010 - protein, 9 aa, Homo Sapiens
SICQLCGFR

SEQ ID NO: 344011 - protein, 9 aa, Homo Sapiens
DTIDERTIS

SEQ ID NO: 344012 - protein, 9 aa, Homo Sapiens
VTGVAIATI

SEQ ID NO: 344013 - protein, 9 aa, Homo Sapiens
DEHGKREPF

SEQ ID NO: 344014 - protein, 9 aa, Homo Sapiens
EGLITLTYK

SEQ ID NO: 344015 - protein, 9 aa, Homo Sapiens
LCFNFPSTM

SEQ ID NO: 344016 - protein, 9 aa, Homo Sapiens
PSPSAQINY

SEQ ID NO: 344017 - protein, 9 aa, Homo Sapiens
FMSCPGRGH

SEQ ID NO: 344018 - protein, 9 aa, Homo Sapiens
NECGRYFAH

SEQ ID NO: 344019 - protein, 9 aa, Homo Sapiens
GIDDFVQLS

SEQ ID NO: 344020 - protein, 9 aa, Homo Sapiens
VASTLSRAD

SEQ ID NO: 344021 - protein, 9 aa, Homo Sapiens
VQLIVQTPS

SEQ ID NO: 344022 - protein, 9 aa, Homo Sapiens
FEVSSYLIL

SEQ ID NO: 344023 - protein, 9 aa, Homo Sapiens
TATGNNSCP

SEQ ID NO: 344024 - protein, 9 aa, Homo Sapiens
YLLQNISSY

SEQ ID NO: 344025 - protein, 9 aa, Homo Sapiens
LHRGYIGVV

SEQ ID NO: 344026 - protein, 9 aa, Homo Sapiens
TDNPCLRNA

SEQ ID NO: 344027 - protein, 9 aa, Homo Sapiens
RIYDWRMLG

SEQ ID NO: 344028 - protein, 9 aa, Homo Sapiens
IRKDLIQHF

SEQ ID NO: 344029 - protein, 9 aa, Homo Sapiens
ISKGFWGTV

SEQ ID NO: 344030 - protein, 9 aa, Homo Sapiens
RMKQLILEH

SEQ ID NO: 344031 - protein, 9 aa, Homo Sapiens
NLEYFMKNS

SEQ ID NO: 344032 - protein, 9 aa, Homo Sapiens
NSYNGHRDL

SEQ ID NO: 344033 - protein, 9 aa, Homo Sapiens
KQLFARLLF

SEQ ID NO: 344034 - protein, 9 aa, Homo Sapiens
HRVLINNKQ

SEQ ID NO: 344035 - protein, 9 aa, Homo Sapiens
AKGRPRLNQ

SEQ ID NO: 344036 - protein, 9 aa, Homo Sapiens
ECIECVKTF

SEQ ID NO: 344037 - protein, 9 aa, Homo Sapiens
QPYDPNFYN

SEQ ID NO: 344038 - protein, 9 aa, Homo Sapiens
HPSSGPHGS

SEQ ID NO: 344039 - protein, 9 aa, Homo Sapiens
SEGKFDKDR

SEQ ID NO: 344040 - protein, 9 aa, Homo Sapiens
VVYLKNTTE

SEQ ID NO: 344041 - protein, 9 aa, Homo Sapiens
PDCMACDLD

SEQ ID NO: 344042 - protein, 9 aa, Homo Sapiens
TKKAVSRSA

SEQ ID NO: 344043 - protein, 9 aa, Homo Sapiens
NNGLVKLIC

SEQ ID NO: 344044 - protein, 9 aa, Homo Sapiens
QLWVVEFGS

SEQ ID NO: 344045 - protein, 9 aa, Homo Sapiens
FSIDQNTGE

SEQ ID NO: 344046 - protein, 9 aa, Homo Sapiens
ECDEDDHRN

SEQ ID NO: 344047 - protein, 9 aa, Homo Sapiens
SLCLGSWSL

SEQ ID NO: 344048 - protein, 9 aa, Homo Sapiens
TNQTAETIL

SEQ ID NO: 344049 - protein, 9 aa, Homo Sapiens
LGNGASTVQ

SEQ ID NO: 344050 - protein, 9 aa, Homo Sapiens
HLLHIIIIF

SEQ ID NO: 344051 - protein, 9 aa, Homo Sapiens
SAQHLDVTV

SEQ ID NO: 344052 - protein, 9 aa, Homo Sapiens
LPIEHQKFG

SEQ ID NO: 344053 - protein, 9 aa, Homo Sapiens
KDSDRLHVD

SEQ ID NO: 344054 - protein, 9 aa, Homo Sapiens
KIFLLGEEV

SEQ ID NO: 344055 - protein, 9 aa, Homo Sapiens
TDQKEFVRK

SEQ ID NO: 344056 - protein, 9 aa, Homo Sapiens
YLEQQCNLT

SEQ ID NO: 344057 - protein, 9 aa, Homo Sapiens
LGVTVDLYI

SEQ ID NO: 344058 - protein, 9 aa, Homo Sapiens
QAANLALLA

SEQ ID NO: 344059 - protein, 9 aa, Homo Sapiens
DWTLLLSSP

SEQ ID NO: 344060 - protein, 9 aa, Homo Sapiens
PPQRSQPPG

SEQ ID NO: 344061 - protein, 9 aa, Homo Sapiens
VKNGIQRSL

SEQ ID NO: 344062 - protein, 9 aa, Homo Sapiens
LQLAVDVCF

SEQ ID NO: 344063 - protein, 9 aa, Homo Sapiens
LGCCVVITP

SEQ ID NO: 344064 - protein, 9 aa, Homo Sapiens
NDMKRKKVL

SEQ ID NO: 344065 - protein, 9 aa, Homo Sapiens
TFSEILNRF

SEQ ID NO: 344066 - protein, 9 aa, Homo Sapiens
EERHKSHEA

SEQ ID NO: 344067 - protein, 9 aa, Homo Sapiens
ILPDEYKYC

SEQ ID NO: 344068 - protein, 9 aa, Homo Sapiens
PYSPISNIV

SEQ ID NO: 344069 - protein, 9 aa, Homo Sapiens
HIVIDKAQN

SEQ ID NO: 344070 - protein, 9 aa, Homo Sapiens
QLILEHYVG

SEQ ID NO: 344071 - protein, 9 aa, Homo Sapiens
GIINENRKQ

SEQ ID NO: 344072 - protein, 9 aa, Homo Sapiens
NTLSVKVMT

SEQ ID NO: 344073 - protein, 9 aa, Homo Sapiens
LPHAGVAWV

SEQ ID NO: 344074 - protein, 9 aa, Homo Sapiens
GEPKHSRTA

SEQ ID NO: 344075 - protein, 9 aa, Homo Sapiens
PAMTMTASL

SEQ ID NO: 344076 - protein, 9 aa, Homo Sapiens
SLFPDFGLL

SEQ ID NO: 344077 - protein, 9 aa, Homo Sapiens
GIIFGVSWF

SEQ ID NO: 344078 - protein, 9 aa, Homo Sapiens
KLSRRHPIA

SEQ ID NO: 344079 - protein, 9 aa, Homo Sapiens
CPMNQMSVW

SEQ ID NO: 344080 - protein, 9 aa, Homo Sapiens
DMLKQLSTA

SEQ ID NO: 344081 - protein, 9 aa, Homo Sapiens
DHLEGQKHK

SEQ ID NO: 344082 - protein, 9 aa, Homo Sapiens
YTVIYLYTA

SEQ ID NO: 344083 - protein, 9 aa, Homo Sapiens
DQILWGNNH

SEQ ID NO: 344084 - protein, 9 aa, Homo Sapiens
HTAVYHEIL

SEQ ID NO: 344085 - protein, 9 aa, Homo Sapiens
SFFYFFFSF

SEQ ID NO: 344086 - protein, 9 aa, Homo Sapiens
MRSGVFTDI

SEQ ID NO: 344087 - protein, 9 aa, Homo Sapiens
IICSYSKIV

SEQ ID NO: 344088 - protein, 9 aa, Homo Sapiens
LDTHTVIIF

SEQ ID NO: 344089 - protein, 9 aa, Homo Sapiens
GRGHPRGQP

SEQ ID NO: 344090 - protein, 9 aa, Homo Sapiens
EENYWDSES

SEQ ID NO: 344091 - protein, 9 aa, Homo Sapiens
EINNVNESW

SEQ ID NO: 344092 - protein, 9 aa, Homo Sapiens
TFFGVQWVC

SEQ ID NO: 344093 - protein, 9 aa, Homo Sapiens
HQGFFLSDS

SEQ ID NO: 344094 - protein, 9 aa, Homo Sapiens
TEQTLPVTV

SEQ ID NO: 344095 - protein, 9 aa, Homo Sapiens
HWTKLQHFL

SEQ ID NO: 344096 - protein, 9 aa, Homo Sapiens
ERIGYPNEW

SEQ ID NO: 344097 - protein, 9 aa, Homo Sapiens
VVVGAGDVG

SEQ ID NO: 344098 - protein, 9 aa, Homo Sapiens
ILRVLATNV

SEQ ID NO: 344099 - protein, 9 aa, Homo Sapiens
EFCNKPQRK

SEQ ID NO: 344100 - protein, 9 aa, Homo Sapiens
TKGIHEYNF

SEQ ID NO: 344101 - protein, 9 aa, Homo Sapiens
RWEIQQNSG

SEQ ID NO: 344102 - protein, 9 aa, Homo Sapiens
NLTVVPHNL

SEQ ID NO: 344103 - protein, 9 aa, Homo Sapiens
DKDISEAFT

SEQ ID NO: 344104 - protein, 9 aa, Homo Sapiens
LNPLMYTLR

SEQ ID NO: 344105 - protein, 9 aa, Homo Sapiens
HEQYLLNVF

SEQ ID NO: 344106 - protein, 9 aa, Homo Sapiens
RFDHIFYMG

SEQ ID NO: 344107 - protein, 9 aa, Homo Sapiens
TKYLAEEDD

SEQ ID NO: 344108 - protein, 9 aa, Homo Sapiens
IKLAELQPP

SEQ ID NO: 344109 - protein, 9 aa, Homo Sapiens
QQIQKIERT

SEQ ID NO: 344110 - protein, 9 aa, Homo Sapiens
TSLDPINEA

SEQ ID NO: 344111 - protein, 9 aa, Homo Sapiens
QGGAKNIQS

SEQ ID NO: 344112 - protein, 9 aa, Homo Sapiens
PLINISEFR

SEQ ID NO: 344113 - protein, 9 aa, Homo Sapiens
RYRRPTMAK

SEQ ID NO: 344114 - protein, 9 aa, Homo Sapiens
HTLTYLLQN

SEQ ID NO: 344115 - protein, 9 aa, Homo Sapiens
KNGIQRSLF

SEQ ID NO: 344116 - protein, 9 aa, Homo Sapiens
STQQYRSNV

SEQ ID NO: 344117 - protein, 9 aa, Homo Sapiens
SVNVENTLL

SEQ ID NO: 344118 - protein, 9 aa, Homo Sapiens
DRVKEKRNT

SEQ ID NO: 344119 - protein, 9 aa, Homo Sapiens
EGAYMCSCH

SEQ ID NO: 344120 - protein, 9 aa, Homo Sapiens
LQDQTGSGW

SEQ ID NO: 344121 - protein, 9 aa, Homo Sapiens
SLFAISASL

SEQ ID NO: 344122 - protein, 9 aa, Homo Sapiens
KLDGTQHRV

SEQ ID NO: 344123 - protein, 9 aa, Homo Sapiens
DWTPATSTD

SEQ ID NO: 344124 - protein, 9 aa, Homo Sapiens
IVKVRYERF

SEQ ID NO: 344125 - protein, 9 aa, Homo Sapiens
LVIFIFSGS

SEQ ID NO: 344126 - protein, 9 aa, Homo Sapiens
CEKVFDVII

SEQ ID NO: 344127 - protein, 9 aa, Homo Sapiens
TENGLTPTK

SEQ ID NO: 344128 - protein, 9 aa, Homo Sapiens
RTEQFCKSF

SEQ ID NO: 344129 - protein, 9 aa, Homo Sapiens
GGPDIFLGF

SEQ ID NO: 344130 - protein, 9 aa, Homo Sapiens
MPSEQIINQ

SEQ ID NO: 344131 - protein, 9 aa, Homo Sapiens
TYPTKRNKF

SEQ ID NO: 344132 - protein, 9 aa, Homo Sapiens
SNEKDKRDP

SEQ ID NO: 344133 - protein, 9 aa, Homo Sapiens
RSLKYFSSS

SEQ ID NO: 344134 - protein, 9 aa, Homo Sapiens
LIMPDSAVV

SEQ ID NO: 344135 - protein, 9 aa, Homo Sapiens
SRSRNIDRY

SEQ ID NO: 344136 - protein, 9 aa, Homo Sapiens
GIYGWRKCC

SEQ ID NO: 344137 - protein, 9 aa, Homo Sapiens
KLENYPEAE

SEQ ID NO: 344138 - protein, 9 aa, Homo Sapiens
RCCIIYVTE

SEQ ID NO: 344139 - protein, 9 aa, Homo Sapiens
KYKRPIPLC

SEQ ID NO: 344140 - protein, 9 aa, Homo Sapiens
ASGKYGDLN

SEQ ID NO: 344141 - protein, 9 aa, Homo Sapiens
SSIKHSLKV

SEQ ID NO: 344142 - protein, 9 aa, Homo Sapiens
TPDIYLSDW

SEQ ID NO: 344143 - protein, 9 aa, Homo Sapiens
EARRSSFEK

SEQ ID NO: 344144 - protein, 9 aa, Homo Sapiens
WLVDLLPST

SEQ ID NO: 344145 - protein, 9 aa, Homo Sapiens
DSRSSSEKK

SEQ ID NO: 344146 - protein, 9 aa, Homo Sapiens
EYGADHMAQ

SEQ ID NO: 344147 - protein, 9 aa, Homo Sapiens
AIPKKKINL

SEQ ID NO: 344148 - protein, 9 aa, Homo Sapiens
MAQAVGRDT

SEQ ID NO: 344149 - protein, 9 aa, Homo Sapiens
IIKHIVAEG

SEQ ID NO: 344150 - protein, 9 aa, Homo Sapiens
RYFAHISVL

SEQ ID NO: 344151 - protein, 9 aa, Homo Sapiens
YLYAAGFSQ

SEQ ID NO: 344152 - protein, 9 aa, Homo Sapiens
MRWAFRGPK

SEQ ID NO: 344153 - protein, 9 aa, Homo Sapiens
EETQLAGLQ

SEQ ID NO: 344154 - protein, 9 aa, Homo Sapiens
CGETLSQIQ

SEQ ID NO: 344155 - protein, 9 aa, Homo Sapiens
IFVTKIIDG

SEQ ID NO: 344156 - protein, 9 aa, Homo Sapiens
PTMAKVVNL

SEQ ID NO: 344157 - protein, 9 aa, Homo Sapiens
IEDEEEEEG

SEQ ID NO: 344158 - protein, 9 aa, Homo Sapiens
LNQEYLNLL

SEQ ID NO: 344159 - protein, 9 aa, Homo Sapiens
QKYIAQRKL

SEQ ID NO: 344160 - protein, 9 aa, Homo Sapiens
TFCVIWTAG

SEQ ID NO: 344161 - protein, 9 aa, Homo Sapiens
GDKYRDCYD

SEQ ID NO: 344162 - protein, 9 aa, Homo Sapiens
QEIKIQQPL

SEQ ID NO: 344163 - protein, 9 aa, Homo Sapiens
SGWGTQVFV

SEQ ID NO: 344164 - protein, 9 aa, Homo Sapiens
QHTHTGEKP

SEQ ID NO: 344165 - protein, 9 aa, Homo Sapiens
LGNTNVDIQ

SEQ ID NO: 344166 - protein, 9 aa, Homo Sapiens
ILKPAEGNT

SEQ ID NO: 344167 - protein, 9 aa, Homo Sapiens
VTFVFDAVT

SEQ ID NO: 344168 - protein, 9 aa, Homo Sapiens
QSGVVKLCN

SEQ ID NO: 344169 - protein, 9 aa, Homo Sapiens
LFVRKNNSP

SEQ ID NO: 344170 - protein, 9 aa, Homo Sapiens
RKLLPVLNP

SEQ ID NO: 344171 - protein, 9 aa, Homo Sapiens
DYIQTQIIS

SEQ ID NO: 344172 - protein, 9 aa, Homo Sapiens
HQRLHSRET

SEQ ID NO: 344173 - protein, 9 aa, Homo Sapiens
SVICCLCAI

SEQ ID NO: 344174 - protein, 9 aa, Homo Sapiens
GPCGETGPA

SEQ ID NO: 344175 - protein, 9 aa, Homo Sapiens
HQSKNKWKF

SEQ ID NO: 344176 - protein, 9 aa, Homo Sapiens
QLVQDDQAK

SEQ ID NO: 344177 - protein, 9 aa, Homo Sapiens
DLCRFGSVP

SEQ ID NO: 344178 - protein, 9 aa, Homo Sapiens
EGPKHLYGL

SEQ ID NO: 344179 - protein, 9 aa, Homo Sapiens
KGGAMALNE

SEQ ID NO: 344180 - protein, 9 aa, Homo Sapiens
DILSELFQR

SEQ ID NO: 344181 - protein, 9 aa, Homo Sapiens
KIILSIGGY

SEQ ID NO: 344182 - protein, 9 aa, Homo Sapiens
VDKMHNSNT

SEQ ID NO: 344183 - protein, 9 aa, Homo Sapiens
LACQIRYER

SEQ ID NO: 344184 - protein, 9 aa, Homo Sapiens
NDGQFRRTE

SEQ ID NO: 344185 - protein, 9 aa, Homo Sapiens
EGSLLALSF

SEQ ID NO: 344186 - protein, 9 aa, Homo Sapiens
HGSCVQACG

SEQ ID NO: 344187 - protein, 9 aa, Homo Sapiens
VVHDIRNYP

SEQ ID NO: 344188 - protein, 9 aa, Homo Sapiens
LYQGGNQRL

SEQ ID NO: 344189 - protein, 9 aa, Homo Sapiens
TKSPDYLEF

SEQ ID NO: 344190 - protein, 9 aa, Homo Sapiens
QMFLYFLVM

SEQ ID NO: 344191 - protein, 9 aa, Homo Sapiens
LYCEVPKVG

SEQ ID NO: 344192 - protein, 9 aa, Homo Sapiens
PEKARLSSS

SEQ ID NO: 344193 - protein, 9 aa, Homo Sapiens
LARASTKKK

SEQ ID NO: 344194 - protein, 9 aa, Homo Sapiens
KVGFFKPIS

SEQ ID NO: 344195 - protein, 9 aa, Homo Sapiens
KAKIILKKF

SEQ ID NO: 344196 - protein, 9 aa, Homo Sapiens
CLANNPIGD

SEQ ID NO: 344197 - protein, 9 aa, Homo Sapiens
THTLTQQRH

SEQ ID NO: 344198 - protein, 9 aa, Homo Sapiens
ANRDANKLS

SEQ ID NO: 344199 - protein, 9 aa, Homo Sapiens
QQGEMLHKK

SEQ ID NO: 344200 - protein, 9 aa, Homo Sapiens
LLDRFAQPA

SEQ ID NO: 344201 - protein, 9 aa, Homo Sapiens
HTGTPLGYI

SEQ ID NO: 344202 - protein, 9 aa, Homo Sapiens
SSPFVEQLL

SEQ ID NO: 344203 - protein, 9 aa, Homo Sapiens
INSQGERLM

SEQ ID NO: 344204 - protein, 9 aa, Homo Sapiens
YSYFPIPVL

SEQ ID NO: 344205 - protein, 9 aa, Homo Sapiens
YVRLINSMS

SEQ ID NO: 344206 - protein, 9 aa, Homo Sapiens
RHSMQIEQI

SEQ ID NO: 344207 - protein, 9 aa, Homo Sapiens
VTDEHGKRE

SEQ ID NO: 344208 - protein, 9 aa, Homo Sapiens
CSLLSAQQY

SEQ ID NO: 344209 - protein, 9 aa, Homo Sapiens
NGGADKKSS

SEQ ID NO: 344210 - protein, 9 aa, Homo Sapiens
LFKAWLHNS

SEQ ID NO: 344211 - protein, 9 aa, Homo Sapiens
DQVLYQRVS

SEQ ID NO: 344212 - protein, 9 aa, Homo Sapiens
LIFKRGPPG

SEQ ID NO: 344213 - protein, 9 aa, Homo Sapiens
VVAVSQDCY

SEQ ID NO: 344214 - protein, 9 aa, Homo Sapiens
WFYTIVYPL

SEQ ID NO: 344215 - protein, 9 aa, Homo Sapiens
ASFQTEVSY

SEQ ID NO: 344216 - protein, 9 aa, Homo Sapiens
RQTNCLMTL

SEQ ID NO: 344217 - protein, 9 aa, Homo Sapiens
YIHDNAKFQ

SEQ ID NO: 344218 - protein, 9 aa, Homo Sapiens
FPRGFKFNT

SEQ ID NO: 344219 - protein, 9 aa, Homo Sapiens
QYFRFHADK

SEQ ID NO: 344220 - protein, 9 aa, Homo Sapiens
QISEDSPIR

SEQ ID NO: 344221 - protein, 9 aa, Homo Sapiens
AQLVACQRS

SEQ ID NO: 344222 - protein, 9 aa, Homo Sapiens
LDEEEELST

SEQ ID NO: 344223 - protein, 9 aa, Homo Sapiens
RSTQIVEEA

SEQ ID NO: 344224 - protein, 9 aa, Homo Sapiens
ADKKDIAES

SEQ ID NO: 344225 - protein, 9 aa, Homo Sapiens
MAKYFPVFS

SEQ ID NO: 344226 - protein, 9 aa, Homo Sapiens
NEETDSTKE

SEQ ID NO: 344227 - protein, 9 aa, Homo Sapiens
QQNVLKVLT

SEQ ID NO: 344228 - protein, 9 aa, Homo Sapiens
EKWMDRYKI

SEQ ID NO: 344229 - protein, 9 aa, Homo Sapiens
FYQCIYGRK

SEQ ID NO: 344230 - protein, 9 aa, Homo Sapiens
IFAFEESIG

SEQ ID NO: 344231 - protein, 9 aa, Homo Sapiens
TQHLQIEKS

SEQ ID NO: 344232 - protein, 9 aa, Homo Sapiens
HNTPNLAAN

SEQ ID NO: 344233 - protein, 9 aa, Homo Sapiens
DCQSPDESH

SEQ ID NO: 344234 - protein, 9 aa, Homo Sapiens
SICINSREL

SEQ ID NO: 344235 - protein, 9 aa, Homo Sapiens
SNLTTHKRT

SEQ ID NO: 344236 - protein, 9 aa, Homo Sapiens
QTRSHVARV

SEQ ID NO: 344237 - protein, 9 aa, Homo Sapiens
AEKLLCMYQ

SEQ ID NO: 344238 - protein, 9 aa, Homo Sapiens
AARCSMIDD

SEQ ID NO: 344239 - protein, 9 aa, Homo Sapiens
FRELITQLE

SEQ ID NO: 344240 - protein, 9 aa, Homo Sapiens
ICFVCGIFF

SEQ ID NO: 344241 - protein, 9 aa, Homo Sapiens
DEWAEVDRK

SEQ ID NO: 344242 - protein, 9 aa, Homo Sapiens
KLDATEKDL

SEQ ID NO: 344243 - protein, 9 aa, Homo Sapiens
YEEAQKHLK

SEQ ID NO: 344244 - protein, 9 aa, Homo Sapiens
GTSDQIRFT

SEQ ID NO: 344245 - protein, 9 aa, Homo Sapiens
ILLGYLAMV

SEQ ID NO: 344246 - protein, 9 aa, Homo Sapiens
SQTHKERST

SEQ ID NO: 344247 - protein, 9 aa, Homo Sapiens
NEIIAAFDE

SEQ ID NO: 344248 - protein, 9 aa, Homo Sapiens
KLIHTGEKL

SEQ ID NO: 344249 - protein, 9 aa, Homo Sapiens
QCILWFLQQ

SEQ ID NO: 344250 - protein, 9 aa, Homo Sapiens
LPDEYKYCL

SEQ ID NO: 344251 - protein, 9 aa, Homo Sapiens
GGWLVHEEQ

SEQ ID NO: 344252 - protein, 9 aa, Homo Sapiens
LSVIATPRI

SEQ ID NO: 344253 - protein, 9 aa, Homo Sapiens
YTGQEDCLE

SEQ ID NO: 344254 - protein, 9 aa, Homo Sapiens
LIENTNGQL

SEQ ID NO: 344255 - protein, 9 aa, Homo Sapiens
RVPELVDFR

SEQ ID NO: 344256 - protein, 9 aa, Homo Sapiens
KFLKVESPA

SEQ ID NO: 344257 - protein, 9 aa, Homo Sapiens
AVKVYAINL

SEQ ID NO: 344258 - protein, 9 aa, Homo Sapiens
NNGNVILRH

SEQ ID NO: 344259 - protein, 9 aa, Homo Sapiens
SSELNTACR

SEQ ID NO: 344260 - protein, 9 aa, Homo Sapiens
NNVSPHAQP

SEQ ID NO: 344261 - protein, 9 aa, Homo Sapiens
VEKLPFVRK

SEQ ID NO: 344262 - protein, 9 aa, Homo Sapiens
RFTRVLLTR

SEQ ID NO: 344263 - protein, 9 aa, Homo Sapiens
FSSEYPELC

SEQ ID NO: 344264 - protein, 9 aa, Homo Sapiens
KHKLIHTGE

SEQ ID NO: 344265 - protein, 9 aa, Homo Sapiens
DMAHLPFLT

SEQ ID NO: 344266 - protein, 9 aa, Homo Sapiens
SKITMEPNP

SEQ ID NO: 344267 - protein, 9 aa, Homo Sapiens
NITVCMPSV

SEQ ID NO: 344268 - protein, 9 aa, Homo Sapiens
PKDNEARKG

SEQ ID NO: 344269 - protein, 9 aa, Homo Sapiens
IYQSSSDQT

SEQ ID NO: 344270 - protein, 9 aa, Homo Sapiens
TNILIYGNI

SEQ ID NO: 344271 - protein, 9 aa, Homo Sapiens
SLVLYLGSI

SEQ ID NO: 344272 - protein, 9 aa, Homo Sapiens
EEQNRSSLL

SEQ ID NO: 344273 - protein, 9 aa, Homo Sapiens
RGSCSHPQL

SEQ ID NO: 344274 - protein, 9 aa, Homo Sapiens
IASSIMENT

SEQ ID NO: 344275 - protein, 9 aa, Homo Sapiens
PGDNSIFVT

SEQ ID NO: 344276 - protein, 9 aa, Homo Sapiens
PDGLACYWL

SEQ ID NO: 344277 - protein, 9 aa, Homo Sapiens
YPDKRFAQP

SEQ ID NO: 344278 - protein, 9 aa, Homo Sapiens
FLPKCIQAK

SEQ ID NO: 344279 - protein, 9 aa, Homo Sapiens
IALVVEICA

SEQ ID NO: 344280 - protein, 9 aa, Homo Sapiens
LYAYANSHS

SEQ ID NO: 344281 - protein, 9 aa, Homo Sapiens
PIEIQNCQK

SEQ ID NO: 344282 - protein, 9 aa, Homo Sapiens
FLRGYLLGQ

SEQ ID NO: 344283 - protein, 9 aa, Homo Sapiens
VDECKVYTG

SEQ ID NO: 344284 - protein, 9 aa, Homo Sapiens
HGVWSEPSQ

SEQ ID NO: 344285 - protein, 9 aa, Homo Sapiens
KVVVCVRPE

SEQ ID NO: 344286 - protein, 9 aa, Homo Sapiens
RSCLLTKNK

SEQ ID NO: 344287 - protein, 9 aa, Homo Sapiens
KELFLGLAL

SEQ ID NO: 344288 - protein, 9 aa, Homo Sapiens
CPSSPEELD

SEQ ID NO: 344289 - protein, 9 aa, Homo Sapiens
MSNIQQIIQ

SEQ ID NO: 344290 - protein, 9 aa, Homo Sapiens
SNEGCIRYK

SEQ ID NO: 344291 - protein, 9 aa, Homo Sapiens
SSISELSAQ

SEQ ID NO: 344292 - protein, 9 aa, Homo Sapiens
CTMRHSGTS

SEQ ID NO: 344293 - protein, 9 aa, Homo Sapiens
TPATSTDIT

SEQ ID NO: 344294 - protein, 9 aa, Homo Sapiens
NEATTDSTT

SEQ ID NO: 344295 - protein, 9 aa, Homo Sapiens
ALVDQGIFK

SEQ ID NO: 344296 - protein, 9 aa, Homo Sapiens
SHVGVYLSA

SEQ ID NO: 344297 - protein, 9 aa, Homo Sapiens
GRIRYNDMF

SEQ ID NO: 344298 - protein, 9 aa, Homo Sapiens
FVYKRIVPA

SEQ ID NO: 344299 - protein, 9 aa, Homo Sapiens
RCCDNDMKR

SEQ ID NO: 344300 - protein, 9 aa, Homo Sapiens
EVEANRIDV

SEQ ID NO: 344301 - protein, 9 aa, Homo Sapiens
VPPTIRRTF

SEQ ID NO: 344302 - protein, 9 aa, Homo Sapiens
QIKATVMDV

SEQ ID NO: 344303 - protein, 9 aa, Homo Sapiens
YECSKCGNS

SEQ ID NO: 344304 - protein, 9 aa, Homo Sapiens
VDGLIERQL

SEQ ID NO: 344305 - protein, 9 aa, Homo Sapiens
LELSKLCGS

SEQ ID NO: 344306 - protein, 9 aa, Homo Sapiens
KDVKYLKED

SEQ ID NO: 344307 - protein, 9 aa, Homo Sapiens
QRLSLKAEY

SEQ ID NO: 344308 - protein, 9 aa, Homo Sapiens
NQAGGSGSA

SEQ ID NO: 344309 - protein, 9 aa, Homo Sapiens
AAFLQPIQD

SEQ ID NO: 344310 - protein, 9 aa, Homo Sapiens
QPNRIMRLC

SEQ ID NO: 344311 - protein, 9 aa, Homo Sapiens
FVTKIIDGG

SEQ ID NO: 344312 - protein, 9 aa, Homo Sapiens
TTFLFSLSK

SEQ ID NO: 344313 - protein, 9 aa, Homo Sapiens
FFQEEMVKE

SEQ ID NO: 344314 - protein, 9 aa, Homo Sapiens
GSVEVIQTL

SEQ ID NO: 344315 - protein, 9 aa, Homo Sapiens
IINELIGLV

SEQ ID NO: 344316 - protein, 9 aa, Homo Sapiens
DRGPDDQES

SEQ ID NO: 344317 - protein, 9 aa, Homo Sapiens
QTEGRTQNH

SEQ ID NO: 344318 - protein, 9 aa, Homo Sapiens
HRRPEHHKI

SEQ ID NO: 344319 - protein, 9 aa, Homo Sapiens
VHHLGHNLG

SEQ ID NO: 344320 - protein, 9 aa, Homo Sapiens
YPELCSKTK

SEQ ID NO: 344321 - protein, 9 aa, Homo Sapiens
IIYTRENSY

SEQ ID NO: 344322 - protein, 9 aa, Homo Sapiens
YQIIRGLKY

SEQ ID NO: 344323 - protein, 9 aa, Homo Sapiens
VIIVMCNLC

SEQ ID NO: 344324 - protein, 9 aa, Homo Sapiens
LHLAVSKDN

SEQ ID NO: 344325 - protein, 9 aa, Homo Sapiens
AETIIQKTK

SEQ ID NO: 344326 - protein, 9 aa, Homo Sapiens
KLGKQQQWS

SEQ ID NO: 344327 - protein, 9 aa, Homo Sapiens
TDADNDVNT

SEQ ID NO: 344328 - protein, 9 aa, Homo Sapiens
QWPAWQSLN

SEQ ID NO: 344329 - protein, 9 aa, Homo Sapiens
MVGLCLISF

SEQ ID NO: 344330 - protein, 9 aa, Homo Sapiens
YIHHSGRTG

SEQ ID NO: 344331 - protein, 9 aa, Homo Sapiens
SFENVKVFE

SEQ ID NO: 344332 - protein, 9 aa, Homo Sapiens
EKPPQTQKE

SEQ ID NO: 344333 - protein, 9 aa, Homo Sapiens
INDHGPVPE

SEQ ID NO: 344334 - protein, 9 aa, Homo Sapiens
IDHGKPVNN

SEQ ID NO: 344335 - protein, 9 aa, Homo Sapiens
INKVNSEGK

SEQ ID NO: 344336 - protein, 9 aa, Homo Sapiens
ICEKVVNIP

SEQ ID NO: 344337 - protein, 9 aa, Homo Sapiens
MRQILEALH

SEQ ID NO: 344338 - protein, 9 aa, Homo Sapiens
NNLKKFLTR

SEQ ID NO: 344339 - protein, 9 aa, Homo Sapiens
PALQPIVHN

SEQ ID NO: 344340 - protein, 9 aa, Homo Sapiens
CRGPNYTSG

SEQ ID NO: 344341 - protein, 9 aa, Homo Sapiens
ADNDVNTYN

SEQ ID NO: 344342 - protein, 9 aa, Homo Sapiens
TLTCESNAN

SEQ ID NO: 344343 - protein, 9 aa, Homo Sapiens
PGRKVIEYN

SEQ ID NO: 344344 - protein, 9 aa, Homo Sapiens
YQKHNKQWY

SEQ ID NO: 344345 - protein, 9 aa, Homo Sapiens
WIPELNLVE

SEQ ID NO: 344346 - protein, 9 aa, Homo Sapiens
YRIIMNPRI

SEQ ID NO: 344347 - protein, 9 aa, Homo Sapiens
GQAYPVYQD

SEQ ID NO: 344348 - protein, 9 aa, Homo Sapiens
RVQALDRRT

SEQ ID NO: 344349 - protein, 9 aa, Homo Sapiens
IKSRDLPER

SEQ ID NO: 344350 - protein, 9 aa, Homo Sapiens
LSSSPQHLN

SEQ ID NO: 344351 - protein, 9 aa, Homo Sapiens
YHERTHTGD

SEQ ID NO: 344352 - protein, 9 aa, Homo Sapiens
GDIPSEASG

SEQ ID NO: 344353 - protein, 9 aa, Homo Sapiens
RSIELAYEG

SEQ ID NO: 344354 - protein, 9 aa, Homo Sapiens
YSRGPLGQH

SEQ ID NO: 344355 - protein, 9 aa, Homo Sapiens
LTEQTLPVT

SEQ ID NO: 344356 - protein, 9 aa, Homo Sapiens
LFKCNECGK

SEQ ID NO: 344357 - protein, 9 aa, Homo Sapiens
AAGLDRKKV

SEQ ID NO: 344358 - protein, 9 aa, Homo Sapiens
YDSTQQYRS

SEQ ID NO: 344359 - protein, 9 aa, Homo Sapiens
GVHNPQQHR

SEQ ID NO: 344360 - protein, 9 aa, Homo Sapiens
ADKLDLKKN

SEQ ID NO: 344361 - protein, 9 aa, Homo Sapiens
RDEKIFLLG

SEQ ID NO: 344362 - protein, 9 aa, Homo Sapiens
EQTILCNSL

SEQ ID NO: 344363 - protein, 9 aa, Homo Sapiens
NDSIMLVVE

SEQ ID NO: 344364 - protein, 9 aa, Homo Sapiens
FDDIACIRK

SEQ ID NO: 344365 - protein, 9 aa, Homo Sapiens
VFPITSIEQ

SEQ ID NO: 344366 - protein, 9 aa, Homo Sapiens
ESYNINDYS

SEQ ID NO: 344367 - protein, 9 aa, Homo Sapiens
SLTEHKRIN

SEQ ID NO: 344368 - protein, 9 aa, Homo Sapiens
FLNFLLFCA

SEQ ID NO: 344369 - protein, 9 aa, Homo Sapiens
SSREQPCGK

SEQ ID NO: 344370 - protein, 9 aa, Homo Sapiens
TMCQDSLPL

SEQ ID NO: 344371 - protein, 9 aa, Homo Sapiens
LVLWNWESS

SEQ ID NO: 344372 - protein, 9 aa, Homo Sapiens
KKTKQVERM

SEQ ID NO: 344373 - protein, 9 aa, Homo Sapiens
ATEKFIYDH

SEQ ID NO: 344374 - protein, 9 aa, Homo Sapiens
LDPGQFIDQ

SEQ ID NO: 344375 - protein, 9 aa, Homo Sapiens
FSDERVPCP

SEQ ID NO: 344376 - protein, 9 aa, Homo Sapiens
CNFIKKRLY

SEQ ID NO: 344377 - protein, 9 aa, Homo Sapiens
SAIQREYLN

SEQ ID NO: 344378 - protein, 9 aa, Homo Sapiens
ECLVHQSKI

SEQ ID NO: 344379 - protein, 9 aa, Homo Sapiens
TEKRKRQAE

SEQ ID NO: 344380 - protein, 9 aa, Homo Sapiens
QVSPSLDKG

SEQ ID NO: 344381 - protein, 9 aa, Homo Sapiens
CASCNEPLE

SEQ ID NO: 344382 - protein, 9 aa, Homo Sapiens
TLLKEIAKR

SEQ ID NO: 344383 - protein, 9 aa, Homo Sapiens
IQSLFLDKV

SEQ ID NO: 344384 - protein, 9 aa, Homo Sapiens
GALISDLEM

SEQ ID NO: 344385 - protein, 9 aa, Homo Sapiens
KTLRKPATL

SEQ ID NO: 344386 - protein, 9 aa, Homo Sapiens
LTRLRVLNI

SEQ ID NO: 344387 - protein, 9 aa, Homo Sapiens
RGQVTGKTV

SEQ ID NO: 344388 - protein, 9 aa, Homo Sapiens
YNRGDIPSE

SEQ ID NO: 344389 - protein, 9 aa, Homo Sapiens
QRVTLASGL

SEQ ID NO: 344390 - protein, 9 aa, Homo Sapiens
VQSICQLCG

SEQ ID NO: 344391 - protein, 9 aa, Homo Sapiens
DINLDIPRF

SEQ ID NO: 344392 - protein, 9 aa, Homo Sapiens
KLEFALELG

SEQ ID NO: 344393 - protein, 9 aa, Homo Sapiens
SVSSSDRIN

SEQ ID NO: 344394 - protein, 9 aa, Homo Sapiens
TDDEGAPQI

SEQ ID NO: 344395 - protein, 9 aa, Homo Sapiens
RSSLLEENK

SEQ ID NO: 344396 - protein, 9 aa, Homo Sapiens
CSGFLYCSP

SEQ ID NO: 344397 - protein, 9 aa, Homo Sapiens
GKPLEKETF

SEQ ID NO: 344398 - protein, 9 aa, Homo Sapiens
STGTCHHTQ

SEQ ID NO: 344399 - protein, 9 aa, Homo Sapiens
VHGIQIEFI

SEQ ID NO: 344400 - protein, 9 aa, Homo Sapiens
NLKNHDNSL

SEQ ID NO: 344401 - protein, 9 aa, Homo Sapiens
SITQGPPVD

SEQ ID NO: 344402 - protein, 9 aa, Homo Sapiens
AYTFRDPNK

SEQ ID NO: 344403 - protein, 9 aa, Homo Sapiens
TVRKLKLFF

SEQ ID NO: 344404 - protein, 9 aa, Homo Sapiens
GVSYCTREE

SEQ ID NO: 344405 - protein, 9 aa, Homo Sapiens
VVIQHQRAD

SEQ ID NO: 344406 - protein, 9 aa, Homo Sapiens
TEKEKRKQE

SEQ ID NO: 344407 - protein, 9 aa, Homo Sapiens
GPISPKNKK

SEQ ID NO: 344408 - protein, 9 aa, Homo Sapiens
HKQINKPQQ

SEQ ID NO: 344409 - protein, 9 aa, Homo Sapiens
LQKIKAIKL

SEQ ID NO: 344410 - protein, 9 aa, Homo Sapiens
DEDDDTLSY

SEQ ID NO: 344411 - protein, 9 aa, Homo Sapiens
GEDFPAARH

SEQ ID NO: 344412 - protein, 9 aa, Homo Sapiens
EGNTEQLPP

SEQ ID NO: 344413 - protein, 9 aa, Homo Sapiens
NQKENIPLK

SEQ ID NO: 344414 - protein, 9 aa, Homo Sapiens
VVCAPSSFF

SEQ ID NO: 344415 - protein, 9 aa, Homo Sapiens
FKQYSHSET

SEQ ID NO: 344416 - protein, 9 aa, Homo Sapiens
MFTQPEYRA

SEQ ID NO: 344417 - protein, 9 aa, Homo Sapiens
VIWAEVGNT

SEQ ID NO: 344418 - protein, 9 aa, Homo Sapiens
VKVNTVDKY

SEQ ID NO: 344419 - protein, 9 aa, Homo Sapiens
DRPGNLVYH

SEQ ID NO: 344420 - protein, 9 aa, Homo Sapiens
SVLFTGILY

SEQ ID NO: 344421 - protein, 9 aa, Homo Sapiens
TEQQRYSLS

SEQ ID NO: 344422 - protein, 9 aa, Homo Sapiens
AVITQSFCI

SEQ ID NO: 344423 - protein, 9 aa, Homo Sapiens
IAQRKDLAL

SEQ ID NO: 344424 - protein, 9 aa, Homo Sapiens
PVLVSGIIC

SEQ ID NO: 344425 - protein, 9 aa, Homo Sapiens
EQNTDCGGG

SEQ ID NO: 344426 - protein, 9 aa, Homo Sapiens
PSCILMAVL

SEQ ID NO: 344427 - protein, 9 aa, Homo Sapiens
LNSYSTSSK

SEQ ID NO: 344428 - protein, 9 aa, Homo Sapiens
RNLYTQNIK

SEQ ID NO: 344429 - protein, 9 aa, Homo Sapiens
LYWHLKRHL

SEQ ID NO: 344430 - protein, 9 aa, Homo Sapiens
INEDKWKPL

SEQ ID NO: 344431 - protein, 9 aa, Homo Sapiens
STICKMNKH

SEQ ID NO: 344432 - protein, 9 aa, Homo Sapiens
ESPARVRSS

SEQ ID NO: 344433 - protein, 9 aa, Homo Sapiens
EIKRADHPH

SEQ ID NO: 344434 - protein, 9 aa, Homo Sapiens
SLLEKKKKR

SEQ ID NO: 344435 - protein, 9 aa, Homo Sapiens
PKEALKMSV

SEQ ID NO: 344436 - protein, 9 aa, Homo Sapiens
EREASKIMK

SEQ ID NO: 344437 - protein, 9 aa, Homo Sapiens
SSLAQAHEE

SEQ ID NO: 344438 - protein, 9 aa, Homo Sapiens
MAVLAVSSI

SEQ ID NO: 344439 - protein, 9 aa, Homo Sapiens
RQPTYVQAL

SEQ ID NO: 344440 - protein, 9 aa, Homo Sapiens
CPTGWRGRP

SEQ ID NO: 344441 - protein, 9 aa, Homo Sapiens
LRKYNEVLQ

SEQ ID NO: 344442 - protein, 9 aa, Homo Sapiens
GPPSGMIEA

SEQ ID NO: 344443 - protein, 9 aa, Homo Sapiens
LRAHLDGTC

SEQ ID NO: 344444 - protein, 9 aa, Homo Sapiens
QARRQQHTS

SEQ ID NO: 344445 - protein, 9 aa, Homo Sapiens
PHSKAISES

SEQ ID NO: 344446 - protein, 9 aa, Homo Sapiens
FSVFNNDAA

SEQ ID NO: 344447 - protein, 9 aa, Homo Sapiens
SRDECKIIL

SEQ ID NO: 344448 - protein, 9 aa, Homo Sapiens
VLTLEQIKF

SEQ ID NO: 344449 - protein, 9 aa, Homo Sapiens
RTNTWKDHV

SEQ ID NO: 344450 - protein, 9 aa, Homo Sapiens
WLPPLSPVF

SEQ ID NO: 344451 - protein, 9 aa, Homo Sapiens
KITGSSPGW

SEQ ID NO: 344452 - protein, 9 aa, Homo Sapiens
KPSLISWLD

SEQ ID NO: 344453 - protein, 9 aa, Homo Sapiens
NEECLLLER

SEQ ID NO: 344454 - protein, 9 aa, Homo Sapiens
TVSPEQNNR

SEQ ID NO: 344455 - protein, 9 aa, Homo Sapiens
DVSYSNINN

SEQ ID NO: 344456 - protein, 9 aa, Homo Sapiens
GPIIKLMII

SEQ ID NO: 344457 - protein, 9 aa, Homo Sapiens
IHMDCLRWL

SEQ ID NO: 344458 - protein, 9 aa, Homo Sapiens
EAACHRLAN

SEQ ID NO: 344459 - protein, 9 aa, Homo Sapiens
HKKIRTGEK

SEQ ID NO: 344460 - protein, 9 aa, Homo Sapiens
GIIVYQASY

SEQ ID NO: 344461 - protein, 9 aa, Homo Sapiens
KNKQFRSRG

SEQ ID NO: 344462 - protein, 9 aa, Homo Sapiens
TIVKKDAFW

SEQ ID NO: 344463 - protein, 9 aa, Homo Sapiens
VEQALKERM

SEQ ID NO: 344464 - protein, 9 aa, Homo Sapiens
VTVLLPSKW

SEQ ID NO: 344465 - protein, 9 aa, Homo Sapiens
KKSWKRCYF

SEQ ID NO: 344466 - protein, 9 aa, Homo Sapiens
DSHSEHERQ

SEQ ID NO: 344467 - protein, 9 aa, Homo Sapiens
KGKDHKSNS

SEQ ID NO: 344468 - protein, 9 aa, Homo Sapiens
AQKHLKMAE

SEQ ID NO: 344469 - protein, 9 aa, Homo Sapiens
ALLKTGGTT

SEQ ID NO: 344470 - protein, 9 aa, Homo Sapiens
FIADTHEKI

SEQ ID NO: 344471 - protein, 9 aa, Homo Sapiens
DNLQKTVIL

SEQ ID NO: 344472 - protein, 9 aa, Homo Sapiens
QTLRKRLEE

SEQ ID NO: 344473 - protein, 9 aa, Homo Sapiens
GVIKSIFAF

SEQ ID NO: 344474 - protein, 9 aa, Homo Sapiens
CYGSEQEFV

SEQ ID NO: 344475 - protein, 9 aa, Homo Sapiens
QAITSTLRE

SEQ ID NO: 344476 - protein, 9 aa, Homo Sapiens
DNFYAISYL

SEQ ID NO: 344477 - protein, 9 aa, Homo Sapiens
GMNRQINIL

SEQ ID NO: 344478 - protein, 9 aa, Homo Sapiens
HFFLYEEFP

SEQ ID NO: 344479 - protein, 9 aa, Homo Sapiens
LMFCMVGLC

SEQ ID NO: 344480 - protein, 9 aa, Homo Sapiens
PVAILMLAS

SEQ ID NO: 344481 - protein, 9 aa, Homo Sapiens
RKFVFQPEL

SEQ ID NO: 344482 - protein, 9 aa, Homo Sapiens
DDIDGINTN

SEQ ID NO: 344483 - protein, 9 aa, Homo Sapiens
VPERGHMDV

SEQ ID NO: 344484 - protein, 9 aa, Homo Sapiens
KEKNKVKES

SEQ ID NO: 344485 - protein, 9 aa, Homo Sapiens
NLRKQLEML

SEQ ID NO: 344486 - protein, 9 aa, Homo Sapiens
PEKVFHELF

SEQ ID NO: 344487 - protein, 9 aa, Homo Sapiens
HISEAVFLV

SEQ ID NO: 344488 - protein, 9 aa, Homo Sapiens
LDQNVHEKK

SEQ ID NO: 344489 - protein, 9 aa, Homo Sapiens
NPATDVGKI

SEQ ID NO: 344490 - protein, 9 aa, Homo Sapiens
LQNNLDATV

SEQ ID NO: 344491 - protein, 9 aa, Homo Sapiens
GSYTFEKNF

SEQ ID NO: 344492 - protein, 9 aa, Homo Sapiens
QRGHLRDDI

SEQ ID NO: 344493 - protein, 9 aa, Homo Sapiens
PTQADRRTS

SEQ ID NO: 344494 - protein, 9 aa, Homo Sapiens
AARANYQNG

SEQ ID NO: 344495 - protein, 9 aa, Homo Sapiens
WLIFSIVGV

SEQ ID NO: 344496 - protein, 9 aa, Homo Sapiens
DKKLERVEE

SEQ ID NO: 344497 - protein, 9 aa, Homo Sapiens
PVPCGRWAN

SEQ ID NO: 344498 - protein, 9 aa, Homo Sapiens
SLTNLVKNQ

SEQ ID NO: 344499 - protein, 9 aa, Homo Sapiens
IELKKMLKS

SEQ ID NO: 344500 - protein, 9 aa, Homo Sapiens
RPTVNAYTL

SEQ ID NO: 344501 - protein, 9 aa, Homo Sapiens
TSWMEVNFT

SEQ ID NO: 344502 - protein, 9 aa, Homo Sapiens
AELKDRKAS

SEQ ID NO: 344503 - protein, 9 aa, Homo Sapiens
NIYSIYPMH

SEQ ID NO: 344504 - protein, 9 aa, Homo Sapiens
EGKQGRILA

SEQ ID NO: 344505 - protein, 9 aa, Homo Sapiens
SDQIRFTVN

SEQ ID NO: 344506 - protein, 9 aa, Homo Sapiens
VAVKMLKLD

SEQ ID NO: 344507 - protein, 9 aa, Homo Sapiens
ITEIPLINI

SEQ ID NO: 344508 - protein, 9 aa, Homo Sapiens
NPRSQLRQF

SEQ ID NO: 344509 - protein, 9 aa, Homo Sapiens
LSWRLYKHT

SEQ ID NO: 344510 - protein, 9 aa, Homo Sapiens
ERALLNTHV

SEQ ID NO: 344511 - protein, 9 aa, Homo Sapiens
NKMKEQEYW

SEQ ID NO: 344512 - protein, 9 aa, Homo Sapiens
NLAKKDLEK

SEQ ID NO: 344513 - protein, 9 aa, Homo Sapiens
NCGHHKDAG

SEQ ID NO: 344514 - protein, 9 aa, Homo Sapiens
AKEDAQAEI

SEQ ID NO: 344515 - protein, 9 aa, Homo Sapiens
LFIFLGGAC

SEQ ID NO: 344516 - protein, 9 aa, Homo Sapiens
SHECTRRPA

SEQ ID NO: 344517 - protein, 9 aa, Homo Sapiens
AEEICHMFH

SEQ ID NO: 344518 - protein, 9 aa, Homo Sapiens
IDKMTNKMQ

SEQ ID NO: 344519 - protein, 9 aa, Homo Sapiens
QIQKELERE

SEQ ID NO: 344520 - protein, 9 aa, Homo Sapiens
GQMLCNLGT

SEQ ID NO: 344521 - protein, 9 aa, Homo Sapiens
KSPDYLEFS

SEQ ID NO: 344522 - protein, 9 aa, Homo Sapiens
KVNDGEWYN

SEQ ID NO: 344523 - protein, 9 aa, Homo Sapiens
VEEEKNKRQ

SEQ ID NO: 344524 - protein, 9 aa, Homo Sapiens
EIWEEFLMS

SEQ ID NO: 344525 - protein, 9 aa, Homo Sapiens
KEAQKEMQT

SEQ ID NO: 344526 - protein, 9 aa, Homo Sapiens
FCVEHHTFF

SEQ ID NO: 344527 - protein, 9 aa, Homo Sapiens
SSLVMLNEV

SEQ ID NO: 344528 - protein, 9 aa, Homo Sapiens
LKEGDEKLD

SEQ ID NO: 344529 - protein, 9 aa, Homo Sapiens
ILLQCNTED

SEQ ID NO: 344530 - protein, 9 aa, Homo Sapiens
QTIELKKML

SEQ ID NO: 344531 - protein, 9 aa, Homo Sapiens
HRQVRILQD

SEQ ID NO: 344532 - protein, 9 aa, Homo Sapiens
HRLILHAAK

SEQ ID NO: 344533 - protein, 9 aa, Homo Sapiens
VGVSHKARG

SEQ ID NO: 344534 - protein, 9 aa, Homo Sapiens
LVSSSGNDT

SEQ ID NO: 344535 - protein, 9 aa, Homo Sapiens
MLSFSRYPK

SEQ ID NO: 344536 - protein, 9 aa, Homo Sapiens
NGKEMKNKV

SEQ ID NO: 344537 - protein, 9 aa, Homo Sapiens
LPEEDVTHL

SEQ ID NO: 344538 - protein, 9 aa, Homo Sapiens
QADVAFHFN

SEQ ID NO: 344539 - protein, 9 aa, Homo Sapiens
SCDTFLNVF

SEQ ID NO: 344540 - protein, 9 aa, Homo Sapiens
GVQDDMIIA

SEQ ID NO: 344541 - protein, 9 aa, Homo Sapiens
SLQKHVKTV

SEQ ID NO: 344542 - protein, 9 aa, Homo Sapiens
KNISIFDFS

SEQ ID NO: 344543 - protein, 9 aa, Homo Sapiens
QQNSSVFIK

SEQ ID NO: 344544 - protein, 9 aa, Homo Sapiens
TMSLGCCVV

SEQ ID NO: 344545 - protein, 9 aa, Homo Sapiens
HTKKAVSRS

SEQ ID NO: 344546 - protein, 9 aa, Homo Sapiens
TKGNVFVWL

SEQ ID NO: 344547 - protein, 9 aa, Homo Sapiens
EDVIVWMRT

SEQ ID NO: 344548 - protein, 9 aa, Homo Sapiens
FYSPLGMPD

SEQ ID NO: 344549 - protein, 9 aa, Homo Sapiens
APQYAMAAR

SEQ ID NO: 344550 - protein, 9 aa, Homo Sapiens
HNGKFREFF

SEQ ID NO: 344551 - protein, 9 aa, Homo Sapiens
ELFRYFRVP

SEQ ID NO: 344552 - protein, 9 aa, Homo Sapiens
KCLCGAACG

SEQ ID NO: 344553 - protein, 9 aa, Homo Sapiens
REEANKFWH

SEQ ID NO: 344554 - protein, 9 aa, Homo Sapiens
ASYTGQEDC

SEQ ID NO: 344555 - protein, 9 aa, Homo Sapiens
ALHYCHDNN

SEQ ID NO: 344556 - protein, 9 aa, Homo Sapiens
LFVTIGDMD

SEQ ID NO: 344557 - protein, 9 aa, Homo Sapiens
STFPPHQET

SEQ ID NO: 344558 - protein, 9 aa, Homo Sapiens
ILELLWTVP

SEQ ID NO: 344559 - protein, 9 aa, Homo Sapiens
NLENINFKM

SEQ ID NO: 344560 - protein, 9 aa, Homo Sapiens
LGPPKHCPV

SEQ ID NO: 344561 - protein, 9 aa, Homo Sapiens
YSICSRRGT

SEQ ID NO: 344562 - protein, 9 aa, Homo Sapiens
KNHPKYWCQ

SEQ ID NO: 344563 - protein, 9 aa, Homo Sapiens
KRLYKSNKL

SEQ ID NO: 344564 - protein, 9 aa, Homo Sapiens
SHRDKHPVT

SEQ ID NO: 344565 - protein, 9 aa, Homo Sapiens
VIRFLREHS

SEQ ID NO: 344566 - protein, 9 aa, Homo Sapiens
YEAACHRLA

SEQ ID NO: 344567 - protein, 9 aa, Homo Sapiens
VILLACQIR

SEQ ID NO: 344568 - protein, 9 aa, Homo Sapiens
GVSEEFWLV

SEQ ID NO: 344569 - protein, 9 aa, Homo Sapiens
SSNNPQDDI

SEQ ID NO: 344570 - protein, 9 aa, Homo Sapiens
KICQVIRKY

SEQ ID NO: 344571 - protein, 9 aa, Homo Sapiens
PYPSSVVFV

SEQ ID NO: 344572 - protein, 9 aa, Homo Sapiens
SMFIADTHE

SEQ ID NO: 344573 - protein, 9 aa, Homo Sapiens
KVTFSCQEG

SEQ ID NO: 344574 - protein, 9 aa, Homo Sapiens
PPLLLLSVC

SEQ ID NO: 344575 - protein, 9 aa, Homo Sapiens
EIPLGSYYS

SEQ ID NO: 344576 - protein, 9 aa, Homo Sapiens
CHIGVLRHT

SEQ ID NO: 344577 - protein, 9 aa, Homo Sapiens
AVGRDTNRP

SEQ ID NO: 344578 - protein, 9 aa, Homo Sapiens
KRRSRSRNI

SEQ ID NO: 344579 - protein, 9 aa, Homo Sapiens
GLADFIAKK

SEQ ID NO: 344580 - protein, 9 aa, Homo Sapiens
ILNRSKIGW

SEQ ID NO: 344581 - protein, 9 aa, Homo Sapiens
SLVSAPGLV

SEQ ID NO: 344582 - protein, 9 aa, Homo Sapiens
QFGAQVHQR

SEQ ID NO: 344583 - protein, 9 aa, Homo Sapiens
DYFEKVTLR

SEQ ID NO: 344584 - protein, 9 aa, Homo Sapiens
LSSLAQAHE

SEQ ID NO: 344585 - protein, 9 aa, Homo Sapiens
FMQLLLREL

SEQ ID NO: 344586 - protein, 9 aa, Homo Sapiens
LSFPIRRDN

SEQ ID NO: 344587 - protein, 9 aa, Homo Sapiens
CIQAYFYDL

SEQ ID NO: 344588 - protein, 9 aa, Homo Sapiens
PRLSRRTLH

SEQ ID NO: 344589 - protein, 9 aa, Homo Sapiens
HTDEEIANH

SEQ ID NO: 344590 - protein, 9 aa, Homo Sapiens
GECKCKDTW

SEQ ID NO: 344591 - protein, 9 aa, Homo Sapiens
LYAPPKEKG

SEQ ID NO: 344592 - protein, 9 aa, Homo Sapiens
CKPDNGKEC

SEQ ID NO: 344593 - protein, 9 aa, Homo Sapiens
SQKEFVRFL

SEQ ID NO: 344594 - protein, 9 aa, Homo Sapiens
YYRQRHRHE

SEQ ID NO: 344595 - protein, 9 aa, Homo Sapiens
GFTLKIFAN

SEQ ID NO: 344596 - protein, 9 aa, Homo Sapiens
LHAAKHQDS

SEQ ID NO: 344597 - protein, 9 aa, Homo Sapiens
FNSSSVNKF

SEQ ID NO: 344598 - protein, 9 aa, Homo Sapiens
QKKRRIQLY

SEQ ID NO: 344599 - protein, 9 aa, Homo Sapiens
KTVPTANRS

SEQ ID NO: 344600 - protein, 9 aa, Homo Sapiens
RSTGKKNGK

SEQ ID NO: 344601 - protein, 9 aa, Homo Sapiens
GPRQGGGMP

SEQ ID NO: 344602 - protein, 9 aa, Homo Sapiens
FEAFLNSYS

SEQ ID NO: 344603 - protein, 9 aa, Homo Sapiens
KGNVFVWLL

SEQ ID NO: 344604 - protein, 9 aa, Homo Sapiens
DKIMALRNE

SEQ ID NO: 344605 - protein, 9 aa, Homo Sapiens
YTTQVQKLQ

SEQ ID NO: 344606 - protein, 9 aa, Homo Sapiens
ASENKCIHT

SEQ ID NO: 344607 - protein, 9 aa, Homo Sapiens
TPRMNLSLN

SEQ ID NO: 344608 - protein, 9 aa, Homo Sapiens
ADDIIIKGV

SEQ ID NO: 344609 - protein, 9 aa, Homo Sapiens
ESSQNSDLL

SEQ ID NO: 344610 - protein, 9 aa, Homo Sapiens
DEMAVQLDN

SEQ ID NO: 344611 - protein, 9 aa, Homo Sapiens
RDEHPAKCR

SEQ ID NO: 344612 - protein, 9 aa, Homo Sapiens
ITEKPPQTQ

SEQ ID NO: 344613 - protein, 9 aa, Homo Sapiens
FTNDIDKAL

SEQ ID NO: 344614 - protein, 9 aa, Homo Sapiens
SGKIKRTVT

SEQ ID NO: 344615 - protein, 9 aa, Homo Sapiens
SGSIKRSRY

SEQ ID NO: 344616 - protein, 9 aa, Homo Sapiens
TSSNLSRQL

SEQ ID NO: 344617 - protein, 9 aa, Homo Sapiens
HYYETVCMA

SEQ ID NO: 344618 - protein, 9 aa, Homo Sapiens
FCVIWTAGD

SEQ ID NO: 344619 - protein, 9 aa, Homo Sapiens
YLGMTLYWS

SEQ ID NO: 344620 - protein, 9 aa, Homo Sapiens
AIQITYYFQ

SEQ ID NO: 344621 - protein, 9 aa, Homo Sapiens
IRVTVTLFL

SEQ ID NO: 344622 - protein, 9 aa, Homo Sapiens
TFCSKNITI

SEQ ID NO: 344623 - protein, 9 aa, Homo Sapiens
CCHVSITEK

SEQ ID NO: 344624 - protein, 9 aa, Homo Sapiens
CLGKEGTDR

SEQ ID NO: 344625 - protein, 9 aa, Homo Sapiens
NFYAISYLY

SEQ ID NO: 344626 - protein, 9 aa, Homo Sapiens
SSALQSHER

SEQ ID NO: 344627 - protein, 9 aa, Homo Sapiens
EPPRQFFVD

SEQ ID NO: 344628 - protein, 9 aa, Homo Sapiens
EEAIEMYEG

SEQ ID NO: 344629 - protein, 9 aa, Homo Sapiens
PSDICAAET

SEQ ID NO: 344630 - protein, 9 aa, Homo Sapiens
NLQIANNSY

SEQ ID NO: 344631 - protein, 9 aa, Homo Sapiens
GRCISCDCN

SEQ ID NO: 344632 - protein, 9 aa, Homo Sapiens
YLYEFRHRP

SEQ ID NO: 344633 - protein, 9 aa, Homo Sapiens
GPSIFRVVG

SEQ ID NO: 344634 - protein, 9 aa, Homo Sapiens
LINGYTLMD

SEQ ID NO: 344635 - protein, 9 aa, Homo Sapiens
QIEERKAII

SEQ ID NO: 344636 - protein, 9 aa, Homo Sapiens
DQVSCIFAA

SEQ ID NO: 344637 - protein, 9 aa, Homo Sapiens
LAYKIKYPD

SEQ ID NO: 344638 - protein, 9 aa, Homo Sapiens
VNLRPGDNT

SEQ ID NO: 344639 - protein, 9 aa, Homo Sapiens
ETRPSVQEN

SEQ ID NO: 344640 - protein, 9 aa, Homo Sapiens
RNKFHFNIY

SEQ ID NO: 344641 - protein, 9 aa, Homo Sapiens
WRGLVAMAN

SEQ ID NO: 344642 - protein, 9 aa, Homo Sapiens
AWVAAMWHE

SEQ ID NO: 344643 - protein, 9 aa, Homo Sapiens
KQQNLHNCV

SEQ ID NO: 344644 - protein, 9 aa, Homo Sapiens
WRTEVAKNN

SEQ ID NO: 344645 - protein, 9 aa, Homo Sapiens
ENLKSCSEV

SEQ ID NO: 344646 - protein, 9 aa, Homo Sapiens
SRLLAADVL

SEQ ID NO: 344647 - protein, 9 aa, Homo Sapiens
RKVIEYNST

SEQ ID NO: 344648 - protein, 9 aa, Homo Sapiens
QKVSCHPFS

SEQ ID NO: 344649 - protein, 9 aa, Homo Sapiens
ILPTVRSTQ

SEQ ID NO: 344650 - protein, 9 aa, Homo Sapiens
PQMDFNSKP

SEQ ID NO: 344651 - protein, 9 aa, Homo Sapiens
VLVPLRGLP

SEQ ID NO: 344652 - protein, 9 aa, Homo Sapiens
YNKILAISL

SEQ ID NO: 344653 - protein, 9 aa, Homo Sapiens
GVFVGVSQV

SEQ ID NO: 344654 - protein, 9 aa, Homo Sapiens
FDCPMNQMS

SEQ ID NO: 344655 - protein, 9 aa, Homo Sapiens
RELEEGCYC

SEQ ID NO: 344656 - protein, 9 aa, Homo Sapiens
FERLLWQIC

SEQ ID NO: 344657 - protein, 9 aa, Homo Sapiens
KPFTLVCGS

SEQ ID NO: 344658 - protein, 9 aa, Homo Sapiens
EKLCYLPGH

SEQ ID NO: 344659 - protein, 9 aa, Homo Sapiens
TFEVKIFPP

SEQ ID NO: 344660 - protein, 9 aa, Homo Sapiens
RRKFGVSQE

SEQ ID NO: 344661 - protein, 9 aa, Homo Sapiens
EFGSEYGVL

SEQ ID NO: 344662 - protein, 9 aa, Homo Sapiens
KNSDVLVRT

SEQ ID NO: 344663 - protein, 9 aa, Homo Sapiens
LLKRSSKSL

SEQ ID NO: 344664 - protein, 9 aa, Homo Sapiens
QFLLKQRVS

SEQ ID NO: 344665 - protein, 9 aa, Homo Sapiens
HSEKSQIED

SEQ ID NO: 344666 - protein, 9 aa, Homo Sapiens
LIFCIQRFT

SEQ ID NO: 344667 - protein, 9 aa, Homo Sapiens
YFTCDNVLW

SEQ ID NO: 344668 - protein, 9 aa, Homo Sapiens
LFRLVSERN

SEQ ID NO: 344669 - protein, 9 aa, Homo Sapiens
QANNILVRV

SEQ ID NO: 344670 - protein, 9 aa, Homo Sapiens
VFQWPFSAL

SEQ ID NO: 344671 - protein, 9 aa, Homo Sapiens
FAGINSLLN

SEQ ID NO: 344672 - protein, 9 aa, Homo Sapiens
KTANGKGEK

SEQ ID NO: 344673 - protein, 9 aa, Homo Sapiens
RRTLNNSRL

SEQ ID NO: 344674 - protein, 9 aa, Homo Sapiens
LAIVCWSVL

SEQ ID NO: 344675 - protein, 9 aa, Homo Sapiens
ALYICDLST

SEQ ID NO: 344676 - protein, 9 aa, Homo Sapiens
AEQLLAAQN

SEQ ID NO: 344677 - protein, 9 aa, Homo Sapiens
PTLHPGLRA

SEQ ID NO: 344678 - protein, 9 aa, Homo Sapiens
GLQVFVTLP

SEQ ID NO: 344679 - protein, 9 aa, Homo Sapiens
FLVAQVQKL

SEQ ID NO: 344680 - protein, 9 aa, Homo Sapiens
KAYYAFRIY

SEQ ID NO: 344681 - protein, 9 aa, Homo Sapiens
KELVHARLS

SEQ ID NO: 344682 - protein, 9 aa, Homo Sapiens
MSRIIIVGT

SEQ ID NO: 344683 - protein, 9 aa, Homo Sapiens
VKDINNNPP

SEQ ID NO: 344684 - protein, 9 aa, Homo Sapiens
FSFFYFFFS

SEQ ID NO: 344685 - protein, 9 aa, Homo Sapiens
QMHWTPYRA

SEQ ID NO: 344686 - protein, 9 aa, Homo Sapiens
ARQSRRRFW

SEQ ID NO: 344687 - protein, 9 aa, Homo Sapiens
RKKTKQVER

SEQ ID NO: 344688 - protein, 9 aa, Homo Sapiens
GFINEDVIV

SEQ ID NO: 344689 - protein, 9 aa, Homo Sapiens
DQARALIRE

SEQ ID NO: 344690 - protein, 9 aa, Homo Sapiens
QSQAYFKLR

SEQ ID NO: 344691 - protein, 9 aa, Homo Sapiens
MHPEEHFIE

SEQ ID NO: 344692 - protein, 9 aa, Homo Sapiens
GKEMKNKVD

SEQ ID NO: 344693 - protein, 9 aa, Homo Sapiens
RHKIINTGE

SEQ ID NO: 344694 - protein, 9 aa, Homo Sapiens
AHLVLKRFP

SEQ ID NO: 344695 - protein, 9 aa, Homo Sapiens
SKHQITHEI

SEQ ID NO: 344696 - protein, 9 aa, Homo Sapiens
CHITARLDW

SEQ ID NO: 344697 - protein, 9 aa, Homo Sapiens
QKEEGNGYD

SEQ ID NO: 344698 - protein, 9 aa, Homo Sapiens
CKESFTGPI

SEQ ID NO: 344699 - protein, 9 aa, Homo Sapiens
KKEDRGPDD

SEQ ID NO: 344700 - protein, 9 aa, Homo Sapiens
GCRFCYVKT

SEQ ID NO: 344701 - protein, 9 aa, Homo Sapiens
SAGLWDIEN

SEQ ID NO: 344702 - protein, 9 aa, Homo Sapiens
VQYMLVVHM

SEQ ID NO: 344703 - protein, 9 aa, Homo Sapiens
RTIHVYPNF

SEQ ID NO: 344704 - protein, 9 aa, Homo Sapiens
QINKPQQNL

SEQ ID NO: 344705 - protein, 9 aa, Homo Sapiens
ASLSENEAS

SEQ ID NO: 344706 - protein, 9 aa, Homo Sapiens
NQKVSCHPF

SEQ ID NO: 344707 - protein, 9 aa, Homo Sapiens
PAPSEKSNE

SEQ ID NO: 344708 - protein, 9 aa, Homo Sapiens
NEPLETTCF

SEQ ID NO: 344709 - protein, 9 aa, Homo Sapiens
EDLGTAIKD

SEQ ID NO: 344710 - protein, 9 aa, Homo Sapiens
AETSFLSNV

SEQ ID NO: 344711 - protein, 9 aa, Homo Sapiens
FFTSLDPIN

SEQ ID NO: 344712 - protein, 9 aa, Homo Sapiens
PLGTCRGDK

SEQ ID NO: 344713 - protein, 9 aa, Homo Sapiens
FFIERHPSR

SEQ ID NO: 344714 - protein, 9 aa, Homo Sapiens
SEQSDLEEF

SEQ ID NO: 344715 - protein, 9 aa, Homo Sapiens
RKCCLYLFV

SEQ ID NO: 344716 - protein, 9 aa, Homo Sapiens
TETLKGTTE

SEQ ID NO: 344717 - protein, 9 aa, Homo Sapiens
EILWKRLSV

SEQ ID NO: 344718 - protein, 9 aa, Homo Sapiens
SRWCSQVKL

SEQ ID NO: 344719 - protein, 9 aa, Homo Sapiens
NNGLDLGED

SEQ ID NO: 344720 - protein, 9 aa, Homo Sapiens
QAMQEWQHT

SEQ ID NO: 344721 - protein, 9 aa, Homo Sapiens
RQIREARQK

SEQ ID NO: 344722 - protein, 9 aa, Homo Sapiens
LWHIQGCCA

SEQ ID NO: 344723 - protein, 9 aa, Homo Sapiens
FSYRTGQDT

SEQ ID NO: 344724 - protein, 9 aa, Homo Sapiens
RFLLLFWCL

SEQ ID NO: 344725 - protein, 9 aa, Homo Sapiens
VPYRRVEAP

SEQ ID NO: 344726 - protein, 9 aa, Homo Sapiens
SVHSIKFHP

SEQ ID NO: 344727 - protein, 9 aa, Homo Sapiens
LKLANEHIQ

SEQ ID NO: 344728 - protein, 9 aa, Homo Sapiens
IADCIRIEL

SEQ ID NO: 344729 - protein, 9 aa, Homo Sapiens
AKITDDSRW

SEQ ID NO: 344730 - protein, 9 aa, Homo Sapiens
VTSPSSAED

SEQ ID NO: 344731 - protein, 9 aa, Homo Sapiens
RMPSRSLRR

SEQ ID NO: 344732 - protein, 9 aa, Homo Sapiens
CHKPQRGEA

SEQ ID NO: 344733 - protein, 9 aa, Homo Sapiens
GHCHYERKG

SEQ ID NO: 344734 - protein, 9 aa, Homo Sapiens
NTELVGPAH

SEQ ID NO: 344735 - protein, 9 aa, Homo Sapiens
LDCEGDISL

SEQ ID NO: 344736 - protein, 9 aa, Homo Sapiens
YKKMPSIKS

SEQ ID NO: 344737 - protein, 9 aa, Homo Sapiens
PPTVMFSSF

SEQ ID NO: 344738 - protein, 9 aa, Homo Sapiens
ILNNPIVKV

SEQ ID NO: 344739 - protein, 9 aa, Homo Sapiens
DRSTGKKNG

SEQ ID NO: 344740 - protein, 9 aa, Homo Sapiens
KEFIKTCVG

SEQ ID NO: 344741 - protein, 9 aa, Homo Sapiens
TPVQEFNRD

SEQ ID NO: 344742 - protein, 9 aa, Homo Sapiens
LYQRVSREG

SEQ ID NO: 344743 - protein, 9 aa, Homo Sapiens
RVASPKNKE

SEQ ID NO: 344744 - protein, 9 aa, Homo Sapiens
KFQPPRKAA

SEQ ID NO: 344745 - protein, 9 aa, Homo Sapiens
TGPQIHDGG

SEQ ID NO: 344746 - protein, 9 aa, Homo Sapiens
YASRFIVIT

SEQ ID NO: 344747 - protein, 9 aa, Homo Sapiens
PCHSDTLEH

SEQ ID NO: 344748 - protein, 9 aa, Homo Sapiens
GGLAISKGF

SEQ ID NO: 344749 - protein, 9 aa, Homo Sapiens
VKANAREWT

SEQ ID NO: 344750 - protein, 9 aa, Homo Sapiens
VMCISPEEL

SEQ ID NO: 344751 - protein, 9 aa, Homo Sapiens
AFLGPEMTV

SEQ ID NO: 344752 - protein, 9 aa, Homo Sapiens
MHTSSNLSR

SEQ ID NO: 344753 - protein, 9 aa, Homo Sapiens
QQHYAIYDS

SEQ ID NO: 344754 - protein, 9 aa, Homo Sapiens
NHSIATLAI

SEQ ID NO: 344755 - protein, 9 aa, Homo Sapiens
IRQLLLDCT

SEQ ID NO: 344756 - protein, 9 aa, Homo Sapiens
SVHISHDKQ

SEQ ID NO: 344757 - protein, 9 aa, Homo Sapiens
GGLAMGIDN

SEQ ID NO: 344758 - protein, 9 aa, Homo Sapiens
SYEFKFPFQ

SEQ ID NO: 344759 - protein, 9 aa, Homo Sapiens
YNQPKAMTS

SEQ ID NO: 344760 - protein, 9 aa, Homo Sapiens
FKSDIPFIF

SEQ ID NO: 344761 - protein, 9 aa, Homo Sapiens
LLARASTKK

SEQ ID NO: 344762 - protein, 9 aa, Homo Sapiens
PQAYQQLPA

SEQ ID NO: 344763 - protein, 9 aa, Homo Sapiens
IYDHYGREG

SEQ ID NO: 344764 - protein, 9 aa, Homo Sapiens
GHSKAVRDV

SEQ ID NO: 344765 - protein, 9 aa, Homo Sapiens
LFGGNNPFS

SEQ ID NO: 344766 - protein, 9 aa, Homo Sapiens
HLVSHLIIH

SEQ ID NO: 344767 - protein, 9 aa, Homo Sapiens
MNDRSTGKK

SEQ ID NO: 344768 - protein, 9 aa, Homo Sapiens
HKNFILSIG

SEQ ID NO: 344769 - protein, 9 aa, Homo Sapiens
AQHLDVTVG

SEQ ID NO: 344770 - protein, 9 aa, Homo Sapiens
GNAFNQDIT

SEQ ID NO: 344771 - protein, 9 aa, Homo Sapiens
IIVQRLLDF

SEQ ID NO: 344772 - protein, 9 aa, Homo Sapiens
TVIVAGYPP

SEQ ID NO: 344773 - protein, 9 aa, Homo Sapiens
VLGLHRSLP

SEQ ID NO: 344774 - protein, 9 aa, Homo Sapiens
LTTFQMTGS

SEQ ID NO: 344775 - protein, 9 aa, Homo Sapiens
LEHEARHSF

SEQ ID NO: 344776 - protein, 9 aa, Homo Sapiens
HHLGKMYSE

SEQ ID NO: 344777 - protein, 9 aa, Homo Sapiens
CHKCKNKQK

SEQ ID NO: 344778 - protein, 9 aa, Homo Sapiens
HRLSEALKR

SEQ ID NO: 344779 - protein, 9 aa, Homo Sapiens
LFPDFGLLL

SEQ ID NO: 344780 - protein, 9 aa, Homo Sapiens
KCNDIINWL

SEQ ID NO: 344781 - protein, 9 aa, Homo Sapiens
SFSWWSFTS

SEQ ID NO: 344782 - protein, 9 aa, Homo Sapiens
PACPSKSPV

SEQ ID NO: 344783 - protein, 9 aa, Homo Sapiens
VPVAAAKGR

SEQ ID NO: 344784 - protein, 9 aa, Homo Sapiens
SPQMDFNSK

SEQ ID NO: 344785 - protein, 9 aa, Homo Sapiens
RAREINCGF

SEQ ID NO: 344786 - protein, 9 aa, Homo Sapiens
NRRICPTKD

SEQ ID NO: 344787 - protein, 9 aa, Homo Sapiens
PYLCTPRHK

SEQ ID NO: 344788 - protein, 9 aa, Homo Sapiens
VNDTAPSEL

SEQ ID NO: 344789 - protein, 9 aa, Homo Sapiens
QKVDYLLEN

SEQ ID NO: 344790 - protein, 9 aa, Homo Sapiens
IIPDPEKPV

SEQ ID NO: 344791 - protein, 9 aa, Homo Sapiens
CLPVYYKQL

SEQ ID NO: 344792 - protein, 9 aa, Homo Sapiens
VGIICSYSK

SEQ ID NO: 344793 - protein, 9 aa, Homo Sapiens
SHIQEWYEF

SEQ ID NO: 344794 - protein, 9 aa, Homo Sapiens
PLIIFHAGY

SEQ ID NO: 344795 - protein, 9 aa, Homo Sapiens
LVSVGTIVG

SEQ ID NO: 344796 - protein, 9 aa, Homo Sapiens
FWKISAPPE

SEQ ID NO: 344797 - protein, 9 aa, Homo Sapiens
NHPKTQQYV

SEQ ID NO: 344798 - protein, 9 aa, Homo Sapiens
FTIDVNKQQ

SEQ ID NO: 344799 - protein, 9 aa, Homo Sapiens
ERCKEAERI

SEQ ID NO: 344800 - protein, 9 aa, Homo Sapiens
WKINYKGER

SEQ ID NO: 344801 - protein, 9 aa, Homo Sapiens
DQLPQHTFC

SEQ ID NO: 344802 - protein, 9 aa, Homo Sapiens
IPKDEHILW

SEQ ID NO: 344803 - protein, 9 aa, Homo Sapiens
DFFLSEHQI

SEQ ID NO: 344804 - protein, 9 aa, Homo Sapiens
LHSSEFLPP

SEQ ID NO: 344805 - protein, 9 aa, Homo Sapiens
EHSPPCSVL

SEQ ID NO: 344806 - protein, 9 aa, Homo Sapiens
VYGCDNPWA

SEQ ID NO: 344807 - protein, 9 aa, Homo Sapiens
FQVEFDNAT

SEQ ID NO: 344808 - protein, 9 aa, Homo Sapiens
EPTQDAFQG

SEQ ID NO: 344809 - protein, 9 aa, Homo Sapiens
SWCILGSKQ

SEQ ID NO: 344810 - protein, 9 aa, Homo Sapiens
EAPKIFKRI

SEQ ID NO: 344811 - protein, 9 aa, Homo Sapiens
QMNQLQGKK

SEQ ID NO: 344812 - protein, 9 aa, Homo Sapiens
NKQKSTKKF

SEQ ID NO: 344813 - protein, 9 aa, Homo Sapiens
YGNEKQRKQ

SEQ ID NO: 344814 - protein, 9 aa, Homo Sapiens
SSPFQRVRE

SEQ ID NO: 344815 - protein, 9 aa, Homo Sapiens
STNQNKCIE

SEQ ID NO: 344816 - protein, 9 aa, Homo Sapiens
IDGNESEFE

SEQ ID NO: 344817 - protein, 9 aa, Homo Sapiens
EKGLALGLL

SEQ ID NO: 344818 - protein, 9 aa, Homo Sapiens
EVVVRATCS

SEQ ID NO: 344819 - protein, 9 aa, Homo Sapiens
LGSGGKLSQ

SEQ ID NO: 344820 - protein, 9 aa, Homo Sapiens
TNLLGSIFP

SEQ ID NO: 344821 - protein, 9 aa, Homo Sapiens
ASQMHVYYL

SEQ ID NO: 344822 - protein, 9 aa, Homo Sapiens
MFALSTFEE

SEQ ID NO: 344823 - protein, 9 aa, Homo Sapiens
TSNSIDSVL

SEQ ID NO: 344824 - protein, 9 aa, Homo Sapiens
AACHRLANK

SEQ ID NO: 344825 - protein, 9 aa, Homo Sapiens
GRGGNQAGG

SEQ ID NO: 344826 - protein, 9 aa, Homo Sapiens
QACGADSYE

SEQ ID NO: 344827 - protein, 9 aa, Homo Sapiens
TSMTRLYYW

SEQ ID NO: 344828 - protein, 9 aa, Homo Sapiens
IKKGVCVCP

SEQ ID NO: 344829 - protein, 9 aa, Homo Sapiens
SSDRINSGA

SEQ ID NO: 344830 - protein, 9 aa, Homo Sapiens
LQLEKELVH

SEQ ID NO: 344831 - protein, 9 aa, Homo Sapiens
TSNQVRFMS

SEQ ID NO: 344832 - protein, 9 aa, Homo Sapiens
PKGCNLFIY

SEQ ID NO: 344833 - protein, 9 aa, Homo Sapiens
YNSSELNTA

SEQ ID NO: 344834 - protein, 9 aa, Homo Sapiens
AQDRAHRIR

SEQ ID NO: 344835 - protein, 9 aa, Homo Sapiens
TEKKANQLS

SEQ ID NO: 344836 - protein, 9 aa, Homo Sapiens
SPPCSVLPH

SEQ ID NO: 344837 - protein, 9 aa, Homo Sapiens
SIDSVLEKD

SEQ ID NO: 344838 - protein, 9 aa, Homo Sapiens
RHLLLECGK

SEQ ID NO: 344839 - protein, 9 aa, Homo Sapiens
QFPDTLSYL

SEQ ID NO: 344840 - protein, 9 aa, Homo Sapiens
FKELTSNNS

SEQ ID NO: 344841 - protein, 9 aa, Homo Sapiens
AVIHEVQCF

SEQ ID NO: 344842 - protein, 9 aa, Homo Sapiens
CQACDCDPR

SEQ ID NO: 344843 - protein, 9 aa, Homo Sapiens
SDYICCIAV

SEQ ID NO: 344844 - protein, 9 aa, Homo Sapiens
ESKDATKDA

SEQ ID NO: 344845 - protein, 9 aa, Homo Sapiens
MLILLAICR

SEQ ID NO: 344846 - protein, 9 aa, Homo Sapiens
SSWCILGSK

SEQ ID NO: 344847 - protein, 9 aa, Homo Sapiens
INFQSVGSS

SEQ ID NO: 344848 - protein, 9 aa, Homo Sapiens
IVVKINSRK

SEQ ID NO: 344849 - protein, 9 aa, Homo Sapiens
FILASTPSA

SEQ ID NO: 344850 - protein, 9 aa, Homo Sapiens
NRPYLCTPR

SEQ ID NO: 344851 - protein, 9 aa, Homo Sapiens
GSLKALCET

SEQ ID NO: 344852 - protein, 9 aa, Homo Sapiens
VYHSPGHNV

SEQ ID NO: 344853 - protein, 9 aa, Homo Sapiens
IKQLSDFEE

SEQ ID NO: 344854 - protein, 9 aa, Homo Sapiens
YEKSKEIHN

SEQ ID NO: 344855 - protein, 9 aa, Homo Sapiens
TKHIAGKII

SEQ ID NO: 344856 - protein, 9 aa, Homo Sapiens
SPGSLLHGH

SEQ ID NO: 344857 - protein, 9 aa, Homo Sapiens
GLEDDIVVV

SEQ ID NO: 344858 - protein, 9 aa, Homo Sapiens
GQVTGKTVG

SEQ ID NO: 344859 - protein, 9 aa, Homo Sapiens
SSFALSWRL

SEQ ID NO: 344860 - protein, 9 aa, Homo Sapiens
SSPFTETLK

SEQ ID NO: 344861 - protein, 9 aa, Homo Sapiens
KCGAQHVNN

SEQ ID NO: 344862 - protein, 9 aa, Homo Sapiens
LKDVKDVSI

SEQ ID NO: 344863 - protein, 9 aa, Homo Sapiens
GPPLKGYEV

SEQ ID NO: 344864 - protein, 9 aa, Homo Sapiens
KESAALQPF

SEQ ID NO: 344865 - protein, 9 aa, Homo Sapiens
YVLNQALIP

SEQ ID NO: 344866 - protein, 9 aa, Homo Sapiens
HLIQILETK

SEQ ID NO: 344867 - protein, 9 aa, Homo Sapiens
AKVTLQIDS

SEQ ID NO: 344868 - protein, 9 aa, Homo Sapiens
IICFLLIAT

SEQ ID NO: 344869 - protein, 9 aa, Homo Sapiens
LIKFKDNPH

SEQ ID NO: 344870 - protein, 9 aa, Homo Sapiens
DKTLMRKNP

SEQ ID NO: 344871 - protein, 9 aa, Homo Sapiens
PEELEAGTE

SEQ ID NO: 344872 - protein, 9 aa, Homo Sapiens
KESPLNHNS

SEQ ID NO: 344873 - protein, 9 aa, Homo Sapiens
QIRGTERPL

SEQ ID NO: 344874 - protein, 9 aa, Homo Sapiens
SSGLLIRMS

SEQ ID NO: 344875 - protein, 9 aa, Homo Sapiens
KDEKICQAF

SEQ ID NO: 344876 - protein, 9 aa, Homo Sapiens
GQQAASGHC

SEQ ID NO: 344877 - protein, 9 aa, Homo Sapiens
PVLNPSGDY

SEQ ID NO: 344878 - protein, 9 aa, Homo Sapiens
VTNYLSAHD

SEQ ID NO: 344879 - protein, 9 aa, Homo Sapiens
GFFLSDSQS

SEQ ID NO: 344880 - protein, 9 aa, Homo Sapiens
QQIIQENER

SEQ ID NO: 344881 - protein, 9 aa, Homo Sapiens
VTNMRTKLS

SEQ ID NO: 344882 - protein, 9 aa, Homo Sapiens
IGWVWNQMF

SEQ ID NO: 344883 - protein, 9 aa, Homo Sapiens
SLTLHMRNH

SEQ ID NO: 344884 - protein, 9 aa, Homo Sapiens
WNGSLKALC

SEQ ID NO: 344885 - protein, 9 aa, Homo Sapiens
VVVLSQNSR

SEQ ID NO: 344886 - protein, 9 aa, Homo Sapiens
DDYFHHKSD

SEQ ID NO: 344887 - protein, 9 aa, Homo Sapiens
TAFECMYSL

SEQ ID NO: 344888 - protein, 9 aa, Homo Sapiens
NEGASNPCL

SEQ ID NO: 344889 - protein, 9 aa, Homo Sapiens
YYVLYKAVS

SEQ ID NO: 344890 - protein, 9 aa, Homo Sapiens
LNTGMQTTE

SEQ ID NO: 344891 - protein, 9 aa, Homo Sapiens
RRRIVQSMI

SEQ ID NO: 344892 - protein, 9 aa, Homo Sapiens
PVLPFYCSP

SEQ ID NO: 344893 - protein, 9 aa, Homo Sapiens
DNKLLRMMI

SEQ ID NO: 344894 - protein, 9 aa, Homo Sapiens
YCWHSFENY

SEQ ID NO: 344895 - protein, 9 aa, Homo Sapiens
CLMVERCGK

SEQ ID NO: 344896 - protein, 9 aa, Homo Sapiens
TLFLFLLSA

SEQ ID NO: 344897 - protein, 9 aa, Homo Sapiens
VPVEPTYTS

SEQ ID NO: 344898 - protein, 9 aa, Homo Sapiens
KCLVNVGQF

SEQ ID NO: 344899 - protein, 9 aa, Homo Sapiens
KQKIPPPVA

SEQ ID NO: 344900 - protein, 9 aa, Homo Sapiens
LKEQEFRKQ

SEQ ID NO: 344901 - protein, 9 aa, Homo Sapiens
YKDHLEGQK

SEQ ID NO: 344902 - protein, 9 aa, Homo Sapiens
RIVHQRVHN

SEQ ID NO: 344903 - protein, 9 aa, Homo Sapiens
WNYTVRKQS

SEQ ID NO: 344904 - protein, 9 aa, Homo Sapiens
NKKEEYLTF

SEQ ID NO: 344905 - protein, 9 aa, Homo Sapiens
RNKAIIWHR

SEQ ID NO: 344906 - protein, 9 aa, Homo Sapiens
HNEPAQENM

SEQ ID NO: 344907 - protein, 9 aa, Homo Sapiens
DREMRNKKE

SEQ ID NO: 344908 - protein, 9 aa, Homo Sapiens
IGKGQFGEV

SEQ ID NO: 344909 - protein, 9 aa, Homo Sapiens
INTIPNIMF

SEQ ID NO: 344910 - protein, 9 aa, Homo Sapiens
EECTMIDPT

SEQ ID NO: 344911 - protein, 9 aa, Homo Sapiens
IQFTHANKP

SEQ ID NO: 344912 - protein, 9 aa, Homo Sapiens
YRFVSDQKE

SEQ ID NO: 344913 - protein, 9 aa, Homo Sapiens
KGRRKGQQA

SEQ ID NO: 344914 - protein, 9 aa, Homo Sapiens
EITYWLRND

SEQ ID NO: 344915 - protein, 9 aa, Homo Sapiens
AEMFGWNFV

SEQ ID NO: 344916 - protein, 9 aa, Homo Sapiens
TDVGKINLP

SEQ ID NO: 344917 - protein, 9 aa, Homo Sapiens
MILGLIIVQ

SEQ ID NO: 344918 - protein, 9 aa, Homo Sapiens
DSISFQINN

SEQ ID NO: 344919 - protein, 9 aa, Homo Sapiens
RSNNFLPHF

SEQ ID NO: 344920 - protein, 9 aa, Homo Sapiens
IDLGKIVEC

SEQ ID NO: 344921 - protein, 9 aa, Homo Sapiens
VYFDWTPAT

SEQ ID NO: 344922 - protein, 9 aa, Homo Sapiens
ELRSSYFSS

SEQ ID NO: 344923 - protein, 9 aa, Homo Sapiens
TSLGETWDN

SEQ ID NO: 344924 - protein, 9 aa, Homo Sapiens
MFVFAGLVD

SEQ ID NO: 344925 - protein, 9 aa, Homo Sapiens
HFLLPGKTN

SEQ ID NO: 344926 - protein, 9 aa, Homo Sapiens
QNHLDECNI

SEQ ID NO: 344927 - protein, 9 aa, Homo Sapiens
GLLPKKLPN

SEQ ID NO: 344928 - protein, 9 aa, Homo Sapiens
TCLLGRSIE

SEQ ID NO: 344929 - protein, 9 aa, Homo Sapiens
EIPPTDIMA

SEQ ID NO: 344930 - protein, 9 aa, Homo Sapiens
ICGQAYPVY

SEQ ID NO: 344931 - protein, 9 aa, Homo Sapiens
LFPIVMRLE

SEQ ID NO: 344932 - protein, 9 aa, Homo Sapiens
EEVKQASIQ

SEQ ID NO: 344933 - protein, 9 aa, Homo Sapiens
NQGLPLRQH

SEQ ID NO: 344934 - protein, 9 aa, Homo Sapiens
PVSLGAQQQ

SEQ ID NO: 344935 - protein, 9 aa, Homo Sapiens
TICKMNKHV

SEQ ID NO: 344936 - protein, 9 aa, Homo Sapiens
SNWLDEKKV

SEQ ID NO: 344937 - protein, 9 aa, Homo Sapiens
FLSNELSFP

SEQ ID NO: 344938 - protein, 9 aa, Homo Sapiens
FLDTALRRA

SEQ ID NO: 344939 - protein, 9 aa, Homo Sapiens
AQAREKCFT

SEQ ID NO: 344940 - protein, 9 aa, Homo Sapiens
GRINDILSN

SEQ ID NO: 344941 - protein, 9 aa, Homo Sapiens
VCLDLEYSP

SEQ ID NO: 344942 - protein, 9 aa, Homo Sapiens
MDRYKIDSL

SEQ ID NO: 344943 - protein, 9 aa, Homo Sapiens
LHIRKFTQE

SEQ ID NO: 344944 - protein, 9 aa, Homo Sapiens
NKLLLKGSQ

SEQ ID NO: 344945 - protein, 9 aa, Homo Sapiens
LVGIICSYS

SEQ ID NO: 344946 - protein, 9 aa, Homo Sapiens
LSELGVTFT

SEQ ID NO: 344947 - protein, 9 aa, Homo Sapiens
LIGRSHHYH

SEQ ID NO: 344948 - protein, 9 aa, Homo Sapiens
LHSKIEALL

SEQ ID NO: 344949 - protein, 9 aa, Homo Sapiens
MGKIFQTWF

SEQ ID NO: 344950 - protein, 9 aa, Homo Sapiens
YTGMMSSFR

SEQ ID NO: 344951 - protein, 9 aa, Homo Sapiens
FCIDNKALY

SEQ ID NO: 344952 - protein, 9 aa, Homo Sapiens
QHLEQCSIK

SEQ ID NO: 344953 - protein, 9 aa, Homo Sapiens
MMKEFRCEP

SEQ ID NO: 344954 - protein, 9 aa, Homo Sapiens
RKCVAHVCQ

SEQ ID NO: 344955 - protein, 9 aa, Homo Sapiens
IKADYYELD

SEQ ID NO: 344956 - protein, 9 aa, Homo Sapiens
SFFLEATNI

SEQ ID NO: 344957 - protein, 9 aa, Homo Sapiens
MFDLIDVYQ

SEQ ID NO: 344958 - protein, 9 aa, Homo Sapiens
DYGQNGMVT

SEQ ID NO: 344959 - protein, 9 aa, Homo Sapiens
VIFFCLFVH

SEQ ID NO: 344960 - protein, 9 aa, Homo Sapiens
PYLIFCIQR

SEQ ID NO: 344961 - protein, 9 aa, Homo Sapiens
LPFRKNKMK

SEQ ID NO: 344962 - protein, 9 aa, Homo Sapiens
TITAKSHKL

SEQ ID NO: 344963 - protein, 9 aa, Homo Sapiens
GQVREVCKE

SEQ ID NO: 344964 - protein, 9 aa, Homo Sapiens
PPAPPPTQG

SEQ ID NO: 344965 - protein, 9 aa, Homo Sapiens
KLAKSYGIP

SEQ ID NO: 344966 - protein, 9 aa, Homo Sapiens
MVPQTAPAG

SEQ ID NO: 344967 - protein, 9 aa, Homo Sapiens
ICVDCKGGS

SEQ ID NO: 344968 - protein, 9 aa, Homo Sapiens
SWDLQFPCL

SEQ ID NO: 344969 - protein, 9 aa, Homo Sapiens
KLIEKGVSK

SEQ ID NO: 344970 - protein, 9 aa, Homo Sapiens
METLPEEDV

SEQ ID NO: 344971 - protein, 9 aa, Homo Sapiens
EIYQKAFNL

SEQ ID NO: 344972 - protein, 9 aa, Homo Sapiens
YYYRQRHRH

SEQ ID NO: 344973 - protein, 9 aa, Homo Sapiens
SNLDVDIQL

SEQ ID NO: 344974 - protein, 9 aa, Homo Sapiens
PELNLVEHG

SEQ ID NO: 344975 - protein, 9 aa, Homo Sapiens
PNLGNTWYM

SEQ ID NO: 344976 - protein, 9 aa, Homo Sapiens
LCDHERTHT

SEQ ID NO: 344977 - protein, 9 aa, Homo Sapiens
AEAIQILAA

SEQ ID NO: 344978 - protein, 9 aa, Homo Sapiens
SMPVPYRRV

SEQ ID NO: 344979 - protein, 9 aa, Homo Sapiens
ATDADNDVN

SEQ ID NO: 344980 - protein, 9 aa, Homo Sapiens
FRVVGNLVA

SEQ ID NO: 344981 - protein, 9 aa, Homo Sapiens
GFKFNTDEL

SEQ ID NO: 344982 - protein, 9 aa, Homo Sapiens
ACHRLANKA

SEQ ID NO: 344983 - protein, 9 aa, Homo Sapiens
KVFLVHKIS

SEQ ID NO: 344984 - protein, 9 aa, Homo Sapiens
FLRDFTDNP

SEQ ID NO: 344985 - protein, 9 aa, Homo Sapiens
LVLCLQLGV

SEQ ID NO: 344986 - protein, 9 aa, Homo Sapiens
EPIPGEFEK

SEQ ID NO: 344987 - protein, 9 aa, Homo Sapiens
ICVFSQPGA

SEQ ID NO: 344988 - protein, 9 aa, Homo Sapiens
SITIYIAGN

SEQ ID NO: 344989 - protein, 9 aa, Homo Sapiens
TWDQTIIFN

SEQ ID NO: 344990 - protein, 9 aa, Homo Sapiens
SSQPASRPP

SEQ ID NO: 344991 - protein, 9 aa, Homo Sapiens
KGSMQNKKP

SEQ ID NO: 344992 - protein, 9 aa, Homo Sapiens
QCSIKAKPL

SEQ ID NO: 344993 - protein, 9 aa, Homo Sapiens
ICIECRQAF

SEQ ID NO: 344994 - protein, 9 aa, Homo Sapiens
IYGWRKCCL

SEQ ID NO: 344995 - protein, 9 aa, Homo Sapiens
LEWKLSASL

SEQ ID NO: 344996 - protein, 9 aa, Homo Sapiens
DFSLKLYHT

SEQ ID NO: 344997 - protein, 9 aa, Homo Sapiens
VNNLGVCGS

SEQ ID NO: 344998 - protein, 9 aa, Homo Sapiens
VARVQPKFL

SEQ ID NO: 344999 - protein, 9 aa, Homo Sapiens
HRSLPAVAR

SEQ ID NO: 345000 - protein, 9 aa, Homo Sapiens
KLMDVAPSE

SEQ ID NO: 345001 - protein, 9 aa, Homo Sapiens
TQLHFHFFH

SEQ ID NO: 345002 - protein, 9 aa, Homo Sapiens
QLICQQKKE

SEQ ID NO: 345003 - protein, 9 aa, Homo Sapiens
QNRVFHDFR

SEQ ID NO: 345004 - protein, 9 aa, Homo Sapiens
KLCNFGFAR

SEQ ID NO: 345005 - protein, 9 aa, Homo Sapiens
KTFLPKCIQ

SEQ ID NO: 345006 - protein, 9 aa, Homo Sapiens
ALTPLIKAG

SEQ ID NO: 345007 - protein, 9 aa, Homo Sapiens
TVCMPSVLT

SEQ ID NO: 345008 - protein, 9 aa, Homo Sapiens
SNLEGAYMC

SEQ ID NO: 345009 - protein, 9 aa, Homo Sapiens
RKIKENIQI

SEQ ID NO: 345010 - protein, 9 aa, Homo Sapiens
LFWTVIFTL

SEQ ID NO: 345011 - protein, 9 aa, Homo Sapiens
QNEKGEIEQ

SEQ ID NO: 345012 - protein, 9 aa, Homo Sapiens
SLGFKLTSV

SEQ ID NO: 345013 - protein, 9 aa, Homo Sapiens
GIQIDLRCP

SEQ ID NO: 345014 - protein, 9 aa, Homo Sapiens
EDPLQPPPL

SEQ ID NO: 345015 - protein, 9 aa, Homo Sapiens
QQNQYERKG

SEQ ID NO: 345016 - protein, 9 aa, Homo Sapiens
QQSQAYFKL

SEQ ID NO: 345017 - protein, 9 aa, Homo Sapiens
TIDWNTLYQ

SEQ ID NO: 345018 - protein, 9 aa, Homo Sapiens
GPYGIQSEY

SEQ ID NO: 345019 - protein, 9 aa, Homo Sapiens
MYLVSSAKT

SEQ ID NO: 345020 - protein, 9 aa, Homo Sapiens
QQIKEPVSD

SEQ ID NO: 345021 - protein, 9 aa, Homo Sapiens
SNGFVCPIC

SEQ ID NO: 345022 - protein, 9 aa, Homo Sapiens
TFSKAEAPE

SEQ ID NO: 345023 - protein, 9 aa, Homo Sapiens
TPGLCLTTF

SEQ ID NO: 345024 - protein, 9 aa, Homo Sapiens
VTGIYKLSL

SEQ ID NO: 345025 - protein, 9 aa, Homo Sapiens
QNVYCMAKD

SEQ ID NO: 345026 - protein, 9 aa, Homo Sapiens
LLQNAYREV

SEQ ID NO: 345027 - protein, 9 aa, Homo Sapiens
QLSSLTNLP

SEQ ID NO: 345028 - protein, 9 aa, Homo Sapiens
CGAAHRSLT

SEQ ID NO: 345029 - protein, 9 aa, Homo Sapiens
VDQQKTLDL

SEQ ID NO: 345030 - protein, 9 aa, Homo Sapiens
LGLALDMDR

SEQ ID NO: 345031 - protein, 9 aa, Homo Sapiens
LTFYATSYC

SEQ ID NO: 345032 - protein, 9 aa, Homo Sapiens
RGLDNEIKH

SEQ ID NO: 345033 - protein, 9 aa, Homo Sapiens
EEEEEEDVN

SEQ ID NO: 345034 - protein, 9 aa, Homo Sapiens
QNLIDCGQK

SEQ ID NO: 345035 - protein, 9 aa, Homo Sapiens
LDGDSQGLF

SEQ ID NO: 345036 - protein, 9 aa, Homo Sapiens
CNHKRKGSS

SEQ ID NO: 345037 - protein, 9 aa, Homo Sapiens
LVTISFVMK

SEQ ID NO: 345038 - protein, 9 aa, Homo Sapiens
AAFDELLLK

SEQ ID NO: 345039 - protein, 9 aa, Homo Sapiens
QNPGFQFSQ

SEQ ID NO: 345040 - protein, 9 aa, Homo Sapiens
RIRQQNEVR

SEQ ID NO: 345041 - protein, 9 aa, Homo Sapiens
RSQGRISVK

SEQ ID NO: 345042 - protein, 9 aa, Homo Sapiens
LCDQERQSA

SEQ ID NO: 345043 - protein, 9 aa, Homo Sapiens
QLYQKPEGN

SEQ ID NO: 345044 - protein, 9 aa, Homo Sapiens
SMIMSNIQQ

SEQ ID NO: 345045 - protein, 9 aa, Homo Sapiens
SASDLSDGD

SEQ ID NO: 345046 - protein, 9 aa, Homo Sapiens
TEECQKDWC

SEQ ID NO: 345047 - protein, 9 aa, Homo Sapiens
VNLRLILQQ

SEQ ID NO: 345048 - protein, 9 aa, Homo Sapiens
KSSKENWKR

SEQ ID NO: 345049 - protein, 9 aa, Homo Sapiens
HHPFLFFIR

SEQ ID NO: 345050 - protein, 9 aa, Homo Sapiens
KPVLLSKFP

SEQ ID NO: 345051 - protein, 9 aa, Homo Sapiens
GRGFSSKYP

SEQ ID NO: 345052 - protein, 9 aa, Homo Sapiens
VELTVEEIN

SEQ ID NO: 345053 - protein, 9 aa, Homo Sapiens
VSGEIRNIF

SEQ ID NO: 345054 - protein, 9 aa, Homo Sapiens
ERIDGLVLQ

SEQ ID NO: 345055 - protein, 9 aa, Homo Sapiens
QACKERQKR

SEQ ID NO: 345056 - protein, 9 aa, Homo Sapiens
PSGTQSSQE

SEQ ID NO: 345057 - protein, 9 aa, Homo Sapiens
PWHIQIGIL

SEQ ID NO: 345058 - protein, 9 aa, Homo Sapiens
KYIEIDALS

SEQ ID NO: 345059 - protein, 9 aa, Homo Sapiens
MEKDIMPDP

SEQ ID NO: 345060 - protein, 9 aa, Homo Sapiens
SPQKLPTSL

SEQ ID NO: 345061 - protein, 9 aa, Homo Sapiens
YSRSRYLKC

SEQ ID NO: 345062 - protein, 9 aa, Homo Sapiens
FQMAILLQC

SEQ ID NO: 345063 - protein, 9 aa, Homo Sapiens
RHPSRWPAM

SEQ ID NO: 345064 - protein, 9 aa, Homo Sapiens
VEYYIVSVC

SEQ ID NO: 345065 - protein, 9 aa, Homo Sapiens
DEVTESVYA

SEQ ID NO: 345066 - protein, 9 aa, Homo Sapiens
IKQKVDYLL

SEQ ID NO: 345067 - protein, 9 aa, Homo Sapiens
ELTVEEINL

SEQ ID NO: 345068 - protein, 9 aa, Homo Sapiens
AYIQDSRYH

SEQ ID NO: 345069 - protein, 9 aa, Homo Sapiens
KQKVDYLLE

SEQ ID NO: 345070 - protein, 9 aa, Homo Sapiens
QIFNLFSTN

SEQ ID NO: 345071 - protein, 9 aa, Homo Sapiens
IVIISHTLY

SEQ ID NO: 345072 - protein, 9 aa, Homo Sapiens
HSLNNATKA

SEQ ID NO: 345073 - protein, 9 aa, Homo Sapiens
GNCTMRHSG

SEQ ID NO: 345074 - protein, 9 aa, Homo Sapiens
RNLKLDNLV

SEQ ID NO: 345075 - protein, 9 aa, Homo Sapiens
DIIKNDNNT

SEQ ID NO: 345076 - protein, 9 aa, Homo Sapiens
NVQFSDDKD

SEQ ID NO: 345077 - protein, 9 aa, Homo Sapiens
DVTHLEVLQ

SEQ ID NO: 345078 - protein, 9 aa, Homo Sapiens
QSTQLDNPR

SEQ ID NO: 345079 - protein, 9 aa, Homo Sapiens
TSIDSLKEN

SEQ ID NO: 345080 - protein, 9 aa, Homo Sapiens
FIYVKPKQT

SEQ ID NO: 345081 - protein, 9 aa, Homo Sapiens
SYLYYLMSA

SEQ ID NO: 345082 - protein, 9 aa, Homo Sapiens
DFEGKQGRI

SEQ ID NO: 345083 - protein, 9 aa, Homo Sapiens
SGQIFCTAS

SEQ ID NO: 345084 - protein, 9 aa, Homo Sapiens
ESIGKGQFG

SEQ ID NO: 345085 - protein, 9 aa, Homo Sapiens
NLSLNLGGM

SEQ ID NO: 345086 - protein, 9 aa, Homo Sapiens
NHCRRVVCN

SEQ ID NO: 345087 - protein, 9 aa, Homo Sapiens
DEPDMKCDN

SEQ ID NO: 345088 - protein, 9 aa, Homo Sapiens
VESANNSVL

SEQ ID NO: 345089 - protein, 9 aa, Homo Sapiens
LCKCIKLWL

SEQ ID NO: 345090 - protein, 9 aa, Homo Sapiens
AAHMFFEGL

SEQ ID NO: 345091 - protein, 9 aa, Homo Sapiens
VGITAFCLA

SEQ ID NO: 345092 - protein, 9 aa, Homo Sapiens
SWRTNFDEL

SEQ ID NO: 345093 - protein, 9 aa, Homo Sapiens
KLANEHIQK

SEQ ID NO: 345094 - protein, 9 aa, Homo Sapiens
ALQGSLKIK

SEQ ID NO: 345095 - protein, 9 aa, Homo Sapiens
AEQRGKNAL

SEQ ID NO: 345096 - protein, 9 aa, Homo Sapiens
NMRTKLSFN

SEQ ID NO: 345097 - protein, 9 aa, Homo Sapiens
NSRPPEYEL

SEQ ID NO: 345098 - protein, 9 aa, Homo Sapiens
KEKIWDPAH

SEQ ID NO: 345099 - protein, 9 aa, Homo Sapiens
ILSIVGLFL

SEQ ID NO: 345100 - protein, 9 aa, Homo Sapiens
LPGSSYSPA

SEQ ID NO: 345101 - protein, 9 aa, Homo Sapiens
LVLNFQPQV

SEQ ID NO: 345102 - protein, 9 aa, Homo Sapiens
QKTRVFVVV

SEQ ID NO: 345103 - protein, 9 aa, Homo Sapiens
RQWSEKKKA

SEQ ID NO: 345104 - protein, 9 aa, Homo Sapiens
SLDFNGNED

SEQ ID NO: 345105 - protein, 9 aa, Homo Sapiens
NCPDELYAI

SEQ ID NO: 345106 - protein, 9 aa, Homo Sapiens
SEKQSIWIQ

SEQ ID NO: 345107 - protein, 9 aa, Homo Sapiens
FRASQFRSL

SEQ ID NO: 345108 - protein, 9 aa, Homo Sapiens
IKEYQSGWG

SEQ ID NO: 345109 - protein, 9 aa, Homo Sapiens
PTELTEMQN

SEQ ID NO: 345110 - protein, 9 aa, Homo Sapiens
ICRADIRGR

SEQ ID NO: 345111 - protein, 9 aa, Homo Sapiens
YSLIDKNKQ

SEQ ID NO: 345112 - protein, 9 aa, Homo Sapiens
NLSRQLIAQ

SEQ ID NO: 345113 - protein, 9 aa, Homo Sapiens
CKFVLMRAN

SEQ ID NO: 345114 - protein, 9 aa, Homo Sapiens
HTILLGYLA

SEQ ID NO: 345115 - protein, 9 aa, Homo Sapiens
TNQNKCIEM

SEQ ID NO: 345116 - protein, 9 aa, Homo Sapiens
HQFCSPGSL

SEQ ID NO: 345117 - protein, 9 aa, Homo Sapiens
IPPTDIMAE

SEQ ID NO: 345118 - protein, 9 aa, Homo Sapiens
DISLHVPPR

SEQ ID NO: 345119 - protein, 9 aa, Homo Sapiens
VLRELRVEL

SEQ ID NO: 345120 - protein, 9 aa, Homo Sapiens
MKKCSVSGC

SEQ ID NO: 345121 - protein, 9 aa, Homo Sapiens
ACYVWDYTD

SEQ ID NO: 345122 - protein, 9 aa, Homo Sapiens
RLLFTATRN

SEQ ID NO: 345123 - protein, 9 aa, Homo Sapiens
SFYPACVLL

SEQ ID NO: 345124 - protein, 9 aa, Homo Sapiens
VAICTILVP

SEQ ID NO: 345125 - protein, 9 aa, Homo Sapiens
CGWPACHIL

SEQ ID NO: 345126 - protein, 9 aa, Homo Sapiens
TLLFGQRAN

SEQ ID NO: 345127 - protein, 9 aa, Homo Sapiens
HLWHIQGCC

SEQ ID NO: 345128 - protein, 9 aa, Homo Sapiens
NFQNKGKSR

SEQ ID NO: 345129 - protein, 9 aa, Homo Sapiens
DDKDNAHYA

SEQ ID NO: 345130 - protein, 9 aa, Homo Sapiens
FHYFLLVLA

SEQ ID NO: 345131 - protein, 9 aa, Homo Sapiens
TTVLHKQIN

SEQ ID NO: 345132 - protein, 9 aa, Homo Sapiens
DCDQDKHSD

SEQ ID NO: 345133 - protein, 9 aa, Homo Sapiens
GREKEIKEC

SEQ ID NO: 345134 - protein, 9 aa, Homo Sapiens
QKTGDAYKC

SEQ ID NO: 345135 - protein, 9 aa, Homo Sapiens
SERINLLED

SEQ ID NO: 345136 - protein, 9 aa, Homo Sapiens
PLKRLEKLL

SEQ ID NO: 345137 - protein, 9 aa, Homo Sapiens
QIFCTASLI

SEQ ID NO: 345138 - protein, 9 aa, Homo Sapiens
QSSLLNLSL

SEQ ID NO: 345139 - protein, 9 aa, Homo Sapiens
IAEKIQQQN

SEQ ID NO: 345140 - protein, 9 aa, Homo Sapiens
HSYPGFRIS

SEQ ID NO: 345141 - protein, 9 aa, Homo Sapiens
LIYLGFEHS

SEQ ID NO: 345142 - protein, 9 aa, Homo Sapiens
RDAMLHFSL

SEQ ID NO: 345143 - protein, 9 aa, Homo Sapiens
TCAHVGATL

SEQ ID NO: 345144 - protein, 9 aa, Homo Sapiens
EVFKVNKSS

SEQ ID NO: 345145 - protein, 9 aa, Homo Sapiens
FSSALKNNH

SEQ ID NO: 345146 - protein, 9 aa, Homo Sapiens
FNYLHNQNG

SEQ ID NO: 345147 - protein, 9 aa, Homo Sapiens
QHNRHSLQD

SEQ ID NO: 345148 - protein, 9 aa, Homo Sapiens
ISLDKQYKH

SEQ ID NO: 345149 - protein, 9 aa, Homo Sapiens
HKTPEYNIK

SEQ ID NO: 345150 - protein, 9 aa, Homo Sapiens
FIDICQSNS

SEQ ID NO: 345151 - protein, 9 aa, Homo Sapiens
ESAATCLLL

SEQ ID NO: 345152 - protein, 9 aa, Homo Sapiens
ARAGHSGKA

SEQ ID NO: 345153 - protein, 9 aa, Homo Sapiens
WAEVGNTIR

SEQ ID NO: 345154 - protein, 9 aa, Homo Sapiens
NQSSALNRH

SEQ ID NO: 345155 - protein, 9 aa, Homo Sapiens
EGERVYFDD

SEQ ID NO: 345156 - protein, 9 aa, Homo Sapiens
RSLHRVPLR

SEQ ID NO: 345157 - protein, 9 aa, Homo Sapiens
LQKLPPHLQ

SEQ ID NO: 345158 - protein, 9 aa, Homo Sapiens
NIAKNERRY

SEQ ID NO: 345159 - protein, 9 aa, Homo Sapiens
GCEYLASAL

SEQ ID NO: 345160 - protein, 9 aa, Homo Sapiens
MTAISDVEA

SEQ ID NO: 345161 - protein, 9 aa, Homo Sapiens
KLDERDAGI

SEQ ID NO: 345162 - protein, 9 aa, Homo Sapiens
AVIATEKKA

SEQ ID NO: 345163 - protein, 9 aa, Homo Sapiens
PKYLYAAGF

SEQ ID NO: 345164 - protein, 9 aa, Homo Sapiens
RSSTGSYED

SEQ ID NO: 345165 - protein, 9 aa, Homo Sapiens
LREHSQMDT

SEQ ID NO: 345166 - protein, 9 aa, Homo Sapiens
TIFIDEIYS

SEQ ID NO: 345167 - protein, 9 aa, Homo Sapiens
QENKHYANI

SEQ ID NO: 345168 - protein, 9 aa, Homo Sapiens
LIWMSKRYK

SEQ ID NO: 345169 - protein, 9 aa, Homo Sapiens
NVDIQMVKG

SEQ ID NO: 345170 - protein, 9 aa, Homo Sapiens
ICGTQGAEE

SEQ ID NO: 345171 - protein, 9 aa, Homo Sapiens
NSVNKKDLP

SEQ ID NO: 345172 - protein, 9 aa, Homo Sapiens
TRAERTNNW

SEQ ID NO: 345173 - protein, 9 aa, Homo Sapiens
SLGGTALQN

SEQ ID NO: 345174 - protein, 9 aa, Homo Sapiens
LLTLIDIND

SEQ ID NO: 345175 - protein, 9 aa, Homo Sapiens
PAHRVALAE

SEQ ID NO: 345176 - protein, 9 aa, Homo Sapiens
GTPAPFTSI

SEQ ID NO: 345177 - protein, 9 aa, Homo Sapiens
VPSIEFNAH

SEQ ID NO: 345178 - protein, 9 aa, Homo Sapiens
LPPLSPVFS

SEQ ID NO: 345179 - protein, 9 aa, Homo Sapiens
KFENELVLH

SEQ ID NO: 345180 - protein, 9 aa, Homo Sapiens
NKCQEQQQD

SEQ ID NO: 345181 - protein, 9 aa, Homo Sapiens
WGEGAQFDL

SEQ ID NO: 345182 - protein, 9 aa, Homo Sapiens
AARQFAVLD

SEQ ID NO: 345183 - protein, 9 aa, Homo Sapiens
SSLIHHQII

SEQ ID NO: 345184 - protein, 9 aa, Homo Sapiens
SQSPTDILI

SEQ ID NO: 345185 - protein, 9 aa, Homo Sapiens
FVSLTETAL

SEQ ID NO: 345186 - protein, 9 aa, Homo Sapiens
AVLLARINN

SEQ ID NO: 345187 - protein, 9 aa, Homo Sapiens
NKDITLEEM

SEQ ID NO: 345188 - protein, 9 aa, Homo Sapiens
RRSPPVAFT

SEQ ID NO: 345189 - protein, 9 aa, Homo Sapiens
KRCYFLLRA

SEQ ID NO: 345190 - protein, 9 aa, Homo Sapiens
LHKKRREKD

SEQ ID NO: 345191 - protein, 9 aa, Homo Sapiens
PNNGEFWFS

SEQ ID NO: 345192 - protein, 9 aa, Homo Sapiens
QSDDENIQN

SEQ ID NO: 345193 - protein, 9 aa, Homo Sapiens
TALHLAVSK

SEQ ID NO: 345194 - protein, 9 aa, Homo Sapiens
PEHVRKIIQ

SEQ ID NO: 345195 - protein, 9 aa, Homo Sapiens
LNVFVFLLG

SEQ ID NO: 345196 - protein, 9 aa, Homo Sapiens
EIMLALSSF

SEQ ID NO: 345197 - protein, 9 aa, Homo Sapiens
ECHLKIKTC

SEQ ID NO: 345198 - protein, 9 aa, Homo Sapiens
PSPASSLGE

SEQ ID NO: 345199 - protein, 9 aa, Homo Sapiens
RKKIIAYIP

SEQ ID NO: 345200 - protein, 9 aa, Homo Sapiens
VSSKECLQT

SEQ ID NO: 345201 - protein, 9 aa, Homo Sapiens
SNEETDSTK

SEQ ID NO: 345202 - protein, 9 aa, Homo Sapiens
KYWCQGYFR

SEQ ID NO: 345203 - protein, 9 aa, Homo Sapiens
QPPVVNPYD

SEQ ID NO: 345204 - protein, 9 aa, Homo Sapiens
VGCSNWKRI

SEQ ID NO: 345205 - protein, 9 aa, Homo Sapiens
KLAETSFLS

SEQ ID NO: 345206 - protein, 9 aa, Homo Sapiens
TGEASNFTR

SEQ ID NO: 345207 - protein, 9 aa, Homo Sapiens
TFHELGTEM

SEQ ID NO: 345208 - protein, 9 aa, Homo Sapiens
QEVLSPIPE

SEQ ID NO: 345209 - protein, 9 aa, Homo Sapiens
FTHANKPKG

SEQ ID NO: 345210 - protein, 9 aa, Homo Sapiens
HTTRWLTQA

SEQ ID NO: 345211 - protein, 9 aa, Homo Sapiens
CFKRTKEQM

SEQ ID NO: 345212 - protein, 9 aa, Homo Sapiens
ISKLNERCI

SEQ ID NO: 345213 - protein, 9 aa, Homo Sapiens
LFKTHDKDL

SEQ ID NO: 345214 - protein, 9 aa, Homo Sapiens
QGKYQNKAR

SEQ ID NO: 345215 - protein, 9 aa, Homo Sapiens
SINHQMWLL

SEQ ID NO: 345216 - protein, 9 aa, Homo Sapiens
SSISQVTAS

SEQ ID NO: 345217 - protein, 9 aa, Homo Sapiens
EEEEDKEEV

SEQ ID NO: 345218 - protein, 9 aa, Homo Sapiens
KAFRGAMDL

SEQ ID NO: 345219 - protein, 9 aa, Homo Sapiens
GPQAYQQLP

SEQ ID NO: 345220 - protein, 9 aa, Homo Sapiens
EVWLQYEKL

SEQ ID NO: 345221 - protein, 9 aa, Homo Sapiens
KDINKNKNV

SEQ ID NO: 345222 - protein, 9 aa, Homo Sapiens
LNSTNSGSG

SEQ ID NO: 345223 - protein, 9 aa, Homo Sapiens
EINLDDDDM

SEQ ID NO: 345224 - protein, 9 aa, Homo Sapiens
RHNKDTFLG

SEQ ID NO: 345225 - protein, 9 aa, Homo Sapiens
KEVPERGHM

SEQ ID NO: 345226 - protein, 9 aa, Homo Sapiens
SDQSEFREQ

SEQ ID NO: 345227 - protein, 9 aa, Homo Sapiens
AWPFPGVLE

SEQ ID NO: 345228 - protein, 9 aa, Homo Sapiens
HTFCVIWTA

SEQ ID NO: 345229 - protein, 9 aa, Homo Sapiens
AKSDKRTFL

SEQ ID NO: 345230 - protein, 9 aa, Homo Sapiens
HRLVVLFGD

SEQ ID NO: 345231 - protein, 9 aa, Homo Sapiens
LVMLNEVKR

SEQ ID NO: 345232 - protein, 9 aa, Homo Sapiens
GFSEGNTEQ

SEQ ID NO: 345233 - protein, 9 aa, Homo Sapiens
AQYLLDSNG

SEQ ID NO: 345234 - protein, 9 aa, Homo Sapiens
ASEQPLAIS

SEQ ID NO: 345235 - protein, 9 aa, Homo Sapiens
KDFDGTQAR

SEQ ID NO: 345236 - protein, 9 aa, Homo Sapiens
DAYELFTSL

SEQ ID NO: 345237 - protein, 9 aa, Homo Sapiens
YTSKWTNNY

SEQ ID NO: 345238 - protein, 9 aa, Homo Sapiens
DPAACGRIR

SEQ ID NO: 345239 - protein, 9 aa, Homo Sapiens
DQKEEGNGY

SEQ ID NO: 345240 - protein, 9 aa, Homo Sapiens
NTCFEWASF

SEQ ID NO: 345241 - protein, 9 aa, Homo Sapiens
LFKKSWWGD

SEQ ID NO: 345242 - protein, 9 aa, Homo Sapiens
LVTSMSGPS

SEQ ID NO: 345243 - protein, 9 aa, Homo Sapiens
TTGDATTRH

SEQ ID NO: 345244 - protein, 9 aa, Homo Sapiens
ALTQAICTG

SEQ ID NO: 345245 - protein, 9 aa, Homo Sapiens
WDLQFPCLT

SEQ ID NO: 345246 - protein, 9 aa, Homo Sapiens
KGEAHREGF

SEQ ID NO: 345247 - protein, 9 aa, Homo Sapiens
KDLKKFLKS

SEQ ID NO: 345248 - protein, 9 aa, Homo Sapiens
CLRKALLEK

SEQ ID NO: 345249 - protein, 9 aa, Homo Sapiens
CYIQYGNEK

SEQ ID NO: 345250 - protein, 9 aa, Homo Sapiens
DHDESICLI

SEQ ID NO: 345251 - protein, 9 aa, Homo Sapiens
QSFDDIACI

SEQ ID NO: 345252 - protein, 9 aa, Homo Sapiens
LINSMSKQA

SEQ ID NO: 345253 - protein, 9 aa, Homo Sapiens
LLQIPQSYN

SEQ ID NO: 345254 - protein, 9 aa, Homo Sapiens
FKKTVGDIL

SEQ ID NO: 345255 - protein, 9 aa, Homo Sapiens
GEIRNIFYL

SEQ ID NO: 345256 - protein, 9 aa, Homo Sapiens
SDVTPDNGP

SEQ ID NO: 345257 - protein, 9 aa, Homo Sapiens
NKLFGSVIF

SEQ ID NO: 345258 - protein, 9 aa, Homo Sapiens
KVAQAREKC

SEQ ID NO: 345259 - protein, 9 aa, Homo Sapiens
IKVIFIPSS

SEQ ID NO: 345260 - protein, 9 aa, Homo Sapiens
HKGVPNPID

SEQ ID NO: 345261 - protein, 9 aa, Homo Sapiens
GYTLNADNK

SEQ ID NO: 345262 - protein, 9 aa, Homo Sapiens
KEPQQDGGG

SEQ ID NO: 345263 - protein, 9 aa, Homo Sapiens
SNTTVVTPF

SEQ ID NO: 345264 - protein, 9 aa, Homo Sapiens
GVARLYRSR

SEQ ID NO: 345265 - protein, 9 aa, Homo Sapiens
EEPGEDKDS

SEQ ID NO: 345266 - protein, 9 aa, Homo Sapiens
HINQKCELC

SEQ ID NO: 345267 - protein, 9 aa, Homo Sapiens
CSGFEPPSW

SEQ ID NO: 345268 - protein, 9 aa, Homo Sapiens
GTARTMCQD

SEQ ID NO: 345269 - protein, 9 aa, Homo Sapiens
NVDFQRDGR

SEQ ID NO: 345270 - protein, 9 aa, Homo Sapiens
QMLHLHGTD

SEQ ID NO: 345271 - protein, 9 aa, Homo Sapiens
QKAFNLIEH

SEQ ID NO: 345272 - protein, 9 aa, Homo Sapiens
KCDACNLQF

SEQ ID NO: 345273 - protein, 9 aa, Homo Sapiens
GLMEMDQHI

SEQ ID NO: 345274 - protein, 9 aa, Homo Sapiens
VVGAGYPVQ

SEQ ID NO: 345275 - protein, 9 aa, Homo Sapiens
QTPARKLTA

SEQ ID NO: 345276 - protein, 9 aa, Homo Sapiens
EQLCTYQEG

SEQ ID NO: 345277 - protein, 9 aa, Homo Sapiens
LHLETEAGY

SEQ ID NO: 345278 - protein, 9 aa, Homo Sapiens
DILSNALKR

SEQ ID NO: 345279 - protein, 9 aa, Homo Sapiens
ANYVLNQAL

SEQ ID NO: 345280 - protein, 9 aa, Homo Sapiens
YNFKSDIWP

SEQ ID NO: 345281 - protein, 9 aa, Homo Sapiens
LTNLVKNQL

SEQ ID NO: 345282 - protein, 9 aa, Homo Sapiens
LYASVLLLT

SEQ ID NO: 345283 - protein, 9 aa, Homo Sapiens
YFKDFHSTA

SEQ ID NO: 345284 - protein, 9 aa, Homo Sapiens
LLSDQNKQV

SEQ ID NO: 345285 - protein, 9 aa, Homo Sapiens
DILSLYEVV

SEQ ID NO: 345286 - protein, 9 aa, Homo Sapiens
KPYGRKSKY

SEQ ID NO: 345287 - protein, 9 aa, Homo Sapiens
IIDTLELQS

SEQ ID NO: 345288 - protein, 9 aa, Homo Sapiens
TPGGFRCKC

SEQ ID NO: 345289 - protein, 9 aa, Homo Sapiens
TLTKYFTSS

SEQ ID NO: 345290 - protein, 9 aa, Homo Sapiens
TNESITQGP

SEQ ID NO: 345291 - protein, 9 aa, Homo Sapiens
LVPVSRRPP

SEQ ID NO: 345292 - protein, 9 aa, Homo Sapiens
KKGQFIDEL

SEQ ID NO: 345293 - protein, 9 aa, Homo Sapiens
STAPQLLIN

SEQ ID NO: 345294 - protein, 9 aa, Homo Sapiens
HPDSPLLCK

SEQ ID NO: 345295 - protein, 9 aa, Homo Sapiens
IINRQLIEA

SEQ ID NO: 345296 - protein, 9 aa, Homo Sapiens
KLCRQAGIW

SEQ ID NO: 345297 - protein, 9 aa, Homo Sapiens
DLDHNCSEN

SEQ ID NO: 345298 - protein, 9 aa, Homo Sapiens
LRPEDDILH

SEQ ID NO: 345299 - protein, 9 aa, Homo Sapiens
NKLDKKDLF

SEQ ID NO: 345300 - protein, 9 aa, Homo Sapiens
NVCRDRLEN

SEQ ID NO: 345301 - protein, 9 aa, Homo Sapiens
QKNRWDNND

SEQ ID NO: 345302 - protein, 9 aa, Homo Sapiens
PEMVSCIKI

SEQ ID NO: 345303 - protein, 9 aa, Homo Sapiens
YKFILNDGT

SEQ ID NO: 345304 - protein, 9 aa, Homo Sapiens
HVPVEIVKS

SEQ ID NO: 345305 - protein, 9 aa, Homo Sapiens
LPFVPGKTS

SEQ ID NO: 345306 - protein, 9 aa, Homo Sapiens
VFQPELFDV

SEQ ID NO: 345307 - protein, 9 aa, Homo Sapiens
CCECGKTFS

SEQ ID NO: 345308 - protein, 9 aa, Homo Sapiens
GSYYSGEHL

SEQ ID NO: 345309 - protein, 9 aa, Homo Sapiens
QNVLVDASA

SEQ ID NO: 345310 - protein, 9 aa, Homo Sapiens
IINTGEKPY

SEQ ID NO: 345311 - protein, 9 aa, Homo Sapiens
TFDGQHYSF

SEQ ID NO: 345312 - protein, 9 aa, Homo Sapiens
DKMHNSNTG

SEQ ID NO: 345313 - protein, 9 aa, Homo Sapiens
ELIEKQQRE

SEQ ID NO: 345314 - protein, 9 aa, Homo Sapiens
EEEESLVRC

SEQ ID NO: 345315 - protein, 9 aa, Homo Sapiens
LLLVIQLGC

SEQ ID NO: 345316 - protein, 9 aa, Homo Sapiens
SQLHKSDCN

SEQ ID NO: 345317 - protein, 9 aa, Homo Sapiens
LLNPFMYTI

SEQ ID NO: 345318 - protein, 9 aa, Homo Sapiens
SSCELELQV

SEQ ID NO: 345319 - protein, 9 aa, Homo Sapiens
KPLSCVVFI

SEQ ID NO: 345320 - protein, 9 aa, Homo Sapiens
FLALLMFAL

SEQ ID NO: 345321 - protein, 9 aa, Homo Sapiens
SWMLLVAKR

SEQ ID NO: 345322 - protein, 9 aa, Homo Sapiens
QAGIWVIMI

SEQ ID NO: 345323 - protein, 9 aa, Homo Sapiens
LLNTATVKE

SEQ ID NO: 345324 - protein, 9 aa, Homo Sapiens
TLQGEDIAF

SEQ ID NO: 345325 - protein, 9 aa, Homo Sapiens
PEQVVPIQD

SEQ ID NO: 345326 - protein, 9 aa, Homo Sapiens
GAGEHGLQE

SEQ ID NO: 345327 - protein, 9 aa, Homo Sapiens
KQFLKEINK

SEQ ID NO: 345328 - protein, 9 aa, Homo Sapiens
VTGIATSIV

SEQ ID NO: 345329 - protein, 9 aa, Homo Sapiens
GIIKSLILP

SEQ ID NO: 345330 - protein, 9 aa, Homo Sapiens
FKFYHLLNY

SEQ ID NO: 345331 - protein, 9 aa, Homo Sapiens
FCDCEIALI

SEQ ID NO: 345332 - protein, 9 aa, Homo Sapiens
QRLNNLLTD

SEQ ID NO: 345333 - protein, 9 aa, Homo Sapiens
TVWGTHLDL

SEQ ID NO: 345334 - protein, 9 aa, Homo Sapiens
VLGFNTSWE

SEQ ID NO: 345335 - protein, 9 aa, Homo Sapiens
TSYVTEVEA

SEQ ID NO: 345336 - protein, 9 aa, Homo Sapiens
DAYCTDLEE

SEQ ID NO: 345337 - protein, 9 aa, Homo Sapiens
VSKPLEDIK

SEQ ID NO: 345338 - protein, 9 aa, Homo Sapiens
YDLTLWCDY

SEQ ID NO: 345339 - protein, 9 aa, Homo Sapiens
FIIQNLKIN

SEQ ID NO: 345340 - protein, 9 aa, Homo Sapiens
ESLPPSCRN

SEQ ID NO: 345341 - protein, 9 aa, Homo Sapiens
DLDETIIIV

SEQ ID NO: 345342 - protein, 9 aa, Homo Sapiens
GLKLANEHI

SEQ ID NO: 345343 - protein, 9 aa, Homo Sapiens
WLHSKIEAL

SEQ ID NO: 345344 - protein, 9 aa, Homo Sapiens
SQNSNSYLS

SEQ ID NO: 345345 - protein, 9 aa, Homo Sapiens
FHRVVRHHK

SEQ ID NO: 345346 - protein, 9 aa, Homo Sapiens
FQHKWFEVA

SEQ ID NO: 345347 - protein, 9 aa, Homo Sapiens
HTRKFTHSI

SEQ ID NO: 345348 - protein, 9 aa, Homo Sapiens
RLAAGELCL

SEQ ID NO: 345349 - protein, 9 aa, Homo Sapiens
KYTIDVLNQ

SEQ ID NO: 345350 - protein, 9 aa, Homo Sapiens
ALMHTSSNL

SEQ ID NO: 345351 - protein, 9 aa, Homo Sapiens
PSHSPYKKK

SEQ ID NO: 345352 - protein, 9 aa, Homo Sapiens
KRIVPACFL

SEQ ID NO: 345353 - protein, 9 aa, Homo Sapiens
DNRKLHMEL

SEQ ID NO: 345354 - protein, 9 aa, Homo Sapiens
DLRTGLSTL

SEQ ID NO: 345355 - protein, 9 aa, Homo Sapiens
HGGMRDLHK

SEQ ID NO: 345356 - protein, 9 aa, Homo Sapiens
NGQLMANPE

SEQ ID NO: 345357 - protein, 9 aa, Homo Sapiens
IGYGSCLFI

SEQ ID NO: 345358 - protein, 9 aa, Homo Sapiens
GLDQYQHVP

SEQ ID NO: 345359 - protein, 9 aa, Homo Sapiens
AQQNKQIFL

SEQ ID NO: 345360 - protein, 9 aa, Homo Sapiens
LKRFNLCPE

SEQ ID NO: 345361 - protein, 9 aa, Homo Sapiens
VHTLVLGLV

SEQ ID NO: 345362 - protein, 9 aa, Homo Sapiens
NKPTVSVFS

SEQ ID NO: 345363 - protein, 9 aa, Homo Sapiens
SPLNHNSGW

SEQ ID NO: 345364 - protein, 9 aa, Homo Sapiens
GHQWDKIPL

SEQ ID NO: 345365 - protein, 9 aa, Homo Sapiens
LAGLQVFVT

SEQ ID NO: 345366 - protein, 9 aa, Homo Sapiens
HMKALSHLS

SEQ ID NO: 345367 - protein, 9 aa, Homo Sapiens
LTCSHGNYL

SEQ ID NO: 345368 - protein, 9 aa, Homo Sapiens
QFEEVIQEK

SEQ ID NO: 345369 - protein, 9 aa, Homo Sapiens
REAESGGLR

SEQ ID NO: 345370 - protein, 9 aa, Homo Sapiens
GITAFCLAQ

SEQ ID NO: 345371 - protein, 9 aa, Homo Sapiens
EECDKVLSR

SEQ ID NO: 345372 - protein, 9 aa, Homo Sapiens
IEWAKSDKR

SEQ ID NO: 345373 - protein, 9 aa, Homo Sapiens
GKAFSKSLN

SEQ ID NO: 345374 - protein, 9 aa, Homo Sapiens
INNNPPVFS

SEQ ID NO: 345375 - protein, 9 aa, Homo Sapiens
TGVRAQIIA

SEQ ID NO: 345376 - protein, 9 aa, Homo Sapiens
GCVKCQTLS

SEQ ID NO: 345377 - protein, 9 aa, Homo Sapiens
HQLKKEEQQ

SEQ ID NO: 345378 - protein, 9 aa, Homo Sapiens
DPGVSYCTR

SEQ ID NO: 345379 - protein, 9 aa, Homo Sapiens
KSIWEITVE

SEQ ID NO: 345380 - protein, 9 aa, Homo Sapiens
QADLSKDSL

SEQ ID NO: 345381 - protein, 9 aa, Homo Sapiens
LLDSNGHLP

SEQ ID NO: 345382 - protein, 9 aa, Homo Sapiens
REVCIVAQR

SEQ ID NO: 345383 - protein, 9 aa, Homo Sapiens
VTLKNKTSD

SEQ ID NO: 345384 - protein, 9 aa, Homo Sapiens
HVCQHNQLL

SEQ ID NO: 345385 - protein, 9 aa, Homo Sapiens
YYGCLHLVS

SEQ ID NO: 345386 - protein, 9 aa, Homo Sapiens
EALKSEEKD

SEQ ID NO: 345387 - protein, 9 aa, Homo Sapiens
PSLCLPEIN

SEQ ID NO: 345388 - protein, 9 aa, Homo Sapiens
FQTYGSATQ

SEQ ID NO: 345389 - protein, 9 aa, Homo Sapiens
ILEPHNGKF

SEQ ID NO: 345390 - protein, 9 aa, Homo Sapiens
EKLFKCNEC

SEQ ID NO: 345391 - protein, 9 aa, Homo Sapiens
INSLLNYLT

SEQ ID NO: 345392 - protein, 9 aa, Homo Sapiens
FFRVKMYPI

SEQ ID NO: 345393 - protein, 9 aa, Homo Sapiens
KETFLLMLQ

SEQ ID NO: 345394 - protein, 9 aa, Homo Sapiens
KLGLQNGKE

SEQ ID NO: 345395 - protein, 9 aa, Homo Sapiens
RVWQTRSHV

SEQ ID NO: 345396 - protein, 9 aa, Homo Sapiens
NSKNKEKLI

SEQ ID NO: 345397 - protein, 9 aa, Homo Sapiens
GFEPPSWRK

SEQ ID NO: 345398 - protein, 9 aa, Homo Sapiens
LDLCRFGSV

SEQ ID NO: 345399 - protein, 9 aa, Homo Sapiens
WIDRIHTPR

SEQ ID NO: 345400 - protein, 9 aa, Homo Sapiens
FLNHPALIC

SEQ ID NO: 345401 - protein, 9 aa, Homo Sapiens
EKELVHARL

SEQ ID NO: 345402 - protein, 9 aa, Homo Sapiens
FKLSGPFRQ

SEQ ID NO: 345403 - protein, 9 aa, Homo Sapiens
IGTLNGIFV

SEQ ID NO: 345404 - protein, 9 aa, Homo Sapiens
LWTVPIAGG

SEQ ID NO: 345405 - protein, 9 aa, Homo Sapiens
PHKAFPVLG

SEQ ID NO: 345406 - protein, 9 aa, Homo Sapiens
FRAHAASMF

SEQ ID NO: 345407 - protein, 9 aa, Homo Sapiens
NTNVDIQMV

SEQ ID NO: 345408 - protein, 9 aa, Homo Sapiens
VRAQIIAEP

SEQ ID NO: 345409 - protein, 9 aa, Homo Sapiens
AESSPFVEQ

SEQ ID NO: 345410 - protein, 9 aa, Homo Sapiens
KKSAVVMGR

SEQ ID NO: 345411 - protein, 9 aa, Homo Sapiens
DTDDEGAPQ

SEQ ID NO: 345412 - protein, 9 aa, Homo Sapiens
TITEQQRYS

SEQ ID NO: 345413 - protein, 9 aa, Homo Sapiens
VLDPEHRGH

SEQ ID NO: 345414 - protein, 9 aa, Homo Sapiens
SEQIHLGDD

SEQ ID NO: 345415 - protein, 9 aa, Homo Sapiens
VCKKHMLSC

SEQ ID NO: 345416 - protein, 9 aa, Homo Sapiens
QSLSRNAFA

SEQ ID NO: 345417 - protein, 9 aa, Homo Sapiens
ATRAQLANN

SEQ ID NO: 345418 - protein, 9 aa, Homo Sapiens
VIPTPNSDV

SEQ ID NO: 345419 - protein, 9 aa, Homo Sapiens
FLRNKAIIW

SEQ ID NO: 345420 - protein, 9 aa, Homo Sapiens
DEHFLEMKL

SEQ ID NO: 345421 - protein, 9 aa, Homo Sapiens
NKKEKSCRL

SEQ ID NO: 345422 - protein, 9 aa, Homo Sapiens
ICRFCWHQI

SEQ ID NO: 345423 - protein, 9 aa, Homo Sapiens
SKSSNSNAI

SEQ ID NO: 345424 - protein, 9 aa, Homo Sapiens
RFKTKHIAG

SEQ ID NO: 345425 - protein, 9 aa, Homo Sapiens
NTVKLLTGA

SEQ ID NO: 345426 - protein, 9 aa, Homo Sapiens
NAEILFKKL

SEQ ID NO: 345427 - protein, 9 aa, Homo Sapiens
SICIDWFYT

SEQ ID NO: 345428 - protein, 9 aa, Homo Sapiens
SAIINEIYF

SEQ ID NO: 345429 - protein, 9 aa, Homo Sapiens
NSCIILKIV

SEQ ID NO: 345430 - protein, 9 aa, Homo Sapiens
QVIYLFATY

SEQ ID NO: 345431 - protein, 9 aa, Homo Sapiens
ESGKKRKIK

SEQ ID NO: 345432 - protein, 9 aa, Homo Sapiens
LDKFRINIL

SEQ ID NO: 345433 - protein, 9 aa, Homo Sapiens
KKQNLEKNK

SEQ ID NO: 345434 - protein, 9 aa, Homo Sapiens
GDQGWQNND

SEQ ID NO: 345435 - protein, 9 aa, Homo Sapiens
FQKGGEHLY

SEQ ID NO: 345436 - protein, 9 aa, Homo Sapiens
RCSMIDDTY

SEQ ID NO: 345437 - protein, 9 aa, Homo Sapiens
GWGEGAQFD

SEQ ID NO: 345438 - protein, 9 aa, Homo Sapiens
LTKNKIRSL

SEQ ID NO: 345439 - protein, 9 aa, Homo Sapiens
ITFFFIIIS

SEQ ID NO: 345440 - protein, 9 aa, Homo Sapiens
EEEPNRMPS

SEQ ID NO: 345441 - protein, 9 aa, Homo Sapiens
LNQALIPRD

SEQ ID NO: 345442 - protein, 9 aa, Homo Sapiens
VYCLHVIHH

SEQ ID NO: 345443 - protein, 9 aa, Homo Sapiens
ANEIALSLN

SEQ ID NO: 345444 - protein, 9 aa, Homo Sapiens
LREFMQLLL

SEQ ID NO: 345445 - protein, 9 aa, Homo Sapiens
GETITGKVK

SEQ ID NO: 345446 - protein, 9 aa, Homo Sapiens
LTVLDKCQL

SEQ ID NO: 345447 - protein, 9 aa, Homo Sapiens
RLASQSKAC

SEQ ID NO: 345448 - protein, 9 aa, Homo Sapiens
KAYECSRCG

SEQ ID NO: 345449 - protein, 9 aa, Homo Sapiens
PFSFHLFED

SEQ ID NO: 345450 - protein, 9 aa, Homo Sapiens
ASLSSGRFH

SEQ ID NO: 345451 - protein, 9 aa, Homo Sapiens
ATRRLNGQA

SEQ ID NO: 345452 - protein, 9 aa, Homo Sapiens
QHERIHTGK

SEQ ID NO: 345453 - protein, 9 aa, Homo Sapiens
NDIGLTLAS

SEQ ID NO: 345454 - protein, 9 aa, Homo Sapiens
HGLPWAIIY

SEQ ID NO: 345455 - protein, 9 aa, Homo Sapiens
SLVETQKSK

SEQ ID NO: 345456 - protein, 9 aa, Homo Sapiens
WWVGYEFFA

SEQ ID NO: 345457 - protein, 9 aa, Homo Sapiens
LAPNALSPV

SEQ ID NO: 345458 - protein, 9 aa, Homo Sapiens
DLKIMFPDI

SEQ ID NO: 345459 - protein, 9 aa, Homo Sapiens
FKISHKMLD

SEQ ID NO: 345460 - protein, 9 aa, Homo Sapiens
LMLASKSVN

SEQ ID NO: 345461 - protein, 9 aa, Homo Sapiens
LRHLLLECG

SEQ ID NO: 345462 - protein, 9 aa, Homo Sapiens
LGNDQNPGF

SEQ ID NO: 345463 - protein, 9 aa, Homo Sapiens
DNEVEQRHT

SEQ ID NO: 345464 - protein, 9 aa, Homo Sapiens
ACFDEFNQI

SEQ ID NO: 345465 - protein, 9 aa, Homo Sapiens
ETEPSKTVP

SEQ ID NO: 345466 - protein, 9 aa, Homo Sapiens
DSDLIFKRG

SEQ ID NO: 345467 - protein, 9 aa, Homo Sapiens
YFSFLPQSS

SEQ ID NO: 345468 - protein, 9 aa, Homo Sapiens
DCRDSLSED

SEQ ID NO: 345469 - protein, 9 aa, Homo Sapiens
YPEMVSCIK

SEQ ID NO: 345470 - protein, 9 aa, Homo Sapiens
GEDKWLLQK

SEQ ID NO: 345471 - protein, 9 aa, Homo Sapiens
YDPVSEYKI

SEQ ID NO: 345472 - protein, 9 aa, Homo Sapiens
KMPSSVSED

SEQ ID NO: 345473 - protein, 9 aa, Homo Sapiens
TELDAVESR

SEQ ID NO: 345474 - protein, 9 aa, Homo Sapiens
GQTQLLERQ

SEQ ID NO: 345475 - protein, 9 aa, Homo Sapiens
ERSTSLTTV

SEQ ID NO: 345476 - protein, 9 aa, Homo Sapiens
ALRMRMYSL

SEQ ID NO: 345477 - protein, 9 aa, Homo Sapiens
GLRIKGKRH

SEQ ID NO: 345478 - protein, 9 aa, Homo Sapiens
DERTISKKK

SEQ ID NO: 345479 - protein, 9 aa, Homo Sapiens
YLLNVFVFL

SEQ ID NO: 345480 - protein, 9 aa, Homo Sapiens
FSSSVNVEN

SEQ ID NO: 345481 - protein, 9 aa, Homo Sapiens
GVIFYQCIY

SEQ ID NO: 345482 - protein, 9 aa, Homo Sapiens
AHLSVVAEG

SEQ ID NO: 345483 - protein, 9 aa, Homo Sapiens
QHHKLHTGE

SEQ ID NO: 345484 - protein, 9 aa, Homo Sapiens
AHNREKNHP

SEQ ID NO: 345485 - protein, 9 aa, Homo Sapiens
KTHEKGTSR

SEQ ID NO: 345486 - protein, 9 aa, Homo Sapiens
FGRQMGGGR

SEQ ID NO: 345487 - protein, 9 aa, Homo Sapiens
RLLLQLLGP

SEQ ID NO: 345488 - protein, 9 aa, Homo Sapiens
VKHEQNTDC

SEQ ID NO: 345489 - protein, 9 aa, Homo Sapiens
VLDQVLYQR

SEQ ID NO: 345490 - protein, 9 aa, Homo Sapiens
WVDLIKYLP

SEQ ID NO: 345491 - protein, 9 aa, Homo Sapiens
EGIIYVDGA

SEQ ID NO: 345492 - protein, 9 aa, Homo Sapiens
QCQDCRDSL

SEQ ID NO: 345493 - protein, 9 aa, Homo Sapiens
SNFLGGVVH

SEQ ID NO: 345494 - protein, 9 aa, Homo Sapiens
ASTFPPHQE

SEQ ID NO: 345495 - protein, 9 aa, Homo Sapiens
DADKKDIAE

SEQ ID NO: 345496 - protein, 9 aa, Homo Sapiens
CMADTDVQL

SEQ ID NO: 345497 - protein, 9 aa, Homo Sapiens
ISENLKSCS

SEQ ID NO: 345498 - protein, 9 aa, Homo Sapiens
PALRGHTKP

SEQ ID NO: 345499 - protein, 9 aa, Homo Sapiens
TAFCLAQKL

SEQ ID NO: 345500 - protein, 9 aa, Homo Sapiens
LNEDSDLIF

SEQ ID NO: 345501 - protein, 9 aa, Homo Sapiens
GGIIRTCQK

SEQ ID NO: 345502 - protein, 9 aa, Homo Sapiens
GESLRSHFE

SEQ ID NO: 345503 - protein, 9 aa, Homo Sapiens
LDVELINEI

SEQ ID NO: 345504 - protein, 9 aa, Homo Sapiens
TAFCLAQKP

SEQ ID NO: 345505 - protein, 9 aa, Homo Sapiens
KVFINTIPN

SEQ ID NO: 345506 - protein, 9 aa, Homo Sapiens
TAFCLAQKT

SEQ ID NO: 345507 - protein, 9 aa, Homo Sapiens
QRQLALKVI

SEQ ID NO: 345508 - protein, 9 aa, Homo Sapiens
MNNNIINTQ

SEQ ID NO: 345509 - protein, 9 aa, Homo Sapiens
EDDIIVWHT

SEQ ID NO: 345510 - protein, 9 aa, Homo Sapiens
SLNSTNSGS

SEQ ID NO: 345511 - protein, 9 aa, Homo Sapiens
GGGLSASGT

SEQ ID NO: 345512 - protein, 9 aa, Homo Sapiens
SAQLHLWAF

SEQ ID NO: 345513 - protein, 9 aa, Homo Sapiens
MCHKCKNKQ

SEQ ID NO: 345514 - protein, 9 aa, Homo Sapiens
PNALSPVEE

SEQ ID NO: 345515 - protein, 9 aa, Homo Sapiens
KELQGLADF

SEQ ID NO: 345516 - protein, 9 aa, Homo Sapiens
RQMAVCEKV

SEQ ID NO: 345517 - protein, 9 aa, Homo Sapiens
LTQGSVAFE

SEQ ID NO: 345518 - protein, 9 aa, Homo Sapiens
ALEANMTKW

SEQ ID NO: 345519 - protein, 9 aa, Homo Sapiens
LYQDNNGNV

SEQ ID NO: 345520 - protein, 9 aa, Homo Sapiens
WQTLQSATV

SEQ ID NO: 345521 - protein, 9 aa, Homo Sapiens
LADFIAKKV

SEQ ID NO: 345522 - protein, 9 aa, Homo Sapiens
EYSPSAYTQ

SEQ ID NO: 345523 - protein, 9 aa, Homo Sapiens
SSLSLLTET

SEQ ID NO: 345524 - protein, 9 aa, Homo Sapiens
IPIQYYVRW

SEQ ID NO: 345525 - protein, 9 aa, Homo Sapiens
SKYKIASYS

SEQ ID NO: 345526 - protein, 9 aa, Homo Sapiens
QSKNKWKFY

SEQ ID NO: 345527 - protein, 9 aa, Homo Sapiens
QGPCTCDRE

SEQ ID NO: 345528 - protein, 9 aa, Homo Sapiens
KMNENIIRT

SEQ ID NO: 345529 - protein, 9 aa, Homo Sapiens
VLDSSQGNL

SEQ ID NO: 345530 - protein, 9 aa, Homo Sapiens
HIGISFVKE

SEQ ID NO: 345531 - protein, 9 aa, Homo Sapiens
TKNLSEVGF

SEQ ID NO: 345532 - protein, 9 aa, Homo Sapiens
IRKFIILIT

SEQ ID NO: 345533 - protein, 9 aa, Homo Sapiens
NISYNVLEW

SEQ ID NO: 345534 - protein, 9 aa, Homo Sapiens
VLGEGATEV

SEQ ID NO: 345535 - protein, 9 aa, Homo Sapiens
VYNHKTPEY

SEQ ID NO: 345536 - protein, 9 aa, Homo Sapiens
MLYVLYFDC

SEQ ID NO: 345537 - protein, 9 aa, Homo Sapiens
TLTELWFHN

SEQ ID NO: 345538 - protein, 9 aa, Homo Sapiens
CMACDLDMV

SEQ ID NO: 345539 - protein, 9 aa, Homo Sapiens
ERVEEAAVL

SEQ ID NO: 345540 - protein, 9 aa, Homo Sapiens
RDMQMGGGG

SEQ ID NO: 345541 - protein, 9 aa, Homo Sapiens
ISPQSRGTH

SEQ ID NO: 345542 - protein, 9 aa, Homo Sapiens
LFCFGESTT

SEQ ID NO: 345543 - protein, 9 aa, Homo Sapiens
SRSKYLPSP

SEQ ID NO: 345544 - protein, 9 aa, Homo Sapiens
QHHCQVSEE

SEQ ID NO: 345545 - protein, 9 aa, Homo Sapiens
RKQQKERKN

SEQ ID NO: 345546 - protein, 9 aa, Homo Sapiens
SRKQQKERK

SEQ ID NO: 345547 - protein, 9 aa, Homo Sapiens
NADNKTCSV

SEQ ID NO: 345548 - protein, 9 aa, Homo Sapiens
PSLPGTTNG

SEQ ID NO: 345549 - protein, 9 aa, Homo Sapiens
SSSLNEHKI

SEQ ID NO: 345550 - protein, 9 aa, Homo Sapiens
LWHGDQILW

SEQ ID NO: 345551 - protein, 9 aa, Homo Sapiens
LARRCFKRT

SEQ ID NO: 345552 - protein, 9 aa, Homo Sapiens
PAWTFYSGA

SEQ ID NO: 345553 - protein, 9 aa, Homo Sapiens
FGLAVTEIL

SEQ ID NO: 345554 - protein, 9 aa, Homo Sapiens
QKRSYSSSS

SEQ ID NO: 345555 - protein, 9 aa, Homo Sapiens
RDKRSNSLW

SEQ ID NO: 345556 - protein, 9 aa, Homo Sapiens
FREFFPNHQ

SEQ ID NO: 345557 - protein, 9 aa, Homo Sapiens
YFSGCLAQI

SEQ ID NO: 345558 - protein, 9 aa, Homo Sapiens
PLLWGQSFC

SEQ ID NO: 345559 - protein, 9 aa, Homo Sapiens
MRKAGHKAL

SEQ ID NO: 345560 - protein, 9 aa, Homo Sapiens
AVDNLDSQS

SEQ ID NO: 345561 - protein, 9 aa, Homo Sapiens
CFRQTNCLM

SEQ ID NO: 345562 - protein, 9 aa, Homo Sapiens
QNRSSLLEE

SEQ ID NO: 345563 - protein, 9 aa, Homo Sapiens
TKLQDQTGS

SEQ ID NO: 345564 - protein, 9 aa, Homo Sapiens
KAFNLFSSI

SEQ ID NO: 345565 - protein, 9 aa, Homo Sapiens
RHGVRILRA

SEQ ID NO: 345566 - protein, 9 aa, Homo Sapiens
KSQKKNRNV

SEQ ID NO: 345567 - protein, 9 aa, Homo Sapiens
LLKTGGTTS

SEQ ID NO: 345568 - protein, 9 aa, Homo Sapiens
ARRAHRQIN

SEQ ID NO: 345569 - protein, 9 aa, Homo Sapiens
QFAYIDNFK

SEQ ID NO: 345570 - protein, 9 aa, Homo Sapiens
LTYTLLNKL

SEQ ID NO: 345571 - protein, 9 aa, Homo Sapiens
GLAEEICHM

SEQ ID NO: 345572 - protein, 9 aa, Homo Sapiens
LSAPEAEQG

SEQ ID NO: 345573 - protein, 9 aa, Homo Sapiens
KMILLHIRK

SEQ ID NO: 345574 - protein, 9 aa, Homo Sapiens
EPRTATSGP

SEQ ID NO: 345575 - protein, 9 aa, Homo Sapiens
YCSPATPAE

SEQ ID NO: 345576 - protein, 9 aa, Homo Sapiens
SQNLSTPPL

SEQ ID NO: 345577 - protein, 9 aa, Homo Sapiens
CPQAEVDRF

SEQ ID NO: 345578 - protein, 9 aa, Homo Sapiens
DSIEKEHVK

SEQ ID NO: 345579 - protein, 9 aa, Homo Sapiens
YDPSPWVKE

SEQ ID NO: 345580 - protein, 9 aa, Homo Sapiens
LILCHNNIT

SEQ ID NO: 345581 - protein, 9 aa, Homo Sapiens
RQPSRIKPM

SEQ ID NO: 345582 - protein, 9 aa, Homo Sapiens
KEPHMLFDH

SEQ ID NO: 345583 - protein, 9 aa, Homo Sapiens
ITPCVCILM

SEQ ID NO: 345584 - protein, 9 aa, Homo Sapiens
WERYTKVAK

SEQ ID NO: 345585 - protein, 9 aa, Homo Sapiens
IKVRDKDYG

SEQ ID NO: 345586 - protein, 9 aa, Homo Sapiens
VRPTCFEMK

SEQ ID NO: 345587 - protein, 9 aa, Homo Sapiens
TWDSANADL

SEQ ID NO: 345588 - protein, 9 aa, Homo Sapiens
LDPDWSAIT

SEQ ID NO: 345589 - protein, 9 aa, Homo Sapiens
RKLKKHFYV

SEQ ID NO: 345590 - protein, 9 aa, Homo Sapiens
KTNSKRPDP

SEQ ID NO: 345591 - protein, 9 aa, Homo Sapiens
YQGGNQRLL

SEQ ID NO: 345592 - protein, 9 aa, Homo Sapiens
ILRTQIAAS

SEQ ID NO: 345593 - protein, 9 aa, Homo Sapiens
NVCMGFGFI

SEQ ID NO: 345594 - protein, 9 aa, Homo Sapiens
FIRDSLISL

SEQ ID NO: 345595 - protein, 9 aa, Homo Sapiens
EKRTSAKKL

SEQ ID NO: 345596 - protein, 9 aa, Homo Sapiens
GFSYRTGQD

SEQ ID NO: 345597 - protein, 9 aa, Homo Sapiens
DACNLQFAT

SEQ ID NO: 345598 - protein, 9 aa, Homo Sapiens
VMPFNIYMF

SEQ ID NO: 345599 - protein, 9 aa, Homo Sapiens
FSDKRTSQS

SEQ ID NO: 345600 - protein, 9 aa, Homo Sapiens
GLWWQSQDL

SEQ ID NO: 345601 - protein, 9 aa, Homo Sapiens
SDLAMQVIT

SEQ ID NO: 345602 - protein, 9 aa, Homo Sapiens
GKEGGKGPC

SEQ ID NO: 345603 - protein, 9 aa, Homo Sapiens
AGELCLGKE

SEQ ID NO: 345604 - protein, 9 aa, Homo Sapiens
ENLCFDLYD

SEQ ID NO: 345605 - protein, 9 aa, Homo Sapiens
TKMNKMSFV

SEQ ID NO: 345606 - protein, 9 aa, Homo Sapiens
GFVCPICFD

SEQ ID NO: 345607 - protein, 9 aa, Homo Sapiens
LAQENKVDF

SEQ ID NO: 345608 - protein, 9 aa, Homo Sapiens
FQKAVDDLN

SEQ ID NO: 345609 - protein, 9 aa, Homo Sapiens
WGLWWQSQD

SEQ ID NO: 345610 - protein, 9 aa, Homo Sapiens
YSRHNAEIL

SEQ ID NO: 345611 - protein, 9 aa, Homo Sapiens
RRGCASAPG

SEQ ID NO: 345612 - protein, 9 aa, Homo Sapiens
NYNNQASEQ

SEQ ID NO: 345613 - protein, 9 aa, Homo Sapiens
TLMTVFLLL

SEQ ID NO: 345614 - protein, 9 aa, Homo Sapiens
ALYDCQSPD

SEQ ID NO: 345615 - protein, 9 aa, Homo Sapiens
RAKQKTHEK

SEQ ID NO: 345616 - protein, 9 aa, Homo Sapiens
WKEYMHRRQ

SEQ ID NO: 345617 - protein, 9 aa, Homo Sapiens
WDNHRLRND

SEQ ID NO: 345618 - protein, 9 aa, Homo Sapiens
VTTNNKEVN

SEQ ID NO: 345619 - protein, 9 aa, Homo Sapiens
FSLFYDQDN

SEQ ID NO: 345620 - protein, 9 aa, Homo Sapiens
NNRLFSSSY

SEQ ID NO: 345621 - protein, 9 aa, Homo Sapiens
SLCHVDASF

SEQ ID NO: 345622 - protein, 9 aa, Homo Sapiens
SFTSSSALQ

SEQ ID NO: 345623 - protein, 9 aa, Homo Sapiens
QNELRETVD

SEQ ID NO: 345624 - protein, 9 aa, Homo Sapiens
PSGVLAGGW

SEQ ID NO: 345625 - protein, 9 aa, Homo Sapiens
LSNKALKKI

SEQ ID NO: 345626 - protein, 9 aa, Homo Sapiens
MPKVHIKFT

SEQ ID NO: 345627 - protein, 9 aa, Homo Sapiens
VQVQIKIYS

SEQ ID NO: 345628 - protein, 9 aa, Homo Sapiens
RAEAEQQRQ

SEQ ID NO: 345629 - protein, 9 aa, Homo Sapiens
CPLYKSSKA

SEQ ID NO: 345630 - protein, 9 aa, Homo Sapiens
VSSSYENER

SEQ ID NO: 345631 - protein, 9 aa, Homo Sapiens
YFICHRDLK

SEQ ID NO: 345632 - protein, 9 aa, Homo Sapiens
VVAEGGSAV

SEQ ID NO: 345633 - protein, 9 aa, Homo Sapiens
SVFWVGSKN

SEQ ID NO: 345634 - protein, 9 aa, Homo Sapiens
GNEDIPTEL

SEQ ID NO: 345635 - protein, 9 aa, Homo Sapiens
KFNHYDTAV

SEQ ID NO: 345636 - protein, 9 aa, Homo Sapiens
NNFLHQLLE

SEQ ID NO: 345637 - protein, 9 aa, Homo Sapiens
HNHTYQMLT

SEQ ID NO: 345638 - protein, 9 aa, Homo Sapiens
CVDCKGGSR

SEQ ID NO: 345639 - protein, 9 aa, Homo Sapiens
INFKMAAEE

SEQ ID NO: 345640 - protein, 9 aa, Homo Sapiens
VEFDNATEA

SEQ ID NO: 345641 - protein, 9 aa, Homo Sapiens
LSPFMGGND

SEQ ID NO: 345642 - protein, 9 aa, Homo Sapiens
LALYIYEYL

SEQ ID NO: 345643 - protein, 9 aa, Homo Sapiens
FATYVLASL

SEQ ID NO: 345644 - protein, 9 aa, Homo Sapiens
ATEEIKVIF

SEQ ID NO: 345645 - protein, 9 aa, Homo Sapiens
WTIFSLLKA

SEQ ID NO: 345646 - protein, 9 aa, Homo Sapiens
SLSNTAVYY

SEQ ID NO: 345647 - protein, 9 aa, Homo Sapiens
PEEGPKHLY

SEQ ID NO: 345648 - protein, 9 aa, Homo Sapiens
YQFQLFQEA

SEQ ID NO: 345649 - protein, 9 aa, Homo Sapiens
GALTRVSQI

SEQ ID NO: 345650 - protein, 9 aa, Homo Sapiens
ETGYNEINN

SEQ ID NO: 345651 - protein, 9 aa, Homo Sapiens
LFLYTAELL

SEQ ID NO: 345652 - protein, 9 aa, Homo Sapiens
NTAYLSKVN

SEQ ID NO: 345653 - protein, 9 aa, Homo Sapiens
VQGKESTRQ

SEQ ID NO: 345654 - protein, 9 aa, Homo Sapiens
RSQLSVFKV

SEQ ID NO: 345655 - protein, 9 aa, Homo Sapiens
GKTKSGYFL

SEQ ID NO: 345656 - protein, 9 aa, Homo Sapiens
SVTKNWTSY

SEQ ID NO: 345657 - protein, 9 aa, Homo Sapiens
REELGAQPD

SEQ ID NO: 345658 - protein, 9 aa, Homo Sapiens
EDVKGDDNP

SEQ ID NO: 345659 - protein, 9 aa, Homo Sapiens
TILCQLTKT

SEQ ID NO: 345660 - protein, 9 aa, Homo Sapiens
LSKFPTKIP

SEQ ID NO: 345661 - protein, 9 aa, Homo Sapiens
GGELFDHIV

SEQ ID NO: 345662 - protein, 9 aa, Homo Sapiens
GDHDDSAMN

SEQ ID NO: 345663 - protein, 9 aa, Homo Sapiens
LTEGDFANN

SEQ ID NO: 345664 - protein, 9 aa, Homo Sapiens
KEKRKQEEE

SEQ ID NO: 345665 - protein, 9 aa, Homo Sapiens
NKHFSDSND

SEQ ID NO: 345666 - protein, 9 aa, Homo Sapiens
FASRHKSFM

SEQ ID NO: 345667 - protein, 9 aa, Homo Sapiens
TFTWQGLLT

SEQ ID NO: 345668 - protein, 9 aa, Homo Sapiens
TTSEDGTVI

SEQ ID NO: 345669 - protein, 9 aa, Homo Sapiens
DNDLLSSST

SEQ ID NO: 345670 - protein, 9 aa, Homo Sapiens
ATTVSLCLG

SEQ ID NO: 345671 - protein, 9 aa, Homo Sapiens
VQPDNVIEK

SEQ ID NO: 345672 - protein, 9 aa, Homo Sapiens
DGQHYSFIG

SEQ ID NO: 345673 - protein, 9 aa, Homo Sapiens
GGETQGYLC

SEQ ID NO: 345674 - protein, 9 aa, Homo Sapiens
GIEGEDSIS

SEQ ID NO: 345675 - protein, 9 aa, Homo Sapiens
IDLSASSSL

SEQ ID NO: 345676 - protein, 9 aa, Homo Sapiens
SADSLATPR

SEQ ID NO: 345677 - protein, 9 aa, Homo Sapiens
SNKLLDKAF

SEQ ID NO: 345678 - protein, 9 aa, Homo Sapiens
TQKAAKGYT

SEQ ID NO: 345679 - protein, 9 aa, Homo Sapiens
DMALCQNAR

SEQ ID NO: 345680 - protein, 9 aa, Homo Sapiens
HKGTCYWIA

SEQ ID NO: 345681 - protein, 9 aa, Homo Sapiens
KLSWIAKLE

SEQ ID NO: 345682 - protein, 9 aa, Homo Sapiens
QAVGRDTNR

SEQ ID NO: 345683 - protein, 9 aa, Homo Sapiens
CGHHKDAGV

SEQ ID NO: 345684 - protein, 9 aa, Homo Sapiens
SYFPIPVLK

SEQ ID NO: 345685 - protein, 9 aa, Homo Sapiens
GAQFDLYKL

SEQ ID NO: 345686 - protein, 9 aa, Homo Sapiens
SSPRILKTH

SEQ ID NO: 345687 - protein, 9 aa, Homo Sapiens
VDFVLCDQR

SEQ ID NO: 345688 - protein, 9 aa, Homo Sapiens
LSTLISQKV

SEQ ID NO: 345689 - protein, 9 aa, Homo Sapiens
FYYFRGVEV

SEQ ID NO: 345690 - protein, 9 aa, Homo Sapiens
NKMSFVEKV

SEQ ID NO: 345691 - protein, 9 aa, Homo Sapiens
EKIFAFQRT

SEQ ID NO: 345692 - protein, 9 aa, Homo Sapiens
FASRRKQCY

SEQ ID NO: 345693 - protein, 9 aa, Homo Sapiens
IQQGAGALG

SEQ ID NO: 345694 - protein, 9 aa, Homo Sapiens
NWDNDNVED

SEQ ID NO: 345695 - protein, 9 aa, Homo Sapiens
RFWLVEGNL

SEQ ID NO: 345696 - protein, 9 aa, Homo Sapiens
TLPYRYNLF

SEQ ID NO: 345697 - protein, 9 aa, Homo Sapiens
MENTYTRSA

SEQ ID NO: 345698 - protein, 9 aa, Homo Sapiens
GEYKGGYVI

SEQ ID NO: 345699 - protein, 9 aa, Homo Sapiens
RTNGKGISC

SEQ ID NO: 345700 - protein, 9 aa, Homo Sapiens
ATKDAKEIK

SEQ ID NO: 345701 - protein, 9 aa, Homo Sapiens
LRALSMVAD

SEQ ID NO: 345702 - protein, 9 aa, Homo Sapiens
NKCNQCLDC

SEQ ID NO: 345703 - protein, 9 aa, Homo Sapiens
NKCSAFQFF

SEQ ID NO: 345704 - protein, 9 aa, Homo Sapiens
PPSTQLHFH

SEQ ID NO: 345705 - protein, 9 aa, Homo Sapiens
SRSGMLEML

SEQ ID NO: 345706 - protein, 9 aa, Homo Sapiens
QFDPFNFLS

SEQ ID NO: 345707 - protein, 9 aa, Homo Sapiens
RVLGLHRSL

SEQ ID NO: 345708 - protein, 9 aa, Homo Sapiens
HQEKMILST

SEQ ID NO: 345709 - protein, 9 aa, Homo Sapiens
ETLTELWFH

SEQ ID NO: 345710 - protein, 9 aa, Homo Sapiens
QKGGEHLYN

SEQ ID NO: 345711 - protein, 9 aa, Homo Sapiens
NGFDSHFSL

SEQ ID NO: 345712 - protein, 9 aa, Homo Sapiens
TCLQNWEAM

SEQ ID NO: 345713 - protein, 9 aa, Homo Sapiens
PPGSVGISV

SEQ ID NO: 345714 - protein, 9 aa, Homo Sapiens
EQVHRHMNS

SEQ ID NO: 345715 - protein, 9 aa, Homo Sapiens
ADVLYRLGR

SEQ ID NO: 345716 - protein, 9 aa, Homo Sapiens
CQRSSKRKT

SEQ ID NO: 345717 - protein, 9 aa, Homo Sapiens
KHKLYVSFR

SEQ ID NO: 345718 - protein, 9 aa, Homo Sapiens
MCSRPKSNI

SEQ ID NO: 345719 - protein, 9 aa, Homo Sapiens
TVHRQTHTG

SEQ ID NO: 345720 - protein, 9 aa, Homo Sapiens
CFTTSTAPQ

SEQ ID NO: 345721 - protein, 9 aa, Homo Sapiens
LRPRCINMT

SEQ ID NO: 345722 - protein, 9 aa, Homo Sapiens
TQCIKWKGL

SEQ ID NO: 345723 - protein, 9 aa, Homo Sapiens
VFSLLVMAL

SEQ ID NO: 345724 - protein, 9 aa, Homo Sapiens
SHLLEEIKE

SEQ ID NO: 345725 - protein, 9 aa, Homo Sapiens
CKEEQRYSG

SEQ ID NO: 345726 - protein, 9 aa, Homo Sapiens
GDVPRRSPP

SEQ ID NO: 345727 - protein, 9 aa, Homo Sapiens
LGLIIVQRL

SEQ ID NO: 345728 - protein, 9 aa, Homo Sapiens
EKQRKQAFE

SEQ ID NO: 345729 - protein, 9 aa, Homo Sapiens
TKYSTLKHE

SEQ ID NO: 345730 - protein, 9 aa, Homo Sapiens
IATRLQRVI

SEQ ID NO: 345731 - protein, 9 aa, Homo Sapiens
LEMMSQTMI

SEQ ID NO: 345732 - protein, 9 aa, Homo Sapiens
ILLCNVILW

SEQ ID NO: 345733 - protein, 9 aa, Homo Sapiens
WWCFHKHGT

SEQ ID NO: 345734 - protein, 9 aa, Homo Sapiens
QYKNNQIEN

SEQ ID NO: 345735 - protein, 9 aa, Homo Sapiens
INTSSLCKH

SEQ ID NO: 345736 - protein, 9 aa, Homo Sapiens
CAGPQTYKD

SEQ ID NO: 345737 - protein, 9 aa, Homo Sapiens
KTIGVIDKK

SEQ ID NO: 345738 - protein, 9 aa, Homo Sapiens
NGNTLWRTT

SEQ ID NO: 345739 - protein, 9 aa, Homo Sapiens
LDECNIKKG

SEQ ID NO: 345740 - protein, 9 aa, Homo Sapiens
VQVHQDTLH

SEQ ID NO: 345741 - protein, 9 aa, Homo Sapiens
LDKHIIGFD

SEQ ID NO: 345742 - protein, 9 aa, Homo Sapiens
RADEYYLYA

SEQ ID NO: 345743 - protein, 9 aa, Homo Sapiens
YQTVVALDK

SEQ ID NO: 345744 - protein, 9 aa, Homo Sapiens
PTAPSDICA

SEQ ID NO: 345745 - protein, 9 aa, Homo Sapiens
TLQEVKILA

SEQ ID NO: 345746 - protein, 9 aa, Homo Sapiens
ALFLHLHNL

SEQ ID NO: 345747 - protein, 9 aa, Homo Sapiens
FIKTCVGLP

SEQ ID NO: 345748 - protein, 9 aa, Homo Sapiens
DVELINEIL

SEQ ID NO: 345749 - protein, 9 aa, Homo Sapiens
KFFELSDLL

SEQ ID NO: 345750 - protein, 9 aa, Homo Sapiens
QDLARIYIQ

SEQ ID NO: 345751 - protein, 9 aa, Homo Sapiens
QLKAKEQHF

SEQ ID NO: 345752 - protein, 9 aa, Homo Sapiens
PWHWHFSQG

SEQ ID NO: 345753 - protein, 9 aa, Homo Sapiens
DTYYYRQRH

SEQ ID NO: 345754 - protein, 9 aa, Homo Sapiens
SKIDEKRLA

SEQ ID NO: 345755 - protein, 9 aa, Homo Sapiens
KPPNEEHRL

SEQ ID NO: 345756 - protein, 9 aa, Homo Sapiens
PQDLTMEEL

SEQ ID NO: 345757 - protein, 9 aa, Homo Sapiens
CHSLLNTAT

SEQ ID NO: 345758 - protein, 9 aa, Homo Sapiens
WQAHTLTVL

SEQ ID NO: 345759 - protein, 9 aa, Homo Sapiens
RVVPVEPTY

SEQ ID NO: 345760 - protein, 9 aa, Homo Sapiens
GTEICKFVH

SEQ ID NO: 345761 - protein, 9 aa, Homo Sapiens
IKAKPLKSI

SEQ ID NO: 345762 - protein, 9 aa, Homo Sapiens
FVFQPELFD

SEQ ID NO: 345763 - protein, 9 aa, Homo Sapiens
FPDCMACDL

SEQ ID NO: 345764 - protein, 9 aa, Homo Sapiens
YCKKERCFT

SEQ ID NO: 345765 - protein, 9 aa, Homo Sapiens
IVDDPKTLK

SEQ ID NO: 345766 - protein, 9 aa, Homo Sapiens
PILKFLLDV

SEQ ID NO: 345767 - protein, 9 aa, Homo Sapiens
TKIYKYWLA

SEQ ID NO: 345768 - protein, 9 aa, Homo Sapiens
QGQGRHNAI

SEQ ID NO: 345769 - protein, 9 aa, Homo Sapiens
EILNKTRSF

SEQ ID NO: 345770 - protein, 9 aa, Homo Sapiens
RRFWKINYK

SEQ ID NO: 345771 - protein, 9 aa, Homo Sapiens
LETDDGVVG

SEQ ID NO: 345772 - protein, 9 aa, Homo Sapiens
VDKIQTEVL

SEQ ID NO: 345773 - protein, 9 aa, Homo Sapiens
DKKICFWDI

SEQ ID NO: 345774 - protein, 9 aa, Homo Sapiens
KILDKCNDI

SEQ ID NO: 345775 - protein, 9 aa, Homo Sapiens
GETLSQIQN

SEQ ID NO: 345776 - protein, 9 aa, Homo Sapiens
EDVSVFFTK

SEQ ID NO: 345777 - protein, 9 aa, Homo Sapiens
ITSSNVINK

SEQ ID NO: 345778 - protein, 9 aa, Homo Sapiens
LLRMMIAKQ

SEQ ID NO: 345779 - protein, 9 aa, Homo Sapiens
ASFQHKWFE

SEQ ID NO: 345780 - protein, 9 aa, Homo Sapiens
REYEKRVLA

SEQ ID NO: 345781 - protein, 9 aa, Homo Sapiens
ELDEEESIW

SEQ ID NO: 345782 - protein, 9 aa, Homo Sapiens
DEKRLAPRH

SEQ ID NO: 345783 - protein, 9 aa, Homo Sapiens
GTETSQANL

SEQ ID NO: 345784 - protein, 9 aa, Homo Sapiens
YACQPKVMC

SEQ ID NO: 345785 - protein, 9 aa, Homo Sapiens
DTLPDFRNK

SEQ ID NO: 345786 - protein, 9 aa, Homo Sapiens
WSHRTLKTD

SEQ ID NO: 345787 - protein, 9 aa, Homo Sapiens
TPHSGDNSS

SEQ ID NO: 345788 - protein, 9 aa, Homo Sapiens
CGTEKKNYA

SEQ ID NO: 345789 - protein, 9 aa, Homo Sapiens
RPPHLHRAT

SEQ ID NO: 345790 - protein, 9 aa, Homo Sapiens
LMFNCSVPS

SEQ ID NO: 345791 - protein, 9 aa, Homo Sapiens
SRRSHQQEC

SEQ ID NO: 345792 - protein, 9 aa, Homo Sapiens
VKVYAINLE

SEQ ID NO: 345793 - protein, 9 aa, Homo Sapiens
TKLKSQVQP

SEQ ID NO: 345794 - protein, 9 aa, Homo Sapiens
DDFVQLSRL

SEQ ID NO: 345795 - protein, 9 aa, Homo Sapiens
LALKVIVTL

SEQ ID NO: 345796 - protein, 9 aa, Homo Sapiens
HKNLIQQIS

SEQ ID NO: 345797 - protein, 9 aa, Homo Sapiens
KKELEEQQK

SEQ ID NO: 345798 - protein, 9 aa, Homo Sapiens
KIIRTLLSP

SEQ ID NO: 345799 - protein, 9 aa, Homo Sapiens
AKHNVLTLK

SEQ ID NO: 345800 - protein, 9 aa, Homo Sapiens
VLDKCQLMF

SEQ ID NO: 345801 - protein, 9 aa, Homo Sapiens
NMFDLVMEI

SEQ ID NO: 345802 - protein, 9 aa, Homo Sapiens
LISSKLKEC

SEQ ID NO: 345803 - protein, 9 aa, Homo Sapiens
ESKPKQSTE

SEQ ID NO: 345804 - protein, 9 aa, Homo Sapiens
QTVDDFKTQ

SEQ ID NO: 345805 - protein, 9 aa, Homo Sapiens
LVVLLTVAA

SEQ ID NO: 345806 - protein, 9 aa, Homo Sapiens
ALIGLWEVG

SEQ ID NO: 345807 - protein, 9 aa, Homo Sapiens
REFMQLLLR

SEQ ID NO: 345808 - protein, 9 aa, Homo Sapiens
DPRLYFDNT

SEQ ID NO: 345809 - protein, 9 aa, Homo Sapiens
CVLVSPRNS

SEQ ID NO: 345810 - protein, 9 aa, Homo Sapiens
LGWLCPQAE

SEQ ID NO: 345811 - protein, 9 aa, Homo Sapiens
IAGVLAIAL

SEQ ID NO: 345812 - protein, 9 aa, Homo Sapiens
MFLYFLVMS

SEQ ID NO: 345813 - protein, 9 aa, Homo Sapiens
CKMNKHVLK

SEQ ID NO: 345814 - protein, 9 aa, Homo Sapiens
NSSFSSSVN

SEQ ID NO: 345815 - protein, 9 aa, Homo Sapiens
NKNKFFKDR

SEQ ID NO: 345816 - protein, 9 aa, Homo Sapiens
LARSIGMVK

SEQ ID NO: 345817 - protein, 9 aa, Homo Sapiens
IADAFVHHI

SEQ ID NO: 345818 - protein, 9 aa, Homo Sapiens
TTTASESIS

SEQ ID NO: 345819 - protein, 9 aa, Homo Sapiens
AEVGNTIRV

SEQ ID NO: 345820 - protein, 9 aa, Homo Sapiens
RAGHSGKAI

SEQ ID NO: 345821 - protein, 9 aa, Homo Sapiens
VISLSFVIS

SEQ ID NO: 345822 - protein, 9 aa, Homo Sapiens
YANSHSLFV

SEQ ID NO: 345823 - protein, 9 aa, Homo Sapiens
RDFPKGLVA

SEQ ID NO: 345824 - protein, 9 aa, Homo Sapiens
KVGKLKDDD

SEQ ID NO: 345825 - protein, 9 aa, Homo Sapiens
AKGDPGPPG

SEQ ID NO: 345826 - protein, 9 aa, Homo Sapiens
VDIGTYLIQ

SEQ ID NO: 345827 - protein, 9 aa, Homo Sapiens
VGLMEMDQH

SEQ ID NO: 345828 - protein, 9 aa, Homo Sapiens
TQNVLKLFP

SEQ ID NO: 345829 - protein, 9 aa, Homo Sapiens
TAKEMKQIT

SEQ ID NO: 345830 - protein, 9 aa, Homo Sapiens
VLAPNALSP

SEQ ID NO: 345831 - protein, 9 aa, Homo Sapiens
IRKFTQERN

SEQ ID NO: 345832 - protein, 9 aa, Homo Sapiens
WEILHSTIC

SEQ ID NO: 345833 - protein, 9 aa, Homo Sapiens
LTPGLCLTT

SEQ ID NO: 345834 - protein, 9 aa, Homo Sapiens
HHLSRHITS

SEQ ID NO: 345835 - protein, 9 aa, Homo Sapiens
KTTHHNYYF

SEQ ID NO: 345836 - protein, 9 aa, Homo Sapiens
HRNGDPEES

SEQ ID NO: 345837 - protein, 9 aa, Homo Sapiens
FALSTFEES

SEQ ID NO: 345838 - protein, 9 aa, Homo Sapiens
QAVQKQLWD

SEQ ID NO: 345839 - protein, 9 aa, Homo Sapiens
KMLRCTKRG

SEQ ID NO: 345840 - protein, 9 aa, Homo Sapiens
SEEYNQVLD

SEQ ID NO: 345841 - protein, 9 aa, Homo Sapiens
EVTELYVQN

SEQ ID NO: 345842 - protein, 9 aa, Homo Sapiens
ETRLQEVCS

SEQ ID NO: 345843 - protein, 9 aa, Homo Sapiens
EKRLAPRHI

SEQ ID NO: 345844 - protein, 9 aa, Homo Sapiens
QNHTGEKHY

SEQ ID NO: 345845 - protein, 9 aa, Homo Sapiens
GYTTEPVPD

SEQ ID NO: 345846 - protein, 9 aa, Homo Sapiens
QCNTEDAYT

SEQ ID NO: 345847 - protein, 9 aa, Homo Sapiens
EEVKEEEEE

SEQ ID NO: 345848 - protein, 9 aa, Homo Sapiens
EIKIQQPLK

SEQ ID NO: 345849 - protein, 9 aa, Homo Sapiens
GLRDSHSEH

SEQ ID NO: 345850 - protein, 9 aa, Homo Sapiens
NSTNSGSGL

SEQ ID NO: 345851 - protein, 9 aa, Homo Sapiens
ASSPFQRVR

SEQ ID NO: 345852 - protein, 9 aa, Homo Sapiens
KTKHTIQFV

SEQ ID NO: 345853 - protein, 9 aa, Homo Sapiens
YPACVLLSS

SEQ ID NO: 345854 - protein, 9 aa, Homo Sapiens
HLPSPSPSA

SEQ ID NO: 345855 - protein, 9 aa, Homo Sapiens
QWDVLSGNC

SEQ ID NO: 345856 - protein, 9 aa, Homo Sapiens
GDNGDPGPM

SEQ ID NO: 345857 - protein, 9 aa, Homo Sapiens
KIILKKFPH

SEQ ID NO: 345858 - protein, 9 aa, Homo Sapiens
YEDRVKRLS

SEQ ID NO: 345859 - protein, 9 aa, Homo Sapiens
EPPTSPPER

SEQ ID NO: 345860 - protein, 9 aa, Homo Sapiens
WDIKDSISH

SEQ ID NO: 345861 - protein, 9 aa, Homo Sapiens
TDCTHTGLG

SEQ ID NO: 345862 - protein, 9 aa, Homo Sapiens
PPNFNTCTA

SEQ ID NO: 345863 - protein, 9 aa, Homo Sapiens
QCICLSLVY

SEQ ID NO: 345864 - protein, 9 aa, Homo Sapiens
GLSNVGWAI

SEQ ID NO: 345865 - protein, 9 aa, Homo Sapiens
PFKEGKIIK

SEQ ID NO: 345866 - protein, 9 aa, Homo Sapiens
LCEITTTLS

SEQ ID NO: 345867 - protein, 9 aa, Homo Sapiens
YPDFHDDYG

SEQ ID NO: 345868 - protein, 9 aa, Homo Sapiens
LEEQQKLGN

SEQ ID NO: 345869 - protein, 9 aa, Homo Sapiens
TREGLNMNL

SEQ ID NO: 345870 - protein, 9 aa, Homo Sapiens
RHSLQDPST

SEQ ID NO: 345871 - protein, 9 aa, Homo Sapiens
NSLKSSKNA

SEQ ID NO: 345872 - protein, 9 aa, Homo Sapiens
LAAAGRRRQ

SEQ ID NO: 345873 - protein, 9 aa, Homo Sapiens
CVCIMMNEG

SEQ ID NO: 345874 - protein, 9 aa, Homo Sapiens
FRLFRTNTW

SEQ ID NO: 345875 - protein, 9 aa, Homo Sapiens
CTNKLRDRI

SEQ ID NO: 345876 - protein, 9 aa, Homo Sapiens
LKQQIQKIE

SEQ ID NO: 345877 - protein, 9 aa, Homo Sapiens
CIRIELRSP

SEQ ID NO: 345878 - protein, 9 aa, Homo Sapiens
FPRAKIKVL

SEQ ID NO: 345879 - protein, 9 aa, Homo Sapiens
FDLVMEIGD

SEQ ID NO: 345880 - protein, 9 aa, Homo Sapiens
WDEASFQTE

SEQ ID NO: 345881 - protein, 9 aa, Homo Sapiens
QLLAAQNPL

SEQ ID NO: 345882 - protein, 9 aa, Homo Sapiens
DEFNQIELE

SEQ ID NO: 345883 - protein, 9 aa, Homo Sapiens
EKLPFVRKS

SEQ ID NO: 345884 - protein, 9 aa, Homo Sapiens
RAEILGRTS

SEQ ID NO: 345885 - protein, 9 aa, Homo Sapiens
SSKNASLRT

SEQ ID NO: 345886 - protein, 9 aa, Homo Sapiens
NATKAGEGS

SEQ ID NO: 345887 - protein, 9 aa, Homo Sapiens
QASVDGPGT

SEQ ID NO: 345888 - protein, 9 aa, Homo Sapiens
QRKLDDSQK

SEQ ID NO: 345889 - protein, 9 aa, Homo Sapiens
TLLSIFQSY

SEQ ID NO: 345890 - protein, 9 aa, Homo Sapiens
FTDNPCLRN

SEQ ID NO: 345891 - protein, 9 aa, Homo Sapiens
KFQCGDGTC

SEQ ID NO: 345892 - protein, 9 aa, Homo Sapiens
MWHEQEGRV

SEQ ID NO: 345893 - protein, 9 aa, Homo Sapiens
EEIANHKGP

SEQ ID NO: 345894 - protein, 9 aa, Homo Sapiens
VHEEQKIRL

SEQ ID NO: 345895 - protein, 9 aa, Homo Sapiens
IVTYHHHLY

SEQ ID NO: 345896 - protein, 9 aa, Homo Sapiens
IQKTKQQQY

SEQ ID NO: 345897 - protein, 9 aa, Homo Sapiens
QFLWEKACE

SEQ ID NO: 345898 - protein, 9 aa, Homo Sapiens
EYTCRLLDI

SEQ ID NO: 345899 - protein, 9 aa, Homo Sapiens
PKNKKPKER

SEQ ID NO: 345900 - protein, 9 aa, Homo Sapiens
TPSGSYWDC

SEQ ID NO: 345901 - protein, 9 aa, Homo Sapiens
KTTNVQLQA

SEQ ID NO: 345902 - protein, 9 aa, Homo Sapiens
FCLFVHFLN

SEQ ID NO: 345903 - protein, 9 aa, Homo Sapiens
SVVSLTPAT

SEQ ID NO: 345904 - protein, 9 aa, Homo Sapiens
HPAKCRSRT

SEQ ID NO: 345905 - protein, 9 aa, Homo Sapiens
CQGPCTCDR

SEQ ID NO: 345906 - protein, 9 aa, Homo Sapiens
RFNLCPEVI

SEQ ID NO: 345907 - protein, 9 aa, Homo Sapiens
PQVLNLGQA

SEQ ID NO: 345908 - protein, 9 aa, Homo Sapiens
SLDEEKEKN

SEQ ID NO: 345909 - protein, 9 aa, Homo Sapiens
RINFCLSII

SEQ ID NO: 345910 - protein, 9 aa, Homo Sapiens
AGELEKKAE

SEQ ID NO: 345911 - protein, 9 aa, Homo Sapiens
IFIFSGSVQ

SEQ ID NO: 345912 - protein, 9 aa, Homo Sapiens
LMHTSSNLS

SEQ ID NO: 345913 - protein, 9 aa, Homo Sapiens
AAFHTFLKT

SEQ ID NO: 345914 - protein, 9 aa, Homo Sapiens
DVFAVFQWP

SEQ ID NO: 345915 - protein, 9 aa, Homo Sapiens
VIWCPQDTG

SEQ ID NO: 345916 - protein, 9 aa, Homo Sapiens
NLMRSGVFT

SEQ ID NO: 345917 - protein, 9 aa, Homo Sapiens
SSNGYANIS

SEQ ID NO: 345918 - protein, 9 aa, Homo Sapiens
FCQPVDPQL

SEQ ID NO: 345919 - protein, 9 aa, Homo Sapiens
LLFCAYAYP

SEQ ID NO: 345920 - protein, 9 aa, Homo Sapiens
LFSLSLSFL

SEQ ID NO: 345921 - protein, 9 aa, Homo Sapiens
DVNSESEGS

SEQ ID NO: 345922 - protein, 9 aa, Homo Sapiens
KMLKLDATE

SEQ ID NO: 345923 - protein, 9 aa, Homo Sapiens
AYICVFSQP

SEQ ID NO: 345924 - protein, 9 aa, Homo Sapiens
QTGEVIFKD

SEQ ID NO: 345925 - protein, 9 aa, Homo Sapiens
TIDDGSRCL

SEQ ID NO: 345926 - protein, 9 aa, Homo Sapiens
MQWKVRQTL

SEQ ID NO: 345927 - protein, 9 aa, Homo Sapiens
PRASKAQRR

SEQ ID NO: 345928 - protein, 9 aa, Homo Sapiens
GGIYPSVED

SEQ ID NO: 345929 - protein, 9 aa, Homo Sapiens
EKCSSKKKK

SEQ ID NO: 345930 - protein, 9 aa, Homo Sapiens
PPIKVMVTL

SEQ ID NO: 345931 - protein, 9 aa, Homo Sapiens
DFVKKKCLE

SEQ ID NO: 345932 - protein, 9 aa, Homo Sapiens
EPSNKLYVV

SEQ ID NO: 345933 - protein, 9 aa, Homo Sapiens
PEQGKKTEE

SEQ ID NO: 345934 - protein, 9 aa, Homo Sapiens
HLSMKVCEK

SEQ ID NO: 345935 - protein, 9 aa, Homo Sapiens
VYLYEFRHR

SEQ ID NO: 345936 - protein, 9 aa, Homo Sapiens
ILMTNHLYA

SEQ ID NO: 345937 - protein, 9 aa, Homo Sapiens
KESKPKQST

SEQ ID NO: 345938 - protein, 9 aa, Homo Sapiens
IFCDNIKGN

SEQ ID NO: 345939 - protein, 9 aa, Homo Sapiens
KEKDNRKLH

SEQ ID NO: 345940 - protein, 9 aa, Homo Sapiens
MAKNEVGSA

SEQ ID NO: 345941 - protein, 9 aa, Homo Sapiens
IEVQQTGCV

SEQ ID NO: 345942 - protein, 9 aa, Homo Sapiens
QVRIEVVGI

SEQ ID NO: 345943 - protein, 9 aa, Homo Sapiens
PYGIQSEYC

SEQ ID NO: 345944 - protein, 9 aa, Homo Sapiens
ENVDMPNTS

SEQ ID NO: 345945 - protein, 9 aa, Homo Sapiens
APGSPDKQP

SEQ ID NO: 345946 - protein, 9 aa, Homo Sapiens
GRPGPRCSH

SEQ ID NO: 345947 - protein, 9 aa, Homo Sapiens
NNPDLLPNI

SEQ ID NO: 345948 - protein, 9 aa, Homo Sapiens
GRYFAHISV

SEQ ID NO: 345949 - protein, 9 aa, Homo Sapiens
SHQQIHTSE

SEQ ID NO: 345950 - protein, 9 aa, Homo Sapiens
RSSNILLLE

SEQ ID NO: 345951 - protein, 9 aa, Homo Sapiens
FQDLQNDAP

SEQ ID NO: 345952 - protein, 9 aa, Homo Sapiens
PHCGEKSSK

SEQ ID NO: 345953 - protein, 9 aa, Homo Sapiens
SFSSQSINF

SEQ ID NO: 345954 - protein, 9 aa, Homo Sapiens
EAHKSTPEI

SEQ ID NO: 345955 - protein, 9 aa, Homo Sapiens
MCDVHSITS

SEQ ID NO: 345956 - protein, 9 aa, Homo Sapiens
ILEKSGQIF

SEQ ID NO: 345957 - protein, 9 aa, Homo Sapiens
PSRRTLNNS

SEQ ID NO: 345958 - protein, 9 aa, Homo Sapiens
NATVCAGAS

SEQ ID NO: 345959 - protein, 9 aa, Homo Sapiens
PSTNGCQLF

SEQ ID NO: 345960 - protein, 9 aa, Homo Sapiens
TNIHRQIRA

SEQ ID NO: 345961 - protein, 9 aa, Homo Sapiens
QLVCGACKP

SEQ ID NO: 345962 - protein, 9 aa, Homo Sapiens
DVGKSALTI

SEQ ID NO: 345963 - protein, 9 aa, Homo Sapiens
VYLPTSVGL

SEQ ID NO: 345964 - protein, 9 aa, Homo Sapiens
FCARNGEYI

SEQ ID NO: 345965 - protein, 9 aa, Homo Sapiens
SLSFVISGF

SEQ ID NO: 345966 - protein, 9 aa, Homo Sapiens
FEKPKTKIY

SEQ ID NO: 345967 - protein, 9 aa, Homo Sapiens
ETACRLRAT

SEQ ID NO: 345968 - protein, 9 aa, Homo Sapiens
KIQRAHHKN

SEQ ID NO: 345969 - protein, 9 aa, Homo Sapiens
QCSYISTNN

SEQ ID NO: 345970 - protein, 9 aa, Homo Sapiens
GAGKYLAKW

SEQ ID NO: 345971 - protein, 9 aa, Homo Sapiens
QRLHSRETL

SEQ ID NO: 345972 - protein, 9 aa, Homo Sapiens
EVVVLSQNS

SEQ ID NO: 345973 - protein, 9 aa, Homo Sapiens
IVTWVSGSL

SEQ ID NO: 345974 - protein, 9 aa, Homo Sapiens
KIKQTKDCP

SEQ ID NO: 345975 - protein, 9 aa, Homo Sapiens
CRRKPFTLV

SEQ ID NO: 345976 - protein, 9 aa, Homo Sapiens
YITVVKKLD

SEQ ID NO: 345977 - protein, 9 aa, Homo Sapiens
LDLILCNNT

SEQ ID NO: 345978 - protein, 9 aa, Homo Sapiens
DYGVINTDM

SEQ ID NO: 345979 - protein, 9 aa, Homo Sapiens
QTQVLKKRH

SEQ ID NO: 345980 - protein, 9 aa, Homo Sapiens
LCDQRAIDL

SEQ ID NO: 345981 - protein, 9 aa, Homo Sapiens
SEDPGFYSP

SEQ ID NO: 345982 - protein, 9 aa, Homo Sapiens
PFHSLNNAT

SEQ ID NO: 345983 - protein, 9 aa, Homo Sapiens
LYIGIIAIL

SEQ ID NO: 345984 - protein, 9 aa, Homo Sapiens
GGVIKSIFA

SEQ ID NO: 345985 - protein, 9 aa, Homo Sapiens
DLISSKLKE

SEQ ID NO: 345986 - protein, 9 aa, Homo Sapiens
GKVVNSDRP

SEQ ID NO: 345987 - protein, 9 aa, Homo Sapiens
QSFCIIFPV

SEQ ID NO: 345988 - protein, 9 aa, Homo Sapiens
AWLPEDKVE

SEQ ID NO: 345989 - protein, 9 aa, Homo Sapiens
SSNSNAIQV

SEQ ID NO: 345990 - protein, 9 aa, Homo Sapiens
TGLSTLMEL

SEQ ID NO: 345991 - protein, 9 aa, Homo Sapiens
ALVLRSRLH

SEQ ID NO: 345992 - protein, 9 aa, Homo Sapiens
FNGVSLMDR

SEQ ID NO: 345993 - protein, 9 aa, Homo Sapiens
YWDASACVI

SEQ ID NO: 345994 - protein, 9 aa, Homo Sapiens
PRIPKVQSN

SEQ ID NO: 345995 - protein, 9 aa, Homo Sapiens
SAKVPVGVQ

SEQ ID NO: 345996 - protein, 9 aa, Homo Sapiens
TTLTLKEME

SEQ ID NO: 345997 - protein, 9 aa, Homo Sapiens
QHFNIHTGE

SEQ ID NO: 345998 - protein, 9 aa, Homo Sapiens
DDNDDPPVF

SEQ ID NO: 345999 - protein, 9 aa, Homo Sapiens
AEDEEWKII

SEQ ID NO: 346000 - protein, 9 aa, Homo Sapiens
SACTAGFFV

SEQ ID NO: 346001 - protein, 9 aa, Homo Sapiens
YKNPDYVKK

SEQ ID NO: 346002 - protein, 9 aa, Homo Sapiens
KKENKPTVS

SEQ ID NO: 346003 - protein, 9 aa, Homo Sapiens
KNENLETEL

SEQ ID NO: 346004 - protein, 9 aa, Homo Sapiens
YTPVQEFNR

SEQ ID NO: 346005 - protein, 9 aa, Homo Sapiens
GSTKSSDYL

SEQ ID NO: 346006 - protein, 9 aa, Homo Sapiens
ECTRRPAFP

SEQ ID NO: 346007 - protein, 9 aa, Homo Sapiens
RFNWRGLVA

SEQ ID NO: 346008 - protein, 9 aa, Homo Sapiens
CGKPYSPIS

SEQ ID NO: 346009 - protein, 9 aa, Homo Sapiens
YSGRGRGCR

SEQ ID NO: 346010 - protein, 9 aa, Homo Sapiens
FQCGPTSTS

SEQ ID NO: 346011 - protein, 9 aa, Homo Sapiens
SKTWDCFQM

SEQ ID NO: 346012 - protein, 9 aa, Homo Sapiens
DTELGYTKQ

SEQ ID NO: 346013 - protein, 9 aa, Homo Sapiens
TAVYHIDLV

SEQ ID NO: 346014 - protein, 9 aa, Homo Sapiens
PLKNPSVPM

SEQ ID NO: 346015 - protein, 9 aa, Homo Sapiens
RTMCQDSLP

SEQ ID NO: 346016 - protein, 9 aa, Homo Sapiens
IYPTSKLVS

SEQ ID NO: 346017 - protein, 9 aa, Homo Sapiens
GIIRTCQKF

SEQ ID NO: 346018 - protein, 9 aa, Homo Sapiens
NAHAMRWAF

SEQ ID NO: 346019 - protein, 9 aa, Homo Sapiens
WSHGYTEAL

SEQ ID NO: 346020 - protein, 9 aa, Homo Sapiens
TCCHVSITE

SEQ ID NO: 346021 - protein, 9 aa, Homo Sapiens
EKYLAYHEW

SEQ ID NO: 346022 - protein, 9 aa, Homo Sapiens
DKDLRENGE

SEQ ID NO: 346023 - protein, 9 aa, Homo Sapiens
LWFLRARDF

SEQ ID NO: 346024 - protein, 9 aa, Homo Sapiens
LYICMKCGL

SEQ ID NO: 346025 - protein, 9 aa, Homo Sapiens
EKDKKENKP

SEQ ID NO: 346026 - protein, 9 aa, Homo Sapiens
NDRVQVEFY

SEQ ID NO: 346027 - protein, 9 aa, Homo Sapiens
KPKEQILFI

SEQ ID NO: 346028 - protein, 9 aa, Homo Sapiens
SEVVKFDRS

SEQ ID NO: 346029 - protein, 9 aa, Homo Sapiens
KMPEIRMVL

SEQ ID NO: 346030 - protein, 9 aa, Homo Sapiens
GKIKLITSE

SEQ ID NO: 346031 - protein, 9 aa, Homo Sapiens
TRLAGFTAW

SEQ ID NO: 346032 - protein, 9 aa, Homo Sapiens
QGVAGYDIS

SEQ ID NO: 346033 - protein, 9 aa, Homo Sapiens
NLAALSFTP

SEQ ID NO: 346034 - protein, 9 aa, Homo Sapiens
RQTYPKKPG

SEQ ID NO: 346035 - protein, 9 aa, Homo Sapiens
ICTILVPVI

SEQ ID NO: 346036 - protein, 9 aa, Homo Sapiens
AREWTRMHG

SEQ ID NO: 346037 - protein, 9 aa, Homo Sapiens
DPEVFDSLH

SEQ ID NO: 346038 - protein, 9 aa, Homo Sapiens
IEKEHVKEI

SEQ ID NO: 346039 - protein, 9 aa, Homo Sapiens
LEQLLGGPD

SEQ ID NO: 346040 - protein, 9 aa, Homo Sapiens
APRTLSQGT

SEQ ID NO: 346041 - protein, 9 aa, Homo Sapiens
VEELKALKD

SEQ ID NO: 346042 - protein, 9 aa, Homo Sapiens
YQGLEWKLS

SEQ ID NO: 346043 - protein, 9 aa, Homo Sapiens
KMKREEKLF

SEQ ID NO: 346044 - protein, 9 aa, Homo Sapiens
KQWKEYMHR

SEQ ID NO: 346045 - protein, 9 aa, Homo Sapiens
KWSTQGEEN

SEQ ID NO: 346046 - protein, 9 aa, Homo Sapiens
HSYFICHRD

SEQ ID NO: 346047 - protein, 9 aa, Homo Sapiens
HGVEYLANN

SEQ ID NO: 346048 - protein, 9 aa, Homo Sapiens
NSDLLKLWN

SEQ ID NO: 346049 - protein, 9 aa, Homo Sapiens
WKRLSVSES

SEQ ID NO: 346050 - protein, 9 aa, Homo Sapiens
VPADIQILA

SEQ ID NO: 346051 - protein, 9 aa, Homo Sapiens
NKPFYTLQE

SEQ ID NO: 346052 - protein, 9 aa, Homo Sapiens
YQDKLFQWL

SEQ ID NO: 346053 - protein, 9 aa, Homo Sapiens
SVNLSLLDL

SEQ ID NO: 346054 - protein, 9 aa, Homo Sapiens
KRFTPRKGD

SEQ ID NO: 346055 - protein, 9 aa, Homo Sapiens
FVRNSTECR

SEQ ID NO: 346056 - protein, 9 aa, Homo Sapiens
QQEYINDDG

SEQ ID NO: 346057 - protein, 9 aa, Homo Sapiens
LEDDIVVVA

SEQ ID NO: 346058 - protein, 9 aa, Homo Sapiens
IPEEAQSDM

SEQ ID NO: 346059 - protein, 9 aa, Homo Sapiens
TQVRTDIYI

SEQ ID NO: 346060 - protein, 9 aa, Homo Sapiens
IEVASGKYG

SEQ ID NO: 346061 - protein, 9 aa, Homo Sapiens
SASKQGLAK

SEQ ID NO: 346062 - protein, 9 aa, Homo Sapiens
NNVIIVMCN

SEQ ID NO: 346063 - protein, 9 aa, Homo Sapiens
ISKEEQNRS

SEQ ID NO: 346064 - protein, 9 aa, Homo Sapiens
SSEYPELCS

SEQ ID NO: 346065 - protein, 9 aa, Homo Sapiens
FDLIDVYQK

SEQ ID NO: 346066 - protein, 9 aa, Homo Sapiens
KQQYKPDSS

SEQ ID NO: 346067 - protein, 9 aa, Homo Sapiens
SFLSNVTSN

SEQ ID NO: 346068 - protein, 9 aa, Homo Sapiens
VMCNLCIRY

SEQ ID NO: 346069 - protein, 9 aa, Homo Sapiens
NKAIPGKKS

SEQ ID NO: 346070 - protein, 9 aa, Homo Sapiens
KENDLSVIR

SEQ ID NO: 346071 - protein, 9 aa, Homo Sapiens
NIFSRFFYY

SEQ ID NO: 346072 - protein, 9 aa, Homo Sapiens
AFIRIQTNA

SEQ ID NO: 346073 - protein, 9 aa, Homo Sapiens
AGGVFLVAL

SEQ ID NO: 346074 - protein, 9 aa, Homo Sapiens
LEATNIKTS

SEQ ID NO: 346075 - protein, 9 aa, Homo Sapiens
VQICFVNPA

SEQ ID NO: 346076 - protein, 9 aa, Homo Sapiens
LKNICEVLD

SEQ ID NO: 346077 - protein, 9 aa, Homo Sapiens
GSVSSELDN

SEQ ID NO: 346078 - protein, 9 aa, Homo Sapiens
EQHIQKRLI

SEQ ID NO: 346079 - protein, 9 aa, Homo Sapiens
VRKGKKRNE

SEQ ID NO: 346080 - protein, 9 aa, Homo Sapiens
GHVNGATVI

SEQ ID NO: 346081 - protein, 9 aa, Homo Sapiens
LICVEPFTT

SEQ ID NO: 346082 - protein, 9 aa, Homo Sapiens
QSSQGEEEL

SEQ ID NO: 346083 - protein, 9 aa, Homo Sapiens
PHLHRATVF

SEQ ID NO: 346084 - protein, 9 aa, Homo Sapiens
AETACRLRA

SEQ ID NO: 346085 - protein, 9 aa, Homo Sapiens
NVCVSLVFS

SEQ ID NO: 346086 - protein, 9 aa, Homo Sapiens
EKEKKGKDH

SEQ ID NO: 346087 - protein, 9 aa, Homo Sapiens
VEYYDIKLS

SEQ ID NO: 346088 - protein, 9 aa, Homo Sapiens
IIAKEEIFG

SEQ ID NO: 346089 - protein, 9 aa, Homo Sapiens
FFCNVTPLL

SEQ ID NO: 346090 - protein, 9 aa, Homo Sapiens
FGGKCLVNV

SEQ ID NO: 346091 - protein, 9 aa, Homo Sapiens
IALQGSLKI

SEQ ID NO: 346092 - protein, 9 aa, Homo Sapiens
VCQPNELIM

SEQ ID NO: 346093 - protein, 9 aa, Homo Sapiens
EGTEASALK

SEQ ID NO: 346094 - protein, 9 aa, Homo Sapiens
EQGIHAELL

SEQ ID NO: 346095 - protein, 9 aa, Homo Sapiens
CHVDASFFL

SEQ ID NO: 346096 - protein, 9 aa, Homo Sapiens
TFANLDSSV

SEQ ID NO: 346097 - protein, 9 aa, Homo Sapiens
KYLYAAGFS

SEQ ID NO: 346098 - protein, 9 aa, Homo Sapiens
VTTQNVLKL

SEQ ID NO: 346099 - protein, 9 aa, Homo Sapiens
AAAKYVPSK

SEQ ID NO: 346100 - protein, 9 aa, Homo Sapiens
GPQTYKDHL

SEQ ID NO: 346101 - protein, 9 aa, Homo Sapiens
GKSEQSDLE

SEQ ID NO: 346102 - protein, 9 aa, Homo Sapiens
LTYSQIGGR

SEQ ID NO: 346103 - protein, 9 aa, Homo Sapiens
IEGNHLAQS

SEQ ID NO: 346104 - protein, 9 aa, Homo Sapiens
WSATILSIV

SEQ ID NO: 346105 - protein, 9 aa, Homo Sapiens
RQIFNPDYG

SEQ ID NO: 346106 - protein, 9 aa, Homo Sapiens
QMHVYYLGM

SEQ ID NO: 346107 - protein, 9 aa, Homo Sapiens
KYTLDAFGT

SEQ ID NO: 346108 - protein, 9 aa, Homo Sapiens
YFPYFTKHN

SEQ ID NO: 346109 - protein, 9 aa, Homo Sapiens
KLARVSLVC

SEQ ID NO: 346110 - protein, 9 aa, Homo Sapiens
RMLVVGTSL

SEQ ID NO: 346111 - protein, 9 aa, Homo Sapiens
LQHRLVVLF

SEQ ID NO: 346112 - protein, 9 aa, Homo Sapiens
GSSSPQKRS

SEQ ID NO: 346113 - protein, 9 aa, Homo Sapiens
PVQPVTKTI

SEQ ID NO: 346114 - protein, 9 aa, Homo Sapiens
LEQDIFNRS

SEQ ID NO: 346115 - protein, 9 aa, Homo Sapiens
LQLEGLKCI

SEQ ID NO: 346116 - protein, 9 aa, Homo Sapiens
VWKFAYAHK

SEQ ID NO: 346117 - protein, 9 aa, Homo Sapiens
RSQRILQRI

SEQ ID NO: 346118 - protein, 9 aa, Homo Sapiens
TTASESISN

SEQ ID NO: 346119 - protein, 9 aa, Homo Sapiens
VRIMNLIGM

SEQ ID NO: 346120 - protein, 9 aa, Homo Sapiens
LNKWSCESI

SEQ ID NO: 346121 - protein, 9 aa, Homo Sapiens
LSSSKENAW

SEQ ID NO: 346122 - protein, 9 aa, Homo Sapiens
LKMLVNFIV

SEQ ID NO: 346123 - protein, 9 aa, Homo Sapiens
TSKWTNNYS

SEQ ID NO: 346124 - protein, 9 aa, Homo Sapiens
SYEDRVKRL

SEQ ID NO: 346125 - protein, 9 aa, Homo Sapiens
IDPIQVVQG

SEQ ID NO: 346126 - protein, 9 aa, Homo Sapiens
KGLLAPLLN

SEQ ID NO: 346127 - protein, 9 aa, Homo Sapiens
PGVVSTPIP

SEQ ID NO: 346128 - protein, 9 aa, Homo Sapiens
QTKEGCYFH

SEQ ID NO: 346129 - protein, 9 aa, Homo Sapiens
SQVSKHQIT

SEQ ID NO: 346130 - protein, 9 aa, Homo Sapiens
VSGIICFLL

SEQ ID NO: 346131 - protein, 9 aa, Homo Sapiens
ENQPHKKYK

SEQ ID NO: 346132 - protein, 9 aa, Homo Sapiens
AFPQNDDEK

SEQ ID NO: 346133 - protein, 9 aa, Homo Sapiens
TENINNTFI

SEQ ID NO: 346134 - protein, 9 aa, Homo Sapiens
NAYISALNL

SEQ ID NO: 346135 - protein, 9 aa, Homo Sapiens
SGCCFSRPA

SEQ ID NO: 346136 - protein, 9 aa, Homo Sapiens
RRLNGQAFP

SEQ ID NO: 346137 - protein, 9 aa, Homo Sapiens
ENLSAPEAE

SEQ ID NO: 346138 - protein, 9 aa, Homo Sapiens
LLNSMMTVG

SEQ ID NO: 346139 - protein, 9 aa, Homo Sapiens
LVGLIQSSF

SEQ ID NO: 346140 - protein, 9 aa, Homo Sapiens
FDKILYNKF

SEQ ID NO: 346141 - protein, 9 aa, Homo Sapiens
ACKERQKRG

SEQ ID NO: 346142 - protein, 9 aa, Homo Sapiens
PVNCALYIC

SEQ ID NO: 346143 - protein, 9 aa, Homo Sapiens
KDKKENKPT

SEQ ID NO: 346144 - protein, 9 aa, Homo Sapiens
KTAKSFALH

SEQ ID NO: 346145 - protein, 9 aa, Homo Sapiens
DKIARNGDA

SEQ ID NO: 346146 - protein, 9 aa, Homo Sapiens
PAEGNTTDQ

SEQ ID NO: 346147 - protein, 9 aa, Homo Sapiens
SVVFGMRKA

SEQ ID NO: 346148 - protein, 9 aa, Homo Sapiens
SWDYGINQP

SEQ ID NO: 346149 - protein, 9 aa, Homo Sapiens
AADVAIKHR

SEQ ID NO: 346150 - protein, 9 aa, Homo Sapiens
TGMKRKDEL

SEQ ID NO: 346151 - protein, 9 aa, Homo Sapiens
VKMAKDRIN

SEQ ID NO: 346152 - protein, 9 aa, Homo Sapiens
EEDASSKVE

SEQ ID NO: 346153 - protein, 9 aa, Homo Sapiens
CNDNQREVC

SEQ ID NO: 346154 - protein, 9 aa, Homo Sapiens
SPARVRSSQ

SEQ ID NO: 346155 - protein, 9 aa, Homo Sapiens
AENGLVHQT

SEQ ID NO: 346156 - protein, 9 aa, Homo Sapiens
SSLSSPSVE

SEQ ID NO: 346157 - protein, 9 aa, Homo Sapiens
NKTRSFHHK

SEQ ID NO: 346158 - protein, 9 aa, Homo Sapiens
NLKTLFSVG

SEQ ID NO: 346159 - protein, 9 aa, Homo Sapiens
WRRDHGPQS

SEQ ID NO: 346160 - protein, 9 aa, Homo Sapiens
GYWPLWDLG

SEQ ID NO: 346161 - protein, 9 aa, Homo Sapiens
CSNSVTAAV

SEQ ID NO: 346162 - protein, 9 aa, Homo Sapiens
FREGHQWDK

SEQ ID NO: 346163 - protein, 9 aa, Homo Sapiens
PVYYKQLVL

SEQ ID NO: 346164 - protein, 9 aa, Homo Sapiens
FVHTDMTKN

SEQ ID NO: 346165 - protein, 9 aa, Homo Sapiens
EKEKRKQEE

SEQ ID NO: 346166 - protein, 9 aa, Homo Sapiens
QTNCLMTLF

SEQ ID NO: 346167 - protein, 9 aa, Homo Sapiens
IMGYDRYVA

SEQ ID NO: 346168 - protein, 9 aa, Homo Sapiens
NNWFKWFIG

SEQ ID NO: 346169 - protein, 9 aa, Homo Sapiens
DSQSGSPHE

SEQ ID NO: 346170 - protein, 9 aa, Homo Sapiens
LAQSKNRSL

SEQ ID NO: 346171 - protein, 9 aa, Homo Sapiens
LPTCGSHFA

SEQ ID NO: 346172 - protein, 9 aa, Homo Sapiens
RGHLRDDIK

SEQ ID NO: 346173 - protein, 9 aa, Homo Sapiens
ILSLYEVVH

SEQ ID NO: 346174 - protein, 9 aa, Homo Sapiens
ERHSVCDDI

SEQ ID NO: 346175 - protein, 9 aa, Homo Sapiens
PLGRELSVS

SEQ ID NO: 346176 - protein, 9 aa, Homo Sapiens
FGRLEINLD

SEQ ID NO: 346177 - protein, 9 aa, Homo Sapiens
QFLRVMTWQ

SEQ ID NO: 346178 - protein, 9 aa, Homo Sapiens
KQQIQKIER

SEQ ID NO: 346179 - protein, 9 aa, Homo Sapiens
IMDVLSADD

SEQ ID NO: 346180 - protein, 9 aa, Homo Sapiens
VSVILLLSM

SEQ ID NO: 346181 - protein, 9 aa, Homo Sapiens
PIIKLMIIP

SEQ ID NO: 346182 - protein, 9 aa, Homo Sapiens
CANHFADGR

SEQ ID NO: 346183 - protein, 9 aa, Homo Sapiens
PRYLDIPGD

SEQ ID NO: 346184 - protein, 9 aa, Homo Sapiens
VKESGKRKV

SEQ ID NO: 346185 - protein, 9 aa, Homo Sapiens
KWMVHGYPS

SEQ ID NO: 346186 - protein, 9 aa, Homo Sapiens
HQQECDEDD

SEQ ID NO: 346187 - protein, 9 aa, Homo Sapiens
FLLPGGLEC

SEQ ID NO: 346188 - protein, 9 aa, Homo Sapiens
GYQTVVALD

SEQ ID NO: 346189 - protein, 9 aa, Homo Sapiens
DIVQFLVQL

SEQ ID NO: 346190 - protein, 9 aa, Homo Sapiens
SLNQEYLNL

SEQ ID NO: 346191 - protein, 9 aa, Homo Sapiens
DLDPCLLED

SEQ ID NO: 346192 - protein, 9 aa, Homo Sapiens
PLQATHSGI

SEQ ID NO: 346193 - protein, 9 aa, Homo Sapiens
SLRNLYTQN

SEQ ID NO: 346194 - protein, 9 aa, Homo Sapiens
LELGYSEEQ

SEQ ID NO: 346195 - protein, 9 aa, Homo Sapiens
ASSASESQI

SEQ ID NO: 346196 - protein, 9 aa, Homo Sapiens
SKSLSLVLG

SEQ ID NO: 346197 - protein, 9 aa, Homo Sapiens
KFFGDPIEV

SEQ ID NO: 346198 - protein, 9 aa, Homo Sapiens
QKQEVWEAF

SEQ ID NO: 346199 - protein, 9 aa, Homo Sapiens
GTPLGYIPY

SEQ ID NO: 346200 - protein, 9 aa, Homo Sapiens
FRNSPISHL

SEQ ID NO: 346201 - protein, 9 aa, Homo Sapiens
PPWGRLHSH

SEQ ID NO: 346202 - protein, 9 aa, Homo Sapiens
GKGTHCSQN

SEQ ID NO: 346203 - protein, 9 aa, Homo Sapiens
SKKNVCVSL

SEQ ID NO: 346204 - protein, 9 aa, Homo Sapiens
HEANRDANK

SEQ ID NO: 346205 - protein, 9 aa, Homo Sapiens
KGLFVPLQS

SEQ ID NO: 346206 - protein, 9 aa, Homo Sapiens
TPTWKAETA

SEQ ID NO: 346207 - protein, 9 aa, Homo Sapiens
QLIFYAHPE

SEQ ID NO: 346208 - protein, 9 aa, Homo Sapiens
LEGMSLGID

SEQ ID NO: 346209 - protein, 9 aa, Homo Sapiens
FPHHGIATS

SEQ ID NO: 346210 - protein, 9 aa, Homo Sapiens
AVKNLASPL

SEQ ID NO: 346211 - protein, 9 aa, Homo Sapiens
DEASFQTEV

SEQ ID NO: 346212 - protein, 9 aa, Homo Sapiens
AKLQFAYID

SEQ ID NO: 346213 - protein, 9 aa, Homo Sapiens
CRICCKSYV

SEQ ID NO: 346214 - protein, 9 aa, Homo Sapiens
RIPKADAPL

SEQ ID NO: 346215 - protein, 9 aa, Homo Sapiens
TRWDEASFQ

SEQ ID NO: 346216 - protein, 9 aa, Homo Sapiens
ERCLRKALL

SEQ ID NO: 346217 - protein, 9 aa, Homo Sapiens
NEEHSHRDK

SEQ ID NO: 346218 - protein, 9 aa, Homo Sapiens
LHKQINKPQ

SEQ ID NO: 346219 - protein, 9 aa, Homo Sapiens
PFPKTTLTL

SEQ ID NO: 346220 - protein, 9 aa, Homo Sapiens
TDSNHSIAT

SEQ ID NO: 346221 - protein, 9 aa, Homo Sapiens
KKEFWNPSI

SEQ ID NO: 346222 - protein, 9 aa, Homo Sapiens
LKEPQQDGG

SEQ ID NO: 346223 - protein, 9 aa, Homo Sapiens
KTKKDKAFY

SEQ ID NO: 346224 - protein, 9 aa, Homo Sapiens
TGSLYDPSP

SEQ ID NO: 346225 - protein, 9 aa, Homo Sapiens
GLVAGKRAE

SEQ ID NO: 346226 - protein, 9 aa, Homo Sapiens
HKQKASGQT

SEQ ID NO: 346227 - protein, 9 aa, Homo Sapiens
VDTYWPFQG

SEQ ID NO: 346228 - protein, 9 aa, Homo Sapiens
PILEMALIP

SEQ ID NO: 346229 - protein, 9 aa, Homo Sapiens
GVKEAVTAL

SEQ ID NO: 346230 - protein, 9 aa, Homo Sapiens
KMHNSNTGI

SEQ ID NO: 346231 - protein, 9 aa, Homo Sapiens
LHRPMYFVL

SEQ ID NO: 346232 - protein, 9 aa, Homo Sapiens
ASLSWDLQF

SEQ ID NO: 346233 - protein, 9 aa, Homo Sapiens
ILCFNFPST

SEQ ID NO: 346234 - protein, 9 aa, Homo Sapiens
KLEKQMTSF

SEQ ID NO: 346235 - protein, 9 aa, Homo Sapiens
VCSAFLAAY

SEQ ID NO: 346236 - protein, 9 aa, Homo Sapiens
EWAEVDRKR

SEQ ID NO: 346237 - protein, 9 aa, Homo Sapiens
SLSDQEGYF

SEQ ID NO: 346238 - protein, 9 aa, Homo Sapiens
KARKESEPL

SEQ ID NO: 346239 - protein, 9 aa, Homo Sapiens
TNTQENKHY

SEQ ID NO: 346240 - protein, 9 aa, Homo Sapiens
TSVYYITFS

SEQ ID NO: 346241 - protein, 9 aa, Homo Sapiens
GKLLNKEWK

SEQ ID NO: 346242 - protein, 9 aa, Homo Sapiens
REAANQLLI

SEQ ID NO: 346243 - protein, 9 aa, Homo Sapiens
DGSFNCVCN

SEQ ID NO: 346244 - protein, 9 aa, Homo Sapiens
GGGWLVHEE

SEQ ID NO: 346245 - protein, 9 aa, Homo Sapiens
CSFPMADSS

SEQ ID NO: 346246 - protein, 9 aa, Homo Sapiens
AKGYTQFYY

SEQ ID NO: 346247 - protein, 9 aa, Homo Sapiens
EPELYLNPF

SEQ ID NO: 346248 - protein, 9 aa, Homo Sapiens
KIIESPMHP

SEQ ID NO: 346249 - protein, 9 aa, Homo Sapiens
DVPPGEYKG

SEQ ID NO: 346250 - protein, 9 aa, Homo Sapiens
DPSSLQKHV

SEQ ID NO: 346251 - protein, 9 aa, Homo Sapiens
LEENEECTM

SEQ ID NO: 346252 - protein, 9 aa, Homo Sapiens
THFTGNKVG

SEQ ID NO: 346253 - protein, 9 aa, Homo Sapiens
ALTSKINLH

SEQ ID NO: 346254 - protein, 9 aa, Homo Sapiens
LPVYYKQLV

SEQ ID NO: 346255 - protein, 9 aa, Homo Sapiens
LFMEGVGKP

SEQ ID NO: 346256 - protein, 9 aa, Homo Sapiens
QAETLVTLD

SEQ ID NO: 346257 - protein, 9 aa, Homo Sapiens
LGHCHYERK

SEQ ID NO: 346258 - protein, 9 aa, Homo Sapiens
KSKEVVTHM

SEQ ID NO: 346259 - protein, 9 aa, Homo Sapiens
QKITYEGGN

SEQ ID NO: 346260 - protein, 9 aa, Homo Sapiens
SPVFSDDDS

SEQ ID NO: 346261 - protein, 9 aa, Homo Sapiens
TNRNGEEMR

SEQ ID NO: 346262 - protein, 9 aa, Homo Sapiens
SVMNLDNLT

SEQ ID NO: 346263 - protein, 9 aa, Homo Sapiens
LVLVSPPRC

SEQ ID NO: 346264 - protein, 9 aa, Homo Sapiens
RHSPKRVPT

SEQ ID NO: 346265 - protein, 9 aa, Homo Sapiens
ELYKLLGRK

SEQ ID NO: 346266 - protein, 9 aa, Homo Sapiens
VALFKTWDL

SEQ ID NO: 346267 - protein, 9 aa, Homo Sapiens
VTVLFLYTA

SEQ ID NO: 346268 - protein, 9 aa, Homo Sapiens
SNDAHTKKA

SEQ ID NO: 346269 - protein, 9 aa, Homo Sapiens
DLKWSCLPL

SEQ ID NO: 346270 - protein, 9 aa, Homo Sapiens
QATTDAIEA

SEQ ID NO: 346271 - protein, 9 aa, Homo Sapiens
TNEAAALLD

SEQ ID NO: 346272 - protein, 9 aa, Homo Sapiens
NASLRTTSS

SEQ ID NO: 346273 - protein, 9 aa, Homo Sapiens
IFQSMYYPL

SEQ ID NO: 346274 - protein, 9 aa, Homo Sapiens
RISRVEELA

SEQ ID NO: 346275 - protein, 9 aa, Homo Sapiens
GNTWYMNAV

SEQ ID NO: 346276 - protein, 9 aa, Homo Sapiens
RSGRCANGL

SEQ ID NO: 346277 - protein, 9 aa, Homo Sapiens
VLYFDCWFQ

SEQ ID NO: 346278 - protein, 9 aa, Homo Sapiens
GAQVMRNGD

SEQ ID NO: 346279 - protein, 9 aa, Homo Sapiens
DIWPLGCLL

SEQ ID NO: 346280 - protein, 9 aa, Homo Sapiens
RLCFNHFAT

SEQ ID NO: 346281 - protein, 9 aa, Homo Sapiens
ARTIHVYPN

SEQ ID NO: 346282 - protein, 9 aa, Homo Sapiens
EDKHLMSSI

SEQ ID NO: 346283 - protein, 9 aa, Homo Sapiens
EPHDKHRLD

SEQ ID NO: 346284 - protein, 9 aa, Homo Sapiens
LSQHKKIRT

SEQ ID NO: 346285 - protein, 9 aa, Homo Sapiens
TIIIISMIL

SEQ ID NO: 346286 - protein, 9 aa, Homo Sapiens
TKIKEKEIE

SEQ ID NO: 346287 - protein, 9 aa, Homo Sapiens
KHICGEYQI

SEQ ID NO: 346288 - protein, 9 aa, Homo Sapiens
LVFENSVGD

SEQ ID NO: 346289 - protein, 9 aa, Homo Sapiens
TSGTFRLRQ

SEQ ID NO: 346290 - protein, 9 aa, Homo Sapiens
SETSLVNKP

SEQ ID NO: 346291 - protein, 9 aa, Homo Sapiens
PEIRMVLFG

SEQ ID NO: 346292 - protein, 9 aa, Homo Sapiens
KELTSNNSA

SEQ ID NO: 346293 - protein, 9 aa, Homo Sapiens
GMKNTQQCP

SEQ ID NO: 346294 - protein, 9 aa, Homo Sapiens
IAIPKKKIN

SEQ ID NO: 346295 - protein, 9 aa, Homo Sapiens
QIPQSYNVT

SEQ ID NO: 346296 - protein, 9 aa, Homo Sapiens
WSEVEAERE

SEQ ID NO: 346297 - protein, 9 aa, Homo Sapiens
IIMYTRANS

SEQ ID NO: 346298 - protein, 9 aa, Homo Sapiens
QRLLSDQEL

SEQ ID NO: 346299 - protein, 9 aa, Homo Sapiens
TEKGSEKLL

SEQ ID NO: 346300 - protein, 9 aa, Homo Sapiens
YFVIAYIYA

SEQ ID NO: 346301 - protein, 9 aa, Homo Sapiens
EKNEHGFQK

SEQ ID NO: 346302 - protein, 9 aa, Homo Sapiens
EESRLKLAT

SEQ ID NO: 346303 - protein, 9 aa, Homo Sapiens
CCQPTCGRS

SEQ ID NO: 346304 - protein, 9 aa, Homo Sapiens
APPGGRTNI

SEQ ID NO: 346305 - protein, 9 aa, Homo Sapiens
TAASSVSTG

SEQ ID NO: 346306 - protein, 9 aa, Homo Sapiens
HGGWDWSQG

SEQ ID NO: 346307 - protein, 9 aa, Homo Sapiens
IRGTERPLG

SEQ ID NO: 346308 - protein, 9 aa, Homo Sapiens
CSRFQESLN

SEQ ID NO: 346309 - protein, 9 aa, Homo Sapiens
KFRNAMLKN

SEQ ID NO: 346310 - protein, 9 aa, Homo Sapiens
EDYQNRYRS

SEQ ID NO: 346311 - protein, 9 aa, Homo Sapiens
LDGVDIYSL

SEQ ID NO: 346312 - protein, 9 aa, Homo Sapiens
EISRFQKRD

SEQ ID NO: 346313 - protein, 9 aa, Homo Sapiens
FAFSIFKSD

SEQ ID NO: 346314 - protein, 9 aa, Homo Sapiens
EDQHTQITQ

SEQ ID NO: 346315 - protein, 9 aa, Homo Sapiens
VNKAQDNTR

SEQ ID NO: 346316 - protein, 9 aa, Homo Sapiens
PKTQQYVRA

SEQ ID NO: 346317 - protein, 9 aa, Homo Sapiens
LDNEIKHEM

SEQ ID NO: 346318 - protein, 9 aa, Homo Sapiens
WAQQTPVQL

SEQ ID NO: 346319 - protein, 9 aa, Homo Sapiens
VVQLLNFFS

SEQ ID NO: 346320 - protein, 9 aa, Homo Sapiens
KFRINILSL

SEQ ID NO: 346321 - protein, 9 aa, Homo Sapiens
SPRLPRSPC

SEQ ID NO: 346322 - protein, 9 aa, Homo Sapiens
PSVQENSQA

SEQ ID NO: 346323 - protein, 9 aa, Homo Sapiens
QRFDPPIII

SEQ ID NO: 346324 - protein, 9 aa, Homo Sapiens
TAKTSVKPS

SEQ ID NO: 346325 - protein, 9 aa, Homo Sapiens
STHLTQHQN

SEQ ID NO: 346326 - protein, 9 aa, Homo Sapiens
VNRPYLCTP

SEQ ID NO: 346327 - protein, 9 aa, Homo Sapiens
PCSVLPHTS

SEQ ID NO: 346328 - protein, 9 aa, Homo Sapiens
FVSRKRQIL

SEQ ID NO: 346329 - protein, 9 aa, Homo Sapiens
EIASQEKKI

SEQ ID NO: 346330 - protein, 9 aa, Homo Sapiens
LMFALSTFE

SEQ ID NO: 346331 - protein, 9 aa, Homo Sapiens
ISWLDEEEE

SEQ ID NO: 346332 - protein, 9 aa, Homo Sapiens
RQKSYTSDL

SEQ ID NO: 346333 - protein, 9 aa, Homo Sapiens
SYPESAQST

SEQ ID NO: 346334 - protein, 9 aa, Homo Sapiens
REGLSEEVT

SEQ ID NO: 346335 - protein, 9 aa, Homo Sapiens
SEKTKCLNE

SEQ ID NO: 346336 - protein, 9 aa, Homo Sapiens
TTLKSATAI

SEQ ID NO: 346337 - protein, 9 aa, Homo Sapiens
IIENNHSLY

SEQ ID NO: 346338 - protein, 9 aa, Homo Sapiens
KEKAIEVEC

SEQ ID NO: 346339 - protein, 9 aa, Homo Sapiens
GHCKWFNVC

SEQ ID NO: 346340 - protein, 9 aa, Homo Sapiens
ETSLIEVYM

SEQ ID NO: 346341 - protein, 9 aa, Homo Sapiens
LMDVAPSES

SEQ ID NO: 346342 - protein, 9 aa, Homo Sapiens
RSGKLLNKE

SEQ ID NO: 346343 - protein, 9 aa, Homo Sapiens
NGKEVIFAF

SEQ ID NO: 346344 - protein, 9 aa, Homo Sapiens
KSKEIHNTP

SEQ ID NO: 346345 - protein, 9 aa, Homo Sapiens
SGDRPFKCK

SEQ ID NO: 346346 - protein, 9 aa, Homo Sapiens
RRRQWSEKK

SEQ ID NO: 346347 - protein, 9 aa, Homo Sapiens
LCFGLEDQT

SEQ ID NO: 346348 - protein, 9 aa, Homo Sapiens
VVFVVSWLP

SEQ ID NO: 346349 - protein, 9 aa, Homo Sapiens
CGRYFAHIS

SEQ ID NO: 346350 - protein, 9 aa, Homo Sapiens
NELELTKMN

SEQ ID NO: 346351 - protein, 9 aa, Homo Sapiens
DCIHCTQDG

SEQ ID NO: 346352 - protein, 9 aa, Homo Sapiens
NIIAYDNSR

SEQ ID NO: 346353 - protein, 9 aa, Homo Sapiens
CMSKYTVVF

SEQ ID NO: 346354 - protein, 9 aa, Homo Sapiens
QGPKNIEQI

SEQ ID NO: 346355 - protein, 9 aa, Homo Sapiens
AYHPFSRLA

SEQ ID NO: 346356 - protein, 9 aa, Homo Sapiens
ADAFVHHID

SEQ ID NO: 346357 - protein, 9 aa, Homo Sapiens
EKYTVIYLY

SEQ ID NO: 346358 - protein, 9 aa, Homo Sapiens
IALEASFSS

SEQ ID NO: 346359 - protein, 9 aa, Homo Sapiens
KENKPTVSV

SEQ ID NO: 346360 - protein, 9 aa, Homo Sapiens
WTRLVGINL

SEQ ID NO: 346361 - protein, 9 aa, Homo Sapiens
VVDQCLACL

SEQ ID NO: 346362 - protein, 9 aa, Homo Sapiens
IYGLDFVKK

SEQ ID NO: 346363 - protein, 9 aa, Homo Sapiens
KILYNKFNH

SEQ ID NO: 346364 - protein, 9 aa, Homo Sapiens
LTSQSPTDI

SEQ ID NO: 346365 - protein, 9 aa, Homo Sapiens
IWHRPALVK

SEQ ID NO: 346366 - protein, 9 aa, Homo Sapiens
YNTPGHNYS

SEQ ID NO: 346367 - protein, 9 aa, Homo Sapiens
GYDNEDNYS

SEQ ID NO: 346368 - protein, 9 aa, Homo Sapiens
INCKQDWSD

SEQ ID NO: 346369 - protein, 9 aa, Homo Sapiens
ESQIISCRL

SEQ ID NO: 346370 - protein, 9 aa, Homo Sapiens
RCYSAEVGT

SEQ ID NO: 346371 - protein, 9 aa, Homo Sapiens
HLNQHLRVN

SEQ ID NO: 346372 - protein, 9 aa, Homo Sapiens
NEKQRKQAF

SEQ ID NO: 346373 - protein, 9 aa, Homo Sapiens
IFQSYPESA

SEQ ID NO: 346374 - protein, 9 aa, Homo Sapiens
LLPEGAGRF

SEQ ID NO: 346375 - protein, 9 aa, Homo Sapiens
EAIQILAAA

SEQ ID NO: 346376 - protein, 9 aa, Homo Sapiens
SILEKESDK

SEQ ID NO: 346377 - protein, 9 aa, Homo Sapiens
FTCDNVLWA

SEQ ID NO: 346378 - protein, 9 aa, Homo Sapiens
VQLFSGLEI

SEQ ID NO: 346379 - protein, 9 aa, Homo Sapiens
LIDSLSKNI

SEQ ID NO: 346380 - protein, 9 aa, Homo Sapiens
RFGKFIQIH

SEQ ID NO: 346381 - protein, 9 aa, Homo Sapiens
IEDNVRFEH

SEQ ID NO: 346382 - protein, 9 aa, Homo Sapiens
RVPCPVTTD

SEQ ID NO: 346383 - protein, 9 aa, Homo Sapiens
KGISRQSAN

SEQ ID NO: 346384 - protein, 9 aa, Homo Sapiens
ISCDCNRAG

SEQ ID NO: 346385 - protein, 9 aa, Homo Sapiens
EQSNKCVQA

SEQ ID NO: 346386 - protein, 9 aa, Homo Sapiens
GGLKQFYFP

SEQ ID NO: 346387 - protein, 9 aa, Homo Sapiens
DAFFKIIQN

SEQ ID NO: 346388 - protein, 9 aa, Homo Sapiens
GVDCNHKRK

SEQ ID NO: 346389 - protein, 9 aa, Homo Sapiens
FVPEEMMEE

SEQ ID NO: 346390 - protein, 9 aa, Homo Sapiens
IMSFSGGQQ

SEQ ID NO: 346391 - protein, 9 aa, Homo Sapiens
TRHRQIHTG

SEQ ID NO: 346392 - protein, 9 aa, Homo Sapiens
EDLKVNQFK

SEQ ID NO: 346393 - protein, 9 aa, Homo Sapiens
NELVIFIFS

SEQ ID NO: 346394 - protein, 9 aa, Homo Sapiens
LLVNTERSE

SEQ ID NO: 346395 - protein, 9 aa, Homo Sapiens
GIDLWSGAM

SEQ ID NO: 346396 - protein, 9 aa, Homo Sapiens
LENVQPDNV

SEQ ID NO: 346397 - protein, 9 aa, Homo Sapiens
EICGALVDV

SEQ ID NO: 346398 - protein, 9 aa, Homo Sapiens
AEHGLPGTS

SEQ ID NO: 346399 - protein, 9 aa, Homo Sapiens
IHDIHGIIN

SEQ ID NO: 346400 - protein, 9 aa, Homo Sapiens
IPSILKYAE

SEQ ID NO: 346401 - protein, 9 aa, Homo Sapiens
LRKIKENIQ

SEQ ID NO: 346402 - protein, 9 aa, Homo Sapiens
VYPRHFGPV

SEQ ID NO: 346403 - protein, 9 aa, Homo Sapiens
VRADEYYLY

SEQ ID NO: 346404 - protein, 9 aa, Homo Sapiens
QLQKLVSFD

SEQ ID NO: 346405 - protein, 9 aa, Homo Sapiens
KRIITGEKP

SEQ ID NO: 346406 - protein, 9 aa, Homo Sapiens
KSIYFSGCL

SEQ ID NO: 346407 - protein, 9 aa, Homo Sapiens
MDTDDPQIK

SEQ ID NO: 346408 - protein, 9 aa, Homo Sapiens
GILCELKEV

SEQ ID NO: 346409 - protein, 9 aa, Homo Sapiens
DDATTCHIG

SEQ ID NO: 346410 - protein, 9 aa, Homo Sapiens
HAKKIKYFE

SEQ ID NO: 346411 - protein, 9 aa, Homo Sapiens
LHQQTSDSN

SEQ ID NO: 346412 - protein, 9 aa, Homo Sapiens
HFVSSLSDK

SEQ ID NO: 346413 - protein, 9 aa, Homo Sapiens
VQQTGCVKC

SEQ ID NO: 346414 - protein, 9 aa, Homo Sapiens
ALNRHKMTH

SEQ ID NO: 346415 - protein, 9 aa, Homo Sapiens
QIHEITHTG

SEQ ID NO: 346416 - protein, 9 aa, Homo Sapiens
IEDMLERHE

SEQ ID NO: 346417 - protein, 9 aa, Homo Sapiens
VNCICVDCK

SEQ ID NO: 346418 - protein, 9 aa, Homo Sapiens
TQASTEGCK

SEQ ID NO: 346419 - protein, 9 aa, Homo Sapiens
RSIKGGIEG

SEQ ID NO: 346420 - protein, 9 aa, Homo Sapiens
LFTNQKENI

SEQ ID NO: 346421 - protein, 9 aa, Homo Sapiens
KFHYKFFCD

SEQ ID NO: 346422 - protein, 9 aa, Homo Sapiens
QSNLISKVP

SEQ ID NO: 346423 - protein, 9 aa, Homo Sapiens
VSEYRFVSD

SEQ ID NO: 346424 - protein, 9 aa, Homo Sapiens
PLDLHLSMF

SEQ ID NO: 346425 - protein, 9 aa, Homo Sapiens
SCGRGHKQQ

SEQ ID NO: 346426 - protein, 9 aa, Homo Sapiens
KNYSNTSKL

SEQ ID NO: 346427 - protein, 9 aa, Homo Sapiens
PSTQLHFHF

SEQ ID NO: 346428 - protein, 9 aa, Homo Sapiens
PSRKKQGRK

SEQ ID NO: 346429 - protein, 9 aa, Homo Sapiens
RERLSLLWS

SEQ ID NO: 346430 - protein, 9 aa, Homo Sapiens
VTENADSDI

SEQ ID NO: 346431 - protein, 9 aa, Homo Sapiens
NNSTNQNKC

SEQ ID NO: 346432 - protein, 9 aa, Homo Sapiens
TLFMVLEHY

SEQ ID NO: 346433 - protein, 9 aa, Homo Sapiens
CGNTFNRCS

SEQ ID NO: 346434 - protein, 9 aa, Homo Sapiens
RAWEELDGS

SEQ ID NO: 346435 - protein, 9 aa, Homo Sapiens
CQLTKTSRE

SEQ ID NO: 346436 - protein, 9 aa, Homo Sapiens
LQKKQNVLQ

SEQ ID NO: 346437 - protein, 9 aa, Homo Sapiens
MRHSGTSAA

SEQ ID NO: 346438 - protein, 9 aa, Homo Sapiens
HPQPYRWSC

SEQ ID NO: 346439 - protein, 9 aa, Homo Sapiens
LGGWERYTK

SEQ ID NO: 346440 - protein, 9 aa, Homo Sapiens
KIVESTLFQ

SEQ ID NO: 346441 - protein, 9 aa, Homo Sapiens
KLLNKEWKK

SEQ ID NO: 346442 - protein, 9 aa, Homo Sapiens
QIELVQKLA

SEQ ID NO: 346443 - protein, 9 aa, Homo Sapiens
YRQRHRHER

SEQ ID NO: 346444 - protein, 9 aa, Homo Sapiens
KNSVQSGKS

SEQ ID NO: 346445 - protein, 9 aa, Homo Sapiens
AQCICLSLV

SEQ ID NO: 346446 - protein, 9 aa, Homo Sapiens
SRESVEEKQ

SEQ ID NO: 346447 - protein, 9 aa, Homo Sapiens
SGIGFKTAK

SEQ ID NO: 346448 - protein, 9 aa, Homo Sapiens
LCPEVILAS

SEQ ID NO: 346449 - protein, 9 aa, Homo Sapiens
SNSGMLPNT

SEQ ID NO: 346450 - protein, 9 aa, Homo Sapiens
FPIIDGRNR

SEQ ID NO: 346451 - protein, 9 aa, Homo Sapiens
SSNLTKHKL

SEQ ID NO: 346452 - protein, 9 aa, Homo Sapiens
KVPADIQIL

SEQ ID NO: 346453 - protein, 9 aa, Homo Sapiens
GISEDQRLQ

SEQ ID NO: 346454 - protein, 9 aa, Homo Sapiens
KSQIEDEEE

SEQ ID NO: 346455 - protein, 9 aa, Homo Sapiens
NFRFQKDFM

SEQ ID NO: 346456 - protein, 9 aa, Homo Sapiens
FWVLGTLFL

SEQ ID NO: 346457 - protein, 9 aa, Homo Sapiens
FKVNKSSYS

SEQ ID NO: 346458 - protein, 9 aa, Homo Sapiens
GYLAMVIEG

SEQ ID NO: 346459 - protein, 9 aa, Homo Sapiens
STEGLITLT

SEQ ID NO: 346460 - protein, 9 aa, Homo Sapiens
VLTIVTLMV

SEQ ID NO: 346461 - protein, 9 aa, Homo Sapiens
CQTNINEGA

SEQ ID NO: 346462 - protein, 9 aa, Homo Sapiens
QCLKCLKNM

SEQ ID NO: 346463 - protein, 9 aa, Homo Sapiens
FSHSSNNPQ

SEQ ID NO: 346464 - protein, 9 aa, Homo Sapiens
ARDPAWLPE

SEQ ID NO: 346465 - protein, 9 aa, Homo Sapiens
MRPFEHIMK

SEQ ID NO: 346466 - protein, 9 aa, Homo Sapiens
VSVAVEAST

SEQ ID NO: 346467 - protein, 9 aa, Homo Sapiens
TEMQNDLFN

SEQ ID NO: 346468 - protein, 9 aa, Homo Sapiens
KLTPLHCAA

SEQ ID NO: 346469 - protein, 9 aa, Homo Sapiens
TVIVAWAIG

SEQ ID NO: 346470 - protein, 9 aa, Homo Sapiens
PIIKRRQCQ

SEQ ID NO: 346471 - protein, 9 aa, Homo Sapiens
KRMLTKDLQ

SEQ ID NO: 346472 - protein, 9 aa, Homo Sapiens
GARLEGDLP

SEQ ID NO: 346473 - protein, 9 aa, Homo Sapiens
VHARLSEAE

SEQ ID NO: 346474 - protein, 9 aa, Homo Sapiens
FLEEIAKAA

SEQ ID NO: 346475 - protein, 9 aa, Homo Sapiens
SNGCMHTLH

SEQ ID NO: 346476 - protein, 9 aa, Homo Sapiens
EVFYTPVQE

SEQ ID NO: 346477 - protein, 9 aa, Homo Sapiens
RVWMMKGDF

SEQ ID NO: 346478 - protein, 9 aa, Homo Sapiens
RYHRIIKIE

SEQ ID NO: 346479 - protein, 9 aa, Homo Sapiens
GAMYLVSSA

SEQ ID NO: 346480 - protein, 9 aa, Homo Sapiens
LMNSTDQES

SEQ ID NO: 346481 - protein, 9 aa, Homo Sapiens
HLHIDVVSE

SEQ ID NO: 346482 - protein, 9 aa, Homo Sapiens
MELLAAAGR

SEQ ID NO: 346483 - protein, 9 aa, Homo Sapiens
SPGWDVKLL

SEQ ID NO: 346484 - protein, 9 aa, Homo Sapiens
DARYEAACH

SEQ ID NO: 346485 - protein, 9 aa, Homo Sapiens
RAQIIAEPE

SEQ ID NO: 346486 - protein, 9 aa, Homo Sapiens
LDETIIIVH

SEQ ID NO: 346487 - protein, 9 aa, Homo Sapiens
FCKMSIYFR

SEQ ID NO: 346488 - protein, 9 aa, Homo Sapiens
QIKYLNLFY

SEQ ID NO: 346489 - protein, 9 aa, Homo Sapiens
VTVSHHPQP

SEQ ID NO: 346490 - protein, 9 aa, Homo Sapiens
YFVSSGLLI

SEQ ID NO: 346491 - protein, 9 aa, Homo Sapiens
RICPTKDVR

SEQ ID NO: 346492 - protein, 9 aa, Homo Sapiens
ANNRLFSSS

SEQ ID NO: 346493 - protein, 9 aa, Homo Sapiens
LRFPDCRKC

SEQ ID NO: 346494 - protein, 9 aa, Homo Sapiens
VKYNVLYFA

SEQ ID NO: 346495 - protein, 9 aa, Homo Sapiens
QSHTFSEQT

SEQ ID NO: 346496 - protein, 9 aa, Homo Sapiens
LSVAEDPLV

SEQ ID NO: 346497 - protein, 9 aa, Homo Sapiens
KVEEESKQQ

SEQ ID NO: 346498 - protein, 9 aa, Homo Sapiens
VILEAQGDT

SEQ ID NO: 346499 - protein, 9 aa, Homo Sapiens
LGKIVECTF

SEQ ID NO: 346500 - protein, 9 aa, Homo Sapiens
VEPLKRLEK

SEQ ID NO: 346501 - protein, 9 aa, Homo Sapiens
LHLHNLTLL

SEQ ID NO: 346502 - protein, 9 aa, Homo Sapiens
ATRLQRVID

SEQ ID NO: 346503 - protein, 9 aa, Homo Sapiens
TIEIINLAK

SEQ ID NO: 346504 - protein, 9 aa, Homo Sapiens
DKAQNFRTE

SEQ ID NO: 346505 - protein, 9 aa, Homo Sapiens
FDHKNLIQQ

SEQ ID NO: 346506 - protein, 9 aa, Homo Sapiens
LKPQAKLAH

SEQ ID NO: 346507 - protein, 9 aa, Homo Sapiens
GSAATVSVS

SEQ ID NO: 346508 - protein, 9 aa, Homo Sapiens
TGEKPYVGK

SEQ ID NO: 346509 - protein, 9 aa, Homo Sapiens
MALHWACYN

SEQ ID NO: 346510 - protein, 9 aa, Homo Sapiens
EDMSHTDVC

SEQ ID NO: 346511 - protein, 9 aa, Homo Sapiens
SQYSGQLHK

SEQ ID NO: 346512 - protein, 9 aa, Homo Sapiens
SGKLLNKEW

SEQ ID NO: 346513 - protein, 9 aa, Homo Sapiens
FKRTKEQMD

SEQ ID NO: 346514 - protein, 9 aa, Homo Sapiens
LSIVGLFLG

SEQ ID NO: 346515 - protein, 9 aa, Homo Sapiens
KMDEKIAFP

SEQ ID NO: 346516 - protein, 9 aa, Homo Sapiens
LKEAKKKLA

SEQ ID NO: 346517 - protein, 9 aa, Homo Sapiens
KTISLVICG

SEQ ID NO: 346518 - protein, 9 aa, Homo Sapiens
HQPPVSTLS

SEQ ID NO: 346519 - protein, 9 aa, Homo Sapiens
ALVLKAVSS

SEQ ID NO: 346520 - protein, 9 aa, Homo Sapiens
DKHRLDRIN

SEQ ID NO: 346521 - protein, 9 aa, Homo Sapiens
GEVNEQALN

SEQ ID NO: 346522 - protein, 9 aa, Homo Sapiens
LKNIKTRLG

SEQ ID NO: 346523 - protein, 9 aa, Homo Sapiens
QLFVLDVVI

SEQ ID NO: 346524 - protein, 9 aa, Homo Sapiens
FVPGKTSRV

SEQ ID NO: 346525 - protein, 9 aa, Homo Sapiens
TSFFTWGNN

SEQ ID NO: 346526 - protein, 9 aa, Homo Sapiens
KTSRKQQKE

SEQ ID NO: 346527 - protein, 9 aa, Homo Sapiens
KACDTKVLI

SEQ ID NO: 346528 - protein, 9 aa, Homo Sapiens
ALVACCIVL

SEQ ID NO: 346529 - protein, 9 aa, Homo Sapiens
GGEPKHSRT

SEQ ID NO: 346530 - protein, 9 aa, Homo Sapiens
SLKDKKVEL

SEQ ID NO: 346531 - protein, 9 aa, Homo Sapiens
CTKLYQQLN

SEQ ID NO: 346532 - protein, 9 aa, Homo Sapiens
DSDGLCLLG

SEQ ID NO: 346533 - protein, 9 aa, Homo Sapiens
HPNGNVWVC

SEQ ID NO: 346534 - protein, 9 aa, Homo Sapiens
GRFLINFSY

SEQ ID NO: 346535 - protein, 9 aa, Homo Sapiens
RSCRAIVYC

SEQ ID NO: 346536 - protein, 9 aa, Homo Sapiens
LIYRDRLQI

SEQ ID NO: 346537 - protein, 9 aa, Homo Sapiens
DFDGTQARL

SEQ ID NO: 346538 - protein, 9 aa, Homo Sapiens
NETLTELWF

SEQ ID NO: 346539 - protein, 9 aa, Homo Sapiens
SQMHWTPYR

SEQ ID NO: 346540 - protein, 9 aa, Homo Sapiens
EMKLDEGTS

SEQ ID NO: 346541 - protein, 9 aa, Homo Sapiens
SRLSGKQVD

SEQ ID NO: 346542 - protein, 9 aa, Homo Sapiens
HANKSIVNQ

SEQ ID NO: 346543 - protein, 9 aa, Homo Sapiens
ANRIDVEIL

SEQ ID NO: 346544 - protein, 9 aa, Homo Sapiens
NDESQIKAT

SEQ ID NO: 346545 - protein, 9 aa, Homo Sapiens
AREINCGFV

SEQ ID NO: 346546 - protein, 9 aa, Homo Sapiens
MVTVKIISK

SEQ ID NO: 346547 - protein, 9 aa, Homo Sapiens
SNSYLSACL

SEQ ID NO: 346548 - protein, 9 aa, Homo Sapiens
SDLSPPQRS

SEQ ID NO: 346549 - protein, 9 aa, Homo Sapiens
HKTTRSGTL

SEQ ID NO: 346550 - protein, 9 aa, Homo Sapiens
AFSIFKSDI

SEQ ID NO: 346551 - protein, 9 aa, Homo Sapiens
LVCGACKPE

SEQ ID NO: 346552 - protein, 9 aa, Homo Sapiens
LTPQQNSSV

SEQ ID NO: 346553 - protein, 9 aa, Homo Sapiens
NVNNVIKPS

SEQ ID NO: 346554 - protein, 9 aa, Homo Sapiens
TLKEVVSRN

SEQ ID NO: 346555 - protein, 9 aa, Homo Sapiens
YTVLGRLAL

SEQ ID NO: 346556 - protein, 9 aa, Homo Sapiens
IYPAIYIDA

SEQ ID NO: 346557 - protein, 9 aa, Homo Sapiens
SSLNEHKII

SEQ ID NO: 346558 - protein, 9 aa, Homo Sapiens
LHIWCSNKK

SEQ ID NO: 346559 - protein, 9 aa, Homo Sapiens
CGRSSCCSQ

SEQ ID NO: 346560 - protein, 9 aa, Homo Sapiens
SQVIFIATA

SEQ ID NO: 346561 - protein, 9 aa, Homo Sapiens
IDGNVMRKF

SEQ ID NO: 346562 - protein, 9 aa, Homo Sapiens
GLCKNGGTC

SEQ ID NO: 346563 - protein, 9 aa, Homo Sapiens
HRVLFETDL

SEQ ID NO: 346564 - protein, 9 aa, Homo Sapiens
PMEGTISWT

SEQ ID NO: 346565 - protein, 9 aa, Homo Sapiens
QTTLKSATA

SEQ ID NO: 346566 - protein, 9 aa, Homo Sapiens
SNTQTVLLT

SEQ ID NO: 346567 - protein, 9 aa, Homo Sapiens
DSKSSNSNA

SEQ ID NO: 346568 - protein, 9 aa, Homo Sapiens
QGIIVYQAS

SEQ ID NO: 346569 - protein, 9 aa, Homo Sapiens
KHLMSSILT

SEQ ID NO: 346570 - protein, 9 aa, Homo Sapiens
KGNEYSLWD

SEQ ID NO: 346571 - protein, 9 aa, Homo Sapiens
TFFWQAHTL

SEQ ID NO: 346572 - protein, 9 aa, Homo Sapiens
HMKVVVCVR

SEQ ID NO: 346573 - protein, 9 aa, Homo Sapiens
AACYAASVI

SEQ ID NO: 346574 - protein, 9 aa, Homo Sapiens
KAYELSVFC

SEQ ID NO: 346575 - protein, 9 aa, Homo Sapiens
ITSTLREDK

SEQ ID NO: 346576 - protein, 9 aa, Homo Sapiens
KKDLSKQLG

SEQ ID NO: 346577 - protein, 9 aa, Homo Sapiens
EQDNAELET

SEQ ID NO: 346578 - protein, 9 aa, Homo Sapiens
TCSPREWSC

SEQ ID NO: 346579 - protein, 9 aa, Homo Sapiens
PYSCRICCK

SEQ ID NO: 346580 - protein, 9 aa, Homo Sapiens
RWKMLYQDK

SEQ ID NO: 346581 - protein, 9 aa, Homo Sapiens
GKIFSFRSS

SEQ ID NO: 346582 - protein, 9 aa, Homo Sapiens
RRKAERLVK

SEQ ID NO: 346583 - protein, 9 aa, Homo Sapiens
LGNTWYMNA

SEQ ID NO: 346584 - protein, 9 aa, Homo Sapiens
NIQIILETR

SEQ ID NO: 346585 - protein, 9 aa, Homo Sapiens
PEGEGLRYF

SEQ ID NO: 346586 - protein, 9 aa, Homo Sapiens
AVLLIGIHG

SEQ ID NO: 346587 - protein, 9 aa, Homo Sapiens
MNRRRKFIL

SEQ ID NO: 346588 - protein, 9 aa, Homo Sapiens
MTIVFDLSR

SEQ ID NO: 346589 - protein, 9 aa, Homo Sapiens
LRSSYFSSW

SEQ ID NO: 346590 - protein, 9 aa, Homo Sapiens
SELDNHPMN

SEQ ID NO: 346591 - protein, 9 aa, Homo Sapiens
HLNKCAIFE

SEQ ID NO: 346592 - protein, 9 aa, Homo Sapiens
LFSGLEIVP

SEQ ID NO: 346593 - protein, 9 aa, Homo Sapiens
DGQLVKKIW

SEQ ID NO: 346594 - protein, 9 aa, Homo Sapiens
SVEVIQTLC

SEQ ID NO: 346595 - protein, 9 aa, Homo Sapiens
RGEIIWSHL

SEQ ID NO: 346596 - protein, 9 aa, Homo Sapiens
RLENVQPDN

SEQ ID NO: 346597 - protein, 9 aa, Homo Sapiens
CRCNRNFVY

SEQ ID NO: 346598 - protein, 9 aa, Homo Sapiens
HDKDNDTSS

SEQ ID NO: 346599 - protein, 9 aa, Homo Sapiens
EPLDLHLSM

SEQ ID NO: 346600 - protein, 9 aa, Homo Sapiens
NDLSVIRQL

SEQ ID NO: 346601 - protein, 9 aa, Homo Sapiens
NNPPTFSQN

SEQ ID NO: 346602 - protein, 9 aa, Homo Sapiens
HPDRITTIK

SEQ ID NO: 346603 - protein, 9 aa, Homo Sapiens
DAEKCVSVA

SEQ ID NO: 346604 - protein, 9 aa, Homo Sapiens
GINFKVKTV

SEQ ID NO: 346605 - protein, 9 aa, Homo Sapiens
RTRVVYQIY

SEQ ID NO: 346606 - protein, 9 aa, Homo Sapiens
ARRQQHTSS

SEQ ID NO: 346607 - protein, 9 aa, Homo Sapiens
ICTGEKPYK

SEQ ID NO: 346608 - protein, 9 aa, Homo Sapiens
EEEGLEDNW

SEQ ID NO: 346609 - protein, 9 aa, Homo Sapiens
MVKVNTVDK

SEQ ID NO: 346610 - protein, 9 aa, Homo Sapiens
VLSGKIKLI

SEQ ID NO: 346611 - protein, 9 aa, Homo Sapiens
RWADNPCVS

SEQ ID NO: 346612 - protein, 9 aa, Homo Sapiens
QSLVIEKLS

SEQ ID NO: 346613 - protein, 9 aa, Homo Sapiens
SKQTEYWDN

SEQ ID NO: 346614 - protein, 9 aa, Homo Sapiens
SLCRHRMHE

SEQ ID NO: 346615 - protein, 9 aa, Homo Sapiens
IRRDNGSWE

SEQ ID NO: 346616 - protein, 9 aa, Homo Sapiens
NYLTRQNSS

SEQ ID NO: 346617 - protein, 9 aa, Homo Sapiens
LANNNLLAL

SEQ ID NO: 346618 - protein, 9 aa, Homo Sapiens
GGPLVGIIC

SEQ ID NO: 346619 - protein, 9 aa, Homo Sapiens
INISIIDGN

SEQ ID NO: 346620 - protein, 9 aa, Homo Sapiens
QSDMHYSVA

SEQ ID NO: 346621 - protein, 9 aa, Homo Sapiens
PVPYRRVEA

SEQ ID NO: 346622 - protein, 9 aa, Homo Sapiens
FSLLSVSPV

SEQ ID NO: 346623 - protein, 9 aa, Homo Sapiens
AEDFLCDYT

SEQ ID NO: 346624 - protein, 9 aa, Homo Sapiens
EKICQAFYF

SEQ ID NO: 346625 - protein, 9 aa, Homo Sapiens
RQAGIWVIM

SEQ ID NO: 346626 - protein, 9 aa, Homo Sapiens
KEIEWDDMA

SEQ ID NO: 346627 - protein, 9 aa, Homo Sapiens
LNQGNIFKQ

SEQ ID NO: 346628 - protein, 9 aa, Homo Sapiens
ISLSPSVAY

SEQ ID NO: 346629 - protein, 9 aa, Homo Sapiens
RQSDTPQKS

SEQ ID NO: 346630 - protein, 9 aa, Homo Sapiens
GLQPGNIYP

SEQ ID NO: 346631 - protein, 9 aa, Homo Sapiens
ETAATLKHT

SEQ ID NO: 346632 - protein, 9 aa, Homo Sapiens
LVSPPRCLI

SEQ ID NO: 346633 - protein, 9 aa, Homo Sapiens
HMRKRVCAL

SEQ ID NO: 346634 - protein, 9 aa, Homo Sapiens
ARIERPHNY

SEQ ID NO: 346635 - protein, 9 aa, Homo Sapiens
YWHLKRHLD

SEQ ID NO: 346636 - protein, 9 aa, Homo Sapiens
DRINNNPDL

SEQ ID NO: 346637 - protein, 9 aa, Homo Sapiens
QNLKERFHM

SEQ ID NO: 346638 - protein, 9 aa, Homo Sapiens
AMAATYSTL

SEQ ID NO: 346639 - protein, 9 aa, Homo Sapiens
ATKIKEKEI

SEQ ID NO: 346640 - protein, 9 aa, Homo Sapiens
ILKPSVKNF

SEQ ID NO: 346641 - protein, 9 aa, Homo Sapiens
IRFLREHSQ

SEQ ID NO: 346642 - protein, 9 aa, Homo Sapiens
AYARTIHVY

SEQ ID NO: 346643 - protein, 9 aa, Homo Sapiens
VHRNLKLDN

SEQ ID NO: 346644 - protein, 9 aa, Homo Sapiens
LGIADCIRI

SEQ ID NO: 346645 - protein, 9 aa, Homo Sapiens
HHLGSPSCL

SEQ ID NO: 346646 - protein, 9 aa, Homo Sapiens
MFQLVVQTV

SEQ ID NO: 346647 - protein, 9 aa, Homo Sapiens
ESYWRIMSV

SEQ ID NO: 346648 - protein, 9 aa, Homo Sapiens
VAVSRGVVV

SEQ ID NO: 346649 - protein, 9 aa, Homo Sapiens
VITQSFCII

SEQ ID NO: 346650 - protein, 9 aa, Homo Sapiens
EDIAFLATD

SEQ ID NO: 346651 - protein, 9 aa, Homo Sapiens
SPNPSKHQG

SEQ ID NO: 346652 - protein, 9 aa, Homo Sapiens
LLNPNIAKN

SEQ ID NO: 346653 - protein, 9 aa, Homo Sapiens
RDSLSEDLA

SEQ ID NO: 346654 - protein, 9 aa, Homo Sapiens
GTALQNLEQ

SEQ ID NO: 346655 - protein, 9 aa, Homo Sapiens
DLADSFFIV

SEQ ID NO: 346656 - protein, 9 aa, Homo Sapiens
LNKSRKFNL

SEQ ID NO: 346657 - protein, 9 aa, Homo Sapiens
LKSEPYEKD

SEQ ID NO: 346658 - protein, 9 aa, Homo Sapiens
PSLDKGAKA

SEQ ID NO: 346659 - protein, 9 aa, Homo Sapiens
PTCGSHFAV

SEQ ID NO: 346660 - protein, 9 aa, Homo Sapiens
GSYEDRVKR

SEQ ID NO: 346661 - protein, 9 aa, Homo Sapiens
NSTQTGKQQ

SEQ ID NO: 346662 - protein, 9 aa, Homo Sapiens
MKLDKNKRT

SEQ ID NO: 346663 - protein, 9 aa, Homo Sapiens
VLDAAGGRQ

SEQ ID NO: 346664 - protein, 9 aa, Homo Sapiens
AKMRQEHQN

SEQ ID NO: 346665 - protein, 9 aa, Homo Sapiens
LARVWMMKG

SEQ ID NO: 346666 - protein, 9 aa, Homo Sapiens
SQNDISLIL

SEQ ID NO: 346667 - protein, 9 aa, Homo Sapiens
GSVGISVPT

SEQ ID NO: 346668 - protein, 9 aa, Homo Sapiens
DTVEQLQCE

SEQ ID NO: 346669 - protein, 9 aa, Homo Sapiens
QIPSCLYQD

SEQ ID NO: 346670 - protein, 9 aa, Homo Sapiens
DLRSSNILL

SEQ ID NO: 346671 - protein, 9 aa, Homo Sapiens
VSGYLSARK

SEQ ID NO: 346672 - protein, 9 aa, Homo Sapiens
ATHTLTQQR

SEQ ID NO: 346673 - protein, 9 aa, Homo Sapiens
EMLSGDRVR

SEQ ID NO: 346674 - protein, 9 aa, Homo Sapiens
HQSKIFADR

SEQ ID NO: 346675 - protein, 9 aa, Homo Sapiens
QNKMEEIVR

SEQ ID NO: 346676 - protein, 9 aa, Homo Sapiens
RRRRQWSEK

SEQ ID NO: 346677 - protein, 9 aa, Homo Sapiens
ATVENAYIS

SEQ ID NO: 346678 - protein, 9 aa, Homo Sapiens
LVTASPLWT

SEQ ID NO: 346679 - protein, 9 aa, Homo Sapiens
ENTIILFTK

SEQ ID NO: 346680 - protein, 9 aa, Homo Sapiens
EQKSPDLKT

SEQ ID NO: 346681 - protein, 9 aa, Homo Sapiens
SSNGTDRTT

SEQ ID NO: 346682 - protein, 9 aa, Homo Sapiens
SAGVGRMGV

SEQ ID NO: 346683 - protein, 9 aa, Homo Sapiens
SPRGIFVVR

SEQ ID NO: 346684 - protein, 9 aa, Homo Sapiens
DKKEDRGPD

SEQ ID NO: 346685 - protein, 9 aa, Homo Sapiens
RKFHFFVAI

SEQ ID NO: 346686 - protein, 9 aa, Homo Sapiens
ISFNQTTNE

SEQ ID NO: 346687 - protein, 9 aa, Homo Sapiens
MESSKLGMP

SEQ ID NO: 346688 - protein, 9 aa, Homo Sapiens
LGVVRLHIN

SEQ ID NO: 346689 - protein, 9 aa, Homo Sapiens
SVKESQWDD

SEQ ID NO: 346690 - protein, 9 aa, Homo Sapiens
QTLYESSVV

SEQ ID NO: 346691 - protein, 9 aa, Homo Sapiens
SGTQSSQEY

SEQ ID NO: 346692 - protein, 9 aa, Homo Sapiens
INNSQLFEN

SEQ ID NO: 346693 - protein, 9 aa, Homo Sapiens
HVNNNLQVI

SEQ ID NO: 346694 - protein, 9 aa, Homo Sapiens
GHAIQNPNA

SEQ ID NO: 346695 - protein, 9 aa, Homo Sapiens
STVQRVTLA

SEQ ID NO: 346696 - protein, 9 aa, Homo Sapiens
IIFNEVEIY

SEQ ID NO: 346697 - protein, 9 aa, Homo Sapiens
IKDHLWHIQ

SEQ ID NO: 346698 - protein, 9 aa, Homo Sapiens
TKQAHKLAK

SEQ ID NO: 346699 - protein, 9 aa, Homo Sapiens
LHRQVRILQ

SEQ ID NO: 346700 - protein, 9 aa, Homo Sapiens
DFDEMTFGK

SEQ ID NO: 346701 - protein, 9 aa, Homo Sapiens
PEDKVEEEA

SEQ ID NO: 346702 - protein, 9 aa, Homo Sapiens
KTSDDEALL

SEQ ID NO: 346703 - protein, 9 aa, Homo Sapiens
FSIAVVHHL

SEQ ID NO: 346704 - protein, 9 aa, Homo Sapiens
LRPACGRVS

SEQ ID NO: 346705 - protein, 9 aa, Homo Sapiens
NEKQRMELE

SEQ ID NO: 346706 - protein, 9 aa, Homo Sapiens
SLCALSTNL

SEQ ID NO: 346707 - protein, 9 aa, Homo Sapiens
LLTVHAINL

SEQ ID NO: 346708 - protein, 9 aa, Homo Sapiens
EEFFKLARQ

SEQ ID NO: 346709 - protein, 9 aa, Homo Sapiens
RFCYVKTAR

SEQ ID NO: 346710 - protein, 9 aa, Homo Sapiens
ILYVDPVGN

SEQ ID NO: 346711 - protein, 9 aa, Homo Sapiens
SISNITVCM

SEQ ID NO: 346712 - protein, 9 aa, Homo Sapiens
SDGLCLLGG

SEQ ID NO: 346713 - protein, 9 aa, Homo Sapiens
EDITPLPGL

SEQ ID NO: 346714 - protein, 9 aa, Homo Sapiens
EDLDAIDWN

SEQ ID NO: 346715 - protein, 9 aa, Homo Sapiens
PYGRKSKYK

SEQ ID NO: 346716 - protein, 9 aa, Homo Sapiens
RKKVQQYTL

SEQ ID NO: 346717 - protein, 9 aa, Homo Sapiens
FWFSLEIHV

SEQ ID NO: 346718 - protein, 9 aa, Homo Sapiens
LVTGIATSI

SEQ ID NO: 346719 - protein, 9 aa, Homo Sapiens
LDLEYSPSA

SEQ ID NO: 346720 - protein, 9 aa, Homo Sapiens
PEDDILHQW

SEQ ID NO: 346721 - protein, 9 aa, Homo Sapiens
QQQWSEKRP

SEQ ID NO: 346722 - protein, 9 aa, Homo Sapiens
AQSPRCRHA

SEQ ID NO: 346723 - protein, 9 aa, Homo Sapiens
SCIQAYFYD

SEQ ID NO: 346724 - protein, 9 aa, Homo Sapiens
LLQKKAQEV

SEQ ID NO: 346725 - protein, 9 aa, Homo Sapiens
EKIQQQNQY

SEQ ID NO: 346726 - protein, 9 aa, Homo Sapiens
SVQGIIVYQ

SEQ ID NO: 346727 - protein, 9 aa, Homo Sapiens
GQLMANPEA

SEQ ID NO: 346728 - protein, 9 aa, Homo Sapiens
EDKTKRELL

SEQ ID NO: 346729 - protein, 9 aa, Homo Sapiens
EDMLERHEE

SEQ ID NO: 346730 - protein, 9 aa, Homo Sapiens
FNRSLMACC

SEQ ID NO: 346731 - protein, 9 aa, Homo Sapiens
SQVTNMRTK

SEQ ID NO: 346732 - protein, 9 aa, Homo Sapiens
LLKEIAKRK

SEQ ID NO: 346733 - protein, 9 aa, Homo Sapiens
KKKLDNEVE

SEQ ID NO: 346734 - protein, 9 aa, Homo Sapiens
LLEVVVLSQ

SEQ ID NO: 346735 - protein, 9 aa, Homo Sapiens
WKRCYFLLR

SEQ ID NO: 346736 - protein, 9 aa, Homo Sapiens
QYGNEKQRK

SEQ ID NO: 346737 - protein, 9 aa, Homo Sapiens
SEFQIHHDV

SEQ ID NO: 346738 - protein, 9 aa, Homo Sapiens
GDESKDATK

SEQ ID NO: 346739 - protein, 9 aa, Homo Sapiens
EMASILEKE

SEQ ID NO: 346740 - protein, 9 aa, Homo Sapiens
QMGGGRDSE

SEQ ID NO: 346741 - protein, 9 aa, Homo Sapiens
ARSCIQAYF

SEQ ID NO: 346742 - protein, 9 aa, Homo Sapiens
QMDKGVIQQ

SEQ ID NO: 346743 - protein, 9 aa, Homo Sapiens
DFASFQHKW

SEQ ID NO: 346744 - protein, 9 aa, Homo Sapiens
CLKDYVKVK

SEQ ID NO: 346745 - protein, 9 aa, Homo Sapiens
KVGKHAHFK

SEQ ID NO: 346746 - protein, 9 aa, Homo Sapiens
DMQMGGGGA

SEQ ID NO: 346747 - protein, 9 aa, Homo Sapiens
PIGSLDVKK

SEQ ID NO: 346748 - protein, 9 aa, Homo Sapiens
QAELGALHS

SEQ ID NO: 346749 - protein, 9 aa, Homo Sapiens
CSIKAKPLK

SEQ ID NO: 346750 - protein, 9 aa, Homo Sapiens
VALYDCQSP

SEQ ID NO: 346751 - protein, 9 aa, Homo Sapiens
GKIIESPMH

SEQ ID NO: 346752 - protein, 9 aa, Homo Sapiens
ISGCMQKVS

SEQ ID NO: 346753 - protein, 9 aa, Homo Sapiens
KNFSRGLNV

SEQ ID NO: 346754 - protein, 9 aa, Homo Sapiens
LFPLSFLIK

SEQ ID NO: 346755 - protein, 9 aa, Homo Sapiens
DNPHISDDP

SEQ ID NO: 346756 - protein, 9 aa, Homo Sapiens
YIINNHLPK

SEQ ID NO: 346757 - protein, 9 aa, Homo Sapiens
KIEGNRLTS

SEQ ID NO: 346758 - protein, 9 aa, Homo Sapiens
EWKRMCSRP

SEQ ID NO: 346759 - protein, 9 aa, Homo Sapiens
AYLAFQDLQ

SEQ ID NO: 346760 - protein, 9 aa, Homo Sapiens
MKPHKAFPV

SEQ ID NO: 346761 - protein, 9 aa, Homo Sapiens
LFLAARLPL

SEQ ID NO: 346762 - protein, 9 aa, Homo Sapiens
FQQLSSLTN

SEQ ID NO: 346763 - protein, 9 aa, Homo Sapiens
VAHKHYTID

SEQ ID NO: 346764 - protein, 9 aa, Homo Sapiens
HGRGHKSSM

SEQ ID NO: 346765 - protein, 9 aa, Homo Sapiens
VSQPRKHLC

SEQ ID NO: 346766 - protein, 9 aa, Homo Sapiens
DMDKSHFTR

SEQ ID NO: 346767 - protein, 9 aa, Homo Sapiens
AEIVTNIFI

SEQ ID NO: 346768 - protein, 9 aa, Homo Sapiens
GKIVDRINN

SEQ ID NO: 346769 - protein, 9 aa, Homo Sapiens
RGFLPDWNK

SEQ ID NO: 346770 - protein, 9 aa, Homo Sapiens
KQQQWSEKR

SEQ ID NO: 346771 - protein, 9 aa, Homo Sapiens
TFPPHQETA

SEQ ID NO: 346772 - protein, 9 aa, Homo Sapiens
DSAMNHHLQ

SEQ ID NO: 346773 - protein, 9 aa, Homo Sapiens
VTDEEIEFL

SEQ ID NO: 346774 - protein, 9 aa, Homo Sapiens
DLCFTTSTA

SEQ ID NO: 346775 - protein, 9 aa, Homo Sapiens
HRIIKIEGN

SEQ ID NO: 346776 - protein, 9 aa, Homo Sapiens
KDWCCQSNC

SEQ ID NO: 346777 - protein, 9 aa, Homo Sapiens
SSESPLSLK

SEQ ID NO: 346778 - protein, 9 aa, Homo Sapiens
QTVESTVDQ

SEQ ID NO: 346779 - protein, 9 aa, Homo Sapiens
SDDPSIFIT

SEQ ID NO: 346780 - protein, 9 aa, Homo Sapiens
YLIPRYVRD

SEQ ID NO: 346781 - protein, 9 aa, Homo Sapiens
SATPKMLVD

SEQ ID NO: 346782 - protein, 9 aa, Homo Sapiens
GEYQIEDKM

SEQ ID NO: 346783 - protein, 9 aa, Homo Sapiens
TGAAPIFIK

SEQ ID NO: 346784 - protein, 9 aa, Homo Sapiens
WWLARVWMM

SEQ ID NO: 346785 - protein, 9 aa, Homo Sapiens
NLLLDRIRK

SEQ ID NO: 346786 - protein, 9 aa, Homo Sapiens
TTRHHLGSR

SEQ ID NO: 346787 - protein, 9 aa, Homo Sapiens
DIWPEQGIE

SEQ ID NO: 346788 - protein, 9 aa, Homo Sapiens
IFFFGTHKT

SEQ ID NO: 346789 - protein, 9 aa, Homo Sapiens
LGWAPLHLA

SEQ ID NO: 346790 - protein, 9 aa, Homo Sapiens
GFEHSELLC

SEQ ID NO: 346791 - protein, 9 aa, Homo Sapiens
AGKFMITFP

SEQ ID NO: 346792 - protein, 9 aa, Homo Sapiens
TTHGPPSMA

SEQ ID NO: 346793 - protein, 9 aa, Homo Sapiens
IFGLTVTLS

SEQ ID NO: 346794 - protein, 9 aa, Homo Sapiens
EKPYDTITQ

SEQ ID NO: 346795 - protein, 9 aa, Homo Sapiens
LKIQFLIYP

SEQ ID NO: 346796 - protein, 9 aa, Homo Sapiens
ILIDPIQVV

SEQ ID NO: 346797 - protein, 9 aa, Homo Sapiens
TTNVQLQAF

SEQ ID NO: 346798 - protein, 9 aa, Homo Sapiens
QRTEELKEA

SEQ ID NO: 346799 - protein, 9 aa, Homo Sapiens
VAALRQALQ

SEQ ID NO: 346800 - protein, 9 aa, Homo Sapiens
QAEVYGVRL

SEQ ID NO: 346801 - protein, 9 aa, Homo Sapiens
HHQIIHTGE

SEQ ID NO: 346802 - protein, 9 aa, Homo Sapiens
QIREARQKE

SEQ ID NO: 346803 - protein, 9 aa, Homo Sapiens
HYFMLWHPK

SEQ ID NO: 346804 - protein, 9 aa, Homo Sapiens
STVIALKML

SEQ ID NO: 346805 - protein, 9 aa, Homo Sapiens
NQHLRVNTQ

SEQ ID NO: 346806 - protein, 9 aa, Homo Sapiens
KNVVFAIDV

SEQ ID NO: 346807 - protein, 9 aa, Homo Sapiens
STPIPICRE

SEQ ID NO: 346808 - protein, 9 aa, Homo Sapiens
VYVLHFDNT

SEQ ID NO: 346809 - protein, 9 aa, Homo Sapiens
FSRCFHHCN

SEQ ID NO: 346810 - protein, 9 aa, Homo Sapiens
LCNFGFART

SEQ ID NO: 346811 - protein, 9 aa, Homo Sapiens
KSDIPFIFT

SEQ ID NO: 346812 - protein, 9 aa, Homo Sapiens
LSNDSIMLV

SEQ ID NO: 346813 - protein, 9 aa, Homo Sapiens
LTEHKRINA

SEQ ID NO: 346814 - protein, 9 aa, Homo Sapiens
GERVYFDDI

SEQ ID NO: 346815 - protein, 9 aa, Homo Sapiens
CALNKSRKF

SEQ ID NO: 346816 - protein, 9 aa, Homo Sapiens
HPFYRGNKD

SEQ ID NO: 346817 - protein, 9 aa, Homo Sapiens
KDVMASSHF

SEQ ID NO: 346818 - protein, 9 aa, Homo Sapiens
GSHVGVYLS

SEQ ID NO: 346819 - protein, 9 aa, Homo Sapiens
HVPNNLFFF

SEQ ID NO: 346820 - protein, 9 aa, Homo Sapiens
FENVLISSK

SEQ ID NO: 346821 - protein, 9 aa, Homo Sapiens
HLLTYLPRE

SEQ ID NO: 346822 - protein, 9 aa, Homo Sapiens
LYVDPVGNN

SEQ ID NO: 346823 - protein, 9 aa, Homo Sapiens
RARKITSME

SEQ ID NO: 346824 - protein, 9 aa, Homo Sapiens
LMTNHLYAA

SEQ ID NO: 346825 - protein, 9 aa, Homo Sapiens
SLCKHEKNH

SEQ ID NO: 346826 - protein, 9 aa, Homo Sapiens
EEAQLIELI

SEQ ID NO: 346827 - protein, 9 aa, Homo Sapiens
TLPEVHYHL

SEQ ID NO: 346828 - protein, 9 aa, Homo Sapiens
LESTVPQEK

SEQ ID NO: 346829 - protein, 9 aa, Homo Sapiens
DIVEGGSDK

SEQ ID NO: 346830 - protein, 9 aa, Homo Sapiens
QECDEDDHR

SEQ ID NO: 346831 - protein, 9 aa, Homo Sapiens
VILMGCSRV

SEQ ID NO: 346832 - protein, 9 aa, Homo Sapiens
RDEIGQIEL

SEQ ID NO: 346833 - protein, 9 aa, Homo Sapiens
KQAKEDAQA

SEQ ID NO: 346834 - protein, 9 aa, Homo Sapiens
DYWIVVKIN

SEQ ID NO: 346835 - protein, 9 aa, Homo Sapiens
TYNALNVLM

SEQ ID NO: 346836 - protein, 9 aa, Homo Sapiens
KGLVSLEQL

SEQ ID NO: 346837 - protein, 9 aa, Homo Sapiens
IQTLRKRLE

SEQ ID NO: 346838 - protein, 9 aa, Homo Sapiens
EPTGYIRFK

SEQ ID NO: 346839 - protein, 9 aa, Homo Sapiens
FTETLKGTT

SEQ ID NO: 346840 - protein, 9 aa, Homo Sapiens
FEDKTDIFQ

SEQ ID NO: 346841 - protein, 9 aa, Homo Sapiens
RRTFWINER

SEQ ID NO: 346842 - protein, 9 aa, Homo Sapiens
LSETSLVNK

SEQ ID NO: 346843 - protein, 9 aa, Homo Sapiens
QQMPKVHIK

SEQ ID NO: 346844 - protein, 9 aa, Homo Sapiens
LVPPTIRRT

SEQ ID NO: 346845 - protein, 9 aa, Homo Sapiens
INQTEEERT

SEQ ID NO: 346846 - protein, 9 aa, Homo Sapiens
SKDIQTCKI

SEQ ID NO: 346847 - protein, 9 aa, Homo Sapiens
GSTYCWHSF

SEQ ID NO: 346848 - protein, 9 aa, Homo Sapiens
VTRVVFGEL

SEQ ID NO: 346849 - protein, 9 aa, Homo Sapiens
TEGRLAGQR

SEQ ID NO: 346850 - protein, 9 aa, Homo Sapiens
FAVLDPEHR

SEQ ID NO: 346851 - protein, 9 aa, Homo Sapiens
EHCSHNGTD

SEQ ID NO: 346852 - protein, 9 aa, Homo Sapiens
SWIAKLEAA

SEQ ID NO: 346853 - protein, 9 aa, Homo Sapiens
VLTFELSIF

SEQ ID NO: 346854 - protein, 9 aa, Homo Sapiens
STEAPEQVV

SEQ ID NO: 346855 - protein, 9 aa, Homo Sapiens
IIAEAEKKV

SEQ ID NO: 346856 - protein, 9 aa, Homo Sapiens
DKRTFLRQA

SEQ ID NO: 346857 - protein, 9 aa, Homo Sapiens
YNVLDQNVH

SEQ ID NO: 346858 - protein, 9 aa, Homo Sapiens
RYNTPGHNY

SEQ ID NO: 346859 - protein, 9 aa, Homo Sapiens
EFFKLARQT

SEQ ID NO: 346860 - protein, 9 aa, Homo Sapiens
VKEKRNTTT

SEQ ID NO: 346861 - protein, 9 aa, Homo Sapiens
DLIRPLKIS

SEQ ID NO: 346862 - protein, 9 aa, Homo Sapiens
LLFVRRQNP

SEQ ID NO: 346863 - protein, 9 aa, Homo Sapiens
PAWVSSSVL

SEQ ID NO: 346864 - protein, 9 aa, Homo Sapiens
WKVEVAKKT

SEQ ID NO: 346865 - protein, 9 aa, Homo Sapiens
FSLSLSFLL

SEQ ID NO: 346866 - protein, 9 aa, Homo Sapiens
FLIYPALQP

SEQ ID NO: 346867 - protein, 9 aa, Homo Sapiens
PIEDFEASF

SEQ ID NO: 346868 - protein, 9 aa, Homo Sapiens
INTCDLLSR

SEQ ID NO: 346869 - protein, 9 aa, Homo Sapiens
FLVSVSKDN

SEQ ID NO: 346870 - protein, 9 aa, Homo Sapiens
PKKSFVKGT

SEQ ID NO: 346871 - protein, 9 aa, Homo Sapiens
IVRSSIQIT

SEQ ID NO: 346872 - protein, 9 aa, Homo Sapiens
QPEAAFLGP

SEQ ID NO: 346873 - protein, 9 aa, Homo Sapiens
FGTHKTAFL

SEQ ID NO: 346874 - protein, 9 aa, Homo Sapiens
GDILKSNKR

SEQ ID NO: 346875 - protein, 9 aa, Homo Sapiens
SDGPAAQDG

SEQ ID NO: 346876 - protein, 9 aa, Homo Sapiens
QTVLLTPEI

SEQ ID NO: 346877 - protein, 9 aa, Homo Sapiens
ITSIEQVLN

SEQ ID NO: 346878 - protein, 9 aa, Homo Sapiens
LRHLSMKVC

SEQ ID NO: 346879 - protein, 9 aa, Homo Sapiens
PGEYRRSLD

SEQ ID NO: 346880 - protein, 9 aa, Homo Sapiens
LFRSHKEDQ

SEQ ID NO: 346881 - protein, 9 aa, Homo Sapiens
YKRIVPACF

SEQ ID NO: 346882 - protein, 9 aa, Homo Sapiens
SFDDIACIR

SEQ ID NO: 346883 - protein, 9 aa, Homo Sapiens
KQAGVLGFN

SEQ ID NO: 346884 - protein, 9 aa, Homo Sapiens
AEFFSFENV

SEQ ID NO: 346885 - protein, 9 aa, Homo Sapiens
SNMLSFYDP

SEQ ID NO: 346886 - protein, 9 aa, Homo Sapiens
SAQSPRCRH

SEQ ID NO: 346887 - protein, 9 aa, Homo Sapiens
KQVVVAALR

SEQ ID NO: 346888 - protein, 9 aa, Homo Sapiens
QGPKYVNIF

SEQ ID NO: 346889 - protein, 9 aa, Homo Sapiens
QYYVRWRLG

SEQ ID NO: 346890 - protein, 9 aa, Homo Sapiens
NQLFVLDVV

SEQ ID NO: 346891 - protein, 9 aa, Homo Sapiens
EPSAQQLRD

SEQ ID NO: 346892 - protein, 9 aa, Homo Sapiens
VWMANEGFD

SEQ ID NO: 346893 - protein, 9 aa, Homo Sapiens
NAPIEDRRR

SEQ ID NO: 346894 - protein, 9 aa, Homo Sapiens
WCETGISFV

SEQ ID NO: 346895 - protein, 9 aa, Homo Sapiens
CGWWLARVW

SEQ ID NO: 346896 - protein, 9 aa, Homo Sapiens
DNQRVQAHA

SEQ ID NO: 346897 - protein, 9 aa, Homo Sapiens
YQKTGDAYK

SEQ ID NO: 346898 - protein, 9 aa, Homo Sapiens
RERTQASTE

SEQ ID NO: 346899 - protein, 9 aa, Homo Sapiens
QRQLEEVDE

SEQ ID NO: 346900 - protein, 9 aa, Homo Sapiens
QEKAGLPQS

SEQ ID NO: 346901 - protein, 9 aa, Homo Sapiens
QEIYQKAFN

SEQ ID NO: 346902 - protein, 9 aa, Homo Sapiens
EGQTHTISL

SEQ ID NO: 346903 - protein, 9 aa, Homo Sapiens
LRNAGATQS

SEQ ID NO: 346904 - protein, 9 aa, Homo Sapiens
FRNEEEKIL

SEQ ID NO: 346905 - protein, 9 aa, Homo Sapiens
PEHCSHNGT

SEQ ID NO: 346906 - protein, 9 aa, Homo Sapiens
EKENKKIWD

SEQ ID NO: 346907 - protein, 9 aa, Homo Sapiens
VASGKYGDL

SEQ ID NO: 346908 - protein, 9 aa, Homo Sapiens
YAASVIGYL

SEQ ID NO: 346909 - protein, 9 aa, Homo Sapiens
SNLMLQHEE

SEQ ID NO: 346910 - protein, 9 aa, Homo Sapiens
KTATEAADY

SEQ ID NO: 346911 - protein, 9 aa, Homo Sapiens
ATQFQLELI

SEQ ID NO: 346912 - protein, 9 aa, Homo Sapiens
YSGTSDQIR

SEQ ID NO: 346913 - protein, 9 aa, Homo Sapiens
LSPELPKPT

SEQ ID NO: 346914 - protein, 9 aa, Homo Sapiens
TPLPGLPGI

SEQ ID NO: 346915 - protein, 9 aa, Homo Sapiens
EDIQTVFYS

SEQ ID NO: 346916 - protein, 9 aa, Homo Sapiens
LNDILKASL

SEQ ID NO: 346917 - protein, 9 aa, Homo Sapiens
LWLLGCHMR

SEQ ID NO: 346918 - protein, 9 aa, Homo Sapiens
ELGEAQRSL

SEQ ID NO: 346919 - protein, 9 aa, Homo Sapiens
CGRWANILE

SEQ ID NO: 346920 - protein, 9 aa, Homo Sapiens
ELINEILNI

SEQ ID NO: 346921 - protein, 9 aa, Homo Sapiens
ANNETKRNQ

SEQ ID NO: 346922 - protein, 9 aa, Homo Sapiens
QKTHEKGTS

SEQ ID NO: 346923 - protein, 9 aa, Homo Sapiens
ISIFDFSSG

SEQ ID NO: 346924 - protein, 9 aa, Homo Sapiens
PPHLHRATV

SEQ ID NO: 346925 - protein, 9 aa, Homo Sapiens
LPSREGGDE

SEQ ID NO: 346926 - protein, 9 aa, Homo Sapiens
KSFEFFIPD

SEQ ID NO: 346927 - protein, 9 aa, Homo Sapiens
GAYMCSCHK

SEQ ID NO: 346928 - protein, 9 aa, Homo Sapiens
LFVHNVATE

SEQ ID NO: 346929 - protein, 9 aa, Homo Sapiens
DTRKKTKQV

SEQ ID NO: 346930 - protein, 9 aa, Homo Sapiens
VLLDSNKKL

SEQ ID NO: 346931 - protein, 9 aa, Homo Sapiens
VSVLALKLK

SEQ ID NO: 346932 - protein, 9 aa, Homo Sapiens
VYAINLESQ

SEQ ID NO: 346933 - protein, 9 aa, Homo Sapiens
FQESLNQNQ

SEQ ID NO: 346934 - protein, 9 aa, Homo Sapiens
NLIHSTHIH

SEQ ID NO: 346935 - protein, 9 aa, Homo Sapiens
NHLAQSKNR

SEQ ID NO: 346936 - protein, 9 aa, Homo Sapiens
TQNKCNQCL

SEQ ID NO: 346937 - protein, 9 aa, Homo Sapiens
SAKKTPVER

SEQ ID NO: 346938 - protein, 9 aa, Homo Sapiens
ERSHTRERR

SEQ ID NO: 346939 - protein, 9 aa, Homo Sapiens
AMQVITSPS

SEQ ID NO: 346940 - protein, 9 aa, Homo Sapiens
RPIPEDNFL

SEQ ID NO: 346941 - protein, 9 aa, Homo Sapiens
FRNRHPGAS

SEQ ID NO: 346942 - protein, 9 aa, Homo Sapiens
DIEEMMQNS

SEQ ID NO: 346943 - protein, 9 aa, Homo Sapiens
KLSAKKTPV

SEQ ID NO: 346944 - protein, 9 aa, Homo Sapiens
ILKFLLDVS

SEQ ID NO: 346945 - protein, 9 aa, Homo Sapiens
DINKNKNVT

SEQ ID NO: 346946 - protein, 9 aa, Homo Sapiens
PPKRKEDKL

SEQ ID NO: 346947 - protein, 9 aa, Homo Sapiens
QPRKHLCVW

SEQ ID NO: 346948 - protein, 9 aa, Homo Sapiens
CAELMKLPM

SEQ ID NO: 346949 - protein, 9 aa, Homo Sapiens
VLEKLIEKG

SEQ ID NO: 346950 - protein, 9 aa, Homo Sapiens
LGYGCAGFG

SEQ ID NO: 346951 - protein, 9 aa, Homo Sapiens
QGLADFIAK

SEQ ID NO: 346952 - protein, 9 aa, Homo Sapiens
EVSVLALKL

SEQ ID NO: 346953 - protein, 9 aa, Homo Sapiens
EDHKTSPLD

SEQ ID NO: 346954 - protein, 9 aa, Homo Sapiens
QFPSSPFTE

SEQ ID NO: 346955 - protein, 9 aa, Homo Sapiens
VNSLAAVPY

SEQ ID NO: 346956 - protein, 9 aa, Homo Sapiens
RKHRKTTLE

SEQ ID NO: 346957 - protein, 9 aa, Homo Sapiens
YNRDWYKHN

SEQ ID NO: 346958 - protein, 9 aa, Homo Sapiens
SPIRFLVVK

SEQ ID NO: 346959 - protein, 9 aa, Homo Sapiens
QIRFTVNRR

SEQ ID NO: 346960 - protein, 9 aa, Homo Sapiens
HTLVLGLVN

SEQ ID NO: 346961 - protein, 9 aa, Homo Sapiens
ECGKTFSQN

SEQ ID NO: 346962 - protein, 9 aa, Homo Sapiens
IRQIFNPDY

SEQ ID NO: 346963 - protein, 9 aa, Homo Sapiens
IDWFYTIVY

SEQ ID NO: 346964 - protein, 9 aa, Homo Sapiens
LTIVTLMVA

SEQ ID NO: 346965 - protein, 9 aa, Homo Sapiens
HMRRNAFSI

SEQ ID NO: 346966 - protein, 9 aa, Homo Sapiens
IGRSHHYHR

SEQ ID NO: 346967 - protein, 9 aa, Homo Sapiens
DLYIAICFV

SEQ ID NO: 346968 - protein, 9 aa, Homo Sapiens
QLSSQKMEY

SEQ ID NO: 346969 - protein, 9 aa, Homo Sapiens
LGFEHSELL

SEQ ID NO: 346970 - protein, 9 aa, Homo Sapiens
RQIPIKLIS

SEQ ID NO: 346971 - protein, 9 aa, Homo Sapiens
ADKLMDLRN

SEQ ID NO: 346972 - protein, 9 aa, Homo Sapiens
WFSPNENII

SEQ ID NO: 346973 - protein, 9 aa, Homo Sapiens
LKSLYADNL

SEQ ID NO: 346974 - protein, 9 aa, Homo Sapiens
NGDPEESQR

SEQ ID NO: 346975 - protein, 9 aa, Homo Sapiens
NDKLGHGDT

SEQ ID NO: 346976 - protein, 9 aa, Homo Sapiens
GKIVECTFT

SEQ ID NO: 346977 - protein, 9 aa, Homo Sapiens
DHGKPVNNA

SEQ ID NO: 346978 - protein, 9 aa, Homo Sapiens
KREGQGSLR

SEQ ID NO: 346979 - protein, 9 aa, Homo Sapiens
DAANGIDDK

SEQ ID NO: 346980 - protein, 9 aa, Homo Sapiens
QEEIPNHRN

SEQ ID NO: 346981 - protein, 9 aa, Homo Sapiens
LVEFGDVLG

SEQ ID NO: 346982 - protein, 9 aa, Homo Sapiens
QLQGKKSCH

SEQ ID NO: 346983 - protein, 9 aa, Homo Sapiens
TKCLNELKL

SEQ ID NO: 346984 - protein, 9 aa, Homo Sapiens
LTHQAAIVS

SEQ ID NO: 346985 - protein, 9 aa, Homo Sapiens
GRLFFKFYH

SEQ ID NO: 346986 - protein, 9 aa, Homo Sapiens
QIKQKVDYL

SEQ ID NO: 346987 - protein, 9 aa, Homo Sapiens
EDKEEVEED

SEQ ID NO: 346988 - protein, 9 aa, Homo Sapiens
DISTQHLQI

SEQ ID NO: 346989 - protein, 9 aa, Homo Sapiens
VFPVYQGST

SEQ ID NO: 346990 - protein, 9 aa, Homo Sapiens
CPKDVKYNV

SEQ ID NO: 346991 - protein, 9 aa, Homo Sapiens
NLTVIWCPQ

SEQ ID NO: 346992 - protein, 9 aa, Homo Sapiens
VCGIFFSIL

SEQ ID NO: 346993 - protein, 9 aa, Homo Sapiens
VLAIVEQSW

SEQ ID NO: 346994 - protein, 9 aa, Homo Sapiens
NTRVIQLNA

SEQ ID NO: 346995 - protein, 9 aa, Homo Sapiens
VHLINYYVQ

SEQ ID NO: 346996 - protein, 9 aa, Homo Sapiens
TAFSVGRKK

SEQ ID NO: 346997 - protein, 9 aa, Homo Sapiens
YCEVPKVGC

SEQ ID NO: 346998 - protein, 9 aa, Homo Sapiens
QDDIATEAY

SEQ ID NO: 346999 - protein, 9 aa, Homo Sapiens
SYSYFPIPV

SEQ ID NO: 347000 - protein, 9 aa, Homo Sapiens
GQGSLRGAV

SEQ ID NO: 347001 - protein, 9 aa, Homo Sapiens
EVIKLQIEG

SEQ ID NO: 347002 - protein, 9 aa, Homo Sapiens
SKISGSIIN

SEQ ID NO: 347003 - protein, 9 aa, Homo Sapiens
AREKCFTFV

SEQ ID NO: 347004 - protein, 9 aa, Homo Sapiens
VLTSYHSTA

SEQ ID NO: 347005 - protein, 9 aa, Homo Sapiens
QPSPSAQIN

SEQ ID NO: 347006 - protein, 9 aa, Homo Sapiens
VSNTQTVLL

SEQ ID NO: 347007 - protein, 9 aa, Homo Sapiens
SPQSRGTHT

SEQ ID NO: 347008 - protein, 9 aa, Homo Sapiens
GVYFDWTPA

SEQ ID NO: 347009 - protein, 9 aa, Homo Sapiens
FFGTHKTAF

SEQ ID NO: 347010 - protein, 9 aa, Homo Sapiens
YLEYLLMAV

SEQ ID NO: 347011 - protein, 9 aa, Homo Sapiens
CHNNITSIS

SEQ ID NO: 347012 - protein, 9 aa, Homo Sapiens
QVLQQEHRL

SEQ ID NO: 347013 - protein, 9 aa, Homo Sapiens
AKLQYPALA

SEQ ID NO: 347014 - protein, 9 aa, Homo Sapiens
TQIAASKTI

SEQ ID NO: 347015 - protein, 9 aa, Homo Sapiens
FTRWRYGVS

SEQ ID NO: 347016 - protein, 9 aa, Homo Sapiens
KVHQRGTMG

SEQ ID NO: 347017 - protein, 9 aa, Homo Sapiens
VLSQAKDKL

SEQ ID NO: 347018 - protein, 9 aa, Homo Sapiens
VGDILSKKG

SEQ ID NO: 347019 - protein, 9 aa, Homo Sapiens
LGRLSAGSV

SEQ ID NO: 347020 - protein, 9 aa, Homo Sapiens
EWTRMHGLN

SEQ ID NO: 347021 - protein, 9 aa, Homo Sapiens
TLTLKEMEK

SEQ ID NO: 347022 - protein, 9 aa, Homo Sapiens
TNNWSLIGS

SEQ ID NO: 347023 - protein, 9 aa, Homo Sapiens
HGSSTIQNL

SEQ ID NO: 347024 - protein, 9 aa, Homo Sapiens
EQMTDMAKI

SEQ ID NO: 347025 - protein, 9 aa, Homo Sapiens
GRTNITSLG

SEQ ID NO: 347026 - protein, 9 aa, Homo Sapiens
FTSLDPINE

SEQ ID NO: 347027 - protein, 9 aa, Homo Sapiens
DHLKDEKET

SEQ ID NO: 347028 - protein, 9 aa, Homo Sapiens
AYYAFRIYD

SEQ ID NO: 347029 - protein, 9 aa, Homo Sapiens
KQVDGKGQA

SEQ ID NO: 347030 - protein, 9 aa, Homo Sapiens
IQRKKEFWN

SEQ ID NO: 347031 - protein, 9 aa, Homo Sapiens
ARNGDASSS

SEQ ID NO: 347032 - protein, 9 aa, Homo Sapiens
RLHSRETLL

SEQ ID NO: 347033 - protein, 9 aa, Homo Sapiens
CHSYFICHR

SEQ ID NO: 347034 - protein, 9 aa, Homo Sapiens
HRQILQESI

SEQ ID NO: 347035 - protein, 9 aa, Homo Sapiens
FVISGFTEI

SEQ ID NO: 347036 - protein, 9 aa, Homo Sapiens
CTYQEGKES

SEQ ID NO: 347037 - protein, 9 aa, Homo Sapiens
TCQIEEMEN

SEQ ID NO: 347038 - protein, 9 aa, Homo Sapiens
REYKRIILA

SEQ ID NO: 347039 - protein, 9 aa, Homo Sapiens
KWCHVDFQR

SEQ ID NO: 347040 - protein, 9 aa, Homo Sapiens
QIHEIIHTG

SEQ ID NO: 347041 - protein, 9 aa, Homo Sapiens
AIQVDQSGL

SEQ ID NO: 347042 - protein, 9 aa, Homo Sapiens
TEEDYKLAM

SEQ ID NO: 347043 - protein, 9 aa, Homo Sapiens
SLTLGEIIT

SEQ ID NO: 347044 - protein, 9 aa, Homo Sapiens
NRTPLVMVH

SEQ ID NO: 347045 - protein, 9 aa, Homo Sapiens
LQNTEESLC

SEQ ID NO: 347046 - protein, 9 aa, Homo Sapiens
TKAPTSPFK

SEQ ID NO: 347047 - protein, 9 aa, Homo Sapiens
LTTLFDVLE

SEQ ID NO: 347048 - protein, 9 aa, Homo Sapiens
DSLAKTIKN

SEQ ID NO: 347049 - protein, 9 aa, Homo Sapiens
ANLTKRRHA

SEQ ID NO: 347050 - protein, 9 aa, Homo Sapiens
VTITATGRG

SEQ ID NO: 347051 - protein, 9 aa, Homo Sapiens
LSKCLCGAA

SEQ ID NO: 347052 - protein, 9 aa, Homo Sapiens
FFGRQMGGG

SEQ ID NO: 347053 - protein, 9 aa, Homo Sapiens
CICVDCKGG

SEQ ID NO: 347054 - protein, 9 aa, Homo Sapiens
KAREKSQVQ

SEQ ID NO: 347055 - protein, 9 aa, Homo Sapiens
IFAFVLIVE

SEQ ID NO: 347056 - protein, 9 aa, Homo Sapiens
VQIKIYSKI

SEQ ID NO: 347057 - protein, 9 aa, Homo Sapiens
QHLQIEKSN

SEQ ID NO: 347058 - protein, 9 aa, Homo Sapiens
VGRTARAGH

SEQ ID NO: 347059 - protein, 9 aa, Homo Sapiens
LGRELSVSD

SEQ ID NO: 347060 - protein, 9 aa, Homo Sapiens
DLEMDVADD

SEQ ID NO: 347061 - protein, 9 aa, Homo Sapiens
KQVAGLLPK

SEQ ID NO: 347062 - protein, 9 aa, Homo Sapiens
GFYSSMLFI

SEQ ID NO: 347063 - protein, 9 aa, Homo Sapiens
GRKITKNLS

SEQ ID NO: 347064 - protein, 9 aa, Homo Sapiens
RSQTAIIVP

SEQ ID NO: 347065 - protein, 9 aa, Homo Sapiens
APVTGHTCL

SEQ ID NO: 347066 - protein, 9 aa, Homo Sapiens
PEILWKRLS

SEQ ID NO: 347067 - protein, 9 aa, Homo Sapiens
VGAPRFFSA

SEQ ID NO: 347068 - protein, 9 aa, Homo Sapiens
EVSSYLILR

SEQ ID NO: 347069 - protein, 9 aa, Homo Sapiens
QPKAMTSIL

SEQ ID NO: 347070 - protein, 9 aa, Homo Sapiens
GQLEGILCE

SEQ ID NO: 347071 - protein, 9 aa, Homo Sapiens
KICSDLTAL

SEQ ID NO: 347072 - protein, 9 aa, Homo Sapiens
RENALLKYL

SEQ ID NO: 347073 - protein, 9 aa, Homo Sapiens
TFPSACGKT

SEQ ID NO: 347074 - protein, 9 aa, Homo Sapiens
DDLSAVHNH

SEQ ID NO: 347075 - protein, 9 aa, Homo Sapiens
HIGEKFYRQ

SEQ ID NO: 347076 - protein, 9 aa, Homo Sapiens
SGTSQKITY

SEQ ID NO: 347077 - protein, 9 aa, Homo Sapiens
SWMEVNFTK

SEQ ID NO: 347078 - protein, 9 aa, Homo Sapiens
SMLPDKVEK

SEQ ID NO: 347079 - protein, 9 aa, Homo Sapiens
CLMRLTKLK

SEQ ID NO: 347080 - protein, 9 aa, Homo Sapiens
ALIGKNGKI

SEQ ID NO: 347081 - protein, 9 aa, Homo Sapiens
LSLPFVTTN

SEQ ID NO: 347082 - protein, 9 aa, Homo Sapiens
LEKHVELEG

SEQ ID NO: 347083 - protein, 9 aa, Homo Sapiens
FQGHDAPVL

SEQ ID NO: 347084 - protein, 9 aa, Homo Sapiens
KTRKLAGPK

SEQ ID NO: 347085 - protein, 9 aa, Homo Sapiens
EACYVWDYT

SEQ ID NO: 347086 - protein, 9 aa, Homo Sapiens
LHKVREMMN

SEQ ID NO: 347087 - protein, 9 aa, Homo Sapiens
ENLVTDSNH

SEQ ID NO: 347088 - protein, 9 aa, Homo Sapiens
MYTLRNEEV

SEQ ID NO: 347089 - protein, 9 aa, Homo Sapiens
LCGTKDLSI

SEQ ID NO: 347090 - protein, 9 aa, Homo Sapiens
IRQIECLPT

SEQ ID NO: 347091 - protein, 9 aa, Homo Sapiens
FQLVVQTVG

SEQ ID NO: 347092 - protein, 9 aa, Homo Sapiens
RWLTQAAGD

SEQ ID NO: 347093 - protein, 9 aa, Homo Sapiens
GRCANGLCK

SEQ ID NO: 347094 - protein, 9 aa, Homo Sapiens
QTLDFKEFM

SEQ ID NO: 347095 - protein, 9 aa, Homo Sapiens
GCTICEKVV

SEQ ID NO: 347096 - protein, 9 aa, Homo Sapiens
FSSVKESQW

SEQ ID NO: 347097 - protein, 9 aa, Homo Sapiens
AIEMYEGSH

SEQ ID NO: 347098 - protein, 9 aa, Homo Sapiens
SSLSVKEVP

SEQ ID NO: 347099 - protein, 9 aa, Homo Sapiens
NLSAPEAEQ

SEQ ID NO: 347100 - protein, 9 aa, Homo Sapiens
CMHTLHISS

SEQ ID NO: 347101 - protein, 9 aa, Homo Sapiens
SVGTFWSND

SEQ ID NO: 347102 - protein, 9 aa, Homo Sapiens
LPKEALKMS

SEQ ID NO: 347103 - protein, 9 aa, Homo Sapiens
ASPGIMLQN

SEQ ID NO: 347104 - protein, 9 aa, Homo Sapiens
IDLQNTVSK

SEQ ID NO: 347105 - protein, 9 aa, Homo Sapiens
YSLKGKSRA

SEQ ID NO: 347106 - protein, 9 aa, Homo Sapiens
IEDFEASFQ

SEQ ID NO: 347107 - protein, 9 aa, Homo Sapiens
NHLAVLEKH

SEQ ID NO: 347108 - protein, 9 aa, Homo Sapiens
VASTELDAV

SEQ ID NO: 347109 - protein, 9 aa, Homo Sapiens
SSQNSDLLK

SEQ ID NO: 347110 - protein, 9 aa, Homo Sapiens
MEAALGSLI

SEQ ID NO: 347111 - protein, 9 aa, Homo Sapiens
VENLEHSPE

SEQ ID NO: 347112 - protein, 9 aa, Homo Sapiens
ETYMLYIAR

SEQ ID NO: 347113 - protein, 9 aa, Homo Sapiens
LLQHERIHT

SEQ ID NO: 347114 - protein, 9 aa, Homo Sapiens
VDVFSLLVM

SEQ ID NO: 347115 - protein, 9 aa, Homo Sapiens
LMTVFLLLK

SEQ ID NO: 347116 - protein, 9 aa, Homo Sapiens
MTRKKLNKY

SEQ ID NO: 347117 - protein, 9 aa, Homo Sapiens
MFCMVGLCL

SEQ ID NO: 347118 - protein, 9 aa, Homo Sapiens
AIGLHIALA

SEQ ID NO: 347119 - protein, 9 aa, Homo Sapiens
NGYMINLDY

SEQ ID NO: 347120 - protein, 9 aa, Homo Sapiens
IISCRLKTH

SEQ ID NO: 347121 - protein, 9 aa, Homo Sapiens
VFCERGKFQ

SEQ ID NO: 347122 - protein, 9 aa, Homo Sapiens
NQREVCIVA

SEQ ID NO: 347123 - protein, 9 aa, Homo Sapiens
LVHARLSEA

SEQ ID NO: 347124 - protein, 9 aa, Homo Sapiens
VRCYSAEVG

SEQ ID NO: 347125 - protein, 9 aa, Homo Sapiens
GGTALQNLE

SEQ ID NO: 347126 - protein, 9 aa, Homo Sapiens
GWAISFVTK

SEQ ID NO: 347127 - protein, 9 aa, Homo Sapiens
LGSLTADKD

SEQ ID NO: 347128 - protein, 9 aa, Homo Sapiens
WLPAEDMPL

SEQ ID NO: 347129 - protein, 9 aa, Homo Sapiens
SREDYGSPD

SEQ ID NO: 347130 - protein, 9 aa, Homo Sapiens
HLSEPEITL

SEQ ID NO: 347131 - protein, 9 aa, Homo Sapiens
FDQHCRLTG

SEQ ID NO: 347132 - protein, 9 aa, Homo Sapiens
GIATSVAAV

SEQ ID NO: 347133 - protein, 9 aa, Homo Sapiens
GSIMWEGRD

SEQ ID NO: 347134 - protein, 9 aa, Homo Sapiens
ARKNYQTLT

SEQ ID NO: 347135 - protein, 9 aa, Homo Sapiens
EAVFLVPVS

SEQ ID NO: 347136 - protein, 9 aa, Homo Sapiens
LKDITAQYS

SEQ ID NO: 347137 - protein, 9 aa, Homo Sapiens
PSSNGCMHT

SEQ ID NO: 347138 - protein, 9 aa, Homo Sapiens
SLNFNQTLR

SEQ ID NO: 347139 - protein, 9 aa, Homo Sapiens
FMFIMKHNP

SEQ ID NO: 347140 - protein, 9 aa, Homo Sapiens
KYLMFVFNL

SEQ ID NO: 347141 - protein, 9 aa, Homo Sapiens
CTKRGWMWN

SEQ ID NO: 347142 - protein, 9 aa, Homo Sapiens
NRRRKFILA

SEQ ID NO: 347143 - protein, 9 aa, Homo Sapiens
NFSRGLNVR

SEQ ID NO: 347144 - protein, 9 aa, Homo Sapiens
FIWVDLIKY

SEQ ID NO: 347145 - protein, 9 aa, Homo Sapiens
CEECDKVLS

SEQ ID NO: 347146 - protein, 9 aa, Homo Sapiens
SSCSYLHKA

SEQ ID NO: 347147 - protein, 9 aa, Homo Sapiens
KIIYDDGKM

SEQ ID NO: 347148 - protein, 9 aa, Homo Sapiens
NSVQACKER

SEQ ID NO: 347149 - protein, 9 aa, Homo Sapiens
ALGVKNKLC

SEQ ID NO: 347150 - protein, 9 aa, Homo Sapiens
QASKGLSNL

SEQ ID NO: 347151 - protein, 9 aa, Homo Sapiens
CGRIRYNDM

SEQ ID NO: 347152 - protein, 9 aa, Homo Sapiens
AHKFLKVES

SEQ ID NO: 347153 - protein, 9 aa, Homo Sapiens
TSSTASWAF

SEQ ID NO: 347154 - protein, 9 aa, Homo Sapiens
LNKTRSFHH

SEQ ID NO: 347155 - protein, 9 aa, Homo Sapiens
VHIKFTEGE

SEQ ID NO: 347156 - protein, 9 aa, Homo Sapiens
RHLSMKVCE

SEQ ID NO: 347157 - protein, 9 aa, Homo Sapiens
AVEAPPNRQ

SEQ ID NO: 347158 - protein, 9 aa, Homo Sapiens
LLLERLEEN

SEQ ID NO: 347159 - protein, 9 aa, Homo Sapiens
FREKSVVIQ

SEQ ID NO: 347160 - protein, 9 aa, Homo Sapiens
FPKTTLTLK

SEQ ID NO: 347161 - protein, 9 aa, Homo Sapiens
SPSLDFNGN

SEQ ID NO: 347162 - protein, 9 aa, Homo Sapiens
IEQVPRQPT

SEQ ID NO: 347163 - protein, 9 aa, Homo Sapiens
ASLTSQVIH

SEQ ID NO: 347164 - protein, 9 aa, Homo Sapiens
VQTKEGCYF

SEQ ID NO: 347165 - protein, 9 aa, Homo Sapiens
AQLANNAKT

SEQ ID NO: 347166 - protein, 9 aa, Homo Sapiens
GTVAGAVII

SEQ ID NO: 347167 - protein, 9 aa, Homo Sapiens
RPPTLHPGL

SEQ ID NO: 347168 - protein, 9 aa, Homo Sapiens
PEIGERVHT

SEQ ID NO: 347169 - protein, 9 aa, Homo Sapiens
LGPPSTQLH

SEQ ID NO: 347170 - protein, 9 aa, Homo Sapiens
HVCQYNAVV

SEQ ID NO: 347171 - protein, 9 aa, Homo Sapiens
EMDQHIEFF

SEQ ID NO: 347172 - protein, 9 aa, Homo Sapiens
FQDNIFQSM

SEQ ID NO: 347173 - protein, 9 aa, Homo Sapiens
KNDNNTFTV

SEQ ID NO: 347174 - protein, 9 aa, Homo Sapiens
RRRSQRILQ

SEQ ID NO: 347175 - protein, 9 aa, Homo Sapiens
EMMEEQKTK

SEQ ID NO: 347176 - protein, 9 aa, Homo Sapiens
NLGTERFLE

SEQ ID NO: 347177 - protein, 9 aa, Homo Sapiens
ATAQAPTDI

SEQ ID NO: 347178 - protein, 9 aa, Homo Sapiens
LSLLEDSYN

SEQ ID NO: 347179 - protein, 9 aa, Homo Sapiens
PEQNIKDYF

SEQ ID NO: 347180 - protein, 9 aa, Homo Sapiens
GVGLLTRFL

SEQ ID NO: 347181 - protein, 9 aa, Homo Sapiens
VFMANTFLA

SEQ ID NO: 347182 - protein, 9 aa, Homo Sapiens
KVDYLLENL

SEQ ID NO: 347183 - protein, 9 aa, Homo Sapiens
SLFVHNVAT

SEQ ID NO: 347184 - protein, 9 aa, Homo Sapiens
PYVLLQNAY

SEQ ID NO: 347185 - protein, 9 aa, Homo Sapiens
ASQEFDFNK

SEQ ID NO: 347186 - protein, 9 aa, Homo Sapiens
RIATRKKII

SEQ ID NO: 347187 - protein, 9 aa, Homo Sapiens
DCKGGSRTG

SEQ ID NO: 347188 - protein, 9 aa, Homo Sapiens
QAESLAVHG

SEQ ID NO: 347189 - protein, 9 aa, Homo Sapiens
KGIKGGTKV

SEQ ID NO: 347190 - protein, 9 aa, Homo Sapiens
VFAIDVSSS

SEQ ID NO: 347191 - protein, 9 aa, Homo Sapiens
WPKVGATLV

SEQ ID NO: 347192 - protein, 9 aa, Homo Sapiens
EYNFPQFPD

SEQ ID NO: 347193 - protein, 9 aa, Homo Sapiens
LILVAVFQY

SEQ ID NO: 347194 - protein, 9 aa, Homo Sapiens
FENVDMPNT

SEQ ID NO: 347195 - protein, 9 aa, Homo Sapiens
LLSLGGAID

SEQ ID NO: 347196 - protein, 9 aa, Homo Sapiens
ATYSTLNSS

SEQ ID NO: 347197 - protein, 9 aa, Homo Sapiens
IDFDMDLQA

SEQ ID NO: 347198 - protein, 9 aa, Homo Sapiens
SNNTVSPRA

SEQ ID NO: 347199 - protein, 9 aa, Homo Sapiens
TLIPEFLAE

SEQ ID NO: 347200 - protein, 9 aa, Homo Sapiens
NPHKLGKQQ

SEQ ID NO: 347201 - protein, 9 aa, Homo Sapiens
KFHFNIYSF

SEQ ID NO: 347202 - protein, 9 aa, Homo Sapiens
AHRQINASR

SEQ ID NO: 347203 - protein, 9 aa, Homo Sapiens
LTVHQITHT

SEQ ID NO: 347204 - protein, 9 aa, Homo Sapiens
LKLYAYANS

SEQ ID NO: 347205 - protein, 9 aa, Homo Sapiens
KDPRLYFDN

SEQ ID NO: 347206 - protein, 9 aa, Homo Sapiens
ACTAGFFVS

SEQ ID NO: 347207 - protein, 9 aa, Homo Sapiens
FPEWQSWGS

SEQ ID NO: 347208 - protein, 9 aa, Homo Sapiens
DLSAVHNHT

SEQ ID NO: 347209 - protein, 9 aa, Homo Sapiens
DNSLHQEES

SEQ ID NO: 347210 - protein, 9 aa, Homo Sapiens
LHFDNTYSF

SEQ ID NO: 347211 - protein, 9 aa, Homo Sapiens
FIPLVLAFC

SEQ ID NO: 347212 - protein, 9 aa, Homo Sapiens
SISRLSGKQ

SEQ ID NO: 347213 - protein, 9 aa, Homo Sapiens
NYNKSWIHS

SEQ ID NO: 347214 - protein, 9 aa, Homo Sapiens
GNLVYHFCD

SEQ ID NO: 347215 - protein, 9 aa, Homo Sapiens
CNTEDAYTV

SEQ ID NO: 347216 - protein, 9 aa, Homo Sapiens
ETSFHQHQE

SEQ ID NO: 347217 - protein, 9 aa, Homo Sapiens
LWQRLNNLL

SEQ ID NO: 347218 - protein, 9 aa, Homo Sapiens
QAKIECDNK

SEQ ID NO: 347219 - protein, 9 aa, Homo Sapiens
YKSNKLFGS

SEQ ID NO: 347220 - protein, 9 aa, Homo Sapiens
LHKIEAEIV

SEQ ID NO: 347221 - protein, 9 aa, Homo Sapiens
YVNQNGQKV

SEQ ID NO: 347222 - protein, 9 aa, Homo Sapiens
TQLLSFGKT

SEQ ID NO: 347223 - protein, 9 aa, Homo Sapiens
REMRNKKEE

SEQ ID NO: 347224 - protein, 9 aa, Homo Sapiens
EDLEAYICV

SEQ ID NO: 347225 - protein, 9 aa, Homo Sapiens
ELILILMCF

SEQ ID NO: 347226 - protein, 9 aa, Homo Sapiens
QLHFHFFHI

SEQ ID NO: 347227 - protein, 9 aa, Homo Sapiens
ELVHARLSE

SEQ ID NO: 347228 - protein, 9 aa, Homo Sapiens
SIEQQASIM

SEQ ID NO: 347229 - protein, 9 aa, Homo Sapiens
QRMELEQNV

SEQ ID NO: 347230 - protein, 9 aa, Homo Sapiens
LHKRNHTQN

SEQ ID NO: 347231 - protein, 9 aa, Homo Sapiens
AELRDAELA

SEQ ID NO: 347232 - protein, 9 aa, Homo Sapiens
PGEYKGGYV

SEQ ID NO: 347233 - protein, 9 aa, Homo Sapiens
KGATEKTPD

SEQ ID NO: 347234 - protein, 9 aa, Homo Sapiens
PGRPQIKKD

SEQ ID NO: 347235 - protein, 9 aa, Homo Sapiens
SIKHSLKVA

SEQ ID NO: 347236 - protein, 9 aa, Homo Sapiens
EKTKCLNEL

SEQ ID NO: 347237 - protein, 9 aa, Homo Sapiens
TKCSCMLTS

SEQ ID NO: 347238 - protein, 9 aa, Homo Sapiens
ERCGKILFE

SEQ ID NO: 347239 - protein, 9 aa, Homo Sapiens
QIANFQEKL

SEQ ID NO: 347240 - protein, 9 aa, Homo Sapiens
SLTQHQRVN

SEQ ID NO: 347241 - protein, 9 aa, Homo Sapiens
YHVTSPALR

SEQ ID NO: 347242 - protein, 9 aa, Homo Sapiens
ITWECVQPM

SEQ ID NO: 347243 - protein, 9 aa, Homo Sapiens
LSQIQNSIV

SEQ ID NO: 347244 - protein, 9 aa, Homo Sapiens
RETRLQEVC

SEQ ID NO: 347245 - protein, 9 aa, Homo Sapiens
SLSLHNHLL

SEQ ID NO: 347246 - protein, 9 aa, Homo Sapiens
PTSLGETWD

SEQ ID NO: 347247 - protein, 9 aa, Homo Sapiens
EAPEQVVPI

SEQ ID NO: 347248 - protein, 9 aa, Homo Sapiens
SVPNLSAPG

SEQ ID NO: 347249 - protein, 9 aa, Homo Sapiens
EENKSLKRT

SEQ ID NO: 347250 - protein, 9 aa, Homo Sapiens
PPIAALAQD

SEQ ID NO: 347251 - protein, 9 aa, Homo Sapiens
PRQMAVCEK

SEQ ID NO: 347252 - protein, 9 aa, Homo Sapiens
SSVAICTIL

SEQ ID NO: 347253 - protein, 9 aa, Homo Sapiens
HLETEAGYY

SEQ ID NO: 347254 - protein, 9 aa, Homo Sapiens
GTPWYPINS

SEQ ID NO: 347255 - protein, 9 aa, Homo Sapiens
LKMSVAPGL

SEQ ID NO: 347256 - protein, 9 aa, Homo Sapiens
VEFGDVLGA

SEQ ID NO: 347257 - protein, 9 aa, Homo Sapiens
HLLKHIVCL

SEQ ID NO: 347258 - protein, 9 aa, Homo Sapiens
DQDKHSDSA

SEQ ID NO: 347259 - protein, 9 aa, Homo Sapiens
EMYTTQVQK

SEQ ID NO: 347260 - protein, 9 aa, Homo Sapiens
RRNFASKWG

SEQ ID NO: 347261 - protein, 9 aa, Homo Sapiens
WDETEYKVP

SEQ ID NO: 347262 - protein, 9 aa, Homo Sapiens
NALSPVEEF

SEQ ID NO: 347263 - protein, 9 aa, Homo Sapiens
RRKEKDNRK

SEQ ID NO: 347264 - protein, 9 aa, Homo Sapiens
VGSVHSIKF

SEQ ID NO: 347265 - protein, 9 aa, Homo Sapiens
KMWQEKEIK

SEQ ID NO: 347266 - protein, 9 aa, Homo Sapiens
LKIKQVVNL

SEQ ID NO: 347267 - protein, 9 aa, Homo Sapiens
TIGGGWLVH

SEQ ID NO: 347268 - protein, 9 aa, Homo Sapiens
LQNAASVMC

SEQ ID NO: 347269 - protein, 9 aa, Homo Sapiens
QLVWRTEVA

SEQ ID NO: 347270 - protein, 9 aa, Homo Sapiens
GKSMSQPRD

SEQ ID NO: 347271 - protein, 9 aa, Homo Sapiens
GLNNICSIY

SEQ ID NO: 347272 - protein, 9 aa, Homo Sapiens
SPQPQGQET

SEQ ID NO: 347273 - protein, 9 aa, Homo Sapiens
EKVRQLEQD

SEQ ID NO: 347274 - protein, 9 aa, Homo Sapiens
GKREAMLDM

SEQ ID NO: 347275 - protein, 9 aa, Homo Sapiens
WENIQNLEA

SEQ ID NO: 347276 - protein, 9 aa, Homo Sapiens
IRDKRSNSL

SEQ ID NO: 347277 - protein, 9 aa, Homo Sapiens
VTRTFMKIL

SEQ ID NO: 347278 - protein, 9 aa, Homo Sapiens
EENLQRSDK

SEQ ID NO: 347279 - protein, 9 aa, Homo Sapiens
AHRRPEHHK

SEQ ID NO: 347280 - protein, 9 aa, Homo Sapiens
FTVEILLKI

SEQ ID NO: 347281 - protein, 9 aa, Homo Sapiens
VHLTQERNI

SEQ ID NO: 347282 - protein, 9 aa, Homo Sapiens
FLYTDLFLS

SEQ ID NO: 347283 - protein, 9 aa, Homo Sapiens
DWIKANTEL

SEQ ID NO: 347284 - protein, 9 aa, Homo Sapiens
VWLQYEKLH

SEQ ID NO: 347285 - protein, 9 aa, Homo Sapiens
ISHICLWVL

SEQ ID NO: 347286 - protein, 9 aa, Homo Sapiens
FGTDIVRQI

SEQ ID NO: 347287 - protein, 9 aa, Homo Sapiens
DLWPTMENI

SEQ ID NO: 347288 - protein, 9 aa, Homo Sapiens
TVGPHQRPH

SEQ ID NO: 347289 - protein, 9 aa, Homo Sapiens
FQVFVFESM

SEQ ID NO: 347290 - protein, 9 aa, Homo Sapiens
WAAEECRVH

SEQ ID NO: 347291 - protein, 9 aa, Homo Sapiens
LHDQTVIHK

SEQ ID NO: 347292 - protein, 9 aa, Homo Sapiens
VMKEKASFF

SEQ ID NO: 347293 - protein, 9 aa, Homo Sapiens
FMRPFEHIM

SEQ ID NO: 347294 - protein, 9 aa, Homo Sapiens
RNNPIKSIP

SEQ ID NO: 347295 - protein, 9 aa, Homo Sapiens
VKVLSSGKY

SEQ ID NO: 347296 - protein, 9 aa, Homo Sapiens
DKFRDILLR

SEQ ID NO: 347297 - protein, 9 aa, Homo Sapiens
GDTWVTPCS

SEQ ID NO: 347298 - protein, 9 aa, Homo Sapiens
PNGNVWVCI

SEQ ID NO: 347299 - protein, 9 aa, Homo Sapiens
LQKIRKYFS

SEQ ID NO: 347300 - protein, 9 aa, Homo Sapiens
REYRYVAQA

SEQ ID NO: 347301 - protein, 9 aa, Homo Sapiens
PEGIPSILK

SEQ ID NO: 347302 - protein, 9 aa, Homo Sapiens
WPCSFPMAD

SEQ ID NO: 347303 - protein, 9 aa, Homo Sapiens
AFVKETYML

SEQ ID NO: 347304 - protein, 9 aa, Homo Sapiens
YKITQQQKV

SEQ ID NO: 347305 - protein, 9 aa, Homo Sapiens
LLEDSYNME

SEQ ID NO: 347306 - protein, 9 aa, Homo Sapiens
RHHLGSRHQ

SEQ ID NO: 347307 - protein, 9 aa, Homo Sapiens
DLSSEQIHL

SEQ ID NO: 347308 - protein, 9 aa, Homo Sapiens
KSKYKIASY

SEQ ID NO: 347309 - protein, 9 aa, Homo Sapiens
FLNYDLTLW

SEQ ID NO: 347310 - protein, 9 aa, Homo Sapiens
DEEALQRSS

SEQ ID NO: 347311 - protein, 9 aa, Homo Sapiens
LVGINLVRC

SEQ ID NO: 347312 - protein, 9 aa, Homo Sapiens
PLTLKGVAE

SEQ ID NO: 347313 - protein, 9 aa, Homo Sapiens
QELERLRSK

SEQ ID NO: 347314 - protein, 9 aa, Homo Sapiens
LACKIHDGM

SEQ ID NO: 347315 - protein, 9 aa, Homo Sapiens
TIRERYFKD

SEQ ID NO: 347316 - protein, 9 aa, Homo Sapiens
VKCHITARL

SEQ ID NO: 347317 - protein, 9 aa, Homo Sapiens
HKGPISMTK

SEQ ID NO: 347318 - protein, 9 aa, Homo Sapiens
GPDDQESHA

SEQ ID NO: 347319 - protein, 9 aa, Homo Sapiens
RLLAADVLY

SEQ ID NO: 347320 - protein, 9 aa, Homo Sapiens
TIKDHLWHI

SEQ ID NO: 347321 - protein, 9 aa, Homo Sapiens
KIPKRPLFN

SEQ ID NO: 347322 - protein, 9 aa, Homo Sapiens
TAALDLQEV

SEQ ID NO: 347323 - protein, 9 aa, Homo Sapiens
SLDKGAKAD

SEQ ID NO: 347324 - protein, 9 aa, Homo Sapiens
ELKNMKRKM

SEQ ID NO: 347325 - protein, 9 aa, Homo Sapiens
DFFEQTILC

SEQ ID NO: 347326 - protein, 9 aa, Homo Sapiens
AATYSTLNS

SEQ ID NO: 347327 - protein, 9 aa, Homo Sapiens
HVRKIIQDH

SEQ ID NO: 347328 - protein, 9 aa, Homo Sapiens
NLKEVLNVV

SEQ ID NO: 347329 - protein, 9 aa, Homo Sapiens
LLPEGIDDF

SEQ ID NO: 347330 - protein, 9 aa, Homo Sapiens
LADLFGQMP

SEQ ID NO: 347331 - protein, 9 aa, Homo Sapiens
PPSCRNSNS

SEQ ID NO: 347332 - protein, 9 aa, Homo Sapiens
FFLSDSQSG

SEQ ID NO: 347333 - protein, 9 aa, Homo Sapiens
SDSELDIPV

SEQ ID NO: 347334 - protein, 9 aa, Homo Sapiens
GSDKADLGE

SEQ ID NO: 347335 - protein, 9 aa, Homo Sapiens
QKTLDLKST

SEQ ID NO: 347336 - protein, 9 aa, Homo Sapiens
MACGFTTIS

SEQ ID NO: 347337 - protein, 9 aa, Homo Sapiens
NFLGGVVHL

SEQ ID NO: 347338 - protein, 9 aa, Homo Sapiens
LLKEKSIWE

SEQ ID NO: 347339 - protein, 9 aa, Homo Sapiens
LRQKLIQSL

SEQ ID NO: 347340 - protein, 9 aa, Homo Sapiens
DEKTQMICQ

SEQ ID NO: 347341 - protein, 9 aa, Homo Sapiens
LIDTHNLLL

SEQ ID NO: 347342 - protein, 9 aa, Homo Sapiens
WNVTGNSIR

SEQ ID NO: 347343 - protein, 9 aa, Homo Sapiens
QGRHNAIKC

SEQ ID NO: 347344 - protein, 9 aa, Homo Sapiens
ADQKRCSAL

SEQ ID NO: 347345 - protein, 9 aa, Homo Sapiens
NITANLIAF

SEQ ID NO: 347346 - protein, 9 aa, Homo Sapiens
AGFRGLSEE

SEQ ID NO: 347347 - protein, 9 aa, Homo Sapiens
CIKFVPNET

SEQ ID NO: 347348 - protein, 9 aa, Homo Sapiens
GQFIDELIT

SEQ ID NO: 347349 - protein, 9 aa, Homo Sapiens
HSKIYMVHR

SEQ ID NO: 347350 - protein, 9 aa, Homo Sapiens
LIKYTIDVL

SEQ ID NO: 347351 - protein, 9 aa, Homo Sapiens
FLQNVKGTK

SEQ ID NO: 347352 - protein, 9 aa, Homo Sapiens
TYEYEREET

SEQ ID NO: 347353 - protein, 9 aa, Homo Sapiens
THLNKCAIF

SEQ ID NO: 347354 - protein, 9 aa, Homo Sapiens
ACNLQFATS

SEQ ID NO: 347355 - protein, 9 aa, Homo Sapiens
GKVVQTACM

SEQ ID NO: 347356 - protein, 9 aa, Homo Sapiens
LVMSYSAKF

SEQ ID NO: 347357 - protein, 9 aa, Homo Sapiens
LAVCHPDRI

SEQ ID NO: 347358 - protein, 9 aa, Homo Sapiens
FRALWSSGT

SEQ ID NO: 347359 - protein, 9 aa, Homo Sapiens
LLSKFPTKI

SEQ ID NO: 347360 - protein, 9 aa, Homo Sapiens
AMALKVEGL

SEQ ID NO: 347361 - protein, 9 aa, Homo Sapiens
TFFQTHPSA

SEQ ID NO: 347362 - protein, 9 aa, Homo Sapiens
RASTKKKSR

SEQ ID NO: 347363 - protein, 9 aa, Homo Sapiens
ADEYIDIGT

SEQ ID NO: 347364 - protein, 9 aa, Homo Sapiens
TWPVAILML

SEQ ID NO: 347365 - protein, 9 aa, Homo Sapiens
KQRFYQLLD

SEQ ID NO: 347366 - protein, 9 aa, Homo Sapiens
LQERDEIGQ

SEQ ID NO: 347367 - protein, 9 aa, Homo Sapiens
KYKEEHRQI

SEQ ID NO: 347368 - protein, 9 aa, Homo Sapiens
ESFFKGYGR

SEQ ID NO: 347369 - protein, 9 aa, Homo Sapiens
KVAVKMLKL

SEQ ID NO: 347370 - protein, 9 aa, Homo Sapiens
DITTAAVLI

SEQ ID NO: 347371 - protein, 9 aa, Homo Sapiens
LRSCGGCDT

SEQ ID NO: 347372 - protein, 9 aa, Homo Sapiens
PTMQTLMCD

SEQ ID NO: 347373 - protein, 9 aa, Homo Sapiens
RKKAKIILK

SEQ ID NO: 347374 - protein, 9 aa, Homo Sapiens
FEKEKKESI

SEQ ID NO: 347375 - protein, 9 aa, Homo Sapiens
EQLAQLAQG

SEQ ID NO: 347376 - protein, 9 aa, Homo Sapiens
KNEVLRELR

SEQ ID NO: 347377 - protein, 9 aa, Homo Sapiens
LPPQEATNY

SEQ ID NO: 347378 - protein, 9 aa, Homo Sapiens
QLLLTEVNK

SEQ ID NO: 347379 - protein, 9 aa, Homo Sapiens
ICVVHARVI

SEQ ID NO: 347380 - protein, 9 aa, Homo Sapiens
EKHHVNMKA

SEQ ID NO: 347381 - protein, 9 aa, Homo Sapiens
LSQVIFIAT

SEQ ID NO: 347382 - protein, 9 aa, Homo Sapiens
IIKRRQCQP

SEQ ID NO: 347383 - protein, 9 aa, Homo Sapiens
LINFSYLLS

SEQ ID NO: 347384 - protein, 9 aa, Homo Sapiens
HHQNCYGSE

SEQ ID NO: 347385 - protein, 9 aa, Homo Sapiens
LKDPFLSNE

SEQ ID NO: 347386 - protein, 9 aa, Homo Sapiens
ASRQEAVIC

SEQ ID NO: 347387 - protein, 9 aa, Homo Sapiens
TASLTPTFF

SEQ ID NO: 347388 - protein, 9 aa, Homo Sapiens
TNTFFWQAH

SEQ ID NO: 347389 - protein, 9 aa, Homo Sapiens
LEAFPQNDD

SEQ ID NO: 347390 - protein, 9 aa, Homo Sapiens
LIQIAQAEK

SEQ ID NO: 347391 - protein, 9 aa, Homo Sapiens
HAAYHPFSR

SEQ ID NO: 347392 - protein, 9 aa, Homo Sapiens
NEEEKILET

SEQ ID NO: 347393 - protein, 9 aa, Homo Sapiens
ERTRVVYQI

SEQ ID NO: 347394 - protein, 9 aa, Homo Sapiens
FPPNSSGWG

SEQ ID NO: 347395 - protein, 9 aa, Homo Sapiens
DCIYFNGVS

SEQ ID NO: 347396 - protein, 9 aa, Homo Sapiens
EKKYLAATF

SEQ ID NO: 347397 - protein, 9 aa, Homo Sapiens
GFTDPSHSE

SEQ ID NO: 347398 - protein, 9 aa, Homo Sapiens
FVSDQKEEL

SEQ ID NO: 347399 - protein, 9 aa, Homo Sapiens
WEADLRNPQ

SEQ ID NO: 347400 - protein, 9 aa, Homo Sapiens
LQGLRMCTP

SEQ ID NO: 347401 - protein, 9 aa, Homo Sapiens
QRVEQEVED

SEQ ID NO: 347402 - protein, 9 aa, Homo Sapiens
SETAFSAFQ

SEQ ID NO: 347403 - protein, 9 aa, Homo Sapiens
SHPSDFQCG

SEQ ID NO: 347404 - protein, 9 aa, Homo Sapiens
LPGKVVQTA

SEQ ID NO: 347405 - protein, 9 aa, Homo Sapiens
VQENSQAFN

SEQ ID NO: 347406 - protein, 9 aa, Homo Sapiens
RDFINIESK

SEQ ID NO: 347407 - protein, 9 aa, Homo Sapiens
HGKPVNNAL

SEQ ID NO: 347408 - protein, 9 aa, Homo Sapiens
FKMPSSVSE

SEQ ID NO: 347409 - protein, 9 aa, Homo Sapiens
GFFCFFFFF

SEQ ID NO: 347410 - protein, 9 aa, Homo Sapiens
PLRRTHQKC

SEQ ID NO: 347411 - protein, 9 aa, Homo Sapiens
LIVVFFVFV

SEQ ID NO: 347412 - protein, 9 aa, Homo Sapiens
SMENLASYR

SEQ ID NO: 347413 - protein, 9 aa, Homo Sapiens
LLATLFSTL

SEQ ID NO: 347414 - protein, 9 aa, Homo Sapiens
FNVTVTMTK

SEQ ID NO: 347415 - protein, 9 aa, Homo Sapiens
EMEARRQQY

SEQ ID NO: 347416 - protein, 9 aa, Homo Sapiens
QAYPVYQDY

SEQ ID NO: 347417 - protein, 9 aa, Homo Sapiens
SREGGDESG

SEQ ID NO: 347418 - protein, 9 aa, Homo Sapiens
RQTLAFSIH

SEQ ID NO: 347419 - protein, 9 aa, Homo Sapiens
KIHDHAILL

SEQ ID NO: 347420 - protein, 9 aa, Homo Sapiens
EILFKAWLH

SEQ ID NO: 347421 - protein, 9 aa, Homo Sapiens
KLFDKLALR

SEQ ID NO: 347422 - protein, 9 aa, Homo Sapiens
EPLVLVSPP

SEQ ID NO: 347423 - protein, 9 aa, Homo Sapiens
DDYEIINRQ

SEQ ID NO: 347424 - protein, 9 aa, Homo Sapiens
LHQEKMILS

SEQ ID NO: 347425 - protein, 9 aa, Homo Sapiens
RIQNEKGEI

SEQ ID NO: 347426 - protein, 9 aa, Homo Sapiens
ESPIDLADD

SEQ ID NO: 347427 - protein, 9 aa, Homo Sapiens
PYKKKKNNL

SEQ ID NO: 347428 - protein, 9 aa, Homo Sapiens
VPVDGILYA

SEQ ID NO: 347429 - protein, 9 aa, Homo Sapiens
RKKHAAEVT

SEQ ID NO: 347430 - protein, 9 aa, Homo Sapiens
TLWGAVGHR

SEQ ID NO: 347431 - protein, 9 aa, Homo Sapiens
QLLGPPGRR

SEQ ID NO: 347432 - protein, 9 aa, Homo Sapiens
ECRSLRVKR

SEQ ID NO: 347433 - protein, 9 aa, Homo Sapiens
HGYMALHWA

SEQ ID NO: 347434 - protein, 9 aa, Homo Sapiens
KIVEQINCK

SEQ ID NO: 347435 - protein, 9 aa, Homo Sapiens
LGFKLTSVE

SEQ ID NO: 347436 - protein, 9 aa, Homo Sapiens
VIQEKLLLK

SEQ ID NO: 347437 - protein, 9 aa, Homo Sapiens
KYAKYIAQV

SEQ ID NO: 347438 - protein, 9 aa, Homo Sapiens
SMNLESDNE

SEQ ID NO: 347439 - protein, 9 aa, Homo Sapiens
VKESQWDDG

SEQ ID NO: 347440 - protein, 9 aa, Homo Sapiens
LKGAVAGAR

SEQ ID NO: 347441 - protein, 9 aa, Homo Sapiens
LIEKGVSKG

SEQ ID NO: 347442 - protein, 9 aa, Homo Sapiens
KFSLLSVSP

SEQ ID NO: 347443 - protein, 9 aa, Homo Sapiens
VFKVVPGTD

SEQ ID NO: 347444 - protein, 9 aa, Homo Sapiens
KEIKRADHP

SEQ ID NO: 347445 - protein, 9 aa, Homo Sapiens
EIEACTAGC

SEQ ID NO: 347446 - protein, 9 aa, Homo Sapiens
AGGWQTLQS

SEQ ID NO: 347447 - protein, 9 aa, Homo Sapiens
SVFCDCEIA

SEQ ID NO: 347448 - protein, 9 aa, Homo Sapiens
DHAAYHPFS

SEQ ID NO: 347449 - protein, 9 aa, Homo Sapiens
VYPKIIERA

SEQ ID NO: 347450 - protein, 9 aa, Homo Sapiens
KNETDVFWK

SEQ ID NO: 347451 - protein, 9 aa, Homo Sapiens
DLSLMTNCM

SEQ ID NO: 347452 - protein, 9 aa, Homo Sapiens
GWDVKLLWL

SEQ ID NO: 347453 - protein, 9 aa, Homo Sapiens
IQEEIPNHR

SEQ ID NO: 347454 - protein, 9 aa, Homo Sapiens
RHCVVCSTP

SEQ ID NO: 347455 - protein, 9 aa, Homo Sapiens
NKGDGSCDV

SEQ ID NO: 347456 - protein, 9 aa, Homo Sapiens
ADNHGYMAL

SEQ ID NO: 347457 - protein, 9 aa, Homo Sapiens
ANQYKDPQS

SEQ ID NO: 347458 - protein, 9 aa, Homo Sapiens
AKIKKGGLD

SEQ ID NO: 347459 - protein, 9 aa, Homo Sapiens
FAYAHKYLL

SEQ ID NO: 347460 - protein, 9 aa, Homo Sapiens
QVAHDQAVV

SEQ ID NO: 347461 - protein, 9 aa, Homo Sapiens
TAFIRIQTN

SEQ ID NO: 347462 - protein, 9 aa, Homo Sapiens
SSWDYGINQ

SEQ ID NO: 347463 - protein, 9 aa, Homo Sapiens
LESHIQEWY

SEQ ID NO: 347464 - protein, 9 aa, Homo Sapiens
YAMAARVEP

SEQ ID NO: 347465 - protein, 9 aa, Homo Sapiens
GAVAKVIAT

SEQ ID NO: 347466 - protein, 9 aa, Homo Sapiens
TCHSLLNTA

SEQ ID NO: 347467 - protein, 9 aa, Homo Sapiens
PDMDKSHFT

SEQ ID NO: 347468 - protein, 9 aa, Homo Sapiens
FVINGSKSL

SEQ ID NO: 347469 - protein, 9 aa, Homo Sapiens
KFCTKLYQQ

SEQ ID NO: 347470 - protein, 9 aa, Homo Sapiens
TDLLLEPHN

SEQ ID NO: 347471 - protein, 9 aa, Homo Sapiens
SNHSIATLA

SEQ ID NO: 347472 - protein, 9 aa, Homo Sapiens
TSQMHWTPY

SEQ ID NO: 347473 - protein, 9 aa, Homo Sapiens
LPTQADRRT

SEQ ID NO: 347474 - protein, 9 aa, Homo Sapiens
EKPYGRVEC

SEQ ID NO: 347475 - protein, 9 aa, Homo Sapiens
MKLLVLVVL

SEQ ID NO: 347476 - protein, 9 aa, Homo Sapiens
IRERYFKDF

SEQ ID NO: 347477 - protein, 9 aa, Homo Sapiens
TVAGAVIIG

SEQ ID NO: 347478 - protein, 9 aa, Homo Sapiens
LHFSTENAS

SEQ ID NO: 347479 - protein, 9 aa, Homo Sapiens
YNEINNVNE

SEQ ID NO: 347480 - protein, 9 aa, Homo Sapiens
CFEMKNEKL

SEQ ID NO: 347481 - protein, 9 aa, Homo Sapiens
ATHSGIAAS

SEQ ID NO: 347482 - protein, 9 aa, Homo Sapiens
IDLWSGAMT

SEQ ID NO: 347483 - protein, 9 aa, Homo Sapiens
FLLHIWCSN

SEQ ID NO: 347484 - protein, 9 aa, Homo Sapiens
THSEELHNC

SEQ ID NO: 347485 - protein, 9 aa, Homo Sapiens
IVEGGSDKA

SEQ ID NO: 347486 - protein, 9 aa, Homo Sapiens
GKQGRILAN

SEQ ID NO: 347487 - protein, 9 aa, Homo Sapiens
DVYPKIIER

SEQ ID NO: 347488 - protein, 9 aa, Homo Sapiens
TLQADFNKT

SEQ ID NO: 347489 - protein, 9 aa, Homo Sapiens
NEFCNKPQR

SEQ ID NO: 347490 - protein, 9 aa, Homo Sapiens
LQCEHCARF

SEQ ID NO: 347491 - protein, 9 aa, Homo Sapiens
VAVFQYGHF

SEQ ID NO: 347492 - protein, 9 aa, Homo Sapiens
SNWHGGWDW

SEQ ID NO: 347493 - protein, 9 aa, Homo Sapiens
WSFGGGDND

SEQ ID NO: 347494 - protein, 9 aa, Homo Sapiens
GTHKTAFLG

SEQ ID NO: 347495 - protein, 9 aa, Homo Sapiens
IVMCNLCIR

SEQ ID NO: 347496 - protein, 9 aa, Homo Sapiens
NSDEPVADI

SEQ ID NO: 347497 - protein, 9 aa, Homo Sapiens
MRMLKSEEV

SEQ ID NO: 347498 - protein, 9 aa, Homo Sapiens
RDLHKSSFS

SEQ ID NO: 347499 - protein, 9 aa, Homo Sapiens
RDALRMRMY

SEQ ID NO: 347500 - protein, 9 aa, Homo Sapiens
LRELARTLQ

SEQ ID NO: 347501 - protein, 9 aa, Homo Sapiens
CIHKLHYFR

SEQ ID NO: 347502 - protein, 9 aa, Homo Sapiens
SNISAYDGE

SEQ ID NO: 347503 - protein, 9 aa, Homo Sapiens
WIHTLTYLL

SEQ ID NO: 347504 - protein, 9 aa, Homo Sapiens
SAMIIWINE

SEQ ID NO: 347505 - protein, 9 aa, Homo Sapiens
HNFAITFFM

SEQ ID NO: 347506 - protein, 9 aa, Homo Sapiens
SASNIPTEI

SEQ ID NO: 347507 - protein, 9 aa, Homo Sapiens
FRTNTWKDH

SEQ ID NO: 347508 - protein, 9 aa, Homo Sapiens
YRYNLFCEW

SEQ ID NO: 347509 - protein, 9 aa, Homo Sapiens
LYVRLINSM

SEQ ID NO: 347510 - protein, 9 aa, Homo Sapiens
MTFDGQLVK

SEQ ID NO: 347511 - protein, 9 aa, Homo Sapiens
YPSEPRPSL

SEQ ID NO: 347512 - protein, 9 aa, Homo Sapiens
NKTSDDEAL

SEQ ID NO: 347513 - protein, 9 aa, Homo Sapiens
IRIENPNYL

SEQ ID NO: 347514 - protein, 9 aa, Homo Sapiens
FAFSYLYYL

SEQ ID NO: 347515 - protein, 9 aa, Homo Sapiens
LIMWRRDHG

SEQ ID NO: 347516 - protein, 9 aa, Homo Sapiens
PFGVRIYYV

SEQ ID NO: 347517 - protein, 9 aa, Homo Sapiens
DVDAAVKQR

SEQ ID NO: 347518 - protein, 9 aa, Homo Sapiens
TNPNNGEFW

SEQ ID NO: 347519 - protein, 9 aa, Homo Sapiens
PDELYAIMK

SEQ ID NO: 347520 - protein, 9 aa, Homo Sapiens
SWTDWGNTP

SEQ ID NO: 347521 - protein, 9 aa, Homo Sapiens
WPAWQSLNV

SEQ ID NO: 347522 - protein, 9 aa, Homo Sapiens
ENETSFKQT

SEQ ID NO: 347523 - protein, 9 aa, Homo Sapiens
GIICSYSKI

SEQ ID NO: 347524 - protein, 9 aa, Homo Sapiens
GIKSSPHDS

SEQ ID NO: 347525 - protein, 9 aa, Homo Sapiens
LFHVCCISV

SEQ ID NO: 347526 - protein, 9 aa, Homo Sapiens
GPLVGIICS

SEQ ID NO: 347527 - protein, 9 aa, Homo Sapiens
NTWYMNAVL

SEQ ID NO: 347528 - protein, 9 aa, Homo Sapiens
SNLVQHQII

SEQ ID NO: 347529 - protein, 9 aa, Homo Sapiens
VAFDLSQVI

SEQ ID NO: 347530 - protein, 9 aa, Homo Sapiens
SELSNWYTE

SEQ ID NO: 347531 - protein, 9 aa, Homo Sapiens
ECSGCGKLF

SEQ ID NO: 347532 - protein, 9 aa, Homo Sapiens
CVQHQKLHP

SEQ ID NO: 347533 - protein, 9 aa, Homo Sapiens
FTRVLLTRS

SEQ ID NO: 347534 - protein, 9 aa, Homo Sapiens
YTLESGGAS

SEQ ID NO: 347535 - protein, 9 aa, Homo Sapiens
SSKLGMPGV

SEQ ID NO: 347536 - protein, 9 aa, Homo Sapiens
GSNTCSTSS

SEQ ID NO: 347537 - protein, 9 aa, Homo Sapiens
EQERRQEEH

SEQ ID NO: 347538 - protein, 9 aa, Homo Sapiens
FSPFHFFSL

SEQ ID NO: 347539 - protein, 9 aa, Homo Sapiens
CKEYQFRCK

SEQ ID NO: 347540 - protein, 9 aa, Homo Sapiens
EEICHMFHV

SEQ ID NO: 347541 - protein, 9 aa, Homo Sapiens
NFYSNLMLQ

SEQ ID NO: 347542 - protein, 9 aa, Homo Sapiens
LFCGMKNTQ

SEQ ID NO: 347543 - protein, 9 aa, Homo Sapiens
SHHSNRIVH

SEQ ID NO: 347544 - protein, 9 aa, Homo Sapiens
CCRRKPFTL

SEQ ID NO: 347545 - protein, 9 aa, Homo Sapiens
EEINLLSVA

SEQ ID NO: 347546 - protein, 9 aa, Homo Sapiens
LLDLIRPLK

SEQ ID NO: 347547 - protein, 9 aa, Homo Sapiens
SDLEMDVAD

SEQ ID NO: 347548 - protein, 9 aa, Homo Sapiens
DEFTQIIAE

SEQ ID NO: 347549 - protein, 9 aa, Homo Sapiens
KSKHMLAYM

SEQ ID NO: 347550 - protein, 9 aa, Homo Sapiens
TSPTPRDFP

SEQ ID NO: 347551 - protein, 9 aa, Homo Sapiens
GIFKELTRD

SEQ ID NO: 347552 - protein, 9 aa, Homo Sapiens
IWEEFLMSF

SEQ ID NO: 347553 - protein, 9 aa, Homo Sapiens
KIPGRRNSQ

SEQ ID NO: 347554 - protein, 9 aa, Homo Sapiens
GRWNLKEEA

SEQ ID NO: 347555 - protein, 9 aa, Homo Sapiens
NVYAFNLFC

SEQ ID NO: 347556 - protein, 9 aa, Homo Sapiens
FCSPGSLLH

SEQ ID NO: 347557 - protein, 9 aa, Homo Sapiens
DDIIVWHTV

SEQ ID NO: 347558 - protein, 9 aa, Homo Sapiens
NNWSLIGSV

SEQ ID NO: 347559 - protein, 9 aa, Homo Sapiens
DTTENGLPG

SEQ ID NO: 347560 - protein, 9 aa, Homo Sapiens
SHKLAVEYN

SEQ ID NO: 347561 - protein, 9 aa, Homo Sapiens
YVGKECGKA

SEQ ID NO: 347562 - protein, 9 aa, Homo Sapiens
DTCMADTDV

SEQ ID NO: 347563 - protein, 9 aa, Homo Sapiens
GFGSPLGRL

SEQ ID NO: 347564 - protein, 9 aa, Homo Sapiens
MPNTSEGLP

SEQ ID NO: 347565 - protein, 9 aa, Homo Sapiens
LILMCFILA

SEQ ID NO: 347566 - protein, 9 aa, Homo Sapiens
PLEQPERIC

SEQ ID NO: 347567 - protein, 9 aa, Homo Sapiens
LCHMESKTG

SEQ ID NO: 347568 - protein, 9 aa, Homo Sapiens
IDKLRTLDS

SEQ ID NO: 347569 - protein, 9 aa, Homo Sapiens
SGQTTSIVT

SEQ ID NO: 347570 - protein, 9 aa, Homo Sapiens
HYFLLVLAF

SEQ ID NO: 347571 - protein, 9 aa, Homo Sapiens
LWSATILSI

SEQ ID NO: 347572 - protein, 9 aa, Homo Sapiens
SIKRSRYFQ

SEQ ID NO: 347573 - protein, 9 aa, Homo Sapiens
VKMLKLDAT

SEQ ID NO: 347574 - protein, 9 aa, Homo Sapiens
DANYVLNQA

SEQ ID NO: 347575 - protein, 9 aa, Homo Sapiens
EAWDNHRLR

SEQ ID NO: 347576 - protein, 9 aa, Homo Sapiens
LSVVPDEEA

SEQ ID NO: 347577 - protein, 9 aa, Homo Sapiens
DNYRNLISL

SEQ ID NO: 347578 - protein, 9 aa, Homo Sapiens
IYGRKPFGH

SEQ ID NO: 347579 - protein, 9 aa, Homo Sapiens
QVHQRSSEV

SEQ ID NO: 347580 - protein, 9 aa, Homo Sapiens
LATKIKEKE

SEQ ID NO: 347581 - protein, 9 aa, Homo Sapiens
YLQKEAGVG

SEQ ID NO: 347582 - protein, 9 aa, Homo Sapiens
DHDNSFMKM

SEQ ID NO: 347583 - protein, 9 aa, Homo Sapiens
QFSALDLDP

SEQ ID NO: 347584 - protein, 9 aa, Homo Sapiens
QWKVRQTLA

SEQ ID NO: 347585 - protein, 9 aa, Homo Sapiens
SHKMLDQCP

SEQ ID NO: 347586 - protein, 9 aa, Homo Sapiens
GLTVHRQTH

SEQ ID NO: 347587 - protein, 9 aa, Homo Sapiens
GNKVGFFKP

SEQ ID NO: 347588 - protein, 9 aa, Homo Sapiens
WKALVTKRT

SEQ ID NO: 347589 - protein, 9 aa, Homo Sapiens
TRYNNHTYR

SEQ ID NO: 347590 - protein, 9 aa, Homo Sapiens
CRNYNNQAS

SEQ ID NO: 347591 - protein, 9 aa, Homo Sapiens
DILRVLATN

SEQ ID NO: 347592 - protein, 9 aa, Homo Sapiens
PPKYDKIKD

SEQ ID NO: 347593 - protein, 9 aa, Homo Sapiens
DNINKAFSK

SEQ ID NO: 347594 - protein, 9 aa, Homo Sapiens
TKETLKIVS

SEQ ID NO: 347595 - protein, 9 aa, Homo Sapiens
SEALKYLTM

SEQ ID NO: 347596 - protein, 9 aa, Homo Sapiens
QKHNKQWYE

SEQ ID NO: 347597 - protein, 9 aa, Homo Sapiens
CQCLTTVID

SEQ ID NO: 347598 - protein, 9 aa, Homo Sapiens
METLKDTTL

SEQ ID NO: 347599 - protein, 9 aa, Homo Sapiens
ERCKSHYTA

SEQ ID NO: 347600 - protein, 9 aa, Homo Sapiens
PKSEKCSSK

SEQ ID NO: 347601 - protein, 9 aa, Homo Sapiens
LMTVESANN

SEQ ID NO: 347602 - protein, 9 aa, Homo Sapiens
HNIDTCCHV

SEQ ID NO: 347603 - protein, 9 aa, Homo Sapiens
QSNKCVQAA

SEQ ID NO: 347604 - protein, 9 aa, Homo Sapiens
PVRKNLFCF

SEQ ID NO: 347605 - protein, 9 aa, Homo Sapiens
SPRTLETDD

SEQ ID NO: 347606 - protein, 9 aa, Homo Sapiens
ICDPTVHWL

SEQ ID NO: 347607 - protein, 9 aa, Homo Sapiens
LWSLNSDEP

SEQ ID NO: 347608 - protein, 9 aa, Homo Sapiens
QRLLDFIFS

SEQ ID NO: 347609 - protein, 9 aa, Homo Sapiens
NAASVMCIS

SEQ ID NO: 347610 - protein, 9 aa, Homo Sapiens
TCRLLDITT

SEQ ID NO: 347611 - protein, 9 aa, Homo Sapiens
INNFIIFWS

SEQ ID NO: 347612 - protein, 9 aa, Homo Sapiens
SALKPAFGF

SEQ ID NO: 347613 - protein, 9 aa, Homo Sapiens
TSKKNVCVS

SEQ ID NO: 347614 - protein, 9 aa, Homo Sapiens
IQSDIPAPR

SEQ ID NO: 347615 - protein, 9 aa, Homo Sapiens
VLRQKILKP

SEQ ID NO: 347616 - protein, 9 aa, Homo Sapiens
EGAPQISLA

SEQ ID NO: 347617 - protein, 9 aa, Homo Sapiens
ILIYVFQDF

SEQ ID NO: 347618 - protein, 9 aa, Homo Sapiens
TRVPRLPKF

SEQ ID NO: 347619 - protein, 9 aa, Homo Sapiens
RRRKFILAS

SEQ ID NO: 347620 - protein, 9 aa, Homo Sapiens
VNQTIEKVS

SEQ ID NO: 347621 - protein, 9 aa, Homo Sapiens
SSNFLSNSC

SEQ ID NO: 347622 - protein, 9 aa, Homo Sapiens
IKLITSEEE

SEQ ID NO: 347623 - protein, 9 aa, Homo Sapiens
KDISEAFTS

SEQ ID NO: 347624 - protein, 9 aa, Homo Sapiens
DIVVVALDL

SEQ ID NO: 347625 - protein, 9 aa, Homo Sapiens
PKVHIKFTE

SEQ ID NO: 347626 - protein, 9 aa, Homo Sapiens
GAQAKPPKI

SEQ ID NO: 347627 - protein, 9 aa, Homo Sapiens
EKSGQIFCT

SEQ ID NO: 347628 - protein, 9 aa, Homo Sapiens
NNFIIFWSF

SEQ ID NO: 347629 - protein, 9 aa, Homo Sapiens
RQLAEDFLC

SEQ ID NO: 347630 - protein, 9 aa, Homo Sapiens
KQLRKKQEA

SEQ ID NO: 347631 - protein, 9 aa, Homo Sapiens
LRAWVAAMW

SEQ ID NO: 347632 - protein, 9 aa, Homo Sapiens
ANHPFMFIM

SEQ ID NO: 347633 - protein, 9 aa, Homo Sapiens
IPIKSKEVV

SEQ ID NO: 347634 - protein, 9 aa, Homo Sapiens
LFQRGLRHV

SEQ ID NO: 347635 - protein, 9 aa, Homo Sapiens
TSPTKSPDY

SEQ ID NO: 347636 - protein, 9 aa, Homo Sapiens
YQFRCKNKA

SEQ ID NO: 347637 - protein, 9 aa, Homo Sapiens
HSEELHNCI

SEQ ID NO: 347638 - protein, 9 aa, Homo Sapiens
GGEKRRGCA

SEQ ID NO: 347639 - protein, 9 aa, Homo Sapiens
NPFDVFISP

SEQ ID NO: 347640 - protein, 9 aa, Homo Sapiens
KLWLSLQDQ

SEQ ID NO: 347641 - protein, 9 aa, Homo Sapiens
KSFVKGTIQ

SEQ ID NO: 347642 - protein, 9 aa, Homo Sapiens
DGSQTFDII

SEQ ID NO: 347643 - protein, 9 aa, Homo Sapiens
DDGSRCLFT

SEQ ID NO: 347644 - protein, 9 aa, Homo Sapiens
EMYSLGSNH

SEQ ID NO: 347645 - protein, 9 aa, Homo Sapiens
KASQPEAAF

SEQ ID NO: 347646 - protein, 9 aa, Homo Sapiens
GFGNQCGKP

SEQ ID NO: 347647 - protein, 9 aa, Homo Sapiens
DITPLPGLP

SEQ ID NO: 347648 - protein, 9 aa, Homo Sapiens
ESTVPQEKV

SEQ ID NO: 347649 - protein, 9 aa, Homo Sapiens
QIILETRAT

SEQ ID NO: 347650 - protein, 9 aa, Homo Sapiens
GSLKIKQVV

SEQ ID NO: 347651 - protein, 9 aa, Homo Sapiens
NCAELMKLP

SEQ ID NO: 347652 - protein, 9 aa, Homo Sapiens
EQEFRKQIH

SEQ ID NO: 347653 - protein, 9 aa, Homo Sapiens
EEKPYKCDA

SEQ ID NO: 347654 - protein, 9 aa, Homo Sapiens
EEHERLLER

SEQ ID NO: 347655 - protein, 9 aa, Homo Sapiens
EACTAGCDK

SEQ ID NO: 347656 - protein, 9 aa, Homo Sapiens
TLNEEHSHR

SEQ ID NO: 347657 - protein, 9 aa, Homo Sapiens
SNHPQGFFS

SEQ ID NO: 347658 - protein, 9 aa, Homo Sapiens
NNDAAELHN

SEQ ID NO: 347659 - protein, 9 aa, Homo Sapiens
PEGEHQYKL

SEQ ID NO: 347660 - protein, 9 aa, Homo Sapiens
TLGCQNNNS

SEQ ID NO: 347661 - protein, 9 aa, Homo Sapiens
ITFEITFCS

SEQ ID NO: 347662 - protein, 9 aa, Homo Sapiens
KSNLENINF

SEQ ID NO: 347663 - protein, 9 aa, Homo Sapiens
KLGMPGVSL

SEQ ID NO: 347664 - protein, 9 aa, Homo Sapiens
EASKIMKSI

SEQ ID NO: 347665 - protein, 9 aa, Homo Sapiens
LRKKDVLLQ

SEQ ID NO: 347666 - protein, 9 aa, Homo Sapiens
HTGVLTIVT

SEQ ID NO: 347667 - protein, 9 aa, Homo Sapiens
YVEQLWVVE

SEQ ID NO: 347668 - protein, 9 aa, Homo Sapiens
SLDVELINE

SEQ ID NO: 347669 - protein, 9 aa, Homo Sapiens
VKKTSGGGR

SEQ ID NO: 347670 - protein, 9 aa, Homo Sapiens
EDKLDVPDD

SEQ ID NO: 347671 - protein, 9 aa, Homo Sapiens
FATMPLVTS

SEQ ID NO: 347672 - protein, 9 aa, Homo Sapiens
RGAELVTEE

SEQ ID NO: 347673 - protein, 9 aa, Homo Sapiens
GDELDAMLK

SEQ ID NO: 347674 - protein, 9 aa, Homo Sapiens
RRQPHVVSQ

SEQ ID NO: 347675 - protein, 9 aa, Homo Sapiens
LILPKNKGS

SEQ ID NO: 347676 - protein, 9 aa, Homo Sapiens
CQQHQSWLR

SEQ ID NO: 347677 - protein, 9 aa, Homo Sapiens
KADYYELDW

SEQ ID NO: 347678 - protein, 9 aa, Homo Sapiens
FRCSSSLCD

SEQ ID NO: 347679 - protein, 9 aa, Homo Sapiens
PILHRDLRS

SEQ ID NO: 347680 - protein, 9 aa, Homo Sapiens
SNELSFPQL

SEQ ID NO: 347681 - protein, 9 aa, Homo Sapiens
CEDHDESIC

SEQ ID NO: 347682 - protein, 9 aa, Homo Sapiens
EKSQKKNRN

SEQ ID NO: 347683 - protein, 9 aa, Homo Sapiens
AKYYRQMDS

SEQ ID NO: 347684 - protein, 9 aa, Homo Sapiens
VIVACCNQL

SEQ ID NO: 347685 - protein, 9 aa, Homo Sapiens
TSYKSKFKR

SEQ ID NO: 347686 - protein, 9 aa, Homo Sapiens
SMAGHSSCV

SEQ ID NO: 347687 - protein, 9 aa, Homo Sapiens
SLNLISNLW

SEQ ID NO: 347688 - protein, 9 aa, Homo Sapiens
TLSTPPTAA

SEQ ID NO: 347689 - protein, 9 aa, Homo Sapiens
EELKSLDKD

SEQ ID NO: 347690 - protein, 9 aa, Homo Sapiens
KCLKNMNLE

SEQ ID NO: 347691 - protein, 9 aa, Homo Sapiens
EVTVTPNTA

SEQ ID NO: 347692 - protein, 9 aa, Homo Sapiens
APSELSNWY

SEQ ID NO: 347693 - protein, 9 aa, Homo Sapiens
ELNNKINMQ

SEQ ID NO: 347694 - protein, 9 aa, Homo Sapiens
PVPYFGPVF

SEQ ID NO: 347695 - protein, 9 aa, Homo Sapiens
YQNRYRSDP

SEQ ID NO: 347696 - protein, 9 aa, Homo Sapiens
DATEQRTSS

SEQ ID NO: 347697 - protein, 9 aa, Homo Sapiens
PTSPFKREE

SEQ ID NO: 347698 - protein, 9 aa, Homo Sapiens
MNESSIDYI

SEQ ID NO: 347699 - protein, 9 aa, Homo Sapiens
LVICGTQGA

SEQ ID NO: 347700 - protein, 9 aa, Homo Sapiens
SKQGLAKAV

SEQ ID NO: 347701 - protein, 9 aa, Homo Sapiens
QVVVAALRQ

SEQ ID NO: 347702 - protein, 9 aa, Homo Sapiens
NEIMLALSS

SEQ ID NO: 347703 - protein, 9 aa, Homo Sapiens
DVKGDDNPK

SEQ ID NO: 347704 - protein, 9 aa, Homo Sapiens
EAEETNGGT

SEQ ID NO: 347705 - protein, 9 aa, Homo Sapiens
PHHGIATSV

SEQ ID NO: 347706 - protein, 9 aa, Homo Sapiens
FEIYFRKET

SEQ ID NO: 347707 - protein, 9 aa, Homo Sapiens
MQTLMCDVH

SEQ ID NO: 347708 - protein, 9 aa, Homo Sapiens
AHKSTPEIS

SEQ ID NO: 347709 - protein, 9 aa, Homo Sapiens
LTPTKKIQV

SEQ ID NO: 347710 - protein, 9 aa, Homo Sapiens
PITSIEQVL

SEQ ID NO: 347711 - protein, 9 aa, Homo Sapiens
KIFKRIQSQ

SEQ ID NO: 347712 - protein, 9 aa, Homo Sapiens
DEGHAIQNP

SEQ ID NO: 347713 - protein, 9 aa, Homo Sapiens
GEILNKTRS

SEQ ID NO: 347714 - protein, 9 aa, Homo Sapiens
KNTSKLLFK

SEQ ID NO: 347715 - protein, 9 aa, Homo Sapiens
ELHTKTNLK

SEQ ID NO: 347716 - protein, 9 aa, Homo Sapiens
THKVANTSY

SEQ ID NO: 347717 - protein, 9 aa, Homo Sapiens
NTLRNKMGK

SEQ ID NO: 347718 - protein, 9 aa, Homo Sapiens
EGKIIKVYG

SEQ ID NO: 347719 - protein, 9 aa, Homo Sapiens
KYLAKWMVH

SEQ ID NO: 347720 - protein, 9 aa, Homo Sapiens
ALLCKLFLD

SEQ ID NO: 347721 - protein, 9 aa, Homo Sapiens
TPNSDVFTF

SEQ ID NO: 347722 - protein, 9 aa, Homo Sapiens
RLLWQICRG

SEQ ID NO: 347723 - protein, 9 aa, Homo Sapiens
APVYLYEFR

SEQ ID NO: 347724 - protein, 9 aa, Homo Sapiens
SRLLTILCE

SEQ ID NO: 347725 - protein, 9 aa, Homo Sapiens
IVVLIKLYS

SEQ ID NO: 347726 - protein, 9 aa, Homo Sapiens
ASSNGYANI

SEQ ID NO: 347727 - protein, 9 aa, Homo Sapiens
NKTDLQLHV

SEQ ID NO: 347728 - protein, 9 aa, Homo Sapiens
MARMYVAET

SEQ ID NO: 347729 - protein, 9 aa, Homo Sapiens
HSSHKLYSQ

SEQ ID NO: 347730 - protein, 9 aa, Homo Sapiens
ECSRCGKAY

SEQ ID NO: 347731 - protein, 9 aa, Homo Sapiens
NNSYNDALL

SEQ ID NO: 347732 - protein, 9 aa, Homo Sapiens
CLMWCIGDF

SEQ ID NO: 347733 - protein, 9 aa, Homo Sapiens
IRQQNEVRV

SEQ ID NO: 347734 - protein, 9 aa, Homo Sapiens
DSVKASNST

SEQ ID NO: 347735 - protein, 9 aa, Homo Sapiens
ELQKEKKRK

SEQ ID NO: 347736 - protein, 9 aa, Homo Sapiens
ITTFGAFLH

SEQ ID NO: 347737 - protein, 9 aa, Homo Sapiens
DACTRKFHF

SEQ ID NO: 347738 - protein, 9 aa, Homo Sapiens
RSLLRKWYN

SEQ ID NO: 347739 - protein, 9 aa, Homo Sapiens
VSTGEPLPK

SEQ ID NO: 347740 - protein, 9 aa, Homo Sapiens
ILEHYVGAV

SEQ ID NO: 347741 - protein, 9 aa, Homo Sapiens
GIDDKDSFN

SEQ ID NO: 347742 - protein, 9 aa, Homo Sapiens
CKTSKKVAV

SEQ ID NO: 347743 - protein, 9 aa, Homo Sapiens
RNIFYLFLY

SEQ ID NO: 347744 - protein, 9 aa, Homo Sapiens
GYTEALGVK

SEQ ID NO: 347745 - protein, 9 aa, Homo Sapiens
ERTFKRFTP

SEQ ID NO: 347746 - protein, 9 aa, Homo Sapiens
NISIIDGNE

SEQ ID NO: 347747 - protein, 9 aa, Homo Sapiens
FPGLTSTHS

SEQ ID NO: 347748 - protein, 9 aa, Homo Sapiens
ENKTTVVYL

SEQ ID NO: 347749 - protein, 9 aa, Homo Sapiens
RTQASTEGC

SEQ ID NO: 347750 - protein, 9 aa, Homo Sapiens
GKALRVHAT

SEQ ID NO: 347751 - protein, 9 aa, Homo Sapiens
LREEANKFW

SEQ ID NO: 347752 - protein, 9 aa, Homo Sapiens
VTGLAQVIL

SEQ ID NO: 347753 - protein, 9 aa, Homo Sapiens
VHSIKFHPS

SEQ ID NO: 347754 - protein, 9 aa, Homo Sapiens
CSYDSSMES

SEQ ID NO: 347755 - protein, 9 aa, Homo Sapiens
PPCELYVFI

SEQ ID NO: 347756 - protein, 9 aa, Homo Sapiens
GTLVVTVNT

SEQ ID NO: 347757 - protein, 9 aa, Homo Sapiens
HQIHSKDGL

SEQ ID NO: 347758 - protein, 9 aa, Homo Sapiens
ANNIVLLPD

SEQ ID NO: 347759 - protein, 9 aa, Homo Sapiens
QNDLFNKEK

SEQ ID NO: 347760 - protein, 9 aa, Homo Sapiens
ELESHIQEW

SEQ ID NO: 347761 - protein, 9 aa, Homo Sapiens
KTNLVTISY

SEQ ID NO: 347762 - protein, 9 aa, Homo Sapiens
GRLSAGSVD

SEQ ID NO: 347763 - protein, 9 aa, Homo Sapiens
SPRTIVLFL

SEQ ID NO: 347764 - protein, 9 aa, Homo Sapiens
NIQFPLMTP

SEQ ID NO: 347765 - protein, 9 aa, Homo Sapiens
VAFSDERVP

SEQ ID NO: 347766 - protein, 9 aa, Homo Sapiens
LKSEAKEPL

SEQ ID NO: 347767 - protein, 9 aa, Homo Sapiens
FSNYSELQG

SEQ ID NO: 347768 - protein, 9 aa, Homo Sapiens
SPIDLADDL

SEQ ID NO: 347769 - protein, 9 aa, Homo Sapiens
SDLSDGDAK

SEQ ID NO: 347770 - protein, 9 aa, Homo Sapiens
KEEIVQLFS

SEQ ID NO: 347771 - protein, 9 aa, Homo Sapiens
HKYFPDAIP

SEQ ID NO: 347772 - protein, 9 aa, Homo Sapiens
NLDIPRFQM

SEQ ID NO: 347773 - protein, 9 aa, Homo Sapiens
IQTNASDST

SEQ ID NO: 347774 - protein, 9 aa, Homo Sapiens
EPVELRSSY

SEQ ID NO: 347775 - protein, 9 aa, Homo Sapiens
RAQLANNAK

SEQ ID NO: 347776 - protein, 9 aa, Homo Sapiens
KYLKEDDAN

SEQ ID NO: 347777 - protein, 9 aa, Homo Sapiens
RGRRGGRGH

SEQ ID NO: 347778 - protein, 9 aa, Homo Sapiens
SPRQTPICD

SEQ ID NO: 347779 - protein, 9 aa, Homo Sapiens
RIALVVEIC

SEQ ID NO: 347780 - protein, 9 aa, Homo Sapiens
VVDQQKTLD

SEQ ID NO: 347781 - protein, 9 aa, Homo Sapiens
KPFKSNHPQ

SEQ ID NO: 347782 - protein, 9 aa, Homo Sapiens
RRILVLEKV

SEQ ID NO: 347783 - protein, 9 aa, Homo Sapiens
KDNAAALEE

SEQ ID NO: 347784 - protein, 9 aa, Homo Sapiens
QLFQEAVPP

SEQ ID NO: 347785 - protein, 9 aa, Homo Sapiens
VFKKKKWST

SEQ ID NO: 347786 - protein, 9 aa, Homo Sapiens
EKQCLKMLE

SEQ ID NO: 347787 - protein, 9 aa, Homo Sapiens
LEYLLMAVI

SEQ ID NO: 347788 - protein, 9 aa, Homo Sapiens
HGNTLHKGW

SEQ ID NO: 347789 - protein, 9 aa, Homo Sapiens
YLAYHEWKM

SEQ ID NO: 347790 - protein, 9 aa, Homo Sapiens
PFLSNELSF

SEQ ID NO: 347791 - protein, 9 aa, Homo Sapiens
EEENMVLRS

SEQ ID NO: 347792 - protein, 9 aa, Homo Sapiens
NQTAETILT

SEQ ID NO: 347793 - protein, 9 aa, Homo Sapiens
LEQHIQKRL

SEQ ID NO: 347794 - protein, 9 aa, Homo Sapiens
TLVVTVNTT

SEQ ID NO: 347795 - protein, 9 aa, Homo Sapiens
SESWSVKVK

SEQ ID NO: 347796 - protein, 9 aa, Homo Sapiens
GLLFTSDNL

SEQ ID NO: 347797 - protein, 9 aa, Homo Sapiens
DELSKSLSL

SEQ ID NO: 347798 - protein, 9 aa, Homo Sapiens
PRCLHTAVY

SEQ ID NO: 347799 - protein, 9 aa, Homo Sapiens
WTLALHPLT

SEQ ID NO: 347800 - protein, 9 aa, Homo Sapiens
EMKIFPIRA

SEQ ID NO: 347801 - protein, 9 aa, Homo Sapiens
YPHNKDGEP

SEQ ID NO: 347802 - protein, 9 aa, Homo Sapiens
ELNKWSCES

SEQ ID NO: 347803 - protein, 9 aa, Homo Sapiens
DTPWASTFP

SEQ ID NO: 347804 - protein, 9 aa, Homo Sapiens
KENTLILLD

SEQ ID NO: 347805 - protein, 9 aa, Homo Sapiens
DSGADGGTL

SEQ ID NO: 347806 - protein, 9 aa, Homo Sapiens
ASVMCISPE

SEQ ID NO: 347807 - protein, 9 aa, Homo Sapiens
FILDGLHED

SEQ ID NO: 347808 - protein, 9 aa, Homo Sapiens
VCKFVLMRA

SEQ ID NO: 347809 - protein, 9 aa, Homo Sapiens
RIYEAKEEL

SEQ ID NO: 347810 - protein, 9 aa, Homo Sapiens
DPKVTSMFK

SEQ ID NO: 347811 - protein, 9 aa, Homo Sapiens
KKRRIQLYQ

SEQ ID NO: 347812 - protein, 9 aa, Homo Sapiens
TYFGGAVAY

SEQ ID NO: 347813 - protein, 9 aa, Homo Sapiens
ITKTCPNHY

SEQ ID NO: 347814 - protein, 9 aa, Homo Sapiens
NSPLKREKN

SEQ ID NO: 347815 - protein, 9 aa, Homo Sapiens
SYNGHRDLE

SEQ ID NO: 347816 - protein, 9 aa, Homo Sapiens
DYFQKVILR

SEQ ID NO: 347817 - protein, 9 aa, Homo Sapiens
EQRGKNALK

SEQ ID NO: 347818 - protein, 9 aa, Homo Sapiens
GGADKKSSC

SEQ ID NO: 347819 - protein, 9 aa, Homo Sapiens
AIQILAAAL

SEQ ID NO: 347820 - protein, 9 aa, Homo Sapiens
DKDYGQNGM

SEQ ID NO: 347821 - protein, 9 aa, Homo Sapiens
QSDGWERAF

SEQ ID NO: 347822 - protein, 9 aa, Homo Sapiens
VCAGASCVV

SEQ ID NO: 347823 - protein, 9 aa, Homo Sapiens
FNNDAAELH

SEQ ID NO: 347824 - protein, 9 aa, Homo Sapiens
QTETTADCR

SEQ ID NO: 347825 - protein, 9 aa, Homo Sapiens
RQGAVVAVT

SEQ ID NO: 347826 - protein, 9 aa, Homo Sapiens
EGAQVMRNG

SEQ ID NO: 347827 - protein, 9 aa, Homo Sapiens
ELSKSLSLV

SEQ ID NO: 347828 - protein, 9 aa, Homo Sapiens
VKQKSMQGK

SEQ ID NO: 347829 - protein, 9 aa, Homo Sapiens
NPNDDIQYD

SEQ ID NO: 347830 - protein, 9 aa, Homo Sapiens
EIGQIELVQ

SEQ ID NO: 347831 - protein, 9 aa, Homo Sapiens
QFLIYPALQ

SEQ ID NO: 347832 - protein, 9 aa, Homo Sapiens
ATRNEILVW

SEQ ID NO: 347833 - protein, 9 aa, Homo Sapiens
SPLSLKRPK

SEQ ID NO: 347834 - protein, 9 aa, Homo Sapiens
IDWNTLYQK

SEQ ID NO: 347835 - protein, 9 aa, Homo Sapiens
DVRDYFMSC

SEQ ID NO: 347836 - protein, 9 aa, Homo Sapiens
IIHKHCVYY

SEQ ID NO: 347837 - protein, 9 aa, Homo Sapiens
EKEIVVLIK

SEQ ID NO: 347838 - protein, 9 aa, Homo Sapiens
SEWGLWWQS

SEQ ID NO: 347839 - protein, 9 aa, Homo Sapiens
ECQLVCGAC

SEQ ID NO: 347840 - protein, 9 aa, Homo Sapiens
ISIHDNKFF

SEQ ID NO: 347841 - protein, 9 aa, Homo Sapiens
GSSESPLSL

SEQ ID NO: 347842 - protein, 9 aa, Homo Sapiens
DPPARKEKN

SEQ ID NO: 347843 - protein, 9 aa, Homo Sapiens
WFNSVAKTP

SEQ ID NO: 347844 - protein, 9 aa, Homo Sapiens
GEHTERHAQ

SEQ ID NO: 347845 - protein, 9 aa, Homo Sapiens
SIGLLFVSY

SEQ ID NO: 347846 - protein, 9 aa, Homo Sapiens
NPEHCSHNG

SEQ ID NO: 347847 - protein, 9 aa, Homo Sapiens
ALCCMQPHS

SEQ ID NO: 347848 - protein, 9 aa, Homo Sapiens
GVVKLCNFG

SEQ ID NO: 347849 - protein, 9 aa, Homo Sapiens
HHMLFELLK

SEQ ID NO: 347850 - protein, 9 aa, Homo Sapiens
KVDLSLKDK

SEQ ID NO: 347851 - protein, 9 aa, Homo Sapiens
AVLDPEHRG

SEQ ID NO: 347852 - protein, 9 aa, Homo Sapiens
KKAGLAPFV

SEQ ID NO: 347853 - protein, 9 aa, Homo Sapiens
LVLVVLLTV

SEQ ID NO: 347854 - protein, 9 aa, Homo Sapiens
QSRGTHTNP

SEQ ID NO: 347855 - protein, 9 aa, Homo Sapiens
DKAWQNYNK

SEQ ID NO: 347856 - protein, 9 aa, Homo Sapiens
GHGRGHKSS

SEQ ID NO: 347857 - protein, 9 aa, Homo Sapiens
KARLSSSPQ

SEQ ID NO: 347858 - protein, 9 aa, Homo Sapiens
EKCTLEGEL

SEQ ID NO: 347859 - protein, 9 aa, Homo Sapiens
MLQDLLSDQ

SEQ ID NO: 347860 - protein, 9 aa, Homo Sapiens
VGISVPTND

SEQ ID NO: 347861 - protein, 9 aa, Homo Sapiens
LEINVFKVH

SEQ ID NO: 347862 - protein, 9 aa, Homo Sapiens
EICKYKKRF

SEQ ID NO: 347863 - protein, 9 aa, Homo Sapiens
QNPNAQQTK

SEQ ID NO: 347864 - protein, 9 aa, Homo Sapiens
TAGFSEKFL

SEQ ID NO: 347865 - protein, 9 aa, Homo Sapiens
SNYSASASQ

SEQ ID NO: 347866 - protein, 9 aa, Homo Sapiens
YSYAINLPV

SEQ ID NO: 347867 - protein, 9 aa, Homo Sapiens
SLFVFPVYQ

SEQ ID NO: 347868 - protein, 9 aa, Homo Sapiens
CSKKNEIMV

SEQ ID NO: 347869 - protein, 9 aa, Homo Sapiens
VDAAVKQRL

SEQ ID NO: 347870 - protein, 9 aa, Homo Sapiens
MYATIQTES

SEQ ID NO: 347871 - protein, 9 aa, Homo Sapiens
KVEARKNYQ

SEQ ID NO: 347872 - protein, 9 aa, Homo Sapiens
GNLSRSAQL

SEQ ID NO: 347873 - protein, 9 aa, Homo Sapiens
QFDLYKLLS

SEQ ID NO: 347874 - protein, 9 aa, Homo Sapiens
YVRRKSIKN

SEQ ID NO: 347875 - protein, 9 aa, Homo Sapiens
AHAMRWAFR

SEQ ID NO: 347876 - protein, 9 aa, Homo Sapiens
RAAGLKENT

SEQ ID NO: 347877 - protein, 9 aa, Homo Sapiens
DEEIANHKG

SEQ ID NO: 347878 - protein, 9 aa, Homo Sapiens
TRLYYWDAS

SEQ ID NO: 347879 - protein, 9 aa, Homo Sapiens
DLDLFSEGS

SEQ ID NO: 347880 - protein, 9 aa, Homo Sapiens
FNTVTTCVP

SEQ ID NO: 347881 - protein, 9 aa, Homo Sapiens
KLQHFLDTA

SEQ ID NO: 347882 - protein, 9 aa, Homo Sapiens
IAVVHHLGH

SEQ ID NO: 347883 - protein, 9 aa, Homo Sapiens
YFDWTPATS

SEQ ID NO: 347884 - protein, 9 aa, Homo Sapiens
LDTASLVPG

SEQ ID NO: 347885 - protein, 9 aa, Homo Sapiens
TKNWTSYMR

SEQ ID NO: 347886 - protein, 9 aa, Homo Sapiens
MAKQKQTSF

SEQ ID NO: 347887 - protein, 9 aa, Homo Sapiens
DPNFYNETY

SEQ ID NO: 347888 - protein, 9 aa, Homo Sapiens
ASRLLAADV

SEQ ID NO: 347889 - protein, 9 aa, Homo Sapiens
DKVLSRKSH

SEQ ID NO: 347890 - protein, 9 aa, Homo Sapiens
QTMIRGMMD

SEQ ID NO: 347891 - protein, 9 aa, Homo Sapiens
LPSPSPSAY

SEQ ID NO: 347892 - protein, 9 aa, Homo Sapiens
EFASRHKSF

SEQ ID NO: 347893 - protein, 9 aa, Homo Sapiens
NEAAALLDD

SEQ ID NO: 347894 - protein, 9 aa, Homo Sapiens
EILLKITTF

SEQ ID NO: 347895 - protein, 9 aa, Homo Sapiens
HLMSSILTS

SEQ ID NO: 347896 - protein, 9 aa, Homo Sapiens
CCHCRNIVH

SEQ ID NO: 347897 - protein, 9 aa, Homo Sapiens
HNIWVYDEE

SEQ ID NO: 347898 - protein, 9 aa, Homo Sapiens
DVVKRKLKM

SEQ ID NO: 347899 - protein, 9 aa, Homo Sapiens
DIIKLFNEM

SEQ ID NO: 347900 - protein, 9 aa, Homo Sapiens
DQGVAGYDI

SEQ ID NO: 347901 - protein, 9 aa, Homo Sapiens
EDKSNGFVC

SEQ ID NO: 347902 - protein, 9 aa, Homo Sapiens
LLETLQTAG

SEQ ID NO: 347903 - protein, 9 aa, Homo Sapiens
GPGALLKTG

SEQ ID NO: 347904 - protein, 9 aa, Homo Sapiens
IRIALGNGA

SEQ ID NO: 347905 - protein, 9 aa, Homo Sapiens
TDDSRWCSQ

SEQ ID NO: 347906 - protein, 9 aa, Homo Sapiens
LDVDIQLSL

SEQ ID NO: 347907 - protein, 9 aa, Homo Sapiens
QDERGPNAQ

SEQ ID NO: 347908 - protein, 9 aa, Homo Sapiens
ATLPFVPGK

SEQ ID NO: 347909 - protein, 9 aa, Homo Sapiens
VNFTKNRKD

SEQ ID NO: 347910 - protein, 9 aa, Homo Sapiens
ATMNGIIKS

SEQ ID NO: 347911 - protein, 9 aa, Homo Sapiens
VVGINDNAP

SEQ ID NO: 347912 - protein, 9 aa, Homo Sapiens
EENFEKLWL

SEQ ID NO: 347913 - protein, 9 aa, Homo Sapiens
QNTVSKCKR

SEQ ID NO: 347914 - protein, 9 aa, Homo Sapiens
QHVPVEIVK

SEQ ID NO: 347915 - protein, 9 aa, Homo Sapiens
GEWYNVDFQ

SEQ ID NO: 347916 - protein, 9 aa, Homo Sapiens
AWAVQNIQN

SEQ ID NO: 347917 - protein, 9 aa, Homo Sapiens
MPLLEAPLC

SEQ ID NO: 347918 - protein, 9 aa, Homo Sapiens
KWKDRQKSY

SEQ ID NO: 347919 - protein, 9 aa, Homo Sapiens
ALAMALMGG

SEQ ID NO: 347920 - protein, 9 aa, Homo Sapiens
RNIDRYYLR

SEQ ID NO: 347921 - protein, 9 aa, Homo Sapiens
YELIVDVNK

SEQ ID NO: 347922 - protein, 9 aa, Homo Sapiens
LKQFGNILI

SEQ ID NO: 347923 - protein, 9 aa, Homo Sapiens
SISRVTYLL

SEQ ID NO: 347924 - protein, 9 aa, Homo Sapiens
HKTKKKKTR

SEQ ID NO: 347925 - protein, 9 aa, Homo Sapiens
ALAVITQSF

SEQ ID NO: 347926 - protein, 9 aa, Homo Sapiens
LGYTKQLFQ

SEQ ID NO: 347927 - protein, 9 aa, Homo Sapiens
HDHRITSQI

SEQ ID NO: 347928 - protein, 9 aa, Homo Sapiens
HFSQGFPVI

SEQ ID NO: 347929 - protein, 9 aa, Homo Sapiens
QEYINDDGL

SEQ ID NO: 347930 - protein, 9 aa, Homo Sapiens
DDVKEQMYK

SEQ ID NO: 347931 - protein, 9 aa, Homo Sapiens
QLEMLSGDR

SEQ ID NO: 347932 - protein, 9 aa, Homo Sapiens
HAAELRDAE

SEQ ID NO: 347933 - protein, 9 aa, Homo Sapiens
MGWLHSKIE

SEQ ID NO: 347934 - protein, 9 aa, Homo Sapiens
GGFRCKCWV

SEQ ID NO: 347935 - protein, 9 aa, Homo Sapiens
KELFFDYRY

SEQ ID NO: 347936 - protein, 9 aa, Homo Sapiens
SSAAKAEAI

SEQ ID NO: 347937 - protein, 9 aa, Homo Sapiens
NHLYAAILG

SEQ ID NO: 347938 - protein, 9 aa, Homo Sapiens
GSLTADKDE

SEQ ID NO: 347939 - protein, 9 aa, Homo Sapiens
TLTIHKIIN

SEQ ID NO: 347940 - protein, 9 aa, Homo Sapiens
TGYIRFKKF

SEQ ID NO: 347941 - protein, 9 aa, Homo Sapiens
RWLKKKHQL

SEQ ID NO: 347942 - protein, 9 aa, Homo Sapiens
QAKPPKITG

SEQ ID NO: 347943 - protein, 9 aa, Homo Sapiens
STPPTAALD

SEQ ID NO: 347944 - protein, 9 aa, Homo Sapiens
VLKSEPYEK

SEQ ID NO: 347945 - protein, 9 aa, Homo Sapiens
LVEGNLSRS

SEQ ID NO: 347946 - protein, 9 aa, Homo Sapiens
YMVHRNKSE

SEQ ID NO: 347947 - protein, 9 aa, Homo Sapiens
RQQHFEKRR

SEQ ID NO: 347948 - protein, 9 aa, Homo Sapiens
GLLKLLARA

SEQ ID NO: 347949 - protein, 9 aa, Homo Sapiens
IKVQTKEGC

SEQ ID NO: 347950 - protein, 9 aa, Homo Sapiens
STHIHIMPS

SEQ ID NO: 347951 - protein, 9 aa, Homo Sapiens
HTGLGGYWG

SEQ ID NO: 347952 - protein, 9 aa, Homo Sapiens
GGNDNETLA

SEQ ID NO: 347953 - protein, 9 aa, Homo Sapiens
EGFDKNEIQ

SEQ ID NO: 347954 - protein, 9 aa, Homo Sapiens
VDCKGGSRT

SEQ ID NO: 347955 - protein, 9 aa, Homo Sapiens
LTRYKKLHN

SEQ ID NO: 347956 - protein, 9 aa, Homo Sapiens
YPDGRKEIM

SEQ ID NO: 347957 - protein, 9 aa, Homo Sapiens
NEDRFDFTQ

SEQ ID NO: 347958 - protein, 9 aa, Homo Sapiens
GYGSCLFIY

SEQ ID NO: 347959 - protein, 9 aa, Homo Sapiens
SQNIKINEM

SEQ ID NO: 347960 - protein, 9 aa, Homo Sapiens
AVSVILLLS

SEQ ID NO: 347961 - protein, 9 aa, Homo Sapiens
TNEIMLALS

SEQ ID NO: 347962 - protein, 9 aa, Homo Sapiens
KLLVNVVFD

SEQ ID NO: 347963 - protein, 9 aa, Homo Sapiens
WPACHILHV

SEQ ID NO: 347964 - protein, 9 aa, Homo Sapiens
SPLLDSRER

SEQ ID NO: 347965 - protein, 9 aa, Homo Sapiens
IPKKKINLK

SEQ ID NO: 347966 - protein, 9 aa, Homo Sapiens
KCGKPYSPI

SEQ ID NO: 347967 - protein, 9 aa, Homo Sapiens
VVWEAGEAG

SEQ ID NO: 347968 - protein, 9 aa, Homo Sapiens
ENYSKKDKG

SEQ ID NO: 347969 - protein, 9 aa, Homo Sapiens
IITGVNSSD

SEQ ID NO: 347970 - protein, 9 aa, Homo Sapiens
TVKHEQNTD

SEQ ID NO: 347971 - protein, 9 aa, Homo Sapiens
DISLDKQYK

SEQ ID NO: 347972 - protein, 9 aa, Homo Sapiens
VGLLTRFLK

SEQ ID NO: 347973 - protein, 9 aa, Homo Sapiens
NLGVASYIE

SEQ ID NO: 347974 - protein, 9 aa, Homo Sapiens
SIKGWRPKI

SEQ ID NO: 347975 - protein, 9 aa, Homo Sapiens
WSVKVKIKL

SEQ ID NO: 347976 - protein, 9 aa, Homo Sapiens
TEKPPQTQK

SEQ ID NO: 347977 - protein, 9 aa, Homo Sapiens
AGGPLVGII

SEQ ID NO: 347978 - protein, 9 aa, Homo Sapiens
RSRPPHLHR

SEQ ID NO: 347979 - protein, 9 aa, Homo Sapiens
AKWFEELQK

SEQ ID NO: 347980 - protein, 9 aa, Homo Sapiens
RMRRLHMQH

SEQ ID NO: 347981 - protein, 9 aa, Homo Sapiens
KKPAESKNN

SEQ ID NO: 347982 - protein, 9 aa, Homo Sapiens
VSEYKIQGL

SEQ ID NO: 347983 - protein, 9 aa, Homo Sapiens
IENNHSLYL

SEQ ID NO: 347984 - protein, 9 aa, Homo Sapiens
YSLSFQSHH

SEQ ID NO: 347985 - protein, 9 aa, Homo Sapiens
QDNNGNVIL

SEQ ID NO: 347986 - protein, 9 aa, Homo Sapiens
TNYSKPQPT

SEQ ID NO: 347987 - protein, 9 aa, Homo Sapiens
ATVNLTVIW

SEQ ID NO: 347988 - protein, 9 aa, Homo Sapiens
VLKLFPKLR

SEQ ID NO: 347989 - protein, 9 aa, Homo Sapiens
CVIATSTKI

SEQ ID NO: 347990 - protein, 9 aa, Homo Sapiens
QDTVEQLQC

SEQ ID NO: 347991 - protein, 9 aa, Homo Sapiens
LRCTKRGWM

SEQ ID NO: 347992 - protein, 9 aa, Homo Sapiens
CRKAGSIMW

SEQ ID NO: 347993 - protein, 9 aa, Homo Sapiens
VENAYISAL

SEQ ID NO: 347994 - protein, 9 aa, Homo Sapiens
VENEWKRMC

SEQ ID NO: 347995 - protein, 9 aa, Homo Sapiens
RRAHRQINA

SEQ ID NO: 347996 - protein, 9 aa, Homo Sapiens
HICRADIRG

SEQ ID NO: 347997 - protein, 9 aa, Homo Sapiens
MDVAPSESE

SEQ ID NO: 347998 - protein, 9 aa, Homo Sapiens
PSCRNSNSN

SEQ ID NO: 347999 - protein, 9 aa, Homo Sapiens
KGELYRQNR

SEQ ID NO: 348000 - protein, 9 aa, Homo Sapiens
SFGDKYRDC

SEQ ID NO: 348001 - protein, 9 aa, Homo Sapiens
DVKYNVLYF

SEQ ID NO: 348002 - protein, 9 aa, Homo Sapiens
VLKAVSSSS

SEQ ID NO: 348003 - protein, 9 aa, Homo Sapiens
VIHFQGGSH

SEQ ID NO: 348004 - protein, 9 aa, Homo Sapiens
SYTEGNASQ

SEQ ID NO: 348005 - protein, 9 aa, Homo Sapiens
SLKLYHTFS

SEQ ID NO: 348006 - protein, 9 aa, Homo Sapiens
MEFAHYIEE

SEQ ID NO: 348007 - protein, 9 aa, Homo Sapiens
AQSKNRSLI

SEQ ID NO: 348008 - protein, 9 aa, Homo Sapiens
HCHYERKGL

SEQ ID NO: 348009 - protein, 9 aa, Homo Sapiens
PTRLIVVFF

SEQ ID NO: 348010 - protein, 9 aa, Homo Sapiens
PKLKIILSI

SEQ ID NO: 348011 - protein, 9 aa, Homo Sapiens
MHANKSIVN

SEQ ID NO: 348012 - protein, 9 aa, Homo Sapiens
QLPQHTFCV

SEQ ID NO: 348013 - protein, 9 aa, Homo Sapiens
NTAERGNYL

SEQ ID NO: 348014 - protein, 9 aa, Homo Sapiens
PSHSERFCL

SEQ ID NO: 348015 - protein, 9 aa, Homo Sapiens
KLDDSQKDD

SEQ ID NO: 348016 - protein, 9 aa, Homo Sapiens
LGIKGYQTV

SEQ ID NO: 348017 - protein, 9 aa, Homo Sapiens
YFMKNSDNK

SEQ ID NO: 348018 - protein, 9 aa, Homo Sapiens
RLQMEAQCI

SEQ ID NO: 348019 - protein, 9 aa, Homo Sapiens
KVLDQPPTV

SEQ ID NO: 348020 - protein, 9 aa, Homo Sapiens
SPFQRVREE

SEQ ID NO: 348021 - protein, 9 aa, Homo Sapiens
DNPHLIIMN

SEQ ID NO: 348022 - protein, 9 aa, Homo Sapiens
QNHGHNVCS

SEQ ID NO: 348023 - protein, 9 aa, Homo Sapiens
NVTGPQIHD

SEQ ID NO: 348024 - protein, 9 aa, Homo Sapiens
KIGWVWNQM

SEQ ID NO: 348025 - protein, 9 aa, Homo Sapiens
GAPYPQTRW

SEQ ID NO: 348026 - protein, 9 aa, Homo Sapiens
HMKSAEGRT

SEQ ID NO: 348027 - protein, 9 aa, Homo Sapiens
QESKMNENI

SEQ ID NO: 348028 - protein, 9 aa, Homo Sapiens
WDSANADLI

SEQ ID NO: 348029 - protein, 9 aa, Homo Sapiens
ELNGENVYH

SEQ ID NO: 348030 - protein, 9 aa, Homo Sapiens
TSGPSSKLE

SEQ ID NO: 348031 - protein, 9 aa, Homo Sapiens
GQSQSCVTG

SEQ ID NO: 348032 - protein, 9 aa, Homo Sapiens
HISTSINFN

SEQ ID NO: 348033 - protein, 9 aa, Homo Sapiens
CRLIYHQQT

SEQ ID NO: 348034 - protein, 9 aa, Homo Sapiens
AEYVWLAIN

SEQ ID NO: 348035 - protein, 9 aa, Homo Sapiens
VFDLSRRMG

SEQ ID NO: 348036 - protein, 9 aa, Homo Sapiens
KSVISDGPA

SEQ ID NO: 348037 - protein, 9 aa, Homo Sapiens
LDFVKKKCL

SEQ ID NO: 348038 - protein, 9 aa, Homo Sapiens
VKVIDKTLM

SEQ ID NO: 348039 - protein, 9 aa, Homo Sapiens
VCMAAIKES

SEQ ID NO: 348040 - protein, 9 aa, Homo Sapiens
TTDLDEGVN

SEQ ID NO: 348041 - protein, 9 aa, Homo Sapiens
ELLLEPPIA

SEQ ID NO: 348042 - protein, 9 aa, Homo Sapiens
VMRLERVCK

SEQ ID NO: 348043 - protein, 9 aa, Homo Sapiens
DKDLDLFSE

SEQ ID NO: 348044 - protein, 9 aa, Homo Sapiens
EIVVQLLNF

SEQ ID NO: 348045 - protein, 9 aa, Homo Sapiens
GEEENQATK

SEQ ID NO: 348046 - protein, 9 aa, Homo Sapiens
MSCSENCLS

SEQ ID NO: 348047 - protein, 9 aa, Homo Sapiens
PHVVSQWSR

SEQ ID NO: 348048 - protein, 9 aa, Homo Sapiens
TMPLVTSMS

SEQ ID NO: 348049 - protein, 9 aa, Homo Sapiens
NLWKFCVEH

SEQ ID NO: 348050 - protein, 9 aa, Homo Sapiens
QCEECGNTF

SEQ ID NO: 348051 - protein, 9 aa, Homo Sapiens
FVRMKQLIL

SEQ ID NO: 348052 - protein, 9 aa, Homo Sapiens
AFRIYDFNN

SEQ ID NO: 348053 - protein, 9 aa, Homo Sapiens
VLNSECAHR

SEQ ID NO: 348054 - protein, 9 aa, Homo Sapiens
MGIDNCSVM

SEQ ID NO: 348055 - protein, 9 aa, Homo Sapiens
NRMPSRSLR

SEQ ID NO: 348056 - protein, 9 aa, Homo Sapiens
FEACYVWDY

SEQ ID NO: 348057 - protein, 9 aa, Homo Sapiens
LGGLDVRRQ

SEQ ID NO: 348058 - protein, 9 aa, Homo Sapiens
EVLSPIPEL

SEQ ID NO: 348059 - protein, 9 aa, Homo Sapiens
ASQSCILEP

SEQ ID NO: 348060 - protein, 9 aa, Homo Sapiens
EYYDIKLSE

SEQ ID NO: 348061 - protein, 9 aa, Homo Sapiens
AKNTSKLLF

SEQ ID NO: 348062 - protein, 9 aa, Homo Sapiens
SKGLFVPLQ

SEQ ID NO: 348063 - protein, 9 aa, Homo Sapiens
LPYTYSKIT

SEQ ID NO: 348064 - protein, 9 aa, Homo Sapiens
ESVYAALTS

SEQ ID NO: 348065 - protein, 9 aa, Homo Sapiens
GIKGYQTVV

SEQ ID NO: 348066 - protein, 9 aa, Homo Sapiens
MQFNLYITK

SEQ ID NO: 348067 - protein, 9 aa, Homo Sapiens
PVDMARMYV

SEQ ID NO: 348068 - protein, 9 aa, Homo Sapiens
IYTVGAKVT

SEQ ID NO: 348069 - protein, 9 aa, Homo Sapiens
ICVGPEEQE

SEQ ID NO: 348070 - protein, 9 aa, Homo Sapiens
PFPSPADIK

SEQ ID NO: 348071 - protein, 9 aa, Homo Sapiens
EKAIEVECI

SEQ ID NO: 348072 - protein, 9 aa, Homo Sapiens
IHQLEGTDL

SEQ ID NO: 348073 - protein, 9 aa, Homo Sapiens
RVNTQETLY

SEQ ID NO: 348074 - protein, 9 aa, Homo Sapiens
VVNIPSSFQ

SEQ ID NO: 348075 - protein, 9 aa, Homo Sapiens
TTSIVTHRA

SEQ ID NO: 348076 - protein, 9 aa, Homo Sapiens
KRTSAKKLL

SEQ ID NO: 348077 - protein, 9 aa, Homo Sapiens
KRLSDVTGN

SEQ ID NO: 348078 - protein, 9 aa, Homo Sapiens
YVVAFSDER

SEQ ID NO: 348079 - protein, 9 aa, Homo Sapiens
LSELRALSM

SEQ ID NO: 348080 - protein, 9 aa, Homo Sapiens
SKIMKSIGE

SEQ ID NO: 348081 - protein, 9 aa, Homo Sapiens
FDGQHYSFI

SEQ ID NO: 348082 - protein, 9 aa, Homo Sapiens
QVVPIQDHS

SEQ ID NO: 348083 - protein, 9 aa, Homo Sapiens
TDVYPKIIE

SEQ ID NO: 348084 - protein, 9 aa, Homo Sapiens
RLLDITTAA

SEQ ID NO: 348085 - protein, 9 aa, Homo Sapiens
LVKESGKRK

SEQ ID NO: 348086 - protein, 9 aa, Homo Sapiens
FMLDNLQKT

SEQ ID NO: 348087 - protein, 9 aa, Homo Sapiens
ERKQTPKHQ

SEQ ID NO: 348088 - protein, 9 aa, Homo Sapiens
FRQSDTPQK

SEQ ID NO: 348089 - protein, 9 aa, Homo Sapiens
DNLPGNVGE

SEQ ID NO: 348090 - protein, 9 aa, Homo Sapiens
GDSQPANRT

SEQ ID NO: 348091 - protein, 9 aa, Homo Sapiens
AYVEQYLLE

SEQ ID NO: 348092 - protein, 9 aa, Homo Sapiens
DSHFSLSPN

SEQ ID NO: 348093 - protein, 9 aa, Homo Sapiens
RAIVRDPKT

SEQ ID NO: 348094 - protein, 9 aa, Homo Sapiens
SQLFQLNYL

SEQ ID NO: 348095 - protein, 9 aa, Homo Sapiens
SLGKTNVKG

SEQ ID NO: 348096 - protein, 9 aa, Homo Sapiens
FASFQHKWF

SEQ ID NO: 348097 - protein, 9 aa, Homo Sapiens
YDTLDQLLQ

SEQ ID NO: 348098 - protein, 9 aa, Homo Sapiens
IGFINFIVE

SEQ ID NO: 348099 - protein, 9 aa, Homo Sapiens
RWDEASFQT

SEQ ID NO: 348100 - protein, 9 aa, Homo Sapiens
SEDCCKKVQ

SEQ ID NO: 348101 - protein, 9 aa, Homo Sapiens
CIKLWLQYT

SEQ ID NO: 348102 - protein, 9 aa, Homo Sapiens
LSLIKFKDN

SEQ ID NO: 348103 - protein, 9 aa, Homo Sapiens
SFAKHQIIH

SEQ ID NO: 348104 - protein, 9 aa, Homo Sapiens
ARQLEEELQ

SEQ ID NO: 348105 - protein, 9 aa, Homo Sapiens
NKTLVEELK

SEQ ID NO: 348106 - protein, 9 aa, Homo Sapiens
GGKGPCGET

SEQ ID NO: 348107 - protein, 9 aa, Homo Sapiens
LHYCHDNNI

SEQ ID NO: 348108 - protein, 9 aa, Homo Sapiens
GEGEEEVKE

SEQ ID NO: 348109 - protein, 9 aa, Homo Sapiens
VICVGCSTV

SEQ ID NO: 348110 - protein, 9 aa, Homo Sapiens
DGTQARLLP

SEQ ID NO: 348111 - protein, 9 aa, Homo Sapiens
TTLQGEDIA

SEQ ID NO: 348112 - protein, 9 aa, Homo Sapiens
LERLHLQSN

SEQ ID NO: 348113 - protein, 9 aa, Homo Sapiens
NHTHVISVA

SEQ ID NO: 348114 - protein, 9 aa, Homo Sapiens
LEEKGPMFK

SEQ ID NO: 348115 - protein, 9 aa, Homo Sapiens
WNKAGEWSE

SEQ ID NO: 348116 - protein, 9 aa, Homo Sapiens
YGCAGFGGL

SEQ ID NO: 348117 - protein, 9 aa, Homo Sapiens
ALQPGDWIM

SEQ ID NO: 348118 - protein, 9 aa, Homo Sapiens
DTVKEYPLL

SEQ ID NO: 348119 - protein, 9 aa, Homo Sapiens
RRSSFEKHR

SEQ ID NO: 348120 - protein, 9 aa, Homo Sapiens
SLRDSLWNR

SEQ ID NO: 348121 - protein, 9 aa, Homo Sapiens
TDVRRKEKD

SEQ ID NO: 348122 - protein, 9 aa, Homo Sapiens
VLPHELYWH

SEQ ID NO: 348123 - protein, 9 aa, Homo Sapiens
TFWCLYHKG

SEQ ID NO: 348124 - protein, 9 aa, Homo Sapiens
LRLQMEAQC

SEQ ID NO: 348125 - protein, 9 aa, Homo Sapiens
YNEVLQIND

SEQ ID NO: 348126 - protein, 9 aa, Homo Sapiens
AHHPFLFFI

SEQ ID NO: 348127 - protein, 9 aa, Homo Sapiens
EYQIEDKME

SEQ ID NO: 348128 - protein, 9 aa, Homo Sapiens
KDISEEDIQ

SEQ ID NO: 348129 - protein, 9 aa, Homo Sapiens
WIKANTELV

SEQ ID NO: 348130 - protein, 9 aa, Homo Sapiens
WGGGTPDAN

SEQ ID NO: 348131 - protein, 9 aa, Homo Sapiens
TDVQLMRTR

SEQ ID NO: 348132 - protein, 9 aa, Homo Sapiens
QVHQDTLHT

SEQ ID NO: 348133 - protein, 9 aa, Homo Sapiens
SQRKVRMNY

SEQ ID NO: 348134 - protein, 9 aa, Homo Sapiens
NSMSKQAII

SEQ ID NO: 348135 - protein, 9 aa, Homo Sapiens
NSVSKSVRL

SEQ ID NO: 348136 - protein, 9 aa, Homo Sapiens
PGQTQLLER

SEQ ID NO: 348137 - protein, 9 aa, Homo Sapiens
CYPQENVIR

SEQ ID NO: 348138 - protein, 9 aa, Homo Sapiens
LSICIDWFY

SEQ ID NO: 348139 - protein, 9 aa, Homo Sapiens
EQNPFDVFI

SEQ ID NO: 348140 - protein, 9 aa, Homo Sapiens
GQVKNEVLR

SEQ ID NO: 348141 - protein, 9 aa, Homo Sapiens
FKMPPPSPP

SEQ ID NO: 348142 - protein, 9 aa, Homo Sapiens
KVQEQHRQQ

SEQ ID NO: 348143 - protein, 9 aa, Homo Sapiens
LTYHVHNLI

SEQ ID NO: 348144 - protein, 9 aa, Homo Sapiens
KSCQQQNTE

SEQ ID NO: 348145 - protein, 9 aa, Homo Sapiens
TSQKITYEG

SEQ ID NO: 348146 - protein, 9 aa, Homo Sapiens
MCNLCIRYT

SEQ ID NO: 348147 - protein, 9 aa, Homo Sapiens
SGSPKENTS

SEQ ID NO: 348148 - protein, 9 aa, Homo Sapiens
LDNHPMNEE

SEQ ID NO: 348149 - protein, 9 aa, Homo Sapiens
GLHKIEAEI

SEQ ID NO: 348150 - protein, 9 aa, Homo Sapiens
YSKPQPTYE

SEQ ID NO: 348151 - protein, 9 aa, Homo Sapiens
YFPLSSEPF

SEQ ID NO: 348152 - protein, 9 aa, Homo Sapiens
KQYKHQLEE

SEQ ID NO: 348153 - protein, 9 aa, Homo Sapiens
LWKYTINNV

SEQ ID NO: 348154 - protein, 9 aa, Homo Sapiens
LQNPRSQLR

SEQ ID NO: 348155 - protein, 9 aa, Homo Sapiens
LKNPRVGPL

SEQ ID NO: 348156 - protein, 9 aa, Homo Sapiens
LLVVADHHF

SEQ ID NO: 348157 - protein, 9 aa, Homo Sapiens
NNIFEESYW

SEQ ID NO: 348158 - protein, 9 aa, Homo Sapiens
VPLEKEEAS

SEQ ID NO: 348159 - protein, 9 aa, Homo Sapiens
ACRLRATHG

SEQ ID NO: 348160 - protein, 9 aa, Homo Sapiens
MHIYQPRFH

SEQ ID NO: 348161 - protein, 9 aa, Homo Sapiens
RDLSSEQIH

SEQ ID NO: 348162 - protein, 9 aa, Homo Sapiens
KMEEIVRSS

SEQ ID NO: 348163 - protein, 9 aa, Homo Sapiens
MCPVRALPA

SEQ ID NO: 348164 - protein, 9 aa, Homo Sapiens
DESPKLTSS

SEQ ID NO: 348165 - protein, 9 aa, Homo Sapiens
VTLDEEAFA

SEQ ID NO: 348166 - protein, 9 aa, Homo Sapiens
HGARLLLGR

SEQ ID NO: 348167 - protein, 9 aa, Homo Sapiens
WVLGTLFLA

SEQ ID NO: 348168 - protein, 9 aa, Homo Sapiens
VSVCCEEKT

SEQ ID NO: 348169 - protein, 9 aa, Homo Sapiens
RIPKDNEAR

SEQ ID NO: 348170 - protein, 9 aa, Homo Sapiens
LFRTNTWKD

SEQ ID NO: 348171 - protein, 9 aa, Homo Sapiens
SNVGWAISF

SEQ ID NO: 348172 - protein, 9 aa, Homo Sapiens
YMNGMNRQI

SEQ ID NO: 348173 - protein, 9 aa, Homo Sapiens
SVTRVVFGE

SEQ ID NO: 348174 - protein, 9 aa, Homo Sapiens
SVLIPPQNP

SEQ ID NO: 348175 - protein, 9 aa, Homo Sapiens
AKLIMFRGE

SEQ ID NO: 348176 - protein, 9 aa, Homo Sapiens
DKRTSQSVN

SEQ ID NO: 348177 - protein, 9 aa, Homo Sapiens
LAAVPYRAE

SEQ ID NO: 348178 - protein, 9 aa, Homo Sapiens
NEPAQENMA

SEQ ID NO: 348179 - protein, 9 aa, Homo Sapiens
KRQALVEFG

SEQ ID NO: 348180 - protein, 9 aa, Homo Sapiens
ILIAKLIMF

SEQ ID NO: 348181 - protein, 9 aa, Homo Sapiens
NFKMAAEEE

SEQ ID NO: 348182 - protein, 9 aa, Homo Sapiens
NINDITEGI

SEQ ID NO: 348183 - protein, 9 aa, Homo Sapiens
IVDRINNDG

SEQ ID NO: 348184 - protein, 9 aa, Homo Sapiens
YKGKPLEKE

SEQ ID NO: 348185 - protein, 9 aa, Homo Sapiens
VEEKDFDLV

SEQ ID NO: 348186 - protein, 9 aa, Homo Sapiens
LERDEKIFL

SEQ ID NO: 348187 - protein, 9 aa, Homo Sapiens
HIILNSMHI

SEQ ID NO: 348188 - protein, 9 aa, Homo Sapiens
TGKRYCINL

SEQ ID NO: 348189 - protein, 9 aa, Homo Sapiens
LYITKQIRL

SEQ ID NO: 348190 - protein, 9 aa, Homo Sapiens
STALSEKCT

SEQ ID NO: 348191 - protein, 9 aa, Homo Sapiens
VEGNLSRSA

SEQ ID NO: 348192 - protein, 9 aa, Homo Sapiens
NHSYPGFRI

SEQ ID NO: 348193 - protein, 9 aa, Homo Sapiens
DTEIKNGQA

SEQ ID NO: 348194 - protein, 9 aa, Homo Sapiens
KPYECIECV

SEQ ID NO: 348195 - protein, 9 aa, Homo Sapiens
KEKRNTTTE

SEQ ID NO: 348196 - protein, 9 aa, Homo Sapiens
KLGHNKLKE

SEQ ID NO: 348197 - protein, 9 aa, Homo Sapiens
RGSKDINKN

SEQ ID NO: 348198 - protein, 9 aa, Homo Sapiens
IPVTCQIEE

SEQ ID NO: 348199 - protein, 9 aa, Homo Sapiens
VPNNLFFFF

SEQ ID NO: 348200 - protein, 9 aa, Homo Sapiens
IGLADYTLE

SEQ ID NO: 348201 - protein, 9 aa, Homo Sapiens
LISLEEEEG

SEQ ID NO: 348202 - protein, 9 aa, Homo Sapiens
LASEVEETE

SEQ ID NO: 348203 - protein, 9 aa, Homo Sapiens
YGSPDLSET

SEQ ID NO: 348204 - protein, 9 aa, Homo Sapiens
RTRKEIFKT

SEQ ID NO: 348205 - protein, 9 aa, Homo Sapiens
ALDLYIAIC

SEQ ID NO: 348206 - protein, 9 aa, Homo Sapiens
SSLMVHQIT

SEQ ID NO: 348207 - protein, 9 aa, Homo Sapiens
ALKPKKKNN

SEQ ID NO: 348208 - protein, 9 aa, Homo Sapiens
FSWLTCLLQ

SEQ ID NO: 348209 - protein, 9 aa, Homo Sapiens
EMVNDATEQ

SEQ ID NO: 348210 - protein, 9 aa, Homo Sapiens
TCFEMKNEK

SEQ ID NO: 348211 - protein, 9 aa, Homo Sapiens
ENIVYLTNL

SEQ ID NO: 348212 - protein, 9 aa, Homo Sapiens
RWVHLDIEI

SEQ ID NO: 348213 - protein, 9 aa, Homo Sapiens
AMSRLLRSL

SEQ ID NO: 348214 - protein, 9 aa, Homo Sapiens
HEYNFEIKN

SEQ ID NO: 348215 - protein, 9 aa, Homo Sapiens
IREKYIEID

SEQ ID NO: 348216 - protein, 9 aa, Homo Sapiens
RMGVFITLS

SEQ ID NO: 348217 - protein, 9 aa, Homo Sapiens
ASPLSLLQL

SEQ ID NO: 348218 - protein, 9 aa, Homo Sapiens
LFQNPVYHL

SEQ ID NO: 348219 - protein, 9 aa, Homo Sapiens
GLALMSQGS

SEQ ID NO: 348220 - protein, 9 aa, Homo Sapiens
ITAMQRGDA

SEQ ID NO: 348221 - protein, 9 aa, Homo Sapiens
IYEELLHMK

SEQ ID NO: 348222 - protein, 9 aa, Homo Sapiens
LDLQNNLIS

SEQ ID NO: 348223 - protein, 9 aa, Homo Sapiens
SDGTVRTWY

SEQ ID NO: 348224 - protein, 9 aa, Homo Sapiens
EGEEPGEDK

SEQ ID NO: 348225 - protein, 9 aa, Homo Sapiens
YDWRMLGTR

SEQ ID NO: 348226 - protein, 9 aa, Homo Sapiens
WDALRPPLQ

SEQ ID NO: 348227 - protein, 9 aa, Homo Sapiens
LPNFICQNT

SEQ ID NO: 348228 - protein, 9 aa, Homo Sapiens
TVVLLTELK

SEQ ID NO: 348229 - protein, 9 aa, Homo Sapiens
NGSLKALCE

SEQ ID NO: 348230 - protein, 9 aa, Homo Sapiens
RSVLRQKIL

SEQ ID NO: 348231 - protein, 9 aa, Homo Sapiens
QGVSLECQN

SEQ ID NO: 348232 - protein, 9 aa, Homo Sapiens
VIAYIYAQS

SEQ ID NO: 348233 - protein, 9 aa, Homo Sapiens
VQEQHRQQH

SEQ ID NO: 348234 - protein, 9 aa, Homo Sapiens
KTTLLLHPD

SEQ ID NO: 348235 - protein, 9 aa, Homo Sapiens
SFQTEVSYL

SEQ ID NO: 348236 - protein, 9 aa, Homo Sapiens
TKKIQVNSK

SEQ ID NO: 348237 - protein, 9 aa, Homo Sapiens
IFQAIDKKP

SEQ ID NO: 348238 - protein, 9 aa, Homo Sapiens
LQIPSCLYQ

SEQ ID NO: 348239 - protein, 9 aa, Homo Sapiens
SSALNRHKM

SEQ ID NO: 348240 - protein, 9 aa, Homo Sapiens
AGLDRKKVQ

SEQ ID NO: 348241 - protein, 9 aa, Homo Sapiens
NYYKNASEN

SEQ ID NO: 348242 - protein, 9 aa, Homo Sapiens
KYLEQQCNL

SEQ ID NO: 348243 - protein, 9 aa, Homo Sapiens
KVKDEKICQ

SEQ ID NO: 348244 - protein, 9 aa, Homo Sapiens
ARLLFNDPD

SEQ ID NO: 348245 - protein, 9 aa, Homo Sapiens
GDLVEYGAD

SEQ ID NO: 348246 - protein, 9 aa, Homo Sapiens
IDTHNLLLL

SEQ ID NO: 348247 - protein, 9 aa, Homo Sapiens
RGKNALKDA

SEQ ID NO: 348248 - protein, 9 aa, Homo Sapiens
EIRMVLFGA

SEQ ID NO: 348249 - protein, 9 aa, Homo Sapiens
GGNQAGGSG

SEQ ID NO: 348250 - protein, 9 aa, Homo Sapiens
GEKWMDRYK

SEQ ID NO: 348251 - protein, 9 aa, Homo Sapiens
NVADDNDDP

SEQ ID NO: 348252 - protein, 9 aa, Homo Sapiens
VPPTLREDK

SEQ ID NO: 348253 - protein, 9 aa, Homo Sapiens
CCLAGNQAD

SEQ ID NO: 348254 - protein, 9 aa, Homo Sapiens
MVTLGEEDL

SEQ ID NO: 348255 - protein, 9 aa, Homo Sapiens
EICHMFHVA

SEQ ID NO: 348256 - protein, 9 aa, Homo Sapiens
ILMLTNKCQ

SEQ ID NO: 348257 - protein, 9 aa, Homo Sapiens
NNLTVVPHN

SEQ ID NO: 348258 - protein, 9 aa, Homo Sapiens
FEPLTLSHN

SEQ ID NO: 348259 - protein, 9 aa, Homo Sapiens
KLFPGRTDN

SEQ ID NO: 348260 - protein, 9 aa, Homo Sapiens
ASISRLSGK

SEQ ID NO: 348261 - protein, 9 aa, Homo Sapiens
ASQFRSLQT

SEQ ID NO: 348262 - protein, 9 aa, Homo Sapiens
LKYLFDYSP

SEQ ID NO: 348263 - protein, 9 aa, Homo Sapiens
VRYEVNCLG

SEQ ID NO: 348264 - protein, 9 aa, Homo Sapiens
VTAASSVST

SEQ ID NO: 348265 - protein, 9 aa, Homo Sapiens
SDKNISIFD

SEQ ID NO: 348266 - protein, 9 aa, Homo Sapiens
RLVETEKEK

SEQ ID NO: 348267 - protein, 9 aa, Homo Sapiens
QQISDSKKK

SEQ ID NO: 348268 - protein, 9 aa, Homo Sapiens
QTQKELAYL

SEQ ID NO: 348269 - protein, 9 aa, Homo Sapiens
PEKKSKHML

SEQ ID NO: 348270 - protein, 9 aa, Homo Sapiens
QRALIGLWE

SEQ ID NO: 348271 - protein, 9 aa, Homo Sapiens
LETVLANFS

SEQ ID NO: 348272 - protein, 9 aa, Homo Sapiens
LIDPIQVVQ

SEQ ID NO: 348273 - protein, 9 aa, Homo Sapiens
IETGAAPIF

SEQ ID NO: 348274 - protein, 9 aa, Homo Sapiens
KLYQQLNDL

SEQ ID NO: 348275 - protein, 9 aa, Homo Sapiens
LDQVQEVLS

SEQ ID NO: 348276 - protein, 9 aa, Homo Sapiens
YSGQLHKVR

SEQ ID NO: 348277 - protein, 9 aa, Homo Sapiens
GIHQGFRSL

SEQ ID NO: 348278 - protein, 9 aa, Homo Sapiens
CNKIDVVKR

SEQ ID NO: 348279 - protein, 9 aa, Homo Sapiens
GAGHFWSQH

SEQ ID NO: 348280 - protein, 9 aa, Homo Sapiens
TDTQNVTFV

SEQ ID NO: 348281 - protein, 9 aa, Homo Sapiens
FKEHQQIHT

SEQ ID NO: 348282 - protein, 9 aa, Homo Sapiens
RNLVNDFYC

SEQ ID NO: 348283 - protein, 9 aa, Homo Sapiens
QEHISTSIN

SEQ ID NO: 348284 - protein, 9 aa, Homo Sapiens
PFSVCYDPY

SEQ ID NO: 348285 - protein, 9 aa, Homo Sapiens
GYVPIQTPA

SEQ ID NO: 348286 - protein, 9 aa, Homo Sapiens
YCTREEIQE

SEQ ID NO: 348287 - protein, 9 aa, Homo Sapiens
TPMYLFLTN

SEQ ID NO: 348288 - protein, 9 aa, Homo Sapiens
TDAYGVIHF

SEQ ID NO: 348289 - protein, 9 aa, Homo Sapiens
LHKGWSQIM

SEQ ID NO: 348290 - protein, 9 aa, Homo Sapiens
KEAHKSTPE

SEQ ID NO: 348291 - protein, 9 aa, Homo Sapiens
ISDAEQRGK

SEQ ID NO: 348292 - protein, 9 aa, Homo Sapiens
LKVASLQVP

SEQ ID NO: 348293 - protein, 9 aa, Homo Sapiens
NSNLVQHQI

SEQ ID NO: 348294 - protein, 9 aa, Homo Sapiens
LHSGGCPCK

SEQ ID NO: 348295 - protein, 9 aa, Homo Sapiens
TRKKLNKYE

SEQ ID NO: 348296 - protein, 9 aa, Homo Sapiens
NSKRPDPLK

SEQ ID NO: 348297 - protein, 9 aa, Homo Sapiens
KDGPISPKN

SEQ ID NO: 348298 - protein, 9 aa, Homo Sapiens
KREYEKRVL

SEQ ID NO: 348299 - protein, 9 aa, Homo Sapiens
GSGPGALLK

SEQ ID NO: 348300 - protein, 9 aa, Homo Sapiens
IRRTFWINE

SEQ ID NO: 348301 - protein, 9 aa, Homo Sapiens
AVMGRALSM

SEQ ID NO: 348302 - protein, 9 aa, Homo Sapiens
SNSVQACKE

SEQ ID NO: 348303 - protein, 9 aa, Homo Sapiens
VSPCKVTAD

SEQ ID NO: 348304 - protein, 9 aa, Homo Sapiens
QVGVICCPV

SEQ ID NO: 348305 - protein, 9 aa, Homo Sapiens
HKWFEVAFV

SEQ ID NO: 348306 - protein, 9 aa, Homo Sapiens
VVEEILEIC

SEQ ID NO: 348307 - protein, 9 aa, Homo Sapiens
SVALVNTSK

SEQ ID NO: 348308 - protein, 9 aa, Homo Sapiens
NLFCFGEST

SEQ ID NO: 348309 - protein, 9 aa, Homo Sapiens
SLWLEEFSM

SEQ ID NO: 348310 - protein, 9 aa, Homo Sapiens
SSEQIHLGD

SEQ ID NO: 348311 - protein, 9 aa, Homo Sapiens
LMDLLKKIW

SEQ ID NO: 348312 - protein, 9 aa, Homo Sapiens
VVALFKTWD

SEQ ID NO: 348313 - protein, 9 aa, Homo Sapiens
QKAAKGYTQ

SEQ ID NO: 348314 - protein, 9 aa, Homo Sapiens
NVLLPLIIF

SEQ ID NO: 348315 - protein, 9 aa, Homo Sapiens
ALALAYRQI

SEQ ID NO: 348316 - protein, 9 aa, Homo Sapiens
TPLLNPFMY

SEQ ID NO: 348317 - protein, 9 aa, Homo Sapiens
NAEKVTQKI

SEQ ID NO: 348318 - protein, 9 aa, Homo Sapiens
ESPLNHNSG

SEQ ID NO: 348319 - protein, 9 aa, Homo Sapiens
ADKWVKARN

SEQ ID NO: 348320 - protein, 9 aa, Homo Sapiens
LANLYIFSR

SEQ ID NO: 348321 - protein, 9 aa, Homo Sapiens
LTADKDEEG

SEQ ID NO: 348322 - protein, 9 aa, Homo Sapiens
LQNGKEYLF

SEQ ID NO: 348323 - protein, 9 aa, Homo Sapiens
KITYEGGNA

SEQ ID NO: 348324 - protein, 9 aa, Homo Sapiens
LGCKSTPKI

SEQ ID NO: 348325 - protein, 9 aa, Homo Sapiens
LNKILSNVK

SEQ ID NO: 348326 - protein, 9 aa, Homo Sapiens
RDPFSFHLF

SEQ ID NO: 348327 - protein, 9 aa, Homo Sapiens
NQGNIFKQY

SEQ ID NO: 348328 - protein, 9 aa, Homo Sapiens
ENCPDELYA

SEQ ID NO: 348329 - protein, 9 aa, Homo Sapiens
QKRCSALLS

SEQ ID NO: 348330 - protein, 9 aa, Homo Sapiens
QNGMIIPSM

SEQ ID NO: 348331 - protein, 9 aa, Homo Sapiens
SERFQENSL

SEQ ID NO: 348332 - protein, 9 aa, Homo Sapiens
HGLTPFHYL

SEQ ID NO: 348333 - protein, 9 aa, Homo Sapiens
KQQKVWMAN

SEQ ID NO: 348334 - protein, 9 aa, Homo Sapiens
NETLLDKFY

SEQ ID NO: 348335 - protein, 9 aa, Homo Sapiens
PLQAITVTA

SEQ ID NO: 348336 - protein, 9 aa, Homo Sapiens
ERLQAITEK

SEQ ID NO: 348337 - protein, 9 aa, Homo Sapiens
LMRLTKLKS

SEQ ID NO: 348338 - protein, 9 aa, Homo Sapiens
DSVPLKVTV

SEQ ID NO: 348339 - protein, 9 aa, Homo Sapiens
RFQKRDLHK

SEQ ID NO: 348340 - protein, 9 aa, Homo Sapiens
ALVLAPVPT

SEQ ID NO: 348341 - protein, 9 aa, Homo Sapiens
IALPLNSDV

SEQ ID NO: 348342 - protein, 9 aa, Homo Sapiens
RSSYFSSWD

SEQ ID NO: 348343 - protein, 9 aa, Homo Sapiens
RLFPIVMRL

SEQ ID NO: 348344 - protein, 9 aa, Homo Sapiens
MFKLSGPFR

SEQ ID NO: 348345 - protein, 9 aa, Homo Sapiens
DNATVCAGA

SEQ ID NO: 348346 - protein, 9 aa, Homo Sapiens
FCSNFCEFI

SEQ ID NO: 348347 - protein, 9 aa, Homo Sapiens
NKPQRKPVP

SEQ ID NO: 348348 - protein, 9 aa, Homo Sapiens
DVMDQLSYS

SEQ ID NO: 348349 - protein, 9 aa, Homo Sapiens
QEWQHTSNF

SEQ ID NO: 348350 - protein, 9 aa, Homo Sapiens
VIDKTLMRK

SEQ ID NO: 348351 - protein, 9 aa, Homo Sapiens
RSFHFKYVH

SEQ ID NO: 348352 - protein, 9 aa, Homo Sapiens
DTLSYTVRI

SEQ ID NO: 348353 - protein, 9 aa, Homo Sapiens
IGWWVRNMN

SEQ ID NO: 348354 - protein, 9 aa, Homo Sapiens
AQLKRFDEW

SEQ ID NO: 348355 - protein, 9 aa, Homo Sapiens
TWLVFVGIY

SEQ ID NO: 348356 - protein, 9 aa, Homo Sapiens
QLDGLEKYF

SEQ ID NO: 348357 - protein, 9 aa, Homo Sapiens
LAPNSSSLS

SEQ ID NO: 348358 - protein, 9 aa, Homo Sapiens
EAEELESTV

SEQ ID NO: 348359 - protein, 9 aa, Homo Sapiens
ALSPVEEFV

SEQ ID NO: 348360 - protein, 9 aa, Homo Sapiens
CMLTSPPGL

SEQ ID NO: 348361 - protein, 9 aa, Homo Sapiens
CLPGYTGEF

SEQ ID NO: 348362 - protein, 9 aa, Homo Sapiens
LREVTVNVL

SEQ ID NO: 348363 - protein, 9 aa, Homo Sapiens
SLISWLDEE

SEQ ID NO: 348364 - protein, 9 aa, Homo Sapiens
ILGRNHTHV

SEQ ID NO: 348365 - protein, 9 aa, Homo Sapiens
AVHCLSGKH

SEQ ID NO: 348366 - protein, 9 aa, Homo Sapiens
LHDNSLHQE

SEQ ID NO: 348367 - protein, 9 aa, Homo Sapiens
TGKTVGTAV

SEQ ID NO: 348368 - protein, 9 aa, Homo Sapiens
SDPRIKSRD

SEQ ID NO: 348369 - protein, 9 aa, Homo Sapiens
TIELKKMLK

SEQ ID NO: 348370 - protein, 9 aa, Homo Sapiens
VQFDPFNFL

SEQ ID NO: 348371 - protein, 9 aa, Homo Sapiens
SLMTNCMEH

SEQ ID NO: 348372 - protein, 9 aa, Homo Sapiens
ENNEDHTPN

SEQ ID NO: 348373 - protein, 9 aa, Homo Sapiens
EDRVKRLSV

SEQ ID NO: 348374 - protein, 9 aa, Homo Sapiens
KQQNKFGEE

SEQ ID NO: 348375 - protein, 9 aa, Homo Sapiens
AGKYLAKWM

SEQ ID NO: 348376 - protein, 9 aa, Homo Sapiens
ASLFHVCCI

SEQ ID NO: 348377 - protein, 9 aa, Homo Sapiens
SERSIIRIN

SEQ ID NO: 348378 - protein, 9 aa, Homo Sapiens
FRNAMLKNI

SEQ ID NO: 348379 - protein, 9 aa, Homo Sapiens
KRTSAQVQT

SEQ ID NO: 348380 - protein, 9 aa, Homo Sapiens
ADGEIGSQD

SEQ ID NO: 348381 - protein, 9 aa, Homo Sapiens
IPELNLVEH

SEQ ID NO: 348382 - protein, 9 aa, Homo Sapiens
EDYGSPDLS

SEQ ID NO: 348383 - protein, 9 aa, Homo Sapiens
VGINFKVKT

SEQ ID NO: 348384 - protein, 9 aa, Homo Sapiens
QCIATADYY

SEQ ID NO: 348385 - protein, 9 aa, Homo Sapiens
GPTKMTTEE

SEQ ID NO: 348386 - protein, 9 aa, Homo Sapiens
GVPTIQSDI

SEQ ID NO: 348387 - protein, 9 aa, Homo Sapiens
RRIHKETSL

SEQ ID NO: 348388 - protein, 9 aa, Homo Sapiens
QIEKIWLWL

SEQ ID NO: 348389 - protein, 9 aa, Homo Sapiens
FHHRIFFPR

SEQ ID NO: 348390 - protein, 9 aa, Homo Sapiens
EPGVFVGVS

SEQ ID NO: 348391 - protein, 9 aa, Homo Sapiens
ALTRVSQII

SEQ ID NO: 348392 - protein, 9 aa, Homo Sapiens
AKSDNSCTN

SEQ ID NO: 348393 - protein, 9 aa, Homo Sapiens
KGKKAIQRE

SEQ ID NO: 348394 - protein, 9 aa, Homo Sapiens
MVQEERCLR

SEQ ID NO: 348395 - protein, 9 aa, Homo Sapiens
ELGYSEEQV

SEQ ID NO: 348396 - protein, 9 aa, Homo Sapiens
ICYNVLDQN

SEQ ID NO: 348397 - protein, 9 aa, Homo Sapiens
NLLHLVHAQ

SEQ ID NO: 348398 - protein, 9 aa, Homo Sapiens
IFCFAASTF

SEQ ID NO: 348399 - protein, 9 aa, Homo Sapiens
PPHLQWKRP

SEQ ID NO: 348400 - protein, 9 aa, Homo Sapiens
DLEVITLWF

SEQ ID NO: 348401 - protein, 9 aa, Homo Sapiens
YPSSVVFVQ

SEQ ID NO: 348402 - protein, 9 aa, Homo Sapiens
HSGSASPMD

SEQ ID NO: 348403 - protein, 9 aa, Homo Sapiens
LTKHKLIHT

SEQ ID NO: 348404 - protein, 9 aa, Homo Sapiens
NLASPLIGR

SEQ ID NO: 348405 - protein, 9 aa, Homo Sapiens
DALTEQLQK

SEQ ID NO: 348406 - protein, 9 aa, Homo Sapiens
VRDYFMSCP

SEQ ID NO: 348407 - protein, 9 aa, Homo Sapiens
EHTERHAQP

SEQ ID NO: 348408 - protein, 9 aa, Homo Sapiens
EWQSWGSME

SEQ ID NO: 348409 - protein, 9 aa, Homo Sapiens
LEAQGDTWV

SEQ ID NO: 348410 - protein, 9 aa, Homo Sapiens
YHNYGHLEL

SEQ ID NO: 348411 - protein, 9 aa, Homo Sapiens
TNQKENIPL

SEQ ID NO: 348412 - protein, 9 aa, Homo Sapiens
SGLWGIEDM

SEQ ID NO: 348413 - protein, 9 aa, Homo Sapiens
MQIDGNVMR

SEQ ID NO: 348414 - protein, 9 aa, Homo Sapiens
SYDIIVEGI

SEQ ID NO: 348415 - protein, 9 aa, Homo Sapiens
RLAGFTAWI

SEQ ID NO: 348416 - protein, 9 aa, Homo Sapiens
ETMSLGCCV

SEQ ID NO: 348417 - protein, 9 aa, Homo Sapiens
HYNLGISCI

SEQ ID NO: 348418 - protein, 9 aa, Homo Sapiens
FRVKMYPIE

SEQ ID NO: 348419 - protein, 9 aa, Homo Sapiens
CPEVILASW

SEQ ID NO: 348420 - protein, 9 aa, Homo Sapiens
PTKKTNSKR

SEQ ID NO: 348421 - protein, 9 aa, Homo Sapiens
VPVNCALYI

SEQ ID NO: 348422 - protein, 9 aa, Homo Sapiens
EVIQEKLLL

SEQ ID NO: 348423 - protein, 9 aa, Homo Sapiens
LVHSGTRIQ

SEQ ID NO: 348424 - protein, 9 aa, Homo Sapiens
TADYTTKKY

SEQ ID NO: 348425 - protein, 9 aa, Homo Sapiens
LAHHLSEPE

SEQ ID NO: 348426 - protein, 9 aa, Homo Sapiens
RYLHNRSRI

SEQ ID NO: 348427 - protein, 9 aa, Homo Sapiens
DSNFLGGVV

SEQ ID NO: 348428 - protein, 9 aa, Homo Sapiens
SLFILLCNV

SEQ ID NO: 348429 - protein, 9 aa, Homo Sapiens
RFGFSEGNT

SEQ ID NO: 348430 - protein, 9 aa, Homo Sapiens
NDAEDLPFT

SEQ ID NO: 348431 - protein, 9 aa, Homo Sapiens
FELLKNAMR

SEQ ID NO: 348432 - protein, 9 aa, Homo Sapiens
MTQINQVAH

SEQ ID NO: 348433 - protein, 9 aa, Homo Sapiens
VGSVKLLKL

SEQ ID NO: 348434 - protein, 9 aa, Homo Sapiens
DEGIKYLVE

SEQ ID NO: 348435 - protein, 9 aa, Homo Sapiens
LLHIRKFTQ

SEQ ID NO: 348436 - protein, 9 aa, Homo Sapiens
PYFTKHNVT

SEQ ID NO: 348437 - protein, 9 aa, Homo Sapiens
LLSDPGPGK

SEQ ID NO: 348438 - protein, 9 aa, Homo Sapiens
PQHTFCVIW

SEQ ID NO: 348439 - protein, 9 aa, Homo Sapiens
PIPEDNFLA

SEQ ID NO: 348440 - protein, 9 aa, Homo Sapiens
TQEAGKFMI

SEQ ID NO: 348441 - protein, 9 aa, Homo Sapiens
INQKCELCH

SEQ ID NO: 348442 - protein, 9 aa, Homo Sapiens
TCIASGWHP

SEQ ID NO: 348443 - protein, 9 aa, Homo Sapiens
VTTTVSEVS

SEQ ID NO: 348444 - protein, 9 aa, Homo Sapiens
KGKCGIDGV

SEQ ID NO: 348445 - protein, 9 aa, Homo Sapiens
TGESLRSHF

SEQ ID NO: 348446 - protein, 9 aa, Homo Sapiens
EKTAAATKT

SEQ ID NO: 348447 - protein, 9 aa, Homo Sapiens
PGKERKQTP

SEQ ID NO: 348448 - protein, 9 aa, Homo Sapiens
YKNMIQEQD

SEQ ID NO: 348449 - protein, 9 aa, Homo Sapiens
QQGIVHRDL

SEQ ID NO: 348450 - protein, 9 aa, Homo Sapiens
GFPNLGNTW

SEQ ID NO: 348451 - protein, 9 aa, Homo Sapiens
VTVMAGNNE

SEQ ID NO: 348452 - protein, 9 aa, Homo Sapiens
HFWSQHTTE

SEQ ID NO: 348453 - protein, 9 aa, Homo Sapiens
NSLDHSETR

SEQ ID NO: 348454 - protein, 9 aa, Homo Sapiens
PFKMPSSVS

SEQ ID NO: 348455 - protein, 9 aa, Homo Sapiens
GVAGYDISM

SEQ ID NO: 348456 - protein, 9 aa, Homo Sapiens
LQDHQLSFK

SEQ ID NO: 348457 - protein, 9 aa, Homo Sapiens
CVSVLQAET

SEQ ID NO: 348458 - protein, 9 aa, Homo Sapiens
PRVSEDVYH

SEQ ID NO: 348459 - protein, 9 aa, Homo Sapiens
LRFVIIHKH

SEQ ID NO: 348460 - protein, 9 aa, Homo Sapiens
SSLISPLQR

SEQ ID NO: 348461 - protein, 9 aa, Homo Sapiens
PDRITTIKH

SEQ ID NO: 348462 - protein, 9 aa, Homo Sapiens
LKEIAKRKE

SEQ ID NO: 348463 - protein, 9 aa, Homo Sapiens
HIAGKIIPA

SEQ ID NO: 348464 - protein, 9 aa, Homo Sapiens
IAAFDELLL

SEQ ID NO: 348465 - protein, 9 aa, Homo Sapiens
ESLRPVHLT

SEQ ID NO: 348466 - protein, 9 aa, Homo Sapiens
AKLDGTQHR

SEQ ID NO: 348467 - protein, 9 aa, Homo Sapiens
NEVQTLFGL

SEQ ID NO: 348468 - protein, 9 aa, Homo Sapiens
LISSEEEES

SEQ ID NO: 348469 - protein, 9 aa, Homo Sapiens
TESELSLPE

SEQ ID NO: 348470 - protein, 9 aa, Homo Sapiens
KPYYGEGGI

SEQ ID NO: 348471 - protein, 9 aa, Homo Sapiens
LKCISCGSS

SEQ ID NO: 348472 - protein, 9 aa, Homo Sapiens
TAIKLAELQ

SEQ ID NO: 348473 - protein, 9 aa, Homo Sapiens
FENSVGDIL

SEQ ID NO: 348474 - protein, 9 aa, Homo Sapiens
KRRIQLYQK

SEQ ID NO: 348475 - protein, 9 aa, Homo Sapiens
KESQNIKIN

SEQ ID NO: 348476 - protein, 9 aa, Homo Sapiens
KINEMVAKH

SEQ ID NO: 348477 - protein, 9 aa, Homo Sapiens
IKDYFEKVT

SEQ ID NO: 348478 - protein, 9 aa, Homo Sapiens
PQEAINCLH

SEQ ID NO: 348479 - protein, 9 aa, Homo Sapiens
KENKITGII

SEQ ID NO: 348480 - protein, 9 aa, Homo Sapiens
QHFLDTALR

SEQ ID NO: 348481 - protein, 9 aa, Homo Sapiens
CLQLGVNKA

SEQ ID NO: 348482 - protein, 9 aa, Homo Sapiens
LHSGSASPM

SEQ ID NO: 348483 - protein, 9 aa, Homo Sapiens
LETFQLDSN

SEQ ID NO: 348484 - protein, 9 aa, Homo Sapiens
DVTVGDLTV

SEQ ID NO: 348485 - protein, 9 aa, Homo Sapiens
QAFKGLVSL

SEQ ID NO: 348486 - protein, 9 aa, Homo Sapiens
GMRDLHKSS

SEQ ID NO: 348487 - protein, 9 aa, Homo Sapiens
DLSFMYRWL

SEQ ID NO: 348488 - protein, 9 aa, Homo Sapiens
EVLLSASLS

SEQ ID NO: 348489 - protein, 9 aa, Homo Sapiens
RKFNLMYDG

SEQ ID NO: 348490 - protein, 9 aa, Homo Sapiens
GGKCLVNVG

SEQ ID NO: 348491 - protein, 9 aa, Homo Sapiens
SFKYLLDQL

SEQ ID NO: 348492 - protein, 9 aa, Homo Sapiens
RTHEKIHTG

SEQ ID NO: 348493 - protein, 9 aa, Homo Sapiens
CLLYKIKWG

SEQ ID NO: 348494 - protein, 9 aa, Homo Sapiens
FVKETYMLY

SEQ ID NO: 348495 - protein, 9 aa, Homo Sapiens
RIHTPRASN

SEQ ID NO: 348496 - protein, 9 aa, Homo Sapiens
RSRLHLPEM

SEQ ID NO: 348497 - protein, 9 aa, Homo Sapiens
VDSVLVLQA

SEQ ID NO: 348498 - protein, 9 aa, Homo Sapiens
QSLNVRAAP

SEQ ID NO: 348499 - protein, 9 aa, Homo Sapiens
TTIFIDEIY

SEQ ID NO: 348500 - protein, 9 aa, Homo Sapiens
VQFLVQLDD

SEQ ID NO: 348501 - protein, 9 aa, Homo Sapiens
LQSYSAGEA

SEQ ID NO: 348502 - protein, 9 aa, Homo Sapiens
VLILVLKRL

SEQ ID NO: 348503 - protein, 9 aa, Homo Sapiens
GRGKREGQG

SEQ ID NO: 348504 - protein, 9 aa, Homo Sapiens
AEVDRKRVL

SEQ ID NO: 348505 - protein, 9 aa, Homo Sapiens
NHPHQFCSP

SEQ ID NO: 348506 - protein, 9 aa, Homo Sapiens
ANLTQASNI

SEQ ID NO: 348507 - protein, 9 aa, Homo Sapiens
RIKGKRHRK

SEQ ID NO: 348508 - protein, 9 aa, Homo Sapiens
FDSEKIMWT

SEQ ID NO: 348509 - protein, 9 aa, Homo Sapiens
ELKKMLKST

SEQ ID NO: 348510 - protein, 9 aa, Homo Sapiens
SIIFIPCIY

SEQ ID NO: 348511 - protein, 9 aa, Homo Sapiens
TTDQAGFSE

SEQ ID NO: 348512 - protein, 9 aa, Homo Sapiens
PSANEVFYT

SEQ ID NO: 348513 - protein, 9 aa, Homo Sapiens
ISDDPSIFI

SEQ ID NO: 348514 - protein, 9 aa, Homo Sapiens
CKVAVCEAT

SEQ ID NO: 348515 - protein, 9 aa, Homo Sapiens
WCDYYGCNQ

SEQ ID NO: 348516 - protein, 9 aa, Homo Sapiens
IHHQIIHTG

SEQ ID NO: 348517 - protein, 9 aa, Homo Sapiens
LGLNVALSS

SEQ ID NO: 348518 - protein, 9 aa, Homo Sapiens
LHQIIHKGG

SEQ ID NO: 348519 - protein, 9 aa, Homo Sapiens
KDWKVHKGT

SEQ ID NO: 348520 - protein, 9 aa, Homo Sapiens
VGIYSTIWP

SEQ ID NO: 348521 - protein, 9 aa, Homo Sapiens
SWRLYKHTN

SEQ ID NO: 348522 - protein, 9 aa, Homo Sapiens
GDPPGRCIS

SEQ ID NO: 348523 - protein, 9 aa, Homo Sapiens
KHTIEALMD

SEQ ID NO: 348524 - protein, 9 aa, Homo Sapiens
LCLANNPIG

SEQ ID NO: 348525 - protein, 9 aa, Homo Sapiens
RKEKNKVKE

SEQ ID NO: 348526 - protein, 9 aa, Homo Sapiens
TDDEDDNDL

SEQ ID NO: 348527 - protein, 9 aa, Homo Sapiens
NKKVRKGKK

SEQ ID NO: 348528 - protein, 9 aa, Homo Sapiens
VDVKCLNFR

SEQ ID NO: 348529 - protein, 9 aa, Homo Sapiens
ATQHFTNRL

SEQ ID NO: 348530 - protein, 9 aa, Homo Sapiens
SAASVALVN

SEQ ID NO: 348531 - protein, 9 aa, Homo Sapiens
FLMFNCSVP

SEQ ID NO: 348532 - protein, 9 aa, Homo Sapiens
GLQPLLFQN

SEQ ID NO: 348533 - protein, 9 aa, Homo Sapiens
SAYQAFHGL

SEQ ID NO: 348534 - protein, 9 aa, Homo Sapiens
LLLLQTAEL

SEQ ID NO: 348535 - protein, 9 aa, Homo Sapiens
RSERSIIRI

SEQ ID NO: 348536 - protein, 9 aa, Homo Sapiens
ENNKEGGND

SEQ ID NO: 348537 - protein, 9 aa, Homo Sapiens
NISTDQRDK

SEQ ID NO: 348538 - protein, 9 aa, Homo Sapiens
KERSTILCQ

SEQ ID NO: 348539 - protein, 9 aa, Homo Sapiens
TSPALRGHT

SEQ ID NO: 348540 - protein, 9 aa, Homo Sapiens
KTTLEMSSS

SEQ ID NO: 348541 - protein, 9 aa, Homo Sapiens
HDVPKHKKF

SEQ ID NO: 348542 - protein, 9 aa, Homo Sapiens
ADLIQRITE

SEQ ID NO: 348543 - protein, 9 aa, Homo Sapiens
SVLLLTCLS

SEQ ID NO: 348544 - protein, 9 aa, Homo Sapiens
CVCTCAHVG

SEQ ID NO: 348545 - protein, 9 aa, Homo Sapiens
TKDLKHNKL

SEQ ID NO: 348546 - protein, 9 aa, Homo Sapiens
KTPVNTNQH

SEQ ID NO: 348547 - protein, 9 aa, Homo Sapiens
LKMICHTTN

SEQ ID NO: 348548 - protein, 9 aa, Homo Sapiens
KKDSASNIP

SEQ ID NO: 348549 - protein, 9 aa, Homo Sapiens
LLTETMEVL

SEQ ID NO: 348550 - protein, 9 aa, Homo Sapiens
YLILRNHNE

SEQ ID NO: 348551 - protein, 9 aa, Homo Sapiens
KECVERLTA

SEQ ID NO: 348552 - protein, 9 aa, Homo Sapiens
RLLLGRVGD

SEQ ID NO: 348553 - protein, 9 aa, Homo Sapiens
YKIITLKTK

SEQ ID NO: 348554 - protein, 9 aa, Homo Sapiens
MQEYITVVK

SEQ ID NO: 348555 - protein, 9 aa, Homo Sapiens
GLCTVLDQP

SEQ ID NO: 348556 - protein, 9 aa, Homo Sapiens
EGSKTWDCF

SEQ ID NO: 348557 - protein, 9 aa, Homo Sapiens
LDDSQKDDM

SEQ ID NO: 348558 - protein, 9 aa, Homo Sapiens
GGKQRSYTK

SEQ ID NO: 348559 - protein, 9 aa, Homo Sapiens
MHNLKIRPY

SEQ ID NO: 348560 - protein, 9 aa, Homo Sapiens
LWVEFITVS

SEQ ID NO: 348561 - protein, 9 aa, Homo Sapiens
MTTEELNAL

SEQ ID NO: 348562 - protein, 9 aa, Homo Sapiens
RLAGQRVEQ

SEQ ID NO: 348563 - protein, 9 aa, Homo Sapiens
QNHVVSQKI

SEQ ID NO: 348564 - protein, 9 aa, Homo Sapiens
VCGRCCAKF

SEQ ID NO: 348565 - protein, 9 aa, Homo Sapiens
SGRCANGLC

SEQ ID NO: 348566 - protein, 9 aa, Homo Sapiens
IRHIRNSSA

SEQ ID NO: 348567 - protein, 9 aa, Homo Sapiens
FLSEHQITH

SEQ ID NO: 348568 - protein, 9 aa, Homo Sapiens
PGASMDDNY

SEQ ID NO: 348569 - protein, 9 aa, Homo Sapiens
PQYAMAARV

SEQ ID NO: 348570 - protein, 9 aa, Homo Sapiens
GAYTVHPSS

SEQ ID NO: 348571 - protein, 9 aa, Homo Sapiens
IGISEDQRL

SEQ ID NO: 348572 - protein, 9 aa, Homo Sapiens
FMFVHPEWR

SEQ ID NO: 348573 - protein, 9 aa, Homo Sapiens
GGRTNITSL

SEQ ID NO: 348574 - protein, 9 aa, Homo Sapiens
SVAICTILV

SEQ ID NO: 348575 - protein, 9 aa, Homo Sapiens
LEVTLKNKT

SEQ ID NO: 348576 - protein, 9 aa, Homo Sapiens
YLCPSGLKD

SEQ ID NO: 348577 - protein, 9 aa, Homo Sapiens
ELEEQQKLG

SEQ ID NO: 348578 - protein, 9 aa, Homo Sapiens
SNSTGEART

SEQ ID NO: 348579 - protein, 9 aa, Homo Sapiens
ARQFAVLDP

SEQ ID NO: 348580 - protein, 9 aa, Homo Sapiens
AEDTGKLAV

SEQ ID NO: 348581 - protein, 9 aa, Homo Sapiens
KVQTKEGCY

SEQ ID NO: 348582 - protein, 9 aa, Homo Sapiens
KHAVIALHH

SEQ ID NO: 348583 - protein, 9 aa, Homo Sapiens
YSPLGMPDP

SEQ ID NO: 348584 - protein, 9 aa, Homo Sapiens
ILQDKENLL

SEQ ID NO: 348585 - protein, 9 aa, Homo Sapiens
KIFEYNSLE

SEQ ID NO: 348586 - protein, 9 aa, Homo Sapiens
HPWHWHFSQ

SEQ ID NO: 348587 - protein, 9 aa, Homo Sapiens
ITMQEKSRW

SEQ ID NO: 348588 - protein, 9 aa, Homo Sapiens
TRSGTLFER

SEQ ID NO: 348589 - protein, 9 aa, Homo Sapiens
PVNNALDLK

SEQ ID NO: 348590 - protein, 9 aa, Homo Sapiens
CWFQIFNMK

SEQ ID NO: 348591 - protein, 9 aa, Homo Sapiens
NISAYDGEY

SEQ ID NO: 348592 - protein, 9 aa, Homo Sapiens
FTSGKWYWK

SEQ ID NO: 348593 - protein, 9 aa, Homo Sapiens
HQLIEYGNK

SEQ ID NO: 348594 - protein, 9 aa, Homo Sapiens
IKETMTPGY

SEQ ID NO: 348595 - protein, 9 aa, Homo Sapiens
EGAGRFHST

SEQ ID NO: 348596 - protein, 9 aa, Homo Sapiens
MEMDQHIEF

SEQ ID NO: 348597 - protein, 9 aa, Homo Sapiens
LKLENYPEA

SEQ ID NO: 348598 - protein, 9 aa, Homo Sapiens
RDLLIQISL

SEQ ID NO: 348599 - protein, 9 aa, Homo Sapiens
HVYPNFRPT

SEQ ID NO: 348600 - protein, 9 aa, Homo Sapiens
IQITLNQLG

SEQ ID NO: 348601 - protein, 9 aa, Homo Sapiens
RNAKLQYPA

SEQ ID NO: 348602 - protein, 9 aa, Homo Sapiens
TFEITFCSK

SEQ ID NO: 348603 - protein, 9 aa, Homo Sapiens
NNSQLFENG

SEQ ID NO: 348604 - protein, 9 aa, Homo Sapiens
NEHIQKAGG

SEQ ID NO: 348605 - protein, 9 aa, Homo Sapiens
EHILWFLRA

SEQ ID NO: 348606 - protein, 9 aa, Homo Sapiens
LEMALIPEA

SEQ ID NO: 348607 - protein, 9 aa, Homo Sapiens
VFTFFSSFV

SEQ ID NO: 348608 - protein, 9 aa, Homo Sapiens
NRPSFNGIL

SEQ ID NO: 348609 - protein, 9 aa, Homo Sapiens
KKDLPICGS

SEQ ID NO: 348610 - protein, 9 aa, Homo Sapiens
NTVTTCVPW

SEQ ID NO: 348611 - protein, 9 aa, Homo Sapiens
GWLVHEEQK

SEQ ID NO: 348612 - protein, 9 aa, Homo Sapiens
LLAVNWLLE

SEQ ID NO: 348613 - protein, 9 aa, Homo Sapiens
NRRIQNEKG

SEQ ID NO: 348614 - protein, 9 aa, Homo Sapiens
KKTKNNLKK

SEQ ID NO: 348615 - protein, 9 aa, Homo Sapiens
IQKNRWDNN

SEQ ID NO: 348616 - protein, 9 aa, Homo Sapiens
KVHATVENA

SEQ ID NO: 348617 - protein, 9 aa, Homo Sapiens
EAPLEPGVF

SEQ ID NO: 348618 - protein, 9 aa, Homo Sapiens
FKSNHPQGF

SEQ ID NO: 348619 - protein, 9 aa, Homo Sapiens
TVNVLSRKL

SEQ ID NO: 348620 - protein, 9 aa, Homo Sapiens
CIATADYYG

SEQ ID NO: 348621 - protein, 9 aa, Homo Sapiens
EDTNYREIT

SEQ ID NO: 348622 - protein, 9 aa, Homo Sapiens
ASFIDKVWF

SEQ ID NO: 348623 - protein, 9 aa, Homo Sapiens
FQIHINKYK

SEQ ID NO: 348624 - protein, 9 aa, Homo Sapiens
DANQESNIS

SEQ ID NO: 348625 - protein, 9 aa, Homo Sapiens
GTCLKSLGL

SEQ ID NO: 348626 - protein, 9 aa, Homo Sapiens
TYSKITMEP

SEQ ID NO: 348627 - protein, 9 aa, Homo Sapiens
KPMMKEFRC

SEQ ID NO: 348628 - protein, 9 aa, Homo Sapiens
YHNIWVYDE

SEQ ID NO: 348629 - protein, 9 aa, Homo Sapiens
WTAYGFVKL

SEQ ID NO: 348630 - protein, 9 aa, Homo Sapiens
SFQQLSSLT

SEQ ID NO: 348631 - protein, 9 aa, Homo Sapiens
CSVLPHTSS

SEQ ID NO: 348632 - protein, 9 aa, Homo Sapiens
PFDCINCGK

SEQ ID NO: 348633 - protein, 9 aa, Homo Sapiens
MDMVAWGVG

SEQ ID NO: 348634 - protein, 9 aa, Homo Sapiens
HDNSLHQEE

SEQ ID NO: 348635 - protein, 9 aa, Homo Sapiens
DKAEFFSFE

SEQ ID NO: 348636 - protein, 9 aa, Homo Sapiens
YHIDLVKTR

SEQ ID NO: 348637 - protein, 9 aa, Homo Sapiens
NEEVFKVNK

SEQ ID NO: 348638 - protein, 9 aa, Homo Sapiens
QSCVTGPRN

SEQ ID NO: 348639 - protein, 9 aa, Homo Sapiens
TAPQLLINL

SEQ ID NO: 348640 - protein, 9 aa, Homo Sapiens
EREGLSEEV

SEQ ID NO: 348641 - protein, 9 aa, Homo Sapiens
SYKFILNDG

SEQ ID NO: 348642 - protein, 9 aa, Homo Sapiens
KKVQQYTLI

SEQ ID NO: 348643 - protein, 9 aa, Homo Sapiens
CCPVGTYQP

SEQ ID NO: 348644 - protein, 9 aa, Homo Sapiens
AGFAFSIFK

SEQ ID NO: 348645 - protein, 9 aa, Homo Sapiens
ELCVFPDRC

SEQ ID NO: 348646 - protein, 9 aa, Homo Sapiens
SEDQRLQRT

SEQ ID NO: 348647 - protein, 9 aa, Homo Sapiens
KNEHGFQKG

SEQ ID NO: 348648 - protein, 9 aa, Homo Sapiens
YSIQYVLEV

SEQ ID NO: 348649 - protein, 9 aa, Homo Sapiens
LKQFYFPLS

SEQ ID NO: 348650 - protein, 9 aa, Homo Sapiens
RKYEFKKDL

SEQ ID NO: 348651 - protein, 9 aa, Homo Sapiens
CHTTNLTLW

SEQ ID NO: 348652 - protein, 9 aa, Homo Sapiens
LLHLVHAQA

SEQ ID NO: 348653 - protein, 9 aa, Homo Sapiens
CLVSVGTIV

SEQ ID NO: 348654 - protein, 9 aa, Homo Sapiens
DPVSEYKIQ

SEQ ID NO: 348655 - protein, 9 aa, Homo Sapiens
TFILRVVLR

SEQ ID NO: 348656 - protein, 9 aa, Homo Sapiens
LNDIATFLD

SEQ ID NO: 348657 - protein, 9 aa, Homo Sapiens
SLSENEASD

SEQ ID NO: 348658 - protein, 9 aa, Homo Sapiens
SVKEVPCLE

SEQ ID NO: 348659 - protein, 9 aa, Homo Sapiens
QNKCIEMKK

SEQ ID NO: 348660 - protein, 9 aa, Homo Sapiens
AYKIKYPDN

SEQ ID NO: 348661 - protein, 9 aa, Homo Sapiens
QILAPGETI

SEQ ID NO: 348662 - protein, 9 aa, Homo Sapiens
LKWSCLPLA

SEQ ID NO: 348663 - protein, 9 aa, Homo Sapiens
VNSDRPERS

SEQ ID NO: 348664 - protein, 9 aa, Homo Sapiens
VFSLFVHNV

SEQ ID NO: 348665 - protein, 9 aa, Homo Sapiens
DVSSLLLQI

SEQ ID NO: 348666 - protein, 9 aa, Homo Sapiens
LVSATGHSD

SEQ ID NO: 348667 - protein, 9 aa, Homo Sapiens
WLQYLEKLN

SEQ ID NO: 348668 - protein, 9 aa, Homo Sapiens
TCRGDKFQC

SEQ ID NO: 348669 - protein, 9 aa, Homo Sapiens
QNGKEYLFQ

SEQ ID NO: 348670 - protein, 9 aa, Homo Sapiens
NKITGIITT

SEQ ID NO: 348671 - protein, 9 aa, Homo Sapiens
TNMRTKLSF

SEQ ID NO: 348672 - protein, 9 aa, Homo Sapiens
MAGKTDQKE

SEQ ID NO: 348673 - protein, 9 aa, Homo Sapiens
PDYLEFSPG

SEQ ID NO: 348674 - protein, 9 aa, Homo Sapiens
QCQPEIRMW

SEQ ID NO: 348675 - protein, 9 aa, Homo Sapiens
RDKIARNGD

SEQ ID NO: 348676 - protein, 9 aa, Homo Sapiens
DVAGGLAMG

SEQ ID NO: 348677 - protein, 9 aa, Homo Sapiens
SSNVMPFNI

SEQ ID NO: 348678 - protein, 9 aa, Homo Sapiens
CQLFITCSK

SEQ ID NO: 348679 - protein, 9 aa, Homo Sapiens
SSPEELDKL

SEQ ID NO: 348680 - protein, 9 aa, Homo Sapiens
WPRVGYWPL

SEQ ID NO: 348681 - protein, 9 aa, Homo Sapiens
AYDSLCTLG

SEQ ID NO: 348682 - protein, 9 aa, Homo Sapiens
SRSTYFQVH

SEQ ID NO: 348683 - protein, 9 aa, Homo Sapiens
AFQQIGERL

SEQ ID NO: 348684 - protein, 9 aa, Homo Sapiens
YQFSRCFHH

SEQ ID NO: 348685 - protein, 9 aa, Homo Sapiens
NTGEKLYKC

SEQ ID NO: 348686 - protein, 9 aa, Homo Sapiens
MSLVQLIVQ

SEQ ID NO: 348687 - protein, 9 aa, Homo Sapiens
NRNFVYCNE

SEQ ID NO: 348688 - protein, 9 aa, Homo Sapiens
AFSYLYYLM

SEQ ID NO: 348689 - protein, 9 aa, Homo Sapiens
ISDANYVLN

SEQ ID NO: 348690 - protein, 9 aa, Homo Sapiens
FWSTKSETN

SEQ ID NO: 348691 - protein, 9 aa, Homo Sapiens
QYAMAARVE

SEQ ID NO: 348692 - protein, 9 aa, Homo Sapiens
QHRLILHAA

SEQ ID NO: 348693 - protein, 9 aa, Homo Sapiens
SNMFDLIDV

SEQ ID NO: 348694 - protein, 9 aa, Homo Sapiens
WHKLMMSVA

SEQ ID NO: 348695 - protein, 9 aa, Homo Sapiens
HPEEHFIEK

SEQ ID NO: 348696 - protein, 9 aa, Homo Sapiens
LFQHQVIHT

SEQ ID NO: 348697 - protein, 9 aa, Homo Sapiens
LKAHHDIVQ

SEQ ID NO: 348698 - protein, 9 aa, Homo Sapiens
EASENKCIH

SEQ ID NO: 348699 - protein, 9 aa, Homo Sapiens
SFTSSTASW

SEQ ID NO: 348700 - protein, 9 aa, Homo Sapiens
IALLCKCIK

SEQ ID NO: 348701 - protein, 9 aa, Homo Sapiens
QTNINEGAS

SEQ ID NO: 348702 - protein, 9 aa, Homo Sapiens
KCIELIYAA

SEQ ID NO: 348703 - protein, 9 aa, Homo Sapiens
YDKIHQSKN

SEQ ID NO: 348704 - protein, 9 aa, Homo Sapiens
KELQKEKKR

SEQ ID NO: 348705 - protein, 9 aa, Homo Sapiens
HRGSSSPQK

SEQ ID NO: 348706 - protein, 9 aa, Homo Sapiens
RFITAERIK

SEQ ID NO: 348707 - protein, 9 aa, Homo Sapiens
YQNATGESC

SEQ ID NO: 348708 - protein, 9 aa, Homo Sapiens
VSPRNSQSG

SEQ ID NO: 348709 - protein, 9 aa, Homo Sapiens
STNTQENKH

SEQ ID NO: 348710 - protein, 9 aa, Homo Sapiens
EVECIKAES

SEQ ID NO: 348711 - protein, 9 aa, Homo Sapiens
CGIDGVDGV

SEQ ID NO: 348712 - protein, 9 aa, Homo Sapiens
LLCKTSKKV

SEQ ID NO: 348713 - protein, 9 aa, Homo Sapiens
AFKWYGSCV

SEQ ID NO: 348714 - protein, 9 aa, Homo Sapiens
LINISEFRV

SEQ ID NO: 348715 - protein, 9 aa, Homo Sapiens
LNISYNVLE

SEQ ID NO: 348716 - protein, 9 aa, Homo Sapiens
RYKYAAGVH

SEQ ID NO: 348717 - protein, 9 aa, Homo Sapiens
LSVSPVEFF

SEQ ID NO: 348718 - protein, 9 aa, Homo Sapiens
QKTFQGHDA

SEQ ID NO: 348719 - protein, 9 aa, Homo Sapiens
YEPGAVKLS

SEQ ID NO: 348720 - protein, 9 aa, Homo Sapiens
SSNYSASAS

SEQ ID NO: 348721 - protein, 9 aa, Homo Sapiens
SQPRKHLCV

SEQ ID NO: 348722 - protein, 9 aa, Homo Sapiens
AELESHIQE

SEQ ID NO: 348723 - protein, 9 aa, Homo Sapiens
CTLGVVRLH

SEQ ID NO: 348724 - protein, 9 aa, Homo Sapiens
ALSMTLKHL

SEQ ID NO: 348725 - protein, 9 aa, Homo Sapiens
LQTTNTTRF

SEQ ID NO: 348726 - protein, 9 aa, Homo Sapiens
EKEKKESIF

SEQ ID NO: 348727 - protein, 9 aa, Homo Sapiens
LKTISLVIC

SEQ ID NO: 348728 - protein, 9 aa, Homo Sapiens
MHDEDPLQP

SEQ ID NO: 348729 - protein, 9 aa, Homo Sapiens
KGYKQWKEY

SEQ ID NO: 348730 - protein, 9 aa, Homo Sapiens
KDGAYTVHP

SEQ ID NO: 348731 - protein, 9 aa, Homo Sapiens
FINFIVEPT

SEQ ID NO: 348732 - protein, 9 aa, Homo Sapiens
EQQCNLTTS

SEQ ID NO: 348733 - protein, 9 aa, Homo Sapiens
HKDAGVICS

SEQ ID NO: 348734 - protein, 9 aa, Homo Sapiens
SGVVKLCNF

SEQ ID NO: 348735 - protein, 9 aa, Homo Sapiens
ISRVEELAL

SEQ ID NO: 348736 - protein, 9 aa, Homo Sapiens
FSIVGVNLF

SEQ ID NO: 348737 - protein, 9 aa, Homo Sapiens
SLDMLKQLS

SEQ ID NO: 348738 - protein, 9 aa, Homo Sapiens
EKGVSKGYV

SEQ ID NO: 348739 - protein, 9 aa, Homo Sapiens
LYQKHNKQW

SEQ ID NO: 348740 - protein, 9 aa, Homo Sapiens
YMCPVRALP

SEQ ID NO: 348741 - protein, 9 aa, Homo Sapiens
DVKEQMYKL

SEQ ID NO: 348742 - protein, 9 aa, Homo Sapiens
QSPLLDSRE

SEQ ID NO: 348743 - protein, 9 aa, Homo Sapiens
RDLRSSNIL

SEQ ID NO: 348744 - protein, 9 aa, Homo Sapiens
GHFHRVVRH

SEQ ID NO: 348745 - protein, 9 aa, Homo Sapiens
LPWHIQIGI

SEQ ID NO: 348746 - protein, 9 aa, Homo Sapiens
EVLLTKIHL

SEQ ID NO: 348747 - protein, 9 aa, Homo Sapiens
MFGWNFVFE

SEQ ID NO: 348748 - protein, 9 aa, Homo Sapiens
SSLFVFPVY

SEQ ID NO: 348749 - protein, 9 aa, Homo Sapiens
TGIATSIVL

SEQ ID NO: 348750 - protein, 9 aa, Homo Sapiens
VEIPPTDIM

SEQ ID NO: 348751 - protein, 9 aa, Homo Sapiens
ECVKTFCWS

SEQ ID NO: 348752 - protein, 9 aa, Homo Sapiens
GGINTLKEV

SEQ ID NO: 348753 - protein, 9 aa, Homo Sapiens
EHSELLCKS

SEQ ID NO: 348754 - protein, 9 aa, Homo Sapiens
EAYDSLCTL

SEQ ID NO: 348755 - protein, 9 aa, Homo Sapiens
AKAMSSPRI

SEQ ID NO: 348756 - protein, 9 aa, Homo Sapiens
FVCGIFFSI

SEQ ID NO: 348757 - protein, 9 aa, Homo Sapiens
GAKNIQSIY

SEQ ID NO: 348758 - protein, 9 aa, Homo Sapiens
EEDYQNRYR

SEQ ID NO: 348759 - protein, 9 aa, Homo Sapiens
FYQCSYLTR

SEQ ID NO: 348760 - protein, 9 aa, Homo Sapiens
IIYPHNKDG

SEQ ID NO: 348761 - protein, 9 aa, Homo Sapiens
LSSIKHSLK

SEQ ID NO: 348762 - protein, 9 aa, Homo Sapiens
TDVDNLRMI

SEQ ID NO: 348763 - protein, 9 aa, Homo Sapiens
GHKHIKHSH

SEQ ID NO: 348764 - protein, 9 aa, Homo Sapiens
VLYQRVSRE

SEQ ID NO: 348765 - protein, 9 aa, Homo Sapiens
DDFFEQTIL

SEQ ID NO: 348766 - protein, 9 aa, Homo Sapiens
NWDFRNKTD

SEQ ID NO: 348767 - protein, 9 aa, Homo Sapiens
KVVSVSELL

SEQ ID NO: 348768 - protein, 9 aa, Homo Sapiens
SAKKLLQEY

SEQ ID NO: 348769 - protein, 9 aa, Homo Sapiens
NNINDITEG

SEQ ID NO: 348770 - protein, 9 aa, Homo Sapiens
IILRKLELE

SEQ ID NO: 348771 - protein, 9 aa, Homo Sapiens
KDHVSELEA

SEQ ID NO: 348772 - protein, 9 aa, Homo Sapiens
DLPPGTNIL

SEQ ID NO: 348773 - protein, 9 aa, Homo Sapiens
HKTVVLLTE

SEQ ID NO: 348774 - protein, 9 aa, Homo Sapiens
ASVTRVVFG

SEQ ID NO: 348775 - protein, 9 aa, Homo Sapiens
EKKKRDSWK

SEQ ID NO: 348776 - protein, 9 aa, Homo Sapiens
DIHRAFQLL

SEQ ID NO: 348777 - protein, 9 aa, Homo Sapiens
RISSATGCW

SEQ ID NO: 348778 - protein, 9 aa, Homo Sapiens
QTLCLGGAH

SEQ ID NO: 348779 - protein, 9 aa, Homo Sapiens
KFIKADYYE

SEQ ID NO: 348780 - protein, 9 aa, Homo Sapiens
AICFVCGIF

SEQ ID NO: 348781 - protein, 9 aa, Homo Sapiens
KQRKQAFEE

SEQ ID NO: 348782 - protein, 9 aa, Homo Sapiens
RPSVQENSQ

SEQ ID NO: 348783 - protein, 9 aa, Homo Sapiens
EELERDEKI

SEQ ID NO: 348784 - protein, 9 aa, Homo Sapiens
ENIQNLEAP

SEQ ID NO: 348785 - protein, 9 aa, Homo Sapiens
IDGLLMLLY

SEQ ID NO: 348786 - protein, 9 aa, Homo Sapiens
TLMAQAVGR

SEQ ID NO: 348787 - protein, 9 aa, Homo Sapiens
TMAKQKQTS

SEQ ID NO: 348788 - protein, 9 aa, Homo Sapiens
ASLQDPPLY

SEQ ID NO: 348789 - protein, 9 aa, Homo Sapiens
HGAPRPGIK

SEQ ID NO: 348790 - protein, 9 aa, Homo Sapiens
KLYICMKCG

SEQ ID NO: 348791 - protein, 9 aa, Homo Sapiens
EADAPSPAS

SEQ ID NO: 348792 - protein, 9 aa, Homo Sapiens
GCYCFRQTN

SEQ ID NO: 348793 - protein, 9 aa, Homo Sapiens
LISIHDNKF

SEQ ID NO: 348794 - protein, 9 aa, Homo Sapiens
NRLWGLQQE

SEQ ID NO: 348795 - protein, 9 aa, Homo Sapiens
QGLDHLIQI

SEQ ID NO: 348796 - protein, 9 aa, Homo Sapiens
HLSQHKIIY

SEQ ID NO: 348797 - protein, 9 aa, Homo Sapiens
GKINLPPGI

SEQ ID NO: 348798 - protein, 9 aa, Homo Sapiens
DASQMHVYY

SEQ ID NO: 348799 - protein, 9 aa, Homo Sapiens
SHQPPVSTL

SEQ ID NO: 348800 - protein, 9 aa, Homo Sapiens
PNIRKFIIL

SEQ ID NO: 348801 - protein, 9 aa, Homo Sapiens
RIILALWNP

SEQ ID NO: 348802 - protein, 9 aa, Homo Sapiens
GGKLSQTCV

SEQ ID NO: 348803 - protein, 9 aa, Homo Sapiens
IYMFKNNNP

SEQ ID NO: 348804 - protein, 9 aa, Homo Sapiens
LFWGLRSYH

SEQ ID NO: 348805 - protein, 9 aa, Homo Sapiens
KAFNLIEHY

SEQ ID NO: 348806 - protein, 9 aa, Homo Sapiens
SDVEAKETT

SEQ ID NO: 348807 - protein, 9 aa, Homo Sapiens
GTERFLELA

SEQ ID NO: 348808 - protein, 9 aa, Homo Sapiens
TSSHRTLKA

SEQ ID NO: 348809 - protein, 9 aa, Homo Sapiens
NKCIEMKKL

SEQ ID NO: 348810 - protein, 9 aa, Homo Sapiens
RQILQESID

SEQ ID NO: 348811 - protein, 9 aa, Homo Sapiens
VHLCVCTCA

SEQ ID NO: 348812 - protein, 9 aa, Homo Sapiens
KISGSIINE

SEQ ID NO: 348813 - protein, 9 aa, Homo Sapiens
KNRWDNNDT

SEQ ID NO: 348814 - protein, 9 aa, Homo Sapiens
MVLRSKACH

SEQ ID NO: 348815 - protein, 9 aa, Homo Sapiens
HVHNLIGAQ

SEQ ID NO: 348816 - protein, 9 aa, Homo Sapiens
SSASQGAGF

SEQ ID NO: 348817 - protein, 9 aa, Homo Sapiens
NAILDLTHN

SEQ ID NO: 348818 - protein, 9 aa, Homo Sapiens
PEKRRITIE

SEQ ID NO: 348819 - protein, 9 aa, Homo Sapiens
EATEKFIYD

SEQ ID NO: 348820 - protein, 9 aa, Homo Sapiens
NLKTRNLDP

SEQ ID NO: 348821 - protein, 9 aa, Homo Sapiens
IEWDDMAHL

SEQ ID NO: 348822 - protein, 9 aa, Homo Sapiens
LQIHEIIHT

SEQ ID NO: 348823 - protein, 9 aa, Homo Sapiens
TFWINERTG

SEQ ID NO: 348824 - protein, 9 aa, Homo Sapiens
VDLSLKDKK

SEQ ID NO: 348825 - protein, 9 aa, Homo Sapiens
CLKDISLFI

SEQ ID NO: 348826 - protein, 9 aa, Homo Sapiens
FTPRKGDKI

SEQ ID NO: 348827 - protein, 9 aa, Homo Sapiens
KKSKSPSWY

SEQ ID NO: 348828 - protein, 9 aa, Homo Sapiens
SVFIIHMIS

SEQ ID NO: 348829 - protein, 9 aa, Homo Sapiens
ENPNYLQDQ

SEQ ID NO: 348830 - protein, 9 aa, Homo Sapiens
QQRRPWEPP

SEQ ID NO: 348831 - protein, 9 aa, Homo Sapiens
FSVPVEIDG

SEQ ID NO: 348832 - protein, 9 aa, Homo Sapiens
SDVSTRWQK

SEQ ID NO: 348833 - protein, 9 aa, Homo Sapiens
LGQSLAETM

SEQ ID NO: 348834 - protein, 9 aa, Homo Sapiens
RSRYLKCIS

SEQ ID NO: 348835 - protein, 9 aa, Homo Sapiens
KRTNGKGIS

SEQ ID NO: 348836 - protein, 9 aa, Homo Sapiens
SRKRQILIS

SEQ ID NO: 348837 - protein, 9 aa, Homo Sapiens
REVDKIDEI

SEQ ID NO: 348838 - protein, 9 aa, Homo Sapiens
IHYILYLTD

SEQ ID NO: 348839 - protein, 9 aa, Homo Sapiens
PIDLVFVIN

SEQ ID NO: 348840 - protein, 9 aa, Homo Sapiens
KKLHNLTNL

SEQ ID NO: 348841 - protein, 9 aa, Homo Sapiens
DHKTSPLDN

SEQ ID NO: 348842 - protein, 9 aa, Homo Sapiens
ILEKESDKE

SEQ ID NO: 348843 - protein, 9 aa, Homo Sapiens
SLVRCVDGS

SEQ ID NO: 348844 - protein, 9 aa, Homo Sapiens
AVDVCFLNR

SEQ ID NO: 348845 - protein, 9 aa, Homo Sapiens
EKSSKAKEV

SEQ ID NO: 348846 - protein, 9 aa, Homo Sapiens
TLHKPDRLD

SEQ ID NO: 348847 - protein, 9 aa, Homo Sapiens
ILAAIVGSV

SEQ ID NO: 348848 - protein, 9 aa, Homo Sapiens
NIHRQIRAS

SEQ ID NO: 348849 - protein, 9 aa, Homo Sapiens
TDTFHFRIQ

SEQ ID NO: 348850 - protein, 9 aa, Homo Sapiens
SLQNNLDAT

SEQ ID NO: 348851 - protein, 9 aa, Homo Sapiens
KPDNGKECG

SEQ ID NO: 348852 - protein, 9 aa, Homo Sapiens
AIDKKPSID

SEQ ID NO: 348853 - protein, 9 aa, Homo Sapiens
LINNKQVTL

SEQ ID NO: 348854 - protein, 9 aa, Homo Sapiens
QQGEQGDNG

SEQ ID NO: 348855 - protein, 9 aa, Homo Sapiens
KHQGNEIGG

SEQ ID NO: 348856 - protein, 9 aa, Homo Sapiens
RDILLRHCD

SEQ ID NO: 348857 - protein, 9 aa, Homo Sapiens
LKVLTNKTL

SEQ ID NO: 348858 - protein, 9 aa, Homo Sapiens
TDLYGNCTM

SEQ ID NO: 348859 - protein, 9 aa, Homo Sapiens
PCHPTLQFG

SEQ ID NO: 348860 - protein, 9 aa, Homo Sapiens
HGIQIEFIN

SEQ ID NO: 348861 - protein, 9 aa, Homo Sapiens
FETLIKYTI

SEQ ID NO: 348862 - protein, 9 aa, Homo Sapiens
NIISKDQLC

SEQ ID NO: 348863 - protein, 9 aa, Homo Sapiens
CLKCLKNMN

SEQ ID NO: 348864 - protein, 9 aa, Homo Sapiens
PALADNFYA

SEQ ID NO: 348865 - protein, 9 aa, Homo Sapiens
ELVIFIFSG

SEQ ID NO: 348866 - protein, 9 aa, Homo Sapiens
FILLCNVIL

SEQ ID NO: 348867 - protein, 9 aa, Homo Sapiens
PILHQQTSD

SEQ ID NO: 348868 - protein, 9 aa, Homo Sapiens
PSNHVPNNL

SEQ ID NO: 348869 - protein, 9 aa, Homo Sapiens
QQHQDKVLY

SEQ ID NO: 348870 - protein, 9 aa, Homo Sapiens
YCINLAALS

SEQ ID NO: 348871 - protein, 9 aa, Homo Sapiens
EDSYNMELE

SEQ ID NO: 348872 - protein, 9 aa, Homo Sapiens
VCTVCIKFS

SEQ ID NO: 348873 - protein, 9 aa, Homo Sapiens
PVLLSKFPT

SEQ ID NO: 348874 - protein, 9 aa, Homo Sapiens
LKKHVISKE

SEQ ID NO: 348875 - protein, 9 aa, Homo Sapiens
LHNHLLTYL

SEQ ID NO: 348876 - protein, 9 aa, Homo Sapiens
SVDECKVYT

SEQ ID NO: 348877 - protein, 9 aa, Homo Sapiens
KIDEKRLAP

SEQ ID NO: 348878 - protein, 9 aa, Homo Sapiens
SRRTLHKPD

SEQ ID NO: 348879 - protein, 9 aa, Homo Sapiens
KSAEGRTKA

SEQ ID NO: 348880 - protein, 9 aa, Homo Sapiens
AGLVDTECC

SEQ ID NO: 348881 - protein, 9 aa, Homo Sapiens
VLLIGIHGC

SEQ ID NO: 348882 - protein, 9 aa, Homo Sapiens
HCVFNASDF

SEQ ID NO: 348883 - protein, 9 aa, Homo Sapiens
NTATVKEKK

SEQ ID NO: 348884 - protein, 9 aa, Homo Sapiens
HPNSFWLGH

SEQ ID NO: 348885 - protein, 9 aa, Homo Sapiens
YHFTTDSWE

SEQ ID NO: 348886 - protein, 9 aa, Homo Sapiens
VGYNGPNLV

SEQ ID NO: 348887 - protein, 9 aa, Homo Sapiens
PFTLVCGSA

SEQ ID NO: 348888 - protein, 9 aa, Homo Sapiens
IGLLSANSK

SEQ ID NO: 348889 - protein, 9 aa, Homo Sapiens
EDHDESICL

SEQ ID NO: 348890 - protein, 9 aa, Homo Sapiens
QLFQLNYLS

SEQ ID NO: 348891 - protein, 9 aa, Homo Sapiens
RSNSLWLEE

SEQ ID NO: 348892 - protein, 9 aa, Homo Sapiens
VTEVEANRI

SEQ ID NO: 348893 - protein, 9 aa, Homo Sapiens
SIWEITVES

SEQ ID NO: 348894 - protein, 9 aa, Homo Sapiens
TALIASGVS

SEQ ID NO: 348895 - protein, 9 aa, Homo Sapiens
LLADDIIIK

SEQ ID NO: 348896 - protein, 9 aa, Homo Sapiens
NLVMSDKSI

SEQ ID NO: 348897 - protein, 9 aa, Homo Sapiens
EADILEVLR

SEQ ID NO: 348898 - protein, 9 aa, Homo Sapiens
RRMWNDTVQ

SEQ ID NO: 348899 - protein, 9 aa, Homo Sapiens
GAWGPRESQ

SEQ ID NO: 348900 - protein, 9 aa, Homo Sapiens
NLRRLENNH

SEQ ID NO: 348901 - protein, 9 aa, Homo Sapiens
WPVAILMLA

SEQ ID NO: 348902 - protein, 9 aa, Homo Sapiens
NQIDLMDMA

SEQ ID NO: 348903 - protein, 9 aa, Homo Sapiens
DIIKHIVAE

SEQ ID NO: 348904 - protein, 9 aa, Homo Sapiens
EPILKFLLD

SEQ ID NO: 348905 - protein, 9 aa, Homo Sapiens
LATLLLCGT

SEQ ID NO: 348906 - protein, 9 aa, Homo Sapiens
NTRTNVQFS

SEQ ID NO: 348907 - protein, 9 aa, Homo Sapiens
NLVVLDAAG

SEQ ID NO: 348908 - protein, 9 aa, Homo Sapiens
GHFDKKICF

SEQ ID NO: 348909 - protein, 9 aa, Homo Sapiens
VIHYILYLT

SEQ ID NO: 348910 - protein, 9 aa, Homo Sapiens
KYLSSNDQL

SEQ ID NO: 348911 - protein, 9 aa, Homo Sapiens
SSPDILCSS

SEQ ID NO: 348912 - protein, 9 aa, Homo Sapiens
WFLEQQNQV

SEQ ID NO: 348913 - protein, 9 aa, Homo Sapiens
AEMSHAPQS

SEQ ID NO: 348914 - protein, 9 aa, Homo Sapiens
NVRVQNCAI

SEQ ID NO: 348915 - protein, 9 aa, Homo Sapiens
LFLGLALMS

SEQ ID NO: 348916 - protein, 9 aa, Homo Sapiens
GLRGFPFHT

SEQ ID NO: 348917 - protein, 9 aa, Homo Sapiens
ANHFADGRC

SEQ ID NO: 348918 - protein, 9 aa, Homo Sapiens
SNHVPNNLF

SEQ ID NO: 348919 - protein, 9 aa, Homo Sapiens
GAELVTEEK

SEQ ID NO: 348920 - protein, 9 aa, Homo Sapiens
PSSNFLSNS

SEQ ID NO: 348921 - protein, 9 aa, Homo Sapiens
LHSRETLLQ

SEQ ID NO: 348922 - protein, 9 aa, Homo Sapiens
AVLSKSKCN

SEQ ID NO: 348923 - protein, 9 aa, Homo Sapiens
LVYQIAMVH

SEQ ID NO: 348924 - protein, 9 aa, Homo Sapiens
DVECQACDC

SEQ ID NO: 348925 - protein, 9 aa, Homo Sapiens
ILWFLQQSA

SEQ ID NO: 348926 - protein, 9 aa, Homo Sapiens
WLLGCHMRR

SEQ ID NO: 348927 - protein, 9 aa, Homo Sapiens
HKASLKRCC

SEQ ID NO: 348928 - protein, 9 aa, Homo Sapiens
TRYSPGWDV

SEQ ID NO: 348929 - protein, 9 aa, Homo Sapiens
FCSKNITIL

SEQ ID NO: 348930 - protein, 9 aa, Homo Sapiens
ERVYFDDIH

SEQ ID NO: 348931 - protein, 9 aa, Homo Sapiens
IFYMFAGIN

SEQ ID NO: 348932 - protein, 9 aa, Homo Sapiens
EAFPISHIC

SEQ ID NO: 348933 - protein, 9 aa, Homo Sapiens
EANMTKWEQ

SEQ ID NO: 348934 - protein, 9 aa, Homo Sapiens
KEALSNKAL

SEQ ID NO: 348935 - protein, 9 aa, Homo Sapiens
LWKFCVEHH

SEQ ID NO: 348936 - protein, 9 aa, Homo Sapiens
FCDVSSDVF

SEQ ID NO: 348937 - protein, 9 aa, Homo Sapiens
KDKEPVPWK

SEQ ID NO: 348938 - protein, 9 aa, Homo Sapiens
VFDCIYFNG

SEQ ID NO: 348939 - protein, 9 aa, Homo Sapiens
ISQKEFVRF

SEQ ID NO: 348940 - protein, 9 aa, Homo Sapiens
ETKCVKPLG

SEQ ID NO: 348941 - protein, 9 aa, Homo Sapiens
SNLESSQNS

SEQ ID NO: 348942 - protein, 9 aa, Homo Sapiens
EAGEAGLEE

SEQ ID NO: 348943 - protein, 9 aa, Homo Sapiens
HVTVARPHL

SEQ ID NO: 348944 - protein, 9 aa, Homo Sapiens
HISHLAQHR

SEQ ID NO: 348945 - protein, 9 aa, Homo Sapiens
NPDELRFNA

SEQ ID NO: 348946 - protein, 9 aa, Homo Sapiens
NKLCHEQFY

SEQ ID NO: 348947 - protein, 9 aa, Homo Sapiens
FRGQVYSKL

SEQ ID NO: 348948 - protein, 9 aa, Homo Sapiens
TGLIEKNIK

SEQ ID NO: 348949 - protein, 9 aa, Homo Sapiens
ECINTTNGS

SEQ ID NO: 348950 - protein, 9 aa, Homo Sapiens
LNSYNGHRD

SEQ ID NO: 348951 - protein, 9 aa, Homo Sapiens
CAIFEKPRL

SEQ ID NO: 348952 - protein, 9 aa, Homo Sapiens
VADHHFYRY

SEQ ID NO: 348953 - protein, 9 aa, Homo Sapiens
VDVYLPKVE

SEQ ID NO: 348954 - protein, 9 aa, Homo Sapiens
CSYLTRHKL

SEQ ID NO: 348955 - protein, 9 aa, Homo Sapiens
KLKYHPEMR

SEQ ID NO: 348956 - protein, 9 aa, Homo Sapiens
ACTAGCDKA

SEQ ID NO: 348957 - protein, 9 aa, Homo Sapiens
GVACPALQN

SEQ ID NO: 348958 - protein, 9 aa, Homo Sapiens
EIEDLKVNQ

SEQ ID NO: 348959 - protein, 9 aa, Homo Sapiens
QDDQAKGPL

SEQ ID NO: 348960 - protein, 9 aa, Homo Sapiens
RMMIAKQRL

SEQ ID NO: 348961 - protein, 9 aa, Homo Sapiens
QNRGFFKGL

SEQ ID NO: 348962 - protein, 9 aa, Homo Sapiens
YGRVECGKA

SEQ ID NO: 348963 - protein, 9 aa, Homo Sapiens
VIGSPEILW

SEQ ID NO: 348964 - protein, 9 aa, Homo Sapiens
SEEQYNKIA

SEQ ID NO: 348965 - protein, 9 aa, Homo Sapiens
NSIFVTKII

SEQ ID NO: 348966 - protein, 9 aa, Homo Sapiens
NTPNLAANN

SEQ ID NO: 348967 - protein, 9 aa, Homo Sapiens
FCLKGMEES

SEQ ID NO: 348968 - protein, 9 aa, Homo Sapiens
ELDYLPQPY

SEQ ID NO: 348969 - protein, 9 aa, Homo Sapiens
QITHIGEKP

SEQ ID NO: 348970 - protein, 9 aa, Homo Sapiens
MGTSGDHDN

SEQ ID NO: 348971 - protein, 9 aa, Homo Sapiens
FDLSGMDSL

SEQ ID NO: 348972 - protein, 9 aa, Homo Sapiens
IQEQDLQLE

SEQ ID NO: 348973 - protein, 9 aa, Homo Sapiens
HHYHRKENL

SEQ ID NO: 348974 - protein, 9 aa, Homo Sapiens
RHGSAAEQL

SEQ ID NO: 348975 - protein, 9 aa, Homo Sapiens
LGTLFLAIG

SEQ ID NO: 348976 - protein, 9 aa, Homo Sapiens
EILEICIHK

SEQ ID NO: 348977 - protein, 9 aa, Homo Sapiens
ERLAAGELC

SEQ ID NO: 348978 - protein, 9 aa, Homo Sapiens
EIGTSSDKV

SEQ ID NO: 348979 - protein, 9 aa, Homo Sapiens
VIGIDLWSG

SEQ ID NO: 348980 - protein, 9 aa, Homo Sapiens
HAMRKAAIV

SEQ ID NO: 348981 - protein, 9 aa, Homo Sapiens
MNVNNVIKP

SEQ ID NO: 348982 - protein, 9 aa, Homo Sapiens
GFHTYLISF

SEQ ID NO: 348983 - protein, 9 aa, Homo Sapiens
PCLGHRRTS

SEQ ID NO: 348984 - protein, 9 aa, Homo Sapiens
RKESEPLAK

SEQ ID NO: 348985 - protein, 9 aa, Homo Sapiens
LLKITTFGA

SEQ ID NO: 348986 - protein, 9 aa, Homo Sapiens
HKSEQILKV

SEQ ID NO: 348987 - protein, 9 aa, Homo Sapiens
VTTHGPPSM

SEQ ID NO: 348988 - protein, 9 aa, Homo Sapiens
DQVIEDIEE

SEQ ID NO: 348989 - protein, 9 aa, Homo Sapiens
IEYDAYCTD

SEQ ID NO: 348990 - protein, 9 aa, Homo Sapiens
TFLDTVKEY

SEQ ID NO: 348991 - protein, 9 aa, Homo Sapiens
ILSTHKIIH

SEQ ID NO: 348992 - protein, 9 aa, Homo Sapiens
YHAMRKAAI

SEQ ID NO: 348993 - protein, 9 aa, Homo Sapiens
WMEVNFTKN

SEQ ID NO: 348994 - protein, 9 aa, Homo Sapiens
EFLVELHKF

SEQ ID NO: 348995 - protein, 9 aa, Homo Sapiens
PSSGGHTPH

SEQ ID NO: 348996 - protein, 9 aa, Homo Sapiens
NALLKYLSS

SEQ ID NO: 348997 - protein, 9 aa, Homo Sapiens
HLQVKTTNV

SEQ ID NO: 348998 - protein, 9 aa, Homo Sapiens
EGNTTDQAG

SEQ ID NO: 348999 - protein, 9 aa, Homo Sapiens
LTTPLKKQR

SEQ ID NO: 349000 - protein, 9 aa, Homo Sapiens
LMDRLSNDS

SEQ ID NO: 349001 - protein, 9 aa, Homo Sapiens
KIRNMFDLV

SEQ ID NO: 349002 - protein, 9 aa, Homo Sapiens
HIVAEGEHK

SEQ ID NO: 349003 - protein, 9 aa, Homo Sapiens
LEAKDAHLV

SEQ ID NO: 349004 - protein, 9 aa, Homo Sapiens
EWRLFSLQL

SEQ ID NO: 349005 - protein, 9 aa, Homo Sapiens
FICHRDLKP

SEQ ID NO: 349006 - protein, 9 aa, Homo Sapiens
NNTVSPRAS

SEQ ID NO: 349007 - protein, 9 aa, Homo Sapiens
SVIPTPNSD

SEQ ID NO: 349008 - protein, 9 aa, Homo Sapiens
KLFGSVIFK

SEQ ID NO: 349009 - protein, 9 aa, Homo Sapiens
VLLSKFPTK

SEQ ID NO: 349010 - protein, 9 aa, Homo Sapiens
SLLDLIRPL

SEQ ID NO: 349011 - protein, 9 aa, Homo Sapiens
KFVFQPELF

SEQ ID NO: 349012 - protein, 9 aa, Homo Sapiens
SFETTGESL

SEQ ID NO: 349013 - protein, 9 aa, Homo Sapiens
EQLCQAIEE

SEQ ID NO: 349014 - protein, 9 aa, Homo Sapiens
QAEEEPNRM

SEQ ID NO: 349015 - protein, 9 aa, Homo Sapiens
LLVSATGHS

SEQ ID NO: 349016 - protein, 9 aa, Homo Sapiens
KGNVTAQIA

SEQ ID NO: 349017 - protein, 9 aa, Homo Sapiens
LLVDLQNYQ

SEQ ID NO: 349018 - protein, 9 aa, Homo Sapiens
LGSGQVVLE

SEQ ID NO: 349019 - protein, 9 aa, Homo Sapiens
SWGSMENLA

SEQ ID NO: 349020 - protein, 9 aa, Homo Sapiens
PDTIRERYF

SEQ ID NO: 349021 - protein, 9 aa, Homo Sapiens
ARTMCQDSL

SEQ ID NO: 349022 - protein, 9 aa, Homo Sapiens
LNNEMMKAI

SEQ ID NO: 349023 - protein, 9 aa, Homo Sapiens
HCSAGVGRM

SEQ ID NO: 349024 - protein, 9 aa, Homo Sapiens
DGEADATAS

SEQ ID NO: 349025 - protein, 9 aa, Homo Sapiens
LSDGDAKLE

SEQ ID NO: 349026 - protein, 9 aa, Homo Sapiens
IHYASVTVN

SEQ ID NO: 349027 - protein, 9 aa, Homo Sapiens
DEQQHAQRN

SEQ ID NO: 349028 - protein, 9 aa, Homo Sapiens
FGEGSLLAL

SEQ ID NO: 349029 - protein, 9 aa, Homo Sapiens
RADIRGRSP

SEQ ID NO: 349030 - protein, 9 aa, Homo Sapiens
LKNPSVPMQ

SEQ ID NO: 349031 - protein, 9 aa, Homo Sapiens
PDPTRLIVV

SEQ ID NO: 349032 - protein, 9 aa, Homo Sapiens
FKDEAQSLR

SEQ ID NO: 349033 - protein, 9 aa, Homo Sapiens
YYSGEHLTA

SEQ ID NO: 349034 - protein, 9 aa, Homo Sapiens
GKKTYECSG

SEQ ID NO: 349035 - protein, 9 aa, Homo Sapiens
AQVASLSWD

SEQ ID NO: 349036 - protein, 9 aa, Homo Sapiens
VACPALQNK

SEQ ID NO: 349037 - protein, 9 aa, Homo Sapiens
MDVEEGKMG

SEQ ID NO: 349038 - protein, 9 aa, Homo Sapiens
LVCMMNESS

SEQ ID NO: 349039 - protein, 9 aa, Homo Sapiens
AVVNHFQKA

SEQ ID NO: 349040 - protein, 9 aa, Homo Sapiens
INGNYHRFL

SEQ ID NO: 349041 - protein, 9 aa, Homo Sapiens
FLKVESPAR

SEQ ID NO: 349042 - protein, 9 aa, Homo Sapiens
LGYSTVIAL

SEQ ID NO: 349043 - protein, 9 aa, Homo Sapiens
DAQDIQEAS

SEQ ID NO: 349044 - protein, 9 aa, Homo Sapiens
PPRAPRASK

SEQ ID NO: 349045 - protein, 9 aa, Homo Sapiens
LDICYSTPL

SEQ ID NO: 349046 - protein, 9 aa, Homo Sapiens
SQIICSVKM

SEQ ID NO: 349047 - protein, 9 aa, Homo Sapiens
YPYGYTTEP

SEQ ID NO: 349048 - protein, 9 aa, Homo Sapiens
ILSIGGYLF

SEQ ID NO: 349049 - protein, 9 aa, Homo Sapiens
DRLSNDSIM

SEQ ID NO: 349050 - protein, 9 aa, Homo Sapiens
LTETPEAGI

SEQ ID NO: 349051 - protein, 9 aa, Homo Sapiens
SQNSYLTIH

SEQ ID NO: 349052 - protein, 9 aa, Homo Sapiens
YQCSYLTRH

SEQ ID NO: 349053 - protein, 9 aa, Homo Sapiens
DYQTFFDPK

SEQ ID NO: 349054 - protein, 9 aa, Homo Sapiens
REKEIKECA

SEQ ID NO: 349055 - protein, 9 aa, Homo Sapiens
FLDKKHQNH

SEQ ID NO: 349056 - protein, 9 aa, Homo Sapiens
HGTPAPFTS

SEQ ID NO: 349057 - protein, 9 aa, Homo Sapiens
GFTHRNVYK

SEQ ID NO: 349058 - protein, 9 aa, Homo Sapiens
QSICQLCGF

SEQ ID NO: 349059 - protein, 9 aa, Homo Sapiens
QHRVLFETD

SEQ ID NO: 349060 - protein, 9 aa, Homo Sapiens
EPSKTVPTA

SEQ ID NO: 349061 - protein, 9 aa, Homo Sapiens
KVNRPYLCT

SEQ ID NO: 349062 - protein, 9 aa, Homo Sapiens
WIKGVGWLT

SEQ ID NO: 349063 - protein, 9 aa, Homo Sapiens
TQKVKVKKA

SEQ ID NO: 349064 - protein, 9 aa, Homo Sapiens
SSSPQKRSY

SEQ ID NO: 349065 - protein, 9 aa, Homo Sapiens
SVLVLQAYI

SEQ ID NO: 349066 - protein, 9 aa, Homo Sapiens
TETMEVLQQ

SEQ ID NO: 349067 - protein, 9 aa, Homo Sapiens
YTSLTALSG

SEQ ID NO: 349068 - protein, 9 aa, Homo Sapiens
PEGSTKPIQ

SEQ ID NO: 349069 - protein, 9 aa, Homo Sapiens
LVVVGAGDV

SEQ ID NO: 349070 - protein, 9 aa, Homo Sapiens
LGCFTAQDT

SEQ ID NO: 349071 - protein, 9 aa, Homo Sapiens
DLVCCPECD

SEQ ID NO: 349072 - protein, 9 aa, Homo Sapiens
TDHGMKPHK

SEQ ID NO: 349073 - protein, 9 aa, Homo Sapiens
KMKNFKCRF

SEQ ID NO: 349074 - protein, 9 aa, Homo Sapiens
PGDWIMLVD

SEQ ID NO: 349075 - protein, 9 aa, Homo Sapiens
MYFVLGHLS

SEQ ID NO: 349076 - protein, 9 aa, Homo Sapiens
VLLAARANY

SEQ ID NO: 349077 - protein, 9 aa, Homo Sapiens
IRDTLPDFR

SEQ ID NO: 349078 - protein, 9 aa, Homo Sapiens
SDTNEAAAL

SEQ ID NO: 349079 - protein, 9 aa, Homo Sapiens
FLFRITTHC

SEQ ID NO: 349080 - protein, 9 aa, Homo Sapiens
EQDERGPNA

SEQ ID NO: 349081 - protein, 9 aa, Homo Sapiens
TEEAEGQAQ

SEQ ID NO: 349082 - protein, 9 aa, Homo Sapiens
LSPLGQINE

SEQ ID NO: 349083 - protein, 9 aa, Homo Sapiens
TNGGTQIQP

SEQ ID NO: 349084 - protein, 9 aa, Homo Sapiens
QALKERMIH

SEQ ID NO: 349085 - protein, 9 aa, Homo Sapiens
IPGRRNSQT

SEQ ID NO: 349086 - protein, 9 aa, Homo Sapiens
TCESNANPP

SEQ ID NO: 349087 - protein, 9 aa, Homo Sapiens
IKSSPHDSH

SEQ ID NO: 349088 - protein, 9 aa, Homo Sapiens
NDNGTNYTF

SEQ ID NO: 349089 - protein, 9 aa, Homo Sapiens
SSSLCDHER

SEQ ID NO: 349090 - protein, 9 aa, Homo Sapiens
FSEKFHLVA

SEQ ID NO: 349091 - protein, 9 aa, Homo Sapiens
GGGEPPTSP

SEQ ID NO: 349092 - protein, 9 aa, Homo Sapiens
GMACGFTTI

SEQ ID NO: 349093 - protein, 9 aa, Homo Sapiens
EHQFFEIQS

SEQ ID NO: 349094 - protein, 9 aa, Homo Sapiens
PAACGRIRY

SEQ ID NO: 349095 - protein, 9 aa, Homo Sapiens
AHVCQHNQL

SEQ ID NO: 349096 - protein, 9 aa, Homo Sapiens
MNLLVPSLT

SEQ ID NO: 349097 - protein, 9 aa, Homo Sapiens
VNINGESRS

SEQ ID NO: 349098 - protein, 9 aa, Homo Sapiens
KDNRKLHME

SEQ ID NO: 349099 - protein, 9 aa, Homo Sapiens
SLLNTATVK

SEQ ID NO: 349100 - protein, 9 aa, Homo Sapiens
GGYMLEWVC

SEQ ID NO: 349101 - protein, 9 aa, Homo Sapiens
GIIYVDGAS

SEQ ID NO: 349102 - protein, 9 aa, Homo Sapiens
LKSEEVLSC

SEQ ID NO: 349103 - protein, 9 aa, Homo Sapiens
SLIDKNKQF

SEQ ID NO: 349104 - protein, 9 aa, Homo Sapiens
KVYAINLES

SEQ ID NO: 349105 - protein, 9 aa, Homo Sapiens
DNVEKESKQ

SEQ ID NO: 349106 - protein, 9 aa, Homo Sapiens
QKDGAYTVH

SEQ ID NO: 349107 - protein, 9 aa, Homo Sapiens
LQRSCLLTK

SEQ ID NO: 349108 - protein, 9 aa, Homo Sapiens
GKGQFGEVW

SEQ ID NO: 349109 - protein, 9 aa, Homo Sapiens
ERVHTLVLG

SEQ ID NO: 349110 - protein, 9 aa, Homo Sapiens
DNAKFQKKR

SEQ ID NO: 349111 - protein, 9 aa, Homo Sapiens
QQNTELLSI

SEQ ID NO: 349112 - protein, 9 aa, Homo Sapiens
IVVVALDLQ

SEQ ID NO: 349113 - protein, 9 aa, Homo Sapiens
SPAPASSIS

SEQ ID NO: 349114 - protein, 9 aa, Homo Sapiens
EIQNCQKII

SEQ ID NO: 349115 - protein, 9 aa, Homo Sapiens
PGASEGIKC

SEQ ID NO: 349116 - protein, 9 aa, Homo Sapiens
AAVPKYAKY

SEQ ID NO: 349117 - protein, 9 aa, Homo Sapiens
EVIQTLCLG

SEQ ID NO: 349118 - protein, 9 aa, Homo Sapiens
LEPHNKYRF

SEQ ID NO: 349119 - protein, 9 aa, Homo Sapiens
LVSHLIIHT

SEQ ID NO: 349120 - protein, 9 aa, Homo Sapiens
HNGGTCRNL

SEQ ID NO: 349121 - protein, 9 aa, Homo Sapiens
ARWPSLRLH

SEQ ID NO: 349122 - protein, 9 aa, Homo Sapiens
GHEIWEEFL

SEQ ID NO: 349123 - protein, 9 aa, Homo Sapiens
SVCYDPYTQ

SEQ ID NO: 349124 - protein, 9 aa, Homo Sapiens
TESSLTKHI

SEQ ID NO: 349125 - protein, 9 aa, Homo Sapiens
GASTVQEEE

SEQ ID NO: 349126 - protein, 9 aa, Homo Sapiens
PDLSEVVKF

SEQ ID NO: 349127 - protein, 9 aa, Homo Sapiens
NERGALVGL

SEQ ID NO: 349128 - protein, 9 aa, Homo Sapiens
ASKIMKSIG

SEQ ID NO: 349129 - protein, 9 aa, Homo Sapiens
CHRLANKAV

SEQ ID NO: 349130 - protein, 9 aa, Homo Sapiens
GPSSGGHTP

SEQ ID NO: 349131 - protein, 9 aa, Homo Sapiens
TAKSHKLAV

SEQ ID NO: 349132 - protein, 9 aa, Homo Sapiens
YVWLAINYR

SEQ ID NO: 349133 - protein, 9 aa, Homo Sapiens
SLDKFRINI

SEQ ID NO: 349134 - protein, 9 aa, Homo Sapiens
SLQLLASDL

SEQ ID NO: 349135 - protein, 9 aa, Homo Sapiens
KSWIHSFRG

SEQ ID NO: 349136 - protein, 9 aa, Homo Sapiens
DNNTFTVKY

SEQ ID NO: 349137 - protein, 9 aa, Homo Sapiens
RKSIKNKRA

SEQ ID NO: 349138 - protein, 9 aa, Homo Sapiens
EGVYQCMAK

SEQ ID NO: 349139 - protein, 9 aa, Homo Sapiens
TLRPRCINM

SEQ ID NO: 349140 - protein, 9 aa, Homo Sapiens
KKQKELGMA

SEQ ID NO: 349141 - protein, 9 aa, Homo Sapiens
MLYVCCGTV

SEQ ID NO: 349142 - protein, 9 aa, Homo Sapiens
LWFQSTVSK

SEQ ID NO: 349143 - protein, 9 aa, Homo Sapiens
KPQRKPVPE

SEQ ID NO: 349144 - protein, 9 aa, Homo Sapiens
VRTRRYVCK

SEQ ID NO: 349145 - protein, 9 aa, Homo Sapiens
PMEKDIMPD

SEQ ID NO: 349146 - protein, 9 aa, Homo Sapiens
SNLTTTASE

SEQ ID NO: 349147 - protein, 9 aa, Homo Sapiens
KIHYASVTV

SEQ ID NO: 349148 - protein, 9 aa, Homo Sapiens
VCWTIFSLL

SEQ ID NO: 349149 - protein, 9 aa, Homo Sapiens
KEIHNTPLD

SEQ ID NO: 349150 - protein, 9 aa, Homo Sapiens
QILHCYRDC

SEQ ID NO: 349151 - protein, 9 aa, Homo Sapiens
PTIILSFPT

SEQ ID NO: 349152 - protein, 9 aa, Homo Sapiens
VSLSSVAIC

SEQ ID NO: 349153 - protein, 9 aa, Homo Sapiens
HNQNHVVSQ

SEQ ID NO: 349154 - protein, 9 aa, Homo Sapiens
VLRDSRDVL

SEQ ID NO: 349155 - protein, 9 aa, Homo Sapiens
DEITHNDIA

SEQ ID NO: 349156 - protein, 9 aa, Homo Sapiens
AHKHYTIDV

SEQ ID NO: 349157 - protein, 9 aa, Homo Sapiens
KPERNILVL

SEQ ID NO: 349158 - protein, 9 aa, Homo Sapiens
FSDLAMQVI

SEQ ID NO: 349159 - protein, 9 aa, Homo Sapiens
MQTIMTSLK

SEQ ID NO: 349160 - protein, 9 aa, Homo Sapiens
LFNLDRFCF

SEQ ID NO: 349161 - protein, 9 aa, Homo Sapiens
PEFHHGAQA

SEQ ID NO: 349162 - protein, 9 aa, Homo Sapiens
VHATLTNTL

SEQ ID NO: 349163 - protein, 9 aa, Homo Sapiens
PKVTSMFKL

SEQ ID NO: 349164 - protein, 9 aa, Homo Sapiens
TATQHFTNR

SEQ ID NO: 349165 - protein, 9 aa, Homo Sapiens
PVTCQIEEM

SEQ ID NO: 349166 - protein, 9 aa, Homo Sapiens
DKKKDFLQE

SEQ ID NO: 349167 - protein, 9 aa, Homo Sapiens
KQLVLHPRR

SEQ ID NO: 349168 - protein, 9 aa, Homo Sapiens
NSDVFTFSV

SEQ ID NO: 349169 - protein, 9 aa, Homo Sapiens
TTKAPTSPF

SEQ ID NO: 349170 - protein, 9 aa, Homo Sapiens
DDEDDNDLL

SEQ ID NO: 349171 - protein, 9 aa, Homo Sapiens
KKAERLGLH

SEQ ID NO: 349172 - protein, 9 aa, Homo Sapiens
RTKKKTRKD

SEQ ID NO: 349173 - protein, 9 aa, Homo Sapiens
RKIKHLRVL

SEQ ID NO: 349174 - protein, 9 aa, Homo Sapiens
YDFRWMTAR

SEQ ID NO: 349175 - protein, 9 aa, Homo Sapiens
INNNPPTFS

SEQ ID NO: 349176 - protein, 9 aa, Homo Sapiens
GTLWYRPPD

SEQ ID NO: 349177 - protein, 9 aa, Homo Sapiens
QFKEHQQIH

SEQ ID NO: 349178 - protein, 9 aa, Homo Sapiens
ERNIQIIVP

SEQ ID NO: 349179 - protein, 9 aa, Homo Sapiens
PLLNPFMYT

SEQ ID NO: 349180 - protein, 9 aa, Homo Sapiens
RASSPFQRV

SEQ ID NO: 349181 - protein, 9 aa, Homo Sapiens
GNLSNLVVL

SEQ ID NO: 349182 - protein, 9 aa, Homo Sapiens
VGEDGDKRK

SEQ ID NO: 349183 - protein, 9 aa, Homo Sapiens
STIQNLKER

SEQ ID NO: 349184 - protein, 9 aa, Homo Sapiens
PPTLREDKR

SEQ ID NO: 349185 - protein, 9 aa, Homo Sapiens
KLLVVADHH

SEQ ID NO: 349186 - protein, 9 aa, Homo Sapiens
PKYDKIKDM

SEQ ID NO: 349187 - protein, 9 aa, Homo Sapiens
QKVMVTVKI

SEQ ID NO: 349188 - protein, 9 aa, Homo Sapiens
GTRIQQAFG

SEQ ID NO: 349189 - protein, 9 aa, Homo Sapiens
SIDVSSAAK

SEQ ID NO: 349190 - protein, 9 aa, Homo Sapiens
KTFSQNSYL

SEQ ID NO: 349191 - protein, 9 aa, Homo Sapiens
FLVHKISGH

SEQ ID NO: 349192 - protein, 9 aa, Homo Sapiens
ELSHLLEEI

SEQ ID NO: 349193 - protein, 9 aa, Homo Sapiens
MNPRICGFL

SEQ ID NO: 349194 - protein, 9 aa, Homo Sapiens
AESLAVHGL

SEQ ID NO: 349195 - protein, 9 aa, Homo Sapiens
NIQNVLVDA

SEQ ID NO: 349196 - protein, 9 aa, Homo Sapiens
KVVNSDRPE

SEQ ID NO: 349197 - protein, 9 aa, Homo Sapiens
FYCKKERCF

SEQ ID NO: 349198 - protein, 9 aa, Homo Sapiens
VTSSSEIIR

SEQ ID NO: 349199 - protein, 9 aa, Homo Sapiens
GSSMKPQAD

SEQ ID NO: 349200 - protein, 9 aa, Homo Sapiens
KIINTGEKP

SEQ ID NO: 349201 - protein, 9 aa, Homo Sapiens
KEGGNDNQD

SEQ ID NO: 349202 - protein, 9 aa, Homo Sapiens
DSVGGKIIE

SEQ ID NO: 349203 - protein, 9 aa, Homo Sapiens
CFDEFNQIE

SEQ ID NO: 349204 - protein, 9 aa, Homo Sapiens
VLPFYCSPA

SEQ ID NO: 349205 - protein, 9 aa, Homo Sapiens
LTKLKSQVQ

SEQ ID NO: 349206 - protein, 9 aa, Homo Sapiens
KIINTGEKL

SEQ ID NO: 349207 - protein, 9 aa, Homo Sapiens
CVDNATVCA

SEQ ID NO: 349208 - protein, 9 aa, Homo Sapiens
QPESLRPVH

SEQ ID NO: 349209 - protein, 9 aa, Homo Sapiens
QQGQGRHNA

SEQ ID NO: 349210 - protein, 9 aa, Homo Sapiens
SVIGYLTSR

SEQ ID NO: 349211 - protein, 9 aa, Homo Sapiens
MISREAANQ

SEQ ID NO: 349212 - protein, 9 aa, Homo Sapiens
TQLSFVFLV

SEQ ID NO: 349213 - protein, 9 aa, Homo Sapiens
PGDNTTFQL

SEQ ID NO: 349214 - protein, 9 aa, Homo Sapiens
SSSVNKFAK

SEQ ID NO: 349215 - protein, 9 aa, Homo Sapiens
RDPAWLPED

SEQ ID NO: 349216 - protein, 9 aa, Homo Sapiens
LTVHRKIHS

SEQ ID NO: 349217 - protein, 9 aa, Homo Sapiens
WLQKIKAIK

SEQ ID NO: 349218 - protein, 9 aa, Homo Sapiens
IKQGLIQNM

SEQ ID NO: 349219 - protein, 9 aa, Homo Sapiens
QKQKPASSE

SEQ ID NO: 349220 - protein, 9 aa, Homo Sapiens
FVQLRDGDR

SEQ ID NO: 349221 - protein, 9 aa, Homo Sapiens
HLTQHQNIH

SEQ ID NO: 349222 - protein, 9 aa, Homo Sapiens
CKEAERIAR

SEQ ID NO: 349223 - protein, 9 aa, Homo Sapiens
FRMRVRWEI

SEQ ID NO: 349224 - protein, 9 aa, Homo Sapiens
YFFYKRLNQ

SEQ ID NO: 349225 - protein, 9 aa, Homo Sapiens
ECGKDGPKY

SEQ ID NO: 349226 - protein, 9 aa, Homo Sapiens
DVNKQEENN

SEQ ID NO: 349227 - protein, 9 aa, Homo Sapiens
LQIDLNKEN

SEQ ID NO: 349228 - protein, 9 aa, Homo Sapiens
WEELDGSLG

SEQ ID NO: 349229 - protein, 9 aa, Homo Sapiens
KYILTIKAN

SEQ ID NO: 349230 - protein, 9 aa, Homo Sapiens
EAGIHQGFR

SEQ ID NO: 349231 - protein, 9 aa, Homo Sapiens
KVLSRKSHL

SEQ ID NO: 349232 - protein, 9 aa, Homo Sapiens
LDHLIQILE

SEQ ID NO: 349233 - protein, 9 aa, Homo Sapiens
NYNRGDIPS

SEQ ID NO: 349234 - protein, 9 aa, Homo Sapiens
NPQDDIATE

SEQ ID NO: 349235 - protein, 9 aa, Homo Sapiens
IEDRRRAAT

SEQ ID NO: 349236 - protein, 9 aa, Homo Sapiens
KQQKERKNR

SEQ ID NO: 349237 - protein, 9 aa, Homo Sapiens
MIKYLSQEF

SEQ ID NO: 349238 - protein, 9 aa, Homo Sapiens
FLMLYFLLY

SEQ ID NO: 349239 - protein, 9 aa, Homo Sapiens
DFQCGPTST

SEQ ID NO: 349240 - protein, 9 aa, Homo Sapiens
VSMEILFKA

SEQ ID NO: 349241 - protein, 9 aa, Homo Sapiens
YIQRTLRNF

SEQ ID NO: 349242 - protein, 9 aa, Homo Sapiens
CSNFCEFIG

SEQ ID NO: 349243 - protein, 9 aa, Homo Sapiens
INLHQHQRI

SEQ ID NO: 349244 - protein, 9 aa, Homo Sapiens
KENTLGCQN

SEQ ID NO: 349245 - protein, 9 aa, Homo Sapiens
WVIMITGDN

SEQ ID NO: 349246 - protein, 9 aa, Homo Sapiens
NLMTSAVPV

SEQ ID NO: 349247 - protein, 9 aa, Homo Sapiens
LLEAPLCIS

SEQ ID NO: 349248 - protein, 9 aa, Homo Sapiens
GTYLIQDMK

SEQ ID NO: 349249 - protein, 9 aa, Homo Sapiens
HDESICLIC

SEQ ID NO: 349250 - protein, 9 aa, Homo Sapiens
ARQTYPKKP

SEQ ID NO: 349251 - protein, 9 aa, Homo Sapiens
TTKSAAKRL

SEQ ID NO: 349252 - protein, 9 aa, Homo Sapiens
RQNPQMRYT

SEQ ID NO: 349253 - protein, 9 aa, Homo Sapiens
AGVYVAFGA

SEQ ID NO: 349254 - protein, 9 aa, Homo Sapiens
ISPESPTNQ

SEQ ID NO: 349255 - protein, 9 aa, Homo Sapiens
RGVAVKGQG

SEQ ID NO: 349256 - protein, 9 aa, Homo Sapiens
KVIDKTLMR

SEQ ID NO: 349257 - protein, 9 aa, Homo Sapiens
LNPNIAKNE

SEQ ID NO: 349258 - protein, 9 aa, Homo Sapiens
KDGLLQQLK

SEQ ID NO: 349259 - protein, 9 aa, Homo Sapiens
FEESKSYDI

SEQ ID NO: 349260 - protein, 9 aa, Homo Sapiens
KLAQLEEVK

SEQ ID NO: 349261 - protein, 9 aa, Homo Sapiens
RIITGEKPY

SEQ ID NO: 349262 - protein, 9 aa, Homo Sapiens
YKIDSLIGK

SEQ ID NO: 349263 - protein, 9 aa, Homo Sapiens
IVSMEILFK

SEQ ID NO: 349264 - protein, 9 aa, Homo Sapiens
DIRVPFFIC

SEQ ID NO: 349265 - protein, 9 aa, Homo Sapiens
EGFSYRTGQ

SEQ ID NO: 349266 - protein, 9 aa, Homo Sapiens
NHKGPPVFT

SEQ ID NO: 349267 - protein, 9 aa, Homo Sapiens
KAWFIRQEH

SEQ ID NO: 349268 - protein, 9 aa, Homo Sapiens
TVQRVTLAS

SEQ ID NO: 349269 - protein, 9 aa, Homo Sapiens
AVRPGPLQL

SEQ ID NO: 349270 - protein, 9 aa, Homo Sapiens
SAQLKRFDE

SEQ ID NO: 349271 - protein, 9 aa, Homo Sapiens
PKTEDHGTP

SEQ ID NO: 349272 - protein, 9 aa, Homo Sapiens
SRVWWDSNF

SEQ ID NO: 349273 - protein, 9 aa, Homo Sapiens
SLFHEQSNK

SEQ ID NO: 349274 - protein, 9 aa, Homo Sapiens
QTILCNSLV

SEQ ID NO: 349275 - protein, 9 aa, Homo Sapiens
YHTFSAMKK

SEQ ID NO: 349276 - protein, 9 aa, Homo Sapiens
LLNKLDEAV

SEQ ID NO: 349277 - protein, 9 aa, Homo Sapiens
DSEEEDEEE

SEQ ID NO: 349278 - protein, 9 aa, Homo Sapiens
QTLMCDVHS

SEQ ID NO: 349279 - protein, 9 aa, Homo Sapiens
LRTSFQQLS

SEQ ID NO: 349280 - protein, 9 aa, Homo Sapiens
ASLTSCIIR

SEQ ID NO: 349281 - protein, 9 aa, Homo Sapiens
RPACGRVSC

SEQ ID NO: 349282 - protein, 9 aa, Homo Sapiens
CTRGCRFCY

SEQ ID NO: 349283 - protein, 9 aa, Homo Sapiens
NKDNTFSFS

SEQ ID NO: 349284 - protein, 9 aa, Homo Sapiens
PQTIQDQAK

SEQ ID NO: 349285 - protein, 9 aa, Homo Sapiens
EYLNLPRRS

SEQ ID NO: 349286 - protein, 9 aa, Homo Sapiens
APRASKAQR

SEQ ID NO: 349287 - protein, 9 aa, Homo Sapiens
VCINILGGQ

SEQ ID NO: 349288 - protein, 9 aa, Homo Sapiens
NKFHFNIYS

SEQ ID NO: 349289 - protein, 9 aa, Homo Sapiens
AEEEIKIPV

SEQ ID NO: 349290 - protein, 9 aa, Homo Sapiens
DVKYLKEDD

SEQ ID NO: 349291 - protein, 9 aa, Homo Sapiens
LRWSRFTRV

SEQ ID NO: 349292 - protein, 9 aa, Homo Sapiens
AQEKVLQGS

SEQ ID NO: 349293 - protein, 9 aa, Homo Sapiens
HQHMHTGER

SEQ ID NO: 349294 - protein, 9 aa, Homo Sapiens
IRHCVVCST

SEQ ID NO: 349295 - protein, 9 aa, Homo Sapiens
GAVAYTIGL

SEQ ID NO: 349296 - protein, 9 aa, Homo Sapiens
NGTYFQIHI

SEQ ID NO: 349297 - protein, 9 aa, Homo Sapiens
VRRKSIKNK

SEQ ID NO: 349298 - protein, 9 aa, Homo Sapiens
RKIKRLKPT

SEQ ID NO: 349299 - protein, 9 aa, Homo Sapiens
GLNVALSSC

SEQ ID NO: 349300 - protein, 9 aa, Homo Sapiens
WDKIPLSGS

SEQ ID NO: 349301 - protein, 9 aa, Homo Sapiens
LYTGMMSSF

SEQ ID NO: 349302 - protein, 9 aa, Homo Sapiens
LAEEICHMF

SEQ ID NO: 349303 - protein, 9 aa, Homo Sapiens
DNLGVTVDL

SEQ ID NO: 349304 - protein, 9 aa, Homo Sapiens
SANEVFYTP

SEQ ID NO: 349305 - protein, 9 aa, Homo Sapiens
KALPTCGSH

SEQ ID NO: 349306 - protein, 9 aa, Homo Sapiens
AALEMMSQT

SEQ ID NO: 349307 - protein, 9 aa, Homo Sapiens
FRDILLRHC

SEQ ID NO: 349308 - protein, 9 aa, Homo Sapiens
APVTKNNGP

SEQ ID NO: 349309 - protein, 9 aa, Homo Sapiens
TEASALKGL

SEQ ID NO: 349310 - protein, 9 aa, Homo Sapiens
SNKGAKTLA

SEQ ID NO: 349311 - protein, 9 aa, Homo Sapiens
LTRHKIINT

SEQ ID NO: 349312 - protein, 9 aa, Homo Sapiens
FTWTKHGVP

SEQ ID NO: 349313 - protein, 9 aa, Homo Sapiens
GDTQHREKL

SEQ ID NO: 349314 - protein, 9 aa, Homo Sapiens
HFRIQRTTE

SEQ ID NO: 349315 - protein, 9 aa, Homo Sapiens
TTLELGWLC

SEQ ID NO: 349316 - protein, 9 aa, Homo Sapiens
YIEIDALSQ

SEQ ID NO: 349317 - protein, 9 aa, Homo Sapiens
NIQQIIQEN

SEQ ID NO: 349318 - protein, 9 aa, Homo Sapiens
GTQSSQEYD

SEQ ID NO: 349319 - protein, 9 aa, Homo Sapiens
HKSFMETAM

SEQ ID NO: 349320 - protein, 9 aa, Homo Sapiens
KERRSLLRK

SEQ ID NO: 349321 - protein, 9 aa, Homo Sapiens
AVINEIFQC

SEQ ID NO: 349322 - protein, 9 aa, Homo Sapiens
NPLMYTLRN

SEQ ID NO: 349323 - protein, 9 aa, Homo Sapiens
YRGNKDTPY

SEQ ID NO: 349324 - protein, 9 aa, Homo Sapiens
VRHHKGGKA

SEQ ID NO: 349325 - protein, 9 aa, Homo Sapiens
DIVERNIQI

SEQ ID NO: 349326 - protein, 9 aa, Homo Sapiens
LNYLSGDIT

SEQ ID NO: 349327 - protein, 9 aa, Homo Sapiens
PLQPPPLPE

SEQ ID NO: 349328 - protein, 9 aa, Homo Sapiens
PISHICLWV

SEQ ID NO: 349329 - protein, 9 aa, Homo Sapiens
DVGKINLPP

SEQ ID NO: 349330 - protein, 9 aa, Homo Sapiens
QLLGGPDIF

SEQ ID NO: 349331 - protein, 9 aa, Homo Sapiens
SSVICCLCA

SEQ ID NO: 349332 - protein, 9 aa, Homo Sapiens
EQNQYDLKT

SEQ ID NO: 349333 - protein, 9 aa, Homo Sapiens
KHVRLEHLH

SEQ ID NO: 349334 - protein, 9 aa, Homo Sapiens
AVTALIASG

SEQ ID NO: 349335 - protein, 9 aa, Homo Sapiens
WQSLNVRAA

SEQ ID NO: 349336 - protein, 9 aa, Homo Sapiens
KDLKHNKLP

SEQ ID NO: 349337 - protein, 9 aa, Homo Sapiens
HDQTVIHKG

SEQ ID NO: 349338 - protein, 9 aa, Homo Sapiens
DVTDEHGKR

SEQ ID NO: 349339 - protein, 9 aa, Homo Sapiens
GLDRKKVQQ

SEQ ID NO: 349340 - protein, 9 aa, Homo Sapiens
VVPDEEAIE

SEQ ID NO: 349341 - protein, 9 aa, Homo Sapiens
DMLERHEEA

SEQ ID NO: 349342 - protein, 9 aa, Homo Sapiens
TNIFISWFP

SEQ ID NO: 349343 - protein, 9 aa, Homo Sapiens
KVRMNYYPY

SEQ ID NO: 349344 - protein, 9 aa, Homo Sapiens
IHDHAILLT

SEQ ID NO: 349345 - protein, 9 aa, Homo Sapiens
ENTNGQLMA

SEQ ID NO: 349346 - protein, 9 aa, Homo Sapiens
EPNLEIGTH

SEQ ID NO: 349347 - protein, 9 aa, Homo Sapiens
KDIAESTLP

SEQ ID NO: 349348 - protein, 9 aa, Homo Sapiens
GIYPSVEDS

SEQ ID NO: 349349 - protein, 9 aa, Homo Sapiens
SVLALKLKE

SEQ ID NO: 349350 - protein, 9 aa, Homo Sapiens
EKKPEAAAK

SEQ ID NO: 349351 - protein, 9 aa, Homo Sapiens
RALNRTNHP

SEQ ID NO: 349352 - protein, 9 aa, Homo Sapiens
ISKGLFVPL

SEQ ID NO: 349353 - protein, 9 aa, Homo Sapiens
GRKSKYKIA

SEQ ID NO: 349354 - protein, 9 aa, Homo Sapiens
EFLMSFTPA

SEQ ID NO: 349355 - protein, 9 aa, Homo Sapiens
VSSSEDITP

SEQ ID NO: 349356 - protein, 9 aa, Homo Sapiens
MLWHPKLIK

SEQ ID NO: 349357 - protein, 9 aa, Homo Sapiens
FSSIWGEKC

SEQ ID NO: 349358 - protein, 9 aa, Homo Sapiens
MSLPPNCWC

SEQ ID NO: 349359 - protein, 9 aa, Homo Sapiens
WECVQPMKG

SEQ ID NO: 349360 - protein, 9 aa, Homo Sapiens
NIIIVIFPI

SEQ ID NO: 349361 - protein, 9 aa, Homo Sapiens
GLECHLKIK

SEQ ID NO: 349362 - protein, 9 aa, Homo Sapiens
FKERSTILC

SEQ ID NO: 349363 - protein, 9 aa, Homo Sapiens
AICRMHSAE

SEQ ID NO: 349364 - protein, 9 aa, Homo Sapiens
STQLHFHFF

SEQ ID NO: 349365 - protein, 9 aa, Homo Sapiens
IFRGQVYSK

SEQ ID NO: 349366 - protein, 9 aa, Homo Sapiens
RKKLNKYEN

SEQ ID NO: 349367 - protein, 9 aa, Homo Sapiens
QNKSLATLT

SEQ ID NO: 349368 - protein, 9 aa, Homo Sapiens
LISELQRVA

SEQ ID NO: 349369 - protein, 9 aa, Homo Sapiens
TSLLQTVMT

SEQ ID NO: 349370 - protein, 9 aa, Homo Sapiens
YWCLTNGNT

SEQ ID NO: 349371 - protein, 9 aa, Homo Sapiens
KATIPPPLP

SEQ ID NO: 349372 - protein, 9 aa, Homo Sapiens
RCSHCQKNL

SEQ ID NO: 349373 - protein, 9 aa, Homo Sapiens
YFPIPVLKK

SEQ ID NO: 349374 - protein, 9 aa, Homo Sapiens
VCIMMNEGK

SEQ ID NO: 349375 - protein, 9 aa, Homo Sapiens
LCHEQFYQC

SEQ ID NO: 349376 - protein, 9 aa, Homo Sapiens
NDDGLIQIE

SEQ ID NO: 349377 - protein, 9 aa, Homo Sapiens
LLGRSIELA

SEQ ID NO: 349378 - protein, 9 aa, Homo Sapiens
INFNIIKIL

SEQ ID NO: 349379 - protein, 9 aa, Homo Sapiens
NADFSVPVE

SEQ ID NO: 349380 - protein, 9 aa, Homo Sapiens
SFLHDNSLH

SEQ ID NO: 349381 - protein, 9 aa, Homo Sapiens
GMYFVSSGL

SEQ ID NO: 349382 - protein, 9 aa, Homo Sapiens
LTSSIMQKV

SEQ ID NO: 349383 - protein, 9 aa, Homo Sapiens
GGLDVRRQI

SEQ ID NO: 349384 - protein, 9 aa, Homo Sapiens
FKLTSVEKS

SEQ ID NO: 349385 - protein, 9 aa, Homo Sapiens
NELIMPDSA

SEQ ID NO: 349386 - protein, 9 aa, Homo Sapiens
EADTGSLYD

SEQ ID NO: 349387 - protein, 9 aa, Homo Sapiens
SLGCCVVIT

SEQ ID NO: 349388 - protein, 9 aa, Homo Sapiens
HTDTFHFRI

SEQ ID NO: 349389 - protein, 9 aa, Homo Sapiens
DKNEIQNAE

SEQ ID NO: 349390 - protein, 9 aa, Homo Sapiens
INDILSNAL

SEQ ID NO: 349391 - protein, 9 aa, Homo Sapiens
SRIRRMWNY

SEQ ID NO: 349392 - protein, 9 aa, Homo Sapiens
GQSEQLVPV

SEQ ID NO: 349393 - protein, 9 aa, Homo Sapiens
CHLKIKTCT

SEQ ID NO: 349394 - protein, 9 aa, Homo Sapiens
TNSKRPDPL

SEQ ID NO: 349395 - protein, 9 aa, Homo Sapiens
KQRLVETEK

SEQ ID NO: 349396 - protein, 9 aa, Homo Sapiens
HFSLSPNLM

SEQ ID NO: 349397 - protein, 9 aa, Homo Sapiens
ISHHLGKMY

SEQ ID NO: 349398 - protein, 9 aa, Homo Sapiens
FIKGKDNSH

SEQ ID NO: 349399 - protein, 9 aa, Homo Sapiens
EPIKTFYRF

SEQ ID NO: 349400 - protein, 9 aa, Homo Sapiens
MHTKIDKLR

SEQ ID NO: 349401 - protein, 9 aa, Homo Sapiens
NRSLMACCL

SEQ ID NO: 349402 - protein, 9 aa, Homo Sapiens
SQGAGFRGL

SEQ ID NO: 349403 - protein, 9 aa, Homo Sapiens
ELPYTYSKI

SEQ ID NO: 349404 - protein, 9 aa, Homo Sapiens
DDNNQTLDF

SEQ ID NO: 349405 - protein, 9 aa, Homo Sapiens
KEEELSRDS

SEQ ID NO: 349406 - protein, 9 aa, Homo Sapiens
VITFEITFC

SEQ ID NO: 349407 - protein, 9 aa, Homo Sapiens
QLYLSQTVG

SEQ ID NO: 349408 - protein, 9 aa, Homo Sapiens
LMNDRSTGK

SEQ ID NO: 349409 - protein, 9 aa, Homo Sapiens
ESKSYDIIV

SEQ ID NO: 349410 - protein, 9 aa, Homo Sapiens
KENTSTATM

SEQ ID NO: 349411 - protein, 9 aa, Homo Sapiens
LHLPEMVGH

SEQ ID NO: 349412 - protein, 9 aa, Homo Sapiens
RALIGLWEV

SEQ ID NO: 349413 - protein, 9 aa, Homo Sapiens
QYPSPGSNL

SEQ ID NO: 349414 - protein, 9 aa, Homo Sapiens
ALDFCHSYF

SEQ ID NO: 349415 - protein, 9 aa, Homo Sapiens
RERYFKDFH

SEQ ID NO: 349416 - protein, 9 aa, Homo Sapiens
FIVPQQWVT

SEQ ID NO: 349417 - protein, 9 aa, Homo Sapiens
ELCHMESKT

SEQ ID NO: 349418 - protein, 9 aa, Homo Sapiens
RIFFPRKCP

SEQ ID NO: 349419 - protein, 9 aa, Homo Sapiens
SQHKKIRTG

SEQ ID NO: 349420 - protein, 9 aa, Homo Sapiens
NLLSPVAFG

SEQ ID NO: 349421 - protein, 9 aa, Homo Sapiens
ENLVMSDKS

SEQ ID NO: 349422 - protein, 9 aa, Homo Sapiens
IIFPYLYES

SEQ ID NO: 349423 - protein, 9 aa, Homo Sapiens
NLNTGMQTT

SEQ ID NO: 349424 - protein, 9 aa, Homo Sapiens
RIALAVITQ

SEQ ID NO: 349425 - protein, 9 aa, Homo Sapiens
HTIQFVDWC

SEQ ID NO: 349426 - protein, 9 aa, Homo Sapiens
SSSYENERP

SEQ ID NO: 349427 - protein, 9 aa, Homo Sapiens
KEKYTVLGR

SEQ ID NO: 349428 - protein, 9 aa, Homo Sapiens
GIIGPRQGG

SEQ ID NO: 349429 - protein, 9 aa, Homo Sapiens
QKASGQTVD

SEQ ID NO: 349430 - protein, 9 aa, Homo Sapiens
LCEKISKIY

SEQ ID NO: 349431 - protein, 9 aa, Homo Sapiens
NVTPLLKLS

SEQ ID NO: 349432 - protein, 9 aa, Homo Sapiens
QEFVQRLEL

SEQ ID NO: 349433 - protein, 9 aa, Homo Sapiens
ICMVNMKSK

SEQ ID NO: 349434 - protein, 9 aa, Homo Sapiens
STNSGSGLL

SEQ ID NO: 349435 - protein, 9 aa, Homo Sapiens
NGERRKFGV

SEQ ID NO: 349436 - protein, 9 aa, Homo Sapiens
KDATKDAKE

SEQ ID NO: 349437 - protein, 9 aa, Homo Sapiens
TTCVPWNLH

SEQ ID NO: 349438 - protein, 9 aa, Homo Sapiens
TPRKGDKIY

SEQ ID NO: 349439 - protein, 9 aa, Homo Sapiens
FHIQFEEVI

SEQ ID NO: 349440 - protein, 9 aa, Homo Sapiens
TQLKSLYAD

SEQ ID NO: 349441 - protein, 9 aa, Homo Sapiens
IATIKTKHT

SEQ ID NO: 349442 - protein, 9 aa, Homo Sapiens
QSDLEEFQE

SEQ ID NO: 349443 - protein, 9 aa, Homo Sapiens
PLGSYYSGE

SEQ ID NO: 349444 - protein, 9 aa, Homo Sapiens
GKKEEASQN

SEQ ID NO: 349445 - protein, 9 aa, Homo Sapiens
LCLGKEGTD

SEQ ID NO: 349446 - protein, 9 aa, Homo Sapiens
LIIVQRLLD

SEQ ID NO: 349447 - protein, 9 aa, Homo Sapiens
DRSRRITNN

SEQ ID NO: 349448 - protein, 9 aa, Homo Sapiens
SKNMPFQDD

SEQ ID NO: 349449 - protein, 9 aa, Homo Sapiens
INGYTLMDL

SEQ ID NO: 349450 - protein, 9 aa, Homo Sapiens
QAPTDINSS

SEQ ID NO: 349451 - protein, 9 aa, Homo Sapiens
IYSKIAKIV

SEQ ID NO: 349452 - protein, 9 aa, Homo Sapiens
TLKPEQSFE

SEQ ID NO: 349453 - protein, 9 aa, Homo Sapiens
TELTEMQND

SEQ ID NO: 349454 - protein, 9 aa, Homo Sapiens
MVAGGTNSC

SEQ ID NO: 349455 - protein, 9 aa, Homo Sapiens
TEEKPFVCS

SEQ ID NO: 349456 - protein, 9 aa, Homo Sapiens
QTVIHKGPI

SEQ ID NO: 349457 - protein, 9 aa, Homo Sapiens
ILFKAWLHN

SEQ ID NO: 349458 - protein, 9 aa, Homo Sapiens
NNNPPTFSQ

SEQ ID NO: 349459 - protein, 9 aa, Homo Sapiens
LYTARDQDE

SEQ ID NO: 349460 - protein, 9 aa, Homo Sapiens
ILMCFILAL

SEQ ID NO: 349461 - protein, 9 aa, Homo Sapiens
VSTPIPICR

SEQ ID NO: 349462 - protein, 9 aa, Homo Sapiens
VKVKKATVN

SEQ ID NO: 349463 - protein, 9 aa, Homo Sapiens
FILKPSVKN

SEQ ID NO: 349464 - protein, 9 aa, Homo Sapiens
MDEADAKSA

SEQ ID NO: 349465 - protein, 9 aa, Homo Sapiens
GDLADSFFI

SEQ ID NO: 349466 - protein, 9 aa, Homo Sapiens
KRNLFQHQV

SEQ ID NO: 349467 - protein, 9 aa, Homo Sapiens
GRQTKMIWF

SEQ ID NO: 349468 - protein, 9 aa, Homo Sapiens
EIQGTVEFL

SEQ ID NO: 349469 - protein, 9 aa, Homo Sapiens
LSDKDMDIN

SEQ ID NO: 349470 - protein, 9 aa, Homo Sapiens
DLGKIVECT

SEQ ID NO: 349471 - protein, 9 aa, Homo Sapiens
KVANTSYFH

SEQ ID NO: 349472 - protein, 9 aa, Homo Sapiens
SRPKPERNI

SEQ ID NO: 349473 - protein, 9 aa, Homo Sapiens
NTQTVLLTP

SEQ ID NO: 349474 - protein, 9 aa, Homo Sapiens
KFHLVAHQR

SEQ ID NO: 349475 - protein, 9 aa, Homo Sapiens
HFDNTYSFV

SEQ ID NO: 349476 - protein, 9 aa, Homo Sapiens
LKEINKWTV

SEQ ID NO: 349477 - protein, 9 aa, Homo Sapiens
LGGLADLFG

SEQ ID NO: 349478 - protein, 9 aa, Homo Sapiens
EAEMFGWNF

SEQ ID NO: 349479 - protein, 9 aa, Homo Sapiens
LVKRLEYLV

SEQ ID NO: 349480 - protein, 9 aa, Homo Sapiens
IYVFQDFLF

SEQ ID NO: 349481 - protein, 9 aa, Homo Sapiens
LCQSPLLDS

SEQ ID NO: 349482 - protein, 9 aa, Homo Sapiens
KSGYTGQHC

SEQ ID NO: 349483 - protein, 9 aa, Homo Sapiens
QECSPGVVS

SEQ ID NO: 349484 - protein, 9 aa, Homo Sapiens
AITATQCRL

SEQ ID NO: 349485 - protein, 9 aa, Homo Sapiens
NHKALKALL

SEQ ID NO: 349486 - protein, 9 aa, Homo Sapiens
QSINFQSVG

SEQ ID NO: 349487 - protein, 9 aa, Homo Sapiens
FVAFAINLI

SEQ ID NO: 349488 - protein, 9 aa, Homo Sapiens
LSTSADSLA

SEQ ID NO: 349489 - protein, 9 aa, Homo Sapiens
TVLDVLEGQ

SEQ ID NO: 349490 - protein, 9 aa, Homo Sapiens
SSQSGGKPD

SEQ ID NO: 349491 - protein, 9 aa, Homo Sapiens
TSKLFSEEN

SEQ ID NO: 349492 - protein, 9 aa, Homo Sapiens
HVWEDNWDN

SEQ ID NO: 349493 - protein, 9 aa, Homo Sapiens
YSELNKWSC

SEQ ID NO: 349494 - protein, 9 aa, Homo Sapiens
TGYNEINNV

SEQ ID NO: 349495 - protein, 9 aa, Homo Sapiens
ECVQLVCPD

SEQ ID NO: 349496 - protein, 9 aa, Homo Sapiens
HLLFVRRQN

SEQ ID NO: 349497 - protein, 9 aa, Homo Sapiens
TDCGGGYVK

SEQ ID NO: 349498 - protein, 9 aa, Homo Sapiens
WANILEKDK

SEQ ID NO: 349499 - protein, 9 aa, Homo Sapiens
SLFFCPVYK

SEQ ID NO: 349500 - protein, 9 aa, Homo Sapiens
IFIFEWWCF

SEQ ID NO: 349501 - protein, 9 aa, Homo Sapiens
QVKQKSMQG

SEQ ID NO: 349502 - protein, 9 aa, Homo Sapiens
EDRRRAATC

SEQ ID NO: 349503 - protein, 9 aa, Homo Sapiens
RDKDYGQNG

SEQ ID NO: 349504 - protein, 9 aa, Homo Sapiens
LNFNQTLRL

SEQ ID NO: 349505 - protein, 9 aa, Homo Sapiens
LVMSDKSIF

SEQ ID NO: 349506 - protein, 9 aa, Homo Sapiens
KRLEKLLTK

SEQ ID NO: 349507 - protein, 9 aa, Homo Sapiens
CCFWPVGIT

SEQ ID NO: 349508 - protein, 9 aa, Homo Sapiens
RQEHFGGAM

SEQ ID NO: 349509 - protein, 9 aa, Homo Sapiens
LVTKQAFNI

SEQ ID NO: 349510 - protein, 9 aa, Homo Sapiens
METEEEPPQ

SEQ ID NO: 349511 - protein, 9 aa, Homo Sapiens
SVVHLINYY

SEQ ID NO: 349512 - protein, 9 aa, Homo Sapiens
GEGLRYFSG

SEQ ID NO: 349513 - protein, 9 aa, Homo Sapiens
DCGKSFCHS

SEQ ID NO: 349514 - protein, 9 aa, Homo Sapiens
TATVKEKKE

SEQ ID NO: 349515 - protein, 9 aa, Homo Sapiens
SPDYLEFSP

SEQ ID NO: 349516 - protein, 9 aa, Homo Sapiens
QRDYSLPFY

SEQ ID NO: 349517 - protein, 9 aa, Homo Sapiens
LDERQDAHL

SEQ ID NO: 349518 - protein, 9 aa, Homo Sapiens
CMAKNEVGS

SEQ ID NO: 349519 - protein, 9 aa, Homo Sapiens
DEELDYLPQ

SEQ ID NO: 349520 - protein, 9 aa, Homo Sapiens
SMGVLSGKI

SEQ ID NO: 349521 - protein, 9 aa, Homo Sapiens
MEVNINGES

SEQ ID NO: 349522 - protein, 9 aa, Homo Sapiens
DKLQCDLQD

SEQ ID NO: 349523 - protein, 9 aa, Homo Sapiens
KVREMMNQV

SEQ ID NO: 349524 - protein, 9 aa, Homo Sapiens
TNLLELEHI

SEQ ID NO: 349525 - protein, 9 aa, Homo Sapiens
VTRSLKYFS

SEQ ID NO: 349526 - protein, 9 aa, Homo Sapiens
KSDSDEEEE

SEQ ID NO: 349527 - protein, 9 aa, Homo Sapiens
DNPKESSPF

SEQ ID NO: 349528 - protein, 9 aa, Homo Sapiens
QSPRCRHAR

SEQ ID NO: 349529 - protein, 9 aa, Homo Sapiens
WDGESSLSV

SEQ ID NO: 349530 - protein, 9 aa, Homo Sapiens
GGLECHLKI

SEQ ID NO: 349531 - protein, 9 aa, Homo Sapiens
LRGLPPMHM

SEQ ID NO: 349532 - protein, 9 aa, Homo Sapiens
TEVEISMTS

SEQ ID NO: 349533 - protein, 9 aa, Homo Sapiens
LAVLRISSA

SEQ ID NO: 349534 - protein, 9 aa, Homo Sapiens
SMFLTLLHF

SEQ ID NO: 349535 - protein, 9 aa, Homo Sapiens
SAAWNETLL

SEQ ID NO: 349536 - protein, 9 aa, Homo Sapiens
ITDKLSLSL

SEQ ID NO: 349537 - protein, 9 aa, Homo Sapiens
ITTHCLAYS

SEQ ID NO: 349538 - protein, 9 aa, Homo Sapiens
GKVFLVHKI

SEQ ID NO: 349539 - protein, 9 aa, Homo Sapiens
LLECGKDGP

SEQ ID NO: 349540 - protein, 9 aa, Homo Sapiens
LDQYQHVPV

SEQ ID NO: 349541 - protein, 9 aa, Homo Sapiens
VLFLYTAEL

SEQ ID NO: 349542 - protein, 9 aa, Homo Sapiens
YLNLLFRIL

SEQ ID NO: 349543 - protein, 9 aa, Homo Sapiens
LLQGYHFTT

SEQ ID NO: 349544 - protein, 9 aa, Homo Sapiens
RQQHTSSLR

SEQ ID NO: 349545 - protein, 9 aa, Homo Sapiens
WQVVLLDSN

SEQ ID NO: 349546 - protein, 9 aa, Homo Sapiens
KKVDGLIER

SEQ ID NO: 349547 - protein, 9 aa, Homo Sapiens
QVLGKKIKQ

SEQ ID NO: 349548 - protein, 9 aa, Homo Sapiens
THNTYQHFY

SEQ ID NO: 349549 - protein, 9 aa, Homo Sapiens
DRAAGLKEN

SEQ ID NO: 349550 - protein, 9 aa, Homo Sapiens
KHLRVLFIT

SEQ ID NO: 349551 - protein, 9 aa, Homo Sapiens
QFCKESFTG

SEQ ID NO: 349552 - protein, 9 aa, Homo Sapiens
IQFNVVMCR

SEQ ID NO: 349553 - protein, 9 aa, Homo Sapiens
LPTMSPTLS

SEQ ID NO: 349554 - protein, 9 aa, Homo Sapiens
GAISVPNLS

SEQ ID NO: 349555 - protein, 9 aa, Homo Sapiens
HKRTHTAEK

SEQ ID NO: 349556 - protein, 9 aa, Homo Sapiens
RLSSFSLRD

SEQ ID NO: 349557 - protein, 9 aa, Homo Sapiens
ENCAVREKL

SEQ ID NO: 349558 - protein, 9 aa, Homo Sapiens
QNKQIFLRN

SEQ ID NO: 349559 - protein, 9 aa, Homo Sapiens
MFPDIIARA

SEQ ID NO: 349560 - protein, 9 aa, Homo Sapiens
DDTPWASTF

SEQ ID NO: 349561 - protein, 9 aa, Homo Sapiens
GVDTSPPRR

SEQ ID NO: 349562 - protein, 9 aa, Homo Sapiens
PSVVSLTPA

SEQ ID NO: 349563 - protein, 9 aa, Homo Sapiens
PEGIQLQCF

SEQ ID NO: 349564 - protein, 9 aa, Homo Sapiens
SGNTPITVW

SEQ ID NO: 349565 - protein, 9 aa, Homo Sapiens
REHSQMDTY

SEQ ID NO: 349566 - protein, 9 aa, Homo Sapiens
KENIQIILE

SEQ ID NO: 349567 - protein, 9 aa, Homo Sapiens
YFRVPELVD

SEQ ID NO: 349568 - protein, 9 aa, Homo Sapiens
VLSSGKYTG

SEQ ID NO: 349569 - protein, 9 aa, Homo Sapiens
YKIIYRPSG

SEQ ID NO: 349570 - protein, 9 aa, Homo Sapiens
SLQDLQQKY

SEQ ID NO: 349571 - protein, 9 aa, Homo Sapiens
RYVVCYTSA

SEQ ID NO: 349572 - protein, 9 aa, Homo Sapiens
RLDLILCNN

SEQ ID NO: 349573 - protein, 9 aa, Homo Sapiens
VLAYERYIC

SEQ ID NO: 349574 - protein, 9 aa, Homo Sapiens
TNKCQEQQQ

SEQ ID NO: 349575 - protein, 9 aa, Homo Sapiens
EDVTHLEVL

SEQ ID NO: 349576 - protein, 9 aa, Homo Sapiens
GNLEHVKIN

SEQ ID NO: 349577 - protein, 9 aa, Homo Sapiens
QKLIQSLFL

SEQ ID NO: 349578 - protein, 9 aa, Homo Sapiens
FLVILVATL

SEQ ID NO: 349579 - protein, 9 aa, Homo Sapiens
QGWQNNDRV

SEQ ID NO: 349580 - protein, 9 aa, Homo Sapiens
TDIFQDVKW

SEQ ID NO: 349581 - protein, 9 aa, Homo Sapiens
QVQIKIYSK

SEQ ID NO: 349582 - protein, 9 aa, Homo Sapiens
LTFLNFLLF

SEQ ID NO: 349583 - protein, 9 aa, Homo Sapiens
LNSLSELAP

SEQ ID NO: 349584 - protein, 9 aa, Homo Sapiens
RQINILREK

SEQ ID NO: 349585 - protein, 9 aa, Homo Sapiens
LDEGHAIQN

SEQ ID NO: 349586 - protein, 9 aa, Homo Sapiens
KKANLQVIN

SEQ ID NO: 349587 - protein, 9 aa, Homo Sapiens
YFGPVFTEV

SEQ ID NO: 349588 - protein, 9 aa, Homo Sapiens
SEITEKPPQ

SEQ ID NO: 349589 - protein, 9 aa, Homo Sapiens
HCPLYKSSK

SEQ ID NO: 349590 - protein, 9 aa, Homo Sapiens
DIINWLDKN

SEQ ID NO: 349591 - protein, 9 aa, Homo Sapiens
FEDGNTVKL

SEQ ID NO: 349592 - protein, 9 aa, Homo Sapiens
LNLGGMATI

SEQ ID NO: 349593 - protein, 9 aa, Homo Sapiens
QRKDLALWT

SEQ ID NO: 349594 - protein, 9 aa, Homo Sapiens
IGIYGWRKC

SEQ ID NO: 349595 - protein, 9 aa, Homo Sapiens
KASGQTVDD

SEQ ID NO: 349596 - protein, 9 aa, Homo Sapiens
IECGKLFRH

SEQ ID NO: 349597 - protein, 9 aa, Homo Sapiens
IKKGGLDGV

SEQ ID NO: 349598 - protein, 9 aa, Homo Sapiens
FVHFLFYWN

SEQ ID NO: 349599 - protein, 9 aa, Homo Sapiens
YKVNNLGVC

SEQ ID NO: 349600 - protein, 9 aa, Homo Sapiens
LFRGLSLND

SEQ ID NO: 349601 - protein, 9 aa, Homo Sapiens
TNDSSAAWD

SEQ ID NO: 349602 - protein, 9 aa, Homo Sapiens
NLTILIYVF

SEQ ID NO: 349603 - protein, 9 aa, Homo Sapiens
GVSKGYVFQ

SEQ ID NO: 349604 - protein, 9 aa, Homo Sapiens
FHFFVAIQV

SEQ ID NO: 349605 - protein, 9 aa, Homo Sapiens
SREEQVKQK

SEQ ID NO: 349606 - protein, 9 aa, Homo Sapiens
YTLNADNKT

SEQ ID NO: 349607 - protein, 9 aa, Homo Sapiens
LHAVMKKVL

SEQ ID NO: 349608 - protein, 9 aa, Homo Sapiens
SIDLSASSS

SEQ ID NO: 349609 - protein, 9 aa, Homo Sapiens
IQEQQNVLK

SEQ ID NO: 349610 - protein, 9 aa, Homo Sapiens
PVEVFESLL

SEQ ID NO: 349611 - protein, 9 aa, Homo Sapiens
AVCKDEINI

SEQ ID NO: 349612 - protein, 9 aa, Homo Sapiens
PASACARCA

SEQ ID NO: 349613 - protein, 9 aa, Homo Sapiens
LYFDCWFQI

SEQ ID NO: 349614 - protein, 9 aa, Homo Sapiens
FPFGVRIYY

SEQ ID NO: 349615 - protein, 9 aa, Homo Sapiens
KTLVIEDNV

SEQ ID NO: 349616 - protein, 9 aa, Homo Sapiens
WIQTKPSDI

SEQ ID NO: 349617 - protein, 9 aa, Homo Sapiens
EPKHSRTAY

SEQ ID NO: 349618 - protein, 9 aa, Homo Sapiens
TQLELDPKC

SEQ ID NO: 349619 - protein, 9 aa, Homo Sapiens
PLLDSRERG

SEQ ID NO: 349620 - protein, 9 aa, Homo Sapiens
IDLNKENKI

SEQ ID NO: 349621 - protein, 9 aa, Homo Sapiens
GHTPHSGDN

SEQ ID NO: 349622 - protein, 9 aa, Homo Sapiens
GKDHKSNSK

SEQ ID NO: 349623 - protein, 9 aa, Homo Sapiens
SNLKEVLNV

SEQ ID NO: 349624 - protein, 9 aa, Homo Sapiens
ERRGVAVKG

SEQ ID NO: 349625 - protein, 9 aa, Homo Sapiens
ILMGKIFQT

SEQ ID NO: 349626 - protein, 9 aa, Homo Sapiens
EKQTETTAD

SEQ ID NO: 349627 - protein, 9 aa, Homo Sapiens
LADNFYAIS

SEQ ID NO: 349628 - protein, 9 aa, Homo Sapiens
ITWDKKGMD

SEQ ID NO: 349629 - protein, 9 aa, Homo Sapiens
KIIDGICGQ

SEQ ID NO: 349630 - protein, 9 aa, Homo Sapiens
SSPMEKDIM

SEQ ID NO: 349631 - protein, 9 aa, Homo Sapiens
SNGSAKVPV

SEQ ID NO: 349632 - protein, 9 aa, Homo Sapiens
TRILKPKEQ

SEQ ID NO: 349633 - protein, 9 aa, Homo Sapiens
TMKLNSLSE

SEQ ID NO: 349634 - protein, 9 aa, Homo Sapiens
LGVLPYFWE

SEQ ID NO: 349635 - protein, 9 aa, Homo Sapiens
DVFSKYGNT

SEQ ID NO: 349636 - protein, 9 aa, Homo Sapiens
PVWLYEQLL

SEQ ID NO: 349637 - protein, 9 aa, Homo Sapiens
DKHATLWGA

SEQ ID NO: 349638 - protein, 9 aa, Homo Sapiens
VNTEDNKGL

SEQ ID NO: 349639 - protein, 9 aa, Homo Sapiens
FIHFIEECS

SEQ ID NO: 349640 - protein, 9 aa, Homo Sapiens
LDRKKVQQY

SEQ ID NO: 349641 - protein, 9 aa, Homo Sapiens
NSSLISPLQ

SEQ ID NO: 349642 - protein, 9 aa, Homo Sapiens
NTHVTQVTE

SEQ ID NO: 349643 - protein, 9 aa, Homo Sapiens
NVFVFLLGL

SEQ ID NO: 349644 - protein, 9 aa, Homo Sapiens
SVCEYAFNR

SEQ ID NO: 349645 - protein, 9 aa, Homo Sapiens
AISDVEAKE

SEQ ID NO: 349646 - protein, 9 aa, Homo Sapiens
DLPLADKGM

SEQ ID NO: 349647 - protein, 9 aa, Homo Sapiens
TLVEELKAL

SEQ ID NO: 349648 - protein, 9 aa, Homo Sapiens
KNKPFYTLQ

SEQ ID NO: 349649 - protein, 9 aa, Homo Sapiens
SLQELCHME

SEQ ID NO: 349650 - protein, 9 aa, Homo Sapiens
IASCRDRLS

SEQ ID NO: 349651 - protein, 9 aa, Homo Sapiens
TEADGTQGK

SEQ ID NO: 349652 - protein, 9 aa, Homo Sapiens
MYTTQVQKL

SEQ ID NO: 349653 - protein, 9 aa, Homo Sapiens
AKWKDRQKS

SEQ ID NO: 349654 - protein, 9 aa, Homo Sapiens
HYLICVEPF

SEQ ID NO: 349655 - protein, 9 aa, Homo Sapiens
MIIPDPEKP

SEQ ID NO: 349656 - protein, 9 aa, Homo Sapiens
FDNTCVVPE

SEQ ID NO: 349657 - protein, 9 aa, Homo Sapiens
EEKGPMFKL

SEQ ID NO: 349658 - protein, 9 aa, Homo Sapiens
NKSFKCKKR

SEQ ID NO: 349659 - protein, 9 aa, Homo Sapiens
LRPTVNAYT

SEQ ID NO: 349660 - protein, 9 aa, Homo Sapiens
EEREAESGG

SEQ ID NO: 349661 - protein, 9 aa, Homo Sapiens
HKARGEGVP

SEQ ID NO: 349662 - protein, 9 aa, Homo Sapiens
SEKDKKENK

SEQ ID NO: 349663 - protein, 9 aa, Homo Sapiens
QPEVDTYWP

SEQ ID NO: 349664 - protein, 9 aa, Homo Sapiens
SVELETIFK

SEQ ID NO: 349665 - protein, 9 aa, Homo Sapiens
NGGTCRNLV

SEQ ID NO: 349666 - protein, 9 aa, Homo Sapiens
MFSIQIMKT

SEQ ID NO: 349667 - protein, 9 aa, Homo Sapiens
HSDYICCIA

SEQ ID NO: 349668 - protein, 9 aa, Homo Sapiens
YRYNTPGHN

SEQ ID NO: 349669 - protein, 9 aa, Homo Sapiens
YFQTYGSAT

SEQ ID NO: 349670 - protein, 9 aa, Homo Sapiens
FIDELITKW

SEQ ID NO: 349671 - protein, 9 aa, Homo Sapiens
AWLRCALNK

SEQ ID NO: 349672 - protein, 9 aa, Homo Sapiens
IFYQCIYGR

SEQ ID NO: 349673 - protein, 9 aa, Homo Sapiens
MAGGLIYSF

SEQ ID NO: 349674 - protein, 9 aa, Homo Sapiens
GNPNDDIQY

SEQ ID NO: 349675 - protein, 9 aa, Homo Sapiens
QLRNQLGQQ

SEQ ID NO: 349676 - protein, 9 aa, Homo Sapiens
AAQEFVQRL

SEQ ID NO: 349677 - protein, 9 aa, Homo Sapiens
VLLQNQVAH

SEQ ID NO: 349678 - protein, 9 aa, Homo Sapiens
QQYRSNVPN

SEQ ID NO: 349679 - protein, 9 aa, Homo Sapiens
TEQIANFQE

SEQ ID NO: 349680 - protein, 9 aa, Homo Sapiens
VWHDKDNDT

SEQ ID NO: 349681 - protein, 9 aa, Homo Sapiens
LSNTTVVTP

SEQ ID NO: 349682 - protein, 9 aa, Homo Sapiens
HSDLPPGTN

SEQ ID NO: 349683 - protein, 9 aa, Homo Sapiens
KEFINLLLD

SEQ ID NO: 349684 - protein, 9 aa, Homo Sapiens
LTLEQIKFY

SEQ ID NO: 349685 - protein, 9 aa, Homo Sapiens
DITAQYSAD

SEQ ID NO: 349686 - protein, 9 aa, Homo Sapiens
QLVNKTIII

SEQ ID NO: 349687 - protein, 9 aa, Homo Sapiens
GLLGVCIGD

SEQ ID NO: 349688 - protein, 9 aa, Homo Sapiens
SSARTKLEP

SEQ ID NO: 349689 - protein, 9 aa, Homo Sapiens
GIKCYLYPD

SEQ ID NO: 349690 - protein, 9 aa, Homo Sapiens
GVICCPVCS

SEQ ID NO: 349691 - protein, 9 aa, Homo Sapiens
AEEEPNRMP

SEQ ID NO: 349692 - protein, 9 aa, Homo Sapiens
KNTCFEWAS

SEQ ID NO: 349693 - protein, 9 aa, Homo Sapiens
VNVLSRKLC

SEQ ID NO: 349694 - protein, 9 aa, Homo Sapiens
QHQRIHTGG

SEQ ID NO: 349695 - protein, 9 aa, Homo Sapiens
KQKPASSEP

SEQ ID NO: 349696 - protein, 9 aa, Homo Sapiens
SATMNGIIK

SEQ ID NO: 349697 - protein, 9 aa, Homo Sapiens
FLEHQTQVL

SEQ ID NO: 349698 - protein, 9 aa, Homo Sapiens
GLKDYFQKV

SEQ ID NO: 349699 - protein, 9 aa, Homo Sapiens
DFRNKLQGQ

SEQ ID NO: 349700 - protein, 9 aa, Homo Sapiens
ASIHQLEGT

SEQ ID NO: 349701 - protein, 9 aa, Homo Sapiens
IIMNPRICG

SEQ ID NO: 349702 - protein, 9 aa, Homo Sapiens
NHNPYPSSV

SEQ ID NO: 349703 - protein, 9 aa, Homo Sapiens
INELIGLVR

SEQ ID NO: 349704 - protein, 9 aa, Homo Sapiens
ECHMLAVMA

SEQ ID NO: 349705 - protein, 9 aa, Homo Sapiens
KNIISPLWD

SEQ ID NO: 349706 - protein, 9 aa, Homo Sapiens
YKNNQIENY

SEQ ID NO: 349707 - protein, 9 aa, Homo Sapiens
IRFKKFLPV

SEQ ID NO: 349708 - protein, 9 aa, Homo Sapiens
GTADLFAFS

SEQ ID NO: 349709 - protein, 9 aa, Homo Sapiens
LILLFYKVS

SEQ ID NO: 349710 - protein, 9 aa, Homo Sapiens
ATYFKISHK

SEQ ID NO: 349711 - protein, 9 aa, Homo Sapiens
NTSQMHWTP

SEQ ID NO: 349712 - protein, 9 aa, Homo Sapiens
HIDLVKTRM

SEQ ID NO: 349713 - protein, 9 aa, Homo Sapiens
METREGLNM

SEQ ID NO: 349714 - protein, 9 aa, Homo Sapiens
KGQFIDELI

SEQ ID NO: 349715 - protein, 9 aa, Homo Sapiens
TSEDASIHQ

SEQ ID NO: 349716 - protein, 9 aa, Homo Sapiens
ASMFLTLLH

SEQ ID NO: 349717 - protein, 9 aa, Homo Sapiens
PRKHLCVWI

SEQ ID NO: 349718 - protein, 9 aa, Homo Sapiens
RCINMTDTG

SEQ ID NO: 349719 - protein, 9 aa, Homo Sapiens
FSSITNHKI

SEQ ID NO: 349720 - protein, 9 aa, Homo Sapiens
EELWQRLNN

SEQ ID NO: 349721 - protein, 9 aa, Homo Sapiens
CARNGEYIT

SEQ ID NO: 349722 - protein, 9 aa, Homo Sapiens
GKNKKVRKG

SEQ ID NO: 349723 - protein, 9 aa, Homo Sapiens
TLTLGVLNL

SEQ ID NO: 349724 - protein, 9 aa, Homo Sapiens
GQQGEQGDN

SEQ ID NO: 349725 - protein, 9 aa, Homo Sapiens
KVGATLVLM

SEQ ID NO: 349726 - protein, 9 aa, Homo Sapiens
GMLPNTVLP

SEQ ID NO: 349727 - protein, 9 aa, Homo Sapiens
LRNKAIIWH

SEQ ID NO: 349728 - protein, 9 aa, Homo Sapiens
TPPISNLTT

SEQ ID NO: 349729 - protein, 9 aa, Homo Sapiens
HVNMKAKRC

SEQ ID NO: 349730 - protein, 9 aa, Homo Sapiens
DSCRFADND

SEQ ID NO: 349731 - protein, 9 aa, Homo Sapiens
EVVKFDRSK

SEQ ID NO: 349732 - protein, 9 aa, Homo Sapiens
NHTQNKCNQ

SEQ ID NO: 349733 - protein, 9 aa, Homo Sapiens
IQDVQRESE

SEQ ID NO: 349734 - protein, 9 aa, Homo Sapiens
FKGLVSLEQ

SEQ ID NO: 349735 - protein, 9 aa, Homo Sapiens
QTPSQTHKE

SEQ ID NO: 349736 - protein, 9 aa, Homo Sapiens
DVKCLNFRK

SEQ ID NO: 349737 - protein, 9 aa, Homo Sapiens
YSEDVVYYA

SEQ ID NO: 349738 - protein, 9 aa, Homo Sapiens
TQLICQQKK

SEQ ID NO: 349739 - protein, 9 aa, Homo Sapiens
TAERGNYLT

SEQ ID NO: 349740 - protein, 9 aa, Homo Sapiens
NLAANNVFP

SEQ ID NO: 349741 - protein, 9 aa, Homo Sapiens
EQPYECHEC

SEQ ID NO: 349742 - protein, 9 aa, Homo Sapiens
GDATTRHHL

SEQ ID NO: 349743 - protein, 9 aa, Homo Sapiens
VYGVRLAAK

SEQ ID NO: 349744 - protein, 9 aa, Homo Sapiens
YATIQTESI

SEQ ID NO: 349745 - protein, 9 aa, Homo Sapiens
LKPHKVCAS

SEQ ID NO: 349746 - protein, 9 aa, Homo Sapiens
RESGKKRKI

SEQ ID NO: 349747 - protein, 9 aa, Homo Sapiens
GKILFENPD

SEQ ID NO: 349748 - protein, 9 aa, Homo Sapiens
PYQCEECGN

SEQ ID NO: 349749 - protein, 9 aa, Homo Sapiens
EVWEAFDLF

SEQ ID NO: 349750 - protein, 9 aa, Homo Sapiens
QLVKKIWVP

SEQ ID NO: 349751 - protein, 9 aa, Homo Sapiens
LEIPLGSYY

SEQ ID NO: 349752 - protein, 9 aa, Homo Sapiens
TNHCRRVVC

SEQ ID NO: 349753 - protein, 9 aa, Homo Sapiens
DRITTIKHW

SEQ ID NO: 349754 - protein, 9 aa, Homo Sapiens
EDKWLLQKK

SEQ ID NO: 349755 - protein, 9 aa, Homo Sapiens
KEQMYKLAK

SEQ ID NO: 349756 - protein, 9 aa, Homo Sapiens
NNGPGSTRG

SEQ ID NO: 349757 - protein, 9 aa, Homo Sapiens
PSNVACSLP

SEQ ID NO: 349758 - protein, 9 aa, Homo Sapiens
LALRRNKEY

SEQ ID NO: 349759 - protein, 9 aa, Homo Sapiens
TDANEAPQF

SEQ ID NO: 349760 - protein, 9 aa, Homo Sapiens
QGTPGVLRD

SEQ ID NO: 349761 - protein, 9 aa, Homo Sapiens
GGRYYCKVE

SEQ ID NO: 349762 - protein, 9 aa, Homo Sapiens
KIKAIKLAE

SEQ ID NO: 349763 - protein, 9 aa, Homo Sapiens
MYTTLFTLE

SEQ ID NO: 349764 - protein, 9 aa, Homo Sapiens
TINSYEMQN

SEQ ID NO: 349765 - protein, 9 aa, Homo Sapiens
FHTFLKTEF

SEQ ID NO: 349766 - protein, 9 aa, Homo Sapiens
EKRRGCASA

SEQ ID NO: 349767 - protein, 9 aa, Homo Sapiens
PEYLNLPRR

SEQ ID NO: 349768 - protein, 9 aa, Homo Sapiens
ENCLSAQGD

SEQ ID NO: 349769 - protein, 9 aa, Homo Sapiens
GIQSEYCIR

SEQ ID NO: 349770 - protein, 9 aa, Homo Sapiens
RDVCFNTAG

SEQ ID NO: 349771 - protein, 9 aa, Homo Sapiens
IVQFLVQLD

SEQ ID NO: 349772 - protein, 9 aa, Homo Sapiens
LNNLLTDVL

SEQ ID NO: 349773 - protein, 9 aa, Homo Sapiens
CALYICDLS

SEQ ID NO: 349774 - protein, 9 aa, Homo Sapiens
TNVEEEKNK

SEQ ID NO: 349775 - protein, 9 aa, Homo Sapiens
VCYKIITLK

SEQ ID NO: 349776 - protein, 9 aa, Homo Sapiens
NGRGGNQAG

SEQ ID NO: 349777 - protein, 9 aa, Homo Sapiens
YAQVHIAED

SEQ ID NO: 349778 - protein, 9 aa, Homo Sapiens
LIEKNIKLF

SEQ ID NO: 349779 - protein, 9 aa, Homo Sapiens
EMTFGKVKS

SEQ ID NO: 349780 - protein, 9 aa, Homo Sapiens
CQIHFGDNI

SEQ ID NO: 349781 - protein, 9 aa, Homo Sapiens
RQEINAAQP

SEQ ID NO: 349782 - protein, 9 aa, Homo Sapiens
MKSNLENIN

SEQ ID NO: 349783 - protein, 9 aa, Homo Sapiens
RRRMDTEEQ

SEQ ID NO: 349784 - protein, 9 aa, Homo Sapiens
TLGEIITGV

SEQ ID NO: 349785 - protein, 9 aa, Homo Sapiens
NKTIIILDK

SEQ ID NO: 349786 - protein, 9 aa, Homo Sapiens
VIEVTTQNV

SEQ ID NO: 349787 - protein, 9 aa, Homo Sapiens
IRPIPEDNF

SEQ ID NO: 349788 - protein, 9 aa, Homo Sapiens
TLEMSSSML

SEQ ID NO: 349789 - protein, 9 aa, Homo Sapiens
DNGWDSGSN

SEQ ID NO: 349790 - protein, 9 aa, Homo Sapiens
LDAFFKIIQ

SEQ ID NO: 349791 - protein, 9 aa, Homo Sapiens
QVKSVISDG

SEQ ID NO: 349792 - protein, 9 aa, Homo Sapiens
STENNCAKF

SEQ ID NO: 349793 - protein, 9 aa, Homo Sapiens
ELRDAELAQ

SEQ ID NO: 349794 - protein, 9 aa, Homo Sapiens
HEPPHLANL

SEQ ID NO: 349795 - protein, 9 aa, Homo Sapiens
DKIDEIRRV

SEQ ID NO: 349796 - protein, 9 aa, Homo Sapiens
SVNSVFTFF

SEQ ID NO: 349797 - protein, 9 aa, Homo Sapiens
STLNSSKPT

SEQ ID NO: 349798 - protein, 9 aa, Homo Sapiens
GTSVYYITF

SEQ ID NO: 349799 - protein, 9 aa, Homo Sapiens
TRSHVARVI

SEQ ID NO: 349800 - protein, 9 aa, Homo Sapiens
GAQVASLSW

SEQ ID NO: 349801 - protein, 9 aa, Homo Sapiens
LRCALNKHS

SEQ ID NO: 349802 - protein, 9 aa, Homo Sapiens
SIGAVWGVK

SEQ ID NO: 349803 - protein, 9 aa, Homo Sapiens
NEYSLWDCP

SEQ ID NO: 349804 - protein, 9 aa, Homo Sapiens
KLPDYSPFS

SEQ ID NO: 349805 - protein, 9 aa, Homo Sapiens
RSGVFTDIE

SEQ ID NO: 349806 - protein, 9 aa, Homo Sapiens
PTYTSLTAL

SEQ ID NO: 349807 - protein, 9 aa, Homo Sapiens
EIVVLIKLY

SEQ ID NO: 349808 - protein, 9 aa, Homo Sapiens
HTVIIFPYL

SEQ ID NO: 349809 - protein, 9 aa, Homo Sapiens
VSHKARGEG

SEQ ID NO: 349810 - protein, 9 aa, Homo Sapiens
KSVSLQYKN

SEQ ID NO: 349811 - protein, 9 aa, Homo Sapiens
VVVAALRQA

SEQ ID NO: 349812 - protein, 9 aa, Homo Sapiens
RYCINLAAL

SEQ ID NO: 349813 - protein, 9 aa, Homo Sapiens
EFLMKDGDK

SEQ ID NO: 349814 - protein, 9 aa, Homo Sapiens
IYVTEADLV

SEQ ID NO: 349815 - protein, 9 aa, Homo Sapiens
SAQLISELQ

SEQ ID NO: 349816 - protein, 9 aa, Homo Sapiens
RSKLIRDSM

SEQ ID NO: 349817 - protein, 9 aa, Homo Sapiens
MLPNTVLPP

SEQ ID NO: 349818 - protein, 9 aa, Homo Sapiens
KREPFAETD

SEQ ID NO: 349819 - protein, 9 aa, Homo Sapiens
TNLTSSIMQ

SEQ ID NO: 349820 - protein, 9 aa, Homo Sapiens
ELTVLDKCQ

SEQ ID NO: 349821 - protein, 9 aa, Homo Sapiens
LRVQALDRR

SEQ ID NO: 349822 - protein, 9 aa, Homo Sapiens
HYKFFCDVS

SEQ ID NO: 349823 - protein, 9 aa, Homo Sapiens
TLPSRRTLN

SEQ ID NO: 349824 - protein, 9 aa, Homo Sapiens
MDVGVSHKA

SEQ ID NO: 349825 - protein, 9 aa, Homo Sapiens
KEIKECAAI

SEQ ID NO: 349826 - protein, 9 aa, Homo Sapiens
TQPPEKRRI

SEQ ID NO: 349827 - protein, 9 aa, Homo Sapiens
FWRKEDLDA

SEQ ID NO: 349828 - protein, 9 aa, Homo Sapiens
IISPLWDFR

SEQ ID NO: 349829 - protein, 9 aa, Homo Sapiens
DTVQKQSES

SEQ ID NO: 349830 - protein, 9 aa, Homo Sapiens
LEETQLAGL

SEQ ID NO: 349831 - protein, 9 aa, Homo Sapiens
DSQSDKHTV

SEQ ID NO: 349832 - protein, 9 aa, Homo Sapiens
LLAARANYQ

SEQ ID NO: 349833 - protein, 9 aa, Homo Sapiens
GRSHHYHRK

SEQ ID NO: 349834 - protein, 9 aa, Homo Sapiens
PQHYPMAFP

SEQ ID NO: 349835 - protein, 9 aa, Homo Sapiens
YRNLQIANN

SEQ ID NO: 349836 - protein, 9 aa, Homo Sapiens
SYTLFVRKN

SEQ ID NO: 349837 - protein, 9 aa, Homo Sapiens
GGSKAPVPY

SEQ ID NO: 349838 - protein, 9 aa, Homo Sapiens
LDMLLQHQI

SEQ ID NO: 349839 - protein, 9 aa, Homo Sapiens
ADPQCIPSN

SEQ ID NO: 349840 - protein, 9 aa, Homo Sapiens
LNTHVTQVT

SEQ ID NO: 349841 - protein, 9 aa, Homo Sapiens
QSTVSISVV

SEQ ID NO: 349842 - protein, 9 aa, Homo Sapiens
ELSLLEKKK

SEQ ID NO: 349843 - protein, 9 aa, Homo Sapiens
NNISHDTFG

SEQ ID NO: 349844 - protein, 9 aa, Homo Sapiens
YFVLGHLSF

SEQ ID NO: 349845 - protein, 9 aa, Homo Sapiens
VTPSDKGMD

SEQ ID NO: 349846 - protein, 9 aa, Homo Sapiens
QNLEAPYIP

SEQ ID NO: 349847 - protein, 9 aa, Homo Sapiens
QSGKSDSDE

SEQ ID NO: 349848 - protein, 9 aa, Homo Sapiens
NDLTFLRIC

SEQ ID NO: 349849 - protein, 9 aa, Homo Sapiens
MQNAVNDAG

SEQ ID NO: 349850 - protein, 9 aa, Homo Sapiens
NSAQNLTKY

SEQ ID NO: 349851 - protein, 9 aa, Homo Sapiens
LWKRLSVSE

SEQ ID NO: 349852 - protein, 9 aa, Homo Sapiens
LSTNTQENK

SEQ ID NO: 349853 - protein, 9 aa, Homo Sapiens
HFCYNVALE

SEQ ID NO: 349854 - protein, 9 aa, Homo Sapiens
DEALNTDKI

SEQ ID NO: 349855 - protein, 9 aa, Homo Sapiens
RAIVYCSFG

SEQ ID NO: 349856 - protein, 9 aa, Homo Sapiens
CNYRTALCG

SEQ ID NO: 349857 - protein, 9 aa, Homo Sapiens
PSEKSNEET

SEQ ID NO: 349858 - protein, 9 aa, Homo Sapiens
YLIFCIQRF

SEQ ID NO: 349859 - protein, 9 aa, Homo Sapiens
SLDKQYKHQ

SEQ ID NO: 349860 - protein, 9 aa, Homo Sapiens
ANGKGEKRA

SEQ ID NO: 349861 - protein, 9 aa, Homo Sapiens
AEDLPFTKG

SEQ ID NO: 349862 - protein, 9 aa, Homo Sapiens
KHNKLPLGL

SEQ ID NO: 349863 - protein, 9 aa, Homo Sapiens
ASVTVNTYS

SEQ ID NO: 349864 - protein, 9 aa, Homo Sapiens
IVTDANEAP

SEQ ID NO: 349865 - protein, 9 aa, Homo Sapiens
VIFAFEESI

SEQ ID NO: 349866 - protein, 9 aa, Homo Sapiens
TKNNGPGST

SEQ ID NO: 349867 - protein, 9 aa, Homo Sapiens
ECGKACNRI

SEQ ID NO: 349868 - protein, 9 aa, Homo Sapiens
VTDTRVQTM

SEQ ID NO: 349869 - protein, 9 aa, Homo Sapiens
DQNTGEIVI

SEQ ID NO: 349870 - protein, 9 aa, Homo Sapiens
NAYTLNSIA

SEQ ID NO: 349871 - protein, 9 aa, Homo Sapiens
LLGPPGRRY

SEQ ID NO: 349872 - protein, 9 aa, Homo Sapiens
SEYRFVSDQ

SEQ ID NO: 349873 - protein, 9 aa, Homo Sapiens
PTCGRSSCC

SEQ ID NO: 349874 - protein, 9 aa, Homo Sapiens
LEKYFYSFY

SEQ ID NO: 349875 - protein, 9 aa, Homo Sapiens
LFSWMLLVA

SEQ ID NO: 349876 - protein, 9 aa, Homo Sapiens
VALSSCHVD

SEQ ID NO: 349877 - protein, 9 aa, Homo Sapiens
GQCGKSFCQ

SEQ ID NO: 349878 - protein, 9 aa, Homo Sapiens
PVWSQVFSL

SEQ ID NO: 349879 - protein, 9 aa, Homo Sapiens
LDRINNNPD

SEQ ID NO: 349880 - protein, 9 aa, Homo Sapiens
KATEENKSL

SEQ ID NO: 349881 - protein, 9 aa, Homo Sapiens
INLDEGVNG

SEQ ID NO: 349882 - protein, 9 aa, Homo Sapiens
PVRALPADK

SEQ ID NO: 349883 - protein, 9 aa, Homo Sapiens
WLVFVGIYS

SEQ ID NO: 349884 - protein, 9 aa, Homo Sapiens
WFKWFIGLV

SEQ ID NO: 349885 - protein, 9 aa, Homo Sapiens
AENGLGSPV

SEQ ID NO: 349886 - protein, 9 aa, Homo Sapiens
CFFQEEMVK

SEQ ID NO: 349887 - protein, 9 aa, Homo Sapiens
SPTKLQDQT

SEQ ID NO: 349888 - protein, 9 aa, Homo Sapiens
LWGQSFCWK

SEQ ID NO: 349889 - protein, 9 aa, Homo Sapiens
LTLHQHTHT

SEQ ID NO: 349890 - protein, 9 aa, Homo Sapiens
SYSILESFI

SEQ ID NO: 349891 - protein, 9 aa, Homo Sapiens
NFFMTATQH

SEQ ID NO: 349892 - protein, 9 aa, Homo Sapiens
SESAATCLL

SEQ ID NO: 349893 - protein, 9 aa, Homo Sapiens
NNTDKNYLN

SEQ ID NO: 349894 - protein, 9 aa, Homo Sapiens
TEQLQKLVS

SEQ ID NO: 349895 - protein, 9 aa, Homo Sapiens
TEQSVAQVI

SEQ ID NO: 349896 - protein, 9 aa, Homo Sapiens
IDICQSNSA

SEQ ID NO: 349897 - protein, 9 aa, Homo Sapiens
CVVITPEIK

SEQ ID NO: 349898 - protein, 9 aa, Homo Sapiens
LGALEFSLF

SEQ ID NO: 349899 - protein, 9 aa, Homo Sapiens
RPKIRHTEN

SEQ ID NO: 349900 - protein, 9 aa, Homo Sapiens
HYPMAFPST

SEQ ID NO: 349901 - protein, 9 aa, Homo Sapiens
VQNCGTEKK

SEQ ID NO: 349902 - protein, 9 aa, Homo Sapiens
PAQHRLSEA

SEQ ID NO: 349903 - protein, 9 aa, Homo Sapiens
LKVNQFKNV

SEQ ID NO: 349904 - protein, 9 aa, Homo Sapiens
SEQIINQLT

SEQ ID NO: 349905 - protein, 9 aa, Homo Sapiens
MRLTKLKSQ

SEQ ID NO: 349906 - protein, 9 aa, Homo Sapiens
EKVEQETWC

SEQ ID NO: 349907 - protein, 9 aa, Homo Sapiens
RSHVARVIV

SEQ ID NO: 349908 - protein, 9 aa, Homo Sapiens
LQIDCGSYH

SEQ ID NO: 349909 - protein, 9 aa, Homo Sapiens
KLCLMWCIG

SEQ ID NO: 349910 - protein, 9 aa, Homo Sapiens
VFGSSGNLA

SEQ ID NO: 349911 - protein, 9 aa, Homo Sapiens
LKIFANLLS

SEQ ID NO: 349912 - protein, 9 aa, Homo Sapiens
CGLDYCPYE

SEQ ID NO: 349913 - protein, 9 aa, Homo Sapiens
QWSEKKKAH

SEQ ID NO: 349914 - protein, 9 aa, Homo Sapiens
GTLNGIFVL

SEQ ID NO: 349915 - protein, 9 aa, Homo Sapiens
PPGEYKGGY

SEQ ID NO: 349916 - protein, 9 aa, Homo Sapiens
EEGKMGDEE

SEQ ID NO: 349917 - protein, 9 aa, Homo Sapiens
HFHFFHIQL

SEQ ID NO: 349918 - protein, 9 aa, Homo Sapiens
VSYITALDL

SEQ ID NO: 349919 - protein, 9 aa, Homo Sapiens
ACCNQLFVL

SEQ ID NO: 349920 - protein, 9 aa, Homo Sapiens
LNFQPQVIC

SEQ ID NO: 349921 - protein, 9 aa, Homo Sapiens
NIKTRLGRR

SEQ ID NO: 349922 - protein, 9 aa, Homo Sapiens
LFEDKTDIF

SEQ ID NO: 349923 - protein, 9 aa, Homo Sapiens
NNSCPSTET

SEQ ID NO: 349924 - protein, 9 aa, Homo Sapiens
VIDKKKDFL

SEQ ID NO: 349925 - protein, 9 aa, Homo Sapiens
LQNDAPVPY

SEQ ID NO: 349926 - protein, 9 aa, Homo Sapiens
VIHHILKAN

SEQ ID NO: 349927 - protein, 9 aa, Homo Sapiens
EGQAQSLKT

SEQ ID NO: 349928 - protein, 9 aa, Homo Sapiens
IFIYMCPVR

SEQ ID NO: 349929 - protein, 9 aa, Homo Sapiens
CEPPDSRCP

SEQ ID NO: 349930 - protein, 9 aa, Homo Sapiens
SIVLKPHNI

SEQ ID NO: 349931 - protein, 9 aa, Homo Sapiens
NYYVQMCKD

SEQ ID NO: 349932 - protein, 9 aa, Homo Sapiens
LDRFCFEKR

SEQ ID NO: 349933 - protein, 9 aa, Homo Sapiens
CSDQGVAGY

SEQ ID NO: 349934 - protein, 9 aa, Homo Sapiens
IKYKRPIPL

SEQ ID NO: 349935 - protein, 9 aa, Homo Sapiens
RRSQRILQR

SEQ ID NO: 349936 - protein, 9 aa, Homo Sapiens
NLDRFCFEK

SEQ ID NO: 349937 - protein, 9 aa, Homo Sapiens
ESSPFVEQL

SEQ ID NO: 349938 - protein, 9 aa, Homo Sapiens
ARTLQTSMA

SEQ ID NO: 349939 - protein, 9 aa, Homo Sapiens
PARDPAWLP

SEQ ID NO: 349940 - protein, 9 aa, Homo Sapiens
EAEKDMWIV

SEQ ID NO: 349941 - protein, 9 aa, Homo Sapiens
LPYFWEFSM

SEQ ID NO: 349942 - protein, 9 aa, Homo Sapiens
SLFKKSWWG

SEQ ID NO: 349943 - protein, 9 aa, Homo Sapiens
LMSFTPAVK

SEQ ID NO: 349944 - protein, 9 aa, Homo Sapiens
EQYNKIAIP

SEQ ID NO: 349945 - protein, 9 aa, Homo Sapiens
ASEAGEHEK

SEQ ID NO: 349946 - protein, 9 aa, Homo Sapiens
YLNLFYSFL

SEQ ID NO: 349947 - protein, 9 aa, Homo Sapiens
QWKKFCSNF

SEQ ID NO: 349948 - protein, 9 aa, Homo Sapiens
SFALSWRLY

SEQ ID NO: 349949 - protein, 9 aa, Homo Sapiens
GIGYGCNIN

SEQ ID NO: 349950 - protein, 9 aa, Homo Sapiens
KRLEYLVKK

SEQ ID NO: 349951 - protein, 9 aa, Homo Sapiens
DFNGNEDIP

SEQ ID NO: 349952 - protein, 9 aa, Homo Sapiens
GLACYWLGE

SEQ ID NO: 349953 - protein, 9 aa, Homo Sapiens
NGYTLMDLL

SEQ ID NO: 349954 - protein, 9 aa, Homo Sapiens
HPKYQEQCR

SEQ ID NO: 349955 - protein, 9 aa, Homo Sapiens
QGRISVKWM

SEQ ID NO: 349956 - protein, 9 aa, Homo Sapiens
AKIILKKFP

SEQ ID NO: 349957 - protein, 9 aa, Homo Sapiens
EVNEQALNK

SEQ ID NO: 349958 - protein, 9 aa, Homo Sapiens
VRLTQLPKN

SEQ ID NO: 349959 - protein, 9 aa, Homo Sapiens
IHTGEKLYI

SEQ ID NO: 349960 - protein, 9 aa, Homo Sapiens
GVDQFCLGH

SEQ ID NO: 349961 - protein, 9 aa, Homo Sapiens
KYNEVLQIN

SEQ ID NO: 349962 - protein, 9 aa, Homo Sapiens
TPEVPFFGP

SEQ ID NO: 349963 - protein, 9 aa, Homo Sapiens
VTATDADND

SEQ ID NO: 349964 - protein, 9 aa, Homo Sapiens
LVMYDGIMA

SEQ ID NO: 349965 - protein, 9 aa, Homo Sapiens
VDTHINEVM

SEQ ID NO: 349966 - protein, 9 aa, Homo Sapiens
AESHNQIDL

SEQ ID NO: 349967 - protein, 9 aa, Homo Sapiens
WYSSNGSAK

SEQ ID NO: 349968 - protein, 9 aa, Homo Sapiens
NQARRQQHT

SEQ ID NO: 349969 - protein, 9 aa, Homo Sapiens
FKFNTDELN

SEQ ID NO: 349970 - protein, 9 aa, Homo Sapiens
VGKALRVHA

SEQ ID NO: 349971 - protein, 9 aa, Homo Sapiens
FWSFKIVLF

SEQ ID NO: 349972 - protein, 9 aa, Homo Sapiens
LEIEYLEKQ

SEQ ID NO: 349973 - protein, 9 aa, Homo Sapiens
SGLSLVSAP

SEQ ID NO: 349974 - protein, 9 aa, Homo Sapiens
QFFVDQWEL

SEQ ID NO: 349975 - protein, 9 aa, Homo Sapiens
NCGTEKKNY

SEQ ID NO: 349976 - protein, 9 aa, Homo Sapiens
CFGLEDQTY

SEQ ID NO: 349977 - protein, 9 aa, Homo Sapiens
NFEKPKTKI

SEQ ID NO: 349978 - protein, 9 aa, Homo Sapiens
GSSGNLANV

SEQ ID NO: 349979 - protein, 9 aa, Homo Sapiens
EISLTSQSP

SEQ ID NO: 349980 - protein, 9 aa, Homo Sapiens
EKTKKDKAF

SEQ ID NO: 349981 - protein, 9 aa, Homo Sapiens
THICRADIR

SEQ ID NO: 349982 - protein, 9 aa, Homo Sapiens
SVALYDCQS

SEQ ID NO: 349983 - protein, 9 aa, Homo Sapiens
LFHAVMGRA

SEQ ID NO: 349984 - protein, 9 aa, Homo Sapiens
THKRTHTAE

SEQ ID NO: 349985 - protein, 9 aa, Homo Sapiens
LQGSLKIKQ

SEQ ID NO: 349986 - protein, 9 aa, Homo Sapiens
QEATNYSKP

SEQ ID NO: 349987 - protein, 9 aa, Homo Sapiens
VRILRAVVI

SEQ ID NO: 349988 - protein, 9 aa, Homo Sapiens
AKQKTHEKG

SEQ ID NO: 349989 - protein, 9 aa, Homo Sapiens
ELLKKMQFL

SEQ ID NO: 349990 - protein, 9 aa, Homo Sapiens
KQYSHSETP

SEQ ID NO: 349991 - protein, 9 aa, Homo Sapiens
TTCQILCMM

SEQ ID NO: 349992 - protein, 9 aa, Homo Sapiens
YGQNGMVTC

SEQ ID NO: 349993 - protein, 9 aa, Homo Sapiens
LITEKKDNA

SEQ ID NO: 349994 - protein, 9 aa, Homo Sapiens
EVISNTKET

SEQ ID NO: 349995 - protein, 9 aa, Homo Sapiens
RLLNEIIAA

SEQ ID NO: 349996 - protein, 9 aa, Homo Sapiens
HWKALVTKR

SEQ ID NO: 349997 - protein, 9 aa, Homo Sapiens
SNSIDSVLE

SEQ ID NO: 349998 - protein, 9 aa, Homo Sapiens
DCFQERNNC

SEQ ID NO: 349999 - protein, 9 aa, Homo Sapiens
AFQATAQAN

SEQ ID NO: 350000 - protein, 9 aa, Homo Sapiens
LPKCIQAKI

SEQ ID NO: 350001 - protein, 9 aa, Homo Sapiens
YMLEWVCLG

SEQ ID NO: 350002 - protein, 9 aa, Homo Sapiens
RQKLIQSLF

SEQ ID NO: 350003 - protein, 9 aa, Homo Sapiens
KLWHCLLML

SEQ ID NO: 350004 - protein, 9 aa, Homo Sapiens
VIRQNVQKK

SEQ ID NO: 350005 - protein, 9 aa, Homo Sapiens
DRIHIFSYF

SEQ ID NO: 350006 - protein, 9 aa, Homo Sapiens
EPEFHHGAQ

SEQ ID NO: 350007 - protein, 9 aa, Homo Sapiens
ELIMPDSAV

SEQ ID NO: 350008 - protein, 9 aa, Homo Sapiens
CNLCIRYTI

SEQ ID NO: 350009 - protein, 9 aa, Homo Sapiens
VEIQRGHLR

SEQ ID NO: 350010 - protein, 9 aa, Homo Sapiens
FYRGNKDTP

SEQ ID NO: 350011 - protein, 9 aa, Homo Sapiens
CKIHDGMFR

SEQ ID NO: 350012 - protein, 9 aa, Homo Sapiens
LSELFQRGL

SEQ ID NO: 350013 - protein, 9 aa, Homo Sapiens
EELHNCIQK

SEQ ID NO: 350014 - protein, 9 aa, Homo Sapiens
LAADVLYRL

SEQ ID NO: 350015 - protein, 9 aa, Homo Sapiens
RGFWSTKSE

SEQ ID NO: 350016 - protein, 9 aa, Homo Sapiens
DYVKKGDTR

SEQ ID NO: 350017 - protein, 9 aa, Homo Sapiens
HFQKANCSA

SEQ ID NO: 350018 - protein, 9 aa, Homo Sapiens
VAKVIATTV

SEQ ID NO: 350019 - protein, 9 aa, Homo Sapiens
GSKTWDCFQ

SEQ ID NO: 350020 - protein, 9 aa, Homo Sapiens
RCIKFVPNE

SEQ ID NO: 350021 - protein, 9 aa, Homo Sapiens
KYCLRHKRS

SEQ ID NO: 350022 - protein, 9 aa, Homo Sapiens
IDSMDSNVK

SEQ ID NO: 350023 - protein, 9 aa, Homo Sapiens
VKLAKYYRQ

SEQ ID NO: 350024 - protein, 9 aa, Homo Sapiens
CGTKDLSIA

SEQ ID NO: 350025 - protein, 9 aa, Homo Sapiens
FNISTDQRD

SEQ ID NO: 350026 - protein, 9 aa, Homo Sapiens
QSVAQVIQS

SEQ ID NO: 350027 - protein, 9 aa, Homo Sapiens
NMAYVAVAA

SEQ ID NO: 350028 - protein, 9 aa, Homo Sapiens
LDEKKVDGL

SEQ ID NO: 350029 - protein, 9 aa, Homo Sapiens
NVMPFNIYM

SEQ ID NO: 350030 - protein, 9 aa, Homo Sapiens
YLAEEDDII

SEQ ID NO: 350031 - protein, 9 aa, Homo Sapiens
PLLNDILKA

SEQ ID NO: 350032 - protein, 9 aa, Homo Sapiens
KRKKVLDDL

SEQ ID NO: 350033 - protein, 9 aa, Homo Sapiens
IKTKHTIQF

SEQ ID NO: 350034 - protein, 9 aa, Homo Sapiens
THPGVITRI

SEQ ID NO: 350035 - protein, 9 aa, Homo Sapiens
AREKSQVQT

SEQ ID NO: 350036 - protein, 9 aa, Homo Sapiens
LASDDEEDA

SEQ ID NO: 350037 - protein, 9 aa, Homo Sapiens
RSLKLTYTL

SEQ ID NO: 350038 - protein, 9 aa, Homo Sapiens
LMYTLRNEE

SEQ ID NO: 350039 - protein, 9 aa, Homo Sapiens
VAPRTLSQG

SEQ ID NO: 350040 - protein, 9 aa, Homo Sapiens
PPLPPKFSN

SEQ ID NO: 350041 - protein, 9 aa, Homo Sapiens
FYSAKNTSK

SEQ ID NO: 350042 - protein, 9 aa, Homo Sapiens
KLKYLFDYS

SEQ ID NO: 350043 - protein, 9 aa, Homo Sapiens
SEPEFHHGA

SEQ ID NO: 350044 - protein, 9 aa, Homo Sapiens
QISLSPSVA

SEQ ID NO: 350045 - protein, 9 aa, Homo Sapiens
QPQGQETES

SEQ ID NO: 350046 - protein, 9 aa, Homo Sapiens
DQLLQNQIV

SEQ ID NO: 350047 - protein, 9 aa, Homo Sapiens
KSIKNKRAL

SEQ ID NO: 350048 - protein, 9 aa, Homo Sapiens
LAKGNVTAQ

SEQ ID NO: 350049 - protein, 9 aa, Homo Sapiens
HLRKCCQAG

SEQ ID NO: 350050 - protein, 9 aa, Homo Sapiens
KAYIFKELQ

SEQ ID NO: 350051 - protein, 9 aa, Homo Sapiens
EGNLSRSAQ

SEQ ID NO: 350052 - protein, 9 aa, Homo Sapiens
HVTVVGELF

SEQ ID NO: 350053 - protein, 9 aa, Homo Sapiens
QRILIAKLI

SEQ ID NO: 350054 - protein, 9 aa, Homo Sapiens
FKKSKSPSW

SEQ ID NO: 350055 - protein, 9 aa, Homo Sapiens
GPAPGSPDK

SEQ ID NO: 350056 - protein, 9 aa, Homo Sapiens
KEATEKFIY

SEQ ID NO: 350057 - protein, 9 aa, Homo Sapiens
EKAGLPQSI

SEQ ID NO: 350058 - protein, 9 aa, Homo Sapiens
SGNPNDDIQ

SEQ ID NO: 350059 - protein, 9 aa, Homo Sapiens
VSSSHGKRK

SEQ ID NO: 350060 - protein, 9 aa, Homo Sapiens
DRDRDANQE

SEQ ID NO: 350061 - protein, 9 aa, Homo Sapiens
EKSIWEITV

SEQ ID NO: 350062 - protein, 9 aa, Homo Sapiens
SEEVLSCRY

SEQ ID NO: 350063 - protein, 9 aa, Homo Sapiens
WSQHTTEVV

SEQ ID NO: 350064 - protein, 9 aa, Homo Sapiens
QGSLKIKQV

SEQ ID NO: 350065 - protein, 9 aa, Homo Sapiens
KIYMVHRNK

SEQ ID NO: 350066 - protein, 9 aa, Homo Sapiens
VQFSDDKDG

SEQ ID NO: 350067 - protein, 9 aa, Homo Sapiens
PHNGKFREF

SEQ ID NO: 350068 - protein, 9 aa, Homo Sapiens
KLYVSFRDL

SEQ ID NO: 350069 - protein, 9 aa, Homo Sapiens
GVVSTPIPI

SEQ ID NO: 350070 - protein, 9 aa, Homo Sapiens
TWCETGISF

SEQ ID NO: 350071 - protein, 9 aa, Homo Sapiens
VFAVFQWPF

SEQ ID NO: 350072 - protein, 9 aa, Homo Sapiens
KNSNMFDLI

SEQ ID NO: 350073 - protein, 9 aa, Homo Sapiens
IVRDPKTLL

SEQ ID NO: 350074 - protein, 9 aa, Homo Sapiens
SNIQQIIQE

SEQ ID NO: 350075 - protein, 9 aa, Homo Sapiens
YSKPLKKFV

SEQ ID NO: 350076 - protein, 9 aa, Homo Sapiens
GVSGHLALI

SEQ ID NO: 350077 - protein, 9 aa, Homo Sapiens
KDGFMCLTD

SEQ ID NO: 350078 - protein, 9 aa, Homo Sapiens
RGAMDLKNL

SEQ ID NO: 350079 - protein, 9 aa, Homo Sapiens
KKNVCVSLV

SEQ ID NO: 350080 - protein, 9 aa, Homo Sapiens
GYMDVGVSH

SEQ ID NO: 350081 - protein, 9 aa, Homo Sapiens
RKEDKLLGE

SEQ ID NO: 350082 - protein, 9 aa, Homo Sapiens
IGSFIDHVH

SEQ ID NO: 350083 - protein, 9 aa, Homo Sapiens
EIQNGPYRQ

SEQ ID NO: 350084 - protein, 9 aa, Homo Sapiens
LGRTSLKIW

SEQ ID NO: 350085 - protein, 9 aa, Homo Sapiens
INAGEKPYK

SEQ ID NO: 350086 - protein, 9 aa, Homo Sapiens
FHDLTEQIA

SEQ ID NO: 350087 - protein, 9 aa, Homo Sapiens
WGVGLASVE

SEQ ID NO: 350088 - protein, 9 aa, Homo Sapiens
PDGKSEQSD

SEQ ID NO: 350089 - protein, 9 aa, Homo Sapiens
HNLIGAQLV

SEQ ID NO: 350090 - protein, 9 aa, Homo Sapiens
IYQIIRGLK

SEQ ID NO: 350091 - protein, 9 aa, Homo Sapiens
AQRKDLALW

SEQ ID NO: 350092 - protein, 9 aa, Homo Sapiens
HKKFPASNI

SEQ ID NO: 350093 - protein, 9 aa, Homo Sapiens
LSRDSRSSS

SEQ ID NO: 350094 - protein, 9 aa, Homo Sapiens
FQAIDKKPS

SEQ ID NO: 350095 - protein, 9 aa, Homo Sapiens
QQHAQRNVG

SEQ ID NO: 350096 - protein, 9 aa, Homo Sapiens
KKITDKLSL

SEQ ID NO: 350097 - protein, 9 aa, Homo Sapiens
IQNSNTEEK

SEQ ID NO: 350098 - protein, 9 aa, Homo Sapiens
SGWHPHEPI

SEQ ID NO: 350099 - protein, 9 aa, Homo Sapiens
ANISGCMQK

SEQ ID NO: 350100 - protein, 9 aa, Homo Sapiens
NVGWAISFV

SEQ ID NO: 350101 - protein, 9 aa, Homo Sapiens
VLLKEKSIW

SEQ ID NO: 350102 - protein, 9 aa, Homo Sapiens
TKLGETFYS

SEQ ID NO: 350103 - protein, 9 aa, Homo Sapiens
DVPIEIQNC

SEQ ID NO: 350104 - protein, 9 aa, Homo Sapiens
VRQTLAFSI

SEQ ID NO: 350105 - protein, 9 aa, Homo Sapiens
AALQPFFTL

SEQ ID NO: 350106 - protein, 9 aa, Homo Sapiens
KIKKLHQEK

SEQ ID NO: 350107 - protein, 9 aa, Homo Sapiens
RASVWENVP

SEQ ID NO: 350108 - protein, 9 aa, Homo Sapiens
VCMPSVLTL

SEQ ID NO: 350109 - protein, 9 aa, Homo Sapiens
CENPTVDLV

SEQ ID NO: 350110 - protein, 9 aa, Homo Sapiens
FSLNHPNHL

SEQ ID NO: 350111 - protein, 9 aa, Homo Sapiens
KAPQYAMAA

SEQ ID NO: 350112 - protein, 9 aa, Homo Sapiens
QGSVAFEDV

SEQ ID NO: 350113 - protein, 9 aa, Homo Sapiens
LIQHQIIHS

SEQ ID NO: 350114 - protein, 9 aa, Homo Sapiens
LLLPSGSKG

SEQ ID NO: 350115 - protein, 9 aa, Homo Sapiens
PVTNLTSSI

SEQ ID NO: 350116 - protein, 9 aa, Homo Sapiens
NSLAAVPYR

SEQ ID NO: 350117 - protein, 9 aa, Homo Sapiens
FNPDYGMFT

SEQ ID NO: 350118 - protein, 9 aa, Homo Sapiens
DLCQKVEAT

SEQ ID NO: 350119 - protein, 9 aa, Homo Sapiens
LISKEEQNR

SEQ ID NO: 350120 - protein, 9 aa, Homo Sapiens
GFKAENSYL

SEQ ID NO: 350121 - protein, 9 aa, Homo Sapiens
DKKDIAEST

SEQ ID NO: 350122 - protein, 9 aa, Homo Sapiens
RSCKNLWKF

SEQ ID NO: 350123 - protein, 9 aa, Homo Sapiens
TPSQTHKER

SEQ ID NO: 350124 - protein, 9 aa, Homo Sapiens
HLFEDSLED

SEQ ID NO: 350125 - protein, 9 aa, Homo Sapiens
LVLHQSVEA

SEQ ID NO: 350126 - protein, 9 aa, Homo Sapiens
FTLKRFTKV

SEQ ID NO: 350127 - protein, 9 aa, Homo Sapiens
GPTDALALS

SEQ ID NO: 350128 - protein, 9 aa, Homo Sapiens
WFAKWFEEL

SEQ ID NO: 350129 - protein, 9 aa, Homo Sapiens
LIPLCEKIS

SEQ ID NO: 350130 - protein, 9 aa, Homo Sapiens
RHHLSRHIT

SEQ ID NO: 350131 - protein, 9 aa, Homo Sapiens
AIVIFCGYK

SEQ ID NO: 350132 - protein, 9 aa, Homo Sapiens
LGFAFHKDS

SEQ ID NO: 350133 - protein, 9 aa, Homo Sapiens
HKSHEAEVL

SEQ ID NO: 350134 - protein, 9 aa, Homo Sapiens
ESSFILAST

SEQ ID NO: 350135 - protein, 9 aa, Homo Sapiens
LDTLLYQKH

SEQ ID NO: 350136 - protein, 9 aa, Homo Sapiens
IIIIFGTDI

SEQ ID NO: 350137 - protein, 9 aa, Homo Sapiens
CILVAHKHY

SEQ ID NO: 350138 - protein, 9 aa, Homo Sapiens
KHKKFPASN

SEQ ID NO: 350139 - protein, 9 aa, Homo Sapiens
DVISLSFVI

SEQ ID NO: 350140 - protein, 9 aa, Homo Sapiens
HATVENAYI

SEQ ID NO: 350141 - protein, 9 aa, Homo Sapiens
AISDVTPDN

SEQ ID NO: 350142 - protein, 9 aa, Homo Sapiens
LLGCVKNGI

SEQ ID NO: 350143 - protein, 9 aa, Homo Sapiens
HSRWTRLVG

SEQ ID NO: 350144 - protein, 9 aa, Homo Sapiens
IDQNTGEIV

SEQ ID NO: 350145 - protein, 9 aa, Homo Sapiens
QNRYRSDPN

SEQ ID NO: 350146 - protein, 9 aa, Homo Sapiens
NSMYDAVTN

SEQ ID NO: 350147 - protein, 9 aa, Homo Sapiens
VLQLFLSQT

SEQ ID NO: 350148 - protein, 9 aa, Homo Sapiens
DDGKMLRCT

SEQ ID NO: 350149 - protein, 9 aa, Homo Sapiens
PGEQLLNVD

SEQ ID NO: 350150 - protein, 9 aa, Homo Sapiens
LEHLHIDVV

SEQ ID NO: 350151 - protein, 9 aa, Homo Sapiens
TWDNLTILA

SEQ ID NO: 350152 - protein, 9 aa, Homo Sapiens
PTKMTTEEL

SEQ ID NO: 350153 - protein, 9 aa, Homo Sapiens
DSESEASEN

SEQ ID NO: 350154 - protein, 9 aa, Homo Sapiens
PHSGDNSSE

SEQ ID NO: 350155 - protein, 9 aa, Homo Sapiens
NGFVCPICF

SEQ ID NO: 350156 - protein, 9 aa, Homo Sapiens
LKTPTCVPV

SEQ ID NO: 350157 - protein, 9 aa, Homo Sapiens
PKNIEQIHK

SEQ ID NO: 350158 - protein, 9 aa, Homo Sapiens
RLIVVFFVF

SEQ ID NO: 350159 - protein, 9 aa, Homo Sapiens
GLAVTEILG

SEQ ID NO: 350160 - protein, 9 aa, Homo Sapiens
NDIINWLDK

SEQ ID NO: 350161 - protein, 9 aa, Homo Sapiens
LLWQICRGN

SEQ ID NO: 350162 - protein, 9 aa, Homo Sapiens
IKLIYNAGV

SEQ ID NO: 350163 - protein, 9 aa, Homo Sapiens
QSINTDTLS

SEQ ID NO: 350164 - protein, 9 aa, Homo Sapiens
AYTLNSIAL

SEQ ID NO: 350165 - protein, 9 aa, Homo Sapiens
RRNSQTEEP

SEQ ID NO: 350166 - protein, 9 aa, Homo Sapiens
PMYFVLGHL

SEQ ID NO: 350167 - protein, 9 aa, Homo Sapiens
NSPRTLETD

SEQ ID NO: 350168 - protein, 9 aa, Homo Sapiens
FNKFQFERL

SEQ ID NO: 350169 - protein, 9 aa, Homo Sapiens
YLAATFPSA

SEQ ID NO: 350170 - protein, 9 aa, Homo Sapiens
IFLVILVAT

SEQ ID NO: 350171 - protein, 9 aa, Homo Sapiens
SLLQLASPS

SEQ ID NO: 350172 - protein, 9 aa, Homo Sapiens
IKLFDKLAL

SEQ ID NO: 350173 - protein, 9 aa, Homo Sapiens
QNYQYTLHN

SEQ ID NO: 350174 - protein, 9 aa, Homo Sapiens
ITAIKLAEL

SEQ ID NO: 350175 - protein, 9 aa, Homo Sapiens
NMGRINDIL

SEQ ID NO: 350176 - protein, 9 aa, Homo Sapiens
LIFIFEWWC

SEQ ID NO: 350177 - protein, 9 aa, Homo Sapiens
DHAPFSSIW

SEQ ID NO: 350178 - protein, 9 aa, Homo Sapiens
ELERDEKIF

SEQ ID NO: 350179 - protein, 9 aa, Homo Sapiens
QFLPTMSPT

SEQ ID NO: 350180 - protein, 9 aa, Homo Sapiens
DNYFVNYTF

SEQ ID NO: 350181 - protein, 9 aa, Homo Sapiens
RHCVSVLQA

SEQ ID NO: 350182 - protein, 9 aa, Homo Sapiens
TELTGFTEH

SEQ ID NO: 350183 - protein, 9 aa, Homo Sapiens
NHKTPEYNI

SEQ ID NO: 350184 - protein, 9 aa, Homo Sapiens
ANGIDDKDS

SEQ ID NO: 350185 - protein, 9 aa, Homo Sapiens
KGVIQQGAG

SEQ ID NO: 350186 - protein, 9 aa, Homo Sapiens
TFYSDSSEM

SEQ ID NO: 350187 - protein, 9 aa, Homo Sapiens
LCVCIMMNE

SEQ ID NO: 350188 - protein, 9 aa, Homo Sapiens
SDTKGNVFV

SEQ ID NO: 350189 - protein, 9 aa, Homo Sapiens
ISKIYEMRM

SEQ ID NO: 350190 - protein, 9 aa, Homo Sapiens
EVKGKDITM

SEQ ID NO: 350191 - protein, 9 aa, Homo Sapiens
PPKEKGLAL

SEQ ID NO: 350192 - protein, 9 aa, Homo Sapiens
QTEVSYLEI

SEQ ID NO: 350193 - protein, 9 aa, Homo Sapiens
SAGCGPPSG

SEQ ID NO: 350194 - protein, 9 aa, Homo Sapiens
LICYVTITN

SEQ ID NO: 350195 - protein, 9 aa, Homo Sapiens
KGTLRLDTL

SEQ ID NO: 350196 - protein, 9 aa, Homo Sapiens
NKAIIWHRP

SEQ ID NO: 350197 - protein, 9 aa, Homo Sapiens
KVQDWYYKA

SEQ ID NO: 350198 - protein, 9 aa, Homo Sapiens
SSSNSPRTL

SEQ ID NO: 350199 - protein, 9 aa, Homo Sapiens
TWVSGSLAL

SEQ ID NO: 350200 - protein, 9 aa, Homo Sapiens
GAQPDATKV

SEQ ID NO: 350201 - protein, 9 aa, Homo Sapiens
MEESQNKSL

SEQ ID NO: 350202 - protein, 9 aa, Homo Sapiens
STIKDHLWH

SEQ ID NO: 350203 - protein, 9 aa, Homo Sapiens
QYRSNVPNM

SEQ ID NO: 350204 - protein, 9 aa, Homo Sapiens
PVTKNNGPG

SEQ ID NO: 350205 - protein, 9 aa, Homo Sapiens
FRFQKDFMR

SEQ ID NO: 350206 - protein, 9 aa, Homo Sapiens
KVKRGRAVP

SEQ ID NO: 350207 - protein, 9 aa, Homo Sapiens
LHLVHAQAN

SEQ ID NO: 350208 - protein, 9 aa, Homo Sapiens
AISVPNLSA

SEQ ID NO: 350209 - protein, 9 aa, Homo Sapiens
CFSRPAYPY

SEQ ID NO: 350210 - protein, 9 aa, Homo Sapiens
LFSVGGWNF

SEQ ID NO: 350211 - protein, 9 aa, Homo Sapiens
YQAESLAVH

SEQ ID NO: 350212 - protein, 9 aa, Homo Sapiens
ERDMQMGGG

SEQ ID NO: 350213 - protein, 9 aa, Homo Sapiens
KAKPLKSIL

SEQ ID NO: 350214 - protein, 9 aa, Homo Sapiens
AGGLIYSFL

SEQ ID NO: 350215 - protein, 9 aa, Homo Sapiens
ERRSLLRKW

SEQ ID NO: 350216 - protein, 9 aa, Homo Sapiens
DLPFTKGEI

SEQ ID NO: 350217 - protein, 9 aa, Homo Sapiens
TELICYVTI

SEQ ID NO: 350218 - protein, 9 aa, Homo Sapiens
ANNAKTSSN

SEQ ID NO: 350219 - protein, 9 aa, Homo Sapiens
ISDGPAAQD

SEQ ID NO: 350220 - protein, 9 aa, Homo Sapiens
KVESPARVR

SEQ ID NO: 350221 - protein, 9 aa, Homo Sapiens
LSFYQQIKE

SEQ ID NO: 350222 - protein, 9 aa, Homo Sapiens
PPKRKDKSS

SEQ ID NO: 350223 - protein, 9 aa, Homo Sapiens
IFKSDIPFI

SEQ ID NO: 350224 - protein, 9 aa, Homo Sapiens
IPGTPVLEA

SEQ ID NO: 350225 - protein, 9 aa, Homo Sapiens
HVISKEAQL

SEQ ID NO: 350226 - protein, 9 aa, Homo Sapiens
ALVTKRTNG

SEQ ID NO: 350227 - protein, 9 aa, Homo Sapiens
IQITYYFQT

SEQ ID NO: 350228 - protein, 9 aa, Homo Sapiens
YDIIVEGID

SEQ ID NO: 350229 - protein, 9 aa, Homo Sapiens
PPLYPPVQV

SEQ ID NO: 350230 - protein, 9 aa, Homo Sapiens
VKELVRILR

SEQ ID NO: 350231 - protein, 9 aa, Homo Sapiens
KVIEYNSTR

SEQ ID NO: 350232 - protein, 9 aa, Homo Sapiens
DQEFELSIS

SEQ ID NO: 350233 - protein, 9 aa, Homo Sapiens
DPVSEPLVE

SEQ ID NO: 350234 - protein, 9 aa, Homo Sapiens
DIRGRSPDW

SEQ ID NO: 350235 - protein, 9 aa, Homo Sapiens
DQNPGFQFS

SEQ ID NO: 350236 - protein, 9 aa, Homo Sapiens
HAMRWAFRG

SEQ ID NO: 350237 - protein, 9 aa, Homo Sapiens
KRPEGPGAA

SEQ ID NO: 350238 - protein, 9 aa, Homo Sapiens
INIPRCSCS

SEQ ID NO: 350239 - protein, 9 aa, Homo Sapiens
WEIQQNSGF

SEQ ID NO: 350240 - protein, 9 aa, Homo Sapiens
DLRWHKLMM

SEQ ID NO: 350241 - protein, 9 aa, Homo Sapiens
LDKERMTTK

SEQ ID NO: 350242 - protein, 9 aa, Homo Sapiens
GKSAQIPPH

SEQ ID NO: 350243 - protein, 9 aa, Homo Sapiens
DQNKQVLEH

SEQ ID NO: 350244 - protein, 9 aa, Homo Sapiens
PSGSPKENT

SEQ ID NO: 350245 - protein, 9 aa, Homo Sapiens
ARKHKYFKK

SEQ ID NO: 350246 - protein, 9 aa, Homo Sapiens
CQICSCGLD

SEQ ID NO: 350247 - protein, 9 aa, Homo Sapiens
SFSLRDSLW

SEQ ID NO: 350248 - protein, 9 aa, Homo Sapiens
AYISFMFVH

SEQ ID NO: 350249 - protein, 9 aa, Homo Sapiens
EPTYTSLTA

SEQ ID NO: 350250 - protein, 9 aa, Homo Sapiens
IQNLEAPYI

SEQ ID NO: 350251 - protein, 9 aa, Homo Sapiens
YNFEIKNVP

SEQ ID NO: 350252 - protein, 9 aa, Homo Sapiens
ARVWMMKGD

SEQ ID NO: 350253 - protein, 9 aa, Homo Sapiens
FSTNDSSAA

SEQ ID NO: 350254 - protein, 9 aa, Homo Sapiens
TQPLKKLEI

SEQ ID NO: 350255 - protein, 9 aa, Homo Sapiens
TILIYVFQD

SEQ ID NO: 350256 - protein, 9 aa, Homo Sapiens
QNGCISIWR

SEQ ID NO: 350257 - protein, 9 aa, Homo Sapiens
SCVVFINKK

SEQ ID NO: 350258 - protein, 9 aa, Homo Sapiens
AYCTFPALV

SEQ ID NO: 350259 - protein, 9 aa, Homo Sapiens
NRLFSSSYD

SEQ ID NO: 350260 - protein, 9 aa, Homo Sapiens
KILCKLSLE

SEQ ID NO: 350261 - protein, 9 aa, Homo Sapiens
WGVLLAARA

SEQ ID NO: 350262 - protein, 9 aa, Homo Sapiens
AAATKTIKP

SEQ ID NO: 350263 - protein, 9 aa, Homo Sapiens
PMLNPLMYT

SEQ ID NO: 350264 - protein, 9 aa, Homo Sapiens
HTCNPPWAE

SEQ ID NO: 350265 - protein, 9 aa, Homo Sapiens
NPIKSIPSY

SEQ ID NO: 350266 - protein, 9 aa, Homo Sapiens
RGNYLTRQN

SEQ ID NO: 350267 - protein, 9 aa, Homo Sapiens
RPTCFEMKN

SEQ ID NO: 350268 - protein, 9 aa, Homo Sapiens
VGVVCLFLA

SEQ ID NO: 350269 - protein, 9 aa, Homo Sapiens
NQVLDSVLV

SEQ ID NO: 350270 - protein, 9 aa, Homo Sapiens
DKSHFTRDP

SEQ ID NO: 350271 - protein, 9 aa, Homo Sapiens
YQCEECGNT

SEQ ID NO: 350272 - protein, 9 aa, Homo Sapiens
AVPVLNSEC

SEQ ID NO: 350273 - protein, 9 aa, Homo Sapiens
LKLDATEKD

SEQ ID NO: 350274 - protein, 9 aa, Homo Sapiens
NSLSELAPI

SEQ ID NO: 350275 - protein, 9 aa, Homo Sapiens
CAGLHRSPH

SEQ ID NO: 350276 - protein, 9 aa, Homo Sapiens
SRVNALANN

SEQ ID NO: 350277 - protein, 9 aa, Homo Sapiens
FRCKCWVGY

SEQ ID NO: 350278 - protein, 9 aa, Homo Sapiens
PYKCSVCEY

SEQ ID NO: 350279 - protein, 9 aa, Homo Sapiens
VCHPDRITT

SEQ ID NO: 350280 - protein, 9 aa, Homo Sapiens
VLCTPEGIQ

SEQ ID NO: 350281 - protein, 9 aa, Homo Sapiens
GWSNEKDKR

SEQ ID NO: 350282 - protein, 9 aa, Homo Sapiens
VKKKHTKQN

SEQ ID NO: 350283 - protein, 9 aa, Homo Sapiens
SGKWYWKVE

SEQ ID NO: 350284 - protein, 9 aa, Homo Sapiens
SREAANQLL

SEQ ID NO: 350285 - protein, 9 aa, Homo Sapiens
TLSPMKSFL

SEQ ID NO: 350286 - protein, 9 aa, Homo Sapiens
KIRHTENKS

SEQ ID NO: 350287 - protein, 9 aa, Homo Sapiens
ALALQHRLV

SEQ ID NO: 350288 - protein, 9 aa, Homo Sapiens
NLFSSITNH

SEQ ID NO: 350289 - protein, 9 aa, Homo Sapiens
LRDKIMALR

SEQ ID NO: 350290 - protein, 9 aa, Homo Sapiens
FIERHPSRW

SEQ ID NO: 350291 - protein, 9 aa, Homo Sapiens
IEDHKTSPL

SEQ ID NO: 350292 - protein, 9 aa, Homo Sapiens
EASREDYGS

SEQ ID NO: 350293 - protein, 9 aa, Homo Sapiens
SASLTSQVI

SEQ ID NO: 350294 - protein, 9 aa, Homo Sapiens
QVSGEIRNI

SEQ ID NO: 350295 - protein, 9 aa, Homo Sapiens
QRQRLLLIS

SEQ ID NO: 350296 - protein, 9 aa, Homo Sapiens
STFYENWSF

SEQ ID NO: 350297 - protein, 9 aa, Homo Sapiens
RINRTATFV

SEQ ID NO: 350298 - protein, 9 aa, Homo Sapiens
FSTVDAPVT

SEQ ID NO: 350299 - protein, 9 aa, Homo Sapiens
NAQFLWSLW

SEQ ID NO: 350300 - protein, 9 aa, Homo Sapiens
AKETTYSSG

SEQ ID NO: 350301 - protein, 9 aa, Homo Sapiens
SIFCFAAST

SEQ ID NO: 350302 - protein, 9 aa, Homo Sapiens
TRVQTMNEF

SEQ ID NO: 350303 - protein, 9 aa, Homo Sapiens
PLKGYEVTD

SEQ ID NO: 350304 - protein, 9 aa, Homo Sapiens
QEDGLVLLT

SEQ ID NO: 350305 - protein, 9 aa, Homo Sapiens
GTCYWIAET

SEQ ID NO: 350306 - protein, 9 aa, Homo Sapiens
IRMLVVGTS

SEQ ID NO: 350307 - protein, 9 aa, Homo Sapiens
GVIHFQGGS

SEQ ID NO: 350308 - protein, 9 aa, Homo Sapiens
RLLSDQELT

SEQ ID NO: 350309 - protein, 9 aa, Homo Sapiens
DANLTKRRH

SEQ ID NO: 350310 - protein, 9 aa, Homo Sapiens
PDEEAIEMY

SEQ ID NO: 350311 - protein, 9 aa, Homo Sapiens
LYVLYFDCW

SEQ ID NO: 350312 - protein, 9 aa, Homo Sapiens
FVEQLLKKG

SEQ ID NO: 350313 - protein, 9 aa, Homo Sapiens
YECINTTNG

SEQ ID NO: 350314 - protein, 9 aa, Homo Sapiens
IDRIHTPRA

SEQ ID NO: 350315 - protein, 9 aa, Homo Sapiens
RVWWDSNFL

SEQ ID NO: 350316 - protein, 9 aa, Homo Sapiens
FREELGAQP

SEQ ID NO: 350317 - protein, 9 aa, Homo Sapiens
MNTALRDRL

SEQ ID NO: 350318 - protein, 9 aa, Homo Sapiens
INLILLFYK

SEQ ID NO: 350319 - protein, 9 aa, Homo Sapiens
EAPRGDKEE

SEQ ID NO: 350320 - protein, 9 aa, Homo Sapiens
TKLSFNIQA

SEQ ID NO: 350321 - protein, 9 aa, Homo Sapiens
AGVYVLHFD

SEQ ID NO: 350322 - protein, 9 aa, Homo Sapiens
QIKQLSDFE

SEQ ID NO: 350323 - protein, 9 aa, Homo Sapiens
EILGRTSLK

SEQ ID NO: 350324 - protein, 9 aa, Homo Sapiens
ITTTLSFEG

SEQ ID NO: 350325 - protein, 9 aa, Homo Sapiens
HIPGDNSIF

SEQ ID NO: 350326 - protein, 9 aa, Homo Sapiens
ICLWVLQII

SEQ ID NO: 350327 - protein, 9 aa, Homo Sapiens
RTNVQFSDD

SEQ ID NO: 350328 - protein, 9 aa, Homo Sapiens
QPGDWIMLV

SEQ ID NO: 350329 - protein, 9 aa, Homo Sapiens
NTRAKRDKL

SEQ ID NO: 350330 - protein, 9 aa, Homo Sapiens
MSDKSIFYF

SEQ ID NO: 350331 - protein, 9 aa, Homo Sapiens
MMSSFRSVQ

SEQ ID NO: 350332 - protein, 9 aa, Homo Sapiens
RVRWEIQQN

SEQ ID NO: 350333 - protein, 9 aa, Homo Sapiens
KETIEIINL

SEQ ID NO: 350334 - protein, 9 aa, Homo Sapiens
KAGKRSPRR

SEQ ID NO: 350335 - protein, 9 aa, Homo Sapiens
NERDEITHN

SEQ ID NO: 350336 - protein, 9 aa, Homo Sapiens
PIQVVQGDI

SEQ ID NO: 350337 - protein, 9 aa, Homo Sapiens
PLLLLSVCA

SEQ ID NO: 350338 - protein, 9 aa, Homo Sapiens
TRCLAPLVP

SEQ ID NO: 350339 - protein, 9 aa, Homo Sapiens
YASKGLHLE

SEQ ID NO: 350340 - protein, 9 aa, Homo Sapiens
KLFTRCLAP

SEQ ID NO: 350341 - protein, 9 aa, Homo Sapiens
QHFLEQLLD

SEQ ID NO: 350342 - protein, 9 aa, Homo Sapiens
FQATAQANV

SEQ ID NO: 350343 - protein, 9 aa, Homo Sapiens
QQRDLIRQI

SEQ ID NO: 350344 - protein, 9 aa, Homo Sapiens
EPRTFQTFS

SEQ ID NO: 350345 - protein, 9 aa, Homo Sapiens
DEMRLELQI

SEQ ID NO: 350346 - protein, 9 aa, Homo Sapiens
VSNEGCIRY

SEQ ID NO: 350347 - protein, 9 aa, Homo Sapiens
NSTVTKING

SEQ ID NO: 350348 - protein, 9 aa, Homo Sapiens
IATQFQLEL

SEQ ID NO: 350349 - protein, 9 aa, Homo Sapiens
FAEDEEWKI

SEQ ID NO: 350350 - protein, 9 aa, Homo Sapiens
LEQIKFYEE

SEQ ID NO: 350351 - protein, 9 aa, Homo Sapiens
MVERCGKIL

SEQ ID NO: 350352 - protein, 9 aa, Homo Sapiens
DLRQDANLT

SEQ ID NO: 350353 - protein, 9 aa, Homo Sapiens
LRMMIAKQR

SEQ ID NO: 350354 - protein, 9 aa, Homo Sapiens
KKVQDWYYK

SEQ ID NO: 350355 - protein, 9 aa, Homo Sapiens
CLPGSSNYS

SEQ ID NO: 350356 - protein, 9 aa, Homo Sapiens
RNSEKVYLC

SEQ ID NO: 350357 - protein, 9 aa, Homo Sapiens
LLPVLNPSG

SEQ ID NO: 350358 - protein, 9 aa, Homo Sapiens
PQLDGLEKY

SEQ ID NO: 350359 - protein, 9 aa, Homo Sapiens
SFLHHQNCY

SEQ ID NO: 350360 - protein, 9 aa, Homo Sapiens
SPMKSFLSE

SEQ ID NO: 350361 - protein, 9 aa, Homo Sapiens
SGGCPCKGT

SEQ ID NO: 350362 - protein, 9 aa, Homo Sapiens
EMFGWNFVF

SEQ ID NO: 350363 - protein, 9 aa, Homo Sapiens
RFKQQTPSQ

SEQ ID NO: 350364 - protein, 9 aa, Homo Sapiens
KLFKCNECG

SEQ ID NO: 350365 - protein, 9 aa, Homo Sapiens
PISVLVKMY

SEQ ID NO: 350366 - protein, 9 aa, Homo Sapiens
LKIRNMFDL

SEQ ID NO: 350367 - protein, 9 aa, Homo Sapiens
TTSERSTSL

SEQ ID NO: 350368 - protein, 9 aa, Homo Sapiens
KWLSKSSAT

SEQ ID NO: 350369 - protein, 9 aa, Homo Sapiens
EILHSTICK

SEQ ID NO: 350370 - protein, 9 aa, Homo Sapiens
SASLSENEA

SEQ ID NO: 350371 - protein, 9 aa, Homo Sapiens
EKVLDQPPT

SEQ ID NO: 350372 - protein, 9 aa, Homo Sapiens
CKYKKRFNS

SEQ ID NO: 350373 - protein, 9 aa, Homo Sapiens
DKNKQFRSR

SEQ ID NO: 350374 - protein, 9 aa, Homo Sapiens
TVHQITHTG

SEQ ID NO: 350375 - protein, 9 aa, Homo Sapiens
KWYGSCVQH

SEQ ID NO: 350376 - protein, 9 aa, Homo Sapiens
FEICGALVD

SEQ ID NO: 350377 - protein, 9 aa, Homo Sapiens
LDKLQCDLQ

SEQ ID NO: 350378 - protein, 9 aa, Homo Sapiens
YIESILLYT

SEQ ID NO: 350379 - protein, 9 aa, Homo Sapiens
SLRNSKSKL

SEQ ID NO: 350380 - protein, 9 aa, Homo Sapiens
PKIIERAGY

SEQ ID NO: 350381 - protein, 9 aa, Homo Sapiens
VPFFICGPS

SEQ ID NO: 350382 - protein, 9 aa, Homo Sapiens
VTTCVPWNL

SEQ ID NO: 350383 - protein, 9 aa, Homo Sapiens
EKHVELEGL

SEQ ID NO: 350384 - protein, 9 aa, Homo Sapiens
CSYLHKASL

SEQ ID NO: 350385 - protein, 9 aa, Homo Sapiens
RLYYWDASA

SEQ ID NO: 350386 - protein, 9 aa, Homo Sapiens
LLTRFLKLL

SEQ ID NO: 350387 - protein, 9 aa, Homo Sapiens
QHATLKPEQ

SEQ ID NO: 350388 - protein, 9 aa, Homo Sapiens
KYPTDKEHN

SEQ ID NO: 350389 - protein, 9 aa, Homo Sapiens
LNAQFLWSL

SEQ ID NO: 350390 - protein, 9 aa, Homo Sapiens
NDDLLAQEA

SEQ ID NO: 350391 - protein, 9 aa, Homo Sapiens
QGILLKRSS

SEQ ID NO: 350392 - protein, 9 aa, Homo Sapiens
DVSSAAKAE

SEQ ID NO: 350393 - protein, 9 aa, Homo Sapiens
RTQIAASKT

SEQ ID NO: 350394 - protein, 9 aa, Homo Sapiens
QIPVTCQIE

SEQ ID NO: 350395 - protein, 9 aa, Homo Sapiens
DDRSFLNLL

SEQ ID NO: 350396 - protein, 9 aa, Homo Sapiens
CVIWTAGDV

SEQ ID NO: 350397 - protein, 9 aa, Homo Sapiens
NVLTLEQIK

SEQ ID NO: 350398 - protein, 9 aa, Homo Sapiens
TFLLMLQSV

SEQ ID NO: 350399 - protein, 9 aa, Homo Sapiens
DIPMDPSIQ

SEQ ID NO: 350400 - protein, 9 aa, Homo Sapiens
LLERLEENH

SEQ ID NO: 350401 - protein, 9 aa, Homo Sapiens
NIVLLPDPL

SEQ ID NO: 350402 - protein, 9 aa, Homo Sapiens
QEAGKFMIT

SEQ ID NO: 350403 - protein, 9 aa, Homo Sapiens
QSASKQGLA

SEQ ID NO: 350404 - protein, 9 aa, Homo Sapiens
LQDYEKYKE

SEQ ID NO: 350405 - protein, 9 aa, Homo Sapiens
LRQKILKPK

SEQ ID NO: 350406 - protein, 9 aa, Homo Sapiens
FKTHDKDLR

SEQ ID NO: 350407 - protein, 9 aa, Homo Sapiens
NPFMYTIRN

SEQ ID NO: 350408 - protein, 9 aa, Homo Sapiens
LADYTLESG

SEQ ID NO: 350409 - protein, 9 aa, Homo Sapiens
QGIRQGKSM

SEQ ID NO: 350410 - protein, 9 aa, Homo Sapiens
KLVCGNITV

SEQ ID NO: 350411 - protein, 9 aa, Homo Sapiens
VHLVSHLII

SEQ ID NO: 350412 - protein, 9 aa, Homo Sapiens
QNNDRVQVE

SEQ ID NO: 350413 - protein, 9 aa, Homo Sapiens
LSNELSFPQ

SEQ ID NO: 350414 - protein, 9 aa, Homo Sapiens
NGDVQNSTR

SEQ ID NO: 350415 - protein, 9 aa, Homo Sapiens
TVTKINGAV

SEQ ID NO: 350416 - protein, 9 aa, Homo Sapiens
QLEKELVHA

SEQ ID NO: 350417 - protein, 9 aa, Homo Sapiens
FSHAQTVVI

SEQ ID NO: 350418 - protein, 9 aa, Homo Sapiens
DELPLSVHI

SEQ ID NO: 350419 - protein, 9 aa, Homo Sapiens
CKVHGFYPP

SEQ ID NO: 350420 - protein, 9 aa, Homo Sapiens
GPPGRRYYS

SEQ ID NO: 350421 - protein, 9 aa, Homo Sapiens
PTQDAFQGQ

SEQ ID NO: 350422 - protein, 9 aa, Homo Sapiens
RRQAFNTEL

SEQ ID NO: 350423 - protein, 9 aa, Homo Sapiens
RDRDANQES

SEQ ID NO: 350424 - protein, 9 aa, Homo Sapiens
ALTRYKKLH

SEQ ID NO: 350425 - protein, 9 aa, Homo Sapiens
SSSLIHHQI

SEQ ID NO: 350426 - protein, 9 aa, Homo Sapiens
HATLWGAVG

SEQ ID NO: 350427 - protein, 9 aa, Homo Sapiens
RTVLKPHKV

SEQ ID NO: 350428 - protein, 9 aa, Homo Sapiens
EKDRDRDAN

SEQ ID NO: 350429 - protein, 9 aa, Homo Sapiens
YICCIAVHP

SEQ ID NO: 350430 - protein, 9 aa, Homo Sapiens
SASGTPWYP

SEQ ID NO: 350431 - protein, 9 aa, Homo Sapiens
YSLWDCPAR

SEQ ID NO: 350432 - protein, 9 aa, Homo Sapiens
DYFMSCPGR

SEQ ID NO: 350433 - protein, 9 aa, Homo Sapiens
NYYPYLADR

SEQ ID NO: 350434 - protein, 9 aa, Homo Sapiens
LENYPEAEG

SEQ ID NO: 350435 - protein, 9 aa, Homo Sapiens
QKLLKQKLQ

SEQ ID NO: 350436 - protein, 9 aa, Homo Sapiens
YYFQTYGSA

SEQ ID NO: 350437 - protein, 9 aa, Homo Sapiens
NWRGLVAMA

SEQ ID NO: 350438 - protein, 9 aa, Homo Sapiens
KPQAKLAHL

SEQ ID NO: 350439 - protein, 9 aa, Homo Sapiens
TFFSSFVQG

SEQ ID NO: 350440 - protein, 9 aa, Homo Sapiens
QQQNTELLS

SEQ ID NO: 350441 - protein, 9 aa, Homo Sapiens
EINCGFVAF

SEQ ID NO: 350442 - protein, 9 aa, Homo Sapiens
VVHLINYYV

SEQ ID NO: 350443 - protein, 9 aa, Homo Sapiens
PKTKIYKYW

SEQ ID NO: 350444 - protein, 9 aa, Homo Sapiens
LIDEFIKAI

SEQ ID NO: 350445 - protein, 9 aa, Homo Sapiens
YRQNRFASS

SEQ ID NO: 350446 - protein, 9 aa, Homo Sapiens
RIERPHNYF

SEQ ID NO: 350447 - protein, 9 aa, Homo Sapiens
NHFFCGISP

SEQ ID NO: 350448 - protein, 9 aa, Homo Sapiens
SLSLSFLLT

SEQ ID NO: 350449 - protein, 9 aa, Homo Sapiens
LKGMEESGS

SEQ ID NO: 350450 - protein, 9 aa, Homo Sapiens
TLPDFRNKL

SEQ ID NO: 350451 - protein, 9 aa, Homo Sapiens
VKESQNDIS

SEQ ID NO: 350452 - protein, 9 aa, Homo Sapiens
NKVKESVSR

SEQ ID NO: 350453 - protein, 9 aa, Homo Sapiens
QVQKGPLTL

SEQ ID NO: 350454 - protein, 9 aa, Homo Sapiens
LSLGGTALQ

SEQ ID NO: 350455 - protein, 9 aa, Homo Sapiens
HGKRKDNKI

SEQ ID NO: 350456 - protein, 9 aa, Homo Sapiens
NTLDSYRCE

SEQ ID NO: 350457 - protein, 9 aa, Homo Sapiens
EAQYLLDSN

SEQ ID NO: 350458 - protein, 9 aa, Homo Sapiens
YRYVAVSRG

SEQ ID NO: 350459 - protein, 9 aa, Homo Sapiens
KFCSNFCEF

SEQ ID NO: 350460 - protein, 9 aa, Homo Sapiens
VRQLEQDNA

SEQ ID NO: 350461 - protein, 9 aa, Homo Sapiens
DQQKTLDLK

SEQ ID NO: 350462 - protein, 9 aa, Homo Sapiens
RDYGGINTL

SEQ ID NO: 350463 - protein, 9 aa, Homo Sapiens
TELWFHNQR

SEQ ID NO: 350464 - protein, 9 aa, Homo Sapiens
LPRIPKVQS

SEQ ID NO: 350465 - protein, 9 aa, Homo Sapiens
RVNSGERPF

SEQ ID NO: 350466 - protein, 9 aa, Homo Sapiens
VKDRSPRAN

SEQ ID NO: 350467 - protein, 9 aa, Homo Sapiens
KQHGSSRKS

SEQ ID NO: 350468 - protein, 9 aa, Homo Sapiens
RHMNSLMDE

SEQ ID NO: 350469 - protein, 9 aa, Homo Sapiens
LCFLSTLIS

SEQ ID NO: 350470 - protein, 9 aa, Homo Sapiens
RDILIDPIQ

SEQ ID NO: 350471 - protein, 9 aa, Homo Sapiens
SKLGKLFKG

SEQ ID NO: 350472 - protein, 9 aa, Homo Sapiens
PGKALPITC

SEQ ID NO: 350473 - protein, 9 aa, Homo Sapiens
LSMFLPTLL

SEQ ID NO: 350474 - protein, 9 aa, Homo Sapiens
SAMPFKIIY

SEQ ID NO: 350475 - protein, 9 aa, Homo Sapiens
QKRDLHKLE

SEQ ID NO: 350476 - protein, 9 aa, Homo Sapiens
LCLARPAKL

SEQ ID NO: 350477 - protein, 9 aa, Homo Sapiens
AGGVFLSHE

SEQ ID NO: 350478 - protein, 9 aa, Homo Sapiens
TAGIASSIM

SEQ ID NO: 350479 - protein, 9 aa, Homo Sapiens
AVWGVKCEA

SEQ ID NO: 350480 - protein, 9 aa, Homo Sapiens
MVLFGANTN

SEQ ID NO: 350481 - protein, 9 aa, Homo Sapiens
RKKEFWNPS

SEQ ID NO: 350482 - protein, 9 aa, Homo Sapiens
LELLWTVPI

SEQ ID NO: 350483 - protein, 9 aa, Homo Sapiens
CDNPWAGGV

SEQ ID NO: 350484 - protein, 9 aa, Homo Sapiens
TVNSLAAVP

SEQ ID NO: 350485 - protein, 9 aa, Homo Sapiens
ACVDTHINE

SEQ ID NO: 350486 - protein, 9 aa, Homo Sapiens
LLPPCELYV

SEQ ID NO: 350487 - protein, 9 aa, Homo Sapiens
LKHIVCLEP

SEQ ID NO: 350488 - protein, 9 aa, Homo Sapiens
GTCRNLVND

SEQ ID NO: 350489 - protein, 9 aa, Homo Sapiens
LTKYFTSSS

SEQ ID NO: 350490 - protein, 9 aa, Homo Sapiens
TQQCPGLGS

SEQ ID NO: 350491 - protein, 9 aa, Homo Sapiens
KQKLAETSF

SEQ ID NO: 350492 - protein, 9 aa, Homo Sapiens
EKRAAKQQR

SEQ ID NO: 350493 - protein, 9 aa, Homo Sapiens
VAHDQAVVL

SEQ ID NO: 350494 - protein, 9 aa, Homo Sapiens
YGNCTMRHS

SEQ ID NO: 350495 - protein, 9 aa, Homo Sapiens
LQNWEAMGN

SEQ ID NO: 350496 - protein, 9 aa, Homo Sapiens
QQKTFQGHD

SEQ ID NO: 350497 - protein, 9 aa, Homo Sapiens
DNLTILAVQ

SEQ ID NO: 350498 - protein, 9 aa, Homo Sapiens
MGSTEACVD

SEQ ID NO: 350499 - protein, 9 aa, Homo Sapiens
QATKDKRTE

SEQ ID NO: 350500 - protein, 9 aa, Homo Sapiens
EDRFDFTQL

SEQ ID NO: 350501 - protein, 9 aa, Homo Sapiens
YLPLLWGQS

SEQ ID NO: 350502 - protein, 9 aa, Homo Sapiens
SALNRHKMT

SEQ ID NO: 350503 - protein, 9 aa, Homo Sapiens
ELESTVPQE

SEQ ID NO: 350504 - protein, 9 aa, Homo Sapiens
GLHQDSATH

SEQ ID NO: 350505 - protein, 9 aa, Homo Sapiens
CSQNAYMLV

SEQ ID NO: 350506 - protein, 9 aa, Homo Sapiens
THLPGKVVQ

SEQ ID NO: 350507 - protein, 9 aa, Homo Sapiens
NLDLKKSDV

SEQ ID NO: 350508 - protein, 9 aa, Homo Sapiens
RKIIQDHGD

SEQ ID NO: 350509 - protein, 9 aa, Homo Sapiens
FTKNRKDKN

SEQ ID NO: 350510 - protein, 9 aa, Homo Sapiens
SKHQGNEIG

SEQ ID NO: 350511 - protein, 9 aa, Homo Sapiens
ILITFFFII

SEQ ID NO: 350512 - protein, 9 aa, Homo Sapiens
CERGKFQPP

SEQ ID NO: 350513 - protein, 9 aa, Homo Sapiens
LIQSSFASC

SEQ ID NO: 350514 - protein, 9 aa, Homo Sapiens
PTIRRTFWI

SEQ ID NO: 350515 - protein, 9 aa, Homo Sapiens
VIYLFATYV

SEQ ID NO: 350516 - protein, 9 aa, Homo Sapiens
KDAQDIQEA

SEQ ID NO: 350517 - protein, 9 aa, Homo Sapiens
DVLVRTGLT

SEQ ID NO: 350518 - protein, 9 aa, Homo Sapiens
NVWVCINIL

SEQ ID NO: 350519 - protein, 9 aa, Homo Sapiens
NLIEHYFGV

SEQ ID NO: 350520 - protein, 9 aa, Homo Sapiens
CKSYVRPGS

SEQ ID NO: 350521 - protein, 9 aa, Homo Sapiens
KLFSEENSD

SEQ ID NO: 350522 - protein, 9 aa, Homo Sapiens
KLIMFRGEV

SEQ ID NO: 350523 - protein, 9 aa, Homo Sapiens
KQTPKHQNE

SEQ ID NO: 350524 - protein, 9 aa, Homo Sapiens
KEQHFLEQL

SEQ ID NO: 350525 - protein, 9 aa, Homo Sapiens
KPSADQKLS

SEQ ID NO: 350526 - protein, 9 aa, Homo Sapiens
QICRFCWHQ

SEQ ID NO: 350527 - protein, 9 aa, Homo Sapiens
KNGVAAFHT

SEQ ID NO: 350528 - protein, 9 aa, Homo Sapiens
IFGDILKSN

SEQ ID NO: 350529 - protein, 9 aa, Homo Sapiens
LLLEPHNKY

SEQ ID NO: 350530 - protein, 9 aa, Homo Sapiens
YCANHFADG

SEQ ID NO: 350531 - protein, 9 aa, Homo Sapiens
DKETIEIIN

SEQ ID NO: 350532 - protein, 9 aa, Homo Sapiens
ANHKGPPVF

SEQ ID NO: 350533 - protein, 9 aa, Homo Sapiens
KQKASGQTV

SEQ ID NO: 350534 - protein, 9 aa, Homo Sapiens
VECTFTKMR

SEQ ID NO: 350535 - protein, 9 aa, Homo Sapiens
YGSCLVASE

SEQ ID NO: 350536 - protein, 9 aa, Homo Sapiens
NLSLLDLIR

SEQ ID NO: 350537 - protein, 9 aa, Homo Sapiens
SKAPVPYFG

SEQ ID NO: 350538 - protein, 9 aa, Homo Sapiens
KLKDDDFER

SEQ ID NO: 350539 - protein, 9 aa, Homo Sapiens
FVQTREYRY

SEQ ID NO: 350540 - protein, 9 aa, Homo Sapiens
AKQKQTSFK

SEQ ID NO: 350541 - protein, 9 aa, Homo Sapiens
DEKETLLKE

SEQ ID NO: 350542 - protein, 9 aa, Homo Sapiens
IRQGKSMSQ

SEQ ID NO: 350543 - protein, 9 aa, Homo Sapiens
TIITSPEYL

SEQ ID NO: 350544 - protein, 9 aa, Homo Sapiens
LTIHKIINT

SEQ ID NO: 350545 - protein, 9 aa, Homo Sapiens
ADIKETMTP

SEQ ID NO: 350546 - protein, 9 aa, Homo Sapiens
EINVFKVHK

SEQ ID NO: 350547 - protein, 9 aa, Homo Sapiens
QMDSEDVYD

SEQ ID NO: 350548 - protein, 9 aa, Homo Sapiens
AMNHHLQET

SEQ ID NO: 350549 - protein, 9 aa, Homo Sapiens
IQNSIVNKN

SEQ ID NO: 350550 - protein, 9 aa, Homo Sapiens
ALPLNSDVP

SEQ ID NO: 350551 - protein, 9 aa, Homo Sapiens
SSIDYISRF

SEQ ID NO: 350552 - protein, 9 aa, Homo Sapiens
LGLHRSLPA

SEQ ID NO: 350553 - protein, 9 aa, Homo Sapiens
RQEEHERLL

SEQ ID NO: 350554 - protein, 9 aa, Homo Sapiens
QNVHEKKLG

SEQ ID NO: 350555 - protein, 9 aa, Homo Sapiens
TRHKIINTG

SEQ ID NO: 350556 - protein, 9 aa, Homo Sapiens
EVDERQRAS

SEQ ID NO: 350557 - protein, 9 aa, Homo Sapiens
LVVWEAGEA

SEQ ID NO: 350558 - protein, 9 aa, Homo Sapiens
FSSPSLSFY

SEQ ID NO: 350559 - protein, 9 aa, Homo Sapiens
CGKALTSKI

SEQ ID NO: 350560 - protein, 9 aa, Homo Sapiens
GFRGLSEEK

SEQ ID NO: 350561 - protein, 9 aa, Homo Sapiens
VPTVAQYHF

SEQ ID NO: 350562 - protein, 9 aa, Homo Sapiens
TGWNPVWLY

SEQ ID NO: 350563 - protein, 9 aa, Homo Sapiens
AHKNFILSI

SEQ ID NO: 350564 - protein, 9 aa, Homo Sapiens
RTISKKKLT

SEQ ID NO: 350565 - protein, 9 aa, Homo Sapiens
GKREGQGSL

SEQ ID NO: 350566 - protein, 9 aa, Homo Sapiens
GLKQQNLHN

SEQ ID NO: 350567 - protein, 9 aa, Homo Sapiens
GPANISGCM

SEQ ID NO: 350568 - protein, 9 aa, Homo Sapiens
LARTLQTSM

SEQ ID NO: 350569 - protein, 9 aa, Homo Sapiens
CKDEINIPR

SEQ ID NO: 350570 - protein, 9 aa, Homo Sapiens
SEQKKTKNN

SEQ ID NO: 350571 - protein, 9 aa, Homo Sapiens
QQVVHICLE

SEQ ID NO: 350572 - protein, 9 aa, Homo Sapiens
LTKHIQQAH

SEQ ID NO: 350573 - protein, 9 aa, Homo Sapiens
MKPGRPQIK

SEQ ID NO: 350574 - protein, 9 aa, Homo Sapiens
NNPPVFSLR

SEQ ID NO: 350575 - protein, 9 aa, Homo Sapiens
QRIHTGGKP

SEQ ID NO: 350576 - protein, 9 aa, Homo Sapiens
ESHIQEWYE

SEQ ID NO: 350577 - protein, 9 aa, Homo Sapiens
LMHDEDPLQ

SEQ ID NO: 350578 - protein, 9 aa, Homo Sapiens
RRRFWKINY

SEQ ID NO: 350579 - protein, 9 aa, Homo Sapiens
TIMGIFFCL

SEQ ID NO: 350580 - protein, 9 aa, Homo Sapiens
IFSIVPVIL

SEQ ID NO: 350581 - protein, 9 aa, Homo Sapiens
KGTKSSQPL

SEQ ID NO: 350582 - protein, 9 aa, Homo Sapiens
FTSDNLKLV

SEQ ID NO: 350583 - protein, 9 aa, Homo Sapiens
EDQKQEVWE

SEQ ID NO: 350584 - protein, 9 aa, Homo Sapiens
WICGPQAYQ

SEQ ID NO: 350585 - protein, 9 aa, Homo Sapiens
SVEIYGLDF

SEQ ID NO: 350586 - protein, 9 aa, Homo Sapiens
SEGWCKALP

SEQ ID NO: 350587 - protein, 9 aa, Homo Sapiens
RSTYFQVHE

SEQ ID NO: 350588 - protein, 9 aa, Homo Sapiens
PKYAKYIAQ

SEQ ID NO: 350589 - protein, 9 aa, Homo Sapiens
LSPQPQGQE

SEQ ID NO: 350590 - protein, 9 aa, Homo Sapiens
NNSIFCSPR

SEQ ID NO: 350591 - protein, 9 aa, Homo Sapiens
QLFCGMKNT

SEQ ID NO: 350592 - protein, 9 aa, Homo Sapiens
VSEPLVEKF

SEQ ID NO: 350593 - protein, 9 aa, Homo Sapiens
LLGGPDIFL

SEQ ID NO: 350594 - protein, 9 aa, Homo Sapiens
QVIQSAKEQ

SEQ ID NO: 350595 - protein, 9 aa, Homo Sapiens
GAKVTFSCQ

SEQ ID NO: 350596 - protein, 9 aa, Homo Sapiens
KRVLAIVEQ

SEQ ID NO: 350597 - protein, 9 aa, Homo Sapiens
KNRRNFASK

SEQ ID NO: 350598 - protein, 9 aa, Homo Sapiens
AQTVVICVG

SEQ ID NO: 350599 - protein, 9 aa, Homo Sapiens
YVLHFDNTY

SEQ ID NO: 350600 - protein, 9 aa, Homo Sapiens
ALGQYHQNG

SEQ ID NO: 350601 - protein, 9 aa, Homo Sapiens
THIIVVSII

SEQ ID NO: 350602 - protein, 9 aa, Homo Sapiens
RNPDELRFN

SEQ ID NO: 350603 - protein, 9 aa, Homo Sapiens
SMYDAVTNK

SEQ ID NO: 350604 - protein, 9 aa, Homo Sapiens
RQFAVLDPE

SEQ ID NO: 350605 - protein, 9 aa, Homo Sapiens
LLHDQTVIH

SEQ ID NO: 350606 - protein, 9 aa, Homo Sapiens
GYSTVIALK

SEQ ID NO: 350607 - protein, 9 aa, Homo Sapiens
ISIRPIPED

SEQ ID NO: 350608 - protein, 9 aa, Homo Sapiens
SRRRRRQWS

SEQ ID NO: 350609 - protein, 9 aa, Homo Sapiens
SKIGWVWNQ

SEQ ID NO: 350610 - protein, 9 aa, Homo Sapiens
KPLEDIKAR

SEQ ID NO: 350611 - protein, 9 aa, Homo Sapiens
PPLSPVFSS

SEQ ID NO: 350612 - protein, 9 aa, Homo Sapiens
QNSIVNKNT

SEQ ID NO: 350613 - protein, 9 aa, Homo Sapiens
AEQVCTIVK

SEQ ID NO: 350614 - protein, 9 aa, Homo Sapiens
SYLILRNHN

SEQ ID NO: 350615 - protein, 9 aa, Homo Sapiens
EENNEKRQK

SEQ ID NO: 350616 - protein, 9 aa, Homo Sapiens
VFDSLHFST

SEQ ID NO: 350617 - protein, 9 aa, Homo Sapiens
SNIDNLGVT

SEQ ID NO: 350618 - protein, 9 aa, Homo Sapiens
SDNEDGGEA

SEQ ID NO: 350619 - protein, 9 aa, Homo Sapiens
EVSTTVQKV

SEQ ID NO: 350620 - protein, 9 aa, Homo Sapiens
PCPGASQSC

SEQ ID NO: 350621 - protein, 9 aa, Homo Sapiens
QNGQKVRPL

SEQ ID NO: 350622 - protein, 9 aa, Homo Sapiens
PERICQRTH

SEQ ID NO: 350623 - protein, 9 aa, Homo Sapiens
KSMFQLVVQ

SEQ ID NO: 350624 - protein, 9 aa, Homo Sapiens
NAQAAISQE

SEQ ID NO: 350625 - protein, 9 aa, Homo Sapiens
LLDYDSNML

SEQ ID NO: 350626 - protein, 9 aa, Homo Sapiens
DVREKQGQQ

SEQ ID NO: 350627 - protein, 9 aa, Homo Sapiens
YVKMAKDRI

SEQ ID NO: 350628 - protein, 9 aa, Homo Sapiens
NRILVANNR

SEQ ID NO: 350629 - protein, 9 aa, Homo Sapiens
AQAHAENGD

SEQ ID NO: 350630 - protein, 9 aa, Homo Sapiens
TVPTANRSG

SEQ ID NO: 350631 - protein, 9 aa, Homo Sapiens
EELQHHCQV

SEQ ID NO: 350632 - protein, 9 aa, Homo Sapiens
IPYRVVEAK

SEQ ID NO: 350633 - protein, 9 aa, Homo Sapiens
GLETAVLLA

SEQ ID NO: 350634 - protein, 9 aa, Homo Sapiens
GDPDDAARC

SEQ ID NO: 350635 - protein, 9 aa, Homo Sapiens
APQCKRSYH

SEQ ID NO: 350636 - protein, 9 aa, Homo Sapiens
GRGCRGPNY

SEQ ID NO: 350637 - protein, 9 aa, Homo Sapiens
VLHKQINKP

SEQ ID NO: 350638 - protein, 9 aa, Homo Sapiens
VDNAWWVGY

SEQ ID NO: 350639 - protein, 9 aa, Homo Sapiens
YVAVCNPLW

SEQ ID NO: 350640 - protein, 9 aa, Homo Sapiens
LQHHCQVSE

SEQ ID NO: 350641 - protein, 9 aa, Homo Sapiens
EGCYCICED

SEQ ID NO: 350642 - protein, 9 aa, Homo Sapiens
PYAQVHIAE

SEQ ID NO: 350643 - protein, 9 aa, Homo Sapiens
AGIIGPRQG

SEQ ID NO: 350644 - protein, 9 aa, Homo Sapiens
PQCKVAVCE

SEQ ID NO: 350645 - protein, 9 aa, Homo Sapiens
QAFQATAQA

SEQ ID NO: 350646 - protein, 9 aa, Homo Sapiens
MDVADDDAD

SEQ ID NO: 350647 - protein, 9 aa, Homo Sapiens
NGGEILNKT

SEQ ID NO: 350648 - protein, 9 aa, Homo Sapiens
EEQVLSLQN

SEQ ID NO: 350649 - protein, 9 aa, Homo Sapiens
SFSFFYFFF

SEQ ID NO: 350650 - protein, 9 aa, Homo Sapiens
LGCFGVDQF

SEQ ID NO: 350651 - protein, 9 aa, Homo Sapiens
GNTVKLLTG

SEQ ID NO: 350652 - protein, 9 aa, Homo Sapiens
AARHLYWDD

SEQ ID NO: 350653 - protein, 9 aa, Homo Sapiens
CLVKWLEVC

SEQ ID NO: 350654 - protein, 9 aa, Homo Sapiens
VGNTIRVTF

SEQ ID NO: 350655 - protein, 9 aa, Homo Sapiens
QTYPKKPGV

SEQ ID NO: 350656 - protein, 9 aa, Homo Sapiens
NEGCIRYKK

SEQ ID NO: 350657 - protein, 9 aa, Homo Sapiens
IQGLPNESW

SEQ ID NO: 350658 - protein, 9 aa, Homo Sapiens
LVHKISGHD

SEQ ID NO: 350659 - protein, 9 aa, Homo Sapiens
PPYFSWTGA

SEQ ID NO: 350660 - protein, 9 aa, Homo Sapiens
LVCVVVVFV

SEQ ID NO: 350661 - protein, 9 aa, Homo Sapiens
CKKVQDWYY

SEQ ID NO: 350662 - protein, 9 aa, Homo Sapiens
FFCGISPIL

SEQ ID NO: 350663 - protein, 9 aa, Homo Sapiens
FFRFPLHLQ

SEQ ID NO: 350664 - protein, 9 aa, Homo Sapiens
VIIGGVTRL

SEQ ID NO: 350665 - protein, 9 aa, Homo Sapiens
SLNLGGMAT

SEQ ID NO: 350666 - protein, 9 aa, Homo Sapiens
NGKFREFFP

SEQ ID NO: 350667 - protein, 9 aa, Homo Sapiens
EKKDNAAAL

SEQ ID NO: 350668 - protein, 9 aa, Homo Sapiens
VAIATILFF

SEQ ID NO: 350669 - protein, 9 aa, Homo Sapiens
IHTGDKPFQ

SEQ ID NO: 350670 - protein, 9 aa, Homo Sapiens
FACPILHQQ

SEQ ID NO: 350671 - protein, 9 aa, Homo Sapiens
KDLLVNQTI

SEQ ID NO: 350672 - protein, 9 aa, Homo Sapiens
HRIILRTQI

SEQ ID NO: 350673 - protein, 9 aa, Homo Sapiens
NADSDIISD

SEQ ID NO: 350674 - protein, 9 aa, Homo Sapiens
CGKACNRIS

SEQ ID NO: 350675 - protein, 9 aa, Homo Sapiens
ILMAVLAVS

SEQ ID NO: 350676 - protein, 9 aa, Homo Sapiens
MSFSGGQQD

SEQ ID NO: 350677 - protein, 9 aa, Homo Sapiens
YASVLLLTC

SEQ ID NO: 350678 - protein, 9 aa, Homo Sapiens
HLYGLSQNT

SEQ ID NO: 350679 - protein, 9 aa, Homo Sapiens
SLAAVPYRA

SEQ ID NO: 350680 - protein, 9 aa, Homo Sapiens
RGRGCRGPN

SEQ ID NO: 350681 - protein, 9 aa, Homo Sapiens
RSHLTIHQI

SEQ ID NO: 350682 - protein, 9 aa, Homo Sapiens
KELVRILRT

SEQ ID NO: 350683 - protein, 9 aa, Homo Sapiens
PPPACPSKS

SEQ ID NO: 350684 - protein, 9 aa, Homo Sapiens
PYNKINQII

SEQ ID NO: 350685 - protein, 9 aa, Homo Sapiens
FSLFVHNVA

SEQ ID NO: 350686 - protein, 9 aa, Homo Sapiens
GCGPPSGMI

SEQ ID NO: 350687 - protein, 9 aa, Homo Sapiens
RTFQTFSKA

SEQ ID NO: 350688 - protein, 9 aa, Homo Sapiens
CSAFLAAYS

SEQ ID NO: 350689 - protein, 9 aa, Homo Sapiens
VRKTAFECM

SEQ ID NO: 350690 - protein, 9 aa, Homo Sapiens
GPGKALPIT

SEQ ID NO: 350691 - protein, 9 aa, Homo Sapiens
LEANMTKWE

SEQ ID NO: 350692 - protein, 9 aa, Homo Sapiens
ESHKIIHTG

SEQ ID NO: 350693 - protein, 9 aa, Homo Sapiens
SARLLFTAT

SEQ ID NO: 350694 - protein, 9 aa, Homo Sapiens
PAHNREKNH

SEQ ID NO: 350695 - protein, 9 aa, Homo Sapiens
HPTLQFGGK

SEQ ID NO: 350696 - protein, 9 aa, Homo Sapiens
LEGAYMCSC

SEQ ID NO: 350697 - protein, 9 aa, Homo Sapiens
NVLDQNVHE

SEQ ID NO: 350698 - protein, 9 aa, Homo Sapiens
LTLIDINDH

SEQ ID NO: 350699 - protein, 9 aa, Homo Sapiens
KTTWQINLK

SEQ ID NO: 350700 - protein, 9 aa, Homo Sapiens
IHSGDRPFK

SEQ ID NO: 350701 - protein, 9 aa, Homo Sapiens
PLWTSFLES

SEQ ID NO: 350702 - protein, 9 aa, Homo Sapiens
RKAISTLFD

SEQ ID NO: 350703 - protein, 9 aa, Homo Sapiens
ILHCYRDCP

SEQ ID NO: 350704 - protein, 9 aa, Homo Sapiens
ARLLFTATR

SEQ ID NO: 350705 - protein, 9 aa, Homo Sapiens
QLKSLYADN

SEQ ID NO: 350706 - protein, 9 aa, Homo Sapiens
WDCIHCTQD

SEQ ID NO: 350707 - protein, 9 aa, Homo Sapiens
CKVYTGGYN

SEQ ID NO: 350708 - protein, 9 aa, Homo Sapiens
QLASPSGLC

SEQ ID NO: 350709 - protein, 9 aa, Homo Sapiens
KIHLSPGKF

SEQ ID NO: 350710 - protein, 9 aa, Homo Sapiens
EFDWKAYIQ

SEQ ID NO: 350711 - protein, 9 aa, Homo Sapiens
ATTDAIEAK

SEQ ID NO: 350712 - protein, 9 aa, Homo Sapiens
TTISSVLIP

SEQ ID NO: 350713 - protein, 9 aa, Homo Sapiens
FGAQVHQRS

SEQ ID NO: 350714 - protein, 9 aa, Homo Sapiens
IADKLDLKK

SEQ ID NO: 350715 - protein, 9 aa, Homo Sapiens
SLSSGRFHK

SEQ ID NO: 350716 - protein, 9 aa, Homo Sapiens
FSQNSYLTI

SEQ ID NO: 350717 - protein, 9 aa, Homo Sapiens
IEMYTTQVQ

SEQ ID NO: 350718 - protein, 9 aa, Homo Sapiens
KLKGAVAGA

SEQ ID NO: 350719 - protein, 9 aa, Homo Sapiens
FWKGYKQWK

SEQ ID NO: 350720 - protein, 9 aa, Homo Sapiens
LITGIIYPH

SEQ ID NO: 350721 - protein, 9 aa, Homo Sapiens
LKREKNILE

SEQ ID NO: 350722 - protein, 9 aa, Homo Sapiens
HNQNGSELD

SEQ ID NO: 350723 - protein, 9 aa, Homo Sapiens
LDHNCSENK

SEQ ID NO: 350724 - protein, 9 aa, Homo Sapiens
IVVSIIFIP

SEQ ID NO: 350725 - protein, 9 aa, Homo Sapiens
CQQKKEKEL

SEQ ID NO: 350726 - protein, 9 aa, Homo Sapiens
LILCNNTAY

SEQ ID NO: 350727 - protein, 9 aa, Homo Sapiens
SPLKREKNI

SEQ ID NO: 350728 - protein, 9 aa, Homo Sapiens
PTDINSSKT

SEQ ID NO: 350729 - protein, 9 aa, Homo Sapiens
NLTKHKLIH

SEQ ID NO: 350730 - protein, 9 aa, Homo Sapiens
QVHIAEDQL

SEQ ID NO: 350731 - protein, 9 aa, Homo Sapiens
YNNQASEQN

SEQ ID NO: 350732 - protein, 9 aa, Homo Sapiens
VARPHLLSM

SEQ ID NO: 350733 - protein, 9 aa, Homo Sapiens
SDDKEKPVK

SEQ ID NO: 350734 - protein, 9 aa, Homo Sapiens
SCLAKGSPK

SEQ ID NO: 350735 - protein, 9 aa, Homo Sapiens
KPYDTITQE

SEQ ID NO: 350736 - protein, 9 aa, Homo Sapiens
EYNQIQKEL

SEQ ID NO: 350737 - protein, 9 aa, Homo Sapiens
NGIDDKDSF

SEQ ID NO: 350738 - protein, 9 aa, Homo Sapiens
LYKHTNSQF

SEQ ID NO: 350739 - protein, 9 aa, Homo Sapiens
IQRQLEEVD

SEQ ID NO: 350740 - protein, 9 aa, Homo Sapiens
YNQVLDSVL

SEQ ID NO: 350741 - protein, 9 aa, Homo Sapiens
LTYPTKRNK

SEQ ID NO: 350742 - protein, 9 aa, Homo Sapiens
YPECLQYGH

SEQ ID NO: 350743 - protein, 9 aa, Homo Sapiens
CCLYLFVLL

SEQ ID NO: 350744 - protein, 9 aa, Homo Sapiens
SLYLGRKEH

SEQ ID NO: 350745 - protein, 9 aa, Homo Sapiens
SVNVSSKEC

SEQ ID NO: 350746 - protein, 9 aa, Homo Sapiens
LGVCIGDKR

SEQ ID NO: 350747 - protein, 9 aa, Homo Sapiens
FLRYFSDKQ

SEQ ID NO: 350748 - protein, 9 aa, Homo Sapiens
IFSSKQQCI

SEQ ID NO: 350749 - protein, 9 aa, Homo Sapiens
CMKTTWQIN

SEQ ID NO: 350750 - protein, 9 aa, Homo Sapiens
GVEYLANNC

SEQ ID NO: 350751 - protein, 9 aa, Homo Sapiens
RHGRFKCSN

SEQ ID NO: 350752 - protein, 9 aa, Homo Sapiens
DKNKRTPYI

SEQ ID NO: 350753 - protein, 9 aa, Homo Sapiens
YRDCPHEVL

SEQ ID NO: 350754 - protein, 9 aa, Homo Sapiens
DKKHQNHYR

SEQ ID NO: 350755 - protein, 9 aa, Homo Sapiens
TNGSLSSVP

SEQ ID NO: 350756 - protein, 9 aa, Homo Sapiens
SFSHAPSSN

SEQ ID NO: 350757 - protein, 9 aa, Homo Sapiens
LAYRQIDDD

SEQ ID NO: 350758 - protein, 9 aa, Homo Sapiens
LPRSPCLGH

SEQ ID NO: 350759 - protein, 9 aa, Homo Sapiens
VHTCSPREW

SEQ ID NO: 350760 - protein, 9 aa, Homo Sapiens
EAQSDMHYS

SEQ ID NO: 350761 - protein, 9 aa, Homo Sapiens
KNPDYVKKG

SEQ ID NO: 350762 - protein, 9 aa, Homo Sapiens
KCQLMFFIG

SEQ ID NO: 350763 - protein, 9 aa, Homo Sapiens
GAPRFFSAV

SEQ ID NO: 350764 - protein, 9 aa, Homo Sapiens
PNIAKNERR

SEQ ID NO: 350765 - protein, 9 aa, Homo Sapiens
TDVGQTQAA

SEQ ID NO: 350766 - protein, 9 aa, Homo Sapiens
FKKGSRNNT

SEQ ID NO: 350767 - protein, 9 aa, Homo Sapiens
YSSMLFITL

SEQ ID NO: 350768 - protein, 9 aa, Homo Sapiens
MKRKKVLDD

SEQ ID NO: 350769 - protein, 9 aa, Homo Sapiens
QGRTLTLGV

SEQ ID NO: 350770 - protein, 9 aa, Homo Sapiens
ILKDFDGTQ

SEQ ID NO: 350771 - protein, 9 aa, Homo Sapiens
TKHNVTAVV

SEQ ID NO: 350772 - protein, 9 aa, Homo Sapiens
GKAAEDCFQ

SEQ ID NO: 350773 - protein, 9 aa, Homo Sapiens
RINAGEKPY

SEQ ID NO: 350774 - protein, 9 aa, Homo Sapiens
DNSLSQSGS

SEQ ID NO: 350775 - protein, 9 aa, Homo Sapiens
SCMLTSPPG

SEQ ID NO: 350776 - protein, 9 aa, Homo Sapiens
YHSTAERKL

SEQ ID NO: 350777 - protein, 9 aa, Homo Sapiens
SNSESADNG

SEQ ID NO: 350778 - protein, 9 aa, Homo Sapiens
RKNNSPALH

SEQ ID NO: 350779 - protein, 9 aa, Homo Sapiens
NLLVDLQNY

SEQ ID NO: 350780 - protein, 9 aa, Homo Sapiens
KALPITCCL

SEQ ID NO: 350781 - protein, 9 aa, Homo Sapiens
VRVTRANSF

SEQ ID NO: 350782 - protein, 9 aa, Homo Sapiens
ENEDRFDFT

SEQ ID NO: 350783 - protein, 9 aa, Homo Sapiens
PQGWPRVGY

SEQ ID NO: 350784 - protein, 9 aa, Homo Sapiens
EVKIFPPED

SEQ ID NO: 350785 - protein, 9 aa, Homo Sapiens
AADVLYRLG

SEQ ID NO: 350786 - protein, 9 aa, Homo Sapiens
SGSIINELI

SEQ ID NO: 350787 - protein, 9 aa, Homo Sapiens
DRFAQPATK

SEQ ID NO: 350788 - protein, 9 aa, Homo Sapiens
NTDMFQTVD

SEQ ID NO: 350789 - protein, 9 aa, Homo Sapiens
IVGIYRKKS

SEQ ID NO: 350790 - protein, 9 aa, Homo Sapiens
RGGLSNVGW

SEQ ID NO: 350791 - protein, 9 aa, Homo Sapiens
LKCIERNEQ

SEQ ID NO: 350792 - protein, 9 aa, Homo Sapiens
QTAGFSEKF

SEQ ID NO: 350793 - protein, 9 aa, Homo Sapiens
INLKDKSHE

SEQ ID NO: 350794 - protein, 9 aa, Homo Sapiens
AGEAGLEEC

SEQ ID NO: 350795 - protein, 9 aa, Homo Sapiens
LMWCIGDFR

SEQ ID NO: 350796 - protein, 9 aa, Homo Sapiens
TKGTLEEPQ

SEQ ID NO: 350797 - protein, 9 aa, Homo Sapiens
NINNTFIKT

SEQ ID NO: 350798 - protein, 9 aa, Homo Sapiens
VNMKAKRCA

SEQ ID NO: 350799 - protein, 9 aa, Homo Sapiens
LSFETTGES

SEQ ID NO: 350800 - protein, 9 aa, Homo Sapiens
QNIKDYFEK

SEQ ID NO: 350801 - protein, 9 aa, Homo Sapiens
RRGQVREVC

SEQ ID NO: 350802 - protein, 9 aa, Homo Sapiens
YFAHISVLK

SEQ ID NO: 350803 - protein, 9 aa, Homo Sapiens
RAWVAAMWH

SEQ ID NO: 350804 - protein, 9 aa, Homo Sapiens
INEIYFTTK

SEQ ID NO: 350805 - protein, 9 aa, Homo Sapiens
EYYIVSVCC

SEQ ID NO: 350806 - protein, 9 aa, Homo Sapiens
TRKDLNRGQ

SEQ ID NO: 350807 - protein, 9 aa, Homo Sapiens
DMKLSMNNN

SEQ ID NO: 350808 - protein, 9 aa, Homo Sapiens
VVSWLPLHA

SEQ ID NO: 350809 - protein, 9 aa, Homo Sapiens
NLLKMICHT

SEQ ID NO: 350810 - protein, 9 aa, Homo Sapiens
QRSSTPIEH

SEQ ID NO: 350811 - protein, 9 aa, Homo Sapiens
RCLAPLVPE

SEQ ID NO: 350812 - protein, 9 aa, Homo Sapiens
HDKHRLDRI

SEQ ID NO: 350813 - protein, 9 aa, Homo Sapiens
NILQATKSH

SEQ ID NO: 350814 - protein, 9 aa, Homo Sapiens
NIKRRTYNA

SEQ ID NO: 350815 - protein, 9 aa, Homo Sapiens
LSSQKMEYF

SEQ ID NO: 350816 - protein, 9 aa, Homo Sapiens
HNCLPNFIC

SEQ ID NO: 350817 - protein, 9 aa, Homo Sapiens
NQYYQKSSV

SEQ ID NO: 350818 - protein, 9 aa, Homo Sapiens
KLIRDSMER

SEQ ID NO: 350819 - protein, 9 aa, Homo Sapiens
GSLDVKKVK

SEQ ID NO: 350820 - protein, 9 aa, Homo Sapiens
KVPLEKEEA

SEQ ID NO: 350821 - protein, 9 aa, Homo Sapiens
ECRVHKLIK

SEQ ID NO: 350822 - protein, 9 aa, Homo Sapiens
ENTLILLDV

SEQ ID NO: 350823 - protein, 9 aa, Homo Sapiens
SLGWSNEKD

SEQ ID NO: 350824 - protein, 9 aa, Homo Sapiens
IVVAVSQDC

SEQ ID NO: 350825 - protein, 9 aa, Homo Sapiens
QTHPNSFWL

SEQ ID NO: 350826 - protein, 9 aa, Homo Sapiens
QGQALEPTQ

SEQ ID NO: 350827 - protein, 9 aa, Homo Sapiens
HDLTEQIAN

SEQ ID NO: 350828 - protein, 9 aa, Homo Sapiens
GLGNRVLVM

SEQ ID NO: 350829 - protein, 9 aa, Homo Sapiens
VKAYIFKEL

SEQ ID NO: 350830 - protein, 9 aa, Homo Sapiens
THFFCNVTP

SEQ ID NO: 350831 - protein, 9 aa, Homo Sapiens
RPQCKQIYQ

SEQ ID NO: 350832 - protein, 9 aa, Homo Sapiens
FNFPSTMIK

SEQ ID NO: 350833 - protein, 9 aa, Homo Sapiens
KYEPGAVKL

SEQ ID NO: 350834 - protein, 9 aa, Homo Sapiens
RIKTTSEDG

SEQ ID NO: 350835 - protein, 9 aa, Homo Sapiens
GYSYAINLP

SEQ ID NO: 350836 - protein, 9 aa, Homo Sapiens
IVKITGEIV

SEQ ID NO: 350837 - protein, 9 aa, Homo Sapiens
PCCCLRPAC

SEQ ID NO: 350838 - protein, 9 aa, Homo Sapiens
RVPRLPKFA

SEQ ID NO: 350839 - protein, 9 aa, Homo Sapiens
NDRARRSPQ

SEQ ID NO: 350840 - protein, 9 aa, Homo Sapiens
VSQCPTGWR

SEQ ID NO: 350841 - protein, 9 aa, Homo Sapiens
LEGTNVEEE

SEQ ID NO: 350842 - protein, 9 aa, Homo Sapiens
ITVCMPSVL

SEQ ID NO: 350843 - protein, 9 aa, Homo Sapiens
QLEKMSKDC

SEQ ID NO: 350844 - protein, 9 aa, Homo Sapiens
FCFEKRNKI

SEQ ID NO: 350845 - protein, 9 aa, Homo Sapiens
NQLRNQLGQ

SEQ ID NO: 350846 - protein, 9 aa, Homo Sapiens
KGKPKPRSL

SEQ ID NO: 350847 - protein, 9 aa, Homo Sapiens
PTEDNKLCH

SEQ ID NO: 350848 - protein, 9 aa, Homo Sapiens
KTTVVYLKN

SEQ ID NO: 350849 - protein, 9 aa, Homo Sapiens
LKRPKTAEE

SEQ ID NO: 350850 - protein, 9 aa, Homo Sapiens
VTQKIVTER

SEQ ID NO: 350851 - protein, 9 aa, Homo Sapiens
KRLENVQPD

SEQ ID NO: 350852 - protein, 9 aa, Homo Sapiens
MNENIIRTR

SEQ ID NO: 350853 - protein, 9 aa, Homo Sapiens
YFLLHQIIH

SEQ ID NO: 350854 - protein, 9 aa, Homo Sapiens
TKCIELIYA

SEQ ID NO: 350855 - protein, 9 aa, Homo Sapiens
STGHGRGHK

SEQ ID NO: 350856 - protein, 9 aa, Homo Sapiens
LALLNNEMM

SEQ ID NO: 350857 - protein, 9 aa, Homo Sapiens
MKQKQKPAS

SEQ ID NO: 350858 - protein, 9 aa, Homo Sapiens
GQYHQNGCI

SEQ ID NO: 350859 - protein, 9 aa, Homo Sapiens
REEQVKQKS

SEQ ID NO: 350860 - protein, 9 aa, Homo Sapiens
SVSSALTML

SEQ ID NO: 350861 - protein, 9 aa, Homo Sapiens
IFIATANTT

SEQ ID NO: 350862 - protein, 9 aa, Homo Sapiens
DIKIKEENI

SEQ ID NO: 350863 - protein, 9 aa, Homo Sapiens
MWRNTRSKV

SEQ ID NO: 350864 - protein, 9 aa, Homo Sapiens
HWASYTGQE

SEQ ID NO: 350865 - protein, 9 aa, Homo Sapiens
LCGSLPFSP

SEQ ID NO: 350866 - protein, 9 aa, Homo Sapiens
DKLSLSLGE

SEQ ID NO: 350867 - protein, 9 aa, Homo Sapiens
ITGVNSSDP

SEQ ID NO: 350868 - protein, 9 aa, Homo Sapiens
ALKPAFGFG

SEQ ID NO: 350869 - protein, 9 aa, Homo Sapiens
LNADNKTCS

SEQ ID NO: 350870 - protein, 9 aa, Homo Sapiens
SSSLFPDFG

SEQ ID NO: 350871 - protein, 9 aa, Homo Sapiens
QHQVIHTGS

SEQ ID NO: 350872 - protein, 9 aa, Homo Sapiens
GKRTKKKTR

SEQ ID NO: 350873 - protein, 9 aa, Homo Sapiens
QMHSPPSNV

SEQ ID NO: 350874 - protein, 9 aa, Homo Sapiens
LLSSPDILC

SEQ ID NO: 350875 - protein, 9 aa, Homo Sapiens
RRNPADPQC

SEQ ID NO: 350876 - protein, 9 aa, Homo Sapiens
ERRAGVNKD

SEQ ID NO: 350877 - protein, 9 aa, Homo Sapiens
NTLHVGGII

SEQ ID NO: 350878 - protein, 9 aa, Homo Sapiens
TNVFITKTC

SEQ ID NO: 350879 - protein, 9 aa, Homo Sapiens
ACGGLNNIC

SEQ ID NO: 350880 - protein, 9 aa, Homo Sapiens
EANRIDVEI

SEQ ID NO: 350881 - protein, 9 aa, Homo Sapiens
QPELSVPDL

SEQ ID NO: 350882 - protein, 9 aa, Homo Sapiens
FSEYIPTPS

SEQ ID NO: 350883 - protein, 9 aa, Homo Sapiens
AAPVTGHTC

SEQ ID NO: 350884 - protein, 9 aa, Homo Sapiens
NNPFLGIAY

SEQ ID NO: 350885 - protein, 9 aa, Homo Sapiens
VLSKSKCNL

SEQ ID NO: 350886 - protein, 9 aa, Homo Sapiens
VRKMINVYK

SEQ ID NO: 350887 - protein, 9 aa, Homo Sapiens
YECIECGKL

SEQ ID NO: 350888 - protein, 9 aa, Homo Sapiens
QAYFYDLHE

SEQ ID NO: 350889 - protein, 9 aa, Homo Sapiens
GGAMALNEK

SEQ ID NO: 350890 - protein, 9 aa, Homo Sapiens
QFDISVNDS

SEQ ID NO: 350891 - protein, 9 aa, Homo Sapiens
LWGIEDMLE

SEQ ID NO: 350892 - protein, 9 aa, Homo Sapiens
EIYRWIWDA

SEQ ID NO: 350893 - protein, 9 aa, Homo Sapiens
LTPLLNPFM

SEQ ID NO: 350894 - protein, 9 aa, Homo Sapiens
EMAALTQDI

SEQ ID NO: 350895 - protein, 9 aa, Homo Sapiens
LCETKCSRQ

SEQ ID NO: 350896 - protein, 9 aa, Homo Sapiens
VKECVERLT

SEQ ID NO: 350897 - protein, 9 aa, Homo Sapiens
DKWVKARNQ

SEQ ID NO: 350898 - protein, 9 aa, Homo Sapiens
VISNTKETL

SEQ ID NO: 350899 - protein, 9 aa, Homo Sapiens
YGSTVFLRV

SEQ ID NO: 350900 - protein, 9 aa, Homo Sapiens
AHHKNVRIT

SEQ ID NO: 350901 - protein, 9 aa, Homo Sapiens
LLTILCEEM

SEQ ID NO: 350902 - protein, 9 aa, Homo Sapiens
AAEECRVHK

SEQ ID NO: 350903 - protein, 9 aa, Homo Sapiens
RLTGNNVQQ

SEQ ID NO: 350904 - protein, 9 aa, Homo Sapiens
EKYPTDKEH

SEQ ID NO: 350905 - protein, 9 aa, Homo Sapiens
LSNRCCIIY

SEQ ID NO: 350906 - protein, 9 aa, Homo Sapiens
RPVHLTQER

SEQ ID NO: 350907 - protein, 9 aa, Homo Sapiens
TQARLLPEA

SEQ ID NO: 350908 - protein, 9 aa, Homo Sapiens
NQRLLSDQE

SEQ ID NO: 350909 - protein, 9 aa, Homo Sapiens
SLYSLDVEL

SEQ ID NO: 350910 - protein, 9 aa, Homo Sapiens
RPDQKDLLG

SEQ ID NO: 350911 - protein, 9 aa, Homo Sapiens
GIKYLVEIT

SEQ ID NO: 350912 - protein, 9 aa, Homo Sapiens
TKQAFNITI

SEQ ID NO: 350913 - protein, 9 aa, Homo Sapiens
FWLVDLLPS

SEQ ID NO: 350914 - protein, 9 aa, Homo Sapiens
QELIEKQQR

SEQ ID NO: 350915 - protein, 9 aa, Homo Sapiens
KLLGRKSGG

SEQ ID NO: 350916 - protein, 9 aa, Homo Sapiens
SLTSQVIHN

SEQ ID NO: 350917 - protein, 9 aa, Homo Sapiens
LLAAAGRRR

SEQ ID NO: 350918 - protein, 9 aa, Homo Sapiens
IWLWLRGLR

SEQ ID NO: 350919 - protein, 9 aa, Homo Sapiens
HHMKVVVCV

SEQ ID NO: 350920 - protein, 9 aa, Homo Sapiens
TGHTCLNVN

SEQ ID NO: 350921 - protein, 9 aa, Homo Sapiens
AAMALKVED

SEQ ID NO: 350922 - protein, 9 aa, Homo Sapiens
VTCIDYQTF

SEQ ID NO: 350923 - protein, 9 aa, Homo Sapiens
RIVPACFLA

SEQ ID NO: 350924 - protein, 9 aa, Homo Sapiens
DLPAMSRLL

SEQ ID NO: 350925 - protein, 9 aa, Homo Sapiens
FGSPLGRLS

SEQ ID NO: 350926 - protein, 9 aa, Homo Sapiens
LVLRSRLHL

SEQ ID NO: 350927 - protein, 9 aa, Homo Sapiens
VPGKTSRVP

SEQ ID NO: 350928 - protein, 9 aa, Homo Sapiens
TPWYPINSR

SEQ ID NO: 350929 - protein, 9 aa, Homo Sapiens
YKLAMAELN

SEQ ID NO: 350930 - protein, 9 aa, Homo Sapiens
SPVIKSIRV

SEQ ID NO: 350931 - protein, 9 aa, Homo Sapiens
LFLFLLSAT

SEQ ID NO: 350932 - protein, 9 aa, Homo Sapiens
FSFSFFYFF

SEQ ID NO: 350933 - protein, 9 aa, Homo Sapiens
RIILRTQIA

SEQ ID NO: 350934 - protein, 9 aa, Homo Sapiens
YNALNVLMA

SEQ ID NO: 350935 - protein, 9 aa, Homo Sapiens
MGVFITLSI

SEQ ID NO: 350936 - protein, 9 aa, Homo Sapiens
FWLVEGNLS

SEQ ID NO: 350937 - protein, 9 aa, Homo Sapiens
SFITLFPLS

SEQ ID NO: 350938 - protein, 9 aa, Homo Sapiens
GWLHSKIEA

SEQ ID NO: 350939 - protein, 9 aa, Homo Sapiens
EQQKLGNAP

SEQ ID NO: 350940 - protein, 9 aa, Homo Sapiens
HLQPSQLSS

SEQ ID NO: 350941 - protein, 9 aa, Homo Sapiens
RFCFEKRNK

SEQ ID NO: 350942 - protein, 9 aa, Homo Sapiens
VQSGKSDSD

SEQ ID NO: 350943 - protein, 9 aa, Homo Sapiens
IQYYVRWRL

SEQ ID NO: 350944 - protein, 9 aa, Homo Sapiens
AEERHKSHE

SEQ ID NO: 350945 - protein, 9 aa, Homo Sapiens
YYLGMTLYW

SEQ ID NO: 350946 - protein, 9 aa, Homo Sapiens
GCSKTPKNR

SEQ ID NO: 350947 - protein, 9 aa, Homo Sapiens
DTGSLYDPS

SEQ ID NO: 350948 - protein, 9 aa, Homo Sapiens
KLLVLVVLL

SEQ ID NO: 350949 - protein, 9 aa, Homo Sapiens
ITGEKPYRC

SEQ ID NO: 350950 - protein, 9 aa, Homo Sapiens
LTKHKIICT

SEQ ID NO: 350951 - protein, 9 aa, Homo Sapiens
IEDDSEVNV

SEQ ID NO: 350952 - protein, 9 aa, Homo Sapiens
TWDCVLVSP

SEQ ID NO: 350953 - protein, 9 aa, Homo Sapiens
WEAFDLFDV

SEQ ID NO: 350954 - protein, 9 aa, Homo Sapiens
LCFDLYDVD

SEQ ID NO: 350955 - protein, 9 aa, Homo Sapiens
SNLTQHWRI

SEQ ID NO: 350956 - protein, 9 aa, Homo Sapiens
MQLLLRELL

SEQ ID NO: 350957 - protein, 9 aa, Homo Sapiens
KNRNVDQSL

SEQ ID NO: 350958 - protein, 9 aa, Homo Sapiens
SADNGWDSG

SEQ ID NO: 350959 - protein, 9 aa, Homo Sapiens
LTLPRTKDT

SEQ ID NO: 350960 - protein, 9 aa, Homo Sapiens
SYNLTVRKL

SEQ ID NO: 350961 - protein, 9 aa, Homo Sapiens
EQVPRQPTY

SEQ ID NO: 350962 - protein, 9 aa, Homo Sapiens
LENLGIADC

SEQ ID NO: 350963 - protein, 9 aa, Homo Sapiens
VGSAYQAFH

SEQ ID NO: 350964 - protein, 9 aa, Homo Sapiens
ENLKQIHSA

SEQ ID NO: 350965 - protein, 9 aa, Homo Sapiens
QGEHVLNFQ

SEQ ID NO: 350966 - protein, 9 aa, Homo Sapiens
YGSCLFIYV

SEQ ID NO: 350967 - protein, 9 aa, Homo Sapiens
ETSNSIDSV

SEQ ID NO: 350968 - protein, 9 aa, Homo Sapiens
GYLLFKDDF

SEQ ID NO: 350969 - protein, 9 aa, Homo Sapiens
KANTELVGP

SEQ ID NO: 350970 - protein, 9 aa, Homo Sapiens
KLDEAVQFS

SEQ ID NO: 350971 - protein, 9 aa, Homo Sapiens
EKTLVIEDN

SEQ ID NO: 350972 - protein, 9 aa, Homo Sapiens
DIFKKSKSP

SEQ ID NO: 350973 - protein, 9 aa, Homo Sapiens
LGCVKNGIQ

SEQ ID NO: 350974 - protein, 9 aa, Homo Sapiens
LARNQYYQK

SEQ ID NO: 350975 - protein, 9 aa, Homo Sapiens
PVDGILYAA

SEQ ID NO: 350976 - protein, 9 aa, Homo Sapiens
PLVLAFCYW

SEQ ID NO: 350977 - protein, 9 aa, Homo Sapiens
AIMKMCWKE

SEQ ID NO: 350978 - protein, 9 aa, Homo Sapiens
DQSEFREQQ

SEQ ID NO: 350979 - protein, 9 aa, Homo Sapiens
EDAQAEIEQ

SEQ ID NO: 350980 - protein, 9 aa, Homo Sapiens
FFSFENVKV

SEQ ID NO: 350981 - protein, 9 aa, Homo Sapiens
IGGVTRLTE

SEQ ID NO: 350982 - protein, 9 aa, Homo Sapiens
HNGSFANFL

SEQ ID NO: 350983 - protein, 9 aa, Homo Sapiens
ICHMFHVAW

SEQ ID NO: 350984 - protein, 9 aa, Homo Sapiens
CRFCWHQIR

SEQ ID NO: 350985 - protein, 9 aa, Homo Sapiens
SLDWGAPNA

SEQ ID NO: 350986 - protein, 9 aa, Homo Sapiens
SPLGQINEA

SEQ ID NO: 350987 - protein, 9 aa, Homo Sapiens
EIAKAAEMV

SEQ ID NO: 350988 - protein, 9 aa, Homo Sapiens
AVVKLVCGN

SEQ ID NO: 350989 - protein, 9 aa, Homo Sapiens
IRQRVDNIK

SEQ ID NO: 350990 - protein, 9 aa, Homo Sapiens
KGIHEYNFE

SEQ ID NO: 350991 - protein, 9 aa, Homo Sapiens
ELSVSDDSS

SEQ ID NO: 350992 - protein, 9 aa, Homo Sapiens
KSNHPQGFF

SEQ ID NO: 350993 - protein, 9 aa, Homo Sapiens
AHYIEELAR

SEQ ID NO: 350994 - protein, 9 aa, Homo Sapiens
ISLVICGTQ

SEQ ID NO: 350995 - protein, 9 aa, Homo Sapiens
RINDILSNA

SEQ ID NO: 350996 - protein, 9 aa, Homo Sapiens
HSHCPRHCP

SEQ ID NO: 350997 - protein, 9 aa, Homo Sapiens
TEEKFQAVM

SEQ ID NO: 350998 - protein, 9 aa, Homo Sapiens
RHTGTPLGY

SEQ ID NO: 350999 - protein, 9 aa, Homo Sapiens
GKDLPAMSR

SEQ ID NO: 351000 - protein, 9 aa, Homo Sapiens
CQSPLLDSR

SEQ ID NO: 351001 - protein, 9 aa, Homo Sapiens
LGAQPDATK

SEQ ID NO: 351002 - protein, 9 aa, Homo Sapiens
IFEFNQSLG

SEQ ID NO: 351003 - protein, 9 aa, Homo Sapiens
WSCLPLAFA

SEQ ID NO: 351004 - protein, 9 aa, Homo Sapiens
GEVKGKDIT

SEQ ID NO: 351005 - protein, 9 aa, Homo Sapiens
EPLTLSHNN

SEQ ID NO: 351006 - protein, 9 aa, Homo Sapiens
SNSNAIQVD

SEQ ID NO: 351007 - protein, 9 aa, Homo Sapiens
IEVTTQNVL

SEQ ID NO: 351008 - protein, 9 aa, Homo Sapiens
KPYKCDACN

SEQ ID NO: 351009 - protein, 9 aa, Homo Sapiens
VALLCKLFL

SEQ ID NO: 351010 - protein, 9 aa, Homo Sapiens
VIISHTLYD

SEQ ID NO: 351011 - protein, 9 aa, Homo Sapiens
SSKSLNKEW

SEQ ID NO: 351012 - protein, 9 aa, Homo Sapiens
QMICQQHQS

SEQ ID NO: 351013 - protein, 9 aa, Homo Sapiens
PNEEHRLED

SEQ ID NO: 351014 - protein, 9 aa, Homo Sapiens
DQEGYFQEL

SEQ ID NO: 351015 - protein, 9 aa, Homo Sapiens
MLPDKVEKP

SEQ ID NO: 351016 - protein, 9 aa, Homo Sapiens
NLINKCNFI

SEQ ID NO: 351017 - protein, 9 aa, Homo Sapiens
PTAAAVPKY

SEQ ID NO: 351018 - protein, 9 aa, Homo Sapiens
VVKELELAH

SEQ ID NO: 351019 - protein, 9 aa, Homo Sapiens
HNKDITLEE

SEQ ID NO: 351020 - protein, 9 aa, Homo Sapiens
VLEIQKNRW

SEQ ID NO: 351021 - protein, 9 aa, Homo Sapiens
AKAPTDPKL

SEQ ID NO: 351022 - protein, 9 aa, Homo Sapiens
LGYTPVTNL

SEQ ID NO: 351023 - protein, 9 aa, Homo Sapiens
NKSWIHSFR

SEQ ID NO: 351024 - protein, 9 aa, Homo Sapiens
RPRLLVNTE

SEQ ID NO: 351025 - protein, 9 aa, Homo Sapiens
LQPWNVTGN

SEQ ID NO: 351026 - protein, 9 aa, Homo Sapiens
QLNSKAVKN

SEQ ID NO: 351027 - protein, 9 aa, Homo Sapiens
LLSANTSQG

SEQ ID NO: 351028 - protein, 9 aa, Homo Sapiens
LWYPLLMNR

SEQ ID NO: 351029 - protein, 9 aa, Homo Sapiens
RRCFKRTKE

SEQ ID NO: 351030 - protein, 9 aa, Homo Sapiens
ITDFRKDSK

SEQ ID NO: 351031 - protein, 9 aa, Homo Sapiens
TGVKAYECS

SEQ ID NO: 351032 - protein, 9 aa, Homo Sapiens
LSAHWCPPC

SEQ ID NO: 351033 - protein, 9 aa, Homo Sapiens
AVKMLKLDA

SEQ ID NO: 351034 - protein, 9 aa, Homo Sapiens
GSTEACVDY

SEQ ID NO: 351035 - protein, 9 aa, Homo Sapiens
LSEWKMVSP

SEQ ID NO: 351036 - protein, 9 aa, Homo Sapiens
GVDSAMNHH

SEQ ID NO: 351037 - protein, 9 aa, Homo Sapiens
RKTTLEMSS

SEQ ID NO: 351038 - protein, 9 aa, Homo Sapiens
FTFFSSFVQ

SEQ ID NO: 351039 - protein, 9 aa, Homo Sapiens
HHVNMKAKR

SEQ ID NO: 351040 - protein, 9 aa, Homo Sapiens
SQIYPVVCA

SEQ ID NO: 351041 - protein, 9 aa, Homo Sapiens
PGVSYCTRE

SEQ ID NO: 351042 - protein, 9 aa, Homo Sapiens
HINHLYIKQ

SEQ ID NO: 351043 - protein, 9 aa, Homo Sapiens
DQTIIFNEV

SEQ ID NO: 351044 - protein, 9 aa, Homo Sapiens
AGDVVMVNY

SEQ ID NO: 351045 - protein, 9 aa, Homo Sapiens
TKAYLTCST

SEQ ID NO: 351046 - protein, 9 aa, Homo Sapiens
AYANSHSLF

SEQ ID NO: 351047 - protein, 9 aa, Homo Sapiens
APGETITGK

SEQ ID NO: 351048 - protein, 9 aa, Homo Sapiens
KTHQRLHTE

SEQ ID NO: 351049 - protein, 9 aa, Homo Sapiens
KFWKISAPP

SEQ ID NO: 351050 - protein, 9 aa, Homo Sapiens
QNLTKYSTL

SEQ ID NO: 351051 - protein, 9 aa, Homo Sapiens
WGVKCEACP

SEQ ID NO: 351052 - protein, 9 aa, Homo Sapiens
GLFVPLQSI

SEQ ID NO: 351053 - protein, 9 aa, Homo Sapiens
QSDKHTVMD

SEQ ID NO: 351054 - protein, 9 aa, Homo Sapiens
TVENAYISA

SEQ ID NO: 351055 - protein, 9 aa, Homo Sapiens
GCYCICEDE

SEQ ID NO: 351056 - protein, 9 aa, Homo Sapiens
LIPLEKLEK

SEQ ID NO: 351057 - protein, 9 aa, Homo Sapiens
SAMNTLRNK

SEQ ID NO: 351058 - protein, 9 aa, Homo Sapiens
SELDIMFTL

SEQ ID NO: 351059 - protein, 9 aa, Homo Sapiens
EKKESIFVV

SEQ ID NO: 351060 - protein, 9 aa, Homo Sapiens
GNLALGQKL

SEQ ID NO: 351061 - protein, 9 aa, Homo Sapiens
DQDIMLLCL

SEQ ID NO: 351062 - protein, 9 aa, Homo Sapiens
TNSGSGLLP

SEQ ID NO: 351063 - protein, 9 aa, Homo Sapiens
KEENIFCDN

SEQ ID NO: 351064 - protein, 9 aa, Homo Sapiens
QGLKDYFQK

SEQ ID NO: 351065 - protein, 9 aa, Homo Sapiens
LSTKKKAIS

SEQ ID NO: 351066 - protein, 9 aa, Homo Sapiens
IKAENTTRA

SEQ ID NO: 351067 - protein, 9 aa, Homo Sapiens
FRYLHNRSR

SEQ ID NO: 351068 - protein, 9 aa, Homo Sapiens
TDLFLSLVA

SEQ ID NO: 351069 - protein, 9 aa, Homo Sapiens
EVITLWFQS

SEQ ID NO: 351070 - protein, 9 aa, Homo Sapiens
ESSLTKHIQ

SEQ ID NO: 351071 - protein, 9 aa, Homo Sapiens
QFLKEINKW

SEQ ID NO: 351072 - protein, 9 aa, Homo Sapiens
TEKTPDEKK

SEQ ID NO: 351073 - protein, 9 aa, Homo Sapiens
EKRATATEC

SEQ ID NO: 351074 - protein, 9 aa, Homo Sapiens
VQACGADSY

SEQ ID NO: 351075 - protein, 9 aa, Homo Sapiens
KQITEVEPP

SEQ ID NO: 351076 - protein, 9 aa, Homo Sapiens
WYGSCVQHQ

SEQ ID NO: 351077 - protein, 9 aa, Homo Sapiens
WAEVDRKRV

SEQ ID NO: 351078 - protein, 9 aa, Homo Sapiens
DKTKDLLVN

SEQ ID NO: 351079 - protein, 9 aa, Homo Sapiens
NLQRQLALK

SEQ ID NO: 351080 - protein, 9 aa, Homo Sapiens
QHLQDYEKY

SEQ ID NO: 351081 - protein, 9 aa, Homo Sapiens
NNSSYVHGG

SEQ ID NO: 351082 - protein, 9 aa, Homo Sapiens
NEDVIVWMR

SEQ ID NO: 351083 - protein, 9 aa, Homo Sapiens
SFLTTFQMT

SEQ ID NO: 351084 - protein, 9 aa, Homo Sapiens
HEMDSFNGP

SEQ ID NO: 351085 - protein, 9 aa, Homo Sapiens
GYDSTQQYR

SEQ ID NO: 351086 - protein, 9 aa, Homo Sapiens
KRNTTTEEN

SEQ ID NO: 351087 - protein, 9 aa, Homo Sapiens
LVLQAYIFN

SEQ ID NO: 351088 - protein, 9 aa, Homo Sapiens
GALEFSLFY

SEQ ID NO: 351089 - protein, 9 aa, Homo Sapiens
ELFPDIYRG

SEQ ID NO: 351090 - protein, 9 aa, Homo Sapiens
LIQHHKLHT

SEQ ID NO: 351091 - protein, 9 aa, Homo Sapiens
ECGKVFHHI

SEQ ID NO: 351092 - protein, 9 aa, Homo Sapiens
INLIFRYLH

SEQ ID NO: 351093 - protein, 9 aa, Homo Sapiens
CSYISTNNG

SEQ ID NO: 351094 - protein, 9 aa, Homo Sapiens
MIMSNIQQI

SEQ ID NO: 351095 - protein, 9 aa, Homo Sapiens
IIYLIPRYV

SEQ ID NO: 351096 - protein, 9 aa, Homo Sapiens
LWLRNNPIK

SEQ ID NO: 351097 - protein, 9 aa, Homo Sapiens
YGKVFLVHK

SEQ ID NO: 351098 - protein, 9 aa, Homo Sapiens
TSADSLATP

SEQ ID NO: 351099 - protein, 9 aa, Homo Sapiens
PGLFSFLTY

SEQ ID NO: 351100 - protein, 9 aa, Homo Sapiens
PLTKGISRQ

SEQ ID NO: 351101 - protein, 9 aa, Homo Sapiens
EIQRGHLRD

SEQ ID NO: 351102 - protein, 9 aa, Homo Sapiens
KRDLHKLEL

SEQ ID NO: 351103 - protein, 9 aa, Homo Sapiens
HLKQFGNIL

SEQ ID NO: 351104 - protein, 9 aa, Homo Sapiens
MPDPKLLEK

SEQ ID NO: 351105 - protein, 9 aa, Homo Sapiens
GPLTLKGVA

SEQ ID NO: 351106 - protein, 9 aa, Homo Sapiens
QKTLIEMYT

SEQ ID NO: 351107 - protein, 9 aa, Homo Sapiens
RLQEVCSAF

SEQ ID NO: 351108 - protein, 9 aa, Homo Sapiens
QGSSVLQVS

SEQ ID NO: 351109 - protein, 9 aa, Homo Sapiens
LNSGGHSDS

SEQ ID NO: 351110 - protein, 9 aa, Homo Sapiens
PQRSQPPGK

SEQ ID NO: 351111 - protein, 9 aa, Homo Sapiens
VLDIAGFKI

SEQ ID NO: 351112 - protein, 9 aa, Homo Sapiens
KDSPFWLPE

SEQ ID NO: 351113 - protein, 9 aa, Homo Sapiens
ANSHSLFVW

SEQ ID NO: 351114 - protein, 9 aa, Homo Sapiens
RLHMQHRSF

SEQ ID NO: 351115 - protein, 9 aa, Homo Sapiens
VAKEAWDNH

SEQ ID NO: 351116 - protein, 9 aa, Homo Sapiens
ITVRHAKKI

SEQ ID NO: 351117 - protein, 9 aa, Homo Sapiens
SKKKELCRT

SEQ ID NO: 351118 - protein, 9 aa, Homo Sapiens
KLKYRKVQE

SEQ ID NO: 351119 - protein, 9 aa, Homo Sapiens
ANMVPSVTN

SEQ ID NO: 351120 - protein, 9 aa, Homo Sapiens
IDKTLMRKN

SEQ ID NO: 351121 - protein, 9 aa, Homo Sapiens
PLGGLADLF

SEQ ID NO: 351122 - protein, 9 aa, Homo Sapiens
HKLIKEMDY

SEQ ID NO: 351123 - protein, 9 aa, Homo Sapiens
IPRCSCSLS

SEQ ID NO: 351124 - protein, 9 aa, Homo Sapiens
LNEEHSHRD

SEQ ID NO: 351125 - protein, 9 aa, Homo Sapiens
RRDNGSWEV

SEQ ID NO: 351126 - protein, 9 aa, Homo Sapiens
CYLYPDLSR

SEQ ID NO: 351127 - protein, 9 aa, Homo Sapiens
IQKYILTIK

SEQ ID NO: 351128 - protein, 9 aa, Homo Sapiens
MFVFNLFIF

SEQ ID NO: 351129 - protein, 9 aa, Homo Sapiens
DCMACDLDM

SEQ ID NO: 351130 - protein, 9 aa, Homo Sapiens
ETSQANLSD

SEQ ID NO: 351131 - protein, 9 aa, Homo Sapiens
HMFFEGLRL

SEQ ID NO: 351132 - protein, 9 aa, Homo Sapiens
DSNPNQEKY

SEQ ID NO: 351133 - protein, 9 aa, Homo Sapiens
VAAFHTFLK

SEQ ID NO: 351134 - protein, 9 aa, Homo Sapiens
QLARRCFKR

SEQ ID NO: 351135 - protein, 9 aa, Homo Sapiens
PLQENHNNQ

SEQ ID NO: 351136 - protein, 9 aa, Homo Sapiens
QTPKHQNEL

SEQ ID NO: 351137 - protein, 9 aa, Homo Sapiens
WEGLNVVKM

SEQ ID NO: 351138 - protein, 9 aa, Homo Sapiens
TKSSDYLRV

SEQ ID NO: 351139 - protein, 9 aa, Homo Sapiens
QVVLEMDMG

SEQ ID NO: 351140 - protein, 9 aa, Homo Sapiens
PIDLADDLA

SEQ ID NO: 351141 - protein, 9 aa, Homo Sapiens
NGGTQIQPL

SEQ ID NO: 351142 - protein, 9 aa, Homo Sapiens
SSRGTPTQM

SEQ ID NO: 351143 - protein, 9 aa, Homo Sapiens
KKINKIPID

SEQ ID NO: 351144 - protein, 9 aa, Homo Sapiens
SCLIHEITH

SEQ ID NO: 351145 - protein, 9 aa, Homo Sapiens
EVGVHGIQI

SEQ ID NO: 351146 - protein, 9 aa, Homo Sapiens
MFAFLLCVC

SEQ ID NO: 351147 - protein, 9 aa, Homo Sapiens
KTYEYEREE

SEQ ID NO: 351148 - protein, 9 aa, Homo Sapiens
FCHSYFICH

SEQ ID NO: 351149 - protein, 9 aa, Homo Sapiens
LQNAYREVS

SEQ ID NO: 351150 - protein, 9 aa, Homo Sapiens
HSNRIVHQR

SEQ ID NO: 351151 - protein, 9 aa, Homo Sapiens
GNGASTVQE

SEQ ID NO: 351152 - protein, 9 aa, Homo Sapiens
RICSKKNEI

SEQ ID NO: 351153 - protein, 9 aa, Homo Sapiens
DLSDSERIS

SEQ ID NO: 351154 - protein, 9 aa, Homo Sapiens
PIEHQKFGK

SEQ ID NO: 351155 - protein, 9 aa, Homo Sapiens
WLIQKLSWI

SEQ ID NO: 351156 - protein, 9 aa, Homo Sapiens
HILQDMHKT

SEQ ID NO: 351157 - protein, 9 aa, Homo Sapiens
PEAAAKYVP

SEQ ID NO: 351158 - protein, 9 aa, Homo Sapiens
VGYLLFKDD

SEQ ID NO: 351159 - protein, 9 aa, Homo Sapiens
SEPLAKPNR

SEQ ID NO: 351160 - protein, 9 aa, Homo Sapiens
NNPIVKVRY

SEQ ID NO: 351161 - protein, 9 aa, Homo Sapiens
HIYVCLNEY

SEQ ID NO: 351162 - protein, 9 aa, Homo Sapiens
DEKIAFPIP

SEQ ID NO: 351163 - protein, 9 aa, Homo Sapiens
SFMYRWLKN

SEQ ID NO: 351164 - protein, 9 aa, Homo Sapiens
IIAAFDELL

SEQ ID NO: 351165 - protein, 9 aa, Homo Sapiens
ILKKFPHLA

SEQ ID NO: 351166 - protein, 9 aa, Homo Sapiens
KDVESFFKG

SEQ ID NO: 351167 - protein, 9 aa, Homo Sapiens
WDLEADSNS

SEQ ID NO: 351168 - protein, 9 aa, Homo Sapiens
YPAIYIDAQ

SEQ ID NO: 351169 - protein, 9 aa, Homo Sapiens
NDNQREVCI

SEQ ID NO: 351170 - protein, 9 aa, Homo Sapiens
PVRLTQLPK

SEQ ID NO: 351171 - protein, 9 aa, Homo Sapiens
WADNPCVSG

SEQ ID NO: 351172 - protein, 9 aa, Homo Sapiens
DREKRAAKQ

SEQ ID NO: 351173 - protein, 9 aa, Homo Sapiens
NYSKPLKKF

SEQ ID NO: 351174 - protein, 9 aa, Homo Sapiens
PSIEQQASI

SEQ ID NO: 351175 - protein, 9 aa, Homo Sapiens
YPALLQHNG

SEQ ID NO: 351176 - protein, 9 aa, Homo Sapiens
MKCDNMMTC

SEQ ID NO: 351177 - protein, 9 aa, Homo Sapiens
HATHTLTQQ

SEQ ID NO: 351178 - protein, 9 aa, Homo Sapiens
PFIRPANQY

SEQ ID NO: 351179 - protein, 9 aa, Homo Sapiens
VMLKNIKTR

SEQ ID NO: 351180 - protein, 9 aa, Homo Sapiens
NNKEVNATA

SEQ ID NO: 351181 - protein, 9 aa, Homo Sapiens
LDTAKEMKQ

SEQ ID NO: 351182 - protein, 9 aa, Homo Sapiens
KSMSQPRDL

SEQ ID NO: 351183 - protein, 9 aa, Homo Sapiens
ILAKQQNKF

SEQ ID NO: 351184 - protein, 9 aa, Homo Sapiens
LPFCQPVDP

SEQ ID NO: 351185 - protein, 9 aa, Homo Sapiens
QPQVICLPQ

SEQ ID NO: 351186 - protein, 9 aa, Homo Sapiens
VEEKQPRLL

SEQ ID NO: 351187 - protein, 9 aa, Homo Sapiens
LEHVKINQG

SEQ ID NO: 351188 - protein, 9 aa, Homo Sapiens
KKDKAFYHP

SEQ ID NO: 351189 - protein, 9 aa, Homo Sapiens
EFWFSLEIH

SEQ ID NO: 351190 - protein, 9 aa, Homo Sapiens
QSEFREQQP

SEQ ID NO: 351191 - protein, 9 aa, Homo Sapiens
KERALLNTH

SEQ ID NO: 351192 - protein, 9 aa, Homo Sapiens
GQGGAKNIQ

SEQ ID NO: 351193 - protein, 9 aa, Homo Sapiens
HELYWHLKR

SEQ ID NO: 351194 - protein, 9 aa, Homo Sapiens
LMLQHEERE

SEQ ID NO: 351195 - protein, 9 aa, Homo Sapiens
NEFCDSRLF

SEQ ID NO: 351196 - protein, 9 aa, Homo Sapiens
VKVVANITA

SEQ ID NO: 351197 - protein, 9 aa, Homo Sapiens
KPFDLHIYV

SEQ ID NO: 351198 - protein, 9 aa, Homo Sapiens
SGGELFDHI

SEQ ID NO: 351199 - protein, 9 aa, Homo Sapiens
RKTFSQSSQ

SEQ ID NO: 351200 - protein, 9 aa, Homo Sapiens
EDMFREVDK

SEQ ID NO: 351201 - protein, 9 aa, Homo Sapiens
KCSNSVTAA

SEQ ID NO: 351202 - protein, 9 aa, Homo Sapiens
NSPRQTPIC

SEQ ID NO: 351203 - protein, 9 aa, Homo Sapiens
FNLDRFCFE

SEQ ID NO: 351204 - protein, 9 aa, Homo Sapiens
DPDVECQAC

SEQ ID NO: 351205 - protein, 9 aa, Homo Sapiens
PDKRFAQPR

SEQ ID NO: 351206 - protein, 9 aa, Homo Sapiens
AKKLLQEYC

SEQ ID NO: 351207 - protein, 9 aa, Homo Sapiens
TTSTAPQLL

SEQ ID NO: 351208 - protein, 9 aa, Homo Sapiens
LDVRKTAFE

SEQ ID NO: 351209 - protein, 9 aa, Homo Sapiens
SDSERISIP

SEQ ID NO: 351210 - protein, 9 aa, Homo Sapiens
QQQREGPKG

SEQ ID NO: 351211 - protein, 9 aa, Homo Sapiens
ATSLMQIDG

SEQ ID NO: 351212 - protein, 9 aa, Homo Sapiens
LIPPQNPGS

SEQ ID NO: 351213 - protein, 9 aa, Homo Sapiens
LSQARSLLS

SEQ ID NO: 351214 - protein, 9 aa, Homo Sapiens
LDKFRDILL

SEQ ID NO: 351215 - protein, 9 aa, Homo Sapiens
EYSFLTTFQ

SEQ ID NO: 351216 - protein, 9 aa, Homo Sapiens
HIKFTEGED

SEQ ID NO: 351217 - protein, 9 aa, Homo Sapiens
ITCIVSRQL

SEQ ID NO: 351218 - protein, 9 aa, Homo Sapiens
DSVLEKDPR

SEQ ID NO: 351219 - protein, 9 aa, Homo Sapiens
KHATLWGAV

SEQ ID NO: 351220 - protein, 9 aa, Homo Sapiens
SSEQKKTKN

SEQ ID NO: 351221 - protein, 9 aa, Homo Sapiens
EWAKSDKRT

SEQ ID NO: 351222 - protein, 9 aa, Homo Sapiens
LSTLSVIAT

SEQ ID NO: 351223 - protein, 9 aa, Homo Sapiens
DFDECQFDI

SEQ ID NO: 351224 - protein, 9 aa, Homo Sapiens
RGHMDVAEP

SEQ ID NO: 351225 - protein, 9 aa, Homo Sapiens
LPSCLLSLC

SEQ ID NO: 351226 - protein, 9 aa, Homo Sapiens
HAIQNPNAQ

SEQ ID NO: 351227 - protein, 9 aa, Homo Sapiens
KIITLKTKK

SEQ ID NO: 351228 - protein, 9 aa, Homo Sapiens
LIPAVITCI

SEQ ID NO: 351229 - protein, 9 aa, Homo Sapiens
INGSKSLGE

SEQ ID NO: 351230 - protein, 9 aa, Homo Sapiens
QQCNLTTSS

SEQ ID NO: 351231 - protein, 9 aa, Homo Sapiens
SPSCLSVGE

SEQ ID NO: 351232 - protein, 9 aa, Homo Sapiens
APASSISQV

SEQ ID NO: 351233 - protein, 9 aa, Homo Sapiens
LSFSHAPSS

SEQ ID NO: 351234 - protein, 9 aa, Homo Sapiens
HIFCNVTPL

SEQ ID NO: 351235 - protein, 9 aa, Homo Sapiens
HIIENNHSL

SEQ ID NO: 351236 - protein, 9 aa, Homo Sapiens
QKLPPHLQW

SEQ ID NO: 351237 - protein, 9 aa, Homo Sapiens
ELPLSVHIS

SEQ ID NO: 351238 - protein, 9 aa, Homo Sapiens
DYHARKVQM

SEQ ID NO: 351239 - protein, 9 aa, Homo Sapiens
SSIRTHEKI

SEQ ID NO: 351240 - protein, 9 aa, Homo Sapiens
VNTSKNGIS

SEQ ID NO: 351241 - protein, 9 aa, Homo Sapiens
EMMSQTMIR

SEQ ID NO: 351242 - protein, 9 aa, Homo Sapiens
GDHLGNTNV

SEQ ID NO: 351243 - protein, 9 aa, Homo Sapiens
TFTYHKITH

SEQ ID NO: 351244 - protein, 9 aa, Homo Sapiens
DTPEICKYK

SEQ ID NO: 351245 - protein, 9 aa, Homo Sapiens
NLQARKHKY

SEQ ID NO: 351246 - protein, 9 aa, Homo Sapiens
EDIHRAFQL

SEQ ID NO: 351247 - protein, 9 aa, Homo Sapiens
ESWSVKVKI

SEQ ID NO: 351248 - protein, 9 aa, Homo Sapiens
RIYIQRTLR

SEQ ID NO: 351249 - protein, 9 aa, Homo Sapiens
LQKHVKTVH

SEQ ID NO: 351250 - protein, 9 aa, Homo Sapiens
ISDVTPDNG

SEQ ID NO: 351251 - protein, 9 aa, Homo Sapiens
NILALYTGM

SEQ ID NO: 351252 - protein, 9 aa, Homo Sapiens
ARVQPKFLQ

SEQ ID NO: 351253 - protein, 9 aa, Homo Sapiens
HFFVAIQVL

SEQ ID NO: 351254 - protein, 9 aa, Homo Sapiens
EGIQIDLRC

SEQ ID NO: 351255 - protein, 9 aa, Homo Sapiens
VGVICCPVC

SEQ ID NO: 351256 - protein, 9 aa, Homo Sapiens
FKCSNSVTA

SEQ ID NO: 351257 - protein, 9 aa, Homo Sapiens
TTLQELEEL

SEQ ID NO: 351258 - protein, 9 aa, Homo Sapiens
SKLPPVCYK

SEQ ID NO: 351259 - protein, 9 aa, Homo Sapiens
WSAITATQC

SEQ ID NO: 351260 - protein, 9 aa, Homo Sapiens
NGSLSSVPG

SEQ ID NO: 351261 - protein, 9 aa, Homo Sapiens
IAYDNSRVR

SEQ ID NO: 351262 - protein, 9 aa, Homo Sapiens
LLQLASPSG

SEQ ID NO: 351263 - protein, 9 aa, Homo Sapiens
VVKFTTQKS

SEQ ID NO: 351264 - protein, 9 aa, Homo Sapiens
SPLSLETRV

SEQ ID NO: 351265 - protein, 9 aa, Homo Sapiens
KQKQKPASS

SEQ ID NO: 351266 - protein, 9 aa, Homo Sapiens
PTKKIQVNS

SEQ ID NO: 351267 - protein, 9 aa, Homo Sapiens
SQIKATVMD

SEQ ID NO: 351268 - protein, 9 aa, Homo Sapiens
WTLLLSSPD

SEQ ID NO: 351269 - protein, 9 aa, Homo Sapiens
DKPYKCSEC

SEQ ID NO: 351270 - protein, 9 aa, Homo Sapiens
IQANDELSK

SEQ ID NO: 351271 - protein, 9 aa, Homo Sapiens
DAAPVTKNN

SEQ ID NO: 351272 - protein, 9 aa, Homo Sapiens
KGQAVQKQL

SEQ ID NO: 351273 - protein, 9 aa, Homo Sapiens
SKDNAELIT

SEQ ID NO: 351274 - protein, 9 aa, Homo Sapiens
DALDGKIKF

SEQ ID NO: 351275 - protein, 9 aa, Homo Sapiens
EDCCKKVQD

SEQ ID NO: 351276 - protein, 9 aa, Homo Sapiens
RSKNKLLLK

SEQ ID NO: 351277 - protein, 9 aa, Homo Sapiens
QINYQSSSP

SEQ ID NO: 351278 - protein, 9 aa, Homo Sapiens
WSLNSDEPV

SEQ ID NO: 351279 - protein, 9 aa, Homo Sapiens
WHHEVSAHA

SEQ ID NO: 351280 - protein, 9 aa, Homo Sapiens
RAHRIRQQN

SEQ ID NO: 351281 - protein, 9 aa, Homo Sapiens
VEVKDINNN

SEQ ID NO: 351282 - protein, 9 aa, Homo Sapiens
QAGKQWSNL

SEQ ID NO: 351283 - protein, 9 aa, Homo Sapiens
AVYCCHCRN

SEQ ID NO: 351284 - protein, 9 aa, Homo Sapiens
SLSDNLVLH

SEQ ID NO: 351285 - protein, 9 aa, Homo Sapiens
ERRYKCKQC

SEQ ID NO: 351286 - protein, 9 aa, Homo Sapiens
IYYVLYKAV

SEQ ID NO: 351287 - protein, 9 aa, Homo Sapiens
PYTYSKITM

SEQ ID NO: 351288 - protein, 9 aa, Homo Sapiens
FDRKWLQYL

SEQ ID NO: 351289 - protein, 9 aa, Homo Sapiens
KHHILRCMG

SEQ ID NO: 351290 - protein, 9 aa, Homo Sapiens
NSAMPFKII

SEQ ID NO: 351291 - protein, 9 aa, Homo Sapiens
FLIPTSYKS

SEQ ID NO: 351292 - protein, 9 aa, Homo Sapiens
EHRIPKADA

SEQ ID NO: 351293 - protein, 9 aa, Homo Sapiens
KSPLREEAN

SEQ ID NO: 351294 - protein, 9 aa, Homo Sapiens
EGPKGCNLF

SEQ ID NO: 351295 - protein, 9 aa, Homo Sapiens
FFDSRSKYL

SEQ ID NO: 351296 - protein, 9 aa, Homo Sapiens
VTALFCKVH

SEQ ID NO: 351297 - protein, 9 aa, Homo Sapiens
EESQNKSLA

SEQ ID NO: 351298 - protein, 9 aa, Homo Sapiens
AINCLHAAI

SEQ ID NO: 351299 - protein, 9 aa, Homo Sapiens
LNHPNHLFC

SEQ ID NO: 351300 - protein, 9 aa, Homo Sapiens
RYTWPCSFP

SEQ ID NO: 351301 - protein, 9 aa, Homo Sapiens
ILCFGLEDQ

SEQ ID NO: 351302 - protein, 9 aa, Homo Sapiens
TQENKHYAN

SEQ ID NO: 351303 - protein, 9 aa, Homo Sapiens
VIRHCVVCS

SEQ ID NO: 351304 - protein, 9 aa, Homo Sapiens
RMVLFGANT

SEQ ID NO: 351305 - protein, 9 aa, Homo Sapiens
NIFQNIQEM

SEQ ID NO: 351306 - protein, 9 aa, Homo Sapiens
NGNEDIPTE

SEQ ID NO: 351307 - protein, 9 aa, Homo Sapiens
KLLENLVMS

SEQ ID NO: 351308 - protein, 9 aa, Homo Sapiens
AIVHATHTL

SEQ ID NO: 351309 - protein, 9 aa, Homo Sapiens
GVYQCMAKN

SEQ ID NO: 351310 - protein, 9 aa, Homo Sapiens
YTKQKVMVT

SEQ ID NO: 351311 - protein, 9 aa, Homo Sapiens
DEKSQKKNR

SEQ ID NO: 351312 - protein, 9 aa, Homo Sapiens
DGQFRRTEQ

SEQ ID NO: 351313 - protein, 9 aa, Homo Sapiens
WQIKYLNLF

SEQ ID NO: 351314 - protein, 9 aa, Homo Sapiens
GAEDRTHNI

SEQ ID NO: 351315 - protein, 9 aa, Homo Sapiens
LENNHPLLT

SEQ ID NO: 351316 - protein, 9 aa, Homo Sapiens
SCPVSLGAQ

SEQ ID NO: 351317 - protein, 9 aa, Homo Sapiens
SNFTRWRYG

SEQ ID NO: 351318 - protein, 9 aa, Homo Sapiens
SWLPPLSPV

SEQ ID NO: 351319 - protein, 9 aa, Homo Sapiens
AFNITIMIL

SEQ ID NO: 351320 - protein, 9 aa, Homo Sapiens
SKPTEDNKL

SEQ ID NO: 351321 - protein, 9 aa, Homo Sapiens
FLGHCHYER

SEQ ID NO: 351322 - protein, 9 aa, Homo Sapiens
SRNSWLPPL

SEQ ID NO: 351323 - protein, 9 aa, Homo Sapiens
KHKIICTGE

SEQ ID NO: 351324 - protein, 9 aa, Homo Sapiens
CFDLYDVDS

SEQ ID NO: 351325 - protein, 9 aa, Homo Sapiens
FEERENLCF

SEQ ID NO: 351326 - protein, 9 aa, Homo Sapiens
SENSKEADI

SEQ ID NO: 351327 - protein, 9 aa, Homo Sapiens
VMTANLNIK

SEQ ID NO: 351328 - protein, 9 aa, Homo Sapiens
KGHLRIHQH

SEQ ID NO: 351329 - protein, 9 aa, Homo Sapiens
RITEISRDL

SEQ ID NO: 351330 - protein, 9 aa, Homo Sapiens
EGSVEVIQT

SEQ ID NO: 351331 - protein, 9 aa, Homo Sapiens
SECAHREAR

SEQ ID NO: 351332 - protein, 9 aa, Homo Sapiens
VATSKKNVC

SEQ ID NO: 351333 - protein, 9 aa, Homo Sapiens
IKFTEGEDK

SEQ ID NO: 351334 - protein, 9 aa, Homo Sapiens
TQIIAEAEK

SEQ ID NO: 351335 - protein, 9 aa, Homo Sapiens
TPGKKAATT

SEQ ID NO: 351336 - protein, 9 aa, Homo Sapiens
CPVAVKKTS

SEQ ID NO: 351337 - protein, 9 aa, Homo Sapiens
LALCCMQPH

SEQ ID NO: 351338 - protein, 9 aa, Homo Sapiens
PRKAISTLF

SEQ ID NO: 351339 - protein, 9 aa, Homo Sapiens
KIYKYWLAQ

SEQ ID NO: 351340 - protein, 9 aa, Homo Sapiens
SNPEERYDT

SEQ ID NO: 351341 - protein, 9 aa, Homo Sapiens
VDMPNTSEG

SEQ ID NO: 351342 - protein, 9 aa, Homo Sapiens
SRVCRHNKD

SEQ ID NO: 351343 - protein, 9 aa, Homo Sapiens
RDRLENTII

SEQ ID NO: 351344 - protein, 9 aa, Homo Sapiens
DGLVLLTCD

SEQ ID NO: 351345 - protein, 9 aa, Homo Sapiens
LKQAKEDAQ

SEQ ID NO: 351346 - protein, 9 aa, Homo Sapiens
KNKKVRKGK

SEQ ID NO: 351347 - protein, 9 aa, Homo Sapiens
VDLDKFRDI

SEQ ID NO: 351348 - protein, 9 aa, Homo Sapiens
NQRFKNKLP

SEQ ID NO: 351349 - protein, 9 aa, Homo Sapiens
EITEKPPQT

SEQ ID NO: 351350 - protein, 9 aa, Homo Sapiens
QAAQALAKL

SEQ ID NO: 351351 - protein, 9 aa, Homo Sapiens
EKNKMKREE

SEQ ID NO: 351352 - protein, 9 aa, Homo Sapiens
GNTEQLPPS

SEQ ID NO: 351353 - protein, 9 aa, Homo Sapiens
INEMVAKHP

SEQ ID NO: 351354 - protein, 9 aa, Homo Sapiens
DKILYNKFN

SEQ ID NO: 351355 - protein, 9 aa, Homo Sapiens
SLFEDKTDI

SEQ ID NO: 351356 - protein, 9 aa, Homo Sapiens
HGAEDRTHN

SEQ ID NO: 351357 - protein, 9 aa, Homo Sapiens
ARDKPMHDE

SEQ ID NO: 351358 - protein, 9 aa, Homo Sapiens
ETQLAGLQV

SEQ ID NO: 351359 - protein, 9 aa, Homo Sapiens
FLIYQIIRG

SEQ ID NO: 351360 - protein, 9 aa, Homo Sapiens
TKTANKIAL

SEQ ID NO: 351361 - protein, 9 aa, Homo Sapiens
LPGSSNYSA

SEQ ID NO: 351362 - protein, 9 aa, Homo Sapiens
ATPRLTLSE

SEQ ID NO: 351363 - protein, 9 aa, Homo Sapiens
PTDAYGVIH

SEQ ID NO: 351364 - protein, 9 aa, Homo Sapiens
DYGLKENDE

SEQ ID NO: 351365 - protein, 9 aa, Homo Sapiens
GKTSFFTWG

SEQ ID NO: 351366 - protein, 9 aa, Homo Sapiens
LSIRHFCKM

SEQ ID NO: 351367 - protein, 9 aa, Homo Sapiens
INKVWMAEQ

SEQ ID NO: 351368 - protein, 9 aa, Homo Sapiens
VQQGIVHRD

SEQ ID NO: 351369 - protein, 9 aa, Homo Sapiens
NHTTRWLTQ

SEQ ID NO: 351370 - protein, 9 aa, Homo Sapiens
CISIISHEC

SEQ ID NO: 351371 - protein, 9 aa, Homo Sapiens
VGTLWYRPP

SEQ ID NO: 351372 - protein, 9 aa, Homo Sapiens
EDTGGIYPS

SEQ ID NO: 351373 - protein, 9 aa, Homo Sapiens
KNVSARTDL

SEQ ID NO: 351374 - protein, 9 aa, Homo Sapiens
AVLKLACVD

SEQ ID NO: 351375 - protein, 9 aa, Homo Sapiens
KCSCMLTSP

SEQ ID NO: 351376 - protein, 9 aa, Homo Sapiens
KEIGQIIRN

SEQ ID NO: 351377 - protein, 9 aa, Homo Sapiens
LACVDTHIN

SEQ ID NO: 351378 - protein, 9 aa, Homo Sapiens
IPLVLAFCY

SEQ ID NO: 351379 - protein, 9 aa, Homo Sapiens
KKFLPVMTE

SEQ ID NO: 351380 - protein, 9 aa, Homo Sapiens
IQHIVIDKA

SEQ ID NO: 351381 - protein, 9 aa, Homo Sapiens
ADPPAENLS

SEQ ID NO: 351382 - protein, 9 aa, Homo Sapiens
SAQQLRDIF

SEQ ID NO: 351383 - protein, 9 aa, Homo Sapiens
NVDTKSTRF

SEQ ID NO: 351384 - protein, 9 aa, Homo Sapiens
SCRDRLSRL

SEQ ID NO: 351385 - protein, 9 aa, Homo Sapiens
KTIITSPEY

SEQ ID NO: 351386 - protein, 9 aa, Homo Sapiens
MKEKASFFP

SEQ ID NO: 351387 - protein, 9 aa, Homo Sapiens
ESTLFQQSE

SEQ ID NO: 351388 - protein, 9 aa, Homo Sapiens
VTRAGFLNR

SEQ ID NO: 351389 - protein, 9 aa, Homo Sapiens
SSFAKHQII

SEQ ID NO: 351390 - protein, 9 aa, Homo Sapiens
LVETQKSKV

SEQ ID NO: 351391 - protein, 9 aa, Homo Sapiens
VGGGSLNLI

SEQ ID NO: 351392 - protein, 9 aa, Homo Sapiens
WAGPLQAIT

SEQ ID NO: 351393 - protein, 9 aa, Homo Sapiens
SQEPEKALH

SEQ ID NO: 351394 - protein, 9 aa, Homo Sapiens
KKIKQAIKS

SEQ ID NO: 351395 - protein, 9 aa, Homo Sapiens
CCLCAIDIH

SEQ ID NO: 351396 - protein, 9 aa, Homo Sapiens
SENVQNNTR

SEQ ID NO: 351397 - protein, 9 aa, Homo Sapiens
AECHMLAVM

SEQ ID NO: 351398 - protein, 9 aa, Homo Sapiens
LKNHDNSLS

SEQ ID NO: 351399 - protein, 9 aa, Homo Sapiens
LWSSGTAAA

SEQ ID NO: 351400 - protein, 9 aa, Homo Sapiens
DLFSEGSLG

SEQ ID NO: 351401 - protein, 9 aa, Homo Sapiens
YISTNNGKR

SEQ ID NO: 351402 - protein, 9 aa, Homo Sapiens
RQILEALHY

SEQ ID NO: 351403 - protein, 9 aa, Homo Sapiens
RPYLCTPRH

SEQ ID NO: 351404 - protein, 9 aa, Homo Sapiens
GRSIELAYE

SEQ ID NO: 351405 - protein, 9 aa, Homo Sapiens
GPEASRPPT

SEQ ID NO: 351406 - protein, 9 aa, Homo Sapiens
QVSKHQITH

SEQ ID NO: 351407 - protein, 9 aa, Homo Sapiens
HQITHEIEK

SEQ ID NO: 351408 - protein, 9 aa, Homo Sapiens
ERHGSAAEQ

SEQ ID NO: 351409 - protein, 9 aa, Homo Sapiens
LKIMFPDII

SEQ ID NO: 351410 - protein, 9 aa, Homo Sapiens
LSEISNPKN

SEQ ID NO: 351411 - protein, 9 aa, Homo Sapiens
GSVAFEDVA

SEQ ID NO: 351412 - protein, 9 aa, Homo Sapiens
CYCICEDEN

SEQ ID NO: 351413 - protein, 9 aa, Homo Sapiens
VVSQWSRSA

SEQ ID NO: 351414 - protein, 9 aa, Homo Sapiens
HRNLKLDNL

SEQ ID NO: 351415 - protein, 9 aa, Homo Sapiens
NHTAFIRIQ

SEQ ID NO: 351416 - protein, 9 aa, Homo Sapiens
LFSEGSLGS

SEQ ID NO: 351417 - protein, 9 aa, Homo Sapiens
STEVLYVNQ

SEQ ID NO: 351418 - protein, 9 aa, Homo Sapiens
TLQFGGKRL

SEQ ID NO: 351419 - protein, 9 aa, Homo Sapiens
HYGREGLTG

SEQ ID NO: 351420 - protein, 9 aa, Homo Sapiens
VECIKAESA

SEQ ID NO: 351421 - protein, 9 aa, Homo Sapiens
NLSAPGQGC

SEQ ID NO: 351422 - protein, 9 aa, Homo Sapiens
EQENEDLAH

SEQ ID NO: 351423 - protein, 9 aa, Homo Sapiens
KINSRKTVT

SEQ ID NO: 351424 - protein, 9 aa, Homo Sapiens
NTLYQKEIK

SEQ ID NO: 351425 - protein, 9 aa, Homo Sapiens
FYFPLSSEP

SEQ ID NO: 351426 - protein, 9 aa, Homo Sapiens
EIQQNSGFG

SEQ ID NO: 351427 - protein, 9 aa, Homo Sapiens
DTHEKISVQ

SEQ ID NO: 351428 - protein, 9 aa, Homo Sapiens
EDYGVINTD

SEQ ID NO: 351429 - protein, 9 aa, Homo Sapiens
TNEATTDST

SEQ ID NO: 351430 - protein, 9 aa, Homo Sapiens
VSMKAPPDL

SEQ ID NO: 351431 - protein, 9 aa, Homo Sapiens
YMLLASEVE

SEQ ID NO: 351432 - protein, 9 aa, Homo Sapiens
KKRDSWKSS

SEQ ID NO: 351433 - protein, 9 aa, Homo Sapiens
LSMFTGEEK

SEQ ID NO: 351434 - protein, 9 aa, Homo Sapiens
LNGENVYHC

SEQ ID NO: 351435 - protein, 9 aa, Homo Sapiens
VVTVAGNLN

SEQ ID NO: 351436 - protein, 9 aa, Homo Sapiens
YPGFRISFS

SEQ ID NO: 351437 - protein, 9 aa, Homo Sapiens
DAYGVIHFQ

SEQ ID NO: 351438 - protein, 9 aa, Homo Sapiens
LEKEATEKF

SEQ ID NO: 351439 - protein, 9 aa, Homo Sapiens
QDKHSDSDY

SEQ ID NO: 351440 - protein, 9 aa, Homo Sapiens
DFINIESKF

SEQ ID NO: 351441 - protein, 9 aa, Homo Sapiens
QINRFAWPK

SEQ ID NO: 351442 - protein, 9 aa, Homo Sapiens
SHFTTFDGQ

SEQ ID NO: 351443 - protein, 9 aa, Homo Sapiens
LLERGHTDI

SEQ ID NO: 351444 - protein, 9 aa, Homo Sapiens
LILEHYVGA

SEQ ID NO: 351445 - protein, 9 aa, Homo Sapiens
GHKSSMKKL

SEQ ID NO: 351446 - protein, 9 aa, Homo Sapiens
KFVEACLNK

SEQ ID NO: 351447 - protein, 9 aa, Homo Sapiens
GDAFQSHTF

SEQ ID NO: 351448 - protein, 9 aa, Homo Sapiens
EIGQIIRNG

SEQ ID NO: 351449 - protein, 9 aa, Homo Sapiens
MNMGRINDI

SEQ ID NO: 351450 - protein, 9 aa, Homo Sapiens
FYSKITTRD

SEQ ID NO: 351451 - protein, 9 aa, Homo Sapiens
ENIFCDNIK

SEQ ID NO: 351452 - protein, 9 aa, Homo Sapiens
NDTELICYV

SEQ ID NO: 351453 - protein, 9 aa, Homo Sapiens
ADLHPGHIL

SEQ ID NO: 351454 - protein, 9 aa, Homo Sapiens
PGSTPQISL

SEQ ID NO: 351455 - protein, 9 aa, Homo Sapiens
QRHMVMHTG

SEQ ID NO: 351456 - protein, 9 aa, Homo Sapiens
VECQACDCD

SEQ ID NO: 351457 - protein, 9 aa, Homo Sapiens
MTDMAKIKL

SEQ ID NO: 351458 - protein, 9 aa, Homo Sapiens
VVVGYNGPN

SEQ ID NO: 351459 - protein, 9 aa, Homo Sapiens
TGIYKLSLC

SEQ ID NO: 351460 - protein, 9 aa, Homo Sapiens
LVCGNITVY

SEQ ID NO: 351461 - protein, 9 aa, Homo Sapiens
ATLVLMWLK

SEQ ID NO: 351462 - protein, 9 aa, Homo Sapiens
KTYLICYQR

SEQ ID NO: 351463 - protein, 9 aa, Homo Sapiens
PSLLNHTTR

SEQ ID NO: 351464 - protein, 9 aa, Homo Sapiens
VDARSDQTG

SEQ ID NO: 351465 - protein, 9 aa, Homo Sapiens
QTFFDPKSN

SEQ ID NO: 351466 - protein, 9 aa, Homo Sapiens
PEDNFLAAQ

SEQ ID NO: 351467 - protein, 9 aa, Homo Sapiens
LVFCERGKF

SEQ ID NO: 351468 - protein, 9 aa, Homo Sapiens
NNLINKCNF

SEQ ID NO: 351469 - protein, 9 aa, Homo Sapiens
IKELFLGLA

SEQ ID NO: 351470 - protein, 9 aa, Homo Sapiens
ERLSLLWSE

SEQ ID NO: 351471 - protein, 9 aa, Homo Sapiens
VGVHGIQIE

SEQ ID NO: 351472 - protein, 9 aa, Homo Sapiens
IIISYARII

SEQ ID NO: 351473 - protein, 9 aa, Homo Sapiens
VVSIIFIPC

SEQ ID NO: 351474 - protein, 9 aa, Homo Sapiens
SDCNSSPEH

SEQ ID NO: 351475 - protein, 9 aa, Homo Sapiens
TFLNVFQSR

SEQ ID NO: 351476 - protein, 9 aa, Homo Sapiens
GVCIGDKRR

SEQ ID NO: 351477 - protein, 9 aa, Homo Sapiens
GFADFVYKR

SEQ ID NO: 351478 - protein, 9 aa, Homo Sapiens
LSSFSLRDS

SEQ ID NO: 351479 - protein, 9 aa, Homo Sapiens
RVQLAHHLS

SEQ ID NO: 351480 - protein, 9 aa, Homo Sapiens
GLCQSPLLD

SEQ ID NO: 351481 - protein, 9 aa, Homo Sapiens
SLNNATKAG

SEQ ID NO: 351482 - protein, 9 aa, Homo Sapiens
LRHGVRILR

SEQ ID NO: 351483 - protein, 9 aa, Homo Sapiens
ECGKLFRHS

SEQ ID NO: 351484 - protein, 9 aa, Homo Sapiens
PNNTFLQDQ

SEQ ID NO: 351485 - protein, 9 aa, Homo Sapiens
RVVLQLKDH

SEQ ID NO: 351486 - protein, 9 aa, Homo Sapiens
ETMRMLKSE

SEQ ID NO: 351487 - protein, 9 aa, Homo Sapiens
DGLLQQLKE

SEQ ID NO: 351488 - protein, 9 aa, Homo Sapiens
LLNDILKAS

SEQ ID NO: 351489 - protein, 9 aa, Homo Sapiens
NLCNKIDVV

SEQ ID NO: 351490 - protein, 9 aa, Homo Sapiens
NVFRQLDKC

SEQ ID NO: 351491 - protein, 9 aa, Homo Sapiens
TQTLLKEIA

SEQ ID NO: 351492 - protein, 9 aa, Homo Sapiens
RKVFINTIP

SEQ ID NO: 351493 - protein, 9 aa, Homo Sapiens
SDEVTESVY

SEQ ID NO: 351494 - protein, 9 aa, Homo Sapiens
LCTLGVVRL

SEQ ID NO: 351495 - protein, 9 aa, Homo Sapiens
YKDLKKFLK

SEQ ID NO: 351496 - protein, 9 aa, Homo Sapiens
CQGYFRDYC

SEQ ID NO: 351497 - protein, 9 aa, Homo Sapiens
AQAKPPKIT

SEQ ID NO: 351498 - protein, 9 aa, Homo Sapiens
LYLYQFQLF

SEQ ID NO: 351499 - protein, 9 aa, Homo Sapiens
CTSTSNMGS

SEQ ID NO: 351500 - protein, 9 aa, Homo Sapiens
NISEFRVVV

SEQ ID NO: 351501 - protein, 9 aa, Homo Sapiens
SLPFCQPVD

SEQ ID NO: 351502 - protein, 9 aa, Homo Sapiens
CVPWNLHEP

SEQ ID NO: 351503 - protein, 9 aa, Homo Sapiens
PHACSECGK

SEQ ID NO: 351504 - protein, 9 aa, Homo Sapiens
KGSYSLVET

SEQ ID NO: 351505 - protein, 9 aa, Homo Sapiens
AREKDVESF

SEQ ID NO: 351506 - protein, 9 aa, Homo Sapiens
NQKCELCHK

SEQ ID NO: 351507 - protein, 9 aa, Homo Sapiens
APRHILVKF

SEQ ID NO: 351508 - protein, 9 aa, Homo Sapiens
SHLHINHLY

SEQ ID NO: 351509 - protein, 9 aa, Homo Sapiens
VAKNNLNPS

SEQ ID NO: 351510 - protein, 9 aa, Homo Sapiens
LIRPLKISS

SEQ ID NO: 351511 - protein, 9 aa, Homo Sapiens
YFKISHKML

SEQ ID NO: 351512 - protein, 9 aa, Homo Sapiens
NIKLFFSGS

SEQ ID NO: 351513 - protein, 9 aa, Homo Sapiens
RDSLISLEE

SEQ ID NO: 351514 - protein, 9 aa, Homo Sapiens
IKNETDVFW

SEQ ID NO: 351515 - protein, 9 aa, Homo Sapiens
VLRFPDCRK

SEQ ID NO: 351516 - protein, 9 aa, Homo Sapiens
QRILNRSKI

SEQ ID NO: 351517 - protein, 9 aa, Homo Sapiens
KAEAITSQK

SEQ ID NO: 351518 - protein, 9 aa, Homo Sapiens
NERRYSLSF

SEQ ID NO: 351519 - protein, 9 aa, Homo Sapiens
HLQRWNQLQ

SEQ ID NO: 351520 - protein, 9 aa, Homo Sapiens
RLHSGSASP

SEQ ID NO: 351521 - protein, 9 aa, Homo Sapiens
QNVLKVLTN

SEQ ID NO: 351522 - protein, 9 aa, Homo Sapiens
VRLSVAEDP

SEQ ID NO: 351523 - protein, 9 aa, Homo Sapiens
KEEQNRSSL

SEQ ID NO: 351524 - protein, 9 aa, Homo Sapiens
KEQEFRKQI

SEQ ID NO: 351525 - protein, 9 aa, Homo Sapiens
KSSFSLSGS

SEQ ID NO: 351526 - protein, 9 aa, Homo Sapiens
SYFFYKRLN

SEQ ID NO: 351527 - protein, 9 aa, Homo Sapiens
RVNKCGAQH

SEQ ID NO: 351528 - protein, 9 aa, Homo Sapiens
VLKTLRKPA

SEQ ID NO: 351529 - protein, 9 aa, Homo Sapiens
SSSDRINSG

SEQ ID NO: 351530 - protein, 9 aa, Homo Sapiens
SPHSKAISE

SEQ ID NO: 351531 - protein, 9 aa, Homo Sapiens
KLEQHIQKR

SEQ ID NO: 351532 - protein, 9 aa, Homo Sapiens
EAQRSLHRV

SEQ ID NO: 351533 - protein, 9 aa, Homo Sapiens
ILNDTELIC

SEQ ID NO: 351534 - protein, 9 aa, Homo Sapiens
IINENRKQQ

SEQ ID NO: 351535 - protein, 9 aa, Homo Sapiens
QPPVSTLSP

SEQ ID NO: 351536 - protein, 9 aa, Homo Sapiens
ESKMNENII

SEQ ID NO: 351537 - protein, 9 aa, Homo Sapiens
YDPNFYNET

SEQ ID NO: 351538 - protein, 9 aa, Homo Sapiens
QKLSVTFIE

SEQ ID NO: 351539 - protein, 9 aa, Homo Sapiens
TFYKINKNK

SEQ ID NO: 351540 - protein, 9 aa, Homo Sapiens
NTQETLYQC

SEQ ID NO: 351541 - protein, 9 aa, Homo Sapiens
NSNAIQVDQ

SEQ ID NO: 351542 - protein, 9 aa, Homo Sapiens
LGAYVEQYL

SEQ ID NO: 351543 - protein, 9 aa, Homo Sapiens
EKPFDCINC

SEQ ID NO: 351544 - protein, 9 aa, Homo Sapiens
NKCGAQHVN

SEQ ID NO: 351545 - protein, 9 aa, Homo Sapiens
RTNNWSLIG

SEQ ID NO: 351546 - protein, 9 aa, Homo Sapiens
GRRRKQSGR

SEQ ID NO: 351547 - protein, 9 aa, Homo Sapiens
DDNYFVNYT

SEQ ID NO: 351548 - protein, 9 aa, Homo Sapiens
VQRESLNRH

SEQ ID NO: 351549 - protein, 9 aa, Homo Sapiens
ANNINDITE

SEQ ID NO: 351550 - protein, 9 aa, Homo Sapiens
RAFQLLLTE

SEQ ID NO: 351551 - protein, 9 aa, Homo Sapiens
QQPLKNPSV

SEQ ID NO: 351552 - protein, 9 aa, Homo Sapiens
NHLKQNDSI

SEQ ID NO: 351553 - protein, 9 aa, Homo Sapiens
RKQIHNLED

SEQ ID NO: 351554 - protein, 9 aa, Homo Sapiens
VESTVDQKN

SEQ ID NO: 351555 - protein, 9 aa, Homo Sapiens
DIISDEANS

SEQ ID NO: 351556 - protein, 9 aa, Homo Sapiens
DEKDWFAKW

SEQ ID NO: 351557 - protein, 9 aa, Homo Sapiens
LRSKNKDIE

SEQ ID NO: 351558 - protein, 9 aa, Homo Sapiens
QKERKNRMK

SEQ ID NO: 351559 - protein, 9 aa, Homo Sapiens
SVQHNKDIT

SEQ ID NO: 351560 - protein, 9 aa, Homo Sapiens
IWAEVGNTI

SEQ ID NO: 351561 - protein, 9 aa, Homo Sapiens
GGGVQIRSV

SEQ ID NO: 351562 - protein, 9 aa, Homo Sapiens
GRQMGGGRD

SEQ ID NO: 351563 - protein, 9 aa, Homo Sapiens
HSGGCPCKG

SEQ ID NO: 351564 - protein, 9 aa, Homo Sapiens
ATKDKFALE

SEQ ID NO: 351565 - protein, 9 aa, Homo Sapiens
TVHKILCKL

SEQ ID NO: 351566 - protein, 9 aa, Homo Sapiens
GRTLTLGVL

SEQ ID NO: 351567 - protein, 9 aa, Homo Sapiens
DSWKSSGFL

SEQ ID NO: 351568 - protein, 9 aa, Homo Sapiens
HADKEMEGT

SEQ ID NO: 351569 - protein, 9 aa, Homo Sapiens
CLTNGNTLW

SEQ ID NO: 351570 - protein, 9 aa, Homo Sapiens
TIANHWIIH

SEQ ID NO: 351571 - protein, 9 aa, Homo Sapiens
TVKIISKKK

SEQ ID NO: 351572 - protein, 9 aa, Homo Sapiens
KVAKRGGQH

SEQ ID NO: 351573 - protein, 9 aa, Homo Sapiens
LPDYSPFSS

SEQ ID NO: 351574 - protein, 9 aa, Homo Sapiens
YPQVLNLGQ

SEQ ID NO: 351575 - protein, 9 aa, Homo Sapiens
RSLDWGAPN

SEQ ID NO: 351576 - protein, 9 aa, Homo Sapiens
MVEIPPTDI

SEQ ID NO: 351577 - protein, 9 aa, Homo Sapiens
TTTHRCICC

SEQ ID NO: 351578 - protein, 9 aa, Homo Sapiens
LLLDERQDA

SEQ ID NO: 351579 - protein, 9 aa, Homo Sapiens
NLMLQHEER

SEQ ID NO: 351580 - protein, 9 aa, Homo Sapiens
ETSLKIPKR

SEQ ID NO: 351581 - protein, 9 aa, Homo Sapiens
QITSSNVIN

SEQ ID NO: 351582 - protein, 9 aa, Homo Sapiens
KKSLEEAAK

SEQ ID NO: 351583 - protein, 9 aa, Homo Sapiens
LSASGTPWY

SEQ ID NO: 351584 - protein, 9 aa, Homo Sapiens
CSHNGTDPY

SEQ ID NO: 351585 - protein, 9 aa, Homo Sapiens
TSNNSALEY

SEQ ID NO: 351586 - protein, 9 aa, Homo Sapiens
TPLKKQRFY

SEQ ID NO: 351587 - protein, 9 aa, Homo Sapiens
SASGKSAQI

SEQ ID NO: 351588 - protein, 9 aa, Homo Sapiens
GVKAYECSR

SEQ ID NO: 351589 - protein, 9 aa, Homo Sapiens
KEDRGPDDQ

SEQ ID NO: 351590 - protein, 9 aa, Homo Sapiens
YKETTYQRD

SEQ ID NO: 351591 - protein, 9 aa, Homo Sapiens
APQSQDFQF

SEQ ID NO: 351592 - protein, 9 aa, Homo Sapiens
ANNPIGDTG

SEQ ID NO: 351593 - protein, 9 aa, Homo Sapiens
ISGKHHILR

SEQ ID NO: 351594 - protein, 9 aa, Homo Sapiens
MASILEKES

SEQ ID NO: 351595 - protein, 9 aa, Homo Sapiens
LDYLPQPYR

SEQ ID NO: 351596 - protein, 9 aa, Homo Sapiens
NGVSLMDRP

SEQ ID NO: 351597 - protein, 9 aa, Homo Sapiens
REKDVESFF

SEQ ID NO: 351598 - protein, 9 aa, Homo Sapiens
PACHLRKCC

SEQ ID NO: 351599 - protein, 9 aa, Homo Sapiens
CTIDGLLML

SEQ ID NO: 351600 - protein, 9 aa, Homo Sapiens
KLLIWMSKR

SEQ ID NO: 351601 - protein, 9 aa, Homo Sapiens
EMLHKKRRE

SEQ ID NO: 351602 - protein, 9 aa, Homo Sapiens
TFLASHRKL

SEQ ID NO: 351603 - protein, 9 aa, Homo Sapiens
LDKFCTKLY

SEQ ID NO: 351604 - protein, 9 aa, Homo Sapiens
QWLEADCHG

SEQ ID NO: 351605 - protein, 9 aa, Homo Sapiens
RYDTPKRAL

SEQ ID NO: 351606 - protein, 9 aa, Homo Sapiens
DIPSEASGL

SEQ ID NO: 351607 - protein, 9 aa, Homo Sapiens
KLACVDTHI

SEQ ID NO: 351608 - protein, 9 aa, Homo Sapiens
PPACPSKSP

SEQ ID NO: 351609 - protein, 9 aa, Homo Sapiens
QQEKQNTAY

SEQ ID NO: 351610 - protein, 9 aa, Homo Sapiens
LQTEVSRLK

SEQ ID NO: 351611 - protein, 9 aa, Homo Sapiens
ISFLLLLFS

SEQ ID NO: 351612 - protein, 9 aa, Homo Sapiens
PFPFGVRIY

SEQ ID NO: 351613 - protein, 9 aa, Homo Sapiens
PGNIYPTSK

SEQ ID NO: 351614 - protein, 9 aa, Homo Sapiens
GINLVRCHA

SEQ ID NO: 351615 - protein, 9 aa, Homo Sapiens
GGKAAEDCF

SEQ ID NO: 351616 - protein, 9 aa, Homo Sapiens
HSDTLEHLL

SEQ ID NO: 351617 - protein, 9 aa, Homo Sapiens
VLLARINNF

SEQ ID NO: 351618 - protein, 9 aa, Homo Sapiens
SYNQPKAMT

SEQ ID NO: 351619 - protein, 9 aa, Homo Sapiens
VTDLLNCFL

SEQ ID NO: 351620 - protein, 9 aa, Homo Sapiens
VENNWFKWF

SEQ ID NO: 351621 - protein, 9 aa, Homo Sapiens
LVETEKEKR

SEQ ID NO: 351622 - protein, 9 aa, Homo Sapiens
VAGKMDLDH

SEQ ID NO: 351623 - protein, 9 aa, Homo Sapiens
FQTEVSYLE

SEQ ID NO: 351624 - protein, 9 aa, Homo Sapiens
SPFTETLKG

SEQ ID NO: 351625 - protein, 9 aa, Homo Sapiens
DTCCHVSIT

SEQ ID NO: 351626 - protein, 9 aa, Homo Sapiens
TATEAADYI

SEQ ID NO: 351627 - protein, 9 aa, Homo Sapiens
VITLWLVYL

SEQ ID NO: 351628 - protein, 9 aa, Homo Sapiens
DLKVNQFKN

SEQ ID NO: 351629 - protein, 9 aa, Homo Sapiens
EGTGRLFFK

SEQ ID NO: 351630 - protein, 9 aa, Homo Sapiens
TISDTNEAA

SEQ ID NO: 351631 - protein, 9 aa, Homo Sapiens
GQGRHNAIK

SEQ ID NO: 351632 - protein, 9 aa, Homo Sapiens
FESMLPDKV

SEQ ID NO: 351633 - protein, 9 aa, Homo Sapiens
FNLQARKHK

SEQ ID NO: 351634 - protein, 9 aa, Homo Sapiens
THEKGTSRK

SEQ ID NO: 351635 - protein, 9 aa, Homo Sapiens
GKQWSNLSS

SEQ ID NO: 351636 - protein, 9 aa, Homo Sapiens
ESNCAELMK

SEQ ID NO: 351637 - protein, 9 aa, Homo Sapiens
MAAEIVTNI

SEQ ID NO: 351638 - protein, 9 aa, Homo Sapiens
ACANEIALS

SEQ ID NO: 351639 - protein, 9 aa, Homo Sapiens
HMLFELLKN

SEQ ID NO: 351640 - protein, 9 aa, Homo Sapiens
EKSQVQTLH

SEQ ID NO: 351641 - protein, 9 aa, Homo Sapiens
EALNTDKIK

SEQ ID NO: 351642 - protein, 9 aa, Homo Sapiens
RQMGGGRDS

SEQ ID NO: 351643 - protein, 9 aa, Homo Sapiens
INVELSLLE

SEQ ID NO: 351644 - protein, 9 aa, Homo Sapiens
NSCPVSLGA

SEQ ID NO: 351645 - protein, 9 aa, Homo Sapiens
TKHKLIHTG

SEQ ID NO: 351646 - protein, 9 aa, Homo Sapiens
PDIFPGLHK

SEQ ID NO: 351647 - protein, 9 aa, Homo Sapiens
KKVEEESKQ

SEQ ID NO: 351648 - protein, 9 aa, Homo Sapiens
YGLSCQGPC

SEQ ID NO: 351649 - protein, 9 aa, Homo Sapiens
FRSPSPLVY

SEQ ID NO: 351650 - protein, 9 aa, Homo Sapiens
KHQITHEIE

SEQ ID NO: 351651 - protein, 9 aa, Homo Sapiens
RRIQNEKGE

SEQ ID NO: 351652 - protein, 9 aa, Homo Sapiens
LEYSPSAYT

SEQ ID NO: 351653 - protein, 9 aa, Homo Sapiens
INILREKQT

SEQ ID NO: 351654 - protein, 9 aa, Homo Sapiens
FQHQVIHTG

SEQ ID NO: 351655 - protein, 9 aa, Homo Sapiens
SQTCVMWDD

SEQ ID NO: 351656 - protein, 9 aa, Homo Sapiens
DLQNNLISS

SEQ ID NO: 351657 - protein, 9 aa, Homo Sapiens
PRCINMTDT

SEQ ID NO: 351658 - protein, 9 aa, Homo Sapiens
CETVIVAWA

SEQ ID NO: 351659 - protein, 9 aa, Homo Sapiens
SENLNLRKQ

SEQ ID NO: 351660 - protein, 9 aa, Homo Sapiens
TATGRGKPP

SEQ ID NO: 351661 - protein, 9 aa, Homo Sapiens
QPGGLQPLL

SEQ ID NO: 351662 - protein, 9 aa, Homo Sapiens
DKLTELMFE

SEQ ID NO: 351663 - protein, 9 aa, Homo Sapiens
EDDDTLSYT

SEQ ID NO: 351664 - protein, 9 aa, Homo Sapiens
LSGMDSLSS

SEQ ID NO: 351665 - protein, 9 aa, Homo Sapiens
YLQEQGIHA

SEQ ID NO: 351666 - protein, 9 aa, Homo Sapiens
HFFRPRCLH

SEQ ID NO: 351667 - protein, 9 aa, Homo Sapiens
TSLVNKPLV

SEQ ID NO: 351668 - protein, 9 aa, Homo Sapiens
NKRALRRFL

SEQ ID NO: 351669 - protein, 9 aa, Homo Sapiens
RISFSTTSA

SEQ ID NO: 351670 - protein, 9 aa, Homo Sapiens
DLQNLIDCG

SEQ ID NO: 351671 - protein, 9 aa, Homo Sapiens
KNDDDPKFM

SEQ ID NO: 351672 - protein, 9 aa, Homo Sapiens
ERTQASTEG

SEQ ID NO: 351673 - protein, 9 aa, Homo Sapiens
VFKLMDVAP

SEQ ID NO: 351674 - protein, 9 aa, Homo Sapiens
TLWLVYLWV

SEQ ID NO: 351675 - protein, 9 aa, Homo Sapiens
ALKVEGLVA

SEQ ID NO: 351676 - protein, 9 aa, Homo Sapiens
TVSLCLGSW

SEQ ID NO: 351677 - protein, 9 aa, Homo Sapiens
ELQTEVSRL

SEQ ID NO: 351678 - protein, 9 aa, Homo Sapiens
TYPECLQYG

SEQ ID NO: 351679 - protein, 9 aa, Homo Sapiens
NPEERYDTP

SEQ ID NO: 351680 - protein, 9 aa, Homo Sapiens
QMFPHHSIT

SEQ ID NO: 351681 - protein, 9 aa, Homo Sapiens
MGRALSMTL

SEQ ID NO: 351682 - protein, 9 aa, Homo Sapiens
VNLSLLDLI

SEQ ID NO: 351683 - protein, 9 aa, Homo Sapiens
LSCVVFINK

SEQ ID NO: 351684 - protein, 9 aa, Homo Sapiens
KETERHSVC

SEQ ID NO: 351685 - protein, 9 aa, Homo Sapiens
KSFSQSAYL

SEQ ID NO: 351686 - protein, 9 aa, Homo Sapiens
NINEGASNP

SEQ ID NO: 351687 - protein, 9 aa, Homo Sapiens
RPQIKKDEK

SEQ ID NO: 351688 - protein, 9 aa, Homo Sapiens
FIRPANQYK

SEQ ID NO: 351689 - protein, 9 aa, Homo Sapiens
SLFYDQDNS

SEQ ID NO: 351690 - protein, 9 aa, Homo Sapiens
FLKEINKWT

SEQ ID NO: 351691 - protein, 9 aa, Homo Sapiens
KFILNDGTM

SEQ ID NO: 351692 - protein, 9 aa, Homo Sapiens
KAPTDPKLR

SEQ ID NO: 351693 - protein, 9 aa, Homo Sapiens
QILFSALET

SEQ ID NO: 351694 - protein, 9 aa, Homo Sapiens
CEYAFNRKD

SEQ ID NO: 351695 - protein, 9 aa, Homo Sapiens
LDEEESIWK

SEQ ID NO: 351696 - protein, 9 aa, Homo Sapiens
KVRQLEQDN

SEQ ID NO: 351697 - protein, 9 aa, Homo Sapiens
ACYAASVIG

SEQ ID NO: 351698 - protein, 9 aa, Homo Sapiens
AYMCSCHKG

SEQ ID NO: 351699 - protein, 9 aa, Homo Sapiens
VLSENVQNN

SEQ ID NO: 351700 - protein, 9 aa, Homo Sapiens
LDGKIKFFK

SEQ ID NO: 351701 - protein, 9 aa, Homo Sapiens
LLDKAFSIS

SEQ ID NO: 351702 - protein, 9 aa, Homo Sapiens
NKLIKVLSP

SEQ ID NO: 351703 - protein, 9 aa, Homo Sapiens
SKSLNKEWK

SEQ ID NO: 351704 - protein, 9 aa, Homo Sapiens
HHEVSAHAL

SEQ ID NO: 351705 - protein, 9 aa, Homo Sapiens
LNYDLTLWC

SEQ ID NO: 351706 - protein, 9 aa, Homo Sapiens
SFLSELGVT

SEQ ID NO: 351707 - protein, 9 aa, Homo Sapiens
PSEQIINQL

SEQ ID NO: 351708 - protein, 9 aa, Homo Sapiens
KFPSSLAFS

SEQ ID NO: 351709 - protein, 9 aa, Homo Sapiens
RDEQELQKI

SEQ ID NO: 351710 - protein, 9 aa, Homo Sapiens
RSRYFQSPS

SEQ ID NO: 351711 - protein, 9 aa, Homo Sapiens
DSYLRNGWN

SEQ ID NO: 351712 - protein, 9 aa, Homo Sapiens
ARRRIVQSM

SEQ ID NO: 351713 - protein, 9 aa, Homo Sapiens
QSQSCVTGP

SEQ ID NO: 351714 - protein, 9 aa, Homo Sapiens
GEAHREGFS

SEQ ID NO: 351715 - protein, 9 aa, Homo Sapiens
SAKQKIPPP

SEQ ID NO: 351716 - protein, 9 aa, Homo Sapiens
LRYFSGIKG

SEQ ID NO: 351717 - protein, 9 aa, Homo Sapiens
NETYDYGGF

SEQ ID NO: 351718 - protein, 9 aa, Homo Sapiens
KIALEASFS

SEQ ID NO: 351719 - protein, 9 aa, Homo Sapiens
LRYFSDKQK

SEQ ID NO: 351720 - protein, 9 aa, Homo Sapiens
RMGNLALGQ

SEQ ID NO: 351721 - protein, 9 aa, Homo Sapiens
RQDANLTKR

SEQ ID NO: 351722 - protein, 9 aa, Homo Sapiens
LSVHISHDK

SEQ ID NO: 351723 - protein, 9 aa, Homo Sapiens
ERIRGHVLP

SEQ ID NO: 351724 - protein, 9 aa, Homo Sapiens
NTLKRFNLC

SEQ ID NO: 351725 - protein, 9 aa, Homo Sapiens
VVFKLMDVA

SEQ ID NO: 351726 - protein, 9 aa, Homo Sapiens
HEEQKIRLH

SEQ ID NO: 351727 - protein, 9 aa, Homo Sapiens
VLNFQNKGK

SEQ ID NO: 351728 - protein, 9 aa, Homo Sapiens
FWGVLLAAR

SEQ ID NO: 351729 - protein, 9 aa, Homo Sapiens
CLWVLQIIF

SEQ ID NO: 351730 - protein, 9 aa, Homo Sapiens
CKERNQYGE

SEQ ID NO: 351731 - protein, 9 aa, Homo Sapiens
CQVNLIFCD

SEQ ID NO: 351732 - protein, 9 aa, Homo Sapiens
RRKLREFMQ

SEQ ID NO: 351733 - protein, 9 aa, Homo Sapiens
IIVYQASYF

SEQ ID NO: 351734 - protein, 9 aa, Homo Sapiens
VMVAGGTNS

SEQ ID NO: 351735 - protein, 9 aa, Homo Sapiens
KGPMFKLLP

SEQ ID NO: 351736 - protein, 9 aa, Homo Sapiens
GRAEILGRT

SEQ ID NO: 351737 - protein, 9 aa, Homo Sapiens
QLQLEGLKC

SEQ ID NO: 351738 - protein, 9 aa, Homo Sapiens
SHGYTEALG

SEQ ID NO: 351739 - protein, 9 aa, Homo Sapiens
ITLFWTVIF

SEQ ID NO: 351740 - protein, 9 aa, Homo Sapiens
GVNTEDNKG

SEQ ID NO: 351741 - protein, 9 aa, Homo Sapiens
LLFSLSLSF

SEQ ID NO: 351742 - protein, 9 aa, Homo Sapiens
TVLHKQINK

SEQ ID NO: 351743 - protein, 9 aa, Homo Sapiens
NTFLQDQSP

SEQ ID NO: 351744 - protein, 9 aa, Homo Sapiens
VELSLLEKK

SEQ ID NO: 351745 - protein, 9 aa, Homo Sapiens
AKEPLKDSE

SEQ ID NO: 351746 - protein, 9 aa, Homo Sapiens
QDDMIIAKE

SEQ ID NO: 351747 - protein, 9 aa, Homo Sapiens
ELCSKTKAL

SEQ ID NO: 351748 - protein, 9 aa, Homo Sapiens
RTKCIELIY

SEQ ID NO: 351749 - protein, 9 aa, Homo Sapiens
KSSNSNAIQ

SEQ ID NO: 351750 - protein, 9 aa, Homo Sapiens
ADSLATPRL

SEQ ID NO: 351751 - protein, 9 aa, Homo Sapiens
FINEDVIVW

SEQ ID NO: 351752 - protein, 9 aa, Homo Sapiens
KKTKKGATE

SEQ ID NO: 351753 - protein, 9 aa, Homo Sapiens
TKSAAKRLK

SEQ ID NO: 351754 - protein, 9 aa, Homo Sapiens
KNMIQEQDL

SEQ ID NO: 351755 - protein, 9 aa, Homo Sapiens
FSGFGSPLG

SEQ ID NO: 351756 - protein, 9 aa, Homo Sapiens
PESLRPVHL

SEQ ID NO: 351757 - protein, 9 aa, Homo Sapiens
FTHSFLLTI

SEQ ID NO: 351758 - protein, 9 aa, Homo Sapiens
NEEHRLEDA

SEQ ID NO: 351759 - protein, 9 aa, Homo Sapiens
SIFKSDIPF

SEQ ID NO: 351760 - protein, 9 aa, Homo Sapiens
IKMRIKTTS

SEQ ID NO: 351761 - protein, 9 aa, Homo Sapiens
GSRRRRRQW

SEQ ID NO: 351762 - protein, 9 aa, Homo Sapiens
VTVDLYILN

SEQ ID NO: 351763 - protein, 9 aa, Homo Sapiens
SSAKQKIPP

SEQ ID NO: 351764 - protein, 9 aa, Homo Sapiens
PENNKEGGN

SEQ ID NO: 351765 - protein, 9 aa, Homo Sapiens
EKLTDECYN

SEQ ID NO: 351766 - protein, 9 aa, Homo Sapiens
ESNEFCNKP

SEQ ID NO: 351767 - protein, 9 aa, Homo Sapiens
GQTVDDFKT

SEQ ID NO: 351768 - protein, 9 aa, Homo Sapiens
RMRVRWEIQ

SEQ ID NO: 351769 - protein, 9 aa, Homo Sapiens
HIRDTLPDF

SEQ ID NO: 351770 - protein, 9 aa, Homo Sapiens
FQMNQLQGK

SEQ ID NO: 351771 - protein, 9 aa, Homo Sapiens
KYQNKARRS

SEQ ID NO: 351772 - protein, 9 aa, Homo Sapiens
TRLIVVFFV

SEQ ID NO: 351773 - protein, 9 aa, Homo Sapiens
FVGGGSLNL

SEQ ID NO: 351774 - protein, 9 aa, Homo Sapiens
PLYKSSKAL

SEQ ID NO: 351775 - protein, 9 aa, Homo Sapiens
LAPLQMDVR

SEQ ID NO: 351776 - protein, 9 aa, Homo Sapiens
DNWDNDNVE

SEQ ID NO: 351777 - protein, 9 aa, Homo Sapiens
KFSINSDIW

SEQ ID NO: 351778 - protein, 9 aa, Homo Sapiens
EEIASQEKK

SEQ ID NO: 351779 - protein, 9 aa, Homo Sapiens
QDKVLYLLS

SEQ ID NO: 351780 - protein, 9 aa, Homo Sapiens
EHLHIDVVS

SEQ ID NO: 351781 - protein, 9 aa, Homo Sapiens
ILCQLTKTS

SEQ ID NO: 351782 - protein, 9 aa, Homo Sapiens
VADKNDDDP

SEQ ID NO: 351783 - protein, 9 aa, Homo Sapiens
SLSQTPADG

SEQ ID NO: 351784 - protein, 9 aa, Homo Sapiens
ATLKHTIEA

SEQ ID NO: 351785 - protein, 9 aa, Homo Sapiens
KMTNKMQKT

SEQ ID NO: 351786 - protein, 9 aa, Homo Sapiens
TQVGVICCP

SEQ ID NO: 351787 - protein, 9 aa, Homo Sapiens
KHKREIYDH

SEQ ID NO: 351788 - protein, 9 aa, Homo Sapiens
EQNIKDYFE

SEQ ID NO: 351789 - protein, 9 aa, Homo Sapiens
SLMHDEDPL

SEQ ID NO: 351790 - protein, 9 aa, Homo Sapiens
AGFFVSLTE

SEQ ID NO: 351791 - protein, 9 aa, Homo Sapiens
HSELLCKSW

SEQ ID NO: 351792 - protein, 9 aa, Homo Sapiens
RPSSIQKLN

SEQ ID NO: 351793 - protein, 9 aa, Homo Sapiens
ANEHIQKAG

SEQ ID NO: 351794 - protein, 9 aa, Homo Sapiens
HYCHDNNII

SEQ ID NO: 351795 - protein, 9 aa, Homo Sapiens
HNRVALGVP

SEQ ID NO: 351796 - protein, 9 aa, Homo Sapiens
DLLLEPHNK

SEQ ID NO: 351797 - protein, 9 aa, Homo Sapiens
TSLKEEERF

SEQ ID NO: 351798 - protein, 9 aa, Homo Sapiens
EIAEKIQQQ

SEQ ID NO: 351799 - protein, 9 aa, Homo Sapiens
CGQKKFSCC

SEQ ID NO: 351800 - protein, 9 aa, Homo Sapiens
MNYYPYLAD

SEQ ID NO: 351801 - protein, 9 aa, Homo Sapiens
YNINDYSLR

SEQ ID NO: 351802 - protein, 9 aa, Homo Sapiens
LDVKKVKKA

SEQ ID NO: 351803 - protein, 9 aa, Homo Sapiens
VKRKLKMWL

SEQ ID NO: 351804 - protein, 9 aa, Homo Sapiens
SRHKSFMET

SEQ ID NO: 351805 - protein, 9 aa, Homo Sapiens
HKTGMKRKD

SEQ ID NO: 351806 - protein, 9 aa, Homo Sapiens
TTEPVPDQD

SEQ ID NO: 351807 - protein, 9 aa, Homo Sapiens
IHIFSYFFY

SEQ ID NO: 351808 - protein, 9 aa, Homo Sapiens
APLQMDVRE

SEQ ID NO: 351809 - protein, 9 aa, Homo Sapiens
PNLSAPGQG

SEQ ID NO: 351810 - protein, 9 aa, Homo Sapiens
EPHNKYRFL

SEQ ID NO: 351811 - protein, 9 aa, Homo Sapiens
GETPPSVEL

SEQ ID NO: 351812 - protein, 9 aa, Homo Sapiens
RFTKVEDII

SEQ ID NO: 351813 - protein, 9 aa, Homo Sapiens
SDQDSFLHD

SEQ ID NO: 351814 - protein, 9 aa, Homo Sapiens
FNQTLRLLM

SEQ ID NO: 351815 - protein, 9 aa, Homo Sapiens
WLEVCCVCP

SEQ ID NO: 351816 - protein, 9 aa, Homo Sapiens
QICSCGLDY

SEQ ID NO: 351817 - protein, 9 aa, Homo Sapiens
QINCKQDWS

SEQ ID NO: 351818 - protein, 9 aa, Homo Sapiens
RDSRDVLAG

SEQ ID NO: 351819 - protein, 9 aa, Homo Sapiens
AQSDMHYSV

SEQ ID NO: 351820 - protein, 9 aa, Homo Sapiens
NESNCAELM

SEQ ID NO: 351821 - protein, 9 aa, Homo Sapiens
QLLSFGKTK

SEQ ID NO: 351822 - protein, 9 aa, Homo Sapiens
EFINLLLDR

SEQ ID NO: 351823 - protein, 9 aa, Homo Sapiens
AGIGYGCNI

SEQ ID NO: 351824 - protein, 9 aa, Homo Sapiens
YQQLPAKWS

SEQ ID NO: 351825 - protein, 9 aa, Homo Sapiens
GKSIYFSGC

SEQ ID NO: 351826 - protein, 9 aa, Homo Sapiens
SPSVMNLDN

SEQ ID NO: 351827 - protein, 9 aa, Homo Sapiens
KSNGRGGNQ

SEQ ID NO: 351828 - protein, 9 aa, Homo Sapiens
PPVSTLSPN

SEQ ID NO: 351829 - protein, 9 aa, Homo Sapiens
IIAYIPGRT

SEQ ID NO: 351830 - protein, 9 aa, Homo Sapiens
RFLREHSQM

SEQ ID NO: 351831 - protein, 9 aa, Homo Sapiens
IETSLRNSK

SEQ ID NO: 351832 - protein, 9 aa, Homo Sapiens
PFMYTIRNK

SEQ ID NO: 351833 - protein, 9 aa, Homo Sapiens
QLSTANDEI

SEQ ID NO: 351834 - protein, 9 aa, Homo Sapiens
YNEAYISFM

SEQ ID NO: 351835 - protein, 9 aa, Homo Sapiens
LIIHIGAIF

SEQ ID NO: 351836 - protein, 9 aa, Homo Sapiens
LDKNKRTPY

SEQ ID NO: 351837 - protein, 9 aa, Homo Sapiens
DLLRKGVEV

SEQ ID NO: 351838 - protein, 9 aa, Homo Sapiens
YVQMDKGVI

SEQ ID NO: 351839 - protein, 9 aa, Homo Sapiens
TLSYTVRIA

SEQ ID NO: 351840 - protein, 9 aa, Homo Sapiens
MRRLHMQHR

SEQ ID NO: 351841 - protein, 9 aa, Homo Sapiens
KEIKMRIKT

SEQ ID NO: 351842 - protein, 9 aa, Homo Sapiens
WLIMSFSGG

SEQ ID NO: 351843 - protein, 9 aa, Homo Sapiens
AMPFKIIYD

SEQ ID NO: 351844 - protein, 9 aa, Homo Sapiens
LRHSPKRVP

SEQ ID NO: 351845 - protein, 9 aa, Homo Sapiens
TPNTAWGGE

SEQ ID NO: 351846 - protein, 9 aa, Homo Sapiens
YICVFSQPG

SEQ ID NO: 351847 - protein, 9 aa, Homo Sapiens
QGSRFTWRK

SEQ ID NO: 351848 - protein, 9 aa, Homo Sapiens
IECVKTFCW

SEQ ID NO: 351849 - protein, 9 aa, Homo Sapiens
HELFRYFRV

SEQ ID NO: 351850 - protein, 9 aa, Homo Sapiens
RINLLEDDS

SEQ ID NO: 351851 - protein, 9 aa, Homo Sapiens
AFTEREASK

SEQ ID NO: 351852 - protein, 9 aa, Homo Sapiens
EKKSKHMLA

SEQ ID NO: 351853 - protein, 9 aa, Homo Sapiens
DIAFLATDI

SEQ ID NO: 351854 - protein, 9 aa, Homo Sapiens
IFSIVGVNL

SEQ ID NO: 351855 - protein, 9 aa, Homo Sapiens
HLQDYEKYK

SEQ ID NO: 351856 - protein, 9 aa, Homo Sapiens
LNHPALICC

SEQ ID NO: 351857 - protein, 9 aa, Homo Sapiens
RERTRVVYQ

SEQ ID NO: 351858 - protein, 9 aa, Homo Sapiens
NGYANISEL

SEQ ID NO: 351859 - protein, 9 aa, Homo Sapiens
VGRDTNRPL

SEQ ID NO: 351860 - protein, 9 aa, Homo Sapiens
KGKRHRKKL

SEQ ID NO: 351861 - protein, 9 aa, Homo Sapiens
SLEEAAKRE

SEQ ID NO: 351862 - protein, 9 aa, Homo Sapiens
EFREQQPPA

SEQ ID NO: 351863 - protein, 9 aa, Homo Sapiens
FNAHHPFLF

SEQ ID NO: 351864 - protein, 9 aa, Homo Sapiens
TVDLCQKVE

SEQ ID NO: 351865 - protein, 9 aa, Homo Sapiens
YHFCYNVAL

SEQ ID NO: 351866 - protein, 9 aa, Homo Sapiens
TSQANLSDL

SEQ ID NO: 351867 - protein, 9 aa, Homo Sapiens
ALAKPFNKF

SEQ ID NO: 351868 - protein, 9 aa, Homo Sapiens
QPANRTGPF

SEQ ID NO: 351869 - protein, 9 aa, Homo Sapiens
YWRIMSVKR

SEQ ID NO: 351870 - protein, 9 aa, Homo Sapiens
QNIKVSRLL

SEQ ID NO: 351871 - protein, 9 aa, Homo Sapiens
WFIRQEHFG

SEQ ID NO: 351872 - protein, 9 aa, Homo Sapiens
LEQIHNRVA

SEQ ID NO: 351873 - protein, 9 aa, Homo Sapiens
ECSPGVVST

SEQ ID NO: 351874 - protein, 9 aa, Homo Sapiens
AQIIAEPEW

SEQ ID NO: 351875 - protein, 9 aa, Homo Sapiens
RIYYVLYKA

SEQ ID NO: 351876 - protein, 9 aa, Homo Sapiens
VNADLSASE

SEQ ID NO: 351877 - protein, 9 aa, Homo Sapiens
ADIRGRSPD

SEQ ID NO: 351878 - protein, 9 aa, Homo Sapiens
GWQTLQSAT

SEQ ID NO: 351879 - protein, 9 aa, Homo Sapiens
ALFDRKWLQ

SEQ ID NO: 351880 - protein, 9 aa, Homo Sapiens
LEKVNNLVK

SEQ ID NO: 351881 - protein, 9 aa, Homo Sapiens
LQNYQYTLH

SEQ ID NO: 351882 - protein, 9 aa, Homo Sapiens
LSVCAWGLL

SEQ ID NO: 351883 - protein, 9 aa, Homo Sapiens
TIPPPLPPK

SEQ ID NO: 351884 - protein, 9 aa, Homo Sapiens
KTCPNHYTL

SEQ ID NO: 351885 - protein, 9 aa, Homo Sapiens
TSLNFNQTL

SEQ ID NO: 351886 - protein, 9 aa, Homo Sapiens
KAWPFPGVL

SEQ ID NO: 351887 - protein, 9 aa, Homo Sapiens
SKNKLLLKG

SEQ ID NO: 351888 - protein, 9 aa, Homo Sapiens
LDSDEDLGT

SEQ ID NO: 351889 - protein, 9 aa, Homo Sapiens
LHQKLCFFQ

SEQ ID NO: 351890 - protein, 9 aa, Homo Sapiens
LAQQGPQHY

SEQ ID NO: 351891 - protein, 9 aa, Homo Sapiens
LEADSNSKD

SEQ ID NO: 351892 - protein, 9 aa, Homo Sapiens
RSILTYSQI

SEQ ID NO: 351893 - protein, 9 aa, Homo Sapiens
QRGKNALKD

SEQ ID NO: 351894 - protein, 9 aa, Homo Sapiens
DSFLHDNSL

SEQ ID NO: 351895 - protein, 9 aa, Homo Sapiens
FFSPSLLKR

SEQ ID NO: 351896 - protein, 9 aa, Homo Sapiens
DYSIEEDGS

SEQ ID NO: 351897 - protein, 9 aa, Homo Sapiens
DNKLCHEQF

SEQ ID NO: 351898 - protein, 9 aa, Homo Sapiens
PYECIECVK

SEQ ID NO: 351899 - protein, 9 aa, Homo Sapiens
MVSCIKIGS

SEQ ID NO: 351900 - protein, 9 aa, Homo Sapiens
GKQELQPFN

SEQ ID NO: 351901 - protein, 9 aa, Homo Sapiens
ETTLGSHLM

SEQ ID NO: 351902 - protein, 9 aa, Homo Sapiens
YGKFSINSD

SEQ ID NO: 351903 - protein, 9 aa, Homo Sapiens
KNHPRVYQN

SEQ ID NO: 351904 - protein, 9 aa, Homo Sapiens
PLKHVTVAR

SEQ ID NO: 351905 - protein, 9 aa, Homo Sapiens
VESNEFCNK

SEQ ID NO: 351906 - protein, 9 aa, Homo Sapiens
HRDLEIERP

SEQ ID NO: 351907 - protein, 9 aa, Homo Sapiens
LSSKSYSYF

SEQ ID NO: 351908 - protein, 9 aa, Homo Sapiens
QERDEIGQI

SEQ ID NO: 351909 - protein, 9 aa, Homo Sapiens
KFKDNPHLI

SEQ ID NO: 351910 - protein, 9 aa, Homo Sapiens
KITVALLTE

SEQ ID NO: 351911 - protein, 9 aa, Homo Sapiens
VDTECCLLA

SEQ ID NO: 351912 - protein, 9 aa, Homo Sapiens
TAYLSKVNA

SEQ ID NO: 351913 - protein, 9 aa, Homo Sapiens
HTQLSFVFL

SEQ ID NO: 351914 - protein, 9 aa, Homo Sapiens
RPGTARTMC

SEQ ID NO: 351915 - protein, 9 aa, Homo Sapiens
KMQFLWEKA

SEQ ID NO: 351916 - protein, 9 aa, Homo Sapiens
DVRKTAFEC

SEQ ID NO: 351917 - protein, 9 aa, Homo Sapiens
GIFFSILGT

SEQ ID NO: 351918 - protein, 9 aa, Homo Sapiens
VEQLCQAIE

SEQ ID NO: 351919 - protein, 9 aa, Homo Sapiens
LTKDLQNGM

SEQ ID NO: 351920 - protein, 9 aa, Homo Sapiens
LGVNKAQDN

SEQ ID NO: 351921 - protein, 9 aa, Homo Sapiens
RMQHNRHSL

SEQ ID NO: 351922 - protein, 9 aa, Homo Sapiens
LENLKQIHS

SEQ ID NO: 351923 - protein, 9 aa, Homo Sapiens
SKAVRDVCF

SEQ ID NO: 351924 - protein, 9 aa, Homo Sapiens
EDEDDDTLS

SEQ ID NO: 351925 - protein, 9 aa, Homo Sapiens
IDSLSKNIT

SEQ ID NO: 351926 - protein, 9 aa, Homo Sapiens
KWFNVCMGF

SEQ ID NO: 351927 - protein, 9 aa, Homo Sapiens
KDKGKAKLG

SEQ ID NO: 351928 - protein, 9 aa, Homo Sapiens
CQPVDPQLL

SEQ ID NO: 351929 - protein, 9 aa, Homo Sapiens
WYNVDFQRD

SEQ ID NO: 351930 - protein, 9 aa, Homo Sapiens
QKIKAIKLA

SEQ ID NO: 351931 - protein, 9 aa, Homo Sapiens
ELICYVTIT

SEQ ID NO: 351932 - protein, 9 aa, Homo Sapiens
DVRRKEKDN

SEQ ID NO: 351933 - protein, 9 aa, Homo Sapiens
KNLWKFCVE

SEQ ID NO: 351934 - protein, 9 aa, Homo Sapiens
SHSEHERQY

SEQ ID NO: 351935 - protein, 9 aa, Homo Sapiens
FNQSSALNR

SEQ ID NO: 351936 - protein, 9 aa, Homo Sapiens
DDSEVNVND

SEQ ID NO: 351937 - protein, 9 aa, Homo Sapiens
PGPRCSHCQ

SEQ ID NO: 351938 - protein, 9 aa, Homo Sapiens
GQQFRGRTN

SEQ ID NO: 351939 - protein, 9 aa, Homo Sapiens
SLRHSPKRV

SEQ ID NO: 351940 - protein, 9 aa, Homo Sapiens
RALWSSGTA

SEQ ID NO: 351941 - protein, 9 aa, Homo Sapiens
AKTKAGATV

SEQ ID NO: 351942 - protein, 9 aa, Homo Sapiens
QLRDGDRYW

SEQ ID NO: 351943 - protein, 9 aa, Homo Sapiens
HSEMKLDEG

SEQ ID NO: 351944 - protein, 9 aa, Homo Sapiens
IFTTGIMTP

SEQ ID NO: 351945 - protein, 9 aa, Homo Sapiens
RSLQTSPKI

SEQ ID NO: 351946 - protein, 9 aa, Homo Sapiens
ANEAPQFSQ

SEQ ID NO: 351947 - protein, 9 aa, Homo Sapiens
AAAAAGGKQ

SEQ ID NO: 351948 - protein, 9 aa, Homo Sapiens
PSSPFTETL

SEQ ID NO: 351949 - protein, 9 aa, Homo Sapiens
IQILAAALT

SEQ ID NO: 351950 - protein, 9 aa, Homo Sapiens
DNAELETTL

SEQ ID NO: 351951 - protein, 9 aa, Homo Sapiens
TSCYCPNNS

SEQ ID NO: 351952 - protein, 9 aa, Homo Sapiens
LTADQVIED

SEQ ID NO: 351953 - protein, 9 aa, Homo Sapiens
NSVFTFFSS

SEQ ID NO: 351954 - protein, 9 aa, Homo Sapiens
MKNTQQCPG

SEQ ID NO: 351955 - protein, 9 aa, Homo Sapiens
LSHSSSFQR

SEQ ID NO: 351956 - protein, 9 aa, Homo Sapiens
NGKEYLFQA

SEQ ID NO: 351957 - protein, 9 aa, Homo Sapiens
LNPFCPPGF

SEQ ID NO: 351958 - protein, 9 aa, Homo Sapiens
HLHINHLYI

SEQ ID NO: 351959 - protein, 9 aa, Homo Sapiens
SGKHHILRC

SEQ ID NO: 351960 - protein, 9 aa, Homo Sapiens
EEVWLQYEK

SEQ ID NO: 351961 - protein, 9 aa, Homo Sapiens
EQLLNVDTK

SEQ ID NO: 351962 - protein, 9 aa, Homo Sapiens
LYFTCDNVL

SEQ ID NO: 351963 - protein, 9 aa, Homo Sapiens
TQIKQKVDY

SEQ ID NO: 351964 - protein, 9 aa, Homo Sapiens
QVQTLHKVK

SEQ ID NO: 351965 - protein, 9 aa, Homo Sapiens
INQKVSCHP

SEQ ID NO: 351966 - protein, 9 aa, Homo Sapiens
RRRRRQWSE

SEQ ID NO: 351967 - protein, 9 aa, Homo Sapiens
LGCQNNNST

SEQ ID NO: 351968 - protein, 9 aa, Homo Sapiens
GINSLLNYL

SEQ ID NO: 351969 - protein, 9 aa, Homo Sapiens
DVIVWMRTA

SEQ ID NO: 351970 - protein, 9 aa, Homo Sapiens
SEKEIVVLI

SEQ ID NO: 351971 - protein, 9 aa, Homo Sapiens
ILVLEKVNN

SEQ ID NO: 351972 - protein, 9 aa, Homo Sapiens
QQLVNKTII

SEQ ID NO: 351973 - protein, 9 aa, Homo Sapiens
YPMHNLKIR

SEQ ID NO: 351974 - protein, 9 aa, Homo Sapiens
RSCIQAYFY

SEQ ID NO: 351975 - protein, 9 aa, Homo Sapiens
KNGKGLRHL

SEQ ID NO: 351976 - protein, 9 aa, Homo Sapiens
GMGGAMYLV

SEQ ID NO: 351977 - protein, 9 aa, Homo Sapiens
QSEQLVPVD

SEQ ID NO: 351978 - protein, 9 aa, Homo Sapiens
DYICCIAVH

SEQ ID NO: 351979 - protein, 9 aa, Homo Sapiens
QIISCRLKT

SEQ ID NO: 351980 - protein, 9 aa, Homo Sapiens
LVIEDNVRF

SEQ ID NO: 351981 - protein, 9 aa, Homo Sapiens
IATRRLNGQ

SEQ ID NO: 351982 - protein, 9 aa, Homo Sapiens
PKGAWGPRE

SEQ ID NO: 351983 - protein, 9 aa, Homo Sapiens
CRNSNSNPP

SEQ ID NO: 351984 - protein, 9 aa, Homo Sapiens
NLRPGDNTT

SEQ ID NO: 351985 - protein, 9 aa, Homo Sapiens
GVLNLQYFF

SEQ ID NO: 351986 - protein, 9 aa, Homo Sapiens
ISPLQRILP

SEQ ID NO: 351987 - protein, 9 aa, Homo Sapiens
GQVVLEMDM

SEQ ID NO: 351988 - protein, 9 aa, Homo Sapiens
DSASNIPTE

SEQ ID NO: 351989 - protein, 9 aa, Homo Sapiens
HLKSEAKEP

SEQ ID NO: 351990 - protein, 9 aa, Homo Sapiens
YLSACLISL

SEQ ID NO: 351991 - protein, 9 aa, Homo Sapiens
SSFSSSVNV

SEQ ID NO: 351992 - protein, 9 aa, Homo Sapiens
RLLYVTCLQ

SEQ ID NO: 351993 - protein, 9 aa, Homo Sapiens
ICGPQAYQQ

SEQ ID NO: 351994 - protein, 9 aa, Homo Sapiens
HKYFKKHEK

SEQ ID NO: 351995 - protein, 9 aa, Homo Sapiens
ICQRTHFVI

SEQ ID NO: 351996 - protein, 9 aa, Homo Sapiens
QYLLEKSRL

SEQ ID NO: 351997 - protein, 9 aa, Homo Sapiens
SSPQKRSYS

SEQ ID NO: 351998 - protein, 9 aa, Homo Sapiens
ITQLELDPK

SEQ ID NO: 351999 - protein, 9 aa, Homo Sapiens
QSDTPQKSS

SEQ ID NO: 352000 - protein, 9 aa, Homo Sapiens
PGSGPGALL

SEQ ID NO: 352001 - protein, 9 aa, Homo Sapiens
AAETGGIAA

SEQ ID NO: 352002 - protein, 9 aa, Homo Sapiens
NGKGLRHLS

SEQ ID NO: 352003 - protein, 9 aa, Homo Sapiens
QIELEVLSV

SEQ ID NO: 352004 - protein, 9 aa, Homo Sapiens
KITKNLSEV

SEQ ID NO: 352005 - protein, 9 aa, Homo Sapiens
ELFKPYYGE

SEQ ID NO: 352006 - protein, 9 aa, Homo Sapiens
PTDKEHNSN

SEQ ID NO: 352007 - protein, 9 aa, Homo Sapiens
NLTKYSTLK

SEQ ID NO: 352008 - protein, 9 aa, Homo Sapiens
KYRKVQEHE

SEQ ID NO: 352009 - protein, 9 aa, Homo Sapiens
GVLLAARAN

SEQ ID NO: 352010 - protein, 9 aa, Homo Sapiens
NHKRKGSST

SEQ ID NO: 352011 - protein, 9 aa, Homo Sapiens
LLNEIIAAF

SEQ ID NO: 352012 - protein, 9 aa, Homo Sapiens
SNCLGICSF

SEQ ID NO: 352013 - protein, 9 aa, Homo Sapiens
QVPRQPTYV

SEQ ID NO: 352014 - protein, 9 aa, Homo Sapiens
SRCGKAYRH

SEQ ID NO: 352015 - protein, 9 aa, Homo Sapiens
HAVIALHHG

SEQ ID NO: 352016 - protein, 9 aa, Homo Sapiens
IPTSYKSKF

SEQ ID NO: 352017 - protein, 9 aa, Homo Sapiens
DHGSCVQAC

SEQ ID NO: 352018 - protein, 9 aa, Homo Sapiens
MTIQHCPLY

SEQ ID NO: 352019 - protein, 9 aa, Homo Sapiens
SKAWGDVNR

SEQ ID NO: 352020 - protein, 9 aa, Homo Sapiens
LHEAGGEYF

SEQ ID NO: 352021 - protein, 9 aa, Homo Sapiens
PSVCRCNRN

SEQ ID NO: 352022 - protein, 9 aa, Homo Sapiens
PPLKGYEVT

SEQ ID NO: 352023 - protein, 9 aa, Homo Sapiens
ISKKKLTPF

SEQ ID NO: 352024 - protein, 9 aa, Homo Sapiens
DVKCHITAR

SEQ ID NO: 352025 - protein, 9 aa, Homo Sapiens
IFFSILGTG

SEQ ID NO: 352026 - protein, 9 aa, Homo Sapiens
NFEKLWLSL

SEQ ID NO: 352027 - protein, 9 aa, Homo Sapiens
MLKLDATEK

SEQ ID NO: 352028 - protein, 9 aa, Homo Sapiens
NTLILCHNN

SEQ ID NO: 352029 - protein, 9 aa, Homo Sapiens
RVEEAAVLQ

SEQ ID NO: 352030 - protein, 9 aa, Homo Sapiens
WNDTVQKQS

SEQ ID NO: 352031 - protein, 9 aa, Homo Sapiens
KCNFIKKRL

SEQ ID NO: 352032 - protein, 9 aa, Homo Sapiens
IKELQVAFQ

SEQ ID NO: 352033 - protein, 9 aa, Homo Sapiens
SCLSVGEQP

SEQ ID NO: 352034 - protein, 9 aa, Homo Sapiens
FLRVRTSIK

SEQ ID NO: 352035 - protein, 9 aa, Homo Sapiens
WPFQGTMGV

SEQ ID NO: 352036 - protein, 9 aa, Homo Sapiens
LKSCSEVGE

SEQ ID NO: 352037 - protein, 9 aa, Homo Sapiens
LKHVTVARP

SEQ ID NO: 352038 - protein, 9 aa, Homo Sapiens
VRSDSELDI

SEQ ID NO: 352039 - protein, 9 aa, Homo Sapiens
NVTTTVSEV

SEQ ID NO: 352040 - protein, 9 aa, Homo Sapiens
NNVFPPPSQ

SEQ ID NO: 352041 - protein, 9 aa, Homo Sapiens
TFSFSFSNK

SEQ ID NO: 352042 - protein, 9 aa, Homo Sapiens
HVNGATVIN

SEQ ID NO: 352043 - protein, 9 aa, Homo Sapiens
YKYTLDAFG

SEQ ID NO: 352044 - protein, 9 aa, Homo Sapiens
WDCVLVSPR

SEQ ID NO: 352045 - protein, 9 aa, Homo Sapiens
GPHQRPHIP

SEQ ID NO: 352046 - protein, 9 aa, Homo Sapiens
LVHEEQKIR

SEQ ID NO: 352047 - protein, 9 aa, Homo Sapiens
VEELALRAL

SEQ ID NO: 352048 - protein, 9 aa, Homo Sapiens
SRNIDRYYL

SEQ ID NO: 352049 - protein, 9 aa, Homo Sapiens
VWQTRSHVA

SEQ ID NO: 352050 - protein, 9 aa, Homo Sapiens
HENFLLFSL

SEQ ID NO: 352051 - protein, 9 aa, Homo Sapiens
LQYHKNLLK

SEQ ID NO: 352052 - protein, 9 aa, Homo Sapiens
PEKALHIGI

SEQ ID NO: 352053 - protein, 9 aa, Homo Sapiens
QAVIKEGGL

SEQ ID NO: 352054 - protein, 9 aa, Homo Sapiens
NTDKIKRLE

SEQ ID NO: 352055 - protein, 9 aa, Homo Sapiens
IVTNYLSAH

SEQ ID NO: 352056 - protein, 9 aa, Homo Sapiens
SIWKKAVQF

SEQ ID NO: 352057 - protein, 9 aa, Homo Sapiens
DMRKAGHKA

SEQ ID NO: 352058 - protein, 9 aa, Homo Sapiens
LHYYETVCM

SEQ ID NO: 352059 - protein, 9 aa, Homo Sapiens
FNCSSSFQY

SEQ ID NO: 352060 - protein, 9 aa, Homo Sapiens
KDVSILQVK

SEQ ID NO: 352061 - protein, 9 aa, Homo Sapiens
HCQVSEEEQ

SEQ ID NO: 352062 - protein, 9 aa, Homo Sapiens
YMLYIARAV

SEQ ID NO: 352063 - protein, 9 aa, Homo Sapiens
FHHKSDNQV

SEQ ID NO: 352064 - protein, 9 aa, Homo Sapiens
GVDMDDKDN

SEQ ID NO: 352065 - protein, 9 aa, Homo Sapiens
FQLLPPCEL

SEQ ID NO: 352066 - protein, 9 aa, Homo Sapiens
ACMCAGLHR

SEQ ID NO: 352067 - protein, 9 aa, Homo Sapiens
PYASKGLHL

SEQ ID NO: 352068 - protein, 9 aa, Homo Sapiens
TFSIAVVHH

SEQ ID NO: 352069 - protein, 9 aa, Homo Sapiens
QKTKQQQYA

SEQ ID NO: 352070 - protein, 9 aa, Homo Sapiens
IQNLKINSS

SEQ ID NO: 352071 - protein, 9 aa, Homo Sapiens
MSTVHKILC

SEQ ID NO: 352072 - protein, 9 aa, Homo Sapiens
DLVDKIQTE

SEQ ID NO: 352073 - protein, 9 aa, Homo Sapiens
DQYHFCYNV

SEQ ID NO: 352074 - protein, 9 aa, Homo Sapiens
CNLGTERFL

SEQ ID NO: 352075 - protein, 9 aa, Homo Sapiens
QREDFLRLL

SEQ ID NO: 352076 - protein, 9 aa, Homo Sapiens
ENMKKPAES

SEQ ID NO: 352077 - protein, 9 aa, Homo Sapiens
AQLEEVKQA

SEQ ID NO: 352078 - protein, 9 aa, Homo Sapiens
KREIYDHYG

SEQ ID NO: 352079 - protein, 9 aa, Homo Sapiens
PNSDVFTFS

SEQ ID NO: 352080 - protein, 9 aa, Homo Sapiens
GNVQQVVHI

SEQ ID NO: 352081 - protein, 9 aa, Homo Sapiens
CQPNELIMP

SEQ ID NO: 352082 - protein, 9 aa, Homo Sapiens
VLVSPPRCL

SEQ ID NO: 352083 - protein, 9 aa, Homo Sapiens
TKDAKEIKK

SEQ ID NO: 352084 - protein, 9 aa, Homo Sapiens
IVSVCCEEK

SEQ ID NO: 352085 - protein, 9 aa, Homo Sapiens
KTDLLLEPH

SEQ ID NO: 352086 - protein, 9 aa, Homo Sapiens
PRTIVLFLS

SEQ ID NO: 352087 - protein, 9 aa, Homo Sapiens
INKPQQNLQ

SEQ ID NO: 352088 - protein, 9 aa, Homo Sapiens
AESEEYNQV

SEQ ID NO: 352089 - protein, 9 aa, Homo Sapiens
VFCDCEIAL

SEQ ID NO: 352090 - protein, 9 aa, Homo Sapiens
TQLTDEVLY

SEQ ID NO: 352091 - protein, 9 aa, Homo Sapiens
TTTLSFEGD

SEQ ID NO: 352092 - protein, 9 aa, Homo Sapiens
QEALAKGNV

SEQ ID NO: 352093 - protein, 9 aa, Homo Sapiens
LETLQTAGF

SEQ ID NO: 352094 - protein, 9 aa, Homo Sapiens
KHYFMLWHP

SEQ ID NO: 352095 - protein, 9 aa, Homo Sapiens
PDGSDPRIK

SEQ ID NO: 352096 - protein, 9 aa, Homo Sapiens
EVGEDGDKR

SEQ ID NO: 352097 - protein, 9 aa, Homo Sapiens
LAARANYQN

SEQ ID NO: 352098 - protein, 9 aa, Homo Sapiens
FFQTHPSAT

SEQ ID NO: 352099 - protein, 9 aa, Homo Sapiens
DSPIRFLVV

SEQ ID NO: 352100 - protein, 9 aa, Homo Sapiens
EKDVESFFK

SEQ ID NO: 352101 - protein, 9 aa, Homo Sapiens
FEKHRKEKP

SEQ ID NO: 352102 - protein, 9 aa, Homo Sapiens
IKRYLNLAE

SEQ ID NO: 352103 - protein, 9 aa, Homo Sapiens
QKPFKVQYM

SEQ ID NO: 352104 - protein, 9 aa, Homo Sapiens
EKSCMNVNN

SEQ ID NO: 352105 - protein, 9 aa, Homo Sapiens
NSLFFCPVY

SEQ ID NO: 352106 - protein, 9 aa, Homo Sapiens
NVIIVMCNL

SEQ ID NO: 352107 - protein, 9 aa, Homo Sapiens
QAWSFMTPH

SEQ ID NO: 352108 - protein, 9 aa, Homo Sapiens
RPDNLISRE

SEQ ID NO: 352109 - protein, 9 aa, Homo Sapiens
THLTQHQNI

SEQ ID NO: 352110 - protein, 9 aa, Homo Sapiens
YIKTYLQAV

SEQ ID NO: 352111 - protein, 9 aa, Homo Sapiens
NAGDVVMVN

SEQ ID NO: 352112 - protein, 9 aa, Homo Sapiens
EITWECVQP

SEQ ID NO: 352113 - protein, 9 aa, Homo Sapiens
VQKLNDSSS

SEQ ID NO: 352114 - protein, 9 aa, Homo Sapiens
VNNLVKEWI

SEQ ID NO: 352115 - protein, 9 aa, Homo Sapiens
QVVLLDSNK

SEQ ID NO: 352116 - protein, 9 aa, Homo Sapiens
PQTQKELAY

SEQ ID NO: 352117 - protein, 9 aa, Homo Sapiens
RSAHLIQHQ

SEQ ID NO: 352118 - protein, 9 aa, Homo Sapiens
VKWLIMSFS

SEQ ID NO: 352119 - protein, 9 aa, Homo Sapiens
TQIQPLPAD

SEQ ID NO: 352120 - protein, 9 aa, Homo Sapiens
AGLPQSINT

SEQ ID NO: 352121 - protein, 9 aa, Homo Sapiens
RDALLLQIP

SEQ ID NO: 352122 - protein, 9 aa, Homo Sapiens
EVASGKYGD

SEQ ID NO: 352123 - protein, 9 aa, Homo Sapiens
SQKMEYFSA

SEQ ID NO: 352124 - protein, 9 aa, Homo Sapiens
PSSIQKLNC

SEQ ID NO: 352125 - protein, 9 aa, Homo Sapiens
EMQTIMTSL

SEQ ID NO: 352126 - protein, 9 aa, Homo Sapiens
NNMLLATKQ

SEQ ID NO: 352127 - protein, 9 aa, Homo Sapiens
LALKKHVIS

SEQ ID NO: 352128 - protein, 9 aa, Homo Sapiens
IQHQIIHSG

SEQ ID NO: 352129 - protein, 9 aa, Homo Sapiens
HYFRNRHPG

SEQ ID NO: 352130 - protein, 9 aa, Homo Sapiens
VLYVNQNGQ

SEQ ID NO: 352131 - protein, 9 aa, Homo Sapiens
KQLILEHYV

SEQ ID NO: 352132 - protein, 9 aa, Homo Sapiens
LDFCHSYFI

SEQ ID NO: 352133 - protein, 9 aa, Homo Sapiens
QPELFDVTK

SEQ ID NO: 352134 - protein, 9 aa, Homo Sapiens
HPLDFDEMT

SEQ ID NO: 352135 - protein, 9 aa, Homo Sapiens
LKVKRGRAV

SEQ ID NO: 352136 - protein, 9 aa, Homo Sapiens
NLVMYDGIM

SEQ ID NO: 352137 - protein, 9 aa, Homo Sapiens
AQYHFYLSF

SEQ ID NO: 352138 - protein, 9 aa, Homo Sapiens
KSRDLPERP

SEQ ID NO: 352139 - protein, 9 aa, Homo Sapiens
IYIPVNVTS

SEQ ID NO: 352140 - protein, 9 aa, Homo Sapiens
VDTKSTRFF

SEQ ID NO: 352141 - protein, 9 aa, Homo Sapiens
RLQAITEKR

SEQ ID NO: 352142 - protein, 9 aa, Homo Sapiens
MEAQCICLS

SEQ ID NO: 352143 - protein, 9 aa, Homo Sapiens
SQSGGKPDS

SEQ ID NO: 352144 - protein, 9 aa, Homo Sapiens
LDGRTHSKE

SEQ ID NO: 352145 - protein, 9 aa, Homo Sapiens
LQNTVSKCK

SEQ ID NO: 352146 - protein, 9 aa, Homo Sapiens
SGQSFGYGQ

SEQ ID NO: 352147 - protein, 9 aa, Homo Sapiens
YIYEYLLHV

SEQ ID NO: 352148 - protein, 9 aa, Homo Sapiens
KISWFNNGL

SEQ ID NO: 352149 - protein, 9 aa, Homo Sapiens
QYHFYLSFE

SEQ ID NO: 352150 - protein, 9 aa, Homo Sapiens
KWKERTASG

SEQ ID NO: 352151 - protein, 9 aa, Homo Sapiens
IDFLASQEF

SEQ ID NO: 352152 - protein, 9 aa, Homo Sapiens
PPCSVLPHT

SEQ ID NO: 352153 - protein, 9 aa, Homo Sapiens
GIFTTGIMT

SEQ ID NO: 352154 - protein, 9 aa, Homo Sapiens
DRSKNKLLL

SEQ ID NO: 352155 - protein, 9 aa, Homo Sapiens
SIPPSPLTP

SEQ ID NO: 352156 - protein, 9 aa, Homo Sapiens
KKFVEACLN

SEQ ID NO: 352157 - protein, 9 aa, Homo Sapiens
SAALQPFFT

SEQ ID NO: 352158 - protein, 9 aa, Homo Sapiens
ADISAFELQ

SEQ ID NO: 352159 - protein, 9 aa, Homo Sapiens
ANDELSKSL

SEQ ID NO: 352160 - protein, 9 aa, Homo Sapiens
LEQLPDLGC

SEQ ID NO: 352161 - protein, 9 aa, Homo Sapiens
VKPLGLENG

SEQ ID NO: 352162 - protein, 9 aa, Homo Sapiens
PIAALAQDT

SEQ ID NO: 352163 - protein, 9 aa, Homo Sapiens
APLEPGVFV

SEQ ID NO: 352164 - protein, 9 aa, Homo Sapiens
LPYTKFFGG

SEQ ID NO: 352165 - protein, 9 aa, Homo Sapiens
LSLKDKKVE

SEQ ID NO: 352166 - protein, 9 aa, Homo Sapiens
AHAENGDLI

SEQ ID NO: 352167 - protein, 9 aa, Homo Sapiens
VSKCKREYF

SEQ ID NO: 352168 - protein, 9 aa, Homo Sapiens
KTKDKLTPL

SEQ ID NO: 352169 - protein, 9 aa, Homo Sapiens
VEEINLLSV

SEQ ID NO: 352170 - protein, 9 aa, Homo Sapiens
MKMWQEKEI

SEQ ID NO: 352171 - protein, 9 aa, Homo Sapiens
ESEPLAKPN

SEQ ID NO: 352172 - protein, 9 aa, Homo Sapiens
KEELKNMKR

SEQ ID NO: 352173 - protein, 9 aa, Homo Sapiens
FFKFYHLLN

SEQ ID NO: 352174 - protein, 9 aa, Homo Sapiens
YTKVAKRGG

SEQ ID NO: 352175 - protein, 9 aa, Homo Sapiens
YELFWGLRS

SEQ ID NO: 352176 - protein, 9 aa, Homo Sapiens
PVLNSECAH

SEQ ID NO: 352177 - protein, 9 aa, Homo Sapiens
PRTFQTFSK

SEQ ID NO: 352178 - protein, 9 aa, Homo Sapiens
CGKAFARWP

SEQ ID NO: 352179 - protein, 9 aa, Homo Sapiens
DLHKSSFSL

SEQ ID NO: 352180 - protein, 9 aa, Homo Sapiens
NHKFTKELH

SEQ ID NO: 352181 - protein, 9 aa, Homo Sapiens
KKFGIGLPI

SEQ ID NO: 352182 - protein, 9 aa, Homo Sapiens
LWHPKLIKL

SEQ ID NO: 352183 - protein, 9 aa, Homo Sapiens
MAKDRINHC

SEQ ID NO: 352184 - protein, 9 aa, Homo Sapiens
INKNKFFKD

SEQ ID NO: 352185 - protein, 9 aa, Homo Sapiens
HHSNRIVHQ

SEQ ID NO: 352186 - protein, 9 aa, Homo Sapiens
RLVGINLVR

SEQ ID NO: 352187 - protein, 9 aa, Homo Sapiens
WSGAMTPDH

SEQ ID NO: 352188 - protein, 9 aa, Homo Sapiens
SQGERLMER

SEQ ID NO: 352189 - protein, 9 aa, Homo Sapiens
TPSDKGMDH

SEQ ID NO: 352190 - protein, 9 aa, Homo Sapiens
RGFKFNTDE

SEQ ID NO: 352191 - protein, 9 aa, Homo Sapiens
LPKQFLPTM

SEQ ID NO: 352192 - protein, 9 aa, Homo Sapiens
RKHLCVWIS

SEQ ID NO: 352193 - protein, 9 aa, Homo Sapiens
ICCLCAIDI

SEQ ID NO: 352194 - protein, 9 aa, Homo Sapiens
TGKKNGKLW

SEQ ID NO: 352195 - protein, 9 aa, Homo Sapiens
QVITSPSKN

SEQ ID NO: 352196 - protein, 9 aa, Homo Sapiens
THRNGDPEE

SEQ ID NO: 352197 - protein, 9 aa, Homo Sapiens
VIVAGYPPD

SEQ ID NO: 352198 - protein, 9 aa, Homo Sapiens
GEKLDERDA

SEQ ID NO: 352199 - protein, 9 aa, Homo Sapiens
STVDAPVTP

SEQ ID NO: 352200 - protein, 9 aa, Homo Sapiens
TGKELFFDY

SEQ ID NO: 352201 - protein, 9 aa, Homo Sapiens
QIDDDKGRT

SEQ ID NO: 352202 - protein, 9 aa, Homo Sapiens
THANKPKGR

SEQ ID NO: 352203 - protein, 9 aa, Homo Sapiens
IKERALLNT

SEQ ID NO: 352204 - protein, 9 aa, Homo Sapiens
EMASAQLKR

SEQ ID NO: 352205 - protein, 9 aa, Homo Sapiens
RCKCWVGYE

SEQ ID NO: 352206 - protein, 9 aa, Homo Sapiens
QTIMTSLKR

SEQ ID NO: 352207 - protein, 9 aa, Homo Sapiens
QEYDGNIRQ

SEQ ID NO: 352208 - protein, 9 aa, Homo Sapiens
SFVMKFFNW

SEQ ID NO: 352209 - protein, 9 aa, Homo Sapiens
KIYSKIAKI

SEQ ID NO: 352210 - protein, 9 aa, Homo Sapiens
LTESSLTKH

SEQ ID NO: 352211 - protein, 9 aa, Homo Sapiens
EGKFDKDRD

SEQ ID NO: 352212 - protein, 9 aa, Homo Sapiens
CMPSVLTLV

SEQ ID NO: 352213 - protein, 9 aa, Homo Sapiens
RWLKRDSYL

SEQ ID NO: 352214 - protein, 9 aa, Homo Sapiens
LFMVLEHYN

SEQ ID NO: 352215 - protein, 9 aa, Homo Sapiens
FRNKTDLQL

SEQ ID NO: 352216 - protein, 9 aa, Homo Sapiens
VYQCMAKNE

SEQ ID NO: 352217 - protein, 9 aa, Homo Sapiens
EFTQIIAEA

SEQ ID NO: 352218 - protein, 9 aa, Homo Sapiens
LSTVNSLAA

SEQ ID NO: 352219 - protein, 9 aa, Homo Sapiens
IDLADDLAK

SEQ ID NO: 352220 - protein, 9 aa, Homo Sapiens
LSASSSLRC

SEQ ID NO: 352221 - protein, 9 aa, Homo Sapiens
FITAERIKL

SEQ ID NO: 352222 - protein, 9 aa, Homo Sapiens
ASEGAQVMR

SEQ ID NO: 352223 - protein, 9 aa, Homo Sapiens
NNVQQYHRA

SEQ ID NO: 352224 - protein, 9 aa, Homo Sapiens
KSLATLTIQ

SEQ ID NO: 352225 - protein, 9 aa, Homo Sapiens
FVQLSRLCY

SEQ ID NO: 352226 - protein, 9 aa, Homo Sapiens
FLLCVCIMM

SEQ ID NO: 352227 - protein, 9 aa, Homo Sapiens
GLLIRMSMP

SEQ ID NO: 352228 - protein, 9 aa, Homo Sapiens
HPEWEQKIQ

SEQ ID NO: 352229 - protein, 9 aa, Homo Sapiens
SEAKEPLKD

SEQ ID NO: 352230 - protein, 9 aa, Homo Sapiens
FTDPSHSER

SEQ ID NO: 352231 - protein, 9 aa, Homo Sapiens
HTGEKLYIC

SEQ ID NO: 352232 - protein, 9 aa, Homo Sapiens
CCFSRPAYP

SEQ ID NO: 352233 - protein, 9 aa, Homo Sapiens
WDNDNVEDD

SEQ ID NO: 352234 - protein, 9 aa, Homo Sapiens
KNVNLNTGM

SEQ ID NO: 352235 - protein, 9 aa, Homo Sapiens
STVDRAIAS

SEQ ID NO: 352236 - protein, 9 aa, Homo Sapiens
ASHRKLGMA

SEQ ID NO: 352237 - protein, 9 aa, Homo Sapiens
VLKIKQTKD

SEQ ID NO: 352238 - protein, 9 aa, Homo Sapiens
FALDRINNN

SEQ ID NO: 352239 - protein, 9 aa, Homo Sapiens
KYLPSPHPV

SEQ ID NO: 352240 - protein, 9 aa, Homo Sapiens
WIWDALRPP

SEQ ID NO: 352241 - protein, 9 aa, Homo Sapiens
ELRALSMVA

SEQ ID NO: 352242 - protein, 9 aa, Homo Sapiens
ILVTISFVM

SEQ ID NO: 352243 - protein, 9 aa, Homo Sapiens
TTWQINLKT

SEQ ID NO: 352244 - protein, 9 aa, Homo Sapiens
KMRIKTTSE

SEQ ID NO: 352245 - protein, 9 aa, Homo Sapiens
YIPTPSNRV

SEQ ID NO: 352246 - protein, 9 aa, Homo Sapiens
EHRIILRTQ

SEQ ID NO: 352247 - protein, 9 aa, Homo Sapiens
NNEMMKAIK

SEQ ID NO: 352248 - protein, 9 aa, Homo Sapiens
RTSAQVQTG

SEQ ID NO: 352249 - protein, 9 aa, Homo Sapiens
ECLQTESPE

SEQ ID NO: 352250 - protein, 9 aa, Homo Sapiens
ARIAQLVAC

SEQ ID NO: 352251 - protein, 9 aa, Homo Sapiens
NTQQCPGLG

SEQ ID NO: 352252 - protein, 9 aa, Homo Sapiens
LYGLSQNTY

SEQ ID NO: 352253 - protein, 9 aa, Homo Sapiens
GITQILGKK

SEQ ID NO: 352254 - protein, 9 aa, Homo Sapiens
LEIEDLKVN

SEQ ID NO: 352255 - protein, 9 aa, Homo Sapiens
DQFSALDLD

SEQ ID NO: 352256 - protein, 9 aa, Homo Sapiens
SQWDDGKGA

SEQ ID NO: 352257 - protein, 9 aa, Homo Sapiens
SVVPDEEAI

SEQ ID NO: 352258 - protein, 9 aa, Homo Sapiens
DERQDAHLL

SEQ ID NO: 352259 - protein, 9 aa, Homo Sapiens
IYFVGCFAQ

SEQ ID NO: 352260 - protein, 9 aa, Homo Sapiens
LEEEEEEDV

SEQ ID NO: 352261 - protein, 9 aa, Homo Sapiens
AQSLKTEDL

SEQ ID NO: 352262 - protein, 9 aa, Homo Sapiens
FSKYGNTLS

SEQ ID NO: 352263 - protein, 9 aa, Homo Sapiens
IPIGSLDVK

SEQ ID NO: 352264 - protein, 9 aa, Homo Sapiens
LNERCIKFV

SEQ ID NO: 352265 - protein, 9 aa, Homo Sapiens
NLSMTFDGQ

SEQ ID NO: 352266 - protein, 9 aa, Homo Sapiens
NGLTPTKKI

SEQ ID NO: 352267 - protein, 9 aa, Homo Sapiens
AMYLVSSAK

SEQ ID NO: 352268 - protein, 9 aa, Homo Sapiens
EVNCLGIYE

SEQ ID NO: 352269 - protein, 9 aa, Homo Sapiens
HLFCESQRI

SEQ ID NO: 352270 - protein, 9 aa, Homo Sapiens
ACHLRKCCQ

SEQ ID NO: 352271 - protein, 9 aa, Homo Sapiens
LCCLAGNQA

SEQ ID NO: 352272 - protein, 9 aa, Homo Sapiens
NLISRELRA

SEQ ID NO: 352273 - protein, 9 aa, Homo Sapiens
TCPNHYTLV

SEQ ID NO: 352274 - protein, 9 aa, Homo Sapiens
LLGNIVTWV

SEQ ID NO: 352275 - protein, 9 aa, Homo Sapiens
IKYTIDVLN

SEQ ID NO: 352276 - protein, 9 aa, Homo Sapiens
LLQLLGPPG

SEQ ID NO: 352277 - protein, 9 aa, Homo Sapiens
HIRNSSART

SEQ ID NO: 352278 - protein, 9 aa, Homo Sapiens
GIWVIMITG

SEQ ID NO: 352279 - protein, 9 aa, Homo Sapiens
EISHHLGKM

SEQ ID NO: 352280 - protein, 9 aa, Homo Sapiens
PRVGYWPLW

SEQ ID NO: 352281 - protein, 9 aa, Homo Sapiens
NCDQRFRFP

SEQ ID NO: 352282 - protein, 9 aa, Homo Sapiens
GFTTISVGI

SEQ ID NO: 352283 - protein, 9 aa, Homo Sapiens
IEMPLLEAP

SEQ ID NO: 352284 - protein, 9 aa, Homo Sapiens
RDGEADATA

SEQ ID NO: 352285 - protein, 9 aa, Homo Sapiens
AGLHRSPHR

SEQ ID NO: 352286 - protein, 9 aa, Homo Sapiens
SVCSLLSAQ

SEQ ID NO: 352287 - protein, 9 aa, Homo Sapiens
VNNVIKPSI

SEQ ID NO: 352288 - protein, 9 aa, Homo Sapiens
IILITDGEA

SEQ ID NO: 352289 - protein, 9 aa, Homo Sapiens
DLTTPLKKQ

SEQ ID NO: 352290 - protein, 9 aa, Homo Sapiens
SHSKTYLIC

SEQ ID NO: 352291 - protein, 9 aa, Homo Sapiens
QASIMLNIM

SEQ ID NO: 352292 - protein, 9 aa, Homo Sapiens
PEKVLDQPP

SEQ ID NO: 352293 - protein, 9 aa, Homo Sapiens
RSHYNLGIS

SEQ ID NO: 352294 - protein, 9 aa, Homo Sapiens
ERMESPIDL

SEQ ID NO: 352295 - protein, 9 aa, Homo Sapiens
CNKPQRKPV

SEQ ID NO: 352296 - protein, 9 aa, Homo Sapiens
VCIKFSRHV

SEQ ID NO: 352297 - protein, 9 aa, Homo Sapiens
NVLKLFPKL

SEQ ID NO: 352298 - protein, 9 aa, Homo Sapiens
MYWYIFVFC

SEQ ID NO: 352299 - protein, 9 aa, Homo Sapiens
NIVLNRPSS

SEQ ID NO: 352300 - protein, 9 aa, Homo Sapiens
MSGFFCFFF

SEQ ID NO: 352301 - protein, 9 aa, Homo Sapiens
REVCKEEQR

SEQ ID NO: 352302 - protein, 9 aa, Homo Sapiens
ENTTRAMSI

SEQ ID NO: 352303 - protein, 9 aa, Homo Sapiens
DQVQEVLSP

SEQ ID NO: 352304 - protein, 9 aa, Homo Sapiens
GFQKGGEHL

SEQ ID NO: 352305 - protein, 9 aa, Homo Sapiens
DQNVHEKKL

SEQ ID NO: 352306 - protein, 9 aa, Homo Sapiens
VLGKKIKQA

SEQ ID NO: 352307 - protein, 9 aa, Homo Sapiens
FPNCQCLTT

SEQ ID NO: 352308 - protein, 9 aa, Homo Sapiens
LWLEEFSME

SEQ ID NO: 352309 - protein, 9 aa, Homo Sapiens
CINLAALSF

SEQ ID NO: 352310 - protein, 9 aa, Homo Sapiens
LCQQAITST

SEQ ID NO: 352311 - protein, 9 aa, Homo Sapiens
IGNLEALRY

SEQ ID NO: 352312 - protein, 9 aa, Homo Sapiens
QDLTMEELS

SEQ ID NO: 352313 - protein, 9 aa, Homo Sapiens
INSRKTVTH

SEQ ID NO: 352314 - protein, 9 aa, Homo Sapiens
EIVVVGYNG

SEQ ID NO: 352315 - protein, 9 aa, Homo Sapiens
DRYHRIIKI

SEQ ID NO: 352316 - protein, 9 aa, Homo Sapiens
VIFIFSGSV

SEQ ID NO: 352317 - protein, 9 aa, Homo Sapiens
STHSEELHN

SEQ ID NO: 352318 - protein, 9 aa, Homo Sapiens
FTTFDGQHY

SEQ ID NO: 352319 - protein, 9 aa, Homo Sapiens
GVFLSHESP

SEQ ID NO: 352320 - protein, 9 aa, Homo Sapiens
DKERMTTKQ

SEQ ID NO: 352321 - protein, 9 aa, Homo Sapiens
VPLQSIQTL

SEQ ID NO: 352322 - protein, 9 aa, Homo Sapiens
KISLSTLSV

SEQ ID NO: 352323 - protein, 9 aa, Homo Sapiens
RVPRGEIIW

SEQ ID NO: 352324 - protein, 9 aa, Homo Sapiens
NINKVWMAE

SEQ ID NO: 352325 - protein, 9 aa, Homo Sapiens
RINNNPDLL

SEQ ID NO: 352326 - protein, 9 aa, Homo Sapiens
QRSCLLTKN

SEQ ID NO: 352327 - protein, 9 aa, Homo Sapiens
GNDNETLAN

SEQ ID NO: 352328 - protein, 9 aa, Homo Sapiens
FMLSFSRYP

SEQ ID NO: 352329 - protein, 9 aa, Homo Sapiens
GKRAESQIR

SEQ ID NO: 352330 - protein, 9 aa, Homo Sapiens
KLPFVRKSE

SEQ ID NO: 352331 - protein, 9 aa, Homo Sapiens
ARCSMIDDT

SEQ ID NO: 352332 - protein, 9 aa, Homo Sapiens
HQQTSDSNP

SEQ ID NO: 352333 - protein, 9 aa, Homo Sapiens
VCCVCPMCN

SEQ ID NO: 352334 - protein, 9 aa, Homo Sapiens
SMRIEHEHK

SEQ ID NO: 352335 - protein, 9 aa, Homo Sapiens
QNNNSTASS

SEQ ID NO: 352336 - protein, 9 aa, Homo Sapiens
GKSYYKVNN

SEQ ID NO: 352337 - protein, 9 aa, Homo Sapiens
PACGRVSCH

SEQ ID NO: 352338 - protein, 9 aa, Homo Sapiens
HTQRMQHNR

SEQ ID NO: 352339 - protein, 9 aa, Homo Sapiens
YVFQDFLFT

SEQ ID NO: 352340 - protein, 9 aa, Homo Sapiens
KHHVNMKAK

SEQ ID NO: 352341 - protein, 9 aa, Homo Sapiens
WTFYSGAFQ

SEQ ID NO: 352342 - protein, 9 aa, Homo Sapiens
LYTDLFLSL

SEQ ID NO: 352343 - protein, 9 aa, Homo Sapiens
QEAINCLHA

SEQ ID NO: 352344 - protein, 9 aa, Homo Sapiens
TMQTLMCDV

SEQ ID NO: 352345 - protein, 9 aa, Homo Sapiens
TLVIEDNVR

SEQ ID NO: 352346 - protein, 9 aa, Homo Sapiens
DAAVKQRLS

SEQ ID NO: 352347 - protein, 9 aa, Homo Sapiens
YGAGEHGLQ

SEQ ID NO: 352348 - protein, 9 aa, Homo Sapiens
HGIINENRK

SEQ ID NO: 352349 - protein, 9 aa, Homo Sapiens
WHLKRHLDY

SEQ ID NO: 352350 - protein, 9 aa, Homo Sapiens
KTKAINGNY

SEQ ID NO: 352351 - protein, 9 aa, Homo Sapiens
CVQACGADS

SEQ ID NO: 352352 - protein, 9 aa, Homo Sapiens
KDEWAEVDR

SEQ ID NO: 352353 - protein, 9 aa, Homo Sapiens
GLVLQIDCG

SEQ ID NO: 352354 - protein, 9 aa, Homo Sapiens
LPVQPVTKT

SEQ ID NO: 352355 - protein, 9 aa, Homo Sapiens
RDKPMHDEI

SEQ ID NO: 352356 - protein, 9 aa, Homo Sapiens
VEARKNYQT

SEQ ID NO: 352357 - protein, 9 aa, Homo Sapiens
VMLSMLMHF

SEQ ID NO: 352358 - protein, 9 aa, Homo Sapiens
EEESIWKKA

SEQ ID NO: 352359 - protein, 9 aa, Homo Sapiens
PKNLEIYKG

SEQ ID NO: 352360 - protein, 9 aa, Homo Sapiens
IIFIPCIYI

SEQ ID NO: 352361 - protein, 9 aa, Homo Sapiens
VTISFVMKF

SEQ ID NO: 352362 - protein, 9 aa, Homo Sapiens
NTIPNIMFF

SEQ ID NO: 352363 - protein, 9 aa, Homo Sapiens
EMDMGLREM

SEQ ID NO: 352364 - protein, 9 aa, Homo Sapiens
IYIQRTLRN

SEQ ID NO: 352365 - protein, 9 aa, Homo Sapiens
HNLFVLRGT

SEQ ID NO: 352366 - protein, 9 aa, Homo Sapiens
GLSSLFQRP

SEQ ID NO: 352367 - protein, 9 aa, Homo Sapiens
LDRFAQPAT

SEQ ID NO: 352368 - protein, 9 aa, Homo Sapiens
RRSPQKLPT

SEQ ID NO: 352369 - protein, 9 aa, Homo Sapiens
NKGAKTLAR

SEQ ID NO: 352370 - protein, 9 aa, Homo Sapiens
RIEVVGIND

SEQ ID NO: 352371 - protein, 9 aa, Homo Sapiens
PPNEEHRLE

SEQ ID NO: 352372 - protein, 9 aa, Homo Sapiens
TPEQCCTKF

SEQ ID NO: 352373 - protein, 9 aa, Homo Sapiens
GGASPHSKA

SEQ ID NO: 352374 - protein, 9 aa, Homo Sapiens
LDIMFTLDK

SEQ ID NO: 352375 - protein, 9 aa, Homo Sapiens
SDSESKLVI

SEQ ID NO: 352376 - protein, 9 aa, Homo Sapiens
NAHHPFLFF

SEQ ID NO: 352377 - protein, 9 aa, Homo Sapiens
AHFKTRKLA

SEQ ID NO: 352378 - protein, 9 aa, Homo Sapiens
QFRLIRLCF

SEQ ID NO: 352379 - protein, 9 aa, Homo Sapiens
DNWQLSQFW

SEQ ID NO: 352380 - protein, 9 aa, Homo Sapiens
LKQNDSIIV

SEQ ID NO: 352381 - protein, 9 aa, Homo Sapiens
NKESQNIKI

SEQ ID NO: 352382 - protein, 9 aa, Homo Sapiens
IHSAAVSCG

SEQ ID NO: 352383 - protein, 9 aa, Homo Sapiens
KQINKPQQN

SEQ ID NO: 352384 - protein, 9 aa, Homo Sapiens
SDSEEEDEE

SEQ ID NO: 352385 - protein, 9 aa, Homo Sapiens
TIVTLMVAV

SEQ ID NO: 352386 - protein, 9 aa, Homo Sapiens
SGPHDVHTC

SEQ ID NO: 352387 - protein, 9 aa, Homo Sapiens
QTMEDQDNQ

SEQ ID NO: 352388 - protein, 9 aa, Homo Sapiens
EEKYTVIYL

SEQ ID NO: 352389 - protein, 9 aa, Homo Sapiens
TEYKVPARL

SEQ ID NO: 352390 - protein, 9 aa, Homo Sapiens
KIFADRPCL

SEQ ID NO: 352391 - protein, 9 aa, Homo Sapiens
VRKIIQDHG

SEQ ID NO: 352392 - protein, 9 aa, Homo Sapiens
RGVRRHIQK

SEQ ID NO: 352393 - protein, 9 aa, Homo Sapiens
EASHIEELQ

SEQ ID NO: 352394 - protein, 9 aa, Homo Sapiens
LGTPSISTN

SEQ ID NO: 352395 - protein, 9 aa, Homo Sapiens
QARREGFDK

SEQ ID NO: 352396 - protein, 9 aa, Homo Sapiens
IFYMGNTAV

SEQ ID NO: 352397 - protein, 9 aa, Homo Sapiens
VHSLLTGTF

SEQ ID NO: 352398 - protein, 9 aa, Homo Sapiens
ILETSLKIP

SEQ ID NO: 352399 - protein, 9 aa, Homo Sapiens
SCGGGVQIR

SEQ ID NO: 352400 - protein, 9 aa, Homo Sapiens
MWNDTVQKQ

SEQ ID NO: 352401 - protein, 9 aa, Homo Sapiens
VLEHEARHS

SEQ ID NO: 352402 - protein, 9 aa, Homo Sapiens
LVLLTCDAE

SEQ ID NO: 352403 - protein, 9 aa, Homo Sapiens
RLLTVHAIN

SEQ ID NO: 352404 - protein, 9 aa, Homo Sapiens
KEDKLLGES

SEQ ID NO: 352405 - protein, 9 aa, Homo Sapiens
TLTYLLQNI

SEQ ID NO: 352406 - protein, 9 aa, Homo Sapiens
NTAVYYCLV

SEQ ID NO: 352407 - protein, 9 aa, Homo Sapiens
EHLGLNVAL

SEQ ID NO: 352408 - protein, 9 aa, Homo Sapiens
EHPAKCRSR

SEQ ID NO: 352409 - protein, 9 aa, Homo Sapiens
VQTLFGLHL

SEQ ID NO: 352410 - protein, 9 aa, Homo Sapiens
AWITELMQV

SEQ ID NO: 352411 - protein, 9 aa, Homo Sapiens
ATAVYHIDL

SEQ ID NO: 352412 - protein, 9 aa, Homo Sapiens
VHCVFNASD

SEQ ID NO: 352413 - protein, 9 aa, Homo Sapiens
FNEFCDSRL

SEQ ID NO: 352414 - protein, 9 aa, Homo Sapiens
TSTHSKFII

SEQ ID NO: 352415 - protein, 9 aa, Homo Sapiens
ELDGSLGSC

SEQ ID NO: 352416 - protein, 9 aa, Homo Sapiens
LQPFNRNLK

SEQ ID NO: 352417 - protein, 9 aa, Homo Sapiens
PISHLPSPS

SEQ ID NO: 352418 - protein, 9 aa, Homo Sapiens
LMTSAVPVA

SEQ ID NO: 352419 - protein, 9 aa, Homo Sapiens
LFEIVVQLL

SEQ ID NO: 352420 - protein, 9 aa, Homo Sapiens
CLPEDIWTR

SEQ ID NO: 352421 - protein, 9 aa, Homo Sapiens
QSRISYHAM

SEQ ID NO: 352422 - protein, 9 aa, Homo Sapiens
LAQLEEVKQ

SEQ ID NO: 352423 - protein, 9 aa, Homo Sapiens
TARAGHSGK

SEQ ID NO: 352424 - protein, 9 aa, Homo Sapiens
SGNLSQVKL

SEQ ID NO: 352425 - protein, 9 aa, Homo Sapiens
HQNHYRVYN

SEQ ID NO: 352426 - protein, 9 aa, Homo Sapiens
VIDHFSIDQ

SEQ ID NO: 352427 - protein, 9 aa, Homo Sapiens
KGQFGEVWR

SEQ ID NO: 352428 - protein, 9 aa, Homo Sapiens
QHLRQKLIQ

SEQ ID NO: 352429 - protein, 9 aa, Homo Sapiens
LEDKTKREL

SEQ ID NO: 352430 - protein, 9 aa, Homo Sapiens
CIGDKRRIV

SEQ ID NO: 352431 - protein, 9 aa, Homo Sapiens
EGLRYFSGI

SEQ ID NO: 352432 - protein, 9 aa, Homo Sapiens
VFPDRCVVC

SEQ ID NO: 352433 - protein, 9 aa, Homo Sapiens
GSTEDKHLM

SEQ ID NO: 352434 - protein, 9 aa, Homo Sapiens
KDEFTQIIA

SEQ ID NO: 352435 - protein, 9 aa, Homo Sapiens
QREEELKEL

SEQ ID NO: 352436 - protein, 9 aa, Homo Sapiens
PAARKFKPD

SEQ ID NO: 352437 - protein, 9 aa, Homo Sapiens
PGNLVYHFC

SEQ ID NO: 352438 - protein, 9 aa, Homo Sapiens
TIKTSSGKI

SEQ ID NO: 352439 - protein, 9 aa, Homo Sapiens
KSNKLFGSV

SEQ ID NO: 352440 - protein, 9 aa, Homo Sapiens
ATTCHIGVL

SEQ ID NO: 352441 - protein, 9 aa, Homo Sapiens
CEITWECVQ

SEQ ID NO: 352442 - protein, 9 aa, Homo Sapiens
RIENPNYLQ

SEQ ID NO: 352443 - protein, 9 aa, Homo Sapiens
RRDYGGINT

SEQ ID NO: 352444 - protein, 9 aa, Homo Sapiens
DTAPSELSN

SEQ ID NO: 352445 - protein, 9 aa, Homo Sapiens
AYISALNLP

SEQ ID NO: 352446 - protein, 9 aa, Homo Sapiens
LTNIHRQIR

SEQ ID NO: 352447 - protein, 9 aa, Homo Sapiens
KSPLSLETR

SEQ ID NO: 352448 - protein, 9 aa, Homo Sapiens
EQERCKEAE

SEQ ID NO: 352449 - protein, 9 aa, Homo Sapiens
TYHVHNLIG

SEQ ID NO: 352450 - protein, 9 aa, Homo Sapiens
KETYMLYIA

SEQ ID NO: 352451 - protein, 9 aa, Homo Sapiens
GLGYGCAGF

SEQ ID NO: 352452 - protein, 9 aa, Homo Sapiens
FLIDKGNAF

SEQ ID NO: 352453 - protein, 9 aa, Homo Sapiens
FHFRIQRTT

SEQ ID NO: 352454 - protein, 9 aa, Homo Sapiens
LEKDSDGLC

SEQ ID NO: 352455 - protein, 9 aa, Homo Sapiens
VNIPLSVYN

SEQ ID NO: 352456 - protein, 9 aa, Homo Sapiens
HCMESSKLG

SEQ ID NO: 352457 - protein, 9 aa, Homo Sapiens
ISELQRVAH

SEQ ID NO: 352458 - protein, 9 aa, Homo Sapiens
QASNIYSGQ

SEQ ID NO: 352459 - protein, 9 aa, Homo Sapiens
VLALKLKES

SEQ ID NO: 352460 - protein, 9 aa, Homo Sapiens
QFVQLRDGD

SEQ ID NO: 352461 - protein, 9 aa, Homo Sapiens
ERTASGITN

SEQ ID NO: 352462 - protein, 9 aa, Homo Sapiens
DNLVYYNRL

SEQ ID NO: 352463 - protein, 9 aa, Homo Sapiens
KPFNKFQFE

SEQ ID NO: 352464 - protein, 9 aa, Homo Sapiens
VHATVENAY

SEQ ID NO: 352465 - protein, 9 aa, Homo Sapiens
NHPFMFIMK

SEQ ID NO: 352466 - protein, 9 aa, Homo Sapiens
SCPGRGHGH

SEQ ID NO: 352467 - protein, 9 aa, Homo Sapiens
GINTNMYQP

SEQ ID NO: 352468 - protein, 9 aa, Homo Sapiens
NRHETIHTG

SEQ ID NO: 352469 - protein, 9 aa, Homo Sapiens
INAAQPQCP

SEQ ID NO: 352470 - protein, 9 aa, Homo Sapiens
VQNSTRSDL

SEQ ID NO: 352471 - protein, 9 aa, Homo Sapiens
CERSHTRER

SEQ ID NO: 352472 - protein, 9 aa, Homo Sapiens
GEQPYECHE

SEQ ID NO: 352473 - protein, 9 aa, Homo Sapiens
LETRVDLCD

SEQ ID NO: 352474 - protein, 9 aa, Homo Sapiens
GTAIKDLLR

SEQ ID NO: 352475 - protein, 9 aa, Homo Sapiens
KQAQRWAQQ

SEQ ID NO: 352476 - protein, 9 aa, Homo Sapiens
LAFQDLQND

SEQ ID NO: 352477 - protein, 9 aa, Homo Sapiens
AEQQRQEEL

SEQ ID NO: 352478 - protein, 9 aa, Homo Sapiens
VLWLLGCHM

SEQ ID NO: 352479 - protein, 9 aa, Homo Sapiens
VAKLRDKIM

SEQ ID NO: 352480 - protein, 9 aa, Homo Sapiens
GMKEWSRRK

SEQ ID NO: 352481 - protein, 9 aa, Homo Sapiens
KEIGAIAQA

SEQ ID NO: 352482 - protein, 9 aa, Homo Sapiens
NKHSLERYL

SEQ ID NO: 352483 - protein, 9 aa, Homo Sapiens
SALKGLEKK

SEQ ID NO: 352484 - protein, 9 aa, Homo Sapiens
CDTKVLIED

SEQ ID NO: 352485 - protein, 9 aa, Homo Sapiens
GENVSMKAP

SEQ ID NO: 352486 - protein, 9 aa, Homo Sapiens
SMKAPPDLL

SEQ ID NO: 352487 - protein, 9 aa, Homo Sapiens
VMKFFNWLS

SEQ ID NO: 352488 - protein, 9 aa, Homo Sapiens
KNNLKKFLT

SEQ ID NO: 352489 - protein, 9 aa, Homo Sapiens
ASAQLKRFD

SEQ ID NO: 352490 - protein, 9 aa, Homo Sapiens
LQAELGALH

SEQ ID NO: 352491 - protein, 9 aa, Homo Sapiens
NVQQVVHIC

SEQ ID NO: 352492 - protein, 9 aa, Homo Sapiens
NKSLATLTI

SEQ ID NO: 352493 - protein, 9 aa, Homo Sapiens
LEDNWNWDT

SEQ ID NO: 352494 - protein, 9 aa, Homo Sapiens
NQKGSTKSS

SEQ ID NO: 352495 - protein, 9 aa, Homo Sapiens
VHELIPAVI

SEQ ID NO: 352496 - protein, 9 aa, Homo Sapiens
ELSVPDLRR

SEQ ID NO: 352497 - protein, 9 aa, Homo Sapiens
AVLAVSSIQ

SEQ ID NO: 352498 - protein, 9 aa, Homo Sapiens
TVIWCPQDT

SEQ ID NO: 352499 - protein, 9 aa, Homo Sapiens
WYMNAVLQS

SEQ ID NO: 352500 - protein, 9 aa, Homo Sapiens
VVLIKLYSR

SEQ ID NO: 352501 - protein, 9 aa, Homo Sapiens
LPEFELVLW

SEQ ID NO: 352502 - protein, 9 aa, Homo Sapiens
TNNKEVNAT

SEQ ID NO: 352503 - protein, 9 aa, Homo Sapiens
TVEEIEACT

SEQ ID NO: 352504 - protein, 9 aa, Homo Sapiens
SSQEDYEFK

SEQ ID NO: 352505 - protein, 9 aa, Homo Sapiens
LIVTDANEA

SEQ ID NO: 352506 - protein, 9 aa, Homo Sapiens
KVDALDGKI

SEQ ID NO: 352507 - protein, 9 aa, Homo Sapiens
TGSKTTNDA

SEQ ID NO: 352508 - protein, 9 aa, Homo Sapiens
TVRSTQIVE

SEQ ID NO: 352509 - protein, 9 aa, Homo Sapiens
RNRHPGASI

SEQ ID NO: 352510 - protein, 9 aa, Homo Sapiens
CSFADAQGC

SEQ ID NO: 352511 - protein, 9 aa, Homo Sapiens
SRRKQVVVA

SEQ ID NO: 352512 - protein, 9 aa, Homo Sapiens
RYSLSFQSH

SEQ ID NO: 352513 - protein, 9 aa, Homo Sapiens
RKAGSIMWE

SEQ ID NO: 352514 - protein, 9 aa, Homo Sapiens
NRVCGHSSG

SEQ ID NO: 352515 - protein, 9 aa, Homo Sapiens
GNVILRHYE

SEQ ID NO: 352516 - protein, 9 aa, Homo Sapiens
QCPTGWRGR

SEQ ID NO: 352517 - protein, 9 aa, Homo Sapiens
NSMMTVGPH

SEQ ID NO: 352518 - protein, 9 aa, Homo Sapiens
MEYFSAVPP

SEQ ID NO: 352519 - protein, 9 aa, Homo Sapiens
NKYQTEQSL

SEQ ID NO: 352520 - protein, 9 aa, Homo Sapiens
VPYCGSQSI

SEQ ID NO: 352521 - protein, 9 aa, Homo Sapiens
IGMGRPAQH

SEQ ID NO: 352522 - protein, 9 aa, Homo Sapiens
ISFGLAVTE

SEQ ID NO: 352523 - protein, 9 aa, Homo Sapiens
AGFMTREEH

SEQ ID NO: 352524 - protein, 9 aa, Homo Sapiens
AATRAQLAN

SEQ ID NO: 352525 - protein, 9 aa, Homo Sapiens
DYSMPVPYR

SEQ ID NO: 352526 - protein, 9 aa, Homo Sapiens
LSHLSQHKI

SEQ ID NO: 352527 - protein, 9 aa, Homo Sapiens
FNEVEIYGE

SEQ ID NO: 352528 - protein, 9 aa, Homo Sapiens
NICMAGGLI

SEQ ID NO: 352529 - protein, 9 aa, Homo Sapiens
GALLKTGGT

SEQ ID NO: 352530 - protein, 9 aa, Homo Sapiens
SVLSPELPK

SEQ ID NO: 352531 - protein, 9 aa, Homo Sapiens
LGAGNLEYF

SEQ ID NO: 352532 - protein, 9 aa, Homo Sapiens
CPACHLRKC

SEQ ID NO: 352533 - protein, 9 aa, Homo Sapiens
LPISGHKHI

SEQ ID NO: 352534 - protein, 9 aa, Homo Sapiens
DLTLWCDYY

SEQ ID NO: 352535 - protein, 9 aa, Homo Sapiens
HIDVVSENP

SEQ ID NO: 352536 - protein, 9 aa, Homo Sapiens
CLDIDKLLV

SEQ ID NO: 352537 - protein, 9 aa, Homo Sapiens
TRLRELART

SEQ ID NO: 352538 - protein, 9 aa, Homo Sapiens
KPEKVFHEL

SEQ ID NO: 352539 - protein, 9 aa, Homo Sapiens
SEKCTLEGE

SEQ ID NO: 352540 - protein, 9 aa, Homo Sapiens
SPLREEANK

SEQ ID NO: 352541 - protein, 9 aa, Homo Sapiens
AEAQYLLDS

SEQ ID NO: 352542 - protein, 9 aa, Homo Sapiens
SFGLAVTEI

SEQ ID NO: 352543 - protein, 9 aa, Homo Sapiens
GTTHKRIIT

SEQ ID NO: 352544 - protein, 9 aa, Homo Sapiens
VPRRSPPVA

SEQ ID NO: 352545 - protein, 9 aa, Homo Sapiens
LEDSYNMEL

SEQ ID NO: 352546 - protein, 9 aa, Homo Sapiens
MNKFIGSFI

SEQ ID NO: 352547 - protein, 9 aa, Homo Sapiens
NNLLTDVLL

SEQ ID NO: 352548 - protein, 9 aa, Homo Sapiens
PENQARRQQ

SEQ ID NO: 352549 - protein, 9 aa, Homo Sapiens
DVAPSESEK

SEQ ID NO: 352550 - protein, 9 aa, Homo Sapiens
ALYTGMMSS

SEQ ID NO: 352551 - protein, 9 aa, Homo Sapiens
LEGLNNFLH

SEQ ID NO: 352552 - protein, 9 aa, Homo Sapiens
GNIVTWVSG

SEQ ID NO: 352553 - protein, 9 aa, Homo Sapiens
VGPPLKGYE

SEQ ID NO: 352554 - protein, 9 aa, Homo Sapiens
VKCKGNEYS

SEQ ID NO: 352555 - protein, 9 aa, Homo Sapiens
LVGHSTTKS

SEQ ID NO: 352556 - protein, 9 aa, Homo Sapiens
TRWYKDGAL

SEQ ID NO: 352557 - protein, 9 aa, Homo Sapiens
CGVPTIQSD

SEQ ID NO: 352558 - protein, 9 aa, Homo Sapiens
KHQNHYRVY

SEQ ID NO: 352559 - protein, 9 aa, Homo Sapiens
VLHQSVEAD

SEQ ID NO: 352560 - protein, 9 aa, Homo Sapiens
ALKYLTMQV

SEQ ID NO: 352561 - protein, 9 aa, Homo Sapiens
PSISRVTYL

SEQ ID NO: 352562 - protein, 9 aa, Homo Sapiens
VVLQLKDHV

SEQ ID NO: 352563 - protein, 9 aa, Homo Sapiens
CQSSNLHQH

SEQ ID NO: 352564 - protein, 9 aa, Homo Sapiens
HGPPSMAGH

SEQ ID NO: 352565 - protein, 9 aa, Homo Sapiens
ESLQLLASD

SEQ ID NO: 352566 - protein, 9 aa, Homo Sapiens
CYWLGEKLY

SEQ ID NO: 352567 - protein, 9 aa, Homo Sapiens
YECSGCGKL

SEQ ID NO: 352568 - protein, 9 aa, Homo Sapiens
LDTPNTTGP

SEQ ID NO: 352569 - protein, 9 aa, Homo Sapiens
YRRSLDWGA

SEQ ID NO: 352570 - protein, 9 aa, Homo Sapiens
QQQNQYERK

SEQ ID NO: 352571 - protein, 9 aa, Homo Sapiens
TLYESSVVF

SEQ ID NO: 352572 - protein, 9 aa, Homo Sapiens
FHYKFFCDV

SEQ ID NO: 352573 - protein, 9 aa, Homo Sapiens
VAEGGSAVS

SEQ ID NO: 352574 - protein, 9 aa, Homo Sapiens
NTFTVKYTP

SEQ ID NO: 352575 - protein, 9 aa, Homo Sapiens
MGGAMYLVS

SEQ ID NO: 352576 - protein, 9 aa, Homo Sapiens
INTGEKPYK

SEQ ID NO: 352577 - protein, 9 aa, Homo Sapiens
SLEEERIWK

SEQ ID NO: 352578 - protein, 9 aa, Homo Sapiens
RRLKQAKED

SEQ ID NO: 352579 - protein, 9 aa, Homo Sapiens
LSYSILESF

SEQ ID NO: 352580 - protein, 9 aa, Homo Sapiens
KAATTPAKK

SEQ ID NO: 352581 - protein, 9 aa, Homo Sapiens
NLTQASNIY

SEQ ID NO: 352582 - protein, 9 aa, Homo Sapiens
QYKLFVDGQ

SEQ ID NO: 352583 - protein, 9 aa, Homo Sapiens
LPPKFSNQF

SEQ ID NO: 352584 - protein, 9 aa, Homo Sapiens
EDNKGLELD

SEQ ID NO: 352585 - protein, 9 aa, Homo Sapiens
NLHLLENSL

SEQ ID NO: 352586 - protein, 9 aa, Homo Sapiens
FLFLAARLP

SEQ ID NO: 352587 - protein, 9 aa, Homo Sapiens
GGGESLQLL

SEQ ID NO: 352588 - protein, 9 aa, Homo Sapiens
DTQHREKLR

SEQ ID NO: 352589 - protein, 9 aa, Homo Sapiens
GKKGQFIDE

SEQ ID NO: 352590 - protein, 9 aa, Homo Sapiens
EEFPGDERR

SEQ ID NO: 352591 - protein, 9 aa, Homo Sapiens
LEEGCYCIC

SEQ ID NO: 352592 - protein, 9 aa, Homo Sapiens
IHIQNHTGE

SEQ ID NO: 352593 - protein, 9 aa, Homo Sapiens
KTVGDILRV

SEQ ID NO: 352594 - protein, 9 aa, Homo Sapiens
MKEFRCEPS

SEQ ID NO: 352595 - protein, 9 aa, Homo Sapiens
QNKEKYTVL

SEQ ID NO: 352596 - protein, 9 aa, Homo Sapiens
ELKQPRSCL

SEQ ID NO: 352597 - protein, 9 aa, Homo Sapiens
SNDSIMLVV

SEQ ID NO: 352598 - protein, 9 aa, Homo Sapiens
AVEASTDSS

SEQ ID NO: 352599 - protein, 9 aa, Homo Sapiens
HVAEVAVSV

SEQ ID NO: 352600 - protein, 9 aa, Homo Sapiens
VLINNKQVT

SEQ ID NO: 352601 - protein, 9 aa, Homo Sapiens
LLLQIPQSY

SEQ ID NO: 352602 - protein, 9 aa, Homo Sapiens
ECIKAESAE

SEQ ID NO: 352603 - protein, 9 aa, Homo Sapiens
EGWGEGAQF

SEQ ID NO: 352604 - protein, 9 aa, Homo Sapiens
TISICINSR

SEQ ID NO: 352605 - protein, 9 aa, Homo Sapiens
TVRSDSELD

SEQ ID NO: 352606 - protein, 9 aa, Homo Sapiens
WGQSFCWKS

SEQ ID NO: 352607 - protein, 9 aa, Homo Sapiens
QFNLYITKQ

SEQ ID NO: 352608 - protein, 9 aa, Homo Sapiens
DNRAEYVWL

SEQ ID NO: 352609 - protein, 9 aa, Homo Sapiens
PKITKSTQT

SEQ ID NO: 352610 - protein, 9 aa, Homo Sapiens
GLTVTLSVN

SEQ ID NO: 352611 - protein, 9 aa, Homo Sapiens
LQTLQSENL

SEQ ID NO: 352612 - protein, 9 aa, Homo Sapiens
DHSPISQKE

SEQ ID NO: 352613 - protein, 9 aa, Homo Sapiens
AQAVGRDTN

SEQ ID NO: 352614 - protein, 9 aa, Homo Sapiens
CGTSFYQCS

SEQ ID NO: 352615 - protein, 9 aa, Homo Sapiens
SSMLFITLM

SEQ ID NO: 352616 - protein, 9 aa, Homo Sapiens
VIQLGCFTA

SEQ ID NO: 352617 - protein, 9 aa, Homo Sapiens
EEDVNSESE

SEQ ID NO: 352618 - protein, 9 aa, Homo Sapiens
SAKYIQIHG

SEQ ID NO: 352619 - protein, 9 aa, Homo Sapiens
GKECGKAFR

SEQ ID NO: 352620 - protein, 9 aa, Homo Sapiens
GNDQNPGFQ

SEQ ID NO: 352621 - protein, 9 aa, Homo Sapiens
SKGFWGTVG

SEQ ID NO: 352622 - protein, 9 aa, Homo Sapiens
ESEEYNQVL

SEQ ID NO: 352623 - protein, 9 aa, Homo Sapiens
YITSFGPVS

SEQ ID NO: 352624 - protein, 9 aa, Homo Sapiens
TTNGSLSSV

SEQ ID NO: 352625 - protein, 9 aa, Homo Sapiens
QTSLCFSEY

SEQ ID NO: 352626 - protein, 9 aa, Homo Sapiens
RKAFRGAMD

SEQ ID NO: 352627 - protein, 9 aa, Homo Sapiens
FPTKSPTKN

SEQ ID NO: 352628 - protein, 9 aa, Homo Sapiens
PQGQETESL

SEQ ID NO: 352629 - protein, 9 aa, Homo Sapiens
KFICEDMSH

SEQ ID NO: 352630 - protein, 9 aa, Homo Sapiens
PAPPPTQGL

SEQ ID NO: 352631 - protein, 9 aa, Homo Sapiens
FCGYKISRN

SEQ ID NO: 352632 - protein, 9 aa, Homo Sapiens
LWDTFHELG

SEQ ID NO: 352633 - protein, 9 aa, Homo Sapiens
NKESVEKAA

SEQ ID NO: 352634 - protein, 9 aa, Homo Sapiens
NYNGGEPKH

SEQ ID NO: 352635 - protein, 9 aa, Homo Sapiens
ALKLKESVK

SEQ ID NO: 352636 - protein, 9 aa, Homo Sapiens
QVVHICLEC

SEQ ID NO: 352637 - protein, 9 aa, Homo Sapiens
ARLEGDLPL

SEQ ID NO: 352638 - protein, 9 aa, Homo Sapiens
LKLFTRCLA

SEQ ID NO: 352639 - protein, 9 aa, Homo Sapiens
IMDDDNNQT

SEQ ID NO: 352640 - protein, 9 aa, Homo Sapiens
VLQLKDHVS

SEQ ID NO: 352641 - protein, 9 aa, Homo Sapiens
TGDAYKCPV

SEQ ID NO: 352642 - protein, 9 aa, Homo Sapiens
IKINEMVAK

SEQ ID NO: 352643 - protein, 9 aa, Homo Sapiens
LYADNLPGN

SEQ ID NO: 352644 - protein, 9 aa, Homo Sapiens
IGFKTAKSF

SEQ ID NO: 352645 - protein, 9 aa, Homo Sapiens
PVTGHTCLN

SEQ ID NO: 352646 - protein, 9 aa, Homo Sapiens
ESDNEDGGE

SEQ ID NO: 352647 - protein, 9 aa, Homo Sapiens
SLAATVTVL

SEQ ID NO: 352648 - protein, 9 aa, Homo Sapiens
GEEDDKSKT

SEQ ID NO: 352649 - protein, 9 aa, Homo Sapiens
RCLRKALLE

SEQ ID NO: 352650 - protein, 9 aa, Homo Sapiens
YLPGHSKCS

SEQ ID NO: 352651 - protein, 9 aa, Homo Sapiens
DEDDNDLLS

SEQ ID NO: 352652 - protein, 9 aa, Homo Sapiens
IHEYNFEIK

SEQ ID NO: 352653 - protein, 9 aa, Homo Sapiens
KASFFPPVE

SEQ ID NO: 352654 - protein, 9 aa, Homo Sapiens
QYHQNGCIS

SEQ ID NO: 352655 - protein, 9 aa, Homo Sapiens
ASKGLHLET

SEQ ID NO: 352656 - protein, 9 aa, Homo Sapiens
KKLHLSNGV

SEQ ID NO: 352657 - protein, 9 aa, Homo Sapiens
SSGNLANVE

SEQ ID NO: 352658 - protein, 9 aa, Homo Sapiens
EASALKGLE

SEQ ID NO: 352659 - protein, 9 aa, Homo Sapiens
KDRDRDANQ

SEQ ID NO: 352660 - protein, 9 aa, Homo Sapiens
GSNLTQHWR

SEQ ID NO: 352661 - protein, 9 aa, Homo Sapiens
VRIYDWRML

SEQ ID NO: 352662 - protein, 9 aa, Homo Sapiens
KISKEEREA

SEQ ID NO: 352663 - protein, 9 aa, Homo Sapiens
CVQLVCPDA

SEQ ID NO: 352664 - protein, 9 aa, Homo Sapiens
DKPDLSEVV

SEQ ID NO: 352665 - protein, 9 aa, Homo Sapiens
HAEVIKLQI

SEQ ID NO: 352666 - protein, 9 aa, Homo Sapiens
LCKLFLDSY

SEQ ID NO: 352667 - protein, 9 aa, Homo Sapiens
VDGPGTCLK

SEQ ID NO: 352668 - protein, 9 aa, Homo Sapiens
HCPPAPPPT

SEQ ID NO: 352669 - protein, 9 aa, Homo Sapiens
LSNLEIGMY

SEQ ID NO: 352670 - protein, 9 aa, Homo Sapiens
HVDSIINKW

SEQ ID NO: 352671 - protein, 9 aa, Homo Sapiens
PGIKLIYNA

SEQ ID NO: 352672 - protein, 9 aa, Homo Sapiens
TVMTMMLPF

SEQ ID NO: 352673 - protein, 9 aa, Homo Sapiens
AVRACVIHF

SEQ ID NO: 352674 - protein, 9 aa, Homo Sapiens
HHLSEPEIT

SEQ ID NO: 352675 - protein, 9 aa, Homo Sapiens
DKRSNSLWL

SEQ ID NO: 352676 - protein, 9 aa, Homo Sapiens
GHTCLNVNV

SEQ ID NO: 352677 - protein, 9 aa, Homo Sapiens
GLYLYQFQL

SEQ ID NO: 352678 - protein, 9 aa, Homo Sapiens
DWSAITATQ

SEQ ID NO: 352679 - protein, 9 aa, Homo Sapiens
TDAPAMTMT

SEQ ID NO: 352680 - protein, 9 aa, Homo Sapiens
SGRQTKMIW

SEQ ID NO: 352681 - protein, 9 aa, Homo Sapiens
GLPPKRKED

SEQ ID NO: 352682 - protein, 9 aa, Homo Sapiens
IETKTKDKL

SEQ ID NO: 352683 - protein, 9 aa, Homo Sapiens
GLAQVILQW

SEQ ID NO: 352684 - protein, 9 aa, Homo Sapiens
KECGKACNR

SEQ ID NO: 352685 - protein, 9 aa, Homo Sapiens
SNRCCIIYV

SEQ ID NO: 352686 - protein, 9 aa, Homo Sapiens
QIHFGATGK

SEQ ID NO: 352687 - protein, 9 aa, Homo Sapiens
FKMSTVHKI

SEQ ID NO: 352688 - protein, 9 aa, Homo Sapiens
QGWPRVGYW

SEQ ID NO: 352689 - protein, 9 aa, Homo Sapiens
CLNCLLMIE

SEQ ID NO: 352690 - protein, 9 aa, Homo Sapiens
YKLLGRKSG

SEQ ID NO: 352691 - protein, 9 aa, Homo Sapiens
KFPRGFKFN

SEQ ID NO: 352692 - protein, 9 aa, Homo Sapiens
IKQRLHSGS

SEQ ID NO: 352693 - protein, 9 aa, Homo Sapiens
AMALKVEDP

SEQ ID NO: 352694 - protein, 9 aa, Homo Sapiens
TGIEGEDSI

SEQ ID NO: 352695 - protein, 9 aa, Homo Sapiens
PFKVQYMLV

SEQ ID NO: 352696 - protein, 9 aa, Homo Sapiens
LTLGVLNLQ

SEQ ID NO: 352697 - protein, 9 aa, Homo Sapiens
SSAMIKYLS

SEQ ID NO: 352698 - protein, 9 aa, Homo Sapiens
AKMINLMRS

SEQ ID NO: 352699 - protein, 9 aa, Homo Sapiens
DRWLKKKHQ

SEQ ID NO: 352700 - protein, 9 aa, Homo Sapiens
HMESKTGHR

SEQ ID NO: 352701 - protein, 9 aa, Homo Sapiens
TQHRVLFET

SEQ ID NO: 352702 - protein, 9 aa, Homo Sapiens
IQEKNNMKA

SEQ ID NO: 352703 - protein, 9 aa, Homo Sapiens
QEKNNMKAL

SEQ ID NO: 352704 - protein, 9 aa, Homo Sapiens
AAGELCLGK

SEQ ID NO: 352705 - protein, 9 aa, Homo Sapiens
KAEFFSFEN

SEQ ID NO: 352706 - protein, 9 aa, Homo Sapiens
RSHKEDQGK

SEQ ID NO: 352707 - protein, 9 aa, Homo Sapiens
RYFSGIKGL

SEQ ID NO: 352708 - protein, 9 aa, Homo Sapiens
QFCSPGSLL

SEQ ID NO: 352709 - protein, 9 aa, Homo Sapiens
KKDSPFWLP

SEQ ID NO: 352710 - protein, 9 aa, Homo Sapiens
GILLAVNWL

SEQ ID NO: 352711 - protein, 9 aa, Homo Sapiens
KETIPEEAQ

SEQ ID NO: 352712 - protein, 9 aa, Homo Sapiens
IHKIINTGE

SEQ ID NO: 352713 - protein, 9 aa, Homo Sapiens
QFFTSLDPI

SEQ ID NO: 352714 - protein, 9 aa, Homo Sapiens
KFMITFPYG

SEQ ID NO: 352715 - protein, 9 aa, Homo Sapiens
QRLSSLIQL

SEQ ID NO: 352716 - protein, 9 aa, Homo Sapiens
PSRIKPMDD

SEQ ID NO: 352717 - protein, 9 aa, Homo Sapiens
DPPLYPPVQ

SEQ ID NO: 352718 - protein, 9 aa, Homo Sapiens
SERYELIVD

SEQ ID NO: 352719 - protein, 9 aa, Homo Sapiens
NVKGTKSSQ

SEQ ID NO: 352720 - protein, 9 aa, Homo Sapiens
HTERHAQPP

SEQ ID NO: 352721 - protein, 9 aa, Homo Sapiens
DDMIIAKEE

SEQ ID NO: 352722 - protein, 9 aa, Homo Sapiens
ILQIFNEFC

SEQ ID NO: 352723 - protein, 9 aa, Homo Sapiens
SSGNDTTEN

SEQ ID NO: 352724 - protein, 9 aa, Homo Sapiens
CSVCEYAFN

SEQ ID NO: 352725 - protein, 9 aa, Homo Sapiens
DQFLLKQRV

SEQ ID NO: 352726 - protein, 9 aa, Homo Sapiens
YCQIIDQRD

SEQ ID NO: 352727 - protein, 9 aa, Homo Sapiens
AEKVTQKIV

SEQ ID NO: 352728 - protein, 9 aa, Homo Sapiens
IGYGCNINE

SEQ ID NO: 352729 - protein, 9 aa, Homo Sapiens
LIHTGEKLY

SEQ ID NO: 352730 - protein, 9 aa, Homo Sapiens
LQPPPLPEG

SEQ ID NO: 352731 - protein, 9 aa, Homo Sapiens
LQINRFAWP

SEQ ID NO: 352732 - protein, 9 aa, Homo Sapiens
NTIILFTKV

SEQ ID NO: 352733 - protein, 9 aa, Homo Sapiens
SYFHTTPNT

SEQ ID NO: 352734 - protein, 9 aa, Homo Sapiens
PVELRSSYF

SEQ ID NO: 352735 - protein, 9 aa, Homo Sapiens
DPDMALCQN

SEQ ID NO: 352736 - protein, 9 aa, Homo Sapiens
KSQFKEHQQ

SEQ ID NO: 352737 - protein, 9 aa, Homo Sapiens
ITFCSKNIT

SEQ ID NO: 352738 - protein, 9 aa, Homo Sapiens
EAERAEAEQ

SEQ ID NO: 352739 - protein, 9 aa, Homo Sapiens
RAEAKQMKV

SEQ ID NO: 352740 - protein, 9 aa, Homo Sapiens
NNSKWVEVD

SEQ ID NO: 352741 - protein, 9 aa, Homo Sapiens
NTLWRTTVE

SEQ ID NO: 352742 - protein, 9 aa, Homo Sapiens
DLTHNTYQH

SEQ ID NO: 352743 - protein, 9 aa, Homo Sapiens
RTARAGHSG

SEQ ID NO: 352744 - protein, 9 aa, Homo Sapiens
LRLILQQSQ

SEQ ID NO: 352745 - protein, 9 aa, Homo Sapiens
QDQFLLKQR

SEQ ID NO: 352746 - protein, 9 aa, Homo Sapiens
NREKNHPRV

SEQ ID NO: 352747 - protein, 9 aa, Homo Sapiens
ISQLFQLNY

SEQ ID NO: 352748 - protein, 9 aa, Homo Sapiens
SRETLLQCE

SEQ ID NO: 352749 - protein, 9 aa, Homo Sapiens
QTVFYSWLQ

SEQ ID NO: 352750 - protein, 9 aa, Homo Sapiens
LVYFVIAYI

SEQ ID NO: 352751 - protein, 9 aa, Homo Sapiens
LEAPLCISC

SEQ ID NO: 352752 - protein, 9 aa, Homo Sapiens
EGYTLNADN

SEQ ID NO: 352753 - protein, 9 aa, Homo Sapiens
NLSLMNSTD

SEQ ID NO: 352754 - protein, 9 aa, Homo Sapiens
QKVVSVSEL

SEQ ID NO: 352755 - protein, 9 aa, Homo Sapiens
RLLVFFFLI

SEQ ID NO: 352756 - protein, 9 aa, Homo Sapiens
ENQNKPLSC

SEQ ID NO: 352757 - protein, 9 aa, Homo Sapiens
TSLTTVLIS

SEQ ID NO: 352758 - protein, 9 aa, Homo Sapiens
DMDINEEEL

SEQ ID NO: 352759 - protein, 9 aa, Homo Sapiens
EAKETTYSS

SEQ ID NO: 352760 - protein, 9 aa, Homo Sapiens
AQRSLHRVP

SEQ ID NO: 352761 - protein, 9 aa, Homo Sapiens
QDNQRVQAH

SEQ ID NO: 352762 - protein, 9 aa, Homo Sapiens
DGSDPRIKS

SEQ ID NO: 352763 - protein, 9 aa, Homo Sapiens
EECLLLERL

SEQ ID NO: 352764 - protein, 9 aa, Homo Sapiens
KCSSKKKKS

SEQ ID NO: 352765 - protein, 9 aa, Homo Sapiens
DHPAHAEVI

SEQ ID NO: 352766 - protein, 9 aa, Homo Sapiens
EKMLYVCCG

SEQ ID NO: 352767 - protein, 9 aa, Homo Sapiens
GELPYTYSK

SEQ ID NO: 352768 - protein, 9 aa, Homo Sapiens
TTNTTRFVL

SEQ ID NO: 352769 - protein, 9 aa, Homo Sapiens
LYYFLGFLF

SEQ ID NO: 352770 - protein, 9 aa, Homo Sapiens
LSRSGMLEM

SEQ ID NO: 352771 - protein, 9 aa, Homo Sapiens
SCGASLHGL

SEQ ID NO: 352772 - protein, 9 aa, Homo Sapiens
RQGGGMPEK

SEQ ID NO: 352773 - protein, 9 aa, Homo Sapiens
EQKPFKVQY

SEQ ID NO: 352774 - protein, 9 aa, Homo Sapiens
CPHCGEKSS

SEQ ID NO: 352775 - protein, 9 aa, Homo Sapiens
DKLDLKKNV

SEQ ID NO: 352776 - protein, 9 aa, Homo Sapiens
NFICQNTLG

SEQ ID NO: 352777 - protein, 9 aa, Homo Sapiens
PDWNKAGEW

SEQ ID NO: 352778 - protein, 9 aa, Homo Sapiens
NHWIIHNEE

SEQ ID NO: 352779 - protein, 9 aa, Homo Sapiens
SVSLQYKNN

SEQ ID NO: 352780 - protein, 9 aa, Homo Sapiens
LCHKPQRGE

SEQ ID NO: 352781 - protein, 9 aa, Homo Sapiens
ALSEKCTLE

SEQ ID NO: 352782 - protein, 9 aa, Homo Sapiens
HNAEILFKK

SEQ ID NO: 352783 - protein, 9 aa, Homo Sapiens
VFESFVVLG

SEQ ID NO: 352784 - protein, 9 aa, Homo Sapiens
RDECLMRLT

SEQ ID NO: 352785 - protein, 9 aa, Homo Sapiens
VVAFSDERV

SEQ ID NO: 352786 - protein, 9 aa, Homo Sapiens
SHLPSPSPS

SEQ ID NO: 352787 - protein, 9 aa, Homo Sapiens
CYTSAKDGE

SEQ ID NO: 352788 - protein, 9 aa, Homo Sapiens
QHTGVLTIV

SEQ ID NO: 352789 - protein, 9 aa, Homo Sapiens
FAENTARCE

SEQ ID NO: 352790 - protein, 9 aa, Homo Sapiens
PLLEAPLCI

SEQ ID NO: 352791 - protein, 9 aa, Homo Sapiens
ETTYQRDYS

SEQ ID NO: 352792 - protein, 9 aa, Homo Sapiens
GYNEINNVN

SEQ ID NO: 352793 - protein, 9 aa, Homo Sapiens
EIIHTGERP

SEQ ID NO: 352794 - protein, 9 aa, Homo Sapiens
VLNLQYFFD

SEQ ID NO: 352795 - protein, 9 aa, Homo Sapiens
QDVESYIHH

SEQ ID NO: 352796 - protein, 9 aa, Homo Sapiens
MHDEIFYTL

SEQ ID NO: 352797 - protein, 9 aa, Homo Sapiens
LLSSLQYHK

SEQ ID NO: 352798 - protein, 9 aa, Homo Sapiens
FVTTNNKEV

SEQ ID NO: 352799 - protein, 9 aa, Homo Sapiens
FCNKPQRKP

SEQ ID NO: 352800 - protein, 9 aa, Homo Sapiens
IPKVQSNGP

SEQ ID NO: 352801 - protein, 9 aa, Homo Sapiens
NPADPQCIP

SEQ ID NO: 352802 - protein, 9 aa, Homo Sapiens
RITTHCLAY

SEQ ID NO: 352803 - protein, 9 aa, Homo Sapiens
THQRLHTEE

SEQ ID NO: 352804 - protein, 9 aa, Homo Sapiens
RQTHTGEKP

SEQ ID NO: 352805 - protein, 9 aa, Homo Sapiens
FYFFFSFSL

SEQ ID NO: 352806 - protein, 9 aa, Homo Sapiens
VMSLVQLIV

SEQ ID NO: 352807 - protein, 9 aa, Homo Sapiens
PKQGLKDYF

SEQ ID NO: 352808 - protein, 9 aa, Homo Sapiens
PGNPVLAVV

SEQ ID NO: 352809 - protein, 9 aa, Homo Sapiens
LVTKRTNGK

SEQ ID NO: 352810 - protein, 9 aa, Homo Sapiens
ATLLSANTS

SEQ ID NO: 352811 - protein, 9 aa, Homo Sapiens
KFTTQKSVP

SEQ ID NO: 352812 - protein, 9 aa, Homo Sapiens
SSLRERTRV

SEQ ID NO: 352813 - protein, 9 aa, Homo Sapiens
RRTHQKCVI

SEQ ID NO: 352814 - protein, 9 aa, Homo Sapiens
ARREGFDKN

SEQ ID NO: 352815 - protein, 9 aa, Homo Sapiens
KLAYFSFLP

SEQ ID NO: 352816 - protein, 9 aa, Homo Sapiens
ADTQVLSWR

SEQ ID NO: 352817 - protein, 9 aa, Homo Sapiens
VFACPILHQ

SEQ ID NO: 352818 - protein, 9 aa, Homo Sapiens
KGSTKSSDY

SEQ ID NO: 352819 - protein, 9 aa, Homo Sapiens
DGVSEEFWL

SEQ ID NO: 352820 - protein, 9 aa, Homo Sapiens
QPNLKYTIT

SEQ ID NO: 352821 - protein, 9 aa, Homo Sapiens
INLDYSVGQ

SEQ ID NO: 352822 - protein, 9 aa, Homo Sapiens
RKSIARVFT

SEQ ID NO: 352823 - protein, 9 aa, Homo Sapiens
TRKKTKQVE

SEQ ID NO: 352824 - protein, 9 aa, Homo Sapiens
FCQSSNLHQ

SEQ ID NO: 352825 - protein, 9 aa, Homo Sapiens
KNFILSIGG

SEQ ID NO: 352826 - protein, 9 aa, Homo Sapiens
EMLSRLSLL

SEQ ID NO: 352827 - protein, 9 aa, Homo Sapiens
LSQGTAVTH

SEQ ID NO: 352828 - protein, 9 aa, Homo Sapiens
KGGTKVYKS

SEQ ID NO: 352829 - protein, 9 aa, Homo Sapiens
PQISLAEML

SEQ ID NO: 352830 - protein, 9 aa, Homo Sapiens
LVGAPRFFS

SEQ ID NO: 352831 - protein, 9 aa, Homo Sapiens
VIVAWAIGG

SEQ ID NO: 352832 - protein, 9 aa, Homo Sapiens
SMQGTIMGI

SEQ ID NO: 352833 - protein, 9 aa, Homo Sapiens
GISPILKLA

SEQ ID NO: 352834 - protein, 9 aa, Homo Sapiens
EGLNNFLHQ

SEQ ID NO: 352835 - protein, 9 aa, Homo Sapiens
WVSSSVLTG

SEQ ID NO: 352836 - protein, 9 aa, Homo Sapiens
AAKYVPSKV

SEQ ID NO: 352837 - protein, 9 aa, Homo Sapiens
IAIKGVARL

SEQ ID NO: 352838 - protein, 9 aa, Homo Sapiens
VSGHLALII

SEQ ID NO: 352839 - protein, 9 aa, Homo Sapiens
DKTKRELLE

SEQ ID NO: 352840 - protein, 9 aa, Homo Sapiens
IDVSSAAKA

SEQ ID NO: 352841 - protein, 9 aa, Homo Sapiens
DEYYLYAKN

SEQ ID NO: 352842 - protein, 9 aa, Homo Sapiens
PLEKETFQF

SEQ ID NO: 352843 - protein, 9 aa, Homo Sapiens
VVVFVVSWL

SEQ ID NO: 352844 - protein, 9 aa, Homo Sapiens
ISIFCFAAS

SEQ ID NO: 352845 - protein, 9 aa, Homo Sapiens
KDVVYPEIF

SEQ ID NO: 352846 - protein, 9 aa, Homo Sapiens
KALCETKCS

SEQ ID NO: 352847 - protein, 9 aa, Homo Sapiens
LNESNCAEL

SEQ ID NO: 352848 - protein, 9 aa, Homo Sapiens
FQPQVICLP

SEQ ID NO: 352849 - protein, 9 aa, Homo Sapiens
QGGNQRLLS

SEQ ID NO: 352850 - protein, 9 aa, Homo Sapiens
SCTNKLRDR

SEQ ID NO: 352851 - protein, 9 aa, Homo Sapiens
MRNKKEEYL

SEQ ID NO: 352852 - protein, 9 aa, Homo Sapiens
HISHDKQDK

SEQ ID NO: 352853 - protein, 9 aa, Homo Sapiens
GFKTAKSFA

SEQ ID NO: 352854 - protein, 9 aa, Homo Sapiens
YSHQSGDFT

SEQ ID NO: 352855 - protein, 9 aa, Homo Sapiens
WCQGYFRDY

SEQ ID NO: 352856 - protein, 9 aa, Homo Sapiens
NESNSESAD

SEQ ID NO: 352857 - protein, 9 aa, Homo Sapiens
VKDYIQTQI

SEQ ID NO: 352858 - protein, 9 aa, Homo Sapiens
NCLLMIECS

SEQ ID NO: 352859 - protein, 9 aa, Homo Sapiens
QTIFSVFNN

SEQ ID NO: 352860 - protein, 9 aa, Homo Sapiens
PFDLHIYVC

SEQ ID NO: 352861 - protein, 9 aa, Homo Sapiens
LQIFNEFCD

SEQ ID NO: 352862 - protein, 9 aa, Homo Sapiens
EQNQATTDA

SEQ ID NO: 352863 - protein, 9 aa, Homo Sapiens
RLENTIILF

SEQ ID NO: 352864 - protein, 9 aa, Homo Sapiens
TVGINFKVK

SEQ ID NO: 352865 - protein, 9 aa, Homo Sapiens
SRFQESLNQ

SEQ ID NO: 352866 - protein, 9 aa, Homo Sapiens
GPSTNGCQL

SEQ ID NO: 352867 - protein, 9 aa, Homo Sapiens
LNLMPDFFP

SEQ ID NO: 352868 - protein, 9 aa, Homo Sapiens
KTEADGTQG

SEQ ID NO: 352869 - protein, 9 aa, Homo Sapiens
LERLDLQNN

SEQ ID NO: 352870 - protein, 9 aa, Homo Sapiens
KYLTMQVLN

SEQ ID NO: 352871 - protein, 9 aa, Homo Sapiens
ANGTSVYYI

SEQ ID NO: 352872 - protein, 9 aa, Homo Sapiens
YYKQLVLHP

SEQ ID NO: 352873 - protein, 9 aa, Homo Sapiens
GLRYFSGIK

SEQ ID NO: 352874 - protein, 9 aa, Homo Sapiens
SANLTTHKI

SEQ ID NO: 352875 - protein, 9 aa, Homo Sapiens
EINNWLNAA

SEQ ID NO: 352876 - protein, 9 aa, Homo Sapiens
NTTTHRCIC

SEQ ID NO: 352877 - protein, 9 aa, Homo Sapiens
GEFCQSKID

SEQ ID NO: 352878 - protein, 9 aa, Homo Sapiens
FLNLLHLVH

SEQ ID NO: 352879 - protein, 9 aa, Homo Sapiens
FTPPKSEKC

SEQ ID NO: 352880 - protein, 9 aa, Homo Sapiens
RRQCQPEIR

SEQ ID NO: 352881 - protein, 9 aa, Homo Sapiens
YLPKVEGDL

SEQ ID NO: 352882 - protein, 9 aa, Homo Sapiens
ERIKLLFFR

SEQ ID NO: 352883 - protein, 9 aa, Homo Sapiens
HDKDLRENG

SEQ ID NO: 352884 - protein, 9 aa, Homo Sapiens
RYLNVRRNH

SEQ ID NO: 352885 - protein, 9 aa, Homo Sapiens
IPKTLGIIF

SEQ ID NO: 352886 - protein, 9 aa, Homo Sapiens
RRQWSEKKK

SEQ ID NO: 352887 - protein, 9 aa, Homo Sapiens
YVVCYTSAK

SEQ ID NO: 352888 - protein, 9 aa, Homo Sapiens
YGNIIAYDN

SEQ ID NO: 352889 - protein, 9 aa, Homo Sapiens
LLFKDDFIL

SEQ ID NO: 352890 - protein, 9 aa, Homo Sapiens
INVTTTVSE

SEQ ID NO: 352891 - protein, 9 aa, Homo Sapiens
PVNTNQHKR

SEQ ID NO: 352892 - protein, 9 aa, Homo Sapiens
YGWRKCCLY

SEQ ID NO: 352893 - protein, 9 aa, Homo Sapiens
HMHTGERPY

SEQ ID NO: 352894 - protein, 9 aa, Homo Sapiens
YKNASENKE

SEQ ID NO: 352895 - protein, 9 aa, Homo Sapiens
KIETSLRNS

SEQ ID NO: 352896 - protein, 9 aa, Homo Sapiens
EDGLVLLTC

SEQ ID NO: 352897 - protein, 9 aa, Homo Sapiens
QTQAAQALA

SEQ ID NO: 352898 - protein, 9 aa, Homo Sapiens
KIFAFQRTI

SEQ ID NO: 352899 - protein, 9 aa, Homo Sapiens
HFCKMSIYF

SEQ ID NO: 352900 - protein, 9 aa, Homo Sapiens
HRQHLQRLQ

SEQ ID NO: 352901 - protein, 9 aa, Homo Sapiens
LKEAEEDSS

SEQ ID NO: 352902 - protein, 9 aa, Homo Sapiens
TTIIIISMI

SEQ ID NO: 352903 - protein, 9 aa, Homo Sapiens
FWCLYHKGH

SEQ ID NO: 352904 - protein, 9 aa, Homo Sapiens
EAKEPLKDS

SEQ ID NO: 352905 - protein, 9 aa, Homo Sapiens
IMFTLDKVH

SEQ ID NO: 352906 - protein, 9 aa, Homo Sapiens
NSVSLMNRG

SEQ ID NO: 352907 - protein, 9 aa, Homo Sapiens
SAVVRIMNL

SEQ ID NO: 352908 - protein, 9 aa, Homo Sapiens
RIRIALGNG

SEQ ID NO: 352909 - protein, 9 aa, Homo Sapiens
GRKVIEYNS

SEQ ID NO: 352910 - protein, 9 aa, Homo Sapiens
HLVFENSVG

SEQ ID NO: 352911 - protein, 9 aa, Homo Sapiens
ADILEVLRH

SEQ ID NO: 352912 - protein, 9 aa, Homo Sapiens
TSEMVNDAT

SEQ ID NO: 352913 - protein, 9 aa, Homo Sapiens
HYRYNTPGH

SEQ ID NO: 352914 - protein, 9 aa, Homo Sapiens
RNRPSFNGI

SEQ ID NO: 352915 - protein, 9 aa, Homo Sapiens
LVATLQGSA

SEQ ID NO: 352916 - protein, 9 aa, Homo Sapiens
IQKRLIQRR

SEQ ID NO: 352917 - protein, 9 aa, Homo Sapiens
VKRGRAVPV

SEQ ID NO: 352918 - protein, 9 aa, Homo Sapiens
NNYNRGDIP

SEQ ID NO: 352919 - protein, 9 aa, Homo Sapiens
DRTHNIIMV

SEQ ID NO: 352920 - protein, 9 aa, Homo Sapiens
AGIMLPEFH

SEQ ID NO: 352921 - protein, 9 aa, Homo Sapiens
NYLAKHNVL

SEQ ID NO: 352922 - protein, 9 aa, Homo Sapiens
KDKLFNEIN

SEQ ID NO: 352923 - protein, 9 aa, Homo Sapiens
PLWDFREFE

SEQ ID NO: 352924 - protein, 9 aa, Homo Sapiens
LAALTQAIC

SEQ ID NO: 352925 - protein, 9 aa, Homo Sapiens
NDGEWYNVD

SEQ ID NO: 352926 - protein, 9 aa, Homo Sapiens
LINNELSHL

SEQ ID NO: 352927 - protein, 9 aa, Homo Sapiens
GNRVLVMSY

SEQ ID NO: 352928 - protein, 9 aa, Homo Sapiens
FFDPKSNPL

SEQ ID NO: 352929 - protein, 9 aa, Homo Sapiens
KQTETTADC

SEQ ID NO: 352930 - protein, 9 aa, Homo Sapiens
TLFLAIGLW

SEQ ID NO: 352931 - protein, 9 aa, Homo Sapiens
TSAKKLLQE

SEQ ID NO: 352932 - protein, 9 aa, Homo Sapiens
DVGVSHKAR

SEQ ID NO: 352933 - protein, 9 aa, Homo Sapiens
TQNVTFVFD

SEQ ID NO: 352934 - protein, 9 aa, Homo Sapiens
SFHHRIFFP

SEQ ID NO: 352935 - protein, 9 aa, Homo Sapiens
KLSPGVFEN

SEQ ID NO: 352936 - protein, 9 aa, Homo Sapiens
KDKRTERSK

SEQ ID NO: 352937 - protein, 9 aa, Homo Sapiens
TDFYQVRAC

SEQ ID NO: 352938 - protein, 9 aa, Homo Sapiens
LLLEPPIAA

SEQ ID NO: 352939 - protein, 9 aa, Homo Sapiens
YAHPEWEQK

SEQ ID NO: 352940 - protein, 9 aa, Homo Sapiens
QISQISMKL

SEQ ID NO: 352941 - protein, 9 aa, Homo Sapiens
KIKEKEIEG

SEQ ID NO: 352942 - protein, 9 aa, Homo Sapiens
LTSFMKGRT

SEQ ID NO: 352943 - protein, 9 aa, Homo Sapiens
MQRGDAGYY

SEQ ID NO: 352944 - protein, 9 aa, Homo Sapiens
RGNLSNLVV

SEQ ID NO: 352945 - protein, 9 aa, Homo Sapiens
LSLNLGGMA

SEQ ID NO: 352946 - protein, 9 aa, Homo Sapiens
GESSQGQFS

SEQ ID NO: 352947 - protein, 9 aa, Homo Sapiens
PDWSAITAT

SEQ ID NO: 352948 - protein, 9 aa, Homo Sapiens
MPRPASACA

SEQ ID NO: 352949 - protein, 9 aa, Homo Sapiens
EQVLQQEHR

SEQ ID NO: 352950 - protein, 9 aa, Homo Sapiens
TTGESLRSH

SEQ ID NO: 352951 - protein, 9 aa, Homo Sapiens
ERGPNAQAA

SEQ ID NO: 352952 - protein, 9 aa, Homo Sapiens
LDSDSESKL

SEQ ID NO: 352953 - protein, 9 aa, Homo Sapiens
NFNIIKILN

SEQ ID NO: 352954 - protein, 9 aa, Homo Sapiens
VSSAAKAEA

SEQ ID NO: 352955 - protein, 9 aa, Homo Sapiens
VKIFPPEDK

SEQ ID NO: 352956 - protein, 9 aa, Homo Sapiens
KQLAELHTK

SEQ ID NO: 352957 - protein, 9 aa, Homo Sapiens
GARIERPHN

SEQ ID NO: 352958 - protein, 9 aa, Homo Sapiens
RLHLLDNTD

SEQ ID NO: 352959 - protein, 9 aa, Homo Sapiens
PAPASSISQ

SEQ ID NO: 352960 - protein, 9 aa, Homo Sapiens
LSQTVGIQK

SEQ ID NO: 352961 - protein, 9 aa, Homo Sapiens
RSKSNLGWA

SEQ ID NO: 352962 - protein, 9 aa, Homo Sapiens
VTVTMTKCD

SEQ ID NO: 352963 - protein, 9 aa, Homo Sapiens
QELLAFILD

SEQ ID NO: 352964 - protein, 9 aa, Homo Sapiens
GLHLETEAG

SEQ ID NO: 352965 - protein, 9 aa, Homo Sapiens
WMSKRYKEL

SEQ ID NO: 352966 - protein, 9 aa, Homo Sapiens
APRFFSAVG

SEQ ID NO: 352967 - protein, 9 aa, Homo Sapiens
YSCRICCKS

SEQ ID NO: 352968 - protein, 9 aa, Homo Sapiens
HMMNKFIGS

SEQ ID NO: 352969 - protein, 9 aa, Homo Sapiens
GVKLTHQAA

SEQ ID NO: 352970 - protein, 9 aa, Homo Sapiens
HVELEGLKV

SEQ ID NO: 352971 - protein, 9 aa, Homo Sapiens
LLAFILDGL

SEQ ID NO: 352972 - protein, 9 aa, Homo Sapiens
TQHQNIHTG

SEQ ID NO: 352973 - protein, 9 aa, Homo Sapiens
PSHQPPVST

SEQ ID NO: 352974 - protein, 9 aa, Homo Sapiens
LKITTFGAF

SEQ ID NO: 352975 - protein, 9 aa, Homo Sapiens
RFPLHLQPS

SEQ ID NO: 352976 - protein, 9 aa, Homo Sapiens
YLNPFCPPG

SEQ ID NO: 352977 - protein, 9 aa, Homo Sapiens
LGGPDIFLG

SEQ ID NO: 352978 - protein, 9 aa, Homo Sapiens
EDREMRNKK

SEQ ID NO: 352979 - protein, 9 aa, Homo Sapiens
LFVDGQWVH

SEQ ID NO: 352980 - protein, 9 aa, Homo Sapiens
LSDNLVLHM

SEQ ID NO: 352981 - protein, 9 aa, Homo Sapiens
LRTGLSTLM

SEQ ID NO: 352982 - protein, 9 aa, Homo Sapiens
YHKITHTGE

SEQ ID NO: 352983 - protein, 9 aa, Homo Sapiens
FSIVPVILM

SEQ ID NO: 352984 - protein, 9 aa, Homo Sapiens
EKEVTELYV

SEQ ID NO: 352985 - protein, 9 aa, Homo Sapiens
DTDVQLMRT

SEQ ID NO: 352986 - protein, 9 aa, Homo Sapiens
AKEQHFLEQ

SEQ ID NO: 352987 - protein, 9 aa, Homo Sapiens
VKNEVLREL

SEQ ID NO: 352988 - protein, 9 aa, Homo Sapiens
VATLQGSAP

SEQ ID NO: 352989 - protein, 9 aa, Homo Sapiens
PKVGATLVL

SEQ ID NO: 352990 - protein, 9 aa, Homo Sapiens
ATLTCESNA

SEQ ID NO: 352991 - protein, 9 aa, Homo Sapiens
RIHQHMHTG

SEQ ID NO: 352992 - protein, 9 aa, Homo Sapiens
FTGNKVGFF

SEQ ID NO: 352993 - protein, 9 aa, Homo Sapiens
LDYCPYEIV

SEQ ID NO: 352994 - protein, 9 aa, Homo Sapiens
TPTKKIQVN

SEQ ID NO: 352995 - protein, 9 aa, Homo Sapiens
FRLVSERNL

SEQ ID NO: 352996 - protein, 9 aa, Homo Sapiens
IKDMAMMTH

SEQ ID NO: 352997 - protein, 9 aa, Homo Sapiens
EQVLSLQNN

SEQ ID NO: 352998 - protein, 9 aa, Homo Sapiens
EENIFCDNI

SEQ ID NO: 352999 - protein, 9 aa, Homo Sapiens
LFFCPVYKD

SEQ ID NO: 353000 - protein, 9 aa, Homo Sapiens
YEELLHMKA

SEQ ID NO: 353001 - protein, 9 aa, Homo Sapiens
ASTQLNLIT

SEQ ID NO: 353002 - protein, 9 aa, Homo Sapiens
QEQLSSLAQ

SEQ ID NO: 353003 - protein, 9 aa, Homo Sapiens
FIANHPFMF

SEQ ID NO: 353004 - protein, 9 aa, Homo Sapiens
SASQGAGFR

SEQ ID NO: 353005 - protein, 9 aa, Homo Sapiens
TEAEMFGWN

SEQ ID NO: 353006 - protein, 9 aa, Homo Sapiens
LDIKRYLNL

SEQ ID NO: 353007 - protein, 9 aa, Homo Sapiens
LSMLLTDPH

SEQ ID NO: 353008 - protein, 9 aa, Homo Sapiens
IQGEHVLNF

SEQ ID NO: 353009 - protein, 9 aa, Homo Sapiens
PSAIINEIY

SEQ ID NO: 353010 - protein, 9 aa, Homo Sapiens
EYQFRCKNK

SEQ ID NO: 353011 - protein, 9 aa, Homo Sapiens
NLYITKQIR

SEQ ID NO: 353012 - protein, 9 aa, Homo Sapiens
LCCMQPHSE

SEQ ID NO: 353013 - protein, 9 aa, Homo Sapiens
LSSLIQLTS

SEQ ID NO: 353014 - protein, 9 aa, Homo Sapiens
TTVSLCLGS

SEQ ID NO: 353015 - protein, 9 aa, Homo Sapiens
NQYKDPQSK

SEQ ID NO: 353016 - protein, 9 aa, Homo Sapiens
SASESQIIS

SEQ ID NO: 353017 - protein, 9 aa, Homo Sapiens
SDMVLKIKQ

SEQ ID NO: 353018 - protein, 9 aa, Homo Sapiens
SHHPQPYRW

SEQ ID NO: 353019 - protein, 9 aa, Homo Sapiens
FDWICKERN

SEQ ID NO: 353020 - protein, 9 aa, Homo Sapiens
AGIHQGFRS

SEQ ID NO: 353021 - protein, 9 aa, Homo Sapiens
LFVSYFHCM

SEQ ID NO: 353022 - protein, 9 aa, Homo Sapiens
APSDICAAE

SEQ ID NO: 353023 - protein, 9 aa, Homo Sapiens
LAQVILQWK

SEQ ID NO: 353024 - protein, 9 aa, Homo Sapiens
KIKRTVTRI

SEQ ID NO: 353025 - protein, 9 aa, Homo Sapiens
QHEVCFVPK

SEQ ID NO: 353026 - protein, 9 aa, Homo Sapiens
QAMQEYITV

SEQ ID NO: 353027 - protein, 9 aa, Homo Sapiens
QRTLRNFIN

SEQ ID NO: 353028 - protein, 9 aa, Homo Sapiens
SSTDFSELK

SEQ ID NO: 353029 - protein, 9 aa, Homo Sapiens
QEVCSAFLA

SEQ ID NO: 353030 - protein, 9 aa, Homo Sapiens
KEDLDAIDW

SEQ ID NO: 353031 - protein, 9 aa, Homo Sapiens
ILLSQIEER

SEQ ID NO: 353032 - protein, 9 aa, Homo Sapiens
FETGYNEIN

SEQ ID NO: 353033 - protein, 9 aa, Homo Sapiens
KVLKLIKGS

SEQ ID NO: 353034 - protein, 9 aa, Homo Sapiens
LVSQCPTGW

SEQ ID NO: 353035 - protein, 9 aa, Homo Sapiens
PICGVPTIQ

SEQ ID NO: 353036 - protein, 9 aa, Homo Sapiens
SGTLFERLN

SEQ ID NO: 353037 - protein, 9 aa, Homo Sapiens
LESFDADKK

SEQ ID NO: 353038 - protein, 9 aa, Homo Sapiens
SEPYEKDGE

SEQ ID NO: 353039 - protein, 9 aa, Homo Sapiens
PLMYFELPD

SEQ ID NO: 353040 - protein, 9 aa, Homo Sapiens
PEPELYLNP

SEQ ID NO: 353041 - protein, 9 aa, Homo Sapiens
LYEFRHRPQ

SEQ ID NO: 353042 - protein, 9 aa, Homo Sapiens
TLKDITAQY

SEQ ID NO: 353043 - protein, 9 aa, Homo Sapiens
ISVPNLSAP

SEQ ID NO: 353044 - protein, 9 aa, Homo Sapiens
NNPIGDTGV

SEQ ID NO: 353045 - protein, 9 aa, Homo Sapiens
ENKVDFILL

SEQ ID NO: 353046 - protein, 9 aa, Homo Sapiens
KAEAIQILA

SEQ ID NO: 353047 - protein, 9 aa, Homo Sapiens
TFKQQKVWM

SEQ ID NO: 353048 - protein, 9 aa, Homo Sapiens
HLIQHHKLH

SEQ ID NO: 353049 - protein, 9 aa, Homo Sapiens
NMVAWFEKS

SEQ ID NO: 353050 - protein, 9 aa, Homo Sapiens
DFYQVRACL

SEQ ID NO: 353051 - protein, 9 aa, Homo Sapiens
TGEIVLSFP

SEQ ID NO: 353052 - protein, 9 aa, Homo Sapiens
NPYDMPGTS

SEQ ID NO: 353053 - protein, 9 aa, Homo Sapiens
LQNQIVTDP

SEQ ID NO: 353054 - protein, 9 aa, Homo Sapiens
TIVFDLSRR

SEQ ID NO: 353055 - protein, 9 aa, Homo Sapiens
DKGAKADTG

SEQ ID NO: 353056 - protein, 9 aa, Homo Sapiens
THTGEKPHA

SEQ ID NO: 353057 - protein, 9 aa, Homo Sapiens
STNGCQLFI

SEQ ID NO: 353058 - protein, 9 aa, Homo Sapiens
VDMARMYVA

SEQ ID NO: 353059 - protein, 9 aa, Homo Sapiens
NKSSYSKKI

SEQ ID NO: 353060 - protein, 9 aa, Homo Sapiens
KFRFLNKLI

SEQ ID NO: 353061 - protein, 9 aa, Homo Sapiens
LLEPPIAAL

SEQ ID NO: 353062 - protein, 9 aa, Homo Sapiens
AYFPYFTKH

SEQ ID NO: 353063 - protein, 9 aa, Homo Sapiens
FNLYASVLL

SEQ ID NO: 353064 - protein, 9 aa, Homo Sapiens
RSSQNGSLK

SEQ ID NO: 353065 - protein, 9 aa, Homo Sapiens
LDKCQLMFF

SEQ ID NO: 353066 - protein, 9 aa, Homo Sapiens
LRQGSRFTW

SEQ ID NO: 353067 - protein, 9 aa, Homo Sapiens
WFNNGLDLG

SEQ ID NO: 353068 - protein, 9 aa, Homo Sapiens
LTVVPHNLP

SEQ ID NO: 353069 - protein, 9 aa, Homo Sapiens
SGVFTDIEQ

SEQ ID NO: 353070 - protein, 9 aa, Homo Sapiens
EITDVDNLR

SEQ ID NO: 353071 - protein, 9 aa, Homo Sapiens
DYEIINRQL

SEQ ID NO: 353072 - protein, 9 aa, Homo Sapiens
SLLQTVMTM

SEQ ID NO: 353073 - protein, 9 aa, Homo Sapiens
RGQLNITAM

SEQ ID NO: 353074 - protein, 9 aa, Homo Sapiens
FQPPRKAAA

SEQ ID NO: 353075 - protein, 9 aa, Homo Sapiens
SFQSYEAPR

SEQ ID NO: 353076 - protein, 9 aa, Homo Sapiens
VVENLEHSP

SEQ ID NO: 353077 - protein, 9 aa, Homo Sapiens
TTTKKTTLL

SEQ ID NO: 353078 - protein, 9 aa, Homo Sapiens
HARLSEAES

SEQ ID NO: 353079 - protein, 9 aa, Homo Sapiens
VIFYQCIYG

SEQ ID NO: 353080 - protein, 9 aa, Homo Sapiens
GFSAGLWDI

SEQ ID NO: 353081 - protein, 9 aa, Homo Sapiens
LGQYHQNGC

SEQ ID NO: 353082 - protein, 9 aa, Homo Sapiens
YIQIHGRTH

SEQ ID NO: 353083 - protein, 9 aa, Homo Sapiens
QFLWSLWDT

SEQ ID NO: 353084 - protein, 9 aa, Homo Sapiens
QNLQLLPGI

SEQ ID NO: 353085 - protein, 9 aa, Homo Sapiens
FMTREEHKK

SEQ ID NO: 353086 - protein, 9 aa, Homo Sapiens
EDFLCDYTQ

SEQ ID NO: 353087 - protein, 9 aa, Homo Sapiens
ETERHSVCD

SEQ ID NO: 353088 - protein, 9 aa, Homo Sapiens
MLKNIKTRL

SEQ ID NO: 353089 - protein, 9 aa, Homo Sapiens
KEACLLYKI

SEQ ID NO: 353090 - protein, 9 aa, Homo Sapiens
MLISVSVLN

SEQ ID NO: 353091 - protein, 9 aa, Homo Sapiens
IHHIKNVYA

SEQ ID NO: 353092 - protein, 9 aa, Homo Sapiens
VKGQGVSVE

SEQ ID NO: 353093 - protein, 9 aa, Homo Sapiens
ILIDSLSKN

SEQ ID NO: 353094 - protein, 9 aa, Homo Sapiens
SSNLSRQLI

SEQ ID NO: 353095 - protein, 9 aa, Homo Sapiens
FYQQIKEPV

SEQ ID NO: 353096 - protein, 9 aa, Homo Sapiens
PPGRRYYSL

SEQ ID NO: 353097 - protein, 9 aa, Homo Sapiens
CVDIQEKNN

SEQ ID NO: 353098 - protein, 9 aa, Homo Sapiens
ASQPPVVNP

SEQ ID NO: 353099 - protein, 9 aa, Homo Sapiens
KKKTSRKQQ

SEQ ID NO: 353100 - protein, 9 aa, Homo Sapiens
MRQEHQNRV

SEQ ID NO: 353101 - protein, 9 aa, Homo Sapiens
PSSAEDTGK

SEQ ID NO: 353102 - protein, 9 aa, Homo Sapiens
KGKLLVSAT

SEQ ID NO: 353103 - protein, 9 aa, Homo Sapiens
LDGDNKYGA

SEQ ID NO: 353104 - protein, 9 aa, Homo Sapiens
VSKDASVKA

SEQ ID NO: 353105 - protein, 9 aa, Homo Sapiens
QCCTKFKSL

SEQ ID NO: 353106 - protein, 9 aa, Homo Sapiens
IYKNPDYVK

SEQ ID NO: 353107 - protein, 9 aa, Homo Sapiens
AWIKGVGWL

SEQ ID NO: 353108 - protein, 9 aa, Homo Sapiens
MKRKDELNH

SEQ ID NO: 353109 - protein, 9 aa, Homo Sapiens
LNWENIQNL

SEQ ID NO: 353110 - protein, 9 aa, Homo Sapiens
PIEDRRRAA

SEQ ID NO: 353111 - protein, 9 aa, Homo Sapiens
GAPQISLAE

SEQ ID NO: 353112 - protein, 9 aa, Homo Sapiens
YNKINQIIL

SEQ ID NO: 353113 - protein, 9 aa, Homo Sapiens
IFAENTARC

SEQ ID NO: 353114 - protein, 9 aa, Homo Sapiens
VLPYFWEFS

SEQ ID NO: 353115 - protein, 9 aa, Homo Sapiens
LKEVLNVVK

SEQ ID NO: 353116 - protein, 9 aa, Homo Sapiens
GLVHQTQSL

SEQ ID NO: 353117 - protein, 9 aa, Homo Sapiens
KKFIIANVR

SEQ ID NO: 353118 - protein, 9 aa, Homo Sapiens
PFPVLEHEA

SEQ ID NO: 353119 - protein, 9 aa, Homo Sapiens
LWWQSQDLA

SEQ ID NO: 353120 - protein, 9 aa, Homo Sapiens
CLRWLKRDS

SEQ ID NO: 353121 - protein, 9 aa, Homo Sapiens
RITWDKKGM

SEQ ID NO: 353122 - protein, 9 aa, Homo Sapiens
VWSHRTLKT

SEQ ID NO: 353123 - protein, 9 aa, Homo Sapiens
YGINQPLLS

SEQ ID NO: 353124 - protein, 9 aa, Homo Sapiens
QQKLGNAPA

SEQ ID NO: 353125 - protein, 9 aa, Homo Sapiens
CKLFLDSYF

SEQ ID NO: 353126 - protein, 9 aa, Homo Sapiens
NIDTCCHVS

SEQ ID NO: 353127 - protein, 9 aa, Homo Sapiens
VKVRVYLLN

SEQ ID NO: 353128 - protein, 9 aa, Homo Sapiens
GYGCAGFGG

SEQ ID NO: 353129 - protein, 9 aa, Homo Sapiens
SVLEKDPRP

SEQ ID NO: 353130 - protein, 9 aa, Homo Sapiens
SVKVVANIT

SEQ ID NO: 353131 - protein, 9 aa, Homo Sapiens
MCQDSLPLL

SEQ ID NO: 353132 - protein, 9 aa, Homo Sapiens
DGAISVPNL

SEQ ID NO: 353133 - protein, 9 aa, Homo Sapiens
SSLCDHERT

SEQ ID NO: 353134 - protein, 9 aa, Homo Sapiens
ITLNQLGTP

SEQ ID NO: 353135 - protein, 9 aa, Homo Sapiens
EAYFPYFTK

SEQ ID NO: 353136 - protein, 9 aa, Homo Sapiens
EKAISKKVE

SEQ ID NO: 353137 - protein, 9 aa, Homo Sapiens
VANSVALLC

SEQ ID NO: 353138 - protein, 9 aa, Homo Sapiens
YQNIKILHL

SEQ ID NO: 353139 - protein, 9 aa, Homo Sapiens
FTTVLHKQI

SEQ ID NO: 353140 - protein, 9 aa, Homo Sapiens
QVEQCLKCL

SEQ ID NO: 353141 - protein, 9 aa, Homo Sapiens
LMRKNPLAV

SEQ ID NO: 353142 - protein, 9 aa, Homo Sapiens
LIPPLETVL

SEQ ID NO: 353143 - protein, 9 aa, Homo Sapiens
ELQVQSLRT

SEQ ID NO: 353144 - protein, 9 aa, Homo Sapiens
NLTTTASES

SEQ ID NO: 353145 - protein, 9 aa, Homo Sapiens
NLEGAYMCS

SEQ ID NO: 353146 - protein, 9 aa, Homo Sapiens
NPAFWWTNR

SEQ ID NO: 353147 - protein, 9 aa, Homo Sapiens
VDDPKTLKT

SEQ ID NO: 353148 - protein, 9 aa, Homo Sapiens
VKHNQNHVV

SEQ ID NO: 353149 - protein, 9 aa, Homo Sapiens
YQRDYSLPF

SEQ ID NO: 353150 - protein, 9 aa, Homo Sapiens
CYVWDYTDH

SEQ ID NO: 353151 - protein, 9 aa, Homo Sapiens
MSHTDVCQG

SEQ ID NO: 353152 - protein, 9 aa, Homo Sapiens
MSEFQIHHD

SEQ ID NO: 353153 - protein, 9 aa, Homo Sapiens
VSTVGINFK

SEQ ID NO: 353154 - protein, 9 aa, Homo Sapiens
EVCLDLEYS

SEQ ID NO: 353155 - protein, 9 aa, Homo Sapiens
HGLPGTSWS

SEQ ID NO: 353156 - protein, 9 aa, Homo Sapiens
TTIANHWII

SEQ ID NO: 353157 - protein, 9 aa, Homo Sapiens
QEQHRQQHF

SEQ ID NO: 353158 - protein, 9 aa, Homo Sapiens
CHLRKCCQA

SEQ ID NO: 353159 - protein, 9 aa, Homo Sapiens
AKDRINHCG

SEQ ID NO: 353160 - protein, 9 aa, Homo Sapiens
EQLQKLVSF

SEQ ID NO: 353161 - protein, 9 aa, Homo Sapiens
VCMGFGFIS

SEQ ID NO: 353162 - protein, 9 aa, Homo Sapiens
QRLQSYSAG

SEQ ID NO: 353163 - protein, 9 aa, Homo Sapiens
RSYICIECR

SEQ ID NO: 353164 - protein, 9 aa, Homo Sapiens
YFSSWDDSS

SEQ ID NO: 353165 - protein, 9 aa, Homo Sapiens
SHRTLKTDA

SEQ ID NO: 353166 - protein, 9 aa, Homo Sapiens
IQQEYINDD

SEQ ID NO: 353167 - protein, 9 aa, Homo Sapiens
GENGSVLQR

SEQ ID NO: 353168 - protein, 9 aa, Homo Sapiens
SFDADKKDI

SEQ ID NO: 353169 - protein, 9 aa, Homo Sapiens
VVVITDGRH

SEQ ID NO: 353170 - protein, 9 aa, Homo Sapiens
AMQRGDAGY

SEQ ID NO: 353171 - protein, 9 aa, Homo Sapiens
YRERLSLLW

SEQ ID NO: 353172 - protein, 9 aa, Homo Sapiens
NKRTPYIMK

SEQ ID NO: 353173 - protein, 9 aa, Homo Sapiens
EQGDNGDPG

SEQ ID NO: 353174 - protein, 9 aa, Homo Sapiens
FLCMAPISL

SEQ ID NO: 353175 - protein, 9 aa, Homo Sapiens
ESECIIKVQ

SEQ ID NO: 353176 - protein, 9 aa, Homo Sapiens
ISLSTLSVI

SEQ ID NO: 353177 - protein, 9 aa, Homo Sapiens
ILMLASKSV

SEQ ID NO: 353178 - protein, 9 aa, Homo Sapiens
REQQDAYEL

SEQ ID NO: 353179 - protein, 9 aa, Homo Sapiens
YDYQEDGLV

SEQ ID NO: 353180 - protein, 9 aa, Homo Sapiens
KKFLKSKGY

SEQ ID NO: 353181 - protein, 9 aa, Homo Sapiens
SSKESAALQ

SEQ ID NO: 353182 - protein, 9 aa, Homo Sapiens
YLQQAQSQY

SEQ ID NO: 353183 - protein, 9 aa, Homo Sapiens
YQHVPVEIV

SEQ ID NO: 353184 - protein, 9 aa, Homo Sapiens
CSVPSYLKL

SEQ ID NO: 353185 - protein, 9 aa, Homo Sapiens
NKFQFERLG

SEQ ID NO: 353186 - protein, 9 aa, Homo Sapiens
YYHMKKCSV

SEQ ID NO: 353187 - protein, 9 aa, Homo Sapiens
VQPVTKTIT

SEQ ID NO: 353188 - protein, 9 aa, Homo Sapiens
KAMTSILDH

SEQ ID NO: 353189 - protein, 9 aa, Homo Sapiens
HKTAFLGPK

SEQ ID NO: 353190 - protein, 9 aa, Homo Sapiens
CINSRELLV

SEQ ID NO: 353191 - protein, 9 aa, Homo Sapiens
YIDIGTLNG

SEQ ID NO: 353192 - protein, 9 aa, Homo Sapiens
FVDFVLCDQ

SEQ ID NO: 353193 - protein, 9 aa, Homo Sapiens
RKNKMKEQE

SEQ ID NO: 353194 - protein, 9 aa, Homo Sapiens
FLDTVKEYP

SEQ ID NO: 353195 - protein, 9 aa, Homo Sapiens
NRFQKAVDD

SEQ ID NO: 353196 - protein, 9 aa, Homo Sapiens
NVVKMGRVM

SEQ ID NO: 353197 - protein, 9 aa, Homo Sapiens
EQAAERLRT

SEQ ID NO: 353198 - protein, 9 aa, Homo Sapiens
RKNLFCFGE

SEQ ID NO: 353199 - protein, 9 aa, Homo Sapiens
SHLNRHETI

SEQ ID NO: 353200 - protein, 9 aa, Homo Sapiens
LQFGGKRLM

SEQ ID NO: 353201 - protein, 9 aa, Homo Sapiens
QRVTRAAAA

SEQ ID NO: 353202 - protein, 9 aa, Homo Sapiens
YQQIKEPVS

SEQ ID NO: 353203 - protein, 9 aa, Homo Sapiens
PEPEPPRQF

SEQ ID NO: 353204 - protein, 9 aa, Homo Sapiens
LGLISIFCF

SEQ ID NO: 353205 - protein, 9 aa, Homo Sapiens
DLRTKKRIY

SEQ ID NO: 353206 - protein, 9 aa, Homo Sapiens
DAEQRGKNA

SEQ ID NO: 353207 - protein, 9 aa, Homo Sapiens
VLFLSVALL

SEQ ID NO: 353208 - protein, 9 aa, Homo Sapiens
IMLSLSQTP

SEQ ID NO: 353209 - protein, 9 aa, Homo Sapiens
SRFQKRDLH

SEQ ID NO: 353210 - protein, 9 aa, Homo Sapiens
VPSVTNNTD

SEQ ID NO: 353211 - protein, 9 aa, Homo Sapiens
TIDVNKQQR

SEQ ID NO: 353212 - protein, 9 aa, Homo Sapiens
QRSDKELEK

SEQ ID NO: 353213 - protein, 9 aa, Homo Sapiens
FFTKTEWKL

SEQ ID NO: 353214 - protein, 9 aa, Homo Sapiens
PGKKSAVVM

SEQ ID NO: 353215 - protein, 9 aa, Homo Sapiens
KIWDKARKE

SEQ ID NO: 353216 - protein, 9 aa, Homo Sapiens
PNRQTCVFF

SEQ ID NO: 353217 - protein, 9 aa, Homo Sapiens
CGGGVQIRS

SEQ ID NO: 353218 - protein, 9 aa, Homo Sapiens
PFYPASVYP

SEQ ID NO: 353219 - protein, 9 aa, Homo Sapiens
SKITTRDAV

SEQ ID NO: 353220 - protein, 9 aa, Homo Sapiens
KIIAYIPGR

SEQ ID NO: 353221 - protein, 9 aa, Homo Sapiens
LFFNHGEAT

SEQ ID NO: 353222 - protein, 9 aa, Homo Sapiens
SILQVKVLK

SEQ ID NO: 353223 - protein, 9 aa, Homo Sapiens
KGNEGSPGP

SEQ ID NO: 353224 - protein, 9 aa, Homo Sapiens
ALLADDIII

SEQ ID NO: 353225 - protein, 9 aa, Homo Sapiens
SKESKPKQS

SEQ ID NO: 353226 - protein, 9 aa, Homo Sapiens
YHLAKHPKY

SEQ ID NO: 353227 - protein, 9 aa, Homo Sapiens
QGTVEFLVE

SEQ ID NO: 353228 - protein, 9 aa, Homo Sapiens
VWEAFDLFD

SEQ ID NO: 353229 - protein, 9 aa, Homo Sapiens
MSLGIDTQL

SEQ ID NO: 353230 - protein, 9 aa, Homo Sapiens
CARFQCGEL

SEQ ID NO: 353231 - protein, 9 aa, Homo Sapiens
GSTKPIQSP

SEQ ID NO: 353232 - protein, 9 aa, Homo Sapiens
SQSINHFFC

SEQ ID NO: 353233 - protein, 9 aa, Homo Sapiens
ELLKYLEYL

SEQ ID NO: 353234 - protein, 9 aa, Homo Sapiens
VINEIFQCQ

SEQ ID NO: 353235 - protein, 9 aa, Homo Sapiens
FLACPATAT

SEQ ID NO: 353236 - protein, 9 aa, Homo Sapiens
LLWTVPIAG

SEQ ID NO: 353237 - protein, 9 aa, Homo Sapiens
KKGRRKGQQ

SEQ ID NO: 353238 - protein, 9 aa, Homo Sapiens
SIYFSGCLA

SEQ ID NO: 353239 - protein, 9 aa, Homo Sapiens
CIHCTQDGW

SEQ ID NO: 353240 - protein, 9 aa, Homo Sapiens
HNQIDLMDM

SEQ ID NO: 353241 - protein, 9 aa, Homo Sapiens
PSENSKEAD

SEQ ID NO: 353242 - protein, 9 aa, Homo Sapiens
EGADDSLDK

SEQ ID NO: 353243 - protein, 9 aa, Homo Sapiens
YFSWTGAAL

SEQ ID NO: 353244 - protein, 9 aa, Homo Sapiens
VKASNSTQT

SEQ ID NO: 353245 - protein, 9 aa, Homo Sapiens
VIALHHGRL

SEQ ID NO: 353246 - protein, 9 aa, Homo Sapiens
KSHLMLISV

SEQ ID NO: 353247 - protein, 9 aa, Homo Sapiens
IVPQQWVTG

SEQ ID NO: 353248 - protein, 9 aa, Homo Sapiens
VQPMKGDPV

SEQ ID NO: 353249 - protein, 9 aa, Homo Sapiens
GGAELKDRK

SEQ ID NO: 353250 - protein, 9 aa, Homo Sapiens
DNPCLRNAI

SEQ ID NO: 353251 - protein, 9 aa, Homo Sapiens
PRDFPKGLV

SEQ ID NO: 353252 - protein, 9 aa, Homo Sapiens
GQVYSKLKY

SEQ ID NO: 353253 - protein, 9 aa, Homo Sapiens
EHENFLLFS

SEQ ID NO: 353254 - protein, 9 aa, Homo Sapiens
EISNPKNME

SEQ ID NO: 353255 - protein, 9 aa, Homo Sapiens
RFFLRIRVV

SEQ ID NO: 353256 - protein, 9 aa, Homo Sapiens
FWCLHFVNN

SEQ ID NO: 353257 - protein, 9 aa, Homo Sapiens
VGGGESLQL

SEQ ID NO: 353258 - protein, 9 aa, Homo Sapiens
IVENNWFKW

SEQ ID NO: 353259 - protein, 9 aa, Homo Sapiens
VQLAHHLSE

SEQ ID NO: 353260 - protein, 9 aa, Homo Sapiens
PAAPSALAL

SEQ ID NO: 353261 - protein, 9 aa, Homo Sapiens
LPEVISNTK

SEQ ID NO: 353262 - protein, 9 aa, Homo Sapiens
KNIEQIHKE

SEQ ID NO: 353263 - protein, 9 aa, Homo Sapiens
IQIEFINEK

SEQ ID NO: 353264 - protein, 9 aa, Homo Sapiens
ASPRTIVLF

SEQ ID NO: 353265 - protein, 9 aa, Homo Sapiens
NSPHPTYLQ

SEQ ID NO: 353266 - protein, 9 aa, Homo Sapiens
IDRYYLRNN

SEQ ID NO: 353267 - protein, 9 aa, Homo Sapiens
GKSFCHSSS

SEQ ID NO: 353268 - protein, 9 aa, Homo Sapiens
LVVLFGDLA

SEQ ID NO: 353269 - protein, 9 aa, Homo Sapiens
DIGFGNQCG

SEQ ID NO: 353270 - protein, 9 aa, Homo Sapiens
AEETNGGTQ

SEQ ID NO: 353271 - protein, 9 aa, Homo Sapiens
AGFLNRESS

SEQ ID NO: 353272 - protein, 9 aa, Homo Sapiens
DERELSPPL

SEQ ID NO: 353273 - protein, 9 aa, Homo Sapiens
LHLQSNLIS

SEQ ID NO: 353274 - protein, 9 aa, Homo Sapiens
TKELHAKLQ

SEQ ID NO: 353275 - protein, 9 aa, Homo Sapiens
NINFKMAAE

SEQ ID NO: 353276 - protein, 9 aa, Homo Sapiens
NLQDHQLSF

SEQ ID NO: 353277 - protein, 9 aa, Homo Sapiens
VLSGQTTSI

SEQ ID NO: 353278 - protein, 9 aa, Homo Sapiens
FTNTCTTCQ

SEQ ID NO: 353279 - protein, 9 aa, Homo Sapiens
PHLSSSKEN

SEQ ID NO: 353280 - protein, 9 aa, Homo Sapiens
TKTKAINGN

SEQ ID NO: 353281 - protein, 9 aa, Homo Sapiens
AHKYCQVAP

SEQ ID NO: 353282 - protein, 9 aa, Homo Sapiens
VDILSELFQ

SEQ ID NO: 353283 - protein, 9 aa, Homo Sapiens
MKLKGAVAG

SEQ ID NO: 353284 - protein, 9 aa, Homo Sapiens
NNVIKPSIR

SEQ ID NO: 353285 - protein, 9 aa, Homo Sapiens
TEICKFVHF

SEQ ID NO: 353286 - protein, 9 aa, Homo Sapiens
ATVCAGASC

SEQ ID NO: 353287 - protein, 9 aa, Homo Sapiens
TCMADTDVQ

SEQ ID NO: 353288 - protein, 9 aa, Homo Sapiens
NTEESLCHV

SEQ ID NO: 353289 - protein, 9 aa, Homo Sapiens
KMYPIEDFE

SEQ ID NO: 353290 - protein, 9 aa, Homo Sapiens
VIRKYEFKK

SEQ ID NO: 353291 - protein, 9 aa, Homo Sapiens
LLGVCIGDK

SEQ ID NO: 353292 - protein, 9 aa, Homo Sapiens
PRTATSGPS

SEQ ID NO: 353293 - protein, 9 aa, Homo Sapiens
TQTVLLTPE

SEQ ID NO: 353294 - protein, 9 aa, Homo Sapiens
VVSLTPATF

SEQ ID NO: 353295 - protein, 9 aa, Homo Sapiens
FLPTMSPTL

SEQ ID NO: 353296 - protein, 9 aa, Homo Sapiens
NLILLFYKV

SEQ ID NO: 353297 - protein, 9 aa, Homo Sapiens
EKDWFAKWF

SEQ ID NO: 353298 - protein, 9 aa, Homo Sapiens
VEDLKAKLC

SEQ ID NO: 353299 - protein, 9 aa, Homo Sapiens
RLDRINEYV

SEQ ID NO: 353300 - protein, 9 aa, Homo Sapiens
SNNFLPHFG

SEQ ID NO: 353301 - protein, 9 aa, Homo Sapiens
EVCCVCPMC

SEQ ID NO: 353302 - protein, 9 aa, Homo Sapiens
VICGTQGAE

SEQ ID NO: 353303 - protein, 9 aa, Homo Sapiens
QISLAEMLE

SEQ ID NO: 353304 - protein, 9 aa, Homo Sapiens
AYSTVQRVT

SEQ ID NO: 353305 - protein, 9 aa, Homo Sapiens
LRPGDNTTF

SEQ ID NO: 353306 - protein, 9 aa, Homo Sapiens
TKGISRQSA

SEQ ID NO: 353307 - protein, 9 aa, Homo Sapiens
ILHQQTSDS

SEQ ID NO: 353308 - protein, 9 aa, Homo Sapiens
NIQIIVPLN

SEQ ID NO: 353309 - protein, 9 aa, Homo Sapiens
IYCQIIDQR

SEQ ID NO: 353310 - protein, 9 aa, Homo Sapiens
DFYCKKERC

SEQ ID NO: 353311 - protein, 9 aa, Homo Sapiens
RRRRSQRIL

SEQ ID NO: 353312 - protein, 9 aa, Homo Sapiens
GTDVGQTQA

SEQ ID NO: 353313 - protein, 9 aa, Homo Sapiens
ENKQITASL

SEQ ID NO: 353314 - protein, 9 aa, Homo Sapiens
KFSECLKKC

SEQ ID NO: 353315 - protein, 9 aa, Homo Sapiens
ECKCKDTWS

SEQ ID NO: 353316 - protein, 9 aa, Homo Sapiens
SERSTSLTT

SEQ ID NO: 353317 - protein, 9 aa, Homo Sapiens
KYIAQRKLK

SEQ ID NO: 353318 - protein, 9 aa, Homo Sapiens
VPDLIVSIN

SEQ ID NO: 353319 - protein, 9 aa, Homo Sapiens
NLYTQNIKV

SEQ ID NO: 353320 - protein, 9 aa, Homo Sapiens
GFSSKYPDF

SEQ ID NO: 353321 - protein, 9 aa, Homo Sapiens
SLKCNLDKE

SEQ ID NO: 353322 - protein, 9 aa, Homo Sapiens
NSKEADILE

SEQ ID NO: 353323 - protein, 9 aa, Homo Sapiens
IIQKTKQQQ

SEQ ID NO: 353324 - protein, 9 aa, Homo Sapiens
LSFYSEDVV

SEQ ID NO: 353325 - protein, 9 aa, Homo Sapiens
LLACQIRYE

SEQ ID NO: 353326 - protein, 9 aa, Homo Sapiens
CCNQLFVLD

SEQ ID NO: 353327 - protein, 9 aa, Homo Sapiens
MNHPACANE

SEQ ID NO: 353328 - protein, 9 aa, Homo Sapiens
AGYIYCQII

SEQ ID NO: 353329 - protein, 9 aa, Homo Sapiens
EAAEKEQKL

SEQ ID NO: 353330 - protein, 9 aa, Homo Sapiens
NKQVTLPAI

SEQ ID NO: 353331 - protein, 9 aa, Homo Sapiens
QEINAAQPQ

SEQ ID NO: 353332 - protein, 9 aa, Homo Sapiens
LDSNGHLPK

SEQ ID NO: 353333 - protein, 9 aa, Homo Sapiens
CLEVRPTCF

SEQ ID NO: 353334 - protein, 9 aa, Homo Sapiens
ECQFDISVN

SEQ ID NO: 353335 - protein, 9 aa, Homo Sapiens
AKAAQEFVQ

SEQ ID NO: 353336 - protein, 9 aa, Homo Sapiens
SLAKTIKNE

SEQ ID NO: 353337 - protein, 9 aa, Homo Sapiens
IRGRSPDWY

SEQ ID NO: 353338 - protein, 9 aa, Homo Sapiens
PSISTNQTA

SEQ ID NO: 353339 - protein, 9 aa, Homo Sapiens
PAGPNNTFL

SEQ ID NO: 353340 - protein, 9 aa, Homo Sapiens
KTSFFTWGN

SEQ ID NO: 353341 - protein, 9 aa, Homo Sapiens
CVQCASCNE

SEQ ID NO: 353342 - protein, 9 aa, Homo Sapiens
WTSYMRHTC

SEQ ID NO: 353343 - protein, 9 aa, Homo Sapiens
IVNGDVQNS

SEQ ID NO: 353344 - protein, 9 aa, Homo Sapiens
NRHKMTHTG

SEQ ID NO: 353345 - protein, 9 aa, Homo Sapiens
QISANSNPA

SEQ ID NO: 353346 - protein, 9 aa, Homo Sapiens
DRFDFTQLT

SEQ ID NO: 353347 - protein, 9 aa, Homo Sapiens
KYRDCYDSD

SEQ ID NO: 353348 - protein, 9 aa, Homo Sapiens
LFRYFRVPE

SEQ ID NO: 353349 - protein, 9 aa, Homo Sapiens
TEEQKDKDS

SEQ ID NO: 353350 - protein, 9 aa, Homo Sapiens
SGPGALLKT

SEQ ID NO: 353351 - protein, 9 aa, Homo Sapiens
VGTFWSNDN

SEQ ID NO: 353352 - protein, 9 aa, Homo Sapiens
SCMNVNNVI

SEQ ID NO: 353353 - protein, 9 aa, Homo Sapiens
RLIRLCFWK

SEQ ID NO: 353354 - protein, 9 aa, Homo Sapiens
VLAGGWQTL

SEQ ID NO: 353355 - protein, 9 aa, Homo Sapiens
WECTMYWYI

SEQ ID NO: 353356 - protein, 9 aa, Homo Sapiens
NNYSMVLTG

SEQ ID NO: 353357 - protein, 9 aa, Homo Sapiens
QLCTYQEGK

SEQ ID NO: 353358 - protein, 9 aa, Homo Sapiens
ILSIGGIGE

SEQ ID NO: 353359 - protein, 9 aa, Homo Sapiens
QELALRRNK

SEQ ID NO: 353360 - protein, 9 aa, Homo Sapiens
KAYEKSKEI

SEQ ID NO: 353361 - protein, 9 aa, Homo Sapiens
KIKYPDNFF

SEQ ID NO: 353362 - protein, 9 aa, Homo Sapiens
AVYHIDLVK

SEQ ID NO: 353363 - protein, 9 aa, Homo Sapiens
DFTDNPCLR

SEQ ID NO: 353364 - protein, 9 aa, Homo Sapiens
NRNVDQSLI

SEQ ID NO: 353365 - protein, 9 aa, Homo Sapiens
QSTVDRAIA

SEQ ID NO: 353366 - protein, 9 aa, Homo Sapiens
VYKKMPSIK

SEQ ID NO: 353367 - protein, 9 aa, Homo Sapiens
LTYLLQNIS

SEQ ID NO: 353368 - protein, 9 aa, Homo Sapiens
FAGELEKKA

SEQ ID NO: 353369 - protein, 9 aa, Homo Sapiens
EGTNVEEEK

SEQ ID NO: 353370 - protein, 9 aa, Homo Sapiens
YPTDKEHNS

SEQ ID NO: 353371 - protein, 9 aa, Homo Sapiens
LNTLFMVLE

SEQ ID NO: 353372 - protein, 9 aa, Homo Sapiens
GRLAGQRVE

SEQ ID NO: 353373 - protein, 9 aa, Homo Sapiens
KMTTEELNA

SEQ ID NO: 353374 - protein, 9 aa, Homo Sapiens
VFNDELPAR

SEQ ID NO: 353375 - protein, 9 aa, Homo Sapiens
DEEAIEMYE

SEQ ID NO: 353376 - protein, 9 aa, Homo Sapiens
FTGPIPLHQ

SEQ ID NO: 353377 - protein, 9 aa, Homo Sapiens
RKGGAMALN

SEQ ID NO: 353378 - protein, 9 aa, Homo Sapiens
LRERTRVVY

SEQ ID NO: 353379 - protein, 9 aa, Homo Sapiens
EKKQKELGM

SEQ ID NO: 353380 - protein, 9 aa, Homo Sapiens
LVTDTRVQT

SEQ ID NO: 353381 - protein, 9 aa, Homo Sapiens
AGINSLLNY

SEQ ID NO: 353382 - protein, 9 aa, Homo Sapiens
SIFAFVLIV

SEQ ID NO: 353383 - protein, 9 aa, Homo Sapiens
TIPHIFCNV

SEQ ID NO: 353384 - protein, 9 aa, Homo Sapiens
PLASSNGYA

SEQ ID NO: 353385 - protein, 9 aa, Homo Sapiens
KERRAGVNK

SEQ ID NO: 353386 - protein, 9 aa, Homo Sapiens
TFLNFLLFC

SEQ ID NO: 353387 - protein, 9 aa, Homo Sapiens
PRCRHARDC

SEQ ID NO: 353388 - protein, 9 aa, Homo Sapiens
SDVLVRTGL

SEQ ID NO: 353389 - protein, 9 aa, Homo Sapiens
VEDEDDDTL

SEQ ID NO: 353390 - protein, 9 aa, Homo Sapiens
VLVYFVIAY

SEQ ID NO: 353391 - protein, 9 aa, Homo Sapiens
EIASCRDRL

SEQ ID NO: 353392 - protein, 9 aa, Homo Sapiens
ATNIKTSKN

SEQ ID NO: 353393 - protein, 9 aa, Homo Sapiens
EPKKSFVKG

SEQ ID NO: 353394 - protein, 9 aa, Homo Sapiens
ICGEYQIED

SEQ ID NO: 353395 - protein, 9 aa, Homo Sapiens
GYMALHWAC

SEQ ID NO: 353396 - protein, 9 aa, Homo Sapiens
SQPPVVNPY

SEQ ID NO: 353397 - protein, 9 aa, Homo Sapiens
AEGQAQSLK

SEQ ID NO: 353398 - protein, 9 aa, Homo Sapiens
TIVLFLSVA

SEQ ID NO: 353399 - protein, 9 aa, Homo Sapiens
QQAQSQYPS

SEQ ID NO: 353400 - protein, 9 aa, Homo Sapiens
SDKRTSQSV

SEQ ID NO: 353401 - protein, 9 aa, Homo Sapiens
LDNLQKTVI

SEQ ID NO: 353402 - protein, 9 aa, Homo Sapiens
RKLKLFFSK

SEQ ID NO: 353403 - protein, 9 aa, Homo Sapiens
LTGNNVQQY

SEQ ID NO: 353404 - protein, 9 aa, Homo Sapiens
CDKTGCSKT

SEQ ID NO: 353405 - protein, 9 aa, Homo Sapiens
EAGVYVLHF

SEQ ID NO: 353406 - protein, 9 aa, Homo Sapiens
LCGFRQEES

SEQ ID NO: 353407 - protein, 9 aa, Homo Sapiens
ISKDQLCLA

SEQ ID NO: 353408 - protein, 9 aa, Homo Sapiens
YVCKFVLMR

SEQ ID NO: 353409 - protein, 9 aa, Homo Sapiens
RPGIKSSPH

SEQ ID NO: 353410 - protein, 9 aa, Homo Sapiens
SDDENIQNS

SEQ ID NO: 353411 - protein, 9 aa, Homo Sapiens
SNLMDYSHQ

SEQ ID NO: 353412 - protein, 9 aa, Homo Sapiens
LFSTNDSSA

SEQ ID NO: 353413 - protein, 9 aa, Homo Sapiens
MFREVDKID

SEQ ID NO: 353414 - protein, 9 aa, Homo Sapiens
GRRNSQTEE

SEQ ID NO: 353415 - protein, 9 aa, Homo Sapiens
SPSSNGCMH

SEQ ID NO: 353416 - protein, 9 aa, Homo Sapiens
FCSTLMTVF

SEQ ID NO: 353417 - protein, 9 aa, Homo Sapiens
SNEFCNKPQ

SEQ ID NO: 353418 - protein, 9 aa, Homo Sapiens
GAYCTFPAL

SEQ ID NO: 353419 - protein, 9 aa, Homo Sapiens
RLHAVMKKV

SEQ ID NO: 353420 - protein, 9 aa, Homo Sapiens
RPTMAKVVN

SEQ ID NO: 353421 - protein, 9 aa, Homo Sapiens
HNVLGTESR

SEQ ID NO: 353422 - protein, 9 aa, Homo Sapiens
ISTQHLQIE

SEQ ID NO: 353423 - protein, 9 aa, Homo Sapiens
EQLWVVEFG

SEQ ID NO: 353424 - protein, 9 aa, Homo Sapiens
GKFMITFPY

SEQ ID NO: 353425 - protein, 9 aa, Homo Sapiens
TFMKILGKG

SEQ ID NO: 353426 - protein, 9 aa, Homo Sapiens
ESICLICSL

SEQ ID NO: 353427 - protein, 9 aa, Homo Sapiens
CMAAIKESW

SEQ ID NO: 353428 - protein, 9 aa, Homo Sapiens
TASLFKKSW

SEQ ID NO: 353429 - protein, 9 aa, Homo Sapiens
SQIEDEEEE

SEQ ID NO: 353430 - protein, 9 aa, Homo Sapiens
QPTCGRSSC

SEQ ID NO: 353431 - protein, 9 aa, Homo Sapiens
KGLNSGGHS

SEQ ID NO: 353432 - protein, 9 aa, Homo Sapiens
FLLVLAFLD

SEQ ID NO: 353433 - protein, 9 aa, Homo Sapiens
LPFYCSPAT

SEQ ID NO: 353434 - protein, 9 aa, Homo Sapiens
VTVAGNLNV

SEQ ID NO: 353435 - protein, 9 aa, Homo Sapiens
YNRLQSLSR

SEQ ID NO: 353436 - protein, 9 aa, Homo Sapiens
KLQYPALAP

SEQ ID NO: 353437 - protein, 9 aa, Homo Sapiens
SGKHQGSLV

SEQ ID NO: 353438 - protein, 9 aa, Homo Sapiens
SEEKDMDIS

SEQ ID NO: 353439 - protein, 9 aa, Homo Sapiens
LCQNAREMT

SEQ ID NO: 353440 - protein, 9 aa, Homo Sapiens
YVAETVLAL

SEQ ID NO: 353441 - protein, 9 aa, Homo Sapiens
GQAVQKQLW

SEQ ID NO: 353442 - protein, 9 aa, Homo Sapiens
KEKSIWEIT

SEQ ID NO: 353443 - protein, 9 aa, Homo Sapiens
KTIKNETDV

SEQ ID NO: 353444 - protein, 9 aa, Homo Sapiens
EIVRSSIQI

SEQ ID NO: 353445 - protein, 9 aa, Homo Sapiens
DLGTAIKDL

SEQ ID NO: 353446 - protein, 9 aa, Homo Sapiens
DHGMKPHKA

SEQ ID NO: 353447 - protein, 9 aa, Homo Sapiens
TVRDDIDGI

SEQ ID NO: 353448 - protein, 9 aa, Homo Sapiens
DLRDLLIQI

SEQ ID NO: 353449 - protein, 9 aa, Homo Sapiens
RNKYQTEQS

SEQ ID NO: 353450 - protein, 9 aa, Homo Sapiens
YPVEVFESL

SEQ ID NO: 353451 - protein, 9 aa, Homo Sapiens
LDSPYAQVH

SEQ ID NO: 353452 - protein, 9 aa, Homo Sapiens
PACHILHVS

SEQ ID NO: 353453 - protein, 9 aa, Homo Sapiens
QVKYKRNFE

SEQ ID NO: 353454 - protein, 9 aa, Homo Sapiens
CLLPASRFQ

SEQ ID NO: 353455 - protein, 9 aa, Homo Sapiens
TDIIKLFNE

SEQ ID NO: 353456 - protein, 9 aa, Homo Sapiens
QAAIDKMTN

SEQ ID NO: 353457 - protein, 9 aa, Homo Sapiens
QLQCFMKYF

SEQ ID NO: 353458 - protein, 9 aa, Homo Sapiens
FCYNVALEY

SEQ ID NO: 353459 - protein, 9 aa, Homo Sapiens
AAQPQCPVG

SEQ ID NO: 353460 - protein, 9 aa, Homo Sapiens
LSSRGTPTQ

SEQ ID NO: 353461 - protein, 9 aa, Homo Sapiens
QNIKILHLK

SEQ ID NO: 353462 - protein, 9 aa, Homo Sapiens
VFQYGHFSL

SEQ ID NO: 353463 - protein, 9 aa, Homo Sapiens
THTVIIFPY

SEQ ID NO: 353464 - protein, 9 aa, Homo Sapiens
CDTFLNVFQ

SEQ ID NO: 353465 - protein, 9 aa, Homo Sapiens
FTLTEQTLP

SEQ ID NO: 353466 - protein, 9 aa, Homo Sapiens
SGFGSPLGR

SEQ ID NO: 353467 - protein, 9 aa, Homo Sapiens
GKLKDDDFE

SEQ ID NO: 353468 - protein, 9 aa, Homo Sapiens
CLDCAVVNH

SEQ ID NO: 353469 - protein, 9 aa, Homo Sapiens
RQLEEELQT

SEQ ID NO: 353470 - protein, 9 aa, Homo Sapiens
SHSSSFQRH

SEQ ID NO: 353471 - protein, 9 aa, Homo Sapiens
KWSCLPLAF

SEQ ID NO: 353472 - protein, 9 aa, Homo Sapiens
QVRTDIYIT

SEQ ID NO: 353473 - protein, 9 aa, Homo Sapiens
HLRQKLIQS

SEQ ID NO: 353474 - protein, 9 aa, Homo Sapiens
AKDFCQNIT

SEQ ID NO: 353475 - protein, 9 aa, Homo Sapiens
GVYVAFGAP

SEQ ID NO: 353476 - protein, 9 aa, Homo Sapiens
SKYTVVFYQ

SEQ ID NO: 353477 - protein, 9 aa, Homo Sapiens
GFWSTKSET

SEQ ID NO: 353478 - protein, 9 aa, Homo Sapiens
PFINELVIF

SEQ ID NO: 353479 - protein, 9 aa, Homo Sapiens
YQVGLMEMD

SEQ ID NO: 353480 - protein, 9 aa, Homo Sapiens
YLSQEFGMP

SEQ ID NO: 353481 - protein, 9 aa, Homo Sapiens
VVKLCNFGF

SEQ ID NO: 353482 - protein, 9 aa, Homo Sapiens
LHYMLLASE

SEQ ID NO: 353483 - protein, 9 aa, Homo Sapiens
DVKKVKKAG

SEQ ID NO: 353484 - protein, 9 aa, Homo Sapiens
IERPHNYFC

SEQ ID NO: 353485 - protein, 9 aa, Homo Sapiens
PLAGNKDNT

SEQ ID NO: 353486 - protein, 9 aa, Homo Sapiens
KINLHQHQR

SEQ ID NO: 353487 - protein, 9 aa, Homo Sapiens
FSRRSSSWC

SEQ ID NO: 353488 - protein, 9 aa, Homo Sapiens
RAKQAQRWA

SEQ ID NO: 353489 - protein, 9 aa, Homo Sapiens
GLQNGKEYL

SEQ ID NO: 353490 - protein, 9 aa, Homo Sapiens
HSVLFTGIL

SEQ ID NO: 353491 - protein, 9 aa, Homo Sapiens
LPTSVGLLQ

SEQ ID NO: 353492 - protein, 9 aa, Homo Sapiens
QAFNITIMI

SEQ ID NO: 353493 - protein, 9 aa, Homo Sapiens
EADCHGKSQ

SEQ ID NO: 353494 - protein, 9 aa, Homo Sapiens
TNDATGPDT

SEQ ID NO: 353495 - protein, 9 aa, Homo Sapiens
SLLDGRTHS

SEQ ID NO: 353496 - protein, 9 aa, Homo Sapiens
QSDMYILNE

SEQ ID NO: 353497 - protein, 9 aa, Homo Sapiens
SRLKLATLL

SEQ ID NO: 353498 - protein, 9 aa, Homo Sapiens
NQPLLSLRL

SEQ ID NO: 353499 - protein, 9 aa, Homo Sapiens
VWEDNWDND

SEQ ID NO: 353500 - protein, 9 aa, Homo Sapiens
PSKTVPTAN

SEQ ID NO: 353501 - protein, 9 aa, Homo Sapiens
DGDSQGLFN

SEQ ID NO: 353502 - protein, 9 aa, Homo Sapiens
IRDSMERGD

SEQ ID NO: 353503 - protein, 9 aa, Homo Sapiens
GSKAPVPYF

SEQ ID NO: 353504 - protein, 9 aa, Homo Sapiens
EPRPSLSGK

SEQ ID NO: 353505 - protein, 9 aa, Homo Sapiens
LKSREHSSH

SEQ ID NO: 353506 - protein, 9 aa, Homo Sapiens
LVEKFSPPS

SEQ ID NO: 353507 - protein, 9 aa, Homo Sapiens
YEAKEELKE

SEQ ID NO: 353508 - protein, 9 aa, Homo Sapiens
PMKSFLSEL

SEQ ID NO: 353509 - protein, 9 aa, Homo Sapiens
LNHFFCGIS

SEQ ID NO: 353510 - protein, 9 aa, Homo Sapiens
QLEEVDERQ

SEQ ID NO: 353511 - protein, 9 aa, Homo Sapiens
YEKYKENSV

SEQ ID NO: 353512 - protein, 9 aa, Homo Sapiens
IALHHGRLC

SEQ ID NO: 353513 - protein, 9 aa, Homo Sapiens
TKAPWGTLS

SEQ ID NO: 353514 - protein, 9 aa, Homo Sapiens
FRRTEQFCK

SEQ ID NO: 353515 - protein, 9 aa, Homo Sapiens
ILKWNELNA

SEQ ID NO: 353516 - protein, 9 aa, Homo Sapiens
ARVSLVCKE

SEQ ID NO: 353517 - protein, 9 aa, Homo Sapiens
IFFIERHPS

SEQ ID NO: 353518 - protein, 9 aa, Homo Sapiens
PCVDIQEKN

SEQ ID NO: 353519 - protein, 9 aa, Homo Sapiens
PKCIQAKIQ

SEQ ID NO: 353520 - protein, 9 aa, Homo Sapiens
LDEEKEKNE

SEQ ID NO: 353521 - protein, 9 aa, Homo Sapiens
NLVEHGPDG

SEQ ID NO: 353522 - protein, 9 aa, Homo Sapiens
QKKNRNVDQ

SEQ ID NO: 353523 - protein, 9 aa, Homo Sapiens
QRWNQLQED

SEQ ID NO: 353524 - protein, 9 aa, Homo Sapiens
ACGRVSCHT

SEQ ID NO: 353525 - protein, 9 aa, Homo Sapiens
ELVTEEKFT

SEQ ID NO: 353526 - protein, 9 aa, Homo Sapiens
ASVWENVPV

SEQ ID NO: 353527 - protein, 9 aa, Homo Sapiens
SLHRPMYFV

SEQ ID NO: 353528 - protein, 9 aa, Homo Sapiens
VDTSPPRRS

SEQ ID NO: 353529 - protein, 9 aa, Homo Sapiens
YTVVFYQMA

SEQ ID NO: 353530 - protein, 9 aa, Homo Sapiens
NQASEQNWA

SEQ ID NO: 353531 - protein, 9 aa, Homo Sapiens
FSECLKKCS

SEQ ID NO: 353532 - protein, 9 aa, Homo Sapiens
SLSTLSVIA

SEQ ID NO: 353533 - protein, 9 aa, Homo Sapiens
RKGQQAASG

SEQ ID NO: 353534 - protein, 9 aa, Homo Sapiens
DQEGRPEQR

SEQ ID NO: 353535 - protein, 9 aa, Homo Sapiens
NKLDEAVQF

SEQ ID NO: 353536 - protein, 9 aa, Homo Sapiens
NLKLDNLVY

SEQ ID NO: 353537 - protein, 9 aa, Homo Sapiens
LNPFMYTIR

SEQ ID NO: 353538 - protein, 9 aa, Homo Sapiens
LGFKMLAVG

SEQ ID NO: 353539 - protein, 9 aa, Homo Sapiens
TGRASDQSE

SEQ ID NO: 353540 - protein, 9 aa, Homo Sapiens
PDDYEIINR

SEQ ID NO: 353541 - protein, 9 aa, Homo Sapiens
ILQATKSHV

SEQ ID NO: 353542 - protein, 9 aa, Homo Sapiens
SHHLGKMYS

SEQ ID NO: 353543 - protein, 9 aa, Homo Sapiens
RGEIGSGNL

SEQ ID NO: 353544 - protein, 9 aa, Homo Sapiens
QVYSKLKYH

SEQ ID NO: 353545 - protein, 9 aa, Homo Sapiens
YKLTGNFSS

SEQ ID NO: 353546 - protein, 9 aa, Homo Sapiens
SQELLAFIL

SEQ ID NO: 353547 - protein, 9 aa, Homo Sapiens
GKTNVKGDE

SEQ ID NO: 353548 - protein, 9 aa, Homo Sapiens
EKKITALEK

SEQ ID NO: 353549 - protein, 9 aa, Homo Sapiens
YCSEILGVV

SEQ ID NO: 353550 - protein, 9 aa, Homo Sapiens
PFGDAFQSH

SEQ ID NO: 353551 - protein, 9 aa, Homo Sapiens
EKLDLNEDN

SEQ ID NO: 353552 - protein, 9 aa, Homo Sapiens
ADAPSPASS

SEQ ID NO: 353553 - protein, 9 aa, Homo Sapiens
RQAFKGLVS

SEQ ID NO: 353554 - protein, 9 aa, Homo Sapiens
KQAFNITIM

SEQ ID NO: 353555 - protein, 9 aa, Homo Sapiens
GISVPTNDL

SEQ ID NO: 353556 - protein, 9 aa, Homo Sapiens
KWIHTLTYL

SEQ ID NO: 353557 - protein, 9 aa, Homo Sapiens
QQQISDSKK

SEQ ID NO: 353558 - protein, 9 aa, Homo Sapiens
EESQRQRLL

SEQ ID NO: 353559 - protein, 9 aa, Homo Sapiens
LSLHNHLLT

SEQ ID NO: 353560 - protein, 9 aa, Homo Sapiens
SEVSVLALK

SEQ ID NO: 353561 - protein, 9 aa, Homo Sapiens
LIYQIIRGL

SEQ ID NO: 353562 - protein, 9 aa, Homo Sapiens
EVPKVGCSN

SEQ ID NO: 353563 - protein, 9 aa, Homo Sapiens
EVYLQKEAG

SEQ ID NO: 353564 - protein, 9 aa, Homo Sapiens
FLYEEFPGD

SEQ ID NO: 353565 - protein, 9 aa, Homo Sapiens
VIQHQRADS

SEQ ID NO: 353566 - protein, 9 aa, Homo Sapiens
RLYFDNTCV

SEQ ID NO: 353567 - protein, 9 aa, Homo Sapiens
EKQNTAYLS

SEQ ID NO: 353568 - protein, 9 aa, Homo Sapiens
IVGVNLFAG

SEQ ID NO: 353569 - protein, 9 aa, Homo Sapiens
RLYKHTNSQ

SEQ ID NO: 353570 - protein, 9 aa, Homo Sapiens
IKVLTADIV

SEQ ID NO: 353571 - protein, 9 aa, Homo Sapiens
ALQPIVHNL

SEQ ID NO: 353572 - protein, 9 aa, Homo Sapiens
PVSEPLVEK

SEQ ID NO: 353573 - protein, 9 aa, Homo Sapiens
KRNKFHFNI

SEQ ID NO: 353574 - protein, 9 aa, Homo Sapiens
SRIKTLQAD

SEQ ID NO: 353575 - protein, 9 aa, Homo Sapiens
VSQIICSVK

SEQ ID NO: 353576 - protein, 9 aa, Homo Sapiens
TSDQIRFTV

SEQ ID NO: 353577 - protein, 9 aa, Homo Sapiens
TNYREITDV

SEQ ID NO: 353578 - protein, 9 aa, Homo Sapiens
LDKQYKHQL

SEQ ID NO: 353579 - protein, 9 aa, Homo Sapiens
VRNSTECRS

SEQ ID NO: 353580 - protein, 9 aa, Homo Sapiens
TIHKIINTG

SEQ ID NO: 353581 - protein, 9 aa, Homo Sapiens
SLYEVVHRI

SEQ ID NO: 353582 - protein, 9 aa, Homo Sapiens
ARTKLEPES

SEQ ID NO: 353583 - protein, 9 aa, Homo Sapiens
PQATTVSLC

SEQ ID NO: 353584 - protein, 9 aa, Homo Sapiens
KMNKMSFVE

SEQ ID NO: 353585 - protein, 9 aa, Homo Sapiens
TQHTGVLTI

SEQ ID NO: 353586 - protein, 9 aa, Homo Sapiens
NVSMKAPPD

SEQ ID NO: 353587 - protein, 9 aa, Homo Sapiens
QLAQGISQL

SEQ ID NO: 353588 - protein, 9 aa, Homo Sapiens
NFVFEDFVS

SEQ ID NO: 353589 - protein, 9 aa, Homo Sapiens
LEEARNIFR

SEQ ID NO: 353590 - protein, 9 aa, Homo Sapiens
HTAFIRIQT

SEQ ID NO: 353591 - protein, 9 aa, Homo Sapiens
YFNSSSVNK

SEQ ID NO: 353592 - protein, 9 aa, Homo Sapiens
YTTEPVPDQ

SEQ ID NO: 353593 - protein, 9 aa, Homo Sapiens
VSTRWQKQR

SEQ ID NO: 353594 - protein, 9 aa, Homo Sapiens
DELITKWQK

SEQ ID NO: 353595 - protein, 9 aa, Homo Sapiens
QRKVRMNYY

SEQ ID NO: 353596 - protein, 9 aa, Homo Sapiens
VQEERCLRK

SEQ ID NO: 353597 - protein, 9 aa, Homo Sapiens
HLQSNLISK

SEQ ID NO: 353598 - protein, 9 aa, Homo Sapiens
QTAQNSQLD

SEQ ID NO: 353599 - protein, 9 aa, Homo Sapiens
LVIQLGCFT

SEQ ID NO: 353600 - protein, 9 aa, Homo Sapiens
DLTNEATTD

SEQ ID NO: 353601 - protein, 9 aa, Homo Sapiens
VGGKIIESP

SEQ ID NO: 353602 - protein, 9 aa, Homo Sapiens
WPLGCLLYE

SEQ ID NO: 353603 - protein, 9 aa, Homo Sapiens
VDSIINKWL

SEQ ID NO: 353604 - protein, 9 aa, Homo Sapiens
YLAMVIEGL

SEQ ID NO: 353605 - protein, 9 aa, Homo Sapiens
GASQSCILE

SEQ ID NO: 353606 - protein, 9 aa, Homo Sapiens
SNLIQHQII

SEQ ID NO: 353607 - protein, 9 aa, Homo Sapiens
KAKEQHFLE

SEQ ID NO: 353608 - protein, 9 aa, Homo Sapiens
SIFFIERHP

SEQ ID NO: 353609 - protein, 9 aa, Homo Sapiens
ASLGFKLTS

SEQ ID NO: 353610 - protein, 9 aa, Homo Sapiens
SHNGTDPYK

SEQ ID NO: 353611 - protein, 9 aa, Homo Sapiens
KEKHHVNMK

SEQ ID NO: 353612 - protein, 9 aa, Homo Sapiens
NLDYSVGQS

SEQ ID NO: 353613 - protein, 9 aa, Homo Sapiens
GTLFLAIGL

SEQ ID NO: 353614 - protein, 9 aa, Homo Sapiens
GWGGGTPDA

SEQ ID NO: 353615 - protein, 9 aa, Homo Sapiens
QFTCIPYRV

SEQ ID NO: 353616 - protein, 9 aa, Homo Sapiens
DAHLLMTNC

SEQ ID NO: 353617 - protein, 9 aa, Homo Sapiens
IKNKRALRR

SEQ ID NO: 353618 - protein, 9 aa, Homo Sapiens
DGTNTFFWQ

SEQ ID NO: 353619 - protein, 9 aa, Homo Sapiens
TLEQIKFYE

SEQ ID NO: 353620 - protein, 9 aa, Homo Sapiens
HIQFEEVIQ

SEQ ID NO: 353621 - protein, 9 aa, Homo Sapiens
GHFWSQHTT

SEQ ID NO: 353622 - protein, 9 aa, Homo Sapiens
SIIRINFCL

SEQ ID NO: 353623 - protein, 9 aa, Homo Sapiens
GLFSFLTYR

SEQ ID NO: 353624 - protein, 9 aa, Homo Sapiens
LANNPIGDT

SEQ ID NO: 353625 - protein, 9 aa, Homo Sapiens
VQTACMSAC

SEQ ID NO: 353626 - protein, 9 aa, Homo Sapiens
LKKHFYVVT

SEQ ID NO: 353627 - protein, 9 aa, Homo Sapiens
DKEMEGTSS

SEQ ID NO: 353628 - protein, 9 aa, Homo Sapiens
SCLVASELL

SEQ ID NO: 353629 - protein, 9 aa, Homo Sapiens
DKKSSCFIE

SEQ ID NO: 353630 - protein, 9 aa, Homo Sapiens
SPLGRLSAG

SEQ ID NO: 353631 - protein, 9 aa, Homo Sapiens
SVIHYILYL

SEQ ID NO: 353632 - protein, 9 aa, Homo Sapiens
TVGIQKIIG

SEQ ID NO: 353633 - protein, 9 aa, Homo Sapiens
MDTEEQKDK

SEQ ID NO: 353634 - protein, 9 aa, Homo Sapiens
DKYPEMVSC

SEQ ID NO: 353635 - protein, 9 aa, Homo Sapiens
IIIFTNTCT

SEQ ID NO: 353636 - protein, 9 aa, Homo Sapiens
YNIGIIEDN

SEQ ID NO: 353637 - protein, 9 aa, Homo Sapiens
VYITLLNKL

SEQ ID NO: 353638 - protein, 9 aa, Homo Sapiens
MLMEGLKQQ

SEQ ID NO: 353639 - protein, 9 aa, Homo Sapiens
VRPGPLQLL

SEQ ID NO: 353640 - protein, 9 aa, Homo Sapiens
DCVLVSPRN

SEQ ID NO: 353641 - protein, 9 aa, Homo Sapiens
ISICINSRE

SEQ ID NO: 353642 - protein, 9 aa, Homo Sapiens
DADKWVKAR

SEQ ID NO: 353643 - protein, 9 aa, Homo Sapiens
KAIKLAEQK

SEQ ID NO: 353644 - protein, 9 aa, Homo Sapiens
KHSLKVAAI

SEQ ID NO: 353645 - protein, 9 aa, Homo Sapiens
NIRKFIILI

SEQ ID NO: 353646 - protein, 9 aa, Homo Sapiens
SWLTCLLQH

SEQ ID NO: 353647 - protein, 9 aa, Homo Sapiens
PPTDIMAEL

SEQ ID NO: 353648 - protein, 9 aa, Homo Sapiens
RMLTKDLQN

SEQ ID NO: 353649 - protein, 9 aa, Homo Sapiens
RYTDPSSLQ

SEQ ID NO: 353650 - protein, 9 aa, Homo Sapiens
SDERVPCPV

SEQ ID NO: 353651 - protein, 9 aa, Homo Sapiens
SYWDCIHCT

SEQ ID NO: 353652 - protein, 9 aa, Homo Sapiens
CNIKKGVSW

SEQ ID NO: 353653 - protein, 9 aa, Homo Sapiens
YAYGLKTAN

SEQ ID NO: 353654 - protein, 9 aa, Homo Sapiens
YISFMFVHP

SEQ ID NO: 353655 - protein, 9 aa, Homo Sapiens
YTINNVSPH

SEQ ID NO: 353656 - protein, 9 aa, Homo Sapiens
NNNPDLLPN

SEQ ID NO: 353657 - protein, 9 aa, Homo Sapiens
LSECIRGTV

SEQ ID NO: 353658 - protein, 9 aa, Homo Sapiens
NTELQPVKT

SEQ ID NO: 353659 - protein, 9 aa, Homo Sapiens
NLTVSNTQT

SEQ ID NO: 353660 - protein, 9 aa, Homo Sapiens
SFFPPVEKP

SEQ ID NO: 353661 - protein, 9 aa, Homo Sapiens
KILHTKEKP

SEQ ID NO: 353662 - protein, 9 aa, Homo Sapiens
IASRQEAVI

SEQ ID NO: 353663 - protein, 9 aa, Homo Sapiens
RNKKEEYLT

SEQ ID NO: 353664 - protein, 9 aa, Homo Sapiens
GGCPCKGTL

SEQ ID NO: 353665 - protein, 9 aa, Homo Sapiens
MGVLSGKIK

SEQ ID NO: 353666 - protein, 9 aa, Homo Sapiens
SVTDLLNCF

SEQ ID NO: 353667 - protein, 9 aa, Homo Sapiens
QCKQIYQSS

SEQ ID NO: 353668 - protein, 9 aa, Homo Sapiens
KDEKETLLK

SEQ ID NO: 353669 - protein, 9 aa, Homo Sapiens
FQLELIKTK

SEQ ID NO: 353670 - protein, 9 aa, Homo Sapiens
QIQNSIVNK

SEQ ID NO: 353671 - protein, 9 aa, Homo Sapiens
QLAGLQVFV

SEQ ID NO: 353672 - protein, 9 aa, Homo Sapiens
DLIQHFNIH

SEQ ID NO: 353673 - protein, 9 aa, Homo Sapiens
DVLLQNQVA

SEQ ID NO: 353674 - protein, 9 aa, Homo Sapiens
QILISGSRR

SEQ ID NO: 353675 - protein, 9 aa, Homo Sapiens
DPRERDMQM

SEQ ID NO: 353676 - protein, 9 aa, Homo Sapiens
TQLPKNGGW

SEQ ID NO: 353677 - protein, 9 aa, Homo Sapiens
GCKSTPKIT

SEQ ID NO: 353678 - protein, 9 aa, Homo Sapiens
SPCKVTADK

SEQ ID NO: 353679 - protein, 9 aa, Homo Sapiens
LQDSGHNRT

SEQ ID NO: 353680 - protein, 9 aa, Homo Sapiens
GIQFSKGKY

SEQ ID NO: 353681 - protein, 9 aa, Homo Sapiens
KEFWNPSIY

SEQ ID NO: 353682 - protein, 9 aa, Homo Sapiens
EAGEHEKHK

SEQ ID NO: 353683 - protein, 9 aa, Homo Sapiens
AILVTDTRV

SEQ ID NO: 353684 - protein, 9 aa, Homo Sapiens
QFISHQQIH

SEQ ID NO: 353685 - protein, 9 aa, Homo Sapiens
LLPSGSKGE

SEQ ID NO: 353686 - protein, 9 aa, Homo Sapiens
TDPSSLQKH

SEQ ID NO: 353687 - protein, 9 aa, Homo Sapiens
EAWENHLKQ

SEQ ID NO: 353688 - protein, 9 aa, Homo Sapiens
PSDLHSRNN

SEQ ID NO: 353689 - protein, 9 aa, Homo Sapiens
TEDVSTGEP

SEQ ID NO: 353690 - protein, 9 aa, Homo Sapiens
HMNSLMDED

SEQ ID NO: 353691 - protein, 9 aa, Homo Sapiens
LVACCIVLF

SEQ ID NO: 353692 - protein, 9 aa, Homo Sapiens
VIADAFVHH

SEQ ID NO: 353693 - protein, 9 aa, Homo Sapiens
QTLVTELSM

SEQ ID NO: 353694 - protein, 9 aa, Homo Sapiens
TFDLSGMDS

SEQ ID NO: 353695 - protein, 9 aa, Homo Sapiens
KKKMKLCGT

SEQ ID NO: 353696 - protein, 9 aa, Homo Sapiens
EPEKALHIG

SEQ ID NO: 353697 - protein, 9 aa, Homo Sapiens
YRDRLQINR

SEQ ID NO: 353698 - protein, 9 aa, Homo Sapiens
PFEPSNKLY

SEQ ID NO: 353699 - protein, 9 aa, Homo Sapiens
DCNGFDSHF

SEQ ID NO: 353700 - protein, 9 aa, Homo Sapiens
CDYTQINVG

SEQ ID NO: 353701 - protein, 9 aa, Homo Sapiens
AGQRVEQEV

SEQ ID NO: 353702 - protein, 9 aa, Homo Sapiens
QKKTKNNLK

SEQ ID NO: 353703 - protein, 9 aa, Homo Sapiens
FIGSFIDHV

SEQ ID NO: 353704 - protein, 9 aa, Homo Sapiens
KIDEIRRVR

SEQ ID NO: 353705 - protein, 9 aa, Homo Sapiens
DDFRNKYQT

SEQ ID NO: 353706 - protein, 9 aa, Homo Sapiens
VRFCLKGME

SEQ ID NO: 353707 - protein, 9 aa, Homo Sapiens
WLLQKKAQE

SEQ ID NO: 353708 - protein, 9 aa, Homo Sapiens
AELATNNSK

SEQ ID NO: 353709 - protein, 9 aa, Homo Sapiens
YGNTLSVKV

SEQ ID NO: 353710 - protein, 9 aa, Homo Sapiens
VGFNKGLDR

SEQ ID NO: 353711 - protein, 9 aa, Homo Sapiens
ILKVASLQV

SEQ ID NO: 353712 - protein, 9 aa, Homo Sapiens
HLHSEALKY

SEQ ID NO: 353713 - protein, 9 aa, Homo Sapiens
NRHYHLNCG

SEQ ID NO: 353714 - protein, 9 aa, Homo Sapiens
PEPLDLHLS

SEQ ID NO: 353715 - protein, 9 aa, Homo Sapiens
PPSGSPKEN

SEQ ID NO: 353716 - protein, 9 aa, Homo Sapiens
GGWERYTKV

SEQ ID NO: 353717 - protein, 9 aa, Homo Sapiens
SNDVVDFFH

SEQ ID NO: 353718 - protein, 9 aa, Homo Sapiens
ACKNQVCNL

SEQ ID NO: 353719 - protein, 9 aa, Homo Sapiens
CNPPWAESS

SEQ ID NO: 353720 - protein, 9 aa, Homo Sapiens
REKRAAKQQ

SEQ ID NO: 353721 - protein, 9 aa, Homo Sapiens
ARKEKNKVK

SEQ ID NO: 353722 - protein, 9 aa, Homo Sapiens
LIMSFSGGQ

SEQ ID NO: 353723 - protein, 9 aa, Homo Sapiens
KTLFSVGGW

SEQ ID NO: 353724 - protein, 9 aa, Homo Sapiens
VICCPVCSQ

SEQ ID NO: 353725 - protein, 9 aa, Homo Sapiens
DEEAFADTE

SEQ ID NO: 353726 - protein, 9 aa, Homo Sapiens
IEDNWQLSQ

SEQ ID NO: 353727 - protein, 9 aa, Homo Sapiens
LCLPGMLQQ

SEQ ID NO: 353728 - protein, 9 aa, Homo Sapiens
DYQNRYRSD

SEQ ID NO: 353729 - protein, 9 aa, Homo Sapiens
ECQKDWCCQ

SEQ ID NO: 353730 - protein, 9 aa, Homo Sapiens
ATCLLLASK

SEQ ID NO: 353731 - protein, 9 aa, Homo Sapiens
IILWKLMKN

SEQ ID NO: 353732 - protein, 9 aa, Homo Sapiens
GIHNCLPNF

SEQ ID NO: 353733 - protein, 9 aa, Homo Sapiens
QATHSGIAA

SEQ ID NO: 353734 - protein, 9 aa, Homo Sapiens
CTNQNAISS

SEQ ID NO: 353735 - protein, 9 aa, Homo Sapiens
PFNRNLKTQ

SEQ ID NO: 353736 - protein, 9 aa, Homo Sapiens
SASPRTIVL

SEQ ID NO: 353737 - protein, 9 aa, Homo Sapiens
YQVLAPNAL

SEQ ID NO: 353738 - protein, 9 aa, Homo Sapiens
GVVCLFLAC

SEQ ID NO: 353739 - protein, 9 aa, Homo Sapiens
SIKQRLHSG

SEQ ID NO: 353740 - protein, 9 aa, Homo Sapiens
TMEFAHYIE

SEQ ID NO: 353741 - protein, 9 aa, Homo Sapiens
YKHNFAITF

SEQ ID NO: 353742 - protein, 9 aa, Homo Sapiens
DLKSTREAW

SEQ ID NO: 353743 - protein, 9 aa, Homo Sapiens
LLKYLEYLL

SEQ ID NO: 353744 - protein, 9 aa, Homo Sapiens
RISVKWMAI

SEQ ID NO: 353745 - protein, 9 aa, Homo Sapiens
NLLKNIKLF

SEQ ID NO: 353746 - protein, 9 aa, Homo Sapiens
CTQDLSLMT

SEQ ID NO: 353747 - protein, 9 aa, Homo Sapiens
LAGQRVEQE

SEQ ID NO: 353748 - protein, 9 aa, Homo Sapiens
GAAFHIFQA

SEQ ID NO: 353749 - protein, 9 aa, Homo Sapiens
EDCLNCLLM

SEQ ID NO: 353750 - protein, 9 aa, Homo Sapiens
INNWLNAAI

SEQ ID NO: 353751 - protein, 9 aa, Homo Sapiens
HICLECEKT

SEQ ID NO: 353752 - protein, 9 aa, Homo Sapiens
YQLGPPKHC

SEQ ID NO: 353753 - protein, 9 aa, Homo Sapiens
DKALTVSSA

SEQ ID NO: 353754 - protein, 9 aa, Homo Sapiens
KRKISEEDK

SEQ ID NO: 353755 - protein, 9 aa, Homo Sapiens
IHEIIHTGE

SEQ ID NO: 353756 - protein, 9 aa, Homo Sapiens
GLCLTTFLF

SEQ ID NO: 353757 - protein, 9 aa, Homo Sapiens
FFRICPIFV

SEQ ID NO: 353758 - protein, 9 aa, Homo Sapiens
RTIVLFLSV

SEQ ID NO: 353759 - protein, 9 aa, Homo Sapiens
DVQELNQIL

SEQ ID NO: 353760 - protein, 9 aa, Homo Sapiens
FFRPRCLHT

SEQ ID NO: 353761 - protein, 9 aa, Homo Sapiens
ERYFKDFHS

SEQ ID NO: 353762 - protein, 9 aa, Homo Sapiens
LKNSNMFDL

SEQ ID NO: 353763 - protein, 9 aa, Homo Sapiens
EFLEKEATE

SEQ ID NO: 353764 - protein, 9 aa, Homo Sapiens
ENADSDIIS

SEQ ID NO: 353765 - protein, 9 aa, Homo Sapiens
KLAVEYNIF

SEQ ID NO: 353766 - protein, 9 aa, Homo Sapiens
IKHSLKVAA

SEQ ID NO: 353767 - protein, 9 aa, Homo Sapiens
WKQFRALWS

SEQ ID NO: 353768 - protein, 9 aa, Homo Sapiens
KLVKLKYRK

SEQ ID NO: 353769 - protein, 9 aa, Homo Sapiens
WLKRDSYLP

SEQ ID NO: 353770 - protein, 9 aa, Homo Sapiens
AAKQELEQQ

SEQ ID NO: 353771 - protein, 9 aa, Homo Sapiens
PHKKYKLTG

SEQ ID NO: 353772 - protein, 9 aa, Homo Sapiens
DTLDQLLQN

SEQ ID NO: 353773 - protein, 9 aa, Homo Sapiens
EALAKGNVT

SEQ ID NO: 353774 - protein, 9 aa, Homo Sapiens
YLLNESNCA

SEQ ID NO: 353775 - protein, 9 aa, Homo Sapiens
KICQAFYFA

SEQ ID NO: 353776 - protein, 9 aa, Homo Sapiens
GDNIKLKLS

SEQ ID NO: 353777 - protein, 9 aa, Homo Sapiens
KKDSDRLHV

SEQ ID NO: 353778 - protein, 9 aa, Homo Sapiens
VTESVYAAL

SEQ ID NO: 353779 - protein, 9 aa, Homo Sapiens
RFQCGELII

SEQ ID NO: 353780 - protein, 9 aa, Homo Sapiens
IEGLEDDIV

SEQ ID NO: 353781 - protein, 9 aa, Homo Sapiens
RPRCLHTAV

SEQ ID NO: 353782 - protein, 9 aa, Homo Sapiens
MGLQPGNIY

SEQ ID NO: 353783 - protein, 9 aa, Homo Sapiens
ETIIQKTKQ

SEQ ID NO: 353784 - protein, 9 aa, Homo Sapiens
GCQNNNSTA

SEQ ID NO: 353785 - protein, 9 aa, Homo Sapiens
SLQDSGHNR

SEQ ID NO: 353786 - protein, 9 aa, Homo Sapiens
VGTIVGIYR

SEQ ID NO: 353787 - protein, 9 aa, Homo Sapiens
NRPSSIQKL

SEQ ID NO: 353788 - protein, 9 aa, Homo Sapiens
LTLWCDYYG

SEQ ID NO: 353789 - protein, 9 aa, Homo Sapiens
RKISEEDKL

SEQ ID NO: 353790 - protein, 9 aa, Homo Sapiens
NSGGHSDSA

SEQ ID NO: 353791 - protein, 9 aa, Homo Sapiens
MANTFLASH

SEQ ID NO: 353792 - protein, 9 aa, Homo Sapiens
DPEPELYLN

SEQ ID NO: 353793 - protein, 9 aa, Homo Sapiens
ELYAIMKMC

SEQ ID NO: 353794 - protein, 9 aa, Homo Sapiens
FKVVPGTDQ

SEQ ID NO: 353795 - protein, 9 aa, Homo Sapiens
FFPPVEKPD

SEQ ID NO: 353796 - protein, 9 aa, Homo Sapiens
NLCPEVILA

SEQ ID NO: 353797 - protein, 9 aa, Homo Sapiens
TVQKQSESS

SEQ ID NO: 353798 - protein, 9 aa, Homo Sapiens
THDKMNEIS

SEQ ID NO: 353799 - protein, 9 aa, Homo Sapiens
AAREKDVES

SEQ ID NO: 353800 - protein, 9 aa, Homo Sapiens
WEGRDRVVN

SEQ ID NO: 353801 - protein, 9 aa, Homo Sapiens
EKFHLVAHQ

SEQ ID NO: 353802 - protein, 9 aa, Homo Sapiens
SLKALCETK

SEQ ID NO: 353803 - protein, 9 aa, Homo Sapiens
HYTAFSVGR

SEQ ID NO: 353804 - protein, 9 aa, Homo Sapiens
FEIFFGRQM

SEQ ID NO: 353805 - protein, 9 aa, Homo Sapiens
NKINMQQTV

SEQ ID NO: 353806 - protein, 9 aa, Homo Sapiens
FKTAKSFAL

SEQ ID NO: 353807 - protein, 9 aa, Homo Sapiens
TKECSHVLV

SEQ ID NO: 353808 - protein, 9 aa, Homo Sapiens
NFKVKTVFK

SEQ ID NO: 353809 - protein, 9 aa, Homo Sapiens
SVPDLIVSI

SEQ ID NO: 353810 - protein, 9 aa, Homo Sapiens
EGASNPCLN

SEQ ID NO: 353811 - protein, 9 aa, Homo Sapiens
TLDEEAFAD

SEQ ID NO: 353812 - protein, 9 aa, Homo Sapiens
KKPPRAPRA

SEQ ID NO: 353813 - protein, 9 aa, Homo Sapiens
LPLIIFHAG

SEQ ID NO: 353814 - protein, 9 aa, Homo Sapiens
QFRSAESVC

SEQ ID NO: 353815 - protein, 9 aa, Homo Sapiens
ESRLKLATL

SEQ ID NO: 353816 - protein, 9 aa, Homo Sapiens
GHSDSAKSV

SEQ ID NO: 353817 - protein, 9 aa, Homo Sapiens
EHQQIHTGE

SEQ ID NO: 353818 - protein, 9 aa, Homo Sapiens
FLGLALMSQ

SEQ ID NO: 353819 - protein, 9 aa, Homo Sapiens
DSPLLCKTS

SEQ ID NO: 353820 - protein, 9 aa, Homo Sapiens
IFEDGNTVK

SEQ ID NO: 353821 - protein, 9 aa, Homo Sapiens
CTILVPVII

SEQ ID NO: 353822 - protein, 9 aa, Homo Sapiens
KFREFFPNH

SEQ ID NO: 353823 - protein, 9 aa, Homo Sapiens
LQVSPSLDK

SEQ ID NO: 353824 - protein, 9 aa, Homo Sapiens
RNKEVTRTF

SEQ ID NO: 353825 - protein, 9 aa, Homo Sapiens
KYKIASYSK

SEQ ID NO: 353826 - protein, 9 aa, Homo Sapiens
PNTSEGLPD

SEQ ID NO: 353827 - protein, 9 aa, Homo Sapiens
KSKSPSWYK

SEQ ID NO: 353828 - protein, 9 aa, Homo Sapiens
ILAVCHPDR

SEQ ID NO: 353829 - protein, 9 aa, Homo Sapiens
NPNQEKYSS

SEQ ID NO: 353830 - protein, 9 aa, Homo Sapiens
KLLFFRICP

SEQ ID NO: 353831 - protein, 9 aa, Homo Sapiens
TLAVLRISS

SEQ ID NO: 353832 - protein, 9 aa, Homo Sapiens
ISGNTSQRG

SEQ ID NO: 353833 - protein, 9 aa, Homo Sapiens
PSALFLHLH

SEQ ID NO: 353834 - protein, 9 aa, Homo Sapiens
KVRQTLAFS

SEQ ID NO: 353835 - protein, 9 aa, Homo Sapiens
IPNIFQNIQ

SEQ ID NO: 353836 - protein, 9 aa, Homo Sapiens
KCVSVAQQL

SEQ ID NO: 353837 - protein, 9 aa, Homo Sapiens
HREGFSYRT

SEQ ID NO: 353838 - protein, 9 aa, Homo Sapiens
INKPLNAFM

SEQ ID NO: 353839 - protein, 9 aa, Homo Sapiens
VEKESKQLK

SEQ ID NO: 353840 - protein, 9 aa, Homo Sapiens
QLPKQFLPT

SEQ ID NO: 353841 - protein, 9 aa, Homo Sapiens
AVKKTSGGG

SEQ ID NO: 353842 - protein, 9 aa, Homo Sapiens
LECQNLQLL

SEQ ID NO: 353843 - protein, 9 aa, Homo Sapiens
FWDLEADSN

SEQ ID NO: 353844 - protein, 9 aa, Homo Sapiens
EPGASMDDN

SEQ ID NO: 353845 - protein, 9 aa, Homo Sapiens
TNIKTSKNN

SEQ ID NO: 353846 - protein, 9 aa, Homo Sapiens
NCQTNINEG

SEQ ID NO: 353847 - protein, 9 aa, Homo Sapiens
NSSLERTFR

SEQ ID NO: 353848 - protein, 9 aa, Homo Sapiens
IECDNKGDG

SEQ ID NO: 353849 - protein, 9 aa, Homo Sapiens
VVYQIYAKR

SEQ ID NO: 353850 - protein, 9 aa, Homo Sapiens
SIWLARKIC

SEQ ID NO: 353851 - protein, 9 aa, Homo Sapiens
FGSSCFKYQ

SEQ ID NO: 353852 - protein, 9 aa, Homo Sapiens
TATSGPSSK

SEQ ID NO: 353853 - protein, 9 aa, Homo Sapiens
PNIFQNIQE

SEQ ID NO: 353854 - protein, 9 aa, Homo Sapiens
RLFRTNTWK

SEQ ID NO: 353855 - protein, 9 aa, Homo Sapiens
CGRGHKQQN

SEQ ID NO: 353856 - protein, 9 aa, Homo Sapiens
RFDFTQLTD

SEQ ID NO: 353857 - protein, 9 aa, Homo Sapiens
KDINNNPPV

SEQ ID NO: 353858 - protein, 9 aa, Homo Sapiens
SSLCKHEKN

SEQ ID NO: 353859 - protein, 9 aa, Homo Sapiens
SFIFAENTA

SEQ ID NO: 353860 - protein, 9 aa, Homo Sapiens
NGMNRQINI

SEQ ID NO: 353861 - protein, 9 aa, Homo Sapiens
AQPQCPVGL

SEQ ID NO: 353862 - protein, 9 aa, Homo Sapiens
TEDPTLNYG

SEQ ID NO: 353863 - protein, 9 aa, Homo Sapiens
ERTISKKKL

SEQ ID NO: 353864 - protein, 9 aa, Homo Sapiens
VPDLRRFID

SEQ ID NO: 353865 - protein, 9 aa, Homo Sapiens
INSDIWSYG

SEQ ID NO: 353866 - protein, 9 aa, Homo Sapiens
QSSALNRHK

SEQ ID NO: 353867 - protein, 9 aa, Homo Sapiens
TACRLRATH

SEQ ID NO: 353868 - protein, 9 aa, Homo Sapiens
QFSVQMFRF

SEQ ID NO: 353869 - protein, 9 aa, Homo Sapiens
SANTSQGKL

SEQ ID NO: 353870 - protein, 9 aa, Homo Sapiens
LQGSSVLQV

SEQ ID NO: 353871 - protein, 9 aa, Homo Sapiens
VAQYHFYLS

SEQ ID NO: 353872 - protein, 9 aa, Homo Sapiens
ETIEIINLA

SEQ ID NO: 353873 - protein, 9 aa, Homo Sapiens
HLTQERNIL

SEQ ID NO: 353874 - protein, 9 aa, Homo Sapiens
KVWFLEQQN

SEQ ID NO: 353875 - protein, 9 aa, Homo Sapiens
KQVLMGPYH

SEQ ID NO: 353876 - protein, 9 aa, Homo Sapiens
GMIEAFTKK

SEQ ID NO: 353877 - protein, 9 aa, Homo Sapiens
ESVCSLLSA

SEQ ID NO: 353878 - protein, 9 aa, Homo Sapiens
PVYEKYCAN

SEQ ID NO: 353879 - protein, 9 aa, Homo Sapiens
VEFLVELHK

SEQ ID NO: 353880 - protein, 9 aa, Homo Sapiens
LSHILEQIT

SEQ ID NO: 353881 - protein, 9 aa, Homo Sapiens
ILCLISFLL

SEQ ID NO: 353882 - protein, 9 aa, Homo Sapiens
NWSFVMDEE

SEQ ID NO: 353883 - protein, 9 aa, Homo Sapiens
ALCETKCSR

SEQ ID NO: 353884 - protein, 9 aa, Homo Sapiens
CNDIINWLD

SEQ ID NO: 353885 - protein, 9 aa, Homo Sapiens
INKWLSKSS

SEQ ID NO: 353886 - protein, 9 aa, Homo Sapiens
FAFHKDSYL

SEQ ID NO: 353887 - protein, 9 aa, Homo Sapiens
LLSANSKNK

SEQ ID NO: 353888 - protein, 9 aa, Homo Sapiens
PGHSKCSSV

SEQ ID NO: 353889 - protein, 9 aa, Homo Sapiens
SVCRCNRNF

SEQ ID NO: 353890 - protein, 9 aa, Homo Sapiens
NQFISHQQI

SEQ ID NO: 353891 - protein, 9 aa, Homo Sapiens
VYLPLLWGQ

SEQ ID NO: 353892 - protein, 9 aa, Homo Sapiens
VYLLNDDLK

SEQ ID NO: 353893 - protein, 9 aa, Homo Sapiens
IMNPRICGF

SEQ ID NO: 353894 - protein, 9 aa, Homo Sapiens
LCLMWCIGD

SEQ ID NO: 353895 - protein, 9 aa, Homo Sapiens
YEHSRRGCS

SEQ ID NO: 353896 - protein, 9 aa, Homo Sapiens
IQSQSKPYD

SEQ ID NO: 353897 - protein, 9 aa, Homo Sapiens
EEPNRMPSR

SEQ ID NO: 353898 - protein, 9 aa, Homo Sapiens
PMHDEIFYT

SEQ ID NO: 353899 - protein, 9 aa, Homo Sapiens
ISRQSANVK

SEQ ID NO: 353900 - protein, 9 aa, Homo Sapiens
KWYWKVEVA

SEQ ID NO: 353901 - protein, 9 aa, Homo Sapiens
SSPSQSTQL

SEQ ID NO: 353902 - protein, 9 aa, Homo Sapiens
PALICCEQC

SEQ ID NO: 353903 - protein, 9 aa, Homo Sapiens
LTKIHLSPG

SEQ ID NO: 353904 - protein, 9 aa, Homo Sapiens
FTALHLAVS

SEQ ID NO: 353905 - protein, 9 aa, Homo Sapiens
ACVHLCVCT

SEQ ID NO: 353906 - protein, 9 aa, Homo Sapiens
SLQLLSETT

SEQ ID NO: 353907 - protein, 9 aa, Homo Sapiens
VRMEQQHQD

SEQ ID NO: 353908 - protein, 9 aa, Homo Sapiens
LQLGVNKAQ

SEQ ID NO: 353909 - protein, 9 aa, Homo Sapiens
VKIKLKIQF

SEQ ID NO: 353910 - protein, 9 aa, Homo Sapiens
LIKLNRRIC

SEQ ID NO: 353911 - protein, 9 aa, Homo Sapiens
FFLYTDLFL

SEQ ID NO: 353912 - protein, 9 aa, Homo Sapiens
EQCTQKAAK

SEQ ID NO: 353913 - protein, 9 aa, Homo Sapiens
PTDALALSV

SEQ ID NO: 353914 - protein, 9 aa, Homo Sapiens
SLKYFSSSK

SEQ ID NO: 353915 - protein, 9 aa, Homo Sapiens
HNGTDPYKP

SEQ ID NO: 353916 - protein, 9 aa, Homo Sapiens
VNSLGEIYD

SEQ ID NO: 353917 - protein, 9 aa, Homo Sapiens
ASFLVAQVQ

SEQ ID NO: 353918 - protein, 9 aa, Homo Sapiens
GIHAELLPI

SEQ ID NO: 353919 - protein, 9 aa, Homo Sapiens
TAWITELMQ

SEQ ID NO: 353920 - protein, 9 aa, Homo Sapiens
IEGEDSISF

SEQ ID NO: 353921 - protein, 9 aa, Homo Sapiens
QLVACQRSS

SEQ ID NO: 353922 - protein, 9 aa, Homo Sapiens
KLPQLILVN

SEQ ID NO: 353923 - protein, 9 aa, Homo Sapiens
IFPLVTTKG

SEQ ID NO: 353924 - protein, 9 aa, Homo Sapiens
AWGVGLASV

SEQ ID NO: 353925 - protein, 9 aa, Homo Sapiens
WNQGNVFPI

SEQ ID NO: 353926 - protein, 9 aa, Homo Sapiens
TRNEILVWE

SEQ ID NO: 353927 - protein, 9 aa, Homo Sapiens
LQNATQRIQ

SEQ ID NO: 353928 - protein, 9 aa, Homo Sapiens
ADNPCVSGT

SEQ ID NO: 353929 - protein, 9 aa, Homo Sapiens
PQSINTDTL

SEQ ID NO: 353930 - protein, 9 aa, Homo Sapiens
RNSWLPPLS

SEQ ID NO: 353931 - protein, 9 aa, Homo Sapiens
TKCDVTGGK

SEQ ID NO: 353932 - protein, 9 aa, Homo Sapiens
RPCCCLRPA

SEQ ID NO: 353933 - protein, 9 aa, Homo Sapiens
FGPDLITVT

SEQ ID NO: 353934 - protein, 9 aa, Homo Sapiens
IAHLNLQDH

SEQ ID NO: 353935 - protein, 9 aa, Homo Sapiens
HIHIMPSLN

SEQ ID NO: 353936 - protein, 9 aa, Homo Sapiens
GTHCSQNAY

SEQ ID NO: 353937 - protein, 9 aa, Homo Sapiens
CKHEKNHSG

SEQ ID NO: 353938 - protein, 9 aa, Homo Sapiens
VSDQKEELE

SEQ ID NO: 353939 - protein, 9 aa, Homo Sapiens
VRDVCFNTA

SEQ ID NO: 353940 - protein, 9 aa, Homo Sapiens
APRSMQGTI

SEQ ID NO: 353941 - protein, 9 aa, Homo Sapiens
RDKIMALRN

SEQ ID NO: 353942 - protein, 9 aa, Homo Sapiens
SNVSFYIVT

SEQ ID NO: 353943 - protein, 9 aa, Homo Sapiens
LINDAYKIT

SEQ ID NO: 353944 - protein, 9 aa, Homo Sapiens
ARRCFKRTK

SEQ ID NO: 353945 - protein, 9 aa, Homo Sapiens
CHVSITEKT

SEQ ID NO: 353946 - protein, 9 aa, Homo Sapiens
EIKECAAIF

SEQ ID NO: 353947 - protein, 9 aa, Homo Sapiens
GNTLHKGWS

SEQ ID NO: 353948 - protein, 9 aa, Homo Sapiens
TFNLHLLEN

SEQ ID NO: 353949 - protein, 9 aa, Homo Sapiens
AVRLGNCKP

SEQ ID NO: 353950 - protein, 9 aa, Homo Sapiens
LSPDGLACY

SEQ ID NO: 353951 - protein, 9 aa, Homo Sapiens
KALHIGISF

SEQ ID NO: 353952 - protein, 9 aa, Homo Sapiens
LEEERIWKE

SEQ ID NO: 353953 - protein, 9 aa, Homo Sapiens
IQNPNAQQT

SEQ ID NO: 353954 - protein, 9 aa, Homo Sapiens
CLCGAACGV

SEQ ID NO: 353955 - protein, 9 aa, Homo Sapiens
VHNLIGAQL

SEQ ID NO: 353956 - protein, 9 aa, Homo Sapiens
CHMFHVAWV

SEQ ID NO: 353957 - protein, 9 aa, Homo Sapiens
YRQMDSEDV

SEQ ID NO: 353958 - protein, 9 aa, Homo Sapiens
KLPFPIIDG

SEQ ID NO: 353959 - protein, 9 aa, Homo Sapiens
LWCDYYGCN

SEQ ID NO: 353960 - protein, 9 aa, Homo Sapiens
SANADLIIH

SEQ ID NO: 353961 - protein, 9 aa, Homo Sapiens
HQHTHTGEK

SEQ ID NO: 353962 - protein, 9 aa, Homo Sapiens
APISLFAIS

SEQ ID NO: 353963 - protein, 9 aa, Homo Sapiens
HSLKVAAIS

SEQ ID NO: 353964 - protein, 9 aa, Homo Sapiens
CGEYQIEDK

SEQ ID NO: 353965 - protein, 9 aa, Homo Sapiens
VAQAREKCF

SEQ ID NO: 353966 - protein, 9 aa, Homo Sapiens
KFNTDELNF

SEQ ID NO: 353967 - protein, 9 aa, Homo Sapiens
GLDNEIKHE

SEQ ID NO: 353968 - protein, 9 aa, Homo Sapiens
LKPAEGNTT

SEQ ID NO: 353969 - protein, 9 aa, Homo Sapiens
KSPVPIAPT

SEQ ID NO: 353970 - protein, 9 aa, Homo Sapiens
RGKREAMLD

SEQ ID NO: 353971 - protein, 9 aa, Homo Sapiens
RIQLYQKPE

SEQ ID NO: 353972 - protein, 9 aa, Homo Sapiens
QDEEINQTE

SEQ ID NO: 353973 - protein, 9 aa, Homo Sapiens
EGLEDDIVV

SEQ ID NO: 353974 - protein, 9 aa, Homo Sapiens
AFRGAMDLK

SEQ ID NO: 353975 - protein, 9 aa, Homo Sapiens
GGHSDSAKS

SEQ ID NO: 353976 - protein, 9 aa, Homo Sapiens
LLSSVICCL

SEQ ID NO: 353977 - protein, 9 aa, Homo Sapiens
GEDVKGDDN

SEQ ID NO: 353978 - protein, 9 aa, Homo Sapiens
NLLELEHIE

SEQ ID NO: 353979 - protein, 9 aa, Homo Sapiens
TKTIRQKIV

SEQ ID NO: 353980 - protein, 9 aa, Homo Sapiens
TATFVKWSP

SEQ ID NO: 353981 - protein, 9 aa, Homo Sapiens
VFLEHQTQV

SEQ ID NO: 353982 - protein, 9 aa, Homo Sapiens
PYPQTRWYK

SEQ ID NO: 353983 - protein, 9 aa, Homo Sapiens
SATESSFIL

SEQ ID NO: 353984 - protein, 9 aa, Homo Sapiens
EAALGSLIQ

SEQ ID NO: 353985 - protein, 9 aa, Homo Sapiens
AAAKESEEN

SEQ ID NO: 353986 - protein, 9 aa, Homo Sapiens
GESLQLLAS

SEQ ID NO: 353987 - protein, 9 aa, Homo Sapiens
PCCARFQCG

SEQ ID NO: 353988 - protein, 9 aa, Homo Sapiens
DVSVFFTKT

SEQ ID NO: 353989 - protein, 9 aa, Homo Sapiens
NITAMQRGD

SEQ ID NO: 353990 - protein, 9 aa, Homo Sapiens
DYQEDGLVL

SEQ ID NO: 353991 - protein, 9 aa, Homo Sapiens
GHRVLINNK

SEQ ID NO: 353992 - protein, 9 aa, Homo Sapiens
LCRQAGIWV

SEQ ID NO: 353993 - protein, 9 aa, Homo Sapiens
CLGSWSLTE

SEQ ID NO: 353994 - protein, 9 aa, Homo Sapiens
KLGETFYSD

SEQ ID NO: 353995 - protein, 9 aa, Homo Sapiens
GCVLLPEGA

SEQ ID NO: 353996 - protein, 9 aa, Homo Sapiens
TQNAAWRKR

SEQ ID NO: 353997 - protein, 9 aa, Homo Sapiens
KVVANITAN

SEQ ID NO: 353998 - protein, 9 aa, Homo Sapiens
QIEFINEKG

SEQ ID NO: 353999 - protein, 9 aa, Homo Sapiens
IIQNLKINS

SEQ ID NO: 354000 - protein, 9 aa, Homo Sapiens
KIIERAGYS

SEQ ID NO: 354001 - protein, 9 aa, Homo Sapiens
LAVITQSFC

SEQ ID NO: 354002 - protein, 9 aa, Homo Sapiens
ATGRGKPPL

SEQ ID NO: 354003 - protein, 9 aa, Homo Sapiens
LLMFALSTF

SEQ ID NO: 354004 - protein, 9 aa, Homo Sapiens
TRKEIFKTL

SEQ ID NO: 354005 - protein, 9 aa, Homo Sapiens
KIQFLIYPA

SEQ ID NO: 354006 - protein, 9 aa, Homo Sapiens
HSGTRIQQA

SEQ ID NO: 354007 - protein, 9 aa, Homo Sapiens
GLQPINTHQ

SEQ ID NO: 354008 - protein, 9 aa, Homo Sapiens
SLCLPEINN

SEQ ID NO: 354009 - protein, 9 aa, Homo Sapiens
LIEMYTTQV

SEQ ID NO: 354010 - protein, 9 aa, Homo Sapiens
LTQKAKVGK

SEQ ID NO: 354011 - protein, 9 aa, Homo Sapiens
KPVYPVMAK

SEQ ID NO: 354012 - protein, 9 aa, Homo Sapiens
YVIGDLKIM

SEQ ID NO: 354013 - protein, 9 aa, Homo Sapiens
TPGHNYSNH

SEQ ID NO: 354014 - protein, 9 aa, Homo Sapiens
VAGYPPDTP

SEQ ID NO: 354015 - protein, 9 aa, Homo Sapiens
DNFLAAQAS

SEQ ID NO: 354016 - protein, 9 aa, Homo Sapiens
FTDIIKLFN

SEQ ID NO: 354017 - protein, 9 aa, Homo Sapiens
VTLSVNVTM

SEQ ID NO: 354018 - protein, 9 aa, Homo Sapiens
PGGINVTTT

SEQ ID NO: 354019 - protein, 9 aa, Homo Sapiens
SVRIYDWRM

SEQ ID NO: 354020 - protein, 9 aa, Homo Sapiens
MKKICQVIR

SEQ ID NO: 354021 - protein, 9 aa, Homo Sapiens
VRSSIQITG

SEQ ID NO: 354022 - protein, 9 aa, Homo Sapiens
CIGDFRPNH

SEQ ID NO: 354023 - protein, 9 aa, Homo Sapiens
FVFAGLVDT

SEQ ID NO: 354024 - protein, 9 aa, Homo Sapiens
KALKKICVK

SEQ ID NO: 354025 - protein, 9 aa, Homo Sapiens
AGHGSTYCW

SEQ ID NO: 354026 - protein, 9 aa, Homo Sapiens
INVYIHDNA

SEQ ID NO: 354027 - protein, 9 aa, Homo Sapiens
LDYDSNMLS

SEQ ID NO: 354028 - protein, 9 aa, Homo Sapiens
SNGRGGNQA

SEQ ID NO: 354029 - protein, 9 aa, Homo Sapiens
DEEIPIKSK

SEQ ID NO: 354030 - protein, 9 aa, Homo Sapiens
NNNLINKCN

SEQ ID NO: 354031 - protein, 9 aa, Homo Sapiens
FANNETKRN

SEQ ID NO: 354032 - protein, 9 aa, Homo Sapiens
NHPLLTRFF

SEQ ID NO: 354033 - protein, 9 aa, Homo Sapiens
EKYSSSNEK

SEQ ID NO: 354034 - protein, 9 aa, Homo Sapiens
AGGTKAPWG

SEQ ID NO: 354035 - protein, 9 aa, Homo Sapiens
THFVSSLSD

SEQ ID NO: 354036 - protein, 9 aa, Homo Sapiens
SSLSDKSVK

SEQ ID NO: 354037 - protein, 9 aa, Homo Sapiens
HRSPHRESL

SEQ ID NO: 354038 - protein, 8 aa, Homo Sapiens
DSKESLTP

SEQ ID NO: 354039 - protein, 9 aa, Homo Sapiens
PYPQEVSTT

SEQ ID NO: 354040 - protein, 9 aa, Homo Sapiens
QDKLFQWLG

SEQ ID NO: 354041 - protein, 9 aa, Homo Sapiens
LLNHTTRWL

SEQ ID NO: 354042 - protein, 9 aa, Homo Sapiens
GLNVVKMGR

SEQ ID NO: 354043 - protein, 9 aa, Homo Sapiens
FSLLVMALD

SEQ ID NO: 354044 - protein, 9 aa, Homo Sapiens
DVVDFFHKY

SEQ ID NO: 354045 - protein, 9 aa, Homo Sapiens
KTEDHGTPA

SEQ ID NO: 354046 - protein, 9 aa, Homo Sapiens
QKIVDDPKT

SEQ ID NO: 354047 - protein, 9 aa, Homo Sapiens
ARILCGIVS

SEQ ID NO: 354048 - protein, 9 aa, Homo Sapiens
LLERLDLQN

SEQ ID NO: 354049 - protein, 9 aa, Homo Sapiens
FDSLHFSTE

SEQ ID NO: 354050 - protein, 9 aa, Homo Sapiens
QRVDNIKVL

SEQ ID NO: 354051 - protein, 9 aa, Homo Sapiens
AGIWVIMIT

SEQ ID NO: 354052 - protein, 9 aa, Homo Sapiens
WSNLSSLQP

SEQ ID NO: 354053 - protein, 9 aa, Homo Sapiens
MLSLSQTPA

SEQ ID NO: 354054 - protein, 9 aa, Homo Sapiens
GQRANTIKN

SEQ ID NO: 354055 - protein, 9 aa, Homo Sapiens
RAHLIQHHK

SEQ ID NO: 354056 - protein, 9 aa, Homo Sapiens
HLLDNTDVA

SEQ ID NO: 354057 - protein, 9 aa, Homo Sapiens
QQDGGGGPG

SEQ ID NO: 354058 - protein, 9 aa, Homo Sapiens
IHMISHTGE

SEQ ID NO: 354059 - protein, 9 aa, Homo Sapiens
RHKSHEAEV

SEQ ID NO: 354060 - protein, 9 aa, Homo Sapiens
VTSMFKLSG

SEQ ID NO: 354061 - protein, 9 aa, Homo Sapiens
KPYGRVECG

SEQ ID NO: 354062 - protein, 9 aa, Homo Sapiens
EPHMLFDHI

SEQ ID NO: 354063 - protein, 9 aa, Homo Sapiens
LQRVIDRWK

SEQ ID NO: 354064 - protein, 9 aa, Homo Sapiens
YLNLAENSS

SEQ ID NO: 354065 - protein, 9 aa, Homo Sapiens
APLPWHIQI

SEQ ID NO: 354066 - protein, 9 aa, Homo Sapiens
ENSLDHSET

SEQ ID NO: 354067 - protein, 9 aa, Homo Sapiens
GAGDVGKSA

SEQ ID NO: 354068 - protein, 9 aa, Homo Sapiens
KFNLMYDGT

SEQ ID NO: 354069 - protein, 9 aa, Homo Sapiens
LNRALYFTC

SEQ ID NO: 354070 - protein, 9 aa, Homo Sapiens
YLIHEITHT

SEQ ID NO: 354071 - protein, 9 aa, Homo Sapiens
RTPEQCCTK

SEQ ID NO: 354072 - protein, 9 aa, Homo Sapiens
LNKHSLERY

SEQ ID NO: 354073 - protein, 9 aa, Homo Sapiens
WSISSCDTF

SEQ ID NO: 354074 - protein, 9 aa, Homo Sapiens
EALGVKNKL

SEQ ID NO: 354075 - protein, 9 aa, Homo Sapiens
FVRKNNSPA

SEQ ID NO: 354076 - protein, 9 aa, Homo Sapiens
NKIREQNQY

SEQ ID NO: 354077 - protein, 9 aa, Homo Sapiens
EEAAVLQGS

SEQ ID NO: 354078 - protein, 9 aa, Homo Sapiens
QAAERLRTL

SEQ ID NO: 354079 - protein, 9 aa, Homo Sapiens
QKHGKNVPK

SEQ ID NO: 354080 - protein, 9 aa, Homo Sapiens
FIKADYYEL

SEQ ID NO: 354081 - protein, 9 aa, Homo Sapiens
KDSFNNSPA

SEQ ID NO: 354082 - protein, 9 aa, Homo Sapiens
HYASVTVNT

SEQ ID NO: 354083 - protein, 9 aa, Homo Sapiens
EGCYFHVLL

SEQ ID NO: 354084 - protein, 9 aa, Homo Sapiens
GGDESGGEN

SEQ ID NO: 354085 - protein, 9 aa, Homo Sapiens
RHTKMKTTT

SEQ ID NO: 354086 - protein, 9 aa, Homo Sapiens
KLQFAYIDN

SEQ ID NO: 354087 - protein, 9 aa, Homo Sapiens
RAQYTLRVQ

SEQ ID NO: 354088 - protein, 9 aa, Homo Sapiens
VSINHQMWL

SEQ ID NO: 354089 - protein, 9 aa, Homo Sapiens
ILETFQLDS

SEQ ID NO: 354090 - protein, 9 aa, Homo Sapiens
VTDHGMKPH

SEQ ID NO: 354091 - protein, 9 aa, Homo Sapiens
KRFPQAFFC

SEQ ID NO: 354092 - protein, 9 aa, Homo Sapiens
AITVTALLW

SEQ ID NO: 354093 - protein, 9 aa, Homo Sapiens
VLEGMSLGI

SEQ ID NO: 354094 - protein, 9 aa, Homo Sapiens
PDLGCPAPR

SEQ ID NO: 354095 - protein, 9 aa, Homo Sapiens
EKILETFQL

SEQ ID NO: 354096 - protein, 9 aa, Homo Sapiens
KDRKASAFL

SEQ ID NO: 354097 - protein, 9 aa, Homo Sapiens
NIEQIHKEA

SEQ ID NO: 354098 - protein, 9 aa, Homo Sapiens
VLAQLDDNV

SEQ ID NO: 354099 - protein, 9 aa, Homo Sapiens
THRNVYKNH

SEQ ID NO: 354100 - protein, 9 aa, Homo Sapiens
EGTSTFANL

SEQ ID NO: 354101 - protein, 9 aa, Homo Sapiens
VHQDTLHTM

SEQ ID NO: 354102 - protein, 9 aa, Homo Sapiens
KLFRHSSVL

SEQ ID NO: 354103 - protein, 9 aa, Homo Sapiens
GALENKRAA

SEQ ID NO: 354104 - protein, 9 aa, Homo Sapiens
AADGEIGSQ

SEQ ID NO: 354105 - protein, 9 aa, Homo Sapiens
IDEKRLAPR

SEQ ID NO: 354106 - protein, 9 aa, Homo Sapiens
TVKESQNDI

SEQ ID NO: 354107 - protein, 9 aa, Homo Sapiens
TMETEEEPP

SEQ ID NO: 354108 - protein, 9 aa, Homo Sapiens
PTAALDLQE

SEQ ID NO: 354109 - protein, 9 aa, Homo Sapiens
LVAGKRAEP

SEQ ID NO: 354110 - protein, 9 aa, Homo Sapiens
ARMYVAETV

SEQ ID NO: 354111 - protein, 9 aa, Homo Sapiens
SRRKQCYWP

SEQ ID NO: 354112 - protein, 9 aa, Homo Sapiens
LEQCSIKAK

SEQ ID NO: 354113 - protein, 9 aa, Homo Sapiens
KPMHDEIFY

SEQ ID NO: 354114 - protein, 9 aa, Homo Sapiens
PMYLFLTNL

SEQ ID NO: 354115 - protein, 9 aa, Homo Sapiens
FEEVIQEKL

SEQ ID NO: 354116 - protein, 9 aa, Homo Sapiens
PHKVCASGK

SEQ ID NO: 354117 - protein, 9 aa, Homo Sapiens
TLGSHLMSL

SEQ ID NO: 354118 - protein, 9 aa, Homo Sapiens
QKEFVRFLL

SEQ ID NO: 354119 - protein, 9 aa, Homo Sapiens
LPQSINTDT

SEQ ID NO: 354120 - protein, 9 aa, Homo Sapiens
LTQLPKNGG

SEQ ID NO: 354121 - protein, 9 aa, Homo Sapiens
TLVQAEASL

SEQ ID NO: 354122 - protein, 9 aa, Homo Sapiens
DIETNGGAD

SEQ ID NO: 354123 - protein, 9 aa, Homo Sapiens
DARSDQTGE

SEQ ID NO: 354124 - protein, 9 aa, Homo Sapiens
SCTNQNAIS

SEQ ID NO: 354125 - protein, 9 aa, Homo Sapiens
CKKHMLSCF

SEQ ID NO: 354126 - protein, 9 aa, Homo Sapiens
LSRDECKII

SEQ ID NO: 354127 - protein, 9 aa, Homo Sapiens
TNGCQLFIT

SEQ ID NO: 354128 - protein, 9 aa, Homo Sapiens
VAEGEHKSG

SEQ ID NO: 354129 - protein, 9 aa, Homo Sapiens
KMPSIKSDV

SEQ ID NO: 354130 - protein, 9 aa, Homo Sapiens
DRAHRIRQQ

SEQ ID NO: 354131 - protein, 9 aa, Homo Sapiens
HKLAVEYNI

SEQ ID NO: 354132 - protein, 9 aa, Homo Sapiens
SKYGNTLSV

SEQ ID NO: 354133 - protein, 9 aa, Homo Sapiens
THVISVAKV

SEQ ID NO: 354134 - protein, 9 aa, Homo Sapiens
AIAPSITSS

SEQ ID NO: 354135 - protein, 9 aa, Homo Sapiens
YSKITMEPN

SEQ ID NO: 354136 - protein, 9 aa, Homo Sapiens
PSQSTQLDN

SEQ ID NO: 354137 - protein, 9 aa, Homo Sapiens
CHNEPAQEN

SEQ ID NO: 354138 - protein, 9 aa, Homo Sapiens
QTLFGLHLS

SEQ ID NO: 354139 - protein, 9 aa, Homo Sapiens
GLRNAGATQ

SEQ ID NO: 354140 - protein, 9 aa, Homo Sapiens
VSPENNKEG

SEQ ID NO: 354141 - protein, 9 aa, Homo Sapiens
LGIQSQSKP

SEQ ID NO: 354142 - protein, 9 aa, Homo Sapiens
YNETYDYGG

SEQ ID NO: 354143 - protein, 9 aa, Homo Sapiens
PEICKYKKR

SEQ ID NO: 354144 - protein, 9 aa, Homo Sapiens
DQHCRLTGS

SEQ ID NO: 354145 - protein, 9 aa, Homo Sapiens
DDTYYYRQR

SEQ ID NO: 354146 - protein, 9 aa, Homo Sapiens
VEEAAVLQG

SEQ ID NO: 354147 - protein, 9 aa, Homo Sapiens
CLPGMLQQR

SEQ ID NO: 354148 - protein, 9 aa, Homo Sapiens
YDTPKRALK

SEQ ID NO: 354149 - protein, 9 aa, Homo Sapiens
KSRAEAKQM

SEQ ID NO: 354150 - protein, 9 aa, Homo Sapiens
VRKSIARVF

SEQ ID NO: 354151 - protein, 9 aa, Homo Sapiens
ASKQGLAKA

SEQ ID NO: 354152 - protein, 9 aa, Homo Sapiens
RVLINNKQV

SEQ ID NO: 354153 - protein, 9 aa, Homo Sapiens
PDEYKYCLR

SEQ ID NO: 354154 - protein, 9 aa, Homo Sapiens
KSEKLKYLF

SEQ ID NO: 354155 - protein, 9 aa, Homo Sapiens
LLDSNKKLA

SEQ ID NO: 354156 - protein, 9 aa, Homo Sapiens
GEHEKHKKS

SEQ ID NO: 354157 - protein, 9 aa, Homo Sapiens
KPHKAFPVL

SEQ ID NO: 354158 - protein, 9 aa, Homo Sapiens
KSNEETDST

SEQ ID NO: 354159 - protein, 9 aa, Homo Sapiens
YSQAEMKIF

SEQ ID NO: 354160 - protein, 9 aa, Homo Sapiens
TNSTVTKIN

SEQ ID NO: 354161 - protein, 9 aa, Homo Sapiens
LILQQSQAY

SEQ ID NO: 354162 - protein, 9 aa, Homo Sapiens
QRSNYALTI

SEQ ID NO: 354163 - protein, 9 aa, Homo Sapiens
DEISRFQKR

SEQ ID NO: 354164 - protein, 9 aa, Homo Sapiens
TRWLTQAAG

SEQ ID NO: 354165 - protein, 9 aa, Homo Sapiens
SKLGMPGVS

SEQ ID NO: 354166 - protein, 9 aa, Homo Sapiens
LNQILFSAL

SEQ ID NO: 354167 - protein, 9 aa, Homo Sapiens
NMVLRSKAC

SEQ ID NO: 354168 - protein, 9 aa, Homo Sapiens
LLMLLYVIL

SEQ ID NO: 354169 - protein, 9 aa, Homo Sapiens
TVLKPHKVC

SEQ ID NO: 354170 - protein, 9 aa, Homo Sapiens
HQKLCFFQE

SEQ ID NO: 354171 - protein, 9 aa, Homo Sapiens
TDGSFNCVC

SEQ ID NO: 354172 - protein, 9 aa, Homo Sapiens
KSVTKNWTS

SEQ ID NO: 354173 - protein, 9 aa, Homo Sapiens
KHLFGLQIR

SEQ ID NO: 354174 - protein, 9 aa, Homo Sapiens
KLNKYENGE

SEQ ID NO: 354175 - protein, 9 aa, Homo Sapiens
TQLPKYLYA

SEQ ID NO: 354176 - protein, 9 aa, Homo Sapiens
DQAKGPLRV

SEQ ID NO: 354177 - protein, 9 aa, Homo Sapiens
TSYHSTAER

SEQ ID NO: 354178 - protein, 9 aa, Homo Sapiens
FILSIGGIG

SEQ ID NO: 354179 - protein, 9 aa, Homo Sapiens
YLLPYTKFF

SEQ ID NO: 354180 - protein, 9 aa, Homo Sapiens
DLSDGDAKL

SEQ ID NO: 354181 - protein, 9 aa, Homo Sapiens
EERAREINC

SEQ ID NO: 354182 - protein, 9 aa, Homo Sapiens
ELRGKSAFS

SEQ ID NO: 354183 - protein, 9 aa, Homo Sapiens
SLQYHKNLL

SEQ ID NO: 354184 - protein, 9 aa, Homo Sapiens
GYHFTTDSW

SEQ ID NO: 354185 - protein, 9 aa, Homo Sapiens
TNKHFSDSN

SEQ ID NO: 354186 - protein, 9 aa, Homo Sapiens
KPFYTLQEV

SEQ ID NO: 354187 - protein, 9 aa, Homo Sapiens
SIVPVILMG

SEQ ID NO: 354188 - protein, 9 aa, Homo Sapiens
TTPLKKQRF

SEQ ID NO: 354189 - protein, 9 aa, Homo Sapiens
ETMEVLQQS

SEQ ID NO: 354190 - protein, 9 aa, Homo Sapiens
SDPGVSYCT

SEQ ID NO: 354191 - protein, 9 aa, Homo Sapiens
EGDADKWVK

SEQ ID NO: 354192 - protein, 9 aa, Homo Sapiens
EDDANRKTF

SEQ ID NO: 354193 - protein, 9 aa, Homo Sapiens
SPFKREELL

SEQ ID NO: 354194 - protein, 9 aa, Homo Sapiens
LCFTTSTAP

SEQ ID NO: 354195 - protein, 9 aa, Homo Sapiens
NYSNTSKLF

SEQ ID NO: 354196 - protein, 9 aa, Homo Sapiens
RQRAHLIQH

SEQ ID NO: 354197 - protein, 9 aa, Homo Sapiens
LGFSNYSEL

SEQ ID NO: 354198 - protein, 9 aa, Homo Sapiens
LIEYGNKSG

SEQ ID NO: 354199 - protein, 9 aa, Homo Sapiens
NLKEEAQLI

SEQ ID NO: 354200 - protein, 9 aa, Homo Sapiens
TLTRHKIIN

SEQ ID NO: 354201 - protein, 9 aa, Homo Sapiens
LSGKHQGSL

SEQ ID NO: 354202 - protein, 9 aa, Homo Sapiens
KKDKETIYY

SEQ ID NO: 354203 - protein, 9 aa, Homo Sapiens
QFTHANKPK

SEQ ID NO: 354204 - protein, 9 aa, Homo Sapiens
AQAPTDINS

SEQ ID NO: 354205 - protein, 9 aa, Homo Sapiens
FMAAEIVTN

SEQ ID NO: 354206 - protein, 9 aa, Homo Sapiens
VWWDSNFLG

SEQ ID NO: 354207 - protein, 9 aa, Homo Sapiens
KLCGKGFTH

SEQ ID NO: 354208 - protein, 9 aa, Homo Sapiens
VVRATCSGF

SEQ ID NO: 354209 - protein, 9 aa, Homo Sapiens
AAWNETLLD

SEQ ID NO: 354210 - protein, 9 aa, Homo Sapiens
AMDLKNLQL

SEQ ID NO: 354211 - protein, 9 aa, Homo Sapiens
PEKSPLSLE

SEQ ID NO: 354212 - protein, 9 aa, Homo Sapiens
PPPTQGLEN

SEQ ID NO: 354213 - protein, 9 aa, Homo Sapiens
LVLMWLKRG

SEQ ID NO: 354214 - protein, 9 aa, Homo Sapiens
SKCGNSFRG

SEQ ID NO: 354215 - protein, 9 aa, Homo Sapiens
QEVWEAFDL

SEQ ID NO: 354216 - protein, 9 aa, Homo Sapiens
PSGSYWDCI

SEQ ID NO: 354217 - protein, 9 aa, Homo Sapiens
EELKNMKRK

SEQ ID NO: 354218 - protein, 9 aa, Homo Sapiens
PDLSIAQQN

SEQ ID NO: 354219 - protein, 9 aa, Homo Sapiens
LAHLAGLLL

SEQ ID NO: 354220 - protein, 9 aa, Homo Sapiens
FVQRLELGD

SEQ ID NO: 354221 - protein, 9 aa, Homo Sapiens
EYNFEIKNV

SEQ ID NO: 354222 - protein, 9 aa, Homo Sapiens
HHLYDIHVT

SEQ ID NO: 354223 - protein, 9 aa, Homo Sapiens
FSYFFYKRL

SEQ ID NO: 354224 - protein, 9 aa, Homo Sapiens
ITHFFCNVT

SEQ ID NO: 354225 - protein, 9 aa, Homo Sapiens
HDIHGIINE

SEQ ID NO: 354226 - protein, 9 aa, Homo Sapiens
HNKDGEPEY

SEQ ID NO: 354227 - protein, 9 aa, Homo Sapiens
RLLVNTERS

SEQ ID NO: 354228 - protein, 9 aa, Homo Sapiens
DKKDSASNI

SEQ ID NO: 354229 - protein, 9 aa, Homo Sapiens
KEELWQRLN

SEQ ID NO: 354230 - protein, 9 aa, Homo Sapiens
KIIQDHGDM

SEQ ID NO: 354231 - protein, 9 aa, Homo Sapiens
QEQQNVLKV

SEQ ID NO: 354232 - protein, 9 aa, Homo Sapiens
KFYHLLNYS

SEQ ID NO: 354233 - protein, 9 aa, Homo Sapiens
LGVLNLQYF

SEQ ID NO: 354234 - protein, 9 aa, Homo Sapiens
RRKSIKNKR

SEQ ID NO: 354235 - protein, 9 aa, Homo Sapiens
ALELGYSEE

SEQ ID NO: 354236 - protein, 9 aa, Homo Sapiens
VIGFKAENS

SEQ ID NO: 354237 - protein, 9 aa, Homo Sapiens
GPNNTFLQD

SEQ ID NO: 354238 - protein, 9 aa, Homo Sapiens
RFLDKKHQN

SEQ ID NO: 354239 - protein, 9 aa, Homo Sapiens
SPISQKEFV

SEQ ID NO: 354240 - protein, 9 aa, Homo Sapiens
NNPIKSIPS

SEQ ID NO: 354241 - protein, 9 aa, Homo Sapiens
NKALYDICS

SEQ ID NO: 354242 - protein, 9 aa, Homo Sapiens
AQFLWSLWD

SEQ ID NO: 354243 - protein, 9 aa, Homo Sapiens
LEFALELGY

SEQ ID NO: 354244 - protein, 9 aa, Homo Sapiens
KESTRQQDT

SEQ ID NO: 354245 - protein, 9 aa, Homo Sapiens
LQEVCSAFL

SEQ ID NO: 354246 - protein, 9 aa, Homo Sapiens
LDIEITNSS

SEQ ID NO: 354247 - protein, 9 aa, Homo Sapiens
FWNPSIYEK

SEQ ID NO: 354248 - protein, 9 aa, Homo Sapiens
QPWNVTGNS

SEQ ID NO: 354249 - protein, 9 aa, Homo Sapiens
LGLKCGICM

SEQ ID NO: 354250 - protein, 9 aa, Homo Sapiens
DLAMQVITS

SEQ ID NO: 354251 - protein, 9 aa, Homo Sapiens
QLELIKTKA

SEQ ID NO: 354252 - protein, 9 aa, Homo Sapiens
FYRQSVREA

SEQ ID NO: 354253 - protein, 9 aa, Homo Sapiens
LKRFTKVED

SEQ ID NO: 354254 - protein, 9 aa, Homo Sapiens
CVGPEEQEL

SEQ ID NO: 354255 - protein, 9 aa, Homo Sapiens
KCSVCEYAF

SEQ ID NO: 354256 - protein, 9 aa, Homo Sapiens
HLDIEITNS

SEQ ID NO: 354257 - protein, 9 aa, Homo Sapiens
NKQFRSRGS

SEQ ID NO: 354258 - protein, 9 aa, Homo Sapiens
PSILKYAEA

SEQ ID NO: 354259 - protein, 9 aa, Homo Sapiens
INCLHAAID

SEQ ID NO: 354260 - protein, 9 aa, Homo Sapiens
SEHSEMKLD

SEQ ID NO: 354261 - protein, 9 aa, Homo Sapiens
YFFFSFSLF

SEQ ID NO: 354262 - protein, 9 aa, Homo Sapiens
GTINSYEMQ

SEQ ID NO: 354263 - protein, 9 aa, Homo Sapiens
GHNIDTCCH

SEQ ID NO: 354264 - protein, 9 aa, Homo Sapiens
PKELNGENV

SEQ ID NO: 354265 - protein, 9 aa, Homo Sapiens
ADTDVQLMR

SEQ ID NO: 354266 - protein, 9 aa, Homo Sapiens
VVAALRQAL

SEQ ID NO: 354267 - protein, 9 aa, Homo Sapiens
QTLEPTLSQ

SEQ ID NO: 354268 - protein, 9 aa, Homo Sapiens
DGTQGKKTE

SEQ ID NO: 354269 - protein, 9 aa, Homo Sapiens
MAKVVNLGV

SEQ ID NO: 354270 - protein, 9 aa, Homo Sapiens
RIQQAFGKL

SEQ ID NO: 354271 - protein, 9 aa, Homo Sapiens
GRPQCKQIY

SEQ ID NO: 354272 - protein, 9 aa, Homo Sapiens
CDVSSDVFY

SEQ ID NO: 354273 - protein, 9 aa, Homo Sapiens
GSGRIALVV

SEQ ID NO: 354274 - protein, 9 aa, Homo Sapiens
TISSVLIPP

SEQ ID NO: 354275 - protein, 9 aa, Homo Sapiens
ARKHRKTTL

SEQ ID NO: 354276 - protein, 9 aa, Homo Sapiens
WHQIRTDEN

SEQ ID NO: 354277 - protein, 9 aa, Homo Sapiens
WCCQSNCKL

SEQ ID NO: 354278 - protein, 9 aa, Homo Sapiens
VGLIQSSFA

SEQ ID NO: 354279 - protein, 9 aa, Homo Sapiens
AQVQKLNDS

SEQ ID NO: 354280 - protein, 9 aa, Homo Sapiens
VCKEEQRYS

SEQ ID NO: 354281 - protein, 9 aa, Homo Sapiens
PINTHQTNL

SEQ ID NO: 354282 - protein, 9 aa, Homo Sapiens
TCQRLWEYL

SEQ ID NO: 354283 - protein, 9 aa, Homo Sapiens
FTHSIPHSS

SEQ ID NO: 354284 - protein, 9 aa, Homo Sapiens
GLSAQSPRC

SEQ ID NO: 354285 - protein, 9 aa, Homo Sapiens
SKSPVPIAP

SEQ ID NO: 354286 - protein, 9 aa, Homo Sapiens
FFLLITITL

SEQ ID NO: 354287 - protein, 9 aa, Homo Sapiens
LLDGRTHSK

SEQ ID NO: 354288 - protein, 9 aa, Homo Sapiens
FCYWAKLCY

SEQ ID NO: 354289 - protein, 9 aa, Homo Sapiens
LRPEEIKEL

SEQ ID NO: 354290 - protein, 9 aa, Homo Sapiens
NIVNGDVQN

SEQ ID NO: 354291 - protein, 9 aa, Homo Sapiens
KGNAFNQDI

SEQ ID NO: 354292 - protein, 9 aa, Homo Sapiens
NDERELSPP

SEQ ID NO: 354293 - protein, 9 aa, Homo Sapiens
VGATAVYHI

SEQ ID NO: 354294 - protein, 9 aa, Homo Sapiens
RAESQIRGT

SEQ ID NO: 354295 - protein, 9 aa, Homo Sapiens
SIPHSSPCR

SEQ ID NO: 354296 - protein, 9 aa, Homo Sapiens
FINTIPNIM

SEQ ID NO: 354297 - protein, 9 aa, Homo Sapiens
NITIMILIC

SEQ ID NO: 354298 - protein, 9 aa, Homo Sapiens
EVQQTGCVK

SEQ ID NO: 354299 - protein, 9 aa, Homo Sapiens
GIKGGTKVY

SEQ ID NO: 354300 - protein, 9 aa, Homo Sapiens
EEDIQTVFY

SEQ ID NO: 354301 - protein, 9 aa, Homo Sapiens
PSADQKLSV

SEQ ID NO: 354302 - protein, 9 aa, Homo Sapiens
QYDKIHQSK

SEQ ID NO: 354303 - protein, 9 aa, Homo Sapiens
LGETPPSVE

SEQ ID NO: 354304 - protein, 9 aa, Homo Sapiens
PNFYNETYD

SEQ ID NO: 354305 - protein, 9 aa, Homo Sapiens
IVTAVYCCH

SEQ ID NO: 354306 - protein, 9 aa, Homo Sapiens
LDERDAGIT

SEQ ID NO: 354307 - protein, 9 aa, Homo Sapiens
THQKCVIAT

SEQ ID NO: 354308 - protein, 9 aa, Homo Sapiens
IFERWECTM

SEQ ID NO: 354309 - protein, 9 aa, Homo Sapiens
TNNYSMVLT

SEQ ID NO: 354310 - protein, 9 aa, Homo Sapiens
LFLHLHNLT

SEQ ID NO: 354311 - protein, 9 aa, Homo Sapiens
MDPRERDMQ

SEQ ID NO: 354312 - protein, 9 aa, Homo Sapiens
GNATLPFVP

SEQ ID NO: 354313 - protein, 9 aa, Homo Sapiens
CPSEIVIGQ

SEQ ID NO: 354314 - protein, 9 aa, Homo Sapiens
EELQTMDQA

SEQ ID NO: 354315 - protein, 9 aa, Homo Sapiens
VTSRPKPER

SEQ ID NO: 354316 - protein, 9 aa, Homo Sapiens
LVEYGADHM

SEQ ID NO: 354317 - protein, 9 aa, Homo Sapiens
MVAWGVGLA

SEQ ID NO: 354318 - protein, 9 aa, Homo Sapiens
AIPNEESVV

SEQ ID NO: 354319 - protein, 9 aa, Homo Sapiens
HCPRHCPPW

SEQ ID NO: 354320 - protein, 9 aa, Homo Sapiens
KEIYPDKRF

SEQ ID NO: 354321 - protein, 9 aa, Homo Sapiens
TSQSPTDIL

SEQ ID NO: 354322 - protein, 9 aa, Homo Sapiens
AKNSVSLMN

SEQ ID NO: 354323 - protein, 9 aa, Homo Sapiens
AKLAYFSFL

SEQ ID NO: 354324 - protein, 9 aa, Homo Sapiens
KTAFECMYS

SEQ ID NO: 354325 - protein, 9 aa, Homo Sapiens
APDESPKLT

SEQ ID NO: 354326 - protein, 9 aa, Homo Sapiens
KCRLIYHQQ

SEQ ID NO: 354327 - protein, 9 aa, Homo Sapiens
AEQLAQLAQ

SEQ ID NO: 354328 - protein, 9 aa, Homo Sapiens
YKLFVDGQW

SEQ ID NO: 354329 - protein, 9 aa, Homo Sapiens
LTMEELSLR

SEQ ID NO: 354330 - protein, 9 aa, Homo Sapiens
TGRLFFKFY

SEQ ID NO: 354331 - protein, 9 aa, Homo Sapiens
VLLEQDIFN

SEQ ID NO: 354332 - protein, 9 aa, Homo Sapiens
ASLRNLYTQ

SEQ ID NO: 354333 - protein, 9 aa, Homo Sapiens
FKKDLSKQL

SEQ ID NO: 354334 - protein, 9 aa, Homo Sapiens
ICKYKKRFN

SEQ ID NO: 354335 - protein, 9 aa, Homo Sapiens
VLAIALPVP

SEQ ID NO: 354336 - protein, 9 aa, Homo Sapiens
YETVCMAAI

SEQ ID NO: 354337 - protein, 9 aa, Homo Sapiens
ASNSTQTGK

SEQ ID NO: 354338 - protein, 9 aa, Homo Sapiens
LFVHFLNGL

SEQ ID NO: 354339 - protein, 9 aa, Homo Sapiens
KIKWGMSRK

SEQ ID NO: 354340 - protein, 9 aa, Homo Sapiens
GKAFFSPSL

SEQ ID NO: 354341 - protein, 9 aa, Homo Sapiens
LFDVLEMLA

SEQ ID NO: 354342 - protein, 9 aa, Homo Sapiens
LKYRKVQEH

SEQ ID NO: 354343 - protein, 9 aa, Homo Sapiens
DNDNVEDDF

SEQ ID NO: 354344 - protein, 9 aa, Homo Sapiens
IQSEKEIVV

SEQ ID NO: 354345 - protein, 9 aa, Homo Sapiens
KNKGSMQNK

SEQ ID NO: 354346 - protein, 9 aa, Homo Sapiens
NLPEVISNT

SEQ ID NO: 354347 - protein, 9 aa, Homo Sapiens
DCLNCLLMI

SEQ ID NO: 354348 - protein, 9 aa, Homo Sapiens
LGPSIFRVV

SEQ ID NO: 354349 - protein, 9 aa, Homo Sapiens
TDEHGKREP

SEQ ID NO: 354350 - protein, 9 aa, Homo Sapiens
IQLKAKEQH

SEQ ID NO: 354351 - protein, 9 aa, Homo Sapiens
SSALKNNHK

SEQ ID NO: 354352 - protein, 9 aa, Homo Sapiens
NDELSKSLS

SEQ ID NO: 354353 - protein, 9 aa, Homo Sapiens
GTIVGIYRK

SEQ ID NO: 354354 - protein, 9 aa, Homo Sapiens
DGINTNMYQ

SEQ ID NO: 354355 - protein, 9 aa, Homo Sapiens
GRWVHLDIE

SEQ ID NO: 354356 - protein, 9 aa, Homo Sapiens
WGAVGHRPV

SEQ ID NO: 354357 - protein, 9 aa, Homo Sapiens
DFDLVDKIQ

SEQ ID NO: 354358 - protein, 9 aa, Homo Sapiens
IKANTELVG

SEQ ID NO: 354359 - protein, 9 aa, Homo Sapiens
ALRYLNVRR

SEQ ID NO: 354360 - protein, 9 aa, Homo Sapiens
IISKDQLCL

SEQ ID NO: 354361 - protein, 9 aa, Homo Sapiens
GVRIYYVLY

SEQ ID NO: 354362 - protein, 9 aa, Homo Sapiens
DVGPYGIQS

SEQ ID NO: 354363 - protein, 9 aa, Homo Sapiens
SAAGVYVAF

SEQ ID NO: 354364 - protein, 9 aa, Homo Sapiens
SQIISCRLK

SEQ ID NO: 354365 - protein, 9 aa, Homo Sapiens
VCGACKPEC

SEQ ID NO: 354366 - protein, 9 aa, Homo Sapiens
PQQQREGPK

SEQ ID NO: 354367 - protein, 9 aa, Homo Sapiens
WWSFTSSTA

SEQ ID NO: 354368 - protein, 9 aa, Homo Sapiens
NGVGICKKK

SEQ ID NO: 354369 - protein, 9 aa, Homo Sapiens
PNNLFFFFF

SEQ ID NO: 354370 - protein, 9 aa, Homo Sapiens
LQDTVEQLQ

SEQ ID NO: 354371 - protein, 9 aa, Homo Sapiens
EPDISLHVP

SEQ ID NO: 354372 - protein, 9 aa, Homo Sapiens
DDILHQWRQ

SEQ ID NO: 354373 - protein, 9 aa, Homo Sapiens
VKLWSLNSD

SEQ ID NO: 354374 - protein, 9 aa, Homo Sapiens
SLLKRHEKS

SEQ ID NO: 354375 - protein, 9 aa, Homo Sapiens
TTWDCDQDK

SEQ ID NO: 354376 - protein, 9 aa, Homo Sapiens
NNLFFFFFF

SEQ ID NO: 354377 - protein, 9 aa, Homo Sapiens
AAKLMKNIQ

SEQ ID NO: 354378 - protein, 9 aa, Homo Sapiens
DVVLLQDVK

SEQ ID NO: 354379 - protein, 9 aa, Homo Sapiens
CPSKSPVPI

SEQ ID NO: 354380 - protein, 9 aa, Homo Sapiens
YFLGFLFLA

SEQ ID NO: 354381 - protein, 9 aa, Homo Sapiens
GELCLGKEG

SEQ ID NO: 354382 - protein, 9 aa, Homo Sapiens
LVGPPLKGY

SEQ ID NO: 354383 - protein, 9 aa, Homo Sapiens
NRGSCSHPQ

SEQ ID NO: 354384 - protein, 9 aa, Homo Sapiens
IEITNSSGR

SEQ ID NO: 354385 - protein, 9 aa, Homo Sapiens
KLDEGTSVL

SEQ ID NO: 354386 - protein, 9 aa, Homo Sapiens
STLKATIPP

SEQ ID NO: 354387 - protein, 9 aa, Homo Sapiens
PQSRGTHTN

SEQ ID NO: 354388 - protein, 9 aa, Homo Sapiens
YHHHLYDIH

SEQ ID NO: 354389 - protein, 9 aa, Homo Sapiens
IAHLARHRN

SEQ ID NO: 354390 - protein, 9 aa, Homo Sapiens
ASLHGLTPF

SEQ ID NO: 354391 - protein, 9 aa, Homo Sapiens
YFETGYNEI

SEQ ID NO: 354392 - protein, 9 aa, Homo Sapiens
KKDDTYDKD

SEQ ID NO: 354393 - protein, 9 aa, Homo Sapiens
HGVRILRAV

SEQ ID NO: 354394 - protein, 9 aa, Homo Sapiens
LPGMLQQRR

SEQ ID NO: 354395 - protein, 9 aa, Homo Sapiens
QEHQNRVFH

SEQ ID NO: 354396 - protein, 9 aa, Homo Sapiens
KAFSDKRTS

SEQ ID NO: 354397 - protein, 9 aa, Homo Sapiens
VDLCQKVEA

SEQ ID NO: 354398 - protein, 9 aa, Homo Sapiens
AGHFWSQHT

SEQ ID NO: 354399 - protein, 9 aa, Homo Sapiens
GEPPTSPPE

SEQ ID NO: 354400 - protein, 9 aa, Homo Sapiens
YLISFNQTT

SEQ ID NO: 354401 - protein, 9 aa, Homo Sapiens
LYIAICFVF

SEQ ID NO: 354402 - protein, 9 aa, Homo Sapiens
LLFDSEKIM

SEQ ID NO: 354403 - protein, 9 aa, Homo Sapiens
YRCVVQNRM

SEQ ID NO: 354404 - protein, 9 aa, Homo Sapiens
QIATRRLNG

SEQ ID NO: 354405 - protein, 9 aa, Homo Sapiens
LHIIIIFGT

SEQ ID NO: 354406 - protein, 9 aa, Homo Sapiens
EEELKKQLR

SEQ ID NO: 354407 - protein, 9 aa, Homo Sapiens
MCAGLHRSP

SEQ ID NO: 354408 - protein, 9 aa, Homo Sapiens
CFLAPEILT

SEQ ID NO: 354409 - protein, 9 aa, Homo Sapiens
GEKSSKAKE

SEQ ID NO: 354410 - protein, 9 aa, Homo Sapiens
TAHKNFILS

SEQ ID NO: 354411 - protein, 9 aa, Homo Sapiens
LQLLDDSIT

SEQ ID NO: 354412 - protein, 9 aa, Homo Sapiens
QSARRKRKK

SEQ ID NO: 354413 - protein, 9 aa, Homo Sapiens
HRDKHPVTW

SEQ ID NO: 354414 - protein, 9 aa, Homo Sapiens
KFADWAQEQ

SEQ ID NO: 354415 - protein, 9 aa, Homo Sapiens
FQNNNKWQR

SEQ ID NO: 354416 - protein, 9 aa, Homo Sapiens
WSNDNGTNY

SEQ ID NO: 354417 - protein, 9 aa, Homo Sapiens
LESDNEDGG

SEQ ID NO: 354418 - protein, 9 aa, Homo Sapiens
LFVAFAINL

SEQ ID NO: 354419 - protein, 9 aa, Homo Sapiens
GVEKAKAMS

SEQ ID NO: 354420 - protein, 9 aa, Homo Sapiens
RPFSVCYDP

SEQ ID NO: 354421 - protein, 9 aa, Homo Sapiens
FSLKLYHTF

SEQ ID NO: 354422 - protein, 9 aa, Homo Sapiens
KWLEVCCVC

SEQ ID NO: 354423 - protein, 9 aa, Homo Sapiens
QSDTPEICK

SEQ ID NO: 354424 - protein, 9 aa, Homo Sapiens
IKGGIEGGA

SEQ ID NO: 354425 - protein, 9 aa, Homo Sapiens
KNMKRKMER

SEQ ID NO: 354426 - protein, 9 aa, Homo Sapiens
QARSLLSLV

SEQ ID NO: 354427 - protein, 9 aa, Homo Sapiens
DNIFGTVIV

SEQ ID NO: 354428 - protein, 9 aa, Homo Sapiens
EEKFQAVML

SEQ ID NO: 354429 - protein, 9 aa, Homo Sapiens
KTTSEDGTV

SEQ ID NO: 354430 - protein, 9 aa, Homo Sapiens
TIQNLKERF

SEQ ID NO: 354431 - protein, 9 aa, Homo Sapiens
IQIKEYVHI

SEQ ID NO: 354432 - protein, 9 aa, Homo Sapiens
CGASLHGLT

SEQ ID NO: 354433 - protein, 9 aa, Homo Sapiens
VKINQGTLT

SEQ ID NO: 354434 - protein, 9 aa, Homo Sapiens
ALYFTCDNV

SEQ ID NO: 354435 - protein, 9 aa, Homo Sapiens
SGEIRNIFY

SEQ ID NO: 354436 - protein, 9 aa, Homo Sapiens
CARCAHPLT

SEQ ID NO: 354437 - protein, 9 aa, Homo Sapiens
MPRKAISTL

SEQ ID NO: 354438 - protein, 9 aa, Homo Sapiens
VFLVWKFAY

SEQ ID NO: 354439 - protein, 9 aa, Homo Sapiens
RVLPIEHQK

SEQ ID NO: 354440 - protein, 9 aa, Homo Sapiens
HFFCNVTPL

SEQ ID NO: 354441 - protein, 9 aa, Homo Sapiens
IWDKARKEK

SEQ ID NO: 354442 - protein, 9 aa, Homo Sapiens
YKCSVCEYA

SEQ ID NO: 354443 - protein, 9 aa, Homo Sapiens
ELQTMDQAL

SEQ ID NO: 354444 - protein, 9 aa, Homo Sapiens
LNRRICPTK

SEQ ID NO: 354445 - protein, 9 aa, Homo Sapiens
SNTCSTSSP

SEQ ID NO: 354446 - protein, 9 aa, Homo Sapiens
PRICGFLIL

SEQ ID NO: 354447 - protein, 9 aa, Homo Sapiens
ALCGAAHRS

SEQ ID NO: 354448 - protein, 9 aa, Homo Sapiens
RLSVAEDPL

SEQ ID NO: 354449 - protein, 9 aa, Homo Sapiens
SNCAELMKL

SEQ ID NO: 354450 - protein, 9 aa, Homo Sapiens
MLISSQPVI

SEQ ID NO: 354451 - protein, 9 aa, Homo Sapiens
MTKCDVTGG

SEQ ID NO: 354452 - protein, 9 aa, Homo Sapiens
RPYSCRICC

SEQ ID NO: 354453 - protein, 9 aa, Homo Sapiens
CLHNNERQG

SEQ ID NO: 354454 - protein, 9 aa, Homo Sapiens
PKEQILFIN

SEQ ID NO: 354455 - protein, 9 aa, Homo Sapiens
QTCKILNAQ

SEQ ID NO: 354456 - protein, 9 aa, Homo Sapiens
SKIFADRPC

SEQ ID NO: 354457 - protein, 9 aa, Homo Sapiens
RYLDIPGDK

SEQ ID NO: 354458 - protein, 9 aa, Homo Sapiens
IPPQNPGSL

SEQ ID NO: 354459 - protein, 9 aa, Homo Sapiens
GLADLFGQM

SEQ ID NO: 354460 - protein, 9 aa, Homo Sapiens
KPHACSECG

SEQ ID NO: 354461 - protein, 9 aa, Homo Sapiens
VLFCGPKAL

SEQ ID NO: 354462 - protein, 9 aa, Homo Sapiens
RFVSDQKEE

SEQ ID NO: 354463 - protein, 9 aa, Homo Sapiens
KLNERCIKF

SEQ ID NO: 354464 - protein, 9 aa, Homo Sapiens
KQLNTRSSQ

SEQ ID NO: 354465 - protein, 9 aa, Homo Sapiens
YTQNIKVSR

SEQ ID NO: 354466 - protein, 9 aa, Homo Sapiens
WAPLHLACY

SEQ ID NO: 354467 - protein, 9 aa, Homo Sapiens
STEGCKEGR

SEQ ID NO: 354468 - protein, 9 aa, Homo Sapiens
KGKYQLATK

SEQ ID NO: 354469 - protein, 9 aa, Homo Sapiens
NSSSLSSPS

SEQ ID NO: 354470 - protein, 9 aa, Homo Sapiens
GEIGSGNLS

SEQ ID NO: 354471 - protein, 9 aa, Homo Sapiens
YIGIIAILQ

SEQ ID NO: 354472 - protein, 9 aa, Homo Sapiens
NQIILVVDP

SEQ ID NO: 354473 - protein, 9 aa, Homo Sapiens
TFRLRQGSR

SEQ ID NO: 354474 - protein, 9 aa, Homo Sapiens
TLDAFGTAR

SEQ ID NO: 354475 - protein, 9 aa, Homo Sapiens
DHKKADAEE

SEQ ID NO: 354476 - protein, 9 aa, Homo Sapiens
TLETDDGVV

SEQ ID NO: 354477 - protein, 9 aa, Homo Sapiens
SAATVSVST

SEQ ID NO: 354478 - protein, 9 aa, Homo Sapiens
TADKLMDLR

SEQ ID NO: 354479 - protein, 9 aa, Homo Sapiens
GEKRRGCAS

SEQ ID NO: 354480 - protein, 9 aa, Homo Sapiens
PVPQCKVAV

SEQ ID NO: 354481 - protein, 9 aa, Homo Sapiens
LCQAIEELY

SEQ ID NO: 354482 - protein, 9 aa, Homo Sapiens
KISHKMLDQ

SEQ ID NO: 354483 - protein, 9 aa, Homo Sapiens
PEVLLTKIH

SEQ ID NO: 354484 - protein, 9 aa, Homo Sapiens
AKLRDKIMA

SEQ ID NO: 354485 - protein, 9 aa, Homo Sapiens
LRRNKEYCL

SEQ ID NO: 354486 - protein, 9 aa, Homo Sapiens
PFSRLAILP

SEQ ID NO: 354487 - protein, 9 aa, Homo Sapiens
TIDRYVVCY

SEQ ID NO: 354488 - protein, 9 aa, Homo Sapiens
YSFLTTFQM

SEQ ID NO: 354489 - protein, 9 aa, Homo Sapiens
VKGDDNPKE

SEQ ID NO: 354490 - protein, 9 aa, Homo Sapiens
GLLFVSYFH

SEQ ID NO: 354491 - protein, 9 aa, Homo Sapiens
CPFPGAVTK

SEQ ID NO: 354492 - protein, 9 aa, Homo Sapiens
KPQGKVQYG

SEQ ID NO: 354493 - protein, 9 aa, Homo Sapiens
QGTIMGIFF

SEQ ID NO: 354494 - protein, 9 aa, Homo Sapiens
RRKQCYWPF

SEQ ID NO: 354495 - protein, 9 aa, Homo Sapiens
HNNQGTVNW

SEQ ID NO: 354496 - protein, 9 aa, Homo Sapiens
KKKELEEQQ

SEQ ID NO: 354497 - protein, 9 aa, Homo Sapiens
DWIVTGLQP

SEQ ID NO: 354498 - protein, 9 aa, Homo Sapiens
CYSAEVGTL

SEQ ID NO: 354499 - protein, 9 aa, Homo Sapiens
LWHCLLMLL

SEQ ID NO: 354500 - protein, 9 aa, Homo Sapiens
AEEGDVPRR

SEQ ID NO: 354501 - protein, 9 aa, Homo Sapiens
LEEAKQLFA

SEQ ID NO: 354502 - protein, 9 aa, Homo Sapiens
EHQTQVLKK

SEQ ID NO: 354503 - protein, 9 aa, Homo Sapiens
LYAAGFSQH

SEQ ID NO: 354504 - protein, 9 aa, Homo Sapiens
LIQLKAKEQ

SEQ ID NO: 354505 - protein, 9 aa, Homo Sapiens
VLQNELQTE

SEQ ID NO: 354506 - protein, 9 aa, Homo Sapiens
MSEPEFHHG

SEQ ID NO: 354507 - protein, 9 aa, Homo Sapiens
SKSVRLYLV

SEQ ID NO: 354508 - protein, 9 aa, Homo Sapiens
KSEQSDLEE

SEQ ID NO: 354509 - protein, 9 aa, Homo Sapiens
KEHQQIHTG

SEQ ID NO: 354510 - protein, 9 aa, Homo Sapiens
AGCGPPSGM

SEQ ID NO: 354511 - protein, 9 aa, Homo Sapiens
SGEDKWLLQ

SEQ ID NO: 354512 - protein, 9 aa, Homo Sapiens
DMVAWGVGL

SEQ ID NO: 354513 - protein, 9 aa, Homo Sapiens
KDVLLQNQV

SEQ ID NO: 354514 - protein, 9 aa, Homo Sapiens
NPPKYDKIK

SEQ ID NO: 354515 - protein, 9 aa, Homo Sapiens
QTQIISKKI

SEQ ID NO: 354516 - protein, 9 aa, Homo Sapiens
QKLPTSLKK

SEQ ID NO: 354517 - protein, 9 aa, Homo Sapiens
EPVPWKFPS

SEQ ID NO: 354518 - protein, 9 aa, Homo Sapiens
VRACLAMLE

SEQ ID NO: 354519 - protein, 9 aa, Homo Sapiens
EKEIKRADH

SEQ ID NO: 354520 - protein, 9 aa, Homo Sapiens
RFQKDFMRP

SEQ ID NO: 354521 - protein, 9 aa, Homo Sapiens
APSSFFIGD

SEQ ID NO: 354522 - protein, 9 aa, Homo Sapiens
FGLQIRVPP

SEQ ID NO: 354523 - protein, 9 aa, Homo Sapiens
HFLDTALRR

SEQ ID NO: 354524 - protein, 9 aa, Homo Sapiens
QIRIENPNY

SEQ ID NO: 354525 - protein, 9 aa, Homo Sapiens
QVREVCKEE

SEQ ID NO: 354526 - protein, 9 aa, Homo Sapiens
LISQKVPEK

SEQ ID NO: 354527 - protein, 9 aa, Homo Sapiens
QLPDLGCPA

SEQ ID NO: 354528 - protein, 9 aa, Homo Sapiens
HEAGGEYFA

SEQ ID NO: 354529 - protein, 9 aa, Homo Sapiens
GEEKIFAFQ

SEQ ID NO: 354530 - protein, 9 aa, Homo Sapiens
KEKASFFPP

SEQ ID NO: 354531 - protein, 9 aa, Homo Sapiens
EQIEKIWLW

SEQ ID NO: 354532 - protein, 9 aa, Homo Sapiens
LSDEVTESV

SEQ ID NO: 354533 - protein, 9 aa, Homo Sapiens
TYLISFNQT

SEQ ID NO: 354534 - protein, 9 aa, Homo Sapiens
AGPGLSLGG

SEQ ID NO: 354535 - protein, 9 aa, Homo Sapiens
YLTMQVLNS

SEQ ID NO: 354536 - protein, 9 aa, Homo Sapiens
CHPFSDRMP

SEQ ID NO: 354537 - protein, 9 aa, Homo Sapiens
LQNELRETV

SEQ ID NO: 354538 - protein, 9 aa, Homo Sapiens
LGTCRGDKF

SEQ ID NO: 354539 - protein, 9 aa, Homo Sapiens
FMSLPPNCW

SEQ ID NO: 354540 - protein, 9 aa, Homo Sapiens
KLFNEMAER

SEQ ID NO: 354541 - protein, 9 aa, Homo Sapiens
CCARFQCGE

SEQ ID NO: 354542 - protein, 9 aa, Homo Sapiens
ISHQQIHTS

SEQ ID NO: 354543 - protein, 9 aa, Homo Sapiens
KDTKNVNLN

SEQ ID NO: 354544 - protein, 9 aa, Homo Sapiens
QTLAFSIHE

SEQ ID NO: 354545 - protein, 9 aa, Homo Sapiens
CGICMVNMK

SEQ ID NO: 354546 - protein, 9 aa, Homo Sapiens
NSCISPLSL

SEQ ID NO: 354547 - protein, 9 aa, Homo Sapiens
ICYQRKHDY

SEQ ID NO: 354548 - protein, 9 aa, Homo Sapiens
VLGTLFLAI

SEQ ID NO: 354549 - protein, 9 aa, Homo Sapiens
MDYSIEEDG

SEQ ID NO: 354550 - protein, 9 aa, Homo Sapiens
RTQHTGVLT

SEQ ID NO: 354551 - protein, 9 aa, Homo Sapiens
TTHCLAYSN

SEQ ID NO: 354552 - protein, 9 aa, Homo Sapiens
RWNLKEEAQ

SEQ ID NO: 354553 - protein, 9 aa, Homo Sapiens
ANSVALLCK

SEQ ID NO: 354554 - protein, 9 aa, Homo Sapiens
KFLRDFTDN

SEQ ID NO: 354555 - protein, 9 aa, Homo Sapiens
IFFPRKCPT

SEQ ID NO: 354556 - protein, 9 aa, Homo Sapiens
CDQDKHSDS

SEQ ID NO: 354557 - protein, 9 aa, Homo Sapiens
EGNGYDTRS

SEQ ID NO: 354558 - protein, 9 aa, Homo Sapiens
HPASKSNIN

SEQ ID NO: 354559 - protein, 9 aa, Homo Sapiens
KHTIQFVDW

SEQ ID NO: 354560 - protein, 9 aa, Homo Sapiens
VTGHTCLNV

SEQ ID NO: 354561 - protein, 9 aa, Homo Sapiens
LLSASLSEN

SEQ ID NO: 354562 - protein, 9 aa, Homo Sapiens
VTLRLQAEL

SEQ ID NO: 354563 - protein, 9 aa, Homo Sapiens
ILFKKLILD

SEQ ID NO: 354564 - protein, 9 aa, Homo Sapiens
GKFDKDRDS

SEQ ID NO: 354565 - protein, 9 aa, Homo Sapiens
QDLLSDQNK

SEQ ID NO: 354566 - protein, 9 aa, Homo Sapiens
ALQRSSTPI

SEQ ID NO: 354567 - protein, 9 aa, Homo Sapiens
LTTAKTSVK

SEQ ID NO: 354568 - protein, 9 aa, Homo Sapiens
FYGNNSSYV

SEQ ID NO: 354569 - protein, 9 aa, Homo Sapiens
TDFRKDSKN

SEQ ID NO: 354570 - protein, 9 aa, Homo Sapiens
GTFPHHGIA

SEQ ID NO: 354571 - protein, 9 aa, Homo Sapiens
KWVKARNQH

SEQ ID NO: 354572 - protein, 9 aa, Homo Sapiens
MEGWGEGAQ

SEQ ID NO: 354573 - protein, 9 aa, Homo Sapiens
GMLQQRRPW

SEQ ID NO: 354574 - protein, 9 aa, Homo Sapiens
PMMKEFRCE

SEQ ID NO: 354575 - protein, 9 aa, Homo Sapiens
AVTSSSEII

SEQ ID NO: 354576 - protein, 9 aa, Homo Sapiens
NNHKALKAL

SEQ ID NO: 354577 - protein, 9 aa, Homo Sapiens
IKFYEENGF

SEQ ID NO: 354578 - protein, 9 aa, Homo Sapiens
HTKMKTTTN

SEQ ID NO: 354579 - protein, 9 aa, Homo Sapiens
FVSSLSDKS

SEQ ID NO: 354580 - protein, 9 aa, Homo Sapiens
DECKVYTGG

SEQ ID NO: 354581 - protein, 9 aa, Homo Sapiens
ADDSLDKFR

SEQ ID NO: 354582 - protein, 9 aa, Homo Sapiens
LKIILSIGG

SEQ ID NO: 354583 - protein, 9 aa, Homo Sapiens
ADQRRDFIN

SEQ ID NO: 354584 - protein, 9 aa, Homo Sapiens
LTQASNIYS

SEQ ID NO: 354585 - protein, 9 aa, Homo Sapiens
RANTIKNTV

SEQ ID NO: 354586 - protein, 9 aa, Homo Sapiens
PRAPRASKA

SEQ ID NO: 354587 - protein, 9 aa, Homo Sapiens
MYGKFSINS

SEQ ID NO: 354588 - protein, 9 aa, Homo Sapiens
CEGDISLDK

SEQ ID NO: 354589 - protein, 9 aa, Homo Sapiens
LSLVALDGK

SEQ ID NO: 354590 - protein, 9 aa, Homo Sapiens
HELFGGNNP

SEQ ID NO: 354591 - protein, 9 aa, Homo Sapiens
DQLSYSILE

SEQ ID NO: 354592 - protein, 9 aa, Homo Sapiens
HQYKLFVDG

SEQ ID NO: 354593 - protein, 9 aa, Homo Sapiens
ATLLLCGTE

SEQ ID NO: 354594 - protein, 9 aa, Homo Sapiens
NELGKTSFF

SEQ ID NO: 354595 - protein, 9 aa, Homo Sapiens
QFAFSYLYY

SEQ ID NO: 354596 - protein, 9 aa, Homo Sapiens
GTFWSNDNG

SEQ ID NO: 354597 - protein, 9 aa, Homo Sapiens
ANNSVLGPL

SEQ ID NO: 354598 - protein, 9 aa, Homo Sapiens
SQIQNSIVN

SEQ ID NO: 354599 - protein, 9 aa, Homo Sapiens
RNKTDLQLH

SEQ ID NO: 354600 - protein, 9 aa, Homo Sapiens
PILVEKLPF

SEQ ID NO: 354601 - protein, 9 aa, Homo Sapiens
QNKPLSCVV

SEQ ID NO: 354602 - protein, 9 aa, Homo Sapiens
VTKTEKTAT

SEQ ID NO: 354603 - protein, 9 aa, Homo Sapiens
QLFENGDVP

SEQ ID NO: 354604 - protein, 9 aa, Homo Sapiens
PKHSRTAYT

SEQ ID NO: 354605 - protein, 9 aa, Homo Sapiens
AILQSYRFV

SEQ ID NO: 354606 - protein, 9 aa, Homo Sapiens
EEAAMALKV

SEQ ID NO: 354607 - protein, 9 aa, Homo Sapiens
QRSYTKDYT

SEQ ID NO: 354608 - protein, 9 aa, Homo Sapiens
FEESYWRIM

SEQ ID NO: 354609 - protein, 9 aa, Homo Sapiens
LLTKNKIRS

SEQ ID NO: 354610 - protein, 9 aa, Homo Sapiens
LCLALQHAG

SEQ ID NO: 354611 - protein, 9 aa, Homo Sapiens
AYIDNFKTR

SEQ ID NO: 354612 - protein, 9 aa, Homo Sapiens
KDLEVEQAL

SEQ ID NO: 354613 - protein, 9 aa, Homo Sapiens
AFLDTHAAQ

SEQ ID NO: 354614 - protein, 9 aa, Homo Sapiens
EIGERVHTL

SEQ ID NO: 354615 - protein, 9 aa, Homo Sapiens
GALVGLSSL

SEQ ID NO: 354616 - protein, 9 aa, Homo Sapiens
AKDAHLVLK

SEQ ID NO: 354617 - protein, 9 aa, Homo Sapiens
LENTIILFT

SEQ ID NO: 354618 - protein, 9 aa, Homo Sapiens
LKDKLFNEI

SEQ ID NO: 354619 - protein, 9 aa, Homo Sapiens
CIMMNEGKI

SEQ ID NO: 354620 - protein, 9 aa, Homo Sapiens
DQNHLQRWN

SEQ ID NO: 354621 - protein, 9 aa, Homo Sapiens
CWHQIRTDE

SEQ ID NO: 354622 - protein, 9 aa, Homo Sapiens
KAENSYLTK

SEQ ID NO: 354623 - protein, 9 aa, Homo Sapiens
LLWGQSFCW

SEQ ID NO: 354624 - protein, 9 aa, Homo Sapiens
FLEAKDAHL

SEQ ID NO: 354625 - protein, 9 aa, Homo Sapiens
EEKLKYIKT

SEQ ID NO: 354626 - protein, 9 aa, Homo Sapiens
QNNKLPDYS

SEQ ID NO: 354627 - protein, 9 aa, Homo Sapiens
EDSRHGQVP

SEQ ID NO: 354628 - protein, 9 aa, Homo Sapiens
IDFGSSCFK

SEQ ID NO: 354629 - protein, 9 aa, Homo Sapiens
NVTAQIALQ

SEQ ID NO: 354630 - protein, 9 aa, Homo Sapiens
YGRFLINFS

SEQ ID NO: 354631 - protein, 9 aa, Homo Sapiens
PWHEQYLLN

SEQ ID NO: 354632 - protein, 9 aa, Homo Sapiens
EHEHKLSPG

SEQ ID NO: 354633 - protein, 9 aa, Homo Sapiens
CAISLWLQG

SEQ ID NO: 354634 - protein, 9 aa, Homo Sapiens
ITQQQKVVS

SEQ ID NO: 354635 - protein, 9 aa, Homo Sapiens
SELFQRGLR

SEQ ID NO: 354636 - protein, 9 aa, Homo Sapiens
HLMSLLEKV

SEQ ID NO: 354637 - protein, 9 aa, Homo Sapiens
CKSNWHGGW

SEQ ID NO: 354638 - protein, 9 aa, Homo Sapiens
PFYRGNKDT

SEQ ID NO: 354639 - protein, 9 aa, Homo Sapiens
TECRSLRVK

SEQ ID NO: 354640 - protein, 9 aa, Homo Sapiens
SKAEAPELS

SEQ ID NO: 354641 - protein, 9 aa, Homo Sapiens
SLMNRGCEG

SEQ ID NO: 354642 - protein, 9 aa, Homo Sapiens
KEVTRTFMK

SEQ ID NO: 354643 - protein, 9 aa, Homo Sapiens
ASFFPPVEK

SEQ ID NO: 354644 - protein, 9 aa, Homo Sapiens
ALENKRAAA

SEQ ID NO: 354645 - protein, 9 aa, Homo Sapiens
YGNKSGKKA

SEQ ID NO: 354646 - protein, 9 aa, Homo Sapiens
PCSSNTLKG

SEQ ID NO: 354647 - protein, 9 aa, Homo Sapiens
GTFTVNADL

SEQ ID NO: 354648 - protein, 9 aa, Homo Sapiens
IVAPPGGRT

SEQ ID NO: 354649 - protein, 9 aa, Homo Sapiens
IVACCNQLF

SEQ ID NO: 354650 - protein, 9 aa, Homo Sapiens
YLTRQNSST

SEQ ID NO: 354651 - protein, 9 aa, Homo Sapiens
NQTLRLLMS

SEQ ID NO: 354652 - protein, 9 aa, Homo Sapiens
VKFDRSKLK

SEQ ID NO: 354653 - protein, 9 aa, Homo Sapiens
EALHYMLLA

SEQ ID NO: 354654 - protein, 9 aa, Homo Sapiens
EPVISGKHH

SEQ ID NO: 354655 - protein, 9 aa, Homo Sapiens
PGSVGISVP

SEQ ID NO: 354656 - protein, 9 aa, Homo Sapiens
SQPANRTGP

SEQ ID NO: 354657 - protein, 9 aa, Homo Sapiens
MHVYYLGMT

SEQ ID NO: 354658 - protein, 9 aa, Homo Sapiens
PQVNGEHTE

SEQ ID NO: 354659 - protein, 9 aa, Homo Sapiens
HQDSATHRN

SEQ ID NO: 354660 - protein, 9 aa, Homo Sapiens
IWVIMITGD

SEQ ID NO: 354661 - protein, 9 aa, Homo Sapiens
LQVFVTLPD

SEQ ID NO: 354662 - protein, 9 aa, Homo Sapiens
SGGKPDSSP

SEQ ID NO: 354663 - protein, 9 aa, Homo Sapiens
AVEAEKDMW

SEQ ID NO: 354664 - protein, 9 aa, Homo Sapiens
PLVTSMSGP

SEQ ID NO: 354665 - protein, 9 aa, Homo Sapiens
TAGFFVSLT

SEQ ID NO: 354666 - protein, 9 aa, Homo Sapiens
LFEDSLEDL

SEQ ID NO: 354667 - protein, 9 aa, Homo Sapiens
GKTTHHNYY

SEQ ID NO: 354668 - protein, 9 aa, Homo Sapiens
KLLARASTK

SEQ ID NO: 354669 - protein, 9 aa, Homo Sapiens
LACLHFSPF

SEQ ID NO: 354670 - protein, 9 aa, Homo Sapiens
SRLLRSLVF

SEQ ID NO: 354671 - protein, 9 aa, Homo Sapiens
DGEIGSQDG

SEQ ID NO: 354672 - protein, 9 aa, Homo Sapiens
STVPQEKVI

SEQ ID NO: 354673 - protein, 9 aa, Homo Sapiens
RIVDKMHNS

SEQ ID NO: 354674 - protein, 9 aa, Homo Sapiens
YTWPCSFPM

SEQ ID NO: 354675 - protein, 9 aa, Homo Sapiens
QKITSLACK

SEQ ID NO: 354676 - protein, 9 aa, Homo Sapiens
NIFGTVIVA

SEQ ID NO: 354677 - protein, 9 aa, Homo Sapiens
AGYDISMST

SEQ ID NO: 354678 - protein, 9 aa, Homo Sapiens
NNEKRQKLV

SEQ ID NO: 354679 - protein, 9 aa, Homo Sapiens
TEVEANRID

SEQ ID NO: 354680 - protein, 9 aa, Homo Sapiens
CPVRALPAD

SEQ ID NO: 354681 - protein, 9 aa, Homo Sapiens
NLQRSDKEL

SEQ ID NO: 354682 - protein, 9 aa, Homo Sapiens
RVLAQLDDN

SEQ ID NO: 354683 - protein, 9 aa, Homo Sapiens
WRKEDLDAI

SEQ ID NO: 354684 - protein, 9 aa, Homo Sapiens
GKEFINLLL

SEQ ID NO: 354685 - protein, 9 aa, Homo Sapiens
ICSRLSSIT

SEQ ID NO: 354686 - protein, 9 aa, Homo Sapiens
VAEQVLQQE

SEQ ID NO: 354687 - protein, 9 aa, Homo Sapiens
KKEEASQNL

SEQ ID NO: 354688 - protein, 9 aa, Homo Sapiens
MDCLRWLKR

SEQ ID NO: 354689 - protein, 9 aa, Homo Sapiens
VVMKLWHCL

SEQ ID NO: 354690 - protein, 9 aa, Homo Sapiens
IEKNIKLFF

SEQ ID NO: 354691 - protein, 9 aa, Homo Sapiens
RTQVLGKKI

SEQ ID NO: 354692 - protein, 9 aa, Homo Sapiens
VHKILCKLS

SEQ ID NO: 354693 - protein, 9 aa, Homo Sapiens
GGAVAYTIG

SEQ ID NO: 354694 - protein, 9 aa, Homo Sapiens
TKINGAVLI

SEQ ID NO: 354695 - protein, 9 aa, Homo Sapiens
SLCDHERTH

SEQ ID NO: 354696 - protein, 9 aa, Homo Sapiens
EYFAMDEDG

SEQ ID NO: 354697 - protein, 9 aa, Homo Sapiens
DIMPDPKLL

SEQ ID NO: 354698 - protein, 9 aa, Homo Sapiens
AAIAPSITS

SEQ ID NO: 354699 - protein, 9 aa, Homo Sapiens
HSSNNPQDD

SEQ ID NO: 354700 - protein, 9 aa, Homo Sapiens
HIRLVVTKG

SEQ ID NO: 354701 - protein, 9 aa, Homo Sapiens
NKGLDRIFL

SEQ ID NO: 354702 - protein, 9 aa, Homo Sapiens
KAIEVECIK

SEQ ID NO: 354703 - protein, 9 aa, Homo Sapiens
VCAPSSFFI

SEQ ID NO: 354704 - protein, 9 aa, Homo Sapiens
AASVMCISP

SEQ ID NO: 354705 - protein, 9 aa, Homo Sapiens
IAKAAEMVP

SEQ ID NO: 354706 - protein, 9 aa, Homo Sapiens
GKLFRHSSV

SEQ ID NO: 354707 - protein, 9 aa, Homo Sapiens
SDANYVLNQ

SEQ ID NO: 354708 - protein, 9 aa, Homo Sapiens
TCLLQHERI

SEQ ID NO: 354709 - protein, 9 aa, Homo Sapiens
VLFITAAWS

SEQ ID NO: 354710 - protein, 9 aa, Homo Sapiens
RLSRRTLHK

SEQ ID NO: 354711 - protein, 9 aa, Homo Sapiens
LIYHQQTHT

SEQ ID NO: 354712 - protein, 9 aa, Homo Sapiens
HSPPCSVLP

SEQ ID NO: 354713 - protein, 9 aa, Homo Sapiens
WIFSSKQQC

SEQ ID NO: 354714 - protein, 9 aa, Homo Sapiens
IKGVARLYR

SEQ ID NO: 354715 - protein, 9 aa, Homo Sapiens
DDQEFELSI

SEQ ID NO: 354716 - protein, 9 aa, Homo Sapiens
HYKNMIQEQ

SEQ ID NO: 354717 - protein, 9 aa, Homo Sapiens
GKQQQWSEK

SEQ ID NO: 354718 - protein, 9 aa, Homo Sapiens
KQAFQATAQ

SEQ ID NO: 354719 - protein, 9 aa, Homo Sapiens
DIQTVFYSW

SEQ ID NO: 354720 - protein, 9 aa, Homo Sapiens
IKQAIKSLN

SEQ ID NO: 354721 - protein, 9 aa, Homo Sapiens
KDASVKAYI

SEQ ID NO: 354722 - protein, 9 aa, Homo Sapiens
TTLFDVLEM

SEQ ID NO: 354723 - protein, 9 aa, Homo Sapiens
RTSFQQLSS

SEQ ID NO: 354724 - protein, 9 aa, Homo Sapiens
HAKAPTDPK

SEQ ID NO: 354725 - protein, 9 aa, Homo Sapiens
LICQQKKEK

SEQ ID NO: 354726 - protein, 9 aa, Homo Sapiens
VHWRRETEK

SEQ ID NO: 354727 - protein, 9 aa, Homo Sapiens
WFEELQKET

SEQ ID NO: 354728 - protein, 9 aa, Homo Sapiens
PHGVWSEPS

SEQ ID NO: 354729 - protein, 9 aa, Homo Sapiens
LRISSATGC

SEQ ID NO: 354730 - protein, 9 aa, Homo Sapiens
THTAEKFYK

SEQ ID NO: 354731 - protein, 9 aa, Homo Sapiens
FKAENSYLT

SEQ ID NO: 354732 - protein, 9 aa, Homo Sapiens
LRKQLEMLS

SEQ ID NO: 354733 - protein, 9 aa, Homo Sapiens
TSLRNSKSK

SEQ ID NO: 354734 - protein, 9 aa, Homo Sapiens
LNPAARKFK

SEQ ID NO: 354735 - protein, 9 aa, Homo Sapiens
QPFNRNLKT

SEQ ID NO: 354736 - protein, 9 aa, Homo Sapiens
ERELEEGCY

SEQ ID NO: 354737 - protein, 9 aa, Homo Sapiens
ASRFIVITD

SEQ ID NO: 354738 - protein, 9 aa, Homo Sapiens
SLLEDSYNM

SEQ ID NO: 354739 - protein, 9 aa, Homo Sapiens
MLLKRSGKL

SEQ ID NO: 354740 - protein, 9 aa, Homo Sapiens
CQNNNSTAS

SEQ ID NO: 354741 - protein, 9 aa, Homo Sapiens
KGKDITMLE

SEQ ID NO: 354742 - protein, 9 aa, Homo Sapiens
WMMKGDFYV

SEQ ID NO: 354743 - protein, 9 aa, Homo Sapiens
DEKIFLLGE

SEQ ID NO: 354744 - protein, 9 aa, Homo Sapiens
RCRHARDCH

SEQ ID NO: 354745 - protein, 9 aa, Homo Sapiens
EHKIIHAGE

SEQ ID NO: 354746 - protein, 9 aa, Homo Sapiens
KEIFKTLIK

SEQ ID NO: 354747 - protein, 9 aa, Homo Sapiens
MKTTWQINL

SEQ ID NO: 354748 - protein, 9 aa, Homo Sapiens
LVQQGIVHR

SEQ ID NO: 354749 - protein, 9 aa, Homo Sapiens
AEPKKSFVK

SEQ ID NO: 354750 - protein, 9 aa, Homo Sapiens
LFLGMHPEE

SEQ ID NO: 354751 - protein, 9 aa, Homo Sapiens
AKLCSTVAN

SEQ ID NO: 354752 - protein, 9 aa, Homo Sapiens
AFAESHNQI

SEQ ID NO: 354753 - protein, 9 aa, Homo Sapiens
PPSISRVTY

SEQ ID NO: 354754 - protein, 9 aa, Homo Sapiens
LFLTNLSIL

SEQ ID NO: 354755 - protein, 9 aa, Homo Sapiens
GFAFHKDSY

SEQ ID NO: 354756 - protein, 9 aa, Homo Sapiens
VSHLHINHL

SEQ ID NO: 354757 - protein, 9 aa, Homo Sapiens
LPKYLYAAG

SEQ ID NO: 354758 - protein, 9 aa, Homo Sapiens
PHDKHRLDR

SEQ ID NO: 354759 - protein, 9 aa, Homo Sapiens
RKFGVSQER

SEQ ID NO: 354760 - protein, 9 aa, Homo Sapiens
TGILYVDPV

SEQ ID NO: 354761 - protein, 9 aa, Homo Sapiens
DKQPGSPSP

SEQ ID NO: 354762 - protein, 9 aa, Homo Sapiens
RLRELARTL

SEQ ID NO: 354763 - protein, 9 aa, Homo Sapiens
QISNKGAKT

SEQ ID NO: 354764 - protein, 9 aa, Homo Sapiens
DIHGIINEN

SEQ ID NO: 354765 - protein, 9 aa, Homo Sapiens
EEHQFFEIQ

SEQ ID NO: 354766 - protein, 9 aa, Homo Sapiens
LHKSDCNSS

SEQ ID NO: 354767 - protein, 9 aa, Homo Sapiens
RAATCLQTR

SEQ ID NO: 354768 - protein, 9 aa, Homo Sapiens
CYFLLRASG

SEQ ID NO: 354769 - protein, 9 aa, Homo Sapiens
LILILMCFI

SEQ ID NO: 354770 - protein, 9 aa, Homo Sapiens
FSSKEVFQA

SEQ ID NO: 354771 - protein, 9 aa, Homo Sapiens
QWSEKRPHM

SEQ ID NO: 354772 - protein, 9 aa, Homo Sapiens
LFTATRNEI

SEQ ID NO: 354773 - protein, 9 aa, Homo Sapiens
RLSLKAEYK

SEQ ID NO: 354774 - protein, 9 aa, Homo Sapiens
PLFNTSKFT

SEQ ID NO: 354775 - protein, 9 aa, Homo Sapiens
EKLWLSLQD

SEQ ID NO: 354776 - protein, 9 aa, Homo Sapiens
SIGKGQFGE

SEQ ID NO: 354777 - protein, 9 aa, Homo Sapiens
TQNHGHNVC

SEQ ID NO: 354778 - protein, 9 aa, Homo Sapiens
YPDIALPLN

SEQ ID NO: 354779 - protein, 9 aa, Homo Sapiens
IRHFCKMSI

SEQ ID NO: 354780 - protein, 9 aa, Homo Sapiens
MQASKGLSN

SEQ ID NO: 354781 - protein, 9 aa, Homo Sapiens
PNEECLLLE

SEQ ID NO: 354782 - protein, 9 aa, Homo Sapiens
LHNQNGSEL

SEQ ID NO: 354783 - protein, 9 aa, Homo Sapiens
VLSRKSHLE

SEQ ID NO: 354784 - protein, 9 aa, Homo Sapiens
FNETLTELW

SEQ ID NO: 354785 - protein, 9 aa, Homo Sapiens
QVQKLNDSS

SEQ ID NO: 354786 - protein, 9 aa, Homo Sapiens
TLHKGWSQI

SEQ ID NO: 354787 - protein, 9 aa, Homo Sapiens
YPVLVSGII

SEQ ID NO: 354788 - protein, 9 aa, Homo Sapiens
HKFTKELHA

SEQ ID NO: 354789 - protein, 9 aa, Homo Sapiens
QNKFGEEIA

SEQ ID NO: 354790 - protein, 9 aa, Homo Sapiens
VSSLSDKSV

SEQ ID NO: 354791 - protein, 9 aa, Homo Sapiens
RHFCKMSIY

SEQ ID NO: 354792 - protein, 9 aa, Homo Sapiens
PIFFFGTHK

SEQ ID NO: 354793 - protein, 9 aa, Homo Sapiens
DLQNTVSKC

SEQ ID NO: 354794 - protein, 9 aa, Homo Sapiens
SFREKSVVI

SEQ ID NO: 354795 - protein, 9 aa, Homo Sapiens
WQNYNKILA

SEQ ID NO: 354796 - protein, 9 aa, Homo Sapiens
FTKELHAKL

SEQ ID NO: 354797 - protein, 9 aa, Homo Sapiens
SSVKESQWD

SEQ ID NO: 354798 - protein, 9 aa, Homo Sapiens
VREKLTDEC

SEQ ID NO: 354799 - protein, 9 aa, Homo Sapiens
IALKMLVNF

SEQ ID NO: 354800 - protein, 9 aa, Homo Sapiens
DTFYKINKN

SEQ ID NO: 354801 - protein, 9 aa, Homo Sapiens
GLSLVSAPG

SEQ ID NO: 354802 - protein, 9 aa, Homo Sapiens
DMKRKKVLD

SEQ ID NO: 354803 - protein, 9 aa, Homo Sapiens
YTLFVRKNN

SEQ ID NO: 354804 - protein, 9 aa, Homo Sapiens
QNQATTDAI

SEQ ID NO: 354805 - protein, 9 aa, Homo Sapiens
PVISGKHHI

SEQ ID NO: 354806 - protein, 9 aa, Homo Sapiens
VALDTLLYQ

SEQ ID NO: 354807 - protein, 9 aa, Homo Sapiens
GNYLTRQNS

SEQ ID NO: 354808 - protein, 9 aa, Homo Sapiens
KASDSVISM

SEQ ID NO: 354809 - protein, 9 aa, Homo Sapiens
ASYNLTVRK

SEQ ID NO: 354810 - protein, 9 aa, Homo Sapiens
PKNKGSMQN

SEQ ID NO: 354811 - protein, 9 aa, Homo Sapiens
VGAGHFWSQ

SEQ ID NO: 354812 - protein, 9 aa, Homo Sapiens
SENCLSAQG

SEQ ID NO: 354813 - protein, 9 aa, Homo Sapiens
AYGLKTANG

SEQ ID NO: 354814 - protein, 9 aa, Homo Sapiens
EGEDSISFQ

SEQ ID NO: 354815 - protein, 9 aa, Homo Sapiens
AQHVNNNLQ

SEQ ID NO: 354816 - protein, 9 aa, Homo Sapiens
EKTSNSTGE

SEQ ID NO: 354817 - protein, 9 aa, Homo Sapiens
DFNRRIQNE

SEQ ID NO: 354818 - protein, 9 aa, Homo Sapiens
IQREDFLRL

SEQ ID NO: 354819 - protein, 9 aa, Homo Sapiens
STPLMYFEL

SEQ ID NO: 354820 - protein, 9 aa, Homo Sapiens
TYWPFQGTM

SEQ ID NO: 354821 - protein, 9 aa, Homo Sapiens
VTKECSHVL

SEQ ID NO: 354822 - protein, 9 aa, Homo Sapiens
ALYIPGLFS

SEQ ID NO: 354823 - protein, 9 aa, Homo Sapiens
NTTVVTPFL

SEQ ID NO: 354824 - protein, 9 aa, Homo Sapiens
ENSFKYLLD

SEQ ID NO: 354825 - protein, 9 aa, Homo Sapiens
EASQNLSTP

SEQ ID NO: 354826 - protein, 9 aa, Homo Sapiens
CCLRKLLSK

SEQ ID NO: 354827 - protein, 9 aa, Homo Sapiens
DSPFWLPEP

SEQ ID NO: 354828 - protein, 9 aa, Homo Sapiens
IIGPRQGGG

SEQ ID NO: 354829 - protein, 9 aa, Homo Sapiens
DINDHGPVP

SEQ ID NO: 354830 - protein, 9 aa, Homo Sapiens
SLTTVLISP

SEQ ID NO: 354831 - protein, 9 aa, Homo Sapiens
TGEKLFKCN

SEQ ID NO: 354832 - protein, 9 aa, Homo Sapiens
KRSQGRISV

SEQ ID NO: 354833 - protein, 9 aa, Homo Sapiens
LILVLKRLS

SEQ ID NO: 354834 - protein, 9 aa, Homo Sapiens
EARQKEEKQ

SEQ ID NO: 354835 - protein, 9 aa, Homo Sapiens
MFKLLPGES

SEQ ID NO: 354836 - protein, 9 aa, Homo Sapiens
AEAKQMKVA

SEQ ID NO: 354837 - protein, 9 aa, Homo Sapiens
DICVGPEEQ

SEQ ID NO: 354838 - protein, 9 aa, Homo Sapiens
SQIGFINFI

SEQ ID NO: 354839 - protein, 9 aa, Homo Sapiens
RAKEIGQII

SEQ ID NO: 354840 - protein, 9 aa, Homo Sapiens
QACDCDPRG

SEQ ID NO: 354841 - protein, 9 aa, Homo Sapiens
VLVVLLTVA

SEQ ID NO: 354842 - protein, 9 aa, Homo Sapiens
AIIFGRLEI

SEQ ID NO: 354843 - protein, 9 aa, Homo Sapiens
TKAINGNYH

SEQ ID NO: 354844 - protein, 9 aa, Homo Sapiens
PISPKNKKP

SEQ ID NO: 354845 - protein, 9 aa, Homo Sapiens
CSCGLDYCP

SEQ ID NO: 354846 - protein, 9 aa, Homo Sapiens
CDTCMADTD

SEQ ID NO: 354847 - protein, 9 aa, Homo Sapiens
VQTGNIREE

SEQ ID NO: 354848 - protein, 9 aa, Homo Sapiens
SNNPQDDIA

SEQ ID NO: 354849 - protein, 9 aa, Homo Sapiens
FRQTNCLMT

SEQ ID NO: 354850 - protein, 9 aa, Homo Sapiens
QCMAKNEVG

SEQ ID NO: 354851 - protein, 9 aa, Homo Sapiens
YFTTKVPQK

SEQ ID NO: 354852 - protein, 9 aa, Homo Sapiens
DGRTHSKEV

SEQ ID NO: 354853 - protein, 9 aa, Homo Sapiens
LQDLLSDQN

SEQ ID NO: 354854 - protein, 9 aa, Homo Sapiens
DNDIGLTLA

SEQ ID NO: 354855 - protein, 9 aa, Homo Sapiens
LALLPGEWL

SEQ ID NO: 354856 - protein, 9 aa, Homo Sapiens
VRMKQLILE

SEQ ID NO: 354857 - protein, 9 aa, Homo Sapiens
SDLTRHRQI

SEQ ID NO: 354858 - protein, 9 aa, Homo Sapiens
ISANSNPAM

SEQ ID NO: 354859 - protein, 9 aa, Homo Sapiens
KGRPRLNQH

SEQ ID NO: 354860 - protein, 9 aa, Homo Sapiens
MNGIIKSLI

SEQ ID NO: 354861 - protein, 9 aa, Homo Sapiens
DYGINQPLL

SEQ ID NO: 354862 - protein, 9 aa, Homo Sapiens
QVLYQRVSR

SEQ ID NO: 354863 - protein, 9 aa, Homo Sapiens
FNDELPARI

SEQ ID NO: 354864 - protein, 9 aa, Homo Sapiens
SLNREMYSL

SEQ ID NO: 354865 - protein, 9 aa, Homo Sapiens
VERDSIHRQ

SEQ ID NO: 354866 - protein, 9 aa, Homo Sapiens
HFTTFDGQH

SEQ ID NO: 354867 - protein, 9 aa, Homo Sapiens
LQLRVQQLV

SEQ ID NO: 354868 - protein, 9 aa, Homo Sapiens
FPPHQETAE

SEQ ID NO: 354869 - protein, 9 aa, Homo Sapiens
TTVQKVMER

SEQ ID NO: 354870 - protein, 9 aa, Homo Sapiens
KGDDNPKES

SEQ ID NO: 354871 - protein, 9 aa, Homo Sapiens
IGEKLDERD

SEQ ID NO: 354872 - protein, 9 aa, Homo Sapiens
AAVKQRLSL

SEQ ID NO: 354873 - protein, 9 aa, Homo Sapiens
LKYIKTYLQ

SEQ ID NO: 354874 - protein, 9 aa, Homo Sapiens
HTGDKPFQC

SEQ ID NO: 354875 - protein, 9 aa, Homo Sapiens
GNPTKKTNS

SEQ ID NO: 354876 - protein, 9 aa, Homo Sapiens
TKRTNGKGI

SEQ ID NO: 354877 - protein, 9 aa, Homo Sapiens
GHRDLEIER

SEQ ID NO: 354878 - protein, 9 aa, Homo Sapiens
LLEIEDLKV

SEQ ID NO: 354879 - protein, 9 aa, Homo Sapiens
DATTCHIGV

SEQ ID NO: 354880 - protein, 9 aa, Homo Sapiens
SAVLLIGIH

SEQ ID NO: 354881 - protein, 9 aa, Homo Sapiens
LWLIQKLSW

SEQ ID NO: 354882 - protein, 9 aa, Homo Sapiens
KAQNFRTED

SEQ ID NO: 354883 - protein, 9 aa, Homo Sapiens
VPCGRWANI

SEQ ID NO: 354884 - protein, 9 aa, Homo Sapiens
PTVKNRRNF

SEQ ID NO: 354885 - protein, 9 aa, Homo Sapiens
KKLNKYENG

SEQ ID NO: 354886 - protein, 9 aa, Homo Sapiens
EIVTNIFIS

SEQ ID NO: 354887 - protein, 9 aa, Homo Sapiens
YLKEEEENN

SEQ ID NO: 354888 - protein, 9 aa, Homo Sapiens
HDNAKFQKK

SEQ ID NO: 354889 - protein, 9 aa, Homo Sapiens
AKIECDNKG

SEQ ID NO: 354890 - protein, 9 aa, Homo Sapiens
ESLNRHYHL

SEQ ID NO: 354891 - protein, 9 aa, Homo Sapiens
TDSWEHIHF

SEQ ID NO: 354892 - protein, 9 aa, Homo Sapiens
AGCEYLASA

SEQ ID NO: 354893 - protein, 9 aa, Homo Sapiens
GSCLVASEL

SEQ ID NO: 354894 - protein, 9 aa, Homo Sapiens
DSLHFSTEN

SEQ ID NO: 354895 - protein, 9 aa, Homo Sapiens
HKMLDQCPH

SEQ ID NO: 354896 - protein, 9 aa, Homo Sapiens
LMTNCMEHA

SEQ ID NO: 354897 - protein, 9 aa, Homo Sapiens
PDYVKKGDT

SEQ ID NO: 354898 - protein, 9 aa, Homo Sapiens
PSNCLGICS

SEQ ID NO: 354899 - protein, 9 aa, Homo Sapiens
QWLQKIKAI

SEQ ID NO: 354900 - protein, 9 aa, Homo Sapiens
EKGSEKLLK

SEQ ID NO: 354901 - protein, 9 aa, Homo Sapiens
SNISEKTKC

SEQ ID NO: 354902 - protein, 9 aa, Homo Sapiens
LHCYRDCPH

SEQ ID NO: 354903 - protein, 9 aa, Homo Sapiens
VALDKHIIG

SEQ ID NO: 354904 - protein, 9 aa, Homo Sapiens
SSSSLFPDF

SEQ ID NO: 354905 - protein, 9 aa, Homo Sapiens
NITVYETTV

SEQ ID NO: 354906 - protein, 9 aa, Homo Sapiens
IVSGNTPIT

SEQ ID NO: 354907 - protein, 9 aa, Homo Sapiens
TCTTCQILC

SEQ ID NO: 354908 - protein, 9 aa, Homo Sapiens
SEKCSSKKK

SEQ ID NO: 354909 - protein, 9 aa, Homo Sapiens
TWQGLLTAH

SEQ ID NO: 354910 - protein, 9 aa, Homo Sapiens
GDKVPADIQ

SEQ ID NO: 354911 - protein, 9 aa, Homo Sapiens
FQIYGLLVA

SEQ ID NO: 354912 - protein, 9 aa, Homo Sapiens
ENSQAFNPD

SEQ ID NO: 354913 - protein, 9 aa, Homo Sapiens
DVFRSNNFL

SEQ ID NO: 354914 - protein, 9 aa, Homo Sapiens
DQKLSVTFI

SEQ ID NO: 354915 - protein, 9 aa, Homo Sapiens
NTTFQLQVR

SEQ ID NO: 354916 - protein, 9 aa, Homo Sapiens
TDHGSCVQA

SEQ ID NO: 354917 - protein, 9 aa, Homo Sapiens
SLLQKLPPH

SEQ ID NO: 354918 - protein, 9 aa, Homo Sapiens
SNLEIGMYA

SEQ ID NO: 354919 - protein, 9 aa, Homo Sapiens
ELLGSYTEG

SEQ ID NO: 354920 - protein, 9 aa, Homo Sapiens
TYMLYIARA

SEQ ID NO: 354921 - protein, 9 aa, Homo Sapiens
FRYFRVPEL

SEQ ID NO: 354922 - protein, 9 aa, Homo Sapiens
HLPEMVGHP

SEQ ID NO: 354923 - protein, 9 aa, Homo Sapiens
WCLTNGNTL

SEQ ID NO: 354924 - protein, 9 aa, Homo Sapiens
KLLRMMIAK

SEQ ID NO: 354925 - protein, 9 aa, Homo Sapiens
ATKLVKLKY

SEQ ID NO: 354926 - protein, 9 aa, Homo Sapiens
MVVHDIRNY

SEQ ID NO: 354927 - protein, 9 aa, Homo Sapiens
SYSNINNGL

SEQ ID NO: 354928 - protein, 9 aa, Homo Sapiens
PIVKVRYER

SEQ ID NO: 354929 - protein, 9 aa, Homo Sapiens
ARVFTVINQ

SEQ ID NO: 354930 - protein, 9 aa, Homo Sapiens
IMQSIKGWR

SEQ ID NO: 354931 - protein, 9 aa, Homo Sapiens
DHVSELEAD

SEQ ID NO: 354932 - protein, 9 aa, Homo Sapiens
KKSFVKGTI

SEQ ID NO: 354933 - protein, 9 aa, Homo Sapiens
CYRDCPHEV

SEQ ID NO: 354934 - protein, 9 aa, Homo Sapiens
PTLPYRYNL

SEQ ID NO: 354935 - protein, 9 aa, Homo Sapiens
HLLEEIKEQ

SEQ ID NO: 354936 - protein, 9 aa, Homo Sapiens
TELLSITEI

SEQ ID NO: 354937 - protein, 9 aa, Homo Sapiens
WENHLKQND

SEQ ID NO: 354938 - protein, 9 aa, Homo Sapiens
NERCIKFVP

SEQ ID NO: 354939 - protein, 9 aa, Homo Sapiens
LYDCQSPDE

SEQ ID NO: 354940 - protein, 9 aa, Homo Sapiens
RVLDCHKKD

SEQ ID NO: 354941 - protein, 9 aa, Homo Sapiens
KQRMELEQN

SEQ ID NO: 354942 - protein, 9 aa, Homo Sapiens
HCVVCSTPQ

SEQ ID NO: 354943 - protein, 9 aa, Homo Sapiens
QRIATRKKI

SEQ ID NO: 354944 - protein, 9 aa, Homo Sapiens
AKLAHLAGL

SEQ ID NO: 354945 - protein, 9 aa, Homo Sapiens
KLSQAKTQI

SEQ ID NO: 354946 - protein, 9 aa, Homo Sapiens
GTSQKITYE

SEQ ID NO: 354947 - protein, 9 aa, Homo Sapiens
IIIISMILC

SEQ ID NO: 354948 - protein, 9 aa, Homo Sapiens
NAPWTLIPE

SEQ ID NO: 354949 - protein, 9 aa, Homo Sapiens
ASRLSSFSL

SEQ ID NO: 354950 - protein, 9 aa, Homo Sapiens
NIYSGQVQQ

SEQ ID NO: 354951 - protein, 9 aa, Homo Sapiens
CTREEIQEV

SEQ ID NO: 354952 - protein, 9 aa, Homo Sapiens
RTIILWKLM

SEQ ID NO: 354953 - protein, 9 aa, Homo Sapiens
GNQCGKPKG

SEQ ID NO: 354954 - protein, 9 aa, Homo Sapiens
SRPPHLHRA

SEQ ID NO: 354955 - protein, 9 aa, Homo Sapiens
SPFVPEEMM

SEQ ID NO: 354956 - protein, 9 aa, Homo Sapiens
KFTEGEDKI

SEQ ID NO: 354957 - protein, 9 aa, Homo Sapiens
LLEEIKEQE

SEQ ID NO: 354958 - protein, 9 aa, Homo Sapiens
LLTLRPRCI

SEQ ID NO: 354959 - protein, 9 aa, Homo Sapiens
RGFSAGLWD

SEQ ID NO: 354960 - protein, 9 aa, Homo Sapiens
MPLVTSMSG

SEQ ID NO: 354961 - protein, 9 aa, Homo Sapiens
EIMFPDQTV

SEQ ID NO: 354962 - protein, 9 aa, Homo Sapiens
NCSSSFQYH

SEQ ID NO: 354963 - protein, 9 aa, Homo Sapiens
LTQHQRVNS

SEQ ID NO: 354964 - protein, 9 aa, Homo Sapiens
SQEDSDTPA

SEQ ID NO: 354965 - protein, 9 aa, Homo Sapiens
TLKECVQLV

SEQ ID NO: 354966 - protein, 9 aa, Homo Sapiens
KDNEARKGN

SEQ ID NO: 354967 - protein, 9 aa, Homo Sapiens
RACVIHFME

SEQ ID NO: 354968 - protein, 9 aa, Homo Sapiens
SRREQMTDM

SEQ ID NO: 354969 - protein, 9 aa, Homo Sapiens
VNLNTGMQT

SEQ ID NO: 354970 - protein, 9 aa, Homo Sapiens
THSKEVNIL

SEQ ID NO: 354971 - protein, 9 aa, Homo Sapiens
TALCGAAHR

SEQ ID NO: 354972 - protein, 9 aa, Homo Sapiens
DCPHEVLLC

SEQ ID NO: 354973 - protein, 9 aa, Homo Sapiens
LYNKFNHYD

SEQ ID NO: 354974 - protein, 9 aa, Homo Sapiens
IVLNRPSSI

SEQ ID NO: 354975 - protein, 9 aa, Homo Sapiens
EAKDAHLVL

SEQ ID NO: 354976 - protein, 9 aa, Homo Sapiens
PGTARTMCQ

SEQ ID NO: 354977 - protein, 9 aa, Homo Sapiens
QTPICDPTV

SEQ ID NO: 354978 - protein, 9 aa, Homo Sapiens
FLSNVTSNY

SEQ ID NO: 354979 - protein, 9 aa, Homo Sapiens
SSDLMAQPP

SEQ ID NO: 354980 - protein, 9 aa, Homo Sapiens
INYQSSSPL

SEQ ID NO: 354981 - protein, 9 aa, Homo Sapiens
AVVRIMNLI

SEQ ID NO: 354982 - protein, 9 aa, Homo Sapiens
DKKENKPTV

SEQ ID NO: 354983 - protein, 9 aa, Homo Sapiens
EQLRAHLDG

SEQ ID NO: 354984 - protein, 9 aa, Homo Sapiens
ETLKGTTED

SEQ ID NO: 354985 - protein, 9 aa, Homo Sapiens
NNIFSIVPV

SEQ ID NO: 354986 - protein, 9 aa, Homo Sapiens
ERISIPPSP

SEQ ID NO: 354987 - protein, 9 aa, Homo Sapiens
TEPSKTVPT

SEQ ID NO: 354988 - protein, 9 aa, Homo Sapiens
ELDCEGDIS

SEQ ID NO: 354989 - protein, 9 aa, Homo Sapiens
QWWNRVCGH

SEQ ID NO: 354990 - protein, 9 aa, Homo Sapiens
VFNYLAKHN

SEQ ID NO: 354991 - protein, 9 aa, Homo Sapiens
QVASLSWDL

SEQ ID NO: 354992 - protein, 9 aa, Homo Sapiens
NAREWTRMH

SEQ ID NO: 354993 - protein, 9 aa, Homo Sapiens
LASQSKACD

SEQ ID NO: 354994 - protein, 9 aa, Homo Sapiens
AMLHFSLFV

SEQ ID NO: 354995 - protein, 9 aa, Homo Sapiens
TVIFTLTSV

SEQ ID NO: 354996 - protein, 9 aa, Homo Sapiens
KLTSVEKSL

SEQ ID NO: 354997 - protein, 9 aa, Homo Sapiens
TGLSFYQQI

SEQ ID NO: 354998 - protein, 9 aa, Homo Sapiens
LALEANMTK

SEQ ID NO: 354999 - protein, 9 aa, Homo Sapiens
LQKLVSFDQ

SEQ ID NO: 355000 - protein, 9 aa, Homo Sapiens
DTEKGSEKL

SEQ ID NO: 355001 - protein, 9 aa, Homo Sapiens
TKILPWYPQ

SEQ ID NO: 355002 - protein, 9 aa, Homo Sapiens
PFEIFFGRQ

SEQ ID NO: 355003 - protein, 9 aa, Homo Sapiens
NVLQSEKET

SEQ ID NO: 355004 - protein, 9 aa, Homo Sapiens
ITLLNKLDE

SEQ ID NO: 355005 - protein, 9 aa, Homo Sapiens
IKLFFSGSA

SEQ ID NO: 355006 - protein, 9 aa, Homo Sapiens
CIDWFYTIV

SEQ ID NO: 355007 - protein, 9 aa, Homo Sapiens
FCFAASTFP

SEQ ID NO: 355008 - protein, 9 aa, Homo Sapiens
LFYDQDNSS

SEQ ID NO: 355009 - protein, 9 aa, Homo Sapiens
LQKEKKRKK

SEQ ID NO: 355010 - protein, 9 aa, Homo Sapiens
RCTKRGWMW

SEQ ID NO: 355011 - protein, 9 aa, Homo Sapiens
KAINGNYHR

SEQ ID NO: 355012 - protein, 9 aa, Homo Sapiens
DNSFMKMLR

SEQ ID NO: 355013 - protein, 9 aa, Homo Sapiens
NCYGSEQEF

SEQ ID NO: 355014 - protein, 9 aa, Homo Sapiens
EFFSFENVK

SEQ ID NO: 355015 - protein, 9 aa, Homo Sapiens
WMWSASDLS

SEQ ID NO: 355016 - protein, 9 aa, Homo Sapiens
SSRKVNDGK

SEQ ID NO: 355017 - protein, 9 aa, Homo Sapiens
LITQLELDP

SEQ ID NO: 355018 - protein, 9 aa, Homo Sapiens
NSVTSRPKP

SEQ ID NO: 355019 - protein, 9 aa, Homo Sapiens
KGTLEEPQT

SEQ ID NO: 355020 - protein, 9 aa, Homo Sapiens
PEAIFSNAY

SEQ ID NO: 355021 - protein, 9 aa, Homo Sapiens
TPSGTQSSQ

SEQ ID NO: 355022 - protein, 9 aa, Homo Sapiens
VKTKKFTLT

SEQ ID NO: 355023 - protein, 9 aa, Homo Sapiens
DKFCTKLYQ

SEQ ID NO: 355024 - protein, 9 aa, Homo Sapiens
CLLTKNKIR

SEQ ID NO: 355025 - protein, 9 aa, Homo Sapiens
TSKFTLERN

SEQ ID NO: 355026 - protein, 9 aa, Homo Sapiens
SSVNVENTL

SEQ ID NO: 355027 - protein, 9 aa, Homo Sapiens
VISGKHHIL

SEQ ID NO: 355028 - protein, 9 aa, Homo Sapiens
VFVVSWLPL

SEQ ID NO: 355029 - protein, 9 aa, Homo Sapiens
AWTFYSGAF

SEQ ID NO: 355030 - protein, 9 aa, Homo Sapiens
VKGDELDAM

SEQ ID NO: 355031 - protein, 9 aa, Homo Sapiens
TSSCTNQNA

SEQ ID NO: 355032 - protein, 9 aa, Homo Sapiens
ACKKHKLYV

SEQ ID NO: 355033 - protein, 9 aa, Homo Sapiens
FNTLHVGGI

SEQ ID NO: 355034 - protein, 9 aa, Homo Sapiens
NMCGISEAQ

SEQ ID NO: 355035 - protein, 9 aa, Homo Sapiens
TSSSALQSH

SEQ ID NO: 355036 - protein, 9 aa, Homo Sapiens
RTLETDDGV

SEQ ID NO: 355037 - protein, 9 aa, Homo Sapiens
LARVSLVCK

SEQ ID NO: 355038 - protein, 9 aa, Homo Sapiens
PFTKGEILV

SEQ ID NO: 355039 - protein, 9 aa, Homo Sapiens
EEEPPQQPP

SEQ ID NO: 355040 - protein, 9 aa, Homo Sapiens
RQKTRVFVV

SEQ ID NO: 355041 - protein, 9 aa, Homo Sapiens
VVGYNGPNL

SEQ ID NO: 355042 - protein, 9 aa, Homo Sapiens
KLDNLVYYN

SEQ ID NO: 355043 - protein, 9 aa, Homo Sapiens
TKAGATVTV

SEQ ID NO: 355044 - protein, 9 aa, Homo Sapiens
AQSLGERTV

SEQ ID NO: 355045 - protein, 9 aa, Homo Sapiens
IQFPLMTPQ

SEQ ID NO: 355046 - protein, 9 aa, Homo Sapiens
TEEEPPQQP

SEQ ID NO: 355047 - protein, 9 aa, Homo Sapiens
TTQKSVPDV

SEQ ID NO: 355048 - protein, 9 aa, Homo Sapiens
AQLAGEDAD

SEQ ID NO: 355049 - protein, 9 aa, Homo Sapiens
FDGTQARLL

SEQ ID NO: 355050 - protein, 9 aa, Homo Sapiens
LYAAILGYD

SEQ ID NO: 355051 - protein, 9 aa, Homo Sapiens
IGVIDKKKD

SEQ ID NO: 355052 - protein, 9 aa, Homo Sapiens
AKRAIQTGK

SEQ ID NO: 355053 - protein, 9 aa, Homo Sapiens
AFSAFQQIG

SEQ ID NO: 355054 - protein, 9 aa, Homo Sapiens
LIRDSMERG

SEQ ID NO: 355055 - protein, 9 aa, Homo Sapiens
EESYNINDY

SEQ ID NO: 355056 - protein, 9 aa, Homo Sapiens
QCPVAVKKT

SEQ ID NO: 355057 - protein, 9 aa, Homo Sapiens
THKILHTKE

SEQ ID NO: 355058 - protein, 9 aa, Homo Sapiens
LFAISASLK

SEQ ID NO: 355059 - protein, 9 aa, Homo Sapiens
QKDDEENYW

SEQ ID NO: 355060 - protein, 9 aa, Homo Sapiens
KYCANHFAD

SEQ ID NO: 355061 - protein, 9 aa, Homo Sapiens
YKLVMETRE

SEQ ID NO: 355062 - protein, 9 aa, Homo Sapiens
SLGGAIDIP

SEQ ID NO: 355063 - protein, 9 aa, Homo Sapiens
QQISNNTVS

SEQ ID NO: 355064 - protein, 9 aa, Homo Sapiens
FFFGTHKTA

SEQ ID NO: 355065 - protein, 9 aa, Homo Sapiens
RLKEPQQDG

SEQ ID NO: 355066 - protein, 9 aa, Homo Sapiens
SEKIMWTTV

SEQ ID NO: 355067 - protein, 9 aa, Homo Sapiens
IWFNSVAKT

SEQ ID NO: 355068 - protein, 9 aa, Homo Sapiens
SKNTCFEWA

SEQ ID NO: 355069 - protein, 9 aa, Homo Sapiens
YLLDQLKDV

SEQ ID NO: 355070 - protein, 9 aa, Homo Sapiens
DSRCPSEIV

SEQ ID NO: 355071 - protein, 9 aa, Homo Sapiens
LPFEPSNKL

SEQ ID NO: 355072 - protein, 9 aa, Homo Sapiens
NDTVQKQSE

SEQ ID NO: 355073 - protein, 9 aa, Homo Sapiens
NSLSQSGSD

SEQ ID NO: 355074 - protein, 9 aa, Homo Sapiens
LVDKDLDLF

SEQ ID NO: 355075 - protein, 9 aa, Homo Sapiens
KMEYFSAVP

SEQ ID NO: 355076 - protein, 9 aa, Homo Sapiens
DRSPRANLP

SEQ ID NO: 355077 - protein, 9 aa, Homo Sapiens
FQPELFDVT

SEQ ID NO: 355078 - protein, 9 aa, Homo Sapiens
VYSKLKYHP

SEQ ID NO: 355079 - protein, 9 aa, Homo Sapiens
ADLFAFSFG

SEQ ID NO: 355080 - protein, 9 aa, Homo Sapiens
TDRTTELSE

SEQ ID NO: 355081 - protein, 9 aa, Homo Sapiens
DDGLDVRKT

SEQ ID NO: 355082 - protein, 9 aa, Homo Sapiens
NYSKKDKGK

SEQ ID NO: 355083 - protein, 9 aa, Homo Sapiens
CQYDKIHQS

SEQ ID NO: 355084 - protein, 9 aa, Homo Sapiens
IKGKRHRKK

SEQ ID NO: 355085 - protein, 9 aa, Homo Sapiens
EKALHIGIS

SEQ ID NO: 355086 - protein, 9 aa, Homo Sapiens
QPCGKRFPQ

SEQ ID NO: 355087 - protein, 9 aa, Homo Sapiens
LSLYEVVHR

SEQ ID NO: 355088 - protein, 9 aa, Homo Sapiens
VHRKIHSGE

SEQ ID NO: 355089 - protein, 9 aa, Homo Sapiens
CLAAIAPSI

SEQ ID NO: 355090 - protein, 9 aa, Homo Sapiens
WSCESICLV

SEQ ID NO: 355091 - protein, 9 aa, Homo Sapiens
TEKKNYAKR

SEQ ID NO: 355092 - protein, 9 aa, Homo Sapiens
RNFEESKGR

SEQ ID NO: 355093 - protein, 9 aa, Homo Sapiens
PVNKCSAFQ

SEQ ID NO: 355094 - protein, 9 aa, Homo Sapiens
GTEASALKG

SEQ ID NO: 355095 - protein, 9 aa, Homo Sapiens
LGRVGDCLV

SEQ ID NO: 355096 - protein, 9 aa, Homo Sapiens
RRQQHTSSL

SEQ ID NO: 355097 - protein, 9 aa, Homo Sapiens
KLCHEQFYQ

SEQ ID NO: 355098 - protein, 9 aa, Homo Sapiens
RVIDRWKAL

SEQ ID NO: 355099 - protein, 9 aa, Homo Sapiens
THDKDLREN

SEQ ID NO: 355100 - protein, 9 aa, Homo Sapiens
TYVLGQNSP

SEQ ID NO: 355101 - protein, 9 aa, Homo Sapiens
KLARQTYPK

SEQ ID NO: 355102 - protein, 9 aa, Homo Sapiens
WNLVMYDGI

SEQ ID NO: 355103 - protein, 9 aa, Homo Sapiens
RPLAVRACV

SEQ ID NO: 355104 - protein, 9 aa, Homo Sapiens
IDEIQNGPY

SEQ ID NO: 355105 - protein, 9 aa, Homo Sapiens
TGVAIATIL

SEQ ID NO: 355106 - protein, 9 aa, Homo Sapiens
PPSMAGHSS

SEQ ID NO: 355107 - protein, 9 aa, Homo Sapiens
TEGDFANNE

SEQ ID NO: 355108 - protein, 9 aa, Homo Sapiens
SGLLIRMSM

SEQ ID NO: 355109 - protein, 9 aa, Homo Sapiens
STQTGKQQL

SEQ ID NO: 355110 - protein, 9 aa, Homo Sapiens
IYVKPKQTQ

SEQ ID NO: 355111 - protein, 9 aa, Homo Sapiens
GSLGSCQAL

SEQ ID NO: 355112 - protein, 9 aa, Homo Sapiens
VFEAFLNSY

SEQ ID NO: 355113 - protein, 9 aa, Homo Sapiens
IGERVHTLV

SEQ ID NO: 355114 - protein, 9 aa, Homo Sapiens
NTCTIDGLL

SEQ ID NO: 355115 - protein, 9 aa, Homo Sapiens
RVVFQISQP

SEQ ID NO: 355116 - protein, 9 aa, Homo Sapiens
TLTGLPWSL

SEQ ID NO: 355117 - protein, 9 aa, Homo Sapiens
RLITEKKDN

SEQ ID NO: 355118 - protein, 9 aa, Homo Sapiens
YKSSKALST

SEQ ID NO: 355119 - protein, 9 aa, Homo Sapiens
INQLTAMSS

SEQ ID NO: 355120 - protein, 9 aa, Homo Sapiens
VYVAFGAPI

SEQ ID NO: 355121 - protein, 9 aa, Homo Sapiens
GNVFPITSI

SEQ ID NO: 355122 - protein, 9 aa, Homo Sapiens
YKPDENEVQ

SEQ ID NO: 355123 - protein, 9 aa, Homo Sapiens
CAVREKLTD

SEQ ID NO: 355124 - protein, 9 aa, Homo Sapiens
AQVHIAEDQ

SEQ ID NO: 355125 - protein, 9 aa, Homo Sapiens
CKCKDTWSG

SEQ ID NO: 355126 - protein, 9 aa, Homo Sapiens
LFSEENSDE

SEQ ID NO: 355127 - protein, 9 aa, Homo Sapiens
YCPHCGEKS

SEQ ID NO: 355128 - protein, 9 aa, Homo Sapiens
QAHKLAKSY

SEQ ID NO: 355129 - protein, 9 aa, Homo Sapiens
SATISWFWD

SEQ ID NO: 355130 - protein, 9 aa, Homo Sapiens
TGEDWNLVM

SEQ ID NO: 355131 - protein, 9 aa, Homo Sapiens
TARCEWNYF

SEQ ID NO: 355132 - protein, 9 aa, Homo Sapiens
ALPFYPASV

SEQ ID NO: 355133 - protein, 9 aa, Homo Sapiens
TLKTLTFKL

SEQ ID NO: 355134 - protein, 9 aa, Homo Sapiens
AGLSAQSPR

SEQ ID NO: 355135 - protein, 9 aa, Homo Sapiens
SYEAPRGDK

SEQ ID NO: 355136 - protein, 9 aa, Homo Sapiens
RFFYYFRGV

SEQ ID NO: 355137 - protein, 9 aa, Homo Sapiens
GGMRDLHKS

SEQ ID NO: 355138 - protein, 9 aa, Homo Sapiens
LDQPPTVMF

SEQ ID NO: 355139 - protein, 9 aa, Homo Sapiens
LVTANTTFC

SEQ ID NO: 355140 - protein, 9 aa, Homo Sapiens
LDTVKEYPL

SEQ ID NO: 355141 - protein, 9 aa, Homo Sapiens
TEREASKIM

SEQ ID NO: 355142 - protein, 9 aa, Homo Sapiens
GEDIAFLAT

SEQ ID NO: 355143 - protein, 9 aa, Homo Sapiens
FCGISPILK

SEQ ID NO: 355144 - protein, 9 aa, Homo Sapiens
VGLGLISIF

SEQ ID NO: 355145 - protein, 9 aa, Homo Sapiens
KSKGYDFES

SEQ ID NO: 355146 - protein, 9 aa, Homo Sapiens
IERELEEGC

SEQ ID NO: 355147 - protein, 9 aa, Homo Sapiens
GLTYHVHNL

SEQ ID NO: 355148 - protein, 9 aa, Homo Sapiens
SEGAQVMRN

SEQ ID NO: 355149 - protein, 9 aa, Homo Sapiens
TVVTPFLTK

SEQ ID NO: 355150 - protein, 9 aa, Homo Sapiens
VCMMNESSI

SEQ ID NO: 355151 - protein, 9 aa, Homo Sapiens
QNGSLKTWN

SEQ ID NO: 355152 - protein, 9 aa, Homo Sapiens
LPPCELYVF

SEQ ID NO: 355153 - protein, 9 aa, Homo Sapiens
IALAVITQS

SEQ ID NO: 355154 - protein, 9 aa, Homo Sapiens
VVVRATCSG

SEQ ID NO: 355155 - protein, 9 aa, Homo Sapiens
RKITSMETA

SEQ ID NO: 355156 - protein, 9 aa, Homo Sapiens
QGVIRHCVV

SEQ ID NO: 355157 - protein, 9 aa, Homo Sapiens
FVRFVLMFY

SEQ ID NO: 355158 - protein, 9 aa, Homo Sapiens
DGTQHRVLF

SEQ ID NO: 355159 - protein, 9 aa, Homo Sapiens
LWPTMENIL

SEQ ID NO: 355160 - protein, 9 aa, Homo Sapiens
KSSKNASLR

SEQ ID NO: 355161 - protein, 9 aa, Homo Sapiens
HGSTYCWHS

SEQ ID NO: 355162 - protein, 9 aa, Homo Sapiens
KRTKEQMDR

SEQ ID NO: 355163 - protein, 9 aa, Homo Sapiens
GSEYGVLYK

SEQ ID NO: 355164 - protein, 9 aa, Homo Sapiens
LCLISFLLL

SEQ ID NO: 355165 - protein, 9 aa, Homo Sapiens
VFTWTKHGV

SEQ ID NO: 355166 - protein, 9 aa, Homo Sapiens
SQHKIIYTR

SEQ ID NO: 355167 - protein, 9 aa, Homo Sapiens
YIDFLMLYF

SEQ ID NO: 355168 - protein, 9 aa, Homo Sapiens
KTQMICQQH

SEQ ID NO: 355169 - protein, 9 aa, Homo Sapiens
SVLTGTSEP

SEQ ID NO: 355170 - protein, 9 aa, Homo Sapiens
QRLLLISGN

SEQ ID NO: 355171 - protein, 9 aa, Homo Sapiens
MMNESSIDY

SEQ ID NO: 355172 - protein, 9 aa, Homo Sapiens
LRIHQHMHT

SEQ ID NO: 355173 - protein, 9 aa, Homo Sapiens
AGKMDLDHN

SEQ ID NO: 355174 - protein, 9 aa, Homo Sapiens
IIYVDGASN

SEQ ID NO: 355175 - protein, 9 aa, Homo Sapiens
IEYGNKSGK

SEQ ID NO: 355176 - protein, 9 aa, Homo Sapiens
CTIVKKDAF

SEQ ID NO: 355177 - protein, 9 aa, Homo Sapiens
ELCHKPQRG

SEQ ID NO: 355178 - protein, 9 aa, Homo Sapiens
IALGNGAST

SEQ ID NO: 355179 - protein, 9 aa, Homo Sapiens
MKSAEGRTK

SEQ ID NO: 355180 - protein, 9 aa, Homo Sapiens
NILFVITTP

SEQ ID NO: 355181 - protein, 9 aa, Homo Sapiens
KAMSSPRIL

SEQ ID NO: 355182 - protein, 9 aa, Homo Sapiens
KPEQSFEIL

SEQ ID NO: 355183 - protein, 9 aa, Homo Sapiens
IHDGGVYRC

SEQ ID NO: 355184 - protein, 9 aa, Homo Sapiens
ELSTNTQEN

SEQ ID NO: 355185 - protein, 9 aa, Homo Sapiens
RMYSLKGKS

SEQ ID NO: 355186 - protein, 9 aa, Homo Sapiens
QTAQRSALL

SEQ ID NO: 355187 - protein, 9 aa, Homo Sapiens
RDVQTDCTH

SEQ ID NO: 355188 - protein, 9 aa, Homo Sapiens
KEEVWLQYE

SEQ ID NO: 355189 - protein, 9 aa, Homo Sapiens
DQIGLALLN

SEQ ID NO: 355190 - protein, 9 aa, Homo Sapiens
LKWNELNAG

SEQ ID NO: 355191 - protein, 9 aa, Homo Sapiens
LSKLCGSLP

SEQ ID NO: 355192 - protein, 9 aa, Homo Sapiens
FNKSVDFKM

SEQ ID NO: 355193 - protein, 9 aa, Homo Sapiens
TYKDHLEGQ

SEQ ID NO: 355194 - protein, 9 aa, Homo Sapiens
QGKKTEEFF

SEQ ID NO: 355195 - protein, 9 aa, Homo Sapiens
SPASSLGER

SEQ ID NO: 355196 - protein, 9 aa, Homo Sapiens
FRNKYQTEQ

SEQ ID NO: 355197 - protein, 9 aa, Homo Sapiens
KEKQTETTA

SEQ ID NO: 355198 - protein, 9 aa, Homo Sapiens
KRNNRRKNK

SEQ ID NO: 355199 - protein, 9 aa, Homo Sapiens
FADNDIGLT

SEQ ID NO: 355200 - protein, 9 aa, Homo Sapiens
AADPPAENL

SEQ ID NO: 355201 - protein, 9 aa, Homo Sapiens
DIKELFLGL

SEQ ID NO: 355202 - protein, 9 aa, Homo Sapiens
HRKKLILAK

SEQ ID NO: 355203 - protein, 9 aa, Homo Sapiens
VLYRLGRLE

SEQ ID NO: 355204 - protein, 9 aa, Homo Sapiens
ENNWFKWFI

SEQ ID NO: 355205 - protein, 9 aa, Homo Sapiens
TAMAGKTDQ

SEQ ID NO: 355206 - protein, 9 aa, Homo Sapiens
SLDVKKVKK

SEQ ID NO: 355207 - protein, 9 aa, Homo Sapiens
LRRLENNHP

SEQ ID NO: 355208 - protein, 9 aa, Homo Sapiens
TLHVGGIIR

SEQ ID NO: 355209 - protein, 9 aa, Homo Sapiens
QKFGKAFAF

SEQ ID NO: 355210 - protein, 9 aa, Homo Sapiens
DILLRHCDV

SEQ ID NO: 355211 - protein, 9 aa, Homo Sapiens
CLYHKGHPP

SEQ ID NO: 355212 - protein, 9 aa, Homo Sapiens
EDVVYYAFK

SEQ ID NO: 355213 - protein, 9 aa, Homo Sapiens
LSPMKSFLS

SEQ ID NO: 355214 - protein, 9 aa, Homo Sapiens
QIIQENERL

SEQ ID NO: 355215 - protein, 9 aa, Homo Sapiens
TVEQLQCEH

SEQ ID NO: 355216 - protein, 9 aa, Homo Sapiens
MRAKGTPDK

SEQ ID NO: 355217 - protein, 9 aa, Homo Sapiens
TSLACKIHD

SEQ ID NO: 355218 - protein, 9 aa, Homo Sapiens
STKPIQSPA

SEQ ID NO: 355219 - protein, 9 aa, Homo Sapiens
TTLTKYFTS

SEQ ID NO: 355220 - protein, 9 aa, Homo Sapiens
MSRITMQEK

SEQ ID NO: 355221 - protein, 9 aa, Homo Sapiens
DSLCTLGVV

SEQ ID NO: 355222 - protein, 9 aa, Homo Sapiens
YVKKCLNGV

SEQ ID NO: 355223 - protein, 9 aa, Homo Sapiens
HFSSKEVFQ

SEQ ID NO: 355224 - protein, 9 aa, Homo Sapiens
CFTFVLAVV

SEQ ID NO: 355225 - protein, 9 aa, Homo Sapiens
VQEVLSPIP

SEQ ID NO: 355226 - protein, 9 aa, Homo Sapiens
PTLSPQPQG

SEQ ID NO: 355227 - protein, 9 aa, Homo Sapiens
EEAQKHLKM

SEQ ID NO: 355228 - protein, 9 aa, Homo Sapiens
RPPEYELFW

SEQ ID NO: 355229 - protein, 9 aa, Homo Sapiens
LACLKEEWM

SEQ ID NO: 355230 - protein, 9 aa, Homo Sapiens
SALALQHRL

SEQ ID NO: 355231 - protein, 9 aa, Homo Sapiens
KIKFFKCLY

SEQ ID NO: 355232 - protein, 9 aa, Homo Sapiens
ANSCIILKI

SEQ ID NO: 355233 - protein, 9 aa, Homo Sapiens
YPDITYIFT

SEQ ID NO: 355234 - protein, 9 aa, Homo Sapiens
LQSDMYILN

SEQ ID NO: 355235 - protein, 9 aa, Homo Sapiens
ITSMETALA

SEQ ID NO: 355236 - protein, 9 aa, Homo Sapiens
KKTRKDLNR

SEQ ID NO: 355237 - protein, 9 aa, Homo Sapiens
TAPSDICAA

SEQ ID NO: 355238 - protein, 9 aa, Homo Sapiens
NKILSNVKK

SEQ ID NO: 355239 - protein, 9 aa, Homo Sapiens
TTCHIGVLR

SEQ ID NO: 355240 - protein, 9 aa, Homo Sapiens
ITAERIKLL

SEQ ID NO: 355241 - protein, 9 aa, Homo Sapiens
NNGFINEDV

SEQ ID NO: 355242 - protein, 9 aa, Homo Sapiens
HHRIFFPRK

SEQ ID NO: 355243 - protein, 9 aa, Homo Sapiens
QGGRYYCKV

SEQ ID NO: 355244 - protein, 9 aa, Homo Sapiens
RRYKCKQCG

SEQ ID NO: 355245 - protein, 9 aa, Homo Sapiens
VAQVIQSAK

SEQ ID NO: 355246 - protein, 9 aa, Homo Sapiens
YTLVIPIQY

SEQ ID NO: 355247 - protein, 9 aa, Homo Sapiens
GQIELVQKL

SEQ ID NO: 355248 - protein, 9 aa, Homo Sapiens
VASYIESIL

SEQ ID NO: 355249 - protein, 9 aa, Homo Sapiens
EARRQQYPS

SEQ ID NO: 355250 - protein, 9 aa, Homo Sapiens
LFLSQTAQR

SEQ ID NO: 355251 - protein, 9 aa, Homo Sapiens
VIFIATANT

SEQ ID NO: 355252 - protein, 9 aa, Homo Sapiens
DLSQVIFIA

SEQ ID NO: 355253 - protein, 9 aa, Homo Sapiens
PDAGGVFLS

SEQ ID NO: 355254 - protein, 9 aa, Homo Sapiens
PPRKQRRQP

SEQ ID NO: 355255 - protein, 9 aa, Homo Sapiens
YTRANSCII

SEQ ID NO: 355256 - protein, 9 aa, Homo Sapiens
QIRYERDNN

SEQ ID NO: 355257 - protein, 9 aa, Homo Sapiens
FNLYITKQI

SEQ ID NO: 355258 - protein, 9 aa, Homo Sapiens
GIASSIMEN

SEQ ID NO: 355259 - protein, 9 aa, Homo Sapiens
ADLSKDSLG

SEQ ID NO: 355260 - protein, 9 aa, Homo Sapiens
QKIPPPVAP

SEQ ID NO: 355261 - protein, 9 aa, Homo Sapiens
QLSLDMLKQ

SEQ ID NO: 355262 - protein, 9 aa, Homo Sapiens
GIMLQNPRS

SEQ ID NO: 355263 - protein, 9 aa, Homo Sapiens
RAEYVWLAI

SEQ ID NO: 355264 - protein, 9 aa, Homo Sapiens
VEKAISKKV

SEQ ID NO: 355265 - protein, 9 aa, Homo Sapiens
TEHKRINAG

SEQ ID NO: 355266 - protein, 9 aa, Homo Sapiens
ICVGCSTVL

SEQ ID NO: 355267 - protein, 9 aa, Homo Sapiens
TCKSNWHGG

SEQ ID NO: 355268 - protein, 9 aa, Homo Sapiens
AQQGPQHYP

SEQ ID NO: 355269 - protein, 9 aa, Homo Sapiens
SSDSEEEDE

SEQ ID NO: 355270 - protein, 9 aa, Homo Sapiens
KLMMSVAGR

SEQ ID NO: 355271 - protein, 9 aa, Homo Sapiens
ERGALVGLS

SEQ ID NO: 355272 - protein, 9 aa, Homo Sapiens
GLVDTECCL

SEQ ID NO: 355273 - protein, 9 aa, Homo Sapiens
QCQVNLIFC

SEQ ID NO: 355274 - protein, 9 aa, Homo Sapiens
LPFPIIDGR

SEQ ID NO: 355275 - protein, 9 aa, Homo Sapiens
ISNTKETLK

SEQ ID NO: 355276 - protein, 9 aa, Homo Sapiens
ETLKDTTLQ

SEQ ID NO: 355277 - protein, 9 aa, Homo Sapiens
GLSNLEIGM

SEQ ID NO: 355278 - protein, 9 aa, Homo Sapiens
FLSDSQSGS

SEQ ID NO: 355279 - protein, 9 aa, Homo Sapiens
RREYKRIIL

SEQ ID NO: 355280 - protein, 9 aa, Homo Sapiens
SLHQKLCFF

SEQ ID NO: 355281 - protein, 9 aa, Homo Sapiens
ATIQTESIR

SEQ ID NO: 355282 - protein, 9 aa, Homo Sapiens
KMFFLIDKG

SEQ ID NO: 355283 - protein, 9 aa, Homo Sapiens
NVRFCLKGM

SEQ ID NO: 355284 - protein, 9 aa, Homo Sapiens
SCLPLAFAY

SEQ ID NO: 355285 - protein, 9 aa, Homo Sapiens
PYGRVECGK

SEQ ID NO: 355286 - protein, 9 aa, Homo Sapiens
HSSDSEEED

SEQ ID NO: 355287 - protein, 9 aa, Homo Sapiens
DEHPAKCRS

SEQ ID NO: 355288 - protein, 9 aa, Homo Sapiens
VMCLKDYVK

SEQ ID NO: 355289 - protein, 9 aa, Homo Sapiens
RLAQENKVD

SEQ ID NO: 355290 - protein, 9 aa, Homo Sapiens
CRADIRGRS

SEQ ID NO: 355291 - protein, 9 aa, Homo Sapiens
ILCHNNITS

SEQ ID NO: 355292 - protein, 9 aa, Homo Sapiens
YFSHHSNRI

SEQ ID NO: 355293 - protein, 9 aa, Homo Sapiens
IGFGNQCGK

SEQ ID NO: 355294 - protein, 9 aa, Homo Sapiens
QHTFCVIWT

SEQ ID NO: 355295 - protein, 9 aa, Homo Sapiens
VQRLLDFIF

SEQ ID NO: 355296 - protein, 9 aa, Homo Sapiens
FPDIYRGCE

SEQ ID NO: 355297 - protein, 9 aa, Homo Sapiens
QHKKIRTGE

SEQ ID NO: 355298 - protein, 9 aa, Homo Sapiens
AELHTKTNL

SEQ ID NO: 355299 - protein, 9 aa, Homo Sapiens
KMGDEEAPT

SEQ ID NO: 355300 - protein, 9 aa, Homo Sapiens
KDPFLSNEL

SEQ ID NO: 355301 - protein, 9 aa, Homo Sapiens
PSKAWGDVN

SEQ ID NO: 355302 - protein, 9 aa, Homo Sapiens
SSCLIHEIT

SEQ ID NO: 355303 - protein, 9 aa, Homo Sapiens
NVLSRKLCN

SEQ ID NO: 355304 - protein, 9 aa, Homo Sapiens
ECQACDCDP

SEQ ID NO: 355305 - protein, 9 aa, Homo Sapiens
VISGFTEIS

SEQ ID NO: 355306 - protein, 9 aa, Homo Sapiens
TECKEYQFR

SEQ ID NO: 355307 - protein, 9 aa, Homo Sapiens
LNGVGICKK

SEQ ID NO: 355308 - protein, 9 aa, Homo Sapiens
IVYQASYFG

SEQ ID NO: 355309 - protein, 9 aa, Homo Sapiens
SEILGVVAT

SEQ ID NO: 355310 - protein, 9 aa, Homo Sapiens
GEKPHACSE

SEQ ID NO: 355311 - protein, 9 aa, Homo Sapiens
QIYGLLVAL

SEQ ID NO: 355312 - protein, 9 aa, Homo Sapiens
CVIHFMETQ

SEQ ID NO: 355313 - protein, 9 aa, Homo Sapiens
GETFYSDSS

SEQ ID NO: 355314 - protein, 9 aa, Homo Sapiens
PKPERNILV

SEQ ID NO: 355315 - protein, 9 aa, Homo Sapiens
TGSVKSERI

SEQ ID NO: 355316 - protein, 9 aa, Homo Sapiens
NLDSQSDKH

SEQ ID NO: 355317 - protein, 9 aa, Homo Sapiens
KLSRTKEHT

SEQ ID NO: 355318 - protein, 9 aa, Homo Sapiens
TNNGKRCPN

SEQ ID NO: 355319 - protein, 9 aa, Homo Sapiens
CPSGLKDML

SEQ ID NO: 355320 - protein, 9 aa, Homo Sapiens
ENFYSNLML

SEQ ID NO: 355321 - protein, 9 aa, Homo Sapiens
VFGMRKALQ

SEQ ID NO: 355322 - protein, 9 aa, Homo Sapiens
IQIHFGATG

SEQ ID NO: 355323 - protein, 9 aa, Homo Sapiens
SLDWIKANT

SEQ ID NO: 355324 - protein, 9 aa, Homo Sapiens
MFTLDKVHI

SEQ ID NO: 355325 - protein, 9 aa, Homo Sapiens
ELRDKIARN

SEQ ID NO: 355326 - protein, 9 aa, Homo Sapiens
LHSEALKYL

SEQ ID NO: 355327 - protein, 9 aa, Homo Sapiens
SYIDFLMLY

SEQ ID NO: 355328 - protein, 9 aa, Homo Sapiens
RELFPDIYR

SEQ ID NO: 355329 - protein, 9 aa, Homo Sapiens
EIPLINISE

SEQ ID NO: 355330 - protein, 9 aa, Homo Sapiens
QSMPSEQII

SEQ ID NO: 355331 - protein, 9 aa, Homo Sapiens
DGALIAKDW

SEQ ID NO: 355332 - protein, 9 aa, Homo Sapiens
QQRTHTGEQ

SEQ ID NO: 355333 - protein, 9 aa, Homo Sapiens
ELEKEAHKS

SEQ ID NO: 355334 - protein, 9 aa, Homo Sapiens
FTYHKITHT

SEQ ID NO: 355335 - protein, 9 aa, Homo Sapiens
IQSEYCIRK

SEQ ID NO: 355336 - protein, 9 aa, Homo Sapiens
QGIVHRDLK

SEQ ID NO: 355337 - protein, 9 aa, Homo Sapiens
RESRSGQSF

SEQ ID NO: 355338 - protein, 9 aa, Homo Sapiens
KLLPGESNK

SEQ ID NO: 355339 - protein, 9 aa, Homo Sapiens
GMDVEEGKM

SEQ ID NO: 355340 - protein, 9 aa, Homo Sapiens
GDYVIMTIV

SEQ ID NO: 355341 - protein, 9 aa, Homo Sapiens
EELDYLPQP

SEQ ID NO: 355342 - protein, 9 aa, Homo Sapiens
LMEGLKQQN

SEQ ID NO: 355343 - protein, 9 aa, Homo Sapiens
GHILVQGAN

SEQ ID NO: 355344 - protein, 9 aa, Homo Sapiens
GHSTTKSAA

SEQ ID NO: 355345 - protein, 9 aa, Homo Sapiens
RTTDICVGP

SEQ ID NO: 355346 - protein, 9 aa, Homo Sapiens
GEIGSQDGP

SEQ ID NO: 355347 - protein, 9 aa, Homo Sapiens
QVAEQVLQQ

SEQ ID NO: 355348 - protein, 9 aa, Homo Sapiens
ITYYFQTYG

SEQ ID NO: 355349 - protein, 9 aa, Homo Sapiens
SIHQLEGTD

SEQ ID NO: 355350 - protein, 9 aa, Homo Sapiens
CETGISFVT

SEQ ID NO: 355351 - protein, 9 aa, Homo Sapiens
MYSLGSNHS

SEQ ID NO: 355352 - protein, 9 aa, Homo Sapiens
KALKPKKKN

SEQ ID NO: 355353 - protein, 9 aa, Homo Sapiens
QLAEDFLCD

SEQ ID NO: 355354 - protein, 9 aa, Homo Sapiens
ALANNIVLL

SEQ ID NO: 355355 - protein, 9 aa, Homo Sapiens
GEWLPAEDM

SEQ ID NO: 355356 - protein, 9 aa, Homo Sapiens
VKAGKRSPR

SEQ ID NO: 355357 - protein, 9 aa, Homo Sapiens
LKDISLFIL

SEQ ID NO: 355358 - protein, 9 aa, Homo Sapiens
SNLRKQLEM

SEQ ID NO: 355359 - protein, 9 aa, Homo Sapiens
NMNTLRRCI

SEQ ID NO: 355360 - protein, 9 aa, Homo Sapiens
EVIFAFEES

SEQ ID NO: 355361 - protein, 9 aa, Homo Sapiens
QISDSKKKE

SEQ ID NO: 355362 - protein, 9 aa, Homo Sapiens
QRRQPSQKA

SEQ ID NO: 355363 - protein, 9 aa, Homo Sapiens
KRHGRFKCS

SEQ ID NO: 355364 - protein, 9 aa, Homo Sapiens
GLVSLEQLY

SEQ ID NO: 355365 - protein, 9 aa, Homo Sapiens
PLTFYATSY

SEQ ID NO: 355366 - protein, 9 aa, Homo Sapiens
KLLSITVRH

SEQ ID NO: 355367 - protein, 9 aa, Homo Sapiens
LHLQPSQLS

SEQ ID NO: 355368 - protein, 9 aa, Homo Sapiens
QDYHARKVQ

SEQ ID NO: 355369 - protein, 9 aa, Homo Sapiens
KAIPGKKSA

SEQ ID NO: 355370 - protein, 9 aa, Homo Sapiens
QNSRDAIAA

SEQ ID NO: 355371 - protein, 9 aa, Homo Sapiens
IHTPRASNE

SEQ ID NO: 355372 - protein, 9 aa, Homo Sapiens
FLREHSQMD

SEQ ID NO: 355373 - protein, 9 aa, Homo Sapiens
FLFSWMLLV

SEQ ID NO: 355374 - protein, 9 aa, Homo Sapiens
LNLVEHGPD

SEQ ID NO: 355375 - protein, 9 aa, Homo Sapiens
KHGAPRPGI

SEQ ID NO: 355376 - protein, 9 aa, Homo Sapiens
GIMLPEFHL

SEQ ID NO: 355377 - protein, 9 aa, Homo Sapiens
TTHHNYYFI

SEQ ID NO: 355378 - protein, 9 aa, Homo Sapiens
DFSVPVEID

SEQ ID NO: 355379 - protein, 9 aa, Homo Sapiens
LGVVATPGT

SEQ ID NO: 355380 - protein, 9 aa, Homo Sapiens
RLTQLPKNG

SEQ ID NO: 355381 - protein, 9 aa, Homo Sapiens
IKGKDNSHN

SEQ ID NO: 355382 - protein, 9 aa, Homo Sapiens
EELDKLQCD

SEQ ID NO: 355383 - protein, 9 aa, Homo Sapiens
EEKILETFQ

SEQ ID NO: 355384 - protein, 9 aa, Homo Sapiens
SLRPVHLTQ

SEQ ID NO: 355385 - protein, 9 aa, Homo Sapiens
VVANITANL

SEQ ID NO: 355386 - protein, 9 aa, Homo Sapiens
GSQSINHFF

SEQ ID NO: 355387 - protein, 9 aa, Homo Sapiens
IMTGWNPVW

SEQ ID NO: 355388 - protein, 9 aa, Homo Sapiens
GDVLGACNA

SEQ ID NO: 355389 - protein, 9 aa, Homo Sapiens
TVTALLWME

SEQ ID NO: 355390 - protein, 9 aa, Homo Sapiens
SAGTSSQPA

SEQ ID NO: 355391 - protein, 9 aa, Homo Sapiens
MCLKDYVKV

SEQ ID NO: 355392 - protein, 9 aa, Homo Sapiens
QWVVENLEH

SEQ ID NO: 355393 - protein, 9 aa, Homo Sapiens
ENVIRQNVQ

SEQ ID NO: 355394 - protein, 9 aa, Homo Sapiens
QETWCETGI

SEQ ID NO: 355395 - protein, 9 aa, Homo Sapiens
VIEDNVRFE

SEQ ID NO: 355396 - protein, 9 aa, Homo Sapiens
ARYRRPTMA

SEQ ID NO: 355397 - protein, 9 aa, Homo Sapiens
FGYGQHGSS

SEQ ID NO: 355398 - protein, 9 aa, Homo Sapiens
LDIDKLLVN

SEQ ID NO: 355399 - protein, 9 aa, Homo Sapiens
REINCGFVA

SEQ ID NO: 355400 - protein, 9 aa, Homo Sapiens
LFIVAIFCV

SEQ ID NO: 355401 - protein, 9 aa, Homo Sapiens
DKCNDIINW

SEQ ID NO: 355402 - protein, 9 aa, Homo Sapiens
SEEPKVKEL

SEQ ID NO: 355403 - protein, 9 aa, Homo Sapiens
WHLGIQSQS

SEQ ID NO: 355404 - protein, 9 aa, Homo Sapiens
TAMGYDHYV

SEQ ID NO: 355405 - protein, 9 aa, Homo Sapiens
YTLMAQAVG

SEQ ID NO: 355406 - protein, 9 aa, Homo Sapiens
MLDMLLQHQ

SEQ ID NO: 355407 - protein, 9 aa, Homo Sapiens
KQKQTSFKA

SEQ ID NO: 355408 - protein, 9 aa, Homo Sapiens
CAGFGGLGY

SEQ ID NO: 355409 - protein, 9 aa, Homo Sapiens
SKYPDFHDD

SEQ ID NO: 355410 - protein, 9 aa, Homo Sapiens
SPKNKESVE

SEQ ID NO: 355411 - protein, 9 aa, Homo Sapiens
PHNKDGEPE

SEQ ID NO: 355412 - protein, 9 aa, Homo Sapiens
IILSFPTKS

SEQ ID NO: 355413 - protein, 9 aa, Homo Sapiens
RGCRFCYVK

SEQ ID NO: 355414 - protein, 9 aa, Homo Sapiens
EQDIFNRSL

SEQ ID NO: 355415 - protein, 9 aa, Homo Sapiens
LTEQIANFQ

SEQ ID NO: 355416 - protein, 9 aa, Homo Sapiens
YKITVALLT

SEQ ID NO: 355417 - protein, 9 aa, Homo Sapiens
KIPEGERVY

SEQ ID NO: 355418 - protein, 9 aa, Homo Sapiens
TYNVRPSEY

SEQ ID NO: 355419 - protein, 9 aa, Homo Sapiens
GSPDKQPGS

SEQ ID NO: 355420 - protein, 9 aa, Homo Sapiens
TRAKLAYFS

SEQ ID NO: 355421 - protein, 9 aa, Homo Sapiens
CHHTQLSFV

SEQ ID NO: 355422 - protein, 9 aa, Homo Sapiens
KLPPVCYKI

SEQ ID NO: 355423 - protein, 9 aa, Homo Sapiens
VDYLLENLE

SEQ ID NO: 355424 - protein, 9 aa, Homo Sapiens
HRSFIIQNI

SEQ ID NO: 355425 - protein, 9 aa, Homo Sapiens
FTTSTAPQL

SEQ ID NO: 355426 - protein, 9 aa, Homo Sapiens
FKYQKLYTY

SEQ ID NO: 355427 - protein, 9 aa, Homo Sapiens
SHRGAIGLH

SEQ ID NO: 355428 - protein, 9 aa, Homo Sapiens
IYMCPVRAL

SEQ ID NO: 355429 - protein, 9 aa, Homo Sapiens
QPVTKTITT

SEQ ID NO: 355430 - protein, 9 aa, Homo Sapiens
RLSIQKYIL

SEQ ID NO: 355431 - protein, 9 aa, Homo Sapiens
YTVGAKVTF

SEQ ID NO: 355432 - protein, 9 aa, Homo Sapiens
GIPKEADIE

SEQ ID NO: 355433 - protein, 9 aa, Homo Sapiens
RIQTNASDS

SEQ ID NO: 355434 - protein, 9 aa, Homo Sapiens
AEDCFQERN

SEQ ID NO: 355435 - protein, 9 aa, Homo Sapiens
NVIRQNVQK

SEQ ID NO: 355436 - protein, 9 aa, Homo Sapiens
KCLNGVGIC

SEQ ID NO: 355437 - protein, 9 aa, Homo Sapiens
DQLCLALQH

SEQ ID NO: 355438 - protein, 9 aa, Homo Sapiens
DAFQSHTFS

SEQ ID NO: 355439 - protein, 9 aa, Homo Sapiens
INDYSLRDQ

SEQ ID NO: 355440 - protein, 9 aa, Homo Sapiens
TKNLKEEHL

SEQ ID NO: 355441 - protein, 9 aa, Homo Sapiens
IDSLKENLD

SEQ ID NO: 355442 - protein, 9 aa, Homo Sapiens
TVVCQPNEL

SEQ ID NO: 355443 - protein, 9 aa, Homo Sapiens
QFPLMTPQD

SEQ ID NO: 355444 - protein, 9 aa, Homo Sapiens
KMLDQCPHP

SEQ ID NO: 355445 - protein, 9 aa, Homo Sapiens
PKEKQTETT

SEQ ID NO: 355446 - protein, 9 aa, Homo Sapiens
LVPSLTNLV

SEQ ID NO: 355447 - protein, 9 aa, Homo Sapiens
VITLWFQST

SEQ ID NO: 355448 - protein, 9 aa, Homo Sapiens
RPASACARC

SEQ ID NO: 355449 - protein, 9 aa, Homo Sapiens
DCPMNQMSV

SEQ ID NO: 355450 - protein, 9 aa, Homo Sapiens
FRLIRLCFW

SEQ ID NO: 355451 - protein, 9 aa, Homo Sapiens
GKVLLAKCK

SEQ ID NO: 355452 - protein, 9 aa, Homo Sapiens
LLPGAPDPF

SEQ ID NO: 355453 - protein, 9 aa, Homo Sapiens
RMKPFKSNH

SEQ ID NO: 355454 - protein, 9 aa, Homo Sapiens
KRAAKQQRK

SEQ ID NO: 355455 - protein, 9 aa, Homo Sapiens
KEYVHIHNE

SEQ ID NO: 355456 - protein, 9 aa, Homo Sapiens
VDRVLGLHR

SEQ ID NO: 355457 - protein, 9 aa, Homo Sapiens
KKTYECSGC

SEQ ID NO: 355458 - protein, 9 aa, Homo Sapiens
RRKGQQAAS

SEQ ID NO: 355459 - protein, 9 aa, Homo Sapiens
STFANLDSS

SEQ ID NO: 355460 - protein, 9 aa, Homo Sapiens
TTQNVLKLF

SEQ ID NO: 355461 - protein, 9 aa, Homo Sapiens
SEEDKKANL

SEQ ID NO: 355462 - protein, 9 aa, Homo Sapiens
ILRVVLRLK

SEQ ID NO: 355463 - protein, 9 aa, Homo Sapiens
CIVLFVSDL

SEQ ID NO: 355464 - protein, 9 aa, Homo Sapiens
KNILFVITT

SEQ ID NO: 355465 - protein, 9 aa, Homo Sapiens
IQQIIQENE

SEQ ID NO: 355466 - protein, 9 aa, Homo Sapiens
MEGLKQQNL

SEQ ID NO: 355467 - protein, 9 aa, Homo Sapiens
IGTFTVNAD

SEQ ID NO: 355468 - protein, 9 aa, Homo Sapiens
IACIRKTLA

SEQ ID NO: 355469 - protein, 9 aa, Homo Sapiens
LAFLDTHAA

SEQ ID NO: 355470 - protein, 9 aa, Homo Sapiens
EEARNIFRF

SEQ ID NO: 355471 - protein, 9 aa, Homo Sapiens
KVNCLSFNP

SEQ ID NO: 355472 - protein, 9 aa, Homo Sapiens
KDEEGVTLT

SEQ ID NO: 355473 - protein, 9 aa, Homo Sapiens
SALQSHERT

SEQ ID NO: 355474 - protein, 9 aa, Homo Sapiens
VFYTPVQEF

SEQ ID NO: 355475 - protein, 9 aa, Homo Sapiens
CYLPGHSKC

SEQ ID NO: 355476 - protein, 9 aa, Homo Sapiens
LIYKFSGCC

SEQ ID NO: 355477 - protein, 9 aa, Homo Sapiens
EKRASSPFQ

SEQ ID NO: 355478 - protein, 9 aa, Homo Sapiens
VYRNLQIAN

SEQ ID NO: 355479 - protein, 9 aa, Homo Sapiens
IQNKMEEIV

SEQ ID NO: 355480 - protein, 9 aa, Homo Sapiens
PIVHNLFVL

SEQ ID NO: 355481 - protein, 9 aa, Homo Sapiens
HKLGKQQQW

SEQ ID NO: 355482 - protein, 9 aa, Homo Sapiens
KINMQQTVI

SEQ ID NO: 355483 - protein, 9 aa, Homo Sapiens
QEKVLQGSS

SEQ ID NO: 355484 - protein, 9 aa, Homo Sapiens
EAKQMKVAK

SEQ ID NO: 355485 - protein, 9 aa, Homo Sapiens
IWIQTKPSD

SEQ ID NO: 355486 - protein, 9 aa, Homo Sapiens
IDGINTNMY

SEQ ID NO: 355487 - protein, 9 aa, Homo Sapiens
LQTMEDQDN

SEQ ID NO: 355488 - protein, 9 aa, Homo Sapiens
KMPPPSPPL

SEQ ID NO: 355489 - protein, 9 aa, Homo Sapiens
LQGIRQGKS

SEQ ID NO: 355490 - protein, 9 aa, Homo Sapiens
CLLGGRRIG

SEQ ID NO: 355491 - protein, 9 aa, Homo Sapiens
KFYRQSVRE

SEQ ID NO: 355492 - protein, 9 aa, Homo Sapiens
TPQISLSPS

SEQ ID NO: 355493 - protein, 9 aa, Homo Sapiens
CKKFMERNP

SEQ ID NO: 355494 - protein, 9 aa, Homo Sapiens
GKSFCQSSN

SEQ ID NO: 355495 - protein, 9 aa, Homo Sapiens
TVTLFLFLL

SEQ ID NO: 355496 - protein, 9 aa, Homo Sapiens
TDIYITSFG

SEQ ID NO: 355497 - protein, 9 aa, Homo Sapiens
GLDGVDIYS

SEQ ID NO: 355498 - protein, 9 aa, Homo Sapiens
KILKPKDVA

SEQ ID NO: 355499 - protein, 9 aa, Homo Sapiens
GGKKTYPEC

SEQ ID NO: 355500 - protein, 9 aa, Homo Sapiens
YFSDKQKIS

SEQ ID NO: 355501 - protein, 9 aa, Homo Sapiens
VKEAVTALI

SEQ ID NO: 355502 - protein, 9 aa, Homo Sapiens
KLSTKKKAI

SEQ ID NO: 355503 - protein, 9 aa, Homo Sapiens
HRCICCPVG

SEQ ID NO: 355504 - protein, 9 aa, Homo Sapiens
SAVDILGKK

SEQ ID NO: 355505 - protein, 9 aa, Homo Sapiens
EHGLPGTSW

SEQ ID NO: 355506 - protein, 9 aa, Homo Sapiens
KDLEVITLW

SEQ ID NO: 355507 - protein, 9 aa, Homo Sapiens
PNCQCLTTV

SEQ ID NO: 355508 - protein, 9 aa, Homo Sapiens
ALTILQFTR

SEQ ID NO: 355509 - protein, 9 aa, Homo Sapiens
DMARMYVAE

SEQ ID NO: 355510 - protein, 9 aa, Homo Sapiens
KPGLVAGKR

SEQ ID NO: 355511 - protein, 9 aa, Homo Sapiens
VGVNLFAGK

SEQ ID NO: 355512 - protein, 9 aa, Homo Sapiens
KCQQLANNN

SEQ ID NO: 355513 - protein, 9 aa, Homo Sapiens
AGLAPFVYL

SEQ ID NO: 355514 - protein, 9 aa, Homo Sapiens
RRGGRGHPR

SEQ ID NO: 355515 - protein, 9 aa, Homo Sapiens
INAKPNLLS

SEQ ID NO: 355516 - protein, 9 aa, Homo Sapiens
QHRQQHFEK

SEQ ID NO: 355517 - protein, 9 aa, Homo Sapiens
RCLFTKSKT

SEQ ID NO: 355518 - protein, 9 aa, Homo Sapiens
SLDEKQLAE

SEQ ID NO: 355519 - protein, 9 aa, Homo Sapiens
KVIFIPSSP

SEQ ID NO: 355520 - protein, 9 aa, Homo Sapiens
YPLFMEGVG

SEQ ID NO: 355521 - protein, 9 aa, Homo Sapiens
KYTINNVSP

SEQ ID NO: 355522 - protein, 9 aa, Homo Sapiens
ELRIPKDNE

SEQ ID NO: 355523 - protein, 9 aa, Homo Sapiens
TLRLFPIVM

SEQ ID NO: 355524 - protein, 9 aa, Homo Sapiens
KTQMFIHFI

SEQ ID NO: 355525 - protein, 9 aa, Homo Sapiens
FKGIQFSKG

SEQ ID NO: 355526 - protein, 9 aa, Homo Sapiens
GDYLHFSPK

SEQ ID NO: 355527 - protein, 9 aa, Homo Sapiens
EEGNGYDTR

SEQ ID NO: 355528 - protein, 9 aa, Homo Sapiens
PIHMRKRVC

SEQ ID NO: 355529 - protein, 9 aa, Homo Sapiens
LWSRSLKLT

SEQ ID NO: 355530 - protein, 9 aa, Homo Sapiens
NPGFQFSQA

SEQ ID NO: 355531 - protein, 9 aa, Homo Sapiens
LARKICSDL

SEQ ID NO: 355532 - protein, 9 aa, Homo Sapiens
LEIQKNRWD

SEQ ID NO: 355533 - protein, 9 aa, Homo Sapiens
SFEFFIPDN

SEQ ID NO: 355534 - protein, 9 aa, Homo Sapiens
CHSSSFRRH

SEQ ID NO: 355535 - protein, 9 aa, Homo Sapiens
YLFQVEFDN

SEQ ID NO: 355536 - protein, 9 aa, Homo Sapiens
DPLTFYATS

SEQ ID NO: 355537 - protein, 9 aa, Homo Sapiens
SVFKKKKWS

SEQ ID NO: 355538 - protein, 9 aa, Homo Sapiens
VHDQDYGKN

SEQ ID NO: 355539 - protein, 9 aa, Homo Sapiens
GAQVHQRSS

SEQ ID NO: 355540 - protein, 9 aa, Homo Sapiens
CFKYQKLYT

SEQ ID NO: 355541 - protein, 9 aa, Homo Sapiens
LRIPKDNEA

SEQ ID NO: 355542 - protein, 9 aa, Homo Sapiens
QARKHKYFK

SEQ ID NO: 355543 - protein, 9 aa, Homo Sapiens
QKANGERRK

SEQ ID NO: 355544 - protein, 9 aa, Homo Sapiens
SVPQDLTME

SEQ ID NO: 355545 - protein, 9 aa, Homo Sapiens
TAGEDTGGI

SEQ ID NO: 355546 - protein, 9 aa, Homo Sapiens
TQKASCRCK

SEQ ID NO: 355547 - protein, 9 aa, Homo Sapiens
EKIFLLGEE

SEQ ID NO: 355548 - protein, 9 aa, Homo Sapiens
LLGSYTEGN

SEQ ID NO: 355549 - protein, 9 aa, Homo Sapiens
LHHGRLCFM

SEQ ID NO: 355550 - protein, 9 aa, Homo Sapiens
TLMCDVHSI

SEQ ID NO: 355551 - protein, 9 aa, Homo Sapiens
FNRRIQNEK

SEQ ID NO: 355552 - protein, 9 aa, Homo Sapiens
KRTPYIMKT

SEQ ID NO: 355553 - protein, 9 aa, Homo Sapiens
HIALAISAI

SEQ ID NO: 355554 - protein, 9 aa, Homo Sapiens
LCRHRMHEQ

SEQ ID NO: 355555 - protein, 9 aa, Homo Sapiens
YTGVRAQII

SEQ ID NO: 355556 - protein, 9 aa, Homo Sapiens
IWDALRPPL

SEQ ID NO: 355557 - protein, 9 aa, Homo Sapiens
KSQVQTLHK

SEQ ID NO: 355558 - protein, 9 aa, Homo Sapiens
VQQLVEQVE

SEQ ID NO: 355559 - protein, 9 aa, Homo Sapiens
QLLSETTSL

SEQ ID NO: 355560 - protein, 9 aa, Homo Sapiens
PGKTNLVTI

SEQ ID NO: 355561 - protein, 9 aa, Homo Sapiens
FVFNLFIFL

SEQ ID NO: 355562 - protein, 9 aa, Homo Sapiens
VLHFLQQHY

SEQ ID NO: 355563 - protein, 9 aa, Homo Sapiens
NHNSGWGPI

SEQ ID NO: 355564 - protein, 9 aa, Homo Sapiens
KDKLTPLHC

SEQ ID NO: 355565 - protein, 9 aa, Homo Sapiens
RKPFTLVCG

SEQ ID NO: 355566 - protein, 9 aa, Homo Sapiens
FNVTLRLQA

SEQ ID NO: 355567 - protein, 9 aa, Homo Sapiens
NTDGSFNCV

SEQ ID NO: 355568 - protein, 9 aa, Homo Sapiens
SDIISDEAN

SEQ ID NO: 355569 - protein, 9 aa, Homo Sapiens
KDITLEEMR

SEQ ID NO: 355570 - protein, 9 aa, Homo Sapiens
LANNIVLLP

SEQ ID NO: 355571 - protein, 9 aa, Homo Sapiens
QTKPSDIIR

SEQ ID NO: 355572 - protein, 9 aa, Homo Sapiens
RRGCSYDSS

SEQ ID NO: 355573 - protein, 9 aa, Homo Sapiens
NLVQHQIIH

SEQ ID NO: 355574 - protein, 9 aa, Homo Sapiens
KGQQAASGH

SEQ ID NO: 355575 - protein, 9 aa, Homo Sapiens
SDGQLDLSE

SEQ ID NO: 355576 - protein, 9 aa, Homo Sapiens
GGAKNIQSI

SEQ ID NO: 355577 - protein, 9 aa, Homo Sapiens
VHFLFYWNL

SEQ ID NO: 355578 - protein, 9 aa, Homo Sapiens
AGFYRCVVQ

SEQ ID NO: 355579 - protein, 9 aa, Homo Sapiens
DRFKTKHIA

SEQ ID NO: 355580 - protein, 9 aa, Homo Sapiens
FVKKKCLEW

SEQ ID NO: 355581 - protein, 9 aa, Homo Sapiens
VDALDGKIK

SEQ ID NO: 355582 - protein, 9 aa, Homo Sapiens
RSPRRGEIG

SEQ ID NO: 355583 - protein, 9 aa, Homo Sapiens
SDNLKLVHI

SEQ ID NO: 355584 - protein, 9 aa, Homo Sapiens
WNELNAGDV

SEQ ID NO: 355585 - protein, 9 aa, Homo Sapiens
RRNLKTRNL

SEQ ID NO: 355586 - protein, 9 aa, Homo Sapiens
PDAAPVTKN

SEQ ID NO: 355587 - protein, 9 aa, Homo Sapiens
QEDSDTPAE

SEQ ID NO: 355588 - protein, 9 aa, Homo Sapiens
TPANGTSVY

SEQ ID NO: 355589 - protein, 9 aa, Homo Sapiens
EYINDDGLI

SEQ ID NO: 355590 - protein, 9 aa, Homo Sapiens
HAPQSQDFQ

SEQ ID NO: 355591 - protein, 9 aa, Homo Sapiens
SNLSRQLIA

SEQ ID NO: 355592 - protein, 9 aa, Homo Sapiens
KLHQEKMIL

SEQ ID NO: 355593 - protein, 9 aa, Homo Sapiens
RRIQLYQKP

SEQ ID NO: 355594 - protein, 9 aa, Homo Sapiens
KIKENIQII

SEQ ID NO: 355595 - protein, 9 aa, Homo Sapiens
PLREEANKF

SEQ ID NO: 355596 - protein, 9 aa, Homo Sapiens
VGLASVEQH

SEQ ID NO: 355597 - protein, 9 aa, Homo Sapiens
GNGYDTRSE

SEQ ID NO: 355598 - protein, 9 aa, Homo Sapiens
TIVGIYRKK

SEQ ID NO: 355599 - protein, 9 aa, Homo Sapiens
QRLVETEKE

SEQ ID NO: 355600 - protein, 9 aa, Homo Sapiens
EMQKERRRI

SEQ ID NO: 355601 - protein, 9 aa, Homo Sapiens
DMVLKIKQT

SEQ ID NO: 355602 - protein, 9 aa, Homo Sapiens
NLYIFSRDG

SEQ ID NO: 355603 - protein, 9 aa, Homo Sapiens
LDPDMALCQ

SEQ ID NO: 355604 - protein, 9 aa, Homo Sapiens
LLCQQAITS

SEQ ID NO: 355605 - protein, 9 aa, Homo Sapiens
PEYRASVWE

SEQ ID NO: 355606 - protein, 9 aa, Homo Sapiens
RILMGKIFQ

SEQ ID NO: 355607 - protein, 9 aa, Homo Sapiens
KLVVWEAGE

SEQ ID NO: 355608 - protein, 9 aa, Homo Sapiens
CQVIRKYNY

SEQ ID NO: 355609 - protein, 9 aa, Homo Sapiens
IITSPEYLN

SEQ ID NO: 355610 - protein, 9 aa, Homo Sapiens
HLGLNVALS

SEQ ID NO: 355611 - protein, 9 aa, Homo Sapiens
DKGNAFNQD

SEQ ID NO: 355612 - protein, 9 aa, Homo Sapiens
GLQLAVDVC

SEQ ID NO: 355613 - protein, 9 aa, Homo Sapiens
QRFPTFFQT

SEQ ID NO: 355614 - protein, 9 aa, Homo Sapiens
DPDWSAITA

SEQ ID NO: 355615 - protein, 9 aa, Homo Sapiens
HAVQTTLKS

SEQ ID NO: 355616 - protein, 9 aa, Homo Sapiens
MEDQDNQRV

SEQ ID NO: 355617 - protein, 9 aa, Homo Sapiens
WENGMKVGL

SEQ ID NO: 355618 - protein, 9 aa, Homo Sapiens
QLEGLNNFL

SEQ ID NO: 355619 - protein, 9 aa, Homo Sapiens
WDVKLLWLP

SEQ ID NO: 355620 - protein, 9 aa, Homo Sapiens
IQTLCLGGA

SEQ ID NO: 355621 - protein, 9 aa, Homo Sapiens
AGPNNTFLQ

SEQ ID NO: 355622 - protein, 9 aa, Homo Sapiens
LSRRTLHKP

SEQ ID NO: 355623 - protein, 9 aa, Homo Sapiens
DTPAEEDSG

SEQ ID NO: 355624 - protein, 9 aa, Homo Sapiens
LRVVLRLKA

SEQ ID NO: 355625 - protein, 9 aa, Homo Sapiens
GDKFQCGDG

SEQ ID NO: 355626 - protein, 9 aa, Homo Sapiens
GKALPITCC

SEQ ID NO: 355627 - protein, 9 aa, Homo Sapiens
QHYPMAFPS

SEQ ID NO: 355628 - protein, 9 aa, Homo Sapiens
EFITVSGYL

SEQ ID NO: 355629 - protein, 9 aa, Homo Sapiens
FDHIVEKGF

SEQ ID NO: 355630 - protein, 9 aa, Homo Sapiens
IAKLFPGRT

SEQ ID NO: 355631 - protein, 9 aa, Homo Sapiens
LELQVQSLR

SEQ ID NO: 355632 - protein, 9 aa, Homo Sapiens
VYPVMAKKE

SEQ ID NO: 355633 - protein, 9 aa, Homo Sapiens
LISPLQRIL

SEQ ID NO: 355634 - protein, 9 aa, Homo Sapiens
IWDPAHRVA

SEQ ID NO: 355635 - protein, 9 aa, Homo Sapiens
WTKHGVPLD

SEQ ID NO: 355636 - protein, 9 aa, Homo Sapiens
AVKLSRRHP

SEQ ID NO: 355637 - protein, 9 aa, Homo Sapiens
AECIRFILG

SEQ ID NO: 355638 - protein, 9 aa, Homo Sapiens
DNQREVCIV

SEQ ID NO: 355639 - protein, 9 aa, Homo Sapiens
CSDKNISIF

SEQ ID NO: 355640 - protein, 9 aa, Homo Sapiens
KDYGQNGMV

SEQ ID NO: 355641 - protein, 9 aa, Homo Sapiens
SKNSVQSGK

SEQ ID NO: 355642 - protein, 9 aa, Homo Sapiens
VKLLTGASL

SEQ ID NO: 355643 - protein, 9 aa, Homo Sapiens
GTEHRIPKA

SEQ ID NO: 355644 - protein, 9 aa, Homo Sapiens
TKYFTSSSP

SEQ ID NO: 355645 - protein, 9 aa, Homo Sapiens
INQGTLTIL

SEQ ID NO: 355646 - protein, 9 aa, Homo Sapiens
FDIIKNDNN

SEQ ID NO: 355647 - protein, 9 aa, Homo Sapiens
KVLLAKCKS

SEQ ID NO: 355648 - protein, 9 aa, Homo Sapiens
NTCTTCQIL

SEQ ID NO: 355649 - protein, 9 aa, Homo Sapiens
QRIHTGETP

SEQ ID NO: 355650 - protein, 9 aa, Homo Sapiens
VSNSVQACK

SEQ ID NO: 355651 - protein, 9 aa, Homo Sapiens
RKICSDLTA

SEQ ID NO: 355652 - protein, 9 aa, Homo Sapiens
INLDIPRFQ

SEQ ID NO: 355653 - protein, 9 aa, Homo Sapiens
ALAYRQIDD

SEQ ID NO: 355654 - protein, 9 aa, Homo Sapiens
RLHTEEKPF

SEQ ID NO: 355655 - protein, 9 aa, Homo Sapiens
SDLIFKRGP

SEQ ID NO: 355656 - protein, 9 aa, Homo Sapiens
LLNKEWKKK

SEQ ID NO: 355657 - protein, 9 aa, Homo Sapiens
VCFLNRRHL

SEQ ID NO: 355658 - protein, 9 aa, Homo Sapiens
DDLKWSCLP

SEQ ID NO: 355659 - protein, 9 aa, Homo Sapiens
ALSNKALKK

SEQ ID NO: 355660 - protein, 9 aa, Homo Sapiens
GCNINEKQI

SEQ ID NO: 355661 - protein, 9 aa, Homo Sapiens
LYESSVVFG

SEQ ID NO: 355662 - protein, 9 aa, Homo Sapiens
QDKHSDSAQ

SEQ ID NO: 355663 - protein, 9 aa, Homo Sapiens
IVESTLFQQ

SEQ ID NO: 355664 - protein, 9 aa, Homo Sapiens
LAMGIDNCS

SEQ ID NO: 355665 - protein, 9 aa, Homo Sapiens
QYTLRVQAL

SEQ ID NO: 355666 - protein, 9 aa, Homo Sapiens
FAHYIEELA

SEQ ID NO: 355667 - protein, 9 aa, Homo Sapiens
GYGRFLINF

SEQ ID NO: 355668 - protein, 9 aa, Homo Sapiens
SNLTKHKLI

SEQ ID NO: 355669 - protein, 9 aa, Homo Sapiens
ADKEMEGTS

SEQ ID NO: 355670 - protein, 9 aa, Homo Sapiens
GNTLWRTTV

SEQ ID NO: 355671 - protein, 9 aa, Homo Sapiens
TTKGENHPS

SEQ ID NO: 355672 - protein, 9 aa, Homo Sapiens
IQTVFYSWL

SEQ ID NO: 355673 - protein, 9 aa, Homo Sapiens
GPQIHDGGV

SEQ ID NO: 355674 - protein, 9 aa, Homo Sapiens
NMKRKMERD

SEQ ID NO: 355675 - protein, 9 aa, Homo Sapiens
LLASEVEET

SEQ ID NO: 355676 - protein, 9 aa, Homo Sapiens
QYHGRTHTG

SEQ ID NO: 355677 - protein, 9 aa, Homo Sapiens
SIVGYLLFK

SEQ ID NO: 355678 - protein, 9 aa, Homo Sapiens
LSGKLHNTG

SEQ ID NO: 355679 - protein, 9 aa, Homo Sapiens
GEEPGEDKD

SEQ ID NO: 355680 - protein, 9 aa, Homo Sapiens
EIAKRKEVI

SEQ ID NO: 355681 - protein, 9 aa, Homo Sapiens
VSHAFLPRI

SEQ ID NO: 355682 - protein, 9 aa, Homo Sapiens
YNAGVAFVV

SEQ ID NO: 355683 - protein, 9 aa, Homo Sapiens
LMAVLAVSS

SEQ ID NO: 355684 - protein, 9 aa, Homo Sapiens
YNSTRDLET

SEQ ID NO: 355685 - protein, 9 aa, Homo Sapiens
SGSNLTQHW

SEQ ID NO: 355686 - protein, 9 aa, Homo Sapiens
ENINNTFIK

SEQ ID NO: 355687 - protein, 9 aa, Homo Sapiens
GEKGKCGID

SEQ ID NO: 355688 - protein, 9 aa, Homo Sapiens
PLKKFVEAC

SEQ ID NO: 355689 - protein, 9 aa, Homo Sapiens
AVTNKHFSD

SEQ ID NO: 355690 - protein, 9 aa, Homo Sapiens
SGRFHKRKH

SEQ ID NO: 355691 - protein, 9 aa, Homo Sapiens
LARINNFMM

SEQ ID NO: 355692 - protein, 9 aa, Homo Sapiens
FSHHSNRIV

SEQ ID NO: 355693 - protein, 9 aa, Homo Sapiens
LYYVREFVL

SEQ ID NO: 355694 - protein, 9 aa, Homo Sapiens
DTSEMVNDA

SEQ ID NO: 355695 - protein, 9 aa, Homo Sapiens
FEDVSVFFT

SEQ ID NO: 355696 - protein, 9 aa, Homo Sapiens
IWVDLIKYL

SEQ ID NO: 355697 - protein, 9 aa, Homo Sapiens
IMFPDIIAR

SEQ ID NO: 355698 - protein, 9 aa, Homo Sapiens
VHADLHPGH

SEQ ID NO: 355699 - protein, 9 aa, Homo Sapiens
RHNAEILFK

SEQ ID NO: 355700 - protein, 9 aa, Homo Sapiens
KGTPDKVFT

SEQ ID NO: 355701 - protein, 9 aa, Homo Sapiens
LNLRKQATT

SEQ ID NO: 355702 - protein, 9 aa, Homo Sapiens
LIARRQAFN

SEQ ID NO: 355703 - protein, 9 aa, Homo Sapiens
QEGYFQELL

SEQ ID NO: 355704 - protein, 9 aa, Homo Sapiens
DIQILAIKS

SEQ ID NO: 355705 - protein, 9 aa, Homo Sapiens
SERISIPPS

SEQ ID NO: 355706 - protein, 9 aa, Homo Sapiens
YTDPLTFYA

SEQ ID NO: 355707 - protein, 9 aa, Homo Sapiens
YFHTTPNTS

SEQ ID NO: 355708 - protein, 9 aa, Homo Sapiens
LSRIIREKY

SEQ ID NO: 355709 - protein, 9 aa, Homo Sapiens
QKSVPDVVQ

SEQ ID NO: 355710 - protein, 9 aa, Homo Sapiens
ISRFQKRDL

SEQ ID NO: 355711 - protein, 9 aa, Homo Sapiens
ESHPSDFQC

SEQ ID NO: 355712 - protein, 9 aa, Homo Sapiens
MVHQITHTG

SEQ ID NO: 355713 - protein, 9 aa, Homo Sapiens
PPWAESSAK

SEQ ID NO: 355714 - protein, 9 aa, Homo Sapiens
WKAETACRL

SEQ ID NO: 355715 - protein, 9 aa, Homo Sapiens
GKMDLDHNC

SEQ ID NO: 355716 - protein, 9 aa, Homo Sapiens
SGHFDKKIC

SEQ ID NO: 355717 - protein, 9 aa, Homo Sapiens
WVEFITVSG

SEQ ID NO: 355718 - protein, 9 aa, Homo Sapiens
SNTKETLKI

SEQ ID NO: 355719 - protein, 9 aa, Homo Sapiens
LDNEVEQRH

SEQ ID NO: 355720 - protein, 9 aa, Homo Sapiens
LLAKCKSDG

SEQ ID NO: 355721 - protein, 9 aa, Homo Sapiens
LRINRTATF

SEQ ID NO: 355722 - protein, 9 aa, Homo Sapiens
KKEKSCRLY

SEQ ID NO: 355723 - protein, 9 aa, Homo Sapiens
VVLDAAGGR

SEQ ID NO: 355724 - protein, 9 aa, Homo Sapiens
QEVAEQFLR

SEQ ID NO: 355725 - protein, 9 aa, Homo Sapiens
VEWRLFSLQ

SEQ ID NO: 355726 - protein, 9 aa, Homo Sapiens
KINLKDKSH

SEQ ID NO: 355727 - protein, 9 aa, Homo Sapiens
LRSSNILLL

SEQ ID NO: 355728 - protein, 9 aa, Homo Sapiens
VTQDAEKCV

SEQ ID NO: 355729 - protein, 9 aa, Homo Sapiens
QSDIPAPRI

SEQ ID NO: 355730 - protein, 9 aa, Homo Sapiens
SVNKKDLPI

SEQ ID NO: 355731 - protein, 9 aa, Homo Sapiens
TVLGAYVEQ

SEQ ID NO: 355732 - protein, 9 aa, Homo Sapiens
ERDEITHND

SEQ ID NO: 355733 - protein, 9 aa, Homo Sapiens
AYELSVFCD

SEQ ID NO: 355734 - protein, 9 aa, Homo Sapiens
VLEKHVELE

SEQ ID NO: 355735 - protein, 9 aa, Homo Sapiens
YLHFSPKQQ

SEQ ID NO: 355736 - protein, 9 aa, Homo Sapiens
VITSPSKNY

SEQ ID NO: 355737 - protein, 9 aa, Homo Sapiens
WTLIPEFLA

SEQ ID NO: 355738 - protein, 9 aa, Homo Sapiens
RSSSLNSTN

SEQ ID NO: 355739 - protein, 9 aa, Homo Sapiens
EGSESESWS

SEQ ID NO: 355740 - protein, 9 aa, Homo Sapiens
KTKQVERML

SEQ ID NO: 355741 - protein, 9 aa, Homo Sapiens
ALLMFALST

SEQ ID NO: 355742 - protein, 9 aa, Homo Sapiens
LFLSLVAVP

SEQ ID NO: 355743 - protein, 9 aa, Homo Sapiens
QLQQLVNKT

SEQ ID NO: 355744 - protein, 9 aa, Homo Sapiens
QREYLNISF

SEQ ID NO: 355745 - protein, 9 aa, Homo Sapiens
EIGSGNLSQ

SEQ ID NO: 355746 - protein, 9 aa, Homo Sapiens
YQEEAAMAL

SEQ ID NO: 355747 - protein, 9 aa, Homo Sapiens
NQILFSALE

SEQ ID NO: 355748 - protein, 9 aa, Homo Sapiens
KPLKKFVEA

SEQ ID NO: 355749 - protein, 9 aa, Homo Sapiens
EAAMALKVE

SEQ ID NO: 355750 - protein, 9 aa, Homo Sapiens
DMPNTSEGL

SEQ ID NO: 355751 - protein, 9 aa, Homo Sapiens
LEVEQALKE

SEQ ID NO: 355752 - protein, 9 aa, Homo Sapiens
NNTFTVKYT

SEQ ID NO: 355753 - protein, 9 aa, Homo Sapiens
LCVYKGKPL

SEQ ID NO: 355754 - protein, 9 aa, Homo Sapiens
IILRTQIAA

SEQ ID NO: 355755 - protein, 9 aa, Homo Sapiens
MKTPEVPFF

SEQ ID NO: 355756 - protein, 9 aa, Homo Sapiens
QSQVKYKRN

SEQ ID NO: 355757 - protein, 9 aa, Homo Sapiens
NVTITATGR

SEQ ID NO: 355758 - protein, 9 aa, Homo Sapiens
FVLCDQRAI

SEQ ID NO: 355759 - protein, 9 aa, Homo Sapiens
YVKDRSPRA

SEQ ID NO: 355760 - protein, 9 aa, Homo Sapiens
PGSSYSPAS

SEQ ID NO: 355761 - protein, 9 aa, Homo Sapiens
IDVDSVLVL

SEQ ID NO: 355762 - protein, 9 aa, Homo Sapiens
GKWIHTLTY

SEQ ID NO: 355763 - protein, 9 aa, Homo Sapiens
RYEVNCLGI

SEQ ID NO: 355764 - protein, 9 aa, Homo Sapiens
GSCLFIYVK

SEQ ID NO: 355765 - protein, 9 aa, Homo Sapiens
KDNTFSFSF

SEQ ID NO: 355766 - protein, 9 aa, Homo Sapiens
KSVALYDCQ

SEQ ID NO: 355767 - protein, 9 aa, Homo Sapiens
KNNGPGSTR

SEQ ID NO: 355768 - protein, 9 aa, Homo Sapiens
PGSPDKQPG

SEQ ID NO: 355769 - protein, 9 aa, Homo Sapiens
KYFPVFSLL

SEQ ID NO: 355770 - protein, 9 aa, Homo Sapiens
VTYLLGAGR

SEQ ID NO: 355771 - protein, 9 aa, Homo Sapiens
QSQIGFINF

SEQ ID NO: 355772 - protein, 9 aa, Homo Sapiens
AKRKEVIFS

SEQ ID NO: 355773 - protein, 9 aa, Homo Sapiens
LCQICSCGL

SEQ ID NO: 355774 - protein, 9 aa, Homo Sapiens
PVTKTITTP

SEQ ID NO: 355775 - protein, 9 aa, Homo Sapiens
SKENTLGCQ

SEQ ID NO: 355776 - protein, 9 aa, Homo Sapiens
IPKRPLFNF

SEQ ID NO: 355777 - protein, 8 aa, Homo Sapiens
KSWQLIAV

SEQ ID NO: 355778 - protein, 9 aa, Homo Sapiens
VRLYLVVSP

SEQ ID NO: 355779 - protein, 9 aa, Homo Sapiens
YTKFFGGVS

SEQ ID NO: 355780 - protein, 9 aa, Homo Sapiens
SEDVYHSHV

SEQ ID NO: 355781 - protein, 9 aa, Homo Sapiens
VCNPLWYPL

SEQ ID NO: 355782 - protein, 9 aa, Homo Sapiens
IQHCPLYKS

SEQ ID NO: 355783 - protein, 9 aa, Homo Sapiens
VLNPSGDYY

SEQ ID NO: 355784 - protein, 9 aa, Homo Sapiens
QGNEIGGKP

SEQ ID NO: 355785 - protein, 9 aa, Homo Sapiens
IEKQQREEE

SEQ ID NO: 355786 - protein, 9 aa, Homo Sapiens
PTLARKMAI

SEQ ID NO: 355787 - protein, 9 aa, Homo Sapiens
LPPLPPKFS

SEQ ID NO: 355788 - protein, 9 aa, Homo Sapiens
DFLKNSNMF

SEQ ID NO: 355789 - protein, 9 aa, Homo Sapiens
PEGIQIDLR

SEQ ID NO: 355790 - protein, 9 aa, Homo Sapiens
VFVINGSKS

SEQ ID NO: 355791 - protein, 9 aa, Homo Sapiens
SFWLGHLLD

SEQ ID NO: 355792 - protein, 9 aa, Homo Sapiens
KGYGRFLIN

SEQ ID NO: 355793 - protein, 9 aa, Homo Sapiens
DVLYRLGRL

SEQ ID NO: 355794 - protein, 9 aa, Homo Sapiens
MSPGSTPQI

SEQ ID NO: 355795 - protein, 9 aa, Homo Sapiens
ESVIRFFIK

SEQ ID NO: 355796 - protein, 9 aa, Homo Sapiens
GRPQIKKDE

SEQ ID NO: 355797 - protein, 9 aa, Homo Sapiens
PQEVSTTVQ

SEQ ID NO: 355798 - protein, 9 aa, Homo Sapiens
RSDQTGEVI

SEQ ID NO: 355799 - protein, 9 aa, Homo Sapiens
ASSQEDYEF

SEQ ID NO: 355800 - protein, 9 aa, Homo Sapiens
LELTKMNKM

SEQ ID NO: 355801 - protein, 9 aa, Homo Sapiens
VQKSSGVKL

SEQ ID NO: 355802 - protein, 9 aa, Homo Sapiens
FKLGLQNGK

SEQ ID NO: 355803 - protein, 9 aa, Homo Sapiens
RRAATCLQT

SEQ ID NO: 355804 - protein, 9 aa, Homo Sapiens
KALRSWRIN

SEQ ID NO: 355805 - protein, 9 aa, Homo Sapiens
RWDNNDTTI

SEQ ID NO: 355806 - protein, 9 aa, Homo Sapiens
ASSPSYKFI

SEQ ID NO: 355807 - protein, 9 aa, Homo Sapiens
DVDVYLPKV

SEQ ID NO: 355808 - protein, 9 aa, Homo Sapiens
TSQINLIDL

SEQ ID NO: 355809 - protein, 9 aa, Homo Sapiens
EQHFLEQLL

SEQ ID NO: 355810 - protein, 9 aa, Homo Sapiens
KHGVPLDLQ

SEQ ID NO: 355811 - protein, 9 aa, Homo Sapiens
HHFYRYMGR

SEQ ID NO: 355812 - protein, 9 aa, Homo Sapiens
HSKCSSVYE

SEQ ID NO: 355813 - protein, 9 aa, Homo Sapiens
LKNMKRKME

SEQ ID NO: 355814 - protein, 9 aa, Homo Sapiens
EFKELTSNN

SEQ ID NO: 355815 - protein, 9 aa, Homo Sapiens
AMQEYITVV

SEQ ID NO: 355816 - protein, 9 aa, Homo Sapiens
SAQEKVLQG

SEQ ID NO: 355817 - protein, 9 aa, Homo Sapiens
DTQNVTFVF

SEQ ID NO: 355818 - protein, 9 aa, Homo Sapiens
MVPSVTNNT

SEQ ID NO: 355819 - protein, 9 aa, Homo Sapiens
TSTFANLDS

SEQ ID NO: 355820 - protein, 9 aa, Homo Sapiens
NSPSLDFNG

SEQ ID NO: 355821 - protein, 9 aa, Homo Sapiens
SVQACKERQ

SEQ ID NO: 355822 - protein, 9 aa, Homo Sapiens
IYFRKETFL

SEQ ID NO: 355823 - protein, 9 aa, Homo Sapiens
LALRALREK

SEQ ID NO: 355824 - protein, 9 aa, Homo Sapiens
ILVLKRLSD

SEQ ID NO: 355825 - protein, 9 aa, Homo Sapiens
AGFKIFEYN

SEQ ID NO: 355826 - protein, 9 aa, Homo Sapiens
SDDFRNKYQ

SEQ ID NO: 355827 - protein, 9 aa, Homo Sapiens
GIIYPHNKD

SEQ ID NO: 355828 - protein, 9 aa, Homo Sapiens
GMASFGASI

SEQ ID NO: 355829 - protein, 9 aa, Homo Sapiens
LQGKKSCHT

SEQ ID NO: 355830 - protein, 9 aa, Homo Sapiens
SELSAQLHL

SEQ ID NO: 355831 - protein, 9 aa, Homo Sapiens
LAPLLNDIL

SEQ ID NO: 355832 - protein, 9 aa, Homo Sapiens
QVGLMEMDQ

SEQ ID NO: 355833 - protein, 9 aa, Homo Sapiens
SYHSTAERK

SEQ ID NO: 355834 - protein, 9 aa, Homo Sapiens
TQGKKTEEF

SEQ ID NO: 355835 - protein, 9 aa, Homo Sapiens
AEVYGVRLA

SEQ ID NO: 355836 - protein, 9 aa, Homo Sapiens
VLIQDINNN

SEQ ID NO: 355837 - protein, 9 aa, Homo Sapiens
TFRGFWSTK

SEQ ID NO: 355838 - protein, 9 aa, Homo Sapiens
NVKKKHTKQ

SEQ ID NO: 355839 - protein, 9 aa, Homo Sapiens
TGVKEAVTA

SEQ ID NO: 355840 - protein, 9 aa, Homo Sapiens
LTCLLQHER

SEQ ID NO: 355841 - protein, 9 aa, Homo Sapiens
WSCGASLHG

SEQ ID NO: 355842 - protein, 9 aa, Homo Sapiens
RLFSSSYDR

SEQ ID NO: 355843 - protein, 9 aa, Homo Sapiens
MLYQDKLFQ

SEQ ID NO: 355844 - protein, 9 aa, Homo Sapiens
CFQERNNCL

SEQ ID NO: 355845 - protein, 9 aa, Homo Sapiens
VLPHTSSGS

SEQ ID NO: 355846 - protein, 9 aa, Homo Sapiens
VAGGLAMGI

SEQ ID NO: 355847 - protein, 9 aa, Homo Sapiens
VCLFLACPA

SEQ ID NO: 355848 - protein, 9 aa, Homo Sapiens
LKKQLRKKQ

SEQ ID NO: 355849 - protein, 9 aa, Homo Sapiens
SKFPTKIPR

SEQ ID NO: 355850 - protein, 9 aa, Homo Sapiens
RAKRDKLTE

SEQ ID NO: 355851 - protein, 9 aa, Homo Sapiens
VRILQDKEN

SEQ ID NO: 355852 - protein, 9 aa, Homo Sapiens
ENSKEADIL

SEQ ID NO: 355853 - protein, 9 aa, Homo Sapiens
LHQCILWFL

SEQ ID NO: 355854 - protein, 9 aa, Homo Sapiens
SAPPCTQCI

SEQ ID NO: 355855 - protein, 9 aa, Homo Sapiens
GFMTREEHK

SEQ ID NO: 355856 - protein, 9 aa, Homo Sapiens
DGQLDLSEF

SEQ ID NO: 355857 - protein, 9 aa, Homo Sapiens
RAERTNNWS

SEQ ID NO: 355858 - protein, 9 aa, Homo Sapiens
WQMHSPPSN

SEQ ID NO: 355859 - protein, 9 aa, Homo Sapiens
TTQVQKLQE

SEQ ID NO: 355860 - protein, 9 aa, Homo Sapiens
SHNQIDLMD

SEQ ID NO: 355861 - protein, 9 aa, Homo Sapiens
CRHNKDTFL

SEQ ID NO: 355862 - protein, 9 aa, Homo Sapiens
DLHSRNNML

SEQ ID NO: 355863 - protein, 9 aa, Homo Sapiens
LDNRAEYVW

SEQ ID NO: 355864 - protein, 9 aa, Homo Sapiens
TCQAWSFMT

SEQ ID NO: 355865 - protein, 9 aa, Homo Sapiens
HEMRGTADL

SEQ ID NO: 355866 - protein, 9 aa, Homo Sapiens
IQNCQKIIK

SEQ ID NO: 355867 - protein, 9 aa, Homo Sapiens
GKGPCGETG

SEQ ID NO: 355868 - protein, 9 aa, Homo Sapiens
NFNTCTACK

SEQ ID NO: 355869 - protein, 9 aa, Homo Sapiens
YHSHVAGQM

SEQ ID NO: 355870 - protein, 9 aa, Homo Sapiens
ILGKKPWVT

SEQ ID NO: 355871 - protein, 9 aa, Homo Sapiens
QTCVFFEAP

SEQ ID NO: 355872 - protein, 9 aa, Homo Sapiens
CSKTPKNRY

SEQ ID NO: 355873 - protein, 9 aa, Homo Sapiens
EEKEKNENL

SEQ ID NO: 355874 - protein, 9 aa, Homo Sapiens
EKSPLSLET

SEQ ID NO: 355875 - protein, 9 aa, Homo Sapiens
LSDKSVKVW

SEQ ID NO: 355876 - protein, 9 aa, Homo Sapiens
NNEDHTPNY

SEQ ID NO: 355877 - protein, 9 aa, Homo Sapiens
RILCGIVSV

SEQ ID NO: 355878 - protein, 9 aa, Homo Sapiens
GFPIEDHKT

SEQ ID NO: 355879 - protein, 9 aa, Homo Sapiens
NLFGGKCLV

SEQ ID NO: 355880 - protein, 9 aa, Homo Sapiens
FLLTIMGYD

SEQ ID NO: 355881 - protein, 9 aa, Homo Sapiens
CLTDQSYID

SEQ ID NO: 355882 - protein, 9 aa, Homo Sapiens
PFQDNIFQS

SEQ ID NO: 355883 - protein, 9 aa, Homo Sapiens
ICCKSYVRP

SEQ ID NO: 355884 - protein, 9 aa, Homo Sapiens
LNNFLHQLL

SEQ ID NO: 355885 - protein, 9 aa, Homo Sapiens
IANVRVQNC

SEQ ID NO: 355886 - protein, 9 aa, Homo Sapiens
RNNTDKNYL

SEQ ID NO: 355887 - protein, 9 aa, Homo Sapiens
SDRLHVDFA

SEQ ID NO: 355888 - protein, 9 aa, Homo Sapiens
NPFCPPGFS

SEQ ID NO: 355889 - protein, 9 aa, Homo Sapiens
TANLNIKYK

SEQ ID NO: 355890 - protein, 9 aa, Homo Sapiens
EADATASSI

SEQ ID NO: 355891 - protein, 9 aa, Homo Sapiens
PGLTSTHSK

SEQ ID NO: 355892 - protein, 9 aa, Homo Sapiens
SITVRHAKK

SEQ ID NO: 355893 - protein, 9 aa, Homo Sapiens
CRMHSAEGR

SEQ ID NO: 355894 - protein, 9 aa, Homo Sapiens
NPYPSSVVF

SEQ ID NO: 355895 - protein, 9 aa, Homo Sapiens
SWDETEYKV

SEQ ID NO: 355896 - protein, 9 aa, Homo Sapiens
RIVTYHHHL

SEQ ID NO: 355897 - protein, 9 aa, Homo Sapiens
KTWDLDFGG

SEQ ID NO: 355898 - protein, 9 aa, Homo Sapiens
PSLDYSMPV

SEQ ID NO: 355899 - protein, 9 aa, Homo Sapiens
ALQNKVQAL

SEQ ID NO: 355900 - protein, 9 aa, Homo Sapiens
WDYGINQPL

SEQ ID NO: 355901 - protein, 9 aa, Homo Sapiens
CLFTKSKTD

SEQ ID NO: 355902 - protein, 9 aa, Homo Sapiens
AARYRRPTM

SEQ ID NO: 355903 - protein, 9 aa, Homo Sapiens
RTTELSELE

SEQ ID NO: 355904 - protein, 9 aa, Homo Sapiens
SPKRHHKQL

SEQ ID NO: 355905 - protein, 9 aa, Homo Sapiens
LRVQQLVEQ

SEQ ID NO: 355906 - protein, 9 aa, Homo Sapiens
SQLSVFKVV

SEQ ID NO: 355907 - protein, 9 aa, Homo Sapiens
QTHTISLPI

SEQ ID NO: 355908 - protein, 9 aa, Homo Sapiens
PVERDSIHR

SEQ ID NO: 355909 - protein, 9 aa, Homo Sapiens
VYAFNLFCQ

SEQ ID NO: 355910 - protein, 9 aa, Homo Sapiens
IDVGFNKGL

SEQ ID NO: 355911 - protein, 9 aa, Homo Sapiens
HSIKFHPSE

SEQ ID NO: 355912 - protein, 9 aa, Homo Sapiens
AQVEQLCQA

SEQ ID NO: 355913 - protein, 9 aa, Homo Sapiens
VSSELDNHP

SEQ ID NO: 355914 - protein, 9 aa, Homo Sapiens
LLQTVMTMM

SEQ ID NO: 355915 - protein, 9 aa, Homo Sapiens
PSAQINYQS

SEQ ID NO: 355916 - protein, 9 aa, Homo Sapiens
KNKLPVPIP

SEQ ID NO: 355917 - protein, 9 aa, Homo Sapiens
MILMTNHLY

SEQ ID NO: 355918 - protein, 9 aa, Homo Sapiens
PKYVNIFIN

SEQ ID NO: 355919 - protein, 9 aa, Homo Sapiens
LSLSNVSKQ

SEQ ID NO: 355920 - protein, 9 aa, Homo Sapiens
ERAREINCG

SEQ ID NO: 355921 - protein, 9 aa, Homo Sapiens
IPSEVPGQT

SEQ ID NO: 355922 - protein, 9 aa, Homo Sapiens
DAMQHAAEL

SEQ ID NO: 355923 - protein, 9 aa, Homo Sapiens
FSINSDIWS

SEQ ID NO: 355924 - protein, 9 aa, Homo Sapiens
LVTTKGENH

SEQ ID NO: 355925 - protein, 9 aa, Homo Sapiens
IVHRNLKLD

SEQ ID NO: 355926 - protein, 9 aa, Homo Sapiens
QQRRLEWER

SEQ ID NO: 355927 - protein, 9 aa, Homo Sapiens
QAGVLGFNT

SEQ ID NO: 355928 - protein, 9 aa, Homo Sapiens
TSFKQTLEP

SEQ ID NO: 355929 - protein, 9 aa, Homo Sapiens
GFLFLAARL

SEQ ID NO: 355930 - protein, 9 aa, Homo Sapiens
GAPVYLYEF

SEQ ID NO: 355931 - protein, 9 aa, Homo Sapiens
KVRVYLLND

SEQ ID NO: 355932 - protein, 9 aa, Homo Sapiens
VVFAIDVSS

SEQ ID NO: 355933 - protein, 9 aa, Homo Sapiens
LSKISGSII

SEQ ID NO: 355934 - protein, 9 aa, Homo Sapiens
QLATKIKEK

SEQ ID NO: 355935 - protein, 9 aa, Homo Sapiens
RHLYWDDLK

SEQ ID NO: 355936 - protein, 9 aa, Homo Sapiens
CLIHEITHT

SEQ ID NO: 355937 - protein, 9 aa, Homo Sapiens
HPRGQPPVP

SEQ ID NO: 355938 - protein, 9 aa, Homo Sapiens
DERGPNAQA

SEQ ID NO: 355939 - protein, 9 aa, Homo Sapiens
AILMLASKS

SEQ ID NO: 355940 - protein, 9 aa, Homo Sapiens
ERYELIVDV

SEQ ID NO: 355941 - protein, 9 aa, Homo Sapiens
ILPKNKGSM

SEQ ID NO: 355942 - protein, 9 aa, Homo Sapiens
NYSMVLTGA

SEQ ID NO: 355943 - protein, 9 aa, Homo Sapiens
LLPYTKFFG

SEQ ID NO: 355944 - protein, 9 aa, Homo Sapiens
YFRKETFLL

SEQ ID NO: 355945 - protein, 9 aa, Homo Sapiens
LFRITTHCL

SEQ ID NO: 355946 - protein, 9 aa, Homo Sapiens
YQTSCYCPN

SEQ ID NO: 355947 - protein, 9 aa, Homo Sapiens
VLQAEVYGV

SEQ ID NO: 355948 - protein, 9 aa, Homo Sapiens
SESVYYGCL

SEQ ID NO: 355949 - protein, 9 aa, Homo Sapiens
VSKQTEYWD

SEQ ID NO: 355950 - protein, 9 aa, Homo Sapiens
CMYQNATGE

SEQ ID NO: 355951 - protein, 9 aa, Homo Sapiens
CSEILGVVA

SEQ ID NO: 355952 - protein, 9 aa, Homo Sapiens
YNDESQIKA

SEQ ID NO: 355953 - protein, 9 aa, Homo Sapiens
KIPPPVAPK

SEQ ID NO: 355954 - protein, 9 aa, Homo Sapiens
VHPSSGPHG

SEQ ID NO: 355955 - protein, 9 aa, Homo Sapiens
NIISPLWDF

SEQ ID NO: 355956 - protein, 9 aa, Homo Sapiens
RDAGITEKV

SEQ ID NO: 355957 - protein, 9 aa, Homo Sapiens
GATEKTPDE

SEQ ID NO: 355958 - protein, 9 aa, Homo Sapiens
GKWYWKVEV

SEQ ID NO: 355959 - protein, 9 aa, Homo Sapiens
YVHIHNEIS

SEQ ID NO: 355960 - protein, 9 aa, Homo Sapiens
QLEEELQTM

SEQ ID NO: 355961 - protein, 9 aa, Homo Sapiens
QHQRVNSGE

SEQ ID NO: 355962 - protein, 9 aa, Homo Sapiens
QILGKKPWV

SEQ ID NO: 355963 - protein, 9 aa, Homo Sapiens
RNHTHVISV

SEQ ID NO: 355964 - protein, 9 aa, Homo Sapiens
VCQHNQLLP

SEQ ID NO: 355965 - protein, 9 aa, Homo Sapiens
THKTAFLGP

SEQ ID NO: 355966 - protein, 9 aa, Homo Sapiens
GFEACYVWD

SEQ ID NO: 355967 - protein, 9 aa, Homo Sapiens
TQEYNQIQK

SEQ ID NO: 355968 - protein, 9 aa, Homo Sapiens
LTSYHSTAE

SEQ ID NO: 355969 - protein, 9 aa, Homo Sapiens
LADDIIIKG

SEQ ID NO: 355970 - protein, 9 aa, Homo Sapiens
LNRFQKAVD

SEQ ID NO: 355971 - protein, 9 aa, Homo Sapiens
PHAGVAWVS

SEQ ID NO: 355972 - protein, 9 aa, Homo Sapiens
WVCINILGG

SEQ ID NO: 355973 - protein, 9 aa, Homo Sapiens
RCALNKHSL

SEQ ID NO: 355974 - protein, 9 aa, Homo Sapiens
LRETQEYNQ

SEQ ID NO: 355975 - protein, 9 aa, Homo Sapiens
DNVFRQLDK

SEQ ID NO: 355976 - protein, 9 aa, Homo Sapiens
NDLLSSSTL

SEQ ID NO: 355977 - protein, 9 aa, Homo Sapiens
TQAAQALAK

SEQ ID NO: 355978 - protein, 9 aa, Homo Sapiens
ALSWRLYKH

SEQ ID NO: 355979 - protein, 9 aa, Homo Sapiens
YCFRQTNCL

SEQ ID NO: 355980 - protein, 9 aa, Homo Sapiens
QELPFRKNK

SEQ ID NO: 355981 - protein, 9 aa, Homo Sapiens
EACLLYKIK

SEQ ID NO: 355982 - protein, 9 aa, Homo Sapiens
DEERAREIN

SEQ ID NO: 355983 - protein, 9 aa, Homo Sapiens
HRQTHTGEK

SEQ ID NO: 355984 - protein, 9 aa, Homo Sapiens
MDYSHQSGD

SEQ ID NO: 355985 - protein, 9 aa, Homo Sapiens
APKGAWGPR

SEQ ID NO: 355986 - protein, 9 aa, Homo Sapiens
TEESLCHVD

SEQ ID NO: 355987 - protein, 9 aa, Homo Sapiens
AFLPRIPKV

SEQ ID NO: 355988 - protein, 9 aa, Homo Sapiens
SHAPQSQDF

SEQ ID NO: 355989 - protein, 9 aa, Homo Sapiens
TWPCSFPMA

SEQ ID NO: 355990 - protein, 9 aa, Homo Sapiens
INENVLGAQ

SEQ ID NO: 355991 - protein, 9 aa, Homo Sapiens
HLGSPSCLS

SEQ ID NO: 355992 - protein, 9 aa, Homo Sapiens
AINLPVSVE

SEQ ID NO: 355993 - protein, 9 aa, Homo Sapiens
NFTKNRKDK

SEQ ID NO: 355994 - protein, 9 aa, Homo Sapiens
FNLFSTNDS

SEQ ID NO: 355995 - protein, 9 aa, Homo Sapiens
FKWYGSCVQ

SEQ ID NO: 355996 - protein, 9 aa, Homo Sapiens
RELSVSDDS

SEQ ID NO: 355997 - protein, 9 aa, Homo Sapiens
LNCLLMIEC

SEQ ID NO: 355998 - protein, 9 aa, Homo Sapiens
SLLWSEVEA

SEQ ID NO: 355999 - protein, 9 aa, Homo Sapiens
TLARSLLVN

SEQ ID NO: 356000 - protein, 9 aa, Homo Sapiens
LKSATAIAV

SEQ ID NO: 356001 - protein, 9 aa, Homo Sapiens
VRRKEKDNR

SEQ ID NO: 356002 - protein, 9 aa, Homo Sapiens
RRTYNALNV

SEQ ID NO: 356003 - protein, 9 aa, Homo Sapiens
PHRLTGNNV

SEQ ID NO: 356004 - protein, 9 aa, Homo Sapiens
EEGIVVAVS

SEQ ID NO: 356005 - protein, 9 aa, Homo Sapiens
TDKLSLSLG

SEQ ID NO: 356006 - protein, 9 aa, Homo Sapiens
KAGHKALSI

SEQ ID NO: 356007 - protein, 9 aa, Homo Sapiens
SSLLLQIPQ

SEQ ID NO: 356008 - protein, 9 aa, Homo Sapiens
YLKEDDANR

SEQ ID NO: 356009 - protein, 9 aa, Homo Sapiens
LSASLVLLN

SEQ ID NO: 356010 - protein, 9 aa, Homo Sapiens
PQIHDGGVY

SEQ ID NO: 356011 - protein, 9 aa, Homo Sapiens
EIFFGRQMG

SEQ ID NO: 356012 - protein, 9 aa, Homo Sapiens
IKAIKLAEQ

SEQ ID NO: 356013 - protein, 9 aa, Homo Sapiens
AVQKQLWDV

SEQ ID NO: 356014 - protein, 9 aa, Homo Sapiens
QILAAALTQ

SEQ ID NO: 356015 - protein, 9 aa, Homo Sapiens
CTMEVEGGD

SEQ ID NO: 356016 - protein, 9 aa, Homo Sapiens
PYPALLQHN

SEQ ID NO: 356017 - protein, 9 aa, Homo Sapiens
WAKSDKRTF

SEQ ID NO: 356018 - protein, 9 aa, Homo Sapiens
SEQLVPVDG

SEQ ID NO: 356019 - protein, 9 aa, Homo Sapiens
RVVLRLKAE

SEQ ID NO: 356020 - protein, 9 aa, Homo Sapiens
ELEEENMVL

SEQ ID NO: 356021 - protein, 9 aa, Homo Sapiens
IVLLVTGIA

SEQ ID NO: 356022 - protein, 9 aa, Homo Sapiens
PEPLVLVSP

SEQ ID NO: 356023 - protein, 9 aa, Homo Sapiens
QNATGESCN

SEQ ID NO: 356024 - protein, 9 aa, Homo Sapiens
IVLSFPAGI

SEQ ID NO: 356025 - protein, 9 aa, Homo Sapiens
LTNKCQEQQ

SEQ ID NO: 356026 - protein, 9 aa, Homo Sapiens
YLCLPGMLQ

SEQ ID NO: 356027 - protein, 9 aa, Homo Sapiens
RTFWINERT

SEQ ID NO: 356028 - protein, 9 aa, Homo Sapiens
DAGAPVYLY

SEQ ID NO: 356029 - protein, 9 aa, Homo Sapiens
LVSVSKDNS

SEQ ID NO: 356030 - protein, 9 aa, Homo Sapiens
GFPFHTPLK

SEQ ID NO: 356031 - protein, 9 aa, Homo Sapiens
AQAHEEALS

SEQ ID NO: 356032 - protein, 9 aa, Homo Sapiens
KHVISKEAQ

SEQ ID NO: 356033 - protein, 9 aa, Homo Sapiens
NHFQKANCS

SEQ ID NO: 356034 - protein, 9 aa, Homo Sapiens
AVSQDCYTR

SEQ ID NO: 356035 - protein, 9 aa, Homo Sapiens
SKEADILEV

SEQ ID NO: 356036 - protein, 9 aa, Homo Sapiens
SKYLPSPHP

SEQ ID NO: 356037 - protein, 9 aa, Homo Sapiens
HKQQGEMLH

SEQ ID NO: 356038 - protein, 9 aa, Homo Sapiens
GADDSLDKF

SEQ ID NO: 356039 - protein, 9 aa, Homo Sapiens
VMHYLICVE

SEQ ID NO: 356040 - protein, 9 aa, Homo Sapiens
NYSKPQPTY

SEQ ID NO: 356041 - protein, 9 aa, Homo Sapiens
FHIFQAIDK

SEQ ID NO: 356042 - protein, 9 aa, Homo Sapiens
VVVVFVVSW

SEQ ID NO: 356043 - protein, 9 aa, Homo Sapiens
MKIQRAHHK

SEQ ID NO: 356044 - protein, 9 aa, Homo Sapiens
TCGRSSCCS

SEQ ID NO: 356045 - protein, 9 aa, Homo Sapiens
SVIRFFIKG

SEQ ID NO: 356046 - protein, 9 aa, Homo Sapiens
EDFPAARHL

SEQ ID NO: 356047 - protein, 9 aa, Homo Sapiens
PNLAANNVF

SEQ ID NO: 356048 - protein, 9 aa, Homo Sapiens
SQKIPREPI

SEQ ID NO: 356049 - protein, 9 aa, Homo Sapiens
LLSLCQCPP

SEQ ID NO: 356050 - protein, 9 aa, Homo Sapiens
KTKSGYFLS

SEQ ID NO: 356051 - protein, 9 aa, Homo Sapiens
KLDNEVEQR

SEQ ID NO: 356052 - protein, 9 aa, Homo Sapiens
RLSSLIQLT

SEQ ID NO: 356053 - protein, 9 aa, Homo Sapiens
VAEVAVSVI

SEQ ID NO: 356054 - protein, 9 aa, Homo Sapiens
GILELLWTV

SEQ ID NO: 356055 - protein, 9 aa, Homo Sapiens
RHYDDFFEQ

SEQ ID NO: 356056 - protein, 9 aa, Homo Sapiens
LLSICIDWF

SEQ ID NO: 356057 - protein, 9 aa, Homo Sapiens
PTVIDEIQN

SEQ ID NO: 356058 - protein, 9 aa, Homo Sapiens
AANGIDDKD

SEQ ID NO: 356059 - protein, 9 aa, Homo Sapiens
IQIDLRCPL

SEQ ID NO: 356060 - protein, 9 aa, Homo Sapiens
QQTIFSVFN

SEQ ID NO: 356061 - protein, 9 aa, Homo Sapiens
NLLLLQTAE

SEQ ID NO: 356062 - protein, 9 aa, Homo Sapiens
YSVGAGHFW

SEQ ID NO: 356063 - protein, 9 aa, Homo Sapiens
SASLTSCII

SEQ ID NO: 356064 - protein, 9 aa, Homo Sapiens
KSNLGWAPL

SEQ ID NO: 356065 - protein, 9 aa, Homo Sapiens
YSKIAKIVS

SEQ ID NO: 356066 - protein, 9 aa, Homo Sapiens
VPKYAKYIA

SEQ ID NO: 356067 - protein, 9 aa, Homo Sapiens
GKPYSPISN

SEQ ID NO: 356068 - protein, 9 aa, Homo Sapiens
CLFWGVLLA

SEQ ID NO: 356069 - protein, 9 aa, Homo Sapiens
GCEPRSQTA

SEQ ID NO: 356070 - protein, 9 aa, Homo Sapiens
GNITVYETT

SEQ ID NO: 356071 - protein, 9 aa, Homo Sapiens
RFHKRKHKH

SEQ ID NO: 356072 - protein, 9 aa, Homo Sapiens
SGFFCFFFF

SEQ ID NO: 356073 - protein, 9 aa, Homo Sapiens
MNVTGPQIH

SEQ ID NO: 356074 - protein, 9 aa, Homo Sapiens
GGVFLSHES

SEQ ID NO: 356075 - protein, 9 aa, Homo Sapiens
HCLCELPAL

SEQ ID NO: 356076 - protein, 9 aa, Homo Sapiens
RVKEKRNTT

SEQ ID NO: 356077 - protein, 9 aa, Homo Sapiens
LAEEDDIIV

SEQ ID NO: 356078 - protein, 9 aa, Homo Sapiens
QQNKQIFLR

SEQ ID NO: 356079 - protein, 9 aa, Homo Sapiens
LIQKLSWIA

SEQ ID NO: 356080 - protein, 9 aa, Homo Sapiens
ANLTTHKII

SEQ ID NO: 356081 - protein, 9 aa, Homo Sapiens
EVRPTCFEM

SEQ ID NO: 356082 - protein, 9 aa, Homo Sapiens
QILFINLCQ

SEQ ID NO: 356083 - protein, 9 aa, Homo Sapiens
HLANLYIFS

SEQ ID NO: 356084 - protein, 9 aa, Homo Sapiens
TDVALACAR

SEQ ID NO: 356085 - protein, 9 aa, Homo Sapiens
VSIDDLKNP

SEQ ID NO: 356086 - protein, 9 aa, Homo Sapiens
VIKSIFAFV

SEQ ID NO: 356087 - protein, 9 aa, Homo Sapiens
LGEGATEVE

SEQ ID NO: 356088 - protein, 9 aa, Homo Sapiens
LLVTGIATS

SEQ ID NO: 356089 - protein, 9 aa, Homo Sapiens
HPAHAEVIK

SEQ ID NO: 356090 - protein, 9 aa, Homo Sapiens
LIDLVTNES

SEQ ID NO: 356091 - protein, 9 aa, Homo Sapiens
LSQIEERKA

SEQ ID NO: 356092 - protein, 9 aa, Homo Sapiens
LCNLGTERF

SEQ ID NO: 356093 - protein, 9 aa, Homo Sapiens
IFYAHPEWE

SEQ ID NO: 356094 - protein, 9 aa, Homo Sapiens
FHGSSTIQN

SEQ ID NO: 356095 - protein, 9 aa, Homo Sapiens
SLISIHDNK

SEQ ID NO: 356096 - protein, 9 aa, Homo Sapiens
MMKLKGAVA

SEQ ID NO: 356097 - protein, 9 aa, Homo Sapiens
LCPSGLKDM

SEQ ID NO: 356098 - protein, 9 aa, Homo Sapiens
DKLLVNVVF

SEQ ID NO: 356099 - protein, 9 aa, Homo Sapiens
TRSNVSFYI

SEQ ID NO: 356100 - protein, 9 aa, Homo Sapiens
FQCGELIIE

SEQ ID NO: 356101 - protein, 9 aa, Homo Sapiens
TSQRGKSGF

SEQ ID NO: 356102 - protein, 9 aa, Homo Sapiens
TICDGALIA

SEQ ID NO: 356103 - protein, 9 aa, Homo Sapiens
YLCTPRHKI

SEQ ID NO: 356104 - protein, 9 aa, Homo Sapiens
INLLSVAYK

SEQ ID NO: 356105 - protein, 9 aa, Homo Sapiens
PNHRNAVIV

SEQ ID NO: 356106 - protein, 9 aa, Homo Sapiens
DVLEMLASF

SEQ ID NO: 356107 - protein, 9 aa, Homo Sapiens
PGGATSSHR

SEQ ID NO: 356108 - protein, 9 aa, Homo Sapiens
EDWNLVMYD

SEQ ID NO: 356109 - protein, 9 aa, Homo Sapiens
KITDKLSLS

SEQ ID NO: 356110 - protein, 9 aa, Homo Sapiens
KKAIQREDF

SEQ ID NO: 356111 - protein, 9 aa, Homo Sapiens
EVEQALKER

SEQ ID NO: 356112 - protein, 9 aa, Homo Sapiens
NIKVLTADI

SEQ ID NO: 356113 - protein, 9 aa, Homo Sapiens
NYVACGGLN

SEQ ID NO: 356114 - protein, 9 aa, Homo Sapiens
LFSSITNHK

SEQ ID NO: 356115 - protein, 9 aa, Homo Sapiens
SQTEEPTVA

SEQ ID NO: 356116 - protein, 9 aa, Homo Sapiens
STSINFNII

SEQ ID NO: 356117 - protein, 9 aa, Homo Sapiens
VMNLDNLTR

SEQ ID NO: 356118 - protein, 9 aa, Homo Sapiens
RKFIILITD

SEQ ID NO: 356119 - protein, 9 aa, Homo Sapiens
ECIEWAKSD

SEQ ID NO: 356120 - protein, 9 aa, Homo Sapiens
TVKLLTGAS

SEQ ID NO: 356121 - protein, 9 aa, Homo Sapiens
SYCPHCGEK

SEQ ID NO: 356122 - protein, 9 aa, Homo Sapiens
MEAPKIFKR

SEQ ID NO: 356123 - protein, 9 aa, Homo Sapiens
FLKNSNMFD

SEQ ID NO: 356124 - protein, 9 aa, Homo Sapiens
AVIIGGVTR

SEQ ID NO: 356125 - protein, 9 aa, Homo Sapiens
YHKNLLKYL

SEQ ID NO: 356126 - protein, 9 aa, Homo Sapiens
NIYPTSKLV

SEQ ID NO: 356127 - protein, 9 aa, Homo Sapiens
SHAFLPRIP

SEQ ID NO: 356128 - protein, 9 aa, Homo Sapiens
SGVVTVAGN

SEQ ID NO: 356129 - protein, 9 aa, Homo Sapiens
ACQIRYERD

SEQ ID NO: 356130 - protein, 9 aa, Homo Sapiens
SFQIHEITH

SEQ ID NO: 356131 - protein, 9 aa, Homo Sapiens
LKSKGYDFE

SEQ ID NO: 356132 - protein, 9 aa, Homo Sapiens
HAPSSNFLS

SEQ ID NO: 356133 - protein, 9 aa, Homo Sapiens
VHATHTLTQ

SEQ ID NO: 356134 - protein, 9 aa, Homo Sapiens
RVQQLVEQV

SEQ ID NO: 356135 - protein, 9 aa, Homo Sapiens
KETSLIEVY

SEQ ID NO: 356136 - protein, 9 aa, Homo Sapiens
YTIGKEFIN

SEQ ID NO: 356137 - protein, 9 aa, Homo Sapiens
TYKSFEFFI

SEQ ID NO: 356138 - protein, 9 aa, Homo Sapiens
EHKLSPGVF

SEQ ID NO: 356139 - protein, 9 aa, Homo Sapiens
SFNLYASVL

SEQ ID NO: 356140 - protein, 9 aa, Homo Sapiens
ILSELFQRG

SEQ ID NO: 356141 - protein, 9 aa, Homo Sapiens
HRIFFPRKC

SEQ ID NO: 356142 - protein, 9 aa, Homo Sapiens
QDSGHNRTV

SEQ ID NO: 356143 - protein, 9 aa, Homo Sapiens
ENDERELSP

SEQ ID NO: 356144 - protein, 9 aa, Homo Sapiens
PIQNSNTEE

SEQ ID NO: 356145 - protein, 9 aa, Homo Sapiens
INCGFVAFM

SEQ ID NO: 356146 - protein, 9 aa, Homo Sapiens
GAMALNEKR

SEQ ID NO: 356147 - protein, 9 aa, Homo Sapiens
KMAIGHREQ

SEQ ID NO: 356148 - protein, 9 aa, Homo Sapiens
ECPPPYFSW

SEQ ID NO: 356149 - protein, 9 aa, Homo Sapiens
ESQIRGTER

SEQ ID NO: 356150 - protein, 9 aa, Homo Sapiens
TGEKLYICM

SEQ ID NO: 356151 - protein, 9 aa, Homo Sapiens
HYHRKENLE

SEQ ID NO: 356152 - protein, 9 aa, Homo Sapiens
INQPLLSLR

SEQ ID NO: 356153 - protein, 9 aa, Homo Sapiens
HPPIKAFSD

SEQ ID NO: 356154 - protein, 9 aa, Homo Sapiens
MNLLVDLQN

SEQ ID NO: 356155 - protein, 9 aa, Homo Sapiens
EAEEDSSGG

SEQ ID NO: 356156 - protein, 9 aa, Homo Sapiens
NTTDLDEGV

SEQ ID NO: 356157 - protein, 9 aa, Homo Sapiens
LGKQQQWSE

SEQ ID NO: 356158 - protein, 9 aa, Homo Sapiens
WCIGDFRPN

SEQ ID NO: 356159 - protein, 9 aa, Homo Sapiens
KANAREWTR

SEQ ID NO: 356160 - protein, 9 aa, Homo Sapiens
SQEKKITAL

SEQ ID NO: 356161 - protein, 9 aa, Homo Sapiens
CSVEIQITL

SEQ ID NO: 356162 - protein, 9 aa, Homo Sapiens
TATQCRLDK

SEQ ID NO: 356163 - protein, 9 aa, Homo Sapiens
PVLTTAKTS

SEQ ID NO: 356164 - protein, 9 aa, Homo Sapiens
VRDKDYGQN

SEQ ID NO: 356165 - protein, 9 aa, Homo Sapiens
AAKQQRKKM

SEQ ID NO: 356166 - protein, 9 aa, Homo Sapiens
ATNNSKWVE

SEQ ID NO: 356167 - protein, 9 aa, Homo Sapiens
SYLSACLIS

SEQ ID NO: 356168 - protein, 9 aa, Homo Sapiens
HFKTRKLAG

SEQ ID NO: 356169 - protein, 9 aa, Homo Sapiens
HNRSRIQVW

SEQ ID NO: 356170 - protein, 9 aa, Homo Sapiens
YSQNSNSYL

SEQ ID NO: 356171 - protein, 9 aa, Homo Sapiens
MLERHEEAE

SEQ ID NO: 356172 - protein, 9 aa, Homo Sapiens
YFDCWFQIF

SEQ ID NO: 356173 - protein, 9 aa, Homo Sapiens
DTFNLHLLE

SEQ ID NO: 356174 - protein, 9 aa, Homo Sapiens
IQTQIISKK

SEQ ID NO: 356175 - protein, 9 aa, Homo Sapiens
TLSTIKDHL

SEQ ID NO: 356176 - protein, 9 aa, Homo Sapiens
DKNISIFDF

SEQ ID NO: 356177 - protein, 9 aa, Homo Sapiens
VAIKHRNEA

SEQ ID NO: 356178 - protein, 9 aa, Homo Sapiens
GCVAPQCKR

SEQ ID NO: 356179 - protein, 9 aa, Homo Sapiens
QRWAQQTPV

SEQ ID NO: 356180 - protein, 9 aa, Homo Sapiens
LQSREETQN

SEQ ID NO: 356181 - protein, 9 aa, Homo Sapiens
KNASENKEI

SEQ ID NO: 356182 - protein, 9 aa, Homo Sapiens
FVFPVYQGS

SEQ ID NO: 356183 - protein, 9 aa, Homo Sapiens
GMDSLSSES

SEQ ID NO: 356184 - protein, 9 aa, Homo Sapiens
KESQWDDGK

SEQ ID NO: 356185 - protein, 9 aa, Homo Sapiens
SRKFNLMYD

SEQ ID NO: 356186 - protein, 9 aa, Homo Sapiens
IGSGNLSQV

SEQ ID NO: 356187 - protein, 9 aa, Homo Sapiens
KCNLDKERM

SEQ ID NO: 356188 - protein, 9 aa, Homo Sapiens
SELFTNQKE

SEQ ID NO: 356189 - protein, 9 aa, Homo Sapiens
AIDKMTNKM

SEQ ID NO: 356190 - protein, 9 aa, Homo Sapiens
DWKAYIQDS

SEQ ID NO: 356191 - protein, 9 aa, Homo Sapiens
HLTIHQIIH

SEQ ID NO: 356192 - protein, 9 aa, Homo Sapiens
NSKAVKNLA

SEQ ID NO: 356193 - protein, 9 aa, Homo Sapiens
AFARWPSLR

SEQ ID NO: 356194 - protein, 9 aa, Homo Sapiens
ISSEEEESL

SEQ ID NO: 356195 - protein, 9 aa, Homo Sapiens
FRLVLNFQP

SEQ ID NO: 356196 - protein, 9 aa, Homo Sapiens
NKVDFILLG

SEQ ID NO: 356197 - protein, 9 aa, Homo Sapiens
GKQRSYTKD

SEQ ID NO: 356198 - protein, 9 aa, Homo Sapiens
YFHHKSDNQ

SEQ ID NO: 356199 - protein, 9 aa, Homo Sapiens
PFMFIMKHN

SEQ ID NO: 356200 - protein, 9 aa, Homo Sapiens
WNYNKSWIH

SEQ ID NO: 356201 - protein, 9 aa, Homo Sapiens
QRVNSGERP

SEQ ID NO: 356202 - protein, 9 aa, Homo Sapiens
KVKKATVNS

SEQ ID NO: 356203 - protein, 9 aa, Homo Sapiens
VLSGNCDQR

SEQ ID NO: 356204 - protein, 9 aa, Homo Sapiens
EAAAKYVPS

SEQ ID NO: 356205 - protein, 9 aa, Homo Sapiens
INLDDDDMF

SEQ ID NO: 356206 - protein, 9 aa, Homo Sapiens
PVYPVMAKK

SEQ ID NO: 356207 - protein, 9 aa, Homo Sapiens
PVLEHEARH

SEQ ID NO: 356208 - protein, 9 aa, Homo Sapiens
QNQYDLKTA

SEQ ID NO: 356209 - protein, 9 aa, Homo Sapiens
CCIVLFVSD

SEQ ID NO: 356210 - protein, 9 aa, Homo Sapiens
HFKYVHYYL

SEQ ID NO: 356211 - protein, 9 aa, Homo Sapiens
KDELNHSLR

SEQ ID NO: 356212 - protein, 9 aa, Homo Sapiens
QNMVAWFEK

SEQ ID NO: 356213 - protein, 9 aa, Homo Sapiens
LDQVLYQRV

SEQ ID NO: 356214 - protein, 9 aa, Homo Sapiens
GQEDCLELL

SEQ ID NO: 356215 - protein, 9 aa, Homo Sapiens
AFADTEIRL

SEQ ID NO: 356216 - protein, 9 aa, Homo Sapiens
KSALESHKI

SEQ ID NO: 356217 - protein, 9 aa, Homo Sapiens
VTWVSGSLA

SEQ ID NO: 356218 - protein, 9 aa, Homo Sapiens
VIQQGAGAL

SEQ ID NO: 356219 - protein, 9 aa, Homo Sapiens
HRIVDKMHN

SEQ ID NO: 356220 - protein, 9 aa, Homo Sapiens
IKTTSEDGT

SEQ ID NO: 356221 - protein, 9 aa, Homo Sapiens
QNEGIKSLW

SEQ ID NO: 356222 - protein, 9 aa, Homo Sapiens
TKTQMFIHF

SEQ ID NO: 356223 - protein, 9 aa, Homo Sapiens
GERPRYLDI

SEQ ID NO: 356224 - protein, 9 aa, Homo Sapiens
QYHFCYNVA

SEQ ID NO: 356225 - protein, 9 aa, Homo Sapiens
IPPPVAPKP

SEQ ID NO: 356226 - protein, 9 aa, Homo Sapiens
DLTMEELSL

SEQ ID NO: 356227 - protein, 9 aa, Homo Sapiens
GLPGTSWSP

SEQ ID NO: 356228 - protein, 9 aa, Homo Sapiens
GPGLSLGGT

SEQ ID NO: 356229 - protein, 9 aa, Homo Sapiens
SGWGGGTPD

SEQ ID NO: 356230 - protein, 9 aa, Homo Sapiens
AQFDLYKLL

SEQ ID NO: 356231 - protein, 9 aa, Homo Sapiens
RSRSGSIKR

SEQ ID NO: 356232 - protein, 9 aa, Homo Sapiens
ASDDFRNKY

SEQ ID NO: 356233 - protein, 9 aa, Homo Sapiens
WDASACVIM

SEQ ID NO: 356234 - protein, 9 aa, Homo Sapiens
EDMFAKLKD

SEQ ID NO: 356235 - protein, 9 aa, Homo Sapiens
SIMLNIMEE

SEQ ID NO: 356236 - protein, 9 aa, Homo Sapiens
ISTSINFNI

SEQ ID NO: 356237 - protein, 9 aa, Homo Sapiens
VKFSECLKK

SEQ ID NO: 356238 - protein, 9 aa, Homo Sapiens
VTNIFISWF

SEQ ID NO: 356239 - protein, 9 aa, Homo Sapiens
LDITTAAVL

SEQ ID NO: 356240 - protein, 9 aa, Homo Sapiens
LISPAAECI

SEQ ID NO: 356241 - protein, 9 aa, Homo Sapiens
LKTANGKGE

SEQ ID NO: 356242 - protein, 9 aa, Homo Sapiens
NDIATFLDT

SEQ ID NO: 356243 - protein, 9 aa, Homo Sapiens
VIGDLKIMF

SEQ ID NO: 356244 - protein, 9 aa, Homo Sapiens
SCELELQVQ

SEQ ID NO: 356245 - protein, 9 aa, Homo Sapiens
NPPWAESSA

SEQ ID NO: 356246 - protein, 9 aa, Homo Sapiens
SNVRGKQHG

SEQ ID NO: 356247 - protein, 9 aa, Homo Sapiens
TIQRINENV

SEQ ID NO: 356248 - protein, 9 aa, Homo Sapiens
LPGYTGEFC

SEQ ID NO: 356249 - protein, 9 aa, Homo Sapiens
QQKTLDLKS

SEQ ID NO: 356250 - protein, 9 aa, Homo Sapiens
PVGITAFCL

SEQ ID NO: 356251 - protein, 9 aa, Homo Sapiens
WRLYKHTNS

SEQ ID NO: 356252 - protein, 9 aa, Homo Sapiens
EQQDAYELF

SEQ ID NO: 356253 - protein, 9 aa, Homo Sapiens
DMSHTDVCQ

SEQ ID NO: 356254 - protein, 9 aa, Homo Sapiens
ALQPFFTLQ

SEQ ID NO: 356255 - protein, 9 aa, Homo Sapiens
EAKLQFAYI

SEQ ID NO: 356256 - protein, 9 aa, Homo Sapiens
WIMLVDDSN

SEQ ID NO: 356257 - protein, 9 aa, Homo Sapiens
SSSVLTGTS

SEQ ID NO: 356258 - protein, 9 aa, Homo Sapiens
TKGEILVII

SEQ ID NO: 356259 - protein, 9 aa, Homo Sapiens
MASFGASIT

SEQ ID NO: 356260 - protein, 9 aa, Homo Sapiens
NIFSIVPVI

SEQ ID NO: 356261 - protein, 9 aa, Homo Sapiens
KQATMKALQ

SEQ ID NO: 356262 - protein, 9 aa, Homo Sapiens
PRAKIKVLK

SEQ ID NO: 356263 - protein, 9 aa, Homo Sapiens
AVIAEQLAQ

SEQ ID NO: 356264 - protein, 9 aa, Homo Sapiens
DYGKNGQVV

SEQ ID NO: 356265 - protein, 9 aa, Homo Sapiens
AYAHKYLLA

SEQ ID NO: 356266 - protein, 9 aa, Homo Sapiens
HSGKAITFV

SEQ ID NO: 356267 - protein, 9 aa, Homo Sapiens
PSATISWFW

SEQ ID NO: 356268 - protein, 9 aa, Homo Sapiens
SFLRGYLLG

SEQ ID NO: 356269 - protein, 9 aa, Homo Sapiens
MENILQATK

SEQ ID NO: 356270 - protein, 9 aa, Homo Sapiens
QTHKERSTS

SEQ ID NO: 356271 - protein, 9 aa, Homo Sapiens
GNTTDQAGF

SEQ ID NO: 356272 - protein, 9 aa, Homo Sapiens
SSEIIRGKR

SEQ ID NO: 356273 - protein, 9 aa, Homo Sapiens
TADKDEEGV

SEQ ID NO: 356274 - protein, 9 aa, Homo Sapiens
ATTDSTTSK

SEQ ID NO: 356275 - protein, 9 aa, Homo Sapiens
ERLTAREYA

SEQ ID NO: 356276 - protein, 9 aa, Homo Sapiens
WSKDYWIAK

SEQ ID NO: 356277 - protein, 9 aa, Homo Sapiens
IHEANRDAN

SEQ ID NO: 356278 - protein, 9 aa, Homo Sapiens
PFPGVLECC

SEQ ID NO: 356279 - protein, 9 aa, Homo Sapiens
NQNHVVSQK

SEQ ID NO: 356280 - protein, 9 aa, Homo Sapiens
SCSSVVLKT

SEQ ID NO: 356281 - protein, 9 aa, Homo Sapiens
NFLLFCAYA

SEQ ID NO: 356282 - protein, 9 aa, Homo Sapiens
QQKKEKELV

SEQ ID NO: 356283 - protein, 9 aa, Homo Sapiens
GGWQTLQSA

SEQ ID NO: 356284 - protein, 9 aa, Homo Sapiens
GTFRLRQGS

SEQ ID NO: 356285 - protein, 9 aa, Homo Sapiens
YDKDKKSKK

SEQ ID NO: 356286 - protein, 9 aa, Homo Sapiens
VFVVVITDG

SEQ ID NO: 356287 - protein, 9 aa, Homo Sapiens
ISPLWDFRE

SEQ ID NO: 356288 - protein, 9 aa, Homo Sapiens
DLCLVNSSL

SEQ ID NO: 356289 - protein, 9 aa, Homo Sapiens
LHTAVYHEI

SEQ ID NO: 356290 - protein, 9 aa, Homo Sapiens
LEQQCNLTT

SEQ ID NO: 356291 - protein, 9 aa, Homo Sapiens
NMTKWEQKY

SEQ ID NO: 356292 - protein, 9 aa, Homo Sapiens
AVTFDLSGM

SEQ ID NO: 356293 - protein, 9 aa, Homo Sapiens
LFLSVALLS

SEQ ID NO: 356294 - protein, 9 aa, Homo Sapiens
EVCKEEQRY

SEQ ID NO: 356295 - protein, 9 aa, Homo Sapiens
RDNGSWEVI

SEQ ID NO: 356296 - protein, 9 aa, Homo Sapiens
HMLAVMAYD

SEQ ID NO: 356297 - protein, 9 aa, Homo Sapiens
IRPANQYKD

SEQ ID NO: 356298 - protein, 9 aa, Homo Sapiens
SRLSSFSLR

SEQ ID NO: 356299 - protein, 9 aa, Homo Sapiens
DEIQNGPYR

SEQ ID NO: 356300 - protein, 9 aa, Homo Sapiens
KYPDNFFLL

SEQ ID NO: 356301 - protein, 9 aa, Homo Sapiens
DSMERGDLV

SEQ ID NO: 356302 - protein, 9 aa, Homo Sapiens
DLRCPLSRN

SEQ ID NO: 356303 - protein, 9 aa, Homo Sapiens
SSNGCMHTL

SEQ ID NO: 356304 - protein, 9 aa, Homo Sapiens
PTKLQDQTG

SEQ ID NO: 356305 - protein, 9 aa, Homo Sapiens
HSKAISESE

SEQ ID NO: 356306 - protein, 9 aa, Homo Sapiens
KEGDEKLDL

SEQ ID NO: 356307 - protein, 9 aa, Homo Sapiens
VQEKAGLPQ

SEQ ID NO: 356308 - protein, 9 aa, Homo Sapiens
PPHLANLYI

SEQ ID NO: 356309 - protein, 9 aa, Homo Sapiens
SINFNIIKI

SEQ ID NO: 356310 - protein, 9 aa, Homo Sapiens
DLQNGMIIP

SEQ ID NO: 356311 - protein, 9 aa, Homo Sapiens
GNQAGGSGS

SEQ ID NO: 356312 - protein, 9 aa, Homo Sapiens
LLFFRICPI

SEQ ID NO: 356313 - protein, 9 aa, Homo Sapiens
PITCCLVKA

SEQ ID NO: 356314 - protein, 9 aa, Homo Sapiens
YSTLKHEGF

SEQ ID NO: 356315 - protein, 9 aa, Homo Sapiens
KLNSLSELA

SEQ ID NO: 356316 - protein, 9 aa, Homo Sapiens
IKYLSQEFG

SEQ ID NO: 356317 - protein, 9 aa, Homo Sapiens
LDSVGGKII

SEQ ID NO: 356318 - protein, 9 aa, Homo Sapiens
LFQVEFDNA

SEQ ID NO: 356319 - protein, 9 aa, Homo Sapiens
CSHVLVGLE

SEQ ID NO: 356320 - protein, 9 aa, Homo Sapiens
RKLLSKLEE

SEQ ID NO: 356321 - protein, 9 aa, Homo Sapiens
IQSAKEQIK

SEQ ID NO: 356322 - protein, 9 aa, Homo Sapiens
STNNGKRCP

SEQ ID NO: 356323 - protein, 9 aa, Homo Sapiens
NVLKVLTNK

SEQ ID NO: 356324 - protein, 9 aa, Homo Sapiens
MNKMSFVEK

SEQ ID NO: 356325 - protein, 9 aa, Homo Sapiens
ELEDSDDKE

SEQ ID NO: 356326 - protein, 9 aa, Homo Sapiens
MTSILDHLN

SEQ ID NO: 356327 - protein, 9 aa, Homo Sapiens
RMWNDTVQK

SEQ ID NO: 356328 - protein, 9 aa, Homo Sapiens
RQQYPSPGS

SEQ ID NO: 356329 - protein, 9 aa, Homo Sapiens
LIHSTHIHI

SEQ ID NO: 356330 - protein, 9 aa, Homo Sapiens
PAEKEVTEL

SEQ ID NO: 356331 - protein, 9 aa, Homo Sapiens
GEKLYICMK

SEQ ID NO: 356332 - protein, 9 aa, Homo Sapiens
RTASGITNQ

SEQ ID NO: 356333 - protein, 9 aa, Homo Sapiens
PADIQILAI

SEQ ID NO: 356334 - protein, 9 aa, Homo Sapiens
SFLIKRLPI

SEQ ID NO: 356335 - protein, 9 aa, Homo Sapiens
YECNECGRY

SEQ ID NO: 356336 - protein, 9 aa, Homo Sapiens
ALQSHERTH

SEQ ID NO: 356337 - protein, 9 aa, Homo Sapiens
LSASLSENE

SEQ ID NO: 356338 - protein, 9 aa, Homo Sapiens
KIMQSIKGW

SEQ ID NO: 356339 - protein, 9 aa, Homo Sapiens
KSDKRTFLR

SEQ ID NO: 356340 - protein, 9 aa, Homo Sapiens
TIHQIIHTG

SEQ ID NO: 356341 - protein, 9 aa, Homo Sapiens
AKTIKNETD

SEQ ID NO: 356342 - protein, 9 aa, Homo Sapiens
GRASDQSEF

SEQ ID NO: 356343 - protein, 9 aa, Homo Sapiens
TENADSDII

SEQ ID NO: 356344 - protein, 9 aa, Homo Sapiens
HPSTEAPEQ

SEQ ID NO: 356345 - protein, 9 aa, Homo Sapiens
NIKLKLSNI

SEQ ID NO: 356346 - protein, 9 aa, Homo Sapiens
PFPIIDGRN

SEQ ID NO: 356347 - protein, 9 aa, Homo Sapiens
LFATYVLAS

SEQ ID NO: 356348 - protein, 9 aa, Homo Sapiens
ADWSKDIQT

SEQ ID NO: 356349 - protein, 9 aa, Homo Sapiens
SLVQLIVQT

SEQ ID NO: 356350 - protein, 9 aa, Homo Sapiens
HLAKCLDEQ

SEQ ID NO: 356351 - protein, 9 aa, Homo Sapiens
ITGVDSAMN

SEQ ID NO: 356352 - protein, 9 aa, Homo Sapiens
RIIKIEGNR

SEQ ID NO: 356353 - protein, 9 aa, Homo Sapiens
EQATKQFLK

SEQ ID NO: 356354 - protein, 9 aa, Homo Sapiens
EEKDMDISA

SEQ ID NO: 356355 - protein, 9 aa, Homo Sapiens
FKQQTPSQT

SEQ ID NO: 356356 - protein, 9 aa, Homo Sapiens
HCYRDCPHE

SEQ ID NO: 356357 - protein, 9 aa, Homo Sapiens
FYNETYDYG

SEQ ID NO: 356358 - protein, 9 aa, Homo Sapiens
KDIQTCKIL

SEQ ID NO: 356359 - protein, 9 aa, Homo Sapiens
PRQFFVDQW

SEQ ID NO: 356360 - protein, 9 aa, Homo Sapiens
FDLVDKIQT

SEQ ID NO: 356361 - protein, 9 aa, Homo Sapiens
EKLDERDAG

SEQ ID NO: 356362 - protein, 9 aa, Homo Sapiens
LVGLSSLFQ

SEQ ID NO: 356363 - protein, 9 aa, Homo Sapiens
SDTPAEEDS

SEQ ID NO: 356364 - protein, 9 aa, Homo Sapiens
APTDPKLRE

SEQ ID NO: 356365 - protein, 9 aa, Homo Sapiens
EQKEKHHVN

SEQ ID NO: 356366 - protein, 9 aa, Homo Sapiens
NEKEKKGKD

SEQ ID NO: 356367 - protein, 9 aa, Homo Sapiens
KQQRKKMEK

SEQ ID NO: 356368 - protein, 9 aa, Homo Sapiens
IGIDLWSGA

SEQ ID NO: 356369 - protein, 9 aa, Homo Sapiens
ICLECEKTS

SEQ ID NO: 356370 - protein, 9 aa, Homo Sapiens
AWQNYNKIL

SEQ ID NO: 356371 - protein, 9 aa, Homo Sapiens
NSTVKESQN

SEQ ID NO: 356372 - protein, 9 aa, Homo Sapiens
ILGVSGHLA

SEQ ID NO: 356373 - protein, 9 aa, Homo Sapiens
LFSIVGYLL

SEQ ID NO: 356374 - protein, 9 aa, Homo Sapiens
SQARSLLSL

SEQ ID NO: 356375 - protein, 9 aa, Homo Sapiens
KEYQFRCKN

SEQ ID NO: 356376 - protein, 9 aa, Homo Sapiens
RRVLAQLDD

SEQ ID NO: 356377 - protein, 9 aa, Homo Sapiens
SHQQECDED

SEQ ID NO: 356378 - protein, 9 aa, Homo Sapiens
EKSCRLYKH

SEQ ID NO: 356379 - protein, 9 aa, Homo Sapiens
ELEKKAERL

SEQ ID NO: 356380 - protein, 9 aa, Homo Sapiens
HPTYLQQAQ

SEQ ID NO: 356381 - protein, 9 aa, Homo Sapiens
RKWLQYLEK

SEQ ID NO: 356382 - protein, 9 aa, Homo Sapiens
FLSTLISQK

SEQ ID NO: 356383 - protein, 9 aa, Homo Sapiens
FGGVQDDMI

SEQ ID NO: 356384 - protein, 9 aa, Homo Sapiens
LTMLQERRC

SEQ ID NO: 356385 - protein, 9 aa, Homo Sapiens
TVHRKIHSG

SEQ ID NO: 356386 - protein, 9 aa, Homo Sapiens
TKQVERMLG

SEQ ID NO: 356387 - protein, 9 aa, Homo Sapiens
PAHRRPEHH

SEQ ID NO: 356388 - protein, 9 aa, Homo Sapiens
FRSNNFLPH

SEQ ID NO: 356389 - protein, 9 aa, Homo Sapiens
YFNGVSLMD

SEQ ID NO: 356390 - protein, 9 aa, Homo Sapiens
VISDGPAAQ

SEQ ID NO: 356391 - protein, 9 aa, Homo Sapiens
ECSHVLVGL

SEQ ID NO: 356392 - protein, 9 aa, Homo Sapiens
MIWFNSVAK

SEQ ID NO: 356393 - protein, 9 aa, Homo Sapiens
HLCVWISFY

SEQ ID NO: 356394 - protein, 9 aa, Homo Sapiens
VFITKTCPN

SEQ ID NO: 356395 - protein, 9 aa, Homo Sapiens
IEQERCKEA

SEQ ID NO: 356396 - protein, 9 aa, Homo Sapiens
LNDGQFRRT

SEQ ID NO: 356397 - protein, 9 aa, Homo Sapiens
LKVIVTLSE

SEQ ID NO: 356398 - protein, 9 aa, Homo Sapiens
CKSHYTAFS

SEQ ID NO: 356399 - protein, 9 aa, Homo Sapiens
RNPKEPDIS

SEQ ID NO: 356400 - protein, 9 aa, Homo Sapiens
SGHGMKQKQ

SEQ ID NO: 356401 - protein, 9 aa, Homo Sapiens
QDLYVRLIN

SEQ ID NO: 356402 - protein, 9 aa, Homo Sapiens
LWGLQQEML

SEQ ID NO: 356403 - protein, 9 aa, Homo Sapiens
DQHTQITQV

SEQ ID NO: 356404 - protein, 9 aa, Homo Sapiens
VAAMWHEQE

SEQ ID NO: 356405 - protein, 9 aa, Homo Sapiens
QIDLMDMAD

SEQ ID NO: 356406 - protein, 9 aa, Homo Sapiens
GEKPYGRVE

SEQ ID NO: 356407 - protein, 9 aa, Homo Sapiens
VTDHGSCVQ

SEQ ID NO: 356408 - protein, 9 aa, Homo Sapiens
IFCIQRFTK

SEQ ID NO: 356409 - protein, 9 aa, Homo Sapiens
PRDVGKVVN

SEQ ID NO: 356410 - protein, 9 aa, Homo Sapiens
WTRMHGLND

SEQ ID NO: 356411 - protein, 9 aa, Homo Sapiens
LIIRGEQVN

SEQ ID NO: 356412 - protein, 9 aa, Homo Sapiens
IKLFNEMAE

SEQ ID NO: 356413 - protein, 9 aa, Homo Sapiens
NVVFAIDVS

SEQ ID NO: 356414 - protein, 9 aa, Homo Sapiens
YNAVVGAGY

SEQ ID NO: 356415 - protein, 9 aa, Homo Sapiens
TETPEAGIH

SEQ ID NO: 356416 - protein, 9 aa, Homo Sapiens
KEKSCRLYK

SEQ ID NO: 356417 - protein, 9 aa, Homo Sapiens
LFVRRQNPQ

SEQ ID NO: 356418 - protein, 9 aa, Homo Sapiens
NTFNRCSHL

SEQ ID NO: 356419 - protein, 9 aa, Homo Sapiens
GWQNNDRVQ

SEQ ID NO: 356420 - protein, 9 aa, Homo Sapiens
AINLILLFY

SEQ ID NO: 356421 - protein, 9 aa, Homo Sapiens
SPLWDFREF

SEQ ID NO: 356422 - protein, 9 aa, Homo Sapiens
VNCFENVLI

SEQ ID NO: 356423 - protein, 9 aa, Homo Sapiens
ENPTVDLVC

SEQ ID NO: 356424 - protein, 9 aa, Homo Sapiens
QGERLMERY

SEQ ID NO: 356425 - protein, 9 aa, Homo Sapiens
ALKVEDPFY

SEQ ID NO: 356426 - protein, 9 aa, Homo Sapiens
MRMYSLKGK

SEQ ID NO: 356427 - protein, 9 aa, Homo Sapiens
TKKGATEKT

SEQ ID NO: 356428 - protein, 9 aa, Homo Sapiens
YIQYGNEKQ

SEQ ID NO: 356429 - protein, 9 aa, Homo Sapiens
LTFLRICSK

SEQ ID NO: 356430 - protein, 9 aa, Homo Sapiens
EQCPVAVKK

SEQ ID NO: 356431 - protein, 9 aa, Homo Sapiens
VNSESEGSS

SEQ ID NO: 356432 - protein, 9 aa, Homo Sapiens
QRRDFINIE

SEQ ID NO: 356433 - protein, 9 aa, Homo Sapiens
VVKFDRSKL

SEQ ID NO: 356434 - protein, 9 aa, Homo Sapiens
IIFTNTCTT

SEQ ID NO: 356435 - protein, 9 aa, Homo Sapiens
SLVMLNEVK

SEQ ID NO: 356436 - protein, 9 aa, Homo Sapiens
IQGVPQTIQ

SEQ ID NO: 356437 - protein, 9 aa, Homo Sapiens
YIRFKKFLP

SEQ ID NO: 356438 - protein, 9 aa, Homo Sapiens
PRPFSVCYD

SEQ ID NO: 356439 - protein, 9 aa, Homo Sapiens
PPGTNILIY

SEQ ID NO: 356440 - protein, 9 aa, Homo Sapiens
LESHKIIHT

SEQ ID NO: 356441 - protein, 9 aa, Homo Sapiens
NIFQSMYYP

SEQ ID NO: 356442 - protein, 9 aa, Homo Sapiens
LAGNKDNTF

SEQ ID NO: 356443 - protein, 9 aa, Homo Sapiens
HSKAVRDVC

SEQ ID NO: 356444 - protein, 9 aa, Homo Sapiens
KWLLQKKAQ

SEQ ID NO: 356445 - protein, 9 aa, Homo Sapiens
ILEICIHKL

SEQ ID NO: 356446 - protein, 9 aa, Homo Sapiens
GESSLSVKE

SEQ ID NO: 356447 - protein, 9 aa, Homo Sapiens
FEECPPPYF

SEQ ID NO: 356448 - protein, 9 aa, Homo Sapiens
MDKSHFTRD

SEQ ID NO: 356449 - protein, 9 aa, Homo Sapiens
PYHPDTCPE

SEQ ID NO: 356450 - protein, 9 aa, Homo Sapiens
ESAGPGLCL

SEQ ID NO: 356451 - protein, 9 aa, Homo Sapiens
AEILGRTSL

SEQ ID NO: 356452 - protein, 9 aa, Homo Sapiens
DSITIYIAG

SEQ ID NO: 356453 - protein, 9 aa, Homo Sapiens
ITTRDAVKL

SEQ ID NO: 356454 - protein, 9 aa, Homo Sapiens
LAVDVCFLN

SEQ ID NO: 356455 - protein, 9 aa, Homo Sapiens
GWPRVGYWP

SEQ ID NO: 356456 - protein, 9 aa, Homo Sapiens
RLRVLNISY

SEQ ID NO: 356457 - protein, 9 aa, Homo Sapiens
FKKKKWSTQ

SEQ ID NO: 356458 - protein, 9 aa, Homo Sapiens
TLNADNKTC

SEQ ID NO: 356459 - protein, 9 aa, Homo Sapiens
GRCCAKFFE

SEQ ID NO: 356460 - protein, 9 aa, Homo Sapiens
RTHNIIMVL

SEQ ID NO: 356461 - protein, 9 aa, Homo Sapiens
ECLKKCSET

SEQ ID NO: 356462 - protein, 9 aa, Homo Sapiens
HICLWVLQI

SEQ ID NO: 356463 - protein, 9 aa, Homo Sapiens
APLSDEVTE

SEQ ID NO: 356464 - protein, 9 aa, Homo Sapiens
TVEEINLLS

SEQ ID NO: 356465 - protein, 9 aa, Homo Sapiens
SDNLVLHMV

SEQ ID NO: 356466 - protein, 9 aa, Homo Sapiens
NNRRKNKCV

SEQ ID NO: 356467 - protein, 9 aa, Homo Sapiens
NLIQHQIIH

SEQ ID NO: 356468 - protein, 9 aa, Homo Sapiens
CGNNILDHC

SEQ ID NO: 356469 - protein, 9 aa, Homo Sapiens
INSSKTVLN

SEQ ID NO: 356470 - protein, 9 aa, Homo Sapiens
WSEKRPHMP

SEQ ID NO: 356471 - protein, 9 aa, Homo Sapiens
FFEERENLC

SEQ ID NO: 356472 - protein, 9 aa, Homo Sapiens
NTIKNTVCV

SEQ ID NO: 356473 - protein, 9 aa, Homo Sapiens
IQLGCFTAQ

SEQ ID NO: 356474 - protein, 9 aa, Homo Sapiens
GCFGVDQFC

SEQ ID NO: 356475 - protein, 9 aa, Homo Sapiens
NWTSYMRHT

SEQ ID NO: 356476 - protein, 9 aa, Homo Sapiens
HDKHATLWG

SEQ ID NO: 356477 - protein, 9 aa, Homo Sapiens
ICIHKLHYF

SEQ ID NO: 356478 - protein, 9 aa, Homo Sapiens
YFAMDEDGD

SEQ ID NO: 356479 - protein, 9 aa, Homo Sapiens
VVKLVCGNI

SEQ ID NO: 356480 - protein, 9 aa, Homo Sapiens
IDYQTFFDP

SEQ ID NO: 356481 - protein, 9 aa, Homo Sapiens
HRVVRHHKG

SEQ ID NO: 356482 - protein, 9 aa, Homo Sapiens
LALVKESGK

SEQ ID NO: 356483 - protein, 9 aa, Homo Sapiens
RPRCINMTD

SEQ ID NO: 356484 - protein, 9 aa, Homo Sapiens
LRSLSLHNH

SEQ ID NO: 356485 - protein, 9 aa, Homo Sapiens
ILTFLNFLL

SEQ ID NO: 356486 - protein, 9 aa, Homo Sapiens
MTANLNIKY

SEQ ID NO: 356487 - protein, 9 aa, Homo Sapiens
SFYQCSYLT

SEQ ID NO: 356488 - protein, 9 aa, Homo Sapiens
FKFPFQNNN

SEQ ID NO: 356489 - protein, 9 aa, Homo Sapiens
AIFIYMCPV

SEQ ID NO: 356490 - protein, 9 aa, Homo Sapiens
LVNKTIIIL

SEQ ID NO: 356491 - protein, 9 aa, Homo Sapiens
TCLKSLGLF

SEQ ID NO: 356492 - protein, 9 aa, Homo Sapiens
ERLHLQSNL

SEQ ID NO: 356493 - protein, 9 aa, Homo Sapiens
DEDLGTAIK

SEQ ID NO: 356494 - protein, 9 aa, Homo Sapiens
PNSFWLGHL

SEQ ID NO: 356495 - protein, 9 aa, Homo Sapiens
FRASASLTS

SEQ ID NO: 356496 - protein, 9 aa, Homo Sapiens
IVGSVKLLK

SEQ ID NO: 356497 - protein, 9 aa, Homo Sapiens
KKKLHLSNG

SEQ ID NO: 356498 - protein, 9 aa, Homo Sapiens
KTQFVCINI

SEQ ID NO: 356499 - protein, 9 aa, Homo Sapiens
TGLDQYQHV

SEQ ID NO: 356500 - protein, 9 aa, Homo Sapiens
IHQRVHTGD

SEQ ID NO: 356501 - protein, 9 aa, Homo Sapiens
LTPTFFSQT

SEQ ID NO: 356502 - protein, 9 aa, Homo Sapiens
LTPTFFSQV

SEQ ID NO: 356503 - protein, 9 aa, Homo Sapiens
LLNDDLKPA

SEQ ID NO: 356504 - protein, 9 aa, Homo Sapiens
QAYQQLPAK

SEQ ID NO: 356505 - protein, 9 aa, Homo Sapiens
INQIILVVD

SEQ ID NO: 356506 - protein, 9 aa, Homo Sapiens
KKQNVLQSE

SEQ ID NO: 356507 - protein, 9 aa, Homo Sapiens
GVLPYFWEF

SEQ ID NO: 356508 - protein, 9 aa, Homo Sapiens
LRQKTSKPQ

SEQ ID NO: 356509 - protein, 9 aa, Homo Sapiens
QHIVIDKAQ

SEQ ID NO: 356510 - protein, 9 aa, Homo Sapiens
TQVMTLQGL

SEQ ID NO: 356511 - protein, 9 aa, Homo Sapiens
TTVSEVSVP

SEQ ID NO: 356512 - protein, 9 aa, Homo Sapiens
FLTCETVIV

SEQ ID NO: 356513 - protein, 9 aa, Homo Sapiens
GRLHSHCPR

SEQ ID NO: 356514 - protein, 9 aa, Homo Sapiens
QELQPFNRN

SEQ ID NO: 356515 - protein, 9 aa, Homo Sapiens
TIYIAGNQL

SEQ ID NO: 356516 - protein, 9 aa, Homo Sapiens
NSQTEEPTV

SEQ ID NO: 356517 - protein, 9 aa, Homo Sapiens
LIDCGQKKF

SEQ ID NO: 356518 - protein, 9 aa, Homo Sapiens
DVEAKETTY

SEQ ID NO: 356519 - protein, 9 aa, Homo Sapiens
DDPPVFPHS

SEQ ID NO: 356520 - protein, 9 aa, Homo Sapiens
ADEALNTDK

SEQ ID NO: 356521 - protein, 9 aa, Homo Sapiens
PIYSLIDKN

SEQ ID NO: 356522 - protein, 9 aa, Homo Sapiens
HICINTLDS

SEQ ID NO: 356523 - protein, 9 aa, Homo Sapiens
PGETITGKV

SEQ ID NO: 356524 - protein, 9 aa, Homo Sapiens
AALGSLIQI

SEQ ID NO: 356525 - protein, 9 aa, Homo Sapiens
VAVSQDCYT

SEQ ID NO: 356526 - protein, 9 aa, Homo Sapiens
GRGHKSSMK

SEQ ID NO: 356527 - protein, 9 aa, Homo Sapiens
MPKNLEIYK

SEQ ID NO: 356528 - protein, 9 aa, Homo Sapiens
VTVARPHLL

SEQ ID NO: 356529 - protein, 9 aa, Homo Sapiens
VSRGVVVAV

SEQ ID NO: 356530 - protein, 9 aa, Homo Sapiens
NKLTCSHGN

SEQ ID NO: 356531 - protein, 9 aa, Homo Sapiens
QLEKMLYVC

SEQ ID NO: 356532 - protein, 9 aa, Homo Sapiens
CHPTLQFGG

SEQ ID NO: 356533 - protein, 9 aa, Homo Sapiens
CLRKLLSKL

SEQ ID NO: 356534 - protein, 9 aa, Homo Sapiens
SLPEFELVL

SEQ ID NO: 356535 - protein, 9 aa, Homo Sapiens
RSNLESSQN

SEQ ID NO: 356536 - protein, 9 aa, Homo Sapiens
PSQCLEIDE

SEQ ID NO: 356537 - protein, 9 aa, Homo Sapiens
YRRPTMAKV

SEQ ID NO: 356538 - protein, 9 aa, Homo Sapiens
VKNRRNFAS

SEQ ID NO: 356539 - protein, 9 aa, Homo Sapiens
PRSMQGTIM

SEQ ID NO: 356540 - protein, 9 aa, Homo Sapiens
IIHKGGKPY

SEQ ID NO: 356541 - protein, 9 aa, Homo Sapiens
DNATEASGI

SEQ ID NO: 356542 - protein, 9 aa, Homo Sapiens
ADKDEEGVT

SEQ ID NO: 356543 - protein, 9 aa, Homo Sapiens
VHQRIHTGD

SEQ ID NO: 356544 - protein, 9 aa, Homo Sapiens
NITTRLLLK

SEQ ID NO: 356545 - protein, 9 aa, Homo Sapiens
LDLIRPLKI

SEQ ID NO: 356546 - protein, 9 aa, Homo Sapiens
IQHHKLHTG

SEQ ID NO: 356547 - protein, 9 aa, Homo Sapiens
EAEGQAQSL

SEQ ID NO: 356548 - protein, 9 aa, Homo Sapiens
QENTRTNVQ

SEQ ID NO: 356549 - protein, 9 aa, Homo Sapiens
PFWLPEPVP

SEQ ID NO: 356550 - protein, 9 aa, Homo Sapiens
EIIRGKRRA

SEQ ID NO: 356551 - protein, 9 aa, Homo Sapiens
ERRKFGVSQ

SEQ ID NO: 356552 - protein, 9 aa, Homo Sapiens
TLMRKNPLA

SEQ ID NO: 356553 - protein, 9 aa, Homo Sapiens
IGFYSSMLF

SEQ ID NO: 356554 - protein, 9 aa, Homo Sapiens
GINDNAPEF

SEQ ID NO: 356555 - protein, 9 aa, Homo Sapiens
GKFREFFPN

SEQ ID NO: 356556 - protein, 9 aa, Homo Sapiens
ARSDQTGEV

SEQ ID NO: 356557 - protein, 9 aa, Homo Sapiens
YHLLKHIVC

SEQ ID NO: 356558 - protein, 9 aa, Homo Sapiens
IRFFIKGKD

SEQ ID NO: 356559 - protein, 9 aa, Homo Sapiens
YFSGIKGLQ

SEQ ID NO: 356560 - protein, 9 aa, Homo Sapiens
CRHRMHEQQ

SEQ ID NO: 356561 - protein, 9 aa, Homo Sapiens
KPYVGKECG

SEQ ID NO: 356562 - protein, 9 aa, Homo Sapiens
SDNSCTNKL

SEQ ID NO: 356563 - protein, 9 aa, Homo Sapiens
KYLNLFYSF

SEQ ID NO: 356564 - protein, 9 aa, Homo Sapiens
VTEILGLVF

SEQ ID NO: 356565 - protein, 9 aa, Homo Sapiens
ALPITCCLV

SEQ ID NO: 356566 - protein, 9 aa, Homo Sapiens
TKEGCYFHV

SEQ ID NO: 356567 - protein, 9 aa, Homo Sapiens
LLSKCLCGA

SEQ ID NO: 356568 - protein, 9 aa, Homo Sapiens
GVRAQIIAE

SEQ ID NO: 356569 - protein, 9 aa, Homo Sapiens
LSIGGIGEG

SEQ ID NO: 356570 - protein, 9 aa, Homo Sapiens
HLRIHQHMH

SEQ ID NO: 356571 - protein, 9 aa, Homo Sapiens
LTRVSQIIC

SEQ ID NO: 356572 - protein, 9 aa, Homo Sapiens
DPAWLPEDK

SEQ ID NO: 356573 - protein, 9 aa, Homo Sapiens
YFQIHINKY

SEQ ID NO: 356574 - protein, 9 aa, Homo Sapiens
DEENYWDSE

SEQ ID NO: 356575 - protein, 9 aa, Homo Sapiens
CGKSFCHSS

SEQ ID NO: 356576 - protein, 9 aa, Homo Sapiens
ESQNKSLAT

SEQ ID NO: 356577 - protein, 9 aa, Homo Sapiens
HEQSNKCVQ

SEQ ID NO: 356578 - protein, 9 aa, Homo Sapiens
LMQIDGNVM

SEQ ID NO: 356579 - protein, 9 aa, Homo Sapiens
KQQTPSQTH

SEQ ID NO: 356580 - protein, 9 aa, Homo Sapiens
NFLQNVKGT

SEQ ID NO: 356581 - protein, 9 aa, Homo Sapiens
AFFSPSLLK

SEQ ID NO: 356582 - protein, 9 aa, Homo Sapiens
HFSPFHFFS

SEQ ID NO: 356583 - protein, 9 aa, Homo Sapiens
NEVVVRATC

SEQ ID NO: 356584 - protein, 9 aa, Homo Sapiens
PFVEQLLKK

SEQ ID NO: 356585 - protein, 9 aa, Homo Sapiens
PQQWVTGAI

SEQ ID NO: 356586 - protein, 9 aa, Homo Sapiens
SSHRTLKAS

SEQ ID NO: 356587 - protein, 9 aa, Homo Sapiens
NKINQIILV

SEQ ID NO: 356588 - protein, 9 aa, Homo Sapiens
SYVTEVEAN

SEQ ID NO: 356589 - protein, 9 aa, Homo Sapiens
EDGSQTFDI

SEQ ID NO: 356590 - protein, 9 aa, Homo Sapiens
LVLYLGSIS

SEQ ID NO: 356591 - protein, 9 aa, Homo Sapiens
RWCSQVKLG

SEQ ID NO: 356592 - protein, 9 aa, Homo Sapiens
VLSPELPKP

SEQ ID NO: 356593 - protein, 9 aa, Homo Sapiens
EKEQKLLKQ

SEQ ID NO: 356594 - protein, 9 aa, Homo Sapiens
DRMKDVKCH

SEQ ID NO: 356595 - protein, 9 aa, Homo Sapiens
VRFVLMFYK

SEQ ID NO: 356596 - protein, 9 aa, Homo Sapiens
CKCIKLWLQ

SEQ ID NO: 356597 - protein, 9 aa, Homo Sapiens
HLGIQSQSK

SEQ ID NO: 356598 - protein, 9 aa, Homo Sapiens
HLDECNIKK

SEQ ID NO: 356599 - protein, 9 aa, Homo Sapiens
RTGLSTLME

SEQ ID NO: 356600 - protein, 9 aa, Homo Sapiens
QTLRLLMSQ

SEQ ID NO: 356601 - protein, 9 aa, Homo Sapiens
KRSSKSLNK

SEQ ID NO: 356602 - protein, 9 aa, Homo Sapiens
EELESTVPQ

SEQ ID NO: 356603 - protein, 9 aa, Homo Sapiens
LLCLARPAK

SEQ ID NO: 356604 - protein, 9 aa, Homo Sapiens
PKFSNQFES

SEQ ID NO: 356605 - protein, 9 aa, Homo Sapiens
GLSLNDDLL

SEQ ID NO: 356606 - protein, 9 aa, Homo Sapiens
HLLNHPKTQ

SEQ ID NO: 356607 - protein, 9 aa, Homo Sapiens
RLQINRFAW

SEQ ID NO: 356608 - protein, 9 aa, Homo Sapiens
GQYVTFLRY

SEQ ID NO: 356609 - protein, 9 aa, Homo Sapiens
HDVHTCSPR

SEQ ID NO: 356610 - protein, 9 aa, Homo Sapiens
SVKFSECLK

SEQ ID NO: 356611 - protein, 9 aa, Homo Sapiens
FVPLQSIQT

SEQ ID NO: 356612 - protein, 9 aa, Homo Sapiens
GLITVLCLF

SEQ ID NO: 356613 - protein, 9 aa, Homo Sapiens
ERLMNYFSA

SEQ ID NO: 356614 - protein, 9 aa, Homo Sapiens
TSTLREDKD

SEQ ID NO: 356615 - protein, 9 aa, Homo Sapiens
KLMHTKIDK

SEQ ID NO: 356616 - protein, 9 aa, Homo Sapiens
DVELTVEEI

SEQ ID NO: 356617 - protein, 9 aa, Homo Sapiens
FYWCLTNGN

SEQ ID NO: 356618 - protein, 9 aa, Homo Sapiens
LTQHQITHT

SEQ ID NO: 356619 - protein, 9 aa, Homo Sapiens
EMKKICQVI

SEQ ID NO: 356620 - protein, 9 aa, Homo Sapiens
DPPAENLSA

SEQ ID NO: 356621 - protein, 9 aa, Homo Sapiens
IWVYDEEAT

SEQ ID NO: 356622 - protein, 9 aa, Homo Sapiens
NNQIENYKE

SEQ ID NO: 356623 - protein, 9 aa, Homo Sapiens
QAKGPLRVG

SEQ ID NO: 356624 - protein, 9 aa, Homo Sapiens
ALRHGVRIL

SEQ ID NO: 356625 - protein, 9 aa, Homo Sapiens
GNVWVCINI

SEQ ID NO: 356626 - protein, 9 aa, Homo Sapiens
YGVIHFQGG

SEQ ID NO: 356627 - protein, 9 aa, Homo Sapiens
SVSKSVRLY

SEQ ID NO: 356628 - protein, 9 aa, Homo Sapiens
VELINEILN

SEQ ID NO: 356629 - protein, 9 aa, Homo Sapiens
ENGSVLQRV

SEQ ID NO: 356630 - protein, 9 aa, Homo Sapiens
NMKKPAESK

SEQ ID NO: 356631 - protein, 9 aa, Homo Sapiens
WTSFLESLK

SEQ ID NO: 356632 - protein, 9 aa, Homo Sapiens
QPLKKLEIN

SEQ ID NO: 356633 - protein, 9 aa, Homo Sapiens
TVMAGNNEN

SEQ ID NO: 356634 - protein, 9 aa, Homo Sapiens
LAVVTCNLF

SEQ ID NO: 356635 - protein, 9 aa, Homo Sapiens
RFTPRKGDK

SEQ ID NO: 356636 - protein, 9 aa, Homo Sapiens
KKICFWDIR

SEQ ID NO: 356637 - protein, 9 aa, Homo Sapiens
YHFCDVKDE

SEQ ID NO: 356638 - protein, 9 aa, Homo Sapiens
FDKFLEEIA

SEQ ID NO: 356639 - protein, 9 aa, Homo Sapiens
HIQIGILIG

SEQ ID NO: 356640 - protein, 9 aa, Homo Sapiens
FEFDWKAYI

SEQ ID NO: 356641 - protein, 9 aa, Homo Sapiens
YGSHPWHWH

SEQ ID NO: 356642 - protein, 9 aa, Homo Sapiens
PEMANMVPS

SEQ ID NO: 356643 - protein, 9 aa, Homo Sapiens
KSPVFSDDD

SEQ ID NO: 356644 - protein, 9 aa, Homo Sapiens
IDKLLVNVV

SEQ ID NO: 356645 - protein, 9 aa, Homo Sapiens
EHVKINQGT

SEQ ID NO: 356646 - protein, 9 aa, Homo Sapiens
KGYTQFYYV

SEQ ID NO: 356647 - protein, 9 aa, Homo Sapiens
RQNRFASSK

SEQ ID NO: 356648 - protein, 9 aa, Homo Sapiens
GEFWFSLEI

SEQ ID NO: 356649 - protein, 9 aa, Homo Sapiens
LGKLFKGGG

SEQ ID NO: 356650 - protein, 9 aa, Homo Sapiens
KDLDLFSEG

SEQ ID NO: 356651 - protein, 9 aa, Homo Sapiens
TVTTCVPWN

SEQ ID NO: 356652 - protein, 9 aa, Homo Sapiens
LVNTSKNGI

SEQ ID NO: 356653 - protein, 9 aa, Homo Sapiens
LLLSVCAWG

SEQ ID NO: 356654 - protein, 9 aa, Homo Sapiens
SHPQLCVCR

SEQ ID NO: 356655 - protein, 9 aa, Homo Sapiens
HKISGHDTG

SEQ ID NO: 356656 - protein, 9 aa, Homo Sapiens
GSKDINKNK

SEQ ID NO: 356657 - protein, 9 aa, Homo Sapiens
LSLQNNLDA

SEQ ID NO: 356658 - protein, 9 aa, Homo Sapiens
ASLVPGCSS

SEQ ID NO: 356659 - protein, 9 aa, Homo Sapiens
ACVGSAYQA

SEQ ID NO: 356660 - protein, 9 aa, Homo Sapiens
AQPDATKVL

SEQ ID NO: 356661 - protein, 9 aa, Homo Sapiens
YARTIHVYP

SEQ ID NO: 356662 - protein, 9 aa, Homo Sapiens
FPLHYPIHM

SEQ ID NO: 356663 - protein, 9 aa, Homo Sapiens
KLKIQFLIY

SEQ ID NO: 356664 - protein, 9 aa, Homo Sapiens
IWELIGISE

SEQ ID NO: 356665 - protein, 9 aa, Homo Sapiens
NKYENGEFS

SEQ ID NO: 356666 - protein, 9 aa, Homo Sapiens
CRFSLSVPR

SEQ ID NO: 356667 - protein, 9 aa, Homo Sapiens
YDDLIDEFI

SEQ ID NO: 356668 - protein, 9 aa, Homo Sapiens
CAGASCVVP

SEQ ID NO: 356669 - protein, 9 aa, Homo Sapiens
NLSEIETVH

SEQ ID NO: 356670 - protein, 9 aa, Homo Sapiens
KKVKKAGDA

SEQ ID NO: 356671 - protein, 9 aa, Homo Sapiens
PAVITCIVS

SEQ ID NO: 356672 - protein, 9 aa, Homo Sapiens
KTPKNRYRK

SEQ ID NO: 356673 - protein, 9 aa, Homo Sapiens
YYPDITYIF

SEQ ID NO: 356674 - protein, 9 aa, Homo Sapiens
ASIGCVAPQ

SEQ ID NO: 356675 - protein, 9 aa, Homo Sapiens
TTISVGIVL

SEQ ID NO: 356676 - protein, 9 aa, Homo Sapiens
VGYEFFADV

SEQ ID NO: 356677 - protein, 9 aa, Homo Sapiens
HNLKIRPYF

SEQ ID NO: 356678 - protein, 9 aa, Homo Sapiens
RIMLSLSQT

SEQ ID NO: 356679 - protein, 9 aa, Homo Sapiens
LEKIAEDPG

SEQ ID NO: 356680 - protein, 9 aa, Homo Sapiens
DIENNPTVQ

SEQ ID NO: 356681 - protein, 9 aa, Homo Sapiens
NNPQDDIAT

SEQ ID NO: 356682 - protein, 9 aa, Homo Sapiens
IMSNIQQII

SEQ ID NO: 356683 - protein, 9 aa, Homo Sapiens
QCKRSYHFP

SEQ ID NO: 356684 - protein, 9 aa, Homo Sapiens
NKIDVVKRK

SEQ ID NO: 356685 - protein, 9 aa, Homo Sapiens
SQEFDFNKV

SEQ ID NO: 356686 - protein, 9 aa, Homo Sapiens
MQKFIKADY

SEQ ID NO: 356687 - protein, 9 aa, Homo Sapiens
SCSDKNISI

SEQ ID NO: 356688 - protein, 9 aa, Homo Sapiens
PSAAKVTLQ

SEQ ID NO: 356689 - protein, 9 aa, Homo Sapiens
NARRRIVQS

SEQ ID NO: 356690 - protein, 9 aa, Homo Sapiens
NGSRFPASQ

SEQ ID NO: 356691 - protein, 9 aa, Homo Sapiens
EKVLQGSSV

SEQ ID NO: 356692 - protein, 9 aa, Homo Sapiens
QKEEKQQEA

SEQ ID NO: 356693 - protein, 9 aa, Homo Sapiens
SISWMGGNN

SEQ ID NO: 356694 - protein, 9 aa, Homo Sapiens
LSPSNHVPN

SEQ ID NO: 356695 - protein, 9 aa, Homo Sapiens
KEFKELTSN

SEQ ID NO: 356696 - protein, 9 aa, Homo Sapiens
TALSEKCTL

SEQ ID NO: 356697 - protein, 9 aa, Homo Sapiens
GKRAEPMES

SEQ ID NO: 356698 - protein, 9 aa, Homo Sapiens
KQGLKDYFQ

SEQ ID NO: 356699 - protein, 9 aa, Homo Sapiens
CYPLCPKDV

SEQ ID NO: 356700 - protein, 9 aa, Homo Sapiens
LDGLEKYFY

SEQ ID NO: 356701 - protein, 9 aa, Homo Sapiens
EAGTESELS

SEQ ID NO: 356702 - protein, 9 aa, Homo Sapiens
RKDLIQHFN

SEQ ID NO: 356703 - protein, 9 aa, Homo Sapiens
STFQLHVHC

SEQ ID NO: 356704 - protein, 9 aa, Homo Sapiens
VCVCPFPGA

SEQ ID NO: 356705 - protein, 9 aa, Homo Sapiens
KLGKLFKGG

SEQ ID NO: 356706 - protein, 9 aa, Homo Sapiens
CVFPDRCVV

SEQ ID NO: 356707 - protein, 9 aa, Homo Sapiens
SPPQRSQPP

SEQ ID NO: 356708 - protein, 9 aa, Homo Sapiens
NTCQRLWEY

SEQ ID NO: 356709 - protein, 9 aa, Homo Sapiens
TDDYFHHKS

SEQ ID NO: 356710 - protein, 9 aa, Homo Sapiens
PSCLSVGEQ

SEQ ID NO: 356711 - protein, 9 aa, Homo Sapiens
DVNEISHHL

SEQ ID NO: 356712 - protein, 9 aa, Homo Sapiens
MLLCLARPA

SEQ ID NO: 356713 - protein, 9 aa, Homo Sapiens
KQQNVYCMA

SEQ ID NO: 356714 - protein, 9 aa, Homo Sapiens
SQSGSPHEL

SEQ ID NO: 356715 - protein, 9 aa, Homo Sapiens
TTHRCICCP

SEQ ID NO: 356716 - protein, 9 aa, Homo Sapiens
QNNLDATVT

SEQ ID NO: 356717 - protein, 9 aa, Homo Sapiens
QTAPAGYLV

SEQ ID NO: 356718 - protein, 9 aa, Homo Sapiens
VMTLQGLVS

SEQ ID NO: 356719 - protein, 9 aa, Homo Sapiens
LARQTYPKK

SEQ ID NO: 356720 - protein, 9 aa, Homo Sapiens
AEDYGVINT

SEQ ID NO: 356721 - protein, 9 aa, Homo Sapiens
KDMDINEEE

SEQ ID NO: 356722 - protein, 9 aa, Homo Sapiens
RLSTFYENW

SEQ ID NO: 356723 - protein, 9 aa, Homo Sapiens
ASSFTDAPA

SEQ ID NO: 356724 - protein, 9 aa, Homo Sapiens
IDKNKQFRS

SEQ ID NO: 356725 - protein, 9 aa, Homo Sapiens
LEEIAKAAE

SEQ ID NO: 356726 - protein, 9 aa, Homo Sapiens
RSIGMVKVN

SEQ ID NO: 356727 - protein, 9 aa, Homo Sapiens
TKNYYKNAS

SEQ ID NO: 356728 - protein, 9 aa, Homo Sapiens
DIDVGFNKG

SEQ ID NO: 356729 - protein, 9 aa, Homo Sapiens
RLEINLDDD

SEQ ID NO: 356730 - protein, 9 aa, Homo Sapiens
IMLPEFHLL

SEQ ID NO: 356731 - protein, 9 aa, Homo Sapiens
HISDDPSIF

SEQ ID NO: 356732 - protein, 9 aa, Homo Sapiens
LQIANNSYN

SEQ ID NO: 356733 - protein, 9 aa, Homo Sapiens
EQHREEMQK

SEQ ID NO: 356734 - protein, 9 aa, Homo Sapiens
QYDLFLSCD

SEQ ID NO: 356735 - protein, 9 aa, Homo Sapiens
DCKVHQRGT

SEQ ID NO: 356736 - protein, 9 aa, Homo Sapiens
THNIIMVLK

SEQ ID NO: 356737 - protein, 9 aa, Homo Sapiens
FRPRCLHTA

SEQ ID NO: 356738 - protein, 9 aa, Homo Sapiens
VNSSLERTF

SEQ ID NO: 356739 - protein, 9 aa, Homo Sapiens
ATEKTPDEK

SEQ ID NO: 356740 - protein, 9 aa, Homo Sapiens
SKHLQSLVI

SEQ ID NO: 356741 - protein, 9 aa, Homo Sapiens
NTIPHIFCN

SEQ ID NO: 356742 - protein, 9 aa, Homo Sapiens
VVGELFRLV

SEQ ID NO: 356743 - protein, 9 aa, Homo Sapiens
SNVSKQTEY

SEQ ID NO: 356744 - protein, 9 aa, Homo Sapiens
PVPWKFPSS

SEQ ID NO: 356745 - protein, 9 aa, Homo Sapiens
VPNLSAPGQ

SEQ ID NO: 356746 - protein, 9 aa, Homo Sapiens
FIFAENTAR

SEQ ID NO: 356747 - protein, 9 aa, Homo Sapiens
INSGATFTE

SEQ ID NO: 356748 - protein, 9 aa, Homo Sapiens
RFLPASTQL

SEQ ID NO: 356749 - protein, 9 aa, Homo Sapiens
CSHFAQDIW

SEQ ID NO: 356750 - protein, 9 aa, Homo Sapiens
VILVATLQG

SEQ ID NO: 356751 - protein, 9 aa, Homo Sapiens
TEALGVKNK

SEQ ID NO: 356752 - protein, 9 aa, Homo Sapiens
NIVFWVLGT

SEQ ID NO: 356753 - protein, 9 aa, Homo Sapiens
VIFYSKITT

SEQ ID NO: 356754 - protein, 9 aa, Homo Sapiens
ETVHGFVSH

SEQ ID NO: 356755 - protein, 9 aa, Homo Sapiens
HVARVIVAT

SEQ ID NO: 356756 - protein, 9 aa, Homo Sapiens
QQASIMLNI

SEQ ID NO: 356757 - protein, 9 aa, Homo Sapiens
DIDHGKPVN

SEQ ID NO: 356758 - protein, 9 aa, Homo Sapiens
AQLHLWAFK

SEQ ID NO: 356759 - protein, 9 aa, Homo Sapiens
LRQEINAAQ

SEQ ID NO: 356760 - protein, 9 aa, Homo Sapiens
IYKYWLAQQ

SEQ ID NO: 356761 - protein, 9 aa, Homo Sapiens
RDSRSSSEK

SEQ ID NO: 356762 - protein, 9 aa, Homo Sapiens
SNTCQRLWE

SEQ ID NO: 356763 - protein, 9 aa, Homo Sapiens
YTFILRVVL

SEQ ID NO: 356764 - protein, 9 aa, Homo Sapiens
SSVLTGTSE

SEQ ID NO: 356765 - protein, 9 aa, Homo Sapiens
KDYFEKVTL

SEQ ID NO: 356766 - protein, 9 aa, Homo Sapiens
LAVKDYIQT

SEQ ID NO: 356767 - protein, 9 aa, Homo Sapiens
ADRRTSGQI

SEQ ID NO: 356768 - protein, 9 aa, Homo Sapiens
QVRFMSLPP

SEQ ID NO: 356769 - protein, 9 aa, Homo Sapiens
DWHHEVSAH

SEQ ID NO: 356770 - protein, 9 aa, Homo Sapiens
YEKRVLAIV

SEQ ID NO: 356771 - protein, 9 aa, Homo Sapiens
GQHYSFIGM

SEQ ID NO: 356772 - protein, 9 aa, Homo Sapiens
GDNSIFVTK

SEQ ID NO: 356773 - protein, 9 aa, Homo Sapiens
VYKGKPLEK

SEQ ID NO: 356774 - protein, 9 aa, Homo Sapiens
VVRHHKGGK

SEQ ID NO: 356775 - protein, 9 aa, Homo Sapiens
DLVTKQAFN

SEQ ID NO: 356776 - protein, 9 aa, Homo Sapiens
KEKPVKQDD

SEQ ID NO: 356777 - protein, 9 aa, Homo Sapiens
KKLERVEEA

SEQ ID NO: 356778 - protein, 9 aa, Homo Sapiens
CGFNTVTTC

SEQ ID NO: 356779 - protein, 9 aa, Homo Sapiens
PATKDKFAL

SEQ ID NO: 356780 - protein, 9 aa, Homo Sapiens
NHFADGRCD

SEQ ID NO: 356781 - protein, 9 aa, Homo Sapiens
YALTDLMTK

SEQ ID NO: 356782 - protein, 9 aa, Homo Sapiens
SIFVTKIID

SEQ ID NO: 356783 - protein, 9 aa, Homo Sapiens
FDLMNRSLH

SEQ ID NO: 356784 - protein, 9 aa, Homo Sapiens
LRPGEYRRS

SEQ ID NO: 356785 - protein, 9 aa, Homo Sapiens
DCTHTGLGG

SEQ ID NO: 356786 - protein, 9 aa, Homo Sapiens
YTYSKITME

SEQ ID NO: 356787 - protein, 9 aa, Homo Sapiens
ETGAAPIFI

SEQ ID NO: 356788 - protein, 9 aa, Homo Sapiens
AIKGVARLY

SEQ ID NO: 356789 - protein, 9 aa, Homo Sapiens
KFLLDVSLK

SEQ ID NO: 356790 - protein, 9 aa, Homo Sapiens
RKASAFLHM

SEQ ID NO: 356791 - protein, 9 aa, Homo Sapiens
NDDIQYDLF

SEQ ID NO: 356792 - protein, 9 aa, Homo Sapiens
CQQLANNNL

SEQ ID NO: 356793 - protein, 9 aa, Homo Sapiens
ADGKTTHHN

SEQ ID NO: 356794 - protein, 9 aa, Homo Sapiens
CPSVCRCNR

SEQ ID NO: 356795 - protein, 9 aa, Homo Sapiens
HKPGLVAGK

SEQ ID NO: 356796 - protein, 9 aa, Homo Sapiens
ISVGIVLIQ

SEQ ID NO: 356797 - protein, 9 aa, Homo Sapiens
VWELDCEGD

SEQ ID NO: 356798 - protein, 9 aa, Homo Sapiens
GGLNNICSI

SEQ ID NO: 356799 - protein, 9 aa, Homo Sapiens
LERIGYPNE

SEQ ID NO: 356800 - protein, 9 aa, Homo Sapiens
ECGKIFSFR

SEQ ID NO: 356801 - protein, 9 aa, Homo Sapiens
SFLNLLHLV

SEQ ID NO: 356802 - protein, 9 aa, Homo Sapiens
SSYFSSWDD

SEQ ID NO: 356803 - protein, 9 aa, Homo Sapiens
FQSHTFSEQ

SEQ ID NO: 356804 - protein, 9 aa, Homo Sapiens
ILSLIKFKD

SEQ ID NO: 356805 - protein, 9 aa, Homo Sapiens
NGVAIHSLA

SEQ ID NO: 356806 - protein, 9 aa, Homo Sapiens
GASLHGLTP

SEQ ID NO: 356807 - protein, 9 aa, Homo Sapiens
NVNLNTGMQ

SEQ ID NO: 356808 - protein, 9 aa, Homo Sapiens
PEFHLLRDT

SEQ ID NO: 356809 - protein, 9 aa, Homo Sapiens
NPRICGFLI

SEQ ID NO: 356810 - protein, 9 aa, Homo Sapiens
SKPKQSTEK

SEQ ID NO: 356811 - protein, 9 aa, Homo Sapiens
HTRERRYKC

SEQ ID NO: 356812 - protein, 9 aa, Homo Sapiens
KCKSDGAFY

SEQ ID NO: 356813 - protein, 9 aa, Homo Sapiens
EENEECTMI

SEQ ID NO: 356814 - protein, 9 aa, Homo Sapiens
SQISMKLPQ

SEQ ID NO: 356815 - protein, 9 aa, Homo Sapiens
KELEEENMV

SEQ ID NO: 356816 - protein, 9 aa, Homo Sapiens
TISKKKLTP

SEQ ID NO: 356817 - protein, 9 aa, Homo Sapiens
NKSLKRTFQ

SEQ ID NO: 356818 - protein, 9 aa, Homo Sapiens
LKEGQGGAK

SEQ ID NO: 356819 - protein, 9 aa, Homo Sapiens
PSKPPNEEH

SEQ ID NO: 356820 - protein, 9 aa, Homo Sapiens
EEAEGQAQS

SEQ ID NO: 356821 - protein, 9 aa, Homo Sapiens
MDVLSADDI

SEQ ID NO: 356822 - protein, 9 aa, Homo Sapiens
NENIIRTRA

SEQ ID NO: 356823 - protein, 9 aa, Homo Sapiens
YSLGSNHSI

SEQ ID NO: 356824 - protein, 9 aa, Homo Sapiens
SYEDKSNGF

SEQ ID NO: 356825 - protein, 9 aa, Homo Sapiens
EEKPYDTIT

SEQ ID NO: 356826 - protein, 9 aa, Homo Sapiens
ECAAIFHEH

SEQ ID NO: 356827 - protein, 9 aa, Homo Sapiens
VETYNDESQ

SEQ ID NO: 356828 - protein, 9 aa, Homo Sapiens
ISFMFVHPE

SEQ ID NO: 356829 - protein, 9 aa, Homo Sapiens
LCMAPISLF

SEQ ID NO: 356830 - protein, 9 aa, Homo Sapiens
VPEEMMEEQ

SEQ ID NO: 356831 - protein, 9 aa, Homo Sapiens
PKVGCSNWK

SEQ ID NO: 356832 - protein, 9 aa, Homo Sapiens
NQGTLTILS

SEQ ID NO: 356833 - protein, 9 aa, Homo Sapiens
DQSDDENIQ

SEQ ID NO: 356834 - protein, 9 aa, Homo Sapiens
SEKVYLCDQ

SEQ ID NO: 356835 - protein, 9 aa, Homo Sapiens
LNFLLFCAY

SEQ ID NO: 356836 - protein, 9 aa, Homo Sapiens
NLKPQAKLA

SEQ ID NO: 356837 - protein, 9 aa, Homo Sapiens
ITSPSKNYI

SEQ ID NO: 356838 - protein, 9 aa, Homo Sapiens
LNVADDNDD

SEQ ID NO: 356839 - protein, 9 aa, Homo Sapiens
ELYVQNENS

SEQ ID NO: 356840 - protein, 9 aa, Homo Sapiens
NNSVLGPLY

SEQ ID NO: 356841 - protein, 9 aa, Homo Sapiens
KPEAAAKYV

SEQ ID NO: 356842 - protein, 9 aa, Homo Sapiens
TKVAKRGGQ

SEQ ID NO: 356843 - protein, 9 aa, Homo Sapiens
LAEDFLCDY

SEQ ID NO: 356844 - protein, 9 aa, Homo Sapiens
CKIILRKLE

SEQ ID NO: 356845 - protein, 9 aa, Homo Sapiens
PKADAPLTT

SEQ ID NO: 356846 - protein, 9 aa, Homo Sapiens
TYLQAVGMF

SEQ ID NO: 356847 - protein, 9 aa, Homo Sapiens
ASDSVISMT

SEQ ID NO: 356848 - protein, 9 aa, Homo Sapiens
FKPYYGEGG

SEQ ID NO: 356849 - protein, 9 aa, Homo Sapiens
HSTLKATIP

SEQ ID NO: 356850 - protein, 9 aa, Homo Sapiens
SCRNYNNQA

SEQ ID NO: 356851 - protein, 9 aa, Homo Sapiens
PPPKATEEN

SEQ ID NO: 356852 - protein, 9 aa, Homo Sapiens
IQRFTKNNF

SEQ ID NO: 356853 - protein, 9 aa, Homo Sapiens
EESLVRCVD

SEQ ID NO: 356854 - protein, 9 aa, Homo Sapiens
SMMTVGPHQ

SEQ ID NO: 356855 - protein, 9 aa, Homo Sapiens
NQVAHDQAV

SEQ ID NO: 356856 - protein, 9 aa, Homo Sapiens
LGQHEVCFV

SEQ ID NO: 356857 - protein, 9 aa, Homo Sapiens
KKDNAAALE

SEQ ID NO: 356858 - protein, 9 aa, Homo Sapiens
IHEITHTGE

SEQ ID NO: 356859 - protein, 9 aa, Homo Sapiens
VARLYRSRK

SEQ ID NO: 356860 - protein, 9 aa, Homo Sapiens
GEGIEVLKS

SEQ ID NO: 356861 - protein, 9 aa, Homo Sapiens
PTCFEMKNE

SEQ ID NO: 356862 - protein, 9 aa, Homo Sapiens
SEELHNCIQ

SEQ ID NO: 356863 - protein, 9 aa, Homo Sapiens
IDNLGVTVD

SEQ ID NO: 356864 - protein, 9 aa, Homo Sapiens
YKYCLRHKR

SEQ ID NO: 356865 - protein, 9 aa, Homo Sapiens
QPYECHECG

SEQ ID NO: 356866 - protein, 9 aa, Homo Sapiens
NVELSLLEK

SEQ ID NO: 356867 - protein, 9 aa, Homo Sapiens
MTRLYYWDA

SEQ ID NO: 356868 - protein, 9 aa, Homo Sapiens
NEVFYTPVQ

SEQ ID NO: 356869 - protein, 9 aa, Homo Sapiens
THIPNIFQN

SEQ ID NO: 356870 - protein, 9 aa, Homo Sapiens
GTNSCISPL

SEQ ID NO: 356871 - protein, 9 aa, Homo Sapiens
GTQARLLPE

SEQ ID NO: 356872 - protein, 9 aa, Homo Sapiens
ALAKGNVTA

SEQ ID NO: 356873 - protein, 9 aa, Homo Sapiens
KANGERRKF

SEQ ID NO: 356874 - protein, 9 aa, Homo Sapiens
EELGAQPDA

SEQ ID NO: 356875 - protein, 9 aa, Homo Sapiens
VEGGDKLQT

SEQ ID NO: 356876 - protein, 9 aa, Homo Sapiens
VVTPFLTKL

SEQ ID NO: 356877 - protein, 9 aa, Homo Sapiens
GYTDPLTFY

SEQ ID NO: 356878 - protein, 9 aa, Homo Sapiens
AQAADVAIK

SEQ ID NO: 356879 - protein, 9 aa, Homo Sapiens
LKKFVEACL

SEQ ID NO: 356880 - protein, 9 aa, Homo Sapiens
AYHMMNKFI

SEQ ID NO: 356881 - protein, 9 aa, Homo Sapiens
RQRFPTFFQ

SEQ ID NO: 356882 - protein, 9 aa, Homo Sapiens
QNVLKLFPK

SEQ ID NO: 356883 - protein, 9 aa, Homo Sapiens
YYLYAKNEN

SEQ ID NO: 356884 - protein, 9 aa, Homo Sapiens
INLPVSVEE

SEQ ID NO: 356885 - protein, 9 aa, Homo Sapiens
EGPTDALAL

SEQ ID NO: 356886 - protein, 9 aa, Homo Sapiens
CQQQISDSK

SEQ ID NO: 356887 - protein, 9 aa, Homo Sapiens
ASSPSQSTQ

SEQ ID NO: 356888 - protein, 9 aa, Homo Sapiens
AYGKVFLVH

SEQ ID NO: 356889 - protein, 9 aa, Homo Sapiens
IVTTHGPPS

SEQ ID NO: 356890 - protein, 9 aa, Homo Sapiens
QTKNYYKNA

SEQ ID NO: 356891 - protein, 9 aa, Homo Sapiens
HGKDLEVEQ

SEQ ID NO: 356892 - protein, 9 aa, Homo Sapiens
DKAFSISQL

SEQ ID NO: 356893 - protein, 9 aa, Homo Sapiens
QQHFEKRRK

SEQ ID NO: 356894 - protein, 9 aa, Homo Sapiens
DQKRCSALL

SEQ ID NO: 356895 - protein, 9 aa, Homo Sapiens
SSSSSLFPD

SEQ ID NO: 356896 - protein, 9 aa, Homo Sapiens
KTPEVPFFG

SEQ ID NO: 356897 - protein, 9 aa, Homo Sapiens
HIDVDSVLV

SEQ ID NO: 356898 - protein, 9 aa, Homo Sapiens
YRASVWENV

SEQ ID NO: 356899 - protein, 9 aa, Homo Sapiens
EEALQRSST

SEQ ID NO: 356900 - protein, 9 aa, Homo Sapiens
LGKIVDRIN

SEQ ID NO: 356901 - protein, 9 aa, Homo Sapiens
NGLGSPVIK

SEQ ID NO: 356902 - protein, 9 aa, Homo Sapiens
KSREHSSHK

SEQ ID NO: 356903 - protein, 9 aa, Homo Sapiens
EPPQQPPET

SEQ ID NO: 356904 - protein, 9 aa, Homo Sapiens
ENLQRSDKE

SEQ ID NO: 356905 - protein, 9 aa, Homo Sapiens
VRLITEKKD

SEQ ID NO: 356906 - protein, 9 aa, Homo Sapiens
QPHVVSQWS

SEQ ID NO: 356907 - protein, 9 aa, Homo Sapiens
LDLGYNRLQ

SEQ ID NO: 356908 - protein, 9 aa, Homo Sapiens
TVAGNLNVT

SEQ ID NO: 356909 - protein, 9 aa, Homo Sapiens
CLHAAIDIY

SEQ ID NO: 356910 - protein, 9 aa, Homo Sapiens
NPWAGGVFL

SEQ ID NO: 356911 - protein, 9 aa, Homo Sapiens
SADQKLSVT

SEQ ID NO: 356912 - protein, 9 aa, Homo Sapiens
SPNENIIIV

SEQ ID NO: 356913 - protein, 9 aa, Homo Sapiens
DSYNMELEA

SEQ ID NO: 356914 - protein, 9 aa, Homo Sapiens
AAPSALALC

SEQ ID NO: 356915 - protein, 9 aa, Homo Sapiens
PICGSSGEE

SEQ ID NO: 356916 - protein, 9 aa, Homo Sapiens
LLSTVNSLA

SEQ ID NO: 356917 - protein, 9 aa, Homo Sapiens
HEAADQKRC

SEQ ID NO: 356918 - protein, 9 aa, Homo Sapiens
VNALANNIV

SEQ ID NO: 356919 - protein, 9 aa, Homo Sapiens
KKQVAGLLP

SEQ ID NO: 356920 - protein, 9 aa, Homo Sapiens
VLQIDCGSY

SEQ ID NO: 356921 - protein, 9 aa, Homo Sapiens
HFLQQHYAI

SEQ ID NO: 356922 - protein, 9 aa, Homo Sapiens
LVELHKFYN

SEQ ID NO: 356923 - protein, 9 aa, Homo Sapiens
TGDATTRHH

SEQ ID NO: 356924 - protein, 9 aa, Homo Sapiens
IIQNEGIKS

SEQ ID NO: 356925 - protein, 9 aa, Homo Sapiens
YGYTTEPVP

SEQ ID NO: 356926 - protein, 9 aa, Homo Sapiens
ECGNTFNRC

SEQ ID NO: 356927 - protein, 9 aa, Homo Sapiens
LFTNAWCWL

SEQ ID NO: 356928 - protein, 9 aa, Homo Sapiens
NTARCEWNY

SEQ ID NO: 356929 - protein, 9 aa, Homo Sapiens
VFTMDTDDP

SEQ ID NO: 356930 - protein, 9 aa, Homo Sapiens
LASDDFRNK

SEQ ID NO: 356931 - protein, 9 aa, Homo Sapiens
ILVANNRLF

SEQ ID NO: 356932 - protein, 9 aa, Homo Sapiens
HPLTELTGF

SEQ ID NO: 356933 - protein, 9 aa, Homo Sapiens
ENQNKTLVE

SEQ ID NO: 356934 - protein, 9 aa, Homo Sapiens
EKLKYLFDY

SEQ ID NO: 356935 - protein, 9 aa, Homo Sapiens
FTVNADLSA

SEQ ID NO: 356936 - protein, 9 aa, Homo Sapiens
DKADLGELN

SEQ ID NO: 356937 - protein, 9 aa, Homo Sapiens
NQLGQQFRG

SEQ ID NO: 356938 - protein, 9 aa, Homo Sapiens
FKELTRDFL

SEQ ID NO: 356939 - protein, 9 aa, Homo Sapiens
QQLPKQFLP

SEQ ID NO: 356940 - protein, 9 aa, Homo Sapiens
KAKLCSTVA

SEQ ID NO: 356941 - protein, 9 aa, Homo Sapiens
SGSYWDCIH

SEQ ID NO: 356942 - protein, 9 aa, Homo Sapiens
CSLIRMLVV

SEQ ID NO: 356943 - protein, 9 aa, Homo Sapiens
RTDIYITSF

SEQ ID NO: 356944 - protein, 9 aa, Homo Sapiens
VPHNLPSSL

SEQ ID NO: 356945 - protein, 9 aa, Homo Sapiens
YMARGEKYL

SEQ ID NO: 356946 - protein, 9 aa, Homo Sapiens
EEERFIESS

SEQ ID NO: 356947 - protein, 9 aa, Homo Sapiens
VFTNDIDKA

SEQ ID NO: 356948 - protein, 9 aa, Homo Sapiens
IILVVDPVT

SEQ ID NO: 356949 - protein, 9 aa, Homo Sapiens
GNLVYQIAM

SEQ ID NO: 356950 - protein, 9 aa, Homo Sapiens
WSLWDTFKD

SEQ ID NO: 356951 - protein, 9 aa, Homo Sapiens
WSFTSSTAS

SEQ ID NO: 356952 - protein, 9 aa, Homo Sapiens
REKSVVIQH

SEQ ID NO: 356953 - protein, 9 aa, Homo Sapiens
DHLVQQGIV

SEQ ID NO: 356954 - protein, 9 aa, Homo Sapiens
CLEVTLKNK

SEQ ID NO: 356955 - protein, 9 aa, Homo Sapiens
HVGSVHSIK

SEQ ID NO: 356956 - protein, 9 aa, Homo Sapiens
MLYQDNNGN

SEQ ID NO: 356957 - protein, 9 aa, Homo Sapiens
GHPTLPYRY

SEQ ID NO: 356958 - protein, 9 aa, Homo Sapiens
LVSLEQLYL

SEQ ID NO: 356959 - protein, 9 aa, Homo Sapiens
NLALLADDI

SEQ ID NO: 356960 - protein, 9 aa, Homo Sapiens
ISNNTVSPR

SEQ ID NO: 356961 - protein, 9 aa, Homo Sapiens
CCKSYVRPG

SEQ ID NO: 356962 - protein, 9 aa, Homo Sapiens
AFVLIVEFI

SEQ ID NO: 356963 - protein, 9 aa, Homo Sapiens
NTSKLFSEE

SEQ ID NO: 356964 - protein, 9 aa, Homo Sapiens
FLVWKFAYA

SEQ ID NO: 356965 - protein, 9 aa, Homo Sapiens
RHAKAPTDP

SEQ ID NO: 356966 - protein, 9 aa, Homo Sapiens
VKKDAFWRL

SEQ ID NO: 356967 - protein, 9 aa, Homo Sapiens
GLNSGGHSD

SEQ ID NO: 356968 - protein, 9 aa, Homo Sapiens
SWKQFRALW

SEQ ID NO: 356969 - protein, 9 aa, Homo Sapiens
LKPAFGFGI

SEQ ID NO: 356970 - protein, 9 aa, Homo Sapiens
RMRMYSLKG

SEQ ID NO: 356971 - protein, 9 aa, Homo Sapiens
GTSSQPASR

SEQ ID NO: 356972 - protein, 9 aa, Homo Sapiens
MKAPPDLLD

SEQ ID NO: 356973 - protein, 9 aa, Homo Sapiens
CSRLTVHRK

SEQ ID NO: 356974 - protein, 9 aa, Homo Sapiens
KEHVKEISE

SEQ ID NO: 356975 - protein, 9 aa, Homo Sapiens
VCTIVKKDA

SEQ ID NO: 356976 - protein, 9 aa, Homo Sapiens
NSYEMQNAV

SEQ ID NO: 356977 - protein, 9 aa, Homo Sapiens
NTTTEENGE

SEQ ID NO: 356978 - protein, 9 aa, Homo Sapiens
VQNNTRVIQ

SEQ ID NO: 356979 - protein, 9 aa, Homo Sapiens
LEFGSEYGV

SEQ ID NO: 356980 - protein, 9 aa, Homo Sapiens
SRNNTDKNY

SEQ ID NO: 356981 - protein, 9 aa, Homo Sapiens
VREVCKEEQ

SEQ ID NO: 356982 - protein, 9 aa, Homo Sapiens
TSLKIPKRP

SEQ ID NO: 356983 - protein, 9 aa, Homo Sapiens
FYVEQLWVV

SEQ ID NO: 356984 - protein, 9 aa, Homo Sapiens
EALMHTSSN

SEQ ID NO: 356985 - protein, 9 aa, Homo Sapiens
MYTIRNKEV

SEQ ID NO: 356986 - protein, 9 aa, Homo Sapiens
PSLTNLVKN

SEQ ID NO: 356987 - protein, 9 aa, Homo Sapiens
SEYKIQGLP

SEQ ID NO: 356988 - protein, 9 aa, Homo Sapiens
LENFYSNLM

SEQ ID NO: 356989 - protein, 9 aa, Homo Sapiens
ACGFTTISV

SEQ ID NO: 356990 - protein, 9 aa, Homo Sapiens
DVPKHKKFP

SEQ ID NO: 356991 - protein, 9 aa, Homo Sapiens
QIYQSSSDQ

SEQ ID NO: 356992 - protein, 9 aa, Homo Sapiens
LSVPQDLTM

SEQ ID NO: 356993 - protein, 9 aa, Homo Sapiens
RESVIRFFI

SEQ ID NO: 356994 - protein, 9 aa, Homo Sapiens
SSFTDAPAM

SEQ ID NO: 356995 - protein, 9 aa, Homo Sapiens
LLPEGIPSI

SEQ ID NO: 356996 - protein, 9 aa, Homo Sapiens
ASPSTDSAL

SEQ ID NO: 356997 - protein, 9 aa, Homo Sapiens
ALTSFMKGR

SEQ ID NO: 356998 - protein, 9 aa, Homo Sapiens
VYFDDIHRK

SEQ ID NO: 356999 - protein, 9 aa, Homo Sapiens
SQKITYEGG

SEQ ID NO: 357000 - protein, 9 aa, Homo Sapiens
KGAKTLARS

SEQ ID NO: 357001 - protein, 9 aa, Homo Sapiens
GLPLRQHHS

SEQ ID NO: 357002 - protein, 9 aa, Homo Sapiens
TKEHTYVLG

SEQ ID NO: 357003 - protein, 9 aa, Homo Sapiens
NRHPGASIQ

SEQ ID NO: 357004 - protein, 9 aa, Homo Sapiens
TVLCLFFNH

SEQ ID NO: 357005 - protein, 9 aa, Homo Sapiens
ETEYKVPAR

SEQ ID NO: 357006 - protein, 9 aa, Homo Sapiens
CQAWSFMTP

SEQ ID NO: 357007 - protein, 9 aa, Homo Sapiens
NQATKDKRT

SEQ ID NO: 357008 - protein, 9 aa, Homo Sapiens
SYISTNNGK

SEQ ID NO: 357009 - protein, 9 aa, Homo Sapiens
ICGFLILLS

SEQ ID NO: 357010 - protein, 9 aa, Homo Sapiens
GEGSLLALS

SEQ ID NO: 357011 - protein, 9 aa, Homo Sapiens
RKTICDGAL

SEQ ID NO: 357012 - protein, 9 aa, Homo Sapiens
IDCGQKKFS

SEQ ID NO: 357013 - protein, 9 aa, Homo Sapiens
EYLLMAVIN

SEQ ID NO: 357014 - protein, 9 aa, Homo Sapiens
RTRRYVCKF

SEQ ID NO: 357015 - protein, 9 aa, Homo Sapiens
RDWYKHNFA

SEQ ID NO: 357016 - protein, 9 aa, Homo Sapiens
VYLQKEAGV

SEQ ID NO: 357017 - protein, 9 aa, Homo Sapiens
PGLCLTTFL

SEQ ID NO: 357018 - protein, 9 aa, Homo Sapiens
SNSTQTGKQ

SEQ ID NO: 357019 - protein, 9 aa, Homo Sapiens
LHQDSATHR

SEQ ID NO: 357020 - protein, 9 aa, Homo Sapiens
YLAKHNVLT

SEQ ID NO: 357021 - protein, 9 aa, Homo Sapiens
AASVFKKKK

SEQ ID NO: 357022 - protein, 9 aa, Homo Sapiens
KDWFAKWFE

SEQ ID NO: 357023 - protein, 9 aa, Homo Sapiens
SLPPSCRNS

SEQ ID NO: 357024 - protein, 9 aa, Homo Sapiens
EVNFTKNRK

SEQ ID NO: 357025 - protein, 9 aa, Homo Sapiens
ENHNNQGTV

SEQ ID NO: 357026 - protein, 9 aa, Homo Sapiens
NNPPLQRLS

SEQ ID NO: 357027 - protein, 9 aa, Homo Sapiens
KKMPSIKSD

SEQ ID NO: 357028 - protein, 9 aa, Homo Sapiens
SGRGRGCRG

SEQ ID NO: 357029 - protein, 9 aa, Homo Sapiens
LLKNIKLFD

SEQ ID NO: 357030 - protein, 9 aa, Homo Sapiens
LGEIITGVN

SEQ ID NO: 357031 - protein, 9 aa, Homo Sapiens
LRQDANLTK

SEQ ID NO: 357032 - protein, 9 aa, Homo Sapiens
VRIYYVLYK

SEQ ID NO: 357033 - protein, 9 aa, Homo Sapiens
QVERMLGNA

SEQ ID NO: 357034 - protein, 9 aa, Homo Sapiens
RIRAMRAAQ

SEQ ID NO: 357035 - protein, 9 aa, Homo Sapiens
FGSTEDKHL

SEQ ID NO: 357036 - protein, 9 aa, Homo Sapiens
LQSENLNLR

SEQ ID NO: 357037 - protein, 9 aa, Homo Sapiens
HKREIYDHY

SEQ ID NO: 357038 - protein, 9 aa, Homo Sapiens
SIFQSYPES

SEQ ID NO: 357039 - protein, 9 aa, Homo Sapiens
PTWKAETAC

SEQ ID NO: 357040 - protein, 9 aa, Homo Sapiens
ASVFKKKKW

SEQ ID NO: 357041 - protein, 9 aa, Homo Sapiens
SYYHMKKCS

SEQ ID NO: 357042 - protein, 9 aa, Homo Sapiens
QIKEPVSDI

SEQ ID NO: 357043 - protein, 9 aa, Homo Sapiens
TFQMTGSTL

SEQ ID NO: 357044 - protein, 9 aa, Homo Sapiens
PRKQRRQPS

SEQ ID NO: 357045 - protein, 9 aa, Homo Sapiens
CDNMMTCYL

SEQ ID NO: 357046 - protein, 9 aa, Homo Sapiens
RNTTTEENG

SEQ ID NO: 357047 - protein, 9 aa, Homo Sapiens
LVASELLIR

SEQ ID NO: 357048 - protein, 9 aa, Homo Sapiens
KSVVIQHQR

SEQ ID NO: 357049 - protein, 9 aa, Homo Sapiens
ASNIPTEIK

SEQ ID NO: 357050 - protein, 9 aa, Homo Sapiens
EIQITLNQL

SEQ ID NO: 357051 - protein, 9 aa, Homo Sapiens
SNAIQVDQS

SEQ ID NO: 357052 - protein, 9 aa, Homo Sapiens
DWICKERNQ

SEQ ID NO: 357053 - protein, 9 aa, Homo Sapiens
KAQSDGWER

SEQ ID NO: 357054 - protein, 9 aa, Homo Sapiens
LAKPFNKFQ

SEQ ID NO: 357055 - protein, 9 aa, Homo Sapiens
VFNNDAAEL

SEQ ID NO: 357056 - protein, 9 aa, Homo Sapiens
MKLSMNNNI

SEQ ID NO: 357057 - protein, 9 aa, Homo Sapiens
CFGEGSLLA

SEQ ID NO: 357058 - protein, 9 aa, Homo Sapiens
NRLAWIVVV

SEQ ID NO: 357059 - protein, 9 aa, Homo Sapiens
RDSHSEHER

SEQ ID NO: 357060 - protein, 9 aa, Homo Sapiens
INNVNESWK

SEQ ID NO: 357061 - protein, 9 aa, Homo Sapiens
VVFFVFVLF

SEQ ID NO: 357062 - protein, 9 aa, Homo Sapiens
FPGRTDNSI

SEQ ID NO: 357063 - protein, 9 aa, Homo Sapiens
IIEDNWQLS

SEQ ID NO: 357064 - protein, 9 aa, Homo Sapiens
AWENHLKQN

SEQ ID NO: 357065 - protein, 9 aa, Homo Sapiens
EMAVQLDNV

SEQ ID NO: 357066 - protein, 9 aa, Homo Sapiens
LDYGLKEND

SEQ ID NO: 357067 - protein, 9 aa, Homo Sapiens
KQTSFKAHI

SEQ ID NO: 357068 - protein, 9 aa, Homo Sapiens
EEDDKSKTQ

SEQ ID NO: 357069 - protein, 9 aa, Homo Sapiens
LKSLDKDIS

SEQ ID NO: 357070 - protein, 9 aa, Homo Sapiens
AGELMPRKA

SEQ ID NO: 357071 - protein, 9 aa, Homo Sapiens
LFSTLTGLP

SEQ ID NO: 357072 - protein, 9 aa, Homo Sapiens
EEGDADKWV

SEQ ID NO: 357073 - protein, 9 aa, Homo Sapiens
RGGRGHPRG

SEQ ID NO: 357074 - protein, 9 aa, Homo Sapiens
SKTYLICYQ

SEQ ID NO: 357075 - protein, 9 aa, Homo Sapiens
NKLLPLHRG

SEQ ID NO: 357076 - protein, 9 aa, Homo Sapiens
LQQHYAIYD

SEQ ID NO: 357077 - protein, 9 aa, Homo Sapiens
KTYSLEEER

SEQ ID NO: 357078 - protein, 9 aa, Homo Sapiens
THNDIALLK

SEQ ID NO: 357079 - protein, 9 aa, Homo Sapiens
KAIIWHRPA

SEQ ID NO: 357080 - protein, 9 aa, Homo Sapiens
YTKQLFQFL

SEQ ID NO: 357081 - protein, 9 aa, Homo Sapiens
NTLGCQNNN

SEQ ID NO: 357082 - protein, 9 aa, Homo Sapiens
DVESFFKGY

SEQ ID NO: 357083 - protein, 9 aa, Homo Sapiens
NADLSASEQ

SEQ ID NO: 357084 - protein, 9 aa, Homo Sapiens
VHGFYPPEI

SEQ ID NO: 357085 - protein, 9 aa, Homo Sapiens
CGAQHVNNN

SEQ ID NO: 357086 - protein, 9 aa, Homo Sapiens
GHNYSNHSK

SEQ ID NO: 357087 - protein, 9 aa, Homo Sapiens
AITEKRKRQ

SEQ ID NO: 357088 - protein, 9 aa, Homo Sapiens
VRNMNTLRR

SEQ ID NO: 357089 - protein, 9 aa, Homo Sapiens
VPVLNSECA

SEQ ID NO: 357090 - protein, 9 aa, Homo Sapiens
QGTAVTHGD

SEQ ID NO: 357091 - protein, 9 aa, Homo Sapiens
ALSSFNSCL

SEQ ID NO: 357092 - protein, 9 aa, Homo Sapiens
LLSVCAWGL

SEQ ID NO: 357093 - protein, 9 aa, Homo Sapiens
HSPGHNVLG

SEQ ID NO: 357094 - protein, 9 aa, Homo Sapiens
MLHFSLFVT

SEQ ID NO: 357095 - protein, 9 aa, Homo Sapiens
LKHNKLPLG

SEQ ID NO: 357096 - protein, 9 aa, Homo Sapiens
GGLSNVGWA

SEQ ID NO: 357097 - protein, 9 aa, Homo Sapiens
MYSLKGKSR

SEQ ID NO: 357098 - protein, 9 aa, Homo Sapiens
AERGNYLTR

SEQ ID NO: 357099 - protein, 9 aa, Homo Sapiens
MAKKEEDGT

SEQ ID NO: 357100 - protein, 9 aa, Homo Sapiens
TMIYFVGCF

SEQ ID NO: 357101 - protein, 9 aa, Homo Sapiens
TICRFEPLT

SEQ ID NO: 357102 - protein, 9 aa, Homo Sapiens
SCILMAVLA

SEQ ID NO: 357103 - protein, 9 aa, Homo Sapiens
ICFVNPAGE

SEQ ID NO: 357104 - protein, 9 aa, Homo Sapiens
NRDWYKHNF

SEQ ID NO: 357105 - protein, 9 aa, Homo Sapiens
PLKQQIQKI

SEQ ID NO: 357106 - protein, 9 aa, Homo Sapiens
GTFTWQGLL

SEQ ID NO: 357107 - protein, 9 aa, Homo Sapiens
CYAVRLSVA

SEQ ID NO: 357108 - protein, 9 aa, Homo Sapiens
PDKRKEFIK

SEQ ID NO: 357109 - protein, 9 aa, Homo Sapiens
LEEEEGLVC

SEQ ID NO: 357110 - protein, 9 aa, Homo Sapiens
SLMVHQITH

SEQ ID NO: 357111 - protein, 9 aa, Homo Sapiens
LKKKLDNEV

SEQ ID NO: 357112 - protein, 9 aa, Homo Sapiens
PCGKRFPQA

SEQ ID NO: 357113 - protein, 9 aa, Homo Sapiens
HLVQQGIVH

SEQ ID NO: 357114 - protein, 9 aa, Homo Sapiens
KCLLLVLMS

SEQ ID NO: 357115 - protein, 9 aa, Homo Sapiens
IYKLSLCKM

SEQ ID NO: 357116 - protein, 9 aa, Homo Sapiens
VALAKPFNK

SEQ ID NO: 357117 - protein, 9 aa, Homo Sapiens
ACLAMLEKN

SEQ ID NO: 357118 - protein, 9 aa, Homo Sapiens
MDDKDNAHY

SEQ ID NO: 357119 - protein, 9 aa, Homo Sapiens
KESDKENGI

SEQ ID NO: 357120 - protein, 9 aa, Homo Sapiens
DSDTPAEED

SEQ ID NO: 357121 - protein, 9 aa, Homo Sapiens
INTLDSYRC

SEQ ID NO: 357122 - protein, 9 aa, Homo Sapiens
WDTFYKINK

SEQ ID NO: 357123 - protein, 9 aa, Homo Sapiens
MLEWVCLGN

SEQ ID NO: 357124 - protein, 9 aa, Homo Sapiens
YSSSNEKQT

SEQ ID NO: 357125 - protein, 9 aa, Homo Sapiens
HTEEKPFVC

SEQ ID NO: 357126 - protein, 9 aa, Homo Sapiens
GQLNITAMQ

SEQ ID NO: 357127 - protein, 9 aa, Homo Sapiens
EYKIQGLPN

SEQ ID NO: 357128 - protein, 9 aa, Homo Sapiens
GVLRDSRDV

SEQ ID NO: 357129 - protein, 9 aa, Homo Sapiens
VRVQNCAII

SEQ ID NO: 357130 - protein, 9 aa, Homo Sapiens
GCRGPNYTS

SEQ ID NO: 357131 - protein, 9 aa, Homo Sapiens
LRDAELAQK

SEQ ID NO: 357132 - protein, 9 aa, Homo Sapiens
HNSNEEDKV

SEQ ID NO: 357133 - protein, 9 aa, Homo Sapiens
DKLNYSIQY

SEQ ID NO: 357134 - protein, 9 aa, Homo Sapiens
FNPEHCSHN

SEQ ID NO: 357135 - protein, 9 aa, Homo Sapiens
NTASTGKTF

SEQ ID NO: 357136 - protein, 9 aa, Homo Sapiens
RNHTQNKCN

SEQ ID NO: 357137 - protein, 9 aa, Homo Sapiens
TQSSQEYDG

SEQ ID NO: 357138 - protein, 9 aa, Homo Sapiens
NPDLLPNIT

SEQ ID NO: 357139 - protein, 9 aa, Homo Sapiens
LAELHTKTN

SEQ ID NO: 357140 - protein, 9 aa, Homo Sapiens
ASSDISLDK

SEQ ID NO: 357141 - protein, 9 aa, Homo Sapiens
ATSDKKDSA

SEQ ID NO: 357142 - protein, 9 aa, Homo Sapiens
CCCLRPACG

SEQ ID NO: 357143 - protein, 9 aa, Homo Sapiens
VVCYTSAKD

SEQ ID NO: 357144 - protein, 9 aa, Homo Sapiens
EVLLDIKRY

SEQ ID NO: 357145 - protein, 9 aa, Homo Sapiens
ICAAETGGI

SEQ ID NO: 357146 - protein, 9 aa, Homo Sapiens
CKSDGAFYA

SEQ ID NO: 357147 - protein, 9 aa, Homo Sapiens
MDKGVIQQG

SEQ ID NO: 357148 - protein, 9 aa, Homo Sapiens
GSGNLSQVK

SEQ ID NO: 357149 - protein, 9 aa, Homo Sapiens
FSAVGLVTI

SEQ ID NO: 357150 - protein, 9 aa, Homo Sapiens
LSTIKDHLW

SEQ ID NO: 357151 - protein, 9 aa, Homo Sapiens
VAVCNPLWY

SEQ ID NO: 357152 - protein, 9 aa, Homo Sapiens
LYKYTLDAF

SEQ ID NO: 357153 - protein, 9 aa, Homo Sapiens
LHTEEKPFV

SEQ ID NO: 357154 - protein, 9 aa, Homo Sapiens
LNSDEPVAD

SEQ ID NO: 357155 - protein, 9 aa, Homo Sapiens
VCRCNRNFV

SEQ ID NO: 357156 - protein, 9 aa, Homo Sapiens
PGVLRDSRD

SEQ ID NO: 357157 - protein, 9 aa, Homo Sapiens
VCKDEINIP

SEQ ID NO: 357158 - protein, 9 aa, Homo Sapiens
ADTHEKISV

SEQ ID NO: 357159 - protein, 9 aa, Homo Sapiens
SRMKPFKSN

SEQ ID NO: 357160 - protein, 9 aa, Homo Sapiens
VRDDIDGIN

SEQ ID NO: 357161 - protein, 9 aa, Homo Sapiens
ATTIANHWI

SEQ ID NO: 357162 - protein, 9 aa, Homo Sapiens
DRIEIGYTY

SEQ ID NO: 357163 - protein, 9 aa, Homo Sapiens
LLPGEWLPA

SEQ ID NO: 357164 - protein, 9 aa, Homo Sapiens
KEFRCEPSS

SEQ ID NO: 357165 - protein, 9 aa, Homo Sapiens
HNTYQHFYD

SEQ ID NO: 357166 - protein, 9 aa, Homo Sapiens
MEQLCTYQE

SEQ ID NO: 357167 - protein, 9 aa, Homo Sapiens
VSLEQLYLH

SEQ ID NO: 357168 - protein, 9 aa, Homo Sapiens
TINNVSPHA

SEQ ID NO: 357169 - protein, 9 aa, Homo Sapiens
ACDTKVLIE

SEQ ID NO: 357170 - protein, 9 aa, Homo Sapiens
CFASLFHVC

SEQ ID NO: 357171 - protein, 9 aa, Homo Sapiens
DSATHRNGD

SEQ ID NO: 357172 - protein, 9 aa, Homo Sapiens
EFIKAITDR

SEQ ID NO: 357173 - protein, 9 aa, Homo Sapiens
HCRLTGSTP

SEQ ID NO: 357174 - protein, 9 aa, Homo Sapiens
VYLTNLLEL

SEQ ID NO: 357175 - protein, 9 aa, Homo Sapiens
HYIEELARS

SEQ ID NO: 357176 - protein, 9 aa, Homo Sapiens
CVFSQPGAL

SEQ ID NO: 357177 - protein, 9 aa, Homo Sapiens
PHDVHTCSP

SEQ ID NO: 357178 - protein, 9 aa, Homo Sapiens
FISHQQIHT

SEQ ID NO: 357179 - protein, 9 aa, Homo Sapiens
LLEQDIFNR

SEQ ID NO: 357180 - protein, 9 aa, Homo Sapiens
GFINFIVEP

SEQ ID NO: 357181 - protein, 9 aa, Homo Sapiens
PEHRRVLAQ

SEQ ID NO: 357182 - protein, 9 aa, Homo Sapiens
FRVLDCHKK

SEQ ID NO: 357183 - protein, 9 aa, Homo Sapiens
FSPSLLKRH

SEQ ID NO: 357184 - protein, 9 aa, Homo Sapiens
EGHQWDKIP

SEQ ID NO: 357185 - protein, 9 aa, Homo Sapiens
LAGFTAWIT

SEQ ID NO: 357186 - protein, 9 aa, Homo Sapiens
KNKRTPYIM

SEQ ID NO: 357187 - protein, 9 aa, Homo Sapiens
FIILITDGE

SEQ ID NO: 357188 - protein, 9 aa, Homo Sapiens
YIQGYKIIY

SEQ ID NO: 357189 - protein, 9 aa, Homo Sapiens
KINTCDLLS

SEQ ID NO: 357190 - protein, 9 aa, Homo Sapiens
NTRSSQNGS

SEQ ID NO: 357191 - protein, 9 aa, Homo Sapiens
EGQGGAKNI

SEQ ID NO: 357192 - protein, 9 aa, Homo Sapiens
DMTKNLKEE

SEQ ID NO: 357193 - protein, 9 aa, Homo Sapiens
QMLCNLGTE

SEQ ID NO: 357194 - protein, 9 aa, Homo Sapiens
TPITVWGTH

SEQ ID NO: 357195 - protein, 9 aa, Homo Sapiens
HSTICKMNK

SEQ ID NO: 357196 - protein, 9 aa, Homo Sapiens
TTRSGTLFE

SEQ ID NO: 357197 - protein, 9 aa, Homo Sapiens
LQADFNKTE

SEQ ID NO: 357198 - protein, 9 aa, Homo Sapiens
PIVMRLERV

SEQ ID NO: 357199 - protein, 9 aa, Homo Sapiens
NLESSQNSD

SEQ ID NO: 357200 - protein, 9 aa, Homo Sapiens
DLYVRLINS

SEQ ID NO: 357201 - protein, 9 aa, Homo Sapiens
YEFFADVWR

SEQ ID NO: 357202 - protein, 9 aa, Homo Sapiens
APPNRQTCV

SEQ ID NO: 357203 - protein, 9 aa, Homo Sapiens
HLKRHLDYV

SEQ ID NO: 357204 - protein, 9 aa, Homo Sapiens
PDSSPITKH

SEQ ID NO: 357205 - protein, 9 aa, Homo Sapiens
SPFHFFSLH

SEQ ID NO: 357206 - protein, 9 aa, Homo Sapiens
RLYRSRKKH

SEQ ID NO: 357207 - protein, 9 aa, Homo Sapiens
DPYPQEVST

SEQ ID NO: 357208 - protein, 9 aa, Homo Sapiens
RINSGATFT

SEQ ID NO: 357209 - protein, 9 aa, Homo Sapiens
GSLNLISNL

SEQ ID NO: 357210 - protein, 9 aa, Homo Sapiens
VNEQALNKI

SEQ ID NO: 357211 - protein, 9 aa, Homo Sapiens
VVVCVRPEN

SEQ ID NO: 357212 - protein, 9 aa, Homo Sapiens
QPVISSLEY

SEQ ID NO: 357213 - protein, 9 aa, Homo Sapiens
EALRYLNVR

SEQ ID NO: 357214 - protein, 9 aa, Homo Sapiens
AKAKAEAIQ

SEQ ID NO: 357215 - protein, 9 aa, Homo Sapiens
ENKHYANIG

SEQ ID NO: 357216 - protein, 9 aa, Homo Sapiens
VTTWDCDQD

SEQ ID NO: 357217 - protein, 9 aa, Homo Sapiens
TNGSRFPAS

SEQ ID NO: 357218 - protein, 9 aa, Homo Sapiens
HRIVTYHHH

SEQ ID NO: 357219 - protein, 9 aa, Homo Sapiens
RHPGASIQE

SEQ ID NO: 357220 - protein, 9 aa, Homo Sapiens
IHKETSLIE

SEQ ID NO: 357221 - protein, 9 aa, Homo Sapiens
LPGKTNLVT

SEQ ID NO: 357222 - protein, 9 aa, Homo Sapiens
NCALYICDL

SEQ ID NO: 357223 - protein, 9 aa, Homo Sapiens
IVLKPHNIK

SEQ ID NO: 357224 - protein, 9 aa, Homo Sapiens
QAWQKAQSD

SEQ ID NO: 357225 - protein, 9 aa, Homo Sapiens
WLCPQAEVD

SEQ ID NO: 357226 - protein, 9 aa, Homo Sapiens
QQAITSTLR

SEQ ID NO: 357227 - protein, 9 aa, Homo Sapiens
HLITGFNTL

SEQ ID NO: 357228 - protein, 9 aa, Homo Sapiens
VTYTFRGFW

SEQ ID NO: 357229 - protein, 9 aa, Homo Sapiens
FYRFKDTAY

SEQ ID NO: 357230 - protein, 9 aa, Homo Sapiens
TWYMNAVLQ

SEQ ID NO: 357231 - protein, 9 aa, Homo Sapiens
VLTKNIQFT

SEQ ID NO: 357232 - protein, 9 aa, Homo Sapiens
KGYDNEDNY

SEQ ID NO: 357233 - protein, 9 aa, Homo Sapiens
PEYNIKMKI

SEQ ID NO: 357234 - protein, 9 aa, Homo Sapiens
RQCQPEIRM

SEQ ID NO: 357235 - protein, 9 aa, Homo Sapiens
EGDVPRRSP

SEQ ID NO: 357236 - protein, 9 aa, Homo Sapiens
GLALDMDRI

SEQ ID NO: 357237 - protein, 9 aa, Homo Sapiens
TLLLSSPDI

SEQ ID NO: 357238 - protein, 9 aa, Homo Sapiens
YRWIWDALR

SEQ ID NO: 357239 - protein, 9 aa, Homo Sapiens
PILDTASLV

SEQ ID NO: 357240 - protein, 9 aa, Homo Sapiens
ATEKKANQL

SEQ ID NO: 357241 - protein, 9 aa, Homo Sapiens
KVDFILLGG

SEQ ID NO: 357242 - protein, 9 aa, Homo Sapiens
DISLFILLC

SEQ ID NO: 357243 - protein, 9 aa, Homo Sapiens
IVQRLLDFI

SEQ ID NO: 357244 - protein, 9 aa, Homo Sapiens
KTGMKRKDE

SEQ ID NO: 357245 - protein, 9 aa, Homo Sapiens
DNDDPPVFP

SEQ ID NO: 357246 - protein, 9 aa, Homo Sapiens
KGPLTLKGV

SEQ ID NO: 357247 - protein, 9 aa, Homo Sapiens
VKSEKLKYL

SEQ ID NO: 357248 - protein, 9 aa, Homo Sapiens
RFLVVKVSA

SEQ ID NO: 357249 - protein, 9 aa, Homo Sapiens
GLLTRFLKL

SEQ ID NO: 357250 - protein, 9 aa, Homo Sapiens
KTKRELLES

SEQ ID NO: 357251 - protein, 9 aa, Homo Sapiens
QWYLDLCRF

SEQ ID NO: 357252 - protein, 9 aa, Homo Sapiens
TEEIKVIFI

SEQ ID NO: 357253 - protein, 9 aa, Homo Sapiens
STVSISVVS

SEQ ID NO: 357254 - protein, 9 aa, Homo Sapiens
AGNNENYSA

SEQ ID NO: 357255 - protein, 9 aa, Homo Sapiens
YYDIKLSEW

SEQ ID NO: 357256 - protein, 9 aa, Homo Sapiens
PPRQFFVDQ

SEQ ID NO: 357257 - protein, 9 aa, Homo Sapiens
YEEFPGDER

SEQ ID NO: 357258 - protein, 9 aa, Homo Sapiens
PGPANISGC

SEQ ID NO: 357259 - protein, 9 aa, Homo Sapiens
KKSLEDKTK

SEQ ID NO: 357260 - protein, 9 aa, Homo Sapiens
ATLWGAVGH

SEQ ID NO: 357261 - protein, 9 aa, Homo Sapiens
PASRFQMPV

SEQ ID NO: 357262 - protein, 9 aa, Homo Sapiens
LEVVVLSQN

SEQ ID NO: 357263 - protein, 9 aa, Homo Sapiens
SEEDIQTVF

SEQ ID NO: 357264 - protein, 9 aa, Homo Sapiens
RENLCFDLY

SEQ ID NO: 357265 - protein, 9 aa, Homo Sapiens
RNPNLKTLF

SEQ ID NO: 357266 - protein, 9 aa, Homo Sapiens
LLLQLLGPP

SEQ ID NO: 357267 - protein, 9 aa, Homo Sapiens
HKQQNVYCM

SEQ ID NO: 357268 - protein, 9 aa, Homo Sapiens
TLGIIFGVS

SEQ ID NO: 357269 - protein, 9 aa, Homo Sapiens
RCGKILFEN

SEQ ID NO: 357270 - protein, 9 aa, Homo Sapiens
LNVALSSCH

SEQ ID NO: 357271 - protein, 9 aa, Homo Sapiens
AMGIDNCSV

SEQ ID NO: 357272 - protein, 9 aa, Homo Sapiens
NSEKVYLCD

SEQ ID NO: 357273 - protein, 9 aa, Homo Sapiens
GLHRSPHRE

SEQ ID NO: 357274 - protein, 9 aa, Homo Sapiens
VVYPEIFPA

SEQ ID NO: 357275 - protein, 9 aa, Homo Sapiens
KIDVNEISH

SEQ ID NO: 357276 - protein, 9 aa, Homo Sapiens
YRSNVPNMH

SEQ ID NO: 357277 - protein, 9 aa, Homo Sapiens
MILSNTTVV

SEQ ID NO: 357278 - protein, 9 aa, Homo Sapiens
AYDGEYAQP

SEQ ID NO: 357279 - protein, 9 aa, Homo Sapiens
HLCVCTCAH

SEQ ID NO: 357280 - protein, 9 aa, Homo Sapiens
WNQLQEDLQ

SEQ ID NO: 357281 - protein, 9 aa, Homo Sapiens
LALGQYHQN

SEQ ID NO: 357282 - protein, 9 aa, Homo Sapiens
EAENGLVHQ

SEQ ID NO: 357283 - protein, 9 aa, Homo Sapiens
PKNMENLLD

SEQ ID NO: 357284 - protein, 9 aa, Homo Sapiens
ISRVTYLLG

SEQ ID NO: 357285 - protein, 9 aa, Homo Sapiens
GSVLSPELP

SEQ ID NO: 357286 - protein, 9 aa, Homo Sapiens
ASVKFSECL

SEQ ID NO: 357287 - protein, 9 aa, Homo Sapiens
MNRQINILR

SEQ ID NO: 357288 - protein, 9 aa, Homo Sapiens
FLMSFTPAV

SEQ ID NO: 357289 - protein, 9 aa, Homo Sapiens
VNGEHTERH

SEQ ID NO: 357290 - protein, 9 aa, Homo Sapiens
SYHAMRKAA

SEQ ID NO: 357291 - protein, 9 aa, Homo Sapiens
QKKQNVLQS

SEQ ID NO: 357292 - protein, 9 aa, Homo Sapiens
SLERTFREL

SEQ ID NO: 357293 - protein, 9 aa, Homo Sapiens
NKMQKTLEN

SEQ ID NO: 357294 - protein, 9 aa, Homo Sapiens
SQRQRLLLI

SEQ ID NO: 357295 - protein, 9 aa, Homo Sapiens
LETKELWDT

SEQ ID NO: 357296 - protein, 9 aa, Homo Sapiens
IRVVFQISQ

SEQ ID NO: 357297 - protein, 9 aa, Homo Sapiens
CDNKGDGSC

SEQ ID NO: 357298 - protein, 9 aa, Homo Sapiens
CVTECKEYQ

SEQ ID NO: 357299 - protein, 9 aa, Homo Sapiens
KKMKVDLSL

SEQ ID NO: 357300 - protein, 9 aa, Homo Sapiens
IFCNVTPLL

SEQ ID NO: 357301 - protein, 9 aa, Homo Sapiens
SRGPLGQHE

SEQ ID NO: 357302 - protein, 9 aa, Homo Sapiens
CLPLAFAYR

SEQ ID NO: 357303 - protein, 9 aa, Homo Sapiens
TGVACPALQ

SEQ ID NO: 357304 - protein, 9 aa, Homo Sapiens
GLKCGICMV

SEQ ID NO: 357305 - protein, 9 aa, Homo Sapiens
TSMFKLSGP

SEQ ID NO: 357306 - protein, 9 aa, Homo Sapiens
VDFFHKYFP

SEQ ID NO: 357307 - protein, 9 aa, Homo Sapiens
WIAKLEAAY

SEQ ID NO: 357308 - protein, 9 aa, Homo Sapiens
KRIILALWN

SEQ ID NO: 357309 - protein, 9 aa, Homo Sapiens
LMPRKAIST

SEQ ID NO: 357310 - protein, 9 aa, Homo Sapiens
LHQPYEAAH

SEQ ID NO: 357311 - protein, 9 aa, Homo Sapiens
GCMQKVSYF

SEQ ID NO: 357312 - protein, 9 aa, Homo Sapiens
EALKMSVAP

SEQ ID NO: 357313 - protein, 9 aa, Homo Sapiens
LVTDSNHSI

SEQ ID NO: 357314 - protein, 9 aa, Homo Sapiens
VLEAFPQND

SEQ ID NO: 357315 - protein, 9 aa, Homo Sapiens
WTKLQHFLD

SEQ ID NO: 357316 - protein, 9 aa, Homo Sapiens
TPRASSPSQ

SEQ ID NO: 357317 - protein, 9 aa, Homo Sapiens
EYLASALIS

SEQ ID NO: 357318 - protein, 9 aa, Homo Sapiens
PPLKDPFLS

SEQ ID NO: 357319 - protein, 9 aa, Homo Sapiens
ENTRTNVQF

SEQ ID NO: 357320 - protein, 9 aa, Homo Sapiens
ASEVEETEI

SEQ ID NO: 357321 - protein, 9 aa, Homo Sapiens
SSLTKHIQQ

SEQ ID NO: 357322 - protein, 9 aa, Homo Sapiens
SSPNTSQMH

SEQ ID NO: 357323 - protein, 9 aa, Homo Sapiens
PREPIPGEF

SEQ ID NO: 357324 - protein, 9 aa, Homo Sapiens
KEHTYVLGQ

SEQ ID NO: 357325 - protein, 9 aa, Homo Sapiens
GSSCFKYQK

SEQ ID NO: 357326 - protein, 9 aa, Homo Sapiens
GHVGSVHSI

SEQ ID NO: 357327 - protein, 9 aa, Homo Sapiens
GSTGTCHHT

SEQ ID NO: 357328 - protein, 9 aa, Homo Sapiens
ARIYIQRTL

SEQ ID NO: 357329 - protein, 9 aa, Homo Sapiens
TKRRHAELC

SEQ ID NO: 357330 - protein, 9 aa, Homo Sapiens
LVIRKYEFK

SEQ ID NO: 357331 - protein, 9 aa, Homo Sapiens
SRQSANVKS

SEQ ID NO: 357332 - protein, 9 aa, Homo Sapiens
SSKECLQTE

SEQ ID NO: 357333 - protein, 9 aa, Homo Sapiens
GLHQKAHRL

SEQ ID NO: 357334 - protein, 9 aa, Homo Sapiens
CTCAHVGAT

SEQ ID NO: 357335 - protein, 9 aa, Homo Sapiens
DYTLESGGA

SEQ ID NO: 357336 - protein, 9 aa, Homo Sapiens
MGPYHPDTC

SEQ ID NO: 357337 - protein, 9 aa, Homo Sapiens
ISHLKKKLD

SEQ ID NO: 357338 - protein, 9 aa, Homo Sapiens
HIQHIVIDK

SEQ ID NO: 357339 - protein, 9 aa, Homo Sapiens
FSIVGYLLF

SEQ ID NO: 357340 - protein, 9 aa, Homo Sapiens
LDCAVVNHF

SEQ ID NO: 357341 - protein, 9 aa, Homo Sapiens
SIEFNAHHP

SEQ ID NO: 357342 - protein, 9 aa, Homo Sapiens
TTTNIYIFN

SEQ ID NO: 357343 - protein, 9 aa, Homo Sapiens
KLCGTKDLS

SEQ ID NO: 357344 - protein, 9 aa, Homo Sapiens
YIQIKEYVH

SEQ ID NO: 357345 - protein, 9 aa, Homo Sapiens
MKQLILEHY

SEQ ID NO: 357346 - protein, 9 aa, Homo Sapiens
VHQSKIFAD

SEQ ID NO: 357347 - protein, 9 aa, Homo Sapiens
RGTMGETAL

SEQ ID NO: 357348 - protein, 9 aa, Homo Sapiens
DDANRKTFT

SEQ ID NO: 357349 - protein, 9 aa, Homo Sapiens
EFAHYIEEL

SEQ ID NO: 357350 - protein, 9 aa, Homo Sapiens
QAARQFAVL

SEQ ID NO: 357351 - protein, 9 aa, Homo Sapiens
LGHNKLKEC

SEQ ID NO: 357352 - protein, 9 aa, Homo Sapiens
TNQHKREIL

SEQ ID NO: 357353 - protein, 9 aa, Homo Sapiens
QQWQVAEQV

SEQ ID NO: 357354 - protein, 9 aa, Homo Sapiens
ANTSQGKLL

SEQ ID NO: 357355 - protein, 9 aa, Homo Sapiens
SLGIDTQLL

SEQ ID NO: 357356 - protein, 9 aa, Homo Sapiens
NNTAYQEVF

SEQ ID NO: 357357 - protein, 9 aa, Homo Sapiens
FDLSQVIFI

SEQ ID NO: 357358 - protein, 9 aa, Homo Sapiens
EILSPLGQI

SEQ ID NO: 357359 - protein, 9 aa, Homo Sapiens
FWLGHLLDK

SEQ ID NO: 357360 - protein, 9 aa, Homo Sapiens
LPLKLENYP

SEQ ID NO: 357361 - protein, 9 aa, Homo Sapiens
ISELSAQLH

SEQ ID NO: 357362 - protein, 9 aa, Homo Sapiens
TGNKVGFFK

SEQ ID NO: 357363 - protein, 9 aa, Homo Sapiens
ILALYTGMM

SEQ ID NO: 357364 - protein, 9 aa, Homo Sapiens
KEVLNVVKE

SEQ ID NO: 357365 - protein, 9 aa, Homo Sapiens
ESSIDYISR

SEQ ID NO: 357366 - protein, 9 aa, Homo Sapiens
PEAGIHQGF

SEQ ID NO: 357367 - protein, 9 aa, Homo Sapiens
ILASTPSAT

SEQ ID NO: 357368 - protein, 9 aa, Homo Sapiens
FDFTQLTDE

SEQ ID NO: 357369 - protein, 9 aa, Homo Sapiens
LAGEDADIS

SEQ ID NO: 357370 - protein, 9 aa, Homo Sapiens
TNTWKDHVA

SEQ ID NO: 357371 - protein, 9 aa, Homo Sapiens
LKLYHTFSA

SEQ ID NO: 357372 - protein, 9 aa, Homo Sapiens
ASNFTRWRY

SEQ ID NO: 357373 - protein, 9 aa, Homo Sapiens
QRITEISRD

SEQ ID NO: 357374 - protein, 9 aa, Homo Sapiens
LHKASLKRC

SEQ ID NO: 357375 - protein, 9 aa, Homo Sapiens
LVDAHTAKV

SEQ ID NO: 357376 - protein, 9 aa, Homo Sapiens
NISIFDFSS

SEQ ID NO: 357377 - protein, 9 aa, Homo Sapiens
FRFHADKEM

SEQ ID NO: 357378 - protein, 9 aa, Homo Sapiens
LYEEFPGDE

SEQ ID NO: 357379 - protein, 9 aa, Homo Sapiens
RNTRSKVSG

SEQ ID NO: 357380 - protein, 9 aa, Homo Sapiens
GETQGYLCP

SEQ ID NO: 357381 - protein, 9 aa, Homo Sapiens
YCLHVIHHI

SEQ ID NO: 357382 - protein, 9 aa, Homo Sapiens
EKSKEIHNT

SEQ ID NO: 357383 - protein, 9 aa, Homo Sapiens
PQISLSPSV

SEQ ID NO: 357384 - protein, 9 aa, Homo Sapiens
ALKTPTCVP

SEQ ID NO: 357385 - protein, 9 aa, Homo Sapiens
LQSLSRNAF

SEQ ID NO: 357386 - protein, 9 aa, Homo Sapiens
RIRRMWNYT

SEQ ID NO: 357387 - protein, 9 aa, Homo Sapiens
PLPEKKSKH

SEQ ID NO: 357388 - protein, 9 aa, Homo Sapiens
PKIFKRIQS

SEQ ID NO: 357389 - protein, 9 aa, Homo Sapiens
EIFKTLIKG

SEQ ID NO: 357390 - protein, 9 aa, Homo Sapiens
ESNANPPVS

SEQ ID NO: 357391 - protein, 9 aa, Homo Sapiens
QVLSLQNNL

SEQ ID NO: 357392 - protein, 9 aa, Homo Sapiens
ETIPEEAQS

SEQ ID NO: 357393 - protein, 9 aa, Homo Sapiens
YIIEMPLLE

SEQ ID NO: 357394 - protein, 9 aa, Homo Sapiens
HMKKCSVSG

SEQ ID NO: 357395 - protein, 9 aa, Homo Sapiens
FETTGESLR

SEQ ID NO: 357396 - protein, 9 aa, Homo Sapiens
PEASRPPTL

SEQ ID NO: 357397 - protein, 9 aa, Homo Sapiens
IKPMDDHLR

SEQ ID NO: 357398 - protein, 9 aa, Homo Sapiens
RQMDSEDVY

SEQ ID NO: 357399 - protein, 9 aa, Homo Sapiens
PNVDYYPDI

SEQ ID NO: 357400 - protein, 9 aa, Homo Sapiens
FLGMHPEEH

SEQ ID NO: 357401 - protein, 9 aa, Homo Sapiens
LINSQGERL

SEQ ID NO: 357402 - protein, 9 aa, Homo Sapiens
GWWVRNMNT

SEQ ID NO: 357403 - protein, 9 aa, Homo Sapiens
NPNNGEFWF

SEQ ID NO: 357404 - protein, 9 aa, Homo Sapiens
SNPAFWWTN

SEQ ID NO: 357405 - protein, 9 aa, Homo Sapiens
EQCLKCLKN

SEQ ID NO: 357406 - protein, 9 aa, Homo Sapiens
VDIQMVKGV

SEQ ID NO: 357407 - protein, 9 aa, Homo Sapiens
INVYKPDWC

SEQ ID NO: 357408 - protein, 9 aa, Homo Sapiens
GQLIFYAHP

SEQ ID NO: 357409 - protein, 9 aa, Homo Sapiens
AEALTPLIK

SEQ ID NO: 357410 - protein, 9 aa, Homo Sapiens
AASKESKPK

SEQ ID NO: 357411 - protein, 9 aa, Homo Sapiens
RWNQLQEDL

SEQ ID NO: 357412 - protein, 9 aa, Homo Sapiens
ATQRIQEIV

SEQ ID NO: 357413 - protein, 9 aa, Homo Sapiens
QTKNRMWRN

SEQ ID NO: 357414 - protein, 9 aa, Homo Sapiens
TTQLWHGDQ

SEQ ID NO: 357415 - protein, 9 aa, Homo Sapiens
QAHTLTVLF

SEQ ID NO: 357416 - protein, 9 aa, Homo Sapiens
EEILEICIH

SEQ ID NO: 357417 - protein, 9 aa, Homo Sapiens
SSSEIIRGK

SEQ ID NO: 357418 - protein, 9 aa, Homo Sapiens
NETKRNQLF

SEQ ID NO: 357419 - protein, 9 aa, Homo Sapiens
SEEEESLVR

SEQ ID NO: 357420 - protein, 9 aa, Homo Sapiens
MQKERRRIQ

SEQ ID NO: 357421 - protein, 9 aa, Homo Sapiens
LHIYVCLNE

SEQ ID NO: 357422 - protein, 9 aa, Homo Sapiens
PSHKTTRSG

SEQ ID NO: 357423 - protein, 9 aa, Homo Sapiens
CQPTCGRSS

SEQ ID NO: 357424 - protein, 9 aa, Homo Sapiens
VPAWVSSSV

SEQ ID NO: 357425 - protein, 9 aa, Homo Sapiens
TQKIVTERS

SEQ ID NO: 357426 - protein, 9 aa, Homo Sapiens
LKYLTMQVL

SEQ ID NO: 357427 - protein, 9 aa, Homo Sapiens
CGHSSGPMV

SEQ ID NO: 357428 - protein, 9 aa, Homo Sapiens
GYKQWKEYM

SEQ ID NO: 357429 - protein, 9 aa, Homo Sapiens
FTLIVTDAN

SEQ ID NO: 357430 - protein, 9 aa, Homo Sapiens
IHFGDNIKL

SEQ ID NO: 357431 - protein, 9 aa, Homo Sapiens
AIADKLDLK

SEQ ID NO: 357432 - protein, 9 aa, Homo Sapiens
RKQRRQPSQ

SEQ ID NO: 357433 - protein, 9 aa, Homo Sapiens
QVKNEVLRE

SEQ ID NO: 357434 - protein, 9 aa, Homo Sapiens
NIWVYDEEA

SEQ ID NO: 357435 - protein, 9 aa, Homo Sapiens
QPLKQQIQK

SEQ ID NO: 357436 - protein, 9 aa, Homo Sapiens
QEPIKTFYR

SEQ ID NO: 357437 - protein, 9 aa, Homo Sapiens
LGMHPEEHF

SEQ ID NO: 357438 - protein, 9 aa, Homo Sapiens
YFSAALNNF

SEQ ID NO: 357439 - protein, 9 aa, Homo Sapiens
KFMERNPDE

SEQ ID NO: 357440 - protein, 9 aa, Homo Sapiens
QLANNNLLA

SEQ ID NO: 357441 - protein, 9 aa, Homo Sapiens
EMALIPEAE

SEQ ID NO: 357442 - protein, 9 aa, Homo Sapiens
QTCVMWDDL

SEQ ID NO: 357443 - protein, 9 aa, Homo Sapiens
PVVCAPSSF

SEQ ID NO: 357444 - protein, 9 aa, Homo Sapiens
ETQGYLCPS

SEQ ID NO: 357445 - protein, 9 aa, Homo Sapiens
LSENVQNNT

SEQ ID NO: 357446 - protein, 9 aa, Homo Sapiens
LLNNEMMKA

SEQ ID NO: 357447 - protein, 9 aa, Homo Sapiens
EQETWCETG

SEQ ID NO: 357448 - protein, 9 aa, Homo Sapiens
FPLSFLIKR

SEQ ID NO: 357449 - protein, 9 aa, Homo Sapiens
RQPHVVSQW

SEQ ID NO: 357450 - protein, 9 aa, Homo Sapiens
SPYKKKKNN

SEQ ID NO: 357451 - protein, 9 aa, Homo Sapiens
YELSVFCDC

SEQ ID NO: 357452 - protein, 9 aa, Homo Sapiens
ELMPRKAIS

SEQ ID NO: 357453 - protein, 9 aa, Homo Sapiens
GGTNSCISP

SEQ ID NO: 357454 - protein, 9 aa, Homo Sapiens
APPCTQCIK

SEQ ID NO: 357455 - protein, 9 aa, Homo Sapiens
QGKSMSQPR

SEQ ID NO: 357456 - protein, 9 aa, Homo Sapiens
TKCYPQENV

SEQ ID NO: 357457 - protein, 9 aa, Homo Sapiens
TASPLWTSF

SEQ ID NO: 357458 - protein, 9 aa, Homo Sapiens
TLDKVHIIL

SEQ ID NO: 357459 - protein, 9 aa, Homo Sapiens
SFSFKGIQF

SEQ ID NO: 357460 - protein, 9 aa, Homo Sapiens
SVYPRHFGP

SEQ ID NO: 357461 - protein, 9 aa, Homo Sapiens
EIYTVGAKV

SEQ ID NO: 357462 - protein, 9 aa, Homo Sapiens
MAATYSTLN

SEQ ID NO: 357463 - protein, 9 aa, Homo Sapiens
EANKFWHHF

SEQ ID NO: 357464 - protein, 9 aa, Homo Sapiens
QKPASSEPT

SEQ ID NO: 357465 - protein, 9 aa, Homo Sapiens
WRGRPRGRM

SEQ ID NO: 357466 - protein, 9 aa, Homo Sapiens
VAEPKKSFV

SEQ ID NO: 357467 - protein, 9 aa, Homo Sapiens
FYSSMLFIT

SEQ ID NO: 357468 - protein, 9 aa, Homo Sapiens
LRFNWRGLV

SEQ ID NO: 357469 - protein, 9 aa, Homo Sapiens
KNMPFQDDQ

SEQ ID NO: 357470 - protein, 9 aa, Homo Sapiens
TTHIIVVSI

SEQ ID NO: 357471 - protein, 9 aa, Homo Sapiens
NSTGEARTE

SEQ ID NO: 357472 - protein, 9 aa, Homo Sapiens
CCIAVHPTQ

SEQ ID NO: 357473 - protein, 9 aa, Homo Sapiens
PDIFLGFLK

SEQ ID NO: 357474 - protein, 9 aa, Homo Sapiens
GPCTCDREH

SEQ ID NO: 357475 - protein, 9 aa, Homo Sapiens
LRNSKSKLL

SEQ ID NO: 357476 - protein, 9 aa, Homo Sapiens
IEKGVSKGY

SEQ ID NO: 357477 - protein, 9 aa, Homo Sapiens
QMVVHDIRN

SEQ ID NO: 357478 - protein, 9 aa, Homo Sapiens
LVAVFQYGH

SEQ ID NO: 357479 - protein, 9 aa, Homo Sapiens
YAFNRKDKL

SEQ ID NO: 357480 - protein, 9 aa, Homo Sapiens
FDKNEIQNA

SEQ ID NO: 357481 - protein, 9 aa, Homo Sapiens
GVINTDMFQ

SEQ ID NO: 357482 - protein, 9 aa, Homo Sapiens
GKACNRISH

SEQ ID NO: 357483 - protein, 9 aa, Homo Sapiens
VSSGLSLVS

SEQ ID NO: 357484 - protein, 9 aa, Homo Sapiens
LMEMDQHIE

SEQ ID NO: 357485 - protein, 9 aa, Homo Sapiens
MALIPEAEL

SEQ ID NO: 357486 - protein, 9 aa, Homo Sapiens
WKDRQKSYT

SEQ ID NO: 357487 - protein, 9 aa, Homo Sapiens
GWCKALPTC

SEQ ID NO: 357488 - protein, 9 aa, Homo Sapiens
EWLPAEDMP

SEQ ID NO: 357489 - protein, 9 aa, Homo Sapiens
LHLSNGVAI

SEQ ID NO: 357490 - protein, 9 aa, Homo Sapiens
KETTYQRDY

SEQ ID NO: 357491 - protein, 9 aa, Homo Sapiens
PSTMETEEE

SEQ ID NO: 357492 - protein, 9 aa, Homo Sapiens
CRFCYVKTA

SEQ ID NO: 357493 - protein, 9 aa, Homo Sapiens
KGVSKGYVF

SEQ ID NO: 357494 - protein, 9 aa, Homo Sapiens
ATCHSLLNT

SEQ ID NO: 357495 - protein, 9 aa, Homo Sapiens
IEYLEKQCL

SEQ ID NO: 357496 - protein, 9 aa, Homo Sapiens
LFVFPVYQG

SEQ ID NO: 357497 - protein, 9 aa, Homo Sapiens
HLHNLTLLT

SEQ ID NO: 357498 - protein, 9 aa, Homo Sapiens
GGSLNLISN

SEQ ID NO: 357499 - protein, 9 aa, Homo Sapiens
CMAGGLIYS

SEQ ID NO: 357500 - protein, 9 aa, Homo Sapiens
TVCMAAIKE

SEQ ID NO: 357501 - protein, 9 aa, Homo Sapiens
ALPTCGSHF

SEQ ID NO: 357502 - protein, 9 aa, Homo Sapiens
MDRSRRITN

SEQ ID NO: 357503 - protein, 9 aa, Homo Sapiens
NHRNAVIVA

SEQ ID NO: 357504 - protein, 9 aa, Homo Sapiens
AFDWICKER

SEQ ID NO: 357505 - protein, 9 aa, Homo Sapiens
EYKGGYVIK

SEQ ID NO: 357506 - protein, 9 aa, Homo Sapiens
SSSALQSHE

SEQ ID NO: 357507 - protein, 9 aa, Homo Sapiens
YLLMAVING

SEQ ID NO: 357508 - protein, 9 aa, Homo Sapiens
FKSFVEKLN

SEQ ID NO: 357509 - protein, 9 aa, Homo Sapiens
FQSYEAPRG

SEQ ID NO: 357510 - protein, 9 aa, Homo Sapiens
PIPNSPLAL

SEQ ID NO: 357511 - protein, 9 aa, Homo Sapiens
KVVIETGAA

SEQ ID NO: 357512 - protein, 9 aa, Homo Sapiens
AFLINGYTL

SEQ ID NO: 357513 - protein, 9 aa, Homo Sapiens
TTLLLHPDS

SEQ ID NO: 357514 - protein, 9 aa, Homo Sapiens
SSLQKHVKT

SEQ ID NO: 357515 - protein, 9 aa, Homo Sapiens
NVQQYHRAL

SEQ ID NO: 357516 - protein, 9 aa, Homo Sapiens
ENAILDLTH

SEQ ID NO: 357517 - protein, 9 aa, Homo Sapiens
VQELNQILF

SEQ ID NO: 357518 - protein, 9 aa, Homo Sapiens
HLAVLEKHV

SEQ ID NO: 357519 - protein, 9 aa, Homo Sapiens
EQVVPIQDH

SEQ ID NO: 357520 - protein, 9 aa, Homo Sapiens
LRVLNISYN

SEQ ID NO: 357521 - protein, 9 aa, Homo Sapiens
HFGDNIKLK

SEQ ID NO: 357522 - protein, 9 aa, Homo Sapiens
YLLGQSLAE

SEQ ID NO: 357523 - protein, 9 aa, Homo Sapiens
YNVTITATG

SEQ ID NO: 357524 - protein, 9 aa, Homo Sapiens
VPPGSVGIS

SEQ ID NO: 357525 - protein, 9 aa, Homo Sapiens
TETSQANLS

SEQ ID NO: 357526 - protein, 9 aa, Homo Sapiens
GKCGIDGVD

SEQ ID NO: 357527 - protein, 9 aa, Homo Sapiens
PPFPSPADI

SEQ ID NO: 357528 - protein, 9 aa, Homo Sapiens
NEWKRMCSR

SEQ ID NO: 357529 - protein, 9 aa, Homo Sapiens
SWLDEEEEL

SEQ ID NO: 357530 - protein, 9 aa, Homo Sapiens
VDMDDKDNA

SEQ ID NO: 357531 - protein, 9 aa, Homo Sapiens
HVKINQGTL

SEQ ID NO: 357532 - protein, 9 aa, Homo Sapiens
LKEEAQLIE

SEQ ID NO: 357533 - protein, 9 aa, Homo Sapiens
FQMTGSTLK

SEQ ID NO: 357534 - protein, 9 aa, Homo Sapiens
DRVLGLHRS

SEQ ID NO: 357535 - protein, 9 aa, Homo Sapiens
DAIVIFCGY

SEQ ID NO: 357536 - protein, 9 aa, Homo Sapiens
TLMDLLKKI

SEQ ID NO: 357537 - protein, 9 aa, Homo Sapiens
LISIFCFAA

SEQ ID NO: 357538 - protein, 9 aa, Homo Sapiens
TKTKDKLTP

SEQ ID NO: 357539 - protein, 9 aa, Homo Sapiens
LWLVYLWVS

SEQ ID NO: 357540 - protein, 9 aa, Homo Sapiens
NLVTDSNHS

SEQ ID NO: 357541 - protein, 9 aa, Homo Sapiens
SGIAASVNA

SEQ ID NO: 357542 - protein, 9 aa, Homo Sapiens
KTGCETVDV

SEQ ID NO: 357543 - protein, 9 aa, Homo Sapiens
ACCIVLFVS

SEQ ID NO: 357544 - protein, 9 aa, Homo Sapiens
ELIYAALTS

SEQ ID NO: 357545 - protein, 9 aa, Homo Sapiens
ATAQANVYV

SEQ ID NO: 357546 - protein, 9 aa, Homo Sapiens
YKELEGTNV

SEQ ID NO: 357547 - protein, 9 aa, Homo Sapiens
SNGYANISE

SEQ ID NO: 357548 - protein, 9 aa, Homo Sapiens
NAHYAVQAR

SEQ ID NO: 357549 - protein, 9 aa, Homo Sapiens
KRELLESYI

SEQ ID NO: 357550 - protein, 9 aa, Homo Sapiens
PAGHGSTYC

SEQ ID NO: 357551 - protein, 9 aa, Homo Sapiens
KEHLNHNPY

SEQ ID NO: 357552 - protein, 9 aa, Homo Sapiens
VNNSSLISP

SEQ ID NO: 357553 - protein, 9 aa, Homo Sapiens
TTEDREMRN

SEQ ID NO: 357554 - protein, 9 aa, Homo Sapiens
GFNKGLDRI

SEQ ID NO: 357555 - protein, 9 aa, Homo Sapiens
TLGTKTESS

SEQ ID NO: 357556 - protein, 9 aa, Homo Sapiens
GIKKGVCVC

SEQ ID NO: 357557 - protein, 9 aa, Homo Sapiens
RLHLPEMVG

SEQ ID NO: 357558 - protein, 9 aa, Homo Sapiens
VSIIFIPCI

SEQ ID NO: 357559 - protein, 9 aa, Homo Sapiens
AEIGTSSDK

SEQ ID NO: 357560 - protein, 9 aa, Homo Sapiens
ENNCAKFTL

SEQ ID NO: 357561 - protein, 9 aa, Homo Sapiens
EHSSHKLYS

SEQ ID NO: 357562 - protein, 9 aa, Homo Sapiens
TIPRPFSVC

SEQ ID NO: 357563 - protein, 9 aa, Homo Sapiens
DKHSDSDYR

SEQ ID NO: 357564 - protein, 9 aa, Homo Sapiens
YSMPVPYRR

SEQ ID NO: 357565 - protein, 9 aa, Homo Sapiens
GEKLFKCNE

SEQ ID NO: 357566 - protein, 9 aa, Homo Sapiens
MALKVEGLV

SEQ ID NO: 357567 - protein, 9 aa, Homo Sapiens
GAGFRGLSE

SEQ ID NO: 357568 - protein, 9 aa, Homo Sapiens
QRKEEDYQN

SEQ ID NO: 357569 - protein, 9 aa, Homo Sapiens
QVLSWRTNF

SEQ ID NO: 357570 - protein, 9 aa, Homo Sapiens
HSRTAYTRQ

SEQ ID NO: 357571 - protein, 9 aa, Homo Sapiens
DKPFQCNEC

SEQ ID NO: 357572 - protein, 9 aa, Homo Sapiens
DKKQVAGLL

SEQ ID NO: 357573 - protein, 9 aa, Homo Sapiens
VCLLPLLLP

SEQ ID NO: 357574 - protein, 9 aa, Homo Sapiens
RKLDDSQKD

SEQ ID NO: 357575 - protein, 9 aa, Homo Sapiens
IKSIPSYAF

SEQ ID NO: 357576 - protein, 9 aa, Homo Sapiens
RDRAKERRA

SEQ ID NO: 357577 - protein, 9 aa, Homo Sapiens
HYDDFFEQT

SEQ ID NO: 357578 - protein, 9 aa, Homo Sapiens
CFHHCNPGI

SEQ ID NO: 357579 - protein, 9 aa, Homo Sapiens
HKFLKVESP

SEQ ID NO: 357580 - protein, 9 aa, Homo Sapiens
WLPEDKVEE

SEQ ID NO: 357581 - protein, 9 aa, Homo Sapiens
DTELICYVT

SEQ ID NO: 357582 - protein, 9 aa, Homo Sapiens
QLLASDLQR

SEQ ID NO: 357583 - protein, 9 aa, Homo Sapiens
HRGYIGVVN

SEQ ID NO: 357584 - protein, 9 aa, Homo Sapiens
KYGDSPRGI

SEQ ID NO: 357585 - protein, 9 aa, Homo Sapiens
EPGAVKLSR

SEQ ID NO: 357586 - protein, 9 aa, Homo Sapiens
TLPFVPGKT

SEQ ID NO: 357587 - protein, 9 aa, Homo Sapiens
NNKEGGNDN

SEQ ID NO: 357588 - protein, 9 aa, Homo Sapiens
PKVKELVRI

SEQ ID NO: 357589 - protein, 9 aa, Homo Sapiens
ASIMLNIME

SEQ ID NO: 357590 - protein, 9 aa, Homo Sapiens
AMRAAQSLG

SEQ ID NO: 357591 - protein, 9 aa, Homo Sapiens
RERVAGSAE

SEQ ID NO: 357592 - protein, 9 aa, Homo Sapiens
DRQKSYTSD

SEQ ID NO: 357593 - protein, 9 aa, Homo Sapiens
IVHSLLTGT

SEQ ID NO: 357594 - protein, 9 aa, Homo Sapiens
LSFVISGFT

SEQ ID NO: 357595 - protein, 9 aa, Homo Sapiens
CDKVLSRKS

SEQ ID NO: 357596 - protein, 9 aa, Homo Sapiens
MKLWHCLLM

SEQ ID NO: 357597 - protein, 9 aa, Homo Sapiens
PQQDGGGGP

SEQ ID NO: 357598 - protein, 9 aa, Homo Sapiens
IPWLSETSL

SEQ ID NO: 357599 - protein, 9 aa, Homo Sapiens
QHREKLRRN

SEQ ID NO: 357600 - protein, 9 aa, Homo Sapiens
RNMFDLVME

SEQ ID NO: 357601 - protein, 9 aa, Homo Sapiens
LALQHRLVV

SEQ ID NO: 357602 - protein, 9 aa, Homo Sapiens
KLYHTFSAM

SEQ ID NO: 357603 - protein, 9 aa, Homo Sapiens
RLVLNFQPQ

SEQ ID NO: 357604 - protein, 9 aa, Homo Sapiens
QDINNNPPT

SEQ ID NO: 357605 - protein, 9 aa, Homo Sapiens
QSGRGQRIA

SEQ ID NO: 357606 - protein, 9 aa, Homo Sapiens
EQVNIPLSV

SEQ ID NO: 357607 - protein, 9 aa, Homo Sapiens
LVLKAVSSS

SEQ ID NO: 357608 - protein, 9 aa, Homo Sapiens
KTYLQAVGM

SEQ ID NO: 357609 - protein, 9 aa, Homo Sapiens
KSEQILKVA

SEQ ID NO: 357610 - protein, 9 aa, Homo Sapiens
RENAELESH

SEQ ID NO: 357611 - protein, 9 aa, Homo Sapiens
IICILVAHK

SEQ ID NO: 357612 - protein, 9 aa, Homo Sapiens
SNKLFGSVI

SEQ ID NO: 357613 - protein, 9 aa, Homo Sapiens
MKPQADVAF

SEQ ID NO: 357614 - protein, 9 aa, Homo Sapiens
FFWQAHTLT

SEQ ID NO: 357615 - protein, 9 aa, Homo Sapiens
DRSSAQHLD

SEQ ID NO: 357616 - protein, 9 aa, Homo Sapiens
EKNNMKALA

SEQ ID NO: 357617 - protein, 9 aa, Homo Sapiens
LSSVAICTI

SEQ ID NO: 357618 - protein, 9 aa, Homo Sapiens
KNPKLKIIL

SEQ ID NO: 357619 - protein, 9 aa, Homo Sapiens
QIDGNVMRK

SEQ ID NO: 357620 - protein, 9 aa, Homo Sapiens
DASIHQLEG

SEQ ID NO: 357621 - protein, 9 aa, Homo Sapiens
VLIYLGFEH

SEQ ID NO: 357622 - protein, 9 aa, Homo Sapiens
DNLKLVHIV

SEQ ID NO: 357623 - protein, 9 aa, Homo Sapiens
RTFMKILGK

SEQ ID NO: 357624 - protein, 9 aa, Homo Sapiens
NTACRKHEL

SEQ ID NO: 357625 - protein, 9 aa, Homo Sapiens
RYICVVHAR

SEQ ID NO: 357626 - protein, 9 aa, Homo Sapiens
GLDYCPYEI

SEQ ID NO: 357627 - protein, 9 aa, Homo Sapiens
LCSLIRMLV

SEQ ID NO: 357628 - protein, 9 aa, Homo Sapiens
ETVLANFSS

SEQ ID NO: 357629 - protein, 9 aa, Homo Sapiens
IVPVILMGC

SEQ ID NO: 357630 - protein, 9 aa, Homo Sapiens
SQEYDGNIR

SEQ ID NO: 357631 - protein, 9 aa, Homo Sapiens
DISLDKITP

SEQ ID NO: 357632 - protein, 9 aa, Homo Sapiens
APPLFNTSK

SEQ ID NO: 357633 - protein, 9 aa, Homo Sapiens
RWMTARRRV

SEQ ID NO: 357634 - protein, 9 aa, Homo Sapiens
EKLLKEDKN

SEQ ID NO: 357635 - protein, 9 aa, Homo Sapiens
GGSDKADLG

SEQ ID NO: 357636 - protein, 9 aa, Homo Sapiens
NGATVINED

SEQ ID NO: 357637 - protein, 9 aa, Homo Sapiens
AYDNSRVRL

SEQ ID NO: 357638 - protein, 9 aa, Homo Sapiens
YLIEEELKK

SEQ ID NO: 357639 - protein, 9 aa, Homo Sapiens
SAGIIGPRQ

SEQ ID NO: 357640 - protein, 9 aa, Homo Sapiens
VDDFASFQH

SEQ ID NO: 357641 - protein, 9 aa, Homo Sapiens
FSFKGIQFS

SEQ ID NO: 357642 - protein, 9 aa, Homo Sapiens
QIPIKLISK

SEQ ID NO: 357643 - protein, 9 aa, Homo Sapiens
PSTDSALKP

SEQ ID NO: 357644 - protein, 9 aa, Homo Sapiens
SKWTNNYSM

SEQ ID NO: 357645 - protein, 9 aa, Homo Sapiens
EGRLAGQRV

SEQ ID NO: 357646 - protein, 9 aa, Homo Sapiens
KTTNDATGP

SEQ ID NO: 357647 - protein, 9 aa, Homo Sapiens
WGIEDMLER

SEQ ID NO: 357648 - protein, 9 aa, Homo Sapiens
KSERYELIV

SEQ ID NO: 357649 - protein, 9 aa, Homo Sapiens
VTKNWTSYM

SEQ ID NO: 357650 - protein, 9 aa, Homo Sapiens
REQPCGKRF

SEQ ID NO: 357651 - protein, 9 aa, Homo Sapiens
SLFHVCCIS

SEQ ID NO: 357652 - protein, 9 aa, Homo Sapiens
WHDKDNDTS

SEQ ID NO: 357653 - protein, 9 aa, Homo Sapiens
GQFRRTEQF

SEQ ID NO: 357654 - protein, 9 aa, Homo Sapiens
HTFLKTEFS

SEQ ID NO: 357655 - protein, 9 aa, Homo Sapiens
CVKPLGLEN

SEQ ID NO: 357656 - protein, 9 aa, Homo Sapiens
KYIQIHGRT

SEQ ID NO: 357657 - protein, 9 aa, Homo Sapiens
LKLATLLLC

SEQ ID NO: 357658 - protein, 9 aa, Homo Sapiens
GVTALFCKV

SEQ ID NO: 357659 - protein, 9 aa, Homo Sapiens
RIHIFSYFF

SEQ ID NO: 357660 - protein, 9 aa, Homo Sapiens
GKNVPKYQC

SEQ ID NO: 357661 - protein, 9 aa, Homo Sapiens
SMMKLKGAV

SEQ ID NO: 357662 - protein, 9 aa, Homo Sapiens
IQNHTGEKH

SEQ ID NO: 357663 - protein, 9 aa, Homo Sapiens
FVVLGGDNV

SEQ ID NO: 357664 - protein, 9 aa, Homo Sapiens
DNKALYDIC

SEQ ID NO: 357665 - protein, 9 aa, Homo Sapiens
LEAYICVFS

SEQ ID NO: 357666 - protein, 9 aa, Homo Sapiens
AFNTELQPV

SEQ ID NO: 357667 - protein, 9 aa, Homo Sapiens
TLIVTDANE

SEQ ID NO: 357668 - protein, 9 aa, Homo Sapiens
QDHGDMTNR

SEQ ID NO: 357669 - protein, 9 aa, Homo Sapiens
RRRAATCLQ

SEQ ID NO: 357670 - protein, 9 aa, Homo Sapiens
IMKHFGWEA

SEQ ID NO: 357671 - protein, 9 aa, Homo Sapiens
EQSVAQVIQ

SEQ ID NO: 357672 - protein, 9 aa, Homo Sapiens
IIIVHSLLT

SEQ ID NO: 357673 - protein, 9 aa, Homo Sapiens
LLVALAMAL

SEQ ID NO: 357674 - protein, 9 aa, Homo Sapiens
FGLTVTLSV

SEQ ID NO: 357675 - protein, 9 aa, Homo Sapiens
SIGCVAPQC

SEQ ID NO: 357676 - protein, 9 aa, Homo Sapiens
DIDGINTNM

SEQ ID NO: 357677 - protein, 9 aa, Homo Sapiens
LQKERLMNY

SEQ ID NO: 357678 - protein, 9 aa, Homo Sapiens
LSMNNNIIN

SEQ ID NO: 357679 - protein, 9 aa, Homo Sapiens
LSWRTNFDE

SEQ ID NO: 357680 - protein, 9 aa, Homo Sapiens
IYPDKRFAQ

SEQ ID NO: 357681 - protein, 9 aa, Homo Sapiens
LNYSIQYVL

SEQ ID NO: 357682 - protein, 9 aa, Homo Sapiens
KVNNLVKEW

SEQ ID NO: 357683 - protein, 9 aa, Homo Sapiens
YKFFCDVSS

SEQ ID NO: 357684 - protein, 9 aa, Homo Sapiens
LELGWLCPQ

SEQ ID NO: 357685 - protein, 9 aa, Homo Sapiens
ALADNFYAI

SEQ ID NO: 357686 - protein, 9 aa, Homo Sapiens
LQPLLFQNP

SEQ ID NO: 357687 - protein, 9 aa, Homo Sapiens
KSAAKRLKL

SEQ ID NO: 357688 - protein, 9 aa, Homo Sapiens
SVIRQLLLD

SEQ ID NO: 357689 - protein, 9 aa, Homo Sapiens
SPTKSPDYL

SEQ ID NO: 357690 - protein, 9 aa, Homo Sapiens
AVRDVCFNT

SEQ ID NO: 357691 - protein, 9 aa, Homo Sapiens
NSLWLEEFS

SEQ ID NO: 357692 - protein, 9 aa, Homo Sapiens
ICMAGGLIY

SEQ ID NO: 357693 - protein, 9 aa, Homo Sapiens
AFLNSYSTS

SEQ ID NO: 357694 - protein, 9 aa, Homo Sapiens
VNHFQKANC

SEQ ID NO: 357695 - protein, 9 aa, Homo Sapiens
KAAQEFVQR

SEQ ID NO: 357696 - protein, 9 aa, Homo Sapiens
EEKIFAFQR

SEQ ID NO: 357697 - protein, 9 aa, Homo Sapiens
EDVNKQEEN

SEQ ID NO: 357698 - protein, 9 aa, Homo Sapiens
LQNGMIIPS

SEQ ID NO: 357699 - protein, 9 aa, Homo Sapiens
ICSCGLDYC

SEQ ID NO: 357700 - protein, 9 aa, Homo Sapiens
QNAASVMCI

SEQ ID NO: 357701 - protein, 9 aa, Homo Sapiens
KQKEEHQFF

SEQ ID NO: 357702 - protein, 9 aa, Homo Sapiens
LDEQQHAQR

SEQ ID NO: 357703 - protein, 9 aa, Homo Sapiens
FQFQDVTRA

SEQ ID NO: 357704 - protein, 9 aa, Homo Sapiens
AKLKDKLFN

SEQ ID NO: 357705 - protein, 9 aa, Homo Sapiens
QIGFINFIV

SEQ ID NO: 357706 - protein, 9 aa, Homo Sapiens
ETIQRINEN

SEQ ID NO: 357707 - protein, 9 aa, Homo Sapiens
EILGVVATP

SEQ ID NO: 357708 - protein, 9 aa, Homo Sapiens
SVFVAEPKK

SEQ ID NO: 357709 - protein, 9 aa, Homo Sapiens
RTATSGPSS

SEQ ID NO: 357710 - protein, 9 aa, Homo Sapiens
KLAHLAGLL

SEQ ID NO: 357711 - protein, 9 aa, Homo Sapiens
DEKLDLNED

SEQ ID NO: 357712 - protein, 9 aa, Homo Sapiens
SSLFPDFGL

SEQ ID NO: 357713 - protein, 9 aa, Homo Sapiens
GGESLQLLA

SEQ ID NO: 357714 - protein, 9 aa, Homo Sapiens
EICKFVHFL

SEQ ID NO: 357715 - protein, 9 aa, Homo Sapiens
HIVCLEPDD

SEQ ID NO: 357716 - protein, 9 aa, Homo Sapiens
PWAGGVFLV

SEQ ID NO: 357717 - protein, 9 aa, Homo Sapiens
ESGPHDVHT

SEQ ID NO: 357718 - protein, 9 aa, Homo Sapiens
QSMIDQSNR

SEQ ID NO: 357719 - protein, 9 aa, Homo Sapiens
PMEKNVVFA

SEQ ID NO: 357720 - protein, 9 aa, Homo Sapiens
RLVVLFGDL

SEQ ID NO: 357721 - protein, 9 aa, Homo Sapiens
NMMTCYLFH

SEQ ID NO: 357722 - protein, 9 aa, Homo Sapiens
AAGVYVAFG

SEQ ID NO: 357723 - protein, 9 aa, Homo Sapiens
LLGYLAMVI

SEQ ID NO: 357724 - protein, 9 aa, Homo Sapiens
LSLIPAWTF

SEQ ID NO: 357725 - protein, 9 aa, Homo Sapiens
QCGKPKGPR

SEQ ID NO: 357726 - protein, 9 aa, Homo Sapiens
FYGLSCQGP

SEQ ID NO: 357727 - protein, 9 aa, Homo Sapiens
RQDAHLLMT

SEQ ID NO: 357728 - protein, 9 aa, Homo Sapiens
SQFKEHQQI

SEQ ID NO: 357729 - protein, 9 aa, Homo Sapiens
RGEQVNIPL

SEQ ID NO: 357730 - protein, 9 aa, Homo Sapiens
QNQGLPLRQ

SEQ ID NO: 357731 - protein, 9 aa, Homo Sapiens
LQDLQQKYI

SEQ ID NO: 357732 - protein, 9 aa, Homo Sapiens
LLSITVRHA

SEQ ID NO: 357733 - protein, 9 aa, Homo Sapiens
QTLDTPNTT

SEQ ID NO: 357734 - protein, 9 aa, Homo Sapiens
PLCPKDVVY

SEQ ID NO: 357735 - protein, 9 aa, Homo Sapiens
VPQTIQDQA

SEQ ID NO: 357736 - protein, 9 aa, Homo Sapiens
DIFPGLHKI

SEQ ID NO: 357737 - protein, 9 aa, Homo Sapiens
ADFVYKRIV

SEQ ID NO: 357738 - protein, 9 aa, Homo Sapiens
PGVFVGVSQ

SEQ ID NO: 357739 - protein, 9 aa, Homo Sapiens
QIGILIGIS

SEQ ID NO: 357740 - protein, 9 aa, Homo Sapiens
PKITGSSPG

SEQ ID NO: 357741 - protein, 9 aa, Homo Sapiens
QIHSKDGLL

SEQ ID NO: 357742 - protein, 9 aa, Homo Sapiens
PSVTDLLNC

SEQ ID NO: 357743 - protein, 9 aa, Homo Sapiens
RLLAPGVDT

SEQ ID NO: 357744 - protein, 9 aa, Homo Sapiens
DQDKHSDSD

SEQ ID NO: 357745 - protein, 9 aa, Homo Sapiens
FKRFTPRKG

SEQ ID NO: 357746 - protein, 9 aa, Homo Sapiens
GYSNVRGKQ

SEQ ID NO: 357747 - protein, 9 aa, Homo Sapiens
VSHHPQPYR

SEQ ID NO: 357748 - protein, 9 aa, Homo Sapiens
ALVVEICAC

SEQ ID NO: 357749 - protein, 9 aa, Homo Sapiens
VLLEIEDLK

SEQ ID NO: 357750 - protein, 9 aa, Homo Sapiens
MLTSPPGLW

SEQ ID NO: 357751 - protein, 9 aa, Homo Sapiens
AAPIFIKLL

SEQ ID NO: 357752 - protein, 9 aa, Homo Sapiens
REQWLQKIK

SEQ ID NO: 357753 - protein, 9 aa, Homo Sapiens
KKVRKGKKR

SEQ ID NO: 357754 - protein, 9 aa, Homo Sapiens
LLEQKLSQA

SEQ ID NO: 357755 - protein, 9 aa, Homo Sapiens
RRKRRNLKT

SEQ ID NO: 357756 - protein, 9 aa, Homo Sapiens
VLLQDVKNV

SEQ ID NO: 357757 - protein, 9 aa, Homo Sapiens
GKEHIDNIN

SEQ ID NO: 357758 - protein, 9 aa, Homo Sapiens
ILKPKEQIL

SEQ ID NO: 357759 - protein, 9 aa, Homo Sapiens
PQIKKDEKQ

SEQ ID NO: 357760 - protein, 9 aa, Homo Sapiens
RSHVRTRGT

SEQ ID NO: 357761 - protein, 9 aa, Homo Sapiens
DDMAHLPFL

SEQ ID NO: 357762 - protein, 9 aa, Homo Sapiens
YPGEVKGKD

SEQ ID NO: 357763 - protein, 9 aa, Homo Sapiens
AAVFTNDID

SEQ ID NO: 357764 - protein, 9 aa, Homo Sapiens
KQAHKLAKS

SEQ ID NO: 357765 - protein, 9 aa, Homo Sapiens
FGAHKYCQV

SEQ ID NO: 357766 - protein, 9 aa, Homo Sapiens
QYMARGEKY

SEQ ID NO: 357767 - protein, 9 aa, Homo Sapiens
IEEELKKQL

SEQ ID NO: 357768 - protein, 9 aa, Homo Sapiens
QLFSGLEIV

SEQ ID NO: 357769 - protein, 9 aa, Homo Sapiens
EGLKCIERN

SEQ ID NO: 357770 - protein, 9 aa, Homo Sapiens
RFVIIHKHC

SEQ ID NO: 357771 - protein, 9 aa, Homo Sapiens
LQYPALAPW

SEQ ID NO: 357772 - protein, 9 aa, Homo Sapiens
KDNDTSSDP

SEQ ID NO: 357773 - protein, 9 aa, Homo Sapiens
THCSQNAYM

SEQ ID NO: 357774 - protein, 9 aa, Homo Sapiens
QKLAQLEEV

SEQ ID NO: 357775 - protein, 9 aa, Homo Sapiens
CFPYVLLQN

SEQ ID NO: 357776 - protein, 9 aa, Homo Sapiens
TTFCFDLFQ

SEQ ID NO: 357777 - protein, 9 aa, Homo Sapiens
KDFCQNITT

SEQ ID NO: 357778 - protein, 9 aa, Homo Sapiens
TERSNISAY

SEQ ID NO: 357779 - protein, 9 aa, Homo Sapiens
TPICDPTVH

SEQ ID NO: 357780 - protein, 9 aa, Homo Sapiens
FDVFISPES

SEQ ID NO: 357781 - protein, 9 aa, Homo Sapiens
ETHFTGNKV

SEQ ID NO: 357782 - protein, 9 aa, Homo Sapiens
SRSGSIKRS

SEQ ID NO: 357783 - protein, 9 aa, Homo Sapiens
IHNCLPNFI

SEQ ID NO: 357784 - protein, 9 aa, Homo Sapiens
TLFDVLEML

SEQ ID NO: 357785 - protein, 9 aa, Homo Sapiens
RALLNTHVT

SEQ ID NO: 357786 - protein, 9 aa, Homo Sapiens
CSKCGNSFR

SEQ ID NO: 357787 - protein, 9 aa, Homo Sapiens
TPCVCILMS

SEQ ID NO: 357788 - protein, 9 aa, Homo Sapiens
CRQAFIQKT

SEQ ID NO: 357789 - protein, 9 aa, Homo Sapiens
PGVLECCLV

SEQ ID NO: 357790 - protein, 9 aa, Homo Sapiens
QQECDEDDH

SEQ ID NO: 357791 - protein, 9 aa, Homo Sapiens
QIKKDEKQN

SEQ ID NO: 357792 - protein, 9 aa, Homo Sapiens
EITHTGEKP

SEQ ID NO: 357793 - protein, 9 aa, Homo Sapiens
ASRPALADN

SEQ ID NO: 357794 - protein, 9 aa, Homo Sapiens
LPRVSLSNT

SEQ ID NO: 357795 - protein, 9 aa, Homo Sapiens
VCQYNAVVG

SEQ ID NO: 357796 - protein, 9 aa, Homo Sapiens
CWHSFENYF

SEQ ID NO: 357797 - protein, 9 aa, Homo Sapiens
DFEESKSYD

SEQ ID NO: 357798 - protein, 9 aa, Homo Sapiens
LGSPVIKSI

SEQ ID NO: 357799 - protein, 9 aa, Homo Sapiens
SNIYSGQVQ

SEQ ID NO: 357800 - protein, 9 aa, Homo Sapiens
RNIQIIVPL

SEQ ID NO: 357801 - protein, 9 aa, Homo Sapiens
ILHSTICKM

SEQ ID NO: 357802 - protein, 9 aa, Homo Sapiens
NMILMTNHL

SEQ ID NO: 357803 - protein, 9 aa, Homo Sapiens
ATSGPSSKL

SEQ ID NO: 357804 - protein, 9 aa, Homo Sapiens
SHSSNNPQD

SEQ ID NO: 357805 - protein, 9 aa, Homo Sapiens
HGQVPSSFY

SEQ ID NO: 357806 - protein, 9 aa, Homo Sapiens
LFAFSFGPN

SEQ ID NO: 357807 - protein, 9 aa, Homo Sapiens
TYLIQDMKA

SEQ ID NO: 357808 - protein, 9 aa, Homo Sapiens
NKFIGSFID

SEQ ID NO: 357809 - protein, 9 aa, Homo Sapiens
RSLSLHNHL

SEQ ID NO: 357810 - protein, 9 aa, Homo Sapiens
QHIQKRLIQ

SEQ ID NO: 357811 - protein, 9 aa, Homo Sapiens
EIEWDDMAH

SEQ ID NO: 357812 - protein, 9 aa, Homo Sapiens
HHKDAGVIC

SEQ ID NO: 357813 - protein, 9 aa, Homo Sapiens
NTSKLLFKK

SEQ ID NO: 357814 - protein, 9 aa, Homo Sapiens
EEEGIPKEA

SEQ ID NO: 357815 - protein, 9 aa, Homo Sapiens
EYPELCSKT

SEQ ID NO: 357816 - protein, 9 aa, Homo Sapiens
KGTCYWIAE

SEQ ID NO: 357817 - protein, 9 aa, Homo Sapiens
GVIDKKKDF

SEQ ID NO: 357818 - protein, 9 aa, Homo Sapiens
NLKVKRGRA

SEQ ID NO: 357819 - protein, 9 aa, Homo Sapiens
PPKHCPVVT

SEQ ID NO: 357820 - protein, 9 aa, Homo Sapiens
CTPEGIQLQ

SEQ ID NO: 357821 - protein, 9 aa, Homo Sapiens
KCKGNEYSL

SEQ ID NO: 357822 - protein, 9 aa, Homo Sapiens
EYGVLYKTL

SEQ ID NO: 357823 - protein, 9 aa, Homo Sapiens
TFYSGAFQR

SEQ ID NO: 357824 - protein, 9 aa, Homo Sapiens
YAINLESQY

SEQ ID NO: 357825 - protein, 9 aa, Homo Sapiens
QKDLLGYLN

SEQ ID NO: 357826 - protein, 9 aa, Homo Sapiens
PKYLCNAIN

SEQ ID NO: 357827 - protein, 9 aa, Homo Sapiens
AEEDSSGGE

SEQ ID NO: 357828 - protein, 9 aa, Homo Sapiens
YWLGEKLYW

SEQ ID NO: 357829 - protein, 9 aa, Homo Sapiens
ECVQPMKGD

SEQ ID NO: 357830 - protein, 9 aa, Homo Sapiens
RAAKQQRKK

SEQ ID NO: 357831 - protein, 9 aa, Homo Sapiens
LIFYAHPEW

SEQ ID NO: 357832 - protein, 9 aa, Homo Sapiens
IERHPSRWP

SEQ ID NO: 357833 - protein, 9 aa, Homo Sapiens
TVGTAVVHG

SEQ ID NO: 357834 - protein, 9 aa, Homo Sapiens
IYIDAQTES

SEQ ID NO: 357835 - protein, 9 aa, Homo Sapiens
TVVKKLDPG

SEQ ID NO: 357836 - protein, 9 aa, Homo Sapiens
NLLGSIFPM

SEQ ID NO: 357837 - protein, 9 aa, Homo Sapiens
ILWFLRARD

SEQ ID NO: 357838 - protein, 9 aa, Homo Sapiens
FCNYRTALC

SEQ ID NO: 357839 - protein, 9 aa, Homo Sapiens
PHLANLYIF

SEQ ID NO: 357840 - protein, 9 aa, Homo Sapiens
LLNHPKTQQ

SEQ ID NO: 357841 - protein, 9 aa, Homo Sapiens
LSPPQRSQP

SEQ ID NO: 357842 - protein, 9 aa, Homo Sapiens
STILCQLTK

SEQ ID NO: 357843 - protein, 9 aa, Homo Sapiens
KHFIIYLIP

SEQ ID NO: 357844 - protein, 9 aa, Homo Sapiens
GIDTQLLNG

SEQ ID NO: 357845 - protein, 9 aa, Homo Sapiens
LYVQNENSV

SEQ ID NO: 357846 - protein, 9 aa, Homo Sapiens
VWSQVFSLF

SEQ ID NO: 357847 - protein, 9 aa, Homo Sapiens
LLHIIIIFG

SEQ ID NO: 357848 - protein, 9 aa, Homo Sapiens
WLYEQLLQK

SEQ ID NO: 357849 - protein, 9 aa, Homo Sapiens
AKSAAHSSQ

SEQ ID NO: 357850 - protein, 9 aa, Homo Sapiens
RLENNHPLL

SEQ ID NO: 357851 - protein, 9 aa, Homo Sapiens
DIIVEGIDK

SEQ ID NO: 357852 - protein, 9 aa, Homo Sapiens
HVTDEEIEF

SEQ ID NO: 357853 - protein, 9 aa, Homo Sapiens
MGPPSKPPN

SEQ ID NO: 357854 - protein, 9 aa, Homo Sapiens
IVISVQHNK

SEQ ID NO: 357855 - protein, 9 aa, Homo Sapiens
DPDDAARCS

SEQ ID NO: 357856 - protein, 9 aa, Homo Sapiens
CLSVGEQPD

SEQ ID NO: 357857 - protein, 9 aa, Homo Sapiens
DTASLVPGC

SEQ ID NO: 357858 - protein, 9 aa, Homo Sapiens
PPKATEENK

SEQ ID NO: 357859 - protein, 9 aa, Homo Sapiens
RKAERLVKY

SEQ ID NO: 357860 - protein, 9 aa, Homo Sapiens
FLLDVSLKF

SEQ ID NO: 357861 - protein, 9 aa, Homo Sapiens
VVNPYDMPG

SEQ ID NO: 357862 - protein, 9 aa, Homo Sapiens
LFCESQRIL

SEQ ID NO: 357863 - protein, 9 aa, Homo Sapiens
VLHMVDGGG

SEQ ID NO: 357864 - protein, 9 aa, Homo Sapiens
EEEKILETF

SEQ ID NO: 357865 - protein, 9 aa, Homo Sapiens
PPQNPGSLS

SEQ ID NO: 357866 - protein, 9 aa, Homo Sapiens
ASSIMENTY

SEQ ID NO: 357867 - protein, 9 aa, Homo Sapiens
QIHTSESTY

SEQ ID NO: 357868 - protein, 9 aa, Homo Sapiens
QSIKGWRPK

SEQ ID NO: 357869 - protein, 9 aa, Homo Sapiens
QSEKETRNK

SEQ ID NO: 357870 - protein, 9 aa, Homo Sapiens
FILPDEYKY

SEQ ID NO: 357871 - protein, 9 aa, Homo Sapiens
DDDTLSYTV

SEQ ID NO: 357872 - protein, 9 aa, Homo Sapiens
ANKFWHHFM

SEQ ID NO: 357873 - protein, 9 aa, Homo Sapiens
PVIKSIRVD

SEQ ID NO: 357874 - protein, 9 aa, Homo Sapiens
QELCHMESK

SEQ ID NO: 357875 - protein, 9 aa, Homo Sapiens
IQTPARKLT

SEQ ID NO: 357876 - protein, 9 aa, Homo Sapiens
GKPFDLHIY

SEQ ID NO: 357877 - protein, 9 aa, Homo Sapiens
PLSECIRGT

SEQ ID NO: 357878 - protein, 9 aa, Homo Sapiens
VNDGEWYNV

SEQ ID NO: 357879 - protein, 9 aa, Homo Sapiens
ASHIEELQS

SEQ ID NO: 357880 - protein, 9 aa, Homo Sapiens
PGTPVLEAF

SEQ ID NO: 357881 - protein, 9 aa, Homo Sapiens
LQPIVHNLF

SEQ ID NO: 357882 - protein, 9 aa, Homo Sapiens
YLSDWIFTL

SEQ ID NO: 357883 - protein, 9 aa, Homo Sapiens
EEQYNKIAI

SEQ ID NO: 357884 - protein, 9 aa, Homo Sapiens
QREVCIVAQ

SEQ ID NO: 357885 - protein, 9 aa, Homo Sapiens
YHVHNLIGA

SEQ ID NO: 357886 - protein, 9 aa, Homo Sapiens
ITSLACKIH

SEQ ID NO: 357887 - protein, 9 aa, Homo Sapiens
EADSNSKDN

SEQ ID NO: 357888 - protein, 9 aa, Homo Sapiens
NEAYISFMF

SEQ ID NO: 357889 - protein, 9 aa, Homo Sapiens
CIIYVTEAD

SEQ ID NO: 357890 - protein, 9 aa, Homo Sapiens
PRVSLSNTA

SEQ ID NO: 357891 - protein, 9 aa, Homo Sapiens
SIINELIGL

SEQ ID NO: 357892 - protein, 9 aa, Homo Sapiens
RPFPKTTLT

SEQ ID NO: 357893 - protein, 9 aa, Homo Sapiens
EAIEMYEGS

SEQ ID NO: 357894 - protein, 9 aa, Homo Sapiens
LQRLEKIAE

SEQ ID NO: 357895 - protein, 9 aa, Homo Sapiens
SKKDKGKAK

SEQ ID NO: 357896 - protein, 9 aa, Homo Sapiens
TLREDKRPE

SEQ ID NO: 357897 - protein, 9 aa, Homo Sapiens
FMHANKSIV

SEQ ID NO: 357898 - protein, 9 aa, Homo Sapiens
MEKENKKIW

SEQ ID NO: 357899 - protein, 9 aa, Homo Sapiens
SHCPRHCPP

SEQ ID NO: 357900 - protein, 9 aa, Homo Sapiens
NNKLPDYSP

SEQ ID NO: 357901 - protein, 9 aa, Homo Sapiens
GYTPVTNLT

SEQ ID NO: 357902 - protein, 9 aa, Homo Sapiens
SSSVNVENT

SEQ ID NO: 357903 - protein, 9 aa, Homo Sapiens
LHNNERQGL

SEQ ID NO: 357904 - protein, 9 aa, Homo Sapiens
IKHRNEAEL

SEQ ID NO: 357905 - protein, 9 aa, Homo Sapiens
VKHICGEYQ

SEQ ID NO: 357906 - protein, 9 aa, Homo Sapiens
FLQQGKSIY

SEQ ID NO: 357907 - protein, 9 aa, Homo Sapiens
RADQGPKNI

SEQ ID NO: 357908 - protein, 9 aa, Homo Sapiens
EKEHVKEIS

SEQ ID NO: 357909 - protein, 9 aa, Homo Sapiens
CVVVVFVVS

SEQ ID NO: 357910 - protein, 9 aa, Homo Sapiens
DVHTCSPRE

SEQ ID NO: 357911 - protein, 9 aa, Homo Sapiens
VKSLQELCH

SEQ ID NO: 357912 - protein, 9 aa, Homo Sapiens
SVSPVEFFR

SEQ ID NO: 357913 - protein, 9 aa, Homo Sapiens
GFFVSLTET

SEQ ID NO: 357914 - protein, 9 aa, Homo Sapiens
DDQESHAQG

SEQ ID NO: 357915 - protein, 9 aa, Homo Sapiens
AKCRSRTKN

SEQ ID NO: 357916 - protein, 9 aa, Homo Sapiens
PLHRGYIGV

SEQ ID NO: 357917 - protein, 9 aa, Homo Sapiens
NDATEQRTS

SEQ ID NO: 357918 - protein, 9 aa, Homo Sapiens
GRVGDCLVE

SEQ ID NO: 357919 - protein, 9 aa, Homo Sapiens
VVTVMAGNN

SEQ ID NO: 357920 - protein, 9 aa, Homo Sapiens
SLVDKDLDL

SEQ ID NO: 357921 - protein, 9 aa, Homo Sapiens
KLLFFRKTI

SEQ ID NO: 357922 - protein, 9 aa, Homo Sapiens
GKAFARWPS

SEQ ID NO: 357923 - protein, 9 aa, Homo Sapiens
RNQLGQQFR

SEQ ID NO: 357924 - protein, 9 aa, Homo Sapiens
DECNIKKGV

SEQ ID NO: 357925 - protein, 9 aa, Homo Sapiens
NAWWVGYEF

SEQ ID NO: 357926 - protein, 9 aa, Homo Sapiens
TISKGLFVP

SEQ ID NO: 357927 - protein, 9 aa, Homo Sapiens
NVPYCGSQS

SEQ ID NO: 357928 - protein, 9 aa, Homo Sapiens
RLSDVTGNK

SEQ ID NO: 357929 - protein, 9 aa, Homo Sapiens
LQQRRPWEP

SEQ ID NO: 357930 - protein, 9 aa, Homo Sapiens
LDQLLQNQI

SEQ ID NO: 357931 - protein, 9 aa, Homo Sapiens
MNGFPVNKC

SEQ ID NO: 357932 - protein, 9 aa, Homo Sapiens
SGTPWYPIN

SEQ ID NO: 357933 - protein, 9 aa, Homo Sapiens
VNLEQVHRH

SEQ ID NO: 357934 - protein, 9 aa, Homo Sapiens
KAETACRLR

SEQ ID NO: 357935 - protein, 9 aa, Homo Sapiens
KNFKCRFSL

SEQ ID NO: 357936 - protein, 9 aa, Homo Sapiens
LGQINEAVN

SEQ ID NO: 357937 - protein, 9 aa, Homo Sapiens
SSFQYHGRT

SEQ ID NO: 357938 - protein, 9 aa, Homo Sapiens
LVEHGPDGI

SEQ ID NO: 357939 - protein, 9 aa, Homo Sapiens
VEAKETTYS

SEQ ID NO: 357940 - protein, 9 aa, Homo Sapiens
NVSSKECLQ

SEQ ID NO: 357941 - protein, 9 aa, Homo Sapiens
TTFQMTGST

SEQ ID NO: 357942 - protein, 9 aa, Homo Sapiens
ELDKLQCDL

SEQ ID NO: 357943 - protein, 9 aa, Homo Sapiens
RGKFQPPRK

SEQ ID NO: 357944 - protein, 9 aa, Homo Sapiens
NKSGKKAGD

SEQ ID NO: 357945 - protein, 9 aa, Homo Sapiens
FTHRNVYKN

SEQ ID NO: 357946 - protein, 9 aa, Homo Sapiens
FQKRDLHKL

SEQ ID NO: 357947 - protein, 9 aa, Homo Sapiens
GDVQNSTRS

SEQ ID NO: 357948 - protein, 9 aa, Homo Sapiens
LNSMHIYQP

SEQ ID NO: 357949 - protein, 9 aa, Homo Sapiens
EFDFNKVFR

SEQ ID NO: 357950 - protein, 9 aa, Homo Sapiens
LEQKSPDLK

SEQ ID NO: 357951 - protein, 9 aa, Homo Sapiens
RNSSARTKL

SEQ ID NO: 357952 - protein, 9 aa, Homo Sapiens
LPLHRGYIG

SEQ ID NO: 357953 - protein, 9 aa, Homo Sapiens
KLMIIPDPE

SEQ ID NO: 357954 - protein, 9 aa, Homo Sapiens
KEKKGKDHK

SEQ ID NO: 357955 - protein, 9 aa, Homo Sapiens
TRLVGINLV

SEQ ID NO: 357956 - protein, 9 aa, Homo Sapiens
IKDLRDLLI

SEQ ID NO: 357957 - protein, 9 aa, Homo Sapiens
KRKKDSPFW

SEQ ID NO: 357958 - protein, 9 aa, Homo Sapiens
FFNVLLPLI

SEQ ID NO: 357959 - protein, 9 aa, Homo Sapiens
IQTESIRWL

SEQ ID NO: 357960 - protein, 9 aa, Homo Sapiens
LQNNLISSI

SEQ ID NO: 357961 - protein, 9 aa, Homo Sapiens
GYQLTQHQI

SEQ ID NO: 357962 - protein, 9 aa, Homo Sapiens
VCEYAFNRK

SEQ ID NO: 357963 - protein, 9 aa, Homo Sapiens
ILKYAEAGE

SEQ ID NO: 357964 - protein, 9 aa, Homo Sapiens
LQAETLVTL

SEQ ID NO: 357965 - protein, 9 aa, Homo Sapiens
AVQLDNVFR

SEQ ID NO: 357966 - protein, 9 aa, Homo Sapiens
LNRTNHPPG

SEQ ID NO: 357967 - protein, 9 aa, Homo Sapiens
CLGICSFAD

SEQ ID NO: 357968 - protein, 9 aa, Homo Sapiens
DKTDIFQDV

SEQ ID NO: 357969 - protein, 9 aa, Homo Sapiens
IMWEGRDRV

SEQ ID NO: 357970 - protein, 9 aa, Homo Sapiens
LFNLALLIE

SEQ ID NO: 357971 - protein, 9 aa, Homo Sapiens
NFSYLLSKR

SEQ ID NO: 357972 - protein, 9 aa, Homo Sapiens
SPKNKKPKE

SEQ ID NO: 357973 - protein, 9 aa, Homo Sapiens
ARSIGMVKV

SEQ ID NO: 357974 - protein, 9 aa, Homo Sapiens
SKDINKNKN

SEQ ID NO: 357975 - protein, 9 aa, Homo Sapiens
FMYRWLKNC

SEQ ID NO: 357976 - protein, 9 aa, Homo Sapiens
PLADKGMTA

SEQ ID NO: 357977 - protein, 9 aa, Homo Sapiens
YLPTSVGLL

SEQ ID NO: 357978 - protein, 9 aa, Homo Sapiens
NTLFMVLEH

SEQ ID NO: 357979 - protein, 9 aa, Homo Sapiens
ATHRNGDPE

SEQ ID NO: 357980 - protein, 9 aa, Homo Sapiens
TVHGFVSHS

SEQ ID NO: 357981 - protein, 9 aa, Homo Sapiens
QEKEIKRAD

SEQ ID NO: 357982 - protein, 9 aa, Homo Sapiens
IGSSKPDMD

SEQ ID NO: 357983 - protein, 9 aa, Homo Sapiens
LSSGKYTGA

SEQ ID NO: 357984 - protein, 9 aa, Homo Sapiens
DTLELQSDM

SEQ ID NO: 357985 - protein, 9 aa, Homo Sapiens
FSQVIYLFA

SEQ ID NO: 357986 - protein, 9 aa, Homo Sapiens
SGFMEQLCT

SEQ ID NO: 357987 - protein, 9 aa, Homo Sapiens
KAPTSPFKR

SEQ ID NO: 357988 - protein, 9 aa, Homo Sapiens
QPEAEELES

SEQ ID NO: 357989 - protein, 9 aa, Homo Sapiens
GVRRHIQKV

SEQ ID NO: 357990 - protein, 9 aa, Homo Sapiens
NRTNHPPGN

SEQ ID NO: 357991 - protein, 9 aa, Homo Sapiens
IYHQQTHTG

SEQ ID NO: 357992 - protein, 9 aa, Homo Sapiens
KIMALRNEC

SEQ ID NO: 357993 - protein, 9 aa, Homo Sapiens
CLLLERLEE

SEQ ID NO: 357994 - protein, 9 aa, Homo Sapiens
PPQTQKELA

SEQ ID NO: 357995 - protein, 9 aa, Homo Sapiens
PKRKEDKLL

SEQ ID NO: 357996 - protein, 9 aa, Homo Sapiens
DPGVSLVCK

SEQ ID NO: 357997 - protein, 9 aa, Homo Sapiens
FTKGEILVI

SEQ ID NO: 357998 - protein, 9 aa, Homo Sapiens
IELAYEGKC

SEQ ID NO: 357999 - protein, 9 aa, Homo Sapiens
LVCKKHMLS

SEQ ID NO: 358000 - protein, 9 aa, Homo Sapiens
IYRGCEAFL

SEQ ID NO: 358001 - protein, 9 aa, Homo Sapiens
RAAGKGYDN

SEQ ID NO: 358002 - protein, 9 aa, Homo Sapiens
IYDVFRSNN

SEQ ID NO: 358003 - protein, 9 aa, Homo Sapiens
CVSGTVHTK

SEQ ID NO: 358004 - protein, 9 aa, Homo Sapiens
AAKGYTQFY

SEQ ID NO: 358005 - protein, 9 aa, Homo Sapiens
SLIKFKDNP

SEQ ID NO: 358006 - protein, 9 aa, Homo Sapiens
VIESLGWSN

SEQ ID NO: 358007 - protein, 9 aa, Homo Sapiens
DTTLQELEE

SEQ ID NO: 358008 - protein, 9 aa, Homo Sapiens
SKESAALQP

SEQ ID NO: 358009 - protein, 9 aa, Homo Sapiens
EELKKQLRK

SEQ ID NO: 358010 - protein, 9 aa, Homo Sapiens
KNGKIHDHA

SEQ ID NO: 358011 - protein, 9 aa, Homo Sapiens
GTTNGSLSS

SEQ ID NO: 358012 - protein, 9 aa, Homo Sapiens
KKYGDSPRG

SEQ ID NO: 358013 - protein, 9 aa, Homo Sapiens
YTLQEVKIL

SEQ ID NO: 358014 - protein, 9 aa, Homo Sapiens
PVDIGTYLI

SEQ ID NO: 358015 - protein, 9 aa, Homo Sapiens
LLQTMEDQD

SEQ ID NO: 358016 - protein, 9 aa, Homo Sapiens
SFALHSSEF

SEQ ID NO: 358017 - protein, 9 aa, Homo Sapiens
ISNPKNMEN

SEQ ID NO: 358018 - protein, 9 aa, Homo Sapiens
LSEFLNLIG

SEQ ID NO: 358019 - protein, 9 aa, Homo Sapiens
EMRLELQIS

SEQ ID NO: 358020 - protein, 9 aa, Homo Sapiens
FFHKYFPDA

SEQ ID NO: 358021 - protein, 9 aa, Homo Sapiens
YNVRPSEYI

SEQ ID NO: 358022 - protein, 9 aa, Homo Sapiens
GCETVDVVQ

SEQ ID NO: 358023 - protein, 9 aa, Homo Sapiens
TPTQMFPHH

SEQ ID NO: 358024 - protein, 9 aa, Homo Sapiens
EAEQQRQEE

SEQ ID NO: 358025 - protein, 9 aa, Homo Sapiens
LLDERQDAH

SEQ ID NO: 358026 - protein, 9 aa, Homo Sapiens
DVCFLNRRH

SEQ ID NO: 358027 - protein, 9 aa, Homo Sapiens
KYFTSSSPS

SEQ ID NO: 358028 - protein, 9 aa, Homo Sapiens
ETEKEKRKQ

SEQ ID NO: 358029 - protein, 9 aa, Homo Sapiens
NCLGICSFA

SEQ ID NO: 358030 - protein, 9 aa, Homo Sapiens
ANKLSTIHG

SEQ ID NO: 358031 - protein, 9 aa, Homo Sapiens
EAADYIINN

SEQ ID NO: 358032 - protein, 9 aa, Homo Sapiens
YQSSSDQTR

SEQ ID NO: 358033 - protein, 9 aa, Homo Sapiens
GKLLVSATG

SEQ ID NO: 358034 - protein, 9 aa, Homo Sapiens
KETKDGFMC

SEQ ID NO: 358035 - protein, 9 aa, Homo Sapiens
ASLFKKSWW

SEQ ID NO: 358036 - protein, 9 aa, Homo Sapiens
AKREKQLAD

SEQ ID NO: 358037 - protein, 9 aa, Homo Sapiens
TFLPKCIQA

SEQ ID NO: 358038 - protein, 9 aa, Homo Sapiens
SAAKVTLQI

SEQ ID NO: 358039 - protein, 9 aa, Homo Sapiens
SIELAYEGK

SEQ ID NO: 358040 - protein, 9 aa, Homo Sapiens
WLRGLRKYK

SEQ ID NO: 358041 - protein, 9 aa, Homo Sapiens
NLSRSAQLT

SEQ ID NO: 358042 - protein, 9 aa, Homo Sapiens
VSSGLLIRM

SEQ ID NO: 358043 - protein, 9 aa, Homo Sapiens
GSCVQHQKL

SEQ ID NO: 358044 - protein, 9 aa, Homo Sapiens
GIGFKTAKS

SEQ ID NO: 358045 - protein, 9 aa, Homo Sapiens
AHRLPEIQQ

SEQ ID NO: 358046 - protein, 9 aa, Homo Sapiens
TKDLQNGMI

SEQ ID NO: 358047 - protein, 9 aa, Homo Sapiens
GTKLGETFY

SEQ ID NO: 358048 - protein, 9 aa, Homo Sapiens
LVQAEASLP

SEQ ID NO: 358049 - protein, 9 aa, Homo Sapiens
VGAGDVGKS

SEQ ID NO: 358050 - protein, 9 aa, Homo Sapiens
GSPKRHHKQ

SEQ ID NO: 358051 - protein, 9 aa, Homo Sapiens
QALRHGVRI

SEQ ID NO: 358052 - protein, 9 aa, Homo Sapiens
LEKMLYVCC

SEQ ID NO: 358053 - protein, 9 aa, Homo Sapiens
PAHAEVIKL

SEQ ID NO: 358054 - protein, 9 aa, Homo Sapiens
VSSLLLQIP

SEQ ID NO: 358055 - protein, 9 aa, Homo Sapiens
YNVDFQRDG

SEQ ID NO: 358056 - protein, 9 aa, Homo Sapiens
LYPPVQVIR

SEQ ID NO: 358057 - protein, 9 aa, Homo Sapiens
LIIFHAGYS

SEQ ID NO: 358058 - protein, 9 aa, Homo Sapiens
QKCVIATST

SEQ ID NO: 358059 - protein, 9 aa, Homo Sapiens
AKCKSDGAF

SEQ ID NO: 358060 - protein, 9 aa, Homo Sapiens
PNLLKMICH

SEQ ID NO: 358061 - protein, 9 aa, Homo Sapiens
RSAESVCSL

SEQ ID NO: 358062 - protein, 9 aa, Homo Sapiens
EEAAKREKQ

SEQ ID NO: 358063 - protein, 9 aa, Homo Sapiens
SHKARGEGV

SEQ ID NO: 358064 - protein, 9 aa, Homo Sapiens
LQIDSSRIR

SEQ ID NO: 358065 - protein, 9 aa, Homo Sapiens
GYANISELQ

SEQ ID NO: 358066 - protein, 9 aa, Homo Sapiens
AESESAATC

SEQ ID NO: 358067 - protein, 9 aa, Homo Sapiens
SPKLTSSSE

SEQ ID NO: 358068 - protein, 9 aa, Homo Sapiens
DSEKIMWTT

SEQ ID NO: 358069 - protein, 9 aa, Homo Sapiens
EATDTEDPT

SEQ ID NO: 358070 - protein, 9 aa, Homo Sapiens
LWVVEFGSL

SEQ ID NO: 358071 - protein, 9 aa, Homo Sapiens
NQNGSELDL

SEQ ID NO: 358072 - protein, 9 aa, Homo Sapiens
EQAARQFAV

SEQ ID NO: 358073 - protein, 9 aa, Homo Sapiens
FIIYLIPRY

SEQ ID NO: 358074 - protein, 9 aa, Homo Sapiens
DKHLITGFN

SEQ ID NO: 358075 - protein, 9 aa, Homo Sapiens
EELSRDSRS

SEQ ID NO: 358076 - protein, 9 aa, Homo Sapiens
MADSSSSSL

SEQ ID NO: 358077 - protein, 9 aa, Homo Sapiens
DYVIMTIVF

SEQ ID NO: 358078 - protein, 9 aa, Homo Sapiens
LEKKAERLG

SEQ ID NO: 358079 - protein, 9 aa, Homo Sapiens
NAITHFFCN

SEQ ID NO: 358080 - protein, 9 aa, Homo Sapiens
PLISPAAEC

SEQ ID NO: 358081 - protein, 9 aa, Homo Sapiens
LLQKLPPHL

SEQ ID NO: 358082 - protein, 9 aa, Homo Sapiens
LLRKGVEVK

SEQ ID NO: 358083 - protein, 9 aa, Homo Sapiens
CTQCIKWKG

SEQ ID NO: 358084 - protein, 9 aa, Homo Sapiens
KENMKKPAE

SEQ ID NO: 358085 - protein, 9 aa, Homo Sapiens
SGMLEMLLP

SEQ ID NO: 358086 - protein, 9 aa, Homo Sapiens
KITTRDAVK

SEQ ID NO: 358087 - protein, 9 aa, Homo Sapiens
PDMKCDNMM

SEQ ID NO: 358088 - protein, 9 aa, Homo Sapiens
VAHVCQHNQ

SEQ ID NO: 358089 - protein, 9 aa, Homo Sapiens
LYQFQLFQE

SEQ ID NO: 358090 - protein, 9 aa, Homo Sapiens
TVDVVQERV

SEQ ID NO: 358091 - protein, 9 aa, Homo Sapiens
KAWQNYNKI

SEQ ID NO: 358092 - protein, 9 aa, Homo Sapiens
SELEKEAHK

SEQ ID NO: 358093 - protein, 9 aa, Homo Sapiens
GNCDQRFRF

SEQ ID NO: 358094 - protein, 9 aa, Homo Sapiens
SVKASNSTQ

SEQ ID NO: 358095 - protein, 9 aa, Homo Sapiens
SVNCICVDC

SEQ ID NO: 358096 - protein, 9 aa, Homo Sapiens
TFIDFDMDL

SEQ ID NO: 358097 - protein, 9 aa, Homo Sapiens
KVTADKLMD

SEQ ID NO: 358098 - protein, 9 aa, Homo Sapiens
ENDLSVIRQ

SEQ ID NO: 358099 - protein, 9 aa, Homo Sapiens
SNADFSVPV

SEQ ID NO: 358100 - protein, 9 aa, Homo Sapiens
EGEHKSGVL

SEQ ID NO: 358101 - protein, 9 aa, Homo Sapiens
FDDKHLITG

SEQ ID NO: 358102 - protein, 9 aa, Homo Sapiens
VSGNTPITV

SEQ ID NO: 358103 - protein, 9 aa, Homo Sapiens
SIAQRKDLA

SEQ ID NO: 358104 - protein, 9 aa, Homo Sapiens
TVSNTQTVL

SEQ ID NO: 358105 - protein, 9 aa, Homo Sapiens
INTDMFQTV

SEQ ID NO: 358106 - protein, 9 aa, Homo Sapiens
AEMAALTQD

SEQ ID NO: 358107 - protein, 9 aa, Homo Sapiens
HLDVTVGDL

SEQ ID NO: 358108 - protein, 9 aa, Homo Sapiens
CIQAKIQDY

SEQ ID NO: 358109 - protein, 9 aa, Homo Sapiens
ALVDVKCLN

SEQ ID NO: 358110 - protein, 9 aa, Homo Sapiens
NQGQALEPT

SEQ ID NO: 358111 - protein, 9 aa, Homo Sapiens
QLISELQRV

SEQ ID NO: 358112 - protein, 9 aa, Homo Sapiens
ASRHKSFME

SEQ ID NO: 358113 - protein, 9 aa, Homo Sapiens
KVSAPSGIG

SEQ ID NO: 358114 - protein, 9 aa, Homo Sapiens
KGLHLETEA

SEQ ID NO: 358115 - protein, 9 aa, Homo Sapiens
SLSLLTETM

SEQ ID NO: 358116 - protein, 9 aa, Homo Sapiens
QTNASDSTE

SEQ ID NO: 358117 - protein, 9 aa, Homo Sapiens
EYIPTPSNR

SEQ ID NO: 358118 - protein, 9 aa, Homo Sapiens
CIASGWHPH

SEQ ID NO: 358119 - protein, 9 aa, Homo Sapiens
LALQPGDWI

SEQ ID NO: 358120 - protein, 9 aa, Homo Sapiens
HGMKQKQKP

SEQ ID NO: 358121 - protein, 9 aa, Homo Sapiens
KVENGVGVP

SEQ ID NO: 358122 - protein, 9 aa, Homo Sapiens
KAKAMSSPR

SEQ ID NO: 358123 - protein, 9 aa, Homo Sapiens
DNDVNTYNA

SEQ ID NO: 358124 - protein, 9 aa, Homo Sapiens
IRQKIVDFL

SEQ ID NO: 358125 - protein, 9 aa, Homo Sapiens
GLKENTLIL

SEQ ID NO: 358126 - protein, 9 aa, Homo Sapiens
NGILYYYQS

SEQ ID NO: 358127 - protein, 9 aa, Homo Sapiens
MTKNLKEEH

SEQ ID NO: 358128 - protein, 9 aa, Homo Sapiens
RLRSKNKDI

SEQ ID NO: 358129 - protein, 9 aa, Homo Sapiens
NIHTGEKTY

SEQ ID NO: 358130 - protein, 9 aa, Homo Sapiens
VIDEIQNGP

SEQ ID NO: 358131 - protein, 9 aa, Homo Sapiens
AIAQAHAEN

SEQ ID NO: 358132 - protein, 9 aa, Homo Sapiens
KQEVWEAFD

SEQ ID NO: 358133 - protein, 9 aa, Homo Sapiens
LAVLEKHVE

SEQ ID NO: 358134 - protein, 9 aa, Homo Sapiens
NRGCEGFSF

SEQ ID NO: 358135 - protein, 9 aa, Homo Sapiens
LGCHMRRNA

SEQ ID NO: 358136 - protein, 9 aa, Homo Sapiens
AWSFMTPHS

SEQ ID NO: 358137 - protein, 9 aa, Homo Sapiens
LDYSMPVPY

SEQ ID NO: 358138 - protein, 9 aa, Homo Sapiens
FQLNYLSGD

SEQ ID NO: 358139 - protein, 9 aa, Homo Sapiens
AQGDLADSF

SEQ ID NO: 358140 - protein, 9 aa, Homo Sapiens
KKNGKLWSP

SEQ ID NO: 358141 - protein, 9 aa, Homo Sapiens
VNLTVIWCP

SEQ ID NO: 358142 - protein, 9 aa, Homo Sapiens
IFEKPRLSN

SEQ ID NO: 358143 - protein, 9 aa, Homo Sapiens
AWMWSASDL

SEQ ID NO: 358144 - protein, 9 aa, Homo Sapiens
ERRYSLSFQ

SEQ ID NO: 358145 - protein, 9 aa, Homo Sapiens
TFPALVLAP

SEQ ID NO: 358146 - protein, 9 aa, Homo Sapiens
HKRKGSSTD

SEQ ID NO: 358147 - protein, 9 aa, Homo Sapiens
SSHLNRHET

SEQ ID NO: 358148 - protein, 9 aa, Homo Sapiens
CCLRPACGR

SEQ ID NO: 358149 - protein, 9 aa, Homo Sapiens
RNKKEKSCR

SEQ ID NO: 358150 - protein, 9 aa, Homo Sapiens
DGLCLLGGR

SEQ ID NO: 358151 - protein, 9 aa, Homo Sapiens
DASSKVEKA

SEQ ID NO: 358152 - protein, 9 aa, Homo Sapiens
ENYPEAEGL

SEQ ID NO: 358153 - protein, 9 aa, Homo Sapiens
RLTVHRKIH

SEQ ID NO: 358154 - protein, 9 aa, Homo Sapiens
KNALKDAKN

SEQ ID NO: 358155 - protein, 9 aa, Homo Sapiens
EHSEMKLDE

SEQ ID NO: 358156 - protein, 9 aa, Homo Sapiens
FTCIPYRVV

SEQ ID NO: 358157 - protein, 9 aa, Homo Sapiens
TQHQITHTG

SEQ ID NO: 358158 - protein, 9 aa, Homo Sapiens
KFKPDVKSK

SEQ ID NO: 358159 - protein, 9 aa, Homo Sapiens
QRKLKKHFY

SEQ ID NO: 358160 - protein, 9 aa, Homo Sapiens
VTADKLMDL

SEQ ID NO: 358161 - protein, 9 aa, Homo Sapiens
VVTVNTTDL

SEQ ID NO: 358162 - protein, 9 aa, Homo Sapiens
IYLSDWIFT

SEQ ID NO: 358163 - protein, 9 aa, Homo Sapiens
QPLLFQNPV

SEQ ID NO: 358164 - protein, 9 aa, Homo Sapiens
LQEQGIHAE

SEQ ID NO: 358165 - protein, 9 aa, Homo Sapiens
LSGKQVDGK

SEQ ID NO: 358166 - protein, 9 aa, Homo Sapiens
FVTQPSNTC

SEQ ID NO: 358167 - protein, 9 aa, Homo Sapiens
SAQINYQSS

SEQ ID NO: 358168 - protein, 9 aa, Homo Sapiens
GVLECCLVL

SEQ ID NO: 358169 - protein, 9 aa, Homo Sapiens
LFITLMSVD

SEQ ID NO: 358170 - protein, 9 aa, Homo Sapiens
IEFNAHHPF

SEQ ID NO: 358171 - protein, 9 aa, Homo Sapiens
HKHCVYYFK

SEQ ID NO: 358172 - protein, 9 aa, Homo Sapiens
TVSVSTSNI

SEQ ID NO: 358173 - protein, 9 aa, Homo Sapiens
RRNKEYCLL

SEQ ID NO: 358174 - protein, 9 aa, Homo Sapiens
LHRFYGNNS

SEQ ID NO: 358175 - protein, 9 aa, Homo Sapiens
IVFDLSRRM

SEQ ID NO: 358176 - protein, 9 aa, Homo Sapiens
PDISFTIDV

SEQ ID NO: 358177 - protein, 9 aa, Homo Sapiens
SLEEEEGLV

SEQ ID NO: 358178 - protein, 9 aa, Homo Sapiens
SNANPPVSH

SEQ ID NO: 358179 - protein, 9 aa, Homo Sapiens
KTNSTVTKI

SEQ ID NO: 358180 - protein, 9 aa, Homo Sapiens
ACPALQNKV

SEQ ID NO: 358181 - protein, 9 aa, Homo Sapiens
FGGFDLMNR

SEQ ID NO: 358182 - protein, 9 aa, Homo Sapiens
LFVRNSTEC

SEQ ID NO: 358183 - protein, 9 aa, Homo Sapiens
INENRKQQF

SEQ ID NO: 358184 - protein, 9 aa, Homo Sapiens
NRNKKEKSC

SEQ ID NO: 358185 - protein, 9 aa, Homo Sapiens
EYLANNCTK

SEQ ID NO: 358186 - protein, 9 aa, Homo Sapiens
LFLFSWMLL

SEQ ID NO: 358187 - protein, 9 aa, Homo Sapiens
GHSGKAITF

SEQ ID NO: 358188 - protein, 9 aa, Homo Sapiens
KELNGENVY

SEQ ID NO: 358189 - protein, 9 aa, Homo Sapiens
GNKDTPYEA

SEQ ID NO: 358190 - protein, 9 aa, Homo Sapiens
GKRKDNKIR

SEQ ID NO: 358191 - protein, 9 aa, Homo Sapiens
RGSVSSELD

SEQ ID NO: 358192 - protein, 9 aa, Homo Sapiens
LRQIREARQ

SEQ ID NO: 358193 - protein, 9 aa, Homo Sapiens
KFRVLDCHK

SEQ ID NO: 358194 - protein, 9 aa, Homo Sapiens
PLHYYETVC

SEQ ID NO: 358195 - protein, 9 aa, Homo Sapiens
QNKCNQCLD

SEQ ID NO: 358196 - protein, 9 aa, Homo Sapiens
CYAASVIGY

SEQ ID NO: 358197 - protein, 9 aa, Homo Sapiens
VNNALDLKF

SEQ ID NO: 358198 - protein, 9 aa, Homo Sapiens
IVENEWKRM

SEQ ID NO: 358199 - protein, 9 aa, Homo Sapiens
VKCEACPDP

SEQ ID NO: 358200 - protein, 9 aa, Homo Sapiens
VLLAKCKSD

SEQ ID NO: 358201 - protein, 9 aa, Homo Sapiens
YNQIQKELE

SEQ ID NO: 358202 - protein, 9 aa, Homo Sapiens
FFIKGKDNS

SEQ ID NO: 358203 - protein, 9 aa, Homo Sapiens
RRAGVNKDY

SEQ ID NO: 358204 - protein, 9 aa, Homo Sapiens
RQEHQNRVF

SEQ ID NO: 358205 - protein, 9 aa, Homo Sapiens
KSPSWYKYT

SEQ ID NO: 358206 - protein, 9 aa, Homo Sapiens
CQSNSATPK

SEQ ID NO: 358207 - protein, 9 aa, Homo Sapiens
SKDQLCLAL

SEQ ID NO: 358208 - protein, 9 aa, Homo Sapiens
LRLHLLDNT

SEQ ID NO: 358209 - protein, 9 aa, Homo Sapiens
LTKYSTLKH

SEQ ID NO: 358210 - protein, 9 aa, Homo Sapiens
TEGCKEGRE

SEQ ID NO: 358211 - protein, 9 aa, Homo Sapiens
EWGAEALTP

SEQ ID NO: 358212 - protein, 9 aa, Homo Sapiens
GSQDGPQTS

SEQ ID NO: 358213 - protein, 9 aa, Homo Sapiens
LKNLFNMCG

SEQ ID NO: 358214 - protein, 9 aa, Homo Sapiens
KHVELEGLK

SEQ ID NO: 358215 - protein, 9 aa, Homo Sapiens
LSMLMHFSS

SEQ ID NO: 358216 - protein, 9 aa, Homo Sapiens
HNPYPSSVV

SEQ ID NO: 358217 - protein, 9 aa, Homo Sapiens
WDSNFLGGV

SEQ ID NO: 358218 - protein, 9 aa, Homo Sapiens
MVINRLFLW

SEQ ID NO: 358219 - protein, 9 aa, Homo Sapiens
NLCVYKGKP

SEQ ID NO: 358220 - protein, 9 aa, Homo Sapiens
RLELQISAN

SEQ ID NO: 358221 - protein, 9 aa, Homo Sapiens
AVAGARSKG

SEQ ID NO: 358222 - protein, 9 aa, Homo Sapiens
GSKTTNDAT

SEQ ID NO: 358223 - protein, 9 aa, Homo Sapiens
GRALSMTLK

SEQ ID NO: 358224 - protein, 9 aa, Homo Sapiens
MWGDSQPAN

SEQ ID NO: 358225 - protein, 9 aa, Homo Sapiens
GSPEKARLS

SEQ ID NO: 358226 - protein, 9 aa, Homo Sapiens
VLNVVKELE

SEQ ID NO: 358227 - protein, 9 aa, Homo Sapiens
FALSWRLYK

SEQ ID NO: 358228 - protein, 9 aa, Homo Sapiens
YPESAQSTF

SEQ ID NO: 358229 - protein, 9 aa, Homo Sapiens
AIVLDQFVQ

SEQ ID NO: 358230 - protein, 9 aa, Homo Sapiens
YRIMVEVYL

SEQ ID NO: 358231 - protein, 9 aa, Homo Sapiens
HRLTGNNVQ

SEQ ID NO: 358232 - protein, 9 aa, Homo Sapiens
ECQSTVSIS

SEQ ID NO: 358233 - protein, 9 aa, Homo Sapiens
FVAEPKKSF

SEQ ID NO: 358234 - protein, 9 aa, Homo Sapiens
DVSTGEPLP

SEQ ID NO: 358235 - protein, 9 aa, Homo Sapiens
AFFKIIQNE

SEQ ID NO: 358236 - protein, 9 aa, Homo Sapiens
TPTCVPVSI

SEQ ID NO: 358237 - protein, 9 aa, Homo Sapiens
RVTLASGLV

SEQ ID NO: 358238 - protein, 9 aa, Homo Sapiens
IIYEELLHM

SEQ ID NO: 358239 - protein, 9 aa, Homo Sapiens
YLYQFQLFQ

SEQ ID NO: 358240 - protein, 9 aa, Homo Sapiens
NQPLKQQIQ

SEQ ID NO: 358241 - protein, 9 aa, Homo Sapiens
CCDNDMKRK

SEQ ID NO: 358242 - protein, 9 aa, Homo Sapiens
GYTYFYLFK

SEQ ID NO: 358243 - protein, 9 aa, Homo Sapiens
VLSRVCRHN

SEQ ID NO: 358244 - protein, 9 aa, Homo Sapiens
KEHIDNINK

SEQ ID NO: 358245 - protein, 9 aa, Homo Sapiens
TMEDQDNQR

SEQ ID NO: 358246 - protein, 9 aa, Homo Sapiens
ETLLQCEDC

SEQ ID NO: 358247 - protein, 9 aa, Homo Sapiens
TQQHNTMFS

SEQ ID NO: 358248 - protein, 9 aa, Homo Sapiens
AINGNYHRF

SEQ ID NO: 358249 - protein, 9 aa, Homo Sapiens
SKSLNLTNH

SEQ ID NO: 358250 - protein, 9 aa, Homo Sapiens
FIKAENTTR

SEQ ID NO: 358251 - protein, 9 aa, Homo Sapiens
GDISLDKIT

SEQ ID NO: 358252 - protein, 9 aa, Homo Sapiens
VDRINNDGD

SEQ ID NO: 358253 - protein, 9 aa, Homo Sapiens
SREETQNAA

SEQ ID NO: 358254 - protein, 9 aa, Homo Sapiens
EKPFLGHCH

SEQ ID NO: 358255 - protein, 9 aa, Homo Sapiens
RQQNEVRVL

SEQ ID NO: 358256 - protein, 9 aa, Homo Sapiens
LKKSDVSTR

SEQ ID NO: 358257 - protein, 9 aa, Homo Sapiens
NSMHIYQPR

SEQ ID NO: 358258 - protein, 9 aa, Homo Sapiens
LENKLLPLH

SEQ ID NO: 358259 - protein, 9 aa, Homo Sapiens
PGKKAATTP

SEQ ID NO: 358260 - protein, 9 aa, Homo Sapiens
EKAKAMSSP

SEQ ID NO: 358261 - protein, 9 aa, Homo Sapiens
LRNNPIKSI

SEQ ID NO: 358262 - protein, 9 aa, Homo Sapiens
IISYARIIG

SEQ ID NO: 358263 - protein, 9 aa, Homo Sapiens
LRKGVEVKE

SEQ ID NO: 358264 - protein, 9 aa, Homo Sapiens
LLELGEAQR

SEQ ID NO: 358265 - protein, 9 aa, Homo Sapiens
PKEKGLALG

SEQ ID NO: 358266 - protein, 9 aa, Homo Sapiens
GVPQTIQDQ

SEQ ID NO: 358267 - protein, 9 aa, Homo Sapiens
QSLGERTVT

SEQ ID NO: 358268 - protein, 9 aa, Homo Sapiens
GCGKAFVWS

SEQ ID NO: 358269 - protein, 9 aa, Homo Sapiens
TVCIKFSRH

SEQ ID NO: 358270 - protein, 9 aa, Homo Sapiens
PNQKGSTKS

SEQ ID NO: 358271 - protein, 9 aa, Homo Sapiens
CLKGMEESG

SEQ ID NO: 358272 - protein, 9 aa, Homo Sapiens
LNITAMQRG

SEQ ID NO: 358273 - protein, 9 aa, Homo Sapiens
HRIRQQNEV

SEQ ID NO: 358274 - protein, 9 aa, Homo Sapiens
ITLWFQSTV

SEQ ID NO: 358275 - protein, 9 aa, Homo Sapiens
TGEQPYECH

SEQ ID NO: 358276 - protein, 9 aa, Homo Sapiens
LQNQVAHVK

SEQ ID NO: 358277 - protein, 9 aa, Homo Sapiens
MALCQNARE

SEQ ID NO: 358278 - protein, 9 aa, Homo Sapiens
NQIELEVLS

SEQ ID NO: 358279 - protein, 9 aa, Homo Sapiens
TEDQKQEVW

SEQ ID NO: 358280 - protein, 9 aa, Homo Sapiens
LAVSKDNAE

SEQ ID NO: 358281 - protein, 9 aa, Homo Sapiens
ESKLVIDLG

SEQ ID NO: 358282 - protein, 9 aa, Homo Sapiens
SCFPYVLLQ

SEQ ID NO: 358283 - protein, 9 aa, Homo Sapiens
GNASQARVD

SEQ ID NO: 358284 - protein, 9 aa, Homo Sapiens
ETSFKQTLE

SEQ ID NO: 358285 - protein, 9 aa, Homo Sapiens
LEGLKCIER

SEQ ID NO: 358286 - protein, 9 aa, Homo Sapiens
WYKETTYQR

SEQ ID NO: 358287 - protein, 9 aa, Homo Sapiens
MLSGIFTTG

SEQ ID NO: 358288 - protein, 9 aa, Homo Sapiens
SVKLWSLNS

SEQ ID NO: 358289 - protein, 9 aa, Homo Sapiens
VHCLSGKHQ

SEQ ID NO: 358290 - protein, 9 aa, Homo Sapiens
GNEIGGKPF

SEQ ID NO: 358291 - protein, 9 aa, Homo Sapiens
LFTRCLAPL

SEQ ID NO: 358292 - protein, 9 aa, Homo Sapiens
TYFQIHINK

SEQ ID NO: 358293 - protein, 9 aa, Homo Sapiens
QNSTRSDLY

SEQ ID NO: 358294 - protein, 9 aa, Homo Sapiens
EEDYKLAMA

SEQ ID NO: 358295 - protein, 9 aa, Homo Sapiens
RNSPISHLP

SEQ ID NO: 358296 - protein, 9 aa, Homo Sapiens
FEGKQGRIL

SEQ ID NO: 358297 - protein, 9 aa, Homo Sapiens
LVDQGIFKE

SEQ ID NO: 358298 - protein, 9 aa, Homo Sapiens
FRICPIFVF

SEQ ID NO: 358299 - protein, 9 aa, Homo Sapiens
DRDISTQHL

SEQ ID NO: 358300 - protein, 9 aa, Homo Sapiens
KHLQSLVIE

SEQ ID NO: 358301 - protein, 9 aa, Homo Sapiens
SKWSKDYWI

SEQ ID NO: 358302 - protein, 9 aa, Homo Sapiens
RRGVRRHIQ

SEQ ID NO: 358303 - protein, 9 aa, Homo Sapiens
QQLPAKWSG

SEQ ID NO: 358304 - protein, 9 aa, Homo Sapiens
AEVGTLWYR

SEQ ID NO: 358305 - protein, 9 aa, Homo Sapiens
GKPKPRSLQ

SEQ ID NO: 358306 - protein, 9 aa, Homo Sapiens
QIHLGDDFN

SEQ ID NO: 358307 - protein, 9 aa, Homo Sapiens
RISGNTSQR

SEQ ID NO: 358308 - protein, 9 aa, Homo Sapiens
AKAEAITSQ

SEQ ID NO: 358309 - protein, 9 aa, Homo Sapiens
SYPISVLVK

SEQ ID NO: 358310 - protein, 9 aa, Homo Sapiens
CTAGFFVSL

SEQ ID NO: 358311 - protein, 9 aa, Homo Sapiens
PKCDGLGTG

SEQ ID NO: 358312 - protein, 9 aa, Homo Sapiens
LVLEKVNNL

SEQ ID NO: 358313 - protein, 9 aa, Homo Sapiens
PSRMKPFKS

SEQ ID NO: 358314 - protein, 9 aa, Homo Sapiens
LSQNSRDAI

SEQ ID NO: 358315 - protein, 9 aa, Homo Sapiens
SQAKIECDN

SEQ ID NO: 358316 - protein, 9 aa, Homo Sapiens
LGGTALQNL

SEQ ID NO: 358317 - protein, 9 aa, Homo Sapiens
TQAEKDRWL

SEQ ID NO: 358318 - protein, 9 aa, Homo Sapiens
ERVQLAHHL

SEQ ID NO: 358319 - protein, 9 aa, Homo Sapiens
HVGVYLSAH

SEQ ID NO: 358320 - protein, 9 aa, Homo Sapiens
CSAQLISEL

SEQ ID NO: 358321 - protein, 9 aa, Homo Sapiens
SCVKWLIMS

SEQ ID NO: 358322 - protein, 9 aa, Homo Sapiens
IQHFNIHTG

SEQ ID NO: 358323 - protein, 9 aa, Homo Sapiens
MSSPRILKT

SEQ ID NO: 358324 - protein, 9 aa, Homo Sapiens
RVYFDDIHR

SEQ ID NO: 358325 - protein, 9 aa, Homo Sapiens
LIEKQQREE

SEQ ID NO: 358326 - protein, 9 aa, Homo Sapiens
QRVIDRWKA

SEQ ID NO: 358327 - protein, 9 aa, Homo Sapiens
LYVFIIPFE

SEQ ID NO: 358328 - protein, 9 aa, Homo Sapiens
QLRAHLDGT

SEQ ID NO: 358329 - protein, 9 aa, Homo Sapiens
CAVVNHFQK

SEQ ID NO: 358330 - protein, 9 aa, Homo Sapiens
YHPDTCPEV

SEQ ID NO: 358331 - protein, 9 aa, Homo Sapiens
RLHLQSNLI

SEQ ID NO: 358332 - protein, 9 aa, Homo Sapiens
VNAYTLNSI

SEQ ID NO: 358333 - protein, 9 aa, Homo Sapiens
EIYFRKETF

SEQ ID NO: 358334 - protein, 9 aa, Homo Sapiens
DESQIKATV

SEQ ID NO: 358335 - protein, 9 aa, Homo Sapiens
VSAKERRSL

SEQ ID NO: 358336 - protein, 9 aa, Homo Sapiens
DTFHFRIQR

SEQ ID NO: 358337 - protein, 9 aa, Homo Sapiens
IENPNYLQD

SEQ ID NO: 358338 - protein, 9 aa, Homo Sapiens
HHCQVSEEE

SEQ ID NO: 358339 - protein, 9 aa, Homo Sapiens
QLLELSKLC

SEQ ID NO: 358340 - protein, 9 aa, Homo Sapiens
SRISYHAMR

SEQ ID NO: 358341 - protein, 9 aa, Homo Sapiens
TRSSQNGSL

SEQ ID NO: 358342 - protein, 9 aa, Homo Sapiens
ASTELDAVE

SEQ ID NO: 358343 - protein, 9 aa, Homo Sapiens
STRQQDTRS

SEQ ID NO: 358344 - protein, 9 aa, Homo Sapiens
MSEGGDQVS

SEQ ID NO: 358345 - protein, 9 aa, Homo Sapiens
GNLEYFMKN

SEQ ID NO: 358346 - protein, 9 aa, Homo Sapiens
TQHREKLRR

SEQ ID NO: 358347 - protein, 9 aa, Homo Sapiens
FTMDTDDPQ

SEQ ID NO: 358348 - protein, 9 aa, Homo Sapiens
LPLSVHISH

SEQ ID NO: 358349 - protein, 9 aa, Homo Sapiens
ATSPLQENH

SEQ ID NO: 358350 - protein, 9 aa, Homo Sapiens
ATMKALQKK

SEQ ID NO: 358351 - protein, 9 aa, Homo Sapiens
QLPKNGGWN

SEQ ID NO: 358352 - protein, 9 aa, Homo Sapiens
HHKSDNQVN

SEQ ID NO: 358353 - protein, 9 aa, Homo Sapiens
GAGNLEYFM

SEQ ID NO: 358354 - protein, 9 aa, Homo Sapiens
NLPTIILSF

SEQ ID NO: 358355 - protein, 9 aa, Homo Sapiens
HKRLENVQP

SEQ ID NO: 358356 - protein, 9 aa, Homo Sapiens
NFIIFWSFK

SEQ ID NO: 358357 - protein, 9 aa, Homo Sapiens
CSAGVGRMG

SEQ ID NO: 358358 - protein, 9 aa, Homo Sapiens
RDANKLSTI

SEQ ID NO: 358359 - protein, 9 aa, Homo Sapiens
LCLLGGRRI

SEQ ID NO: 358360 - protein, 9 aa, Homo Sapiens
FKLLPGESN

SEQ ID NO: 358361 - protein, 9 aa, Homo Sapiens
PGKVVQTAC

SEQ ID NO: 358362 - protein, 9 aa, Homo Sapiens
LVAQVQKLN

SEQ ID NO: 358363 - protein, 9 aa, Homo Sapiens
QARLLPEAI

SEQ ID NO: 358364 - protein, 9 aa, Homo Sapiens
SLNEHKIIH

SEQ ID NO: 358365 - protein, 9 aa, Homo Sapiens
LETSFHQHQ

SEQ ID NO: 358366 - protein, 9 aa, Homo Sapiens
QKSIKQRLH

SEQ ID NO: 358367 - protein, 9 aa, Homo Sapiens
KLKKHFYVV

SEQ ID NO: 358368 - protein, 9 aa, Homo Sapiens
LFVITTPDV

SEQ ID NO: 358369 - protein, 9 aa, Homo Sapiens
EMQNAVNDA

SEQ ID NO: 358370 - protein, 9 aa, Homo Sapiens
VFFVFVLFF

SEQ ID NO: 358371 - protein, 9 aa, Homo Sapiens
FADTEIRLG

SEQ ID NO: 358372 - protein, 9 aa, Homo Sapiens
LQKKRRIQL

SEQ ID NO: 358373 - protein, 9 aa, Homo Sapiens
IPREPIPGE

SEQ ID NO: 358374 - protein, 9 aa, Homo Sapiens
PGLSLGGTA

SEQ ID NO: 358375 - protein, 9 aa, Homo Sapiens
ITGSSPGWG

SEQ ID NO: 358376 - protein, 9 aa, Homo Sapiens
NDAYKITVA

SEQ ID NO: 358377 - protein, 9 aa, Homo Sapiens
AAKVTLQID

SEQ ID NO: 358378 - protein, 9 aa, Homo Sapiens
SLSLCDSNV

SEQ ID NO: 358379 - protein, 9 aa, Homo Sapiens
FHAVMGRAL

SEQ ID NO: 358380 - protein, 9 aa, Homo Sapiens
TVIALKMLV

SEQ ID NO: 358381 - protein, 9 aa, Homo Sapiens
APNALSPVE

SEQ ID NO: 358382 - protein, 9 aa, Homo Sapiens
GTLEEPQTL

SEQ ID NO: 358383 - protein, 9 aa, Homo Sapiens
KLLTGASLD

SEQ ID NO: 358384 - protein, 9 aa, Homo Sapiens
FLLHQIIHK

SEQ ID NO: 358385 - protein, 9 aa, Homo Sapiens
CQRQGAVVA

SEQ ID NO: 358386 - protein, 9 aa, Homo Sapiens
GEASNFTRW

SEQ ID NO: 358387 - protein, 9 aa, Homo Sapiens
IYPHNKDGE

SEQ ID NO: 358388 - protein, 9 aa, Homo Sapiens
DTLSYLYKL

SEQ ID NO: 358389 - protein, 9 aa, Homo Sapiens
TKELWDTFH

SEQ ID NO: 358390 - protein, 9 aa, Homo Sapiens
ENKSLKRTF

SEQ ID NO: 358391 - protein, 9 aa, Homo Sapiens
IPNGVQICF

SEQ ID NO: 358392 - protein, 9 aa, Homo Sapiens
WGEKCEMKL

SEQ ID NO: 358393 - protein, 9 aa, Homo Sapiens
LPFKEGKII

SEQ ID NO: 358394 - protein, 9 aa, Homo Sapiens
KDKAFYHPR

SEQ ID NO: 358395 - protein, 9 aa, Homo Sapiens
TNHPPGNWK

SEQ ID NO: 358396 - protein, 9 aa, Homo Sapiens
VVKKAGLAP

SEQ ID NO: 358397 - protein, 9 aa, Homo Sapiens
WFSLEIHVN

SEQ ID NO: 358398 - protein, 9 aa, Homo Sapiens
KENLDKKKK

SEQ ID NO: 358399 - protein, 9 aa, Homo Sapiens
CILWFLQQS

SEQ ID NO: 358400 - protein, 9 aa, Homo Sapiens
GCCFSRPAY

SEQ ID NO: 358401 - protein, 9 aa, Homo Sapiens
NYFCKCGDC

SEQ ID NO: 358402 - protein, 9 aa, Homo Sapiens
QILKVASLQ

SEQ ID NO: 358403 - protein, 9 aa, Homo Sapiens
KVNKSSYSK

SEQ ID NO: 358404 - protein, 9 aa, Homo Sapiens
TYGCTSTSN

SEQ ID NO: 358405 - protein, 9 aa, Homo Sapiens
RIQEIVQNT

SEQ ID NO: 358406 - protein, 9 aa, Homo Sapiens
PEKRATATE

SEQ ID NO: 358407 - protein, 9 aa, Homo Sapiens
TLLQCEDCG

SEQ ID NO: 358408 - protein, 9 aa, Homo Sapiens
DVAIKHRNE

SEQ ID NO: 358409 - protein, 9 aa, Homo Sapiens
AAGFSQHGM

SEQ ID NO: 358410 - protein, 9 aa, Homo Sapiens
ISHECTRRP

SEQ ID NO: 358411 - protein, 9 aa, Homo Sapiens
TGLAQVILQ

SEQ ID NO: 358412 - protein, 9 aa, Homo Sapiens
TLDQLLQNQ

SEQ ID NO: 358413 - protein, 9 aa, Homo Sapiens
KWTSLNFNQ

SEQ ID NO: 358414 - protein, 9 aa, Homo Sapiens
VACGGLNNI

SEQ ID NO: 358415 - protein, 9 aa, Homo Sapiens
SEEDKLDVP

SEQ ID NO: 358416 - protein, 9 aa, Homo Sapiens
WLVCWTIFS

SEQ ID NO: 358417 - protein, 9 aa, Homo Sapiens
PIEVQQTGC

SEQ ID NO: 358418 - protein, 9 aa, Homo Sapiens
GCCVVITPE

SEQ ID NO: 358419 - protein, 9 aa, Homo Sapiens
EEYNQVLDS

SEQ ID NO: 358420 - protein, 9 aa, Homo Sapiens
DISIAQRKD

SEQ ID NO: 358421 - protein, 9 aa, Homo Sapiens
FWSNDNGTN

SEQ ID NO: 358422 - protein, 9 aa, Homo Sapiens
VHLTLHQHT

SEQ ID NO: 358423 - protein, 9 aa, Homo Sapiens
IHQHMHTGE

SEQ ID NO: 358424 - protein, 9 aa, Homo Sapiens
EGPQKREEV

SEQ ID NO: 358425 - protein, 9 aa, Homo Sapiens
MAVQLDNVF

SEQ ID NO: 358426 - protein, 9 aa, Homo Sapiens
PEISLTSQS

SEQ ID NO: 358427 - protein, 9 aa, Homo Sapiens
STDKKDSDR

SEQ ID NO: 358428 - protein, 9 aa, Homo Sapiens
AIHIQNHTG

SEQ ID NO: 358429 - protein, 9 aa, Homo Sapiens
QRANTIKNT

SEQ ID NO: 358430 - protein, 9 aa, Homo Sapiens
LLLYIGIIA

SEQ ID NO: 358431 - protein, 9 aa, Homo Sapiens
QMKETERHS

SEQ ID NO: 358432 - protein, 9 aa, Homo Sapiens
GEHQYKLFV

SEQ ID NO: 358433 - protein, 9 aa, Homo Sapiens
SFTIDVNKQ

SEQ ID NO: 358434 - protein, 9 aa, Homo Sapiens
QKEMQTIMT

SEQ ID NO: 358435 - protein, 9 aa, Homo Sapiens
QLRTSFQQL

SEQ ID NO: 358436 - protein, 9 aa, Homo Sapiens
LGRSIELAY

SEQ ID NO: 358437 - protein, 9 aa, Homo Sapiens
QMEAQCICL

SEQ ID NO: 358438 - protein, 9 aa, Homo Sapiens
KLTYTLLNK

SEQ ID NO: 358439 - protein, 9 aa, Homo Sapiens
EKNFSRGLN

SEQ ID NO: 358440 - protein, 9 aa, Homo Sapiens
VREFVLRFP

SEQ ID NO: 358441 - protein, 9 aa, Homo Sapiens
RLTKLKSQV

SEQ ID NO: 358442 - protein, 9 aa, Homo Sapiens
IQFSKGKYK

SEQ ID NO: 358443 - protein, 9 aa, Homo Sapiens
LTLKEMEKL

SEQ ID NO: 358444 - protein, 9 aa, Homo Sapiens
SHKIIHTGE

SEQ ID NO: 358445 - protein, 9 aa, Homo Sapiens
KRKGGAMAL

SEQ ID NO: 358446 - protein, 9 aa, Homo Sapiens
SDLHSRNNM

SEQ ID NO: 358447 - protein, 9 aa, Homo Sapiens
PDDQESHAQ

SEQ ID NO: 358448 - protein, 9 aa, Homo Sapiens
LEPGVFVGV

SEQ ID NO: 358449 - protein, 9 aa, Homo Sapiens
EFSLFYDQD

SEQ ID NO: 358450 - protein, 9 aa, Homo Sapiens
IGYPNEWYL

SEQ ID NO: 358451 - protein, 9 aa, Homo Sapiens
VKQASIQHI

SEQ ID NO: 358452 - protein, 9 aa, Homo Sapiens
YGKNGQVVC

SEQ ID NO: 358453 - protein, 9 aa, Homo Sapiens
KKHQNHYRV

SEQ ID NO: 358454 - protein, 9 aa, Homo Sapiens
AQHRLSEAL

SEQ ID NO: 358455 - protein, 9 aa, Homo Sapiens
QNAAWRKRG

SEQ ID NO: 358456 - protein, 9 aa, Homo Sapiens
QKFVFSLAA

SEQ ID NO: 358457 - protein, 9 aa, Homo Sapiens
TLQGLVSPS

SEQ ID NO: 358458 - protein, 9 aa, Homo Sapiens
LKAYYAFRI

SEQ ID NO: 358459 - protein, 9 aa, Homo Sapiens
KAAEDCFQE

SEQ ID NO: 358460 - protein, 9 aa, Homo Sapiens
WRLFSLQLL

SEQ ID NO: 358461 - protein, 9 aa, Homo Sapiens
FEPPSWRKI

SEQ ID NO: 358462 - protein, 9 aa, Homo Sapiens
YSIYPMHNL

SEQ ID NO: 358463 - protein, 9 aa, Homo Sapiens
SRHNAEILF

SEQ ID NO: 358464 - protein, 9 aa, Homo Sapiens
QGYLCPSGL

SEQ ID NO: 358465 - protein, 9 aa, Homo Sapiens
QMAVCEKVF

SEQ ID NO: 358466 - protein, 9 aa, Homo Sapiens
SMPSEQIIN

SEQ ID NO: 358467 - protein, 9 aa, Homo Sapiens
LNLTNHQRI

SEQ ID NO: 358468 - protein, 9 aa, Homo Sapiens
RVWHDKDND

SEQ ID NO: 358469 - protein, 9 aa, Homo Sapiens
SYTFEKNFS

SEQ ID NO: 358470 - protein, 9 aa, Homo Sapiens
ENMAYVAVA

SEQ ID NO: 358471 - protein, 9 aa, Homo Sapiens
TDICVGPEE

SEQ ID NO: 358472 - protein, 9 aa, Homo Sapiens
GQLVKKIWV

SEQ ID NO: 358473 - protein, 9 aa, Homo Sapiens
FPGIKLIYN

SEQ ID NO: 358474 - protein, 9 aa, Homo Sapiens
MYVAETVLA

SEQ ID NO: 358475 - protein, 9 aa, Homo Sapiens
PFVPGKTSR

SEQ ID NO: 358476 - protein, 9 aa, Homo Sapiens
GMHPEEHFI

SEQ ID NO: 358477 - protein, 9 aa, Homo Sapiens
ENNEKRQKL

SEQ ID NO: 358478 - protein, 9 aa, Homo Sapiens
ALYIYEYLL

SEQ ID NO: 358479 - protein, 9 aa, Homo Sapiens
GVVATPGTN

SEQ ID NO: 358480 - protein, 9 aa, Homo Sapiens
PDIPKTLGI

SEQ ID NO: 358481 - protein, 9 aa, Homo Sapiens
LKAKLCSTV

SEQ ID NO: 358482 - protein, 9 aa, Homo Sapiens
QLTNIHRQI

SEQ ID NO: 358483 - protein, 9 aa, Homo Sapiens
LFHEQSNKC

SEQ ID NO: 358484 - protein, 9 aa, Homo Sapiens
TLKSATAIA

SEQ ID NO: 358485 - protein, 9 aa, Homo Sapiens
VQTELLTLP

SEQ ID NO: 358486 - protein, 9 aa, Homo Sapiens
TLLDSPYAQ

SEQ ID NO: 358487 - protein, 9 aa, Homo Sapiens
VAVSVILLL

SEQ ID NO: 358488 - protein, 9 aa, Homo Sapiens
LAVNWLLER

SEQ ID NO: 358489 - protein, 9 aa, Homo Sapiens
KTRSFHHKL

SEQ ID NO: 358490 - protein, 9 aa, Homo Sapiens
DQRSCRAIV

SEQ ID NO: 358491 - protein, 9 aa, Homo Sapiens
PQFPDTLSY

SEQ ID NO: 358492 - protein, 9 aa, Homo Sapiens
TLGVLNLQY

SEQ ID NO: 358493 - protein, 9 aa, Homo Sapiens
TGCSKTPKN

SEQ ID NO: 358494 - protein, 9 aa, Homo Sapiens
KYLEYLLMA

SEQ ID NO: 358495 - protein, 9 aa, Homo Sapiens
ETWDNLTIL

SEQ ID NO: 358496 - protein, 9 aa, Homo Sapiens
DNSTASEVL

SEQ ID NO: 358497 - protein, 9 aa, Homo Sapiens
SKQEGIIYV

SEQ ID NO: 358498 - protein, 9 aa, Homo Sapiens
IMENTYTRS

SEQ ID NO: 358499 - protein, 9 aa, Homo Sapiens
DKQYKHQLE

SEQ ID NO: 358500 - protein, 9 aa, Homo Sapiens
LIEEELKKQ

SEQ ID NO: 358501 - protein, 9 aa, Homo Sapiens
DETIIIVHS

SEQ ID NO: 358502 - protein, 9 aa, Homo Sapiens
NGQAFPLPR

SEQ ID NO: 358503 - protein, 9 aa, Homo Sapiens
FINELVIFI

SEQ ID NO: 358504 - protein, 9 aa, Homo Sapiens
DNKGLELDI

SEQ ID NO: 358505 - protein, 9 aa, Homo Sapiens
RSPSPLVYL

SEQ ID NO: 358506 - protein, 9 aa, Homo Sapiens
VCGNITVYE

SEQ ID NO: 358507 - protein, 9 aa, Homo Sapiens
HFIIYLIPR

SEQ ID NO: 358508 - protein, 9 aa, Homo Sapiens
LQLLSETTS

SEQ ID NO: 358509 - protein, 9 aa, Homo Sapiens
LNEKQRMEL

SEQ ID NO: 358510 - protein, 9 aa, Homo Sapiens
KEIAKRKEV

SEQ ID NO: 358511 - protein, 9 aa, Homo Sapiens
INLMRSGVF

SEQ ID NO: 358512 - protein, 9 aa, Homo Sapiens
RMWNYTVRK

SEQ ID NO: 358513 - protein, 9 aa, Homo Sapiens
ASSLGERLE

SEQ ID NO: 358514 - protein, 9 aa, Homo Sapiens
IIRGEQVNI

SEQ ID NO: 358515 - protein, 9 aa, Homo Sapiens
LNKYENGEF

SEQ ID NO: 358516 - protein, 9 aa, Homo Sapiens
PDEGIKYLV

SEQ ID NO: 358517 - protein, 9 aa, Homo Sapiens
CIPSNPSHR

SEQ ID NO: 358518 - protein, 9 aa, Homo Sapiens
AFLQPIQDV

SEQ ID NO: 358519 - protein, 9 aa, Homo Sapiens
TAAATKTIK

SEQ ID NO: 358520 - protein, 9 aa, Homo Sapiens
QVNGEHTER

SEQ ID NO: 358521 - protein, 9 aa, Homo Sapiens
FGDAFQSHT

SEQ ID NO: 358522 - protein, 9 aa, Homo Sapiens
CINCGKAFS

SEQ ID NO: 358523 - protein, 9 aa, Homo Sapiens
TPKHQNELR

SEQ ID NO: 358524 - protein, 9 aa, Homo Sapiens
SHPWHWHFS

SEQ ID NO: 358525 - protein, 9 aa, Homo Sapiens
QPDATKVLI

SEQ ID NO: 358526 - protein, 9 aa, Homo Sapiens
IDIGTLNGI

SEQ ID NO: 358527 - protein, 9 aa, Homo Sapiens
GVRLAAKYL

SEQ ID NO: 358528 - protein, 9 aa, Homo Sapiens
QYSGQLHKV

SEQ ID NO: 358529 - protein, 9 aa, Homo Sapiens
PFYHSAVLL

SEQ ID NO: 358530 - protein, 9 aa, Homo Sapiens
MPFKIIYDD

SEQ ID NO: 358531 - protein, 9 aa, Homo Sapiens
DIPKTLGII

SEQ ID NO: 358532 - protein, 9 aa, Homo Sapiens
TMNGIIKSL

SEQ ID NO: 358533 - protein, 9 aa, Homo Sapiens
EDSDTPAEE

SEQ ID NO: 358534 - protein, 9 aa, Homo Sapiens
FFLYEEFPG

SEQ ID NO: 358535 - protein, 9 aa, Homo Sapiens
GDKPYKCSE

SEQ ID NO: 358536 - protein, 9 aa, Homo Sapiens
ILEIEYLEK

SEQ ID NO: 358537 - protein, 9 aa, Homo Sapiens
HRNAVIVAK

SEQ ID NO: 358538 - protein, 9 aa, Homo Sapiens
KCGKSFSFR

SEQ ID NO: 358539 - protein, 9 aa, Homo Sapiens
ALEFSLFYD

SEQ ID NO: 358540 - protein, 9 aa, Homo Sapiens
SNLTRHQII

SEQ ID NO: 358541 - protein, 9 aa, Homo Sapiens
PPTQGLENS

SEQ ID NO: 358542 - protein, 9 aa, Homo Sapiens
CLFLACPAT

SEQ ID NO: 358543 - protein, 9 aa, Homo Sapiens
RFSSEYPEL

SEQ ID NO: 358544 - protein, 9 aa, Homo Sapiens
IQILAIKST

SEQ ID NO: 358545 - protein, 9 aa, Homo Sapiens
FLASQEFDF

SEQ ID NO: 358546 - protein, 9 aa, Homo Sapiens
NRLFLWIFV

SEQ ID NO: 358547 - protein, 9 aa, Homo Sapiens
KCGNSFRGK

SEQ ID NO: 358548 - protein, 9 aa, Homo Sapiens
RERRYKCKQ

SEQ ID NO: 358549 - protein, 9 aa, Homo Sapiens
SLSEISNPK

SEQ ID NO: 358550 - protein, 9 aa, Homo Sapiens
SQSDKHTVM

SEQ ID NO: 358551 - protein, 9 aa, Homo Sapiens
KQELQPFNR

SEQ ID NO: 358552 - protein, 9 aa, Homo Sapiens
VNPYDMPGT

SEQ ID NO: 358553 - protein, 9 aa, Homo Sapiens
SQNSDLLKL

SEQ ID NO: 358554 - protein, 9 aa, Homo Sapiens
TFLRICSKK

SEQ ID NO: 358555 - protein, 9 aa, Homo Sapiens
TFCIDNKAL

SEQ ID NO: 358556 - protein, 9 aa, Homo Sapiens
TIGVIDKKK

SEQ ID NO: 358557 - protein, 9 aa, Homo Sapiens
TTNNKEVNA

SEQ ID NO: 358558 - protein, 9 aa, Homo Sapiens
LMGKIFQTW

SEQ ID NO: 358559 - protein, 9 aa, Homo Sapiens
EEPGASMDD

SEQ ID NO: 358560 - protein, 9 aa, Homo Sapiens
HKRNHTQNK

SEQ ID NO: 358561 - protein, 9 aa, Homo Sapiens
STMIKLPGF

SEQ ID NO: 358562 - protein, 9 aa, Homo Sapiens
INIESKFAL

SEQ ID NO: 358563 - protein, 9 aa, Homo Sapiens
IQNVLVDAS

SEQ ID NO: 358564 - protein, 9 aa, Homo Sapiens
DMDDKDNAH

SEQ ID NO: 358565 - protein, 9 aa, Homo Sapiens
WCKALPTCG

SEQ ID NO: 358566 - protein, 9 aa, Homo Sapiens
SCSHPQLCV

SEQ ID NO: 358567 - protein, 9 aa, Homo Sapiens
SKFTLERNP

SEQ ID NO: 358568 - protein, 9 aa, Homo Sapiens
EGKMGDEEA

SEQ ID NO: 358569 - protein, 9 aa, Homo Sapiens
ISLEEEEGL

SEQ ID NO: 358570 - protein, 9 aa, Homo Sapiens
NYALTILQF

SEQ ID NO: 358571 - protein, 9 aa, Homo Sapiens
NLKQIHSAA

SEQ ID NO: 358572 - protein, 9 aa, Homo Sapiens
QFIANHPFM

SEQ ID NO: 358573 - protein, 9 aa, Homo Sapiens
VRKLKLFFS

SEQ ID NO: 358574 - protein, 9 aa, Homo Sapiens
EYQSGWGTQ

SEQ ID NO: 358575 - protein, 9 aa, Homo Sapiens
HFSIDQNTG

SEQ ID NO: 358576 - protein, 9 aa, Homo Sapiens
FENVKVFES

SEQ ID NO: 358577 - protein, 9 aa, Homo Sapiens
IQDINNNPP

SEQ ID NO: 358578 - protein, 9 aa, Homo Sapiens
QDGGGGPGS

SEQ ID NO: 358579 - protein, 9 aa, Homo Sapiens
SFQHKWFEV

SEQ ID NO: 358580 - protein, 9 aa, Homo Sapiens
PETAATLKH

SEQ ID NO: 358581 - protein, 9 aa, Homo Sapiens
LLSVSPVEF

SEQ ID NO: 358582 - protein, 9 aa, Homo Sapiens
ESTVDQKNN

SEQ ID NO: 358583 - protein, 9 aa, Homo Sapiens
HSSLVMLNE

SEQ ID NO: 358584 - protein, 9 aa, Homo Sapiens
LSEIETVHG

SEQ ID NO: 358585 - protein, 9 aa, Homo Sapiens
PADIKETMT

SEQ ID NO: 358586 - protein, 9 aa, Homo Sapiens
TMIRGMMDE

SEQ ID NO: 358587 - protein, 9 aa, Homo Sapiens
HNIIMVLKD

SEQ ID NO: 358588 - protein, 9 aa, Homo Sapiens
KKGLNSGGH

SEQ ID NO: 358589 - protein, 9 aa, Homo Sapiens
VLLSASLSE

SEQ ID NO: 358590 - protein, 9 aa, Homo Sapiens
GYDHYVAIC

SEQ ID NO: 358591 - protein, 9 aa, Homo Sapiens
SGLLKLLAR

SEQ ID NO: 358592 - protein, 9 aa, Homo Sapiens
EAYISFMFV

SEQ ID NO: 358593 - protein, 9 aa, Homo Sapiens
GLELDIIPA

SEQ ID NO: 358594 - protein, 9 aa, Homo Sapiens
LNEHKIIHA

SEQ ID NO: 358595 - protein, 9 aa, Homo Sapiens
HLSNGVAIH

SEQ ID NO: 358596 - protein, 9 aa, Homo Sapiens
KDVFSKYGN

SEQ ID NO: 358597 - protein, 9 aa, Homo Sapiens
RNGDASSSQ

SEQ ID NO: 358598 - protein, 9 aa, Homo Sapiens
NPEKTAAAT

SEQ ID NO: 358599 - protein, 9 aa, Homo Sapiens
TSPPERAVL

SEQ ID NO: 358600 - protein, 9 aa, Homo Sapiens
CTTCQILCM

SEQ ID NO: 358601 - protein, 9 aa, Homo Sapiens
RRLENNHPL

SEQ ID NO: 358602 - protein, 9 aa, Homo Sapiens
SRLHLPEMV

SEQ ID NO: 358603 - protein, 9 aa, Homo Sapiens
MEVEGGDKL

SEQ ID NO: 358604 - protein, 9 aa, Homo Sapiens
HLNRALYFT

SEQ ID NO: 358605 - protein, 9 aa, Homo Sapiens
HPKTQQYVR

SEQ ID NO: 358606 - protein, 9 aa, Homo Sapiens
NYWDSESPC

SEQ ID NO: 358607 - protein, 9 aa, Homo Sapiens
LPCCARFQC

SEQ ID NO: 358608 - protein, 9 aa, Homo Sapiens
KSKAEMSHA

SEQ ID NO: 358609 - protein, 9 aa, Homo Sapiens
GTKAPWGTL

SEQ ID NO: 358610 - protein, 9 aa, Homo Sapiens
IVCWSVLKR

SEQ ID NO: 358611 - protein, 9 aa, Homo Sapiens
TVINEDKWK

SEQ ID NO: 358612 - protein, 9 aa, Homo Sapiens
GNVMRKFHG

SEQ ID NO: 358613 - protein, 9 aa, Homo Sapiens
IIKSLILPG

SEQ ID NO: 358614 - protein, 9 aa, Homo Sapiens
QGKESTRQQ

SEQ ID NO: 358615 - protein, 9 aa, Homo Sapiens
KTRNLDPEN

SEQ ID NO: 358616 - protein, 9 aa, Homo Sapiens
RCKSGYTGQ

SEQ ID NO: 358617 - protein, 9 aa, Homo Sapiens
QYKADLAWI

SEQ ID NO: 358618 - protein, 9 aa, Homo Sapiens
TSCAFPGLT

SEQ ID NO: 358619 - protein, 9 aa, Homo Sapiens
NFGFARTLA

SEQ ID NO: 358620 - protein, 9 aa, Homo Sapiens
IFKRIQSQT

SEQ ID NO: 358621 - protein, 9 aa, Homo Sapiens
KRAIQTGKE

SEQ ID NO: 358622 - protein, 9 aa, Homo Sapiens
IMVEVYLQK

SEQ ID NO: 358623 - protein, 9 aa, Homo Sapiens
ALALCCMQP

SEQ ID NO: 358624 - protein, 9 aa, Homo Sapiens
NHTYRIDDV

SEQ ID NO: 358625 - protein, 9 aa, Homo Sapiens
NGEFWFSLE

SEQ ID NO: 358626 - protein, 9 aa, Homo Sapiens
HYPIHMRKR

SEQ ID NO: 358627 - protein, 9 aa, Homo Sapiens
LPFLRIGLS

SEQ ID NO: 358628 - protein, 9 aa, Homo Sapiens
TGGIYPSVE

SEQ ID NO: 358629 - protein, 9 aa, Homo Sapiens
HEKHKKSFL

SEQ ID NO: 358630 - protein, 9 aa, Homo Sapiens
ALQNAASVM

SEQ ID NO: 358631 - protein, 9 aa, Homo Sapiens
KFTLERNPI

SEQ ID NO: 358632 - protein, 9 aa, Homo Sapiens
LKRLEKLLT

SEQ ID NO: 358633 - protein, 9 aa, Homo Sapiens
EILEKSGQI

SEQ ID NO: 358634 - protein, 9 aa, Homo Sapiens
ISIISHECT

SEQ ID NO: 358635 - protein, 9 aa, Homo Sapiens
LPVLNPSGD

SEQ ID NO: 358636 - protein, 9 aa, Homo Sapiens
RAGVNKDYE

SEQ ID NO: 358637 - protein, 9 aa, Homo Sapiens
IKFVPNETY

SEQ ID NO: 358638 - protein, 9 aa, Homo Sapiens
CLAPLVPED

SEQ ID NO: 358639 - protein, 9 aa, Homo Sapiens
VFISPESPT

SEQ ID NO: 358640 - protein, 9 aa, Homo Sapiens
LTVKHNQNH

SEQ ID NO: 358641 - protein, 9 aa, Homo Sapiens
QIIAEAEKK

SEQ ID NO: 358642 - protein, 9 aa, Homo Sapiens
STAHKNFIL

SEQ ID NO: 358643 - protein, 9 aa, Homo Sapiens
VSKHQITHE

SEQ ID NO: 358644 - protein, 9 aa, Homo Sapiens
GASEGIKCY

SEQ ID NO: 358645 - protein, 9 aa, Homo Sapiens
FLLITITLG

SEQ ID NO: 358646 - protein, 9 aa, Homo Sapiens
LEDEIEHLQ

SEQ ID NO: 358647 - protein, 9 aa, Homo Sapiens
LQSNLISKV

SEQ ID NO: 358648 - protein, 9 aa, Homo Sapiens
LTEEDYKLA

SEQ ID NO: 358649 - protein, 9 aa, Homo Sapiens
IIRNGAARP

SEQ ID NO: 358650 - protein, 9 aa, Homo Sapiens
REGFDKNEI

SEQ ID NO: 358651 - protein, 9 aa, Homo Sapiens
ERSKLIRDS

SEQ ID NO: 358652 - protein, 9 aa, Homo Sapiens
NSPISHLPS

SEQ ID NO: 358653 - protein, 9 aa, Homo Sapiens
VEVIVIISH

SEQ ID NO: 358654 - protein, 9 aa, Homo Sapiens
DGNATLPFV

SEQ ID NO: 358655 - protein, 9 aa, Homo Sapiens
TANTTFCFD

SEQ ID NO: 358656 - protein, 9 aa, Homo Sapiens
PRQPTYVQA

SEQ ID NO: 358657 - protein, 9 aa, Homo Sapiens
ICRMHSAEG

SEQ ID NO: 358658 - protein, 9 aa, Homo Sapiens
FVRRQNPQM

SEQ ID NO: 358659 - protein, 9 aa, Homo Sapiens
ILVTDTRVQ

SEQ ID NO: 358660 - protein, 9 aa, Homo Sapiens
TVESANNSV

SEQ ID NO: 358661 - protein, 9 aa, Homo Sapiens
IDIPMDPSI

SEQ ID NO: 358662 - protein, 9 aa, Homo Sapiens
HQWWNRVCG

SEQ ID NO: 358663 - protein, 9 aa, Homo Sapiens
GFVKLFTNA

SEQ ID NO: 358664 - protein, 9 aa, Homo Sapiens
FKLMDVAPS

SEQ ID NO: 358665 - protein, 9 aa, Homo Sapiens
TNKMQKTLE

SEQ ID NO: 358666 - protein, 9 aa, Homo Sapiens
SSQEYDGNI

SEQ ID NO: 358667 - protein, 9 aa, Homo Sapiens
KSLYADNLP

SEQ ID NO: 358668 - protein, 9 aa, Homo Sapiens
LKKMLKSTS

SEQ ID NO: 358669 - protein, 9 aa, Homo Sapiens
DDSLDKFRI

SEQ ID NO: 358670 - protein, 9 aa, Homo Sapiens
QETLKECVQ

SEQ ID NO: 358671 - protein, 9 aa, Homo Sapiens
ALFKTWDLD

SEQ ID NO: 358672 - protein, 9 aa, Homo Sapiens
QMFVFAGLV

SEQ ID NO: 358673 - protein, 9 aa, Homo Sapiens
VVQTVGSRR

SEQ ID NO: 358674 - protein, 9 aa, Homo Sapiens
QPATKDKFA

SEQ ID NO: 358675 - protein, 9 aa, Homo Sapiens
SCTMKLNSL

SEQ ID NO: 358676 - protein, 9 aa, Homo Sapiens
DAHTAKVNC

SEQ ID NO: 358677 - protein, 9 aa, Homo Sapiens
DIYLSDWIF

SEQ ID NO: 358678 - protein, 9 aa, Homo Sapiens
VVCQPNELI

SEQ ID NO: 358679 - protein, 9 aa, Homo Sapiens
QVILQWKPN

SEQ ID NO: 358680 - protein, 9 aa, Homo Sapiens
TQLAGLQVF

SEQ ID NO: 358681 - protein, 9 aa, Homo Sapiens
DGICGQAYP

SEQ ID NO: 358682 - protein, 9 aa, Homo Sapiens
LYSLDVELI

SEQ ID NO: 358683 - protein, 9 aa, Homo Sapiens
YQVRACLAM

SEQ ID NO: 358684 - protein, 9 aa, Homo Sapiens
CFVNPAGEV

SEQ ID NO: 358685 - protein, 9 aa, Homo Sapiens
HPLLTRFFK

SEQ ID NO: 358686 - protein, 9 aa, Homo Sapiens
SGCGKLFRD

SEQ ID NO: 358687 - protein, 9 aa, Homo Sapiens
ELEAGTESE

SEQ ID NO: 358688 - protein, 9 aa, Homo Sapiens
GALIKDIWE

SEQ ID NO: 358689 - protein, 9 aa, Homo Sapiens
TGSLCEITT

SEQ ID NO: 358690 - protein, 9 aa, Homo Sapiens
VVPVEPTYT

SEQ ID NO: 358691 - protein, 9 aa, Homo Sapiens
TKVYKSLIT

SEQ ID NO: 358692 - protein, 9 aa, Homo Sapiens
SSLQYHKNL

SEQ ID NO: 358693 - protein, 9 aa, Homo Sapiens
KNKMKEQEY

SEQ ID NO: 358694 - protein, 9 aa, Homo Sapiens
TWKAETACR

SEQ ID NO: 358695 - protein, 9 aa, Homo Sapiens
ASYFLLHQI

SEQ ID NO: 358696 - protein, 9 aa, Homo Sapiens
GCHMRRNAF

SEQ ID NO: 358697 - protein, 9 aa, Homo Sapiens
NIQGVPQTI

SEQ ID NO: 358698 - protein, 9 aa, Homo Sapiens
KSEPYEKDG

SEQ ID NO: 358699 - protein, 9 aa, Homo Sapiens
YMGNTAVGK

SEQ ID NO: 358700 - protein, 9 aa, Homo Sapiens
KGKPLEKET

SEQ ID NO: 358701 - protein, 9 aa, Homo Sapiens
RFVLMFYKE

SEQ ID NO: 358702 - protein, 9 aa, Homo Sapiens
DLIDEFIKA

SEQ ID NO: 358703 - protein, 9 aa, Homo Sapiens
TLSVIATPR

SEQ ID NO: 358704 - protein, 9 aa, Homo Sapiens
NIFINLPRS

SEQ ID NO: 358705 - protein, 9 aa, Homo Sapiens
AWQKAQSDG

SEQ ID NO: 358706 - protein, 9 aa, Homo Sapiens
LGIVYLPTS

SEQ ID NO: 358707 - protein, 9 aa, Homo Sapiens
LDEKQLAEL

SEQ ID NO: 358708 - protein, 9 aa, Homo Sapiens
SREHSSHKL

SEQ ID NO: 358709 - protein, 9 aa, Homo Sapiens
RVFTVINQT

SEQ ID NO: 358710 - protein, 9 aa, Homo Sapiens
MVLKIKQTK

SEQ ID NO: 358711 - protein, 9 aa, Homo Sapiens
MWRRDHGPQ

SEQ ID NO: 358712 - protein, 9 aa, Homo Sapiens
VGKVVNSDR

SEQ ID NO: 358713 - protein, 9 aa, Homo Sapiens
NTTENINNT

SEQ ID NO: 358714 - protein, 9 aa, Homo Sapiens
SLGLKCGIC

SEQ ID NO: 358715 - protein, 9 aa, Homo Sapiens
CALCPKDVK

SEQ ID NO: 358716 - protein, 9 aa, Homo Sapiens
AHPEWEQKI

SEQ ID NO: 358717 - protein, 9 aa, Homo Sapiens
YFWEFSMES

SEQ ID NO: 358718 - protein, 9 aa, Homo Sapiens
FSEGNTEQL

SEQ ID NO: 358719 - protein, 9 aa, Homo Sapiens
QTFSKAEAP

SEQ ID NO: 358720 - protein, 9 aa, Homo Sapiens
KEHTDTFHF

SEQ ID NO: 358721 - protein, 9 aa, Homo Sapiens
KQMKVAKNA

SEQ ID NO: 358722 - protein, 9 aa, Homo Sapiens
WKMLYQDKL

SEQ ID NO: 358723 - protein, 9 aa, Homo Sapiens
RPRAVKVYA

SEQ ID NO: 358724 - protein, 9 aa, Homo Sapiens
ARSAEKTKT

SEQ ID NO: 358725 - protein, 9 aa, Homo Sapiens
KRDSWKSSG

SEQ ID NO: 358726 - protein, 9 aa, Homo Sapiens
SSRREQMTD

SEQ ID NO: 358727 - protein, 9 aa, Homo Sapiens
CVHWRRETE

SEQ ID NO: 358728 - protein, 9 aa, Homo Sapiens
DNAAALEEL

SEQ ID NO: 358729 - protein, 9 aa, Homo Sapiens
MFFLIDKGN

SEQ ID NO: 358730 - protein, 9 aa, Homo Sapiens
HVHCVFNAS

SEQ ID NO: 358731 - protein, 9 aa, Homo Sapiens
MAQEDSRHG

SEQ ID NO: 358732 - protein, 9 aa, Homo Sapiens
NCGKAFSDH

SEQ ID NO: 358733 - protein, 9 aa, Homo Sapiens
QGIHAELLP

SEQ ID NO: 358734 - protein, 9 aa, Homo Sapiens
SELQRVAHY

SEQ ID NO: 358735 - protein, 9 aa, Homo Sapiens
VTDSNHSIA

SEQ ID NO: 358736 - protein, 9 aa, Homo Sapiens
HQRVNSGER

SEQ ID NO: 358737 - protein, 9 aa, Homo Sapiens
HLEQCSIKA

SEQ ID NO: 358738 - protein, 9 aa, Homo Sapiens
KGIQFSKGK

SEQ ID NO: 358739 - protein, 9 aa, Homo Sapiens
TDINSSKTV

SEQ ID NO: 358740 - protein, 9 aa, Homo Sapiens
LSLSQTPAD

SEQ ID NO: 358741 - protein, 9 aa, Homo Sapiens
VDIQEKNNM

SEQ ID NO: 358742 - protein, 9 aa, Homo Sapiens
CHHMKVVVC

SEQ ID NO: 358743 - protein, 9 aa, Homo Sapiens
TTTVSEVSV

SEQ ID NO: 358744 - protein, 9 aa, Homo Sapiens
DLKAKLCST

SEQ ID NO: 358745 - protein, 9 aa, Homo Sapiens
YPALAPWPP

SEQ ID NO: 358746 - protein, 9 aa, Homo Sapiens
VKYLKEDDA

SEQ ID NO: 358747 - protein, 9 aa, Homo Sapiens
VENGVGVPA

SEQ ID NO: 358748 - protein, 9 aa, Homo Sapiens
FKIIYDDGK

SEQ ID NO: 358749 - protein, 9 aa, Homo Sapiens
QPERICQRT

SEQ ID NO: 358750 - protein, 9 aa, Homo Sapiens
MIIWINEIL

SEQ ID NO: 358751 - protein, 9 aa, Homo Sapiens
FSRSTYFQV

SEQ ID NO: 358752 - protein, 9 aa, Homo Sapiens
ASRFQMPVS

SEQ ID NO: 358753 - protein, 9 aa, Homo Sapiens
LKQPRSCLF

SEQ ID NO: 358754 - protein, 9 aa, Homo Sapiens
QKRNNRRKN

SEQ ID NO: 358755 - protein, 9 aa, Homo Sapiens
VESPARVRS

SEQ ID NO: 358756 - protein, 9 aa, Homo Sapiens
YQAFHGLAG

SEQ ID NO: 358757 - protein, 9 aa, Homo Sapiens
ICPTKDVRP

SEQ ID NO: 358758 - protein, 9 aa, Homo Sapiens
EPPIAALAQ

SEQ ID NO: 358759 - protein, 9 aa, Homo Sapiens
NTFFWQAHT

SEQ ID NO: 358760 - protein, 9 aa, Homo Sapiens
LEKEEASHI

SEQ ID NO: 358761 - protein, 9 aa, Homo Sapiens
KHGKNVPKY

SEQ ID NO: 358762 - protein, 9 aa, Homo Sapiens
HQWDKIPLS

SEQ ID NO: 358763 - protein, 9 aa, Homo Sapiens
AWIVVVLQA

SEQ ID NO: 358764 - protein, 9 aa, Homo Sapiens
KLIYNAGVA

SEQ ID NO: 358765 - protein, 9 aa, Homo Sapiens
RTKAYLTCS

SEQ ID NO: 358766 - protein, 9 aa, Homo Sapiens
VPGQTQLLE

SEQ ID NO: 358767 - protein, 9 aa, Homo Sapiens
APQISLAEM

SEQ ID NO: 358768 - protein, 9 aa, Homo Sapiens
TDEERAREI

SEQ ID NO: 358769 - protein, 9 aa, Homo Sapiens
VDTSEMVND

SEQ ID NO: 358770 - protein, 9 aa, Homo Sapiens
YTLMDLLKK

SEQ ID NO: 358771 - protein, 9 aa, Homo Sapiens
KWTNNYSMV

SEQ ID NO: 358772 - protein, 9 aa, Homo Sapiens
AAEDCFQER

SEQ ID NO: 358773 - protein, 9 aa, Homo Sapiens
QKMPEIRMV

SEQ ID NO: 358774 - protein, 9 aa, Homo Sapiens
DEDPLQPPP

SEQ ID NO: 358775 - protein, 9 aa, Homo Sapiens
QNNTRVIQL

SEQ ID NO: 358776 - protein, 9 aa, Homo Sapiens
APWGTLSRS

SEQ ID NO: 358777 - protein, 9 aa, Homo Sapiens
VKTFCWSTN

SEQ ID NO: 358778 - protein, 9 aa, Homo Sapiens
FSIQIMKTP

SEQ ID NO: 358779 - protein, 9 aa, Homo Sapiens
RKFTQERNR

SEQ ID NO: 358780 - protein, 9 aa, Homo Sapiens
FDSRSKYLP

SEQ ID NO: 358781 - protein, 9 aa, Homo Sapiens
FPIVMRLER

SEQ ID NO: 358782 - protein, 9 aa, Homo Sapiens
VTAKTKAGA

SEQ ID NO: 358783 - protein, 9 aa, Homo Sapiens
TFFRFPLHL

SEQ ID NO: 358784 - protein, 9 aa, Homo Sapiens
RTLTLGVLN

SEQ ID NO: 358785 - protein, 9 aa, Homo Sapiens
LGIPHLSSS

SEQ ID NO: 358786 - protein, 9 aa, Homo Sapiens
RGDIPSEAS

SEQ ID NO: 358787 - protein, 9 aa, Homo Sapiens
IPEGERVYF

SEQ ID NO: 358788 - protein, 9 aa, Homo Sapiens
YFITPCVCI

SEQ ID NO: 358789 - protein, 9 aa, Homo Sapiens
INTGEKLYK

SEQ ID NO: 358790 - protein, 9 aa, Homo Sapiens
FLLGCVKNG

SEQ ID NO: 358791 - protein, 9 aa, Homo Sapiens
FIFEWWCFH

SEQ ID NO: 358792 - protein, 9 aa, Homo Sapiens
ELKKQLRKK

SEQ ID NO: 358793 - protein, 9 aa, Homo Sapiens
NLCLPGSSY

SEQ ID NO: 358794 - protein, 9 aa, Homo Sapiens
NENVLGAQL

SEQ ID NO: 358795 - protein, 9 aa, Homo Sapiens
KCVKPLGLE

SEQ ID NO: 358796 - protein, 9 aa, Homo Sapiens
DNNQTLDFK

SEQ ID NO: 358797 - protein, 9 aa, Homo Sapiens
EPEPPRQFF

SEQ ID NO: 358798 - protein, 9 aa, Homo Sapiens
KRSNSLWLE

SEQ ID NO: 358799 - protein, 9 aa, Homo Sapiens
VAGGTNSCI

SEQ ID NO: 358800 - protein, 9 aa, Homo Sapiens
CMVNMKSKE

SEQ ID NO: 358801 - protein, 9 aa, Homo Sapiens
MQKHYFMLW

SEQ ID NO: 358802 - protein, 9 aa, Homo Sapiens
DSLGPSIFR

SEQ ID NO: 358803 - protein, 9 aa, Homo Sapiens
RENDLLRKG

SEQ ID NO: 358804 - protein, 9 aa, Homo Sapiens
NNTRVIQLN

SEQ ID NO: 358805 - protein, 9 aa, Homo Sapiens
LTNGNTLWR

SEQ ID NO: 358806 - protein, 9 aa, Homo Sapiens
VLCDQRAID

SEQ ID NO: 358807 - protein, 9 aa, Homo Sapiens
DDLKNPRVG

SEQ ID NO: 358808 - protein, 9 aa, Homo Sapiens
TQDAEKCVS

SEQ ID NO: 358809 - protein, 9 aa, Homo Sapiens
PNHLFCESQ

SEQ ID NO: 358810 - protein, 9 aa, Homo Sapiens
FQPELSVPD

SEQ ID NO: 358811 - protein, 9 aa, Homo Sapiens
LFSLQLLSE

SEQ ID NO: 358812 - protein, 9 aa, Homo Sapiens
VLNTLFMVL

SEQ ID NO: 358813 - protein, 9 aa, Homo Sapiens
NIVFTWTKH

SEQ ID NO: 358814 - protein, 9 aa, Homo Sapiens
QQTLDTPNT

SEQ ID NO: 358815 - protein, 9 aa, Homo Sapiens
ARHLYWDDL

SEQ ID NO: 358816 - protein, 9 aa, Homo Sapiens
VFVFESMLP

SEQ ID NO: 358817 - protein, 9 aa, Homo Sapiens
ASGKSAQIP

SEQ ID NO: 358818 - protein, 9 aa, Homo Sapiens
ESESAATCL

SEQ ID NO: 358819 - protein, 9 aa, Homo Sapiens
NLFIFLGGA

SEQ ID NO: 358820 - protein, 9 aa, Homo Sapiens
HNLTNLLIA

SEQ ID NO: 358821 - protein, 9 aa, Homo Sapiens
QYLLNVFVF

SEQ ID NO: 358822 - protein, 9 aa, Homo Sapiens
SRFIVITDF

SEQ ID NO: 358823 - protein, 9 aa, Homo Sapiens
YGSCVQHQK

SEQ ID NO: 358824 - protein, 9 aa, Homo Sapiens
IYLGFEHSE

SEQ ID NO: 358825 - protein, 9 aa, Homo Sapiens
MFAGINSLL

SEQ ID NO: 358826 - protein, 9 aa, Homo Sapiens
WYWKVEVAK

SEQ ID NO: 358827 - protein, 9 aa, Homo Sapiens
DLLSDQNKQ

SEQ ID NO: 358828 - protein, 9 aa, Homo Sapiens
REPIPGEFE

SEQ ID NO: 358829 - protein, 9 aa, Homo Sapiens
GKIFQTWFE

SEQ ID NO: 358830 - protein, 9 aa, Homo Sapiens
ITVTALLWM

SEQ ID NO: 358831 - protein, 9 aa, Homo Sapiens
ERAEAEQQR

SEQ ID NO: 358832 - protein, 9 aa, Homo Sapiens
QRVREEEIE

SEQ ID NO: 358833 - protein, 9 aa, Homo Sapiens
GKIHDHAIL

SEQ ID NO: 358834 - protein, 9 aa, Homo Sapiens
NTHLNKCAI

SEQ ID NO: 358835 - protein, 9 aa, Homo Sapiens
AGPQTYKDH

SEQ ID NO: 358836 - protein, 9 aa, Homo Sapiens
IGCVAPQCK

SEQ ID NO: 358837 - protein, 9 aa, Homo Sapiens
VVATPGTNM

SEQ ID NO: 358838 - protein, 9 aa, Homo Sapiens
QFSKGKYKC

SEQ ID NO: 358839 - protein, 9 aa, Homo Sapiens
FGVDQFCLG

SEQ ID NO: 358840 - protein, 9 aa, Homo Sapiens
CINTTNGSR

SEQ ID NO: 358841 - protein, 9 aa, Homo Sapiens
FQTFWCLYH

SEQ ID NO: 358842 - protein, 9 aa, Homo Sapiens
PDLITVTKE

SEQ ID NO: 358843 - protein, 9 aa, Homo Sapiens
QSGWGTQVF

SEQ ID NO: 358844 - protein, 9 aa, Homo Sapiens
SEILNRFQK

SEQ ID NO: 358845 - protein, 9 aa, Homo Sapiens
ILEAQGDTW

SEQ ID NO: 358846 - protein, 9 aa, Homo Sapiens
FVLVPLRGL

SEQ ID NO: 358847 - protein, 9 aa, Homo Sapiens
RKSPVFSDD

SEQ ID NO: 358848 - protein, 9 aa, Homo Sapiens
SLSQSGSDS

SEQ ID NO: 358849 - protein, 9 aa, Homo Sapiens
AGDVGKSAL

SEQ ID NO: 358850 - protein, 9 aa, Homo Sapiens
QLGQQFRGR

SEQ ID NO: 358851 - protein, 9 aa, Homo Sapiens
FQSVGSSLT

SEQ ID NO: 358852 - protein, 9 aa, Homo Sapiens
YLSGDITIL

SEQ ID NO: 358853 - protein, 9 aa, Homo Sapiens
IIKIEGNRL

SEQ ID NO: 358854 - protein, 9 aa, Homo Sapiens
EKLIEKGVS

SEQ ID NO: 358855 - protein, 9 aa, Homo Sapiens
NILVRVTRA

SEQ ID NO: 358856 - protein, 9 aa, Homo Sapiens
VSHLIIHTG

SEQ ID NO: 358857 - protein, 9 aa, Homo Sapiens
EEGSESESW

SEQ ID NO: 358858 - protein, 9 aa, Homo Sapiens
RLKFENELV

SEQ ID NO: 358859 - protein, 9 aa, Homo Sapiens
TVLIQDINN

SEQ ID NO: 358860 - protein, 9 aa, Homo Sapiens
TRKFVFQPE

SEQ ID NO: 358861 - protein, 9 aa, Homo Sapiens
TSLIEVYMR

SEQ ID NO: 358862 - protein, 9 aa, Homo Sapiens
IRYNDMFEM

SEQ ID NO: 358863 - protein, 9 aa, Homo Sapiens
KFWDLEADS

SEQ ID NO: 358864 - protein, 9 aa, Homo Sapiens
TLLSANTSQ

SEQ ID NO: 358865 - protein, 9 aa, Homo Sapiens
NFKCRFSLS

SEQ ID NO: 358866 - protein, 9 aa, Homo Sapiens
MYPYGYTTE

SEQ ID NO: 358867 - protein, 9 aa, Homo Sapiens
ENERPNSSH

SEQ ID NO: 358868 - protein, 9 aa, Homo Sapiens
YVNRPFPVL

SEQ ID NO: 358869 - protein, 9 aa, Homo Sapiens
EYRYVAQAS

SEQ ID NO: 358870 - protein, 9 aa, Homo Sapiens
LLDSRERGG

SEQ ID NO: 358871 - protein, 9 aa, Homo Sapiens
FIKAITDRY

SEQ ID NO: 358872 - protein, 9 aa, Homo Sapiens
RGFSSKYPD

SEQ ID NO: 358873 - protein, 9 aa, Homo Sapiens
GSHPWHWHF

SEQ ID NO: 358874 - protein, 9 aa, Homo Sapiens
ISWFNNGLD

SEQ ID NO: 358875 - protein, 9 aa, Homo Sapiens
TPVTNLTSS

SEQ ID NO: 358876 - protein, 9 aa, Homo Sapiens
SWKSSGFLN

SEQ ID NO: 358877 - protein, 9 aa, Homo Sapiens
LIEDDSEVN

SEQ ID NO: 358878 - protein, 9 aa, Homo Sapiens
QMYKLAKKG

SEQ ID NO: 358879 - protein, 9 aa, Homo Sapiens
AMNTLRNKM

SEQ ID NO: 358880 - protein, 9 aa, Homo Sapiens
LGYSYAINL

SEQ ID NO: 358881 - protein, 9 aa, Homo Sapiens
LFARLLFND

SEQ ID NO: 358882 - protein, 9 aa, Homo Sapiens
KGSRNNTDK

SEQ ID NO: 358883 - protein, 9 aa, Homo Sapiens
FKSDIWPLG

SEQ ID NO: 358884 - protein, 9 aa, Homo Sapiens
QQYVRADVE

SEQ ID NO: 358885 - protein, 9 aa, Homo Sapiens
ERRQEEHER

SEQ ID NO: 358886 - protein, 9 aa, Homo Sapiens
TLQGSAPRE

SEQ ID NO: 358887 - protein, 9 aa, Homo Sapiens
EQIHNRVAL

SEQ ID NO: 358888 - protein, 9 aa, Homo Sapiens
ITTRLLLKS

SEQ ID NO: 358889 - protein, 9 aa, Homo Sapiens
CIDNKALYD

SEQ ID NO: 358890 - protein, 9 aa, Homo Sapiens
GAIAQAHAE

SEQ ID NO: 358891 - protein, 9 aa, Homo Sapiens
VGGKAAEDC

SEQ ID NO: 358892 - protein, 9 aa, Homo Sapiens
ADFIAKKVE

SEQ ID NO: 358893 - protein, 9 aa, Homo Sapiens
AKAEAIQIL

SEQ ID NO: 358894 - protein, 9 aa, Homo Sapiens
KNKLLLKGS

SEQ ID NO: 358895 - protein, 9 aa, Homo Sapiens
WNETLLDKF

SEQ ID NO: 358896 - protein, 9 aa, Homo Sapiens
MWQEKEIKR

SEQ ID NO: 358897 - protein, 9 aa, Homo Sapiens
NQATTDAIE

SEQ ID NO: 358898 - protein, 9 aa, Homo Sapiens
RIRIEQERC

SEQ ID NO: 358899 - protein, 9 aa, Homo Sapiens
GRAVPVLPN

SEQ ID NO: 358900 - protein, 9 aa, Homo Sapiens
SHYNLGISC

SEQ ID NO: 358901 - protein, 9 aa, Homo Sapiens
GENVYHCGL

SEQ ID NO: 358902 - protein, 9 aa, Homo Sapiens
LDLDPCLLE

SEQ ID NO: 358903 - protein, 9 aa, Homo Sapiens
GRFHKRKHK

SEQ ID NO: 358904 - protein, 9 aa, Homo Sapiens
HTHTGEKPY

SEQ ID NO: 358905 - protein, 9 aa, Homo Sapiens
PKKKINLKD

SEQ ID NO: 358906 - protein, 9 aa, Homo Sapiens
GLWQAMQEW

SEQ ID NO: 358907 - protein, 9 aa, Homo Sapiens
FFVSRKRQI

SEQ ID NO: 358908 - protein, 9 aa, Homo Sapiens
SGMLPNTVL

SEQ ID NO: 358909 - protein, 9 aa, Homo Sapiens
LIPSEVPGQ

SEQ ID NO: 358910 - protein, 9 aa, Homo Sapiens
ENPEKTAAA

SEQ ID NO: 358911 - protein, 9 aa, Homo Sapiens
QDGLRNAGA

SEQ ID NO: 358912 - protein, 9 aa, Homo Sapiens
TKPVYPVMA

SEQ ID NO: 358913 - protein, 9 aa, Homo Sapiens
SVPTNDLNL

SEQ ID NO: 358914 - protein, 9 aa, Homo Sapiens
KVDGLIERQ

SEQ ID NO: 358915 - protein, 9 aa, Homo Sapiens
IYDWRMLGT

SEQ ID NO: 358916 - protein, 9 aa, Homo Sapiens
LLYIGIIAI

SEQ ID NO: 358917 - protein, 9 aa, Homo Sapiens
EVTRSLKYF

SEQ ID NO: 358918 - protein, 9 aa, Homo Sapiens
SSMKPQADV

SEQ ID NO: 358919 - protein, 9 aa, Homo Sapiens
IRKYEFKKD

SEQ ID NO: 358920 - protein, 9 aa, Homo Sapiens
IVYLPTSVG

SEQ ID NO: 358921 - protein, 9 aa, Homo Sapiens
LKATIPPPL

SEQ ID NO: 358922 - protein, 9 aa, Homo Sapiens
MTATQHFTN

SEQ ID NO: 358923 - protein, 9 aa, Homo Sapiens
DRINSGATF

SEQ ID NO: 358924 - protein, 9 aa, Homo Sapiens
DLTEQIANF

SEQ ID NO: 358925 - protein, 9 aa, Homo Sapiens
RKRQILISG

SEQ ID NO: 358926 - protein, 9 aa, Homo Sapiens
QENVIRQNV

SEQ ID NO: 358927 - protein, 9 aa, Homo Sapiens
SVKWMAIES

SEQ ID NO: 358928 - protein, 9 aa, Homo Sapiens
FSVCYDPYT

SEQ ID NO: 358929 - protein, 9 aa, Homo Sapiens
DGDFEIVVV

SEQ ID NO: 358930 - protein, 9 aa, Homo Sapiens
GWLKEIYPD

SEQ ID NO: 358931 - protein, 9 aa, Homo Sapiens
GLADYTLES

SEQ ID NO: 358932 - protein, 9 aa, Homo Sapiens
KYICENQDL

SEQ ID NO: 358933 - protein, 9 aa, Homo Sapiens
QIECLPTSG

SEQ ID NO: 358934 - protein, 9 aa, Homo Sapiens
SLACKIHDG

SEQ ID NO: 358935 - protein, 9 aa, Homo Sapiens
CMNVNNVIK

SEQ ID NO: 358936 - protein, 9 aa, Homo Sapiens
PPLQRLSSL

SEQ ID NO: 358937 - protein, 9 aa, Homo Sapiens
PTASLTPTF

SEQ ID NO: 358938 - protein, 9 aa, Homo Sapiens
AQINYQSSS

SEQ ID NO: 358939 - protein, 9 aa, Homo Sapiens
KFIGSFIDH

SEQ ID NO: 358940 - protein, 9 aa, Homo Sapiens
YRWLKNCNL

SEQ ID NO: 358941 - protein, 9 aa, Homo Sapiens
NNQTLDFKE

SEQ ID NO: 358942 - protein, 9 aa, Homo Sapiens
VLEMDMGLR

SEQ ID NO: 358943 - protein, 9 aa, Homo Sapiens
ARKITSMET

SEQ ID NO: 358944 - protein, 9 aa, Homo Sapiens
VSEEFWLVD

SEQ ID NO: 358945 - protein, 9 aa, Homo Sapiens
PADSVPLKV

SEQ ID NO: 358946 - protein, 9 aa, Homo Sapiens
WRIMSVKRP

SEQ ID NO: 358947 - protein, 9 aa, Homo Sapiens
ENVLISSKT

SEQ ID NO: 358948 - protein, 9 aa, Homo Sapiens
VEQLQCEHC

SEQ ID NO: 358949 - protein, 9 aa, Homo Sapiens
PKLHTPMYL

SEQ ID NO: 358950 - protein, 9 aa, Homo Sapiens
LKYTITCVA

SEQ ID NO: 358951 - protein, 9 aa, Homo Sapiens
CPTKDVRPI

SEQ ID NO: 358952 - protein, 9 aa, Homo Sapiens
LSLCQCPPG

SEQ ID NO: 358953 - protein, 9 aa, Homo Sapiens
KMKPGRPQI

SEQ ID NO: 358954 - protein, 9 aa, Homo Sapiens
QLVVQTVGS

SEQ ID NO: 358955 - protein, 9 aa, Homo Sapiens
VKAYECSRC

SEQ ID NO: 358956 - protein, 9 aa, Homo Sapiens
TQVLKKRHT

SEQ ID NO: 358957 - protein, 9 aa, Homo Sapiens
KKKDFLQET

SEQ ID NO: 358958 - protein, 9 aa, Homo Sapiens
SIQIMKTPE

SEQ ID NO: 358959 - protein, 9 aa, Homo Sapiens
LHPMEGTIS

SEQ ID NO: 358960 - protein, 9 aa, Homo Sapiens
IASQEKKIT

SEQ ID NO: 358961 - protein, 9 aa, Homo Sapiens
QPNELIMPD

SEQ ID NO: 358962 - protein, 9 aa, Homo Sapiens
DEADAKSAA

SEQ ID NO: 358963 - protein, 9 aa, Homo Sapiens
AEQVLQQEH

SEQ ID NO: 358964 - protein, 9 aa, Homo Sapiens
EMKQITEVE

SEQ ID NO: 358965 - protein, 9 aa, Homo Sapiens
EDHGTPAPF

SEQ ID NO: 358966 - protein, 9 aa, Homo Sapiens
PVTAASSVS

SEQ ID NO: 358967 - protein, 9 aa, Homo Sapiens
TLFSTLTGL

SEQ ID NO: 358968 - protein, 9 aa, Homo Sapiens
IKRSRYFQS

SEQ ID NO: 358969 - protein, 9 aa, Homo Sapiens
IGLAEEICH

SEQ ID NO: 358970 - protein, 9 aa, Homo Sapiens
NLSQVKLGI

SEQ ID NO: 358971 - protein, 9 aa, Homo Sapiens
VPSLTNLVK

SEQ ID NO: 358972 - protein, 9 aa, Homo Sapiens
RFLINFSYL

SEQ ID NO: 358973 - protein, 9 aa, Homo Sapiens
DKDMDINEE

SEQ ID NO: 358974 - protein, 9 aa, Homo Sapiens
ITSFGPVSD

SEQ ID NO: 358975 - protein, 9 aa, Homo Sapiens
NEVLQINDT

SEQ ID NO: 358976 - protein, 9 aa, Homo Sapiens
HKNLLKYLN

SEQ ID NO: 358977 - protein, 9 aa, Homo Sapiens
TMCVNWSNI

SEQ ID NO: 358978 - protein, 9 aa, Homo Sapiens
GELFDHIVE

SEQ ID NO: 358979 - protein, 9 aa, Homo Sapiens
KLNSHHNKK

SEQ ID NO: 358980 - protein, 9 aa, Homo Sapiens
TSSQPASRP

SEQ ID NO: 358981 - protein, 9 aa, Homo Sapiens
PVKSSKENW

SEQ ID NO: 358982 - protein, 9 aa, Homo Sapiens
FQNIQEMEE

SEQ ID NO: 358983 - protein, 9 aa, Homo Sapiens
WYGSTVFLR

SEQ ID NO: 358984 - protein, 9 aa, Homo Sapiens
VLRIPPKYL

SEQ ID NO: 358985 - protein, 9 aa, Homo Sapiens
NAGEKPYKC

SEQ ID NO: 358986 - protein, 9 aa, Homo Sapiens
CNTWPVAIL

SEQ ID NO: 358987 - protein, 9 aa, Homo Sapiens
LMNRGCEGF

SEQ ID NO: 358988 - protein, 9 aa, Homo Sapiens
MSHAPQSQD

SEQ ID NO: 358989 - protein, 9 aa, Homo Sapiens
TDPKLRELL

SEQ ID NO: 358990 - protein, 9 aa, Homo Sapiens
MSRLLRSLV

SEQ ID NO: 358991 - protein, 9 aa, Homo Sapiens
DDNDLLSSS

SEQ ID NO: 358992 - protein, 9 aa, Homo Sapiens
CNVTPLLKL

SEQ ID NO: 358993 - protein, 9 aa, Homo Sapiens
NRQISVAAF

SEQ ID NO: 358994 - protein, 9 aa, Homo Sapiens
ASTEGCKEG

SEQ ID NO: 358995 - protein, 9 aa, Homo Sapiens
AGKQWSNLS

SEQ ID NO: 358996 - protein, 9 aa, Homo Sapiens
IGLLFVSYF

SEQ ID NO: 358997 - protein, 9 aa, Homo Sapiens
LPEKSPLSL

SEQ ID NO: 358998 - protein, 9 aa, Homo Sapiens
SKSNGRGGN

SEQ ID NO: 358999 - protein, 9 aa, Homo Sapiens
PLKLENYPE

SEQ ID NO: 359000 - protein, 9 aa, Homo Sapiens
KQGLAKAVA

SEQ ID NO: 359001 - protein, 9 aa, Homo Sapiens
RVHKLIKEM

SEQ ID NO: 359002 - protein, 9 aa, Homo Sapiens
MSNTCQRLW

SEQ ID NO: 359003 - protein, 9 aa, Homo Sapiens
NNDRVQVEF

SEQ ID NO: 359004 - protein, 9 aa, Homo Sapiens
DSVIPTPNS

SEQ ID NO: 359005 - protein, 9 aa, Homo Sapiens
GGTDNPHIS

SEQ ID NO: 359006 - protein, 9 aa, Homo Sapiens
EKYFYSFYV

SEQ ID NO: 359007 - protein, 9 aa, Homo Sapiens
STNLLGSIF

SEQ ID NO: 359008 - protein, 9 aa, Homo Sapiens
VHHILQDMH

SEQ ID NO: 359009 - protein, 9 aa, Homo Sapiens
VFENSVGDI

SEQ ID NO: 359010 - protein, 9 aa, Homo Sapiens
KSLILPGII

SEQ ID NO: 359011 - protein, 9 aa, Homo Sapiens
LTQVMTLQG

SEQ ID NO: 359012 - protein, 9 aa, Homo Sapiens
YVAMVINRL

SEQ ID NO: 359013 - protein, 9 aa, Homo Sapiens
MAGNNENYS

SEQ ID NO: 359014 - protein, 9 aa, Homo Sapiens
LMPILVEKL

SEQ ID NO: 359015 - protein, 9 aa, Homo Sapiens
NTGVACPAL

SEQ ID NO: 359016 - protein, 9 aa, Homo Sapiens
CIVKITGEI

SEQ ID NO: 359017 - protein, 9 aa, Homo Sapiens
ENGLTPTKK

SEQ ID NO: 359018 - protein, 9 aa, Homo Sapiens
LLQNQIVTD

SEQ ID NO: 359019 - protein, 9 aa, Homo Sapiens
CNSCPFICS

SEQ ID NO: 359020 - protein, 9 aa, Homo Sapiens
KPTEDNKLC

SEQ ID NO: 359021 - protein, 9 aa, Homo Sapiens
QKGSTKSSD

SEQ ID NO: 359022 - protein, 9 aa, Homo Sapiens
QNLKINSSY

SEQ ID NO: 359023 - protein, 9 aa, Homo Sapiens
WKISAPPEA

SEQ ID NO: 359024 - protein, 9 aa, Homo Sapiens
GLQQEMLSR

SEQ ID NO: 359025 - protein, 9 aa, Homo Sapiens
FVCLLPLLL

SEQ ID NO: 359026 - protein, 9 aa, Homo Sapiens
FAINLILLF

SEQ ID NO: 359027 - protein, 9 aa, Homo Sapiens
DYNSSELNT

SEQ ID NO: 359028 - protein, 9 aa, Homo Sapiens
LDAVESRAQ

SEQ ID NO: 359029 - protein, 9 aa, Homo Sapiens
GYPNEWYLN

SEQ ID NO: 359030 - protein, 9 aa, Homo Sapiens
HRAFQLLLT

SEQ ID NO: 359031 - protein, 9 aa, Homo Sapiens
LLPHAGVAW

SEQ ID NO: 359032 - protein, 9 aa, Homo Sapiens
TALKTPTCV

SEQ ID NO: 359033 - protein, 9 aa, Homo Sapiens
YPQENVIRQ

SEQ ID NO: 359034 - protein, 9 aa, Homo Sapiens
MAVCEKVFD

SEQ ID NO: 359035 - protein, 9 aa, Homo Sapiens
ERYICVVHA

SEQ ID NO: 359036 - protein, 9 aa, Homo Sapiens
DRLQINRFA

SEQ ID NO: 359037 - protein, 9 aa, Homo Sapiens
RKKDSPFWL

SEQ ID NO: 359038 - protein, 9 aa, Homo Sapiens
RRHIQKVHK

SEQ ID NO: 359039 - protein, 9 aa, Homo Sapiens
DKIKDMAMM

SEQ ID NO: 359040 - protein, 9 aa, Homo Sapiens
NADLIIHIG

SEQ ID NO: 359041 - protein, 9 aa, Homo Sapiens
LDPAYPDIA

SEQ ID NO: 359042 - protein, 9 aa, Homo Sapiens
SDEDLGTAI

SEQ ID NO: 359043 - protein, 9 aa, Homo Sapiens
FEQTILCNS

SEQ ID NO: 359044 - protein, 9 aa, Homo Sapiens
SGIHNCLPN

SEQ ID NO: 359045 - protein, 9 aa, Homo Sapiens
SPSLLKRHE

SEQ ID NO: 359046 - protein, 9 aa, Homo Sapiens
GRTQNHGHN

SEQ ID NO: 359047 - protein, 9 aa, Homo Sapiens
QVRACLAML

SEQ ID NO: 359048 - protein, 9 aa, Homo Sapiens
PFCQPVDPQ

SEQ ID NO: 359049 - protein, 9 aa, Homo Sapiens
QALSEMASA

SEQ ID NO: 359050 - protein, 9 aa, Homo Sapiens
FTDAPAMTM

SEQ ID NO: 359051 - protein, 9 aa, Homo Sapiens
TFINTSSLC

SEQ ID NO: 359052 - protein, 9 aa, Homo Sapiens
ADAPLTTSN

SEQ ID NO: 359053 - protein, 9 aa, Homo Sapiens
VKDVSILQV

SEQ ID NO: 359054 - protein, 9 aa, Homo Sapiens
EEIVQLFSG

SEQ ID NO: 359055 - protein, 9 aa, Homo Sapiens
LFDHIRLVV

SEQ ID NO: 359056 - protein, 9 aa, Homo Sapiens
LVEKLPFVR

SEQ ID NO: 359057 - protein, 9 aa, Homo Sapiens
MLCNLGTER

SEQ ID NO: 359058 - protein, 9 aa, Homo Sapiens
QIHDGGVYR

SEQ ID NO: 359059 - protein, 9 aa, Homo Sapiens
SCRICCKSY

SEQ ID NO: 359060 - protein, 9 aa, Homo Sapiens
CTLEGELHD

SEQ ID NO: 359061 - protein, 9 aa, Homo Sapiens
TNLVTISYP

SEQ ID NO: 359062 - protein, 9 aa, Homo Sapiens
ESVDECKVY

SEQ ID NO: 359063 - protein, 9 aa, Homo Sapiens
SQEDYEFKT

SEQ ID NO: 359064 - protein, 9 aa, Homo Sapiens
YIDNFKTRT

SEQ ID NO: 359065 - protein, 9 aa, Homo Sapiens
AHICINTLD

SEQ ID NO: 359066 - protein, 9 aa, Homo Sapiens
KEVIFAFEE

SEQ ID NO: 359067 - protein, 9 aa, Homo Sapiens
DFFHKYFPD

SEQ ID NO: 359068 - protein, 9 aa, Homo Sapiens
ASMDDNYFV

SEQ ID NO: 359069 - protein, 9 aa, Homo Sapiens
LEQITSSNV

SEQ ID NO: 359070 - protein, 9 aa, Homo Sapiens
FFFIIISYA

SEQ ID NO: 359071 - protein, 9 aa, Homo Sapiens
TQQYRSNVP

SEQ ID NO: 359072 - protein, 9 aa, Homo Sapiens
PGWDVKLLW

SEQ ID NO: 359073 - protein, 9 aa, Homo Sapiens
RQHLQRLQS

SEQ ID NO: 359074 - protein, 9 aa, Homo Sapiens
PNRIMRLCF

SEQ ID NO: 359075 - protein, 9 aa, Homo Sapiens
ADATASSIP

SEQ ID NO: 359076 - protein, 9 aa, Homo Sapiens
TLVLMWLKR

SEQ ID NO: 359077 - protein, 9 aa, Homo Sapiens
AGVFTMDTD

SEQ ID NO: 359078 - protein, 9 aa, Homo Sapiens
DDLIDEFIK

SEQ ID NO: 359079 - protein, 9 aa, Homo Sapiens
GADGGTLVQ

SEQ ID NO: 359080 - protein, 9 aa, Homo Sapiens
QGFFLSDSQ

SEQ ID NO: 359081 - protein, 9 aa, Homo Sapiens
PKQQYKPDS

SEQ ID NO: 359082 - protein, 9 aa, Homo Sapiens
ASLGIPHLS

SEQ ID NO: 359083 - protein, 9 aa, Homo Sapiens
LIPNGVQIC

SEQ ID NO: 359084 - protein, 9 aa, Homo Sapiens
KYFSSSKRM

SEQ ID NO: 359085 - protein, 9 aa, Homo Sapiens
TQHQRVNSG

SEQ ID NO: 359086 - protein, 9 aa, Homo Sapiens
IGLHIALAI

SEQ ID NO: 359087 - protein, 9 aa, Homo Sapiens
DSNKKLACG

SEQ ID NO: 359088 - protein, 9 aa, Homo Sapiens
HLRDDIKEY

SEQ ID NO: 359089 - protein, 9 aa, Homo Sapiens
GGAMYLVSS

SEQ ID NO: 359090 - protein, 9 aa, Homo Sapiens
LFNEMAERH

SEQ ID NO: 359091 - protein, 9 aa, Homo Sapiens
AGVMHYLIC

SEQ ID NO: 359092 - protein, 9 aa, Homo Sapiens
KDMAMMTHL

SEQ ID NO: 359093 - protein, 9 aa, Homo Sapiens
EKIAEDPGT

SEQ ID NO: 359094 - protein, 9 aa, Homo Sapiens
GRISVKWMA

SEQ ID NO: 359095 - protein, 9 aa, Homo Sapiens
CYWAKLCYI

SEQ ID NO: 359096 - protein, 9 aa, Homo Sapiens
FFCDVSSDV

SEQ ID NO: 359097 - protein, 9 aa, Homo Sapiens
SSEFLPPIR

SEQ ID NO: 359098 - protein, 9 aa, Homo Sapiens
KQKVMVTVK

SEQ ID NO: 359099 - protein, 9 aa, Homo Sapiens
VSNIDNLGV

SEQ ID NO: 359100 - protein, 9 aa, Homo Sapiens
LDYSVGQSV

SEQ ID NO: 359101 - protein, 9 aa, Homo Sapiens
TTENGLPGS

SEQ ID NO: 359102 - protein, 9 aa, Homo Sapiens
MIYFVGCFA

SEQ ID NO: 359103 - protein, 9 aa, Homo Sapiens
HYNERDEIT

SEQ ID NO: 359104 - protein, 9 aa, Homo Sapiens
LKRSGKLLN

SEQ ID NO: 359105 - protein, 9 aa, Homo Sapiens
VYLQAVKES

SEQ ID NO: 359106 - protein, 9 aa, Homo Sapiens
NRQINILRE

SEQ ID NO: 359107 - protein, 9 aa, Homo Sapiens
LAMQVITSP

SEQ ID NO: 359108 - protein, 9 aa, Homo Sapiens
MPFQDDQEF

SEQ ID NO: 359109 - protein, 9 aa, Homo Sapiens
QVLAPNALS

SEQ ID NO: 359110 - protein, 9 aa, Homo Sapiens
TQCSVEIQI

SEQ ID NO: 359111 - protein, 9 aa, Homo Sapiens
VGHSTTKSA

SEQ ID NO: 359112 - protein, 9 aa, Homo Sapiens
HSLLNTATV

SEQ ID NO: 359113 - protein, 9 aa, Homo Sapiens
SLVTANTTF

SEQ ID NO: 359114 - protein, 9 aa, Homo Sapiens
QQKVVSVSE

SEQ ID NO: 359115 - protein, 9 aa, Homo Sapiens
EEKQPRLLK

SEQ ID NO: 359116 - protein, 9 aa, Homo Sapiens
SELNTACRK

SEQ ID NO: 359117 - protein, 9 aa, Homo Sapiens
GTIMGIFFC

SEQ ID NO: 359118 - protein, 9 aa, Homo Sapiens
ECDKVLSRK

SEQ ID NO: 359119 - protein, 9 aa, Homo Sapiens
KTITEQQRY

SEQ ID NO: 359120 - protein, 9 aa, Homo Sapiens
EIGYTYFYL

SEQ ID NO: 359121 - protein, 9 aa, Homo Sapiens
DIKRYLNLA

SEQ ID NO: 359122 - protein, 9 aa, Homo Sapiens
SVSDDSSLS

SEQ ID NO: 359123 - protein, 9 aa, Homo Sapiens
LITFFFIII

SEQ ID NO: 359124 - protein, 9 aa, Homo Sapiens
WQSWGSMEN

SEQ ID NO: 359125 - protein, 9 aa, Homo Sapiens
KAVRLGNCK

SEQ ID NO: 359126 - protein, 9 aa, Homo Sapiens
LAQAHEEAL

SEQ ID NO: 359127 - protein, 9 aa, Homo Sapiens
NRFQPELSV

SEQ ID NO: 359128 - protein, 9 aa, Homo Sapiens
NTTNGSRFP

SEQ ID NO: 359129 - protein, 9 aa, Homo Sapiens
GTDNPHISD

SEQ ID NO: 359130 - protein, 9 aa, Homo Sapiens
ECLLLERLE

SEQ ID NO: 359131 - protein, 9 aa, Homo Sapiens
LSKSKCNLL

SEQ ID NO: 359132 - protein, 9 aa, Homo Sapiens
SIAQQNKQI

SEQ ID NO: 359133 - protein, 9 aa, Homo Sapiens
YLQDQSHAL

SEQ ID NO: 359134 - protein, 9 aa, Homo Sapiens
SFYQQIKEP

SEQ ID NO: 359135 - protein, 9 aa, Homo Sapiens
QCGPTSTSI

SEQ ID NO: 359136 - protein, 9 aa, Homo Sapiens
QRISGNTSQ

SEQ ID NO: 359137 - protein, 9 aa, Homo Sapiens
GVGRMGVFI

SEQ ID NO: 359138 - protein, 9 aa, Homo Sapiens
DENEVQTLF

SEQ ID NO: 359139 - protein, 9 aa, Homo Sapiens
TWTKHGVPL

SEQ ID NO: 359140 - protein, 9 aa, Homo Sapiens
NSECAHREA

SEQ ID NO: 359141 - protein, 9 aa, Homo Sapiens
LRYLNVRRN

SEQ ID NO: 359142 - protein, 9 aa, Homo Sapiens
CENKTTVVY

SEQ ID NO: 359143 - protein, 9 aa, Homo Sapiens
WLSSKSYSY

SEQ ID NO: 359144 - protein, 9 aa, Homo Sapiens
HVEPLKRLE

SEQ ID NO: 359145 - protein, 9 aa, Homo Sapiens
FRSAKYIQI

SEQ ID NO: 359146 - protein, 9 aa, Homo Sapiens
LQVQSLRTA

SEQ ID NO: 359147 - protein, 9 aa, Homo Sapiens
TQDLSLMTN

SEQ ID NO: 359148 - protein, 9 aa, Homo Sapiens
NIDRYYLRN

SEQ ID NO: 359149 - protein, 9 aa, Homo Sapiens
ALNKILSNV

SEQ ID NO: 359150 - protein, 9 aa, Homo Sapiens
DISFTIDVN

SEQ ID NO: 359151 - protein, 9 aa, Homo Sapiens
SGIFTTGIM

SEQ ID NO: 359152 - protein, 9 aa, Homo Sapiens
VEYGADHMA

SEQ ID NO: 359153 - protein, 9 aa, Homo Sapiens
QSNSATPKM

SEQ ID NO: 359154 - protein, 9 aa, Homo Sapiens
VCEATGRQL

SEQ ID NO: 359155 - protein, 9 aa, Homo Sapiens
HHIIENNHS

SEQ ID NO: 359156 - protein, 9 aa, Homo Sapiens
SKYSFHHRI

SEQ ID NO: 359157 - protein, 9 aa, Homo Sapiens
LYQFSRCFH

SEQ ID NO: 359158 - protein, 9 aa, Homo Sapiens
FSLRDSLWN

SEQ ID NO: 359159 - protein, 9 aa, Homo Sapiens
GDELPLSVH

SEQ ID NO: 359160 - protein, 9 aa, Homo Sapiens
APSSNFLSN

SEQ ID NO: 359161 - protein, 9 aa, Homo Sapiens
DDEENYWDS

SEQ ID NO: 359162 - protein, 9 aa, Homo Sapiens
LFDHIVEKG

SEQ ID NO: 359163 - protein, 9 aa, Homo Sapiens
GNQRLLSDQ

SEQ ID NO: 359164 - protein, 9 aa, Homo Sapiens
TAQAPTDIN

SEQ ID NO: 359165 - protein, 9 aa, Homo Sapiens
KVKCLHNNE

SEQ ID NO: 359166 - protein, 9 aa, Homo Sapiens
YEAPRGDKE

SEQ ID NO: 359167 - protein, 9 aa, Homo Sapiens
FENELVLHQ

SEQ ID NO: 359168 - protein, 9 aa, Homo Sapiens
PANQYKDPQ

SEQ ID NO: 359169 - protein, 9 aa, Homo Sapiens
KEVVTHMWT

SEQ ID NO: 359170 - protein, 9 aa, Homo Sapiens
QRFTKNNFF

SEQ ID NO: 359171 - protein, 9 aa, Homo Sapiens
PSGMIEAFT

SEQ ID NO: 359172 - protein, 9 aa, Homo Sapiens
PSEYINLDI

SEQ ID NO: 359173 - protein, 9 aa, Homo Sapiens
HQSRISYHA

SEQ ID NO: 359174 - protein, 9 aa, Homo Sapiens
VGKHAHFKT

SEQ ID NO: 359175 - protein, 9 aa, Homo Sapiens
GNTLSVKVM

SEQ ID NO: 359176 - protein, 9 aa, Homo Sapiens
VGDILRVLA

SEQ ID NO: 359177 - protein, 9 aa, Homo Sapiens
QNTEESLCH

SEQ ID NO: 359178 - protein, 9 aa, Homo Sapiens
KECVQLVCP

SEQ ID NO: 359179 - protein, 9 aa, Homo Sapiens
FTVINQTQK

SEQ ID NO: 359180 - protein, 9 aa, Homo Sapiens
AYPDIALPL

SEQ ID NO: 359181 - protein, 9 aa, Homo Sapiens
IRGLKYIHS

SEQ ID NO: 359182 - protein, 9 aa, Homo Sapiens
HCSQNAYML

SEQ ID NO: 359183 - protein, 9 aa, Homo Sapiens
KKLDNEVEQ

SEQ ID NO: 359184 - protein, 9 aa, Homo Sapiens
GHKQQNVYC

SEQ ID NO: 359185 - protein, 9 aa, Homo Sapiens
DFVQLSRLC

SEQ ID NO: 359186 - protein, 9 aa, Homo Sapiens
RDRSKNKLL

SEQ ID NO: 359187 - protein, 9 aa, Homo Sapiens
TCGHISVQF

SEQ ID NO: 359188 - protein, 9 aa, Homo Sapiens
PITVWGTHL

SEQ ID NO: 359189 - protein, 9 aa, Homo Sapiens
AMIIWINEI

SEQ ID NO: 359190 - protein, 9 aa, Homo Sapiens
PLTLSHNNM

SEQ ID NO: 359191 - protein, 9 aa, Homo Sapiens
RAMSIKILC

SEQ ID NO: 359192 - protein, 9 aa, Homo Sapiens
QAREKCFTF

SEQ ID NO: 359193 - protein, 9 aa, Homo Sapiens
SPPRCLIAN

SEQ ID NO: 359194 - protein, 9 aa, Homo Sapiens
PAPGSPDKQ

SEQ ID NO: 359195 - protein, 9 aa, Homo Sapiens
QMTDMAKIK

SEQ ID NO: 359196 - protein, 9 aa, Homo Sapiens
RGHTKPQDF

SEQ ID NO: 359197 - protein, 9 aa, Homo Sapiens
KPCSSNTLK

SEQ ID NO: 359198 - protein, 9 aa, Homo Sapiens
RSLLSLVAL

SEQ ID NO: 359199 - protein, 9 aa, Homo Sapiens
ADTGSLYDP

SEQ ID NO: 359200 - protein, 9 aa, Homo Sapiens
ERYTKVAKR

SEQ ID NO: 359201 - protein, 9 aa, Homo Sapiens
LCDSNVIHH

SEQ ID NO: 359202 - protein, 9 aa, Homo Sapiens
DNLLKNIKL

SEQ ID NO: 359203 - protein, 9 aa, Homo Sapiens
IGYTYFYLF

SEQ ID NO: 359204 - protein, 9 aa, Homo Sapiens
IYPVVCAPS

SEQ ID NO: 359205 - protein, 9 aa, Homo Sapiens
LNISFNILD

SEQ ID NO: 359206 - protein, 9 aa, Homo Sapiens
TWEKEELKN

SEQ ID NO: 359207 - protein, 9 aa, Homo Sapiens
VGCYCFRQT

SEQ ID NO: 359208 - protein, 9 aa, Homo Sapiens
ATTRHHLGS

SEQ ID NO: 359209 - protein, 9 aa, Homo Sapiens
KIFQTWFEQ

SEQ ID NO: 359210 - protein, 9 aa, Homo Sapiens
RRSRSRNID

SEQ ID NO: 359211 - protein, 9 aa, Homo Sapiens
APSVIHYIL

SEQ ID NO: 359212 - protein, 9 aa, Homo Sapiens
KIRKYFSFP

SEQ ID NO: 359213 - protein, 9 aa, Homo Sapiens
NIKYKRPIP

SEQ ID NO: 359214 - protein, 9 aa, Homo Sapiens
IKNRKLTKT

SEQ ID NO: 359215 - protein, 9 aa, Homo Sapiens
AFFNTASTG

SEQ ID NO: 359216 - protein, 9 aa, Homo Sapiens
RPDGLPKTY

SEQ ID NO: 359217 - protein, 9 aa, Homo Sapiens
GIDLGKIVE

SEQ ID NO: 359218 - protein, 9 aa, Homo Sapiens
ANMTKWEQK

SEQ ID NO: 359219 - protein, 9 aa, Homo Sapiens
EGDISLDKI

SEQ ID NO: 359220 - protein, 9 aa, Homo Sapiens
RQILISGSR

SEQ ID NO: 359221 - protein, 9 aa, Homo Sapiens
SRHGQVPSS

SEQ ID NO: 359222 - protein, 9 aa, Homo Sapiens
SLHNHLLTY

SEQ ID NO: 359223 - protein, 9 aa, Homo Sapiens
SPSAQINYQ

SEQ ID NO: 359224 - protein, 9 aa, Homo Sapiens
KTKKGATEK

SEQ ID NO: 359225 - protein, 9 aa, Homo Sapiens
NGLVHQTQS

SEQ ID NO: 359226 - protein, 9 aa, Homo Sapiens
GTPVLEAFP

SEQ ID NO: 359227 - protein, 9 aa, Homo Sapiens
KKKGLNSGG

SEQ ID NO: 359228 - protein, 9 aa, Homo Sapiens
AFGTARRST

SEQ ID NO: 359229 - protein, 9 aa, Homo Sapiens
PYTKFFGGV

SEQ ID NO: 359230 - protein, 9 aa, Homo Sapiens
MSGECQSTV

SEQ ID NO: 359231 - protein, 9 aa, Homo Sapiens
LSYTFILRV

SEQ ID NO: 359232 - protein, 9 aa, Homo Sapiens
IDKALTVSS

SEQ ID NO: 359233 - protein, 9 aa, Homo Sapiens
EISDANYVL

SEQ ID NO: 359234 - protein, 9 aa, Homo Sapiens
DQRRDFINI

SEQ ID NO: 359235 - protein, 9 aa, Homo Sapiens
VTALIASGV

SEQ ID NO: 359236 - protein, 9 aa, Homo Sapiens
QPYEAAHMF

SEQ ID NO: 359237 - protein, 9 aa, Homo Sapiens
AMIKYLSQE

SEQ ID NO: 359238 - protein, 9 aa, Homo Sapiens
AQWPAWQSL

SEQ ID NO: 359239 - protein, 9 aa, Homo Sapiens
IKNVYAFNL

SEQ ID NO: 359240 - protein, 9 aa, Homo Sapiens
YQKSSVSSV

SEQ ID NO: 359241 - protein, 9 aa, Homo Sapiens
HKCKNKQKS

SEQ ID NO: 359242 - protein, 9 aa, Homo Sapiens
EKKAERLGL

SEQ ID NO: 359243 - protein, 9 aa, Homo Sapiens
STVFLRVRT

SEQ ID NO: 359244 - protein, 9 aa, Homo Sapiens
DRFCFEKRN

SEQ ID NO: 359245 - protein, 9 aa, Homo Sapiens
KQRSYTKDY

SEQ ID NO: 359246 - protein, 9 aa, Homo Sapiens
INQRFKNKL

SEQ ID NO: 359247 - protein, 9 aa, Homo Sapiens
QLPSREGGD

SEQ ID NO: 359248 - protein, 9 aa, Homo Sapiens
SLDYSMPVP

SEQ ID NO: 359249 - protein, 9 aa, Homo Sapiens
HILVQGANG

SEQ ID NO: 359250 - protein, 9 aa, Homo Sapiens
LLASEGAQV

SEQ ID NO: 359251 - protein, 9 aa, Homo Sapiens
GKYQLATKI

SEQ ID NO: 359252 - protein, 9 aa, Homo Sapiens
IHFIEECSF

SEQ ID NO: 359253 - protein, 9 aa, Homo Sapiens
TKMKTTTNI

SEQ ID NO: 359254 - protein, 9 aa, Homo Sapiens
EFFIPDNEE

SEQ ID NO: 359255 - protein, 9 aa, Homo Sapiens
NDTSSDPLL

SEQ ID NO: 359256 - protein, 9 aa, Homo Sapiens
DPFLSNELS

SEQ ID NO: 359257 - protein, 9 aa, Homo Sapiens
DICAAETGG

SEQ ID NO: 359258 - protein, 9 aa, Homo Sapiens
GKKRKIKRL

SEQ ID NO: 359259 - protein, 9 aa, Homo Sapiens
NREMYSLGS

SEQ ID NO: 359260 - protein, 9 aa, Homo Sapiens
EASFQTEVS

SEQ ID NO: 359261 - protein, 9 aa, Homo Sapiens
PSDFQCGPT

SEQ ID NO: 359262 - protein, 9 aa, Homo Sapiens
SCESICLVL

SEQ ID NO: 359263 - protein, 9 aa, Homo Sapiens
VYKNFRREL

SEQ ID NO: 359264 - protein, 9 aa, Homo Sapiens
NIFYLFLYM

SEQ ID NO: 359265 - protein, 9 aa, Homo Sapiens
FFTWGNNIN

SEQ ID NO: 359266 - protein, 9 aa, Homo Sapiens
MRLCFNHFA

SEQ ID NO: 359267 - protein, 9 aa, Homo Sapiens
DSTFQLHVH

SEQ ID NO: 359268 - protein, 9 aa, Homo Sapiens
VVAKEAWDN

SEQ ID NO: 359269 - protein, 9 aa, Homo Sapiens
QMPKVHIKF

SEQ ID NO: 359270 - protein, 9 aa, Homo Sapiens
PRTLSQGTA

SEQ ID NO: 359271 - protein, 9 aa, Homo Sapiens
IYITSFGPV

SEQ ID NO: 359272 - protein, 9 aa, Homo Sapiens
DDPKTLKTL

SEQ ID NO: 359273 - protein, 9 aa, Homo Sapiens
VPVSRRPPT

SEQ ID NO: 359274 - protein, 9 aa, Homo Sapiens
VNSEGKFDK

SEQ ID NO: 359275 - protein, 9 aa, Homo Sapiens
VSEDVYHSH

SEQ ID NO: 359276 - protein, 9 aa, Homo Sapiens
KWSCESICL

SEQ ID NO: 359277 - protein, 9 aa, Homo Sapiens
LKTGGTTSP

SEQ ID NO: 359278 - protein, 9 aa, Homo Sapiens
PQEVAEQFL

SEQ ID NO: 359279 - protein, 9 aa, Homo Sapiens
LEICIHKLH

SEQ ID NO: 359280 - protein, 9 aa, Homo Sapiens
FLSQTAQRS

SEQ ID NO: 359281 - protein, 9 aa, Homo Sapiens
NRIVHQRVH

SEQ ID NO: 359282 - protein, 9 aa, Homo Sapiens
PYVGKECGK

SEQ ID NO: 359283 - protein, 9 aa, Homo Sapiens
FGKTKSGYF

SEQ ID NO: 359284 - protein, 9 aa, Homo Sapiens
DICQSNSAT

SEQ ID NO: 359285 - protein, 9 aa, Homo Sapiens
VFRPDNLIS

SEQ ID NO: 359286 - protein, 9 aa, Homo Sapiens
QLCLALQHA

SEQ ID NO: 359287 - protein, 9 aa, Homo Sapiens
HSGIAASVN

SEQ ID NO: 359288 - protein, 9 aa, Homo Sapiens
VRTTDICVG

SEQ ID NO: 359289 - protein, 9 aa, Homo Sapiens
LIGISEDQR

SEQ ID NO: 359290 - protein, 9 aa, Homo Sapiens
SEKSQIEDE

SEQ ID NO: 359291 - protein, 9 aa, Homo Sapiens
TLKNKTSDD

SEQ ID NO: 359292 - protein, 9 aa, Homo Sapiens
NSSCRNYNN

SEQ ID NO: 359293 - protein, 9 aa, Homo Sapiens
RSNVPNMHN

SEQ ID NO: 359294 - protein, 9 aa, Homo Sapiens
EKTQMICQQ

SEQ ID NO: 359295 - protein, 9 aa, Homo Sapiens
IILNSMHIY

SEQ ID NO: 359296 - protein, 9 aa, Homo Sapiens
VWLYEQLLQ

SEQ ID NO: 359297 - protein, 9 aa, Homo Sapiens
SSAQVEQLC

SEQ ID NO: 359298 - protein, 9 aa, Homo Sapiens
KLREFMQLL

SEQ ID NO: 359299 - protein, 9 aa, Homo Sapiens
AVEIYRWIW

SEQ ID NO: 359300 - protein, 9 aa, Homo Sapiens
IHGIINENR

SEQ ID NO: 359301 - protein, 9 aa, Homo Sapiens
AYKITVALL

SEQ ID NO: 359302 - protein, 9 aa, Homo Sapiens
KEMKQITEV

SEQ ID NO: 359303 - protein, 9 aa, Homo Sapiens
IMYATIQTE

SEQ ID NO: 359304 - protein, 9 aa, Homo Sapiens
ECDNKGDGS

SEQ ID NO: 359305 - protein, 9 aa, Homo Sapiens
LSEPEITLI

SEQ ID NO: 359306 - protein, 9 aa, Homo Sapiens
MMSVAGRVA

SEQ ID NO: 359307 - protein, 9 aa, Homo Sapiens
RDIEQVPRQ

SEQ ID NO: 359308 - protein, 9 aa, Homo Sapiens
VRDPKTLLL

SEQ ID NO: 359309 - protein, 9 aa, Homo Sapiens
TWQINLKTN

SEQ ID NO: 359310 - protein, 9 aa, Homo Sapiens
PYGYTTEPV

SEQ ID NO: 359311 - protein, 9 aa, Homo Sapiens
RAKGTPDKV

SEQ ID NO: 359312 - protein, 9 aa, Homo Sapiens
HGKNVPKYQ

SEQ ID NO: 359313 - protein, 9 aa, Homo Sapiens
KINKIPIDN

SEQ ID NO: 359314 - protein, 9 aa, Homo Sapiens
GRTSLKIWN

SEQ ID NO: 359315 - protein, 9 aa, Homo Sapiens
IQLYQKPEG

SEQ ID NO: 359316 - protein, 9 aa, Homo Sapiens
CLSAQGDSL

SEQ ID NO: 359317 - protein, 9 aa, Homo Sapiens
QDGPQTSNS

SEQ ID NO: 359318 - protein, 9 aa, Homo Sapiens
LGRKSGGVC

SEQ ID NO: 359319 - protein, 9 aa, Homo Sapiens
LPEDKVEEE

SEQ ID NO: 359320 - protein, 9 aa, Homo Sapiens
FFIIISYAR

SEQ ID NO: 359321 - protein, 9 aa, Homo Sapiens
IYKFSGCCF

SEQ ID NO: 359322 - protein, 9 aa, Homo Sapiens
TTFMHANKS

SEQ ID NO: 359323 - protein, 9 aa, Homo Sapiens
PIKTFYRFK

SEQ ID NO: 359324 - protein, 9 aa, Homo Sapiens
IHRAFQLLL

SEQ ID NO: 359325 - protein, 9 aa, Homo Sapiens
YFMLWHPKL

SEQ ID NO: 359326 - protein, 9 aa, Homo Sapiens
MSVAGRVAS

SEQ ID NO: 359327 - protein, 9 aa, Homo Sapiens
EQQHAQRNV

SEQ ID NO: 359328 - protein, 9 aa, Homo Sapiens
IDKAQNFRT

SEQ ID NO: 359329 - protein, 9 aa, Homo Sapiens
MKQITEVEP

SEQ ID NO: 359330 - protein, 9 aa, Homo Sapiens
SECLKKCSE

SEQ ID NO: 359331 - protein, 9 aa, Homo Sapiens
LIYNAGVAF

SEQ ID NO: 359332 - protein, 9 aa, Homo Sapiens
MSSFQSYEA

SEQ ID NO: 359333 - protein, 9 aa, Homo Sapiens
FQDVTRAGF

SEQ ID NO: 359334 - protein, 9 aa, Homo Sapiens
PPPYFSWTG

SEQ ID NO: 359335 - protein, 9 aa, Homo Sapiens
HPSRWPAMK

SEQ ID NO: 359336 - protein, 9 aa, Homo Sapiens
CIEWAKSDK

SEQ ID NO: 359337 - protein, 9 aa, Homo Sapiens
VHTDMTKNL

SEQ ID NO: 359338 - protein, 9 aa, Homo Sapiens
GPKYVNIFI

SEQ ID NO: 359339 - protein, 9 aa, Homo Sapiens
MEEIVRSSI

SEQ ID NO: 359340 - protein, 9 aa, Homo Sapiens
GSYWDCIHC

SEQ ID NO: 359341 - protein, 9 aa, Homo Sapiens
IINNSQLFE

SEQ ID NO: 359342 - protein, 9 aa, Homo Sapiens
LIDINDHGP

SEQ ID NO: 359343 - protein, 9 aa, Homo Sapiens
ITGEIVLSF

SEQ ID NO: 359344 - protein, 9 aa, Homo Sapiens
VIKEGGLCT

SEQ ID NO: 359345 - protein, 9 aa, Homo Sapiens
TDEEIEFLM

SEQ ID NO: 359346 - protein, 9 aa, Homo Sapiens
IQRAHHKNV

SEQ ID NO: 359347 - protein, 9 aa, Homo Sapiens
RTLSQGTAV

SEQ ID NO: 359348 - protein, 9 aa, Homo Sapiens
VDQFCLGHT

SEQ ID NO: 359349 - protein, 9 aa, Homo Sapiens
LAVRACVIH

SEQ ID NO: 359350 - protein, 9 aa, Homo Sapiens
EGIKYLVEI

SEQ ID NO: 359351 - protein, 9 aa, Homo Sapiens
IQGTVEFLV

SEQ ID NO: 359352 - protein, 9 aa, Homo Sapiens
KSWKRCYFL

SEQ ID NO: 359353 - protein, 9 aa, Homo Sapiens
YKIKYPDNF

SEQ ID NO: 359354 - protein, 9 aa, Homo Sapiens
QNNNKWQRN

SEQ ID NO: 359355 - protein, 9 aa, Homo Sapiens
SRSSSRSHV

SEQ ID NO: 359356 - protein, 9 aa, Homo Sapiens
GVLAGGWQT

SEQ ID NO: 359357 - protein, 9 aa, Homo Sapiens
SIHDIHGII

SEQ ID NO: 359358 - protein, 9 aa, Homo Sapiens
VSEPGNNVT

SEQ ID NO: 359359 - protein, 9 aa, Homo Sapiens
YKIASYSKT

SEQ ID NO: 359360 - protein, 9 aa, Homo Sapiens
KSRKFNLMY

SEQ ID NO: 359361 - protein, 9 aa, Homo Sapiens
REASKIMKS

SEQ ID NO: 359362 - protein, 9 aa, Homo Sapiens
AVCHPDRIT

SEQ ID NO: 359363 - protein, 9 aa, Homo Sapiens
ADEISRFQK

SEQ ID NO: 359364 - protein, 9 aa, Homo Sapiens
STVHKILCK

SEQ ID NO: 359365 - protein, 9 aa, Homo Sapiens
SEYIPTPSN

SEQ ID NO: 359366 - protein, 9 aa, Homo Sapiens
KSIKQRLHS

SEQ ID NO: 359367 - protein, 9 aa, Homo Sapiens
NVENTLLGL

SEQ ID NO: 359368 - protein, 9 aa, Homo Sapiens
EFKKDLSKQ

SEQ ID NO: 359369 - protein, 9 aa, Homo Sapiens
FDKKICFWD

SEQ ID NO: 359370 - protein, 9 aa, Homo Sapiens
LLLTEVNKA

SEQ ID NO: 359371 - protein, 9 aa, Homo Sapiens
DIDKLLVNV

SEQ ID NO: 359372 - protein, 9 aa, Homo Sapiens
TFQTFSKAE

SEQ ID NO: 359373 - protein, 9 aa, Homo Sapiens
RMNLSLNLG

SEQ ID NO: 359374 - protein, 9 aa, Homo Sapiens
KEADILEVL

SEQ ID NO: 359375 - protein, 9 aa, Homo Sapiens
ILQNATQRI

SEQ ID NO: 359376 - protein, 9 aa, Homo Sapiens
RDKHPVTWQ

SEQ ID NO: 359377 - protein, 9 aa, Homo Sapiens
EEEENNEKR

SEQ ID NO: 359378 - protein, 9 aa, Homo Sapiens
FALHSSEFL

SEQ ID NO: 359379 - protein, 9 aa, Homo Sapiens
LTSTHSKFI

SEQ ID NO: 359380 - protein, 9 aa, Homo Sapiens
TKLYQQLND

SEQ ID NO: 359381 - protein, 9 aa, Homo Sapiens
MKTTTNIYI

SEQ ID NO: 359382 - protein, 9 aa, Homo Sapiens
EMRGTADLF

SEQ ID NO: 359383 - protein, 9 aa, Homo Sapiens
TQKSVPDVV

SEQ ID NO: 359384 - protein, 9 aa, Homo Sapiens
NKQIFLRNL

SEQ ID NO: 359385 - protein, 9 aa, Homo Sapiens
GEDGDKRKK

SEQ ID NO: 359386 - protein, 9 aa, Homo Sapiens
GGAIDIPMD

SEQ ID NO: 359387 - protein, 9 aa, Homo Sapiens
AQEDSRHGQ

SEQ ID NO: 359388 - protein, 9 aa, Homo Sapiens
FNLFSSITN

SEQ ID NO: 359389 - protein, 9 aa, Homo Sapiens
WQKAQSDGW

SEQ ID NO: 359390 - protein, 9 aa, Homo Sapiens
LDLTHNTYQ

SEQ ID NO: 359391 - protein, 9 aa, Homo Sapiens
FVTFEVKIF

SEQ ID NO: 359392 - protein, 9 aa, Homo Sapiens
LLLLFSLVR

SEQ ID NO: 359393 - protein, 9 aa, Homo Sapiens
LQHFLDTAL

SEQ ID NO: 359394 - protein, 9 aa, Homo Sapiens
INISEFRVV

SEQ ID NO: 359395 - protein, 9 aa, Homo Sapiens
SIQKYILTI

SEQ ID NO: 359396 - protein, 9 aa, Homo Sapiens
PLVGIICSY

SEQ ID NO: 359397 - protein, 9 aa, Homo Sapiens
GTSFYQCSY

SEQ ID NO: 359398 - protein, 9 aa, Homo Sapiens
FHKGVPNPI

SEQ ID NO: 359399 - protein, 9 aa, Homo Sapiens
SYICIECRQ

SEQ ID NO: 359400 - protein, 9 aa, Homo Sapiens
RSFLNLLHL

SEQ ID NO: 359401 - protein, 9 aa, Homo Sapiens
QGQETESLD

SEQ ID NO: 359402 - protein, 9 aa, Homo Sapiens
RPAHRRPEH

SEQ ID NO: 359403 - protein, 9 aa, Homo Sapiens
PNPSKHQGN

SEQ ID NO: 359404 - protein, 9 aa, Homo Sapiens
SAQVQTGNI

SEQ ID NO: 359405 - protein, 9 aa, Homo Sapiens
VVIETGAAP

SEQ ID NO: 359406 - protein, 9 aa, Homo Sapiens
EQQASIMLN

SEQ ID NO: 359407 - protein, 9 aa, Homo Sapiens
AQRWAQQTP

SEQ ID NO: 359408 - protein, 9 aa, Homo Sapiens
ERGHMDVAE

SEQ ID NO: 359409 - protein, 9 aa, Homo Sapiens
SFKQTLEPT

SEQ ID NO: 359410 - protein, 9 aa, Homo Sapiens
YLSQHKKIR

SEQ ID NO: 359411 - protein, 9 aa, Homo Sapiens
PFICSRLSS

SEQ ID NO: 359412 - protein, 9 aa, Homo Sapiens
YIPVNVTSI

SEQ ID NO: 359413 - protein, 9 aa, Homo Sapiens
NIGIIEDNW

SEQ ID NO: 359414 - protein, 9 aa, Homo Sapiens
RWLKNCNLV

SEQ ID NO: 359415 - protein, 9 aa, Homo Sapiens
YVPIQTPAR

SEQ ID NO: 359416 - protein, 9 aa, Homo Sapiens
NRAEYVWLA

SEQ ID NO: 359417 - protein, 9 aa, Homo Sapiens
SNSATPKML

SEQ ID NO: 359418 - protein, 9 aa, Homo Sapiens
PPTLSPQPQ

SEQ ID NO: 359419 - protein, 9 aa, Homo Sapiens
LLQHNGSFA

SEQ ID NO: 359420 - protein, 9 aa, Homo Sapiens
ITHNDIALL

SEQ ID NO: 359421 - protein, 9 aa, Homo Sapiens
ERPNSSHLF

SEQ ID NO: 359422 - protein, 9 aa, Homo Sapiens
MLFDHIRLV

SEQ ID NO: 359423 - protein, 9 aa, Homo Sapiens
GRPFPKTTL

SEQ ID NO: 359424 - protein, 9 aa, Homo Sapiens
RVPFFICGP

SEQ ID NO: 359425 - protein, 9 aa, Homo Sapiens
AKVTFSCQE

SEQ ID NO: 359426 - protein, 9 aa, Homo Sapiens
LPEPVALTE

SEQ ID NO: 359427 - protein, 9 aa, Homo Sapiens
LFKSLPEPV

SEQ ID NO: 359428 - protein, 9 aa, Homo Sapiens
ELLSAMMQL

SEQ ID NO: 359429 - protein, 9 aa, Homo Sapiens
SVSSLDSFG

SEQ ID NO: 359430 - protein, 9 aa, Homo Sapiens
PLHLCVITS

SEQ ID NO: 359431 - protein, 9 aa, Homo Sapiens
EELVNDHTR

SEQ ID NO: 359432 - protein, 9 aa, Homo Sapiens
LLYNDLFFP

SEQ ID NO: 359433 - protein, 9 aa, Homo Sapiens
GKSCCHCFP

SEQ ID NO: 359434 - protein, 9 aa, Homo Sapiens
NATLEKQLN

SEQ ID NO: 359435 - protein, 9 aa, Homo Sapiens
QPTPPPPGP

SEQ ID NO: 359436 - protein, 9 aa, Homo Sapiens
NVPSQIHSK

SEQ ID NO: 359437 - protein, 9 aa, Homo Sapiens
KLPIAMRVL

SEQ ID NO: 359438 - protein, 9 aa, Homo Sapiens
DDGTASVEG

SEQ ID NO: 359439 - protein, 9 aa, Homo Sapiens
NRPPRLVPV

SEQ ID NO: 359440 - protein, 9 aa, Homo Sapiens
GITSHMVAD

SEQ ID NO: 359441 - protein, 9 aa, Homo Sapiens
TLMANDLGL

SEQ ID NO: 359442 - protein, 9 aa, Homo Sapiens
KWFSGMQKG

SEQ ID NO: 359443 - protein, 9 aa, Homo Sapiens
RITKCIATV

SEQ ID NO: 359444 - protein, 9 aa, Homo Sapiens
LQNLLHGLN

SEQ ID NO: 359445 - protein, 9 aa, Homo Sapiens
CFRCVACSC

SEQ ID NO: 359446 - protein, 9 aa, Homo Sapiens
RTQRWAAGL

SEQ ID NO: 359447 - protein, 9 aa, Homo Sapiens
IPSGKHILW

SEQ ID NO: 359448 - protein, 9 aa, Homo Sapiens
ESVGVAAVA

SEQ ID NO: 359449 - protein, 9 aa, Homo Sapiens
AMALFSFCS

SEQ ID NO: 359450 - protein, 9 aa, Homo Sapiens
SAMMQLWGD

SEQ ID NO: 359451 - protein, 9 aa, Homo Sapiens
GRRGHKDRE

SEQ ID NO: 359452 - protein, 9 aa, Homo Sapiens
LQTAGMHLG

SEQ ID NO: 359453 - protein, 9 aa, Homo Sapiens
PRGRWRPDL

SEQ ID NO: 359454 - protein, 9 aa, Homo Sapiens
PQSFTTYGF

SEQ ID NO: 359455 - protein, 9 aa, Homo Sapiens
DEFKSMMHL

SEQ ID NO: 359456 - protein, 9 aa, Homo Sapiens
GDLKSFLQE

SEQ ID NO: 359457 - protein, 9 aa, Homo Sapiens
HSKDTLTLR

SEQ ID NO: 359458 - protein, 9 aa, Homo Sapiens
SKLMNNIAD

SEQ ID NO: 359459 - protein, 9 aa, Homo Sapiens
GALQVLSEA

SEQ ID NO: 359460 - protein, 9 aa, Homo Sapiens
NHEPAGMGL

SEQ ID NO: 359461 - protein, 9 aa, Homo Sapiens
NVTMQVAGE

SEQ ID NO: 359462 - protein, 9 aa, Homo Sapiens
LMHPYAQKC

SEQ ID NO: 359463 - protein, 9 aa, Homo Sapiens
FSFCSSCGE

SEQ ID NO: 359464 - protein, 9 aa, Homo Sapiens
LMANDLGLA

SEQ ID NO: 359465 - protein, 9 aa, Homo Sapiens
LDSLGTVPE

SEQ ID NO: 359466 - protein, 9 aa, Homo Sapiens
MMQLWGDSG

SEQ ID NO: 359467 - protein, 9 aa, Homo Sapiens
LQWENSFVS

SEQ ID NO: 359468 - protein, 9 aa, Homo Sapiens
QITTLCCVP

SEQ ID NO: 359469 - protein, 9 aa, Homo Sapiens
VACSCQLIP

SEQ ID NO: 359470 - protein, 9 aa, Homo Sapiens
GRTETQTTS

SEQ ID NO: 359471 - protein, 9 aa, Homo Sapiens
PPVLYSTFT

SEQ ID NO: 359472 - protein, 9 aa, Homo Sapiens
EKSQEQPGN

SEQ ID NO: 359473 - protein, 9 aa, Homo Sapiens
SPEVYLKCP

SEQ ID NO: 359474 - protein, 9 aa, Homo Sapiens
TVLGSIDHV

SEQ ID NO: 359475 - protein, 9 aa, Homo Sapiens
QLWGDSGIQ

SEQ ID NO: 359476 - protein, 9 aa, Homo Sapiens
GFGTTLMAN

SEQ ID NO: 359477 - protein, 9 aa, Homo Sapiens
LQETRPRPS

SEQ ID NO: 359478 - protein, 9 aa, Homo Sapiens
PLFKSLPEP

SEQ ID NO: 359479 - protein, 9 aa, Homo Sapiens
YSIMKSCWH

SEQ ID NO: 359480 - protein, 9 aa, Homo Sapiens
VYLKCPAHS

SEQ ID NO: 359481 - protein, 9 aa, Homo Sapiens
QKCSRYIYV

SEQ ID NO: 359482 - protein, 9 aa, Homo Sapiens
RIDEFKSMM

SEQ ID NO: 359483 - protein, 9 aa, Homo Sapiens
YLANVILWG

SEQ ID NO: 359484 - protein, 9 aa, Homo Sapiens
LPREAIIIR

SEQ ID NO: 359485 - protein, 9 aa, Homo Sapiens
LNELTRTNE

SEQ ID NO: 359486 - protein, 9 aa, Homo Sapiens
LGPLFKSLP

SEQ ID NO: 359487 - protein, 9 aa, Homo Sapiens
QIHSKDTLT

SEQ ID NO: 359488 - protein, 9 aa, Homo Sapiens
VTTLQWENS

SEQ ID NO: 359489 - protein, 9 aa, Homo Sapiens
HLCVITSFD

SEQ ID NO: 359490 - protein, 9 aa, Homo Sapiens
QTAGMHLGA

SEQ ID NO: 359491 - protein, 9 aa, Homo Sapiens
CPAHSDDWR

SEQ ID NO: 359492 - protein, 9 aa, Homo Sapiens
SLVSVISIS

SEQ ID NO: 359493 - protein, 9 aa, Homo Sapiens
DLFFPLSFL

SEQ ID NO: 359494 - protein, 9 aa, Homo Sapiens
GKHILWRHL

SEQ ID NO: 359495 - protein, 9 aa, Homo Sapiens
LRSKMGKSC

SEQ ID NO: 359496 - protein, 9 aa, Homo Sapiens
HKDRERERL

SEQ ID NO: 359497 - protein, 9 aa, Homo Sapiens
PPPCVPRSA

SEQ ID NO: 359498 - protein, 9 aa, Homo Sapiens
ANDLGLAQD

SEQ ID NO: 359499 - protein, 9 aa, Homo Sapiens
RPEPQQPTP

SEQ ID NO: 359500 - protein, 9 aa, Homo Sapiens
PIAMRVLTN

SEQ ID NO: 359501 - protein, 9 aa, Homo Sapiens
TPLVTIALD

SEQ ID NO: 359502 - protein, 9 aa, Homo Sapiens
QMDYEEGLM

SEQ ID NO: 359503 - protein, 9 aa, Homo Sapiens
IDYSGMRPL

SEQ ID NO: 359504 - protein, 9 aa, Homo Sapiens
RITFLFDST

SEQ ID NO: 359505 - protein, 9 aa, Homo Sapiens
TLTVTSTQP

SEQ ID NO: 359506 - protein, 9 aa, Homo Sapiens
AKCRDGRKL

SEQ ID NO: 359507 - protein, 9 aa, Homo Sapiens
RSSYLANVI

SEQ ID NO: 359508 - protein, 9 aa, Homo Sapiens
PVLYSTFTW

SEQ ID NO: 359509 - protein, 9 aa, Homo Sapiens
LTVIWCPQD

SEQ ID NO: 359510 - protein, 9 aa, Homo Sapiens
TIALDSLGT

SEQ ID NO: 359511 - protein, 9 aa, Homo Sapiens
DPSEGSPCS

SEQ ID NO: 359512 - protein, 9 aa, Homo Sapiens
AWPGAGRTE

SEQ ID NO: 359513 - protein, 9 aa, Homo Sapiens
SKEGKKYHS

SEQ ID NO: 359514 - protein, 9 aa, Homo Sapiens
VVKVVGGHM

SEQ ID NO: 359515 - protein, 9 aa, Homo Sapiens
CSPDGALQV

SEQ ID NO: 359516 - protein, 9 aa, Homo Sapiens
PDIIIMPPT

SEQ ID NO: 359517 - protein, 9 aa, Homo Sapiens
SPDGALQVL

SEQ ID NO: 359518 - protein, 9 aa, Homo Sapiens
YEYKQCSKA

SEQ ID NO: 359519 - protein, 9 aa, Homo Sapiens
CNMALLFSF

SEQ ID NO: 359520 - protein, 9 aa, Homo Sapiens
YENWLVSRI

SEQ ID NO: 359521 - protein, 9 aa, Homo Sapiens
GVLMDLGCY

SEQ ID NO: 359522 - protein, 9 aa, Homo Sapiens
VSTGHAIPL

SEQ ID NO: 359523 - protein, 9 aa, Homo Sapiens
LANVILWGH

SEQ ID NO: 359524 - protein, 9 aa, Homo Sapiens
TSSLVSVIS

SEQ ID NO: 359525 - protein, 9 aa, Homo Sapiens
DLGCYSMQL

SEQ ID NO: 359526 - protein, 9 aa, Homo Sapiens
IYIYTHIYI

SEQ ID NO: 359527 - protein, 9 aa, Homo Sapiens
SMVVDTPEL

SEQ ID NO: 359528 - protein, 9 aa, Homo Sapiens
PDGALQVLS

SEQ ID NO: 359529 - protein, 9 aa, Homo Sapiens
STGHTKRIT

SEQ ID NO: 359530 - protein, 9 aa, Homo Sapiens
APFRVNHAV

SEQ ID NO: 359531 - protein, 9 aa, Homo Sapiens
PSTYAAAYA

SEQ ID NO: 359532 - protein, 9 aa, Homo Sapiens
PPLPREAII

SEQ ID NO: 359533 - protein, 9 aa, Homo Sapiens
LGRTQRWAA

SEQ ID NO: 359534 - protein, 9 aa, Homo Sapiens
KKWFSGMQK

SEQ ID NO: 359535 - protein, 9 aa, Homo Sapiens
YKKWFSGMQ

SEQ ID NO: 359536 - protein, 9 aa, Homo Sapiens
KSLPEPVAL

SEQ ID NO: 359537 - protein, 9 aa, Homo Sapiens
IALDSLGTV

SEQ ID NO: 359538 - protein, 9 aa, Homo Sapiens
LMDLGCYSM

SEQ ID NO: 359539 - protein, 9 aa, Homo Sapiens
PLPREAIII

SEQ ID NO: 359540 - protein, 9 aa, Homo Sapiens
PRAWPGAGR

SEQ ID NO: 359541 - protein, 9 aa, Homo Sapiens
RPSSAATSQ

SEQ ID NO: 359542 - protein, 9 aa, Homo Sapiens
LKSFLQETR

SEQ ID NO: 359543 - protein, 9 aa, Homo Sapiens
ACSCQLIPG

SEQ ID NO: 359544 - protein, 9 aa, Homo Sapiens
EIFDSRRNP

SEQ ID NO: 359545 - protein, 9 aa, Homo Sapiens
KCSRYIYVV

SEQ ID NO: 359546 - protein, 9 aa, Homo Sapiens
CQLIPGDEF

SEQ ID NO: 359547 - protein, 9 aa, Homo Sapiens
RARKPRGRW

SEQ ID NO: 359548 - protein, 9 aa, Homo Sapiens
TLKTIINRL

SEQ ID NO: 359549 - protein, 9 aa, Homo Sapiens
ALLFSFAQA

SEQ ID NO: 359550 - protein, 9 aa, Homo Sapiens
NDLGLAQDS

SEQ ID NO: 359551 - protein, 9 aa, Homo Sapiens
WPGAGRTET

SEQ ID NO: 359552 - protein, 9 aa, Homo Sapiens
HCSPDGALQ

SEQ ID NO: 359553 - protein, 9 aa, Homo Sapiens
TLPLHLCVI

SEQ ID NO: 359554 - protein, 9 aa, Homo Sapiens
FQITTLCCV

SEQ ID NO: 359555 - protein, 9 aa, Homo Sapiens
SAATSQAPP

SEQ ID NO: 359556 - protein, 9 aa, Homo Sapiens
ATVNLTVIW

SEQ ID NO: 359557 - protein, 9 aa, Homo Sapiens
MVVDTPELL

SEQ ID NO: 359558 - protein, 9 aa, Homo Sapiens
DERISRFSM

SEQ ID NO: 359559 - protein, 9 aa, Homo Sapiens
FTTYGFMPF

SEQ ID NO: 359560 - protein, 9 aa, Homo Sapiens
IREREEREC

SEQ ID NO: 359561 - protein, 9 aa, Homo Sapiens
VPCQAETCA

SEQ ID NO: 359562 - protein, 9 aa, Homo Sapiens
TVIWCPQDT

SEQ ID NO: 359563 - protein, 9 aa, Homo Sapiens
LQRPEPQQP

SEQ ID NO: 359564 - protein, 9 aa, Homo Sapiens
EGSPCSPAG

SEQ ID NO: 359565 - protein, 9 aa, Homo Sapiens
SQIHSKDTL

SEQ ID NO: 359566 - protein, 9 aa, Homo Sapiens
LVKLARGYT

SEQ ID NO: 359567 - protein, 9 aa, Homo Sapiens
KKLPIELCD

SEQ ID NO: 359568 - protein, 9 aa, Homo Sapiens
KSCWHWREA

SEQ ID NO: 359569 - protein, 9 aa, Homo Sapiens
ITSHMVADV

SEQ ID NO: 359570 - protein, 9 aa, Homo Sapiens
PEDDGTASV

SEQ ID NO: 359571 - protein, 9 aa, Homo Sapiens
YLKCPAHSD

SEQ ID NO: 359572 - protein, 9 aa, Homo Sapiens
MGKSCCHCF

SEQ ID NO: 359573 - protein, 9 aa, Homo Sapiens
PLVTIALDS

SEQ ID NO: 359574 - protein, 9 aa, Homo Sapiens
SSTNSTSST

SEQ ID NO: 359575 - protein, 9 aa, Homo Sapiens
IFDSRRNPT

SEQ ID NO: 359576 - protein, 9 aa, Homo Sapiens
TVTSTQPVG

SEQ ID NO: 359577 - protein, 9 aa, Homo Sapiens
CGESVGVAA

SEQ ID NO: 359578 - protein, 9 aa, Homo Sapiens
KSDNSQHLS

SEQ ID NO: 359579 - protein, 9 aa, Homo Sapiens
TLVKLARGY

SEQ ID NO: 359580 - protein, 9 aa, Homo Sapiens
PEADSLADA

SEQ ID NO: 359581 - protein, 9 aa, Homo Sapiens
RGYTNGTKP

SEQ ID NO: 359582 - protein, 9 aa, Homo Sapiens
ALDSLGTVP

SEQ ID NO: 359583 - protein, 9 aa, Homo Sapiens
QPGNFYVSS

SEQ ID NO: 359584 - protein, 9 aa, Homo Sapiens
RRGHKDRER

SEQ ID NO: 359585 - protein, 9 aa, Homo Sapiens
SHCSPDGAL

SEQ ID NO: 359586 - protein, 9 aa, Homo Sapiens
DVRITKCIA

SEQ ID NO: 359587 - protein, 9 aa, Homo Sapiens
EREERECLQ

SEQ ID NO: 359588 - protein, 9 aa, Homo Sapiens
LPAPFRVNH

SEQ ID NO: 359589 - protein, 9 aa, Homo Sapiens
TQRSVDGSR

SEQ ID NO: 359590 - protein, 9 aa, Homo Sapiens
SKPLAAKHG

SEQ ID NO: 359591 - protein, 9 aa, Homo Sapiens
LSPEVYLKC

SEQ ID NO: 359592 - protein, 9 aa, Homo Sapiens
CWHWREADR

SEQ ID NO: 359593 - protein, 9 aa, Homo Sapiens
DITLFHTMD

SEQ ID NO: 359594 - protein, 9 aa, Homo Sapiens
DGALQVLSE

SEQ ID NO: 359595 - protein, 9 aa, Homo Sapiens
EYKQCSKAF

SEQ ID NO: 359596 - protein, 9 aa, Homo Sapiens
ATSQAPPRP

SEQ ID NO: 359597 - protein, 9 aa, Homo Sapiens
GGDLKSFLQ

SEQ ID NO: 359598 - protein, 9 aa, Homo Sapiens
SVPCQAETC

SEQ ID NO: 359599 - protein, 9 aa, Homo Sapiens
DSRRNPTVE

SEQ ID NO: 359600 - protein, 9 aa, Homo Sapiens
GSWTEAKCR

SEQ ID NO: 359601 - protein, 9 aa, Homo Sapiens
NPSTYAAAY

SEQ ID NO: 359602 - protein, 9 aa, Homo Sapiens
NNIADICKS

SEQ ID NO: 359603 - protein, 9 aa, Homo Sapiens
KMYGSAVPA

SEQ ID NO: 359604 - protein, 9 aa, Homo Sapiens
VNLEAVRIL

SEQ ID NO: 359605 - protein, 9 aa, Homo Sapiens
VEGPDEAGR

SEQ ID NO: 359606 - protein, 9 aa, Homo Sapiens
ARGYTNGTK

SEQ ID NO: 359607 - protein, 9 aa, Homo Sapiens
PTSGLGRTQ

SEQ ID NO: 359608 - protein, 9 aa, Homo Sapiens
TGHTKRITF

SEQ ID NO: 359609 - protein, 9 aa, Homo Sapiens
PKTLDKFTI

SEQ ID NO: 359610 - protein, 9 aa, Homo Sapiens
YKQCSKAFP

SEQ ID NO: 359611 - protein, 9 aa, Homo Sapiens
PSTTSSLVS

SEQ ID NO: 359612 - protein, 9 aa, Homo Sapiens
FDSRRNPTV

SEQ ID NO: 359613 - protein, 9 aa, Homo Sapiens
RRNPTVEVD

SEQ ID NO: 359614 - protein, 9 aa, Homo Sapiens
YSTFTWLGY

SEQ ID NO: 359615 - protein, 9 aa, Homo Sapiens
KCTECVKSF

SEQ ID NO: 359616 - protein, 9 aa, Homo Sapiens
ILNTLSKFQ

SEQ ID NO: 359617 - protein, 9 aa, Homo Sapiens
ELCDSYRKG

SEQ ID NO: 359618 - protein, 9 aa, Homo Sapiens
WRPDLPAPE

SEQ ID NO: 359619 - protein, 9 aa, Homo Sapiens
AMIEHIDYS

SEQ ID NO: 359620 - protein, 9 aa, Homo Sapiens
EAQQTPEFK

SEQ ID NO: 359621 - protein, 9 aa, Homo Sapiens
VQPEADSLA

SEQ ID NO: 359622 - protein, 9 aa, Homo Sapiens
AAPPPPCVP

SEQ ID NO: 359623 - protein, 9 aa, Homo Sapiens
RPANPSTYA

SEQ ID NO: 359624 - protein, 9 aa, Homo Sapiens
CQAETCAHL

SEQ ID NO: 359625 - protein, 9 aa, Homo Sapiens
SLDSFGVVR

SEQ ID NO: 359626 - protein, 9 aa, Homo Sapiens
NPVNLEAVR

SEQ ID NO: 359627 - protein, 9 aa, Homo Sapiens
AQKCSRYIY

SEQ ID NO: 359628 - protein, 9 aa, Homo Sapiens
MANDLGLAQ

SEQ ID NO: 359629 - protein, 9 aa, Homo Sapiens
WHWREADRP

SEQ ID NO: 359630 - protein, 9 aa, Homo Sapiens
GRWRPDLPA

SEQ ID NO: 359631 - protein, 9 aa, Homo Sapiens
GYTNGTKPL

SEQ ID NO: 359632 - protein, 9 aa, Homo Sapiens
AELLSAMMQ

SEQ ID NO: 359633 - protein, 9 aa, Homo Sapiens
LFHTMDTLY

SEQ ID NO: 359634 - protein, 9 aa, Homo Sapiens
LSVPCQAET

SEQ ID NO: 359635 - protein, 9 aa, Homo Sapiens
HWREADRPS

SEQ ID NO: 359636 - protein, 9 aa, Homo Sapiens
MMSLKSDNS

SEQ ID NO: 359637 - protein, 9 aa, Homo Sapiens
CDSYRKGFW

SEQ ID NO: 359638 - protein, 9 aa, Homo Sapiens
SSGQGTPSS

SEQ ID NO: 359639 - protein, 9 aa, Homo Sapiens
PSSVSTGHA

SEQ ID NO: 359640 - protein, 9 aa, Homo Sapiens
HEMPNHEPA

SEQ ID NO: 359641 - protein, 9 aa, Homo Sapiens
GMQKGVETE

SEQ ID NO: 359642 - protein, 9 aa, Homo Sapiens
TQPVGTRDW

SEQ ID NO: 359643 - protein, 9 aa, Homo Sapiens
SFTTYGFMP

SEQ ID NO: 359644 - protein, 9 aa, Homo Sapiens
IPAPKPKIA

SEQ ID NO: 359645 - protein, 9 aa, Homo Sapiens
RLPAPFRVN

SEQ ID NO: 359646 - protein, 9 aa, Homo Sapiens
PANPSTYAA

SEQ ID NO: 359647 - protein, 9 aa, Homo Sapiens
VLLQSKEGK

SEQ ID NO: 359648 - protein, 9 aa, Homo Sapiens
NSVDKLKVH

SEQ ID NO: 359649 - protein, 9 aa, Homo Sapiens
TSTQPVGTR

SEQ ID NO: 359650 - protein, 9 aa, Homo Sapiens
GCYSMQLDT

SEQ ID NO: 359651 - protein, 9 aa, Homo Sapiens
KEGKKYHSQ

SEQ ID NO: 359652 - protein, 9 aa, Homo Sapiens
ITKCIATVN

SEQ ID NO: 359653 - protein, 9 aa, Homo Sapiens
KDTLTLRTS

SEQ ID NO: 359654 - protein, 9 aa, Homo Sapiens
LVALSLPTG

SEQ ID NO: 359655 - protein, 9 aa, Homo Sapiens
ITFLFDSTL

SEQ ID NO: 359656 - protein, 9 aa, Homo Sapiens
QSFTTYGFM

SEQ ID NO: 359657 - protein, 9 aa, Homo Sapiens
SGSWTEAKC

SEQ ID NO: 359658 - protein, 9 aa, Homo Sapiens
VSRIHIQKG

SEQ ID NO: 359659 - protein, 9 aa, Homo Sapiens
VITSFDVCL

SEQ ID NO: 359660 - protein, 9 aa, Homo Sapiens
HCNMALLFS

SEQ ID NO: 359661 - protein, 9 aa, Homo Sapiens
PVNLEAVRI

SEQ ID NO: 359662 - protein, 9 aa, Homo Sapiens
MRVLTNYQR

SEQ ID NO: 359663 - protein, 9 aa, Homo Sapiens
VLYSTFTWL

SEQ ID NO: 359664 - protein, 9 aa, Homo Sapiens
ENPVNLEAV

SEQ ID NO: 359665 - protein, 9 aa, Homo Sapiens
IDEFKSMMH

SEQ ID NO: 359666 - protein, 9 aa, Homo Sapiens
QQNLYKDVM

SEQ ID NO: 359667 - protein, 9 aa, Homo Sapiens
GAGRTETQT

SEQ ID NO: 359668 - protein, 9 aa, Homo Sapiens
SGQGTPSST

SEQ ID NO: 359669 - protein, 9 aa, Homo Sapiens
RGHKDRERE

SEQ ID NO: 359670 - protein, 9 aa, Homo Sapiens
KPRGRWRPD

SEQ ID NO: 359671 - protein, 9 aa, Homo Sapiens
KEYEEAMST

SEQ ID NO: 359672 - protein, 9 aa, Homo Sapiens
GGTESLQMT

SEQ ID NO: 359673 - protein, 9 aa, Homo Sapiens
HILWRHLAE

SEQ ID NO: 359674 - protein, 9 aa, Homo Sapiens
DFFLLVSPH

SEQ ID NO: 359675 - protein, 9 aa, Homo Sapiens
SPHRCGAVE

SEQ ID NO: 359676 - protein, 9 aa, Homo Sapiens
SFGVVRLPA

SEQ ID NO: 359677 - protein, 9 aa, Homo Sapiens
SAVPAAAPT

SEQ ID NO: 359678 - protein, 9 aa, Homo Sapiens
VSSLDSFGV

SEQ ID NO: 359679 - protein, 9 aa, Homo Sapiens
MQVAGETYS

SEQ ID NO: 359680 - protein, 9 aa, Homo Sapiens
PHRCGAVET

SEQ ID NO: 359681 - protein, 9 aa, Homo Sapiens
HLGAQTPVG

SEQ ID NO: 359682 - protein, 9 aa, Homo Sapiens
VLTNYQRLC

SEQ ID NO: 359683 - protein, 9 aa, Homo Sapiens
CDKAFNSVD

SEQ ID NO: 359684 - protein, 9 aa, Homo Sapiens
VTSTQPVGT

SEQ ID NO: 359685 - protein, 9 aa, Homo Sapiens
EAKCRDGRK

SEQ ID NO: 359686 - protein, 9 aa, Homo Sapiens
SVGVAAVAA

SEQ ID NO: 359687 - protein, 9 aa, Homo Sapiens
AGGTESLQM

SEQ ID NO: 359688 - protein, 9 aa, Homo Sapiens
CQMDYEEGL

SEQ ID NO: 359689 - protein, 9 aa, Homo Sapiens
SQILPTKEY

SEQ ID NO: 359690 - protein, 9 aa, Homo Sapiens
WCPQDTGGG

SEQ ID NO: 359691 - protein, 9 aa, Homo Sapiens
LSAMMQLWG

SEQ ID NO: 359692 - protein, 9 aa, Homo Sapiens
LKSDNSQHL

SEQ ID NO: 359693 - protein, 9 aa, Homo Sapiens
CTECVKSFS

SEQ ID NO: 359694 - protein, 9 aa, Homo Sapiens
PEPQQPTPP

SEQ ID NO: 359695 - protein, 9 aa, Homo Sapiens
HETLKTIIN

SEQ ID NO: 359696 - protein, 9 aa, Homo Sapiens
LQLQVQPEA

SEQ ID NO: 359697 - protein, 9 aa, Homo Sapiens
GVAAVAAIT

SEQ ID NO: 359698 - protein, 9 aa, Homo Sapiens
TLRSKMGKS

SEQ ID NO: 359699 - protein, 9 aa, Homo Sapiens
IMKSCWHWR

SEQ ID NO: 359700 - protein, 9 aa, Homo Sapiens
DLKSFLQET

SEQ ID NO: 359701 - protein, 9 aa, Homo Sapiens
GAMIEHIDY

SEQ ID NO: 359702 - protein, 9 aa, Homo Sapiens
SETTTTAST

SEQ ID NO: 359703 - protein, 9 aa, Homo Sapiens
IIIRHTSVR

SEQ ID NO: 359704 - protein, 9 aa, Homo Sapiens
RHHEMPNHE

SEQ ID NO: 359705 - protein, 9 aa, Homo Sapiens
SFCSSCGEL

SEQ ID NO: 359706 - protein, 9 aa, Homo Sapiens
GGHMLYVCA

SEQ ID NO: 359707 - protein, 9 aa, Homo Sapiens
VPAAAPTNL

SEQ ID NO: 359708 - protein, 9 aa, Homo Sapiens
IMPPTPTGM

SEQ ID NO: 359709 - protein, 9 aa, Homo Sapiens
HEPAGMGLN

SEQ ID NO: 359710 - protein, 9 aa, Homo Sapiens
PCVPRSAST

SEQ ID NO: 359711 - protein, 9 aa, Homo Sapiens
LQVQPEADS

SEQ ID NO: 359712 - protein, 9 aa, Homo Sapiens
AQQTPEFKE

SEQ ID NO: 359713 - protein, 9 aa, Homo Sapiens
AMMQLWGDS

SEQ ID NO: 359714 - protein, 9 aa, Homo Sapiens
VKSFSQSST

SEQ ID NO: 359715 - protein, 9 aa, Homo Sapiens
AATSQAPPR

SEQ ID NO: 359716 - protein, 9 aa, Homo Sapiens
EHIDYSGMR

SEQ ID NO: 359717 - protein, 9 aa, Homo Sapiens
MQKGVETES

SEQ ID NO: 359718 - protein, 9 aa, Homo Sapiens
DSQWKNVTM

SEQ ID NO: 359719 - protein, 9 aa, Homo Sapiens
TDQMMSLKS

SEQ ID NO: 359720 - protein, 9 aa, Homo Sapiens
LLQSKEGKK

SEQ ID NO: 359721 - protein, 9 aa, Homo Sapiens
SCCHCFPCC

SEQ ID NO: 359722 - protein, 9 aa, Homo Sapiens
VADVSWHSL

SEQ ID NO: 359723 - protein, 9 aa, Homo Sapiens
HIYIHTHTF

SEQ ID NO: 359724 - protein, 9 aa, Homo Sapiens
IEHIDYSGM

SEQ ID NO: 359725 - protein, 9 aa, Homo Sapiens
CYLHETLKT

SEQ ID NO: 359726 - protein, 9 aa, Homo Sapiens
DTAQQNLYK

SEQ ID NO: 359727 - protein, 9 aa, Homo Sapiens
QMPKKTQRS

SEQ ID NO: 359728 - protein, 9 aa, Homo Sapiens
VTMQVAGET

SEQ ID NO: 359729 - protein, 9 aa, Homo Sapiens
WLVSRIHIQ

SEQ ID NO: 359730 - protein, 9 aa, Homo Sapiens
FGPQSFTTY

SEQ ID NO: 359731 - protein, 9 aa, Homo Sapiens
VPDIIIMPP

SEQ ID NO: 359732 - protein, 9 aa, Homo Sapiens
TIRIWDVRI

SEQ ID NO: 359733 - protein, 9 aa, Homo Sapiens
MKSCWHWRE

SEQ ID NO: 359734 - protein, 9 aa, Homo Sapiens
ANPSTYAAA

SEQ ID NO: 359735 - protein, 9 aa, Homo Sapiens
HHEMPNHEP

SEQ ID NO: 359736 - protein, 9 aa, Homo Sapiens
KPLAAKHGF

SEQ ID NO: 359737 - protein, 9 aa, Homo Sapiens
VVRLPAPFR

SEQ ID NO: 359738 - protein, 9 aa, Homo Sapiens
VPPLPREAI

SEQ ID NO: 359739 - protein, 9 aa, Homo Sapiens
GLGPLFKSL

SEQ ID NO: 359740 - protein, 9 aa, Homo Sapiens
TPSSTNSTS

SEQ ID NO: 359741 - protein, 9 aa, Homo Sapiens
PRHHEMPNH

SEQ ID NO: 359742 - protein, 9 aa, Homo Sapiens
RKPRGRWRP

SEQ ID NO: 359743 - protein, 9 aa, Homo Sapiens
SKDTLTLRT

SEQ ID NO: 359744 - protein, 9 aa, Homo Sapiens
STYAAAYAG

SEQ ID NO: 359745 - protein, 9 aa, Homo Sapiens
QRSVDGSRL

SEQ ID NO: 359746 - protein, 9 aa, Homo Sapiens
APPPPCVPR

SEQ ID NO: 359747 - protein, 9 aa, Homo Sapiens
AVRILVKDE

SEQ ID NO: 359748 - protein, 9 aa, Homo Sapiens
FLQETRPRP

SEQ ID NO: 359749 - protein, 9 aa, Homo Sapiens
LVPVANYPH

SEQ ID NO: 359750 - protein, 9 aa, Homo Sapiens
IYTHIYIHT

SEQ ID NO: 359751 - protein, 9 aa, Homo Sapiens
KTQRSVDGS

SEQ ID NO: 359752 - protein, 9 aa, Homo Sapiens
MRLSVPCQA

SEQ ID NO: 359753 - protein, 9 aa, Homo Sapiens
WFSGMQKGV

SEQ ID NO: 359754 - protein, 9 aa, Homo Sapiens
ISRFSMVVD

SEQ ID NO: 359755 - protein, 9 aa, Homo Sapiens
WDVRITKCI

SEQ ID NO: 359756 - protein, 9 aa, Homo Sapiens
LFSFCSSCG

SEQ ID NO: 359757 - protein, 9 aa, Homo Sapiens
VDPSEGSPC

SEQ ID NO: 359758 - protein, 9 aa, Homo Sapiens
TLSKFQITT

SEQ ID NO: 359759 - protein, 9 aa, Homo Sapiens
FRVNHAVEW

SEQ ID NO: 359760 - protein, 9 aa, Homo Sapiens
MQLWGDSGI

SEQ ID NO: 359761 - protein, 9 aa, Homo Sapiens
LSLPTGHGD

SEQ ID NO: 359762 - protein, 9 aa, Homo Sapiens
STFTWLGYV

SEQ ID NO: 359763 - protein, 9 aa, Homo Sapiens
GRTQRWAAG

SEQ ID NO: 359764 - protein, 9 aa, Homo Sapiens
RDITLFHTM

SEQ ID NO: 359765 - protein, 9 aa, Homo Sapiens
PKIATVLIW

SEQ ID NO: 359766 - protein, 9 aa, Homo Sapiens
LVSRIHIQK

SEQ ID NO: 359767 - protein, 9 aa, Homo Sapiens
MALLFSFAQ

SEQ ID NO: 359768 - protein, 9 aa, Homo Sapiens
AMRVLTNYQ

SEQ ID NO: 359769 - protein, 9 aa, Homo Sapiens
LVTIALDSL

SEQ ID NO: 359770 - protein, 9 aa, Homo Sapiens
HGAMIEHID

SEQ ID NO: 359771 - protein, 9 aa, Homo Sapiens
LARGYTNGT

SEQ ID NO: 359772 - protein, 9 aa, Homo Sapiens
SLPTGHGDT

SEQ ID NO: 359773 - protein, 9 aa, Homo Sapiens
YTHIYIHTH

SEQ ID NO: 359774 - protein, 9 aa, Homo Sapiens
GPQSFTTYG

SEQ ID NO: 359775 - protein, 9 aa, Homo Sapiens
PAAWEAQQT

SEQ ID NO: 359776 - protein, 9 aa, Homo Sapiens
MIEHIDYSG

SEQ ID NO: 359777 - protein, 9 aa, Homo Sapiens
IIIMPPTPT

SEQ ID NO: 359778 - protein, 9 aa, Homo Sapiens
RVLTNYQRL

SEQ ID NO: 359779 - protein, 9 aa, Homo Sapiens
VNLTVIWCP

SEQ ID NO: 359780 - protein, 9 aa, Homo Sapiens
ETLKTIINR

SEQ ID NO: 359781 - protein, 9 aa, Homo Sapiens
TTSSLVSVI

SEQ ID NO: 359782 - protein, 9 aa, Homo Sapiens
QPKTLDKFT

SEQ ID NO: 359783 - protein, 9 aa, Homo Sapiens
VKVVGGHML

SEQ ID NO: 359784 - protein, 9 aa, Homo Sapiens
PAPKPKIAT

SEQ ID NO: 359785 - protein, 9 aa, Homo Sapiens
LEEAMALFS

SEQ ID NO: 359786 - protein, 9 aa, Homo Sapiens
ARPANPSTY

SEQ ID NO: 359787 - protein, 9 aa, Homo Sapiens
KCPAHSDDW

SEQ ID NO: 359788 - protein, 9 aa, Homo Sapiens
EEAMALFSF

SEQ ID NO: 359789 - protein, 9 aa, Homo Sapiens
YSMQLDTPE

SEQ ID NO: 359790 - protein, 9 aa, Homo Sapiens
AREIFDSRR

SEQ ID NO: 359791 - protein, 9 aa, Homo Sapiens
VIWCPQDTG

SEQ ID NO: 359792 - protein, 9 aa, Homo Sapiens
CSRYIYVVW

SEQ ID NO: 359793 - protein, 9 aa, Homo Sapiens
PLVLLSKPL

SEQ ID NO: 359794 - protein, 9 aa, Homo Sapiens
YTNGTKPLD

SEQ ID NO: 359795 - protein, 9 aa, Homo Sapiens
NKKLPIELC

SEQ ID NO: 359796 - protein, 9 aa, Homo Sapiens
FRCVACSCQ

SEQ ID NO: 359797 - protein, 9 aa, Homo Sapiens
PSGKHILWR

SEQ ID NO: 359798 - protein, 9 aa, Homo Sapiens
QQTPEFKEP

SEQ ID NO: 359799 - protein, 9 aa, Homo Sapiens
WRHLAEEMS

SEQ ID NO: 359800 - protein, 9 aa, Homo Sapiens
FLLVSPHRC

SEQ ID NO: 359801 - protein, 9 aa, Homo Sapiens
HTKRITFLF

SEQ ID NO: 359802 - protein, 9 aa, Homo Sapiens
GHTKRITFL

SEQ ID NO: 359803 - protein, 9 aa, Homo Sapiens
PRSVTTLQW

SEQ ID NO: 359804 - protein, 9 aa, Homo Sapiens
QSKEGKKYH

SEQ ID NO: 359805 - protein, 9 aa, Homo Sapiens
AAAPTNLPT

SEQ ID NO: 359806 - protein, 9 aa, Homo Sapiens
PTGHGDTDG

SEQ ID NO: 359807 - protein, 9 aa, Homo Sapiens
VALSLPTGH

SEQ ID NO: 359808 - protein, 9 aa, Homo Sapiens
KMRLSVPCQ

SEQ ID NO: 359809 - protein, 9 aa, Homo Sapiens
ETLPLHLCV

SEQ ID NO: 359810 - protein, 9 aa, Homo Sapiens
TESLQMTFL

SEQ ID NO: 359811 - protein, 9 aa, Homo Sapiens
EKLYEYKQC

SEQ ID NO: 359812 - protein, 9 aa, Homo Sapiens
LVNDHTRKN

SEQ ID NO: 359813 - protein, 9 aa, Homo Sapiens
SGMQKGVET

SEQ ID NO: 359814 - protein, 9 aa, Homo Sapiens
AVPAAAPTN

SEQ ID NO: 359815 - protein, 9 aa, Homo Sapiens
GQGTPSSTN

SEQ ID NO: 359816 - protein, 9 aa, Homo Sapiens
QQPTPPPPG

SEQ ID NO: 359817 - protein, 9 aa, Homo Sapiens
FGITSHMVA

SEQ ID NO: 359818 - protein, 9 aa, Homo Sapiens
EGKKYHSQK

SEQ ID NO: 359819 - protein, 9 aa, Homo Sapiens
QTPEFKEPQ

SEQ ID NO: 359820 - protein, 9 aa, Homo Sapiens
HGIHCNMAL

SEQ ID NO: 359821 - protein, 9 aa, Homo Sapiens
PPCVPRSAS

SEQ ID NO: 359822 - protein, 9 aa, Homo Sapiens
NWLVSRIHI

SEQ ID NO: 359823 - protein, 9 aa, Homo Sapiens
ILPTKEYEE

SEQ ID NO: 359824 - protein, 9 aa, Homo Sapiens
ERISRFSMV

SEQ ID NO: 359825 - protein, 9 aa, Homo Sapiens
PCSPAGLGA

SEQ ID NO: 359826 - protein, 9 aa, Homo Sapiens
EQPGNFYVS

SEQ ID NO: 359827 - protein, 9 aa, Homo Sapiens
GPLFKSLPE

SEQ ID NO: 359828 - protein, 9 aa, Homo Sapiens
TTTTASTEG

SEQ ID NO: 359829 - protein, 9 aa, Homo Sapiens
TSGLGRTQR

SEQ ID NO: 359830 - protein, 9 aa, Homo Sapiens
FHTMDTLYR

SEQ ID NO: 359831 - protein, 9 aa, Homo Sapiens
QDLQNLLHG

SEQ ID NO: 359832 - protein, 9 aa, Homo Sapiens
LSKFQITTL

SEQ ID NO: 359833 - protein, 9 aa, Homo Sapiens
KTLDKFTII

SEQ ID NO: 359834 - protein, 9 aa, Homo Sapiens
RGRWRPDLP

SEQ ID NO: 359835 - protein, 9 aa, Homo Sapiens
LVLLSKPLA

SEQ ID NO: 359836 - protein, 9 aa, Homo Sapiens
VPLGGRRGH

SEQ ID NO: 359837 - protein, 9 aa, Homo Sapiens
EAVRILVKD

SEQ ID NO: 359838 - protein, 9 aa, Homo Sapiens
GTTLMANDL

SEQ ID NO: 359839 - protein, 9 aa, Homo Sapiens
MPPTPTGMM

SEQ ID NO: 359840 - protein, 9 aa, Homo Sapiens
IQMPKKTQR

SEQ ID NO: 359841 - protein, 9 aa, Homo Sapiens
REIFDSRRN

SEQ ID NO: 359842 - protein, 9 aa, Homo Sapiens
AFNSVDKLK

SEQ ID NO: 359843 - protein, 9 aa, Homo Sapiens
VFAEKSQEQ

SEQ ID NO: 359844 - protein, 9 aa, Homo Sapiens
GVVRLPAPF

SEQ ID NO: 359845 - protein, 9 aa, Homo Sapiens
SRDITLFHT

SEQ ID NO: 359846 - protein, 9 aa, Homo Sapiens
TECVKSFSQ

SEQ ID NO: 359847 - protein, 9 aa, Homo Sapiens
TAGMHLGAQ

SEQ ID NO: 359848 - protein, 9 aa, Homo Sapiens
LCVITSFDV

SEQ ID NO: 359849 - protein, 9 aa, Homo Sapiens
WAGGTESLQ

SEQ ID NO: 359850 - protein, 9 aa, Homo Sapiens
SSVSTGHAI

SEQ ID NO: 359851 - protein, 9 aa, Homo Sapiens
TEAKCRDGR

SEQ ID NO: 359852 - protein, 9 aa, Homo Sapiens
WTEAKCRDG

SEQ ID NO: 359853 - protein, 9 aa, Homo Sapiens
MNNIADICK

SEQ ID NO: 359854 - protein, 9 aa, Homo Sapiens
TPTSGLGRT

SEQ ID NO: 359855 - protein, 9 aa, Homo Sapiens
APKPKIATV

SEQ ID NO: 359856 - protein, 9 aa, Homo Sapiens
GLNVIGQIT

SEQ ID NO: 359857 - protein, 9 aa, Homo Sapiens
IYIHTHTFY

SEQ ID NO: 359858 - protein, 9 aa, Homo Sapiens
HPYAQKCSR

SEQ ID NO: 359859 - protein, 9 aa, Homo Sapiens
AAWEAQQTP

SEQ ID NO: 359860 - protein, 9 aa, Homo Sapiens
FGTTLMAND

SEQ ID NO: 359861 - protein, 9 aa, Homo Sapiens
EMPNHEPAG

SEQ ID NO: 359862 - protein, 9 aa, Homo Sapiens
PAPFRVNHA

SEQ ID NO: 359863 - protein, 9 aa, Homo Sapiens
ECLQRERER

SEQ ID NO: 359864 - protein, 9 aa, Homo Sapiens
VVGGHMLYV

SEQ ID NO: 359865 - protein, 9 aa, Homo Sapiens
ALSLPTGHG

SEQ ID NO: 359866 - protein, 9 aa, Homo Sapiens
SQEQPGNFY

SEQ ID NO: 359867 - protein, 9 aa, Homo Sapiens
GARPANPST

SEQ ID NO: 359868 - protein, 9 aa, Homo Sapiens
QETRPRPSQ

SEQ ID NO: 359869 - protein, 9 aa, Homo Sapiens
QHGIHCNMA

SEQ ID NO: 359870 - protein, 9 aa, Homo Sapiens
PSSAATSQA

SEQ ID NO: 359871 - protein, 9 aa, Homo Sapiens
TVNLTVIWC

SEQ ID NO: 359872 - protein, 9 aa, Homo Sapiens
VLGSIDHVY

SEQ ID NO: 359873 - protein, 9 aa, Homo Sapiens
TASVEGPDE

SEQ ID NO: 359874 - protein, 9 aa, Homo Sapiens
VPSQIHSKD

SEQ ID NO: 359875 - protein, 9 aa, Homo Sapiens
LYSTFTWLG

SEQ ID NO: 359876 - protein, 9 aa, Homo Sapiens
MPKKTQRSV

SEQ ID NO: 359877 - protein, 9 aa, Homo Sapiens
VDKLKVHSY

SEQ ID NO: 359878 - protein, 9 aa, Homo Sapiens
NDLFFPLSF

SEQ ID NO: 359879 - protein, 9 aa, Homo Sapiens
HMLYVCAAC

SEQ ID NO: 359880 - protein, 9 aa, Homo Sapiens
YLHETLKTI

SEQ ID NO: 359881 - protein, 9 aa, Homo Sapiens
LWAGGTESL

SEQ ID NO: 359882 - protein, 9 aa, Homo Sapiens
LLLYNDLFF

SEQ ID NO: 359883 - protein, 9 aa, Homo Sapiens
AEKSQEQPG

SEQ ID NO: 359884 - protein, 9 aa, Homo Sapiens
QKGVETEST

SEQ ID NO: 359885 - protein, 9 aa, Homo Sapiens
TYAAAYAGP

SEQ ID NO: 359886 - protein, 9 aa, Homo Sapiens
VSPHRCGAV

SEQ ID NO: 359887 - protein, 9 aa, Homo Sapiens
IRIWDVRIT

SEQ ID NO: 359888 - protein, 9 aa, Homo Sapiens
YIYTHIYIH

SEQ ID NO: 359889 - protein, 9 aa, Homo Sapiens
SSLDSFGVV

SEQ ID NO: 359890 - protein, 9 aa, Homo Sapiens
VCGESVGVA

SEQ ID NO: 359891 - protein, 9 aa, Homo Sapiens
WIPAPKPKI

SEQ ID NO: 359892 - protein, 9 aa, Homo Sapiens
LTSKLMNNI

SEQ ID NO: 359893 - protein, 9 aa, Homo Sapiens
QGTPSSTNS

SEQ ID NO: 359894 - protein, 9 aa, Homo Sapiens
SQAPPRPRP

SEQ ID NO: 359895 - protein, 9 aa, Homo Sapiens
MHLGAQTPV

SEQ ID NO: 359896 - protein, 9 aa, Homo Sapiens
EERECLQRE

SEQ ID NO: 359897 - protein, 9 aa, Homo Sapiens
MHPYAQKCS

SEQ ID NO: 359898 - protein, 9 aa, Homo Sapiens
IHCNMALLF

SEQ ID NO: 359899 - protein, 9 aa, Homo Sapiens
TTLQWENSF

SEQ ID NO: 359900 - protein, 9 aa, Homo Sapiens
ECVKSFSQS

SEQ ID NO: 359901 - protein, 9 aa, Homo Sapiens
FFLLVSPHR

SEQ ID NO: 359902 - protein, 9 aa, Homo Sapiens
HTRKNRINP

SEQ ID NO: 359903 - protein, 9 aa, Homo Sapiens
STPLVTIAL

SEQ ID NO: 359904 - protein, 9 aa, Homo Sapiens
FGVVRLPAP

SEQ ID NO: 359905 - protein, 9 aa, Homo Sapiens
ALQVLSEAE

SEQ ID NO: 359906 - protein, 9 aa, Homo Sapiens
CPQPKTLDK

SEQ ID NO: 359907 - protein, 9 aa, Homo Sapiens
QALWAGGTE

SEQ ID NO: 359908 - protein, 9 aa, Homo Sapiens
KAFNSVDKL

SEQ ID NO: 359909 - protein, 9 aa, Homo Sapiens
YNDLFFPLS

SEQ ID NO: 359910 - protein, 9 aa, Homo Sapiens
CVPRSASTG

SEQ ID NO: 359911 - protein, 9 aa, Homo Sapiens
EAIIIRHTS

SEQ ID NO: 359912 - protein, 9 aa, Homo Sapiens
QLQVQPEAD

SEQ ID NO: 359913 - protein, 9 aa, Homo Sapiens
KSQEQPGNF

SEQ ID NO: 359914 - protein, 9 aa, Homo Sapiens
GKLPIAMRV

SEQ ID NO: 359915 - protein, 9 aa, Homo Sapiens
ITLFHTMDT

SEQ ID NO: 359916 - protein, 9 aa, Homo Sapiens
GMHLGAQTP

SEQ ID NO: 359917 - protein, 9 aa, Homo Sapiens
IYENWLVSR

SEQ ID NO: 359918 - protein, 9 aa, Homo Sapiens
TQRWAAGLG

SEQ ID NO: 359919 - protein, 9 aa, Homo Sapiens
KLARGYTNG

SEQ ID NO: 359920 - protein, 9 aa, Homo Sapiens
SFLQETRPR

SEQ ID NO: 359921 - protein, 9 aa, Homo Sapiens
TLDKFTIIQ

SEQ ID NO: 359922 - protein, 9 aa, Homo Sapiens
PLGGRRGHK

SEQ ID NO: 359923 - protein, 9 aa, Homo Sapiens
RWRPDLPAP

SEQ ID NO: 359924 - protein, 9 aa, Homo Sapiens
IATVLIWIY

SEQ ID NO: 359925 - protein, 9 aa, Homo Sapiens
RSKMGKSCC

SEQ ID NO: 359926 - protein, 9 aa, Homo Sapiens
LTVTSTQPV

SEQ ID NO: 359927 - protein, 9 aa, Homo Sapiens
KQLNELTRT

SEQ ID NO: 359928 - protein, 9 aa, Homo Sapiens
LDSFGVVRL

SEQ ID NO: 359929 - protein, 9 aa, Homo Sapiens
NVLLQSKEG

SEQ ID NO: 359930 - protein, 9 aa, Homo Sapiens
PAAAPTNLP

SEQ ID NO: 359931 - protein, 9 aa, Homo Sapiens
VILWGHRFE

SEQ ID NO: 359932 - protein, 9 aa, Homo Sapiens
IAMRVLTNY

SEQ ID NO: 359933 - protein, 9 aa, Homo Sapiens
LLPSTTSSL

SEQ ID NO: 359934 - protein, 9 aa, Homo Sapiens
AGMHLGAQT

SEQ ID NO: 359935 - protein, 9 aa, Homo Sapiens
PGAGRTETQ

SEQ ID NO: 359936 - protein, 9 aa, Homo Sapiens
PQQPTPPPP

SEQ ID NO: 359937 - protein, 9 aa, Homo Sapiens
RLPRSVTTL

SEQ ID NO: 359938 - protein, 9 aa, Homo Sapiens
RIHIQKGPQ

SEQ ID NO: 359939 - protein, 9 aa, Homo Sapiens
PFRVNHAVE

SEQ ID NO: 359940 - protein, 9 aa, Homo Sapiens
MDLGCYSMQ

SEQ ID NO: 359941 - protein, 9 aa, Homo Sapiens
LFFPLSFLV

SEQ ID NO: 359942 - protein, 9 aa, Homo Sapiens
SGKHILWRH

SEQ ID NO: 359943 - protein, 9 aa, Homo Sapiens
PEELVNDHT

SEQ ID NO: 359944 - protein, 9 aa, Homo Sapiens
GIHCNMALL

SEQ ID NO: 359945 - protein, 9 aa, Homo Sapiens
PTKEYEEAM

SEQ ID NO: 359946 - protein, 9 aa, Homo Sapiens
VGVAAVAAI

SEQ ID NO: 359947 - protein, 9 aa, Homo Sapiens
RLSVPCQAE

SEQ ID NO: 359948 - protein, 9 aa, Homo Sapiens
ATLEKQLNE

SEQ ID NO: 359949 - protein, 9 aa, Homo Sapiens
PRLVPVANY

SEQ ID NO: 359950 - protein, 9 aa, Homo Sapiens
QRIDEFKSM

SEQ ID NO: 359951 - protein, 9 aa, Homo Sapiens
VLMDLGCYS

SEQ ID NO: 359952 - protein, 9 aa, Homo Sapiens
RLKVQLKLL

SEQ ID NO: 359953 - protein, 9 aa, Homo Sapiens
NVNRPPRLV

SEQ ID NO: 359954 - protein, 9 aa, Homo Sapiens
LKTIINRLV

SEQ ID NO: 359955 - protein, 9 aa, Homo Sapiens
NDHTRKNRI

SEQ ID NO: 359956 - protein, 9 aa, Homo Sapiens
HGLNVIGQI

SEQ ID NO: 359957 - protein, 9 aa, Homo Sapiens
SCWHWREAD

SEQ ID NO: 359958 - protein, 9 aa, Homo Sapiens
SGLGRTQRW

SEQ ID NO: 359959 - protein, 9 aa, Homo Sapiens
FKSLPEPVA

SEQ ID NO: 359960 - protein, 9 aa, Homo Sapiens
AAAAPPPPC

SEQ ID NO: 359961 - protein, 9 aa, Homo Sapiens
CSCQLIPGD

SEQ ID NO: 359962 - protein, 9 aa, Homo Sapiens
RECLQRERE

SEQ ID NO: 359963 - protein, 9 aa, Homo Sapiens
SDNSQHLSC

SEQ ID NO: 359964 - protein, 9 aa, Homo Sapiens
KCRDGRKLV

SEQ ID NO: 359965 - protein, 9 aa, Homo Sapiens
TKEYEEAMS

SEQ ID NO: 359966 - protein, 9 aa, Homo Sapiens
HMVADVSWH

SEQ ID NO: 359967 - protein, 9 aa, Homo Sapiens
DHGAMIEHI

SEQ ID NO: 359968 - protein, 9 aa, Homo Sapiens
SSAATSQAP

SEQ ID NO: 359969 - protein, 9 aa, Homo Sapiens
LPLHLCVIT

SEQ ID NO: 359970 - protein, 9 aa, Homo Sapiens
MLYVCAACE

SEQ ID NO: 359971 - protein, 9 aa, Homo Sapiens
TTYGFMPFI

SEQ ID NO: 359972 - protein, 9 aa, Homo Sapiens
ENWLVSRIH

SEQ ID NO: 359973 - protein, 9 aa, Homo Sapiens
TYGFMPFIS

SEQ ID NO: 359974 - protein, 9 aa, Homo Sapiens
LEKQLNELT

SEQ ID NO: 359975 - protein, 9 aa, Homo Sapiens
STQPVGTRD

SEQ ID NO: 359976 - protein, 9 aa, Homo Sapiens
ALRLKVQLK

SEQ ID NO: 359977 - protein, 9 aa, Homo Sapiens
DKLKVHSYS

SEQ ID NO: 359978 - protein, 9 aa, Homo Sapiens
LPIELCDSY

SEQ ID NO: 359979 - protein, 9 aa, Homo Sapiens
QNLLHGLNV

SEQ ID NO: 359980 - protein, 9 aa, Homo Sapiens
GLGRTQRWA

SEQ ID NO: 359981 - protein, 9 aa, Homo Sapiens
PNHEPAGMG

SEQ ID NO: 359982 - protein, 9 aa, Homo Sapiens
WKNVTMQVA

SEQ ID NO: 359983 - protein, 9 aa, Homo Sapiens
NTLSKFQIT

SEQ ID NO: 359984 - protein, 9 aa, Homo Sapiens
EPQQPTPPP

SEQ ID NO: 359985 - protein, 9 aa, Homo Sapiens
LDVPDIIIM

SEQ ID NO: 359986 - protein, 9 aa, Homo Sapiens
AWEAQQTPE

SEQ ID NO: 359987 - protein, 9 aa, Homo Sapiens
LPTGHGDTD

SEQ ID NO: 359988 - protein, 9 aa, Homo Sapiens
GTPSSTNST

SEQ ID NO: 359989 - protein, 9 aa, Homo Sapiens
TKQRIDEFK

SEQ ID NO: 359990 - protein, 9 aa, Homo Sapiens
SPCSPAGLG

SEQ ID NO: 359991 - protein, 9 aa, Homo Sapiens
TMDTLYRHS

SEQ ID NO: 359992 - protein, 9 aa, Homo Sapiens
LRLKVQLKL

SEQ ID NO: 359993 - protein, 9 aa, Homo Sapiens
QRPEPQQPT

SEQ ID NO: 359994 - protein, 9 aa, Homo Sapiens
DLVALSLPT

SEQ ID NO: 359995 - protein, 9 aa, Homo Sapiens
DKAFNSVDK

SEQ ID NO: 359996 - protein, 9 aa, Homo Sapiens
TRKNRINPL

SEQ ID NO: 359997 - protein, 9 aa, Homo Sapiens
SRFSMVVDT

SEQ ID NO: 359998 - protein, 9 aa, Homo Sapiens
GEKLYEYKQ

SEQ ID NO: 359999 - protein, 9 aa, Homo Sapiens
KKTQRSVDG

SEQ ID NO: 360000 - protein, 9 aa, Homo Sapiens
KSCCHCFPC

SEQ ID NO: 360001 - protein, 9 aa, Homo Sapiens
TSHMVADVS

SEQ ID NO: 360002 - protein, 9 aa, Homo Sapiens
FNSVDKLKV

SEQ ID NO: 360003 - protein, 9 aa, Homo Sapiens
ERECLQRER

SEQ ID NO: 360004 - protein, 9 aa, Homo Sapiens
QNLYKDVML

SEQ ID NO: 360005 - protein, 9 aa, Homo Sapiens
QRSQILPTK

SEQ ID NO: 360006 - protein, 9 aa, Homo Sapiens
EVYLKCPAH

SEQ ID NO: 360007 - protein, 9 aa, Homo Sapiens
DHTRKNRIN

SEQ ID NO: 360008 - protein, 9 aa, Homo Sapiens
REERECLQR

SEQ ID NO: 360009 - protein, 9 aa, Homo Sapiens
SIMKSCWHW

SEQ ID NO: 360010 - protein, 9 aa, Homo Sapiens
LWRHLAEEM

SEQ ID NO: 360011 - protein, 9 aa, Homo Sapiens
LFGITSHMV

SEQ ID NO: 360012 - protein, 9 aa, Homo Sapiens
EPPLVLLSK

SEQ ID NO: 360013 - protein, 9 aa, Homo Sapiens
NIADICKSL

SEQ ID NO: 360014 - protein, 9 aa, Homo Sapiens
IQALWAGGT

SEQ ID NO: 360015 - protein, 9 aa, Homo Sapiens
RFSMVVDTP

SEQ ID NO: 360016 - protein, 9 aa, Homo Sapiens
KLPIELCDS

SEQ ID NO: 360017 - protein, 9 aa, Homo Sapiens
AGRTETQTT

SEQ ID NO: 360018 - protein, 9 aa, Homo Sapiens
TGHGDTDGP

SEQ ID NO: 360019 - protein, 9 aa, Homo Sapiens
LGCYSMQLD

SEQ ID NO: 360020 - protein, 9 aa, Homo Sapiens
PYAQKCSRY

SEQ ID NO: 360021 - protein, 9 aa, Homo Sapiens
YGSAVPAAA

SEQ ID NO: 360022 - protein, 9 aa, Homo Sapiens
DIIIMPPTP

SEQ ID NO: 360023 - protein, 9 aa, Homo Sapiens
LVSVISISA

SEQ ID NO: 360024 - protein, 9 aa, Homo Sapiens
MVADVSWHS

SEQ ID NO: 360025 - protein, 9 aa, Homo Sapiens
PQPKTLDKF

SEQ ID NO: 360026 - protein, 9 aa, Homo Sapiens
VKLARGYTN

SEQ ID NO: 360027 - protein, 9 aa, Homo Sapiens
PSSTNSTSS

SEQ ID NO: 360028 - protein, 9 aa, Homo Sapiens
PIQMPKKTQ

SEQ ID NO: 360029 - protein, 9 aa, Homo Sapiens
NLEAVRILV

SEQ ID NO: 360030 - protein, 9 aa, Homo Sapiens
YAQKCSRYI

SEQ ID NO: 360031 - protein, 9 aa, Homo Sapiens
HTMDTLYRH

SEQ ID NO: 360032 - protein, 9 aa, Homo Sapiens
RLVPVANYP

SEQ ID NO: 360033 - protein, 9 aa, Homo Sapiens
LHLCVITSF

SEQ ID NO: 360034 - protein, 9 aa, Homo Sapiens
ELVNDHTRK

SEQ ID NO: 360035 - protein, 9 aa, Homo Sapiens
STTSSLVSV

SEQ ID NO: 360036 - protein, 9 aa, Homo Sapiens
IHTHTFYVS

SEQ ID NO: 360037 - protein, 9 aa, Homo Sapiens
SVDKLKVHS

SEQ ID NO: 360038 - protein, 9 aa, Homo Sapiens
HRCGAVETR

SEQ ID NO: 360039 - protein, 9 aa, Homo Sapiens
KCYLHETLK

SEQ ID NO: 360040 - protein, 9 aa, Homo Sapiens
LQSKEGKKY

SEQ ID NO: 360041 - protein, 9 aa, Homo Sapiens
ALFSFCSSC

SEQ ID NO: 360042 - protein, 9 aa, Homo Sapiens
VRLPAPFRV

SEQ ID NO: 360043 - protein, 9 aa, Homo Sapiens
DQMMSLKSD

SEQ ID NO: 360044 - protein, 9 aa, Homo Sapiens
NELTRTNEL

SEQ ID NO: 360045 - protein, 9 aa, Homo Sapiens
PREAIIIRH

SEQ ID NO: 360046 - protein, 9 aa, Homo Sapiens
QLNELTRTN

SEQ ID NO: 360047 - protein, 9 aa, Homo Sapiens
VNDHTRKNR

SEQ ID NO: 360048 - protein, 9 aa, Homo Sapiens
QAETCAHLQ

SEQ ID NO: 360049 - protein, 9 aa, Homo Sapiens
SKFQITTLC

SEQ ID NO: 360050 - protein, 9 aa, Homo Sapiens
SRIHIQKGP

SEQ ID NO: 360051 - protein, 9 aa, Homo Sapiens
KLMNNIADI

SEQ ID NO: 360052 - protein, 9 aa, Homo Sapiens
QILPTKEYE

SEQ ID NO: 360053 - protein, 9 aa, Homo Sapiens
TKRITFLFD

SEQ ID NO: 360054 - protein, 9 aa, Homo Sapiens
PIELCDSYR

SEQ ID NO: 360055 - protein, 9 aa, Homo Sapiens
RSVTTLQWE

SEQ ID NO: 360056 - protein, 9 aa, Homo Sapiens
MYGSAVPAA

SEQ ID NO: 360057 - protein, 9 aa, Homo Sapiens
CYSMQLDTP

SEQ ID NO: 360058 - protein, 9 aa, Homo Sapiens
VRILVKDES

SEQ ID NO: 360059 - protein, 9 aa, Homo Sapiens
SCQLIPGDE

SEQ ID NO: 360060 - protein, 9 aa, Homo Sapiens
GSETTTTAS

SEQ ID NO: 360061 - protein, 9 aa, Homo Sapiens
DGTASVEGP

SEQ ID NO: 360062 - protein, 9 aa, Homo Sapiens
LDKFTIIQN

SEQ ID NO: 360063 - protein, 9 aa, Homo Sapiens
VVCGESVGV

SEQ ID NO: 360064 - protein, 9 aa, Homo Sapiens
SVSTGHAIP

SEQ ID NO: 360065 - protein, 9 aa, Homo Sapiens
LPTKEYEEA

SEQ ID NO: 360066 - protein, 9 aa, Homo Sapiens
PSQIHSKDT

SEQ ID NO: 360067 - protein, 9 aa, Homo Sapiens
TSQAPPRPR

SEQ ID NO: 360068 - protein, 9 aa, Homo Sapiens
IWDVRITKC

SEQ ID NO: 360069 - protein, 9 aa, Homo Sapiens
EDDGTASVE

SEQ ID NO: 360070 - protein, 9 aa, Homo Sapiens
KMGKSCCHC

SEQ ID NO: 360071 - protein, 9 aa, Homo Sapiens
RRPSSAATS

SEQ ID NO: 360072 - protein, 9 aa, Homo Sapiens
HIDYSGMRP

SEQ ID NO: 360073 - protein, 9 aa, Homo Sapiens
EKQLNELTR

SEQ ID NO: 360074 - protein, 9 aa, Homo Sapiens
SYLANVILW

SEQ ID NO: 360075 - protein, 9 aa, Homo Sapiens
LLSKPLAAK

SEQ ID NO: 360076 - protein, 9 aa, Homo Sapiens
LLHGLNVIG

SEQ ID NO: 360077 - protein, 9 aa, Homo Sapiens
TAQQNLYKD

SEQ ID NO: 360078 - protein, 9 aa, Homo Sapiens
QMMSLKSDN

SEQ ID NO: 360079 - protein, 9 aa, Homo Sapiens
FSMVVDTPE

SEQ ID NO: 360080 - protein, 9 aa, Homo Sapiens
LPIAMRVLT

SEQ ID NO: 360081 - protein, 9 aa, Homo Sapiens
WEAQQTPEF

SEQ ID NO: 360082 - protein, 9 aa, Homo Sapiens
CRDGRKLVP

SEQ ID NO: 360083 - protein, 9 aa, Homo Sapiens
PPLVLLSKP

SEQ ID NO: 360084 - protein, 9 aa, Homo Sapiens
YKCTECVKS

SEQ ID NO: 360085 - protein, 9 aa, Homo Sapiens
NLTVIWCPQ

SEQ ID NO: 360086 - protein, 9 aa, Homo Sapiens
NLLHGLNVI

SEQ ID NO: 360087 - protein, 9 aa, Homo Sapiens
LEAVRILVK

SEQ ID NO: 360088 - protein, 9 aa, Homo Sapiens
ETTTTASTE

SEQ ID NO: 360089 - protein, 9 aa, Homo Sapiens
IHSKDTLTL

SEQ ID NO: 360090 - protein, 9 aa, Homo Sapiens
EAMALFSFC

SEQ ID NO: 360091 - protein, 9 aa, Homo Sapiens
KFTIIQNLQ

SEQ ID NO: 360092 - protein, 9 aa, Homo Sapiens
RTETQTTSQ

SEQ ID NO: 360093 - protein, 9 aa, Homo Sapiens
NVILWGHRF

SEQ ID NO: 360094 - protein, 9 aa, Homo Sapiens
CVKSFSQSS

SEQ ID NO: 360095 - protein, 9 aa, Homo Sapiens
PCQAETCAH

SEQ ID NO: 360096 - protein, 9 aa, Homo Sapiens
TSKLMNNIA

SEQ ID NO: 360097 - protein, 9 aa, Homo Sapiens
SVTTLQWEN

SEQ ID NO: 360098 - protein, 9 aa, Homo Sapiens
KHILWRHLA

SEQ ID NO: 360099 - protein, 9 aa, Homo Sapiens
LPSTTSSLV

SEQ ID NO: 360100 - protein, 9 aa, Homo Sapiens
MALFSFCSS

SEQ ID NO: 360101 - protein, 9 aa, Homo Sapiens
PSEGSPCSP

SEQ ID NO: 360102 - protein, 9 aa, Homo Sapiens
PKPKIATVL

SEQ ID NO: 360103 - protein, 9 aa, Homo Sapiens
KIATVLIWI

SEQ ID NO: 360104 - protein, 9 aa, Homo Sapiens
MSLKSDNSQ

SEQ ID NO: 360105 - protein, 9 aa, Homo Sapiens
LCDSYRKGF

SEQ ID NO: 360106 - protein, 9 aa, Homo Sapiens
QEQPGNFYV

SEQ ID NO: 360107 - protein, 9 aa, Homo Sapiens
ARKPRGRWR

SEQ ID NO: 360108 - protein, 9 aa, Homo Sapiens
YIHTHTFYV

SEQ ID NO: 360109 - protein, 9 aa, Homo Sapiens
RIWDVRITK

SEQ ID NO: 360110 - protein, 9 aa, Homo Sapiens
LSKPLAAKH

SEQ ID NO: 360111 - protein, 9 aa, Homo Sapiens
LQVLSEAEE

SEQ ID NO: 360112 - protein, 9 aa, Homo Sapiens
AAAPPPPCV

SEQ ID NO: 360113 - protein, 9 aa, Homo Sapiens
GTESLQMTF

SEQ ID NO: 360114 - protein, 9 aa, Homo Sapiens
KFQITTLCC

SEQ ID NO: 360115 - protein, 9 aa, Homo Sapiens
TTLMANDLG

SEQ ID NO: 360116 - protein, 9 aa, Homo Sapiens
LHGLNVIGQ

SEQ ID NO: 360117 - protein, 9 aa, Homo Sapiens
STNSTSSTP

SEQ ID NO: 360118 - protein, 9 aa, Homo Sapiens
LMNNIADIC

SEQ ID NO: 360119 - protein, 9 aa, Homo Sapiens
LKCPAHSDD

SEQ ID NO: 360120 - protein, 9 aa, Homo Sapiens
GKKYHSQKQ

SEQ ID NO: 360121 - protein, 9 aa, Homo Sapiens
VGGHMLYVC

SEQ ID NO: 360122 - protein, 9 aa, Homo Sapiens
KPKIATVLI

SEQ ID NO: 360123 - protein, 9 aa, Homo Sapiens
AQQNLYKDV

SEQ ID NO: 360124 - protein, 9 aa, Homo Sapiens
RSQILPTKE

SEQ ID NO: 360125 - protein, 9 aa, Homo Sapiens
VNRPPRLVP

SEQ ID NO: 360126 - protein, 9 aa, Homo Sapiens
PEVYLKCPA

SEQ ID NO: 360127 - protein, 9 aa, Homo Sapiens
LLLLYNDLF

SEQ ID NO: 360128 - protein, 9 aa, Homo Sapiens
PPRLVPVAN

SEQ ID NO: 360129 - protein, 9 aa, Homo Sapiens
CSPAGLGAL

SEQ ID NO: 360130 - protein, 9 aa, Homo Sapiens
SHMVADVSW

SEQ ID NO: 360131 - protein, 9 aa, Homo Sapiens
KSFLQETRP

SEQ ID NO: 360132 - protein, 9 aa, Homo Sapiens
FSGMQKGVE

SEQ ID NO: 360133 - protein, 9 aa, Homo Sapiens
VRITKCIAT

SEQ ID NO: 360134 - protein, 9 aa, Homo Sapiens
LYNDLFFPL

SEQ ID NO: 360135 - protein, 9 aa, Homo Sapiens
CVITSFDVC

SEQ ID NO: 360136 - protein, 9 aa, Homo Sapiens
KQRIDEFKS

SEQ ID NO: 360137 - protein, 9 aa, Homo Sapiens
DLQNLLHGL

SEQ ID NO: 360138 - protein, 9 aa, Homo Sapiens
RISRFSMVV

SEQ ID NO: 360139 - protein, 9 aa, Homo Sapiens
VAAVAAITQ

SEQ ID NO: 360140 - protein, 9 aa, Homo Sapiens
TFLFDSTLT

SEQ ID NO: 360141 - protein, 9 aa, Homo Sapiens
DSFGVVRLP

SEQ ID NO: 360142 - protein, 9 aa, Homo Sapiens
KRITFLFDS

SEQ ID NO: 360143 - protein, 9 aa, Homo Sapiens
CLQRERERL

SEQ ID NO: 360144 - protein, 9 aa, Homo Sapiens
QVQPEADSL

SEQ ID NO: 360145 - protein, 9 aa, Homo Sapiens
KLYEYKQCS

SEQ ID NO: 360146 - protein, 9 aa, Homo Sapiens
GNVNRPPRL

SEQ ID NO: 360147 - protein, 9 aa, Homo Sapiens
MPNHEPAGM

SEQ ID NO: 360148 - protein, 9 aa, Homo Sapiens
ALWAGGTES

SEQ ID NO: 360149 - protein, 9 aa, Homo Sapiens
SWTEAKCRD

SEQ ID NO: 360150 - protein, 9 aa, Homo Sapiens
LGGRRGHKD

SEQ ID NO: 360151 - protein, 9 aa, Homo Sapiens
LLSAMMQLW

SEQ ID NO: 360152 - protein, 9 aa, Homo Sapiens
VLLSKPLAA

SEQ ID NO: 360153 - protein, 9 aa, Homo Sapiens
RCVACSCQL

SEQ ID NO: 360154 - protein, 9 aa, Homo Sapiens
DLQLQVQPE

SEQ ID NO: 360155 - protein, 9 aa, Homo Sapiens
VLQTAGMHL

SEQ ID NO: 360156 - protein, 9 aa, Homo Sapiens
LVSPHRCGA

SEQ ID NO: 360157 - protein, 9 aa, Homo Sapiens
GSPCSPAGL

SEQ ID NO: 360158 - protein, 9 aa, Homo Sapiens
AIIIRHTSV

SEQ ID NO: 360159 - protein, 9 aa, Homo Sapiens
TMQVAGETY

SEQ ID NO: 360160 - protein, 9 aa, Homo Sapiens
CVACSCQLI

SEQ ID NO: 360161 - protein, 9 aa, Homo Sapiens
SEGSPCSPA

SEQ ID NO: 360162 - protein, 9 aa, Homo Sapiens
DKFTIIQNL

SEQ ID NO: 360163 - protein, 9 aa, Homo Sapiens
IPPVLYSTF

SEQ ID NO: 360164 - protein, 9 aa, Homo Sapiens
REAIIIRHT

SEQ ID NO: 360165 - protein, 9 aa, Homo Sapiens
GSAVPAAAP

SEQ ID NO: 360166 - protein, 9 aa, Homo Sapiens
LYEYKQCSK

SEQ ID NO: 360167 - protein, 9 aa, Homo Sapiens
LNTLSKFQI

SEQ ID NO: 360168 - protein, 9 aa, Homo Sapiens
RVLQTAGMH

SEQ ID NO: 360169 - protein, 9 aa, Homo Sapiens
QWKNVTMQV

SEQ ID NO: 360170 - protein, 9 aa, Homo Sapiens
ASVEGPDEA

SEQ ID NO: 360171 - protein, 9 aa, Homo Sapiens
QPVGTRDWI

SEQ ID NO: 360172 - protein, 9 aa, Homo Sapiens
LLVSPHRCG

SEQ ID NO: 360173 - protein, 9 aa, Homo Sapiens
IELCDSYRK

SEQ ID NO: 360174 - protein, 9 aa, Homo Sapiens
SLPEPVALT

SEQ ID NO: 360175 - protein, 9 aa, Homo Sapiens
FAEKSQEQP

SEQ ID NO: 360176 - protein, 9 aa, Homo Sapiens
QPEADSLAD

SEQ ID NO: 360177 - protein, 9 aa, Homo Sapiens
SSLVSVISI

SEQ ID NO: 360178 - protein, 9 aa, Homo Sapiens
ANVILWGHR

SEQ ID NO: 360179 - protein, 9 aa, Homo Sapiens
GGRRGHKDR

SEQ ID NO: 360180 - protein, 9 aa, Homo Sapiens
IWCPQDTGG

SEQ ID NO: 360181 - protein, 9 aa, Homo Sapiens
TLFHTMDTL

SEQ ID NO: 360182 - protein, 9 aa, Homo Sapiens
RNPTVEVDL

SEQ ID NO: 360183 - protein, 9 aa, Homo Sapiens
LHETLKTII

SEQ ID NO: 360184 - protein, 9 aa, Homo Sapiens
RAWPGAGRT

SEQ ID NO: 360185 - protein, 9 aa, Homo Sapiens
TFTWLGYVN

SEQ ID NO: 360186 - protein, 9 aa, Homo Sapiens
SKMGKSCCH

SEQ ID NO: 360187 - protein, 9 aa, Homo Sapiens
TLEKQLNEL

SEQ ID NO: 360188 - protein, 9 aa, Homo Sapiens
SVEGPDEAG

SEQ ID NO: 360189 - protein, 9 aa, Homo Sapiens
THIYIHTHT

SEQ ID NO: 360190 - protein, 9 aa, Homo Sapiens
PPPPCVPRS

SEQ ID NO: 360191 - protein, 9 aa, Homo Sapiens
NDLQLQVQP

SEQ ID NO: 360192 - protein, 9 aa, Homo Sapiens
GHKDRERER

SEQ ID NO: 360193 - protein, 9 aa, Homo Sapiens
TLQWENSFV

SEQ ID NO: 360194 - protein, 9 aa, Homo Sapiens
DVPDIIIMP

SEQ ID NO: 360195 - protein, 9 aa, Homo Sapiens
PKKTQRSVD

SEQ ID NO: 360196 - protein, 9 aa, Homo Sapiens
VTIALDSLG

SEQ ID NO: 360197 - protein, 9 aa, Homo Sapiens
NIPPVLYST

SEQ ID NO: 360198 - protein, 9 aa, Homo Sapiens
SSYLANVIL

SEQ ID NO: 360199 - protein, 9 aa, Homo Sapiens
RPPRLVPVA

SEQ ID NO: 360200 - protein, 9 aa, Homo Sapiens
GTLTVTSTQ

SEQ ID NO: 360201 - protein, 9 aa, Homo Sapiens
IIMPPTPTG

SEQ ID NO: 360202 - protein, 9 aa, Homo Sapiens
LLTSKLMNN

SEQ ID NO: 360203 - protein, 9 aa, Homo Sapiens
PLLLLYNDL

SEQ ID NO: 360204 - protein, 9 aa, Homo Sapiens
PPAAWEAQQ

SEQ ID NO: 360205 - protein, 9 aa, Homo Sapiens
KTIINRLVE

SEQ ID NO: 360206 - protein, 9 aa, Homo Sapiens
KVVGGHMLY

SEQ ID NO: 360207 - protein, 9 aa, Homo Sapiens
KNVTMQVAG

SEQ ID NO: 360208 - protein, 9 aa, Homo Sapiens
LPRSVTTLQ

SEQ ID NO: 360209 - protein, 9 aa, Homo Sapiens
REREERECL

SEQ ID NO: 360210 - protein, 9 aa, Homo Sapiens
AGSETTTTA

SEQ ID NO: 360211 - protein, 9 aa, Homo Sapiens
GESVGVAAV

SEQ ID NO: 360212 - protein, 9 aa, Homo Sapiens
NMALLFSFA

SEQ ID NO: 360213 - protein, 9 aa, Homo Sapiens
SQWKNVTMQ

SEQ ID NO: 360214 - protein, 9 aa, Homo Sapiens
GTASVEGPD

SEQ ID NO: 360215 - protein, 9 aa, Homo Sapiens
LGSIDHVYT

SEQ ID NO: 360216 - protein, 9 aa, Homo Sapiens
MDYEEGLMK

SEQ ID NO: 360217 - protein, 9 aa, Homo Sapiens
ILWRHLAEE

SEQ ID NO: 360218 - protein, 9 aa, Homo Sapiens
ARSSYLANV

SEQ ID NO: 360219 - protein, 9 aa, Homo Sapiens
GHMLYVCAA

SEQ ID NO: 360220 - protein, 9 aa, Homo Sapiens
SLKSDNSQH

SEQ ID NO: 360221 - protein, 9 aa, Homo Sapiens
SRRNPTVEV

SEQ ID NO: 360222 - protein, 9 aa, Homo Sapiens
RELILERNP

SEQ ID NO: 360223 - protein, 9 aa, Homo Sapiens
RGLYDQYGK

SEQ ID NO: 360224 - protein, 9 aa, Homo Sapiens
APVAGGRPD

SEQ ID NO: 360225 - protein, 9 aa, Homo Sapiens
REFMLEKSS

SEQ ID NO: 360226 - protein, 9 aa, Homo Sapiens
QNEDYLQNR

SEQ ID NO: 360227 - protein, 9 aa, Homo Sapiens
HSLLNIREF

SEQ ID NO: 360228 - protein, 9 aa, Homo Sapiens
LHILERNLM

SEQ ID NO: 360229 - protein, 9 aa, Homo Sapiens
PERFDQSVT

SEQ ID NO: 360230 - protein, 9 aa, Homo Sapiens
AKGAQQGDP

SEQ ID NO: 360231 - protein, 9 aa, Homo Sapiens
SVAVAASVI

SEQ ID NO: 360232 - protein, 9 aa, Homo Sapiens
IKKEASYFI

SEQ ID NO: 360233 - protein, 9 aa, Homo Sapiens
EHPGEITSD

SEQ ID NO: 360234 - protein, 9 aa, Homo Sapiens
RERNINKEH

SEQ ID NO: 360235 - protein, 9 aa, Homo Sapiens
NPERFDQSV

SEQ ID NO: 360236 - protein, 9 aa, Homo Sapiens
GLKTGLQPF

SEQ ID NO: 360237 - protein, 9 aa, Homo Sapiens
KKFRALCQP

SEQ ID NO: 360238 - protein, 9 aa, Homo Sapiens
AAVMTFCRL

SEQ ID NO: 360239 - protein, 9 aa, Homo Sapiens
LRLANSTIN

SEQ ID NO: 360240 - protein, 9 aa, Homo Sapiens
QALHALPSE

SEQ ID NO: 360241 - protein, 9 aa, Homo Sapiens
VAVAASVIL

SEQ ID NO: 360242 - protein, 9 aa, Homo Sapiens
THSLLNIRE

SEQ ID NO: 360243 - protein, 9 aa, Homo Sapiens
IKKRVENKY

SEQ ID NO: 360244 - protein, 9 aa, Homo Sapiens
KGELEELKA

SEQ ID NO: 360245 - protein, 9 aa, Homo Sapiens
EFSVNLQRK

SEQ ID NO: 360246 - protein, 9 aa, Homo Sapiens
HSTVPTFSC

SEQ ID NO: 360247 - protein, 9 aa, Homo Sapiens
VVKFSLGMH

SEQ ID NO: 360248 - protein, 9 aa, Homo Sapiens
HPQQLCEKC

SEQ ID NO: 360249 - protein, 9 aa, Homo Sapiens
FQINTSVCL

SEQ ID NO: 360250 - protein, 9 aa, Homo Sapiens
LLQSQQQKQ

SEQ ID NO: 360251 - protein, 9 aa, Homo Sapiens
PQQLCEKCK

SEQ ID NO: 360252 - protein, 9 aa, Homo Sapiens
QLCEKCKVL

SEQ ID NO: 360253 - protein, 9 aa, Homo Sapiens
SKFVALLPA

SEQ ID NO: 360254 - protein, 9 aa, Homo Sapiens
SNMPHLQTL

SEQ ID NO: 360255 - protein, 9 aa, Homo Sapiens
RVQLHEWTM

SEQ ID NO: 360256 - protein, 9 aa, Homo Sapiens
NVVKHLAVA

SEQ ID NO: 360257 - protein, 9 aa, Homo Sapiens
KVDPLYELV

SEQ ID NO: 360258 - protein, 9 aa, Homo Sapiens
ICRLRTAFS

SEQ ID NO: 360259 - protein, 9 aa, Homo Sapiens
HYEIMMYHR

SEQ ID NO: 360260 - protein, 9 aa, Homo Sapiens
SGLALIPDK

SEQ ID NO: 360261 - protein, 9 aa, Homo Sapiens
APKKVKVNC

SEQ ID NO: 360262 - protein, 9 aa, Homo Sapiens
LSGFMIGHM

SEQ ID NO: 360263 - protein, 9 aa, Homo Sapiens
KLKRKQDLE

SEQ ID NO: 360264 - protein, 9 aa, Homo Sapiens
QSQQQKQRG

SEQ ID NO: 360265 - protein, 9 aa, Homo Sapiens
VTWQVEHPG

SEQ ID NO: 360266 - protein, 9 aa, Homo Sapiens
TEIQIDQRE

SEQ ID NO: 360267 - protein, 9 aa, Homo Sapiens
RVLNVIKPS

SEQ ID NO: 360268 - protein, 9 aa, Homo Sapiens
DQSKEHPQQ

SEQ ID NO: 360269 - protein, 9 aa, Homo Sapiens
AALTTLSGD

SEQ ID NO: 360270 - protein, 9 aa, Homo Sapiens
SVQGSAPLP

SEQ ID NO: 360271 - protein, 9 aa, Homo Sapiens
HLAVAQNSF

SEQ ID NO: 360272 - protein, 9 aa, Homo Sapiens
HWNCKTDSF

SEQ ID NO: 360273 - protein, 9 aa, Homo Sapiens
TFDSLAGTT

SEQ ID NO: 360274 - protein, 9 aa, Homo Sapiens
LLTTPMNMK

SEQ ID NO: 360275 - protein, 9 aa, Homo Sapiens
HCPHHERCS

SEQ ID NO: 360276 - protein, 9 aa, Homo Sapiens
NMKIHLITT

SEQ ID NO: 360277 - protein, 9 aa, Homo Sapiens
LHPFAGWGG

SEQ ID NO: 360278 - protein, 9 aa, Homo Sapiens
QLLVMVRVQ

SEQ ID NO: 360279 - protein, 9 aa, Homo Sapiens
SQQQKQRGH

SEQ ID NO: 360280 - protein, 9 aa, Homo Sapiens
WLHILFFVV

SEQ ID NO: 360281 - protein, 9 aa, Homo Sapiens
GGRPDLGLG

SEQ ID NO: 360282 - protein, 9 aa, Homo Sapiens
HGLKTGLQP

SEQ ID NO: 360283 - protein, 9 aa, Homo Sapiens
YISETDLSS

SEQ ID NO: 360284 - protein, 9 aa, Homo Sapiens
RSSMFLFGI

SEQ ID NO: 360285 - protein, 9 aa, Homo Sapiens
PSEQQDFLF

SEQ ID NO: 360286 - protein, 9 aa, Homo Sapiens
HMTEVVRHC

SEQ ID NO: 360287 - protein, 9 aa, Homo Sapiens
ASVQGSAPL

SEQ ID NO: 360288 - protein, 9 aa, Homo Sapiens
RTAFSWILG

SEQ ID NO: 360289 - protein, 9 aa, Homo Sapiens
RRKLTFDSL

SEQ ID NO: 360290 - protein, 9 aa, Homo Sapiens
DQYGKEGLK

SEQ ID NO: 360291 - protein, 9 aa, Homo Sapiens
NWTETRGIQ

SEQ ID NO: 360292 - protein, 9 aa, Homo Sapiens
QLVTWQVEH

SEQ ID NO: 360293 - protein, 9 aa, Homo Sapiens
SAGAFPSFY

SEQ ID NO: 360294 - protein, 9 aa, Homo Sapiens
GRTCNKTAP

SEQ ID NO: 360295 - protein, 9 aa, Homo Sapiens
RIEAQLATL

SEQ ID NO: 360296 - protein, 9 aa, Homo Sapiens
IQIDQREED

SEQ ID NO: 360297 - protein, 9 aa, Homo Sapiens
SPPLTSKFV

SEQ ID NO: 360298 - protein, 9 aa, Homo Sapiens
LDNVAGVSI

SEQ ID NO: 360299 - protein, 9 aa, Homo Sapiens
RPKICRLRT

SEQ ID NO: 360300 - protein, 9 aa, Homo Sapiens
FSLGMHPLF

SEQ ID NO: 360301 - protein, 9 aa, Homo Sapiens
KESEIHLLK

SEQ ID NO: 360302 - protein, 9 aa, Homo Sapiens
RPVTEEETR

SEQ ID NO: 360303 - protein, 9 aa, Homo Sapiens
HFSKLKRKQ

SEQ ID NO: 360304 - protein, 9 aa, Homo Sapiens
TIKKRVENK

SEQ ID NO: 360305 - protein, 9 aa, Homo Sapiens
LLYTTLRCS

SEQ ID NO: 360306 - protein, 9 aa, Homo Sapiens
LRFPRAGEF

SEQ ID NO: 360307 - protein, 9 aa, Homo Sapiens
TDRPWLHIL

SEQ ID NO: 360308 - protein, 9 aa, Homo Sapiens
LQTLQAIVS

SEQ ID NO: 360309 - protein, 9 aa, Homo Sapiens
AEGAAEAAP

SEQ ID NO: 360310 - protein, 9 aa, Homo Sapiens
IQKSPVFCV

SEQ ID NO: 360311 - protein, 9 aa, Homo Sapiens
QMEIQKSPV

SEQ ID NO: 360312 - protein, 9 aa, Homo Sapiens
ATVPPKPQY

SEQ ID NO: 360313 - protein, 9 aa, Homo Sapiens
AVAARKKLK

SEQ ID NO: 360314 - protein, 9 aa, Homo Sapiens
GKKQYISVG

SEQ ID NO: 360315 - protein, 9 aa, Homo Sapiens
EEYTKEGIE

SEQ ID NO: 360316 - protein, 9 aa, Homo Sapiens
AARKKLKGE

SEQ ID NO: 360317 - protein, 9 aa, Homo Sapiens
PVAGGRPDL

SEQ ID NO: 360318 - protein, 9 aa, Homo Sapiens
MNPVPQMEI

SEQ ID NO: 360319 - protein, 9 aa, Homo Sapiens
DSREHHPRK

SEQ ID NO: 360320 - protein, 9 aa, Homo Sapiens
RTLLSLPGY

SEQ ID NO: 360321 - protein, 9 aa, Homo Sapiens
ESEIHLLKE

SEQ ID NO: 360322 - protein, 9 aa, Homo Sapiens
ALHPFAGWG

SEQ ID NO: 360323 - protein, 9 aa, Homo Sapiens
GKEGLKTGG

SEQ ID NO: 360324 - protein, 9 aa, Homo Sapiens
SVGTQGRTC

SEQ ID NO: 360325 - protein, 9 aa, Homo Sapiens
IRELILERN

SEQ ID NO: 360326 - protein, 9 aa, Homo Sapiens
RFDQSVTVL

SEQ ID NO: 360327 - protein, 9 aa, Homo Sapiens
RKYRRNWTE

SEQ ID NO: 360328 - protein, 9 aa, Homo Sapiens
EKSTWQLLV

SEQ ID NO: 360329 - protein, 9 aa, Homo Sapiens
YEAIQTYTS

SEQ ID NO: 360330 - protein, 9 aa, Homo Sapiens
YDQYGKEGL

SEQ ID NO: 360331 - protein, 9 aa, Homo Sapiens
GKLSVVTHS

SEQ ID NO: 360332 - protein, 9 aa, Homo Sapiens
RPLVRQLVT

SEQ ID NO: 360333 - protein, 9 aa, Homo Sapiens
HPRKHLSLR

SEQ ID NO: 360334 - protein, 9 aa, Homo Sapiens
IRQLLQSQQ

SEQ ID NO: 360335 - protein, 9 aa, Homo Sapiens
AVEKKFRAL

SEQ ID NO: 360336 - protein, 9 aa, Homo Sapiens
RNPMYVRYA

SEQ ID NO: 360337 - protein, 9 aa, Homo Sapiens
VNCDSFLCQ

SEQ ID NO: 360338 - protein, 9 aa, Homo Sapiens
LDIRASIQP

SEQ ID NO: 360339 - protein, 9 aa, Homo Sapiens
TWTAVALHP

SEQ ID NO: 360340 - protein, 9 aa, Homo Sapiens
EELCGRSTE

SEQ ID NO: 360341 - protein, 9 aa, Homo Sapiens
IVTRRPLVR

SEQ ID NO: 360342 - protein, 9 aa, Homo Sapiens
KPAHMMLSG

SEQ ID NO: 360343 - protein, 9 aa, Homo Sapiens
AADFLLYIS

SEQ ID NO: 360344 - protein, 9 aa, Homo Sapiens
TQGRTCNKT

SEQ ID NO: 360345 - protein, 9 aa, Homo Sapiens
GCDWIVTGN

SEQ ID NO: 360346 - protein, 9 aa, Homo Sapiens
NAEVKLVEF

SEQ ID NO: 360347 - protein, 9 aa, Homo Sapiens
EKDSNMPHL

SEQ ID NO: 360348 - protein, 9 aa, Homo Sapiens
KEHPQQLCE

SEQ ID NO: 360349 - protein, 9 aa, Homo Sapiens
VEKKFRALC

SEQ ID NO: 360350 - protein, 9 aa, Homo Sapiens
PHLQTLQAI

SEQ ID NO: 360351 - protein, 9 aa, Homo Sapiens
GSTFQINTS

SEQ ID NO: 360352 - protein, 9 aa, Homo Sapiens
QELRRSLEF

SEQ ID NO: 360353 - protein, 9 aa, Homo Sapiens
DNVAGVSIT

SEQ ID NO: 360354 - protein, 9 aa, Homo Sapiens
AGGRIVWGH

SEQ ID NO: 360355 - protein, 9 aa, Homo Sapiens
EKVDEQQTF

SEQ ID NO: 360356 - protein, 9 aa, Homo Sapiens
KFEQGKKEK

SEQ ID NO: 360357 - protein, 9 aa, Homo Sapiens
LEFSVNLQR

SEQ ID NO: 360358 - protein, 9 aa, Homo Sapiens
TSTIQAKDG

SEQ ID NO: 360359 - protein, 9 aa, Homo Sapiens
STFQINTSV

SEQ ID NO: 360360 - protein, 9 aa, Homo Sapiens
QEKESEIHL

SEQ ID NO: 360361 - protein, 9 aa, Homo Sapiens
GRMKVKEWE

SEQ ID NO: 360362 - protein, 9 aa, Homo Sapiens
VQGSAPLPR

SEQ ID NO: 360363 - protein, 9 aa, Homo Sapiens
EIQKSPVFC

SEQ ID NO: 360364 - protein, 9 aa, Homo Sapiens
YISVGNVVK

SEQ ID NO: 360365 - protein, 9 aa, Homo Sapiens
EAIQTYTST

SEQ ID NO: 360366 - protein, 9 aa, Homo Sapiens
AIIKVKVDP

SEQ ID NO: 360367 - protein, 9 aa, Homo Sapiens
LTDRPWLHI

SEQ ID NO: 360368 - protein, 9 aa, Homo Sapiens
GFCRKIAKG

SEQ ID NO: 360369 - protein, 9 aa, Homo Sapiens
KVKVDPLYE

SEQ ID NO: 360370 - protein, 9 aa, Homo Sapiens
CAPKKVKVN

SEQ ID NO: 360371 - protein, 9 aa, Homo Sapiens
IGCDWIVTG

SEQ ID NO: 360372 - protein, 9 aa, Homo Sapiens
SKLKRKQDL

SEQ ID NO: 360373 - protein, 9 aa, Homo Sapiens
STIQAKDGG

SEQ ID NO: 360374 - protein, 9 aa, Homo Sapiens
PQYEFKEVA

SEQ ID NO: 360375 - protein, 9 aa, Homo Sapiens
KSAMSGAIR

SEQ ID NO: 360376 - protein, 9 aa, Homo Sapiens
SGFMIGHMA

SEQ ID NO: 360377 - protein, 9 aa, Homo Sapiens
FVLEQEEYT

SEQ ID NO: 360378 - protein, 9 aa, Homo Sapiens
EKSSMNVMN

SEQ ID NO: 360379 - protein, 9 aa, Homo Sapiens
GIFSTTILC

SEQ ID NO: 360380 - protein, 9 aa, Homo Sapiens
ANSTINSDG

SEQ ID NO: 360381 - protein, 9 aa, Homo Sapiens
EIHLLKEHL

SEQ ID NO: 360382 - protein, 9 aa, Homo Sapiens
ERNINKEHE

SEQ ID NO: 360383 - protein, 9 aa, Homo Sapiens
RFPRAGEFP

SEQ ID NO: 360384 - protein, 9 aa, Homo Sapiens
DQSVTVLGT

SEQ ID NO: 360385 - protein, 9 aa, Homo Sapiens
ITSVLLRFP

SEQ ID NO: 360386 - protein, 9 aa, Homo Sapiens
DISNSMRAI

SEQ ID NO: 360387 - protein, 9 aa, Homo Sapiens
MTEVVRHCP

SEQ ID NO: 360388 - protein, 9 aa, Homo Sapiens
LLNIRGHTL

SEQ ID NO: 360389 - protein, 9 aa, Homo Sapiens
QAGAGSTFQ

SEQ ID NO: 360390 - protein, 9 aa, Homo Sapiens
TVPPKPQYS

SEQ ID NO: 360391 - protein, 9 aa, Homo Sapiens
MKVKEWEKS

SEQ ID NO: 360392 - protein, 9 aa, Homo Sapiens
LLNIREFML

SEQ ID NO: 360393 - protein, 9 aa, Homo Sapiens
SLSGFMIGH

SEQ ID NO: 360394 - protein, 9 aa, Homo Sapiens
AAAALTTLS

SEQ ID NO: 360395 - protein, 9 aa, Homo Sapiens
AGGRPDLGL

SEQ ID NO: 360396 - protein, 9 aa, Homo Sapiens
ERNLMNALN

SEQ ID NO: 360397 - protein, 9 aa, Homo Sapiens
HNAEVKLVE

SEQ ID NO: 360398 - protein, 9 aa, Homo Sapiens
NPVPQMEIQ

SEQ ID NO: 360399 - protein, 9 aa, Homo Sapiens
QGRTCNKTA

SEQ ID NO: 360400 - protein, 9 aa, Homo Sapiens
NGRTGLMVT

SEQ ID NO: 360401 - protein, 9 aa, Homo Sapiens
KFVALLPAL

SEQ ID NO: 360402 - protein, 9 aa, Homo Sapiens
MTFSEDKMV

SEQ ID NO: 360403 - protein, 9 aa, Homo Sapiens
SYFIFSSIT

SEQ ID NO: 360404 - protein, 9 aa, Homo Sapiens
EKESEIHLL

SEQ ID NO: 360405 - protein, 9 aa, Homo Sapiens
KSSMNVMNV

SEQ ID NO: 360406 - protein, 9 aa, Homo Sapiens
NHIEKHGAN

SEQ ID NO: 360407 - protein, 9 aa, Homo Sapiens
EKGGGLAAA

SEQ ID NO: 360408 - protein, 9 aa, Homo Sapiens
TTLRCSAQP

SEQ ID NO: 360409 - protein, 9 aa, Homo Sapiens
ERTSRAVEK

SEQ ID NO: 360410 - protein, 9 aa, Homo Sapiens
LSLSGFMIG

SEQ ID NO: 360411 - protein, 9 aa, Homo Sapiens
LTLLLYTTL

SEQ ID NO: 360412 - protein, 9 aa, Homo Sapiens
TLLTTPMNM

SEQ ID NO: 360413 - protein, 9 aa, Homo Sapiens
NPSAGAQTL

SEQ ID NO: 360414 - protein, 9 aa, Homo Sapiens
HMMLSGRMK

SEQ ID NO: 360415 - protein, 9 aa, Homo Sapiens
TSKFVALLP

SEQ ID NO: 360416 - protein, 9 aa, Homo Sapiens
WATRSSMFL

SEQ ID NO: 360417 - protein, 9 aa, Homo Sapiens
EGNKMTPGV

SEQ ID NO: 360418 - protein, 9 aa, Homo Sapiens
LVMVRVQLH

SEQ ID NO: 360419 - protein, 9 aa, Homo Sapiens
SMNVMNVVK

SEQ ID NO: 360420 - protein, 9 aa, Homo Sapiens
IKVKVDPLY

SEQ ID NO: 360421 - protein, 9 aa, Homo Sapiens
IHLLKEHLC

SEQ ID NO: 360422 - protein, 9 aa, Homo Sapiens
ETEIQIDQR

SEQ ID NO: 360423 - protein, 9 aa, Homo Sapiens
NIREFMLEK

SEQ ID NO: 360424 - protein, 9 aa, Homo Sapiens
GNGEIGCDW

SEQ ID NO: 360425 - protein, 9 aa, Homo Sapiens
DLNTIKKRV

SEQ ID NO: 360426 - protein, 9 aa, Homo Sapiens
EASYFIFSS

SEQ ID NO: 360427 - protein, 9 aa, Homo Sapiens
FWSECPGEQ

SEQ ID NO: 360428 - protein, 9 aa, Homo Sapiens
REELCGRST

SEQ ID NO: 360429 - protein, 9 aa, Homo Sapiens
HLITTHSLL

SEQ ID NO: 360430 - protein, 9 aa, Homo Sapiens
LVRQLVTSK

SEQ ID NO: 360431 - protein, 9 aa, Homo Sapiens
KLKGELEEL

SEQ ID NO: 360432 - protein, 9 aa, Homo Sapiens
EDQELLQES

SEQ ID NO: 360433 - protein, 9 aa, Homo Sapiens
PLPRKKSTR

SEQ ID NO: 360434 - protein, 9 aa, Homo Sapiens
VMVRVQLHE

SEQ ID NO: 360435 - protein, 9 aa, Homo Sapiens
AQTLLNIRG

SEQ ID NO: 360436 - protein, 9 aa, Homo Sapiens
NLMNALNVG

SEQ ID NO: 360437 - protein, 9 aa, Homo Sapiens
CRNKDHYEI

SEQ ID NO: 360438 - protein, 9 aa, Homo Sapiens
VLTLLLYTT

SEQ ID NO: 360439 - protein, 9 aa, Homo Sapiens
RPDMTFSED

SEQ ID NO: 360440 - protein, 9 aa, Homo Sapiens
VWQVEGNGQ

SEQ ID NO: 360441 - protein, 9 aa, Homo Sapiens
KDHYEIMMY

SEQ ID NO: 360442 - protein, 9 aa, Homo Sapiens
SEQQDFLFN

SEQ ID NO: 360443 - protein, 9 aa, Homo Sapiens
VGKLSVVTH

SEQ ID NO: 360444 - protein, 9 aa, Homo Sapiens
FCRKIAKGA

SEQ ID NO: 360445 - protein, 9 aa, Homo Sapiens
PMNMKIHLI

SEQ ID NO: 360446 - protein, 9 aa, Homo Sapiens
LVEFWSECP

SEQ ID NO: 360447 - protein, 9 aa, Homo Sapiens
FAVSHTLLD

SEQ ID NO: 360448 - protein, 9 aa, Homo Sapiens
AAPVAGGRP

SEQ ID NO: 360449 - protein, 9 aa, Homo Sapiens
ERIEAQLAT

SEQ ID NO: 360450 - protein, 9 aa, Homo Sapiens
DGPGEPRRH

SEQ ID NO: 360451 - protein, 9 aa, Homo Sapiens
QKQRGHLRT

SEQ ID NO: 360452 - protein, 9 aa, Homo Sapiens
LTTPMNMKI

SEQ ID NO: 360453 - protein, 9 aa, Homo Sapiens
VPTFSCPWG

SEQ ID NO: 360454 - protein, 9 aa, Homo Sapiens
RKQDLEKKR

SEQ ID NO: 360455 - protein, 9 aa, Homo Sapiens
TCNKTAPQA

SEQ ID NO: 360456 - protein, 9 aa, Homo Sapiens
TPMNMKIHL

SEQ ID NO: 360457 - protein, 9 aa, Homo Sapiens
VPQMEIQKS

SEQ ID NO: 360458 - protein, 9 aa, Homo Sapiens
NEDATDRSY

SEQ ID NO: 360459 - protein, 9 aa, Homo Sapiens
SEIHLLKEH

SEQ ID NO: 360460 - protein, 9 aa, Homo Sapiens
RDSRRNRSP

SEQ ID NO: 360461 - protein, 9 aa, Homo Sapiens
VDPLYELVT

SEQ ID NO: 360462 - protein, 9 aa, Homo Sapiens
EQLNQIKNH

SEQ ID NO: 360463 - protein, 9 aa, Homo Sapiens
KEVAGSFTS

SEQ ID NO: 360464 - protein, 9 aa, Homo Sapiens
LLVVHWNCK

SEQ ID NO: 360465 - protein, 9 aa, Homo Sapiens
PKKVKVNCD

SEQ ID NO: 360466 - protein, 9 aa, Homo Sapiens
RVTLERNPM

SEQ ID NO: 360467 - protein, 9 aa, Homo Sapiens
KQDLEKKRK

SEQ ID NO: 360468 - protein, 9 aa, Homo Sapiens
VTRRPLVRQ

SEQ ID NO: 360469 - protein, 9 aa, Homo Sapiens
EQQTFLNKI

SEQ ID NO: 360470 - protein, 9 aa, Homo Sapiens
TTPMNMKIH

SEQ ID NO: 360471 - protein, 9 aa, Homo Sapiens
QEEYTKEGI

SEQ ID NO: 360472 - protein, 9 aa, Homo Sapiens
VRQLVTSKA

SEQ ID NO: 360473 - protein, 9 aa, Homo Sapiens
EIGCDWIVT

SEQ ID NO: 360474 - protein, 9 aa, Homo Sapiens
KRTDKSAMS

SEQ ID NO: 360475 - protein, 9 aa, Homo Sapiens
FDQSVTVLG

SEQ ID NO: 360476 - protein, 9 aa, Homo Sapiens
GEPRRHRQK

SEQ ID NO: 360477 - protein, 9 aa, Homo Sapiens
KTDSFSLKQ

SEQ ID NO: 360478 - protein, 9 aa, Homo Sapiens
KGAQQGDPL

SEQ ID NO: 360479 - protein, 9 aa, Homo Sapiens
PRMNVMNVG

SEQ ID NO: 360480 - protein, 9 aa, Homo Sapiens
NCDSFLCQN

SEQ ID NO: 360481 - protein, 9 aa, Homo Sapiens
KPRMNVMNV

SEQ ID NO: 360482 - protein, 9 aa, Homo Sapiens
KNHIEKHGA

SEQ ID NO: 360483 - protein, 9 aa, Homo Sapiens
TSVLLRFPR

SEQ ID NO: 360484 - protein, 9 aa, Homo Sapiens
VMTFCRLLN

SEQ ID NO: 360485 - protein, 9 aa, Homo Sapiens
ILERNPMYV

SEQ ID NO: 360486 - protein, 9 aa, Homo Sapiens
WKQNKFEQG

SEQ ID NO: 360487 - protein, 9 aa, Homo Sapiens
TEVVRHCPH

SEQ ID NO: 360488 - protein, 9 aa, Homo Sapiens
LFNIRRVTL

SEQ ID NO: 360489 - protein, 9 aa, Homo Sapiens
KKYDGLEVD

SEQ ID NO: 360490 - protein, 9 aa, Homo Sapiens
LQNRLPTET

SEQ ID NO: 360491 - protein, 9 aa, Homo Sapiens
WQLLVMVRV

SEQ ID NO: 360492 - protein, 9 aa, Homo Sapiens
MNMKIHLIT

SEQ ID NO: 360493 - protein, 9 aa, Homo Sapiens
LPSEQQDFL

SEQ ID NO: 360494 - protein, 9 aa, Homo Sapiens
LYDQYGKEG

SEQ ID NO: 360495 - protein, 9 aa, Homo Sapiens
GFMIGHMAY

SEQ ID NO: 360496 - protein, 9 aa, Homo Sapiens
TLLDIRASI

SEQ ID NO: 360497 - protein, 9 aa, Homo Sapiens
LDLQRIKMK

SEQ ID NO: 360498 - protein, 9 aa, Homo Sapiens
NINKEHELF

SEQ ID NO: 360499 - protein, 9 aa, Homo Sapiens
CTEKVDEQQ

SEQ ID NO: 360500 - protein, 9 aa, Homo Sapiens
GPGEPRRHR

SEQ ID NO: 360501 - protein, 9 aa, Homo Sapiens
CRQLILTCP

SEQ ID NO: 360502 - protein, 9 aa, Homo Sapiens
IRASIQPKP

SEQ ID NO: 360503 - protein, 9 aa, Homo Sapiens
EQGKKEKTL

SEQ ID NO: 360504 - protein, 9 aa, Homo Sapiens
RTGLMVTCY

SEQ ID NO: 360505 - protein, 9 aa, Homo Sapiens
ALTTLSGDS

SEQ ID NO: 360506 - protein, 9 aa, Homo Sapiens
HPGEITSDL

SEQ ID NO: 360507 - protein, 9 aa, Homo Sapiens
QYGKEGLKT

SEQ ID NO: 360508 - protein, 9 aa, Homo Sapiens
DLAEDPQDE

SEQ ID NO: 360509 - protein, 9 aa, Homo Sapiens
STTILCQKL

SEQ ID NO: 360510 - protein, 9 aa, Homo Sapiens
LSVVTHSLL

SEQ ID NO: 360511 - protein, 9 aa, Homo Sapiens
IIRKYRRNW

SEQ ID NO: 360512 - protein, 9 aa, Homo Sapiens
KPQYSYHDI

SEQ ID NO: 360513 - protein, 9 aa, Homo Sapiens
NCRNKDHYE

SEQ ID NO: 360514 - protein, 9 aa, Homo Sapiens
ATRLHILER

SEQ ID NO: 360515 - protein, 9 aa, Homo Sapiens
VTEEETRVM

SEQ ID NO: 360516 - protein, 9 aa, Homo Sapiens
PQMEIQKSP

SEQ ID NO: 360517 - protein, 9 aa, Homo Sapiens
IFSTTILCQ

SEQ ID NO: 360518 - protein, 9 aa, Homo Sapiens
MLSGRMKVK

SEQ ID NO: 360519 - protein, 9 aa, Homo Sapiens
VVKHLAVAQ

SEQ ID NO: 360520 - protein, 9 aa, Homo Sapiens
SAAAMYSGP

SEQ ID NO: 360521 - protein, 9 aa, Homo Sapiens
ADFLLYISE

SEQ ID NO: 360522 - protein, 9 aa, Homo Sapiens
GAAEAAPFE

SEQ ID NO: 360523 - protein, 9 aa, Homo Sapiens
SGVQTDNED

SEQ ID NO: 360524 - protein, 9 aa, Homo Sapiens
SHTLLDIRA

SEQ ID NO: 360525 - protein, 9 aa, Homo Sapiens
DNEDATDRS

SEQ ID NO: 360526 - protein, 9 aa, Homo Sapiens
PSFYIRELI

SEQ ID NO: 360527 - protein, 9 aa, Homo Sapiens
AAAPVAGGR

SEQ ID NO: 360528 - protein, 9 aa, Homo Sapiens
MRPVTEEET

SEQ ID NO: 360529 - protein, 9 aa, Homo Sapiens
EYTKEGIEW

SEQ ID NO: 360530 - protein, 9 aa, Homo Sapiens
RYKSVAVAA

SEQ ID NO: 360531 - protein, 9 aa, Homo Sapiens
AAEAAPFEA

SEQ ID NO: 360532 - protein, 9 aa, Homo Sapiens
ISVGNVVKH

SEQ ID NO: 360533 - protein, 9 aa, Homo Sapiens
NCKTDSFSL

SEQ ID NO: 360534 - protein, 9 aa, Homo Sapiens
TECSIHLEV

SEQ ID NO: 360535 - protein, 9 aa, Homo Sapiens
FHFSKLKRK

SEQ ID NO: 360536 - protein, 9 aa, Homo Sapiens
SAADFLLYI

SEQ ID NO: 360537 - protein, 9 aa, Homo Sapiens
QPKPRMNVM

SEQ ID NO: 360538 - protein, 9 aa, Homo Sapiens
KHLAVAQNS

SEQ ID NO: 360539 - protein, 9 aa, Homo Sapiens
DQELLQESG

SEQ ID NO: 360540 - protein, 9 aa, Homo Sapiens
EWTMKQPVF

SEQ ID NO: 360541 - protein, 9 aa, Homo Sapiens
ESGLALIPD

SEQ ID NO: 360542 - protein, 9 aa, Homo Sapiens
QSKEHPQQL

SEQ ID NO: 360543 - protein, 9 aa, Homo Sapiens
TSMKPAHMM

SEQ ID NO: 360544 - protein, 9 aa, Homo Sapiens
EVVRHCPHH

SEQ ID NO: 360545 - protein, 9 aa, Homo Sapiens
YATNPSAGA

SEQ ID NO: 360546 - protein, 9 aa, Homo Sapiens
LQSQQQKQR

SEQ ID NO: 360547 - protein, 9 aa, Homo Sapiens
YEFKEVAGS

SEQ ID NO: 360548 - protein, 9 aa, Homo Sapiens
MYSGPVYAL

SEQ ID NO: 360549 - protein, 9 aa, Homo Sapiens
WGEGNKMTP

SEQ ID NO: 360550 - protein, 9 aa, Homo Sapiens
WTAVALHPF

SEQ ID NO: 360551 - protein, 9 aa, Homo Sapiens
GPEKGGGLA

SEQ ID NO: 360552 - protein, 9 aa, Homo Sapiens
MNVMNVGKL

SEQ ID NO: 360553 - protein, 9 aa, Homo Sapiens
WEKSTWQLL

SEQ ID NO: 360554 - protein, 9 aa, Homo Sapiens
ILDLQRIKM

SEQ ID NO: 360555 - protein, 9 aa, Homo Sapiens
RMNVMNVGK

SEQ ID NO: 360556 - protein, 9 aa, Homo Sapiens
GHLRTSMKP

SEQ ID NO: 360557 - protein, 9 aa, Homo Sapiens
GAAAPVAGG

SEQ ID NO: 360558 - protein, 9 aa, Homo Sapiens
FMYMRPDMT

SEQ ID NO: 360559 - protein, 9 aa, Homo Sapiens
DSRDSRRNR

SEQ ID NO: 360560 - protein, 9 aa, Homo Sapiens
LAEDPQDEQ

SEQ ID NO: 360561 - protein, 9 aa, Homo Sapiens
AIQTYTSTI

SEQ ID NO: 360562 - protein, 9 aa, Homo Sapiens
STWQLLVMV

SEQ ID NO: 360563 - protein, 9 aa, Homo Sapiens
DKRTDKSAM

SEQ ID NO: 360564 - protein, 9 aa, Homo Sapiens
NTIKKRVEN

SEQ ID NO: 360565 - protein, 9 aa, Homo Sapiens
AFPSFYIRE

SEQ ID NO: 360566 - protein, 9 aa, Homo Sapiens
IKITVDGPG

SEQ ID NO: 360567 - protein, 9 aa, Homo Sapiens
MRPKICRLR

SEQ ID NO: 360568 - protein, 9 aa, Homo Sapiens
PAIIKVKVD

SEQ ID NO: 360569 - protein, 9 aa, Homo Sapiens
DRPWLHILF

SEQ ID NO: 360570 - protein, 9 aa, Homo Sapiens
DIRASIQPK

SEQ ID NO: 360571 - protein, 9 aa, Homo Sapiens
LVVHWNCKT

SEQ ID NO: 360572 - protein, 9 aa, Homo Sapiens
VTCYHGFQS

SEQ ID NO: 360573 - protein, 9 aa, Homo Sapiens
TDNEDATDR

SEQ ID NO: 360574 - protein, 9 aa, Homo Sapiens
VEIKKEASY

SEQ ID NO: 360575 - protein, 9 aa, Homo Sapiens
NRLPTETTV

SEQ ID NO: 360576 - protein, 9 aa, Homo Sapiens
LSLPGYKEK

SEQ ID NO: 360577 - protein, 9 aa, Homo Sapiens
KKQYISVGN

SEQ ID NO: 360578 - protein, 9 aa, Homo Sapiens
LHEWTMKQP

SEQ ID NO: 360579 - protein, 9 aa, Homo Sapiens
ALHALPSEQ

SEQ ID NO: 360580 - protein, 9 aa, Homo Sapiens
KICRLRTAF

SEQ ID NO: 360581 - protein, 9 aa, Homo Sapiens
LWATRSSMF

SEQ ID NO: 360582 - protein, 9 aa, Homo Sapiens
RTDKSAMSG

SEQ ID NO: 360583 - protein, 9 aa, Homo Sapiens
ASHHSMSQS

SEQ ID NO: 360584 - protein, 9 aa, Homo Sapiens
QSIMVQRRS

SEQ ID NO: 360585 - protein, 9 aa, Homo Sapiens
LNVIKPSAG

SEQ ID NO: 360586 - protein, 9 aa, Homo Sapiens
GRRKLTFDS

SEQ ID NO: 360587 - protein, 9 aa, Homo Sapiens
HFAVSHTLL

SEQ ID NO: 360588 - protein, 9 aa, Homo Sapiens
TKEGIEWTF

SEQ ID NO: 360589 - protein, 9 aa, Homo Sapiens
SITSLKDGL

SEQ ID NO: 360590 - protein, 9 aa, Homo Sapiens
LITTHSLLN

SEQ ID NO: 360591 - protein, 9 aa, Homo Sapiens
AGPEKGGGL

SEQ ID NO: 360592 - protein, 9 aa, Homo Sapiens
LMVTCYHGF

SEQ ID NO: 360593 - protein, 9 aa, Homo Sapiens
IVWGHAAPA

SEQ ID NO: 360594 - protein, 9 aa, Homo Sapiens
KYDGLEVDI

SEQ ID NO: 360595 - protein, 9 aa, Homo Sapiens
GRTLLSLPG

SEQ ID NO: 360596 - protein, 9 aa, Homo Sapiens
PMYVRYATN

SEQ ID NO: 360597 - protein, 9 aa, Homo Sapiens
EAQLATLEG

SEQ ID NO: 360598 - protein, 9 aa, Homo Sapiens
SAGAQTLLN

SEQ ID NO: 360599 - protein, 9 aa, Homo Sapiens
EAAEGAAEA

SEQ ID NO: 360600 - protein, 9 aa, Homo Sapiens
SLGMHPLFN

SEQ ID NO: 360601 - protein, 9 aa, Homo Sapiens
IGKKQYISV

SEQ ID NO: 360602 - protein, 9 aa, Homo Sapiens
VSTWTAVAL

SEQ ID NO: 360603 - protein, 9 aa, Homo Sapiens
LLSLPGYKE

SEQ ID NO: 360604 - protein, 9 aa, Homo Sapiens
DKRYKSVAV

SEQ ID NO: 360605 - protein, 9 aa, Homo Sapiens
TLLSLPGYK

SEQ ID NO: 360606 - protein, 9 aa, Homo Sapiens
KRVENKYYA

SEQ ID NO: 360607 - protein, 9 aa, Homo Sapiens
RMKVKEWEK

SEQ ID NO: 360608 - protein, 9 aa, Homo Sapiens
ELRRSLEFS

SEQ ID NO: 360609 - protein, 9 aa, Homo Sapiens
SSMNVMNVV

SEQ ID NO: 360610 - protein, 9 aa, Homo Sapiens
LANSTINSD

SEQ ID NO: 360611 - protein, 9 aa, Homo Sapiens
RLHILERNL

SEQ ID NO: 360612 - protein, 9 aa, Homo Sapiens
SRAVEKKFR

SEQ ID NO: 360613 - protein, 9 aa, Homo Sapiens
LMPAAAALT

SEQ ID NO: 360614 - protein, 9 aa, Homo Sapiens
GNVVKHLAV

SEQ ID NO: 360615 - protein, 9 aa, Homo Sapiens
EDYLQNRLP

SEQ ID NO: 360616 - protein, 9 aa, Homo Sapiens
SREHHPRKH

SEQ ID NO: 360617 - protein, 9 aa, Homo Sapiens
AAMYSGPVY

SEQ ID NO: 360618 - protein, 9 aa, Homo Sapiens
IDQREEDLK

SEQ ID NO: 360619 - protein, 9 aa, Homo Sapiens
RKKLKGELE

SEQ ID NO: 360620 - protein, 9 aa, Homo Sapiens
HSMSQSIMV

SEQ ID NO: 360621 - protein, 9 aa, Homo Sapiens
TLERNPMRV

SEQ ID NO: 360622 - protein, 9 aa, Homo Sapiens
YMKKQPDIS

SEQ ID NO: 360623 - protein, 9 aa, Homo Sapiens
VGRHFAVSH

SEQ ID NO: 360624 - protein, 9 aa, Homo Sapiens
VGRRKLTFD

SEQ ID NO: 360625 - protein, 9 aa, Homo Sapiens
SAPLPRKKS

SEQ ID NO: 360626 - protein, 9 aa, Homo Sapiens
AGFCRKIAK

SEQ ID NO: 360627 - protein, 9 aa, Homo Sapiens
NGEIGCDWI

SEQ ID NO: 360628 - protein, 9 aa, Homo Sapiens
VLEQEEYTK

SEQ ID NO: 360629 - protein, 9 aa, Homo Sapiens
GNGQSFSIN

SEQ ID NO: 360630 - protein, 9 aa, Homo Sapiens
VSITSLKDG

SEQ ID NO: 360631 - protein, 9 aa, Homo Sapiens
SVGNVVKHL

SEQ ID NO: 360632 - protein, 9 aa, Homo Sapiens
KYRRNWTET

SEQ ID NO: 360633 - protein, 9 aa, Homo Sapiens
RRNRSPIRG

SEQ ID NO: 360634 - protein, 9 aa, Homo Sapiens
KRYKSVAVA

SEQ ID NO: 360635 - protein, 9 aa, Homo Sapiens
RTSMKPAHM

SEQ ID NO: 360636 - protein, 9 aa, Homo Sapiens
SVTVLGTQI

SEQ ID NO: 360637 - protein, 9 aa, Homo Sapiens
QQLCEKCKV

SEQ ID NO: 360638 - protein, 9 aa, Homo Sapiens
LEVDIWSLG

SEQ ID NO: 360639 - protein, 9 aa, Homo Sapiens
PDMTFSEDK

SEQ ID NO: 360640 - protein, 9 aa, Homo Sapiens
STECSIHLE

SEQ ID NO: 360641 - protein, 9 aa, Homo Sapiens
PLFNIRRVT

SEQ ID NO: 360642 - protein, 9 aa, Homo Sapiens
YMRPDMTFS

SEQ ID NO: 360643 - protein, 9 aa, Homo Sapiens
GGRIVWGHA

SEQ ID NO: 360644 - protein, 9 aa, Homo Sapiens
HIGKKQYIS

SEQ ID NO: 360645 - protein, 9 aa, Homo Sapiens
NVIKPSAGA

SEQ ID NO: 360646 - protein, 9 aa, Homo Sapiens
SFATRLHIL

SEQ ID NO: 360647 - protein, 9 aa, Homo Sapiens
FNIRRVTLE

SEQ ID NO: 360648 - protein, 9 aa, Homo Sapiens
VKFSLGMHP

SEQ ID NO: 360649 - protein, 9 aa, Homo Sapiens
RSLEFSVNL

SEQ ID NO: 360650 - protein, 9 aa, Homo Sapiens
KQRGHLRTS

SEQ ID NO: 360651 - protein, 9 aa, Homo Sapiens
NVVKFSLGM

SEQ ID NO: 360652 - protein, 9 aa, Homo Sapiens
QCRQLILTC

SEQ ID NO: 360653 - protein, 9 aa, Homo Sapiens
WNSPPLTSK

SEQ ID NO: 360654 - protein, 9 aa, Homo Sapiens
KEGLKTGGG

SEQ ID NO: 360655 - protein, 9 aa, Homo Sapiens
GEAAEGAAE

SEQ ID NO: 360656 - protein, 9 aa, Homo Sapiens
ELETEIQID

SEQ ID NO: 360657 - protein, 9 aa, Homo Sapiens
NIRRVTLER

SEQ ID NO: 360658 - protein, 9 aa, Homo Sapiens
QGSAPLPRK

SEQ ID NO: 360659 - protein, 9 aa, Homo Sapiens
WQVEHPGEI

SEQ ID NO: 360660 - protein, 9 aa, Homo Sapiens
MSGAIRLHI

SEQ ID NO: 360661 - protein, 9 aa, Homo Sapiens
SLLNIREFM

SEQ ID NO: 360662 - protein, 9 aa, Homo Sapiens
VKLVEFWSE

SEQ ID NO: 360663 - protein, 9 aa, Homo Sapiens
PPLTSKFVA

SEQ ID NO: 360664 - protein, 9 aa, Homo Sapiens
IQPKPRMNV

SEQ ID NO: 360665 - protein, 9 aa, Homo Sapiens
TSAAAMYSG

SEQ ID NO: 360666 - protein, 9 aa, Homo Sapiens
RTCNKTAPQ

SEQ ID NO: 360667 - protein, 9 aa, Homo Sapiens
EGAAEAAPF

SEQ ID NO: 360668 - protein, 9 aa, Homo Sapiens
QLILTCPAC

SEQ ID NO: 360669 - protein, 9 aa, Homo Sapiens
QTYTSTIQA

SEQ ID NO: 360670 - protein, 9 aa, Homo Sapiens
NVMNVVKFS

SEQ ID NO: 360671 - protein, 9 aa, Homo Sapiens
VTHSLLNIR

SEQ ID NO: 360672 - protein, 9 aa, Homo Sapiens
LYTTLRCSA

SEQ ID NO: 360673 - protein, 9 aa, Homo Sapiens
ERNPMYVRY

SEQ ID NO: 360674 - protein, 9 aa, Homo Sapiens
RNPMRVLNV

SEQ ID NO: 360675 - protein, 9 aa, Homo Sapiens
EHPQQLCEK

SEQ ID NO: 360676 - protein, 9 aa, Homo Sapiens
STINSDGSV

SEQ ID NO: 360677 - protein, 9 aa, Homo Sapiens
SVLLRFPRA

SEQ ID NO: 360678 - protein, 9 aa, Homo Sapiens
LKRKQDLEK

SEQ ID NO: 360679 - protein, 9 aa, Homo Sapiens
IKPSAGAFP

SEQ ID NO: 360680 - protein, 9 aa, Homo Sapiens
IHLITTHSL

SEQ ID NO: 360681 - protein, 9 aa, Homo Sapiens
LLLYTTLRC

SEQ ID NO: 360682 - protein, 9 aa, Homo Sapiens
TVDGPGEPR

SEQ ID NO: 360683 - protein, 9 aa, Homo Sapiens
YDGLEVDIW

SEQ ID NO: 360684 - protein, 9 aa, Homo Sapiens
TCTATVPPK

SEQ ID NO: 360685 - protein, 9 aa, Homo Sapiens
IIKVKVDPL

SEQ ID NO: 360686 - protein, 9 aa, Homo Sapiens
QHMTEVVRH

SEQ ID NO: 360687 - protein, 9 aa, Homo Sapiens
GEIGCDWIV

SEQ ID NO: 360688 - protein, 9 aa, Homo Sapiens
MRPDMTFSE

SEQ ID NO: 360689 - protein, 9 aa, Homo Sapiens
MLEKSSMNV

SEQ ID NO: 360690 - protein, 9 aa, Homo Sapiens
RRNWTETRG

SEQ ID NO: 360691 - protein, 9 aa, Homo Sapiens
MEDKRYKSV

SEQ ID NO: 360692 - protein, 9 aa, Homo Sapiens
PLTSKFVAL

SEQ ID NO: 360693 - protein, 9 aa, Homo Sapiens
THSTVPTFS

SEQ ID NO: 360694 - protein, 9 aa, Homo Sapiens
PVTEEETRV

SEQ ID NO: 360695 - protein, 9 aa, Homo Sapiens
TRSSMFLFG

SEQ ID NO: 360696 - protein, 9 aa, Homo Sapiens
EGNGQSFSI

SEQ ID NO: 360697 - protein, 9 aa, Homo Sapiens
GRTGLMVTC

SEQ ID NO: 360698 - protein, 9 aa, Homo Sapiens
AEVKLVEFW

SEQ ID NO: 360699 - protein, 9 aa, Homo Sapiens
LPGYKEKVE

SEQ ID NO: 360700 - protein, 9 aa, Homo Sapiens
ELILERNPM

SEQ ID NO: 360701 - protein, 9 aa, Homo Sapiens
LTFDSLAGT

SEQ ID NO: 360702 - protein, 9 aa, Homo Sapiens
ASIQPKPRM

SEQ ID NO: 360703 - protein, 9 aa, Homo Sapiens
YKSVAVAAS

SEQ ID NO: 360704 - protein, 9 aa, Homo Sapiens
DWIVTGNFI

SEQ ID NO: 360705 - protein, 9 aa, Homo Sapiens
EVKLVEFWS

SEQ ID NO: 360706 - protein, 9 aa, Homo Sapiens
HILERNLMN

SEQ ID NO: 360707 - protein, 9 aa, Homo Sapiens
QQKQRGHLR

SEQ ID NO: 360708 - protein, 9 aa, Homo Sapiens
PWLHILFFV

SEQ ID NO: 360709 - protein, 9 aa, Homo Sapiens
ITVDGPGEP

SEQ ID NO: 360710 - protein, 9 aa, Homo Sapiens
ILCQKLMQV

SEQ ID NO: 360711 - protein, 9 aa, Homo Sapiens
LMNALNVGR

SEQ ID NO: 360712 - protein, 9 aa, Homo Sapiens
QNRLPTETT

SEQ ID NO: 360713 - protein, 9 aa, Homo Sapiens
RTSRAVEKK

SEQ ID NO: 360714 - protein, 9 aa, Homo Sapiens
EWEKSTWQL

SEQ ID NO: 360715 - protein, 9 aa, Homo Sapiens
MRVLNVIKP

SEQ ID NO: 360716 - protein, 9 aa, Homo Sapiens
AGVSITSLK

SEQ ID NO: 360717 - protein, 9 aa, Homo Sapiens
QGKKYDGLE

SEQ ID NO: 360718 - protein, 9 aa, Homo Sapiens
VENKYYAKA

SEQ ID NO: 360719 - protein, 9 aa, Homo Sapiens
LRRSLEFSV

SEQ ID NO: 360720 - protein, 9 aa, Homo Sapiens
GKKYDGLEV

SEQ ID NO: 360721 - protein, 9 aa, Homo Sapiens
KQYISVGNV

SEQ ID NO: 360722 - protein, 9 aa, Homo Sapiens
TCYHGFQSV

SEQ ID NO: 360723 - protein, 9 aa, Homo Sapiens
RNRSPIRGS

SEQ ID NO: 360724 - protein, 9 aa, Homo Sapiens
KITVDGPGE

SEQ ID NO: 360725 - protein, 9 aa, Homo Sapiens
VGTQGRTCN

SEQ ID NO: 360726 - protein, 9 aa, Homo Sapiens
GEGNKMTPG

SEQ ID NO: 360727 - protein, 9 aa, Homo Sapiens
TFMYMRPDM

SEQ ID NO: 360728 - protein, 9 aa, Homo Sapiens
NKFEQGKKE

SEQ ID NO: 360729 - protein, 9 aa, Homo Sapiens
LLRFPRAGE

SEQ ID NO: 360730 - protein, 9 aa, Homo Sapiens
SRRNRSPIR

SEQ ID NO: 360731 - protein, 9 aa, Homo Sapiens
LQEKESEIH

SEQ ID NO: 360732 - protein, 9 aa, Homo Sapiens
VLLRFPRAG

SEQ ID NO: 360733 - protein, 9 aa, Homo Sapiens
ATRSSMFLF

SEQ ID NO: 360734 - protein, 9 aa, Homo Sapiens
RASIQPKPR

SEQ ID NO: 360735 - protein, 9 aa, Homo Sapiens
GLYDQYGKE

SEQ ID NO: 360736 - protein, 9 aa, Homo Sapiens
LILERNPMY

SEQ ID NO: 360737 - protein, 9 aa, Homo Sapiens
CGRSTECSI

SEQ ID NO: 360738 - protein, 9 aa, Homo Sapiens
CRKIAKGAQ

SEQ ID NO: 360739 - protein, 9 aa, Homo Sapiens
VQTDNEDAT

SEQ ID NO: 360740 - protein, 9 aa, Homo Sapiens
ERFDQSVTV

SEQ ID NO: 360741 - protein, 9 aa, Homo Sapiens
AGAFPSFYI

SEQ ID NO: 360742 - protein, 9 aa, Homo Sapiens
EHHPRKHLS

SEQ ID NO: 360743 - protein, 9 aa, Homo Sapiens
SIMVQRRSG

SEQ ID NO: 360744 - protein, 9 aa, Homo Sapiens
PDENGHDLA

SEQ ID NO: 360745 - protein, 9 aa, Homo Sapiens
TEKVDEQQT

SEQ ID NO: 360746 - protein, 9 aa, Homo Sapiens
QRGHLRTSM

SEQ ID NO: 360747 - protein, 9 aa, Homo Sapiens
VKHLAVAQN

SEQ ID NO: 360748 - protein, 9 aa, Homo Sapiens
RKIAKGAQQ

SEQ ID NO: 360749 - protein, 9 aa, Homo Sapiens
LNIRGHTLL

SEQ ID NO: 360750 - protein, 9 aa, Homo Sapiens
HTLLDIRAS

SEQ ID NO: 360751 - protein, 9 aa, Homo Sapiens
VAGGRPDLG

SEQ ID NO: 360752 - protein, 9 aa, Homo Sapiens
LGMHPLFNI

SEQ ID NO: 360753 - protein, 9 aa, Homo Sapiens
TILCQKLMQ

SEQ ID NO: 360754 - protein, 9 aa, Homo Sapiens
STVPTFSCP

SEQ ID NO: 360755 - protein, 9 aa, Homo Sapiens
LCGRSTECS

SEQ ID NO: 360756 - protein, 9 aa, Homo Sapiens
KFSLGMHPL

SEQ ID NO: 360757 - protein, 9 aa, Homo Sapiens
FTHSTVPTF

SEQ ID NO: 360758 - protein, 9 aa, Homo Sapiens
VDSGVQTDN

SEQ ID NO: 360759 - protein, 9 aa, Homo Sapiens
DAGGRIVWG

SEQ ID NO: 360760 - protein, 9 aa, Homo Sapiens
ILSLSGFMI

SEQ ID NO: 360761 - protein, 9 aa, Homo Sapiens
GVQTDNEDA

SEQ ID NO: 360762 - protein, 9 aa, Homo Sapiens
AVSHTLLDI

SEQ ID NO: 360763 - protein, 9 aa, Homo Sapiens
VAGSFTSSL

SEQ ID NO: 360764 - protein, 9 aa, Homo Sapiens
LYISETDLS

SEQ ID NO: 360765 - protein, 9 aa, Homo Sapiens
MTPGVSQGE

SEQ ID NO: 360766 - protein, 9 aa, Homo Sapiens
IPDENGHDL

SEQ ID NO: 360767 - protein, 9 aa, Homo Sapiens
MAAVMTFCR

SEQ ID NO: 360768 - protein, 9 aa, Homo Sapiens
TRLHILERN

SEQ ID NO: 360769 - protein, 9 aa, Homo Sapiens
PGVSQGEWK

SEQ ID NO: 360770 - protein, 9 aa, Homo Sapiens
PSAGAQTLL

SEQ ID NO: 360771 - protein, 9 aa, Homo Sapiens
KQPDISNSM

SEQ ID NO: 360772 - protein, 9 aa, Homo Sapiens
FLLYISETD

SEQ ID NO: 360773 - protein, 9 aa, Homo Sapiens
QLHEWTMKQ

SEQ ID NO: 360774 - protein, 9 aa, Homo Sapiens
YGKEGLKTG

SEQ ID NO: 360775 - protein, 9 aa, Homo Sapiens
AVAQNSFAT

SEQ ID NO: 360776 - protein, 9 aa, Homo Sapiens
DSGVQTDNE

SEQ ID NO: 360777 - protein, 9 aa, Homo Sapiens
LEKSSMNVM

SEQ ID NO: 360778 - protein, 9 aa, Homo Sapiens
KLTFDSLAG

SEQ ID NO: 360779 - protein, 9 aa, Homo Sapiens
ITTHSLLNT

SEQ ID NO: 360780 - protein, 9 aa, Homo Sapiens
LRTAFSWIL

SEQ ID NO: 360781 - protein, 9 aa, Homo Sapiens
KGGGLAAAA

SEQ ID NO: 360782 - protein, 9 aa, Homo Sapiens
TTILCQKLM

SEQ ID NO: 360783 - protein, 9 aa, Homo Sapiens
GTQGRTCNK

SEQ ID NO: 360784 - protein, 9 aa, Homo Sapiens
RGHLRTSMK

SEQ ID NO: 360785 - protein, 9 aa, Homo Sapiens
MNALNVGRH

SEQ ID NO: 360786 - protein, 9 aa, Homo Sapiens
AFTHSTVPT

SEQ ID NO: 360787 - protein, 9 aa, Homo Sapiens
AAAMYSGPV

SEQ ID NO: 360788 - protein, 9 aa, Homo Sapiens
FSVNLQRKQ

SEQ ID NO: 360789 - protein, 9 aa, Homo Sapiens
AMSGAIRLH

SEQ ID NO: 360790 - protein, 9 aa, Homo Sapiens
RRSLEFSVN

SEQ ID NO: 360791 - protein, 9 aa, Homo Sapiens
VHWNCKTDS

SEQ ID NO: 360792 - protein, 9 aa, Homo Sapiens
PTFSCPWGK

SEQ ID NO: 360793 - protein, 9 aa, Homo Sapiens
KIAKGAQQG

SEQ ID NO: 360794 - protein, 9 aa, Homo Sapiens
VMNVGKLSV

SEQ ID NO: 360795 - protein, 9 aa, Homo Sapiens
EFMLEKSSM

SEQ ID NO: 360796 - protein, 9 aa, Homo Sapiens
QQTFLNKIN

SEQ ID NO: 360797 - protein, 9 aa, Homo Sapiens
GGGLAAAAA

SEQ ID NO: 360798 - protein, 9 aa, Homo Sapiens
NPQYEFKEV

SEQ ID NO: 360799 - protein, 9 aa, Homo Sapiens
LKGELEELK

SEQ ID NO: 360800 - protein, 9 aa, Homo Sapiens
MVTCYHGFQ

SEQ ID NO: 360801 - protein, 9 aa, Homo Sapiens
AGSTFQINT

SEQ ID NO: 360802 - protein, 9 aa, Homo Sapiens
EDKRYKSVA

SEQ ID NO: 360803 - protein, 9 aa, Homo Sapiens
VALHPFAGW

SEQ ID NO: 360804 - protein, 9 aa, Homo Sapiens
FDSLAGTTV

SEQ ID NO: 360805 - protein, 9 aa, Homo Sapiens
EVAGSFTSS

SEQ ID NO: 360806 - protein, 9 aa, Homo Sapiens
DPLYELVTA

SEQ ID NO: 360807 - protein, 9 aa, Homo Sapiens
DLERIEAQL

SEQ ID NO: 360808 - protein, 9 aa, Homo Sapiens
KQNKFEQGK

SEQ ID NO: 360809 - protein, 9 aa, Homo Sapiens
IKNHIEKHG

SEQ ID NO: 360810 - protein, 9 aa, Homo Sapiens
HEWTMKQPV

SEQ ID NO: 360811 - protein, 9 aa, Homo Sapiens
STWTAVALH

SEQ ID NO: 360812 - protein, 9 aa, Homo Sapiens
PKICRLRTA

SEQ ID NO: 360813 - protein, 9 aa, Homo Sapiens
VEGNGQSFS

SEQ ID NO: 360814 - protein, 9 aa, Homo Sapiens
TEIILDLQR

SEQ ID NO: 360815 - protein, 9 aa, Homo Sapiens
EIMMYHRNR

SEQ ID NO: 360816 - protein, 9 aa, Homo Sapiens
KVKEWEKST

SEQ ID NO: 360817 - protein, 9 aa, Homo Sapiens
GAQTLLNIR

SEQ ID NO: 360818 - protein, 9 aa, Homo Sapiens
HHSMSQSIM

SEQ ID NO: 360819 - protein, 9 aa, Homo Sapiens
DEQQTFLNK

SEQ ID NO: 360820 - protein, 9 aa, Homo Sapiens
RRVTLERNP

SEQ ID NO: 360821 - protein, 9 aa, Homo Sapiens
FEQGKKEKT

SEQ ID NO: 360822 - protein, 9 aa, Homo Sapiens
KEWEKSTWQ

SEQ ID NO: 360823 - protein, 9 aa, Homo Sapiens
GDSRDSRRN

SEQ ID NO: 360824 - protein, 9 aa, Homo Sapiens
PKPQYSYHD

SEQ ID NO: 360825 - protein, 9 aa, Homo Sapiens
SMSQSIMVQ

SEQ ID NO: 360826 - protein, 9 aa, Homo Sapiens
DYLQNRLPT

SEQ ID NO: 360827 - protein, 9 aa, Homo Sapiens
RPWLHILFF

SEQ ID NO: 360828 - protein, 9 aa, Homo Sapiens
NEDYLQNRL

SEQ ID NO: 360829 - protein, 9 aa, Homo Sapiens
LRTSMKPAH

SEQ ID NO: 360830 - protein, 9 aa, Homo Sapiens
SLEFSVNLQ

SEQ ID NO: 360831 - protein, 9 aa, Homo Sapiens
QYISVGNVV

SEQ ID NO: 360832 - protein, 9 aa, Homo Sapiens
MVRVQLHEW

SEQ ID NO: 360833 - protein, 9 aa, Homo Sapiens
VRYATNPSA

SEQ ID NO: 360834 - protein, 9 aa, Homo Sapiens
NVGKLSVVT

SEQ ID NO: 360835 - protein, 9 aa, Homo Sapiens
TFSCPWGKQ

SEQ ID NO: 360836 - protein, 9 aa, Homo Sapiens
LTGRTLLSL

SEQ ID NO: 360837 - protein, 9 aa, Homo Sapiens
NSPPLTSKF

SEQ ID NO: 360838 - protein, 9 aa, Homo Sapiens
MKKQPDISN

SEQ ID NO: 360839 - protein, 9 aa, Homo Sapiens
TRRPLVRQL

SEQ ID NO: 360840 - protein, 9 aa, Homo Sapiens
KRKQDLEKK

SEQ ID NO: 360841 - protein, 9 aa, Homo Sapiens
PSAGAFPSF

SEQ ID NO: 360842 - protein, 9 aa, Homo Sapiens
LERNPMRVL

SEQ ID NO: 360843 - protein, 9 aa, Homo Sapiens
LAVAQNSFA

SEQ ID NO: 360844 - protein, 9 aa, Homo Sapiens
AGAQTLLNI

SEQ ID NO: 360845 - protein, 9 aa, Homo Sapiens
QIKNHIEKH

SEQ ID NO: 360846 - protein, 9 aa, Homo Sapiens
RGHTLLTTP

SEQ ID NO: 360847 - protein, 9 aa, Homo Sapiens
DSLAGTTVA

SEQ ID NO: 360848 - protein, 9 aa, Homo Sapiens
FKEVAGSFT

SEQ ID NO: 360849 - protein, 9 aa, Homo Sapiens
ENGHDLAED

SEQ ID NO: 360850 - protein, 9 aa, Homo Sapiens
QESGLALIP

SEQ ID NO: 360851 - protein, 9 aa, Homo Sapiens
LTTLSGDSP

SEQ ID NO: 360852 - protein, 9 aa, Homo Sapiens
NGHDLAEDP

SEQ ID NO: 360853 - protein, 9 aa, Homo Sapiens
NPMRVLNVI

SEQ ID NO: 360854 - protein, 9 aa, Homo Sapiens
VVLWATRSS

SEQ ID NO: 360855 - protein, 9 aa, Homo Sapiens
YLQNRLPTE

SEQ ID NO: 360856 - protein, 9 aa, Homo Sapiens
SELETEIQI

SEQ ID NO: 360857 - protein, 9 aa, Homo Sapiens
IRRVTLERN

SEQ ID NO: 360858 - protein, 9 aa, Homo Sapiens
PMRVLNVIK

SEQ ID NO: 360859 - protein, 9 aa, Homo Sapiens
MMLSGRMKV

SEQ ID NO: 360860 - protein, 9 aa, Homo Sapiens
TAVALHPFA

SEQ ID NO: 360861 - protein, 9 aa, Homo Sapiens
KSVAVAASV

SEQ ID NO: 360862 - protein, 9 aa, Homo Sapiens
LQGIFSTTI

SEQ ID NO: 360863 - protein, 9 aa, Homo Sapiens
ACTEKVDEQ

SEQ ID NO: 360864 - protein, 9 aa, Homo Sapiens
VWGHAAPAG

SEQ ID NO: 360865 - protein, 9 aa, Homo Sapiens
SVVTHSLLN

SEQ ID NO: 360866 - protein, 9 aa, Homo Sapiens
CPDSREHHP

SEQ ID NO: 360867 - protein, 9 aa, Homo Sapiens
KVKVNCDSF

SEQ ID NO: 360868 - protein, 9 aa, Homo Sapiens
RHCPHHERC

SEQ ID NO: 360869 - protein, 9 aa, Homo Sapiens
GHDLAEDPQ

SEQ ID NO: 360870 - protein, 9 aa, Homo Sapiens
LTSKFVALL

SEQ ID NO: 360871 - protein, 9 aa, Homo Sapiens
QSVTVLGTQ

SEQ ID NO: 360872 - protein, 9 aa, Homo Sapiens
MNVGKLSVV

SEQ ID NO: 360873 - protein, 9 aa, Homo Sapiens
VQLHEWTMK

SEQ ID NO: 360874 - protein, 9 aa, Homo Sapiens
SHHSMSQSI

SEQ ID NO: 360875 - protein, 9 aa, Homo Sapiens
QLATLEGDD

SEQ ID NO: 360876 - protein, 9 aa, Homo Sapiens
NRSPIRGSP

SEQ ID NO: 360877 - protein, 9 aa, Homo Sapiens
GMHPLFNIR

SEQ ID NO: 360878 - protein, 9 aa, Homo Sapiens
TTHSLLNTS

SEQ ID NO: 360879 - protein, 9 aa, Homo Sapiens
SQAGAGSTF

SEQ ID NO: 360880 - protein, 9 aa, Homo Sapiens
PAAAALTTL

SEQ ID NO: 360881 - protein, 9 aa, Homo Sapiens
KKQPDISNS

SEQ ID NO: 360882 - protein, 9 aa, Homo Sapiens
AAEGAAEAA

SEQ ID NO: 360883 - protein, 9 aa, Homo Sapiens
CDWIVTGNF

SEQ ID NO: 360884 - protein, 9 aa, Homo Sapiens
DLQRIKMKY

SEQ ID NO: 360885 - protein, 9 aa, Homo Sapiens
VVHWNCKTD

SEQ ID NO: 360886 - protein, 9 aa, Homo Sapiens
RVENKYYAK

SEQ ID NO: 360887 - protein, 9 aa, Homo Sapiens
GVSITSLKD

SEQ ID NO: 360888 - protein, 9 aa, Homo Sapiens
LERNPMYVR

SEQ ID NO: 360889 - protein, 9 aa, Homo Sapiens
VPPKPQYSY

SEQ ID NO: 360890 - protein, 9 aa, Homo Sapiens
SDAGGRIVW

SEQ ID NO: 360891 - protein, 9 aa, Homo Sapiens
LVTWQVEHP

SEQ ID NO: 360892 - protein, 9 aa, Homo Sapiens
WSECPGEQN

SEQ ID NO: 360893 - protein, 9 aa, Homo Sapiens
REHHPRKHL

SEQ ID NO: 360894 - protein, 9 aa, Homo Sapiens
AHMMLSGRM

SEQ ID NO: 360895 - protein, 9 aa, Homo Sapiens
AVMTFCRLL

SEQ ID NO: 360896 - protein, 9 aa, Homo Sapiens
NTEIILDLQ

SEQ ID NO: 360897 - protein, 9 aa, Homo Sapiens
INSDGSVTV

SEQ ID NO: 360898 - protein, 9 aa, Homo Sapiens
VWKQNKFEQ

SEQ ID NO: 360899 - protein, 9 aa, Homo Sapiens
GRHFAVSHT

SEQ ID NO: 360900 - protein, 9 aa, Homo Sapiens
MYMRPDMTF

SEQ ID NO: 360901 - protein, 9 aa, Homo Sapiens
VIKPSAGAF

SEQ ID NO: 360902 - protein, 9 aa, Homo Sapiens
EIQIDQREE

SEQ ID NO: 360903 - protein, 9 aa, Homo Sapiens
KPSAGAFPS

SEQ ID NO: 360904 - protein, 9 aa, Homo Sapiens
ALPSEQQDF

SEQ ID NO: 360905 - protein, 9 aa, Homo Sapiens
AGAGSTFQI

SEQ ID NO: 360906 - protein, 9 aa, Homo Sapiens
RRVVLWATR

SEQ ID NO: 360907 - protein, 9 aa, Homo Sapiens
EIKKEASYF

SEQ ID NO: 360908 - protein, 9 aa, Homo Sapiens
FSKLKRKQD

SEQ ID NO: 360909 - protein, 9 aa, Homo Sapiens
TILSLSGFM

SEQ ID NO: 360910 - protein, 9 aa, Homo Sapiens
AVALHPFAG

SEQ ID NO: 360911 - protein, 9 aa, Homo Sapiens
WNCKTDSFS

SEQ ID NO: 360912 - protein, 9 aa, Homo Sapiens
MHPLFNIRR

SEQ ID NO: 360913 - protein, 9 aa, Homo Sapiens
NKDHYEIMM

SEQ ID NO: 360914 - protein, 9 aa, Homo Sapiens
RHFAVSHTL

SEQ ID NO: 360915 - protein, 9 aa, Homo Sapiens
QIDQREEDL

SEQ ID NO: 360916 - protein, 9 aa, Homo Sapiens
TATVPPKPQ

SEQ ID NO: 360917 - protein, 9 aa, Homo Sapiens
FSTTILCQK

SEQ ID NO: 360918 - protein, 9 aa, Homo Sapiens
LTSAAAMYS

SEQ ID NO: 360919 - protein, 9 aa, Homo Sapiens
MEIQKSPVF

SEQ ID NO: 360920 - protein, 9 aa, Homo Sapiens
ELCGRSTEC

SEQ ID NO: 360921 - protein, 9 aa, Homo Sapiens
RQLILTCPA

SEQ ID NO: 360922 - protein, 9 aa, Homo Sapiens
NALNVGRHF

SEQ ID NO: 360923 - protein, 9 aa, Homo Sapiens
TWQVEHPGE

SEQ ID NO: 360924 - protein, 9 aa, Homo Sapiens
YTKEGIEWT

SEQ ID NO: 360925 - protein, 9 aa, Homo Sapiens
RNKDHYEIM

SEQ ID NO: 360926 - protein, 9 aa, Homo Sapiens
PVPQMEIQK

SEQ ID NO: 360927 - protein, 9 aa, Homo Sapiens
HLQTLQAIV

SEQ ID NO: 360928 - protein, 9 aa, Homo Sapiens
LPRKKSTRG

SEQ ID NO: 360929 - protein, 9 aa, Homo Sapiens
WTETRGIQF

SEQ ID NO: 360930 - protein, 9 aa, Homo Sapiens
TFQINTSVC

SEQ ID NO: 360931 - protein, 9 aa, Homo Sapiens
WQVEGNGQS

SEQ ID NO: 360932 - protein, 9 aa, Homo Sapiens
FQGKKYDGL

SEQ ID NO: 360933 - protein, 9 aa, Homo Sapiens
VVTHSLLNI

SEQ ID NO: 360934 - protein, 9 aa, Homo Sapiens
TLLLYTTLR

SEQ ID NO: 360935 - protein, 9 aa, Homo Sapiens
EFKEVAGSF

SEQ ID NO: 360936 - protein, 9 aa, Homo Sapiens
KVDEQQTFL

SEQ ID NO: 360937 - protein, 9 aa, Homo Sapiens
GHTLLTTPM

SEQ ID NO: 360938 - protein, 9 aa, Homo Sapiens
QTLLNIRGH

SEQ ID NO: 360939 - protein, 9 aa, Homo Sapiens
APLPRKKST

SEQ ID NO: 360940 - protein, 9 aa, Homo Sapiens
VLNVIKPSA

SEQ ID NO: 360941 - protein, 9 aa, Homo Sapiens
DGLEVDIWS

SEQ ID NO: 360942 - protein, 9 aa, Homo Sapiens
SGRMKVKEW

SEQ ID NO: 360943 - protein, 9 aa, Homo Sapiens
GSAADFLLY

SEQ ID NO: 360944 - protein, 9 aa, Homo Sapiens
TLRCSAQPT

SEQ ID NO: 360945 - protein, 9 aa, Homo Sapiens
HALPSEQQD

SEQ ID NO: 360946 - protein, 9 aa, Homo Sapiens
ITSLKDGLF

SEQ ID NO: 360947 - protein, 9 aa, Homo Sapiens
AQNSFATRL

SEQ ID NO: 360948 - protein, 9 aa, Homo Sapiens
TYTSTIQAK

SEQ ID NO: 360949 - protein, 9 aa, Homo Sapiens
GLMVTCYHG

SEQ ID NO: 360950 - protein, 9 aa, Homo Sapiens
SLPGYKEKV

SEQ ID NO: 360951 - protein, 9 aa, Homo Sapiens
TTLSGDSPL

SEQ ID NO: 360952 - protein, 9 aa, Homo Sapiens
LLYISETDL

SEQ ID NO: 360953 - protein, 9 aa, Homo Sapiens
QTDNEDATD

SEQ ID NO: 360954 - protein, 9 aa, Homo Sapiens
ATNPSAGAQ

SEQ ID NO: 360955 - protein, 9 aa, Homo Sapiens
CTATVPPKP

SEQ ID NO: 360956 - protein, 9 aa, Homo Sapiens
FPSFYIREL

SEQ ID NO: 360957 - protein, 9 aa, Homo Sapiens
QGIFSTTIL

SEQ ID NO: 360958 - protein, 9 aa, Homo Sapiens
VAARKKLKG

SEQ ID NO: 360959 - protein, 9 aa, Homo Sapiens
HIEKHGANT

SEQ ID NO: 360960 - protein, 9 aa, Homo Sapiens
TWQLLVMVR

SEQ ID NO: 360961 - protein, 9 aa, Homo Sapiens
WCPDSREHH

SEQ ID NO: 360962 - protein, 9 aa, Homo Sapiens
VKVDPLYEL

SEQ ID NO: 360963 - protein, 9 aa, Homo Sapiens
EFWSECPGE

SEQ ID NO: 360964 - protein, 9 aa, Homo Sapiens
NIRGHTLLT

SEQ ID NO: 360965 - protein, 9 aa, Homo Sapiens
RLANSTINS

SEQ ID NO: 360966 - protein, 9 aa, Homo Sapiens
GLEVDIWSL

SEQ ID NO: 360967 - protein, 9 aa, Homo Sapiens
LNVGRHFAV

SEQ ID NO: 360968 - protein, 9 aa, Homo Sapiens
YRRNWTETR

SEQ ID NO: 360969 - protein, 9 aa, Homo Sapiens
DNTEIILDL

SEQ ID NO: 360970 - protein, 9 aa, Homo Sapiens
KSTWQLLVM

SEQ ID NO: 360971 - protein, 9 aa, Homo Sapiens
SKEHPQQLC

SEQ ID NO: 360972 - protein, 9 aa, Homo Sapiens
MIGHMAYNS

SEQ ID NO: 360973 - protein, 9 aa, Homo Sapiens
ALNVGRHFA

SEQ ID NO: 360974 - protein, 9 aa, Homo Sapiens
SQSIMVQRR

SEQ ID NO: 360975 - protein, 9 aa, Homo Sapiens
KLSVVTHSL

SEQ ID NO: 360976 - protein, 9 aa, Homo Sapiens
PPKPQYSYH

SEQ ID NO: 360977 - protein, 9 aa, Homo Sapiens
LNTIKKRVE

SEQ ID NO: 360978 - protein, 9 aa, Homo Sapiens
VKEWEKSTW

SEQ ID NO: 360979 - protein, 9 aa, Homo Sapiens
TVPTFSCPW

SEQ ID NO: 360980 - protein, 9 aa, Homo Sapiens
RLRTAFSWI

SEQ ID NO: 360981 - protein, 9 aa, Homo Sapiens
EVWKQNKFE

SEQ ID NO: 360982 - protein, 9 aa, Homo Sapiens
SFYIRELIL

SEQ ID NO: 360983 - protein, 9 aa, Homo Sapiens
RNWTETRGI

SEQ ID NO: 360984 - protein, 9 aa, Homo Sapiens
KIHLITTHS

SEQ ID NO: 360985 - protein, 9 aa, Homo Sapiens
AAALTTLSG

SEQ ID NO: 360986 - protein, 9 aa, Homo Sapiens
TGLMVTCYH

SEQ ID NO: 360987 - protein, 9 aa, Homo Sapiens
VEHPGEITS

SEQ ID NO: 360988 - protein, 9 aa, Homo Sapiens
PEKGGGLAA

SEQ ID NO: 360989 - protein, 9 aa, Homo Sapiens
NVMNVGKLS

SEQ ID NO: 360990 - protein, 9 aa, Homo Sapiens
RRPLVRQLV

SEQ ID NO: 360991 - protein, 9 aa, Homo Sapiens
WIVTGNFIL

SEQ ID NO: 360992 - protein, 9 aa, Homo Sapiens
MPAAAALTT

SEQ ID NO: 360993 - protein, 9 aa, Homo Sapiens
LLQESGLAL

SEQ ID NO: 360994 - protein, 9 aa, Homo Sapiens
QLLQSQQQK

SEQ ID NO: 360995 - protein, 9 aa, Homo Sapiens
NPMYVRYAT

SEQ ID NO: 360996 - protein, 9 aa, Homo Sapiens
RLPTETTVL

SEQ ID NO: 360997 - protein, 9 aa, Homo Sapiens
HHPRKHLSL

SEQ ID NO: 360998 - protein, 9 aa, Homo Sapiens
RQLVTSKAE

SEQ ID NO: 360999 - protein, 9 aa, Homo Sapiens
FMIGHMAYN

SEQ ID NO: 361000 - protein, 9 aa, Homo Sapiens
ARKKLKGEL

SEQ ID NO: 361001 - protein, 9 aa, Homo Sapiens
LLVMVRVQL

SEQ ID NO: 361002 - protein, 9 aa, Homo Sapiens
IAKGAQQGD

SEQ ID NO: 361003 - protein, 9 aa, Homo Sapiens
SNSMRAILV

SEQ ID NO: 361004 - protein, 9 aa, Homo Sapiens
YVRYATNPS

SEQ ID NO: 361005 - protein, 9 aa, Homo Sapiens
DSRRNRSPI

SEQ ID NO: 361006 - protein, 9 aa, Homo Sapiens
YFIFSSITI

SEQ ID NO: 361007 - protein, 9 aa, Homo Sapiens
IITSVLLRF

SEQ ID NO: 361008 - protein, 9 aa, Homo Sapiens
WGHAAPAGA

SEQ ID NO: 361009 - protein, 9 aa, Homo Sapiens
QVEHPGEIT

SEQ ID NO: 361010 - protein, 9 aa, Homo Sapiens
YTTLRCSAQ

SEQ ID NO: 361011 - protein, 9 aa, Homo Sapiens
MKIHLITTH

SEQ ID NO: 361012 - protein, 9 aa, Homo Sapiens
ISNSMRAIL

SEQ ID NO: 361013 - protein, 9 aa, Homo Sapiens
PDSREHHPR

SEQ ID NO: 361014 - protein, 9 aa, Homo Sapiens
RQLLQSQQQ

SEQ ID NO: 361015 - protein, 9 aa, Homo Sapiens
PLVRQLVTS

SEQ ID NO: 361016 - protein, 9 aa, Homo Sapiens
FATRLHILE

SEQ ID NO: 361017 - protein, 9 aa, Homo Sapiens
RIVWGHAAP

SEQ ID NO: 361018 - protein, 9 aa, Homo Sapiens
ILTCPACQG

SEQ ID NO: 361019 - protein, 9 aa, Homo Sapiens
QPDISNSMR

SEQ ID NO: 361020 - protein, 9 aa, Homo Sapiens
ILFFVVFLV

SEQ ID NO: 361021 - protein, 9 aa, Homo Sapiens
HTLLTTPMN

SEQ ID NO: 361022 - protein, 9 aa, Homo Sapiens
KKLKGELEE

SEQ ID NO: 361023 - protein, 9 aa, Homo Sapiens
TGRTLLSLP

SEQ ID NO: 361024 - protein, 9 aa, Homo Sapiens
TINSDGSVT

SEQ ID NO: 361025 - protein, 9 aa, Homo Sapiens
HDLAEDPQD

SEQ ID NO: 361026 - protein, 9 aa, Homo Sapiens
LHALPSEQQ

SEQ ID NO: 361027 - protein, 9 aa, Homo Sapiens
VTVLGTQIF

SEQ ID NO: 361028 - protein, 9 aa, Homo Sapiens
IRKYRRNWT

SEQ ID NO: 361029 - protein, 9 aa, Homo Sapiens
VRVQLHEWT

SEQ ID NO: 361030 - protein, 9 aa, Homo Sapiens
AEAAPFEAD

SEQ ID NO: 361031 - protein, 9 aa, Homo Sapiens
MKPAHMMLS

SEQ ID NO: 361032 - protein, 9 aa, Homo Sapiens
PDISNSMRA

SEQ ID NO: 361033 - protein, 9 aa, Homo Sapiens
YTSTIQAKD

SEQ ID NO: 361034 - protein, 9 aa, Homo Sapiens
LNIREFMLE

SEQ ID NO: 361035 - protein, 9 aa, Homo Sapiens
SMKPAHMML

SEQ ID NO: 361036 - protein, 9 aa, Homo Sapiens
GAFPSFYIR

SEQ ID NO: 361037 - protein, 9 aa, Homo Sapiens
NKMTPGVSQ

SEQ ID NO: 361038 - protein, 9 aa, Homo Sapiens
QQQKQRGHL

SEQ ID NO: 361039 - protein, 9 aa, Homo Sapiens
KKRVENKYY

SEQ ID NO: 361040 - protein, 9 aa, Homo Sapiens
IRGHTLLTT

SEQ ID NO: 361041 - protein, 9 aa, Homo Sapiens
LEQEEYTKE

SEQ ID NO: 361042 - protein, 9 aa, Homo Sapiens
DENGHDLAE

SEQ ID NO: 361043 - protein, 9 aa, Homo Sapiens
HLLKEHLCL

SEQ ID NO: 361044 - protein, 9 aa, Homo Sapiens
PKPRMNVMN

SEQ ID NO: 361045 - protein, 9 aa, Homo Sapiens
GRSTECSIH

SEQ ID NO: 361046 - protein, 9 aa, Homo Sapiens
QNKFEQGKK

SEQ ID NO: 361047 - protein, 9 aa, Homo Sapiens
VAQNSFATR

SEQ ID NO: 361048 - protein, 9 aa, Homo Sapiens
DHYEIMMYH

SEQ ID NO: 361049 - protein, 9 aa, Homo Sapiens
NVGRHFAVS

SEQ ID NO: 361050 - protein, 9 aa, Homo Sapiens
LWVWQVEGN

SEQ ID NO: 361051 - protein, 9 aa, Homo Sapiens
YEIMMYHRN

SEQ ID NO: 361052 - protein, 9 aa, Homo Sapiens
EIILDLQRI

SEQ ID NO: 361053 - protein, 9 aa, Homo Sapiens
KEASYFIFS

SEQ ID NO: 361054 - protein, 9 aa, Homo Sapiens
LQRIKMKYL

SEQ ID NO: 361055 - protein, 9 aa, Homo Sapiens
AMYSGPVYA

SEQ ID NO: 361056 - protein, 9 aa, Homo Sapiens
FYIRELILE

SEQ ID NO: 361057 - protein, 9 aa, Homo Sapiens
SGPVYALHD

SEQ ID NO: 361058 - protein, 9 aa, Homo Sapiens
SRDSRRNRS

SEQ ID NO: 361059 - protein, 9 aa, Homo Sapiens
ASYFIFSSI

SEQ ID NO: 361060 - protein, 9 aa, Homo Sapiens
KMTPGVSQG

SEQ ID NO: 361061 - protein, 9 aa, Homo Sapiens
TPQCRQLIL

SEQ ID NO: 361062 - protein, 9 aa, Homo Sapiens
MPHLQTLQA

SEQ ID NO: 361063 - protein, 9 aa, Homo Sapiens
NVAGVSITS

SEQ ID NO: 361064 - protein, 9 aa, Homo Sapiens
DKSAMSGAI

SEQ ID NO: 361065 - protein, 9 aa, Homo Sapiens
NQIKNHIEK

SEQ ID NO: 361066 - protein, 9 aa, Homo Sapiens
DDLERIEAQ

SEQ ID NO: 361067 - protein, 9 aa, Homo Sapiens
STPQCRQLI

SEQ ID NO: 361068 - protein, 9 aa, Homo Sapiens
RNINKEHEL

SEQ ID NO: 361069 - protein, 9 aa, Homo Sapiens
QVEGNGQSF

SEQ ID NO: 361070 - protein, 9 aa, Homo Sapiens
NGQSFSINF

SEQ ID NO: 361071 - protein, 9 aa, Homo Sapiens
LGEAAEGAA

SEQ ID NO: 361072 - protein, 9 aa, Homo Sapiens
GSAPLPRKK

SEQ ID NO: 361073 - protein, 9 aa, Homo Sapiens
TNPSAGAQT

SEQ ID NO: 361074 - protein, 9 aa, Homo Sapiens
MNVVKFSLG

SEQ ID NO: 361075 - protein, 9 aa, Homo Sapiens
LLDIRASIQ

SEQ ID NO: 361076 - protein, 9 aa, Homo Sapiens
LSGRMKVKE

SEQ ID NO: 361077 - protein, 9 aa, Homo Sapiens
QNSFATRLH

SEQ ID NO: 361078 - protein, 9 aa, Homo Sapiens
VRHCPHHER

SEQ ID NO: 361079 - protein, 9 aa, Homo Sapiens
AQLATLEGD

SEQ ID NO: 361080 - protein, 9 aa, Homo Sapiens
VVRHCPHHE

SEQ ID NO: 361081 - protein, 9 aa, Homo Sapiens
TPGVSQGEW

SEQ ID NO: 361082 - protein, 9 aa, Homo Sapiens
RAVEKKFRA

SEQ ID NO: 361083 - protein, 9 aa, Homo Sapiens
LERNLMNAL

SEQ ID NO: 361084 - protein, 9 aa, Homo Sapiens
KKVKVNCDS

SEQ ID NO: 361085 - protein, 9 aa, Homo Sapiens
LQESGLALI

SEQ ID NO: 361086 - protein, 9 aa, Homo Sapiens
LETEIQIDQ

SEQ ID NO: 361087 - protein, 9 aa, Homo Sapiens
MYVRYATNP

SEQ ID NO: 361088 - protein, 9 aa, Homo Sapiens
YSGPVYALH

SEQ ID NO: 361089 - protein, 9 aa, Homo Sapiens
DQALHALPS

SEQ ID NO: 361090 - protein, 9 aa, Homo Sapiens
VGNVVKHLA

SEQ ID NO: 361091 - protein, 9 aa, Homo Sapiens
HILFFVVFL

SEQ ID NO: 361092 - protein, 9 aa, Homo Sapiens
NSTINSDGS

SEQ ID NO: 361093 - protein, 9 aa, Homo Sapiens
LNQIKNHIE

SEQ ID NO: 361094 - protein, 9 aa, Homo Sapiens
CRLRTAFSW

SEQ ID NO: 361095 - protein, 9 aa, Homo Sapiens
KKEASYFIF

SEQ ID NO: 361096 - protein, 9 aa, Homo Sapiens
PQCRQLILT

SEQ ID NO: 361097 - protein, 9 aa, Homo Sapiens
VMNVVKFSL

SEQ ID NO: 361098 - protein, 9 aa, Homo Sapiens
LERIEAQLA

SEQ ID NO: 361099 - protein, 9 aa, Homo Sapiens
IILDLQRIK

SEQ ID NO: 361100 - protein, 9 aa, Homo Sapiens
VDEQQTFLN

SEQ ID NO: 361101 - protein, 9 aa, Homo Sapiens
MSQSIMVQR

SEQ ID NO: 361102 - protein, 9 aa, Homo Sapiens
LHILFFVVF

SEQ ID NO: 361103 - protein, 9 aa, Homo Sapiens
GRIVWGHAA

SEQ ID NO: 361104 - protein, 9 aa, Homo Sapiens
GSVGTQGRT

SEQ ID NO: 361105 - protein, 9 aa, Homo Sapiens
HPLFNIRRV

SEQ ID NO: 361106 - protein, 9 aa, Homo Sapiens
DSNMPHLQT

SEQ ID NO: 361107 - protein, 9 aa, Homo Sapiens
RSTECSIHL

SEQ ID NO: 361108 - protein, 9 aa, Homo Sapiens
HLRTSMKPA

SEQ ID NO: 361109 - protein, 9 aa, Homo Sapiens
RVVLWATRS

SEQ ID NO: 361110 - protein, 9 aa, Homo Sapiens
NLRLANSTI

SEQ ID NO: 361111 - protein, 9 aa, Homo Sapiens
TDKSAMSGA

SEQ ID NO: 361112 - protein, 9 aa, Homo Sapiens
QLNQIKNHI

SEQ ID NO: 361113 - protein, 9 aa, Homo Sapiens
DFLLYISET

SEQ ID NO: 361114 - protein, 9 aa, Homo Sapiens
LILTCPACQ

SEQ ID NO: 361115 - protein, 9 aa, Homo Sapiens
IEAQLATLE

SEQ ID NO: 361116 - protein, 9 aa, Homo Sapiens
TSRAVEKKF

SEQ ID NO: 361117 - protein, 9 aa, Homo Sapiens
SAMSGAIRL

SEQ ID NO: 361118 - protein, 9 aa, Homo Sapiens
GNKMTPGVS

SEQ ID NO: 361119 - protein, 9 aa, Homo Sapiens
VLWATRSSM

SEQ ID NO: 361120 - protein, 9 aa, Homo Sapiens
CKTDSFSLK

SEQ ID NO: 361121 - protein, 9 aa, Homo Sapiens
KVNCDSFLC

SEQ ID NO: 361122 - protein, 9 aa, Homo Sapiens
VSHTLLDIR

SEQ ID NO: 361123 - protein, 9 aa, Homo Sapiens
NSFATRLHI

SEQ ID NO: 361124 - protein, 9 aa, Homo Sapiens
GRPDLGLGA

SEQ ID NO: 361125 - protein, 9 aa, Homo Sapiens
KDSNMPHLQ

SEQ ID NO: 361126 - protein, 9 aa, Homo Sapiens
VKVNCDSFL

SEQ ID NO: 361127 - protein, 9 aa, Homo Sapiens
WVWQVEGNG

SEQ ID NO: 361128 - protein, 9 aa, Homo Sapiens
PAHMMLSGR

SEQ ID NO: 361129 - protein, 9 aa, Homo Sapiens
RNLMNALNV

SEQ ID NO: 361130 - protein, 9 aa, Homo Sapiens
FMLEKSSMN

SEQ ID NO: 361131 - protein, 9 aa, Homo Sapiens
VTLERNPMR

SEQ ID NO: 361132 - protein, 9 aa, Homo Sapiens
EQEEYTKEG

SEQ ID NO: 361133 - protein, 9 aa, Homo Sapiens
RKLTFDSLA

SEQ ID NO: 361134 - protein, 9 aa, Homo Sapiens
VEFWSECPG

SEQ ID NO: 361135 - protein, 9 aa, Homo Sapiens
VAGVSITSL

SEQ ID NO: 361136 - protein, 9 aa, Homo Sapiens
QYEFKEVAG

SEQ ID NO: 361137 - protein, 9 aa, Homo Sapiens
DMTFSEDKM

SEQ ID NO: 361138 - protein, 9 aa, Homo Sapiens
SIQPKPRMN

SEQ ID NO: 361139 - protein, 9 aa, Homo Sapiens
VIITSVLLR

SEQ ID NO: 361140 - protein, 9 aa, Homo Sapiens
KLVEFWSEC

SEQ ID NO: 361141 - protein, 9 aa, Homo Sapiens
TLLNIRGHT

SEQ ID NO: 361142 - protein, 9 aa, Homo Sapiens
ELLQESGLA

SEQ ID NO: 361143 - protein, 9 aa, Homo Sapiens
IREFMLEKS

SEQ ID NO: 361144 - protein, 9 aa, Homo Sapiens
ERNPMRVLN

SEQ ID NO: 361145 - protein, 9 aa, Homo Sapiens
EKKFRALCQ

SEQ ID NO: 361146 - protein, 9 aa, Homo Sapiens
YIRELILER

SEQ ID NO: 361147 - protein, 9 aa, Homo Sapiens
VDGPGEPRR

SEQ ID NO: 361148 - protein, 9 aa, Homo Sapiens
PGEPRRHRQ

SEQ ID NO: 361149 - protein, 9 aa, Homo Sapiens
QELLQESGL

SEQ ID NO: 361150 - protein, 9 aa, Homo Sapiens
IQTYTSTIQ

SEQ ID NO: 361151 - protein, 9 aa, Homo Sapiens
GAGSTFQIN

SEQ ID NO: 361152 - protein, 9 aa, Homo Sapiens
MNVMNVVKF

SEQ ID NO: 361153 - protein, 9 aa, Homo Sapiens
RYATNPSAG

SEQ ID NO: 361154 - protein, 9 aa, Homo Sapiens
NMPHLQTLQ

SEQ ID NO: 361155 - protein, 9 aa, Homo Sapiens
IDSRKINNS

SEQ ID NO: 361156 - protein, 9 aa, Homo Sapiens
WPFCPPGHP

SEQ ID NO: 361157 - protein, 9 aa, Homo Sapiens
FPTAWLNVL

SEQ ID NO: 361158 - protein, 9 aa, Homo Sapiens
AFVDYPEQN

SEQ ID NO: 361159 - protein, 9 aa, Homo Sapiens
FECGKVFRR

SEQ ID NO: 361160 - protein, 9 aa, Homo Sapiens
SPSFWGFVS

SEQ ID NO: 361161 - protein, 9 aa, Homo Sapiens
ILQHTWFFF

SEQ ID NO: 361162 - protein, 9 aa, Homo Sapiens
PMYLFLCLI

SEQ ID NO: 361163 - protein, 9 aa, Homo Sapiens
SNESFISAN

SEQ ID NO: 361164 - protein, 9 aa, Homo Sapiens
LQEVFQAER

SEQ ID NO: 361165 - protein, 9 aa, Homo Sapiens
HGLEIFQHC

SEQ ID NO: 361166 - protein, 9 aa, Homo Sapiens
HVCACPGRD

SEQ ID NO: 361167 - protein, 9 aa, Homo Sapiens
PTAWLNVLP

SEQ ID NO: 361168 - protein, 9 aa, Homo Sapiens
AYVGSYLVV

SEQ ID NO: 361169 - protein, 9 aa, Homo Sapiens
YQCFECGKV

SEQ ID NO: 361170 - protein, 9 aa, Homo Sapiens
KTPEGLATS

SEQ ID NO: 361171 - protein, 9 aa, Homo Sapiens
PERGGKTPE

SEQ ID NO: 361172 - protein, 9 aa, Homo Sapiens
EEDLCTKLL

SEQ ID NO: 361173 - protein, 9 aa, Homo Sapiens
LTLCCALVV

SEQ ID NO: 361174 - protein, 9 aa, Homo Sapiens
NCTDADYLG

SEQ ID NO: 361175 - protein, 9 aa, Homo Sapiens
LLGASLGGI

SEQ ID NO: 361176 - protein, 9 aa, Homo Sapiens
CLPSCNNRH

SEQ ID NO: 361177 - protein, 9 aa, Homo Sapiens
NETPKKKKE

SEQ ID NO: 361178 - protein, 9 aa, Homo Sapiens
VGACGVGKS

SEQ ID NO: 361179 - protein, 9 aa, Homo Sapiens
PFMLFNVFN

SEQ ID NO: 361180 - protein, 9 aa, Homo Sapiens
PSFWGFVST

SEQ ID NO: 361181 - protein, 9 aa, Homo Sapiens
QSSLVSSSP

SEQ ID NO: 361182 - protein, 9 aa, Homo Sapiens
TMPNKPVVP

SEQ ID NO: 361183 - protein, 9 aa, Homo Sapiens
YLFLCLISL

SEQ ID NO: 361184 - protein, 9 aa, Homo Sapiens
RPPRTLWPL

SEQ ID NO: 361185 - protein, 9 aa, Homo Sapiens
LEEDLCTKL

SEQ ID NO: 361186 - protein, 9 aa, Homo Sapiens
AILQHTWFF

SEQ ID NO: 361187 - protein, 9 aa, Homo Sapiens
QIAEIKDWN

SEQ ID NO: 361188 - protein, 9 aa, Homo Sapiens
LFVILLLIY

SEQ ID NO: 361189 - protein, 9 aa, Homo Sapiens
KKGPERGGK

SEQ ID NO: 361190 - protein, 9 aa, Homo Sapiens
IGTTFEGCA

SEQ ID NO: 361191 - protein, 9 aa, Homo Sapiens
CLAKAWVEQ

SEQ ID NO: 361192 - protein, 9 aa, Homo Sapiens
YFFLSHVAF

SEQ ID NO: 361193 - protein, 9 aa, Homo Sapiens
FQAERLLLQ

SEQ ID NO: 361194 - protein, 9 aa, Homo Sapiens
HTWFFFQLM

SEQ ID NO: 361195 - protein, 9 aa, Homo Sapiens
EEDIDSRKI

SEQ ID NO: 361196 - protein, 9 aa, Homo Sapiens
KKIHSGEKV

SEQ ID NO: 361197 - protein, 9 aa, Homo Sapiens
NSFEVHVCA

SEQ ID NO: 361198 - protein, 9 aa, Homo Sapiens
FISANCTDA

SEQ ID NO: 361199 - protein, 9 aa, Homo Sapiens
PMYFFLSHV

SEQ ID NO: 361200 - protein, 9 aa, Homo Sapiens
RHLEEDLCT

SEQ ID NO: 361201 - protein, 9 aa, Homo Sapiens
ETKEICDWQ

SEQ ID NO: 361202 - protein, 9 aa, Homo Sapiens
KSPTSPTMP

SEQ ID NO: 361203 - protein, 9 aa, Homo Sapiens
HAPFLAAFC

SEQ ID NO: 361204 - protein, 9 aa, Homo Sapiens
TLIMMYKTY

SEQ ID NO: 361205 - protein, 9 aa, Homo Sapiens
TYCQCILDN

SEQ ID NO: 361206 - protein, 9 aa, Homo Sapiens
VILHVPRSP

SEQ ID NO: 361207 - protein, 9 aa, Homo Sapiens
EPPRPAPPW

SEQ ID NO: 361208 - protein, 9 aa, Homo Sapiens
SMFVAFIIL

SEQ ID NO: 361209 - protein, 9 aa, Homo Sapiens
HCDCAKGLS

SEQ ID NO: 361210 - protein, 9 aa, Homo Sapiens
MHKYQPRMH

SEQ ID NO: 361211 - protein, 9 aa, Homo Sapiens
YKTYCQCIL

SEQ ID NO: 361212 - protein, 9 aa, Homo Sapiens
LAPGMEVTY

SEQ ID NO: 361213 - protein, 9 aa, Homo Sapiens
PLLGASLGG

SEQ ID NO: 361214 - protein, 9 aa, Homo Sapiens
TTFEGCAIY

SEQ ID NO: 361215 - protein, 9 aa, Homo Sapiens
SSSGGSSGN

SEQ ID NO: 361216 - protein, 9 aa, Homo Sapiens
RDQTLEPLE

SEQ ID NO: 361217 - protein, 9 aa, Homo Sapiens
INDPRYTAL

SEQ ID NO: 361218 - protein, 9 aa, Homo Sapiens
ALFLQEVFQ

SEQ ID NO: 361219 - protein, 9 aa, Homo Sapiens
LFPTAWLNV

SEQ ID NO: 361220 - protein, 9 aa, Homo Sapiens
GVLVSYPSA

SEQ ID NO: 361221 - protein, 9 aa, Homo Sapiens
FLAAFCADG

SEQ ID NO: 361222 - protein, 9 aa, Homo Sapiens
LVSYPSAGG

SEQ ID NO: 361223 - protein, 9 aa, Homo Sapiens
KLVVVGACG

SEQ ID NO: 361224 - protein, 9 aa, Homo Sapiens
YQPRMHVIR

SEQ ID NO: 361225 - protein, 9 aa, Homo Sapiens
SCGGGWPFC

SEQ ID NO: 361226 - protein, 9 aa, Homo Sapiens
VDYPEQNWA

SEQ ID NO: 361227 - protein, 9 aa, Homo Sapiens
PAPPWFLVV

SEQ ID NO: 361228 - protein, 9 aa, Homo Sapiens
REAILQHTW

SEQ ID NO: 361229 - protein, 9 aa, Homo Sapiens
FVILLLIYC

SEQ ID NO: 361230 - protein, 9 aa, Homo Sapiens
TFEGCAIYL

SEQ ID NO: 361231 - protein, 9 aa, Homo Sapiens
HKYQPRMHV

SEQ ID NO: 361232 - protein, 9 aa, Homo Sapiens
FQHCDCAKG

SEQ ID NO: 361233 - protein, 9 aa, Homo Sapiens
LAKAWVEQL

SEQ ID NO: 361234 - protein, 9 aa, Homo Sapiens
PPRTLWPLS

SEQ ID NO: 361235 - protein, 9 aa, Homo Sapiens
PRMSCGGGW

SEQ ID NO: 361236 - protein, 9 aa, Homo Sapiens
VFQAERLLL

SEQ ID NO: 361237 - protein, 9 aa, Homo Sapiens
EKEHQYEKK

SEQ ID NO: 361238 - protein, 9 aa, Homo Sapiens
LCLYYHVPV

SEQ ID NO: 361239 - protein, 9 aa, Homo Sapiens
LISLTDLAL

SEQ ID NO: 361240 - protein, 9 aa, Homo Sapiens
TILFPTAWL

SEQ ID NO: 361241 - protein, 9 aa, Homo Sapiens
EVHVCACPG

SEQ ID NO: 361242 - protein, 9 aa, Homo Sapiens
TTGEYKSKF

SEQ ID NO: 361243 - protein, 9 aa, Homo Sapiens
ETPQSSGQS

SEQ ID NO: 361244 - protein, 9 aa, Homo Sapiens
GGKTPEGLA

SEQ ID NO: 361245 - protein, 9 aa, Homo Sapiens
WLNVLPLLT

SEQ ID NO: 361246 - protein, 9 aa, Homo Sapiens
VGSMFVAFI

SEQ ID NO: 361247 - protein, 9 aa, Homo Sapiens
KHRFYRPPY

SEQ ID NO: 361248 - protein, 9 aa, Homo Sapiens
SFWGFVSTL

SEQ ID NO: 361249 - protein, 9 aa, Homo Sapiens
EYKSKFNGN

SEQ ID NO: 361250 - protein, 9 aa, Homo Sapiens
AEGITKMSD

SEQ ID NO: 361251 - protein, 9 aa, Homo Sapiens
YRPPYTWTK

SEQ ID NO: 361252 - protein, 9 aa, Homo Sapiens
WKGRLFPCG

SEQ ID NO: 361253 - protein, 9 aa, Homo Sapiens
ELFPDISQG

SEQ ID NO: 361254 - protein, 9 aa, Homo Sapiens
SIYEEMKHK

SEQ ID NO: 361255 - protein, 9 aa, Homo Sapiens
LCTKLLSLK

SEQ ID NO: 361256 - protein, 9 aa, Homo Sapiens
APLLGASLG

SEQ ID NO: 361257 - protein, 9 aa, Homo Sapiens
KGPERGGKT

SEQ ID NO: 361258 - protein, 9 aa, Homo Sapiens
KSWGLTLCC

SEQ ID NO: 361259 - protein, 9 aa, Homo Sapiens
ASLGGIIYL

SEQ ID NO: 361260 - protein, 9 aa, Homo Sapiens
IVGSMFVAF

SEQ ID NO: 361261 - protein, 9 aa, Homo Sapiens
ISANCTDAD

SEQ ID NO: 361262 - protein, 9 aa, Homo Sapiens
IFQHCDCAK

SEQ ID NO: 361263 - protein, 9 aa, Homo Sapiens
QCFECGKVF

SEQ ID NO: 361264 - protein, 9 aa, Homo Sapiens
SDQGDPFML

SEQ ID NO: 361265 - protein, 9 aa, Homo Sapiens
CGKVFRRKL

SEQ ID NO: 361266 - protein, 9 aa, Homo Sapiens
ERLLLQEEQ

SEQ ID NO: 361267 - protein, 9 aa, Homo Sapiens
AVELHKLKL

SEQ ID NO: 361268 - protein, 9 aa, Homo Sapiens
YASPGLLPV

SEQ ID NO: 361269 - protein, 9 aa, Homo Sapiens
TPSPSFWGF

SEQ ID NO: 361270 - protein, 9 aa, Homo Sapiens
SPTMPNKPV

SEQ ID NO: 361271 - protein, 9 aa, Homo Sapiens
QPAYVGSYL

SEQ ID NO: 361272 - protein, 9 aa, Homo Sapiens
VHQCEECGK

SEQ ID NO: 361273 - protein, 9 aa, Homo Sapiens
KGRDQTLEP

SEQ ID NO: 361274 - protein, 9 aa, Homo Sapiens
RTLWPLSHA

SEQ ID NO: 361275 - protein, 9 aa, Homo Sapiens
KEEKASDSN

SEQ ID NO: 361276 - protein, 9 aa, Homo Sapiens
AGGATRPSA

SEQ ID NO: 361277 - protein, 9 aa, Homo Sapiens
HKYGTQGCY

SEQ ID NO: 361278 - protein, 9 aa, Homo Sapiens
QALLFVILL

SEQ ID NO: 361279 - protein, 9 aa, Homo Sapiens
VILLLIYCL

SEQ ID NO: 361280 - protein, 9 aa, Homo Sapiens
VGSYLVVTA

SEQ ID NO: 361281 - protein, 9 aa, Homo Sapiens
LNVLPLLTA

SEQ ID NO: 361282 - protein, 9 aa, Homo Sapiens
EDLCTKLLS

SEQ ID NO: 361283 - protein, 9 aa, Homo Sapiens
EEKASDSNP

SEQ ID NO: 361284 - protein, 9 aa, Homo Sapiens
PRPAPPWFL

SEQ ID NO: 361285 - protein, 9 aa, Homo Sapiens
SWKGRLFPC

SEQ ID NO: 361286 - protein, 9 aa, Homo Sapiens
AAFCADGRW

SEQ ID NO: 361287 - protein, 9 aa, Homo Sapiens
GLLPVPPPQ

SEQ ID NO: 361288 - protein, 9 aa, Homo Sapiens
HQYEKKQAE

SEQ ID NO: 361289 - protein, 9 aa, Homo Sapiens
KKEALFLQE

SEQ ID NO: 361290 - protein, 9 aa, Homo Sapiens
APGMEVTYR

SEQ ID NO: 361291 - protein, 9 aa, Homo Sapiens
VAPLLGASL

SEQ ID NO: 361292 - protein, 9 aa, Homo Sapiens
ESDQGDPFM

SEQ ID NO: 361293 - protein, 9 aa, Homo Sapiens
FPDISQGCE

SEQ ID NO: 361294 - protein, 9 aa, Homo Sapiens
RFYRPPYTW

SEQ ID NO: 361295 - protein, 9 aa, Homo Sapiens
RYTALAKLS

SEQ ID NO: 361296 - protein, 9 aa, Homo Sapiens
WVEQLRREA

SEQ ID NO: 361297 - protein, 9 aa, Homo Sapiens
KIHSGEKVH

SEQ ID NO: 361298 - protein, 9 aa, Homo Sapiens
FLCLISLTD

SEQ ID NO: 361299 - protein, 9 aa, Homo Sapiens
LAEGITKMS

SEQ ID NO: 361300 - protein, 9 aa, Homo Sapiens
AWLNVLPLL

SEQ ID NO: 361301 - protein, 9 aa, Homo Sapiens
CTKLLSLKL

SEQ ID NO: 361302 - protein, 9 aa, Homo Sapiens
RLFPCGACG

SEQ ID NO: 361303 - protein, 9 aa, Homo Sapiens
NESFISANC

SEQ ID NO: 361304 - protein, 9 aa, Homo Sapiens
TRTPSPSFW

SEQ ID NO: 361305 - protein, 9 aa, Homo Sapiens
QRTHADSLG

SEQ ID NO: 361306 - protein, 9 aa, Homo Sapiens
APFLAAFCA

SEQ ID NO: 361307 - protein, 9 aa, Homo Sapiens
SSGQSSLVS

SEQ ID NO: 361308 - protein, 9 aa, Homo Sapiens
PWFLVVAAI

SEQ ID NO: 361309 - protein, 9 aa, Homo Sapiens
VREAILQHT

SEQ ID NO: 361310 - protein, 9 aa, Homo Sapiens
PSPSFWGFV

SEQ ID NO: 361311 - protein, 9 aa, Homo Sapiens
RFVKRHCKH

SEQ ID NO: 361312 - protein, 9 aa, Homo Sapiens
QGDPFMLFN

SEQ ID NO: 361313 - protein, 9 aa, Homo Sapiens
LLFVILLLI

SEQ ID NO: 361314 - protein, 9 aa, Homo Sapiens
LCCALVVFT

SEQ ID NO: 361315 - protein, 9 aa, Homo Sapiens
TSPTMPNKP

SEQ ID NO: 361316 - protein, 9 aa, Homo Sapiens
QHCDCAKGL

SEQ ID NO: 361317 - protein, 9 aa, Homo Sapiens
VVVGACGVG

SEQ ID NO: 361318 - protein, 9 aa, Homo Sapiens
NNSLTYGII

SEQ ID NO: 361319 - protein, 9 aa, Homo Sapiens
YVGSYLVVT

SEQ ID NO: 361320 - protein, 9 aa, Homo Sapiens
FEVHVCACP

SEQ ID NO: 361321 - protein, 9 aa, Homo Sapiens
KEICDWQCD

SEQ ID NO: 361322 - protein, 9 aa, Homo Sapiens
LSMEEDIDS

SEQ ID NO: 361323 - protein, 9 aa, Homo Sapiens
EIFQHCDCA

SEQ ID NO: 361324 - protein, 9 aa, Homo Sapiens
RLLLQEEQE

SEQ ID NO: 361325 - protein, 9 aa, Homo Sapiens
WGLTLCCAL

SEQ ID NO: 361326 - protein, 9 aa, Homo Sapiens
LVPNNSLTY

SEQ ID NO: 361327 - protein, 9 aa, Homo Sapiens
CCALVVFTL

SEQ ID NO: 361328 - protein, 9 aa, Homo Sapiens
ISLTDLALS

SEQ ID NO: 361329 - protein, 9 aa, Homo Sapiens
DSLGRLCPA

SEQ ID NO: 361330 - protein, 9 aa, Homo Sapiens
GASLGGIIY

SEQ ID NO: 361331 - protein, 9 aa, Homo Sapiens
VVGACGVGK

SEQ ID NO: 361332 - protein, 9 aa, Homo Sapiens
LCLISLTDL

SEQ ID NO: 361333 - protein, 9 aa, Homo Sapiens
WMKDVQEVQ

SEQ ID NO: 361334 - protein, 9 aa, Homo Sapiens
LWPLSHAKS

SEQ ID NO: 361335 - protein, 9 aa, Homo Sapiens
GGWPFCPPG

SEQ ID NO: 361336 - protein, 9 aa, Homo Sapiens
HRFYRPPYT

SEQ ID NO: 361337 - protein, 9 aa, Homo Sapiens
SLAEGITKM

SEQ ID NO: 361338 - protein, 9 aa, Homo Sapiens
GCAIYLLKV

SEQ ID NO: 361339 - protein, 9 aa, Homo Sapiens
SPTSPTMPN

SEQ ID NO: 361340 - protein, 9 aa, Homo Sapiens
PRSPKATQG

SEQ ID NO: 361341 - protein, 9 aa, Homo Sapiens
YYHVPVSSD

SEQ ID NO: 361342 - protein, 9 aa, Homo Sapiens
RPPYTWTKK

SEQ ID NO: 361343 - protein, 9 aa, Homo Sapiens
TLCCALVVF

SEQ ID NO: 361344 - protein, 9 aa, Homo Sapiens
MMYKTYCQC

SEQ ID NO: 361345 - protein, 9 aa, Homo Sapiens
DISQGCEAF

SEQ ID NO: 361346 - protein, 9 aa, Homo Sapiens
EAILQHTWF

SEQ ID NO: 361347 - protein, 9 aa, Homo Sapiens
HLEEDLCTK

SEQ ID NO: 361348 - protein, 9 aa, Homo Sapiens
LLQEEQEGG

SEQ ID NO: 361349 - protein, 9 aa, Homo Sapiens
RETVFTHAV

SEQ ID NO: 361350 - protein, 9 aa, Homo Sapiens
ICDWQCDLS

SEQ ID NO: 361351 - protein, 9 aa, Homo Sapiens
MEVTYRLQL

SEQ ID NO: 361352 - protein, 9 aa, Homo Sapiens
RMHVIRKDC

SEQ ID NO: 361353 - protein, 9 aa, Homo Sapiens
KDVQEVQPS

SEQ ID NO: 361354 - protein, 9 aa, Homo Sapiens
LGRLCPAPT

SEQ ID NO: 361355 - protein, 9 aa, Homo Sapiens
LEIFQHCDC

SEQ ID NO: 361356 - protein, 9 aa, Homo Sapiens
MYFFLSHVA

SEQ ID NO: 361357 - protein, 9 aa, Homo Sapiens
SYPSAGGAT

SEQ ID NO: 361358 - protein, 9 aa, Homo Sapiens
YHVPVSSDK

SEQ ID NO: 361359 - protein, 9 aa, Homo Sapiens
PGMEVTYRL

SEQ ID NO: 361360 - protein, 9 aa, Homo Sapiens
FLSHVAFAD

SEQ ID NO: 361361 - protein, 9 aa, Homo Sapiens
KKKKEALFL

SEQ ID NO: 361362 - protein, 9 aa, Homo Sapiens
YVILHVPRS

SEQ ID NO: 361363 - protein, 9 aa, Homo Sapiens
KHCVIEHTN

SEQ ID NO: 361364 - protein, 9 aa, Homo Sapiens
ATEAVELHK

SEQ ID NO: 361365 - protein, 9 aa, Homo Sapiens
LLLQEEQEG

SEQ ID NO: 361366 - protein, 9 aa, Homo Sapiens
ESFISANCT

SEQ ID NO: 361367 - protein, 9 aa, Homo Sapiens
CGVGKSALT

SEQ ID NO: 361368 - protein, 9 aa, Homo Sapiens
RAYASPGLL

SEQ ID NO: 361369 - protein, 9 aa, Homo Sapiens
GRNSFEVHV

SEQ ID NO: 361370 - protein, 9 aa, Homo Sapiens
ESIYEEMKH

SEQ ID NO: 361371 - protein, 9 aa, Homo Sapiens
FLQEVFQAE

SEQ ID NO: 361372 - protein, 9 aa, Homo Sapiens
SPGLLPVPP

SEQ ID NO: 361373 - protein, 9 aa, Homo Sapiens
MIINDPRYT

SEQ ID NO: 361374 - protein, 9 aa, Homo Sapiens
AERLLLQEE

SEQ ID NO: 361375 - protein, 9 aa, Homo Sapiens
MPNKPVVPL

SEQ ID NO: 361376 - protein, 9 aa, Homo Sapiens
GYAFVDYPE

SEQ ID NO: 361377 - protein, 9 aa, Homo Sapiens
CLYYHVPVS

SEQ ID NO: 361378 - protein, 9 aa, Homo Sapiens
LAAFCADGR

SEQ ID NO: 361379 - protein, 9 aa, Homo Sapiens
LFPCGACGR

SEQ ID NO: 361380 - protein, 9 aa, Homo Sapiens
PFLAAFCAD

SEQ ID NO: 361381 - protein, 9 aa, Homo Sapiens
FVDYPEQNW

SEQ ID NO: 361382 - protein, 9 aa, Homo Sapiens
RPAPPWFLV

SEQ ID NO: 361383 - protein, 9 aa, Homo Sapiens
SGEKVHQCE

SEQ ID NO: 361384 - protein, 9 aa, Homo Sapiens
PGRPPRTLW

SEQ ID NO: 361385 - protein, 9 aa, Homo Sapiens
EGCAIYLLK

SEQ ID NO: 361386 - protein, 9 aa, Homo Sapiens
GLAPGMEVT

SEQ ID NO: 361387 - protein, 9 aa, Homo Sapiens
TGEYKSKFN

SEQ ID NO: 361388 - protein, 9 aa, Homo Sapiens
MYKTYCQCI

SEQ ID NO: 361389 - protein, 9 aa, Homo Sapiens
PSAGGATRP

SEQ ID NO: 361390 - protein, 9 aa, Homo Sapiens
QAERLLLQE

SEQ ID NO: 361391 - protein, 9 aa, Homo Sapiens
PNNSLTYGI

SEQ ID NO: 361392 - protein, 9 aa, Homo Sapiens
DLCTKLLSL

SEQ ID NO: 361393 - protein, 9 aa, Homo Sapiens
EGVWMKDVQ

SEQ ID NO: 361394 - protein, 9 aa, Homo Sapiens
CGGGWPFCP

SEQ ID NO: 361395 - protein, 9 aa, Homo Sapiens
QIGSRETVF

SEQ ID NO: 361396 - protein, 9 aa, Homo Sapiens
TEAVELHKL

SEQ ID NO: 361397 - protein, 9 aa, Homo Sapiens
MHVIRKDCG

SEQ ID NO: 361398 - protein, 9 aa, Homo Sapiens
RELFPDISQ

SEQ ID NO: 361399 - protein, 9 aa, Homo Sapiens
ETVFTHAVS

SEQ ID NO: 361400 - protein, 9 aa, Homo Sapiens
ANCTDADYL

SEQ ID NO: 361401 - protein, 9 aa, Homo Sapiens
VVKEEKASD

SEQ ID NO: 361402 - protein, 9 aa, Homo Sapiens
HADSLGRLC

SEQ ID NO: 361403 - protein, 9 aa, Homo Sapiens
RLQPAYVGS

SEQ ID NO: 361404 - protein, 9 aa, Homo Sapiens
PYTWTKKSE

SEQ ID NO: 361405 - protein, 9 aa, Homo Sapiens
KKSETKEIC

SEQ ID NO: 361406 - protein, 9 aa, Homo Sapiens
CADGRWHHV

SEQ ID NO: 361407 - protein, 9 aa, Homo Sapiens
IRHLEEDLC

SEQ ID NO: 361408 - protein, 9 aa, Homo Sapiens
ECGKVFRRK

SEQ ID NO: 361409 - protein, 9 aa, Homo Sapiens
PPWFLVVAA

SEQ ID NO: 361410 - protein, 9 aa, Homo Sapiens
LNHLKEKEH

SEQ ID NO: 361411 - protein, 9 aa, Homo Sapiens
AYASPGLLP

SEQ ID NO: 361412 - protein, 9 aa, Homo Sapiens
FYRPPYTWT

SEQ ID NO: 361413 - protein, 9 aa, Homo Sapiens
EEMKHKYGT

SEQ ID NO: 361414 - protein, 9 aa, Homo Sapiens
LHVPRSPKA

SEQ ID NO: 361415 - protein, 9 aa, Homo Sapiens
GRPPRTLWP

SEQ ID NO: 361416 - protein, 9 aa, Homo Sapiens
NDPRYTALA

SEQ ID NO: 361417 - protein, 9 aa, Homo Sapiens
VFTHAVSAA

SEQ ID NO: 361418 - protein, 9 aa, Homo Sapiens
CLISLTDLA

SEQ ID NO: 361419 - protein, 9 aa, Homo Sapiens
DPFMLFNVF

SEQ ID NO: 361420 - protein, 9 aa, Homo Sapiens
DVQEVQPSD

SEQ ID NO: 361421 - protein, 9 aa, Homo Sapiens
GRLFPCGAC

SEQ ID NO: 361422 - protein, 9 aa, Homo Sapiens
GMEVTYRLQ

SEQ ID NO: 361423 - protein, 9 aa, Homo Sapiens
SQGCEAFLR

SEQ ID NO: 361424 - protein, 9 aa, Homo Sapiens
NSLTYGIIL

SEQ ID NO: 361425 - protein, 9 aa, Homo Sapiens
GPERGGKTP

SEQ ID NO: 361426 - protein, 9 aa, Homo Sapiens
PAYVGSYLV

SEQ ID NO: 361427 - protein, 9 aa, Homo Sapiens
GITKMSDNM

SEQ ID NO: 361428 - protein, 9 aa, Homo Sapiens
YPEQNWAIR

SEQ ID NO: 361429 - protein, 9 aa, Homo Sapiens
VSYPSAGGA

SEQ ID NO: 361430 - protein, 9 aa, Homo Sapiens
SWGLTLCCA

SEQ ID NO: 361431 - protein, 9 aa, Homo Sapiens
EKVHQCEEC

SEQ ID NO: 361432 - protein, 9 aa, Homo Sapiens
YTALAKLSE

SEQ ID NO: 361433 - protein, 9 aa, Homo Sapiens
MKDVQEVQP

SEQ ID NO: 361434 - protein, 9 aa, Homo Sapiens
PRYTALAKL

SEQ ID NO: 361435 - protein, 9 aa, Homo Sapiens
GCQGLAPGM

SEQ ID NO: 361436 - protein, 9 aa, Homo Sapiens
SLGRLCPAP

SEQ ID NO: 361437 - protein, 9 aa, Homo Sapiens
PTSPTMPNK

SEQ ID NO: 361438 - protein, 9 aa, Homo Sapiens
IYEEMKHKY

SEQ ID NO: 361439 - protein, 9 aa, Homo Sapiens
VWMKDVQEV

SEQ ID NO: 361440 - protein, 9 aa, Homo Sapiens
LCLAKAWVE

SEQ ID NO: 361441 - protein, 9 aa, Homo Sapiens
EKASDSNPN

SEQ ID NO: 361442 - protein, 9 aa, Homo Sapiens
GEYKSKFNG

SEQ ID NO: 361443 - protein, 9 aa, Homo Sapiens
QEVFQAERL

SEQ ID NO: 361444 - protein, 9 aa, Homo Sapiens
LFLCLISLT

SEQ ID NO: 361445 - protein, 9 aa, Homo Sapiens
RGGKTPEGL

SEQ ID NO: 361446 - protein, 9 aa, Homo Sapiens
HQRTHADSL

SEQ ID NO: 361447 - protein, 9 aa, Homo Sapiens
YPSAGGATR

SEQ ID NO: 361448 - protein, 9 aa, Homo Sapiens
EEQEGGWRR

SEQ ID NO: 361449 - protein, 9 aa, Homo Sapiens
TLEPLEAEL

SEQ ID NO: 361450 - protein, 9 aa, Homo Sapiens
YAFVDYPEQ

SEQ ID NO: 361451 - protein, 9 aa, Homo Sapiens
PTMPNKPVV

SEQ ID NO: 361452 - protein, 9 aa, Homo Sapiens
PSCNNRHFW

SEQ ID NO: 361453 - protein, 9 aa, Homo Sapiens
GVWMKDVQE

SEQ ID NO: 361454 - protein, 9 aa, Homo Sapiens
MEEDIDSRK

SEQ ID NO: 361455 - protein, 9 aa, Homo Sapiens
SFEVHVCAC

SEQ ID NO: 361456 - protein, 9 aa, Homo Sapiens
LQEEQEGGW

SEQ ID NO: 361457 - protein, 9 aa, Homo Sapiens
VPVSSDKVT

SEQ ID NO: 361458 - protein, 9 aa, Homo Sapiens
EICDWQCDL

SEQ ID NO: 361459 - protein, 9 aa, Homo Sapiens
VPFLIVGSM

SEQ ID NO: 361460 - protein, 9 aa, Homo Sapiens
ERGGKTPEG

SEQ ID NO: 361461 - protein, 9 aa, Homo Sapiens
TWFFFQLMV

SEQ ID NO: 361462 - protein, 9 aa, Homo Sapiens
CYVILHVPR

SEQ ID NO: 361463 - protein, 9 aa, Homo Sapiens
CQGLAPGME

SEQ ID NO: 361464 - protein, 9 aa, Homo Sapiens
SKFNGNRPS

SEQ ID NO: 361465 - protein, 9 aa, Homo Sapiens
MLFNVFNAW

SEQ ID NO: 361466 - protein, 9 aa, Homo Sapiens
LGRNSFEVH

SEQ ID NO: 361467 - protein, 9 aa, Homo Sapiens
KSETKEICD

SEQ ID NO: 361468 - protein, 9 aa, Homo Sapiens
FETPQSSGQ

SEQ ID NO: 361469 - protein, 9 aa, Homo Sapiens
IHSGEKVHQ

SEQ ID NO: 361470 - protein, 9 aa, Homo Sapiens
PRMHVIRKD

SEQ ID NO: 361471 - protein, 9 aa, Homo Sapiens
HSGEKVHQC

SEQ ID NO: 361472 - protein, 9 aa, Homo Sapiens
FWGFVSTLS

SEQ ID NO: 361473 - protein, 9 aa, Homo Sapiens
VEGVWMKDV

SEQ ID NO: 361474 - protein, 9 aa, Homo Sapiens
SMHKYQPRM

SEQ ID NO: 361475 - protein, 9 aa, Homo Sapiens
DPRYTALAK

SEQ ID NO: 361476 - protein, 9 aa, Homo Sapiens
FEGCAIYLL

SEQ ID NO: 361477 - protein, 9 aa, Homo Sapiens
CKHCVIEHT

SEQ ID NO: 361478 - protein, 9 aa, Homo Sapiens
KHKYGTQGC

SEQ ID NO: 361479 - protein, 9 aa, Homo Sapiens
RSPKATQGA

SEQ ID NO: 361480 - protein, 9 aa, Homo Sapiens
HVAFADMAY

SEQ ID NO: 361481 - protein, 9 aa, Homo Sapiens
KEKEHQYEK

SEQ ID NO: 361482 - protein, 9 aa, Homo Sapiens
TALAKLSEK

SEQ ID NO: 361483 - protein, 9 aa, Homo Sapiens
DSLAEGITK

SEQ ID NO: 361484 - protein, 9 aa, Homo Sapiens
VLVSYPSAG

SEQ ID NO: 361485 - protein, 9 aa, Homo Sapiens
IMMYKTYCQ

SEQ ID NO: 361486 - protein, 9 aa, Homo Sapiens
LIMMYKTYC

SEQ ID NO: 361487 - protein, 9 aa, Homo Sapiens
KGRLFPCGA

SEQ ID NO: 361488 - protein, 9 aa, Homo Sapiens
HLKEKEHQY

SEQ ID NO: 361489 - protein, 9 aa, Homo Sapiens
KAWVEQLRR

SEQ ID NO: 361490 - protein, 9 aa, Homo Sapiens
FRLQPAYVG

SEQ ID NO: 361491 - protein, 9 aa, Homo Sapiens
AWVEQLRRE

SEQ ID NO: 361492 - protein, 9 aa, Homo Sapiens
KVHQCEECG

SEQ ID NO: 361493 - protein, 9 aa, Homo Sapiens
WGFVSTLSE

SEQ ID NO: 361494 - protein, 9 aa, Homo Sapiens
IRAYASPGL

SEQ ID NO: 361495 - protein, 9 aa, Homo Sapiens
THADSLGRL

SEQ ID NO: 361496 - protein, 9 aa, Homo Sapiens
KKKEALFLQ

SEQ ID NO: 361497 - protein, 9 aa, Homo Sapiens
KRHCKHCVI

SEQ ID NO: 361498 - protein, 9 aa, Homo Sapiens
EAVELHKLK

SEQ ID NO: 361499 - protein, 9 aa, Homo Sapiens
VPNNSLTYG

SEQ ID NO: 361500 - protein, 9 aa, Homo Sapiens
GTTFEGCAI

SEQ ID NO: 361501 - protein, 9 aa, Homo Sapiens
LQIAEIKDW

SEQ ID NO: 361502 - protein, 9 aa, Homo Sapiens
EHQYEKKQA

SEQ ID NO: 361503 - protein, 9 aa, Homo Sapiens
KVFRRKLSL

SEQ ID NO: 361504 - protein, 9 aa, Homo Sapiens
GLEIFQHCD

SEQ ID NO: 361505 - protein, 9 aa, Homo Sapiens
EQEGGWRRR

SEQ ID NO: 361506 - protein, 9 aa, Homo Sapiens
MFVAFIILG

SEQ ID NO: 361507 - protein, 9 aa, Homo Sapiens
KVVKEEKAS

SEQ ID NO: 361508 - protein, 9 aa, Homo Sapiens
LLCLYYHVP

SEQ ID NO: 361509 - protein, 9 aa, Homo Sapiens
NHLKEKEHQ

SEQ ID NO: 361510 - protein, 9 aa, Homo Sapiens
KEALFLQEV

SEQ ID NO: 361511 - protein, 9 aa, Homo Sapiens
QPRMHVIRK

SEQ ID NO: 361512 - protein, 9 aa, Homo Sapiens
QHTWFFFQL

SEQ ID NO: 361513 - protein, 9 aa, Homo Sapiens
SGQSSLVSS

SEQ ID NO: 361514 - protein, 9 aa, Homo Sapiens
APPWFLVVA

SEQ ID NO: 361515 - protein, 9 aa, Homo Sapiens
IGSRETVFT

SEQ ID NO: 361516 - protein, 9 aa, Homo Sapiens
GAGAGAGAE

SEQ ID NO: 361517 - protein, 9 aa, Homo Sapiens
TKEICDWQC

SEQ ID NO: 361518 - protein, 9 aa, Homo Sapiens
GLTLCCALV

SEQ ID NO: 361519 - protein, 9 aa, Homo Sapiens
GGGSWKGRL

SEQ ID NO: 361520 - protein, 9 aa, Homo Sapiens
SLGGIIYLV

SEQ ID NO: 361521 - protein, 9 aa, Homo Sapiens
TWTKKSETK

SEQ ID NO: 361522 - protein, 9 aa, Homo Sapiens
DAVCLVPNN

SEQ ID NO: 361523 - protein, 9 aa, Homo Sapiens
CAIYLLKVG

SEQ ID NO: 361524 - protein, 9 aa, Homo Sapiens
SHVAFADMA

SEQ ID NO: 361525 - protein, 9 aa, Homo Sapiens
LQPAYVGSY

SEQ ID NO: 361526 - protein, 9 aa, Homo Sapiens
IINDPRYTA

SEQ ID NO: 361527 - protein, 9 aa, Homo Sapiens
PFLIVGSMF

SEQ ID NO: 361528 - protein, 9 aa, Homo Sapiens
QSSGQSSLV

SEQ ID NO: 361529 - protein, 9 aa, Homo Sapiens
LLLIYCLTI

SEQ ID NO: 361530 - protein, 9 aa, Homo Sapiens
SANCTDADY

SEQ ID NO: 361531 - protein, 9 aa, Homo Sapiens
FCADGRWHH

SEQ ID NO: 361532 - protein, 9 aa, Homo Sapiens
QEEQEGGWR

SEQ ID NO: 361533 - protein, 9 aa, Homo Sapiens
KFNGNRPSS

SEQ ID NO: 361534 - protein, 9 aa, Homo Sapiens
SETKEICDW

SEQ ID NO: 361535 - protein, 9 aa, Homo Sapiens
CLVPNNSLT

SEQ ID NO: 361536 - protein, 9 aa, Homo Sapiens
TPKKKKEAL

SEQ ID NO: 361537 - protein, 9 aa, Homo Sapiens
LQHTWFFFQ

SEQ ID NO: 361538 - protein, 9 aa, Homo Sapiens
QTLEPLEAE

SEQ ID NO: 361539 - protein, 9 aa, Homo Sapiens
FMLFNVFNA

SEQ ID NO: 361540 - protein, 9 aa, Homo Sapiens
TPQSSGQSS

SEQ ID NO: 361541 - protein, 9 aa, Homo Sapiens
VCLVPNNSL

SEQ ID NO: 361542 - protein, 9 aa, Homo Sapiens
MYLFLCLIS

SEQ ID NO: 361543 - protein, 9 aa, Homo Sapiens
EMKHKYGTQ

SEQ ID NO: 361544 - protein, 9 aa, Homo Sapiens
LFPDISQGC

SEQ ID NO: 361545 - protein, 9 aa, Homo Sapiens
LKEKEHQYE

SEQ ID NO: 361546 - protein, 9 aa, Homo Sapiens
VKRHCKHCV

SEQ ID NO: 361547 - protein, 9 aa, Homo Sapiens
YLCLAKAWV

SEQ ID NO: 361548 - protein, 9 aa, Homo Sapiens
PDISQGCEA

SEQ ID NO: 361549 - protein, 9 aa, Homo Sapiens
SMEEDIDSR

SEQ ID NO: 361550 - protein, 9 aa, Homo Sapiens
ILFPTAWLN

SEQ ID NO: 361551 - protein, 9 aa, Homo Sapiens
LYYHVPVSS

SEQ ID NO: 361552 - protein, 9 aa, Homo Sapiens
WTKKSETKE

SEQ ID NO: 361553 - protein, 9 aa, Homo Sapiens
PDSLAEGIT

SEQ ID NO: 361554 - protein, 9 aa, Homo Sapiens
GRDQTLEPL

SEQ ID NO: 361555 - protein, 9 aa, Homo Sapiens
AFCADGRWH

SEQ ID NO: 361556 - protein, 9 aa, Homo Sapiens
MATEAVELH

SEQ ID NO: 361557 - protein, 9 aa, Homo Sapiens
DQGDPFMLF

SEQ ID NO: 361558 - protein, 9 aa, Homo Sapiens
PKKKKEALF

SEQ ID NO: 361559 - protein, 9 aa, Homo Sapiens
LLPVPPPQN

SEQ ID NO: 361560 - protein, 9 aa, Homo Sapiens
ILLLIYCLT

SEQ ID NO: 361561 - protein, 9 aa, Homo Sapiens
YKSKFNGNR

SEQ ID NO: 361562 - protein, 9 aa, Homo Sapiens
WPLSHAKSE

SEQ ID NO: 361563 - protein, 9 aa, Homo Sapiens
MKHKYGTQG

SEQ ID NO: 361564 - protein, 9 aa, Homo Sapiens
LPDSLAEGI

SEQ ID NO: 361565 - protein, 9 aa, Homo Sapiens
VFRRKLSLI

SEQ ID NO: 361566 - protein, 9 aa, Homo Sapiens
LSHVAFADM

SEQ ID NO: 361567 - protein, 9 aa, Homo Sapiens
VHVCACPGR

SEQ ID NO: 361568 - protein, 9 aa, Homo Sapiens
TVFTHAVSA

SEQ ID NO: 361569 - protein, 9 aa, Homo Sapiens
STTGEYKSK

SEQ ID NO: 361570 - protein, 9 aa, Homo Sapiens
GSWKGRLFP

SEQ ID NO: 361571 - protein, 9 aa, Homo Sapiens
EGITKMSDN

SEQ ID NO: 361572 - protein, 9 aa, Homo Sapiens
ACGVGKSAL

SEQ ID NO: 361573 - protein, 9 aa, Homo Sapiens
PLEAELQAT

SEQ ID NO: 361574 - protein, 9 aa, Homo Sapiens
MQIGSRETV

SEQ ID NO: 361575 - protein, 9 aa, Homo Sapiens
ADSLGRLCP

SEQ ID NO: 361576 - protein, 9 aa, Homo Sapiens
DSRKINNSF

SEQ ID NO: 361577 - protein, 9 aa, Homo Sapiens
YEEMKHKYG

SEQ ID NO: 361578 - protein, 9 aa, Homo Sapiens
RTHADSLGR

SEQ ID NO: 361579 - protein, 9 aa, Homo Sapiens
YCQCILDNA

SEQ ID NO: 361580 - protein, 9 aa, Homo Sapiens
SKSPTSPTM

SEQ ID NO: 361581 - protein, 9 aa, Homo Sapiens
YTWTKKSET

SEQ ID NO: 361582 - protein, 9 aa, Homo Sapiens
GDPFMLFNV

SEQ ID NO: 361583 - protein, 9 aa, Homo Sapiens
VIGTTFEGC

SEQ ID NO: 361584 - protein, 9 aa, Homo Sapiens
RNSFEVHVC

SEQ ID NO: 361585 - protein, 9 aa, Homo Sapiens
GGGWPFCPP

SEQ ID NO: 361586 - protein, 9 aa, Homo Sapiens
SHGLEIFQH

SEQ ID NO: 361587 - protein, 9 aa, Homo Sapiens
KTYCQCILD

SEQ ID NO: 361588 - protein, 9 aa, Homo Sapiens
SAGGATRPS

SEQ ID NO: 361589 - protein, 9 aa, Homo Sapiens
FFLSHVAFA

SEQ ID NO: 361590 - protein, 9 aa, Homo Sapiens
ETPKKKKEA

SEQ ID NO: 361591 - protein, 9 aa, Homo Sapiens
TAWLNVLPL

SEQ ID NO: 361592 - protein, 9 aa, Homo Sapiens
VKEEKASDS

SEQ ID NO: 361593 - protein, 9 aa, Homo Sapiens
PGLLPVPPP

SEQ ID NO: 361594 - protein, 9 aa, Homo Sapiens
FVKRHCKHC

SEQ ID NO: 361595 - protein, 9 aa, Homo Sapiens
GEKVHQCEE

SEQ ID NO: 361596 - protein, 9 aa, Homo Sapiens
GKVFRRKLS

SEQ ID NO: 361597 - protein, 9 aa, Homo Sapiens
HVPVSSDKV

SEQ ID NO: 361598 - protein, 9 aa, Homo Sapiens
HVPRSPKAT

SEQ ID NO: 361599 - protein, 9 aa, Homo Sapiens
EDIDSRKIN

SEQ ID NO: 361600 - protein, 9 aa, Homo Sapiens
VQEVQPSDR

SEQ ID NO: 361601 - protein, 9 aa, Homo Sapiens
PPYTWTKKS

SEQ ID NO: 361602 - protein, 9 aa, Homo Sapiens
LGASLGGII

SEQ ID NO: 361603 - protein, 9 aa, Homo Sapiens
LKSWGLTLC

SEQ ID NO: 361604 - protein, 9 aa, Homo Sapiens
PEQNWAIRA

SEQ ID NO: 361605 - protein, 9 aa, Homo Sapiens
GSRETVFTH

SEQ ID NO: 361606 - protein, 9 aa, Homo Sapiens
SCLPSCNNR

SEQ ID NO: 361607 - protein, 9 aa, Homo Sapiens
SDSNPNEES

SEQ ID NO: 361608 - protein, 9 aa, Homo Sapiens
LPSCNNRHF

SEQ ID NO: 361609 - protein, 9 aa, Homo Sapiens
VVAPLLGAS

SEQ ID NO: 361610 - protein, 9 aa, Homo Sapiens
RTPSPSFWG

SEQ ID NO: 361611 - protein, 9 aa, Homo Sapiens
LEPLEAELQ

SEQ ID NO: 361612 - protein, 9 aa, Homo Sapiens
VPRSPKATQ

SEQ ID NO: 361613 - protein, 9 aa, Homo Sapiens
KYQPRMHVI

SEQ ID NO: 361614 - protein, 9 aa, Homo Sapiens
EVFQAERLL

SEQ ID NO: 361615 - protein, 9 aa, Homo Sapiens
RMSCGGGWP

SEQ ID NO: 361616 - protein, 9 aa, Homo Sapiens
AYLCLAKAW

SEQ ID NO: 361617 - protein, 9 aa, Homo Sapiens
FLIVGSMFV

SEQ ID NO: 361618 - protein, 9 aa, Homo Sapiens
TLWPLSHAK

SEQ ID NO: 361619 - protein, 9 aa, Homo Sapiens
AVCLVPNNS

SEQ ID NO: 361620 - protein, 9 aa, Homo Sapiens
KSKFNGNRP

SEQ ID NO: 361621 - protein, 9 aa, Homo Sapiens
GGSWKGRLF

SEQ ID NO: 361622 - protein, 9 aa, Homo Sapiens
SFISANCTD

SEQ ID NO: 361623 - protein, 9 aa, Homo Sapiens
GKTPEGLAT

SEQ ID NO: 361624 - protein, 9 aa, Homo Sapiens
PPRPAPPWF

SEQ ID NO: 361625 - protein, 9 aa, Homo Sapiens
GQSSLVSSS

SEQ ID NO: 361626 - protein, 9 aa, Homo Sapiens
SRKINNSFL

SEQ ID NO: 361627 - protein, 9 aa, Homo Sapiens
GWPFCPPGH

SEQ ID NO: 361628 - protein, 9 aa, Homo Sapiens
CFECGKVFR

SEQ ID NO: 361629 - protein, 9 aa, Homo Sapiens
LIVGSMFVA

SEQ ID NO: 361630 - protein, 9 aa, Homo Sapiens
PQSSGQSSL

SEQ ID NO: 361631 - protein, 9 aa, Homo Sapiens
VAFADMAYS

SEQ ID NO: 361632 - protein, 9 aa, Homo Sapiens
WFLVVAAIV

SEQ ID NO: 361633 - protein, 9 aa, Homo Sapiens
EALFLQEVF

SEQ ID NO: 361634 - protein, 9 aa, Homo Sapiens
HCKHCVIEH

SEQ ID NO: 361635 - protein, 9 aa, Homo Sapiens
DYPEQNWAI

SEQ ID NO: 361636 - protein, 9 aa, Homo Sapiens
DLLCLYYHV

SEQ ID NO: 361637 - protein, 9 aa, Homo Sapiens
ASDSNPNEE

SEQ ID NO: 361638 - protein, 9 aa, Homo Sapiens
LFLQEVFQA

SEQ ID NO: 361639 - protein, 9 aa, Homo Sapiens
CDWQCDLSI

SEQ ID NO: 361640 - protein, 9 aa, Homo Sapiens
ILHVPRSPK

SEQ ID NO: 361641 - protein, 9 aa, Homo Sapiens
TKKSETKEI

SEQ ID NO: 361642 - protein, 9 aa, Homo Sapiens
MSCGGGWPF

SEQ ID NO: 361643 - protein, 9 aa, Homo Sapiens
ASPGLLPVP

SEQ ID NO: 361644 - protein, 9 aa, Homo Sapiens
DIDSRKINN

SEQ ID NO: 361645 - protein, 9 aa, Homo Sapiens
ISQGCEAFL

SEQ ID NO: 361646 - protein, 9 aa, Homo Sapiens
QGLAPGMEV

SEQ ID NO: 361647 - protein, 9 aa, Homo Sapiens
SRETVFTHA

SEQ ID NO: 361648 - protein, 9 aa, Homo Sapiens
EPLEAELQA

SEQ ID NO: 361649 - protein, 9 aa, Homo Sapiens
TLQIAEIKD

SEQ ID NO: 361650 - protein, 9 aa, Homo Sapiens
WQALLFVIL

SEQ ID NO: 361651 - protein, 9 aa, Homo Sapiens
ITKMSDNMG

SEQ ID NO: 361652 - protein, 9 aa, Homo Sapiens
QGCEAFLRH

SEQ ID NO: 361653 - protein, 9 aa, Homo Sapiens
AKAWVEQLR

SEQ ID NO: 361654 - protein, 9 aa, Homo Sapiens
KEHQYEKKQ

SEQ ID NO: 361655 - protein, 9 aa, Homo Sapiens
ALLFVILLL

SEQ ID NO: 361656 - protein, 9 aa, Homo Sapiens
HFRLQPAYV

SEQ ID NO: 361657 - protein, 9 aa, Homo Sapiens
GACGVGKSA

SEQ ID NO: 361658 - protein, 9 aa, Homo Sapiens
PRTLWPLSH

SEQ ID NO: 361659 - protein, 9 aa, Homo Sapiens
EQNWAIRAI

SEQ ID NO: 361660 - protein, 9 aa, Homo Sapiens
YKLVVVGAC

SEQ ID NO: 361661 - protein, 9 aa, Homo Sapiens
KASDSNPNE

SEQ ID NO: 361662 - protein, 9 aa, Homo Sapiens
LVVVGACGV

SEQ ID NO: 361663 - protein, 9 aa, Homo Sapiens
DQTLEPLEA

SEQ ID NO: 361664 - protein, 9 aa, Homo Sapiens
GSMFVAFII

SEQ ID NO: 361665 - protein, 9 aa, Homo Sapiens
RHCKHCVIE

SEQ ID NO: 361666 - protein, 9 aa, Homo Sapiens
HCVIEHTNP

SEQ ID NO: 361667 - protein, 9 aa, Homo Sapiens
GPSWKQELV

SEQ ID NO: 361668 - protein, 9 aa, Homo Sapiens
FHGYPHCRP

SEQ ID NO: 361669 - protein, 9 aa, Homo Sapiens
ESGSYFCTA

SEQ ID NO: 361670 - protein, 9 aa, Homo Sapiens
KVKKKPRVP

SEQ ID NO: 361671 - protein, 9 aa, Homo Sapiens
PPRMLSPQN

SEQ ID NO: 361672 - protein, 9 aa, Homo Sapiens
VPPRMLSPQ

SEQ ID NO: 361673 - protein, 9 aa, Homo Sapiens
DARLAMNKH

SEQ ID NO: 361674 - protein, 9 aa, Homo Sapiens
EERYNAFCF

SEQ ID NO: 361675 - protein, 9 aa, Homo Sapiens
LVGRRPAGE

SEQ ID NO: 361676 - protein, 9 aa, Homo Sapiens
PGFTGNPGP

SEQ ID NO: 361677 - protein, 9 aa, Homo Sapiens
RMLSPQNQL

SEQ ID NO: 361678 - protein, 9 aa, Homo Sapiens
VHSGGTVVE

SEQ ID NO: 361679 - protein, 9 aa, Homo Sapiens
PEPEHPRFA

SEQ ID NO: 361680 - protein, 9 aa, Homo Sapiens
KFTRCEHMK

SEQ ID NO: 361681 - protein, 9 aa, Homo Sapiens
PCFSIYIMG

SEQ ID NO: 361682 - protein, 9 aa, Homo Sapiens
CHRDGSWFL

SEQ ID NO: 361683 - protein, 9 aa, Homo Sapiens
WGIKVEHVE

SEQ ID NO: 361684 - protein, 9 aa, Homo Sapiens
TEEAPSAPR

SEQ ID NO: 361685 - protein, 9 aa, Homo Sapiens
LHYIYFIFP

SEQ ID NO: 361686 - protein, 9 aa, Homo Sapiens
PDDLLSTKD

SEQ ID NO: 361687 - protein, 9 aa, Homo Sapiens
SQKGELTPL

SEQ ID NO: 361688 - protein, 9 aa, Homo Sapiens
PAANETMRH

SEQ ID NO: 361689 - protein, 9 aa, Homo Sapiens
GKEEIFYIF

SEQ ID NO: 361690 - protein, 9 aa, Homo Sapiens
YFRKIPLLL

SEQ ID NO: 361691 - protein, 9 aa, Homo Sapiens
KTKIATPQG

SEQ ID NO: 361692 - protein, 9 aa, Homo Sapiens
AVQNGKIYI

SEQ ID NO: 361693 - protein, 9 aa, Homo Sapiens
DKFVLESEK

SEQ ID NO: 361694 - protein, 9 aa, Homo Sapiens
YPHCRPCDC

SEQ ID NO: 361695 - protein, 9 aa, Homo Sapiens
MITRCSQPL

SEQ ID NO: 361696 - protein, 9 aa, Homo Sapiens
VITAPQMFG

SEQ ID NO: 361697 - protein, 9 aa, Homo Sapiens
DQADAKFRR

SEQ ID NO: 361698 - protein, 9 aa, Homo Sapiens
SFYNARLLC

SEQ ID NO: 361699 - protein, 9 aa, Homo Sapiens
VSSDGGCKA

SEQ ID NO: 361700 - protein, 9 aa, Homo Sapiens
ITKFSLEHQ

SEQ ID NO: 361701 - protein, 9 aa, Homo Sapiens
RSSTSSRTP

SEQ ID NO: 361702 - protein, 9 aa, Homo Sapiens
MFSRCTSFC

SEQ ID NO: 361703 - protein, 9 aa, Homo Sapiens
NVLGTSMSP

SEQ ID NO: 361704 - protein, 9 aa, Homo Sapiens
VSQKGELTP

SEQ ID NO: 361705 - protein, 9 aa, Homo Sapiens
VQAENVLGT

SEQ ID NO: 361706 - protein, 9 aa, Homo Sapiens
NCQINHLHV

SEQ ID NO: 361707 - protein, 9 aa, Homo Sapiens
DNRLEVGAD

SEQ ID NO: 361708 - protein, 9 aa, Homo Sapiens
RMNPKVITA

SEQ ID NO: 361709 - protein, 9 aa, Homo Sapiens
YIHTHTFYV

SEQ ID NO: 361710 - protein, 9 aa, Homo Sapiens
VPTRKGEQT

SEQ ID NO: 361711 - protein, 9 aa, Homo Sapiens
HCMHLHEKR

SEQ ID NO: 361712 - protein, 9 aa, Homo Sapiens
RDHVPRPDS

SEQ ID NO: 361713 - protein, 9 aa, Homo Sapiens
YGGPDWRCP

SEQ ID NO: 361714 - protein, 9 aa, Homo Sapiens
FAGNVAARF

SEQ ID NO: 361715 - protein, 9 aa, Homo Sapiens
TDAVLPAAL

SEQ ID NO: 361716 - protein, 9 aa, Homo Sapiens
CFAGNVAAR

SEQ ID NO: 361717 - protein, 9 aa, Homo Sapiens
AMITRCSQP

SEQ ID NO: 361718 - protein, 9 aa, Homo Sapiens
EVSSDGGCK

SEQ ID NO: 361719 - protein, 9 aa, Homo Sapiens
CLGGEVGGP

SEQ ID NO: 361720 - protein, 9 aa, Homo Sapiens
DARLLHVDS

SEQ ID NO: 361721 - protein, 9 aa, Homo Sapiens
PPAVPTRKG

SEQ ID NO: 361722 - protein, 9 aa, Homo Sapiens
LFKPAVIAE

SEQ ID NO: 361723 - protein, 9 aa, Homo Sapiens
FHWVESLKG

SEQ ID NO: 361724 - protein, 9 aa, Homo Sapiens
HPRWLCAGA

SEQ ID NO: 361725 - protein, 9 aa, Homo Sapiens
PQCRPRSCT

SEQ ID NO: 361726 - protein, 9 aa, Homo Sapiens
NSWRCNCGL

SEQ ID NO: 361727 - protein, 9 aa, Homo Sapiens
IVLQVVKSR

SEQ ID NO: 361728 - protein, 9 aa, Homo Sapiens
VEDKFVLES

SEQ ID NO: 361729 - protein, 9 aa, Homo Sapiens
LYGHTSTVH

SEQ ID NO: 361730 - protein, 9 aa, Homo Sapiens
PGGAGGGQQ

SEQ ID NO: 361731 - protein, 9 aa, Homo Sapiens
YVLVQDYFG

SEQ ID NO: 361732 - protein, 9 aa, Homo Sapiens
GQQGPGTHM

SEQ ID NO: 361733 - protein, 9 aa, Homo Sapiens
SWKQELVNQ

SEQ ID NO: 361734 - protein, 9 aa, Homo Sapiens
SLSTTQSKV

SEQ ID NO: 361735 - protein, 9 aa, Homo Sapiens
QDFCTDLVV

SEQ ID NO: 361736 - protein, 9 aa, Homo Sapiens
GRDSPSAGD

SEQ ID NO: 361737 - protein, 9 aa, Homo Sapiens
IDYFRKIPL

SEQ ID NO: 361738 - protein, 9 aa, Homo Sapiens
KDSWVEATP

SEQ ID NO: 361739 - protein, 9 aa, Homo Sapiens
LLAMSIDCY

SEQ ID NO: 361740 - protein, 9 aa, Homo Sapiens
VTIVTAILA

SEQ ID NO: 361741 - protein, 9 aa, Homo Sapiens
SPCHRDGSW

SEQ ID NO: 361742 - protein, 9 aa, Homo Sapiens
DADYMKRYL

SEQ ID NO: 361743 - protein, 9 aa, Homo Sapiens
PAVPTRKGE

SEQ ID NO: 361744 - protein, 9 aa, Homo Sapiens
HPRFAAFTA

SEQ ID NO: 361745 - protein, 9 aa, Homo Sapiens
EAVFFTTPS

SEQ ID NO: 361746 - protein, 9 aa, Homo Sapiens
FSCSRTQAG

SEQ ID NO: 361747 - protein, 9 aa, Homo Sapiens
KVITAPQMF

SEQ ID NO: 361748 - protein, 9 aa, Homo Sapiens
PDARLAMNK

SEQ ID NO: 361749 - protein, 9 aa, Homo Sapiens
VFFTTPSCS

SEQ ID NO: 361750 - protein, 9 aa, Homo Sapiens
RLCVHGACL

SEQ ID NO: 361751 - protein, 9 aa, Homo Sapiens
YMKRYLGDL

SEQ ID NO: 361752 - protein, 9 aa, Homo Sapiens
FRNLFSSSW

SEQ ID NO: 361753 - protein, 9 aa, Homo Sapiens
RKSFHGRLE

SEQ ID NO: 361754 - protein, 9 aa, Homo Sapiens
LRNLMYSAP

SEQ ID NO: 361755 - protein, 9 aa, Homo Sapiens
MMIGRCNLV

SEQ ID NO: 361756 - protein, 9 aa, Homo Sapiens
WEVCGSKGE

SEQ ID NO: 361757 - protein, 9 aa, Homo Sapiens
QGPGTHMSE

SEQ ID NO: 361758 - protein, 9 aa, Homo Sapiens
GTEHSGWVA

SEQ ID NO: 361759 - protein, 9 aa, Homo Sapiens
NANLRKKSL

SEQ ID NO: 361760 - protein, 9 aa, Homo Sapiens
ESFKEGDTV

SEQ ID NO: 361761 - protein, 9 aa, Homo Sapiens
VGIIKKMKK

SEQ ID NO: 361762 - protein, 9 aa, Homo Sapiens
NRLEVGADM

SEQ ID NO: 361763 - protein, 9 aa, Homo Sapiens
IFYIFEGDP

SEQ ID NO: 361764 - protein, 9 aa, Homo Sapiens
RDYVALQTK

SEQ ID NO: 361765 - protein, 9 aa, Homo Sapiens
HHQQLHNIH

SEQ ID NO: 361766 - protein, 9 aa, Homo Sapiens
LDPEFEPQC

SEQ ID NO: 361767 - protein, 9 aa, Homo Sapiens
QQGPGTHMS

SEQ ID NO: 361768 - protein, 9 aa, Homo Sapiens
ESQAMITRC

SEQ ID NO: 361769 - protein, 9 aa, Homo Sapiens
VCGSKGEVL

SEQ ID NO: 361770 - protein, 9 aa, Homo Sapiens
FRHGASINY

SEQ ID NO: 361771 - protein, 9 aa, Homo Sapiens
SNCQINHLH

SEQ ID NO: 361772 - protein, 9 aa, Homo Sapiens
YCGFLSPSL

SEQ ID NO: 361773 - protein, 9 aa, Homo Sapiens
AGRCRRGAD

SEQ ID NO: 361774 - protein, 9 aa, Homo Sapiens
YCLMLQCWK

SEQ ID NO: 361775 - protein, 9 aa, Homo Sapiens
QSEEELRER

SEQ ID NO: 361776 - protein, 9 aa, Homo Sapiens
EIFYIFEGD

SEQ ID NO: 361777 - protein, 9 aa, Homo Sapiens
EEDEDDDDD

SEQ ID NO: 361778 - protein, 9 aa, Homo Sapiens
IYIMGLVLE

SEQ ID NO: 361779 - protein, 9 aa, Homo Sapiens
ACGGNLTGT

SEQ ID NO: 361780 - protein, 9 aa, Homo Sapiens
KKSSGHMQT

SEQ ID NO: 361781 - protein, 9 aa, Homo Sapiens
QPQPPPPLP

SEQ ID NO: 361782 - protein, 9 aa, Homo Sapiens
DYMVEDKFV

SEQ ID NO: 361783 - protein, 9 aa, Homo Sapiens
MYSAPLYVD

SEQ ID NO: 361784 - protein, 9 aa, Homo Sapiens
MPRLCVHGA

SEQ ID NO: 361785 - protein, 9 aa, Homo Sapiens
NAEERYNAF

SEQ ID NO: 361786 - protein, 9 aa, Homo Sapiens
GHNSWRCNC

SEQ ID NO: 361787 - protein, 9 aa, Homo Sapiens
MSPCHRDGS

SEQ ID NO: 361788 - protein, 9 aa, Homo Sapiens
FPRSIRPDN

SEQ ID NO: 361789 - protein, 9 aa, Homo Sapiens
DDKLDADYM

SEQ ID NO: 361790 - protein, 9 aa, Homo Sapiens
YEEICLYEE

SEQ ID NO: 361791 - protein, 9 aa, Homo Sapiens
ELPRSSTSS

SEQ ID NO: 361792 - protein, 9 aa, Homo Sapiens
ISFSCSRTQ

SEQ ID NO: 361793 - protein, 9 aa, Homo Sapiens
SFHGRLENL

SEQ ID NO: 361794 - protein, 9 aa, Homo Sapiens
HLHVSYTNT

SEQ ID NO: 361795 - protein, 9 aa, Homo Sapiens
KLADDMYSL

SEQ ID NO: 361796 - protein, 9 aa, Homo Sapiens
LVAHLLSKY

SEQ ID NO: 361797 - protein, 9 aa, Homo Sapiens
IYIYTHIYI

SEQ ID NO: 361798 - protein, 9 aa, Homo Sapiens
VDIVLQVVK

SEQ ID NO: 361799 - protein, 9 aa, Homo Sapiens
FTTPSCSAL

SEQ ID NO: 361800 - protein, 9 aa, Homo Sapiens
LPAALAAVV

SEQ ID NO: 361801 - protein, 9 aa, Homo Sapiens
VLPAALAAV

SEQ ID NO: 361802 - protein, 9 aa, Homo Sapiens
QDSDNRLEV

SEQ ID NO: 361803 - protein, 9 aa, Homo Sapiens
SEEELRERS

SEQ ID NO: 361804 - protein, 9 aa, Homo Sapiens
GDSHAFSED

SEQ ID NO: 361805 - protein, 9 aa, Homo Sapiens
FPSESFKEG

SEQ ID NO: 361806 - protein, 9 aa, Homo Sapiens
SPPAGRCRR

SEQ ID NO: 361807 - protein, 9 aa, Homo Sapiens
DYRLMWEVC

SEQ ID NO: 361808 - protein, 9 aa, Homo Sapiens
DQSEEELRE

SEQ ID NO: 361809 - protein, 9 aa, Homo Sapiens
AVATARHPR

SEQ ID NO: 361810 - protein, 9 aa, Homo Sapiens
VDVATQVPT

SEQ ID NO: 361811 - protein, 9 aa, Homo Sapiens
PSCSALKGK

SEQ ID NO: 361812 - protein, 9 aa, Homo Sapiens
FRDYVALQT

SEQ ID NO: 361813 - protein, 9 aa, Homo Sapiens
QNGKIYISG

SEQ ID NO: 361814 - protein, 9 aa, Homo Sapiens
IMGLVLEWI

SEQ ID NO: 361815 - protein, 9 aa, Homo Sapiens
DSAVATARH

SEQ ID NO: 361816 - protein, 9 aa, Homo Sapiens
AVDVATQVP

SEQ ID NO: 361817 - protein, 9 aa, Homo Sapiens
ENSSGQSDN

SEQ ID NO: 361818 - protein, 9 aa, Homo Sapiens
AWAADARLL

SEQ ID NO: 361819 - protein, 9 aa, Homo Sapiens
VATFQQLPK

SEQ ID NO: 361820 - protein, 9 aa, Homo Sapiens
QLKSFYNAR

SEQ ID NO: 361821 - protein, 9 aa, Homo Sapiens
SQAMITRCS

SEQ ID NO: 361822 - protein, 9 aa, Homo Sapiens
DEENYPVIV

SEQ ID NO: 361823 - protein, 9 aa, Homo Sapiens
EEIFYIFEG

SEQ ID NO: 361824 - protein, 9 aa, Homo Sapiens
PSPPAGRCR

SEQ ID NO: 361825 - protein, 9 aa, Homo Sapiens
HNSWRCNCG

SEQ ID NO: 361826 - protein, 9 aa, Homo Sapiens
LTGTAGVIL

SEQ ID NO: 361827 - protein, 9 aa, Homo Sapiens
KTENEAPTE

SEQ ID NO: 361828 - protein, 9 aa, Homo Sapiens
TVHCMHLHE

SEQ ID NO: 361829 - protein, 9 aa, Homo Sapiens
IATPQGAAP

SEQ ID NO: 361830 - protein, 9 aa, Homo Sapiens
APSAPRQSV

SEQ ID NO: 361831 - protein, 9 aa, Homo Sapiens
KVELPRSST

SEQ ID NO: 361832 - protein, 9 aa, Homo Sapiens
DGGCKAALG

SEQ ID NO: 361833 - protein, 9 aa, Homo Sapiens
MHCTQTRFS

SEQ ID NO: 361834 - protein, 9 aa, Homo Sapiens
TSAKVELPR

SEQ ID NO: 361835 - protein, 9 aa, Homo Sapiens
ARLLHVDSS

SEQ ID NO: 361836 - protein, 9 aa, Homo Sapiens
PLGPSWKQE

SEQ ID NO: 361837 - protein, 9 aa, Homo Sapiens
PLVNLPNIL

SEQ ID NO: 361838 - protein, 9 aa, Homo Sapiens
DYFGSNPGT

SEQ ID NO: 361839 - protein, 9 aa, Homo Sapiens
VVYEVHSGG

SEQ ID NO: 361840 - protein, 9 aa, Homo Sapiens
AAKKSSGHM

SEQ ID NO: 361841 - protein, 9 aa, Homo Sapiens
SAKVELPRS

SEQ ID NO: 361842 - protein, 9 aa, Homo Sapiens
GCKAALGTH

SEQ ID NO: 361843 - protein, 9 aa, Homo Sapiens
FPLVNLPNI

SEQ ID NO: 361844 - protein, 9 aa, Homo Sapiens
SGWVATFQQ

SEQ ID NO: 361845 - protein, 9 aa, Homo Sapiens
CCFAGNVAA

SEQ ID NO: 361846 - protein, 9 aa, Homo Sapiens
LQSNNIANT

SEQ ID NO: 361847 - protein, 9 aa, Homo Sapiens
ATYQTNYGF

SEQ ID NO: 361848 - protein, 9 aa, Homo Sapiens
DPEFEPQCR

SEQ ID NO: 361849 - protein, 9 aa, Homo Sapiens
LEERLKHVR

SEQ ID NO: 361850 - protein, 9 aa, Homo Sapiens
DKATDICMH

SEQ ID NO: 361851 - protein, 9 aa, Homo Sapiens
DPVGQLEPI

SEQ ID NO: 361852 - protein, 9 aa, Homo Sapiens
NKWTLCVQM

SEQ ID NO: 361853 - protein, 9 aa, Homo Sapiens
ISNCQINHL

SEQ ID NO: 361854 - protein, 9 aa, Homo Sapiens
HVEIKDVKL

SEQ ID NO: 361855 - protein, 9 aa, Homo Sapiens
KFPRSIRPD

SEQ ID NO: 361856 - protein, 9 aa, Homo Sapiens
KVPANPEVL

SEQ ID NO: 361857 - protein, 9 aa, Homo Sapiens
YFGSNPGTF

SEQ ID NO: 361858 - protein, 9 aa, Homo Sapiens
CNEVGCDGP

SEQ ID NO: 361859 - protein, 9 aa, Homo Sapiens
QVTIVTAIL

SEQ ID NO: 361860 - protein, 9 aa, Homo Sapiens
VEYGGPDWR

SEQ ID NO: 361861 - protein, 9 aa, Homo Sapiens
EVLLLMASS

SEQ ID NO: 361862 - protein, 9 aa, Homo Sapiens
KLDADYMKR

SEQ ID NO: 361863 - protein, 9 aa, Homo Sapiens
LSPSLKSSK

SEQ ID NO: 361864 - protein, 9 aa, Homo Sapiens
TKVVYEVHS

SEQ ID NO: 361865 - protein, 9 aa, Homo Sapiens
GDGSDEENY

SEQ ID NO: 361866 - protein, 9 aa, Homo Sapiens
FGHRTDPSG

SEQ ID NO: 361867 - protein, 9 aa, Homo Sapiens
ALGDSHAFS

SEQ ID NO: 361868 - protein, 9 aa, Homo Sapiens
AFPSESFKE

SEQ ID NO: 361869 - protein, 9 aa, Homo Sapiens
IKFPRSIRP

SEQ ID NO: 361870 - protein, 9 aa, Homo Sapiens
DWRCPPPPY

SEQ ID NO: 361871 - protein, 9 aa, Homo Sapiens
ETMRHGCLR

SEQ ID NO: 361872 - protein, 9 aa, Homo Sapiens
RDSPSAGDP

SEQ ID NO: 361873 - protein, 9 aa, Homo Sapiens
ANPEVLLLM

SEQ ID NO: 361874 - protein, 9 aa, Homo Sapiens
KIATPQGAA

SEQ ID NO: 361875 - protein, 9 aa, Homo Sapiens
RNRERSSRS

SEQ ID NO: 361876 - protein, 9 aa, Homo Sapiens
VETQVTIVT

SEQ ID NO: 361877 - protein, 9 aa, Homo Sapiens
CSRTQAGEL

SEQ ID NO: 361878 - protein, 9 aa, Homo Sapiens
YAVDVATQV

SEQ ID NO: 361879 - protein, 9 aa, Homo Sapiens
EEICLYEEA

SEQ ID NO: 361880 - protein, 9 aa, Homo Sapiens
HSGGTVVEN

SEQ ID NO: 361881 - protein, 9 aa, Homo Sapiens
GAVQNGKIY

SEQ ID NO: 361882 - protein, 9 aa, Homo Sapiens
PCACLGGEV

SEQ ID NO: 361883 - protein, 9 aa, Homo Sapiens
VATARHPRW

SEQ ID NO: 361884 - protein, 9 aa, Homo Sapiens
HPESQAMIT

SEQ ID NO: 361885 - protein, 9 aa, Homo Sapiens
TAFPSESFK

SEQ ID NO: 361886 - protein, 9 aa, Homo Sapiens
NRPDARLAM

SEQ ID NO: 361887 - protein, 9 aa, Homo Sapiens
EYIKFPRSI

SEQ ID NO: 361888 - protein, 9 aa, Homo Sapiens
DSPSAGDPV

SEQ ID NO: 361889 - protein, 9 aa, Homo Sapiens
ATYCGFLSP

SEQ ID NO: 361890 - protein, 9 aa, Homo Sapiens
IATYQTNYG

SEQ ID NO: 361891 - protein, 9 aa, Homo Sapiens
PLLRHHQQL

SEQ ID NO: 361892 - protein, 9 aa, Homo Sapiens
EDQDSDNRL

SEQ ID NO: 361893 - protein, 9 aa, Homo Sapiens
EHQTWDQLL

SEQ ID NO: 361894 - protein, 9 aa, Homo Sapiens
NNIANTVDE

SEQ ID NO: 361895 - protein, 9 aa, Homo Sapiens
YTHIYIHTH

SEQ ID NO: 361896 - protein, 9 aa, Homo Sapiens
NLEDAAKKS

SEQ ID NO: 361897 - protein, 9 aa, Homo Sapiens
FYIFEGDPI

SEQ ID NO: 361898 - protein, 9 aa, Homo Sapiens
TKFSLEHQT

SEQ ID NO: 361899 - protein, 9 aa, Homo Sapiens
EAPSAPRQS

SEQ ID NO: 361900 - protein, 9 aa, Homo Sapiens
PSAGDPVGQ

SEQ ID NO: 361901 - protein, 9 aa, Homo Sapiens
PACLLSTAR

SEQ ID NO: 361902 - protein, 9 aa, Homo Sapiens
MILHYIYFI

SEQ ID NO: 361903 - protein, 9 aa, Homo Sapiens
SMPDLEHCH

SEQ ID NO: 361904 - protein, 9 aa, Homo Sapiens
YCPVGFGHR

SEQ ID NO: 361905 - protein, 9 aa, Homo Sapiens
SVSQKGELT

SEQ ID NO: 361906 - protein, 9 aa, Homo Sapiens
LPVDDTSFH

SEQ ID NO: 361907 - protein, 9 aa, Homo Sapiens
CPVEVKVTS

SEQ ID NO: 361908 - protein, 9 aa, Homo Sapiens
FTRCEHMKR

SEQ ID NO: 361909 - protein, 9 aa, Homo Sapiens
CGKKFTRCE

SEQ ID NO: 361910 - protein, 9 aa, Homo Sapiens
HEDYNSEIQ

SEQ ID NO: 361911 - protein, 9 aa, Homo Sapiens
QDDDSNLLQ

SEQ ID NO: 361912 - protein, 9 aa, Homo Sapiens
GIIKKMKKR

SEQ ID NO: 361913 - protein, 9 aa, Homo Sapiens
DNCSEEMYC

SEQ ID NO: 361914 - protein, 9 aa, Homo Sapiens
DYNSEIQEV

SEQ ID NO: 361915 - protein, 9 aa, Homo Sapiens
LPGFTGNPG

SEQ ID NO: 361916 - protein, 9 aa, Homo Sapiens
EKVPANPEV

SEQ ID NO: 361917 - protein, 9 aa, Homo Sapiens
DDSNLLQDL

SEQ ID NO: 361918 - protein, 9 aa, Homo Sapiens
DHKNLTVTR

SEQ ID NO: 361919 - protein, 9 aa, Homo Sapiens
RYNAFCFTS

SEQ ID NO: 361920 - protein, 9 aa, Homo Sapiens
TTIGFRDYV

SEQ ID NO: 361921 - protein, 9 aa, Homo Sapiens
AEERYNAFC

SEQ ID NO: 361922 - protein, 9 aa, Homo Sapiens
HWFFAHSFD

SEQ ID NO: 361923 - protein, 9 aa, Homo Sapiens
AHWSTDAVY

SEQ ID NO: 361924 - protein, 9 aa, Homo Sapiens
EDIPLLEDI

SEQ ID NO: 361925 - protein, 9 aa, Homo Sapiens
TLCVQMSKR

SEQ ID NO: 361926 - protein, 9 aa, Homo Sapiens
KISNCQINH

SEQ ID NO: 361927 - protein, 9 aa, Homo Sapiens
VHWFFAHSF

SEQ ID NO: 361928 - protein, 9 aa, Homo Sapiens
SDEENYPVI

SEQ ID NO: 361929 - protein, 9 aa, Homo Sapiens
SNNIANTVD

SEQ ID NO: 361930 - protein, 9 aa, Homo Sapiens
SFSPKDKMI

SEQ ID NO: 361931 - protein, 9 aa, Homo Sapiens
PEHPRFAAF

SEQ ID NO: 361932 - protein, 9 aa, Homo Sapiens
PRQSVTVLT

SEQ ID NO: 361933 - protein, 9 aa, Homo Sapiens
KALNAHWST

SEQ ID NO: 361934 - protein, 9 aa, Homo Sapiens
FKEGDTVII

SEQ ID NO: 361935 - protein, 9 aa, Homo Sapiens
HSGWVATFQ

SEQ ID NO: 361936 - protein, 9 aa, Homo Sapiens
RRPAGENSS

SEQ ID NO: 361937 - protein, 9 aa, Homo Sapiens
PERDHVPRP

SEQ ID NO: 361938 - protein, 9 aa, Homo Sapiens
SPQNQLIRV

SEQ ID NO: 361939 - protein, 9 aa, Homo Sapiens
RASAPAGRS

SEQ ID NO: 361940 - protein, 9 aa, Homo Sapiens
VLQVVKSRG

SEQ ID NO: 361941 - protein, 9 aa, Homo Sapiens
AKVELPRSS

SEQ ID NO: 361942 - protein, 9 aa, Homo Sapiens
LFSSSWFHL

SEQ ID NO: 361943 - protein, 9 aa, Homo Sapiens
NCCFAGNVA

SEQ ID NO: 361944 - protein, 9 aa, Homo Sapiens
EVHSGGTVV

SEQ ID NO: 361945 - protein, 9 aa, Homo Sapiens
AQDFCTDLV

SEQ ID NO: 361946 - protein, 9 aa, Homo Sapiens
GNVAARFGL

SEQ ID NO: 361947 - protein, 9 aa, Homo Sapiens
DSVSQKGEL

SEQ ID NO: 361948 - protein, 9 aa, Homo Sapiens
SSHALGDSH

SEQ ID NO: 361949 - protein, 9 aa, Homo Sapiens
QAMITRCSQ

SEQ ID NO: 361950 - protein, 9 aa, Homo Sapiens
GASINYDDY

SEQ ID NO: 361951 - protein, 9 aa, Homo Sapiens
QSLSTTQSK

SEQ ID NO: 361952 - protein, 9 aa, Homo Sapiens
KVVYEVHSG

SEQ ID NO: 361953 - protein, 9 aa, Homo Sapiens
QNQLIRVIL

SEQ ID NO: 361954 - protein, 9 aa, Homo Sapiens
AGAVQNGKI

SEQ ID NO: 361955 - protein, 9 aa, Homo Sapiens
AGGLVAHLL

SEQ ID NO: 361956 - protein, 9 aa, Homo Sapiens
MRYCNSSMP

SEQ ID NO: 361957 - protein, 9 aa, Homo Sapiens
PYAVDVATQ

SEQ ID NO: 361958 - protein, 9 aa, Homo Sapiens
WTLCVQMSK

SEQ ID NO: 361959 - protein, 9 aa, Homo Sapiens
PVGFGHRTD

SEQ ID NO: 361960 - protein, 9 aa, Homo Sapiens
TARHPRWLC

SEQ ID NO: 361961 - protein, 9 aa, Homo Sapiens
TLPERDHVP

SEQ ID NO: 361962 - protein, 9 aa, Homo Sapiens
AVHWFFAHS

SEQ ID NO: 361963 - protein, 9 aa, Homo Sapiens
EKLEERLKH

SEQ ID NO: 361964 - protein, 9 aa, Homo Sapiens
WVATFQQLP

SEQ ID NO: 361965 - protein, 9 aa, Homo Sapiens
DEDDDDDPT

SEQ ID NO: 361966 - protein, 9 aa, Homo Sapiens
PRLCVHGAC

SEQ ID NO: 361967 - protein, 9 aa, Homo Sapiens
LVVSSANFI

SEQ ID NO: 361968 - protein, 9 aa, Homo Sapiens
CTDLVVSSA

SEQ ID NO: 361969 - protein, 9 aa, Homo Sapiens
QCRPRSCTW

SEQ ID NO: 361970 - protein, 9 aa, Homo Sapiens
TYQTNYGFS

SEQ ID NO: 361971 - protein, 9 aa, Homo Sapiens
YITKFSLEH

SEQ ID NO: 361972 - protein, 9 aa, Homo Sapiens
FSLEHQTWD

SEQ ID NO: 361973 - protein, 9 aa, Homo Sapiens
QAGELMVGE

SEQ ID NO: 361974 - protein, 9 aa, Homo Sapiens
FGSNPGTFR

SEQ ID NO: 361975 - protein, 9 aa, Homo Sapiens
HSDEYIKFP

SEQ ID NO: 361976 - protein, 9 aa, Homo Sapiens
PLSKITEQE

SEQ ID NO: 361977 - protein, 9 aa, Homo Sapiens
DIIDYFRKI

SEQ ID NO: 361978 - protein, 9 aa, Homo Sapiens
EEELRERSQ

SEQ ID NO: 361979 - protein, 9 aa, Homo Sapiens
HAGAVQNGK

SEQ ID NO: 361980 - protein, 9 aa, Homo Sapiens
KVEHVEIKD

SEQ ID NO: 361981 - protein, 9 aa, Homo Sapiens
GRSLRDGSL

SEQ ID NO: 361982 - protein, 9 aa, Homo Sapiens
RDDQADAKF

SEQ ID NO: 361983 - protein, 9 aa, Homo Sapiens
MRMNPKVIT

SEQ ID NO: 361984 - protein, 9 aa, Homo Sapiens
PPEPEHPRF

SEQ ID NO: 361985 - protein, 9 aa, Homo Sapiens
RRASAPAGR

SEQ ID NO: 361986 - protein, 9 aa, Homo Sapiens
QINHLHVSY

SEQ ID NO: 361987 - protein, 9 aa, Homo Sapiens
HWSTDAVYQ

SEQ ID NO: 361988 - protein, 9 aa, Homo Sapiens
NTVDELQQL

SEQ ID NO: 361989 - protein, 9 aa, Homo Sapiens
DSLLAVHWF

SEQ ID NO: 361990 - protein, 9 aa, Homo Sapiens
HCTQTRFSA

SEQ ID NO: 361991 - protein, 9 aa, Homo Sapiens
PHCRPCDCH

SEQ ID NO: 361992 - protein, 9 aa, Homo Sapiens
SENANLRKK

SEQ ID NO: 361993 - protein, 9 aa, Homo Sapiens
KKFTRCEHM

SEQ ID NO: 361994 - protein, 9 aa, Homo Sapiens
EYGGPDWRC

SEQ ID NO: 361995 - protein, 9 aa, Homo Sapiens
LMWEVCGSK

SEQ ID NO: 361996 - protein, 9 aa, Homo Sapiens
PCDPECNEV

SEQ ID NO: 361997 - protein, 9 aa, Homo Sapiens
NIANTVDEL

SEQ ID NO: 361998 - protein, 9 aa, Homo Sapiens
EAPTEISSD

SEQ ID NO: 361999 - protein, 9 aa, Homo Sapiens
HRDGSWFLK

SEQ ID NO: 362000 - protein, 9 aa, Homo Sapiens
PANPEVLLL

SEQ ID NO: 362001 - protein, 9 aa, Homo Sapiens
QYVLVQDYF

SEQ ID NO: 362002 - protein, 9 aa, Homo Sapiens
PRMLSPQNQ

SEQ ID NO: 362003 - protein, 9 aa, Homo Sapiens
ACLGGEVGG

SEQ ID NO: 362004 - protein, 9 aa, Homo Sapiens
ALQKLADDM

SEQ ID NO: 362005 - protein, 9 aa, Homo Sapiens
RKSFSPKDK

SEQ ID NO: 362006 - protein, 9 aa, Homo Sapiens
INHLHVSYT

SEQ ID NO: 362007 - protein, 9 aa, Homo Sapiens
QTNYGFSND

SEQ ID NO: 362008 - protein, 9 aa, Homo Sapiens
EDFIATYQT

SEQ ID NO: 362009 - protein, 9 aa, Homo Sapiens
FIEWMAGGL

SEQ ID NO: 362010 - protein, 9 aa, Homo Sapiens
VAWAADARL

SEQ ID NO: 362011 - protein, 9 aa, Homo Sapiens
PPCFSIYIM

SEQ ID NO: 362012 - protein, 9 aa, Homo Sapiens
ATARHPRWL

SEQ ID NO: 362013 - protein, 9 aa, Homo Sapiens
STTQSKVFQ

SEQ ID NO: 362014 - protein, 9 aa, Homo Sapiens
GGLVAHLLS

SEQ ID NO: 362015 - protein, 9 aa, Homo Sapiens
LMFSRCTSF

SEQ ID NO: 362016 - protein, 9 aa, Homo Sapiens
SIDCYVAIC

SEQ ID NO: 362017 - protein, 9 aa, Homo Sapiens
PCHRDGSWF

SEQ ID NO: 362018 - protein, 9 aa, Homo Sapiens
WVQAENVLG

SEQ ID NO: 362019 - protein, 9 aa, Homo Sapiens
RPAGENSSG

SEQ ID NO: 362020 - protein, 9 aa, Homo Sapiens
CGSKGEVLY

SEQ ID NO: 362021 - protein, 9 aa, Homo Sapiens
TQAGELMVG

SEQ ID NO: 362022 - protein, 9 aa, Homo Sapiens
CLYEEAREV

SEQ ID NO: 362023 - protein, 9 aa, Homo Sapiens
GFHGYPHCR

SEQ ID NO: 362024 - protein, 9 aa, Homo Sapiens
CGGNLTGTA

SEQ ID NO: 362025 - protein, 9 aa, Homo Sapiens
ELPACLLST

SEQ ID NO: 362026 - protein, 9 aa, Homo Sapiens
RRNRERSSR

SEQ ID NO: 362027 - protein, 9 aa, Homo Sapiens
LVNLPNILV

SEQ ID NO: 362028 - protein, 9 aa, Homo Sapiens
PQGAAPPGQ

SEQ ID NO: 362029 - protein, 9 aa, Homo Sapiens
AGGGQQGPG

SEQ ID NO: 362030 - protein, 9 aa, Homo Sapiens
TYCGFLSPS

SEQ ID NO: 362031 - protein, 9 aa, Homo Sapiens
VHCMHLHEK

SEQ ID NO: 362032 - protein, 9 aa, Homo Sapiens
DGSDEENYP

SEQ ID NO: 362033 - protein, 9 aa, Homo Sapiens
PGLPGFTGN

SEQ ID NO: 362034 - protein, 9 aa, Homo Sapiens
RLKHVRMEE

SEQ ID NO: 362035 - protein, 9 aa, Homo Sapiens
PRSIRPDNM

SEQ ID NO: 362036 - protein, 9 aa, Homo Sapiens
SFSCSRTQA

SEQ ID NO: 362037 - protein, 9 aa, Homo Sapiens
AHAGAVQNG

SEQ ID NO: 362038 - protein, 9 aa, Homo Sapiens
KSCHWPSSP

SEQ ID NO: 362039 - protein, 9 aa, Homo Sapiens
HQQLHNIHK

SEQ ID NO: 362040 - protein, 9 aa, Homo Sapiens
GGRSLRDGS

SEQ ID NO: 362041 - protein, 9 aa, Homo Sapiens
PPPPLPSQP

SEQ ID NO: 362042 - protein, 9 aa, Homo Sapiens
ESIKKKKNK

SEQ ID NO: 362043 - protein, 9 aa, Homo Sapiens
KSFSPKDKM

SEQ ID NO: 362044 - protein, 9 aa, Homo Sapiens
EFEPQCRPR

SEQ ID NO: 362045 - protein, 9 aa, Homo Sapiens
SSMPDLEHC

SEQ ID NO: 362046 - protein, 9 aa, Homo Sapiens
VDDTSFHWV

SEQ ID NO: 362047 - protein, 9 aa, Homo Sapiens
FCTDLVVSS

SEQ ID NO: 362048 - protein, 9 aa, Homo Sapiens
VQDYFGSNP

SEQ ID NO: 362049 - protein, 9 aa, Homo Sapiens
PKDKMILHY

SEQ ID NO: 362050 - protein, 9 aa, Homo Sapiens
CQINHLHVS

SEQ ID NO: 362051 - protein, 9 aa, Homo Sapiens
SKCPVEVKV

SEQ ID NO: 362052 - protein, 9 aa, Homo Sapiens
RSQGGRSLR

SEQ ID NO: 362053 - protein, 9 aa, Homo Sapiens
RHGASINYD

SEQ ID NO: 362054 - protein, 9 aa, Homo Sapiens
SESFKEGDT

SEQ ID NO: 362055 - protein, 9 aa, Homo Sapiens
WSTDAVYQE

SEQ ID NO: 362056 - protein, 9 aa, Homo Sapiens
IAESGSYFC

SEQ ID NO: 362057 - protein, 9 aa, Homo Sapiens
ECYEEICLY

SEQ ID NO: 362058 - protein, 9 aa, Homo Sapiens
TGTAGVILS

SEQ ID NO: 362059 - protein, 9 aa, Homo Sapiens
AGRSPRMLH

SEQ ID NO: 362060 - protein, 9 aa, Homo Sapiens
GPLLRHHQQ

SEQ ID NO: 362061 - protein, 9 aa, Homo Sapiens
DIVLQVVKS

SEQ ID NO: 362062 - protein, 9 aa, Homo Sapiens
MPDLEHCHT

SEQ ID NO: 362063 - protein, 9 aa, Homo Sapiens
NQSLSTTQS

SEQ ID NO: 362064 - protein, 9 aa, Homo Sapiens
HIYIHTHTF

SEQ ID NO: 362065 - protein, 9 aa, Homo Sapiens
STKDSWVEA

SEQ ID NO: 362066 - protein, 9 aa, Homo Sapiens
VQMSKRRGG

SEQ ID NO: 362067 - protein, 9 aa, Homo Sapiens
KKIGKKRKR

SEQ ID NO: 362068 - protein, 9 aa, Homo Sapiens
LAMSIDCYV

SEQ ID NO: 362069 - protein, 9 aa, Homo Sapiens
VATQVPTVP

SEQ ID NO: 362070 - protein, 9 aa, Homo Sapiens
DSHAFSEDP

SEQ ID NO: 362071 - protein, 9 aa, Homo Sapiens
EARLRNLMY

SEQ ID NO: 362072 - protein, 9 aa, Homo Sapiens
ENVLGTSMS

SEQ ID NO: 362073 - protein, 9 aa, Homo Sapiens
ERSSRSGKT

SEQ ID NO: 362074 - protein, 9 aa, Homo Sapiens
TELPDKKIG

SEQ ID NO: 362075 - protein, 9 aa, Homo Sapiens
QAENVLGTS

SEQ ID NO: 362076 - protein, 9 aa, Homo Sapiens
NCGLGPFLG

SEQ ID NO: 362077 - protein, 9 aa, Homo Sapiens
TENEAPTEI

SEQ ID NO: 362078 - protein, 9 aa, Homo Sapiens
VEVKVTSGR

SEQ ID NO: 362079 - protein, 9 aa, Homo Sapiens
PSAPRQSVT

SEQ ID NO: 362080 - protein, 9 aa, Homo Sapiens
KKKKNKASA

SEQ ID NO: 362081 - protein, 9 aa, Homo Sapiens
ECNEVGCDG

SEQ ID NO: 362082 - protein, 9 aa, Homo Sapiens
GIKVEHVEI

SEQ ID NO: 362083 - protein, 9 aa, Homo Sapiens
DQDSDNRLE

SEQ ID NO: 362084 - protein, 9 aa, Homo Sapiens
IIDYFRKIP

SEQ ID NO: 362085 - protein, 9 aa, Homo Sapiens
GPPGLPGFT

SEQ ID NO: 362086 - protein, 9 aa, Homo Sapiens
RCTSFCQFT

SEQ ID NO: 362087 - protein, 9 aa, Homo Sapiens
ILVDALQKL

SEQ ID NO: 362088 - protein, 9 aa, Homo Sapiens
PIRYSILEE

SEQ ID NO: 362089 - protein, 9 aa, Homo Sapiens
GRMSPCHRD

SEQ ID NO: 362090 - protein, 9 aa, Homo Sapiens
NCSEEMYCL

SEQ ID NO: 362091 - protein, 9 aa, Homo Sapiens
CYEEICLYE

SEQ ID NO: 362092 - protein, 9 aa, Homo Sapiens
NLLQDLSPE

SEQ ID NO: 362093 - protein, 9 aa, Homo Sapiens
GGEVGGPAA

SEQ ID NO: 362094 - protein, 9 aa, Homo Sapiens
EMYCLMLQC

SEQ ID NO: 362095 - protein, 9 aa, Homo Sapiens
HVRMEEEGE

SEQ ID NO: 362096 - protein, 9 aa, Homo Sapiens
IGFRDYVAL

SEQ ID NO: 362097 - protein, 9 aa, Homo Sapiens
LAAVVTTGK

SEQ ID NO: 362098 - protein, 9 aa, Homo Sapiens
GPCDPECNE

SEQ ID NO: 362099 - protein, 9 aa, Homo Sapiens
CMHCTQTRF

SEQ ID NO: 362100 - protein, 9 aa, Homo Sapiens
IYTHIYIHT

SEQ ID NO: 362101 - protein, 9 aa, Homo Sapiens
EVKVTSGRE

SEQ ID NO: 362102 - protein, 9 aa, Homo Sapiens
PSESFKEGD

SEQ ID NO: 362103 - protein, 9 aa, Homo Sapiens
SSDGGCKAA

SEQ ID NO: 362104 - protein, 9 aa, Homo Sapiens
DDLLSTKDS

SEQ ID NO: 362105 - protein, 9 aa, Homo Sapiens
KFVLESEKE

SEQ ID NO: 362106 - protein, 9 aa, Homo Sapiens
MKRYLGDLT

SEQ ID NO: 362107 - protein, 9 aa, Homo Sapiens
FSRCTSFCQ

SEQ ID NO: 362108 - protein, 9 aa, Homo Sapiens
QGTEHSGWV

SEQ ID NO: 362109 - protein, 9 aa, Homo Sapiens
DSDNRLEVG

SEQ ID NO: 362110 - protein, 9 aa, Homo Sapiens
PGKEEIFYI

SEQ ID NO: 362111 - protein, 9 aa, Homo Sapiens
EDAAKKSSG

SEQ ID NO: 362112 - protein, 9 aa, Homo Sapiens
STVHCMHLH

SEQ ID NO: 362113 - protein, 9 aa, Homo Sapiens
YNKLNQSLS

SEQ ID NO: 362114 - protein, 9 aa, Homo Sapiens
GDQSEEELR

SEQ ID NO: 362115 - protein, 9 aa, Homo Sapiens
TPPCFSIYI

SEQ ID NO: 362116 - protein, 9 aa, Homo Sapiens
TEISSDDSK

SEQ ID NO: 362117 - protein, 9 aa, Homo Sapiens
SLLAVHWFF

SEQ ID NO: 362118 - protein, 9 aa, Homo Sapiens
LAAHAGAVQ

SEQ ID NO: 362119 - protein, 9 aa, Homo Sapiens
GRRPAGENS

SEQ ID NO: 362120 - protein, 9 aa, Homo Sapiens
HGRLENLYY

SEQ ID NO: 362121 - protein, 9 aa, Homo Sapiens
MNPKVITAP

SEQ ID NO: 362122 - protein, 9 aa, Homo Sapiens
GFGHRTDPS

SEQ ID NO: 362123 - protein, 9 aa, Homo Sapiens
REMRMNPKV

SEQ ID NO: 362124 - protein, 9 aa, Homo Sapiens
PRSSTSSRT

SEQ ID NO: 362125 - protein, 9 aa, Homo Sapiens
LPACLLSTA

SEQ ID NO: 362126 - protein, 9 aa, Homo Sapiens
KSQTELPDK

SEQ ID NO: 362127 - protein, 9 aa, Homo Sapiens
IYFIFPLVN

SEQ ID NO: 362128 - protein, 9 aa, Homo Sapiens
PEVLLLMAS

SEQ ID NO: 362129 - protein, 9 aa, Homo Sapiens
NYPVIVPTR

SEQ ID NO: 362130 - protein, 9 aa, Homo Sapiens
IGRCNLVGK

SEQ ID NO: 362131 - protein, 9 aa, Homo Sapiens
LEDQDSDNR

SEQ ID NO: 362132 - protein, 9 aa, Homo Sapiens
RDSVSQKGE

SEQ ID NO: 362133 - protein, 9 aa, Homo Sapiens
PKVITAPQM

SEQ ID NO: 362134 - protein, 9 aa, Homo Sapiens
PQPQPPPPL

SEQ ID NO: 362135 - protein, 9 aa, Homo Sapiens
CYCPVGFGH

SEQ ID NO: 362136 - protein, 9 aa, Homo Sapiens
SAPRQSVTV

SEQ ID NO: 362137 - protein, 9 aa, Homo Sapiens
GFRHGASIN

SEQ ID NO: 362138 - protein, 9 aa, Homo Sapiens
EDEDDDDDP

SEQ ID NO: 362139 - protein, 9 aa, Homo Sapiens
CPVGFGHRT

SEQ ID NO: 362140 - protein, 9 aa, Homo Sapiens
NLTGTAGVI

SEQ ID NO: 362141 - protein, 9 aa, Homo Sapiens
LPERDHVPR

SEQ ID NO: 362142 - protein, 9 aa, Homo Sapiens
GYPHCRPCD

SEQ ID NO: 362143 - protein, 9 aa, Homo Sapiens
SVKVKKKPR

SEQ ID NO: 362144 - protein, 9 aa, Homo Sapiens
EELRERSQA

SEQ ID NO: 362145 - protein, 9 aa, Homo Sapiens
PTRKGEQTS

SEQ ID NO: 362146 - protein, 9 aa, Homo Sapiens
PAGRSPRML

SEQ ID NO: 362147 - protein, 9 aa, Homo Sapiens
DEYIKFPRS

SEQ ID NO: 362148 - protein, 9 aa, Homo Sapiens
MWEVCGSKG

SEQ ID NO: 362149 - protein, 9 aa, Homo Sapiens
GWVATFQQL

SEQ ID NO: 362150 - protein, 9 aa, Homo Sapiens
GPQPQPQPP

SEQ ID NO: 362151 - protein, 9 aa, Homo Sapiens
SDEYIKFPR

SEQ ID NO: 362152 - protein, 9 aa, Homo Sapiens
RCNCGLGPF

SEQ ID NO: 362153 - protein, 9 aa, Homo Sapiens
LRKKSLSLE

SEQ ID NO: 362154 - protein, 9 aa, Homo Sapiens
DAVLPAALA

SEQ ID NO: 362155 - protein, 9 aa, Homo Sapiens
ITLTTIGFR

SEQ ID NO: 362156 - protein, 9 aa, Homo Sapiens
DDDSNLLQD

SEQ ID NO: 362157 - protein, 9 aa, Homo Sapiens
WIRRNRERS

SEQ ID NO: 362158 - protein, 9 aa, Homo Sapiens
TGRMSPCHR

SEQ ID NO: 362159 - protein, 9 aa, Homo Sapiens
HKNLTVTRE

SEQ ID NO: 362160 - protein, 9 aa, Homo Sapiens
NETMRHGCL

SEQ ID NO: 362161 - protein, 9 aa, Homo Sapiens
ELRERSQAG

SEQ ID NO: 362162 - protein, 9 aa, Homo Sapiens
RVPLMFIIQ

SEQ ID NO: 362163 - protein, 9 aa, Homo Sapiens
IKTENEAPT

SEQ ID NO: 362164 - protein, 9 aa, Homo Sapiens
ARLAMNKHN

SEQ ID NO: 362165 - protein, 9 aa, Homo Sapiens
HTSTVHCMH

SEQ ID NO: 362166 - protein, 9 aa, Homo Sapiens
ADARLLHVD

SEQ ID NO: 362167 - protein, 9 aa, Homo Sapiens
ATDICMHCT

SEQ ID NO: 362168 - protein, 9 aa, Homo Sapiens
RHNAEERYN

SEQ ID NO: 362169 - protein, 9 aa, Homo Sapiens
AGNVAARFG

SEQ ID NO: 362170 - protein, 9 aa, Homo Sapiens
SQTELPDKK

SEQ ID NO: 362171 - protein, 9 aa, Homo Sapiens
VKVTSGRET

SEQ ID NO: 362172 - protein, 9 aa, Homo Sapiens
TEHSGWVAT

SEQ ID NO: 362173 - protein, 9 aa, Homo Sapiens
KKKPRVPLM

SEQ ID NO: 362174 - protein, 9 aa, Homo Sapiens
AVPTRKGEQ

SEQ ID NO: 362175 - protein, 9 aa, Homo Sapiens
GSENANLRK

SEQ ID NO: 362176 - protein, 9 aa, Homo Sapiens
FEPQCRPRS

SEQ ID NO: 362177 - protein, 9 aa, Homo Sapiens
EKSCHWPSS

SEQ ID NO: 362178 - protein, 9 aa, Homo Sapiens
DAAKKSSGH

SEQ ID NO: 362179 - protein, 9 aa, Homo Sapiens
TIGFRDYVA

SEQ ID NO: 362180 - protein, 9 aa, Homo Sapiens
CGFLSPSLK

SEQ ID NO: 362181 - protein, 9 aa, Homo Sapiens
SFKEGDTVI

SEQ ID NO: 362182 - protein, 9 aa, Homo Sapiens
GRLENLYYN

SEQ ID NO: 362183 - protein, 9 aa, Homo Sapiens
APENCCFAG

SEQ ID NO: 362184 - protein, 9 aa, Homo Sapiens
DVEYGGPDW

SEQ ID NO: 362185 - protein, 9 aa, Homo Sapiens
GPLGPSWKQ

SEQ ID NO: 362186 - protein, 9 aa, Homo Sapiens
GPDWRCPPP

SEQ ID NO: 362187 - protein, 9 aa, Homo Sapiens
PQPPPPLPS

SEQ ID NO: 362188 - protein, 9 aa, Homo Sapiens
VIAESGSYF

SEQ ID NO: 362189 - protein, 9 aa, Homo Sapiens
TVRDDQADA

SEQ ID NO: 362190 - protein, 9 aa, Homo Sapiens
PENCCFAGN

SEQ ID NO: 362191 - protein, 9 aa, Homo Sapiens
AGENSSGQS

SEQ ID NO: 362192 - protein, 9 aa, Homo Sapiens
PVEVKVTSG

SEQ ID NO: 362193 - protein, 9 aa, Homo Sapiens
GFRDYVALQ

SEQ ID NO: 362194 - protein, 9 aa, Homo Sapiens
PTLPERDHV

SEQ ID NO: 362195 - protein, 9 aa, Homo Sapiens
LYEEAREVF

SEQ ID NO: 362196 - protein, 9 aa, Homo Sapiens
SSRSGKTRC

SEQ ID NO: 362197 - protein, 9 aa, Homo Sapiens
LAQLKSFYN

SEQ ID NO: 362198 - protein, 9 aa, Homo Sapiens
APTEISSDD

SEQ ID NO: 362199 - protein, 9 aa, Homo Sapiens
NLRKKSLSL

SEQ ID NO: 362200 - protein, 9 aa, Homo Sapiens
SEEMYCLML

SEQ ID NO: 362201 - protein, 9 aa, Homo Sapiens
FIFPLVNLP

SEQ ID NO: 362202 - protein, 9 aa, Homo Sapiens
KLNQSLSTT

SEQ ID NO: 362203 - protein, 9 aa, Homo Sapiens
HWVESLKGI

SEQ ID NO: 362204 - protein, 9 aa, Homo Sapiens
FYNARLLCD

SEQ ID NO: 362205 - protein, 9 aa, Homo Sapiens
YMVEDKFVL

SEQ ID NO: 362206 - protein, 9 aa, Homo Sapiens
LLSTARLVP

SEQ ID NO: 362207 - protein, 9 aa, Homo Sapiens
AADARLLHV

SEQ ID NO: 362208 - protein, 9 aa, Homo Sapiens
NRERSSRSG

SEQ ID NO: 362209 - protein, 9 aa, Homo Sapiens
NPEVLLLMA

SEQ ID NO: 362210 - protein, 9 aa, Homo Sapiens
EEAPSAPRQ

SEQ ID NO: 362211 - protein, 9 aa, Homo Sapiens
SCSALKGKS

SEQ ID NO: 362212 - protein, 9 aa, Homo Sapiens
EHSGWVATF

SEQ ID NO: 362213 - protein, 9 aa, Homo Sapiens
SPGFHGYPH

SEQ ID NO: 362214 - protein, 9 aa, Homo Sapiens
TNKWTLCVQ

SEQ ID NO: 362215 - protein, 9 aa, Homo Sapiens
GGQQGPGTH

SEQ ID NO: 362216 - protein, 9 aa, Homo Sapiens
CDPECNEVG

SEQ ID NO: 362217 - protein, 9 aa, Homo Sapiens
AQLKSFYNA

SEQ ID NO: 362218 - protein, 9 aa, Homo Sapiens
DYFRKIPLL

SEQ ID NO: 362219 - protein, 9 aa, Homo Sapiens
PGFHGYPHC

SEQ ID NO: 362220 - protein, 9 aa, Homo Sapiens
GRSPRMLHP

SEQ ID NO: 362221 - protein, 9 aa, Homo Sapiens
HQTWDQLLL

SEQ ID NO: 362222 - protein, 9 aa, Homo Sapiens
AENLEDAAK

SEQ ID NO: 362223 - protein, 9 aa, Homo Sapiens
DSWVEATPR

SEQ ID NO: 362224 - protein, 9 aa, Homo Sapiens
KNKASAFRN

SEQ ID NO: 362225 - protein, 9 aa, Homo Sapiens
IRYSILEEL

SEQ ID NO: 362226 - protein, 9 aa, Homo Sapiens
IKKKKNKAS

SEQ ID NO: 362227 - protein, 9 aa, Homo Sapiens
EPIRYSILE

SEQ ID NO: 362228 - protein, 9 aa, Homo Sapiens
KPAVIAESG

SEQ ID NO: 362229 - protein, 9 aa, Homo Sapiens
CRPRSCTWP

SEQ ID NO: 362230 - protein, 9 aa, Homo Sapiens
ICLYEEARE

SEQ ID NO: 362231 - protein, 9 aa, Homo Sapiens
IANTVDELQ

SEQ ID NO: 362232 - protein, 9 aa, Homo Sapiens
SPSAGDPVG

SEQ ID NO: 362233 - protein, 9 aa, Homo Sapiens
FTGNPGPPG

SEQ ID NO: 362234 - protein, 9 aa, Homo Sapiens
ANTVDELQQ

SEQ ID NO: 362235 - protein, 9 aa, Homo Sapiens
ISTRDPLSK

SEQ ID NO: 362236 - protein, 9 aa, Homo Sapiens
GENSSGQSD

SEQ ID NO: 362237 - protein, 9 aa, Homo Sapiens
YGFRHGASI

SEQ ID NO: 362238 - protein, 9 aa, Homo Sapiens
NSSMPDLEH

SEQ ID NO: 362239 - protein, 9 aa, Homo Sapiens
DDHKNLTVT

SEQ ID NO: 362240 - protein, 9 aa, Homo Sapiens
HTNKWTLCV

SEQ ID NO: 362241 - protein, 9 aa, Homo Sapiens
DRSQGGRSL

SEQ ID NO: 362242 - protein, 9 aa, Homo Sapiens
LPPEPEHPR

SEQ ID NO: 362243 - protein, 9 aa, Homo Sapiens
WRCPPPPYP

SEQ ID NO: 362244 - protein, 9 aa, Homo Sapiens
GKTKIATPQ

SEQ ID NO: 362245 - protein, 9 aa, Homo Sapiens
KECYEEICL

SEQ ID NO: 362246 - protein, 9 aa, Homo Sapiens
MLSPQNQLI

SEQ ID NO: 362247 - protein, 9 aa, Homo Sapiens
LADDMYSLY

SEQ ID NO: 362248 - protein, 9 aa, Homo Sapiens
QGGRSLRDG

SEQ ID NO: 362249 - protein, 9 aa, Homo Sapiens
SSKCPVEVK

SEQ ID NO: 362250 - protein, 9 aa, Homo Sapiens
CVHGACLPT

SEQ ID NO: 362251 - protein, 9 aa, Homo Sapiens
RLAMNKHNN

SEQ ID NO: 362252 - protein, 9 aa, Homo Sapiens
HCRPCDCHE

SEQ ID NO: 362253 - protein, 9 aa, Homo Sapiens
NVDIVLQVV

SEQ ID NO: 362254 - protein, 9 aa, Homo Sapiens
ACLLSTARL

SEQ ID NO: 362255 - protein, 9 aa, Homo Sapiens
HALGDSHAF

SEQ ID NO: 362256 - protein, 9 aa, Homo Sapiens
YIYTHIYIH

SEQ ID NO: 362257 - protein, 9 aa, Homo Sapiens
PPSPPAGRC

SEQ ID NO: 362258 - protein, 9 aa, Homo Sapiens
DICMHCTQT

SEQ ID NO: 362259 - protein, 9 aa, Homo Sapiens
TDICMHCTQ

SEQ ID NO: 362260 - protein, 9 aa, Homo Sapiens
VKVKKKPRV

SEQ ID NO: 362261 - protein, 9 aa, Homo Sapiens
LTAFPSESF

SEQ ID NO: 362262 - protein, 9 aa, Homo Sapiens
LLRHHQQLH

SEQ ID NO: 362263 - protein, 9 aa, Homo Sapiens
SPSLKSSKV

SEQ ID NO: 362264 - protein, 9 aa, Homo Sapiens
DHVPRPDSP

SEQ ID NO: 362265 - protein, 9 aa, Homo Sapiens
LSKITEQEK

SEQ ID NO: 362266 - protein, 9 aa, Homo Sapiens
VDALQKLAD

SEQ ID NO: 362267 - protein, 9 aa, Homo Sapiens
ALAAVVTTG

SEQ ID NO: 362268 - protein, 9 aa, Homo Sapiens
ANLRKKSLS

SEQ ID NO: 362269 - protein, 9 aa, Homo Sapiens
GDPVGQLEP

SEQ ID NO: 362270 - protein, 9 aa, Homo Sapiens
KMKKRIMVH

SEQ ID NO: 362271 - protein, 9 aa, Homo Sapiens
CEHMKRHTL

SEQ ID NO: 362272 - protein, 9 aa, Homo Sapiens
TTPSCSALK

SEQ ID NO: 362273 - protein, 9 aa, Homo Sapiens
ELPDKKIGK

SEQ ID NO: 362274 - protein, 9 aa, Homo Sapiens
HVPRPDSPA

SEQ ID NO: 362275 - protein, 9 aa, Homo Sapiens
IPLLLIDGK

SEQ ID NO: 362276 - protein, 9 aa, Homo Sapiens
LFSSHALGD

SEQ ID NO: 362277 - protein, 9 aa, Homo Sapiens
MESIKKKKN

SEQ ID NO: 362278 - protein, 9 aa, Homo Sapiens
EPEHPRFAA

SEQ ID NO: 362279 - protein, 9 aa, Homo Sapiens
EDYNSEIQE

SEQ ID NO: 362280 - protein, 9 aa, Homo Sapiens
VLLAMSIDC

SEQ ID NO: 362281 - protein, 9 aa, Homo Sapiens
IWVQAENVL

SEQ ID NO: 362282 - protein, 9 aa, Homo Sapiens
EICLYEEAR

SEQ ID NO: 362283 - protein, 9 aa, Homo Sapiens
GLPGFTGNP

SEQ ID NO: 362284 - protein, 9 aa, Homo Sapiens
SVETQVTIV

SEQ ID NO: 362285 - protein, 9 aa, Homo Sapiens
VPANPEVLL

SEQ ID NO: 362286 - protein, 9 aa, Homo Sapiens
RSSRSGKTR

SEQ ID NO: 362287 - protein, 9 aa, Homo Sapiens
IIKKMKKRI

SEQ ID NO: 362288 - protein, 9 aa, Homo Sapiens
ERDHVPRPD

SEQ ID NO: 362289 - protein, 9 aa, Homo Sapiens
YNAFCFTSN

SEQ ID NO: 362290 - protein, 9 aa, Homo Sapiens
FSSHALGDS

SEQ ID NO: 362291 - protein, 9 aa, Homo Sapiens
FHGRLENLY

SEQ ID NO: 362292 - protein, 9 aa, Homo Sapiens
IKVEHVEIK

SEQ ID NO: 362293 - protein, 9 aa, Homo Sapiens
FTRKSFHGR

SEQ ID NO: 362294 - protein, 9 aa, Homo Sapiens
LQVVKSRGI

SEQ ID NO: 362295 - protein, 9 aa, Homo Sapiens
IADYMVEDK

SEQ ID NO: 362296 - protein, 9 aa, Homo Sapiens
SAPAGRSPR

SEQ ID NO: 362297 - protein, 9 aa, Homo Sapiens
HGASINYDD

SEQ ID NO: 362298 - protein, 9 aa, Homo Sapiens
RYSILEELA

SEQ ID NO: 362299 - protein, 9 aa, Homo Sapiens
EHPRFAAFT

SEQ ID NO: 362300 - protein, 9 aa, Homo Sapiens
VGKPVVCAT

SEQ ID NO: 362301 - protein, 9 aa, Homo Sapiens
CVQMSKRRG

SEQ ID NO: 362302 - protein, 9 aa, Homo Sapiens
RLRNLMYSA

SEQ ID NO: 362303 - protein, 9 aa, Homo Sapiens
KCPVEVKVT

SEQ ID NO: 362304 - protein, 9 aa, Homo Sapiens
TDAVYQEAR

SEQ ID NO: 362305 - protein, 9 aa, Homo Sapiens
LVQDYFGSN

SEQ ID NO: 362306 - protein, 9 aa, Homo Sapiens
ADYMKRYLG

SEQ ID NO: 362307 - protein, 9 aa, Homo Sapiens
TSTVHCMHL

SEQ ID NO: 362308 - protein, 9 aa, Homo Sapiens
TKIATPQGA

SEQ ID NO: 362309 - protein, 9 aa, Homo Sapiens
PTEISSDDS

SEQ ID NO: 362310 - protein, 9 aa, Homo Sapiens
AGDPVGQLE

SEQ ID NO: 362311 - protein, 9 aa, Homo Sapiens
ENEAPTEIS

SEQ ID NO: 362312 - protein, 9 aa, Homo Sapiens
KSFYNARLL

SEQ ID NO: 362313 - protein, 9 aa, Homo Sapiens
PVDDTSFHW

SEQ ID NO: 362314 - protein, 9 aa, Homo Sapiens
CACLGGEVG

SEQ ID NO: 362315 - protein, 9 aa, Homo Sapiens
GGPDWRCPP

SEQ ID NO: 362316 - protein, 9 aa, Homo Sapiens
FLEDQDSDN

SEQ ID NO: 362317 - protein, 9 aa, Homo Sapiens
LVGKPVVCA

SEQ ID NO: 362318 - protein, 9 aa, Homo Sapiens
LEDAAKKSS

SEQ ID NO: 362319 - protein, 9 aa, Homo Sapiens
ENLEDAAKK

SEQ ID NO: 362320 - protein, 9 aa, Homo Sapiens
TDLVVSSAN

SEQ ID NO: 362321 - protein, 9 aa, Homo Sapiens
VGRRPAGEN

SEQ ID NO: 362322 - protein, 9 aa, Homo Sapiens
EPAANETMR

SEQ ID NO: 362323 - protein, 9 aa, Homo Sapiens
KDKMILHYI

SEQ ID NO: 362324 - protein, 9 aa, Homo Sapiens
SKITEQEKD

SEQ ID NO: 362325 - protein, 9 aa, Homo Sapiens
STRDPLSKI

SEQ ID NO: 362326 - protein, 9 aa, Homo Sapiens
KKPRVPLMF

SEQ ID NO: 362327 - protein, 9 aa, Homo Sapiens
NSEIQEVEK

SEQ ID NO: 362328 - protein, 9 aa, Homo Sapiens
VEHVEIKDV

SEQ ID NO: 362329 - protein, 9 aa, Homo Sapiens
KPRVPLMFI

SEQ ID NO: 362330 - protein, 9 aa, Homo Sapiens
LDADYMKRY

SEQ ID NO: 362331 - protein, 9 aa, Homo Sapiens
EIQEVEKWL

SEQ ID NO: 362332 - protein, 9 aa, Homo Sapiens
KATDICMHC

SEQ ID NO: 362333 - protein, 9 aa, Homo Sapiens
KAALGTHYR

SEQ ID NO: 362334 - protein, 9 aa, Homo Sapiens
YGHTSTVHC

SEQ ID NO: 362335 - protein, 9 aa, Homo Sapiens
CLMLQCWKQ

SEQ ID NO: 362336 - protein, 9 aa, Homo Sapiens
SIYIMGLVL

SEQ ID NO: 362337 - protein, 9 aa, Homo Sapiens
YSILEELAK

SEQ ID NO: 362338 - protein, 9 aa, Homo Sapiens
LCVQMSKRR

SEQ ID NO: 362339 - protein, 9 aa, Homo Sapiens
GFTGNPGPP

SEQ ID NO: 362340 - protein, 9 aa, Homo Sapiens
VTAILAGVY

SEQ ID NO: 362341 - protein, 9 aa, Homo Sapiens
KEKSCHWPS

SEQ ID NO: 362342 - protein, 9 aa, Homo Sapiens
VLVQDYFGS

SEQ ID NO: 362343 - protein, 9 aa, Homo Sapiens
HRTDPSGDY

SEQ ID NO: 362344 - protein, 9 aa, Homo Sapiens
DFCTDLVVS

SEQ ID NO: 362345 - protein, 9 aa, Homo Sapiens
KKKNKASAF

SEQ ID NO: 362346 - protein, 9 aa, Homo Sapiens
NARLLCDVT

SEQ ID NO: 362347 - protein, 9 aa, Homo Sapiens
PPGLPGFTG

SEQ ID NO: 362348 - protein, 9 aa, Homo Sapiens
VQNGKIYIS

SEQ ID NO: 362349 - protein, 9 aa, Homo Sapiens
DHEDYNSEI

SEQ ID NO: 362350 - protein, 9 aa, Homo Sapiens
LYEDDHKNL

SEQ ID NO: 362351 - protein, 9 aa, Homo Sapiens
VGFGHRTDP

SEQ ID NO: 362352 - protein, 9 aa, Homo Sapiens
GSDEENYPV

SEQ ID NO: 362353 - protein, 9 aa, Homo Sapiens
IHTHTFYVS

SEQ ID NO: 362354 - protein, 9 aa, Homo Sapiens
IDCYVAICC

SEQ ID NO: 362355 - protein, 9 aa, Homo Sapiens
LPRSSTSSR

SEQ ID NO: 362356 - protein, 9 aa, Homo Sapiens
YIYFIFPLV

SEQ ID NO: 362357 - protein, 9 aa, Homo Sapiens
KWTLCVQMS

SEQ ID NO: 362358 - protein, 9 aa, Homo Sapiens
GGAGGGQQG

SEQ ID NO: 362359 - protein, 9 aa, Homo Sapiens
SRTQAGELM

SEQ ID NO: 362360 - protein, 9 aa, Homo Sapiens
ATQVPTVPV

SEQ ID NO: 362361 - protein, 9 aa, Homo Sapiens
LTTIGFRDY

SEQ ID NO: 362362 - protein, 9 aa, Homo Sapiens
IVTAILAGV

SEQ ID NO: 362363 - protein, 9 aa, Homo Sapiens
AVFFTTPSC

SEQ ID NO: 362364 - protein, 9 aa, Homo Sapiens
IKKMKKRIM

SEQ ID NO: 362365 - protein, 9 aa, Homo Sapiens
DFIATYQTN

SEQ ID NO: 362366 - protein, 9 aa, Homo Sapiens
AAHAGAVQN

SEQ ID NO: 362367 - protein, 9 aa, Homo Sapiens
TDRSQGGRS

SEQ ID NO: 362368 - protein, 9 aa, Homo Sapiens
RLMWEVCGS

SEQ ID NO: 362369 - protein, 9 aa, Homo Sapiens
KKEKSCHWP

SEQ ID NO: 362370 - protein, 9 aa, Homo Sapiens
SAVATARHP

SEQ ID NO: 362371 - protein, 9 aa, Homo Sapiens
SWRCNCGLG

SEQ ID NO: 362372 - protein, 9 aa, Homo Sapiens
LGPSWKQEL

SEQ ID NO: 362373 - protein, 9 aa, Homo Sapiens
NHLHVSYTN

SEQ ID NO: 362374 - protein, 9 aa, Homo Sapiens
AGPCDPECN

SEQ ID NO: 362375 - protein, 9 aa, Homo Sapiens
MSPGKEEIF

SEQ ID NO: 362376 - protein, 9 aa, Homo Sapiens
DVATQVPTV

SEQ ID NO: 362377 - protein, 9 aa, Homo Sapiens
NALVSVKKT

SEQ ID NO: 362378 - protein, 9 aa, Homo Sapiens
GRCNLVGKP

SEQ ID NO: 362379 - protein, 9 aa, Homo Sapiens
SILEELAKG

SEQ ID NO: 362380 - protein, 9 aa, Homo Sapiens
GTKVVYEVH

SEQ ID NO: 362381 - protein, 9 aa, Homo Sapiens
VLGTSMSPQ

SEQ ID NO: 362382 - protein, 9 aa, Homo Sapiens
FRKIPLLLI

SEQ ID NO: 362383 - protein, 9 aa, Homo Sapiens
GLVAHLLSK

SEQ ID NO: 362384 - protein, 9 aa, Homo Sapiens
RKKSLSLED

SEQ ID NO: 362385 - protein, 9 aa, Homo Sapiens
GIQAFRNLF

SEQ ID NO: 362386 - protein, 9 aa, Homo Sapiens
RMSPCHRDG

SEQ ID NO: 362387 - protein, 9 aa, Homo Sapiens
TRKGEQTSS

SEQ ID NO: 362388 - protein, 9 aa, Homo Sapiens
RLLHVDSSR

SEQ ID NO: 362389 - protein, 9 aa, Homo Sapiens
ATPQGAAPP

SEQ ID NO: 362390 - protein, 9 aa, Homo Sapiens
PPPLPSQPQ

SEQ ID NO: 362391 - protein, 9 aa, Homo Sapiens
IFPLVNLPN

SEQ ID NO: 362392 - protein, 9 aa, Homo Sapiens
LKHVRMEEE

SEQ ID NO: 362393 - protein, 9 aa, Homo Sapiens
ENCCFAGNV

SEQ ID NO: 362394 - protein, 9 aa, Homo Sapiens
LRQPPAVPT

SEQ ID NO: 362395 - protein, 9 aa, Homo Sapiens
QAFRNLFSS

SEQ ID NO: 362396 - protein, 9 aa, Homo Sapiens
FLSPSLKSS

SEQ ID NO: 362397 - protein, 9 aa, Homo Sapiens
WAADARLLH

SEQ ID NO: 362398 - protein, 9 aa, Homo Sapiens
MRHGCLRLN

SEQ ID NO: 362399 - protein, 9 aa, Homo Sapiens
FFTTPSCSA

SEQ ID NO: 362400 - protein, 9 aa, Homo Sapiens
VKSRGIELS

SEQ ID NO: 362401 - protein, 9 aa, Homo Sapiens
YQTNYGFSN

SEQ ID NO: 362402 - protein, 9 aa, Homo Sapiens
GIWVQAENV

SEQ ID NO: 362403 - protein, 9 aa, Homo Sapiens
NEAPTEISS

SEQ ID NO: 362404 - protein, 9 aa, Homo Sapiens
GGCKAALGT

SEQ ID NO: 362405 - protein, 9 aa, Homo Sapiens
VNLPNILVD

SEQ ID NO: 362406 - protein, 9 aa, Homo Sapiens
DTSFHWVES

SEQ ID NO: 362407 - protein, 9 aa, Homo Sapiens
ILEELAKGS

SEQ ID NO: 362408 - protein, 9 aa, Homo Sapiens
CKAALGTHY

SEQ ID NO: 362409 - protein, 9 aa, Homo Sapiens
TGRGPLGPS

SEQ ID NO: 362410 - protein, 9 aa, Homo Sapiens
LLHVDSSRW

SEQ ID NO: 362411 - protein, 9 aa, Homo Sapiens
LEELAKGSV

SEQ ID NO: 362412 - protein, 9 aa, Homo Sapiens
ICMHCTQTR

SEQ ID NO: 362413 - protein, 9 aa, Homo Sapiens
NPKVITAPQ

SEQ ID NO: 362414 - protein, 9 aa, Homo Sapiens
ENRPDARLA

SEQ ID NO: 362415 - protein, 9 aa, Homo Sapiens
TPQGAAPPG

SEQ ID NO: 362416 - protein, 9 aa, Homo Sapiens
LKSFYNARL

SEQ ID NO: 362417 - protein, 9 aa, Homo Sapiens
KKSLSLEDQ

SEQ ID NO: 362418 - protein, 9 aa, Homo Sapiens
RQPPAVPTR

SEQ ID NO: 362419 - protein, 9 aa, Homo Sapiens
IEWMAGGLV

SEQ ID NO: 362420 - protein, 9 aa, Homo Sapiens
KEEIFYIFE

SEQ ID NO: 362421 - protein, 9 aa, Homo Sapiens
CNCGLGPFL

SEQ ID NO: 362422 - protein, 9 aa, Homo Sapiens
LLAVHWFFA

SEQ ID NO: 362423 - protein, 9 aa, Homo Sapiens
PDKKIGKKR

SEQ ID NO: 362424 - protein, 9 aa, Homo Sapiens
TQVTIVTAI

SEQ ID NO: 362425 - protein, 9 aa, Homo Sapiens
YCNSSMPDL

SEQ ID NO: 362426 - protein, 9 aa, Homo Sapiens
RNLMYSAPL

SEQ ID NO: 362427 - protein, 9 aa, Homo Sapiens
KLEERLKHV

SEQ ID NO: 362428 - protein, 9 aa, Homo Sapiens
APRQSVTVL

SEQ ID NO: 362429 - protein, 9 aa, Homo Sapiens
LTDRSQGGR

SEQ ID NO: 362430 - protein, 9 aa, Homo Sapiens
MSIDCYVAI

SEQ ID NO: 362431 - protein, 9 aa, Homo Sapiens
LGGEVGGPA

SEQ ID NO: 362432 - protein, 9 aa, Homo Sapiens
LQKLADDMY

SEQ ID NO: 362433 - protein, 9 aa, Homo Sapiens
TSFHWVESL

SEQ ID NO: 362434 - protein, 9 aa, Homo Sapiens
LPDKKIGKK

SEQ ID NO: 362435 - protein, 9 aa, Homo Sapiens
PEFEPQCRP

SEQ ID NO: 362436 - protein, 9 aa, Homo Sapiens
YIKFPRSIR

SEQ ID NO: 362437 - protein, 9 aa, Homo Sapiens
AVLPAALAA

SEQ ID NO: 362438 - protein, 9 aa, Homo Sapiens
KDSLLAVHW

SEQ ID NO: 362439 - protein, 9 aa, Homo Sapiens
NQDDDSNLL

SEQ ID NO: 362440 - protein, 9 aa, Homo Sapiens
TQVPTVPVP

SEQ ID NO: 362441 - protein, 9 aa, Homo Sapiens
VCRDSVSQK

SEQ ID NO: 362442 - protein, 9 aa, Homo Sapiens
ERLKHVRME

SEQ ID NO: 362443 - protein, 9 aa, Homo Sapiens
RTQAGELMV

SEQ ID NO: 362444 - protein, 9 aa, Homo Sapiens
LNQSLSTTQ

SEQ ID NO: 362445 - protein, 9 aa, Homo Sapiens
GNLTGTAGV

SEQ ID NO: 362446 - protein, 9 aa, Homo Sapiens
MIGRCNLVG

SEQ ID NO: 362447 - protein, 9 aa, Homo Sapiens
RHHQQLHNI

SEQ ID NO: 362448 - protein, 9 aa, Homo Sapiens
YRLMWEVCG

SEQ ID NO: 362449 - protein, 9 aa, Homo Sapiens
RDPLSKITE

SEQ ID NO: 362450 - protein, 9 aa, Homo Sapiens
IYIHTHTFY

SEQ ID NO: 362451 - protein, 9 aa, Homo Sapiens
DLLSTKDSW

SEQ ID NO: 362452 - protein, 9 aa, Homo Sapiens
YIMGLVLEW

SEQ ID NO: 362453 - protein, 9 aa, Homo Sapiens
DYMKRYLGD

SEQ ID NO: 362454 - protein, 9 aa, Homo Sapiens
IPLLEDIPL

SEQ ID NO: 362455 - protein, 9 aa, Homo Sapiens
LLSTKDSWV

SEQ ID NO: 362456 - protein, 9 aa, Homo Sapiens
RCNLVGKPV

SEQ ID NO: 362457 - protein, 9 aa, Homo Sapiens
EENYPVIVP

SEQ ID NO: 362458 - protein, 9 aa, Homo Sapiens
NAHWSTDAV

SEQ ID NO: 362459 - protein, 9 aa, Homo Sapiens
QPPPPLPSQ

SEQ ID NO: 362460 - protein, 9 aa, Homo Sapiens
SDGGCKAAL

SEQ ID NO: 362461 - protein, 9 aa, Homo Sapiens
EVCGSKGEV

SEQ ID NO: 362462 - protein, 9 aa, Homo Sapiens
CNSSMPDLE

SEQ ID NO: 362463 - protein, 9 aa, Homo Sapiens
STDAVYQEA

SEQ ID NO: 362464 - protein, 9 aa, Homo Sapiens
RKIPLLLID

SEQ ID NO: 362465 - protein, 9 aa, Homo Sapiens
ASAPAGRSP

SEQ ID NO: 362466 - protein, 9 aa, Homo Sapiens
EMRMNPKVI

SEQ ID NO: 362467 - protein, 9 aa, Homo Sapiens
CSEEMYCLM

SEQ ID NO: 362468 - protein, 9 aa, Homo Sapiens
AESGSYFCT

SEQ ID NO: 362469 - protein, 9 aa, Homo Sapiens
FSIYIMGLV

SEQ ID NO: 362470 - protein, 9 aa, Homo Sapiens
ADYMVEDKF

SEQ ID NO: 362471 - protein, 9 aa, Homo Sapiens
NLVGKPVVC

SEQ ID NO: 362472 - protein, 9 aa, Homo Sapiens
QKLADDMYS

SEQ ID NO: 362473 - protein, 9 aa, Homo Sapiens
NLMYSAPLY

SEQ ID NO: 362474 - protein, 9 aa, Homo Sapiens
QGAAPPGQK

SEQ ID NO: 362475 - protein, 9 aa, Homo Sapiens
HYIYFIFPL

SEQ ID NO: 362476 - protein, 9 aa, Homo Sapiens
PPAGRCRRG

SEQ ID NO: 362477 - protein, 9 aa, Homo Sapiens
NLFSSSWFH

SEQ ID NO: 362478 - protein, 9 aa, Homo Sapiens
TTVRDDQAD

SEQ ID NO: 362479 - protein, 9 aa, Homo Sapiens
RQSVTVLTV

SEQ ID NO: 362480 - protein, 9 aa, Homo Sapiens
IQEVEKWLL

SEQ ID NO: 362481 - protein, 9 aa, Homo Sapiens
QDYFGSNPG

SEQ ID NO: 362482 - protein, 9 aa, Homo Sapiens
SFHWVESLK

SEQ ID NO: 362483 - protein, 9 aa, Homo Sapiens
TRDPLSKIT

SEQ ID NO: 362484 - protein, 9 aa, Homo Sapiens
NKLNQSLST

SEQ ID NO: 362485 - protein, 9 aa, Homo Sapiens
DPLSKITEQ

SEQ ID NO: 362486 - protein, 9 aa, Homo Sapiens
PESQAMITR

SEQ ID NO: 362487 - protein, 9 aa, Homo Sapiens
PSWKQELVN

SEQ ID NO: 362488 - protein, 9 aa, Homo Sapiens
VGPLLRHHQ

SEQ ID NO: 362489 - protein, 9 aa, Homo Sapiens
TIVTAILAG

SEQ ID NO: 362490 - protein, 9 aa, Homo Sapiens
DKMILHYIY

SEQ ID NO: 362491 - protein, 9 aa, Homo Sapiens
WRCNCGLGP

SEQ ID NO: 362492 - protein, 9 aa, Homo Sapiens
SPGKEEIFY

SEQ ID NO: 362493 - protein, 9 aa, Homo Sapiens
DLVVSSANF

SEQ ID NO: 362494 - protein, 9 aa, Homo Sapiens
KIPLLLIDG

SEQ ID NO: 362495 - protein, 9 aa, Homo Sapiens
THIYIHTHT

SEQ ID NO: 362496 - protein, 9 aa, Homo Sapiens
EDDDDDPTE

SEQ ID NO: 362497 - protein, 9 aa, Homo Sapiens
NLTVTREQV

SEQ ID NO: 362498 - protein, 9 aa, Homo Sapiens
PAGRCRRGA

SEQ ID NO: 362499 - protein, 9 aa, Homo Sapiens
KHVRMEEEG

SEQ ID NO: 362500 - protein, 9 aa, Homo Sapiens
ILHYIYFIF

SEQ ID NO: 362501 - protein, 9 aa, Homo Sapiens
SVGIIKKMK

SEQ ID NO: 362502 - protein, 9 aa, Homo Sapiens
APYAVDVAT

SEQ ID NO: 362503 - protein, 9 aa, Homo Sapiens
GVCRDSVSQ

SEQ ID NO: 362504 - protein, 9 aa, Homo Sapiens
RGIQAFRNL

SEQ ID NO: 362505 - protein, 9 aa, Homo Sapiens
SRCTSFCQF

SEQ ID NO: 362506 - protein, 9 aa, Homo Sapiens
KKMKKRIMV

SEQ ID NO: 362507 - protein, 9 aa, Homo Sapiens
YFIFPLVNL

SEQ ID NO: 362508 - protein, 9 aa, Homo Sapiens
GRGPLGPSW

SEQ ID NO: 362509 - protein, 9 aa, Homo Sapiens
EDDHKNLTV

SEQ ID NO: 362510 - protein, 9 aa, Homo Sapiens
LSTKDSWVE

SEQ ID NO: 362511 - protein, 9 aa, Homo Sapiens
RCEHMKRHT

SEQ ID NO: 362512 - protein, 9 aa, Homo Sapiens
SDNRLEVGA

SEQ ID NO: 362513 - protein, 9 aa, Homo Sapiens
AANETMRHG

SEQ ID NO: 362514 - protein, 9 aa, Homo Sapiens
NEVGCDGPG

SEQ ID NO: 362515 - protein, 9 aa, Homo Sapiens
CNLVGKPVV

SEQ ID NO: 362516 - protein, 9 aa, Homo Sapiens
VVKSRGIEL

SEQ ID NO: 362517 - protein, 9 aa, Homo Sapiens
CFSIYIMGL

SEQ ID NO: 362518 - protein, 9 aa, Homo Sapiens
EVGGPAAGP

SEQ ID NO: 362519 - protein, 9 aa, Homo Sapiens
CLLSTARLV

SEQ ID NO: 362520 - protein, 9 aa, Homo Sapiens
PAGENSSGQ

SEQ ID NO: 362521 - protein, 9 aa, Homo Sapiens
RLENLYYNG

SEQ ID NO: 362522 - protein, 9 aa, Homo Sapiens
GGGQQGPGT

SEQ ID NO: 362523 - protein, 9 aa, Homo Sapiens
SPTLPERDH

SEQ ID NO: 362524 - protein, 9 aa, Homo Sapiens
AMSIDCYVA

SEQ ID NO: 362525 - protein, 9 aa, Homo Sapiens
DKLDADYMK

SEQ ID NO: 362526 - protein, 9 aa, Homo Sapiens
SYTTVRDDQ

SEQ ID NO: 362527 - protein, 9 aa, Homo Sapiens
LCVHGACLP

SEQ ID NO: 362528 - protein, 9 aa, Homo Sapiens
ERYNAFCFT

SEQ ID NO: 362529 - protein, 9 aa, Homo Sapiens
RERSSRSGK

SEQ ID NO: 362530 - protein, 9 aa, Homo Sapiens
PAALAAVVT

SEQ ID NO: 362531 - protein, 9 aa, Homo Sapiens
EWMAGGLVA

SEQ ID NO: 362532 - protein, 9 aa, Homo Sapiens
KSFHGRLEN

SEQ ID NO: 362533 - protein, 9 aa, Homo Sapiens
GKKFTRCEH

SEQ ID NO: 362534 - protein, 9 aa, Homo Sapiens
GRCRRGADL

SEQ ID NO: 362535 - protein, 9 aa, Homo Sapiens
EPQCRPRSC

SEQ ID NO: 362536 - protein, 9 aa, Homo Sapiens
RSSKCPVEV

SEQ ID NO: 362537 - protein, 9 aa, Homo Sapiens
LTVTREQVD

SEQ ID NO: 362538 - protein, 9 aa, Homo Sapiens
LEPAANETM

SEQ ID NO: 362539 - protein, 9 aa, Homo Sapiens
AENVLGTSM

SEQ ID NO: 362540 - protein, 9 aa, Homo Sapiens
LRLPPEPEH

SEQ ID NO: 362541 - protein, 9 aa, Homo Sapiens
VVGPLLRHH

SEQ ID NO: 362542 - protein, 9 aa, Homo Sapiens
TPSCSALKG

SEQ ID NO: 362543 - protein, 9 aa, Homo Sapiens
LSTTQSKVF

SEQ ID NO: 362544 - protein, 9 aa, Homo Sapiens
ENYPVIVPT

SEQ ID NO: 362545 - protein, 9 aa, Homo Sapiens
LLQSNNIAN

SEQ ID NO: 362546 - protein, 9 aa, Homo Sapiens
KNLTVTREQ

SEQ ID NO: 362547 - protein, 9 aa, Homo Sapiens
LGHNSWRCN

SEQ ID NO: 362548 - protein, 9 aa, Homo Sapiens
SLEHQTWDQ

SEQ ID NO: 362549 - protein, 9 aa, Homo Sapiens
PRVPLMFII

SEQ ID NO: 362550 - protein, 9 aa, Homo Sapiens
NMRYCNSSM

SEQ ID NO: 362551 - protein, 9 aa, Homo Sapiens
MYCLMLQCW

SEQ ID NO: 362552 - protein, 9 aa, Homo Sapiens
AWGIKVEHV

SEQ ID NO: 362553 - protein, 9 aa, Homo Sapiens
GEVGGPAAG

SEQ ID NO: 362554 - protein, 9 aa, Homo Sapiens
ARHPRWLCA

SEQ ID NO: 362555 - protein, 9 aa, Homo Sapiens
VKKKPRVPL

SEQ ID NO: 362556 - protein, 9 aa, Homo Sapiens
APAGRSPRM

SEQ ID NO: 362557 - protein, 9 aa, Homo Sapiens
LGDSHAFSE

SEQ ID NO: 362558 - protein, 9 aa, Homo Sapiens
GGDQSEEEL

SEQ ID NO: 362559 - protein, 9 aa, Homo Sapiens
LVDALQKLA

SEQ ID NO: 362560 - protein, 9 aa, Homo Sapiens
CEPIRYSIL

SEQ ID NO: 362561 - protein, 9 aa, Homo Sapiens
SCHWPSSPV

SEQ ID NO: 362562 - protein, 9 aa, Homo Sapiens
MVEDKFVLE

SEQ ID NO: 362563 - protein, 9 aa, Homo Sapiens
KMILHYIYF

SEQ ID NO: 362564 - protein, 9 aa, Homo Sapiens
VATYCGFLS

SEQ ID NO: 362565 - protein, 9 aa, Homo Sapiens
QTELPDKKI

SEQ ID NO: 362566 - protein, 9 aa, Homo Sapiens
DDQADAKFR

SEQ ID NO: 362567 - protein, 9 aa, Homo Sapiens
LNAHWSTDA

SEQ ID NO: 362568 - protein, 9 aa, Homo Sapiens
IQAFRNLFS

SEQ ID NO: 362569 - protein, 9 aa, Homo Sapiens
HNAEERYNA

SEQ ID NO: 362570 - protein, 9 aa, Homo Sapiens
NEARLRNLM

SEQ ID NO: 362571 - protein, 9 aa, Homo Sapiens
SAGDPVGQL

SEQ ID NO: 362572 - protein, 9 aa, Homo Sapiens
ETGRMSPCH

SEQ ID NO: 362573 - protein, 9 aa, Homo Sapiens
TNYGFSNDG

SEQ ID NO: 362574 - protein, 9 aa, Homo Sapiens
EEMYCLMLQ

SEQ ID NO: 362575 - protein, 9 aa, Homo Sapiens
NAFCFTSNL

SEQ ID NO: 362576 - protein, 9 aa, Homo Sapiens
CRDSVSQKG

SEQ ID NO: 362577 - protein, 9 aa, Homo Sapiens
YPVIVPTRV

SEQ ID NO: 362578 - protein, 9 aa, Homo Sapiens
TKDSWVEAT

SEQ ID NO: 362579 - protein, 9 aa, Homo Sapiens
AVIAESGSY

SEQ ID NO: 362580 - protein, 9 aa, Homo Sapiens
EERLKHVRM

SEQ ID NO: 362581 - protein, 9 aa, Homo Sapiens
TRCEHMKRH

SEQ ID NO: 362582 - protein, 9 aa, Homo Sapiens
SPKDKMILH

SEQ ID NO: 362583 - protein, 9 aa, Homo Sapiens
DPECNEVGC

SEQ ID NO: 362584 - protein, 9 aa, Homo Sapiens
QVVKSRGIE

SEQ ID NO: 362585 - protein, 9 aa, Homo Sapiens
IKKEKSCHW

SEQ ID NO: 362586 - protein, 9 aa, Homo Sapiens
QPPAVPTRK

SEQ ID NO: 362587 - protein, 9 aa, Homo Sapiens
LSPQNQLIR

SEQ ID NO: 362588 - protein, 9 aa, Homo Sapiens
GAGGGQQGP

SEQ ID NO: 362589 - protein, 9 aa, Homo Sapiens
SEIQEVEKW

SEQ ID NO: 362590 - protein, 9 aa, Homo Sapiens
RLPPEPEHP

SEQ ID NO: 362591 - protein, 9 aa, Homo Sapiens
PAVIAESGS

SEQ ID NO: 362592 - protein, 9 aa, Homo Sapiens
DKKIGKKRK

SEQ ID NO: 362593 - protein, 9 aa, Homo Sapiens
DNQDDDSNL

SEQ ID NO: 362594 - protein, 9 aa, Homo Sapiens
IHPESQAMI

SEQ ID NO: 362595 - protein, 9 aa, Homo Sapiens
VVSSANFIP

SEQ ID NO: 362596 - protein, 9 aa, Homo Sapiens
LMYSAPLYV

SEQ ID NO: 362597 - protein, 9 aa, Homo Sapiens
SHALGDSHA

SEQ ID NO: 362598 - protein, 9 aa, Homo Sapiens
IRRNRERSS

SEQ ID NO: 362599 - protein, 9 aa, Homo Sapiens
LRERSQAGG

SEQ ID NO: 362600 - protein, 9 aa, Homo Sapiens
RYCNSSMPD

SEQ ID NO: 362601 - protein, 9 aa, Homo Sapiens
ETQVTIVTA

SEQ ID NO: 362602 - protein, 9 aa, Homo Sapiens
AFRNLFSSS

SEQ ID NO: 362603 - protein, 9 aa, Homo Sapiens
ALNAHWSTD

SEQ ID NO: 362604 - protein, 9 aa, Homo Sapiens
RGPLGPSWK

SEQ ID NO: 362605 - protein, 9 aa, Homo Sapiens
PECNEVGCD

SEQ ID NO: 362606 - protein, 9 aa, Homo Sapiens
HGYPHCRPC

SEQ ID NO: 362607 - protein, 9 aa, Homo Sapiens
TMRHGCLRL

SEQ ID NO: 362608 - protein, 9 aa, Homo Sapiens
DALQKLADD

SEQ ID NO: 362609 - protein, 9 aa, Homo Sapiens
GSVGIIKKM

SEQ ID NO: 362610 - protein, 9 aa, Homo Sapiens
HWPSSPVPL

SEQ ID NO: 362611 - protein, 9 aa, Homo Sapiens
DDTSFHWVE

SEQ ID NO: 362612 - protein, 9 aa, Homo Sapiens
GSYTTVRDD

SEQ ID NO: 362613 - protein, 9 aa, Homo Sapiens
VRDDQADAK

SEQ ID NO: 362614 - protein, 9 aa, Homo Sapiens
PDWRCPPPP

SEQ ID NO: 362615 - protein, 9 aa, Homo Sapiens
RSPRMLHPA

SEQ ID NO: 362616 - protein, 9 aa, Homo Sapiens
RCRRGADLA

SEQ ID NO: 362617 - protein, 9 aa, Homo Sapiens
DAWGIKVEH

SEQ ID NO: 362618 - protein, 9 aa, Homo Sapiens
DIPLLEDIP

SEQ ID NO: 362619 - protein, 9 aa, Homo Sapiens
RNLFSSSWF

SEQ ID NO: 362620 - protein, 9 aa, Homo Sapiens
ENANLRKKS

SEQ ID NO: 362621 - protein, 9 aa, Homo Sapiens
LAVHWFFAH

SEQ ID NO: 362622 - protein, 9 aa, Homo Sapiens
ANETMRHGC

SEQ ID NO: 362623 - protein, 9 aa, Homo Sapiens
RKDSLLAVH

SEQ ID NO: 362624 - protein, 9 aa, Homo Sapiens
VLLLMASSQ

SEQ ID NO: 362625 - protein, 9 aa, Homo Sapiens
VELPRSSTS

SEQ ID NO: 362626 - protein, 9 aa, Homo Sapiens
GGNLTGTAG

SEQ ID NO: 362627 - protein, 9 aa, Homo Sapiens
EDNQDDDSN

SEQ ID NO: 362628 - protein, 9 aa, Homo Sapiens
YEDDHKNLT

SEQ ID NO: 362629 - protein, 9 aa, Homo Sapiens
SNLLQDLSP

SEQ ID NO: 362630 - protein, 9 aa, Homo Sapiens
SIKKKKNKA

SEQ ID NO: 362631 - protein, 9 aa, Homo Sapiens
GHRTDPSGD

SEQ ID NO: 362632 - protein, 9 aa, Homo Sapiens
LMESIKKKK

SEQ ID NO: 362633 - protein, 9 aa, Homo Sapiens
SCSRTQAGE

SEQ ID NO: 362634 - protein, 9 aa, Homo Sapiens
REEEEEEDE

SEQ ID NO: 362635 - protein, 9 aa, Homo Sapiens
RSLRDGSLE

SEQ ID NO: 362636 - protein, 9 aa, Homo Sapiens
FKPAVIAES

SEQ ID NO: 362637 - protein, 9 aa, Homo Sapiens
SQGGRSLRD

SEQ ID NO: 362638 - protein, 9 aa, Homo Sapiens
TLTTIGFRD

SEQ ID NO: 362639 - protein, 9 aa, Homo Sapiens
YEVHSGGTV

SEQ ID NO: 362640 - protein, 9 aa, Homo Sapiens
ARLRNLMYS

SEQ ID NO: 362641 - protein, 9 aa, Homo Sapiens
CRRGADLAL

SEQ ID NO: 362642 - protein, 9 aa, Homo Sapiens
FSPKDKMIL

SEQ ID NO: 362643 - protein, 9 aa, Homo Sapiens
RHPRWLCAG

SEQ ID NO: 362644 - protein, 9 aa, Homo Sapiens
WMAGGLVAH

SEQ ID NO: 362645 - protein, 9 aa, Homo Sapiens
PQNQLIRVI

SEQ ID NO: 362646 - protein, 9 aa, Homo Sapiens
WIHPESQAM

SEQ ID NO: 362647 - protein, 9 aa, Homo Sapiens
YTTVRDDQA

SEQ ID NO: 362648 - protein, 9 aa, Homo Sapiens
ICGKKFTRC

SEQ ID NO: 362649 - protein, 9 aa, Homo Sapiens
QKGELTPLP

SEQ ID NO: 362650 - protein, 9 aa, Homo Sapiens
KKNKASAFR

SEQ ID NO: 362651 - protein, 9 aa, Homo Sapiens
FIATYQTNY

SEQ ID NO: 362652 - protein, 9 aa, Homo Sapiens
GFLSPSLKS

SEQ ID NO: 362653 - protein, 9 aa, Homo Sapiens
GHTSTVHCM

SEQ ID NO: 362654 - protein, 9 aa, Homo Sapiens
RENRPDARL

SEQ ID NO: 362655 - protein, 9 aa, Homo Sapiens
WPSSPVPLV

SEQ ID NO: 362656 - protein, 9 aa, Homo Sapiens
TAGVILSPN

SEQ ID NO: 362657 - protein, 9 aa, Homo Sapiens
VGGPAAGPL

SEQ ID NO: 362658 - protein, 9 aa, Homo Sapiens
YNARLLCDV

SEQ ID NO: 362659 - protein, 9 aa, Homo Sapiens
KITEQEKDF

SEQ ID NO: 362660 - protein, 9 aa, Homo Sapiens
KFSLEHQTW

SEQ ID NO: 362661 - protein, 9 aa, Homo Sapiens
LAMNKHNNE

SEQ ID NO: 362662 - protein, 9 aa, Homo Sapiens
LRHHQQLHN

SEQ ID NO: 362663 - protein, 9 aa, Homo Sapiens
AKKSSGHMQ

SEQ ID NO: 362664 - protein, 9 aa, Homo Sapiens
MAGGLVAHL

SEQ ID NO: 362665 - protein, 9 aa, Homo Sapiens
VYEVHSGGT

SEQ ID NO: 362666 - protein, 9 aa, Homo Sapiens
GTAGVILSP

SEQ ID NO: 362667 - protein, 9 aa, Homo Sapiens
TRKSFHGRL

SEQ ID NO: 362668 - protein, 9 aa, Homo Sapiens
LEHQTWDQL

SEQ ID NO: 362669 - protein, 9 aa, Homo Sapiens
TGNPGPPGL

SEQ ID NO: 362670 - protein, 9 aa, Homo Sapiens
DSNLLQDLS

SEQ ID NO: 362671 - protein, 9 aa, Homo Sapiens
YNSEIQEVE

SEQ ID NO: 362672 - protein, 9 aa, Homo Sapiens
QSNNIANTV

SEQ ID NO: 362673 - protein, 9 aa, Homo Sapiens
CHWPSSPVP

SEQ ID NO: 362674 - protein, 9 aa, Homo Sapiens
RPDARLAMN

SEQ ID NO: 362675 - protein, 9 aa, Homo Sapiens
EDKFVLESE

SEQ ID NO: 362676 - protein, 9 aa, Homo Sapiens
EHVEIKDVK

SEQ ID NO: 362677 - protein, 9 aa, Homo Sapiens
LWEMKPRRN

SEQ ID NO: 362678 - protein, 9 aa, Homo Sapiens
VAKSYASTP

SEQ ID NO: 362679 - protein, 9 aa, Homo Sapiens
VLRHEPRQT

SEQ ID NO: 362680 - protein, 9 aa, Homo Sapiens
PGPQCTTSV

SEQ ID NO: 362681 - protein, 9 aa, Homo Sapiens
GDEAVDKPT

SEQ ID NO: 362682 - protein, 9 aa, Homo Sapiens
PEEPSSTQE

SEQ ID NO: 362683 - protein, 9 aa, Homo Sapiens
LKNVISRYT

SEQ ID NO: 362684 - protein, 9 aa, Homo Sapiens
TVTKDRIIG

SEQ ID NO: 362685 - protein, 9 aa, Homo Sapiens
PGRASASDC

SEQ ID NO: 362686 - protein, 9 aa, Homo Sapiens
HPLIHSLFH

SEQ ID NO: 362687 - protein, 9 aa, Homo Sapiens
IGAGPKGNY

SEQ ID NO: 362688 - protein, 9 aa, Homo Sapiens
LDRWSKETL

SEQ ID NO: 362689 - protein, 9 aa, Homo Sapiens
NKRSYQEDG

SEQ ID NO: 362690 - protein, 9 aa, Homo Sapiens
RIHTVEKPY

SEQ ID NO: 362691 - protein, 9 aa, Homo Sapiens
FDLSLARSF

SEQ ID NO: 362692 - protein, 9 aa, Homo Sapiens
AFLEQVNHI

SEQ ID NO: 362693 - protein, 9 aa, Homo Sapiens
AVDKPTYAT

SEQ ID NO: 362694 - protein, 9 aa, Homo Sapiens
EDNSLALGV

SEQ ID NO: 362695 - protein, 9 aa, Homo Sapiens
TEIDTIAAD

SEQ ID NO: 362696 - protein, 9 aa, Homo Sapiens
CTTSVSARA

SEQ ID NO: 362697 - protein, 9 aa, Homo Sapiens
PPHCSIPPA

SEQ ID NO: 362698 - protein, 9 aa, Homo Sapiens
GEEFPCHRA

SEQ ID NO: 362699 - protein, 9 aa, Homo Sapiens
TVDGFTDAS

SEQ ID NO: 362700 - protein, 9 aa, Homo Sapiens
SYNQEKQLK

SEQ ID NO: 362701 - protein, 9 aa, Homo Sapiens
RNPQVTLED

SEQ ID NO: 362702 - protein, 9 aa, Homo Sapiens
PRGTHGSFA

SEQ ID NO: 362703 - protein, 9 aa, Homo Sapiens
NDDDSDDRD

SEQ ID NO: 362704 - protein, 9 aa, Homo Sapiens
ILAQDVHNR

SEQ ID NO: 362705 - protein, 9 aa, Homo Sapiens
NFKQNQAFQ

SEQ ID NO: 362706 - protein, 9 aa, Homo Sapiens
EELDEECEQ

SEQ ID NO: 362707 - protein, 9 aa, Homo Sapiens
HSYPPPTPN

SEQ ID NO: 362708 - protein, 9 aa, Homo Sapiens
GTVRAWCQV

SEQ ID NO: 362709 - protein, 9 aa, Homo Sapiens
TLYPSHPSN

SEQ ID NO: 362710 - protein, 9 aa, Homo Sapiens
ESESQTRSP

SEQ ID NO: 362711 - protein, 9 aa, Homo Sapiens
EDLEAIRLW

SEQ ID NO: 362712 - protein, 9 aa, Homo Sapiens
SENPGTVRA

SEQ ID NO: 362713 - protein, 9 aa, Homo Sapiens
SKNEGKRWE

SEQ ID NO: 362714 - protein, 9 aa, Homo Sapiens
SFNNPAIRI

SEQ ID NO: 362715 - protein, 9 aa, Homo Sapiens
VTNPAESIP

SEQ ID NO: 362716 - protein, 9 aa, Homo Sapiens
KQKKRQCVS

SEQ ID NO: 362717 - protein, 9 aa, Homo Sapiens
RAGGCSPGP

SEQ ID NO: 362718 - protein, 9 aa, Homo Sapiens
VHRFAWHVS

SEQ ID NO: 362719 - protein, 9 aa, Homo Sapiens
SQRFEMIEF

SEQ ID NO: 362720 - protein, 9 aa, Homo Sapiens
LTLYPSHPS

SEQ ID NO: 362721 - protein, 9 aa, Homo Sapiens
FTKPNYQLI

SEQ ID NO: 362722 - protein, 9 aa, Homo Sapiens
QGCSPGSLG

SEQ ID NO: 362723 - protein, 9 aa, Homo Sapiens
PQVTLEDGY

SEQ ID NO: 362724 - protein, 9 aa, Homo Sapiens
TEGHDQPRL

SEQ ID NO: 362725 - protein, 9 aa, Homo Sapiens
IGDEAVDKP

SEQ ID NO: 362726 - protein, 9 aa, Homo Sapiens
GRALLSSRS

SEQ ID NO: 362727 - protein, 9 aa, Homo Sapiens
PSHPSNPLV

SEQ ID NO: 362728 - protein, 9 aa, Homo Sapiens
VSHPVLTLR

SEQ ID NO: 362729 - protein, 9 aa, Homo Sapiens
RSLGEQDQT

SEQ ID NO: 362730 - protein, 9 aa, Homo Sapiens
TLAAATSSS

SEQ ID NO: 362731 - protein, 9 aa, Homo Sapiens
SCEDNSLAL

SEQ ID NO: 362732 - protein, 9 aa, Homo Sapiens
YIQEALKSD

SEQ ID NO: 362733 - protein, 9 aa, Homo Sapiens
HPTNVVAIV

SEQ ID NO: 362734 - protein, 9 aa, Homo Sapiens
NQQRRRSIR

SEQ ID NO: 362735 - protein, 9 aa, Homo Sapiens
HRCGKRKPL

SEQ ID NO: 362736 - protein, 9 aa, Homo Sapiens
FEMIEFDES

SEQ ID NO: 362737 - protein, 9 aa, Homo Sapiens
RGRALLSSR

SEQ ID NO: 362738 - protein, 9 aa, Homo Sapiens
RPRPVSSPA

SEQ ID NO: 362739 - protein, 9 aa, Homo Sapiens
KRVMKSLSL

SEQ ID NO: 362740 - protein, 9 aa, Homo Sapiens
GYRFLGECD

SEQ ID NO: 362741 - protein, 9 aa, Homo Sapiens
LYGHTSTVC

SEQ ID NO: 362742 - protein, 9 aa, Homo Sapiens
SSRSGSPSS

SEQ ID NO: 362743 - protein, 9 aa, Homo Sapiens
EHLNIQDPE

SEQ ID NO: 362744 - protein, 9 aa, Homo Sapiens
CVSYNQEKQ

SEQ ID NO: 362745 - protein, 9 aa, Homo Sapiens
VSQVLCTYM

SEQ ID NO: 362746 - protein, 9 aa, Homo Sapiens
DLRDVDENL

SEQ ID NO: 362747 - protein, 9 aa, Homo Sapiens
IPHFWTFET

SEQ ID NO: 362748 - protein, 9 aa, Homo Sapiens
PTCPGGTGH

SEQ ID NO: 362749 - protein, 9 aa, Homo Sapiens
FFFFPFFFL

SEQ ID NO: 362750 - protein, 9 aa, Homo Sapiens
NQEKQLKLK

SEQ ID NO: 362751 - protein, 9 aa, Homo Sapiens
PLPTVPPHC

SEQ ID NO: 362752 - protein, 9 aa, Homo Sapiens
LSSRSGSPS

SEQ ID NO: 362753 - protein, 9 aa, Homo Sapiens
IIGAGPKGN

SEQ ID NO: 362754 - protein, 9 aa, Homo Sapiens
NGRYPRGTH

SEQ ID NO: 362755 - protein, 9 aa, Homo Sapiens
YFTKPNYQL

SEQ ID NO: 362756 - protein, 9 aa, Homo Sapiens
YTYNGIFTT

SEQ ID NO: 362757 - protein, 9 aa, Homo Sapiens
VSSPALLEA

SEQ ID NO: 362758 - protein, 9 aa, Homo Sapiens
QQGKAFQCA

SEQ ID NO: 362759 - protein, 9 aa, Homo Sapiens
EQVNHIGDG

SEQ ID NO: 362760 - protein, 9 aa, Homo Sapiens
MVLRHEPRQ

SEQ ID NO: 362761 - protein, 9 aa, Homo Sapiens
ETPSEDLQT

SEQ ID NO: 362762 - protein, 9 aa, Homo Sapiens
HDSEGPAEG

SEQ ID NO: 362763 - protein, 9 aa, Homo Sapiens
LDSEGHDSE

SEQ ID NO: 362764 - protein, 9 aa, Homo Sapiens
TQRLGARAG

SEQ ID NO: 362765 - protein, 9 aa, Homo Sapiens
DEAVDKPTY

SEQ ID NO: 362766 - protein, 9 aa, Homo Sapiens
DNATAFTQT

SEQ ID NO: 362767 - protein, 9 aa, Homo Sapiens
MVFFLEDIM

SEQ ID NO: 362768 - protein, 9 aa, Homo Sapiens
GFFHYIQEA

SEQ ID NO: 362769 - protein, 9 aa, Homo Sapiens
LHPTNVVAI

SEQ ID NO: 362770 - protein, 9 aa, Homo Sapiens
NFLPLWMHS

SEQ ID NO: 362771 - protein, 9 aa, Homo Sapiens
SECLSAAEG

SEQ ID NO: 362772 - protein, 9 aa, Homo Sapiens
FIMETTCVI

SEQ ID NO: 362773 - protein, 9 aa, Homo Sapiens
GSLGQGEPP

SEQ ID NO: 362774 - protein, 9 aa, Homo Sapiens
FVHLPFGVG

SEQ ID NO: 362775 - protein, 9 aa, Homo Sapiens
GGSLGLLWG

SEQ ID NO: 362776 - protein, 9 aa, Homo Sapiens
LWAIWPVHY

SEQ ID NO: 362777 - protein, 9 aa, Homo Sapiens
DYFTKPNYQ

SEQ ID NO: 362778 - protein, 9 aa, Homo Sapiens
NQWETPSED

SEQ ID NO: 362779 - protein, 9 aa, Homo Sapiens
RMVFFLEDI

SEQ ID NO: 362780 - protein, 9 aa, Homo Sapiens
VCCMHLHEK

SEQ ID NO: 362781 - protein, 9 aa, Homo Sapiens
APTIYSDNT

SEQ ID NO: 362782 - protein, 9 aa, Homo Sapiens
GIGVSQVLC

SEQ ID NO: 362783 - protein, 9 aa, Homo Sapiens
GALHILAQD

SEQ ID NO: 362784 - protein, 9 aa, Homo Sapiens
QCWSDEYNC

SEQ ID NO: 362785 - protein, 9 aa, Homo Sapiens
GGAYIKLAD

SEQ ID NO: 362786 - protein, 9 aa, Homo Sapiens
QQLLKTFDE

SEQ ID NO: 362787 - protein, 9 aa, Homo Sapiens
GGPAGWARQ

SEQ ID NO: 362788 - protein, 9 aa, Homo Sapiens
DEECEQFMK

SEQ ID NO: 362789 - protein, 9 aa, Homo Sapiens
EDYSVLVPG

SEQ ID NO: 362790 - protein, 9 aa, Homo Sapiens
IILTNDNFT

SEQ ID NO: 362791 - protein, 9 aa, Homo Sapiens
HKRIHTVEK

SEQ ID NO: 362792 - protein, 9 aa, Homo Sapiens
FFIGDEAVD

SEQ ID NO: 362793 - protein, 9 aa, Homo Sapiens
LCGHDAIKE

SEQ ID NO: 362794 - protein, 9 aa, Homo Sapiens
LWMHSLKPW

SEQ ID NO: 362795 - protein, 9 aa, Homo Sapiens
RCGKRKPLL

SEQ ID NO: 362796 - protein, 9 aa, Homo Sapiens
QFQADPNVL

SEQ ID NO: 362797 - protein, 9 aa, Homo Sapiens
RHRCGKRKP

SEQ ID NO: 362798 - protein, 9 aa, Homo Sapiens
VLLVFGTMT

SEQ ID NO: 362799 - protein, 9 aa, Homo Sapiens
LLWQATPAQ

SEQ ID NO: 362800 - protein, 9 aa, Homo Sapiens
CDCGAPCEP

SEQ ID NO: 362801 - protein, 9 aa, Homo Sapiens
DRIIGAGPK

SEQ ID NO: 362802 - protein, 9 aa, Homo Sapiens
PLIHSLFHG

SEQ ID NO: 362803 - protein, 9 aa, Homo Sapiens
LEQVNHIGD

SEQ ID NO: 362804 - protein, 9 aa, Homo Sapiens
RIDLHKEDY

SEQ ID NO: 362805 - protein, 9 aa, Homo Sapiens
LARSFKSPI

SEQ ID NO: 362806 - protein, 9 aa, Homo Sapiens
CSPGPALGQ

SEQ ID NO: 362807 - protein, 9 aa, Homo Sapiens
PRLIKTLQK

SEQ ID NO: 362808 - protein, 9 aa, Homo Sapiens
NSPSPGKTE

SEQ ID NO: 362809 - protein, 9 aa, Homo Sapiens
KCFRTQMSN

SEQ ID NO: 362810 - protein, 9 aa, Homo Sapiens
AQPGVLLVF

SEQ ID NO: 362811 - protein, 9 aa, Homo Sapiens
PIPGGGDVS

SEQ ID NO: 362812 - protein, 9 aa, Homo Sapiens
CGPQSGLQS

SEQ ID NO: 362813 - protein, 9 aa, Homo Sapiens
PFFIMETTC

SEQ ID NO: 362814 - protein, 9 aa, Homo Sapiens
SDCSAPWSR

SEQ ID NO: 362815 - protein, 9 aa, Homo Sapiens
QPERERCWY

SEQ ID NO: 362816 - protein, 9 aa, Homo Sapiens
GPQCTTSVS

SEQ ID NO: 362817 - protein, 9 aa, Homo Sapiens
TVCCMHLHE

SEQ ID NO: 362818 - protein, 9 aa, Homo Sapiens
QGNRTVLEN

SEQ ID NO: 362819 - protein, 9 aa, Homo Sapiens
EENKWKRVM

SEQ ID NO: 362820 - protein, 9 aa, Homo Sapiens
HRFAWHVSP

SEQ ID NO: 362821 - protein, 9 aa, Homo Sapiens
MQLMNDKIN

SEQ ID NO: 362822 - protein, 9 aa, Homo Sapiens
PFVCSENGY

SEQ ID NO: 362823 - protein, 9 aa, Homo Sapiens
QLRPGNQSD

SEQ ID NO: 362824 - protein, 9 aa, Homo Sapiens
YIERGREAH

SEQ ID NO: 362825 - protein, 9 aa, Homo Sapiens
LSLPAWQLL

SEQ ID NO: 362826 - protein, 9 aa, Homo Sapiens
LQCVPENTG

SEQ ID NO: 362827 - protein, 9 aa, Homo Sapiens
GHRLLWQAT

SEQ ID NO: 362828 - protein, 9 aa, Homo Sapiens
NSLALGVNH

SEQ ID NO: 362829 - protein, 9 aa, Homo Sapiens
FIDEKQLLE

SEQ ID NO: 362830 - protein, 9 aa, Homo Sapiens
RLIKTLQKG

SEQ ID NO: 362831 - protein, 9 aa, Homo Sapiens
NANMMVLRH

SEQ ID NO: 362832 - protein, 9 aa, Homo Sapiens
EELWEMKPR

SEQ ID NO: 362833 - protein, 9 aa, Homo Sapiens
STAPAAHGV

SEQ ID NO: 362834 - protein, 9 aa, Homo Sapiens
LSRQECDRK

SEQ ID NO: 362835 - protein, 9 aa, Homo Sapiens
DPNVLHNSY

SEQ ID NO: 362836 - protein, 9 aa, Homo Sapiens
EVHWLNFTL

SEQ ID NO: 362837 - protein, 9 aa, Homo Sapiens
LVFGTMTDV

SEQ ID NO: 362838 - protein, 9 aa, Homo Sapiens
TLGLICMCL

SEQ ID NO: 362839 - protein, 9 aa, Homo Sapiens
FLGECDCGA

SEQ ID NO: 362840 - protein, 9 aa, Homo Sapiens
VPVYIAEGV

SEQ ID NO: 362841 - protein, 9 aa, Homo Sapiens
CEDNSLALG

SEQ ID NO: 362842 - protein, 9 aa, Homo Sapiens
FSFWAFGKH

SEQ ID NO: 362843 - protein, 9 aa, Homo Sapiens
PGIFRGDKW

SEQ ID NO: 362844 - protein, 9 aa, Homo Sapiens
TSPATLSRA

SEQ ID NO: 362845 - protein, 9 aa, Homo Sapiens
LYPSHPSNP

SEQ ID NO: 362846 - protein, 9 aa, Homo Sapiens
GQIHLRALY

SEQ ID NO: 362847 - protein, 9 aa, Homo Sapiens
ICVEGEEFP

SEQ ID NO: 362848 - protein, 9 aa, Homo Sapiens
SLSLPAWQL

SEQ ID NO: 362849 - protein, 9 aa, Homo Sapiens
LRHEPRQTT

SEQ ID NO: 362850 - protein, 9 aa, Homo Sapiens
QVLCTYMKN

SEQ ID NO: 362851 - protein, 9 aa, Homo Sapiens
IHSLFHGFL

SEQ ID NO: 362852 - protein, 9 aa, Homo Sapiens
QSVLEKLPG

SEQ ID NO: 362853 - protein, 9 aa, Homo Sapiens
SYQEDGFDL

SEQ ID NO: 362854 - protein, 9 aa, Homo Sapiens
LGARAGGCS

SEQ ID NO: 362855 - protein, 9 aa, Homo Sapiens
EERCQKRLQ

SEQ ID NO: 362856 - protein, 9 aa, Homo Sapiens
GARLSVTNP

SEQ ID NO: 362857 - protein, 9 aa, Homo Sapiens
QLCLLSGVA

SEQ ID NO: 362858 - protein, 9 aa, Homo Sapiens
AVDLAKKEA

SEQ ID NO: 362859 - protein, 9 aa, Homo Sapiens
SKTTTILHP

SEQ ID NO: 362860 - protein, 9 aa, Homo Sapiens
EDDNDDDSD

SEQ ID NO: 362861 - protein, 9 aa, Homo Sapiens
LAAATSSSP

SEQ ID NO: 362862 - protein, 9 aa, Homo Sapiens
ARSFKSPIT

SEQ ID NO: 362863 - protein, 9 aa, Homo Sapiens
GSTAPAAHG

SEQ ID NO: 362864 - protein, 9 aa, Homo Sapiens
ETMQLMNDK

SEQ ID NO: 362865 - protein, 9 aa, Homo Sapiens
ICQTLWCSV

SEQ ID NO: 362866 - protein, 9 aa, Homo Sapiens
RFEMIEFDE

SEQ ID NO: 362867 - protein, 9 aa, Homo Sapiens
AAASQGCSP

SEQ ID NO: 362868 - protein, 9 aa, Homo Sapiens
SSHPLIHSL

SEQ ID NO: 362869 - protein, 9 aa, Homo Sapiens
FCQEVENIC

SEQ ID NO: 362870 - protein, 9 aa, Homo Sapiens
RNKRSYQED

SEQ ID NO: 362871 - protein, 9 aa, Homo Sapiens
IVHVELSPM

SEQ ID NO: 362872 - protein, 9 aa, Homo Sapiens
PEKRKEFLK

SEQ ID NO: 362873 - protein, 9 aa, Homo Sapiens
WPVEVLYGV

SEQ ID NO: 362874 - protein, 9 aa, Homo Sapiens
ESIMQLVAT

SEQ ID NO: 362875 - protein, 9 aa, Homo Sapiens
SHCEMHQCW

SEQ ID NO: 362876 - protein, 9 aa, Homo Sapiens
ASLALGDII

SEQ ID NO: 362877 - protein, 9 aa, Homo Sapiens
TKPNYQLIM

SEQ ID NO: 362878 - protein, 9 aa, Homo Sapiens
DRWSKETLG

SEQ ID NO: 362879 - protein, 9 aa, Homo Sapiens
VPAEAFLAQ

SEQ ID NO: 362880 - protein, 9 aa, Homo Sapiens
FHYIQEALK

SEQ ID NO: 362881 - protein, 9 aa, Homo Sapiens
VYIAEGVVT

SEQ ID NO: 362882 - protein, 9 aa, Homo Sapiens
QSTALQKVK

SEQ ID NO: 362883 - protein, 9 aa, Homo Sapiens
QYSVAKSYA

SEQ ID NO: 362884 - protein, 9 aa, Homo Sapiens
PGGTGHRLL

SEQ ID NO: 362885 - protein, 9 aa, Homo Sapiens
TGHRLLWQA

SEQ ID NO: 362886 - protein, 9 aa, Homo Sapiens
PVYIAEGVV

SEQ ID NO: 362887 - protein, 9 aa, Homo Sapiens
LDRIHKLAD

SEQ ID NO: 362888 - protein, 9 aa, Homo Sapiens
NNPAIRISN

SEQ ID NO: 362889 - protein, 9 aa, Homo Sapiens
ASASDCSAP

SEQ ID NO: 362890 - protein, 9 aa, Homo Sapiens
GPTQAPLPV

SEQ ID NO: 362891 - protein, 9 aa, Homo Sapiens
LGSSAYRSQ

SEQ ID NO: 362892 - protein, 9 aa, Homo Sapiens
RCTCIGAQD

SEQ ID NO: 362893 - protein, 9 aa, Homo Sapiens
ISHLRMATP

SEQ ID NO: 362894 - protein, 9 aa, Homo Sapiens
IGVSQVLCT

SEQ ID NO: 362895 - protein, 9 aa, Homo Sapiens
WPVHYGKEI

SEQ ID NO: 362896 - protein, 9 aa, Homo Sapiens
AAHGVTSAP

SEQ ID NO: 362897 - protein, 9 aa, Homo Sapiens
ESQTRSPDF

SEQ ID NO: 362898 - protein, 9 aa, Homo Sapiens
HIGDGLSPL

SEQ ID NO: 362899 - protein, 9 aa, Homo Sapiens
VPEPYTYNG

SEQ ID NO: 362900 - protein, 9 aa, Homo Sapiens
EAPCLQGGG

SEQ ID NO: 362901 - protein, 9 aa, Homo Sapiens
LLDIKSPLL

SEQ ID NO: 362902 - protein, 9 aa, Homo Sapiens
PGTRRHVYD

SEQ ID NO: 362903 - protein, 9 aa, Homo Sapiens
VRAWCQVAQ

SEQ ID NO: 362904 - protein, 9 aa, Homo Sapiens
EMHQCWSDE

SEQ ID NO: 362905 - protein, 9 aa, Homo Sapiens
RYPRGTHGS

SEQ ID NO: 362906 - protein, 9 aa, Homo Sapiens
RVTVPVSHP

SEQ ID NO: 362907 - protein, 9 aa, Homo Sapiens
DAIKEALVD

SEQ ID NO: 362908 - protein, 9 aa, Homo Sapiens
TAPGTRRHV

SEQ ID NO: 362909 - protein, 9 aa, Homo Sapiens
RLGVLLSHL

SEQ ID NO: 362910 - protein, 9 aa, Homo Sapiens
PVPEPYTYN

SEQ ID NO: 362911 - protein, 9 aa, Homo Sapiens
KPNQYTEID

SEQ ID NO: 362912 - protein, 9 aa, Homo Sapiens
SYHPGIFRG

SEQ ID NO: 362913 - protein, 9 aa, Homo Sapiens
KSPLLEQCE

SEQ ID NO: 362914 - protein, 9 aa, Homo Sapiens
PPTPNGCPR

SEQ ID NO: 362915 - protein, 9 aa, Homo Sapiens
GGASSDYGT

SEQ ID NO: 362916 - protein, 9 aa, Homo Sapiens
GNRTVLENL

SEQ ID NO: 362917 - protein, 9 aa, Homo Sapiens
CEQFMKELS

SEQ ID NO: 362918 - protein, 9 aa, Homo Sapiens
YFLHHSRTP

SEQ ID NO: 362919 - protein, 9 aa, Homo Sapiens
QEELWEMKP

SEQ ID NO: 362920 - protein, 9 aa, Homo Sapiens
ALGDIIYVV

SEQ ID NO: 362921 - protein, 9 aa, Homo Sapiens
GGGGGAPRR

SEQ ID NO: 362922 - protein, 9 aa, Homo Sapiens
ITKAEMLKN

SEQ ID NO: 362923 - protein, 9 aa, Homo Sapiens
EEEEEDDND

SEQ ID NO: 362924 - protein, 9 aa, Homo Sapiens
VDFIIIVFS

SEQ ID NO: 362925 - protein, 9 aa, Homo Sapiens
AQDVHNRIV

SEQ ID NO: 362926 - protein, 9 aa, Homo Sapiens
NYIPHFWTF

SEQ ID NO: 362927 - protein, 9 aa, Homo Sapiens
KLPGVDPNN

SEQ ID NO: 362928 - protein, 9 aa, Homo Sapiens
GNQSDSGSE

SEQ ID NO: 362929 - protein, 9 aa, Homo Sapiens
QWLPQSEPL

SEQ ID NO: 362930 - protein, 9 aa, Homo Sapiens
QDPEKRKEF

SEQ ID NO: 362931 - protein, 9 aa, Homo Sapiens
IQDPEKRKE

SEQ ID NO: 362932 - protein, 9 aa, Homo Sapiens
LQRLGVLLS

SEQ ID NO: 362933 - protein, 9 aa, Homo Sapiens
SRNKRSYQE

SEQ ID NO: 362934 - protein, 9 aa, Homo Sapiens
VSQGNRTVL

SEQ ID NO: 362935 - protein, 9 aa, Homo Sapiens
IPGGGDVSG

SEQ ID NO: 362936 - protein, 9 aa, Homo Sapiens
AGGCSPGPA

SEQ ID NO: 362937 - protein, 9 aa, Homo Sapiens
EEEEDDNDD

SEQ ID NO: 362938 - protein, 9 aa, Homo Sapiens
QLLLDIKSP

SEQ ID NO: 362939 - protein, 9 aa, Homo Sapiens
IDLHKEDYS

SEQ ID NO: 362940 - protein, 9 aa, Homo Sapiens
RKLFTSELG

SEQ ID NO: 362941 - protein, 9 aa, Homo Sapiens
GHDSEGPAE

SEQ ID NO: 362942 - protein, 9 aa, Homo Sapiens
QECDRKFRL

SEQ ID NO: 362943 - protein, 9 aa, Homo Sapiens
SNDRPGHKC

SEQ ID NO: 362944 - protein, 9 aa, Homo Sapiens
SRLHMYSPL

SEQ ID NO: 362945 - protein, 9 aa, Homo Sapiens
CLLSGVAAA

SEQ ID NO: 362946 - protein, 9 aa, Homo Sapiens
EKLPGVDPN

SEQ ID NO: 362947 - protein, 9 aa, Homo Sapiens
CLQGGGPAG

SEQ ID NO: 362948 - protein, 9 aa, Homo Sapiens
LTQRLGARA

SEQ ID NO: 362949 - protein, 9 aa, Homo Sapiens
SHLRMATPA

SEQ ID NO: 362950 - protein, 9 aa, Homo Sapiens
DDNDDDSDD

SEQ ID NO: 362951 - protein, 9 aa, Homo Sapiens
IPVDTAAGP

SEQ ID NO: 362952 - protein, 9 aa, Homo Sapiens
RKQKKRQCV

SEQ ID NO: 362953 - protein, 9 aa, Homo Sapiens
CGHDAIKEA

SEQ ID NO: 362954 - protein, 9 aa, Homo Sapiens
EITKQEKDF

SEQ ID NO: 362955 - protein, 9 aa, Homo Sapiens
SSDYGTFYP

SEQ ID NO: 362956 - protein, 9 aa, Homo Sapiens
QLLKTFDEK

SEQ ID NO: 362957 - protein, 9 aa, Homo Sapiens
EQDQTTLRP

SEQ ID NO: 362958 - protein, 9 aa, Homo Sapiens
PCLQGGGPA

SEQ ID NO: 362959 - protein, 9 aa, Homo Sapiens
IQEALKSDK

SEQ ID NO: 362960 - protein, 9 aa, Homo Sapiens
HKEDYSVLV

SEQ ID NO: 362961 - protein, 9 aa, Homo Sapiens
ADPNVLHNS

SEQ ID NO: 362962 - protein, 9 aa, Homo Sapiens
GTFYPRPVA

SEQ ID NO: 362963 - protein, 9 aa, Homo Sapiens
CSCEDNSLA

SEQ ID NO: 362964 - protein, 9 aa, Homo Sapiens
DLAAIPIRA

SEQ ID NO: 362965 - protein, 9 aa, Homo Sapiens
ALHILAQDV

SEQ ID NO: 362966 - protein, 9 aa, Homo Sapiens
VAVDLAKKE

SEQ ID NO: 362967 - protein, 9 aa, Homo Sapiens
FQADPNVLH

SEQ ID NO: 362968 - protein, 9 aa, Homo Sapiens
AEGVFPVTH

SEQ ID NO: 362969 - protein, 9 aa, Homo Sapiens
CQEVENICQ

SEQ ID NO: 362970 - protein, 9 aa, Homo Sapiens
AQTQEIPLT

SEQ ID NO: 362971 - protein, 9 aa, Homo Sapiens
QAFLEQVNH

SEQ ID NO: 362972 - protein, 9 aa, Homo Sapiens
LHMYSPLQC

SEQ ID NO: 362973 - protein, 9 aa, Homo Sapiens
FLGESIMQL

SEQ ID NO: 362974 - protein, 9 aa, Homo Sapiens
YGVAALNGL

SEQ ID NO: 362975 - protein, 9 aa, Homo Sapiens
INANMMVLR

SEQ ID NO: 362976 - protein, 9 aa, Homo Sapiens
TLLSTLAAA

SEQ ID NO: 362977 - protein, 9 aa, Homo Sapiens
RRNFKQNQA

SEQ ID NO: 362978 - protein, 9 aa, Homo Sapiens
ELIVHVELS

SEQ ID NO: 362979 - protein, 9 aa, Homo Sapiens
LMNDKINSM

SEQ ID NO: 362980 - protein, 9 aa, Homo Sapiens
DPEKRKEFL

SEQ ID NO: 362981 - protein, 9 aa, Homo Sapiens
IMETTCVIW

SEQ ID NO: 362982 - protein, 9 aa, Homo Sapiens
KRWEVLSAA

SEQ ID NO: 362983 - protein, 9 aa, Homo Sapiens
HPGIFRGDK

SEQ ID NO: 362984 - protein, 9 aa, Homo Sapiens
IICVEGEEF

SEQ ID NO: 362985 - protein, 9 aa, Homo Sapiens
CTCIGAQDP

SEQ ID NO: 362986 - protein, 9 aa, Homo Sapiens
HMYSPLQCV

SEQ ID NO: 362987 - protein, 9 aa, Homo Sapiens
VRYRLTKIP

SEQ ID NO: 362988 - protein, 9 aa, Homo Sapiens
LMRKGGEKT

SEQ ID NO: 362989 - protein, 9 aa, Homo Sapiens
ADPFFIMET

SEQ ID NO: 362990 - protein, 9 aa, Homo Sapiens
VLDRIHKLA

SEQ ID NO: 362991 - protein, 9 aa, Homo Sapiens
LENQWETPS

SEQ ID NO: 362992 - protein, 9 aa, Homo Sapiens
RFLGECDCG

SEQ ID NO: 362993 - protein, 9 aa, Homo Sapiens
IKEALVDQA

SEQ ID NO: 362994 - protein, 9 aa, Homo Sapiens
EQQLSRQEC

SEQ ID NO: 362995 - protein, 9 aa, Homo Sapiens
RLGARAGGC

SEQ ID NO: 362996 - protein, 9 aa, Homo Sapiens
TKQEKDFLW

SEQ ID NO: 362997 - protein, 9 aa, Homo Sapiens
GTGHRLLWQ

SEQ ID NO: 362998 - protein, 9 aa, Homo Sapiens
FTLRASDNG

SEQ ID NO: 362999 - protein, 9 aa, Homo Sapiens
ASDIILTND

SEQ ID NO: 363000 - protein, 9 aa, Homo Sapiens
GQMGPIGSR

SEQ ID NO: 363001 - protein, 9 aa, Homo Sapiens
QTQEIPLTP

SEQ ID NO: 363002 - protein, 9 aa, Homo Sapiens
VPPHCSIPP

SEQ ID NO: 363003 - protein, 9 aa, Homo Sapiens
CFRTQMSNL

SEQ ID NO: 363004 - protein, 9 aa, Homo Sapiens
GDIIYVVID

SEQ ID NO: 363005 - protein, 9 aa, Homo Sapiens
SPAPIPGGG

SEQ ID NO: 363006 - protein, 9 aa, Homo Sapiens
RAYEPRWFM

SEQ ID NO: 363007 - protein, 9 aa, Homo Sapiens
WFQLLLDIK

SEQ ID NO: 363008 - protein, 9 aa, Homo Sapiens
MHSLKPWDA

SEQ ID NO: 363009 - protein, 9 aa, Homo Sapiens
AYRSQWREP

SEQ ID NO: 363010 - protein, 9 aa, Homo Sapiens
MATPATVSR

SEQ ID NO: 363011 - protein, 9 aa, Homo Sapiens
EEEDDNDDD

SEQ ID NO: 363012 - protein, 9 aa, Homo Sapiens
PRERPRPVS

SEQ ID NO: 363013 - protein, 9 aa, Homo Sapiens
SRQECDRKF

SEQ ID NO: 363014 - protein, 9 aa, Homo Sapiens
LLLDEPSSV

SEQ ID NO: 363015 - protein, 9 aa, Homo Sapiens
GFSECLSAA

SEQ ID NO: 363016 - protein, 9 aa, Homo Sapiens
CPGGTGHRL

SEQ ID NO: 363017 - protein, 9 aa, Homo Sapiens
QFFFFFFPF

SEQ ID NO: 363018 - protein, 9 aa, Homo Sapiens
TPSEDLQTD

SEQ ID NO: 363019 - protein, 9 aa, Homo Sapiens
LHRCVRLTD

SEQ ID NO: 363020 - protein, 9 aa, Homo Sapiens
YTEIDTIAA

SEQ ID NO: 363021 - protein, 9 aa, Homo Sapiens
NDNFTSIVK

SEQ ID NO: 363022 - protein, 9 aa, Homo Sapiens
VIPQQLLKT

SEQ ID NO: 363023 - protein, 9 aa, Homo Sapiens
FVPVYIAEG

SEQ ID NO: 363024 - protein, 9 aa, Homo Sapiens
RLWEEAILQ

SEQ ID NO: 363025 - protein, 9 aa, Homo Sapiens
LRASDNGSP

SEQ ID NO: 363026 - protein, 9 aa, Homo Sapiens
ANMMVLRHE

SEQ ID NO: 363027 - protein, 9 aa, Homo Sapiens
VENICQTLW

SEQ ID NO: 363028 - protein, 9 aa, Homo Sapiens
STVCCMHLH

SEQ ID NO: 363029 - protein, 9 aa, Homo Sapiens
LNGRYPRGT

SEQ ID NO: 363030 - protein, 9 aa, Homo Sapiens
AQFSQGTRA

SEQ ID NO: 363031 - protein, 9 aa, Homo Sapiens
ENLWARWPG

SEQ ID NO: 363032 - protein, 9 aa, Homo Sapiens
QADPNVLHN

SEQ ID NO: 363033 - protein, 9 aa, Homo Sapiens
WEEAILQME

SEQ ID NO: 363034 - protein, 9 aa, Homo Sapiens
YFGFFHYIQ

SEQ ID NO: 363035 - protein, 9 aa, Homo Sapiens
LQGGGPAGW

SEQ ID NO: 363036 - protein, 9 aa, Homo Sapiens
SRCVSYNQE

SEQ ID NO: 363037 - protein, 9 aa, Homo Sapiens
LPEEPSSTQ

SEQ ID NO: 363038 - protein, 9 aa, Homo Sapiens
QFSQGTRAA

SEQ ID NO: 363039 - protein, 9 aa, Homo Sapiens
HPVLTLRAP

SEQ ID NO: 363040 - protein, 9 aa, Homo Sapiens
LALGDIIYV

SEQ ID NO: 363041 - protein, 9 aa, Homo Sapiens
GNYIPHFWT

SEQ ID NO: 363042 - protein, 9 aa, Homo Sapiens
HLRMATPAT

SEQ ID NO: 363043 - protein, 9 aa, Homo Sapiens
SSVMDPCSK

SEQ ID NO: 363044 - protein, 9 aa, Homo Sapiens
AEADMSSDM

SEQ ID NO: 363045 - protein, 9 aa, Homo Sapiens
HVELSPMQK

SEQ ID NO: 363046 - protein, 9 aa, Homo Sapiens
CVEGEEFPC

SEQ ID NO: 363047 - protein, 9 aa, Homo Sapiens
SPLQCVPEN

SEQ ID NO: 363048 - protein, 9 aa, Homo Sapiens
PGHKCFRTQ

SEQ ID NO: 363049 - protein, 9 aa, Homo Sapiens
YRFLGECDC

SEQ ID NO: 363050 - protein, 9 aa, Homo Sapiens
DVNDNATAF

SEQ ID NO: 363051 - protein, 9 aa, Homo Sapiens
GECDCGAPC

SEQ ID NO: 363052 - protein, 9 aa, Homo Sapiens
GIFRGDKWS

SEQ ID NO: 363053 - protein, 9 aa, Homo Sapiens
LIVHVELSP

SEQ ID NO: 363054 - protein, 9 aa, Homo Sapiens
QRKQKKRQC

SEQ ID NO: 363055 - protein, 9 aa, Homo Sapiens
KNEGKRWEV

SEQ ID NO: 363056 - protein, 9 aa, Homo Sapiens
PGDPGQMGP

SEQ ID NO: 363057 - protein, 9 aa, Homo Sapiens
EGEEFPCHR

SEQ ID NO: 363058 - protein, 9 aa, Homo Sapiens
SFWAFGKHS

SEQ ID NO: 363059 - protein, 9 aa, Homo Sapiens
LSVTNPAES

SEQ ID NO: 363060 - protein, 9 aa, Homo Sapiens
GQGEPPTCP

SEQ ID NO: 363061 - protein, 9 aa, Homo Sapiens
AAIPIRAYE

SEQ ID NO: 363062 - protein, 9 aa, Homo Sapiens
THLYLHRCV

SEQ ID NO: 363063 - protein, 9 aa, Homo Sapiens
KTAADRRNF

SEQ ID NO: 363064 - protein, 9 aa, Homo Sapiens
PASLSLPAW

SEQ ID NO: 363065 - protein, 9 aa, Homo Sapiens
DMEVGCSAL

SEQ ID NO: 363066 - protein, 9 aa, Homo Sapiens
PFVHLPFGV

SEQ ID NO: 363067 - protein, 9 aa, Homo Sapiens
VLLSHLRKT

SEQ ID NO: 363068 - protein, 9 aa, Homo Sapiens
LWEEAILQM

SEQ ID NO: 363069 - protein, 9 aa, Homo Sapiens
PNQYTEIDT

SEQ ID NO: 363070 - protein, 9 aa, Homo Sapiens
SPGKTEMDL

SEQ ID NO: 363071 - protein, 9 aa, Homo Sapiens
CLSAAEGVF

SEQ ID NO: 363072 - protein, 9 aa, Homo Sapiens
TGALHILAQ

SEQ ID NO: 363073 - protein, 9 aa, Homo Sapiens
PAAHGVTSA

SEQ ID NO: 363074 - protein, 9 aa, Homo Sapiens
PPTCPGGTG

SEQ ID NO: 363075 - protein, 9 aa, Homo Sapiens
ELDEECEQF

SEQ ID NO: 363076 - protein, 9 aa, Homo Sapiens
DALDSEGHD

SEQ ID NO: 363077 - protein, 9 aa, Homo Sapiens
LLWGLLGQE

SEQ ID NO: 363078 - protein, 9 aa, Homo Sapiens
ADMSSDMEV

SEQ ID NO: 363079 - protein, 9 aa, Homo Sapiens
EKQLLEAME

SEQ ID NO: 363080 - protein, 9 aa, Homo Sapiens
QQRRRSIRR

SEQ ID NO: 363081 - protein, 9 aa, Homo Sapiens
YGTFYPRPV

SEQ ID NO: 363082 - protein, 9 aa, Homo Sapiens
LRCQLGDHL

SEQ ID NO: 363083 - protein, 9 aa, Homo Sapiens
APGSTAPAA

SEQ ID NO: 363084 - protein, 9 aa, Homo Sapiens
SASDCSAPW

SEQ ID NO: 363085 - protein, 9 aa, Homo Sapiens
HSLFHGFLF

SEQ ID NO: 363086 - protein, 9 aa, Homo Sapiens
ECDRKFRLE

SEQ ID NO: 363087 - protein, 9 aa, Homo Sapiens
AIPIRAYEP

SEQ ID NO: 363088 - protein, 9 aa, Homo Sapiens
EVENICQTL

SEQ ID NO: 363089 - protein, 9 aa, Homo Sapiens
ASLSLPAWQ

SEQ ID NO: 363090 - protein, 9 aa, Homo Sapiens
TLADPFFIM

SEQ ID NO: 363091 - protein, 9 aa, Homo Sapiens
SEGHDSEGP

SEQ ID NO: 363092 - protein, 9 aa, Homo Sapiens
MAHAPTIYS

SEQ ID NO: 363093 - protein, 9 aa, Homo Sapiens
TPNGCPRGP

SEQ ID NO: 363094 - protein, 9 aa, Homo Sapiens
FIIIVFSFW

SEQ ID NO: 363095 - protein, 9 aa, Homo Sapiens
TQERMFTID

SEQ ID NO: 363096 - protein, 9 aa, Homo Sapiens
GPALGQLCL

SEQ ID NO: 363097 - protein, 9 aa, Homo Sapiens
TVRAWCQVA

SEQ ID NO: 363098 - protein, 9 aa, Homo Sapiens
HFVNQQRRR

SEQ ID NO: 363099 - protein, 9 aa, Homo Sapiens
MHQCWSDEY

SEQ ID NO: 363100 - protein, 9 aa, Homo Sapiens
VSNLNGRYP

SEQ ID NO: 363101 - protein, 9 aa, Homo Sapiens
LPTVPPHCS

SEQ ID NO: 363102 - protein, 9 aa, Homo Sapiens
VVLCGHDAI

SEQ ID NO: 363103 - protein, 9 aa, Homo Sapiens
ITNQEELWE

SEQ ID NO: 363104 - protein, 9 aa, Homo Sapiens
LLLDIKSPL

SEQ ID NO: 363105 - protein, 9 aa, Homo Sapiens
GYLSRFTHA

SEQ ID NO: 363106 - protein, 9 aa, Homo Sapiens
DASNSERFC

SEQ ID NO: 363107 - protein, 9 aa, Homo Sapiens
LADPFFIME

SEQ ID NO: 363108 - protein, 9 aa, Homo Sapiens
DPFFIMETT

SEQ ID NO: 363109 - protein, 9 aa, Homo Sapiens
KEDYSVLVP

SEQ ID NO: 363110 - protein, 9 aa, Homo Sapiens
FLQSVLEKL

SEQ ID NO: 363111 - protein, 9 aa, Homo Sapiens
EEFPCHRAV

SEQ ID NO: 363112 - protein, 9 aa, Homo Sapiens
LTVDGFTDA

SEQ ID NO: 363113 - protein, 9 aa, Homo Sapiens
WHVSPLINV

SEQ ID NO: 363114 - protein, 9 aa, Homo Sapiens
IMAHAPTIY

SEQ ID NO: 363115 - protein, 9 aa, Homo Sapiens
SQEELDEEC

SEQ ID NO: 363116 - protein, 9 aa, Homo Sapiens
TLSRAWASS

SEQ ID NO: 363117 - protein, 9 aa, Homo Sapiens
DDALDSEGH

SEQ ID NO: 363118 - protein, 9 aa, Homo Sapiens
LHKEDYSVL

SEQ ID NO: 363119 - protein, 9 aa, Homo Sapiens
IFTFCFFPW

SEQ ID NO: 363120 - protein, 9 aa, Homo Sapiens
TTLRPPEKV

SEQ ID NO: 363121 - protein, 9 aa, Homo Sapiens
QSPAPIPGG

SEQ ID NO: 363122 - protein, 9 aa, Homo Sapiens
NAIETMQLM

SEQ ID NO: 363123 - protein, 9 aa, Homo Sapiens
PTSPATLSR

SEQ ID NO: 363124 - protein, 9 aa, Homo Sapiens
QEKQLKLKE

SEQ ID NO: 363125 - protein, 9 aa, Homo Sapiens
RQCGPQSGL

SEQ ID NO: 363126 - protein, 9 aa, Homo Sapiens
LAQDVHNRI

SEQ ID NO: 363127 - protein, 9 aa, Homo Sapiens
PLWAIWPVH

SEQ ID NO: 363128 - protein, 9 aa, Homo Sapiens
PGTVRAWCQ

SEQ ID NO: 363129 - protein, 9 aa, Homo Sapiens
TSTVCCMHL

SEQ ID NO: 363130 - protein, 9 aa, Homo Sapiens
LIHSLFHGF

SEQ ID NO: 363131 - protein, 9 aa, Homo Sapiens
KHHGAQSTA

SEQ ID NO: 363132 - protein, 9 aa, Homo Sapiens
QWETPSEDL

SEQ ID NO: 363133 - protein, 9 aa, Homo Sapiens
PVEVLYGVA

SEQ ID NO: 363134 - protein, 9 aa, Homo Sapiens
LHHSRTPSS

SEQ ID NO: 363135 - protein, 9 aa, Homo Sapiens
EDIMACTKR

SEQ ID NO: 363136 - protein, 9 aa, Homo Sapiens
EISHLRMAT

SEQ ID NO: 363137 - protein, 9 aa, Homo Sapiens
TPEGQWLPQ

SEQ ID NO: 363138 - protein, 9 aa, Homo Sapiens
IKSPLLEQC

SEQ ID NO: 363139 - protein, 9 aa, Homo Sapiens
DFFIGDEAV

SEQ ID NO: 363140 - protein, 9 aa, Homo Sapiens
SSAYRSQWR

SEQ ID NO: 363141 - protein, 9 aa, Homo Sapiens
DNSLALGVN

SEQ ID NO: 363142 - protein, 9 aa, Homo Sapiens
SPGSLGQGE

SEQ ID NO: 363143 - protein, 9 aa, Homo Sapiens
KEKINPFVH

SEQ ID NO: 363144 - protein, 9 aa, Homo Sapiens
QEIPLTPQQ

SEQ ID NO: 363145 - protein, 9 aa, Homo Sapiens
GTPLWAIWP

SEQ ID NO: 363146 - protein, 9 aa, Homo Sapiens
LEDIMACTK

SEQ ID NO: 363147 - protein, 9 aa, Homo Sapiens
RSFKSPITS

SEQ ID NO: 363148 - protein, 9 aa, Homo Sapiens
LRKEEGQIH

SEQ ID NO: 363149 - protein, 9 aa, Homo Sapiens
MMVLRHEPR

SEQ ID NO: 363150 - protein, 9 aa, Homo Sapiens
PTYFLHHSR

SEQ ID NO: 363151 - protein, 9 aa, Homo Sapiens
EFLQSVLEK

SEQ ID NO: 363152 - protein, 9 aa, Homo Sapiens
GDSENPGTV

SEQ ID NO: 363153 - protein, 9 aa, Homo Sapiens
EPSSTQERM

SEQ ID NO: 363154 - protein, 9 aa, Homo Sapiens
IIVFSFWAF

SEQ ID NO: 363155 - protein, 9 aa, Homo Sapiens
GTPEGQWLP

SEQ ID NO: 363156 - protein, 9 aa, Homo Sapiens
RYAFLLHDY

SEQ ID NO: 363157 - protein, 9 aa, Homo Sapiens
GPAGWARQA

SEQ ID NO: 363158 - protein, 9 aa, Homo Sapiens
PNYQLIMSV

SEQ ID NO: 363159 - protein, 9 aa, Homo Sapiens
LGNYIPHFW

SEQ ID NO: 363160 - protein, 9 aa, Homo Sapiens
VNIYIERGR

SEQ ID NO: 363161 - protein, 9 aa, Homo Sapiens
FYRTRCTCI

SEQ ID NO: 363162 - protein, 9 aa, Homo Sapiens
SQPERERCW

SEQ ID NO: 363163 - protein, 9 aa, Homo Sapiens
QCTTSVSAR

SEQ ID NO: 363164 - protein, 9 aa, Homo Sapiens
LQSVLEKLP

SEQ ID NO: 363165 - protein, 9 aa, Homo Sapiens
LCTYMKNLD

SEQ ID NO: 363166 - protein, 9 aa, Homo Sapiens
RWEVLSAAA

SEQ ID NO: 363167 - protein, 9 aa, Homo Sapiens
ITEEFVKQK

SEQ ID NO: 363168 - protein, 9 aa, Homo Sapiens
VHWLNFTLR

SEQ ID NO: 363169 - protein, 9 aa, Homo Sapiens
KHKRIHTVE

SEQ ID NO: 363170 - protein, 9 aa, Homo Sapiens
ALLSSRSGS

SEQ ID NO: 363171 - protein, 9 aa, Homo Sapiens
FDLQRLGVL

SEQ ID NO: 363172 - protein, 9 aa, Homo Sapiens
SQTRSPDFT

SEQ ID NO: 363173 - protein, 9 aa, Homo Sapiens
VFSFWAFGK

SEQ ID NO: 363174 - protein, 9 aa, Homo Sapiens
LTKIPVDTA

SEQ ID NO: 363175 - protein, 9 aa, Homo Sapiens
QGKAFQCAR

SEQ ID NO: 363176 - protein, 9 aa, Homo Sapiens
SNLNGRYPR

SEQ ID NO: 363177 - protein, 9 aa, Homo Sapiens
RLARREERC

SEQ ID NO: 363178 - protein, 9 aa, Homo Sapiens
VNQQRRRSI

SEQ ID NO: 363179 - protein, 9 aa, Homo Sapiens
QFYRTRCTC

SEQ ID NO: 363180 - protein, 9 aa, Homo Sapiens
PGTPLWAIW

SEQ ID NO: 363181 - protein, 9 aa, Homo Sapiens
FFHYIQEAL

SEQ ID NO: 363182 - protein, 9 aa, Homo Sapiens
GHDAIKEAL

SEQ ID NO: 363183 - protein, 9 aa, Homo Sapiens
GSFNNPAIR

SEQ ID NO: 363184 - protein, 9 aa, Homo Sapiens
GCSPGSLGQ

SEQ ID NO: 363185 - protein, 9 aa, Homo Sapiens
KAEMLKNVI

SEQ ID NO: 363186 - protein, 9 aa, Homo Sapiens
MLIDLQYSV

SEQ ID NO: 363187 - protein, 9 aa, Homo Sapiens
AFQCARQMN

SEQ ID NO: 363188 - protein, 9 aa, Homo Sapiens
LSAAEGVFP

SEQ ID NO: 363189 - protein, 9 aa, Homo Sapiens
HWLNFTLRA

SEQ ID NO: 363190 - protein, 9 aa, Homo Sapiens
RKEEGQIHL

SEQ ID NO: 363191 - protein, 9 aa, Homo Sapiens
HWHFVNQQR

SEQ ID NO: 363192 - protein, 9 aa, Homo Sapiens
DLSLARSFK

SEQ ID NO: 363193 - protein, 9 aa, Homo Sapiens
HDYQPAHPT

SEQ ID NO: 363194 - protein, 9 aa, Homo Sapiens
WSKETLGLI

SEQ ID NO: 363195 - protein, 9 aa, Homo Sapiens
HAPTIYSDN

SEQ ID NO: 363196 - protein, 9 aa, Homo Sapiens
SVAKSYAST

SEQ ID NO: 363197 - protein, 9 aa, Homo Sapiens
HLNIQDPEK

SEQ ID NO: 363198 - protein, 9 aa, Homo Sapiens
MEFLGESIM

SEQ ID NO: 363199 - protein, 9 aa, Homo Sapiens
GPAGSFNNP

SEQ ID NO: 363200 - protein, 9 aa, Homo Sapiens
FQLLLDIKS

SEQ ID NO: 363201 - protein, 9 aa, Homo Sapiens
HSLKPWDAV

SEQ ID NO: 363202 - protein, 9 aa, Homo Sapiens
YSPLQCVPE

SEQ ID NO: 363203 - protein, 9 aa, Homo Sapiens
ERPRPVSSP

SEQ ID NO: 363204 - protein, 9 aa, Homo Sapiens
GKRWEVLSA

SEQ ID NO: 363205 - protein, 9 aa, Homo Sapiens
DPGQMGPIG

SEQ ID NO: 363206 - protein, 9 aa, Homo Sapiens
HLRALYALQ

SEQ ID NO: 363207 - protein, 9 aa, Homo Sapiens
LLSTLAAAT

SEQ ID NO: 363208 - protein, 9 aa, Homo Sapiens
GQWLPQSEP

SEQ ID NO: 363209 - protein, 9 aa, Homo Sapiens
WEMKPRRNL

SEQ ID NO: 363210 - protein, 9 aa, Homo Sapiens
EAFLAQRRN

SEQ ID NO: 363211 - protein, 9 aa, Homo Sapiens
LGYRFLGEC

SEQ ID NO: 363212 - protein, 9 aa, Homo Sapiens
EPYTYNGIF

SEQ ID NO: 363213 - protein, 9 aa, Homo Sapiens
IHKLADLCT

SEQ ID NO: 363214 - protein, 9 aa, Homo Sapiens
GHKCFRTQM

SEQ ID NO: 363215 - protein, 9 aa, Homo Sapiens
EQSPAPIPG

SEQ ID NO: 363216 - protein, 9 aa, Homo Sapiens
PEPYTYNGI

SEQ ID NO: 363217 - protein, 9 aa, Homo Sapiens
KNVISRYTG

SEQ ID NO: 363218 - protein, 9 aa, Homo Sapiens
EPGDPGQMG

SEQ ID NO: 363219 - protein, 9 aa, Homo Sapiens
GESESQTRS

SEQ ID NO: 363220 - protein, 9 aa, Homo Sapiens
QAQTQEIPL

SEQ ID NO: 363221 - protein, 9 aa, Homo Sapiens
HTSTVCCMH

SEQ ID NO: 363222 - protein, 9 aa, Homo Sapiens
SSDMEVGCS

SEQ ID NO: 363223 - protein, 9 aa, Homo Sapiens
GAQSTALQK

SEQ ID NO: 363224 - protein, 9 aa, Homo Sapiens
EGVVTMPQY

SEQ ID NO: 363225 - protein, 9 aa, Homo Sapiens
AVNIYIERG

SEQ ID NO: 363226 - protein, 9 aa, Homo Sapiens
LRVTVPVSH

SEQ ID NO: 363227 - protein, 9 aa, Homo Sapiens
ITKQEKDFL

SEQ ID NO: 363228 - protein, 9 aa, Homo Sapiens
HFWTFETGC

SEQ ID NO: 363229 - protein, 9 aa, Homo Sapiens
LHDYQPAHP

SEQ ID NO: 363230 - protein, 9 aa, Homo Sapiens
GEPGDPGQM

SEQ ID NO: 363231 - protein, 9 aa, Homo Sapiens
AVAQFSQGT

SEQ ID NO: 363232 - protein, 9 aa, Homo Sapiens
CARQMNIDV

SEQ ID NO: 363233 - protein, 9 aa, Homo Sapiens
CWYGRHRGA

SEQ ID NO: 363234 - protein, 9 aa, Homo Sapiens
GKTEMDLLV

SEQ ID NO: 363235 - protein, 9 aa, Homo Sapiens
ALDSEGHDS

SEQ ID NO: 363236 - protein, 9 aa, Homo Sapiens
KQEKDFLWS

SEQ ID NO: 363237 - protein, 9 aa, Homo Sapiens
DRPGHKCFR

SEQ ID NO: 363238 - protein, 9 aa, Homo Sapiens
SHLRPEPPN

SEQ ID NO: 363239 - protein, 9 aa, Homo Sapiens
RMEFLGESI

SEQ ID NO: 363240 - protein, 9 aa, Homo Sapiens
RYRLTKIPV

SEQ ID NO: 363241 - protein, 9 aa, Homo Sapiens
VSRNKRSYQ

SEQ ID NO: 363242 - protein, 9 aa, Homo Sapiens
QSGLQSPGT

SEQ ID NO: 363243 - protein, 9 aa, Homo Sapiens
YKRKLFTSE

SEQ ID NO: 363244 - protein, 9 aa, Homo Sapiens
NDNATAFTQ

SEQ ID NO: 363245 - protein, 9 aa, Homo Sapiens
LSTLAAATS

SEQ ID NO: 363246 - protein, 9 aa, Homo Sapiens
ASQGCSPGS

SEQ ID NO: 363247 - protein, 9 aa, Homo Sapiens
VEGEEFPCH

SEQ ID NO: 363248 - protein, 9 aa, Homo Sapiens
VCSENGYLS

SEQ ID NO: 363249 - protein, 9 aa, Homo Sapiens
STLAAATSS

SEQ ID NO: 363250 - protein, 9 aa, Homo Sapiens
KLITEEFVK

SEQ ID NO: 363251 - protein, 9 aa, Homo Sapiens
VLCTYMKNL

SEQ ID NO: 363252 - protein, 9 aa, Homo Sapiens
RLSVTNPAE

SEQ ID NO: 363253 - protein, 9 aa, Homo Sapiens
RRHVYDTKL

SEQ ID NO: 363254 - protein, 9 aa, Homo Sapiens
DVDENLWAR

SEQ ID NO: 363255 - protein, 9 aa, Homo Sapiens
REERCQKRL

SEQ ID NO: 363256 - protein, 9 aa, Homo Sapiens
EKHHGAQST

SEQ ID NO: 363257 - protein, 9 aa, Homo Sapiens
QEALKSDKL

SEQ ID NO: 363258 - protein, 9 aa, Homo Sapiens
HYIQEALKS

SEQ ID NO: 363259 - protein, 9 aa, Homo Sapiens
QVNHIGDGL

SEQ ID NO: 363260 - protein, 9 aa, Homo Sapiens
HQTWTRNPQ

SEQ ID NO: 363261 - protein, 9 aa, Homo Sapiens
SHPVLTLRA

SEQ ID NO: 363262 - protein, 9 aa, Homo Sapiens
RKGGEKTYP

SEQ ID NO: 363263 - protein, 9 aa, Homo Sapiens
FPFFFLRRS

SEQ ID NO: 363264 - protein, 9 aa, Homo Sapiens
GGTGHRLLW

SEQ ID NO: 363265 - protein, 9 aa, Homo Sapiens
METTCVIWF

SEQ ID NO: 363266 - protein, 9 aa, Homo Sapiens
PSEDLQTDL

SEQ ID NO: 363267 - protein, 9 aa, Homo Sapiens
RCVSYNQEK

SEQ ID NO: 363268 - protein, 9 aa, Homo Sapiens
RLHMYSPLQ

SEQ ID NO: 363269 - protein, 9 aa, Homo Sapiens
AEAFLAQRR

SEQ ID NO: 363270 - protein, 9 aa, Homo Sapiens
KEEGQIHLR

SEQ ID NO: 363271 - protein, 9 aa, Homo Sapiens
FLTQRLGAR

SEQ ID NO: 363272 - protein, 9 aa, Homo Sapiens
SPSPGKTEM

SEQ ID NO: 363273 - protein, 9 aa, Homo Sapiens
ENQWETPSE

SEQ ID NO: 363274 - protein, 9 aa, Homo Sapiens
QRFEMIEFD

SEQ ID NO: 363275 - protein, 9 aa, Homo Sapiens
PGKTEMDLL

SEQ ID NO: 363276 - protein, 9 aa, Homo Sapiens
EECEQFMKE

SEQ ID NO: 363277 - protein, 9 aa, Homo Sapiens
TMQLMNDKI

SEQ ID NO: 363278 - protein, 9 aa, Homo Sapiens
GRYAFLLHD

SEQ ID NO: 363279 - protein, 9 aa, Homo Sapiens
QEVENICQT

SEQ ID NO: 363280 - protein, 9 aa, Homo Sapiens
ECDCGAPCE

SEQ ID NO: 363281 - protein, 9 aa, Homo Sapiens
YLSRFTHAN

SEQ ID NO: 363282 - protein, 9 aa, Homo Sapiens
HHGAQSTAL

SEQ ID NO: 363283 - protein, 9 aa, Homo Sapiens
PGNQSDSGS

SEQ ID NO: 363284 - protein, 9 aa, Homo Sapiens
HCEMHQCWS

SEQ ID NO: 363285 - protein, 9 aa, Homo Sapiens
KFKPNQYTE

SEQ ID NO: 363286 - protein, 9 aa, Homo Sapiens
DHQTWTRNP

SEQ ID NO: 363287 - protein, 9 aa, Homo Sapiens
LPQSEPLHP

SEQ ID NO: 363288 - protein, 9 aa, Homo Sapiens
LCLLSGVAA

SEQ ID NO: 363289 - protein, 9 aa, Homo Sapiens
RQCVSGLHR

SEQ ID NO: 363290 - protein, 9 aa, Homo Sapiens
QRLGVLLSH

SEQ ID NO: 363291 - protein, 9 aa, Homo Sapiens
SPGPALGQL

SEQ ID NO: 363292 - protein, 9 aa, Homo Sapiens
AQLRPGNQS

SEQ ID NO: 363293 - protein, 9 aa, Homo Sapiens
VSYNQEKQL

SEQ ID NO: 363294 - protein, 9 aa, Homo Sapiens
FFIMETTCV

SEQ ID NO: 363295 - protein, 9 aa, Homo Sapiens
WVPAEAFLA

SEQ ID NO: 363296 - protein, 9 aa, Homo Sapiens
SKTELIVHV

SEQ ID NO: 363297 - protein, 9 aa, Homo Sapiens
SLTLYPSHP

SEQ ID NO: 363298 - protein, 9 aa, Homo Sapiens
VLYGVAALN

SEQ ID NO: 363299 - protein, 9 aa, Homo Sapiens
GFTDASNSE

SEQ ID NO: 363300 - protein, 9 aa, Homo Sapiens
STALQKVKG

SEQ ID NO: 363301 - protein, 9 aa, Homo Sapiens
SKSSHPLIH

SEQ ID NO: 363302 - protein, 9 aa, Homo Sapiens
KDRIIGAGP

SEQ ID NO: 363303 - protein, 9 aa, Homo Sapiens
CTYMKNLDI

SEQ ID NO: 363304 - protein, 9 aa, Homo Sapiens
GRYPRGTHG

SEQ ID NO: 363305 - protein, 9 aa, Homo Sapiens
PTPNGCPRG

SEQ ID NO: 363306 - protein, 9 aa, Homo Sapiens
LNRPGPQCT

SEQ ID NO: 363307 - protein, 9 aa, Homo Sapiens
YSVAKSYAS

SEQ ID NO: 363308 - protein, 9 aa, Homo Sapiens
LDIKSPLLE

SEQ ID NO: 363309 - protein, 9 aa, Homo Sapiens
SLNSPSPGK

SEQ ID NO: 363310 - protein, 9 aa, Homo Sapiens
QLLEAMETC

SEQ ID NO: 363311 - protein, 9 aa, Homo Sapiens
PIRAYEPRW

SEQ ID NO: 363312 - protein, 9 aa, Homo Sapiens
YIKLADTDD

SEQ ID NO: 363313 - protein, 9 aa, Homo Sapiens
PQSGLQSPG

SEQ ID NO: 363314 - protein, 9 aa, Homo Sapiens
EPPTCPGGT

SEQ ID NO: 363315 - protein, 9 aa, Homo Sapiens
FQCARQMNI

SEQ ID NO: 363316 - protein, 9 aa, Homo Sapiens
NGYLSRFTH

SEQ ID NO: 363317 - protein, 9 aa, Homo Sapiens
RLLWQATPA

SEQ ID NO: 363318 - protein, 9 aa, Homo Sapiens
TKHKRIHTV

SEQ ID NO: 363319 - protein, 9 aa, Homo Sapiens
TGESESQTR

SEQ ID NO: 363320 - protein, 9 aa, Homo Sapiens
EEDDNDDDS

SEQ ID NO: 363321 - protein, 9 aa, Homo Sapiens
KPNYQLIMS

SEQ ID NO: 363322 - protein, 9 aa, Homo Sapiens
GCSPGPALG

SEQ ID NO: 363323 - protein, 9 aa, Homo Sapiens
AIRLWEEAI

SEQ ID NO: 363324 - protein, 9 aa, Homo Sapiens
GEKTYPERL

SEQ ID NO: 363325 - protein, 9 aa, Homo Sapiens
WNFLPLWMH

SEQ ID NO: 363326 - protein, 9 aa, Homo Sapiens
QGEPPTCPG

SEQ ID NO: 363327 - protein, 9 aa, Homo Sapiens
AASQGCSPG

SEQ ID NO: 363328 - protein, 9 aa, Homo Sapiens
KKRQCVSGL

SEQ ID NO: 363329 - protein, 9 aa, Homo Sapiens
WQATPAQRE

SEQ ID NO: 363330 - protein, 9 aa, Homo Sapiens
PIMAHAPTI

SEQ ID NO: 363331 - protein, 9 aa, Homo Sapiens
AQSTALQKV

SEQ ID NO: 363332 - protein, 9 aa, Homo Sapiens
FVNQQRRRS

SEQ ID NO: 363333 - protein, 9 aa, Homo Sapiens
LGECDCGAP

SEQ ID NO: 363334 - protein, 9 aa, Homo Sapiens
GVGTLLSTL

SEQ ID NO: 363335 - protein, 9 aa, Homo Sapiens
EGHDQPRLI

SEQ ID NO: 363336 - protein, 9 aa, Homo Sapiens
SFKSPITSK

SEQ ID NO: 363337 - protein, 9 aa, Homo Sapiens
GGCSPGPAL

SEQ ID NO: 363338 - protein, 9 aa, Homo Sapiens
KIPVDTAAG

SEQ ID NO: 363339 - protein, 9 aa, Homo Sapiens
SVTNPAESI

SEQ ID NO: 363340 - protein, 9 aa, Homo Sapiens
RLTKIPVDT

SEQ ID NO: 363341 - protein, 9 aa, Homo Sapiens
ALGQLCLLS

SEQ ID NO: 363342 - protein, 9 aa, Homo Sapiens
WQLLAAILR

SEQ ID NO: 363343 - protein, 9 aa, Homo Sapiens
ARLSVTNPA

SEQ ID NO: 363344 - protein, 9 aa, Homo Sapiens
FLTEENKWK

SEQ ID NO: 363345 - protein, 9 aa, Homo Sapiens
LAAIPIRAY

SEQ ID NO: 363346 - protein, 9 aa, Homo Sapiens
EKAVAVDLA

SEQ ID NO: 363347 - protein, 9 aa, Homo Sapiens
LTHLYLHRC

SEQ ID NO: 363348 - protein, 9 aa, Homo Sapiens
YGHTSTVCC

SEQ ID NO: 363349 - protein, 9 aa, Homo Sapiens
ENICQTLWC

SEQ ID NO: 363350 - protein, 9 aa, Homo Sapiens
LPLWMHSLK

SEQ ID NO: 363351 - protein, 9 aa, Homo Sapiens
RHEPRQTTS

SEQ ID NO: 363352 - protein, 9 aa, Homo Sapiens
LYGVAALNG

SEQ ID NO: 363353 - protein, 9 aa, Homo Sapiens
EVIPQQLLK

SEQ ID NO: 363354 - protein, 9 aa, Homo Sapiens
DENLWARWP

SEQ ID NO: 363355 - protein, 9 aa, Homo Sapiens
CCMHLHEKR

SEQ ID NO: 363356 - protein, 9 aa, Homo Sapiens
KQQGKAFQC

SEQ ID NO: 363357 - protein, 9 aa, Homo Sapiens
VFVPVYIAE

SEQ ID NO: 363358 - protein, 9 aa, Homo Sapiens
GESIMQLVA

SEQ ID NO: 363359 - protein, 9 aa, Homo Sapiens
LGDHLNVEV

SEQ ID NO: 363360 - protein, 9 aa, Homo Sapiens
KRIHTVEKP

SEQ ID NO: 363361 - protein, 9 aa, Homo Sapiens
RRSLGSSAY

SEQ ID NO: 363362 - protein, 9 aa, Homo Sapiens
LDEPSSVMD

SEQ ID NO: 363363 - protein, 9 aa, Homo Sapiens
EADMSSDME

SEQ ID NO: 363364 - protein, 9 aa, Homo Sapiens
KRKLFTSEL

SEQ ID NO: 363365 - protein, 9 aa, Homo Sapiens
GGHPTSPAT

SEQ ID NO: 363366 - protein, 9 aa, Homo Sapiens
ELWEMKPRR

SEQ ID NO: 363367 - protein, 9 aa, Homo Sapiens
NFTLRASDN

SEQ ID NO: 363368 - protein, 9 aa, Homo Sapiens
WHSYPPPTP

SEQ ID NO: 363369 - protein, 9 aa, Homo Sapiens
LWARWPGAW

SEQ ID NO: 363370 - protein, 9 aa, Homo Sapiens
MLKNVISRY

SEQ ID NO: 363371 - protein, 9 aa, Homo Sapiens
CEMHQCWSD

SEQ ID NO: 363372 - protein, 9 aa, Homo Sapiens
IIYVVIDLP

SEQ ID NO: 363373 - protein, 9 aa, Homo Sapiens
GRSKYLYKR

SEQ ID NO: 363374 - protein, 9 aa, Homo Sapiens
QPRLIKTLQ

SEQ ID NO: 363375 - protein, 9 aa, Homo Sapiens
LGTPEGQWL

SEQ ID NO: 363376 - protein, 9 aa, Homo Sapiens
AGSFNNPAI

SEQ ID NO: 363377 - protein, 9 aa, Homo Sapiens
NPAESIPTI

SEQ ID NO: 363378 - protein, 9 aa, Homo Sapiens
PGSLGQGEP

SEQ ID NO: 363379 - protein, 9 aa, Homo Sapiens
NHIGDGLSP

SEQ ID NO: 363380 - protein, 9 aa, Homo Sapiens
LGEQDQTTL

SEQ ID NO: 363381 - protein, 9 aa, Homo Sapiens
HKCFRTQMS

SEQ ID NO: 363382 - protein, 9 aa, Homo Sapiens
GHPTSPATL

SEQ ID NO: 363383 - protein, 9 aa, Homo Sapiens
CQLGDHLNV

SEQ ID NO: 363384 - protein, 9 aa, Homo Sapiens
LPAQLRPGN

SEQ ID NO: 363385 - protein, 9 aa, Homo Sapiens
DPLSEITKQ

SEQ ID NO: 363386 - protein, 9 aa, Homo Sapiens
NPGTVRAWC

SEQ ID NO: 363387 - protein, 9 aa, Homo Sapiens
DHLNVEVDA

SEQ ID NO: 363388 - protein, 9 aa, Homo Sapiens
LRDVDENLW

SEQ ID NO: 363389 - protein, 9 aa, Homo Sapiens
QRMEFLGES

SEQ ID NO: 363390 - protein, 9 aa, Homo Sapiens
LGQGEPPTC

SEQ ID NO: 363391 - protein, 9 aa, Homo Sapiens
SENGYLSRF

SEQ ID NO: 363392 - protein, 9 aa, Homo Sapiens
EVRKLITEE

SEQ ID NO: 363393 - protein, 9 aa, Homo Sapiens
MNDKINSMV

SEQ ID NO: 363394 - protein, 9 aa, Homo Sapiens
ENGYLSRFT

SEQ ID NO: 363395 - protein, 9 aa, Homo Sapiens
TGVPIMAHA

SEQ ID NO: 363396 - protein, 9 aa, Homo Sapiens
LDEECEQFM

SEQ ID NO: 363397 - protein, 9 aa, Homo Sapiens
APCLQGGGP

SEQ ID NO: 363398 - protein, 9 aa, Homo Sapiens
EPSSVMDPC

SEQ ID NO: 363399 - protein, 9 aa, Homo Sapiens
QCGPQSGLQ

SEQ ID NO: 363400 - protein, 9 aa, Homo Sapiens
QQFFFFFFP

SEQ ID NO: 363401 - protein, 9 aa, Homo Sapiens
PHCSIPPAD

SEQ ID NO: 363402 - protein, 9 aa, Homo Sapiens
DLPEEPSST

SEQ ID NO: 363403 - protein, 9 aa, Homo Sapiens
VWHSYPPPT

SEQ ID NO: 363404 - protein, 9 aa, Homo Sapiens
IASLALGDI

SEQ ID NO: 363405 - protein, 9 aa, Homo Sapiens
RERCWYGRH

SEQ ID NO: 363406 - protein, 9 aa, Homo Sapiens
VIICVEGEE

SEQ ID NO: 363407 - protein, 9 aa, Homo Sapiens
TKDRIIGAG

SEQ ID NO: 363408 - protein, 9 aa, Homo Sapiens
YFDLQRLGV

SEQ ID NO: 363409 - protein, 9 aa, Homo Sapiens
PGVLLVFGT

SEQ ID NO: 363410 - protein, 9 aa, Homo Sapiens
RQVPVPEPY

SEQ ID NO: 363411 - protein, 9 aa, Homo Sapiens
PALGQLCLL

SEQ ID NO: 363412 - protein, 9 aa, Homo Sapiens
SKETLGLIC

SEQ ID NO: 363413 - protein, 9 aa, Homo Sapiens
YRSQWREPT

SEQ ID NO: 363414 - protein, 9 aa, Homo Sapiens
IETMQLMND

SEQ ID NO: 363415 - protein, 9 aa, Homo Sapiens
FFFPFFFLR

SEQ ID NO: 363416 - protein, 9 aa, Homo Sapiens
TRCTCIGAQ

SEQ ID NO: 363417 - protein, 9 aa, Homo Sapiens
LWGLLGQEG

SEQ ID NO: 363418 - protein, 9 aa, Homo Sapiens
WLNFTLRAS

SEQ ID NO: 363419 - protein, 9 aa, Homo Sapiens
REKAVAVDL

SEQ ID NO: 363420 - protein, 9 aa, Homo Sapiens
ERGREAHCQ

SEQ ID NO: 363421 - protein, 9 aa, Homo Sapiens
RFAWHVSPL

SEQ ID NO: 363422 - protein, 9 aa, Homo Sapiens
LARREERCQ

SEQ ID NO: 363423 - protein, 9 aa, Homo Sapiens
NLWARWPGA

SEQ ID NO: 363424 - protein, 9 aa, Homo Sapiens
VHVELSPMQ

SEQ ID NO: 363425 - protein, 9 aa, Homo Sapiens
GKAFQCARQ

SEQ ID NO: 363426 - protein, 9 aa, Homo Sapiens
ENPGTVRAW

SEQ ID NO: 363427 - protein, 9 aa, Homo Sapiens
TVPPHCSIP

SEQ ID NO: 363428 - protein, 9 aa, Homo Sapiens
LYLHRCVRL

SEQ ID NO: 363429 - protein, 9 aa, Homo Sapiens
PSKTELIVH

SEQ ID NO: 363430 - protein, 9 aa, Homo Sapiens
GEQDQTTLR

SEQ ID NO: 363431 - protein, 9 aa, Homo Sapiens
FEISHLRMA

SEQ ID NO: 363432 - protein, 9 aa, Homo Sapiens
VRQCGPQSG

SEQ ID NO: 363433 - protein, 9 aa, Homo Sapiens
SDIILTNDN

SEQ ID NO: 363434 - protein, 9 aa, Homo Sapiens
CGGAYIKLA

SEQ ID NO: 363435 - protein, 9 aa, Homo Sapiens
SLGSSAYRS

SEQ ID NO: 363436 - protein, 9 aa, Homo Sapiens
SGLQSPGTL

SEQ ID NO: 363437 - protein, 9 aa, Homo Sapiens
FLPLWMHSL

SEQ ID NO: 363438 - protein, 9 aa, Homo Sapiens
LQKPRHRCG

SEQ ID NO: 363439 - protein, 9 aa, Homo Sapiens
PQCTTSVSA

SEQ ID NO: 363440 - protein, 9 aa, Homo Sapiens
LAVVHRFAW

SEQ ID NO: 363441 - protein, 9 aa, Homo Sapiens
KWKRVMKSL

SEQ ID NO: 363442 - protein, 9 aa, Homo Sapiens
KSSHPLIHS

SEQ ID NO: 363443 - protein, 9 aa, Homo Sapiens
LDYFTKPNY

SEQ ID NO: 363444 - protein, 9 aa, Homo Sapiens
VEVLYGVAA

SEQ ID NO: 363445 - protein, 9 aa, Homo Sapiens
RPGNQSDSG

SEQ ID NO: 363446 - protein, 9 aa, Homo Sapiens
PAWQLLAAI

SEQ ID NO: 363447 - protein, 9 aa, Homo Sapiens
PHFWTFETG

SEQ ID NO: 363448 - protein, 9 aa, Homo Sapiens
RDVDENLWA

SEQ ID NO: 363449 - protein, 9 aa, Homo Sapiens
SLALGVNHR

SEQ ID NO: 363450 - protein, 9 aa, Homo Sapiens
SGPAGSFNN

SEQ ID NO: 363451 - protein, 9 aa, Homo Sapiens
RCQFYRTRC

SEQ ID NO: 363452 - protein, 9 aa, Homo Sapiens
RWSKETLGL

SEQ ID NO: 363453 - protein, 9 aa, Homo Sapiens
EGKRWEVLS

SEQ ID NO: 363454 - protein, 9 aa, Homo Sapiens
ECEQFMKEL

SEQ ID NO: 363455 - protein, 9 aa, Homo Sapiens
KRQCVSGLH

SEQ ID NO: 363456 - protein, 9 aa, Homo Sapiens
RREERCQKR

SEQ ID NO: 363457 - protein, 9 aa, Homo Sapiens
QGTRAAGGS

SEQ ID NO: 363458 - protein, 9 aa, Homo Sapiens
IRAYEPRWF

SEQ ID NO: 363459 - protein, 9 aa, Homo Sapiens
NEGKRWEVL

SEQ ID NO: 363460 - protein, 9 aa, Homo Sapiens
ARAGGCSPG

SEQ ID NO: 363461 - protein, 9 aa, Homo Sapiens
SAAEGVFPV

SEQ ID NO: 363462 - protein, 9 aa, Homo Sapiens
IERGREAHC

SEQ ID NO: 363463 - protein, 9 aa, Homo Sapiens
VFGTMTDVF

SEQ ID NO: 363464 - protein, 9 aa, Homo Sapiens
FKPNQYTEI

SEQ ID NO: 363465 - protein, 9 aa, Homo Sapiens
CQFYRTRCT

SEQ ID NO: 363466 - protein, 9 aa, Homo Sapiens
INPFVHLPF

SEQ ID NO: 363467 - protein, 9 aa, Homo Sapiens
DFIIIVFSF

SEQ ID NO: 363468 - protein, 9 aa, Homo Sapiens
RIIGAGPKG

SEQ ID NO: 363469 - protein, 9 aa, Homo Sapiens
YLHRCVRLT

SEQ ID NO: 363470 - protein, 9 aa, Homo Sapiens
IAEGVVTMP

SEQ ID NO: 363471 - protein, 9 aa, Homo Sapiens
WLPQSEPLH

SEQ ID NO: 363472 - protein, 9 aa, Homo Sapiens
LEKLPGVDP

SEQ ID NO: 363473 - protein, 9 aa, Homo Sapiens
VHLPFGVGK

SEQ ID NO: 363474 - protein, 9 aa, Homo Sapiens
RHVYDTKLG

SEQ ID NO: 363475 - protein, 9 aa, Homo Sapiens
SESQTRSPD

SEQ ID NO: 363476 - protein, 9 aa, Homo Sapiens
EIDTIAADE

SEQ ID NO: 363477 - protein, 9 aa, Homo Sapiens
SGVAAASQG

SEQ ID NO: 363478 - protein, 9 aa, Homo Sapiens
AEPTYFLHH

SEQ ID NO: 363479 - protein, 9 aa, Homo Sapiens
TRNPQVTLE

SEQ ID NO: 363480 - protein, 9 aa, Homo Sapiens
PGSTAPAAH

SEQ ID NO: 363481 - protein, 9 aa, Homo Sapiens
NATAFTQTS

SEQ ID NO: 363482 - protein, 9 aa, Homo Sapiens
QRLGARAGG

SEQ ID NO: 363483 - protein, 9 aa, Homo Sapiens
SLGLLWGLL

SEQ ID NO: 363484 - protein, 9 aa, Homo Sapiens
PSSVMDPCS

SEQ ID NO: 363485 - protein, 9 aa, Homo Sapiens
TFCFFPWPT

SEQ ID NO: 363486 - protein, 9 aa, Homo Sapiens
SEITKQEKD

SEQ ID NO: 363487 - protein, 9 aa, Homo Sapiens
PGEPGDPGQ

SEQ ID NO: 363488 - protein, 9 aa, Homo Sapiens
KTEMDLLVT

SEQ ID NO: 363489 - protein, 9 aa, Homo Sapiens
QLTHLYLHR

SEQ ID NO: 363490 - protein, 9 aa, Homo Sapiens
EFLGESIMQ

SEQ ID NO: 363491 - protein, 9 aa, Homo Sapiens
AYIKLADTD

SEQ ID NO: 363492 - protein, 9 aa, Homo Sapiens
VDKPTYATK

SEQ ID NO: 363493 - protein, 9 aa, Homo Sapiens
LGLLWGLLG

SEQ ID NO: 363494 - protein, 9 aa, Homo Sapiens
TTTILHPTN

SEQ ID NO: 363495 - protein, 9 aa, Homo Sapiens
VAALNGLFG

SEQ ID NO: 363496 - protein, 9 aa, Homo Sapiens
DEPSSVMDP

SEQ ID NO: 363497 - protein, 9 aa, Homo Sapiens
FIGDEAVDK

SEQ ID NO: 363498 - protein, 9 aa, Homo Sapiens
QEEGSGGPT

SEQ ID NO: 363499 - protein, 9 aa, Homo Sapiens
PFFFLRRSL

SEQ ID NO: 363500 - protein, 9 aa, Homo Sapiens
RMATPATVS

SEQ ID NO: 363501 - protein, 9 aa, Homo Sapiens
NVLHNSYAL

SEQ ID NO: 363502 - protein, 9 aa, Homo Sapiens
QQAQTQEIP

SEQ ID NO: 363503 - protein, 9 aa, Homo Sapiens
IVSRNKRSY

SEQ ID NO: 363504 - protein, 9 aa, Homo Sapiens
IMACTKRLL

SEQ ID NO: 363505 - protein, 9 aa, Homo Sapiens
RQECDRKFR

SEQ ID NO: 363506 - protein, 9 aa, Homo Sapiens
HDAIKEALV

SEQ ID NO: 363507 - protein, 9 aa, Homo Sapiens
TNQEELWEM

SEQ ID NO: 363508 - protein, 9 aa, Homo Sapiens
AVVHRFAWH

SEQ ID NO: 363509 - protein, 9 aa, Homo Sapiens
IIIVFSFWA

SEQ ID NO: 363510 - protein, 9 aa, Homo Sapiens
PAPIPGGGD

SEQ ID NO: 363511 - protein, 9 aa, Homo Sapiens
SDVNDNATA

SEQ ID NO: 363512 - protein, 9 aa, Homo Sapiens
RIHKLADLC

SEQ ID NO: 363513 - protein, 9 aa, Homo Sapiens
YIPHFWTFE

SEQ ID NO: 363514 - protein, 9 aa, Homo Sapiens
TEEFVKQKY

SEQ ID NO: 363515 - protein, 9 aa, Homo Sapiens
FFFFFFPFF

SEQ ID NO: 363516 - protein, 9 aa, Homo Sapiens
RSKYLYKRK

SEQ ID NO: 363517 - protein, 9 aa, Homo Sapiens
WEVLSAAAA

SEQ ID NO: 363518 - protein, 9 aa, Homo Sapiens
IKLADTDDL

SEQ ID NO: 363519 - protein, 9 aa, Homo Sapiens
NMMVLRHEP

SEQ ID NO: 363520 - protein, 9 aa, Homo Sapiens
RSLTLYPSH

SEQ ID NO: 363521 - protein, 9 aa, Homo Sapiens
TEENKWKRV

SEQ ID NO: 363522 - protein, 9 aa, Homo Sapiens
NDRPGHKCF

SEQ ID NO: 363523 - protein, 9 aa, Homo Sapiens
NLNGRYPRG

SEQ ID NO: 363524 - protein, 9 aa, Homo Sapiens
TKIPVDTAA

SEQ ID NO: 363525 - protein, 9 aa, Homo Sapiens
GGGPAGWAR

SEQ ID NO: 363526 - protein, 9 aa, Homo Sapiens
SVLEKLPGV

SEQ ID NO: 363527 - protein, 9 aa, Homo Sapiens
RNFKQNQAF

SEQ ID NO: 363528 - protein, 9 aa, Homo Sapiens
CSAPWSRST

SEQ ID NO: 363529 - protein, 9 aa, Homo Sapiens
NQYTEIDTI

SEQ ID NO: 363530 - protein, 9 aa, Homo Sapiens
NIYIERGRE

SEQ ID NO: 363531 - protein, 9 aa, Homo Sapiens
LNSPSPGKT

SEQ ID NO: 363532 - protein, 9 aa, Homo Sapiens
YLYKRKLFT

SEQ ID NO: 363533 - protein, 9 aa, Homo Sapiens
TQLTHLYLH

SEQ ID NO: 363534 - protein, 9 aa, Homo Sapiens
FNEVIPQQL

SEQ ID NO: 363535 - protein, 9 aa, Homo Sapiens
VFEISHLRM

SEQ ID NO: 363536 - protein, 9 aa, Homo Sapiens
EAVDKPTYA

SEQ ID NO: 363537 - protein, 9 aa, Homo Sapiens
VDENLWARW

SEQ ID NO: 363538 - protein, 9 aa, Homo Sapiens
GHDQPRLIK

SEQ ID NO: 363539 - protein, 9 aa, Homo Sapiens
KYLYKRKLF

SEQ ID NO: 363540 - protein, 9 aa, Homo Sapiens
WMHSLKPWD

SEQ ID NO: 363541 - protein, 9 aa, Homo Sapiens
EEPSSTQER

SEQ ID NO: 363542 - protein, 9 aa, Homo Sapiens
PEGQWLPQS

SEQ ID NO: 363543 - protein, 9 aa, Homo Sapiens
QMGPIGSRG

SEQ ID NO: 363544 - protein, 9 aa, Homo Sapiens
QQLSRQECD

SEQ ID NO: 363545 - protein, 9 aa, Homo Sapiens
YRTRCTCIG

SEQ ID NO: 363546 - protein, 9 aa, Homo Sapiens
LWQATPAQR

SEQ ID NO: 363547 - protein, 9 aa, Homo Sapiens
WGLLGQEGP

SEQ ID NO: 363548 - protein, 9 aa, Homo Sapiens
GLLWGLLGQ

SEQ ID NO: 363549 - protein, 9 aa, Homo Sapiens
HGAQSTALQ

SEQ ID NO: 363550 - protein, 9 aa, Homo Sapiens
EAIRLWEEA

SEQ ID NO: 363551 - protein, 9 aa, Homo Sapiens
SLPAWQLLA

SEQ ID NO: 363552 - protein, 9 aa, Homo Sapiens
GPRERPRPV

SEQ ID NO: 363553 - protein, 9 aa, Homo Sapiens
KTELIVHVE

SEQ ID NO: 363554 - protein, 9 aa, Homo Sapiens
VLMRKGGEK

SEQ ID NO: 363555 - protein, 9 aa, Homo Sapiens
TFCQEVENI

SEQ ID NO: 363556 - protein, 9 aa, Homo Sapiens
EEGQIHLRA

SEQ ID NO: 363557 - protein, 9 aa, Homo Sapiens
SLDRWSKET

SEQ ID NO: 363558 - protein, 9 aa, Homo Sapiens
GFNEVIPQQ

SEQ ID NO: 363559 - protein, 9 aa, Homo Sapiens
GVLLVFGTM

SEQ ID NO: 363560 - protein, 9 aa, Homo Sapiens
QDVHNRIVI

SEQ ID NO: 363561 - protein, 9 aa, Homo Sapiens
TILHPTNVV

SEQ ID NO: 363562 - protein, 9 aa, Homo Sapiens
QIHLRALYA

SEQ ID NO: 363563 - protein, 9 aa, Homo Sapiens
LVLDRIHKL

SEQ ID NO: 363564 - protein, 9 aa, Homo Sapiens
IAQPGVLLV

SEQ ID NO: 363565 - protein, 9 aa, Homo Sapiens
QCVSGLHRY

SEQ ID NO: 363566 - protein, 9 aa, Homo Sapiens
SQGTRAAGG

SEQ ID NO: 363567 - protein, 9 aa, Homo Sapiens
TKAEMLKNV

SEQ ID NO: 363568 - protein, 9 aa, Homo Sapiens
NICQTLWCS

SEQ ID NO: 363569 - protein, 9 aa, Homo Sapiens
GEVRKLITE

SEQ ID NO: 363570 - protein, 9 aa, Homo Sapiens
IWPVHYGKE

SEQ ID NO: 363571 - protein, 9 aa, Homo Sapiens
GVSQVLCTY

SEQ ID NO: 363572 - protein, 9 aa, Homo Sapiens
PAPGSTAPA

SEQ ID NO: 363573 - protein, 9 aa, Homo Sapiens
EVLYGVAAL

SEQ ID NO: 363574 - protein, 9 aa, Homo Sapiens
RPGPQCTTS

SEQ ID NO: 363575 - protein, 9 aa, Homo Sapiens
LNIQDPEKR

SEQ ID NO: 363576 - protein, 9 aa, Homo Sapiens
IVFSFWAFG

SEQ ID NO: 363577 - protein, 9 aa, Homo Sapiens
DIMACTKRL

SEQ ID NO: 363578 - protein, 9 aa, Homo Sapiens
TQEIPLTPQ

SEQ ID NO: 363579 - protein, 9 aa, Homo Sapiens
PTQAPLPVL

SEQ ID NO: 363580 - protein, 9 aa, Homo Sapiens
WTRNPQVTL

SEQ ID NO: 363581 - protein, 9 aa, Homo Sapiens
RASASDCSA

SEQ ID NO: 363582 - protein, 9 aa, Homo Sapiens
VGTLLSTLA

SEQ ID NO: 363583 - protein, 9 aa, Homo Sapiens
HLYLHRCVR

SEQ ID NO: 363584 - protein, 9 aa, Homo Sapiens
RCQKRLQEA

SEQ ID NO: 363585 - protein, 9 aa, Homo Sapiens
VVRQCGPQS

SEQ ID NO: 363586 - protein, 9 aa, Homo Sapiens
FTDASNSER

SEQ ID NO: 363587 - protein, 9 aa, Homo Sapiens
LIPFIDEKQ

SEQ ID NO: 363588 - protein, 9 aa, Homo Sapiens
FKQNQAFQY

SEQ ID NO: 363589 - protein, 9 aa, Homo Sapiens
RALLSSRSG

SEQ ID NO: 363590 - protein, 9 aa, Homo Sapiens
ASDCSAPWS

SEQ ID NO: 363591 - protein, 9 aa, Homo Sapiens
HQCWSDEYN

SEQ ID NO: 363592 - protein, 9 aa, Homo Sapiens
YLGNYIPHF

SEQ ID NO: 363593 - protein, 9 aa, Homo Sapiens
FCFFPWPTE

SEQ ID NO: 363594 - protein, 9 aa, Homo Sapiens
VNSQRFEMI

SEQ ID NO: 363595 - protein, 9 aa, Homo Sapiens
VNHIGDGLS

SEQ ID NO: 363596 - protein, 9 aa, Homo Sapiens
AHAPTIYSD

SEQ ID NO: 363597 - protein, 9 aa, Homo Sapiens
KTTTILHPT

SEQ ID NO: 363598 - protein, 9 aa, Homo Sapiens
LTEENKWKR

SEQ ID NO: 363599 - protein, 9 aa, Homo Sapiens
EMKPRRNLE

SEQ ID NO: 363600 - protein, 9 aa, Homo Sapiens
GGPTQAPLP

SEQ ID NO: 363601 - protein, 9 aa, Homo Sapiens
CQKRLQEAL

SEQ ID NO: 363602 - protein, 9 aa, Homo Sapiens
FVCSENGYL

SEQ ID NO: 363603 - protein, 9 aa, Homo Sapiens
ILTNDNFTS

SEQ ID NO: 363604 - protein, 9 aa, Homo Sapiens
EGHDSEGPA

SEQ ID NO: 363605 - protein, 9 aa, Homo Sapiens
PPPTPNGCP

SEQ ID NO: 363606 - protein, 9 aa, Homo Sapiens
SVMDPCSKR

SEQ ID NO: 363607 - protein, 9 aa, Homo Sapiens
PAGSFNNPA

SEQ ID NO: 363608 - protein, 9 aa, Homo Sapiens
GVLLSHLRK

SEQ ID NO: 363609 - protein, 9 aa, Homo Sapiens
SQVLCTYMK

SEQ ID NO: 363610 - protein, 9 aa, Homo Sapiens
PGQMGPIGS

SEQ ID NO: 363611 - protein, 9 aa, Homo Sapiens
DEKQLLEAM

SEQ ID NO: 363612 - protein, 9 aa, Homo Sapiens
PLQCVPENT

SEQ ID NO: 363613 - protein, 9 aa, Homo Sapiens
DGFTDASNS

SEQ ID NO: 363614 - protein, 9 aa, Homo Sapiens
RDPLSEITK

SEQ ID NO: 363615 - protein, 9 aa, Homo Sapiens
ECLSAAEGV

SEQ ID NO: 363616 - protein, 9 aa, Homo Sapiens
QTTLRPPEK

SEQ ID NO: 363617 - protein, 9 aa, Homo Sapiens
FDLAAIPIR

SEQ ID NO: 363618 - protein, 9 aa, Homo Sapiens
EIVSRNKRS

SEQ ID NO: 363619 - protein, 9 aa, Homo Sapiens
IRLWEEAIL

SEQ ID NO: 363620 - protein, 9 aa, Homo Sapiens
YSKNEGKRW

SEQ ID NO: 363621 - protein, 9 aa, Homo Sapiens
KPRHRCGKR

SEQ ID NO: 363622 - protein, 9 aa, Homo Sapiens
SPATLSRAW

SEQ ID NO: 363623 - protein, 9 aa, Homo Sapiens
ERCQKRLQE

SEQ ID NO: 363624 - protein, 9 aa, Homo Sapiens
GTRAAGGSG

SEQ ID NO: 363625 - protein, 9 aa, Homo Sapiens
RPGHKCFRT

SEQ ID NO: 363626 - protein, 9 aa, Homo Sapiens
NSQRFEMIE

SEQ ID NO: 363627 - protein, 9 aa, Homo Sapiens
EGQWLPQSE

SEQ ID NO: 363628 - protein, 9 aa, Homo Sapiens
KAVAVDLAK

SEQ ID NO: 363629 - protein, 9 aa, Homo Sapiens
DYGTFYPRP

SEQ ID NO: 363630 - protein, 9 aa, Homo Sapiens
KLADTDDLI

SEQ ID NO: 363631 - protein, 9 aa, Homo Sapiens
YNQEKQLKL

SEQ ID NO: 363632 - protein, 9 aa, Homo Sapiens
GRASASDCS

SEQ ID NO: 363633 - protein, 9 aa, Homo Sapiens
LAKKEAAEK

SEQ ID NO: 363634 - protein, 9 aa, Homo Sapiens
LLHDYQPAH

SEQ ID NO: 363635 - protein, 9 aa, Homo Sapiens
LYKRKLFTS

SEQ ID NO: 363636 - protein, 9 aa, Homo Sapiens
LLSGVAAAS

SEQ ID NO: 363637 - protein, 9 aa, Homo Sapiens
MYSPLQCVP

SEQ ID NO: 363638 - protein, 9 aa, Homo Sapiens
DLHKEDYSV

SEQ ID NO: 363639 - protein, 9 aa, Homo Sapiens
SSLTGESES

SEQ ID NO: 363640 - protein, 9 aa, Homo Sapiens
GEPPTCPGG

SEQ ID NO: 363641 - protein, 9 aa, Homo Sapiens
HKLADLCTG

SEQ ID NO: 363642 - protein, 9 aa, Homo Sapiens
HLNVEVDAA

SEQ ID NO: 363643 - protein, 9 aa, Homo Sapiens
FNNPAIRIS

SEQ ID NO: 363644 - protein, 9 aa, Homo Sapiens
YHPGIFRGD

SEQ ID NO: 363645 - protein, 9 aa, Homo Sapiens
NLNRPGPQC

SEQ ID NO: 363646 - protein, 9 aa, Homo Sapiens
GSGGPTQAP

SEQ ID NO: 363647 - protein, 9 aa, Homo Sapiens
TWTRNPQVT

SEQ ID NO: 363648 - protein, 9 aa, Homo Sapiens
QPGVLLVFG

SEQ ID NO: 363649 - protein, 9 aa, Homo Sapiens
WETPSEDLQ

SEQ ID NO: 363650 - protein, 9 aa, Homo Sapiens
PRPVSSPAL

SEQ ID NO: 363651 - protein, 9 aa, Homo Sapiens
LLVFGTMTD

SEQ ID NO: 363652 - protein, 9 aa, Homo Sapiens
VAQFSQGTR

SEQ ID NO: 363653 - protein, 9 aa, Homo Sapiens
VPIMAHAPT

SEQ ID NO: 363654 - protein, 9 aa, Homo Sapiens
KETLGLICM

SEQ ID NO: 363655 - protein, 9 aa, Homo Sapiens
HILAQDVHN

SEQ ID NO: 363656 - protein, 9 aa, Homo Sapiens
PQQLLKTFD

SEQ ID NO: 363657 - protein, 9 aa, Homo Sapiens
RCWYGRHRG

SEQ ID NO: 363658 - protein, 9 aa, Homo Sapiens
LRPGNQSDS

SEQ ID NO: 363659 - protein, 9 aa, Homo Sapiens
TYFLHHSRT

SEQ ID NO: 363660 - protein, 9 aa, Homo Sapiens
LSLARSFKS

SEQ ID NO: 363661 - protein, 9 aa, Homo Sapiens
CSIPPADPR

SEQ ID NO: 363662 - protein, 9 aa, Homo Sapiens
EMIEFDESA

SEQ ID NO: 363663 - protein, 9 aa, Homo Sapiens
QCARQMNID

SEQ ID NO: 363664 - protein, 9 aa, Homo Sapiens
EKTYPERLQ

SEQ ID NO: 363665 - protein, 9 aa, Homo Sapiens
TLRASDNGS

SEQ ID NO: 363666 - protein, 9 aa, Homo Sapiens
LGQLCLLSG

SEQ ID NO: 363667 - protein, 9 aa, Homo Sapiens
LPAWQLLAA

SEQ ID NO: 363668 - protein, 9 aa, Homo Sapiens
PRHRCGKRK

SEQ ID NO: 363669 - protein, 9 aa, Homo Sapiens
RGREAHCQS

SEQ ID NO: 363670 - protein, 9 aa, Homo Sapiens
STQERMFTI

SEQ ID NO: 363671 - protein, 9 aa, Homo Sapiens
TDASNSERF

SEQ ID NO: 363672 - protein, 9 aa, Homo Sapiens
AEGVVTMPQ

SEQ ID NO: 363673 - protein, 9 aa, Homo Sapiens
EPTYFLHHS

SEQ ID NO: 363674 - protein, 9 aa, Homo Sapiens
DVIICVEGE

SEQ ID NO: 363675 - protein, 9 aa, Homo Sapiens
FFLEDIMAC

SEQ ID NO: 363676 - protein, 9 aa, Homo Sapiens
GKRKPLLAI

SEQ ID NO: 363677 - protein, 9 aa, Homo Sapiens
SLGQGEPPT

SEQ ID NO: 363678 - protein, 9 aa, Homo Sapiens
HPSNPLVLE

SEQ ID NO: 363679 - protein, 9 aa, Homo Sapiens
DMSSDMEVG

SEQ ID NO: 363680 - protein, 9 aa, Homo Sapiens
LGESIMQLV

SEQ ID NO: 363681 - protein, 9 aa, Homo Sapiens
LQFQADPNV

SEQ ID NO: 363682 - protein, 9 aa, Homo Sapiens
LRMATPATV

SEQ ID NO: 363683 - protein, 9 aa, Homo Sapiens
NQEELWEMK

SEQ ID NO: 363684 - protein, 9 aa, Homo Sapiens
EASDIILTN

SEQ ID NO: 363685 - protein, 9 aa, Homo Sapiens
GPQSGLQSP

SEQ ID NO: 363686 - protein, 9 aa, Homo Sapiens
QTWTRNPQV

SEQ ID NO: 363687 - protein, 9 aa, Homo Sapiens
KGGEKTYPE

SEQ ID NO: 363688 - protein, 9 aa, Homo Sapiens
TAPAAHGVT

SEQ ID NO: 363689 - protein, 9 aa, Homo Sapiens
NPFVHLPFG

SEQ ID NO: 363690 - protein, 9 aa, Homo Sapiens
LHILAQDVH

SEQ ID NO: 363691 - protein, 9 aa, Homo Sapiens
MRKGGEKTY

SEQ ID NO: 363692 - protein, 9 aa, Homo Sapiens
GGEKTYPER

SEQ ID NO: 363693 - protein, 9 aa, Homo Sapiens
VVHRFAWHV

SEQ ID NO: 363694 - protein, 9 aa, Homo Sapiens
QGGGPAGWA

SEQ ID NO: 363695 - protein, 9 aa, Homo Sapiens
GSYHPGIFR

SEQ ID NO: 363696 - protein, 9 aa, Homo Sapiens
EGSGGPTQA

SEQ ID NO: 363697 - protein, 9 aa, Homo Sapiens
FHWHFVNQQ

SEQ ID NO: 363698 - protein, 9 aa, Homo Sapiens
PVLMRKGGE

SEQ ID NO: 363699 - protein, 9 aa, Homo Sapiens
GTRRHVYDT

SEQ ID NO: 363700 - protein, 9 aa, Homo Sapiens
DEQSPAPIP

SEQ ID NO: 363701 - protein, 9 aa, Homo Sapiens
VSDVNDNAT

SEQ ID NO: 363702 - protein, 9 aa, Homo Sapiens
VDLVLDRIH

SEQ ID NO: 363703 - protein, 9 aa, Homo Sapiens
TQAPLPVLS

SEQ ID NO: 363704 - protein, 9 aa, Homo Sapiens
YPSHPSNPL

SEQ ID NO: 363705 - protein, 9 aa, Homo Sapiens
ADRRNFKQN

SEQ ID NO: 363706 - protein, 9 aa, Homo Sapiens
LTNDNFTSI

SEQ ID NO: 363707 - protein, 9 aa, Homo Sapiens
ATAFTQTSY

SEQ ID NO: 363708 - protein, 9 aa, Homo Sapiens
SGGPTQAPL

SEQ ID NO: 363709 - protein, 9 aa, Homo Sapiens
DIKSPLLEQ

SEQ ID NO: 363710 - protein, 9 aa, Homo Sapiens
KQLLEAMET

SEQ ID NO: 363711 - protein, 9 aa, Homo Sapiens
MSSDMEVGC

SEQ ID NO: 363712 - protein, 9 aa, Homo Sapiens
FTFCFFPWP

SEQ ID NO: 363713 - protein, 9 aa, Homo Sapiens
RTRCTCIGA

SEQ ID NO: 363714 - protein, 9 aa, Homo Sapiens
WSDEYNCSS

SEQ ID NO: 363715 - protein, 9 aa, Homo Sapiens
IRRIDLHKE

SEQ ID NO: 363716 - protein, 9 aa, Homo Sapiens
RRIDLHKED

SEQ ID NO: 363717 - protein, 9 aa, Homo Sapiens
VNDNATAFT

SEQ ID NO: 363718 - protein, 9 aa, Homo Sapiens
FSQGTRAAG

SEQ ID NO: 363719 - protein, 9 aa, Homo Sapiens
ILHPTNVVA

SEQ ID NO: 363720 - protein, 9 aa, Homo Sapiens
IYIERGREA

SEQ ID NO: 363721 - protein, 9 aa, Homo Sapiens
FLHHSRTPS

SEQ ID NO: 363722 - protein, 9 aa, Homo Sapiens
RPVSSPALL

SEQ ID NO: 363723 - protein, 9 aa, Homo Sapiens
AAEGVFPVT

SEQ ID NO: 363724 - protein, 9 aa, Homo Sapiens
HRLLWQATP

SEQ ID NO: 363725 - protein, 9 aa, Homo Sapiens
QYTEIDTIA

SEQ ID NO: 363726 - protein, 9 aa, Homo Sapiens
NIQDPEKRK

SEQ ID NO: 363727 - protein, 9 aa, Homo Sapiens
PAQLRPGNQ

SEQ ID NO: 363728 - protein, 9 aa, Homo Sapiens
HVYDTKLGT

SEQ ID NO: 363729 - protein, 9 aa, Homo Sapiens
DSEGHDSEG

SEQ ID NO: 363730 - protein, 9 aa, Homo Sapiens
PSPGKTEMD

SEQ ID NO: 363731 - protein, 9 aa, Homo Sapiens
NYLGNYIPH

SEQ ID NO: 363732 - protein, 9 aa, Homo Sapiens
EKRKEFLKT

SEQ ID NO: 363733 - protein, 9 aa, Homo Sapiens
VMDPCSKRY

SEQ ID NO: 363734 - protein, 9 aa, Homo Sapiens
TPLWAIWPV

SEQ ID NO: 363735 - protein, 9 aa, Homo Sapiens
GQLCLLSGV

SEQ ID NO: 363736 - protein, 9 aa, Homo Sapiens
LQYSVAKSY

SEQ ID NO: 363737 - protein, 9 aa, Homo Sapiens
GDPGQMGPI

SEQ ID NO: 363738 - protein, 9 aa, Homo Sapiens
GVAALNGLF

SEQ ID NO: 363739 - protein, 9 aa, Homo Sapiens
LSEITKQEK

SEQ ID NO: 363740 - protein, 9 aa, Homo Sapiens
TAADRRNFK

SEQ ID NO: 363741 - protein, 9 aa, Homo Sapiens
TNDNFTSIV

SEQ ID NO: 363742 - protein, 9 aa, Homo Sapiens
SLTGESESQ

SEQ ID NO: 363743 - protein, 9 aa, Homo Sapiens
VLCGHDAIK

SEQ ID NO: 363744 - protein, 9 aa, Homo Sapiens
NQRMEFLGE

SEQ ID NO: 363745 - protein, 9 aa, Homo Sapiens
QRRRSIRRR

SEQ ID NO: 363746 - protein, 9 aa, Homo Sapiens
HRCVRLTDE

SEQ ID NO: 363747 - protein, 9 aa, Homo Sapiens
QDQTTLRPP

SEQ ID NO: 363748 - protein, 9 aa, Homo Sapiens
SAEPTYFLH

SEQ ID NO: 363749 - protein, 9 aa, Homo Sapiens
YAFLLHDYQ

SEQ ID NO: 363750 - protein, 9 aa, Homo Sapiens
LGGSLGLLW

SEQ ID NO: 363751 - protein, 9 aa, Homo Sapiens
QLMNDKINS

SEQ ID NO: 363752 - protein, 9 aa, Homo Sapiens
KINPFVHLP

SEQ ID NO: 363753 - protein, 9 aa, Homo Sapiens
AIWPVHYGK

SEQ ID NO: 363754 - protein, 9 aa, Homo Sapiens
RERPRPVSS

SEQ ID NO: 363755 - protein, 9 aa, Homo Sapiens
HDQPRLIKT

SEQ ID NO: 363756 - protein, 9 aa, Homo Sapiens
AIETMQLMN

SEQ ID NO: 363757 - protein, 9 aa, Homo Sapiens
DNDDDSDDR

SEQ ID NO: 363758 - protein, 9 aa, Homo Sapiens
VAAASQGCS

SEQ ID NO: 363759 - protein, 9 aa, Homo Sapiens
SQGCSPGSL

SEQ ID NO: 363760 - protein, 9 aa, Homo Sapiens
IDEKQLLEA

SEQ ID NO: 363761 - protein, 9 aa, Homo Sapiens
PGPALGQLC

SEQ ID NO: 363762 - protein, 9 aa, Homo Sapiens
IPQQLLKTF

SEQ ID NO: 363763 - protein, 9 aa, Homo Sapiens
LGDIIYVVI

SEQ ID NO: 363764 - protein, 9 aa, Homo Sapiens
VFFLEDIMA

SEQ ID NO: 363765 - protein, 9 aa, Homo Sapiens
EKEKINPFV

SEQ ID NO: 363766 - protein, 9 aa, Homo Sapiens
TTILHPTNV

SEQ ID NO: 363767 - protein, 9 aa, Homo Sapiens
PLWMHSLKP

SEQ ID NO: 363768 - protein, 9 aa, Homo Sapiens
HCSIPPADP

SEQ ID NO: 363769 - protein, 9 aa, Homo Sapiens
WAIWPVHYG

SEQ ID NO: 363770 - protein, 9 aa, Homo Sapiens
AVAVDLAKK

SEQ ID NO: 363771 - protein, 9 aa, Homo Sapiens
LNFTLRASD

SEQ ID NO: 363772 - protein, 9 aa, Homo Sapiens
PVSSPALLE

SEQ ID NO: 363773 - protein, 9 aa, Homo Sapiens
NKWKRVMKS

SEQ ID NO: 363774 - protein, 9 aa, Homo Sapiens
LSGVAAASQ

SEQ ID NO: 363775 - protein, 9 aa, Homo Sapiens
MEVGCSALR

SEQ ID NO: 363776 - protein, 9 aa, Homo Sapiens
PERERCWYG

SEQ ID NO: 363777 - protein, 9 aa, Homo Sapiens
NYQLIMSVF

SEQ ID NO: 363778 - protein, 9 aa, Homo Sapiens
PYTYNGIFT

SEQ ID NO: 363779 - protein, 9 aa, Homo Sapiens
SAYRSQWRE

SEQ ID NO: 363780 - protein, 9 aa, Homo Sapiens
QEELDEECE

SEQ ID NO: 363781 - protein, 9 aa, Homo Sapiens
WHFVNQQRR

SEQ ID NO: 363782 - protein, 9 aa, Homo Sapiens
LLDEPSSVM

SEQ ID NO: 363783 - protein, 9 aa, Homo Sapiens
NQSDSGSEG

SEQ ID NO: 363784 - protein, 9 aa, Homo Sapiens
LLSSRSGSP

SEQ ID NO: 363785 - protein, 9 aa, Homo Sapiens
ERERCWYGR

SEQ ID NO: 363786 - protein, 9 aa, Homo Sapiens
AWHVSPLIN

SEQ ID NO: 363787 - protein, 9 aa, Homo Sapiens
QKPRHRCGK

SEQ ID NO: 363788 - protein, 9 aa, Homo Sapiens
FKSPITSKR

SEQ ID NO: 363789 - protein, 9 aa, Homo Sapiens
FLEDIMACT

SEQ ID NO: 363790 - protein, 9 aa, Homo Sapiens
GASSDYGTF

SEQ ID NO: 363791 - protein, 9 aa, Homo Sapiens
EGQIHLRAL

SEQ ID NO: 363792 - protein, 9 aa, Homo Sapiens
LEAIRLWEE

SEQ ID NO: 363793 - protein, 9 aa, Homo Sapiens
ETLGLICMC

SEQ ID NO: 363794 - protein, 9 aa, Homo Sapiens
EEGSGGPTQ

SEQ ID NO: 363795 - protein, 9 aa, Homo Sapiens
GSSAYRSQW

SEQ ID NO: 363796 - protein, 9 aa, Homo Sapiens
ASSDYGTFY

SEQ ID NO: 363797 - protein, 9 aa, Homo Sapiens
SDMEVGCSA

SEQ ID NO: 363798 - protein, 9 aa, Homo Sapiens
NGARLSVTN

SEQ ID NO: 363799 - protein, 9 aa, Homo Sapiens
NEVIPQQLL

SEQ ID NO: 363800 - protein, 9 aa, Homo Sapiens
HLQFQADPN

SEQ ID NO: 363801 - protein, 9 aa, Homo Sapiens
CWSDEYNCS

SEQ ID NO: 363802 - protein, 9 aa, Homo Sapiens
ATLSRAWAS

SEQ ID NO: 363803 - protein, 9 aa, Homo Sapiens
LITEEFVKQ

SEQ ID NO: 363804 - protein, 9 aa, Homo Sapiens
APAAHGVTS

SEQ ID NO: 363805 - protein, 9 aa, Homo Sapiens
CDRKFRLEE

SEQ ID NO: 363806 - protein, 9 aa, Homo Sapiens
GDHLNVEVD

SEQ ID NO: 363807 - protein, 9 aa, Homo Sapiens
TRAAGGSGA

SEQ ID NO: 363808 - protein, 9 aa, Homo Sapiens
DLEAIRLWE

SEQ ID NO: 363809 - protein, 9 aa, Homo Sapiens
PTVPPHCSI

SEQ ID NO: 363810 - protein, 9 aa, Homo Sapiens
YPPPTPNGC

SEQ ID NO: 363811 - protein, 9 aa, Homo Sapiens
CSENGYLSR

SEQ ID NO: 363812 - protein, 9 aa, Homo Sapiens
AFLLHDYQP

SEQ ID NO: 363813 - protein, 9 aa, Homo Sapiens
GAYIKLADT

SEQ ID NO: 363814 - protein, 9 aa, Homo Sapiens
DLAKKEAAE

SEQ ID NO: 363815 - protein, 9 aa, Homo Sapiens
PVDTAAGPY

SEQ ID NO: 363816 - protein, 9 aa, Homo Sapiens
VLEKLPGVD

SEQ ID NO: 363817 - protein, 9 aa, Homo Sapiens
GVAAASQGC

SEQ ID NO: 363818 - protein, 9 aa, Homo Sapiens
APIPGGGDV

SEQ ID NO: 363819 - protein, 9 aa, Homo Sapiens
SDYGTFYPR

SEQ ID NO: 363820 - protein, 9 aa, Homo Sapiens
APGTRRHVY

SEQ ID NO: 363821 - protein, 9 aa, Homo Sapiens
DQTTLRPPE

SEQ ID NO: 363822 - protein, 9 aa, Homo Sapiens
SLDYFTKPN

SEQ ID NO: 363823 - protein, 9 aa, Homo Sapiens
PATLSRAWA

SEQ ID NO: 363824 - protein, 9 aa, Homo Sapiens
SLARSFKSP

SEQ ID NO: 363825 - protein, 9 aa, Homo Sapiens
CVSGLHRYL

SEQ ID NO: 363826 - protein, 9 aa, Homo Sapiens
LGVLLSHLR

SEQ ID NO: 363827 - protein, 9 aa, Homo Sapiens
QLSRQECDR

SEQ ID NO: 363828 - protein, 9 aa, Homo Sapiens
DCSAPWSRS

SEQ ID NO: 363829 - protein, 9 aa, Homo Sapiens
HPTSPATLS

SEQ ID NO: 363830 - protein, 9 aa, Homo Sapiens
CSRCVSYNQ

SEQ ID NO: 363831 - protein, 9 aa, Homo Sapiens
SLGEQDQTT

SEQ ID NO: 363832 - protein, 9 aa, Homo Sapiens
AADRRNFKQ

SEQ ID NO: 363833 - protein, 9 aa, Homo Sapiens
CGKRKPLLA

SEQ ID NO: 363834 - protein, 9 aa, Homo Sapiens
YRLTKIPVD

SEQ ID NO: 363835 - protein, 9 aa, Homo Sapiens
LTGESESQT

SEQ ID NO: 363836 - protein, 9 aa, Homo Sapiens
GVPIMAHAP

SEQ ID NO: 363837 - protein, 9 aa, Homo Sapiens
DYQPAHPTF

SEQ ID NO: 363838 - protein, 9 aa, Homo Sapiens
PLSEITKQE

SEQ ID NO: 363839 - protein, 9 aa, Homo Sapiens
AIKEALVDQ

SEQ ID NO: 363840 - protein, 9 aa, Homo Sapiens
DIIYVVIDL

SEQ ID NO: 363841 - protein, 9 aa, Homo Sapiens
WKRVMKSLS

SEQ ID NO: 363842 - protein, 9 aa, Homo Sapiens
CIFTFCFFP

SEQ ID NO: 363843 - protein, 9 aa, Homo Sapiens
HLRPEPPNT

SEQ ID NO: 363844 - protein, 9 aa, Homo Sapiens
AWQLLAAIL

SEQ ID NO: 363845 - protein, 9 aa, Homo Sapiens
VDGFTDASN

SEQ ID NO: 363846 - protein, 9 aa, Homo Sapiens
KRSYQEDGF

SEQ ID NO: 363847 - protein, 9 aa, Homo Sapiens
FFPFFFLRR

SEQ ID NO: 363848 - protein, 9 aa, Homo Sapiens
TALQKVKGQ

SEQ ID NO: 363849 - protein, 9 aa, Homo Sapiens
TSKTTTILH

SEQ ID NO: 363850 - protein, 9 aa, Homo Sapiens
PITKAEMLK

SEQ ID NO: 363851 - protein, 9 aa, Homo Sapiens
RSLGSSAYR

SEQ ID NO: 363852 - protein, 9 aa, Homo Sapiens
SQGNRTVLE

SEQ ID NO: 363853 - protein, 9 aa, Homo Sapiens
FLLHDYQPA

SEQ ID NO: 363854 - protein, 9 aa, Homo Sapiens
CSPGSLGQG

SEQ ID NO: 363855 - protein, 9 aa, Homo Sapiens
GSLGLLWGL

SEQ ID NO: 363856 - protein, 9 aa, Homo Sapiens
DIILTNDNF

SEQ ID NO: 363857 - protein, 9 aa, Homo Sapiens
KAFQCARQM

SEQ ID NO: 363858 - protein, 9 aa, Homo Sapiens
EMLKNVISR

SEQ ID NO: 363859 - protein, 9 aa, Homo Sapiens
FLEQVNHIG

SEQ ID NO: 363860 - protein, 9 aa, Homo Sapiens
RFLTQRLGA

SEQ ID NO: 363861 - protein, 9 aa, Homo Sapiens
PFIDEKQLL

SEQ ID NO: 363862 - protein, 9 aa, Homo Sapiens
VYDTKLGTD

SEQ ID NO: 363863 - protein, 9 aa, Homo Sapiens
QKKRQCVSG

SEQ ID NO: 363864 - protein, 9 aa, Homo Sapiens
GAGPKGNYS

SEQ ID NO: 363865 - protein, 9 aa, Homo Sapiens
PNVLHNSYA

SEQ ID NO: 363866 - protein, 9 aa, Homo Sapiens
FFFFFPFFF

SEQ ID NO: 363867 - protein, 9 aa, Homo Sapiens
SYPPPTPNG

SEQ ID NO: 363868 - protein, 9 aa, Homo Sapiens
YIAEGVVTM

SEQ ID NO: 363869 - protein, 9 aa, Homo Sapiens
GHTSTVCCM

SEQ ID NO: 363870 - protein, 9 aa, Homo Sapiens
RSYQEDGFD

SEQ ID NO: 363871 - protein, 9 aa, Homo Sapiens
STEGHDQPR

SEQ ID NO: 363872 - protein, 9 aa, Homo Sapiens
SHPLIHSLF

SEQ ID NO: 363873 - protein, 9 aa, Homo Sapiens
NRPGPQCTT

SEQ ID NO: 363874 - protein, 9 aa, Homo Sapiens
VPVPEPYTY

SEQ ID NO: 363875 - protein, 9 aa, Homo Sapiens
FGFFHYIQE

SEQ ID NO: 363876 - protein, 9 aa, Homo Sapiens
FSECLSAAE

SEQ ID NO: 363877 - protein, 9 aa, Homo Sapiens
EDEQSPAPI

SEQ ID NO: 363878 - protein, 9 aa, Homo Sapiens
SLALGDIIY

SEQ ID NO: 363879 - protein, 9 aa, Homo Sapiens
YPRGTHGSF

SEQ ID NO: 363880 - protein, 9 aa, Homo Sapiens
QVPVPEPYT

SEQ ID NO: 363881 - protein, 9 aa, Homo Sapiens
WYGRHRGAG

SEQ ID NO: 363882 - protein, 9 aa, Homo Sapiens
KVNSQRFEM

SEQ ID NO: 363883 - protein, 9 aa, Homo Sapiens
DRIHKLADL

SEQ ID NO: 363884 - protein, 9 aa, Homo Sapiens
DRRNFKQNQ

SEQ ID NO: 363885 - protein, 9 aa, Homo Sapiens
SRSGSPSSQ

SEQ ID NO: 363886 - protein, 9 aa, Homo Sapiens
EEFVKQKYL

SEQ ID NO: 363887 - protein, 9 aa, Homo Sapiens
TCPGGTGHR

SEQ ID NO: 363888 - protein, 9 aa, Homo Sapiens
NPQVTLEDG

SEQ ID NO: 363889 - protein, 9 aa, Homo Sapiens
FAWHVSPLI

SEQ ID NO: 363890 - protein, 9 aa, Homo Sapiens
TLRCQLGDH

SEQ ID NO: 363891 - protein, 9 aa, Homo Sapiens
QLGDHLNVE

SEQ ID NO: 363892 - protein, 9 aa, Homo Sapiens
TRRHVYDTK

SEQ ID NO: 363893 - protein, 9 aa, Homo Sapiens
ERCWYGRHR

SEQ ID NO: 363894 - protein, 9 aa, Homo Sapiens
TAFTQTSYT

SEQ ID NO: 363895 - protein, 9 aa, Homo Sapiens
GREAHCQSR

SEQ ID NO: 363896 - protein, 9 aa, Homo Sapiens
GTLLSTLAA

SEQ ID NO: 363897 - protein, 9 aa, Homo Sapiens
GARAGGCSP

SEQ ID NO: 363898 - protein, 9 aa, Homo Sapiens
DLQYSVAKS

SEQ ID NO: 363899 - protein, 9 aa, Homo Sapiens
RCQLGDHLN

SEQ ID NO: 363900 - protein, 9 aa, Homo Sapiens
SHPSNPLVL

SEQ ID NO: 363901 - protein, 9 aa, Homo Sapiens
VDLAKKEAA

SEQ ID NO: 363902 - protein, 9 aa, Homo Sapiens
DLQRLGVLL

SEQ ID NO: 363903 - protein, 9 aa, Homo Sapiens
ASNSERFCL

SEQ ID NO: 363904 - protein, 9 aa, Homo Sapiens
NPAIRISNC

SEQ ID NO: 363905 - protein, 9 aa, Homo Sapiens
ENKWKRVMK

SEQ ID NO: 363906 - protein, 9 aa, Homo Sapiens
DQPRLIKTL

SEQ ID NO: 363907 - protein, 9 aa, Homo Sapiens
DSENPGTVR

SEQ ID NO: 363908 - protein, 9 aa, Homo Sapiens
IPIRAYEPR

SEQ ID NO: 363909 - protein, 9 aa, Homo Sapiens
SEDLQTDLA

SEQ ID NO: 363910 - protein, 9 aa, Homo Sapiens
SSTQERMFT

SEQ ID NO: 363911 - protein, 9 aa, Homo Sapiens
IPFIDEKQL

SEQ ID NO: 363912 - protein, 9 aa, Homo Sapiens
DLVLDRIHK

SEQ ID NO: 363913 - protein, 9 aa, Homo Sapiens
PSSTQERMF

SEQ ID NO: 363914 - protein, 9 aa, Homo Sapiens
ERGRALLSS

SEQ ID NO: 363915 - protein, 9 aa, Homo Sapiens
MIEFDESAG

SEQ ID NO: 363916 - protein, 9 aa, Homo Sapiens
ARREERCQK

SEQ ID NO: 363917 - protein, 9 aa, Homo Sapiens
SKYLYKRKL

SEQ ID NO: 363918 - protein, 9 aa, Homo Sapiens
EKINPFVHL

SEQ ID NO: 363919 - protein, 9 aa, Homo Sapiens
IHLRALYAL

SEQ ID NO: 363920 - protein, 9 aa, Homo Sapiens
VTKDRIIGA

SEQ ID NO: 363921 - protein, 9 aa, Homo Sapiens
TNPAESIPT

SEQ ID NO: 363922 - protein, 9 aa, Homo Sapiens
AEMLKNVIS

SEQ ID NO: 363923 - protein, 9 aa, Homo Sapiens
TFYPRPVAP

SEQ ID NO: 363924 - protein, 9 aa, Homo Sapiens
PAEAFLAQR

SEQ ID NO: 363925 - protein, 9 aa, Homo Sapiens
TELIVHVEL

SEQ ID NO: 363926 - protein, 9 aa, Homo Sapiens
MVSQGNRTV

SEQ ID NO: 363927 - protein, 9 aa, Homo Sapiens
IFRGDKWSC

SEQ ID NO: 363928 - protein, 9 aa, Homo Sapiens
HHSRTPSSD

SEQ ID NO: 363929 - protein, 9 aa, Homo Sapiens
IDLQYSVAK

SEQ ID NO: 363930 - protein, 9 aa, Homo Sapiens
LIDLQYSVA

SEQ ID NO: 363931 - protein, 9 aa, Homo Sapiens
EYILIVHAV

SEQ ID NO: 363932 - protein, 9 aa, Homo Sapiens
LIVHAVDGG

SEQ ID NO: 363933 - protein, 9 aa, Homo Sapiens
VKNKPVKLY

SEQ ID NO: 363934 - protein, 9 aa, Homo Sapiens
TINCSSRPI

SEQ ID NO: 363935 - protein, 9 aa, Homo Sapiens
VHAVDGGVG

SEQ ID NO: 363936 - protein, 9 aa, Homo Sapiens
GLPLVAATP

SEQ ID NO: 363937 - protein, 9 aa, Homo Sapiens
IIDKPQIIE

SEQ ID NO: 363938 - protein, 9 aa, Homo Sapiens
GWTKCKKND

SEQ ID NO: 363939 - protein, 9 aa, Homo Sapiens
EGCYLEIEF

SEQ ID NO: 363940 - protein, 9 aa, Homo Sapiens
KCKKNDTSN

SEQ ID NO: 363941 - protein, 9 aa, Homo Sapiens
QNLQCIFIL

SEQ ID NO: 363942 - protein, 9 aa, Homo Sapiens
LQNLQCIFI

SEQ ID NO: 363943 - protein, 9 aa, Homo Sapiens
AMYVMGFAE

SEQ ID NO: 363944 - protein, 9 aa, Homo Sapiens
ETGCPNIRM

SEQ ID NO: 363945 - protein, 9 aa, Homo Sapiens
RAGGCSPGP

SEQ ID NO: 363946 - protein, 9 aa, Homo Sapiens
PGPPGTSGF

SEQ ID NO: 363947 - protein, 9 aa, Homo Sapiens
GEWAMQHRP

SEQ ID NO: 363948 - protein, 9 aa, Homo Sapiens
QGCSPGSLG

SEQ ID NO: 363949 - protein, 9 aa, Homo Sapiens
QASLLIILK

SEQ ID NO: 363950 - protein, 9 aa, Homo Sapiens
CECKEGCYL

SEQ ID NO: 363951 - protein, 9 aa, Homo Sapiens
SRSELIITW

SEQ ID NO: 363952 - protein, 9 aa, Homo Sapiens
AVAVAMYVM

SEQ ID NO: 363953 - protein, 9 aa, Homo Sapiens
PKIHAIEPL

SEQ ID NO: 363954 - protein, 9 aa, Homo Sapiens
KIHAIEPLS

SEQ ID NO: 363955 - protein, 9 aa, Homo Sapiens
AYKYNIDYK

SEQ ID NO: 363956 - protein, 9 aa, Homo Sapiens
CPAPKIHAI

SEQ ID NO: 363957 - protein, 9 aa, Homo Sapiens
VLCVWALVQ

SEQ ID NO: 363958 - protein, 9 aa, Homo Sapiens
PTCPGGTGH

SEQ ID NO: 363959 - protein, 9 aa, Homo Sapiens
FLSLIRVPR

SEQ ID NO: 363960 - protein, 9 aa, Homo Sapiens
ECKEGCYLE

SEQ ID NO: 363961 - protein, 9 aa, Homo Sapiens
LSPREPLTV

SEQ ID NO: 363962 - protein, 9 aa, Homo Sapiens
DNLDSVSSI

SEQ ID NO: 363963 - protein, 9 aa, Homo Sapiens
TQRLGARAG

SEQ ID NO: 363964 - protein, 9 aa, Homo Sapiens
IRVKLIRPI

SEQ ID NO: 363965 - protein, 9 aa, Homo Sapiens
RVCACRGRD

SEQ ID NO: 363966 - protein, 9 aa, Homo Sapiens
PAVRMEYLD

SEQ ID NO: 363967 - protein, 9 aa, Homo Sapiens
GSLGQGEPP

SEQ ID NO: 363968 - protein, 9 aa, Homo Sapiens
VENVEKQVN

SEQ ID NO: 363969 - protein, 9 aa, Homo Sapiens
VYGSIYAIA

SEQ ID NO: 363970 - protein, 9 aa, Homo Sapiens
AVRMEYLDI

SEQ ID NO: 363971 - protein, 9 aa, Homo Sapiens
MQAAAAAGL

SEQ ID NO: 363972 - protein, 9 aa, Homo Sapiens
SPGPALGQL

SEQ ID NO: 363973 - protein, 9 aa, Homo Sapiens
HHLIEWSPG

SEQ ID NO: 363974 - protein, 9 aa, Homo Sapiens
AVAMYVMGF

SEQ ID NO: 363975 - protein, 9 aa, Homo Sapiens
YILILCYIW

SEQ ID NO: 363976 - protein, 9 aa, Homo Sapiens
RHVSVYGSI

SEQ ID NO: 363977 - protein, 9 aa, Homo Sapiens
VSFPMSSSQ

SEQ ID NO: 363978 - protein, 9 aa, Homo Sapiens
KIQGQVKTT

SEQ ID NO: 363979 - protein, 9 aa, Homo Sapiens
LDSVSSILL

SEQ ID NO: 363980 - protein, 9 aa, Homo Sapiens
GGSRSELII

SEQ ID NO: 363981 - protein, 9 aa, Homo Sapiens
CYILILCYI

SEQ ID NO: 363982 - protein, 9 aa, Homo Sapiens
LLWQATPAQ

SEQ ID NO: 363983 - protein, 9 aa, Homo Sapiens
MTAYWTNFA

SEQ ID NO: 363984 - protein, 9 aa, Homo Sapiens
CSPGPALGQ

SEQ ID NO: 363985 - protein, 9 aa, Homo Sapiens
PHAIFYSAC

SEQ ID NO: 363986 - protein, 9 aa, Homo Sapiens
IGWTKCKKN

SEQ ID NO: 363987 - protein, 9 aa, Homo Sapiens
QQLGCRGAQ

SEQ ID NO: 363988 - protein, 9 aa, Homo Sapiens
WAMQHRPAK

SEQ ID NO: 363989 - protein, 9 aa, Homo Sapiens
LNTVSKIQG

SEQ ID NO: 363990 - protein, 9 aa, Homo Sapiens
SVYGSIYAI

SEQ ID NO: 363991 - protein, 9 aa, Homo Sapiens
TALTPDLCP

SEQ ID NO: 363992 - protein, 9 aa, Homo Sapiens
RSELIITWE

SEQ ID NO: 363993 - protein, 9 aa, Homo Sapiens
VSVYGSIYA

SEQ ID NO: 363994 - protein, 9 aa, Homo Sapiens
GHRLLWQAT

SEQ ID NO: 363995 - protein, 9 aa, Homo Sapiens
LINEKAVEN

SEQ ID NO: 363996 - protein, 9 aa, Homo Sapiens
WSRAHFLLS

SEQ ID NO: 363997 - protein, 9 aa, Homo Sapiens
NIFMRVATI

SEQ ID NO: 363998 - protein, 9 aa, Homo Sapiens
HAVDGGVGH

SEQ ID NO: 363999 - protein, 9 aa, Homo Sapiens
SRAHFLLSL

SEQ ID NO: 364000 - protein, 9 aa, Homo Sapiens
NLKQFRKQL

SEQ ID NO: 364001 - protein, 9 aa, Homo Sapiens
HREERVFLV

SEQ ID NO: 364002 - protein, 9 aa, Homo Sapiens
LGARAGGCS

SEQ ID NO: 364003 - protein, 9 aa, Homo Sapiens
RATALTPDL

SEQ ID NO: 364004 - protein, 9 aa, Homo Sapiens
LCYIWEMYQ

SEQ ID NO: 364005 - protein, 9 aa, Homo Sapiens
VRMEYLDIE

SEQ ID NO: 364006 - protein, 9 aa, Homo Sapiens
EKAVENVEK

SEQ ID NO: 364007 - protein, 9 aa, Homo Sapiens
KDLGLCPKR

SEQ ID NO: 364008 - protein, 9 aa, Homo Sapiens
FPMSSSQEV

SEQ ID NO: 364009 - protein, 9 aa, Homo Sapiens
MRVATILAT

SEQ ID NO: 364010 - protein, 9 aa, Homo Sapiens
MALRRQKQE

SEQ ID NO: 364011 - protein, 9 aa, Homo Sapiens
CYIWEMYQQ

SEQ ID NO: 364012 - protein, 9 aa, Homo Sapiens
VFSEPHAIF

SEQ ID NO: 364013 - protein, 9 aa, Homo Sapiens
SLLIILKLS

SEQ ID NO: 364014 - protein, 9 aa, Homo Sapiens
NLQCIFILT

SEQ ID NO: 364015 - protein, 9 aa, Homo Sapiens
WIDVGSRFK

SEQ ID NO: 364016 - protein, 9 aa, Homo Sapiens
SSILLQSTE

SEQ ID NO: 364017 - protein, 9 aa, Homo Sapiens
EDVSEATWM

SEQ ID NO: 364018 - protein, 9 aa, Homo Sapiens
PGGTGHRLL

SEQ ID NO: 364019 - protein, 9 aa, Homo Sapiens
KLSLKALSR

SEQ ID NO: 364020 - protein, 9 aa, Homo Sapiens
KSEYILIVH

SEQ ID NO: 364021 - protein, 9 aa, Homo Sapiens
IVNTIYEID

SEQ ID NO: 364022 - protein, 9 aa, Homo Sapiens
VRVCACRGR

SEQ ID NO: 364023 - protein, 9 aa, Homo Sapiens
LVVLFMALR

SEQ ID NO: 364024 - protein, 9 aa, Homo Sapiens
GCPNIRMDP

SEQ ID NO: 364025 - protein, 9 aa, Homo Sapiens
CSCSVLCVW

SEQ ID NO: 364026 - protein, 9 aa, Homo Sapiens
GLWSRAHFL

SEQ ID NO: 364027 - protein, 9 aa, Homo Sapiens
NGEWAMQHR

SEQ ID NO: 364028 - protein, 9 aa, Homo Sapiens
WSSSLPLPP

SEQ ID NO: 364029 - protein, 9 aa, Homo Sapiens
VCECKEGCY

SEQ ID NO: 364030 - protein, 9 aa, Homo Sapiens
RAHFLLSLG

SEQ ID NO: 364031 - protein, 9 aa, Homo Sapiens
YVMGFAETV

SEQ ID NO: 364032 - protein, 9 aa, Homo Sapiens
EPLTVHTWA

SEQ ID NO: 364033 - protein, 9 aa, Homo Sapiens
TTLPEQLEE

SEQ ID NO: 364034 - protein, 9 aa, Homo Sapiens
WALVQDLLP

SEQ ID NO: 364035 - protein, 9 aa, Homo Sapiens
ILCYIWEMY

SEQ ID NO: 364036 - protein, 9 aa, Homo Sapiens
LSLEKLSLK

SEQ ID NO: 364037 - protein, 9 aa, Homo Sapiens
VPRNLTFPR

SEQ ID NO: 364038 - protein, 9 aa, Homo Sapiens
FSIALRFPA

SEQ ID NO: 364039 - protein, 9 aa, Homo Sapiens
STTTLPEQL

SEQ ID NO: 364040 - protein, 9 aa, Homo Sapiens
AGGCSPGPA

SEQ ID NO: 364041 - protein, 9 aa, Homo Sapiens
RGAGVVCQQ

SEQ ID NO: 364042 - protein, 9 aa, Homo Sapiens
IYEIDFDVE

SEQ ID NO: 364043 - protein, 9 aa, Homo Sapiens
YIWEMYQQN

SEQ ID NO: 364044 - protein, 9 aa, Homo Sapiens
AAAAAGLPL

SEQ ID NO: 364045 - protein, 9 aa, Homo Sapiens
CLLSGVAAA

SEQ ID NO: 364046 - protein, 9 aa, Homo Sapiens
RVATILATG

SEQ ID NO: 364047 - protein, 9 aa, Homo Sapiens
LTQRLGARA

SEQ ID NO: 364048 - protein, 9 aa, Homo Sapiens
LVETGCPNI

SEQ ID NO: 364049 - protein, 9 aa, Homo Sapiens
KYNIDYKPD

SEQ ID NO: 364050 - protein, 9 aa, Homo Sapiens
DVFSEPHAI

SEQ ID NO: 364051 - protein, 9 aa, Homo Sapiens
ETQPQVCAT

SEQ ID NO: 364052 - protein, 9 aa, Homo Sapiens
LLSPREPLT

SEQ ID NO: 364053 - protein, 9 aa, Homo Sapiens
WVAYKYNID

SEQ ID NO: 364054 - protein, 9 aa, Homo Sapiens
LTVQLPFCR

SEQ ID NO: 364055 - protein, 9 aa, Homo Sapiens
LIEWSPGTK

SEQ ID NO: 364056 - protein, 9 aa, Homo Sapiens
LGFSIALRF

SEQ ID NO: 364057 - protein, 9 aa, Homo Sapiens
CKKNDTSNS

SEQ ID NO: 364058 - protein, 9 aa, Homo Sapiens
CPKRTLRLV

SEQ ID NO: 364059 - protein, 9 aa, Homo Sapiens
FSEPHAIFY

SEQ ID NO: 364060 - protein, 9 aa, Homo Sapiens
KPQIIEVAP

SEQ ID NO: 364061 - protein, 9 aa, Homo Sapiens
LGLCPKRTL

SEQ ID NO: 364062 - protein, 9 aa, Homo Sapiens
LSLIRVPRN

SEQ ID NO: 364063 - protein, 9 aa, Homo Sapiens
RFKTEKNNG

SEQ ID NO: 364064 - protein, 9 aa, Homo Sapiens
LPLPPQVKK

SEQ ID NO: 364065 - protein, 9 aa, Homo Sapiens
SFNCSTINC

SEQ ID NO: 364066 - protein, 9 aa, Homo Sapiens
RLGARAGGC

SEQ ID NO: 364067 - protein, 9 aa, Homo Sapiens
GTGHRLLWQ

SEQ ID NO: 364068 - protein, 9 aa, Homo Sapiens
SLIRVPRNL

SEQ ID NO: 364069 - protein, 9 aa, Homo Sapiens
SLSLEKLSL

SEQ ID NO: 364070 - protein, 9 aa, Homo Sapiens
FMRVATILA

SEQ ID NO: 364071 - protein, 9 aa, Homo Sapiens
RYSTTTLPE

SEQ ID NO: 364072 - protein, 9 aa, Homo Sapiens
CPGGTGHRL

SEQ ID NO: 364073 - protein, 9 aa, Homo Sapiens
TENGEWAMQ

SEQ ID NO: 364074 - protein, 9 aa, Homo Sapiens
LPLVAATPY

SEQ ID NO: 364075 - protein, 9 aa, Homo Sapiens
RVPRNLTFP

SEQ ID NO: 364076 - protein, 9 aa, Homo Sapiens
LILCYIWEM

SEQ ID NO: 364077 - protein, 9 aa, Homo Sapiens
IKDLGLCPK

SEQ ID NO: 364078 - protein, 9 aa, Homo Sapiens
LTVHTWAPT

SEQ ID NO: 364079 - protein, 9 aa, Homo Sapiens
EPHAIFYSA

SEQ ID NO: 364080 - protein, 9 aa, Homo Sapiens
FTENGEWAM

SEQ ID NO: 364081 - protein, 9 aa, Homo Sapiens
VVLFMALRR

SEQ ID NO: 364082 - protein, 9 aa, Homo Sapiens
KEVSFPMSS

SEQ ID NO: 364083 - protein, 9 aa, Homo Sapiens
GAGVVCQQL

SEQ ID NO: 364084 - protein, 9 aa, Homo Sapiens
VQLPFCRRQ

SEQ ID NO: 364085 - protein, 9 aa, Homo Sapiens
ENVEKQVND

SEQ ID NO: 364086 - protein, 9 aa, Homo Sapiens
AAGLPLVAA

SEQ ID NO: 364087 - protein, 9 aa, Homo Sapiens
GQGEPPTCP

SEQ ID NO: 364088 - protein, 9 aa, Homo Sapiens
ILATGGNRK

SEQ ID NO: 364089 - protein, 9 aa, Homo Sapiens
FFLSLIRVP

SEQ ID NO: 364090 - protein, 9 aa, Homo Sapiens
TPDLCPLPG

SEQ ID NO: 364091 - protein, 9 aa, Homo Sapiens
RVYLGFSIA

SEQ ID NO: 364092 - protein, 9 aa, Homo Sapiens
PPTCPGGTG

SEQ ID NO: 364093 - protein, 9 aa, Homo Sapiens
FNCSTINCS

SEQ ID NO: 364094 - protein, 9 aa, Homo Sapiens
PDLCPLPGP

SEQ ID NO: 364095 - protein, 9 aa, Homo Sapiens
NYMVKNLKQ

SEQ ID NO: 364096 - protein, 9 aa, Homo Sapiens
MYVMGFAET

SEQ ID NO: 364097 - protein, 9 aa, Homo Sapiens
SKAMTAYWT

SEQ ID NO: 364098 - protein, 9 aa, Homo Sapiens
PPGTSGFPG

SEQ ID NO: 364099 - protein, 9 aa, Homo Sapiens
ARYSTTTLP

SEQ ID NO: 364100 - protein, 9 aa, Homo Sapiens
GPPGTSGFP

SEQ ID NO: 364101 - protein, 9 aa, Homo Sapiens
VMGFAETVV

SEQ ID NO: 364102 - protein, 9 aa, Homo Sapiens
KAMTAYWTN

SEQ ID NO: 364103 - protein, 9 aa, Homo Sapiens
CKDSEEDVS

SEQ ID NO: 364104 - protein, 9 aa, Homo Sapiens
SKIQGQVKT

SEQ ID NO: 364105 - protein, 9 aa, Homo Sapiens
GPALGQLCL

SEQ ID NO: 364106 - protein, 9 aa, Homo Sapiens
QLCLLSGVA

SEQ ID NO: 364107 - protein, 9 aa, Homo Sapiens
IYAIADISY

SEQ ID NO: 364108 - protein, 9 aa, Homo Sapiens
DSEEDVSEA

SEQ ID NO: 364109 - protein, 9 aa, Homo Sapiens
TGHRLLWQA

SEQ ID NO: 364110 - protein, 9 aa, Homo Sapiens
GFSIALRFP

SEQ ID NO: 364111 - protein, 9 aa, Homo Sapiens
ASLLIILKL

SEQ ID NO: 364112 - protein, 9 aa, Homo Sapiens
EWAMQHRPA

SEQ ID NO: 364113 - protein, 9 aa, Homo Sapiens
RVHREERVF

SEQ ID NO: 364114 - protein, 9 aa, Homo Sapiens
IDVGSRFKT

SEQ ID NO: 364115 - protein, 9 aa, Homo Sapiens
KAVENVEKQ

SEQ ID NO: 364116 - protein, 9 aa, Homo Sapiens
IVKNKPVKL

SEQ ID NO: 364117 - protein, 9 aa, Homo Sapiens
SGFPGSPGA

SEQ ID NO: 364118 - protein, 9 aa, Homo Sapiens
QCIFILTNE

SEQ ID NO: 364119 - protein, 9 aa, Homo Sapiens
IFMRVATIL

SEQ ID NO: 364120 - protein, 9 aa, Homo Sapiens
QAAAAAGLP

SEQ ID NO: 364121 - protein, 9 aa, Homo Sapiens
SPGSLGQGE

SEQ ID NO: 364122 - protein, 9 aa, Homo Sapiens
NVEKQVNDA

SEQ ID NO: 364123 - protein, 9 aa, Homo Sapiens
VAMYVMGFA

SEQ ID NO: 364124 - protein, 9 aa, Homo Sapiens
RMEYLDIES

SEQ ID NO: 364125 - protein, 9 aa, Homo Sapiens
TIYEIDFDV

SEQ ID NO: 364126 - protein, 9 aa, Homo Sapiens
PAPKIHAIE

SEQ ID NO: 364127 - protein, 9 aa, Homo Sapiens
NLVETGCPN

SEQ ID NO: 364128 - protein, 9 aa, Homo Sapiens
GSRFKTEKN

SEQ ID NO: 364129 - protein, 9 aa, Homo Sapiens
WTKCKKNDT

SEQ ID NO: 364130 - protein, 9 aa, Homo Sapiens
LPFCRRQVL

SEQ ID NO: 364131 - protein, 9 aa, Homo Sapiens
DVGSRFKTE

SEQ ID NO: 364132 - protein, 9 aa, Homo Sapiens
TAYWTNFAK

SEQ ID NO: 364133 - protein, 9 aa, Homo Sapiens
SSHLQNLQC

SEQ ID NO: 364134 - protein, 9 aa, Homo Sapiens
YGSIYAIAD

SEQ ID NO: 364135 - protein, 9 aa, Homo Sapiens
GCSPGSLGQ

SEQ ID NO: 364136 - protein, 9 aa, Homo Sapiens
TQPQVCATV

SEQ ID NO: 364137 - protein, 9 aa, Homo Sapiens
VYLGFSIAL

SEQ ID NO: 364138 - protein, 9 aa, Homo Sapiens
CRGRDRRTE

SEQ ID NO: 364139 - protein, 9 aa, Homo Sapiens
LAKEVSFPM

SEQ ID NO: 364140 - protein, 9 aa, Homo Sapiens
ARIIDKPQI

SEQ ID NO: 364141 - protein, 9 aa, Homo Sapiens
SEEDVSEAT

SEQ ID NO: 364142 - protein, 9 aa, Homo Sapiens
GSRSELIIT

SEQ ID NO: 364143 - protein, 9 aa, Homo Sapiens
AHFLLSLGL

SEQ ID NO: 364144 - protein, 9 aa, Homo Sapiens
CIFILTNEM

SEQ ID NO: 364145 - protein, 9 aa, Homo Sapiens
PQVCATVVL

SEQ ID NO: 364146 - protein, 9 aa, Homo Sapiens
SSSLPLPPQ

SEQ ID NO: 364147 - protein, 9 aa, Homo Sapiens
SEYILIVHA

SEQ ID NO: 364148 - protein, 9 aa, Homo Sapiens
VGSRFKTEK

SEQ ID NO: 364149 - protein, 9 aa, Homo Sapiens
QGQVKTTGY

SEQ ID NO: 364150 - protein, 9 aa, Homo Sapiens
SCSVLCVWA

SEQ ID NO: 364151 - protein, 9 aa, Homo Sapiens
PVKLYCKAS

SEQ ID NO: 364152 - protein, 9 aa, Homo Sapiens
LPEQLEETT

SEQ ID NO: 364153 - protein, 9 aa, Homo Sapiens
ASQGCSPGS

SEQ ID NO: 364154 - protein, 9 aa, Homo Sapiens
VSKIQGQVK

SEQ ID NO: 364155 - protein, 9 aa, Homo Sapiens
IILKLSAGD

SEQ ID NO: 364156 - protein, 9 aa, Homo Sapiens
TARIIDKPQ

SEQ ID NO: 364157 - protein, 9 aa, Homo Sapiens
QFRKQLERE

SEQ ID NO: 364158 - protein, 9 aa, Homo Sapiens
TKCKKNDTS

SEQ ID NO: 364159 - protein, 9 aa, Homo Sapiens
IVHAVDGGV

SEQ ID NO: 364160 - protein, 9 aa, Homo Sapiens
GGTGHRLLW

SEQ ID NO: 364161 - protein, 9 aa, Homo Sapiens
ATILATGGN

SEQ ID NO: 364162 - protein, 9 aa, Homo Sapiens
AGTCPAPKI

SEQ ID NO: 364163 - protein, 9 aa, Homo Sapiens
FLTQRLGAR

SEQ ID NO: 364164 - protein, 9 aa, Homo Sapiens
EIDQASLLI

SEQ ID NO: 364165 - protein, 9 aa, Homo Sapiens
PQIIEVAPQ

SEQ ID NO: 364166 - protein, 9 aa, Homo Sapiens
PLTVHTWAP

SEQ ID NO: 364167 - protein, 9 aa, Homo Sapiens
ILIVHAVDG

SEQ ID NO: 364168 - protein, 9 aa, Homo Sapiens
STINCSSRP

SEQ ID NO: 364169 - protein, 9 aa, Homo Sapiens
LLSGVAAAS

SEQ ID NO: 364170 - protein, 9 aa, Homo Sapiens
LCLLSGVAA

SEQ ID NO: 364171 - protein, 9 aa, Homo Sapiens
TGCPNIRMD

SEQ ID NO: 364172 - protein, 9 aa, Homo Sapiens
FMALRRQKQ

SEQ ID NO: 364173 - protein, 9 aa, Homo Sapiens
DLCPLPGPG

SEQ ID NO: 364174 - protein, 9 aa, Homo Sapiens
CACRGRDRR

SEQ ID NO: 364175 - protein, 9 aa, Homo Sapiens
ANITPAVRM

SEQ ID NO: 364176 - protein, 9 aa, Homo Sapiens
GTSGFPGSP

SEQ ID NO: 364177 - protein, 9 aa, Homo Sapiens
VWALVQDLL

SEQ ID NO: 364178 - protein, 9 aa, Homo Sapiens
TVHTWAPTP

SEQ ID NO: 364179 - protein, 9 aa, Homo Sapiens
EPPTCPGGT

SEQ ID NO: 364180 - protein, 9 aa, Homo Sapiens
SLEKLSLKA

SEQ ID NO: 364181 - protein, 9 aa, Homo Sapiens
RLLWQATPA

SEQ ID NO: 364182 - protein, 9 aa, Homo Sapiens
NFFLSLIRV

SEQ ID NO: 364183 - protein, 9 aa, Homo Sapiens
YIVKNKPVK

SEQ ID NO: 364184 - protein, 9 aa, Homo Sapiens
PLPPQVKKK

SEQ ID NO: 364185 - protein, 9 aa, Homo Sapiens
GQLCLLSGV

SEQ ID NO: 364186 - protein, 9 aa, Homo Sapiens
QGEPPTCPG

SEQ ID NO: 364187 - protein, 9 aa, Homo Sapiens
AASQGCSPG

SEQ ID NO: 364188 - protein, 9 aa, Homo Sapiens
WQATPAQRE

SEQ ID NO: 364189 - protein, 9 aa, Homo Sapiens
IRVPRNLTF

SEQ ID NO: 364190 - protein, 9 aa, Homo Sapiens
GEPPTCPGG

SEQ ID NO: 364191 - protein, 9 aa, Homo Sapiens
ALGQLCLLS

SEQ ID NO: 364192 - protein, 9 aa, Homo Sapiens
VHREERVFL

SEQ ID NO: 364193 - protein, 9 aa, Homo Sapiens
QWVAYKYNI

SEQ ID NO: 364194 - protein, 9 aa, Homo Sapiens
IDQASLLII

SEQ ID NO: 364195 - protein, 9 aa, Homo Sapiens
NEKAVENVE

SEQ ID NO: 364196 - protein, 9 aa, Homo Sapiens
MGFAETVVD

SEQ ID NO: 364197 - protein, 9 aa, Homo Sapiens
GVVCQQLGC

SEQ ID NO: 364198 - protein, 9 aa, Homo Sapiens
EGSSGPRVH

SEQ ID NO: 364199 - protein, 9 aa, Homo Sapiens
EEDVSEATW

SEQ ID NO: 364200 - protein, 9 aa, Homo Sapiens
PNLVETGCP

SEQ ID NO: 364201 - protein, 9 aa, Homo Sapiens
SVSSILLQS

SEQ ID NO: 364202 - protein, 9 aa, Homo Sapiens
LALVVLFMA

SEQ ID NO: 364203 - protein, 9 aa, Homo Sapiens
PFCRRQVLN

SEQ ID NO: 364204 - protein, 9 aa, Homo Sapiens
VKLIRPIGI

SEQ ID NO: 364205 - protein, 9 aa, Homo Sapiens
SWSSSLPLP

SEQ ID NO: 364206 - protein, 9 aa, Homo Sapiens
TVSKAMTAY

SEQ ID NO: 364207 - protein, 9 aa, Homo Sapiens
YKYNIDYKP

SEQ ID NO: 364208 - protein, 9 aa, Homo Sapiens
ALVVLFMAL

SEQ ID NO: 364209 - protein, 9 aa, Homo Sapiens
QIIEVAPQV

SEQ ID NO: 364210 - protein, 9 aa, Homo Sapiens
GIRVKLIRP

SEQ ID NO: 364211 - protein, 9 aa, Homo Sapiens
DLGLCPKRT

SEQ ID NO: 364212 - protein, 9 aa, Homo Sapiens
LGQGEPPTC

SEQ ID NO: 364213 - protein, 9 aa, Homo Sapiens
KNDTSNSSC

SEQ ID NO: 364214 - protein, 9 aa, Homo Sapiens
FEVRVCACR

SEQ ID NO: 364215 - protein, 9 aa, Homo Sapiens
SFPMSSSQE

SEQ ID NO: 364216 - protein, 9 aa, Homo Sapiens
LIITWESIP

SEQ ID NO: 364217 - protein, 9 aa, Homo Sapiens
VCACRGRDR

SEQ ID NO: 364218 - protein, 9 aa, Homo Sapiens
ALAKEVSFP

SEQ ID NO: 364219 - protein, 9 aa, Homo Sapiens
ERHHLIEWS

SEQ ID NO: 364220 - protein, 9 aa, Homo Sapiens
INCSSRPIG

SEQ ID NO: 364221 - protein, 9 aa, Homo Sapiens
SEPHAIFYS

SEQ ID NO: 364222 - protein, 9 aa, Homo Sapiens
LRPNLVETG

SEQ ID NO: 364223 - protein, 9 aa, Homo Sapiens
LLSLGLGLT

SEQ ID NO: 364224 - protein, 9 aa, Homo Sapiens
VAYKYNIDY

SEQ ID NO: 364225 - protein, 9 aa, Homo Sapiens
NIDYKPDIE

SEQ ID NO: 364226 - protein, 9 aa, Homo Sapiens
PALGQLCLL

SEQ ID NO: 364227 - protein, 9 aa, Homo Sapiens
MAGTCPAPK

SEQ ID NO: 364228 - protein, 9 aa, Homo Sapiens
PGTSGFPGS

SEQ ID NO: 364229 - protein, 9 aa, Homo Sapiens
KPVKLYCKA

SEQ ID NO: 364230 - protein, 9 aa, Homo Sapiens
FFGRVYLGF

SEQ ID NO: 364231 - protein, 9 aa, Homo Sapiens
SHLQNLQCI

SEQ ID NO: 364232 - protein, 9 aa, Homo Sapiens
LIIVNTIYE

SEQ ID NO: 364233 - protein, 9 aa, Homo Sapiens
APKIHAIEP

SEQ ID NO: 364234 - protein, 9 aa, Homo Sapiens
YSTTTLPEQ

SEQ ID NO: 364235 - protein, 9 aa, Homo Sapiens
IALAKEVSF

SEQ ID NO: 364236 - protein, 9 aa, Homo Sapiens
SLPLPPQVK

SEQ ID NO: 364237 - protein, 9 aa, Homo Sapiens
VCQQLGCRG

SEQ ID NO: 364238 - protein, 9 aa, Homo Sapiens
ARAGGCSPG

SEQ ID NO: 364239 - protein, 9 aa, Homo Sapiens
PRVHREERV

SEQ ID NO: 364240 - protein, 9 aa, Homo Sapiens
LIRVPRNLT

SEQ ID NO: 364241 - protein, 9 aa, Homo Sapiens
SSGPRVHRE

SEQ ID NO: 364242 - protein, 9 aa, Homo Sapiens
GCSPGPALG

SEQ ID NO: 364243 - protein, 9 aa, Homo Sapiens
ATALTPDLC

SEQ ID NO: 364244 - protein, 9 aa, Homo Sapiens
SGVAAASQG

SEQ ID NO: 364245 - protein, 9 aa, Homo Sapiens
REPLTVHTW

SEQ ID NO: 364246 - protein, 9 aa, Homo Sapiens
CSPGSLGQG

SEQ ID NO: 364247 - protein, 9 aa, Homo Sapiens
QRLGARAGG

SEQ ID NO: 364248 - protein, 9 aa, Homo Sapiens
RVKLIRPIG

SEQ ID NO: 364249 - protein, 9 aa, Homo Sapiens
DSVSSILLQ

SEQ ID NO: 364250 - protein, 9 aa, Homo Sapiens
CYLEIEFCL

SEQ ID NO: 364251 - protein, 9 aa, Homo Sapiens
MQHRPAKML

SEQ ID NO: 364252 - protein, 9 aa, Homo Sapiens
HVSVYGSIY

SEQ ID NO: 364253 - protein, 9 aa, Homo Sapiens
SGPRVHREE

SEQ ID NO: 364254 - protein, 9 aa, Homo Sapiens
LCPLPGPGE

SEQ ID NO: 364255 - protein, 9 aa, Homo Sapiens
GCYLEIEFC

SEQ ID NO: 364256 - protein, 9 aa, Homo Sapiens
LFMALRRQK

SEQ ID NO: 364257 - protein, 9 aa, Homo Sapiens
IQGQVKTTG

SEQ ID NO: 364258 - protein, 9 aa, Homo Sapiens
GSSGPRVHR

SEQ ID NO: 364259 - protein, 9 aa, Homo Sapiens
LKALSRQVL

SEQ ID NO: 364260 - protein, 9 aa, Homo Sapiens
SELIITWES

SEQ ID NO: 364261 - protein, 9 aa, Homo Sapiens
ENGEWAMQH

SEQ ID NO: 364262 - protein, 9 aa, Homo Sapiens
FLLSLGLGL

SEQ ID NO: 364263 - protein, 9 aa, Homo Sapiens
LKQFRKQLE

SEQ ID NO: 364264 - protein, 9 aa, Homo Sapiens
IIVNTIYEI

SEQ ID NO: 364265 - protein, 9 aa, Homo Sapiens
LWQATPAQR

SEQ ID NO: 364266 - protein, 9 aa, Homo Sapiens
AAAAGLPLV

SEQ ID NO: 364267 - protein, 9 aa, Homo Sapiens
IITWESIPE

SEQ ID NO: 364268 - protein, 9 aa, Homo Sapiens
NITPAVRME

SEQ ID NO: 364269 - protein, 9 aa, Homo Sapiens
LWSRAHFLL

SEQ ID NO: 364270 - protein, 9 aa, Homo Sapiens
SVLCVWALV

SEQ ID NO: 364271 - protein, 9 aa, Homo Sapiens
VATILATGG

SEQ ID NO: 364272 - protein, 9 aa, Homo Sapiens
KNKPVKLYC

SEQ ID NO: 364273 - protein, 9 aa, Homo Sapiens
KKNDTSNSS

SEQ ID NO: 364274 - protein, 9 aa, Homo Sapiens
FKTEKNNGA

SEQ ID NO: 364275 - protein, 9 aa, Homo Sapiens
AKEVSFPMS

SEQ ID NO: 364276 - protein, 9 aa, Homo Sapiens
LTPDLCPLP

SEQ ID NO: 364277 - protein, 9 aa, Homo Sapiens
VSKAMTAYW

SEQ ID NO: 364278 - protein, 9 aa, Homo Sapiens
LQCIFILTN

SEQ ID NO: 364279 - protein, 9 aa, Homo Sapiens
MEYLDIESK

SEQ ID NO: 364280 - protein, 9 aa, Homo Sapiens
SRFKTEKNN

SEQ ID NO: 364281 - protein, 9 aa, Homo Sapiens
LCVWALVQD

SEQ ID NO: 364282 - protein, 9 aa, Homo Sapiens
AVENVEKQV

SEQ ID NO: 364283 - protein, 9 aa, Homo Sapiens
DQASLLIIL

SEQ ID NO: 364284 - protein, 9 aa, Homo Sapiens
TVQLPFCRR

SEQ ID NO: 364285 - protein, 9 aa, Homo Sapiens
CQQLGCRGA

SEQ ID NO: 364286 - protein, 9 aa, Homo Sapiens
QPQVCATVV

SEQ ID NO: 364287 - protein, 9 aa, Homo Sapiens
SSLPLPPQV

SEQ ID NO: 364288 - protein, 9 aa, Homo Sapiens
VKLYCKASP

SEQ ID NO: 364289 - protein, 9 aa, Homo Sapiens
SPREPLTVH

SEQ ID NO: 364290 - protein, 9 aa, Homo Sapiens
YLGFSIALR

SEQ ID NO: 364291 - protein, 9 aa, Homo Sapiens
IEWSPGTKE

SEQ ID NO: 364292 - protein, 9 aa, Homo Sapiens
SIYAIADIS

SEQ ID NO: 364293 - protein, 9 aa, Homo Sapiens
VSSILLQST

SEQ ID NO: 364294 - protein, 9 aa, Homo Sapiens
ILILCYIWE

SEQ ID NO: 364295 - protein, 9 aa, Homo Sapiens
GLCPKRTLR

SEQ ID NO: 364296 - protein, 9 aa, Homo Sapiens
NTIYEIDFD

SEQ ID NO: 364297 - protein, 9 aa, Homo Sapiens
IDKPQIIEV

SEQ ID NO: 364298 - protein, 9 aa, Homo Sapiens
SDVFSEPHA

SEQ ID NO: 364299 - protein, 9 aa, Homo Sapiens
VVCQQLGCR

SEQ ID NO: 364300 - protein, 9 aa, Homo Sapiens
KDSEEDVSE

SEQ ID NO: 364301 - protein, 9 aa, Homo Sapiens
RIIDKPQII

SEQ ID NO: 364302 - protein, 9 aa, Homo Sapiens
HAIFYSACV

SEQ ID NO: 364303 - protein, 9 aa, Homo Sapiens
CSVLCVWAL

SEQ ID NO: 364304 - protein, 9 aa, Homo Sapiens
KIGWTKCKK

SEQ ID NO: 364305 - protein, 9 aa, Homo Sapiens
HLIEWSPGT

SEQ ID NO: 364306 - protein, 9 aa, Homo Sapiens
PAVERHHLI

SEQ ID NO: 364307 - protein, 9 aa, Homo Sapiens
MVKNLKQFR

SEQ ID NO: 364308 - protein, 9 aa, Homo Sapiens
PEQLEETTR

SEQ ID NO: 364309 - protein, 9 aa, Homo Sapiens
NCLIIVNTI

SEQ ID NO: 364310 - protein, 9 aa, Homo Sapiens
GDIGIRVKL

SEQ ID NO: 364311 - protein, 9 aa, Homo Sapiens
LSLKALSRQ

SEQ ID NO: 364312 - protein, 9 aa, Homo Sapiens
AAAGLPLVA

SEQ ID NO: 364313 - protein, 9 aa, Homo Sapiens
ILLQSTESK

SEQ ID NO: 364314 - protein, 9 aa, Homo Sapiens
VKNLKQFRK

SEQ ID NO: 364315 - protein, 9 aa, Homo Sapiens
LRGAGVVCQ

SEQ ID NO: 364316 - protein, 9 aa, Homo Sapiens
TLPEQLEET

SEQ ID NO: 364317 - protein, 9 aa, Homo Sapiens
CSTINCSSR

SEQ ID NO: 364318 - protein, 9 aa, Homo Sapiens
LGQLCLLSG

SEQ ID NO: 364319 - protein, 9 aa, Homo Sapiens
FCRRQVLNN

SEQ ID NO: 364320 - protein, 9 aa, Homo Sapiens
ITPAVRMEY

SEQ ID NO: 364321 - protein, 9 aa, Homo Sapiens
SLGQGEPPT

SEQ ID NO: 364322 - protein, 9 aa, Homo Sapiens
VAVAMYVMG

SEQ ID NO: 364323 - protein, 9 aa, Homo Sapiens
VCATVVLLP

SEQ ID NO: 364324 - protein, 9 aa, Homo Sapiens
HLQNLQCIF

SEQ ID NO: 364325 - protein, 9 aa, Homo Sapiens
KNLKQFRKQ

SEQ ID NO: 364326 - protein, 9 aa, Homo Sapiens
SCKDSEEDV

SEQ ID NO: 364327 - protein, 9 aa, Homo Sapiens
MSFNCSTIN

SEQ ID NO: 364328 - protein, 9 aa, Homo Sapiens
RHHLIEWSP

SEQ ID NO: 364329 - protein, 9 aa, Homo Sapiens
TSGFPGSPG

SEQ ID NO: 364330 - protein, 9 aa, Homo Sapiens
GSIYAIADI

SEQ ID NO: 364331 - protein, 9 aa, Homo Sapiens
SLIKDLGLC

SEQ ID NO: 364332 - protein, 9 aa, Homo Sapiens
VERHHLIEW

SEQ ID NO: 364333 - protein, 9 aa, Homo Sapiens
GRVYLGFSI

SEQ ID NO: 364334 - protein, 9 aa, Homo Sapiens
HFLLSLGLG

SEQ ID NO: 364335 - protein, 9 aa, Homo Sapiens
RVCECKEGC

SEQ ID NO: 364336 - protein, 9 aa, Homo Sapiens
FGRVYLGFS

SEQ ID NO: 364337 - protein, 9 aa, Homo Sapiens
TPAVRMEYL

SEQ ID NO: 364338 - protein, 9 aa, Homo Sapiens
HRLLWQATP

SEQ ID NO: 364339 - protein, 9 aa, Homo Sapiens
TTTLPEQLE

SEQ ID NO: 364340 - protein, 9 aa, Homo Sapiens
AAASQGCSP

SEQ ID NO: 364341 - protein, 9 aa, Homo Sapiens
TILATGGNR

SEQ ID NO: 364342 - protein, 9 aa, Homo Sapiens
QLPFCRRQV

SEQ ID NO: 364343 - protein, 9 aa, Homo Sapiens
SILLQSTES

SEQ ID NO: 364344 - protein, 9 aa, Homo Sapiens
CRRQVLNNF

SEQ ID NO: 364345 - protein, 9 aa, Homo Sapiens
NKPVKLYCK

SEQ ID NO: 364346 - protein, 9 aa, Homo Sapiens
LIKDLGLCP

SEQ ID NO: 364347 - protein, 9 aa, Homo Sapiens
RPNLVETGC

SEQ ID NO: 364348 - protein, 9 aa, Homo Sapiens
CVWALVQDL

SEQ ID NO: 364349 - protein, 9 aa, Homo Sapiens
YMVKNLKQF

SEQ ID NO: 364350 - protein, 9 aa, Homo Sapiens
AMTAYWTNF

SEQ ID NO: 364351 - protein, 9 aa, Homo Sapiens
EKLSLKALS

SEQ ID NO: 364352 - protein, 9 aa, Homo Sapiens
LCPKRTLRL

SEQ ID NO: 364353 - protein, 9 aa, Homo Sapiens
SQGCSPGSL

SEQ ID NO: 364354 - protein, 9 aa, Homo Sapiens
PGPALGQLC

SEQ ID NO: 364355 - protein, 9 aa, Homo Sapiens
KTEKNNGAG

SEQ ID NO: 364356 - protein, 9 aa, Homo Sapiens
DIGIRVKLI

SEQ ID NO: 364357 - protein, 9 aa, Homo Sapiens
VLFMALRRQ

SEQ ID NO: 364358 - protein, 9 aa, Homo Sapiens
NTVSKIQGQ

SEQ ID NO: 364359 - protein, 9 aa, Homo Sapiens
GGGSRSELI

SEQ ID NO: 364360 - protein, 9 aa, Homo Sapiens
RTVSKAMTA

SEQ ID NO: 364361 - protein, 9 aa, Homo Sapiens
VSEATWMEQ

SEQ ID NO: 364362 - protein, 9 aa, Homo Sapiens
LIRPIGIFS

SEQ ID NO: 364363 - protein, 9 aa, Homo Sapiens
GTCPAPKIH

SEQ ID NO: 364364 - protein, 9 aa, Homo Sapiens
YILIVHAVD

SEQ ID NO: 364365 - protein, 9 aa, Homo Sapiens
CKEGCYLEI

SEQ ID NO: 364366 - protein, 9 aa, Homo Sapiens
ELIITWESI

SEQ ID NO: 364367 - protein, 9 aa, Homo Sapiens
LLALVVLFM

SEQ ID NO: 364368 - protein, 9 aa, Homo Sapiens
LLIILKLSA

SEQ ID NO: 364369 - protein, 9 aa, Homo Sapiens
TVSKIQGQV

SEQ ID NO: 364370 - protein, 9 aa, Homo Sapiens
DVSEATWME

SEQ ID NO: 364371 - protein, 9 aa, Homo Sapiens
NLDSVSSIL

SEQ ID NO: 364372 - protein, 9 aa, Homo Sapiens
VNTIYEIDF

SEQ ID NO: 364373 - protein, 9 aa, Homo Sapiens
TCPGGTGHR

SEQ ID NO: 364374 - protein, 9 aa, Homo Sapiens
IGIRVKLIR

SEQ ID NO: 364375 - protein, 9 aa, Homo Sapiens
QGRDEEWAL

SEQ ID NO: 364376 - protein, 9 aa, Homo Sapiens
AGVVCQQLG

SEQ ID NO: 364377 - protein, 9 aa, Homo Sapiens
EVRVCACRG

SEQ ID NO: 364378 - protein, 9 aa, Homo Sapiens
MLNTVSKIQ

SEQ ID NO: 364379 - protein, 9 aa, Homo Sapiens
DRTVSKAMT

SEQ ID NO: 364380 - protein, 9 aa, Homo Sapiens
ALTPDLCPL

SEQ ID NO: 364381 - protein, 9 aa, Homo Sapiens
GGCSPGPAL

SEQ ID NO: 364382 - protein, 9 aa, Homo Sapiens
QVCATVVLL

SEQ ID NO: 364383 - protein, 9 aa, Homo Sapiens
KEGCYLEIE

SEQ ID NO: 364384 - protein, 9 aa, Homo Sapiens
TCPAPKIHA

SEQ ID NO: 364385 - protein, 9 aa, Homo Sapiens
PREPLTVHT

SEQ ID NO: 364386 - protein, 9 aa, Homo Sapiens
INEKAVENV

SEQ ID NO: 364387 - protein, 9 aa, Homo Sapiens
AMQHRPAKM

SEQ ID NO: 364388 - protein, 9 aa, Homo Sapiens
RFLTQRLGA

SEQ ID NO: 364389 - protein, 9 aa, Homo Sapiens
LIILKLSAG

SEQ ID NO: 364390 - protein, 9 aa, Homo Sapiens
KQFRKQLER

SEQ ID NO: 364391 - protein, 9 aa, Homo Sapiens
YNIDYKPDI

SEQ ID NO: 364392 - protein, 9 aa, Homo Sapiens
REQVHQTTC

SEQ ID NO: 364393 - protein, 9 aa, Homo Sapiens
KLIRPIGIF

SEQ ID NO: 364394 - protein, 9 aa, Homo Sapiens
GVAAASQGC

SEQ ID NO: 364395 - protein, 9 aa, Homo Sapiens
PGSLGQGEP

SEQ ID NO: 364396 - protein, 9 aa, Homo Sapiens
GPRVHREER

SEQ ID NO: 364397 - protein, 9 aa, Homo Sapiens
EVSFPMSSS

SEQ ID NO: 364398 - protein, 9 aa, Homo Sapiens
VAAASQGCS

SEQ ID NO: 364399 - protein, 9 aa, Homo Sapiens
HSDVFSEPH

SEQ ID NO: 364400 - protein, 9 aa, Homo Sapiens
NCSTINCSS

SEQ ID NO: 364401 - protein, 9 aa, Homo Sapiens
DKPQIIEVA

SEQ ID NO: 364402 - protein, 9 aa, Homo Sapiens
CATVVLLPD

SEQ ID NO: 364403 - protein, 9 aa, Homo Sapiens
VETGCPNIR

SEQ ID NO: 364404 - protein, 9 aa, Homo Sapiens
AGLPLVAAT

SEQ ID NO: 364405 - protein, 9 aa, Homo Sapiens
CLIIVNTIY

SEQ ID NO: 364406 - protein, 9 aa, Homo Sapiens
ACRGRDRRT

SEQ ID NO: 364407 - protein, 9 aa, Homo Sapiens
GARAGGCSP

SEQ ID NO: 364408 - protein, 9 aa, Homo Sapiens
SQGRDEEWA

SEQ ID NO: 364409 - protein, 9 aa, Homo Sapiens
LSGVAAASQ

SEQ ID NO: 364410 - protein, 9 aa, Homo Sapiens
IWEMYQQNK

SEQ ID NO: 364411 - protein, 9 aa, Homo Sapiens
RGRDRRTEE

SEQ ID NO: 364412 - protein, 9 aa, Homo Sapiens
LEKLSLKAL

SEQ ID NO: 364413 - protein, 9 aa, Homo Sapiens
AVERHHLIE

SEQ ID NO: 364414 - protein, 9 aa, Homo Sapiens
KLYCKASPA

SEQ ID NO: 364415 - protein, 9 aa, Homo Sapiens
RRQVLNNFF

SEQ ID NO: 364416 - protein, 9 aa, Homo Sapiens
SLKALSRQV

SEQ ID NO: 364417 - protein, 9 aa, Homo Sapiens
IDYKPDIED

SEQ ID NO: 364418 - protein, 9 aa, Homo Sapiens
MRTKQLQER

SEQ ID NO: 364419 - protein, 9 aa, Homo Sapiens
VRNKSFYMH

SEQ ID NO: 364420 - protein, 9 aa, Homo Sapiens
EKRAKKIWK

SEQ ID NO: 364421 - protein, 9 aa, Homo Sapiens
RSKTEAHLA

SEQ ID NO: 364422 - protein, 9 aa, Homo Sapiens
PTEPNVVSV

SEQ ID NO: 364423 - protein, 9 aa, Homo Sapiens
KRPLLPRAP

SEQ ID NO: 364424 - protein, 9 aa, Homo Sapiens
LLAYAFPPG

SEQ ID NO: 364425 - protein, 9 aa, Homo Sapiens
AAGVAEKFA

SEQ ID NO: 364426 - protein, 9 aa, Homo Sapiens
WPLPMCCTP

SEQ ID NO: 364427 - protein, 9 aa, Homo Sapiens
CDCWEPAPE

SEQ ID NO: 364428 - protein, 9 aa, Homo Sapiens
WRTSRTRET

SEQ ID NO: 364429 - protein, 9 aa, Homo Sapiens
IDPQAIHPE

SEQ ID NO: 364430 - protein, 9 aa, Homo Sapiens
IRGMRKLRP

SEQ ID NO: 364431 - protein, 9 aa, Homo Sapiens
SLKARGALA

SEQ ID NO: 364432 - protein, 9 aa, Homo Sapiens
PRHSHFFLP

SEQ ID NO: 364433 - protein, 9 aa, Homo Sapiens
YLRPHKTAH

SEQ ID NO: 364434 - protein, 9 aa, Homo Sapiens
DEFTRLEFP

SEQ ID NO: 364435 - protein, 9 aa, Homo Sapiens
SLRTTPLKT

SEQ ID NO: 364436 - protein, 9 aa, Homo Sapiens
LRLLPGRLL

SEQ ID NO: 364437 - protein, 9 aa, Homo Sapiens
PVRLRSFDV

SEQ ID NO: 364438 - protein, 9 aa, Homo Sapiens
LDEADVDNE

SEQ ID NO: 364439 - protein, 9 aa, Homo Sapiens
STSITRFAF

SEQ ID NO: 364440 - protein, 9 aa, Homo Sapiens
GLARVRSRA

SEQ ID NO: 364441 - protein, 9 aa, Homo Sapiens
SITVSFVGQ

SEQ ID NO: 364442 - protein, 9 aa, Homo Sapiens
VSPPQAAGA

SEQ ID NO: 364443 - protein, 9 aa, Homo Sapiens
TAGTSSKIT

SEQ ID NO: 364444 - protein, 9 aa, Homo Sapiens
TAVGSAQPR

SEQ ID NO: 364445 - protein, 9 aa, Homo Sapiens
TRFSNRSHL

SEQ ID NO: 364446 - protein, 9 aa, Homo Sapiens
NQAPQCPPR

SEQ ID NO: 364447 - protein, 9 aa, Homo Sapiens
GATSSTNRY

SEQ ID NO: 364448 - protein, 9 aa, Homo Sapiens
PQLGAHPAC

SEQ ID NO: 364449 - protein, 9 aa, Homo Sapiens
QVRADPLTA

SEQ ID NO: 364450 - protein, 9 aa, Homo Sapiens
ADPLTASTA

SEQ ID NO: 364451 - protein, 9 aa, Homo Sapiens
YYHTYDRFL

SEQ ID NO: 364452 - protein, 9 aa, Homo Sapiens
TENVDVCVV

SEQ ID NO: 364453 - protein, 9 aa, Homo Sapiens
VSSPTRSSP

SEQ ID NO: 364454 - protein, 9 aa, Homo Sapiens
STRVPLWPK

SEQ ID NO: 364455 - protein, 9 aa, Homo Sapiens
LERYGKDFT

SEQ ID NO: 364456 - protein, 9 aa, Homo Sapiens
TLHQRADPV

SEQ ID NO: 364457 - protein, 9 aa, Homo Sapiens
SSRPLPLQP

SEQ ID NO: 364458 - protein, 9 aa, Homo Sapiens
RMLQSLPKQ

SEQ ID NO: 364459 - protein, 9 aa, Homo Sapiens
EESEDSKNG

SEQ ID NO: 364460 - protein, 9 aa, Homo Sapiens
MLYMEEIQL

SEQ ID NO: 364461 - protein, 9 aa, Homo Sapiens
ATPKQAAQE

SEQ ID NO: 364462 - protein, 9 aa, Homo Sapiens
SPRPPGASS

SEQ ID NO: 364463 - protein, 9 aa, Homo Sapiens
KAQAEAARE

SEQ ID NO: 364464 - protein, 9 aa, Homo Sapiens
SVMSSEGNT

SEQ ID NO: 364465 - protein, 9 aa, Homo Sapiens
PEFEEDSED

SEQ ID NO: 364466 - protein, 9 aa, Homo Sapiens
LPQIRAQVL

SEQ ID NO: 364467 - protein, 9 aa, Homo Sapiens
RSRAALSFA

SEQ ID NO: 364468 - protein, 9 aa, Homo Sapiens
LFECKGCGK

SEQ ID NO: 364469 - protein, 9 aa, Homo Sapiens
VKRVIEVQL

SEQ ID NO: 364470 - protein, 9 aa, Homo Sapiens
GFLTEDKKN

SEQ ID NO: 364471 - protein, 9 aa, Homo Sapiens
NHRDWIATS

SEQ ID NO: 364472 - protein, 9 aa, Homo Sapiens
HGSRMVAGV

SEQ ID NO: 364473 - protein, 9 aa, Homo Sapiens
TATPDRTHF

SEQ ID NO: 364474 - protein, 9 aa, Homo Sapiens
KILKNHPPM

SEQ ID NO: 364475 - protein, 9 aa, Homo Sapiens
GASQTTDAI

SEQ ID NO: 364476 - protein, 9 aa, Homo Sapiens
GTWEFNALL

SEQ ID NO: 364477 - protein, 9 aa, Homo Sapiens
NMAPMSTEL

SEQ ID NO: 364478 - protein, 9 aa, Homo Sapiens
KTRKHKHFY

SEQ ID NO: 364479 - protein, 9 aa, Homo Sapiens
IANSNSLNH

SEQ ID NO: 364480 - protein, 9 aa, Homo Sapiens
SWLKGVLSP

SEQ ID NO: 364481 - protein, 9 aa, Homo Sapiens
SSFCCCTQD

SEQ ID NO: 364482 - protein, 9 aa, Homo Sapiens
ILFPCLRLL

SEQ ID NO: 364483 - protein, 9 aa, Homo Sapiens
VASMDKWKG

SEQ ID NO: 364484 - protein, 9 aa, Homo Sapiens
TLKEKKTRK

SEQ ID NO: 364485 - protein, 9 aa, Homo Sapiens
KDKALSSAF

SEQ ID NO: 364486 - protein, 9 aa, Homo Sapiens
TLEGCISVK

SEQ ID NO: 364487 - protein, 9 aa, Homo Sapiens
NSKKSKTLL

SEQ ID NO: 364488 - protein, 9 aa, Homo Sapiens
SLPTQTSHY

SEQ ID NO: 364489 - protein, 9 aa, Homo Sapiens
PHCPMVVQA

SEQ ID NO: 364490 - protein, 9 aa, Homo Sapiens
SHTGTLCTR

SEQ ID NO: 364491 - protein, 9 aa, Homo Sapiens
SCLFDIETC

SEQ ID NO: 364492 - protein, 9 aa, Homo Sapiens
VEKDATKEF

SEQ ID NO: 364493 - protein, 9 aa, Homo Sapiens
PQDSRQVLA

SEQ ID NO: 364494 - protein, 9 aa, Homo Sapiens
LKYLGMMLV

SEQ ID NO: 364495 - protein, 9 aa, Homo Sapiens
EEGETERTE

SEQ ID NO: 364496 - protein, 9 aa, Homo Sapiens
LCLEYADRA

SEQ ID NO: 364497 - protein, 9 aa, Homo Sapiens
KSAQEFAVN

SEQ ID NO: 364498 - protein, 9 aa, Homo Sapiens
GCSVSKTPD

SEQ ID NO: 364499 - protein, 9 aa, Homo Sapiens
CNLALRMMR

SEQ ID NO: 364500 - protein, 9 aa, Homo Sapiens
ARPACPKVP

SEQ ID NO: 364501 - protein, 9 aa, Homo Sapiens
SLEPQIRPV

SEQ ID NO: 364502 - protein, 9 aa, Homo Sapiens
ELWNTSLLQ

SEQ ID NO: 364503 - protein, 9 aa, Homo Sapiens
HITFGGLSS

SEQ ID NO: 364504 - protein, 9 aa, Homo Sapiens
PGPAAVTAP

SEQ ID NO: 364505 - protein, 9 aa, Homo Sapiens
GLWKGRYYS

SEQ ID NO: 364506 - protein, 9 aa, Homo Sapiens
QNSATFSAN

SEQ ID NO: 364507 - protein, 9 aa, Homo Sapiens
FSTTALSCR

SEQ ID NO: 364508 - protein, 9 aa, Homo Sapiens
ALLVLLSGL

SEQ ID NO: 364509 - protein, 9 aa, Homo Sapiens
HLGRVCLDV

SEQ ID NO: 364510 - protein, 9 aa, Homo Sapiens
EERRPHKEE

SEQ ID NO: 364511 - protein, 9 aa, Homo Sapiens
PITPRLSPL

SEQ ID NO: 364512 - protein, 9 aa, Homo Sapiens
SSSLTKQVI

SEQ ID NO: 364513 - protein, 9 aa, Homo Sapiens
QQWPQQGAP

SEQ ID NO: 364514 - protein, 9 aa, Homo Sapiens
LIQWKRQQQ

SEQ ID NO: 364515 - protein, 9 aa, Homo Sapiens
PCLRLRRAS

SEQ ID NO: 364516 - protein, 9 aa, Homo Sapiens
MGRPEERAP

SEQ ID NO: 364517 - protein, 9 aa, Homo Sapiens
ELQSSGVPE

SEQ ID NO: 364518 - protein, 9 aa, Homo Sapiens
AEKFAITEA

SEQ ID NO: 364519 - protein, 9 aa, Homo Sapiens
MNLNIAKVL

SEQ ID NO: 364520 - protein, 9 aa, Homo Sapiens
AYEILPCGV

SEQ ID NO: 364521 - protein, 9 aa, Homo Sapiens
KKCIGLIYV

SEQ ID NO: 364522 - protein, 9 aa, Homo Sapiens
GFAQDLPIV

SEQ ID NO: 364523 - protein, 9 aa, Homo Sapiens
PSSAASTPP

SEQ ID NO: 364524 - protein, 9 aa, Homo Sapiens
RLTVNTDVG

SEQ ID NO: 364525 - protein, 9 aa, Homo Sapiens
YSMGLLDMT

SEQ ID NO: 364526 - protein, 9 aa, Homo Sapiens
ASSPVSARR

SEQ ID NO: 364527 - protein, 9 aa, Homo Sapiens
IKSQEEDQS

SEQ ID NO: 364528 - protein, 9 aa, Homo Sapiens
SAPWSVIDP

SEQ ID NO: 364529 - protein, 9 aa, Homo Sapiens
EEECMFPKT

SEQ ID NO: 364530 - protein, 9 aa, Homo Sapiens
VSGSWCGTW

SEQ ID NO: 364531 - protein, 9 aa, Homo Sapiens
EKSVKEIKC

SEQ ID NO: 364532 - protein, 9 aa, Homo Sapiens
STSRDSRSF

SEQ ID NO: 364533 - protein, 9 aa, Homo Sapiens
EPPGPTTDA

SEQ ID NO: 364534 - protein, 9 aa, Homo Sapiens
RPACPKVPE

SEQ ID NO: 364535 - protein, 9 aa, Homo Sapiens
LQGKPTSQL

SEQ ID NO: 364536 - protein, 9 aa, Homo Sapiens
SHPCAVRRP

SEQ ID NO: 364537 - protein, 9 aa, Homo Sapiens
AGARARQGA

SEQ ID NO: 364538 - protein, 9 aa, Homo Sapiens
KYSVYLTKG

SEQ ID NO: 364539 - protein, 9 aa, Homo Sapiens
PWATGPSVP

SEQ ID NO: 364540 - protein, 9 aa, Homo Sapiens
VTNGAAWEP

SEQ ID NO: 364541 - protein, 9 aa, Homo Sapiens
SRRRRRKDL

SEQ ID NO: 364542 - protein, 9 aa, Homo Sapiens
IQDQDQELA

SEQ ID NO: 364543 - protein, 9 aa, Homo Sapiens
KDHTFVTSS

SEQ ID NO: 364544 - protein, 9 aa, Homo Sapiens
LFLLAGWCM

SEQ ID NO: 364545 - protein, 9 aa, Homo Sapiens
LLGTYRVVD

SEQ ID NO: 364546 - protein, 9 aa, Homo Sapiens
QPGPQGSSR

SEQ ID NO: 364547 - protein, 9 aa, Homo Sapiens
HNEPSISEH

SEQ ID NO: 364548 - protein, 9 aa, Homo Sapiens
SFYMHRNNS

SEQ ID NO: 364549 - protein, 9 aa, Homo Sapiens
QASPTSSTK

SEQ ID NO: 364550 - protein, 9 aa, Homo Sapiens
SIWLPGCPR

SEQ ID NO: 364551 - protein, 9 aa, Homo Sapiens
LKLSSRLSL

SEQ ID NO: 364552 - protein, 9 aa, Homo Sapiens
RSASRTSNI

SEQ ID NO: 364553 - protein, 9 aa, Homo Sapiens
NADGLAKHP

SEQ ID NO: 364554 - protein, 9 aa, Homo Sapiens
SCILSTKAS

SEQ ID NO: 364555 - protein, 9 aa, Homo Sapiens
LPVLPGDGV

SEQ ID NO: 364556 - protein, 9 aa, Homo Sapiens
YTPEALAAE

SEQ ID NO: 364557 - protein, 9 aa, Homo Sapiens
DEEEGEDEA

SEQ ID NO: 364558 - protein, 9 aa, Homo Sapiens
IQGRFSLVL

SEQ ID NO: 364559 - protein, 9 aa, Homo Sapiens
SPRISSLCP

SEQ ID NO: 364560 - protein, 9 aa, Homo Sapiens
EGPRSKRRC

SEQ ID NO: 364561 - protein, 9 aa, Homo Sapiens
ETKLVRKVA

SEQ ID NO: 364562 - protein, 9 aa, Homo Sapiens
HVGIIYNPV

SEQ ID NO: 364563 - protein, 9 aa, Homo Sapiens
FCINMRQLY

SEQ ID NO: 364564 - protein, 9 aa, Homo Sapiens
YVCLKFHTS

SEQ ID NO: 364565 - protein, 9 aa, Homo Sapiens
CKRRRTHTN

SEQ ID NO: 364566 - protein, 9 aa, Homo Sapiens
CACSHPCAV

SEQ ID NO: 364567 - protein, 9 aa, Homo Sapiens
AFNSMMMEC

SEQ ID NO: 364568 - protein, 9 aa, Homo Sapiens
KKLSIKLHL

SEQ ID NO: 364569 - protein, 9 aa, Homo Sapiens
LDGPQIGVN

SEQ ID NO: 364570 - protein, 9 aa, Homo Sapiens
YVLWAGVAS

SEQ ID NO: 364571 - protein, 9 aa, Homo Sapiens
TPLAWHRTL

SEQ ID NO: 364572 - protein, 9 aa, Homo Sapiens
FFGTRPLFV

SEQ ID NO: 364573 - protein, 9 aa, Homo Sapiens
SASSPVSAR

SEQ ID NO: 364574 - protein, 9 aa, Homo Sapiens
TLCQVSGMP

SEQ ID NO: 364575 - protein, 9 aa, Homo Sapiens
LLVSLAMFR

SEQ ID NO: 364576 - protein, 9 aa, Homo Sapiens
DGFAGIKKL

SEQ ID NO: 364577 - protein, 9 aa, Homo Sapiens
LQSCILSTK

SEQ ID NO: 364578 - protein, 9 aa, Homo Sapiens
VIRNTCKAV

SEQ ID NO: 364579 - protein, 9 aa, Homo Sapiens
KRKHRTKSA

SEQ ID NO: 364580 - protein, 9 aa, Homo Sapiens
RLNPRRSCP

SEQ ID NO: 364581 - protein, 9 aa, Homo Sapiens
CAQCGKDFR

SEQ ID NO: 364582 - protein, 9 aa, Homo Sapiens
TKPSPSSAA

SEQ ID NO: 364583 - protein, 9 aa, Homo Sapiens
TEKGEAEHL

SEQ ID NO: 364584 - protein, 9 aa, Homo Sapiens
LEFLERIHL

SEQ ID NO: 364585 - protein, 9 aa, Homo Sapiens
TGNGVIAFV

SEQ ID NO: 364586 - protein, 9 aa, Homo Sapiens
PCGVDRRWY

SEQ ID NO: 364587 - protein, 9 aa, Homo Sapiens
HMWTYREEP

SEQ ID NO: 364588 - protein, 9 aa, Homo Sapiens
NVTKPLNNF

SEQ ID NO: 364589 - protein, 9 aa, Homo Sapiens
ACSRRSLRT

SEQ ID NO: 364590 - protein, 9 aa, Homo Sapiens
ASWSHATTA

SEQ ID NO: 364591 - protein, 9 aa, Homo Sapiens
RPERAARTP

SEQ ID NO: 364592 - protein, 9 aa, Homo Sapiens
LQPVMQALA

SEQ ID NO: 364593 - protein, 9 aa, Homo Sapiens
DFLKMLYME

SEQ ID NO: 364594 - protein, 9 aa, Homo Sapiens
LPCMLISLL

SEQ ID NO: 364595 - protein, 9 aa, Homo Sapiens
MLEEGDDGD

SEQ ID NO: 364596 - protein, 9 aa, Homo Sapiens
KKRYLCLLE

SEQ ID NO: 364597 - protein, 9 aa, Homo Sapiens
VACPDDQGG

SEQ ID NO: 364598 - protein, 9 aa, Homo Sapiens
YDKPRTTEG

SEQ ID NO: 364599 - protein, 9 aa, Homo Sapiens
SWPQGAPPS

SEQ ID NO: 364600 - protein, 9 aa, Homo Sapiens
GSSSGNGGG

SEQ ID NO: 364601 - protein, 9 aa, Homo Sapiens
FLIQRELLK

SEQ ID NO: 364602 - protein, 9 aa, Homo Sapiens
KHLKFIGNW

SEQ ID NO: 364603 - protein, 9 aa, Homo Sapiens
ASENVQCCI

SEQ ID NO: 364604 - protein, 9 aa, Homo Sapiens
LKTRCLMVL

SEQ ID NO: 364605 - protein, 9 aa, Homo Sapiens
FNQFAEWKL

SEQ ID NO: 364606 - protein, 9 aa, Homo Sapiens
LLGSRMAHP

SEQ ID NO: 364607 - protein, 9 aa, Homo Sapiens
HFSVPNGLT

SEQ ID NO: 364608 - protein, 9 aa, Homo Sapiens
TYLCIPEYE

SEQ ID NO: 364609 - protein, 9 aa, Homo Sapiens
SPATMWPNS

SEQ ID NO: 364610 - protein, 9 aa, Homo Sapiens
TPRPSTAGA

SEQ ID NO: 364611 - protein, 9 aa, Homo Sapiens
NNQFFHDVD

SEQ ID NO: 364612 - protein, 9 aa, Homo Sapiens
VAVFEGRFR

SEQ ID NO: 364613 - protein, 9 aa, Homo Sapiens
TPPEPAVTL

SEQ ID NO: 364614 - protein, 9 aa, Homo Sapiens
GIVQMVFSV

SEQ ID NO: 364615 - protein, 9 aa, Homo Sapiens
QCVENECVC

SEQ ID NO: 364616 - protein, 9 aa, Homo Sapiens
TNIIAKLWR

SEQ ID NO: 364617 - protein, 9 aa, Homo Sapiens
FHQPELVRP

SEQ ID NO: 364618 - protein, 9 aa, Homo Sapiens
VDHGKSTPT

SEQ ID NO: 364619 - protein, 9 aa, Homo Sapiens
GGRHRCSPH

SEQ ID NO: 364620 - protein, 9 aa, Homo Sapiens
KIQDQDQEL

SEQ ID NO: 364621 - protein, 9 aa, Homo Sapiens
GKWLQWPHP

SEQ ID NO: 364622 - protein, 9 aa, Homo Sapiens
GDWDIDVES

SEQ ID NO: 364623 - protein, 9 aa, Homo Sapiens
NGNEDEEGQ

SEQ ID NO: 364624 - protein, 9 aa, Homo Sapiens
LRPCRCCRC

SEQ ID NO: 364625 - protein, 9 aa, Homo Sapiens
WPKKIIIRY

SEQ ID NO: 364626 - protein, 9 aa, Homo Sapiens
GLEEKDSNA

SEQ ID NO: 364627 - protein, 9 aa, Homo Sapiens
PVAKAKPKF

SEQ ID NO: 364628 - protein, 9 aa, Homo Sapiens
WPQQGAPPR

SEQ ID NO: 364629 - protein, 9 aa, Homo Sapiens
QLKADMFKW

SEQ ID NO: 364630 - protein, 9 aa, Homo Sapiens
IVTNGAAWE

SEQ ID NO: 364631 - protein, 9 aa, Homo Sapiens
QMTRERMED

SEQ ID NO: 364632 - protein, 9 aa, Homo Sapiens
RETVMIITR

SEQ ID NO: 364633 - protein, 9 aa, Homo Sapiens
FKGSKKTLL

SEQ ID NO: 364634 - protein, 9 aa, Homo Sapiens
RVMDQAREL

SEQ ID NO: 364635 - protein, 9 aa, Homo Sapiens
WHCDQEEDC

SEQ ID NO: 364636 - protein, 9 aa, Homo Sapiens
QVLDADCVT

SEQ ID NO: 364637 - protein, 9 aa, Homo Sapiens
PDNLLKIYK

SEQ ID NO: 364638 - protein, 9 aa, Homo Sapiens
SMLAARLHW

SEQ ID NO: 364639 - protein, 9 aa, Homo Sapiens
QRFSRKAVY

SEQ ID NO: 364640 - protein, 9 aa, Homo Sapiens
PWPLPMCCT

SEQ ID NO: 364641 - protein, 9 aa, Homo Sapiens
QIPRHIKKF

SEQ ID NO: 364642 - protein, 9 aa, Homo Sapiens
RLTTVSGGT

SEQ ID NO: 364643 - protein, 9 aa, Homo Sapiens
PTGRRASPG

SEQ ID NO: 364644 - protein, 9 aa, Homo Sapiens
CRLFEEPEL

SEQ ID NO: 364645 - protein, 9 aa, Homo Sapiens
WVRYVEFYS

SEQ ID NO: 364646 - protein, 9 aa, Homo Sapiens
IAKLWRMMT

SEQ ID NO: 364647 - protein, 9 aa, Homo Sapiens
ATVLLQSAL

SEQ ID NO: 364648 - protein, 9 aa, Homo Sapiens
FPGKNCTLT

SEQ ID NO: 364649 - protein, 9 aa, Homo Sapiens
QAIKDHTFV

SEQ ID NO: 364650 - protein, 9 aa, Homo Sapiens
GSFLLHKKA

SEQ ID NO: 364651 - protein, 9 aa, Homo Sapiens
ESKALNVNC

SEQ ID NO: 364652 - protein, 9 aa, Homo Sapiens
GQQDQQTIH

SEQ ID NO: 364653 - protein, 9 aa, Homo Sapiens
GPWGMKFRL

SEQ ID NO: 364654 - protein, 9 aa, Homo Sapiens
VPKRLTGSQ

SEQ ID NO: 364655 - protein, 9 aa, Homo Sapiens
RFVVRNTVQ

SEQ ID NO: 364656 - protein, 9 aa, Homo Sapiens
QRRLSKGCW

SEQ ID NO: 364657 - protein, 9 aa, Homo Sapiens
IGLIYVNGR

SEQ ID NO: 364658 - protein, 9 aa, Homo Sapiens
HLAVEACLR

SEQ ID NO: 364659 - protein, 9 aa, Homo Sapiens
VRRPAAPTR

SEQ ID NO: 364660 - protein, 9 aa, Homo Sapiens
LLTSTSDRQ

SEQ ID NO: 364661 - protein, 9 aa, Homo Sapiens
RTVWYLQYT

SEQ ID NO: 364662 - protein, 9 aa, Homo Sapiens
APESPDSRA

SEQ ID NO: 364663 - protein, 9 aa, Homo Sapiens
AHPYQHLQD

SEQ ID NO: 364664 - protein, 9 aa, Homo Sapiens
GGLKLSSRL

SEQ ID NO: 364665 - protein, 9 aa, Homo Sapiens
IEPRDHNEP

SEQ ID NO: 364666 - protein, 9 aa, Homo Sapiens
KPLPVVLGL

SEQ ID NO: 364667 - protein, 9 aa, Homo Sapiens
HTSYESITS

SEQ ID NO: 364668 - protein, 9 aa, Homo Sapiens
AVVMAVCGG

SEQ ID NO: 364669 - protein, 9 aa, Homo Sapiens
RGWHCDQEE

SEQ ID NO: 364670 - protein, 9 aa, Homo Sapiens
TPACASTSR

SEQ ID NO: 364671 - protein, 9 aa, Homo Sapiens
LGAWVCDWL

SEQ ID NO: 364672 - protein, 9 aa, Homo Sapiens
KCSVLGRIQ

SEQ ID NO: 364673 - protein, 9 aa, Homo Sapiens
PQEIYFIET

SEQ ID NO: 364674 - protein, 9 aa, Homo Sapiens
CEEEENWDQ

SEQ ID NO: 364675 - protein, 9 aa, Homo Sapiens
LHPDVARGL

SEQ ID NO: 364676 - protein, 9 aa, Homo Sapiens
RAAAVAPLA

SEQ ID NO: 364677 - protein, 9 aa, Homo Sapiens
RVCDIEHLT

SEQ ID NO: 364678 - protein, 9 aa, Homo Sapiens
AFSTSITRF

SEQ ID NO: 364679 - protein, 9 aa, Homo Sapiens
SHGALQPVM

SEQ ID NO: 364680 - protein, 9 aa, Homo Sapiens
GRRASPGAM

SEQ ID NO: 364681 - protein, 9 aa, Homo Sapiens
MVGSPQRRP

SEQ ID NO: 364682 - protein, 9 aa, Homo Sapiens
AAGAEREHH

SEQ ID NO: 364683 - protein, 9 aa, Homo Sapiens
GRIVSRNGC

SEQ ID NO: 364684 - protein, 9 aa, Homo Sapiens
ISNAENKHI

SEQ ID NO: 364685 - protein, 9 aa, Homo Sapiens
GVTSIVSGA

SEQ ID NO: 364686 - protein, 9 aa, Homo Sapiens
PRAPAAGWA

SEQ ID NO: 364687 - protein, 9 aa, Homo Sapiens
ATSSLEASG

SEQ ID NO: 364688 - protein, 9 aa, Homo Sapiens
ACSHPCAVR

SEQ ID NO: 364689 - protein, 9 aa, Homo Sapiens
RRAISTFGT

SEQ ID NO: 364690 - protein, 9 aa, Homo Sapiens
AFSWLLNPE

SEQ ID NO: 364691 - protein, 9 aa, Homo Sapiens
PVTLLTMDW

SEQ ID NO: 364692 - protein, 9 aa, Homo Sapiens
TLRLYHAHP

SEQ ID NO: 364693 - protein, 9 aa, Homo Sapiens
INVLSHLPS

SEQ ID NO: 364694 - protein, 9 aa, Homo Sapiens
GIRFFLVSI

SEQ ID NO: 364695 - protein, 9 aa, Homo Sapiens
LGSWGQTDL

SEQ ID NO: 364696 - protein, 9 aa, Homo Sapiens
CMTTDINAL

SEQ ID NO: 364697 - protein, 9 aa, Homo Sapiens
PSSSDGSSD

SEQ ID NO: 364698 - protein, 9 aa, Homo Sapiens
WEYWQDFVY

SEQ ID NO: 364699 - protein, 9 aa, Homo Sapiens
QYQRDTQQL

SEQ ID NO: 364700 - protein, 9 aa, Homo Sapiens
PASAPTRWQ

SEQ ID NO: 364701 - protein, 9 aa, Homo Sapiens
SGSSYRCTC

SEQ ID NO: 364702 - protein, 9 aa, Homo Sapiens
KENECLGNY

SEQ ID NO: 364703 - protein, 9 aa, Homo Sapiens
ASNPFYEPK

SEQ ID NO: 364704 - protein, 9 aa, Homo Sapiens
NTAFTKLAP

SEQ ID NO: 364705 - protein, 9 aa, Homo Sapiens
DKILELLDV

SEQ ID NO: 364706 - protein, 9 aa, Homo Sapiens
NTVQRSVAK

SEQ ID NO: 364707 - protein, 9 aa, Homo Sapiens
VQFVFLRKH

SEQ ID NO: 364708 - protein, 9 aa, Homo Sapiens
SLPVAFFFS

SEQ ID NO: 364709 - protein, 9 aa, Homo Sapiens
DDLMPVCCG

SEQ ID NO: 364710 - protein, 9 aa, Homo Sapiens
ENFYLMTNG

SEQ ID NO: 364711 - protein, 9 aa, Homo Sapiens
VQTCIMNNG

SEQ ID NO: 364712 - protein, 9 aa, Homo Sapiens
LTTVSGGTT

SEQ ID NO: 364713 - protein, 9 aa, Homo Sapiens
IRNQPNERQ

SEQ ID NO: 364714 - protein, 9 aa, Homo Sapiens
ALERSKNKE

SEQ ID NO: 364715 - protein, 9 aa, Homo Sapiens
KYRKIKMQN

SEQ ID NO: 364716 - protein, 9 aa, Homo Sapiens
IPSLMAERP

SEQ ID NO: 364717 - protein, 9 aa, Homo Sapiens
TRWTTNYDF

SEQ ID NO: 364718 - protein, 9 aa, Homo Sapiens
KATVIIMVT

SEQ ID NO: 364719 - protein, 9 aa, Homo Sapiens
SGMPPSSPS

SEQ ID NO: 364720 - protein, 9 aa, Homo Sapiens
RLVSGGSDC

SEQ ID NO: 364721 - protein, 9 aa, Homo Sapiens
LFLLVSLAM

SEQ ID NO: 364722 - protein, 9 aa, Homo Sapiens
LHLFPGKNC

SEQ ID NO: 364723 - protein, 9 aa, Homo Sapiens
VEFKMEEIM

SEQ ID NO: 364724 - protein, 9 aa, Homo Sapiens
QCLRVLDGA

SEQ ID NO: 364725 - protein, 9 aa, Homo Sapiens
ECMTTDINA

SEQ ID NO: 364726 - protein, 9 aa, Homo Sapiens
SSVLGAIPL

SEQ ID NO: 364727 - protein, 9 aa, Homo Sapiens
SSIVRDSLW

SEQ ID NO: 364728 - protein, 9 aa, Homo Sapiens
PAGCLRQRR

SEQ ID NO: 364729 - protein, 9 aa, Homo Sapiens
LHKLYLEIS

SEQ ID NO: 364730 - protein, 9 aa, Homo Sapiens
APRAGLAKI

SEQ ID NO: 364731 - protein, 9 aa, Homo Sapiens
PGDGVEGLR

SEQ ID NO: 364732 - protein, 9 aa, Homo Sapiens
GQISTLVLD

SEQ ID NO: 364733 - protein, 9 aa, Homo Sapiens
GSLADWPSN

SEQ ID NO: 364734 - protein, 9 aa, Homo Sapiens
KEIKTTSFW

SEQ ID NO: 364735 - protein, 9 aa, Homo Sapiens
PSRHVHHEK

SEQ ID NO: 364736 - protein, 9 aa, Homo Sapiens
WYTCSMTST

SEQ ID NO: 364737 - protein, 9 aa, Homo Sapiens
NRDLEKIIA

SEQ ID NO: 364738 - protein, 9 aa, Homo Sapiens
KKRIAIEYP

SEQ ID NO: 364739 - protein, 9 aa, Homo Sapiens
AVTNNCQKA

SEQ ID NO: 364740 - protein, 9 aa, Homo Sapiens
WRILPNFLK

SEQ ID NO: 364741 - protein, 9 aa, Homo Sapiens
AASMAAPGS

SEQ ID NO: 364742 - protein, 9 aa, Homo Sapiens
CTPPVAARA

SEQ ID NO: 364743 - protein, 9 aa, Homo Sapiens
RIYRPGLVI

SEQ ID NO: 364744 - protein, 9 aa, Homo Sapiens
ARLFTHFAE

SEQ ID NO: 364745 - protein, 9 aa, Homo Sapiens
PYNLATDDY

SEQ ID NO: 364746 - protein, 9 aa, Homo Sapiens
QYVICLQHR

SEQ ID NO: 364747 - protein, 9 aa, Homo Sapiens
FQHVKRGWV

SEQ ID NO: 364748 - protein, 9 aa, Homo Sapiens
SLSLSAQYG

SEQ ID NO: 364749 - protein, 9 aa, Homo Sapiens
PSGSPCVWT

SEQ ID NO: 364750 - protein, 9 aa, Homo Sapiens
KSQEEDQSI

SEQ ID NO: 364751 - protein, 9 aa, Homo Sapiens
LFRRLQLFM

SEQ ID NO: 364752 - protein, 9 aa, Homo Sapiens
VKFMLKTTR

SEQ ID NO: 364753 - protein, 9 aa, Homo Sapiens
DTLILVEVS

SEQ ID NO: 364754 - protein, 9 aa, Homo Sapiens
VLAGGGNGS

SEQ ID NO: 364755 - protein, 9 aa, Homo Sapiens
TPDRTHFPR

SEQ ID NO: 364756 - protein, 9 aa, Homo Sapiens
GTRLTTVSG

SEQ ID NO: 364757 - protein, 9 aa, Homo Sapiens
SRRRWSSPT

SEQ ID NO: 364758 - protein, 9 aa, Homo Sapiens
ALVHWLQES

SEQ ID NO: 364759 - protein, 9 aa, Homo Sapiens
VSHLLLLCN

SEQ ID NO: 364760 - protein, 9 aa, Homo Sapiens
DQVRLLPPT

SEQ ID NO: 364761 - protein, 9 aa, Homo Sapiens
TLRGPSPWA

SEQ ID NO: 364762 - protein, 9 aa, Homo Sapiens
VINMRVCGF

SEQ ID NO: 364763 - protein, 9 aa, Homo Sapiens
SWSHATTAS

SEQ ID NO: 364764 - protein, 9 aa, Homo Sapiens
VLEVDKRVV

SEQ ID NO: 364765 - protein, 9 aa, Homo Sapiens
PSRLWGWNA

SEQ ID NO: 364766 - protein, 9 aa, Homo Sapiens
AADGTPLLE

SEQ ID NO: 364767 - protein, 9 aa, Homo Sapiens
RPAARAPWR

SEQ ID NO: 364768 - protein, 9 aa, Homo Sapiens
FQHDKVEII

SEQ ID NO: 364769 - protein, 9 aa, Homo Sapiens
STWVWSRPP

SEQ ID NO: 364770 - protein, 9 aa, Homo Sapiens
PNRPNHSPH

SEQ ID NO: 364771 - protein, 9 aa, Homo Sapiens
ELVPALEGQ

SEQ ID NO: 364772 - protein, 9 aa, Homo Sapiens
EPSAACGPP

SEQ ID NO: 364773 - protein, 9 aa, Homo Sapiens
QATPKQAAQ

SEQ ID NO: 364774 - protein, 9 aa, Homo Sapiens
TSTWVWSRP

SEQ ID NO: 364775 - protein, 9 aa, Homo Sapiens
GRTPLTQTP

SEQ ID NO: 364776 - protein, 9 aa, Homo Sapiens
RILLQRNLL

SEQ ID NO: 364777 - protein, 9 aa, Homo Sapiens
QILFPCLRL

SEQ ID NO: 364778 - protein, 9 aa, Homo Sapiens
VISYLISLK

SEQ ID NO: 364779 - protein, 9 aa, Homo Sapiens
VDIHLLREE

SEQ ID NO: 364780 - protein, 9 aa, Homo Sapiens
DPRIHQHLA

SEQ ID NO: 364781 - protein, 9 aa, Homo Sapiens
REQTWLDPD

SEQ ID NO: 364782 - protein, 9 aa, Homo Sapiens
IIQKSSAKY

SEQ ID NO: 364783 - protein, 9 aa, Homo Sapiens
QTWLDPDPA

SEQ ID NO: 364784 - protein, 9 aa, Homo Sapiens
GCGKSFNRS

SEQ ID NO: 364785 - protein, 9 aa, Homo Sapiens
AIYEVLRNS

SEQ ID NO: 364786 - protein, 9 aa, Homo Sapiens
CPVPFCASW

SEQ ID NO: 364787 - protein, 9 aa, Homo Sapiens
EGRLLYHAM

SEQ ID NO: 364788 - protein, 9 aa, Homo Sapiens
GGSDCQVKV

SEQ ID NO: 364789 - protein, 9 aa, Homo Sapiens
DPGGVGEHG

SEQ ID NO: 364790 - protein, 9 aa, Homo Sapiens
EILSTEWDY

SEQ ID NO: 364791 - protein, 9 aa, Homo Sapiens
DRTPPEPAV

SEQ ID NO: 364792 - protein, 9 aa, Homo Sapiens
GNAQCCDCW

SEQ ID NO: 364793 - protein, 9 aa, Homo Sapiens
SGLELAITF

SEQ ID NO: 364794 - protein, 9 aa, Homo Sapiens
ELSCLAKEG

SEQ ID NO: 364795 - protein, 9 aa, Homo Sapiens
RPWKTSCTT

SEQ ID NO: 364796 - protein, 9 aa, Homo Sapiens
KTRFLPTGG

SEQ ID NO: 364797 - protein, 9 aa, Homo Sapiens
EHKPLGTAP

SEQ ID NO: 364798 - protein, 9 aa, Homo Sapiens
DLSAPEKDN

SEQ ID NO: 364799 - protein, 9 aa, Homo Sapiens
GDGRSASWP

SEQ ID NO: 364800 - protein, 9 aa, Homo Sapiens
VRVKMDATR

SEQ ID NO: 364801 - protein, 9 aa, Homo Sapiens
EGEELVVPE

SEQ ID NO: 364802 - protein, 9 aa, Homo Sapiens
FIILEKKTH

SEQ ID NO: 364803 - protein, 9 aa, Homo Sapiens
SPLMATDVK

SEQ ID NO: 364804 - protein, 9 aa, Homo Sapiens
GLNPFIYSQ

SEQ ID NO: 364805 - protein, 9 aa, Homo Sapiens
HTPQHPRCS

SEQ ID NO: 364806 - protein, 9 aa, Homo Sapiens
LRHRKNESL

SEQ ID NO: 364807 - protein, 9 aa, Homo Sapiens
PLPGPILRT

SEQ ID NO: 364808 - protein, 9 aa, Homo Sapiens
SRWHSDDDD

SEQ ID NO: 364809 - protein, 9 aa, Homo Sapiens
TLLKTRCLM

SEQ ID NO: 364810 - protein, 9 aa, Homo Sapiens
INEILSTEW

SEQ ID NO: 364811 - protein, 9 aa, Homo Sapiens
ASITNMSLD

SEQ ID NO: 364812 - protein, 9 aa, Homo Sapiens
LQLLEGMDH

SEQ ID NO: 364813 - protein, 9 aa, Homo Sapiens
STGMKSKES

SEQ ID NO: 364814 - protein, 9 aa, Homo Sapiens
IQYVICLQH

SEQ ID NO: 364815 - protein, 9 aa, Homo Sapiens
NILIMTGDE

SEQ ID NO: 364816 - protein, 9 aa, Homo Sapiens
SPTRWTTNY

SEQ ID NO: 364817 - protein, 9 aa, Homo Sapiens
GEPVGPGQQ

SEQ ID NO: 364818 - protein, 9 aa, Homo Sapiens
ALTMPELTQ

SEQ ID NO: 364819 - protein, 9 aa, Homo Sapiens
RFLVASADR

SEQ ID NO: 364820 - protein, 9 aa, Homo Sapiens
QEAARTCSR

SEQ ID NO: 364821 - protein, 9 aa, Homo Sapiens
NRNAHLVRH

SEQ ID NO: 364822 - protein, 9 aa, Homo Sapiens
KESSPIEPR

SEQ ID NO: 364823 - protein, 9 aa, Homo Sapiens
TDGFAGIKK

SEQ ID NO: 364824 - protein, 9 aa, Homo Sapiens
SEAAAEDDI

SEQ ID NO: 364825 - protein, 9 aa, Homo Sapiens
LSTIVAGST

SEQ ID NO: 364826 - protein, 9 aa, Homo Sapiens
HMTSRDIKV

SEQ ID NO: 364827 - protein, 9 aa, Homo Sapiens
KTTPKPKPS

SEQ ID NO: 364828 - protein, 9 aa, Homo Sapiens
LRDGCMLIK

SEQ ID NO: 364829 - protein, 9 aa, Homo Sapiens
QHHLQALLS

SEQ ID NO: 364830 - protein, 9 aa, Homo Sapiens
SVYLTKGHS

SEQ ID NO: 364831 - protein, 9 aa, Homo Sapiens
PASSSLVTV

SEQ ID NO: 364832 - protein, 9 aa, Homo Sapiens
VLSTSSFCC

SEQ ID NO: 364833 - protein, 9 aa, Homo Sapiens
APPPAGCLR

SEQ ID NO: 364834 - protein, 9 aa, Homo Sapiens
GKITDMLLE

SEQ ID NO: 364835 - protein, 9 aa, Homo Sapiens
HLQAKIKAV

SEQ ID NO: 364836 - protein, 9 aa, Homo Sapiens
DCTRPRLTW

SEQ ID NO: 364837 - protein, 9 aa, Homo Sapiens
SWQSSTLAH

SEQ ID NO: 364838 - protein, 9 aa, Homo Sapiens
QVVAVFEGR

SEQ ID NO: 364839 - protein, 9 aa, Homo Sapiens
LRTLRCPRE

SEQ ID NO: 364840 - protein, 9 aa, Homo Sapiens
GGCLLTVER

SEQ ID NO: 364841 - protein, 9 aa, Homo Sapiens
SSSHTGTLC

SEQ ID NO: 364842 - protein, 9 aa, Homo Sapiens
CSMTSTWVW

SEQ ID NO: 364843 - protein, 9 aa, Homo Sapiens
CDKKRGASS

SEQ ID NO: 364844 - protein, 9 aa, Homo Sapiens
YLQYTDWPD

SEQ ID NO: 364845 - protein, 9 aa, Homo Sapiens
EKGSLHQTY

SEQ ID NO: 364846 - protein, 9 aa, Homo Sapiens
CLCLVLLAM

SEQ ID NO: 364847 - protein, 9 aa, Homo Sapiens
RGQGGDAAA

SEQ ID NO: 364848 - protein, 9 aa, Homo Sapiens
SIVSGALER

SEQ ID NO: 364849 - protein, 9 aa, Homo Sapiens
SFNGSWMVQ

SEQ ID NO: 364850 - protein, 9 aa, Homo Sapiens
GSTVPHAAT

SEQ ID NO: 364851 - protein, 9 aa, Homo Sapiens
PTQTSHYLR

SEQ ID NO: 364852 - protein, 9 aa, Homo Sapiens
VLGGRMGFI

SEQ ID NO: 364853 - protein, 9 aa, Homo Sapiens
SQPRAPACG

SEQ ID NO: 364854 - protein, 9 aa, Homo Sapiens
TEQAQRDLS

SEQ ID NO: 364855 - protein, 9 aa, Homo Sapiens
KDKMIHQKL

SEQ ID NO: 364856 - protein, 9 aa, Homo Sapiens
FLPPRLKKI

SEQ ID NO: 364857 - protein, 9 aa, Homo Sapiens
APPGMQGDK

SEQ ID NO: 364858 - protein, 9 aa, Homo Sapiens
VVLLLQPSM

SEQ ID NO: 364859 - protein, 9 aa, Homo Sapiens
HPLPGPILR

SEQ ID NO: 364860 - protein, 9 aa, Homo Sapiens
STTRTMKSH

SEQ ID NO: 364861 - protein, 9 aa, Homo Sapiens
EMCEKLKGL

SEQ ID NO: 364862 - protein, 9 aa, Homo Sapiens
IKVQGFRIP

SEQ ID NO: 364863 - protein, 9 aa, Homo Sapiens
FNSMMMECM

SEQ ID NO: 364864 - protein, 9 aa, Homo Sapiens
GKPPTSPAT

SEQ ID NO: 364865 - protein, 9 aa, Homo Sapiens
SARPITPRL

SEQ ID NO: 364866 - protein, 9 aa, Homo Sapiens
VNGTFGEIM

SEQ ID NO: 364867 - protein, 9 aa, Homo Sapiens
ACYVEVCVW

SEQ ID NO: 364868 - protein, 9 aa, Homo Sapiens
TEKSRWSGS

SEQ ID NO: 364869 - protein, 9 aa, Homo Sapiens
RRNPRAKQP

SEQ ID NO: 364870 - protein, 9 aa, Homo Sapiens
REEHMERKR

SEQ ID NO: 364871 - protein, 9 aa, Homo Sapiens
KQLSCSTKK

SEQ ID NO: 364872 - protein, 9 aa, Homo Sapiens
SSARSRRRW

SEQ ID NO: 364873 - protein, 9 aa, Homo Sapiens
HDGKEHHFM

SEQ ID NO: 364874 - protein, 9 aa, Homo Sapiens
IHAASLKLP

SEQ ID NO: 364875 - protein, 9 aa, Homo Sapiens
HHIGREPML

SEQ ID NO: 364876 - protein, 9 aa, Homo Sapiens
LRGPSPWAS

SEQ ID NO: 364877 - protein, 9 aa, Homo Sapiens
VCAHFPASS

SEQ ID NO: 364878 - protein, 9 aa, Homo Sapiens
AREPSAACG

SEQ ID NO: 364879 - protein, 9 aa, Homo Sapiens
PTHRFQPLS

SEQ ID NO: 364880 - protein, 9 aa, Homo Sapiens
SEEEGETER

SEQ ID NO: 364881 - protein, 9 aa, Homo Sapiens
MVDVVVENS

SEQ ID NO: 364882 - protein, 9 aa, Homo Sapiens
KTRSWQSST

SEQ ID NO: 364883 - protein, 9 aa, Homo Sapiens
LTAGTSSKI

SEQ ID NO: 364884 - protein, 9 aa, Homo Sapiens
MSLDRSGSP

SEQ ID NO: 364885 - protein, 9 aa, Homo Sapiens
IKILKNHPP

SEQ ID NO: 364886 - protein, 9 aa, Homo Sapiens
CWPPWPRLA

SEQ ID NO: 364887 - protein, 9 aa, Homo Sapiens
FNNFRLQVG

SEQ ID NO: 364888 - protein, 9 aa, Homo Sapiens
NLARQMITK

SEQ ID NO: 364889 - protein, 9 aa, Homo Sapiens
SGGACSMGP

SEQ ID NO: 364890 - protein, 9 aa, Homo Sapiens
ACSITVSFV

SEQ ID NO: 364891 - protein, 9 aa, Homo Sapiens
IGSAGTEIA

SEQ ID NO: 364892 - protein, 9 aa, Homo Sapiens
AFGYFQQDI

SEQ ID NO: 364893 - protein, 9 aa, Homo Sapiens
AHLAHQQCL

SEQ ID NO: 364894 - protein, 9 aa, Homo Sapiens
GPSCRGPLP

SEQ ID NO: 364895 - protein, 9 aa, Homo Sapiens
DNFFAYLTL

SEQ ID NO: 364896 - protein, 9 aa, Homo Sapiens
HPDMYERVV

SEQ ID NO: 364897 - protein, 9 aa, Homo Sapiens
LQHFYIIGQ

SEQ ID NO: 364898 - protein, 9 aa, Homo Sapiens
DYFVDCPVP

SEQ ID NO: 364899 - protein, 9 aa, Homo Sapiens
WWLPERRCS

SEQ ID NO: 364900 - protein, 9 aa, Homo Sapiens
LLLLCNLSP

SEQ ID NO: 364901 - protein, 9 aa, Homo Sapiens
DLSPVYDLL

SEQ ID NO: 364902 - protein, 9 aa, Homo Sapiens
TQDKACISQ

SEQ ID NO: 364903 - protein, 9 aa, Homo Sapiens
VSTGRPQHS

SEQ ID NO: 364904 - protein, 9 aa, Homo Sapiens
ARLALRAWW

SEQ ID NO: 364905 - protein, 9 aa, Homo Sapiens
TGAGQPGQP

SEQ ID NO: 364906 - protein, 9 aa, Homo Sapiens
DCIMNTFSV

SEQ ID NO: 364907 - protein, 9 aa, Homo Sapiens
RSSTNARSA

SEQ ID NO: 364908 - protein, 9 aa, Homo Sapiens
GREPMLCKV

SEQ ID NO: 364909 - protein, 9 aa, Homo Sapiens
SIDRNMGEI

SEQ ID NO: 364910 - protein, 9 aa, Homo Sapiens
VISYAHNVA

SEQ ID NO: 364911 - protein, 9 aa, Homo Sapiens
SAAGDWDID

SEQ ID NO: 364912 - protein, 9 aa, Homo Sapiens
ENFSTLHQR

SEQ ID NO: 364913 - protein, 9 aa, Homo Sapiens
FIGNWILKQ

SEQ ID NO: 364914 - protein, 9 aa, Homo Sapiens
KRVMDQARE

SEQ ID NO: 364915 - protein, 9 aa, Homo Sapiens
PEGWRSPCT

SEQ ID NO: 364916 - protein, 9 aa, Homo Sapiens
LHQLATSYF

SEQ ID NO: 364917 - protein, 9 aa, Homo Sapiens
KSMDRVYDK

SEQ ID NO: 364918 - protein, 9 aa, Homo Sapiens
EKLFECKGC

SEQ ID NO: 364919 - protein, 9 aa, Homo Sapiens
LPIFNRISF

SEQ ID NO: 364920 - protein, 9 aa, Homo Sapiens
QRSHFQHVK

SEQ ID NO: 364921 - protein, 9 aa, Homo Sapiens
GPLGARRTA

SEQ ID NO: 364922 - protein, 9 aa, Homo Sapiens
KIKAVQYQV

SEQ ID NO: 364923 - protein, 9 aa, Homo Sapiens
VYLPLYHEI

SEQ ID NO: 364924 - protein, 9 aa, Homo Sapiens
NFGLIFLTF

SEQ ID NO: 364925 - protein, 9 aa, Homo Sapiens
VVASMDKWK

SEQ ID NO: 364926 - protein, 9 aa, Homo Sapiens
GSSDSSSDS

SEQ ID NO: 364927 - protein, 9 aa, Homo Sapiens
MWTYREEPE

SEQ ID NO: 364928 - protein, 9 aa, Homo Sapiens
RRPPEKRFG

SEQ ID NO: 364929 - protein, 9 aa, Homo Sapiens
VGCGMSSLT

SEQ ID NO: 364930 - protein, 9 aa, Homo Sapiens
PVAFFFSGW

SEQ ID NO: 364931 - protein, 9 aa, Homo Sapiens
RGLVDGWRG

SEQ ID NO: 364932 - protein, 9 aa, Homo Sapiens
RVVLRKPQQ

SEQ ID NO: 364933 - protein, 9 aa, Homo Sapiens
GTEAGGARE

SEQ ID NO: 364934 - protein, 9 aa, Homo Sapiens
WEDGFETEL

SEQ ID NO: 364935 - protein, 9 aa, Homo Sapiens
FNLKMSLMS

SEQ ID NO: 364936 - protein, 9 aa, Homo Sapiens
SGVHCTGTE

SEQ ID NO: 364937 - protein, 9 aa, Homo Sapiens
FDVPGLPDS

SEQ ID NO: 364938 - protein, 9 aa, Homo Sapiens
HRHTHTGEK

SEQ ID NO: 364939 - protein, 9 aa, Homo Sapiens
LGAVQSDTC

SEQ ID NO: 364940 - protein, 9 aa, Homo Sapiens
HLAHQQCLQ

SEQ ID NO: 364941 - protein, 9 aa, Homo Sapiens
DQGGAAQLN

SEQ ID NO: 364942 - protein, 9 aa, Homo Sapiens
RWQGLTLGA

SEQ ID NO: 364943 - protein, 9 aa, Homo Sapiens
QSDTCRSVL

SEQ ID NO: 364944 - protein, 9 aa, Homo Sapiens
LIEFSPLMA

SEQ ID NO: 364945 - protein, 9 aa, Homo Sapiens
VPPIFTGRP

SEQ ID NO: 364946 - protein, 9 aa, Homo Sapiens
PWGMEALGS

SEQ ID NO: 364947 - protein, 9 aa, Homo Sapiens
CEGPKLPTK

SEQ ID NO: 364948 - protein, 9 aa, Homo Sapiens
AAGIPSIAA

SEQ ID NO: 364949 - protein, 9 aa, Homo Sapiens
DETVDSSGP

SEQ ID NO: 364950 - protein, 9 aa, Homo Sapiens
LVLLAMLGC

SEQ ID NO: 364951 - protein, 9 aa, Homo Sapiens
AHQLKTRSW

SEQ ID NO: 364952 - protein, 9 aa, Homo Sapiens
TDEDRQEIR

SEQ ID NO: 364953 - protein, 9 aa, Homo Sapiens
SGAGTGTAS

SEQ ID NO: 364954 - protein, 9 aa, Homo Sapiens
GRSSTNARS

SEQ ID NO: 364955 - protein, 9 aa, Homo Sapiens
LCQLFVPYC

SEQ ID NO: 364956 - protein, 9 aa, Homo Sapiens
LLTDQLSSQ

SEQ ID NO: 364957 - protein, 9 aa, Homo Sapiens
PPPGSSARP

SEQ ID NO: 364958 - protein, 9 aa, Homo Sapiens
RYLGDLTLL

SEQ ID NO: 364959 - protein, 9 aa, Homo Sapiens
SLADIIKYL

SEQ ID NO: 364960 - protein, 9 aa, Homo Sapiens
RRSPASAPT

SEQ ID NO: 364961 - protein, 9 aa, Homo Sapiens
SALGGGAPR

SEQ ID NO: 364962 - protein, 9 aa, Homo Sapiens
TATSDGKHY

SEQ ID NO: 364963 - protein, 9 aa, Homo Sapiens
VAGSTVGPS

SEQ ID NO: 364964 - protein, 9 aa, Homo Sapiens
MVTEPPDVY

SEQ ID NO: 364965 - protein, 9 aa, Homo Sapiens
SQEEDQSII

SEQ ID NO: 364966 - protein, 9 aa, Homo Sapiens
PPDLESLTI

SEQ ID NO: 364967 - protein, 9 aa, Homo Sapiens
LGCFTLLWC

SEQ ID NO: 364968 - protein, 9 aa, Homo Sapiens
QELSINSYT

SEQ ID NO: 364969 - protein, 9 aa, Homo Sapiens
FGKKLAHLT

SEQ ID NO: 364970 - protein, 9 aa, Homo Sapiens
SSSLCWNLS

SEQ ID NO: 364971 - protein, 9 aa, Homo Sapiens
YLVEKDATK

SEQ ID NO: 364972 - protein, 9 aa, Homo Sapiens
SGQKRPFKK

SEQ ID NO: 364973 - protein, 9 aa, Homo Sapiens
WQGCSAKSK

SEQ ID NO: 364974 - protein, 9 aa, Homo Sapiens
WSTWLSLWS

SEQ ID NO: 364975 - protein, 9 aa, Homo Sapiens
RLFTHFAEA

SEQ ID NO: 364976 - protein, 9 aa, Homo Sapiens
VTFEKHGEH

SEQ ID NO: 364977 - protein, 9 aa, Homo Sapiens
AATRPEGWR

SEQ ID NO: 364978 - protein, 9 aa, Homo Sapiens
LYLRPHKTA

SEQ ID NO: 364979 - protein, 9 aa, Homo Sapiens
KADMFKWQI

SEQ ID NO: 364980 - protein, 9 aa, Homo Sapiens
LKTTRVNTS

SEQ ID NO: 364981 - protein, 9 aa, Homo Sapiens
ERRCSRRAG

SEQ ID NO: 364982 - protein, 9 aa, Homo Sapiens
QAKIKAVQY

SEQ ID NO: 364983 - protein, 9 aa, Homo Sapiens
FPDDMDLRV

SEQ ID NO: 364984 - protein, 9 aa, Homo Sapiens
DLSSQSPPS

SEQ ID NO: 364985 - protein, 9 aa, Homo Sapiens
PTPVTKAMP

SEQ ID NO: 364986 - protein, 9 aa, Homo Sapiens
PSPNWRISN

SEQ ID NO: 364987 - protein, 9 aa, Homo Sapiens
RWTAMGGQA

SEQ ID NO: 364988 - protein, 9 aa, Homo Sapiens
LSPGVVTDL

SEQ ID NO: 364989 - protein, 9 aa, Homo Sapiens
TWDMACRNI

SEQ ID NO: 364990 - protein, 9 aa, Homo Sapiens
PYPCHDCGT

SEQ ID NO: 364991 - protein, 9 aa, Homo Sapiens
LALVHWLQE

SEQ ID NO: 364992 - protein, 9 aa, Homo Sapiens
AVADIIPQV

SEQ ID NO: 364993 - protein, 9 aa, Homo Sapiens
VILCLFVFF

SEQ ID NO: 364994 - protein, 9 aa, Homo Sapiens
PRHFGPAPP

SEQ ID NO: 364995 - protein, 9 aa, Homo Sapiens
RLQLFMHLR

SEQ ID NO: 364996 - protein, 9 aa, Homo Sapiens
SVLGAIPLS

SEQ ID NO: 364997 - protein, 9 aa, Homo Sapiens
QVNLHPDVA

SEQ ID NO: 364998 - protein, 9 aa, Homo Sapiens
GSSGSGRAR

SEQ ID NO: 364999 - protein, 9 aa, Homo Sapiens
FLCQLFVPY

SEQ ID NO: 365000 - protein, 9 aa, Homo Sapiens
HAHPYQHLQ

SEQ ID NO: 365001 - protein, 9 aa, Homo Sapiens
TMKSHQAVS

SEQ ID NO: 365002 - protein, 9 aa, Homo Sapiens
AIEYPYSVK

SEQ ID NO: 365003 - protein, 9 aa, Homo Sapiens
ETGLLPECF

SEQ ID NO: 365004 - protein, 9 aa, Homo Sapiens
EWCRHRALE

SEQ ID NO: 365005 - protein, 9 aa, Homo Sapiens
PVVLGLRSV

SEQ ID NO: 365006 - protein, 9 aa, Homo Sapiens
SPFGSCWPP

SEQ ID NO: 365007 - protein, 9 aa, Homo Sapiens
RCTCARRTP

SEQ ID NO: 365008 - protein, 9 aa, Homo Sapiens
WVYYSTANF

SEQ ID NO: 365009 - protein, 9 aa, Homo Sapiens
KEPQNIRRN

SEQ ID NO: 365010 - protein, 9 aa, Homo Sapiens
QVPQPPQPQ

SEQ ID NO: 365011 - protein, 9 aa, Homo Sapiens
DARRTVTET

SEQ ID NO: 365012 - protein, 9 aa, Homo Sapiens
RDSAADFSH

SEQ ID NO: 365013 - protein, 9 aa, Homo Sapiens
NVDVCVVRG

SEQ ID NO: 365014 - protein, 9 aa, Homo Sapiens
QTTDAIFAR

SEQ ID NO: 365015 - protein, 9 aa, Homo Sapiens
AKQLLAVGA

SEQ ID NO: 365016 - protein, 9 aa, Homo Sapiens
EIMKKAAEV

SEQ ID NO: 365017 - protein, 9 aa, Homo Sapiens
TVIIMVTRC

SEQ ID NO: 365018 - protein, 9 aa, Homo Sapiens
CLGSQTDGF

SEQ ID NO: 365019 - protein, 9 aa, Homo Sapiens
NMIQVLMSV

SEQ ID NO: 365020 - protein, 9 aa, Homo Sapiens
KERESYDNR

SEQ ID NO: 365021 - protein, 9 aa, Homo Sapiens
VTEEAKNGE

SEQ ID NO: 365022 - protein, 9 aa, Homo Sapiens
ACVFMTTFR

SEQ ID NO: 365023 - protein, 9 aa, Homo Sapiens
ELSINSYTD

SEQ ID NO: 365024 - protein, 9 aa, Homo Sapiens
TCHLLGEVQ

SEQ ID NO: 365025 - protein, 9 aa, Homo Sapiens
LGPLFNNSS

SEQ ID NO: 365026 - protein, 9 aa, Homo Sapiens
PGPPPACRT

SEQ ID NO: 365027 - protein, 9 aa, Homo Sapiens
LHHVNQAVC

SEQ ID NO: 365028 - protein, 9 aa, Homo Sapiens
QLEKDKMIH

SEQ ID NO: 365029 - protein, 9 aa, Homo Sapiens
FVPNTPTAR

SEQ ID NO: 365030 - protein, 9 aa, Homo Sapiens
VWTLYANLF

SEQ ID NO: 365031 - protein, 9 aa, Homo Sapiens
PQIGVNIRK

SEQ ID NO: 365032 - protein, 9 aa, Homo Sapiens
DCWEPAPEW

SEQ ID NO: 365033 - protein, 9 aa, Homo Sapiens
DAAAAGFPS

SEQ ID NO: 365034 - protein, 9 aa, Homo Sapiens
LSRPGSGPP

SEQ ID NO: 365035 - protein, 9 aa, Homo Sapiens
KPLKKKKTR

SEQ ID NO: 365036 - protein, 9 aa, Homo Sapiens
YHDTLYFPV

SEQ ID NO: 365037 - protein, 9 aa, Homo Sapiens
RPPWAARSW

SEQ ID NO: 365038 - protein, 9 aa, Homo Sapiens
LAKTWVRYV

SEQ ID NO: 365039 - protein, 9 aa, Homo Sapiens
LNKLEEQLW

SEQ ID NO: 365040 - protein, 9 aa, Homo Sapiens
KHRTKSAEE

SEQ ID NO: 365041 - protein, 9 aa, Homo Sapiens
RVDCGPGEG

SEQ ID NO: 365042 - protein, 9 aa, Homo Sapiens
TFTLVTRGT

SEQ ID NO: 365043 - protein, 9 aa, Homo Sapiens
REDPRIHQH

SEQ ID NO: 365044 - protein, 9 aa, Homo Sapiens
TSMESFPPL

SEQ ID NO: 365045 - protein, 9 aa, Homo Sapiens
RERIPPQRA

SEQ ID NO: 365046 - protein, 9 aa, Homo Sapiens
PRIWVLFED

SEQ ID NO: 365047 - protein, 9 aa, Homo Sapiens
TQRKKLPWK

SEQ ID NO: 365048 - protein, 9 aa, Homo Sapiens
FILERNPTN

SEQ ID NO: 365049 - protein, 9 aa, Homo Sapiens
SARRTQMTS

SEQ ID NO: 365050 - protein, 9 aa, Homo Sapiens
GLRGQGGDA

SEQ ID NO: 365051 - protein, 9 aa, Homo Sapiens
SLQVPQNAA

SEQ ID NO: 365052 - protein, 9 aa, Homo Sapiens
DAAAGAALG

SEQ ID NO: 365053 - protein, 9 aa, Homo Sapiens
KEKASHGFL

SEQ ID NO: 365054 - protein, 9 aa, Homo Sapiens
WQRGLQVPQ

SEQ ID NO: 365055 - protein, 9 aa, Homo Sapiens
QAATTLLSD

SEQ ID NO: 365056 - protein, 9 aa, Homo Sapiens
CQLFVPYCI

SEQ ID NO: 365057 - protein, 9 aa, Homo Sapiens
VTAPPSAPG

SEQ ID NO: 365058 - protein, 9 aa, Homo Sapiens
QTPSPVSGS

SEQ ID NO: 365059 - protein, 9 aa, Homo Sapiens
LRIPSASRC

SEQ ID NO: 365060 - protein, 9 aa, Homo Sapiens
RCLLDRSFA

SEQ ID NO: 365061 - protein, 9 aa, Homo Sapiens
WPQGAPPSH

SEQ ID NO: 365062 - protein, 9 aa, Homo Sapiens
TDQLSSQLD

SEQ ID NO: 365063 - protein, 9 aa, Homo Sapiens
RLGPCIGPV

SEQ ID NO: 365064 - protein, 9 aa, Homo Sapiens
GEQFTVLET

SEQ ID NO: 365065 - protein, 9 aa, Homo Sapiens
LFCVCAVGA

SEQ ID NO: 365066 - protein, 9 aa, Homo Sapiens
PWLWRSCLW

SEQ ID NO: 365067 - protein, 9 aa, Homo Sapiens
HTFVTSSFP

SEQ ID NO: 365068 - protein, 9 aa, Homo Sapiens
AHVYLPLYH

SEQ ID NO: 365069 - protein, 9 aa, Homo Sapiens
AEYILKNLQ

SEQ ID NO: 365070 - protein, 9 aa, Homo Sapiens
QERAVEDVA

SEQ ID NO: 365071 - protein, 9 aa, Homo Sapiens
AAGTNYSQM

SEQ ID NO: 365072 - protein, 9 aa, Homo Sapiens
SEENLVDLQ

SEQ ID NO: 365073 - protein, 9 aa, Homo Sapiens
KNHPPMPDK

SEQ ID NO: 365074 - protein, 9 aa, Homo Sapiens
GEDDLMPVC

SEQ ID NO: 365075 - protein, 9 aa, Homo Sapiens
RIVSRNGCD

SEQ ID NO: 365076 - protein, 9 aa, Homo Sapiens
LKADMFKWQ

SEQ ID NO: 365077 - protein, 9 aa, Homo Sapiens
GTWRILPNF

SEQ ID NO: 365078 - protein, 9 aa, Homo Sapiens
ETQAQPGRW

SEQ ID NO: 365079 - protein, 9 aa, Homo Sapiens
PGCKRRRTH

SEQ ID NO: 365080 - protein, 9 aa, Homo Sapiens
YCCIVQHVG

SEQ ID NO: 365081 - protein, 9 aa, Homo Sapiens
SGRTPLTQT

SEQ ID NO: 365082 - protein, 9 aa, Homo Sapiens
SQEDKKIQD

SEQ ID NO: 365083 - protein, 9 aa, Homo Sapiens
QGLSGLMAP

SEQ ID NO: 365084 - protein, 9 aa, Homo Sapiens
GKKLVKISE

SEQ ID NO: 365085 - protein, 9 aa, Homo Sapiens
PPPAPVLLE

SEQ ID NO: 365086 - protein, 9 aa, Homo Sapiens
TTRVNTSLF

SEQ ID NO: 365087 - protein, 9 aa, Homo Sapiens
QDNRSLGAL

SEQ ID NO: 365088 - protein, 9 aa, Homo Sapiens
SEGNTDTPV

SEQ ID NO: 365089 - protein, 9 aa, Homo Sapiens
SQLQFSEHV

SEQ ID NO: 365090 - protein, 9 aa, Homo Sapiens
TKWQKHHPQ

SEQ ID NO: 365091 - protein, 9 aa, Homo Sapiens
GKRRRRNPR

SEQ ID NO: 365092 - protein, 9 aa, Homo Sapiens
WAMELKPTV

SEQ ID NO: 365093 - protein, 9 aa, Homo Sapiens
LHGRVPVGQ

SEQ ID NO: 365094 - protein, 9 aa, Homo Sapiens
PGSSARPIT

SEQ ID NO: 365095 - protein, 9 aa, Homo Sapiens
VICSLADII

SEQ ID NO: 365096 - protein, 9 aa, Homo Sapiens
AAADPLLRT

SEQ ID NO: 365097 - protein, 9 aa, Homo Sapiens
SNDAHDKKA

SEQ ID NO: 365098 - protein, 9 aa, Homo Sapiens
PTIGSIMGS

SEQ ID NO: 365099 - protein, 9 aa, Homo Sapiens
RRDPSGSPC

SEQ ID NO: 365100 - protein, 9 aa, Homo Sapiens
HAATASPTR

SEQ ID NO: 365101 - protein, 9 aa, Homo Sapiens
NCPAALHQL

SEQ ID NO: 365102 - protein, 9 aa, Homo Sapiens
IICILGHVD

SEQ ID NO: 365103 - protein, 9 aa, Homo Sapiens
KRRRTHTNF

SEQ ID NO: 365104 - protein, 9 aa, Homo Sapiens
FARRAISTF

SEQ ID NO: 365105 - protein, 9 aa, Homo Sapiens
EIQLTMNDS

SEQ ID NO: 365106 - protein, 9 aa, Homo Sapiens
LSPWLTGLL

SEQ ID NO: 365107 - protein, 9 aa, Homo Sapiens
HALQPSMTV

SEQ ID NO: 365108 - protein, 9 aa, Homo Sapiens
WYNFTPLAW

SEQ ID NO: 365109 - protein, 9 aa, Homo Sapiens
SKNGFIFGH

SEQ ID NO: 365110 - protein, 9 aa, Homo Sapiens
AFLCGPRHS

SEQ ID NO: 365111 - protein, 9 aa, Homo Sapiens
FERIMQRFS

SEQ ID NO: 365112 - protein, 9 aa, Homo Sapiens
HCTGTELSL

SEQ ID NO: 365113 - protein, 9 aa, Homo Sapiens
GPAPPSQGR

SEQ ID NO: 365114 - protein, 9 aa, Homo Sapiens
HSFFVDNPF

SEQ ID NO: 365115 - protein, 9 aa, Homo Sapiens
CRCYIRRLR

SEQ ID NO: 365116 - protein, 9 aa, Homo Sapiens
GSVQLHYSI

SEQ ID NO: 365117 - protein, 9 aa, Homo Sapiens
SPSHIRHGS

SEQ ID NO: 365118 - protein, 9 aa, Homo Sapiens
WSHATTASR

SEQ ID NO: 365119 - protein, 9 aa, Homo Sapiens
FLLTSTSDR

SEQ ID NO: 365120 - protein, 9 aa, Homo Sapiens
IIECRVFKT

SEQ ID NO: 365121 - protein, 9 aa, Homo Sapiens
TSRTRETLE

SEQ ID NO: 365122 - protein, 9 aa, Homo Sapiens
MKVYVDPID

SEQ ID NO: 365123 - protein, 9 aa, Homo Sapiens
DLDLNPLMF

SEQ ID NO: 365124 - protein, 9 aa, Homo Sapiens
DQLSSQLDD

SEQ ID NO: 365125 - protein, 9 aa, Homo Sapiens
TWRTSRTRE

SEQ ID NO: 365126 - protein, 9 aa, Homo Sapiens
RFAFSTRLA

SEQ ID NO: 365127 - protein, 9 aa, Homo Sapiens
NPFQKECFH

SEQ ID NO: 365128 - protein, 9 aa, Homo Sapiens
RRVDCGPGE

SEQ ID NO: 365129 - protein, 9 aa, Homo Sapiens
LCLRRAQDH

SEQ ID NO: 365130 - protein, 9 aa, Homo Sapiens
LTPGCRSLF

SEQ ID NO: 365131 - protein, 9 aa, Homo Sapiens
GAEREHHSC

SEQ ID NO: 365132 - protein, 9 aa, Homo Sapiens
ACVLLSQCR

SEQ ID NO: 365133 - protein, 9 aa, Homo Sapiens
RASGRMHPC

SEQ ID NO: 365134 - protein, 9 aa, Homo Sapiens
PHPNGATSS

SEQ ID NO: 365135 - protein, 9 aa, Homo Sapiens
GLERVPVAP

SEQ ID NO: 365136 - protein, 9 aa, Homo Sapiens
LTITEHVPL

SEQ ID NO: 365137 - protein, 9 aa, Homo Sapiens
AGDGRSASW

SEQ ID NO: 365138 - protein, 9 aa, Homo Sapiens
VVCGALHVP

SEQ ID NO: 365139 - protein, 9 aa, Homo Sapiens
CILGLPGGL

SEQ ID NO: 365140 - protein, 9 aa, Homo Sapiens
EYKICIDMP

SEQ ID NO: 365141 - protein, 9 aa, Homo Sapiens
GSPEPPPAH

SEQ ID NO: 365142 - protein, 9 aa, Homo Sapiens
KVDIHLLRE

SEQ ID NO: 365143 - protein, 9 aa, Homo Sapiens
KDGLEKEKK

SEQ ID NO: 365144 - protein, 9 aa, Homo Sapiens
INVKTSESW

SEQ ID NO: 365145 - protein, 9 aa, Homo Sapiens
GGTQINFTM

SEQ ID NO: 365146 - protein, 9 aa, Homo Sapiens
VGQVPQVLE

SEQ ID NO: 365147 - protein, 9 aa, Homo Sapiens
CMLIKLLEV

SEQ ID NO: 365148 - protein, 9 aa, Homo Sapiens
PAPTPRTAS

SEQ ID NO: 365149 - protein, 9 aa, Homo Sapiens
DEPVKAKNG

SEQ ID NO: 365150 - protein, 9 aa, Homo Sapiens
VQRCPACRM

SEQ ID NO: 365151 - protein, 9 aa, Homo Sapiens
LERYASCRS

SEQ ID NO: 365152 - protein, 9 aa, Homo Sapiens
DAYCLSVSR

SEQ ID NO: 365153 - protein, 9 aa, Homo Sapiens
TKEASVDLK

SEQ ID NO: 365154 - protein, 9 aa, Homo Sapiens
PACASTSRS

SEQ ID NO: 365155 - protein, 9 aa, Homo Sapiens
LKFIGNWIL

SEQ ID NO: 365156 - protein, 9 aa, Homo Sapiens
AQQKIFDIR

SEQ ID NO: 365157 - protein, 9 aa, Homo Sapiens
SAAVTQCRP

SEQ ID NO: 365158 - protein, 9 aa, Homo Sapiens
WIYCVDPTR

SEQ ID NO: 365159 - protein, 9 aa, Homo Sapiens
HIQEEKKIK

SEQ ID NO: 365160 - protein, 9 aa, Homo Sapiens
GTSIAFSTS

SEQ ID NO: 365161 - protein, 9 aa, Homo Sapiens
SLKDHRIST

SEQ ID NO: 365162 - protein, 9 aa, Homo Sapiens
SGRAPIKAE

SEQ ID NO: 365163 - protein, 9 aa, Homo Sapiens
KAGSVQLHY

SEQ ID NO: 365164 - protein, 9 aa, Homo Sapiens
QFMNSACHQ

SEQ ID NO: 365165 - protein, 9 aa, Homo Sapiens
PGPQGSSRP

SEQ ID NO: 365166 - protein, 9 aa, Homo Sapiens
PDFLKTTSS

SEQ ID NO: 365167 - protein, 9 aa, Homo Sapiens
VGLWKGRYY

SEQ ID NO: 365168 - protein, 9 aa, Homo Sapiens
GQPGPAAVT

SEQ ID NO: 365169 - protein, 9 aa, Homo Sapiens
NNRNVSSAS

SEQ ID NO: 365170 - protein, 9 aa, Homo Sapiens
QGLLGPLFN

SEQ ID NO: 365171 - protein, 9 aa, Homo Sapiens
KNRWEGPGK

SEQ ID NO: 365172 - protein, 9 aa, Homo Sapiens
RMMRRQWSL

SEQ ID NO: 365173 - protein, 9 aa, Homo Sapiens
EIQEAARTC

SEQ ID NO: 365174 - protein, 9 aa, Homo Sapiens
RAVEDVAGL

SEQ ID NO: 365175 - protein, 9 aa, Homo Sapiens
VATNSAGMR

SEQ ID NO: 365176 - protein, 9 aa, Homo Sapiens
RKMLEESKA

SEQ ID NO: 365177 - protein, 9 aa, Homo Sapiens
DKTEYLPTA

SEQ ID NO: 365178 - protein, 9 aa, Homo Sapiens
WEDRAKNTQ

SEQ ID NO: 365179 - protein, 9 aa, Homo Sapiens
ACFGQTSIS

SEQ ID NO: 365180 - protein, 9 aa, Homo Sapiens
SCRGPLPCP

SEQ ID NO: 365181 - protein, 9 aa, Homo Sapiens
QGGAAQLNV

SEQ ID NO: 365182 - protein, 9 aa, Homo Sapiens
HHSCTPVPV

SEQ ID NO: 365183 - protein, 9 aa, Homo Sapiens
VHQVQTSED

SEQ ID NO: 365184 - protein, 9 aa, Homo Sapiens
TLMQRTVGT

SEQ ID NO: 365185 - protein, 9 aa, Homo Sapiens
TRAGDKELQ

SEQ ID NO: 365186 - protein, 9 aa, Homo Sapiens
EPKMTHSKL

SEQ ID NO: 365187 - protein, 9 aa, Homo Sapiens
FAQARGFRK

SEQ ID NO: 365188 - protein, 9 aa, Homo Sapiens
PASPGNRGL

SEQ ID NO: 365189 - protein, 9 aa, Homo Sapiens
DKALSSAFL

SEQ ID NO: 365190 - protein, 9 aa, Homo Sapiens
RCLALLALN

SEQ ID NO: 365191 - protein, 9 aa, Homo Sapiens
GTTFTLVTR

SEQ ID NO: 365192 - protein, 9 aa, Homo Sapiens
GSTGGADRG

SEQ ID NO: 365193 - protein, 9 aa, Homo Sapiens
SNQEHLKEK

SEQ ID NO: 365194 - protein, 9 aa, Homo Sapiens
ATGRHVSLR

SEQ ID NO: 365195 - protein, 9 aa, Homo Sapiens
RGRQERQQQ

SEQ ID NO: 365196 - protein, 9 aa, Homo Sapiens
GISICGGAR

SEQ ID NO: 365197 - protein, 9 aa, Homo Sapiens
RRESGLLLR

SEQ ID NO: 365198 - protein, 9 aa, Homo Sapiens
GSHAPGTAC

SEQ ID NO: 365199 - protein, 9 aa, Homo Sapiens
DSAADFSHY

SEQ ID NO: 365200 - protein, 9 aa, Homo Sapiens
GSPPDLESL

SEQ ID NO: 365201 - protein, 9 aa, Homo Sapiens
GARINDISL

SEQ ID NO: 365202 - protein, 9 aa, Homo Sapiens
SALPTAVTP

SEQ ID NO: 365203 - protein, 9 aa, Homo Sapiens
NGAINHVLQ

SEQ ID NO: 365204 - protein, 9 aa, Homo Sapiens
DVENFYLMT

SEQ ID NO: 365205 - protein, 9 aa, Homo Sapiens
KSFNDSSTL

SEQ ID NO: 365206 - protein, 9 aa, Homo Sapiens
NLLKIYKAK

SEQ ID NO: 365207 - protein, 9 aa, Homo Sapiens
MDATRAGDK

SEQ ID NO: 365208 - protein, 9 aa, Homo Sapiens
GFHVKRVIE

SEQ ID NO: 365209 - protein, 9 aa, Homo Sapiens
LLQRNLLRL

SEQ ID NO: 365210 - protein, 9 aa, Homo Sapiens
SPVYDLLEK

SEQ ID NO: 365211 - protein, 9 aa, Homo Sapiens
ESLAAGGSL

SEQ ID NO: 365212 - protein, 9 aa, Homo Sapiens
EGYELPYNL

SEQ ID NO: 365213 - protein, 9 aa, Homo Sapiens
TSSVLLRAP

SEQ ID NO: 365214 - protein, 9 aa, Homo Sapiens
KTRGQILFP

SEQ ID NO: 365215 - protein, 9 aa, Homo Sapiens
GRAAAAHGD

SEQ ID NO: 365216 - protein, 9 aa, Homo Sapiens
KNGRETIIK

SEQ ID NO: 365217 - protein, 9 aa, Homo Sapiens
LVSQQVSCL

SEQ ID NO: 365218 - protein, 9 aa, Homo Sapiens
GWLCLRRAQ

SEQ ID NO: 365219 - protein, 9 aa, Homo Sapiens
VTPGPPPCR

SEQ ID NO: 365220 - protein, 9 aa, Homo Sapiens
LFFIAFSSQ

SEQ ID NO: 365221 - protein, 9 aa, Homo Sapiens
SPTYLISEA

SEQ ID NO: 365222 - protein, 9 aa, Homo Sapiens
CFLLAVDVS

SEQ ID NO: 365223 - protein, 9 aa, Homo Sapiens
LAITFEHFY

SEQ ID NO: 365224 - protein, 9 aa, Homo Sapiens
RGASKASRA

SEQ ID NO: 365225 - protein, 9 aa, Homo Sapiens
ERNLKCFLK

SEQ ID NO: 365226 - protein, 9 aa, Homo Sapiens
KWELLGSPS

SEQ ID NO: 365227 - protein, 9 aa, Homo Sapiens
DNCAEKLGS

SEQ ID NO: 365228 - protein, 9 aa, Homo Sapiens
MEGGNATRI

SEQ ID NO: 365229 - protein, 9 aa, Homo Sapiens
SHTHDLGTK

SEQ ID NO: 365230 - protein, 9 aa, Homo Sapiens
RTTPLKTAN

SEQ ID NO: 365231 - protein, 9 aa, Homo Sapiens
KKLDVAILE

SEQ ID NO: 365232 - protein, 9 aa, Homo Sapiens
KLPWKLKLK

SEQ ID NO: 365233 - protein, 9 aa, Homo Sapiens
ECLKVGMLK

SEQ ID NO: 365234 - protein, 9 aa, Homo Sapiens
MASLKKQYP

SEQ ID NO: 365235 - protein, 9 aa, Homo Sapiens
TLRPWKTSC

SEQ ID NO: 365236 - protein, 9 aa, Homo Sapiens
FFHDVDVED

SEQ ID NO: 365237 - protein, 9 aa, Homo Sapiens
ASIDKILEL

SEQ ID NO: 365238 - protein, 9 aa, Homo Sapiens
GSCSAPIKL

SEQ ID NO: 365239 - protein, 9 aa, Homo Sapiens
ACNSAMKKH

SEQ ID NO: 365240 - protein, 9 aa, Homo Sapiens
HGRVPVGQG

SEQ ID NO: 365241 - protein, 9 aa, Homo Sapiens
ESEDSKNGF

SEQ ID NO: 365242 - protein, 9 aa, Homo Sapiens
TSTLANLTL

SEQ ID NO: 365243 - protein, 9 aa, Homo Sapiens
FSIANSNSL

SEQ ID NO: 365244 - protein, 9 aa, Homo Sapiens
VCGFPSEKD

SEQ ID NO: 365245 - protein, 9 aa, Homo Sapiens
ELARDARRT

SEQ ID NO: 365246 - protein, 9 aa, Homo Sapiens
AKTTPKPKP

SEQ ID NO: 365247 - protein, 9 aa, Homo Sapiens
KILEMDDHR

SEQ ID NO: 365248 - protein, 9 aa, Homo Sapiens
GTNPASPDV

SEQ ID NO: 365249 - protein, 9 aa, Homo Sapiens
SLWVLPTIC

SEQ ID NO: 365250 - protein, 9 aa, Homo Sapiens
LGLRSVQVP

SEQ ID NO: 365251 - protein, 9 aa, Homo Sapiens
NLALRMMRR

SEQ ID NO: 365252 - protein, 9 aa, Homo Sapiens
LELLDVDTL

SEQ ID NO: 365253 - protein, 9 aa, Homo Sapiens
AGGSLADWP

SEQ ID NO: 365254 - protein, 9 aa, Homo Sapiens
SAASTPPCL

SEQ ID NO: 365255 - protein, 9 aa, Homo Sapiens
LCHMPVPVT

SEQ ID NO: 365256 - protein, 9 aa, Homo Sapiens
LFPCLRLLP

SEQ ID NO: 365257 - protein, 9 aa, Homo Sapiens
HELVPALEG

SEQ ID NO: 365258 - protein, 9 aa, Homo Sapiens
ETQHREARA

SEQ ID NO: 365259 - protein, 9 aa, Homo Sapiens
PQKERRRRN

SEQ ID NO: 365260 - protein, 9 aa, Homo Sapiens
VPPRQLSRS

SEQ ID NO: 365261 - protein, 9 aa, Homo Sapiens
ENRGGSWRS

SEQ ID NO: 365262 - protein, 9 aa, Homo Sapiens
WSTVAQTPS

SEQ ID NO: 365263 - protein, 9 aa, Homo Sapiens
GSRMAHPRL

SEQ ID NO: 365264 - protein, 9 aa, Homo Sapiens
GNLSPTRWT

SEQ ID NO: 365265 - protein, 9 aa, Homo Sapiens
PCHDCGTRF

SEQ ID NO: 365266 - protein, 9 aa, Homo Sapiens
FIHNFQESN

SEQ ID NO: 365267 - protein, 9 aa, Homo Sapiens
KHFYWKHLK

SEQ ID NO: 365268 - protein, 9 aa, Homo Sapiens
CNEIKGEQF

SEQ ID NO: 365269 - protein, 9 aa, Homo Sapiens
EPSISEHVC

SEQ ID NO: 365270 - protein, 9 aa, Homo Sapiens
EHKKFILER

SEQ ID NO: 365271 - protein, 9 aa, Homo Sapiens
PPPACRTGC

SEQ ID NO: 365272 - protein, 9 aa, Homo Sapiens
ARCLLDRSF

SEQ ID NO: 365273 - protein, 9 aa, Homo Sapiens
ISKERVLLP

SEQ ID NO: 365274 - protein, 9 aa, Homo Sapiens
DGGPGVGSF

SEQ ID NO: 365275 - protein, 9 aa, Homo Sapiens
SFNNFRLQV

SEQ ID NO: 365276 - protein, 9 aa, Homo Sapiens
TEAHLAKGA

SEQ ID NO: 365277 - protein, 9 aa, Homo Sapiens
NAPCRCSAP

SEQ ID NO: 365278 - protein, 9 aa, Homo Sapiens
VQKELRLLG

SEQ ID NO: 365279 - protein, 9 aa, Homo Sapiens
ISEEEMCEK

SEQ ID NO: 365280 - protein, 9 aa, Homo Sapiens
HGSMLAARL

SEQ ID NO: 365281 - protein, 9 aa, Homo Sapiens
MVCNLALRM

SEQ ID NO: 365282 - protein, 9 aa, Homo Sapiens
WAGRTGAGQ

SEQ ID NO: 365283 - protein, 9 aa, Homo Sapiens
NNSSVGPLY

SEQ ID NO: 365284 - protein, 9 aa, Homo Sapiens
TLTVAVADI

SEQ ID NO: 365285 - protein, 9 aa, Homo Sapiens
GSSARPITP

SEQ ID NO: 365286 - protein, 9 aa, Homo Sapiens
NGFIFGHAA

SEQ ID NO: 365287 - protein, 9 aa, Homo Sapiens
PRSLAGVSF

SEQ ID NO: 365288 - protein, 9 aa, Homo Sapiens
APRLASAVS

SEQ ID NO: 365289 - protein, 9 aa, Homo Sapiens
TFHALQPSM

SEQ ID NO: 365290 - protein, 9 aa, Homo Sapiens
NTSWHTLHH

SEQ ID NO: 365291 - protein, 9 aa, Homo Sapiens
TARVCDIEH

SEQ ID NO: 365292 - protein, 9 aa, Homo Sapiens
CDLSSQSPP

SEQ ID NO: 365293 - protein, 9 aa, Homo Sapiens
GKDGLLAYA

SEQ ID NO: 365294 - protein, 9 aa, Homo Sapiens
CSLYGKKLV

SEQ ID NO: 365295 - protein, 9 aa, Homo Sapiens
TAPRSLQRS

SEQ ID NO: 365296 - protein, 9 aa, Homo Sapiens
NLTFLDIWY

SEQ ID NO: 365297 - protein, 9 aa, Homo Sapiens
HRPWLHAYV

SEQ ID NO: 365298 - protein, 9 aa, Homo Sapiens
YCKGGITFF

SEQ ID NO: 365299 - protein, 9 aa, Homo Sapiens
LPPPMNCPA

SEQ ID NO: 365300 - protein, 9 aa, Homo Sapiens
SLKLPQDQG

SEQ ID NO: 365301 - protein, 9 aa, Homo Sapiens
IEGNSSFHS

SEQ ID NO: 365302 - protein, 9 aa, Homo Sapiens
PGGRPPSPL

SEQ ID NO: 365303 - protein, 9 aa, Homo Sapiens
WQAQLPQAS

SEQ ID NO: 365304 - protein, 9 aa, Homo Sapiens
VFAQARGFR

SEQ ID NO: 365305 - protein, 9 aa, Homo Sapiens
EDEEGPRSK

SEQ ID NO: 365306 - protein, 9 aa, Homo Sapiens
IKHFLKLMK

SEQ ID NO: 365307 - protein, 9 aa, Homo Sapiens
HVLWNHAVG

SEQ ID NO: 365308 - protein, 9 aa, Homo Sapiens
VVTFTMHLL

SEQ ID NO: 365309 - protein, 9 aa, Homo Sapiens
SSEDILQDA

SEQ ID NO: 365310 - protein, 9 aa, Homo Sapiens
PNLLRQFLP

SEQ ID NO: 365311 - protein, 9 aa, Homo Sapiens
PEKGSLHQT

SEQ ID NO: 365312 - protein, 9 aa, Homo Sapiens
PSDIIENVK

SEQ ID NO: 365313 - protein, 9 aa, Homo Sapiens
DVAKQLLAV

SEQ ID NO: 365314 - protein, 9 aa, Homo Sapiens
CLISVEQEC

SEQ ID NO: 365315 - protein, 9 aa, Homo Sapiens
SANKLLQNL

SEQ ID NO: 365316 - protein, 9 aa, Homo Sapiens
YTHALLHHD

SEQ ID NO: 365317 - protein, 9 aa, Homo Sapiens
HNEIRMVAA

SEQ ID NO: 365318 - protein, 9 aa, Homo Sapiens
NDRQFSSQV

SEQ ID NO: 365319 - protein, 9 aa, Homo Sapiens
PDSRALVGQ

SEQ ID NO: 365320 - protein, 9 aa, Homo Sapiens
LLKIYKAKP

SEQ ID NO: 365321 - protein, 9 aa, Homo Sapiens
IMDTGGLFL

SEQ ID NO: 365322 - protein, 9 aa, Homo Sapiens
EVSAQMEIC

SEQ ID NO: 365323 - protein, 9 aa, Homo Sapiens
PNVVSVSAL

SEQ ID NO: 365324 - protein, 9 aa, Homo Sapiens
EVLESLLEH

SEQ ID NO: 365325 - protein, 9 aa, Homo Sapiens
MAVCGGSRM

SEQ ID NO: 365326 - protein, 9 aa, Homo Sapiens
TGLLPKGPA

SEQ ID NO: 365327 - protein, 9 aa, Homo Sapiens
IDDFSNQEH

SEQ ID NO: 365328 - protein, 9 aa, Homo Sapiens
LAVPPRQLS

SEQ ID NO: 365329 - protein, 9 aa, Homo Sapiens
RVRPCASFD

SEQ ID NO: 365330 - protein, 9 aa, Homo Sapiens
KNKEKKESS

SEQ ID NO: 365331 - protein, 9 aa, Homo Sapiens
LLAVGAEVN

SEQ ID NO: 365332 - protein, 9 aa, Homo Sapiens
LATSYFIDR

SEQ ID NO: 365333 - protein, 9 aa, Homo Sapiens
RCYRHSLLH

SEQ ID NO: 365334 - protein, 9 aa, Homo Sapiens
LWEALWPGP

SEQ ID NO: 365335 - protein, 9 aa, Homo Sapiens
LGTYRVVDL

SEQ ID NO: 365336 - protein, 9 aa, Homo Sapiens
TCLAASMAA

SEQ ID NO: 365337 - protein, 9 aa, Homo Sapiens
LLADEFTRL

SEQ ID NO: 365338 - protein, 9 aa, Homo Sapiens
AQPWRLRLP

SEQ ID NO: 365339 - protein, 9 aa, Homo Sapiens
ALKQVSPAS

SEQ ID NO: 365340 - protein, 9 aa, Homo Sapiens
KFMLKTTRV

SEQ ID NO: 365341 - protein, 9 aa, Homo Sapiens
PLRRTRALR

SEQ ID NO: 365342 - protein, 9 aa, Homo Sapiens
GMSSLTLLM

SEQ ID NO: 365343 - protein, 9 aa, Homo Sapiens
FSVILSLFN

SEQ ID NO: 365344 - protein, 9 aa, Homo Sapiens
FSGWISGSE

SEQ ID NO: 365345 - protein, 9 aa, Homo Sapiens
KRSKAKVER

SEQ ID NO: 365346 - protein, 9 aa, Homo Sapiens
STELKTYLC

SEQ ID NO: 365347 - protein, 9 aa, Homo Sapiens
SHLILLWLL

SEQ ID NO: 365348 - protein, 9 aa, Homo Sapiens
WHMVIGEGF

SEQ ID NO: 365349 - protein, 9 aa, Homo Sapiens
EDEPVKAKN

SEQ ID NO: 365350 - protein, 9 aa, Homo Sapiens
SVILSLFNH

SEQ ID NO: 365351 - protein, 9 aa, Homo Sapiens
HAKKNTAFT

SEQ ID NO: 365352 - protein, 9 aa, Homo Sapiens
RAGFNRRFM

SEQ ID NO: 365353 - protein, 9 aa, Homo Sapiens
IILEKKTHL

SEQ ID NO: 365354 - protein, 9 aa, Homo Sapiens
WLGHRVGVL

SEQ ID NO: 365355 - protein, 9 aa, Homo Sapiens
KAFDITYVC

SEQ ID NO: 365356 - protein, 9 aa, Homo Sapiens
QAAGAEREH

SEQ ID NO: 365357 - protein, 9 aa, Homo Sapiens
FQATITNCR

SEQ ID NO: 365358 - protein, 9 aa, Homo Sapiens
HTHDLGTKR

SEQ ID NO: 365359 - protein, 9 aa, Homo Sapiens
CAEKLGSCP

SEQ ID NO: 365360 - protein, 9 aa, Homo Sapiens
LALRMMRRQ

SEQ ID NO: 365361 - protein, 9 aa, Homo Sapiens
GPILRTLRC

SEQ ID NO: 365362 - protein, 9 aa, Homo Sapiens
NPINIELLL

SEQ ID NO: 365363 - protein, 9 aa, Homo Sapiens
WKLSVFAET

SEQ ID NO: 365364 - protein, 9 aa, Homo Sapiens
KSYRLVLKE

SEQ ID NO: 365365 - protein, 9 aa, Homo Sapiens
TTLARETSL

SEQ ID NO: 365366 - protein, 9 aa, Homo Sapiens
TMNDSKHKL

SEQ ID NO: 365367 - protein, 9 aa, Homo Sapiens
CIRNEREKE

SEQ ID NO: 365368 - protein, 9 aa, Homo Sapiens
SPHCPMVVQ

SEQ ID NO: 365369 - protein, 9 aa, Homo Sapiens
TEVVMSGVH

SEQ ID NO: 365370 - protein, 9 aa, Homo Sapiens
WAGPAATSS

SEQ ID NO: 365371 - protein, 9 aa, Homo Sapiens
IGMEGGNAT

SEQ ID NO: 365372 - protein, 9 aa, Homo Sapiens
TLFQTQIIR

SEQ ID NO: 365373 - protein, 9 aa, Homo Sapiens
QWPHPDPAG

SEQ ID NO: 365374 - protein, 9 aa, Homo Sapiens
YLCLLEIHK

SEQ ID NO: 365375 - protein, 9 aa, Homo Sapiens
VKEIKCFLT

SEQ ID NO: 365376 - protein, 9 aa, Homo Sapiens
ITDMLLEID

SEQ ID NO: 365377 - protein, 9 aa, Homo Sapiens
ETELSPVEQ

SEQ ID NO: 365378 - protein, 9 aa, Homo Sapiens
KVLLPVLPG

SEQ ID NO: 365379 - protein, 9 aa, Homo Sapiens
PPQKERRRR

SEQ ID NO: 365380 - protein, 9 aa, Homo Sapiens
QTDGFAGIK

SEQ ID NO: 365381 - protein, 9 aa, Homo Sapiens
LNPERSLEE

SEQ ID NO: 365382 - protein, 9 aa, Homo Sapiens
PPLPADLPH

SEQ ID NO: 365383 - protein, 9 aa, Homo Sapiens
SRGASGPDG

SEQ ID NO: 365384 - protein, 9 aa, Homo Sapiens
PLHGRVPVG

SEQ ID NO: 365385 - protein, 9 aa, Homo Sapiens
MEQCGRDDY

SEQ ID NO: 365386 - protein, 9 aa, Homo Sapiens
VEDVAGLGA

SEQ ID NO: 365387 - protein, 9 aa, Homo Sapiens
PESPDSRAL

SEQ ID NO: 365388 - protein, 9 aa, Homo Sapiens
HELAQNRLN

SEQ ID NO: 365389 - protein, 9 aa, Homo Sapiens
LAGVSFSQL

SEQ ID NO: 365390 - protein, 9 aa, Homo Sapiens
DRKKKSRTL

SEQ ID NO: 365391 - protein, 9 aa, Homo Sapiens
DRMTPSGQQ

SEQ ID NO: 365392 - protein, 9 aa, Homo Sapiens
HENSSPCQG

SEQ ID NO: 365393 - protein, 9 aa, Homo Sapiens
ISVKDHRTS

SEQ ID NO: 365394 - protein, 9 aa, Homo Sapiens
GLETGDPPP

SEQ ID NO: 365395 - protein, 9 aa, Homo Sapiens
FDCTRPRLT

SEQ ID NO: 365396 - protein, 9 aa, Homo Sapiens
ANDRPDFLK

SEQ ID NO: 365397 - protein, 9 aa, Homo Sapiens
RGARGAKVS

SEQ ID NO: 365398 - protein, 9 aa, Homo Sapiens
LQTRDAFLI

SEQ ID NO: 365399 - protein, 9 aa, Homo Sapiens
LNKQLTAPP

SEQ ID NO: 365400 - protein, 9 aa, Homo Sapiens
SNITEELFL

SEQ ID NO: 365401 - protein, 9 aa, Homo Sapiens
SGSWCGTWT

SEQ ID NO: 365402 - protein, 9 aa, Homo Sapiens
VMTIIVPID

SEQ ID NO: 365403 - protein, 9 aa, Homo Sapiens
MIITRTLVR

SEQ ID NO: 365404 - protein, 9 aa, Homo Sapiens
IHQHLARAA

SEQ ID NO: 365405 - protein, 9 aa, Homo Sapiens
QWSLWVLPT

SEQ ID NO: 365406 - protein, 9 aa, Homo Sapiens
TWPLPGPHA

SEQ ID NO: 365407 - protein, 9 aa, Homo Sapiens
LCMQLGPGP

SEQ ID NO: 365408 - protein, 9 aa, Homo Sapiens
YVCVISYAH

SEQ ID NO: 365409 - protein, 9 aa, Homo Sapiens
GQEWHCGPQ

SEQ ID NO: 365410 - protein, 9 aa, Homo Sapiens
LLQPSMIQE

SEQ ID NO: 365411 - protein, 9 aa, Homo Sapiens
FIYSQNSAG

SEQ ID NO: 365412 - protein, 9 aa, Homo Sapiens
DNPPVLTQA

SEQ ID NO: 365413 - protein, 9 aa, Homo Sapiens
VLGLRSVQV

SEQ ID NO: 365414 - protein, 9 aa, Homo Sapiens
QKNWYHITL

SEQ ID NO: 365415 - protein, 9 aa, Homo Sapiens
GCGPGRRRA

SEQ ID NO: 365416 - protein, 9 aa, Homo Sapiens
ILQPVFRQE

SEQ ID NO: 365417 - protein, 9 aa, Homo Sapiens
VKDHRTSQN

SEQ ID NO: 365418 - protein, 9 aa, Homo Sapiens
LGAPGQASP

SEQ ID NO: 365419 - protein, 9 aa, Homo Sapiens
KLYLEISHQ

SEQ ID NO: 365420 - protein, 9 aa, Homo Sapiens
KVIWIYRSA

SEQ ID NO: 365421 - protein, 9 aa, Homo Sapiens
GLPRRDPSG

SEQ ID NO: 365422 - protein, 9 aa, Homo Sapiens
STSSFCCCT

SEQ ID NO: 365423 - protein, 9 aa, Homo Sapiens
TPPRPLPCP

SEQ ID NO: 365424 - protein, 9 aa, Homo Sapiens
IGREPMLCK

SEQ ID NO: 365425 - protein, 9 aa, Homo Sapiens
FLAAFHAAW

SEQ ID NO: 365426 - protein, 9 aa, Homo Sapiens
IAAKDPAND

SEQ ID NO: 365427 - protein, 9 aa, Homo Sapiens
ARACAATRP

SEQ ID NO: 365428 - protein, 9 aa, Homo Sapiens
AFHAAWMVK

SEQ ID NO: 365429 - protein, 9 aa, Homo Sapiens
ILKQFLHKL

SEQ ID NO: 365430 - protein, 9 aa, Homo Sapiens
SEERRPHKE

SEQ ID NO: 365431 - protein, 9 aa, Homo Sapiens
LVRPKRKHR

SEQ ID NO: 365432 - protein, 9 aa, Homo Sapiens
KQCLNKLEE

SEQ ID NO: 365433 - protein, 9 aa, Homo Sapiens
SSKPYWMVG

SEQ ID NO: 365434 - protein, 9 aa, Homo Sapiens
QCCDCWEPA

SEQ ID NO: 365435 - protein, 9 aa, Homo Sapiens
GLYKMDFGF

SEQ ID NO: 365436 - protein, 9 aa, Homo Sapiens
ASGPDGVRG

SEQ ID NO: 365437 - protein, 9 aa, Homo Sapiens
PKFGEKDKK

SEQ ID NO: 365438 - protein, 9 aa, Homo Sapiens
KEKSVKEIK

SEQ ID NO: 365439 - protein, 9 aa, Homo Sapiens
GTQINFTMA

SEQ ID NO: 365440 - protein, 9 aa, Homo Sapiens
GWAGPAATS

SEQ ID NO: 365441 - protein, 9 aa, Homo Sapiens
SLGTHSYVR

SEQ ID NO: 365442 - protein, 9 aa, Homo Sapiens
TRGTLHTTL

SEQ ID NO: 365443 - protein, 9 aa, Homo Sapiens
PAGSPRPGP

SEQ ID NO: 365444 - protein, 9 aa, Homo Sapiens
FTGHREWVH

SEQ ID NO: 365445 - protein, 9 aa, Homo Sapiens
YFQQDIKGL

SEQ ID NO: 365446 - protein, 9 aa, Homo Sapiens
QSMQSVFNM

SEQ ID NO: 365447 - protein, 9 aa, Homo Sapiens
RSHMLEEGD

SEQ ID NO: 365448 - protein, 9 aa, Homo Sapiens
RSALNSAFG

SEQ ID NO: 365449 - protein, 9 aa, Homo Sapiens
TLHLFPGKN

SEQ ID NO: 365450 - protein, 9 aa, Homo Sapiens
CNNFPTITD

SEQ ID NO: 365451 - protein, 9 aa, Homo Sapiens
FKWQIIQRR

SEQ ID NO: 365452 - protein, 9 aa, Homo Sapiens
NYGICKVYL

SEQ ID NO: 365453 - protein, 9 aa, Homo Sapiens
STKPSPSSA

SEQ ID NO: 365454 - protein, 9 aa, Homo Sapiens
EGSFLLHKK

SEQ ID NO: 365455 - protein, 9 aa, Homo Sapiens
WKMSLLIPS

SEQ ID NO: 365456 - protein, 9 aa, Homo Sapiens
GMRYSSPAN

SEQ ID NO: 365457 - protein, 9 aa, Homo Sapiens
SALRLSPSG

SEQ ID NO: 365458 - protein, 9 aa, Homo Sapiens
PPARAVLNS

SEQ ID NO: 365459 - protein, 9 aa, Homo Sapiens
AEWVIENPA

SEQ ID NO: 365460 - protein, 9 aa, Homo Sapiens
VSRAPKHCE

SEQ ID NO: 365461 - protein, 9 aa, Homo Sapiens
RGAVLCLRL

SEQ ID NO: 365462 - protein, 9 aa, Homo Sapiens
LIIPCPPQS

SEQ ID NO: 365463 - protein, 9 aa, Homo Sapiens
QRIRSKKRK

SEQ ID NO: 365464 - protein, 9 aa, Homo Sapiens
KRVVLHRGE

SEQ ID NO: 365465 - protein, 9 aa, Homo Sapiens
SRSFFTSAH

SEQ ID NO: 365466 - protein, 9 aa, Homo Sapiens
YDKWEMECT

SEQ ID NO: 365467 - protein, 9 aa, Homo Sapiens
DGVEGLRGQ

SEQ ID NO: 365468 - protein, 9 aa, Homo Sapiens
AVEACLRTH

SEQ ID NO: 365469 - protein, 9 aa, Homo Sapiens
LRNSGTVLR

SEQ ID NO: 365470 - protein, 9 aa, Homo Sapiens
HVKRVIEVQ

SEQ ID NO: 365471 - protein, 9 aa, Homo Sapiens
TLLWGLTKE

SEQ ID NO: 365472 - protein, 9 aa, Homo Sapiens
QVGLNHGPV

SEQ ID NO: 365473 - protein, 9 aa, Homo Sapiens
RLNLTKWQK

SEQ ID NO: 365474 - protein, 9 aa, Homo Sapiens
IQEVWTLYA

SEQ ID NO: 365475 - protein, 9 aa, Homo Sapiens
DNTEVKKVM

SEQ ID NO: 365476 - protein, 9 aa, Homo Sapiens
TVGPSGTSR

SEQ ID NO: 365477 - protein, 9 aa, Homo Sapiens
KVMHPKGNG

SEQ ID NO: 365478 - protein, 9 aa, Homo Sapiens
GLSSHTRSH

SEQ ID NO: 365479 - protein, 9 aa, Homo Sapiens
SPWRALGPP

SEQ ID NO: 365480 - protein, 9 aa, Homo Sapiens
GASEENLVD

SEQ ID NO: 365481 - protein, 9 aa, Homo Sapiens
FMLKTTRVN

SEQ ID NO: 365482 - protein, 9 aa, Homo Sapiens
DLSSTNMPT

SEQ ID NO: 365483 - protein, 9 aa, Homo Sapiens
QHLARAAKW

SEQ ID NO: 365484 - protein, 9 aa, Homo Sapiens
NCAEKLGSC

SEQ ID NO: 365485 - protein, 9 aa, Homo Sapiens
WHRTLTAEE

SEQ ID NO: 365486 - protein, 9 aa, Homo Sapiens
EEKDSNAGC

SEQ ID NO: 365487 - protein, 9 aa, Homo Sapiens
FGTCLAASM

SEQ ID NO: 365488 - protein, 9 aa, Homo Sapiens
PRLKKIGKT

SEQ ID NO: 365489 - protein, 9 aa, Homo Sapiens
WTRMLRATT

SEQ ID NO: 365490 - protein, 9 aa, Homo Sapiens
LNPFIYSQN

SEQ ID NO: 365491 - protein, 9 aa, Homo Sapiens
SIYWQEFED

SEQ ID NO: 365492 - protein, 9 aa, Homo Sapiens
MFVSLLFLS

SEQ ID NO: 365493 - protein, 9 aa, Homo Sapiens
VPIDGQIAD

SEQ ID NO: 365494 - protein, 9 aa, Homo Sapiens
RKTAATTAA

SEQ ID NO: 365495 - protein, 9 aa, Homo Sapiens
KRAYETTAG

SEQ ID NO: 365496 - protein, 9 aa, Homo Sapiens
GSALRLSPS

SEQ ID NO: 365497 - protein, 9 aa, Homo Sapiens
SMDKWKGPQ

SEQ ID NO: 365498 - protein, 9 aa, Homo Sapiens
ARQAQTVFW

SEQ ID NO: 365499 - protein, 9 aa, Homo Sapiens
TPDQHTHPK

SEQ ID NO: 365500 - protein, 9 aa, Homo Sapiens
GSQLQKLKE

SEQ ID NO: 365501 - protein, 9 aa, Homo Sapiens
GDKTEYLPT

SEQ ID NO: 365502 - protein, 9 aa, Homo Sapiens
FSTLHQRAD

SEQ ID NO: 365503 - protein, 9 aa, Homo Sapiens
QYLKERESY

SEQ ID NO: 365504 - protein, 9 aa, Homo Sapiens
SYRFSPLLW

SEQ ID NO: 365505 - protein, 9 aa, Homo Sapiens
WQKHHPQRQ

SEQ ID NO: 365506 - protein, 9 aa, Homo Sapiens
VPEEGSEPS

SEQ ID NO: 365507 - protein, 9 aa, Homo Sapiens
AELCNQSVR

SEQ ID NO: 365508 - protein, 9 aa, Homo Sapiens
VDGWRGWTV

SEQ ID NO: 365509 - protein, 9 aa, Homo Sapiens
LAHNEIRMV

SEQ ID NO: 365510 - protein, 9 aa, Homo Sapiens
GGLERVPVA

SEQ ID NO: 365511 - protein, 9 aa, Homo Sapiens
LATGSSRGT

SEQ ID NO: 365512 - protein, 9 aa, Homo Sapiens
CTASSTRVP

SEQ ID NO: 365513 - protein, 9 aa, Homo Sapiens
AHTPTCHLL

SEQ ID NO: 365514 - protein, 9 aa, Homo Sapiens
VLKELRNPL

SEQ ID NO: 365515 - protein, 9 aa, Homo Sapiens
TSRSSARSR

SEQ ID NO: 365516 - protein, 9 aa, Homo Sapiens
AVCGGSRMT

SEQ ID NO: 365517 - protein, 9 aa, Homo Sapiens
PELWATMRG

SEQ ID NO: 365518 - protein, 9 aa, Homo Sapiens
PFIYSQNSA

SEQ ID NO: 365519 - protein, 9 aa, Homo Sapiens
PPGSSARPI

SEQ ID NO: 365520 - protein, 9 aa, Homo Sapiens
TQMTSRRAS

SEQ ID NO: 365521 - protein, 9 aa, Homo Sapiens
ACQNEHLLI

SEQ ID NO: 365522 - protein, 9 aa, Homo Sapiens
AAPTDDLQS

SEQ ID NO: 365523 - protein, 9 aa, Homo Sapiens
SGGGGSSSG

SEQ ID NO: 365524 - protein, 9 aa, Homo Sapiens
ADGQASGGS

SEQ ID NO: 365525 - protein, 9 aa, Homo Sapiens
EYHVNESAC

SEQ ID NO: 365526 - protein, 9 aa, Homo Sapiens
LELNGTETK

SEQ ID NO: 365527 - protein, 9 aa, Homo Sapiens
RGGAPPAGR

SEQ ID NO: 365528 - protein, 9 aa, Homo Sapiens
KEASVDLKN

SEQ ID NO: 365529 - protein, 9 aa, Homo Sapiens
RNVNVHVIR

SEQ ID NO: 365530 - protein, 9 aa, Homo Sapiens
CGTWTAWMP

SEQ ID NO: 365531 - protein, 9 aa, Homo Sapiens
SGWLCLRRA

SEQ ID NO: 365532 - protein, 9 aa, Homo Sapiens
TPRRSPASA

SEQ ID NO: 365533 - protein, 9 aa, Homo Sapiens
LAAFIGSMD

SEQ ID NO: 365534 - protein, 9 aa, Homo Sapiens
EMRDISLIK

SEQ ID NO: 365535 - protein, 9 aa, Homo Sapiens
ALPLPLSGE

SEQ ID NO: 365536 - protein, 9 aa, Homo Sapiens
GSNDAHDKK

SEQ ID NO: 365537 - protein, 9 aa, Homo Sapiens
IKETICGHL

SEQ ID NO: 365538 - protein, 9 aa, Homo Sapiens
NTDVGYYSW

SEQ ID NO: 365539 - protein, 9 aa, Homo Sapiens
LGLLCMQLG

SEQ ID NO: 365540 - protein, 9 aa, Homo Sapiens
GISIATNPE

SEQ ID NO: 365541 - protein, 9 aa, Homo Sapiens
QQSRGGNMA

SEQ ID NO: 365542 - protein, 9 aa, Homo Sapiens
TRDAFLIVF

SEQ ID NO: 365543 - protein, 9 aa, Homo Sapiens
LYKMDFGFV

SEQ ID NO: 365544 - protein, 9 aa, Homo Sapiens
CVGARINDI

SEQ ID NO: 365545 - protein, 9 aa, Homo Sapiens
SSEGNTDTP

SEQ ID NO: 365546 - protein, 9 aa, Homo Sapiens
RLAVSTRGA

SEQ ID NO: 365547 - protein, 9 aa, Homo Sapiens
LEGALQVEA

SEQ ID NO: 365548 - protein, 9 aa, Homo Sapiens
TLANLTLGS

SEQ ID NO: 365549 - protein, 9 aa, Homo Sapiens
TIIVPIDGQ

SEQ ID NO: 365550 - protein, 9 aa, Homo Sapiens
EGCISVKDH

SEQ ID NO: 365551 - protein, 9 aa, Homo Sapiens
SKKNPSPAE

SEQ ID NO: 365552 - protein, 9 aa, Homo Sapiens
DEALRARNL

SEQ ID NO: 365553 - protein, 9 aa, Homo Sapiens
LEISHQLIM

SEQ ID NO: 365554 - protein, 9 aa, Homo Sapiens
GLSAQPWRL

SEQ ID NO: 365555 - protein, 9 aa, Homo Sapiens
KSTPTDSLV

SEQ ID NO: 365556 - protein, 9 aa, Homo Sapiens
RRRKDLTPP

SEQ ID NO: 365557 - protein, 9 aa, Homo Sapiens
SSARPITPR

SEQ ID NO: 365558 - protein, 9 aa, Homo Sapiens
RLWGWNADG

SEQ ID NO: 365559 - protein, 9 aa, Homo Sapiens
IARPQQPVA

SEQ ID NO: 365560 - protein, 9 aa, Homo Sapiens
TEPAASAAV

SEQ ID NO: 365561 - protein, 9 aa, Homo Sapiens
ILNRQFMNS

SEQ ID NO: 365562 - protein, 9 aa, Homo Sapiens
TPKIPPQLF

SEQ ID NO: 365563 - protein, 9 aa, Homo Sapiens
NQVFLRCHL

SEQ ID NO: 365564 - protein, 9 aa, Homo Sapiens
GNLSPGVVT

SEQ ID NO: 365565 - protein, 9 aa, Homo Sapiens
RSKAKVERE

SEQ ID NO: 365566 - protein, 9 aa, Homo Sapiens
PLEVLKKIL

SEQ ID NO: 365567 - protein, 9 aa, Homo Sapiens
NGVEKDRTP

SEQ ID NO: 365568 - protein, 9 aa, Homo Sapiens
VSTRGASKA

SEQ ID NO: 365569 - protein, 9 aa, Homo Sapiens
HSKCITECV

SEQ ID NO: 365570 - protein, 9 aa, Homo Sapiens
WPLPGPHAW

SEQ ID NO: 365571 - protein, 9 aa, Homo Sapiens
DPKAPHTTE

SEQ ID NO: 365572 - protein, 9 aa, Homo Sapiens
IWEVMPRTL

SEQ ID NO: 365573 - protein, 9 aa, Homo Sapiens
NFDETYIGN

SEQ ID NO: 365574 - protein, 9 aa, Homo Sapiens
KAVVDSWNA

SEQ ID NO: 365575 - protein, 9 aa, Homo Sapiens
TQELGPEVS

SEQ ID NO: 365576 - protein, 9 aa, Homo Sapiens
WLWRSCLWE

SEQ ID NO: 365577 - protein, 9 aa, Homo Sapiens
NELLYCQNG

SEQ ID NO: 365578 - protein, 9 aa, Homo Sapiens
KALWESRSH

SEQ ID NO: 365579 - protein, 9 aa, Homo Sapiens
TLSDSPWRA

SEQ ID NO: 365580 - protein, 9 aa, Homo Sapiens
RMGFIHNFQ

SEQ ID NO: 365581 - protein, 9 aa, Homo Sapiens
GDLTLLQES

SEQ ID NO: 365582 - protein, 9 aa, Homo Sapiens
CGVDRRWYF

SEQ ID NO: 365583 - protein, 9 aa, Homo Sapiens
LGAPKKEKS

SEQ ID NO: 365584 - protein, 9 aa, Homo Sapiens
CRSPSRSPF

SEQ ID NO: 365585 - protein, 9 aa, Homo Sapiens
HSLLDPSPR

SEQ ID NO: 365586 - protein, 9 aa, Homo Sapiens
QLTMNDSKH

SEQ ID NO: 365587 - protein, 9 aa, Homo Sapiens
PQRRPPRWT

SEQ ID NO: 365588 - protein, 9 aa, Homo Sapiens
RSPSVASFQ

SEQ ID NO: 365589 - protein, 9 aa, Homo Sapiens
PPSSCWSPR

SEQ ID NO: 365590 - protein, 9 aa, Homo Sapiens
LIQRELLKT

SEQ ID NO: 365591 - protein, 9 aa, Homo Sapiens
FNNSSVGPL

SEQ ID NO: 365592 - protein, 9 aa, Homo Sapiens
TWTAWMPCW

SEQ ID NO: 365593 - protein, 9 aa, Homo Sapiens
STVAQTPSP

SEQ ID NO: 365594 - protein, 9 aa, Homo Sapiens
FLLAGWCMP

SEQ ID NO: 365595 - protein, 9 aa, Homo Sapiens
KQVIHTVEK

SEQ ID NO: 365596 - protein, 9 aa, Homo Sapiens
RYWDLEVRL

SEQ ID NO: 365597 - protein, 9 aa, Homo Sapiens
CGPLVKGVL

SEQ ID NO: 365598 - protein, 9 aa, Homo Sapiens
SPPASRWNP

SEQ ID NO: 365599 - protein, 9 aa, Homo Sapiens
GAPPRAPAA

SEQ ID NO: 365600 - protein, 9 aa, Homo Sapiens
HQWHPDPVL

SEQ ID NO: 365601 - protein, 9 aa, Homo Sapiens
VSKEEKESR

SEQ ID NO: 365602 - protein, 9 aa, Homo Sapiens
QDSLDEAQQ

SEQ ID NO: 365603 - protein, 9 aa, Homo Sapiens
AGPGSTGGA

SEQ ID NO: 365604 - protein, 9 aa, Homo Sapiens
SSLDNTEVK

SEQ ID NO: 365605 - protein, 9 aa, Homo Sapiens
HKIGVFSCG

SEQ ID NO: 365606 - protein, 9 aa, Homo Sapiens
ESQGAPRAG

SEQ ID NO: 365607 - protein, 9 aa, Homo Sapiens
GPLVKGVLE

SEQ ID NO: 365608 - protein, 9 aa, Homo Sapiens
GKVWDEVNL

SEQ ID NO: 365609 - protein, 9 aa, Homo Sapiens
QILHRVPKS

SEQ ID NO: 365610 - protein, 9 aa, Homo Sapiens
KEHDPDPTA

SEQ ID NO: 365611 - protein, 9 aa, Homo Sapiens
GCGMSSLTL

SEQ ID NO: 365612 - protein, 9 aa, Homo Sapiens
MQLEQMKED

SEQ ID NO: 365613 - protein, 9 aa, Homo Sapiens
LAASMAAPG

SEQ ID NO: 365614 - protein, 9 aa, Homo Sapiens
CSRRSLRTT

SEQ ID NO: 365615 - protein, 9 aa, Homo Sapiens
HATLRFNGM

SEQ ID NO: 365616 - protein, 9 aa, Homo Sapiens
REPSAACGP

SEQ ID NO: 365617 - protein, 9 aa, Homo Sapiens
RPEGWRSPC

SEQ ID NO: 365618 - protein, 9 aa, Homo Sapiens
WLLALPGLY

SEQ ID NO: 365619 - protein, 9 aa, Homo Sapiens
VKRNLIQLV

SEQ ID NO: 365620 - protein, 9 aa, Homo Sapiens
VWYLQYTDW

SEQ ID NO: 365621 - protein, 9 aa, Homo Sapiens
SEEEMCEKL

SEQ ID NO: 365622 - protein, 9 aa, Homo Sapiens
GFLAAFHAA

SEQ ID NO: 365623 - protein, 9 aa, Homo Sapiens
HPDPAGSPR

SEQ ID NO: 365624 - protein, 9 aa, Homo Sapiens
LEGWVEEKQ

SEQ ID NO: 365625 - protein, 9 aa, Homo Sapiens
QVQREHLDI

SEQ ID NO: 365626 - protein, 9 aa, Homo Sapiens
MTVGLTFIT

SEQ ID NO: 365627 - protein, 9 aa, Homo Sapiens
NLQNIGCSV

SEQ ID NO: 365628 - protein, 9 aa, Homo Sapiens
DTTTSSPKF

SEQ ID NO: 365629 - protein, 9 aa, Homo Sapiens
AAGFGNSCI

SEQ ID NO: 365630 - protein, 9 aa, Homo Sapiens
VEEMATKKH

SEQ ID NO: 365631 - protein, 9 aa, Homo Sapiens
GMMLVEQPK

SEQ ID NO: 365632 - protein, 9 aa, Homo Sapiens
LPADLPHSS

SEQ ID NO: 365633 - protein, 9 aa, Homo Sapiens
IGPVSTMIP

SEQ ID NO: 365634 - protein, 9 aa, Homo Sapiens
MGEIVIRGN

SEQ ID NO: 365635 - protein, 9 aa, Homo Sapiens
GPVSTMIPP

SEQ ID NO: 365636 - protein, 9 aa, Homo Sapiens
CTSKAYNNQ

SEQ ID NO: 365637 - protein, 9 aa, Homo Sapiens
PGQASPTSS

SEQ ID NO: 365638 - protein, 9 aa, Homo Sapiens
SLQRSPALR

SEQ ID NO: 365639 - protein, 9 aa, Homo Sapiens
TEYLPTALE

SEQ ID NO: 365640 - protein, 9 aa, Homo Sapiens
MELKPTVPP

SEQ ID NO: 365641 - protein, 9 aa, Homo Sapiens
PGDFDVPGL

SEQ ID NO: 365642 - protein, 9 aa, Homo Sapiens
PHAWTSTPR

SEQ ID NO: 365643 - protein, 9 aa, Homo Sapiens
RAKKIWKYF

SEQ ID NO: 365644 - protein, 9 aa, Homo Sapiens
IHTKDYPHW

SEQ ID NO: 365645 - protein, 9 aa, Homo Sapiens
VYVDPIDYW

SEQ ID NO: 365646 - protein, 9 aa, Homo Sapiens
HTRETTYDR

SEQ ID NO: 365647 - protein, 9 aa, Homo Sapiens
TPGCRLGPC

SEQ ID NO: 365648 - protein, 9 aa, Homo Sapiens
NIYPVEDLT

SEQ ID NO: 365649 - protein, 9 aa, Homo Sapiens
TDAIFARRA

SEQ ID NO: 365650 - protein, 9 aa, Homo Sapiens
GDAAAGAAL

SEQ ID NO: 365651 - protein, 9 aa, Homo Sapiens
LSRIKKVSY

SEQ ID NO: 365652 - protein, 9 aa, Homo Sapiens
LSIGPALQL

SEQ ID NO: 365653 - protein, 9 aa, Homo Sapiens
AAEEPRRPR

SEQ ID NO: 365654 - protein, 9 aa, Homo Sapiens
PRLTWCPWA

SEQ ID NO: 365655 - protein, 9 aa, Homo Sapiens
PPAPESPDS

SEQ ID NO: 365656 - protein, 9 aa, Homo Sapiens
KKSRTLGNC

SEQ ID NO: 365657 - protein, 9 aa, Homo Sapiens
CGLSAQPWR

SEQ ID NO: 365658 - protein, 9 aa, Homo Sapiens
TTDAVWGGG

SEQ ID NO: 365659 - protein, 9 aa, Homo Sapiens
NECLGNYPE

SEQ ID NO: 365660 - protein, 9 aa, Homo Sapiens
QSVKNKPLY

SEQ ID NO: 365661 - protein, 9 aa, Homo Sapiens
TVLTSRSLR

SEQ ID NO: 365662 - protein, 9 aa, Homo Sapiens
FSTYAEFSP

SEQ ID NO: 365663 - protein, 9 aa, Homo Sapiens
LSSSLDNTE

SEQ ID NO: 365664 - protein, 9 aa, Homo Sapiens
ASVTIIVSA

SEQ ID NO: 365665 - protein, 9 aa, Homo Sapiens
RRMSSHLRA

SEQ ID NO: 365666 - protein, 9 aa, Homo Sapiens
IQNNRNVSS

SEQ ID NO: 365667 - protein, 9 aa, Homo Sapiens
AVTPRRSPA

SEQ ID NO: 365668 - protein, 9 aa, Homo Sapiens
LQAKMGMQH

SEQ ID NO: 365669 - protein, 9 aa, Homo Sapiens
ASNASLLGG

SEQ ID NO: 365670 - protein, 9 aa, Homo Sapiens
LLTMDWHGE

SEQ ID NO: 365671 - protein, 9 aa, Homo Sapiens
HSSVHSECV

SEQ ID NO: 365672 - protein, 9 aa, Homo Sapiens
TVPGTSDFT

SEQ ID NO: 365673 - protein, 9 aa, Homo Sapiens
VETFAFQTE

SEQ ID NO: 365674 - protein, 9 aa, Homo Sapiens
LTWCPWASG

SEQ ID NO: 365675 - protein, 9 aa, Homo Sapiens
LWARAFHSC

SEQ ID NO: 365676 - protein, 9 aa, Homo Sapiens
FRLQVGLNH

SEQ ID NO: 365677 - protein, 9 aa, Homo Sapiens
ICILGHVDT

SEQ ID NO: 365678 - protein, 9 aa, Homo Sapiens
WVAIPQEQL

SEQ ID NO: 365679 - protein, 9 aa, Homo Sapiens
WHGGRELSD

SEQ ID NO: 365680 - protein, 9 aa, Homo Sapiens
DEGWGPAPG

SEQ ID NO: 365681 - protein, 9 aa, Homo Sapiens
LDEKLLVRG

SEQ ID NO: 365682 - protein, 9 aa, Homo Sapiens
CWFAERVDL

SEQ ID NO: 365683 - protein, 9 aa, Homo Sapiens
REQETSDPE

SEQ ID NO: 365684 - protein, 9 aa, Homo Sapiens
LRRASGRMH

SEQ ID NO: 365685 - protein, 9 aa, Homo Sapiens
VEPSDIIEN

SEQ ID NO: 365686 - protein, 9 aa, Homo Sapiens
HRNLKQKWH

SEQ ID NO: 365687 - protein, 9 aa, Homo Sapiens
GCCHAATLA

SEQ ID NO: 365688 - protein, 9 aa, Homo Sapiens
EDLGHTARE

SEQ ID NO: 365689 - protein, 9 aa, Homo Sapiens
SMVISYLIS

SEQ ID NO: 365690 - protein, 9 aa, Homo Sapiens
EYLDPRIAI

SEQ ID NO: 365691 - protein, 9 aa, Homo Sapiens
GRNVNVHVI

SEQ ID NO: 365692 - protein, 9 aa, Homo Sapiens
TSSSLCWNL

SEQ ID NO: 365693 - protein, 9 aa, Homo Sapiens
VLEWCRHRA

SEQ ID NO: 365694 - protein, 9 aa, Homo Sapiens
RDSRSFFTS

SEQ ID NO: 365695 - protein, 9 aa, Homo Sapiens
YTKIFVGGC

SEQ ID NO: 365696 - protein, 9 aa, Homo Sapiens
GGGPSCRGP

SEQ ID NO: 365697 - protein, 9 aa, Homo Sapiens
KRDINRRAM

SEQ ID NO: 365698 - protein, 9 aa, Homo Sapiens
LQDHKWELL

SEQ ID NO: 365699 - protein, 9 aa, Homo Sapiens
EFAVNPEKI

SEQ ID NO: 365700 - protein, 9 aa, Homo Sapiens
TEPNVVSVS

SEQ ID NO: 365701 - protein, 9 aa, Homo Sapiens
GIENNVLRH

SEQ ID NO: 365702 - protein, 9 aa, Homo Sapiens
AGGDCGSCC

SEQ ID NO: 365703 - protein, 9 aa, Homo Sapiens
NPELWATMR

SEQ ID NO: 365704 - protein, 9 aa, Homo Sapiens
HFPRGSSSR

SEQ ID NO: 365705 - protein, 9 aa, Homo Sapiens
IECRVFKTD

SEQ ID NO: 365706 - protein, 9 aa, Homo Sapiens
SIANSNSLN

SEQ ID NO: 365707 - protein, 9 aa, Homo Sapiens
PRHIKKFLD

SEQ ID NO: 365708 - protein, 9 aa, Homo Sapiens
SRPPSASSP

SEQ ID NO: 365709 - protein, 9 aa, Homo Sapiens
QPRQPGPQG

SEQ ID NO: 365710 - protein, 9 aa, Homo Sapiens
KIKELQALI

SEQ ID NO: 365711 - protein, 9 aa, Homo Sapiens
ASAVSSPTR

SEQ ID NO: 365712 - protein, 9 aa, Homo Sapiens
ATGSSRGTS

SEQ ID NO: 365713 - protein, 9 aa, Homo Sapiens
EWDYIKHLR

SEQ ID NO: 365714 - protein, 9 aa, Homo Sapiens
TGMKSKESG

SEQ ID NO: 365715 - protein, 9 aa, Homo Sapiens
PPMPDKDRL

SEQ ID NO: 365716 - protein, 9 aa, Homo Sapiens
LKARGALAT

SEQ ID NO: 365717 - protein, 9 aa, Homo Sapiens
KQVFWERLV

SEQ ID NO: 365718 - protein, 9 aa, Homo Sapiens
NLKKRKKKK

SEQ ID NO: 365719 - protein, 9 aa, Homo Sapiens
LHWEPVPLK

SEQ ID NO: 365720 - protein, 9 aa, Homo Sapiens
RLYHAHPYQ

SEQ ID NO: 365721 - protein, 9 aa, Homo Sapiens
KKSKTLLEF

SEQ ID NO: 365722 - protein, 9 aa, Homo Sapiens
ESPALKQVS

SEQ ID NO: 365723 - protein, 9 aa, Homo Sapiens
EPRVVVVGH

SEQ ID NO: 365724 - protein, 9 aa, Homo Sapiens
TAAEEPRRP

SEQ ID NO: 365725 - protein, 9 aa, Homo Sapiens
SKKTLLKRM

SEQ ID NO: 365726 - protein, 9 aa, Homo Sapiens
GEHCPSAPD

SEQ ID NO: 365727 - protein, 9 aa, Homo Sapiens
ATAPSPFPS

SEQ ID NO: 365728 - protein, 9 aa, Homo Sapiens
ASTSRSSAR

SEQ ID NO: 365729 - protein, 9 aa, Homo Sapiens
LYHLVSDDV

SEQ ID NO: 365730 - protein, 9 aa, Homo Sapiens
ALDCIFGVE

SEQ ID NO: 365731 - protein, 9 aa, Homo Sapiens
VHVVEALHQ

SEQ ID NO: 365732 - protein, 9 aa, Homo Sapiens
GGAPPAGRS

SEQ ID NO: 365733 - protein, 9 aa, Homo Sapiens
ALEPEAEGS

SEQ ID NO: 365734 - protein, 9 aa, Homo Sapiens
TRAETREEH

SEQ ID NO: 365735 - protein, 9 aa, Homo Sapiens
GSRGLRLLL

SEQ ID NO: 365736 - protein, 9 aa, Homo Sapiens
GGGAPRALQ

SEQ ID NO: 365737 - protein, 9 aa, Homo Sapiens
CSQQEQALE

SEQ ID NO: 365738 - protein, 9 aa, Homo Sapiens
SPDVGFPFV

SEQ ID NO: 365739 - protein, 9 aa, Homo Sapiens
LEEQLWKEV

SEQ ID NO: 365740 - protein, 9 aa, Homo Sapiens
CTTFTRHSL

SEQ ID NO: 365741 - protein, 9 aa, Homo Sapiens
VAARACAAT

SEQ ID NO: 365742 - protein, 9 aa, Homo Sapiens
RVWYTCSMT

SEQ ID NO: 365743 - protein, 9 aa, Homo Sapiens
WDILNRQFM

SEQ ID NO: 365744 - protein, 9 aa, Homo Sapiens
SEGQVDVEN

SEQ ID NO: 365745 - protein, 9 aa, Homo Sapiens
YLTKGHSHQ

SEQ ID NO: 365746 - protein, 9 aa, Homo Sapiens
HWEPVPLKS

SEQ ID NO: 365747 - protein, 9 aa, Homo Sapiens
DHCLQTRDA

SEQ ID NO: 365748 - protein, 9 aa, Homo Sapiens
LPEKGPLSL

SEQ ID NO: 365749 - protein, 9 aa, Homo Sapiens
GPPPPYHDT

SEQ ID NO: 365750 - protein, 9 aa, Homo Sapiens
LLGGKTIEC

SEQ ID NO: 365751 - protein, 9 aa, Homo Sapiens
WALFYPKRV

SEQ ID NO: 365752 - protein, 9 aa, Homo Sapiens
RTPLTQTPA

SEQ ID NO: 365753 - protein, 9 aa, Homo Sapiens
MQNKVFQER

SEQ ID NO: 365754 - protein, 9 aa, Homo Sapiens
KCFLLAVDV

SEQ ID NO: 365755 - protein, 9 aa, Homo Sapiens
LLGPLFNNS

SEQ ID NO: 365756 - protein, 9 aa, Homo Sapiens
QSERKNQAP

SEQ ID NO: 365757 - protein, 9 aa, Homo Sapiens
VEPTGKCFL

SEQ ID NO: 365758 - protein, 9 aa, Homo Sapiens
PLPISKERV

SEQ ID NO: 365759 - protein, 9 aa, Homo Sapiens
IYEVLRNSG

SEQ ID NO: 365760 - protein, 9 aa, Homo Sapiens
PRIHPLPGP

SEQ ID NO: 365761 - protein, 9 aa, Homo Sapiens
KSLLTKKKA

SEQ ID NO: 365762 - protein, 9 aa, Homo Sapiens
KAIELLKRL

SEQ ID NO: 365763 - protein, 9 aa, Homo Sapiens
FCGLLTLHW

SEQ ID NO: 365764 - protein, 9 aa, Homo Sapiens
LVLKELRNP

SEQ ID NO: 365765 - protein, 9 aa, Homo Sapiens
YVLEVRHFS

SEQ ID NO: 365766 - protein, 9 aa, Homo Sapiens
LNRQFMNSA

SEQ ID NO: 365767 - protein, 9 aa, Homo Sapiens
VEPASNGLV

SEQ ID NO: 365768 - protein, 9 aa, Homo Sapiens
MEHISPVPP

SEQ ID NO: 365769 - protein, 9 aa, Homo Sapiens
RPCRMRLYQ

SEQ ID NO: 365770 - protein, 9 aa, Homo Sapiens
MKMHTARVC

SEQ ID NO: 365771 - protein, 9 aa, Homo Sapiens
VFWERLVHL

SEQ ID NO: 365772 - protein, 9 aa, Homo Sapiens
LTMPELTQQ

SEQ ID NO: 365773 - protein, 9 aa, Homo Sapiens
TTSSPKFGE

SEQ ID NO: 365774 - protein, 9 aa, Homo Sapiens
LVGLSCVTC

SEQ ID NO: 365775 - protein, 9 aa, Homo Sapiens
LGFAQDLPI

SEQ ID NO: 365776 - protein, 9 aa, Homo Sapiens
PSRPPTVRR

SEQ ID NO: 365777 - protein, 9 aa, Homo Sapiens
QLGAHPACH

SEQ ID NO: 365778 - protein, 9 aa, Homo Sapiens
LGHITFGGL

SEQ ID NO: 365779 - protein, 9 aa, Homo Sapiens
PRSKRRCPF

SEQ ID NO: 365780 - protein, 9 aa, Homo Sapiens
MPELTQQMF

SEQ ID NO: 365781 - protein, 9 aa, Homo Sapiens
ESLSPIRDM

SEQ ID NO: 365782 - protein, 9 aa, Homo Sapiens
LQRSSCFGG

SEQ ID NO: 365783 - protein, 9 aa, Homo Sapiens
AVLLVDALL

SEQ ID NO: 365784 - protein, 9 aa, Homo Sapiens
SLCPQGLSN

SEQ ID NO: 365785 - protein, 9 aa, Homo Sapiens
LPLPPPVWA

SEQ ID NO: 365786 - protein, 9 aa, Homo Sapiens
HGLGLENRQ

SEQ ID NO: 365787 - protein, 9 aa, Homo Sapiens
GVLSPRIHP

SEQ ID NO: 365788 - protein, 9 aa, Homo Sapiens
MKGGDRVPV

SEQ ID NO: 365789 - protein, 9 aa, Homo Sapiens
TSFWSISSG

SEQ ID NO: 365790 - protein, 9 aa, Homo Sapiens
PSIAAYSKN

SEQ ID NO: 365791 - protein, 9 aa, Homo Sapiens
EKQPLVSSR

SEQ ID NO: 365792 - protein, 9 aa, Homo Sapiens
SATSASGSG

SEQ ID NO: 365793 - protein, 9 aa, Homo Sapiens
ASAAVTQCR

SEQ ID NO: 365794 - protein, 9 aa, Homo Sapiens
AWAGRTGAG

SEQ ID NO: 365795 - protein, 9 aa, Homo Sapiens
HKLESPALK

SEQ ID NO: 365796 - protein, 9 aa, Homo Sapiens
KTAHVPFKF

SEQ ID NO: 365797 - protein, 9 aa, Homo Sapiens
FVGQISTLV

SEQ ID NO: 365798 - protein, 9 aa, Homo Sapiens
EEELDASNP

SEQ ID NO: 365799 - protein, 9 aa, Homo Sapiens
WSPRPPGAS

SEQ ID NO: 365800 - protein, 9 aa, Homo Sapiens
TYVCLKFHT

SEQ ID NO: 365801 - protein, 9 aa, Homo Sapiens
MLSSVLEWC

SEQ ID NO: 365802 - protein, 9 aa, Homo Sapiens
ACRFMECLK

SEQ ID NO: 365803 - protein, 9 aa, Homo Sapiens
DTCRSVLTV

SEQ ID NO: 365804 - protein, 9 aa, Homo Sapiens
QPSRLPKTW

SEQ ID NO: 365805 - protein, 9 aa, Homo Sapiens
LAHFNTETG

SEQ ID NO: 365806 - protein, 9 aa, Homo Sapiens
RTSRTRETL

SEQ ID NO: 365807 - protein, 9 aa, Homo Sapiens
EGARARAGA

SEQ ID NO: 365808 - protein, 9 aa, Homo Sapiens
KAPEKGSLH

SEQ ID NO: 365809 - protein, 9 aa, Homo Sapiens
LSPRIHPLP

SEQ ID NO: 365810 - protein, 9 aa, Homo Sapiens
GTWTAWMPC

SEQ ID NO: 365811 - protein, 9 aa, Homo Sapiens
KNVTKPLNN

SEQ ID NO: 365812 - protein, 9 aa, Homo Sapiens
AADRTFQKW

SEQ ID NO: 365813 - protein, 9 aa, Homo Sapiens
ARSRRRWSS

SEQ ID NO: 365814 - protein, 9 aa, Homo Sapiens
LCLVLLAML

SEQ ID NO: 365815 - protein, 9 aa, Homo Sapiens
LISLKMNSS

SEQ ID NO: 365816 - protein, 9 aa, Homo Sapiens
PMVPGETGL

SEQ ID NO: 365817 - protein, 9 aa, Homo Sapiens
LTGKVWDEV

SEQ ID NO: 365818 - protein, 9 aa, Homo Sapiens
SFMPQLLAY

SEQ ID NO: 365819 - protein, 9 aa, Homo Sapiens
VPEQLPQVQ

SEQ ID NO: 365820 - protein, 9 aa, Homo Sapiens
NTPTARADL

SEQ ID NO: 365821 - protein, 9 aa, Homo Sapiens
SVLGRIQGR

SEQ ID NO: 365822 - protein, 9 aa, Homo Sapiens
RVTPGPPPC

SEQ ID NO: 365823 - protein, 9 aa, Homo Sapiens
PAEGASLWE

SEQ ID NO: 365824 - protein, 9 aa, Homo Sapiens
WLSEGEHMV

SEQ ID NO: 365825 - protein, 9 aa, Homo Sapiens
SYIPYNSQQ

SEQ ID NO: 365826 - protein, 9 aa, Homo Sapiens
SSSSSSGYL

SEQ ID NO: 365827 - protein, 9 aa, Homo Sapiens
RGVSLNLTQ

SEQ ID NO: 365828 - protein, 9 aa, Homo Sapiens
EDSFLENEK

SEQ ID NO: 365829 - protein, 9 aa, Homo Sapiens
ATNSAGMRY

SEQ ID NO: 365830 - protein, 9 aa, Homo Sapiens
PHASINVHL

SEQ ID NO: 365831 - protein, 9 aa, Homo Sapiens
SLIGMEGGN

SEQ ID NO: 365832 - protein, 9 aa, Homo Sapiens
PWWNVLPLS

SEQ ID NO: 365833 - protein, 9 aa, Homo Sapiens
NQIYTVKDI

SEQ ID NO: 365834 - protein, 9 aa, Homo Sapiens
GRSDLPQIR

SEQ ID NO: 365835 - protein, 9 aa, Homo Sapiens
PGPHAWTST

SEQ ID NO: 365836 - protein, 9 aa, Homo Sapiens
ILAFISLDH

SEQ ID NO: 365837 - protein, 9 aa, Homo Sapiens
GRSASRTSN

SEQ ID NO: 365838 - protein, 9 aa, Homo Sapiens
IAPSTEWWT

SEQ ID NO: 365839 - protein, 9 aa, Homo Sapiens
EHCPSAPDN

SEQ ID NO: 365840 - protein, 9 aa, Homo Sapiens
IYRSALNSA

SEQ ID NO: 365841 - protein, 9 aa, Homo Sapiens
GEELVIHNR

SEQ ID NO: 365842 - protein, 9 aa, Homo Sapiens
NRSASITNM

SEQ ID NO: 365843 - protein, 9 aa, Homo Sapiens
FHAAWMVKR

SEQ ID NO: 365844 - protein, 9 aa, Homo Sapiens
MFQSERKNQ

SEQ ID NO: 365845 - protein, 9 aa, Homo Sapiens
MRRQWSLWV

SEQ ID NO: 365846 - protein, 9 aa, Homo Sapiens
QLPQVQREH

SEQ ID NO: 365847 - protein, 9 aa, Homo Sapiens
WNLSLEGLT

SEQ ID NO: 365848 - protein, 9 aa, Homo Sapiens
RTPWPLPMC

SEQ ID NO: 365849 - protein, 9 aa, Homo Sapiens
PTMEAPQRW

SEQ ID NO: 365850 - protein, 9 aa, Homo Sapiens
KSPMRLNLT

SEQ ID NO: 365851 - protein, 9 aa, Homo Sapiens
HEDTPLWSS

SEQ ID NO: 365852 - protein, 9 aa, Homo Sapiens
IVRDSLWRR

SEQ ID NO: 365853 - protein, 9 aa, Homo Sapiens
TRLTTVSGG

SEQ ID NO: 365854 - protein, 9 aa, Homo Sapiens
ETQDKACIS

SEQ ID NO: 365855 - protein, 9 aa, Homo Sapiens
GIQVCMKWC

SEQ ID NO: 365856 - protein, 9 aa, Homo Sapiens
EEGIGEELV

SEQ ID NO: 365857 - protein, 9 aa, Homo Sapiens
DRGSLGHIT

SEQ ID NO: 365858 - protein, 9 aa, Homo Sapiens
PDCSWPQGA

SEQ ID NO: 365859 - protein, 9 aa, Homo Sapiens
SLSPIRDMK

SEQ ID NO: 365860 - protein, 9 aa, Homo Sapiens
QLPQASSTR

SEQ ID NO: 365861 - protein, 9 aa, Homo Sapiens
YPDCIMNTF

SEQ ID NO: 365862 - protein, 9 aa, Homo Sapiens
VCDWLATCT

SEQ ID NO: 365863 - protein, 9 aa, Homo Sapiens
LTDQLSSQL

SEQ ID NO: 365864 - protein, 9 aa, Homo Sapiens
VLLQSALDC

SEQ ID NO: 365865 - protein, 9 aa, Homo Sapiens
QFAVLLVDA

SEQ ID NO: 365866 - protein, 9 aa, Homo Sapiens
RCMYGSMTQ

SEQ ID NO: 365867 - protein, 9 aa, Homo Sapiens
FLRCHLTQT

SEQ ID NO: 365868 - protein, 9 aa, Homo Sapiens
AIALFEIGS

SEQ ID NO: 365869 - protein, 9 aa, Homo Sapiens
PRAGLAKII

SEQ ID NO: 365870 - protein, 9 aa, Homo Sapiens
CTDITMKHK

SEQ ID NO: 365871 - protein, 9 aa, Homo Sapiens
NVRNKSFYM

SEQ ID NO: 365872 - protein, 9 aa, Homo Sapiens
RYLWQENHL

SEQ ID NO: 365873 - protein, 9 aa, Homo Sapiens
RGPPRQRAA

SEQ ID NO: 365874 - protein, 9 aa, Homo Sapiens
FYKGTVPHL

SEQ ID NO: 365875 - protein, 9 aa, Homo Sapiens
AQQRVPKGG

SEQ ID NO: 365876 - protein, 9 aa, Homo Sapiens
WPCSSSVSS

SEQ ID NO: 365877 - protein, 9 aa, Homo Sapiens
KWTRMLRAT

SEQ ID NO: 365878 - protein, 9 aa, Homo Sapiens
KNTSTYHVS

SEQ ID NO: 365879 - protein, 9 aa, Homo Sapiens
VVTDLFPVL

SEQ ID NO: 365880 - protein, 9 aa, Homo Sapiens
IIGTTHSSI

SEQ ID NO: 365881 - protein, 9 aa, Homo Sapiens
PHAQRHELV

SEQ ID NO: 365882 - protein, 9 aa, Homo Sapiens
VQREHLDIR

SEQ ID NO: 365883 - protein, 9 aa, Homo Sapiens
TSRARRTNG

SEQ ID NO: 365884 - protein, 9 aa, Homo Sapiens
LEVLKKILP

SEQ ID NO: 365885 - protein, 9 aa, Homo Sapiens
CGRDDYDPD

SEQ ID NO: 365886 - protein, 9 aa, Homo Sapiens
ECGKSFNDS

SEQ ID NO: 365887 - protein, 9 aa, Homo Sapiens
QIHENIIQK

SEQ ID NO: 365888 - protein, 9 aa, Homo Sapiens
PSSWDHSFV

SEQ ID NO: 365889 - protein, 9 aa, Homo Sapiens
ASATSASGS

SEQ ID NO: 365890 - protein, 9 aa, Homo Sapiens
PLWPKKIII

SEQ ID NO: 365891 - protein, 9 aa, Homo Sapiens
WDYIKHLRD

SEQ ID NO: 365892 - protein, 9 aa, Homo Sapiens
PARLALRAW

SEQ ID NO: 365893 - protein, 9 aa, Homo Sapiens
GQPRQPGPQ

SEQ ID NO: 365894 - protein, 9 aa, Homo Sapiens
AKKLLQLKI

SEQ ID NO: 365895 - protein, 9 aa, Homo Sapiens
TVGSDAYCL

SEQ ID NO: 365896 - protein, 9 aa, Homo Sapiens
FLRKHYLVE

SEQ ID NO: 365897 - protein, 9 aa, Homo Sapiens
MQRGAVLCL

SEQ ID NO: 365898 - protein, 9 aa, Homo Sapiens
CIGPVSTMI

SEQ ID NO: 365899 - protein, 9 aa, Homo Sapiens
TTRTMKSHQ

SEQ ID NO: 365900 - protein, 9 aa, Homo Sapiens
EVMPRTLEG

SEQ ID NO: 365901 - protein, 9 aa, Homo Sapiens
DEAQQKIFD

SEQ ID NO: 365902 - protein, 9 aa, Homo Sapiens
QEREHTPCA

SEQ ID NO: 365903 - protein, 9 aa, Homo Sapiens
PECFRHAPP

SEQ ID NO: 365904 - protein, 9 aa, Homo Sapiens
ELEDLYAKL

SEQ ID NO: 365905 - protein, 9 aa, Homo Sapiens
AACSLDLHF

SEQ ID NO: 365906 - protein, 9 aa, Homo Sapiens
LQAVLQDYE

SEQ ID NO: 365907 - protein, 9 aa, Homo Sapiens
SPTLLKTRC

SEQ ID NO: 365908 - protein, 9 aa, Homo Sapiens
KMDATRAGD

SEQ ID NO: 365909 - protein, 9 aa, Homo Sapiens
PWSVIDPQA

SEQ ID NO: 365910 - protein, 9 aa, Homo Sapiens
FGTRPLFVE

SEQ ID NO: 365911 - protein, 9 aa, Homo Sapiens
YPKRVMDQA

SEQ ID NO: 365912 - protein, 9 aa, Homo Sapiens
VHMVRPNQD

SEQ ID NO: 365913 - protein, 9 aa, Homo Sapiens
PRLASAVSS

SEQ ID NO: 365914 - protein, 9 aa, Homo Sapiens
RPQQPVAQW

SEQ ID NO: 365915 - protein, 9 aa, Homo Sapiens
RKLIQKMYP

SEQ ID NO: 365916 - protein, 9 aa, Homo Sapiens
SNAGCDSPA

SEQ ID NO: 365917 - protein, 9 aa, Homo Sapiens
GLVKMHEIF

SEQ ID NO: 365918 - protein, 9 aa, Homo Sapiens
VVILIRDEI

SEQ ID NO: 365919 - protein, 9 aa, Homo Sapiens
VEQCLRVLD

SEQ ID NO: 365920 - protein, 9 aa, Homo Sapiens
INMRQLYGD

SEQ ID NO: 365921 - protein, 9 aa, Homo Sapiens
SLKQGKVPE

SEQ ID NO: 365922 - protein, 9 aa, Homo Sapiens
STFHQPELV

SEQ ID NO: 365923 - protein, 9 aa, Homo Sapiens
PAEGKCLSA

SEQ ID NO: 365924 - protein, 9 aa, Homo Sapiens
ISGWLCLRR

SEQ ID NO: 365925 - protein, 9 aa, Homo Sapiens
RSVARQAQT

SEQ ID NO: 365926 - protein, 9 aa, Homo Sapiens
QSVFNMNAP

SEQ ID NO: 365927 - protein, 9 aa, Homo Sapiens
KIFMHRNLK

SEQ ID NO: 365928 - protein, 9 aa, Homo Sapiens
RSREVIRNT

SEQ ID NO: 365929 - protein, 9 aa, Homo Sapiens
KLPSTSTLA

SEQ ID NO: 365930 - protein, 9 aa, Homo Sapiens
CTLGSPKPG

SEQ ID NO: 365931 - protein, 9 aa, Homo Sapiens
VYDKPRTTE

SEQ ID NO: 365932 - protein, 9 aa, Homo Sapiens
RPSTPASPG

SEQ ID NO: 365933 - protein, 9 aa, Homo Sapiens
CPAAPRLAS

SEQ ID NO: 365934 - protein, 9 aa, Homo Sapiens
WFCAKIRIL

SEQ ID NO: 365935 - protein, 9 aa, Homo Sapiens
PRVVVVGHG

SEQ ID NO: 365936 - protein, 9 aa, Homo Sapiens
DVILDRKKK

SEQ ID NO: 365937 - protein, 9 aa, Homo Sapiens
VLFHCSECG

SEQ ID NO: 365938 - protein, 9 aa, Homo Sapiens
DAVWGGGRP

SEQ ID NO: 365939 - protein, 9 aa, Homo Sapiens
MLLQLLEGM

SEQ ID NO: 365940 - protein, 9 aa, Homo Sapiens
TTDAIFARR

SEQ ID NO: 365941 - protein, 9 aa, Homo Sapiens
ICIDMPTIY

SEQ ID NO: 365942 - protein, 9 aa, Homo Sapiens
KASSPATMW

SEQ ID NO: 365943 - protein, 9 aa, Homo Sapiens
CLQGKPTSQ

SEQ ID NO: 365944 - protein, 9 aa, Homo Sapiens
PKYGQGQLN

SEQ ID NO: 365945 - protein, 9 aa, Homo Sapiens
THNPINIEL

SEQ ID NO: 365946 - protein, 9 aa, Homo Sapiens
MVTPAKKHV

SEQ ID NO: 365947 - protein, 9 aa, Homo Sapiens
AGSPRPGPR

SEQ ID NO: 365948 - protein, 9 aa, Homo Sapiens
WGQTDLTVL

SEQ ID NO: 365949 - protein, 9 aa, Homo Sapiens
ILSYERQYH

SEQ ID NO: 365950 - protein, 9 aa, Homo Sapiens
RGQPGPAAV

SEQ ID NO: 365951 - protein, 9 aa, Homo Sapiens
TLSTIVAGS

SEQ ID NO: 365952 - protein, 9 aa, Homo Sapiens
NRIEEQSQT

SEQ ID NO: 365953 - protein, 9 aa, Homo Sapiens
GSRERIPPQ

SEQ ID NO: 365954 - protein, 9 aa, Homo Sapiens
QPTEYEHAT

SEQ ID NO: 365955 - protein, 9 aa, Homo Sapiens
RRTCWMTWR

SEQ ID NO: 365956 - protein, 9 aa, Homo Sapiens
PPCLTRMRK

SEQ ID NO: 365957 - protein, 9 aa, Homo Sapiens
FMPQLLAYP

SEQ ID NO: 365958 - protein, 9 aa, Homo Sapiens
ITVSFVGQI

SEQ ID NO: 365959 - protein, 9 aa, Homo Sapiens
HNPINIELL

SEQ ID NO: 365960 - protein, 9 aa, Homo Sapiens
KRAKKIWKY

SEQ ID NO: 365961 - protein, 9 aa, Homo Sapiens
TGAGGDCGS

SEQ ID NO: 365962 - protein, 9 aa, Homo Sapiens
QSLLSLYSV

SEQ ID NO: 365963 - protein, 9 aa, Homo Sapiens
WNTENVDVC

SEQ ID NO: 365964 - protein, 9 aa, Homo Sapiens
GVCKVMHPK

SEQ ID NO: 365965 - protein, 9 aa, Homo Sapiens
EEPELSPTY

SEQ ID NO: 365966 - protein, 9 aa, Homo Sapiens
RGLQVPQPP

SEQ ID NO: 365967 - protein, 9 aa, Homo Sapiens
EKDATKEFS

SEQ ID NO: 365968 - protein, 9 aa, Homo Sapiens
AGRCACSHP

SEQ ID NO: 365969 - protein, 9 aa, Homo Sapiens
SRHVHHEKL

SEQ ID NO: 365970 - protein, 9 aa, Homo Sapiens
DTPGGRPPS

SEQ ID NO: 365971 - protein, 9 aa, Homo Sapiens
SFLVKRNLI

SEQ ID NO: 365972 - protein, 9 aa, Homo Sapiens
PDAYPGRRV

SEQ ID NO: 365973 - protein, 9 aa, Homo Sapiens
GGKFAPFFV

SEQ ID NO: 365974 - protein, 9 aa, Homo Sapiens
CPSSKWTRM

SEQ ID NO: 365975 - protein, 9 aa, Homo Sapiens
SRAGGTRLT

SEQ ID NO: 365976 - protein, 9 aa, Homo Sapiens
TGVGAKKEG

SEQ ID NO: 365977 - protein, 9 aa, Homo Sapiens
VVGCILQPV

SEQ ID NO: 365978 - protein, 9 aa, Homo Sapiens
YSSYIPYNS

SEQ ID NO: 365979 - protein, 9 aa, Homo Sapiens
PPKPSLSLS

SEQ ID NO: 365980 - protein, 9 aa, Homo Sapiens
FTRSSPQTD

SEQ ID NO: 365981 - protein, 9 aa, Homo Sapiens
IVIQKKNIT

SEQ ID NO: 365982 - protein, 9 aa, Homo Sapiens
LSIKLHLLM

SEQ ID NO: 365983 - protein, 9 aa, Homo Sapiens
MKSHQAVSR

SEQ ID NO: 365984 - protein, 9 aa, Homo Sapiens
RPFKKWNYI

SEQ ID NO: 365985 - protein, 9 aa, Homo Sapiens
CMFPKTTDT

SEQ ID NO: 365986 - protein, 9 aa, Homo Sapiens
LGRRTCWMT

SEQ ID NO: 365987 - protein, 9 aa, Homo Sapiens
EGVVAAMGQ

SEQ ID NO: 365988 - protein, 9 aa, Homo Sapiens
EDTPLWSSS

SEQ ID NO: 365989 - protein, 9 aa, Homo Sapiens
TPLDLATTD

SEQ ID NO: 365990 - protein, 9 aa, Homo Sapiens
GCILQPVFR

SEQ ID NO: 365991 - protein, 9 aa, Homo Sapiens
KALSSAFLG

SEQ ID NO: 365992 - protein, 9 aa, Homo Sapiens
PAAPGWPPL

SEQ ID NO: 365993 - protein, 9 aa, Homo Sapiens
NWYHITLMQ

SEQ ID NO: 365994 - protein, 9 aa, Homo Sapiens
FHALQPSMT

SEQ ID NO: 365995 - protein, 9 aa, Homo Sapiens
QQRRPPEKR

SEQ ID NO: 365996 - protein, 9 aa, Homo Sapiens
GCPAGCTPP

SEQ ID NO: 365997 - protein, 9 aa, Homo Sapiens
GQRSHFQHV

SEQ ID NO: 365998 - protein, 9 aa, Homo Sapiens
NCKEAINVL

SEQ ID NO: 365999 - protein, 9 aa, Homo Sapiens
PFQSMQSVF

SEQ ID NO: 366000 - protein, 9 aa, Homo Sapiens
EDQSLRLNT

SEQ ID NO: 366001 - protein, 9 aa, Homo Sapiens
LPLPLSGEA

SEQ ID NO: 366002 - protein, 9 aa, Homo Sapiens
EAPAEGKCL

SEQ ID NO: 366003 - protein, 9 aa, Homo Sapiens
APFQSMQSV

SEQ ID NO: 366004 - protein, 9 aa, Homo Sapiens
SLADWPSNG

SEQ ID NO: 366005 - protein, 9 aa, Homo Sapiens
EPQNIRRNE

SEQ ID NO: 366006 - protein, 9 aa, Homo Sapiens
TMIPPSSKP

SEQ ID NO: 366007 - protein, 9 aa, Homo Sapiens
RRPCRGTAR

SEQ ID NO: 366008 - protein, 9 aa, Homo Sapiens
ASSVLGAIP

SEQ ID NO: 366009 - protein, 9 aa, Homo Sapiens
LWPKKIIIR

SEQ ID NO: 366010 - protein, 9 aa, Homo Sapiens
RLLYHAMKD

SEQ ID NO: 366011 - protein, 9 aa, Homo Sapiens
AESLSPIRD

SEQ ID NO: 366012 - protein, 9 aa, Homo Sapiens
SVFNMNAPV

SEQ ID NO: 366013 - protein, 9 aa, Homo Sapiens
EEEKRKKLN

SEQ ID NO: 366014 - protein, 9 aa, Homo Sapiens
PDSLTDDCE

SEQ ID NO: 366015 - protein, 9 aa, Homo Sapiens
HQMTRERME

SEQ ID NO: 366016 - protein, 9 aa, Homo Sapiens
LDPRIAIAL

SEQ ID NO: 366017 - protein, 9 aa, Homo Sapiens
LHVPDVSLR

SEQ ID NO: 366018 - protein, 9 aa, Homo Sapiens
TRGVGIHVN

SEQ ID NO: 366019 - protein, 9 aa, Homo Sapiens
SRSHTSYES

SEQ ID NO: 366020 - protein, 9 aa, Homo Sapiens
DCSWPQGAP

SEQ ID NO: 366021 - protein, 9 aa, Homo Sapiens
RGYGGTKIC

SEQ ID NO: 366022 - protein, 9 aa, Homo Sapiens
CRFMECLKV

SEQ ID NO: 366023 - protein, 9 aa, Homo Sapiens
GEGSWAGAD

SEQ ID NO: 366024 - protein, 9 aa, Homo Sapiens
GQQKIREEK

SEQ ID NO: 366025 - protein, 9 aa, Homo Sapiens
RPVLAGGGN

SEQ ID NO: 366026 - protein, 9 aa, Homo Sapiens
PVEDLTATS

SEQ ID NO: 366027 - protein, 9 aa, Homo Sapiens
NVRLSWEYW

SEQ ID NO: 366028 - protein, 9 aa, Homo Sapiens
SIKLHLLMD

SEQ ID NO: 366029 - protein, 9 aa, Homo Sapiens
LALNHMGRR

SEQ ID NO: 366030 - protein, 9 aa, Homo Sapiens
MDDHRAVGK

SEQ ID NO: 366031 - protein, 9 aa, Homo Sapiens
SHTRSHLRQ

SEQ ID NO: 366032 - protein, 9 aa, Homo Sapiens
NTEVKKVME

SEQ ID NO: 366033 - protein, 9 aa, Homo Sapiens
PPWAVYTAM

SEQ ID NO: 366034 - protein, 9 aa, Homo Sapiens
FLTEDKKNG

SEQ ID NO: 366035 - protein, 9 aa, Homo Sapiens
SYRLVLKEL

SEQ ID NO: 366036 - protein, 9 aa, Homo Sapiens
ECFRHAPPP

SEQ ID NO: 366037 - protein, 9 aa, Homo Sapiens
YHTYDRFLL

SEQ ID NO: 366038 - protein, 9 aa, Homo Sapiens
DLTATSVTI

SEQ ID NO: 366039 - protein, 9 aa, Homo Sapiens
PDPAGSPRP

SEQ ID NO: 366040 - protein, 9 aa, Homo Sapiens
PSGQQQQQQ

SEQ ID NO: 366041 - protein, 9 aa, Homo Sapiens
MDMPEVLES

SEQ ID NO: 366042 - protein, 9 aa, Homo Sapiens
AARLFTHFA

SEQ ID NO: 366043 - protein, 9 aa, Homo Sapiens
SHTSYESIT

SEQ ID NO: 366044 - protein, 9 aa, Homo Sapiens
QGCVPEQLP

SEQ ID NO: 366045 - protein, 9 aa, Homo Sapiens
ASALPTAVT

SEQ ID NO: 366046 - protein, 9 aa, Homo Sapiens
TNWMSIWLY

SEQ ID NO: 366047 - protein, 9 aa, Homo Sapiens
RAHLAVEAC

SEQ ID NO: 366048 - protein, 9 aa, Homo Sapiens
MPTIYQKNR

SEQ ID NO: 366049 - protein, 9 aa, Homo Sapiens
PKLLMSIYS

SEQ ID NO: 366050 - protein, 9 aa, Homo Sapiens
AQTPSPVSG

SEQ ID NO: 366051 - protein, 9 aa, Homo Sapiens
RTHFPRGSS

SEQ ID NO: 366052 - protein, 9 aa, Homo Sapiens
CAVGACTLS

SEQ ID NO: 366053 - protein, 9 aa, Homo Sapiens
TLLKRMHFD

SEQ ID NO: 366054 - protein, 9 aa, Homo Sapiens
KKLAHLTWK

SEQ ID NO: 366055 - protein, 9 aa, Homo Sapiens
RLVDGSSRC

SEQ ID NO: 366056 - protein, 9 aa, Homo Sapiens
YDVVHVVEA

SEQ ID NO: 366057 - protein, 9 aa, Homo Sapiens
APTPRTASA

SEQ ID NO: 366058 - protein, 9 aa, Homo Sapiens
VDCPVPFCA

SEQ ID NO: 366059 - protein, 9 aa, Homo Sapiens
LLRQFLPAL

SEQ ID NO: 366060 - protein, 9 aa, Homo Sapiens
LCVKRGKPC

SEQ ID NO: 366061 - protein, 9 aa, Homo Sapiens
LTWKQCLNK

SEQ ID NO: 366062 - protein, 9 aa, Homo Sapiens
LARSNYAAE

SEQ ID NO: 366063 - protein, 9 aa, Homo Sapiens
ASSSLVTVS

SEQ ID NO: 366064 - protein, 9 aa, Homo Sapiens
RRPTMEAPQ

SEQ ID NO: 366065 - protein, 9 aa, Homo Sapiens
YCQNGGTCH

SEQ ID NO: 366066 - protein, 9 aa, Homo Sapiens
CILSTKASN

SEQ ID NO: 366067 - protein, 9 aa, Homo Sapiens
GQTDLTVLG

SEQ ID NO: 366068 - protein, 9 aa, Homo Sapiens
ARQEREHTP

SEQ ID NO: 366069 - protein, 9 aa, Homo Sapiens
FPKTTDTSF

SEQ ID NO: 366070 - protein, 9 aa, Homo Sapiens
RPVSPAPSR

SEQ ID NO: 366071 - protein, 9 aa, Homo Sapiens
RGGNMAPMS

SEQ ID NO: 366072 - protein, 9 aa, Homo Sapiens
YCTYLDWLE

SEQ ID NO: 366073 - protein, 9 aa, Homo Sapiens
HPYQHLQDV

SEQ ID NO: 366074 - protein, 9 aa, Homo Sapiens
QNIRRNEMA

SEQ ID NO: 366075 - protein, 9 aa, Homo Sapiens
ASVMLDVPK

SEQ ID NO: 366076 - protein, 9 aa, Homo Sapiens
LNCDRYSMG

SEQ ID NO: 366077 - protein, 9 aa, Homo Sapiens
FVYPELLAD

SEQ ID NO: 366078 - protein, 9 aa, Homo Sapiens
GGPEERLTE

SEQ ID NO: 366079 - protein, 9 aa, Homo Sapiens
ASGRRVWYT

SEQ ID NO: 366080 - protein, 9 aa, Homo Sapiens
KGPARIPIP

SEQ ID NO: 366081 - protein, 9 aa, Homo Sapiens
SGGGGLGRS

SEQ ID NO: 366082 - protein, 9 aa, Homo Sapiens
ADMFKWQII

SEQ ID NO: 366083 - protein, 9 aa, Homo Sapiens
DPREQLRAL

SEQ ID NO: 366084 - protein, 9 aa, Homo Sapiens
GAWLLALPG

SEQ ID NO: 366085 - protein, 9 aa, Homo Sapiens
PQDGFAQWC

SEQ ID NO: 366086 - protein, 9 aa, Homo Sapiens
VTNNCQKAS

SEQ ID NO: 366087 - protein, 9 aa, Homo Sapiens
QSSGVPEVD

SEQ ID NO: 366088 - protein, 9 aa, Homo Sapiens
WAAGTSARP

SEQ ID NO: 366089 - protein, 9 aa, Homo Sapiens
FENLLAWAD

SEQ ID NO: 366090 - protein, 9 aa, Homo Sapiens
GTHSYVRIK

SEQ ID NO: 366091 - protein, 9 aa, Homo Sapiens
AAGDWDIDV

SEQ ID NO: 366092 - protein, 9 aa, Homo Sapiens
TCWRPDCTS

SEQ ID NO: 366093 - protein, 9 aa, Homo Sapiens
VMRRMSSHL

SEQ ID NO: 366094 - protein, 9 aa, Homo Sapiens
THMTSRDIK

SEQ ID NO: 366095 - protein, 9 aa, Homo Sapiens
VSPASPPTQ

SEQ ID NO: 366096 - protein, 9 aa, Homo Sapiens
GACGGSGGV

SEQ ID NO: 366097 - protein, 9 aa, Homo Sapiens
PRAKQPSRL

SEQ ID NO: 366098 - protein, 9 aa, Homo Sapiens
ACGLSAQPW

SEQ ID NO: 366099 - protein, 9 aa, Homo Sapiens
WVWSRPPSA

SEQ ID NO: 366100 - protein, 9 aa, Homo Sapiens
DSMDNDCEV

SEQ ID NO: 366101 - protein, 9 aa, Homo Sapiens
KKKLKKRKE

SEQ ID NO: 366102 - protein, 9 aa, Homo Sapiens
PQRAGSRER

SEQ ID NO: 366103 - protein, 9 aa, Homo Sapiens
CFLLTLPPW

SEQ ID NO: 366104 - protein, 9 aa, Homo Sapiens
GSGKAWGWE

SEQ ID NO: 366105 - protein, 9 aa, Homo Sapiens
RSLQRSSCF

SEQ ID NO: 366106 - protein, 9 aa, Homo Sapiens
PSSPPSSAS

SEQ ID NO: 366107 - protein, 9 aa, Homo Sapiens
STIVAGSTV

SEQ ID NO: 366108 - protein, 9 aa, Homo Sapiens
WMVPWGMEA

SEQ ID NO: 366109 - protein, 9 aa, Homo Sapiens
ESPDSRALV

SEQ ID NO: 366110 - protein, 9 aa, Homo Sapiens
GDFGLATEK

SEQ ID NO: 366111 - protein, 9 aa, Homo Sapiens
IASSVSPPQ

SEQ ID NO: 366112 - protein, 9 aa, Homo Sapiens
THFAEAGRS

SEQ ID NO: 366113 - protein, 9 aa, Homo Sapiens
DPRIAIALF

SEQ ID NO: 366114 - protein, 9 aa, Homo Sapiens
LAGKITDML

SEQ ID NO: 366115 - protein, 9 aa, Homo Sapiens
LAVGAEVNT

SEQ ID NO: 366116 - protein, 9 aa, Homo Sapiens
QNAAAASWP

SEQ ID NO: 366117 - protein, 9 aa, Homo Sapiens
NKLEEQLWK

SEQ ID NO: 366118 - protein, 9 aa, Homo Sapiens
QHVGLAQPL

SEQ ID NO: 366119 - protein, 9 aa, Homo Sapiens
TSLASGTSR

SEQ ID NO: 366120 - protein, 9 aa, Homo Sapiens
ARDALWARA

SEQ ID NO: 366121 - protein, 9 aa, Homo Sapiens
ELRLASYLV

SEQ ID NO: 366122 - protein, 9 aa, Homo Sapiens
GNYPEVLQE

SEQ ID NO: 366123 - protein, 9 aa, Homo Sapiens
CLCLRWITP

SEQ ID NO: 366124 - protein, 9 aa, Homo Sapiens
LASICITSC

SEQ ID NO: 366125 - protein, 9 aa, Homo Sapiens
NFNPGTLSS

SEQ ID NO: 366126 - protein, 9 aa, Homo Sapiens
WWTMVCNLA

SEQ ID NO: 366127 - protein, 9 aa, Homo Sapiens
TTTLHQMTR

SEQ ID NO: 366128 - protein, 9 aa, Homo Sapiens
CFSRLPSKA

SEQ ID NO: 366129 - protein, 9 aa, Homo Sapiens
RKLRPPQKK

SEQ ID NO: 366130 - protein, 9 aa, Homo Sapiens
FRFCGPLVK

SEQ ID NO: 366131 - protein, 9 aa, Homo Sapiens
FLLANLTFL

SEQ ID NO: 366132 - protein, 9 aa, Homo Sapiens
PDYFVDCPV

SEQ ID NO: 366133 - protein, 9 aa, Homo Sapiens
INTSWHTLH

SEQ ID NO: 366134 - protein, 9 aa, Homo Sapiens
SWQAQLPQA

SEQ ID NO: 366135 - protein, 9 aa, Homo Sapiens
KHYLVEDSL

SEQ ID NO: 366136 - protein, 9 aa, Homo Sapiens
VADNRIITL

SEQ ID NO: 366137 - protein, 9 aa, Homo Sapiens
VSLVSGPTA

SEQ ID NO: 366138 - protein, 9 aa, Homo Sapiens
SLWEEGFII

SEQ ID NO: 366139 - protein, 9 aa, Homo Sapiens
NPFICTASS

SEQ ID NO: 366140 - protein, 9 aa, Homo Sapiens
LSSQLDDNS

SEQ ID NO: 366141 - protein, 9 aa, Homo Sapiens
CVFMTTFRR

SEQ ID NO: 366142 - protein, 9 aa, Homo Sapiens
APAAGWAAR

SEQ ID NO: 366143 - protein, 9 aa, Homo Sapiens
DFKLELSCL

SEQ ID NO: 366144 - protein, 9 aa, Homo Sapiens
SHAPGTACV

SEQ ID NO: 366145 - protein, 9 aa, Homo Sapiens
VPVGQGCVP

SEQ ID NO: 366146 - protein, 9 aa, Homo Sapiens
PTDSLVCKA

SEQ ID NO: 366147 - protein, 9 aa, Homo Sapiens
SIGSYGLQE

SEQ ID NO: 366148 - protein, 9 aa, Homo Sapiens
CIDMPTIYQ

SEQ ID NO: 366149 - protein, 9 aa, Homo Sapiens
YLGDLTLLQ

SEQ ID NO: 366150 - protein, 9 aa, Homo Sapiens
VCAVGACTL

SEQ ID NO: 366151 - protein, 9 aa, Homo Sapiens
HPQAKAIGS

SEQ ID NO: 366152 - protein, 9 aa, Homo Sapiens
QHVGQVPQV

SEQ ID NO: 366153 - protein, 9 aa, Homo Sapiens
SEELARDAR

SEQ ID NO: 366154 - protein, 9 aa, Homo Sapiens
TAMGGQASW

SEQ ID NO: 366155 - protein, 9 aa, Homo Sapiens
LKAVVDSWN

SEQ ID NO: 366156 - protein, 9 aa, Homo Sapiens
DRQFSSQVS

SEQ ID NO: 366157 - protein, 9 aa, Homo Sapiens
ELVETRPAA

SEQ ID NO: 366158 - protein, 9 aa, Homo Sapiens
CSSCRSFRS

SEQ ID NO: 366159 - protein, 9 aa, Homo Sapiens
QEVHPQVHK

SEQ ID NO: 366160 - protein, 9 aa, Homo Sapiens
SKKLSPPVM

SEQ ID NO: 366161 - protein, 9 aa, Homo Sapiens
ITPTCRSPS

SEQ ID NO: 366162 - protein, 9 aa, Homo Sapiens
LNEQKELQR

SEQ ID NO: 366163 - protein, 9 aa, Homo Sapiens
VNVHVIRLL

SEQ ID NO: 366164 - protein, 9 aa, Homo Sapiens
ICLQHRVQD

SEQ ID NO: 366165 - protein, 9 aa, Homo Sapiens
PKRDRRSMG

SEQ ID NO: 366166 - protein, 9 aa, Homo Sapiens
TLFTRFACF

SEQ ID NO: 366167 - protein, 9 aa, Homo Sapiens
QVFLRCHLT

SEQ ID NO: 366168 - protein, 9 aa, Homo Sapiens
DCNEIKGEQ

SEQ ID NO: 366169 - protein, 9 aa, Homo Sapiens
DAVKFMLKT

SEQ ID NO: 366170 - protein, 9 aa, Homo Sapiens
TRMRKSTLT

SEQ ID NO: 366171 - protein, 9 aa, Homo Sapiens
GLIYVNGRM

SEQ ID NO: 366172 - protein, 9 aa, Homo Sapiens
PFFVPMSLA

SEQ ID NO: 366173 - protein, 9 aa, Homo Sapiens
KNKMAEGEE

SEQ ID NO: 366174 - protein, 9 aa, Homo Sapiens
PLGQPWLSP

SEQ ID NO: 366175 - protein, 9 aa, Homo Sapiens
RTESPPPLP

SEQ ID NO: 366176 - protein, 9 aa, Homo Sapiens
TMPELTQQM

SEQ ID NO: 366177 - protein, 9 aa, Homo Sapiens
VQGSPERGL

SEQ ID NO: 366178 - protein, 9 aa, Homo Sapiens
SRCRYWDLE

SEQ ID NO: 366179 - protein, 9 aa, Homo Sapiens
AQAPPGPPQ

SEQ ID NO: 366180 - protein, 9 aa, Homo Sapiens
YIGEGTPGL

SEQ ID NO: 366181 - protein, 9 aa, Homo Sapiens
SSPSMASLC

SEQ ID NO: 366182 - protein, 9 aa, Homo Sapiens
LCPQGLSNP

SEQ ID NO: 366183 - protein, 9 aa, Homo Sapiens
VSGGTTSSS

SEQ ID NO: 366184 - protein, 9 aa, Homo Sapiens
GRRVWYTCS

SEQ ID NO: 366185 - protein, 9 aa, Homo Sapiens
IYSQNSAGL

SEQ ID NO: 366186 - protein, 9 aa, Homo Sapiens
HKSPIECQK

SEQ ID NO: 366187 - protein, 9 aa, Homo Sapiens
ESGQVPKAS

SEQ ID NO: 366188 - protein, 9 aa, Homo Sapiens
HCFRSNSNH

SEQ ID NO: 366189 - protein, 9 aa, Homo Sapiens
TLNMIQVLM

SEQ ID NO: 366190 - protein, 9 aa, Homo Sapiens
MLEESKALN

SEQ ID NO: 366191 - protein, 9 aa, Homo Sapiens
VLLAMLGCS

SEQ ID NO: 366192 - protein, 9 aa, Homo Sapiens
FLNCDRYSM

SEQ ID NO: 366193 - protein, 9 aa, Homo Sapiens
LTLSDSPWR

SEQ ID NO: 366194 - protein, 9 aa, Homo Sapiens
SWWPQPCCI

SEQ ID NO: 366195 - protein, 9 aa, Homo Sapiens
LLPKIVLKL

SEQ ID NO: 366196 - protein, 9 aa, Homo Sapiens
AYIWEEWSL

SEQ ID NO: 366197 - protein, 9 aa, Homo Sapiens
ASVLPLLRA

SEQ ID NO: 366198 - protein, 9 aa, Homo Sapiens
KLSSRLSLP

SEQ ID NO: 366199 - protein, 9 aa, Homo Sapiens
LFQTQIIRS

SEQ ID NO: 366200 - protein, 9 aa, Homo Sapiens
SQIHENIIQ

SEQ ID NO: 366201 - protein, 9 aa, Homo Sapiens
ATSDGKHYC

SEQ ID NO: 366202 - protein, 9 aa, Homo Sapiens
IAAYSKNGL

SEQ ID NO: 366203 - protein, 9 aa, Homo Sapiens
FLASVTIIV

SEQ ID NO: 366204 - protein, 9 aa, Homo Sapiens
PQVQREHLD

SEQ ID NO: 366205 - protein, 9 aa, Homo Sapiens
REPGKRRCA

SEQ ID NO: 366206 - protein, 9 aa, Homo Sapiens
PAADRTFQK

SEQ ID NO: 366207 - protein, 9 aa, Homo Sapiens
QINPTNVKN

SEQ ID NO: 366208 - protein, 9 aa, Homo Sapiens
HTNFTGWQL

SEQ ID NO: 366209 - protein, 9 aa, Homo Sapiens
EGQERAVED

SEQ ID NO: 366210 - protein, 9 aa, Homo Sapiens
KTTSSSLCW

SEQ ID NO: 366211 - protein, 9 aa, Homo Sapiens
LFEEALERY

SEQ ID NO: 366212 - protein, 9 aa, Homo Sapiens
AQLPQASST

SEQ ID NO: 366213 - protein, 9 aa, Homo Sapiens
IMQATGLPQ

SEQ ID NO: 366214 - protein, 9 aa, Homo Sapiens
YHEDTPLWS

SEQ ID NO: 366215 - protein, 9 aa, Homo Sapiens
THERERYLW

SEQ ID NO: 366216 - protein, 9 aa, Homo Sapiens
LLPECFRHA

SEQ ID NO: 366217 - protein, 9 aa, Homo Sapiens
RASLWLCRA

SEQ ID NO: 366218 - protein, 9 aa, Homo Sapiens
AYMESQGAP

SEQ ID NO: 366219 - protein, 9 aa, Homo Sapiens
GPLGQPWLS

SEQ ID NO: 366220 - protein, 9 aa, Homo Sapiens
VCGPGACPQ

SEQ ID NO: 366221 - protein, 9 aa, Homo Sapiens
QFLPALQAT

SEQ ID NO: 366222 - protein, 9 aa, Homo Sapiens
PLLEDPREQ

SEQ ID NO: 366223 - protein, 9 aa, Homo Sapiens
LQLPIDWDI

SEQ ID NO: 366224 - protein, 9 aa, Homo Sapiens
DLFPVLSTS

SEQ ID NO: 366225 - protein, 9 aa, Homo Sapiens
ANTQELGPE

SEQ ID NO: 366226 - protein, 9 aa, Homo Sapiens
GSRPEPQCP

SEQ ID NO: 366227 - protein, 9 aa, Homo Sapiens
PEKDNFFAY

SEQ ID NO: 366228 - protein, 9 aa, Homo Sapiens
FVHVIQQVK

SEQ ID NO: 366229 - protein, 9 aa, Homo Sapiens
STVCRAVAS

SEQ ID NO: 366230 - protein, 9 aa, Homo Sapiens
VYPELLADE

SEQ ID NO: 366231 - protein, 9 aa, Homo Sapiens
LRLASYLVR

SEQ ID NO: 366232 - protein, 9 aa, Homo Sapiens
KTTDTSFKN

SEQ ID NO: 366233 - protein, 9 aa, Homo Sapiens
WAGADGQAS

SEQ ID NO: 366234 - protein, 9 aa, Homo Sapiens
AASTPPCLR

SEQ ID NO: 366235 - protein, 9 aa, Homo Sapiens
AIFARRAIS

SEQ ID NO: 366236 - protein, 9 aa, Homo Sapiens
VTCFPPVPQ

SEQ ID NO: 366237 - protein, 9 aa, Homo Sapiens
ATKEFSTYA

SEQ ID NO: 366238 - protein, 9 aa, Homo Sapiens
YGKKLVKIS

SEQ ID NO: 366239 - protein, 9 aa, Homo Sapiens
QGDKTEYLP

SEQ ID NO: 366240 - protein, 9 aa, Homo Sapiens
VDMALDQCF

SEQ ID NO: 366241 - protein, 9 aa, Homo Sapiens
HFSDLDQSF

SEQ ID NO: 366242 - protein, 9 aa, Homo Sapiens
GANGFTGLP

SEQ ID NO: 366243 - protein, 9 aa, Homo Sapiens
CPCRWTAPS

SEQ ID NO: 366244 - protein, 9 aa, Homo Sapiens
LTVGGWSVA

SEQ ID NO: 366245 - protein, 9 aa, Homo Sapiens
LIFLTFIIL

SEQ ID NO: 366246 - protein, 9 aa, Homo Sapiens
DIQVCGPGA

SEQ ID NO: 366247 - protein, 9 aa, Homo Sapiens
LLNAPRPWA

SEQ ID NO: 366248 - protein, 9 aa, Homo Sapiens
PAHPRPPAL

SEQ ID NO: 366249 - protein, 9 aa, Homo Sapiens
LIEELEEEI

SEQ ID NO: 366250 - protein, 9 aa, Homo Sapiens
RSPTSKPST

SEQ ID NO: 366251 - protein, 9 aa, Homo Sapiens
ELCNQSVRE

SEQ ID NO: 366252 - protein, 9 aa, Homo Sapiens
TATSVTIFP

SEQ ID NO: 366253 - protein, 9 aa, Homo Sapiens
DSRSFFTSA

SEQ ID NO: 366254 - protein, 9 aa, Homo Sapiens
ILPNQKPTV

SEQ ID NO: 366255 - protein, 9 aa, Homo Sapiens
VVDLQTLSS

SEQ ID NO: 366256 - protein, 9 aa, Homo Sapiens
HQRADPVYS

SEQ ID NO: 366257 - protein, 9 aa, Homo Sapiens
ENTPEKRAK

SEQ ID NO: 366258 - protein, 9 aa, Homo Sapiens
KPVAQLLPK

SEQ ID NO: 366259 - protein, 9 aa, Homo Sapiens
WGPAPGSGT

SEQ ID NO: 366260 - protein, 9 aa, Homo Sapiens
AVSSPTRSS

SEQ ID NO: 366261 - protein, 9 aa, Homo Sapiens
KTWVRYVEF

SEQ ID NO: 366262 - protein, 9 aa, Homo Sapiens
LHPDMYERV

SEQ ID NO: 366263 - protein, 9 aa, Homo Sapiens
TVGGWSVAI

SEQ ID NO: 366264 - protein, 9 aa, Homo Sapiens
QWLEKKCKE

SEQ ID NO: 366265 - protein, 9 aa, Homo Sapiens
EIKGIQVCM

SEQ ID NO: 366266 - protein, 9 aa, Homo Sapiens
KGPQEEPTI

SEQ ID NO: 366267 - protein, 9 aa, Homo Sapiens
AVSSGLFFI

SEQ ID NO: 366268 - protein, 9 aa, Homo Sapiens
VEGLARVRS

SEQ ID NO: 366269 - protein, 9 aa, Homo Sapiens
FPRCPTHPG

SEQ ID NO: 366270 - protein, 9 aa, Homo Sapiens
TRRVGCRIK

SEQ ID NO: 366271 - protein, 9 aa, Homo Sapiens
DRDKEQEKD

SEQ ID NO: 366272 - protein, 9 aa, Homo Sapiens
RVRSRAALS

SEQ ID NO: 366273 - protein, 9 aa, Homo Sapiens
EKDRTPFNA

SEQ ID NO: 366274 - protein, 9 aa, Homo Sapiens
GRSVARQAQ

SEQ ID NO: 366275 - protein, 9 aa, Homo Sapiens
TDVGYYSWR

SEQ ID NO: 366276 - protein, 9 aa, Homo Sapiens
QLQFSEHVG

SEQ ID NO: 366277 - protein, 9 aa, Homo Sapiens
WGKIVGSLC

SEQ ID NO: 366278 - protein, 9 aa, Homo Sapiens
LQERIWSYL

SEQ ID NO: 366279 - protein, 9 aa, Homo Sapiens
WESEPGLAR

SEQ ID NO: 366280 - protein, 9 aa, Homo Sapiens
KLLAAGFGN

SEQ ID NO: 366281 - protein, 9 aa, Homo Sapiens
PQVLENNEV

SEQ ID NO: 366282 - protein, 9 aa, Homo Sapiens
RLLGGKTIE

SEQ ID NO: 366283 - protein, 9 aa, Homo Sapiens
MGSWLKGVL

SEQ ID NO: 366284 - protein, 9 aa, Homo Sapiens
TPLTQTPAK

SEQ ID NO: 366285 - protein, 9 aa, Homo Sapiens
ECHGVCNYP

SEQ ID NO: 366286 - protein, 9 aa, Homo Sapiens
GAGRMGRPE

SEQ ID NO: 366287 - protein, 9 aa, Homo Sapiens
ITGNGVIAF

SEQ ID NO: 366288 - protein, 9 aa, Homo Sapiens
VEICACPPC

SEQ ID NO: 366289 - protein, 9 aa, Homo Sapiens
HQPELVRPA

SEQ ID NO: 366290 - protein, 9 aa, Homo Sapiens
LKIVLLGVT

SEQ ID NO: 366291 - protein, 9 aa, Homo Sapiens
IRVEGLMAA

SEQ ID NO: 366292 - protein, 9 aa, Homo Sapiens
QQLRRSMQD

SEQ ID NO: 366293 - protein, 9 aa, Homo Sapiens
RRRRKDLTP

SEQ ID NO: 366294 - protein, 9 aa, Homo Sapiens
WLDPDPANA

SEQ ID NO: 366295 - protein, 9 aa, Homo Sapiens
QIFDIIISL

SEQ ID NO: 366296 - protein, 9 aa, Homo Sapiens
KIFVGGCPT

SEQ ID NO: 366297 - protein, 9 aa, Homo Sapiens
RPPSPLSRP

SEQ ID NO: 366298 - protein, 9 aa, Homo Sapiens
YLECVKQQA

SEQ ID NO: 366299 - protein, 9 aa, Homo Sapiens
QGAAAEEGG

SEQ ID NO: 366300 - protein, 9 aa, Homo Sapiens
KKTRKHKHF

SEQ ID NO: 366301 - protein, 9 aa, Homo Sapiens
NEHLLIKGH

SEQ ID NO: 366302 - protein, 9 aa, Homo Sapiens
LCQCDKKRG

SEQ ID NO: 366303 - protein, 9 aa, Homo Sapiens
WQSSTPSLP

SEQ ID NO: 366304 - protein, 9 aa, Homo Sapiens
LELAITFEH

SEQ ID NO: 366305 - protein, 9 aa, Homo Sapiens
CQYEMGECT

SEQ ID NO: 366306 - protein, 9 aa, Homo Sapiens
PWAARSWCE

SEQ ID NO: 366307 - protein, 9 aa, Homo Sapiens
NPESSTTSS

SEQ ID NO: 366308 - protein, 9 aa, Homo Sapiens
IKGLVDFRD

SEQ ID NO: 366309 - protein, 9 aa, Homo Sapiens
QDLLFSTFC

SEQ ID NO: 366310 - protein, 9 aa, Homo Sapiens
HSSIVDCVL

SEQ ID NO: 366311 - protein, 9 aa, Homo Sapiens
KKKTRFLPT

SEQ ID NO: 366312 - protein, 9 aa, Homo Sapiens
QPDDKNLCN

SEQ ID NO: 366313 - protein, 9 aa, Homo Sapiens
YVNGRMRNN

SEQ ID NO: 366314 - protein, 9 aa, Homo Sapiens
RKGLSSHTR

SEQ ID NO: 366315 - protein, 9 aa, Homo Sapiens
RSASAEIQA

SEQ ID NO: 366316 - protein, 9 aa, Homo Sapiens
RKKKSRTLG

SEQ ID NO: 366317 - protein, 9 aa, Homo Sapiens
KSERGGRGY

SEQ ID NO: 366318 - protein, 9 aa, Homo Sapiens
PMSTELKTY

SEQ ID NO: 366319 - protein, 9 aa, Homo Sapiens
IGEKTEIQL

SEQ ID NO: 366320 - protein, 9 aa, Homo Sapiens
AKSIDDTLS

SEQ ID NO: 366321 - protein, 9 aa, Homo Sapiens
VDLQTLSSS

SEQ ID NO: 366322 - protein, 9 aa, Homo Sapiens
EIKCFLTMN

SEQ ID NO: 366323 - protein, 9 aa, Homo Sapiens
SQQEQALEA

SEQ ID NO: 366324 - protein, 9 aa, Homo Sapiens
VAAPTDDLQ

SEQ ID NO: 366325 - protein, 9 aa, Homo Sapiens
VCDMEDLLR

SEQ ID NO: 366326 - protein, 9 aa, Homo Sapiens
APHTTEAYQ

SEQ ID NO: 366327 - protein, 9 aa, Homo Sapiens
TPRGWHCDQ

SEQ ID NO: 366328 - protein, 9 aa, Homo Sapiens
ENLKKRKKK

SEQ ID NO: 366329 - protein, 9 aa, Homo Sapiens
TRTWAGWGP

SEQ ID NO: 366330 - protein, 9 aa, Homo Sapiens
IVSRNGCDA

SEQ ID NO: 366331 - protein, 9 aa, Homo Sapiens
VDQGKVKQA

SEQ ID NO: 366332 - protein, 9 aa, Homo Sapiens
QLLAVGAEV

SEQ ID NO: 366333 - protein, 9 aa, Homo Sapiens
FPMVPGETG

SEQ ID NO: 366334 - protein, 9 aa, Homo Sapiens
INSVINHFN

SEQ ID NO: 366335 - protein, 9 aa, Homo Sapiens
TLHWEPVPL

SEQ ID NO: 366336 - protein, 9 aa, Homo Sapiens
MVQAATTLL

SEQ ID NO: 366337 - protein, 9 aa, Homo Sapiens
SRGLRLLLC

SEQ ID NO: 366338 - protein, 9 aa, Homo Sapiens
DNELLYCQN

SEQ ID NO: 366339 - protein, 9 aa, Homo Sapiens
GGGQRGNGG

SEQ ID NO: 366340 - protein, 9 aa, Homo Sapiens
PACPKVPEE

SEQ ID NO: 366341 - protein, 9 aa, Homo Sapiens
ELLARSNYA

SEQ ID NO: 366342 - protein, 9 aa, Homo Sapiens
LTFLDIWYS

SEQ ID NO: 366343 - protein, 9 aa, Homo Sapiens
HCPSAPDNG

SEQ ID NO: 366344 - protein, 9 aa, Homo Sapiens
RMRKSTLTI

SEQ ID NO: 366345 - protein, 9 aa, Homo Sapiens
EKASHGFLH

SEQ ID NO: 366346 - protein, 9 aa, Homo Sapiens
WSRPPSASS

SEQ ID NO: 366347 - protein, 9 aa, Homo Sapiens
RPRPAARAP

SEQ ID NO: 366348 - protein, 9 aa, Homo Sapiens
TRGGAPPAG

SEQ ID NO: 366349 - protein, 9 aa, Homo Sapiens
SSTSRDSRS

SEQ ID NO: 366350 - protein, 9 aa, Homo Sapiens
PYPGIDLSP

SEQ ID NO: 366351 - protein, 9 aa, Homo Sapiens
VSVSALRGH

SEQ ID NO: 366352 - protein, 9 aa, Homo Sapiens
TRSHLRQLG

SEQ ID NO: 366353 - protein, 9 aa, Homo Sapiens
ISSLTGSNC

SEQ ID NO: 366354 - protein, 9 aa, Homo Sapiens
FINGVEKDR

SEQ ID NO: 366355 - protein, 9 aa, Homo Sapiens
KLFECKGCG

SEQ ID NO: 366356 - protein, 9 aa, Homo Sapiens
CISGRNVNV

SEQ ID NO: 366357 - protein, 9 aa, Homo Sapiens
VELKFVDWV

SEQ ID NO: 366358 - protein, 9 aa, Homo Sapiens
RGLLVTGAS

SEQ ID NO: 366359 - protein, 9 aa, Homo Sapiens
MNYGICKVY

SEQ ID NO: 366360 - protein, 9 aa, Homo Sapiens
KSPIECQKS

SEQ ID NO: 366361 - protein, 9 aa, Homo Sapiens
NPTRMLQSL

SEQ ID NO: 366362 - protein, 9 aa, Homo Sapiens
TSQYYFRIA

SEQ ID NO: 366363 - protein, 9 aa, Homo Sapiens
VLWNHAVGP

SEQ ID NO: 366364 - protein, 9 aa, Homo Sapiens
TWEFNALLL

SEQ ID NO: 366365 - protein, 9 aa, Homo Sapiens
GQPGVRALG

SEQ ID NO: 366366 - protein, 9 aa, Homo Sapiens
AESLAAGGS

SEQ ID NO: 366367 - protein, 9 aa, Homo Sapiens
VVVVGHGSR

SEQ ID NO: 366368 - protein, 9 aa, Homo Sapiens
RSKRRCPFQ

SEQ ID NO: 366369 - protein, 9 aa, Homo Sapiens
VGGWSVAIW

SEQ ID NO: 366370 - protein, 9 aa, Homo Sapiens
IYPVEDLTA

SEQ ID NO: 366371 - protein, 9 aa, Homo Sapiens
RDRRSMGEG

SEQ ID NO: 366372 - protein, 9 aa, Homo Sapiens
AAETDMYPE

SEQ ID NO: 366373 - protein, 9 aa, Homo Sapiens
QAVLQDYEL

SEQ ID NO: 366374 - protein, 9 aa, Homo Sapiens
NSIKSSLDG

SEQ ID NO: 366375 - protein, 9 aa, Homo Sapiens
MALDQCFSR

SEQ ID NO: 366376 - protein, 9 aa, Homo Sapiens
GELELEDLY

SEQ ID NO: 366377 - protein, 9 aa, Homo Sapiens
VYFMYLTSL

SEQ ID NO: 366378 - protein, 9 aa, Homo Sapiens
KYTILQKLA

SEQ ID NO: 366379 - protein, 9 aa, Homo Sapiens
CQPKCPLKS

SEQ ID NO: 366380 - protein, 9 aa, Homo Sapiens
RMSSLTYHH

SEQ ID NO: 366381 - protein, 9 aa, Homo Sapiens
SNAPKYGQG

SEQ ID NO: 366382 - protein, 9 aa, Homo Sapiens
GEARPARAE

SEQ ID NO: 366383 - protein, 9 aa, Homo Sapiens
MSLACSITV

SEQ ID NO: 366384 - protein, 9 aa, Homo Sapiens
PRALQAGGF

SEQ ID NO: 366385 - protein, 9 aa, Homo Sapiens
NEQKELQRR

SEQ ID NO: 366386 - protein, 9 aa, Homo Sapiens
NSAGIQEME

SEQ ID NO: 366387 - protein, 9 aa, Homo Sapiens
WRALGPPAP

SEQ ID NO: 366388 - protein, 9 aa, Homo Sapiens
GLKLSSRLS

SEQ ID NO: 366389 - protein, 9 aa, Homo Sapiens
QAPEGGPWR

SEQ ID NO: 366390 - protein, 9 aa, Homo Sapiens
MHPVTIWGK

SEQ ID NO: 366391 - protein, 9 aa, Homo Sapiens
AFFFSGWIS

SEQ ID NO: 366392 - protein, 9 aa, Homo Sapiens
GSPRPGPRG

SEQ ID NO: 366393 - protein, 9 aa, Homo Sapiens
DFQAFVPHP

SEQ ID NO: 366394 - protein, 9 aa, Homo Sapiens
GVKKHWIDY

SEQ ID NO: 366395 - protein, 9 aa, Homo Sapiens
LVHLSKQVW

SEQ ID NO: 366396 - protein, 9 aa, Homo Sapiens
QQVSCLEVH

SEQ ID NO: 366397 - protein, 9 aa, Homo Sapiens
ILSRATGRH

SEQ ID NO: 366398 - protein, 9 aa, Homo Sapiens
KRSMPEYFL

SEQ ID NO: 366399 - protein, 9 aa, Homo Sapiens
SARSRRRWS

SEQ ID NO: 366400 - protein, 9 aa, Homo Sapiens
AIESWLEKT

SEQ ID NO: 366401 - protein, 9 aa, Homo Sapiens
TWLSLWSHR

SEQ ID NO: 366402 - protein, 9 aa, Homo Sapiens
QEDKKIQDQ

SEQ ID NO: 366403 - protein, 9 aa, Homo Sapiens
CHDCGTRFS

SEQ ID NO: 366404 - protein, 9 aa, Homo Sapiens
ELSTKYSVY

SEQ ID NO: 366405 - protein, 9 aa, Homo Sapiens
GRILLQRNL

SEQ ID NO: 366406 - protein, 9 aa, Homo Sapiens
STSTLANLT

SEQ ID NO: 366407 - protein, 9 aa, Homo Sapiens
ADVDNEYED

SEQ ID NO: 366408 - protein, 9 aa, Homo Sapiens
TLNLKDQKI

SEQ ID NO: 366409 - protein, 9 aa, Homo Sapiens
RGCGPGRRR

SEQ ID NO: 366410 - protein, 9 aa, Homo Sapiens
VNIRKFIVQ

SEQ ID NO: 366411 - protein, 9 aa, Homo Sapiens
ARGGVGAQA

SEQ ID NO: 366412 - protein, 9 aa, Homo Sapiens
SRRASLWLC

SEQ ID NO: 366413 - protein, 9 aa, Homo Sapiens
DDMDLRVYG

SEQ ID NO: 366414 - protein, 9 aa, Homo Sapiens
RVQDPIHLF

SEQ ID NO: 366415 - protein, 9 aa, Homo Sapiens
SAHPSRPCR

SEQ ID NO: 366416 - protein, 9 aa, Homo Sapiens
SSLGGGPSC

SEQ ID NO: 366417 - protein, 9 aa, Homo Sapiens
HQKNWYHIT

SEQ ID NO: 366418 - protein, 9 aa, Homo Sapiens
DCSDVDPGI

SEQ ID NO: 366419 - protein, 9 aa, Homo Sapiens
YRLISGPHA

SEQ ID NO: 366420 - protein, 9 aa, Homo Sapiens
KGRPLPENQ

SEQ ID NO: 366421 - protein, 9 aa, Homo Sapiens
GEKTEIQLT

SEQ ID NO: 366422 - protein, 9 aa, Homo Sapiens
TSTSDRQHT

SEQ ID NO: 366423 - protein, 9 aa, Homo Sapiens
HPRPPALSL

SEQ ID NO: 366424 - protein, 9 aa, Homo Sapiens
TSLFLASVT

SEQ ID NO: 366425 - protein, 9 aa, Homo Sapiens
PPWPRLASI

SEQ ID NO: 366426 - protein, 9 aa, Homo Sapiens
YRTWPLPGP

SEQ ID NO: 366427 - protein, 9 aa, Homo Sapiens
SASGSGCAA

SEQ ID NO: 366428 - protein, 9 aa, Homo Sapiens
KIKMQNKVF

SEQ ID NO: 366429 - protein, 9 aa, Homo Sapiens
KTKPGEDML

SEQ ID NO: 366430 - protein, 9 aa, Homo Sapiens
ICGGARGHA

SEQ ID NO: 366431 - protein, 9 aa, Homo Sapiens
SVMLDVPKR

SEQ ID NO: 366432 - protein, 9 aa, Homo Sapiens
VAPPSSSDG

SEQ ID NO: 366433 - protein, 9 aa, Homo Sapiens
DVCVVRGCS

SEQ ID NO: 366434 - protein, 9 aa, Homo Sapiens
PFGSCWPPW

SEQ ID NO: 366435 - protein, 9 aa, Homo Sapiens
LPLAACQAT

SEQ ID NO: 366436 - protein, 9 aa, Homo Sapiens
KDLENLGFT

SEQ ID NO: 366437 - protein, 9 aa, Homo Sapiens
NVSITNAKT

SEQ ID NO: 366438 - protein, 9 aa, Homo Sapiens
PPEAPLTPR

SEQ ID NO: 366439 - protein, 9 aa, Homo Sapiens
DDICREVLQ

SEQ ID NO: 366440 - protein, 9 aa, Homo Sapiens
TYIGNVVRN

SEQ ID NO: 366441 - protein, 9 aa, Homo Sapiens
IKGIQVCMK

SEQ ID NO: 366442 - protein, 9 aa, Homo Sapiens
ETLESGGAS

SEQ ID NO: 366443 - protein, 9 aa, Homo Sapiens
RWEGPGKQL

SEQ ID NO: 366444 - protein, 9 aa, Homo Sapiens
VKWRVERDV

SEQ ID NO: 366445 - protein, 9 aa, Homo Sapiens
FTMAIDFTA

SEQ ID NO: 366446 - protein, 9 aa, Homo Sapiens
LLAWADSTK

SEQ ID NO: 366447 - protein, 9 aa, Homo Sapiens
EELQSSGVP

SEQ ID NO: 366448 - protein, 9 aa, Homo Sapiens
EHMERKRRE

SEQ ID NO: 366449 - protein, 9 aa, Homo Sapiens
VIQDDKVVA

SEQ ID NO: 366450 - protein, 9 aa, Homo Sapiens
KMTHSKLKE

SEQ ID NO: 366451 - protein, 9 aa, Homo Sapiens
LPCGVDRRW

SEQ ID NO: 366452 - protein, 9 aa, Homo Sapiens
LLWEDRAKN

SEQ ID NO: 366453 - protein, 9 aa, Homo Sapiens
HVGLAQPLR

SEQ ID NO: 366454 - protein, 9 aa, Homo Sapiens
NSIYWQEFE

SEQ ID NO: 366455 - protein, 9 aa, Homo Sapiens
EECMFPKTT

SEQ ID NO: 366456 - protein, 9 aa, Homo Sapiens
LHWLPCAQE

SEQ ID NO: 366457 - protein, 9 aa, Homo Sapiens
CASFDCTRP

SEQ ID NO: 366458 - protein, 9 aa, Homo Sapiens
CQACRFMEC

SEQ ID NO: 366459 - protein, 9 aa, Homo Sapiens
PSISEHVCW

SEQ ID NO: 366460 - protein, 9 aa, Homo Sapiens
VCAPNKDVA

SEQ ID NO: 366461 - protein, 9 aa, Homo Sapiens
KPYTCAQCG

SEQ ID NO: 366462 - protein, 9 aa, Homo Sapiens
ERLVHLSKQ

SEQ ID NO: 366463 - protein, 9 aa, Homo Sapiens
LRHTQILHR

SEQ ID NO: 366464 - protein, 9 aa, Homo Sapiens
HQLITVTMS

SEQ ID NO: 366465 - protein, 9 aa, Homo Sapiens
SAACGPPSV

SEQ ID NO: 366466 - protein, 9 aa, Homo Sapiens
PADLPHSSG

SEQ ID NO: 366467 - protein, 9 aa, Homo Sapiens
ACSPAPTPR

SEQ ID NO: 366468 - protein, 9 aa, Homo Sapiens
KDNGLMGIE

SEQ ID NO: 366469 - protein, 9 aa, Homo Sapiens
EKRKTAEKR

SEQ ID NO: 366470 - protein, 9 aa, Homo Sapiens
LGQAADGTP

SEQ ID NO: 366471 - protein, 9 aa, Homo Sapiens
FSTFCDSER

SEQ ID NO: 366472 - protein, 9 aa, Homo Sapiens
KDLTPPRPL

SEQ ID NO: 366473 - protein, 9 aa, Homo Sapiens
ELNGTETKL

SEQ ID NO: 366474 - protein, 9 aa, Homo Sapiens
HPDVARGLS

SEQ ID NO: 366475 - protein, 9 aa, Homo Sapiens
MGGQASWSH

SEQ ID NO: 366476 - protein, 9 aa, Homo Sapiens
DSGRPGMEH

SEQ ID NO: 366477 - protein, 9 aa, Homo Sapiens
AAMGQDCYT

SEQ ID NO: 366478 - protein, 9 aa, Homo Sapiens
SMDRVYDKP

SEQ ID NO: 366479 - protein, 9 aa, Homo Sapiens
FMNSACHQS

SEQ ID NO: 366480 - protein, 9 aa, Homo Sapiens
SQQVSCLEV

SEQ ID NO: 366481 - protein, 9 aa, Homo Sapiens
AYPGRRVDC

SEQ ID NO: 366482 - protein, 9 aa, Homo Sapiens
LAPKRPLLP

SEQ ID NO: 366483 - protein, 9 aa, Homo Sapiens
SLACSITVS

SEQ ID NO: 366484 - protein, 9 aa, Homo Sapiens
AGTTFTLVT

SEQ ID NO: 366485 - protein, 9 aa, Homo Sapiens
GGDGCRGNG

SEQ ID NO: 366486 - protein, 9 aa, Homo Sapiens
VVHVVEALH

SEQ ID NO: 366487 - protein, 9 aa, Homo Sapiens
GAPAEGARA

SEQ ID NO: 366488 - protein, 9 aa, Homo Sapiens
LLKKCSLYG

SEQ ID NO: 366489 - protein, 9 aa, Homo Sapiens
VDFTLEVEQ

SEQ ID NO: 366490 - protein, 9 aa, Homo Sapiens
RPLFVESTT

SEQ ID NO: 366491 - protein, 9 aa, Homo Sapiens
EGNAKLQQH

SEQ ID NO: 366492 - protein, 9 aa, Homo Sapiens
ERWQKKHDK

SEQ ID NO: 366493 - protein, 9 aa, Homo Sapiens
VWDEVNLRA

SEQ ID NO: 366494 - protein, 9 aa, Homo Sapiens
HWCEYCKKG

SEQ ID NO: 366495 - protein, 9 aa, Homo Sapiens
PLNNSQGTF

SEQ ID NO: 366496 - protein, 9 aa, Homo Sapiens
LKLKLPEKG

SEQ ID NO: 366497 - protein, 9 aa, Homo Sapiens
SIHEFCINM

SEQ ID NO: 366498 - protein, 9 aa, Homo Sapiens
CGPRHSHFF

SEQ ID NO: 366499 - protein, 9 aa, Homo Sapiens
TGDPPPPPP

SEQ ID NO: 366500 - protein, 9 aa, Homo Sapiens
QKGRSSKKN

SEQ ID NO: 366501 - protein, 9 aa, Homo Sapiens
GSIMGSWLK

SEQ ID NO: 366502 - protein, 9 aa, Homo Sapiens
QISEIIDSR

SEQ ID NO: 366503 - protein, 9 aa, Homo Sapiens
MRDISLIKQ

SEQ ID NO: 366504 - protein, 9 aa, Homo Sapiens
FSRMSSLTY

SEQ ID NO: 366505 - protein, 9 aa, Homo Sapiens
PSSCWSPRP

SEQ ID NO: 366506 - protein, 9 aa, Homo Sapiens
PTRSSPPAT

SEQ ID NO: 366507 - protein, 9 aa, Homo Sapiens
PMFEPKMTH

SEQ ID NO: 366508 - protein, 9 aa, Homo Sapiens
LQRSPALRA

SEQ ID NO: 366509 - protein, 9 aa, Homo Sapiens
QPKPPPQKE

SEQ ID NO: 366510 - protein, 9 aa, Homo Sapiens
RQLYHLVSD

SEQ ID NO: 366511 - protein, 9 aa, Homo Sapiens
FLKDNGLMG

SEQ ID NO: 366512 - protein, 9 aa, Homo Sapiens
KNWYHITLM

SEQ ID NO: 366513 - protein, 9 aa, Homo Sapiens
SSSLVTVSW

SEQ ID NO: 366514 - protein, 9 aa, Homo Sapiens
QEQALEATK

SEQ ID NO: 366515 - protein, 9 aa, Homo Sapiens
QKECFHQKN

SEQ ID NO: 366516 - protein, 9 aa, Homo Sapiens
GGNMAPMST

SEQ ID NO: 366517 - protein, 9 aa, Homo Sapiens
MLDVPKRLT

SEQ ID NO: 366518 - protein, 9 aa, Homo Sapiens
VILDRKKKS

SEQ ID NO: 366519 - protein, 9 aa, Homo Sapiens
PTHPGPPPA

SEQ ID NO: 366520 - protein, 9 aa, Homo Sapiens
ALGHMWTYR

SEQ ID NO: 366521 - protein, 9 aa, Homo Sapiens
NSQQEGGSL

SEQ ID NO: 366522 - protein, 9 aa, Homo Sapiens
AAFIGSMDV

SEQ ID NO: 366523 - protein, 9 aa, Homo Sapiens
TAPPSAPGS

SEQ ID NO: 366524 - protein, 9 aa, Homo Sapiens
AAYSKNGLK

SEQ ID NO: 366525 - protein, 9 aa, Homo Sapiens
DAPQRLGKS

SEQ ID NO: 366526 - protein, 9 aa, Homo Sapiens
RESVMREWR

SEQ ID NO: 366527 - protein, 9 aa, Homo Sapiens
LSINSYTDI

SEQ ID NO: 366528 - protein, 9 aa, Homo Sapiens
EDAPQRLGK

SEQ ID NO: 366529 - protein, 9 aa, Homo Sapiens
SRPCRMRLY

SEQ ID NO: 366530 - protein, 9 aa, Homo Sapiens
TGRGRQERQ

SEQ ID NO: 366531 - protein, 9 aa, Homo Sapiens
SIDDTLSTW

SEQ ID NO: 366532 - protein, 9 aa, Homo Sapiens
NSAGMRYSS

SEQ ID NO: 366533 - protein, 9 aa, Homo Sapiens
PYQVLNSQE

SEQ ID NO: 366534 - protein, 9 aa, Homo Sapiens
THSYVRIKD

SEQ ID NO: 366535 - protein, 9 aa, Homo Sapiens
AKRLANVVH

SEQ ID NO: 366536 - protein, 9 aa, Homo Sapiens
ETVMIITRT

SEQ ID NO: 366537 - protein, 9 aa, Homo Sapiens
RCRYWDLEV

SEQ ID NO: 366538 - protein, 9 aa, Homo Sapiens
PREVRHRAA

SEQ ID NO: 366539 - protein, 9 aa, Homo Sapiens
NLLHNRNFW

SEQ ID NO: 366540 - protein, 9 aa, Homo Sapiens
GECTPRGWH

SEQ ID NO: 366541 - protein, 9 aa, Homo Sapiens
VNQAVCDME

SEQ ID NO: 366542 - protein, 9 aa, Homo Sapiens
LPIVPLAAK

SEQ ID NO: 366543 - protein, 9 aa, Homo Sapiens
CITECVRTA

SEQ ID NO: 366544 - protein, 9 aa, Homo Sapiens
AEGARARAG

SEQ ID NO: 366545 - protein, 9 aa, Homo Sapiens
MVKWRVERD

SEQ ID NO: 366546 - protein, 9 aa, Homo Sapiens
HMLEEGDDG

SEQ ID NO: 366547 - protein, 9 aa, Homo Sapiens
RCQKAFSTC

SEQ ID NO: 366548 - protein, 9 aa, Homo Sapiens
NFPTITDYF

SEQ ID NO: 366549 - protein, 9 aa, Homo Sapiens
LCLGCQHCV

SEQ ID NO: 366550 - protein, 9 aa, Homo Sapiens
TLAHFNTET

SEQ ID NO: 366551 - protein, 9 aa, Homo Sapiens
LQSLLSLYS

SEQ ID NO: 366552 - protein, 9 aa, Homo Sapiens
MMLVEQPKG

SEQ ID NO: 366553 - protein, 9 aa, Homo Sapiens
SSNAPKYGQ

SEQ ID NO: 366554 - protein, 9 aa, Homo Sapiens
VKPQKLFQW

SEQ ID NO: 366555 - protein, 9 aa, Homo Sapiens
HQGAEQQQH

SEQ ID NO: 366556 - protein, 9 aa, Homo Sapiens
RGQILFPCL

SEQ ID NO: 366557 - protein, 9 aa, Homo Sapiens
LVPIGKCVW

SEQ ID NO: 366558 - protein, 9 aa, Homo Sapiens
VSKKKSYRL

SEQ ID NO: 366559 - protein, 9 aa, Homo Sapiens
APWSVIDPQ

SEQ ID NO: 366560 - protein, 9 aa, Homo Sapiens
CGMSSLTLL

SEQ ID NO: 366561 - protein, 9 aa, Homo Sapiens
MIQEVWTLY

SEQ ID NO: 366562 - protein, 9 aa, Homo Sapiens
KTEAHLAKG

SEQ ID NO: 366563 - protein, 9 aa, Homo Sapiens
PALRARWST

SEQ ID NO: 366564 - protein, 9 aa, Homo Sapiens
LHHELISTL

SEQ ID NO: 366565 - protein, 9 aa, Homo Sapiens
GGDRVPVDI

SEQ ID NO: 366566 - protein, 9 aa, Homo Sapiens
RVEFQPMEV

SEQ ID NO: 366567 - protein, 9 aa, Homo Sapiens
AHIPYQVLN

SEQ ID NO: 366568 - protein, 9 aa, Homo Sapiens
APQRLGKSR

SEQ ID NO: 366569 - protein, 9 aa, Homo Sapiens
YVNLTPGCR

SEQ ID NO: 366570 - protein, 9 aa, Homo Sapiens
PHSSGLALC

SEQ ID NO: 366571 - protein, 9 aa, Homo Sapiens
GGQRGNGGD

SEQ ID NO: 366572 - protein, 9 aa, Homo Sapiens
ASSTRSSVT

SEQ ID NO: 366573 - protein, 9 aa, Homo Sapiens
LPVVLGLRS

SEQ ID NO: 366574 - protein, 9 aa, Homo Sapiens
EKKIKYSRR

SEQ ID NO: 366575 - protein, 9 aa, Homo Sapiens
PACGLSAQP

SEQ ID NO: 366576 - protein, 9 aa, Homo Sapiens
PPRQRAAAP

SEQ ID NO: 366577 - protein, 9 aa, Homo Sapiens
EGTPGLARE

SEQ ID NO: 366578 - protein, 9 aa, Homo Sapiens
SLHQTYELN

SEQ ID NO: 366579 - protein, 9 aa, Homo Sapiens
TWRILPNFL

SEQ ID NO: 366580 - protein, 9 aa, Homo Sapiens
MVQVALDKA

SEQ ID NO: 366581 - protein, 9 aa, Homo Sapiens
AAPTRRLLV

SEQ ID NO: 366582 - protein, 9 aa, Homo Sapiens
GSMVISYLI

SEQ ID NO: 366583 - protein, 9 aa, Homo Sapiens
PPPLILLRH

SEQ ID NO: 366584 - protein, 9 aa, Homo Sapiens
EEKKIKYSR

SEQ ID NO: 366585 - protein, 9 aa, Homo Sapiens
NDSKHKLES

SEQ ID NO: 366586 - protein, 9 aa, Homo Sapiens
SRTRGTLHT

SEQ ID NO: 366587 - protein, 9 aa, Homo Sapiens
LTDDCEEEE

SEQ ID NO: 366588 - protein, 9 aa, Homo Sapiens
IQKMYPEDT

SEQ ID NO: 366589 - protein, 9 aa, Homo Sapiens
ALRAWWLPE

SEQ ID NO: 366590 - protein, 9 aa, Homo Sapiens
PAAPRLASA

SEQ ID NO: 366591 - protein, 9 aa, Homo Sapiens
WHTLHHELI

SEQ ID NO: 366592 - protein, 9 aa, Homo Sapiens
NGRETIIKT

SEQ ID NO: 366593 - protein, 9 aa, Homo Sapiens
ANSWSTWLS

SEQ ID NO: 366594 - protein, 9 aa, Homo Sapiens
DGFAQWCEQ

SEQ ID NO: 366595 - protein, 9 aa, Homo Sapiens
GPQGSSRPL

SEQ ID NO: 366596 - protein, 9 aa, Homo Sapiens
RKKKKKLKK

SEQ ID NO: 366597 - protein, 9 aa, Homo Sapiens
TTDDIRALL

SEQ ID NO: 366598 - protein, 9 aa, Homo Sapiens
YRSALNSAF

SEQ ID NO: 366599 - protein, 9 aa, Homo Sapiens
IHEFCINMR

SEQ ID NO: 366600 - protein, 9 aa, Homo Sapiens
YSAMNYGIC

SEQ ID NO: 366601 - protein, 9 aa, Homo Sapiens
RILPNFLKH

SEQ ID NO: 366602 - protein, 9 aa, Homo Sapiens
SFLENEKSL

SEQ ID NO: 366603 - protein, 9 aa, Homo Sapiens
GGAPRALQA

SEQ ID NO: 366604 - protein, 9 aa, Homo Sapiens
DPQAIHPEL

SEQ ID NO: 366605 - protein, 9 aa, Homo Sapiens
TPWPLPMCC

SEQ ID NO: 366606 - protein, 9 aa, Homo Sapiens
IEFDQNIFT

SEQ ID NO: 366607 - protein, 9 aa, Homo Sapiens
ILSTEWDYI

SEQ ID NO: 366608 - protein, 9 aa, Homo Sapiens
PPPPPTKKR

SEQ ID NO: 366609 - protein, 9 aa, Homo Sapiens
LESEDSYTP

SEQ ID NO: 366610 - protein, 9 aa, Homo Sapiens
KSRTLGNCG

SEQ ID NO: 366611 - protein, 9 aa, Homo Sapiens
QAPPGPPQQ

SEQ ID NO: 366612 - protein, 9 aa, Homo Sapiens
HISPVPPSV

SEQ ID NO: 366613 - protein, 9 aa, Homo Sapiens
PAARAPWRT

SEQ ID NO: 366614 - protein, 9 aa, Homo Sapiens
PCSATVLSL

SEQ ID NO: 366615 - protein, 9 aa, Homo Sapiens
ALQPVMQAL

SEQ ID NO: 366616 - protein, 9 aa, Homo Sapiens
GGITFFRPG

SEQ ID NO: 366617 - protein, 9 aa, Homo Sapiens
RLLEKENRD

SEQ ID NO: 366618 - protein, 9 aa, Homo Sapiens
HREAWAGRT

SEQ ID NO: 366619 - protein, 9 aa, Homo Sapiens
CVQRCPACR

SEQ ID NO: 366620 - protein, 9 aa, Homo Sapiens
MFPKTTDTS

SEQ ID NO: 366621 - protein, 9 aa, Homo Sapiens
CICGKTKPG

SEQ ID NO: 366622 - protein, 9 aa, Homo Sapiens
LQFSEHVGI

SEQ ID NO: 366623 - protein, 9 aa, Homo Sapiens
ITSERDFHP

SEQ ID NO: 366624 - protein, 9 aa, Homo Sapiens
RLRLPDCSW

SEQ ID NO: 366625 - protein, 9 aa, Homo Sapiens
TALSCRVLT

SEQ ID NO: 366626 - protein, 9 aa, Homo Sapiens
LSPSGSSYR

SEQ ID NO: 366627 - protein, 9 aa, Homo Sapiens
LEEDSFLEN

SEQ ID NO: 366628 - protein, 9 aa, Homo Sapiens
VNLTPGCRS

SEQ ID NO: 366629 - protein, 9 aa, Homo Sapiens
VDVQVVTHH

SEQ ID NO: 366630 - protein, 9 aa, Homo Sapiens
VQCCIIFSH

SEQ ID NO: 366631 - protein, 9 aa, Homo Sapiens
TDLTVLGQP

SEQ ID NO: 366632 - protein, 9 aa, Homo Sapiens
AGDWDIDVE

SEQ ID NO: 366633 - protein, 9 aa, Homo Sapiens
ELPYNLATD

SEQ ID NO: 366634 - protein, 9 aa, Homo Sapiens
KEMEPLIMD

SEQ ID NO: 366635 - protein, 9 aa, Homo Sapiens
PDPANAPCR

SEQ ID NO: 366636 - protein, 9 aa, Homo Sapiens
GKEMEPLIM

SEQ ID NO: 366637 - protein, 9 aa, Homo Sapiens
IQVLMSVVH

SEQ ID NO: 366638 - protein, 9 aa, Homo Sapiens
VTGTQHFKE

SEQ ID NO: 366639 - protein, 9 aa, Homo Sapiens
RMSSHLRAC

SEQ ID NO: 366640 - protein, 9 aa, Homo Sapiens
TLARETSLA

SEQ ID NO: 366641 - protein, 9 aa, Homo Sapiens
AKIKAVQYQ

SEQ ID NO: 366642 - protein, 9 aa, Homo Sapiens
LAAIKKKDY

SEQ ID NO: 366643 - protein, 9 aa, Homo Sapiens
DVPGLPDSH

SEQ ID NO: 366644 - protein, 9 aa, Homo Sapiens
TAAAAAEPP

SEQ ID NO: 366645 - protein, 9 aa, Homo Sapiens
RCSAPANQP

SEQ ID NO: 366646 - protein, 9 aa, Homo Sapiens
EPSDIIENV

SEQ ID NO: 366647 - protein, 9 aa, Homo Sapiens
LVETRPAAD

SEQ ID NO: 366648 - protein, 9 aa, Homo Sapiens
QPRPSTPAS

SEQ ID NO: 366649 - protein, 9 aa, Homo Sapiens
ALPQLGAHP

SEQ ID NO: 366650 - protein, 9 aa, Homo Sapiens
KRCVTTHWL

SEQ ID NO: 366651 - protein, 9 aa, Homo Sapiens
CLALLALNH

SEQ ID NO: 366652 - protein, 9 aa, Homo Sapiens
VFSVILSLF

SEQ ID NO: 366653 - protein, 9 aa, Homo Sapiens
LRARNLLLT

SEQ ID NO: 366654 - protein, 9 aa, Homo Sapiens
AHGDGSTCP

SEQ ID NO: 366655 - protein, 9 aa, Homo Sapiens
LLQESCLIR

SEQ ID NO: 366656 - protein, 9 aa, Homo Sapiens
DHFSIDRNM

SEQ ID NO: 366657 - protein, 9 aa, Homo Sapiens
NRLGLALLQ

SEQ ID NO: 366658 - protein, 9 aa, Homo Sapiens
CLTRMRKST

SEQ ID NO: 366659 - protein, 9 aa, Homo Sapiens
KADPKRDRR

SEQ ID NO: 366660 - protein, 9 aa, Homo Sapiens
YGQGQLNYP

SEQ ID NO: 366661 - protein, 9 aa, Homo Sapiens
HPPMPDKDR

SEQ ID NO: 366662 - protein, 9 aa, Homo Sapiens
SAKSKNLLA

SEQ ID NO: 366663 - protein, 9 aa, Homo Sapiens
QGGDAAAGA

SEQ ID NO: 366664 - protein, 9 aa, Homo Sapiens
ADIIPQVLA

SEQ ID NO: 366665 - protein, 9 aa, Homo Sapiens
TTIHDIPML

SEQ ID NO: 366666 - protein, 9 aa, Homo Sapiens
VFTLKKGRS

SEQ ID NO: 366667 - protein, 9 aa, Homo Sapiens
NNCQKASRE

SEQ ID NO: 366668 - protein, 9 aa, Homo Sapiens
RACANSWST

SEQ ID NO: 366669 - protein, 9 aa, Homo Sapiens
LMVEKLKTL

SEQ ID NO: 366670 - protein, 9 aa, Homo Sapiens
FNRNAHLVR

SEQ ID NO: 366671 - protein, 9 aa, Homo Sapiens
LAVADNRII

SEQ ID NO: 366672 - protein, 9 aa, Homo Sapiens
SPEPPHRTP

SEQ ID NO: 366673 - protein, 9 aa, Homo Sapiens
WCMPGLPCP

SEQ ID NO: 366674 - protein, 9 aa, Homo Sapiens
EREREQTAR

SEQ ID NO: 366675 - protein, 9 aa, Homo Sapiens
RTSQNHSKC

SEQ ID NO: 366676 - protein, 9 aa, Homo Sapiens
QDKACISQA

SEQ ID NO: 366677 - protein, 9 aa, Homo Sapiens
PGWPPLLLL

SEQ ID NO: 366678 - protein, 9 aa, Homo Sapiens
SYTPEALAA

SEQ ID NO: 366679 - protein, 9 aa, Homo Sapiens
LLKRMHFDY

SEQ ID NO: 366680 - protein, 9 aa, Homo Sapiens
LKDAVRARC

SEQ ID NO: 366681 - protein, 9 aa, Homo Sapiens
FYPKRVMDQ

SEQ ID NO: 366682 - protein, 9 aa, Homo Sapiens
ASADRPERA

SEQ ID NO: 366683 - protein, 9 aa, Homo Sapiens
NGVPTSRGA

SEQ ID NO: 366684 - protein, 9 aa, Homo Sapiens
DADCVTCLA

SEQ ID NO: 366685 - protein, 9 aa, Homo Sapiens
TSYFIDRDS

SEQ ID NO: 366686 - protein, 9 aa, Homo Sapiens
RNIWTDHRI

SEQ ID NO: 366687 - protein, 9 aa, Homo Sapiens
WSISSGPWG

SEQ ID NO: 366688 - protein, 9 aa, Homo Sapiens
DRPERAART

SEQ ID NO: 366689 - protein, 9 aa, Homo Sapiens
SDLPQIRAQ

SEQ ID NO: 366690 - protein, 9 aa, Homo Sapiens
LLTAPRSLQ

SEQ ID NO: 366691 - protein, 9 aa, Homo Sapiens
PQPHSLPTQ

SEQ ID NO: 366692 - protein, 9 aa, Homo Sapiens
DALWARAFH

SEQ ID NO: 366693 - protein, 9 aa, Homo Sapiens
APGSRGGRN

SEQ ID NO: 366694 - protein, 9 aa, Homo Sapiens
DLMPVCCGN

SEQ ID NO: 366695 - protein, 9 aa, Homo Sapiens
EPAASAAVT

SEQ ID NO: 366696 - protein, 9 aa, Homo Sapiens
ARPLAELCN

SEQ ID NO: 366697 - protein, 9 aa, Homo Sapiens
LNYCKGGIT

SEQ ID NO: 366698 - protein, 9 aa, Homo Sapiens
ASCRSETLR

SEQ ID NO: 366699 - protein, 9 aa, Homo Sapiens
AAAEEGGVG

SEQ ID NO: 366700 - protein, 9 aa, Homo Sapiens
AADFSHYEY

SEQ ID NO: 366701 - protein, 9 aa, Homo Sapiens
SDTCRSVLT

SEQ ID NO: 366702 - protein, 9 aa, Homo Sapiens
LDPYVNLTP

SEQ ID NO: 366703 - protein, 9 aa, Homo Sapiens
LTMNLNIAK

SEQ ID NO: 366704 - protein, 9 aa, Homo Sapiens
DCRLGVEPA

SEQ ID NO: 366705 - protein, 9 aa, Homo Sapiens
EGVCFLNHH

SEQ ID NO: 366706 - protein, 9 aa, Homo Sapiens
NPASPDVGF

SEQ ID NO: 366707 - protein, 9 aa, Homo Sapiens
EGSTVPHAA

SEQ ID NO: 366708 - protein, 9 aa, Homo Sapiens
PQKLFQWKQ

SEQ ID NO: 366709 - protein, 9 aa, Homo Sapiens
IFLTFIILF

SEQ ID NO: 366710 - protein, 9 aa, Homo Sapiens
KTLCHMPVP

SEQ ID NO: 366711 - protein, 9 aa, Homo Sapiens
MTRRVGCRI

SEQ ID NO: 366712 - protein, 9 aa, Homo Sapiens
AITFEHFYQ

SEQ ID NO: 366713 - protein, 9 aa, Homo Sapiens
RALPPGGCL

SEQ ID NO: 366714 - protein, 9 aa, Homo Sapiens
HFENLLAWA

SEQ ID NO: 366715 - protein, 9 aa, Homo Sapiens
HPAACSLDL

SEQ ID NO: 366716 - protein, 9 aa, Homo Sapiens
GVHCTGTEL

SEQ ID NO: 366717 - protein, 9 aa, Homo Sapiens
FPFAAETDM

SEQ ID NO: 366718 - protein, 9 aa, Homo Sapiens
SGLPPAKRG

SEQ ID NO: 366719 - protein, 9 aa, Homo Sapiens
AAAEDDIAD

SEQ ID NO: 366720 - protein, 9 aa, Homo Sapiens
ENEKSLLQM

SEQ ID NO: 366721 - protein, 9 aa, Homo Sapiens
ISSGPWGMK

SEQ ID NO: 366722 - protein, 9 aa, Homo Sapiens
METLPTVDL

SEQ ID NO: 366723 - protein, 9 aa, Homo Sapiens
RQPGPQGSS

SEQ ID NO: 366724 - protein, 9 aa, Homo Sapiens
GSEATSQYY

SEQ ID NO: 366725 - protein, 9 aa, Homo Sapiens
ERTVWYLQY

SEQ ID NO: 366726 - protein, 9 aa, Homo Sapiens
FACFTWRTS

SEQ ID NO: 366727 - protein, 9 aa, Homo Sapiens
LAPWAWGCP

SEQ ID NO: 366728 - protein, 9 aa, Homo Sapiens
ETTAGAGVP

SEQ ID NO: 366729 - protein, 9 aa, Homo Sapiens
ARRTAKPLG

SEQ ID NO: 366730 - protein, 9 aa, Homo Sapiens
HAEESKKNP

SEQ ID NO: 366731 - protein, 9 aa, Homo Sapiens
TASRVLWPC

SEQ ID NO: 366732 - protein, 9 aa, Homo Sapiens
NDAHDKKAV

SEQ ID NO: 366733 - protein, 9 aa, Homo Sapiens
LVVILIRDE

SEQ ID NO: 366734 - protein, 9 aa, Homo Sapiens
VGAQAPPGP

SEQ ID NO: 366735 - protein, 9 aa, Homo Sapiens
QVRLCKDGM

SEQ ID NO: 366736 - protein, 9 aa, Homo Sapiens
QEEDRVTEE

SEQ ID NO: 366737 - protein, 9 aa, Homo Sapiens
SFSQLELRK

SEQ ID NO: 366738 - protein, 9 aa, Homo Sapiens
YHDQKPGRN

SEQ ID NO: 366739 - protein, 9 aa, Homo Sapiens
ERLKEHDPD

SEQ ID NO: 366740 - protein, 9 aa, Homo Sapiens
YNVRLSWEY

SEQ ID NO: 366741 - protein, 9 aa, Homo Sapiens
HQRAEYILK

SEQ ID NO: 366742 - protein, 9 aa, Homo Sapiens
NMPTEPAAS

SEQ ID NO: 366743 - protein, 9 aa, Homo Sapiens
GCRGNGGQR

SEQ ID NO: 366744 - protein, 9 aa, Homo Sapiens
GPQDNRSLG

SEQ ID NO: 366745 - protein, 9 aa, Homo Sapiens
LKNHPPMPD

SEQ ID NO: 366746 - protein, 9 aa, Homo Sapiens
RPDFLKTTS

SEQ ID NO: 366747 - protein, 9 aa, Homo Sapiens
LSDESEERE

SEQ ID NO: 366748 - protein, 9 aa, Homo Sapiens
RQDSAIHLH

SEQ ID NO: 366749 - protein, 9 aa, Homo Sapiens
SGPHASINV

SEQ ID NO: 366750 - protein, 9 aa, Homo Sapiens
YFVDCPVPF

SEQ ID NO: 366751 - protein, 9 aa, Homo Sapiens
VTLRPWKTS

SEQ ID NO: 366752 - protein, 9 aa, Homo Sapiens
CVWSAGYEE

SEQ ID NO: 366753 - protein, 9 aa, Homo Sapiens
NFFAYLTLA

SEQ ID NO: 366754 - protein, 9 aa, Homo Sapiens
PKPVDVQVV

SEQ ID NO: 366755 - protein, 9 aa, Homo Sapiens
EFYSLQEQH

SEQ ID NO: 366756 - protein, 9 aa, Homo Sapiens
AEAGQLRER

SEQ ID NO: 366757 - protein, 9 aa, Homo Sapiens
PTEPAASAA

SEQ ID NO: 366758 - protein, 9 aa, Homo Sapiens
ERKNQAPQC

SEQ ID NO: 366759 - protein, 9 aa, Homo Sapiens
LYANLFHSF

SEQ ID NO: 366760 - protein, 9 aa, Homo Sapiens
SLLTKKKAS

SEQ ID NO: 366761 - protein, 9 aa, Homo Sapiens
LEWCRHRAL

SEQ ID NO: 366762 - protein, 9 aa, Homo Sapiens
TFTRHSLKA

SEQ ID NO: 366763 - protein, 9 aa, Homo Sapiens
IKDHTFVTS

SEQ ID NO: 366764 - protein, 9 aa, Homo Sapiens
IVSATSGVE

SEQ ID NO: 366765 - protein, 9 aa, Homo Sapiens
RQFLPALQA

SEQ ID NO: 366766 - protein, 9 aa, Homo Sapiens
YRCTCARRT

SEQ ID NO: 366767 - protein, 9 aa, Homo Sapiens
TVGLCLEYA

SEQ ID NO: 366768 - protein, 9 aa, Homo Sapiens
VLSPRIHPL

SEQ ID NO: 366769 - protein, 9 aa, Homo Sapiens
PYCTSKAYN

SEQ ID NO: 366770 - protein, 9 aa, Homo Sapiens
TGSNDAHDK

SEQ ID NO: 366771 - protein, 9 aa, Homo Sapiens
IYRPGLVIG

SEQ ID NO: 366772 - protein, 9 aa, Homo Sapiens
WRPELLPLR

SEQ ID NO: 366773 - protein, 9 aa, Homo Sapiens
ESDLEKKKE

SEQ ID NO: 366774 - protein, 9 aa, Homo Sapiens
QEWHCGPQV

SEQ ID NO: 366775 - protein, 9 aa, Homo Sapiens
PSRPCRMRL

SEQ ID NO: 366776 - protein, 9 aa, Homo Sapiens
RPLPCPAAP

SEQ ID NO: 366777 - protein, 9 aa, Homo Sapiens
AIGSAGTEI

SEQ ID NO: 366778 - protein, 9 aa, Homo Sapiens
LLLLALGHM

SEQ ID NO: 366779 - protein, 9 aa, Homo Sapiens
WDINNQIYT

SEQ ID NO: 366780 - protein, 9 aa, Homo Sapiens
LVCAPNKDV

SEQ ID NO: 366781 - protein, 9 aa, Homo Sapiens
AGLQEVLGH

SEQ ID NO: 366782 - protein, 9 aa, Homo Sapiens
LRICISGRN

SEQ ID NO: 366783 - protein, 9 aa, Homo Sapiens
HLPPPCVDE

SEQ ID NO: 366784 - protein, 9 aa, Homo Sapiens
MTQFTLKHL

SEQ ID NO: 366785 - protein, 9 aa, Homo Sapiens
DGRSASWPQ

SEQ ID NO: 366786 - protein, 9 aa, Homo Sapiens
FPQRRTFLE

SEQ ID NO: 366787 - protein, 9 aa, Homo Sapiens
YMESQGAPR

SEQ ID NO: 366788 - protein, 9 aa, Homo Sapiens
DIALKHYDK

SEQ ID NO: 366789 - protein, 9 aa, Homo Sapiens
RRPAAPTRR

SEQ ID NO: 366790 - protein, 9 aa, Homo Sapiens
ARPSPSHGS

SEQ ID NO: 366791 - protein, 9 aa, Homo Sapiens
FLNSCFSRI

SEQ ID NO: 366792 - protein, 9 aa, Homo Sapiens
VLTQAVFET

SEQ ID NO: 366793 - protein, 9 aa, Homo Sapiens
LSSVLEWCR

SEQ ID NO: 366794 - protein, 9 aa, Homo Sapiens
SRRSLRTTP

SEQ ID NO: 366795 - protein, 9 aa, Homo Sapiens
RKHKHFYWK

SEQ ID NO: 366796 - protein, 9 aa, Homo Sapiens
AVTTTLHQM

SEQ ID NO: 366797 - protein, 9 aa, Homo Sapiens
SYVRIKDSG

SEQ ID NO: 366798 - protein, 9 aa, Homo Sapiens
QHCVQRCPA

SEQ ID NO: 366799 - protein, 9 aa, Homo Sapiens
ETVDSSGPL

SEQ ID NO: 366800 - protein, 9 aa, Homo Sapiens
MVRFVVRNT

SEQ ID NO: 366801 - protein, 9 aa, Homo Sapiens
QSCILSTKA

SEQ ID NO: 366802 - protein, 9 aa, Homo Sapiens
RIAIALFEI

SEQ ID NO: 366803 - protein, 9 aa, Homo Sapiens
MLPAPAAPG

SEQ ID NO: 366804 - protein, 9 aa, Homo Sapiens
AAKDPANDR

SEQ ID NO: 366805 - protein, 9 aa, Homo Sapiens
TWCPWASGR

SEQ ID NO: 366806 - protein, 9 aa, Homo Sapiens
IDLSPVYDL

SEQ ID NO: 366807 - protein, 9 aa, Homo Sapiens
CAATRPEGW

SEQ ID NO: 366808 - protein, 9 aa, Homo Sapiens
INFTMAIDF

SEQ ID NO: 366809 - protein, 9 aa, Homo Sapiens
EKDSNAGCD

SEQ ID NO: 366810 - protein, 9 aa, Homo Sapiens
RSEDLGHTA

SEQ ID NO: 366811 - protein, 9 aa, Homo Sapiens
KGVLERYAS

SEQ ID NO: 366812 - protein, 9 aa, Homo Sapiens
GASKASRAG

SEQ ID NO: 366813 - protein, 9 aa, Homo Sapiens
CLSASSTGS

SEQ ID NO: 366814 - protein, 9 aa, Homo Sapiens
SLSAQYGIG

SEQ ID NO: 366815 - protein, 9 aa, Homo Sapiens
APAEGARAR

SEQ ID NO: 366816 - protein, 9 aa, Homo Sapiens
PEPPHRTPW

SEQ ID NO: 366817 - protein, 9 aa, Homo Sapiens
VPGTSDFTR

SEQ ID NO: 366818 - protein, 9 aa, Homo Sapiens
LAVEACLRT

SEQ ID NO: 366819 - protein, 9 aa, Homo Sapiens
KNKDRDKEQ

SEQ ID NO: 366820 - protein, 9 aa, Homo Sapiens
PKKEKSVKE

SEQ ID NO: 366821 - protein, 9 aa, Homo Sapiens
RSASWPQRL

SEQ ID NO: 366822 - protein, 9 aa, Homo Sapiens
SCWPPWPRL

SEQ ID NO: 366823 - protein, 9 aa, Homo Sapiens
TPIFGPGIS

SEQ ID NO: 366824 - protein, 9 aa, Homo Sapiens
LQVKVIRVE

SEQ ID NO: 366825 - protein, 9 aa, Homo Sapiens
APWAWGCPA

SEQ ID NO: 366826 - protein, 9 aa, Homo Sapiens
RRASGRMHP

SEQ ID NO: 366827 - protein, 9 aa, Homo Sapiens
GVEKDRTPF

SEQ ID NO: 366828 - protein, 9 aa, Homo Sapiens
RSWVAIPQE

SEQ ID NO: 366829 - protein, 9 aa, Homo Sapiens
QRELLKTLN

SEQ ID NO: 366830 - protein, 9 aa, Homo Sapiens
EEEMCEKLK

SEQ ID NO: 366831 - protein, 9 aa, Homo Sapiens
FLHKLYLEI

SEQ ID NO: 366832 - protein, 9 aa, Homo Sapiens
VTNVGKVKI

SEQ ID NO: 366833 - protein, 9 aa, Homo Sapiens
FYHEDTPLW

SEQ ID NO: 366834 - protein, 9 aa, Homo Sapiens
SMDSVSRVR

SEQ ID NO: 366835 - protein, 9 aa, Homo Sapiens
HLFPGKNCT

SEQ ID NO: 366836 - protein, 9 aa, Homo Sapiens
ERHRSRHQQ

SEQ ID NO: 366837 - protein, 9 aa, Homo Sapiens
KVIRVEGLM

SEQ ID NO: 366838 - protein, 9 aa, Homo Sapiens
TESEKMVQV

SEQ ID NO: 366839 - protein, 9 aa, Homo Sapiens
VVLRKPQQK

SEQ ID NO: 366840 - protein, 9 aa, Homo Sapiens
INIELLLNE

SEQ ID NO: 366841 - protein, 9 aa, Homo Sapiens
LFLQTLFQT

SEQ ID NO: 366842 - protein, 9 aa, Homo Sapiens
KHNEVSAQM

SEQ ID NO: 366843 - protein, 9 aa, Homo Sapiens
CSHPCAVRR

SEQ ID NO: 366844 - protein, 9 aa, Homo Sapiens
PQNIRRNEM

SEQ ID NO: 366845 - protein, 9 aa, Homo Sapiens
QYYFRIASS

SEQ ID NO: 366846 - protein, 9 aa, Homo Sapiens
ARSNYAAEE

SEQ ID NO: 366847 - protein, 9 aa, Homo Sapiens
VLWPCSATV

SEQ ID NO: 366848 - protein, 9 aa, Homo Sapiens
KTWNAGLRV

SEQ ID NO: 366849 - protein, 9 aa, Homo Sapiens
DPITVIEGN

SEQ ID NO: 366850 - protein, 9 aa, Homo Sapiens
KRLTGSQLS

SEQ ID NO: 366851 - protein, 9 aa, Homo Sapiens
YFLLTTEKG

SEQ ID NO: 366852 - protein, 9 aa, Homo Sapiens
ISANVGDPS

SEQ ID NO: 366853 - protein, 9 aa, Homo Sapiens
GAWDNQKGR

SEQ ID NO: 366854 - protein, 9 aa, Homo Sapiens
IAAGIPSIA

SEQ ID NO: 366855 - protein, 9 aa, Homo Sapiens
WWAAGTSAR

SEQ ID NO: 366856 - protein, 9 aa, Homo Sapiens
DCEEEENWD

SEQ ID NO: 366857 - protein, 9 aa, Homo Sapiens
QDAQVANKN

SEQ ID NO: 366858 - protein, 9 aa, Homo Sapiens
WCPWASGRR

SEQ ID NO: 366859 - protein, 9 aa, Homo Sapiens
FFSGWISGS

SEQ ID NO: 366860 - protein, 9 aa, Homo Sapiens
KRKKMFLIQ

SEQ ID NO: 366861 - protein, 9 aa, Homo Sapiens
PGRNKWITE

SEQ ID NO: 366862 - protein, 9 aa, Homo Sapiens
ASGTSRARG

SEQ ID NO: 366863 - protein, 9 aa, Homo Sapiens
TKANIARSG

SEQ ID NO: 366864 - protein, 9 aa, Homo Sapiens
CWEPAPEWA

SEQ ID NO: 366865 - protein, 9 aa, Homo Sapiens
EEKQPLVSS

SEQ ID NO: 366866 - protein, 9 aa, Homo Sapiens
QLIMAYPKI

SEQ ID NO: 366867 - protein, 9 aa, Homo Sapiens
AVLGLLCMQ

SEQ ID NO: 366868 - protein, 9 aa, Homo Sapiens
TTSSSLCWN

SEQ ID NO: 366869 - protein, 9 aa, Homo Sapiens
HMVIGEGFG

SEQ ID NO: 366870 - protein, 9 aa, Homo Sapiens
AADPLLRTV

SEQ ID NO: 366871 - protein, 9 aa, Homo Sapiens
PVAQLLPKI

SEQ ID NO: 366872 - protein, 9 aa, Homo Sapiens
DKTHTRETT

SEQ ID NO: 366873 - protein, 9 aa, Homo Sapiens
SLKYLGMML

SEQ ID NO: 366874 - protein, 9 aa, Homo Sapiens
RGGSWRSPT

SEQ ID NO: 366875 - protein, 9 aa, Homo Sapiens
TREEHMERK

SEQ ID NO: 366876 - protein, 9 aa, Homo Sapiens
LIPSKMRET

SEQ ID NO: 366877 - protein, 9 aa, Homo Sapiens
MYLTSLSKN

SEQ ID NO: 366878 - protein, 9 aa, Homo Sapiens
NRGGSWRSP

SEQ ID NO: 366879 - protein, 9 aa, Homo Sapiens
NEDEEGQQK

SEQ ID NO: 366880 - protein, 9 aa, Homo Sapiens
SCVGVFQHD

SEQ ID NO: 366881 - protein, 9 aa, Homo Sapiens
VTPAKKHVF

SEQ ID NO: 366882 - protein, 9 aa, Homo Sapiens
LVYNVRLSW

SEQ ID NO: 366883 - protein, 9 aa, Homo Sapiens
HTLAAAASS

SEQ ID NO: 366884 - protein, 9 aa, Homo Sapiens
HTGTLCTRG

SEQ ID NO: 366885 - protein, 9 aa, Homo Sapiens
VQELSINSY

SEQ ID NO: 366886 - protein, 9 aa, Homo Sapiens
ASTPPCLRL

SEQ ID NO: 366887 - protein, 9 aa, Homo Sapiens
GKSTPTDSL

SEQ ID NO: 366888 - protein, 9 aa, Homo Sapiens
VHSRASWDS

SEQ ID NO: 366889 - protein, 9 aa, Homo Sapiens
IDKILELLD

SEQ ID NO: 366890 - protein, 9 aa, Homo Sapiens
SSLEPQIRP

SEQ ID NO: 366891 - protein, 9 aa, Homo Sapiens
ETRPAADRT

SEQ ID NO: 366892 - protein, 9 aa, Homo Sapiens
SLASGTSRA

SEQ ID NO: 366893 - protein, 9 aa, Homo Sapiens
KMVQVALDK

SEQ ID NO: 366894 - protein, 9 aa, Homo Sapiens
NLLLPCMLI

SEQ ID NO: 366895 - protein, 9 aa, Homo Sapiens
WELLGSPSL

SEQ ID NO: 366896 - protein, 9 aa, Homo Sapiens
QALCLQGKP

SEQ ID NO: 366897 - protein, 9 aa, Homo Sapiens
RLQSLLSLY

SEQ ID NO: 366898 - protein, 9 aa, Homo Sapiens
SSTLAHFNT

SEQ ID NO: 366899 - protein, 9 aa, Homo Sapiens
VMETLPTVD

SEQ ID NO: 366900 - protein, 9 aa, Homo Sapiens
SVLEWCRHR

SEQ ID NO: 366901 - protein, 9 aa, Homo Sapiens
GLARCFKVF

SEQ ID NO: 366902 - protein, 9 aa, Homo Sapiens
KRRGKSERG

SEQ ID NO: 366903 - protein, 9 aa, Homo Sapiens
LNNCYNRGQ

SEQ ID NO: 366904 - protein, 9 aa, Homo Sapiens
QKKNITNNI

SEQ ID NO: 366905 - protein, 9 aa, Homo Sapiens
VAVADIIPQ

SEQ ID NO: 366906 - protein, 9 aa, Homo Sapiens
IPWVYYSTA

SEQ ID NO: 366907 - protein, 9 aa, Homo Sapiens
EKFAITEAT

SEQ ID NO: 366908 - protein, 9 aa, Homo Sapiens
KPVICSLAD

SEQ ID NO: 366909 - protein, 9 aa, Homo Sapiens
KLLMSIYSS

SEQ ID NO: 366910 - protein, 9 aa, Homo Sapiens
PPGLRPCRC

SEQ ID NO: 366911 - protein, 9 aa, Homo Sapiens
WEGPGKQLY

SEQ ID NO: 366912 - protein, 9 aa, Homo Sapiens
LRAGFNRRF

SEQ ID NO: 366913 - protein, 9 aa, Homo Sapiens
GGPWATGPS

SEQ ID NO: 366914 - protein, 9 aa, Homo Sapiens
AQRHELVPA

SEQ ID NO: 366915 - protein, 9 aa, Homo Sapiens
GFAQWCEQM

SEQ ID NO: 366916 - protein, 9 aa, Homo Sapiens
YRLPPPMNC

SEQ ID NO: 366917 - protein, 9 aa, Homo Sapiens
CIIFSHFPF

SEQ ID NO: 366918 - protein, 9 aa, Homo Sapiens
SHFQHVKRG

SEQ ID NO: 366919 - protein, 9 aa, Homo Sapiens
KETKKNSNL

SEQ ID NO: 366920 - protein, 9 aa, Homo Sapiens
RAERAEQQC

SEQ ID NO: 366921 - protein, 9 aa, Homo Sapiens
SSACDGLLS

SEQ ID NO: 366922 - protein, 9 aa, Homo Sapiens
FLQVKVIRV

SEQ ID NO: 366923 - protein, 9 aa, Homo Sapiens
QRRESGLLL

SEQ ID NO: 366924 - protein, 9 aa, Homo Sapiens
KFFMKAMQL

SEQ ID NO: 366925 - protein, 9 aa, Homo Sapiens
VKGVLERYA

SEQ ID NO: 366926 - protein, 9 aa, Homo Sapiens
CCNLNSSFK

SEQ ID NO: 366927 - protein, 9 aa, Homo Sapiens
DCIFGVEEM

SEQ ID NO: 366928 - protein, 9 aa, Homo Sapiens
LFLSWIAIS

SEQ ID NO: 366929 - protein, 9 aa, Homo Sapiens
TTFTLVTRG

SEQ ID NO: 366930 - protein, 9 aa, Homo Sapiens
GACAHLAHQ

SEQ ID NO: 366931 - protein, 9 aa, Homo Sapiens
EQTARARAG

SEQ ID NO: 366932 - protein, 9 aa, Homo Sapiens
EELVIHNRG

SEQ ID NO: 366933 - protein, 9 aa, Homo Sapiens
MIRFFWMEM

SEQ ID NO: 366934 - protein, 9 aa, Homo Sapiens
PTALEPKST

SEQ ID NO: 366935 - protein, 9 aa, Homo Sapiens
NPAGLCGHR

SEQ ID NO: 366936 - protein, 9 aa, Homo Sapiens
CGGSGGVAA

SEQ ID NO: 366937 - protein, 9 aa, Homo Sapiens
MHTARVCDI

SEQ ID NO: 366938 - protein, 9 aa, Homo Sapiens
AFIILEKKT

SEQ ID NO: 366939 - protein, 9 aa, Homo Sapiens
GMHENANIV

SEQ ID NO: 366940 - protein, 9 aa, Homo Sapiens
PVACPDDQG

SEQ ID NO: 366941 - protein, 9 aa, Homo Sapiens
HIYSLFLSP

SEQ ID NO: 366942 - protein, 9 aa, Homo Sapiens
MATDVKLPS

SEQ ID NO: 366943 - protein, 9 aa, Homo Sapiens
DIARLTVNT

SEQ ID NO: 366944 - protein, 9 aa, Homo Sapiens
LTIGEKTEI

SEQ ID NO: 366945 - protein, 9 aa, Homo Sapiens
QAVSLVSGP

SEQ ID NO: 366946 - protein, 9 aa, Homo Sapiens
YFMYLTSLS

SEQ ID NO: 366947 - protein, 9 aa, Homo Sapiens
RPVARDALW

SEQ ID NO: 366948 - protein, 9 aa, Homo Sapiens
GQVPKASSR

SEQ ID NO: 366949 - protein, 9 aa, Homo Sapiens
LPPYLECVK

SEQ ID NO: 366950 - protein, 9 aa, Homo Sapiens
GSWCGTWTA

SEQ ID NO: 366951 - protein, 9 aa, Homo Sapiens
APACGLSAQ

SEQ ID NO: 366952 - protein, 9 aa, Homo Sapiens
KLWSTFHQP

SEQ ID NO: 366953 - protein, 9 aa, Homo Sapiens
KQHLPPPCV

SEQ ID NO: 366954 - protein, 9 aa, Homo Sapiens
GARARQGAA

SEQ ID NO: 366955 - protein, 9 aa, Homo Sapiens
GWRVEFQPM

SEQ ID NO: 366956 - protein, 9 aa, Homo Sapiens
VRARCLLDR

SEQ ID NO: 366957 - protein, 9 aa, Homo Sapiens
IPIPSLMAE

SEQ ID NO: 366958 - protein, 9 aa, Homo Sapiens
SDGGAGRMG

SEQ ID NO: 366959 - protein, 9 aa, Homo Sapiens
HVYSQVTVQ

SEQ ID NO: 366960 - protein, 9 aa, Homo Sapiens
PLDGPQIGV

SEQ ID NO: 366961 - protein, 9 aa, Homo Sapiens
GLVDGWRGW

SEQ ID NO: 366962 - protein, 9 aa, Homo Sapiens
IGVNIRKFI

SEQ ID NO: 366963 - protein, 9 aa, Homo Sapiens
DSPWRALGP

SEQ ID NO: 366964 - protein, 9 aa, Homo Sapiens
FYRLYAVSL

SEQ ID NO: 366965 - protein, 9 aa, Homo Sapiens
EEESEDSKN

SEQ ID NO: 366966 - protein, 9 aa, Homo Sapiens
AFISLDHYL

SEQ ID NO: 366967 - protein, 9 aa, Homo Sapiens
DPAGSPRPG

SEQ ID NO: 366968 - protein, 9 aa, Homo Sapiens
RAPACGLSA

SEQ ID NO: 366969 - protein, 9 aa, Homo Sapiens
DGTPLLEDP

SEQ ID NO: 366970 - protein, 9 aa, Homo Sapiens
EEIQEAART

SEQ ID NO: 366971 - protein, 9 aa, Homo Sapiens
WMTWRASAS

SEQ ID NO: 366972 - protein, 9 aa, Homo Sapiens
SSHGALQPV

SEQ ID NO: 366973 - protein, 9 aa, Homo Sapiens
LLALLALGT

SEQ ID NO: 366974 - protein, 9 aa, Homo Sapiens
GAPRALQAG

SEQ ID NO: 366975 - protein, 9 aa, Homo Sapiens
DADAAAAGF

SEQ ID NO: 366976 - protein, 9 aa, Homo Sapiens
WSGGSGKAW

SEQ ID NO: 366977 - protein, 9 aa, Homo Sapiens
GTGGASKLN

SEQ ID NO: 366978 - protein, 9 aa, Homo Sapiens
TTEKGEAEH

SEQ ID NO: 366979 - protein, 9 aa, Homo Sapiens
PPTPACAST

SEQ ID NO: 366980 - protein, 9 aa, Homo Sapiens
YGSMTQFTL

SEQ ID NO: 366981 - protein, 9 aa, Homo Sapiens
TPAPPPCRP

SEQ ID NO: 366982 - protein, 9 aa, Homo Sapiens
CLKFHTSRP

SEQ ID NO: 366983 - protein, 9 aa, Homo Sapiens
LLVLLSGLL

SEQ ID NO: 366984 - protein, 9 aa, Homo Sapiens
SVSPPQAAG

SEQ ID NO: 366985 - protein, 9 aa, Homo Sapiens
RPEPQCPRN

SEQ ID NO: 366986 - protein, 9 aa, Homo Sapiens
AGLGAQHVG

SEQ ID NO: 366987 - protein, 9 aa, Homo Sapiens
EGKCLSASS

SEQ ID NO: 366988 - protein, 9 aa, Homo Sapiens
QKPGRNKWI

SEQ ID NO: 366989 - protein, 9 aa, Homo Sapiens
VPLGNLSPG

SEQ ID NO: 366990 - protein, 9 aa, Homo Sapiens
SKCITECVR

SEQ ID NO: 366991 - protein, 9 aa, Homo Sapiens
SKHIKHFLK

SEQ ID NO: 366992 - protein, 9 aa, Homo Sapiens
KKCKEIKTT

SEQ ID NO: 366993 - protein, 9 aa, Homo Sapiens
MLRATTLCQ

SEQ ID NO: 366994 - protein, 9 aa, Homo Sapiens
TTHWLNTVL

SEQ ID NO: 366995 - protein, 9 aa, Homo Sapiens
LPLLRAGFN

SEQ ID NO: 366996 - protein, 9 aa, Homo Sapiens
TLLTMDWHG

SEQ ID NO: 366997 - protein, 9 aa, Homo Sapiens
ETIIKTLTQ

SEQ ID NO: 366998 - protein, 9 aa, Homo Sapiens
ERQYHTSAE

SEQ ID NO: 366999 - protein, 9 aa, Homo Sapiens
QTPQDSRQV

SEQ ID NO: 367000 - protein, 9 aa, Homo Sapiens
QQQWPQQGA

SEQ ID NO: 367001 - protein, 9 aa, Homo Sapiens
LMATDVKLP

SEQ ID NO: 367002 - protein, 9 aa, Homo Sapiens
WDFLCQLFV

SEQ ID NO: 367003 - protein, 9 aa, Homo Sapiens
ELAVADNRI

SEQ ID NO: 367004 - protein, 9 aa, Homo Sapiens
TRMLQSLPK

SEQ ID NO: 367005 - protein, 9 aa, Homo Sapiens
IVSTSSHLI

SEQ ID NO: 367006 - protein, 9 aa, Homo Sapiens
YHWLGHRVG

SEQ ID NO: 367007 - protein, 9 aa, Homo Sapiens
RLLQSCILS

SEQ ID NO: 367008 - protein, 9 aa, Homo Sapiens
PPAKRGKRR

SEQ ID NO: 367009 - protein, 9 aa, Homo Sapiens
RSLRTTPLK

SEQ ID NO: 367010 - protein, 9 aa, Homo Sapiens
VQMVFSVIL

SEQ ID NO: 367011 - protein, 9 aa, Homo Sapiens
TNMSLDRSG

SEQ ID NO: 367012 - protein, 9 aa, Homo Sapiens
VFNRNAHLV

SEQ ID NO: 367013 - protein, 9 aa, Homo Sapiens
KDKPLKKKK

SEQ ID NO: 367014 - protein, 9 aa, Homo Sapiens
LGRFCMISA

SEQ ID NO: 367015 - protein, 9 aa, Homo Sapiens
QGRFSLVLL

SEQ ID NO: 367016 - protein, 9 aa, Homo Sapiens
YRALTMPEL

SEQ ID NO: 367017 - protein, 9 aa, Homo Sapiens
VCMVKIMQA

SEQ ID NO: 367018 - protein, 9 aa, Homo Sapiens
ALCLLWEAL

SEQ ID NO: 367019 - protein, 9 aa, Homo Sapiens
EQPERGRVG

SEQ ID NO: 367020 - protein, 9 aa, Homo Sapiens
YRKIKMQNK

SEQ ID NO: 367021 - protein, 9 aa, Homo Sapiens
ITEELFLLV

SEQ ID NO: 367022 - protein, 9 aa, Homo Sapiens
TVSTGRPQH

SEQ ID NO: 367023 - protein, 9 aa, Homo Sapiens
VQLHYSIPE

SEQ ID NO: 367024 - protein, 9 aa, Homo Sapiens
FWERLVHLS

SEQ ID NO: 367025 - protein, 9 aa, Homo Sapiens
GLLAYAFPP

SEQ ID NO: 367026 - protein, 9 aa, Homo Sapiens
VMAVCGGSR

SEQ ID NO: 367027 - protein, 9 aa, Homo Sapiens
GVEQPSTQR

SEQ ID NO: 367028 - protein, 9 aa, Homo Sapiens
PWLSPICRT

SEQ ID NO: 367029 - protein, 9 aa, Homo Sapiens
VMDQARELV

SEQ ID NO: 367030 - protein, 9 aa, Homo Sapiens
LLLGGGQRG

SEQ ID NO: 367031 - protein, 9 aa, Homo Sapiens
TPSGQQQQQ

SEQ ID NO: 367032 - protein, 9 aa, Homo Sapiens
FLLTTEKGE

SEQ ID NO: 367033 - protein, 9 aa, Homo Sapiens
LRISTATSD

SEQ ID NO: 367034 - protein, 9 aa, Homo Sapiens
LASVTIIVS

SEQ ID NO: 367035 - protein, 9 aa, Homo Sapiens
YFADKLYKS

SEQ ID NO: 367036 - protein, 9 aa, Homo Sapiens
GIPSIAAYS

SEQ ID NO: 367037 - protein, 9 aa, Homo Sapiens
AVSPEEGAH

SEQ ID NO: 367038 - protein, 9 aa, Homo Sapiens
LAYAFPPGP

SEQ ID NO: 367039 - protein, 9 aa, Homo Sapiens
SVTIIVSAT

SEQ ID NO: 367040 - protein, 9 aa, Homo Sapiens
WWPQPCCIS

SEQ ID NO: 367041 - protein, 9 aa, Homo Sapiens
TGGWGCYRR

SEQ ID NO: 367042 - protein, 9 aa, Homo Sapiens
FMECLKVGM

SEQ ID NO: 367043 - protein, 9 aa, Homo Sapiens
IQQKTELLV

SEQ ID NO: 367044 - protein, 9 aa, Homo Sapiens
HDLNSPGSM

SEQ ID NO: 367045 - protein, 9 aa, Homo Sapiens
EAWAGRTGA

SEQ ID NO: 367046 - protein, 9 aa, Homo Sapiens
KIPPGLFQE

SEQ ID NO: 367047 - protein, 9 aa, Homo Sapiens
WTMVCNLAL

SEQ ID NO: 367048 - protein, 9 aa, Homo Sapiens
RIKRVSGTI

SEQ ID NO: 367049 - protein, 9 aa, Homo Sapiens
TTFGMEQCG

SEQ ID NO: 367050 - protein, 9 aa, Homo Sapiens
FRIASSVSP

SEQ ID NO: 367051 - protein, 9 aa, Homo Sapiens
RSDLPQIRA

SEQ ID NO: 367052 - protein, 9 aa, Homo Sapiens
NGCDACREL

SEQ ID NO: 367053 - protein, 9 aa, Homo Sapiens
ANLFHSFFV

SEQ ID NO: 367054 - protein, 9 aa, Homo Sapiens
IPSPIGANG

SEQ ID NO: 367055 - protein, 9 aa, Homo Sapiens
ARRTQMTSR

SEQ ID NO: 367056 - protein, 9 aa, Homo Sapiens
EWVIENPAV

SEQ ID NO: 367057 - protein, 9 aa, Homo Sapiens
QVLNSQEKK

SEQ ID NO: 367058 - protein, 9 aa, Homo Sapiens
YLHHCQRHI

SEQ ID NO: 367059 - protein, 9 aa, Homo Sapiens
SSHTRSHLR

SEQ ID NO: 367060 - protein, 9 aa, Homo Sapiens
SKSMDRVYD

SEQ ID NO: 367061 - protein, 9 aa, Homo Sapiens
RVCGFPSEK

SEQ ID NO: 367062 - protein, 9 aa, Homo Sapiens
FPASSSLVT

SEQ ID NO: 367063 - protein, 9 aa, Homo Sapiens
ELWATMRGF

SEQ ID NO: 367064 - protein, 9 aa, Homo Sapiens
QGAPRAGLA

SEQ ID NO: 367065 - protein, 9 aa, Homo Sapiens
VAKQLLAVG

SEQ ID NO: 367066 - protein, 9 aa, Homo Sapiens
LTQVVAVFE

SEQ ID NO: 367067 - protein, 9 aa, Homo Sapiens
ARQGAAAEE

SEQ ID NO: 367068 - protein, 9 aa, Homo Sapiens
WTLYANLFH

SEQ ID NO: 367069 - protein, 9 aa, Homo Sapiens
MYERVVLRK

SEQ ID NO: 367070 - protein, 9 aa, Homo Sapiens
VLEVRHFSV

SEQ ID NO: 367071 - protein, 9 aa, Homo Sapiens
RLAAFIGSM

SEQ ID NO: 367072 - protein, 9 aa, Homo Sapiens
SASRTSNIS

SEQ ID NO: 367073 - protein, 9 aa, Homo Sapiens
LHNRNFWIL

SEQ ID NO: 367074 - protein, 9 aa, Homo Sapiens
KLRPPQKKS

SEQ ID NO: 367075 - protein, 9 aa, Homo Sapiens
QNQGLALPY

SEQ ID NO: 367076 - protein, 9 aa, Homo Sapiens
CINMRQLYG

SEQ ID NO: 367077 - protein, 9 aa, Homo Sapiens
IMKKAAEVL

SEQ ID NO: 367078 - protein, 9 aa, Homo Sapiens
ILMRFLTYS

SEQ ID NO: 367079 - protein, 9 aa, Homo Sapiens
ATMWPNSTP

SEQ ID NO: 367080 - protein, 9 aa, Homo Sapiens
FTRHSLKAR

SEQ ID NO: 367081 - protein, 9 aa, Homo Sapiens
VINHFNVEE

SEQ ID NO: 367082 - protein, 9 aa, Homo Sapiens
GWGPAPGSG

SEQ ID NO: 367083 - protein, 9 aa, Homo Sapiens
PGSARSASA

SEQ ID NO: 367084 - protein, 9 aa, Homo Sapiens
WLPERRCSR

SEQ ID NO: 367085 - protein, 9 aa, Homo Sapiens
LLYHAMKDH

SEQ ID NO: 367086 - protein, 9 aa, Homo Sapiens
SNFNPGTLS

SEQ ID NO: 367087 - protein, 9 aa, Homo Sapiens
SAPGSARSA

SEQ ID NO: 367088 - protein, 9 aa, Homo Sapiens
QCYCLISVE

SEQ ID NO: 367089 - protein, 9 aa, Homo Sapiens
RPPRWTAMG

SEQ ID NO: 367090 - protein, 9 aa, Homo Sapiens
TAPSPFPSL

SEQ ID NO: 367091 - protein, 9 aa, Homo Sapiens
ISSKHIKHF

SEQ ID NO: 367092 - protein, 9 aa, Homo Sapiens
RLSPLIRAP

SEQ ID NO: 367093 - protein, 9 aa, Homo Sapiens
AMELKPTVP

SEQ ID NO: 367094 - protein, 9 aa, Homo Sapiens
WQIIQRRKN

SEQ ID NO: 367095 - protein, 9 aa, Homo Sapiens
SSPVSARRT

SEQ ID NO: 367096 - protein, 9 aa, Homo Sapiens
APASPPTKV

SEQ ID NO: 367097 - protein, 9 aa, Homo Sapiens
KLIEFSPLM

SEQ ID NO: 367098 - protein, 9 aa, Homo Sapiens
RLPDCSWPQ

SEQ ID NO: 367099 - protein, 9 aa, Homo Sapiens
WDLEVRLCF

SEQ ID NO: 367100 - protein, 9 aa, Homo Sapiens
EPLYQCQRC

SEQ ID NO: 367101 - protein, 9 aa, Homo Sapiens
YLGMMLVEQ

SEQ ID NO: 367102 - protein, 9 aa, Homo Sapiens
RPCASFDCT

SEQ ID NO: 367103 - protein, 9 aa, Homo Sapiens
NFGFSRLRK

SEQ ID NO: 367104 - protein, 9 aa, Homo Sapiens
NVQCCIIFS

SEQ ID NO: 367105 - protein, 9 aa, Homo Sapiens
LAIASLIGM

SEQ ID NO: 367106 - protein, 9 aa, Homo Sapiens
THPGPPPAC

SEQ ID NO: 367107 - protein, 9 aa, Homo Sapiens
PKQAAQEEK

SEQ ID NO: 367108 - protein, 9 aa, Homo Sapiens
LSVQNQFIH

SEQ ID NO: 367109 - protein, 9 aa, Homo Sapiens
SWSPDISGG

SEQ ID NO: 367110 - protein, 9 aa, Homo Sapiens
SCRSETLRK

SEQ ID NO: 367111 - protein, 9 aa, Homo Sapiens
TQTSHYLRQ

SEQ ID NO: 367112 - protein, 9 aa, Homo Sapiens
MESQGAPRA

SEQ ID NO: 367113 - protein, 9 aa, Homo Sapiens
RPLLPRAPP

SEQ ID NO: 367114 - protein, 9 aa, Homo Sapiens
YWKAGSVQL

SEQ ID NO: 367115 - protein, 9 aa, Homo Sapiens
KPPPQKERR

SEQ ID NO: 367116 - protein, 9 aa, Homo Sapiens
KMGMQHHLQ

SEQ ID NO: 367117 - protein, 9 aa, Homo Sapiens
ALWESRSHT

SEQ ID NO: 367118 - protein, 9 aa, Homo Sapiens
RDEIYGAVA

SEQ ID NO: 367119 - protein, 9 aa, Homo Sapiens
CMQLGPGPK

SEQ ID NO: 367120 - protein, 9 aa, Homo Sapiens
GEELQSSGV

SEQ ID NO: 367121 - protein, 9 aa, Homo Sapiens
TRFACFTWR

SEQ ID NO: 367122 - protein, 9 aa, Homo Sapiens
FVFFSMMRP

SEQ ID NO: 367123 - protein, 9 aa, Homo Sapiens
CLRWITPTC

SEQ ID NO: 367124 - protein, 9 aa, Homo Sapiens
NGIENNVLR

SEQ ID NO: 367125 - protein, 9 aa, Homo Sapiens
KGSLHQTYE

SEQ ID NO: 367126 - protein, 9 aa, Homo Sapiens
SKGNSLSDE

SEQ ID NO: 367127 - protein, 9 aa, Homo Sapiens
WAVLAWARA

SEQ ID NO: 367128 - protein, 9 aa, Homo Sapiens
SSKHIKHFL

SEQ ID NO: 367129 - protein, 9 aa, Homo Sapiens
KKLPWKLKL

SEQ ID NO: 367130 - protein, 9 aa, Homo Sapiens
ASTPRPSTA

SEQ ID NO: 367131 - protein, 9 aa, Homo Sapiens
KRGASSSTS

SEQ ID NO: 367132 - protein, 9 aa, Homo Sapiens
RTLVRKLCQ

SEQ ID NO: 367133 - protein, 9 aa, Homo Sapiens
RLAALLALL

SEQ ID NO: 367134 - protein, 9 aa, Homo Sapiens
PSPSSAAST

SEQ ID NO: 367135 - protein, 9 aa, Homo Sapiens
HSYVRIKDS

SEQ ID NO: 367136 - protein, 9 aa, Homo Sapiens
CWKRGSRSR

SEQ ID NO: 367137 - protein, 9 aa, Homo Sapiens
HQETQHREA

SEQ ID NO: 367138 - protein, 9 aa, Homo Sapiens
HTPTCHLLG

SEQ ID NO: 367139 - protein, 9 aa, Homo Sapiens
SLQLKVFPK

SEQ ID NO: 367140 - protein, 9 aa, Homo Sapiens
IDRNMGEIV

SEQ ID NO: 367141 - protein, 9 aa, Homo Sapiens
AQARGFRKL

SEQ ID NO: 367142 - protein, 9 aa, Homo Sapiens
DMHPVTIWG

SEQ ID NO: 367143 - protein, 9 aa, Homo Sapiens
HAWTSTPRT

SEQ ID NO: 367144 - protein, 9 aa, Homo Sapiens
CEFGIRFFL

SEQ ID NO: 367145 - protein, 9 aa, Homo Sapiens
APEKGSLHQ

SEQ ID NO: 367146 - protein, 9 aa, Homo Sapiens
CAHFPASSS

SEQ ID NO: 367147 - protein, 9 aa, Homo Sapiens
NHITAFTEV

SEQ ID NO: 367148 - protein, 9 aa, Homo Sapiens
PEVLESLLE

SEQ ID NO: 367149 - protein, 9 aa, Homo Sapiens
RARRTNGAS

SEQ ID NO: 367150 - protein, 9 aa, Homo Sapiens
LSPVYDLLE

SEQ ID NO: 367151 - protein, 9 aa, Homo Sapiens
LTVNTDVGY

SEQ ID NO: 367152 - protein, 9 aa, Homo Sapiens
AQHVGQVPQ

SEQ ID NO: 367153 - protein, 9 aa, Homo Sapiens
FFIAFSSQL

SEQ ID NO: 367154 - protein, 9 aa, Homo Sapiens
YRVVDLQTL

SEQ ID NO: 367155 - protein, 9 aa, Homo Sapiens
PKALKGIHP

SEQ ID NO: 367156 - protein, 9 aa, Homo Sapiens
LAIAAIEKM

SEQ ID NO: 367157 - protein, 9 aa, Homo Sapiens
QLHFLSVQN

SEQ ID NO: 367158 - protein, 9 aa, Homo Sapiens
PLQPSRPPT

SEQ ID NO: 367159 - protein, 9 aa, Homo Sapiens
CRSVLTVRN

SEQ ID NO: 367160 - protein, 9 aa, Homo Sapiens
CWSTVAQTP

SEQ ID NO: 367161 - protein, 9 aa, Homo Sapiens
NIIAKLWRM

SEQ ID NO: 367162 - protein, 9 aa, Homo Sapiens
SPCVWTPRA

SEQ ID NO: 367163 - protein, 9 aa, Homo Sapiens
LDLNPLMFV

SEQ ID NO: 367164 - protein, 9 aa, Homo Sapiens
FRSNSNHRD

SEQ ID NO: 367165 - protein, 9 aa, Homo Sapiens
KNPSPAEGA

SEQ ID NO: 367166 - protein, 9 aa, Homo Sapiens
LHTPQHPRC

SEQ ID NO: 367167 - protein, 9 aa, Homo Sapiens
SGSPCVWTP

SEQ ID NO: 367168 - protein, 9 aa, Homo Sapiens
FSSPNVTSM

SEQ ID NO: 367169 - protein, 9 aa, Homo Sapiens
PGAPPPAGC

SEQ ID NO: 367170 - protein, 9 aa, Homo Sapiens
IWIYRSALN

SEQ ID NO: 367171 - protein, 9 aa, Homo Sapiens
DPDPANAPC

SEQ ID NO: 367172 - protein, 9 aa, Homo Sapiens
VSTMIPPSS

SEQ ID NO: 367173 - protein, 9 aa, Homo Sapiens
RPHKTAHVP

SEQ ID NO: 367174 - protein, 9 aa, Homo Sapiens
CAKIRILSL

SEQ ID NO: 367175 - protein, 9 aa, Homo Sapiens
ATNENRGGS

SEQ ID NO: 367176 - protein, 9 aa, Homo Sapiens
DFSHYEYLC

SEQ ID NO: 367177 - protein, 9 aa, Homo Sapiens
PSKSAPVPK

SEQ ID NO: 367178 - protein, 9 aa, Homo Sapiens
ISKGNSLSD

SEQ ID NO: 367179 - protein, 9 aa, Homo Sapiens
EELFLLVSL

SEQ ID NO: 367180 - protein, 9 aa, Homo Sapiens
FLSPAIRLL

SEQ ID NO: 367181 - protein, 9 aa, Homo Sapiens
PPSHREAWA

SEQ ID NO: 367182 - protein, 9 aa, Homo Sapiens
RHVHHEKLQ

SEQ ID NO: 367183 - protein, 9 aa, Homo Sapiens
PLPADLPHS

SEQ ID NO: 367184 - protein, 9 aa, Homo Sapiens
RSNSNHRDW

SEQ ID NO: 367185 - protein, 9 aa, Homo Sapiens
KTTRVNTSL

SEQ ID NO: 367186 - protein, 9 aa, Homo Sapiens
PRRDPSGSP

SEQ ID NO: 367187 - protein, 9 aa, Homo Sapiens
SKHKLESPA

SEQ ID NO: 367188 - protein, 9 aa, Homo Sapiens
DLTVLGQPG

SEQ ID NO: 367189 - protein, 9 aa, Homo Sapiens
PAAPASTPR

SEQ ID NO: 367190 - protein, 9 aa, Homo Sapiens
GRFSLVLLQ

SEQ ID NO: 367191 - protein, 9 aa, Homo Sapiens
TKERTEPEV

SEQ ID NO: 367192 - protein, 9 aa, Homo Sapiens
PGEDMLCLL

SEQ ID NO: 367193 - protein, 9 aa, Homo Sapiens
VAKPLDGPQ

SEQ ID NO: 367194 - protein, 9 aa, Homo Sapiens
TEYKICIDM

SEQ ID NO: 367195 - protein, 9 aa, Homo Sapiens
SFLCSPRFH

SEQ ID NO: 367196 - protein, 9 aa, Homo Sapiens
EIRVCPKKT

SEQ ID NO: 367197 - protein, 9 aa, Homo Sapiens
LKPTVPPIF

SEQ ID NO: 367198 - protein, 9 aa, Homo Sapiens
FFFSGWISG

SEQ ID NO: 367199 - protein, 9 aa, Homo Sapiens
GRDCSDVDP

SEQ ID NO: 367200 - protein, 9 aa, Homo Sapiens
WLPGCPRGV

SEQ ID NO: 367201 - protein, 9 aa, Homo Sapiens
LVRGTMQPF

SEQ ID NO: 367202 - protein, 9 aa, Homo Sapiens
SLSRIKKVS

SEQ ID NO: 367203 - protein, 9 aa, Homo Sapiens
LSSHTRSHL

SEQ ID NO: 367204 - protein, 9 aa, Homo Sapiens
GPGVGSFLL

SEQ ID NO: 367205 - protein, 9 aa, Homo Sapiens
GVAAGDQGR

SEQ ID NO: 367206 - protein, 9 aa, Homo Sapiens
MRQLYGDSR

SEQ ID NO: 367207 - protein, 9 aa, Homo Sapiens
QERIWSYLM

SEQ ID NO: 367208 - protein, 9 aa, Homo Sapiens
TVLLQSALD

SEQ ID NO: 367209 - protein, 9 aa, Homo Sapiens
VCCGNEVTP

SEQ ID NO: 367210 - protein, 9 aa, Homo Sapiens
WEPAPEWAS

SEQ ID NO: 367211 - protein, 9 aa, Homo Sapiens
LLPGRLLQS

SEQ ID NO: 367212 - protein, 9 aa, Homo Sapiens
GFAVGTWEF

SEQ ID NO: 367213 - protein, 9 aa, Homo Sapiens
LAAGGSLAD

SEQ ID NO: 367214 - protein, 9 aa, Homo Sapiens
EICACPPCL

SEQ ID NO: 367215 - protein, 9 aa, Homo Sapiens
LVEVSSLKY

SEQ ID NO: 367216 - protein, 9 aa, Homo Sapiens
GVHDSMDND

SEQ ID NO: 367217 - protein, 9 aa, Homo Sapiens
VDNEYEDED

SEQ ID NO: 367218 - protein, 9 aa, Homo Sapiens
YANLFHSFF

SEQ ID NO: 367219 - protein, 9 aa, Homo Sapiens
THTRETTYD

SEQ ID NO: 367220 - protein, 9 aa, Homo Sapiens
FRRLQLFMH

SEQ ID NO: 367221 - protein, 9 aa, Homo Sapiens
SITSVTLRP

SEQ ID NO: 367222 - protein, 9 aa, Homo Sapiens
QVRALLLAA

SEQ ID NO: 367223 - protein, 9 aa, Homo Sapiens
RLCKDGMWT

SEQ ID NO: 367224 - protein, 9 aa, Homo Sapiens
STMPQQGWN

SEQ ID NO: 367225 - protein, 9 aa, Homo Sapiens
KKESSPIEP

SEQ ID NO: 367226 - protein, 9 aa, Homo Sapiens
GHQRPWWNV

SEQ ID NO: 367227 - protein, 9 aa, Homo Sapiens
TRPAADRTF

SEQ ID NO: 367228 - protein, 9 aa, Homo Sapiens
TSSHLILLW

SEQ ID NO: 367229 - protein, 9 aa, Homo Sapiens
LGHTAREKE

SEQ ID NO: 367230 - protein, 9 aa, Homo Sapiens
GCDACRELI

SEQ ID NO: 367231 - protein, 9 aa, Homo Sapiens
RIEGFPFAA

SEQ ID NO: 367232 - protein, 9 aa, Homo Sapiens
HVQELQKLK

SEQ ID NO: 367233 - protein, 9 aa, Homo Sapiens
GTAGGGGSW

SEQ ID NO: 367234 - protein, 9 aa, Homo Sapiens
RCCQEHGLG

SEQ ID NO: 367235 - protein, 9 aa, Homo Sapiens
KELRNPLKV

SEQ ID NO: 367236 - protein, 9 aa, Homo Sapiens
QARGFRKLH

SEQ ID NO: 367237 - protein, 9 aa, Homo Sapiens
AGGPEERLT

SEQ ID NO: 367238 - protein, 9 aa, Homo Sapiens
MKEKASHGF

SEQ ID NO: 367239 - protein, 9 aa, Homo Sapiens
EPEAEGSFL

SEQ ID NO: 367240 - protein, 9 aa, Homo Sapiens
SPIRDMKVK

SEQ ID NO: 367241 - protein, 9 aa, Homo Sapiens
SIAFSTSIT

SEQ ID NO: 367242 - protein, 9 aa, Homo Sapiens
PLLTDQLSS

SEQ ID NO: 367243 - protein, 9 aa, Homo Sapiens
REWRHLCFQ

SEQ ID NO: 367244 - protein, 9 aa, Homo Sapiens
LQTLFQTQI

SEQ ID NO: 367245 - protein, 9 aa, Homo Sapiens
EHLMEKMKT

SEQ ID NO: 367246 - protein, 9 aa, Homo Sapiens
YHLVSDDVC

SEQ ID NO: 367247 - protein, 9 aa, Homo Sapiens
STVPHAATA

SEQ ID NO: 367248 - protein, 9 aa, Homo Sapiens
LMAPPGMQG

SEQ ID NO: 367249 - protein, 9 aa, Homo Sapiens
KRVIEVQLL

SEQ ID NO: 367250 - protein, 9 aa, Homo Sapiens
RTPPEPAVT

SEQ ID NO: 367251 - protein, 9 aa, Homo Sapiens
TQFTLKHLS

SEQ ID NO: 367252 - protein, 9 aa, Homo Sapiens
LGGRMGFIH

SEQ ID NO: 367253 - protein, 9 aa, Homo Sapiens
TSITRFAFS

SEQ ID NO: 367254 - protein, 9 aa, Homo Sapiens
LSTPIFGPG

SEQ ID NO: 367255 - protein, 9 aa, Homo Sapiens
VSPAPSRRL

SEQ ID NO: 367256 - protein, 9 aa, Homo Sapiens
PGVVTDLFP

SEQ ID NO: 367257 - protein, 9 aa, Homo Sapiens
GTGRGRQER

SEQ ID NO: 367258 - protein, 9 aa, Homo Sapiens
SNLSHMMIR

SEQ ID NO: 367259 - protein, 9 aa, Homo Sapiens
LTKQVIHTV

SEQ ID NO: 367260 - protein, 9 aa, Homo Sapiens
RELLKTLNM

SEQ ID NO: 367261 - protein, 9 aa, Homo Sapiens
QDEALRARN

SEQ ID NO: 367262 - protein, 9 aa, Homo Sapiens
AVRARCLLD

SEQ ID NO: 367263 - protein, 9 aa, Homo Sapiens
IKSSLDGET

SEQ ID NO: 367264 - protein, 9 aa, Homo Sapiens
DLNSPGSMV

SEQ ID NO: 367265 - protein, 9 aa, Homo Sapiens
DQCFSRLPS

SEQ ID NO: 367266 - protein, 9 aa, Homo Sapiens
LAREEAGAD

SEQ ID NO: 367267 - protein, 9 aa, Homo Sapiens
EPKNTSTYH

SEQ ID NO: 367268 - protein, 9 aa, Homo Sapiens
PVLAGGGNG

SEQ ID NO: 367269 - protein, 9 aa, Homo Sapiens
LCQVSGMPA

SEQ ID NO: 367270 - protein, 9 aa, Homo Sapiens
PPTKVSRTK

SEQ ID NO: 367271 - protein, 9 aa, Homo Sapiens
GNCGPYCTS

SEQ ID NO: 367272 - protein, 9 aa, Homo Sapiens
KKIKELQAL

SEQ ID NO: 367273 - protein, 9 aa, Homo Sapiens
QEGGSLQVP

SEQ ID NO: 367274 - protein, 9 aa, Homo Sapiens
AANINESTP

SEQ ID NO: 367275 - protein, 9 aa, Homo Sapiens
QCRPAGRCA

SEQ ID NO: 367276 - protein, 9 aa, Homo Sapiens
GKTKPGEDM

SEQ ID NO: 367277 - protein, 9 aa, Homo Sapiens
QEVAVHVQE

SEQ ID NO: 367278 - protein, 9 aa, Homo Sapiens
VIRVEGLMA

SEQ ID NO: 367279 - protein, 9 aa, Homo Sapiens
MVIGEGFGF

SEQ ID NO: 367280 - protein, 9 aa, Homo Sapiens
KPRTPKIPP

SEQ ID NO: 367281 - protein, 9 aa, Homo Sapiens
TTEAYQKYN

SEQ ID NO: 367282 - protein, 9 aa, Homo Sapiens
CRSFRSGDG

SEQ ID NO: 367283 - protein, 9 aa, Homo Sapiens
VTSTMPQQG

SEQ ID NO: 367284 - protein, 9 aa, Homo Sapiens
QHVKRGWVW

SEQ ID NO: 367285 - protein, 9 aa, Homo Sapiens
PQEEPTIGS

SEQ ID NO: 367286 - protein, 9 aa, Homo Sapiens
PDDICREVL

SEQ ID NO: 367287 - protein, 9 aa, Homo Sapiens
HYLAIVHAT

SEQ ID NO: 367288 - protein, 9 aa, Homo Sapiens
RALQAGGFP

SEQ ID NO: 367289 - protein, 9 aa, Homo Sapiens
DHKWELLGS

SEQ ID NO: 367290 - protein, 9 aa, Homo Sapiens
RVPVDIRIL

SEQ ID NO: 367291 - protein, 9 aa, Homo Sapiens
REREQTARA

SEQ ID NO: 367292 - protein, 9 aa, Homo Sapiens
KKNKEKKES

SEQ ID NO: 367293 - protein, 9 aa, Homo Sapiens
STLHQRADP

SEQ ID NO: 367294 - protein, 9 aa, Homo Sapiens
EPQCPRNRP

SEQ ID NO: 367295 - protein, 9 aa, Homo Sapiens
EKESRMEIA

SEQ ID NO: 367296 - protein, 9 aa, Homo Sapiens
TNGAAWEPR

SEQ ID NO: 367297 - protein, 9 aa, Homo Sapiens
SPPTKVSRT

SEQ ID NO: 367298 - protein, 9 aa, Homo Sapiens
GNSRMNSTG

SEQ ID NO: 367299 - protein, 9 aa, Homo Sapiens
RGTARCARP

SEQ ID NO: 367300 - protein, 9 aa, Homo Sapiens
KWQKHHPQR

SEQ ID NO: 367301 - protein, 9 aa, Homo Sapiens
RAAAAHGDG

SEQ ID NO: 367302 - protein, 9 aa, Homo Sapiens
YFRIASSVS

SEQ ID NO: 367303 - protein, 9 aa, Homo Sapiens
YPHWCEYCK

SEQ ID NO: 367304 - protein, 9 aa, Homo Sapiens
PTKVSRTKS

SEQ ID NO: 367305 - protein, 9 aa, Homo Sapiens
GERLYRCRE

SEQ ID NO: 367306 - protein, 9 aa, Homo Sapiens
VKNVAKPLD

SEQ ID NO: 367307 - protein, 9 aa, Homo Sapiens
TLLQESCLI

SEQ ID NO: 367308 - protein, 9 aa, Homo Sapiens
HAASLKLPQ

SEQ ID NO: 367309 - protein, 9 aa, Homo Sapiens
CVPEQLPQV

SEQ ID NO: 367310 - protein, 9 aa, Homo Sapiens
RLQLRLNPR

SEQ ID NO: 367311 - protein, 9 aa, Homo Sapiens
YRLYAVSLV

SEQ ID NO: 367312 - protein, 9 aa, Homo Sapiens
RAETREEHM

SEQ ID NO: 367313 - protein, 9 aa, Homo Sapiens
LENLGFTHL

SEQ ID NO: 367314 - protein, 9 aa, Homo Sapiens
IPPGLFQEI

SEQ ID NO: 367315 - protein, 9 aa, Homo Sapiens
RASPGAMDL

SEQ ID NO: 367316 - protein, 9 aa, Homo Sapiens
KELEAIESW

SEQ ID NO: 367317 - protein, 9 aa, Homo Sapiens
EVQLLDDND

SEQ ID NO: 367318 - protein, 9 aa, Homo Sapiens
SPVSGSWCG

SEQ ID NO: 367319 - protein, 9 aa, Homo Sapiens
KEEHVCLPN

SEQ ID NO: 367320 - protein, 9 aa, Homo Sapiens
KKFLDKLSK

SEQ ID NO: 367321 - protein, 9 aa, Homo Sapiens
SVKNKPLYF

SEQ ID NO: 367322 - protein, 9 aa, Homo Sapiens
NSRSASAEI

SEQ ID NO: 367323 - protein, 9 aa, Homo Sapiens
INHFNVEED

SEQ ID NO: 367324 - protein, 9 aa, Homo Sapiens
CKGGITFFR

SEQ ID NO: 367325 - protein, 9 aa, Homo Sapiens
PDPKALKGI

SEQ ID NO: 367326 - protein, 9 aa, Homo Sapiens
ANFVKDTYS

SEQ ID NO: 367327 - protein, 9 aa, Homo Sapiens
KKKSRTLGN

SEQ ID NO: 367328 - protein, 9 aa, Homo Sapiens
PSLSLSRIK

SEQ ID NO: 367329 - protein, 9 aa, Homo Sapiens
HRIRQALFP

SEQ ID NO: 367330 - protein, 9 aa, Homo Sapiens
TEAGGARET

SEQ ID NO: 367331 - protein, 9 aa, Homo Sapiens
RDALWARAF

SEQ ID NO: 367332 - protein, 9 aa, Homo Sapiens
PTGKCFLLA

SEQ ID NO: 367333 - protein, 9 aa, Homo Sapiens
DAYPGRRVD

SEQ ID NO: 367334 - protein, 9 aa, Homo Sapiens
PGTSDFTRS

SEQ ID NO: 367335 - protein, 9 aa, Homo Sapiens
GPRAGAPAE

SEQ ID NO: 367336 - protein, 9 aa, Homo Sapiens
PPRWTAMGG

SEQ ID NO: 367337 - protein, 9 aa, Homo Sapiens
GQERTVWYL

SEQ ID NO: 367338 - protein, 9 aa, Homo Sapiens
LYLAEWVIE

SEQ ID NO: 367339 - protein, 9 aa, Homo Sapiens
PDISGGREI

SEQ ID NO: 367340 - protein, 9 aa, Homo Sapiens
WRKSKGKKR

SEQ ID NO: 367341 - protein, 9 aa, Homo Sapiens
VSLVNIILL

SEQ ID NO: 367342 - protein, 9 aa, Homo Sapiens
MQRTVGTWR

SEQ ID NO: 367343 - protein, 9 aa, Homo Sapiens
IYTVKDIKA

SEQ ID NO: 367344 - protein, 9 aa, Homo Sapiens
SSIVDCVLK

SEQ ID NO: 367345 - protein, 9 aa, Homo Sapiens
QTSMHKKPR

SEQ ID NO: 367346 - protein, 9 aa, Homo Sapiens
SPLLWEDRA

SEQ ID NO: 367347 - protein, 9 aa, Homo Sapiens
KLPQDQGLN

SEQ ID NO: 367348 - protein, 9 aa, Homo Sapiens
KWRVERDVV

SEQ ID NO: 367349 - protein, 9 aa, Homo Sapiens
LTQAVFETI

SEQ ID NO: 367350 - protein, 9 aa, Homo Sapiens
KVPEEGSEP

SEQ ID NO: 367351 - protein, 9 aa, Homo Sapiens
KQFLHKLYL

SEQ ID NO: 367352 - protein, 9 aa, Homo Sapiens
RLLVVGCIL

SEQ ID NO: 367353 - protein, 9 aa, Homo Sapiens
NNEVRVQVD

SEQ ID NO: 367354 - protein, 9 aa, Homo Sapiens
LPDCSWPQG

SEQ ID NO: 367355 - protein, 9 aa, Homo Sapiens
KYKFFMKAM

SEQ ID NO: 367356 - protein, 9 aa, Homo Sapiens
PYLECVKQQ

SEQ ID NO: 367357 - protein, 9 aa, Homo Sapiens
TPAKKHVFD

SEQ ID NO: 367358 - protein, 9 aa, Homo Sapiens
RFSLVLLQD

SEQ ID NO: 367359 - protein, 9 aa, Homo Sapiens
YEVGEIRWG

SEQ ID NO: 367360 - protein, 9 aa, Homo Sapiens
IYWQEFEDT

SEQ ID NO: 367361 - protein, 9 aa, Homo Sapiens
LEKENRDLE

SEQ ID NO: 367362 - protein, 9 aa, Homo Sapiens
DRLREPLQN

SEQ ID NO: 367363 - protein, 9 aa, Homo Sapiens
VLENFSTLH

SEQ ID NO: 367364 - protein, 9 aa, Homo Sapiens
FVFLRKHYL

SEQ ID NO: 367365 - protein, 9 aa, Homo Sapiens
ERERYLWQE

SEQ ID NO: 367366 - protein, 9 aa, Homo Sapiens
DKLDKDGLE

SEQ ID NO: 367367 - protein, 9 aa, Homo Sapiens
LAHLTWKQC

SEQ ID NO: 367368 - protein, 9 aa, Homo Sapiens
QTEIAQLMS

SEQ ID NO: 367369 - protein, 9 aa, Homo Sapiens
IMQRFSRKA

SEQ ID NO: 367370 - protein, 9 aa, Homo Sapiens
SGYLCICNE

SEQ ID NO: 367371 - protein, 9 aa, Homo Sapiens
KTLTQRKKL

SEQ ID NO: 367372 - protein, 9 aa, Homo Sapiens
APPEAPLTP

SEQ ID NO: 367373 - protein, 9 aa, Homo Sapiens
KQLLAVGAE

SEQ ID NO: 367374 - protein, 9 aa, Homo Sapiens
ALAAAGTNY

SEQ ID NO: 367375 - protein, 9 aa, Homo Sapiens
FTSAHPSRP

SEQ ID NO: 367376 - protein, 9 aa, Homo Sapiens
VAQLLPKIV

SEQ ID NO: 367377 - protein, 9 aa, Homo Sapiens
MVVQARLCV

SEQ ID NO: 367378 - protein, 9 aa, Homo Sapiens
EAEGSFLLH

SEQ ID NO: 367379 - protein, 9 aa, Homo Sapiens
RRSLRTTPL

SEQ ID NO: 367380 - protein, 9 aa, Homo Sapiens
AATTAAAAA

SEQ ID NO: 367381 - protein, 9 aa, Homo Sapiens
HMPVPVTVG

SEQ ID NO: 367382 - protein, 9 aa, Homo Sapiens
RKIKMQNKV

SEQ ID NO: 367383 - protein, 9 aa, Homo Sapiens
GTLSSGGGA

SEQ ID NO: 367384 - protein, 9 aa, Homo Sapiens
VGPSGTSRT

SEQ ID NO: 367385 - protein, 9 aa, Homo Sapiens
QRAGSRERG

SEQ ID NO: 367386 - protein, 9 aa, Homo Sapiens
IENNVLRHR

SEQ ID NO: 367387 - protein, 9 aa, Homo Sapiens
WPSNGGHVV

SEQ ID NO: 367388 - protein, 9 aa, Homo Sapiens
YEEVLEVDK

SEQ ID NO: 367389 - protein, 9 aa, Homo Sapiens
LSQCRLFEE

SEQ ID NO: 367390 - protein, 9 aa, Homo Sapiens
DETYIGNVV

SEQ ID NO: 367391 - protein, 9 aa, Homo Sapiens
LPWPPPAPV

SEQ ID NO: 367392 - protein, 9 aa, Homo Sapiens
IHENIIQKS

SEQ ID NO: 367393 - protein, 9 aa, Homo Sapiens
RYLSCSSCR

SEQ ID NO: 367394 - protein, 9 aa, Homo Sapiens
LPNFLKHDL

SEQ ID NO: 367395 - protein, 9 aa, Homo Sapiens
LYYSAMNYG

SEQ ID NO: 367396 - protein, 9 aa, Homo Sapiens
EPPHRTPWP

SEQ ID NO: 367397 - protein, 9 aa, Homo Sapiens
APGSARSAS

SEQ ID NO: 367398 - protein, 9 aa, Homo Sapiens
TIIVSATSG

SEQ ID NO: 367399 - protein, 9 aa, Homo Sapiens
VERWQKKHD

SEQ ID NO: 367400 - protein, 9 aa, Homo Sapiens
HGALQPVMQ

SEQ ID NO: 367401 - protein, 9 aa, Homo Sapiens
IDHLLQSTG

SEQ ID NO: 367402 - protein, 9 aa, Homo Sapiens
RKRSVPVAK

SEQ ID NO: 367403 - protein, 9 aa, Homo Sapiens
KKKETKKNS

SEQ ID NO: 367404 - protein, 9 aa, Homo Sapiens
YLAEWVIEN

SEQ ID NO: 367405 - protein, 9 aa, Homo Sapiens
WEVMPRTLE

SEQ ID NO: 367406 - protein, 9 aa, Homo Sapiens
SWAGADGQA

SEQ ID NO: 367407 - protein, 9 aa, Homo Sapiens
ESLSLSAQY

SEQ ID NO: 367408 - protein, 9 aa, Homo Sapiens
CVKQQANEA

SEQ ID NO: 367409 - protein, 9 aa, Homo Sapiens
NYCKGGITF

SEQ ID NO: 367410 - protein, 9 aa, Homo Sapiens
QNNRNVSSA

SEQ ID NO: 367411 - protein, 9 aa, Homo Sapiens
RVTEEAKNG

SEQ ID NO: 367412 - protein, 9 aa, Homo Sapiens
QLSSQLDDN

SEQ ID NO: 367413 - protein, 9 aa, Homo Sapiens
NSYTDIECS

SEQ ID NO: 367414 - protein, 9 aa, Homo Sapiens
GRSSKKNKE

SEQ ID NO: 367415 - protein, 9 aa, Homo Sapiens
RVVERWQKK

SEQ ID NO: 367416 - protein, 9 aa, Homo Sapiens
TGSNCCNLN

SEQ ID NO: 367417 - protein, 9 aa, Homo Sapiens
RNGCDACRE

SEQ ID NO: 367418 - protein, 9 aa, Homo Sapiens
KKRRGKSER

SEQ ID NO: 367419 - protein, 9 aa, Homo Sapiens
LESLLEHSL

SEQ ID NO: 367420 - protein, 9 aa, Homo Sapiens
SRLRKISMR

SEQ ID NO: 367421 - protein, 9 aa, Homo Sapiens
ELALVHWLQ

SEQ ID NO: 367422 - protein, 9 aa, Homo Sapiens
ANGFTGLPP

SEQ ID NO: 367423 - protein, 9 aa, Homo Sapiens
SDCQVKVWD

SEQ ID NO: 367424 - protein, 9 aa, Homo Sapiens
WAGWGPGSS

SEQ ID NO: 367425 - protein, 9 aa, Homo Sapiens
RPGMEHISP

SEQ ID NO: 367426 - protein, 9 aa, Homo Sapiens
PFFRYCTYL

SEQ ID NO: 367427 - protein, 9 aa, Homo Sapiens
LDQCFSRLP

SEQ ID NO: 367428 - protein, 9 aa, Homo Sapiens
LQVPQPPQP

SEQ ID NO: 367429 - protein, 9 aa, Homo Sapiens
AASGFAVGT

SEQ ID NO: 367430 - protein, 9 aa, Homo Sapiens
RPKRKHRTK

SEQ ID NO: 367431 - protein, 9 aa, Homo Sapiens
AGTGAGGDC

SEQ ID NO: 367432 - protein, 9 aa, Homo Sapiens
SNFDETYIG

SEQ ID NO: 367433 - protein, 9 aa, Homo Sapiens
WTAMGGQAS

SEQ ID NO: 367434 - protein, 9 aa, Homo Sapiens
EKTEIQLTM

SEQ ID NO: 367435 - protein, 9 aa, Homo Sapiens
IQQVKTNNS

SEQ ID NO: 367436 - protein, 9 aa, Homo Sapiens
LGARRTAKP

SEQ ID NO: 367437 - protein, 9 aa, Homo Sapiens
LARETSLAS

SEQ ID NO: 367438 - protein, 9 aa, Homo Sapiens
NHENSSPCQ

SEQ ID NO: 367439 - protein, 9 aa, Homo Sapiens
HSVVLHTLL

SEQ ID NO: 367440 - protein, 9 aa, Homo Sapiens
PQCKKRKNY

SEQ ID NO: 367441 - protein, 9 aa, Homo Sapiens
SRQSPSHIR

SEQ ID NO: 367442 - protein, 9 aa, Homo Sapiens
AGSALGGGA

SEQ ID NO: 367443 - protein, 9 aa, Homo Sapiens
RGNGGQRRE

SEQ ID NO: 367444 - protein, 9 aa, Homo Sapiens
ADCVTCLAN

SEQ ID NO: 367445 - protein, 9 aa, Homo Sapiens
QAGEELQSS

SEQ ID NO: 367446 - protein, 9 aa, Homo Sapiens
DNECDFAYE

SEQ ID NO: 367447 - protein, 9 aa, Homo Sapiens
FFVDNPFQK

SEQ ID NO: 367448 - protein, 9 aa, Homo Sapiens
ENNEVRVQV

SEQ ID NO: 367449 - protein, 9 aa, Homo Sapiens
HPQPRPSTP

SEQ ID NO: 367450 - protein, 9 aa, Homo Sapiens
TGRHVSLRI

SEQ ID NO: 367451 - protein, 9 aa, Homo Sapiens
LDIREAAQK

SEQ ID NO: 367452 - protein, 9 aa, Homo Sapiens
QIRPVYVPV

SEQ ID NO: 367453 - protein, 9 aa, Homo Sapiens
DASNPFYEP

SEQ ID NO: 367454 - protein, 9 aa, Homo Sapiens
PLQYSADAD

SEQ ID NO: 367455 - protein, 9 aa, Homo Sapiens
EHLLIKGHQ

SEQ ID NO: 367456 - protein, 9 aa, Homo Sapiens
SSTNMPTEP

SEQ ID NO: 367457 - protein, 9 aa, Homo Sapiens
VCLTAGTSS

SEQ ID NO: 367458 - protein, 9 aa, Homo Sapiens
QPKCPLKSK

SEQ ID NO: 367459 - protein, 9 aa, Homo Sapiens
VLGRIQGRF

SEQ ID NO: 367460 - protein, 9 aa, Homo Sapiens
DGVRGPNGD

SEQ ID NO: 367461 - protein, 9 aa, Homo Sapiens
SLPKQGGKV

SEQ ID NO: 367462 - protein, 9 aa, Homo Sapiens
SNVEHLMEK

SEQ ID NO: 367463 - protein, 9 aa, Homo Sapiens
TVPHLGRVC

SEQ ID NO: 367464 - protein, 9 aa, Homo Sapiens
QNIARQLYH

SEQ ID NO: 367465 - protein, 9 aa, Homo Sapiens
AFDITYVCL

SEQ ID NO: 367466 - protein, 9 aa, Homo Sapiens
RAHTPTCHL

SEQ ID NO: 367467 - protein, 9 aa, Homo Sapiens
RGQCVENEC

SEQ ID NO: 367468 - protein, 9 aa, Homo Sapiens
FTMHLLSTP

SEQ ID NO: 367469 - protein, 9 aa, Homo Sapiens
SAPEKDNFF

SEQ ID NO: 367470 - protein, 9 aa, Homo Sapiens
LTHQYKYEV

SEQ ID NO: 367471 - protein, 9 aa, Homo Sapiens
RVHTQEPLY

SEQ ID NO: 367472 - protein, 9 aa, Homo Sapiens
RIQGRFSLV

SEQ ID NO: 367473 - protein, 9 aa, Homo Sapiens
GGPWRGQPG

SEQ ID NO: 367474 - protein, 9 aa, Homo Sapiens
TDAVWGGGR

SEQ ID NO: 367475 - protein, 9 aa, Homo Sapiens
LPISKERVL

SEQ ID NO: 367476 - protein, 9 aa, Homo Sapiens
QKVVTCFPP

SEQ ID NO: 367477 - protein, 9 aa, Homo Sapiens
LRATTLCQV

SEQ ID NO: 367478 - protein, 9 aa, Homo Sapiens
KIVVVVWDR

SEQ ID NO: 367479 - protein, 9 aa, Homo Sapiens
VFFSMMRPS

SEQ ID NO: 367480 - protein, 9 aa, Homo Sapiens
TRWQGLTLG

SEQ ID NO: 367481 - protein, 9 aa, Homo Sapiens
DKEQEKDRE

SEQ ID NO: 367482 - protein, 9 aa, Homo Sapiens
ATGPSVPSW

SEQ ID NO: 367483 - protein, 9 aa, Homo Sapiens
DRVPVDIRI

SEQ ID NO: 367484 - protein, 9 aa, Homo Sapiens
AFGQAISLD

SEQ ID NO: 367485 - protein, 9 aa, Homo Sapiens
CRWTAPSSP

SEQ ID NO: 367486 - protein, 9 aa, Homo Sapiens
SMHKKPRTP

SEQ ID NO: 367487 - protein, 9 aa, Homo Sapiens
QSGLPPAKR

SEQ ID NO: 367488 - protein, 9 aa, Homo Sapiens
FTLVTRGTS

SEQ ID NO: 367489 - protein, 9 aa, Homo Sapiens
NSNLSHMMI

SEQ ID NO: 367490 - protein, 9 aa, Homo Sapiens
WSVIDPQAI

SEQ ID NO: 367491 - protein, 9 aa, Homo Sapiens
LYHEIMERS

SEQ ID NO: 367492 - protein, 9 aa, Homo Sapiens
ACGPPSVCD

SEQ ID NO: 367493 - protein, 9 aa, Homo Sapiens
EVNCRNEHA

SEQ ID NO: 367494 - protein, 9 aa, Homo Sapiens
SKSAPVPKK

SEQ ID NO: 367495 - protein, 9 aa, Homo Sapiens
TITEHVPLG

SEQ ID NO: 367496 - protein, 9 aa, Homo Sapiens
RSQPKPPPQ

SEQ ID NO: 367497 - protein, 9 aa, Homo Sapiens
WLAHNEIRM

SEQ ID NO: 367498 - protein, 9 aa, Homo Sapiens
SGPDGVRGP

SEQ ID NO: 367499 - protein, 9 aa, Homo Sapiens
CLQHRVQDP

SEQ ID NO: 367500 - protein, 9 aa, Homo Sapiens
GNLVTGTQH

SEQ ID NO: 367501 - protein, 9 aa, Homo Sapiens
AYPRHFGPA

SEQ ID NO: 367502 - protein, 9 aa, Homo Sapiens
PYQHLQDVD

SEQ ID NO: 367503 - protein, 9 aa, Homo Sapiens
CRYWDLEVR

SEQ ID NO: 367504 - protein, 9 aa, Homo Sapiens
NSVINHFNV

SEQ ID NO: 367505 - protein, 9 aa, Homo Sapiens
VVEFKMEEI

SEQ ID NO: 367506 - protein, 9 aa, Homo Sapiens
SALNEQKEL

SEQ ID NO: 367507 - protein, 9 aa, Homo Sapiens
AEQPERGRV

SEQ ID NO: 367508 - protein, 9 aa, Homo Sapiens
KKNSNLSHM

SEQ ID NO: 367509 - protein, 9 aa, Homo Sapiens
DISKGNSLS

SEQ ID NO: 367510 - protein, 9 aa, Homo Sapiens
PLPGPHAWT

SEQ ID NO: 367511 - protein, 9 aa, Homo Sapiens
SSWDHSFVS

SEQ ID NO: 367512 - protein, 9 aa, Homo Sapiens
PLLWEDRAK

SEQ ID NO: 367513 - protein, 9 aa, Homo Sapiens
KDSSPHCPM

SEQ ID NO: 367514 - protein, 9 aa, Homo Sapiens
HRVQDPIHL

SEQ ID NO: 367515 - protein, 9 aa, Homo Sapiens
FRLRCLQHF

SEQ ID NO: 367516 - protein, 9 aa, Homo Sapiens
LILLRHVGL

SEQ ID NO: 367517 - protein, 9 aa, Homo Sapiens
LLGVTNDQV

SEQ ID NO: 367518 - protein, 9 aa, Homo Sapiens
NLENLLHNR

SEQ ID NO: 367519 - protein, 9 aa, Homo Sapiens
HKTAHVPFK

SEQ ID NO: 367520 - protein, 9 aa, Homo Sapiens
QNCLGSQTD

SEQ ID NO: 367521 - protein, 9 aa, Homo Sapiens
SSVASQKWG

SEQ ID NO: 367522 - protein, 9 aa, Homo Sapiens
TQHFKEALQ

SEQ ID NO: 367523 - protein, 9 aa, Homo Sapiens
IVSLMLDPV

SEQ ID NO: 367524 - protein, 9 aa, Homo Sapiens
IHGARPSQP

SEQ ID NO: 367525 - protein, 9 aa, Homo Sapiens
FLENEKSLL

SEQ ID NO: 367526 - protein, 9 aa, Homo Sapiens
KHKLESPAL

SEQ ID NO: 367527 - protein, 9 aa, Homo Sapiens
SVLQNSKDK

SEQ ID NO: 367528 - protein, 9 aa, Homo Sapiens
KTVEPTGKC

SEQ ID NO: 367529 - protein, 9 aa, Homo Sapiens
AKELNKQLT

SEQ ID NO: 367530 - protein, 9 aa, Homo Sapiens
DITYVCLKF

SEQ ID NO: 367531 - protein, 9 aa, Homo Sapiens
LFYPKRVMD

SEQ ID NO: 367532 - protein, 9 aa, Homo Sapiens
SGTSRAAGT

SEQ ID NO: 367533 - protein, 9 aa, Homo Sapiens
GCSAKSKNL

SEQ ID NO: 367534 - protein, 9 aa, Homo Sapiens
DFILSRATG

SEQ ID NO: 367535 - protein, 9 aa, Homo Sapiens
MEGLEVFAQ

SEQ ID NO: 367536 - protein, 9 aa, Homo Sapiens
GPQEEPTIG

SEQ ID NO: 367537 - protein, 9 aa, Homo Sapiens
EEHVCLPNS

SEQ ID NO: 367538 - protein, 9 aa, Homo Sapiens
LNNSQGTFS

SEQ ID NO: 367539 - protein, 9 aa, Homo Sapiens
PGPPQQQWP

SEQ ID NO: 367540 - protein, 9 aa, Homo Sapiens
ALWARAFHS

SEQ ID NO: 367541 - protein, 9 aa, Homo Sapiens
SFFVDNPFQ

SEQ ID NO: 367542 - protein, 9 aa, Homo Sapiens
QRLWHGGRE

SEQ ID NO: 367543 - protein, 9 aa, Homo Sapiens
QAPQCPPRL

SEQ ID NO: 367544 - protein, 9 aa, Homo Sapiens
PKMTHSKLK

SEQ ID NO: 367545 - protein, 9 aa, Homo Sapiens
AVTQCRPAG

SEQ ID NO: 367546 - protein, 9 aa, Homo Sapiens
SMASNYTGC

SEQ ID NO: 367547 - protein, 9 aa, Homo Sapiens
HAAWMVKRW

SEQ ID NO: 367548 - protein, 9 aa, Homo Sapiens
DPCLYRWLS

SEQ ID NO: 367549 - protein, 9 aa, Homo Sapiens
QKMYPEDTA

SEQ ID NO: 367550 - protein, 9 aa, Homo Sapiens
SICITSCPQ

SEQ ID NO: 367551 - protein, 9 aa, Homo Sapiens
ACGGSGGVA

SEQ ID NO: 367552 - protein, 9 aa, Homo Sapiens
QNKEPQNIR

SEQ ID NO: 367553 - protein, 9 aa, Homo Sapiens
QFTVLETRL

SEQ ID NO: 367554 - protein, 9 aa, Homo Sapiens
PFICTASST

SEQ ID NO: 367555 - protein, 9 aa, Homo Sapiens
AYVLWAGVA

SEQ ID NO: 367556 - protein, 9 aa, Homo Sapiens
HRAADWAEA

SEQ ID NO: 367557 - protein, 9 aa, Homo Sapiens
SPALKQVSP

SEQ ID NO: 367558 - protein, 9 aa, Homo Sapiens
WRRNPAGLC

SEQ ID NO: 367559 - protein, 9 aa, Homo Sapiens
HFLKLMKTV

SEQ ID NO: 367560 - protein, 9 aa, Homo Sapiens
NMRQLYGDS

SEQ ID NO: 367561 - protein, 9 aa, Homo Sapiens
GYKQVFWER

SEQ ID NO: 367562 - protein, 9 aa, Homo Sapiens
PARAESLAA

SEQ ID NO: 367563 - protein, 9 aa, Homo Sapiens
GVGSFLLHG

SEQ ID NO: 367564 - protein, 9 aa, Homo Sapiens
GPGRRRAVQ

SEQ ID NO: 367565 - protein, 9 aa, Homo Sapiens
GDGVEGLRG

SEQ ID NO: 367566 - protein, 9 aa, Homo Sapiens
KCFLTMNLN

SEQ ID NO: 367567 - protein, 9 aa, Homo Sapiens
DLLFSTFCD

SEQ ID NO: 367568 - protein, 9 aa, Homo Sapiens
DFTLEVEQC

SEQ ID NO: 367569 - protein, 9 aa, Homo Sapiens
ILLRHVGLL

SEQ ID NO: 367570 - protein, 9 aa, Homo Sapiens
SKGCWRWSC

SEQ ID NO: 367571 - protein, 9 aa, Homo Sapiens
LLLLGAPGQ

SEQ ID NO: 367572 - protein, 9 aa, Homo Sapiens
LNSIKSSLD

SEQ ID NO: 367573 - protein, 9 aa, Homo Sapiens
SLCWSTVAQ

SEQ ID NO: 367574 - protein, 9 aa, Homo Sapiens
VRSRAALSF

SEQ ID NO: 367575 - protein, 9 aa, Homo Sapiens
KLLVRGTMQ

SEQ ID NO: 367576 - protein, 9 aa, Homo Sapiens
SMTVGLTFI

SEQ ID NO: 367577 - protein, 9 aa, Homo Sapiens
GASSGWAGP

SEQ ID NO: 367578 - protein, 9 aa, Homo Sapiens
MHKKPRTPK

SEQ ID NO: 367579 - protein, 9 aa, Homo Sapiens
APLPWMVPW

SEQ ID NO: 367580 - protein, 9 aa, Homo Sapiens
WSPDISGGR

SEQ ID NO: 367581 - protein, 9 aa, Homo Sapiens
SLGHITFGG

SEQ ID NO: 367582 - protein, 9 aa, Homo Sapiens
LGGKTIECI

SEQ ID NO: 367583 - protein, 9 aa, Homo Sapiens
AETREEHME

SEQ ID NO: 367584 - protein, 9 aa, Homo Sapiens
QDSAIHLHV

SEQ ID NO: 367585 - protein, 9 aa, Homo Sapiens
MIHQKLKRF

SEQ ID NO: 367586 - protein, 9 aa, Homo Sapiens
TSRTRGTLH

SEQ ID NO: 367587 - protein, 9 aa, Homo Sapiens
ETFHMGCGS

SEQ ID NO: 367588 - protein, 9 aa, Homo Sapiens
QNRLNVSIT

SEQ ID NO: 367589 - protein, 9 aa, Homo Sapiens
QLQKLKELQ

SEQ ID NO: 367590 - protein, 9 aa, Homo Sapiens
ESWQAQLPQ

SEQ ID NO: 367591 - protein, 9 aa, Homo Sapiens
SLKLLFEMR

SEQ ID NO: 367592 - protein, 9 aa, Homo Sapiens
AAEDDIADP

SEQ ID NO: 367593 - protein, 9 aa, Homo Sapiens
EKGPLSLWR

SEQ ID NO: 367594 - protein, 9 aa, Homo Sapiens
AEATARLNM

SEQ ID NO: 367595 - protein, 9 aa, Homo Sapiens
PSWQSSTLA

SEQ ID NO: 367596 - protein, 9 aa, Homo Sapiens
RGMRKLRPP

SEQ ID NO: 367597 - protein, 9 aa, Homo Sapiens
LANLTLGSL

SEQ ID NO: 367598 - protein, 9 aa, Homo Sapiens
GSQQSRGGN

SEQ ID NO: 367599 - protein, 9 aa, Homo Sapiens
RIIETPHTA

SEQ ID NO: 367600 - protein, 9 aa, Homo Sapiens
LPDDGGPGV

SEQ ID NO: 367601 - protein, 9 aa, Homo Sapiens
FPWKMSLLI

SEQ ID NO: 367602 - protein, 9 aa, Homo Sapiens
NLTPGCRSL

SEQ ID NO: 367603 - protein, 9 aa, Homo Sapiens
RDCDNKKIS

SEQ ID NO: 367604 - protein, 9 aa, Homo Sapiens
ERRSKTEAH

SEQ ID NO: 367605 - protein, 9 aa, Homo Sapiens
LLLCNLSPG

SEQ ID NO: 367606 - protein, 9 aa, Homo Sapiens
VRNTVQRSV

SEQ ID NO: 367607 - protein, 9 aa, Homo Sapiens
STLAHFNTE

SEQ ID NO: 367608 - protein, 9 aa, Homo Sapiens
QQVGLPAPL

SEQ ID NO: 367609 - protein, 9 aa, Homo Sapiens
TQPPSRHVH

SEQ ID NO: 367610 - protein, 9 aa, Homo Sapiens
ALATVCWPC

SEQ ID NO: 367611 - protein, 9 aa, Homo Sapiens
GVRALGKWL

SEQ ID NO: 367612 - protein, 9 aa, Homo Sapiens
ASRAGGTRL

SEQ ID NO: 367613 - protein, 9 aa, Homo Sapiens
ASEENLVDL

SEQ ID NO: 367614 - protein, 9 aa, Homo Sapiens
EALDHEEEK

SEQ ID NO: 367615 - protein, 9 aa, Homo Sapiens
GCGPSSEGV

SEQ ID NO: 367616 - protein, 9 aa, Homo Sapiens
RSASITNMS

SEQ ID NO: 367617 - protein, 9 aa, Homo Sapiens
ARAESLAAG

SEQ ID NO: 367618 - protein, 9 aa, Homo Sapiens
PHAATASPT

SEQ ID NO: 367619 - protein, 9 aa, Homo Sapiens
KALKGIHPD

SEQ ID NO: 367620 - protein, 9 aa, Homo Sapiens
KVDQGKVKQ

SEQ ID NO: 367621 - protein, 9 aa, Homo Sapiens
RKKLNRLGL

SEQ ID NO: 367622 - protein, 9 aa, Homo Sapiens
RIAIEYPYS

SEQ ID NO: 367623 - protein, 9 aa, Homo Sapiens
TAKPLGADR

SEQ ID NO: 367624 - protein, 9 aa, Homo Sapiens
VQKVVTCFP

SEQ ID NO: 367625 - protein, 9 aa, Homo Sapiens
AEKRIKMST

SEQ ID NO: 367626 - protein, 9 aa, Homo Sapiens
CRCCQEHGL

SEQ ID NO: 367627 - protein, 9 aa, Homo Sapiens
LLKTKVYFM

SEQ ID NO: 367628 - protein, 9 aa, Homo Sapiens
QTSISVGKA

SEQ ID NO: 367629 - protein, 9 aa, Homo Sapiens
EGWGPAPGS

SEQ ID NO: 367630 - protein, 9 aa, Homo Sapiens
EVEPSDIIE

SEQ ID NO: 367631 - protein, 9 aa, Homo Sapiens
VGFPFVSRT

SEQ ID NO: 367632 - protein, 9 aa, Homo Sapiens
KDYPHWCEY

SEQ ID NO: 367633 - protein, 9 aa, Homo Sapiens
GARETFHMG

SEQ ID NO: 367634 - protein, 9 aa, Homo Sapiens
IFPRRTDED

SEQ ID NO: 367635 - protein, 9 aa, Homo Sapiens
KEFNQFAEW

SEQ ID NO: 367636 - protein, 9 aa, Homo Sapiens
SPEPPPAHP

SEQ ID NO: 367637 - protein, 9 aa, Homo Sapiens
GIGEELVIH

SEQ ID NO: 367638 - protein, 9 aa, Homo Sapiens
DPSKSAPVP

SEQ ID NO: 367639 - protein, 9 aa, Homo Sapiens
GPCIGPVST

SEQ ID NO: 367640 - protein, 9 aa, Homo Sapiens
SSGTSRAAG

SEQ ID NO: 367641 - protein, 9 aa, Homo Sapiens
PDMYERVVL

SEQ ID NO: 367642 - protein, 9 aa, Homo Sapiens
MWFCAKIRI

SEQ ID NO: 367643 - protein, 9 aa, Homo Sapiens
LLGAPGQAS

SEQ ID NO: 367644 - protein, 9 aa, Homo Sapiens
ERTEPEVPP

SEQ ID NO: 367645 - protein, 9 aa, Homo Sapiens
AQEFAVNPE

SEQ ID NO: 367646 - protein, 9 aa, Homo Sapiens
DWDILNRQF

SEQ ID NO: 367647 - protein, 9 aa, Homo Sapiens
EYPYSVKRN

SEQ ID NO: 367648 - protein, 9 aa, Homo Sapiens
SYLVRMAMV

SEQ ID NO: 367649 - protein, 9 aa, Homo Sapiens
YTTIHDIPM

SEQ ID NO: 367650 - protein, 9 aa, Homo Sapiens
PRLSPLIRA

SEQ ID NO: 367651 - protein, 9 aa, Homo Sapiens
SQAPEGGPW

SEQ ID NO: 367652 - protein, 9 aa, Homo Sapiens
GCLRQRRLS

SEQ ID NO: 367653 - protein, 9 aa, Homo Sapiens
KGRSSKKNK

SEQ ID NO: 367654 - protein, 9 aa, Homo Sapiens
EGSFLVKRN

SEQ ID NO: 367655 - protein, 9 aa, Homo Sapiens
LALPGLYRL

SEQ ID NO: 367656 - protein, 9 aa, Homo Sapiens
SIQYVICLQ

SEQ ID NO: 367657 - protein, 9 aa, Homo Sapiens
WLCLRRAQD

SEQ ID NO: 367658 - protein, 9 aa, Homo Sapiens
RLPKTWNAG

SEQ ID NO: 367659 - protein, 9 aa, Homo Sapiens
RAEQQCIRN

SEQ ID NO: 367660 - protein, 9 aa, Homo Sapiens
AWDNQKGRP

SEQ ID NO: 367661 - protein, 9 aa, Homo Sapiens
RLWHGGREL

SEQ ID NO: 367662 - protein, 9 aa, Homo Sapiens
VADIIPQVL

SEQ ID NO: 367663 - protein, 9 aa, Homo Sapiens
TVIEGNSSF

SEQ ID NO: 367664 - protein, 9 aa, Homo Sapiens
HWLPCAQET

SEQ ID NO: 367665 - protein, 9 aa, Homo Sapiens
SAVSSPTRS

SEQ ID NO: 367666 - protein, 9 aa, Homo Sapiens
GAAAEEGGV

SEQ ID NO: 367667 - protein, 9 aa, Homo Sapiens
GKSERGGRG

SEQ ID NO: 367668 - protein, 9 aa, Homo Sapiens
AVDGLYKMD

SEQ ID NO: 367669 - protein, 9 aa, Homo Sapiens
KSLSSSLDN

SEQ ID NO: 367670 - protein, 9 aa, Homo Sapiens
CLFDIETCH

SEQ ID NO: 367671 - protein, 9 aa, Homo Sapiens
QYGIGYKQV

SEQ ID NO: 367672 - protein, 9 aa, Homo Sapiens
VNPEKIQLY

SEQ ID NO: 367673 - protein, 9 aa, Homo Sapiens
ALRCSASPT

SEQ ID NO: 367674 - protein, 9 aa, Homo Sapiens
HERERYLWQ

SEQ ID NO: 367675 - protein, 9 aa, Homo Sapiens
LGVEPASNG

SEQ ID NO: 367676 - protein, 9 aa, Homo Sapiens
HAYVLWAGV

SEQ ID NO: 367677 - protein, 9 aa, Homo Sapiens
LPNQKPTVL

SEQ ID NO: 367678 - protein, 9 aa, Homo Sapiens
QIRAQVLIY

SEQ ID NO: 367679 - protein, 9 aa, Homo Sapiens
VSARRTQMT

SEQ ID NO: 367680 - protein, 9 aa, Homo Sapiens
LILVEVSSL

SEQ ID NO: 367681 - protein, 9 aa, Homo Sapiens
LRLPDCSWP

SEQ ID NO: 367682 - protein, 9 aa, Homo Sapiens
ANGVPTSRG

SEQ ID NO: 367683 - protein, 9 aa, Homo Sapiens
NLKQKWHLG

SEQ ID NO: 367684 - protein, 9 aa, Homo Sapiens
LGDPCLYRW

SEQ ID NO: 367685 - protein, 9 aa, Homo Sapiens
GSCPQFFKV

SEQ ID NO: 367686 - protein, 9 aa, Homo Sapiens
MYGSMTQFT

SEQ ID NO: 367687 - protein, 9 aa, Homo Sapiens
EAPLTPREQ

SEQ ID NO: 367688 - protein, 9 aa, Homo Sapiens
LGPLGARRT

SEQ ID NO: 367689 - protein, 9 aa, Homo Sapiens
EPKLLMSIY

SEQ ID NO: 367690 - protein, 9 aa, Homo Sapiens
CMYGSMTQF

SEQ ID NO: 367691 - protein, 9 aa, Homo Sapiens
GAPPAGRSV

SEQ ID NO: 367692 - protein, 9 aa, Homo Sapiens
FAQQRVPKG

SEQ ID NO: 367693 - protein, 9 aa, Homo Sapiens
GFTHLIGSP

SEQ ID NO: 367694 - protein, 9 aa, Homo Sapiens
NACVLLSQC

SEQ ID NO: 367695 - protein, 9 aa, Homo Sapiens
SISSGPWGM

SEQ ID NO: 367696 - protein, 9 aa, Homo Sapiens
RALFTSLAS

SEQ ID NO: 367697 - protein, 9 aa, Homo Sapiens
LGIVQMVFS

SEQ ID NO: 367698 - protein, 9 aa, Homo Sapiens
KIVLLGVTN

SEQ ID NO: 367699 - protein, 9 aa, Homo Sapiens
LSTEWDYIK

SEQ ID NO: 367700 - protein, 9 aa, Homo Sapiens
FNPGTLSSG

SEQ ID NO: 367701 - protein, 9 aa, Homo Sapiens
AKKNTAFTK

SEQ ID NO: 367702 - protein, 9 aa, Homo Sapiens
GAPPPAGCL

SEQ ID NO: 367703 - protein, 9 aa, Homo Sapiens
DIIPQVLAD

SEQ ID NO: 367704 - protein, 9 aa, Homo Sapiens
VMQALALGP

SEQ ID NO: 367705 - protein, 9 aa, Homo Sapiens
KGNSLSDES

SEQ ID NO: 367706 - protein, 9 aa, Homo Sapiens
AHLTWKQCL

SEQ ID NO: 367707 - protein, 9 aa, Homo Sapiens
TLGSPKPGD

SEQ ID NO: 367708 - protein, 9 aa, Homo Sapiens
SRIVQISAF

SEQ ID NO: 367709 - protein, 9 aa, Homo Sapiens
PKKKETKKN

SEQ ID NO: 367710 - protein, 9 aa, Homo Sapiens
NLNIAKVLL

SEQ ID NO: 367711 - protein, 9 aa, Homo Sapiens
TPGGRPPSP

SEQ ID NO: 367712 - protein, 9 aa, Homo Sapiens
SPSHGSMLA

SEQ ID NO: 367713 - protein, 9 aa, Homo Sapiens
NRGLPLPPP

SEQ ID NO: 367714 - protein, 9 aa, Homo Sapiens
MPVPVTVGF

SEQ ID NO: 367715 - protein, 9 aa, Homo Sapiens
YNRGQCVEN

SEQ ID NO: 367716 - protein, 9 aa, Homo Sapiens
AWEPRRTLS

SEQ ID NO: 367717 - protein, 9 aa, Homo Sapiens
STRLAVSTR

SEQ ID NO: 367718 - protein, 9 aa, Homo Sapiens
RVERDVVQQ

SEQ ID NO: 367719 - protein, 9 aa, Homo Sapiens
NVEHLMEKM

SEQ ID NO: 367720 - protein, 9 aa, Homo Sapiens
IPRHIKKFL

SEQ ID NO: 367721 - protein, 9 aa, Homo Sapiens
STRSSVTGI

SEQ ID NO: 367722 - protein, 9 aa, Homo Sapiens
TSSPKFGEK

SEQ ID NO: 367723 - protein, 9 aa, Homo Sapiens
ADWPSNGGH

SEQ ID NO: 367724 - protein, 9 aa, Homo Sapiens
YSTAKNVKM

SEQ ID NO: 367725 - protein, 9 aa, Homo Sapiens
LEAIESWLE

SEQ ID NO: 367726 - protein, 9 aa, Homo Sapiens
YFILWTKLE

SEQ ID NO: 367727 - protein, 9 aa, Homo Sapiens
STFCDSERL

SEQ ID NO: 367728 - protein, 9 aa, Homo Sapiens
EDFQAFVPH

SEQ ID NO: 367729 - protein, 9 aa, Homo Sapiens
KSPTVTFEK

SEQ ID NO: 367730 - protein, 9 aa, Homo Sapiens
AKKEGRSST

SEQ ID NO: 367731 - protein, 9 aa, Homo Sapiens
RNTVQRSVA

SEQ ID NO: 367732 - protein, 9 aa, Homo Sapiens
HGARPSQPR

SEQ ID NO: 367733 - protein, 9 aa, Homo Sapiens
TPTDSLVCK

SEQ ID NO: 367734 - protein, 9 aa, Homo Sapiens
LTNIFESFM

SEQ ID NO: 367735 - protein, 9 aa, Homo Sapiens
KDHRTSQNH

SEQ ID NO: 367736 - protein, 9 aa, Homo Sapiens
LLALGHMWT

SEQ ID NO: 367737 - protein, 9 aa, Homo Sapiens
TLESGGASR

SEQ ID NO: 367738 - protein, 9 aa, Homo Sapiens
PCRGTARCA

SEQ ID NO: 367739 - protein, 9 aa, Homo Sapiens
YYFRIASSV

SEQ ID NO: 367740 - protein, 9 aa, Homo Sapiens
AIAAIEKMV

SEQ ID NO: 367741 - protein, 9 aa, Homo Sapiens
LFAQQRVPK

SEQ ID NO: 367742 - protein, 9 aa, Homo Sapiens
WVWNPTRML

SEQ ID NO: 367743 - protein, 9 aa, Homo Sapiens
PTVTFEKHG

SEQ ID NO: 367744 - protein, 9 aa, Homo Sapiens
RRNPAGLCG

SEQ ID NO: 367745 - protein, 9 aa, Homo Sapiens
HRDWIATSG

SEQ ID NO: 367746 - protein, 9 aa, Homo Sapiens
KIVSLMLDP

SEQ ID NO: 367747 - protein, 9 aa, Homo Sapiens
QRNLLRLQS

SEQ ID NO: 367748 - protein, 9 aa, Homo Sapiens
IDKRSMPEY

SEQ ID NO: 367749 - protein, 9 aa, Homo Sapiens
SLVLLQDGW

SEQ ID NO: 367750 - protein, 9 aa, Homo Sapiens
IVFQYKETS

SEQ ID NO: 367751 - protein, 9 aa, Homo Sapiens
RLGKSRRRR

SEQ ID NO: 367752 - protein, 9 aa, Homo Sapiens
CDACRELIG

SEQ ID NO: 367753 - protein, 9 aa, Homo Sapiens
RSWCESRAA

SEQ ID NO: 367754 - protein, 9 aa, Homo Sapiens
QPSMIQEVW

SEQ ID NO: 367755 - protein, 9 aa, Homo Sapiens
ALRVHQETQ

SEQ ID NO: 367756 - protein, 9 aa, Homo Sapiens
LVIHNRGKE

SEQ ID NO: 367757 - protein, 9 aa, Homo Sapiens
NRNVSSASE

SEQ ID NO: 367758 - protein, 9 aa, Homo Sapiens
GSLQVPQNA

SEQ ID NO: 367759 - protein, 9 aa, Homo Sapiens
VRADPLTAS

SEQ ID NO: 367760 - protein, 9 aa, Homo Sapiens
LQALIEELE

SEQ ID NO: 367761 - protein, 9 aa, Homo Sapiens
ASICITSCP

SEQ ID NO: 367762 - protein, 9 aa, Homo Sapiens
RVLNEHKKF

SEQ ID NO: 367763 - protein, 9 aa, Homo Sapiens
SQLQKLKEL

SEQ ID NO: 367764 - protein, 9 aa, Homo Sapiens
CLMVLGLEQ

SEQ ID NO: 367765 - protein, 9 aa, Homo Sapiens
IMVTRCEEG

SEQ ID NO: 367766 - protein, 9 aa, Homo Sapiens
RDRGSLGHI

SEQ ID NO: 367767 - protein, 9 aa, Homo Sapiens
SVSALRGHG

SEQ ID NO: 367768 - protein, 9 aa, Homo Sapiens
AAIKKKDYV

SEQ ID NO: 367769 - protein, 9 aa, Homo Sapiens
KEKKTRKHK

SEQ ID NO: 367770 - protein, 9 aa, Homo Sapiens
PPQTRMLHL

SEQ ID NO: 367771 - protein, 9 aa, Homo Sapiens
VGCILQPVF

SEQ ID NO: 367772 - protein, 9 aa, Homo Sapiens
PQDQGLNIP

SEQ ID NO: 367773 - protein, 9 aa, Homo Sapiens
EVDAIVNAS

SEQ ID NO: 367774 - protein, 9 aa, Homo Sapiens
DGSSRCAGK

SEQ ID NO: 367775 - protein, 9 aa, Homo Sapiens
MDTGGLFLK

SEQ ID NO: 367776 - protein, 9 aa, Homo Sapiens
RKKKMSPPA

SEQ ID NO: 367777 - protein, 9 aa, Homo Sapiens
FQGTRRRCY

SEQ ID NO: 367778 - protein, 9 aa, Homo Sapiens
VGLAQPLRV

SEQ ID NO: 367779 - protein, 9 aa, Homo Sapiens
PIICILGHV

SEQ ID NO: 367780 - protein, 9 aa, Homo Sapiens
DVNDNPPVL

SEQ ID NO: 367781 - protein, 9 aa, Homo Sapiens
GLCGHRTFS

SEQ ID NO: 367782 - protein, 9 aa, Homo Sapiens
VHEVPHAQR

SEQ ID NO: 367783 - protein, 9 aa, Homo Sapiens
PPAAPEHKP

SEQ ID NO: 367784 - protein, 9 aa, Homo Sapiens
HLTWKQCLN

SEQ ID NO: 367785 - protein, 9 aa, Homo Sapiens
RRSMGEGGK

SEQ ID NO: 367786 - protein, 9 aa, Homo Sapiens
KFLDKLSKL

SEQ ID NO: 367787 - protein, 9 aa, Homo Sapiens
DHNREAEME

SEQ ID NO: 367788 - protein, 9 aa, Homo Sapiens
KMSPPASRW

SEQ ID NO: 367789 - protein, 9 aa, Homo Sapiens
KKNITNNIL

SEQ ID NO: 367790 - protein, 9 aa, Homo Sapiens
MCEKLKGLI

SEQ ID NO: 367791 - protein, 9 aa, Homo Sapiens
AGQLRERVR

SEQ ID NO: 367792 - protein, 9 aa, Homo Sapiens
KKDFDIALK

SEQ ID NO: 367793 - protein, 9 aa, Homo Sapiens
RALPQLGAH

SEQ ID NO: 367794 - protein, 9 aa, Homo Sapiens
TLTQRKKLP

SEQ ID NO: 367795 - protein, 9 aa, Homo Sapiens
WRSCLWEER

SEQ ID NO: 367796 - protein, 9 aa, Homo Sapiens
LEVRHFSVP

SEQ ID NO: 367797 - protein, 9 aa, Homo Sapiens
IPSASRCQK

SEQ ID NO: 367798 - protein, 9 aa, Homo Sapiens
SAFGQAISL

SEQ ID NO: 367799 - protein, 9 aa, Homo Sapiens
SLADNKYTI

SEQ ID NO: 367800 - protein, 9 aa, Homo Sapiens
QNFSTYAEF

SEQ ID NO: 367801 - protein, 9 aa, Homo Sapiens
LKDQKILGK

SEQ ID NO: 367802 - protein, 9 aa, Homo Sapiens
IRFFWMEMR

SEQ ID NO: 367803 - protein, 9 aa, Homo Sapiens
TVFWGQEWH

SEQ ID NO: 367804 - protein, 9 aa, Homo Sapiens
LRLRRASGR

SEQ ID NO: 367805 - protein, 9 aa, Homo Sapiens
LFSTFCDSE

SEQ ID NO: 367806 - protein, 9 aa, Homo Sapiens
LPPPLILLR

SEQ ID NO: 367807 - protein, 9 aa, Homo Sapiens
HVKRGWVWN

SEQ ID NO: 367808 - protein, 9 aa, Homo Sapiens
FGMHENANI

SEQ ID NO: 367809 - protein, 9 aa, Homo Sapiens
LYAVSLVNI

SEQ ID NO: 367810 - protein, 9 aa, Homo Sapiens
SMIQEVWTL

SEQ ID NO: 367811 - protein, 9 aa, Homo Sapiens
PSSKWTRML

SEQ ID NO: 367812 - protein, 9 aa, Homo Sapiens
SACYVEVCV

SEQ ID NO: 367813 - protein, 9 aa, Homo Sapiens
SPPATSRPP

SEQ ID NO: 367814 - protein, 9 aa, Homo Sapiens
WITPTCRSP

SEQ ID NO: 367815 - protein, 9 aa, Homo Sapiens
DGSTCPCRW

SEQ ID NO: 367816 - protein, 9 aa, Homo Sapiens
LLVTENVQT

SEQ ID NO: 367817 - protein, 9 aa, Homo Sapiens
SPSMASLCW

SEQ ID NO: 367818 - protein, 9 aa, Homo Sapiens
DLTLLQESC

SEQ ID NO: 367819 - protein, 9 aa, Homo Sapiens
REELLKKCS

SEQ ID NO: 367820 - protein, 9 aa, Homo Sapiens
VDCGPGEGR

SEQ ID NO: 367821 - protein, 9 aa, Homo Sapiens
ASSGWAGPA

SEQ ID NO: 367822 - protein, 9 aa, Homo Sapiens
STMIPPSSK

SEQ ID NO: 367823 - protein, 9 aa, Homo Sapiens
AHDGKEHHF

SEQ ID NO: 367824 - protein, 9 aa, Homo Sapiens
LENFSTLHQ

SEQ ID NO: 367825 - protein, 9 aa, Homo Sapiens
GLIFLTFII

SEQ ID NO: 367826 - protein, 9 aa, Homo Sapiens
AKTWVRYVE

SEQ ID NO: 367827 - protein, 9 aa, Homo Sapiens
IQNFSTYAE

SEQ ID NO: 367828 - protein, 9 aa, Homo Sapiens
RWQRGLQVP

SEQ ID NO: 367829 - protein, 9 aa, Homo Sapiens
RPSQPRAPA

SEQ ID NO: 367830 - protein, 9 aa, Homo Sapiens
FVSLLFLSW

SEQ ID NO: 367831 - protein, 9 aa, Homo Sapiens
SDGKHYCYP

SEQ ID NO: 367832 - protein, 9 aa, Homo Sapiens
PSTQRSLAF

SEQ ID NO: 367833 - protein, 9 aa, Homo Sapiens
PGLRPCRCC

SEQ ID NO: 367834 - protein, 9 aa, Homo Sapiens
IIKTLTQRK

SEQ ID NO: 367835 - protein, 9 aa, Homo Sapiens
NSTNADGIS

SEQ ID NO: 367836 - protein, 9 aa, Homo Sapiens
WASAWWAAG

SEQ ID NO: 367837 - protein, 9 aa, Homo Sapiens
PPEPAVTLC

SEQ ID NO: 367838 - protein, 9 aa, Homo Sapiens
KPQEIYFIE

SEQ ID NO: 367839 - protein, 9 aa, Homo Sapiens
NMGEIVIRG

SEQ ID NO: 367840 - protein, 9 aa, Homo Sapiens
SMDNDCEVL

SEQ ID NO: 367841 - protein, 9 aa, Homo Sapiens
TVCRAVASG

SEQ ID NO: 367842 - protein, 9 aa, Homo Sapiens
KKDLENLGF

SEQ ID NO: 367843 - protein, 9 aa, Homo Sapiens
FPRRTDEDR

SEQ ID NO: 367844 - protein, 9 aa, Homo Sapiens
LWESRSHTS

SEQ ID NO: 367845 - protein, 9 aa, Homo Sapiens
GVSAFGQAI

SEQ ID NO: 367846 - protein, 9 aa, Homo Sapiens
WILKQFLHK

SEQ ID NO: 367847 - protein, 9 aa, Homo Sapiens
APPPCRPRV

SEQ ID NO: 367848 - protein, 9 aa, Homo Sapiens
LKMSLMSGQ

SEQ ID NO: 367849 - protein, 9 aa, Homo Sapiens
IVHPAACSL

SEQ ID NO: 367850 - protein, 9 aa, Homo Sapiens
KDNFFAYLT

SEQ ID NO: 367851 - protein, 9 aa, Homo Sapiens
QEQNQGLAL

SEQ ID NO: 367852 - protein, 9 aa, Homo Sapiens
HRTSQNHSK

SEQ ID NO: 367853 - protein, 9 aa, Homo Sapiens
PPPGLRPCR

SEQ ID NO: 367854 - protein, 9 aa, Homo Sapiens
ITSVTLRPW

SEQ ID NO: 367855 - protein, 9 aa, Homo Sapiens
LTSLSKNPK

SEQ ID NO: 367856 - protein, 9 aa, Homo Sapiens
GTRRRCYRH

SEQ ID NO: 367857 - protein, 9 aa, Homo Sapiens
YFLLANLTF

SEQ ID NO: 367858 - protein, 9 aa, Homo Sapiens
GSSWHMVIG

SEQ ID NO: 367859 - protein, 9 aa, Homo Sapiens
RGTLHTTLA

SEQ ID NO: 367860 - protein, 9 aa, Homo Sapiens
TSRPPPGSS

SEQ ID NO: 367861 - protein, 9 aa, Homo Sapiens
KQFYSTAKN

SEQ ID NO: 367862 - protein, 9 aa, Homo Sapiens
FVVRNTVQR

SEQ ID NO: 367863 - protein, 9 aa, Homo Sapiens
FYRTWPLPG

SEQ ID NO: 367864 - protein, 9 aa, Homo Sapiens
RWQPRIWVL

SEQ ID NO: 367865 - protein, 9 aa, Homo Sapiens
LVGRSDLPQ

SEQ ID NO: 367866 - protein, 9 aa, Homo Sapiens
LGKSRRRRR

SEQ ID NO: 367867 - protein, 9 aa, Homo Sapiens
PPGPTTDAV

SEQ ID NO: 367868 - protein, 9 aa, Homo Sapiens
RQMITKDKN

SEQ ID NO: 367869 - protein, 9 aa, Homo Sapiens
LFMHLRQDL

SEQ ID NO: 367870 - protein, 9 aa, Homo Sapiens
GSPRISSLC

SEQ ID NO: 367871 - protein, 9 aa, Homo Sapiens
LVKRNLIQL

SEQ ID NO: 367872 - protein, 9 aa, Homo Sapiens
PVDIRILAA

SEQ ID NO: 367873 - protein, 9 aa, Homo Sapiens
LKLPQDQGL

SEQ ID NO: 367874 - protein, 9 aa, Homo Sapiens
VAEKFAITE

SEQ ID NO: 367875 - protein, 9 aa, Homo Sapiens
IVNASNASL

SEQ ID NO: 367876 - protein, 9 aa, Homo Sapiens
YKNKEQREQ

SEQ ID NO: 367877 - protein, 9 aa, Homo Sapiens
RCRPPWAAR

SEQ ID NO: 367878 - protein, 9 aa, Homo Sapiens
TPRAGSGRA

SEQ ID NO: 367879 - protein, 9 aa, Homo Sapiens
ITLMQRTVG

SEQ ID NO: 367880 - protein, 9 aa, Homo Sapiens
LLSLYSVAV

SEQ ID NO: 367881 - protein, 9 aa, Homo Sapiens
TRGQILFPC

SEQ ID NO: 367882 - protein, 9 aa, Homo Sapiens
PLKKKKTRF

SEQ ID NO: 367883 - protein, 9 aa, Homo Sapiens
SWPVRASSV

SEQ ID NO: 367884 - protein, 9 aa, Homo Sapiens
SHLPPQTRM

SEQ ID NO: 367885 - protein, 9 aa, Homo Sapiens
ASAACQNEH

SEQ ID NO: 367886 - protein, 9 aa, Homo Sapiens
YTPALVCAP

SEQ ID NO: 367887 - protein, 9 aa, Homo Sapiens
HREWVHMVR

SEQ ID NO: 367888 - protein, 9 aa, Homo Sapiens
AVLQDYELQ

SEQ ID NO: 367889 - protein, 9 aa, Homo Sapiens
TWVWSRPPS

SEQ ID NO: 367890 - protein, 9 aa, Homo Sapiens
YKGTVPHLG

SEQ ID NO: 367891 - protein, 9 aa, Homo Sapiens
DLEKKKERS

SEQ ID NO: 367892 - protein, 9 aa, Homo Sapiens
QPQRRGTGR

SEQ ID NO: 367893 - protein, 9 aa, Homo Sapiens
VGGPWATGP

SEQ ID NO: 367894 - protein, 9 aa, Homo Sapiens
KAIGSAGTE

SEQ ID NO: 367895 - protein, 9 aa, Homo Sapiens
PPPPTKKRG

SEQ ID NO: 367896 - protein, 9 aa, Homo Sapiens
GSMTQFTLK

SEQ ID NO: 367897 - protein, 9 aa, Homo Sapiens
PLPLSGEAL

SEQ ID NO: 367898 - protein, 9 aa, Homo Sapiens
YKDLRDGCM

SEQ ID NO: 367899 - protein, 9 aa, Homo Sapiens
EDPRIHQHL

SEQ ID NO: 367900 - protein, 9 aa, Homo Sapiens
SGVPEVDGD

SEQ ID NO: 367901 - protein, 9 aa, Homo Sapiens
RVLLPGDMG

SEQ ID NO: 367902 - protein, 9 aa, Homo Sapiens
RDKEQEKDR

SEQ ID NO: 367903 - protein, 9 aa, Homo Sapiens
GQAISLDLR

SEQ ID NO: 367904 - protein, 9 aa, Homo Sapiens
LCTRGGTGV

SEQ ID NO: 367905 - protein, 9 aa, Homo Sapiens
VEDLTATSV

SEQ ID NO: 367906 - protein, 9 aa, Homo Sapiens
RSPFGSCWP

SEQ ID NO: 367907 - protein, 9 aa, Homo Sapiens
SNSNHRDWI

SEQ ID NO: 367908 - protein, 9 aa, Homo Sapiens
KSDIYVCVI

SEQ ID NO: 367909 - protein, 9 aa, Homo Sapiens
SITRFAFST

SEQ ID NO: 367910 - protein, 9 aa, Homo Sapiens
SYGLQEKSV

SEQ ID NO: 367911 - protein, 9 aa, Homo Sapiens
PGGCLLTVE

SEQ ID NO: 367912 - protein, 9 aa, Homo Sapiens
VGRSDLPQI

SEQ ID NO: 367913 - protein, 9 aa, Homo Sapiens
WASGRRVWY

SEQ ID NO: 367914 - protein, 9 aa, Homo Sapiens
ITFFRPGAA

SEQ ID NO: 367915 - protein, 9 aa, Homo Sapiens
LSEGEHMVD

SEQ ID NO: 367916 - protein, 9 aa, Homo Sapiens
HHVNQAVCD

SEQ ID NO: 367917 - protein, 9 aa, Homo Sapiens
WGCPAGCTP

SEQ ID NO: 367918 - protein, 9 aa, Homo Sapiens
LLGGGQRGN

SEQ ID NO: 367919 - protein, 9 aa, Homo Sapiens
LALLALGTG

SEQ ID NO: 367920 - protein, 9 aa, Homo Sapiens
GQASPTSST

SEQ ID NO: 367921 - protein, 9 aa, Homo Sapiens
PISKERVLL

SEQ ID NO: 367922 - protein, 9 aa, Homo Sapiens
KPGDGEYKF

SEQ ID NO: 367923 - protein, 9 aa, Homo Sapiens
APFFVPMSL

SEQ ID NO: 367924 - protein, 9 aa, Homo Sapiens
GPQEVAVHV

SEQ ID NO: 367925 - protein, 9 aa, Homo Sapiens
WLLNPERSL

SEQ ID NO: 367926 - protein, 9 aa, Homo Sapiens
TRETTYDRE

SEQ ID NO: 367927 - protein, 9 aa, Homo Sapiens
PSRRLSLWA

SEQ ID NO: 367928 - protein, 9 aa, Homo Sapiens
LVSGPTAGG

SEQ ID NO: 367929 - protein, 9 aa, Homo Sapiens
SAGMRYSSP

SEQ ID NO: 367930 - protein, 9 aa, Homo Sapiens
ALQPSMTVD

SEQ ID NO: 367931 - protein, 9 aa, Homo Sapiens
GSSRPLPLQ

SEQ ID NO: 367932 - protein, 9 aa, Homo Sapiens
GLALLQHHA

SEQ ID NO: 367933 - protein, 9 aa, Homo Sapiens
KEQEKDREK

SEQ ID NO: 367934 - protein, 9 aa, Homo Sapiens
QMITKDKNW

SEQ ID NO: 367935 - protein, 9 aa, Homo Sapiens
LLPCMLISL

SEQ ID NO: 367936 - protein, 9 aa, Homo Sapiens
EGYETALKG

SEQ ID NO: 367937 - protein, 9 aa, Homo Sapiens
EQNQGLALP

SEQ ID NO: 367938 - protein, 9 aa, Homo Sapiens
MRSEEEGET

SEQ ID NO: 367939 - protein, 9 aa, Homo Sapiens
VHWLQESRR

SEQ ID NO: 367940 - protein, 9 aa, Homo Sapiens
PQCPRNRPY

SEQ ID NO: 367941 - protein, 9 aa, Homo Sapiens
SCRVLTDLS

SEQ ID NO: 367942 - protein, 9 aa, Homo Sapiens
CLSVSRALS

SEQ ID NO: 367943 - protein, 9 aa, Homo Sapiens
CPKKTTKKR

SEQ ID NO: 367944 - protein, 9 aa, Homo Sapiens
SFSSPNVTS

SEQ ID NO: 367945 - protein, 9 aa, Homo Sapiens
KKPRTPKIP

SEQ ID NO: 367946 - protein, 9 aa, Homo Sapiens
RNPRAKQPS

SEQ ID NO: 367947 - protein, 9 aa, Homo Sapiens
QAKMGMQHH

SEQ ID NO: 367948 - protein, 9 aa, Homo Sapiens
LSLYSVAVW

SEQ ID NO: 367949 - protein, 9 aa, Homo Sapiens
REQTARARA

SEQ ID NO: 367950 - protein, 9 aa, Homo Sapiens
QAVCDMEDL

SEQ ID NO: 367951 - protein, 9 aa, Homo Sapiens
IDWDILNRQ

SEQ ID NO: 367952 - protein, 9 aa, Homo Sapiens
KCFLKTRGQ

SEQ ID NO: 367953 - protein, 9 aa, Homo Sapiens
KEVAKHWGW

SEQ ID NO: 367954 - protein, 9 aa, Homo Sapiens
VPDVSLRNS

SEQ ID NO: 367955 - protein, 9 aa, Homo Sapiens
TFVTTQEQR

SEQ ID NO: 367956 - protein, 9 aa, Homo Sapiens
MWTTVLVDD

SEQ ID NO: 367957 - protein, 9 aa, Homo Sapiens
WKKVIWIYR

SEQ ID NO: 367958 - protein, 9 aa, Homo Sapiens
ALGSQLQKL

SEQ ID NO: 367959 - protein, 9 aa, Homo Sapiens
VEHLMEKMK

SEQ ID NO: 367960 - protein, 9 aa, Homo Sapiens
ARQLYHLVS

SEQ ID NO: 367961 - protein, 9 aa, Homo Sapiens
QPSLKDHRI

SEQ ID NO: 367962 - protein, 9 aa, Homo Sapiens
VAPLAPWAW

SEQ ID NO: 367963 - protein, 9 aa, Homo Sapiens
SPASPPTQQ

SEQ ID NO: 367964 - protein, 9 aa, Homo Sapiens
VPIGKCVWS

SEQ ID NO: 367965 - protein, 9 aa, Homo Sapiens
PLTQTPAKP

SEQ ID NO: 367966 - protein, 9 aa, Homo Sapiens
STYAEFSPC

SEQ ID NO: 367967 - protein, 9 aa, Homo Sapiens
LWRSCLWEE

SEQ ID NO: 367968 - protein, 9 aa, Homo Sapiens
EDRQEIRQQ

SEQ ID NO: 367969 - protein, 9 aa, Homo Sapiens
PLGARRTAK

SEQ ID NO: 367970 - protein, 9 aa, Homo Sapiens
MRLNLTKWQ

SEQ ID NO: 367971 - protein, 9 aa, Homo Sapiens
PQQGAPPRA

SEQ ID NO: 367972 - protein, 9 aa, Homo Sapiens
HHELISTLM

SEQ ID NO: 367973 - protein, 9 aa, Homo Sapiens
WLQWPHPDP

SEQ ID NO: 367974 - protein, 9 aa, Homo Sapiens
RDHNEPSIS

SEQ ID NO: 367975 - protein, 9 aa, Homo Sapiens
GVLERYASC

SEQ ID NO: 367976 - protein, 9 aa, Homo Sapiens
TIGEKTEIQ

SEQ ID NO: 367977 - protein, 9 aa, Homo Sapiens
GAEQQQHHV

SEQ ID NO: 367978 - protein, 9 aa, Homo Sapiens
VVMSGVHCT

SEQ ID NO: 367979 - protein, 9 aa, Homo Sapiens
GPYCTSKAY

SEQ ID NO: 367980 - protein, 9 aa, Homo Sapiens
PTARADLAA

SEQ ID NO: 367981 - protein, 9 aa, Homo Sapiens
QICEFGIRF

SEQ ID NO: 367982 - protein, 9 aa, Homo Sapiens
GPHAWTSTP

SEQ ID NO: 367983 - protein, 9 aa, Homo Sapiens
FLTMNLNIA

SEQ ID NO: 367984 - protein, 9 aa, Homo Sapiens
ANDRQFSSQ

SEQ ID NO: 367985 - protein, 9 aa, Homo Sapiens
RKTAEKRIK

SEQ ID NO: 367986 - protein, 9 aa, Homo Sapiens
EAEAGQLRE

SEQ ID NO: 367987 - protein, 9 aa, Homo Sapiens
HVSGPWRPE

SEQ ID NO: 367988 - protein, 9 aa, Homo Sapiens
QLQERIWSY

SEQ ID NO: 367989 - protein, 9 aa, Homo Sapiens
RFYRTWPLP

SEQ ID NO: 367990 - protein, 9 aa, Homo Sapiens
ESTPYFILW

SEQ ID NO: 367991 - protein, 9 aa, Homo Sapiens
HDCGTRFSN

SEQ ID NO: 367992 - protein, 9 aa, Homo Sapiens
GQRRESGLL

SEQ ID NO: 367993 - protein, 9 aa, Homo Sapiens
SLVSGPTAG

SEQ ID NO: 367994 - protein, 9 aa, Homo Sapiens
VTPAPPPCR

SEQ ID NO: 367995 - protein, 9 aa, Homo Sapiens
KPTSQLVNL

SEQ ID NO: 367996 - protein, 9 aa, Homo Sapiens
KATNIIAKL

SEQ ID NO: 367997 - protein, 9 aa, Homo Sapiens
IYSSGNEDG

SEQ ID NO: 367998 - protein, 9 aa, Homo Sapiens
PRVTPGPPP

SEQ ID NO: 367999 - protein, 9 aa, Homo Sapiens
GTCLAASMA

SEQ ID NO: 368000 - protein, 9 aa, Homo Sapiens
APKRPLLPR

SEQ ID NO: 368001 - protein, 9 aa, Homo Sapiens
ASPPTQQPQ

SEQ ID NO: 368002 - protein, 9 aa, Homo Sapiens
TYDRFLLGV

SEQ ID NO: 368003 - protein, 9 aa, Homo Sapiens
TCRSPSRSP

SEQ ID NO: 368004 - protein, 9 aa, Homo Sapiens
AAEEGGVGA

SEQ ID NO: 368005 - protein, 9 aa, Homo Sapiens
FVPMSLACS

SEQ ID NO: 368006 - protein, 9 aa, Homo Sapiens
ESRSHTSYE

SEQ ID NO: 368007 - protein, 9 aa, Homo Sapiens
SEAEKTLGD

SEQ ID NO: 368008 - protein, 9 aa, Homo Sapiens
VLENNEVRV

SEQ ID NO: 368009 - protein, 9 aa, Homo Sapiens
ARGAKVSRN

SEQ ID NO: 368010 - protein, 9 aa, Homo Sapiens
LWRMMTLNL

SEQ ID NO: 368011 - protein, 9 aa, Homo Sapiens
AWWLPERRC

SEQ ID NO: 368012 - protein, 9 aa, Homo Sapiens
GLSGLMAPP

SEQ ID NO: 368013 - protein, 9 aa, Homo Sapiens
KSMTVGLTF

SEQ ID NO: 368014 - protein, 9 aa, Homo Sapiens
PRIAIALFE

SEQ ID NO: 368015 - protein, 9 aa, Homo Sapiens
EPVKAKNGR

SEQ ID NO: 368016 - protein, 9 aa, Homo Sapiens
WGQEWHCGP

SEQ ID NO: 368017 - protein, 9 aa, Homo Sapiens
QTRMLHLQD

SEQ ID NO: 368018 - protein, 9 aa, Homo Sapiens
DKVEIIAND

SEQ ID NO: 368019 - protein, 9 aa, Homo Sapiens
CFSRIVQIS

SEQ ID NO: 368020 - protein, 9 aa, Homo Sapiens
LLEKENRDL

SEQ ID NO: 368021 - protein, 9 aa, Homo Sapiens
AWHRTLTAE

SEQ ID NO: 368022 - protein, 9 aa, Homo Sapiens
HEMVTEPPD

SEQ ID NO: 368023 - protein, 9 aa, Homo Sapiens
EGNTDTPVS

SEQ ID NO: 368024 - protein, 9 aa, Homo Sapiens
QPPAPESPD

SEQ ID NO: 368025 - protein, 9 aa, Homo Sapiens
RVLFHCSEC

SEQ ID NO: 368026 - protein, 9 aa, Homo Sapiens
LNSQQEGGS

SEQ ID NO: 368027 - protein, 9 aa, Homo Sapiens
VRFVVRNTV

SEQ ID NO: 368028 - protein, 9 aa, Homo Sapiens
QAADGTPLL

SEQ ID NO: 368029 - protein, 9 aa, Homo Sapiens
TSDRQHTTF

SEQ ID NO: 368030 - protein, 9 aa, Homo Sapiens
PVTVSRPTP

SEQ ID NO: 368031 - protein, 9 aa, Homo Sapiens
AGRTGAGQP

SEQ ID NO: 368032 - protein, 9 aa, Homo Sapiens
VLCFSIANS

SEQ ID NO: 368033 - protein, 9 aa, Homo Sapiens
KINSVINHF

SEQ ID NO: 368034 - protein, 9 aa, Homo Sapiens
TPRLSPLIR

SEQ ID NO: 368035 - protein, 9 aa, Homo Sapiens
SKLWSTFHQ

SEQ ID NO: 368036 - protein, 9 aa, Homo Sapiens
KNTQALPLP

SEQ ID NO: 368037 - protein, 9 aa, Homo Sapiens
AGMRNHENS

SEQ ID NO: 368038 - protein, 9 aa, Homo Sapiens
PVAARACAA

SEQ ID NO: 368039 - protein, 9 aa, Homo Sapiens
MMTLNLKDQ

SEQ ID NO: 368040 - protein, 9 aa, Homo Sapiens
GPPQQQWPQ

SEQ ID NO: 368041 - protein, 9 aa, Homo Sapiens
SRLPKTWNA

SEQ ID NO: 368042 - protein, 9 aa, Homo Sapiens
VQNHITAFT

SEQ ID NO: 368043 - protein, 9 aa, Homo Sapiens
SERKNQAPQ

SEQ ID NO: 368044 - protein, 9 aa, Homo Sapiens
LEPQIRPVY

SEQ ID NO: 368045 - protein, 9 aa, Homo Sapiens
NYAAEEISE

SEQ ID NO: 368046 - protein, 9 aa, Homo Sapiens
TTLLSDASH

SEQ ID NO: 368047 - protein, 9 aa, Homo Sapiens
ECSYFYRLY

SEQ ID NO: 368048 - protein, 9 aa, Homo Sapiens
MTSRDIKVQ

SEQ ID NO: 368049 - protein, 9 aa, Homo Sapiens
VRLRSFDVG

SEQ ID NO: 368050 - protein, 9 aa, Homo Sapiens
TLCYHWLGH

SEQ ID NO: 368051 - protein, 9 aa, Homo Sapiens
TSKAYNNQP

SEQ ID NO: 368052 - protein, 9 aa, Homo Sapiens
LSHMMIRFF

SEQ ID NO: 368053 - protein, 9 aa, Homo Sapiens
KKSYRLVLK

SEQ ID NO: 368054 - protein, 9 aa, Homo Sapiens
PVAAPTDDL

SEQ ID NO: 368055 - protein, 9 aa, Homo Sapiens
VSLLFLSWI

SEQ ID NO: 368056 - protein, 9 aa, Homo Sapiens
IAAIEKMVV

SEQ ID NO: 368057 - protein, 9 aa, Homo Sapiens
DYVQTCIMN

SEQ ID NO: 368058 - protein, 9 aa, Homo Sapiens
CDPGGVGEH

SEQ ID NO: 368059 - protein, 9 aa, Homo Sapiens
GQIPRHIKK

SEQ ID NO: 368060 - protein, 9 aa, Homo Sapiens
KIKETICGH

SEQ ID NO: 368061 - protein, 9 aa, Homo Sapiens
EMLQDHKWE

SEQ ID NO: 368062 - protein, 9 aa, Homo Sapiens
FIGSMDVFQ

SEQ ID NO: 368063 - protein, 9 aa, Homo Sapiens
DKDKPLKKK

SEQ ID NO: 368064 - protein, 9 aa, Homo Sapiens
MHRNLKQKW

SEQ ID NO: 368065 - protein, 9 aa, Homo Sapiens
NPEKIQLYS

SEQ ID NO: 368066 - protein, 9 aa, Homo Sapiens
AWARAHLAV

SEQ ID NO: 368067 - protein, 9 aa, Homo Sapiens
FILSRATGR

SEQ ID NO: 368068 - protein, 9 aa, Homo Sapiens
SAQEFAVNP

SEQ ID NO: 368069 - protein, 9 aa, Homo Sapiens
RLYRCRECG

SEQ ID NO: 368070 - protein, 9 aa, Homo Sapiens
RDVVQQTEA

SEQ ID NO: 368071 - protein, 9 aa, Homo Sapiens
KLLQLKILT

SEQ ID NO: 368072 - protein, 9 aa, Homo Sapiens
TKRPCLLEA

SEQ ID NO: 368073 - protein, 9 aa, Homo Sapiens
AARWQRGLQ

SEQ ID NO: 368074 - protein, 9 aa, Homo Sapiens
DSQEDKKIQ

SEQ ID NO: 368075 - protein, 9 aa, Homo Sapiens
IQKKNITNN

SEQ ID NO: 368076 - protein, 9 aa, Homo Sapiens
KGQDGIGSE

SEQ ID NO: 368077 - protein, 9 aa, Homo Sapiens
PDPTAPPYD

SEQ ID NO: 368078 - protein, 9 aa, Homo Sapiens
TTLCQVSGM

SEQ ID NO: 368079 - protein, 9 aa, Homo Sapiens
EGASPEPPH

SEQ ID NO: 368080 - protein, 9 aa, Homo Sapiens
AGADGQASG

SEQ ID NO: 368081 - protein, 9 aa, Homo Sapiens
WVRRQFEFS

SEQ ID NO: 368082 - protein, 9 aa, Homo Sapiens
EPRRPRPAA

SEQ ID NO: 368083 - protein, 9 aa, Homo Sapiens
GPHASINVH

SEQ ID NO: 368084 - protein, 9 aa, Homo Sapiens
PASTPRPST

SEQ ID NO: 368085 - protein, 9 aa, Homo Sapiens
YISANVGDP

SEQ ID NO: 368086 - protein, 9 aa, Homo Sapiens
CQPYRSEFY

SEQ ID NO: 368087 - protein, 9 aa, Homo Sapiens
IVQMVFSVI

SEQ ID NO: 368088 - protein, 9 aa, Homo Sapiens
DYPHWCEYC

SEQ ID NO: 368089 - protein, 9 aa, Homo Sapiens
ESLTIIFNF

SEQ ID NO: 368090 - protein, 9 aa, Homo Sapiens
GDSGAPPCR

SEQ ID NO: 368091 - protein, 9 aa, Homo Sapiens
AVVVVHEVP

SEQ ID NO: 368092 - protein, 9 aa, Homo Sapiens
LINSSACDG

SEQ ID NO: 368093 - protein, 9 aa, Homo Sapiens
PWPRLASIC

SEQ ID NO: 368094 - protein, 9 aa, Homo Sapiens
LSYERQYHT

SEQ ID NO: 368095 - protein, 9 aa, Homo Sapiens
FCGPLVKGV

SEQ ID NO: 368096 - protein, 9 aa, Homo Sapiens
MLKTTRVNT

SEQ ID NO: 368097 - protein, 9 aa, Homo Sapiens
GSDCQVKVW

SEQ ID NO: 368098 - protein, 9 aa, Homo Sapiens
LYLHHCQRH

SEQ ID NO: 368099 - protein, 9 aa, Homo Sapiens
SMQSVFNMN

SEQ ID NO: 368100 - protein, 9 aa, Homo Sapiens
MSAVTHSPM

SEQ ID NO: 368101 - protein, 9 aa, Homo Sapiens
PRGWHCDQE

SEQ ID NO: 368102 - protein, 9 aa, Homo Sapiens
RHSVVLHTL

SEQ ID NO: 368103 - protein, 9 aa, Homo Sapiens
SLTDDCEEE

SEQ ID NO: 368104 - protein, 9 aa, Homo Sapiens
HTTLARETS

SEQ ID NO: 368105 - protein, 9 aa, Homo Sapiens
NKKRKKMFL

SEQ ID NO: 368106 - protein, 9 aa, Homo Sapiens
YLFKQLSCS

SEQ ID NO: 368107 - protein, 9 aa, Homo Sapiens
SQCCPQCKK

SEQ ID NO: 368108 - protein, 9 aa, Homo Sapiens
RLRRASGRM

SEQ ID NO: 368109 - protein, 9 aa, Homo Sapiens
DLGHTAREK

SEQ ID NO: 368110 - protein, 9 aa, Homo Sapiens
KICIDMPTI

SEQ ID NO: 368111 - protein, 9 aa, Homo Sapiens
LLKTLNMIQ

SEQ ID NO: 368112 - protein, 9 aa, Homo Sapiens
TGLLPECFR

SEQ ID NO: 368113 - protein, 9 aa, Homo Sapiens
SRMAHPRLP

SEQ ID NO: 368114 - protein, 9 aa, Homo Sapiens
PSASRCQKA

SEQ ID NO: 368115 - protein, 9 aa, Homo Sapiens
RVVVVGHGS

SEQ ID NO: 368116 - protein, 9 aa, Homo Sapiens
PPVAARACA

SEQ ID NO: 368117 - protein, 9 aa, Homo Sapiens
ARVCDIEHL

SEQ ID NO: 368118 - protein, 9 aa, Homo Sapiens
SPLIRAPGS

SEQ ID NO: 368119 - protein, 9 aa, Homo Sapiens
GVSFSQLEL

SEQ ID NO: 368120 - protein, 9 aa, Homo Sapiens
RRSKTEAHL

SEQ ID NO: 368121 - protein, 9 aa, Homo Sapiens
SDVGLWKGR

SEQ ID NO: 368122 - protein, 9 aa, Homo Sapiens
CRWVWNPTR

SEQ ID NO: 368123 - protein, 9 aa, Homo Sapiens
GNGVIAFVL

SEQ ID NO: 368124 - protein, 9 aa, Homo Sapiens
AGAPAEGAR

SEQ ID NO: 368125 - protein, 9 aa, Homo Sapiens
TLCHMPVPV

SEQ ID NO: 368126 - protein, 9 aa, Homo Sapiens
KKKMSPPAS

SEQ ID NO: 368127 - protein, 9 aa, Homo Sapiens
IWEEWSLLI

SEQ ID NO: 368128 - protein, 9 aa, Homo Sapiens
AGCLRQRRL

SEQ ID NO: 368129 - protein, 9 aa, Homo Sapiens
EMRCMYGSM

SEQ ID NO: 368130 - protein, 9 aa, Homo Sapiens
ATVIIMVTR

SEQ ID NO: 368131 - protein, 9 aa, Homo Sapiens
DQELATVLL

SEQ ID NO: 368132 - protein, 9 aa, Homo Sapiens
VLQMECVGA

SEQ ID NO: 368133 - protein, 9 aa, Homo Sapiens
KISLEKEIK

SEQ ID NO: 368134 - protein, 9 aa, Homo Sapiens
FSPTVGLCL

SEQ ID NO: 368135 - protein, 9 aa, Homo Sapiens
EPAVTLCEQ

SEQ ID NO: 368136 - protein, 9 aa, Homo Sapiens
HTRSHLRQL

SEQ ID NO: 368137 - protein, 9 aa, Homo Sapiens
DSALNEQKE

SEQ ID NO: 368138 - protein, 9 aa, Homo Sapiens
GSPCVWTPR

SEQ ID NO: 368139 - protein, 9 aa, Homo Sapiens
KANIARSGD

SEQ ID NO: 368140 - protein, 9 aa, Homo Sapiens
QATVRETKS

SEQ ID NO: 368141 - protein, 9 aa, Homo Sapiens
KMSLLIPSK

SEQ ID NO: 368142 - protein, 9 aa, Homo Sapiens
FGSCWPPWP

SEQ ID NO: 368143 - protein, 9 aa, Homo Sapiens
REHHSCTPV

SEQ ID NO: 368144 - protein, 9 aa, Homo Sapiens
GEKPYTCAQ

SEQ ID NO: 368145 - protein, 9 aa, Homo Sapiens
KLKLPEKGP

SEQ ID NO: 368146 - protein, 9 aa, Homo Sapiens
SQGTGSFFS

SEQ ID NO: 368147 - protein, 9 aa, Homo Sapiens
PPCRPRVTP

SEQ ID NO: 368148 - protein, 9 aa, Homo Sapiens
LGALEPSGC

SEQ ID NO: 368149 - protein, 9 aa, Homo Sapiens
PDPAVVVVH

SEQ ID NO: 368150 - protein, 9 aa, Homo Sapiens
SPYILMRFL

SEQ ID NO: 368151 - protein, 9 aa, Homo Sapiens
EDEEGQQKI

SEQ ID NO: 368152 - protein, 9 aa, Homo Sapiens
ACDGLLSRP

SEQ ID NO: 368153 - protein, 9 aa, Homo Sapiens
SMASLKKQY

SEQ ID NO: 368154 - protein, 9 aa, Homo Sapiens
QGSSRPLPL

SEQ ID NO: 368155 - protein, 9 aa, Homo Sapiens
KCLNFRKPQ

SEQ ID NO: 368156 - protein, 9 aa, Homo Sapiens
RRLQLFMHL

SEQ ID NO: 368157 - protein, 9 aa, Homo Sapiens
IFGNVGSAL

SEQ ID NO: 368158 - protein, 9 aa, Homo Sapiens
DEIDHLLQS

SEQ ID NO: 368159 - protein, 9 aa, Homo Sapiens
LEESKALNV

SEQ ID NO: 368160 - protein, 9 aa, Homo Sapiens
KPGEDMLCL

SEQ ID NO: 368161 - protein, 9 aa, Homo Sapiens
NVLPLSCFL

SEQ ID NO: 368162 - protein, 9 aa, Homo Sapiens
SEHVGIIYN

SEQ ID NO: 368163 - protein, 9 aa, Homo Sapiens
IGKTCWRPD

SEQ ID NO: 368164 - protein, 9 aa, Homo Sapiens
GVEEMATKK

SEQ ID NO: 368165 - protein, 9 aa, Homo Sapiens
YKKKDFDIA

SEQ ID NO: 368166 - protein, 9 aa, Homo Sapiens
FFEDFQAFV

SEQ ID NO: 368167 - protein, 9 aa, Homo Sapiens
LLRAPPGCG

SEQ ID NO: 368168 - protein, 9 aa, Homo Sapiens
TEWWTMVCN

SEQ ID NO: 368169 - protein, 9 aa, Homo Sapiens
PAIRRLARH

SEQ ID NO: 368170 - protein, 9 aa, Homo Sapiens
ECTDITMKH

SEQ ID NO: 368171 - protein, 9 aa, Homo Sapiens
QPSTQRSLA

SEQ ID NO: 368172 - protein, 9 aa, Homo Sapiens
ESEPGLARC

SEQ ID NO: 368173 - protein, 9 aa, Homo Sapiens
NRYSQPCPS

SEQ ID NO: 368174 - protein, 9 aa, Homo Sapiens
RLQVGLNHG

SEQ ID NO: 368175 - protein, 9 aa, Homo Sapiens
LPMCCTPAS

SEQ ID NO: 368176 - protein, 9 aa, Homo Sapiens
NIRKFIVQI

SEQ ID NO: 368177 - protein, 9 aa, Homo Sapiens
SLMSGQKRP

SEQ ID NO: 368178 - protein, 9 aa, Homo Sapiens
DIDVESLEL

SEQ ID NO: 368179 - protein, 9 aa, Homo Sapiens
NLFHSFFVD

SEQ ID NO: 368180 - protein, 9 aa, Homo Sapiens
IVQINPTNV

SEQ ID NO: 368181 - protein, 9 aa, Homo Sapiens
QHDKVEIIA

SEQ ID NO: 368182 - protein, 9 aa, Homo Sapiens
VCVISYAHN

SEQ ID NO: 368183 - protein, 9 aa, Homo Sapiens
FIRNQPNER

SEQ ID NO: 368184 - protein, 9 aa, Homo Sapiens
LTVAVADII

SEQ ID NO: 368185 - protein, 9 aa, Homo Sapiens
APQPHSLPT

SEQ ID NO: 368186 - protein, 9 aa, Homo Sapiens
SVARQAQTV

SEQ ID NO: 368187 - protein, 9 aa, Homo Sapiens
APAAPGWPP

SEQ ID NO: 368188 - protein, 9 aa, Homo Sapiens
PGGVGEHGQ

SEQ ID NO: 368189 - protein, 9 aa, Homo Sapiens
CFTLLWCVY

SEQ ID NO: 368190 - protein, 9 aa, Homo Sapiens
ATSSTNRYS

SEQ ID NO: 368191 - protein, 9 aa, Homo Sapiens
GGGSWSSAS

SEQ ID NO: 368192 - protein, 9 aa, Homo Sapiens
DDLDLNPLM

SEQ ID NO: 368193 - protein, 9 aa, Homo Sapiens
PFYGFTIMR

SEQ ID NO: 368194 - protein, 9 aa, Homo Sapiens
IATYQAFPR

SEQ ID NO: 368195 - protein, 9 aa, Homo Sapiens
TTPPTPACA

SEQ ID NO: 368196 - protein, 9 aa, Homo Sapiens
WKLKLKLPE

SEQ ID NO: 368197 - protein, 9 aa, Homo Sapiens
PPPPYHDTL

SEQ ID NO: 368198 - protein, 9 aa, Homo Sapiens
SFDCTRPRL

SEQ ID NO: 368199 - protein, 9 aa, Homo Sapiens
VSGMPAMTC

SEQ ID NO: 368200 - protein, 9 aa, Homo Sapiens
RIRGMRKLR

SEQ ID NO: 368201 - protein, 9 aa, Homo Sapiens
IGSEAEKTL

SEQ ID NO: 368202 - protein, 9 aa, Homo Sapiens
DDKNLCNKP

SEQ ID NO: 368203 - protein, 9 aa, Homo Sapiens
LRLNPRRSC

SEQ ID NO: 368204 - protein, 9 aa, Homo Sapiens
SSHTHDLGT

SEQ ID NO: 368205 - protein, 9 aa, Homo Sapiens
PTSSTKPSP

SEQ ID NO: 368206 - protein, 9 aa, Homo Sapiens
PSPSHGSML

SEQ ID NO: 368207 - protein, 9 aa, Homo Sapiens
LDASNPFYE

SEQ ID NO: 368208 - protein, 9 aa, Homo Sapiens
GRRVDCGPG

SEQ ID NO: 368209 - protein, 9 aa, Homo Sapiens
SFSPYILMR

SEQ ID NO: 368210 - protein, 9 aa, Homo Sapiens
SGPWRPELL

SEQ ID NO: 368211 - protein, 9 aa, Homo Sapiens
SRMSSLTYH

SEQ ID NO: 368212 - protein, 9 aa, Homo Sapiens
STGRPQHSS

SEQ ID NO: 368213 - protein, 9 aa, Homo Sapiens
LSSRLSLPS

SEQ ID NO: 368214 - protein, 9 aa, Homo Sapiens
QQCYCLISV

SEQ ID NO: 368215 - protein, 9 aa, Homo Sapiens
VMREWRHLC

SEQ ID NO: 368216 - protein, 9 aa, Homo Sapiens
FSSLEPQIR

SEQ ID NO: 368217 - protein, 9 aa, Homo Sapiens
DMPEVLESL

SEQ ID NO: 368218 - protein, 9 aa, Homo Sapiens
KKNPSPAEG

SEQ ID NO: 368219 - protein, 9 aa, Homo Sapiens
APPSQGRGR

SEQ ID NO: 368220 - protein, 9 aa, Homo Sapiens
LTLHWEPVP

SEQ ID NO: 368221 - protein, 9 aa, Homo Sapiens
LSCSTKKRT

SEQ ID NO: 368222 - protein, 9 aa, Homo Sapiens
VPKGGPLLD

SEQ ID NO: 368223 - protein, 9 aa, Homo Sapiens
QPSRPPTVR

SEQ ID NO: 368224 - protein, 9 aa, Homo Sapiens
VGEIRWGAE

SEQ ID NO: 368225 - protein, 9 aa, Homo Sapiens
EEQLWKEVA

SEQ ID NO: 368226 - protein, 9 aa, Homo Sapiens
GLCCWKRGS

SEQ ID NO: 368227 - protein, 9 aa, Homo Sapiens
LRGPPRQRA

SEQ ID NO: 368228 - protein, 9 aa, Homo Sapiens
PHGPGDFDV

SEQ ID NO: 368229 - protein, 9 aa, Homo Sapiens
AMQLEQMKE

SEQ ID NO: 368230 - protein, 9 aa, Homo Sapiens
GSKKTLLKR

SEQ ID NO: 368231 - protein, 9 aa, Homo Sapiens
SGFAVGTWE

SEQ ID NO: 368232 - protein, 9 aa, Homo Sapiens
QLKAVVDSW

SEQ ID NO: 368233 - protein, 9 aa, Homo Sapiens
TPASPGNRG

SEQ ID NO: 368234 - protein, 9 aa, Homo Sapiens
LGHDGARGP

SEQ ID NO: 368235 - protein, 9 aa, Homo Sapiens
RNQPNERQV

SEQ ID NO: 368236 - protein, 9 aa, Homo Sapiens
IEGFPFAAE

SEQ ID NO: 368237 - protein, 9 aa, Homo Sapiens
GQQCYCLIS

SEQ ID NO: 368238 - protein, 9 aa, Homo Sapiens
LKQFLHKLY

SEQ ID NO: 368239 - protein, 9 aa, Homo Sapiens
GMDHLVQQG

SEQ ID NO: 368240 - protein, 9 aa, Homo Sapiens
MHTLAAAAS

SEQ ID NO: 368241 - protein, 9 aa, Homo Sapiens
AGSAAGDWD

SEQ ID NO: 368242 - protein, 9 aa, Homo Sapiens
PQIRAQVLI

SEQ ID NO: 368243 - protein, 9 aa, Homo Sapiens
HCVQRCPAC

SEQ ID NO: 368244 - protein, 9 aa, Homo Sapiens
RGKSERGGR

SEQ ID NO: 368245 - protein, 9 aa, Homo Sapiens
AGGGGSWSS

SEQ ID NO: 368246 - protein, 9 aa, Homo Sapiens
CSFVWGVKK

SEQ ID NO: 368247 - protein, 9 aa, Homo Sapiens
LIQQKTELL

SEQ ID NO: 368248 - protein, 9 aa, Homo Sapiens
ESWLEKTEF

SEQ ID NO: 368249 - protein, 9 aa, Homo Sapiens
LALLQHHAL

SEQ ID NO: 368250 - protein, 9 aa, Homo Sapiens
GYEAYECHG

SEQ ID NO: 368251 - protein, 9 aa, Homo Sapiens
VYLVEKDAT

SEQ ID NO: 368252 - protein, 9 aa, Homo Sapiens
ACISQAMRC

SEQ ID NO: 368253 - protein, 9 aa, Homo Sapiens
HDKVEIIAN

SEQ ID NO: 368254 - protein, 9 aa, Homo Sapiens
SCQACRFME

SEQ ID NO: 368255 - protein, 9 aa, Homo Sapiens
GKFAPFFVP

SEQ ID NO: 368256 - protein, 9 aa, Homo Sapiens
SGGVAAGDQ

SEQ ID NO: 368257 - protein, 9 aa, Homo Sapiens
DNKKISLEK

SEQ ID NO: 368258 - protein, 9 aa, Homo Sapiens
AHPVRLRSF

SEQ ID NO: 368259 - protein, 9 aa, Homo Sapiens
FTHFAEAGR

SEQ ID NO: 368260 - protein, 9 aa, Homo Sapiens
PGRLLQSCI

SEQ ID NO: 368261 - protein, 9 aa, Homo Sapiens
RALGKWLQW

SEQ ID NO: 368262 - protein, 9 aa, Homo Sapiens
RCFKVFHSE

SEQ ID NO: 368263 - protein, 9 aa, Homo Sapiens
NSCFSRIVQ

SEQ ID NO: 368264 - protein, 9 aa, Homo Sapiens
ASRTSNISK

SEQ ID NO: 368265 - protein, 9 aa, Homo Sapiens
YELPYNLAT

SEQ ID NO: 368266 - protein, 9 aa, Homo Sapiens
ARALPPGGC

SEQ ID NO: 368267 - protein, 9 aa, Homo Sapiens
PFQKECFHQ

SEQ ID NO: 368268 - protein, 9 aa, Homo Sapiens
KVWDEVNLR

SEQ ID NO: 368269 - protein, 9 aa, Homo Sapiens
TRYLSCSSC

SEQ ID NO: 368270 - protein, 9 aa, Homo Sapiens
DQSFSFHSG

SEQ ID NO: 368271 - protein, 9 aa, Homo Sapiens
CGTRFSNRS

SEQ ID NO: 368272 - protein, 9 aa, Homo Sapiens
YVICLQHRV

SEQ ID NO: 368273 - protein, 9 aa, Homo Sapiens
SAAADPLLR

SEQ ID NO: 368274 - protein, 9 aa, Homo Sapiens
QTRDAFLIV

SEQ ID NO: 368275 - protein, 9 aa, Homo Sapiens
MQDSLDEAQ

SEQ ID NO: 368276 - protein, 9 aa, Homo Sapiens
AGMRYSSPA

SEQ ID NO: 368277 - protein, 9 aa, Homo Sapiens
GAWVCDWLA

SEQ ID NO: 368278 - protein, 9 aa, Homo Sapiens
GIWEVMPRT

SEQ ID NO: 368279 - protein, 9 aa, Homo Sapiens
LYRKVMFGN

SEQ ID NO: 368280 - protein, 9 aa, Homo Sapiens
LWTKLEYAR

SEQ ID NO: 368281 - protein, 9 aa, Homo Sapiens
GIDLSPVYD

SEQ ID NO: 368282 - protein, 9 aa, Homo Sapiens
GPHPTVSTG

SEQ ID NO: 368283 - protein, 9 aa, Homo Sapiens
LMLDPVTPY

SEQ ID NO: 368284 - protein, 9 aa, Homo Sapiens
NESACYVEV

SEQ ID NO: 368285 - protein, 9 aa, Homo Sapiens
GNYRNLVFL

SEQ ID NO: 368286 - protein, 9 aa, Homo Sapiens
AAGGSLADW

SEQ ID NO: 368287 - protein, 9 aa, Homo Sapiens
YDFPAVLCW

SEQ ID NO: 368288 - protein, 9 aa, Homo Sapiens
RTGSHAPGT

SEQ ID NO: 368289 - protein, 9 aa, Homo Sapiens
LDHYLAIVH

SEQ ID NO: 368290 - protein, 9 aa, Homo Sapiens
DVRFESIWL

SEQ ID NO: 368291 - protein, 9 aa, Homo Sapiens
NCLGSQTDG

SEQ ID NO: 368292 - protein, 9 aa, Homo Sapiens
TQTPAKPTK

SEQ ID NO: 368293 - protein, 9 aa, Homo Sapiens
LTLPPWAVY

SEQ ID NO: 368294 - protein, 9 aa, Homo Sapiens
PRRTDEDRQ

SEQ ID NO: 368295 - protein, 9 aa, Homo Sapiens
RDMKVKGEA

SEQ ID NO: 368296 - protein, 9 aa, Homo Sapiens
SLLIPSKMR

SEQ ID NO: 368297 - protein, 9 aa, Homo Sapiens
VHPAACSLD

SEQ ID NO: 368298 - protein, 9 aa, Homo Sapiens
GRGRQERQQ

SEQ ID NO: 368299 - protein, 9 aa, Homo Sapiens
FESFMPQLL

SEQ ID NO: 368300 - protein, 9 aa, Homo Sapiens
VSQKKLSIK

SEQ ID NO: 368301 - protein, 9 aa, Homo Sapiens
SLTKQVIHT

SEQ ID NO: 368302 - protein, 9 aa, Homo Sapiens
APCRCSAPA

SEQ ID NO: 368303 - protein, 9 aa, Homo Sapiens
APPGCGKTT

SEQ ID NO: 368304 - protein, 9 aa, Homo Sapiens
PAARGGVGA

SEQ ID NO: 368305 - protein, 9 aa, Homo Sapiens
LMQQYLKER

SEQ ID NO: 368306 - protein, 9 aa, Homo Sapiens
VWAVLAWAR

SEQ ID NO: 368307 - protein, 9 aa, Homo Sapiens
TNNILFPWK

SEQ ID NO: 368308 - protein, 9 aa, Homo Sapiens
SSYIPYNSQ

SEQ ID NO: 368309 - protein, 9 aa, Homo Sapiens
KSRRRRRKD

SEQ ID NO: 368310 - protein, 9 aa, Homo Sapiens
LPLYHEIME

SEQ ID NO: 368311 - protein, 9 aa, Homo Sapiens
TPQDSRQVL

SEQ ID NO: 368312 - protein, 9 aa, Homo Sapiens
RKHYLVEDS

SEQ ID NO: 368313 - protein, 9 aa, Homo Sapiens
STVGPSGTS

SEQ ID NO: 368314 - protein, 9 aa, Homo Sapiens
DVDNEYEDE

SEQ ID NO: 368315 - protein, 9 aa, Homo Sapiens
HMDKKRYLC

SEQ ID NO: 368316 - protein, 9 aa, Homo Sapiens
VGPPTALWE

SEQ ID NO: 368317 - protein, 9 aa, Homo Sapiens
TLHQLATSY

SEQ ID NO: 368318 - protein, 9 aa, Homo Sapiens
RQSPSHIRH

SEQ ID NO: 368319 - protein, 9 aa, Homo Sapiens
LPTGGWGCY

SEQ ID NO: 368320 - protein, 9 aa, Homo Sapiens
RLYAVSLVN

SEQ ID NO: 368321 - protein, 9 aa, Homo Sapiens
VSGGGGLGR

SEQ ID NO: 368322 - protein, 9 aa, Homo Sapiens
SAPTRWQGL

SEQ ID NO: 368323 - protein, 9 aa, Homo Sapiens
VKMHEIFIS

SEQ ID NO: 368324 - protein, 9 aa, Homo Sapiens
EDSEDEQAA

SEQ ID NO: 368325 - protein, 9 aa, Homo Sapiens
GNSSFHSPD

SEQ ID NO: 368326 - protein, 9 aa, Homo Sapiens
GLSCVTCFR

SEQ ID NO: 368327 - protein, 9 aa, Homo Sapiens
VPQNAAAAS

SEQ ID NO: 368328 - protein, 9 aa, Homo Sapiens
SPRIHPLPG

SEQ ID NO: 368329 - protein, 9 aa, Homo Sapiens
QYKYEVGEI

SEQ ID NO: 368330 - protein, 9 aa, Homo Sapiens
GTQHFKEAL

SEQ ID NO: 368331 - protein, 9 aa, Homo Sapiens
FVESTTEQA

SEQ ID NO: 368332 - protein, 9 aa, Homo Sapiens
PAHIYSLFL

SEQ ID NO: 368333 - protein, 9 aa, Homo Sapiens
PDVYSYFAQ

SEQ ID NO: 368334 - protein, 9 aa, Homo Sapiens
SNASIDKIL

SEQ ID NO: 368335 - protein, 9 aa, Homo Sapiens
CNLSPGGLS

SEQ ID NO: 368336 - protein, 9 aa, Homo Sapiens
LELEDLYAK

SEQ ID NO: 368337 - protein, 9 aa, Homo Sapiens
SPIECQKSL

SEQ ID NO: 368338 - protein, 9 aa, Homo Sapiens
EVLRNSGTV

SEQ ID NO: 368339 - protein, 9 aa, Homo Sapiens
AVGAEVNTK

SEQ ID NO: 368340 - protein, 9 aa, Homo Sapiens
TFCDSERLV

SEQ ID NO: 368341 - protein, 9 aa, Homo Sapiens
AHFNTETGE

SEQ ID NO: 368342 - protein, 9 aa, Homo Sapiens
SSFSSPNVT

SEQ ID NO: 368343 - protein, 9 aa, Homo Sapiens
AKLWRMMTL

SEQ ID NO: 368344 - protein, 9 aa, Homo Sapiens
SPVSARRTQ

SEQ ID NO: 368345 - protein, 9 aa, Homo Sapiens
IMAYPKIKE

SEQ ID NO: 368346 - protein, 9 aa, Homo Sapiens
AKQPSRLPK

SEQ ID NO: 368347 - protein, 9 aa, Homo Sapiens
SRKRALPQL

SEQ ID NO: 368348 - protein, 9 aa, Homo Sapiens
SASALPTAV

SEQ ID NO: 368349 - protein, 9 aa, Homo Sapiens
IKNSFLCSP

SEQ ID NO: 368350 - protein, 9 aa, Homo Sapiens
CLVLLAMLG

SEQ ID NO: 368351 - protein, 9 aa, Homo Sapiens
ARNLLLTDK

SEQ ID NO: 368352 - protein, 9 aa, Homo Sapiens
TETKLVRKV

SEQ ID NO: 368353 - protein, 9 aa, Homo Sapiens
TGELELEDL

SEQ ID NO: 368354 - protein, 9 aa, Homo Sapiens
LSSLIKKKT

SEQ ID NO: 368355 - protein, 9 aa, Homo Sapiens
PPRPLPCPA

SEQ ID NO: 368356 - protein, 9 aa, Homo Sapiens
IQRELLKTL

SEQ ID NO: 368357 - protein, 9 aa, Homo Sapiens
PQQGWNATH

SEQ ID NO: 368358 - protein, 9 aa, Homo Sapiens
EGASLWEEG

SEQ ID NO: 368359 - protein, 9 aa, Homo Sapiens
AAVTQCRPA

SEQ ID NO: 368360 - protein, 9 aa, Homo Sapiens
WDKLFNLKM

SEQ ID NO: 368361 - protein, 9 aa, Homo Sapiens
PSPIGANGF

SEQ ID NO: 368362 - protein, 9 aa, Homo Sapiens
CLFVFFSMM

SEQ ID NO: 368363 - protein, 9 aa, Homo Sapiens
WARAHLAVE

SEQ ID NO: 368364 - protein, 9 aa, Homo Sapiens
KKDYVPPKD

SEQ ID NO: 368365 - protein, 9 aa, Homo Sapiens
APTRWQGLT

SEQ ID NO: 368366 - protein, 9 aa, Homo Sapiens
QGVVQFAVL

SEQ ID NO: 368367 - protein, 9 aa, Homo Sapiens
GHGSRMVAG

SEQ ID NO: 368368 - protein, 9 aa, Homo Sapiens
QTDLTVLGQ

SEQ ID NO: 368369 - protein, 9 aa, Homo Sapiens
DLIDKRSMP

SEQ ID NO: 368370 - protein, 9 aa, Homo Sapiens
KLNLQNIGC

SEQ ID NO: 368371 - protein, 9 aa, Homo Sapiens
YLTSLSKNP

SEQ ID NO: 368372 - protein, 9 aa, Homo Sapiens
RSETLRKCM

SEQ ID NO: 368373 - protein, 9 aa, Homo Sapiens
MSGQKRPFK

SEQ ID NO: 368374 - protein, 9 aa, Homo Sapiens
GYGGTKICW

SEQ ID NO: 368375 - protein, 9 aa, Homo Sapiens
ACPDDQGGA

SEQ ID NO: 368376 - protein, 9 aa, Homo Sapiens
THALLHHDP

SEQ ID NO: 368377 - protein, 9 aa, Homo Sapiens
CSLDLHFGA

SEQ ID NO: 368378 - protein, 9 aa, Homo Sapiens
CMKWCATCR

SEQ ID NO: 368379 - protein, 9 aa, Homo Sapiens
SLSSSLDNT

SEQ ID NO: 368380 - protein, 9 aa, Homo Sapiens
GGQASWSHA

SEQ ID NO: 368381 - protein, 9 aa, Homo Sapiens
QGACAHLAH

SEQ ID NO: 368382 - protein, 9 aa, Homo Sapiens
FYMHRNNSV

SEQ ID NO: 368383 - protein, 9 aa, Homo Sapiens
EGFPFAAET

SEQ ID NO: 368384 - protein, 9 aa, Homo Sapiens
RISTATSDG

SEQ ID NO: 368385 - protein, 9 aa, Homo Sapiens
MPQLLAYPN

SEQ ID NO: 368386 - protein, 9 aa, Homo Sapiens
MRYSSPANL

SEQ ID NO: 368387 - protein, 9 aa, Homo Sapiens
PMCCTPASS

SEQ ID NO: 368388 - protein, 9 aa, Homo Sapiens
PMPDKDRLK

SEQ ID NO: 368389 - protein, 9 aa, Homo Sapiens
QPPQPQRRG

SEQ ID NO: 368390 - protein, 9 aa, Homo Sapiens
PRPWAPVPA

SEQ ID NO: 368391 - protein, 9 aa, Homo Sapiens
LMSIYSSGN

SEQ ID NO: 368392 - protein, 9 aa, Homo Sapiens
FGIRFFLVS

SEQ ID NO: 368393 - protein, 9 aa, Homo Sapiens
TVPPIFTGR

SEQ ID NO: 368394 - protein, 9 aa, Homo Sapiens
HVFDVNRPC

SEQ ID NO: 368395 - protein, 9 aa, Homo Sapiens
PWRPELLPL

SEQ ID NO: 368396 - protein, 9 aa, Homo Sapiens
LRQRRLSKG

SEQ ID NO: 368397 - protein, 9 aa, Homo Sapiens
RKCYEPVPA

SEQ ID NO: 368398 - protein, 9 aa, Homo Sapiens
QQKIREEKD

SEQ ID NO: 368399 - protein, 9 aa, Homo Sapiens
MEEIMKKAA

SEQ ID NO: 368400 - protein, 9 aa, Homo Sapiens
RIVQISAFL

SEQ ID NO: 368401 - protein, 9 aa, Homo Sapiens
MCCTPASSQ

SEQ ID NO: 368402 - protein, 9 aa, Homo Sapiens
CAVRRPAAP

SEQ ID NO: 368403 - protein, 9 aa, Homo Sapiens
KPKVDNVEA

SEQ ID NO: 368404 - protein, 9 aa, Homo Sapiens
HLRVHTQEP

SEQ ID NO: 368405 - protein, 9 aa, Homo Sapiens
IDKSMTVGL

SEQ ID NO: 368406 - protein, 9 aa, Homo Sapiens
WTTNYDFSL

SEQ ID NO: 368407 - protein, 9 aa, Homo Sapiens
QAAIKKVDQ

SEQ ID NO: 368408 - protein, 9 aa, Homo Sapiens
DQGLSGLMA

SEQ ID NO: 368409 - protein, 9 aa, Homo Sapiens
QTQIIRSCE

SEQ ID NO: 368410 - protein, 9 aa, Homo Sapiens
GRDDYDPDA

SEQ ID NO: 368411 - protein, 9 aa, Homo Sapiens
WSLWVLPTI

SEQ ID NO: 368412 - protein, 9 aa, Homo Sapiens
WKQCLNKLE

SEQ ID NO: 368413 - protein, 9 aa, Homo Sapiens
SQKWGPLGQ

SEQ ID NO: 368414 - protein, 9 aa, Homo Sapiens
REGRDCSDV

SEQ ID NO: 368415 - protein, 9 aa, Homo Sapiens
KELLARSNY

SEQ ID NO: 368416 - protein, 9 aa, Homo Sapiens
TEEPELSPT

SEQ ID NO: 368417 - protein, 9 aa, Homo Sapiens
EAQQKIFDI

SEQ ID NO: 368418 - protein, 9 aa, Homo Sapiens
IYFASSVLG

SEQ ID NO: 368419 - protein, 9 aa, Homo Sapiens
HIPYQVLNS

SEQ ID NO: 368420 - protein, 9 aa, Homo Sapiens
FSSWVVVLM

SEQ ID NO: 368421 - protein, 9 aa, Homo Sapiens
NDCEVLGED

SEQ ID NO: 368422 - protein, 9 aa, Homo Sapiens
AALLALLAL

SEQ ID NO: 368423 - protein, 9 aa, Homo Sapiens
KCRKCYEPV

SEQ ID NO: 368424 - protein, 9 aa, Homo Sapiens
PALGLAVPP

SEQ ID NO: 368425 - protein, 9 aa, Homo Sapiens
LWATMRGFA

SEQ ID NO: 368426 - protein, 9 aa, Homo Sapiens
PISSKHIKH

SEQ ID NO: 368427 - protein, 9 aa, Homo Sapiens
TLSSGGGAP

SEQ ID NO: 368428 - protein, 9 aa, Homo Sapiens
RPCRCCRCL

SEQ ID NO: 368429 - protein, 9 aa, Homo Sapiens
PNVTSMESF

SEQ ID NO: 368430 - protein, 9 aa, Homo Sapiens
ERRIIETPH

SEQ ID NO: 368431 - protein, 9 aa, Homo Sapiens
LMPVCCGNE

SEQ ID NO: 368432 - protein, 9 aa, Homo Sapiens
AKSPTVTFE

SEQ ID NO: 368433 - protein, 9 aa, Homo Sapiens
TRVNTSLFL

SEQ ID NO: 368434 - protein, 9 aa, Homo Sapiens
FSTSITRFA

SEQ ID NO: 368435 - protein, 9 aa, Homo Sapiens
LMSGQKRPF

SEQ ID NO: 368436 - protein, 9 aa, Homo Sapiens
SRGARGAKV

SEQ ID NO: 368437 - protein, 9 aa, Homo Sapiens
RAPPGCGKT

SEQ ID NO: 368438 - protein, 9 aa, Homo Sapiens
TNAATAPSP

SEQ ID NO: 368439 - protein, 9 aa, Homo Sapiens
ESACYVEVC

SEQ ID NO: 368440 - protein, 9 aa, Homo Sapiens
YNLATDDYA

SEQ ID NO: 368441 - protein, 9 aa, Homo Sapiens
PGVRALGKW

SEQ ID NO: 368442 - protein, 9 aa, Homo Sapiens
HIGREPMLC

SEQ ID NO: 368443 - protein, 9 aa, Homo Sapiens
GERHRSRHQ

SEQ ID NO: 368444 - protein, 9 aa, Homo Sapiens
IKAVQYQVN

SEQ ID NO: 368445 - protein, 9 aa, Homo Sapiens
AVVDSWNAI

SEQ ID NO: 368446 - protein, 9 aa, Homo Sapiens
PASPPTKVS

SEQ ID NO: 368447 - protein, 9 aa, Homo Sapiens
TILHPEIIE

SEQ ID NO: 368448 - protein, 9 aa, Homo Sapiens
VFWGQEWHC

SEQ ID NO: 368449 - protein, 9 aa, Homo Sapiens
WSVAIWKEG

SEQ ID NO: 368450 - protein, 9 aa, Homo Sapiens
PPPPPVLPG

SEQ ID NO: 368451 - protein, 9 aa, Homo Sapiens
DIYVCVISY

SEQ ID NO: 368452 - protein, 9 aa, Homo Sapiens
LKKCSLYGK

SEQ ID NO: 368453 - protein, 9 aa, Homo Sapiens
DQKPGRNKW

SEQ ID NO: 368454 - protein, 9 aa, Homo Sapiens
IRTANTQEL

SEQ ID NO: 368455 - protein, 9 aa, Homo Sapiens
DSEKSTMGV

SEQ ID NO: 368456 - protein, 9 aa, Homo Sapiens
WARAFHSCT

SEQ ID NO: 368457 - protein, 9 aa, Homo Sapiens
GRRRAVQGS

SEQ ID NO: 368458 - protein, 9 aa, Homo Sapiens
RIHQHLARA

SEQ ID NO: 368459 - protein, 9 aa, Homo Sapiens
EEGSATPDQ

SEQ ID NO: 368460 - protein, 9 aa, Homo Sapiens
DFTRSSPQT

SEQ ID NO: 368461 - protein, 9 aa, Homo Sapiens
PGRWCRLSS

SEQ ID NO: 368462 - protein, 9 aa, Homo Sapiens
TSDGLCVKR

SEQ ID NO: 368463 - protein, 9 aa, Homo Sapiens
RTRGTLHTT

SEQ ID NO: 368464 - protein, 9 aa, Homo Sapiens
DFDIALKHY

SEQ ID NO: 368465 - protein, 9 aa, Homo Sapiens
ESPPPLPAD

SEQ ID NO: 368466 - protein, 9 aa, Homo Sapiens
RHRSRHQQS

SEQ ID NO: 368467 - protein, 9 aa, Homo Sapiens
KLIIPCPPQ

SEQ ID NO: 368468 - protein, 9 aa, Homo Sapiens
GRSWVAIPQ

SEQ ID NO: 368469 - protein, 9 aa, Homo Sapiens
TANTQELGP

SEQ ID NO: 368470 - protein, 9 aa, Homo Sapiens
RMGRPEERA

SEQ ID NO: 368471 - protein, 9 aa, Homo Sapiens
TMHLLSTPI

SEQ ID NO: 368472 - protein, 9 aa, Homo Sapiens
ALNVNCVDY

SEQ ID NO: 368473 - protein, 9 aa, Homo Sapiens
QERTVWYLQ

SEQ ID NO: 368474 - protein, 9 aa, Homo Sapiens
GSRGGRNPP

SEQ ID NO: 368475 - protein, 9 aa, Homo Sapiens
SWHMVIGEG

SEQ ID NO: 368476 - protein, 9 aa, Homo Sapiens
DVPKRLTGS

SEQ ID NO: 368477 - protein, 9 aa, Homo Sapiens
SSSSSGYLC

SEQ ID NO: 368478 - protein, 9 aa, Homo Sapiens
QETQHREAR

SEQ ID NO: 368479 - protein, 9 aa, Homo Sapiens
TIIKTLTQR

SEQ ID NO: 368480 - protein, 9 aa, Homo Sapiens
CQNEHLLIK

SEQ ID NO: 368481 - protein, 9 aa, Homo Sapiens
TGRPQHSSP

SEQ ID NO: 368482 - protein, 9 aa, Homo Sapiens
PIDKSMTVG

SEQ ID NO: 368483 - protein, 9 aa, Homo Sapiens
LLLQPSMIQ

SEQ ID NO: 368484 - protein, 9 aa, Homo Sapiens
KFAPFFVPM

SEQ ID NO: 368485 - protein, 9 aa, Homo Sapiens
LTAPRSLQR

SEQ ID NO: 368486 - protein, 9 aa, Homo Sapiens
CSWPQGAPP

SEQ ID NO: 368487 - protein, 9 aa, Homo Sapiens
TQALPLPLS

SEQ ID NO: 368488 - protein, 9 aa, Homo Sapiens
PPSRHVHHE

SEQ ID NO: 368489 - protein, 9 aa, Homo Sapiens
PPPAAPEHK

SEQ ID NO: 368490 - protein, 9 aa, Homo Sapiens
AGKITDMLL

SEQ ID NO: 368491 - protein, 9 aa, Homo Sapiens
AVLAFPDDM

SEQ ID NO: 368492 - protein, 9 aa, Homo Sapiens
TCSMTSTWV

SEQ ID NO: 368493 - protein, 9 aa, Homo Sapiens
RPRVTPGPP

SEQ ID NO: 368494 - protein, 9 aa, Homo Sapiens
LALGHMWTY

SEQ ID NO: 368495 - protein, 9 aa, Homo Sapiens
SSVSPPQAA

SEQ ID NO: 368496 - protein, 9 aa, Homo Sapiens
EILPCGVDR

SEQ ID NO: 368497 - protein, 9 aa, Homo Sapiens
QEPLYQCQR

SEQ ID NO: 368498 - protein, 9 aa, Homo Sapiens
TGERLYRCR

SEQ ID NO: 368499 - protein, 9 aa, Homo Sapiens
VPLMFGSLM

SEQ ID NO: 368500 - protein, 9 aa, Homo Sapiens
ASCLFDIET

SEQ ID NO: 368501 - protein, 9 aa, Homo Sapiens
KRKKKKKLK

SEQ ID NO: 368502 - protein, 9 aa, Homo Sapiens
LPECFRHAP

SEQ ID NO: 368503 - protein, 9 aa, Homo Sapiens
SASPTEGAC

SEQ ID NO: 368504 - protein, 9 aa, Homo Sapiens
QSSTPSLPP

SEQ ID NO: 368505 - protein, 9 aa, Homo Sapiens
KGNGRSGFL

SEQ ID NO: 368506 - protein, 9 aa, Homo Sapiens
TTLVQHRHT

SEQ ID NO: 368507 - protein, 9 aa, Homo Sapiens
PKIVLKLKS

SEQ ID NO: 368508 - protein, 9 aa, Homo Sapiens
FSLHRCNKY

SEQ ID NO: 368509 - protein, 9 aa, Homo Sapiens
WSHRPPSSC

SEQ ID NO: 368510 - protein, 9 aa, Homo Sapiens
EEKRKKLNR

SEQ ID NO: 368511 - protein, 9 aa, Homo Sapiens
RTKQLQERI

SEQ ID NO: 368512 - protein, 9 aa, Homo Sapiens
AAAVAPLAP

SEQ ID NO: 368513 - protein, 9 aa, Homo Sapiens
YQVLNSQEK

SEQ ID NO: 368514 - protein, 9 aa, Homo Sapiens
DGLLAYAFP

SEQ ID NO: 368515 - protein, 9 aa, Homo Sapiens
TNNCQKASR

SEQ ID NO: 368516 - protein, 9 aa, Homo Sapiens
PMLCKVLNS

SEQ ID NO: 368517 - protein, 9 aa, Homo Sapiens
EPLIMDTGG

SEQ ID NO: 368518 - protein, 9 aa, Homo Sapiens
HCPMVVQAR

SEQ ID NO: 368519 - protein, 9 aa, Homo Sapiens
PNFRVGKKL

SEQ ID NO: 368520 - protein, 9 aa, Homo Sapiens
CILQPVFRQ

SEQ ID NO: 368521 - protein, 9 aa, Homo Sapiens
QQEQALEAT

SEQ ID NO: 368522 - protein, 9 aa, Homo Sapiens
LFFGTRPLF

SEQ ID NO: 368523 - protein, 9 aa, Homo Sapiens
SCTTFTRHS

SEQ ID NO: 368524 - protein, 9 aa, Homo Sapiens
SATVCLTAG

SEQ ID NO: 368525 - protein, 9 aa, Homo Sapiens
LILFCVCAV

SEQ ID NO: 368526 - protein, 9 aa, Homo Sapiens
GVIAFVLWC

SEQ ID NO: 368527 - protein, 9 aa, Homo Sapiens
RNLKQKWHL

SEQ ID NO: 368528 - protein, 9 aa, Homo Sapiens
RLISGPHAS

SEQ ID NO: 368529 - protein, 9 aa, Homo Sapiens
TKKRGKSQG

SEQ ID NO: 368530 - protein, 9 aa, Homo Sapiens
HGPHPTVST

SEQ ID NO: 368531 - protein, 9 aa, Homo Sapiens
AGLCGHRTF

SEQ ID NO: 368532 - protein, 9 aa, Homo Sapiens
FGPGISAHQ

SEQ ID NO: 368533 - protein, 9 aa, Homo Sapiens
EASQAEAVA

SEQ ID NO: 368534 - protein, 9 aa, Homo Sapiens
RCNKYGKAF

SEQ ID NO: 368535 - protein, 9 aa, Homo Sapiens
ECDPGGVGE

SEQ ID NO: 368536 - protein, 9 aa, Homo Sapiens
GGASRALFT

SEQ ID NO: 368537 - protein, 9 aa, Homo Sapiens
VPHLGRVCL

SEQ ID NO: 368538 - protein, 9 aa, Homo Sapiens
LTNWMSIWL

SEQ ID NO: 368539 - protein, 9 aa, Homo Sapiens
PRAGAPAEG

SEQ ID NO: 368540 - protein, 9 aa, Homo Sapiens
PAPLHGRVP

SEQ ID NO: 368541 - protein, 9 aa, Homo Sapiens
NQAVCDMED

SEQ ID NO: 368542 - protein, 9 aa, Homo Sapiens
GTSITLSTI

SEQ ID NO: 368543 - protein, 9 aa, Homo Sapiens
EKKTRKHKH

SEQ ID NO: 368544 - protein, 9 aa, Homo Sapiens
WCSVPVESG

SEQ ID NO: 368545 - protein, 9 aa, Homo Sapiens
KLSLKQGKV

SEQ ID NO: 368546 - protein, 9 aa, Homo Sapiens
LLQLKILTP

SEQ ID NO: 368547 - protein, 9 aa, Homo Sapiens
ESLQLKAVV

SEQ ID NO: 368548 - protein, 9 aa, Homo Sapiens
VKVIRVEGL

SEQ ID NO: 368549 - protein, 9 aa, Homo Sapiens
TARADLAAQ

SEQ ID NO: 368550 - protein, 9 aa, Homo Sapiens
RPCRGTARC

SEQ ID NO: 368551 - protein, 9 aa, Homo Sapiens
RWITPTCRS

SEQ ID NO: 368552 - protein, 9 aa, Homo Sapiens
AASLALGRF

SEQ ID NO: 368553 - protein, 9 aa, Homo Sapiens
PAPSRRLSL

SEQ ID NO: 368554 - protein, 9 aa, Homo Sapiens
FSNQEHLKE

SEQ ID NO: 368555 - protein, 9 aa, Homo Sapiens
PRGGHPQPR

SEQ ID NO: 368556 - protein, 9 aa, Homo Sapiens
VPVDIRILA

SEQ ID NO: 368557 - protein, 9 aa, Homo Sapiens
PEGGPWRGQ

SEQ ID NO: 368558 - protein, 9 aa, Homo Sapiens
SHMLEEGDD

SEQ ID NO: 368559 - protein, 9 aa, Homo Sapiens
VFLRCHLTQ

SEQ ID NO: 368560 - protein, 9 aa, Homo Sapiens
AEGKCLSAS

SEQ ID NO: 368561 - protein, 9 aa, Homo Sapiens
EHGQQVGLP

SEQ ID NO: 368562 - protein, 9 aa, Homo Sapiens
PGGPAGSGG

SEQ ID NO: 368563 - protein, 9 aa, Homo Sapiens
AARTCSRLF

SEQ ID NO: 368564 - protein, 9 aa, Homo Sapiens
DHGKSTPTD

SEQ ID NO: 368565 - protein, 9 aa, Homo Sapiens
FDIIISLII

SEQ ID NO: 368566 - protein, 9 aa, Homo Sapiens
KVSRTKSPG

SEQ ID NO: 368567 - protein, 9 aa, Homo Sapiens
RETSVFTLK

SEQ ID NO: 368568 - protein, 9 aa, Homo Sapiens
TVMIITRTL

SEQ ID NO: 368569 - protein, 9 aa, Homo Sapiens
RNVSSASEA

SEQ ID NO: 368570 - protein, 9 aa, Homo Sapiens
SSCRSFRSG

SEQ ID NO: 368571 - protein, 9 aa, Homo Sapiens
TQKLAQQLC

SEQ ID NO: 368572 - protein, 9 aa, Homo Sapiens
NKNRIEEQS

SEQ ID NO: 368573 - protein, 9 aa, Homo Sapiens
PGGLKLSSR

SEQ ID NO: 368574 - protein, 9 aa, Homo Sapiens
KMVVLLLQP

SEQ ID NO: 368575 - protein, 9 aa, Homo Sapiens
TSRRASLWL

SEQ ID NO: 368576 - protein, 9 aa, Homo Sapiens
TLVLDVSSI

SEQ ID NO: 368577 - protein, 9 aa, Homo Sapiens
VRLLPPTQE

SEQ ID NO: 368578 - protein, 9 aa, Homo Sapiens
MFVPAIASA

SEQ ID NO: 368579 - protein, 9 aa, Homo Sapiens
YRFSPLLWE

SEQ ID NO: 368580 - protein, 9 aa, Homo Sapiens
PPYHDTLYF

SEQ ID NO: 368581 - protein, 9 aa, Homo Sapiens
TIHSEDKNK

SEQ ID NO: 368582 - protein, 9 aa, Homo Sapiens
TTVSGGTTS

SEQ ID NO: 368583 - protein, 9 aa, Homo Sapiens
EIDNECDFA

SEQ ID NO: 368584 - protein, 9 aa, Homo Sapiens
PFKKWNYIN

SEQ ID NO: 368585 - protein, 9 aa, Homo Sapiens
WCRHRALEV

SEQ ID NO: 368586 - protein, 9 aa, Homo Sapiens
RVCPKKTTK

SEQ ID NO: 368587 - protein, 9 aa, Homo Sapiens
PGLAREEAG

SEQ ID NO: 368588 - protein, 9 aa, Homo Sapiens
SPGNRGLPL

SEQ ID NO: 368589 - protein, 9 aa, Homo Sapiens
FTHLIGSPF

SEQ ID NO: 368590 - protein, 9 aa, Homo Sapiens
NDFKLELSC

SEQ ID NO: 368591 - protein, 9 aa, Homo Sapiens
WTPRAGSGR

SEQ ID NO: 368592 - protein, 9 aa, Homo Sapiens
GAGAGPRAG

SEQ ID NO: 368593 - protein, 9 aa, Homo Sapiens
RLTEEFPGQ

SEQ ID NO: 368594 - protein, 9 aa, Homo Sapiens
GALEPSGCT

SEQ ID NO: 368595 - protein, 9 aa, Homo Sapiens
LRHRGLVDG

SEQ ID NO: 368596 - protein, 9 aa, Homo Sapiens
VCLPNSKKK

SEQ ID NO: 368597 - protein, 9 aa, Homo Sapiens
KMIHQKLKR

SEQ ID NO: 368598 - protein, 9 aa, Homo Sapiens
CKVMHPKGN

SEQ ID NO: 368599 - protein, 9 aa, Homo Sapiens
INESTPYFI

SEQ ID NO: 368600 - protein, 9 aa, Homo Sapiens
FSRKAVYVV

SEQ ID NO: 368601 - protein, 9 aa, Homo Sapiens
GLFFIAFSS

SEQ ID NO: 368602 - protein, 9 aa, Homo Sapiens
TSLADNKYT

SEQ ID NO: 368603 - protein, 9 aa, Homo Sapiens
TSFCLAPKR

SEQ ID NO: 368604 - protein, 9 aa, Homo Sapiens
LPLQPSRPP

SEQ ID NO: 368605 - protein, 9 aa, Homo Sapiens
TLPPWAVYT

SEQ ID NO: 368606 - protein, 9 aa, Homo Sapiens
LGVTNDQVD

SEQ ID NO: 368607 - protein, 9 aa, Homo Sapiens
PTQQPQTPQ

SEQ ID NO: 368608 - protein, 9 aa, Homo Sapiens
GNVVRNILK

SEQ ID NO: 368609 - protein, 9 aa, Homo Sapiens
IVCTGRHQW

SEQ ID NO: 368610 - protein, 9 aa, Homo Sapiens
LQQHQLITV

SEQ ID NO: 368611 - protein, 9 aa, Homo Sapiens
VKTSESWQA

SEQ ID NO: 368612 - protein, 9 aa, Homo Sapiens
PSPLSRPGS

SEQ ID NO: 368613 - protein, 9 aa, Homo Sapiens
FSPLLWEDR

SEQ ID NO: 368614 - protein, 9 aa, Homo Sapiens
RRRRNPRAK

SEQ ID NO: 368615 - protein, 9 aa, Homo Sapiens
ERRPHKEEE

SEQ ID NO: 368616 - protein, 9 aa, Homo Sapiens
VPMSLACSI

SEQ ID NO: 368617 - protein, 9 aa, Homo Sapiens
NEPSISEHV

SEQ ID NO: 368618 - protein, 9 aa, Homo Sapiens
SSWVVVLMV

SEQ ID NO: 368619 - protein, 9 aa, Homo Sapiens
ELIQWKRQQ

SEQ ID NO: 368620 - protein, 9 aa, Homo Sapiens
CPTHPGPPP

SEQ ID NO: 368621 - protein, 9 aa, Homo Sapiens
ITRTLVRKL

SEQ ID NO: 368622 - protein, 9 aa, Homo Sapiens
VSLMLDPVT

SEQ ID NO: 368623 - protein, 9 aa, Homo Sapiens
RNHENSSPC

SEQ ID NO: 368624 - protein, 9 aa, Homo Sapiens
VGQISTLVL

SEQ ID NO: 368625 - protein, 9 aa, Homo Sapiens
KACISQAMR

SEQ ID NO: 368626 - protein, 9 aa, Homo Sapiens
SFLLHKKAI

SEQ ID NO: 368627 - protein, 9 aa, Homo Sapiens
ARTCSRLFG

SEQ ID NO: 368628 - protein, 9 aa, Homo Sapiens
VVMTYWTTF

SEQ ID NO: 368629 - protein, 9 aa, Homo Sapiens
PQVHKIGVF

SEQ ID NO: 368630 - protein, 9 aa, Homo Sapiens
ITLNNSIYW

SEQ ID NO: 368631 - protein, 9 aa, Homo Sapiens
PSCRCYIRR

SEQ ID NO: 368632 - protein, 9 aa, Homo Sapiens
RIWQGCSAK

SEQ ID NO: 368633 - protein, 9 aa, Homo Sapiens
EHLDIREAA

SEQ ID NO: 368634 - protein, 9 aa, Homo Sapiens
CSRGARGAK

SEQ ID NO: 368635 - protein, 9 aa, Homo Sapiens
AQDLPIVPL

SEQ ID NO: 368636 - protein, 9 aa, Homo Sapiens
STPSLPPCS

SEQ ID NO: 368637 - protein, 9 aa, Homo Sapiens
LSTKYSVYL

SEQ ID NO: 368638 - protein, 9 aa, Homo Sapiens
KGEEGSATP

SEQ ID NO: 368639 - protein, 9 aa, Homo Sapiens
VHPQVHKIG

SEQ ID NO: 368640 - protein, 9 aa, Homo Sapiens
GGKTIECIS

SEQ ID NO: 368641 - protein, 9 aa, Homo Sapiens
RFSPLLWED

SEQ ID NO: 368642 - protein, 9 aa, Homo Sapiens
PASRWNPLR

SEQ ID NO: 368643 - protein, 9 aa, Homo Sapiens
TWLDPDPAN

SEQ ID NO: 368644 - protein, 9 aa, Homo Sapiens
ALPDDICRE

SEQ ID NO: 368645 - protein, 9 aa, Homo Sapiens
GNRGLPLPP

SEQ ID NO: 368646 - protein, 9 aa, Homo Sapiens
LASCSRGAR

SEQ ID NO: 368647 - protein, 9 aa, Homo Sapiens
RSLQRSPAL

SEQ ID NO: 368648 - protein, 9 aa, Homo Sapiens
THQYKYEVG

SEQ ID NO: 368649 - protein, 9 aa, Homo Sapiens
TCARRTPTD

SEQ ID NO: 368650 - protein, 9 aa, Homo Sapiens
WEMECTDIT

SEQ ID NO: 368651 - protein, 9 aa, Homo Sapiens
YQRDTQQLR

SEQ ID NO: 368652 - protein, 9 aa, Homo Sapiens
GPPPCRPRV

SEQ ID NO: 368653 - protein, 9 aa, Homo Sapiens
GQGGDAAAG

SEQ ID NO: 368654 - protein, 9 aa, Homo Sapiens
TPPCLRLRR

SEQ ID NO: 368655 - protein, 9 aa, Homo Sapiens
DRRSMGEGG

SEQ ID NO: 368656 - protein, 9 aa, Homo Sapiens
TSLLQTQEL

SEQ ID NO: 368657 - protein, 9 aa, Homo Sapiens
CSVLGRIQG

SEQ ID NO: 368658 - protein, 9 aa, Homo Sapiens
PWGMKFRLQ

SEQ ID NO: 368659 - protein, 9 aa, Homo Sapiens
QRRTFLEAW

SEQ ID NO: 368660 - protein, 9 aa, Homo Sapiens
RHSHFFLPV

SEQ ID NO: 368661 - protein, 9 aa, Homo Sapiens
DKKNGIWEV

SEQ ID NO: 368662 - protein, 9 aa, Homo Sapiens
GCRLGPCIG

SEQ ID NO: 368663 - protein, 9 aa, Homo Sapiens
SSDGSSDSS

SEQ ID NO: 368664 - protein, 9 aa, Homo Sapiens
PTVSTGRPQ

SEQ ID NO: 368665 - protein, 9 aa, Homo Sapiens
AWLLALPGL

SEQ ID NO: 368666 - protein, 9 aa, Homo Sapiens
TQQPQTPQD

SEQ ID NO: 368667 - protein, 9 aa, Homo Sapiens
TPYMHTLAA

SEQ ID NO: 368668 - protein, 9 aa, Homo Sapiens
LANLTFLDI

SEQ ID NO: 368669 - protein, 9 aa, Homo Sapiens
TAGAGVPFS

SEQ ID NO: 368670 - protein, 9 aa, Homo Sapiens
NGEARPARA

SEQ ID NO: 368671 - protein, 9 aa, Homo Sapiens
SQNHSKCIT

SEQ ID NO: 368672 - protein, 9 aa, Homo Sapiens
IDMPTIYQK

SEQ ID NO: 368673 - protein, 9 aa, Homo Sapiens
QRSPALRAR

SEQ ID NO: 368674 - protein, 9 aa, Homo Sapiens
EDYGLVKMH

SEQ ID NO: 368675 - protein, 9 aa, Homo Sapiens
AGWCMPGLP

SEQ ID NO: 368676 - protein, 9 aa, Homo Sapiens
QSIVCTGRH

SEQ ID NO: 368677 - protein, 9 aa, Homo Sapiens
QLRLNPRRS

SEQ ID NO: 368678 - protein, 9 aa, Homo Sapiens
AKPGAPPPA

SEQ ID NO: 368679 - protein, 9 aa, Homo Sapiens
LATTDDIRA

SEQ ID NO: 368680 - protein, 9 aa, Homo Sapiens
KVMFGNYRN

SEQ ID NO: 368681 - protein, 9 aa, Homo Sapiens
STLTIFRFC

SEQ ID NO: 368682 - protein, 9 aa, Homo Sapiens
GTSSVLLRA

SEQ ID NO: 368683 - protein, 9 aa, Homo Sapiens
HFQHVKRGW

SEQ ID NO: 368684 - protein, 9 aa, Homo Sapiens
PRWTAMGGQ

SEQ ID NO: 368685 - protein, 9 aa, Homo Sapiens
GDGSTCPCR

SEQ ID NO: 368686 - protein, 9 aa, Homo Sapiens
EQCLRVLDG

SEQ ID NO: 368687 - protein, 9 aa, Homo Sapiens
RIPSASRCQ

SEQ ID NO: 368688 - protein, 9 aa, Homo Sapiens
PDCIMNTFS

SEQ ID NO: 368689 - protein, 9 aa, Homo Sapiens
LLWLLGSRM

SEQ ID NO: 368690 - protein, 9 aa, Homo Sapiens
SIKSSLDGE

SEQ ID NO: 368691 - protein, 9 aa, Homo Sapiens
TPEALAAED

SEQ ID NO: 368692 - protein, 9 aa, Homo Sapiens
KLLAACSQQ

SEQ ID NO: 368693 - protein, 9 aa, Homo Sapiens
GPSGTSRTR

SEQ ID NO: 368694 - protein, 9 aa, Homo Sapiens
GAAFSWLLN

SEQ ID NO: 368695 - protein, 9 aa, Homo Sapiens
VEIKGIQVC

SEQ ID NO: 368696 - protein, 9 aa, Homo Sapiens
TSITSVTLR

SEQ ID NO: 368697 - protein, 9 aa, Homo Sapiens
MLDPVTPYR

SEQ ID NO: 368698 - protein, 9 aa, Homo Sapiens
PCPPQSTSN

SEQ ID NO: 368699 - protein, 9 aa, Homo Sapiens
TSESWQAQL

SEQ ID NO: 368700 - protein, 9 aa, Homo Sapiens
SRCQKAFST

SEQ ID NO: 368701 - protein, 9 aa, Homo Sapiens
SIDKILELL

SEQ ID NO: 368702 - protein, 9 aa, Homo Sapiens
RGNGGDGCR

SEQ ID NO: 368703 - protein, 9 aa, Homo Sapiens
NHPPMPDKD

SEQ ID NO: 368704 - protein, 9 aa, Homo Sapiens
SPEEGAHVY

SEQ ID NO: 368705 - protein, 9 aa, Homo Sapiens
NPLMFVPAI

SEQ ID NO: 368706 - protein, 9 aa, Homo Sapiens
RTMKSHQAV

SEQ ID NO: 368707 - protein, 9 aa, Homo Sapiens
WPQRLLWQT

SEQ ID NO: 368708 - protein, 9 aa, Homo Sapiens
GGVAAGDQG

SEQ ID NO: 368709 - protein, 9 aa, Homo Sapiens
CLTAGTSSK

SEQ ID NO: 368710 - protein, 9 aa, Homo Sapiens
WVIENPAVF

SEQ ID NO: 368711 - protein, 9 aa, Homo Sapiens
ARRTNGASQ

SEQ ID NO: 368712 - protein, 9 aa, Homo Sapiens
NPVAAPTDD

SEQ ID NO: 368713 - protein, 9 aa, Homo Sapiens
KSIDDTLST

SEQ ID NO: 368714 - protein, 9 aa, Homo Sapiens
LATVLLQSA

SEQ ID NO: 368715 - protein, 9 aa, Homo Sapiens
LAMLGCSII

SEQ ID NO: 368716 - protein, 9 aa, Homo Sapiens
IEVQLLDDN

SEQ ID NO: 368717 - protein, 9 aa, Homo Sapiens
GVSLNLTQK

SEQ ID NO: 368718 - protein, 9 aa, Homo Sapiens
LSPLIRAPG

SEQ ID NO: 368719 - protein, 9 aa, Homo Sapiens
SLHRCNKYG

SEQ ID NO: 368720 - protein, 9 aa, Homo Sapiens
VVRNTVQRS

SEQ ID NO: 368721 - protein, 9 aa, Homo Sapiens
SQQFPGQPA

SEQ ID NO: 368722 - protein, 9 aa, Homo Sapiens
SRPPPGSSA

SEQ ID NO: 368723 - protein, 9 aa, Homo Sapiens
VHAKKNTAF

SEQ ID NO: 368724 - protein, 9 aa, Homo Sapiens
NEVSAQMEI

SEQ ID NO: 368725 - protein, 9 aa, Homo Sapiens
LIVGCGMSS

SEQ ID NO: 368726 - protein, 9 aa, Homo Sapiens
SNASLLGGG

SEQ ID NO: 368727 - protein, 9 aa, Homo Sapiens
ILIRDEIYG

SEQ ID NO: 368728 - protein, 9 aa, Homo Sapiens
CRAVASGMA

SEQ ID NO: 368729 - protein, 9 aa, Homo Sapiens
LQPSRPPTV

SEQ ID NO: 368730 - protein, 9 aa, Homo Sapiens
EPEVPPRPA

SEQ ID NO: 368731 - protein, 9 aa, Homo Sapiens
VVAVFEGRF

SEQ ID NO: 368732 - protein, 9 aa, Homo Sapiens
ISLDHYLAI

SEQ ID NO: 368733 - protein, 9 aa, Homo Sapiens
SAPIKLLPG

SEQ ID NO: 368734 - protein, 9 aa, Homo Sapiens
ASNYTGCCH

SEQ ID NO: 368735 - protein, 9 aa, Homo Sapiens
SPGVVTDLF

SEQ ID NO: 368736 - protein, 9 aa, Homo Sapiens
VMFGNYRNL

SEQ ID NO: 368737 - protein, 9 aa, Homo Sapiens
KLFNLKMSL

SEQ ID NO: 368738 - protein, 9 aa, Homo Sapiens
LKQVSPASP

SEQ ID NO: 368739 - protein, 9 aa, Homo Sapiens
ARAHLAVEA

SEQ ID NO: 368740 - protein, 9 aa, Homo Sapiens
RSRHQQSAD

SEQ ID NO: 368741 - protein, 9 aa, Homo Sapiens
RSCPTLRAC

SEQ ID NO: 368742 - protein, 9 aa, Homo Sapiens
CQKSLLSLL

SEQ ID NO: 368743 - protein, 9 aa, Homo Sapiens
QPQTPQDSR

SEQ ID NO: 368744 - protein, 9 aa, Homo Sapiens
KMVTPAKKH

SEQ ID NO: 368745 - protein, 9 aa, Homo Sapiens
GHVSGPWRP

SEQ ID NO: 368746 - protein, 9 aa, Homo Sapiens
TQINFTMAI

SEQ ID NO: 368747 - protein, 9 aa, Homo Sapiens
LSPTRWTTN

SEQ ID NO: 368748 - protein, 9 aa, Homo Sapiens
KKNTAFTKL

SEQ ID NO: 368749 - protein, 9 aa, Homo Sapiens
LNLQNIGCS

SEQ ID NO: 368750 - protein, 9 aa, Homo Sapiens
KTFSRMSSL

SEQ ID NO: 368751 - protein, 9 aa, Homo Sapiens
EQKELQRRL

SEQ ID NO: 368752 - protein, 9 aa, Homo Sapiens
SAIHLHVSR

SEQ ID NO: 368753 - protein, 9 aa, Homo Sapiens
LVKMHEIFI

SEQ ID NO: 368754 - protein, 9 aa, Homo Sapiens
CSAPIKLLP

SEQ ID NO: 368755 - protein, 9 aa, Homo Sapiens
PLVVELGHD

SEQ ID NO: 368756 - protein, 9 aa, Homo Sapiens
AIRRLARHG

SEQ ID NO: 368757 - protein, 9 aa, Homo Sapiens
STPPCLRLR

SEQ ID NO: 368758 - protein, 9 aa, Homo Sapiens
DYVPPKDLS

SEQ ID NO: 368759 - protein, 9 aa, Homo Sapiens
PYWMVGSPQ

SEQ ID NO: 368760 - protein, 9 aa, Homo Sapiens
PREPGKRRC

SEQ ID NO: 368761 - protein, 9 aa, Homo Sapiens
HDGARGPVG

SEQ ID NO: 368762 - protein, 9 aa, Homo Sapiens
GKLSTVCRA

SEQ ID NO: 368763 - protein, 9 aa, Homo Sapiens
TIVAGSTVG

SEQ ID NO: 368764 - protein, 9 aa, Homo Sapiens
AVNPEKIQL

SEQ ID NO: 368765 - protein, 9 aa, Homo Sapiens
GGQQCYCLI

SEQ ID NO: 368766 - protein, 9 aa, Homo Sapiens
SHLRACKGH

SEQ ID NO: 368767 - protein, 9 aa, Homo Sapiens
FGSSWHMVI

SEQ ID NO: 368768 - protein, 9 aa, Homo Sapiens
VSQQVSCLE

SEQ ID NO: 368769 - protein, 9 aa, Homo Sapiens
TQILHRVPK

SEQ ID NO: 368770 - protein, 9 aa, Homo Sapiens
PRPLPCPAA

SEQ ID NO: 368771 - protein, 9 aa, Homo Sapiens
DILRHRGLV

SEQ ID NO: 368772 - protein, 9 aa, Homo Sapiens
KMDFGFVEI

SEQ ID NO: 368773 - protein, 9 aa, Homo Sapiens
VPVACPDDQ

SEQ ID NO: 368774 - protein, 9 aa, Homo Sapiens
PCRWTAPSS

SEQ ID NO: 368775 - protein, 9 aa, Homo Sapiens
PDPSKSAPV

SEQ ID NO: 368776 - protein, 9 aa, Homo Sapiens
PEAEGSFLL

SEQ ID NO: 368777 - protein, 9 aa, Homo Sapiens
MITLNNSIY

SEQ ID NO: 368778 - protein, 9 aa, Homo Sapiens
TLHTTLARE

SEQ ID NO: 368779 - protein, 9 aa, Homo Sapiens
TIGSIMGSW

SEQ ID NO: 368780 - protein, 9 aa, Homo Sapiens
GFTGFGKKL

SEQ ID NO: 368781 - protein, 9 aa, Homo Sapiens
TKIFVGGCP

SEQ ID NO: 368782 - protein, 9 aa, Homo Sapiens
PFFVSRAPK

SEQ ID NO: 368783 - protein, 9 aa, Homo Sapiens
ADFSHYEYL

SEQ ID NO: 368784 - protein, 9 aa, Homo Sapiens
IKKITSERD

SEQ ID NO: 368785 - protein, 9 aa, Homo Sapiens
AAVTAPPSA

SEQ ID NO: 368786 - protein, 9 aa, Homo Sapiens
PAGSGGACS

SEQ ID NO: 368787 - protein, 9 aa, Homo Sapiens
PELSPTYLI

SEQ ID NO: 368788 - protein, 9 aa, Homo Sapiens
PWLSEGEHM

SEQ ID NO: 368789 - protein, 9 aa, Homo Sapiens
DVAILENYD

SEQ ID NO: 368790 - protein, 9 aa, Homo Sapiens
DKMIHQKLK

SEQ ID NO: 368791 - protein, 9 aa, Homo Sapiens
TSEGASEEN

SEQ ID NO: 368792 - protein, 9 aa, Homo Sapiens
CGIVSTSSH

SEQ ID NO: 368793 - protein, 9 aa, Homo Sapiens
SNAENKHIL

SEQ ID NO: 368794 - protein, 9 aa, Homo Sapiens
LHTTLARET

SEQ ID NO: 368795 - protein, 9 aa, Homo Sapiens
IYVCVISYA

SEQ ID NO: 368796 - protein, 9 aa, Homo Sapiens
WLKGVLSPR

SEQ ID NO: 368797 - protein, 9 aa, Homo Sapiens
FRLQLPIDW

SEQ ID NO: 368798 - protein, 9 aa, Homo Sapiens
GCISVKDHR

SEQ ID NO: 368799 - protein, 9 aa, Homo Sapiens
AGSVQLHYS

SEQ ID NO: 368800 - protein, 9 aa, Homo Sapiens
GNIVIQKKN

SEQ ID NO: 368801 - protein, 9 aa, Homo Sapiens
FYGFTIMRD

SEQ ID NO: 368802 - protein, 9 aa, Homo Sapiens
QKKLSIKLH

SEQ ID NO: 368803 - protein, 9 aa, Homo Sapiens
GGSWRSPTS

SEQ ID NO: 368804 - protein, 9 aa, Homo Sapiens
GSGRAAAAH

SEQ ID NO: 368805 - protein, 9 aa, Homo Sapiens
QHFYIIGQP

SEQ ID NO: 368806 - protein, 9 aa, Homo Sapiens
ASPGNRGLP

SEQ ID NO: 368807 - protein, 9 aa, Homo Sapiens
NCYNRGQCV

SEQ ID NO: 368808 - protein, 9 aa, Homo Sapiens
QQKIFDIRE

SEQ ID NO: 368809 - protein, 9 aa, Homo Sapiens
SSRLSLPSS

SEQ ID NO: 368810 - protein, 9 aa, Homo Sapiens
LLLALVTAV

SEQ ID NO: 368811 - protein, 9 aa, Homo Sapiens
DLTQVVAVF

SEQ ID NO: 368812 - protein, 9 aa, Homo Sapiens
KQPLVSSRD

SEQ ID NO: 368813 - protein, 9 aa, Homo Sapiens
EAGQLRERV

SEQ ID NO: 368814 - protein, 9 aa, Homo Sapiens
AQTVFWGQE

SEQ ID NO: 368815 - protein, 9 aa, Homo Sapiens
LIMDTGGLF

SEQ ID NO: 368816 - protein, 9 aa, Homo Sapiens
NITNNILFP

SEQ ID NO: 368817 - protein, 9 aa, Homo Sapiens
GGPAGSGGA

SEQ ID NO: 368818 - protein, 9 aa, Homo Sapiens
SDSQEDKKI

SEQ ID NO: 368819 - protein, 9 aa, Homo Sapiens
GIQNNRNVS

SEQ ID NO: 368820 - protein, 9 aa, Homo Sapiens
RARCLLDRS

SEQ ID NO: 368821 - protein, 9 aa, Homo Sapiens
KILELLDVD

SEQ ID NO: 368822 - protein, 9 aa, Homo Sapiens
RGSRSRPQE

SEQ ID NO: 368823 - protein, 9 aa, Homo Sapiens
SKWTRMLRA

SEQ ID NO: 368824 - protein, 9 aa, Homo Sapiens
VTVSRPTPV

SEQ ID NO: 368825 - protein, 9 aa, Homo Sapiens
TRFAFSTRL

SEQ ID NO: 368826 - protein, 9 aa, Homo Sapiens
EKSRWSGSH

SEQ ID NO: 368827 - protein, 9 aa, Homo Sapiens
SPGSMVISY

SEQ ID NO: 368828 - protein, 9 aa, Homo Sapiens
EFNQFAEWK

SEQ ID NO: 368829 - protein, 9 aa, Homo Sapiens
KDKNRWEGP

SEQ ID NO: 368830 - protein, 9 aa, Homo Sapiens
NLHPDVARG

SEQ ID NO: 368831 - protein, 9 aa, Homo Sapiens
TKQVIHTVE

SEQ ID NO: 368832 - protein, 9 aa, Homo Sapiens
QSNVEHLME

SEQ ID NO: 368833 - protein, 9 aa, Homo Sapiens
VVWDRPFQR

SEQ ID NO: 368834 - protein, 9 aa, Homo Sapiens
KGKKRRGKS

SEQ ID NO: 368835 - protein, 9 aa, Homo Sapiens
LCGIVSTSS

SEQ ID NO: 368836 - protein, 9 aa, Homo Sapiens
KELNKQLTA

SEQ ID NO: 368837 - protein, 9 aa, Homo Sapiens
CVLLSQCRL

SEQ ID NO: 368838 - protein, 9 aa, Homo Sapiens
KPPCLTRMR

SEQ ID NO: 368839 - protein, 9 aa, Homo Sapiens
QDGIGSEAE

SEQ ID NO: 368840 - protein, 9 aa, Homo Sapiens
KGPQEVAVH

SEQ ID NO: 368841 - protein, 9 aa, Homo Sapiens
MEKLREKQS

SEQ ID NO: 368842 - protein, 9 aa, Homo Sapiens
IAWVRIYRP

SEQ ID NO: 368843 - protein, 9 aa, Homo Sapiens
DYTHALLHH

SEQ ID NO: 368844 - protein, 9 aa, Homo Sapiens
HRCNKYGKA

SEQ ID NO: 368845 - protein, 9 aa, Homo Sapiens
FAQDLPIVP

SEQ ID NO: 368846 - protein, 9 aa, Homo Sapiens
PQTRMLHLQ

SEQ ID NO: 368847 - protein, 9 aa, Homo Sapiens
LILLWLLGS

SEQ ID NO: 368848 - protein, 9 aa, Homo Sapiens
CLGCQHCVQ

SEQ ID NO: 368849 - protein, 9 aa, Homo Sapiens
SCCCQYEMG

SEQ ID NO: 368850 - protein, 9 aa, Homo Sapiens
EFVNIYTYL

SEQ ID NO: 368851 - protein, 9 aa, Homo Sapiens
LQPVFRQET

SEQ ID NO: 368852 - protein, 9 aa, Homo Sapiens
KSFYMHRNN

SEQ ID NO: 368853 - protein, 9 aa, Homo Sapiens
ISAHQLKTR

SEQ ID NO: 368854 - protein, 9 aa, Homo Sapiens
LWGTRGGAP

SEQ ID NO: 368855 - protein, 9 aa, Homo Sapiens
TGIFGNVGS

SEQ ID NO: 368856 - protein, 9 aa, Homo Sapiens
AGGTRLTTV

SEQ ID NO: 368857 - protein, 9 aa, Homo Sapiens
EGAAFSWLL

SEQ ID NO: 368858 - protein, 9 aa, Homo Sapiens
EPNVVSVSA

SEQ ID NO: 368859 - protein, 9 aa, Homo Sapiens
GPRGSRSQG

SEQ ID NO: 368860 - protein, 9 aa, Homo Sapiens
PGPTTDAVW

SEQ ID NO: 368861 - protein, 9 aa, Homo Sapiens
LIGMEGGNA

SEQ ID NO: 368862 - protein, 9 aa, Homo Sapiens
GTTSSSGTS

SEQ ID NO: 368863 - protein, 9 aa, Homo Sapiens
KSKGKKRRG

SEQ ID NO: 368864 - protein, 9 aa, Homo Sapiens
LTHKSPIEC

SEQ ID NO: 368865 - protein, 9 aa, Homo Sapiens
APPSHREAW

SEQ ID NO: 368866 - protein, 9 aa, Homo Sapiens
GEHMVDVVV

SEQ ID NO: 368867 - protein, 9 aa, Homo Sapiens
CTPRGWHCD

SEQ ID NO: 368868 - protein, 9 aa, Homo Sapiens
NGASQTTDA

SEQ ID NO: 368869 - protein, 9 aa, Homo Sapiens
GAALGQAAD

SEQ ID NO: 368870 - protein, 9 aa, Homo Sapiens
LLSEAAAED

SEQ ID NO: 368871 - protein, 9 aa, Homo Sapiens
HPQVHKIGV

SEQ ID NO: 368872 - protein, 9 aa, Homo Sapiens
ALRGPPRQR

SEQ ID NO: 368873 - protein, 9 aa, Homo Sapiens
QRHELVPAL

SEQ ID NO: 368874 - protein, 9 aa, Homo Sapiens
PRPPALSLR

SEQ ID NO: 368875 - protein, 9 aa, Homo Sapiens
DPKALKGIH

SEQ ID NO: 368876 - protein, 9 aa, Homo Sapiens
TCHRYLNIA

SEQ ID NO: 368877 - protein, 9 aa, Homo Sapiens
PVYDLLEKG

SEQ ID NO: 368878 - protein, 9 aa, Homo Sapiens
SISEEEMCE

SEQ ID NO: 368879 - protein, 9 aa, Homo Sapiens
LSPIRDMKV

SEQ ID NO: 368880 - protein, 9 aa, Homo Sapiens
RPTPVTKAM

SEQ ID NO: 368881 - protein, 9 aa, Homo Sapiens
ETSNFGFSR

SEQ ID NO: 368882 - protein, 9 aa, Homo Sapiens
NGIWEVMPR

SEQ ID NO: 368883 - protein, 9 aa, Homo Sapiens
GPPRQRAAA

SEQ ID NO: 368884 - protein, 9 aa, Homo Sapiens
ASAPTRWQG

SEQ ID NO: 368885 - protein, 9 aa, Homo Sapiens
WVEEKQPLV

SEQ ID NO: 368886 - protein, 9 aa, Homo Sapiens
TITNCRGNL

SEQ ID NO: 368887 - protein, 9 aa, Homo Sapiens
RGGRGYGGT

SEQ ID NO: 368888 - protein, 9 aa, Homo Sapiens
LLDVDTLIL

SEQ ID NO: 368889 - protein, 9 aa, Homo Sapiens
NVVHQVQTS

SEQ ID NO: 368890 - protein, 9 aa, Homo Sapiens
ARAPWRTST

SEQ ID NO: 368891 - protein, 9 aa, Homo Sapiens
YGIGYKQVF

SEQ ID NO: 368892 - protein, 9 aa, Homo Sapiens
LVKGVLERY

SEQ ID NO: 368893 - protein, 9 aa, Homo Sapiens
TERTENREE

SEQ ID NO: 368894 - protein, 9 aa, Homo Sapiens
LKMNSSKCS

SEQ ID NO: 368895 - protein, 9 aa, Homo Sapiens
WKGRYYSVN

SEQ ID NO: 368896 - protein, 9 aa, Homo Sapiens
RPITPRLSP

SEQ ID NO: 368897 - protein, 9 aa, Homo Sapiens
PAEGARARA

SEQ ID NO: 368898 - protein, 9 aa, Homo Sapiens
PQSAKSPTV

SEQ ID NO: 368899 - protein, 9 aa, Homo Sapiens
TSLASCSRG

SEQ ID NO: 368900 - protein, 9 aa, Homo Sapiens
RGGVGAQAP

SEQ ID NO: 368901 - protein, 9 aa, Homo Sapiens
QFPMVPGET

SEQ ID NO: 368902 - protein, 9 aa, Homo Sapiens
RRTDEDRQE

SEQ ID NO: 368903 - protein, 9 aa, Homo Sapiens
SSPTRSSPP

SEQ ID NO: 368904 - protein, 9 aa, Homo Sapiens
AGTSSKITW

SEQ ID NO: 368905 - protein, 9 aa, Homo Sapiens
YREDPRIHQ

SEQ ID NO: 368906 - protein, 9 aa, Homo Sapiens
LCCWKRGSR

SEQ ID NO: 368907 - protein, 9 aa, Homo Sapiens
VTNGVLVSQ

SEQ ID NO: 368908 - protein, 9 aa, Homo Sapiens
TLYFPVLIV

SEQ ID NO: 368909 - protein, 9 aa, Homo Sapiens
ASRWNPLRR

SEQ ID NO: 368910 - protein, 9 aa, Homo Sapiens
TVGTWRILP

SEQ ID NO: 368911 - protein, 9 aa, Homo Sapiens
ISRDIQEQN

SEQ ID NO: 368912 - protein, 9 aa, Homo Sapiens
ARGSSGSGR

SEQ ID NO: 368913 - protein, 9 aa, Homo Sapiens
AAAHGDGST

SEQ ID NO: 368914 - protein, 9 aa, Homo Sapiens
TNIFESFMP

SEQ ID NO: 368915 - protein, 9 aa, Homo Sapiens
DLGTKRENK

SEQ ID NO: 368916 - protein, 9 aa, Homo Sapiens
CSPHSSVHS

SEQ ID NO: 368917 - protein, 9 aa, Homo Sapiens
TLHHELIST

SEQ ID NO: 368918 - protein, 9 aa, Homo Sapiens
RKDLTPPRP

SEQ ID NO: 368919 - protein, 9 aa, Homo Sapiens
STLVLDVSS

SEQ ID NO: 368920 - protein, 9 aa, Homo Sapiens
VRPCASFDC

SEQ ID NO: 368921 - protein, 9 aa, Homo Sapiens
PNGATSSTN

SEQ ID NO: 368922 - protein, 9 aa, Homo Sapiens
SAKPGAPPP

SEQ ID NO: 368923 - protein, 9 aa, Homo Sapiens
GARGSSGSG

SEQ ID NO: 368924 - protein, 9 aa, Homo Sapiens
AAELPHECD

SEQ ID NO: 368925 - protein, 9 aa, Homo Sapiens
DEDRQEIRQ

SEQ ID NO: 368926 - protein, 9 aa, Homo Sapiens
LYRCRECGK

SEQ ID NO: 368927 - protein, 9 aa, Homo Sapiens
AALGQAADG

SEQ ID NO: 368928 - protein, 9 aa, Homo Sapiens
GGCPTTPPT

SEQ ID NO: 368929 - protein, 9 aa, Homo Sapiens
VLCLRLWLC

SEQ ID NO: 368930 - protein, 9 aa, Homo Sapiens
PPAHPRPPA

SEQ ID NO: 368931 - protein, 9 aa, Homo Sapiens
LDADCVTCL

SEQ ID NO: 368932 - protein, 9 aa, Homo Sapiens
CKEAINVLS

SEQ ID NO: 368933 - protein, 9 aa, Homo Sapiens
ASSSTSRDS

SEQ ID NO: 368934 - protein, 9 aa, Homo Sapiens
LSLSRIKKV

SEQ ID NO: 368935 - protein, 9 aa, Homo Sapiens
GHREWVHMV

SEQ ID NO: 368936 - protein, 9 aa, Homo Sapiens
EVHPQVHKI

SEQ ID NO: 368937 - protein, 9 aa, Homo Sapiens
VSHFSDLDQ

SEQ ID NO: 368938 - protein, 9 aa, Homo Sapiens
KQGGKVDIH

SEQ ID NO: 368939 - protein, 9 aa, Homo Sapiens
VSEQRLWHG

SEQ ID NO: 368940 - protein, 9 aa, Homo Sapiens
RPLVVELGH

SEQ ID NO: 368941 - protein, 9 aa, Homo Sapiens
EPRDHNEPS

SEQ ID NO: 368942 - protein, 9 aa, Homo Sapiens
PLMFGSLMV

SEQ ID NO: 368943 - protein, 9 aa, Homo Sapiens
KCYEPVPAD

SEQ ID NO: 368944 - protein, 9 aa, Homo Sapiens
YNNQPTMET

SEQ ID NO: 368945 - protein, 9 aa, Homo Sapiens
KFIVQINPT

SEQ ID NO: 368946 - protein, 9 aa, Homo Sapiens
PGKPPTSPA

SEQ ID NO: 368947 - protein, 9 aa, Homo Sapiens
QFYQPPRAQ

SEQ ID NO: 368948 - protein, 9 aa, Homo Sapiens
DGCRGNGGQ

SEQ ID NO: 368949 - protein, 9 aa, Homo Sapiens
VTIIVSATS

SEQ ID NO: 368950 - protein, 9 aa, Homo Sapiens
MHPKGNGRS

SEQ ID NO: 368951 - protein, 9 aa, Homo Sapiens
KRKTAEKRI

SEQ ID NO: 368952 - protein, 9 aa, Homo Sapiens
SEFYSLQEQ

SEQ ID NO: 368953 - protein, 9 aa, Homo Sapiens
EVPHAQRHE

SEQ ID NO: 368954 - protein, 9 aa, Homo Sapiens
PLTIGEKTE

SEQ ID NO: 368955 - protein, 9 aa, Homo Sapiens
KLKLKLPEK

SEQ ID NO: 368956 - protein, 9 aa, Homo Sapiens
ACASTSRSS

SEQ ID NO: 368957 - protein, 9 aa, Homo Sapiens
EGWVEEKQP

SEQ ID NO: 368958 - protein, 9 aa, Homo Sapiens
TKEFSTYAD

SEQ ID NO: 368959 - protein, 9 aa, Homo Sapiens
MDKKRYLCL

SEQ ID NO: 368960 - protein, 9 aa, Homo Sapiens
WGMEALGSW

SEQ ID NO: 368961 - protein, 9 aa, Homo Sapiens
GFQTFVTTQ

SEQ ID NO: 368962 - protein, 9 aa, Homo Sapiens
QQCIRNERE

SEQ ID NO: 368963 - protein, 9 aa, Homo Sapiens
ENECLGNYP

SEQ ID NO: 368964 - protein, 9 aa, Homo Sapiens
RVQVDAAEL

SEQ ID NO: 368965 - protein, 9 aa, Homo Sapiens
CTPASSQCP

SEQ ID NO: 368966 - protein, 9 aa, Homo Sapiens
APRSLQRSS

SEQ ID NO: 368967 - protein, 9 aa, Homo Sapiens
VHDSMDNDC

SEQ ID NO: 368968 - protein, 9 aa, Homo Sapiens
ADVHSRASW

SEQ ID NO: 368969 - protein, 9 aa, Homo Sapiens
TNVGKVKIN

SEQ ID NO: 368970 - protein, 9 aa, Homo Sapiens
RNPAGLCGH

SEQ ID NO: 368971 - protein, 9 aa, Homo Sapiens
SKKKSYRLV

SEQ ID NO: 368972 - protein, 9 aa, Homo Sapiens
VLVSQQVSC

SEQ ID NO: 368973 - protein, 9 aa, Homo Sapiens
ATVCLTAGT

SEQ ID NO: 368974 - protein, 9 aa, Homo Sapiens
GGLDGAWLL

SEQ ID NO: 368975 - protein, 9 aa, Homo Sapiens
FQSERKNQA

SEQ ID NO: 368976 - protein, 9 aa, Homo Sapiens
CFPPVPQQQ

SEQ ID NO: 368977 - protein, 9 aa, Homo Sapiens
LTTEKGEAE

SEQ ID NO: 368978 - protein, 9 aa, Homo Sapiens
LESPALKQV

SEQ ID NO: 368979 - protein, 9 aa, Homo Sapiens
WSAGYEERR

SEQ ID NO: 368980 - protein, 9 aa, Homo Sapiens
PVGPGQQAL

SEQ ID NO: 368981 - protein, 9 aa, Homo Sapiens
LDPDPANAP

SEQ ID NO: 368982 - protein, 9 aa, Homo Sapiens
NVNVHVIRL

SEQ ID NO: 368983 - protein, 9 aa, Homo Sapiens
VRASSVASQ

SEQ ID NO: 368984 - protein, 9 aa, Homo Sapiens
NWMSIWLYT

SEQ ID NO: 368985 - protein, 9 aa, Homo Sapiens
SLCWNLSLE

SEQ ID NO: 368986 - protein, 9 aa, Homo Sapiens
TCAQCGKDF

SEQ ID NO: 368987 - protein, 9 aa, Homo Sapiens
PTKKRGKSQ

SEQ ID NO: 368988 - protein, 9 aa, Homo Sapiens
AVEDVAGLG

SEQ ID NO: 368989 - protein, 9 aa, Homo Sapiens
TMPQQGWNA

SEQ ID NO: 368990 - protein, 9 aa, Homo Sapiens
PPPAHPRPP

SEQ ID NO: 368991 - protein, 9 aa, Homo Sapiens
DHRIRQALF

SEQ ID NO: 368992 - protein, 9 aa, Homo Sapiens
QGLLLGGGQ

SEQ ID NO: 368993 - protein, 9 aa, Homo Sapiens
RESLGLWGT

SEQ ID NO: 368994 - protein, 9 aa, Homo Sapiens
YQFPMVPGE

SEQ ID NO: 368995 - protein, 9 aa, Homo Sapiens
MPQQGWNAT

SEQ ID NO: 368996 - protein, 9 aa, Homo Sapiens
NRSEDLGHT

SEQ ID NO: 368997 - protein, 9 aa, Homo Sapiens
SWLLNPERS

SEQ ID NO: 368998 - protein, 9 aa, Homo Sapiens
DHYLAIVHA

SEQ ID NO: 368999 - protein, 9 aa, Homo Sapiens
NASNASLLG

SEQ ID NO: 369000 - protein, 9 aa, Homo Sapiens
KQVSPASPP

SEQ ID NO: 369001 - protein, 9 aa, Homo Sapiens
ATFSANKLL

SEQ ID NO: 369002 - protein, 9 aa, Homo Sapiens
LAQNRLNVS

SEQ ID NO: 369003 - protein, 9 aa, Homo Sapiens
SAMNYGICK

SEQ ID NO: 369004 - protein, 9 aa, Homo Sapiens
KLRAPIICI

SEQ ID NO: 369005 - protein, 9 aa, Homo Sapiens
TELLVTENV

SEQ ID NO: 369006 - protein, 9 aa, Homo Sapiens
CSAPANQPR

SEQ ID NO: 369007 - protein, 9 aa, Homo Sapiens
LPKIVLKLK

SEQ ID NO: 369008 - protein, 9 aa, Homo Sapiens
PPPQKERRR

SEQ ID NO: 369009 - protein, 9 aa, Homo Sapiens
ALPPGGCLL

SEQ ID NO: 369010 - protein, 9 aa, Homo Sapiens
YMHRNNSVP

SEQ ID NO: 369011 - protein, 9 aa, Homo Sapiens
FKDFILSRA

SEQ ID NO: 369012 - protein, 9 aa, Homo Sapiens
HPAARGGVG

SEQ ID NO: 369013 - protein, 9 aa, Homo Sapiens
WMVGSPQRR

SEQ ID NO: 369014 - protein, 9 aa, Homo Sapiens
CPQCKKRKN

SEQ ID NO: 369015 - protein, 9 aa, Homo Sapiens
ANSNSLNHV

SEQ ID NO: 369016 - protein, 9 aa, Homo Sapiens
LARVRSRAA

SEQ ID NO: 369017 - protein, 9 aa, Homo Sapiens
LAYIWEEWS

SEQ ID NO: 369018 - protein, 9 aa, Homo Sapiens
AAAAHGDGS

SEQ ID NO: 369019 - protein, 9 aa, Homo Sapiens
PSASSPVSA

SEQ ID NO: 369020 - protein, 9 aa, Homo Sapiens
QMVFSVILS

SEQ ID NO: 369021 - protein, 9 aa, Homo Sapiens
ERESYDNRL

SEQ ID NO: 369022 - protein, 9 aa, Homo Sapiens
PGLARCFKV

SEQ ID NO: 369023 - protein, 9 aa, Homo Sapiens
QGTRRRCYR

SEQ ID NO: 369024 - protein, 9 aa, Homo Sapiens
SRATGRHVS

SEQ ID NO: 369025 - protein, 9 aa, Homo Sapiens
DKKRGASSS

SEQ ID NO: 369026 - protein, 9 aa, Homo Sapiens
TRLLCLHSL

SEQ ID NO: 369027 - protein, 9 aa, Homo Sapiens
VMRGLLVTG

SEQ ID NO: 369028 - protein, 9 aa, Homo Sapiens
TKDYPHWCE

SEQ ID NO: 369029 - protein, 9 aa, Homo Sapiens
ESLLEHSLP

SEQ ID NO: 369030 - protein, 9 aa, Homo Sapiens
LLANLTFLD

SEQ ID NO: 369031 - protein, 9 aa, Homo Sapiens
GSQTDGFAG

SEQ ID NO: 369032 - protein, 9 aa, Homo Sapiens
ATKERTEPE

SEQ ID NO: 369033 - protein, 9 aa, Homo Sapiens
KKILPNQKP

SEQ ID NO: 369034 - protein, 9 aa, Homo Sapiens
RTANTQELG

SEQ ID NO: 369035 - protein, 9 aa, Homo Sapiens
GYTPALVCA

SEQ ID NO: 369036 - protein, 9 aa, Homo Sapiens
WATMRGFAE

SEQ ID NO: 369037 - protein, 9 aa, Homo Sapiens
EQTWLDPDP

SEQ ID NO: 369038 - protein, 9 aa, Homo Sapiens
KNKPLYFAD

SEQ ID NO: 369039 - protein, 9 aa, Homo Sapiens
ANSINQVFL

SEQ ID NO: 369040 - protein, 9 aa, Homo Sapiens
VAKAKPKFS

SEQ ID NO: 369041 - protein, 9 aa, Homo Sapiens
SSGWAGPAA

SEQ ID NO: 369042 - protein, 9 aa, Homo Sapiens
RRAQDHLRL

SEQ ID NO: 369043 - protein, 9 aa, Homo Sapiens
QFTLKHLSW

SEQ ID NO: 369044 - protein, 9 aa, Homo Sapiens
YPKIKETIC

SEQ ID NO: 369045 - protein, 9 aa, Homo Sapiens
SHPQAKAIG

SEQ ID NO: 369046 - protein, 9 aa, Homo Sapiens
REHTPCAET

SEQ ID NO: 369047 - protein, 9 aa, Homo Sapiens
HALLHHDPL

SEQ ID NO: 369048 - protein, 9 aa, Homo Sapiens
CQEHGLGLE

SEQ ID NO: 369049 - protein, 9 aa, Homo Sapiens
PVSPAPSRR

SEQ ID NO: 369050 - protein, 9 aa, Homo Sapiens
ASPPTKVSR

SEQ ID NO: 369051 - protein, 9 aa, Homo Sapiens
LGGGQRGNG

SEQ ID NO: 369052 - protein, 9 aa, Homo Sapiens
WLLGSRMAH

SEQ ID NO: 369053 - protein, 9 aa, Homo Sapiens
YLCRWVWNP

SEQ ID NO: 369054 - protein, 9 aa, Homo Sapiens
PIDWDILNR

SEQ ID NO: 369055 - protein, 9 aa, Homo Sapiens
EVDKRVVLH

SEQ ID NO: 369056 - protein, 9 aa, Homo Sapiens
KKAIIFNGC

SEQ ID NO: 369057 - protein, 9 aa, Homo Sapiens
DDCEEEENW

SEQ ID NO: 369058 - protein, 9 aa, Homo Sapiens
PATSRPPPG

SEQ ID NO: 369059 - protein, 9 aa, Homo Sapiens
SRLWGWNAD

SEQ ID NO: 369060 - protein, 9 aa, Homo Sapiens
KKEGRSSTN

SEQ ID NO: 369061 - protein, 9 aa, Homo Sapiens
GAKVSRNTL

SEQ ID NO: 369062 - protein, 9 aa, Homo Sapiens
KEQREQETS

SEQ ID NO: 369063 - protein, 9 aa, Homo Sapiens
VVIFYDVVH

SEQ ID NO: 369064 - protein, 9 aa, Homo Sapiens
FSRLRKISM

SEQ ID NO: 369065 - protein, 9 aa, Homo Sapiens
EVIRNTCKA

SEQ ID NO: 369066 - protein, 9 aa, Homo Sapiens
ADLPHSSGL

SEQ ID NO: 369067 - protein, 9 aa, Homo Sapiens
TPRKTAATT

SEQ ID NO: 369068 - protein, 9 aa, Homo Sapiens
IIFNGCMTQ

SEQ ID NO: 369069 - protein, 9 aa, Homo Sapiens
EDISKGNSL

SEQ ID NO: 369070 - protein, 9 aa, Homo Sapiens
LGHGALVDE

SEQ ID NO: 369071 - protein, 9 aa, Homo Sapiens
LKKIGKTCW

SEQ ID NO: 369072 - protein, 9 aa, Homo Sapiens
PRAGSGRAA

SEQ ID NO: 369073 - protein, 9 aa, Homo Sapiens
SLMLDPVTP

SEQ ID NO: 369074 - protein, 9 aa, Homo Sapiens
LSQLQFSEH

SEQ ID NO: 369075 - protein, 9 aa, Homo Sapiens
SPPQAAGAE

SEQ ID NO: 369076 - protein, 9 aa, Homo Sapiens
TGRHQWHPD

SEQ ID NO: 369077 - protein, 9 aa, Homo Sapiens
EEEGETERT

SEQ ID NO: 369078 - protein, 9 aa, Homo Sapiens
VRFESIWLP

SEQ ID NO: 369079 - protein, 9 aa, Homo Sapiens
VLAWARAHL

SEQ ID NO: 369080 - protein, 9 aa, Homo Sapiens
RLVHLSKQV

SEQ ID NO: 369081 - protein, 9 aa, Homo Sapiens
VLGAIPLSG

SEQ ID NO: 369082 - protein, 9 aa, Homo Sapiens
EVNLRAQEL

SEQ ID NO: 369083 - protein, 9 aa, Homo Sapiens
RWTAPSSPP

SEQ ID NO: 369084 - protein, 9 aa, Homo Sapiens
LCWNLSLEG

SEQ ID NO: 369085 - protein, 9 aa, Homo Sapiens
RTSNISKAS

SEQ ID NO: 369086 - protein, 9 aa, Homo Sapiens
FPVLSTSSF

SEQ ID NO: 369087 - protein, 9 aa, Homo Sapiens
YVAIQNFST

SEQ ID NO: 369088 - protein, 9 aa, Homo Sapiens
IVLLGVTND

SEQ ID NO: 369089 - protein, 9 aa, Homo Sapiens
RSRRKQHLP

SEQ ID NO: 369090 - protein, 9 aa, Homo Sapiens
LGNCGPYCT

SEQ ID NO: 369091 - protein, 9 aa, Homo Sapiens
KDYVQTCIM

SEQ ID NO: 369092 - protein, 9 aa, Homo Sapiens
DFDVPGLPD

SEQ ID NO: 369093 - protein, 9 aa, Homo Sapiens
SWGQTDLTV

SEQ ID NO: 369094 - protein, 9 aa, Homo Sapiens
SQPCPSSKW

SEQ ID NO: 369095 - protein, 9 aa, Homo Sapiens
NFTPLAWHR

SEQ ID NO: 369096 - protein, 9 aa, Homo Sapiens
FFLVSITCA

SEQ ID NO: 369097 - protein, 9 aa, Homo Sapiens
GMRKLRPPQ

SEQ ID NO: 369098 - protein, 9 aa, Homo Sapiens
TGHREWVHM

SEQ ID NO: 369099 - protein, 9 aa, Homo Sapiens
FLPALQATL

SEQ ID NO: 369100 - protein, 9 aa, Homo Sapiens
KLARCRPPW

SEQ ID NO: 369101 - protein, 9 aa, Homo Sapiens
RLASRWHSD

SEQ ID NO: 369102 - protein, 9 aa, Homo Sapiens
ALRARWSTS

SEQ ID NO: 369103 - protein, 9 aa, Homo Sapiens
VSAFGQAIS

SEQ ID NO: 369104 - protein, 9 aa, Homo Sapiens
ISLKMNSSK

SEQ ID NO: 369105 - protein, 9 aa, Homo Sapiens
SAQPWRLRL

SEQ ID NO: 369106 - protein, 9 aa, Homo Sapiens
CAANSINQV

SEQ ID NO: 369107 - protein, 9 aa, Homo Sapiens
LFLAVGGPW

SEQ ID NO: 369108 - protein, 9 aa, Homo Sapiens
APEGGPWRG

SEQ ID NO: 369109 - protein, 9 aa, Homo Sapiens
EHATNCATH

SEQ ID NO: 369110 - protein, 9 aa, Homo Sapiens
DINRRAMRT

SEQ ID NO: 369111 - protein, 9 aa, Homo Sapiens
LERVPVAPD

SEQ ID NO: 369112 - protein, 9 aa, Homo Sapiens
SKKCIGLIY

SEQ ID NO: 369113 - protein, 9 aa, Homo Sapiens
AHLAVEACL

SEQ ID NO: 369114 - protein, 9 aa, Homo Sapiens
EPPDVYSYF

SEQ ID NO: 369115 - protein, 9 aa, Homo Sapiens
PWMVPWGME

SEQ ID NO: 369116 - protein, 9 aa, Homo Sapiens
GPEERLTEE

SEQ ID NO: 369117 - protein, 9 aa, Homo Sapiens
GQTSISVGK

SEQ ID NO: 369118 - protein, 9 aa, Homo Sapiens
PCLTRMRKS

SEQ ID NO: 369119 - protein, 9 aa, Homo Sapiens
EICSFVWGV

SEQ ID NO: 369120 - protein, 9 aa, Homo Sapiens
QELATVLLQ

SEQ ID NO: 369121 - protein, 9 aa, Homo Sapiens
VRPKRKHRT

SEQ ID NO: 369122 - protein, 9 aa, Homo Sapiens
CVISYAHNV

SEQ ID NO: 369123 - protein, 9 aa, Homo Sapiens
KVSRNTLFT

SEQ ID NO: 369124 - protein, 9 aa, Homo Sapiens
IQEAARTCS

SEQ ID NO: 369125 - protein, 9 aa, Homo Sapiens
QKLAQQLCT

SEQ ID NO: 369126 - protein, 9 aa, Homo Sapiens
TKLVRKVAG

SEQ ID NO: 369127 - protein, 9 aa, Homo Sapiens
QPGPAAVTA

SEQ ID NO: 369128 - protein, 9 aa, Homo Sapiens
PRIHQHLAR

SEQ ID NO: 369129 - protein, 9 aa, Homo Sapiens
LLCLHSLLD

SEQ ID NO: 369130 - protein, 9 aa, Homo Sapiens
IYSLFLSPA

SEQ ID NO: 369131 - protein, 9 aa, Homo Sapiens
CKEIKTTSF

SEQ ID NO: 369132 - protein, 9 aa, Homo Sapiens
DNPFQKECF

SEQ ID NO: 369133 - protein, 9 aa, Homo Sapiens
RVNGTFGEI

SEQ ID NO: 369134 - protein, 9 aa, Homo Sapiens
HFAEAGRST

SEQ ID NO: 369135 - protein, 9 aa, Homo Sapiens
VICLQHRVQ

SEQ ID NO: 369136 - protein, 9 aa, Homo Sapiens
EFEEDSEDE

SEQ ID NO: 369137 - protein, 9 aa, Homo Sapiens
AYCLSVSRA

SEQ ID NO: 369138 - protein, 9 aa, Homo Sapiens
QINVKTSES

SEQ ID NO: 369139 - protein, 9 aa, Homo Sapiens
VGDPSKSDS

SEQ ID NO: 369140 - protein, 9 aa, Homo Sapiens
GYETALKGF

SEQ ID NO: 369141 - protein, 9 aa, Homo Sapiens
STGGADRGC

SEQ ID NO: 369142 - protein, 9 aa, Homo Sapiens
LSLWSHRPP

SEQ ID NO: 369143 - protein, 9 aa, Homo Sapiens
RLRCLQHFY

SEQ ID NO: 369144 - protein, 9 aa, Homo Sapiens
KVLLKTKVY

SEQ ID NO: 369145 - protein, 9 aa, Homo Sapiens
CCGNEVTPT

SEQ ID NO: 369146 - protein, 9 aa, Homo Sapiens
MNSSKCSVL

SEQ ID NO: 369147 - protein, 9 aa, Homo Sapiens
HRAVGKKLG

SEQ ID NO: 369148 - protein, 9 aa, Homo Sapiens
AASLKLPQD

SEQ ID NO: 369149 - protein, 9 aa, Homo Sapiens
EPTGKCFLL

SEQ ID NO: 369150 - protein, 9 aa, Homo Sapiens
VTPDPAVVV

SEQ ID NO: 369151 - protein, 9 aa, Homo Sapiens
PPGLFQEIL

SEQ ID NO: 369152 - protein, 9 aa, Homo Sapiens
PNTPTARAD

SEQ ID NO: 369153 - protein, 9 aa, Homo Sapiens
LTPREQTWL

SEQ ID NO: 369154 - protein, 9 aa, Homo Sapiens
DRFLLGVNV

SEQ ID NO: 369155 - protein, 9 aa, Homo Sapiens
VTIWGKIVG

SEQ ID NO: 369156 - protein, 9 aa, Homo Sapiens
FDITYVCLK

SEQ ID NO: 369157 - protein, 9 aa, Homo Sapiens
FAVNPEKIQ

SEQ ID NO: 369158 - protein, 9 aa, Homo Sapiens
TRTLVRKLC

SEQ ID NO: 369159 - protein, 9 aa, Homo Sapiens
FVNIYTYLC

SEQ ID NO: 369160 - protein, 9 aa, Homo Sapiens
ILQDAQVAN

SEQ ID NO: 369161 - protein, 9 aa, Homo Sapiens
TFSGREHLI

SEQ ID NO: 369162 - protein, 9 aa, Homo Sapiens
RPGSGPPTH

SEQ ID NO: 369163 - protein, 9 aa, Homo Sapiens
RLPPPMNCP

SEQ ID NO: 369164 - protein, 9 aa, Homo Sapiens
PWVYYSTAN

SEQ ID NO: 369165 - protein, 9 aa, Homo Sapiens
MTPSGQQQQ

SEQ ID NO: 369166 - protein, 9 aa, Homo Sapiens
RVPVGQGCV

SEQ ID NO: 369167 - protein, 9 aa, Homo Sapiens
INLVVILIR

SEQ ID NO: 369168 - protein, 9 aa, Homo Sapiens
LCFSIANSN

SEQ ID NO: 369169 - protein, 9 aa, Homo Sapiens
SKCSVLGRI

SEQ ID NO: 369170 - protein, 9 aa, Homo Sapiens
AYPKIKETI

SEQ ID NO: 369171 - protein, 9 aa, Homo Sapiens
VGLCLEYAD

SEQ ID NO: 369172 - protein, 9 aa, Homo Sapiens
PPHRTPWPL

SEQ ID NO: 369173 - protein, 9 aa, Homo Sapiens
GCMLIKLLE

SEQ ID NO: 369174 - protein, 9 aa, Homo Sapiens
SVIDPQAIH

SEQ ID NO: 369175 - protein, 9 aa, Homo Sapiens
GGARETFHM

SEQ ID NO: 369176 - protein, 9 aa, Homo Sapiens
TGASVAPSP

SEQ ID NO: 369177 - protein, 9 aa, Homo Sapiens
MNDSKHKLE

SEQ ID NO: 369178 - protein, 9 aa, Homo Sapiens
KLELSCLAK

SEQ ID NO: 369179 - protein, 9 aa, Homo Sapiens
SQGACAHLA

SEQ ID NO: 369180 - protein, 9 aa, Homo Sapiens
SSSVSSIVR

SEQ ID NO: 369181 - protein, 9 aa, Homo Sapiens
LSSQSPPSP

SEQ ID NO: 369182 - protein, 9 aa, Homo Sapiens
TRALRGPPR

SEQ ID NO: 369183 - protein, 9 aa, Homo Sapiens
TGGREGRDC

SEQ ID NO: 369184 - protein, 9 aa, Homo Sapiens
SQTSMHKKP

SEQ ID NO: 369185 - protein, 9 aa, Homo Sapiens
PLDLATTDD

SEQ ID NO: 369186 - protein, 9 aa, Homo Sapiens
PQGAPPSHR

SEQ ID NO: 369187 - protein, 9 aa, Homo Sapiens
KRDRRSMGE

SEQ ID NO: 369188 - protein, 9 aa, Homo Sapiens
SSHTGTLCT

SEQ ID NO: 369189 - protein, 9 aa, Homo Sapiens
SSPIEPRDH

SEQ ID NO: 369190 - protein, 9 aa, Homo Sapiens
GNALVILTV

SEQ ID NO: 369191 - protein, 9 aa, Homo Sapiens
WYHITLMQR

SEQ ID NO: 369192 - protein, 9 aa, Homo Sapiens
PCQPKCPLK

SEQ ID NO: 369193 - protein, 9 aa, Homo Sapiens
MLCKVLNST

SEQ ID NO: 369194 - protein, 9 aa, Homo Sapiens
FCVCAVGAC

SEQ ID NO: 369195 - protein, 9 aa, Homo Sapiens
HPTVSTGRP

SEQ ID NO: 369196 - protein, 9 aa, Homo Sapiens
LWPCSATVL

SEQ ID NO: 369197 - protein, 9 aa, Homo Sapiens
DNLLKIYKA

SEQ ID NO: 369198 - protein, 9 aa, Homo Sapiens
TSTMPQQGW

SEQ ID NO: 369199 - protein, 9 aa, Homo Sapiens
SWVAIPQEQ

SEQ ID NO: 369200 - protein, 9 aa, Homo Sapiens
ISLGAPKKE

SEQ ID NO: 369201 - protein, 9 aa, Homo Sapiens
NVTSMESFP

SEQ ID NO: 369202 - protein, 9 aa, Homo Sapiens
MKFRLQLPI

SEQ ID NO: 369203 - protein, 9 aa, Homo Sapiens
RQFMNSACH

SEQ ID NO: 369204 - protein, 9 aa, Homo Sapiens
VRGAEGGRG

SEQ ID NO: 369205 - protein, 9 aa, Homo Sapiens
PSSPSMASL

SEQ ID NO: 369206 - protein, 9 aa, Homo Sapiens
PSSEGVCFL

SEQ ID NO: 369207 - protein, 9 aa, Homo Sapiens
GTSITSVTL

SEQ ID NO: 369208 - protein, 9 aa, Homo Sapiens
IHPLPGPIL

SEQ ID NO: 369209 - protein, 9 aa, Homo Sapiens
DRAKNTQAL

SEQ ID NO: 369210 - protein, 9 aa, Homo Sapiens
VDPIDYWKN

SEQ ID NO: 369211 - protein, 9 aa, Homo Sapiens
QQYQRDTQQ

SEQ ID NO: 369212 - protein, 9 aa, Homo Sapiens
SGMPAMTCL

SEQ ID NO: 369213 - protein, 9 aa, Homo Sapiens
KGTVPHLGR

SEQ ID NO: 369214 - protein, 9 aa, Homo Sapiens
KDGMWTTVL

SEQ ID NO: 369215 - protein, 9 aa, Homo Sapiens
SEDEQAAKQ

SEQ ID NO: 369216 - protein, 9 aa, Homo Sapiens
KLGSCPQFF

SEQ ID NO: 369217 - protein, 9 aa, Homo Sapiens
GGQRRESGL

SEQ ID NO: 369218 - protein, 9 aa, Homo Sapiens
KTCWRPDCT

SEQ ID NO: 369219 - protein, 9 aa, Homo Sapiens
IAFSSQLFL

SEQ ID NO: 369220 - protein, 9 aa, Homo Sapiens
SFFTSAHPS

SEQ ID NO: 369221 - protein, 9 aa, Homo Sapiens
ESPDYFVDC

SEQ ID NO: 369222 - protein, 9 aa, Homo Sapiens
QAKAIGSAG

SEQ ID NO: 369223 - protein, 9 aa, Homo Sapiens
GRSASWPQR

SEQ ID NO: 369224 - protein, 9 aa, Homo Sapiens
DLSPWLTGL

SEQ ID NO: 369225 - protein, 9 aa, Homo Sapiens
KECFHQKNW

SEQ ID NO: 369226 - protein, 9 aa, Homo Sapiens
EIRMVAAGA

SEQ ID NO: 369227 - protein, 9 aa, Homo Sapiens
TEHVPLGNL

SEQ ID NO: 369228 - protein, 9 aa, Homo Sapiens
ALFPQRRTF

SEQ ID NO: 369229 - protein, 9 aa, Homo Sapiens
KGVLSPRIH

SEQ ID NO: 369230 - protein, 9 aa, Homo Sapiens
SLLYFLLTT

SEQ ID NO: 369231 - protein, 9 aa, Homo Sapiens
SMPEYFLEA

SEQ ID NO: 369232 - protein, 9 aa, Homo Sapiens
PPTKKRGKS

SEQ ID NO: 369233 - protein, 9 aa, Homo Sapiens
LWGLTKEAS

SEQ ID NO: 369234 - protein, 9 aa, Homo Sapiens
PQGSSRPLP

SEQ ID NO: 369235 - protein, 9 aa, Homo Sapiens
PLMFVPAIA

SEQ ID NO: 369236 - protein, 9 aa, Homo Sapiens
LCLQGKPTS

SEQ ID NO: 369237 - protein, 9 aa, Homo Sapiens
LKTYLCRWV

SEQ ID NO: 369238 - protein, 9 aa, Homo Sapiens
KKIPPGLFQ

SEQ ID NO: 369239 - protein, 9 aa, Homo Sapiens
VSGALERSK

SEQ ID NO: 369240 - protein, 9 aa, Homo Sapiens
WMVQGILAM

SEQ ID NO: 369241 - protein, 9 aa, Homo Sapiens
AHPRPPALS

SEQ ID NO: 369242 - protein, 9 aa, Homo Sapiens
LPQASSTRS

SEQ ID NO: 369243 - protein, 9 aa, Homo Sapiens
PKRLTGSQL

SEQ ID NO: 369244 - protein, 9 aa, Homo Sapiens
IGDFGLATE

SEQ ID NO: 369245 - protein, 9 aa, Homo Sapiens
RTQMTSRRA

SEQ ID NO: 369246 - protein, 9 aa, Homo Sapiens
SRPEPQCPR

SEQ ID NO: 369247 - protein, 9 aa, Homo Sapiens
VILTVLTSR

SEQ ID NO: 369248 - protein, 9 aa, Homo Sapiens
EASGMPPSS

SEQ ID NO: 369249 - protein, 9 aa, Homo Sapiens
KSKNLLAWN

SEQ ID NO: 369250 - protein, 9 aa, Homo Sapiens
QVSPASPPT

SEQ ID NO: 369251 - protein, 9 aa, Homo Sapiens
KRRRRNPRA

SEQ ID NO: 369252 - protein, 9 aa, Homo Sapiens
QEEIQEAAR

SEQ ID NO: 369253 - protein, 9 aa, Homo Sapiens
TYQAFPRCP

SEQ ID NO: 369254 - protein, 9 aa, Homo Sapiens
SSVTGIFGN

SEQ ID NO: 369255 - protein, 9 aa, Homo Sapiens
TGKCFLLAV

SEQ ID NO: 369256 - protein, 9 aa, Homo Sapiens
ISGGREIFK

SEQ ID NO: 369257 - protein, 9 aa, Homo Sapiens
EDVAGLGAQ

SEQ ID NO: 369258 - protein, 9 aa, Homo Sapiens
EQEKDREKD

SEQ ID NO: 369259 - protein, 9 aa, Homo Sapiens
ARPQQPVAQ

SEQ ID NO: 369260 - protein, 9 aa, Homo Sapiens
TELSPVEQK

SEQ ID NO: 369261 - protein, 9 aa, Homo Sapiens
QLSCSTKKR

SEQ ID NO: 369262 - protein, 9 aa, Homo Sapiens
LLRAGFNRR

SEQ ID NO: 369263 - protein, 9 aa, Homo Sapiens
LTMNDSKHK

SEQ ID NO: 369264 - protein, 9 aa, Homo Sapiens
KHFRLRCLQ

SEQ ID NO: 369265 - protein, 9 aa, Homo Sapiens
PGNRGLPLP

SEQ ID NO: 369266 - protein, 9 aa, Homo Sapiens
LLTLPPWAV

SEQ ID NO: 369267 - protein, 9 aa, Homo Sapiens
PTNVKNVTK

SEQ ID NO: 369268 - protein, 9 aa, Homo Sapiens
TRFYRTWPL

SEQ ID NO: 369269 - protein, 9 aa, Homo Sapiens
SAQYGIGYK

SEQ ID NO: 369270 - protein, 9 aa, Homo Sapiens
RGSRSQGTG

SEQ ID NO: 369271 - protein, 9 aa, Homo Sapiens
SHREAWAGR

SEQ ID NO: 369272 - protein, 9 aa, Homo Sapiens
SASITNMSL

SEQ ID NO: 369273 - protein, 9 aa, Homo Sapiens
RTKSAEEEL

SEQ ID NO: 369274 - protein, 9 aa, Homo Sapiens
LLLPCMLIS

SEQ ID NO: 369275 - protein, 9 aa, Homo Sapiens
GTVPHLGRV

SEQ ID NO: 369276 - protein, 9 aa, Homo Sapiens
VGTWRILPN

SEQ ID NO: 369277 - protein, 9 aa, Homo Sapiens
SDIYVCVIS

SEQ ID NO: 369278 - protein, 9 aa, Homo Sapiens
KAYNNQPTM

SEQ ID NO: 369279 - protein, 9 aa, Homo Sapiens
WGWEAAAGG

SEQ ID NO: 369280 - protein, 9 aa, Homo Sapiens
PPMNCPAAL

SEQ ID NO: 369281 - protein, 9 aa, Homo Sapiens
YPYSVKRNV

SEQ ID NO: 369282 - protein, 9 aa, Homo Sapiens
ITLSTIVAG

SEQ ID NO: 369283 - protein, 9 aa, Homo Sapiens
IGSIMGSWL

SEQ ID NO: 369284 - protein, 9 aa, Homo Sapiens
PEKRAKKIW

SEQ ID NO: 369285 - protein, 9 aa, Homo Sapiens
SKTEAHLAK

SEQ ID NO: 369286 - protein, 9 aa, Homo Sapiens
NILFSSWVV

SEQ ID NO: 369287 - protein, 9 aa, Homo Sapiens
GTSRARRTN

SEQ ID NO: 369288 - protein, 9 aa, Homo Sapiens
QRSSCFGGR

SEQ ID NO: 369289 - protein, 9 aa, Homo Sapiens
QGSPERGLR

SEQ ID NO: 369290 - protein, 9 aa, Homo Sapiens
LRAPPGCGK

SEQ ID NO: 369291 - protein, 9 aa, Homo Sapiens
MECLKVGML

SEQ ID NO: 369292 - protein, 9 aa, Homo Sapiens
CGPGRRRAV

SEQ ID NO: 369293 - protein, 9 aa, Homo Sapiens
TLTIFRFCG

SEQ ID NO: 369294 - protein, 9 aa, Homo Sapiens
RETIIKTLT

SEQ ID NO: 369295 - protein, 9 aa, Homo Sapiens
CLRQRRLSK

SEQ ID NO: 369296 - protein, 9 aa, Homo Sapiens
TLAGKITDM

SEQ ID NO: 369297 - protein, 9 aa, Homo Sapiens
EMVTEPPDV

SEQ ID NO: 369298 - protein, 9 aa, Homo Sapiens
EALERYGKD

SEQ ID NO: 369299 - protein, 9 aa, Homo Sapiens
TSDGKHYCY

SEQ ID NO: 369300 - protein, 9 aa, Homo Sapiens
VWGVKKHWI

SEQ ID NO: 369301 - protein, 9 aa, Homo Sapiens
EDRVTEEAK

SEQ ID NO: 369302 - protein, 9 aa, Homo Sapiens
CYRHSLLHL

SEQ ID NO: 369303 - protein, 9 aa, Homo Sapiens
ANSENPELW

SEQ ID NO: 369304 - protein, 9 aa, Homo Sapiens
HQVQTSEDL

SEQ ID NO: 369305 - protein, 9 aa, Homo Sapiens
LLPVLPGDG

SEQ ID NO: 369306 - protein, 9 aa, Homo Sapiens
LGFTHLIGS

SEQ ID NO: 369307 - protein, 9 aa, Homo Sapiens
ENLGFTHLI

SEQ ID NO: 369308 - protein, 9 aa, Homo Sapiens
REQLRALVT

SEQ ID NO: 369309 - protein, 9 aa, Homo Sapiens
HITLMQRTV

SEQ ID NO: 369310 - protein, 9 aa, Homo Sapiens
PRPQDGFAQ

SEQ ID NO: 369311 - protein, 9 aa, Homo Sapiens
LAAFHAAWM

SEQ ID NO: 369312 - protein, 9 aa, Homo Sapiens
VEQPSTQRS

SEQ ID NO: 369313 - protein, 9 aa, Homo Sapiens
LDVAILENY

SEQ ID NO: 369314 - protein, 9 aa, Homo Sapiens
AVMRGLLVT

SEQ ID NO: 369315 - protein, 9 aa, Homo Sapiens
SASWPQRLL

SEQ ID NO: 369316 - protein, 9 aa, Homo Sapiens
VVVWDRPFQ

SEQ ID NO: 369317 - protein, 9 aa, Homo Sapiens
VLERYASCR

SEQ ID NO: 369318 - protein, 9 aa, Homo Sapiens
LWEERLLGD

SEQ ID NO: 369319 - protein, 9 aa, Homo Sapiens
IHLHVSRLY

SEQ ID NO: 369320 - protein, 9 aa, Homo Sapiens
PFSPTVGLC

SEQ ID NO: 369321 - protein, 9 aa, Homo Sapiens
RCLMVLGLE

SEQ ID NO: 369322 - protein, 9 aa, Homo Sapiens
PTRWQGLTL

SEQ ID NO: 369323 - protein, 9 aa, Homo Sapiens
NNSQGTFSG

SEQ ID NO: 369324 - protein, 9 aa, Homo Sapiens
DDGGPGVGS

SEQ ID NO: 369325 - protein, 9 aa, Homo Sapiens
KAIIFNGCM

SEQ ID NO: 369326 - protein, 9 aa, Homo Sapiens
LDVPKRLTG

SEQ ID NO: 369327 - protein, 9 aa, Homo Sapiens
YHITLMQRT

SEQ ID NO: 369328 - protein, 9 aa, Homo Sapiens
KRPPSEAAR

SEQ ID NO: 369329 - protein, 9 aa, Homo Sapiens
FSLVLLQDG

SEQ ID NO: 369330 - protein, 9 aa, Homo Sapiens
NKPVAQLLP

SEQ ID NO: 369331 - protein, 9 aa, Homo Sapiens
TRPRLTWCP

SEQ ID NO: 369332 - protein, 9 aa, Homo Sapiens
LASYLVRMA

SEQ ID NO: 369333 - protein, 9 aa, Homo Sapiens
KPGRNKWIT

SEQ ID NO: 369334 - protein, 9 aa, Homo Sapiens
MFLIQRELL

SEQ ID NO: 369335 - protein, 9 aa, Homo Sapiens
DAIHVLWNH

SEQ ID NO: 369336 - protein, 9 aa, Homo Sapiens
ALYLAEWVI

SEQ ID NO: 369337 - protein, 9 aa, Homo Sapiens
GLPWPPPAP

SEQ ID NO: 369338 - protein, 9 aa, Homo Sapiens
ATPDQHTHP

SEQ ID NO: 369339 - protein, 9 aa, Homo Sapiens
KGHQRPWWN

SEQ ID NO: 369340 - protein, 9 aa, Homo Sapiens
SIKNSFLCS

SEQ ID NO: 369341 - protein, 9 aa, Homo Sapiens
GTFSGREHL

SEQ ID NO: 369342 - protein, 9 aa, Homo Sapiens
YLPTALEPK

SEQ ID NO: 369343 - protein, 9 aa, Homo Sapiens
CFLTMNLNI

SEQ ID NO: 369344 - protein, 9 aa, Homo Sapiens
QLYLRPHKT

SEQ ID NO: 369345 - protein, 9 aa, Homo Sapiens
SACHQSPTL

SEQ ID NO: 369346 - protein, 9 aa, Homo Sapiens
VPVESGDII

SEQ ID NO: 369347 - protein, 9 aa, Homo Sapiens
LMFVPAIAS

SEQ ID NO: 369348 - protein, 9 aa, Homo Sapiens
GRCACSHPC

SEQ ID NO: 369349 - protein, 9 aa, Homo Sapiens
PLPPPVWAV

SEQ ID NO: 369350 - protein, 9 aa, Homo Sapiens
GHPQPRPST

SEQ ID NO: 369351 - protein, 9 aa, Homo Sapiens
PPVMETLPT

SEQ ID NO: 369352 - protein, 9 aa, Homo Sapiens
NVCDNELLY

SEQ ID NO: 369353 - protein, 9 aa, Homo Sapiens
AKSLLTKKK

SEQ ID NO: 369354 - protein, 9 aa, Homo Sapiens
NAATAPSPF

SEQ ID NO: 369355 - protein, 9 aa, Homo Sapiens
VQHVGLAQP

SEQ ID NO: 369356 - protein, 9 aa, Homo Sapiens
PPVLTQAVF

SEQ ID NO: 369357 - protein, 9 aa, Homo Sapiens
PSPWASAWW

SEQ ID NO: 369358 - protein, 9 aa, Homo Sapiens
QLTAPPAAF

SEQ ID NO: 369359 - protein, 9 aa, Homo Sapiens
QASWSHATT

SEQ ID NO: 369360 - protein, 9 aa, Homo Sapiens
WLYTFVRDS

SEQ ID NO: 369361 - protein, 9 aa, Homo Sapiens
IVGCGMSSL

SEQ ID NO: 369362 - protein, 9 aa, Homo Sapiens
RRTQMTSRR

SEQ ID NO: 369363 - protein, 9 aa, Homo Sapiens
EWHCGPQVP

SEQ ID NO: 369364 - protein, 9 aa, Homo Sapiens
LQPDDKNLC

SEQ ID NO: 369365 - protein, 9 aa, Homo Sapiens
LLMSIYSSG

SEQ ID NO: 369366 - protein, 9 aa, Homo Sapiens
KRTHNPINI

SEQ ID NO: 369367 - protein, 9 aa, Homo Sapiens
FEMRDISLI

SEQ ID NO: 369368 - protein, 9 aa, Homo Sapiens
NSPGSMVIS

SEQ ID NO: 369369 - protein, 9 aa, Homo Sapiens
DMDLRVYGP

SEQ ID NO: 369370 - protein, 9 aa, Homo Sapiens
MACRNILPP

SEQ ID NO: 369371 - protein, 9 aa, Homo Sapiens
FHSFFVDNP

SEQ ID NO: 369372 - protein, 9 aa, Homo Sapiens
KLLFEMRDI

SEQ ID NO: 369373 - protein, 9 aa, Homo Sapiens
DGPQIGVNI

SEQ ID NO: 369374 - protein, 9 aa, Homo Sapiens
GTLHTTLAR

SEQ ID NO: 369375 - protein, 9 aa, Homo Sapiens
GSWMVQGIL

SEQ ID NO: 369376 - protein, 9 aa, Homo Sapiens
DMACRNILP

SEQ ID NO: 369377 - protein, 9 aa, Homo Sapiens
GSPKPGDGE

SEQ ID NO: 369378 - protein, 9 aa, Homo Sapiens
LNKKATNII

SEQ ID NO: 369379 - protein, 9 aa, Homo Sapiens
LENLLHNRN

SEQ ID NO: 369380 - protein, 9 aa, Homo Sapiens
SEATSQYYF

SEQ ID NO: 369381 - protein, 9 aa, Homo Sapiens
PQAAGAERE

SEQ ID NO: 369382 - protein, 9 aa, Homo Sapiens
ESKKNPSPA

SEQ ID NO: 369383 - protein, 9 aa, Homo Sapiens
EQGLLLGGG

SEQ ID NO: 369384 - protein, 9 aa, Homo Sapiens
RRTRALRGP

SEQ ID NO: 369385 - protein, 9 aa, Homo Sapiens
RPPPGSSAR

SEQ ID NO: 369386 - protein, 9 aa, Homo Sapiens
RDLSSDERN

SEQ ID NO: 369387 - protein, 9 aa, Homo Sapiens
HDKQNSRSA

SEQ ID NO: 369388 - protein, 9 aa, Homo Sapiens
YTALRCSAS

SEQ ID NO: 369389 - protein, 9 aa, Homo Sapiens
VILIRDEIY

SEQ ID NO: 369390 - protein, 9 aa, Homo Sapiens
QPRAPACGL

SEQ ID NO: 369391 - protein, 9 aa, Homo Sapiens
NLILFCVCA

SEQ ID NO: 369392 - protein, 9 aa, Homo Sapiens
PIIGTTHSS

SEQ ID NO: 369393 - protein, 9 aa, Homo Sapiens
PPSPAGSSI

SEQ ID NO: 369394 - protein, 9 aa, Homo Sapiens
MPPSSPSMA

SEQ ID NO: 369395 - protein, 9 aa, Homo Sapiens
CSASPTEGA

SEQ ID NO: 369396 - protein, 9 aa, Homo Sapiens
SSSGYLCIC

SEQ ID NO: 369397 - protein, 9 aa, Homo Sapiens
EAGGARETF

SEQ ID NO: 369398 - protein, 9 aa, Homo Sapiens
NGMRLGAVA

SEQ ID NO: 369399 - protein, 9 aa, Homo Sapiens
PQIRPVYVP

SEQ ID NO: 369400 - protein, 9 aa, Homo Sapiens
RVPKGGPLL

SEQ ID NO: 369401 - protein, 9 aa, Homo Sapiens
ARIPIPSLM

SEQ ID NO: 369402 - protein, 9 aa, Homo Sapiens
FTLKHLSWD

SEQ ID NO: 369403 - protein, 9 aa, Homo Sapiens
PIKLLPGQS

SEQ ID NO: 369404 - protein, 9 aa, Homo Sapiens
SDIIENVKA

SEQ ID NO: 369405 - protein, 9 aa, Homo Sapiens
GRPPSPLSR

SEQ ID NO: 369406 - protein, 9 aa, Homo Sapiens
VVSVSALRG

SEQ ID NO: 369407 - protein, 9 aa, Homo Sapiens
EVSSLKYVR

SEQ ID NO: 369408 - protein, 9 aa, Homo Sapiens
VEKDRTPFN

SEQ ID NO: 369409 - protein, 9 aa, Homo Sapiens
KKKRSKAKV

SEQ ID NO: 369410 - protein, 9 aa, Homo Sapiens
PWRLRLPDC

SEQ ID NO: 369411 - protein, 9 aa, Homo Sapiens
SVLPLLRAG

SEQ ID NO: 369412 - protein, 9 aa, Homo Sapiens
IRDEIYGAV

SEQ ID NO: 369413 - protein, 9 aa, Homo Sapiens
KGCWRWSCG

SEQ ID NO: 369414 - protein, 9 aa, Homo Sapiens
SSTNARSAT

SEQ ID NO: 369415 - protein, 9 aa, Homo Sapiens
SLRSLQRSP

SEQ ID NO: 369416 - protein, 9 aa, Homo Sapiens
GLMGIEEQS

SEQ ID NO: 369417 - protein, 9 aa, Homo Sapiens
LASRVKAQA

SEQ ID NO: 369418 - protein, 9 aa, Homo Sapiens
RRTAKPLGA

SEQ ID NO: 369419 - protein, 9 aa, Homo Sapiens
GSALGGGAP

SEQ ID NO: 369420 - protein, 9 aa, Homo Sapiens
MREWRHLCF

SEQ ID NO: 369421 - protein, 9 aa, Homo Sapiens
CRHRALEVI

SEQ ID NO: 369422 - protein, 9 aa, Homo Sapiens
TSSTKPSPS

SEQ ID NO: 369423 - protein, 9 aa, Homo Sapiens
LLARSNYAA

SEQ ID NO: 369424 - protein, 9 aa, Homo Sapiens
FGYFQQDIK

SEQ ID NO: 369425 - protein, 9 aa, Homo Sapiens
RDINRRAMR

SEQ ID NO: 369426 - protein, 9 aa, Homo Sapiens
RVPVAPDGP

SEQ ID NO: 369427 - protein, 9 aa, Homo Sapiens
QALIEELEE

SEQ ID NO: 369428 - protein, 9 aa, Homo Sapiens
ETYIGNVVR

SEQ ID NO: 369429 - protein, 9 aa, Homo Sapiens
SGRAAAAHG

SEQ ID NO: 369430 - protein, 9 aa, Homo Sapiens
PPPAGCLRQ

SEQ ID NO: 369431 - protein, 9 aa, Homo Sapiens
ATSQYYFRI

SEQ ID NO: 369432 - protein, 9 aa, Homo Sapiens
LRCSASPTE

SEQ ID NO: 369433 - protein, 9 aa, Homo Sapiens
IHAEESKKN

SEQ ID NO: 369434 - protein, 9 aa, Homo Sapiens
YHAMKDHIV

SEQ ID NO: 369435 - protein, 9 aa, Homo Sapiens
RGLRLLLCL

SEQ ID NO: 369436 - protein, 9 aa, Homo Sapiens
CPQGLSNPS

SEQ ID NO: 369437 - protein, 9 aa, Homo Sapiens
PTPRTASAS

SEQ ID NO: 369438 - protein, 9 aa, Homo Sapiens
KVFPKHYRP

SEQ ID NO: 369439 - protein, 9 aa, Homo Sapiens
IHNFQESNS

SEQ ID NO: 369440 - protein, 9 aa, Homo Sapiens
LSPPVMETL

SEQ ID NO: 369441 - protein, 9 aa, Homo Sapiens
MEAPQRWTS

SEQ ID NO: 369442 - protein, 9 aa, Homo Sapiens
LFLSPAIRL

SEQ ID NO: 369443 - protein, 9 aa, Homo Sapiens
KNGIWEVMP

SEQ ID NO: 369444 - protein, 9 aa, Homo Sapiens
LGGQQCYCL

SEQ ID NO: 369445 - protein, 9 aa, Homo Sapiens
NYTGCCHAA

SEQ ID NO: 369446 - protein, 9 aa, Homo Sapiens
QKWGPLGQP

SEQ ID NO: 369447 - protein, 9 aa, Homo Sapiens
TESPPPLPA

SEQ ID NO: 369448 - protein, 9 aa, Homo Sapiens
FHTHERERY

SEQ ID NO: 369449 - protein, 9 aa, Homo Sapiens
IKLHLLMDT

SEQ ID NO: 369450 - protein, 9 aa, Homo Sapiens
FDQNIFTAF

SEQ ID NO: 369451 - protein, 9 aa, Homo Sapiens
IQAAIKKVD

SEQ ID NO: 369452 - protein, 9 aa, Homo Sapiens
FMYLTSLSK

SEQ ID NO: 369453 - protein, 9 aa, Homo Sapiens
CLYRWLSAA

SEQ ID NO: 369454 - protein, 9 aa, Homo Sapiens
EDDIADPFF

SEQ ID NO: 369455 - protein, 9 aa, Homo Sapiens
GSGSCSAPI

SEQ ID NO: 369456 - protein, 9 aa, Homo Sapiens
RPGPRGGHP

SEQ ID NO: 369457 - protein, 9 aa, Homo Sapiens
GISAHQLKT

SEQ ID NO: 369458 - protein, 9 aa, Homo Sapiens
EECSYFYRL

SEQ ID NO: 369459 - protein, 9 aa, Homo Sapiens
LKERESYDN

SEQ ID NO: 369460 - protein, 9 aa, Homo Sapiens
RPLPENQGN

SEQ ID NO: 369461 - protein, 9 aa, Homo Sapiens
VPHPNGATS

SEQ ID NO: 369462 - protein, 9 aa, Homo Sapiens
SGQVPKASS

SEQ ID NO: 369463 - protein, 9 aa, Homo Sapiens
EGRDCSDVD

SEQ ID NO: 369464 - protein, 9 aa, Homo Sapiens
YDRFLLGVN

SEQ ID NO: 369465 - protein, 9 aa, Homo Sapiens
LQEKEKIIV

SEQ ID NO: 369466 - protein, 9 aa, Homo Sapiens
YGKKAIIFN

SEQ ID NO: 369467 - protein, 9 aa, Homo Sapiens
HTARVCDIE

SEQ ID NO: 369468 - protein, 9 aa, Homo Sapiens
TSLSKNPKI

SEQ ID NO: 369469 - protein, 9 aa, Homo Sapiens
IVAGSTVGP

SEQ ID NO: 369470 - protein, 9 aa, Homo Sapiens
LGSGSCSAP

SEQ ID NO: 369471 - protein, 9 aa, Homo Sapiens
EMEPLIMDT

SEQ ID NO: 369472 - protein, 9 aa, Homo Sapiens
TYAEFSPCR

SEQ ID NO: 369473 - protein, 9 aa, Homo Sapiens
FIAFSSQLF

SEQ ID NO: 369474 - protein, 9 aa, Homo Sapiens
VNIYTYLCI

SEQ ID NO: 369475 - protein, 9 aa, Homo Sapiens
VKAQAEAAR

SEQ ID NO: 369476 - protein, 9 aa, Homo Sapiens
SSPPATSRP

SEQ ID NO: 369477 - protein, 9 aa, Homo Sapiens
PPRAPAAGW

SEQ ID NO: 369478 - protein, 9 aa, Homo Sapiens
SLTLSDSPW

SEQ ID NO: 369479 - protein, 9 aa, Homo Sapiens
RGALATGSS

SEQ ID NO: 369480 - protein, 9 aa, Homo Sapiens
EFTRRPTME

SEQ ID NO: 369481 - protein, 9 aa, Homo Sapiens
DVDTLILVE

SEQ ID NO: 369482 - protein, 9 aa, Homo Sapiens
LCIPEYEEK

SEQ ID NO: 369483 - protein, 9 aa, Homo Sapiens
IIAKLWRMM

SEQ ID NO: 369484 - protein, 9 aa, Homo Sapiens
TIWGKIVGS

SEQ ID NO: 369485 - protein, 9 aa, Homo Sapiens
LLALPGLYR

SEQ ID NO: 369486 - protein, 9 aa, Homo Sapiens
ERVLLPGDM

SEQ ID NO: 369487 - protein, 9 aa, Homo Sapiens
IWTDHRIRQ

SEQ ID NO: 369488 - protein, 9 aa, Homo Sapiens
LCWFAERVD

SEQ ID NO: 369489 - protein, 9 aa, Homo Sapiens
HQAVSRVSR

SEQ ID NO: 369490 - protein, 9 aa, Homo Sapiens
SPTGRRASP

SEQ ID NO: 369491 - protein, 9 aa, Homo Sapiens
FVDNPFQKE

SEQ ID NO: 369492 - protein, 9 aa, Homo Sapiens
HKPLGTAPH

SEQ ID NO: 369493 - protein, 9 aa, Homo Sapiens
KLEEQLWKE

SEQ ID NO: 369494 - protein, 9 aa, Homo Sapiens
LPQDQGLNI

SEQ ID NO: 369495 - protein, 9 aa, Homo Sapiens
NNVLRHRKN

SEQ ID NO: 369496 - protein, 9 aa, Homo Sapiens
LALLGCFTL

SEQ ID NO: 369497 - protein, 9 aa, Homo Sapiens
LVRHQKIHS

SEQ ID NO: 369498 - protein, 9 aa, Homo Sapiens
SLAGVSFSQ

SEQ ID NO: 369499 - protein, 9 aa, Homo Sapiens
PFYKNKEQR

SEQ ID NO: 369500 - protein, 9 aa, Homo Sapiens
GSYGLQEKS

SEQ ID NO: 369501 - protein, 9 aa, Homo Sapiens
RAGGTRLTT

SEQ ID NO: 369502 - protein, 9 aa, Homo Sapiens
SLVESGQVP

SEQ ID NO: 369503 - protein, 9 aa, Homo Sapiens
PGISAHQLK

SEQ ID NO: 369504 - protein, 9 aa, Homo Sapiens
PMVVQARLC

SEQ ID NO: 369505 - protein, 9 aa, Homo Sapiens
PRRPRPAAR

SEQ ID NO: 369506 - protein, 9 aa, Homo Sapiens
LHHCQRHIQ

SEQ ID NO: 369507 - protein, 9 aa, Homo Sapiens
NTLFTRFAC

SEQ ID NO: 369508 - protein, 9 aa, Homo Sapiens
KYEVGEIRW

SEQ ID NO: 369509 - protein, 9 aa, Homo Sapiens
ASMDKWKGP

SEQ ID NO: 369510 - protein, 9 aa, Homo Sapiens
LAALPDDIC

SEQ ID NO: 369511 - protein, 9 aa, Homo Sapiens
SWMVQGILA

SEQ ID NO: 369512 - protein, 9 aa, Homo Sapiens
CMLISLLAP

SEQ ID NO: 369513 - protein, 9 aa, Homo Sapiens
PNFLKHDLN

SEQ ID NO: 369514 - protein, 9 aa, Homo Sapiens
AFIGSMDVF

SEQ ID NO: 369515 - protein, 9 aa, Homo Sapiens
DRYSMGLLD

SEQ ID NO: 369516 - protein, 9 aa, Homo Sapiens
SGQERTVWY

SEQ ID NO: 369517 - protein, 9 aa, Homo Sapiens
RISSLCPQG

SEQ ID NO: 369518 - protein, 9 aa, Homo Sapiens
DHNEPSISE

SEQ ID NO: 369519 - protein, 9 aa, Homo Sapiens
RARWSTSFC

SEQ ID NO: 369520 - protein, 9 aa, Homo Sapiens
QSLPKQGGK

SEQ ID NO: 369521 - protein, 9 aa, Homo Sapiens
GLDGAWLLA

SEQ ID NO: 369522 - protein, 9 aa, Homo Sapiens
KDSEKSTMG

SEQ ID NO: 369523 - protein, 9 aa, Homo Sapiens
HPGPPPACR

SEQ ID NO: 369524 - protein, 9 aa, Homo Sapiens
IKMQNKVFQ

SEQ ID NO: 369525 - protein, 9 aa, Homo Sapiens
CFTWRTSRT

SEQ ID NO: 369526 - protein, 9 aa, Homo Sapiens
GTSARPSPS

SEQ ID NO: 369527 - protein, 9 aa, Homo Sapiens
IARSGDAAQ

SEQ ID NO: 369528 - protein, 9 aa, Homo Sapiens
QQRVPKGGP

SEQ ID NO: 369529 - protein, 9 aa, Homo Sapiens
KMAEGEELV

SEQ ID NO: 369530 - protein, 9 aa, Homo Sapiens
PVLSTSSFC

SEQ ID NO: 369531 - protein, 9 aa, Homo Sapiens
HQYKYEVGE

SEQ ID NO: 369532 - protein, 9 aa, Homo Sapiens
SGLALCGIV

SEQ ID NO: 369533 - protein, 9 aa, Homo Sapiens
ADRTFQKWA

SEQ ID NO: 369534 - protein, 9 aa, Homo Sapiens
STTALSCRV

SEQ ID NO: 369535 - protein, 9 aa, Homo Sapiens
LVVELGHDG

SEQ ID NO: 369536 - protein, 9 aa, Homo Sapiens
QKLKELQAR

SEQ ID NO: 369537 - protein, 9 aa, Homo Sapiens
IIETPHTAT

SEQ ID NO: 369538 - protein, 9 aa, Homo Sapiens
GRPLPENQG

SEQ ID NO: 369539 - protein, 9 aa, Homo Sapiens
KPIVHAKKN

SEQ ID NO: 369540 - protein, 9 aa, Homo Sapiens
LRRAQDHLR

SEQ ID NO: 369541 - protein, 9 aa, Homo Sapiens
EKEGSTVPH

SEQ ID NO: 369542 - protein, 9 aa, Homo Sapiens
RAISTFGTS

SEQ ID NO: 369543 - protein, 9 aa, Homo Sapiens
DKNRWEGPG

SEQ ID NO: 369544 - protein, 9 aa, Homo Sapiens
LTPPRPLPC

SEQ ID NO: 369545 - protein, 9 aa, Homo Sapiens
VWTPRAGSG

SEQ ID NO: 369546 - protein, 9 aa, Homo Sapiens
SREVIRNTC

SEQ ID NO: 369547 - protein, 9 aa, Homo Sapiens
RHGGVKRIS

SEQ ID NO: 369548 - protein, 9 aa, Homo Sapiens
LDKDGLEKE

SEQ ID NO: 369549 - protein, 9 aa, Homo Sapiens
SADADAAAA

SEQ ID NO: 369550 - protein, 9 aa, Homo Sapiens
LFSSWVVVL

SEQ ID NO: 369551 - protein, 9 aa, Homo Sapiens
TKKKASSPA

SEQ ID NO: 369552 - protein, 9 aa, Homo Sapiens
KGGITFFRP

SEQ ID NO: 369553 - protein, 9 aa, Homo Sapiens
GTGAGGDCG

SEQ ID NO: 369554 - protein, 9 aa, Homo Sapiens
MQSVFNMNA

SEQ ID NO: 369555 - protein, 9 aa, Homo Sapiens
LYQFYHEDT

SEQ ID NO: 369556 - protein, 9 aa, Homo Sapiens
PQAIHPELN

SEQ ID NO: 369557 - protein, 9 aa, Homo Sapiens
SQYYFRIAS

SEQ ID NO: 369558 - protein, 9 aa, Homo Sapiens
GASGPDGVR

SEQ ID NO: 369559 - protein, 9 aa, Homo Sapiens
SPNSAGIQE

SEQ ID NO: 369560 - protein, 9 aa, Homo Sapiens
LCQPYRSEF

SEQ ID NO: 369561 - protein, 9 aa, Homo Sapiens
KDMIARPQQ

SEQ ID NO: 369562 - protein, 9 aa, Homo Sapiens
LLWGLTKEA

SEQ ID NO: 369563 - protein, 9 aa, Homo Sapiens
TYRVVDLQT

SEQ ID NO: 369564 - protein, 9 aa, Homo Sapiens
IFESFMPQL

SEQ ID NO: 369565 - protein, 9 aa, Homo Sapiens
PDCTSLAEN

SEQ ID NO: 369566 - protein, 9 aa, Homo Sapiens
VSSIVRDSL

SEQ ID NO: 369567 - protein, 9 aa, Homo Sapiens
RAWWLPERR

SEQ ID NO: 369568 - protein, 9 aa, Homo Sapiens
EHISPVPPS

SEQ ID NO: 369569 - protein, 9 aa, Homo Sapiens
VDIQVCGPG

SEQ ID NO: 369570 - protein, 9 aa, Homo Sapiens
EARPARAES

SEQ ID NO: 369571 - protein, 9 aa, Homo Sapiens
TTTSSPKFG

SEQ ID NO: 369572 - protein, 9 aa, Homo Sapiens
THSKLKEVV

SEQ ID NO: 369573 - protein, 9 aa, Homo Sapiens
AALPDDICR

SEQ ID NO: 369574 - protein, 9 aa, Homo Sapiens
GKSFNDSST

SEQ ID NO: 369575 - protein, 9 aa, Homo Sapiens
SEGASEENL

SEQ ID NO: 369576 - protein, 9 aa, Homo Sapiens
EDCRLGVEP

SEQ ID NO: 369577 - protein, 9 aa, Homo Sapiens
RFLPTGGWG

SEQ ID NO: 369578 - protein, 9 aa, Homo Sapiens
PKAPHTTEA

SEQ ID NO: 369579 - protein, 9 aa, Homo Sapiens
PLGGQQCYC

SEQ ID NO: 369580 - protein, 9 aa, Homo Sapiens
KIVLKLKSP

SEQ ID NO: 369581 - protein, 9 aa, Homo Sapiens
PQRRTFLEA

SEQ ID NO: 369582 - protein, 9 aa, Homo Sapiens
CVMPEDVEN

SEQ ID NO: 369583 - protein, 9 aa, Homo Sapiens
ITNNILFPW

SEQ ID NO: 369584 - protein, 9 aa, Homo Sapiens
KRSVPVAKA

SEQ ID NO: 369585 - protein, 9 aa, Homo Sapiens
GGWSVAIWK

SEQ ID NO: 369586 - protein, 9 aa, Homo Sapiens
QLRERVREA

SEQ ID NO: 369587 - protein, 9 aa, Homo Sapiens
YWDLEVRLC

SEQ ID NO: 369588 - protein, 9 aa, Homo Sapiens
GLQEKSVAE

SEQ ID NO: 369589 - protein, 9 aa, Homo Sapiens
LTGSNCCNL

SEQ ID NO: 369590 - protein, 9 aa, Homo Sapiens
DRGCGPGRR

SEQ ID NO: 369591 - protein, 9 aa, Homo Sapiens
AARLHWLPC

SEQ ID NO: 369592 - protein, 9 aa, Homo Sapiens
LLLGAPGQA

SEQ ID NO: 369593 - protein, 9 aa, Homo Sapiens
GLFQEILHL

SEQ ID NO: 369594 - protein, 9 aa, Homo Sapiens
PPQQQWPQQ

SEQ ID NO: 369595 - protein, 9 aa, Homo Sapiens
ETFHALQPS

SEQ ID NO: 369596 - protein, 9 aa, Homo Sapiens
PPDVYSYFA

SEQ ID NO: 369597 - protein, 9 aa, Homo Sapiens
VLLSQCRLF

SEQ ID NO: 369598 - protein, 9 aa, Homo Sapiens
LRPWKTSCT

SEQ ID NO: 369599 - protein, 9 aa, Homo Sapiens
QIYTVKDIK

SEQ ID NO: 369600 - protein, 9 aa, Homo Sapiens
AVADNRIIT

SEQ ID NO: 369601 - protein, 9 aa, Homo Sapiens
TVTFEKHGE

SEQ ID NO: 369602 - protein, 9 aa, Homo Sapiens
RDCSDVDPG

SEQ ID NO: 369603 - protein, 9 aa, Homo Sapiens
MITKDKNWH

SEQ ID NO: 369604 - protein, 9 aa, Homo Sapiens
LALCGIVST

SEQ ID NO: 369605 - protein, 9 aa, Homo Sapiens
VFMTTFRRA

SEQ ID NO: 369606 - protein, 9 aa, Homo Sapiens
GTRPLFVES

SEQ ID NO: 369607 - protein, 9 aa, Homo Sapiens
ANIVFQYKE

SEQ ID NO: 369608 - protein, 9 aa, Homo Sapiens
RLSSDPSRS

SEQ ID NO: 369609 - protein, 9 aa, Homo Sapiens
DGQIADFLR

SEQ ID NO: 369610 - protein, 9 aa, Homo Sapiens
HFSIDRNMG

SEQ ID NO: 369611 - protein, 9 aa, Homo Sapiens
APIICILGH

SEQ ID NO: 369612 - protein, 9 aa, Homo Sapiens
AVLAWARAH

SEQ ID NO: 369613 - protein, 9 aa, Homo Sapiens
ILELLDVDT

SEQ ID NO: 369614 - protein, 9 aa, Homo Sapiens
TRKHKHFYW

SEQ ID NO: 369615 - protein, 9 aa, Homo Sapiens
SWRSPTSKP

SEQ ID NO: 369616 - protein, 9 aa, Homo Sapiens
LAFPDDMDL

SEQ ID NO: 369617 - protein, 9 aa, Homo Sapiens
PSTPASPGN

SEQ ID NO: 369618 - protein, 9 aa, Homo Sapiens
LAGMRNHEN

SEQ ID NO: 369619 - protein, 9 aa, Homo Sapiens
FGSLMVEKL

SEQ ID NO: 369620 - protein, 9 aa, Homo Sapiens
SDSPWRALG

SEQ ID NO: 369621 - protein, 9 aa, Homo Sapiens
MSLLIPSKM

SEQ ID NO: 369622 - protein, 9 aa, Homo Sapiens
WRSPTSKPS

SEQ ID NO: 369623 - protein, 9 aa, Homo Sapiens
YFASSVLGA

SEQ ID NO: 369624 - protein, 9 aa, Homo Sapiens
EGSWAGADG

SEQ ID NO: 369625 - protein, 9 aa, Homo Sapiens
QEVLGHGAL

SEQ ID NO: 369626 - protein, 9 aa, Homo Sapiens
GSRGASGPD

SEQ ID NO: 369627 - protein, 9 aa, Homo Sapiens
AAPRLASAV

SEQ ID NO: 369628 - protein, 9 aa, Homo Sapiens
GLRPCRCCR

SEQ ID NO: 369629 - protein, 9 aa, Homo Sapiens
NGVLVSQQV

SEQ ID NO: 369630 - protein, 9 aa, Homo Sapiens
QLLPKIVLK

SEQ ID NO: 369631 - protein, 9 aa, Homo Sapiens
FDETYIGNV

SEQ ID NO: 369632 - protein, 9 aa, Homo Sapiens
MLQSLPKQG

SEQ ID NO: 369633 - protein, 9 aa, Homo Sapiens
GAPLPWMVP

SEQ ID NO: 369634 - protein, 9 aa, Homo Sapiens
GFPFAAETD

SEQ ID NO: 369635 - protein, 9 aa, Homo Sapiens
KILYLHHCQ

SEQ ID NO: 369636 - protein, 9 aa, Homo Sapiens
RWCRLSSDP

SEQ ID NO: 369637 - protein, 9 aa, Homo Sapiens
LWNTSLLQT

SEQ ID NO: 369638 - protein, 9 aa, Homo Sapiens
AHPSRPCRM

SEQ ID NO: 369639 - protein, 9 aa, Homo Sapiens
TLRACANSW

SEQ ID NO: 369640 - protein, 9 aa, Homo Sapiens
RLASYLVRM

SEQ ID NO: 369641 - protein, 9 aa, Homo Sapiens
RMLRATTLC

SEQ ID NO: 369642 - protein, 9 aa, Homo Sapiens
VNTSLFLAS

SEQ ID NO: 369643 - protein, 9 aa, Homo Sapiens
PREQTWLDP

SEQ ID NO: 369644 - protein, 9 aa, Homo Sapiens
FKINSVINH

SEQ ID NO: 369645 - protein, 9 aa, Homo Sapiens
CCCQYEMGE

SEQ ID NO: 369646 - protein, 9 aa, Homo Sapiens
SGLFFIAFS

SEQ ID NO: 369647 - protein, 9 aa, Homo Sapiens
GYDFPAVLC

SEQ ID NO: 369648 - protein, 9 aa, Homo Sapiens
IIVSATSGV

SEQ ID NO: 369649 - protein, 9 aa, Homo Sapiens
IGYKQVFWE

SEQ ID NO: 369650 - protein, 9 aa, Homo Sapiens
NIFESFMPQ

SEQ ID NO: 369651 - protein, 9 aa, Homo Sapiens
SPTVTFEKH

SEQ ID NO: 369652 - protein, 9 aa, Homo Sapiens
NSINQVFLR

SEQ ID NO: 369653 - protein, 9 aa, Homo Sapiens
KLDVAILEN

SEQ ID NO: 369654 - protein, 9 aa, Homo Sapiens
RGTSRARRT

SEQ ID NO: 369655 - protein, 9 aa, Homo Sapiens
TVAQTPSPV

SEQ ID NO: 369656 - protein, 9 aa, Homo Sapiens
PGSGPPTHR

SEQ ID NO: 369657 - protein, 9 aa, Homo Sapiens
VAYEILPCG

SEQ ID NO: 369658 - protein, 9 aa, Homo Sapiens
LNEHKKFIL

SEQ ID NO: 369659 - protein, 9 aa, Homo Sapiens
GRMGRPEER

SEQ ID NO: 369660 - protein, 9 aa, Homo Sapiens
LLTTEKGEA

SEQ ID NO: 369661 - protein, 9 aa, Homo Sapiens
VETRPAADR

SEQ ID NO: 369662 - protein, 9 aa, Homo Sapiens
RTLEGCISV

SEQ ID NO: 369663 - protein, 9 aa, Homo Sapiens
APVPARLAL

SEQ ID NO: 369664 - protein, 9 aa, Homo Sapiens
RFCGPLVKG

SEQ ID NO: 369665 - protein, 9 aa, Homo Sapiens
PEKGPLSLW

SEQ ID NO: 369666 - protein, 9 aa, Homo Sapiens
FLCGPRHSH

SEQ ID NO: 369667 - protein, 9 aa, Homo Sapiens
GWHCDQEED

SEQ ID NO: 369668 - protein, 9 aa, Homo Sapiens
KSKTLLEFL

SEQ ID NO: 369669 - protein, 9 aa, Homo Sapiens
SNTIAPSTE

SEQ ID NO: 369670 - protein, 9 aa, Homo Sapiens
PEEGAHVYS

SEQ ID NO: 369671 - protein, 9 aa, Homo Sapiens
SYFYRLYAV

SEQ ID NO: 369672 - protein, 9 aa, Homo Sapiens
AETDMYPEF

SEQ ID NO: 369673 - protein, 9 aa, Homo Sapiens
TRSSPPATS

SEQ ID NO: 369674 - protein, 9 aa, Homo Sapiens
EFCINMRQL

SEQ ID NO: 369675 - protein, 9 aa, Homo Sapiens
ALDHEEEKN

SEQ ID NO: 369676 - protein, 9 aa, Homo Sapiens
QQPVAQWHQ

SEQ ID NO: 369677 - protein, 9 aa, Homo Sapiens
SLMVEKLKT

SEQ ID NO: 369678 - protein, 9 aa, Homo Sapiens
WDNQKGRPL

SEQ ID NO: 369679 - protein, 9 aa, Homo Sapiens
LRTTPLKTA

SEQ ID NO: 369680 - protein, 9 aa, Homo Sapiens
HMRETSVFT

SEQ ID NO: 369681 - protein, 9 aa, Homo Sapiens
GPRSKRRCP

SEQ ID NO: 369682 - protein, 9 aa, Homo Sapiens
KAPHTTEAY

SEQ ID NO: 369683 - protein, 9 aa, Homo Sapiens
SRASWDSSE

SEQ ID NO: 369684 - protein, 9 aa, Homo Sapiens
PAPAAPGWP

SEQ ID NO: 369685 - protein, 9 aa, Homo Sapiens
GSATPDQHT

SEQ ID NO: 369686 - protein, 9 aa, Homo Sapiens
SPTVGLCLE

SEQ ID NO: 369687 - protein, 9 aa, Homo Sapiens
KKVIWIYRS

SEQ ID NO: 369688 - protein, 9 aa, Homo Sapiens
SALATVCWP

SEQ ID NO: 369689 - protein, 9 aa, Homo Sapiens
QLFMHLRQD

SEQ ID NO: 369690 - protein, 9 aa, Homo Sapiens
DQVLDADCV

SEQ ID NO: 369691 - protein, 9 aa, Homo Sapiens
PRSLQRSSC

SEQ ID NO: 369692 - protein, 9 aa, Homo Sapiens
LGSCPQFFK

SEQ ID NO: 369693 - protein, 9 aa, Homo Sapiens
GSGPPTHRF

SEQ ID NO: 369694 - protein, 9 aa, Homo Sapiens
ATTAAAAAE

SEQ ID NO: 369695 - protein, 9 aa, Homo Sapiens
VIEFDQNIF

SEQ ID NO: 369696 - protein, 9 aa, Homo Sapiens
QFAEWKLSV

SEQ ID NO: 369697 - protein, 9 aa, Homo Sapiens
RDLEKIIAE

SEQ ID NO: 369698 - protein, 9 aa, Homo Sapiens
DLPQIRAQV

SEQ ID NO: 369699 - protein, 9 aa, Homo Sapiens
HVDHGKSTP

SEQ ID NO: 369700 - protein, 9 aa, Homo Sapiens
RGASSSTSR

SEQ ID NO: 369701 - protein, 9 aa, Homo Sapiens
ANLTFLDIW

SEQ ID NO: 369702 - protein, 9 aa, Homo Sapiens
GTGTASGGT

SEQ ID NO: 369703 - protein, 9 aa, Homo Sapiens
VPQVLENNE

SEQ ID NO: 369704 - protein, 9 aa, Homo Sapiens
THKSPIECQ

SEQ ID NO: 369705 - protein, 9 aa, Homo Sapiens
NKYGKAFAK

SEQ ID NO: 369706 - protein, 9 aa, Homo Sapiens
ARARAGARA

SEQ ID NO: 369707 - protein, 9 aa, Homo Sapiens
MTHSKLKEV

SEQ ID NO: 369708 - protein, 9 aa, Homo Sapiens
DGKEHHFMV

SEQ ID NO: 369709 - protein, 9 aa, Homo Sapiens
ITPRLSPLI

SEQ ID NO: 369710 - protein, 9 aa, Homo Sapiens
VVHQVQTSE

SEQ ID NO: 369711 - protein, 9 aa, Homo Sapiens
SEDLGHTAR

SEQ ID NO: 369712 - protein, 9 aa, Homo Sapiens
VLKLKSPMR

SEQ ID NO: 369713 - protein, 9 aa, Homo Sapiens
SGWAGPAAT

SEQ ID NO: 369714 - protein, 9 aa, Homo Sapiens
HMMIRFFWM

SEQ ID NO: 369715 - protein, 9 aa, Homo Sapiens
CDNELLYCQ

SEQ ID NO: 369716 - protein, 9 aa, Homo Sapiens
SSGPWGMKF

SEQ ID NO: 369717 - protein, 9 aa, Homo Sapiens
ILVEVSSLK

SEQ ID NO: 369718 - protein, 9 aa, Homo Sapiens
VLGQPGVRA

SEQ ID NO: 369719 - protein, 9 aa, Homo Sapiens
EGQVDVENG

SEQ ID NO: 369720 - protein, 9 aa, Homo Sapiens
QVKVIRVEG

SEQ ID NO: 369721 - protein, 9 aa, Homo Sapiens
LKTKVYFMY

SEQ ID NO: 369722 - protein, 9 aa, Homo Sapiens
RAQDHLRLH

SEQ ID NO: 369723 - protein, 9 aa, Homo Sapiens
SCLWEERLL

SEQ ID NO: 369724 - protein, 9 aa, Homo Sapiens
VRHQKIHSG

SEQ ID NO: 369725 - protein, 9 aa, Homo Sapiens
LVPALEGQE

SEQ ID NO: 369726 - protein, 9 aa, Homo Sapiens
AGSTVGPSG

SEQ ID NO: 369727 - protein, 9 aa, Homo Sapiens
NKMAEGEEL

SEQ ID NO: 369728 - protein, 9 aa, Homo Sapiens
GAGPRAGAP

SEQ ID NO: 369729 - protein, 9 aa, Homo Sapiens
SYTDIECSI

SEQ ID NO: 369730 - protein, 9 aa, Homo Sapiens
DIIENVKAK

SEQ ID NO: 369731 - protein, 9 aa, Homo Sapiens
KCVWSAGYE

SEQ ID NO: 369732 - protein, 9 aa, Homo Sapiens
PLPWMVPWG

SEQ ID NO: 369733 - protein, 9 aa, Homo Sapiens
PREQLRALV

SEQ ID NO: 369734 - protein, 9 aa, Homo Sapiens
KQLQERIWS

SEQ ID NO: 369735 - protein, 9 aa, Homo Sapiens
AACGPPSVC

SEQ ID NO: 369736 - protein, 9 aa, Homo Sapiens
KWQIIQRRK

SEQ ID NO: 369737 - protein, 9 aa, Homo Sapiens
KKKKTRFLP

SEQ ID NO: 369738 - protein, 9 aa, Homo Sapiens
AEGSFLLHK

SEQ ID NO: 369739 - protein, 9 aa, Homo Sapiens
NLHTPQHPR

SEQ ID NO: 369740 - protein, 9 aa, Homo Sapiens
SRRLSLWAV

SEQ ID NO: 369741 - protein, 9 aa, Homo Sapiens
KKFGSSWHM

SEQ ID NO: 369742 - protein, 9 aa, Homo Sapiens
QRRGTGRGR

SEQ ID NO: 369743 - protein, 9 aa, Homo Sapiens
KKRGASSST

SEQ ID NO: 369744 - protein, 9 aa, Homo Sapiens
GHMWTYREE

SEQ ID NO: 369745 - protein, 9 aa, Homo Sapiens
VTCFRAALS

SEQ ID NO: 369746 - protein, 9 aa, Homo Sapiens
KIRILSLET

SEQ ID NO: 369747 - protein, 9 aa, Homo Sapiens
QEEKKIKYS

SEQ ID NO: 369748 - protein, 9 aa, Homo Sapiens
SSPKFGEKD

SEQ ID NO: 369749 - protein, 9 aa, Homo Sapiens
GRVGGPGAG

SEQ ID NO: 369750 - protein, 9 aa, Homo Sapiens
ASWPVRASS

SEQ ID NO: 369751 - protein, 9 aa, Homo Sapiens
LADIIKYLK

SEQ ID NO: 369752 - protein, 9 aa, Homo Sapiens
IMTGDEAST

SEQ ID NO: 369753 - protein, 9 aa, Homo Sapiens
HPNGATSST

SEQ ID NO: 369754 - protein, 9 aa, Homo Sapiens
YGFTIMRDF

SEQ ID NO: 369755 - protein, 9 aa, Homo Sapiens
NLTKWQKHH

SEQ ID NO: 369756 - protein, 9 aa, Homo Sapiens
VVVVWDRPF

SEQ ID NO: 369757 - protein, 9 aa, Homo Sapiens
LREKQSSHS

SEQ ID NO: 369758 - protein, 9 aa, Homo Sapiens
NSFLCSPRF

SEQ ID NO: 369759 - protein, 9 aa, Homo Sapiens
SQNSAGLRR

SEQ ID NO: 369760 - protein, 9 aa, Homo Sapiens
GGREIFKPR

SEQ ID NO: 369761 - protein, 9 aa, Homo Sapiens
YLWQENHLM

SEQ ID NO: 369762 - protein, 9 aa, Homo Sapiens
LMFGSLMVE

SEQ ID NO: 369763 - protein, 9 aa, Homo Sapiens
EEDSFLENE

SEQ ID NO: 369764 - protein, 9 aa, Homo Sapiens
NTIAPSTEW

SEQ ID NO: 369765 - protein, 9 aa, Homo Sapiens
AWVRIYRPG

SEQ ID NO: 369766 - protein, 9 aa, Homo Sapiens
RTHNPINIE

SEQ ID NO: 369767 - protein, 9 aa, Homo Sapiens
EEGPRSKRR

SEQ ID NO: 369768 - protein, 9 aa, Homo Sapiens
SFWSISSGP

SEQ ID NO: 369769 - protein, 9 aa, Homo Sapiens
IFDIIISLI

SEQ ID NO: 369770 - protein, 9 aa, Homo Sapiens
SSGYLCICN

SEQ ID NO: 369771 - protein, 9 aa, Homo Sapiens
VERDVVQQT

SEQ ID NO: 369772 - protein, 9 aa, Homo Sapiens
QNHSKCITE

SEQ ID NO: 369773 - protein, 9 aa, Homo Sapiens
TGFGKKLAH

SEQ ID NO: 369774 - protein, 9 aa, Homo Sapiens
SRDIQEQNQ

SEQ ID NO: 369775 - protein, 9 aa, Homo Sapiens
GGVGEHGQQ

SEQ ID NO: 369776 - protein, 9 aa, Homo Sapiens
KDPANDRQF

SEQ ID NO: 369777 - protein, 9 aa, Homo Sapiens
SGRRVWYTC

SEQ ID NO: 369778 - protein, 9 aa, Homo Sapiens
CFRAALSDT

SEQ ID NO: 369779 - protein, 9 aa, Homo Sapiens
QVCMKWCAT

SEQ ID NO: 369780 - protein, 9 aa, Homo Sapiens
QNIGCSVSK

SEQ ID NO: 369781 - protein, 9 aa, Homo Sapiens
AWGCPAGCT

SEQ ID NO: 369782 - protein, 9 aa, Homo Sapiens
HGQQVGLPA

SEQ ID NO: 369783 - protein, 9 aa, Homo Sapiens
CREVLQNQL

SEQ ID NO: 369784 - protein, 9 aa, Homo Sapiens
FLQPDDKNL

SEQ ID NO: 369785 - protein, 9 aa, Homo Sapiens
THLTVVTFT

SEQ ID NO: 369786 - protein, 9 aa, Homo Sapiens
NAENKHILE

SEQ ID NO: 369787 - protein, 9 aa, Homo Sapiens
PVCCGNEVT

SEQ ID NO: 369788 - protein, 9 aa, Homo Sapiens
IGNWILKQF

SEQ ID NO: 369789 - protein, 9 aa, Homo Sapiens
RRAGCLCLR

SEQ ID NO: 369790 - protein, 9 aa, Homo Sapiens
NALVILTVL

SEQ ID NO: 369791 - protein, 9 aa, Homo Sapiens
RTPFNARTL

SEQ ID NO: 369792 - protein, 9 aa, Homo Sapiens
IIENVKAKI

SEQ ID NO: 369793 - protein, 9 aa, Homo Sapiens
HGALVDEVG

SEQ ID NO: 369794 - protein, 9 aa, Homo Sapiens
RASELRGPG

SEQ ID NO: 369795 - protein, 9 aa, Homo Sapiens
GPGISAHQL

SEQ ID NO: 369796 - protein, 9 aa, Homo Sapiens
PRGLCCWKR

SEQ ID NO: 369797 - protein, 9 aa, Homo Sapiens
LDEAQQKIF

SEQ ID NO: 369798 - protein, 9 aa, Homo Sapiens
PRQPGPQGS

SEQ ID NO: 369799 - protein, 9 aa, Homo Sapiens
VSGGSDCQV

SEQ ID NO: 369800 - protein, 9 aa, Homo Sapiens
MRGLLVTGA

SEQ ID NO: 369801 - protein, 9 aa, Homo Sapiens
TLEVEPSDI

SEQ ID NO: 369802 - protein, 9 aa, Homo Sapiens
AAGWAARWQ

SEQ ID NO: 369803 - protein, 9 aa, Homo Sapiens
KFIGNWILK

SEQ ID NO: 369804 - protein, 9 aa, Homo Sapiens
EAAEAEAGQ

SEQ ID NO: 369805 - protein, 9 aa, Homo Sapiens
KCSLYGKKL

SEQ ID NO: 369806 - protein, 9 aa, Homo Sapiens
AARACAATR

SEQ ID NO: 369807 - protein, 9 aa, Homo Sapiens
LYFADKLYK

SEQ ID NO: 369808 - protein, 9 aa, Homo Sapiens
RIMQRFSRK

SEQ ID NO: 369809 - protein, 9 aa, Homo Sapiens
KLSTVCRAV

SEQ ID NO: 369810 - protein, 9 aa, Homo Sapiens
GYELPYNLA

SEQ ID NO: 369811 - protein, 9 aa, Homo Sapiens
RKNQAPQCP

SEQ ID NO: 369812 - protein, 9 aa, Homo Sapiens
PEIIECRVF

SEQ ID NO: 369813 - protein, 9 aa, Homo Sapiens
SPRSLAGVS

SEQ ID NO: 369814 - protein, 9 aa, Homo Sapiens
DSYTPEALA

SEQ ID NO: 369815 - protein, 9 aa, Homo Sapiens
GDGEYKFGA

SEQ ID NO: 369816 - protein, 9 aa, Homo Sapiens
LNLKDQKIL

SEQ ID NO: 369817 - protein, 9 aa, Homo Sapiens
EALWPGPGG

SEQ ID NO: 369818 - protein, 9 aa, Homo Sapiens
GNAKLQQHQ

SEQ ID NO: 369819 - protein, 9 aa, Homo Sapiens
KPYWMVGSP

SEQ ID NO: 369820 - protein, 9 aa, Homo Sapiens
IWLYTFVRD

SEQ ID NO: 369821 - protein, 9 aa, Homo Sapiens
SRALFTSLA

SEQ ID NO: 369822 - protein, 9 aa, Homo Sapiens
NDRPDFLKT

SEQ ID NO: 369823 - protein, 9 aa, Homo Sapiens
TPLLEDPRE

SEQ ID NO: 369824 - protein, 9 aa, Homo Sapiens
LPQLGAHPA

SEQ ID NO: 369825 - protein, 9 aa, Homo Sapiens
WRVEFQPME

SEQ ID NO: 369826 - protein, 9 aa, Homo Sapiens
KLIQKMYPE

SEQ ID NO: 369827 - protein, 9 aa, Homo Sapiens
EQARQEREH

SEQ ID NO: 369828 - protein, 9 aa, Homo Sapiens
RMNSTGMKS

SEQ ID NO: 369829 - protein, 9 aa, Homo Sapiens
ILSTKASNT

SEQ ID NO: 369830 - protein, 9 aa, Homo Sapiens
TFLDIWYSS

SEQ ID NO: 369831 - protein, 9 aa, Homo Sapiens
NQINVKTSE

SEQ ID NO: 369832 - protein, 9 aa, Homo Sapiens
ARLHWLPCA

SEQ ID NO: 369833 - protein, 9 aa, Homo Sapiens
FGNVGSALR

SEQ ID NO: 369834 - protein, 9 aa, Homo Sapiens
ISTLVLDVS

SEQ ID NO: 369835 - protein, 9 aa, Homo Sapiens
ETGELELED

SEQ ID NO: 369836 - protein, 9 aa, Homo Sapiens
VRKLIQKMY

SEQ ID NO: 369837 - protein, 9 aa, Homo Sapiens
ASRVKAQAE

SEQ ID NO: 369838 - protein, 9 aa, Homo Sapiens
RYCTYLDWL

SEQ ID NO: 369839 - protein, 9 aa, Homo Sapiens
PARIPIPSL

SEQ ID NO: 369840 - protein, 9 aa, Homo Sapiens
QMEICDIQQ

SEQ ID NO: 369841 - protein, 9 aa, Homo Sapiens
LSEAAAEDD

SEQ ID NO: 369842 - protein, 9 aa, Homo Sapiens
CMVKIMQAT

SEQ ID NO: 369843 - protein, 9 aa, Homo Sapiens
RRVNGTFGE

SEQ ID NO: 369844 - protein, 9 aa, Homo Sapiens
WSTFHQPEL

SEQ ID NO: 369845 - protein, 9 aa, Homo Sapiens
REWVHMVRP

SEQ ID NO: 369846 - protein, 9 aa, Homo Sapiens
THSSIVDCV

SEQ ID NO: 369847 - protein, 9 aa, Homo Sapiens
RPGGLGGSR

SEQ ID NO: 369848 - protein, 9 aa, Homo Sapiens
QYSADADAA

SEQ ID NO: 369849 - protein, 9 aa, Homo Sapiens
DSFLENEKS

SEQ ID NO: 369850 - protein, 9 aa, Homo Sapiens
STNRYSQPC

SEQ ID NO: 369851 - protein, 9 aa, Homo Sapiens
PIDGQIADF

SEQ ID NO: 369852 - protein, 9 aa, Homo Sapiens
MPRTLEGCI

SEQ ID NO: 369853 - protein, 9 aa, Homo Sapiens
EDEQAAKQE

SEQ ID NO: 369854 - protein, 9 aa, Homo Sapiens
DEEGPRSKR

SEQ ID NO: 369855 - protein, 9 aa, Homo Sapiens
WRPDCTSLA

SEQ ID NO: 369856 - protein, 9 aa, Homo Sapiens
YSQPCPSSK

SEQ ID NO: 369857 - protein, 9 aa, Homo Sapiens
VARHSVVLH

SEQ ID NO: 369858 - protein, 9 aa, Homo Sapiens
NAPKYGQGQ

SEQ ID NO: 369859 - protein, 9 aa, Homo Sapiens
SQLDDNSNK

SEQ ID NO: 369860 - protein, 9 aa, Homo Sapiens
LGKWLQWPH

SEQ ID NO: 369861 - protein, 9 aa, Homo Sapiens
RAVLNSTNA

SEQ ID NO: 369862 - protein, 9 aa, Homo Sapiens
SGRPGMEHI

SEQ ID NO: 369863 - protein, 9 aa, Homo Sapiens
CLRLLPGRL

SEQ ID NO: 369864 - protein, 9 aa, Homo Sapiens
ILSLETYPV

SEQ ID NO: 369865 - protein, 9 aa, Homo Sapiens
LASRWHSDD

SEQ ID NO: 369866 - protein, 9 aa, Homo Sapiens
PVESGDIIH

SEQ ID NO: 369867 - protein, 9 aa, Homo Sapiens
AEGASLWEE

SEQ ID NO: 369868 - protein, 9 aa, Homo Sapiens
DEEGQQKIR

SEQ ID NO: 369869 - protein, 9 aa, Homo Sapiens
LEPEAEGSF

SEQ ID NO: 369870 - protein, 9 aa, Homo Sapiens
NLSPTRWTT

SEQ ID NO: 369871 - protein, 9 aa, Homo Sapiens
EIKTTSFWS

SEQ ID NO: 369872 - protein, 9 aa, Homo Sapiens
RRRNPRAKQ

SEQ ID NO: 369873 - protein, 9 aa, Homo Sapiens
WSTSFCLAP

SEQ ID NO: 369874 - protein, 9 aa, Homo Sapiens
GVGAQAPPG

SEQ ID NO: 369875 - protein, 9 aa, Homo Sapiens
EQGEFDEEE

SEQ ID NO: 369876 - protein, 9 aa, Homo Sapiens
WLEKTEFTL

SEQ ID NO: 369877 - protein, 9 aa, Homo Sapiens
WTDHRIRQA

SEQ ID NO: 369878 - protein, 9 aa, Homo Sapiens
RDGCMLIKL

SEQ ID NO: 369879 - protein, 9 aa, Homo Sapiens
LSNFNPGTL

SEQ ID NO: 369880 - protein, 9 aa, Homo Sapiens
APIKLLPGQ

SEQ ID NO: 369881 - protein, 9 aa, Homo Sapiens
PAHIPYQVL

SEQ ID NO: 369882 - protein, 9 aa, Homo Sapiens
APPCRPRVT

SEQ ID NO: 369883 - protein, 9 aa, Homo Sapiens
NSATFSANK

SEQ ID NO: 369884 - protein, 9 aa, Homo Sapiens
PKTWNAGLR

SEQ ID NO: 369885 - protein, 9 aa, Homo Sapiens
LGHVSGPWR

SEQ ID NO: 369886 - protein, 9 aa, Homo Sapiens
EEDRVTEEA

SEQ ID NO: 369887 - protein, 9 aa, Homo Sapiens
LSTSSFCCC

SEQ ID NO: 369888 - protein, 9 aa, Homo Sapiens
GWVEEKQPL

SEQ ID NO: 369889 - protein, 9 aa, Homo Sapiens
RADPLTAST

SEQ ID NO: 369890 - protein, 9 aa, Homo Sapiens
SFLLTSTSD

SEQ ID NO: 369891 - protein, 9 aa, Homo Sapiens
SRAAGTTFT

SEQ ID NO: 369892 - protein, 9 aa, Homo Sapiens
RILSLETYP

SEQ ID NO: 369893 - protein, 9 aa, Homo Sapiens
VMSSEGNTD

SEQ ID NO: 369894 - protein, 9 aa, Homo Sapiens
LAWARAHLA

SEQ ID NO: 369895 - protein, 9 aa, Homo Sapiens
HLSKQVWDY

SEQ ID NO: 369896 - protein, 9 aa, Homo Sapiens
AAAAPRVLF

SEQ ID NO: 369897 - protein, 9 aa, Homo Sapiens
ICTASSTRV

SEQ ID NO: 369898 - protein, 9 aa, Homo Sapiens
AQAVTNNCQ

SEQ ID NO: 369899 - protein, 9 aa, Homo Sapiens
LGLPGGLKL

SEQ ID NO: 369900 - protein, 9 aa, Homo Sapiens
EPQDTPGGR

SEQ ID NO: 369901 - protein, 9 aa, Homo Sapiens
VEASQAEAV

SEQ ID NO: 369902 - protein, 9 aa, Homo Sapiens
DAIVNASNA

SEQ ID NO: 369903 - protein, 9 aa, Homo Sapiens
PGQRSHFQH

SEQ ID NO: 369904 - protein, 9 aa, Homo Sapiens
VSAQMEICD

SEQ ID NO: 369905 - protein, 9 aa, Homo Sapiens
VVELGHDGA

SEQ ID NO: 369906 - protein, 9 aa, Homo Sapiens
FKQLSCSTK

SEQ ID NO: 369907 - protein, 9 aa, Homo Sapiens
DHRTSQNHS

SEQ ID NO: 369908 - protein, 9 aa, Homo Sapiens
NLLAWADST

SEQ ID NO: 369909 - protein, 9 aa, Homo Sapiens
KQATPKQAA

SEQ ID NO: 369910 - protein, 9 aa, Homo Sapiens
RESYDNRLL

SEQ ID NO: 369911 - protein, 9 aa, Homo Sapiens
FCDSERLVS

SEQ ID NO: 369912 - protein, 9 aa, Homo Sapiens
KLPTKRPCL

SEQ ID NO: 369913 - protein, 9 aa, Homo Sapiens
TIMRDFFPT

SEQ ID NO: 369914 - protein, 9 aa, Homo Sapiens
MGMQHHLQA

SEQ ID NO: 369915 - protein, 9 aa, Homo Sapiens
TSRDSRSFF

SEQ ID NO: 369916 - protein, 9 aa, Homo Sapiens
VARDALWAR

SEQ ID NO: 369917 - protein, 9 aa, Homo Sapiens
CRSETLRKC

SEQ ID NO: 369918 - protein, 9 aa, Homo Sapiens
LDVTSTMPQ

SEQ ID NO: 369919 - protein, 9 aa, Homo Sapiens
GALHVPDVS

SEQ ID NO: 369920 - protein, 9 aa, Homo Sapiens
GNHSHKPPC

SEQ ID NO: 369921 - protein, 9 aa, Homo Sapiens
GLLCMQLGP

SEQ ID NO: 369922 - protein, 9 aa, Homo Sapiens
QQTIHSEDK

SEQ ID NO: 369923 - protein, 9 aa, Homo Sapiens
CLHSLLDPS

SEQ ID NO: 369924 - protein, 9 aa, Homo Sapiens
RKVMFGNYR

SEQ ID NO: 369925 - protein, 9 aa, Homo Sapiens
WHSDDDDDP

SEQ ID NO: 369926 - protein, 9 aa, Homo Sapiens
KHDLNSPGS

SEQ ID NO: 369927 - protein, 9 aa, Homo Sapiens
NGTFGEIMV

SEQ ID NO: 369928 - protein, 9 aa, Homo Sapiens
QNEHLLIKG

SEQ ID NO: 369929 - protein, 9 aa, Homo Sapiens
TSAHPSRPC

SEQ ID NO: 369930 - protein, 9 aa, Homo Sapiens
LTKKKASSP

SEQ ID NO: 369931 - protein, 9 aa, Homo Sapiens
DISGGREIF

SEQ ID NO: 369932 - protein, 9 aa, Homo Sapiens
FDLTQVVAV

SEQ ID NO: 369933 - protein, 9 aa, Homo Sapiens
DVVHVVEAL

SEQ ID NO: 369934 - protein, 9 aa, Homo Sapiens
DNVEALDHE

SEQ ID NO: 369935 - protein, 9 aa, Homo Sapiens
TFFVRRVNG

SEQ ID NO: 369936 - protein, 9 aa, Homo Sapiens
GWSVAIWKE

SEQ ID NO: 369937 - protein, 9 aa, Homo Sapiens
VGLSCVTCF

SEQ ID NO: 369938 - protein, 9 aa, Homo Sapiens
VTFTMHLLS

SEQ ID NO: 369939 - protein, 9 aa, Homo Sapiens
GSMDVFQIT

SEQ ID NO: 369940 - protein, 9 aa, Homo Sapiens
STRGASKAS

SEQ ID NO: 369941 - protein, 9 aa, Homo Sapiens
SIAAYSKNG

SEQ ID NO: 369942 - protein, 9 aa, Homo Sapiens
DGMWTTVLV

SEQ ID NO: 369943 - protein, 9 aa, Homo Sapiens
EDDLMPVCC

SEQ ID NO: 369944 - protein, 9 aa, Homo Sapiens
VTAVGSAQP

SEQ ID NO: 369945 - protein, 9 aa, Homo Sapiens
LWNHAVGPS

SEQ ID NO: 369946 - protein, 9 aa, Homo Sapiens
CTYLDWLEQ

SEQ ID NO: 369947 - protein, 9 aa, Homo Sapiens
KGVSAFGQA

SEQ ID NO: 369948 - protein, 9 aa, Homo Sapiens
PLFVESTTE

SEQ ID NO: 369949 - protein, 9 aa, Homo Sapiens
NVEALDHEE

SEQ ID NO: 369950 - protein, 9 aa, Homo Sapiens
DWDIDVESL

SEQ ID NO: 369951 - protein, 9 aa, Homo Sapiens
KLKSQISEI

SEQ ID NO: 369952 - protein, 9 aa, Homo Sapiens
ATLKEKKTR

SEQ ID NO: 369953 - protein, 9 aa, Homo Sapiens
PRPGPRGGH

SEQ ID NO: 369954 - protein, 9 aa, Homo Sapiens
AVLCLRLWL

SEQ ID NO: 369955 - protein, 9 aa, Homo Sapiens
RAGCLCLRW

SEQ ID NO: 369956 - protein, 9 aa, Homo Sapiens
YILKNLQQE

SEQ ID NO: 369957 - protein, 9 aa, Homo Sapiens
SSLEASGMP

SEQ ID NO: 369958 - protein, 9 aa, Homo Sapiens
LDTESEKMV

SEQ ID NO: 369959 - protein, 9 aa, Homo Sapiens
LASGTSRAR

SEQ ID NO: 369960 - protein, 9 aa, Homo Sapiens
AHNEIRMVA

SEQ ID NO: 369961 - protein, 9 aa, Homo Sapiens
AKMGMQHHL

SEQ ID NO: 369962 - protein, 9 aa, Homo Sapiens
KAIEIDNEC

SEQ ID NO: 369963 - protein, 9 aa, Homo Sapiens
MFGSLMVEK

SEQ ID NO: 369964 - protein, 9 aa, Homo Sapiens
WGTRGGAPP

SEQ ID NO: 369965 - protein, 9 aa, Homo Sapiens
GGSSSGNGG

SEQ ID NO: 369966 - protein, 9 aa, Homo Sapiens
QPIIGTTHS

SEQ ID NO: 369967 - protein, 9 aa, Homo Sapiens
GASLWEEGF

SEQ ID NO: 369968 - protein, 9 aa, Homo Sapiens
SPNWRISNA

SEQ ID NO: 369969 - protein, 9 aa, Homo Sapiens
EGALQVEAS

SEQ ID NO: 369970 - protein, 9 aa, Homo Sapiens
IMRDFFPTV

SEQ ID NO: 369971 - protein, 9 aa, Homo Sapiens
KQDLLFSTF

SEQ ID NO: 369972 - protein, 9 aa, Homo Sapiens
EAIESWLEK

SEQ ID NO: 369973 - protein, 9 aa, Homo Sapiens
PALVCAPNK

SEQ ID NO: 369974 - protein, 9 aa, Homo Sapiens
RDIKVQGFR

SEQ ID NO: 369975 - protein, 9 aa, Homo Sapiens
ARCFKVFHS

SEQ ID NO: 369976 - protein, 9 aa, Homo Sapiens
PSSASATSA

SEQ ID NO: 369977 - protein, 9 aa, Homo Sapiens
HQTYELNDL

SEQ ID NO: 369978 - protein, 9 aa, Homo Sapiens
GKKLAHLTW

SEQ ID NO: 369979 - protein, 9 aa, Homo Sapiens
VLAFPDDMD

SEQ ID NO: 369980 - protein, 9 aa, Homo Sapiens
ERIVHPAAC

SEQ ID NO: 369981 - protein, 9 aa, Homo Sapiens
NVKTSESWQ

SEQ ID NO: 369982 - protein, 9 aa, Homo Sapiens
QGAPPRAPA

SEQ ID NO: 369983 - protein, 9 aa, Homo Sapiens
LRGQGGDAA

SEQ ID NO: 369984 - protein, 9 aa, Homo Sapiens
VVVVHEVPH

SEQ ID NO: 369985 - protein, 9 aa, Homo Sapiens
SATSGVEQP

SEQ ID NO: 369986 - protein, 9 aa, Homo Sapiens
CESRAAAVA

SEQ ID NO: 369987 - protein, 9 aa, Homo Sapiens
RCYIRRLRA

SEQ ID NO: 369988 - protein, 9 aa, Homo Sapiens
IIPCPPQST

SEQ ID NO: 369989 - protein, 9 aa, Homo Sapiens
AKVLLKTKV

SEQ ID NO: 369990 - protein, 9 aa, Homo Sapiens
EPGLARCFK

SEQ ID NO: 369991 - protein, 9 aa, Homo Sapiens
TCWMTWRAS

SEQ ID NO: 369992 - protein, 9 aa, Homo Sapiens
LATVCWPCS

SEQ ID NO: 369993 - protein, 9 aa, Homo Sapiens
ARVRSRAAL

SEQ ID NO: 369994 - protein, 9 aa, Homo Sapiens
CPWASGRRV

SEQ ID NO: 369995 - protein, 9 aa, Homo Sapiens
ILGHVDTGK

SEQ ID NO: 369996 - protein, 9 aa, Homo Sapiens
GSMLAARLH

SEQ ID NO: 369997 - protein, 9 aa, Homo Sapiens
RAKELNKQL

SEQ ID NO: 369998 - protein, 9 aa, Homo Sapiens
NVGDPSKSD

SEQ ID NO: 369999 - protein, 9 aa, Homo Sapiens
LVASADRPE

SEQ ID NO: 370000 - protein, 9 aa, Homo Sapiens
ITECVRTAL

SEQ ID NO: 370001 - protein, 9 aa, Homo Sapiens
IITRTLVRK

SEQ ID NO: 370002 - protein, 9 aa, Homo Sapiens
LRNIWTDHR

SEQ ID NO: 370003 - protein, 9 aa, Homo Sapiens
DKRSMPEYF

SEQ ID NO: 370004 - protein, 9 aa, Homo Sapiens
IFNGCMTQV

SEQ ID NO: 370005 - protein, 9 aa, Homo Sapiens
QAAQEEKQK

SEQ ID NO: 370006 - protein, 9 aa, Homo Sapiens
PTCRSPSRS

SEQ ID NO: 370007 - protein, 9 aa, Homo Sapiens
EHVGIIYNP

SEQ ID NO: 370008 - protein, 9 aa, Homo Sapiens
SSLDGETPG

SEQ ID NO: 370009 - protein, 9 aa, Homo Sapiens
PKDSEKSTM

SEQ ID NO: 370010 - protein, 9 aa, Homo Sapiens
EYEHATNCA

SEQ ID NO: 370011 - protein, 9 aa, Homo Sapiens
NGYTPALVC

SEQ ID NO: 370012 - protein, 9 aa, Homo Sapiens
LYGKKAIIF

SEQ ID NO: 370013 - protein, 9 aa, Homo Sapiens
QNSIGSYGL

SEQ ID NO: 370014 - protein, 9 aa, Homo Sapiens
KLGAWVCDW
